United States Patent 7,709,616 (MICRORNAS AND USES THEREOF) - sequence listing, part 12

SEQ ID NO: 334466 - RNA, 64 nt, hsa
cagcuccuuccuuccuucccccaggaacacggaggccaccgagggggcugggccuaucaggagg

SEQ ID NO: 334467 - RNA, 64 nt, hsa
ugaaggguuacuuguaggucguggcuucugagcggccaccgaugcugcucucugcgggugacag

SEQ ID NO: 334468 - RNA, 64 nt, hsa
cauuggaguguuagaaacuagaauagaccucuccgccaccgagcugcugugucacgcccucagc

SEQ ID NO: 334469 - RNA, 64 nt, hsa
gacuccaaucccagaauugcucacugagcgcuaugccaccgaagcguugaccugaacauauuag

SEQ ID NO: 334470 - RNA, 64 nt, hsa
cuggaggccgcugagguccugguggaacacacgugccaccgaggagcugucaccggccugaccg

SEQ ID NO: 334471 - RNA, 64 nt, hsa
cagaucuuggggagcugccccacaagccccgcuggccaccgagggcugcagccgcugcgcugcc

SEQ ID NO: 334472 - RNA, 64 nt, hsa
gcagaggccugcagggccucugucaauuguacgcgccaccgagugccuucaacacagcuugucu

SEQ ID NO: 334473 - RNA, 61 nt, hsa
ccuugcuucuccagauuuagcauccugcagagccaccgagaaaauaaaaaagcugggcuug

SEQ ID NO: 334474 - RNA, 64 nt, hsa
cugcuccuaaggguagaaaacuccaggguccccugccaccgacugcccagccacuccaagcccc

SEQ ID NO: 334475 - RNA, 64 nt, hsa
uuguuuuaucacucuggacugugcagagccaccugccaccgagaucugcauuccgacugccuau

SEQ ID NO: 334476 - RNA, 64 nt, hsa
gugguucuggagccauugugggugagggucgagggccaccgaggucccgcgcaccgcugccugc

SEQ ID NO: 334477 - RNA, 64 nt, hsa
ggccaaacugcaggcaaccaccucgggccgcugggccaccgagcugcccuggaugggcugcugg

SEQ ID NO: 334478 - RNA, 64 nt, hsa
cagcucugagccaucggcuuuguggucaucaugugccaccgagcugggacuucuggcaucacuu

SEQ ID NO: 334479 - RNA, 64 nt, hsa
gcaguaucgguuugagaucauccuugggaacccggccaccgaacucaguguugcaacucacuuu

SEQ ID NO: 334480 - RNA, 64 nt, hsa
aggacugcggguugcuggcuuguacaccgcagcugccaccgagacaccagccucugauggcuca

SEQ ID NO: 334481 - RNA, 64 nt, hsa
agaacuuugaugacgagugaugccaggaagccaggccaccgaagcccccacccuacccuuauuc

SEQ ID NO: 334482 - RNA, 64 nt, hsa
cagcuguccccgauaccacgagcugcugcgggaggccaccgaggccgccgaguaccaggaggcc

SEQ ID NO: 334483 - RNA, 64 nt, hsa
cgcuguggggagcgcgcccggaccuggcaguggagccaccgagcgagcagcucgguccagugac

SEQ ID NO: 334484 - RNA, 64 nt, hsa
agaagauugcuuaauucacauaagauuccuagaagccaccgaauccaaucaugguaaaaaugug

SEQ ID NO: 334485 - RNA, 64 nt, hsa
ugauccccgcccagaaguaggcgccugcccaccugccaccgacugcuggaacccagccaguggg

SEQ ID NO: 334486 - RNA, 64 nt, hsa
gcagccugcagagccacagucagccugcccacaugccaccgagcaaacgcaucuugcuuuucac

SEQ ID NO: 334487 - RNA, 64 nt, hsa
agcugagacuagaauucaggguccucacucccaggccaccgaaccaugcagccccuucuuuggg

SEQ ID NO: 334488 - RNA, 64 nt, hsa
ggguaucuugcccuauaagauaaacagucaaaaugccaccgagcuguucacuagugaugugugg

SEQ ID NO: 334489 - RNA, 64 nt, hsa
caggagccuggacccggccucccggggcugcggcgccaccgagcccggcaaaugcgcacgaccu

SEQ ID NO: 334490 - RNA, 64 nt, hsa
ugagcagagagggaaagauuaauuuacacugcuggccaccgaaggcagguguuuccuggguagu

SEQ ID NO: 334491 - RNA, 64 nt, hsa
ggcaucaccaacacggccucccugcagcugcccugccaccgacagaccccgauuaaacccacac

SEQ ID NO: 334492 - RNA, 64 nt, hsa
auaugcuguguaucucaccagguagcugucaggggccaccgagagugucguuaaaaaugggcau

SEQ ID NO: 334493 - RNA, 64 nt, hsa
uaaagguaauccuuacuuucuuuguauuacuuagguucuuaaauuucuaugauaaacauguauu

SEQ ID NO: 334494 - RNA, 64 nt, hsa
uaaagguaauccuuacuuucuuuguauuacuuagguucuuaauuaaagguaauccuuacuuucu

SEQ ID NO: 334495 - RNA, 64 nt, hsa
gccagggucugcugcacugcuguucugauaauagguucuuaacauuguauguauauguguuugc

SEQ ID NO: 334496 - RNA, 64 nt, hsa
uucugcucagccacugggcucuuucacuuuuuuaguucuuaaaaauuuauuuuuaaguucuaaa

SEQ ID NO: 334497 - RNA, 64 nt, hsa
uuuauuuuuaaguucuaaaauaaaauaaaaauaaguucuuaaaauuuauuuuuuuccugaauaa

SEQ ID NO: 334498 - RNA, 64 nt, hsa
ugcccugaaagaauaauagggauuauaccugucuguucuuaaagauuucaugguuggcucagac

SEQ ID NO: 334499 - RNA, 64 nt, hsa
uucuuuauuggaaugugguuguaauccuuguucaguucuuaaguuucgguuuuuuuuaaaaaca

SEQ ID NO: 334500 - RNA, 64 nt, hsa
guaaaaugucuaccaguagccagaugcuuccagaguucuuaaugccucucuggcauuucagagc

SEQ ID NO: 334501 - RNA, 64 nt, hsa
uguaaaugaauagagaguaucaguuuacaauaauguucuuaaaacaguauccucuggauaguug

SEQ ID NO: 334502 - RNA, 64 nt, hsa
gugaugagucuugaagcuggaaacuagguaacagguucuuaaauaguucaugugaaaaucauga

SEQ ID NO: 334503 - RNA, 64 nt, hsa
auaauucuccacuguguuuagaauaacaucugagguucuuaaccuggccuuggaaggguaucac

SEQ ID NO: 334504 - RNA, 64 nt, hsa
ugggguaaaacccaugguuauguggaacauaacuguucuuaaaaagucaauuauaauuuguaac

SEQ ID NO: 334505 - RNA, 64 nt, hsa
caaaauaagagucugaggauuucuucuuacuggcguucuuaaaggucucuaaaauuaaagaaca

SEQ ID NO: 334506 - RNA, 64 nt, hsa
ucuugaugauauauaaaaauuggaagccaaaccaguucuuaaaugcuacaugcaacucccagau

SEQ ID NO: 334507 - RNA, 64 nt, hsa
uccuggucuguaacuugaauuguuucuuccacauguucuuaaguacuagaguuaaacuugucua

SEQ ID NO: 334508 - RNA, 64 nt, hsa
cauugauaauuuuuauuuaguucuuaagaaaccuguucuuaauguuggcaugucacauuuuucu

SEQ ID NO: 334509 - RNA, 64 nt, hsa
gcauauaguguuuuucauugauaauuuuuauuuaguucuuaagaaaccuguucuuaauguuggc

SEQ ID NO: 334510 - RNA, 64 nt, hsa
uugaagaggguauuuuauuguuuuuuaaaaaaagguucuuaaacauuauuugaaauaguuaaua

SEQ ID NO: 334511 - RNA, 64 nt, hsa
auuauuuauaaguauagauugugaauuuuuccauguucuuaaaauuauuuuuaucuuuuuucau

SEQ ID NO: 334512 - RNA, 64 nt, hsa
uuauaaaauggaaaucaaauuguacauuagcagaguucuuaagcuuuuugaauugaaggagacc

SEQ ID NO: 334513 - RNA, 64 nt, hsa
aucucugaccugagaaaaaacaacuuugacccuuguucuuaaaaugcuuuaaccuugaaguugc

SEQ ID NO: 334514 - RNA, 64 nt, hsa
cguaggcuggggcuugugucuuugucauugucugguucuuaagagucccagcuccagguggcgu

SEQ ID NO: 334515 - RNA, 64 nt, hsa
gaguuaugagcccugauuuugucuuuuucucuaaguucuuaacauguuaugucccuaguggcuu

SEQ ID NO: 334516 - RNA, 64 nt, hsa
aaaguauacugaccuaagauucucauuaguuuuaguucuuaaaacgaauaguaaaugauuucac

SEQ ID NO: 334517 - RNA, 64 nt, hsa
ugcuuggagaauuugcucuuuuuuuggcauauaaguucuuaagaauguccguccuuugucauau

SEQ ID NO: 334518 - RNA, 64 nt, hsa
uucugacaguauaauuuauugaguuacuagggagguucuuaaauccucauaucuggaaacuugu

SEQ ID NO: 334519 - RNA, 64 nt, hsa
aaaaaaauagacuaaacaaaucacaaauuguucaguucuuaaaauguaauuaugucacacacac

SEQ ID NO: 334520 - RNA, 64 nt, hsa
acuuaagaacuucugaaguucuuaaaguucugaaguucuuaaagcccauggauccuuucucaga

SEQ ID NO: 334521 - RNA, 64 nt, hsa
uuacuugagcuucagcaacuuaagaacuucugaaguucuuaaaguucugaaguucuuaaagccc

SEQ ID NO: 334522 - RNA, 64 nt, hsa
gauuccugagcaaauucccucaaagugaacucuuguucuuaaauuuugaauuuuauggugagau

SEQ ID NO: 334523 - RNA, 64 nt, hsa
aauugaauucaaauaaaaucauacacacuuucuaguucuuaauauuugucuuucugaauaauag

SEQ ID NO: 334524 - RNA, 64 nt, hsa; identical to SEQ ID NO: 334518

SEQ ID NO: 334525 - RNA, 64 nt, hsa; identical to SEQ ID NO: 334519

SEQ ID NO: 334526 - RNA, 64 nt, hsa
ccaggcucuggacuaggugcuagguuuccagggaggagccaaacacgggccuugcucuugugga

SEQ ID NO: 334527 - RNA, 64 nt, hsa
gcugcugggaucggaccagccacuguggcagaugggagccaagcuugaggacugcuggugaccu

SEQ ID NO: 334528 - RNA, 64 nt, hsa
gugaucuggaaggcaggcaggacgggggcguuggggagccaaagucaacucugggccucuggag

SEQ ID NO: 334529 - RNA, 64 nt, hsa
gguauggaaaccugccggcuccaggccagacccaggagccaagagaaggcugaagccagcuugg

SEQ ID NO: 334530 - RNA, 64 nt, hsa
guacauccgcccaccaugucccccugcugggucaggagccaacacaggacccugcgugugagcg

SEQ ID NO: 334531 - RNA, 64 nt, hsa
cacccugcugaagaucacucugugcccugggggaggagccaagcccucaccccacaaggggcag

SEQ ID NO: 334532 - RNA, 64 nt, hsa
auucuuuaacaggacaaacuuacugcagcuugaaggagccaaccauggauuugaggcgugugaa

SEQ ID NO: 334533 - RNA, 64 nt, hsa
cccggcgcagugggaagcucgcagcagcuggggaggagccaaagccucggcgcucaccuaagcc

SEQ ID NO: 334534 - RNA, 64 nt, hsa
gucccuggaccagccuccuguuugcaggcccagaggagccaagucauuaaaauggaaguggauu

SEQ ID NO: 334535 - RNA, 64 nt, hsa
ccaucuucauggagggggucauuucagagcccucggagccaaugaacagcuccuccucuuggag

SEQ ID NO: 334536 - RNA, 64 nt, hsa
caggugcccaagaagauggaggaucccugugccaggagccaaccuggucuucccgagggucagu

SEQ ID NO: 334537 - RNA, 64 nt, hsa
gaggggggacccggcuggccccuugggucagacuggagccaacaccgccagccacccccucugg

SEQ ID NO: 334538 - RNA, 64 nt, hsa
gcugugauuaccaucaguccauuuuaccgaggaaggagccaagguccaggcccacugaaggacu

SEQ ID NO: 334539 - RNA, 64 nt, hsa
uuuaaagcuuuauaugccucaaauaucagggaaaggagccaaguccuugguauuuaguuuggug

SEQ ID NO: 334540 - RNA, 64 nt, hsa
gaauggugugaacccgggaggcggagcuugcaguggagccaagauugcgccacugcacuccagc

SEQ ID NO: 334541 - RNA, 64 nt, hsa
uuugaaggcccagucuucucucccagccucaguuggagccaaagcuuuguccuuuagccagcac

SEQ ID NO: 334542 - RNA, 64 nt, hsa
aguuuuguuccaucuuggauauuugaagagaaaaggagccaagaacuggcggguggugugugug

SEQ ID NO: 334543 - RNA, 64 nt, hsa
ccugcccuggggcucccagggaagugggagcuggggagccaauccacccagacccgcguccacc

SEQ ID NO: 334544 - RNA, 64 nt, hsa
uggccuguggcacagcccugagugucccaagccgggagccaacgaagccggacacggcuucacu

SEQ ID NO: 334545 - RNA, 64 nt, hsa
aggccccgggcuucccuucuccccagccagagguggagccaagugguccagcgucacuccagug

SEQ ID NO: 334546 - RNA, 64 nt, hsa
ccuacaacucauggaagguaaagaaccugcaacuggagccaagaagaguaacaagccaaaugaa

SEQ ID NO: 334547 - RNA, 64 nt, hsa
uucuguaauaaaagcaaacagccuggcuuagcaaggagccaacauaacagaugggcuggaagua

SEQ ID NO: 334548 - RNA, 64 nt, hsa
cccagccuccagggacugaaccgugcugcuguugggagccaagaccggcccuuuggagccggca

SEQ ID NO: 334549 - RNA, 64 nt, hsa
aaggugggagccaacacccuucugauggaaggugggagccaacacccuucugauggaaggcggg

SEQ ID NO: 334550 - RNA, 64 nt, hsa
aaggugggagccaacacccuucugauggaaggugggagccaacacccuucugauggaagguggg

SEQ ID NO: 334551 - RNA, 64 nt, hsa; identical to SEQ ID NO: 334550

SEQ ID NO: 334552 - RNA, 64 nt, hsa; identical to SEQ ID NO: 334550

SEQ ID NO: 334553 - RNA, 64 nt, hsa
guuucccugggccagcaucuucugauggaaggugggagccaacacccuucugauggaagguggg

SEQ ID NO: 334554 - RNA, 64 nt, hsa
agacgguguuauugugaagguggcauucaucugcggagccaaaacccagccaucggggaagggu

SEQ ID NO: 334555 - RNA, 64 nt, hsa
gacuuuuguuuagucuuucuaagaaauagaucauggagccaagugaagugcacuuugucaaaug

SEQ ID NO: 334556 - RNA, 64 nt, hsa
aguuuggugauacugucaagcccuauccuucucugccucuuaacuccuucacgaggaaucuggg

SEQ ID NO: 334557 - RNA, 64 nt, hsa
ucucugccucuuaacuccuucacgaggaaucugggccucuuauuucguuucuggggacugcauu

SEQ ID NO: 334558 - RNA, 64 nt, hsa
accgccccucaccaacccagagaaccugcuuuacuuugcccagggacuuccuccccaugugaac

SEQ ID NO: 334559 - RNA, 64 nt, hsa
auuggccagaagaagcuuaagugggcagacacuguuugcccaguguuugugcaaggauggagug

SEQ ID NO: 334560 - RNA, 64 nt, hsa
uucuuuuuuuuuuuucaagacagggucucgcucuuuugcccaggauggaguacaguggcauggu

SEQ ID NO: 334561 - RNA, 64 nt, hsa
aagaggccaagauccugauucagaggaggcauccuuugcccagagcugcuuagcuaaucugacc

SEQ ID NO: 334562 - RNA, 64 nt, hsa
uuccuucuuugugccuccuuccaaaccacaguuauuugcccaaacuaccucucguggcugguuu

SEQ ID NO: 334563 - RNA, 64 nt, hsa
aaacccuugaaccaguguccuagaccagaugauuuuugcccauguguauccccauuuaaauucc

SEQ ID NO: 334564 - RNA, 64 nt, hsa
agggcaggugggcagggagcagacagggucuggcuuugcccagagggcacgggcuuucccaccu

SEQ ID NO: 334565 - RNA, 64 nt, hsa
ccacucgggacaccuggaugguuucucuuaggacuuugcccaccuccuucucauggcacuugcu

SEQ ID NO: 334566 - RNA, 64 nt, hsa
uuugagaagcuuguuauucauuauacaaaaaguauuugcccauuccuauucuaagauuugcaga

SEQ ID NO: 334567 - RNA, 64 nt, hsa
auaauuugauuugauaugauuguuucauuuauaauuugcccaaauacauggagcacaaaauuua

SEQ ID NO: 334568 - RNA, 64 nt, hsa
auugauugucauauuucauguugggaccaaguaguuugcccauggcaaaccuaaauuuaugacc

SEQ ID NO: 334569 - RNA, 64 nt, hsa
aauuuaguuaauaaaauaauuaugaucuauguuguuugcccaauugagauccaguuuuuuguug

SEQ ID NO: 334570 - RNA, 64 nt, hsa
cauguagaggacaagauuuauuuucuuuccucccuuugcccaguagccacaucugguuuacuca

SEQ ID NO: 334571 - RNA, 64 nt, hsa
auaaaaagaaauuguagaaauaaacacauuaaaauuugcccagcugucgucuaagcccucuuga

SEQ ID NO: 334572 - RNA, 64 nt, hsa
uuuuuuuuuuuuuuuugagauggaauuuugcucuuuugcccagucuggagugcaguggcaugau

SEQ ID NO: 334573 - RNA, 64 nt, hsa
auguguguguguguguguguguguguuuuuccuguuugcccagcagugcauuguggguuccaag

SEQ ID NO: 334574 - RNA, 64 nt, hsa
aagugagccuguuuggaugauggaugccauuccuuuugcccaguuaaauguucaccaaucauuu

SEQ ID NO: 334575 - RNA, 64 nt, hsa
aauauggagaucuuccuuuaccccucaacuuuaauuugcccaguuauaccucaguguuguagca

SEQ ID NO: 334576 - RNA, 64 nt, hsa
auucagcaaauauuaguuuguccuccuuuaauuguuugcccaaaucuuccacccaucuuuuuuc

SEQ ID NO: 334577 - RNA, 64 nt, hsa
aaggagaauuucucuuagaggguggcaaaaugccuuugcccagugucccuauuuuaggcaucuu

SEQ ID NO: 334578 - RNA, 64 nt, hsa
uuuaauaucaacucucacuccugaauucaguugcuuugcccaagauaggaguucucugaugcag

SEQ ID NO: 334579 - RNA, 64 nt, hsa
augucuacagaaaaugcuggcugagcugaacacauuugcccaauuccaggugugcacagaaaac

SEQ ID NO: 334580 - RNA, 64 nt, hsa
aauccgggacaccugggccgggcuguagaucagguuugcccacuugauugagaaagauguucca

SEQ ID NO: 334581 - RNA, 64 nt, hsa
cuuggauuaggcaaggcuccacucauuguugauauuugcccagcaggaaaaucauguaaguuau

SEQ ID NO: 334582 - RNA, 64 nt, hsa
ugacuuaccccagcuaccguuaaaugaggacaaaucaccuuaaaacauguucauuugauucaua

SEQ ID NO: 334583 - RNA, 64 nt, hsa
auuucaaacuauguuuuacuuguauaugauguagucaccuuaacuaucuuucaauuccauacuu

SEQ ID NO: 334584 - RNA, 64 nt, hsa
uuuguucaugucuagcccacugggaauuuuguuuucaccuuauacugaguccuuuuucuaaugu

SEQ ID NO: 334585 - RNA, 64 nt, hsa
aagaacaucaagcuucaucucugcuuacagaaucucaccuuauugaguggguuccacuuuauuu

SEQ ID NO: 334586 - RNA, 64 nt, hsa
uggaucucuggaggcuuccacccuuccugauuauucaccuuaagcgauuucaauuuguaaauga

SEQ ID NO: 334587 - RNA, 64 nt, hsa
uguaguuucuuaauauauacuugaaggaaauguuucaccuuauuuuuggucuuuguuuauucau

SEQ ID NO: 334588 - RNA, 64 nt, hsa
ugugugggauaaugucauuaauauauccuaaauuaaccuaaacguauuucacuaacucuggcuc

SEQ ID NO: 334589 - RNA, 64 nt, hsa
auguacuauagauauaacuguacaaaaauuguucaaccuaaaacaaucuguaauugcuuauugu

SEQ ID NO: 334590 - RNA, 64 nt, hsa
cugggcuaucuuagcuaacuuauccuaaacccuuaaccuaaauuuaacuugagccccagucuca

SEQ ID NO: 334591 - RNA, 64 nt, hsa
auuccaugugaaaauaaaauaugaggaaaaguuuaaccuaaauaauuagaaucccauuagaggu

SEQ ID NO: 334592 - RNA, 64 nt, hsa
uucgaaccuaaaguuuagaugcauuguauaaaaaaaccuaaaagcaguaucuguuauuuagcug

SEQ ID NO: 334593 - RNA, 64 nt, hsa
gccauucacaguguaaggcagcacuuaaauuucgaaccuaaaguuuagaugcauuguauaaaaa

SEQ ID NO: 334594 - RNA, 64 nt, hsa
aagaauguaagggcuauaaguagaaacuuucuauaaccuaaaugauguuauagaauuauuuuug

SEQ ID NO: 334595 - RNA, 64 nt, hsa
aaaggggaugcccagugguuucccuuugcuucccaaccuaaaauuucaaguuuaauaaaauagc

SEQ ID NO: 334596 - RNA, 64 nt, hsa
gauuauaaagagauaucaaagcacgauuuuagauaaccuaaacggcccagccuauacgaaguug

SEQ ID NO: 334597 - RNA, 64 nt, hsa
gugagcuucuaucauauuccuguuuuauuagcagaaccuaaaggaauuuauuuaaugauguugu

SEQ ID NO: 334598 - RNA, 64 nt, hsa
agccaccaagaauguggacauaugaaaauucaagaaccuaaaaaauaccaguuuugaaugaguu

SEQ ID NO: 334599 - RNA, 64 nt, hsa
cauuucaguagguucucaacuuaaaauuaagccuaaccuaaaacugccagcaacacaacuggag

SEQ ID NO: 334600 - RNA, 64 nt, hsa
uuauuuucaguuuuccaaaauucuaucaucuuuaaaccuaaauaauucaauuucauggaugcac

SEQ ID NO: 334601 - RNA, 64 nt, hsa
gagcucucugugcuaucugcucaauuuuucucuaaaccuaaaacuguucuaaaauagaaagucu

SEQ ID NO: 334602 - RNA, 64 nt, hsa
acauucugaaauuuauuuggaaccagaaaagcccaaccuaaauagcaaaagcaauccuaagcaa

SEQ ID NO: 334603 - RNA, 64 nt, hsa
aucaacucaagauggauuaaagacuuaaauauaaaaccuaaaaguauuaaauuccuagaagaaa

SEQ ID NO: 334604 - RNA, 64 nt, hsa
aacaugcaguugacccauguacacauacuccuugaaccuaaaauaaaacaugaaaaaaagcaaa

SEQ ID NO: 334605 - RNA, 64 nt, hsa
gcaagcaaaaacaaaaugggaugugaagaauugaggcaugcaacccaauagcauaaauguccuu

SEQ ID NO: 334606 - RNA, 64 nt, hsa
uccugccucagccucccaaguagcugggauuacaggcaugcaccaccacgcccagcuaauuuuu

SEQ ID NO: 334607 - RNA, 64 nt, hsa
acuagauauuaaugucaaucauuuaagauuaaugggcaugcaauuaagucuccauuuaagauua

SEQ ID NO: 334608 - RNA, 64 nt, hsa
gggcaugcaauuaagucuccauuuaagauuaaugggcaugcaaugaagucuccagcagacaauc

SEQ ID NO: 334609 - RNA, 64 nt, hsa
ugccuggagggcagggagugggagccaaugaacaggcaugcaagugagagcuuccugagcuuuc

SEQ ID NO: 334610 - RNA, 64 nt, hsa
uccugccgcagguacaugaugaugcgggacugcuggcaugcagugcccucacagagacccaccu

SEQ ID NO: 334611 - RNA, 64 nt, hsa
ugaagacauguuucaagaaccgcauuucgggaagggcaugcacgggcaugcacacggcugguca

SEQ ID NO: 334612 - RNA, 64 nt, hsa
uuucaagaaccgcauuucgggaagggcaugcacgggcaugcacacggcuggucacucugcccuc

SEQ ID NO: 334613 - RNA, 64 nt, hsa
cuucugagcccaccucccaggguaggcaccugggggcaugcaggugcccaccucccaggguagg

SEQ ID NO: 334614 - RNA, 64 nt, hsa
ugcaggugcccaccucccaggguaggcaccugggggcaugcagguacccaccucuuucucuugg

SEQ ID NO: 334615 - RNA, 64 nt, hsa
uccugccucagccucccuaguagcugggauuacaggcaugcaccaccauacccagcuaauuucu

SEQ ID NO: 334616 - RNA, 64 nt, hsa
uccugccucagccucccgaguagcugggauugcaggcaugcaccaucacaccuggcuaauuuug

SEQ ID NO: 334617 - RNA, 64 nt, hsa
uccggaacauucauucccccaccggugaggaccuggcaugcagcgaagcagcccagcccggcgg

SEQ ID NO: 334618 - RNA, 64 nt, hsa
uccugccucagccucccaaguagcugggacuacaggcaugcaccaccacacuuggccaauguuc

SEQ ID NO: 334619 - RNA, 64 nt, hsa
auuuuggcugcuguucuuuaaucuuccucuagcaggcaugcaguccaaggaauaucaaaauucu

SEQ ID NO: 334620 - RNA, 64 nt, hsa
auuuuggcugcugcucuuuaauuuuccucuagcaggcaugcaguccaaggaauaucaaaauucu

SEQ ID NO: 334621 - RNA, 64 nt, hsa; identical to SEQ ID NO: 206809

SEQ ID NO: 334622 - RNA, 64 nt, hsa; identical to SEQ ID NO: 206810

SEQ ID NO: 334623 - RNA, 64 nt, hsa; identical to SEQ ID NO: 206811

SEQ ID NO: 334624 - RNA, 64 nt, hsa; identical to SEQ ID NO: 206812

SEQ ID NO: 334625 - RNA, 64 nt, hsa; identical to SEQ ID NO: 206813

SEQ ID NO: 334626 - RNA, 64 nt, hsa; identical to SEQ ID NO: 206814

SEQ ID NO: 334627 - RNA, 64 nt, hsa; identical to SEQ ID NO: 206815

SEQ ID NO: 334628 - RNA, 64 nt, hsa; identical to SEQ ID NO: 206816

SEQ ID NO: 334629 - RNA, 64 nt, hsa; identical to SEQ ID NO: 206817

SEQ ID NO: 334630 - RNA, 64 nt, hsa; identical to SEQ ID NO: 206818

SEQ ID NO: 334631 - RNA, 64 nt, hsa; identical to SEQ ID NO: 206819

SEQ ID NO: 334632 - RNA, 64 nt, hsa; identical to SEQ ID NO: 206820

SEQ ID NO: 334633 - RNA, 64 nt, hsa; identical to SEQ ID NO: 206821

SEQ ID NO: 334634 - RNA, 64 nt, hsa; identical to SEQ ID NO: 206822

SEQ ID NO: 334635 - RNA, 64 nt, hsa; identical to SEQ ID NO: 206823

SEQ ID NO: 334636 - RNA, 64 nt, hsa; identical to SEQ ID NO: 206824

SEQ ID NO: 334637 - RNA, 64 nt, hsa; identical to SEQ ID NO: 206825

SEQ ID NO: 334638 - RNA, 64 nt, hsa; identical to SEQ ID NO: 206826

SEQ ID NO: 334639 - RNA, 64 nt, hsa; identical to SEQ ID NO: 206827

SEQ ID NO: 334640 - RNA, 64 nt, hsa; identical to SEQ ID NO: 206828

SEQ ID NO: 334641 - RNA, 64 nt, hsa; identical to SEQ ID NO: 206829

SEQ ID NO: 334642 - RNA, 56 nt, hsa; identical to SEQ ID NO: 206830

SEQ ID NO: 334643 - RNA, 64 nt, hsa; identical to SEQ ID NO: 206831

SEQ ID NO: 334644 - RNA, 64 nt, hsa; identical to SEQ ID NO: 206832

SEQ ID NO: 334645 - RNA, 64 nt, hsa; identical to SEQ ID NO: 206833

SEQ ID NO: 334646 - RNA, 64 nt, hsa; identical to SEQ ID NO: 284724

SEQ ID NO: 334647 - RNA, 64 nt, hsa; identical to SEQ ID NO: 284725

SEQ ID NO: 334648 - RNA, 64 nt, hsa; identical to SEQ ID NO: 284726

SEQ ID NO: 334649 - RNA, 64 nt, hsa; identical to SEQ ID NO: 284727

SEQ ID NO: 334650 - RNA, 64 nt, hsa; identical to SEQ ID NO: 284728

SEQ ID NO: 334651 - RNA, 64 nt, hsa; identical to SEQ ID NO: 284729

SEQ ID NO: 334652 - RNA, 64 nt, hsa; identical to SEQ ID NO: 284730

SEQ ID NO: 334653 - RNA, 64 nt, hsa; identical to SEQ ID NO: 284731

SEQ ID NO: 334654 - RNA, 64 nt, hsa; identical to SEQ ID NO: 284732

SEQ ID NO: 334655 - RNA, 64 nt, hsa; identical to SEQ ID NO: 284733

SEQ ID NO: 334656 - RNA, 64 nt, hsa; identical to SEQ ID NO: 284734

SEQ ID NO: 334657 - RNA, 64 nt, hsa; identical to SEQ ID NO: 284735

SEQ ID NO: 334658 - RNA, 64 nt, hsa; identical to SEQ ID NO: 284736

SEQ ID NO: 334659 - RNA, 64 nt, hsa; identical to SEQ ID NO: 284737

SEQ ID NO: 334660 - RNA, 64 nt, hsa; identical to SEQ ID NO: 284738

SEQ ID NO: 334661 - RNA, 64 nt, hsa; identical to SEQ ID NO: 284739

SEQ ID NO: 334662 - RNA, 64 nt, hsa; identical to SEQ ID NO: 284740

SEQ ID NO: 334663 - RNA, 64 nt, hsa; identical to SEQ ID NO: 284741

SEQ ID NO: 334664 - RNA, 64 nt, hsa; identical to SEQ ID NO: 284742

SEQ ID NO: 334665 - RNA, 64 nt, hsa; identical to SEQ ID NO: 284743

SEQ ID NO: 334666 - RNA, 64 nt, hsa; identical to SEQ ID NO: 284744

SEQ ID NO: 334667 - RNA, 64 nt, hsa; identical to SEQ ID NO: 284745

SEQ ID NO: 334668 - RNA, 64 nt, hsa; identical to SEQ ID NO: 284746

SEQ ID NO: 334669 - RNA, 64 nt, hsa; identical to SEQ ID NO: 284747

SEQ ID NO: 334670 - RNA, 64 nt, hsa; identical to SEQ ID NO: 272932

SEQ ID NO: 334671 - RNA, 64 nt, hsa; identical to SEQ ID NO: 272933

SEQ ID NO: 334672 - RNA, 64 nt, hsa; identical to SEQ ID NO: 272934

SEQ ID NO: 334673 - RNA, 64 nt, hsa; identical to SEQ ID NO: 272935

SEQ ID NO: 334674 - RNA, 64 nt, hsa; identical to SEQ ID NO: 272936

SEQ ID NO: 334675 - RNA, 64 nt, hsa; identical to SEQ ID NO: 272937

SEQ ID NO: 334676 - RNA, 64 nt, hsa; identical to SEQ ID NO: 272938

SEQ ID NO: 334677 - RNA, 64 nt, hsa; identical to SEQ ID NO: 272939

SEQ ID NO: 334678 - RNA, 64 nt, hsa; identical to SEQ ID NO: 272940

SEQ ID NO: 334679 - RNA, 64 nt, hsa; identical to SEQ ID NO: 272941

SEQ ID NO: 334680 - RNA, 64 nt, hsa; identical to SEQ ID NO: 272942

SEQ ID NO: 334681 - RNA, 64 nt, hsa; identical to SEQ ID NO: 272943

SEQ ID NO: 334682 - RNA, 64 nt, hsa; identical to SEQ ID NO: 272944

SEQ ID NO: 334683 - RNA, 64 nt, hsa; identical to SEQ ID NO: 272945

SEQ ID NO: 334684 - RNA, 64 nt, hsa; identical to SEQ ID NO: 272946

SEQ ID NO: 334685 - RNA, 64 nt, hsa; identical to SEQ ID NO: 272947

SEQ ID NO: 334686 - RNA, 64 nt, hsa; identical to SEQ ID NO: 272948

SEQ ID NO: 334687 - RNA, 64 nt, hsa; identical to SEQ ID NO: 272949

SEQ ID NO: 334688 - RNA, 64 nt, hsa; identical to SEQ ID NO: 272950

SEQ ID NO: 334689 - RNA, 64 nt, hsa; identical to SEQ ID NO: 272951

SEQ ID NO: 334690 - RNA, 64 nt, hsa; identical to SEQ ID NO: 272952

SEQ ID NO: 334691 - RNA, 64 nt, hsa; identical to SEQ ID NO: 272953

SEQ ID NO: 334692 - RNA, 64 nt, hsa
gugaugucuguuucccagggcucagaccuaauccaguuauaauaaaaucaauuaaaugaaauau

SEQ ID NO: 334693 - RNA, 64 nt, hsa
cuguagacuagaauuucuuaaaaggguguuacugaguuauaagcucacuaggcuguaaaaacaa

SEQ ID NO: 334694 - RNA, 64 nt, hsa
uggcgguauacaaaguaaaauguuauaaaugugaaguuauaaaauaaauauaugcuaauaaaau

SEQ ID NO: 334695 - RNA, 64 nt, hsa
guuacaagacuacagcuauaaccugcaguugagcaguuauaaaccuacaaaaugggcccugccc

SEQ ID NO: 334696 - RNA, 64 nt, hsa
gaauuauauauaaagaaggguguuuaauaaugauaguuauaauaauaaauaauugaaacaaucu

SEQ ID NO: 334697 - RNA, 64 nt, hsa
ugaaucccuugcaauuggagguaaauuaugucuuaguuauaauuagauugugaaucagccaacu

SEQ ID NO: 334698 - RNA, 64 nt, hsa
cuguacccuuaugcagagcaagcauuccauccuaaguuauaaacuacagugauguuuaauuuug

SEQ ID NO: 334699 - RNA, 64 nt, hsa
aggcugggaaaggcuaaaugacuuauccuccaucaguuauaacagccccuggucuucuuaaauu

SEQ ID NO: 334700 - RNA, 64 nt, hsa
aagccccacucuuaaaaaguugcacuguuccaguaguuauaauccacuugcccuaggaacaagu

SEQ ID NO: 334701 - RNA, 64 nt, hsa
accccucagggauuauucacauuuaaauauuuucaguuauaagcagugagguccuaaaguguua

SEQ ID NO: 334702 - RNA, 64 nt, hsa
aguuuuuuuccuuaaugugaaaguaauuugaccaaguuauaaugcauuuuuguuuuuaacaaau

SEQ ID NO: 334703 - RNA, 64 nt, hsa
gguggccaaaucugagaacaauuaaauucauuuuaguuauaauaaauuuaauauuuguaaaugu

SEQ ID NO: 334704 - RNA, 64 nt, hsa
ggaacgcauuuuggguuguuuaaaaauuuauaacaguuauaaagaaagauuguaaacuaaagug

SEQ ID NO: 334705 - RNA, 64 nt, hsa
gcagguuuuacacgucuaugcaauuguacaaaaaaguuauaagaaaacuacauguaaaaucuug

SEQ ID NO: 334706 - RNA, 64 nt, hsa
caggguacaaaaaauucagugaugugccuaaauaaguuauaaagauuuaggccaaucagaagcu

SEQ ID NO: 334707 - RNA, 64 nt, hsa
guaggguaggcagccugagagucuagaggccuuuaguuauaaaggaaucuagccagugaacaua

SEQ ID NO: 334708 - RNA, 64 nt, hsa
gugugggguuuguuuuuuagucuuguuuuuuuaauucauuaaccagugguuagcccuuaagggg

SEQ ID NO: 334709 - RNA, 64 nt, hsa
cacauccucucaaguuaggaggauggaggccugcuucauuaagaagcuggggguaggguggggg

SEQ ID NO: 334710 - RNA, 64 nt, hsa
cacacagacaucagaaaauucuguugagagcagguucauuaaauuuguaagauggcauauucua

SEQ ID NO: 334711 - RNA, 64 nt, hsa
aggaaaauguauuucuguauaagaguucuuugcuuucauuaacuuggauucauuuaaaaauuaa

SEQ ID NO: 334712 - RNA, 64 nt, hsa
accagcaucuguccagcuguucaguauauugugauucauuaaaaaaucucuucuaucccagaca

SEQ ID NO: 334713 - RNA, 64 nt, hsa
uaaaagcaaaacuagaaaucuuuuaaugacaauuuucauuaauuucaggguuaucauuuuugag

SEQ ID NO: 334714 - RNA, 64 nt, hsa
ucacagcuagcauguucacagauuugaaagaaguuucauuaaaagcaccauugcuuucuguacu

SEQ ID NO: 334715 - RNA, 64 nt, hsa
acacuaggccuuugaugcuuuaauucuucuucaguucauuaaaaguaacuacuaaggaaagguu

SEQ ID NO: 334716 - RNA, 64 nt, hsa
cagacauccccaaagcuugucugccugugggucuuucauuaaaggugacgggcaaggguuuucu

SEQ ID NO: 334717 - RNA, 64 nt, hsa
auguguguacaguguccacaggcaucacaccuucuucauuaaaaacccaguuuccuggucauuu

SEQ ID NO: 334718 - RNA, 64 nt, hsa
cugaaggauuauuaagcaaccuuaaagcaauaaguucauuaaacagaagguaauaggaagaaca

SEQ ID NO: 334719 - RNA, 64 nt, hsa
uuagaaaaaaacaaacucuacuaauuuuuagauauucauuaauaggaaagauuuaauguuacag

SEQ ID NO: 334720 - RNA, 64 nt, hsa
gguauugauugaaaaaagagaaaggggcaagaaauucauuaaagaaaaaccacagauacugaaa

SEQ ID NO: 334721 - RNA, 64 nt, hsa
uauaaacaugguguuuuucagaaauaaaaauuauuucauuaaccuuuacuauuacugugauaau

SEQ ID NO: 334722 - RNA, 64 nt, hsa
ucuguuguaaagacaccuuauuuaauauaaucgauucauuaacauugaagucaugaccaacaac

SEQ ID NO: 334723 - RNA, 64 nt, hsa
uuuggaaaacuauaggcuggaaacuccuaucuguuucauuaacuauguauggagcuuuguaucu

SEQ ID NO: 334724 - RNA, 64 nt, hsa
gcuuuuaauuuuauuuguaugaauuuuccaggauuucauuaaaaauuauuauuguauuuuuuac

SEQ ID NO: 334725 - RNA, 64 nt, hsa
ugucaaacuggccauuugacuucagagauuuguuuucauuaaaaaauaagccugccgccaaaau

SEQ ID NO: 334726 - RNA, 64 nt, hsa
uuuuggcugacagaucagauaaaauuacuuucuauucauuaauuuuucucuacaacuuuaugag

SEQ ID NO: 334727 - RNA, 64 nt, hsa
acaugauaacugguaccuuaucuacuguaaauauuucauuaaaaaugaugcacacauagauaua

SEQ ID NO: 334728 - RNA, 64 nt, hsa
auuuuaauguuuuauuggcaacguaugcugcuuuuucauuaaaauaugcuauuaaaauuaaaug

SEQ ID NO: 334729 - RNA, 64 nt, hsa
cauguuuauuucuacccuuaaugcaaugaaauguuucauuaauaaaaaaccacuuuauauaaaa

SEQ ID NO: 334730 - RNA, 64 nt, hsa
aauaugugauauauuuccccucuugaagaggcaauucauuaaacucucaaauuuucuauagaau

SEQ ID NO: 334731 - RNA, 64 nt, hsa
aggcuaaauucacagcgcuaugcaauucuuaauuuucauuaaguuguuauuucaguuuuaaaug

SEQ ID NO: 334732 - RNA, 64 nt, hsa
uauuucuaaaauauaagaucugagauugaauauuuucauuaaaagcuacaguuuugugaaucuu

SEQ ID NO: 334733 - RNA, 64 nt, hsa
aacaaaaaccagagaugugccuauacaauuuguguucauuaaugugccucacuuuuuuucucag

SEQ ID NO: 334734 - RNA, 64 nt, hsa
gucuuccaagauuuuguaaauauuuuugauuuuuuucauuaaauguaaauuuuacauaaaaguu

SEQ ID NO: 334735 - RNA, 64 nt, hsa
ucacaauggcgaauggugacuuuucuuucacgauuucauuaauuugaaagcacacaggaaaguu

SEQ ID NO: 334736 - RNA, 64 nt, hsa
uuuguacagagguuacugcaauaaaggaaguggauucauuaaaccuauuuaauguccauucuua

SEQ ID NO: 334737 - RNA, 64 nt, hsa
aaaguagacugucuuugcauuuugccaucugaaguucauuaaucuuuagaugacaaaaaagcaa

SEQ ID NO: 334738 - RNA, 64 nt, hsa
aucuguuuccuguaggcucuuucugcugucuauauucauuaaaguuuuccacuucacccuccca

SEQ ID NO: 334739 - RNA, 64 nt, hsa
cuguauucccgagaccaacgaagcguugggauacuucauuaaauguagcgacugucaacagcgu

SEQ ID NO: 334740 - RNA, 64 nt, hsa
ggacaaguugcuuuuaccugauuugaugauacauuucauuaagguuccaguuauaaauauuuug

SEQ ID NO: 334741 - RNA, 64 nt, hsa
ugugguuguccagugguauacaacugacaggcauuucauuaagcacauagaccagacuuuguga

SEQ ID NO: 334742 - RNA, 64 nt, hsa
auagaccagacuuugugaaugguucagauauuuuuucauuaaaaaacaagguauggcagaugga

SEQ ID NO: 334743 - RNA, 64 nt, hsa
auguaugcauaguuucauauuuaaugaauaugcuuucauuaaauagggagguagauuugaaaaa

SEQ ID NO: 334744 - RNA, 64 nt, hsa
uauuaccacucauguucuuucuacacugacacuauucauuaagaacaucaagcuucaucucugc

SEQ ID NO: 334745 - RNA, 64 nt, hsa
agcuaaggcacagaagacugaaugaaugcaaggauucauuaacucuuugaauuuguuaaauacu

SEQ ID NO: 334746 - RNA, 64 nt, hsa
auucuuauaguuaucuuuuuaacaucuuauuuuuuucauuaauuacauaucaacauuaauuuug

SEQ ID NO: 334747 - RNA, 64 nt, hsa
aaaauaaguuuaagaaauuuaagagaauuguguuuucauuaaguuuugcauaucuuuuguuaug

SEQ ID NO: 334748 - RNA, 64 nt, hsa
uugcauagaauaaugaagaucuuuguuuuuuguuuucauuaaagagccauucuggcacuuuaau

SEQ ID NO: 334749 - RNA, 64 nt, hsa
cauuuugagaacauucccuggaauugccacauaauucauuaaaaacauuuuuuuaagcaacacu

SEQ ID NO: 334750 - RNA, 64 nt, hsa
aaagugauaagauagccuugauuuuaaaagcugauucauuaauaucaaaauacuuuaauaagug

SEQ ID NO: 334751 - RNA, 64 nt, hsa
uauauucuucuuuauaucucugacaugacauauuuucauuaauaguuuaaaucagugaccauca

SEQ ID NO: 334752 - RNA, 64 nt, hsa
acaagcuacuggaugcacugucagauuaacuuauuucauuaaagaaguugggagaacaaauagg

SEQ ID NO: 334753 - RNA, 64 nt, hsa
agacugacaguugguauauguaccagccaaucccuucauuaaauguauacagauuuaguuaagu

SEQ ID NO: 334754 - RNA, 64 nt, hsa
aaaguuucacaacagauuucuaaguuaaaucauuuucauuaaaaggaaaaaagaaaaaaaauuu

SEQ ID NO: 334755 - RNA, 64 nt, hsa
uucugaagcuagaaacaaucuauaguuauacaucuucauuaauacuguguuaccuuuuaaaaua

SEQ ID NO: 334756 - RNA, 64 nt, hsa
gaccuaacauaugucucuaccuagaacggaugguuucauuaaagaauguggauuuauugaugug

SEQ ID NO: 334757 - RNA, 64 nt, hsa
auaauuuaaacagugagguaguuuugaauggcauuucauuaaggcaucuaugggcauuaugagc

SEQ ID NO: 334758 - RNA, 64 nt, hsa
uuuggugcuucuucagggauugaacucaguaucuuucauuaaaaaacacagcaguuuuccuugc

SEQ ID NO: 334759 - RNA, 64 nt, hsa
gaguuucaauacuuuuuauauuuuaauauuuccauucauuaauauuaugguuauugucagcaau

SEQ ID NO: 334760 - RNA, 64 nt, hsa
uggcacuuuggcauaccgaaaaaacaugaaauuuuucauuaaaaugccaugaaucaagccaggg

SEQ ID NO: 334761 - RNA, 64 nt, hsa
gacuccuccagaauuuuaguagauacaggguggguucauuaagagugauaaaagugggaagaca

SEQ ID NO: 334762 - RNA, 64 nt, hsa
auuucauguaauuuacccuuugcaauaaaaaugauucauuaaauauauaacuaaaugugauuug

SEQ ID NO: 334763 - RNA, 64 nt, hsa
aaagauauuuuagaaucaauuuauaaagggguaauucauuaauuacacuuuaaaauuggaaagu

SEQ ID NO: 334764 - RNA, 64 nt, hsa
aaggauccauuuaguuaaaaucgggcacucuauauucauuaagguuuaugaauuaaaaagaaag

SEQ ID NO: 334765 - RNA, 64 nt, hsa
guauucuaaauuaaugcagaaccauauggaaaauuucauuaaaaucuauccccaaaugugcuuu

SEQ ID NO: 334766 - RNA, 64 nt, hsa
uugcuaaguaauucccaauagaaagcugcuuauuuucauuaaugaaaaauaaccaugguuugua

SEQ ID NO: 334767 - RNA, 64 nt, hsa
aguuucuuuucugguuuuaguuugggaauaaucauucauuaaaaaaaauguauugugguuuaug

SEQ ID NO: 334768 - RNA, 64 nt, hsa
aucauaauacaaggaaccucagagcccccauuuguucauuaaagaggcaacuacagccaaaauc

SEQ ID NO: 334769 - RNA, 64 nt, hsa
uuaaaccaguacuugucaguccaucuuaauacuguucauuaaggcacucucugucucuaauccu

SEQ ID NO: 334770 - RNA, 64 nt, hsa
uaguaaaaaauguaggguuauuuaccauaaccuguucauuaauaucagaaauuuacaauagcau

SEQ ID NO: 334771 - RNA, 64 nt, hsa
ucugaaauguacucagugaaaauuuguuuugaguuucauuaaugcuauuucaccaguuagacau

SEQ ID NO: 334772 - RNA, 64 nt, hsa
acaaucuucccugucaugacuuuaaguucuacuuuucauuaaccauggccugauauuaguucuu

SEQ ID NO: 334773 - RNA, 64 nt, hsa; identical to SEQ ID NO: 110524

SEQ ID NO: 334774 - RNA, 64 nt, hsa; identical to SEQ ID NO: 110525

SEQ ID NO: 334775 - RNA, 64 nt, hsa; identical to SEQ ID NO: 110526

SEQ ID NO: 334776 - RNA, 64 nt, hsa; identical to SEQ ID NO: 110527

SEQ ID NO: 334777 - RNA, 64 nt, hsa; identical to SEQ ID NO: 110528

SEQ ID NO: 334778 - RNA, 64 nt, hsa; identical to SEQ ID NO: 110529

SEQ ID NO: 334779 - RNA, 64 nt, hsa; identical to SEQ ID NO: 110530

SEQ ID NO: 334780 - RNA, 64 nt, hsa; identical to SEQ ID NO: 110531

SEQ ID NO: 334781 - RNA, 64 nt, hsa; identical to SEQ ID NO: 110532

SEQ ID NO: 334782 - RNA, 64 nt, hsa; identical to SEQ ID NO: 110533

SEQ ID NO: 334783 - RNA, 64 nt, hsa; identical to SEQ ID NO: 110534

SEQ ID NO: 334784 - RNA, 64 nt, hsa; identical to SEQ ID NO: 110535

SEQ ID NO: 334785 - RNA, 64 nt, hsa; identical to SEQ ID NO: 110536

SEQ ID NO: 334786 - RNA, 64 nt, hsa; identical to SEQ ID NO: 110537

SEQ ID NO: 334787 - RNA, 64 nt, hsa; identical to SEQ ID NO: 110538

SEQ ID NO: 334788 - RNA, 64 nt, hsa; identical to SEQ ID NO: 110539

SEQ ID NO: 334789 - RNA, 64 nt, hsa; identical to SEQ ID NO: 110540

SEQ ID NO: 334790 - RNA, 64 nt, hsa; identical to SEQ ID NO: 110541

SEQ ID NO: 334791 - RNA, 64 nt, hsa; identical to SEQ ID NO: 110542

SEQ ID NO: 334792 - RNA, 64 nt, hsa; identical to SEQ ID NO: 110543

SEQ ID NO: 334793 - RNA, 64 nt, hsa; identical to SEQ ID NO: 110544

SEQ ID NO: 334794 - RNA, 64 nt, hsa; identical to SEQ ID NO: 110545

SEQ ID NO: 334795 - RNA, 64 nt, hsa; identical to SEQ ID NO: 110546

SEQ ID NO: 334796 - RNA, 64 nt, hsa; identical to SEQ ID NO: 110547

SEQ ID NO: 334797 - RNA, 64 nt, hsa; identical to SEQ ID NO: 110548

SEQ ID NO: 334798 - RNA, 64 nt, hsa; identical to SEQ ID NO: 110549

SEQ ID NO: 334799 - RNA, 64 nt, hsa; identical to SEQ ID NO: 110550

SEQ ID NO: 334800 - RNA, 64 nt, hsa; identical to SEQ ID NO: 110551

SEQ ID NO: 334801 - RNA, 64 nt, hsa; identical to SEQ ID NO: 110552

SEQ ID NO: 334802 - RNA, 64 nt, hsa; identical to SEQ ID NO: 110553

SEQ ID NO: 334803 - RNA, 64 nt, hsa; identical to SEQ ID NO: 110554

SEQ ID NO: 334804 - RNA, 64 nt, hsa; identical to SEQ ID NO: 110555

SEQ ID NO: 334805 - RNA, 64 nt, hsa; identical to SEQ ID NO: 110556

SEQ ID NO: 334806 - RNA, 64 nt, hsa; identical to SEQ ID NO: 110557

SEQ ID NO: 334807 - RNA, 64 nt, hsa; identical to SEQ ID NO: 110558

SEQ ID NO: 334808 - RNA, 64 nt, hsa; identical to SEQ ID NO: 110559

SEQ ID NO: 334809 - RNA, 64 nt, hsa; identical to SEQ ID NO: 110560

SEQ ID NO: 334810 - RNA, 64 nt, hsa; identical to SEQ ID NO: 110561

SEQ ID NO: 334811 - RNA, 64 nt, hsa; identical to SEQ ID NO: 110562

SEQ ID NO: 334812 - RNA, 64 nt, hsa; identical to SEQ ID NO: 110563

SEQ ID NO: 334813 - RNA, 64 nt, hsa; identical to SEQ ID NO: 110564

SEQ ID NO: 334814 - RNA, 64 nt, hsa; identical to SEQ ID NO: 110565

SEQ ID NO: 334815 - RNA, 64 nt, hsa; identical to SEQ ID NO: 110566

SEQ ID NO: 334816 - RNA, 64 nt, hsa; identical to SEQ ID NO: 110567

SEQ ID NO: 334817 - RNA, 64 nt, hsa; identical to SEQ ID NO: 110568

SEQ ID NO: 334818 - RNA, 64 nt, hsa; identical to SEQ ID NO: 110569

SEQ ID NO: 334819 - RNA, 64 nt, hsa; identical to SEQ ID NO: 110570

SEQ ID NO: 334820 - RNA, 64 nt, hsa; identical to SEQ ID NO: 110571

SEQ ID NO: 334821 - RNA, 64 nt, hsa; identical to SEQ ID NO: 110572

SEQ ID NO: 334822 - RNA, 64 nt, hsa; identical to SEQ ID NO: 110573

SEQ ID NO: 334823 - RNA, 64 nt, hsa; identical to SEQ ID NO: 110574

SEQ ID NO: 334824 - RNA, 64 nt, hsa; identical to SEQ ID NO: 110575

SEQ ID NO: 334825 - RNA, 64 nt, hsa; identical to SEQ ID NO: 110576

SEQ ID NO: 334826 - RNA, 64 nt, hsa; identical to SEQ ID NO: 110577

SEQ ID NO: 334827 - RNA, 64 nt, hsa; identical to SEQ ID NO: 110578

SEQ ID NO: 334828 - RNA, 64 nt, hsa; identical to SEQ ID NO: 110579

SEQ ID NO: 334829 - RNA, 64 nt, hsa; identical to SEQ ID NO: 110580

SEQ ID NO: 334830 - RNA, 64 nt, hsa; identical to SEQ ID NO: 110581

SEQ ID NO: 334831 - RNA, 64 nt, hsa; identical to SEQ ID NO: 110582

SEQ ID NO: 334832 - RNA, 64 nt, hsa; identical to SEQ ID NO: 110583

SEQ ID NO: 334833 - RNA, 64 nt, hsa; identical to SEQ ID NO: 110584

SEQ ID NO: 334834 - RNA, 64 nt, hsa; identical to SEQ ID NO: 110585

SEQ ID NO: 334835 - RNA, 64 nt, hsa; identical to SEQ ID NO: 110586

SEQ ID NO: 334836 - RNA, 64 nt, hsa; identical to SEQ ID NO: 110587

SEQ ID NO: 334837 - RNA, 64 nt, hsa; identical to SEQ ID NO: 110588

SEQ ID NO: 334838 - RNA, 64 nt, hsa; identical to SEQ ID NO: 110589

SEQ ID NO: 334839 - RNA, 64 nt, hsa; identical to SEQ ID NO: 110590

SEQ ID NO: 334840 - RNA, 64 nt, hsa; identical to SEQ ID NO: 110591

SEQ ID NO: 334841 - RNA, 64 nt, hsa; identical to SEQ ID NO: 110592

SEQ ID NO: 334842 - RNA, 64 nt, hsa; identical to SEQ ID NO: 110593

SEQ ID NO: 334843 - RNA, 64 nt, hsa; identical to SEQ ID NO: 110594

SEQ ID NO: 334844 - RNA, 64 nt, hsa; identical to SEQ ID NO: 110595

SEQ ID NO: 334845 - RNA, 64 nt, hsa; identical to SEQ ID NO: 110596

SEQ ID NO: 334846 - RNA, 64 nt, hsa; identical to SEQ ID NO: 110597

SEQ ID NO: 334847 - RNA, 64 nt, hsa; identical to SEQ ID NO: 110598

SEQ ID NO: 334848 - RNA, 64 nt, hsa; identical to SEQ ID NO: 110599

SEQ ID NO: 334849 - RNA, 64 nt, hsa; identical to SEQ ID NO: 110600

SEQ ID NO: 334850 - RNA, 64 nt, hsa; identical to SEQ ID NO: 110601

SEQ ID NO: 334851 - RNA, 64 nt, hsa; identical to SEQ ID NO: 110602

SEQ ID NO: 334852 - RNA, 64 nt, hsa; identical to SEQ ID NO: 110603

SEQ ID NO: 334853 - RNA, 64 nt, hsa; identical to SEQ ID NO: 110604

SEQ ID NO: 334854 - RNA, 64 nt, hsa; identical to SEQ ID NO: 110605

SEQ ID NO: 334855 - RNA, 64 nt, hsa; identical to SEQ ID NO: 110606

SEQ ID NO: 334856 - RNA, 64 nt, hsa; identical to SEQ ID NO: 110607

SEQ ID NO: 334857 - RNA, 64 nt, hsa; identical to SEQ ID NO: 110608

SEQ ID NO: 334858 - RNA, 64 nt, hsa; identical to SEQ ID NO: 110609

SEQ ID NO: 334859 - RNA, 64 nt, hsa; identical to SEQ ID NO: 110610

SEQ ID NO: 334860 - RNA, 64 nt, hsa; identical to SEQ ID NO: 110611

SEQ ID NO: 334861 - RNA, 64 nt, hsa; identical to SEQ ID NO: 110612

SEQ ID NO: 334862 - RNA, 64 nt, hsa; identical to SEQ ID NO: 110613

SEQ ID NO: 334863 - RNA, 64 nt, hsa; identical to SEQ ID NO: 110614

SEQ ID NO: 334864 - RNA, 64 nt, hsa; identical to SEQ ID NO: 110615

SEQ ID NO: 334865 - RNA, 64 nt, hsa; identical to SEQ ID NO: 110616

SEQ ID NO: 334866 - RNA, 64 nt, hsa; identical to SEQ ID NO: 110617

SEQ ID NO: 334867 - RNA, 64 nt, hsa; identical to SEQ ID NO: 110618

SEQ ID NO: 334868 - RNA, 64 nt, hsa; identical to SEQ ID NO: 110619

SEQ ID NO: 334869 - RNA, 64 nt, hsa; identical to SEQ ID NO: 110620

SEQ ID NO: 334870 - RNA, 64 nt, hsa; identical to SEQ ID NO: 110621

SEQ ID NO: 334871 - RNA, 64 nt, hsa; identical to SEQ ID NO: 110622

SEQ ID NO: 334872 - RNA, 64 nt, hsa; identical to SEQ ID NO: 110623

SEQ ID NO: 334873 - RNA, 64 nt, hsa; identical to SEQ ID NO: 110624

SEQ ID NO: 334874 - RNA, 64 nt, hsa; identical to SEQ ID NO: 110625

SEQ ID NO: 334875 - RNA, 64 nt, hsa; identical to SEQ ID NO: 110626

SEQ ID NO: 334876 - RNA, 64 nt, hsa; identical to SEQ ID NO: 110627

SEQ ID NO: 334877 - RNA, 64 nt, hsa; identical to SEQ ID NO: 110628

SEQ ID NO: 334878 - RNA, 64 nt, hsa; identical to SEQ ID NO: 110629

SEQ ID NO: 334879 - RNA, 64 nt, hsa; identical to SEQ ID NO: 110630

SEQ ID NO: 334880 - RNA, 64 nt, hsa; identical to SEQ ID NO: 110631

SEQ ID NO: 334881 - RNA, 64 nt, hsa; identical to SEQ ID NO: 110632

SEQ ID NO: 334882 - RNA, 64 nt, hsa; identical to SEQ ID NO: 110633

SEQ ID NO: 334883 - RNA, 64 nt, hsa; identical to SEQ ID NO: 110634

SEQ ID NO: 334884 - RNA, 64 nt, hsa; identical to SEQ ID NO: 110635

SEQ ID NO: 334885 - RNA, 64 nt, hsa; identical to SEQ ID NO: 110636

SEQ ID NO: 334886 - RNA, 64 nt, hsa; identical to SEQ ID NO: 110637

SEQ ID NO: 334887 - RNA, 64 nt, hsa; identical to SEQ ID NO: 110638

SEQ ID NO: 334888 - RNA, 64 nt, hsa; identical to SEQ ID NO: 110639

SEQ ID NO: 334889 - RNA, 64 nt, hsa; identical to SEQ ID NO: 110640

SEQ ID NO: 334890 - RNA, 64 nt, hsa; identical to SEQ ID NO: 110641

SEQ ID NO: 334891 - RNA, 64 nt, hsa; identical to SEQ ID NO: 110642

SEQ ID NO: 334892 - RNA, 64 nt, hsa; identical to SEQ ID NO: 110643

SEQ ID NO: 334893 - RNA, 64 nt, hsa; identical to SEQ ID NO: 110644

SEQ ID NO: 334894 - RNA, 64 nt, hsa; identical to SEQ ID NO: 110645

SEQ ID NO: 334895 - RNA, 64 nt, hsa; identical to SEQ ID NO: 110646

SEQ ID NO: 334896 - RNA, 64 nt, hsa; identical to SEQ ID NO: 110647

SEQ ID NO: 334897 - RNA, 64 nt, hsa; identical to SEQ ID NO: 110648

SEQ ID NO: 334898 - RNA, 64 nt, hsa; identical to SEQ ID NO: 110649

SEQ ID NO: 334899 - RNA, 64 nt, hsa; identical to SEQ ID NO: 110650

SEQ ID NO: 334900 - RNA, 64 nt, hsa; identical to SEQ ID NO: 110651

SEQ ID NO: 334901 - RNA, 64 nt, hsa; identical to SEQ ID NO: 110652

SEQ ID NO: 334902 - RNA, 64 nt, hsa; identical to SEQ ID NO: 110653

SEQ ID NO: 334903 - RNA, 64 nt, hsa; identical to SEQ ID NO: 110654

SEQ ID NO: 334904 - RNA, 64 nt, hsa; identical to SEQ ID NO: 110655

SEQ ID NO: 334905 - RNA, 64 nt, hsa; identical to SEQ ID NO: 110656

SEQ ID NO: 334906 - RNA, 64 nt, hsa; identical to SEQ ID NO: 110657

SEQ ID NO: 334907 - RNA, 64 nt, hsa; identical to SEQ ID NO: 110658

SEQ ID NO: 334908 - RNA, 64 nt, hsa; identical to SEQ ID NO: 110659

SEQ ID NO: 334909 - RNA, 64 nt, hsa; identical to SEQ ID NO: 110660

SEQ ID NO: 334910 - RNA, 64 nt, hsa; identical to SEQ ID NO: 110661

SEQ ID NO: 334911 - RNA, 64 nt, hsa; identical to SEQ ID NO: 110662

SEQ ID NO: 334912 - RNA, 64 nt, hsa; identical to SEQ ID NO: 110663

SEQ ID NO: 334913 - RNA, 64 nt, hsa; identical to SEQ ID NO: 110664

SEQ ID NO: 334914 - RNA, 64 nt, hsa; identical to SEQ ID NO: 110665

SEQ ID NO: 334915 - RNA, 64 nt, hsa; identical to SEQ ID NO: 110666

SEQ ID NO: 334916 - RNA, 64 nt, hsa; identical to SEQ ID NO: 110667

SEQ ID NO: 334917 - RNA, 64 nt, hsa; identical to SEQ ID NO: 110668

SEQ ID NO: 334918 - RNA, 64 nt, hsa; identical to SEQ ID NO: 110669

SEQ ID NO: 334919 - RNA, 64 nt, hsa; identical to SEQ ID NO: 110670

SEQ ID NO: 334920 - RNA, 64 nt, hsa; identical to SEQ ID NO: 110671

SEQ ID NO: 334921 - RNA, 64 nt, hsa; identical to SEQ ID NO: 110672

SEQ ID NO: 334922 - RNA, 64 nt, hsa; identical to SEQ ID NO: 110673

SEQ ID NO: 334923 - RNA, 64 nt, hsa; identical to SEQ ID NO: 110674

SEQ ID NO: 334924 - RNA, 64 nt, hsa; identical to SEQ ID NO: 110675

SEQ ID NO: 334925 - RNA, 64 nt, hsa; identical to SEQ ID NO: 110676

SEQ ID NO: 334926 - RNA, 64 nt, hsa; identical to SEQ ID NO: 110677

SEQ ID NO: 334927 - RNA, 64 nt, hsa; identical to SEQ ID NO: 110678

SEQ ID NO: 334928 - RNA, 64 nt, hsa; identical to SEQ ID NO: 110679

SEQ ID NO: 334929 - RNA, 64 nt, hsa; identical to SEQ ID NO: 110680

SEQ ID NO: 334930 - RNA, 64 nt, hsa; identical to SEQ ID NO: 110681

SEQ ID NO: 334931 - RNA, 64 nt, hsa; identical to SEQ ID NO: 110682

SEQ ID NO: 334932 - RNA, 64 nt, hsa; identical to SEQ ID NO: 110683

SEQ ID NO: 334933 - RNA, 64 nt, hsa; identical to SEQ ID NO: 110684

SEQ ID NO: 334934 - RNA, 64 nt, hsa; identical to SEQ ID NO: 110685

SEQ ID NO: 334935 - RNA, 64 nt, hsa; identical to SEQ ID NO: 110686

SEQ ID NO: 334936 - RNA, 64 nt, hsa; identical to SEQ ID NO: 110687

SEQ ID NO: 334937 - RNA, 64 nt, hsa; identical to SEQ ID NO: 110688

SEQ ID NO: 334938 - RNA, 64 nt, hsa; identical to SEQ ID NO: 110689

SEQ ID NO: 334939 - RNA, 64 nt, hsa; identical to SEQ ID NO: 110690

SEQ ID NO: 334940 - RNA, 64 nt, hsa; identical to SEQ ID NO: 110691

SEQ ID NO: 334941 - RNA, 64 nt, hsa; identical to SEQ ID NO: 110692

SEQ ID NO: 334942 - RNA, 64 nt, hsa; identical to SEQ ID NO: 110693

SEQ ID NO: 334943 - RNA, 51 nt, hsa; identical to SEQ ID NO: 110694

SEQ ID NO: 334944 - RNA, 64 nt, hsa; identical to SEQ ID NO: 110695

SEQ ID NO: 334945 - RNA, 64 nt, hsa; identical to SEQ ID NO: 110696

SEQ ID NO: 334946 - RNA, 64 nt, hsa; identical to SEQ ID NO: 110697

SEQ ID NO: 334947 - RNA, 64 nt, hsa; identical to SEQ ID NO: 110698

SEQ ID NO: 334948 - RNA, 64 nt, hsa; identical to SEQ ID NO: 110699

SEQ ID NO: 334949 - RNA, 64 nt, hsa; identical to SEQ ID NO: 110700

SEQ ID NO: 334950 - RNA, 64 nt, hsa; identical to SEQ ID NO: 110701

SEQ ID NO: 334951 - RNA, 64 nt, hsa; identical to SEQ ID NO: 110702

SEQ ID NO: 334952 - RNA, 64 nt, hsa; identical to SEQ ID NO: 110703

SEQ ID NO: 334953 - RNA, 64 nt, hsa; identical to SEQ ID NO: 110704

SEQ ID NO: 334954 - RNA, 64 nt, hsa; identical to SEQ ID NO: 110705

SEQ ID NO: 334955 - RNA, 64 nt, hsa; identical to SEQ ID NO: 110706

SEQ ID NO: 334956 - RNA, 64 nt, hsa; identical to SEQ ID NO: 110707

SEQ ID NO: 334957 - RNA, 64 nt, hsa; identical to SEQ ID NO: 110708

SEQ ID NO: 334958 - RNA, 64 nt, hsa; identical to SEQ ID NO: 110709

SEQ ID NO: 334959 - RNA, 64 nt, hsa; identical to SEQ ID NO: 110710

SEQ ID NO: 334960 - RNA, 64 nt, hsa; identical to SEQ ID NO: 110711

SEQ ID NO: 334961 - RNA, 64 nt, hsa; identical to SEQ ID NO: 110712

SEQ ID NO: 334962 - RNA, 64 nt, hsa; identical to SEQ ID NO: 110713

SEQ ID NO: 334963 - RNA, 64 nt, hsa; identical to SEQ ID NO: 110714

SEQ ID NO: 334964 - RNA, 64 nt, hsa; identical to SEQ ID NO: 110715

SEQ ID NO: 334965 - RNA, 64 nt, hsa; identical to SEQ ID NO: 110716

SEQ ID NO: 334966 - RNA, 64 nt, hsa; identical to SEQ ID NO: 110717

SEQ ID NO: 334967 - RNA, 64 nt, hsa; identical to SEQ ID NO: 110718

SEQ ID NO: 334968 - RNA, 64 nt, hsa; identical to SEQ ID NO: 110719

SEQ ID NO: 334969 - RNA, 64 nt, hsa; identical to SEQ ID NO: 110720

SEQ ID NO: 334970 - RNA, 64 nt, hsa; identical to SEQ ID NO: 110721

SEQ ID NO: 334971 - RNA, 64 nt, hsa; identical to SEQ ID NO: 110722

SEQ ID NO: 334972 - RNA, 64 nt, hsa; identical to SEQ ID NO: 110723

SEQ ID NO: 334973 - RNA, 64 nt, hsa; identical to SEQ ID NO: 110724

SEQ ID NO: 334974 - RNA, 64 nt, hsa; identical to SEQ ID NO: 110725

SEQ ID NO: 334975 - RNA, 64 nt, hsa; identical to SEQ ID NO: 110726

SEQ ID NO: 334976 - RNA, 64 nt, hsa; identical to SEQ ID NO: 110727

SEQ ID NO: 334977 - RNA, 64 nt, hsa; identical to SEQ ID NO: 110728

SEQ ID NO: 334978 - RNA, 64 nt, hsa; identical to SEQ ID NO: 110729

SEQ ID NO: 334979 - RNA, 64 nt, hsa; identical to SEQ ID NO: 110730

SEQ ID NO: 334980 - RNA, 64 nt, hsa; identical to SEQ ID NO: 110731

SEQ ID NO: 334981 - RNA, 64 nt, hsa; identical to SEQ ID NO: 110732

SEQ ID NO: 334982 - RNA, 64 nt, hsa; identical to SEQ ID NO: 110733

SEQ ID NO: 334983 - RNA, 64 nt, hsa; identical to SEQ ID NO: 110734

SEQ ID NO: 334984 - RNA, 64 nt, hsa; identical to SEQ ID NO: 110735

SEQ ID NO: 334985 - RNA, 64 nt, hsa; identical to SEQ ID NO: 110736

SEQ ID NO: 334986 - RNA, 64 nt, hsa; identical to SEQ ID NO: 110737

SEQ ID NO: 334987 - RNA, 64 nt, hsa; identical to SEQ ID NO: 110738

SEQ ID NO: 334988 - RNA, 64 nt, hsa; identical to SEQ ID NO: 110739

SEQ ID NO: 334989 - RNA, 64 nt, hsa; identical to SEQ ID NO: 110740

SEQ ID NO: 334990 - RNA, 64 nt, hsa; identical to SEQ ID NO: 110741

SEQ ID NO: 334991 - RNA, 64 nt, hsa; identical to SEQ ID NO: 110742

SEQ ID NO: 334992 - RNA, 64 nt, hsa; identical to SEQ ID NO: 110741

SEQ ID NO: 334993 - RNA, 64 nt, hsa; identical to SEQ ID NO: 110744

SEQ ID NO: 334994 - RNA, 64 nt, hsa; identical to SEQ ID NO: 110745

SEQ ID NO: 334995 - RNA, 64 nt, hsa; identical to SEQ ID NO: 110746

SEQ ID NO: 334996 - RNA, 64 nt, hsa; identical to SEQ ID NO: 110747

SEQ ID NO: 334997 - RNA, 64 nt, hsa; identical to SEQ ID NO: 110748

SEQ ID NO: 334998 - RNA, 64 nt, hsa; identical to SEQ ID NO: 110749

SEQ ID NO: 334999 - RNA, 64 nt, hsa; identical to SEQ ID NO: 110750

SEQ ID NO: 335000 - RNA, 64 nt, hsa; identical to SEQ ID NO: 110751

SEQ ID NO: 335001 - RNA, 64 nt, hsa; identical to SEQ ID NO: 110752

SEQ ID NO: 335002 - RNA, 64 nt, hsa; identical to SEQ ID NO: 110753

SEQ ID NO: 335003 - RNA, 64 nt, hsa; identical to SEQ ID NO: 110754

SEQ ID NO: 335004 - RNA, 64 nt, hsa; identical to SEQ ID NO: 110755

SEQ ID NO: 335005 - RNA, 64 nt, hsa; identical to SEQ ID NO: 110756

SEQ ID NO: 335006 - RNA, 64 nt, hsa; identical to SEQ ID NO: 110757

SEQ ID NO: 335007 - RNA, 64 nt, hsa; identical to SEQ ID NO: 110758

SEQ ID NO: 335008 - RNA, 64 nt, hsa; identical to SEQ ID NO: 110759

SEQ ID NO: 335009 - RNA, 64 nt, hsa; identical to SEQ ID NO: 110760

SEQ ID NO: 335010 - RNA, 64 nt, hsa; identical to SEQ ID NO: 110761

SEQ ID NO: 335011 - RNA, 64 nt, hsa; identical to SEQ ID NO: 110762

SEQ ID NO: 335012 - RNA, 64 nt, hsa; identical to SEQ ID NO: 110763

SEQ ID NO: 335013 - RNA, 64 nt, hsa; identical to SEQ ID NO: 110764

SEQ ID NO: 335014 - RNA, 64 nt, hsa; identical to SEQ ID NO: 110765

SEQ ID NO: 335015 - RNA, 64 nt, hsa; identical to SEQ ID NO: 110766

SEQ ID NO: 335016 - RNA, 64 nt, hsa; identical to SEQ ID NO: 110767

SEQ ID NO: 335017 - RNA, 64 nt, hsa; identical to SEQ ID NO: 110768

SEQ ID NO: 335018 - RNA, 64 nt, hsa; identical to SEQ ID NO: 110769

SEQ ID NO: 335019 - RNA, 64 nt, hsa; identical to SEQ ID NO: 110770

SEQ ID NO: 335020 - RNA, 64 nt, hsa; identical to SEQ ID NO: 110771

SEQ ID NO: 335021 - RNA, 64 nt, hsa; identical to SEQ ID NO: 110772

SEQ ID NO: 335022 - RNA, 64 nt, hsa; identical to SEQ ID NO: 110773

SEQ ID NO: 335023 - RNA, 64 nt, hsa; identical to SEQ ID NO: 110774

SEQ ID NO: 335024 - RNA, 64 nt, hsa; identical to SEQ ID NO: 110775

SEQ ID NO: 335025 - RNA, 64 nt, hsa; identical to SEQ ID NO: 110776

SEQ ID NO: 335026 - RNA, 64 nt, hsa; identical to SEQ ID NO: 110777

SEQ ID NO: 335027 - RNA, 64 nt, hsa; identical to SEQ ID NO: 110778

SEQ ID NO: 335028 - RNA, 64 nt, hsa; identical to SEQ ID NO: 110779

SEQ ID NO: 335029 - RNA, 64 nt, hsa
cuuuccacacaggauuccguuggugaaccuguaaaaacaaaacaaacaaaacaaaacaaaaaag

SEQ ID NO: 335030 - RNA, 64 nt, hsa
caggauuccguuggugaaccuguaaaaacaaaacaaacaaaacaaaacaaaaaagacaaaaccu

SEQ ID NO: 335031 - RNA, 64 nt, hsa
uuccguuggugaaccuguaaaaacaaaacaaacaaaacaaaacaaaaaagacaaaaccuaaaac

SEQ ID NO: 335032 - RNA, 64 nt, hsa
uuggugaaccuguaaaaacaaaacaaacaaaacaaaacaaaaaagacaaaaccuaaaacugagc

SEQ ID NO: 335033 - RNA, 64 nt, hsa
cuugcacugcuguggauuuuuuuaagagaagcaaaaacaaaaguaaacuccuuucccuggcccu

SEQ ID NO: 335034 - RNA, 64 nt, hsa
cuuuugaaaugucccuuuaagauuuuuuuauucuaaacaaaauaaagaaaauccugcugcucug

SEQ ID NO: 335035 - RNA, 64 nt, hsa
acuccagccugguuacagagcaagacucugucucaaacaaaacaaaacaaaacaaaaacacacu

SEQ ID NO: 335036 - RNA, 64 nt, hsa
agccugguuacagagcaagacucugucucaaacaaaacaaaacaaaacaaaaacacacuacugu

SEQ ID NO: 335037 - RNA, 64 nt, hsa
gguuacagagcaagacucugucucaaacaaaacaaaacaaaacaaaaacacacuacuguauuuu

SEQ ID NO: 335038 - RNA, 64 nt, hsa
cagagcaagacucugucucaaacaaaacaaaacaaaacaaaaacacacuacuguauuuuggaug

SEQ ID NO: 335039 - RNA, 64 nt, hsa
gcauuccucaucaccaucguguuugcaaagguuaaaacaaaaacaaaaaaccacaaaaauaaaa

SEQ ID NO: 335040 - RNA, 64 nt, hsa
cucaucaccaucguguuugcaaagguuaaaacaaaaacaaaaaaccacaaaaauaaaaaacaaa

SEQ ID NO: 335041 - RNA, 64 nt, hsa
gguuaaaacaaaaacaaaaaaccacaaaaauaaaaaacaaaaaaaacaaaaaacccaagaaaaa

SEQ ID NO: 335042 - RNA, 64 nt, hsa
aaaaacaaaaaaccacaaaaauaaaaaacaaaaaaaacaaaaaacccaagaaaaaaaaaaagag

SEQ ID NO: 335043 - RNA, 64 nt, hsa
aagcaaaccaauaccauugauaagaagaagauaaaaacaaaauauuuuggaguguuuuccaacu

SEQ ID NO: 335044 - RNA, 64 nt, hsa
gcugguuuuaguacucugaaggacaaaaacaagcaaacaaaaaccccugcugcagcauuucagg

SEQ ID NO: 335045 - RNA, 64 nt, hsa
cucugcauguauauuugauaacaugucuuuuguaaaacaaaaauuacaaaaaaauuuguuuaca

SEQ ID NO: 335046 - RNA, 64 nt, hsa
cagccuggcgacacagugagacucugucucaaaaaaacaaaacaaacaaacaaaaauacaaaaa

SEQ ID NO: 335047 - RNA, 64 nt, hsa
cagugagacucugucucaaaaaaacaaaacaaacaaacaaaaauacaaaaaauuagccgggcgu

SEQ ID NO: 335048 - RNA, 64 nt, hsa
aggcaggagcccuggggugagaaaagcaaaaaacaaacaaaaaacaaaacccuggaguguuagg

SEQ ID NO: 335049 - RNA, 64 nt, hsa
agcccuggggugagaaaagcaaaaaacaaacaaaaaacaaaacccuggaguguuaggaggagag

SEQ ID NO: 335050 - RNA, 64 nt, hsa
gagacaaacuuuuuuuagaauugaagucugaaacaaacaaaagcaauucaaugucaauagacau

SEQ ID NO: 335051 - RNA, 64 nt, hsa
acacuuguucuuuacagaaaaauaaagauauuuuaaacaaaauacuagggccaugguauguaau

SEQ ID NO: 335052 - RNA, 64 nt, hsa
agauuaagaaaaagaaccagcugaaccaugaaacaaacaaaaauccuaaaagugauucuuguca

SEQ ID NO: 335053 - RNA, 64 nt, hsa
guaggaaauguucuuuuuuaaaaaaaaauaacaaaaacaaaacaaaacuauuuauuuugugauu

SEQ ID NO: 335054 - RNA, 64 nt, hsa
aaauguucuuuuuuaaaaaaaaauaacaaaaacaaaacaaaacuauuuauuuugugauuguuuu

SEQ ID NO: 335055 - RNA, 64 nt, hsa
cuuaaugaacuugcaaaggaauauugcuaaaaacaaacaaaaaaaacuguuaucgaacuuucuu

SEQ ID NO: 335056 - RNA, 64 nt, hsa
uacuuuauuuuuuugugccuucugaaaggaucuaaaacaaaaauauuuugccuuuuuuucccca

SEQ ID NO: 335057 - RNA, 64 nt, hsa
aaauaugucaugugaaauuauuuuaaaaauguaaaaacaaaacuuucugcuaacaaaauacaua

SEQ ID NO: 335058 - RNA, 64 nt, hsa
aaaaguuaagcuuuugcaaaguugucaaaaguucaaacaaaagucuaguugggauuuuuuacca

SEQ ID NO: 335059 - RNA, 64 nt, hsa
gcauaaguuacaaccccuaggagcucugcuuucaaaacaaaaagagauugggggaguggggagg

SEQ ID NO: 335060 - RNA, 64 nt, hsa
aggaugucaaauagucacaguucuaaguaguuggaaacaaaauugacgcauguuaaucuaugca

SEQ ID NO: 335061 - RNA, 64 nt, hsa
auguuuaaaucaaucuguaaaagguaaaaaugaaaaacaaaaacaagcaaacaaacaaaaaaca

SEQ ID NO: 335062 - RNA, 64 nt, hsa
aaaagguaaaaaugaaaaacaaaaacaagcaaacaaacaaaaaacaauggaaaagaugaagcug

SEQ ID NO: 335063 - RNA, 64 nt, hsa
uauauguucagcaauguugaucucauaaaaggaaaaacaaaagauuuaaguauucuauauacca

SEQ ID NO: 335064 - RNA, 64 nt, hsa
uuaacuaaaaaugcugagaccccuuuuuauagaaaaacaaaaagacaucaagucuucuuaauuc

SEQ ID NO: 335065 - RNA, 63 nt, hsa
ugagaucgcgguauuaaaucugugaaagaaaacaaaacaaaacaaaaacggcuucuuggcguu

SEQ ID NO: 335066 - RNA, 64 nt, hsa
uuggcugagaucgcgguauuaaaucugugaaagaaaacaaaacaaaacaaaaacggcuucuugg

SEQ ID NO: 335067 - RNA, 64 nt, hsa
aaacaaagcgagacccugucuccacuaaacauaaaaacaaaauuacuggggccccauggcacac

SEQ ID NO: 335068 - RNA, 64 nt, hsa
aacaacccaaauguccaagaaugaauaaauggauaaacaaaauaugguauauuuauacaacaga

SEQ ID NO: 335069 - RNA, 64 nt, hsa
aaggcuuguaaauacauagaacaaauauuuaaaaaaacaaaaagaaauugacucaguacuauuu

SEQ ID NO: 335070 - RNA, 64 nt, hsa
cugaggauaacuaaaacuucaaauacacaaaaugaaacaaaagaaacaauuuaaguauuuuuuu

SEQ ID NO: 335071 - RNA, 64 nt, hsa
gcaaaaaaaaaaaaaaaacaaaaaaacaaaaaaaaaacaaaacaguuuuuaaaacugauuuuag

SEQ ID NO: 335072 - RNA, 64 nt, hsa
aauaguccugagcaaaaaaaaaaaaaaaacaaaaaaacaaaaaaaaaacaaaacaguuuuuaaa

SEQ ID NO: 335073 - RNA, 64 nt, hsa
ugaaagcaaauaguccugagcaaaaaaaaaaaaaaaacaaaaaaacaaaaaaaaaacaaaacag

SEQ ID NO: 335074 - RNA, 64 nt, hsa
uccccaccuccucauuuuaguaaaaaacaaacaaaaacaaaaaaaccugagaaguuugaauugu

SEQ ID NO: 335075 - RNA, 64 nt, hsa
agcucuuccccaccuccucauuuuaguaaaaaacaaacaaaaacaaaaaaaccugagaaguuug

SEQ ID NO: 335076 - RNA, 64 nt, hsa
cuguagauucucuccucucccaucccagaaaacaaaacaaaauaaugcuuuucgaaauuguuuc

SEQ ID NO: 335077 - RNA, 64 nt, hsa
caaaucuguagauucucuccucucccaucccagaaaacaaaacaaaauaaugcuuuucgaaauu

SEQ ID NO: 335078 - RNA, 64 nt, hsa
cccaccugggcacuuuuagauaaaaaaaaaaaaaaaacaaaaaacaacaccaaaaaaacagcag

SEQ ID NO: 335079 - RNA, 64 nt, hsa
ccucaaccacucuccuaaugauuggaacaaaagcaaacaaaaaagaaaucucucuauaaaauga

SEQ ID NO: 335080 - RNA, 64 nt, hsa
cauuuuaaggaacuauucuuuggaaaaaaacaaaaaacaaaaaaaacaacaaaaaaagcuaagu

SEQ ID NO: 335081 - RNA, 64 nt, hsa
gagcauccauuuuaaggaacuauucuuuggaaaaaaacaaaaaacaaaaaaaacaacaaaaaaa

SEQ ID NO: 335082 - RNA, 64 nt, hsa
agcgacacucggucucaaaaaacaaaacaaaacaaaacaaaauuagagauugggucuuucccag

SEQ ID NO: 335083 - RNA, 64 nt, hsa
gacagagcgacacucggucucaaaaaacaaaacaaaacaaaacaaaauuagagauugggucuuu

SEQ ID NO: 335084 - RNA, 64 nt, hsa
ugggugacagagcgacacucggucucaaaaaacaaaacaaaacaaaacaaaauuagagauuggg

SEQ ID NO: 335085 - RNA, 64 nt, hsa
cagccugggugacagagcgacacucggucucaaaaaacaaaacaaaacaaaacaaaauuagaga

SEQ ID NO: 335086 - RNA, 64 nt, hsa
cuguacaaaggggaaagaacauaaagguaaaacaaaacaaaacaacauuuugagaacaaagaug

SEQ ID NO: 335087 - RNA, 64 nt, hsa
agcaucuguacaaaggggaaagaacauaaagguaaaacaaaacaaaacaacauuuugagaacaa

SEQ ID NO: 335088 - RNA, 64 nt, hsa
cuguuuguggcuauuuuaaauucauauuauuaaaaaacaaaaaaaacccaccuauuuguguugu

SEQ ID NO: 335089 - RNA, 64 nt, hsa
cugugaauaaaggaauguauagauguuuggauggaaacaaaagcacuagacugaguuuccucuu

SEQ ID NO: 335090 - RNA, 64 nt, hsa
aaacaaaacuuuggaccaaaaucccaguucaaagaaacaaaaaaaagaguggaaacuauucuau

SEQ ID NO: 335091 - RNA, 54 nt, hsa
gaggcagaagcagauacuagaaacaaacaaaacuuuggaccaaaaucccaguuc

SEQ ID NO: 335092 - RNA, 64 nt, hsa
ggcgacagagcaagacgccaucucaaaaacaaaaaaacaaaauucauguuacuaaaagacaggu

SEQ ID NO: 335093 - RNA, 64 nt, hsa
ccagccugggcgacagagcaagacgccaucucaaaaacaaaaaaacaaaauucauguuacuaaa

SEQ ID NO: 335094 - RNA, 64 nt, hsa
gaguauaugugucuuaaugcagucagauuguaaaaaacaaaaacaaagaaacuaagaaucuuac

SEQ ID NO: 335095 - RNA, 59 nt, hsa
acuacaaaagaaaaauauaaaaguaaaacaaacaaaaacaaaccugaaaacugcuuggc

SEQ ID NO: 335096 - RNA, 64 nt, hsa
cuaaacaaaagaaaaccuaaacuaaugucauuggaaacaaaagcuugaaagaaacacaucgcau

SEQ ID NO: 335097 - RNA, 64 nt, hsa
cugaaagaaagaagacugcaaucaagugagagcuaaacaaaagaaaaccuaaacuaaugucauu

SEQ ID NO: 335098 - RNA, 64 nt, hsa
cuaggacccgguuucuuuuacugauuuaaaaacaaaacaaaaaaaaauaaaaaaguugugccug

SEQ ID NO: 335099 - RNA, 64 nt, hsa
agcuucuaggacccgguuucuuuuacugauuuaaaaacaaaacaaaaaaaaauaaaaaaguugu

SEQ ID NO: 335100 - RNA, 64 nt, hsa
ccagcagugugauaauuuaaacauauuuaaacaaaaacaaaaaaaaugaaugcacaaacuugcu

SEQ ID NO: 335101 - RNA, 64 nt, hsa
ggagugccagcagugugauaauuuaaacauauuuaaacaaaaacaaaaaaaaugaaugcacaaa

SEQ ID NO: 335102 - RNA, 64 nt, hsa
cuucacuugccuagucuugaagaaaaaaaacaaaaaacaaaaaaaaaccuuguuccuuuauagg

SEQ ID NO: 335103 - RNA, 64 nt, hsa
cccacugcuucacuugccuagucuugaagaaaaaaaacaaaaaacaaaaaaaaaccuuguuccu

SEQ ID NO: 335104 - RNA, 64 nt, hsa
auaaagccccucuuugcauuuaaaaccaaagucaaaacaaaacucuuguaaugcaauuaauuaa

SEQ ID NO: 335105 - RNA, 64 nt, hsa
acaggaaauaugacuuggaagugcucuguguacuaaacaaaauaaagccccucuuugcauuuaa

SEQ ID NO: 335106 - RNA, 64 nt, hsa
cuucaccuuguacugcaagaugaauuuguaaacaaaacaaaauuggacugucuggaaagcuaaa

SEQ ID NO: 335107 - RNA, 64 nt, hsa
uuuggcuucaccuuguacugcaagaugaauuuguaaacaaaacaaaauuggacugucuggaaag

SEQ ID NO: 335108 - RNA, 64 nt, hsa
acaucgugcagucgugucauaaaaaaacaaaacaaaacaaaaaaacacuaggaguccacucaac

SEQ ID NO: 335109 - RNA, 64 nt, hsa
gauccacaucgugcagucgugucauaaaaaaacaaaacaaaacaaaaaaacacuaggaguccac

SEQ ID NO: 335110 - RNA, 64 nt, hsa
gaccagauccacaucgugcagucgugucauaaaaaaacaaaacaaaacaaaaaaacacuaggag

SEQ ID NO: 335111 - RNA, 64 nt, hsa
guucccauucuaauuaaugcccuuucuuauuuaaaaacaaaaccaaaugauaucuaaguaguuc

SEQ ID NO: 335112 - RNA, 64 nt, hsa
auuuuaaaguacuuuugguuauuuuucugucaucaaacaaaaacagguaucagugcauuauuaa

SEQ ID NO: 335113 - RNA, 64 nt, hsa
aguuucaguggaugauugaaaacaacaacaacaaaaacaaaaugaaacuaaucugcugccucua

SEQ ID NO: 335114 - RNA, 64 nt, hsa
cuuuacagcaacauucgccauacuagcggagguaaaacaaaagaaauauugaaaacugaggcag

SEQ ID NO: 335115 - RNA, 64 nt, hsa
ugacauaacucauacaucggcacugaauuaaacaaaacaaaauacaacuguugcuauaucuuuu

SEQ ID NO: 335116 - RNA, 64 nt, hsa
aaaugugacauaacucauacaucggcacugaauuaaacaaaacaaaauacaacuguugcuauau

SEQ ID NO: 335117 - RNA, 64 nt, hsa
uucuauguugguuucaguggcuggaauuaaaacaaaacaaaacaaacuuccaaacaguguguug

SEQ ID NO: 335118 - RNA, 64 nt, hsa
auaacuucuauguugguuucaguggcuggaauuaaaacaaaacaaaacaaacuuccaaacagug

SEQ ID NO: 335119 - RNA, 64 nt, hsa
agcgagacucuaucucaaaaaaaaacaaaaaaaaaaacaaaaaacaaagaugagucgcacaucu

SEQ ID NO: 335120 - RNA, 64 nt, hsa
ccugggcaacagagcgagacucuaucucaaaaaaaaacaaaaaaaaaaacaaaaaacaaagaug

SEQ ID NO: 335121 - RNA, 64 nt, hsa
ucguuuccaaaacuauugcuacuuugugugcuuuaaacaaaauaccuuggguugaugaaacauc

SEQ ID NO: 335122 - RNA, 64 nt, hsa
uguacacagauguaauuaaaauuguaauccuaacaaacaaaagaaauguaguucagcuuuucaa

SEQ ID NO: 335123 - RNA, 64 nt, hsa
uuaaaaaucuuguuaaacauucuauaaagaaguaaaacaaaauccuuuuaucucaguuauuugc

SEQ ID NO: 335124 - RNA, 64 nt, hsa
auuucugauaauuaaccuaagcccuuaugaaaauaaacaaaaugaagggauuaugacagguauu

SEQ ID NO: 335125 - RNA, 64 nt, hsa
gugacugcuugcugacuuuaucauaauuuucuucaaacaaaaaaauguauagaaaaaucauguc

SEQ ID NO: 335126 - RNA, 64 nt, hsa
cuauaaucuauagacaugugauagcaaaagaaacaaacaaaagccaggaaaacacucauuuucg

SEQ ID NO: 335127 - RNA, 64 nt, hsa
ugguugcugcaaagcucaggccugaaugagcaggaaacaaaaaaggccuugcgacccagcugcc

SEQ ID NO: 335128 - RNA, 64 nt, hsa
uaggaguauuuauguaacuaucuuaugcuucaaaaaacaaaaguauuugugugcauguguauau

SEQ ID NO: 335129 - RNA, 64 nt, hsa
aaaaagauuccucguuauuguuguugccaaagagaaacaaaaaugauuuugcuuuccaagcuug

SEQ ID NO: 335130 - RNA, 64 nt, hsa
acuauuuaguaagcccggauagacuuauugccaaaaacaaaaaauagcuuucaaaagaaauuua

SEQ ID NO: 335131 - RNA, 64 nt, hsa
uuauagguaaugaagcaguucaaaacuugaaagaaaacaaaaccuguccucagaauucuauaaa

SEQ ID NO: 335132 - RNA, 64 nt, hsa
gcgacaacuuauauacacaccuagaauguaaguuaaacaaaauaccggcuuccagagaccccuu

SEQ ID NO: 335133 - RNA, 64 nt, hsa
uuuagaagucuuaguaauguaacuugaagauguuaaacaaaaaucucaaguaaaaugaaaagca

SEQ ID NO: 335134 - RNA, 64 nt, hsa
uggcaacagagcgagacucugucucagaaaaaaaaaacaaaaaccaguuuaggcuggguauggu

SEQ ID NO: 335135 - RNA, 64 nt, hsa
uguaaccaguagcugaucuuaaggcuuuuuuaaaaaacaaaacaaaacaacaaaaaaaaaucuu

SEQ ID NO: 335136 - RNA, 64 nt, hsa
ccaguagcugaucuuaaggcuuuuuuaaaaaacaaaacaaaacaacaaaaaaaaaucuuuauaa

SEQ ID NO: 335137 - RNA, 64 nt, hsa
aaggaacauugaacuguuagaggagugcucuuccaaacaaaacaaaaaugucucuagguuuagu

SEQ ID NO: 335138 - RNA, 64 nt, hsa
acauugaacuguuagaggagugcucuuccaaacaaaacaaaaaugucucuagguuuagucagag

SEQ ID NO: 335139 - RNA, 64 nt, hsa
accaacuuuuauuuggaauaauaauuuuccuccuaaacaaaaacacauugaguuuaagucucug

SEQ ID NO: 335140 - RNA, 64 nt, hsa
cccgugaacuuccuuugacuuauuguccccacuaaaacaaaacaaaaaacuuuuaaugccuucc

SEQ ID NO: 335141 - RNA, 64 nt, hsa
gaacuuccuuugacuuauuguccccacuaaaacaaaacaaaaaacuuuuaaugccuuccacauu

SEQ ID NO: 335142 - RNA, 64 nt, hsa
uccaguuuggacuacagagugagacuccaucucaaaacaaaacaaaacaacaacagcaaaaaac

SEQ ID NO: 335143 - RNA, 64 nt, hsa
uuuggacuacagagugagacuccaucucaaaacaaaacaaaacaacaacagcaaaaaacaacaa

SEQ ID NO: 335144 - RNA, 64 nt, hsa
aaacaaaacaaaacaacaacagcaaaaaacaacaaaacaaaacacaaauacucucacagggcau

SEQ ID NO: 335145 - RNA, 64 nt, hsa
aaaugcaguuccuuucauaauaucucagcaccagaaacaaaaauuaagauuaucaaagcauuuu

SEQ ID NO: 335146 - RNA, 64 nt, hsa
uaaaucaagaaggccaucacuuagaacgaaccccaaacaaaaaugccauaauauaaauguguga

SEQ ID NO: 335147 - RNA, 64 nt, hsa
cgccgaccuucagcuuugugggacuaucaggaaaaaacaaaacaaaaacaaaauguagaaaaag

SEQ ID NO: 335148 - RNA, 64 nt, hsa
accuucagcuuugugggacuaucaggaaaaaacaaaacaaaaacaaaauguagaaaaagcaaaa

SEQ ID NO: 335149 - RNA, 64 nt, hsa
agcuuugugggacuaucaggaaaaaacaaaacaaaaacaaaauguagaaaaagcaaaagcucuu

SEQ ID NO: 335150 - RNA, 64 nt, hsa
aguacucuucuuuccuccuacucuaugaacuucaaaacaaaaacaaaacuuugagagcagcaca

SEQ ID NO: 335151 - RNA, 64 nt, hsa
cuucuuuccuccuacucuaugaacuucaaaacaaaaacaaaacuuugagagcagcacaugcauc

SEQ ID NO: 335152 - RNA, 64 nt, hsa
uccagccugggcaacagagcaagacugucucaaaaaacaaaacgaaacaaaaaaagaaaguuau

SEQ ID NO: 335153 - RNA, 64 nt, hsa
gcaacagagcaagacugucucaaaaaacaaaacgaaacaaaaaaagaaaguuauucuuaguaag

SEQ ID NO: 335154 - RNA, 64 nt, hsa
auuagaaaaaaugaaguuugguuggugaugcaugaaacaaaauagcaagagaggguuauaguuu

SEQ ID NO: 335155 - RNA, 64 nt, hsa
guaggcaucaaaaggcaaaaaucaaaaaaaaaaaaaacaaaaacaaaaaaaaagaugaaccuag

SEQ ID NO: 335156 - RNA, 64 nt, hsa
aucaaaaggcaaaaaucaaaaaaaaaaaaaacaaaaacaaaaaaaaagaugaaccuaggucugu

SEQ ID NO: 335157 - RNA, 64 nt, hsa
acuuaaaagaaagagaaguuuucuugacuuuugaaaacaaaauaugaaaagaaucggcaauguu

SEQ ID NO: 335158 - RNA, 64 nt, hsa
gaaaacaaaauaugaaaagaaucggcaauguuucaaacaaaaagucauaaaagucacuuuauuc

SEQ ID NO: 335159 - RNA, 64 nt, hsa
ggccaccucccucccgcccacccacucucaccccaaacaaaaucacaaaaccuggacaucccuc

SEQ ID NO: 335160 - RNA, 64 nt, hsa
ugaguauuauuugacuccggucuccuuggugcaaaaacaaaaugggaaaaauaaauaagaauaa

SEQ ID NO: 335161 - RNA, 64 nt, hsa
ugauuuuucaauguuauucuucaguccuauuuaaaaacaaaaccaagcucccuucccuuccucc

SEQ ID NO: 335162 - RNA, 64 nt, hsa
aaguaucagcacccagaagagaaaaaggaauuuaaaacaaaaaccacagaggcggaaauaccgg

SEQ ID NO: 335163 - RNA, 64 nt, hsa
gcaaacugagguagcgacacaaaguuaaacaaacaaacaaaaaacacaaaacauaauaaaacac

SEQ ID NO: 335164 - RNA, 64 nt, hsa
agcuuugacucuauaagcaaauugcuuuuuuccaaaacaaaaagaugucucagguuuguuuugu

SEQ ID NO: 335165 - RNA, 64 nt, hsa
auaugcuuauaaccuaguuaaagaaaggaaaagaaaacaaaaaacgaaugaaaauaacugaauu

SEQ ID NO: 335166 - RNA, 64 nt, hsa
ugaaauauaaggcacguuuucacacaaaauuucaaaacaaaaacaagagggcauagaugcaauc

SEQ ID NO: 335167 - RNA, 64 nt, hsa
cucaugcucuuguuucucaaaaaagaaaaacaaaaaacaaaaaacaggggccaauaaauucccu

SEQ ID NO: 335168 - RNA, 64 nt, hsa
caaguaucucaugcucuuguuucucaaaaaagaaaaacaaaaaacaaaaaacaggggccaauaa

SEQ ID NO: 335169 - RNA, 64 nt, hsa
uuauuuguaugcuucaaaaaaaaaaaaaagagagaaacaaaaaagugugacauuacagaugaga

SEQ ID NO: 335170 - RNA, 64 nt, hsa
guuaaucaucauuuuuccuuuaguuuaauuuuauaaacaaaacugauuauaccaguauaaaagc

SEQ ID NO: 335171 - RNA, 64 nt, hsa
gagagaaaaggguguuuuaaauuuaaaaaaauaaaaacaaaaaaguuugauugagacaaugaag

SEQ ID NO: 335172 - RNA, 64 nt, hsa
gguuaggucaugaggacaccaaaaaccuaaaaauaaacaaaaagccaaacaagccuuagcuuuu

SEQ ID NO: 335173 - RNA, 64 nt, hsa
uuugaaaauaaaucuuaguguucaaaacaaaaugaaacaaaaaaaaaaugauaaaaacucucag

SEQ ID NO: 335174 - RNA, 64 nt, hsa
cugugugcuguuugaaaauaaaucuuaguguucaaaacaaaaugaaacaaaaaaaaaaugauaa

SEQ ID NO: 335175 - RNA, 64 nt, hsa
aguuuauaucuugauuauuuuguugucuaaagcuaaacaaaacuugcaugcagcagcuuuugac

SEQ ID NO: 335176 - RNA, 64 nt, hsa
uagcccccuugaucccuaaagaaaacaaacaaacaaacaaaaacuguugcuauuuccuaaccug

SEQ ID NO: 335177 - RNA, 64 nt, hsa
uuuauuuuaguaaaaaaaaaaaaacaaaaaacaaaaacaaaagauuuuuaucaaauguuaugau

SEQ ID NO: 335178 - RNA, 64 nt, hsa
aacagguuuauuuuaguaaaaaaaaaaaaacaaaaaacaaaaacaaaagauuuuuaucaaaugu

SEQ ID NO: 335179 - RNA, 64 nt, hsa
ucccccgaacagguuuauuuuaguaaaaaaaaaaaaacaaaaaacaaaaacaaaagauuuuuau

SEQ ID NO: 335180 - RNA, 64 nt, hsa
cuucuauaaaccaggcuguuaauacaaugaugacaaacaaaacuggcaagaucacuaaaaaaua

SEQ ID NO: 335181 - RNA, 64 nt, hsa
caaccccguuuuuaagcaauggaacucuuucuucaaacaaaagcuuaugcagaacaucucugug

SEQ ID NO: 335182 - RNA, 64 nt, hsa
acagagugagacugcaucucaaaaaaaacccaaaaaacaaaaacaaacaacaacaacaaaauua

SEQ ID NO: 335183 - RNA, 64 nt, hsa
augguaaaacccugucucuacugaaaaacaacaaaaacaaaaacacaaauuagucggguguggu

SEQ ID NO: 335184 - RNA, 64 nt, hsa
ugagacuccaucucauuaaaaaaaacgaaaacaaaaacaaaaaaaacacaaaccaucaucacag

SEQ ID NO: 335185 - RNA, 64 nt, hsa
acagagugagacuccaucucauuaaaaaaaacgaaaacaaaaacaaaaaaaacacaaaccauca

SEQ ID NO: 335186 - RNA, 64 nt, hsa
uauggaccccugagaaugagcaauugagaaaacaaaacaaaaggaacaauccaugaacuuagau

SEQ ID NO: 335187 - RNA, 64 nt, hsa
uuguauauggaccccugagaaugagcaauugagaaaacaaaacaaaaggaacaauccaugaacu

SEQ ID NO: 335188 - RNA, 64 nt, hsa
uucaauaaaaaaaagagaaacuguccuuaaaacaaaacaaaaaccaaaaaagucacccuaucag

SEQ ID NO: 335189 - RNA, 64 nt, hsa
uucauuucaauaaaaaaaagagaaacuguccuuaaaacaaaacaaaaaccaaaaaagucacccu

SEQ ID NO: 335190 - RNA, 64 nt, hsa
auuugcagauacaaaagauggaaauuuuucuguaaaacaaaaccuugaaggagaggagggcggg

SEQ ID NO: 335191 - RNA, 64 nt, hsa
gcacccgggugggggacagagggaccuuuaaagaaaacaaaacuggacagaaacaggaauguga

SEQ ID NO: 335192 - RNA, 64 nt, hsa
ugguuuucuccuucccaaggcagcuggauugaaaaaacaaaacaaaacaaaaaaacccaggggc

SEQ ID NO: 335193 - RNA, 64 nt, hsa
uucuccuucccaaggcagcuggauugaaaaaacaaaacaaaacaaaaaaacccaggggcgucag

SEQ ID NO: 335194 - RNA, 64 nt, hsa
cuucccaaggcagcuggauugaaaaaacaaaacaaaacaaaaaaacccaggggcgucagucgau

SEQ ID NO: 335195 - RNA, 64 nt, hsa
accccaagaggaaguuuucugaaauaagauuuaaaaacaaaacaaaaaaaacacuuaauauuuc

SEQ ID NO: 335196 - RNA, 64 nt, hsa
aagaggaaguuuucugaaauaagauuuaaaaacaaaacaaaaaaaacacuuaauauuucagacu

SEQ ID NO: 335197 - RNA, 64 nt, hsa
aaaaauuuccagaagaggaaaaaaaaacuacaaaaaacaaaacauugaagguugauauuuuaug

SEQ ID NO: 335198 - RNA, 64 nt, hsa
aggcucucgaggcaagcugucaacgucuuguugaaaacaaaaaucaagaaagaauugaaauacu

SEQ ID NO: 335199 - RNA, 64 nt, hsa
gauaggagcuuauggucaaaaagugcaaaaaaaaaaacaaaaaaaaagcaauagauagagaaau

SEQ ID NO: 335200 - RNA, 64 nt, hsa
uuguucuguuggugugauucaaagcaaaacaaacaaacaaaaacaaauuuuaagaacacaacaa

SEQ ID NO: 335201 - RNA, 64 nt, hsa
ucuuugacaaaaauguguacuguguaagccuugcaaacaaaaaacaacaaaaaagaagcagcag

SEQ ID NO: 335202 - RNA, 64 nt, hsa
aagacacaagaaaagcauuucagaggcuaauuuaaaacaaaaaguaagcaccuaaaggcaagga

SEQ ID NO: 335203 - RNA, 64 nt, hsa
uccauuuccuagguaauuuuuuaaaagccagucaaaacaaaaacuuuacugaaaauggacagaa

SEQ ID NO: 335204 - RNA, 50 nt, hsa
auuuauuguaucccauguaaaaacaaaaaaacaaaaaacaaagaaaagaa

SEQ ID NO: 335205 - RNA, 58 nt, hsa
auuuauuguaucccauguaaaaacaaaaaaacaaaaaacaaagaaaagaaagagauuu

SEQ ID NO: 335206 - RNA, 64 nt, hsa
aacuaguuucauauauuaccuaguuauucuuucaaaacaaaacaaaaaaaaaacaaaaacugac

SEQ ID NO: 335207 - RNA, 64 nt, hsa
guuucauauauuaccuaguuauucuuucaaaacaaaacaaaaaaaaaacaaaaacugacgcacu

SEQ ID NO: 335208 - RNA, 64 nt, hsa
augaguaaaauuggaaaacacuuuuaacugaaaaaaacaaaagcacaacaaaccaaaacauggg

SEQ ID NO: 335209 - RNA, 64 nt, hsa
cacccccucaaaagacucaaauuacuagaaucagaaacaaaagucaagauuuuauuaccaaacu

SEQ ID NO: 335210 - RNA, 64 nt, hsa
ccuugguccuggaacauuuauguuccuuuuaaagaaacaaaaaucaaacuuuacagaaagauuu

SEQ ID NO: 335211 - RNA, 64 nt, hsa
caaaaaaaggaaggaagggacacauaucaaacugaaacaaaauuagaaauguaauuauguucua

SEQ ID NO: 335212 - RNA, 64 nt, hsa
uuagccugggcaacagugagugagacucggucucaaacaaaaaccaaauugggaaauucuucuu

SEQ ID NO: 335213 - RNA, 64 nt, hsa
aauauguuucucuuaacaccugaaacuuguuuuaaaacaaaaagcaguauucacuucaaaucau

SEQ ID NO: 335214 - RNA, 64 nt, hsa
uaaacuuugaagauuguuuguaucuuuuuuuaaaaaacaaaacaaaacaaaaauccccaaaaua

SEQ ID NO: 335215 - RNA, 64 nt, hsa
uuugaagauuguuuguaucuuuuuuuaaaaaacaaaacaaaacaaaaauccccaaaauauauag

SEQ ID NO: 335216 - RNA, 64 nt, hsa
agauuguuuguaucuuuuuuuaaaaaacaaaacaaaacaaaaauccccaaaauauauagaaaug

SEQ ID NO: 335217 - RNA, 64 nt, hsa
auuuguauuuagaaaagguuuauauuauuagugaaaacaaaacuaaagggaaguucaaguucuc

SEQ ID NO: 335218 - RNA, 64 nt, hsa
gucucauauaauaaggugaugucggaaacacgcaaaacaaaacgaaaaaagauuucucaguaua

SEQ ID NO: 335219 - RNA, 64 nt, hsa
gaagauugcuaaauuaaauaauuuauagcuccaaaaacaaaaauauacuuguauaugucacaga

SEQ ID NO: 335220 - RNA, 64 nt, hsa
aaauuaaaacucuugguggucacauauuguauauaaacaaaacaauaugcuuuguugaaggaaa

SEQ ID NO: 335221 - RNA, 64 nt, hsa
ucggcagaacugaugugagguaagugagcaugucaaacaaaauaggagcucacauggauauauu

SEQ ID NO: 335222 - RNA, 64 nt, hsa
ucaaucaaaucuguaacacugaauccaagcuauuaaacaaaaaguaugcaaugaaugaauuuug

SEQ ID NO: 335223 - RNA, 63 nt, hsa
guaauuguacugcaauaauuuuucaaaaaacaaaaaacaaaacaaacaaaagagaacuaugca

SEQ ID NO: 335224 - RNA, 64 nt, hsa
aauaggaguaauuguacugcaauaauuuuucaaaaaacaaaaaacaaaacaaacaaaagagaac

SEQ ID NO: 335225 - RNA, 64 nt, hsa
ugguucaaauuauaucuaaacaaaaaagaauaagaaacaaaaaacacauuaaaauuuuaaguug

SEQ ID NO: 335226 - RNA, 64 nt, hsa
agaaaagaaaagaaacaugguucaaauuauaucuaaacaaaaaagaauaagaaacaaaaaacac

SEQ ID NO: 335227 - RNA, 64 nt, hsa
ggugcaagauaaaaggucuugggaaaacaaaacaaaacaaaacaaaccucccuuccccagcagg

SEQ ID NO: 335228 - RNA, 64 nt, hsa
ucucuggugcaagauaaaaggucuugggaaaacaaaacaaaacaaaacaaaccucccuucccca

SEQ ID NO: 335229 - RNA, 64 nt, hsa
uaaauucucuggugcaagauaaaaggucuugggaaaacaaaacaaaacaaaacaaaccucccuu

SEQ ID NO: 335230 - RNA, 64 nt, hsa
uuuucuagaaguuaaacaagagcuaagacaaacaaaacaaaacacagcuuaucuaaucuaauga

SEQ ID NO: 335231 - RNA, 64 nt, hsa
acuaguuuucuagaaguuaaacaagagcuaagacaaacaaaacaaaacacagcuuaucuaaucu

SEQ ID NO: 335232 - RNA, 64 nt, hsa
uaugaacaaaacaaaacaacaacaaaaaacaaacaaacaaaaaagcuauggcacuagaauuuaa

SEQ ID NO: 335233 - RNA, 64 nt, hsa
gauaaguaguaucuuucucucuuucuuaugaacaaaacaaaacaacaacaaaaaacaaacaaac

SEQ ID NO: 335234 - RNA, 64 nt, hsa
uaagaacuauuuuuaaaauauucaaacaaaacuaaaacaaaaauccagugucacaugggccuga

SEQ ID NO: 335235 - RNA, 64 nt, hsa
uagaaaauaaguaagaacuauuuuuaaaauauucaaacaaaacuaaaacaaaaauccaguguca

SEQ ID NO: 335236 - RNA, 64 nt, hsa
uacauaacuuuaggucuaagucuugcuaagggauaaacaaaagcaaugccuagacaucaggguc

SEQ ID NO: 335237 - RNA, 64 nt, hsa
acgcggacuaaaucauuuucauuuaauuuccgguaaacaaaacccacgcgaaugggcacuugua

SEQ ID NO: 335238 - RNA, 64 nt, hsa
ucuaaguagauuuuuugacauuaauguauuuauuaaacaaaaacugagaauuccuuaaauugau

SEQ ID NO: 335239 - RNA, 64 nt, hsa
acuuucagccuguguagggcaaacacaaauccuuaaacaaaaaucauguuaucaaaaacuguca

SEQ ID NO: 335240 - RNA, 64 nt, hsa
aaauguuugcuaccuuaguuuaaaaaacaaucucaaacaaaagacuugcuucaagguguuuuua

SEQ ID NO: 335241 - RNA, 64 nt, hsa
aaucaguuucuuguuuauauuuuuuucaccuuuuaaacaaaaaauucuuuaaaauauuuuaaug

SEQ ID NO: 335242 - RNA, 64 nt, hsa
aaaucuaaaagaaauauauacauacaguguauauaaacaaaauugcacccugaagaugacagag

SEQ ID NO: 335243 - RNA, 64 nt, hsa
uuaagguuguucacuaugauggcaucuuagaauuaaacaaaacuuuuacuagggcugaaaagag

SEQ ID NO: 335244 - RNA, 64 nt, hsa
ugguacuaaacauuuauaauuacuguguaauuauaaacaaaaauacauaaagcuuugaauauaa

SEQ ID NO: 335245 - RNA, 64 nt, hsa
uuuugguauuuaaagcaaaaaaacgaaaaacaaaaaacaaaaacaaaccuuuugguaacugugc

SEQ ID NO: 335246 - RNA, 64 nt, hsa
uuuguaguuuugguauuuaaagcaaaaaaacgaaaaacaaaaaacaaaaacaaaccuuuuggua

SEQ ID NO: 335247 - RNA, 64 nt, hsa
gcauacguuuugguguugcuuuucaaauguuugaaaacaaaaaaaauguuaagaaauggguuuc

SEQ ID NO: 335248 - RNA, 64 nt, hsa
uaaucugaaguaugguauuacaaaacaaacaaacaaacaaaaaacccauguguuaaaauacuca

SEQ ID NO: 335249 - RNA, 64 nt, hsa
cagauaacaaaauacacuuuacugguaaaauuuaaaacaaaaaaggcaaaacaaaacaaacuca

SEQ ID NO: 335250 - RNA, 64 nt, hsa
cacuuuacugguaaaauuuaaaacaaaaaaggcaaaacaaaacaaacucauuuuccccuuaguu

SEQ ID NO: 335251 - RNA, 64 nt, hsa
gccuggauauuauucuuguaguuuaccucuuuaaaaacaaaacaaaacaaaacaaaaaacuccc

SEQ ID NO: 335252 - RNA, 64 nt, hsa
gauauuauucuuguaguuuaccucuuuaaaaacaaaacaaaacaaaacaaaaaacuccccuucc

SEQ ID NO: 335253 - RNA, 64 nt, hsa
uauucuuguaguuuaccucuuuaaaaacaaaacaaaacaaaacaaaaaacuccccuuccucacu

SEQ ID NO: 335254 - RNA, 64 nt, hsa
uuguaguuuaccucuuuaaaaacaaaacaaaacaaaacaaaaaacuccccuuccucacugccca

SEQ ID NO: 335255 - RNA, 64 nt, hsa
aaccugaauucaccacagcuggaauagcuguggaaaacaaaauaaaacaacaaaauuaauaaug

SEQ ID NO: 335256 - RNA, 64 nt, hsa
uucuaguaaugcaaacaaauuauuuuuuacaaaaaaacaaaauaaauaaaauuagacuuccuuc

SEQ ID NO: 335257 - RNA, 64 nt, hsa
uggggagaggacuuaacugacuuaagaaguaggaaaacaaaaaccucucuccucagccuuccac

SEQ ID NO: 335258 - RNA, 64 nt, hsa
acuugaaauguauugacugcugacuauauuuuaaaaacaaaaugaaauaauuugaguuguauua

SEQ ID NO: 335259 - RNA, 64 nt, hsa
acugucuguuggauaauggcuguaaaauguuuaaaaacaaaacaaaacaaaaaagaggcacuag

SEQ ID NO: 335260 - RNA, 64 nt, hsa
cuguuggauaauggcuguaaaauguuuaaaaacaaaacaaaacaaaaaagaggcacuagucuau

SEQ ID NO: 335261 - RNA, 64 nt, hsa
ggauaauggcuguaaaauguuuaaaaacaaaacaaaacaaaaaagaggcacuagucuaucugca

SEQ ID NO: 335262 - RNA, 64 nt, hsa
aguuauucucuaagaggaaacuaguguuuguuaaaaacaaaaauaaaaacaaaaccacacaagg

SEQ ID NO: 335263 - RNA, 64 nt, hsa
agaggaaacuaguguuuguuaaaaacaaaaauaaaaacaaaaccacacaaggagaacccaauuu

SEQ ID NO: 335264 - RNA, 64 nt, hsa
ugacagagucagacuccgucccaaaaaaacaaacaaacaaaacaaaacaaaaaaaaacagaagu

SEQ ID NO: 335265 - RNA, 64 nt, hsa
gagucagacuccgucccaaaaaaacaaacaaacaaaacaaaacaaaaaaaaacagaaguuacaa

SEQ ID NO: 335266 - RNA, 64 nt, hsa
agacuccgucccaaaaaaacaaacaaacaaaacaaaacaaaaaaaaacagaaguuacaaaugaa

SEQ ID NO: 335267 - RNA, 64 nt, hsa
cuccagccuggaugacagagugagaccuugucucaaacaaaacaaaacaaaaaugaaauguucu

SEQ ID NO: 335268 - RNA, 64 nt, hsa
gccuggaugacagagugagaccuugucucaaacaaaacaaaacaaaaaugaaauguucuaguuu

SEQ ID NO: 335269 - RNA, 64 nt, hsa
gaugacagagugagaccuugucucaaacaaaacaaaacaaaaaugaaauguucuaguuuugguu

SEQ ID NO: 335270 - RNA, 64 nt, hsa
gaaugguagcuuuugcacagaacuuccaaaagcaaaacaaaaacaaaaucuauuguaguuauau

SEQ ID NO: 335271 - RNA, 64 nt, hsa
uagcuuuugcacagaacuuccaaaagcaaaacaaaaacaaaaucuauuguaguuauauacuuca

SEQ ID NO: 335272 - RNA, 64 nt, hsa
gucagaaaauggccuucugugcuuucaaaaaaaaaaacaaaaaaaaaaccacacacacacauaa

SEQ ID NO: 335273 - RNA, 64 nt, hsa
gcugaacuuacugcuuauauauauuugauuguaaaaacaaaaagacagugugugugucuguuga

SEQ ID NO: 335274 - RNA, 64 nt, hsa
auuucuccuacuuuacacucucuguacaaaaacaaaacaaaacaacaacaauacaacaagaaca

SEQ ID NO: 335275 - RNA, 64 nt, hsa
uaggaauuucuccuacuuuacacucucuguacaaaaacaaaacaaaacaacaacaauacaacaa

SEQ ID NO: 335276 - RNA, 64 nt, hsa
aagaguguaccauuaacuugauuguugauaauaaaaacaaaaagcaagucuagcaauugaacuc

SEQ ID NO: 335277 - RNA, 64 nt, hsa
aaaacaaaaaaguuggaaggcagaaaccauuaaaaaacaaaaagccaacaacccagaaagguuu

SEQ ID NO: 335278 - RNA, 64 nt, hsa
uguuuagaaaaaaaagacaaaaaaguaaaaauaaaaacaaaaaaguuggaaggcagaaaccauu

SEQ ID NO: 335279 - RNA, 64 nt, hsa
uucaaccccacuccuacccccuuccucaacccccaaacaaaacaaacaaacuucccuggcuucg

SEQ ID NO: 335280 - RNA, 64 nt, hsa
uauacuuauuugucuucuuuuugcauugugaaaaaaacaaaauaaauuuugugugauaauuuug

SEQ ID NO: 335281 - RNA, 64 nt, hsa
gguuaauuuaaacuuaccuaagaagaugagaaucaaacaaaacagauaugcuuacucuaguuaa

SEQ ID NO: 335282 - RNA, 64 nt, hsa
uucuuguagauaacacagggauguagauaaguugaaacaaaaccaguguccucuaagucucuau

SEQ ID NO: 335283 - RNA, 64 nt, hsa
aaauccauauuucauaaauaacugagaauaauuaaaacaaaauuaagcaaaugcacaagcaaaa

SEQ ID NO: 335284 - RNA, 64 nt, hsa
agaauaggauucugugauaauauuuaaauggcaaaaacaaaacauaauuuugugcaauuaacaa

SEQ ID NO: 335285 - RNA, 64 nt, hsa
accagagagagcuuggaauguuaaaaacaaaacaaaacaaaaaaaaacaaggagaaguugucca

SEQ ID NO: 335286 - RNA, 64 nt, hsa
aggggaccagagagagcuuggaauguuaaaaacaaaacaaaacaaaaaaaaacaaggagaaguu

SEQ ID NO: 335287 - RNA, 64 nt, hsa
uggauaggggaccagagagagcuuggaauguuaaaaacaaaacaaaacaaaaaaaaacaaggag

SEQ ID NO: 335288 - RNA, 64 nt, hsa
uagaaacacauuuucuggcuagcagaaaaaaacaaaacaaaacuguuguuucucuuucuugcuu

SEQ ID NO: 335289 - RNA, 64 nt, hsa
augaauagaaacacauuuucuggcuagcagaaaaaaacaaaacaaaacuguuguuucucuuucu

SEQ ID NO: 335290 - RNA, 64 nt, hsa
ggcacaaggaaucacacguggugcagcuaaaacaaaacaaaacaugagcaaacacaaaacccaa

SEQ ID NO: 335291 - RNA, 64 nt, hsa
aaaauggcacaaggaaucacacguggugcagcuaaaacaaaacaaaacaugagcaaacacaaaa

SEQ ID NO: 335292 - RNA, 64 nt, hsa
agaagccuauuuuuaaagcagaagcaaaaaagaaaaacaaaauaacaaaaacaacccuuccucu

SEQ ID NO: 335293 - RNA, 64 nt, hsa
gucuuccuccaaggaguuagaauuucccaguuuaaaacaaaaagggaaauguccuagguuuucu

SEQ ID NO: 335294 - RNA, 64 nt, hsa
ucauuuguaguaaaacuuaaaaagcaaaaacaaaaaacaaaaaagaccuuccugugauacuuua

SEQ ID NO: 335295 - RNA, 64 nt, hsa
cugucacucauuuguaguaaaacuuaaaaagcaaaaacaaaaaacaaaaaagaccuuccuguga

SEQ ID NO: 335296 - RNA, 64 nt, hsa
uuauccuucccugugauuagauaaacaaaauaaaaaacaaaaugcuguauuucucuucuuacgc

SEQ ID NO: 335297 - RNA, 64 nt, hsa
uuugcccuuuguuuauccuucccugugauuagauaaacaaaauaaaaaacaaaaugcuguauuu

SEQ ID NO: 335298 - RNA, 64 nt, hsa
uucccagugucuaauucccuguuauaauuugcacaaacaaaacaaaauguuaugauaaucuuuc

SEQ ID NO: 335299 - RNA, 64 nt, hsa
agugucuaauucccuguuauaauuugcacaaacaaaacaaaauguuaugauaaucuuucuccac

SEQ ID NO: 335300 - RNA, 64 nt, hsa
accaacacaccacucauuggaaaauggaaaaaaaaaacaaaaaaaaaacaaaaaaauguacaau

SEQ ID NO: 335301 - RNA, 64 nt, hsa
acucauuggaaaauggaaaaaaaaaacaaaaaaaaaacaaaaaaauguacaauggaugcauuga

SEQ ID NO: 335302 - RNA, 64 nt, hsa
uggagaaagugggaaauuauaaugucgaacucugaaacaaaaguauuuaacgacccagucaaug

SEQ ID NO: 335303 - RNA, 64 nt, hsa
agacaaucaugggauuuuacuagaauuaaacaacaaacaaaacgcaaaacccaguauaugcuau

SEQ ID NO: 335304 - RNA, 64 nt, hsa
gaaagcauuuucauuucacugcacaucuagagaaaaacaaaaauagaaaauuuucuaguccauc

SEQ ID NO: 335305 - RNA, 64 nt, hsa
auagaaagugccagaaaguguuuaacuugucaaaaaacaaaaacccagcaacagaaaaauggag

SEQ ID NO: 335306 - RNA, 64 nt, hsa
auaugcacauauauauauguauuuaaaaaaaucaaaacaaaaaaaaacucauuuauaccugugu

SEQ ID NO: 335307 - RNA, 64 nt, hsa
uuauaucccaaguccauuuuuuccuguacacuacaaacaaaagauauauuagagacuuuugaaa

SEQ ID NO: 335308 - RNA, 64 nt, hsa
uuuuuaaaauauguguauaagucugucaugugcuaaacaaaauaauaugaaagaccuaguuaaa

SEQ ID NO: 335309 - RNA, 64 nt, hsa
cuacaguguaauaauuuacacuauuuugugcuccaaacaaaacaaaaaucuguguaacuguaaa

SEQ ID NO: 335310 - RNA, 64 nt, hsa
guguaauaauuuacacuauuuugugcuccaaacaaaacaaaaaucuguguaacuguaaaacauu

SEQ ID NO: 335311 - RNA, 64 nt, hsa
aggaauacuuuuguuagaaugagaauuaaagagaaaacaaaagaaucuuggcaaaauuuucccu

SEQ ID NO: 335312 - RNA, 64 nt, hsa
aaaauacauuaggguuuacuugguuguggcaaacaaacaaaaaaugcuuucaguguugaaauau

SEQ ID NO: 335313 - RNA, 64 nt, hsa
ucaacuguuuuuauuucuagucucuuccacuuuaaaacaaaaugaacacugcuugucuucuucc

SEQ ID NO: 335314 - RNA, 64 nt, hsa
cuauauaccaugcuuaaaaaucacgucauucuuuaaacaaaaauacucaagaucauuuauauuu

SEQ ID NO: 335315 - RNA, 64 nt, hsa
cucuucuaaggaaauggagaagcucuguuuauaaaaacaaaaacaaaaccagcugcuacucaua

SEQ ID NO: 335316 - RNA, 64 nt, hsa
uaaggaaauggagaagcucuguuuauaaaaacaaaaacaaaaccagcugcuacucauaaguugg

SEQ ID NO: 335317 - RNA, 64 nt, hsa
uguaucuuugguuuuuguguuuugcugcacacaaaaacaaaagauauaaaaauggaucauaaac

SEQ ID NO: 335318 - RNA, 64 nt, hsa
gaucuuaucacauuuaagucauugcuaauuuuauaaacaaaaacaaugguuuuacuuugcaucu

SEQ ID NO: 335319 - RNA, 64 nt, hsa
cagccugggcgacagagcgagacucugccucaaaaaacaaaacaaaacaaaacacucacccauc

SEQ ID NO: 335320 - RNA, 64 nt, hsa
ugggcgacagagcgagacucugccucaaaaaacaaaacaaaacaaaacacucacccaucaacga

SEQ ID NO: 335321 - RNA, 64 nt, hsa
gacagagcgagacucugccucaaaaaacaaaacaaaacaaaacacucacccaucaacgaauaua

SEQ ID NO: 335322 - RNA, 64 nt, hsa
gcugagcugagcuucgguucuccagaauguaagaaaacaaaaucuaaaacaaaaucugaacucu

SEQ ID NO: 335323 - RNA, 64 nt, hsa
uucgguucuccagaauguaagaaaacaaaaucuaaaacaaaaucugaacucucaaaagucuauu

SEQ ID NO: 335324 - RNA, 64 nt, hsa
ggaagaaccuguuugaugcaaaaaagaaaaugaaaaacaaaacaaaaaauccccaaaaccuuau

SEQ ID NO: 335325 - RNA, 64 nt, hsa
aaccuguuugaugcaaaaaagaaaaugaaaaacaaaacaaaaaauccccaaaaccuuauuaugg

SEQ ID NO: 335326 - RNA, 64 nt, hsa
ugggugacagagcgagacuccgucucaaacaaacaaacaaaaaacuguuuucauuugcucucuu

SEQ ID NO: 335327 - RNA, 64 nt, hsa
uuagacucuuuuaaugcuaauggcuaguacguuuaaacaaaacagcaguucucugcugcaauau

SEQ ID NO: 335328 - RNA, 64 nt, hsa
uuggguccuacuguuguuauuaaaaacagaacaaaaacaaaacacacacacacacaaaaacaga

SEQ ID NO: 335329 - RNA, 64 nt, hsa
aacaaaaacaaaacacacacacacacaaaaacagaaacaaaaaaaaccagcauuaaaauaauaa

SEQ ID NO: 335330 - RNA, 64 nt, hsa
ggugaaacccugccucuacuaaaaauacaaaaaaaaacaaaauuagccgggcgugguugcgggc

SEQ ID NO: 335331 - RNA, 64 nt, hsa
gucugggcgacagagugagacuccaucucaaaacaaacaaaaaaaggauggggcugggcuggag

SEQ ID NO: 335332 - RNA, 64 nt, hsa
ugguggaaaccauuugugaauuuacagacuccaaaaacaaaaagauaauuuagagucucaaagu

SEQ ID NO: 335333 - RNA, 64 nt, hsa
aaauccuugaacuaaugacucaaauuuucaaaugaaacaaaauaagcaguggaucuugcauugg

SEQ ID NO: 335334 - RNA, 64 nt, hsa
uuucacaaguccugugaggcaaaaaaacaaaacaaaacaaaacaaccaaacaaauacaaucuaa

SEQ ID NO: 335335 - RNA, 64 nt, hsa
gacuauuucacaaguccugugaggcaaaaaaacaaaacaaaacaaaacaaccaaacaaauacaa

SEQ ID NO: 335336 - RNA, 64 nt, hsa
cuuaagacuauuucacaaguccugugaggcaaaaaaacaaaacaaaacaaaacaaccaaacaaa

SEQ ID NO: 335337 - RNA, 64 nt, hsa
uuuuacuuucgugccugcauuauuuuucuauuuaaaacaaaaauaaaucuaguuuagcacuaaa

SEQ ID NO: 335338 - RNA, 64 nt, hsa
caacagagcaagacccugucugucucaaaacaaaaaacaaaaccacuuauauugcuagcuacau

SEQ ID NO: 335339 - RNA, 64 nt, hsa
gccugggcaacagagcaagacccugucugucucaaaacaaaaaacaaaaccacuuauauugcua

SEQ ID NO: 335340 - RNA, 64 nt, hsa
agaaaauguguaaggcuugcuaaaaaacaaaacaaaacaaaacacaguccugcauacucaccac

SEQ ID NO: 335341 - RNA, 64 nt, hsa
acaaaagaaaauguguaaggcuugcuaaaaaacaaaacaaaacaaaacacaguccugcauacuc

SEQ ID NO: 335342 - RNA, 64 nt, hsa
ugcauacaaaagaaaauguguaaggcuugcuaaaaaacaaaacaaaacaaaacacaguccugca

SEQ ID NO: 335343 - RNA, 64 nt, hsa
caauuuggaaggguauguaaauagauuaguucauaaacaaaaugguaucaauaaagauuuuaaa

SEQ ID NO: 335344 - RNA, 64 nt, hsa
aauaauacauaguuucuguuaagggaauucucucaaacaaaaggaaagcgauuuuucucaaugc

SEQ ID NO: 335345 - RNA, 64 nt, hsa
cucgauguuuucuuucaacugagaagccuaaaacaaacaaaaaccuuguguguuauccugauau

SEQ ID NO: 335346 - RNA, 64 nt, hsa
uggaaggaugaacuuguuagauagucagaguuggaaacaaaacaauccaagaauagggauauaa

SEQ ID NO: 335347 - RNA, 64 nt, hsa
aaaaacaaaacaaaacaaaacaaaaacaggaaaaaaacaaaaaaccaaagugguaaggauucag

SEQ ID NO: 335348 - RNA, 64 nt, hsa
agccucggguaacacugaaaaacaaaacaaaacaaaacaaaaacaggaaaaaaacaaaaaacca

SEQ ID NO: 335349 - RNA, 64 nt, hsa
agagaagccucggguaacacugaaaaacaaaacaaaacaaaacaaaaacaggaaaaaaacaaaa

SEQ ID NO: 335350 - RNA, 64 nt, hsa
ucuucagagaagccucggguaacacugaaaaacaaaacaaaacaaaacaaaaacaggaaaaaaa

SEQ ID NO: 335351 - RNA, 64 nt, hsa
cuagcucuucagagaagccucggguaacacugaaaaacaaaacaaaacaaaacaaaaacaggaa

SEQ ID NO: 335352 - RNA, 64 nt, hsa
gggugacagagcgagacucugucucaaaaaaacaaaacaaaaaaacaccaaaaaaacccccaaa

SEQ ID NO: 335353 - RNA, 64 nt, hsa
agccugggugacagagcgagacucugucucaaaaaaacaaaacaaaaaaacaccaaaaaaaccc

SEQ ID NO: 335354 - RNA, 64 nt, hsa
guuuuuacagcucaucauucaaauaacgcacaaaaaacaaaagccgcuaugaccggcguugccu

SEQ ID NO: 335355 - RNA, 64 nt, hsa
gaaaauucuaugaaauucagauuucaguguccauaaacaaaauguuauuagagcauagccacac

SEQ ID NO: 335356 - RNA, 64 nt, hsa
aaagaaagcugcaauuauccgccaacugcauuuaaaacaaaacaaaacagaaaaaucaaaauaa

SEQ ID NO: 335357 - RNA, 64 nt, hsa
aagcugcaauuauccgccaacugcauuuaaaacaaaacaaaacagaaaaaucaaaauaacauug

SEQ ID NO: 335358 - RNA, 64 nt, hsa
aucuaagaauacgcggucuccugagaacuucaaaaaacaaaaacaaaaaaacccaaaggcccuu

SEQ ID NO: 335359 - RNA, 64 nt, hsa
gaauacgcggucuccugagaacuucaaaaaacaaaaacaaaaaaacccaaaggcccuuuucagg

SEQ ID NO: 335360 - RNA, 64 nt, hsa
uuauuuggguuaauauuuaugacauuugacauugaaacaaaaauuuaaaauguuaucuuuuaau

SEQ ID NO: 335361 - RNA, 64 nt, hsa
uugugaaaaagcaaucuauuguguccaaauaaaaaaacaaaaagugugacacugguuaacuuuu

SEQ ID NO: 335362 - RNA, 64 nt, hsa
ccgggcaacaagagcgaaaccccaucucgaaaaaaaacaaaacaaaacuagacaagugagugcc

SEQ ID NO: 335363 - RNA, 64 nt, hsa
caacaagagcgaaaccccaucucgaaaaaaaacaaaacaaaacuagacaagugagugccuacgu

SEQ ID NO: 335364 - RNA, 64 nt, hsa
uuucuccuucugacuuuuaauaaugguaauaggaaaacaaaacccaaagcuuuucagaacuuca

SEQ ID NO: 335365 - RNA, 64 nt, hsa
aaucuuacuuucuuuuaaugaccaaccuuagguaaaacaaaaauauuguaauccuagaaauuau

SEQ ID NO: 335366 - RNA, 64 nt, hsa
ccaaaucucuacccuuccccaacccuccauaaaaaaacaaaaauggaaaugaaaaaugaaacaa

SEQ ID NO: 335367 - RNA, 64 nt, hsa
cuccauaaaaaaacaaaaauggaaaugaaaaaugaaacaaaaaaggacaaaaccaaaaaaaaaa

SEQ ID NO: 335368 - RNA, 64 nt, hsa
aagcucgcaagcccggggagagauuuauaaaaguaaacaaaagaaaaccuuccagcaacaaauu

SEQ ID NO: 335369 - RNA, 64 nt, hsa
cauucuccucucccugacuggugucagauucaucaaacaaaaaauaaaucucgaagaaaaaaaa

SEQ ID NO: 335370 - RNA, 64 nt, hsa
ccauaucuccaaaaaaagaaagaaaaaauacaaaaaacaaaaacaaaaaaaaaagaggguaaug

SEQ ID NO: 335371 - RNA, 64 nt, hsa
cuccaaaaaaagaaagaaaaaauacaaaaaacaaaaacaaaaaaaaaagaggguaauguacaag

SEQ ID NO: 335372 - RNA, 64 nt, hsa
guaucucacuuuaaacucuuuggggaaaaaacaaaaacaaaaaaaacuaaguugcuuucuuuuu

SEQ ID NO: 335373 - RNA, 64 nt, hsa
aguacuguaucucacuuuaaacucuuuggggaaaaaacaaaaacaaaaaaaacuaaguugcuuu

SEQ ID NO: 335374 - RNA, 64 nt, hsa
aaggaaacuaaggacuuggcuccaaaacaaaacaaaacaaaaucuggagaugcugaauuuuguu

SEQ ID NO: 335375 - RNA, 64 nt, hsa
cugagaaggaaacuaaggacuuggcuccaaaacaaaacaaaacaaaaucuggagaugcugaauu

SEQ ID NO: 335376 - RNA, 64 nt, hsa
uguuacugagaaggaaacuaaggacuuggcuccaaaacaaaacaaaacaaaaucuggagaugcu

SEQ ID NO: 335377 - RNA, 64 nt, hsa
gggugacagacucugucuccaaaacaaaacaaacaaacaaaaagauuuuauuaaagauauuuug

SEQ ID NO: 335378 - RNA, 64 nt, hsa
ugcacuccaaccugggugacagacucugucuccaaaacaaaacaaacaaacaaaaagauuuuau

SEQ ID NO: 335379 - RNA, 64 nt, hsa
gcuaaggguuuauuuuauguaaaaaaaaaaaaaaaaacaaaaaaaaacccugagaccaugagug

SEQ ID NO: 335380 - RNA, 64 nt, hsa
agccuggacaacaagagcgaaauucugucuaaaaaaacaaaagucccaauuaagaaccuccgaa

SEQ ID NO: 335381 - RNA, 64 nt, hsa
ugugggcauccacaaacaaacaaacaaauaacagaaacaaaaucuguaaauguuccuuuguaaa

SEQ ID NO: 335382 - RNA, 64 nt, hsa
acagaauaucaccauugcaguucaaaacaaaacaaaacaaaaagucuuuuguuugugaacacug

SEQ ID NO: 335383 - RNA, 64 nt, hsa
gcugcacagaauaucaccauugcaguucaaaacaaaacaaaacaaaaagucuuuuguuugugaa

SEQ ID NO: 335384 - RNA, 64 nt, hsa
aauuugcugcacagaauaucaccauugcaguucaaaacaaaacaaaacaaaaagucuuuuguuu

SEQ ID NO: 335385 - RNA, 64 nt, hsa
uccuaaguccuugaauucaccaguagauuuuuguaaacaaaauguaagucgauguuuucucuca

SEQ ID NO: 335386 - RNA, 64 nt, hsa
uuucacucugaagcaguuuuagcuuauuaacagaaaacaaaacuggcaaagcaggcuuuuuguu

SEQ ID NO: 335387 - RNA, 64 nt, hsa
uagggacugggacuccagaaccauuaauaaaacaaaacaaaacaaagcaaaauauugaugauca

SEQ ID NO: 335388 - RNA, 64 nt, hsa
agggguagggacugggacuccagaaccauuaauaaaacaaaacaaaacaaagcaaaauauugau

SEQ ID NO: 335389 - RNA, 64 nt, hsa
cuugaaaguugaacucaaguagaaaaauggauagaaacaaaauucucuaguacucauccaggaa

SEQ ID NO: 335390 - RNA, 64 nt, hsa
ugccaugaggauuucucuuuaggccagaaguacaaaacaaaaaaaccaauggauuuuaaccaaa

SEQ ID NO: 335391 - RNA, 64 nt, hsa
acaaacaaaaaacaaccuuagcauuaagaaauaaaaacaaaaaacaagaagcaaguuguacugc

SEQ ID NO: 335392 - RNA, 64 nt, hsa
cuaagaagccuuaauacucuguaaacaaacaaacaaacaaaaaacaaccuuagcauuaagaaau

SEQ ID NO: 335393 - RNA, 64 nt, hsa
uucaaauggaaggaaccaccugaauuauaucugcaaacaaaauggaaauaguuguugaauaguu

SEQ ID NO: 335394 - RNA, 64 nt, hsa
aauuguuuuaauaucuuuacucaaaaaaacaaaaaaacaaaaacccauggaagcaacaaaagag

SEQ ID NO: 335395 - RNA, 64 nt, hsa
ggcaucugaauuguuuuaauaucuuuacucaaaaaaacaaaaaaacaaaaacccauggaagcaa

SEQ ID NO: 335396 - RNA, 64 nt, hsa
ucccuuggaaccuuuguacgcuuugcucaaaaaaaaacaaaaaaaaaaaacaaaaaaaaaaaac

SEQ ID NO: 335397 - RNA, 64 nt, hsa
uuguacgcuuugcucaaaaaaaaacaaaaaaaaaaaacaaaaaaaaaaaacaacgguggagccu

SEQ ID NO: 335398 - RNA, 64 nt, hsa
auguaaauuuuuuuuuguuuuuaagcauucacccaaacaaaaaaaucacagguaaacccauguu

SEQ ID NO: 335399 - RNA, 64 nt, hsa
aaacuagacaaaugcuaguguguuuuaacuagcuaaacaaaacuaaguuaaaugaacauuuaaa

SEQ ID NO: 335400 - RNA, 64 nt, hsa
aaacuuaugacuuggauauaugguugaagaaucaaaacaaaagcaaaaaaaaaaagcaaaaaaa

SEQ ID NO: 335401 - RNA, 64 nt, hsa
uaauuuuuauguuauguuuugcuuuguuuuaaguaaacaaaaauuuuucuuucuuuacugcaug

SEQ ID NO: 335402 - RNA, 64 nt, hsa
gagcaaauacucuucagauccuauguagucagugaaacaaaauggagagcguauucugauagaa

SEQ ID NO: 335403 - RNA, 64 nt, hsa
agccaaagcaacaagagcaaaaacuucgucucaaaaacaaaacaaaaaaagaguauucauugug

SEQ ID NO: 335404 - RNA, 64 nt, hsa
aagcaacaagagcaaaaacuucgucucaaaaacaaaacaaaaaaagaguauucauugugaggac

SEQ ID NO: 335405 - RNA, 64 nt, hsa
uggugacagggucugacauggucagucuacuaaaaaacaaaaaaaaaaaacaaaaaaaaaaaaa

SEQ ID NO: 335406 - RNA, 64 nt, hsa
ugacauggucagucuacuaaaaaacaaaaaaaaaaaacaaaaaaaaaaaaacaaaagaaaaaaa

SEQ ID NO: 335407 - RNA, 64 nt, hsa
uacuaaaaaacaaaaaaaaaaaacaaaaaaaaaaaaacaaaagaaaaaaauaaaaauacggugg

SEQ ID NO: 335408 - RNA, 64 nt, hsa
acagagcaggacucucucucaaaaaaacacaaaaaaacaaaaacaaaaaaccauacacacacac

SEQ ID NO: 335409 - RNA, 64 nt, hsa
caggacucucucucaaaaaaacacaaaaaaacaaaaacaaaaaaccauacacacacacacacac

SEQ ID NO: 335410 - RNA, 64 nt, hsa
gagggaaaaagaaauacagccucaacagauuaaaaaacaaaagucacacuuaaggauccuucua

SEQ ID NO: 335411 - RNA, 64 nt, hsa
auccugcuuauuucucaaaaaagagggacagugaaaacaaaaacgacauugggacaugcugcuc

SEQ ID NO: 335412 - RNA, 64 nt, hsa
aaaaaaaaaaagcgaaagacugcaguugugcuaaaaacaaaacaaaacaaacaaacaaacaaaa

SEQ ID NO: 335413 - RNA, 64 nt, hsa
aaaaaagcgaaagacugcaguugugcuaaaaacaaaacaaaacaaacaaacaaacaaaaaagua

SEQ ID NO: 335414 - RNA, 64 nt, hsa
caguugugcuaaaaacaaaacaaaacaaacaaacaaacaaaaaaguaaaaaaagauuacuuucg

SEQ ID NO: 335415 - RNA, 64 nt, hsa
cuauaaacaaucccauuuuuauauuuuauuauuaaaacaaaaauaccucucuuugcuagagagu

SEQ ID NO: 335416 - RNA, 64 nt, hsa
agccugggaacaagagugaaacucucaaaagcagaaacaaaaacccaacauauaugggcuguua

SEQ ID NO: 335417 - RNA, 64 nt, hsa
gaaaaauaaaagaaaauguaaaaaacaaaaacaaaaacaaaaaagcaacccaguccccaaccug

SEQ ID NO: 335418 - RNA, 64 nt, hsa
aaaugggaaaaauaaaagaaaauguaaaaaacaaaaacaaaaacaaaaaagcaacccagucccc

SEQ ID NO: 335419 - RNA, 64 nt, hsa
uuacaaaaaugggaaaaauaaaagaaaauguaaaaaacaaaaacaaaaacaaaaaagcaaccca

SEQ ID NO: 335420 - RNA, 64 nt, hsa
aaaaagcucuagguucuucagcacauuucccccaaaacaaaauaaaauugagggcauguugcau

SEQ ID NO: 335421 - RNA, 64 nt, hsa
cauacccauuuucauuacuuugauauaaggugcuaaacaaaaaaagcucuagguucuucagcac

SEQ ID NO: 335422 - RNA, 64 nt, hsa
cgugaccauuugauucucaaacaaaaguuguuccaaacaaaaugaugaacuuugauuugaacag

SEQ ID NO: 335423 - RNA, 64 nt, hsa
uuuguuuugucauuuacgugaccauuugauucucaaacaaaaguuguuccaaacaaaaugauga

SEQ ID NO: 335424 - RNA, 64 nt, hsa
ugacuucagcucuguuuuuagcuagaaacucuaaaaacaaaaauaauaauaaagaaaaauaaau

SEQ ID NO: 335425 - RNA, 64 nt, hsa
uaauaugugcauuguaaaauaaaugccauauuucaaacaaaacacguaauuuuuuuacaguaug

SEQ ID NO: 335426 - RNA, 64 nt, hsa
aaaaaaaaaacaaaaaaaaacaaaaguaaauuaaaaacaaaaccugaugaaacagaugaaggaa

SEQ ID NO: 335427 - RNA, 64 nt, hsa
aaauuaaaaacaaaacaaaaaaaaaaacaaaaaaaaacaaaaguaaauuaaaaacaaaaccuga

SEQ ID NO: 335428 - RNA, 64 nt, hsa
agaaaaauagaaauuaaaaacaaaacaaaaaaaaaaacaaaaaaaaacaaaaguaaauuaaaaa

SEQ ID NO: 335429 - RNA, 64 nt, hsa
ucugaguuaaccagaaaaauagaaauuaaaaacaaaacaaaaaaaaaaacaaaaaaaaacaaaa

SEQ ID NO: 335430 - RNA, 64 nt, hsa
agguuucugaguuaaccagaaaaauagaaauuaaaaacaaaacaaaaaaaaaaacaaaaaaaaa

SEQ ID NO: 335431 - RNA, 64 nt, hsa
ggucuuuuaagagauuuaagcuucaguuuucucaaaacaaaacaauuauccugucuuaucugaa

SEQ ID NO: 335432 - RNA, 64 nt, hsa
guggagagggagcaagggaggccgcagagggaaaaaacaaaacguaacacaguuaagagaaaua

SEQ ID NO: 335433 - RNA, 64 nt, hsa
cccccaaaaaauaaaaaaaccacaaaaaacaaaaaaacaaaacuaaggcacuucacuuagagac

SEQ ID NO: 335434 - RNA, 64 nt, hsa
cucccacccccccaaaaaauaaaaaaaccacaaaaaacaaaaaaacaaaacuaaggcacuucac

SEQ ID NO: 335435 - RNA, 64 nt, hsa
ggcaacagagcaagacucugucucaaaaaaaacaaaacaaaaaggaggcacaaaaccccaggcu

SEQ ID NO: 335436 - RNA, 64 nt, hsa
gccuaggcaacagagcaagacucugucucaaaaaaaacaaaacaaaaaggaggcacaaaacccc

SEQ ID NO: 335437 - RNA, 64 nt, hsa
gagugacagagcgagacuccaucucuuuaaaaacaaacaaaaaauuaucugaaugauccugucu

SEQ ID NO: 335438 - RNA, 64 nt, hsa
aucauagcaagaccucaucucuacuaaaauucaaaaacaaaauuagccgggcaugauggugcau

SEQ ID NO: 335439 - RNA, 64 nt, hsa
ugaaauuuucucuuguaaaacauuuagaaaacaaaaacaaaaaaaaugugauuuguuucugucu

SEQ ID NO: 335440 - RNA, 64 nt, hsa
ugcuuuugaaauuuucucuuguaaaacauuuagaaaacaaaaacaaaaaaaaugugauuuguuu

SEQ ID NO: 335441 - RNA, 64 nt, hsa
gcugccaaaaccauuaaguggaaagcugauuaaaaaacaaaaauuucuaauggauuuaucaaac

SEQ ID NO: 335442 - RNA, 64 nt, hsa
ggcgaaauccccgucuuuacaaaaacaaacaaacaaacaaaaaagauauugcaguuguguugua

SEQ ID NO: 335443 - RNA, 64 nt, hsa
auauuuaggugacuuacagcaaccaauugcaacaaaacaaaauguuaagaaaugaucuuuuuau

SEQ ID NO: 335444 - RNA, 64 nt, hsa
guacacagaaaaacaaaaggacaagcuuucugugaaacaaaauauuuacuuagggauaaugugg

SEQ ID NO: 335445 - RNA, 64 nt, hsa
acgcacaagcgccagugcgcacguguacacagaaaaacaaaaggacaagcuuucugugaaacaa

SEQ ID NO: 335446 - RNA, 64 nt, hsa
caggaaugucuuuuuuaauuagaagacaggaagaaaacaaaaaccagacugugucccacaauca

SEQ ID NO: 335447 - RNA, 64 nt, hsa
uagauuuuuuucccaauugagaaaaauauauacuaaacaaaauagcaauaaaacauaaucacuc

SEQ ID NO: 335448 - RNA, 64 nt, hsa
aaaaauuaucuauagcuaaguacacaauaagcaaaaacaaaaagaaaagaaaauuuuuguagua

SEQ ID NO: 335449 - RNA, 64 nt, hsa
gaacuugcucucauuuuccugggugcaucaaacaaaacaaaaaccaaacacccagaggucucau

SEQ ID NO: 335450 - RNA, 64 nt, hsa
uccuggaacuugcucucauuuuccugggugcaucaaacaaaacaaaaaccaaacacccagaggu

SEQ ID NO: 335451 - RNA, 64 nt, hsa
uuucaggguauccuuaaaaaaaaacacacacgaaaaacaaaaguuugcuuguuuaaaaugacag

SEQ ID NO: 335452 - RNA, 64 nt, hsa
uuuuuaaagcugaguaguuaagaauucccuguaaaaacaaaacccuguaaauugagccucaugu

SEQ ID NO: 335453 - RNA, 64 nt, hsa
uucccuaaguuugaguugauaguuauuaaaaagaaaacaaaacaaaaaaaaaaggcaaggcaca

SEQ ID NO: 335454 - RNA, 64 nt, hsa
uaaguuugaguugauaguuauuaaaaagaaaacaaaacaaaaaaaaaaggcaaggcacaacaaa

SEQ ID NO: 335455 - RNA, 64 nt, hsa
uugauguguuauaguggaaaauaacauauagauuaaacaaaauuuuuaucuuuuuucaagaaua

SEQ ID NO: 335456 - RNA, 64 nt, hsa
ccagcaugugacuaguuacaaaagcaauaaauugaaacaaaacaaaacaaaacaaaacuuguuu

SEQ ID NO: 335457 - RNA, 64 nt, hsa
augugacuaguuacaaaagcaauaaauugaaacaaaacaaaacaaaacaaaacuuguuucuuaa

SEQ ID NO: 335458 - RNA, 64 nt, hsa
acuaguuacaaaagcaauaaauugaaacaaaacaaaacaaaacaaaacuuguuucuuaaaaaug

SEQ ID NO: 335459 - RNA, 64 nt, hsa
uuacaaaagcaauaaauugaaacaaaacaaaacaaaacaaaacuuguuucuuaaaaaugcgguu

SEQ ID NO: 335460 - RNA, 64 nt, hsa
acauucguuucccagugaaaagcaaaccagaacaaaacaaaaagccaccgcaauaauucgguaa

SEQ ID NO: 335461 - RNA, 64 nt, hsa
aauuaaacaauuaaaugaaacaaaucuaaaagugaaacaaaaaccaaccaacaaauacaacaca

SEQ ID NO: 335462 - RNA, 64 nt, hsa
ugaaagaacaaaacaaaacaaaacaaacacaaacaaacaaaaaaccuucaacugccuuaugccc

SEQ ID NO: 335463 - RNA, 64 nt, hsa
uuaugggauuggugcugauugaaagaacaaaacaaaacaaaacaaacacaaacaaacaaaaaac

SEQ ID NO: 335464 - RNA, 64 nt, hsa
aucauuuaugggauuggugcugauugaaagaacaaaacaaaacaaaacaaacacaaacaaacaa

SEQ ID NO: 335465 - RNA, 64 nt, hsa
guauacaaagauauucucuauguuuuguaaguaaaaacaaaaagaaaaccuuucuuuuguuuuu

SEQ ID NO: 335466 - RNA, 64 nt, hsa
uuggaggaugggagagaacaggagggaagaugggaaacaaaauagagaauucuuaagauuuugu

SEQ ID NO: 335467 - RNA, 64 nt, hsa
cccccugagaaaacacuugaauugacgcaauauaaaacaaaaugugaaaaccaaaguggauuua

SEQ ID NO: 335468 - RNA, 64 nt, hsa
guuuuuucuuucccuuuuuuguuccuccaaacaaaaacaaaaugcaggccgagcgcgguggcuc

SEQ ID NO: 335469 - RNA, 64 nt, hsa
gguuuuguuuuuucuuucccuuuuuuguuccuccaaacaaaaacaaaaugcaggccgagcgcgg

SEQ ID NO: 335470 - RNA, 64 nt, hsa
auuugguguacucagcaaauaaacuuuucauuuuaaacaaaaacauucauuuauuguguugugc

SEQ ID NO: 335471 - RNA, 64 nt, hsa
aguauaccuggcuuuuuaaaauauauguauuuaaaaacaaaaagcaacaguaaucuauguguuu

SEQ ID NO: 335472 - RNA, 64 nt, hsa
guuaaugaucaauacuguaaauugggucuuuuguaaacaaaaaggcaaugauguaugcauuuuu

SEQ ID NO: 335473 - RNA, 64 nt, hsa
uaccauaugugcugucuauuauaaaugggacaccaaacaaaauuuucuauuacaguuguguacu

SEQ ID NO: 335474 - RNA, 64 nt, hsa
augaacuucaugugggcuuaauuuucugugcuauaaacaaaaguguuuauuuuuuauuaaccuc

SEQ ID NO: 335475 - RNA, 64 nt, hsa
uuaggugcaucuaucucuucgcucugucuuccacaaacaaaaauucugccuucagacauuuggu

SEQ ID NO: 335476 - RNA, 64 nt, hsa
aggcuuucagguaugaauuaaaagcaaaaacaaaaaacaaaacaauucauuagccucagauucu

SEQ ID NO: 335477 - RNA, 61 nt, hsa
uucaaggcuuucagguaugaauuaaaagcaaaaacaaaaaacaaaacaauucauuagccuc

SEQ ID NO: 335478 - RNA, 64 nt, hsa
ccaacaauaagcuagaaaagacaaaaaaaacaaaaaacaaaaaaacguguaauaaaguuagugg

SEQ ID NO: 335479 - RNA, 64 nt, hsa
uuuucuaccaacaauaagcuagaaaagacaaaaaaaacaaaaaacaaaaaaacguguaauaaag

SEQ ID NO: 335480 - RNA, 64 nt, hsa
aguaucuucauuauucucauuuucucugaguuggaaacaaaaacaugaaggacuccaacuagaa

SEQ ID NO: 335481 - RNA, 64 nt, hsa
accuggggcuaguuuuuuaugcuuuguaccuagaaaacaaaaaauuacauucguugggcuuuuu

SEQ ID NO: 335482 - RNA, 64 nt, hsa
caaaauauuuccucaguacuuugcagaaaacaccaaacaaaaaugccauuuuaaaaaaggugua

SEQ ID NO: 335483 - RNA, 64 nt, hsa
auucauuacuucauguauaucaagcacagcaguaaaacaaaaacccauguauuuaacuuuuuuu

SEQ ID NO: 335484 - RNA, 64 nt, hsa
guagauuucugacaucaaaacuuggacccuuggaaaacaaaaguuuuaauuaaaaaaaauccuu

SEQ ID NO: 335485 - RNA, 64 nt, hsa
uucuguuauauaguggaugauauacacaguggcaaaacaaaaguacauugcuuaaaauauauag

SEQ ID NO: 335486 - RNA, 64 nt, hsa
aaacugguuuuuuucaaaaaaaaaaaaaaaacaaaaacaaaaaaaaaacacaaaagcugcaugu

SEQ ID NO: 335487 - RNA, 64 nt, hsa
caaaauaaacugguuuuuuucaaaaaaaaaaaaaaaacaaaaacaaaaaaaaaacacaaaagcu

SEQ ID NO: 335488 - RNA, 64 nt, hsa
acuuacaucucucuaugcuguucuacaagcaaacaaacaaaaauaggaguauaggaacugcugg

SEQ ID NO: 335489 - RNA, 64 nt, hsa
augauuucaaguacccuguauucuggaugcuaaaaaacaaaaacaaacaaaaaaacaaaaacaa

SEQ ID NO: 335490 - RNA, 64 nt, hsa
guacccuguauucuggaugcuaaaaaacaaaaacaaacaaaaaaacaaaaacaaaaaaacaaaa

SEQ ID NO: 335491 - RNA, 64 nt, hsa
uauucuggaugcuaaaaaacaaaaacaaacaaaaaaacaaaaacaaaaaaacaaaaccagaauc

SEQ ID NO: 335492 - RNA, 64 nt, hsa
ggaugcuaaaaaacaaaaacaaacaaaaaaacaaaaacaaaaaaacaaaaccagaaucagguaa

SEQ ID NO: 335493 - RNA, 64 nt, hsa
aaaaacaaaaacaaacaaaaaaacaaaaacaaaaaaacaaaaccagaaucagguaaaacagcua

SEQ ID NO: 335494 - RNA, 64 nt, hsa
uguuaaggauugucuuaaaguuccuuagccagcaaaacaaaacaaaacaaaacaaacaaaugaa

SEQ ID NO: 335495 - RNA, 64 nt, hsa
aggauugucuuaaaguuccuuagccagcaaaacaaaacaaaacaaaacaaacaaaugaaaaacg

SEQ ID NO: 335496 - RNA, 64 nt, hsa
ugucuuaaaguuccuuagccagcaaaacaaaacaaaacaaaacaaacaaaugaaaaacguuuaa

SEQ ID NO: 335497 - RNA, 64 nt, hsa
aguuuuaaccaguuguagucaaaaugcuacaauaaaacaaaaaagagaaagaaaaugaagagca

SEQ ID NO: 335498 - RNA, 64 nt, hsa
uucuuccauucuuaacaguaugugcccauuugcaaaacaaaaaugcuaauaaucaguaauaguc

SEQ ID NO: 335499 - RNA, 64 nt, hsa
uucaagaccuaacugcagccgcuuugggaaaaaaaaacaaaaaacaaaaaacagaaaacaaaaa

SEQ ID NO: 335500 - RNA, 64 nt, hsa
ccuaacugcagccgcuuugggaaaaaaaaacaaaaaacaaaaaacagaaaacaaaaaaaaaaaa

SEQ ID NO: 335501 - RNA, 64 nt, hsa
guauuccauuuaaaaauauguuuaaauuguccuaaaacaaaauaauuuucucccuaggaguaug

SEQ ID NO: 335502 - RNA, 64 nt, hsa
aguuaucugcaagcaaagagagaggcuucagaagaaacaaaaucaccagcaccuugaucuuuga

SEQ ID NO: 335503 - RNA, 64 nt, hsa
gggaccacauuuuucaaguauuucuaaguauaaaaaacaaaacaaaaaucucuuaggaaauguc

SEQ ID NO: 335504 - RNA, 64 nt, hsa
cacauuuuucaaguauuucuaaguauaaaaaacaaaacaaaaaucucuuaggaaaugucuagac

SEQ ID NO: 335505 - RNA, 64 nt, hsa
ccuugacaaaauuuaagcugagcuuaaaagcaaaaaacaaaaaguacacagaaauauuuauuaa

SEQ ID NO: 335506 - RNA, 64 nt, hsa
ccuucuugcuuauacguuaaguuacauaaaaggaaaacaaaauuauguggugugaaacagccaa

SEQ ID NO: 335507 - RNA, 64 nt, hsa
ccugcaaaaauaaaagggaaaaaaaagaaaaaagaaacaaaaaggaacuucuuauaguugucuu

SEQ ID NO: 335508 - RNA, 64 nt, hsa
cuguagaaauauuauuccagcauagcaggaaaacaaacaaaaguauuggacugucggaggugag

SEQ ID NO: 335509 - RNA, 64 nt, hsa
uaucaaacuugcaaaaaaaaaaaaaaaaaaaaaaaaacaaaaaaacuagacaaggagagaggca

SEQ ID NO: 335510 - RNA, 64 nt, hsa
guacacacacaacagaacaaaaugaagcaaaacaaaacaaaaaaacccacaaaaauuuguaaaa

SEQ ID NO: 335511 - RNA, 64 nt, hsa
uuguuguacacacacaacagaacaaaaugaagcaaaacaaaacaaaaaaacccacaaaaauuug

SEQ ID NO: 335512 - RNA, 64 nt, hsa
uaggccaggccuuuuagcauuuugcuaagacuugaaacaaaaaauguaaauacaaaagaaauca

SEQ ID NO: 335513 - RNA, 64 nt, hsa
accaugaccugcugguguguguguauauuuacaaaaacaaaacaaacaaaccacccauugggau

SEQ ID NO: 335514 - RNA, 64 nt, hsa
guguuuuguauaaaucccuaauauuuaaaaaaaaaaacaaaacaaaaaaagguuacaaaguuug

SEQ ID NO: 335515 - RNA, 64 nt, hsa
uuguauaaaucccuaauauuuaaaaaaaaaaacaaaacaaaaaaagguuacaaaguuuguuaac

SEQ ID NO: 335516 - RNA, 64 nt, hsa
gggauggaaaggacuagccucuacugaugcaaaaaaacaaaaagcaacacaaacguuuccuucu

SEQ ID NO: 335517 - RNA, 64 nt, hsa
aaaaugaggaagauguguucauuguggacucuaaaaacaaaacaaaacacaaaauccccuguuc

SEQ ID NO: 335518 - RNA, 64 nt, hsa
gaggaagauguguucauuguggacucuaaaaacaaaacaaaacacaaaauccccuguucaaaua

SEQ ID NO: 335519 - RNA, 64 nt, hsa
aaacaaaacaaaacacaaaauccccuguucaaauaaacaaaaaauccaagauugauucaugaaa

SEQ ID NO: 335520 - RNA, 64 nt, hsa
ucuuccuauuacuuuauugacucauuuuauugcaaaacaaaaaggauuacccaaacaacauguu

SEQ ID NO: 335521 - RNA, 64 nt, hsa
uaauccaaguaaaggaauaugaagggauuguaaaaaacaaaauguccauugauagaccaucgug

SEQ ID NO: 335522 - RNA, 64 nt, hsa
acucaaugacaaagaccgagucuucuuuuuuuuuaaacaaaaacaaaaaaagcaaccagggcua

SEQ ID NO: 335523 - RNA, 64 nt, hsa
ugacaaagaccgagucuucuuuuuuuuuaaacaaaaacaaaaaaagcaaccagggcuauuugua

SEQ ID NO: 335524 - RNA, 64 nt, hsa
uuucucuuggaauguguauuguuuuuauuuugcgaaacaaaacaaaacaaaaaaaaaagcuugg

SEQ ID NO: 335525 - RNA, 64 nt, hsa
cuuggaauguguauuguuuuuauuuugcgaaacaaaacaaaacaaaaaaaaaagcuuggaacuc

SEQ ID NO: 335526 - RNA, 64 nt, hsa
aauguguauuguuuuuauuuugcgaaacaaaacaaaacaaaaaaaaaagcuuggaacuccauca

SEQ ID NO: 335527 - RNA, 64 nt, hsa
ugcaauucccuauuauauucugcaucagaaaaacaaacaaaacaaaaacaacuuuaaaugcuug

SEQ ID NO: 335528 - RNA, 64 nt, hsa
uucccuauuauauucugcaucagaaaaacaaacaaaacaaaaacaacuuuaaaugcuuguagca

SEQ ID NO: 335529 - RNA, 64 nt, hsa
cuucaggucuuaagugcaaaucaaagcaaaaaacaaacaaaacuuacauggaaaaacuguaagu

SEQ ID NO: 335530 - RNA, 64 nt, hsa
gucucagaccuacaaagaguuaaaacaaacagacaaacaaaaaaaaacacuacuauuuuaaaua

SEQ ID NO: 335531 - RNA, 64 nt, hsa
cuuaaauuggguucaugaugcagucuccucuuuaaaacaaaacaaaacaaaacaaaacuauacu

SEQ ID NO: 335532 - RNA, 64 nt, hsa
auuggguucaugaugcagucuccucuuuaaaacaaaacaaaacaaaacaaaacuauacuugaac

SEQ ID NO: 335533 - RNA, 64 nt, hsa
guucaugaugcagucuccucuuuaaaacaaaacaaaacaaaacaaaacuauacuugaacaaaag

SEQ ID NO: 335534 - RNA, 64 nt, hsa
ugaugcagucuccucuuuaaaacaaaacaaaacaaaacaaaacuauacuugaacaaaaggguca

SEQ ID NO: 335535 - RNA, 64 nt, hsa
gacagggagagguggagaaggaaaaaacccuacaaaacaaaaacaaaccgcauacacguucacc

SEQ ID NO: 335536 - RNA, 64 nt, hsa
uucccccccaucuuuaaaaauaauuaguaauaaaaaacaaaaauuccauaucuagccccauccc

SEQ ID NO: 335537 - RNA, 64 nt, hsa
cauuuuuuaaagucccaccuuucaauguuuaauaaaacaaaaagagaaauccuuaaucuaaaag

SEQ ID NO: 335538 - RNA, 64 nt, hsa
uggccauuagguaccuagcagaugugcacaauauaaacaaaaagauaucuggccuaccuuacua

SEQ ID NO: 335539 - RNA, 64 nt, hsa
acagagccaaacuccgucaaaaaaaaacaaaacaaaacaaaaaaaagacaugggagagauggug

SEQ ID NO: 335540 - RNA, 64 nt, hsa
gagugacagagccaaacuccgucaaaaaaaaacaaaacaaaacaaaaaaaagacaugggagaga

SEQ ID NO: 335541 - RNA, 64 nt, hsa
agcuggagugacagagccaaacuccgucaaaaaaaaacaaaacaaaacaaaaaaaagacauggg

SEQ ID NO: 335542 - RNA, 64 nt, hsa
cauguuucaguuucugcauguagauuuaaauaaaaaacaaaacuuguaaaguuguaacauuuca

SEQ ID NO: 335543 - RNA, 64 nt, hsa
gggaucuaggugagcccauuguaaguaucauugaaaacaaaacaugcccgucaacaugucacag

SEQ ID NO: 335544 - RNA, 64 nt, hsa
caacuuuuuaccuuuugaaauauggcuacauuuaaaacaaaaucucacagcucgguuuuucuua

SEQ ID NO: 335545 - RNA, 64 nt, hsa
augcuacuguauuuuacaucuuuauuucuuggugaaacaaaaguuuuaaaaguaguuuuaacaa

SEQ ID NO: 335546 - RNA, 64 nt, hsa
gcgucuucaaaaacaaauugcacugauaaaacaaaaacaaaaguauguuuuaaaugcuuugaag

SEQ ID NO: 335547 - RNA, 64 nt, hsa
uuuccggcgucuucaaaaacaaauugcacugauaaaacaaaaacaaaaguauguuuuaaaugcu

SEQ ID NO: 335548 - RNA, 64 nt, hsa
cugaaaaaggcagaguuugaaagcucccauuuaaaaacaaaauacuuuuuaaagcccucuugcc

SEQ ID NO: 335549 - RNA, 64 nt, hsa
agaguugcuguggacagaccuguaaggacuugcaaaacaaaagaaagugagggguuuuuuuaac

SEQ ID NO: 335550 - RNA, 64 nt, hsa
ggguaaucaugaaagaaggcucagagaaagagggaaacaaaagccuguucagcagaggccccuu

SEQ ID NO: 335551 - RNA, 64 nt, hsa
ggaggacgccaguaaaaaaacaaaaacaaaaacaaaacaaaacauaaaauauaaacaaucaaaa

SEQ ID NO: 335552 - RNA, 64 nt, hsa
ugaauggaggacgccaguaaaaaaacaaaaacaaaaacaaaacaaaacauaaaauauaaacaau

SEQ ID NO: 335553 - RNA, 64 nt, hsa
aauguuugaauggaggacgccaguaaaaaaacaaaaacaaaaacaaaacaaaacauaaaauaua

SEQ ID NO: 335554 - RNA, 64 nt, hsa
uauguaaauguuugaauggaggacgccaguaaaaaaacaaaaacaaaaacaaaacaaaacauaa

SEQ ID NO: 335555 - RNA, 64 nt, hsa
acucauucuucagugccucaugacugaaaacaaaaaacaaaaaaacgaaagcaucuucacaaug

SEQ ID NO: 335556 - RNA, 64 nt, hsa
cagcacaacucauucuucagugccucaugacugaaaacaaaaaacaaaaaaacgaaagcaucuu

SEQ ID NO: 335557 - RNA, 64 nt, hsa
ugcuuauucuuuaacaaagagaaucuaaaaaaaaaaacaaaaaacuguugucuaauauaucuac

SEQ ID NO: 335558 - RNA, 64 nt, hsa
auauuuucauaaucagucaaaauaauaaaacuaaaaacaaaaaguaaaaauuaguucccaagua

SEQ ID NO: 335559 - RNA, 64 nt, hsa
aauacuuaucucuguuaagacuccauugaaaguuaaacaaaaagccgauauaauaguuuggguu

SEQ ID NO: 335560 - RNA, 64 nt, hsa
uccagcuugggcaacagagugagacuccaucucaaaacaaaacaaaacaaaacaaaacaaaaaa

SEQ ID NO: 335561 - RNA, 64 nt, hsa
cuugggcaacagagugagacuccaucucaaaacaaaacaaaacaaaacaaaacaaaaaaacccg

SEQ ID NO: 335562 - RNA, 64 nt, hsa
gcaacagagugagacuccaucucaaaacaaaacaaaacaaaacaaaacaaaaaaacccggcuuu

SEQ ID NO: 335563 - RNA, 64 nt, hsa
agagugagacuccaucucaaaacaaaacaaaacaaaacaaaacaaaaaaacccggcuuugcugc

SEQ ID NO: 335564 - RNA, 64 nt, hsa
gagacuccaucucaaaacaaaacaaaacaaaacaaaacaaaaaaacccggcuuugcugcuuuua

SEQ ID NO: 335565 - RNA, 64 nt, hsa
cuucuggcuuuuaauuuugccagcuaaggacauaaaacaaaaauaaacaaacaaaaacaaauag

SEQ ID NO: 335566 - RNA, 64 nt, hsa
uuuugccagcuaaggacauaaaacaaaaauaaacaaacaaaaacaaauagccaucugcuaucag

SEQ ID NO: 335567 - RNA, 64 nt, hsa
ggcccccaucagggaccagacuguuccaaaaaaaaaacaaaaaacaaaaacaaacaaaaaaaca

SEQ ID NO: 335568 - RNA, 64 nt, hsa
aucagggaccagacuguuccaaaaaaaaaacaaaaaacaaaaacaaacaaaaaaacacuuaaaa

SEQ ID NO: 335569 - RNA, 64 nt, hsa
agacuguuccaaaaaaaaaacaaaaaacaaaaacaaacaaaaaaacacuuaaaagcccaaggag

SEQ ID NO: 335570 - RNA, 64 nt, hsa
acgcuaaaagauuaaguaaaaugcccaaggguauaaacaaaagcaacaugaaaguggaagccgu

SEQ ID NO: 335571 - RNA, 64 nt, hsa
guaccguuuaaagaaaaagcagcuuuaaagugacaaacaaaauacccuuuuucuuuuaguaugg

SEQ ID NO: 335572 - RNA, 64 nt, hsa
ugagaauaaguuuauauucuugcuagguaaaacaaaacaaaaacgacaguaauaccaaggaauc

SEQ ID NO: 335573 - RNA, 64 nt, hsa
gauuuugagaauaaguuuauauucuugcuagguaaaacaaaacaaaaacgacaguaauaccaag

SEQ ID NO: 335574 - RNA, 64 nt, hsa
ugauugcaaacaaacagugaacacugucugaauuaaacaaaaagcugcccgacuugcaaucuaa

SEQ ID NO: 335575 - RNA, 64 nt, hsa
acaauucauaaugcagcaguuucuccaaaaacaaaaacaaaacacacaccacacacacgcgcuu

SEQ ID NO: 335576 - RNA, 64 nt, hsa
gugguuacaauucauaaugcagcaguuucuccaaaaacaaaaacaaaacacacaccacacacac

SEQ ID NO: 335577 - RNA, 64 nt, hsa
auauuugguuuaguucuguguuucagugacugauaaacaaaaaugaagcuaaaaugaaucaacg

SEQ ID NO: 335578 - RNA, 64 nt, hsa
cuagagggaaaugauucaaauuuuuucauaauucaaacaaaaguuauuacacuaaaaguauuau

SEQ ID NO: 335579 - RNA, 64 nt, hsa
agcaaggcucugucucaaaaaaaaacaaaaacaaaaacaaaaaagacugauaucgcaccuaaau

SEQ ID NO: 335580 - RNA, 64 nt, hsa
ugacagagcaaggcucugucucaaaaaaaaacaaaaacaaaaacaaaaaagacugauaucgcac

SEQ ID NO: 335581 - RNA, 64 nt, hsa
ccugggugacagagcaaggcucugucucaaaaaaaaacaaaaacaaaaacaaaaaagacugaua

SEQ ID NO: 335582 - RNA, 64 nt, hsa
aagggagaagauauucucgugaaagaaaaaaacaaaacaaaacaacagugcuuuuuucaaaccu

SEQ ID NO: 335583 - RNA, 64 nt, hsa
cuuccaagggagaagauauucucgugaaagaaaaaaacaaaacaaaacaacagugcuuuuuuca

SEQ ID NO: 335584 - RNA, 64 nt, hsa
auauuagguuugcuaaauucuuucacagacuauaaaacaaaaaauuuugaggaacaccucucau

SEQ ID NO: 335585 - RNA, 64 nt, hsa
aauaaugacaaaaagcacaugcagaguaauacacaaacaaaaaaagugacaguuacuuuuuugu

SEQ ID NO: 335586 - RNA, 64 nt, hsa
guaucauuuuaguuaagugggucaaacagaaucaaaacaaaacccaaagaaauaaauaaaaaac

SEQ ID NO: 335587 - RNA, 64 nt, hsa
cagaaucaaaacaaaacccaaagaaauaaauaaaaaacaaaauggcuaaauaguuuaaaauagg

SEQ ID NO: 335588 - RNA, 64 nt, hsa
uauucacuuugagaaucgguuugacuuugcuuucaaacaaaacaaaaaccucuugcuuuuaggg

SEQ ID NO: 335589 - RNA, 64 nt, hsa
acuuugagaaucgguuugacuuugcuuucaaacaaaacaaaaaccucuugcuuuuagggguucu

SEQ ID NO: 335590 - RNA, 64 nt, hsa
gagaaaguagcacauggaguagcugagguuaaacaaacaaaaaaaaauuuuaaacaaagaaagg

SEQ ID NO: 335591 - RNA, 64 nt, hsa
cacucuucuaauugaauauuuuuauauuuuuaugaaacaaaagagcauuucuucagguuucuau

SEQ ID NO: 335592 - RNA, 64 nt, hsa
aauuauuaauagcucagguuaaaaacacccauuuaaacaaaaacaagagcauuuguaauaggaa

SEQ ID NO: 335593 - RNA, 64 nt, hsa
gauauauucauauuacucguuuauaaaaaaucaaaaacaaaaggaaagaaaacaaaaaaaacuu

SEQ ID NO: 335594 - RNA, 64 nt, hsa
cucguuuauaaaaaaucaaaaacaaaaggaaagaaaacaaaaaaaacuugcacaaaaauacuga

SEQ ID NO: 335595 - RNA, 64 nt, hsa
gacaguauuguaaucccaucaaaagaugaaagaaaaacaaaaacaaaaaccaacaacaauuagc

SEQ ID NO: 335596 - RNA, 64 nt, hsa
auuguaaucccaucaaaagaugaaagaaaaacaaaaacaaaaaccaacaacaauuagccauagu

SEQ ID NO: 335597 - RNA, 64 nt, hsa
gcucugaaaugaaaguuugucuucacaaauaucaaaacaaaauggaggaaaacuaagcauuggc

SEQ ID NO: 335598 - RNA, 64 nt, hsa
uggguggcaaagugagacucuggcucaaaaaaaaaaacaaaaaacaaaaccaucugcccuccuc

SEQ ID NO: 335599 - RNA, 64 nt, hsa
caaagugagacucuggcucaaaaaaaaaaacaaaaaacaaaaccaucugcccuccuccccuagc

SEQ ID NO: 335600 - RNA, 64 nt, hsa
cagaaucaucuugguagauaggggcacugugcuuaaacaaaaugccauuaaugggauuauaaua

SEQ ID NO: 335601 - RNA, 64 nt, hsa
acuuucauaucaauaauugauuauguauuaacugaaacaaaagacuagagaaagacacaguggg

SEQ ID NO: 335602 - RNA, 64 nt, hsa
cgcaagagauucagcacugggaaagauauaauugaaacaaaauaguguaaucauuuuauuaaaa

SEQ ID NO: 335603 - RNA, 64 nt, hsa
auaguaggauuuuaaagggcauugauagcauaccaaacaaaaggcaaaauaaagugaccuuuuu

SEQ ID NO: 335604 - RNA, 64 nt, hsa
uacuguaaaaaaaagugcacugaacuucaaaacaaaacaaaaaacaacaacaacaaaaaacaag

SEQ ID NO: 335605 - RNA, 64 nt, hsa
aaucuuacuguaaaaaaaagugcacugaacuucaaaacaaaacaaaaaacaacaacaacaaaaa

SEQ ID NO: 335606 - RNA, 64 nt, hsa
gccauguuauaaauauuguuauuuaaaaaacaaaaaacaaaacacacguacauuagguccuggg

SEQ ID NO: 335607 - RNA, 64 nt, hsa
gucacuggccauguuauaaauauuguuauuuaaaaaacaaaaaacaaaacacacguacauuagg

SEQ ID NO: 335608 - RNA, 64 nt, hsa
uuuggaaaagaauuccuucuuaaaaucaaaaacaaaacaaaaaaacacaaaaaacacauucuaa

SEQ ID NO: 335609 - RNA, 64 nt, hsa
guaacuuuggaaaagaauuccuucuuaaaaucaaaaacaaaacaaaaaaacacaaaaaacacau

SEQ ID NO: 335610 - RNA, 64 nt, hsa
cguccacacagcacuggggaaggggagccacuugaaacaaaagucaacaacugguuguaguuca

SEQ ID NO: 335611 - RNA, 64 nt, hsa
acucugucucaaaaaaaaaaaaacaaaaacaaacaaacaaaaaaaacaccucaccaugagugcu

SEQ ID NO: 335612 - RNA, 64 nt, hsa
ggcaacagaguaagacucugucucaaaaaaaaaaaaacaaaaacaaacaaacaaaaaaaacacc

SEQ ID NO: 335613 - RNA, 64 nt, hsa
augcuuuguuuaaaaaaacgaaaaaaacaaaacaaaacaaaaaaacaugagcagugguguucua

SEQ ID NO: 335614 - RNA, 64 nt, hsa
cacuaaugcuuuguuuaaaaaaacgaaaaaaacaaaacaaaacaaaaaaacaugagcaguggug

SEQ ID NO: 335615 - RNA, 64 nt, hsa
gauaacacuaaugcuuuguuuaaaaaaacgaaaaaaacaaaacaaaacaaaaaaacaugagcag

SEQ ID NO: 335616 - RNA, 64 nt, hsa
cuuccuugaaaauuuuauuaaaaaacaaacaaacaaacaaaaagccuguccacccuugagaauc

SEQ ID NO: 335617 - RNA, 64 nt, hsa
ucuauauuuuacauucuuggaaagucuauaugaaaaacaaaaauaacaucuucaguuuuucucc

SEQ ID NO: 335618 - RNA, 64 nt, hsa
uuaucuuaaaaaguaaacaaaacaaaacaaaacaaaacaaaaaacuagauauguaauuucuaaa

SEQ ID NO: 335619 - RNA, 64 nt, hsa
gacucuuaucuuaaaaaguaaacaaaacaaaacaaaacaaaacaaaaaacuagauauguaauuu

SEQ ID NO: 335620 - RNA, 64 nt, hsa
ggcaggacucuuaucuuaaaaaguaaacaaaacaaaacaaaacaaaacaaaaaacuagauaugu

SEQ ID NO: 335621 - RNA, 64 nt, hsa
ggugcggcaggacucuuaucuuaaaaaguaaacaaaacaaaacaaaacaaaacaaaaaacuaga

SEQ ID NO: 335622 - RNA, 64 nt, hsa
aaagaggugcggcaggacucuuaucuuaaaaaguaaacaaaacaaaacaaaacaaaacaaaaaa

SEQ ID NO: 335623 - RNA, 64 nt, hsa
uauauuuuuccuucacugugucaaguggaaacaaaaacaaaaucuuucaaaaaaaaaaucggga

SEQ ID NO: 335624 - RNA, 64 nt, hsa
uauauauauauuuuuccuucacugugucaaguggaaacaaaaacaaaaucuuucaaaaaaaaaa

SEQ ID NO: 335625 - RNA, 64 nt, hsa
uggcauguaguuaucuaaucaagacaccucauucaaacaaaaccugccuuaggaaaauuuaaua

SEQ ID NO: 335626 - RNA, 64 nt, hsa
auuggauuaaucagcugguuucaacucuacugcgaaacaaaaauagcuccuuaaaaguacuguu

SEQ ID NO: 335627 - RNA, 64 nt, hsa
aggcuuuacuucuuuugcaugcacuuuaaaaacaaaacaaaacauuuuucagguuccaaggaag

SEQ ID NO: 335628 - RNA, 64 nt, hsa
aaaaaaggcuuuacuucuuuugcaugcacuuuaaaaacaaaacaaaacauuuuucagguuccaa

SEQ ID NO: 335629 - RNA, 64 nt, hsa
cacaagcugcagucuguagcacugaacaaacaaaaaacaaaacgcucaagccuuacgaccagag

SEQ ID NO: 335630 - RNA, 64 nt, hsa
uggccaccacaagcugcagucuguagcacugaacaaacaaaaaacaaaacgcucaagccuuacg

SEQ ID NO: 335631 - RNA, 64 nt, hsa
uauaaugcuaguccuagauuacuuauugauuuaaaaacaaaaaaaagauuacuuaauuuugauu

SEQ ID NO: 335632 - RNA, 64 nt, hsa
aaaacaaaaaaaagauuacuuaauuuugauuuaaaaacaaaaaaucguaaaauacaaaaaccag

SEQ ID NO: 335633 - RNA, 64 nt, hsa
gcagaagguguauguuggggagaacugaaagggaaaacaaaauacuugacauagucuuaaguag

SEQ ID NO: 335634 - RNA, 64 nt, hsa
uuagcagagacagggaggaaguuuuuauuuuuauaaacaaaaucugauguucagaggccccguu

SEQ ID NO: 335635 - RNA, 64 nt, hsa
auaaacacaaggaacauuccauaucauuagucgaaaacaaaaacaaaaaaaaaaccuuugguca

SEQ ID NO: 335636 - RNA, 64 nt, hsa
acaaggaacauuccauaucauuagucgaaaacaaaaacaaaaaaaaaaccuuuggucauuugua

SEQ ID NO: 335637 - RNA, 64 nt, hsa
aauuugacugugacuuuaaucuaaauuacuauguaaacaaaaaguagauaguuucacuuuuuaa

SEQ ID NO: 335638 - RNA, 64 nt, hsa
caguaccuacauaguuuuuaaauuauuguuuaaaaaacaaaacagcuguuauaaaugaauauua

SEQ ID NO: 335639 - RNA, 64 nt, hsa
gaugaauaaaucuuaaaugcuuuguuuaauuaaaaaacaaaaaucaccaauauccaagacauga

SEQ ID NO: 335640 - RNA, 64 nt, hsa
ucuuuccuuuccaguuaaaaaaaaacaaaaacaaaaacaaaacccuuugcuguaucacugugug

SEQ ID NO: 335641 - RNA, 64 nt, hsa
cuuuccucuuuccuuuccaguuaaaaaaaaacaaaaacaaaaacaaaacccuuugcuguaucac

SEQ ID NO: 335642 - RNA, 64 nt, hsa
ucccuucuuuccucuuuccuuuccaguuaaaaaaaaacaaaaacaaaaacaaaacccuuugcug

SEQ ID NO: 335643 - RNA, 64 nt, hsa
acuaguacauaucuuuaaauuaccaaaaaacaagaaacaaaacauaaaaaccccaaaacuauca

SEQ ID NO: 335644 - RNA, 64 nt, hsa
aauaaccuuccuuaaguacaauuuaacuucaagaaaacaaaauuugacaacauaguuucuuaau

SEQ ID NO: 335645 - RNA, 64 nt, hsa
cugaguauaaaggaaaaacagcaaaacaaaaagcaaacaaaaaaaaacugcaaaagucuaaaau

SEQ ID NO: 335646 - RNA, 64 nt, hsa
agcaagagucccugaguauaaaggaaaaacagcaaaacaaaaagcaaacaaaaaaaaacugcaa

SEQ ID NO: 335647 - RNA, 64 nt, hsa
aaguuauugccaaaggaacugucuguaagacaaaaaacaaaacauguuggaauuacuuaauuga

SEQ ID NO: 335648 - RNA, 64 nt, hsa
auuuccaaucacauugguacuguuugguauuugcaaacaaaaauguaguuaauguaauuuuuau

SEQ ID NO: 335649 - RNA, 64 nt, hsa
caccaucaauuuaaaaguaaaaaaaacaaaaaaaaaacaaaaaauuuaaaaaaaagguuugcua

SEQ ID NO: 335650 - RNA, 64 nt, hsa
augccacgguucaccaucaauuuaaaaguaaaaaaaacaaaaaaaaaacaaaaaauuuaaaaaa

SEQ ID NO: 335651 - RNA, 64 nt, hsa
ugugcugggacugcuauacuugacauuauacugcaaacaaaacuuaaagagauaagcauuaaac

SEQ ID NO: 335652 - RNA, 64 nt, hsa
gucauuaaaacaaaaugaaacauuugccaaaacaaaacaaaaaacuauguauuugcacagcaca

SEQ ID NO: 335653 - RNA, 64 nt, hsa
ccgaagucauuaaaacaaaaugaaacauuugccaaaacaaaacaaaaaacuauguauuugcaca

SEQ ID NO: 335654 - RNA, 64 nt, hsa
auuucauuuucuuuauauuggaccgaagucauuaaaacaaaaugaaacauuugccaaaacaaaa

SEQ ID NO: 335655 - RNA, 64 nt, hsa
gggauuucuaaacagcaguuaagcuacaaaaagcaaacaaaaccacacauauugauggagucug

SEQ ID NO: 335656 - RNA, 64 nt, hsa
uaccugauaaguuccaucguaucaaacuuucuauaaacaaaauacaguauaaucagaaagugcc

SEQ ID NO: 335657 - RNA, 64 nt, hsa
guauuguaaauaaguaacuuugacuucugacaaaaaacaaaaagugcugcauggcucgcaugga

SEQ ID NO: 335658 - RNA, 64 nt, hsa
gaaauuguuccuuggagaaaugaaaacaguguguaaacaaaaugaagcugcccuaauaaaaagg

SEQ ID NO: 335659 - RNA, 64 nt, hsa
aaacucaucugaaauguuacaaaaauaaacuauaaaacaaaaauuugaaaauggaguaguauuu

SEQ ID NO: 335660 - RNA, 64 nt, hsa
gaaauuuauuuguaugauauaaaguuauuacuuuaaacaaaaugcaaguauggggggauuguuu

SEQ ID NO: 335661 - RNA, 64 nt, hsa
uaacuuuuuauaguugaugacuuuaggguagcacaaacaaaacuccuuuguaucuaacuuuucu

SEQ ID NO: 335662 - RNA, 64 nt, hsa
uucugagaccuaaauuuaaagggucaggcauuagaaacaaaaguguuucuucauaucuaggaga

SEQ ID NO: 335663 - RNA, 64 nt, hsa
acauggugcaaccucgucuuuacuaaaaauacaaaaacaaaaauuagccagggguggugguaug

SEQ ID NO: 335664 - RNA, 64 nt, hsa
ccagccugggagacagagcaagacuccaucucaaaaacaaaaacaaaacaaaacaacaacaaaa

SEQ ID NO: 335665 - RNA, 64 nt, hsa
ugggagacagagcaagacuccaucucaaaaacaaaaacaaaacaaaacaacaacaaaaaaagaa

SEQ ID NO: 335666 - RNA, 64 nt, hsa
gacagagcaagacuccaucucaaaaacaaaaacaaaacaaaacaacaacaaaaaaagaaguuaa

SEQ ID NO: 335667 - RNA, 64 nt, hsa
caucagagauacuuuccuaaaaaggaaaaauaaaaaacaaaauggugccacuuuggguugaagc

SEQ ID NO: 335668 - RNA, 64 nt, hsa
uugaauucauuuauaugucuuuugauucuuaaaaaaacaaaaaacauuccauuagaagcaccag

SEQ ID NO: 335669 - RNA, 64 nt, hsa
ucauaccaaaaaguguaagugaaaacccccuuuaaaacaaaacaaaaaaaugaaauaaaauuag

SEQ ID NO: 335670 - RNA, 64 nt, hsa
ccaaaaaguguaagugaaaacccccuuuaaaacaaaacaaaaaaaugaaauaaaauuaggcaaa

SEQ ID NO: 335671 - RNA, 64 nt, hsa
cuguaaccauguuuuuucuguuuaauuauguaaaaaacaaaacuacaacaacaaaaaaagaaaa

SEQ ID NO: 335672 - RNA, 64 nt, hsa
aaagaaaaaaguuaaaaaagaaaaaaacaccaaaaaacaaaaacaaacaaaaaaaaaaacccac

SEQ ID NO: 335673 - RNA, 64 nt, hsa
guuaaaaaagaaaaaaacaccaaaaaacaaaaacaaacaaaaaaaaaaacccacaacccuuauc

SEQ ID NO: 335674 - RNA, 64 nt, hsa
uaaugacuggacaucagaagaggaaaaaaacucaaaacaaaagcgagagagacuauugccauau

SEQ ID NO: 335675 - RNA, 64 nt, hsa
cuuuugccuucaaucuguugucuucaaaacaaacaaacaaaaaaagcuucuugcgccuuucccu

SEQ ID NO: 335676 - RNA, 64 nt, hsa
gcuuguaugcacaagguaggacuuacuucguaagaaacaaaaugccaguauuuucuuaagccau

SEQ ID NO: 335677 - RNA, 64 nt, hsa
ccagacauucuaguuuguggaggguuauuuaaaaaaacaaaaaaggaagauggucaaguuugua

SEQ ID NO: 335678 - RNA, 64 nt, hsa
ccaugcugguagcaagagagaaaaaaucaacagcaaacaaaaccacacaaaccaaaccgucaac

SEQ ID NO: 335679 - RNA, 64 nt, hsa
gcucagucagcaaccucagaacucugaaaaaacaaaacaaaaaaaaaaaaaaaagaaaaaaaaa

SEQ ID NO: 335680 - RNA, 64 nt, hsa
cuguggcucagucagcaaccucagaacucugaaaaaacaaaacaaaaaaaaaaaaaaaagaaaa

SEQ ID NO: 335681 - RNA, 64 nt, hsa
gccuggcgacagagagagacuccaucucaaaacaaaacaaaaaaaauuagccuacuuaaaggca

SEQ ID NO: 335682 - RNA, 64 nt, hsa
cuccagccuggcgacagagagagacuccaucucaaaacaaaacaaaaaaaauuagccuacuuaa

SEQ ID NO: 335683 - RNA, 64 nt, hsa
cgugaccaaauuguuuaagaaaaaaaaacaaaaaaaacaaaaucuagggcuguauuuuauauau

SEQ ID NO: 335684 - RNA, 64 nt, hsa
aaggugcaucgugaccaaauuguuuaagaaaaaaaaacaaaaaaaacaaaaucuagggcuguau

SEQ ID NO: 335685 - RNA, 64 nt, hsa
agcacuguauauaccugucucuaaguaaaggaaaaaacaaaauaaggacuucaauccaaaguuu

SEQ ID NO: 335686 - RNA, 64 nt, hsa
guguuuaacuuuguauuuugauuguugagaacaaaaacaaaaaguaucaauguguauguggcug

SEQ ID NO: 335687 - RNA, 64 nt, hsa
auaugaucuuccauccaaguggagggaaacuuuaaaacaaaaacacccaguacuguggcucagg

SEQ ID NO: 335688 - RNA, 64 nt, hsa
ugucuuuugaagcccagucucugucugucuucagaaacaaaagugaaugccgucauguuccuug

SEQ ID NO: 335689 - RNA, 64 nt, hsa
gcugccuuuaauugucuugcucucuaugggaaaaaaacaaaagggcuucagucucauggauguu

SEQ ID NO: 335690 - RNA, 64 nt, hsa
ugaaaccgcuuuuuaaaauucaaaacaagaaacaaaacaaaaaaaauuaaggggaaaauuauuu

SEQ ID NO: 335691 - RNA, 64 nt, hsa
auagcugaaaccgcuuuuuaaaauucaaaacaagaaacaaaacaaaaaaaauuaaggggaaaau

SEQ ID NO: 335692 - RNA, 64 nt, hsa
gaaaaaggguuguuugacaaccuuugagaaaaagaaacaaaaggaaguaguuaaaugcuuuggu

SEQ ID NO: 335693 - RNA, 64 nt, hsa
uuuguuagugaauuuggaaauaaaaagaaaaaaaaaacaaaaacaaacaggcugccauaauaua

SEQ ID NO: 335694 - RNA, 64 nt, hsa
caaguuacaaguugauaucguugaaugaaaagcaaaacaaaaacaauucaggaacaacggcuaa

SEQ ID NO: 335695 - RNA, 64 nt, hsa
cuaaauccuuuccaauaauugacugguggaaggaaaacaaaaaacaaaaacuaaaaaccucuua

SEQ ID NO: 335696 - RNA, 64 nt, hsa
cuuuccaauaauugacugguggaaggaaaacaaaaaacaaaaacuaaaaaccucuuagcuuuuc

SEQ ID NO: 335697 - RNA, 64 nt, hsa
auuuguguuuauauuuccuguaagugaauaaauaaaacaaaacaaaacaaaaaaaacuugugcc

SEQ ID NO: 335698 - RNA, 64 nt, hsa
uguuuauauuuccuguaagugaauaaauaaaacaaaacaaaacaaaaaaaacuugugccugaua

SEQ ID NO: 335699 - RNA, 64 nt, hsa
auauuuccuguaagugaauaaauaaaacaaaacaaaacaaaaaaaacuugugccugauaagcua

SEQ ID NO: 335700 - RNA, 64 nt, hsa
uccuccuuuaacuccuccuaccccccaagguaagaaacaaaaaacaaacaaacaaacaaaaaua

SEQ ID NO: 335701 - RNA, 64 nt, hsa
accccccaagguaagaaacaaaaaacaaacaaacaaacaaaaauagaagacaaaagaaagacau

SEQ ID NO: 335702 - RNA, 64 nt, hsa
uguucagggagauaauucugccuuuaauugucuaaaacaaaaacaaaaccagccaaccuauguu

SEQ ID NO: 335703 - RNA, 64 nt, hsa
gggagauaauucugccuuuaauugucuaaaacaaaaacaaaaccagccaaccuauguuacacgu

SEQ ID NO: 335704 - RNA, 64 nt, hsa
cuccagccugggugacagagcgagacuaucucagaaacaaaacaaaacaaaacaacaaaaaaag

SEQ ID NO: 335705 - RNA, 64 nt, hsa
gccugggugacagagcgagacuaucucagaaacaaaacaaaacaaaacaacaaaaaaagaaaag

SEQ ID NO: 335706 - RNA, 64 nt, hsa
ggugacagagcgagacuaucucagaaacaaaacaaaacaaaacaacaaaaaaagaaaaggcaga

SEQ ID NO: 335707 - RNA, 64 nt, hsa
gggugcaugggaaagggcuguugauauuaaaaacaaacaaaacaaaaaagccccacacauaacu

SEQ ID NO: 335708 - RNA, 64 nt, hsa
caugggaaagggcuguugauauuaaaaacaaacaaaacaaaaaagccccacacauaacuguuuu

SEQ ID NO: 335709 - RNA, 64 nt, hsa
ugguuuaacucuuuaguuuuauuuuaagaggggaaaacaaaaauaucuugcaagcagaaccuug

SEQ ID NO: 335710 - RNA, 64 nt, hsa
aacaaaguuaggaaguuuguuguuuguuuauuauaaacaaaaagcaugugaaagugcacuuaag

SEQ ID NO: 335711 - RNA, 64 nt, hsa
cccucagaacuuuaguaacagcacaacaaauuaaaaacaaaaacaacucaugccacaguauguc

SEQ ID NO: 335712 - RNA, 64 nt, hsa
uuuggcaugcuguaaaacaaaacaaaacaaaauaaaacaaaaaaaaggaaggaaaaaaaaagaa

SEQ ID NO: 335713 - RNA, 59 nt, hsa
aaggauuuggcaugcuguaaaacaaaacaaaacaaaauaaaacaaaaaaaaggaaggaa

SEQ ID NO: 335714 - RNA, 54 nt, hsa
aaggauuuggcaugcuguaaaacaaaacaaaacaaaauaaaacaaaaaaaagga

SEQ ID NO: 335715 - RNA, 64 nt, hsa; identical to SEQ ID NO: 335696

SEQ ID NO: 335716 - RNA, 64 nt, hsa; identical to SEQ ID NO: 335695

SEQ ID NO: 335717 - RNA, 64 nt, hsa
gcagccugaguaacaaaaugagacccuaucucaaaaacaaaaaggaaaagaaaauauacaugau

SEQ ID NO: 335718 - RNA, 64 nt, hsa
uagucuuaaacucaaauuacuauaugaugauuuaaaacaaaauaaaagagcgaggauggggguu

SEQ ID NO: 335719 - RNA, 64 nt, hsa
uauuuauucucagaaacagaaccagagagaaguuaaacaaaagguuauguaacuguuccuuuaa

SEQ ID NO: 335720 - RNA, 64 nt, hsa
cgggggagggggaacguucauuaaucucugaggaaaacaaaaccuguuuucuacuugagucuaa

SEQ ID NO: 335721 - RNA, 64 nt, hsa
aaaaccucaugagugcauggauuuaaaagagggcaaacaaaaccaguauucuucauauuuacua

SEQ ID NO: 335722 - RNA, 64 nt, hsa
uccugcuaaaaagacaaaaaacaaaaaacaaaaaaaacaaaaaaaaccucaugagugcauggau

SEQ ID NO: 335723 - RNA, 64 nt, hsa
ucccccucuuccugcuaaaaagacaaaaaacaaaaaacaaaaaaaacaaaaaaaaccucaugag

SEQ ID NO: 335724 - RNA, 64 nt, hsa
uauauucucccccucuuccugcuaaaaagacaaaaaacaaaaaacaaaaaaaacaaaaaaaacc

SEQ ID NO: 335725 - RNA, 64 nt, hsa
cacagaaaugaugaaagugaccagaaaaaaacaaaaacaaaaccccuuuacucuguaggucauu

SEQ ID NO: 335726 - RNA, 64 nt, hsa
uucucccacagaaaugaugaaagugaccagaaaaaaacaaaaacaaaaccccuuuacucuguag

SEQ ID NO: 335727 - RNA, 64 nt, hsa
uuuguugcacuuuuaguuuuuuuaaaaaaaacaaaaacaaaaacauggcagaugcauauugugu

SEQ ID NO: 335728 - RNA, 64 nt, hsa
acugacuuuguugcacuuuuaguuuuuuuaaaaaaaacaaaaacaaaaacauggcagaugcaua

SEQ ID NO: 335729 - RNA, 64 nt, hsa
gcgacacagcgagacuccaucucaaaacaaaacaaaacaaaauuagcugagcaugguggugugu

SEQ ID NO: 335730 - RNA, 64 nt, hsa
ccugggcgacacagcgagacuccaucucaaaacaaaacaaaacaaaauuagcugagcauggugg

SEQ ID NO: 335731 - RNA, 64 nt, hsa
uugagccugggcgacacagcgagacuccaucucaaaacaaaacaaaacaaaauuagcugagcau

SEQ ID NO: 335732 - RNA, 64 nt, hsa
ugucuuauuucuaaauuuccuucuuccaagaugaaaacaaaagaaaaacuuaaaacagaaggua

SEQ ID NO: 335733 - RNA, 64 nt, hsa
aagagauucccaccauuauuuagguucaccugcaaaacaaaaaucuuacuccagccccucaaug

SEQ ID NO: 335734 - RNA, 64 nt, hsa
gaaccugccaauccgcuguaacaacucugcuuuaaaacaaaaccaaacaaaacuuuaaaaaaaa

SEQ ID NO: 335735 - RNA, 64 nt, hsa
auccgcuguaacaacucugcuuuaaaacaaaaccaaacaaaacuuuaaaaaaaaaugugugauc

SEQ ID NO: 335736 - RNA, 64 nt, hsa
agaucuugugguuccaugagaauuauuacuuuaaaaacaaaacaaaauauaaaaaacuguguuu

SEQ ID NO: 335737 - RNA, 64 nt, hsa
uugugguuccaugagaauuauuacuuuaaaaacaaaacaaaauauaaaaaacuguguuugagua

SEQ ID NO: 335738 - RNA, 64 nt, hsa
ugacugcuguauucaaauacguagcuuugguaacaaacaaaauccguauaugcaaaucaacaua

SEQ ID NO: 335739 - RNA, 64 nt, hsa
aaauaauaaaggucugcuguggcuaaaaaagcaaaaacaaaaaagcuauccagacaaaauacau

SEQ ID NO: 335740 - RNA, 64 nt, hsa
uaauaaaugcagaaucugaagguaaauagguuuaaaacaaaacaaaaacccaccccuuuaagga

SEQ ID NO: 335741 - RNA, 64 nt, hsa
aaugcagaaucugaagguaaauagguuuaaaacaaaacaaaaacccaccccuuuaaggaguugg

SEQ ID NO: 335742 - RNA, 64 nt, hsa
aaaaaaaccaagaggccaccgugccuuuguaaagaaacaaaauaaaguuuguacuuuguuuuuu

SEQ ID NO: 335743 - RNA, 64 nt, hsa
ccuuuaaauauguuuuuuaagaacagggaaaauuaaacaaaaccccagguuauuucuucccugc

SEQ ID NO: 335744 - RNA, 64 nt, hsa
cucuccucauccuaguucuuuaaaaaaaacaaaaaaacaaaaaaaacuuuuuuuaaucguugua

SEQ ID NO: 335745 - RNA, 61 nt, hsa
cggcucucuccucauccuaguucuuuaaaaaaaacaaaaaaacaaaaaaaacuuuuuuuaa

SEQ ID NO: 335746 - RNA, 64 nt, hsa
uuccaaacuuuugcagaaaaaacaaaaaaacuacaaacaaaagcagcccucugccuccucccca

SEQ ID NO: 335747 - RNA, 64 nt, hsa
agcuacuccccuuucuuccaaacuuuugcagaaaaaacaaaaaaacuacaaacaaaagcagccc

SEQ ID NO: 335748 - RNA, 64 nt, hsa
cuaaaguuuucuucccagagagagcauaauuccgaaacaaaacugugacaaucuuuuggguuga

SEQ ID NO: 335749 - RNA, 64 nt, hsa
gagaacuuucaggcagaucccaccauuagccuguaaacaaaagguguggcaccagccaccuggg

SEQ ID NO: 335750 - RNA, 64 nt, hsa
uguguauuugauggcucuaagggcuauaaauuacaaacaaaacacaucccagacauuaggaguu

SEQ ID NO: 335751 - RNA, 64 nt, hsa
uccaucucuucagaccccuuugccuuuaaaaaaaaaacaaaaacaaaaacaaaaaaacccauaa

SEQ ID NO: 335752 - RNA, 64 nt, hsa
ucuucagaccccuuugccuuuaaaaaaaaaacaaaaacaaaaacaaaaaaacccauaaugccca

SEQ ID NO: 335753 - RNA, 64 nt, hsa
gaccccuuugccuuuaaaaaaaaaacaaaaacaaaaacaaaaaaacccauaaugcccacagaau

SEQ ID NO: 335754 - RNA, 64 nt, hsa
auuggaauucuacuggaaaaaaauacaaaaagcaaaacaaaacccucagcacuguuacaagagg

SEQ ID NO: 335755 - RNA, 64 nt, hsa
agggcaaggaguuuauuacaauguaucuuuauuaaaacaaaaggguguauaguguucacaaacu

SEQ ID NO: 335756 - RNA, 64 nt, hsa
ugggcaaaaagagugagacucugucucaaaaaaaaaacaaaacaaaaaaaaccucuuugcuggu

SEQ ID NO: 335757 - RNA, 64 nt, hsa
aaaaagagugagacucugucucaaaaaaaaaacaaaacaaaaaaaaccucuuugcugguauauu

SEQ ID NO: 335758 - RNA, 64 nt, hsa
gacuuggaggguugguccucuugccuccuggaaaaaacaaaaacaaaaaacugcagugaaagac

SEQ ID NO: 335759 - RNA, 64 nt, hsa
gaggguugguccucuugccuccuggaaaaaacaaaaacaaaaaacugcagugaaagacaagcug

SEQ ID NO: 335760 - RNA, 64 nt, hsa
ucccuucugugugaccgaccccuuggccaaaaaaaaacaaaaagcaaaaaacaaaaaccuaccc

SEQ ID NO: 335761 - RNA, 64 nt, hsa
ccgaccccuuggccaaaaaaaaacaaaaagcaaaaaacaaaaaccuacccuguucugguuuuuu

SEQ ID NO: 335762 - RNA, 64 nt, hsa
acaagaguaaaacuucaucucaaaaaacaaaacaaaacaaaaacaacaacaaaaaacaaaagaa

SEQ ID NO: 335763 - RNA, 64 nt, hsa
ggucaacaagaguaaaacuucaucucaaaaaacaaaacaaaacaaaaacaacaacaaaaaacaa

SEQ ID NO: 335764 - RNA, 64 nt, hsa
agccuggucaacaagaguaaaacuucaucucaaaaaacaaaacaaaacaaaaacaacaacaaaa

SEQ ID NO: 335765 - RNA, 64 nt, hsa
uccccuuauucccgaggcccagaaaagaaaacaaaaacaaaaacccagcacauacaagaaacau

SEQ ID NO: 335766 - RNA, 64 nt, hsa
cucuccuccccuuauucccgaggcccagaaaagaaaacaaaaacaaaaacccagcacauacaag

SEQ ID NO: 335767 - RNA, 64 nt, hsa
uguguauuugauggcuccaagggcuauaaauuacaaacaaaacacaucccagacauuaggaguu

SEQ ID NO: 335768 - RNA, 64 nt, hsa
caaauauuaaagauuuccuuggagucaaaguaaaaaacaaaaaauuguaauguugucuagggau

SEQ ID NO: 335769 - RNA, 64 nt, hsa
gagaacuuucaggcagaucccaccauuagccuguaaacaaaaaguuuggcaccagccaccuggg

SEQ ID NO: 335770 - RNA, 64 nt, hsa
agagguugaauugaguauauauuugaaaaggaaaaaacaaaaaacaaacccagaccccaccuga

SEQ ID NO: 335771 - RNA, 64 nt, hsa
aguauaagcauggauugccaauuccacuugauguaaacaaaacuuuuuuuuauacauaauauau

SEQ ID NO: 335772 - RNA, 64 nt, hsa
aguuugcuggggaguuugauaaaaguauaaaacaaaacaaaaaaagccucgguauaauuuuguu

SEQ ID NO: 335773 - RNA, 64 nt, hsa
cagcaaguuugcuggggaguuugauaaaaguauaaaacaaaacaaaaaaagccucgguauaauu

SEQ ID NO: 335774 - RNA, 64 nt, hsa
gcaaaggcaucucaggaacaucaccuuagugaggaaacaaaauguucugcuagcuuguuuucuu

SEQ ID NO: 335775 - RNA, 64 nt, hsa
gugaugaauauuacuaauaguggucaugagaauaaaacaaaaggugauucuauucagaaugaga

SEQ ID NO: 335776 - RNA, 64 nt, hsa
ugaauaacccuuuuagcauugaaaaaaaaaacaaaaacaaaaaauggaaaaaaaaaaccuugua

SEQ ID NO: 335777 - RNA, 64 nt, hsa
aaauucugaauaacccuuuuagcauugaaaaaaaaaacaaaaacaaaaaauggaaaaaaaaaac

SEQ ID NO: 335778 - RNA, 64 nt, hsa
uagggaaguaaaaaaacaaaacaaaaaacaaaaaaaacaaaaaaaaaacccuauuuaaaugaaa

SEQ ID NO: 335779 - RNA, 64 nt, hsa
caaaucgaauagggaaguaaaaaaacaaaacaaaaaacaaaaaaaacaaaaaaaaaacccuauu

SEQ ID NO: 335780 - RNA, 64 nt, hsa
ggaaacucaaaucgaauagggaaguaaaaaaacaaaacaaaaaacaaaaaaaacaaaaaaaaaa

SEQ ID NO: 335781 - RNA, 64 nt, hsa
aaucaggaaacucaaaucgaauagggaaguaaaaaaacaaaacaaaaaacaaaaaaaacaaaaa

SEQ ID NO: 335782 - RNA, 64 nt, hsa
uuuucuaaaaaacaaacaaaaaaaaaaacacacaaaacaaaaacagaacaaaagaagagagaag

SEQ ID NO: 335783 - RNA, 64 nt, hsa
uauuucuucucccccaccccuuuuucuaaaaaacaaacaaaaaaaaaaacacacaaaacaaaaa

SEQ ID NO: 335784 - RNA, 64 nt, hsa; identical to SEQ ID NO: 335750

SEQ ID NO: 335785 - RNA, 64 nt, hsa
gagaacuuucaggcagaucccaccauuagccuguaaacaaaagguuuggcaccagccaccuggg

SEQ ID NO: 335786 - RNA, 64 nt, hsa
auuugguuuauuuagaaaaaggaagaaaaacaaaaaacaaaaaacuaaagggugagaauuugcu

SEQ ID NO: 335787 - RNA, 64 nt, hsa
accaagcauuugguuuauuuagaaaaaggaagaaaaacaaaaaacaaaaaacuaaagggugaga

SEQ ID NO: 335788 - RNA, 64 nt, hsa
uccuccuucaccccuccucucacugccugccagaaaacaaaaacaccaagaaaccaagucaacu

SEQ ID NO: 335789 - RNA, 64 nt, hsa
aguuguuuuuuuuuuaacaacugggaaaaaacaaaaacaaaaaacuauaguuagaaaaauggaa

SEQ ID NO: 335790 - RNA, 64 nt, hsa
acugugaguuguuuuuuuuuuaacaacugggaaaaaacaaaaacaaaaaacuauaguuagaaaa

SEQ ID NO: 335791 - RNA, 64 nt, hsa
gauaagcaauguucuuuauguagccaaugcuacgaaacaaaagaggugaaagagacccuuuuuu

SEQ ID NO: 335792 - RNA, 64 nt, hsa
uuaauaaauucauaaaaaagacucauaucuuugcaaacaaaagaagggcagauacugggcuucu

SEQ ID NO: 335793 - RNA, 64 nt, hsa
agagcaaaugcuagagcgauuucagcugauagaaaaacaaaaaugaaaaaaaaaacacaaaaaa

SEQ ID NO: 335794 - RNA, 64 nt, hsa
gauagaaaaacaaaaaugaaaaaaaaaacacaaaaaacaaaaaacauggcacguugcuaguuua

SEQ ID NO: 335795 - RNA, 64 nt, hsa
cuuucuuuuuccuuuuuuuuuaaaaaaacaaaacaaacaaaacaccuugaaucaaguuuguuug

SEQ ID NO: 335796 - RNA, 64 nt, hsa
uuccuuugucuuucuuuuuccuuuuuuuuuaaaaaaacaaaacaaacaaaacaccuugaaucaa

SEQ ID NO: 335797 - RNA, 64 nt, hsa
augcaaaaaggaaaacacacacaaccaauaacucaaacaaaaaagggacauuuaugugcaguug

SEQ ID NO: 335798 - RNA, 64 nt, hsa
acuuagacaaagaagugcaaaugucaauuucacuaaacaaaagcuauuagaaguaaagcagaaa

SEQ ID NO: 335799 - RNA, 64 nt, hsa
ggcagaggcaaaguuaucaucauacaaaaaucacaaacaaaaaggagaucuguauucggguauc

SEQ ID NO: 335800 - RNA, 64 nt, hsa
uugagaaaauggauagcuucuguguuaugauaccaaacaaaauauuuucauauuuauuucuuag

SEQ ID NO: 335801 - RNA, 64 nt, hsa
uuguuuaaaauaucuugauauuuucacaaauuuuaaacaaaaaauuaaauaucuauaaagugaa

SEQ ID NO: 335802 - RNA, 64 nt, hsa
auucuuugauuuauuuuauugcaucaaugaauuaaaacaaaaaucuugggggaagaaauuggca

SEQ ID NO: 335803 - RNA, 64 nt, hsa
aagauuaugaaaggaacaggcucuuuaaaaaagaaaacaaaaagccagaaucuuccuuuuuuug

SEQ ID NO: 335804 - RNA, 64 nt, hsa
acuucgagcuauuuagcuaaagcccaccaaaccaaaacaaaauacugauuuuuuuuuuuuuuuu

SEQ ID NO: 335805 - RNA, 64 nt, hsa
uaucugcuuaaagaccuugagaugagccaggaagaaacaaaagcaaggggcauuuccucuccaa

SEQ ID NO: 335806 - RNA, 64 nt, hsa
augcauauaaaagugauggaauuaaugugaaauaaaacaaaaauauaauggcuagaauacaaag

SEQ ID NO: 335807 - RNA, 64 nt, hsa
ugcuaaggcuuuuaauacauuuugaauggcaccaaaacaaaauaagucaaaauggacagucauu

SEQ ID NO: 335808 - RNA, 64 nt, hsa
uaccuguauguuuuguuuuagacgagaccaaacuaaacaaaaaguaucuguuuaucaaaguaaa

SEQ ID NO: 335809 - RNA, 64 nt, hsa
gagaaaauauagaauuccuggauaagaccaaacaaaacaaaacauuaaaauaccuguauguuuu

SEQ ID NO: 335810 - RNA, 64 nt, hsa
gaggagagaaaauauagaauuccuggauaagaccaaacaaaacaaaacauuaaaauaccuguau

SEQ ID NO: 335811 - RNA, 64 nt, hsa
auaucucuuucuuuuucuuccgacauuagaaacaaaacaaaaagaacuguccuuucugcgcuca

SEQ ID NO: 335812 - RNA, 64 nt, hsa
uuaauauaucucuuucuuuuucuuccgacauuagaaacaaaacaaaaagaacuguccuuucugc

SEQ ID NO: 335813 - RNA, 64 nt, hsa
ccaaaguuguuuucuagauuuguggcuuuaagaaaaacaaaacaaaacaaacacauuguuuuuc

SEQ ID NO: 335814 - RNA, 64 nt, hsa
guuguuuucuagauuuguggcuuuaagaaaaacaaaacaaaacaaacacauuguuuuucucaga

SEQ ID NO: 335815 - RNA, 64 nt, hsa
gggagggauggaggagauaauuugcuuauauuaaaaacaaaaaauggcugaggcaggaguuugg

SEQ ID NO: 335816 - RNA, 64 nt, hsa
ugcaugcaaaucaaguggacaagaaaaaauaacaaaacaaaaaacaagaaaaaaaaaacacaaa

SEQ ID NO: 335817 - RNA, 64 nt, hsa
ccucaggccgccagugucgcccugccccuuuuuaaaacaaaaugcccucguuuguaaacccuua

SEQ ID NO: 335818 - RNA, 64 nt, hsa
caaccccaagcuauauauuaccagaugaaaggauaaacaaaauaugguccauccauacaaugga

SEQ ID NO: 335819 - RNA, 64 nt, hsa
ugggggagggggacauagcgagacucggucucaaaaacaaaacaaaacaaaacaaaacaaaaca

SEQ ID NO: 335820 - RNA, 64 nt, hsa
gagggggacauagcgagacucggucucaaaaacaaaacaaaacaaaacaaaacaaaacaaaaac

SEQ ID NO: 335821 - RNA, 64 nt, hsa
ggacauagcgagacucggucucaaaaacaaaacaaaacaaaacaaaacaaaacaaaaacaaaac

SEQ ID NO: 335822 - RNA, 64 nt, hsa
uagcgagacucggucucaaaaacaaaacaaaacaaaacaaaacaaaacaaaaacaaaacaaaac

SEQ ID NO: 335823 - RNA, 64 nt, hsa
agacucggucucaaaaacaaaacaaaacaaaacaaaacaaaacaaaacaaaacaaaacaaaaca

SEQ ID NO: 335824 - RNA, 64 nt, hsa
cggucucaaaaacaaaacaaaacaaaacaaaacaaaacaaaacaaaacaaaacaaaacacugcc

SEQ ID NO: 335825 - RNA, 64 nt, hsa
ucaaaaacaaaacaaaacaaaacaaaacaaaacaaaacaaaacaaaacaaaacacugccaaacu

SEQ ID NO: 335826 - RNA, 64 nt, hsa
aacaaaacaaaacaaaacaaaacaaaacaaaacaaaacaaaacaaaacacugccaaacuguuuc

SEQ ID NO: 335827 - RNA, 64 nt, hsa
acaaaacaaaacaaaacaaaaacaaaacaaaacaaaacaaaacacugccaaacuguuuccaaag

SEQ ID NO: 335828 - RNA, 64 nt, hsa
gaccgagggaggcucugucucaaaagcaaagcaaaaacaaaaacaaaaacaccuaaaaaaccug

SEQ ID NO: 335829 - RNA, 64 nt, hsa
gggaggcucugucucaaaagcaaagcaaaaacaaaaacaaaaacaccuaaaaaaccugcaguuu

SEQ ID NO: 335830 - RNA, 64 nt, hsa
gauuccccaaaucugcauccuuuucaaaaccuaaaaacaaaaagaaaaacaaauaaaacaaaac

SEQ ID NO: 335831 - RNA, 64 nt, hsa
uuucaaaaccuaaaaacaaaaagaaaaacaaauaaaacaaaaccaacucagaccagaacuguuu

SEQ ID NO: 335832 - RNA, 64 nt, hsa
guuccaaaauuuaaucacuaauuaaaaaucuaucaaacaaaacucuggaccagacagauuuaua

SEQ ID NO: 335833 - RNA, 64 nt, hsa
caauaaaugugauuuaucacauacacagaacuaaaaacaaaaaccacaugaccaugaucaucuc

SEQ ID NO: 335834 - RNA, 64 nt, hsa
cuuaaugaugaacaccccaaagcaauugcaacaaaaacaaaaauugacaagugggaccuaauua

SEQ ID NO: 335835 - RNA, 64 nt, hsa
gcagaccucucaauucacaaugaguuaacugauaaaacaaaacagaagucagacaauguuuuaa

SEQ ID NO: 335836 - RNA, 64 nt, hsa
augacaugggaaaaugggagcuucuaaugaggacaaacaaaaaauagagaaaaauuaauaaagu

SEQ ID NO: 335837 - RNA, 64 nt, hsa
ccuaaacccaagcacccaaugaugcaaaaaacaaaaacaaaaaaaaaccaccaaauccccaaau

SEQ ID NO: 335838 - RNA, 64 nt, hsa
cccuucccuaaacccaagcacccaaugaugcaaaaaacaaaaacaaaaaaaaaccaccaaaucc

SEQ ID NO: 335839 - RNA, 64 nt, hsa
uagauagaugguguuugcauguaaauugcagagaaaacaaaaccaaagcugauuggaaacaauu

SEQ ID NO: 335840 - RNA, 64 nt, hsa
cuugcuuugauuuuuagugaagggaauguacguaaaacaaaauagggcuuggcuggucaaagga

SEQ ID NO: 335841 - RNA, 64 nt, hsa
aaaaacuguaaaaaaaaaaaaaaaaaaaaagacaaaacaaaagacaaaaaaaaaaaaaaaaccc

SEQ ID NO: 335842 - RNA, 64 nt, hsa
aaugcgggggagcaggcaguggggcuggaagcagaaacaaaaugaaaaaaaaagggggguggga

SEQ ID NO: 335843 - RNA, 64 nt, hsa
aaaaggcucauaacaacaagaacguuucagaaaaaaacaaaaaguuuuaaaaaaauuguugagu

SEQ ID NO: 335844 - RNA, 64 nt, hsa
accaauuuugggucgagugcauuuaacgagaacaaaacaaaaggcucauaacaacaagaacguu

SEQ ID NO: 335845 - RNA, 64 nt, hsa
ccgccagagcagcuuuuuacaauccagagacagaaaacaaaaucuagaugcaacagcgaaacaa

SEQ ID NO: 335846 - RNA, 64 nt, hsa
cccuggccaacauggugaaaccccaucucuacuaaaacaaaaauuagccaggcaugguggcacc

SEQ ID NO: 335847 - RNA, 64 nt, hsa
aacagagcgagacuccaucucaaaaaaaaaaacaaaacaaaaccaaguucccacuggugaugcc

SEQ ID NO: 335848 - RNA, 64 nt, hsa
uggguaacagagcgagacuccaucucaaaaaaaaaaacaaaacaaaaccaaguucccacuggug

SEQ ID NO: 335849 - RNA, 64 nt, hsa
gcccccuuuuucuuguuaaaaaacaaaaaacaaaaaacaaaaaaccacacacacauuuuguacg

SEQ ID NO: 335850 - RNA, 64 nt, hsa
ggcuuuugcccccuuuuucuuguuaaaaaacaaaaaacaaaaaacaaaaaaccacacacacauu

SEQ ID NO: 335851 - RNA, 64 nt, hsa
cauuccuggcuuuugcccccuuuuucuuguuaaaaaacaaaaaacaaaaaacaaaaaaccacac

SEQ ID NO: 335852 - RNA, 64 nt, hsa
cagcaaguucuuguuuccaaacaacaacaaaacaaaacaaaaaaaaaaccggauagaauaauga

SEQ ID NO: 335853 - RNA, 64 nt, hsa
cgacacagcaaguucuuguuuccaaacaacaacaaaacaaaacaaaaaaaaaaccggauagaau

SEQ ID NO: 335854 - RNA, 64 nt, hsa
caacauauagcaagacucugccucuauuauaaaaaaacaaaauaaaugaaaaggacuguaggag

SEQ ID NO: 335855 - RNA, 64 nt, hsa
aaaacuguucuugggacugucucaacugugcaaaaaacaaaagauggaguguuuacaaguagac

SEQ ID NO: 335856 - RNA, 64 nt, hsa
agugacugagauguaaaaauagauuuuagaauuaaaacaaaauccaaguccucacaccccuguc

SEQ ID NO: 335857 - RNA, 64 nt, hsa
uauuuaacagcuugaguauugcauuuccuuggccaaacaaaaauagcuacaaauccacaaaaau

SEQ ID NO: 335858 - RNA, 64 nt, hsa
gugaugccuuaggacauguuugaacugcagcaaaaaacaaaaacaaaaaacagugcauuagcaa

SEQ ID NO: 335859 - RNA, 64 nt, hsa
ccuuaggacauguuugaacugcagcaaaaaacaaaaacaaaaaacagugcauuagcaauuucau

SEQ ID NO: 335860 - RNA, 64 nt, hsa
gggcaacauagcgagaccucaucuccaaaaaagaaaacaaaaaacaaaaaaaggaaugauguuc

SEQ ID NO: 335861 - RNA, 64 nt, hsa
auagcgagaccucaucuccaaaaaagaaaacaaaaaacaaaaaaaggaaugauguucuguagag

SEQ ID NO: 335862 - RNA, 64 nt, hsa
gcacugauuuaaaacaaaccaaaaaaaaagaaaaaaacaaaaaaaaaaaucccuccuuucuagc

SEQ ID NO: 335863 - RNA, 64 nt, hsa
augauuuaaauuuauaauuaaguaaauuacauuaaaacaaaaaaauuauacucaaaauucauua

SEQ ID NO: 335864 - RNA, 64 nt, hsa
uucauuguuuuacuuuugucuuccucacuaguguaaacaaaaauuucaaccagcauucaugccg

SEQ ID NO: 335865 - RNA, 64 nt, hsa
gcuggucugucuuuucuccauuuguuuaaaaaaaaaacaaaaacaaaaaacaacacuuuggugu

SEQ ID NO: 335866 - RNA, 64 nt, hsa
cugucuuuucuccauuuguuuaaaaaaaaaacaaaaacaaaaaacaacacuuuggugugguggu

SEQ ID NO: 335867 - RNA, 64 nt, hsa
cauaaauucauguaaagccauuuucucuuaaacaaaacaaaacuuucuaaguacagucauucuc

SEQ ID NO: 335868 - RNA, 64 nt, hsa
aggaacauaaauucauguaaagccauuuucucuuaaacaaaacaaaacuuucuaaguacaguca

SEQ ID NO: 335869 - RNA, 64 nt, hsa
uuaauuacuggacucucuuagcacaggaagguggaaacaaaaugccaggccucugcucugaaga

SEQ ID NO: 335870 - RNA, 64 nt, hsa
uuuuagacacgcuuucuuguagugcuucugcaaaaaacaaaaaagggacuuauuuugcauucuc

SEQ ID NO: 335871 - RNA, 64 nt, hsa
ucuaauuuuuuuuccuguugaauggguaaaaacaaaacaaaacuuuuuuuagaagaugaauuug

SEQ ID NO: 335872 - RNA, 64 nt, hsa
gugugucuaauuuuuuuuccuguugaauggguaaaaacaaaacaaaacuuuuuuuagaagauga

SEQ ID NO: 335873 - RNA, 64 nt, hsa
gacagagcgagacccugucuuaaaaaaaaaaacaaaacaaaaccagcaucuguuacuggaacag

SEQ ID NO: 335874 - RNA, 64 nt, hsa
ugggugacagagcgagacccugucuuaaaaaaaaaaacaaaacaaaaccagcaucuguuacugg

SEQ ID NO: 335875 - RNA, 64 nt, hsa
cagucuggucggcaagagugagacuccgucucaaaaacaaaacaaaacaaaaaaaccacauaac

SEQ ID NO: 335876 - RNA, 64 nt, hsa
uggucggcaagagugagacuccgucucaaaaacaaaacaaaacaaaaaaaccacauaacauaaa

SEQ ID NO: 335877 - RNA, 64 nt, hsa
ggcaagagugagacuccgucucaaaaacaaaacaaaacaaaaaaaccacauaacauaaauuuau

SEQ ID NO: 335878 - RNA, 64 nt, hsa
augacuuuccucagaacaugagacuguaaaacaaaaacaaaaaacuaugugaugccucuauuuu

SEQ ID NO: 335879 - RNA, 64 nt, hsa
ugacuuaugacuuuccucagaacaugagacuguaaaacaaaaacaaaaaacuaugugaugccuc

SEQ ID NO: 335880 - RNA, 64 nt, hsa
ggcagagcgagacccugucucaaaaaauaaacaaaaacaaaaugcuucugucaguuaacaaucu

SEQ ID NO: 335881 - RNA, 64 nt, hsa
cuggguggcagagcgagacccugucucaaaaaauaaacaaaaacaaaaugcuucugucaguuaa

SEQ ID NO: 335882 - RNA, 64 nt, hsa
uaguuggagccacaaggcccuugucuuuuuaaaaaaacaaaauauuuugaagauggugaaagug

SEQ ID NO: 335883 - RNA, 64 nt, hsa
guagaagggaaauuuuaaacauaacacucaacccaaacaaaacuacuucgugaggcuuucagca

SEQ ID NO: 335884 - RNA, 64 nt, hsa
ucuucgugauaauauaaucucuauuuuuuuaggaaaacaaaaaugaaaaacuacuccauuugag

SEQ ID NO: 335885 - RNA, 64 nt, hsa
agacaaacauuauaaaaaucugauggcaaaagcaaaacaaaauggaaaguaggggagguggaug

SEQ ID NO: 335886 - RNA, 64 nt, hsa
aguguucugcauuccacauguaagugaauugcaaaaacaaaacaaaacucacucucuuguaggu

SEQ ID NO: 335887 - RNA, 64 nt, hsa
ucugcauuccacauguaagugaauugcaaaaacaaaacaaaacucacucucuuguagguuuauu

SEQ ID NO: 335888 - RNA, 64 nt, hsa
ccuuaaaggaaauguuaaaaaaaaaaaaacaaaaaaacaaaaaaacaacuguucuuugccuaau

SEQ ID NO: 335889 - RNA, 64 nt, hsa
gccaccuuccuuaaaggaaauguuaaaaaaaaaaaaacaaaaaaacaaaaaaacaacuguucuu

SEQ ID NO: 335890 - RNA, 64 nt, hsa
caaaaacaaaaaacaaaaaaaacaaaaaaacaaaaaacaaaaaaacacacacacacaaaaaaag

SEQ ID NO: 335891 - RNA, 64 nt, hsa
ccaaaagcaaaaacaaaaaacaaaaaaaacaaaaaaacaaaaaacaaaaaaacacacacacaca

SEQ ID NO: 335892 - RNA, 64 nt, hsa
gagaccuuccaaaagcaaaaacaaaaaacaaaaaaaacaaaaaaacaaaaaacaaaaaaacaca

SEQ ID NO: 335893 - RNA, 64 nt, hsa
cuccgcugggagaccuuccaaaagcaaaaacaaaaaacaaaaaaaacaaaaaaacaaaaaacaa

SEQ ID NO: 335894 - RNA, 64 nt, hsa
ccagacccuccgcugggagaccuuccaaaagcaaaaacaaaaaacaaaaaaaacaaaaaaacaa

SEQ ID NO: 335895 - RNA, 64 nt, hsa
cauugguguguuuagagauuuuaguuuaaaaacaaaacaaaaagauugaucaaaucuguacagu

SEQ ID NO: 335896 - RNA, 64 nt, hsa
ugggacauugguguguuuagagauuuuaguuuaaaaacaaaacaaaaagauugaucaaaucugu

SEQ ID NO: 335897 - RNA, 64 nt, hsa
cuguuucacaaacaguuuuauuuaaaaaaacaaaaaacaaaaaaaaucaaaaaaucaaaaaaau

SEQ ID NO: 335898 - RNA, 64 nt, hsa
aaaauagcuguuucacaaacaguuuuauuuaaaaaaacaaaaaacaaaaaaaaucaaaaaauca

SEQ ID NO: 335899 - RNA, 64 nt, hsa
uuucaaucuguccaucuaccaggccucgcgauaaaaacaaaacaaaaaaacgcugccagguuuu

SEQ ID NO: 335900 - RNA, 64 nt, hsa
aucuguccaucuaccaggccucgcgauaaaaacaaaacaaaaaaacgcugccagguuuuagaag

SEQ ID NO: 335901 - RNA, 64 nt, hsa
aucccaaugaaagaucaugcauuggggacagcagaaacaaaagcuuuuuuggaaaggcggggaa

SEQ ID NO: 335902 - RNA, 64 nt, hsa
uuggaaaggcggggaagaaggaugaaaccuuuaaaaacaaaaacaaaaacaucaaugaguaggc

SEQ ID NO: 335903 - RNA, 64 nt, hsa
aggcggggaagaaggaugaaaccuuuaaaaacaaaaacaaaaacaucaaugaguaggcauuuua

SEQ ID NO: 335904 - RNA, 64 nt, hsa
auauauauaaauauaaauauauauaaaaacaacaaaacaaaacaaaaaaagaaaaaaaaacaaa

SEQ ID NO: 335905 - RNA, 64 nt, hsa
uauaaauauaaauauauauaaaaacaacaaaacaaaacaaaaaaagaaaaaaaaacaaaaaaca

SEQ ID NO: 335906 - RNA, 64 nt, hsa
acacaaugccaagauagaauuaauuuaaagccuuaaacaaaauuuaucuaaagaaauaacuucu

SEQ ID NO: 335907 - RNA, 64 nt, hsa
uaucaucaucaucauccuaaaauuaacaacccagaaacaaaaaucucuauacagagaucaaauu

SEQ ID NO: 335908 - RNA, 64 nt, hsa
ccugaugccaaagaauaugaaaauauuuaaguaaaaacaaaaugaugcauuuugagaagaacaa

SEQ ID NO: 335909 - RNA, 64 nt, hsa
uuaaaaucuuaaauguguaagucacccccaccaaaaacaaaagagaagaaaaagaauagaaaga

SEQ ID NO: 335910 - RNA, 64 nt, hsa
caaagcuauauaaagaaccaaagguuuagucaagaaacaaaaaucuuaaagauuauuauaaccc

SEQ ID NO: 335911 - RNA, 64 nt, hsa
agauuagacuacacaaaagcuuccuuccaguauuaaacaaaaagaauuaaacauaacuaugaaa

SEQ ID NO: 335912 - RNA, 64 nt, hsa
ugggcuuuguuagcacuuuuuaaaacaaacaaacaaacaaaacaaaaaagcaaaccacauuugu

SEQ ID NO: 335913 - RNA, 64 nt, hsa
uuuguuagcacuuuuuaaaacaaacaaacaaacaaaacaaaaaagcaaaccacauuuguuaucu

SEQ ID NO: 335914 - RNA, 64 nt, hsa
ccaaccugggugacagagugagauuccaucugaaaaacaaaaacaaaaacagaaaacaaacaaa

SEQ ID NO: 335915 - RNA, 64 nt, hsa
ugggugacagagugagauuccaucugaaaaacaaaaacaaaaacagaaaacaaacaaacaaaaa

SEQ ID NO: 335916 - RNA, 64 nt, hsa
aucugaaaaacaaaaacaaaaacagaaaacaaacaaacaaaaaacaaaaaauccccacaacuuu

SEQ ID NO: 335917 - RNA, 64 nt, hsa
aaacaaaaacaaaaacagaaaacaaacaaacaaaaaacaaaaaauccccacaacuuugucaaau

SEQ ID NO: 335918 - RNA, 64 nt, hsa
caaucaugacugagccaaucacuguuucucagaaaaacaaaacaaaacaaaacaaaugacagua

SEQ ID NO: 335919 - RNA, 64 nt, hsa
augacugagccaaucacuguuucucagaaaaacaaaacaaaacaaaacaaaugacaguaacccu

SEQ ID NO: 335920 - RNA, 64 nt, hsa
ugagccaaucacuguuucucagaaaaacaaaacaaaacaaaacaaaugacaguaacccuucccc

SEQ ID NO: 335921 - RNA, 64 nt, hsa
gauuacagaaacacggaguuuccauuuggauuuuaaacaaaauuuaugucauuuucagauccuu

SEQ ID NO: 335922 - RNA, 64 nt, hsa
aucagggcaagcucauagcacauguuuuacaaagaaacaaaauauaaaucacagauuuccaaaa

SEQ ID NO: 335923 - RNA, 64 nt, hsa
uaaugucaaacuugagucacaaagaacauguagaaaacaaaauggauaaaaucugauauguauu

SEQ ID NO: 335924 - RNA, 64 nt, hsa
cuagccugggugacagagcaagacucugucuaaaaaacaaaacaaaacaaaacaaaacaaaaaa

SEQ ID NO: 335925 - RNA, 64 nt, hsa
cugggugacagagcaagacucugucuaaaaaacaaaacaaaacaaaacaaaacaaaaaaaccuc

SEQ ID NO: 335926 - RNA, 64 nt, hsa
ugacagagcaagacucugucuaaaaaacaaaacaaaacaaaacaaaacaaaaaaaccucuuaau

SEQ ID NO: 335927 - RNA, 64 nt, hsa
gagcaagacucugucuaaaaaacaaaacaaaacaaaacaaaacaaaaaaaccucuuaauauucu

SEQ ID NO: 335928 - RNA, 64 nt, hsa
agacucugucuaaaaaacaaaacaaaacaaaacaaaacaaaaaaaccucuuaauauucuggagu

SEQ ID NO: 335929 - RNA, 64 nt, hsa
cgauuauuucaugcuuuuuuuuaaaaaaaaaaaaaaacaaaauaacaaucugaagaggcauuug

SEQ ID NO: 335930 - RNA, 64 nt, hsa
gaagcuuauuguaguauguuugcagaaaaauucuaaacaaaaauuauacagcuuauuagagugu

SEQ ID NO: 335931 - RNA, 64 nt, hsa
auuuugcgaggcuuaggcagcuagacaucguuuaaaacaaaauauuaacuuauauuacaugugu

SEQ ID NO: 335932 - RNA, 64 nt, hsa
accuguuccaccaaaaccuauggaaauuuaaaaaaaacaaaaauaaaaagcaaaacaaaaaucc

SEQ ID NO: 335933 - RNA, 64 nt, hsa
uauggaaauuuaaaaaaaacaaaaauaaaaagcaaaacaaaaaucccaaaaugaauuccauuca

SEQ ID NO: 335934 - RNA, 64 nt, hsa
auuuuuuaaauccccucuguuuaaaagguuuguaaaacaaaaacaaaaaacuaagucugcucag

SEQ ID NO: 335935 - RNA, 64 nt, hsa
uaaauccccucuguuuaaaagguuuguaaaacaaaaacaaaaaacuaagucugcucagugaaau

SEQ ID NO: 335936 - RNA, 64 nt, hsa
uagagacaugcacacacaaagaaucaguagggagaaacaaaaauacaagucccguucuguagcu

SEQ ID NO: 335937 - RNA, 64 nt, hsa
uguaaaaaagaaaaauguauauagcugugaguuuaaacaaaaaccacaaacagacaaacaagaa

SEQ ID NO: 335938 - RNA, 64 nt, hsa
ugguggauuagacagguuaaauauauaaacaaacaaacaaaaauugcucaaaaaagaggagaaa

SEQ ID NO: 335939 - RNA, 64 nt, hsa
uuuauaaaaaaaaguuguuuauaaaaaccccuaaaaacaaaacaaacacacacacacacacaua

SEQ ID NO: 335940 - RNA, 64 nt, hsa
ggaagcaauauuuaauaaaacuaggucaaaaacaaaacaaaacagugacacucacuugugugua

SEQ ID NO: 335941 - RNA, 64 nt, hsa
cccaaggaagcaauauuuaauaaaacuaggucaaaaacaaaacaaaacagugacacucacuugu

SEQ ID NO: 335942 - RNA, 64 nt, hsa
gguaaaacuccgacucuauuuaaaaaaaaaacaaaaacaaaaaaaccuuaaaugucaaaaaaaa

SEQ ID NO: 335943 - RNA, 64 nt, hsa
aaaugugguaaaacuccgacucuauuuaaaaaaaaaacaaaaacaaaaaaaccuuaaaugucaa

SEQ ID NO: 335944 - RNA, 64 nt, hsa
caucucaaaacaaaacaaaacaaaacaaacaaacaaacaaaacuugcaucuaaccaaaaagucu

SEQ ID NO: 335945 - RNA, 64 nt, hsa
cgacaaaaacgaaacuccaucucaaaacaaaacaaaacaaaacaaacaaacaaacaaaacuugc

SEQ ID NO: 335946 - RNA, 64 nt, hsa
cugggcgacaaaaacgaaacuccaucucaaaacaaaacaaaacaaaacaaacaaacaaacaaaa

SEQ ID NO: 335947 - RNA, 64 nt, hsa
ccagccugggcgacaaaaacgaaacuccaucucaaaacaaaacaaaacaaaacaaacaaacaaa

SEQ ID NO: 335948 - RNA, 64 nt, hsa
cuuuagaaugggugguaugggggauuucaaacuuaaacaaaaaacuaucaacuacaaauuaguu

SEQ ID NO: 335949 - RNA, 64 nt, hsa
aaacaaaacuuuggaccaaaaucccaguucaaagaaacaaaaaguggaaacuauucuaucauaa

SEQ ID NO: 335950 - RNA, 54 nt, hsa; identical to SEQ ID NO: 335091

SEQ ID NO: 335951 - RNA, 64 nt, hsa
aacaaaauuaacugcuuaaauguuuugucggggcaaacaaaauuaugugaauuguguuguuuuc

SEQ ID NO: 335952 - RNA, 64 nt, hsa
acaauuguucuucaaaaacaaacaaaacaaaacaaaacaaaauuaacugcuuaaauguuuuguc

SEQ ID NO: 335953 - RNA, 64 nt, hsa
agaccacaauuguucuucaaaaacaaacaaaacaaaacaaaacaaaauuaacugcuuaaauguu

SEQ ID NO: 335954 - RNA, 64 nt, hsa
guaaaagaccacaauuguucuucaaaaacaaacaaaacaaaacaaaacaaaauuaacugcuuaa

SEQ ID NO: 335955 - RNA, 64 nt, hsa
aaaauguaaaagaccacaauuguucuucaaaaacaaacaaaacaaaacaaaacaaaauuaacug

SEQ ID NO: 335956 - RNA, 64 nt, hsa
gucgacuggauucugucaguucaaaaaaggaaagaaacaaaacuucccuacaauuuucuucacu

SEQ ID NO: 335957 - RNA, 64 nt, hsa
uaauuaaauugccaccuucgugguuguaaaagacaaacaaaacauggcaaauuucauuaacaca

SEQ ID NO: 335958 - RNA, 64 nt, hsa
uguaaaaaauaaaaauguauauagcugugagcucaaacaaaaacugcagacaaacaaaaaagag

SEQ ID NO: 335959 - RNA, 64 nt, hsa
uauauagcugugagcucaaacaaaaacugcagacaaacaaaaaagagaaaagcuuuuauuugug

SEQ ID NO: 335960 - RNA, 64 nt, hsa
acacacacagacacacacaaagaaucagcagagaaaacaaaauacaaguccuguucuguaguuc

SEQ ID NO: 335961 - RNA, 64 nt, hsa
ccuggaggccagagugagacuccgucucaaaacaaaacaaaaguggguggcucacggguccgga

SEQ ID NO: 335962 - RNA, 64 nt, hsa
uccagccuggaggccagagugagacuccgucucaaaacaaaacaaaaguggguggcucacgggu

SEQ ID NO: 335963 - RNA, 64 nt, hsa
augcgacucucaaacuuuaaaggaguugcuccuuuguuccaaaauuaaauguguuagauaaauu

SEQ ID NO: 335964 - RNA, 64 nt, hsa
uugaaugugagcagguugaccucaggucacacuuuguuccaaaaacuuuuggaauuauuccagg

SEQ ID NO: 335965 - RNA, 64 nt, hsa
aacaaccuaacaccagauucaagucacauaaaaguguuccaauaaaauggauggaugucuuuuu

SEQ ID NO: 335966 - RNA, 64 nt, hsa
ccuaccaucuaccuauauaccuuauuguaaugaauguuccaaaaugguagagugguagaaaacg

SEQ ID NO: 335967 - RNA, 64 nt, hsa
ggcaugcuaaaccucuagggucugaugcuguuuuuguuccaaauauaaacgaaaggcacuaguc

SEQ ID NO: 335968 - RNA, 64 nt, hsa
cauugcuucagacagaaaaugaauuccgucgguauguuccaaucgugaugaauuugagaaacau

SEQ ID NO: 335969 - RNA, 64 nt, hsa
cagaaaccgcaccccgagagaaaaucccauccucuguuccaaggccccugucugcucuaugcuc

SEQ ID NO: 335970 - RNA, 64 nt, hsa
cugggaaugauuugagggcucuugaaagcccauguguuccaaagcgucuuuaacucugggauag

SEQ ID NO: 335971 - RNA, 64 nt, hsa
uuuuccuugagcauuuauaaaccagggcgaggguuguuccaaaaugaguaauugaaugagauga

SEQ ID NO: 335972 - RNA, 64 nt, hsa
accacuugacuuugcuaauggcuauucuccaauuuguuccaauaagcuaagggcuuuucauaca

SEQ ID NO: 335973 - RNA, 64 nt, hsa
gaggggggaaauacaguucugcucugguuguuucuguuccaaaugauuccauccaccuuuccca

SEQ ID NO: 335974 - RNA, 64 nt, hsa
uuuacuuuuguuuauuuuuaugguaacugcuuucuguuccaaauucaguuucauaaaaggagaa

SEQ ID NO: 335975 - RNA, 64 nt, hsa
ccagacccugguugaauuguuucucucuccugcuuguuccaacccuuuucacucugggcuucuc

SEQ ID NO: 335976 - RNA, 64 nt, hsa
uccuggcaugaccugcaacuccaggugguggauuuguuccaaagccucaaucccuacccccucc

SEQ ID NO: 335977 - RNA, 64 nt, hsa
aaguggugucugccuucaaggguuaaucccucuuuguuccaagcagaagcauucuggcauccca

SEQ ID NO: 335978 - RNA, 64 nt, hsa
ccuugucuuuaaagaucacuuuccugggcugcaauguuccaacccaguuguuccagcuguucac

SEQ ID NO: 335979 - RNA, 64 nt, hsa; identical to SEQ ID NO: 105042

SEQ ID NO: 335980 - RNA, 64 nt, hsa; identical to SEQ ID NO: 105043

SEQ ID NO: 335981 - RNA, 64 nt, hsa; identical to SEQ ID NO: 105044

SEQ ID NO: 335982 - RNA, 64 nt, hsa; identical to SEQ ID NO: 105045

SEQ ID NO: 335983 - RNA, 64 nt, hsa; identical to SEQ ID NO: 105046

SEQ ID NO: 335984 - RNA, 64 nt, hsa; identical to SEQ ID NO: 105047

SEQ ID NO: 335985 - RNA, 64 nt, hsa; identical to SEQ ID NO: 105048

SEQ ID NO: 335986 - RNA, 64 nt, hsa; identical to SEQ ID NO: 105049

SEQ ID NO: 335987 - RNA, 64 nt, hsa; identical to SEQ ID NO: 105050

SEQ ID NO: 335988 - RNA, 64 nt, hsa; identical to SEQ ID NO: 105051

SEQ ID NO: 335989 - RNA, 64 nt, hsa
uagucaauacuacuuuauguaaacagcaguguaaaauccaaaaacuuccaguccuggaggcagg

SEQ ID NO: 335990 - RNA, 64 nt, hsa
cucacauuacagcugaugugaaagagauucuggaaauccaaauguuccccagaaauucugauau

SEQ ID NO: 335991 - RNA, 64 nt, hsa
cauuauauuuagcgguugaguauccaaauccaaaaauccaaaauucaaaaugcuccaauaagca

SEQ ID NO: 335992 - RNA, 64 nt, hsa
aauauuugcauuauauuuagcgguugaguauccaaauccaaaaauccaaaauucaaaaugcucc

SEQ ID NO: 335993 - RNA, 64 nt, hsa
uaauaaguauacucuguuauagucaacaaaguuaaauccaaauucaaaauuauccauuaaaguu

SEQ ID NO: 335994 - RNA, 64 nt, hsa
uuuuucagguuagugauuuuuuuguauacaauuuaauccaaauguuaugacauucagaaaucau

SEQ ID NO: 335995 - RNA, 64 nt, hsa
aaaacaaauccugcauuuagauacaccucaacuaaauccaaaguccccauucaguauauuccau

SEQ ID NO: 335996 - RNA, 64 nt, hsa
augaguuccuagagaacuguccaaggguugggaaaauccaaauucucuuccugguuccagcacu

SEQ ID NO: 335997 - RNA, 62 nt, hsa
auucaacuuuccaaauaaaaguucuacuucauguaauccaaaaauguuuguauucuguucua

SEQ ID NO: 335998 - RNA, 64 nt, hsa
uaaacuacuggucuguuugacagacuuugguaacaauccaaagacccugagggucugagcagcu

SEQ ID NO: 335999 - RNA, 64 nt, hsa
ucucuccucuagguaucguauuuuguugcucaagaauccaaaaugggucuguggacauagggca

SEQ ID NO: 336000 - RNA, 64 nt, hsa
acaagucuuuaauuuaauuuuuguuuuuugccuaaauccaaagaaaaagggcugccgggccagg

SEQ ID NO: 336001 - RNA, 64 nt, hsa
ccuuuaguuccuacuuuagccacugguuucucagaauccaaagaucacauauucuaguguaaca

SEQ ID NO: 336002 - RNA, 64 nt, hsa
cuguguuugacaugagauaguuuaaguuccacaaaauccaaauuuaccauauuauuguuuuuaa

SEQ ID NO: 336003 - RNA, 64 nt, hsa
uagccuguuucuaacacaacugucauaauccugaaauccaaaauugcacuguguuugacaugag

SEQ ID NO: 336004 - RNA, 64 nt, hsa
ccgagcugcuagcugacaaauacaauucugaaggaauccaaaugugacuuugaaaauuguuaga

SEQ ID NO: 336005 - RNA, 64 nt, hsa
agcacgaauagauauugauguuauggagugcuguaauccaaaguuuuuaauugugaggcauguu

SEQ ID NO: 336006 - RNA, 64 nt, hsa
cgguaucagugcaucuacagaaguguuauuugguaauccaaauauuagaguuuucccaaaucca

SEQ ID NO: 336007 - RNA, 64 nt, hsa
guuauuugguaauccaaauauuagaguuuucccaaauccaaaaacggucagaaauaaguccauu

SEQ ID NO: 336008 - RNA, 64 nt, hsa
uauaugacuugagucugcuguaauuggcagcagaaauccaaauuuguaugguagaccaaaaaga

SEQ ID NO: 336009 - RNA, 64 nt, hsa
gugugucugugguuuccaaggccccccuauggagaauccaaaaguauuuuccauugccgugcuc

SEQ ID NO: 336010 - RNA, 64 nt, hsa
aaaaaaauuguacaguguauauuccuuuguuuugaauccaaaucuuuuucauagguaaugacag

SEQ ID NO: 336011 - RNA, 64 nt, hsa
auccuuuaaaggacuggggguuugcucaaaaggaaauccaaaaccuauucuaaacaauuugcau

SEQ ID NO: 336012 - RNA, 64 nt, hsa
auauacaauuucuugaacucaggacuagccugaaaauccaaaaugcauguagaguugacauguu

SEQ ID NO: 336013 - RNA, 64 nt, hsa
agcggagggaugcugagacagucaugguuuauagaauccaaauucucugagaugagggugcuua

SEQ ID NO: 336014 - RNA, 64 nt, hsa
agggaauaucggauucaugcaucaguuuauggugaauccaaaucaaugucuugaauccuuugaa

SEQ ID NO: 336015 - RNA, 64 nt, hsa
cucuaaguaaaggaaaaaacaaaauaaggacuucaauccaaaguuuggacaguagauggacuuc

SEQ ID NO: 336016 - RNA, 64 nt, hsa
ugagaacuuuauuuuggaaaauuuauaagaaaguaauccaaauaagaaacacgauaguugaaaa

SEQ ID NO: 336017 - RNA, 64 nt, hsa
uaguaaauaauuguuuugggcugauuuuucaguaaauccaaagugacuuagguuagaaguuaca

SEQ ID NO: 336018 - RNA, 64 nt, hsa
caacaagacacaagcaaaaauccagcaaugcucaaauccaaaagcacucggcaggacauuucuu

SEQ ID NO: 336019 - RNA, 64 nt, hsa
aaaaaaaaaaaaaaaaaagaaaaaagaaaaaaaaaauccaaaagagagaagaguuuuugcauuc

SEQ ID NO: 336020 - RNA, 64 nt, hsa
aaggaaauccaaaaaagcaaacacaagaaaucaaaauccaaaauuuguuugucacugccaaagu

SEQ ID NO: 336021 - RNA, 64 nt, hsa
ccaaggauaccggacacaccucugcuccaaaggaaauccaaaaaagcaaacacaagaaaucaaa

SEQ ID NO: 336022 - RNA, 64 nt, hsa
uccuguaauguuaaacucuuuggcuuuaaguaaaaauccaaaaaguuuuuuuaaaaaagcaaag

SEQ ID NO: 336023 - RNA, 64 nt, hsa
aagcuggcaggggucaaacaagaagugauaaaggaauccaaaguugaagagcccaggaaacggg

SEQ ID NO: 336024 - RNA, 64 nt, hsa
ggagaagagguucagcucuauuucaucauucccaaauccaaagagagucauuuugucuucagca

SEQ ID NO: 336025 - RNA, 64 nt, hsa
agcaugaaguuggggcacugguggugagaggcggaauccaaaaaaauucagaaaugacuuggcc

SEQ ID NO: 336026 - RNA, 64 nt, hsa
aaaauugauaaauaucugucaccaaaccacaagaaauccaaaaucauuuuagguuuaccaaaca

SEQ ID NO: 336027 - RNA, 64 nt, hsa
aauucaaugguucuauugacuuuuugcgucacuuaauccaaaucaaccaaauucaggguugaau

SEQ ID NO: 336028 - RNA, 64 nt, hsa
uuucucaugaucucaccuauacuuuggggaugauaauccaaaaguauuucacagcacuaaugcu

SEQ ID NO: 336029 - RNA, 64 nt, hsa
ccagagagcaagccaagauuaggugaggguugucuaauccuauggcacaggacgugcuuuacau

SEQ ID NO: 336030 - RNA, 64 nt, hsa
uuuggauggaucaaaccuccuuaauuuuaauuucuaauccuaaaguaaagagaugcaauugggg

SEQ ID NO: 336031 - RNA, 64 nt, hsa
augugcguguguguauacacaugcauauauuuacuaauccuaucugccaaaauggcuuagacac

SEQ ID NO: 336032 - RNA, 64 nt, hsa
acucacaucccacucaagacacaaaacauuuucuuaauccuaguacauuuuuuucugucccuuc

SEQ ID NO: 336033 - RNA, 64 nt, hsa
guugacaguugcuggguguaguggcucaugccuguaauccuagcaacucggggcugagguggga

SEQ ID NO: 336034 - RNA, 64 nt, hsa
aaaaaugcaggcugggcgcgguggcucacgccuguaauccuagcacuuugggaggccgaggcag

SEQ ID NO: 336035 - RNA, 64 nt, hsa
ccaaaaguuaaccgggcgugguggugggugccuguaauccuagcuacuugggaggcugaggcag

SEQ ID NO: 336036 - RNA, 64 nt, hsa
aaacggugcggcugggagcgguggcucacgccuguaauccuagcaccuugggaggccgaggcgg

SEQ ID NO: 336037 - RNA, 64 nt, hsa
cagauaagaaggcacugggccaggcucacaccuguaauccuaaguaacacuuugggaggcuggg

SEQ ID NO: 336038 - RNA, 64 nt, hsa
aagacagugaagcugguuguagggcucacuuuuauaauccuaggauuuggggaagcugaagcag

SEQ ID NO: 336039 - RNA, 62 nt, hsa
augccauuaauaaaacccaagaucuuuuaaaucaaaaccauucagcaaaugcuguaagaccu

SEQ ID NO: 336040 - RNA, 62 nt, hsa
auguaaaucuucauagugucagacauacugaccaaaaccacaaucuagacuacaaaguauau

SEQ ID NO: 336041 - RNA, 62 nt, hsa
ugggaaacagaagccuaaguuauuuaccuuaucaaaaccacguuccuuggaaccacauuauu

SEQ ID NO: 336042 - RNA, 62 nt, hsa
auauuuugugacuuuaauugguaaauauguuacaaaaccaaguacuuaaucuuuuacaucau

SEQ ID NO: 336043 - RNA, 62 nt, hsa
uuuuuucaagaacccuuggauuuaugugaggucaaaaccaaacucuuauucucaguggaaaa

SEQ ID NO: 336044 - RNA, 62 nt, hsa
agguguuuugccagagagauaaaauuuuugcucaaaaccagaaaaagaauuguaauggcuac

SEQ ID NO: 336045 - RNA, 62 nt, hsa
guuacaguacacuuguagccaaaacuggaagacaaaaccaauauauaauuuggcugcugauu

SEQ ID NO: 336046 - RNA, 62 nt, hsa
ugcgcuaccuaacaguaccaucuuggauccuucaaaaccaaagacuugccccagcacugcug

SEQ ID NO: 336047 - RNA, 62 nt, hsa
aguaaggcccagugaucccauuaucccaggggcaaaaccaccuguccccuuuugagcugcca

SEQ ID NO: 336048 - RNA, 62 nt, hsa
uugaaaacaaacaaaaagaagaaaacacucaacaaaaccaaucuacauguuuuggacuaaaa

SEQ ID NO: 336049 - RNA, 62 nt, hsa
gacauccagacuuguauauuucaguggaaauacaaaaccacuucagagaccaggguaucucc

SEQ ID NO: 336050 - RNA, 62 nt, hsa
aagcaaccuggagaacagcuaucaaucauauucaaaaccaguacaagaacugcugccuggua

SEQ ID NO: 336051 - RNA, 62 nt, hsa
cugaccucaggugauccaccgccuaggccucccaaaaccauuagggcucagaggaagguauc

SEQ ID NO: 336052 - RNA, 61 nt, hsa
gauagucuagcagguaauuaaacuuauauguccaaaaccauauucuucccugucucuucaa

SEQ ID NO: 336053 - RNA, 62 nt, hsa
cguucugggcggugguucucgagccugccauucaaaaccaaagcaaauuggagcauuucuca

SEQ ID NO: 336054 - RNA, 62 nt, hsa
auguuuaacauagaaaaugaaugcguuuaaaacaaaaccacuuucugcauuuaaccaguccu

SEQ ID NO: 336055 - RNA, 62 nt, hsa
uguuucagugaaaacuuuggagacaguuuuaacaaaaccaauaaaccaacaacaaaaaaagu

SEQ ID NO: 336056 - RNA, 62 nt, hsa
aaaaaagaaaacagaaaaaaauucagacccugcaaaaccacauuccccauuuuaacgggcgu

SEQ ID NO: 336057 - RNA, 62 nt, hsa
uggcuauaguuacugauuuuuuauuauguaagcaaaaccaauaaaaauuuaaguuuuuuuaa

SEQ ID NO: 336058 - RNA, 62 nt, hsa
aguaagaaacaauuauaauuucuuuacauacucaaaaccaagauagaaaaaggugcuaucgu

SEQ ID NO: 336059 - RNA, 62 nt, hsa
gggauacaaccguuuugcuccauacuaaaugacaaaaccauaaaaaccuuccaaugugggga

SEQ ID NO: 336060 - RNA, 62 nt, hsa
ugccaauccgcuguaacaacucugcuuuaaaacaaaaccaaacaaaacuuuaaaaaaaaaug

SEQ ID NO: 336061 - RNA, 62 nt, hsa
cuccugcagugccauucugccuucucaaugagcaaaaccauuuucuaaguaugaggauauua

SEQ ID NO: 336062 - RNA, 62 nt, hsa
ucauguaauucaaucauguuuaauaugucagucaaaaccaaauucagaauuguuuuguguac

SEQ ID NO: 336063 - RNA, 62 nt, hsa
acugaggaaggaaauguucauuuucauuuguccaaaaccaccuuaaguuuuaaguauauuaa

SEQ ID NO: 336064 - RNA, 62 nt, hsa
ugaaaauaaucuauuuguagcuucucuucuaucaaaaccaacacauccucuucuuucugcca

SEQ ID NO: 336065 - RNA, 62 nt, hsa
uuuuaaaaagaaaaacagaaaaagguuaaucacaaaaccaacccucacuucacagggucugu

SEQ ID NO: 336066 - RNA, 62 nt, hsa
cucucucugacgggguggcauuuggccuugaacaaaaccaaguccacuggggacagaggcag

SEQ ID NO: 336067 - RNA, 62 nt, hsa
acagguggagcugacccucgucuuuguggcagcaaaaccaggaugccuggagcuguggccug

SEQ ID NO: 336068 - RNA, 62 nt, hsa
acuuuauuuucgucaaguuucaagucugaguucaaaaccagcccugaucccuuaugaccaac

SEQ ID NO: 336069 - RNA, 62 nt, hsa
aggauuuuuucuuuuuuaguaaaaaccgguaucaaaaccaaaauuauaggauuuuuuucuuu

SEQ ID NO: 336070 - RNA, 62 nt, hsa
uuuucaacaucuaaaauuuuuguuuuagccuucaaaaccaacuuaccaaccucaguccagcu

SEQ ID NO: 336071 - RNA, 62 nt, hsa
aggaaaucaggcauuccuauuucuuuaaauaacaaaaccacuaauugccacucaaugcugga

SEQ ID NO: 336072 - RNA, 64 nt, hsa; identical to SEQ ID NO: 68758

SEQ ID NO: 336073 - RNA, 64 nt, hsa; identical to SEQ ID NO: 68759

SEQ ID NO: 336074 - RNA, 64 nt, hsa; identical to SEQ ID NO: 68760

SEQ ID NO: 336075 - RNA, 64 nt, hsa; identical to SEQ ID NO: 68761

SEQ ID NO: 336076 - RNA, 64 nt, hsa; identical to SEQ ID NO: 68762

SEQ ID NO: 336077 - RNA, 64 nt, hsa; identical to SEQ ID NO: 68763

SEQ ID NO: 336078 - RNA, 64 nt, hsa; identical to SEQ ID NO: 68764

SEQ ID NO: 336079 - RNA, 64 nt, hsa; identical to SEQ ID NO: 68765

SEQ ID NO: 336080 - RNA, 64 nt, hsa; identical to SEQ ID NO: 68766

SEQ ID NO: 336081 - RNA, 64 nt, hsa; identical to SEQ ID NO: 68767

SEQ ID NO: 336082 - RNA, 64 nt, hsa; identical to SEQ ID NO: 225698

SEQ ID NO: 336083 - RNA, 64 nt, hsa; identical to SEQ ID NO: 225699

SEQ ID NO: 336084 - RNA, 64 nt, hsa; identical to SEQ ID NO: 225700

SEQ ID NO: 336085 - RNA, 64 nt, hsa; identical to SEQ ID NO: 225701

SEQ ID NO: 336086 - RNA, 64 nt, hsa; identical to SEQ ID NO: 225702

SEQ ID NO: 336087 - RNA, 64 nt, hsa; identical to SEQ ID NO: 225703

SEQ ID NO: 336088 - RNA, 64 nt, hsa; identical to SEQ ID NO: 225704

SEQ ID NO: 336089 - RNA, 64 nt, hsa; identical to SEQ ID NO: 225705

SEQ ID NO: 336090 - RNA, 64 nt, hsa; identical to SEQ ID NO: 225706

SEQ ID NO: 336091 - RNA, 64 nt, hsa; identical to SEQ ID NO: 225707

SEQ ID NO: 336092 - RNA, 64 nt, hsa; identical to SEQ ID NO: 225708

SEQ ID NO: 336093 - RNA, 64 nt, hsa; identical to SEQ ID NO: 225709

SEQ ID NO: 336094 - RNA, 64 nt, hsa; identical to SEQ ID NO: 225710

SEQ ID NO: 336095 - RNA, 64 nt, hsa; identical to SEQ ID NO: 225711

SEQ ID NO: 336096 - RNA, 64 nt, hsa; identical to SEQ ID NO: 225712

SEQ ID NO: 336097 - RNA, 64 nt, hsa; identical to SEQ ID NO: 225713

SEQ ID NO: 336098 - RNA, 64 nt, hsa; identical to SEQ ID NO: 225714

SEQ ID NO: 336099 - RNA, 64 nt, hsa; identical to SEQ ID NO: 225715

SEQ ID NO: 336100 - RNA, 64 nt, hsa; identical to SEQ ID NO: 225716

SEQ ID NO: 336101 - RNA, 64 nt, hsa; identical to SEQ ID NO: 225717

SEQ ID NO: 336102 - RNA, 64 nt, hsa; identical to SEQ ID NO: 225718

SEQ ID NO: 336103 - RNA, 64 nt, hsa; identical to SEQ ID NO: 225719

SEQ ID NO: 336104 - RNA, 64 nt, hsa; identical to SEQ ID NO: 225720

SEQ ID NO: 336105 - RNA, 64 nt, hsa; identical to SEQ ID NO: 225721

SEQ ID NO: 336106 - RNA, 64 nt, hsa; identical to SEQ ID NO: 225722

SEQ ID NO: 336107 - RNA, 64 nt, hsa; identical to SEQ ID NO: 225723

SEQ ID NO: 336108 - RNA, 64 nt, hsa; identical to SEQ ID NO: 225724

SEQ ID NO: 336109 - RNA, 64 nt, hsa; identical to SEQ ID NO: 225725

SEQ ID NO: 336110 - RNA, 64 nt, hsa; identical to SEQ ID NO: 225726

SEQ ID NO: 336111 - RNA, 64 nt, hsa; identical to SEQ ID NO: 225727

SEQ ID NO: 336112 - RNA, 64 nt, hsa; identical to SEQ ID NO: 225728

SEQ ID NO: 336113 - RNA, 64 nt, hsa; identical to SEQ ID NO: 225729

SEQ ID NO: 336114 - RNA, 64 nt, hsa; identical to SEQ ID NO: 225730

SEQ ID NO: 336115 - RNA, 64 nt, hsa; identical to SEQ ID NO: 225731

SEQ ID NO: 336116 - RNA, 64 nt, hsa; identical to SEQ ID NO: 225732

SEQ ID NO: 336117 - RNA, 64 nt, hsa; identical to SEQ ID NO: 225733

SEQ ID NO: 336118 - RNA, 64 nt, hsa; identical to SEQ ID NO: 225734

SEQ ID NO: 336119 - RNA, 64 nt, hsa; identical to SEQ ID NO: 225735

SEQ ID NO: 336120 - RNA, 64 nt, hsa; identical to SEQ ID NO: 225736

SEQ ID NO: 336121 - RNA, 64 nt, hsa; identical to SEQ ID NO: 225737

SEQ ID NO: 336122 - RNA, 64 nt, hsa; identical to SEQ ID NO: 225738

SEQ ID NO: 336123 - RNA, 64 nt, hsa; identical to SEQ ID NO: 225739

SEQ ID NO: 336124 - RNA, 64 nt, hsa; identical to SEQ ID NO: 225740

SEQ ID NO: 336125 - RNA, 64 nt, hsa; identical to SEQ ID NO: 225741

SEQ ID NO: 336126 - RNA, 64 nt, hsa; identical to SEQ ID NO: 225742

SEQ ID NO: 336127 - RNA, 64 nt, hsa; identical to SEQ ID NO: 225743

SEQ ID NO: 336128 - RNA, 64 nt, hsa; identical to SEQ ID NO: 225744

SEQ ID NO: 336129 - RNA, 64 nt, hsa; identical to SEQ ID NO: 225745

SEQ ID NO: 336130 - RNA, 64 nt, hsa; identical to SEQ ID NO: 225746

SEQ ID NO: 336131 - RNA, 64 nt, hsa; identical to SEQ ID NO: 225747

SEQ ID NO: 336132 - RNA, 64 nt, hsa; identical to SEQ ID NO: 190207

SEQ ID NO: 336133 - RNA, 64 nt, hsa; identical to SEQ ID NO: 190208

SEQ ID NO: 336134 - RNA, 64 nt, hsa; identical to SEQ ID NO: 190211

SEQ ID NO: 336135 - RNA, 64 nt, hsa; identical to SEQ ID NO: 190212

SEQ ID NO: 336136 - RNA, 64 nt, hsa; identical to SEQ ID NO: 190223

SEQ ID NO: 336137 - RNA, 64 nt, hsa; identical to SEQ ID NO: 190224

SEQ ID NO: 336138 - RNA, 64 nt, hsa; identical to SEQ ID NO: 190242

SEQ ID NO: 336139 - RNA, 64 nt, hsa; identical to SEQ ID NO: 190243

SEQ ID NO: 336140 - RNA, 64 nt, hsa; identical to SEQ ID NO: 190289

SEQ ID NO: 336141 - RNA, 64 nt, hsa; identical to SEQ ID NO: 190290

SEQ ID NO: 336142 - RNA, 64 nt, hsa; identical to SEQ ID NO: 190311

SEQ ID NO: 336143 - RNA, 64 nt, hsa; identical to SEQ ID NO: 190312

SEQ ID NO: 336144 - RNA, 64 nt, hsa; identical to SEQ ID NO: 190388

SEQ ID NO: 336145 - RNA, 64 nt, hsa; identical to SEQ ID NO: 190389

SEQ ID NO: 336146 - RNA, 64 nt, hsa
ggcagguuguuugauuuaauagguaucuuaaucaagaauuaagcuugcaacauuggcuuugcuc

SEQ ID NO: 336147 - RNA, 64 nt, hsa
gaccuuuuccgggauuucuuguucuuaucaagcaagaauuaagcacaugcuaaacgucuuccau

SEQ ID NO: 336148 - RNA, 64 nt, hsa
aaauaaggaugacuuuagaauaauauugugucauagaauuaauuuucagccauguggaccauau

SEQ ID NO: 336149 - RNA, 64 nt, hsa
ggcugcugugguaauucuauuuguauaucucaacagaauuaaaaugucuagcuuggugguauuu

SEQ ID NO: 336150 - RNA, 64 nt, hsa
uucugaagcagaaguuaaaauggacagcauuucuagaauuaacauuuuaaaaucuagucuuagc

SEQ ID NO: 336151 - RNA, 64 nt, hsa
uaagaccuuaaguaaaaggcacaauggguacuacagaauuaaaauguaggucuaacauaaugcc

SEQ ID NO: 336152 - RNA, 64 nt, hsa
uaaaaguuaagguuguucacuaugauggcaucuuagaauuaaacaaaacuuuuacuagggcuga

SEQ ID NO: 336153 - RNA, 64 nt, hsa
acaaugcugucuucaucagaaaacaguuggcauaagaauuaaacauaugaacaucacaaaacaa

SEQ ID NO: 336154 - RNA, 64 nt, hsa
aaacauugagcucaccuuuuauauauuaaccucuagaauuaaugggccuaugugguuuuuuuuc

SEQ ID NO: 336155 - RNA, 64 nt, hsa
uguguuuuuuuauugcuagcuaucauuaccaguuagaauuaacauuaauuacaauuaacaauaa

SEQ ID NO: 336156 - RNA, 64 nt, hsa
uuuuuccagacuagugugccauggauuucugauaagaauuaacauucuugaacaaagguaucag

SEQ ID NO: 336157 - RNA, 64 nt, hsa
uaaaacaggacaauuuaaaaauuuuaaauuuuaaagaauuaaaaauuuuaaaaauuuaaauuaa

SEQ ID NO: 336158 - RNA, 64 nt, hsa
gaacuuuauucccuuauauuccugaaaagaaaucagaauuaacauuuuuauguugaauaaauuu

SEQ ID NO: 336159 - RNA, 64 nt, hsa
ucaccuagaaaaguagccucacucuuauuccucaagaauuaauauccaauguuuaugagucuug

SEQ ID NO: 336160 - RNA, 64 nt, hsa
aaauuuaaauuuauccuccaacuaaauuuuugauagaauuaaauuuaaauuuguccuccaacug

SEQ ID NO: 336161 - RNA, 64 nt, hsa
uguuugcacaauuuaaauuugauaaauuuuugauagaauuaaauuuaaauuuauccuccaacua

SEQ ID NO: 336162 - RNA, 64 nt, hsa
cucaacacuuucccuuuuuucccaaaaugaguagagaauuaaagccacccaaaacagcuucugc

SEQ ID NO: 336163 - RNA, 64 nt, hsa
uuaaaugguaaauaaucuguuuaugugaagaaaaagaauuaagucuuucuuccaacucucuccu

SEQ ID NO: 336164 - RNA, 64 nt, hsa
uuuaguaauuugcaaaagccacaacaguaguggaagaauuaaaauucauaaagucucaucauuc

SEQ ID NO: 336165 - RNA, 64 nt, hsa
gagugaauaggagaaaacaauauauaacacacagagaauuaagaaaaugacauuucuggggagu

SEQ ID NO: 336166 - RNA, 64 nt, hsa
uaguuacagugcuuggaaugagaaggggaaggaaagaauuaacaaaugccaagauuucuggagc

SEQ ID NO: 336167 - RNA, 64 nt, hsa
aauguuuaauaaaugcuuauaugaauggauuuuuagaauuaacuaagaagccaaaaauggcaac

SEQ ID NO: 336168 - RNA, 64 nt, hsa
ccauaucaucaaaagacugaaaaauuauaauuuuagaauuaaacugauggauuucauuauagaa

SEQ ID NO: 336169 - RNA, 64 nt, hsa
cagggcucuccuuccugucccuucgaucuccuugagaauuaagagcuggcagcugcugauggug

SEQ ID NO: 336170 - RNA, 64 nt, hsa
gaccaaggcuauucagcagugaaccagugaccaaagaauuaauuacccuccguuucccacaucc

SEQ ID NO: 336171 - RNA, 64 nt, hsa
acaauagaagacauuuucacuggaauuacaaagcagaauuaaaauuauauuguagaaggaaaca

SEQ ID NO: 336172 - RNA, 64 nt, hsa
uguuuguaauauauucaugaggcuggaaguaagaagaauuaaaaauuuguccuaauuacaauga

SEQ ID NO: 336173 - RNA, 64 nt, hsa
cauaaugagaaagucagacugagguaauaagaccagaauuaagugauagaagaaacuguuguuu

SEQ ID NO: 336174 - RNA, 64 nt, hsa
agcuguaauucugaaauacacauccaagugaaugagaauuaaaaauuuucuaaauauuaauacu

SEQ ID NO: 336175 - RNA, 64 nt, hsa
caucuggaguugaguuggugucagauaguguaugagaauuaaaugugucaucugagcaugcuac

SEQ ID NO: 336176 - RNA, 64 nt, hsa
aguuccagggaugaucaugagcaggcgcaaaaucagaauuaaaggucgcacauagacguuucag

SEQ ID NO: 336177 - RNA, 64 nt, hsa
gaugacugagaaucuauuugaguuuccagcuggcagaauuaauuguuauuauuuuccuaggcgc

SEQ ID NO: 336178 - RNA, 64 nt, hsa
ggcuuuacaggguuguaucauugacuuaaaaugaagaauuaacuuguguuacaucuauaaagag

SEQ ID NO: 336179 - RNA, 64 nt, hsa
agagaauaucucuuggugucauaucuaggggaagagaauuaacuagaauuaaauuuaauguuug

SEQ ID NO: 336180 - RNA, 64 nt, hsa
ucuuggugucauaucuaggggaagagaauuaacuagaauuaaauuuaauguuugaaucuaaauc

SEQ ID NO: 336181 - RNA, 64 nt, hsa
ucucucuuccagggaguaccuuuuuuucuaguugagaauuaauaaugguccaucucuuuugauc

SEQ ID NO: 336182 - RNA, 64 nt, hsa
cuaggguagugacugagauguaaaaauagauuuuagaauuaaaacaaaauccaaguccucacac

SEQ ID NO: 336183 - RNA, 64 nt, hsa
aaugaaugaauuuagaaccacacaaugccaagauagaauuaauuuaaagccuuaaacaaaauuu

SEQ ID NO: 336184 - RNA, 64 nt, hsa
uauuugaagcaugaaaaaagaggguuggagguggagaauuaaccuccugccaugacucuggcuc

SEQ ID NO: 336185 - RNA, 64 nt, hsa
ucucaucugaagaacaaauuagauuuagcuaauuagaauuaauccuggcuuucauugccauagu

SEQ ID NO: 336186 - RNA, 64 nt, hsa
gguauuuuguauugucaaggcaugcauauucuaaagaauuaaaugcuaacuuaacagcacuggc

SEQ ID NO: 336187 - RNA, 64 nt, hsa
uaaagaauuaaagcuucuaugaguauaugguuuaagaauuaaauuauuaguaauuuauuauuuu

SEQ ID NO: 336188 - RNA, 64 nt, hsa
uuacauuccccaagggucaaauuggagcuuuuaaagaauuaaagcuucuaugaguauaugguuu

SEQ ID NO: 336189 - RNA, 64 nt, hsa
cuguacuuuuuuugaucaguuggcaugaagccauagaauuaaauuuuggcuuuagaauacagau

SEQ ID NO: 336190 - RNA, 64 nt, hsa
ugcuuuuggacaauguugcaagaacucuauuuuugacaugcauuaaucuuuuauuuugcacuuu

SEQ ID NO: 336191 - RNA, 64 nt, hsa
acagucaccugagccuuaaauguaaguauuacaugacaugcauucuguuucuuccagaguucug

SEQ ID NO: 336192 - RNA, 64 nt, hsa
ggccucaccuguuuguuuaggccaagaugccauggacaugcagcguuagugaucccacuagcug

SEQ ID NO: 336193 - RNA, 64 nt, hsa
agaggguuccugggggaaguauggugaauaaacugacaugcaugcuucagaaccugccuguguu

SEQ ID NO: 336194 - RNA, 64 nt, hsa
caugccucagcugggacccaccguguagacacacgacaugcaagaguugcagcggcugcuccaa

SEQ ID NO: 336195 - RNA, 64 nt, hsa
cacccucuucugugagcaggaaaagaacccuacugacaugcaugguuuaacuuccucaucagaa

SEQ ID NO: 336196 - RNA, 61 nt, hsa
augucuuugugaaauacacuggugguguccuucuuacaaaacuuuugaaauaaaaaaaaaa

SEQ ID NO: 336197 - RNA, 61 nt, hsa
ugauucagagaaggaccaaauuauaugaaugucuuacaauggaauuuacuuguuacugauu

SEQ ID NO: 336198 - RNA, 61 nt, hsa
ugaaagcagagucuauaaaugaacucuuugcucuuacaagguaauuuacauauuuucuuuc

SEQ ID NO: 336199 - RNA, 61 nt, hsa
ugcuuguugccuuugacagugacagugcgcgucuuacaacuaauuccacuaggcaugggaa

SEQ ID NO: 336200 - RNA, 61 nt, hsa
aucuaggguucuaauugcuuuugcauccuauucuuacaaagugaugucccaacagggaaca

SEQ ID NO: 336201 - RNA, 61 nt, hsa
cuuggcucgccucggccggcccgggaugcacucuuacaacaugugugacucuugaaccugg

SEQ ID NO: 336202 - RNA, 61 nt, hsa
ucagcauaagaaaauucacaccagagccaaaucuuacaaauguagcaguugugaaagaguc

SEQ ID NO: 336203 - RNA, 61 nt, hsa
ucgacuccugcaaaucuauaccagugagaaaucuuacaaauguauugaauguggcaaauuu

SEQ ID NO: 336204 - RNA, 61 nt, hsa
uuuuuuuugacaauuuuggguucccaacuuaucuuacaagugaaaacuuaaauuguaaaac

SEQ ID NO: 336205 - RNA, 61 nt, hsa
uuguaauuauuugcaauuaauuguucuuuuaucuuacaauuguuuaagccugugaucuuuc

SEQ ID NO: 336206 - RNA, 61 nt, hsa
uagacaucagagaaucuauacuggacagaaaucuuacaaaugucaucaguguggcaagguc

SEQ ID NO: 336207 - RNA, 61 nt, hsa
aaaucauuggagaauccauaaugaagagagaucuuacaaguguaauaaauguggcaaauuu

SEQ ID NO: 336208 - RNA, 61 nt, hsa
uagacaucagagaauccaugcuggacagaaaucuuacaaaugucaucagugugguaagguc

SEQ ID NO: 336209 - RNA, 61 nt, hsa
ugcaaaucauuggagaauccauaaugagagaucuuacaaguguaauaaaugugacagauuu

SEQ ID NO: 336210 - RNA, 61 nt, hsa
aagucaucauagucuucauacugcagagaaaucuuacaaaugugaagacugugacaaaguu

SEQ ID NO: 336211 - RNA, 61 nt, hsa
uagacaucagagaauccaugcuggacagaaaucuuacaaaugucaucaguguggaaggguc

SEQ ID NO: 336212 - RNA, 61 nt, hsa
gcacaucauuggagaauccacagugaagagaucuuacaaguguaauaaauguggcaaauuu

SEQ ID NO: 336213 - RNA, 61 nt, hsa
aagucaucauagacuucauacugcauagaaaucuuacaaacgugaacaaugugacaaaguu

SEQ ID NO: 336214 - RNA, 60 nt, hsa
aguaacagaaaaugaugaaauaaagagaccaucuuacaauaaucucaguuuuuguuucuu

SEQ ID NO: 336215 - RNA, 61 nt, hsa
guaauuuuaucaagagcaaaaguuauaguuuucuuacaaguuaaaaaaacagccagauuau

SEQ ID NO: 336216 - RNA, 61 nt, hsa
gaagucuuauaaaaauuuaaaaagacacauuucuuacaaaaaagaguugaaugagguaaaa

SEQ ID NO: 336217 - RNA, 61 nt, hsa
gguaauuugccaggaauucuucauaacaguaucuuacaaaaaacguguugcucucuucaca

SEQ ID NO: 336218 - RNA, 64 nt, hsa
gaacuacauucuucagaauacagugaugaaaauucauuuugaaacucaaauauuuucauuuugg

SEQ ID NO: 336219 - RNA, 64 nt, hsa
auguagaggaaauagaaauguauuuuuucaugaacauuuugauacaaauuucaucauuuaauga

SEQ ID NO: 336220 - RNA, 64 nt, hsa
gagguaaaaacuauaguuuuauuacagcauaauucauuuugagcuccacuaugacauuucaaag

SEQ ID NO: 336221 - RNA, 64 nt, hsa
uaauguauuauacguuugaagccuagugacuuuucauuuugacauucuugugauuucauaugcu

SEQ ID NO: 336222 - RNA, 64 nt, hsa
augcucuauugggggaagacaaaugaagagaaugcauuuugagcauuucaaaucaguaguuugg

SEQ ID NO: 336223 - RNA, 64 nt, hsa
gcccacaauguaaacaggguugguaguuguuacucauuuugaauauaccuuuuccuuauuguau

SEQ ID NO: 336224 - RNA, 64 nt, hsa
auuuuuagaugccacuacuuuuuucuuaaauauucauuuugagacugucaugaguuagaccagu

SEQ ID NO: 336225 - RNA, 64 nt, hsa
uguuuugcucaucuaacuucauuguacccagcgucauuuugacaugucauuuccuaucucccau

SEQ ID NO: 336226 - RNA, 64 nt, hsa
aauuagacaugaacucaguuagcugaaucauuuacauuuugacuccauagcuuagggcagacag

SEQ ID NO: 336227 - RNA, 64 nt, hsa
uccaaaaaucuaaggaguaaacagcuuauuuauacauuuugaggagaaaacaaaguguuucacu

SEQ ID NO: 336228 - RNA, 64 nt, hsa
cugccagauuuucacauuuuuaaaauguucuagucauuuugagaaaucauauaucuuacacagu

SEQ ID NO: 336229 - RNA, 64 nt, hsa
cugacuuuuuguaugaagcaugccucaguuuccucauuuugaucuagauauaaaauuaaaauug

SEQ ID NO: 336230 - RNA, 64 nt, hsa
aggccagucacuguuggaagucauccaagaagcccauuuugaggccauuuugagccuuacucuu

SEQ ID NO: 336231 - RNA, 64 nt, hsa
uguuggaagucauccaagaagcccauuuugaggccauuuugagccuuacucuuaaguucucuau

SEQ ID NO: 336232 - RNA, 64 nt, hsa
gauauagccaauuaaguguguuauggaguacacccauuuugacacacuuguaauaagagaaucu

SEQ ID NO: 336233 - RNA, 64 nt, hsa
gagaaucuuauaaucggaauggagugaaaugaaacauuuugaguacugauggcauguuaucaua

SEQ ID NO: 336234 - RNA, 64 nt, hsa
ucagcaccagaaacaaaaauuaagauuaucaaagcauuuugaauagugcacugccauguguccu

SEQ ID NO: 336235 - RNA, 64 nt, hsa
cuaaauagguuugcuuucuuuuaguuacagugcccauuuugaaauugccuauacagucuuagug

SEQ ID NO: 336236 - RNA, 64 nt, hsa
auuuuuuaugggaagacuuuguguuaaaagugaacauuuugaagguuuuuaacuggugaaacua

SEQ ID NO: 336237 - RNA, 64 nt, hsa
uucuuaugagccaaaaguuugucauuuaaaaguucauuuugagggaauaacauguaauauaauu

SEQ ID NO: 336238 - RNA, 64 nt, hsa
auuuuucucgagugacuagaccaaauaucaagaucauuuugagacucugaaaugaaguaaaaga

SEQ ID NO: 336239 - RNA, 64 nt, hsa
acauugucuuuuaugaauucugaucauauuuagucauuuugaccaaaugagggauuuggucaaa

SEQ ID NO: 336240 - RNA, 64 nt, hsa
ccauuugauaauuuuacaguaaguaggucucauucauuuugacaguuaucaaagauguacuuuc

SEQ ID NO: 336241 - RNA, 64 nt, hsa
gcagacuuaaaguagcuuuguacgccuuaauguucauuuugauuuauuuuaaaucuuuacauuc

SEQ ID NO: 336242 - RNA, 64 nt, hsa
aaagaucucauaacuuuauacagcauguuguaagcauuuugauaacuaaaauccuguucuagug

SEQ ID NO: 336243 - RNA, 64 nt, hsa
aaguaagcagaguucuuugcaagcuuauuuagcacauuuugacacaauguugcacugaaaaccc

SEQ ID NO: 336244 - RNA, 64 nt, hsa
ccucuauuucuuuaaucuguuguuugaagaaccgcauuuugaggguguaaccaguagucaccuc

SEQ ID NO: 336245 - RNA, 64 nt, hsa
agugacagauccuccauuuuuguugggaugcgggcauuuugaaugugaucaucuuugcugaaug

SEQ ID NO: 336246 - RNA, 64 nt, hsa
uaaacuaaaaauuaggguugauuuuuuugcucuccauuuugacuugcaagaaauaauaccucaa

SEQ ID NO: 336247 - RNA, 64 nt, hsa
ucuuuucuaaccuuaacccugccaaaccuugauccauuuugacauuuguuaugcacuauuuuua

SEQ ID NO: 336248 - RNA, 64 nt, hsa
cugcuaaauuuaauaaaaacuucagaaaaaccuccauuuugaucaucaggauuucaucugagug

SEQ ID NO: 336249 - RNA, 64 nt, hsa
auacugcgggcaccagaaugcuaaaguuuccuaacauuuugaaguuucuguaguucauccuuaa

SEQ ID NO: 336250 - RNA, 64 nt, hsa
gaaguguauauacuuuaauguguguauacugucacauuuugacuauuuuggaagacuuucaccu

SEQ ID NO: 336251 - RNA, 64 nt, hsa
cuguuaugcugugaaauuuggaauucaguauuaucauuuugaagucuguaaauuguguuaguca

SEQ ID NO: 336252 - RNA, 64 nt, hsa
guaggacuagcuuaccugauuuuaaugaaaaucacauuuugauacaaacaccagauuugaaagu

SEQ ID NO: 336253 - RNA, 64 nt, hsa
auggugccuacucgaaagaaauguagaugcuaugcauuuugaaaauaaucugcaucaguuagaa

SEQ ID NO: 336254 - RNA, 64 nt, hsa
uaguaauacaugcuguaauauagaauuaguggaacauuuugauuaaucuuucccuagaagugac

SEQ ID NO: 336255 - RNA, 64 nt, hsa
cacacuuagaacacucacugcacugguggcuguucauuuugaggaacuccaaagucaauucaag

SEQ ID NO: 336256 - RNA, 64 nt, hsa
cugcuuaugcuaguucaguauuuggucuaggcuucauuuugauaugacugaauugcaaucuaua

SEQ ID NO: 336257 - RNA, 64 nt, hsa
gaaguuauuuauaauuaauucacagcuaaucaggcauuuugaaagcuuaauuggauucaaaaac

SEQ ID NO: 336258 - RNA, 64 nt, hsa
auacuuugacauuuuaaacaugauaguccauaaccauuuugaaaugcugggcaaacuacaugaa

SEQ ID NO: 336259 - RNA, 64 nt, hsa
gcacuugcaguagugaucuaugccagcaaaacaucauuuugagacaaacauuuuuguggcagau

SEQ ID NO: 336260 - RNA, 64 nt, hsa
uuguuugcucuuuuuguuuuuuaccuaaacaauacauuuugauucucuuguggguugauaaugu

SEQ ID NO: 336261 - RNA, 64 nt, hsa
caagauuuagguugaugaaagauacaugaguuugcauuuugaccuguucagugucugucuucca

SEQ ID NO: 336262 - RNA, 64 nt, hsa
aguauagaucaguugguacagaaauacaugaacacauuuugauagggcuuauuucacacaaaga

SEQ ID NO: 336263 - RNA, 64 nt, hsa
uugaguuucaccuuucuccaguccagcagaauuacauuuugaugaccuccauuuugauacuugu

SEQ ID NO: 336264 - RNA, 64 nt, hsa
cuccaguccagcagaauuacauuuugaugaccuccauuuugauacuuguagaccagaucuaauc

SEQ ID NO: 336265 - RNA, 64 nt, hsa
auugguauguaacacaggauaaaguuauucuugucauuuugaacuguagaguccuauuucagug

SEQ ID NO: 336266 - RNA, 64 nt, hsa
ggacgcauaaucauuaccuuaaagcaucaccacucauuuugaccauauagauuuuauuauguua

SEQ ID NO: 336267 - RNA, 64 nt, hsa
ccaguugaaugcaaaacaaaaaaaauauggaaaacauuuugauaaaauuuuuuccuguuaaaac

SEQ ID NO: 336268 - RNA, 64 nt, hsa
gaugcauuauuuauuuugcuuuagaucuugaauacauuuugagaauaacuaauguggauugaaa

SEQ ID NO: 336269 - RNA, 64 nt, hsa
caucuugaugagaaaacucuuaaauaguaccaaacauuuugaacuuuaaauuauguauuuaaag

SEQ ID NO: 336270 - RNA, 64 nt, hsa
uccagauccaacacaagcagucuugccguuagggcauuuugaagcagauaguagaguaagaacu

SEQ ID NO: 336271 - RNA, 64 nt, hsa
uggguaguuaaaaauuacucccucuuuucucuagcauuuugacauuucagacucaaugcucuga

SEQ ID NO: 336272 - RNA, 64 nt, hsa
aguggguuccacuuuauuuuucauuuguuaucuacauuuugaaggguuuaugugcaaagugaaa

SEQ ID NO: 336273 - RNA, 64 nt, hsa
aagauccuacacuuuuaccuucuuuaaggguguacauuuugauguugaacaucaguuuucaugu

SEQ ID NO: 336274 - RNA, 64 nt, hsa
agaggaaauauaaccggugugagaucuagcaaugcauuuugaaucuucacucccuaccaggcuc

SEQ ID NO: 336275 - RNA, 64 nt, hsa
uuaccauaauuuacucacuuuuuucuguguuagacauuuugauuaucugcaguuuauuacuaca

SEQ ID NO: 336276 - RNA, 64 nt, hsa
uacuacaagcaguggcagagugaauguccuuguacauuuugaguuacaugcuuaauuauguccu

SEQ ID NO: 336277 - RNA, 64 nt, hsa
uucccucacucuacucuccucacuaucggaaauucauuuugauucagaauaaaaaccaaaugua

SEQ ID NO: 336278 - RNA, 64 nt, hsa
aacuuuauuaauaaucauguauuuuuacugaucacauuuugaaaugccuaaaagacuuuauugu

SEQ ID NO: 336279 - RNA, 64 nt, hsa
gacucuagacuauguuaacuaguuaaggauguuacauuuugaaaggauguauguuagauauauu

SEQ ID NO: 336280 - RNA, 64 nt, hsa
uuaggucacuuagaaaaauaugucauguauuuuacauuuugagaaacaaaucaaucaugguuuc

SEQ ID NO: 336281 - RNA, 64 nt, hsa
gcacuuauugauuaagaccuugcauaugucuguccauuuugauuugagauacaacuuuuugugu

SEQ ID NO: 336282 - RNA, 64 nt, hsa
gaccucacuuagcagggauuacagaaaugagauacauuuugaaggagaguugucuguuauguuc

SEQ ID NO: 336283 - RNA, 64 nt, hsa
gggauggcuucaugggagaguggcugucacccaucauuuugaagcauauagaacaacaaaugcu

SEQ ID NO: 336284 - RNA, 64 nt, hsa
auuuugcaagucaaguaaccaaaaaagggggaggcauuuugaagauagaaccucuauuuuaaaa

SEQ ID NO: 336285 - RNA, 64 nt, hsa
ucauuuaccaucauguauccaguaguggauaauucauuuugauggcuucuauuuuuggccaaau

SEQ ID NO: 336286 - RNA, 64 nt, hsa
uauccuuuaaaaggaauacguuuuaggaugucaucauuuugaugugaaucauguaaauguugau

SEQ ID NO: 336287 - RNA, 64 nt, hsa
ugggccuagugaaaaugggggcaggugagaaguccauuuugagaaucagcauaguaaauuacau

SEQ ID NO: 336288 - RNA, 64 nt, hsa
gcaggugauuacuuugaaaaagguugguccagaccauuuugaucaagaaccuguauauguguug

SEQ ID NO: 336289 - RNA, 64 nt, hsa
cuaaauguagcauuucaauuagauccagcuuucacauuuugagauaauuguaaaaagaaugaaa

SEQ ID NO: 336290 - RNA, 64 nt, hsa
ucuguguacgcaaaguaauugcauuuugucccuucauuuugacuuucuuagauucauaauuuga

SEQ ID NO: 336291 - RNA, 64 nt, hsa
aaucuacucaaagcaugggauuauuagaaucaaacauuuugaaagucuguccuugaaggacuaa

SEQ ID NO: 336292 - RNA, 64 nt, hsa
cuucuugaggggaagcuagucuuuugcuuuugcccauuuugaaucacaugaauuauuacagugu

SEQ ID NO: 336293 - RNA, 64 nt, hsa
uaacccaucauaauccaaacaaaugaugccucaacauuuugagcugcucugucggacaaauaaa

SEQ ID NO: 336294 - RNA, 64 nt, hsa
uggaguagaccugaccuuguuauuuauuagauaacauuuugaauguauccauuggauuucuaaa

SEQ ID NO: 336295 - RNA, 64 nt, hsa
aacacaaggcaaaacaacuuugauaugguacagucauuuugacaaucgauauuugaaucacaau

SEQ ID NO: 336296 - RNA, 64 nt, hsa
acaucacaaaucacugaugugguuguaacgacagcauuuugagugccauguauaucacaugaac

SEQ ID NO: 336297 - RNA, 64 nt, hsa
guuauuccauauaaguaucaaguuaaacacaauucauuuugauuauaaacuauuugacuuuuua

SEQ ID NO: 336298 - RNA, 64 nt, hsa
uuugugauacgugucaugugugaaaaguuugaugcauuuugagauggaaaacugaaauuuggaa

SEQ ID NO: 336299 - RNA, 64 nt, hsa
uggacaucccuggaaaccuugcuguugguauuuccauuuugauacuugagagcaucaaauuuug

SEQ ID NO: 336300 - RNA, 64 nt, hsa
gcuaaccacaggaagacugucggcagcccucucacauuuugaggcuggcuuguagguccuugcu

SEQ ID NO: 336301 - RNA, 64 nt, hsa
ggagacccagcagcaccuuuccuccacacaccuucauuuugauguucggguuuuuguguuaagu

SEQ ID NO: 336302 - RNA, 64 nt, hsa
ugaacugucuuggcugugagcaacugcgacaaaacauuuugaaggaaaauuaaaccaaugaaga

SEQ ID NO: 336303 - RNA, 64 nt, hsa
aaaguuacuuagcuaaaauuuuagcaauuuauugcauuuugaaauaaucauuaacaugcugcaa

SEQ ID NO: 336304 - RNA, 64 nt, hsa
uuucagccuguuuuuuagcuuagugccauuaugucauuuugauuuguauucaaguacucuucaa

SEQ ID NO: 336305 - RNA, 64 nt, hsa
agucacuuugcuaaauucuucaccugugguaacucauuuugauuguuauaacaucucagcaccg

SEQ ID NO: 336306 - RNA, 64 nt, hsa
uuuugggggguggggggguauuugcaagaauacucauuuugacauaauagguccucuugucaga

SEQ ID NO: 336307 - RNA, 64 nt, hsa
aagagcccaggugcacugcucacacccccaccugcauuuugaagucauauuauuuuuuguuuug

SEQ ID NO: 336308 - RNA, 64 nt, hsa
cuuuaaacacacacacaaaaucguucuuuacuuucauuuugauucuuuuaaaucugucuaguug

SEQ ID NO: 336309 - RNA, 64 nt, hsa
uucucagcuucucccauaaagagacccuaauaugcauuuugauuuguaauuggaaauguaacuu

SEQ ID NO: 336310 - RNA, 63 nt, hsa
caugcuacauguccaaaaauaaagaccagaaugacauuuugauaauuuucugaguuugucuua

SEQ ID NO: 336311 - RNA, 64 nt, hsa
uuccuugaguaagauaguccaucaguuaccagcacauuuugaaccccugcucuguguagaaugu

SEQ ID NO: 336312 - RNA, 64 nt, hsa
aaucgacgugaaauucacguaacauagaauuaaccauuuugaagugaacaauuugguugcauuc

SEQ ID NO: 336313 - RNA, 64 nt, hsa
aaauaauuuugugcaugaaacaaaguuucgacugcauuuugacugugauuucuggcaugagauc

SEQ ID NO: 336314 - RNA, 64 nt, hsa
cacauacagacucaacagcaaucaugcaguuccagagacacaugaaccugacacaaucucucuu

SEQ ID NO: 336315 - RNA, 64 nt, hsa
agauagacuuuaggggcuggcacaaaucugaucagagacacauauccauacacaggugaaacac

SEQ ID NO: 336316 - RNA, 64 nt, hsa
gauguggccuguugguccuucuguugccaucacagagacacaggcauuuaaauauuuaacuuau

SEQ ID NO: 336317 - RNA, 64 nt, hsa
cccaggcucaggguuaacagcuagccuccuaguugagacacaccuagagaaggguuuuugggag

SEQ ID NO: 336318 - RNA, 64 nt, hsa
cauuaaagaagaguuucuaggggcuacuguuuaugagacacauccaggaguuauguuuaaguaa

SEQ ID NO: 336319 - RNA, 64 nt, hsa
aauggacuugagaucuuggcaaucugcccaaggggagacacaaaauagggauuuuuacuucauu

SEQ ID NO: 336320 - RNA, 64 nt, hsa
ccgacagauccacaaaggaacaauaaagcuauuugagacacaaaccucacgaguggaaaugugg

SEQ ID NO: 336321 - RNA, 64 nt, hsa
aucaagcacgugagaguuuuuguuuaaaagauaagagacacagcauguauuaugcacuucauuu

SEQ ID NO: 336322 - RNA, 64 nt, hsa
gacacacaaucacacgcagccccuccccgccacagagacacaccauuacauacacagacacaca

SEQ ID NO: 336323 - RNA, 64 nt, hsa
gacacaaaaucacacacacacccuccccgccacagagacacaccauuacauacacagacacgca

SEQ ID NO: 336324 - RNA, 64 nt, hsa
uauugcagaagacaguguguugccuuauaggcgugagacacacacacacacacacacacacaca

SEQ ID NO: 336325 - RNA, 64 nt, hsa
uauucaucugaugcuguaaauugcccuucuuucugagacacagauuauaagaugccagaucaua

SEQ ID NO: 336326 - RNA, 64 nt, hsa
ucgggcuugagugagaagagcuugcacagccaacgagacacauugccuucuggagcugggagac

SEQ ID NO: 336327 - RNA, 64 nt, hsa
cgaugugguaggugauaaagaggcaucuuuucuagagacacauuggaccagaugaggauccgaa

SEQ ID NO: 336328 - RNA, 64 nt, hsa
cuuccagggagaccuccccgcccagcagcccccagagacacaacaaccuaccuuccagccuuaa

SEQ ID NO: 336329 - RNA, 64 nt, hsa
agggaaagaaugguggggaccccuguacuugggggagacacaccugcaucuuccuccugccaca

SEQ ID NO: 336330 - RNA, 64 nt, hsa
gggugcuguauucaggaaacccaucucacgugcagagacacacauaggcucaaaauaaaaggau

SEQ ID NO: 336331 - RNA, 64 nt, hsa
gaaauaacuaaaaucagcagaacucaaggaaauagagacacaaaaaaaccuucaaaaaauuaau

SEQ ID NO: 336332 - RNA, 64 nt, hsa
gccaugacagguguccuuccaagagacagaagaggagacacagacacagagcaggaggacacgu

SEQ ID NO: 336333 - RNA, 64 nt, hsa
gcccaauccagugucccuaugagagacggaagaggagacacagacacaaagcaggaggccacau

SEQ ID NO: 336334 - RNA, 64 nt, hsa
gcgaguggauaauuccaacacaagacuggcaguccaaauugaaagagauccagguaagaagauc

SEQ ID NO: 336335 - RNA, 64 nt, hsa
gcaaaucaacacuuucugcacuuaucuuuuggagcaaauugacaugcuguuuuuuggugguucu

SEQ ID NO: 336336 - RNA, 64 nt, hsa
aauuugcauagagaagguccucugguuagucucucaaauugaggcuguuuagggaaauccuuau

SEQ ID NO: 336337 - RNA, 64 nt, hsa
gacuauucauuggagaguuuacccauacauuuagcaaauugaauggccaaaacauuugacucca

SEQ ID NO: 336338 - RNA, 64 nt, hsa
gcacauauuucauuuccucugauuuaugcugucacaaauugaaaaucugaguguaguuaggaca

SEQ ID NO: 336339 - RNA, 64 nt, hsa
uuggagauuguuacgcuugaaauuaaguuggaggcaaauugauaauuacuuaguaauguccuua

SEQ ID NO: 336340 - RNA, 64 nt, hsa
uauuuaagaauugcuaagggaaacaggucuuacacaaauugacacuaacucaaaaaaaaucuua

SEQ ID NO: 336341 - RNA, 64 nt, hsa
ggucaacauaugaugcugcuauaagucuggggcucaaauugauaucccaguagcaauaaacaua

SEQ ID NO: 336342 - RNA, 64 nt, hsa
agagacaagguucugauugugaaacagagccuuucaaauugaaguguagauugauuuaaaaaaa

SEQ ID NO: 336343 - RNA, 64 nt, hsa
uguuaaagauagggagccuuuuaaaaaugugccccaaauugaucagucaguaguguaagaauaa

SEQ ID NO: 336344 - RNA, 64 nt, hsa; identical to SEQ ID NO: 286623

SEQ ID NO: 336345 - RNA, 64 nt, hsa; identical to SEQ ID NO: 286624

SEQ ID NO: 336346 - RNA, 64 nt, hsa; identical to SEQ ID NO: 286625

SEQ ID NO: 336347 - RNA, 64 nt, hsa; identical to SEQ ID NO: 286626

SEQ ID NO: 336348 - RNA, 64 nt, hsa
gggauagggggaggguuggaaaauuuauuuuuaugaaacagagggaagacuuuauuguuguuau

SEQ ID NO: 336349 - RNA, 64 nt, hsa
cacucaauggccuagaagcugccuguacuuuggggaaacagauggagcucuugggcccagccag

SEQ ID NO: 336350 - RNA, 64 nt, hsa
uaugacauauaugaaagguuuaucuaagaagaaagaaacagagauaauauauauauagaaagau

SEQ ID NO: 336351 - RNA, 64 nt, hsa
auaaaaacaagaaccacaaaaacuugaaaaaucugaaacagagaacagaaggccaagagccagc

SEQ ID NO: 336352 - RNA, 64 nt, hsa
cuuaauggaucagacuuugccagauuugguuagggaaacagaaauuuagaauggugcauuauuu

SEQ ID NO: 336353 - RNA, 64 nt, hsa
ggagaguaaauagcccuucagcaugcucauucaugaaacagaagaggcuguacaagugaagaca

SEQ ID NO: 336354 - RNA, 64 nt, hsa
uacuuuaauugaaauacucugaauuccccucauggaaacagagagcauugagagcacuuucuuu

SEQ ID NO: 336355 - RNA, 64 nt, hsa
agcaaguggccgugcuaccuuuuuagagaauaaagaaacagacuuuugaguuuauaugcaaugc

SEQ ID NO: 336356 - RNA, 64 nt, hsa
aaguuuuaauuuggguauagguuaaauggaagaagaaacagaacuucauggccaaaguagaccu

SEQ ID NO: 336357 - RNA, 64 nt, hsa
auaugccacacuuugcaccuuaaugaaauacuuugaaacagaaguuauucacuguguuuuugau

SEQ ID NO: 336358 - RNA, 64 nt, hsa
caccaaaaaaugguagacaugaaaggcaggugaggaaacagaaaaggucucuuugcagauauau

SEQ ID NO: 336359 - RNA, 64 nt, hsa
auggagaugaaauaaacaaggcaaaauagagguggaaacagaaggaagucauuugcugagucug

SEQ ID NO: 336360 - RNA, 64 nt, hsa
gcaucacgucgccuuccuauguaugacgaaacaagaaacagagauuuccaauugcucuuuuguc

SEQ ID NO: 336361 - RNA, 64 nt, hsa
aaucccucacucaaccugcugagguguggauggggaaacagaggcaaaacugaggcaccugaug

SEQ ID NO: 336362 - RNA, 64 nt, hsa
acuggcuaugcauuaccuaaaaccaguccaaaaugaaacagaccaacacacacacaaaagcaaa

SEQ ID NO: 336363 - RNA, 64 nt, hsa
ugcgcauggcuguucugcugcaacugugcuccacgaaacagaagaaaagguaagguguuguguc

SEQ ID NO: 336364 - RNA, 64 nt, hsa
cacugccauugccgagaguccuguuauugagguagaaacagaaaagaaagacguucuugauuuu

SEQ ID NO: 336365 - RNA, 64 nt, hsa
uucugaugauuuggguucuuuuccauaguccaaagaaacagaucagcucuucagguaucauguu

SEQ ID NO: 336366 - RNA, 55 nt, hsa; identical to SEQ ID NO: 248228

SEQ ID NO: 336367 - RNA, 61 nt, hsa; identical to SEQ ID NO: 248229

SEQ ID NO: 336368 - RNA, 64 nt, hsa
uaugcaugugauggugccugagaccccugccuuagaaacagaauuccuaaggggauugacucuc

SEQ ID NO: 336369 - RNA, 64 nt, hsa
caaaguagugccacugcagugucuuuuuaaacuggaaacagaauuggaaaacugccugacuuau

SEQ ID NO: 336370 - RNA, 64 nt, hsa
gagcagaagcaaagagcagacacacauacagccugaaacagaccuggacagacagacacagccu

SEQ ID NO: 336371 - RNA, 64 nt, hsa
gccugaaacagaccuggacagacagacacagccugaaacagacccggacagacagacacagccu

SEQ ID NO: 336372 - RNA, 64 nt, hsa
gccugaaacagacccggacagacagacacagccugaaacagacccagacaaacagacagacaga

SEQ ID NO: 336373 - RNA, 64 nt, hsa
cagacccagacaaacagacagacagacacagccugaaacagacccagacagacagacagacagc

SEQ ID NO: 336374 - RNA, 64 nt, hsa
cugaaacagacccagacagacagacagacagccugaaacagacccagacacagccugaaacaga

SEQ ID NO: 336375 - RNA, 64 nt, hsa
gacagacagccugaaacagacccagacacagccugaaacagauccggacagacagacagaaaca

SEQ ID NO: 336376 - RNA, 64 nt, hsa
gaaacagauccggacagacagacagaaacagccugaaacagacccagacagacagacagacaca

SEQ ID NO: 336377 - RNA, 64 nt, hsa
gaaacagacccagacagacagacagacacagccugaaacagacccggacagacagacagacaca

SEQ ID NO: 336378 - RNA, 64 nt, hsa
gaaacagacccggacagacagacagacacagccugaaacagacccggacagacagacagacaca

SEQ ID NO: 336379 - RNA, 64 nt, hsa; identical to SEQ ID NO: 336378

SEQ ID NO: 336380 - RNA, 64 nt, hsa
gaaacagacccggacagacagacagacacagccugaaacagaccuagacagacagacacagauu

SEQ ID NO: 336381 - RNA, 64 nt, hsa
gccugaaacagaccuagacagacagacacagauugaaacagacccagacaaacagacagacaca

SEQ ID NO: 336382 - RNA, 64 nt, hsa
gaaacagacccagacaaacagacagacacagccugaaacagacccagacacagccugaaacaga

SEQ ID NO: 336383 - RNA, 64 nt, hsa
cagacacagccugaaacagacccagacacagccugaaacagacccggacagacagacagacaca

SEQ ID NO: 336384 - RNA, 64 nt, hsa
gaaacagacccggacagacagacagacacagccugaaacagacccagacagacagacagacaca

SEQ ID NO: 336385 - RNA, 64 nt, hsa
gaaacagacccagacagacagacagacacagccugaaacagacccagacagacagaccgacgca

SEQ ID NO: 336386 - RNA, 64 nt, hsa
aaaacagaccuggacagacaggcagacguagucugaaacagaccugaacagacagacagacgca

SEQ ID NO: 336387 - RNA, 64 nt, hsa
cgccugcuuuagagacacaggaugauucagaccggaaacagaccucguggguguaagaggaagc

SEQ ID NO: 336388 - RNA, 64 nt, hsa
gugaauacgggauugcacuuacucuuucaucacggaaacagaccccccgagagaagccccaacg

SEQ ID NO: 336389 - RNA, 64 nt, hsa
gcuuucagccaugggguugaguuggccauuaaaagaaacagagacuucucucugccauggcccu

SEQ ID NO: 336390 - RNA, 64 nt, hsa
cucgacaucuugaauugcugguagaguaugugaggaaacagauacaguaccuggacuccaugaa

SEQ ID NO: 336391 - RNA, 64 nt, hsa
uuauauuaauuuuauuaagcaaggguucgccagagaaacagaaccaauaggauauauaagccca

SEQ ID NO: 336392 - RNA, 64 nt, hsa
agacaguauuauuacauucaguauuacaauggcagaaacagacagaaaggguggaguaauuugu

SEQ ID NO: 336393 - RNA, 64 nt, hsa
uuaguauuuguaucuucaguucauuccacuuuaggaaacagagcugccaauugaaacagaagaa

SEQ ID NO: 336394 - RNA, 64 nt, hsa
guucauuccacuuuaggaaacagagcugccaauugaaacagaagaagaaaaaaaaaaaaagcag

SEQ ID NO: 336395 - RNA, 64 nt, hsa
gauuuuauuucaccuuuaguuuugggaaaagcgagaaacagaugaucuauaggaugugaguggg

SEQ ID NO: 336396 - RNA, 64 nt, hsa
auaaaaaaaaagauguuaaaacagugaaauuacagaaacagaacauagccacccuguuucauca

SEQ ID NO: 336397 - RNA, 64 nt, hsa; identical to SEQ ID NO: 169446

SEQ ID NO: 336398 - RNA, 64 nt, hsa; identical to SEQ ID NO: 169447

SEQ ID NO: 336399 - RNA, 64 nt, hsa; identical to SEQ ID NO: 169448

SEQ ID NO: 336400 - RNA, 64 nt, hsa; identical to SEQ ID NO: 169449

SEQ ID NO: 336401 - RNA, 64 nt, hsa; identical to SEQ ID NO: 169450

SEQ ID NO: 336402 - RNA, 64 nt, hsa; identical to SEQ ID NO: 169451

SEQ ID NO: 336403 - RNA, 64 nt, hsa; identical to SEQ ID NO: 169452

SEQ ID NO: 336404 - RNA, 64 nt, hsa; identical to SEQ ID NO: 169453

SEQ ID NO: 336405 - RNA, 64 nt, hsa; identical to SEQ ID NO: 169454

SEQ ID NO: 336406 - RNA, 64 nt, hsa; identical to SEQ ID NO: 169455

SEQ ID NO: 336407 - RNA, 64 nt, hsa; identical to SEQ ID NO: 38325

SEQ ID NO: 336408 - RNA, 64 nt, hsa; identical to SEQ ID NO: 38326

SEQ ID NO: 336409 - RNA, 64 nt, hsa; identical to SEQ ID NO: 38327

SEQ ID NO: 336410 - RNA, 64 nt, hsa; identical to SEQ ID NO: 38328

SEQ ID NO: 336411 - RNA, 64 nt, hsa; identical to SEQ ID NO: 38329

SEQ ID NO: 336412 - RNA, 64 nt, hsa; identical to SEQ ID NO: 38330

SEQ ID NO: 336413 - RNA, 64 nt, hsa; identical to SEQ ID NO: 38331

SEQ ID NO: 336414 - RNA, 64 nt, hsa; identical to SEQ ID NO: 38332

SEQ ID NO: 336415 - RNA, 64 nt, hsa; identical to SEQ ID NO: 38333

SEQ ID NO: 336416 - RNA, 64 nt, hsa; identical to SEQ ID NO: 38334

SEQ ID NO: 336417 - RNA, 64 nt, hsa; identical to SEQ ID NO: 38335

SEQ ID NO: 336418 - RNA, 64 nt, hsa; identical to SEQ ID NO: 38336

SEQ ID NO: 336419 - RNA, 64 nt, hsa; identical to SEQ ID NO: 38337

SEQ ID NO: 336420 - RNA, 64 nt, hsa; identical to SEQ ID NO: 38338

SEQ ID NO: 336421 - RNA, 64 nt, hsa; identical to SEQ ID NO: 38339

SEQ ID NO: 336422 - RNA, 64 nt, hsa; identical to SEQ ID NO: 38340

SEQ ID NO: 336423 - RNA, 64 nt, hsa; identical to SEQ ID NO: 38341

SEQ ID NO: 336424 - RNA, 64 nt, hsa; identical to SEQ ID NO: 38342

SEQ ID NO: 336425 - RNA, 64 nt, hsa; identical to SEQ ID NO: 38343

SEQ ID NO: 336426 - RNA, 64 nt, hsa; identical to SEQ ID NO: 38344

SEQ ID NO: 336427 - RNA, 64 nt, hsa; identical to SEQ ID NO: 38345

SEQ ID NO: 336428 - RNA, 64 nt, hsa; identical to SEQ ID NO: 38346

SEQ ID NO: 336429 - RNA, 64 nt, hsa; identical to SEQ ID NO: 38347

SEQ ID NO: 336430 - RNA, 64 nt, hsa; identical to SEQ ID NO: 38348

SEQ ID NO: 336431 - RNA, 64 nt, hsa; identical to SEQ ID NO: 38349

SEQ ID NO: 336432 - RNA, 64 nt, hsa; identical to SEQ ID NO: 38350

SEQ ID NO: 336433 - RNA, 64 nt, hsa; identical to SEQ ID NO: 38351

SEQ ID NO: 336434 - RNA, 64 nt, hsa; identical to SEQ ID NO: 38352

SEQ ID NO: 336435 - RNA, 64 nt, hsa; identical to SEQ ID NO: 38353

SEQ ID NO: 336436 - RNA, 64 nt, hsa; identical to SEQ ID NO: 38354

SEQ ID NO: 336437 - RNA, 64 nt, hsa; identical to SEQ ID NO: 38355

SEQ ID NO: 336438 - RNA, 64 nt, hsa; identical to SEQ ID NO: 38356

SEQ ID NO: 336439 - RNA, 64 nt, hsa; identical to SEQ ID NO: 38357

SEQ ID NO: 336440 - RNA, 64 nt, hsa; identical to SEQ ID NO: 38358

SEQ ID NO: 336441 - RNA, 64 nt, hsa; identical to SEQ ID NO: 38359

SEQ ID NO: 336442 - RNA, 64 nt, hsa; identical to SEQ ID NO: 38360

SEQ ID NO: 336443 - RNA, 64 nt, hsa; identical to SEQ ID NO: 38361

SEQ ID NO: 336444 - RNA, 64 nt, hsa; identical to SEQ ID NO: 38362

SEQ ID NO: 336445 - RNA, 64 nt, hsa; identical to SEQ ID NO: 38363

SEQ ID NO: 336446 - RNA, 64 nt, hsa; identical to SEQ ID NO: 38364

SEQ ID NO: 336447 - RNA, 64 nt, hsa; identical to SEQ ID NO: 38365

SEQ ID NO: 336448 - RNA, 64 nt, hsa; identical to SEQ ID NO: 38366

SEQ ID NO: 336449 - RNA, 64 nt, hsa; identical to SEQ ID NO: 38367

SEQ ID NO: 336450 - RNA, 64 nt, hsa; identical to SEQ ID NO: 38368

SEQ ID NO: 336451 - RNA, 64 nt, hsa; identical to SEQ ID NO: 38369

SEQ ID NO: 336452 - RNA, 64 nt, hsa; identical to SEQ ID NO: 38370

SEQ ID NO: 336453 - RNA, 64 nt, hsa; identical to SEQ ID NO: 38371

SEQ ID NO: 336454 - RNA, 64 nt, hsa; identical to SEQ ID NO: 38372

SEQ ID NO: 336455 - RNA, 64 nt, hsa; identical to SEQ ID NO: 38373

SEQ ID NO: 336456 - RNA, 64 nt, hsa; identical to SEQ ID NO: 38374

SEQ ID NO: 336457 - RNA, 64 nt, hsa; identical to SEQ ID NO: 38375

SEQ ID NO: 336458 - RNA, 64 nt, hsa; identical to SEQ ID NO: 38376

SEQ ID NO: 336459 - RNA, 64 nt, hsa; identical to SEQ ID NO: 38377

SEQ ID NO: 336460 - RNA, 64 nt, hsa; identical to SEQ ID NO: 38378

SEQ ID NO: 336461 - RNA, 64 nt, hsa; identical to SEQ ID NO: 38379

SEQ ID NO: 336462 - RNA, 64 nt, hsa; identical to SEQ ID NO: 38380

SEQ ID NO: 336463 - RNA, 64 nt, hsa; identical to SEQ ID NO: 38381

SEQ ID NO: 336464 - RNA, 64 nt, hsa; identical to SEQ ID NO: 38382

SEQ ID NO: 336465 - RNA, 64 nt, hsa; identical to SEQ ID NO: 38383

SEQ ID NO: 336466 - RNA, 64 nt, hsa; identical to SEQ ID NO: 38384

SEQ ID NO: 336467 - RNA, 64 nt, hsa; identical to SEQ ID NO: 153734

SEQ ID NO: 336468 - RNA, 64 nt, hsa; identical to SEQ ID NO: 153735

SEQ ID NO: 336469 - RNA, 64 nt, hsa; identical to SEQ ID NO: 153736

SEQ ID NO: 336470 - RNA, 64 nt, hsa; identical to SEQ ID NO: 153737

SEQ ID NO: 336471 - RNA, 64 nt, hsa; identical to SEQ ID NO: 153738

SEQ ID NO: 336472 - RNA, 64 nt, hsa; identical to SEQ ID NO: 153739

SEQ ID NO: 336473 - RNA, 64 nt, hsa; identical to SEQ ID NO: 153740

SEQ ID NO: 336474 - RNA, 64 nt, hsa; identical to SEQ ID NO: 153741

SEQ ID NO: 336475 - RNA, 64 nt, hsa; identical to SEQ ID NO: 153742

SEQ ID NO: 336476 - RNA, 64 nt, hsa; identical to SEQ ID NO: 153743

SEQ ID NO: 336477 - RNA, 64 nt, hsa; identical to SEQ ID NO: 153744

SEQ ID NO: 336478 - RNA, 64 nt, hsa; identical to SEQ ID NO: 153745

SEQ ID NO: 336479 - RNA, 64 nt, hsa; identical to SEQ ID NO: 153746

SEQ ID NO: 336480 - RNA, 64 nt, hsa; identical to SEQ ID NO: 153747

SEQ ID NO: 336481 - RNA, 64 nt, hsa; identical to SEQ ID NO: 153748

SEQ ID NO: 336482 - RNA, 64 nt, hsa; identical to SEQ ID NO: 153749

SEQ ID NO: 336483 - RNA, 64 nt, hsa; identical to SEQ ID NO: 153750

SEQ ID NO: 336484 - RNA, 64 nt, hsa; identical to SEQ ID NO: 153751

SEQ ID NO: 336485 - RNA, 64 nt, hsa; identical to SEQ ID NO: 153752

SEQ ID NO: 336486 - RNA, 64 nt, hsa; identical to SEQ ID NO: 153753

SEQ ID NO: 336487 - RNA, 64 nt, hsa; identical to SEQ ID NO: 153754

SEQ ID NO: 336488 - RNA, 64 nt, hsa; identical to SEQ ID NO: 153755

SEQ ID NO: 336489 - RNA, 64 nt, hsa; identical to SEQ ID NO: 153756

SEQ ID NO: 336490 - RNA, 64 nt, hsa; identical to SEQ ID NO: 153757

SEQ ID NO: 336491 - RNA, 64 nt, hsa; identical to SEQ ID NO: 153758

SEQ ID NO: 336492 - RNA, 64 nt, hsa; identical to SEQ ID NO: 153759

SEQ ID NO: 336493 - RNA, 64 nt, hsa; identical to SEQ ID NO: 153760

SEQ ID NO: 336494 - RNA, 64 nt, hsa; identical to SEQ ID NO: 153761

SEQ ID NO: 336495 - RNA, 64 nt, hsa; identical to SEQ ID NO: 153762

SEQ ID NO: 336496 - RNA, 64 nt, hsa; identical to SEQ ID NO: 153763

SEQ ID NO: 336497 - RNA, 64 nt, hsa; identical to SEQ ID NO: 153764

SEQ ID NO: 336498 - RNA, 64 nt, hsa; identical to SEQ ID NO: 153765

SEQ ID NO: 336499 - RNA, 64 nt, hsa; identical to SEQ ID NO: 153766

SEQ ID NO: 336500 - RNA, 64 nt, hsa; identical to SEQ ID NO: 153767

SEQ ID NO: 336501 - RNA, 64 nt, hsa; identical to SEQ ID NO: 153768

SEQ ID NO: 336502 - RNA, 64 nt, hsa; identical to SEQ ID NO: 153769

SEQ ID NO: 336503 - RNA, 64 nt, hsa; identical to SEQ ID NO: 153770

SEQ ID NO: 336504 - RNA, 64 nt, hsa; identical to SEQ ID NO: 153771

SEQ ID NO: 336505 - RNA, 64 nt, hsa; identical to SEQ ID NO: 153772

SEQ ID NO: 336506 - RNA, 64 nt, hsa; identical to SEQ ID NO: 153773

SEQ ID NO: 336507 - RNA, 64 nt, hsa; identical to SEQ ID NO: 153774

SEQ ID NO: 336508 - RNA, 64 nt, hsa; identical to SEQ ID NO: 153775

SEQ ID NO: 336509 - RNA, 64 nt, hsa; identical to SEQ ID NO: 153776

SEQ ID NO: 336510 - RNA, 64 nt, hsa; identical to SEQ ID NO: 153777

SEQ ID NO: 336511 - RNA, 64 nt, hsa; identical to SEQ ID NO: 153778

SEQ ID NO: 336512 - RNA, 64 nt, hsa; identical to SEQ ID NO: 153779

SEQ ID NO: 336513 - RNA, 64 nt, hsa; identical to SEQ ID NO: 153780

SEQ ID NO: 336514 - RNA, 64 nt, hsa; identical to SEQ ID NO: 153781

SEQ ID NO: 336515 - RNA, 64 nt, hsa; identical to SEQ ID NO: 153782

SEQ ID NO: 336516 - RNA, 64 nt, hsa; identical to SEQ ID NO: 153783

SEQ ID NO: 336517 - RNA, 64 nt, hsa; identical to SEQ ID NO: 153784

SEQ ID NO: 336518 - RNA, 64 nt, hsa; identical to SEQ ID NO: 153785

SEQ ID NO: 336519 - RNA, 64 nt, hsa; identical to SEQ ID NO: 153786

SEQ ID NO: 336520 - RNA, 64 nt, hsa; identical to SEQ ID NO: 153787

SEQ ID NO: 336521 - RNA, 64 nt, hsa; identical to SEQ ID NO: 153788

SEQ ID NO: 336522 - RNA, 64 nt, hsa; identical to SEQ ID NO: 153789

SEQ ID NO: 336523 - RNA, 64 nt, hsa; identical to SEQ ID NO: 153790

SEQ ID NO: 336524 - RNA, 64 nt, hsa; identical to SEQ ID NO: 153791

SEQ ID NO: 336525 - RNA, 64 nt, hsa; identical to SEQ ID NO: 153792

SEQ ID NO: 336526 - RNA, 64 nt, hsa; identical to SEQ ID NO: 153793

SEQ ID NO: 336527 - RNA, 64 nt, hsa; identical to SEQ ID NO: 153794

SEQ ID NO: 336528 - RNA, 64 nt, hsa; identical to SEQ ID NO: 153795

SEQ ID NO: 336529 - RNA, 64 nt, hsa; identical to SEQ ID NO: 153796

SEQ ID NO: 336530 - RNA, 64 nt, hsa; identical to SEQ ID NO: 153797

SEQ ID NO: 336531 - RNA, 64 nt, hsa; identical to SEQ ID NO: 153798

SEQ ID NO: 336532 - RNA, 64 nt, hsa; identical to SEQ ID NO: 153799

SEQ ID NO: 336533 - RNA, 64 nt, hsa; identical to SEQ ID NO: 153800

SEQ ID NO: 336534 - RNA, 64 nt, hsa; identical to SEQ ID NO: 153801

SEQ ID NO: 336535 - RNA, 64 nt, hsa; identical to SEQ ID NO: 153802

SEQ ID NO: 336536 - RNA, 64 nt, hsa; identical to SEQ ID NO: 153803

SEQ ID NO: 336537 - RNA, 64 nt, hsa; identical to SEQ ID NO: 153804

SEQ ID NO: 336538 - RNA, 64 nt, hsa; identical to SEQ ID NO: 153805

SEQ ID NO: 336539 - RNA, 64 nt, hsa; identical to SEQ ID NO: 153806

SEQ ID NO: 336540 - RNA, 64 nt, hsa; identical to SEQ ID NO: 153807

SEQ ID NO: 336541 - RNA, 64 nt, hsa; identical to SEQ ID NO: 153808

SEQ ID NO: 336542 - RNA, 64 nt, hsa; identical to SEQ ID NO: 153809

SEQ ID NO: 336543 - RNA, 64 nt, hsa; identical to SEQ ID NO: 153810

SEQ ID NO: 336544 - RNA, 64 nt, hsa; identical to SEQ ID NO: 153811

SEQ ID NO: 336545 - RNA, 64 nt, hsa; identical to SEQ ID NO: 153812

SEQ ID NO: 336546 - RNA, 64 nt, hsa; identical to SEQ ID NO: 153813

SEQ ID NO: 336547 - RNA, 64 nt, hsa; identical to SEQ ID NO: 153814

SEQ ID NO: 336548 - RNA, 64 nt, hsa; identical to SEQ ID NO: 153815

SEQ ID NO: 336549 - RNA, 64 nt, hsa; identical to SEQ ID NO: 153816

SEQ ID NO: 336550 - RNA, 64 nt, hsa; identical to SEQ ID NO: 153817

SEQ ID NO: 336551 - RNA, 64 nt, hsa; identical to SEQ ID NO: 153818

SEQ ID NO: 336552 - RNA, 64 nt, hsa; identical to SEQ ID NO: 153819

SEQ ID NO: 336553 - RNA, 64 nt, hsa; identical to SEQ ID NO: 153820

SEQ ID NO: 336554 - RNA, 64 nt, hsa; identical to SEQ ID NO: 153821

SEQ ID NO: 336555 - RNA, 64 nt, hsa; identical to SEQ ID NO: 153822

SEQ ID NO: 336556 - RNA, 64 nt, hsa; identical to SEQ ID NO: 153823

SEQ ID NO: 336557 - RNA, 64 nt, hsa; identical to SEQ ID NO: 153824

SEQ ID NO: 336558 - RNA, 64 nt, hsa; identical to SEQ ID NO: 153825

SEQ ID NO: 336559 - RNA, 64 nt, hsa; identical to SEQ ID NO: 153826

SEQ ID NO: 336560 - RNA, 64 nt, hsa; identical to SEQ ID NO: 153827

SEQ ID NO: 336561 - RNA, 64 nt, hsa; identical to SEQ ID NO: 153828

SEQ ID NO: 336562 - RNA, 64 nt, hsa; identical to SEQ ID NO: 153829

SEQ ID NO: 336563 - RNA, 64 nt, hsa; identical to SEQ ID NO: 153830

SEQ ID NO: 336564 - RNA, 64 nt, hsa; identical to SEQ ID NO: 153831

SEQ ID NO: 336565 - RNA, 64 nt, hsa; identical to SEQ ID NO: 153832

SEQ ID NO: 336566 - RNA, 64 nt, hsa; identical to SEQ ID NO: 153833

SEQ ID NO: 336567 - RNA, 64 nt, hsa; identical to SEQ ID NO: 153834

SEQ ID NO: 336568 - RNA, 64 nt, hsa; identical to SEQ ID NO: 153835

SEQ ID NO: 336569 - RNA, 64 nt, hsa; identical to SEQ ID NO: 153836

SEQ ID NO: 336570 - RNA, 64 nt, hsa; identical to SEQ ID NO: 153837

SEQ ID NO: 336571 - RNA, 64 nt, hsa; identical to SEQ ID NO: 153838

SEQ ID NO: 336572 - RNA, 64 nt, hsa; identical to SEQ ID NO: 153839

SEQ ID NO: 336573 - RNA, 64 nt, hsa; identical to SEQ ID NO: 153840

SEQ ID NO: 336574 - RNA, 64 nt, hsa; identical to SEQ ID NO: 153841

SEQ ID NO: 336575 - RNA, 64 nt, hsa; identical to SEQ ID NO: 153842

SEQ ID NO: 336576 - RNA, 64 nt, hsa; identical to SEQ ID NO: 153843

SEQ ID NO: 336577 - RNA, 64 nt, hsa; identical to SEQ ID NO: 153844

SEQ ID NO: 336578 - RNA, 64 nt, hsa; identical to SEQ ID NO: 153845

SEQ ID NO: 336579 - RNA, 64 nt, hsa; identical to SEQ ID NO: 153846

SEQ ID NO: 336580 - RNA, 64 nt, hsa; identical to SEQ ID NO: 108382

SEQ ID NO: 336581 - RNA, 64 nt, hsa; identical to SEQ ID NO: 108383

SEQ ID NO: 336582 - RNA, 64 nt, hsa; identical to SEQ ID NO: 108384

SEQ ID NO: 336583 - RNA, 64 nt, hsa; identical to SEQ ID NO: 108385

SEQ ID NO: 336584 - RNA, 64 nt, hsa; identical to SEQ ID NO: 108386

SEQ ID NO: 336585 - RNA, 64 nt, hsa; identical to SEQ ID NO: 108387

SEQ ID NO: 336586 - RNA, 64 nt, hsa; identical to SEQ ID NO: 108388

SEQ ID NO: 336587 - RNA, 64 nt, hsa; identical to SEQ ID NO: 108389

SEQ ID NO: 336588 - RNA, 64 nt, hsa; identical to SEQ ID NO: 108390

SEQ ID NO: 336589 - RNA, 64 nt, hsa; identical to SEQ ID NO: 108391

SEQ ID NO: 336590 - RNA, 64 nt, hsa; identical to SEQ ID NO: 108392

SEQ ID NO: 336591 - RNA, 64 nt, hsa; identical to SEQ ID NO: 108393

SEQ ID NO: 336592 - RNA, 64 nt, hsa; identical to SEQ ID NO: 108394

SEQ ID NO: 336593 - RNA, 64 nt, hsa; identical to SEQ ID NO: 108395

SEQ ID NO: 336594 - RNA, 63 nt, hsa
uugagaaucgggaaaacuagaccccugccacuaacaggcuaggagacuuugggcaguaauggg

SEQ ID NO: 336595 - RNA, 63 nt, hsa
ugaaugguuggccugcauauucuuuuuuaggccacaggcuacagcugagcaauggcuuagucu

SEQ ID NO: 336596 - RNA, 64 nt, hsa; identical to SEQ ID NO: 239676

SEQ ID NO: 336597 - RNA, 64 nt, hsa; identical to SEQ ID NO: 239677

SEQ ID NO: 336598 - RNA, 64 nt, hsa; identical to SEQ ID NO: 239678

SEQ ID NO: 336599 - RNA, 64 nt, hsa; identical to SEQ ID NO: 239679

SEQ ID NO: 336600 - RNA, 64 nt, hsa; identical to SEQ ID NO: 239680

SEQ ID NO: 336601 - RNA, 64 nt, hsa; identical to SEQ ID NO: 239681

SEQ ID NO: 336602 - RNA, 64 nt, hsa; identical to SEQ ID NO: 239682

SEQ ID NO: 336603 - RNA, 64 nt, hsa; identical to SEQ ID NO: 239683

SEQ ID NO: 336604 - RNA, 64 nt, hsa; identical to SEQ ID NO: 239684

SEQ ID NO: 336605 - RNA, 64 nt, hsa; identical to SEQ ID NO: 239685

SEQ ID NO: 336606 - RNA, 64 nt, hsa; identical to SEQ ID NO: 239686

SEQ ID NO: 336607 - RNA, 64 nt, hsa; identical to SEQ ID NO: 239687

SEQ ID NO: 336608 - RNA, 64 nt, hsa; identical to SEQ ID NO: 239688

SEQ ID NO: 336609 - RNA, 64 nt, hsa; identical to SEQ ID NO: 239689

SEQ ID NO: 336610 - RNA, 64 nt, hsa; identical to SEQ ID NO: 239690

SEQ ID NO: 336611 - RNA, 64 nt, hsa; identical to SEQ ID NO: 239691

SEQ ID NO: 336612 - RNA, 64 nt, hsa; identical to SEQ ID NO: 239692

SEQ ID NO: 336613 - RNA, 64 nt, hsa; identical to SEQ ID NO: 239693

SEQ ID NO: 336614 - RNA, 64 nt, hsa; identical to SEQ ID NO: 239694

SEQ ID NO: 336615 - RNA, 64 nt, hsa; identical to SEQ ID NO: 239695

SEQ ID NO: 336616 - RNA, 64 nt, hsa; identical to SEQ ID NO: 239696

SEQ ID NO: 336617 - RNA, 64 nt, hsa; identical to SEQ ID NO: 239697

SEQ ID NO: 336618 - RNA, 64 nt, hsa; identical to SEQ ID NO: 239698

SEQ ID NO: 336619 - RNA, 64 nt, hsa; identical to SEQ ID NO: 239699

SEQ ID NO: 336620 - RNA, 64 nt, hsa; identical to SEQ ID NO: 239700

SEQ ID NO: 336621 - RNA, 64 nt, hsa; identical to SEQ ID NO: 239701

SEQ ID NO: 336622 - RNA, 64 nt, hsa; identical to SEQ ID NO: 239702

SEQ ID NO: 336623 - RNA, 64 nt, hsa; identical to SEQ ID NO: 239703

SEQ ID NO: 336624 - RNA, 64 nt, hsa; identical to SEQ ID NO: 239704

SEQ ID NO: 336625 - RNA, 64 nt, hsa; identical to SEQ ID NO: 239705

SEQ ID NO: 336626 - RNA, 64 nt, hsa; identical to SEQ ID NO: 239706

SEQ ID NO: 336627 - RNA, 64 nt, hsa; identical to SEQ ID NO: 239707

SEQ ID NO: 336628 - RNA, 64 nt, hsa; identical to SEQ ID NO: 239708

SEQ ID NO: 336629 - RNA, 64 nt, hsa; identical to SEQ ID NO: 239709

SEQ ID NO: 336630 - RNA, 64 nt, hsa; identical to SEQ ID NO: 239710

SEQ ID NO: 336631 - RNA, 64 nt, hsa; identical to SEQ ID NO: 239711

SEQ ID NO: 336632 - RNA, 64 nt, hsa; identical to SEQ ID NO: 239712

SEQ ID NO: 336633 - RNA, 64 nt, hsa; identical to SEQ ID NO: 239713

SEQ ID NO: 336634 - RNA, 64 nt, hsa; identical to SEQ ID NO: 239714

SEQ ID NO: 336635 - RNA, 64 nt, hsa; identical to SEQ ID NO: 239715

SEQ ID NO: 336636 - RNA, 64 nt, hsa; identical to SEQ ID NO: 239716

SEQ ID NO: 336637 - RNA, 64 nt, hsa; identical to SEQ ID NO: 239717

SEQ ID NO: 336638 - RNA, 64 nt, hsa; identical to SEQ ID NO: 239718

SEQ ID NO: 336639 - RNA, 64 nt, hsa; identical to SEQ ID NO: 239719

SEQ ID NO: 336640 - RNA, 64 nt, hsa; identical to SEQ ID NO: 239720

SEQ ID NO: 336641 - RNA, 64 nt, hsa; identical to SEQ ID NO: 239721

SEQ ID NO: 336642 - RNA, 64 nt, hsa; identical to SEQ ID NO: 239722

SEQ ID NO: 336643 - RNA, 64 nt, hsa; identical to SEQ ID NO: 239723

SEQ ID NO: 336644 - RNA, 64 nt, hsa; identical to SEQ ID NO: 239724

SEQ ID NO: 336645 - RNA, 64 nt, hsa; identical to SEQ ID NO: 239725

SEQ ID NO: 336646 - RNA, 64 nt, hsa; identical to SEQ ID NO: 239726

SEQ ID NO: 336647 - RNA, 64 nt, hsa; identical to SEQ ID NO: 239727

SEQ ID NO: 336648 - RNA, 64 nt, hsa; identical to SEQ ID NO: 239728

SEQ ID NO: 336649 - RNA, 64 nt, hsa; identical to SEQ ID NO: 239729

SEQ ID NO: 336650 - RNA, 64 nt, hsa; identical to SEQ ID NO: 239730

SEQ ID NO: 336651 - RNA, 64 nt, hsa; identical to SEQ ID NO: 239731

SEQ ID NO: 336652 - RNA, 64 nt, hsa; identical to SEQ ID NO: 239732

SEQ ID NO: 336653 - RNA, 64 nt, hsa; identical to SEQ ID NO: 239733

SEQ ID NO: 336654 - RNA, 64 nt, hsa; identical to SEQ ID NO: 239734

SEQ ID NO: 336655 - RNA, 64 nt, hsa; identical to SEQ ID NO: 239735

SEQ ID NO: 336656 - RNA, 64 nt, hsa; identical to SEQ ID NO: 239736

SEQ ID NO: 336657 - RNA, 64 nt, hsa; identical to SEQ ID NO: 239737

SEQ ID NO: 336658 - RNA, 64 nt, hsa; identical to SEQ ID NO: 239738

SEQ ID NO: 336659 - RNA, 64 nt, hsa; identical to SEQ ID NO: 239739

SEQ ID NO: 336660 - RNA, 64 nt, hsa; identical to SEQ ID NO: 239740

SEQ ID NO: 336661 - RNA, 64 nt, hsa; identical to SEQ ID NO: 239741

SEQ ID NO: 336662 - RNA, 64 nt, hsa; identical to SEQ ID NO: 239742

SEQ ID NO: 336663 - RNA, 64 nt, hsa; identical to SEQ ID NO: 239743

SEQ ID NO: 336664 - RNA, 64 nt, hsa; identical to SEQ ID NO: 239744

SEQ ID NO: 336665 - RNA, 64 nt, hsa; identical to SEQ ID NO: 239745

SEQ ID NO: 336666 - RNA, 64 nt, hsa; identical to SEQ ID NO: 239746

SEQ ID NO: 336667 - RNA, 62 nt, hsa
ugacagaccaggucaucuggcuuccgagaucaucagagaagauaagucugucucuuucagcu

SEQ ID NO: 336668 - RNA, 62 nt, hsa
uaaaaggcaggaaagagaauucuuaggcaaauucagagaaauaagugcuaguuaauacuaau

SEQ ID NO: 336669 - RNA, 62 nt, hsa
ccauagcuaugauguaaagacaauacuguccuucagagaacugguauuaagauaaacuuaag

SEQ ID NO: 336670 - RNA, 62 nt, hsa
aacaucccuaaaaacucagucucuucuaguucucagagaaggguuucaucuucuaagauauc

SEQ ID NO: 336671 - RNA, 62 nt, hsa
aagcagugucuuugaucugcaacagcaaauccucagagaaaaagauucugggguuacuugac

SEQ ID NO: 336672 - RNA, 62 nt, hsa
agugaauaucaucaaaaccacagcauccuugaucagagaagggggagguucacauguuugca

SEQ ID NO: 336673 - RNA, 62 nt, hsa
cugcuacaugucuaaguuuacuuguauuuauuucagagaagaacucuaagauguugcuuugc

SEQ ID NO: 336674 - RNA, 62 nt, hsa
uuucucauaaaauucugucaauucacugaauaucagagaauacugacaucuucaaccuagca

SEQ ID NO: 336675 - RNA, 62 nt, hsa
gguucaaaugucuuacagaacuaagaucuuuuucagagaaauugcucacaaaaguuagugac

SEQ ID NO: 336676 - RNA, 62 nt, hsa
cuuaaacuugugauaaggaagaugaagggucuucagagaagaaccucuuaaaaggcccacgg

SEQ ID NO: 336677 - RNA, 62 nt, hsa
uaagcaaugaagauugagacaauaaauagcacucagagaaugaagcauugauguuacaucag

SEQ ID NO: 336678 - RNA, 62 nt, hsa
aguggauguuccgccugguuagcugguucucuucagagaauauaaagugaaugccuuuaggg

SEQ ID NO: 336679 - RNA, 62 nt, hsa
uuaaaaucccuuaggaauuugguauucacaucucagagaacuacaacacaaaagugcagacu

SEQ ID NO: 336680 - RNA, 62 nt, hsa
acaugcugaaaaagaguaucuaugcauaaguaucagagaagucccucaagcaaucaguaggu

SEQ ID NO: 336681 - RNA, 62 nt, hsa
aaaaagcuucuaacaaaacucugacuuacccaucagagaagccauacuggugaaaaauugua

SEQ ID NO: 336682 - RNA, 62 nt, hsa
cuguaauaccaauauuaaaaauuauuuauguaucagagaacucauuaagaugaggacaaauc

SEQ ID NO: 336683 - RNA, 62 nt, hsa
uuaagguugucuuucuagugaggagauacauaucagagaacauuuguacaauuccccaugaa

SEQ ID NO: 336684 - RNA, 62 nt, hsa
gaaauauaucagcccauguuagacagaagaagucagagaagugaagagagauguguggaaau

SEQ ID NO: 336685 - RNA, 62 nt, hsa
auuuuccaucagagcucagcccuuacuagacaucagagaauccauacuagagagaagcccua

SEQ ID NO: 336686 - RNA, 62 nt, hsa
guuggccuauauuaaacaacaaggaauucauuucagagaaaagcccuauacguguagugaau

SEQ ID NO: 336687 - RNA, 62 nt, hsa
aaagcaggauuuaaccucuaguucucuuguucucagagaacagcagguugauaguagauuau

SEQ ID NO: 336688 - RNA, 62 nt, hsa
uuucuuagccccagcuuuaaaagcuagagaucucagagaaauagcuggcuuaacaaugacag

SEQ ID NO: 336689 - RNA, 62 nt, hsa
cagaaauuagaagcauaguaagauugccaaaaucagagaaucuugcaaaguucuguaauucu

SEQ ID NO: 336690 - RNA, 62 nt, hsa
cuuucccuugagguuaggaaacagguuaaaacucagagaacuccaauaauaaugguuuaaaa

SEQ ID NO: 336691 - RNA, 62 nt, hsa
uugauccucuguucuggaagcuuugaaauuuaucagagaaugaagucauucaguacaucuga

SEQ ID NO: 336692 - RNA, 62 nt, hsa
uuuaauugggcaacccucagaacugaagagguucagagaacuuuccagguuuauacuauacc

SEQ ID NO: 336693 - RNA, 62 nt, hsa
aaaccucuaaguuggaaauugaagcuagccacucagagaaacuugaauugcuaaagaaggcc

SEQ ID NO: 336694 - RNA, 62 nt, hsa
uuucucaugauuauucugauugaucaucuccuucagagaacaugugugaguuaauuacuuua

SEQ ID NO: 336695 - RNA, 62 nt, hsa
uuaacaaagucaccuaguuauacaaacaauugucagagaauucuggauuuggaggguauugg

SEQ ID NO: 336696 - RNA, 62 nt, hsa
aguuugcacaguauuauuuuacagaaaaggaaucagagaaucuacaacauagggccccagaa

SEQ ID NO: 336697 - RNA, 62 nt, hsa
ggcuagagagucaaggagaaccucaaauaugaucagagaauuguggaaaagacauccuuuca

SEQ ID NO: 336698 - RNA, 62 nt, hsa
agacagucccagaaguaaacccucacugugaaucagagaauucacauaggaaagaaaccaga

SEQ ID NO: 336699 - RNA, 62 nt, hsa; identical to SEQ ID NO: 336681

SEQ ID NO: 336700 - RNA, 62 nt, hsa; identical to SEQ ID NO: 336682

SEQ ID NO: 336701 - RNA, 62 nt, hsa
uugacaaacuauaaaucaggguuuuaauuuucucagagaaccugcugucaaauauuuacagc

SEQ ID NO: 336702 - RNA, 62 nt, hsa
ugaaauugguuauacaguuucaaaaaaggagaucagagaaagccaaagaaugucagaaauuu

SEQ ID NO: 336703 - RNA, 62 nt, hsa
ggaugacagugaguugcaagaauaguuuuaguucagagaauugucuuaggacaacaggcuaa

SEQ ID NO: 336704 - RNA, 62 nt, hsa
gggagcaaaaacuagaaugauacaaagaaaggucagagaaaugcaugggaauauuuuuuccu

SEQ ID NO: 336705 - RNA, 62 nt, hsa
gccgucuuucugcugguguugucuuucugccaucagagaagggacacacagcccguucgaag

SEQ ID NO: 336706 - RNA, 62 nt, hsa
uaauucaagcccucaucagguuuacaagaucaucagagaaacagaggauuuuaauuuuuagu

SEQ ID NO: 336707 - RNA, 62 nt, hsa
uccuacacacauuccuuccucgguuauuucauucagagaauauuuaugaaaugccuacugug

SEQ ID NO: 336708 - RNA, 62 nt, hsa
uuuugcauuuucuccucuccuuccccacuuacucagagaauuuaaagucuguagagucagca

SEQ ID NO: 336709 - RNA, 62 nt, hsa
gaauuuuuuaaaaagaaguauaaugccuuacuucagagaacucuuggaaagaagccuuaugu

SEQ ID NO: 336710 - RNA, 62 nt, hsa
agagugacuuucugcaauauuucaaaccuauaucagagaauuacacugugggaaaacuacca

SEQ ID NO: 336711 - RNA, 62 nt, hsa
cucaucaucagucuuaauauucagagaaaacuucagagaaauuauguuuucauccauuaaaa

SEQ ID NO: 336712 - RNA, 62 nt, hsa
gaacaaagagagcucaucaucagucuuaauauucagagaaaacuucagagaaauuauguuuu

SEQ ID NO: 336713 - RNA, 62 nt, hsa
uagaauagaggauugcucagcaugaguccaauucagagaacgguguuugagucagcuugucu

SEQ ID NO: 336714 - RNA, 62 nt, hsa
uaaauucauguguuuccacuucucagauauagucagagaauuauucauuugcccaaaaggac

SEQ ID NO: 336715 - RNA, 62 nt, hsa
uucuaaaugagguagaugaauauucugguucuucagagaaaauagacuuacuggccagugau

SEQ ID NO: 336716 - RNA, 62 nt, hsa
gaaaagaauggaauaagcagaaacugccaugcucagagaauccuagagauacugaagauguu

SEQ ID NO: 336717 - RNA, 62 nt, hsa
uauuucacuagaacuguguacuugauugauuuucagagaaauaucacaaauuagaaauauua

SEQ ID NO: 336718 - RNA, 62 nt, hsa
auaugacuggugauacuggcuuuacagaaauuucagagaacuaauuuuuaaaaucuuuagca

SEQ ID NO: 336719 - RNA, 62 nt, hsa
aggccuuugcuuguuuccuaccuuaauagaaaucagagaauucacacuagugagaaaccgua

SEQ ID NO: 336720 - RNA, 62 nt, hsa
gccuucauuuguuuuuuugauuuuaauagacaucagagaauucacaaaggagagaaacccua

SEQ ID NO: 336721 - RNA, 57 nt, hsa
caagcauaaugcacaucuaaugagacaucagagaauucacaguggggagaaacccua

SEQ ID NO: 336722 - RNA, 62 nt, hsa
aacauucaauguagaagacuuuuaggaaaauaucagagaauuuaaugaaggaaagaagccuu

SEQ ID NO: 336723 - RNA, 62 nt, hsa
uuauuuagugaucaguuacuucauguuuugugucagagaaaacauguacaaaacauuugaga

SEQ ID NO: 336724 - RNA, 62 nt, hsa
uccucauuggucgucccuaugaauuguacguuucagagaaauuuuuuuuccuaugugcaaca

SEQ ID NO: 336725 - RNA, 62 nt, hsa
uucguuucaggggucugccguuccauccugguucagagaaggccgagcguggcuuucucuag

SEQ ID NO: 336726 - RNA, 62 nt, hsa
guuacaaguggaauaagccuuacgggugaagcucagagaagggucggaucugagagaauggg

SEQ ID NO: 336727 - RNA, 62 nt, hsa
ugggauggaaggcugucuucuuuugaggaugaucagagaacuugggcauaggaacaaucugg

SEQ ID NO: 336728 - RNA, 64 nt, hsa; identical to SEQ ID NO: 145537

SEQ ID NO: 336729 - RNA, 64 nt, hsa; identical to SEQ ID NO: 145538

SEQ ID NO: 336730 - RNA, 64 nt, hsa; identical to SEQ ID NO: 145539

SEQ ID NO: 336731 - RNA, 64 nt, hsa; identical to SEQ ID NO: 145540

SEQ ID NO: 336732 - RNA, 64 nt, hsa; identical to SEQ ID NO: 145541

SEQ ID NO: 336733 - RNA, 64 nt, hsa; identical to SEQ ID NO: 145542

SEQ ID NO: 336734 - RNA, 64 nt, hsa; identical to SEQ ID NO: 145543

SEQ ID NO: 336735 - RNA, 64 nt, hsa; identical to SEQ ID NO: 145544

SEQ ID NO: 336736 - RNA, 64 nt, hsa; identical to SEQ ID NO: 145545

SEQ ID NO: 336737 - RNA, 64 nt, hsa; identical to SEQ ID NO: 145546

SEQ ID NO: 336738 - RNA, 64 nt, hsa; identical to SEQ ID NO: 145547

SEQ ID NO: 336739 - RNA, 64 nt, hsa; identical to SEQ ID NO: 145548

SEQ ID NO: 336740 - RNA, 64 nt, hsa; identical to SEQ ID NO: 145549

SEQ ID NO: 336741 - RNA, 64 nt, hsa; identical to SEQ ID NO: 145550

SEQ ID NO: 336742 - RNA, 64 nt, hsa; identical to SEQ ID NO: 145551

SEQ ID NO: 336743 - RNA, 64 nt, hsa; identical to SEQ ID NO: 145552

SEQ ID NO: 336744 - RNA, 64 nt, hsa; identical to SEQ ID NO: 145553

SEQ ID NO: 336745 - RNA, 64 nt, hsa; identical to SEQ ID NO: 145554

SEQ ID NO: 336746 - RNA, 64 nt, hsa; identical to SEQ ID NO: 145555

SEQ ID NO: 336747 - RNA, 64 nt, hsa; identical to SEQ ID NO: 145556

SEQ ID NO: 336748 - RNA, 64 nt, hsa; identical to SEQ ID NO: 145557

SEQ ID NO: 336749 - RNA, 64 nt, hsa; identical to SEQ ID NO: 145558

SEQ ID NO: 336750 - RNA, 64 nt, hsa; identical to SEQ ID NO: 145559

SEQ ID NO: 336751 - RNA, 64 nt, hsa; identical to SEQ ID NO: 145560

SEQ ID NO: 336752 - RNA, 64 nt, hsa; identical to SEQ ID NO: 145561

SEQ ID NO: 336753 - RNA, 64 nt, hsa; identical to SEQ ID NO: 145562

SEQ ID NO: 336754 - RNA, 64 nt, hsa; identical to SEQ ID NO: 145563

SEQ ID NO: 336755 - RNA, 64 nt, hsa; identical to SEQ ID NO: 145564

SEQ ID NO: 336756 - RNA, 64 nt, hsa; identical to SEQ ID NO: 145565

SEQ ID NO: 336757 - RNA, 64 nt, hsa; identical to SEQ ID NO: 145566

SEQ ID NO: 336758 - RNA, 64 nt, hsa; identical to SEQ ID NO: 145567

SEQ ID NO: 336759 - RNA, 64 nt, hsa; identical to SEQ ID NO: 145568

SEQ ID NO: 336760 - RNA, 64 nt, hsa; identical to SEQ ID NO: 145569

SEQ ID NO: 336761 - RNA, 64 nt, hsa; identical to SEQ ID NO: 145570

SEQ ID NO: 336762 - RNA, 64 nt, hsa; identical to SEQ ID NO: 145571

SEQ ID NO: 336763 - RNA, 64 nt, hsa; identical to SEQ ID NO: 145572

SEQ ID NO: 336764 - RNA, 64 nt, hsa; identical to SEQ ID NO: 145573

SEQ ID NO: 336765 - RNA, 64 nt, hsa; identical to SEQ ID NO: 145574

SEQ ID NO: 336766 - RNA, 64 nt, hsa; identical to SEQ ID NO: 145575

SEQ ID NO: 336767 - RNA, 64 nt, hsa; identical to SEQ ID NO: 145576

SEQ ID NO: 336768 - RNA, 64 nt, hsa; identical to SEQ ID NO: 145572

SEQ ID NO: 336769 - RNA, 64 nt, hsa; identical to SEQ ID NO: 145578

SEQ ID NO: 336770 - RNA, 64 nt, hsa; identical to SEQ ID NO: 145579

SEQ ID NO: 336771 - RNA, 64 nt, hsa; identical to SEQ ID NO: 145580

SEQ ID NO: 336772 - RNA, 64 nt, hsa; identical to SEQ ID NO: 145581

SEQ ID NO: 336773 - RNA, 64 nt, hsa; identical to SEQ ID NO: 145582

SEQ ID NO: 336774 - RNA, 64 nt, hsa; identical to SEQ ID NO: 145583

SEQ ID NO: 336775 - RNA, 64 nt, hsa; identical to SEQ ID NO: 145584

SEQ ID NO: 336776 - RNA, 64 nt, hsa; identical to SEQ ID NO: 145585

SEQ ID NO: 336777 - RNA, 64 nt, hsa; identical to SEQ ID NO: 145586

SEQ ID NO: 336778 - RNA, 64 nt, hsa; identical to SEQ ID NO: 145587

SEQ ID NO: 336779 - RNA, 64 nt, hsa; identical to SEQ ID NO: 145588

SEQ ID NO: 336780 - RNA, 64 nt, hsa; identical to SEQ ID NO: 145589

SEQ ID NO: 336781 - RNA, 64 nt, hsa; identical to SEQ ID NO: 145590

SEQ ID NO: 336782 - RNA, 64 nt, hsa; identical to SEQ ID NO: 145591

SEQ ID NO: 336783 - RNA, 64 nt, hsa; identical to SEQ ID NO: 145592

SEQ ID NO: 336784 - RNA, 64 nt, hsa; identical to SEQ ID NO: 145593

SEQ ID NO: 336785 - RNA, 64 nt, hsa; identical to SEQ ID NO: 145545

SEQ ID NO: 336786 - RNA, 64 nt, hsa; identical to SEQ ID NO: 145595

SEQ ID NO: 336787 - RNA, 64 nt, hsa; identical to SEQ ID NO: 145596

SEQ ID NO: 336788 - RNA, 64 nt, hsa; identical to SEQ ID NO: 145597

SEQ ID NO: 336789 - RNA, 64 nt, hsa; identical to SEQ ID NO: 145598

SEQ ID NO: 336790 - RNA, 64 nt, hsa; identical to SEQ ID NO: 145599

SEQ ID NO: 336791 - RNA, 64 nt, hsa; identical to SEQ ID NO: 145600

SEQ ID NO: 336792 - RNA, 64 nt, hsa; identical to SEQ ID NO: 145601

SEQ ID NO: 336793 - RNA, 64 nt, hsa; identical to SEQ ID NO: 145602

SEQ ID NO: 336794 - RNA, 64 nt, hsa; identical to SEQ ID NO: 145603

SEQ ID NO: 336795 - RNA, 64 nt, hsa; identical to SEQ ID NO: 145604

SEQ ID NO: 336796 - RNA, 64 nt, hsa; identical to SEQ ID NO: 145605

SEQ ID NO: 336797 - RNA, 64 nt, hsa; identical to SEQ ID NO: 145606

SEQ ID NO: 336798 - RNA, 64 nt, hsa; identical to SEQ ID NO: 145607

SEQ ID NO: 336799 - RNA, 64 nt, hsa; identical to SEQ ID NO: 145608

SEQ ID NO: 336800 - RNA, 64 nt, hsa; identical to SEQ ID NO: 145609

SEQ ID NO: 336801 - RNA, 64 nt, hsa; identical to SEQ ID NO: 145610

SEQ ID NO: 336802 - RNA, 64 nt, hsa; identical to SEQ ID NO: 145611

SEQ ID NO: 336803 - RNA, 64 nt, hsa; identical to SEQ ID NO: 145612

SEQ ID NO: 336804 - RNA, 64 nt, hsa; identical to SEQ ID NO: 145613

SEQ ID NO: 336805 - RNA, 63 nt, hsa
augccuaccaucagcuccugaaucagggauuuucagcacuaccucugagccaugggguuggcu

SEQ ID NO: 336806 - RNA, 63 nt, hsa
aaaauguauagagugugauguccaauugguauucagcacuauaaauguguuuuuaaccucccg

SEQ ID NO: 336807 - RNA, 63 nt, hsa
uggaaaccaucagguacugccugcagacuucuccagcacuaaauauauuuguucccucuauaa

SEQ ID NO: 336808 - RNA, 63 nt, hsa
cauauaaaacuaucagaaguuaguaaaucauaccagcacuaaaaauaagacaauuggaauaua

SEQ ID NO: 336809 - RNA, 63 nt, hsa
ucuuuuccuccagagguggggcugcaccagacucagcacuagcacuccaucagcacuagcacc

SEQ ID NO: 336810 - RNA, 63 nt, hsa
ggggcugcaccagacucagcacuagcacuccaucagcacuagcaccucacuccaucagcacua

SEQ ID NO: 336811 - RNA, 63 nt, hsa
uagcacuccaucagcacuagcaccucacuccaucagcacuagcaccucacuccaucggccccg

SEQ ID NO: 336812 - RNA, 63 nt, hsa
ggcacuaaugccccacucggcgccccacuccaucagcacuaaugcuccacuccauuggcacua

SEQ ID NO: 336813 - RNA, 63 nt, hsa
acccgcuccuuugacauuggugccccacuccaucagcacuaacgcccugcuccaucggcacug

SEQ ID NO: 336814 - RNA, 63 nt, hsa
uggcugcuuggucuuggccacagugcucucagccagcacuaagggcugaggucaauaccgcag

SEQ ID NO: 336815 - RNA, 63 nt, hsa
ugggggaaguggcuccuggcaggagauuucucccagcacuaauauccugguguucuauaaaau

SEQ ID NO: 336816 - RNA, 64 nt, hsa
ucugaucuggaaggagagggauuauguuauagcuugucagcacagucccaaguucaauauuucu

SEQ ID NO: 336817 - RNA, 64 nt, hsa
uuccaaaauggaugucccugaaugaaaaucaaggugucagcagagcugugcuccuucugaaggc

SEQ ID NO: 336818 - RNA, 64 nt, hsa
agguauaaaaggugacucagaguagagaguaagaugucagcaaauagacaauaagaugucagca

SEQ ID NO: 336819 - RNA, 64 nt, hsa
uagagaguaagaugucagcaaauagacaauaagaugucagcaaaagugccucaaauuuuaacug

SEQ ID NO: 336820 - RNA, 64 nt, hsa
cucaggaaacugaaccuuuuucugaaccaagcacugucagcaaaucucagguauuagagcaacu

SEQ ID NO: 336821 - RNA, 64 nt, hsa
uguaaacugaaagaaaaauaguugcuuuuuaaaaugucagcaagaaggccugccucaucuuaac

SEQ ID NO: 336822 - RNA, 64 nt, hsa
aguggagucauacacgaagggcguguggccaucgugucagcagagagagucucuguacacagcc

SEQ ID NO: 336823 - RNA, 64 nt, hsa
aguggagucauacgcgaaggccauauggccaucgugucagcagagagagucucuguacacagcc

SEQ ID NO: 336824 - RNA, 64 nt, hsa
gccgcggggagguaaugaauugucugugguaucaugucagcagagucuccaagccccacgaacc

SEQ ID NO: 336825 - RNA, 64 nt, hsa
caaccuauuuggauacuuggcaaaagauucuugcugucagcauauaaaaugugcuugucauuug

SEQ ID NO: 336826 - RNA, 64 nt, hsa
aucuuuuuacaaauaaaugaaggauuauaaaugaugucagcauuuuaguaaacuuuuagacaaa

SEQ ID NO: 336827 - RNA, 64 nt, hsa
gcuguccgccucagcucccaccguguuugucuggugucagcacgaggcagagcugugugcucca

SEQ ID NO: 336828 - RNA, 64 nt, hsa
aguugagacuugcauguuccucgcaugugucuaaugucagcacuagaaagcaguuuuaggaggu

SEQ ID NO: 336829 - RNA, 64 nt, hsa
aaagucaggauaaaaauuuuaaaaagcaggccacugucagcaaagccuggagaaguggggccgg

SEQ ID NO: 336830 - RNA, 61 nt, hsa
ugaagaucacugucaucuaaaagccggcuacugucagcaaagccugaagaaguggggcugg

SEQ ID NO: 336831 - RNA, 64 nt, hsa
gcucaccuuuuuucuuccccucucuguucgcugcugucagcauaaugauuguguuccuucccua

SEQ ID NO: 336832 - RNA, 64 nt, hsa
cuguggcugaauugagaccuugcugauguauucaugucagcaccugagucacagcccaggugcc

SEQ ID NO: 336833 - RNA, 64 nt, hsa
gcugaaacuaaauuucuuuaauauuuucuauuccugucagcaccuuuucuagcagcugccaguu

SEQ ID NO: 336834 - RNA, 64 nt, hsa
aaaauaaaaucuuuuuauaauauuaucuaugggaugucagcacaauauaacacucugggaagaa

SEQ ID NO: 336835 - RNA, 64 nt, hsa; identical to SEQ ID NO: 48356

SEQ ID NO: 336836 - RNA, 64 nt, hsa; identical to SEQ ID NO: 48357

SEQ ID NO: 336837 - RNA, 64 nt, hsa; identical to SEQ ID NO: 48358

SEQ ID NO: 336838 - RNA, 64 nt, hsa; identical to SEQ ID NO: 48359

SEQ ID NO: 336839 - RNA, 64 nt, hsa
auuauaaauuugcuuaaagauuuugauuuuuucuucagaauaugguauacuuaaaauuaauuaa

SEQ ID NO: 336840 - RNA, 64 nt, hsa
uucuccaaguagucauaaauguagcaaguauaaaucagaauaucaucuuauaaucuuacagagu

SEQ ID NO: 336841 - RNA, 64 nt, hsa
uaauguuaauacauauuacacuacaguuuacuuuucagaauacuaaagacuuuauaacugcaug

SEQ ID NO: 336842 - RNA, 64 nt, hsa
uaagcaagguaauguguaaaaucagucucggcugucagaauaacuucuaaaagguauuuuuaua

SEQ ID NO: 336843 - RNA, 64 nt, hsa
auacaauucuuaucuagugguauucuacuuguauucagaauacuguauuaaaauuuuacuauuu

SEQ ID NO: 336844 - RNA, 64 nt, hsa
aagcuaggaauaauugaguuuuauagcacuauuuucagaauacgaaaagauacacaaucauucu

SEQ ID NO: 336845 - RNA, 64 nt, hsa
cuuucaaaacaauuugcauuuagaguguuucgcaucagaauaacaugaguaagaugaacuggaa

SEQ ID NO: 336846 - RNA, 64 nt, hsa
auuuaaacaacuaaugcucuuugaagaaucauaaucagaauaaagauaaauucuugaucagcua

SEQ ID NO: 336847 - RNA, 64 nt, hsa
aauuucccagauauuuauguuugaacauaauggcucagaauacauauuugaacaucauaguugu

SEQ ID NO: 336848 - RNA, 64 nt, hsa
uagugcacucauuuaaucugugccucucaaaacuucagaauauuagcauauuaccacaaauaau

SEQ ID NO: 336849 - RNA, 64 nt, hsa
uuggaauucuaugagucaaucuuuuuggcagaauucagaauauuaaaaaguucauacauuugcg

SEQ ID NO: 336850 - RNA, 64 nt, hsa
aaguauuuuaaacagccuguuaauuauaagaaacucagaauaaugaguguaaauguguuauguu

SEQ ID NO: 336851 - RNA, 64 nt, hsa
uccauagguucaacuacugcugaaagucuggauuucagaauaaagcagaauguaaguuucaguu

SEQ ID NO: 336852 - RNA, 64 nt, hsa
ccuuaauuuuggcaaccacuagcaaaaaaacuugucagaauaauuuaaccaagccccucuccac

SEQ ID NO: 336853 - RNA, 64 nt, hsa
auugucaaaauuaauaugauuauuaaucagaauaucagaauaugauucacuauuuaaacuauga

SEQ ID NO: 336854 - RNA, 64 nt, hsa
cuaaaaucauugucaaaauuaauaugauuauuaaucagaauaucagaauaugauucacuauuua

SEQ ID NO: 336855 - RNA, 64 nt, hsa
uucuuuuaaaaguucauguaauauuucugauuuuucagaauauuugcaauaagagucuggauuu

SEQ ID NO: 336856 - RNA, 64 nt, hsa
caaauagaugagagagcaaaucaugugagaaaauucagaauaccaucuguuucauagccgcaca

SEQ ID NO: 336857 - RNA, 64 nt, hsa
gguaguuacuuuauuaguguucaucuguggaguaucagaauagcagucagccaacucugucuca

SEQ ID NO: 336858 - RNA, 64 nt, hsa
cuauuuaugaauauuugaccaaauuauuccagcaucagaauaauaagcaaaauaacuuuguuag

SEQ ID NO: 336859 - RNA, 64 nt, hsa
ugggaaaauccacaccacacucuaaguggacagcucagaauaauuuagcauauuuccuuucaca

SEQ ID NO: 336860 - RNA, 64 nt, hsa
agauucaccacaaauuuucaugggcguugagugcucagaauaaugcuugaacaccucaccuuga

SEQ ID NO: 336861 - RNA, 64 nt, hsa
ugagcaguauauauauaaagcacagauuugcauuucagaauauuagccaguaccagcuuuggua

SEQ ID NO: 336862 - RNA, 64 nt, hsa
uauuugugcgaagugccuuaugcuaugagaccauucagaauaucaucuuuuagacacagcccga

SEQ ID NO: 336863 - RNA, 64 nt, hsa
uguuacugucauucccauuccuuuucguuuagaaucagaauaaaguuguauuucaaauaucuaa

SEQ ID NO: 336864 - RNA, 64 nt, hsa
ccuagggaagcacuugcucaaaaucugugaccugucagaauaaaaaugugguuuguacauauca

SEQ ID NO: 336865 - RNA, 64 nt, hsa
aggauacacaucaaccacuuugcuguugaagcugucagaauaaauuccugguggucagaugaaa

SEQ ID NO: 336866 - RNA, 64 nt, hsa
agcccaacuuauauguuuuaaucucccuugucccucagaauaagcagaaaauauaacugcagcu

SEQ ID NO: 336867 - RNA, 64 nt, hsa
gauuaaguguccaucaccugccugucagccguggucagaauaaguuuuacacgaagcaggugaa

SEQ ID NO: 336868 - RNA, 64 nt, hsa
uacagaauucuuuuugguacuuucacuuauucuuucagaauacaucaaggaugugauuuauggg

SEQ ID NO: 336869 - RNA, 64 nt, hsa
gaauaauaacucuaguaauaacucuuccugcuauucagaauaaguaggagaaugaaaacugcag

SEQ ID NO: 336870 - RNA, 64 nt, hsa
ggcauuuuugucccuuuggaagaagaaauaggacucagaauacaguggcaugagugauuacacu

SEQ ID NO: 336871 - RNA, 64 nt, hsa
ccagaccugagucggcugcucuuggggugggcaccaggucaacccuucuccuccugcuguccag

SEQ ID NO: 336872 - RNA, 64 nt, hsa
guuaaaaaguuuucuguaugucauguuauaauuacaggucaauucuguuaauaucuuuuuguua

SEQ ID NO: 336873 - RNA, 64 nt, hsa
auaauuuguuucugaagaaauuugccgagaguuacaggucaaaaagccuuguuacuaguacaga

SEQ ID NO: 336874 - RNA, 64 nt, hsa
aucugacuuuaauaaaaacauggcucagaaucuacaggucaaauuaauuugaacaguucuuguc

SEQ ID NO: 336875 - RNA, 64 nt, hsa
uuuggcaagaaucccaggcuugaccaacugguaccaggucaaagauuuuuguauucuugugaau

SEQ ID NO: 336876 - RNA, 64 nt, hsa
gaaaaugcuuccaaaaguagacccuguccccacacaggucaagacuacagagaaggcuuuguag

SEQ ID NO: 336877 - RNA, 64 nt, hsa
auggggacauuugaacauguuuaauggguaugcucaggucaacugaccugaccccauuccugau

SEQ ID NO: 336878 - RNA, 64 nt, hsa
gagcugccuaguaggcugaagcuucaggacucugcaggucaaggauaugugaugagcaccggcc

SEQ ID NO: 336879 - RNA, 64 nt, hsa
ugaaaaacacccugcgugaacucaacggugugaacaggucaagaauaacacuucaaagucaucu

SEQ ID NO: 336880 - RNA, 64 nt, hsa
uaagggcuacuuaaugcacagugcauuauguacacaggucaaccaugguaacaauaguucuuag

SEQ ID NO: 336881 - RNA, 64 nt, hsa
ccuucauuggccucuccggauguugaaacaaccacaggucaagaaggaaugugaaucuguuguu

SEQ ID NO: 336882 - RNA, 64 nt, hsa
cccaccucccaccuaucaccccucacccauaacucaggucaacgugaccaaccuuccuugcuua

SEQ ID NO: 336883 - RNA, 64 nt, hsa
acuagggaaguuugucucuccuuucuugcccaaccaggucaaaguaaaaugugaguugacagcu

SEQ ID NO: 336884 - RNA, 64 nt, hsa
aaaugagaaaaagcuuuaguuccaauugacaguucaggucaauguucaaugaacauuccuaucu

SEQ ID NO: 336885 - RNA, 64 nt, hsa
cuaaaaauggauuuggcaugucuucccaucaguucaggucaaaagugcauuguugugagauuua

SEQ ID NO: 336886 - RNA, 64 nt, hsa
auaaaacaaugaaggaaaaccucacuugaaggcccaggucaacaucuaagccuguugagacuua

SEQ ID NO: 336887 - RNA, 64 nt, hsa
cuguaucccauugucuggcuuuuguaaauucauccaggucaagacuaaguauguugguuaauag

SEQ ID NO: 336888 - RNA, 64 nt, hsa
gggagaaggacagagcucucuucaauaaauucgucaggucaaagcagcagcuuugcuucugcug

SEQ ID NO: 336889 - RNA, 64 nt, hsa
uggcuucuagucugguguucugaguacuugauuucaggucaauaacgguccccccucacuccac

SEQ ID NO: 336890 - RNA, 64 nt, hsa
uaggccaugcacccaaugggugcacaauaaauaacaggucaacaaagagggaggugugucagug

SEQ ID NO: 336891 - RNA, 64 nt, hsa
ucucaguuaaugcaacuucaaccuuccagaugcucaggucaaaaacugaaaguugcuuuugacu

SEQ ID NO: 336892 - RNA, 64 nt, hsa
gggggaaaguagaaaaucgaguagaauuuggccucaggucaauaaaugauauaaaaacaugugu

SEQ ID NO: 336893 - RNA, 64 nt, hsa
ugucagacuauacccauggugccucugggcuugacaggucaaaaugguccccaucagccuggag

SEQ ID NO: 336894 - RNA, 64 nt, hsa
gggcuucuggauggauuuuauaggaaaaaauaaacaggucaaugaaugaaacuagaaagcagag

SEQ ID NO: 336895 - RNA, 64 nt, hsa
ugaugacuuauaugagggcagauucaagagccagcaggucaaaaaggccaacacaaccauaagc

SEQ ID NO: 336896 - RNA, 64 nt, hsa
auucuggauccagaacucauuaugggauguaauccaggucaacacuaauaccacuuggaagguu

SEQ ID NO: 336897 - RNA, 64 nt, hsa
uuuguuuuugcuccagucaauuccugauuauccacaggucaacccacauuuuuucauuccuucu

SEQ ID NO: 336898 - RNA, 64 nt, hsa
uggagaaggaacaaggcuauuugaaaacagaaggcaggucaaggguagaaguuaaaggagaauc

SEQ ID NO: 336899 - RNA, 64 nt, hsa
auaucuguaggauaacuuucuugaguggaauugucaggucaaaggguuugugcauuuuacuauu

SEQ ID NO: 336900 - RNA, 64 nt, hsa
caaagugcugcuggaaguagaauuuguccaauaacaggucaacuucagagacuaucugauuucc

SEQ ID NO: 336901 - RNA, 64 nt, hsa
guauccuguucuguaagaucagauguuuuuauugcaggucaauauaauacugccagagacagaa

SEQ ID NO: 336902 - RNA, 64 nt, hsa
gccagcaggcccagaguccccaggggaggaggaccaggucaagggacguucugugggcaguagc

SEQ ID NO: 336903 - RNA, 64 nt, hsa
aucugcauaaugucugaagucauuaaugcaguaacaggucaagcucuuuagcauucuuugacuu

SEQ ID NO: 336904 - RNA, 64 nt, hsa
cuuggucuuguucuggcugucaccaagcaugacccaggucaacuuuuuuuuuccccugaauuac

SEQ ID NO: 336905 - RNA, 64 nt, hsa
gauaagacccauaggcaaacuucgagcccaucagcaggucaacccuaugcugggaaagugagga

SEQ ID NO: 336906 - RNA, 64 nt, hsa
guucuuccuggaaguugacuuuccuuagacccgccaggucaaguuagccgcgugacggacaucc

SEQ ID NO: 336907 - RNA, 64 nt, hsa
guccuguguaaacugcuggaaguucuuccacagucaggucaauuuugucaaacccuucucugua

SEQ ID NO: 336908 - RNA, 64 nt, hsa
aauuauguauugguggggcuggguaccaaugcugcaggucaacagcuaugcugguaggcuccug

SEQ ID NO: 336909 - RNA, 64 nt, hsa
cuccacaggucuuuccaccucugugaguccaagucaggucaaucagcaaggacccaucucugcc

SEQ ID NO: 336910 - RNA, 64 nt, hsa
aaaaaaaaaccacacacacacauaaaaaacccaacaggucaaaauaaaaguugaacuugaguua

SEQ ID NO: 336911 - RNA, 64 nt, hsa
agggccccauaguuauaaaugugaaauuauauuccaggucaaaauuugugaaaaauacacaaaa

SEQ ID NO: 336912 - RNA, 64 nt, hsa
uguaaauccuugccgccugcugaaacauggugugcaggucaacggagaauacuagcugcuccuu

SEQ ID NO: 336913 - RNA, 64 nt, hsa
uggccagcaucucaccaccagcaaguaguagggccaggucaaucccaggcagucugaccccaga

SEQ ID NO: 336914 - RNA, 64 nt, hsa
uacugggggcagagcagacuuugccagugccccucaggucaaaccaagccaagagcacccuguc

SEQ ID NO: 336915 - RNA, 64 nt, hsa
ugacuuuaaccaaaagauuucaacccacaaugaucaggucaaucaaaaucccuaagagcagaac

SEQ ID NO: 336916 - RNA, 64 nt, hsa
cucgcggaucacaccacacugggcacgugguuugcaggucaaaggggcguuuuaaagcagcugg

SEQ ID NO: 336917 - RNA, 64 nt, hsa
cuaaaaaugcaauuuagguaaucuuacguggagacaggucaaccaaagagggagcuaggcaaag

SEQ ID NO: 336918 - RNA, 64 nt, hsa
ucucaucacagagcauaaggcccauuuuguuguucaggucaacagcaaaaugccugcaccauga

SEQ ID NO: 336919 - RNA, 64 nt, hsa
uuuuuuuuuuugugaacauaguuugauuugaucacaggucaaaaacgccuuauauuuucgaaag

SEQ ID NO: 336920 - RNA, 64 nt, hsa
ggauauuacugguuaguugucauuaaguaagauccaggucaaauuccauuugacaaaucccagg

SEQ ID NO: 336921 - RNA, 64 nt, hsa
acucaggcccagcccagagcuguguucccugucucaggucaagcaguggcagacgcaaggcuuu

SEQ ID NO: 336922 - RNA, 64 nt, hsa
caauugguggagagaagcucugaggcacgucaugcaggucaagaaagcuuucuuugcaguagca

SEQ ID NO: 336923 - RNA, 64 nt, hsa
gagcagagagcaugggccuuggguaaagcaggcccaggucaaggucuuacuccagcccuuccug

SEQ ID NO: 336924 - RNA, 64 nt, hsa
guauuuuuuucuuuuuucucaguccuaauuugaacaggucaaagauguguucaggcauuccagg

SEQ ID NO: 336925 - RNA, 64 nt, hsa
acccuucaguauuaauauauacgguauuauauaacaggucaacaagugcucuuugaugauaaaa

SEQ ID NO: 336926 - RNA, 64 nt, hsa
guacaggaucuucaguuauucgaggggaaugaggcaggucaagccgaugcuagccacuaguuug

SEQ ID NO: 336927 - RNA, 64 nt, hsa
acugcuaaauaagcgaagaguuaauuuugaaguucaggucaacaaauuccuguuuggagacggg

SEQ ID NO: 336928 - RNA, 64 nt, hsa
cgagguggcucgacugcucaaccucaccgagaggcaggucaagaucugguuccagaaccgcagg

SEQ ID NO: 336929 - RNA, 64 nt, hsa
uauuuaagccuacuccugacuaacuuggcauuugcaggucaagcaggaagcaguugacaagaca

SEQ ID NO: 336930 - RNA, 64 nt, hsa
auagauggagauauauagugugugauguguaaaucaggucaaaccucaacgacaauugaaaguu

SEQ ID NO: 336931 - RNA, 64 nt, hsa
uacccuuuucugaccaaagagaagcaaaaucuaccaggucaaaauagugccacuaacgguugag

SEQ ID NO: 336932 - RNA, 64 nt, hsa
cauccacuucaucaccuaugaguuccugcaggagcaggucaacccccaccggaccuacaacccg

SEQ ID NO: 336933 - RNA, 64 nt, hsa
guuaauuuuaaaacuagcaaucuauaaagugcaccaggucaacuugaauaaaaacacuaugaca

SEQ ID NO: 336934 - RNA, 64 nt, hsa
auguuuauguaacauaguccagagaacugacaugcaggucaaaagucagauacgcaaccuccuu

SEQ ID NO: 336935 - RNA, 64 nt, hsa
ugcuaaagaaaugucccugagacagcccaaggcucaggucaacugccauaggauucugagcaag

SEQ ID NO: 336936 - RNA, 64 nt, hsa
auguaugauaugcuugguuuaaauucucuuuguccaggucaaaaauuuggaacuuguuucuuau

SEQ ID NO: 336937 - RNA, 64 nt, hsa
uuuuuuccuguuucugaaaagaaauaauaauauccaggucaacagaaugaaaaaugaaagauga

SEQ ID NO: 336938 - RNA, 51 nt, hsa
gggcauccacggcccuguaaacaggucaacggcccaagggccuccugcccu

SEQ ID NO: 336939 - RNA, 62 nt, hsa
agggggaggcgagugugugaauaaaggcucccaucaggucaagugucugcuuguccuccuuu

SEQ ID NO: 336940 - RNA, 64 nt, hsa
ggcuuugggcugagaggaugagggaggucuuucccaggucaaauuacuuuccuuuggccucugc

SEQ ID NO: 336941 - RNA, 64 nt, hsa
uagcuuuuagggaaaaaaaaauguuaacacaucacaggucaaguugaagucauucucuguuuag

SEQ ID NO: 336942 - RNA, 64 nt, hsa
cuuuuugaucgccacuucuuuguggaagcccugccaggucaagaaguuuucccucuuuuguggu

SEQ ID NO: 336943 - RNA, 64 nt, hsa
agauguguuuauccucagcuuauaggaaucucuccaggucaacagguucaaauauucaagaagg

SEQ ID NO: 336944 - RNA, 64 nt, hsa
cuacauuauuugucacacauggaucuguuaccaucaggucaauuccuaguaugcauaaauuuuu

SEQ ID NO: 336945 - RNA, 64 nt, hsa
cccuaaggcccccagcucagacucagcaggcauucaggucaacucaggcagacuggcuaaggac

SEQ ID NO: 336946 - RNA, 57 nt, hsa
uuuuacaguacaaauggugaugaucaucaggucaaggauagucuggagcaauugaga

SEQ ID NO: 336947 - RNA, 64 nt, hsa
uuuuaaaauacauucacacacaaauacaaauugacaggucaaaauccaugaaaugagauccccc

SEQ ID NO: 336948 - RNA, 64 nt, hsa
ggugggucacccccccagauccaaggagaaacugcaggucaagggcugauaacggccaugcagg

SEQ ID NO: 336949 - RNA, 64 nt, hsa
ugacauaaggaaaguaagugcucagaaaaaugugcaggucaauaaguugcaaaaguuggggcug

SEQ ID NO: 336950 - RNA, 56 nt, hsa
gcaggaguuccgauaagugaagugagcaggucaacaguaggacuggggcagaagcu

SEQ ID NO: 336951 - RNA, 64 nt, hsa
gaauuuucuuuuuaauaaaaaggcaccuauaaaacaggucaauacaguacaggcagcacagaga

SEQ ID NO: 336952 - RNA, 64 nt, hsa
caaguuuuuggaccuucuguuccaaaaccuuuugcaggucaaucuuuguauuugaaaugaucca

SEQ ID NO: 336953 - RNA, 64 nt, hsa
uaauuauaaauugagcacugauggaaucccucuacaggucaagaaauagcgcaguguccuggau

SEQ ID NO: 336954 - RNA, 64 nt, hsa
auuccaaggccccaguuacccaucaccuccacaccaggucaaguuuugucucagccccaaaggc

SEQ ID NO: 336955 - RNA, 64 nt, hsa
agagcaacugaauauaauauggaauaaguuugaccaggucaaguuuuaggauauaguugaauuu

SEQ ID NO: 336956 - RNA, 64 nt, hsa
cccucugaccacaagcuucugccugaagauuccucaggucaacaccaucauuaaaugcgaguuu

SEQ ID NO: 336957 - RNA, 64 nt, hsa
ugcugcucauccccagggaggcaucaugggcauccaggucaacugggacugcaaccuggacaga

SEQ ID NO: 336958 - RNA, 64 nt, hsa
acagaaggaguuugggccaacccuggggaacugccaggucaacuuccaaccuuguaugacuuuc

SEQ ID NO: 336959 - RNA, 64 nt, hsa
cucacacuccacugcccaauagugaccucacuuccaggucaaggucuggcgucccaaaugaaag

SEQ ID NO: 336960 - RNA, 64 nt, hsa
cucucgugggucucuucaucucagaaaugccaaucaggucaagguuugcuacauuuuguaugug

SEQ ID NO: 336961 - RNA, 64 nt, hsa
aaguguuuuuacaagacagaacuuucuuuuaagucaggucaacauauuuugucccauuuucagg

SEQ ID NO: 336962 - RNA, 64 nt, hsa
ggugugugcuagccucugugccccguccuugugccaggucaaggugggggcaggcugggcccug

SEQ ID NO: 336963 - RNA, 64 nt, hsa
auaagauugugucucuauagagcuucaaagcauacaggucaauuaagaaagccccucucucucc

SEQ ID NO: 336964 - RNA, 64 nt, hsa
uuaagaccagaaguacuggaaucauacuuccuuucaggucaaaacauuuugugggaaauauccu

SEQ ID NO: 336965 - RNA, 64 nt, hsa
uuuuuaaaacauuaagcaacaguguaaugauuuucaggucaaauuauggcuucacaaauaugug

SEQ ID NO: 336966 - RNA, 64 nt, hsa
auauguaguggaaaucacuauuuguagaaacugucaggucaaaauauuuaacugacuguugaca

SEQ ID NO: 336967 - RNA, 64 nt, hsa
cccccugacuuucccugagaagaaucaucucugccaggucaacuggagucccuggugacuccau

SEQ ID NO: 336968 - RNA, 64 nt, hsa
acaucaguuuuguuuacucauccuccaggaacugcaggucaaguugucagguuauuuauuuuau

SEQ ID NO: 336969 - RNA, 64 nt, hsa
gugcaaaagaaauucuaagugaaugcgcguaugacaggucaacguauuaggaaggagccagaaa

SEQ ID NO: 336970 - RNA, 64 nt, hsa
ggggccugaggucaucggcguggcccaaggcuggcaggucaaccucgcgcuugcuggccagucc

SEQ ID NO: 336971 - RNA, 64 nt, hsa
gcucuguuccccaaccccacugaggccugcugcacaggucaaugccuucguuaucguuauugua

SEQ ID NO: 336972 - RNA, 64 nt, hsa
uugcaauggggaaaugacuuauaaagucacccagcaggucaacaaugggcccacgaccaagacc

SEQ ID NO: 336973 - RNA, 64 nt, hsa
uuagaggccuauuaaacaugacguuauccaauugcaggucaacuuauaguuguagccuuacaac

SEQ ID NO: 336974 - RNA, 64 nt, hsa
uaauaaauaaucauguacauguuuuaccaccacccaggucaagacauagaauguuucaacauuu

SEQ ID NO: 336975 - RNA, 64 nt, hsa
cccaauuuauuaauacuucuguuaaauuugaugucaggucaacauuuuucagaaauguauuuau

SEQ ID NO: 336976 - RNA, 64 nt, hsa
ggcuccagaggguggacggagcggggcccauucucaggucaaaagcaagauuucuacugucaug

SEQ ID NO: 336977 - RNA, 64 nt, hsa
gaaccucauggcccgagcugaauacuugaaggagcaggucaagaugagggaaucucgcugggaa

SEQ ID NO: 336978 - RNA, 64 nt, hsa
guuuuguuuugccuguggaggcaauuggggguuucaggucaaagagagggucaguggaaacaag

SEQ ID NO: 336979 - RNA, 64 nt, hsa
uggccaacgcccgagugucuguuuucaggagccccaggucaagccuugucccuuccuccuccca

SEQ ID NO: 336980 - RNA, 64 nt, hsa
auuuuuaccugcuuuuuuuuuuuuuuuuaauuuucaggucaaguuuuuuauacugcacuuauuu

SEQ ID NO: 336981 - RNA, 64 nt, hsa
uccuggccauagaaugauggaaagggaaggucagcaggucaaagcaggaucagccaacaaccug

SEQ ID NO: 336982 - RNA, 64 nt, hsa
aagacaucuguuuuaaaaagguccuuuaugacuucaggucaaagacugagacucagaacuuuca

SEQ ID NO: 336983 - RNA, 64 nt, hsa
uuuacugaacaccacucugugcuaagcccuagagcaggucaaaaacauaaaaucccugccuucu

SEQ ID NO: 336984 - RNA, 64 nt, hsa
cauuuauuucauuuuggucuuaaugcuuuguaaacaggucaaaaaauacugucauacucuaagc

SEQ ID NO: 336985 - RNA, 64 nt, hsa
acauugcaaaucuucuagaaguucucccccaaaucaggucaaugugugcccuccugagcuccca

SEQ ID NO: 336986 - RNA, 64 nt, hsa
ugucagaauucagugacgugguaggaaagaaagucaggucaagugaugcuuuugagcuuacaca

SEQ ID NO: 336987 - RNA, 64 nt, hsa
ccacccauacuaggacaaacacagcucagaucaccaggucaagcaccuaggccuggcuucuccu

SEQ ID NO: 336988 - RNA, 64 nt, hsa
ugauggcaucaccguggaggucauuguggucaaccaggucaaugccgggcaccuguucgugcag

SEQ ID NO: 336989 - RNA, 64 nt, hsa
uuauuccucuuguuuuauggauaagagauuuguucaggucaaaaguugcaaaacuguucugaag

SEQ ID NO: 336990 - RNA, 64 nt, hsa
uauuccuggacuucggagauggccucucccaagccaggucaaggagguuugggggaggguugcc

SEQ ID NO: 336991 - RNA, 64 nt, hsa
ggaucucuaguuuuugugguuuaauuuuuaguagcaggucaaaaaccugcccuccugugacuua

SEQ ID NO: 336992 - RNA, 64 nt, hsa
auggugccuuuaguuggugcggaugccccguggccaggucaagucagagcaccuggacaggugu

SEQ ID NO: 336993 - RNA, 64 nt, hsa
caagcuaguagaaauauugcaggguucccaaaaccaggucaagcaagaugccaugucaccccug

SEQ ID NO: 336994 - RNA, 64 nt, hsa
uacuuuccugguugcacaaaaggauuucagaaagcaggucaacuaugagguggaucggagauuu

SEQ ID NO: 336995 - RNA, 64 nt, hsa
guugcauuauuccuccauccugucuggaauacaccaggucaacaccagagaucucagaucagaa

SEQ ID NO: 336996 - RNA, 64 nt, hsa
ggcugguaauuuauauaaucccugaaacgggcuucaggucaaacccuuaagacaucugaagcug

SEQ ID NO: 336997 - RNA, 64 nt, hsa
ucgguggaguguucagcaagaucagacagcaguccaggucaaaggcaaacacacacgcuccagc

SEQ ID NO: 336998 - RNA, 64 nt, hsa
cccauauucuugaaugucuucauuccaauggggucaggucaauauuaugaaaauaauuuuuaua

SEQ ID NO: 336999 - RNA, 64 nt, hsa
agcucugcugucccauagggacugcgacugggaccaggucaaccacgccaggggggugucacca

SEQ ID NO: 337000 - RNA, 64 nt, hsa
aggcuggagugaaaguggcgcaaccucugccucccaggucaaagcaauccugccucaggccccc

SEQ ID NO: 337001 - RNA, 64 nt, hsa
ggaaauacgccaaaauguugacaaugacugucuccaggucaaaggagagaggugggauuguggg

SEQ ID NO: 337002 - RNA, 64 nt, hsa
ucacuugaaagauuuuauuguauaaaaaguuucacaggucaauaaacuuagaggaaaaugagua

SEQ ID NO: 337003 - RNA, 64 nt, hsa
aacauuuuuagccacuucauuucuauuuauugaacaggucaaauuugucuuguuauuugugagu

SEQ ID NO: 337004 - RNA, 64 nt, hsa
cggucccagaggaggaccuagugacaucaugggacaggucaaagcauuagggccaccuccaugg

SEQ ID NO: 337005 - RNA, 64 nt, hsa
acuccagacaguugacaagcaucgcagccccugucaggucaaggaauuuuaaccugggagacuc

SEQ ID NO: 337006 - RNA, 64 nt, hsa
ccacggcacccagcagaauuccagucuugagaaacaggucaaggacagcuucaaaagagauucu

SEQ ID NO: 337007 - RNA, 64 nt, hsa
gaggugcaggacugucggggcgagguggccgaggcaggucaaagcugaaaaguggaaucggagc

SEQ ID NO: 337008 - RNA, 64 nt, hsa
uuaacguaccucuuaaaauucguugaaacgauuucaggucaacucugaagaguauuugaaagca

SEQ ID NO: 337009 - RNA, 64 nt, hsa
aaggauaggcacacauucauucuagucuuggggccaggucaaaaggaacacugcuucagaguau

SEQ ID NO: 337010 - RNA, 64 nt, hsa
guggcauacacuguuauucaugguuaagguaaagcaggucaagggauggcauugaaaaaauaua

SEQ ID NO: 337011 - RNA, 64 nt, hsa
cucaucguuacagcaaaccccagggggccuuggccaggucaaggguucugugaggagaggaccc

SEQ ID NO: 337012 - RNA, 64 nt, hsa
gaguucucccaccuuugcucauuuguaaaaugggcaggucaaucuucccaccccaccguguggg

SEQ ID NO: 337013 - RNA, 64 nt, hsa
gugcccggcccauucuaaggguuuucuuugaagacaggucaaaugcuguuaguaaguuucagga

SEQ ID NO: 337014 - RNA, 64 nt, hsa
cuagacccaggauguaucuuuaauucuugucauccaggucaacauaugaugcugcuauaagucu

SEQ ID NO: 337015 - RNA, 64 nt, hsa
aaagcuuuuccagaccccacccuaccuuccaacccaggucaagacauugccaaaucuugaacuc

SEQ ID NO: 337016 - RNA, 64 nt, hsa
uuuuuguccacuaaaaacacacugauggucaacacaggucaaaaccaagagagaauguguaguu

SEQ ID NO: 337017 - RNA, 64 nt, hsa; identical to SEQ ID NO: 76961

SEQ ID NO: 337018 - RNA, 64 nt, hsa; identical to SEQ ID NO: 76962

SEQ ID NO: 337019 - RNA, 64 nt, hsa; identical to SEQ ID NO: 76963

SEQ ID NO: 337020 - RNA, 64 nt, hsa; identical to SEQ ID NO: 76964

SEQ ID NO: 337021 - RNA, 64 nt, hsa; identical to SEQ ID NO: 76965

SEQ ID NO: 337022 - RNA, 64 nt, hsa; identical to SEQ ID NO: 76966

SEQ ID NO: 337023 - RNA, 64 nt, hsa; identical to SEQ ID NO: 76967

SEQ ID NO: 337024 - RNA, 64 nt, hsa; identical to SEQ ID NO: 76968

SEQ ID NO: 337025 - RNA, 64 nt, hsa; identical to SEQ ID NO: 76969

SEQ ID NO: 337026 - RNA, 64 nt, hsa; identical to SEQ ID NO: 76970

SEQ ID NO: 337027 - RNA, 64 nt, hsa; identical to SEQ ID NO: 76971

SEQ ID NO: 337028 - RNA, 64 nt, hsa; identical to SEQ ID NO: 76972

SEQ ID NO: 337029 - RNA, 64 nt, hsa; identical to SEQ ID NO: 76973

SEQ ID NO: 337030 - RNA, 64 nt, hsa; identical to SEQ ID NO: 76974

SEQ ID NO: 337031 - RNA, 64 nt, hsa; identical to SEQ ID NO: 76975

SEQ ID NO: 337032 - RNA, 64 nt, hsa; identical to SEQ ID NO: 76976

SEQ ID NO: 337033 - RNA, 64 nt, hsa; identical to SEQ ID NO: 76977

SEQ ID NO: 337034 - RNA, 64 nt, hsa; identical to SEQ ID NO: 76978

SEQ ID NO: 337035 - RNA, 64 nt, hsa; identical to SEQ ID NO: 76979

SEQ ID NO: 337036 - RNA, 64 nt, hsa; identical to SEQ ID NO: 76980

SEQ ID NO: 337037 - RNA, 64 nt, hsa; identical to SEQ ID NO: 76981

SEQ ID NO: 337038 - RNA, 64 nt, hsa; identical to SEQ ID NO: 76982

SEQ ID NO: 337039 - RNA, 64 nt, hsa; identical to SEQ ID NO: 76983

SEQ ID NO: 337040 - RNA, 64 nt, hsa; identical to SEQ ID NO: 76984

SEQ ID NO: 337041 - RNA, 64 nt, hsa; identical to SEQ ID NO: 76985

SEQ ID NO: 337042 - RNA, 64 nt, hsa; identical to SEQ ID NO: 76986

SEQ ID NO: 337043 - RNA, 64 nt, hsa; identical to SEQ ID NO: 76987

SEQ ID NO: 337044 - RNA, 64 nt, hsa; identical to SEQ ID NO: 76988

SEQ ID NO: 337045 - RNA, 64 nt, hsa; identical to SEQ ID NO: 76989

SEQ ID NO: 337046 - RNA, 64 nt, hsa; identical to SEQ ID NO: 76990

SEQ ID NO: 337047 - RNA, 64 nt, hsa; identical to SEQ ID NO: 76991

SEQ ID NO: 337048 - RNA, 64 nt, hsa; identical to SEQ ID NO: 76992

SEQ ID NO: 337049 - RNA, 64 nt, hsa; identical to SEQ ID NO: 76993

SEQ ID NO: 337050 - RNA, 64 nt, hsa; identical to SEQ ID NO: 76994

SEQ ID NO: 337051 - RNA, 64 nt, hsa; identical to SEQ ID NO: 76995

SEQ ID NO: 337052 - RNA, 64 nt, hsa; identical to SEQ ID NO: 76996

SEQ ID NO: 337053 - RNA, 64 nt, hsa; identical to SEQ ID NO: 76997

SEQ ID NO: 337054 - RNA, 64 nt, hsa; identical to SEQ ID NO: 76998

SEQ ID NO: 337055 - RNA, 64 nt, hsa; identical to SEQ ID NO: 76999

SEQ ID NO: 337056 - RNA, 64 nt, hsa; identical to SEQ ID NO: 77000

SEQ ID NO: 337057 - RNA, 64 nt, hsa; identical to SEQ ID NO: 77001

SEQ ID NO: 337058 - RNA, 64 nt, hsa; identical to SEQ ID NO: 77002

SEQ ID NO: 337059 - RNA, 64 nt, hsa; identical to SEQ ID NO: 77003

SEQ ID NO: 337060 - RNA, 64 nt, hsa; identical to SEQ ID NO: 77004

SEQ ID NO: 337061 - RNA, 64 nt, hsa; identical to SEQ ID NO: 77005

SEQ ID NO: 337062 - RNA, 64 nt, hsa; identical to SEQ ID NO: 77006

SEQ ID NO: 337063 - RNA, 64 nt, hsa; identical to SEQ ID NO: 77007

SEQ ID NO: 337064 - RNA, 64 nt, hsa; identical to SEQ ID NO: 77008

SEQ ID NO: 337065 - RNA, 64 nt, hsa; identical to SEQ ID NO: 77009

SEQ ID NO: 337066 - RNA, 64 nt, hsa; identical to SEQ ID NO: 77010

SEQ ID NO: 337067 - RNA, 64 nt, hsa; identical to SEQ ID NO: 77011

SEQ ID NO: 337068 - RNA, 64 nt, hsa; identical to SEQ ID NO: 77012

SEQ ID NO: 337069 - RNA, 64 nt, hsa; identical to SEQ ID NO: 77013

SEQ ID NO: 337070 - RNA, 64 nt, hsa; identical to SEQ ID NO: 77014

SEQ ID NO: 337071 - RNA, 64 nt, hsa; identical to SEQ ID NO: 77015

SEQ ID NO: 337072 - RNA, 64 nt, hsa; identical to SEQ ID NO: 77016

SEQ ID NO: 337073 - RNA, 64 nt, hsa; identical to SEQ ID NO: 77017

SEQ ID NO: 337074 - RNA, 64 nt, hsa; identical to SEQ ID NO: 77018

SEQ ID NO: 337075 - RNA, 64 nt, hsa; identical to SEQ ID NO: 77019

SEQ ID NO: 337076 - RNA, 64 nt, hsa
ucuuagaugccacaggagaagaggcaaacucaaaugcugagaaccccaagcugauaucagcaau

SEQ ID NO: 337077 - RNA, 64 nt, hsa
caggaguaacuaagauuauaauuuccaccaacauugcugagacauccauaaccaucgaugaugu

SEQ ID NO: 337078 - RNA, 64 nt, hsa
gccaccagacuguuauacugcaccacgggagugcugcugagaaggcuagaaggagauacagcuc

SEQ ID NO: 337079 - RNA, 64 nt, hsa
cacagaagauaaagaagaagucuuucaucuuuacugcugagauccuugggaacacuguugucau

SEQ ID NO: 337080 - RNA, 64 nt, hsa
aaaagagccauacugaaacaugucuuguacagccugcugagauggcgaaacccugugugugggg

SEQ ID NO: 337081 - RNA, 64 nt, hsa
gagcagauacaaccaaugcaucacuguauacucuugcugagaauguggaugcagccucacagau

SEQ ID NO: 337082 - RNA, 64 nt, hsa
accagaguaucuggauuacccaggaagguugagcugcugagauuucaguggugcaaugucuuua

SEQ ID NO: 337083 - RNA, 64 nt, hsa
ggucugggugugaauuccaccuucccuccugcagugcugagaggcagcgaggacggagaggaca

SEQ ID NO: 337084 - RNA, 64 nt, hsa
agaugucaugggggcaccugcucucccugauagaugcugagagcauccagaaacuuccagacca

SEQ ID NO: 337085 - RNA, 64 nt, hsa
accucaucguccaccugccucggccuccccaaagugcugagauuaggcguuagccaccgcgccc

SEQ ID NO: 337086 - RNA, 64 nt, hsa
aggccauucgacgccuucuccaaggggucugauuugcugagacaccagcuucaccuucuuaaca

SEQ ID NO: 337087 - RNA, 64 nt, hsa
guggucaacuuuaguaauauaaaaggcugcuggaugcugagauuccacauaacacaugguuguc

SEQ ID NO: 337088 - RNA, 64 nt, hsa
cagcaucccuucccacaugccugcgccugcugccugcugagaugaggaggggagcgucugggaa

SEQ ID NO: 337089 - RNA, 64 nt, hsa
ccucaagcaauccaccugccuuggccucccaaagugcugagauugcagaugugagccaccgugc

SEQ ID NO: 337090 - RNA, 64 nt, hsa
uugucugcacagaaagucccaguacaacuuccauugcugagaaaauccucagaggacuuuccca

SEQ ID NO: 337091 - RNA, 64 nt, hsa
cugaaucugagguuuuauaaaucccucaaacgauugcugagagccugauuguggaaagaaguga

SEQ ID NO: 337092 - RNA, 64 nt, hsa
gagaguguuuauaauuauguuauuuauugcuggaugcugagaauggucugauauucgugcuacc

SEQ ID NO: 337093 - RNA, 64 nt, hsa
agguggguggaccaguacuccaggugauggggcaugcugagaaauagagaaaagagaccauguu

SEQ ID NO: 337094 - RNA, 64 nt, hsa
ggggcugccccaacccacccccguucuuuguacgugcugagacagccacuagaagaucuuccuc

SEQ ID NO: 337095 - RNA, 64 nt, hsa
agccaagccccagugacccggagagcuggccugaugcugagaguguguccuccuggggcuuuag

SEQ ID NO: 337096 - RNA, 64 nt, hsa
acaagguuuucacugcuuuuucuuuuacauaauaugcugagaauuauuucuuaugcuuuuuacu

SEQ ID NO: 337097 - RNA, 64 nt, hsa
uucuagaagaagagaaacaaagggauugauaaaaugcugagaacuagugauuauauauuuuucu

SEQ ID NO: 337098 - RNA, 64 nt, hsa
ccucaggugauccaccugccucagccucccaaagugcugagauuacaggcaugagccaccacgc

SEQ ID NO: 337099 - RNA, 64 nt, hsa
gcuucucccaucguuagacaucugccaguaagccugcugagagaagccucagcccacucauacc

SEQ ID NO: 337100 - RNA, 64 nt, hsa
gugagaaggaauucagggagagcaaaggagccagugcugagaugcugcuguguugguugaggaa

SEQ ID NO: 337101 - RNA, 64 nt, hsa
uuccagagugugcacuuccagcccacccgggcagugcugagagggaggaggagaacaaggaugg

SEQ ID NO: 337102 - RNA, 64 nt, hsa
aagcacaaagaauugauucauguucaucaauaccugcugagaguacugucccaggaauauccag

SEQ ID NO: 337103 - RNA, 64 nt, hsa
aacugacugaacuagagcuugcagugaaguguucugcugagacugagcaccuuacagauauuuu

SEQ ID NO: 337104 - RNA, 64 nt, hsa
agggaggguacgccaggcgagcccagggcacagaugcugagacagccucuccuucucagugcag

SEQ ID NO: 337105 - RNA, 64 nt, hsa
gcuucaccccugccaggcaagcccagggcauagaugcugagacagccucucccucucagugcag

SEQ ID NO: 337106 - RNA, 64 nt, hsa
uagcauguuucaaagcugaacucuacagagcgagugcugagacaguauuuaggguuucugggag

SEQ ID NO: 337107 - RNA, 64 nt, hsa
cauccuccccccaaccuccugacccauucauaaaugcugagaaugucucucaugggaacacugu

SEQ ID NO: 337108 - RNA, 64 nt, hsa
gugggcauuuccuacauuccuccuuguuugccgcugcugagauugcaguauuuauugcaaugua

SEQ ID NO: 337109 - RNA, 64 nt, hsa
ggguuugguuuuugcugcugguagaaucaggguccucgggcaugaacgcgagcccaaagugcca

SEQ ID NO: 337110 - RNA, 64 nt, hsa
ucgccagggcucccuucuccucugccugguuagacucgggcacccaggaaagccuggccagggc

SEQ ID NO: 337111 - RNA, 64 nt, hsa
cgugucugcugagagcaaccagaccuuccauguccucgggcagcugcaacuccccgcgagaccc

SEQ ID NO: 337112 - RNA, 64 nt, hsa
gcggucucugucuucagggauugugccugcgucccucgggcaccugggcccccccgcuuggcuc

SEQ ID NO: 337113 - RNA, 64 nt, hsa; identical to SEQ ID NO: 163552

SEQ ID NO: 337114 - RNA, 64 nt, hsa; identical to SEQ ID NO: 163553

SEQ ID NO: 337115 - RNA, 64 nt, hsa; identical to SEQ ID NO: 163554

SEQ ID NO: 337116 - RNA, 64 nt, hsa; identical to SEQ ID NO: 163555

SEQ ID NO: 337117 - RNA, 64 nt, hsa; identical to SEQ ID NO: 163556

SEQ ID NO: 337118 - RNA, 64 nt, hsa; identical to SEQ ID NO: 163557

SEQ ID NO: 337119 - RNA, 64 nt, hsa; identical to SEQ ID NO: 163558

SEQ ID NO: 337120 - RNA, 64 nt, hsa; identical to SEQ ID NO: 163559

SEQ ID NO: 337121 - RNA, 64 nt, hsa; identical to SEQ ID NO: 163560

SEQ ID NO: 337122 - RNA, 64 nt, hsa; identical to SEQ ID NO: 163561

SEQ ID NO: 337123 - RNA, 64 nt, hsa; identical to SEQ ID NO: 163562

SEQ ID NO: 337124 - RNA, 64 nt, hsa; identical to SEQ ID NO: 163563

SEQ ID NO: 337125 - RNA, 64 nt, hsa; identical to SEQ ID NO: 163564

SEQ ID NO: 337126 - RNA, 64 nt, hsa; identical to SEQ ID NO: 163565

SEQ ID NO: 337127 - RNA, 64 nt, hsa; identical to SEQ ID NO: 163566

SEQ ID NO: 337128 - RNA, 64 nt, hsa; identical to SEQ ID NO: 163567

SEQ ID NO: 337129 - RNA, 64 nt, hsa; identical to SEQ ID NO: 163568

SEQ ID NO: 337130 - RNA, 64 nt, hsa; identical to SEQ ID NO: 163569

SEQ ID NO: 337131 - RNA, 64 nt, hsa; identical to SEQ ID NO: 163570

SEQ ID NO: 337132 - RNA, 64 nt, hsa; identical to SEQ ID NO: 163571

SEQ ID NO: 337133 - RNA, 64 nt, hsa; identical to SEQ ID NO: 163572

SEQ ID NO: 337134 - RNA, 64 nt, hsa; identical to SEQ ID NO: 163573

SEQ ID NO: 337135 - RNA, 64 nt, hsa; identical to SEQ ID NO: 163574

SEQ ID NO: 337136 - RNA, 64 nt, hsa; identical to SEQ ID NO: 163575

SEQ ID NO: 337137 - RNA, 64 nt, hsa; identical to SEQ ID NO: 163576

SEQ ID NO: 337138 - RNA, 64 nt, hsa; identical to SEQ ID NO: 163577

SEQ ID NO: 337139 - RNA, 64 nt, hsa; identical to SEQ ID NO: 99898

SEQ ID NO: 337140 - RNA, 64 nt, hsa; identical to SEQ ID NO: 99899

SEQ ID NO: 337141 - RNA, 64 nt, hsa; identical to SEQ ID NO: 99900

SEQ ID NO: 337142 - RNA, 64 nt, hsa; identical to SEQ ID NO: 99901

SEQ ID NO: 337143 - RNA, 64 nt, hsa; identical to SEQ ID NO: 99902

SEQ ID NO: 337144 - RNA, 64 nt, hsa; identical to SEQ ID NO: 99903

SEQ ID NO: 337145 - RNA, 64 nt, hsa; identical to SEQ ID NO: 99904

SEQ ID NO: 337146 - RNA, 64 nt, hsa; identical to SEQ ID NO: 99905

SEQ ID NO: 337147 - RNA, 64 nt, hsa; identical to SEQ ID NO: 99906

SEQ ID NO: 337148 - RNA, 64 nt, hsa; identical to SEQ ID NO: 99907

SEQ ID NO: 337149 - RNA, 64 nt, hsa; identical to SEQ ID NO: 99908

SEQ ID NO: 337150 - RNA, 64 nt, hsa; identical to SEQ ID NO: 99909

SEQ ID NO: 337151 - RNA, 64 nt, hsa; identical to SEQ ID NO: 99910

SEQ ID NO: 337152 - RNA, 64 nt, hsa; identical to SEQ ID NO: 99911

SEQ ID NO: 337153 - RNA, 64 nt, hsa; identical to SEQ ID NO: 99912

SEQ ID NO: 337154 - RNA, 64 nt, hsa; identical to SEQ ID NO: 99913

SEQ ID NO: 337155 - RNA, 64 nt, hsa; identical to SEQ ID NO: 99914

SEQ ID NO: 337156 - RNA, 64 nt, hsa; identical to SEQ ID NO: 99915

SEQ ID NO: 337157 - RNA, 64 nt, hsa; identical to SEQ ID NO: 99916

SEQ ID NO: 337158 - RNA, 64 nt, hsa; identical to SEQ ID NO: 99917

SEQ ID NO: 337159 - RNA, 64 nt, hsa; identical to SEQ ID NO: 99918

SEQ ID NO: 337160 - RNA, 64 nt, hsa; identical to SEQ ID NO: 99919

SEQ ID NO: 337161 - RNA, 64 nt, hsa; identical to SEQ ID NO: 99920

SEQ ID NO: 337162 - RNA, 64 nt, hsa; identical to SEQ ID NO: 99921

SEQ ID NO: 337163 - RNA, 64 nt, hsa; identical to SEQ ID NO: 99922

SEQ ID NO: 337164 - RNA, 64 nt, hsa; identical to SEQ ID NO: 99923

SEQ ID NO: 337165 - RNA, 64 nt, hsa; identical to SEQ ID NO: 99924

SEQ ID NO: 337166 - RNA, 64 nt, hsa; identical to SEQ ID NO: 99925

SEQ ID NO: 337167 - RNA, 64 nt, hsa; identical to SEQ ID NO: 99926

SEQ ID NO: 337168 - RNA, 64 nt, hsa; identical to SEQ ID NO: 99927

SEQ ID NO: 337169 - RNA, 64 nt, hsa; identical to SEQ ID NO: 99928

SEQ ID NO: 337170 - RNA, 64 nt, hsa; identical to SEQ ID NO: 99929

SEQ ID NO: 337171 - RNA, 64 nt, hsa; identical to SEQ ID NO: 99930

SEQ ID NO: 337172 - RNA, 64 nt, hsa; identical to SEQ ID NO: 99931

SEQ ID NO: 337173 - RNA, 64 nt, hsa; identical to SEQ ID NO: 99932

SEQ ID NO: 337174 - RNA, 64 nt, hsa; identical to SEQ ID NO: 99933

SEQ ID NO: 337175 - RNA, 64 nt, hsa; identical to SEQ ID NO: 99934

SEQ ID NO: 337176 - RNA, 64 nt, hsa; identical to SEQ ID NO: 99935

SEQ ID NO: 337177 - RNA, 64 nt, hsa; identical to SEQ ID NO: 99936

SEQ ID NO: 337178 - RNA, 64 nt, hsa; identical to SEQ ID NO: 99937

SEQ ID NO: 337179 - RNA, 64 nt, hsa; identical to SEQ ID NO: 99938

SEQ ID NO: 337180 - RNA, 64 nt, hsa; identical to SEQ ID NO: 99939

SEQ ID NO: 337181 - RNA, 64 nt, hsa; identical to SEQ ID NO: 99940

SEQ ID NO: 337182 - RNA, 64 nt, hsa; identical to SEQ ID NO: 99941

SEQ ID NO: 337183 - RNA, 64 nt, hsa; identical to SEQ ID NO: 99942

SEQ ID NO: 337184 - RNA, 64 nt, hsa; identical to SEQ ID NO: 99943

SEQ ID NO: 337185 - RNA, 64 nt, hsa; identical to SEQ ID NO: 99944

SEQ ID NO: 337186 - RNA, 64 nt, hsa; identical to SEQ ID NO: 99945

SEQ ID NO: 337187 - RNA, 64 nt, hsa; identical to SEQ ID NO: 99946

SEQ ID NO: 337188 - RNA, 64 nt, hsa
gcaucucacucccaagugcccccccuuucugugacuccuugaagccuuuacuuuuuuuuuuuuu

SEQ ID NO: 337189 - RNA, 64 nt, hsa
uccugcuuuacuguagcucuuuuucuuccuugcacuccuugaucuuugggcuuccgugaugucc

SEQ ID NO: 337190 - RNA, 64 nt, hsa
uacaaagcagauagucccugaaccacagucgugccuccuugaaacaagccauucuacugugcua

SEQ ID NO: 337191 - RNA, 64 nt, hsa
cacuuaaauggagguguccacaucuuaauuguuucuccuugacacauuucucaauccacgaagc

SEQ ID NO: 337192 - RNA, 64 nt, hsa
caaagcagaaaauaucaucaccaucauaaccuuucuccuugagaaaacuuuuauuuuugucuaa

SEQ ID NO: 337193 - RNA, 64 nt, hsa
cauaauaguuaggauaguuuccuauagcaaagggcuccuugauucauaagcaccucccccccaa

SEQ ID NO: 337194 - RNA, 64 nt, hsa
cccuaagccuggccccaaagguuucucuuucuuccuccuugauuuuccaucuugacgaaggcau

SEQ ID NO: 337195 - RNA, 64 nt, hsa
cccacauucucccagccccccccaaggacccccucuccuugacccccagugcuguaaguaauag

SEQ ID NO: 337196 - RNA, 64 nt, hsa
ccucuauuaaaaaucacugcccuaacuacacuuccuccuugagggaauagaaauggaccuuucu

SEQ ID NO: 337197 - RNA, 64 nt, hsa
cuugguaagccuggaugugacagacaccucggcucuccuugaauaagaaagccagcagaacucu

SEQ ID NO: 337198 - RNA, 64 nt, hsa
gaucucccucuaggaugugauagaucuggucccucuccuugaacuaccccuccacacgcucuag

SEQ ID NO: 337199 - RNA, 64 nt, hsa
auuggcagggagaagcauuguggggcaauuguuccuccuugacaauguagcaauaaauagaugc

SEQ ID NO: 337200 - RNA, 64 nt, hsa
cuagcucccugcacggccgcacccucccagagaacuccuugaggagaacaagugcccuugggga

SEQ ID NO: 337201 - RNA, 64 nt, hsa
uucaggaaaacuccuguagcgccagugcccagcucuccuugagcugaccacuccaguuaggaug

SEQ ID NO: 337202 - RNA, 64 nt, hsa
cuuuucaguguagaccaccagcuccccuccccaucuccuugagucagcagacuguccaaugugc

SEQ ID NO: 337203 - RNA, 64 nt, hsa
cuguuuccuucucuuguguuaucugauagcgucccuccuugagcucaucagaaagguuuuauga

SEQ ID NO: 337204 - RNA, 64 nt, hsa
ucagaguugucucaccccuucucgugccuuuucucuccuugagcuuuauaaacagauuuguacc

SEQ ID NO: 337205 - RNA, 64 nt, hsa
auauauauaaauagggaauuuuuuuuaauguuugcuccuugaguuuucaagaugaaauaaggag

SEQ ID NO: 337206 - RNA, 64 nt, hsa
agcauggcagugcugaccauuucacccacuuggccuccuugaggaauagggauggggagcccuc

SEQ ID NO: 337207 - RNA, 64 nt, hsa
uucuuaucuggaaagagcacggaaaugcagcggccuccuugaagauccugagugagucaccugc

SEQ ID NO: 337208 - RNA, 64 nt, hsa; identical to SEQ ID NO: 94067

SEQ ID NO: 337209 - RNA, 64 nt, hsa; identical to SEQ ID NO: 94068

SEQ ID NO: 337210 - RNA, 64 nt, hsa; identical to SEQ ID NO: 94069

SEQ ID NO: 337211 - RNA, 64 nt, hsa; identical to SEQ ID NO: 94070

SEQ ID NO: 337212 - RNA, 64 nt, hsa; identical to SEQ ID NO: 94071

SEQ ID NO: 337213 - RNA, 64 nt, hsa; identical to SEQ ID NO: 94072

SEQ ID NO: 337214 - RNA, 64 nt, hsa; identical to SEQ ID NO: 94073

SEQ ID NO: 337215 - RNA, 64 nt, hsa; identical to SEQ ID NO: 94074

SEQ ID NO: 337216 - RNA, 64 nt, hsa; identical to SEQ ID NO: 94075

SEQ ID NO: 337217 - RNA, 64 nt, hsa; identical to SEQ ID NO: 94076

SEQ ID NO: 337218 - RNA, 64 nt, hsa; identical to SEQ ID NO: 94077

SEQ ID NO: 337219 - RNA, 64 nt, hsa; identical to SEQ ID NO: 94078

SEQ ID NO: 337220 - RNA, 64 nt, hsa; identical to SEQ ID NO: 94079

SEQ ID NO: 337221 - RNA, 64 nt, hsa; identical to SEQ ID NO: 94080

SEQ ID NO: 337222 - RNA, 64 nt, hsa; identical to SEQ ID NO: 94081

SEQ ID NO: 337223 - RNA, 64 nt, hsa; identical to SEQ ID NO: 94082

SEQ ID NO: 337224 - RNA, 64 nt, hsa; identical to SEQ ID NO: 94083

SEQ ID NO: 337225 - RNA, 64 nt, hsa; identical to SEQ ID NO: 94084

SEQ ID NO: 337226 - RNA, 64 nt, hsa; identical to SEQ ID NO: 94085

SEQ ID NO: 337227 - RNA, 64 nt, hsa; identical to SEQ ID NO: 94086

SEQ ID NO: 337228 - RNA, 64 nt, hsa; identical to SEQ ID NO: 94087

SEQ ID NO: 337229 - RNA, 64 nt, hsa; identical to SEQ ID NO: 94088

SEQ ID NO: 337230 - RNA, 64 nt, hsa; identical to SEQ ID NO: 94089

SEQ ID NO: 337231 - RNA, 53 nt, hsa; identical to SEQ ID NO: 94090

SEQ ID NO: 337232 - RNA, 64 nt, hsa; identical to SEQ ID NO: 94091

SEQ ID NO: 337233 - RNA, 64 nt, hsa; identical to SEQ ID NO: 94092

SEQ ID NO: 337234 - RNA, 64 nt, hsa; identical to SEQ ID NO: 94093

SEQ ID NO: 337235 - RNA, 64 nt, hsa; identical to SEQ ID NO: 94094

SEQ ID NO: 337236 - RNA, 64 nt, hsa; identical to SEQ ID NO: 94095

SEQ ID NO: 337237 - RNA, 64 nt, hsa; identical to SEQ ID NO: 94096

SEQ ID NO: 337238 - RNA, 64 nt, hsa; identical to SEQ ID NO: 94097

SEQ ID NO: 337239 - RNA, 64 nt, hsa; identical to SEQ ID NO: 94098

SEQ ID NO: 337240 - RNA, 64 nt, hsa; identical to SEQ ID NO: 94099

SEQ ID NO: 337241 - RNA, 64 nt, hsa; identical to SEQ ID NO: 94100

SEQ ID NO: 337242 - RNA, 64 nt, hsa; identical to SEQ ID NO: 94101

SEQ ID NO: 337243 - RNA, 64 nt, hsa; identical to SEQ ID NO: 94102

SEQ ID NO: 337244 - RNA, 64 nt, hsa; identical to SEQ ID NO: 81735

SEQ ID NO: 337245 - RNA, 64 nt, hsa; identical to SEQ ID NO: 81736

SEQ ID NO: 337246 - RNA, 64 nt, hsa; identical to SEQ ID NO: 81737

SEQ ID NO: 337247 - RNA, 64 nt, hsa; identical to SEQ ID NO: 81738

SEQ ID NO: 337248 - RNA, 64 nt, hsa; identical to SEQ ID NO: 81739

SEQ ID NO: 337249 - RNA, 64 nt, hsa; identical to SEQ ID NO: 81740

SEQ ID NO: 337250 - RNA, 64 nt, hsa; identical to SEQ ID NO: 81741

SEQ ID NO: 337251 - RNA, 64 nt, hsa; identical to SEQ ID NO: 81742

SEQ ID NO: 337252 - RNA, 63 nt, hsa
uugugcagacauaccauuuucaguucugcugucacuuggaaguucaggcucagcaugaauuuu

SEQ ID NO: 337253 - RNA, 63 nt, hsa
aagcagcucacuacgauaucaaguuacacuaagacuuggaacacuaacauucuguaagagguu

SEQ ID NO: 337254 - RNA, 63 nt, hsa
gacaaguuuaacuuuauuuuuaauguguuaauuacuuggaauaaaugcauuaaucucauguuu

SEQ ID NO: 337255 - RNA, 63 nt, hsa
ggaaaaacaccagaaagcuugcugaaauggaaaacuuggaagaauuguucaucucuuaggcuu

SEQ ID NO: 337256 - RNA, 63 nt, hsa
ccauaguuauuuacuugaaagaugggucuccgcacuuggaaagguuucaagacuugauacugc

SEQ ID NO: 337257 - RNA, 63 nt, hsa
gguucaagagacacugcuuggguuccuuuuucaacuuggaaaaagaaagaaacacucaacaau

SEQ ID NO: 337258 - RNA, 63 nt, hsa
aaguuaucuugguacaacaccguguguauauacacuuggaagcuuaaaaagguguuuugucug

SEQ ID NO: 337259 - RNA, 63 nt, hsa
auugcucauaacuuaccaagaggcuaauacuaaacuuggaaaauuguuuaaguauguuuuauc

SEQ ID NO: 337260 - RNA, 63 nt, hsa
uucauuugggggcuauguguuucaauaacauucacuuggaaucagcugaaagcuguaauaugu

SEQ ID NO: 337261 - RNA, 63 nt, hsa
cucagaacugaaggcaauuauuucuuuugguggacuuggaaucuccguuugucuacacugucc

SEQ ID NO: 337262 - RNA, 63 nt, hsa
guguaccugaaagugagggggagaauggaaccaacuuggaaaacacucugcaggauauuaucc

SEQ ID NO: 337263 - RNA, 63 nt, hsa
aggauuaagaaacucacucaaaaccgcucaacuacuuggaaacugaacaaccugcuccugaau

SEQ ID NO: 337264 - RNA, 63 nt, hsa
ggccugucacccugcuuucccugccucuacuugacuuggaauuggcugaagacuacacaggaa

SEQ ID NO: 337265 - RNA, 63 nt, hsa
acacaggaaugcaucguucccacuccccaucccacuuggaaaacuccaaggggguguggcuuc

SEQ ID NO: 337266 - RNA, 63 nt, hsa
uggcgagugauugcuuuccuucagagaacagacacuuggaauuucuccuuuuaguguuuauau

SEQ ID NO: 337267 - RNA, 63 nt, hsa
gaugcuuuuaaaguuuuauauuuauguccccaaacuuggaaacaagaacucuacuuuagccua

SEQ ID NO: 337268 - RNA, 64 nt, hsa; identical to SEQ ID NO: 175864

SEQ ID NO: 337269 - RNA, 64 nt, hsa; identical to SEQ ID NO: 175865

SEQ ID NO: 337270 - RNA, 64 nt, hsa; identical to SEQ ID NO: 175866

SEQ ID NO: 337271 - RNA, 64 nt, hsa; identical to SEQ ID NO: 175867

SEQ ID NO: 337272 - RNA, 64 nt, hsa; identical to SEQ ID NO: 175868

SEQ ID NO: 337273 - RNA, 64 nt, hsa; identical to SEQ ID NO: 175869

SEQ ID NO: 337274 - RNA, 64 nt, hsa; identical to SEQ ID NO: 175870

SEQ ID NO: 337275 - RNA, 64 nt, hsa; identical to SEQ ID NO: 175871

SEQ ID NO: 337276 - RNA, 64 nt, hsa; identical to SEQ ID NO: 175872

SEQ ID NO: 337277 - RNA, 64 nt, hsa; identical to SEQ ID NO: 175873

SEQ ID NO: 337278 - RNA, 64 nt, hsa; identical to SEQ ID NO: 175874

SEQ ID NO: 337279 - RNA, 64 nt, hsa; identical to SEQ ID NO: 175875

SEQ ID NO: 337280 - RNA, 64 nt, hsa; identical to SEQ ID NO: 175876

SEQ ID NO: 337281 - RNA, 64 nt, hsa; identical to SEQ ID NO: 175877

SEQ ID NO: 337282 - RNA, 64 nt, hsa; identical to SEQ ID NO: 175878

SEQ ID NO: 337283 - RNA, 64 nt, hsa; identical to SEQ ID NO: 175879

SEQ ID NO: 337284 - RNA, 64 nt, hsa; identical to SEQ ID NO: 175880

SEQ ID NO: 337285 - RNA, 55 nt, hsa; identical to SEQ ID NO: 175881

SEQ ID NO: 337286 - RNA, 64 nt, hsa; identical to SEQ ID NO: 175882

SEQ ID NO: 337287 - RNA, 64 nt, hsa; identical to SEQ ID NO: 175883

SEQ ID NO: 337288 - RNA, 64 nt, hsa; identical to SEQ ID NO: 175884

SEQ ID NO: 337289 - RNA, 64 nt, hsa; identical to SEQ ID NO: 175885

SEQ ID NO: 337290 - RNA, 64 nt, hsa; identical to SEQ ID NO: 175886

SEQ ID NO: 337291 - RNA, 64 nt, hsa; identical to SEQ ID NO: 175887

SEQ ID NO: 337292 - RNA, 64 nt, hsa; identical to SEQ ID NO: 175888

SEQ ID NO: 337293 - RNA, 64 nt, hsa; identical to SEQ ID NO: 175889

SEQ ID NO: 337294 - RNA, 64 nt, hsa; identical to SEQ ID NO: 175890

SEQ ID NO: 337295 - RNA, 64 nt, hsa; identical to SEQ ID NO: 175891

SEQ ID NO: 337296 - RNA, 64 nt, hsa; identical to SEQ ID NO: 175892

SEQ ID NO: 337297 - RNA, 64 nt, hsa; identical to SEQ ID NO: 175893

SEQ ID NO: 337298 - RNA, 64 nt, hsa; identical to SEQ ID NO: 175894

SEQ ID NO: 337299 - RNA, 64 nt, hsa; identical to SEQ ID NO: 173405

SEQ ID NO: 337300 - RNA, 64 nt, hsa; identical to SEQ ID NO: 173406

SEQ ID NO: 337301 - RNA, 64 nt, hsa; identical to SEQ ID NO: 173407

SEQ ID NO: 337302 - RNA, 64 nt, hsa; identical to SEQ ID NO: 173408

SEQ ID NO: 337303 - RNA, 64 nt, hsa; identical to SEQ ID NO: 173409

SEQ ID NO: 337304 - RNA, 64 nt, hsa; identical to SEQ ID NO: 173410

SEQ ID NO: 337305 - RNA, 64 nt, hsa
cagggcagugcugcugcagagcuagaaggcccugcagcuacagcugcuucauucccugcauuag

SEQ ID NO: 337306 - RNA, 64 nt, hsa
uacacugagcgggcuacagagcuagaaggcccugcagcuacagcugcuucauucccugcauuag

SEQ ID NO: 337307 - RNA, 64 nt, hsa
cuuggcuuuagccagugccgaagaggagcaggcacagcuacaugggcagcugaaggagcaaagg

SEQ ID NO: 337308 - RNA, 64 nt, hsa
ggagcccccagcagggcccuccgagguggagcagcagcuacaagcagaggcugaacaccugcgg

SEQ ID NO: 337309 - RNA, 64 nt, hsa
ggagcccccagcagggcccuccgagguggaacagcagcuacaagcagaggcugaacaccugcgg

SEQ ID NO: 337310 - RNA, 64 nt, hsa
cccccuuucuaccaccccccuccacacuucacgucagcuacauaguuuccacaggguaauucac

SEQ ID NO: 337311 - RNA, 64 nt, hsa
acgcugcagaaaugagcuggagcucauggguuuucagcuacauuuuucauaacuuuguaguaca

SEQ ID NO: 337312 - RNA, 64 nt, hsa
acccagcuaaagucaccugccuguucuaaaggcccagcuacagccaaucagccgauuuccugag

SEQ ID NO: 337313 - RNA, 64 nt, hsa
uggacagacuguuucucaguuauuuccagagacccagcuacaguucccuggcuguuucuagaga

SEQ ID NO: 337314 - RNA, 64 nt, hsa
guaccaauuuacuguauuaguccguuuucacgcugcugauaaagacauacccgagacugggaag

SEQ ID NO: 337315 - RNA, 64 nt, hsa
gcuucaagcaucuguauuagucuguauuaaugcugcugauaaagacguacccgagacugggaag

SEQ ID NO: 337316 - RNA, 64 nt, hsa
gguucuuuuucuuuucuaugauacacacagccacgcugauaauaugcaaaugaacauuuuccuu

SEQ ID NO: 337317 - RNA, 64 nt, hsa
aguagaaugugugguuuuugcaaaugcuuuaacagcugauaaaaauuuuacauuuguaaaauua

SEQ ID NO: 337318 - RNA, 64 nt, hsa
gauuccuucaacuggcuacugagucaugauccuugcugauaaauauaaccaucaauaaagaagc

SEQ ID NO: 337319 - RNA, 64 nt, hsa
uaucaauucaccagccuccuuguucccuguggcugcugauaacccaacauuccaucucuacccu

SEQ ID NO: 337320 - RNA, 64 nt, hsa
uauauaucugguuguauuagucuguuuucacgcugcugauaaagacauaccugagaccaggaag

SEQ ID NO: 337321 - RNA, 64 nt, hsa
uuagcaguuuacuguauuagucuguuuucacacugcugauaaagacauuccucaagauugugaa

SEQ ID NO: 337322 - RNA, 64 nt, hsa
uaggaugugacuugcguuuugaguagaggggaaggcugauaacggcguaagaugaaguggcccu

SEQ ID NO: 337323 - RNA, 64 nt, hsa
uaggccacacucuauuucaaggcauuuucuuucagcugauaagguguccuccugaagccaagua

SEQ ID NO: 337324 - RNA, 64 nt, hsa
ugggauuacaggcaugagccaccgugccgagccuuccuugaaguuuuuuguuugguuuugauuu

SEQ ID NO: 337325 - RNA, 64 nt, hsa
cugagauagcaggugugagucaucaugcccagccuccuugaaguuuacuaacaauugggauaac

SEQ ID NO: 337326 - RNA, 64 nt, hsa
aguacucuggauguaaaagcucaaaaauugugauuccuugaacguucacuaaaucuucaagcaa

SEQ ID NO: 337327 - RNA, 64 nt, hsa
auuaaucagauuugaaugaggaaugcuucccacauccuugaaagaaaaacuguggcuuacguuu

SEQ ID NO: 337328 - RNA, 64 nt, hsa
ggaauaauauaauugguauggccauuagguucaguccuugaagauaagaaacuuguucucuguu

SEQ ID NO: 337329 - RNA, 64 nt, hsa
uuuagcugaucucauccuaagcaugcuuuauuuuuccuugaaagcuagguauuuaucaacugca

SEQ ID NO: 337330 - RNA, 64 nt, hsa
uuagugaauaauuaaaguacaaacugcuuugaccuccuugaacuuuuccaagcaauuucucugu

SEQ ID NO: 337331 - RNA, 64 nt, hsa
gcucauuaauauuucaagauaaagaacaaauguuuccuugaaugcuugcuuuuguguguuagca

SEQ ID NO: 337332 - RNA, 64 nt, hsa
cacagugagacuccaccucaaaaaaaaaaaaaaauccuugaacuaaugacucaaauuuucaaau

SEQ ID NO: 337333 - RNA, 64 nt, hsa
uaaaggcaaugagaaacaagcagaauuccaggaguccuugaagcagagggcacuggaagacaau

SEQ ID NO: 337334 - RNA, 64 nt, hsa
uccuugaaaauucauaucauaaagucaguuguauuccuugaagcuaucaucguguguacuuggc

SEQ ID NO: 337335 - RNA, 57 nt, hsa
auucuucaaaauccauauaagauacguuccuugaaaauucauaucauaaagucaguu

SEQ ID NO: 337336 - RNA, 64 nt, hsa
uaaauggaaaaaccuauuagguaaauggaaauaauccuugaaaauaguuuuugauguuuuguga

SEQ ID NO: 337337 - RNA, 64 nt, hsa
ugagguaaagaaaauaauuuucaaauugcagacuuccuugaaaggcucaagacuguagcauggu

SEQ ID NO: 337338 - RNA, 64 nt, hsa
ucuacuuuuucaaaugauaugcuguagaaaauauuccuugaagaugugagauuuaaaaauuuuu

SEQ ID NO: 337339 - RNA, 64 nt, hsa
accugauuggaccguguccaaugugcggaagauuuccuugaaaucuucucaagcucuuaugacu

SEQ ID NO: 337340 - RNA, 64 nt, hsa
cuuuaaugggagaauuuucaauuugccaauuuuuuccuugaauggguuuaaguaugcuacaaua

SEQ ID NO: 337341 - RNA, 64 nt, hsa
gagaagguucaagagauucauaagauugucaaacuccuugaagguucagaaccucugcagggaa

SEQ ID NO: 337342 - RNA, 64 nt, hsa
auaccuuuucuuuaccuagaagugccauccauuguccuugaauuauuaugauuaaaguuacugu

SEQ ID NO: 337343 - RNA, 64 nt, hsa
auuaugauuaaaguuacuguugcauuuaggaggcuccuugaaaguaacaccuuuuccaaggaca

SEQ ID NO: 337344 - RNA, 64 nt, hsa
gggaggcuuccccucacuauccuaccccacccgcuccuugaagggcccagauucuaccacacag

SEQ ID NO: 337345 - RNA, 59 nt, hsa
acucuuuggagaugagcuaggauggagaguccuugaaccugaacuuacacaaauuugcc

SEQ ID NO: 337346 - RNA, 64 nt, hsa
gauacuggacuucuuaccaauccggagguuuccuuccuugaaugucaguguguaaaccuggcug

SEQ ID NO: 337347 - RNA, 64 nt, hsa
uccuaauuauaaaagcugcuuuuuugcagaacauuccuugaaaauauaagguuuugaaaagaca

SEQ ID NO: 337348 - RNA, 64 nt, hsa
cacaaacuagaaaaccuagaaaaaauuaauaaauuccuugaaagauauaaccccccaagauuga

SEQ ID NO: 337349 - RNA, 64 nt, hsa
uccugcaacaugcaguugacccauguacacauacuccuugaaccuaaaauaaaacaugaaaaaa

SEQ ID NO: 337350 - RNA, 64 nt, hsa
aagaaaaaaauaauuaaaaaagaaacagugcucaugucauaagcuauguugacaguugccagug

SEQ ID NO: 337351 - RNA, 64 nt, hsa
ggguaguucuugcuccaguaagaggaaucuuaguugucauaaucccuuggagccuggguuuuug

SEQ ID NO: 337352 - RNA, 64 nt, hsa
uugauuuaaaggauuagagaaaucuacaaauguaugucauaaauaagcaaauuuguaaacuuuu

SEQ ID NO: 337353 - RNA, 64 nt, hsa
uaggugagaugauaugaaaaacaaauuuucucacugucauaaaaggcucuaauuaugguuacuu

SEQ ID NO: 337354 - RNA, 64 nt, hsa; identical to SEQ ID NO: 194715

SEQ ID NO: 337355 - RNA, 64 nt, hsa; identical to SEQ ID NO: 194716

SEQ ID NO: 337356 - RNA, 64 nt, hsa; identical to SEQ ID NO: 194717

SEQ ID NO: 337357 - RNA, 64 nt, hsa; identical to SEQ ID NO: 194718

SEQ ID NO: 337358 - RNA, 64 nt, hsa; identical to SEQ ID NO: 194719

SEQ ID NO: 337359 - RNA, 64 nt, hsa; identical to SEQ ID NO: 194720

SEQ ID NO: 337360 - RNA, 64 nt, hsa; identical to SEQ ID NO: 194721

SEQ ID NO: 337361 - RNA, 64 nt, hsa; identical to SEQ ID NO: 194722

SEQ ID NO: 337362 - RNA, 64 nt, hsa; identical to SEQ ID NO: 194723

SEQ ID NO: 337363 - RNA, 64 nt, hsa; identical to SEQ ID NO: 194724

SEQ ID NO: 337364 - RNA, 64 nt, hsa; identical to SEQ ID NO: 194725

SEQ ID NO: 337365 - RNA, 64 nt, hsa; identical to SEQ ID NO: 194726

SEQ ID NO: 337366 - RNA, 64 nt, hsa; identical to SEQ ID NO: 194727

SEQ ID NO: 337367 - RNA, 64 nt, hsa; identical to SEQ ID NO: 194728

SEQ ID NO: 337368 - RNA, 64 nt, hsa; identical to SEQ ID NO: 194729

SEQ ID NO: 337369 - RNA, 64 nt, hsa; identical to SEQ ID NO: 194730

SEQ ID NO: 337370 - RNA, 64 nt, hsa; identical to SEQ ID NO: 194731

SEQ ID NO: 337371 - RNA, 64 nt, hsa; identical to SEQ ID NO: 194732

SEQ ID NO: 337372 - RNA, 64 nt, hsa; identical to SEQ ID NO: 194733

SEQ ID NO: 337373 - RNA, 64 nt, hsa; identical to SEQ ID NO: 194734

SEQ ID NO: 337374 - RNA, 64 nt, hsa; identical to SEQ ID NO: 194735

SEQ ID NO: 337375 - RNA, 64 nt, hsa; identical to SEQ ID NO: 194736

SEQ ID NO: 337376 - RNA, 64 nt, hsa; identical to SEQ ID NO: 194737

SEQ ID NO: 337377 - RNA, 64 nt, hsa; identical to SEQ ID NO: 194738

SEQ ID NO: 337378 - RNA, 64 nt, hsa; identical to SEQ ID NO: 194739

SEQ ID NO: 337379 - RNA, 64 nt, hsa; identical to SEQ ID NO: 194740

SEQ ID NO: 337380 - RNA, 64 nt, hsa; identical to SEQ ID NO: 194741

SEQ ID NO: 337381 - RNA, 64 nt, hsa; identical to SEQ ID NO: 194742

SEQ ID NO: 337382 - RNA, 64 nt, hsa; identical to SEQ ID NO: 194743

SEQ ID NO: 337383 - RNA, 64 nt, hsa; identical to SEQ ID NO: 194744

SEQ ID NO: 337384 - RNA, 64 nt, hsa; identical to SEQ ID NO: 194745

SEQ ID NO: 337385 - RNA, 64 nt, hsa; identical to SEQ ID NO: 194746

SEQ ID NO: 337386 - RNA, 64 nt, hsa; identical to SEQ ID NO: 194747

SEQ ID NO: 337387 - RNA, 64 nt, hsa; identical to SEQ ID NO: 46031

SEQ ID NO: 337388 - RNA, 64 nt, hsa; identical to SEQ ID NO: 46032

SEQ ID NO: 337389 - RNA, 64 nt, hsa; identical to SEQ ID NO: 46033

SEQ ID NO: 337390 - RNA, 64 nt, hsa; identical to SEQ ID NO: 46034

SEQ ID NO: 337391 - RNA, 64 nt, hsa
gccuguaacaaaucucauuuuuguuaccaagaacuguaugaaagaaguaaauccaccccgauuc

SEQ ID NO: 337392 - RNA, 64 nt, hsa
uuguauaaacacuaacauuuuccccuucuguaguuguaugaaaaaacaaauauuguuagcauag

SEQ ID NO: 337393 - RNA, 64 nt, hsa
aacugugaaauaauaaggccgauuuucauauaaauguaugaaaaucaaccauguuuucucucac

SEQ ID NO: 337394 - RNA, 64 nt, hsa
cuguauauguaauaagguuuauuucugugaguuuuguaugaaaaucagccucauuauuuauagu

SEQ ID NO: 337395 - RNA, 64 nt, hsa
agccuucauucuguugcaauuaaguuuuaguacuuguaugaaaggugugaauuagaaagucaca

SEQ ID NO: 337396 - RNA, 64 nt, hsa
aaauuacaguguaguguuuauucuaaggaagauauguaugaauguauauacaaagacucagcua

SEQ ID NO: 337397 - RNA, 64 nt, hsa
auuguguggcagugauuggucuguuuguggagaauguaugaaagcuauuaauauucuagaauag

SEQ ID NO: 337398 - RNA, 64 nt, hsa
auaucguucucaauucuauagacuuucaagccuauguaugaauaugaagggguuuuuuuuuuuu

SEQ ID NO: 337399 - RNA, 64 nt, hsa
aagguuuugucccauuuguugcccuugaauuauuuguaugaauuauauguuccagugaaaaugg

SEQ ID NO: 337400 - RNA, 64 nt, hsa
guuccacccucgugauuguauagggcucuucuccuguaugaacucugagaucagugagcucuga

SEQ ID NO: 337401 - RNA, 64 nt, hsa
auaaaguauauauauacauauauauauauauauauguaugaaacccgcauggaauuaucuguau

SEQ ID NO: 337402 - RNA, 64 nt, hsa
auauauauauguaugaaacccgcauggaauuaucuguaugaaaucaaggugcgcuguggaaaca

SEQ ID NO: 337403 - RNA, 64 nt, hsa
gaugauaugauugacugaugcgcaguccagagcauguaugaauaaucucauaaaacaguaucac

SEQ ID NO: 337404 - RNA, 64 nt, hsa
guuguugguuuuuugauuuuagcauauuauuuccuguaugaaauauguuuuauauaaucuccua

SEQ ID NO: 337405 - RNA, 64 nt, hsa
cauaauucccuugaaauccauccaaguuguugcauguaugaauaguuucuuccuuuuuuucuuu

SEQ ID NO: 337406 - RNA, 64 nt, hsa
cuccaucucuguaauuuugucauuucaagaauguuguaugaauggaaucauacagaauguaauc

SEQ ID NO: 337407 - RNA, 64 nt, hsa
cccccuaaaaaugguaaaucugaucauaucuacauguaugaacuuaacauggaaaauguuaagg

SEQ ID NO: 337408 - RNA, 64 nt, hsa
guaauacugaagagaggggucugcagaaaggauguguaugaagcuuagauaauaauggcuguuu

SEQ ID NO: 337409 - RNA, 64 nt, hsa
uaggugagacucuguuucuguuauuuuuaauugcuguaugaaaugugaucagauuauuuuacua

SEQ ID NO: 337410 - RNA, 64 nt, hsa
uucccuuaaaaaaaaaugacacuuggaagaaaaauguaugaaauucagaaauuccgaucaaaga

SEQ ID NO: 337411 - RNA, 64 nt, hsa
agcucauaauaaugaaaaaaauagaauuauauuuuguaugaauuguuucuaacaaaccuugauc

SEQ ID NO: 337412 - RNA, 64 nt, hsa
aauuuacaagcaaaagaugacaugacgugacaccuguaugaaaaugugaugauugaacucccug

SEQ ID NO: 337413 - RNA, 64 nt, hsa
uuuccugcauauauauguaugaagggcauguauauguaugaaugagcaaacauauuugaaaguu

SEQ ID NO: 337414 - RNA, 64 nt, hsa
guguaugaaugaacauacauuuccugcauauauauguaugaagggcauguauauguaugaauga

SEQ ID NO: 337415 - RNA, 64 nt, hsa
uuuaagaguauaaauagaagggagaguguauauguguaugaaugaacauacauuuccugcauau

SEQ ID NO: 337416 - RNA, 64 nt, hsa
uuuaacaucagaaaaauguauacuggggaaaaguuguaugaagguggugaacaugggagacuuu

SEQ ID NO: 337417 - RNA, 64 nt, hsa
aggaaucuccugcaaacuccuacaggagaaaaguuguaugaauguggaaacuuuagaaauugaa

SEQ ID NO: 337418 - RNA, 64 nt, hsa
aacaauaaaagaauuacacacuaggaaauagaacauaaccaauacuuucgaguccucccugugu

SEQ ID NO: 337419 - RNA, 64 nt, hsa
guauggauuuuuaaaaauucuugucucuacuauuauaaccaaaaaauauuucuuguauguccca

SEQ ID NO: 337420 - RNA, 64 nt, hsa
uggacuaaugaaaugguguuguugauaaucuaaaauaaccaauaauccaaaaaaguucauuuua

SEQ ID NO: 337421 - RNA, 64 nt, hsa
uaaugaucauauauuaccuuuguaauaaaacauuauaaccaaaacauucuguuuaccuuuucag

SEQ ID NO: 337422 - RNA, 64 nt, hsa
aauacuaagauuuguagguuauaaucuaguucacauaaccaauagaaaguguccuauuuuauau

SEQ ID NO: 337423 - RNA, 64 nt, hsa
gucuuggggucugaaugacuuggggccuccauucauaaccaaaguuguaggggcauggaggcag

SEQ ID NO: 337424 - RNA, 64 nt, hsa
ggaacagucuguccuuacagagcugcaauaagaaauaaccaaagaugaagcuggucaaauauuu

SEQ ID NO: 337425 - RNA, 64 nt, hsa
cguggaauggcuacugcugacuaacaugaugcacauaaccaaaugggggccaauggcacaguac

SEQ ID NO: 337426 - RNA, 64 nt, hsa
agagaugccagcagccucugucgcccuuagucauauaaccaaaauccagaccuuauccacaacc

SEQ ID NO: 337427 - RNA, 64 nt, hsa
auagacaaaguaaaaagacagauauuuaagaggcauaaccaaaaaagcaaaacuuguaaacaga

SEQ ID NO: 337428 - RNA, 64 nt, hsa
agcuuugaaauacaauuagguuuuugagauuuuuauaaccaaauacauuucaguguaacauauu

SEQ ID NO: 337429 - RNA, 64 nt, hsa
aaaaaaauucauuaauugcuucuuaacucuuauuauaaccaagcaauuuaauuacaauuguuaa

SEQ ID NO: 337430 - RNA, 64 nt, hsa
ccucuguaauuucaacagagaucagcaaauaaauauaaccaaagauuguccauuacuccccaaa

SEQ ID NO: 337431 - RNA, 64 nt, hsa
cuugggaguugucuuugugguuucaaaaguguaaauaaccaauucagaaaacaaaauggaaaaa

SEQ ID NO: 337432 - RNA, 64 nt, hsa
acccccauggguuuugcuuaggcacucauggguaauaaccaagauggagucccuuuggcaaaac

SEQ ID NO: 337433 - RNA, 64 nt, hsa
gugugccauuuaaaaauccaggccagauccuauuauaaccaacucucaggauuuacagccuuca

SEQ ID NO: 337434 - RNA, 64 nt, hsa
uuauuuggcaaauaacugagccaaccagaauaaaauaaccaauacuccacugcucauauuuuua

SEQ ID NO: 337435 - RNA, 64 nt, hsa
acuaggcuuucuucacacaugcuuauauccuuuaauaaccaauugccaaccacggcuauaagau

SEQ ID NO: 337436 - RNA, 64 nt, hsa
ggagcccucccaccccacccccagauagagggaaauaaccaaaaaacuaccaaacaacagaaac

SEQ ID NO: 337437 - RNA, 64 nt, hsa
gcuuuguucauugcauuuauuaaacaaauguuguauaaccaauacuaaauguacuacugagcuu

SEQ ID NO: 337438 - RNA, 64 nt, hsa
uugcccucgugguggaaacuuuucuuaaaaaguuauaaccaacuuuucuauuaaaagugggaau

SEQ ID NO: 337439 - RNA, 64 nt, hsa
aaaugacucacugucguagaaggaaguuuauuauauaaccaagguuucagguauccuccuguca

SEQ ID NO: 337440 - RNA, 64 nt, hsa
ggccuucucaaugagcacauuaccuccaugaucaauaaccaagaggcugcagucaaauacugcu

SEQ ID NO: 337441 - RNA, 64 nt, hsa
aucaauuagaugccccgaaaucuacagucgcugaauaaccaauaaacaguaaccuccaucaaau

SEQ ID NO: 337442 - RNA, 64 nt, hsa
uucaaauaaaauuuuuauaaucggauucagacccauaaccaaacuauguugguaguagagaagc

SEQ ID NO: 337443 - RNA, 64 nt, hsa
augauauugugauguuucauacaaugcagugaacauaaccaacuuguuaccuaaauaaagaauu

SEQ ID NO: 337444 - RNA, 64 nt, hsa
uuuauauagcagcaaaagauaagaauaaaaucacauaaccaaguugaagcuuccuuggcaaagc

SEQ ID NO: 337445 - RNA, 64 nt, hsa
uuauuuuucaaaugaguauuuaaugaaaguauacauaaccaauguuggguauacagaugcuucu

SEQ ID NO: 337446 - RNA, 64 nt, hsa
uguuaucugagcucuccuauauuaucauacucagauaaccaaauuaaaagaauuagaauaugau

SEQ ID NO: 337447 - RNA, 64 nt, hsa
uuaaaauuugggggaaaaagaaugcaggagugaaauaaccaagucaaaaccauguacuaucucc

SEQ ID NO: 337448 - RNA, 64 nt, hsa
uaccuuuugcuguuugcuguggcagauuccccagauaaccaaggaaaaggggccacccauaccu

SEQ ID NO: 337449 - RNA, 64 nt, hsa
uuacugcgacuaaacuuaauuuaauauuuacucuauaaccaaaugaaauauauuuaaaauauau

SEQ ID NO: 337450 - RNA, 64 nt, hsa
acucaaaugcaaacagacuuucccuagaggugaaauaaccaacguggaguuuuccuucccagaa

SEQ ID NO: 337451 - RNA, 64 nt, hsa
ugaccaggagcacacuaagguguggucaugcaucauaaccaacauucacucaucugggacauuc

SEQ ID NO: 337452 - RNA, 64 nt, hsa
cagugaaguuggaaccaaauaauguguagucucuauaaccaauaccuuuguuuucauguguaag

SEQ ID NO: 337453 - RNA, 64 nt, hsa
uuaagacgugauuuugcuguagaagauggcacuuauaaccaaagcccaaagugguauagaaaug

SEQ ID NO: 337454 - RNA, 64 nt, hsa
guguauggucucuuuuguucagaauuuaaaacugauaaccaaugaaagccuuuucucuuauucc

SEQ ID NO: 337455 - RNA, 64 nt, hsa
uguuaauauucuuucaauaacgaaguugggcaauauaaccaauguuuaaaaaaguuuaaaaugu

SEQ ID NO: 337456 - RNA, 64 nt, hsa
ucgaugaaggaauaucucuucucagaaggaaagaauaaccaacacccugagguuguguguggaa

SEQ ID NO: 337457 - RNA, 64 nt, hsa
uucauuuauuuuuuuuagaauugggauuaugaaaauaaccaaagaguauagaacuuaauaagug

SEQ ID NO: 337458 - RNA, 64 nt, hsa
auauagcuuuucauuaguggggauuuugucaauuauaaccaaaaacaaugugacggauacccaa

SEQ ID NO: 337459 - RNA, 64 nt, hsa
ggcuggaugaggaagucauuuaggaaauguucaaauaaccaauauguggaaauggacacaggga

SEQ ID NO: 337460 - RNA, 64 nt, hsa
uauaugcacauagaagggggacuucuaggaauuuauaaccaaaauuuuaaaacuauuuuuauau

SEQ ID NO: 337461 - RNA, 64 nt, hsa
auuguaauuuuaaugucugcuuagcaccccacugauaaccaaaucacaguuuauuuaaauaauu

SEQ ID NO: 337462 - RNA, 64 nt, hsa
gaggucccaacaggagucaggaagagguuugauuauaaccaagaaaacucacuaugcuaggaau

SEQ ID NO: 337463 - RNA, 64 nt, hsa
gggaaauguaguaaccuaguuaguagucuucaauauaaccaauuguacaaggggaagugguguu

SEQ ID NO: 337464 - RNA, 64 nt, hsa
aaguaucucugaauguauccaggagaggaacugcauaaccaaaggggugaccagcccucagaug

SEQ ID NO: 337465 - RNA, 64 nt, hsa
uuuacuuucuaaauacaaucauauuaggggaaaaauaaccaaaaguaggagaaacagugagaug

SEQ ID NO: 337466 - RNA, 51 nt, hsa
guuggagauccaagcuaugaaauaaccaacaguauucaagaagcaaccagc

SEQ ID NO: 337467 - RNA, 64 nt, hsa
ggaccaguugaucagaacugaucuuauuggucugauaaccaaucuuauuugugaacugauucau

SEQ ID NO: 337468 - RNA, 64 nt, hsa
gagugcuaaggaagcauaucaauuccaauauuuuauaaccaaagcucuaucagaacauauuuau

SEQ ID NO: 337469 - RNA, 64 nt, hsa
accacccaacccggugguuaacgauuuaauacauauaaccaaaccggcagcguuuagaguuggg

SEQ ID NO: 337470 - RNA, 64 nt, hsa
uccaauuuuuaaugucgaauuuuuuucuaacacaauaaccaaaagcuuuuauuuauaaaaaggc

SEQ ID NO: 337471 - RNA, 64 nt, hsa
uauaaccguuuaaaaucaacaauguugauuuuagauaaccaaguaaguauuauaauacaaaaua

SEQ ID NO: 337472 - RNA, 64 nt, hsa
acuguaauauuccacuguaugguccacaguguauauaaccaacaacucaccguugcgcauguag

SEQ ID NO: 337473 - RNA, 64 nt, hsa
aauguaauaagaacaagggaacauguaaacuaacauaaccaauugucaguucuccauguauucc

SEQ ID NO: 337474 - RNA, 64 nt, hsa
aaauaaagaaaagcauuaaggacuuaaagcaacaauaaccaaauaaaaacuugauaggaucuuu

SEQ ID NO: 337475 - RNA, 64 nt, hsa
ccuuuuguucuuaaacuuucagauguguccuuugauaaccaaauucugucacucaagacacaga

SEQ ID NO: 337476 - RNA, 64 nt, hsa
uaguuguagauccuugucauuuugcuguuugaaaauaaccaauguguuuucuaaaacugucgug

SEQ ID NO: 337477 - RNA, 64 nt, hsa
uugcauaugaauuguaaaauguaaauacauuuuuauaaccaauguuuugaucuuauugaauguu

SEQ ID NO: 337478 - RNA, 64 nt, hsa
cgcuaugggauacuggcaaaagugcacauauuucauaaccaaauuaguagcaccagucuuaauu

SEQ ID NO: 337479 - RNA, 64 nt, hsa
gggagacauucuuaugcaucauuugguuuguuuuauaaccaauucauuaaauguaauucauaaa

SEQ ID NO: 337480 - RNA, 64 nt, hsa
aauaaaaaucuauaugacuuuuuauuauugugugauaaccaaguaaauguuuucuauuuugcau

SEQ ID NO: 337481 - RNA, 64 nt, hsa
gagaacugaacccuuacaaacuuuguuuucccucauaaccaaagcuucagguuagaaguuuaga

SEQ ID NO: 337482 - RNA, 64 nt, hsa
gaauggguaacucuucuugauuaaaaguuauguaauaaccaaaugcaaugugaaauauuuuacu

SEQ ID NO: 337483 - RNA, 64 nt, hsa; identical to SEQ ID NO: 337482

SEQ ID NO: 337484 - RNA, 50 nt, hsa
ucuguuugucuggucuuugaauaaccaacccagugauuuacaugcugaua

SEQ ID NO: 337485 - RNA, 64 nt, hsa
uaaaagaacauauuuuaagagacagaacuuagacauaaccaaguaguuguauaccugauuguaa

SEQ ID NO: 337486 - RNA, 64 nt, hsa
caaaucaauucuagucauauauuaaacauccacaauaaccaagauauuuuuaucccaagaaugc

SEQ ID NO: 337487 - RNA, 64 nt, hsa
uauuuuuuguaugcuuaaauaaaaauaaaaauucauaaccaaagagaaucccacauuagcuugu

SEQ ID NO: 337488 - RNA, 64 nt, hsa
uccauagugacguccugaagagccagucuguaaaauaaccaaccacuuacuuagcguuuggaua

SEQ ID NO: 337489 - RNA, 64 nt, hsa
acuucauagaacaaaaaucacucaaaaccuguuuauaaccaaagaauucaugaaaaagaaagcc

SEQ ID NO: 337490 - RNA, 64 nt, hsa
cuauuucugugaguuuuaaaguaggcaagggauaauaaccaaagaagaaaauuucaugaagacu

SEQ ID NO: 337491 - RNA, 64 nt, hsa
uagcauaacuguagcucaaguuuaaaagccauguauaaccaagugugcucuuuuuuuaaaaggu

SEQ ID NO: 337492 - RNA, 64 nt, hsa
acuuggacuugguugcuaaauuuaacuuacacuaauaaccaauuauaaguuccaaauguguuuu

SEQ ID NO: 337493 - RNA, 64 nt, hsa
auacagcucucuucagaguaacugugaaccuuuuauaaccaacacuagaguuaguuuuaaaaga

SEQ ID NO: 337494 - RNA, 64 nt, hsa
uacuuguaccuauauuaauuaugcuuacgccaugauaaccaauauacagauauauuaauuggaa

SEQ ID NO: 337495 - RNA, 64 nt, hsa
aacaaauguguugucauuguuggcaacauacaagauaaccaagaagcuggagucuguucugugu

SEQ ID NO: 337496 - RNA, 64 nt, hsa
uugucugaauuauaaacacuuugagguaccaaacauaaccaaucugugcaacaacauagacuga

SEQ ID NO: 337497 - RNA, 64 nt, hsa
ugaaauguucuguaauucccagagucuuccauaaauaaccaaauggucucauacacguacaaua

SEQ ID NO: 337498 - RNA, 64 nt, hsa
aagacugcuugcuaguaggaaaaaauuucaaauaauaaccaaagcugaaaaauggucugucaua

SEQ ID NO: 337499 - RNA, 64 nt, hsa
cauuuauuguccucaaaauugcuuauggccauguauaaccaauuaauucugaguuuccaaaauc

SEQ ID NO: 337500 - RNA, 64 nt, hsa
auacagaggauaaagaaguuaauggcaugguggaauaaccaaaauguguaucauucuacaaaaa

SEQ ID NO: 337501 - RNA, 64 nt, hsa
gacuuuuugagggaagugugauauauuaacaaauauaaccaauucuaaauuuguuuuagcucua

SEQ ID NO: 337502 - RNA, 64 nt, hsa
ucaaacauaaaguuuaaugugauggaggccccaaauaaccaaacgcguaaguacauaugucagg

SEQ ID NO: 337503 - RNA, 64 nt, hsa
cugagaaauccagcccugugggaacuggugucuuauaaccaaguuggauaccuguguauagcuu

SEQ ID NO: 337504 - RNA, 64 nt, hsa
gugcuuuuucuguggucuuuugcaucucaggaagauaaccaacaguaaucccuugaaaagaaac

SEQ ID NO: 337505 - RNA, 64 nt, hsa
uacuaauuuaaguuuuaaauauuguguuuauaaaauaaccaacuaauaaccauuugucuuuccc

SEQ ID NO: 337506 - RNA, 64 nt, hsa
cuaaugggaagaccaaaauuacuaauaaauugacauaaccaacauuaaaacucauaauuauuuu

SEQ ID NO: 337507 - RNA, 64 nt, hsa
uauugcugucaauuccaauaauaauucuuagcuuauaaccaaagagcaguguuuaaaaggagag

SEQ ID NO: 337508 - RNA, 64 nt, hsa
acgcguguucuguaaucaaacugcaaauauugucauaaccaacauccaaaaugacggcugcuau

SEQ ID NO: 337509 - RNA, 64 nt, hsa
uuuguuuuuauauggaaagaugucaacuauagccauaaccaauaaaauaaaaacugaugaggca

SEQ ID NO: 337510 - RNA, 64 nt, hsa
uucugagcagagccaccauuuuuuauaauuucuaauaaccaacuccagaacuaggagcugauca

SEQ ID NO: 337511 - RNA, 64 nt, hsa
uucucccaccuuaguugguuacagggugagugagauaaccaaugccaaacuuuuugaagucuaa

SEQ ID NO: 337512 - RNA, 64 nt, hsa
uaaauuggaauccuaaccuuauauagacuuguuaauaaccaauucauaaacaaauaaauggcuu

SEQ ID NO: 337513 - RNA, 64 nt, hsa
uaugucuguugaagacgagcagagauauuaaauuauaaccaacuuucaauuuccugugcuaauu

SEQ ID NO: 337514 - RNA, 64 nt, hsa
ugugguguguugcagauuuauuuggccauuuagaauaaccaaaucaaucuggcuaacuaggaau

SEQ ID NO: 337515 - RNA, 64 nt, hsa
aacuagguaucuuauggugagauggugggaugugauaaccaagauguaaguauuacauuuuucu

SEQ ID NO: 337516 - RNA, 64 nt, hsa
uaauucagcaaguaccaacuuguguagcugcagaauaaccaaguggcuauccagucaaguaaau

SEQ ID NO: 337517 - RNA, 64 nt, hsa
guuuuuuuuuccugaugaaagcacagccuaacugauaaccaagauggguuuuauccucaaauau

SEQ ID NO: 337518 - RNA, 64 nt, hsa
acagaaucucaguguauucucaaaguaaaaaggcauaaccaagcacucucuuaucuugccuuau

SEQ ID NO: 337519 - RNA, 64 nt, hsa
aaaggacagaaucucucccccacucccuugccccauaaccaaacauaagcuagcuagucuuguc

SEQ ID NO: 337520 - RNA, 64 nt, hsa
uaugaaaugucucaucagaccugacaugucugagauaaccaaggugauucaggauuugaucaaa

SEQ ID NO: 337521 - RNA, 64 nt, hsa
uuaauggauauacauccucacagaaaaguuggaaauaaccaaaacugaagucuuaauuuaccuu

SEQ ID NO: 337522 - RNA, 64 nt, hsa
cugaagaaucauaggaagaguagacauuuuauuuauaaccaaugauauuucaguauauauuuuc

SEQ ID NO: 337523 - RNA, 64 nt, hsa
auuuuuguacaaggcuaaaaugucuuucccauccauaaccaaguccuccuauggguacauaaac

SEQ ID NO: 337524 - RNA, 64 nt, hsa
cacuauucaauuuuuuuuuguaaagaauguauuuauaaccaacauuuuguugcuuuuuuuuuua

SEQ ID NO: 337525 - RNA, 64 nt, hsa
guuuuuuuuuucuuguuuccuuauaaaacagguaauaaccaaucauuuuguguuuguauuucca

SEQ ID NO: 337526 - RNA, 64 nt, hsa
auaagggaaacuuuagcuugaggguuuaaggaacauaaccaaaguucacaaacauaacgaguga

SEQ ID NO: 337527 - RNA, 64 nt, hsa
aauuugaaaagaccucccauuuguggcuuuguacauaaccaacaggcagauacugagugccuug

SEQ ID NO: 337528 - RNA, 64 nt, hsa
cauuuuuucauauucugaagucucaccacacauaauaaccaagugguagacucacagccgucca

SEQ ID NO: 337529 - RNA, 64 nt, hsa
ucucuaguaaaugcagcuagauucaaaugggcugauaaccaaauuuuaacacaucagcauucac

SEQ ID NO: 337530 - RNA, 64 nt, hsa
cauccuguucugacagcuugauaacauuccuguuauaaccaaggauggaaguguacaccagucc

SEQ ID NO: 337531 - RNA, 64 nt, hsa
uaaauaucauccuuugucuuuccauaugguuuucauaaccaaauacaugacuauagcaugguua

SEQ ID NO: 337532 - RNA, 64 nt, hsa
ccuuugaaguaaaaaggagaucacuuuuuaccaaauaaccaaaaauuuuuagucugucaaagug

SEQ ID NO: 337533 - RNA, 64 nt, hsa
auaaauucaacacuuauuuucugaauucauaaaaauaaccaaaaaaugugagcuauaauguuuc

SEQ ID NO: 337534 - RNA, 64 nt, hsa
uacagugaaaauguugucucuuuacaaccaauugauaaccaaucacauaguuuuaucaguguau

SEQ ID NO: 337535 - RNA, 64 nt, hsa
ucguaggugggcuuuuccuaucagagcuuggcucauaaccaaauaaaguuuuuugaaggccaug

SEQ ID NO: 337536 - RNA, 64 nt, hsa
cagucuuaagcucuguccaccuucaagucaauucauaaccaaguuuuugaacgcugcuaugaau

SEQ ID NO: 337537 - RNA, 64 nt, hsa
ccagccccacagauuuuauuuuugcacauaagccauaaccaauccucaaggcuggcacaggcuu

SEQ ID NO: 337538 - RNA, 64 nt, hsa
aaagucaagcuuaaauugaaguuuaaauucaucuauaaccaaaucaaaugaucagaggaaauuc

SEQ ID NO: 337539 - RNA, 64 nt, hsa
uuuuucauucucauuuaaaauauauugugcuaugauaaccaaccuucuuccaaggagugaccau

SEQ ID NO: 337540 - RNA, 64 nt, hsa
auuuguaaagcaacaugaaaaccuuugauaaaugauaaccaacagucuucuguccuaauuugca

SEQ ID NO: 337541 - RNA, 64 nt, hsa
cuuaauguaacuguacccuucugcauggaaaaucauaaccaacauggcugcaguagacuucuua

SEQ ID NO: 337542 - RNA, 64 nt, hsa
uauuuuaguuacagguuaggaagauggucuuuaaauaaccaaaaauauguuuauuuuuuauuau

SEQ ID NO: 337543 - RNA, 64 nt, hsa
aauuaaauuuuaacagaaaucuuuuaaguauguuauaaccaaaguguucaauuauccuugcaag

SEQ ID NO: 337544 - RNA, 64 nt, hsa
uuuguggaauacacuuuguuugcuucaugugcagauaaccaaaaaucauuuuaaaagauaucaa

SEQ ID NO: 337545 - RNA, 64 nt, hsa
uuaauauccacauguaaggccauuacacaaauaaauaaccaauguuaaaauucaaaugguuugu

SEQ ID NO: 337546 - RNA, 64 nt, hsa
auuuucaaauguuacuauauauuaaagcagaaauauaaccaaagguuaagcugucucggaucug

SEQ ID NO: 337547 - RNA, 64 nt, hsa
augaggaaauguaaauuaaauuaguuauaaauaaauaaccaaaaauguauguaaacauucaaau

SEQ ID NO: 337548 - RNA, 64 nt, hsa
ugcaaaggaaaauauuuucacaaaggguuaucugauaaccaaaaaaaaaaaagacauuucaucu

SEQ ID NO: 337549 - RNA, 64 nt, hsa
aaaugaucucugcaaacaaggugcuuuuuccagaauaaccaagauuaccugaguccaaguuuua

SEQ ID NO: 337550 - RNA, 64 nt, hsa
aaaaaugaaguguauuaaguaaauaaauaaguaaauaaccaaccaacccugaggaacaucuugu

SEQ ID NO: 337551 - RNA, 64 nt, hsa
acuuguuuuugguuuuuaaaacccaguccacaaaauaaccaauccuggacaugaagauucuuuc

SEQ ID NO: 337552 - RNA, 64 nt, hsa
aauaacacauauaguaacgugggaauacuaaaaaauaaccaagauuuuauauuuuuguaaauua

SEQ ID NO: 337553 - RNA, 64 nt, hsa
aauguuucuuuuguggugcuugaggcauauucauauaaccaaaguuugagaacugggaacuuca

SEQ ID NO: 337554 - RNA, 64 nt, hsa
uuauauucugaaagaaaaauaacugacauuauauauaaccaauuaauuuaaaguauugccauuu

SEQ ID NO: 337555 - RNA, 64 nt, hsa
ucugauuacucagaaacaugccccucuucccugaauaaccaagaacauguucuaugaacccaau

SEQ ID NO: 337556 - RNA, 64 nt, hsa
auuucugcuauuauuuuuaaagcaguauuauuuuauaaccaauucuaaaauucagcuuuaaaaa

SEQ ID NO: 337557 - RNA, 64 nt, hsa
aaggguccuuucuuugucaccagccaaggcauugauaaccaaguagccauuuuccucuuaaggu

SEQ ID NO: 337558 - RNA, 64 nt, hsa
aucauugugcuuaauaauaccaagacuaagcaccauaaccaagaaauacuaauguaaagauugu

SEQ ID NO: 337559 - RNA, 64 nt, hsa
aucuuuuaucauguuauccuaaaagugagaagacauaaccaagacauggaaauaaaugugaaag

SEQ ID NO: 337560 - RNA, 64 nt, hsa
cucauuaaaauuggaggaguuugcaugucucaugauaaccaaauguaagaugaaaauaaaagau

SEQ ID NO: 337561 - RNA, 64 nt, hsa
acccuccccuacucagacugagcagcagucccagauaaccaagcaagcucagcucugugggggc

SEQ ID NO: 337562 - RNA, 64 nt, hsa
cugaagaacaauaaacagaauuuuuugacuaagcauaaccaaauuucagaacagucuaaucaau

SEQ ID NO: 337563 - RNA, 64 nt, hsa
cucugcuggacaguggacuguucuauuuuuuucaauaaccaaaaagauuaaacaaaaaauacua

SEQ ID NO: 337564 - RNA, 64 nt, hsa
auugcuaucuaauggggaaauguagcuaugggccauaaccaaaacucacaugaaacggaggcag

SEQ ID NO: 337565 - RNA, 64 nt, hsa
gcugggaaguuaugaaugaagauaacauucacccauaaccaagagaacucagguagcugcauca

SEQ ID NO: 337566 - RNA, 64 nt, hsa
cuguucuuugacugcccacccacagaaaagcaaaauaaccaacuaccuacucaauuguguguuu

SEQ ID NO: 337567 - RNA, 64 nt, hsa
aagaaaugaacuuucagcagucuaaauuuucuaaauaaccaauaguugccaaucuaaaauggca

SEQ ID NO: 337568 - RNA, 64 nt, hsa
acggguaucucuuuucucucuucuaauuuucaguauaaccaaaaauuaucccagcaugagcacg

SEQ ID NO: 337569 - RNA, 64 nt, hsa
uuguuuaaauaaguaauauuuucaaaagaauaaaauaaccaaugauaucucuuggaauaaucug

SEQ ID NO: 337570 - RNA, 64 nt, hsa
ccuuacacuuguuucaugaagagaaaggacuugcauaaccaaaauaaacaaagcaagacaaauu

SEQ ID NO: 337571 - RNA, 64 nt, hsa
aaaaauuugggggaauccauauauaucuuuuuuaauaaccaaguaaauacuuuucauuucugag

SEQ ID NO: 337572 - RNA, 64 nt, hsa
cuguguuccuuuuacagcaaaagggacuuuuuauauaaccaaaugugguguuuuagugacuuuu

SEQ ID NO: 337573 - RNA, 64 nt, hsa
ugaaaucugguaauuugugcagcagcaauagaugauaaccaaaaaaaacucauaauaaucugaa

SEQ ID NO: 337574 - RNA, 64 nt, hsa
gucaauuaacaauaagccaguauaaaacaccuaaauaaccaaucuacaaucucccuucacaagu

SEQ ID NO: 337575 - RNA, 64 nt, hsa
ccaggaaugcacuuuaacaauaucaggauuuuauauaaccaaauaguuucaaauacaacaaaau

SEQ ID NO: 337576 - RNA, 64 nt, hsa
augucaccauaaugaacaauugcuauuuaaauagauaaccaauuuucagacacauuuuuggauu

SEQ ID NO: 337577 - RNA, 64 nt, hsa
cugguuuuccagugugguucugacagcacuacugauaaccaaacuggagucagguauuuuguac

SEQ ID NO: 337578 - RNA, 64 nt, hsa
gauugggaugauacaucauugaacugcacuuuauauaaccaaagcuuagcaguuuguuagauaa

SEQ ID NO: 337579 - RNA, 64 nt, hsa
aagaaaaggauuauugugaggauggucuguaagcauaaccaaaaggaauuugucuaauaacaau

SEQ ID NO: 337580 - RNA, 64 nt, hsa
ggcaauugguaucaucaaugauacucauuuuuuaauaaccaaaggcaggggaaaaucauuuuac

SEQ ID NO: 337581 - RNA, 64 nt, hsa
aaagccaguaacaacagcguguacugccacugucauaaccaauaccaugaaugaauauacuuua

SEQ ID NO: 337582 - RNA, 64 nt, hsa
auaauuaaguggugguguucuuuaaggaauuucuauaaccaaauugaucuuauuuuugauuuca

SEQ ID NO: 337583 - RNA, 64 nt, hsa
ucauucguuuaaaugauauuuuaauguaaaagucauaaccaacauaugaacagacagauuuaug

SEQ ID NO: 337584 - RNA, 64 nt, hsa
uccaaaaagaacaauaaugagagcaaaugcaaaaauaaccaaguccuccgaaggcaucucacgg

SEQ ID NO: 337585 - RNA, 64 nt, hsa
uuuaacauccucuuuagagguaauuuuuguuaacauaaccaaaaauuaaauugaaacaaaaugu

SEQ ID NO: 337586 - RNA, 64 nt, hsa
gguuaagaugugugaauaauuucuguauauauguauaaccaaguacaaacauugauguauaaug

SEQ ID NO: 337587 - RNA, 64 nt, hsa
ugccagagccuuaauaaacguccacagaguauaaauaaccaauuccucauuuguucauuaaacg

SEQ ID NO: 337588 - RNA, 64 nt, hsa
guaaaaugcaaaaauuaaaacaaucuuaaaccacauaaccaagcauugugaacuguaagugcca

SEQ ID NO: 337589 - RNA, 64 nt, hsa
accgaaaugucuuguuuuguugcgacauaggaaaauaaccaagcacaaaguuauauuccauccu

SEQ ID NO: 337590 - RNA, 64 nt, hsa
uuuucuucuguuuuuggaggcauacacauuaugcauaaccaaaacaauggcucaauuguguuua

SEQ ID NO: 337591 - RNA, 64 nt, hsa
aauguaagaaaccauuauuucagguuaugaaaguauaaccaagcauccuuuugggcaauuccuu

SEQ ID NO: 337592 - RNA, 64 nt, hsa
caagauacuguuuuaggaguuuacccucucauuuauaaccaaaguugcucuaaaacacuuucca

SEQ ID NO: 337593 - RNA, 64 nt, hsa
uuucccccaaauaaacauugcuuuauuucuaauaauaaccaagacuuuucaagcuucuagaucu

SEQ ID NO: 337594 - RNA, 64 nt, hsa
uaauaacaacaacuuaaugugcugcugcuuuuccauaaccaacauuuuaaaaauaaaugaaaaa

SEQ ID NO: 337595 - RNA, 64 nt, hsa
aacaaaaauugaauauuuaaugaauugacauuuuauaaccaaccuguuuuuaucuacgguggga

SEQ ID NO: 337596 - RNA, 64 nt, hsa
cacucuaguaaaaaaaccaaauaauuuguuuaaaauaaccaaagaguuguuauaaugcauaauu

SEQ ID NO: 337597 - RNA, 64 nt, hsa
uaacaaucuguaguguuuuuacugccauaguuuuauaaccaaaaucuugacuuaaaauuuuccg

SEQ ID NO: 337598 - RNA, 64 nt, hsa
ucugcaauagugauaaucugaugcugaagaucaaauaaccaauauaaagcauauuucuuggccu

SEQ ID NO: 337599 - RNA, 64 nt, hsa
gccaaugacauaccuugcuucuucaccaguuaugauaaccaagaaugucuccauuguuaaaugu

SEQ ID NO: 337600 - RNA, 64 nt, hsa
ucagugagaugcaggcaucuggcacccagcugcuauaaccaaguguccaccaacuaccugcuaa

SEQ ID NO: 337601 - RNA, 64 nt, hsa
uauaaaauaaauuugccacauaauaugggaugcaauaaccaacaaagcugcuaagugccaaacu

SEQ ID NO: 337602 - RNA, 64 nt, hsa
aaaucauauuauauguuucaauugaucuguuagaauaaccaagaaaacaaaaugcuggaguuuc

SEQ ID NO: 337603 - RNA, 64 nt, hsa
ugccauuuaugcaggaaacuacccuuuucucaauauaaccaaacaaaggcuaauuuauaaaugc

SEQ ID NO: 337604 - RNA, 64 nt, hsa
guccuucugaagggucagaauauguaauuauuugauaaccaaggaagucaagucagauggcuaa

SEQ ID NO: 337605 - RNA, 64 nt, hsa
uuuuaacugauucuuaugauuacuaucauggcauauaaccaaaauccgacugggcucaagaggc

SEQ ID NO: 337606 - RNA, 64 nt, hsa
augauguaacgguuuaauaccuuugaauguuuuaauaaccaaguugcugcugaacuuauacuaa

SEQ ID NO: 337607 - RNA, 64 nt, hsa
guauucgaagacaagucauuccuauuauuauagaauaaccaaaaccuuauuuauguuuuaccuu

SEQ ID NO: 337608 - RNA, 64 nt, hsa
ugaagacaucugaaaucucagcuggucacccaugauaaccaacuuccaccugcccaaccauaua

SEQ ID NO: 337609 - RNA, 64 nt, hsa
ucuuuaggauauauuuuuaaauucuuugaaacacauaaccaaaaugguuugauucacugacuga

SEQ ID NO: 337610 - RNA, 64 nt, hsa
cuuuaauuuccucaccaaauuauugacuuagagcauaaccaaagaccucauucauucaccccag

SEQ ID NO: 337611 - RNA, 64 nt, hsa
agagauuguucucacucccgccccaucuuaauguauaaccaacaccaaacacguggaucaacag

SEQ ID NO: 337612 - RNA, 64 nt, hsa
ugagaaucaaccaggcuuuccugcuccaccugagauaaccaacucccucccguaaucaggaagc

SEQ ID NO: 337613 - RNA, 64 nt, hsa
auugccucccauuugccaucauaugagcuucgccauaaccaaguagagucuaucuuccuaucag

SEQ ID NO: 337614 - RNA, 64 nt, hsa
aagagaccaagaaacuuucaaugaccauucagcuauaaccaacugcaguuugaaucaguggaug

SEQ ID NO: 337615 - RNA, 64 nt, hsa
agggccuucacaguguccuuuauguaagaaugauauaaccaaaagguauauaauuugguaauga

SEQ ID NO: 337616 - RNA, 64 nt, hsa
aaagugccccaaacagcaauagaaaggcauauguauaaccaaacuccaagugauaaccagaccc

SEQ ID NO: 337617 - RNA, 64 nt, hsa
caucccucuggcauuuccuggucucuggcacaucauaaccaauuggaaaccugcaguuuggggu

SEQ ID NO: 337618 - RNA, 64 nt, hsa
agaaagucagcauuuuccuugagcuaaauaccuaauaaccaaaacugugaggaagguuaucggg

SEQ ID NO: 337619 - RNA, 64 nt, hsa
cucaguagccaucagccuggcagcugcccaucccauaaccaaagagcucaaugggcuggagggu

SEQ ID NO: 337620 - RNA, 64 nt, hsa
acguaugauuacucacagcgaucuauuguuccauauaaccaaaaagcaugguuuauucauugaa

SEQ ID NO: 337621 - RNA, 64 nt, hsa
ggugugucagauuuuccucagauuagaugugccaauaaccaaguuuauucaguaaacaacuugu

SEQ ID NO: 337622 - RNA, 64 nt, hsa
aaaugucucaguuuucagcuauaccugcacguucauaaccaacaauauaaaccguggucucaug

SEQ ID NO: 337623 - RNA, 64 nt, hsa
cuagauggcaacauuggacagaaaaugcaaugacauaaccaauuuguaaugauuuuggaacugu

SEQ ID NO: 337624 - RNA, 64 nt, hsa
cgcuaccugacuucaaacuaugcuacaaggcuacauaaccaaaauagcaugguacugguaccaa

SEQ ID NO: 337625 - RNA, 64 nt, hsa
auauuaauuuaguuauauuuagcagaagaggaauauaaccaaaugugacuaaaauauagcagaa

SEQ ID NO: 337626 - RNA, 64 nt, hsa
acaugagaaagcucaugggcaagaaacucuaugaauaaccaagauggagccgggugcaguugcc

SEQ ID NO: 337627 - RNA, 64 nt, hsa
gccuugugagagauugagacacucuaaauaaauaauaaccaagaugggaaauuucccugccaga

SEQ ID NO: 337628 - RNA, 64 nt, hsa
caacacccuccaccuuccccuccaugccaauaaaauaaccaauccagaugccagcagccuguca

SEQ ID NO: 337629 - RNA, 64 nt, hsa
gugugaacucaccaaacacaagaaaaucaaauauauaaccaauagugaaaugccacaccuuugu

SEQ ID NO: 337630 - RNA, 64 nt, hsa
gaaauugaagaagaaugaacuaauaauagcauucauaaccaaacacaaugaugauuauugcaga

SEQ ID NO: 337631 - RNA, 64 nt, hsa
agacagacagaaucaccugaggcguucaaaagauauaaccaaauaaacaagucauccacaauca

SEQ ID NO: 337632 - RNA, 64 nt, hsa
uugccacauucugcccuucccugaccccauuguaauaaccaacuccauauccaaagggaggugg

SEQ ID NO: 337633 - RNA, 64 nt, hsa
ggggaaggcaggcagagcccccucuccgggcgccauaaccaaacuuuccucagucugcuguuua

SEQ ID NO: 337634 - RNA, 64 nt, hsa
gauaauugucugugaagucugagaaaagacuaagauaaccaagaugaacauaaugucaaaggac

SEQ ID NO: 337635 - RNA, 64 nt, hsa
gcgcuccagcuagcugccucaucaaaaacacugaauaaccaaggacugcugaguuuuucuucau

SEQ ID NO: 337636 - RNA, 64 nt, hsa
ugauaaagcaucauguucccuuugauuauccccuauaaccaacacucaacuacaaauaggcugg

SEQ ID NO: 337637 - RNA, 64 nt, hsa
cgccuccuuucuguuuuauuuuugaggaaauaaaauaaccaagugcuaaaucuuguagcucugg

SEQ ID NO: 337638 - RNA, 64 nt, hsa
gugccccuaaccuggcuuuucccaucuccccagcauaaccaaaucuuacuaaacucauccuagg

SEQ ID NO: 337639 - RNA, 64 nt, hsa
ccucugccuacccacgugccugcuuaccugccagauaaccaagugagaugucugcgaguggcua

SEQ ID NO: 337640 - RNA, 64 nt, hsa
gaagacuucuaaaaagacaagaaacauggccuaaauaaccaacauagauuuacauaguaaguuu

SEQ ID NO: 337641 - RNA, 64 nt, hsa
ccuuguguuuuguuuugauuuaauaacauaacaaauaaccaacccuucccugaaaaccucacau

SEQ ID NO: 337642 - RNA, 51 nt, hsa
ggggaaugaagagaguguaaaauaaccaaucugaauaaaacagccaugcuc

SEQ ID NO: 337643 - RNA, 64 nt, hsa
ucggaaguguuuuggaauccagcagcaucauaagauaaccaaacucguccucccagaggaucug

SEQ ID NO: 337644 - RNA, 64 nt, hsa
gaauaugaauauguuuuaucacuaguguggcuaaauaaccaaacauuuguguaaaaaaaaaaaa

SEQ ID NO: 337645 - RNA, 64 nt, hsa
auacaguucagaaugacacauuguaguggcaaagauaaccaaaugucuggcuguuugcuuuuug

SEQ ID NO: 337646 - RNA, 64 nt, hsa
ucuccgugaaucuuaugcugaguaguuuuuccucauaaccaagcauuuaugauauauuacuacu

SEQ ID NO: 337647 - RNA, 64 nt, hsa
uaugucauaccuuuggauacgaagaccauacauaauaaccaaacauaacauuauacacaaagaa

SEQ ID NO: 337648 - RNA, 64 nt, hsa
cggacagccuggcugucauugcuuucuuccuccccauuuggacccuucucugcccuuacauuuu

SEQ ID NO: 337649 - RNA, 64 nt, hsa
ugucccagagcugaggcaaggggauuucucaggucauuuggagaacaagugcuuuaguaguagu

SEQ ID NO: 337650 - RNA, 64 nt, hsa
ccucccguacugcuuucaggucuuguaaaauaagcauuuggaagucuugggaggccugccugcu

SEQ ID NO: 337651 - RNA, 64 nt, hsa
ccuauauuuagguuucuuuucuauuuuuuucucccauuuggauccuuugagguaaaaaaacaua

SEQ ID NO: 337652 - RNA, 64 nt, hsa
agagcaauacccaagccucauuuggaaggcucaacauuuggaauugcacuuuaauugauuaauc

SEQ ID NO: 337653 - RNA, 64 nt, hsa
ugccucugguggcugcagagcaauacccaagccucauuuggaaggcucaacauuuggaauugca

SEQ ID NO: 337654 - RNA, 64 nt, hsa
cauguaucuuguaaucaugauugagccucagaaucauuuggagaaacuauauuuuaaagaacaa

SEQ ID NO: 337655 - RNA, 64 nt, hsa
cuuuuuacugcuuuuguuguaguugucauaauuacauuuggaacaaaaggugugggcuuugggg

SEQ ID NO: 337656 - RNA, 64 nt, hsa
gacaacuugcaccacuaagaaaaaaauguagaaccauuuggaaaaaugaaauuuaguaguucca

SEQ ID NO: 337657 - RNA, 64 nt, hsa
cauuccauguuuuaaucugagccuugcagacuuucauuuggaguuugaacccguuuugguugca

SEQ ID NO: 337658 - RNA, 64 nt, hsa
ugaacucaucacuggcuuagacaguccuggaugccauuuggaaaguaguggcccugcaagccua

SEQ ID NO: 337659 - RNA, 64 nt, hsa
gccuaaaugaaguaguauuuguaggccuggguggcauuuggauuuuucuuuucccucaacaagg

SEQ ID NO: 337660 - RNA, 64 nt, hsa
gucccuuuuauaauuuguuuuaaugauuuugcuacauuuggaauucaauaaaaaaugugaacaa

SEQ ID NO: 337661 - RNA, 64 nt, hsa
agcaaggagauaggauuauagauaauuucacggacauuuggaaauaacauuggugauuauacag

SEQ ID NO: 337662 - RNA, 64 nt, hsa
acacaguuauggcaaaguagacaaagcauuuguucauuuggagcuuagaguccaggaggaauac

SEQ ID NO: 337663 - RNA, 64 nt, hsa
aaguggaguuggugaaucgguuguucuuuccucacauuuggaugauugucauaagguuuuuagc

SEQ ID NO: 337664 - RNA, 64 nt, hsa
auuucuucaaaaagcaaaagcaauauaccuaauucauuuggaucaaacuuacauaggucucagg

SEQ ID NO: 337665 - RNA, 64 nt, hsa
auguauacaguccauauacacauuaaguguuugucauuuggacaaauugaaaacuuuuaauaaa

SEQ ID NO: 337666 - RNA, 64 nt, hsa
auggaucuuguuugauucuguaguuaaauuuccacauuuggaaugggaaggcaucuccaugcca

SEQ ID NO: 337667 - RNA, 64 nt, hsa
ggacuuugugaccaaauagucuacaggaggcagccauuuggaagguuagucuugggucuccuga

SEQ ID NO: 337668 - RNA, 64 nt, hsa
gugcaauuuggggaauaucaaacuuagcauuauacauuuggauauucuaguuguauuguaaauu

SEQ ID NO: 337669 - RNA, 64 nt, hsa
aggauugccuugaucuggcacuuacugauacaagcauuuggagaagagaaaauucaaauauaag

SEQ ID NO: 337670 - RNA, 64 nt, hsa
auucauaugcuuuuccugcauacauuauuuugaucauuuggauaacaucaaugaacacuggcuu

SEQ ID NO: 337671 - RNA, 64 nt, hsa
uguuuucucugcaauuuauuuaaaaccuugcacgcauuuggauaccuugugauuuccaagaacu

SEQ ID NO: 337672 - RNA, 64 nt, hsa
aaauggacuuuccugugauuuguuuuuaaucauucauuuggagaagaggcaugaccuuuguauu

SEQ ID NO: 337673 - RNA, 64 nt, hsa
uguccagugagcaguguugcguuuuuccuuguagcauuuggaaaugauuuacuggaauuacaaa

SEQ ID NO: 337674 - RNA, 64 nt, hsa
auuggagauuggcuugucucacgcagccagugcacauuuggaauugacggaaacaacguugcua

SEQ ID NO: 337675 - RNA, 64 nt, hsa
uuggccucaccuucucuggcccuuaggaucuccccauuuggagacagagccauuuggauauuuu

SEQ ID NO: 337676 - RNA, 64 nt, hsa
uggcccuuaggaucuccccauuuggagacagagccauuuggauauuuuccccuugaacuucucc

SEQ ID NO: 337677 - RNA, 64 nt, hsa
agcauguuucuuuuugaaaaacuagugguggacacauuuggaucacauuuauacaguuauaaaa

SEQ ID NO: 337678 - RNA, 64 nt, hsa
uccccucuugcaguuuguucuguaaugccuuuuacauuuggacacauaguuuaugcuuuuuaga

SEQ ID NO: 337679 - RNA, 64 nt, hsa
ugggacuauacuaguaggagaggaaaggaaaaaacauuuggaaaauaguaacauugauauuucu

SEQ ID NO: 337680 - RNA, 64 nt, hsa
agacagggaagggaauuucacuuaaaaggaaggucauuuggagaugugaagauacacugcuuua

SEQ ID NO: 337681 - RNA, 64 nt, hsa
ucauuauuccuguuuuagcugaagaauuguauuacauuuggagaguaaaaaacuuaaacacgau

SEQ ID NO: 337682 - RNA, 64 nt, hsa
uggagggcugcguauuuguaaauagccugaugcucauuuggaaaaauaaaccagugaacaauau

SEQ ID NO: 337683 - RNA, 64 nt, hsa
ccuuuccuccugcugcacaugagccuucgccgugcauuuggagccaugacagcugauagcucca

SEQ ID NO: 337684 - RNA, 64 nt, hsa
auugccuagccaaaguggguguucaauaaagaaccauuuggagauggucuucugucuggaacug

SEQ ID NO: 337685 - RNA, 64 nt, hsa
ggagauggucucgaugucauggauuuaaagucagcauuuggauuacaacacacauuauugugug

SEQ ID NO: 337686 - RNA, 54 nt, hsa
caccuauaaccaagcuuuaacucccauuuggaauauagaauuaggaugggaaaa

SEQ ID NO: 337687 - RNA, 64 nt, hsa
uucuuucuuaggaucuugaaaauauuugugcagccauuuggaccucaguaugagguaguguuaa

SEQ ID NO: 337688 - RNA, 64 nt, hsa
caaguggaacuuuuaacucguuugaccuccaaaccauuuggaauucuuuccccaguaucugagc

SEQ ID NO: 337689 - RNA, 64 nt, hsa
ggugccuguucuuguagggagaaaugagaaaucgcauuuggauccaggccccaggugggcacca

SEQ ID NO: 337690 - RNA, 64 nt, hsa
uucaugugguggucuguggaaagaaaagaagacucauuuggaaaugaagcugucccuuuccaag

SEQ ID NO: 337691 - RNA, 64 nt, hsa
uaccgaacucgggauuacagaaacacggaguuuccauuuggauuuuaaacaaaauuuaugucau

SEQ ID NO: 337692 - RNA, 64 nt, hsa
aguucugugcaguuugguaugaaacaaauauacucauuuggauauaaaucuuacccuucaaugu

SEQ ID NO: 337693 - RNA, 59 nt, hsa
auuuauuuuaucaauaccaauuuuuguggccauggcagacauugcuaaucaaucacagc

SEQ ID NO: 337694 - RNA, 59 nt, hsa
ugcuggcagucuaaaacaguccacccaccccauggcacugccgcgugauucccgcggcc

SEQ ID NO: 337695 - RNA, 59 nt, hsa
caguucucgugcccuuagaggggaaugaaccauggcaccuuugagagagggggcacugu

SEQ ID NO: 337696 - RNA, 59 nt, hsa
caggacacacugaaaagcagccuuuuucaccauggcaaaccuaaaugcagucagucaca

SEQ ID NO: 337697 - RNA, 59 nt, hsa
acaaacuuaguaucagggguccaugaagcccauggcaucauuuuugaaaauauuucuag

SEQ ID NO: 337698 - RNA, 59 nt, hsa
uuugaaugucauaguacauugugugcuaaccauggcaagcaaacauuuacauuuguuuu

SEQ ID NO: 337699 - RNA, 59 nt, hsa
uguguggcucagugccuggacaaaugaugccauggcagacaguagacagaacaacacuu

SEQ ID NO: 337700 - RNA, 59 nt, hsa
aggguucuuggugaugcuggcagccauggccauggcagcggguggcauccaggcugccc

SEQ ID NO: 337701 - RNA, 59 nt, hsa
ggccaaaaugaauaagcuggacuuucuccccauggcacuggggaaccauggaaguucag

SEQ ID NO: 337702 - RNA, 59 nt, hsa
ugggcuuucuuccaagggcacugggggagccauggcaagguuguagguaggguagagau

SEQ ID NO: 337703 - RNA, 59 nt, hsa
gagucucccaggacccccuuuggagaugcccauggcaugggcacugcccacaggcucag

SEQ ID NO: 337704 - RNA, 59 nt, hsa
aaagccuuuccuugggaaucugccucccuccauggcagggguggauucgggagcuggga

SEQ ID NO: 337705 - RNA, 59 nt, hsa
uuugaaaccaugcuuggcuggaccgggacccauggcaagagcaccugggcaccaguguu

SEQ ID NO: 337706 - RNA, 59 nt, hsa
ugcuuuuugagguuggguuaaaaugccgaccauggcagaggggucacagcucagguucc

SEQ ID NO: 337707 - RNA, 64 nt, hsa
gugagcgacaucaggcgcuuccucagugcauuucacgagccacagguggggcucauccaggccg

SEQ ID NO: 337708 - RNA, 64 nt, hsa
gccucacccugcggugcccuaaaggagggggggcacgagccaacaccccaccccucugccaacc

SEQ ID NO: 337709 - RNA, 64 nt, hsa
acccacccucauugcauuccgcuguagugaaaggacgagccauuucugggcacguggcagcagu

SEQ ID NO: 337710 - RNA, 64 nt, hsa
cacagagaggucucuuccugacccagacgcacucacgagccagguccuggggguaugggggcug

SEQ ID NO: 337711 - RNA, 64 nt, hsa
caccucggccucccaaaguguugagaugacaggcacgagccaccaggcccagccugagugguau

SEQ ID NO: 337712 - RNA, 64 nt, hsa
cagcguggccucccaaagugcugggauuacagacacgagccaccucaccuagccugaugagauu

SEQ ID NO: 337713 - RNA, 64 nt, hsa
aguccaggacacuggugcuuuuuuauacaagagaacgagccagaguucacuccuuccuccuggc

SEQ ID NO: 337714 - RNA, 64 nt, hsa
gugauguggaggaagagccaccugcaagauggacacgagccacaagcugcacugugaaccuggg

SEQ ID NO: 337715 - RNA, 64 nt, hsa
cucgguaaguauguuuagaaauagaacauuagccacgagccauaggcauuucaggccaaaucca

SEQ ID NO: 337716 - RNA, 64 nt, hsa
auggaugagagaagggagagaauaaaaugcaauaacgagccagcauuuacuauguauuuucucc

SEQ ID NO: 337717 - RNA, 64 nt, hsa
gaucagggcuccagggacagaugaugagucucaaacgagccagccagggguucuuuugguuaua

SEQ ID NO: 337718 - RNA, 64 nt, hsa
ugccucugcuucccaaagugcugggauuacaggcacgagccaccacaccuggccaaaaaaauuu

SEQ ID NO: 337719 - RNA, 64 nt, hsa
accgcggguaugcgagugccagauauuggcugagacgagccagcuuagacuaauugguacaagg

SEQ ID NO: 337720 - RNA, 64 nt, hsa
gggcauggaccugaguucugguuuugauucugccacgagccagcugugugaauuuggucaaggg

SEQ ID NO: 337721 - RNA, 64 nt, hsa
caucuuggccucccaaagugcugggauuacagggacgagccaccacaccccaccuauugucuau

SEQ ID NO: 337722 - RNA, 64 nt, hsa
gguggcacugccaggugcguagacagacggugucacgagccauuuccugagccccagggcugaa

SEQ ID NO: 337723 - RNA, 64 nt, hsa
uguuuuggguauuuuuuuuauaugcaaaggucuuacgagccaauaaaacuauuucaaaguacuc

SEQ ID NO: 337724 - RNA, 64 nt, hsa
agcuuuacacaccuugugucacuuuaucuugguaacgagccaagaucaugcaaccaguucaucc

SEQ ID NO: 337725 - RNA, 64 nt, hsa
gucuacacccaguuuguugaagaacugcggguucacgagccauuugucucuucggaggagcuag

SEQ ID NO: 337726 - RNA, 64 nt, hsa
guuuagagaauccuaaugucuacacuggcauagcacgagccauguaagcuucuuuuuuuucuau

SEQ ID NO: 337727 - RNA, 64 nt, hsa
uuuuuaccaucgguuugacuuacaguggaguagaacgagccagaguuccugacuugagcaggug

SEQ ID NO: 337728 - RNA, 64 nt, hsa
ccaggccggcugccucaucucagcucuagggggcacgagccauauggggucugcacaagagacc

SEQ ID NO: 337729 - RNA, 64 nt, hsa
ugggacagcucaguguuggagggccaccugaaccacgagccagggcuggggcuugcaugucauu

SEQ ID NO: 337730 - RNA, 64 nt, hsa
gugccccaacgucagcccaauccaccuugcagacacgagccacacgggccacacggugacugcu

SEQ ID NO: 337731 - RNA, 64 nt, hsa
ggaccucuaaugugggcaugucguccaccccaggacgagccaucagggacagaccccccacccc

SEQ ID NO: 337732 - RNA, 64 nt, hsa
agcugccucccugcugccgagcccuggucuggccacgagccaccacugccucccgcugcugccc

SEQ ID NO: 337733 - RNA, 64 nt, hsa
ucaguucagaagagcuugcagcuuuccagaaggaacgagccaucuuccuggcugcucagaagga

SEQ ID NO: 337734 - RNA, 64 nt, hsa
cuuggguaguugaccugccuuuucugacuccgggacgagccaguccuaggcugccuccgggagc

SEQ ID NO: 337735 - RNA, 64 nt, hsa
ugccucagccucccaaguagcugagacuacaggcacgagccaccacacccagcuaauuuuuaag

SEQ ID NO: 337736 - RNA, 64 nt, hsa
uaccucagccuccugagaagcucggacuacaggcacgagccaccaugcccagcuaauuuucuuu

SEQ ID NO: 337737 - RNA, 64 nt, hsa
ucauuucuuuuuaaaguagacucuuugugaagaaacgagccagugacugaaacacccuggugga

SEQ ID NO: 337738 - RNA, 64 nt, hsa
gaaaaauguccccccaggcauuucuaggcuccucacgagccagccagguggcugcuagcuguua

SEQ ID NO: 337739 - RNA, 64 nt, hsa
uggugcacaugcccuucuuuccccacucccugccacgagccacugcacaggaggcuaucuguag

SEQ ID NO: 337740 - RNA, 64 nt, hsa
ugaaggacuugauuaauagcaaauuggcaauuuaacgagccacuuccaugaucuccaaagaaac

SEQ ID NO: 337741 - RNA, 64 nt, hsa
cagcaagacucagucaucucccuuugggauuggaacgagccacaccuacccggcagaccccucu

SEQ ID NO: 337742 - RNA, 64 nt, hsa
gaagcagcagaaggagcaggagcaagugagagccacgagccaaggugggcacuugaugucggau

SEQ ID NO: 337743 - RNA, 64 nt, hsa
gauuguauucaaugacauuaucaucauuuuuagaacgagccacuaaccuauuagagaagaggca

SEQ ID NO: 337744 - RNA, 64 nt, hsa
auuucuacuguauaaauguuuuacauuaaguguuacgagccacaaauuucauguacauuuauua

SEQ ID NO: 337745 - RNA, 64 nt, hsa
aagacaugacaauggaugaaguccgagaauuugaacgagccacucaggaagccaccaacaagaa

SEQ ID NO: 337746 - RNA, 64 nt, hsa
cgcuguggccgcauggaaccuugagaacccagggacgagccagugccgggaaggaacugccggg

SEQ ID NO: 337747 - RNA, 64 nt, hsa
caaaacauuuugaaaagcauuuacuuuuuugaccacgagccaugaguuuucaaaaaaaucgggg

SEQ ID NO: 337748 - RNA, 64 nt, hsa
ccuuggaccaaaccacgugguuugcagcuuuucuacgagccaggggggagguucccuuggauua

SEQ ID NO: 337749 - RNA, 64 nt, hsa
cgccgggcacaugugaaagguaugccuccgugggacgagccacccgcuuucagcccugugcucu

SEQ ID NO: 337750 - RNA, 64 nt, hsa
ggacugcugacuugguuaugcagucaaugagaucacgagccacugguuauuggauuuuuuuucu

SEQ ID NO: 337751 - RNA, 64 nt, hsa
caguagaugaccuggcuguaaagagauucccuggacgagccagaucauucaguuucagcgaguc

SEQ ID NO: 337752 - RNA, 64 nt, hsa
agggccuacagcuguguuguccaguacaggagccacgagccaaauguggcauuugaauuugaau

SEQ ID NO: 337753 - RNA, 64 nt, hsa
cagaguggaucuuucucugcaguacuguauccacacgagccaacugcuguauuuaacaucugcc

SEQ ID NO: 337754 - RNA, 64 nt, hsa
uaaagggaauguuuuuuucugagauaaaauaaaaacgagccacaucguguuuuaagcuugucca

SEQ ID NO: 337755 - RNA, 64 nt, hsa
cacucccugaucccguagguggaggcgaugggucacgagccauguuaagcacaaccggcuccuu

SEQ ID NO: 337756 - RNA, 64 nt, hsa
guggaauacaagacagugaacucugucugccugaacgagccauguaaauuaaguucuagagcag

SEQ ID NO: 337757 - RNA, 63 nt, hsa
cuugggaguuauuuacuguguuccucuggcagccaauaaaaucaucauaagcccuuuguaaua

SEQ ID NO: 337758 - RNA, 63 nt, hsa
uucuguaugcuucuauuccaaaucauucauuaccaauaaaaacgaaauaccacccuuuccauu

SEQ ID NO: 337759 - RNA, 63 nt, hsa
uuaaaucacauuuagugcuguauaauuugcaugcaauaaaauucaauaaaauuaaauguaaaa

SEQ ID NO: 337760 - RNA, 63 nt, hsa
uuuagugcuguauaauuugcaugcaauaaaauucaauaaaauuaaauguaaaauuaaaugagu

SEQ ID NO: 337761 - RNA, 63 nt, hsa
agccuuggcaccuguuggagacuaugaccaagccaauaaaaagggcauuuaaaucagcccugu

SEQ ID NO: 337762 - RNA, 63 nt, hsa
cuaucacacucuguuaaaaacacauagaaucaucaauaaaaacucaauauaacuuucuuuggg

SEQ ID NO: 337763 - RNA, 63 nt, hsa
auuuuuauauaugguuaaagagaccugucauugcaauaaaagccagcauucacaaaaugagga

SEQ ID NO: 337764 - RNA, 63 nt, hsa
aauacaaaauaagugggaaaugagaaguuauaccaauaaaaagcauuuaaaaauuuaggggau

SEQ ID NO: 337765 - RNA, 63 nt, hsa
uuuauauuuucccucucuugccuuucuuauuugcaauaaaagguauugagccauuuuuuaaau

SEQ ID NO: 337766 - RNA, 63 nt, hsa
ugcaucacggaucaauagacuguacuuauuuuccaauaaaauuuucaaacuuuguacuguuau

SEQ ID NO: 337767 - RNA, 63 nt, hsa
uuguaaccagauacauaaagagcucuuacaacucaauaaaaggcaaguaauuuaaaaauaggc

SEQ ID NO: 337768 - RNA, 63 nt, hsa
uaacaaaauaucacaugcauaaauauuauguaucaauaaaauuuuuuaaugggcaaaggauuu

SEQ ID NO: 337769 - RNA, 63 nt, hsa
gcacaguuugaugaagggcuagagagcuguuugcaauaaaaagucagguuuuuuuccugauuu

SEQ ID NO: 337770 - RNA, 63 nt, hsa
auaucaucucuagcacugccauccaauuuaguucaauaaaauucaaauauaaguuuccaugcu

SEQ ID NO: 337771 - RNA, 63 nt, hsa
uuaaaaaccaaaccaauaaaauuuuuauuuauucaauaaaauaugcacagaacagaugcaaau

SEQ ID NO: 337772 - RNA, 63 nt, hsa
aagaauauuguuuauagguuuuaaaaaccaaaccaauaaaauuuuuauuuauucaauaaaaua

SEQ ID NO: 337773 - RNA, 63 nt, hsa
uauuugcacuacauauaugauaaguauagacagcaauaaaauguuaagaucauuuuuaagaag

SEQ ID NO: 337774 - RNA, 63 nt, hsa
aacuguuucccaaaauaagugcauuuauuuugacaauaaaacuuaaggcuguucaugagaagg

SEQ ID NO: 337775 - RNA, 63 nt, hsa
ccuccguuccgcuagccuacccugucagccuuucaauaaaaguuaugcacaaaugugaacacc

SEQ ID NO: 337776 - RNA, 63 nt, hsa
cuggucaugaucucugaucuccaccucaaaugacaauaaaaaacugguccaacgaagacacug

SEQ ID NO: 337777 - RNA, 63 nt, hsa
cuuacuuucccauuguaacaauaaaaaaaguaucaauaaaauaauuauuggcaaauaaauugg

SEQ ID NO: 337778 - RNA, 63 nt, hsa
cuauauccuugacaccuuacuuucccauuguaacaauaaaaaaaguaucaauaaaauaauuau

SEQ ID NO: 337779 - RNA, 63 nt, hsa
augcaacagggacccuuguaaauugucauacgccaauaaaaugucacaaguaauaacugcugu

SEQ ID NO: 337780 - RNA, 63 nt, hsa
gcguuaacauacuuuguuuugccuagagaggggcaauaaaaaugaaccaaaggauauuuccag

SEQ ID NO: 337781 - RNA, 63 nt, hsa
aguauuuuaaaaaaauuguuuuucaaaugucaccaauaaaaguuuuggcaggaagcuuguugc

SEQ ID NO: 337782 - RNA, 63 nt, hsa
cacaccagaguucuauuuaccucaucuugguaucaauaaaaacuuauguggaagguaaauaua

SEQ ID NO: 337783 - RNA, 63 nt, hsa
uauccacuggucacaucauaacugucuauagggcaauaaaaucuguguuaaacucaauugcuu

SEQ ID NO: 337784 - RNA, 63 nt, hsa
gcauggggguuaagcugauguuaaaacaguuugcaauaaaaaaaaaugaaucagcuuaaguca

SEQ ID NO: 337785 - RNA, 63 nt, hsa
caccauuugguccucuuuaaucuuugaggguuucaauaaaaauuguucacucauaucuguguu

SEQ ID NO: 337786 - RNA, 63 nt, hsa
aaagcagaauuuguuugauaccuaacaagauuucaauaaaaauccaaacuuuguauguacguu

SEQ ID NO: 337787 - RNA, 63 nt, hsa
acaucuuaacuguauaugaacauuucacgaggacaauaaaaauaagacauugaaggaccaauu

SEQ ID NO: 337788 - RNA, 63 nt, hsa
uagcaaucaaucauaauuaguaaacagguguaccaauaaaaagaauuuacaugauagguuaac

SEQ ID NO: 337789 - RNA, 63 nt, hsa
auaaauaacaaguuauaguaccaucucccccgccaauaaaaaagagaagaaaaaagagaaacc

SEQ ID NO: 337790 - RNA, 63 nt, hsa
uucccagauuauccuuguaaugacacgaaucugcaauaaaagccaucagugcuauuuggaugu

SEQ ID NO: 337791 - RNA, 63 nt, hsa
gacaacucuuucuuuaaauaaauuaagucucuacaauaaaaacacaacugcaaaguaccuuca

SEQ ID NO: 337792 - RNA, 63 nt, hsa
ucccauucuaugugucaucaauaguguccuaugcaauaaaauuauuugcaggucuuuaaauca

SEQ ID NO: 337793 - RNA, 63 nt, hsa
aaaggaugaucaaaaauaaugcauccagcaguacaauaaaaguaaaccacaaaaaaauaccuc

SEQ ID NO: 337794 - RNA, 63 nt, hsa
cuccagccugggugacagagugagacuccaucucaauaaaauuaauaauaauaaaaccuucca

SEQ ID NO: 337795 - RNA, 63 nt, hsa
gaguaaaaaucagugaaauugaaaagagaaaaucaauaaaacccaaaacuguucuuugaaaag

SEQ ID NO: 337796 - RNA, 63 nt, hsa
ugaauauguacuuuuaacacaagagagacuauucaauaaaaacucacugggucuuucaugucu

SEQ ID NO: 337797 - RNA, 63 nt, hsa
cuuuuuuauauuguccuccaccuccaucauuuucaauaaaagauagggcuuuugcucccuugu

SEQ ID NO: 337798 - RNA, 63 nt, hsa
acacacacacacacacaaacauauaaccuaugccaauaaaaaugucucagcaacaguggaauu

SEQ ID NO: 337799 - RNA, 63 nt, hsa
cuggaacagugucuggugcacauaauaggugcucaauaaaaauguguucaauggaugaauuuc

SEQ ID NO: 337800 - RNA, 63 nt, hsa
acauaaugugaucaugcucuaacuucaauauaccaauaaaauaaucagcuugcaauuucugau

SEQ ID NO: 337801 - RNA, 63 nt, hsa
uuuugaacuaacaguaauaacuucuugaaaauccaauaaaauuggcaaaagauugugaaaauu

SEQ ID NO: 337802 - RNA, 63 nt, hsa
guugucuucaaaggcaggagaaaauaauguucacaauaaaaugugcuaacaauguuuuguuuc

SEQ ID NO: 337803 - RNA, 63 nt, hsa
aauaaaagaaaagcugacaguauauucugguuucaauaaaaugaccuaucagaaaguagaauu

SEQ ID NO: 337804 - RNA, 63 nt, hsa
aguccaggcaaguuacaaugccuuguugugccucaauaaaaaaguuacaugcaccuucagugu

SEQ ID NO: 337805 - RNA, 63 nt, hsa
cuuuaucaagauugaaagucaguacaguauugacaauaaaaggaugguguucuaauuaguggg

SEQ ID NO: 337806 - RNA, 63 nt, hsa
aaguauagccccacuuauacuauguaaaauuaccaauaaaauauuuuuaugacuacagauuuu

SEQ ID NO: 337807 - RNA, 63 nt, hsa
auuuauuguaauguuuacuagcggacuaguaaacaauaaaacauugauuauuuagcuuuauaa

SEQ ID NO: 337808 - RNA, 63 nt, hsa
auuuuuaggaaaauauuaagcuuuauaaaauagcaauaaaaaauaauucauuuaagaagagau

SEQ ID NO: 337809 - RNA, 63 nt, hsa
uguaggguuuuauuuuauuuuuauuuuuugacccaauaaaauguuauaugaaagaaugaaaau

SEQ ID NO: 337810 - RNA, 63 nt, hsa
gacuauuauuaucuuuguaauaaauuaaccuagcaauaaaaaauauucuguuucuuucguuag

SEQ ID NO: 337811 - RNA, 63 nt, hsa
ggucuaguuucgguaacuguuccagacaucaagcaauaaaaaaaugaauaccacaaaagaugu

SEQ ID NO: 337812 - RNA, 63 nt, hsa
agucuucgauucucagagagcauuugucuaauacaauaaaaacuggcauuaauacaaaccuca

SEQ ID NO: 337813 - RNA, 63 nt, hsa
gauucugucucaaaauaaauacauacauacauacaauaaaaccgaaugagcugguucuuucca

SEQ ID NO: 337814 - RNA, 63 nt, hsa
uacuaaauguacagauaugcaaauuccauagcucaauaaaagaaucugauacuuagaccaaaa

SEQ ID NO: 337815 - RNA, 63 nt, hsa
ugcagaaaaaauauuguaguuugaauauuuaagcaauaaaacugcuagugaguuauuguaagc

SEQ ID NO: 337816 - RNA, 63 nt, hsa
ugggggggaaagaugacaugguauuuaauaauacaauaaaaauauucuuaucacuuccuaucc

SEQ ID NO: 337817 - RNA, 63 nt, hsa
auacacagaauguguacagauuauuuguuaugacaauaaaacacucaaaauaaauggucuuua

SEQ ID NO: 337818 - RNA, 63 nt, hsa
aaauaccacagacacaguuaaagcaaaaggaaacaauaaaaggaaugucugcaugcuauuuua

SEQ ID NO: 337819 - RNA, 63 nt, hsa
uugcugaaucuguuuggguuccaguuuccuuggcaauaaaaugagcuaaaugggcuaggugaa

SEQ ID NO: 337820 - RNA, 63 nt, hsa
aguucuguuucacaaguuuugggccaccuauuucaauaaaaaauaaaauauaaauuaaaaaag

SEQ ID NO: 337821 - RNA, 63 nt, hsa
guaauacaguaaacugaaagaguauauagauagcaauaaaauaacauaaguggacauguuuau

SEQ ID NO: 337822 - RNA, 63 nt, hsa
gacaugguuaaucuggaacuuacguucuuauaccaauaaaagguaccucaauacauguucuuu

SEQ ID NO: 337823 - RNA, 63 nt, hsa
cuggcacugaagaucuccagggacuucagagaccaauaaaagcccauagggaagagagagagg

SEQ ID NO: 337824 - RNA, 63 nt, hsa
gccaugcugcuaugaagacuacuuuuagaucaacaauaaaaaaaaaccuacaaaaaaaccuuu

SEQ ID NO: 337825 - RNA, 63 nt, hsa
cuuauuuuuauuuauuuuuguacugugcugauucaauaaaaugcacugaccauccauuacaga

SEQ ID NO: 337826 - RNA, 63 nt, hsa
uaaugaagaaaagagagaagaaucaaauagaugcaauaaaaaaugauaaagggaauaucauca

SEQ ID NO: 337827 - RNA, 63 nt, hsa
aauauccuugaugaacauugaugugaaaauccucaauaaaauacuggcaaaccgaauccagca

SEQ ID NO: 337828 - RNA, 63 nt, hsa
gggccccaccacgcucucaagagaacgcaccugcaauaaaacagucuugucggccagcugccc

SEQ ID NO: 337829 - RNA, 63 nt, hsa
aagcugugaagaaaaauauauaucaauguuuuccaauaaaauacagugacuaccugauuuggc

SEQ ID NO: 337830 - RNA, 63 nt, hsa
cuuuccaccuuccccuauccaugcacccccucgcaauaaaaccaacucuaaaaucacagcugu

SEQ ID NO: 337831 - RNA, 63 nt, hsa
agagaaaauccacaaauuccaaugucacaaaagcaauaaaacaaacuagaaaaaaaaaagguu

SEQ ID NO: 337832 - RNA, 63 nt, hsa
cucacguauuucuauugucagcgcuggcauaaacaauaaaaaguagacuugguuuuuuugugu

SEQ ID NO: 337833 - RNA, 63 nt, hsa
aauucuacaagaggaaucaccugguuucccaaccaauaaaauggcauuuuaagaaauaaggug

SEQ ID NO: 337834 - RNA, 63 nt, hsa
uguuacuguuuaccauggcaguaauggggcaaacaauaaaaugcaaugugaaaugauuugaug

SEQ ID NO: 337835 - RNA, 63 nt, hsa
aaaucauucuggagguggcauguccuugacucacaauaaaaauuuuagaaaacuauugaaaga

SEQ ID NO: 337836 - RNA, 64 nt, hsa; identical to SEQ ID NO: 189745

SEQ ID NO: 337837 - RNA, 64 nt, hsa; identical to SEQ ID NO: 189746

SEQ ID NO: 337838 - RNA, 64 nt, hsa; identical to SEQ ID NO: 189747

SEQ ID NO: 337839 - RNA, 64 nt, hsa; identical to SEQ ID NO: 189748

SEQ ID NO: 337840 - RNA, 64 nt, hsa; identical to SEQ ID NO: 189749

SEQ ID NO: 337841 - RNA, 55 nt, hsa; identical to SEQ ID NO: 189750

SEQ ID NO: 337842 - RNA, 64 nt, hsa; identical to SEQ ID NO: 189751

SEQ ID NO: 337843 - RNA, 64 nt, hsa; identical to SEQ ID NO: 189752

SEQ ID NO: 337844 - RNA, 64 nt, hsa; identical to SEQ ID NO: 189753

SEQ ID NO: 337845 - RNA, 64 nt, hsa; identical to SEQ ID NO: 189754

SEQ ID NO: 337846 - RNA, 64 nt, hsa; identical to SEQ ID NO: 189755

SEQ ID NO: 337847 - RNA, 64 nt, hsa; identical to SEQ ID NO: 189756

SEQ ID NO: 337848 - RNA, 64 nt, hsa; identical to SEQ ID NO: 303425

SEQ ID NO: 337849 - RNA, 64 nt, hsa; identical to SEQ ID NO: 303426

SEQ ID NO: 337850 - RNA, 64 nt, hsa; identical to SEQ ID NO: 303427

SEQ ID NO: 337851 - RNA, 64 nt, hsa; identical to SEQ ID NO: 303428

SEQ ID NO: 337852 - RNA, 64 nt, hsa; identical to SEQ ID NO: 303429

SEQ ID NO: 337853 - RNA, 64 nt, hsa; identical to SEQ ID NO: 303430

SEQ ID NO: 337854 - RNA, 64 nt, hsa; identical to SEQ ID NO: 303431

SEQ ID NO: 337855 - RNA, 64 nt, hsa; identical to SEQ ID NO: 303432

SEQ ID NO: 337856 - RNA, 64 nt, hsa; identical to SEQ ID NO: 303433

SEQ ID NO: 337857 - RNA, 64 nt, hsa; identical to SEQ ID NO: 303434

SEQ ID NO: 337858 - RNA, 64 nt, hsa; identical to SEQ ID NO: 303435

SEQ ID NO: 337859 - RNA, 64 nt, hsa; identical to SEQ ID NO: 303436

SEQ ID NO: 337860 - RNA, 64 nt, hsa; identical to SEQ ID NO: 303437

SEQ ID NO: 337861 - RNA, 64 nt, hsa; identical to SEQ ID NO: 303438

SEQ ID NO: 337862 - RNA, 64 nt, hsa; identical to SEQ ID NO: 303439

SEQ ID NO: 337863 - RNA, 64 nt, hsa; identical to SEQ ID NO: 303440

SEQ ID NO: 337864 - RNA, 64 nt, hsa; identical to SEQ ID NO: 303441

SEQ ID NO: 337865 - RNA, 64 nt, hsa; identical to SEQ ID NO: 303442

SEQ ID NO: 337866 - RNA, 64 nt, hsa; identical to SEQ ID NO: 303443

SEQ ID NO: 337867 - RNA, 64 nt, hsa; identical to SEQ ID NO: 303444

SEQ ID NO: 337868 - RNA, 64 nt, hsa
auuuucugcaugucauaacauauccuaacugcuauuucagaagaggcagcuuguaggugauugu

SEQ ID NO: 337869 - RNA, 64 nt, hsa
caggaauaauaagcaauacuacacaacuugcuacuuucagaaaacuuuuuuuuagcuucaccga

SEQ ID NO: 337870 - RNA, 64 nt, hsa
guaaauucucuauuuuuuguaauguguucggugauuucagaaagcuagaaaguguauguguggc

SEQ ID NO: 337871 - RNA, 64 nt, hsa
uaaaacaucccuaacugaucgaauauaucaguaauuucagaaucagaugcauccuuucauaaga

SEQ ID NO: 337872 - RNA, 64 nt, hsa
guuuuaguagaaguguugugguuuuaguuggugcuuucagaacugcugccuaggaaacuauaaa

SEQ ID NO: 337873 - RNA, 64 nt, hsa
guggcaccuuggccacaugccugcaggcauuuguuuucagaacagucucaccaauuacaacaca

SEQ ID NO: 337874 - RNA, 64 nt, hsa
uuuuagacacuccccaaauuucuaaauuaaucuuuuucagaaauaucgaaggagccaaaaauau

SEQ ID NO: 337875 - RNA, 64 nt, hsa
uauuuuuauuguguaaugaucuuuaaacgcuauauuucagaaauauuaaauggaagaaaucaau

SEQ ID NO: 337876 - RNA, 64 nt, hsa
ucuggaaaugggaaagggagggguagaaguuccuuuucagaaauaaagaggcauucaugaaggc

SEQ ID NO: 337877 - RNA, 64 nt, hsa
agauuucgguaggcacagguguaaaaaggggagauuucagaagacgggcgaaacaacugauggg

SEQ ID NO: 337878 - RNA, 64 nt, hsa
agacucucucugauggucacuuuguggucugugcuuucagaaauacaggaaucugauaucaaca

SEQ ID NO: 337879 - RNA, 64 nt, hsa
auggccagagcuugaagucuggucucucauuuuguuucagaaaugagugagaggccuuccugca

SEQ ID NO: 337880 - RNA, 64 nt, hsa
uuugagcauaguagcucccuaaacucuuggagccuuucagaaauuccauguagugcuaauaacc

SEQ ID NO: 337881 - RNA, 64 nt, hsa
ugcuuuguuuuuauuuuuuaaguaccaaaauugguuucagaacacugauaacacucagaaaacc

SEQ ID NO: 337882 - RNA, 64 nt, hsa
caugauaaggagcauacgugcauguuuuccguacuuucagaauagagugccuuagcuaggccag

SEQ ID NO: 337883 - RNA, 64 nt, hsa
cuuaauguuaauacauauuacacuacaguuuacuuuucagaauacuaaagacuuuauaacugca

SEQ ID NO: 337884 - RNA, 64 nt, hsa
uugauacugauauugauuuuuauauagguauuuauuucagaauugauauuuugagaaaaauaca

SEQ ID NO: 337885 - RNA, 64 nt, hsa
aauaaauauuagaauaaauaugaaauugaacuauuuucagaaaaagggcaguauauuaagagca

SEQ ID NO: 337886 - RNA, 64 nt, hsa
guuuuuuuaauacgaucuauuuuuauagguucuuuuucagaaguaaaauuuuguacauauauac

SEQ ID NO: 337887 - RNA, 64 nt, hsa
uggcaugaaauuuugguaaaaucugaaaaucacauuucagaauaaaacaauugggcaaaacuac

SEQ ID NO: 337888 - RNA, 64 nt, hsa
agugauuuuuuaaaaauuuuuuaucuuuauaugguuucagaaguaugaaccagcuuucuuuuua

SEQ ID NO: 337889 - RNA, 64 nt, hsa
ugcucuuaaagaggagagcaggaagaaagguugguuucagaaaccaagagggucggcaguggac

SEQ ID NO: 337890 - RNA, 64 nt, hsa
ccucagcuccaccagcucuucaucaugccacucauuucagaacuugagcaaaacagggcaguca

SEQ ID NO: 337891 - RNA, 64 nt, hsa
uaggaauguaaauagauuaagucccacaaugaaauuucagaaguuuuuguucuguaaguaaaaa

SEQ ID NO: 337892 - RNA, 64 nt, hsa
guuacuccuuauuuaauuuugcgucugccaugguuuucagaaucugaauaguauuuauacuucu

SEQ ID NO: 337893 - RNA, 64 nt, hsa
aacuugucuuugauacaaaagagugcugacaguauuucagaaagcugagagaguuuuauacaug

SEQ ID NO: 337894 - RNA, 64 nt, hsa
gaaaacauugccucuuugcaucacauaccucguuuuucagaaacuuuccaaacugcuuuacaua

SEQ ID NO: 337895 - RNA, 64 nt, hsa
ccaggcugaaugcuggagaaaacuggcuaucaucuuucagaagucauuucuaccaucgucugcu

SEQ ID NO: 337896 - RNA, 64 nt, hsa
aaagaaaaaggacgaugucagucaagcagcacuuuuucagaauauacagaacauaaauaauaug

SEQ ID NO: 337897 - RNA, 64 nt, hsa
agcagcaguaaaagucacccuaaaucaaggggcuuuucagaaggucauucugaagaaauaaaga

SEQ ID NO: 337898 - RNA, 64 nt, hsa
uuucugauuucuucuacagcuguagaauaccaucuuucagaaaguuggcuggcuuuauuucuaa

SEQ ID NO: 337899 - RNA, 64 nt, hsa
gucuuucugaagcccugaaaugguaauuguagcauuucagaaaaugucuuucauuucaaucaau

SEQ ID NO: 337900 - RNA, 64 nt, hsa
uuaucacugucacacagcuuauaacauguaugcuuuucagaauacaguugucuagccaagccau

SEQ ID NO: 337901 - RNA, 64 nt, hsa
uucuaaaguuuugucucugacuuuuagaaauaaauuucagaaaaauuguuucaaaagauuuuga

SEQ ID NO: 337902 - RNA, 64 nt, hsa
agaagcuaggaauaauugaguuuuauagcacuauuuucagaauacgaaaagauacacaaucauu

SEQ ID NO: 337903 - RNA, 64 nt, hsa
uaacauuugguuuacuaauuuuuaaucauuuaucuuucagaacuuguuucuuaucaagaaguua

SEQ ID NO: 337904 - RNA, 64 nt, hsa
aaagagcacuuuuuaaacugccauuaaagauggguuucagaaaucauaaacuuugacgugugcc

SEQ ID NO: 337905 - RNA, 64 nt, hsa
auucuaagagcacaugacauguggcugccuccccuuucagaaacaagcugaguaacccagccug

SEQ ID NO: 337906 - RNA, 64 nt, hsa
uguggaacccaaacuguauggggauauuugauguuuucagaaagaggaagaaaauaugguccaa

SEQ ID NO: 337907 - RNA, 64 nt, hsa
gaaaaguagucccccaaauuaacaucagugucuguuucagaaucucucuacucagaugacccca

SEQ ID NO: 337908 - RNA, 64 nt, hsa
augaccccagaaacugaaccaacagaagcagacuuuucagaagauggugaagacagaaacccag

SEQ ID NO: 337909 - RNA, 64 nt, hsa
uuaagaagcucucuucaucuaagagcuguuacuuuuucagaaggggggguauuauugguauucu

SEQ ID NO: 337910 - RNA, 64 nt, hsa
ucggugucccuguaaaacaauccccacagauuacuuucagaaauagauguauuucucuacguaa

SEQ ID NO: 337911 - RNA, 64 nt, hsa
uugcuuuacugcaugaaugaaacugaugguucaauuucagaaguaaugauuaacaguuaugugg

SEQ ID NO: 337912 - RNA, 64 nt, hsa
caugaauugugucucaacagaaacuaaaugaacauuucagaauaaauuauugcuguauguaaac

SEQ ID NO: 337913 - RNA, 64 nt, hsa
ggcugccucuucuuuccucuuggugugcgaaguauuucagaaggccauugaugaauucccccuc

SEQ ID NO: 337914 - RNA, 64 nt, hsa
cuccugcuacacugacagacugauugcguggcucuuucagaagacccaggaagggcagcuccag

SEQ ID NO: 337915 - RNA, 64 nt, hsa
uucagaaaguccauuuuuguuuaaaauuagaacuuuucagaaugccaaaugaaggcuaaaauuu

SEQ ID NO: 337916 - RNA, 64 nt, hsa
uaucauaaccucuugguucauaugcugagaaauuuuucagaaaguccauuuuuguuuaaaauua

SEQ ID NO: 337917 - RNA, 64 nt, hsa
acaguugugacggauguauggauguucuugaacauuucagaaggagugguagaaaaaaacacac

SEQ ID NO: 337918 - RNA, 64 nt, hsa
ggggcagggugugguuuggggggaaauuuuucuuuuucagaagacagaacacagauguggacac

SEQ ID NO: 337919 - RNA, 64 nt, hsa
uuuuucccccugcuucagguuaauuuuuuggauauuucagaaacccauagcaauucagugauuu

SEQ ID NO: 337920 - RNA, 62 nt, hsa
auuuccuccaaacaaaauaaugcaggaauuuauuucagaaaauguaguuuacaagaauaaag

SEQ ID NO: 337921 - RNA, 64 nt, hsa
uucuguccacugcuauggagcagaguuuucccauuuucagaagauaaugacucacaugggaauu

SEQ ID NO: 337922 - RNA, 64 nt, hsa
aaccaccuuauuuuugagcuugguguuuugucuuuuucagaaacuaugagcugugucaccugac

SEQ ID NO: 337923 - RNA, 64 nt, hsa
caugccauccauuauuuuaaauaaacuaauagguuuucagaauuaugaauuuuucagaacucau

SEQ ID NO: 337924 - RNA, 64 nt, hsa
uaaauaaacuaauagguuuucagaauuaugaauuuuucagaacucauccaguccuuguaaucuu

SEQ ID NO: 337925 - RNA, 64 nt, hsa
gacccccaaagacaagacaagcacuuauuuuuauuuucagaagacaaaagaaccaagaugccaa

SEQ ID NO: 337926 - RNA, 64 nt, hsa
ucauguuugcaaaaggucacugugaggcugcauauuucagaaagauguccuuaauaagggaagu

SEQ ID NO: 337927 - RNA, 64 nt, hsa
ccaagucacugcugccauguguguacuguauuauuuucagaaaaaaauauaauagucugagucc

SEQ ID NO: 337928 - RNA, 64 nt, hsa
uauguuuucagaauucaucuuuugaacaacuugguuucagaauauguaaaaugacuuuaaggau

SEQ ID NO: 337929 - RNA, 64 nt, hsa
guuuugauauauucauuugcuacaccaacuauguuuucagaauucaucuuuugaacaacuuggu

SEQ ID NO: 337930 - RNA, 64 nt, hsa
ggccaagugcccaaaagcccucuugcggagcaaauuucagaauauauauguggauccaagcucu

SEQ ID NO: 337931 - RNA, 64 nt, hsa
augaaauauuuuaacauuuuaugggucagucaacuuucagaaauucagggagcuggagagggaa

SEQ ID NO: 337932 - RNA, 64 nt, hsa
cugucauuuaaaauucaugcauuccauauuuugcuuucagaacuuauagucuaugccaauuuug

SEQ ID NO: 337933 - RNA, 64 nt, hsa
ccucaaagagccguaagcuuuuuggaaaaaaacauuucagaagugaaggcuuuugagguuuaua

SEQ ID NO: 337934 - RNA, 64 nt, hsa
uauguuuguauuagccuuuagaaaaaacacuccguuucagaauuguucacaguuuuauuucuua

SEQ ID NO: 337935 - RNA, 64 nt, hsa
aucacgugaaugaaugguggaagacacaacuugguuucagaaagaagauaaacugugauuugac

SEQ ID NO: 337936 - RNA, 64 nt, hsa
uuuuuuaaggugaaaauguuuugacaaguuccuuuuucagaauagguuuuugagcagaacucuu

SEQ ID NO: 337937 - RNA, 64 nt, hsa
uuccacacuuuauuuccuuaauaauaauaaacuuuuucagaaagaauugaguagagcaaaaaug

SEQ ID NO: 337938 - RNA, 64 nt, hsa
guuucuccggcagaaccaacccuccaggacgaaguuucagaauuggcugauggucgugagugca

SEQ ID NO: 337939 - RNA, 64 nt, hsa
caacagcuguaacccuuuccugagggccccgacuuuucagaauaggagcagagagaagcccaga

SEQ ID NO: 337940 - RNA, 64 nt, hsa
ucucuaauugcuaguuguaaaacuguauccaaauuuucagaaaagacagcuucagcuugcaaau

SEQ ID NO: 337941 - RNA, 64 nt, hsa
aagaugaaacuauuguaucucacaaaaaaucuuauuucagaauggaaauauuuuugagaaaagu

SEQ ID NO: 337942 - RNA, 64 nt, hsa
uagaauacuaaaaggaaaaugucauguuaagcaauuucagaacauuaacugaacuauuuucaaa

SEQ ID NO: 337943 - RNA, 64 nt, hsa
ccuuuuacagcguauuacuuagugaacauuacauuuucagaauagauccuaauauuuuauugag

SEQ ID NO: 337944 - RNA, 64 nt, hsa
augcuuggaaacagcauagauauguugcugugguuuucagaauuuucucuuuuaaucacaagaa

SEQ ID NO: 337945 - RNA, 64 nt, hsa
cuugaauugcuaaagaaggccuaugaagccucccuuucagaaauuaagaaaggccaugaaauag

SEQ ID NO: 337946 - RNA, 64 nt, hsa
caucaaauaugaggagaaaccuccaaaaccagcauuucagaaugguuccucaggauccuuuuau

SEQ ID NO: 337947 - RNA, 64 nt, hsa
ccuuguuuggguaaaggcaguaacuaaguuuauguuucagaacugcaaaacaaacaggauaguu

SEQ ID NO: 337948 - RNA, 64 nt, hsa
augcaccuuuucugugaggaggaggggaucgugauuucagaaugaauuauguaucccuucucuu

SEQ ID NO: 337949 - RNA, 64 nt, hsa
uuuguugcuagagaacaauaauaaaauaauucuuuuucagaaaauauuuaauuucuucauaaaa

SEQ ID NO: 337950 - RNA, 64 nt, hsa
aaucauauugaugaaaucguaauucaugguugaguuucagaacaaaagauauucauugcacauu

SEQ ID NO: 337951 - RNA, 64 nt, hsa
aacuggucaauauaguggcagcauaaaguguuuauuucagaauaucaauacaguuuugucuuca

SEQ ID NO: 337952 - RNA, 64 nt, hsa
uuuaugccccuuugagccaaaauuuuuuuuuuuuuuucagaauccauaagaguuuauuuguugg

SEQ ID NO: 337953 - RNA, 64 nt, hsa
uuauggcaauuuaacauguguauucuuuuaauuguuucagaauaggauaauuagguauucgaau

SEQ ID NO: 337954 - RNA, 64 nt, hsa
aaacaaacuccauuacucugauuuuugauacaguuuucagaaaaagaaaugaacauaaucaagu

SEQ ID NO: 337955 - RNA, 64 nt, hsa
gcauuguccucugaguugguuaaauguuaauggauuucagaagccuaauuccaguaucauacuu

SEQ ID NO: 337956 - RNA, 64 nt, hsa
aucaagcuacccucaagaguuucugggcuggauguuucagaacaacaucuacaccaguaaagug

SEQ ID NO: 337957 - RNA, 64 nt, hsa
gguaauuuucuaucccuuauaaguuugucuuuucuuucagaaacaucucuuagccuaauuugaa

SEQ ID NO: 337958 - RNA, 64 nt, hsa
ucuguauauucccuguggaauguaccuaugugaguuucagaaauucucaaaauacguguucaaa

SEQ ID NO: 337959 - RNA, 64 nt, hsa
gcaaugagugugccagaguuauuagugccaaguuuuucagaaaguuugaagcaccauggugugu

SEQ ID NO: 337960 - RNA, 64 nt, hsa
ugacuucuaugaagcuuuuuuuuuaaugugaaauuuucagaauguuguuuuuuucauguagaua

SEQ ID NO: 337961 - RNA, 64 nt, hsa
aagaacaaggaagggaaugaucuuuacucaagaauuucagaaagucagcacugaaguccugacc

SEQ ID NO: 337962 - RNA, 64 nt, hsa
caauguagaguuacgcuuuuauaaguauuucauguuucagaaaugaugcauacagcaauuugua

SEQ ID NO: 337963 - RNA, 64 nt, hsa
gaagucaugcaaauuguaaaacaggaaggaaaccuuucagaagucauacuuuuguuuugcaaca

SEQ ID NO: 337964 - RNA, 64 nt, hsa
uaagacagggacucagcaggagcuugacaggguguuucagaaacuuggaaaccugaagcagcag

SEQ ID NO: 337965 - RNA, 59 nt, hsa
uggugguauguacaagaugagagcgagccuuucagaagccagggucugguccuggcucc

SEQ ID NO: 337966 - RNA, 64 nt, hsa
uauucucaauuuaucaauggauacgugcauguuauuucagaauuaugcaaaacgucaaaaucug

SEQ ID NO: 337967 - RNA, 64 nt, hsa
auacucgaaugucagguuuuugguuuuauuauuauuucagaacuagcucagcccaucucuaauu

SEQ ID NO: 337968 - RNA, 64 nt, hsa
cacuucuagcucggaacuuacuguguaaauaaacuuucagaacugcuaccaugaagugaaaaug

SEQ ID NO: 337969 - RNA, 64 nt, hsa
aauucuccaacccaaaguauucuucuuuucuuaguuucagaaguacuggcaucacacgcagguu

SEQ ID NO: 337970 - RNA, 64 nt, hsa
ucucagcuuucuccaccuuucaguuucucaguuguuucagaaacauagcaaugacauaaaaacu

SEQ ID NO: 337971 - RNA, 64 nt, hsa
ugugcauaugugugcauugccacucucccaaguuuuucagaaaccagcagagcugucaacucuu

SEQ ID NO: 337972 - RNA, 64 nt, hsa
uggcuuucuuccauuguuguuuuuguagcauuuauuucagaaauguguauuuccauaauccaga

SEQ ID NO: 337973 - RNA, 64 nt, hsa
gguuuucuuaaugccagugugaauuugcagauguuuucagaaaaucaagucacaguaacaauuu

SEQ ID NO: 337974 - RNA, 64 nt, hsa
agagaccaaccauauuugggaugaguguaaaagcuuucagaaauaaguuacaaaucuuuguaga

SEQ ID NO: 337975 - RNA, 64 nt, hsa
cauuuuacccauuguuggauaaugguaaucucuuuuucagaauuuugagucuguaauucauuug

SEQ ID NO: 337976 - RNA, 64 nt, hsa
aauuguauaaccagaauuguuccugccuuuagcuuuucagaacuugagauguggcagcacugga

SEQ ID NO: 337977 - RNA, 64 nt, hsa
ugcuguacauuuuggcccuuacgaaauacgucuuuuucagaacuguuaaaguuuugauguacau

SEQ ID NO: 337978 - RNA, 64 nt, hsa
uggaaaaaagugaaugagaccucugauaggggguuuucagaaccuuguucacaccaaaauguga

SEQ ID NO: 337979 - RNA, 64 nt, hsa
cacuaaaguuuuguuucagcaguggcucaaaaaauuucagaaauuacuuuuguaauuauuugca

SEQ ID NO: 337980 - RNA, 64 nt, hsa
cuguaauaaaugguauugauaaucagagaauguauuucagaauacuacaguacaauauauuaug

SEQ ID NO: 337981 - RNA, 64 nt, hsa
aaacagucuuccacuaaccuuugugaguuuauauuuucagaauucagacuuaguuguuaaaaug

SEQ ID NO: 337982 - RNA, 64 nt, hsa
aaaauuggaggugcuggugguauggcugacccuguuucagaagcaggauaguauaaaagcauca

SEQ ID NO: 337983 - RNA, 64 nt, hsa
gaaaacucaacuguuucucuuuguuaucuaaauguuucagaauucaaucgugaaggaacaggca

SEQ ID NO: 337984 - RNA, 64 nt, hsa
cugguaauuuuagugaucuuauuugauuagacuuuuucagaaguacuaaauaaggaauuuuaac

SEQ ID NO: 337985 - RNA, 64 nt, hsa
ucacaaggggaaauuuaagauuguuaacccuguuuuucagaagggcuacuguuaauugcacaua

SEQ ID NO: 337986 - RNA, 64 nt, hsa
gcuuucauaauauguaacuuuuggguucugccuuuuucagaaaauggaaacuugggccaugugu

SEQ ID NO: 337987 - RNA, 64 nt, hsa
gaaauuuuucucugccuuucaguuuuaugaauuuuuucagaaguaacaauauuauuauugacuu

SEQ ID NO: 337988 - RNA, 64 nt, hsa
ugauuauguaguucaguaagaugugcccaagucauuucagaaagaaagacccuucaguuuugau

SEQ ID NO: 337989 - RNA, 64 nt, hsa
uuuuagcaauaauucguuaaugauuccacuugauuuucagaauauuguccugguugauuuugau

SEQ ID NO: 337990 - RNA, 64 nt, hsa
uuuagagaacucagguauucuuuccugacauuguuuucagaauaaagaauauuuuucauaauau

SEQ ID NO: 337991 - RNA, 64 nt, hsa
uguggaugauauuuguucaauaugucaagcugaauuucagaagccaauucuucucauuugucag

SEQ ID NO: 337992 - RNA, 64 nt, hsa
cccaaggucacaaggccgaacauuuucagaaaucuuucagaacucaaagggcauuuagaggaag

SEQ ID NO: 337993 - RNA, 64 nt, hsa
agcagguguuacccaaggucacaaggccgaacauuuucagaaaucuuucagaacucaaagggca

SEQ ID NO: 337994 - RNA, 64 nt, hsa
ucuuugucuaagagcuguggcaacagcaccugaauuucagaaacaaaaggccgggcgcgguggc

SEQ ID NO: 337995 - RNA, 64 nt, hsa
ugcauguaaauauauacucucaacauuuaaaagauuucagaagguuccuggaaauuccaauguc

SEQ ID NO: 337996 - RNA, 64 nt, hsa
uuaaauaucuaaagggaaaggaaaccaacuuuaauuucagaacuucucuuuacgucuuguaugu

SEQ ID NO: 337997 - RNA, 64 nt, hsa
guuacagaauucuuuuugguacuuucacuuauucuuucagaauacaucaaggaugugauuuaug

SEQ ID NO: 337998 - RNA, 64 nt, hsa
agggcauucaucuuugauguucuuccuuuucacauuucagaaucggcaaugccuggcccacucc

SEQ ID NO: 337999 - RNA, 64 nt, hsa
caggaaccuugcacuucacacuucuugagucucguuucagaaggaaaaucauuugggauuccua

SEQ ID NO: 338000 - RNA, 64 nt, hsa
caucccuuguaaagcuaaaauaguuacuucaaauuuucagaaaagauguauauagucaaaauuu

SEQ ID NO: 338001 - RNA, 64 nt, hsa
uuucuuuucaugugcccagcagguuaaguagcguuuucagaauauacauuauucccauccauug

SEQ ID NO: 338002 - RNA, 64 nt, hsa
cagccuucaaaagaauuggcacugggauaagauuuuucagaaaaagaaaaacaucggcaaacug

SEQ ID NO: 338003 - RNA, 64 nt, hsa
caucgcugagcaaauggagcuugcuauguuuuaauuucagaaaauuuccucauauacguagugu

SEQ ID NO: 338004 - RNA, 64 nt, hsa
agauauuuuuaaaauccaagagcuucucuauacuuuucagaaauauccagaugcagugaacugc

SEQ ID NO: 338005 - RNA, 64 nt, hsa
ucuuacuuuuaaauuccaacuuaaaauuaugagguuucagaaauauauugaaaguuuaacaaug

SEQ ID NO: 338006 - RNA, 64 nt, hsa
agcagaaagauuauguuagaagugugauuuuuauuuucagaagucauauacauguaagcuacaa

SEQ ID NO: 338007 - RNA, 64 nt, hsa
auaaaaaaaaaaaaaaagauuuccaaaaugccguuuucagaaccuggguuuuaauagcaguauu

SEQ ID NO: 338008 - RNA, 64 nt, hsa
ugcugaaaugccauuucagaauguauaaaaguacuuucagaauuagaagaaaagugagagcuuc

SEQ ID NO: 338009 - RNA, 64 nt, hsa
ugccaccuucauuuuuccaucugcugaaaugccauuucagaauguauaaaaguacuuucagaau

SEQ ID NO: 338010 - RNA, 64 nt, hsa
guauucccauuuuuaaaauaaauacaaauguuuauuucagaagggcaguuuugauuauauguga

SEQ ID NO: 338011 - RNA, 64 nt, hsa
uuauaaacacagccuuucuuuagcauugauuuaauuucagaacaucuucauauugauuauuagc

SEQ ID NO: 338012 - RNA, 64 nt, hsa
ugcagaaagccagaggacuagagccaaaaacuuguuucagaaagauaggagauagcucuguaga

SEQ ID NO: 338013 - RNA, 64 nt, hsa
uacagaaagccagaggacuagauccaaagacuuguuucagaaagaugagagagaacucugugga

SEQ ID NO: 338014 - RNA, 64 nt, hsa
ugcagaaagccagaggacuagaggccaagacuuguuucagaaagauggaagagaguucuuugga

SEQ ID NO: 338015 - RNA, 64 nt, hsa
uuuuucucuagaguagagguauaauugugugauauuucagaaauacagauaaaugauucaaaaa

SEQ ID NO: 338016 - RNA, 64 nt, hsa
uguugcugauuuuauucuugaucaguaguuugcauuucagaaagccuuucauuuugcuuuaauu

SEQ ID NO: 338017 - RNA, 64 nt, hsa
aaauuugcagcuuccaaugccucuugucuuccuauuucagaaguuuaaauauuaagcaugacag

SEQ ID NO: 338018 - RNA, 64 nt, hsa
accacaacugcauguuggauuagauugucucauauuucagaauaaaauguacuguauacuuuuc

SEQ ID NO: 338019 - RNA, 64 nt, hsa
ggaaaggaaggcaaucgacacaguuauuagcacauuucagaaaaugaacacccuugugauagaa

SEQ ID NO: 338020 - RNA, 64 nt, hsa; identical to SEQ ID NO: 338000

SEQ ID NO: 338021 - RNA, 64 nt, hsa; identical to SEQ ID NO: 338001

SEQ ID NO: 338022 - RNA, 64 nt, hsa
ggccucagugacuguguugcuaaacccaguggucaguucucaguucucagccaucagcagcauu

SEQ ID NO: 338023 - RNA, 64 nt, hsa
gugacuguguugcuaaacccaguggucaguucucaguucucagccaucagcagcauuugcucgc

SEQ ID NO: 338024 - RNA, 64 nt, hsa
ggauuagaaacaaacaaaacucuuaaguccuaaaaguucucaauguagaggcauaaaccugugc

SEQ ID NO: 338025 - RNA, 64 nt, hsa
aguggaggcuggaugugcauuagccuggauccucaguucucaaauguguguggcagccaggaug

SEQ ID NO: 338026 - RNA, 64 nt, hsa
gccuguccgauuuuuccauggguuccaguuucagaguucucauuauuacucaaaguaaaagcgg

SEQ ID NO: 338027 - RNA, 64 nt, hsa
cuguccguguuacauaaucaagugcaauauacucaguucucaugcaggugacauucuaccauga

SEQ ID NO: 338028 - RNA, 64 nt, hsa
gagaguaggcaaacaaauuuugccuucaugguacaguucucaguuuuucuuauaggagaaauau

SEQ ID NO: 338029 - RNA, 64 nt, hsa
uauaauguauguguaauauacauaaucauaauacaguucucagaugcagggaagaaguuuggca

SEQ ID NO: 338030 - RNA, 64 nt, hsa
cagaggauuugaaccauaauccuuggaaaacuuaaguucucauucaccccaguuuuuccuccag

SEQ ID NO: 338031 - RNA, 64 nt, hsa
ugcccucgagaagaguuauugcucuagaaaguugaguucucauuuuuuuaaccuguuauagauu

SEQ ID NO: 338032 - RNA, 64 nt, hsa
acugcaaauggcauaaaaauuaaaguccuagcugaguucucaaugguaaaggcaucagaugucu

SEQ ID NO: 338033 - RNA, 64 nt, hsa
caaucaagcucaccaugcagggcagucacccggcaguucucaaacuuuagcaugugaagaguca

SEQ ID NO: 338034 - RNA, 64 nt, hsa
agauaucuauaacuauagggauacaaaucacuacaguucucagauuuacagcuuuuuuuuguca

SEQ ID NO: 338035 - RNA, 64 nt, hsa
gacauggaacagcagguaguuguuauguagagcuaguucucaaagcugcccugccuguuuuagg

SEQ ID NO: 338036 - RNA, 64 nt, hsa
gcagcucuggagcuccaccaacucucggccugccaguucucaagcgagcuaaucuugucauuaa

SEQ ID NO: 338037 - RNA, 64 nt, hsa
accguguguucggacggcacuggcuccuuuccgaaguucucaguaacugagcccagaguaacug

SEQ ID NO: 338038 - RNA, 64 nt, hsa
cuuuaaaagaaaggagagaacauuuuagaacaauaguucucaaaguguguuccccggacaagca

SEQ ID NO: 338039 - RNA, 64 nt, hsa
agcacaggcugacaccaaaguggcacaacugcacaguucucagauuucuuugcacagauugauu

SEQ ID NO: 338040 - RNA, 64 nt, hsa
caugcuaauuuucauuucuagaauggucacuggcaguucucacuuuuaacuauaagaagucacg

SEQ ID NO: 338041 - RNA, 64 nt, hsa
gcaaugucuuugagaaugcagucauuugcacgugaguucucaucuuuguuuucugaaacagacg

SEQ ID NO: 338042 - RNA, 64 nt, hsa
caaauauaaagaaugugacaaagcuuuuuaaggaaguucucaacccuuauuacacauaauucau

SEQ ID NO: 338043 - RNA, 64 nt, hsa
ugaagaauguggcaaaaccuauaaaccuauaacaaguucucaauuccuuuuuuuuugagaugga

SEQ ID NO: 338044 - RNA, 64 nt, hsa
uugaaaugugaugaauguggcauagccucuucccaguucucaacucuuacuaaacaugagaaca

SEQ ID NO: 338045 - RNA, 64 nt, hsa
cuacaaauaugaagaaugugacaaggccuuuaaaaguucucaacccuuauuacacauaauuuau

SEQ ID NO: 338046 - RNA, 64 nt, hsa
cuugggaucuuguuuagagaauccacuuucuggaaguucucagcauaauuaguguugagagugg

SEQ ID NO: 338047 - RNA, 64 nt, hsa
aauuuauuaacagucagggccuauccuugccuguaguucucagucacuggaugcacaaaaucac

SEQ ID NO: 338048 - RNA, 64 nt, hsa
ucuugugauagugaguucucauaagaucucagugaguucucaugagaucugguuuuuugaaagu

SEQ ID NO: 338049 - RNA, 64 nt, hsa
ggcggacuucccccuugcuguucuugugauagugaguucucauaagaucucagugaguucucau

SEQ ID NO: 338050 - RNA, 64 nt, hsa
cccaaauccggaagucaaaguucucauggucagaaguucucauggugcacgaguccucagcacu

SEQ ID NO: 338051 - RNA, 64 nt, hsa
ucaccugggcagaucccccaaauccggaagucaaaguucucauggucagaaguucucauggugc

SEQ ID NO: 338052 - RNA, 64 nt, hsa; identical to SEQ ID NO: 193119

SEQ ID NO: 338053 - RNA, 64 nt, hsa; identical to SEQ ID NO: 193120

SEQ ID NO: 338054 - RNA, 64 nt, hsa; identical to SEQ ID NO: 193121

SEQ ID NO: 338055 - RNA, 64 nt, hsa; identical to SEQ ID NO: 193122

SEQ ID NO: 338056 - RNA, 64 nt, hsa; identical to SEQ ID NO: 193123

SEQ ID NO: 338057 - RNA, 64 nt, hsa; identical to SEQ ID NO: 193124

SEQ ID NO: 338058 - RNA, 64 nt, hsa; identical to SEQ ID NO: 193125

SEQ ID NO: 338059 - RNA, 64 nt, hsa; identical to SEQ ID NO: 193126

SEQ ID NO: 338060 - RNA, 64 nt, hsa; identical to SEQ ID NO: 193127

SEQ ID NO: 338061 - RNA, 64 nt, hsa; identical to SEQ ID NO: 193128

SEQ ID NO: 338062 - RNA, 64 nt, hsa; identical to SEQ ID NO: 193129

SEQ ID NO: 338063 - RNA, 64 nt, hsa; identical to SEQ ID NO: 193130

SEQ ID NO: 338064 - RNA, 64 nt, hsa; identical to SEQ ID NO: 193131

SEQ ID NO: 338065 - RNA, 64 nt, hsa; identical to SEQ ID NO: 193132

SEQ ID NO: 338066 - RNA, 60 nt, hsa
uucaauuaagguacuucucccucagggacguagaacaauggaaugucagucagucucugu

SEQ ID NO: 338067 - RNA, 60 nt, hsa; identical to SEQ ID NO: 338066

SEQ ID NO: 338068 - RNA, 60 nt, hsa
uuuuacaaaagaaguaucuguuuuauuguauagaacaaguacagcauuuuacuacauagu

SEQ ID NO: 338069 - RNA, 60 nt, hsa
guuaauaaguuagacagaacuuuggcacuuuagaacaaaugcaugagugguauuucaguu

SEQ ID NO: 338070 - RNA, 60 nt, hsa
uauuuucacauaagucaauagauguuucucuagaacaaaauauuuaguaaagcuuuauaa

SEQ ID NO: 338071 - RNA, 60 nt, hsa
cagugacaaucaucauauuggagcaaaacauagaacaaaaucacuaucucagaaauaccu

SEQ ID NO: 338072 - RNA, 60 nt, hsa
aauccuaggaacuguauacuaguuccuacuuagaacaaaaguaucaaguuugcacacaag

SEQ ID NO: 338073 - RNA, 60 nt, hsa
uacuuuacuuguauuaucccauuuaauacuuagaacaaccccgugagauaaguaguuauu

SEQ ID NO: 338074 - RNA, 60 nt, hsa
uuguaauauuuaagaaaugcucauucuuuguagaacaaaaauguauuaaauauuuuaaaa

SEQ ID NO: 338075 - RNA, 60 nt, hsa
cuuugagaacugcuugacuccaugaucuccuagaacaaaaccgcccugacuuuacagggg

SEQ ID NO: 338076 - RNA, 60 nt, hsa
gaaagaaauuugacucauaaacuuccaaguuagaacaaauauuucuucauuauuguugcu

SEQ ID NO: 338077 - RNA, 60 nt, hsa
ugucucaguaauuagaaaucccuuaauaaguagaacaaauguggcaaguaggacuccuau

SEQ ID NO: 338078 - RNA, 64 nt, hsa; identical to SEQ ID NO: 23640

SEQ ID NO: 338079 - RNA, 64 nt, hsa; identical to SEQ ID NO: 23641

SEQ ID NO: 338080 - RNA, 64 nt, hsa; identical to SEQ ID NO: 23642

SEQ ID NO: 338081 - RNA, 64 nt, hsa; identical to SEQ ID NO: 23643

SEQ ID NO: 338082 - RNA, 64 nt, hsa; identical to SEQ ID NO: 23644

SEQ ID NO: 338083 - RNA, 64 nt, hsa; identical to SEQ ID NO: 23645

SEQ ID NO: 338084 - RNA, 64 nt, hsa; identical to SEQ ID NO: 23646

SEQ ID NO: 338085 - RNA, 64 nt, hsa; identical to SEQ ID NO: 23647

SEQ ID NO: 338086 - RNA, 64 nt, hsa; identical to SEQ ID NO: 23648

SEQ ID NO: 338087 - RNA, 64 nt, hsa; identical to SEQ ID NO: 23649

SEQ ID NO: 338088 - RNA, 64 nt, hsa; identical to SEQ ID NO: 23650

SEQ ID NO: 338089 - RNA, 64 nt, hsa; identical to SEQ ID NO: 23651

SEQ ID NO: 338090 - RNA, 64 nt, hsa; identical to SEQ ID NO: 23652

SEQ ID NO: 338091 - RNA, 64 nt, hsa; identical to SEQ ID NO: 23653

SEQ ID NO: 338092 - RNA, 64 nt, hsa; identical to SEQ ID NO: 23654

SEQ ID NO: 338093 - RNA, 64 nt, hsa; identical to SEQ ID NO: 23655

SEQ ID NO: 338094 - RNA, 64 nt, hsa; identical to SEQ ID NO: 23656

SEQ ID NO: 338095 - RNA, 64 nt, hsa; identical to SEQ ID NO: 23657

SEQ ID NO: 338096 - RNA, 64 nt, hsa; identical to SEQ ID NO: 23658

SEQ ID NO: 338097 - RNA, 64 nt, hsa; identical to SEQ ID NO: 23659

SEQ ID NO: 338098 - RNA, 64 nt, hsa; identical to SEQ ID NO: 23660

SEQ ID NO: 338099 - RNA, 64 nt, hsa; identical to SEQ ID NO: 23661

SEQ ID NO: 338100 - RNA, 64 nt, hsa; identical to SEQ ID NO: 23662

SEQ ID NO: 338101 - RNA, 64 nt, hsa; identical to SEQ ID NO: 23663

SEQ ID NO: 338102 - RNA, 64 nt, hsa; identical to SEQ ID NO: 23664

SEQ ID NO: 338103 - RNA, 64 nt, hsa; identical to SEQ ID NO: 23665

SEQ ID NO: 338104 - RNA, 64 nt, hsa; identical to SEQ ID NO: 23666

SEQ ID NO: 338105 - RNA, 64 nt, hsa; identical to SEQ ID NO: 23667

SEQ ID NO: 338106 - RNA, 64 nt, hsa; identical to SEQ ID NO: 23668

SEQ ID NO: 338107 - RNA, 64 nt, hsa; identical to SEQ ID NO: 23669

SEQ ID NO: 338108 - RNA, 64 nt, hsa; identical to SEQ ID NO: 23670

SEQ ID NO: 338109 - RNA, 64 nt, hsa
ucccuggaccucagaggugacacccauugggcccuuccggcaugcccccaguuacuguaaaugu

SEQ ID NO: 338110 - RNA, 64 nt, hsa
uaucuccaggagagcagggcagccuaugcaaguguuccggcaggaccagaaguggccacucaac

SEQ ID NO: 338111 - RNA, 64 nt, hsa
gaaaacccagaugguguuaacuggccgccccacuuuccggcauaacuuuuuagaaaacagaaau

SEQ ID NO: 338112 - RNA, 64 nt, hsa
cuuggguggaucaggacaccugaagaagagaagcuuccggcaacccugcaacccacccaaggag

SEQ ID NO: 338113 - RNA, 64 nt, hsa
gugacacaagcugcuuuagcuaaagucccgcggguuccggcauggcuaggcugagagcagggau

SEQ ID NO: 338114 - RNA, 64 nt, hsa
guuguccacacuccccagcugcacugaccaguguuuccggcaaaaccacauucaugggacacuu

SEQ ID NO: 338115 - RNA, 64 nt, hsa
ugggcggccaccugaggagugacuccaagaagaguuccggcagcuuuccccaggaaagggugag

SEQ ID NO: 338116 - RNA, 64 nt, hsa
cuccacugagaggacugguuuaugccagaucauuuuccggcacacacggaguggcuuugacaga

SEQ ID NO: 338117 - RNA, 64 nt, hsa
uggaaaguaauccaguuugaaaugugaagauguauuccggcagaauagugaguagaaugacaug

SEQ ID NO: 338118 - RNA, 64 nt, hsa
cguguuaccacucuuacuaguuuuuuguuaaucuuuccggcauuuuuaaauaaaaaccaagcaa

SEQ ID NO: 338119 - RNA, 64 nt, hsa
guuguucuuaagagaauugggcuuucuucaucccuuccggcagggagaagcugcccuuugaguu

SEQ ID NO: 338120 - RNA, 64 nt, hsa
gccucgcccacagacggacagaccccucccuuucuuccggcaaaaggaccgagcccugggguag

SEQ ID NO: 338121 - RNA, 64 nt, hsa
cuuuuuguagauauuuaaacaagauuugcugcauuuccggcaaugcccugugcaugccaugguc

SEQ ID NO: 338122 - RNA, 64 nt, hsa
uccaaggcugaggaccccaguggggaguguucuguuccggcauauccuggccguaacgauuuuu

SEQ ID NO: 338123 - RNA, 64 nt, hsa
cuucuaaugcucaggguucuggagggcucuguccuuccggcaaggagaggcacacaugugugcc

SEQ ID NO: 338124 - RNA, 64 nt, hsa
aggggaugcugcugaugugcagagacaucccuuuuuccggcacaugaauugggacgaccuucug

SEQ ID NO: 338125 - RNA, 64 nt, hsa
aaugaagaaguaguuaaaaauguauggacaguuuuuccggcaaaauuuguagcuuaugucuugg

SEQ ID NO: 338126 - RNA, 64 nt, hsa
cauugcgggggguaccaugcagccggugucugacuuccggcagcagcugcuggccugugccggg

SEQ ID NO: 338127 - RNA, 64 nt, hsa
ccccaccugacacccacuggggugcacuuuaauguuccggcagcaagacuggggaacuucaggc

SEQ ID NO: 338128 - RNA, 64 nt, hsa
uuguuuuauuucaccaggcugcaugagacugaccuuccggcauucuuacuaauagucuuucuau

SEQ ID NO: 338129 - RNA, 64 nt, hsa
auggaugaagugaacccaugcagugacuggaugauuccggcauuccugggucuuccuacacuug

SEQ ID NO: 338130 - RNA, 64 nt, hsa
uggugucgucugugaaugcuaaguccaucacccuuuccggcacacugccaaauaaacagcuauu

SEQ ID NO: 338131 - RNA, 64 nt, hsa
accauuagcaugacuuuuaagcacaguaauagaguuccggcauguucagaacaaccugaugaga

SEQ ID NO: 338132 - RNA, 64 nt, hsa
gcaaaagaucugugcacugaacagugaagguggcuuccggcacacuccccgcugccccggaaga

SEQ ID NO: 338133 - RNA, 64 nt, hsa
ccuuuuuggaaugcgagcucccaccagaagaagguuccggcacgaaucccauccccacgucugg

SEQ ID NO: 338134 - RNA, 64 nt, hsa
cagcaggugcuucuggagacaagagcaaagccuuuuccggcagcccggaaccugggaugagaaa

SEQ ID NO: 338135 - RNA, 64 nt, hsa
cagcagcaaagagaagagcauuggggcuggaguguuccggcaaagacagagccagcagcugcgc

SEQ ID NO: 338136 - RNA, 64 nt, hsa
gccuggcccaccccacccacuucugcacuugcgguuccggcauggacaauggaccggagagugg

SEQ ID NO: 338137 - RNA, 64 nt, hsa
guuguccuccaccagcauuucccuuacucugaaguuccggcauucacaucauucauguuuucuu

SEQ ID NO: 338138 - RNA, 64 nt, hsa
ugcucccucagagcuacucuucacuugucccugcuuccggcaccaaguucauaauagagaucuu

SEQ ID NO: 338139 - RNA, 64 nt, hsa
gaggcucugggacaaggcgggagguucgggggccuuccggcaggugaacgcagggcuggagagu

SEQ ID NO: 338140 - RNA, 64 nt, hsa
ggcuugggcugucggggcggaggcgcuggcgggcuuccggcauugagcugaguuggccucgccc

SEQ ID NO: 338141 - RNA, 56 nt, hsa
ccaucggcccggggcccuagcgccuguuccggcagacccccgccgguggcugcugu

SEQ ID NO: 338142 - RNA, 64 nt, hsa
ccugcacacgagcagacacccuuggagcucugaguuccggcaccaguagcaggcccgaaagagg

SEQ ID NO: 338143 - RNA, 64 nt, hsa
uuaaaaaauacaugucuauuugucaaacauaagugggaaccaaagaaaaaaugugacaaguuug

SEQ ID NO: 338144 - RNA, 64 nt, hsa
caucccauugccacuuuaccauucuauuucccaagggaaccaucagcaccaaccugcuaaaugc

SEQ ID NO: 338145 - RNA, 64 nt, hsa
aggcaggaaccucucagccgaugccccccgguaugggaaccagcaccucccaccaaccaaccac

SEQ ID NO: 338146 - RNA, 64 nt, hsa
agccaggaaccucucagccgaugccccccaguaugggaaccagcaccucccaccaaccagccac

SEQ ID NO: 338147 - RNA, 64 nt, hsa
agccaggaaccucucagccgaugccccccggugugggaaccagcaccucccaccaaccagccac

SEQ ID NO: 338148 - RNA, 64 nt, hsa
uaggccucggugcuggccuggguucuagaucucugggaaccagugccugagucacagcugucag

SEQ ID NO: 338149 - RNA, 64 nt, hsa
aguggugagugacuggccuggguucuagaccucugggaaccagcaccugagucacagcugucua

SEQ ID NO: 338150 - RNA, 64 nt, hsa
gcaguccaaggaauaucaaaauucugguuguauugggaaccaagguuacuuucuuguuuuugga

SEQ ID NO: 338151 - RNA, 64 nt, hsa
ugcaguccaaggaauaucaaaauucugauuguaugggaaccaagguuacuuucuuguucuugga

SEQ ID NO: 338152 - RNA, 64 nt, hsa; identical to SEQ ID NO: 99218

SEQ ID NO: 338153 - RNA, 64 nt, hsa; identical to SEQ ID NO: 99219

SEQ ID NO: 338154 - RNA, 64 nt, hsa; identical to SEQ ID NO: 99220

SEQ ID NO: 338155 - RNA, 64 nt, hsa; identical to SEQ ID NO: 99221

SEQ ID NO: 338156 - RNA, 64 nt, hsa; identical to SEQ ID NO: 99222

SEQ ID NO: 338157 - RNA, 64 nt, hsa; identical to SEQ ID NO: 99223

SEQ ID NO: 338158 - RNA, 64 nt, hsa; identical to SEQ ID NO: 99224

SEQ ID NO: 338159 - RNA, 64 nt, hsa; identical to SEQ ID NO: 99225

SEQ ID NO: 338160 - RNA, 64 nt, hsa; identical to SEQ ID NO: 99226

SEQ ID NO: 338161 - RNA, 64 nt, hsa; identical to SEQ ID NO: 99227

SEQ ID NO: 338162 - RNA, 64 nt, hsa; identical to SEQ ID NO: 99228

SEQ ID NO: 338163 - RNA, 64 nt, hsa; identical to SEQ ID NO: 99229

SEQ ID NO: 338164 - RNA, 64 nt, hsa; identical to SEQ ID NO: 99230

SEQ ID NO: 338165 - RNA, 64 nt, hsa; identical to SEQ ID NO: 99231

SEQ ID NO: 338166 - RNA, 64 nt, hsa; identical to SEQ ID NO: 99232

SEQ ID NO: 338167 - RNA, 64 nt, hsa; identical to SEQ ID NO: 99233

SEQ ID NO: 338168 - RNA, 64 nt, hsa; identical to SEQ ID NO: 99234

SEQ ID NO: 338169 - RNA, 64 nt, hsa; identical to SEQ ID NO: 99235

SEQ ID NO: 338170 - RNA, 64 nt, hsa; identical to SEQ ID NO: 99236

SEQ ID NO: 338171 - RNA, 64 nt, hsa; identical to SEQ ID NO: 99237

SEQ ID NO: 338172 - RNA, 64 nt, hsa; identical to SEQ ID NO: 99238

SEQ ID NO: 338173 - RNA, 64 nt, hsa; identical to SEQ ID NO: 99239

SEQ ID NO: 338174 - RNA, 64 nt, hsa; identical to SEQ ID NO: 99240

SEQ ID NO: 338175 - RNA, 64 nt, hsa; identical to SEQ ID NO: 99241

SEQ ID NO: 338176 - RNA, 64 nt, hsa; identical to SEQ ID NO: 193776

SEQ ID NO: 338177 - RNA, 64 nt, hsa; identical to SEQ ID NO: 193777

SEQ ID NO: 338178 - RNA, 64 nt, hsa; identical to SEQ ID NO: 193778

SEQ ID NO: 338179 - RNA, 64 nt, hsa; identical to SEQ ID NO: 193779

SEQ ID NO: 338180 - RNA, 64 nt, hsa; identical to SEQ ID NO: 193780

SEQ ID NO: 338181 - RNA, 64 nt, hsa; identical to SEQ ID NO: 193781

SEQ ID NO: 338182 - RNA, 64 nt, hsa; identical to SEQ ID NO: 193782

SEQ ID NO: 338183 - RNA, 64 nt, hsa; identical to SEQ ID NO: 193783

SEQ ID NO: 338184 - RNA, 64 nt, hsa; identical to SEQ ID NO: 193784

SEQ ID NO: 338185 - RNA, 64 nt, hsa; identical to SEQ ID NO: 193785

SEQ ID NO: 338186 - RNA, 64 nt, hsa; identical to SEQ ID NO: 193786

SEQ ID NO: 338187 - RNA, 64 nt, hsa; identical to SEQ ID NO: 193787

SEQ ID NO: 338188 - RNA, 64 nt, hsa; identical to SEQ ID NO: 193788

SEQ ID NO: 338189 - RNA, 64 nt, hsa; identical to SEQ ID NO: 193789

SEQ ID NO: 338190 - RNA, 64 nt, hsa; identical to SEQ ID NO: 193790

SEQ ID NO: 338191 - RNA, 64 nt, hsa
aaacaugaaaauuuuugaguuacaauuuggagcauaacuggaggguggguuggggaggggugga

SEQ ID NO: 338192 - RNA, 64 nt, hsa
cucgaauaaaaucugcugcaccuuguaaaugcucuaacuggacaugaaggaaaggggcgaggga

SEQ ID NO: 338193 - RNA, 64 nt, hsa
ucaaaauacuuuuuaaggauggcacaguaccauauaacuggaguaauaaaacaugagcuuacau

SEQ ID NO: 338194 - RNA, 64 nt, hsa
gaaaaggaaauagguuuuagguggcauaguggcuuaacuggacugaauucaaauauucuuucaa

SEQ ID NO: 338195 - RNA, 64 nt, hsa
agagccuguaucuggauuuagcacuugaaagaucuaacuggauauuuggguuaaaagaaucaca

SEQ ID NO: 338196 - RNA, 64 nt, hsa
cuuacuuaguucuuagcuacacccacucuaaaauuaacuggacauuaguguacagcccaugucc

SEQ ID NO: 338197 - RNA, 64 nt, hsa
cacugauccauaacuuuccuuaguuuugugcuuauaacuggagaucuuuuggcuuuucuauguu

SEQ ID NO: 338198 - RNA, 64 nt, hsa
aacacgggcauuuguauuuuguaauuuuuuuaaauaacuggacauaugucauuuuaaggacaau

SEQ ID NO: 338199 - RNA, 64 nt, hsa
ugucacuaacccugguuaucauuuuacaggcuuguaacuggauauucuaccagagcucucacua

SEQ ID NO: 338200 - RNA, 64 nt, hsa
gccacagaauuagcccaaaauuaucaaagaacauuaacuggaaggucagguuuuucaaggaaca

SEQ ID NO: 338201 - RNA, 64 nt, hsa
ucagcuuugcccuugacauggacaauagguuuuuuacuuugacggugagaagucuccaccuggu

SEQ ID NO: 338202 - RNA, 64 nt, hsa
cucacuggauagauauuauucgacuccaucaauguacuuugaacuaccugacucauuccagcac

SEQ ID NO: 338203 - RNA, 64 nt, hsa
accuuauuugcuacaacauagaucauaucauugcuacuuugacuuagcauuugcaucauaaaca

SEQ ID NO: 338204 - RNA, 64 nt, hsa
guguacaaauuauaauaaugcaucucuaucuucauacuuugaauggcaaacgcuauuuaugcau

SEQ ID NO: 338205 - RNA, 64 nt, hsa
aauacaagcauacucuuguaagaaaaacacugaauacuuugaaccacaaauaaguguuuaugga

SEQ ID NO: 338206 - RNA, 64 nt, hsa
uuuuaaaaugacuugcacuugugcauauacauaguacuuugaauaauguauauuuuaaauugga

SEQ ID NO: 338207 - RNA, 64 nt, hsa
gccaaccaucuacaaaaacaaugaguaauuuuucuacuuugaagauacacagauggggacaaaa

SEQ ID NO: 338208 - RNA, 64 nt, hsa
ugcacuguaagaacugaccucaggugugcagaucuacuuugauuugggguuuugauuaauucuu

SEQ ID NO: 338209 - RNA, 64 nt, hsa
uaugcugaaaacugucagagggggcaagaagaguuacuuugaguuauaugauauuugaacauac

SEQ ID NO: 338210 - RNA, 64 nt, hsa
ccuuugaguuugucaaaagcaaucaaaguuuuuuuacuuugauuugugaguauacugugacauu

SEQ ID NO: 338211 - RNA, 64 nt, hsa
ugcaauauccccuaagaugcuuuuugagcugucuuacuuugauaucuguuguguaauguuugua

SEQ ID NO: 338212 - RNA, 64 nt, hsa
uagucucauaccuugcagucugggacacccucccuacuuugagaauccaccuacaggaagccaa

SEQ ID NO: 338213 - RNA, 64 nt, hsa
guucagaaagguauuaagggcuuaggccaaaucuuacuuugaguauguuaaaaaaaaaaaaaug

SEQ ID NO: 338214 - RNA, 64 nt, hsa
auucauugagcagcauagaaguuuguuuacauguuacuuugagaugcuagguauuuguggaauu

SEQ ID NO: 338215 - RNA, 64 nt, hsa
caauacuggaacugguaucuagcuacugaugucuuacuuugaguuuauuuaugcuucagaauac

SEQ ID NO: 338216 - RNA, 64 nt, hsa
aagaauuaaguuuuuacuucuaauuauuuugcauuacuuugaguuaaauuugaauagaguauua

SEQ ID NO: 338217 - RNA, 64 nt, hsa
ucuaggaaauaaaagauagaggugagagaugauuuacuuugagaaaagacauugugucaccuau

SEQ ID NO: 338218 - RNA, 64 nt, hsa
auuugguuuaguuuucccacugguauuuauaguuuacuuugaauauuuauauuaauaauuagcu

SEQ ID NO: 338219 - RNA, 64 nt, hsa; identical to SEQ ID NO: 338218

SEQ ID NO: 338220 - RNA, 64 nt, hsa; identical to SEQ ID NO: 338217

SEQ ID NO: 338221 - RNA, 64 nt, hsa
acuuuguuaagcugccuuuuuuuuuuuaacuuccuacuuugaugauaagcacucagauauauau

SEQ ID NO: 338222 - RNA, 64 nt, hsa
auuuuagauuuguuaaaacuauuuuuuccauaaauacuuugaaacauauuuauauauuucaauu

SEQ ID NO: 338223 - RNA, 64 nt, hsa
ggggggcuauuuuaaaugucaaggucagcaguguuacuuugaauguaaacugguauaauaggua

SEQ ID NO: 338224 - RNA, 64 nt, hsa
accauaaaacacuaucugaugcacagaacaccucuacuuugagacucaccucucauaaagcuuc

SEQ ID NO: 338225 - RNA, 61 nt, hsa
cacacaggauuccguuggugaaccuguaaaaacaaaacaaacaaaacaaaacaaaaaagac

SEQ ID NO: 338226 - RNA, 61 nt, hsa
uuccguuggugaaccuguaaaaacaaaacaaacaaaacaaaacaaaaaagacaaaaccuaa

SEQ ID NO: 338227 - RNA, 61 nt, hsa
uuggugaaccuguaaaaacaaaacaaacaaaacaaaacaaaaaagacaaaaccuaaaacug

SEQ ID NO: 338228 - RNA, 61 nt, hsa
agccugguuacagagcaagacucugucucaaacaaaacaaaacaaaacaaaaacacacuac

SEQ ID NO: 338229 - RNA, 61 nt, hsa
gguuacagagcaagacucugucucaaacaaaacaaaacaaaacaaaaacacacuacuguau

SEQ ID NO: 338230 - RNA, 61 nt, hsa
cagagcaagacucugucucaaacaaaacaaaacaaaacaaaaacacacuacuguauuuugg

SEQ ID NO: 338231 - RNA, 61 nt, hsa
auuacuguagugcugagguuauugaaguuauacaaaacacaucucagucucuguuucuugg

SEQ ID NO: 338232 - RNA, 61 nt, hsa
uugaauauugaacucuaacaguuuucuacauacaaaacacagugucaugaagguuauucau

SEQ ID NO: 338233 - RNA, 61 nt, hsa
cauuauuuucuaauccauuuuuaaaauacagacaaaacacuucuuuaaacagaacaagaau

SEQ ID NO: 338234 - RNA, 61 nt, hsa
uaaggagagaaauaacuuuaaaguuuauuagacaaaacagaguauagaugccaagaugucu

SEQ ID NO: 338235 - RNA, 61 nt, hsa
agcgacacucggucucaaaaaacaaaacaaaacaaaacaaaauuagagauugggucuuucc

SEQ ID NO: 338236 - RNA, 61 nt, hsa
gacagagcgacacucggucucaaaaaacaaaacaaaacaaaacaaaauuagagauuggguc

SEQ ID NO: 338237 - RNA, 61 nt, hsa
ugggugacagagcgacacucggucucaaaaaacaaaacaaaacaaaacaaaauuagagauu

SEQ ID NO: 338238 - RNA, 61 nt, hsa
cucagaaaaggcuaacaauuuuauauagaggacaaaacagcauuaaacucaucaguugcaa

SEQ ID NO: 338239 - RNA, 61 nt, hsa
caaaggggaaagaacauaaagguaaaacaaaacaaaacaacauuuugagaacaaagaugac

SEQ ID NO: 338240 - RNA, 61 nt, hsa
cuguacaaaggggaaagaacauaaagguaaaacaaaacaaaacaacauuuugagaacaaag

SEQ ID NO: 338241 - RNA, 61 nt, hsa
acaucgugcagucgugucauaaaaaaacaaaacaaaacaaaaaaacacuaggaguccacuc

SEQ ID NO: 338242 - RNA, 61 nt, hsa
gauccacaucgugcagucgugucauaaaaaaacaaaacaaaacaaaaaaacacuaggaguc

SEQ ID NO: 338243 - RNA, 61 nt, hsa
uguugguuucaguggcuggaauuaaaacaaaacaaaacaaacuuccaaacaguguguuggu

SEQ ID NO: 338244 - RNA, 61 nt, hsa
uucuauguugguuucaguggcuggaauuaaaacaaaacaaaacaaacuuccaaacagugug

SEQ ID NO: 338245 - RNA, 61 nt, hsa
ccaguagcugaucuuaaggcuuuuuuaaaaaacaaaacaaaacaacaaaaaaaaaucuuua

SEQ ID NO: 338246 - RNA, 61 nt, hsa
agcugaucuuaaggcuuuuuuaaaaaacaaaacaaaacaacaaaaaaaaaucuuuauaaga

SEQ ID NO: 338247 - RNA, 61 nt, hsa
uuuggacuacagagugagacuccaucucaaaacaaaacaaaacaacaacagcaaaaaacaa

SEQ ID NO: 338248 - RNA, 61 nt, hsa
acuacagagugagacuccaucucaaaacaaaacaaaacaacaacagcaaaaaacaacaaaa

SEQ ID NO: 338249 - RNA, 61 nt, hsa
aaacaaaacaaaacaacaacagcaaaaaacaacaaaacaaaacacaaauacucucacaggg

SEQ ID NO: 338250 - RNA, 61 nt, hsa
aaacaaaacaacaacagcaaaaaacaacaaaacaaaacacaaauacucucacagggcaugg

SEQ ID NO: 338251 - RNA, 61 nt, hsa
uuagagcuuucaaacuggaaaaaaaaaugaaacaaaacaaauacaccaagaccaaaauagg

SEQ ID NO: 338252 - RNA, 61 nt, hsa
gggagcuguagugauuggaacccacguuugcacaaaacauuuuugcagaaggaaagucaac

SEQ ID NO: 338253 - RNA, 61 nt, hsa
gacuuaguacaaaguuucaauuuguuuccccacaaaacaaagcaauucuuucaagucaguu

SEQ ID NO: 338254 - RNA, 61 nt, hsa
ggucugaauaauagcagaaaaaccaacaucuacaaaacauuaaacuaguguuauacuugau

SEQ ID NO: 338255 - RNA, 61 nt, hsa
uuauucagauuuuauuuuuguaucugugguaacaaaacauuaaccaaaagauuuucugucc

SEQ ID NO: 338256 - RNA, 61 nt, hsa
uaggaggugagcuaguuaacaaacuuguaccacaaaacaauaucgcuuuaacuuuucuaaa

SEQ ID NO: 338257 - RNA, 61 nt, hsa
uucuccuucccaaggcagcuggauugaaaaaacaaaacaaaacaaaaaaacccaggggcgu

SEQ ID NO: 338258 - RNA, 61 nt, hsa
cuucccaaggcagcuggauugaaaaaacaaaacaaaacaaaaaaacccaggggcgucaguc

SEQ ID NO: 338259 - RNA, 61 nt, hsa
uuugaagauuguuuguaucuuuuuuuaaaaaacaaaacaaaacaaaaauccccaaaauaua

SEQ ID NO: 338260 - RNA, 61 nt, hsa
agauuguuuguaucuuuuuuuaaaaaacaaaacaaaacaaaaauccccaaaauauauagaa

SEQ ID NO: 338261 - RNA, 61 nt, hsa
aaguuggauggguggguacuauucugauuacacaaaacaaaugccacacaucacccuuacc

SEQ ID NO: 338262 - RNA, 61 nt, hsa
uuacaggcacaaaaugauggacccaaugcacacaaaacaacccuagaguguuguugagaau

SEQ ID NO: 338263 - RNA, 61 nt, hsa
acaaagaccaucgagacggccauucuuguuuacaaaacacuuaccaagaaagcacuuugua

SEQ ID NO: 338264 - RNA, 61 nt, hsa
uaagcucaaguuugcugugcucucugcagcuacaaaacaucuuggcauauuuaagaguggc

SEQ ID NO: 338265 - RNA, 61 nt, hsa
uuuugccaauaccaaguuucaauuuguuuuuacaaaacauuauucaagccacuagaauuau

SEQ ID NO: 338266 - RNA, 61 nt, hsa
aagauaaaaggucuugggaaaacaaaacaaaacaaaacaaaccucccuuccccagcagggc

SEQ ID NO: 338267 - RNA, 61 nt, hsa
ggugcaagauaaaaggucuugggaaaacaaaacaaaacaaaacaaaccucccuuccccagc

SEQ ID NO: 338268 - RNA, 61 nt, hsa
ucucuggugcaagauaaaaggucuugggaaaacaaaacaaaacaaaacaaaccucccuucc

SEQ ID NO: 338269 - RNA, 61 nt, hsa
cgaacucaaggcuuaauuaacggggcacuaaacaaaacaaccaauaaagucaccagcagua

SEQ ID NO: 338270 - RNA, 61 nt, hsa
cacuucauauaaagguuacuccagaccauguacaaaacacagccacucuugaaaucacaag

SEQ ID NO: 338271 - RNA, 61 nt, hsa
uagaaguuaaacaagagcuaagacaaacaaaacaaaacacagcuuaucuaaucuaaugaga

SEQ ID NO: 338272 - RNA, 61 nt, hsa
uuuucuagaaguuaaacaagagcuaagacaaacaaaacaaaacacagcuuaucuaaucuaa

SEQ ID NO: 338273 - RNA, 61 nt, hsa
guaguaucuuucucucuuucuuaugaacaaaacaaaacaacaacaaaaaacaaacaaacaa

SEQ ID NO: 338274 - RNA, 61 nt, hsa
gauaaguaguaucuuucucucuuucuuaugaacaaaacaaaacaacaacaaaaaacaaaca

SEQ ID NO: 338275 - RNA, 61 nt, hsa
gauauuauucuuguaguuuaccucuuuaaaaacaaaacaaaacaaaacaaaaaacuccccu

SEQ ID NO: 338276 - RNA, 61 nt, hsa
uauucuuguaguuuaccucuuuaaaaacaaaacaaaacaaaacaaaaaacuccccuuccuc

SEQ ID NO: 338277 - RNA, 61 nt, hsa
uuguaguuuaccucuuuaaaaacaaaacaaaacaaaacaaaaaacuccccuuccucacugc

SEQ ID NO: 338278 - RNA, 61 nt, hsa
cuguuggauaauggcuguaaaauguuuaaaaacaaaacaaaacaaaaaagaggcacuaguc

SEQ ID NO: 338279 - RNA, 61 nt, hsa
ggauaauggcuguaaaauguuuaaaaacaaaacaaaacaaaaaagaggcacuagucuaucu

SEQ ID NO: 338280 - RNA, 61 nt, hsa
gagucagacuccgucccaaaaaaacaaacaaacaaaacaaaacaaaaaaaaacagaaguua

SEQ ID NO: 338281 - RNA, 61 nt, hsa
agacuccgucccaaaaaaacaaacaaacaaaacaaaacaaaaaaaaacagaaguuacaaau

SEQ ID NO: 338282 - RNA, 61 nt, hsa
gccuggaugacagagugagaccuugucucaaacaaaacaaaacaaaaaugaaauguucuag

SEQ ID NO: 338283 - RNA, 61 nt, hsa
gaugacagagugagaccuugucucaaacaaaacaaaacaaaaaugaaauguucuaguuuug

SEQ ID NO: 338284 - RNA, 61 nt, hsa
agccuaagaaguuauauauuuaaucagguagacaaaacaguucaaagcauaagguccaugg

SEQ ID NO: 338285 - RNA, 61 nt, hsa
uccuacuuuacacucucuguacaaaaacaaaacaaaacaacaacaauacaacaagaacaac

SEQ ID NO: 338286 - RNA, 61 nt, hsa
auuucuccuacuuuacacucucuguacaaaaacaaaacaaaacaacaacaauacaacaaga

SEQ ID NO: 338287 - RNA, 61 nt, hsa
aggauucugugauaauauuuaaauggcaaaaacaaaacauaauuuugugcaauuaacaaag

SEQ ID NO: 338288 - RNA, 61 nt, hsa
accagagagagcuuggaauguuaaaaacaaaacaaaacaaaaaaaaacaaggagaaguugu

SEQ ID NO: 338289 - RNA, 61 nt, hsa
aggggaccagagagagcuuggaauguuaaaaacaaaacaaaacaaaaaaaaacaaggagaa

SEQ ID NO: 338290 - RNA, 61 nt, hsa
ggauaggaguuauauauucuuauaagacaaaacaaaacaggacaauguuacaagaguaaga

SEQ ID NO: 338291 - RNA, 61 nt, hsa
ugugaggauaggaguuauauauucuuauaagacaaaacaaaacaggacaauguuacaagag

SEQ ID NO: 338292 - RNA, 61 nt, hsa
uacaaauuaaaucuucuggagggucgcuaucacaaaacauugacgauguauguauuauaau

SEQ ID NO: 338293 - RNA, 61 nt, hsa
acaacacgaagaugauaccaaaacaaggaccacaaaacaacuagccaugaugggagacagg

SEQ ID NO: 338294 - RNA, 61 nt, hsa
uagaaacacauuuucuggcuagcagaaaaaaacaaaacaaaacuguuguuucucuuucuug

SEQ ID NO: 338295 - RNA, 61 nt, hsa
aaggaaucacacguggugcagcuaaaacaaaacaaaacaugagcaaacacaaaacccaagg

SEQ ID NO: 338296 - RNA, 61 nt, hsa
ggcacaaggaaucacacguggugcagcuaaaacaaaacaaaacaugagcaaacacaaaacc

SEQ ID NO: 338297 - RNA, 61 nt, hsa
ugggcgacagagcgagacucugccucaaaaaacaaaacaaaacaaaacacucacccaucaa

SEQ ID NO: 338298 - RNA, 61 nt, hsa
gacagagcgagacucugccucaaaaaacaaaacaaaacaaaacacucacccaucaacgaau

SEQ ID NO: 338299 - RNA, 61 nt, hsa
agcgagacucugccucaaaaaacaaaacaaaacaaaacacucacccaucaacgaauauaga

SEQ ID NO: 338300 - RNA, 61 nt, hsa
caaguccugugaggcaaaaaaacaaaacaaaacaaaacaaccaaacaaauacaaucuaacu

SEQ ID NO: 338301 - RNA, 61 nt, hsa
uuucacaaguccugugaggcaaaaaaacaaaacaaaacaaaacaaccaaacaaauacaauc

SEQ ID NO: 338302 - RNA, 61 nt, hsa
gacuauuucacaaguccugugaggcaaaaaaacaaaacaaaacaaaacaaccaaacaaaua

SEQ ID NO: 338303 - RNA, 61 nt, hsa
auguguaaggcuugcuaaaaaacaaaacaaaacaaaacacaguccugcauacucaccacca

SEQ ID NO: 338304 - RNA, 61 nt, hsa
agaaaauguguaaggcuugcuaaaaaacaaaacaaaacaaaacacaguccugcauacucac

SEQ ID NO: 338305 - RNA, 61 nt, hsa
acaaaagaaaauguguaaggcuugcuaaaaaacaaaacaaaacaaaacacaguccugcaua

SEQ ID NO: 338306 - RNA, 61 nt, hsa
ugaccugguuaaauacugucuuaaagcucauacaaaacaaauaggcuuuuccauaaguggc

SEQ ID NO: 338307 - RNA, 61 nt, hsa
uaaaacuuguuuguggucagcacaacaaggaacaaaacaaagcuuugaaaaaacuuuaaca

SEQ ID NO: 338308 - RNA, 61 nt, hsa
agccucggguaacacugaaaaacaaaacaaaacaaaacaaaaacaggaaaaaaacaaaaaa

SEQ ID NO: 338309 - RNA, 61 nt, hsa
agagaagccucggguaacacugaaaaacaaaacaaaacaaaacaaaaacaggaaaaaaaca

SEQ ID NO: 338310 - RNA, 61 nt, hsa
ucuucagagaagccucggguaacacugaaaaacaaaacaaaacaaaacaaaaacaggaaaa

SEQ ID NO: 338311 - RNA, 61 nt, hsa
aagcugcaauuauccgccaacugcauuuaaaacaaaacaaaacagaaaaaucaaaauaaca

SEQ ID NO: 338312 - RNA, 61 nt, hsa
gcaauuauccgccaacugcauuuaaaacaaaacaaaacagaaaaaucaaaauaacauugac

SEQ ID NO: 338313 - RNA, 61 nt, hsa
uuguuuuaaauuuuucauaggggaguuuuggacaaaacagucacuggggagaucacugcca

SEQ ID NO: 338314 - RNA, 61 nt, hsa
gggacaugagccagaguuuaaaagggaaccaacaaaacacuauaacuuaaaaggauggggu

SEQ ID NO: 338315 - RNA, 61 nt, hsa
acauaagguauagcauuugguuuuuaagaaaacaaaacauuaagacgcaacucauuuuaua

SEQ ID NO: 338316 - RNA, 61 nt, hsa
ucaccacagaauccauuuuuuucccaguuccacaaaacacucuguuugccuucaguuuuua

SEQ ID NO: 338317 - RNA, 61 nt, hsa
aaggaaacuaaggacuuggcuccaaaacaaaacaaaacaaaaucuggagaugcugaauuuu

SEQ ID NO: 338318 - RNA, 61 nt, hsa
cugagaaggaaacuaaggacuuggcuccaaaacaaaacaaaacaaaaucuggagaugcuga

SEQ ID NO: 338319 - RNA, 61 nt, hsa
acagaauaucaccauugcaguucaaaacaaaacaaaacaaaaagucuuuuguuugugaaca

SEQ ID NO: 338320 - RNA, 61 nt, hsa
gcugcacagaauaucaccauugcaguucaaaacaaaacaaaacaaaaagucuuuuguuugu

SEQ ID NO: 338321 - RNA, 61 nt, hsa
acugggacuccagaaccauuaauaaaacaaaacaaaacaaagcaaaauauugaugaucagg

SEQ ID NO: 338322 - RNA, 61 nt, hsa
uagggacugggacuccagaaccauuaauaaaacaaaacaaaacaaagcaaaauauugauga

SEQ ID NO: 338323 - RNA, 61 nt, hsa
ugccaugaggauuucucuuuaggccagaaguacaaaacaaaaaaaccaauggauuuuaacc

SEQ ID NO: 338324 - RNA, 61 nt, hsa
cugguugacaguauaauuuucccaaagggcaacaaaacauacagauagcaaauuuauauuc

SEQ ID NO: 338325 - RNA, 61 nt, hsa
cguuaggccaauaaaagaagggccucacaagacaaaacaggagccagaaguaaggacugaa

SEQ ID NO: 338326 - RNA, 61 nt, hsa
agagaaaucaucaguuaagaaaucuacuuuaacaaaacaaaaaggagaaaaaguaauaaug

SEQ ID NO: 338327 - RNA, 61 nt, hsa
aaaaaagcgaaagacugcaguugugcuaaaaacaaaacaaaacaaacaaacaaacaaaaaa

SEQ ID NO: 338328 - RNA, 61 nt, hsa
agcgaaagacugcaguugugcuaaaaacaaaacaaaacaaacaaacaaacaaaaaaguaaa

SEQ ID NO: 338329 - RNA, 61 nt, hsa
accaaaucuucuccuaugcauuuuuaauaugacaaaacaaauuuuaaaagauuugaaauaa

SEQ ID NO: 338330 - RNA, 61 nt, hsa
auauaacuaagacauaugcauuuaugggaagacaaaacaagaaugaaacacuuauacugac

SEQ ID NO: 338331 - RNA, 61 nt, hsa
ugugaagaaugaaguggaggaaguaacuuuuacaaaacauacccaguguuugggguguuuc

SEQ ID NO: 338332 - RNA, 61 nt, hsa
gagccaacucacucuuaugaaaugggcuuuaacaaaacaagaaagaaacguacuuaacugu

SEQ ID NO: 338333 - RNA, 61 nt, hsa
aaaagccuuucuguugcaacuaugaaugaaaacaaaacaccacaaaacagacuucacuaac

SEQ ID NO: 338334 - RNA, 61 nt, hsa
cuguugcaacuaugaaugaaaacaaaacaccacaaaacagacuucacuaacacagaaaaac

SEQ ID NO: 338335 - RNA, 61 nt, hsa
augugacuaguuacaaaagcaauaaauugaaacaaaacaaaacaaaacaaaacuuguuucu

SEQ ID NO: 338336 - RNA, 61 nt, hsa
acuaguuacaaaagcaauaaauugaaacaaaacaaaacaaaacaaaacuuguuucuuaaaa

SEQ ID NO: 338337 - RNA, 61 nt, hsa
uuacaaaagcaauaaauugaaacaaaacaaaacaaaacaaaacuuguuucuuaaaaaugcg

SEQ ID NO: 338338 - RNA, 61 nt, hsa
gaacucccccaaacauggcuguggagagacaacaaaacaaaacaaagcacaaaagucucug

SEQ ID NO: 338339 - RNA, 61 nt, hsa
cccccaaacauggcuguggagagacaacaaaacaaaacaaagcacaaaagucucugccaac

SEQ ID NO: 338340 - RNA, 61 nt, hsa
acauucguuucccagugaaaagcaaaccagaacaaaacaaaaagccaccgcaauaauucgg

SEQ ID NO: 338341 - RNA, 61 nt, hsa
ggauuggugcugauugaaagaacaaaacaaaacaaaacaaacacaaacaaacaaaaaaccu

SEQ ID NO: 338342 - RNA, 61 nt, hsa
uuaugggauuggugcugauugaaagaacaaaacaaaacaaaacaaacacaaacaaacaaaa

SEQ ID NO: 338343 - RNA, 61 nt, hsa
aucauuuaugggauuggugcugauugaaagaacaaaacaaaacaaaacaaacacaaacaaa

SEQ ID NO: 338344 - RNA, 61 nt, hsa
caauacaugguuuuuaacaaaacagaacaaaacaaaacaauacagaaucucucccugaguu

SEQ ID NO: 338345 - RNA, 61 nt, hsa
aaauucaauacaugguuuuuaacaaaacagaacaaaacaaaacaauacagaaucucucccu

SEQ ID NO: 338346 - RNA, 61 nt, hsa
acuaaaauuuaaauucaauacaugguuuuuaacaaaacagaacaaaacaaaacaauacaga

SEQ ID NO: 338347 - RNA, 61 nt, hsa
uacagugcuguaacugggugguccuuuuuaaacaaaacauuauuugcaaaacagaggguau

SEQ ID NO: 338348 - RNA, 61 nt, hsa
gcuacaaagguaaauaauggagagauuugguacaaaacaacaaaauauauauauauucuca

SEQ ID NO: 338349 - RNA, 61 nt, hsa
aggauugucuuaaaguuccuuagccagcaaaacaaaacaaaacaaaacaaacaaaugaaaa

SEQ ID NO: 338350 - RNA, 61 nt, hsa
ugucuuaaaguuccuuagccagcaaaacaaaacaaaacaaaacaaacaaaugaaaaacguu

SEQ ID NO: 338351 - RNA, 61 nt, hsa
uaaaguuccuuagccagcaaaacaaaacaaaacaaaacaaacaaaugaaaaacguuuaaaa

SEQ ID NO: 338352 - RNA, 61 nt, hsa
gaggaagauguguucauuguggacucuaaaaacaaaacaaaacacaaaauccccuguucaa

SEQ ID NO: 338353 - RNA, 61 nt, hsa
agauguguucauuguggacucuaaaaacaaaacaaaacacaaaauccccuguucaaauaaa

SEQ ID NO: 338354 - RNA, 61 nt, hsa
aaccauuguuaaggguugggggaaagcauggacaaaacaucacuggaaacaaaggcuguaa

SEQ ID NO: 338355 - RNA, 61 nt, hsa
cuuggaauguguauuguuuuuauuuugcgaaacaaaacaaaacaaaaaaaaaagcuuggaa

SEQ ID NO: 338356 - RNA, 61 nt, hsa
aauguguauuguuuuuauuuugcgaaacaaaacaaaacaaaaaaaaaagcuuggaacucca

SEQ ID NO: 338357 - RNA, 61 nt, hsa
auuggguucaugaugcagucuccucuuuaaaacaaaacaaaacaaaacaaaacuauacuug

SEQ ID NO: 338358 - RNA, 61 nt, hsa
guucaugaugcagucuccucuuuaaaacaaaacaaaacaaaacaaaacuauacuugaacaa

SEQ ID NO: 338359 - RNA, 61 nt, hsa
ugaugcagucuccucuuuaaaacaaaacaaaacaaaacaaaacuauacuugaacaaaaggg

SEQ ID NO: 338360 - RNA, 61 nt, hsa
uucaggugcuagggacuuaaugaaaaacaggacaaaacaauuccuuuuuguggcccaggua

SEQ ID NO: 338361 - RNA, 61 nt, hsa
acagagccaaacuccgucaaaaaaaaacaaaacaaaacaaaaaaaagacaugggagagaug

SEQ ID NO: 338362 - RNA, 61 nt, hsa
gagugacagagccaaacuccgucaaaaaaaaacaaaacaaaacaaaaaaaagacaugggag

SEQ ID NO: 338363 - RNA, 61 nt, hsa
acgccaguaaaaaaacaaaaacaaaaacaaaacaaaacauaaaauauaaacaaucaaaauc

SEQ ID NO: 338364 - RNA, 61 nt, hsa
ggaggacgccaguaaaaaaacaaaaacaaaaacaaaacaaaacauaaaauauaaacaauca

SEQ ID NO: 338365 - RNA, 61 nt, hsa
cuugggcaacagagugagacuccaucucaaaacaaaacaaaacaaaacaaaacaaaaaaac

SEQ ID NO: 338366 - RNA, 61 nt, hsa
gcaacagagugagacuccaucucaaaacaaaacaaaacaaaacaaaacaaaaaaacccggc

SEQ ID NO: 338367 - RNA, 61 nt, hsa
agagugagacuccaucucaaaacaaaacaaaacaaaacaaaacaaaaaaacccggcuuugc

SEQ ID NO: 338368 - RNA, 61 nt, hsa
gagacuccaucucaaaacaaaacaaaacaaaacaaaacaaaaaaacccggcuuugcugcuu

SEQ ID NO: 338369 - RNA, 61 nt, hsa
agaagauauucucgugaaagaaaaaaacaaaacaaaacaacagugcuuuuuucaaaccuga

SEQ ID NO: 338370 - RNA, 61 nt, hsa
aagggagaagauauucucgugaaagaaaaaaacaaaacaaaacaacagugcuuuuuucaaa

SEQ ID NO: 338371 - RNA, 61 nt, hsa
augacaacuuuauuccacauaaacaaggguaacaaaacaagcugcuuaaauauaccaguca

SEQ ID NO: 338372 - RNA, 61 nt, hsa
aucaaacucauauauuccuccuggcuuccuuacaaaacaagccuuucaaacaaucauuguc

SEQ ID NO: 338373 - RNA, 61 nt, hsa
gauuaaaagaagacaauuauucaaagccaucacaaaacacuauaagacugaccaaaauuua

SEQ ID NO: 338374 - RNA, 61 nt, hsa
cccaggcugcagucuccacaccaaacagucaacaaaacacaaacccugaaggaaaaccuuu

SEQ ID NO: 338375 - RNA, 61 nt, hsa
ggaacacagcgagacccucucauuaaaaacaacaaaacaaaacaauuccagucuuggagua

SEQ ID NO: 338376 - RNA, 61 nt, hsa
acagcgagacccucucauuaaaaacaacaaaacaaaacaauuccagucuuggaguagucua

SEQ ID NO: 338377 - RNA, 61 nt, hsa
uacuguaaaaaaaagugcacugaacuucaaaacaaaacaaaaaacaacaacaacaaaaaac

SEQ ID NO: 338378 - RNA, 61 nt, hsa
aauagaugcacgacaggcauaaacaagaacaacaaaacagguguuauguguacauucggag

SEQ ID NO: 338379 - RNA, 61 nt, hsa
augcuuuguuuaaaaaaacgaaaaaaacaaaacaaaacaaaaaaacaugagcagugguguu

SEQ ID NO: 338380 - RNA, 61 nt, hsa
cacuaaugcuuuguuuaaaaaaacgaaaaaaacaaaacaaaacaaaaaaacaugagcagug

SEQ ID NO: 338381 - RNA, 61 nt, hsa
acuauacauaguuucuuuuguacuugaauauacaaaacaugaacacagugccauaugaaua

SEQ ID NO: 338382 - RNA, 61 nt, hsa
auggauagcacauaauggcacuugucuauguacaaaacacaaacuuuagagcaagaagacc

SEQ ID NO: 338383 - RNA, 61 nt, hsa
uuaucuuaaaaaguaaacaaaacaaaacaaaacaaaacaaaaaacuagauauguaauuucu

SEQ ID NO: 338384 - RNA, 61 nt, hsa
gacucuuaucuuaaaaaguaaacaaaacaaaacaaaacaaaacaaaaaacuagauauguaa

SEQ ID NO: 338385 - RNA, 61 nt, hsa
ggcaggacucuuaucuuaaaaaguaaacaaaacaaaacaaaacaaaacaaaaaacuagaua

SEQ ID NO: 338386 - RNA, 61 nt, hsa
ggugcggcaggacucuuaucuuaaaaaguaaacaaaacaaaacaaaacaaaacaaaaaacu

SEQ ID NO: 338387 - RNA, 61 nt, hsa
uuacuucuuuugcaugcacuuuaaaaacaaaacaaaacauuuuucagguuccaaggaagag

SEQ ID NO: 338388 - RNA, 61 nt, hsa
aggcuuuacuucuuuugcaugcacuuuaaaaacaaaacaaaacauuuuucagguuccaagg

SEQ ID NO: 338389 - RNA, 61 nt, hsa
gacagagcaagacuccaucucaaaaacaaaaacaaaacaaaacaacaacaaaaaaagaagu

SEQ ID NO: 338390 - RNA, 61 nt, hsa
agcaagacuccaucucaaaaacaaaaacaaaacaaaacaacaacaaaaaaagaaguuaaau

SEQ ID NO: 338391 - RNA, 61 nt, hsa
gccccaaauggaaaaaagauacucacacagaacaaaacaguucuuggucuuguucuugguc

SEQ ID NO: 338392 - RNA, 61 nt, hsa
aguuuuguauaugucugauaccguuguuauaacaaaacaaauuuuuuuacuauaguuuuuu

SEQ ID NO: 338393 - RNA, 61 nt, hsa
uguuuauauuuccuguaagugaauaaauaaaacaaaacaaaacaaaaaaaacuugugccug

SEQ ID NO: 338394 - RNA, 61 nt, hsa
auauuuccuguaagugaauaaauaaaacaaaacaaaacaaaaaaaacuugugccugauaag

SEQ ID NO: 338395 - RNA, 61 nt, hsa
gccugggugacagagcgagacuaucucagaaacaaaacaaaacaaaacaacaaaaaaagaa

SEQ ID NO: 338396 - RNA, 61 nt, hsa
ggugacagagcgagacuaucucagaaacaaaacaaaacaaaacaacaaaaaaagaaaaggc

SEQ ID NO: 338397 - RNA, 61 nt, hsa
cagagcgagacuaucucagaaacaaaacaaaacaaaacaacaaaaaaagaaaaggcagagu

SEQ ID NO: 338398 - RNA, 61 nt, hsa
acugcaauuuuauuuuugaguugggacuuuuacaaaacacuuuuuucccuggagucuucuc

SEQ ID NO: 338399 - RNA, 61 nt, hsa
aaccagucuuuuuguauuuauuguuacugagacaaaacaguacucacugaguguuuuucag

SEQ ID NO: 338400 - RNA, 61 nt, hsa
aaacauucacaaauauagaaaaguauacaaaacaaaacaguaagauugucuguaaucacau

SEQ ID NO: 338401 - RNA, 61 nt, hsa
uucaaaaacauucacaaauauagaaaaguauacaaaacaaaacaguaagauugucuguaau

SEQ ID NO: 338402 - RNA, 56 nt, hsa; identical to SEQ ID NO: 223403

SEQ ID NO: 338403 - RNA, 51 nt, hsa; identical to SEQ ID NO: 223404

SEQ ID NO: 338404 - RNA, 61 nt, hsa
gcgacacagcgagacuccaucucaaaacaaaacaaaacaaaauuagcugagcaugguggug

SEQ ID NO: 338405 - RNA, 61 nt, hsa
ccugggcgacacagcgagacuccaucucaaaacaaaacaaaacaaaauuagcugagcaugg

SEQ ID NO: 338406 - RNA, 61 nt, hsa
acaagaguaaaacuucaucucaaaaaacaaaacaaaacaaaaacaacaacaaaaaacaaaa

SEQ ID NO: 338407 - RNA, 61 nt, hsa
ggucaacaagaguaaaacuucaucucaaaaaacaaaacaaaacaaaaacaacaacaaaaaa

SEQ ID NO: 338408 - RNA, 61 nt, hsa
ccccauucugugcccuacuauuuucaacaaaacaaaacaaacaagcaaaaaacacaaaaac

SEQ ID NO: 338409 - RNA, 61 nt, hsa
ccucuccccauucugugcccuacuauuuucaacaaaacaaaacaaacaagcaaaaaacaca

SEQ ID NO: 338410 - RNA, 61 nt, hsa
aguuugcuggggaguuugauaaaaguauaaaacaaaacaaaaaaagccucgguauaauuuu

SEQ ID NO: 338411 - RNA, 61 nt, hsa
ucacaagcuuucggaugggcgguggcuuuucacaaaacauuuagcucaucuuauucucucu

SEQ ID NO: 338412 - RNA, 61 nt, hsa
uuuuuccuuuuuuuuuaaaaaaacaaaacaaacaaaacaccuugaaucaaguuuguuugua

SEQ ID NO: 338413 - RNA, 61 nt, hsa
uugucuuucuuuuuccuuuuuuuuuaaaaaaacaaaacaaacaaaacaccuugaaucaagu

SEQ ID NO: 338414 - RNA, 61 nt, hsa
auguucccaaaucugugcuggcauugaaaggacaaaacauuauacuaguggguuuuucuac

SEQ ID NO: 338415 - RNA, 61 nt, hsa
cagugcugccuucuuuacacugccaguuuugacaaaacagguuuguuuuuuauuuuacaac

SEQ ID NO: 338416 - RNA, 61 nt, hsa
aauauagaauuccuggauaagaccaaacaaaacaaaacauuaaaauaccuguauguuuugu

SEQ ID NO: 338417 - RNA, 61 nt, hsa
gagaaaauauagaauuccuggauaagaccaaacaaaacaaaacauuaaaauaccuguaugu

SEQ ID NO: 338418 - RNA, 61 nt, hsa
guuguuuucuagauuuguggcuuuaagaaaaacaaaacaaaacaaacacauuguuuuucuc

SEQ ID NO: 338419 - RNA, 61 nt, hsa
uuucuagauuuguggcuuuaagaaaaacaaaacaaaacaaacacauuguuuuucucagaac

SEQ ID NO: 338420 - RNA, 61 nt, hsa
gagggggacauagcgagacucggucucaaaaacaaaacaaaacaaaacaaaacaaaacaaa

SEQ ID NO: 338421 - RNA, 61 nt, hsa
ggacauagcgagacucggucucaaaaacaaaacaaaacaaaacaaaacaaaacaaaaacaa

SEQ ID NO: 338422 - RNA, 61 nt, hsa
uagcgagacucggucucaaaaacaaaacaaaacaaaacaaaacaaaacaaaaacaaaacaa

SEQ ID NO: 338423 - RNA, 61 nt, hsa
agacucggucucaaaaacaaaacaaaacaaaacaaaacaaaacaaaacaaaacaaaacaaa

SEQ ID NO: 338424 - RNA, 61 nt, hsa
cggucucaaaaacaaaacaaaacaaaacaaaacaaaacaaaacaaaacaaaacaaaacacu

SEQ ID NO: 338425 - RNA, 61 nt, hsa
ucaaaaacaaaacaaaacaaaacaaaacaaaacaaaacaaaacaaaacaaaacacugccaa

SEQ ID NO: 338426 - RNA, 61 nt, hsa
aacaaaacaaaacaaaacaaaacaaaacaaaacaaaacaaaacaaaacacugccaaacugu

SEQ ID NO: 338427 - RNA, 61 nt, hsa
acaaaacaaaacaaaacaaaaacaaaacaaaacaaaacaaaacacugccaaacuguuucca

SEQ ID NO: 338428 - RNA, 61 nt, hsa
acaaaacaaaacaaaaacaaaacaaaacaaaacaaaacacugccaaacuguuuccaaagca

SEQ ID NO: 338429 - RNA, 61 nt, hsa
uuuccugaguucaggugacugaggaagagccacaaaacaaaacacaacaaaaccaaaccac

SEQ ID NO: 338430 - RNA, 61 nt, hsa
ugaguucaggugacugaggaagagccacaaaacaaaacacaacaaaaccaaaccacagaau

SEQ ID NO: 338431 - RNA, 61 nt, hsa
ucucagaggcucugcuuccuuagguuacaaaacaaaacagggagagaaaaagcaaaccgcg

SEQ ID NO: 338432 - RNA, 61 nt, hsa
uguggucucagaggcucugcuuccuuagguuacaaaacaaaacagggagagaaaaagcaaa

SEQ ID NO: 338433 - RNA, 61 nt, hsa
aguauguuggcauuacuuggaccugguuugaacaaaacauaaaaagccauuuuggagacag

SEQ ID NO: 338434 - RNA, 61 nt, hsa
uguguguguauaaaacuccugugggaaagaaacaaaacaucauucuauaagucaguauacu

SEQ ID NO: 338435 - RNA, 61 nt, hsa
cagcaaguucuuguuuccaaacaacaacaaaacaaaacaaaaaaaaaaccggauagaauaa

SEQ ID NO: 338436 - RNA, 61 nt, hsa
cgacacagcaaguucuuguuuccaaacaacaacaaaacaaaacaaaaaaaaaaccggauag

SEQ ID NO: 338437 - RNA, 61 nt, hsa
uggucggcaagagugagacuccgucucaaaaacaaaacaaaacaaaaaaaccacauaacau

SEQ ID NO: 338438 - RNA, 61 nt, hsa
ggcaagagugagacuccgucucaaaaacaaaacaaaacaaaaaaaccacauaacauaaauu

SEQ ID NO: 338439 - RNA, 61 nt, hsa
ucuauuuguguggcaguuauuggguuuggucacaaaacauccugaaaauucgugcgugggc

SEQ ID NO: 338440 - RNA, 61 nt, hsa
uauacaugaaaauuuguuugacaauaaucucacaaaacauauuuuacaucugaacaaaaug

SEQ ID NO: 338441 - RNA, 61 nt, hsa
auauauauaaauauaaauauauauaaaaacaacaaaacaaaacaaaaaaagaaaaaaaaac

SEQ ID NO: 338442 - RNA, 61 nt, hsa
uauaaauauaaauauauauaaaaacaacaaaacaaaacaaaaaaagaaaaaaaaacaaaaa

SEQ ID NO: 338443 - RNA, 61 nt, hsa
augacugagccaaucacuguuucucagaaaaacaaaacaaaacaaaacaaaugacaguaac

SEQ ID NO: 338444 - RNA, 61 nt, hsa
ugagccaaucacuguuucucagaaaaacaaaacaaaacaaaacaaaugacaguaacccuuc

SEQ ID NO: 338445 - RNA, 61 nt, hsa
caaucacuguuucucagaaaaacaaaacaaaacaaaacaaaugacaguaacccuuccccgg

SEQ ID NO: 338446 - RNA, 61 nt, hsa
cugggugacagagcaagacucugucuaaaaaacaaaacaaaacaaaacaaaacaaaaaaac

SEQ ID NO: 338447 - RNA, 61 nt, hsa
ugacagagcaagacucugucuaaaaaacaaaacaaaacaaaacaaaacaaaaaaaccucuu

SEQ ID NO: 338448 - RNA, 61 nt, hsa
gagcaagacucugucuaaaaaacaaaacaaaacaaaacaaaacaaaaaaaccucuuaauau

SEQ ID NO: 338449 - RNA, 61 nt, hsa
agacucugucuaaaaaacaaaacaaaacaaaacaaaacaaaaaaaccucuuaauauucugg

SEQ ID NO: 338450 - RNA, 61 nt, hsa
caauauuuaauaaaacuaggucaaaaacaaaacaaaacagugacacucacuuguguguaua

SEQ ID NO: 338451 - RNA, 61 nt, hsa
ggaagcaauauuuaauaaaacuaggucaaaaacaaaacaaaacagugacacucacuugugu

SEQ ID NO: 338452 - RNA, 61 nt, hsa
aaaacgaaacuccaucucaaaacaaaacaaaacaaaacaaacaaacaaacaaaacuugcau

SEQ ID NO: 338453 - RNA, 61 nt, hsa
cgacaaaaacgaaacuccaucucaaaacaaaacaaaacaaaacaaacaaacaaacaaaacu

SEQ ID NO: 338454 - RNA, 61 nt, hsa
cugggcgacaaaaacgaaacuccaucucaaaacaaaacaaaacaaaacaaacaaacaaaca

SEQ ID NO: 338455 - RNA, 61 nt, hsa
acaauuguucuucaaaaacaaacaaaacaaaacaaaacaaaauuaacugcuuaaauguuuu

SEQ ID NO: 338456 - RNA, 61 nt, hsa
agaccacaauuguucuucaaaaacaaacaaaacaaaacaaaacaaaauuaacugcuuaaau

SEQ ID NO: 338457 - RNA, 61 nt, hsa
guaaaagaccacaauuguucuucaaaaacaaacaaaacaaaacaaaacaaaauuaacugcu

SEQ ID NO: 338458 - RNA, 62 nt, hsa; identical to SEQ ID NO: 64857

SEQ ID NO: 338459 - RNA, 62 nt, hsa; identical to SEQ ID NO: 64858

SEQ ID NO: 338460 - RNA, 62 nt, hsa; identical to SEQ ID NO: 64859

SEQ ID NO: 338461 - RNA, 62 nt, hsa; identical to SEQ ID NO: 64860

SEQ ID NO: 338462 - RNA, 62 nt, hsa; identical to SEQ ID NO: 64861

SEQ ID NO: 338463 - RNA, 62 nt, hsa; identical to SEQ ID NO: 64862

SEQ ID NO: 338464 - RNA, 62 nt, hsa; identical to SEQ ID NO: 64863

SEQ ID NO: 338465 - RNA, 62 nt, hsa; identical to SEQ ID NO: 64864

SEQ ID NO: 338466 - RNA, 62 nt, hsa; identical to SEQ ID NO: 64865

SEQ ID NO: 338467 - RNA, 62 nt, hsa; identical to SEQ ID NO: 64866

SEQ ID NO: 338468 - RNA, 62 nt, hsa; identical to SEQ ID NO: 64867

SEQ ID NO: 338469 - RNA, 62 nt, hsa; identical to SEQ ID NO: 64868

SEQ ID NO: 338470 - RNA, 62 nt, hsa; identical to SEQ ID NO: 64869

SEQ ID NO: 338471 - RNA, 62 nt, hsa; identical to SEQ ID NO: 64870

SEQ ID NO: 338472 - RNA, 62 nt, hsa; identical to SEQ ID NO: 64871

SEQ ID NO: 338473 - RNA, 62 nt, hsa; identical to SEQ ID NO: 64872

SEQ ID NO: 338474 - RNA, 62 nt, hsa; identical to SEQ ID NO: 64873

SEQ ID NO: 338475 - RNA, 62 nt, hsa; identical to SEQ ID NO: 64874

SEQ ID NO: 338476 - RNA, 62 nt, hsa; identical to SEQ ID NO: 64875

SEQ ID NO: 338477 - RNA, 62 nt, hsa; identical to SEQ ID NO: 64876

SEQ ID NO: 338478 - RNA, 62 nt, hsa; identical to SEQ ID NO: 64877

SEQ ID NO: 338479 - RNA, 62 nt, hsa; identical to SEQ ID NO: 64878

SEQ ID NO: 338480 - RNA, 62 nt, hsa; identical to SEQ ID NO: 64879

SEQ ID NO: 338481 - RNA, 62 nt, hsa; identical to SEQ ID NO: 64880

SEQ ID NO: 338482 - RNA, 62 nt, hsa; identical to SEQ ID NO: 64881

SEQ ID NO: 338483 - RNA, 62 nt, hsa; identical to SEQ ID NO: 64882

SEQ ID NO: 338484 - RNA, 62 nt, hsa; identical to SEQ ID NO: 64883

SEQ ID NO: 338485 - RNA, 62 nt, hsa; identical to SEQ ID NO: 64884

SEQ ID NO: 338486 - RNA, 62 nt, hsa; identical to SEQ ID NO: 64885

SEQ ID NO: 338487 - RNA, 62 nt, hsa; identical to SEQ ID NO: 64886

SEQ ID NO: 338488 - RNA, 62 nt, hsa; identical to SEQ ID NO: 64887

SEQ ID NO: 338489 - RNA, 62 nt, hsa; identical to SEQ ID NO: 64888

SEQ ID NO: 338490 - RNA, 62 nt, hsa; identical to SEQ ID NO: 64889

SEQ ID NO: 338491 - RNA, 62 nt, hsa; identical to SEQ ID NO: 64890

SEQ ID NO: 338492 - RNA, 62 nt, hsa; identical to SEQ ID NO: 64891

SEQ ID NO: 338493 - RNA, 62 nt, hsa; identical to SEQ ID NO: 64892

SEQ ID NO: 338494 - RNA, 62 nt, hsa; identical to SEQ ID NO: 64893

SEQ ID NO: 338495 - RNA, 62 nt, hsa; identical to SEQ ID NO: 64894

SEQ ID NO: 338496 - RNA, 62 nt, hsa; identical to SEQ ID NO: 64895

SEQ ID NO: 338497 - RNA, 62 nt, hsa; identical to SEQ ID NO: 64896

SEQ ID NO: 338498 - RNA, 62 nt, hsa; identical to SEQ ID NO: 64897

SEQ ID NO: 338499 - RNA, 62 nt, hsa; identical to SEQ ID NO: 64898

SEQ ID NO: 338500 - RNA, 62 nt, hsa; identical to SEQ ID NO: 64899

SEQ ID NO: 338501 - RNA, 62 nt, hsa; identical to SEQ ID NO: 64900

SEQ ID NO: 338502 - RNA, 62 nt, hsa; identical to SEQ ID NO: 64901

SEQ ID NO: 338503 - RNA, 62 nt, hsa; identical to SEQ ID NO: 64902

SEQ ID NO: 338504 - RNA, 62 nt, hsa; identical to SEQ ID NO: 64903

SEQ ID NO: 338505 - RNA, 62 nt, hsa; identical to SEQ ID NO: 64904

SEQ ID NO: 338506 - RNA, 62 nt, hsa; identical to SEQ ID NO: 64905

SEQ ID NO: 338507 - RNA, 62 nt, hsa; identical to SEQ ID NO: 64906

SEQ ID NO: 338508 - RNA, 62 nt, hsa; identical to SEQ ID NO: 64907

SEQ ID NO: 338509 - RNA, 62 nt, hsa; identical to SEQ ID NO: 64908

SEQ ID NO: 338510 - RNA, 62 nt, hsa; identical to SEQ ID NO: 64909

SEQ ID NO: 338511 - RNA, 62 nt, hsa; identical to SEQ ID NO: 64910

SEQ ID NO: 338512 - RNA, 62 nt, hsa; identical to SEQ ID NO: 64911

SEQ ID NO: 338513 - RNA, 62 nt, hsa; identical to SEQ ID NO: 64912

SEQ ID NO: 338514 - RNA, 62 nt, hsa; identical to SEQ ID NO: 64913

SEQ ID NO: 338515 - RNA, 62 nt, hsa; identical to SEQ ID NO: 64914

SEQ ID NO: 338516 - RNA, 62 nt, hsa; identical to SEQ ID NO: 64915

SEQ ID NO: 338517 - RNA, 62 nt, hsa; identical to SEQ ID NO: 64916

SEQ ID NO: 338518 - RNA, 62 nt, hsa; identical to SEQ ID NO: 64917

SEQ ID NO: 338519 - RNA, 62 nt, hsa; identical to SEQ ID NO: 64918

SEQ ID NO: 338520 - RNA, 62 nt, hsa; identical to SEQ ID NO: 64919

SEQ ID NO: 338521 - RNA, 62 nt, hsa; identical to SEQ ID NO: 64920

SEQ ID NO: 338522 - RNA, 62 nt, hsa; identical to SEQ ID NO: 64921

SEQ ID NO: 338523 - RNA, 62 nt, hsa; identical to SEQ ID NO: 64922

SEQ ID NO: 338524 - RNA, 62 nt, hsa; identical to SEQ ID NO: 64923

SEQ ID NO: 338525 - RNA, 62 nt, hsa; identical to SEQ ID NO: 64924

SEQ ID NO: 338526 - RNA, 62 nt, hsa; identical to SEQ ID NO: 64925

SEQ ID NO: 338527 - RNA, 62 nt, hsa; identical to SEQ ID NO: 64926

SEQ ID NO: 338528 - RNA, 62 nt, hsa; identical to SEQ ID NO: 64927

SEQ ID NO: 338529 - RNA, 62 nt, hsa; identical to SEQ ID NO: 64928

SEQ ID NO: 338530 - RNA, 62 nt, hsa; identical to SEQ ID NO: 64929

SEQ ID NO: 338531 - RNA, 62 nt, hsa; identical to SEQ ID NO: 64930

SEQ ID NO: 338532 - RNA, 62 nt, hsa; identical to SEQ ID NO: 64931

SEQ ID NO: 338533 - RNA, 62 nt, hsa; identical to SEQ ID NO: 64932

SEQ ID NO: 338534 - RNA, 62 nt, hsa; identical to SEQ ID NO: 64933

SEQ ID NO: 338535 - RNA, 62 nt, hsa; identical to SEQ ID NO: 64934

SEQ ID NO: 338536 - RNA, 62 nt, hsa; identical to SEQ ID NO: 64935

SEQ ID NO: 338537 - RNA, 62 nt, hsa; identical to SEQ ID NO: 64936

SEQ ID NO: 338538 - RNA, 62 nt, hsa; identical to SEQ ID NO: 64937

SEQ ID NO: 338539 - RNA, 62 nt, hsa; identical to SEQ ID NO: 64938

SEQ ID NO: 338540 - RNA, 62 nt, hsa; identical to SEQ ID NO: 64939

SEQ ID NO: 338541 - RNA, 62 nt, hsa; identical to SEQ ID NO: 64940

SEQ ID NO: 338542 - RNA, 62 nt, hsa; identical to SEQ ID NO: 64941

SEQ ID NO: 338543 - RNA, 62 nt, hsa; identical to SEQ ID NO: 64942

SEQ ID NO: 338544 - RNA, 62 nt, hsa; identical to SEQ ID NO: 64943

SEQ ID NO: 338545 - RNA, 62 nt, hsa; identical to SEQ ID NO: 64944

SEQ ID NO: 338546 - RNA, 62 nt, hsa; identical to SEQ ID NO: 64945

SEQ ID NO: 338547 - RNA, 62 nt, hsa; identical to SEQ ID NO: 64946

SEQ ID NO: 338548 - RNA, 62 nt, hsa; identical to SEQ ID NO: 64947

SEQ ID NO: 338549 - RNA, 62 nt, hsa; identical to SEQ ID NO: 64948

SEQ ID NO: 338550 - RNA, 62 nt, hsa; identical to SEQ ID NO: 64949

SEQ ID NO: 338551 - RNA, 62 nt, hsa; identical to SEQ ID NO: 64950

SEQ ID NO: 338552 - RNA, 62 nt, hsa; identical to SEQ ID NO: 64951

SEQ ID NO: 338553 - RNA, 62 nt, hsa; identical to SEQ ID NO: 64952

SEQ ID NO: 338554 - RNA, 62 nt, hsa; identical to SEQ ID NO: 64953

SEQ ID NO: 338555 - RNA, 62 nt, hsa; identical to SEQ ID NO: 64954

SEQ ID NO: 338556 - RNA, 62 nt, hsa; identical to SEQ ID NO: 64955

SEQ ID NO: 338557 - RNA, 62 nt, hsa; identical to SEQ ID NO: 64956

SEQ ID NO: 338558 - RNA, 62 nt, hsa; identical to SEQ ID NO: 64957

SEQ ID NO: 338559 - RNA, 62 nt, hsa; identical to SEQ ID NO: 64958

SEQ ID NO: 338560 - RNA, 62 nt, hsa; identical to SEQ ID NO: 64959

SEQ ID NO: 338561 - RNA, 62 nt, hsa; identical to SEQ ID NO: 64960

SEQ ID NO: 338562 - RNA, 62 nt, hsa; identical to SEQ ID NO: 64961

SEQ ID NO: 338563 - RNA, 62 nt, hsa; identical to SEQ ID NO: 64962

SEQ ID NO: 338564 - RNA, 62 nt, hsa; identical to SEQ ID NO: 64963

SEQ ID NO: 338565 - RNA, 62 nt, hsa; identical to SEQ ID NO: 64964

SEQ ID NO: 338566 - RNA, 62 nt, hsa; identical to SEQ ID NO: 64965

SEQ ID NO: 338567 - RNA, 62 nt, hsa; identical to SEQ ID NO: 64966

SEQ ID NO: 338568 - RNA, 62 nt, hsa; identical to SEQ ID NO: 64967

SEQ ID NO: 338569 - RNA, 62 nt, hsa; identical to SEQ ID NO: 64968

SEQ ID NO: 338570 - RNA, 62 nt, hsa; identical to SEQ ID NO: 64969

SEQ ID NO: 338571 - RNA, 62 nt, hsa; identical to SEQ ID NO: 64970

SEQ ID NO: 338572 - RNA, 62 nt, hsa; identical to SEQ ID NO: 64971

SEQ ID NO: 338573 - RNA, 62 nt, hsa; identical to SEQ ID NO: 64972

SEQ ID NO: 338574 - RNA, 62 nt, hsa; identical to SEQ ID NO: 64973

SEQ ID NO: 338575 - RNA, 62 nt, hsa; identical to SEQ ID NO: 64974

SEQ ID NO: 338576 - RNA, 62 nt, hsa; identical to SEQ ID NO: 64975

SEQ ID NO: 338577 - RNA, 62 nt, hsa; identical to SEQ ID NO: 64976

SEQ ID NO: 338578 - RNA, 62 nt, hsa; identical to SEQ ID NO: 64977

SEQ ID NO: 338579 - RNA, 62 nt, hsa; identical to SEQ ID NO: 64978

SEQ ID NO: 338580 - RNA, 62 nt, hsa; identical to SEQ ID NO: 64979

SEQ ID NO: 338581 - RNA, 62 nt, hsa; identical to SEQ ID NO: 64980

SEQ ID NO: 338582 - RNA, 62 nt, hsa; identical to SEQ ID NO: 64981

SEQ ID NO: 338583 - RNA, 62 nt, hsa; identical to SEQ ID NO: 64982

SEQ ID NO: 338584 - RNA, 62 nt, hsa; identical to SEQ ID NO: 64983

SEQ ID NO: 338585 - RNA, 62 nt, hsa; identical to SEQ ID NO: 64984

SEQ ID NO: 338586 - RNA, 62 nt, hsa; identical to SEQ ID NO: 64985

SEQ ID NO: 338587 - RNA, 62 nt, hsa; identical to SEQ ID NO: 64986

SEQ ID NO: 338588 - RNA, 62 nt, hsa; identical to SEQ ID NO: 64987

SEQ ID NO: 338589 - RNA, 62 nt, hsa; identical to SEQ ID NO: 64988

SEQ ID NO: 338590 - RNA, 62 nt, hsa; identical to SEQ ID NO: 64989

SEQ ID NO: 338591 - RNA, 62 nt, hsa; identical to SEQ ID NO: 64990

SEQ ID NO: 338592 - RNA, 62 nt, hsa; identical to SEQ ID NO: 64991

SEQ ID NO: 338593 - RNA, 62 nt, hsa; identical to SEQ ID NO: 64992

SEQ ID NO: 338594 - RNA, 62 nt, hsa; identical to SEQ ID NO: 64993

SEQ ID NO: 338595 - RNA, 62 nt, hsa; identical to SEQ ID NO: 64994

SEQ ID NO: 338596 - RNA, 56 nt, hsa; identical to SEQ ID NO: 61369

SEQ ID NO: 338597 - RNA, 62 nt, hsa; identical to SEQ ID NO: 64996

SEQ ID NO: 338598 - RNA, 62 nt, hsa; identical to SEQ ID NO: 64997

SEQ ID NO: 338599 - RNA, 62 nt, hsa; identical to SEQ ID NO: 64998

SEQ ID NO: 338600 - RNA, 62 nt, hsa; identical to SEQ ID NO: 64999

SEQ ID NO: 338601 - RNA, 62 nt, hsa; identical to SEQ ID NO: 65000

SEQ ID NO: 338602 - RNA, 62 nt, hsa; identical to SEQ ID NO: 65001

SEQ ID NO: 338603 - RNA, 62 nt, hsa; identical to SEQ ID NO: 65002

SEQ ID NO: 338604 - RNA, 62 nt, hsa; identical to SEQ ID NO: 65003

SEQ ID NO: 338605 - RNA, 62 nt, hsa; identical to SEQ ID NO: 65004

SEQ ID NO: 338606 - RNA, 62 nt, hsa; identical to SEQ ID NO: 65005

SEQ ID NO: 338607 - RNA, 62 nt, hsa; identical to SEQ ID NO: 65006

SEQ ID NO: 338608 - RNA, 62 nt, hsa; identical to SEQ ID NO: 65007

SEQ ID NO: 338609 - RNA, 62 nt, hsa; identical to SEQ ID NO: 65008

SEQ ID NO: 338610 - RNA, 62 nt, hsa; identical to SEQ ID NO: 65009

SEQ ID NO: 338611 - RNA, 62 nt, hsa; identical to SEQ ID NO: 65010

SEQ ID NO: 338612 - RNA, 62 nt, hsa; identical to SEQ ID NO: 65011

SEQ ID NO: 338613 - RNA, 62 nt, hsa; identical to SEQ ID NO: 65012

SEQ ID NO: 338614 - RNA, 62 nt, hsa; identical to SEQ ID NO: 65013

SEQ ID NO: 338615 - RNA, 62 nt, hsa; identical to SEQ ID NO: 65014

SEQ ID NO: 338616 - RNA, 62 nt, hsa; identical to SEQ ID NO: 65015

SEQ ID NO: 338617 - RNA, 62 nt, hsa; identical to SEQ ID NO: 65016

SEQ ID NO: 338618 - RNA, 62 nt, hsa; identical to SEQ ID NO: 65017

SEQ ID NO: 338619 - RNA, 62 nt, hsa; identical to SEQ ID NO: 65018

SEQ ID NO: 338620 - RNA, 62 nt, hsa; identical to SEQ ID NO: 65019

SEQ ID NO: 338621 - RNA, 62 nt, hsa; identical to SEQ ID NO: 65020

SEQ ID NO: 338622 - RNA, 62 nt, hsa; identical to SEQ ID NO: 65021

SEQ ID NO: 338623 - RNA, 62 nt, hsa; identical to SEQ ID NO: 65022

SEQ ID NO: 338624 - RNA, 62 nt, hsa; identical to SEQ ID NO: 65023

SEQ ID NO: 338625 - RNA, 62 nt, hsa; identical to SEQ ID NO: 65024

SEQ ID NO: 338626 - RNA, 62 nt, hsa; identical to SEQ ID NO: 65025

SEQ ID NO: 338627 - RNA, 62 nt, hsa; identical to SEQ ID NO: 65026

SEQ ID NO: 338628 - RNA, 62 nt, hsa; identical to SEQ ID NO: 65027

SEQ ID NO: 338629 - RNA, 62 nt, hsa; identical to SEQ ID NO: 65028

SEQ ID NO: 338630 - RNA, 62 nt, hsa; identical to SEQ ID NO: 65029

SEQ ID NO: 338631 - RNA, 62 nt, hsa; identical to SEQ ID NO: 65030

SEQ ID NO: 338632 - RNA, 62 nt, hsa; identical to SEQ ID NO: 65031

SEQ ID NO: 338633 - RNA, 62 nt, hsa; identical to SEQ ID NO: 65032

SEQ ID NO: 338634 - RNA, 62 nt, hsa; identical to SEQ ID NO: 65033

SEQ ID NO: 338635 - RNA, 62 nt, hsa; identical to SEQ ID NO: 65034

SEQ ID NO: 338636 - RNA, 62 nt, hsa; identical to SEQ ID NO: 65035

SEQ ID NO: 338637 - RNA, 62 nt, hsa; identical to SEQ ID NO: 65036

SEQ ID NO: 338638 - RNA, 62 nt, hsa; identical to SEQ ID NO: 65037

SEQ ID NO: 338639 - RNA, 62 nt, hsa; identical to SEQ ID NO: 65038

SEQ ID NO: 338640 - RNA, 62 nt, hsa; identical to SEQ ID NO: 65039

SEQ ID NO: 338641 - RNA, 62 nt, hsa; identical to SEQ ID NO: 65040

SEQ ID NO: 338642 - RNA, 62 nt, hsa; identical to SEQ ID NO: 65041

SEQ ID NO: 338643 - RNA, 62 nt, hsa; identical to SEQ ID NO: 65042

SEQ ID NO: 338644 - RNA, 62 nt, hsa; identical to SEQ ID NO: 65043

SEQ ID NO: 338645 - RNA, 62 nt, hsa; identical to SEQ ID NO: 65044

SEQ ID NO: 338646 - RNA, 62 nt, hsa; identical to SEQ ID NO: 65045

SEQ ID NO: 338647 - RNA, 62 nt, hsa; identical to SEQ ID NO: 65046

SEQ ID NO: 338648 - RNA, 62 nt, hsa; identical to SEQ ID NO: 65047

SEQ ID NO: 338649 - RNA, 62 nt, hsa; identical to SEQ ID NO: 65048

SEQ ID NO: 338650 - RNA, 62 nt, hsa; identical to SEQ ID NO: 65049

SEQ ID NO: 338651 - RNA, 62 nt, hsa; identical to SEQ ID NO: 65050

SEQ ID NO: 338652 - RNA, 62 nt, hsa; identical to SEQ ID NO: 65051

SEQ ID NO: 338653 - RNA, 62 nt, hsa; identical to SEQ ID NO: 65052

SEQ ID NO: 338654 - RNA, 62 nt, hsa; identical to SEQ ID NO: 65053

SEQ ID NO: 338655 - RNA, 62 nt, hsa; identical to SEQ ID NO: 65054

SEQ ID NO: 338656 - RNA, 62 nt, hsa; identical to SEQ ID NO: 65055

SEQ ID NO: 338657 - RNA, 62 nt, hsa; identical to SEQ ID NO: 65056

SEQ ID NO: 338658 - RNA, 62 nt, hsa; identical to SEQ ID NO: 65057

SEQ ID NO: 338659 - RNA, 62 nt, hsa; identical to SEQ ID NO: 65058

SEQ ID NO: 338660 - RNA, 62 nt, hsa; identical to SEQ ID NO: 65059

SEQ ID NO: 338661 - RNA, 62 nt, hsa; identical to SEQ ID NO: 65060

SEQ ID NO: 338662 - RNA, 62 nt, hsa; identical to SEQ ID NO: 65061

SEQ ID NO: 338663 - RNA, 62 nt, hsa; identical to SEQ ID NO: 65062

SEQ ID NO: 338664 - RNA, 62 nt, hsa; identical to SEQ ID NO: 65063

SEQ ID NO: 338665 - RNA, 62 nt, hsa; identical to SEQ ID NO: 65064

SEQ ID NO: 338666 - RNA, 62 nt, hsa; identical to SEQ ID NO: 65065

SEQ ID NO: 338667 - RNA, 62 nt, hsa; identical to SEQ ID NO: 65066

SEQ ID NO: 338668 - RNA, 62 nt, hsa; identical to SEQ ID NO: 65067

SEQ ID NO: 338669 - RNA, 62 nt, hsa; identical to SEQ ID NO: 65068

SEQ ID NO: 338670 - RNA, 62 nt, hsa; identical to SEQ ID NO: 65069

SEQ ID NO: 338671 - RNA, 62 nt, hsa; identical to SEQ ID NO: 65070

SEQ ID NO: 338672 - RNA, 62 nt, hsa; identical to SEQ ID NO: 65071

SEQ ID NO: 338673 - RNA, 62 nt, hsa; identical to SEQ ID NO: 65072

SEQ ID NO: 338674 - RNA, 62 nt, hsa; identical to SEQ ID NO: 65073

SEQ ID NO: 338675 - RNA, 62 nt, hsa; identical to SEQ ID NO: 65074

SEQ ID NO: 338676 - RNA, 62 nt, hsa; identical to SEQ ID NO: 65075

SEQ ID NO: 338677 - RNA, 62 nt, hsa; identical to SEQ ID NO: 65076

SEQ ID NO: 338678 - RNA, 62 nt, hsa; identical to SEQ ID NO: 65077

SEQ ID NO: 338679 - RNA, 62 nt, hsa; identical to SEQ ID NO: 65078

SEQ ID NO: 338680 - RNA, 62 nt, hsa; identical to SEQ ID NO: 65079

SEQ ID NO: 338681 - RNA, 62 nt, hsa; identical to SEQ ID NO: 65080

SEQ ID NO: 338682 - RNA, 62 nt, hsa; identical to SEQ ID NO: 65081

SEQ ID NO: 338683 - RNA, 62 nt, hsa; identical to SEQ ID NO: 65082

SEQ ID NO: 338684 - RNA, 62 nt, hsa; identical to SEQ ID NO: 65083

SEQ ID NO: 338685 - RNA, 62 nt, hsa; identical to SEQ ID NO: 65084

SEQ ID NO: 338686 - RNA, 62 nt, hsa; identical to SEQ ID NO: 65085

SEQ ID NO: 338687 - RNA, 62 nt, hsa; identical to SEQ ID NO: 65086

SEQ ID NO: 338688 - RNA, 60 nt, hsa; identical to SEQ ID NO: 65087

SEQ ID NO: 338689 - RNA, 62 nt, hsa; identical to SEQ ID NO: 65088

SEQ ID NO: 338690 - RNA, 62 nt, hsa; identical to SEQ ID NO: 65089

SEQ ID NO: 338691 - RNA, 62 nt, hsa; identical to SEQ ID NO: 65090

SEQ ID NO: 338692 - RNA, 62 nt, hsa; identical to SEQ ID NO: 65091

SEQ ID NO: 338693 - RNA, 62 nt, hsa; identical to SEQ ID NO: 65092

SEQ ID NO: 338694 - RNA, 62 nt, hsa; identical to SEQ ID NO: 65093

SEQ ID NO: 338695 - RNA, 51 nt, hsa; identical to SEQ ID NO: 65094

SEQ ID NO: 338696 - RNA, 62 nt, hsa; identical to SEQ ID NO: 65095

SEQ ID NO: 338697 - RNA, 62 nt, hsa; identical to SEQ ID NO: 65096

SEQ ID NO: 338698 - RNA, 62 nt, hsa; identical to SEQ ID NO: 65097

SEQ ID NO: 338699 - RNA, 62 nt, hsa; identical to SEQ ID NO: 65098

SEQ ID NO: 338700 - RNA, 62 nt, hsa; identical to SEQ ID NO: 65099

SEQ ID NO: 338701 - RNA, 62 nt, hsa; identical to SEQ ID NO: 65100

SEQ ID NO: 338702 - RNA, 62 nt, hsa; identical to SEQ ID NO: 65101

SEQ ID NO: 338703 - RNA, 62 nt, hsa; identical to SEQ ID NO: 65102

SEQ ID NO: 338704 - RNA, 62 nt, hsa; identical to SEQ ID NO: 65103

SEQ ID NO: 338705 - RNA, 62 nt, hsa; identical to SEQ ID NO: 65104

SEQ ID NO: 338706 - RNA, 62 nt, hsa; identical to SEQ ID NO: 65105

SEQ ID NO: 338707 - RNA, 62 nt, hsa; identical to SEQ ID NO: 65106

SEQ ID NO: 338708 - RNA, 62 nt, hsa; identical to SEQ ID NO: 65107

SEQ ID NO: 338709 - RNA, 62 nt, hsa; identical to SEQ ID NO: 65108

SEQ ID NO: 338710 - RNA, 62 nt, hsa; identical to SEQ ID NO: 65109

SEQ ID NO: 338711 - RNA, 62 nt, hsa; identical to SEQ ID NO: 65110

SEQ ID NO: 338712 - RNA, 62 nt, hsa; identical to SEQ ID NO: 65111

SEQ ID NO: 338713 - RNA, 62 nt, hsa; identical to SEQ ID NO: 65112

SEQ ID NO: 338714 - RNA, 62 nt, hsa; identical to SEQ ID NO: 65113

SEQ ID NO: 338715 - RNA, 62 nt, hsa; identical to SEQ ID NO: 65114

SEQ ID NO: 338716 - RNA, 62 nt, hsa; identical to SEQ ID NO: 65115

SEQ ID NO: 338717 - RNA, 62 nt, hsa; identical to SEQ ID NO: 65116

SEQ ID NO: 338718 - RNA, 62 nt, hsa; identical to SEQ ID NO: 65117

SEQ ID NO: 338719 - RNA, 62 nt, hsa; identical to SEQ ID NO: 65118

SEQ ID NO: 338720 - RNA, 62 nt, hsa; identical to SEQ ID NO: 65119

SEQ ID NO: 338721 - RNA, 62 nt, hsa; identical to SEQ ID NO: 65120

SEQ ID NO: 338722 - RNA, 62 nt, hsa; identical to SEQ ID NO: 65121

SEQ ID NO: 338723 - RNA, 62 nt, hsa; identical to SEQ ID NO: 65122

SEQ ID NO: 338724 - RNA, 62 nt, hsa; identical to SEQ ID NO: 65123

SEQ ID NO: 338725 - RNA, 62 nt, hsa; identical to SEQ ID NO: 65124

SEQ ID NO: 338726 - RNA, 62 nt, hsa; identical to SEQ ID NO: 65125

SEQ ID NO: 338727 - RNA, 62 nt, hsa; identical to SEQ ID NO: 65126

SEQ ID NO: 338728 - RNA, 62 nt, hsa; identical to SEQ ID NO: 65127

SEQ ID NO: 338729 - RNA, 62 nt, hsa; identical to SEQ ID NO: 65128

SEQ ID NO: 338730 - RNA, 62 nt, hsa; identical to SEQ ID NO: 65129

SEQ ID NO: 338731 - RNA, 62 nt, hsa; identical to SEQ ID NO: 65130

SEQ ID NO: 338732 - RNA, 62 nt, hsa; identical to SEQ ID NO: 65131

SEQ ID NO: 338733 - RNA, 62 nt, hsa; identical to SEQ ID NO: 65132

SEQ ID NO: 338734 - RNA, 62 nt, hsa; identical to SEQ ID NO: 65133

SEQ ID NO: 338735 - RNA, 62 nt, hsa; identical to SEQ ID NO: 65134

SEQ ID NO: 338736 - RNA, 62 nt, hsa; identical to SEQ ID NO: 65135

SEQ ID NO: 338737 - RNA, 63 nt, hsa; identical to SEQ ID NO: 65136

SEQ ID NO: 338738 - RNA, 63 nt, hsa; identical to SEQ ID NO: 65137

SEQ ID NO: 338739 - RNA, 63 nt, hsa; identical to SEQ ID NO: 65138

SEQ ID NO: 338740 - RNA, 63 nt, hsa; identical to SEQ ID NO: 65139

SEQ ID NO: 338741 - RNA, 63 nt, hsa; identical to SEQ ID NO: 65140

SEQ ID NO: 338742 - RNA, 63 nt, hsa; identical to SEQ ID NO: 65141

SEQ ID NO: 338743 - RNA, 63 nt, hsa; identical to SEQ ID NO: 65142

SEQ ID NO: 338744 - RNA, 63 nt, hsa; identical to SEQ ID NO: 65143

SEQ ID NO: 338745 - RNA, 63 nt, hsa; identical to SEQ ID NO: 65144

SEQ ID NO: 338746 - RNA, 63 nt, hsa; identical to SEQ ID NO: 65145

SEQ ID NO: 338747 - RNA, 63 nt, hsa; identical to SEQ ID NO: 65146

SEQ ID NO: 338748 - RNA, 63 nt, hsa; identical to SEQ ID NO: 65147

SEQ ID NO: 338749 - RNA, 63 nt, hsa; identical to SEQ ID NO: 65148

SEQ ID NO: 338750 - RNA, 63 nt, hsa; identical to SEQ ID NO: 65149

SEQ ID NO: 338751 - RNA, 63 nt, hsa; identical to SEQ ID NO: 65150

SEQ ID NO: 338752 - RNA, 63 nt, hsa; identical to SEQ ID NO: 65151

SEQ ID NO: 338753 - RNA, 63 nt, hsa; identical to SEQ ID NO: 65152

SEQ ID NO: 338754 - RNA, 63 nt, hsa; identical to SEQ ID NO: 65153

SEQ ID NO: 338755 - RNA, 63 nt, hsa; identical to SEQ ID NO: 65154

SEQ ID NO: 338756 - RNA, 63 nt, hsa; identical to SEQ ID NO: 65155

SEQ ID NO: 338757 - RNA, 63 nt, hsa; identical to SEQ ID NO: 65156

SEQ ID NO: 338758 - RNA, 63 nt, hsa; identical to SEQ ID NO: 65157

SEQ ID NO: 338759 - RNA, 63 nt, hsa; identical to SEQ ID NO: 65158

SEQ ID NO: 338760 - RNA, 63 nt, hsa; identical to SEQ ID NO: 65159

SEQ ID NO: 338761 - RNA, 63 nt, hsa; identical to SEQ ID NO: 65160

SEQ ID NO: 338762 - RNA, 63 nt, hsa; identical to SEQ ID NO: 65161

SEQ ID NO: 338763 - RNA, 63 nt, hsa; identical to SEQ ID NO: 65162

SEQ ID NO: 338764 - RNA, 63 nt, hsa; identical to SEQ ID NO: 65163

SEQ ID NO: 338765 - RNA, 63 nt, hsa; identical to SEQ ID NO: 65164

SEQ ID NO: 338766 - RNA, 63 nt, hsa; identical to SEQ ID NO: 65165

SEQ ID NO: 338767 - RNA, 63 nt, hsa; identical to SEQ ID NO: 65166

SEQ ID NO: 338768 - RNA, 63 nt, hsa; identical to SEQ ID NO: 65167

SEQ ID NO: 338769 - RNA, 63 nt, hsa; identical to SEQ ID NO: 65168

SEQ ID NO: 338770 - RNA, 63 nt, hsa; identical to SEQ ID NO: 65169

SEQ ID NO: 338771 - RNA, 63 nt, hsa; identical to SEQ ID NO: 65170

SEQ ID NO: 338772 - RNA, 63 nt, hsa; identical to SEQ ID NO: 65171

SEQ ID NO: 338773 - RNA, 63 nt, hsa; identical to SEQ ID NO: 65172

SEQ ID NO: 338774 - RNA, 63 nt, hsa; identical to SEQ ID NO: 65173

SEQ ID NO: 338775 - RNA, 63 nt, hsa; identical to SEQ ID NO: 65174

SEQ ID NO: 338776 - RNA, 63 nt, hsa; identical to SEQ ID NO: 65175

SEQ ID NO: 338777 - RNA, 63 nt, hsa; identical to SEQ ID NO: 65176

SEQ ID NO: 338778 - RNA, 63 nt, hsa; identical to SEQ ID NO: 65177

SEQ ID NO: 338779 - RNA, 63 nt, hsa; identical to SEQ ID NO: 65178

SEQ ID NO: 338780 - RNA, 63 nt, hsa; identical to SEQ ID NO: 65179

SEQ ID NO: 338781 - RNA, 63 nt, hsa; identical to SEQ ID NO: 65180

SEQ ID NO: 338782 - RNA, 63 nt, hsa; identical to SEQ ID NO: 65181

SEQ ID NO: 338783 - RNA, 63 nt, hsa; identical to SEQ ID NO: 65182

SEQ ID NO: 338784 - RNA, 63 nt, hsa; identical to SEQ ID NO: 65183

SEQ ID NO: 338785 - RNA, 63 nt, hsa; identical to SEQ ID NO: 65184

SEQ ID NO: 338786 - RNA, 63 nt, hsa; identical to SEQ ID NO: 65185

SEQ ID NO: 338787 - RNA, 63 nt, hsa; identical to SEQ ID NO: 65186

SEQ ID NO: 338788 - RNA, 63 nt, hsa; identical to SEQ ID NO: 65187

SEQ ID NO: 338789 - RNA, 63 nt, hsa; identical to SEQ ID NO: 65188

SEQ ID NO: 338790 - RNA, 63 nt, hsa; identical to SEQ ID NO: 65189

SEQ ID NO: 338791 - RNA, 63 nt, hsa; identical to SEQ ID NO: 65190

SEQ ID NO: 338792 - RNA, 63 nt, hsa; identical to SEQ ID NO: 65191

SEQ ID NO: 338793 - RNA, 63 nt, hsa; identical to SEQ ID NO: 65192

SEQ ID NO: 338794 - RNA, 63 nt, hsa; identical to SEQ ID NO: 65193

SEQ ID NO: 338795 - RNA, 63 nt, hsa; identical to SEQ ID NO: 65194

SEQ ID NO: 338796 - RNA, 63 nt, hsa; identical to SEQ ID NO: 65195

SEQ ID NO: 338797 - RNA, 63 nt, hsa; identical to SEQ ID NO: 65196

SEQ ID NO: 338798 - RNA, 63 nt, hsa; identical to SEQ ID NO: 65197

SEQ ID NO: 338799 - RNA, 63 nt, hsa; identical to SEQ ID NO: 65198

SEQ ID NO: 338800 - RNA, 63 nt, hsa; identical to SEQ ID NO: 65199

SEQ ID NO: 338801 - RNA, 63 nt, hsa; identical to SEQ ID NO: 65200

SEQ ID NO: 338802 - RNA, 63 nt, hsa; identical to SEQ ID NO: 65201

SEQ ID NO: 338803 - RNA, 63 nt, hsa; identical to SEQ ID NO: 65202

SEQ ID NO: 338804 - RNA, 63 nt, hsa; identical to SEQ ID NO: 65203

SEQ ID NO: 338805 - RNA, 63 nt, hsa; identical to SEQ ID NO: 65204

SEQ ID NO: 338806 - RNA, 63 nt, hsa; identical to SEQ ID NO: 65205

SEQ ID NO: 338807 - RNA, 63 nt, hsa; identical to SEQ ID NO: 65206

SEQ ID NO: 338808 - RNA, 63 nt, hsa; identical to SEQ ID NO: 65207

SEQ ID NO: 338809 - RNA, 63 nt, hsa; identical to SEQ ID NO: 65208

SEQ ID NO: 338810 - RNA, 63 nt, hsa; identical to SEQ ID NO: 65209

SEQ ID NO: 338811 - RNA, 63 nt, hsa; identical to SEQ ID NO: 65210

SEQ ID NO: 338812 - RNA, 63 nt, hsa; identical to SEQ ID NO: 65211

SEQ ID NO: 338813 - RNA, 63 nt, hsa; identical to SEQ ID NO: 65212

SEQ ID NO: 338814 - RNA, 63 nt, hsa; identical to SEQ ID NO: 65213

SEQ ID NO: 338815 - RNA, 63 nt, hsa; identical to SEQ ID NO: 65214

SEQ ID NO: 338816 - RNA, 63 nt, hsa; identical to SEQ ID NO: 65215

SEQ ID NO: 338817 - RNA, 63 nt, hsa; identical to SEQ ID NO: 65216

SEQ ID NO: 338818 - RNA, 63 nt, hsa; identical to SEQ ID NO: 65217

SEQ ID NO: 338819 - RNA, 63 nt, hsa; identical to SEQ ID NO: 65218

SEQ ID NO: 338820 - RNA, 63 nt, hsa; identical to SEQ ID NO: 65219

SEQ ID NO: 338821 - RNA, 63 nt, hsa; identical to SEQ ID NO: 65220

SEQ ID NO: 338822 - RNA, 63 nt, hsa; identical to SEQ ID NO: 65221

SEQ ID NO: 338823 - RNA, 63 nt, hsa; identical to SEQ ID NO: 65222

SEQ ID NO: 338824 - RNA, 63 nt, hsa; identical to SEQ ID NO: 65223

SEQ ID NO: 338825 - RNA, 63 nt, hsa; identical to SEQ ID NO: 65224

SEQ ID NO: 338826 - RNA, 63 nt, hsa; identical to SEQ ID NO: 65225

SEQ ID NO: 338827 - RNA, 63 nt, hsa; identical to SEQ ID NO: 65226

SEQ ID NO: 338828 - RNA, 63 nt, hsa; identical to SEQ ID NO: 65227

SEQ ID NO: 338829 - RNA, 63 nt, hsa; identical to SEQ ID NO: 65228

SEQ ID NO: 338830 - RNA, 63 nt, hsa; identical to SEQ ID NO: 65229

SEQ ID NO: 338831 - RNA, 63 nt, hsa; identical to SEQ ID NO: 65230

SEQ ID NO: 338832 - RNA, 63 nt, hsa; identical to SEQ ID NO: 65231

SEQ ID NO: 338833 - RNA, 63 nt, hsa; identical to SEQ ID NO: 65232

SEQ ID NO: 338834 - RNA, 63 nt, hsa; identical to SEQ ID NO: 65233

SEQ ID NO: 338835 - RNA, 63 nt, hsa; identical to SEQ ID NO: 65234

SEQ ID NO: 338836 - RNA, 63 nt, hsa; identical to SEQ ID NO: 65235

SEQ ID NO: 338837 - RNA, 63 nt, hsa; identical to SEQ ID NO: 65236

SEQ ID NO: 338838 - RNA, 63 nt, hsa; identical to SEQ ID NO: 65237

SEQ ID NO: 338839 - RNA, 63 nt, hsa; identical to SEQ ID NO: 65238

SEQ ID NO: 338840 - RNA, 63 nt, hsa; identical to SEQ ID NO: 65239

SEQ ID NO: 338841 - RNA, 63 nt, hsa; identical to SEQ ID NO: 65240

SEQ ID NO: 338842 - RNA, 63 nt, hsa; identical to SEQ ID NO: 65241

SEQ ID NO: 338843 - RNA, 63 nt, hsa; identical to SEQ ID NO: 65242

SEQ ID NO: 338844 - RNA, 63 nt, hsa; identical to SEQ ID NO: 65243

SEQ ID NO: 338845 - RNA, 63 nt, hsa; identical to SEQ ID NO: 65244

SEQ ID NO: 338846 - RNA, 63 nt, hsa; identical to SEQ ID NO: 65245

SEQ ID NO: 338847 - RNA, 63 nt, hsa; identical to SEQ ID NO: 65246

SEQ ID NO: 338848 - RNA, 63 nt, hsa; identical to SEQ ID NO: 65247

SEQ ID NO: 338849 - RNA, 63 nt, hsa; identical to SEQ ID NO: 65248

SEQ ID NO: 338850 - RNA, 63 nt, hsa; identical to SEQ ID NO: 65249

SEQ ID NO: 338851 - RNA, 63 nt, hsa; identical to SEQ ID NO: 65250

SEQ ID NO: 338852 - RNA, 63 nt, hsa; identical to SEQ ID NO: 65251

SEQ ID NO: 338853 - RNA, 63 nt, hsa; identical to SEQ ID NO: 65252

SEQ ID NO: 338854 - RNA, 63 nt, hsa; identical to SEQ ID NO: 65253

SEQ ID NO: 338855 - RNA, 63 nt, hsa; identical to SEQ ID NO: 65254

SEQ ID NO: 338856 - RNA, 63 nt, hsa; identical to SEQ ID NO: 65255

SEQ ID NO: 338857 - RNA, 63 nt, hsa; identical to SEQ ID NO: 65256

SEQ ID NO: 338858 - RNA, 63 nt, hsa; identical to SEQ ID NO: 65257

SEQ ID NO: 338859 - RNA, 63 nt, hsa; identical to SEQ ID NO: 65258

SEQ ID NO: 338860 - RNA, 63 nt, hsa; identical to SEQ ID NO: 65259

SEQ ID NO: 338861 - RNA, 63 nt, hsa; identical to SEQ ID NO: 65260

SEQ ID NO: 338862 - RNA, 63 nt, hsa; identical to SEQ ID NO: 65261

SEQ ID NO: 338863 - RNA, 63 nt, hsa; identical to SEQ ID NO: 65262

SEQ ID NO: 338864 - RNA, 63 nt, hsa; identical to SEQ ID NO: 65263

SEQ ID NO: 338865 - RNA, 63 nt, hsa; identical to SEQ ID NO: 65264

SEQ ID NO: 338866 - RNA, 63 nt, hsa; identical to SEQ ID NO: 65265

SEQ ID NO: 338867 - RNA, 63 nt, hsa; identical to SEQ ID NO: 65266

SEQ ID NO: 338868 - RNA, 63 nt, hsa; identical to SEQ ID NO: 65267

SEQ ID NO: 338869 - RNA, 63 nt, hsa; identical to SEQ ID NO: 65268

SEQ ID NO: 338870 - RNA, 63 nt, hsa; identical to SEQ ID NO: 65269

SEQ ID NO: 338871 - RNA, 63 nt, hsa; identical to SEQ ID NO: 65270

SEQ ID NO: 338872 - RNA, 63 nt, hsa; identical to SEQ ID NO: 65271

SEQ ID NO: 338873 - RNA, 63 nt, hsa; identical to SEQ ID NO: 65272

SEQ ID NO: 338874 - RNA, 63 nt, hsa; identical to SEQ ID NO: 65273

SEQ ID NO: 338875 - RNA, 56 nt, hsa; identical to SEQ ID NO: 61369

SEQ ID NO: 338876 - RNA, 63 nt, hsa; identical to SEQ ID NO: 65275

SEQ ID NO: 338877 - RNA, 63 nt, hsa; identical to SEQ ID NO: 65276

SEQ ID NO: 338878 - RNA, 63 nt, hsa; identical to SEQ ID NO: 65277

SEQ ID NO: 338879 - RNA, 63 nt, hsa; identical to SEQ ID NO: 65278

SEQ ID NO: 338880 - RNA, 63 nt, hsa; identical to SEQ ID NO: 65279

SEQ ID NO: 338881 - RNA, 63 nt, hsa; identical to SEQ ID NO: 65280

SEQ ID NO: 338882 - RNA, 63 nt, hsa; identical to SEQ ID NO: 65281

SEQ ID NO: 338883 - RNA, 63 nt, hsa; identical to SEQ ID NO: 65282

SEQ ID NO: 338884 - RNA, 63 nt, hsa; identical to SEQ ID NO: 65283

SEQ ID NO: 338885 - RNA, 63 nt, hsa; identical to SEQ ID NO: 65284

SEQ ID NO: 338886 - RNA, 63 nt, hsa; identical to SEQ ID NO: 65285

SEQ ID NO: 338887 - RNA, 63 nt, hsa; identical to SEQ ID NO: 65286

SEQ ID NO: 338888 - RNA, 63 nt, hsa; identical to SEQ ID NO: 65287

SEQ ID NO: 338889 - RNA, 63 nt, hsa; identical to SEQ ID NO: 65288

SEQ ID NO: 338890 - RNA, 63 nt, hsa; identical to SEQ ID NO: 65289

SEQ ID NO: 338891 - RNA, 63 nt, hsa; identical to SEQ ID NO: 65290

SEQ ID NO: 338892 - RNA, 63 nt, hsa; identical to SEQ ID NO: 65291

SEQ ID NO: 338893 - RNA, 63 nt, hsa; identical to SEQ ID NO: 65292

SEQ ID NO: 338894 - RNA, 63 nt, hsa; identical to SEQ ID NO: 65293

SEQ ID NO: 338895 - RNA, 63 nt, hsa; identical to SEQ ID NO: 65294

SEQ ID NO: 338896 - RNA, 63 nt, hsa; identical to SEQ ID NO: 65295

SEQ ID NO: 338897 - RNA, 63 nt, hsa; identical to SEQ ID NO: 65296

SEQ ID NO: 338898 - RNA, 63 nt, hsa; identical to SEQ ID NO: 65297

SEQ ID NO: 338899 - RNA, 63 nt, hsa; identical to SEQ ID NO: 65298

SEQ ID NO: 338900 - RNA, 63 nt, hsa; identical to SEQ ID NO: 65299

SEQ ID NO: 338901 - RNA, 63 nt, hsa; identical to SEQ ID NO: 65300

SEQ ID NO: 338902 - RNA, 63 nt, hsa; identical to SEQ ID NO: 65301

SEQ ID NO: 338903 - RNA, 63 nt, hsa; identical to SEQ ID NO: 65302

SEQ ID NO: 338904 - RNA, 63 nt, hsa; identical to SEQ ID NO: 65303

SEQ ID NO: 338905 - RNA, 63 nt, hsa; identical to SEQ ID NO: 65304

SEQ ID NO: 338906 - RNA, 63 nt, hsa; identical to SEQ ID NO: 65305

SEQ ID NO: 338907 - RNA, 63 nt, hsa; identical to SEQ ID NO: 65306

SEQ ID NO: 338908 - RNA, 63 nt, hsa; identical to SEQ ID NO: 65307

SEQ ID NO: 338909 - RNA, 63 nt, hsa; identical to SEQ ID NO: 65308

SEQ ID NO: 338910 - RNA, 63 nt, hsa; identical to SEQ ID NO: 65309

SEQ ID NO: 338911 - RNA, 63 nt, hsa; identical to SEQ ID NO: 65310

SEQ ID NO: 338912 - RNA, 63 nt, hsa; identical to SEQ ID NO: 65311

SEQ ID NO: 338913 - RNA, 63 nt, hsa; identical to SEQ ID NO: 65312

SEQ ID NO: 338914 - RNA, 63 nt, hsa; identical to SEQ ID NO: 65313

SEQ ID NO: 338915 - RNA, 63 nt, hsa; identical to SEQ ID NO: 65314

SEQ ID NO: 338916 - RNA, 63 nt, hsa; identical to SEQ ID NO: 65315

SEQ ID NO: 338917 - RNA, 63 nt, hsa; identical to SEQ ID NO: 65316

SEQ ID NO: 338918 - RNA, 63 nt, hsa; identical to SEQ ID NO: 65317

SEQ ID NO: 338919 - RNA, 63 nt, hsa; identical to SEQ ID NO: 65318

SEQ ID NO: 338920 - RNA, 63 nt, hsa; identical to SEQ ID NO: 65319

SEQ ID NO: 338921 - RNA, 63 nt, hsa; identical to SEQ ID NO: 65320

SEQ ID NO: 338922 - RNA, 63 nt, hsa; identical to SEQ ID NO: 65321

SEQ ID NO: 338923 - RNA, 63 nt, hsa; identical to SEQ ID NO: 65322

SEQ ID NO: 338924 - RNA, 63 nt, hsa; identical to SEQ ID NO: 65323

SEQ ID NO: 338925 - RNA, 63 nt, hsa; identical to SEQ ID NO: 65324

SEQ ID NO: 338926 - RNA, 63 nt, hsa; identical to SEQ ID NO: 65325

SEQ ID NO: 338927 - RNA, 63 nt, hsa; identical to SEQ ID NO: 65326

SEQ ID NO: 338928 - RNA, 63 nt, hsa; identical to SEQ ID NO: 65327

SEQ ID NO: 338929 - RNA, 63 nt, hsa; identical to SEQ ID NO: 65328

SEQ ID NO: 338930 - RNA, 63 nt, hsa; identical to SEQ ID NO: 65329

SEQ ID NO: 338931 - RNA, 63 nt, hsa; identical to SEQ ID NO: 65330

SEQ ID NO: 338932 - RNA, 63 nt, hsa; identical to SEQ ID NO: 65331

SEQ ID NO: 338933 - RNA, 63 nt, hsa; identical to SEQ ID NO: 65332

SEQ ID NO: 338934 - RNA, 63 nt, hsa; identical to SEQ ID NO: 65333

SEQ ID NO: 338935 - RNA, 63 nt, hsa; identical to SEQ ID NO: 65334

SEQ ID NO: 338936 - RNA, 63 nt, hsa; identical to SEQ ID NO: 65335

SEQ ID NO: 338937 - RNA, 63 nt, hsa; identical to SEQ ID NO: 65336

SEQ ID NO: 338938 - RNA, 63 nt, hsa; identical to SEQ ID NO: 65337

SEQ ID NO: 338939 - RNA, 63 nt, hsa; identical to SEQ ID NO: 65338

SEQ ID NO: 338940 - RNA, 63 nt, hsa; identical to SEQ ID NO: 65339

SEQ ID NO: 338941 - RNA, 63 nt, hsa; identical to SEQ ID NO: 65340

SEQ ID NO: 338942 - RNA, 63 nt, hsa; identical to SEQ ID NO: 65341

SEQ ID NO: 338943 - RNA, 63 nt, hsa; identical to SEQ ID NO: 65342

SEQ ID NO: 338944 - RNA, 63 nt, hsa; identical to SEQ ID NO: 65343

SEQ ID NO: 338945 - RNA, 63 nt, hsa; identical to SEQ ID NO: 65344

SEQ ID NO: 338946 - RNA, 63 nt, hsa; identical to SEQ ID NO: 65345

SEQ ID NO: 338947 - RNA, 63 nt, hsa; identical to SEQ ID NO: 65346

SEQ ID NO: 338948 - RNA, 63 nt, hsa; identical to SEQ ID NO: 65347

SEQ ID NO: 338949 - RNA, 63 nt, hsa; identical to SEQ ID NO: 65348

SEQ ID NO: 338950 - RNA, 63 nt, hsa; identical to SEQ ID NO: 65349

SEQ ID NO: 338951 - RNA, 63 nt, hsa; identical to SEQ ID NO: 65350

SEQ ID NO: 338952 - RNA, 63 nt, hsa; identical to SEQ ID NO: 65351

SEQ ID NO: 338953 - RNA, 63 nt, hsa; identical to SEQ ID NO: 65352

SEQ ID NO: 338954 - RNA, 63 nt, hsa; identical to SEQ ID NO: 65353

SEQ ID NO: 338955 - RNA, 63 nt, hsa; identical to SEQ ID NO: 65354

SEQ ID NO: 338956 - RNA, 63 nt, hsa; identical to SEQ ID NO: 65355

SEQ ID NO: 338957 - RNA, 63 nt, hsa; identical to SEQ ID NO: 65356

SEQ ID NO: 338958 - RNA, 63 nt, hsa; identical to SEQ ID NO: 65357

SEQ ID NO: 338959 - RNA, 63 nt, hsa; identical to SEQ ID NO: 65358

SEQ ID NO: 338960 - RNA, 63 nt, hsa; identical to SEQ ID NO: 65359

SEQ ID NO: 338961 - RNA, 63 nt, hsa; identical to SEQ ID NO: 65360

SEQ ID NO: 338962 - RNA, 63 nt, hsa; identical to SEQ ID NO: 65361

SEQ ID NO: 338963 - RNA, 63 nt, hsa; identical to SEQ ID NO: 65362

SEQ ID NO: 338964 - RNA, 63 nt, hsa; identical to SEQ ID NO: 65363

SEQ ID NO: 338965 - RNA, 63 nt, hsa; identical to SEQ ID NO: 65364

SEQ ID NO: 338966 - RNA, 63 nt, hsa; identical to SEQ ID NO: 65365

SEQ ID NO: 338967 - RNA, 60 nt, hsa; identical to SEQ ID NO: 65087

SEQ ID NO: 338968 - RNA, 63 nt, hsa; identical to SEQ ID NO: 65367

SEQ ID NO: 338969 - RNA, 63 nt, hsa; identical to SEQ ID NO: 65368

SEQ ID NO: 338970 - RNA, 63 nt, hsa; identical to SEQ ID NO: 65369

SEQ ID NO: 338971 - RNA, 63 nt, hsa; identical to SEQ ID NO: 65370

SEQ ID NO: 338972 - RNA, 63 nt, hsa; identical to SEQ ID NO: 65371

SEQ ID NO: 338973 - RNA, 63 nt, hsa; identical to SEQ ID NO: 65372

SEQ ID NO: 338974 - RNA, 51 nt, hsa; identical to SEQ ID NO: 65094

SEQ ID NO: 338975 - RNA, 63 nt, hsa; identical to SEQ ID NO: 65374

SEQ ID NO: 338976 - RNA, 63 nt, hsa; identical to SEQ ID NO: 65375

SEQ ID NO: 338977 - RNA, 63 nt, hsa; identical to SEQ ID NO: 65376

SEQ ID NO: 338978 - RNA, 63 nt, hsa; identical to SEQ ID NO: 65377

SEQ ID NO: 338979 - RNA, 63 nt, hsa; identical to SEQ ID NO: 65378

SEQ ID NO: 338980 - RNA, 63 nt, hsa; identical to SEQ ID NO: 65379

SEQ ID NO: 338981 - RNA, 63 nt, hsa; identical to SEQ ID NO: 65380

SEQ ID NO: 338982 - RNA, 63 nt, hsa; identical to SEQ ID NO: 65381

SEQ ID NO: 338983 - RNA, 63 nt, hsa; identical to SEQ ID NO: 65382

SEQ ID NO: 338984 - RNA, 63 nt, hsa; identical to SEQ ID NO: 65383

SEQ ID NO: 338985 - RNA, 63 nt, hsa; identical to SEQ ID NO: 65384

SEQ ID NO: 338986 - RNA, 63 nt, hsa; identical to SEQ ID NO: 65385

SEQ ID NO: 338987 - RNA, 63 nt, hsa; identical to SEQ ID NO: 65386

SEQ ID NO: 338988 - RNA, 63 nt, hsa; identical to SEQ ID NO: 65387

SEQ ID NO: 338989 - RNA, 63 nt, hsa; identical to SEQ ID NO: 65388

SEQ ID NO: 338990 - RNA, 63 nt, hsa; identical to SEQ ID NO: 65389

SEQ ID NO: 338991 - RNA, 63 nt, hsa; identical to SEQ ID NO: 65390

SEQ ID NO: 338992 - RNA, 63 nt, hsa; identical to SEQ ID NO: 65391

SEQ ID NO: 338993 - RNA, 63 nt, hsa; identical to SEQ ID NO: 65392

SEQ ID NO: 338994 - RNA, 63 nt, hsa; identical to SEQ ID NO: 65393

SEQ ID NO: 338995 - RNA, 63 nt, hsa; identical to SEQ ID NO: 65394

SEQ ID NO: 338996 - RNA, 63 nt, hsa; identical to SEQ ID NO: 65395

SEQ ID NO: 338997 - RNA, 63 nt, hsa; identical to SEQ ID NO: 65396

SEQ ID NO: 338998 - RNA, 63 nt, hsa; identical to SEQ ID NO: 65397

SEQ ID NO: 338999 - RNA, 63 nt, hsa; identical to SEQ ID NO: 65398

SEQ ID NO: 339000 - RNA, 63 nt, hsa; identical to SEQ ID NO: 65399

SEQ ID NO: 339001 - RNA, 63 nt, hsa; identical to SEQ ID NO: 65400

SEQ ID NO: 339002 - RNA, 63 nt, hsa; identical to SEQ ID NO: 65401

SEQ ID NO: 339003 - RNA, 63 nt, hsa; identical to SEQ ID NO: 65402

SEQ ID NO: 339004 - RNA, 63 nt, hsa; identical to SEQ ID NO: 65403

SEQ ID NO: 339005 - RNA, 63 nt, hsa; identical to SEQ ID NO: 65404

SEQ ID NO: 339006 - RNA, 63 nt, hsa; identical to SEQ ID NO: 65405

SEQ ID NO: 339007 - RNA, 63 nt, hsa; identical to SEQ ID NO: 65406

SEQ ID NO: 339008 - RNA, 63 nt, hsa; identical to SEQ ID NO: 65407

SEQ ID NO: 339009 - RNA, 63 nt, hsa; identical to SEQ ID NO: 65408

SEQ ID NO: 339010 - RNA, 63 nt, hsa; identical to SEQ ID NO: 65409

SEQ ID NO: 339011 - RNA, 63 nt, hsa; identical to SEQ ID NO: 65410

SEQ ID NO: 339012 - RNA, 63 nt, hsa; identical to SEQ ID NO: 65411

SEQ ID NO: 339013 - RNA, 63 nt, hsa; identical to SEQ ID NO: 65412

SEQ ID NO: 339014 - RNA, 63 nt, hsa; identical to SEQ ID NO: 65413

SEQ ID NO: 339015 - RNA, 63 nt, hsa; identical to SEQ ID NO: 65414

SEQ ID NO: 339016 - RNA, 61 nt, hsa
gugauuugugcaagccagguucaacccuugccucaagaaaucagaugggaccaauuuagug

SEQ ID NO: 339017 - RNA, 61 nt, hsa
agauggcuggugaggagcuuaacagaggaaccucaagaagauucugaaaauccuaccccca

SEQ ID NO: 339018 - RNA, 61 nt, hsa
aauacugaagggguuaaacagguuuuugcuccucaagaauuuguuugccugggcccaggau

SEQ ID NO: 339019 - RNA, 61 nt, hsa
aacacuuaccaaaagaucacugcaaaccugccucaagaagcugaugguggcacuucaauuu

SEQ ID NO: 339020 - RNA, 61 nt, hsa
guccuuuuuuuuuuuuuuuuuuuuuuaauugcucaagaaaugauucucucacaggcuuggg

SEQ ID NO: 339021 - RNA, 61 nt, hsa
ugaugacaucugacuuuugucgaugggacuucucaagaagccauuccuuggagcuucuguu

SEQ ID NO: 339022 - RNA, 61 nt, hsa
acugccaugaagacggucucuguguccucagcucaagaauccuguagcuugucccaucaua

SEQ ID NO: 339023 - RNA, 58 nt, hsa
caaaccccaaaaacaacugauauaauuacucaagaaauauuugcaacauuaguuuuuu

SEQ ID NO: 339024 - RNA, 61 nt, hsa
uccuccaugguaaagcugaacugaaacaauucucaagaaugcaucagcuguaccuacaaua

SEQ ID NO: 339025 - RNA, 61 nt, hsa
ucugaagauguaagacuuccugaaacaaguucucaagaagucuuuacauuauauuuauaac

SEQ ID NO: 339026 - RNA, 61 nt, hsa
gaauauuggggaaggaagaugauacuucuuucucaagaaaagaaaauuggauuauuaggaa

SEQ ID NO: 339027 - RNA, 61 nt, hsa
cauaagcgaucacuuccuauaugcacuuauucucaagaagaacaucuuuaugguaaagaug

SEQ ID NO: 339028 - RNA, 61 nt, hsa
gaaugcugaacugaaggcucagauugaggagcucaagaacgagaagcagcauuugauauac

SEQ ID NO: 339029 - RNA, 61 nt, hsa
guauuucaccaccuaaauguaauguugauuccucaagaaugaaaugaaggcacuacauuga

SEQ ID NO: 339030 - RNA, 61 nt, hsa
aagacaaaacagauugcgucgcugacaaguucucaagaagaacuuaugaguaagcagucug

SEQ ID NO: 339031 - RNA, 61 nt, hsa
cacgugagguuuuguuuagagggauccacuacucaagaaaaaguuagcaaaccacuccuuu

SEQ ID NO: 339032 - RNA, 61 nt, hsa
caaaagcuugauaugacagagaagaagaaggcucaagaauuuauucaccaguuccucugca

SEQ ID NO: 339033 - RNA, 61 nt, hsa
ccacuggucacagguagacauguggagucaacucaagaaaaagcugagugaacagcaugau

SEQ ID NO: 339034 - RNA, 61 nt, hsa
ugugaccacaucucccaccacguccccagaucucaagaacgcagcucagcuucuccuucga

SEQ ID NO: 339035 - RNA, 61 nt, hsa
agagggccugugggagccugcaaacucacugcucaagaagacauggagacuccugcccugu

SEQ ID NO: 339036 - RNA, 61 nt, hsa
gagauccugucucuuaaagaaaaaaaauaaacucaagaaugauuuuucuaaaaauaugagu

SEQ ID NO: 339037 - RNA, 61 nt, hsa
uacugaucacuauaguauugcauaagcacagcucaagaacugagcuuuguauguguccuuu

SEQ ID NO: 339038 - RNA, 61 nt, hsa
agugggcuacauacaaugagagcccugagcccucaagaacucaugccagcucagcccuaca

SEQ ID NO: 339039 - RNA, 61 nt, hsa
ugacaauggcagagaacaauuaaaggguugacucaagaacuaguuccaaaccuagcagaau

SEQ ID NO: 339040 - RNA, 61 nt, hsa
gggcauccgacaaggcccaucuccuucccuccucaagaagcagaggccuccucuggaguga

SEQ ID NO: 339041 - RNA, 61 nt, hsa
uauggcaguauguauauauuguguuaaguuccucaagaaucuccuuaaaaacuuugaaguu

SEQ ID NO: 339042 - RNA, 61 nt, hsa
gauuuaaggacuucugggggaccaagacauccucaagaaaacaggggcauccagggcuccc

SEQ ID NO: 339043 - RNA, 61 nt, hsa
gucccccagcagaaccagccucaaaaacgcccucaagaacaugaugggccugaacucggac

SEQ ID NO: 339044 - RNA, 51 nt, hsa
cuucugggaaguucucuugaacucaagaacucuuuauuuucuaucauucuu

SEQ ID NO: 339045 - RNA, 61 nt, hsa
ugcucacauccacagucagggcacggcgccccucaagaacuccagagucaccugucucauc

SEQ ID NO: 339046 - RNA, 61 nt, hsa
aggcccucucuuccucucauaccacguuuugcucaagaagcugggcuguaacaauucaggg

SEQ ID NO: 339047 - RNA, 61 nt, hsa
uuuuguaucagugcuguuaauuugcuguugccucaagaaaaagugcuuuuucuccauggau

SEQ ID NO: 339048 - RNA, 61 nt, hsa
aaaccuuauggaaaauaauuauaguacaauucucaagaaaauucacuaugugaaugagaug

SEQ ID NO: 339049 - RNA, 61 nt, hsa
acccugauuugaccccucuucuuauaaggaucucaagaaucucuucagaagcacugaugac

SEQ ID NO: 339050 - RNA, 61 nt, hsa
aaggcaaagcaaggaacaucuugagauaugucucaagaauauaaagauguauuauuuuaag

SEQ ID NO: 339051 - RNA, 61 nt, hsa
ucacaugggaguuguccucacccuuguuaaucucaagaaacucuuauuuauaauagguugc

SEQ ID NO: 339052 - RNA, 61 nt, hsa
cuguuuggaaacaaccccuugagcugccaggcucaagaaaucauggacucacaggguccug

SEQ ID NO: 339053 - RNA, 61 nt, hsa
uggccuguguguuacaaugauaugaucauuucucaagaauaagucccuuuuuguauguguu

SEQ ID NO: 339054 - RNA, 61 nt, hsa
cuucugugucacaaacagcacuccaggccagcucaagaagcaaagcaggccaauagaaaug

SEQ ID NO: 339055 - RNA, 61 nt, hsa
uaugugugcuccauuccucauuucuacuuggcucaagaaaacauuucugcagucaggugag

SEQ ID NO: 339056 - RNA, 61 nt, hsa
ggcagugaaaauggccagccagagaaaagaucucaagaaccagaaauaaauaaggauggug

SEQ ID NO: 339057 - RNA, 61 nt, hsa
aagacauacucauuaaguguuauuuauuuuacucaagaacuggaaaccaacuaaaugccuu

SEQ ID NO: 339058 - RNA, 61 nt, hsa
uauguucccaggcuaguguugaacuccugagcucaagaaauccuccugccugagucucuga

SEQ ID NO: 339059 - RNA, 61 nt, hsa
guuucugauuacauaaaauuugaauagaacacucaagaaguauguagauuuuugaaaaacc

SEQ ID NO: 339060 - RNA, 61 nt, hsa
gaauguuccaacaccugccuccacuucuccccucaagaaauuuucaacgccaggaaucaug

SEQ ID NO: 339061 - RNA, 61 nt, hsa
aagagacuucugcuuuucaacccccacccuccucaagaaguaauaauuuguuuacuuguaa

SEQ ID NO: 339062 - RNA, 61 nt, hsa
uuggaugcggccauucaaggggagccaaaaucucaagaaauucccagcagguuaccuggag

SEQ ID NO: 339063 - RNA, 61 nt, hsa
ccccagacaucuggacacugggcauagauuucucaagaaggaagacuccccugccucccca

SEQ ID NO: 339064 - RNA, 61 nt, hsa
uugaaaacacugcaacagugaacuuuugcaucucaagaaaacauugaaaaauucuaugaau

SEQ ID NO: 339065 - RNA, 61 nt, hsa
gucuuucucuaggacaagcucccagugaucacucaagaaucuggcucucauucuaagaggc

SEQ ID NO: 339066 - RNA, 61 nt, hsa
cauucaucuuguguuuuauaugagaaggugccucaagaauuuccuguuggauuuguuuaaa

SEQ ID NO: 339067 - RNA, 61 nt, hsa
gguucucaauuugacacccuaagcgaucauacucaagaauaguacagauguguggaauacg

SEQ ID NO: 339068 - RNA, 61 nt, hsa
agugacuuauuaaacuauugaaggaaaaggacucaagaaaaauaauaaaagaccauaaaua

SEQ ID NO: 339069 - RNA, 61 nt, hsa
uugaaccuuauuucucaaaacuuauaguagccucaagaagucuauugauauuggucauguu

SEQ ID NO: 339070 - RNA, 58 nt, hsa
agcacaucaugucuaucugaauggagcucucaagaacaagcauuguuuaggaagacug

SEQ ID NO: 339071 - RNA, 61 nt, hsa
ugugcucugaguuuugcuguugaaagucucccucaagaauagcuucagauccucuugugua

SEQ ID NO: 339072 - RNA, 61 nt, hsa
uaucauuuuaauguaauugauuguauauagucucaagaaugguuggugggcaugaguuccu

SEQ ID NO: 339073 - RNA, 61 nt, hsa
uuuuguagcaaucuggucuauagacuuuuaacucaagaagcuaaggcuagacuuguuaccu

SEQ ID NO: 339074 - RNA, 61 nt, hsa
augucucuccucuagguaucguauuuuguugcucaagaauccaaaaugggucuguggacau

SEQ ID NO: 339075 - RNA, 61 nt, hsa
gcuuaguuuuuggacugaaaagauauuaaaacucaagaaggaccaagaaguuuucauaugu

SEQ ID NO: 339076 - RNA, 61 nt, hsa
gaguaacaauacaaauggauuuugggagugacucaagaagugaagaaugcacaagaaugga

SEQ ID NO: 339077 - RNA, 61 nt, hsa
gacacagaacaaggucugucuccuauagucacucaagaagucgaucgagaaguuccacauc

SEQ ID NO: 339078 - RNA, 61 nt, hsa
uaauuagacuuuuguauaagagaugucaugccucaagaaagccauaaaccugguaggaaca

SEQ ID NO: 339079 - RNA, 61 nt, hsa
ccugaagcagacugcugaggaauuacauuugcucaagaauuuuuuccgucaaauugugaac

SEQ ID NO: 339080 - RNA, 61 nt, hsa
uuaauuauuuaucuuuaguuccuuauuaguucucaagaaacaaaugcuagcuucauaugua

SEQ ID NO: 339081 - RNA, 61 nt, hsa
ggucccuuccuuucuccuuuccucucuacugcucaagaacagauuugaggccaggugcggu

SEQ ID NO: 339082 - RNA, 61 nt, hsa
uaagcaauguaauuaugcuauucacaggggccucaagaauugguauguaugaugugaucug

SEQ ID NO: 339083 - RNA, 61 nt, hsa
cuuauguagaaaggacuuugaaauuuuucuucucaagaaaugguuuguauaagaauaacaa

SEQ ID NO: 339084 - RNA, 61 nt, hsa
auacugacugauuaauuauuccugauaacaucucaagaaaaggagaaggaaaguguuucug

SEQ ID NO: 339085 - RNA, 61 nt, hsa
uaaaauugucagcguauuuuuacacuauuggcucaagaauguuauaaugcuaagggacaua

SEQ ID NO: 339086 - RNA, 61 nt, hsa
gaaaagauuaauaccuuaaaagaagaaaacacucaagaagcagcaguccugaaugguguuu

SEQ ID NO: 339087 - RNA, 61 nt, hsa
cacuccagccugggccacagagcaagacugucucaagaaaaaaaauuuuuuaaauaaguuu

SEQ ID NO: 339088 - RNA, 61 nt, hsa
auuuuauacaaauagauugcuuagaaugguucucaagaauuauaagagaaaugaacucaca

SEQ ID NO: 339089 - RNA, 61 nt, hsa
uaagcaccuggcaucuaauggcaggcaggcacucaagaaaugaauuaacuacauaauggaa

SEQ ID NO: 339090 - RNA, 61 nt, hsa
uucugugaauuucaugaagagcagaacauuucucaagaauccucuugagccaguaaucaau

SEQ ID NO: 339091 - RNA, 61 nt, hsa
gagaauagaaaugaaaagccacgucauauaacucaagaauaaaugguguuuuggaaauuuu

SEQ ID NO: 339092 - RNA, 61 nt, hsa
ccugcugggcacaccccacaaaccccacucccucaagaagggccagggccagggcuguaug

SEQ ID NO: 339093 - RNA, 61 nt, hsa
gcaggacaguaaauaaugaaaaccaaauuuccucaagaaauaacugaagaaggagcaagug

SEQ ID NO: 339094 - RNA, 61 nt, hsa
gauguggucaguagggagcuccaugcccaagcucaagaacgacugcaacacuacuuuaugg

SEQ ID NO: 339095 - RNA, 61 nt, hsa
auuuaauugcucaaccaugcauuuaaaacuccucaagaaaggauugguacugcaacuguag

SEQ ID NO: 339096 - RNA, 61 nt, hsa
uaaauuugaguaaauacaauuuuuuagguuacucaagaaccagcauuaguaauuucuagua

SEQ ID NO: 339097 - RNA, 61 nt, hsa
gggaacacacaaagaauuacacaacguuuuccucaagaaaaugguacaaaacacaaccgag

SEQ ID NO: 339098 - RNA, 61 nt, hsa
auaauggguuugggggauaauaauggugaagcucaagaacagaugucuauugaguagaacc

SEQ ID NO: 339099 - RNA, 61 nt, hsa
gugaauuguggaaaaugucauguagcugacacucaagaaauagggauuccuaauaauggca

SEQ ID NO: 339100 - RNA, 61 nt, hsa
gcuuuccugcuauacacauauucacauggcgcucaagaaguuaggcucauggcaacgugug

SEQ ID NO: 339101 - RNA, 61 nt, hsa
ucaucaaguggaagccaacuguccugccugccucaagaauauguguuuucuuuagcuuccc

SEQ ID NO: 339102 - RNA, 61 nt, hsa
aaauuugcucuguuuuaagacuuugaacuaccucaagaagaggaaucuaauacaauauuug

SEQ ID NO: 339103 - RNA, 61 nt, hsa
aaguuuucacugaaugagcauggcagugccacucaagaaaaugaaucuccaaaguaucuuc

SEQ ID NO: 339104 - RNA, 61 nt, hsa
ugcuuagaaguaagcaauucccaggucauagcucaagaauuguuagcaaaugacagauuuc

SEQ ID NO: 339105 - RNA, 61 nt, hsa
gugccaggucacuauuguaagauguuaaaaucucaagaaaauuucacagagcuaaagaaau

SEQ ID NO: 339106 - RNA, 61 nt, hsa
uaagaaaggacuacagcauuugauguguguccucaagaacuugucuugggucugaaaaagc

SEQ ID NO: 339107 - RNA, 61 nt, hsa
uauggccuucuugucaaaaccuucacuggagcucaagaaaagcauuucuguuguguuauuu

SEQ ID NO: 339108 - RNA, 61 nt, hsa
cuuaugggaauccugagcugcuuuucaccaucucaagaagccuaagaaguuauauauuuaa

SEQ ID NO: 339109 - RNA, 61 nt, hsa
uagauaaaaguguuccaguaaucagaaaauccucaagaaaauugacuucauuauuuggaag

SEQ ID NO: 339110 - RNA, 61 nt, hsa
ccauuaccuuuccucugccugaaagacgugucucaagaaaaauaaauucuauuuuagaugc

SEQ ID NO: 339111 - RNA, 61 nt, hsa
uauaucaucauaaaauagacaauguuuuugucucaagaacaagaauaaaauugaaaucugc

SEQ ID NO: 339112 - RNA, 61 nt, hsa
uaaaaagguaaaacuacauuuagacuucuuucucaagaaaucaaauacagcuuuuuuucaa

SEQ ID NO: 339113 - RNA, 61 nt, hsa
cgaacaagauuaauuaccugucuuccuguuucucaagaauauuuacguaguuuuucauagg

SEQ ID NO: 339114 - RNA, 61 nt, hsa
uuuagacuacaauaauacuuuuauccaugugcucaagaaagggccccuuuuuccaacuuau

SEQ ID NO: 339115 - RNA, 61 nt, hsa
uauguauuugcuacucaaguguacagaucuccucaagaaacaucaagggacuccuguguca

SEQ ID NO: 339116 - RNA, 61 nt, hsa
auaaccgauuauugauuacuguauuuuuuuucucaagaacagugauagguagaaacuaauu

SEQ ID NO: 339117 - RNA, 61 nt, hsa
gucaucauugcuguuuagcuugacuguuuuccucaagaacaucgaucugaaggauucauaa

SEQ ID NO: 339118 - RNA, 61 nt, hsa
ugcucuguagagaauuugcuaccgaaguuggcucaagaauuuguuuuuaguguuauuuacc

SEQ ID NO: 339119 - RNA, 61 nt, hsa
gcaaaggccuuccugcauuuaugaauucucucucaagaagcaagagaacaccugcaggaag

SEQ ID NO: 339120 - RNA, 61 nt, hsa
agaauuaagaauggacaggaccaagacagaacucaagaaagccacuggggaaaacucgaga

SEQ ID NO: 339121 - RNA, 61 nt, hsa
auguucaacauuuacuucuauuugauaucugcucaagaagucauagaagucuugggaaacu

SEQ ID NO: 339122 - RNA, 61 nt, hsa
aacauugucagaaauaaauaaaaccacaagucucaagaauuugccacguauguucaagggu

SEQ ID NO: 339123 - RNA, 61 nt, hsa
cuucagguaacacuacagaguacgugaaaugcucaagaauguagucagacugacacuacua

SEQ ID NO: 339124 - RNA, 61 nt, hsa
caaaacacaguccugcauacucaccaccaagcucaagaaauaaaucaucaccaauaccuuu

SEQ ID NO: 339125 - RNA, 61 nt, hsa
caacucauuggguuguagccaaagguucacucucaagaagcuuuaauauuuaaauaaaauc

SEQ ID NO: 339126 - RNA, 61 nt, hsa
aucaccuagaaaaguagccucacucuuauuccucaagaauuaauauccaauguuuaugagu

SEQ ID NO: 339127 - RNA, 61 nt, hsa
ucagcauuguauacacauauuuucacuuuaacucaagaauuccaggagguaauuuguugau

SEQ ID NO: 339128 - RNA, 61 nt, hsa
acaaauggcaauguaaaaaucaagacauuuucucaagaacuguguaccacuaaaaguaaua

SEQ ID NO: 339129 - RNA, 61 nt, hsa
gaagcaugcagagaagaauugguuuguuggccucaagaagaaugggagcugcaaacgcggu

SEQ ID NO: 339130 - RNA, 61 nt, hsa
accaugccccuuccccaggcccccagcaagucucaagaacacagcugcacaggccuugacu

SEQ ID NO: 339131 - RNA, 61 nt, hsa
aaauacaguuuguuuguauaaaauaaacuaucucaagaaaguuuucaacgacagugauagu

SEQ ID NO: 339132 - RNA, 61 nt, hsa
uugagaaauccuuuugugaagucauugccugcucaagaauguacaguggcuccccaaugcc

SEQ ID NO: 339133 - RNA, 61 nt, hsa
agaguguguucgcacuuagccaugggcugggcucaagaaccugauaccuggguugaugugg

SEQ ID NO: 339134 - RNA, 61 nt, hsa
aacugccuaacugaagggaaugggggcccugcucaagaagggggccaggcagcuggaauca

SEQ ID NO: 339135 - RNA, 61 nt, hsa
gguaugagcugccaagucuauuuuaaagacgcucaagaauccucugggguucaucuaggga

SEQ ID NO: 339136 - RNA, 61 nt, hsa
uucagccaacccagaggauguagacccuguccucaagaagugcagggcgaguucugccgug

SEQ ID NO: 339137 - RNA, 61 nt, hsa
guggaacgagacuucugcagagguggcugaccucaagaagcagguacaggcccuucagccc

SEQ ID NO: 339138 - RNA, 61 nt, hsa
cuagauuauauuuaguaggggaaaaauugggcucaagaaccauucaucaguacgugagaca

SEQ ID NO: 339139 - RNA, 61 nt, hsa
cuuguaagcaguucauagaagcugcucaauacucaagaaucuugcaagacaguuauuaaac

SEQ ID NO: 339140 - RNA, 61 nt, hsa
uuguuuugaucauuuccacugcacauuucuccucaagaaaagcgaaaggacagacuguugg

SEQ ID NO: 339141 - RNA, 61 nt, hsa
gcaauuugaacacuaaccucuccccuccuggcucaagaauuacuccgaagucagucugcag

SEQ ID NO: 339142 - RNA, 61 nt, hsa
ugagcaaauaacuacagggugcccauuaccacucaagaagacacuucacguauucuuguau

SEQ ID NO: 339143 - RNA, 61 nt, hsa
gguagccuucaagcuuguccagcagaaccagcucaagaaaggagaugcccuagugguggcc

SEQ ID NO: 339144 - RNA, 61 nt, hsa
uuacuccgugccuuacuggauuuggccuguccucaagaaugguaauuaugaagaguggaga

SEQ ID NO: 339145 - RNA, 61 nt, hsa
agcguccauuuuuucauauuagagguggaaccucaagaaugacuuuauucuuguaucucau

SEQ ID NO: 339146 - RNA, 61 nt, hsa
uugucuugcccuauagacucaggaguugcuucucaagaaagagccagcaaguauucucagc

SEQ ID NO: 339147 - RNA, 61 nt, hsa
uaaacauuaaguuugaaauaggaaugguuuucucaagaauagauuuggugugauaccuugu

SEQ ID NO: 339148 - RNA, 61 nt, hsa
gugaugagcagacauguuuaagggucuaagucucaagaaucuguuauguguguuugcugcg

SEQ ID NO: 339149 - RNA, 61 nt, hsa
uuuaaucuauuuaaucuucuugcauuuauuucucaagaauuacuggcuuuaaaagaagcca

SEQ ID NO: 339150 - RNA, 61 nt, hsa
ccucaauauuugguaaugcuauuuaaagugacucaagaagcaugugcuaucuggcuuugaa

SEQ ID NO: 339151 - RNA, 61 nt, hsa
gaaauauuguugcucaguguuguuaauauagcucaagaauugaguuuauauuugcaguaug

SEQ ID NO: 339152 - RNA, 61 nt, hsa
cgagaagacucagccugagggccugcggagccucaagaagccagaccgcaagaagcgcuac

SEQ ID NO: 339153 - RNA, 61 nt, hsa
ggaacuuccucuuucauuggaaacuuucuuacucaagaaugacggcaguauuguuuucuua

SEQ ID NO: 339154 - RNA, 61 nt, hsa
ugucuucaucaaguauuucccuacagaacuccucaagaaaacagagaucauuuggcuagag

SEQ ID NO: 339155 - RNA, 61 nt, hsa
cucugggccccuccccagcuccacucccuaccucaagaaugugaccauuuggaaaaggcaa

SEQ ID NO: 339156 - RNA, 61 nt, hsa
auguugccaaggcugguuucaaacuccuggacucaagaaauccacccaccucagccuccca

SEQ ID NO: 339157 - RNA, 61 nt, hsa
gacaguuccaggucuugaagcuaaucagcaucucaagaaaguauccagaaagaacaucugc

SEQ ID NO: 339158 - RNA, 61 nt, hsa
cuaagcucucaaaauagcauauucccuagagcucaagaaagcugguccaggagguugaaaa

SEQ ID NO: 339159 - RNA, 61 nt, hsa
ugugcuccagccugggcgacagaagucuugucucaagaagaaaacgaacugggaaaauuuc

SEQ ID NO: 339160 - RNA, 61 nt, hsa
caugcccguucugaccucagccuuggaacuccucaagaaccugaagauuccaguggucagu

SEQ ID NO: 339161 - RNA, 61 nt, hsa
auugggaaacuuaaccguuacccaggcaauacucaagaaggagaauccauuuagcaccucc

SEQ ID NO: 339162 - RNA, 61 nt, hsa
uugcuguuguaaaaguguuuucauaaguucacucaagaaaaaugcagcuguucugaacugg

SEQ ID NO: 339163 - RNA, 61 nt, hsa
gucuguuuaaaaauuacuaauucucaaauggcucaagaacauuagaauuuaaguaccuuuu

SEQ ID NO: 339164 - RNA, 61 nt, hsa
uagugucuucuuccugcccucagcaccacagcucaagaaaaccuaaaguuucaauacaagc

SEQ ID NO: 339165 - RNA, 61 nt, hsa
cacccacgcacccccccacacacuaugcucucucaagaauguaauuuauuggggccccccc

SEQ ID NO: 339166 - RNA, 61 nt, hsa
gaguccugccguggcucagguggaucuaaaacucaagaacaaauucuauuuauuuauuauu

SEQ ID NO: 339167 - RNA, 61 nt, hsa
uacuaucuaucucaccaguauuugcucucgacucaagaagguuaacauuuucugauucaug

SEQ ID NO: 339168 - RNA, 61 nt, hsa
acagcugucuguuguuuuaugaaguuuauuucucaagaaaaugggaauaaauuugggauuu

SEQ ID NO: 339169 - RNA, 61 nt, hsa
cucuagcuugggcaauagagcaaggcuccgucucaagaaaagaaggucauuucccaagacu

SEQ ID NO: 339170 - RNA, 61 nt, hsa
ggaagcauguguguuucuaaaaaguaaaaaucucaagaaaacagaaauggcaugcuuuacc

SEQ ID NO: 339171 - RNA, 61 nt, hsa
aaugcagagauaauuagacaugguucccgcccucaagaagcucacaaaaguauucaggaaa

SEQ ID NO: 339172 - RNA, 61 nt, hsa
uucuuuuggaacuuguuucaagccaaaaacucucaagaaagcaaauugcaccucagcugga

SEQ ID NO: 339173 - RNA, 57 nt, hsa
cuaccagagggaaaauguaaccugucacucaagaagcacaccuacagagcaccugua

SEQ ID NO: 339174 - RNA, 61 nt, hsa
uaaauuaucccauuauguaauucuuggucagcucaagaacuggguucuuuuucuaauaauu

SEQ ID NO: 339175 - RNA, 61 nt, hsa
cuggaacaguaggggcagggagaagacaggucucaagaaaagguuuuuaagaaguuucauc

SEQ ID NO: 339176 - RNA, 61 nt, hsa
ccucuacucucccgugcacugccggccagagcucaagaagcugcugcacgggcugggccuu

SEQ ID NO: 339177 - RNA, 61 nt, hsa
uuacucugaucaaauaaauaaugcuggaauacucaagaauugcauccucugaccuacuuca

SEQ ID NO: 339178 - RNA, 61 nt, hsa
gaggaagcacugaaacaacacaaaacccuaucucaagaacuuguuaaccuccggggagagc

SEQ ID NO: 339179 - RNA, 61 nt, hsa
ccacagggccugagaagucuugcuuuaugggcucaagaaugccaugcgcuggcaguacaug

SEQ ID NO: 339180 - RNA, 61 nt, hsa
cugauauuauuucuauuuaauacucuuuucucucaagaaaaaaaaaaaaguuuguuuuuuc

SEQ ID NO: 339181 - RNA, 61 nt, hsa
gugggagggaauguuuucaaauuucccauuucucaagaaauguucauauuaauugaggauu

SEQ ID NO: 339182 - RNA, 61 nt, hsa
uuugaugauucugagaagaaacuuguccuuccucaagaacacagcccugcuucugacauaa

SEQ ID NO: 339183 - RNA, 61 nt, hsa
auaaccaaaaaaugugagcuauaauguuucccucaagaacaaacagaaacgagauuugcca

SEQ ID NO: 339184 - RNA, 61 nt, hsa
agccccaguuggcuuccuggucaacaaggaccucaagaacugccuguggaccgaggccccc

SEQ ID NO: 339185 - RNA, 61 nt, hsa
cagagguaacucucaggcagcuaagcagcaccucaagaaaacauguuaaauuaaugcuucu

SEQ ID NO: 339186 - RNA, 61 nt, hsa
agaguagcugcugcuuucccugacuuccuuccucaagaauacagucuauucugggggguug

SEQ ID NO: 339187 - RNA, 61 nt, hsa
uuuuccucugacaccagagaacaauaguagucucaagaauggaaaccugaaugucugaggg

SEQ ID NO: 339188 - RNA, 61 nt, hsa
aacuucaguuacugaccagucaagagaauuucucaagaaaaaucccagcaacguucccucu

SEQ ID NO: 339189 - RNA, 61 nt, hsa
agcacaaagugaugaaugacugccuucaagucucaagaaaacacuuuucccuaacuuuuag

SEQ ID NO: 339190 - RNA, 61 nt, hsa
ugggugagcugcaccugauuaguugaaaggccucaagaacaaacacugcaguuuccuggaa

SEQ ID NO: 339191 - RNA, 61 nt, hsa
cuguggaguugguagcugguaacauuguugucucaagaacaacucaccucucucccuagga

SEQ ID NO: 339192 - RNA, 61 nt, hsa
acuaaaccuucuuaauauccgccacagaaggcucaagaauccagcccuaaaauucucucca

SEQ ID NO: 339193 - RNA, 61 nt, hsa
uaccucauaugcaggaugagccaauggcagucucaagaaauguacucgggcgacaccuuac

SEQ ID NO: 339194 - RNA, 61 nt, hsa
uucugacauuccuagacagguucauucuuugcucaagaaaggccugaaugacaauguccag

SEQ ID NO: 339195 - RNA, 61 nt, hsa
acaacaagaucaacuagaagaauucaacugucucaagaaucaagguaccccaauauaucuc

SEQ ID NO: 339196 - RNA, 61 nt, hsa
gaagggagaaaggcaagaugugcacucuggacucaagaaacucuuaguucaguggaggaaa

SEQ ID NO: 339197 - RNA, 61 nt, hsa
acugugagcucccaggugcagccagaggcaccucaagaagaagaggggcauaaacuuuccu

SEQ ID NO: 339198 - RNA, 61 nt, hsa
cagaugaguuagaagcuuuuuaucccuuccucucaagaaaauauucuuucacccugucucu

SEQ ID NO: 339199 - RNA, 61 nt, hsa
ugacauaauuuacaugcaauauguuuaucaacucaagaauuuaauauaguugguacacaac

SEQ ID NO: 339200 - RNA, 61 nt, hsa
auacauuaggagcuucaaacacauauaauuucucaagaaauuuccagaugucucaugcugc

SEQ ID NO: 339201 - RNA, 61 nt, hsa
uaaggaagaacaaggaagggaaugaucuuuacucaagaauuucagaaagucagcacugaag

SEQ ID NO: 339202 - RNA, 57 nt, hsa
guccugaauguuuguuuuaaaguggagcucaagaauagcuuuuaaaaguucuuauuu

SEQ ID NO: 339203 - RNA, 61 nt, hsa
aggcugcuaauuggauuuugguaguucuuaccucaagaaaacuugaauuauuugggggaaa

SEQ ID NO: 339204 - RNA, 61 nt, hsa
gcuuaugaaggaaugccuccuuuguuacacacucaagaauuugucagcacacaauuaauug

SEQ ID NO: 339205 - RNA, 61 nt, hsa
aauucagaaauuggguuuugguucagugauucucaagaaaaagaucucuugcccauuaaga

SEQ ID NO: 339206 - RNA, 61 nt, hsa
aaaauccaaggugcuacaggaaacaagcacacucaagaaaguuuuuuucugaauaacauuu

SEQ ID NO: 339207 - RNA, 61 nt, hsa
agaaaacugaacugaggaaaaugguguuuuccucaagaagacuacuggaacuggaugaccu

SEQ ID NO: 339208 - RNA, 61 nt, hsa
uuccaucuccaaauagccaggcccucucucccucaagaaaugcccagauguagaaauucau

SEQ ID NO: 339209 - RNA, 61 nt, hsa
aguucauuucaucacuuagaaaauaugucuucucaagaacaaaacugugcuguuacaacuc

SEQ ID NO: 339210 - RNA, 61 nt, hsa
gcucucucucugcugccucuucauacguuuucucaagaacuucaguuuauaauuggaagag

SEQ ID NO: 339211 - RNA, 61 nt, hsa
cucuauccgaggccauuggagaccccaguuucucaagaauucagcucugcucugagcgucc

SEQ ID NO: 339212 - RNA, 61 nt, hsa
uugaguccagaugcuucucaccuucuuucuccucaagaaagaugcuuuuugggaaacguug

SEQ ID NO: 339213 - RNA, 61 nt, hsa
cacagacagaugaggcaggagugauggggcacucaagaaaguucagaggaggcauaagcua

SEQ ID NO: 339214 - RNA, 61 nt, hsa
gaucuuggcaugcacccaccuaacccacuuucucaagaacaagaaccuagaaugaauaucc

SEQ ID NO: 339215 - RNA, 61 nt, hsa
cccagaagaccaaacugccuuccccucagggcucaagaauguguacagucuguggggccgg

SEQ ID NO: 339216 - RNA, 61 nt, hsa
uccuuuuguguuuuucccacuuuccaauguacucaagaaaauugaacaaauguaauggauc

SEQ ID NO: 339217 - RNA, 61 nt, hsa
gacuaaggagcugcagcgauacaucgaagggcucaagaagcgccggagcaagaggcuguac

SEQ ID NO: 339218 - RNA, 61 nt, hsa
ccagagggcuuuguggaggacaggccuugcccucaagaacgucguaccugacgcugagccu

SEQ ID NO: 339219 - RNA, 61 nt, hsa
agcuuuuuggaaggauaauucugauaaggcacucaagaaacguacaaccacagugcuuucu

SEQ ID NO: 339220 - RNA, 61 nt, hsa
acccgccaccguggaggcagggggcaagaaacucaagaacgcaucaagagcaccagcccug

SEQ ID NO: 339221 - RNA, 54 nt, hsa
cuaucacuauguuguuguaacuaacucaagaauuucuaaacucucccaggucac

SEQ ID NO: 339222 - RNA, 61 nt, hsa
cucacgcaccucccauccuaaucauccaaugcucaagaaacaacuucuacuucugcccuug

SEQ ID NO: 339223 - RNA, 61 nt, hsa
uuuucagagucaucuacaaaauuuuucuuuccucaagaaaagaguuccuuuugccuuauuc

SEQ ID NO: 339224 - RNA, 61 nt, hsa
gacuuaggaucaugcuggaaggaagccaagucucaagaacugucagcaacagaaaaugaga

SEQ ID NO: 339225 - RNA, 61 nt, hsa
cccuggaucuuugggguaaaaggaggguggccucaagaaacaaugucuggggacaggccuu

SEQ ID NO: 339226 - RNA, 61 nt, hsa
augccuaacaguggucuguuuuuauaugagacucaagaacaggccucauuccagggcacag

SEQ ID NO: 339227 - RNA, 61 nt, hsa
ggaggagggauucuggucuucacugccaugccucaagaacaccuuuguuuugcacugacaa

SEQ ID NO: 339228 - RNA, 61 nt, hsa
ggaaugcugggaaaugagauacauucccgcccucaagaaucucccagucugguaggagaga

SEQ ID NO: 339229 - RNA, 61 nt, hsa
gagacaugagucuuugccggaggaaaagcagcucaagaacacaugugcagucacugguguc

SEQ ID NO: 339230 - RNA, 61 nt, hsa
uuccuauugaucucauuuuauuuagcaucagcucaagaaacuaagucuuagugcacaguau

SEQ ID NO: 339231 - RNA, 61 nt, hsa
uaaugagauaaugcauguaggggaaaaguuucucaagaagguggaagaggcagcaggacuu

SEQ ID NO: 339232 - RNA, 61 nt, hsa
uuauggcaugauuagauugcaaagcaaugaacucaagaaggaauugaaauaaggagggaca

SEQ ID NO: 339233 - RNA, 61 nt, hsa
guuuggauaucuuuaggguuuagaaucuaaccucaagaauaagaaauacaaguacaaauug

SEQ ID NO: 339234 - RNA, 61 nt, hsa
caucuuuuuucuucccucauuuucugggauucucaagaaagaaaaaguaacccauuaucac

SEQ ID NO: 339235 - RNA, 61 nt, hsa
uuuuggacuaauguuacuguccaaguucuuucucaagaaaccacaucugguucagaagagu

SEQ ID NO: 339236 - RNA, 61 nt, hsa
uuaaauuuuuuuauaggcccauaugcucuaucucaagaaacaagaugauuguaacaugucc

SEQ ID NO: 339237 - RNA, 61 nt, hsa
cuuuccuuuauuucacuuguacccaguuucacucaagaaaucuugaugaauauuuauguug

SEQ ID NO: 339238 - RNA, 61 nt, hsa
cccucucuauagccaugagacuccuuguggccucaagaaauuuagacgcccacgacagcac

SEQ ID NO: 339239 - RNA, 61 nt, hsa
ccgcacccgugugcacuguaacuuuugugugcucaagaaauuauacagaaaccuacagcug

SEQ ID NO: 339240 - RNA, 61 nt, hsa
cuccuggagaaagacuuccuugcaggagugacucaagaauuaaucaguaaauaccuugaaa

SEQ ID NO: 339241 - RNA, 51 nt, hsa
ggcuggucuugaacuccugagcucaagaaaucaacacaucuuggccuccca

SEQ ID NO: 339242 - RNA, 61 nt, hsa
uccuucauaaagaaugccacccaucugauuccucaagaaucuagaccuagaaauaccauuu

SEQ ID NO: 339243 - RNA, 61 nt, hsa
ggaaaaaaaaauccaagaaauguauugaauacucaagaaaaugccacauuucaauuacaua

SEQ ID NO: 339244 - RNA, 61 nt, hsa
ucauaugaucuucuucaagccauuauuuuaacucaagaaaacucuagagaagaaaagugaa

SEQ ID NO: 339245 - RNA, 61 nt, hsa
cuccacugcagcaggagggacuuaagcuagacucaagaaagcagcuuggagccucuagguu

SEQ ID NO: 339246 - RNA, 61 nt, hsa
aaaauaguaagccucccuccucguccccugccucaagaaauugccuccuuauuuaucaaca

SEQ ID NO: 339247 - RNA, 61 nt, hsa
ugguaugagcacaggucauggacagccccugcucaagaaaaagcaugagcuggccacacau

SEQ ID NO: 339248 - RNA, 61 nt, hsa
uugaaaaauagucaccaacuguauauacuuccucaagaacugauaauucauuauaucauca

SEQ ID NO: 339249 - RNA, 61 nt, hsa
cugccauucaacucggaaacuauaaguaauucucaagaaagcccucauuuuuauaaccugg

SEQ ID NO: 339250 - RNA, 61 nt, hsa
uuuuacuguuugccaaaacacuugaaugugccucaagaaaagguaccuacuacaugcugua

SEQ ID NO: 339251 - RNA, 61 nt, hsa
cuauacuggauccuuucuuucucuaauaauccucaagaaauccuuacagguaaguauugcu

SEQ ID NO: 339252 - RNA, 61 nt, hsa
cuggagagaugggauccuucuagauacagggcucaagaagucugcugggaguccccugagu

SEQ ID NO: 339253 - RNA, 61 nt, hsa
aggguccucagugcagagcaacuuacgcauccucaagaauccacugcuuuucaggcaagga

SEQ ID NO: 339254 - RNA, 61 nt, hsa
acgugggcaauaccagggacccauggggaaacucaagaaugacagcuucuauauuuuguaa

SEQ ID NO: 339255 - RNA, 61 nt, hsa
cuaagaaggccugucuacacugcaggggaaccucaagaacuuuucauugcacuucuaaaau

SEQ ID NO: 339256 - RNA, 61 nt, hsa
aaggaagagccuuuuaaaaacauuugccaaccucaagaauaaauacugaaagucuugaaag

SEQ ID NO: 339257 - RNA, 61 nt, hsa
ggauucugacuaagaggcaaaagagaaaagacucaagaaacugauccuggagaucgagacc

SEQ ID NO: 339258 - RNA, 61 nt, hsa
agccaggaguaagacaagugggauuuggggccucaagaaauauacucucccagauuuuuac

SEQ ID NO: 339259 - RNA, 61 nt, hsa
uguuuuaacaaaauuagcugaagaaguuauucucaagaaaauuggauguuuucauuggccu

SEQ ID NO: 339260 - RNA, 61 nt, hsa
auaugacaucauccugaagaacuucgagaagcucaagaagcccaggggagaaacaaaggga

SEQ ID NO: 339261 - RNA, 61 nt, hsa
gauuacauacauuugagaauaagaaauuacucucaagaacuucagaaaucugcaacauaau

SEQ ID NO: 339262 - RNA, 61 nt, hsa
auuucccauaaaugggaaguuugcccauugucucaagaaauguguauuucagugacaauuu

SEQ ID NO: 339263 - RNA, 61 nt, hsa
cauuuugggaaguaacugccucugacuucaacucaagaaaacacuuuuuuguugcuaaugu

SEQ ID NO: 339264 - RNA, 61 nt, hsa
gaagacugacuggguggaggcucugccuugccucaagaaccauccccugcagagcauccag

SEQ ID NO: 339265 - RNA, 61 nt, hsa
ggccuugcaucucgccaccuccacuucuguccucaagaacaaguccuaggucaagggaaac

SEQ ID NO: 339266 - RNA, 61 nt, hsa
ggaagugaaaauagccagccagaggaaaugucucaagaaccagaaauaaauaaggguggug

SEQ ID NO: 339267 - RNA, 61 nt, hsa
uuagugcuggauuugaagcuacgcacucagccucaagaacucccuggaauaucccugagaa

SEQ ID NO: 339268 - RNA, 61 nt, hsa
ggcccugggaaucaauuccucaggaauugcccucaagaacucugcuucuugcuuugcagag

SEQ ID NO: 339269 - RNA, 61 nt, hsa
ucuuagaguucauaaauuuacuugagguugccucaagaacucagggaacaauacuguaaac

SEQ ID NO: 339270 - RNA, 61 nt, hsa
gaagaauggaaauggaaaaggguggcugcgacucaagaauaauaugggagcccaugaggag

SEQ ID NO: 339271 - RNA, 61 nt, hsa
ggagauaaacaugaccaucgucaaagaccugcucaagaaauuuuuaaaaaagaaacaaagu

SEQ ID NO: 339272 - RNA, 61 nt, hsa
uucuuauuugcuagggaacugguaaucuaggcucaagaaguguguggagaagguuuauuuu

SEQ ID NO: 339273 - RNA, 61 nt, hsa
ucaguguggacuccuagaacgugcgaccugccucaagaaaaugcaguuuucaaaaacagac

SEQ ID NO: 339274 - RNA, 61 nt, hsa
uccucaggacauggagaucugugcagaugagcucaagaagguccuuaacacagucgugaac

SEQ ID NO: 339275 - RNA, 61 nt, hsa
acaccuguagauauuacuguacuuuuauguucucaagaaauaaguuguugccuauucagug

SEQ ID NO: 339276 - RNA, 61 nt, hsa
ugauucauacauuaucucacuugugccaacacucaagaagcaggcuacacugacacuggua

SEQ ID NO: 339277 - RNA, 56 nt, hsa
cuuuugaccugcugaguugauaaacacucaagaaccucaggagcgcugccagcuug

SEQ ID NO: 339278 - RNA, 61 nt, hsa
uccacuucauccagaugaaggaaaggaagaccucaagaaaaauucacaguugagugcaucc

SEQ ID NO: 339279 - RNA, 61 nt, hsa
ggagauaaacaccaccaucaucaaagagcugcucaagaaauuuuuaaaaacgaaacaaagu

SEQ ID NO: 339280 - RNA, 61 nt, hsa
aacuuuauaaugaaacgguucggaauacuggcucaagaaccuaugucaagaugagcugaau

SEQ ID NO: 339281 - RNA, 61 nt, hsa
gugagcugcuaaauugacuggccuugcagagcucaagaagggggcuuccaaugcugugaga

SEQ ID NO: 339282 - RNA, 61 nt, hsa
ccucucucacacaucacauucccaugguggccucaagaaaggcccggaagcgccaggcugg

SEQ ID NO: 339283 - RNA, 61 nt, hsa
uucuuagugauucacauccacgggacaaaaacucaagaagaaauaagagcugacgccacac

SEQ ID NO: 339284 - RNA, 61 nt, hsa
gggagugugcgaaucuacccugaccaaugggcucaagaauaaaguaugauuuuugagucag

SEQ ID NO: 339285 - RNA, 61 nt, hsa
gagggcuaaaucccaagugucucuugacuggcucaagaauuagggccccaacuacacaccc

SEQ ID NO: 339286 - RNA, 61 nt, hsa
uacuuguggcgaucugaguacucuacucuugcucaagaaguaauacgacaaucagaauaca

SEQ ID NO: 339287 - RNA, 61 nt, hsa
gggagugugcgaaucaaaccugaccaagcggcucaagaauaaaauaugaauugagggcccg

SEQ ID NO: 339288 - RNA, 61 nt, hsa
aaauuuggccuuaagaacugugucuggcguucucaagaaucuagaagauguguaaacaggu

SEQ ID NO: 339289 - RNA, 61 nt, hsa
gaaugcccgcagugagcuauacuuacgcuuccucaagaagaggauuagcucugauuuugag

SEQ ID NO: 339290 - RNA, 61 nt, hsa
acaaaauuaugucugcaccagugaauccauucucaagaaaagucuuaacuaggaaacuaaa

SEQ ID NO: 339291 - RNA, 61 nt, hsa
acacaggcaaauuauuuguggggguaggaaucucaagaauugcgaaagucaaauauggaga

SEQ ID NO: 339292 - RNA, 61 nt, hsa
caccaagcucauuacaucugccagggccugccucaagaagcccagcccagccuuuuccugg

SEQ ID NO: 339293 - RNA, 61 nt, hsa
gguauauuuauguaagaaaaugacuguaaaucucaagaaaaaucucagcagcuaauagcaa

SEQ ID NO: 339294 - RNA, 61 nt, hsa
aaccauuuguuaacuguacugaagguguguccucaagaagaaaguguucaaauuaaaaaag

SEQ ID NO: 339295 - RNA, 61 nt, hsa
cuaccaaaaguuaaaaaaaaaaaaaaaaaagcucaagaaccugcacgagggccuaaaacag

SEQ ID NO: 339296 - RNA, 61 nt, hsa
cucuguuuaguaguugguuggggaaguggggcucaagaaggauuuugggguucaccagaug

SEQ ID NO: 339297 - RNA, 61 nt, hsa
aaggggcuggaaaggggggaauggcccacaucucaagaagcaagauauuguuugugguggu

SEQ ID NO: 339298 - RNA, 61 nt, hsa
cagcauggauuccguggauagcuguugcagucucaagaagacugagagcuuccaaaaugcc

SEQ ID NO: 339299 - RNA, 61 nt, hsa
ccaacauuuugcugccuaccuuguuauccuucucaagaagcugaaguguacgcccucuccc

SEQ ID NO: 339300 - RNA, 61 nt, hsa
uauaccaccuaggaggagaugccaccaagcccucaagaaguugugcccuuccccgccugcg

SEQ ID NO: 339301 - RNA, 61 nt, hsa
acgugucccagcccagcguccaguggugccucucaagaaaccccgaacgaauguucggaug

SEQ ID NO: 339302 - RNA, 61 nt, hsa
caucauuauuaauauaaaaauaacaggcagccucaagaaugugcugagauuucucuggaaa

SEQ ID NO: 339303 - RNA, 61 nt, hsa
ugaagcuggauucuuucauacgauacucuuucucaagaagggggcucccugggaucuccag

SEQ ID NO: 339304 - RNA, 61 nt, hsa
gccugcaggguguggggaaggaggacacaaccucaagaaaggaagcgugaaccccagggaa

SEQ ID NO: 339305 - RNA, 61 nt, hsa
ugacacaaacucacacaaccaugacgcacugcucaagaacuacgggcugcucuacugcuuc

SEQ ID NO: 339306 - RNA, 61 nt, hsa
ugacacaaaaucgcacaacgaugacgcacugcucaagaacuacgggcugcucuacugcuuc

SEQ ID NO: 339307 - RNA, 61 nt, hsa
ugacacaaacucgcacaaccaugacgcacugcucaagaacuacgggcugcucuacugcuuc

SEQ ID NO: 339308 - RNA, 57 nt, hsa
acaaacucacacaacgaugacgcacuacucaagaacuacgggcugcucuacugcuuc

SEQ ID NO: 339309 - RNA, 61 nt, hsa
ugagugcuuuggaauuuaaaugauuguauaacucaagaagauuacuuuucuauguugcuca

SEQ ID NO: 339310 - RNA, 61 nt, hsa
agacgaugcauuucuuggccaaaguggcuuccucaagaaagcagcacuuaccuuugaaaaa

SEQ ID NO: 339311 - RNA, 61 nt, hsa
auggcuucacaguccuuacuucucuaccugccucaagaaggggcucagagcagagacuugu

SEQ ID NO: 339312 - RNA, 61 nt, hsa
aacauucuuccuaaaaggaagacuucauuuucucaagaaaugggauuaguuggggguauua

SEQ ID NO: 339313 - RNA, 61 nt, hsa
acuuuaaaaauaauacuuuuagcucuaauagcucaagaacacaauauucguuaauguucag

SEQ ID NO: 339314 - RNA, 61 nt, hsa
ggcacugaagaccugaaucuacacuaguaaucucaagaaagauuauucauucuaucucaga

SEQ ID NO: 339315 - RNA, 61 nt, hsa
gacgagcucuagcuggaugggcgcagagaaccucaagaaggcaugaagccagccccugcag

SEQ ID NO: 339316 - RNA, 61 nt, hsa
cuccagccuggucgacagagugagacuccaucucaagaaaaaauaaaaauaaaguuguucu

SEQ ID NO: 339317 - RNA, 61 nt, hsa
uugggaggcugaggcaggaggaucacucgagcucaagaauucaagaccugggcaagagaga

SEQ ID NO: 339318 - RNA, 61 nt, hsa
cuccagccugggcgacagagcaagacucugucucaagaagaaaaaaaaaauacauauacac

SEQ ID NO: 339319 - RNA, 61 nt, hsa
uauaugcaugaaguuaaaacaacugacguuacucaagaauuagaaaacuuugcaagauuug

SEQ ID NO: 339320 - RNA, 61 nt, hsa
cuucagccugggcgacacagcgagacccugucucaagaaagaaaagaaaaagagacaaauu

SEQ ID NO: 339321 - RNA, 61 nt, hsa
cuccagcgcugggcccucccuugcccccaagcucaagaagggggcacugcccggcccggcu

SEQ ID NO: 339322 - RNA, 61 nt, hsa
ccuacgccacuggaaacacacccaccgcaaccucaagaaccagacugugcagagggcauug

SEQ ID NO: 339323 - RNA, 61 nt, hsa
uuccagccugugcgacagaaugagacacugucucaagaaaaaauaaaagugggaaaaucuu

SEQ ID NO: 339324 - RNA, 61 nt, hsa
ggaccccccaagucuuccuacccucugcacccucaagaaacccccagugccuuguaugaag

SEQ ID NO: 339325 - RNA, 61 nt, hsa
ccuucauuaacaaagacccuuguucuuaucccucaagaagaaacccaccauaaccagccca

SEQ ID NO: 339326 - RNA, 61 nt, hsa
guaccuauugacuguauccucaugcauuuuccucaagaaugucugaagaagguaguaauau

SEQ ID NO: 339327 - RNA, 61 nt, hsa
ccgggcuacgaugacauguaccugugaaggccucaagaauguaacaucccaggcuucccuc

SEQ ID NO: 339328 - RNA, 59 nt, hsa
cuccagcccgggcaacagaguaagacccugccucaagaaaaaaaaaaaaaaaaaaaauc

SEQ ID NO: 339329 - RNA, 61 nt, hsa
ccaggugccggcacagugccucucccagagccucaagaagggccauuuaggagcuugcuuc

SEQ ID NO: 339330 - RNA, 61 nt, hsa
ccgugccugacucauccaguggggaaggugacucaagaaguuguuuaagccuaggccuagg

SEQ ID NO: 339331 - RNA, 61 nt, hsa
agcuguugcuggaaacuugcuuuaggaacagcucaagaaccuuggaguucauauuucacaa

SEQ ID NO: 339332 - RNA, 61 nt, hsa
agaagaggaguggaugagccugcggguuugccucaagaaacuucaugagggucucuuacua

SEQ ID NO: 339333 - RNA, 61 nt, hsa
cuauggcgcuuccuugaguggaaggaaaugucucaagaaacaaagaucucgcuggugcgua

SEQ ID NO: 339334 - RNA, 52 nt, hsa
aggucaucuugaaaggaugagacucaagaaccaagaugggggaccagcaacc

SEQ ID NO: 339335 - RNA, 61 nt, hsa
aaucuugcuuuuauggucuuccccccucgcccucaagaacaagggccuugugcgugggccu

SEQ ID NO: 339336 - RNA, 61 nt, hsa
uguuuauuuucuaguagcuuuuauaaguacacucaagaauuugucagggagaauaauucug

SEQ ID NO: 339337 - RNA, 61 nt, hsa
ccagguuuacuuucuaucagcugagcaaccucucaagaaaaaauaaauaaauaaauaaacc

SEQ ID NO: 339338 - RNA, 61 nt, hsa
uguucuguauaaacaaaugcagcuggaaucgcucaagaaucuuauuuuucuaaauccaaca

SEQ ID NO: 339339 - RNA, 61 nt, hsa
ccugaagacuccggccaagaggcacaagcagcucaagaacaagcuggagaagaacgaggag

SEQ ID NO: 339340 - RNA, 61 nt, hsa
cuuuccuguauaguucacguuucauguaauccucaagaaauaaaaggaagccaaagagugu

SEQ ID NO: 339341 - RNA, 61 nt, hsa
acuguaggugaaggcuguauuuguaguaguacucaagaaucaccugauguuuucuuauucu

SEQ ID NO: 339342 - RNA, 61 nt, hsa
gauuuggcuggugccgaaguguuucugaagucucaagaacugccauaaaaucucacgcugc

SEQ ID NO: 339343 - RNA, 61 nt, hsa
ucgggacauauauuuacauagaucccagacacucaagaauuagcacagcugauguaaaauu

SEQ ID NO: 339344 - RNA, 61 nt, hsa
guccauuucggggagaggagcaggugggacccucaagaaaaugacggagaacaucccagac

SEQ ID NO: 339345 - RNA, 61 nt, hsa
uuuugaaacuuagguauuuuauauuuuuccccucaagaacuuuuuuuuaagagacagauuu

SEQ ID NO: 339346 - RNA, 61 nt, hsa
ucccagcggccuccggcgucuugcccagcagcucaagaagaaaaagaaggacugaacucca

SEQ ID NO: 339347 - RNA, 61 nt, hsa
ucucgaaauugccaguguguacuuggcuuaacucaagaacaguuucuucuggauuccuuau

SEQ ID NO: 339348 - RNA, 61 nt, hsa
uucuacaaagcaaggcccacagacuaccccacucaagaacagcagguaugugggccagagg

SEQ ID NO: 339349 - RNA, 61 nt, hsa
ggcucccuguacuggagucgucccacuauuccucaagaaaucuuagaaccagcuugugagg

SEQ ID NO: 339350 - RNA, 61 nt, hsa
ucuguacaaguauguggagcaugaaugcugacucaagaaacuuuuacuccuucugcucaag

SEQ ID NO: 339351 - RNA, 61 nt, hsa
gagcgaauuagcaauaacauacaugagauaacucaagaaaucaaaagauaguugauucuug

SEQ ID NO: 339352 - RNA, 61 nt, hsa
uaaaaauguauaggcaguauacacagcacuacucaagaagccaaagaaacacuugugcagu

SEQ ID NO: 339353 - RNA, 61 nt, hsa
accccucucugaagggcuguuguucugcuuccucaagaaauuaaacauuuguuucugugug

SEQ ID NO: 339354 - RNA, 61 nt, hsa
cuccagccugggugacagagugagacucugucucaagaaggaaaaaaaaaaaaaagaaugu

SEQ ID NO: 339355 - RNA, 61 nt, hsa
cagaggaugagugaccaguugcuaaguggggcucaagaagcaccgccuuccccacccccug

SEQ ID NO: 339356 - RNA, 61 nt, hsa
gucacaaauguuccugaaagcaccacagcuacucaagaagaucaaauucaggacauaaacu

SEQ ID NO: 339357 - RNA, 61 nt, hsa
aaucugaaagauuuuucaagaaucuuaaaaucucaagaagugaagcagauucauacagccu

SEQ ID NO: 339358 - RNA, 61 nt, hsa
gaugcagacuuguucuucuuuuuaaagcagucucaagaauaagcauuucuuuaaaauguuu

SEQ ID NO: 339359 - RNA, 61 nt, hsa
aacacaagaacuuaagagaaaaagaaaccuacucaagaaaagacagaagagacagugauuu

SEQ ID NO: 339360 - RNA, 61 nt, hsa
ugacaaacacaagugccccuuuucucuggaucucaagaaugguggaggacccuggaaggac

SEQ ID NO: 339361 - RNA, 61 nt, hsa
uugcacuaucacaauugcuuuuuaguuauuucucaagaagcauguucguauuagagacaaa

SEQ ID NO: 339362 - RNA, 61 nt, hsa
accuucgucucuuugugcuuuguaaagcaaacucaagaaaacugguacaccuguaccagcu

SEQ ID NO: 339363 - RNA, 61 nt, hsa
gaauuagcaguaaaauacaugagauaaagaccucaagaaguuaaaagauacuuaauucuug

SEQ ID NO: 339364 - RNA, 61 nt, hsa; identical to SEQ ID NO: 339351

SEQ ID NO: 339365 - RNA, 61 nt, hsa
acagacugcaccaccccuucccccccugcaucucaagaauaaagcaagcugccuuuguacu

SEQ ID NO: 339366 - RNA, 61 nt, hsa
uuuagguauuaagacugagaaauauuuaaagcucaagaagaacacagaagcacacaucccu

SEQ ID NO: 339367 - RNA, 61 nt, hsa
uaacgagagacaucaguuucucaggaugauccucaagaacguuauggaguccauguugcaa

SEQ ID NO: 339368 - RNA, 61 nt, hsa
agagcgucagguggcaaaaguccuucuguuacucaagaaaaugcucugaaaaauuccuuuu

SEQ ID NO: 339369 - RNA, 63 nt, hsa
gugugauuugugcaagccagguucaacccuugccucaagaaaucagaugggaccaauuuagug

SEQ ID NO: 339370 - RNA, 63 nt, hsa
gaagauggcuggugaggagcuuaacagaggaaccucaagaagauucugaaaauccuaccccca

SEQ ID NO: 339371 - RNA, 63 nt, hsa
gcaauacugaagggguuaaacagguuuuugcuccucaagaauuuguuugccugggcccaggau

SEQ ID NO: 339372 - RNA, 63 nt, hsa
auaacacuuaccaaaagaucacugcaaaccugccucaagaagcugaugguggcacuucaauuu

SEQ ID NO: 339373 - RNA, 63 nt, hsa
aaguccuuuuuuuuuuuuuuuuuuuuuuaauugcucaagaaaugauucucucacaggcuuggg

SEQ ID NO: 339374 - RNA, 63 nt, hsa
acugaugacaucugacuuuugucgaugggacuucucaagaagccauuccuuggagcuucuguu

SEQ ID NO: 339375 - RNA, 63 nt, hsa
auacugccaugaagacggucucuguguccucagcucaagaauccuguagcuugucccaucaua

SEQ ID NO: 339376 - RNA, 58 nt, hsa; identical to SEQ ID NO: 339023

SEQ ID NO: 339377 - RNA, 63 nt, hsa
auuccuccaugguaaagcugaacugaaacaauucucaagaaugcaucagcuguaccuacaaua

SEQ ID NO: 339378 - RNA, 63 nt, hsa
aaucugaagauguaagacuuccugaaacaaguucucaagaagucuuuacauuauauuuauaac

SEQ ID NO: 339379 - RNA, 63 nt, hsa
uugaauauuggggaaggaagaugauacuucuuucucaagaaaagaaaauuggauuauuaggaa

SEQ ID NO: 339380 - RNA, 63 nt, hsa
gucauaagcgaucacuuccuauaugcacuuauucucaagaagaacaucuuuaugguaaagaug

SEQ ID NO: 339381 - RNA, 63 nt, hsa
gugaaugcugaacugaaggcucagauugaggagcucaagaacgagaagcagcauuugauauac

SEQ ID NO: 339382 - RNA, 63 nt, hsa
uuguauuucaccaccuaaauguaauguugauuccucaagaaugaaaugaaggcacuacauuga

SEQ ID NO: 339383 - RNA, 63 nt, hsa
ucaagacaaaacagauugcgucgcugacaaguucucaagaagaacuuaugaguaagcagucug

SEQ ID NO: 339384 - RNA, 63 nt, hsa
uccacgugagguuuuguuuagagggauccacuacucaagaaaaaguuagcaaaccacuccuuu

SEQ ID NO: 339385 - RNA, 63 nt, hsa
accaaaagcuugauaugacagagaagaagaaggcucaagaauuuauucaccaguuccucugca

SEQ ID NO: 339386 - RNA, 63 nt, hsa
auccacuggucacagguagacauguggagucaacucaagaaaaagcugagugaacagcaugau

SEQ ID NO: 339387 - RNA, 63 nt, hsa
cuugugaccacaucucccaccacguccccagaucucaagaacgcagcucagcuucuccuucga

SEQ ID NO: 339388 - RNA, 63 nt, hsa
gaagagggccugugggagccugcaaacucacugcucaagaagacauggagacuccugcccugu

SEQ ID NO: 339389 - RNA, 63 nt, hsa
augagauccugucucuuaaagaaaaaaaauaaacucaagaaugauuuuucuaaaaauaugagu

SEQ ID NO: 339390 - RNA, 63 nt, hsa
cuuacugaucacuauaguauugcauaagcacagcucaagaacugagcuuuguauguguccuuu

SEQ ID NO: 339391 - RNA, 63 nt, hsa
gcagugggcuacauacaaugagagcccugagcccucaagaacucaugccagcucagcccuaca

SEQ ID NO: 339392 - RNA, 63 nt, hsa
auugacaauggcagagaacaauuaaaggguugacucaagaacuaguuccaaaccuagcagaau

SEQ ID NO: 339393 - RNA, 63 nt, hsa
gagggcauccgacaaggcccaucuccuucccuccucaagaagcagaggccuccucuggaguga

SEQ ID NO: 339394 - RNA, 63 nt, hsa
uguauggcaguauguauauauuguguuaaguuccucaagaaucuccuuaaaaacuuugaaguu

SEQ ID NO: 339395 - RNA, 63 nt, hsa
gggauuuaaggacuucugggggaccaagacauccucaagaaaacaggggcauccagggcuccc

SEQ ID NO: 339396 - RNA, 63 nt, hsa
aagucccccagcagaaccagccucaaaaacgcccucaagaacaugaugggccugaacucggac

SEQ ID NO: 339397 - RNA, 51 nt, hsa; identical to SEQ ID NO: 339044

SEQ ID NO: 339398 - RNA, 63 nt, hsa
ccugcucacauccacagucagggcacggcgccccucaagaacuccagagucaccugucucauc

SEQ ID NO: 339399 - RNA, 63 nt, hsa
gaaggcccucucuuccucucauaccacguuuugcucaagaagcugggcuguaacaauucaggg

SEQ ID NO: 339400 - RNA, 63 nt, hsa
uauuuuguaucagugcuguuaauuugcuguugccucaagaaaaagugcuuuuucuccauggau

SEQ ID NO: 339401 - RNA, 63 nt, hsa
gaaaaccuuauggaaaauaauuauaguacaauucucaagaaaauucacuaugugaaugagaug

SEQ ID NO: 339402 - RNA, 63 nt, hsa
ugacccugauuugaccccucuucuuauaaggaucucaagaaucucuucagaagcacugaugac

SEQ ID NO: 339403 - RNA, 63 nt, hsa
ucaaggcaaagcaaggaacaucuugagauaugucucaagaauauaaagauguauuauuuuaag

SEQ ID NO: 339404 - RNA, 63 nt, hsa
gcucacaugggaguuguccucacccuuguuaaucucaagaaacucuuauuuauaauagguugc

SEQ ID NO: 339405 - RNA, 63 nt, hsa
aucuguuuggaaacaaccccuugagcugccaggcucaagaaaucauggacucacaggguccug

SEQ ID NO: 339406 - RNA, 63 nt, hsa
aauggccuguguguuacaaugauaugaucauuucucaagaauaagucccuuuuuguauguguu

SEQ ID NO: 339407 - RNA, 63 nt, hsa
gucuucugugucacaaacagcacuccaggccagcucaagaagcaaagcaggccaauagaaaug

SEQ ID NO: 339408 - RNA, 63 nt, hsa
ccuaugugugcuccauuccucauuucuacuuggcucaagaaaacauuucugcagucaggugag

SEQ ID NO: 339409 - RNA, 63 nt, hsa
aaggcagugaaaauggccagccagagaaaagaucucaagaaccagaaauaaauaaggauggug

SEQ ID NO: 339410 - RNA, 63 nt, hsa
uaaagacauacucauuaaguguuauuuauuuuacucaagaacuggaaaccaacuaaaugccuu

SEQ ID NO: 339411 - RNA, 63 nt, hsa
aguauguucccaggcuaguguugaacuccugagcucaagaaauccuccugccugagucucuga

SEQ ID NO: 339412 - RNA, 63 nt, hsa
agguuucugauuacauaaaauuugaauagaacacucaagaaguauguagauuuuugaaaaacc

SEQ ID NO: 339413 - RNA, 63 nt, hsa
gugaauguuccaacaccugccuccacuucuccccucaagaaauuuucaacgccaggaaucaug

SEQ ID NO: 339414 - RNA, 63 nt, hsa
ugaagagacuucugcuuuucaacccccacccuccucaagaaguaauaauuuguuuacuuguaa

SEQ ID NO: 339415 - RNA, 63 nt, hsa
aguuggaugcggccauucaaggggagccaaaaucucaagaaauucccagcagguuaccuggag

SEQ ID NO: 339416 - RNA, 63 nt, hsa
cuccccagacaucuggacacugggcauagauuucucaagaaggaagacuccccugccucccca

SEQ ID NO: 339417 - RNA, 63 nt, hsa
auuugaaaacacugcaacagugaacuuuugcaucucaagaaaacauugaaaaauucuaugaau

SEQ ID NO: 339418 - RNA, 63 nt, hsa
gugucuuucucuaggacaagcucccagugaucacucaagaaucuggcucucauucuaagaggc

SEQ ID NO: 339419 - RNA, 63 nt, hsa
ugcauucaucuuguguuuuauaugagaaggugccucaagaauuuccuguuggauuuguuuaaa

SEQ ID NO: 339420 - RNA, 63 nt, hsa
cugguucucaauuugacacccuaagcgaucauacucaagaauaguacagauguguggaauacg

SEQ ID NO: 339421 - RNA, 63 nt, hsa
gaagugacuuauuaaacuauugaaggaaaaggacucaagaaaaauaauaaaagaccauaaaua

SEQ ID NO: 339422 - RNA, 63 nt, hsa
uuuugaaccuuauuucucaaaacuuauaguagccucaagaagucuauugauauuggucauguu

SEQ ID NO: 339423 - RNA, 58 nt, hsa; identical to SEQ ID NO: 339070

SEQ ID NO: 339424 - RNA, 63 nt, hsa
uuugugcucugaguuuugcuguugaaagucucccucaagaauagcuucagauccucuugugua

SEQ ID NO: 339425 - RNA, 63 nt, hsa
aauaucauuuuaauguaauugauuguauauagucucaagaaugguuggugggcaugaguuccu

SEQ ID NO: 339426 - RNA, 63 nt, hsa
acuuuuguagcaaucuggucuauagacuuuuaacucaagaagcuaaggcuagacuuguuaccu

SEQ ID NO: 339427 - RNA, 63 nt, hsa
aaaugucucuccucuagguaucguauuuuguugcucaagaauccaaaaugggucuguggacau

SEQ ID NO: 339428 - RNA, 63 nt, hsa
cugcuuaguuuuuggacugaaaagauauuaaaacucaagaaggaccaagaaguuuucauaugu

SEQ ID NO: 339429 - RNA, 63 nt, hsa
aggaguaacaauacaaauggauuuugggagugacucaagaagugaagaaugcacaagaaugga

SEQ ID NO: 339430 - RNA, 63 nt, hsa
aagacacagaacaaggucugucuccuauagucacucaagaagucgaucgagaaguuccacauc

SEQ ID NO: 339431 - RNA, 63 nt, hsa
auuaauuagacuuuuguauaagagaugucaugccucaagaaagccauaaaccugguaggaaca

SEQ ID NO: 339432 - RNA, 63 nt, hsa
ucccugaagcagacugcugaggaauuacauuugcucaagaauuuuuuccgucaaauugugaac

SEQ ID NO: 339433 - RNA, 63 nt, hsa
ccuuaauuauuuaucuuuaguuccuuauuaguucucaagaaacaaaugcuagcuucauaugua

SEQ ID NO: 339434 - RNA, 63 nt, hsa
ugggucccuuccuuucuccuuuccucucuacugcucaagaacagauuugaggccaggugcggu

SEQ ID NO: 339435 - RNA, 63 nt, hsa
uauaagcaauguaauuaugcuauucacaggggccucaagaauugguauguaugaugugaucug

SEQ ID NO: 339436 - RNA, 63 nt, hsa
uccuuauguagaaaggacuuugaaauuuuucuucucaagaaaugguuuguauaagaauaacaa

SEQ ID NO: 339437 - RNA, 63 nt, hsa
ugauacugacugauuaauuauuccugauaacaucucaagaaaaggagaaggaaaguguuucug

SEQ ID NO: 339438 - RNA, 63 nt, hsa
uauaaaauugucagcguauuuuuacacuauuggcucaagaauguuauaaugcuaagggacaua

SEQ ID NO: 339439 - RNA, 63 nt, hsa
aagaaaagauuaauaccuuaaaagaagaaaacacucaagaagcagcaguccugaaugguguuu

SEQ ID NO: 339440 - RNA, 63 nt, hsa
ugcacuccagccugggccacagagcaagacugucucaagaaaaaaaauuuuuuaaauaaguuu

SEQ ID NO: 339441 - RNA, 63 nt, hsa
auauuuuauacaaauagauugcuuagaaugguucucaagaauuauaagagaaaugaacucaca

SEQ ID NO: 339442 - RNA, 63 nt, hsa
gauaagcaccuggcaucuaauggcaggcaggcacucaagaaaugaauuaacuacauaauggaa

SEQ ID NO: 339443 - RNA, 63 nt, hsa
guuucugugaauuucaugaagagcagaacauuucucaagaauccucuugagccaguaaucaau

SEQ ID NO: 339444 - RNA, 63 nt, hsa
uggagaauagaaaugaaaagccacgucauauaacucaagaauaaaugguguuuuggaaauuuu

SEQ ID NO: 339445 - RNA, 63 nt, hsa
ucccugcugggcacaccccacaaaccccacucccucaagaagggccagggccagggcuguaug

SEQ ID NO: 339446 - RNA, 63 nt, hsa
gugcaggacaguaaauaaugaaaaccaaauuuccucaagaaauaacugaagaaggagcaagug

SEQ ID NO: 339447 - RNA, 63 nt, hsa
cagauguggucaguagggagcuccaugcccaagcucaagaacgacugcaacacuacuuuaugg

SEQ ID NO: 339448 - RNA, 63 nt, hsa
caauuuaauugcucaaccaugcauuuaaaacuccucaagaaaggauugguacugcaacuguag

SEQ ID NO: 339449 - RNA, 63 nt, hsa
ucuaaauuugaguaaauacaauuuuuuagguuacucaagaaccagcauuaguaauuucuagua

SEQ ID NO: 339450 - RNA, 63 nt, hsa
aagggaacacacaaagaauuacacaacguuuuccucaagaaaaugguacaaaacacaaccgag

SEQ ID NO: 339451 - RNA, 63 nt, hsa
cuauaauggguuugggggauaauaauggugaagcucaagaacagaugucuauugaguagaacc

SEQ ID NO: 339452 - RNA, 63 nt, hsa
aggugaauuguggaaaaugucauguagcugacacucaagaaauagggauuccuaauaauggca

SEQ ID NO: 339453 - RNA, 63 nt, hsa
uggcuuuccugcuauacacauauucacauggcgcucaagaaguuaggcucauggcaacgugug

SEQ ID NO: 339454 - RNA, 63 nt, hsa
cuucaucaaguggaagccaacuguccugccugccucaagaauauguguuuucuuuagcuuccc

SEQ ID NO: 339455 - RNA, 63 nt, hsa
guaaauuugcucuguuuuaagacuuugaacuaccucaagaagaggaaucuaauacaauauuug

SEQ ID NO: 339456 - RNA, 63 nt, hsa
acaaguuuucacugaaugagcauggcagugccacucaagaaaaugaaucuccaaaguaucuuc

SEQ ID NO: 339457 - RNA, 63 nt, hsa
agugcuuagaaguaagcaauucccaggucauagcucaagaauuguuagcaaaugacagauuuc

SEQ ID NO: 339458 - RNA, 63 nt, hsa
uagugccaggucacuauuguaagauguuaaaaucucaagaaaauuucacagagcuaaagaaau

SEQ ID NO: 339459 - RNA, 63 nt, hsa
gauaagaaaggacuacagcauuugauguguguccucaagaacuugucuugggucugaaaaagc

SEQ ID NO: 339460 - RNA, 63 nt, hsa
ccuauggccuucuugucaaaaccuucacuggagcucaagaaaagcauuucuguuguguuauuu

SEQ ID NO: 339461 - RNA, 63 nt, hsa
ugcuuaugggaauccugagcugcuuuucaccaucucaagaagccuaagaaguuauauauuuaa

SEQ ID NO: 339462 - RNA, 63 nt, hsa
uguagauaaaaguguuccaguaaucagaaaauccucaagaaaauugacuucauuauuuggaag

SEQ ID NO: 339463 - RNA, 63 nt, hsa
gcccauuaccuuuccucugccugaaagacgugucucaagaaaaauaaauucuauuuuagaugc

SEQ ID NO: 339464 - RNA, 63 nt, hsa
aguauaucaucauaaaauagacaauguuuuugucucaagaacaagaauaaaauugaaaucugc

SEQ ID NO: 339465 - RNA, 63 nt, hsa
aauaaaaagguaaaacuacauuuagacuucuuucucaagaaaucaaauacagcuuuuuuucaa

SEQ ID NO: 339466 - RNA, 63 nt, hsa
aacgaacaagauuaauuaccugucuuccuguuucucaagaauauuuacguaguuuuucauagg

SEQ ID NO: 339467 - RNA, 63 nt, hsa
ucuuuagacuacaauaauacuuuuauccaugugcucaagaaagggccccuuuuuccaacuuau

SEQ ID NO: 339468 - RNA, 63 nt, hsa
gauauguauuugcuacucaaguguacagaucuccucaagaaacaucaagggacuccuguguca

SEQ ID NO: 339469 - RNA, 63 nt, hsa
aaauaaccgauuauugauuacuguauuuuuuuucucaagaacagugauagguagaaacuaauu

SEQ ID NO: 339470 - RNA, 63 nt, hsa
aagucaucauugcuguuuagcuugacuguuuuccucaagaacaucgaucugaaggauucauaa

SEQ ID NO: 339471 - RNA, 63 nt, hsa
gaugcucuguagagaauuugcuaccgaaguuggcucaagaauuuguuuuuaguguuauuuacc

SEQ ID NO: 339472 - RNA, 63 nt, hsa
uggcaaaggccuuccugcauuuaugaauucucucucaagaagcaagagaacaccugcaggaag

SEQ ID NO: 339473 - RNA, 63 nt, hsa
ugagaauuaagaauggacaggaccaagacagaacucaagaaagccacuggggaaaacucgaga

SEQ ID NO: 339474 - RNA, 63 nt, hsa
auauguucaacauuuacuucuauuugauaucugcucaagaagucauagaagucuugggaaacu

SEQ ID NO: 339475 - RNA, 63 nt, hsa
guaacauugucagaaauaaauaaaaccacaagucucaagaauuugccacguauguucaagggu

SEQ ID NO: 339476 - RNA, 63 nt, hsa
uucuucagguaacacuacagaguacgugaaaugcucaagaauguagucagacugacacuacua

SEQ ID NO: 339477 - RNA, 63 nt, hsa
aacaaaacacaguccugcauacucaccaccaagcucaagaaauaaaucaucaccaauaccuuu

SEQ ID NO: 339478 - RNA, 63 nt, hsa
gccaacucauuggguuguagccaaagguucacucucaagaagcuuuaauauuuaaauaaaauc

SEQ ID NO: 339479 - RNA, 63 nt, hsa
auaucaccuagaaaaguagccucacucuuauuccucaagaauuaauauccaauguuuaugagu

SEQ ID NO: 339480 - RNA, 63 nt, hsa
caucagcauuguauacacauauuuucacuuuaacucaagaauuccaggagguaauuuguugau

SEQ ID NO: 339481 - RNA, 63 nt, hsa
ucacaaauggcaauguaaaaaucaagacauuuucucaagaacuguguaccacuaaaaguaaua

SEQ ID NO: 339482 - RNA, 63 nt, hsa
aagaagcaugcagagaagaauugguuuguuggccucaagaagaaugggagcugcaaacgcggu

SEQ ID NO: 339483 - RNA, 63 nt, hsa
gaaccaugccccuuccccaggcccccagcaagucucaagaacacagcugcacaggccuugacu

SEQ ID NO: 339484 - RNA, 63 nt, hsa
agaaauacaguuuguuuguauaaaauaaacuaucucaagaaaguuuucaacgacagugauagu

SEQ ID NO: 339485 - RNA, 63 nt, hsa
cuuugagaaauccuuuugugaagucauugccugcucaagaauguacaguggcuccccaaugcc

SEQ ID NO: 339486 - RNA, 63 nt, hsa
acagaguguguucgcacuuagccaugggcugggcucaagaaccugauaccuggguugaugugg

SEQ ID NO: 339487 - RNA, 63 nt, hsa
aaaacugccuaacugaagggaaugggggcccugcucaagaagggggccaggcagcuggaauca

SEQ ID NO: 339488 - RNA, 63 nt, hsa
gggguaugagcugccaagucuauuuuaaagacgcucaagaauccucugggguucaucuaggga

SEQ ID NO: 339489 - RNA, 63 nt, hsa
cauucagccaacccagaggauguagacccuguccucaagaagugcagggcgaguucugccgug

SEQ ID NO: 339490 - RNA, 63 nt, hsa
cuguggaacgagacuucugcagagguggcugaccucaagaagcagguacaggcccuucagccc

SEQ ID NO: 339491 - RNA, 63 nt, hsa
gacuagauuauauuuaguaggggaaaaauugggcucaagaaccauucaucaguacgugagaca

SEQ ID NO: 339492 - RNA, 63 nt, hsa
gacuuguaagcaguucauagaagcugcucaauacucaagaaucuugcaagacaguuauuaaac

SEQ ID NO: 339493 - RNA, 63 nt, hsa
ucuuguuuugaucauuuccacugcacauuucuccucaagaaaagcgaaaggacagacuguugg

SEQ ID NO: 339494 - RNA, 63 nt, hsa
cagcaauuugaacacuaaccucuccccuccuggcucaagaauuacuccgaagucagucugcag

SEQ ID NO: 339495 - RNA, 63 nt, hsa
ucugagcaaauaacuacagggugcccauuaccacucaagaagacacuucacguauucuuguau

SEQ ID NO: 339496 - RNA, 63 nt, hsa
ccgguagccuucaagcuuguccagcagaaccagcucaagaaaggagaugcccuagugguggcc

SEQ ID NO: 339497 - RNA, 63 nt, hsa
uuuuacuccgugccuuacuggauuuggccuguccucaagaaugguaauuaugaagaguggaga

SEQ ID NO: 339498 - RNA, 63 nt, hsa
acagcguccauuuuuucauauuagagguggaaccucaagaaugacuuuauucuuguaucucau

SEQ ID NO: 339499 - RNA, 63 nt, hsa
cauugucuugcccuauagacucaggaguugcuucucaagaaagagccagcaaguauucucagc

SEQ ID NO: 339500 - RNA, 63 nt, hsa
uuuaaacauuaaguuugaaauaggaaugguuuucucaagaauagauuuggugugauaccuugu

SEQ ID NO: 339501 - RNA, 63 nt, hsa
gagugaugagcagacauguuuaagggucuaagucucaagaaucuguuauguguguuugcugcg

SEQ ID NO: 339502 - RNA, 63 nt, hsa
uauuuaaucuauuuaaucuucuugcauuuauuucucaagaauuacuggcuuuaaaagaagcca

SEQ ID NO: 339503 - RNA, 63 nt, hsa
gcccucaauauuugguaaugcuauuuaaagugacucaagaagcaugugcuaucuggcuuugaa

SEQ ID NO: 339504 - RNA, 63 nt, hsa
aagaaauauuguugcucaguguuguuaauauagcucaagaauugaguuuauauuugcaguaug

SEQ ID NO: 339505 - RNA, 63 nt, hsa
gacgagaagacucagccugagggccugcggagccucaagaagccagaccgcaagaagcgcuac

SEQ ID NO: 339506 - RNA, 63 nt, hsa
guggaacuuccucuuucauuggaaacuuucuuacucaagaaugacggcaguauuguuuucuua

SEQ ID NO: 339507 - RNA, 63 nt, hsa
acugucuucaucaaguauuucccuacagaacuccucaagaaaacagagaucauuuggcuagag

SEQ ID NO: 339508 - RNA, 63 nt, hsa
gacucugggccccuccccagcuccacucccuaccucaagaaugugaccauuuggaaaaggcaa

SEQ ID NO: 339509 - RNA, 63 nt, hsa
ccauguugccaaggcugguuucaaacuccuggacucaagaaauccacccaccucagccuccca

SEQ ID NO: 339510 - RNA, 63 nt, hsa
gugacaguuccaggucuugaagcuaaucagcaucucaagaaaguauccagaaagaacaucugc

SEQ ID NO: 339511 - RNA, 63 nt, hsa
uccuaagcucucaaaauagcauauucccuagagcucaagaaagcugguccaggagguugaaaa

SEQ ID NO: 339512 - RNA, 63 nt, hsa
guugugcuccagccugggcgacagaagucuugucucaagaagaaaacgaacugggaaaauuuc

SEQ ID NO: 339513 - RNA, 63 nt, hsa
cccaugcccguucugaccucagccuuggaacuccucaagaaccugaagauuccaguggucagu

SEQ ID NO: 339514 - RNA, 63 nt, hsa
agauugggaaacuuaaccguuacccaggcaauacucaagaaggagaauccauuuagcaccucc

SEQ ID NO: 339515 - RNA, 63 nt, hsa
uuuugcuguuguaaaaguguuuucauaaguucacucaagaaaaaugcagcuguucugaacugg

SEQ ID NO: 339516 - RNA, 63 nt, hsa
augucuguuuaaaaauuacuaauucucaaauggcucaagaacauuagaauuuaaguaccuuuu

SEQ ID NO: 339517 - RNA, 63 nt, hsa
guuagugucuucuuccugcccucagcaccacagcucaagaaaaccuaaaguuucaauacaagc

SEQ ID NO: 339518 - RNA, 63 nt, hsa
uacacccacgcacccccccacacacuaugcucucucaagaauguaauuuauuggggccccccc

SEQ ID NO: 339519 - RNA, 63 nt, hsa
uagaguccugccguggcucagguggaucuaaaacucaagaacaaauucuauuuauuuauuauu

SEQ ID NO: 339520 - RNA, 63 nt, hsa
uauacuaucuaucucaccaguauuugcucucgacucaagaagguuaacauuuucugauucaug

SEQ ID NO: 339521 - RNA, 63 nt, hsa
ugacagcugucuguuguuuuaugaaguuuauuucucaagaaaaugggaauaaauuugggauuu

SEQ ID NO: 339522 - RNA, 63 nt, hsa
cacucuagcuugggcaauagagcaaggcuccgucucaagaaaagaaggucauuucccaagacu

SEQ ID NO: 339523 - RNA, 63 nt, hsa
guggaagcauguguguuucuaaaaaguaaaaaucucaagaaaacagaaauggcaugcuuuacc

SEQ ID NO: 339524 - RNA, 63 nt, hsa
auaaugcagagauaauuagacaugguucccgcccucaagaagcucacaaaaguauucaggaaa

SEQ ID NO: 339525 - RNA, 63 nt, hsa
aguucuuuuggaacuuguuucaagccaaaaacucucaagaaagcaaauugcaccucagcugga

SEQ ID NO: 339526 - RNA, 57 nt, hsa; identical to SEQ ID NO: 339173

SEQ ID NO: 339527 - RNA, 63 nt, hsa
ccuaaauuaucccauuauguaauucuuggucagcucaagaacuggguucuuuuucuaauaauu

SEQ ID NO: 339528 - RNA, 63 nt, hsa
agcuggaacaguaggggcagggagaagacaggucucaagaaaagguuuuuaagaaguuucauc

SEQ ID NO: 339529 - RNA, 63 nt, hsa
uuccucuacucucccgugcacugccggccagagcucaagaagcugcugcacgggcugggccuu

SEQ ID NO: 339530 - RNA, 63 nt, hsa
uuuuacucugaucaaauaaauaaugcuggaauacucaagaauugcauccucugaccuacuuca

SEQ ID NO: 339531 - RNA, 63 nt, hsa
gggaggaagcacugaaacaacacaaaacccuaucucaagaacuuguuaaccuccggggagagc

SEQ ID NO: 339532 - RNA, 63 nt, hsa
aaccacagggccugagaagucuugcuuuaugggcucaagaaugccaugcgcuggcaguacaug

SEQ ID NO: 339533 - RNA, 63 nt, hsa
cccugauauuauuucuauuuaauacucuuuucucucaagaaaaaaaaaaaaguuuguuuuuuc

SEQ ID NO: 339534 - RNA, 63 nt, hsa
uggugggagggaauguuuucaaauuucccauuucucaagaaauguucauauuaauugaggauu

SEQ ID NO: 339535 - RNA, 63 nt, hsa
auuuugaugauucugagaagaaacuuguccuuccucaagaacacagcccugcuucugacauaa

SEQ ID NO: 339536 - RNA, 63 nt, hsa
aaauaaccaaaaaaugugagcuauaauguuucccucaagaacaaacagaaacgagauuugcca

SEQ ID NO: 339537 - RNA, 63 nt, hsa
ucagccccaguuggcuuccuggucaacaaggaccucaagaacugccuguggaccgaggccccc

SEQ ID NO: 339538 - RNA, 63 nt, hsa
ugcagagguaacucucaggcagcuaagcagcaccucaagaaaacauguuaaauuaaugcuucu

SEQ ID NO: 339539 - RNA, 63 nt, hsa
ugagaguagcugcugcuuucccugacuuccuuccucaagaauacagucuauucugggggguug

SEQ ID NO: 339540 - RNA, 63 nt, hsa
gauuuuccucugacaccagagaacaauaguagucucaagaauggaaaccugaaugucugaggg

SEQ ID NO: 339541 - RNA, 63 nt, hsa
aaaacuucaguuacugaccagucaagagaauuucucaagaaaaaucccagcaacguucccucu

SEQ ID NO: 339542 - RNA, 63 nt, hsa
caagcacaaagugaugaaugacugccuucaagucucaagaaaacacuuuucccuaacuuuuag

SEQ ID NO: 339543 - RNA, 63 nt, hsa
uuugggugagcugcaccugauuaguugaaaggccucaagaacaaacacugcaguuuccuggaa

SEQ ID NO: 339544 - RNA, 63 nt, hsa
aacuguggaguugguagcugguaacauuguugucucaagaacaacucaccucucucccuagga

SEQ ID NO: 339545 - RNA, 63 nt, hsa
caacuaaaccuucuuaauauccgccacagaaggcucaagaauccagcccuaaaauucucucca

SEQ ID NO: 339546 - RNA, 63 nt, hsa
acuaccucauaugcaggaugagccaauggcagucucaagaaauguacucgggcgacaccuuac

SEQ ID NO: 339547 - RNA, 63 nt, hsa
uuuucugacauuccuagacagguucauucuuugcucaagaaaggccugaaugacaauguccag

SEQ ID NO: 339548 - RNA, 63 nt, hsa
auacaacaagaucaacuagaagaauucaacugucucaagaaucaagguaccccaauauaucuc

SEQ ID NO: 339549 - RNA, 63 nt, hsa
uugaagggagaaaggcaagaugugcacucuggacucaagaaacucuuaguucaguggaggaaa

SEQ ID NO: 339550 - RNA, 63 nt, hsa
ucacugugagcucccaggugcagccagaggcaccucaagaagaagaggggcauaaacuuuccu

SEQ ID NO: 339551 - RNA, 63 nt, hsa
uucagaugaguuagaagcuuuuuaucccuuccucucaagaaaauauucuuucacccugucucu

SEQ ID NO: 339552 - RNA, 63 nt, hsa
agugacauaauuuacaugcaauauguuuaucaacucaagaauuuaauauaguugguacacaac

SEQ ID NO: 339553 - RNA, 63 nt, hsa
ggauacauuaggagcuucaaacacauauaauuucucaagaaauuuccagaugucucaugcugc

SEQ ID NO: 339554 - RNA, 63 nt, hsa
auuaaggaagaacaaggaagggaaugaucuuuacucaagaauuucagaaagucagcacugaag

SEQ ID NO: 339555 - RNA, 57 nt, hsa; identical to SEQ ID NO: 339202

SEQ ID NO: 339556 - RNA, 63 nt, hsa
gaaggcugcuaauuggauuuugguaguucuuaccucaagaaaacuugaauuauuugggggaaa

SEQ ID NO: 339557 - RNA, 63 nt, hsa
aagcuuaugaaggaaugccuccuuuguuacacacucaagaauuugucagcacacaauuaauug

SEQ ID NO: 339558 - RNA, 63 nt, hsa
auaauucagaaauuggguuuugguucagugauucucaagaaaaagaucucuugcccauuaaga

SEQ ID NO: 339559 - RNA, 63 nt, hsa
acaaaauccaaggugcuacaggaaacaagcacacucaagaaaguuuuuuucugaauaacauuu

SEQ ID NO: 339560 - RNA, 63 nt, hsa
aaagaaaacugaacugaggaaaaugguguuuuccucaagaagacuacuggaacuggaugaccu

SEQ ID NO: 339561 - RNA, 63 nt, hsa
uuuuccaucuccaaauagccaggcccucucucccucaagaaaugcccagauguagaaauucau

SEQ ID NO: 339562 - RNA, 63 nt, hsa
aaaguucauuucaucacuuagaaaauaugucuucucaagaacaaaacugugcuguuacaacuc

SEQ ID NO: 339563 - RNA, 63 nt, hsa
uggcucucucucugcugccucuucauacguuuucucaagaacuucaguuuauaauuggaagag

SEQ ID NO: 339564 - RNA, 63 nt, hsa
uccucuauccgaggccauuggagaccccaguuucucaagaauucagcucugcucugagcgucc

SEQ ID NO: 339565 - RNA, 63 nt, hsa
gguugaguccagaugcuucucaccuucuuucuccucaagaaagaugcuuuuugggaaacguug

SEQ ID NO: 339566 - RNA, 63 nt, hsa
uccacagacagaugaggcaggagugauggggcacucaagaaaguucagaggaggcauaagcua

SEQ ID NO: 339567 - RNA, 63 nt, hsa
uggaucuuggcaugcacccaccuaacccacuuucucaagaacaagaaccuagaaugaauaucc

SEQ ID NO: 339568 - RNA, 63 nt, hsa
cucccagaagaccaaacugccuuccccucagggcucaagaauguguacagucuguggggccgg

SEQ ID NO: 339569 - RNA, 63 nt, hsa
ucuccuuuuguguuuuucccacuuuccaauguacucaagaaaauugaacaaauguaauggauc

SEQ ID NO: 339570 - RNA, 63 nt, hsa
cugacuaaggagcugcagcgauacaucgaagggcucaagaagcgccggagcaagaggcuguac

SEQ ID NO: 339571 - RNA, 63 nt, hsa
ccccagagggcuuuguggaggacaggccuugcccucaagaacgucguaccugacgcugagccu

SEQ ID NO: 339572 - RNA, 63 nt, hsa
ugagcuuuuuggaaggauaauucugauaaggcacucaagaaacguacaaccacagugcuuucu

SEQ ID NO: 339573 - RNA, 63 nt, hsa
agacccgccaccguggaggcagggggcaagaaacucaagaacgcaucaagagcaccagcccug

SEQ ID NO: 339574 - RNA, 54 nt, hsa; identical to SEQ ID NO: 339221

SEQ ID NO: 339575 - RNA, 63 nt, hsa
accucacgcaccucccauccuaaucauccaaugcucaagaaacaacuucuacuucugcccuug

SEQ ID NO: 339576 - RNA, 63 nt, hsa
acuuuucagagucaucuacaaaauuuuucuuuccucaagaaaagaguuccuuuugccuuauuc

SEQ ID NO: 339577 - RNA, 63 nt, hsa
cugacuuaggaucaugcuggaaggaagccaagucucaagaacugucagcaacagaaaaugaga

SEQ ID NO: 339578 - RNA, 63 nt, hsa
gccccuggaucuuugggguaaaaggaggguggccucaagaaacaaugucuggggacaggccuu

SEQ ID NO: 339579 - RNA, 63 nt, hsa
ucaugccuaacaguggucuguuuuuauaugagacucaagaacaggccucauuccagggcacag

SEQ ID NO: 339580 - RNA, 63 nt, hsa
gaggaggagggauucuggucuucacugccaugccucaagaacaccuuuguuuugcacugacaa

SEQ ID NO: 339581 - RNA, 63 nt, hsa
ugggaaugcugggaaaugagauacauucccgcccucaagaaucucccagucugguaggagaga

SEQ ID NO: 339582 - RNA, 63 nt, hsa
aggagacaugagucuuugccggaggaaaagcagcucaagaacacaugugcagucacugguguc

SEQ ID NO: 339583 - RNA, 63 nt, hsa
uauuccuauugaucucauuuuauuuagcaucagcucaagaaacuaagucuuagugcacaguau

SEQ ID NO: 339584 - RNA, 63 nt, hsa
cauaaugagauaaugcauguaggggaaaaguuucucaagaagguggaagaggcagcaggacuu

SEQ ID NO: 339585 - RNA, 63 nt, hsa
auuuauggcaugauuagauugcaaagcaaugaacucaagaaggaauugaaauaaggagggaca

SEQ ID NO: 339586 - RNA, 63 nt, hsa
uaguuuggauaucuuuaggguuuagaaucuaaccucaagaauaagaaauacaaguacaaauug

SEQ ID NO: 339587 - RNA, 63 nt, hsa
cccaucuuuuuucuucccucauuuucugggauucucaagaaagaaaaaguaacccauuaucac

SEQ ID NO: 339588 - RNA, 63 nt, hsa
ccuuuuggacuaauguuacuguccaaguucuuucucaagaaaccacaucugguucagaagagu

SEQ ID NO: 339589 - RNA, 63 nt, hsa
uuuuaaauuuuuuuauaggcccauaugcucuaucucaagaaacaagaugauuguaacaugucc

SEQ ID NO: 339590 - RNA, 63 nt, hsa
aacuuuccuuuauuucacuuguacccaguuucacucaagaaaucuugaugaauauuuauguug

SEQ ID NO: 339591 - RNA, 63 nt, hsa
gacccucucuauagccaugagacuccuuguggccucaagaaauuuagacgcccacgacagcac

SEQ ID NO: 339592 - RNA, 63 nt, hsa
agccgcacccgugugcacuguaacuuuugugugcucaagaaauuauacagaaaccuacagcug

SEQ ID NO: 339593 - RNA, 63 nt, hsa
cacuccuggagaaagacuuccuugcaggagugacucaagaauuaaucaguaaauaccuugaaa

SEQ ID NO: 339594 - RNA, 51 nt, hsa; identical to SEQ ID NO: 339241

SEQ ID NO: 339595 - RNA, 63 nt, hsa
uuuccuucauaaagaaugccacccaucugauuccucaagaaucuagaccuagaaauaccauuu

SEQ ID NO: 339596 - RNA, 63 nt, hsa
uaggaaaaaaaaauccaagaaauguauugaauacucaagaaaaugccacauuucaauuacaua

SEQ ID NO: 339597 - RNA, 63 nt, hsa
ucucauaugaucuucuucaagccauuauuuuaacucaagaaaacucuagagaagaaaagugaa

SEQ ID NO: 339598 - RNA, 63 nt, hsa
cacuccacugcagcaggagggacuuaagcuagacucaagaaagcagcuuggagccucuagguu

SEQ ID NO: 339599 - RNA, 63 nt, hsa
uaaaaauaguaagccucccuccucguccccugccucaagaaauugccuccuuauuuaucaaca

SEQ ID NO: 339600 - RNA, 63 nt, hsa
caugguaugagcacaggucauggacagccccugcucaagaaaaagcaugagcuggccacacau

SEQ ID NO: 339601 - RNA, 63 nt, hsa
uuuugaaaaauagucaccaacuguauauacuuccucaagaacugauaauucauuauaucauca

SEQ ID NO: 339602 - RNA, 63 nt, hsa
cucugccauucaacucggaaacuauaaguaauucucaagaaagcccucauuuuuauaaccugg

SEQ ID NO: 339603 - RNA, 63 nt, hsa
cuuuuuacuguuugccaaaacacuugaaugugccucaagaaaagguaccuacuacaugcugua

SEQ ID NO: 339604 - RNA, 63 nt, hsa
uucuauacuggauccuuucuuucucuaauaauccucaagaaauccuuacagguaaguauugcu

SEQ ID NO: 339605 - RNA, 63 nt, hsa
uacuggagagaugggauccuucuagauacagggcucaagaagucugcugggaguccccugagu

SEQ ID NO: 339606 - RNA, 63 nt, hsa
ucaggguccucagugcagagcaacuuacgcauccucaagaauccacugcuuuucaggcaagga

SEQ ID NO: 339607 - RNA, 63 nt, hsa
ccacgugggcaauaccagggacccauggggaaacucaagaaugacagcuucuauauuuuguaa

SEQ ID NO: 339608 - RNA, 63 nt, hsa
cacuaagaaggccugucuacacugcaggggaaccucaagaacuuuucauugcacuucuaaaau

SEQ ID NO: 339609 - RNA, 63 nt, hsa
aaaaggaagagccuuuuaaaaacauuugccaaccucaagaauaaauacugaaagucuugaaag

SEQ ID NO: 339610 - RNA, 63 nt, hsa
uaggauucugacuaagaggcaaaagagaaaagacucaagaaacugauccuggagaucgagacc

SEQ ID NO: 339611 - RNA, 63 nt, hsa
ggagccaggaguaagacaagugggauuuggggccucaagaaauauacucucccagauuuuuac

SEQ ID NO: 339612 - RNA, 63 nt, hsa
uuuguuuuaacaaaauuagcugaagaaguuauucucaagaaaauuggauguuuucauuggccu

SEQ ID NO: 339613 - RNA, 63 nt, hsa
uuauaugacaucauccugaagaacuucgagaagcucaagaagcccaggggagaaacaaaggga

SEQ ID NO: 339614 - RNA, 63 nt, hsa
aagauuacauacauuugagaauaagaaauuacucucaagaacuucagaaaucugcaacauaau

SEQ ID NO: 339615 - RNA, 63 nt, hsa
auauuucccauaaaugggaaguuugcccauugucucaagaaauguguauuucagugacaauuu

SEQ ID NO: 339616 - RNA, 63 nt, hsa
aacauuuugggaaguaacugccucugacuucaacucaagaaaacacuuuuuuguugcuaaugu

SEQ ID NO: 339617 - RNA, 63 nt, hsa
aagaagacugacuggguggaggcucugccuugccucaagaaccauccccugcagagcauccag

SEQ ID NO: 339618 - RNA, 63 nt, hsa
uaggccuugcaucucgccaccuccacuucuguccucaagaacaaguccuaggucaagggaaac

SEQ ID NO: 339619 - RNA, 63 nt, hsa
aaggaagugaaaauagccagccagaggaaaugucucaagaaccagaaauaaauaaggguggug

SEQ ID NO: 339620 - RNA, 63 nt, hsa
aauuagugcuggauuugaagcuacgcacucagccucaagaacucccuggaauaucccugagaa

SEQ ID NO: 339621 - RNA, 63 nt, hsa
auggcccugggaaucaauuccucaggaauugcccucaagaacucugcuucuugcuuugcagag

SEQ ID NO: 339622 - RNA, 63 nt, hsa
aaucuuagaguucauaaauuuacuugagguugccucaagaacucagggaacaauacuguaaac

SEQ ID NO: 339623 - RNA, 63 nt, hsa
augaagaauggaaauggaaaaggguggcugcgacucaagaauaauaugggagcccaugaggag

SEQ ID NO: 339624 - RNA, 63 nt, hsa
aaggagauaaacaugaccaucgucaaagaccugcucaagaaauuuuuaaaaaagaaacaaagu

SEQ ID NO: 339625 - RNA, 63 nt, hsa
auuucuuauuugcuagggaacugguaaucuaggcucaagaaguguguggagaagguuuauuuu

SEQ ID NO: 339626 - RNA, 63 nt, hsa
caucaguguggacuccuagaacgugcgaccugccucaagaaaaugcaguuuucaaaaacagac

SEQ ID NO: 339627 - RNA, 63 nt, hsa
ccuccucaggacauggagaucugugcagaugagcucaagaagguccuuaacacagucgugaac

SEQ ID NO: 339628 - RNA, 63 nt, hsa
guacaccuguagauauuacuguacuuuuauguucucaagaaauaaguuguugccuauucagug

SEQ ID NO: 339629 - RNA, 63 nt, hsa
acugauucauacauuaucucacuugugccaacacucaagaagcaggcuacacugacacuggua

SEQ ID NO: 339630 - RNA, 56 nt, hsa; identical to SEQ ID NO: 339277

SEQ ID NO: 339631 - RNA, 63 nt, hsa
gcuccacuucauccagaugaaggaaaggaagaccucaagaaaaauucacaguugagugcaucc

SEQ ID NO: 339632 - RNA, 63 nt, hsa
aaggagauaaacaccaccaucaucaaagagcugcucaagaaauuuuuaaaaacgaaacaaagu

SEQ ID NO: 339633 - RNA, 63 nt, hsa
ggaacuuuauaaugaaacgguucggaauacuggcucaagaaccuaugucaagaugagcugaau

SEQ ID NO: 339634 - RNA, 63 nt, hsa
augugagcugcuaaauugacuggccuugcagagcucaagaagggggcuuccaaugcugugaga

SEQ ID NO: 339635 - RNA, 63 nt, hsa
ccccucucucacacaucacauucccaugguggccucaagaaaggcccggaagcgccaggcugg

SEQ ID NO: 339636 - RNA, 63 nt, hsa
uguucuuagugauucacauccacgggacaaaaacucaagaagaaauaagagcugacgccacac

SEQ ID NO: 339637 - RNA, 63 nt, hsa
gagggagugugcgaaucuacccugaccaaugggcucaagaauaaaguaugauuuuugagucag

SEQ ID NO: 339638 - RNA, 63 nt, hsa
uugagggcuaaaucccaagugucucuugacuggcucaagaauuagggccccaacuacacaccc

SEQ ID NO: 339639 - RNA, 63 nt, hsa
ccuacuuguggcgaucugaguacucuacucuugcucaagaaguaauacgacaaucagaauaca

SEQ ID NO: 339640 - RNA, 63 nt, hsa
gagggagugugcgaaucaaaccugaccaagcggcucaagaauaaaauaugaauugagggcccg

SEQ ID NO: 339641 - RNA, 63 nt, hsa
acaaauuuggccuuaagaacugugucuggcguucucaagaaucuagaagauguguaaacaggu

SEQ ID NO: 339642 - RNA, 63 nt, hsa
augaaugcccgcagugagcuauacuuacgcuuccucaagaagaggauuagcucugauuuugag

SEQ ID NO: 339643 - RNA, 63 nt, hsa
cuacaaaauuaugucugcaccagugaauccauucucaagaaaagucuuaacuaggaaacuaaa

SEQ ID NO: 339644 - RNA, 63 nt, hsa
gaacacaggcaaauuauuuguggggguaggaaucucaagaauugcgaaagucaaauauggaga

SEQ ID NO: 339645 - RNA, 63 nt, hsa
cucaccaagcucauuacaucugccagggccugccucaagaagcccagcccagccuuuuccugg

SEQ ID NO: 339646 - RNA, 63 nt, hsa
gugguauauuuauguaagaaaaugacuguaaaucucaagaaaaaucucagcagcuaauagcaa

SEQ ID NO: 339647 - RNA, 63 nt, hsa
guaaccauuuguuaacuguacugaagguguguccucaagaagaaaguguucaaauuaaaaaag

SEQ ID NO: 339648 - RNA, 63 nt, hsa
cucuaccaaaaguuaaaaaaaaaaaaaaaaaagcucaagaaccugcacgagggccuaaaacag

SEQ ID NO: 339649 - RNA, 63 nt, hsa
uucucuguuuaguaguugguuggggaaguggggcucaagaaggauuuugggguucaccagaug

SEQ ID NO: 339650 - RNA, 63 nt, hsa
aaaaggggcuggaaaggggggaauggcccacaucucaagaagcaagauauuguuugugguggu

SEQ ID NO: 339651 - RNA, 63 nt, hsa
aacagcauggauuccguggauagcuguugcagucucaagaagacugagagcuuccaaaaugcc

SEQ ID NO: 339652 - RNA, 63 nt, hsa
caccaacauuuugcugccuaccuuguuauccuucucaagaagcugaaguguacgcccucuccc

SEQ ID NO: 339653 - RNA, 63 nt, hsa
uauauaccaccuaggaggagaugccaccaagcccucaagaaguugugcccuuccccgccugcg

SEQ ID NO: 339654 - RNA, 63 nt, hsa
ccacgugucccagcccagcguccaguggugccucucaagaaaccccgaacgaauguucggaug

SEQ ID NO: 339655 - RNA, 63 nt, hsa
uacaucauuauuaauauaaaaauaacaggcagccucaagaaugugcugagauuucucuggaaa

SEQ ID NO: 339656 - RNA, 63 nt, hsa
ccugaagcuggauucuuucauacgauacucuuucucaagaagggggcucccugggaucuccag

SEQ ID NO: 339657 - RNA, 63 nt, hsa
aggccugcaggguguggggaaggaggacacaaccucaagaaaggaagcgugaaccccagggaa

SEQ ID NO: 339658 - RNA, 63 nt, hsa
uuugacacaaacucacacaaccaugacgcacugcucaagaacuacgggcugcucuacugcuuc

SEQ ID NO: 339659 - RNA, 63 nt, hsa
uuugacacaaaaucgcacaacgaugacgcacugcucaagaacuacgggcugcucuacugcuuc

SEQ ID NO: 339660 - RNA, 63 nt, hsa
uuugacacaaacucgcacaaccaugacgcacugcucaagaacuacgggcugcucuacugcuuc

SEQ ID NO: 339661 - RNA, 57 nt, hsa; identical to SEQ ID NO: 339308

SEQ ID NO: 339662 - RNA, 63 nt, hsa
ugugagugcuuuggaauuuaaaugauuguauaacucaagaagauuacuuuucuauguugcuca

SEQ ID NO: 339663 - RNA, 63 nt, hsa
ccagacgaugcauuucuuggccaaaguggcuuccucaagaaagcagcacuuaccuuugaaaaa

SEQ ID NO: 339664 - RNA, 63 nt, hsa
aaauggcuucacaguccuuacuucucuaccugccucaagaaggggcucagagcagagacuugu

SEQ ID NO: 339665 - RNA, 63 nt, hsa
caaacauucuuccuaaaaggaagacuucauuuucucaagaaaugggauuaguuggggguauua

SEQ ID NO: 339666 - RNA, 63 nt, hsa
uaacuuuaaaaauaauacuuuuagcucuaauagcucaagaacacaauauucguuaauguucag

SEQ ID NO: 339667 - RNA, 63 nt, hsa
agggcacugaagaccugaaucuacacuaguaaucucaagaaagauuauucauucuaucucaga

SEQ ID NO: 339668 - RNA, 63 nt, hsa
augacgagcucuagcuggaugggcgcagagaaccucaagaaggcaugaagccagccccugcag

SEQ ID NO: 339669 - RNA, 63 nt, hsa
cgcuccagccuggucgacagagugagacuccaucucaagaaaaaauaaaaauaaaguuguucu

SEQ ID NO: 339670 - RNA, 63 nt, hsa
cuuugggaggcugaggcaggaggaucacucgagcucaagaauucaagaccugggcaagagaga

SEQ ID NO: 339671 - RNA, 63 nt, hsa
cacuccagccugggcgacagagcaagacucugucucaagaagaaaaaaaaaauacauauacac

SEQ ID NO: 339672 - RNA, 63 nt, hsa
uuuauaugcaugaaguuaaaacaacugacguuacucaagaauuagaaaacuuugcaagauuug

SEQ ID NO: 339673 - RNA, 63 nt, hsa
cacuucagccugggcgacacagcgagacccugucucaagaaagaaaagaaaaagagacaaauu

SEQ ID NO: 339674 - RNA, 63 nt, hsa
uucuccagcgcugggcccucccuugcccccaagcucaagaagggggcacugcccggcccggcu

SEQ ID NO: 339675 - RNA, 63 nt, hsa
gaccuacgccacuggaaacacacccaccgcaaccucaagaaccagacugugcagagggcauug

SEQ ID NO: 339676 - RNA, 63 nt, hsa
cauuccagccugugcgacagaaugagacacugucucaagaaaaaauaaaagugggaaaaucuu

SEQ ID NO: 339677 - RNA, 63 nt, hsa
caggaccccccaagucuuccuacccucugcacccucaagaaacccccagugccuuguaugaag

SEQ ID NO: 339678 - RNA, 63 nt, hsa
uuccuucauuaacaaagacccuuguucuuaucccucaagaagaaacccaccauaaccagccca

SEQ ID NO: 339679 - RNA, 63 nt, hsa
auguaccuauugacuguauccucaugcauuuuccucaagaaugucugaagaagguaguaauau

SEQ ID NO: 339680 - RNA, 63 nt, hsa
cgccgggcuacgaugacauguaccugugaaggccucaagaauguaacaucccaggcuucccuc

SEQ ID NO: 339681 - RNA, 61 nt, hsa
cacuccagcccgggcaacagaguaagacccugccucaagaaaaaaaaaaaaaaaaaaaauc

SEQ ID NO: 339682 - RNA, 63 nt, hsa
ggccaggugccggcacagugccucucccagagccucaagaagggccauuuaggagcuugcuuc

SEQ ID NO: 339683 - RNA, 63 nt, hsa
caccgugccugacucauccaguggggaaggugacucaagaaguuguuuaagccuaggccuagg

SEQ ID NO: 339684 - RNA, 63 nt, hsa
aaagcuguugcuggaaacuugcuuuaggaacagcucaagaaccuuggaguucauauuucacaa

SEQ ID NO: 339685 - RNA, 63 nt, hsa
agagaagaggaguggaugagccugcggguuugccucaagaaacuucaugagggucucuuacua

SEQ ID NO: 339686 - RNA, 63 nt, hsa
cucuauggcgcuuccuugaguggaaggaaaugucucaagaaacaaagaucucgcuggugcgua

SEQ ID NO: 339687 - RNA, 52 nt, hsa; identical to SEQ ID NO: 339334

SEQ ID NO: 339688 - RNA, 63 nt, hsa
aaaaucuugcuuuuauggucuuccccccucgcccucaagaacaagggccuugugcgugggccu

SEQ ID NO: 339689 - RNA, 63 nt, hsa
cuuguuuauuuucuaguagcuuuuauaaguacacucaagaauuugucagggagaauaauucug

SEQ ID NO: 339690 - RNA, 63 nt, hsa
auccagguuuacuuucuaucagcugagcaaccucucaagaaaaaauaaauaaauaaauaaacc

SEQ ID NO: 339691 - RNA, 63 nt, hsa
uguguucuguauaaacaaaugcagcuggaaucgcucaagaaucuuauuuuucuaaauccaaca

SEQ ID NO: 339692 - RNA, 63 nt, hsa
guccugaagacuccggccaagaggcacaagcagcucaagaacaagcuggagaagaacgaggag

SEQ ID NO: 339693 - RNA, 63 nt, hsa
uacuuuccuguauaguucacguuucauguaauccucaagaaauaaaaggaagccaaagagugu

SEQ ID NO: 339694 - RNA, 63 nt, hsa
uuacuguaggugaaggcuguauuuguaguaguacucaagaaucaccugauguuuucuuauucu

SEQ ID NO: 339695 - RNA, 63 nt, hsa
gggauuuggcuggugccgaaguguuucugaagucucaagaacugccauaaaaucucacgcugc

SEQ ID NO: 339696 - RNA, 63 nt, hsa
ggucgggacauauauuuacauagaucccagacacucaagaauuagcacagcugauguaaaauu

SEQ ID NO: 339697 - RNA, 63 nt, hsa
auguccauuucggggagaggagcaggugggacccucaagaaaaugacggagaacaucccagac

SEQ ID NO: 339698 - RNA, 63 nt, hsa
gcuuuugaaacuuagguauuuuauauuuuuccccucaagaacuuuuuuuuaagagacagauuu

SEQ ID NO: 339699 - RNA, 63 nt, hsa
ccucccagcggccuccggcgucuugcccagcagcucaagaagaaaaagaaggacugaacucca

SEQ ID NO: 339700 - RNA, 63 nt, hsa
uuucucgaaauugccaguguguacuuggcuuaacucaagaacaguuucuucuggauuccuuau

SEQ ID NO: 339701 - RNA, 63 nt, hsa
cuuucuacaaagcaaggcccacagacuaccccacucaagaacagcagguaugugggccagagg

SEQ ID NO: 339702 - RNA, 63 nt, hsa
gaggcucccuguacuggagucgucccacuauuccucaagaaaucuuagaaccagcuugugagg

SEQ ID NO: 339703 - RNA, 63 nt, hsa
gaucuguacaaguauguggagcaugaaugcugacucaagaaacuuuuacuccuucugcucaag

SEQ ID NO: 339704 - RNA, 63 nt, hsa
gugagcgaauuagcaauaacauacaugagauaacucaagaaaucaaaagauaguugauucuug

SEQ ID NO: 339705 - RNA, 63 nt, hsa
uauaaaaauguauaggcaguauacacagcacuacucaagaagccaaagaaacacuugugcagu

SEQ ID NO: 339706 - RNA, 63 nt, hsa
ucaccccucucugaagggcuguuguucugcuuccucaagaaauuaaacauuuguuucugugug

SEQ ID NO: 339707 - RNA, 63 nt, hsa
cacuccagccugggugacagagugagacucugucucaagaaggaaaaaaaaaaaaaagaaugu

SEQ ID NO: 339708 - RNA, 63 nt, hsa
gccagaggaugagugaccaguugcuaaguggggcucaagaagcaccgccuuccccacccccug

SEQ ID NO: 339709 - RNA, 63 nt, hsa
cugucacaaauguuccugaaagcaccacagcuacucaagaagaucaaauucaggacauaaacu

SEQ ID NO: 339710 - RNA, 63 nt, hsa
ucaaucugaaagauuuuucaagaaucuuaaaaucucaagaagugaagcagauucauacagccu

SEQ ID NO: 339711 - RNA, 63 nt, hsa
gugaugcagacuuguucuucuuuuuaaagcagucucaagaauaagcauuucuuuaaaauguuu

SEQ ID NO: 339712 - RNA, 63 nt, hsa
agaacacaagaacuuaagagaaaaagaaaccuacucaagaaaagacagaagagacagugauuu

SEQ ID NO: 339713 - RNA, 63 nt, hsa
aaugacaaacacaagugccccuuuucucuggaucucaagaaugguggaggacccuggaaggac

SEQ ID NO: 339714 - RNA, 63 nt, hsa
ucuugcacuaucacaauugcuuuuuaguuauuucucaagaagcauguucguauuagagacaaa

SEQ ID NO: 339715 - RNA, 63 nt, hsa
aaaccuucgucucuuugugcuuuguaaagcaaacucaagaaaacugguacaccuguaccagcu

SEQ ID NO: 339716 - RNA, 63 nt, hsa
aagaauuagcaguaaaauacaugagauaaagaccucaagaaguuaaaagauacuuaauucuug

SEQ ID NO: 339717 - RNA, 63 nt, hsa; identical to SEQ ID NO: 339704

SEQ ID NO: 339718 - RNA, 63 nt, hsa
agacagacugcaccaccccuucccccccugcaucucaagaauaaagcaagcugccuuuguacu

SEQ ID NO: 339719 - RNA, 63 nt, hsa
auuuuagguauuaagacugagaaauauuuaaagcucaagaagaacacagaagcacacaucccu

SEQ ID NO: 339720 - RNA, 63 nt, hsa
ucuaacgagagacaucaguuucucaggaugauccucaagaacguuauggaguccauguugcaa

SEQ ID NO: 339721 - RNA, 63 nt, hsa
caagagcgucagguggcaaaaguccuucuguuacucaagaaaaugcucugaaaaauuccuuuu

SEQ ID NO: 339722 - RNA, 64 nt, hsa
ggugugauuugugcaagccagguucaacccuugccucaagaaaucagaugggaccaauuuagug

SEQ ID NO: 339723 - RNA, 64 nt, hsa
ggaagauggcuggugaggagcuuaacagaggaaccucaagaagauucugaaaauccuaccccca

SEQ ID NO: 339724 - RNA, 64 nt, hsa
ggcaauacugaagggguuaaacagguuuuugcuccucaagaauuuguuugccugggcccaggau

SEQ ID NO: 339725 - RNA, 64 nt, hsa
gauaacacuuaccaaaagaucacugcaaaccugccucaagaagcugaugguggcacuucaauuu

SEQ ID NO: 339726 - RNA, 64 nt, hsa
gaaguccuuuuuuuuuuuuuuuuuuuuuuaauugcucaagaaaugauucucucacaggcuuggg

SEQ ID NO: 339727 - RNA, 64 nt, hsa
gacugaugacaucugacuuuugucgaugggacuucucaagaagccauuccuuggagcuucuguu

SEQ ID NO: 339728 - RNA, 64 nt, hsa
cauacugccaugaagacggucucuguguccucagcucaagaauccuguagcuugucccaucaua

SEQ ID NO: 339729 - RNA, 58 nt, hsa; identical to SEQ ID NO: 339023

SEQ ID NO: 339730 - RNA, 64 nt, hsa
gauuccuccaugguaaagcugaacugaaacaauucucaagaaugcaucagcuguaccuacaaua

SEQ ID NO: 339731 - RNA, 64 nt, hsa
caaucugaagauguaagacuuccugaaacaaguucucaagaagucuuuacauuauauuuauaac

SEQ ID NO: 339732 - RNA, 64 nt, hsa
uuugaauauuggggaaggaagaugauacuucuuucucaagaaaagaaaauuggauuauuaggaa

SEQ ID NO: 339733 - RNA, 64 nt, hsa
ugucauaagcgaucacuuccuauaugcacuuauucucaagaagaacaucuuuaugguaaagaug

SEQ ID NO: 339734 - RNA, 64 nt, hsa
ugugaaugcugaacugaaggcucagauugaggagcucaagaacgagaagcagcauuugauauac

SEQ ID NO: 339735 - RNA, 64 nt, hsa
uuuguauuucaccaccuaaauguaauguugauuccucaagaaugaaaugaaggcacuacauuga

SEQ ID NO: 339736 - RNA, 64 nt, hsa
uucaagacaaaacagauugcgucgcugacaaguucucaagaagaacuuaugaguaagcagucug

SEQ ID NO: 339737 - RNA, 64 nt, hsa
uuccacgugagguuuuguuuagagggauccacuacucaagaaaaaguuagcaaaccacuccuuu

SEQ ID NO: 339738 - RNA, 64 nt, hsa
caccaaaagcuugauaugacagagaagaagaaggcucaagaauuuauucaccaguuccucugca

SEQ ID NO: 339739 - RNA, 64 nt, hsa
gauccacuggucacagguagacauguggagucaacucaagaaaaagcugagugaacagcaugau

SEQ ID NO: 339740 - RNA, 64 nt, hsa
ccuugugaccacaucucccaccacguccccagaucucaagaacgcagcucagcuucuccuucga

SEQ ID NO: 339741 - RNA, 64 nt, hsa
agaagagggccugugggagccugcaaacucacugcucaagaagacauggagacuccugcccugu

SEQ ID NO: 339742 - RNA, 64 nt, hsa
aaugagauccugucucuuaaagaaaaaaaauaaacucaagaaugauuuuucuaaaaauaugagu

SEQ ID NO: 339743 - RNA, 64 nt, hsa
gcuuacugaucacuauaguauugcauaagcacagcucaagaacugagcuuuguauguguccuuu

SEQ ID NO: 339744 - RNA, 64 nt, hsa
agcagugggcuacauacaaugagagcccugagcccucaagaacucaugccagcucagcccuaca

SEQ ID NO: 339745 - RNA, 64 nt, hsa
uauugacaauggcagagaacaauuaaaggguugacucaagaacuaguuccaaaccuagcagaau

SEQ ID NO: 339746 - RNA, 64 nt, hsa
ugagggcauccgacaaggcccaucuccuucccuccucaagaagcagaggccuccucuggaguga

SEQ ID NO: 339747 - RNA, 64 nt, hsa
uuguauggcaguauguauauauuguguuaaguuccucaagaaucuccuuaaaaacuuugaaguu

SEQ ID NO: 339748 - RNA, 64 nt, hsa
ugggauuuaaggacuucugggggaccaagacauccucaagaaaacaggggcauccagggcuccc

SEQ ID NO: 339749 - RNA, 64 nt, hsa
caagucccccagcagaaccagccucaaaaacgcccucaagaacaugaugggccugaacucggac

SEQ ID NO: 339750 - RNA, 51 nt, hsa; identical to SEQ ID NO: 339044

SEQ ID NO: 339751 - RNA, 64 nt, hsa
uccugcucacauccacagucagggcacggcgccccucaagaacuccagagucaccugucucauc

SEQ ID NO: 339752 - RNA, 64 nt, hsa
cgaaggcccucucuuccucucauaccacguuuugcucaagaagcugggcuguaacaauucaggg

SEQ ID NO: 339753 - RNA, 64 nt, hsa
auauuuuguaucagugcuguuaauuugcuguugccucaagaaaaagugcuuuuucuccauggau

SEQ ID NO: 339754 - RNA, 64 nt, hsa
ggaaaaccuuauggaaaauaauuauaguacaauucucaagaaaauucacuaugugaaugagaug

SEQ ID NO: 339755 - RNA, 64 nt, hsa
uugacccugauuugaccccucuucuuauaaggaucucaagaaucucuucagaagcacugaugac

SEQ ID NO: 339756 - RNA, 64 nt, hsa
uucaaggcaaagcaaggaacaucuugagauaugucucaagaauauaaagauguauuauuuuaag

SEQ ID NO: 339757 - RNA, 64 nt, hsa
ggcucacaugggaguuguccucacccuuguuaaucucaagaaacucuuauuuauaauagguugc

SEQ ID NO: 339758 - RNA, 64 nt, hsa
gaucuguuuggaaacaaccccuugagcugccaggcucaagaaaucauggacucacaggguccug

SEQ ID NO: 339759 - RNA, 64 nt, hsa
caauggccuguguguuacaaugauaugaucauuucucaagaauaagucccuuuuuguauguguu

SEQ ID NO: 339760 - RNA, 64 nt, hsa
ugucuucugugucacaaacagcacuccaggccagcucaagaagcaaagcaggccaauagaaaug

SEQ ID NO: 339761 - RNA, 64 nt, hsa
gccuaugugugcuccauuccucauuucuacuuggcucaagaaaacauuucugcagucaggugag

SEQ ID NO: 339762 - RNA, 64 nt, hsa
aaaggcagugaaaauggccagccagagaaaagaucucaagaaccagaaauaaauaaggauggug

SEQ ID NO: 339763 - RNA, 64 nt, hsa
guaaagacauacucauuaaguguuauuuauuuuacucaagaacuggaaaccaacuaaaugccuu

SEQ ID NO: 339764 - RNA, 64 nt, hsa
caguauguucccaggcuaguguugaacuccugagcucaagaaauccuccugccugagucucuga

SEQ ID NO: 339765 - RNA, 64 nt, hsa
uagguuucugauuacauaaaauuugaauagaacacucaagaaguauguagauuuuugaaaaacc

SEQ ID NO: 339766 - RNA, 64 nt, hsa
ugugaauguuccaacaccugccuccacuucuccccucaagaaauuuucaacgccaggaaucaug

SEQ ID NO: 339767 - RNA, 64 nt, hsa
augaagagacuucugcuuuucaacccccacccuccucaagaaguaauaauuuguuuacuuguaa

SEQ ID NO: 339768 - RNA, 64 nt, hsa
aaguuggaugcggccauucaaggggagccaaaaucucaagaaauucccagcagguuaccuggag

SEQ ID NO: 339769 - RNA, 64 nt, hsa
ccuccccagacaucuggacacugggcauagauuucucaagaaggaagacuccccugccucccca

SEQ ID NO: 339770 - RNA, 64 nt, hsa
cauuugaaaacacugcaacagugaacuuuugcaucucaagaaaacauugaaaaauucuaugaau

SEQ ID NO: 339771 - RNA, 64 nt, hsa
cgugucuuucucuaggacaagcucccagugaucacucaagaaucuggcucucauucuaagaggc

SEQ ID NO: 339772 - RNA, 64 nt, hsa
uugcauucaucuuguguuuuauaugagaaggugccucaagaauuuccuguuggauuuguuuaaa

SEQ ID NO: 339773 - RNA, 64 nt, hsa
ccugguucucaauuugacacccuaagcgaucauacucaagaauaguacagauguguggaauacg

SEQ ID NO: 339774 - RNA, 64 nt, hsa
agaagugacuuauuaaacuauugaaggaaaaggacucaagaaaaauaauaaaagaccauaaaua

SEQ ID NO: 339775 - RNA, 64 nt, hsa
uuuuugaaccuuauuucucaaaacuuauaguagccucaagaagucuauugauauuggucauguu

SEQ ID NO: 339776 - RNA, 58 nt, hsa; identical to SEQ ID NO: 339070

SEQ ID NO: 339777 - RNA, 64 nt, hsa
uuuugugcucugaguuuugcuguugaaagucucccucaagaauagcuucagauccucuugugua

SEQ ID NO: 339778 - RNA, 64 nt, hsa
caauaucauuuuaauguaauugauuguauauagucucaagaaugguuggugggcaugaguuccu

SEQ ID NO: 339779 - RNA, 64 nt, hsa
aacuuuuguagcaaucuggucuauagacuuuuaacucaagaagcuaaggcuagacuuguuaccu

SEQ ID NO: 339780 - RNA, 64 nt, hsa
gaaaugucucuccucuagguaucguauuuuguugcucaagaauccaaaaugggucuguggacau

SEQ ID NO: 339781 - RNA, 64 nt, hsa
gcugcuuaguuuuuggacugaaaagauauuaaaacucaagaaggaccaagaaguuuucauaugu

SEQ ID NO: 339782 - RNA, 64 nt, hsa
gaggaguaacaauacaaauggauuuugggagugacucaagaagugaagaaugcacaagaaugga

SEQ ID NO: 339783 - RNA, 64 nt, hsa
caagacacagaacaaggucugucuccuauagucacucaagaagucgaucgagaaguuccacauc

SEQ ID NO: 339784 - RNA, 64 nt, hsa
aauuaauuagacuuuuguauaagagaugucaugccucaagaaagccauaaaccugguaggaaca

SEQ ID NO: 339785 - RNA, 64 nt, hsa
cucccugaagcagacugcugaggaauuacauuugcucaagaauuuuuuccgucaaauugugaac

SEQ ID NO: 339786 - RNA, 64 nt, hsa
gccuuaauuauuuaucuuuaguuccuuauuaguucucaagaaacaaaugcuagcuucauaugua

SEQ ID NO: 339787 - RNA, 64 nt, hsa
gugggucccuuccuuucuccuuuccucucuacugcucaagaacagauuugaggccaggugcggu

SEQ ID NO: 339788 - RNA, 64 nt, hsa
uuauaagcaauguaauuaugcuauucacaggggccucaagaauugguauguaugaugugaucug

SEQ ID NO: 339789 - RNA, 64 nt, hsa
auccuuauguagaaaggacuuugaaauuuuucuucucaagaaaugguuuguauaagaauaacaa

SEQ ID NO: 339790 - RNA, 64 nt, hsa
augauacugacugauuaauuauuccugauaacaucucaagaaaaggagaaggaaaguguuucug

SEQ ID NO: 339791 - RNA, 64 nt, hsa
cuauaaaauugucagcguauuuuuacacuauuggcucaagaauguuauaaugcuaagggacaua

SEQ ID NO: 339792 - RNA, 64 nt, hsa
gaagaaaagauuaauaccuuaaaagaagaaaacacucaagaagcagcaguccugaaugguguuu

SEQ ID NO: 339793 - RNA, 64 nt, hsa
cugcacuccagccugggccacagagcaagacugucucaagaaaaaaaauuuuuuaaauaaguuu

SEQ ID NO: 339794 - RNA, 64 nt, hsa
uauauuuuauacaaauagauugcuuagaaugguucucaagaauuauaagagaaaugaacucaca

SEQ ID NO: 339795 - RNA, 64 nt, hsa
agauaagcaccuggcaucuaauggcaggcaggcacucaagaaaugaauuaacuacauaauggaa

SEQ ID NO: 339796 - RNA, 64 nt, hsa
cguuucugugaauuucaugaagagcagaacauuucucaagaauccucuugagccaguaaucaau

SEQ ID NO: 339797 - RNA, 64 nt, hsa
uuggagaauagaaaugaaaagccacgucauauaacucaagaauaaaugguguuuuggaaauuuu

SEQ ID NO: 339798 - RNA, 64 nt, hsa
aucccugcugggcacaccccacaaaccccacucccucaagaagggccagggccagggcuguaug

SEQ ID NO: 339799 - RNA, 64 nt, hsa
ugugcaggacaguaaauaaugaaaaccaaauuuccucaagaaauaacugaagaaggagcaagug

SEQ ID NO: 339800 - RNA, 64 nt, hsa
ucagauguggucaguagggagcuccaugcccaagcucaagaacgacugcaacacuacuuuaugg

SEQ ID NO: 339801 - RNA, 64 nt, hsa
acaauuuaauugcucaaccaugcauuuaaaacuccucaagaaaggauugguacugcaacuguag

SEQ ID NO: 339802 - RNA, 64 nt, hsa
uucuaaauuugaguaaauacaauuuuuuagguuacucaagaaccagcauuaguaauuucuagua

SEQ ID NO: 339803 - RNA, 64 nt, hsa
uaagggaacacacaaagaauuacacaacguuuuccucaagaaaaugguacaaaacacaaccgag

SEQ ID NO: 339804 - RNA, 64 nt, hsa
ucuauaauggguuugggggauaauaauggugaagcucaagaacagaugucuauugaguagaacc

SEQ ID NO: 339805 - RNA, 64 nt, hsa
caggugaauuguggaaaaugucauguagcugacacucaagaaauagggauuccuaauaauggca

SEQ ID NO: 339806 - RNA, 64 nt, hsa
cuggcuuuccugcuauacacauauucacauggcgcucaagaaguuaggcucauggcaacgugug

SEQ ID NO: 339807 - RNA, 64 nt, hsa
ucuucaucaaguggaagccaacuguccugccugccucaagaauauguguuuucuuuagcuuccc

SEQ ID NO: 339808 - RNA, 64 nt, hsa
uguaaauuugcucuguuuuaagacuuugaacuaccucaagaagaggaaucuaauacaauauuug

SEQ ID NO: 339809 - RNA, 64 nt, hsa
cacaaguuuucacugaaugagcauggcagugccacucaagaaaaugaaucuccaaaguaucuuc

SEQ ID NO: 339810 - RNA, 64 nt, hsa
cagugcuuagaaguaagcaauucccaggucauagcucaagaauuguuagcaaaugacagauuuc

SEQ ID NO: 339811 - RNA, 64 nt, hsa
cuagugccaggucacuauuguaagauguuaaaaucucaagaaaauuucacagagcuaaagaaau

SEQ ID NO: 339812 - RNA, 64 nt, hsa
agauaagaaaggacuacagcauuugauguguguccucaagaacuugucuugggucugaaaaagc

SEQ ID NO: 339813 - RNA, 64 nt, hsa
cccuauggccuucuugucaaaaccuucacuggagcucaagaaaagcauuucuguuguguuauuu

SEQ ID NO: 339814 - RNA, 64 nt, hsa
uugcuuaugggaauccugagcugcuuuucaccaucucaagaagccuaagaaguuauauauuuaa

SEQ ID NO: 339815 - RNA, 64 nt, hsa
uuguagauaaaaguguuccaguaaucagaaaauccucaagaaaauugacuucauuauuuggaag

SEQ ID NO: 339816 - RNA, 64 nt, hsa
ugcccauuaccuuuccucugccugaaagacgugucucaagaaaaauaaauucuauuuuagaugc

SEQ ID NO: 339817 - RNA, 64 nt, hsa
uaguauaucaucauaaaauagacaauguuuuugucucaagaacaagaauaaaauugaaaucugc

SEQ ID NO: 339818 - RNA, 64 nt, hsa
gaauaaaaagguaaaacuacauuuagacuucuuucucaagaaaucaaauacagcuuuuuuucaa

SEQ ID NO: 339819 - RNA, 64 nt, hsa
aaacgaacaagauuaauuaccugucuuccuguuucucaagaauauuuacguaguuuuucauagg

SEQ ID NO: 339820 - RNA, 64 nt, hsa
aucuuuagacuacaauaauacuuuuauccaugugcucaagaaagggccccuuuuuccaacuuau

SEQ ID NO: 339821 - RNA, 64 nt, hsa
agauauguauuugcuacucaaguguacagaucuccucaagaaacaucaagggacuccuguguca

SEQ ID NO: 339822 - RNA, 64 nt, hsa
uaaauaaccgauuauugauuacuguauuuuuuuucucaagaacagugauagguagaaacuaauu

SEQ ID NO: 339823 - RNA, 64 nt, hsa
aaagucaucauugcuguuuagcuugacuguuuuccucaagaacaucgaucugaaggauucauaa

SEQ ID NO: 339824 - RNA, 64 nt, hsa
agaugcucuguagagaauuugcuaccgaaguuggcucaagaauuuguuuuuaguguuauuuacc

SEQ ID NO: 339825 - RNA, 64 nt, hsa
cuggcaaaggccuuccugcauuuaugaauucucucucaagaagcaagagaacaccugcaggaag

SEQ ID NO: 339826 - RNA, 64 nt, hsa
augagaauuaagaauggacaggaccaagacagaacucaagaaagccacuggggaaaacucgaga

SEQ ID NO: 339827 - RNA, 64 nt, hsa
aauauguucaacauuuacuucuauuugauaucugcucaagaagucauagaagucuugggaaacu

SEQ ID NO: 339828 - RNA, 64 nt, hsa
aguaacauugucagaaauaaauaaaaccacaagucucaagaauuugccacguauguucaagggu

SEQ ID NO: 339829 - RNA, 64 nt, hsa
uuucuucagguaacacuacagaguacgugaaaugcucaagaauguagucagacugacacuacua

SEQ ID NO: 339830 - RNA, 64 nt, hsa
aaacaaaacacaguccugcauacucaccaccaagcucaagaaauaaaucaucaccaauaccuuu

SEQ ID NO: 339831 - RNA, 64 nt, hsa
agccaacucauuggguuguagccaaagguucacucucaagaagcuuuaauauuuaaauaaaauc

SEQ ID NO: 339832 - RNA, 64 nt, hsa
aauaucaccuagaaaaguagccucacucuuauuccucaagaauuaauauccaauguuuaugagu

SEQ ID NO: 339833 - RNA, 64 nt, hsa
acaucagcauuguauacacauauuuucacuuuaacucaagaauuccaggagguaauuuguugau

SEQ ID NO: 339834 - RNA, 64 nt, hsa
aucacaaauggcaauguaaaaaucaagacauuuucucaagaacuguguaccacuaaaaguaaua

SEQ ID NO: 339835 - RNA, 64 nt, hsa
caagaagcaugcagagaagaauugguuuguuggccucaagaagaaugggagcugcaaacgcggu

SEQ ID NO: 339836 - RNA, 64 nt, hsa
ggaaccaugccccuuccccaggcccccagcaagucucaagaacacagcugcacaggccuugacu

SEQ ID NO: 339837 - RNA, 64 nt, hsa
aagaaauacaguuuguuuguauaaaauaaacuaucucaagaaaguuuucaacgacagugauagu

SEQ ID NO: 339838 - RNA, 64 nt, hsa
ccuuugagaaauccuuuugugaagucauugccugcucaagaauguacaguggcuccccaaugcc

SEQ ID NO: 339839 - RNA, 64 nt, hsa
uacagaguguguucgcacuuagccaugggcugggcucaagaaccugauaccuggguugaugugg

SEQ ID NO: 339840 - RNA, 64 nt, hsa
gaaaacugccuaacugaagggaaugggggcccugcucaagaagggggccaggcagcuggaauca

SEQ ID NO: 339841 - RNA, 64 nt, hsa
ugggguaugagcugccaagucuauuuuaaagacgcucaagaauccucugggguucaucuaggga

SEQ ID NO: 339842 - RNA, 64 nt, hsa
ucauucagccaacccagaggauguagacccuguccucaagaagugcagggcgaguucugccgug

SEQ ID NO: 339843 - RNA, 64 nt, hsa
gcuguggaacgagacuucugcagagguggcugaccucaagaagcagguacaggcccuucagccc

SEQ ID NO: 339844 - RNA, 64 nt, hsa
agacuagauuauauuuaguaggggaaaaauugggcucaagaaccauucaucaguacgugagaca

SEQ ID NO: 339845 - RNA, 64 nt, hsa
ugacuuguaagcaguucauagaagcugcucaauacucaagaaucuugcaagacaguuauuaaac

SEQ ID NO: 339846 - RNA, 64 nt, hsa
aucuuguuuugaucauuuccacugcacauuucuccucaagaaaagcgaaaggacagacuguugg

SEQ ID NO: 339847 - RNA, 64 nt, hsa
ucagcaauuugaacacuaaccucuccccuccuggcucaagaauuacuccgaagucagucugcag

SEQ ID NO: 339848 - RNA, 64 nt, hsa
uucugagcaaauaacuacagggugcccauuaccacucaagaagacacuucacguauucuuguau

SEQ ID NO: 339849 - RNA, 64 nt, hsa
accgguagccuucaagcuuguccagcagaaccagcucaagaaaggagaugcccuagugguggcc

SEQ ID NO: 339850 - RNA, 64 nt, hsa
guuuuacuccgugccuuacuggauuuggccuguccucaagaaugguaauuaugaagaguggaga

SEQ ID NO: 339851 - RNA, 64 nt, hsa
aacagcguccauuuuuucauauuagagguggaaccucaagaaugacuuuauucuuguaucucau

SEQ ID NO: 339852 - RNA, 64 nt, hsa
gcauugucuugcccuauagacucaggaguugcuucucaagaaagagccagcaaguauucucagc

SEQ ID NO: 339853 - RNA, 64 nt, hsa
uuuuaaacauuaaguuugaaauaggaaugguuuucucaagaauagauuuggugugauaccuugu

SEQ ID NO: 339854 - RNA, 64 nt, hsa
ugagugaugagcagacauguuuaagggucuaagucucaagaaucuguuauguguguuugcugcg

SEQ ID NO: 339855 - RNA, 64 nt, hsa
auauuuaaucuauuuaaucuucuugcauuuauuucucaagaauuacuggcuuuaaaagaagcca

SEQ ID NO: 339856 - RNA, 64 nt, hsa
agcccucaauauuugguaaugcuauuuaaagugacucaagaagcaugugcuaucuggcuuugaa

SEQ ID NO: 339857 - RNA, 64 nt, hsa
aaagaaauauuguugcucaguguuguuaauauagcucaagaauugaguuuauauuugcaguaug

SEQ ID NO: 339858 - RNA, 64 nt, hsa
ggacgagaagacucagccugagggccugcggagccucaagaagccagaccgcaagaagcgcuac

SEQ ID NO: 339859 - RNA, 64 nt, hsa
uguggaacuuccucuuucauuggaaacuuucuuacucaagaaugacggcaguauuguuuucuua

SEQ ID NO: 339860 - RNA, 64 nt, hsa
gacugucuucaucaaguauuucccuacagaacuccucaagaaaacagagaucauuuggcuagag

SEQ ID NO: 339861 - RNA, 64 nt, hsa
ggacucugggccccuccccagcuccacucccuaccucaagaaugugaccauuuggaaaaggcaa

SEQ ID NO: 339862 - RNA, 64 nt, hsa
gccauguugccaaggcugguuucaaacuccuggacucaagaaauccacccaccucagccuccca

SEQ ID NO: 339863 - RNA, 64 nt, hsa
ugugacaguuccaggucuugaagcuaaucagcaucucaagaaaguauccagaaagaacaucugc

SEQ ID NO: 339864 - RNA, 64 nt, hsa
auccuaagcucucaaaauagcauauucccuagagcucaagaaagcugguccaggagguugaaaa

SEQ ID NO: 339865 - RNA, 64 nt, hsa
cguugugcuccagccugggcgacagaagucuugucucaagaagaaaacgaacugggaaaauuuc

SEQ ID NO: 339866 - RNA, 64 nt, hsa
ucccaugcccguucugaccucagccuuggaacuccucaagaaccugaagauuccaguggucagu

SEQ ID NO: 339867 - RNA, 64 nt, hsa
gagauugggaaacuuaaccguuacccaggcaauacucaagaaggagaauccauuuagcaccucc

SEQ ID NO: 339868 - RNA, 64 nt, hsa
uuuuugcuguuguaaaaguguuuucauaaguucacucaagaaaaaugcagcuguucugaacugg

SEQ ID NO: 339869 - RNA, 64 nt, hsa
uaugucuguuuaaaaauuacuaauucucaaauggcucaagaacauuagaauuuaaguaccuuuu

SEQ ID NO: 339870 - RNA, 64 nt, hsa
uguuagugucuucuuccugcccucagcaccacagcucaagaaaaccuaaaguuucaauacaagc

SEQ ID NO: 339871 - RNA, 64 nt, hsa
cuacacccacgcacccccccacacacuaugcucucucaagaauguaauuuauuggggccccccc

SEQ ID NO: 339872 - RNA, 64 nt, hsa
uuagaguccugccguggcucagguggaucuaaaacucaagaacaaauucuauuuauuuauuauu

SEQ ID NO: 339873 - RNA, 64 nt, hsa
auauacuaucuaucucaccaguauuugcucucgacucaagaagguuaacauuuucugauucaug

SEQ ID NO: 339874 - RNA, 64 nt, hsa
augacagcugucuguuguuuuaugaaguuuauuucucaagaaaaugggaauaaauuugggauuu

SEQ ID NO: 339875 - RNA, 64 nt, hsa
ccacucuagcuugggcaauagagcaaggcuccgucucaagaaaagaaggucauuucccaagacu

SEQ ID NO: 339876 - RNA, 64 nt, hsa
aguggaagcauguguguuucuaaaaaguaaaaaucucaagaaaacagaaauggcaugcuuuacc

SEQ ID NO: 339877 - RNA, 64 nt, hsa
aauaaugcagagauaauuagacaugguucccgcccucaagaagcucacaaaaguauucaggaaa

SEQ ID NO: 339878 - RNA, 64 nt, hsa
aaguucuuuuggaacuuguuucaagccaaaaacucucaagaaagcaaauugcaccucagcugga

SEQ ID NO: 339879 - RNA, 57 nt, hsa; identical to SEQ ID NO: 339173

SEQ ID NO: 339880 - RNA, 64 nt, hsa
cccuaaauuaucccauuauguaauucuuggucagcucaagaacuggguucuuuuucuaauaauu

SEQ ID NO: 339881 - RNA, 64 nt, hsa
gagcuggaacaguaggggcagggagaagacaggucucaagaaaagguuuuuaagaaguuucauc

SEQ ID NO: 339882 - RNA, 64 nt, hsa
cuuccucuacucucccgugcacugccggccagagcucaagaagcugcugcacgggcugggccuu

SEQ ID NO: 339883 - RNA, 64 nt, hsa
auuuuacucugaucaaauaaauaaugcuggaauacucaagaauugcauccucugaccuacuuca

SEQ ID NO: 339884 - RNA, 64 nt, hsa
cgggaggaagcacugaaacaacacaaaacccuaucucaagaacuuguuaaccuccggggagagc

SEQ ID NO: 339885 - RNA, 64 nt, hsa
uaaccacagggccugagaagucuugcuuuaugggcucaagaaugccaugcgcuggcaguacaug

SEQ ID NO: 339886 - RNA, 64 nt, hsa
ucccugauauuauuucuauuuaauacucuuuucucucaagaaaaaaaaaaaaguuuguuuuuuc

SEQ ID NO: 339887 - RNA, 64 nt, hsa
auggugggagggaauguuuucaaauuucccauuucucaagaaauguucauauuaauugaggauu

SEQ ID NO: 339888 - RNA, 64 nt, hsa
cauuuugaugauucugagaagaaacuuguccuuccucaagaacacagcccugcuucugacauaa

SEQ ID NO: 339889 - RNA, 64 nt, hsa
aaaauaaccaaaaaaugugagcuauaauguuucccucaagaacaaacagaaacgagauuugcca

SEQ ID NO: 339890 - RNA, 64 nt, hsa
gucagccccaguuggcuuccuggucaacaaggaccucaagaacugccuguggaccgaggccccc

SEQ ID NO: 339891 - RNA, 64 nt, hsa
augcagagguaacucucaggcagcuaagcagcaccucaagaaaacauguuaaauuaaugcuucu

SEQ ID NO: 339892 - RNA, 64 nt, hsa
cugagaguagcugcugcuuucccugacuuccuuccucaagaauacagucuauucugggggguug

SEQ ID NO: 339893 - RNA, 64 nt, hsa
agauuuuccucugacaccagagaacaauaguagucucaagaauggaaaccugaaugucugaggg

SEQ ID NO: 339894 - RNA, 64 nt, hsa
aaaaacuucaguuacugaccagucaagagaauuucucaagaaaaaucccagcaacguucccucu

SEQ ID NO: 339895 - RNA, 64 nt, hsa
ucaagcacaaagugaugaaugacugccuucaagucucaagaaaacacuuuucccuaacuuuuag

SEQ ID NO: 339896 - RNA, 64 nt, hsa
auuugggugagcugcaccugauuaguugaaaggccucaagaacaaacacugcaguuuccuggaa

SEQ ID NO: 339897 - RNA, 64 nt, hsa
caacuguggaguugguagcugguaacauuguugucucaagaacaacucaccucucucccuagga

SEQ ID NO: 339898 - RNA, 64 nt, hsa
acaacuaaaccuucuuaauauccgccacagaaggcucaagaauccagcccuaaaauucucucca

SEQ ID NO: 339899 - RNA, 64 nt, hsa
aacuaccucauaugcaggaugagccaauggcagucucaagaaauguacucgggcgacaccuuac

SEQ ID NO: 339900 - RNA, 64 nt, hsa
cuuuucugacauuccuagacagguucauucuuugcucaagaaaggccugaaugacaauguccag

SEQ ID NO: 339901 - RNA, 64 nt, hsa
aauacaacaagaucaacuagaagaauucaacugucucaagaaucaagguaccccaauauaucuc

SEQ ID NO: 339902 - RNA, 64 nt, hsa
auugaagggagaaaggcaagaugugcacucuggacucaagaaacucuuaguucaguggaggaaa

SEQ ID NO: 339903 - RNA, 64 nt, hsa
gucacugugagcucccaggugcagccagaggcaccucaagaagaagaggggcauaaacuuuccu

SEQ ID NO: 339904 - RNA, 64 nt, hsa
auucagaugaguuagaagcuuuuuaucccuuccucucaagaaaauauucuuucacccugucucu

SEQ ID NO: 339905 - RNA, 64 nt, hsa
aagugacauaauuuacaugcaauauguuuaucaacucaagaauuuaauauaguugguacacaac

SEQ ID NO: 339906 - RNA, 64 nt, hsa
uggauacauuaggagcuucaaacacauauaauuucucaagaaauuuccagaugucucaugcugc

SEQ ID NO: 339907 - RNA, 64 nt, hsa
uauuaaggaagaacaaggaagggaaugaucuuuacucaagaauuucagaaagucagcacugaag

SEQ ID NO: 339908 - RNA, 57 nt, hsa; identical to SEQ ID NO: 339202

SEQ ID NO: 339909 - RNA, 64 nt, hsa
agaaggcugcuaauuggauuuugguaguucuuaccucaagaaaacuugaauuauuugggggaaa

SEQ ID NO: 339910 - RNA, 64 nt, hsa
uaagcuuaugaaggaaugccuccuuuguuacacacucaagaauuugucagcacacaauuaauug

SEQ ID NO: 339911 - RNA, 64 nt, hsa
aauaauucagaaauuggguuuugguucagugauucucaagaaaaagaucucuugcccauuaaga

SEQ ID NO: 339912 - RNA, 64 nt, hsa
cacaaaauccaaggugcuacaggaaacaagcacacucaagaaaguuuuuuucugaauaacauuu

SEQ ID NO: 339913 - RNA, 64 nt, hsa
uaaagaaaacugaacugaggaaaaugguguuuuccucaagaagacuacuggaacuggaugaccu

SEQ ID NO: 339914 - RNA, 64 nt, hsa
auuuuccaucuccaaauagccaggcccucucucccucaagaaaugcccagauguagaaauucau

SEQ ID NO: 339915 - RNA, 64 nt, hsa
gaaaguucauuucaucacuuagaaaauaugucuucucaagaacaaaacugugcuguuacaacuc

SEQ ID NO: 339916 - RNA, 64 nt, hsa
cuggcucucucucugcugccucuucauacguuuucucaagaacuucaguuuauaauuggaagag

SEQ ID NO: 339917 - RNA, 64 nt, hsa
cuccucuauccgaggccauuggagaccccaguuucucaagaauucagcucugcucugagcgucc

SEQ ID NO: 339918 - RNA, 64 nt, hsa
agguugaguccagaugcuucucaccuucuuucuccucaagaaagaugcuuuuugggaaacguug

SEQ ID NO: 339919 - RNA, 64 nt, hsa
uuccacagacagaugaggcaggagugauggggcacucaagaaaguucagaggaggcauaagcua

SEQ ID NO: 339920 - RNA, 64 nt, hsa
uuggaucuuggcaugcacccaccuaacccacuuucucaagaacaagaaccuagaaugaauaucc

SEQ ID NO: 339921 - RNA, 64 nt, hsa
acucccagaagaccaaacugccuuccccucagggcucaagaauguguacagucuguggggccgg

SEQ ID NO: 339922 - RNA, 64 nt, hsa
uucuccuuuuguguuuuucccacuuuccaauguacucaagaaaauugaacaaauguaauggauc

SEQ ID NO: 339923 - RNA, 64 nt, hsa
ccugacuaaggagcugcagcgauacaucgaagggcucaagaagcgccggagcaagaggcuguac

SEQ ID NO: 339924 - RNA, 64 nt, hsa
gccccagagggcuuuguggaggacaggccuugcccucaagaacgucguaccugacgcugagccu

SEQ ID NO: 339925 - RNA, 64 nt, hsa
uugagcuuuuuggaaggauaauucugauaaggcacucaagaaacguacaaccacagugcuuucu

SEQ ID NO: 339926 - RNA, 64 nt, hsa
gagacccgccaccguggaggcagggggcaagaaacucaagaacgcaucaagagcaccagcccug

SEQ ID NO: 339927 - RNA, 54 nt, hsa; identical to SEQ ID NO: 339221

SEQ ID NO: 339928 - RNA, 64 nt, hsa
aaccucacgcaccucccauccuaaucauccaaugcucaagaaacaacuucuacuucugcccuug

SEQ ID NO: 339929 - RNA, 64 nt, hsa
cacuuuucagagucaucuacaaaauuuuucuuuccucaagaaaagaguuccuuuugccuuauuc

SEQ ID NO: 339930 - RNA, 64 nt, hsa
gcugacuuaggaucaugcuggaaggaagccaagucucaagaacugucagcaacagaaaaugaga

SEQ ID NO: 339931 - RNA, 64 nt, hsa
agccccuggaucuuugggguaaaaggaggguggccucaagaaacaaugucuggggacaggccuu

SEQ ID NO: 339932 - RNA, 64 nt, hsa
cucaugccuaacaguggucuguuuuuauaugagacucaagaacaggccucauuccagggcacag

SEQ ID NO: 339933 - RNA, 64 nt, hsa
agaggaggagggauucuggucuucacugccaugccucaagaacaccuuuguuuugcacugacaa

SEQ ID NO: 339934 - RNA, 64 nt, hsa
cugggaaugcugggaaaugagauacauucccgcccucaagaaucucccagucugguaggagaga

SEQ ID NO: 339935 - RNA, 64 nt, hsa
caggagacaugagucuuugccggaggaaaagcagcucaagaacacaugugcagucacugguguc

SEQ ID NO: 339936 - RNA, 64 nt, hsa
auauuccuauugaucucauuuuauuuagcaucagcucaagaaacuaagucuuagugcacaguau

SEQ ID NO: 339937 - RNA, 64 nt, hsa
ccauaaugagauaaugcauguaggggaaaaguuucucaagaagguggaagaggcagcaggacuu

SEQ ID NO: 339938 - RNA, 64 nt, hsa
cauuuauggcaugauuagauugcaaagcaaugaacucaagaaggaauugaaauaaggagggaca

SEQ ID NO: 339939 - RNA, 64 nt, hsa
cuaguuuggauaucuuuaggguuuagaaucuaaccucaagaauaagaaauacaaguacaaauug

SEQ ID NO: 339940 - RNA, 64 nt, hsa
acccaucuuuuuucuucccucauuuucugggauucucaagaaagaaaaaguaacccauuaucac

SEQ ID NO: 339941 - RNA, 64 nt, hsa
cccuuuuggacuaauguuacuguccaaguucuuucucaagaaaccacaucugguucagaagagu

SEQ ID NO: 339942 - RNA, 64 nt, hsa
uuuuuaaauuuuuuuauaggcccauaugcucuaucucaagaaacaagaugauuguaacaugucc

SEQ ID NO: 339943 - RNA, 64 nt, hsa
uaacuuuccuuuauuucacuuguacccaguuucacucaagaaaucuugaugaauauuuauguug

SEQ ID NO: 339944 - RNA, 64 nt, hsa
agacccucucuauagccaugagacuccuuguggccucaagaaauuuagacgcccacgacagcac

SEQ ID NO: 339945 - RNA, 64 nt, hsa
cagccgcacccgugugcacuguaacuuuugugugcucaagaaauuauacagaaaccuacagcug

SEQ ID NO: 339946 - RNA, 64 nt, hsa
ccacuccuggagaaagacuuccuugcaggagugacucaagaauuaaucaguaaauaccuugaaa

SEQ ID NO: 339947 - RNA, 51 nt, hsa; identical to SEQ ID NO: 339241

SEQ ID NO: 339948 - RNA, 64 nt, hsa
auuuccuucauaaagaaugccacccaucugauuccucaagaaucuagaccuagaaauaccauuu

SEQ ID NO: 339949 - RNA, 64 nt, hsa
uuaggaaaaaaaaauccaagaaauguauugaauacucaagaaaaugccacauuucaauuacaua

SEQ ID NO: 339950 - RNA, 64 nt, hsa
aucucauaugaucuucuucaagccauuauuuuaacucaagaaaacucuagagaagaaaagugaa

SEQ ID NO: 339951 - RNA, 64 nt, hsa
gcacuccacugcagcaggagggacuuaagcuagacucaagaaagcagcuuggagccucuagguu

SEQ ID NO: 339952 - RNA, 64 nt, hsa
uuaaaaauaguaagccucccuccucguccccugccucaagaaauugccuccuuauuuaucaaca

SEQ ID NO: 339953 - RNA, 64 nt, hsa
gcaugguaugagcacaggucauggacagccccugcucaagaaaaagcaugagcuggccacacau

SEQ ID NO: 339954 - RNA, 64 nt, hsa
uuuuugaaaaauagucaccaacuguauauacuuccucaagaacugauaauucauuauaucauca

SEQ ID NO: 339955 - RNA, 64 nt, hsa
gcucugccauucaacucggaaacuauaaguaauucucaagaaagcccucauuuuuauaaccugg

SEQ ID NO: 339956 - RNA, 64 nt, hsa
acuuuuuacuguuugccaaaacacuugaaugugccucaagaaaagguaccuacuacaugcugua

SEQ ID NO: 339957 - RNA, 64 nt, hsa
guucuauacuggauccuuucuuucucuaauaauccucaagaaauccuuacagguaaguauugcu

SEQ ID NO: 339958 - RNA, 64 nt, hsa
guacuggagagaugggauccuucuagauacagggcucaagaagucugcugggaguccccugagu

SEQ ID NO: 339959 - RNA, 64 nt, hsa
aucaggguccucagugcagagcaacuuacgcauccucaagaauccacugcuuuucaggcaagga

SEQ ID NO: 339960 - RNA, 64 nt, hsa
cccacgugggcaauaccagggacccauggggaaacucaagaaugacagcuucuauauuuuguaa

SEQ ID NO: 339961 - RNA, 64 nt, hsa
ccacuaagaaggccugucuacacugcaggggaaccucaagaacuuuucauugcacuucuaaaau

SEQ ID NO: 339962 - RNA, 64 nt, hsa
caaaaggaagagccuuuuaaaaacauuugccaaccucaagaauaaauacugaaagucuugaaag

SEQ ID NO: 339963 - RNA, 64 nt, hsa
uuaggauucugacuaagaggcaaaagagaaaagacucaagaaacugauccuggagaucgagacc

SEQ ID NO: 339964 - RNA, 64 nt, hsa
gggagccaggaguaagacaagugggauuuggggccucaagaaauauacucucccagauuuuuac

SEQ ID NO: 339965 - RNA, 64 nt, hsa
uuuuguuuuaacaaaauuagcugaagaaguuauucucaagaaaauuggauguuuucauuggccu

SEQ ID NO: 339966 - RNA, 64 nt, hsa
guuauaugacaucauccugaagaacuucgagaagcucaagaagcccaggggagaaacaaaggga

SEQ ID NO: 339967 - RNA, 64 nt, hsa
aaagauuacauacauuugagaauaagaaauuacucucaagaacuucagaaaucugcaacauaau

SEQ ID NO: 339968 - RNA, 64 nt, hsa
gauauuucccauaaaugggaaguuugcccauugucucaagaaauguguauuucagugacaauuu

SEQ ID NO: 339969 - RNA, 64 nt, hsa
uaacauuuugggaaguaacugccucugacuucaacucaagaaaacacuuuuuuguugcuaaugu

SEQ ID NO: 339970 - RNA, 64 nt, hsa
aaagaagacugacuggguggaggcucugccuugccucaagaaccauccccugcagagcauccag

SEQ ID NO: 339971 - RNA, 64 nt, hsa
guaggccuugcaucucgccaccuccacuucuguccucaagaacaaguccuaggucaagggaaac

SEQ ID NO: 339972 - RNA, 64 nt, hsa
aaaggaagugaaaauagccagccagaggaaaugucucaagaaccagaaauaaauaaggguggug

SEQ ID NO: 339973 - RNA, 64 nt, hsa
gaauuagugcuggauuugaagcuacgcacucagccucaagaacucccuggaauaucccugagaa

SEQ ID NO: 339974 - RNA, 64 nt, hsa
gauggcccugggaaucaauuccucaggaauugcccucaagaacucugcuucuugcuuugcagag

SEQ ID NO: 339975 - RNA, 64 nt, hsa
aaaucuuagaguucauaaauuuacuugagguugccucaagaacucagggaacaauacuguaaac

SEQ ID NO: 339976 - RNA, 64 nt, hsa
aaugaagaauggaaauggaaaaggguggcugcgacucaagaauaauaugggagcccaugaggag

SEQ ID NO: 339977 - RNA, 64 nt, hsa
gaaggagauaaacaugaccaucgucaaagaccugcucaagaaauuuuuaaaaaagaaacaaagu

SEQ ID NO: 339978 - RNA, 64 nt, hsa
aauuucuuauuugcuagggaacugguaaucuaggcucaagaaguguguggagaagguuuauuuu

SEQ ID NO: 339979 - RNA, 64 nt, hsa
gcaucaguguggacuccuagaacgugcgaccugccucaagaaaaugcaguuuucaaaaacagac

SEQ ID NO: 339980 - RNA, 64 nt, hsa
uccuccucaggacauggagaucugugcagaugagcucaagaagguccuuaacacagucgugaac

SEQ ID NO: 339981 - RNA, 64 nt, hsa
aguacaccuguagauauuacuguacuuuuauguucucaagaaauaaguuguugccuauucagug

SEQ ID NO: 339982 - RNA, 64 nt, hsa
uacugauucauacauuaucucacuugugccaacacucaagaagcaggcuacacugacacuggua

SEQ ID NO: 339983 - RNA, 56 nt, hsa; identical to SEQ ID NO: 339277

SEQ ID NO: 339984 - RNA, 64 nt, hsa
ggcuccacuucauccagaugaaggaaaggaagaccucaagaaaaauucacaguugagugcaucc

SEQ ID NO: 339985 - RNA, 64 nt, hsa
gaaggagauaaacaccaccaucaucaaagagcugcucaagaaauuuuuaaaaacgaaacaaagu

SEQ ID NO: 339986 - RNA, 64 nt, hsa
aggaacuuuauaaugaaacgguucggaauacuggcucaagaaccuaugucaagaugagcugaau

SEQ ID NO: 339987 - RNA, 64 nt, hsa
gaugugagcugcuaaauugacuggccuugcagagcucaagaagggggcuuccaaugcugugaga

SEQ ID NO: 339988 - RNA, 64 nt, hsa
gccccucucucacacaucacauucccaugguggccucaagaaaggcccggaagcgccaggcugg

SEQ ID NO: 339989 - RNA, 64 nt, hsa
guguucuuagugauucacauccacgggacaaaaacucaagaagaaauaagagcugacgccacac

SEQ ID NO: 339990 - RNA, 64 nt, hsa
agagggagugugcgaaucuacccugaccaaugggcucaagaauaaaguaugauuuuugagucag

SEQ ID NO: 339991 - RNA, 64 nt, hsa
auugagggcuaaaucccaagugucucuugacuggcucaagaauuagggccccaacuacacaccc

SEQ ID NO: 339992 - RNA, 64 nt, hsa
accuacuuguggcgaucugaguacucuacucuugcucaagaaguaauacgacaaucagaauaca

SEQ ID NO: 339993 - RNA, 64 nt, hsa
agagggagugugcgaaucaaaccugaccaagcggcucaagaauaaaauaugaauugagggcccg

SEQ ID NO: 339994 - RNA, 64 nt, hsa
uacaaauuuggccuuaagaacugugucuggcguucucaagaaucuagaagauguguaaacaggu

SEQ ID NO: 339995 - RNA, 64 nt, hsa
gaugaaugcccgcagugagcuauacuuacgcuuccucaagaagaggauuagcucugauuuugag

SEQ ID NO: 339996 - RNA, 64 nt, hsa
acuacaaaauuaugucugcaccagugaauccauucucaagaaaagucuuaacuaggaaacuaaa

SEQ ID NO: 339997 - RNA, 64 nt, hsa
ggaacacaggcaaauuauuuguggggguaggaaucucaagaauugcgaaagucaaauauggaga

SEQ ID NO: 339998 - RNA, 64 nt, hsa
ccucaccaagcucauuacaucugccagggccugccucaagaagcccagcccagccuuuuccugg

SEQ ID NO: 339999 - RNA, 64 nt, hsa
agugguauauuuauguaagaaaaugacuguaaaucucaagaaaaaucucagcagcuaauagcaa

SEQ ID NO: 340000 - RNA, 64 nt, hsa
uguaaccauuuguuaacuguacugaagguguguccucaagaagaaaguguucaaauuaaaaaag

SEQ ID NO: 340001 - RNA, 64 nt, hsa
ucucuaccaaaaguuaaaaaaaaaaaaaaaaaagcucaagaaccugcacgagggccuaaaacag

SEQ ID NO: 340002 - RNA, 64 nt, hsa
cuucucuguuuaguaguugguuggggaaguggggcucaagaaggauuuugggguucaccagaug

SEQ ID NO: 340003 - RNA, 64 nt, hsa
gaaaaggggcuggaaaggggggaauggcccacaucucaagaagcaagauauuguuugugguggu

SEQ ID NO: 340004 - RNA, 64 nt, hsa
gaacagcauggauuccguggauagcuguugcagucucaagaagacugagagcuuccaaaaugcc

SEQ ID NO: 340005 - RNA, 64 nt, hsa
acaccaacauuuugcugccuaccuuguuauccuucucaagaagcugaaguguacgcccucuccc

SEQ ID NO: 340006 - RNA, 64 nt, hsa
guauauaccaccuaggaggagaugccaccaagcccucaagaaguugugcccuuccccgccugcg

SEQ ID NO: 340007 - RNA, 64 nt, hsa
gccacgugucccagcccagcguccaguggugccucucaagaaaccccgaacgaauguucggaug

SEQ ID NO: 340008 - RNA, 64 nt, hsa
guacaucauuauuaauauaaaaauaacaggcagccucaagaaugugcugagauuucucuggaaa

SEQ ID NO: 340009 - RNA, 64 nt, hsa
cccugaagcuggauucuuucauacgauacucuuucucaagaagggggcucccugggaucuccag

SEQ ID NO: 340010 - RNA, 64 nt, hsa
caggccugcaggguguggggaaggaggacacaaccucaagaaaggaagcgugaaccccagggaa

SEQ ID NO: 340011 - RNA, 64 nt, hsa
guuugacacaaacucacacaaccaugacgcacugcucaagaacuacgggcugcucuacugcuuc

SEQ ID NO: 340012 - RNA, 64 nt, hsa
guuugacacaaaaucgcacaacgaugacgcacugcucaagaacuacgggcugcucuacugcuuc

SEQ ID NO: 340013 - RNA, 64 nt, hsa
guuugacacaaacucgcacaaccaugacgcacugcucaagaacuacgggcugcucuacugcuuc

SEQ ID NO: 340014 - RNA, 57 nt, hsa; identical to SEQ ID NO: 339308

SEQ ID NO: 340015 - RNA, 64 nt, hsa
uugugagugcuuuggaauuuaaaugauuguauaacucaagaagauuacuuuucuauguugcuca

SEQ ID NO: 340016 - RNA, 64 nt, hsa
uccagacgaugcauuucuuggccaaaguggcuuccucaagaaagcagcacuuaccuuugaaaaa

SEQ ID NO: 340017 - RNA, 64 nt, hsa
caaauggcuucacaguccuuacuucucuaccugccucaagaaggggcucagagcagagacuugu

SEQ ID NO: 340018 - RNA, 64 nt, hsa
gcaaacauucuuccuaaaaggaagacuucauuuucucaagaaaugggauuaguuggggguauua

SEQ ID NO: 340019 - RNA, 64 nt, hsa
auaacuuuaaaaauaauacuuuuagcucuaauagcucaagaacacaauauucguuaauguucag

SEQ ID NO: 340020 - RNA, 64 nt, hsa
gagggcacugaagaccugaaucuacacuaguaaucucaagaaagauuauucauucuaucucaga

SEQ ID NO: 340021 - RNA, 64 nt, hsa
caugacgagcucuagcuggaugggcgcagagaaccucaagaaggcaugaagccagccccugcag

SEQ ID NO: 340022 - RNA, 64 nt, hsa
gcgcuccagccuggucgacagagugagacuccaucucaagaaaaaauaaaaauaaaguuguucu

SEQ ID NO: 340023 - RNA, 64 nt, hsa
gcuuugggaggcugaggcaggaggaucacucgagcucaagaauucaagaccugggcaagagaga

SEQ ID NO: 340024 - RNA, 64 nt, hsa
gcacuccagccugggcgacagagcaagacucugucucaagaagaaaaaaaaaauacauauacac

SEQ ID NO: 340025 - RNA, 64 nt, hsa
auuuauaugcaugaaguuaaaacaacugacguuacucaagaauuagaaaacuuugcaagauuug

SEQ ID NO: 340026 - RNA, 64 nt, hsa
gcacuucagccugggcgacacagcgagacccugucucaagaaagaaaagaaaaagagacaaauu

SEQ ID NO: 340027 - RNA, 64 nt, hsa
cuucuccagcgcugggcccucccuugcccccaagcucaagaagggggcacugcccggcccggcu

SEQ ID NO: 340028 - RNA, 64 nt, hsa
cgaccuacgccacuggaaacacacccaccgcaaccucaagaaccagacugugcagagggcauug

SEQ ID NO: 340029 - RNA, 64 nt, hsa
gcauuccagccugugcgacagaaugagacacugucucaagaaaaaauaaaagugggaaaaucuu

SEQ ID NO: 340030 - RNA, 64 nt, hsa
acaggaccccccaagucuuccuacccucugcacccucaagaaacccccagugccuuguaugaag

SEQ ID NO: 340031 - RNA, 64 nt, hsa
cuuccuucauuaacaaagacccuuguucuuaucccucaagaagaaacccaccauaaccagccca

SEQ ID NO: 340032 - RNA, 64 nt, hsa
cauguaccuauugacuguauccucaugcauuuuccucaagaaugucugaagaagguaguaauau

SEQ ID NO: 340033 - RNA, 64 nt, hsa
ccgccgggcuacgaugacauguaccugugaaggccucaagaauguaacaucccaggcuucccuc

SEQ ID NO: 340034 - RNA, 62 nt, hsa
gcacuccagcccgggcaacagaguaagacccugccucaagaaaaaaaaaaaaaaaaaaaauc

SEQ ID NO: 340035 - RNA, 64 nt, hsa
uggccaggugccggcacagugccucucccagagccucaagaagggccauuuaggagcuugcuuc

SEQ ID NO: 340036 - RNA, 64 nt, hsa
gcaccgugccugacucauccaguggggaaggugacucaagaaguuguuuaagccuaggccuagg

SEQ ID NO: 340037 - RNA, 64 nt, hsa
aaaagcuguugcuggaaacuugcuuuaggaacagcucaagaaccuuggaguucauauuucacaa

SEQ ID NO: 340038 - RNA, 64 nt, hsa
gagagaagaggaguggaugagccugcggguuugccucaagaaacuucaugagggucucuuacua

SEQ ID NO: 340039 - RNA, 64 nt, hsa
ucucuauggcgcuuccuugaguggaaggaaaugucucaagaaacaaagaucucgcuggugcgua

SEQ ID NO: 340040 - RNA, 52 nt, hsa; identical to SEQ ID NO: 339334

SEQ ID NO: 340041 - RNA, 64 nt, hsa
gaaaaucuugcuuuuauggucuuccccccucgcccucaagaacaagggccuugugcgugggccu

SEQ ID NO: 340042 - RNA, 64 nt, hsa
acuuguuuauuuucuaguagcuuuuauaaguacacucaagaauuugucagggagaauaauucug

SEQ ID NO: 340043 - RNA, 64 nt, hsa
gauccagguuuacuuucuaucagcugagcaaccucucaagaaaaaauaaauaaauaaauaaacc

SEQ ID NO: 340044 - RNA, 64 nt, hsa
auguguucuguauaaacaaaugcagcuggaaucgcucaagaaucuuauuuuucuaaauccaaca

SEQ ID NO: 340045 - RNA, 64 nt, hsa
gguccugaagacuccggccaagaggcacaagcagcucaagaacaagcuggagaagaacgaggag

SEQ ID NO: 340046 - RNA, 64 nt, hsa
auacuuuccuguauaguucacguuucauguaauccucaagaaauaaaaggaagccaaagagugu

SEQ ID NO: 340047 - RNA, 64 nt, hsa
uuuacuguaggugaaggcuguauuuguaguaguacucaagaaucaccugauguuuucuuauucu

SEQ ID NO: 340048 - RNA, 64 nt, hsa
ggggauuuggcuggugccgaaguguuucugaagucucaagaacugccauaaaaucucacgcugc

SEQ ID NO: 340049 - RNA, 64 nt, hsa
aggucgggacauauauuuacauagaucccagacacucaagaauuagcacagcugauguaaaauu

SEQ ID NO: 340050 - RNA, 64 nt, hsa
gauguccauuucggggagaggagcaggugggacccucaagaaaaugacggagaacaucccagac

SEQ ID NO: 340051 - RNA, 64 nt, hsa
ggcuuuugaaacuuagguauuuuauauuuuuccccucaagaacuuuuuuuuaagagacagauuu

SEQ ID NO: 340052 - RNA, 64 nt, hsa
uccucccagcggccuccggcgucuugcccagcagcucaagaagaaaaagaaggacugaacucca

SEQ ID NO: 340053 - RNA, 64 nt, hsa
cuuucucgaaauugccaguguguacuuggcuuaacucaagaacaguuucuucuggauuccuuau

SEQ ID NO: 340054 - RNA, 64 nt, hsa
ccuuucuacaaagcaaggcccacagacuaccccacucaagaacagcagguaugugggccagagg

SEQ ID NO: 340055 - RNA, 64 nt, hsa
ggaggcucccuguacuggagucgucccacuauuccucaagaaaucuuagaaccagcuugugagg

SEQ ID NO: 340056 - RNA, 64 nt, hsa
ugaucuguacaaguauguggagcaugaaugcugacucaagaaacuuuuacuccuucugcucaag

SEQ ID NO: 340057 - RNA, 64 nt, hsa
ugugagcgaauuagcaauaacauacaugagauaacucaagaaaucaaaagauaguugauucuug

SEQ ID NO: 340058 - RNA, 64 nt, hsa
uuauaaaaauguauaggcaguauacacagcacuacucaagaagccaaagaaacacuugugcagu

SEQ ID NO: 340059 - RNA, 64 nt, hsa
cucaccccucucugaagggcuguuguucugcuuccucaagaaauuaaacauuuguuucugugug

SEQ ID NO: 340060 - RNA, 64 nt, hsa
gcacuccagccugggugacagagugagacucugucucaagaaggaaaaaaaaaaaaaagaaugu

SEQ ID NO: 340061 - RNA, 64 nt, hsa
ugccagaggaugagugaccaguugcuaaguggggcucaagaagcaccgccuuccccacccccug

SEQ ID NO: 340062 - RNA, 64 nt, hsa
ucugucacaaauguuccugaaagcaccacagcuacucaagaagaucaaauucaggacauaaacu

SEQ ID NO: 340063 - RNA, 64 nt, hsa
gucaaucugaaagauuuuucaagaaucuuaaaaucucaagaagugaagcagauucauacagccu

SEQ ID NO: 340064 - RNA, 64 nt, hsa
agugaugcagacuuguucuucuuuuuaaagcagucucaagaauaagcauuucuuuaaaauguuu

SEQ ID NO: 340065 - RNA, 64 nt, hsa
gagaacacaagaacuuaagagaaaaagaaaccuacucaagaaaagacagaagagacagugauuu

SEQ ID NO: 340066 - RNA, 64 nt, hsa
gaaugacaaacacaagugccccuuuucucuggaucucaagaaugguggaggacccuggaaggac

SEQ ID NO: 340067 - RNA, 64 nt, hsa
uucuugcacuaucacaauugcuuuuuaguuauuucucaagaagcauguucguauuagagacaaa

SEQ ID NO: 340068 - RNA, 64 nt, hsa
aaaaccuucgucucuuugugcuuuguaaagcaaacucaagaaaacugguacaccuguaccagcu

SEQ ID NO: 340069 - RNA, 64 nt, hsa
aaagaauuagcaguaaaauacaugagauaaagaccucaagaaguuaaaagauacuuaauucuug

SEQ ID NO: 340070 - RNA, 64 nt, hsa; identical to SEQ ID NO: 340057

SEQ ID NO: 340071 - RNA, 64 nt, hsa
cagacagacugcaccaccccuucccccccugcaucucaagaauaaagcaagcugccuuuguacu

SEQ ID NO: 340072 - RNA, 64 nt, hsa
uauuuuagguauuaagacugagaaauauuuaaagcucaagaagaacacagaagcacacaucccu

SEQ ID NO: 340073 - RNA, 64 nt, hsa
gucuaacgagagacaucaguuucucaggaugauccucaagaacguuauggaguccauguugcaa

SEQ ID NO: 340074 - RNA, 64 nt, hsa
ccaagagcgucagguggcaaaaguccuucuguuacucaagaaaaugcucugaaaaauuccuuuu

SEQ ID NO: 340075 - RNA, 65 nt, hsa
aggugugauuugugcaagccagguucaacccuugccucaagaaaucagaugggaccaauuuagug

SEQ ID NO: 340076 - RNA, 65 nt, hsa
gggaagauggcuggugaggagcuuaacagaggaaccucaagaagauucugaaaauccuaccccca

SEQ ID NO: 340077 - RNA, 65 nt, hsa
gggcaauacugaagggguuaaacagguuuuugcuccucaagaauuuguuugccugggcccaggau

SEQ ID NO: 340078 - RNA, 65 nt, hsa
ugauaacacuuaccaaaagaucacugcaaaccugccucaagaagcugaugguggcacuucaauuu

SEQ ID NO: 340079 - RNA, 65 nt, hsa
ggaaguccuuuuuuuuuuuuuuuuuuuuuuaauugcucaagaaaugauucucucacaggcuuggg

SEQ ID NO: 340080 - RNA, 65 nt, hsa
ugacugaugacaucugacuuuugucgaugggacuucucaagaagccauuccuuggagcuucuguu

SEQ ID NO: 340081 - RNA, 65 nt, hsa
gcauacugccaugaagacggucucuguguccucagcucaagaauccuguagcuugucccaucaua

SEQ ID NO: 340082 - RNA, 58 nt, hsa; identical to SEQ ID NO: 339023

SEQ ID NO: 340083 - RNA, 65 nt, hsa
ggauuccuccaugguaaagcugaacugaaacaauucucaagaaugcaucagcuguaccuacaaua

SEQ ID NO: 340084 - RNA, 65 nt, hsa
ucaaucugaagauguaagacuuccugaaacaaguucucaagaagucuuuacauuauauuuauaac

SEQ ID NO: 340085 - RNA, 65 nt, hsa
uuuugaauauuggggaaggaagaugauacuucuuucucaagaaaagaaaauuggauuauuaggaa

SEQ ID NO: 340086 - RNA, 65 nt, hsa
augucauaagcgaucacuuccuauaugcacuuauucucaagaagaacaucuuuaugguaaagaug

SEQ ID NO: 340087 - RNA, 65 nt, hsa
gugugaaugcugaacugaaggcucagauugaggagcucaagaacgagaagcagcauuugauauac

SEQ ID NO: 340088 - RNA, 65 nt, hsa
auuuguauuucaccaccuaaauguaauguugauuccucaagaaugaaaugaaggcacuacauuga

SEQ ID NO: 340089 - RNA, 65 nt, hsa
cuucaagacaaaacagauugcgucgcugacaaguucucaagaagaacuuaugaguaagcagucug

SEQ ID NO: 340090 - RNA, 65 nt, hsa
uuuccacgugagguuuuguuuagagggauccacuacucaagaaaaaguuagcaaaccacuccuuu

SEQ ID NO: 340091 - RNA, 65 nt, hsa
ucaccaaaagcuugauaugacagagaagaagaaggcucaagaauuuauucaccaguuccucugca

SEQ ID NO: 340092 - RNA, 65 nt, hsa
ugauccacuggucacagguagacauguggagucaacucaagaaaaagcugagugaacagcaugau

SEQ ID NO: 340093 - RNA, 65 nt, hsa
gccuugugaccacaucucccaccacguccccagaucucaagaacgcagcucagcuucuccuucga

SEQ ID NO: 340094 - RNA, 65 nt, hsa
gagaagagggccugugggagccugcaaacucacugcucaagaagacauggagacuccugcccugu

SEQ ID NO: 340095 - RNA, 65 nt, hsa
gaaugagauccugucucuuaaagaaaaaaaauaaacucaagaaugauuuuucuaaaaauaugagu

SEQ ID NO: 340096 - RNA, 65 nt, hsa
agcuuacugaucacuauaguauugcauaagcacagcucaagaacugagcuuuguauguguccuuu

SEQ ID NO: 340097 - RNA, 65 nt, hsa
cagcagugggcuacauacaaugagagcccugagcccucaagaacucaugccagcucagcccuaca

SEQ ID NO: 340098 - RNA, 65 nt, hsa
uuauugacaauggcagagaacaauuaaaggguugacucaagaacuaguuccaaaccuagcagaau

SEQ ID NO: 340099 - RNA, 65 nt, hsa
cugagggcauccgacaaggcccaucuccuucccuccucaagaagcagaggccuccucuggaguga

SEQ ID NO: 340100 - RNA, 65 nt, hsa
uuuguauggcaguauguauauauuguguuaaguuccucaagaaucuccuuaaaaacuuugaaguu

SEQ ID NO: 340101 - RNA, 65 nt, hsa
cugggauuuaaggacuucugggggaccaagacauccucaagaaaacaggggcauccagggcuccc

SEQ ID NO: 340102 - RNA, 65 nt, hsa
ucaagucccccagcagaaccagccucaaaaacgcccucaagaacaugaugggccugaacucggac

SEQ ID NO: 340103 - RNA, 51 nt, hsa; identical to SEQ ID NO: 339044

SEQ ID NO: 340104 - RNA, 65 nt, hsa
uuccugcucacauccacagucagggcacggcgccccucaagaacuccagagucaccugucucauc

SEQ ID NO: 340105 - RNA, 65 nt, hsa
acgaaggcccucucuuccucucauaccacguuuugcucaagaagcugggcuguaacaauucaggg

SEQ ID NO: 340106 - RNA, 65 nt, hsa
cauauuuuguaucagugcuguuaauuugcuguugccucaagaaaaagugcuuuuucuccauggau

SEQ ID NO: 340107 - RNA, 65 nt, hsa
uggaaaaccuuauggaaaauaauuauaguacaauucucaagaaaauucacuaugugaaugagaug

SEQ ID NO: 340108 - RNA, 65 nt, hsa
auugacccugauuugaccccucuucuuauaaggaucucaagaaucucuucagaagcacugaugac

SEQ ID NO: 340109 - RNA, 65 nt, hsa
auucaaggcaaagcaaggaacaucuugagauaugucucaagaauauaaagauguauuauuuuaag

SEQ ID NO: 340110 - RNA, 65 nt, hsa
aggcucacaugggaguuguccucacccuuguuaaucucaagaaacucuuauuuauaauagguugc

SEQ ID NO: 340111 - RNA, 65 nt, hsa
ggaucuguuuggaaacaaccccuugagcugccaggcucaagaaaucauggacucacaggguccug

SEQ ID NO: 340112 - RNA, 65 nt, hsa
ccaauggccuguguguuacaaugauaugaucauuucucaagaauaagucccuuuuuguauguguu

SEQ ID NO: 340113 - RNA, 65 nt, hsa
gugucuucugugucacaaacagcacuccaggccagcucaagaagcaaagcaggccaauagaaaug

SEQ ID NO: 340114 - RNA, 65 nt, hsa
ugccuaugugugcuccauuccucauuucuacuuggcucaagaaaacauuucugcagucaggugag

SEQ ID NO: 340115 - RNA, 65 nt, hsa
uaaaggcagugaaaauggccagccagagaaaagaucucaagaaccagaaauaaauaaggauggug

SEQ ID NO: 340116 - RNA, 65 nt, hsa
gguaaagacauacucauuaaguguuauuuauuuuacucaagaacuggaaaccaacuaaaugccuu

SEQ ID NO: 340117 - RNA, 65 nt, hsa
ucaguauguucccaggcuaguguugaacuccugagcucaagaaauccuccugccugagucucuga

SEQ ID NO: 340118 - RNA, 65 nt, hsa
auagguuucugauuacauaaaauuugaauagaacacucaagaaguauguagauuuuugaaaaacc

SEQ ID NO: 340119 - RNA, 65 nt, hsa
cugugaauguuccaacaccugccuccacuucuccccucaagaaauuuucaacgccaggaaucaug

SEQ ID NO: 340120 - RNA, 65 nt, hsa
caugaagagacuucugcuuuucaacccccacccuccucaagaaguaauaauuuguuuacuuguaa

SEQ ID NO: 340121 - RNA, 65 nt, hsa
caaguuggaugcggccauucaaggggagccaaaaucucaagaaauucccagcagguuaccuggag

SEQ ID NO: 340122 - RNA, 65 nt, hsa
cccuccccagacaucuggacacugggcauagauuucucaagaaggaagacuccccugccucccca

SEQ ID NO: 340123 - RNA, 65 nt, hsa
ucauuugaaaacacugcaacagugaacuuuugcaucucaagaaaacauugaaaaauucuaugaau

SEQ ID NO: 340124 - RNA, 65 nt, hsa
ccgugucuuucucuaggacaagcucccagugaucacucaagaaucuggcucucauucuaagaggc

SEQ ID NO: 340125 - RNA, 65 nt, hsa
auugcauucaucuuguguuuuauaugagaaggugccucaagaauuuccuguuggauuuguuuaaa

SEQ ID NO: 340126 - RNA, 65 nt, hsa
gccugguucucaauuugacacccuaagcgaucauacucaagaauaguacagauguguggaauacg

SEQ ID NO: 340127 - RNA, 65 nt, hsa
cagaagugacuuauuaaacuauugaaggaaaaggacucaagaaaaauaauaaaagaccauaaaua

SEQ ID NO: 340128 - RNA, 65 nt, hsa
uuuuuugaaccuuauuucucaaaacuuauaguagccucaagaagucuauugauauuggucauguu

SEQ ID NO: 340129 - RNA, 58 nt, hsa; identical to SEQ ID NO: 339070

SEQ ID NO: 340130 - RNA, 65 nt, hsa
auuuugugcucugaguuuugcuguugaaagucucccucaagaauagcuucagauccucuugugua

SEQ ID NO: 340131 - RNA, 65 nt, hsa
ucaauaucauuuuaauguaauugauuguauauagucucaagaaugguuggugggcaugaguuccu

SEQ ID NO: 340132 - RNA, 65 nt, hsa
aaacuuuuguagcaaucuggucuauagacuuuuaacucaagaagcuaaggcuagacuuguuaccu

SEQ ID NO: 340133 - RNA, 65 nt, hsa
agaaaugucucuccucuagguaucguauuuuguugcucaagaauccaaaaugggucuguggacau

SEQ ID NO: 340134 - RNA, 65 nt, hsa
ugcugcuuaguuuuuggacugaaaagauauuaaaacucaagaaggaccaagaaguuuucauaugu

SEQ ID NO: 340135 - RNA, 65 nt, hsa
cgaggaguaacaauacaaauggauuuugggagugacucaagaagugaagaaugcacaagaaugga

SEQ ID NO: 340136 - RNA, 65 nt, hsa
ucaagacacagaacaaggucugucuccuauagucacucaagaagucgaucgagaaguuccacauc

SEQ ID NO: 340137 - RNA, 65 nt, hsa
caauuaauuagacuuuuguauaagagaugucaugccucaagaaagccauaaaccugguaggaaca

SEQ ID NO: 340138 - RNA, 65 nt, hsa
ucucccugaagcagacugcugaggaauuacauuugcucaagaauuuuuuccgucaaauugugaac

SEQ ID NO: 340139 - RNA, 65 nt, hsa
ugccuuaauuauuuaucuuuaguuccuuauuaguucucaagaaacaaaugcuagcuucauaugua

SEQ ID NO: 340140 - RNA, 65 nt, hsa
agugggucccuuccuuucuccuuuccucucuacugcucaagaacagauuugaggccaggugcggu

SEQ ID NO: 340141 - RNA, 65 nt, hsa
uuuauaagcaauguaauuaugcuauucacaggggccucaagaauugguauguaugaugugaucug

SEQ ID NO: 340142 - RNA, 65 nt, hsa
aauccuuauguagaaaggacuuugaaauuuuucuucucaagaaaugguuuguauaagaauaacaa

SEQ ID NO: 340143 - RNA, 65 nt, hsa
aaugauacugacugauuaauuauuccugauaacaucucaagaaaaggagaaggaaaguguuucug

SEQ ID NO: 340144 - RNA, 65 nt, hsa
ccuauaaaauugucagcguauuuuuacacuauuggcucaagaauguuauaaugcuaagggacaua

SEQ ID NO: 340145 - RNA, 65 nt, hsa
agaagaaaagauuaauaccuuaaaagaagaaaacacucaagaagcagcaguccugaaugguguuu

SEQ ID NO: 340146 - RNA, 65 nt, hsa
acugcacuccagccugggccacagagcaagacugucucaagaaaaaaaauuuuuuaaauaaguuu

SEQ ID NO: 340147 - RNA, 65 nt, hsa
uuauauuuuauacaaauagauugcuuagaaugguucucaagaauuauaagagaaaugaacucaca

SEQ ID NO: 340148 - RNA, 65 nt, hsa
uagauaagcaccuggcaucuaauggcaggcaggcacucaagaaaugaauuaacuacauaauggaa

SEQ ID NO: 340149 - RNA, 65 nt, hsa
ucguuucugugaauuucaugaagagcagaacauuucucaagaauccucuugagccaguaaucaau

SEQ ID NO: 340150 - RNA, 65 nt, hsa
uuuggagaauagaaaugaaaagccacgucauauaacucaagaauaaaugguguuuuggaaauuuu

SEQ ID NO: 340151 - RNA, 65 nt, hsa
gaucccugcugggcacaccccacaaaccccacucccucaagaagggccagggccagggcuguaug

SEQ ID NO: 340152 - RNA, 65 nt, hsa
uugugcaggacaguaaauaaugaaaaccaaauuuccucaagaaauaacugaagaaggagcaagug

SEQ ID NO: 340153 - RNA, 65 nt, hsa
gucagauguggucaguagggagcuccaugcccaagcucaagaacgacugcaacacuacuuuaugg

SEQ ID NO: 340154 - RNA, 65 nt, hsa
uacaauuuaauugcucaaccaugcauuuaaaacuccucaagaaaggauugguacugcaacuguag

SEQ ID NO: 340155 - RNA, 65 nt, hsa
auucuaaauuugaguaaauacaauuuuuuagguuacucaagaaccagcauuaguaauuucuagua

SEQ ID NO: 340156 - RNA, 65 nt, hsa
cuaagggaacacacaaagaauuacacaacguuuuccucaagaaaaugguacaaaacacaaccgag

SEQ ID NO: 340157 - RNA, 65 nt, hsa
uucuauaauggguuugggggauaauaauggugaagcucaagaacagaugucuauugaguagaacc

SEQ ID NO: 340158 - RNA, 65 nt, hsa
gcaggugaauuguggaaaaugucauguagcugacacucaagaaauagggauuccuaauaauggca

SEQ ID NO: 340159 - RNA, 65 nt, hsa
ucuggcuuuccugcuauacacauauucacauggcgcucaagaaguuaggcucauggcaacgugug

SEQ ID NO: 340160 - RNA, 65 nt, hsa
gucuucaucaaguggaagccaacuguccugccugccucaagaauauguguuuucuuuagcuuccc

SEQ ID NO: 340161 - RNA, 65 nt, hsa
auguaaauuugcucuguuuuaagacuuugaacuaccucaagaagaggaaucuaauacaauauuug

SEQ ID NO: 340162 - RNA, 65 nt, hsa
ccacaaguuuucacugaaugagcauggcagugccacucaagaaaaugaaucuccaaaguaucuuc

SEQ ID NO: 340163 - RNA, 65 nt, hsa
acagugcuuagaaguaagcaauucccaggucauagcucaagaauuguuagcaaaugacagauuuc

SEQ ID NO: 340164 - RNA, 65 nt, hsa
acuagugccaggucacuauuguaagauguuaaaaucucaagaaaauuucacagagcuaaagaaau

SEQ ID NO: 340165 - RNA, 65 nt, hsa
uagauaagaaaggacuacagcauuugauguguguccucaagaacuugucuugggucugaaaaagc

SEQ ID NO: 340166 - RNA, 65 nt, hsa
acccuauggccuucuugucaaaaccuucacuggagcucaagaaaagcauuucuguuguguuauuu

SEQ ID NO: 340167 - RNA, 65 nt, hsa
guugcuuaugggaauccugagcugcuuuucaccaucucaagaagccuaagaaguuauauauuuaa

SEQ ID NO: 340168 - RNA, 65 nt, hsa
cuuguagauaaaaguguuccaguaaucagaaaauccucaagaaaauugacuucauuauuuggaag

SEQ ID NO: 340169 - RNA, 65 nt, hsa
gugcccauuaccuuuccucugccugaaagacgugucucaagaaaaauaaauucuauuuuagaugc

SEQ ID NO: 340170 - RNA, 65 nt, hsa
uuaguauaucaucauaaaauagacaauguuuuugucucaagaacaagaauaaaauugaaaucugc

SEQ ID NO: 340171 - RNA, 65 nt, hsa
agaauaaaaagguaaaacuacauuuagacuucuuucucaagaaaucaaauacagcuuuuuuucaa

SEQ ID NO: 340172 - RNA, 65 nt, hsa
caaacgaacaagauuaauuaccugucuuccuguuucucaagaauauuuacguaguuuuucauagg

SEQ ID NO: 340173 - RNA, 65 nt, hsa
aaucuuuagacuacaauaauacuuuuauccaugugcucaagaaagggccccuuuuuccaacuuau

SEQ ID NO: 340174 - RNA, 65 nt, hsa
cagauauguauuugcuacucaaguguacagaucuccucaagaaacaucaagggacuccuguguca

SEQ ID NO: 340175 - RNA, 65 nt, hsa
uuaaauaaccgauuauugauuacuguauuuuuuuucucaagaacagugauagguagaaacuaauu

SEQ ID NO: 340176 - RNA, 65 nt, hsa
aaaagucaucauugcuguuuagcuugacuguuuuccucaagaacaucgaucugaaggauucauaa

SEQ ID NO: 340177 - RNA, 65 nt, hsa
aagaugcucuguagagaauuugcuaccgaaguuggcucaagaauuuguuuuuaguguuauuuacc

SEQ ID NO: 340178 - RNA, 65 nt, hsa
ucuggcaaaggccuuccugcauuuaugaauucucucucaagaagcaagagaacaccugcaggaag

SEQ ID NO: 340179 - RNA, 65 nt, hsa
aaugagaauuaagaauggacaggaccaagacagaacucaagaaagccacuggggaaaacucgaga

SEQ ID NO: 340180 - RNA, 65 nt, hsa
aaauauguucaacauuuacuucuauuugauaucugcucaagaagucauagaagucuugggaaacu

SEQ ID NO: 340181 - RNA, 65 nt, hsa
aaguaacauugucagaaauaaauaaaaccacaagucucaagaauuugccacguauguucaagggu

SEQ ID NO: 340182 - RNA, 65 nt, hsa
uuuucuucagguaacacuacagaguacgugaaaugcucaagaauguagucagacugacacuacua

SEQ ID NO: 340183 - RNA, 65 nt, hsa
aaaacaaaacacaguccugcauacucaccaccaagcucaagaaauaaaucaucaccaauaccuuu

SEQ ID NO: 340184 - RNA, 65 nt, hsa
cagccaacucauuggguuguagccaaagguucacucucaagaagcuuuaauauuuaaauaaaauc

SEQ ID NO: 340185 - RNA, 65 nt, hsa
aaauaucaccuagaaaaguagccucacucuuauuccucaagaauuaauauccaauguuuaugagu

SEQ ID NO: 340186 - RNA, 65 nt, hsa
aacaucagcauuguauacacauauuuucacuuuaacucaagaauuccaggagguaauuuguugau

SEQ ID NO: 340187 - RNA, 65 nt, hsa
uaucacaaauggcaauguaaaaaucaagacauuuucucaagaacuguguaccacuaaaaguaaua

SEQ ID NO: 340188 - RNA, 65 nt, hsa
ccaagaagcaugcagagaagaauugguuuguuggccucaagaagaaugggagcugcaaacgcggu

SEQ ID NO: 340189 - RNA, 65 nt, hsa
aggaaccaugccccuuccccaggcccccagcaagucucaagaacacagcugcacaggccuugacu

SEQ ID NO: 340190 - RNA, 65 nt, hsa
uaagaaauacaguuuguuuguauaaaauaaacuaucucaagaaaguuuucaacgacagugauagu

SEQ ID NO: 340191 - RNA, 65 nt, hsa
accuuugagaaauccuuuugugaagucauugccugcucaagaauguacaguggcuccccaaugcc

SEQ ID NO: 340192 - RNA, 65 nt, hsa
auacagaguguguucgcacuuagccaugggcugggcucaagaaccugauaccuggguugaugugg

SEQ ID NO: 340193 - RNA, 65 nt, hsa
agaaaacugccuaacugaagggaaugggggcccugcucaagaagggggccaggcagcuggaauca

SEQ ID NO: 340194 - RNA, 65 nt, hsa
cugggguaugagcugccaagucuauuuuaaagacgcucaagaauccucugggguucaucuaggga

SEQ ID NO: 340195 - RNA, 65 nt, hsa
gucauucagccaacccagaggauguagacccuguccucaagaagugcagggcgaguucugccgug

SEQ ID NO: 340196 - RNA, 65 nt, hsa
agcuguggaacgagacuucugcagagguggcugaccucaagaagcagguacaggcccuucagccc

SEQ ID NO: 340197 - RNA, 65 nt, hsa
cagacuagauuauauuuaguaggggaaaaauugggcucaagaaccauucaucaguacgugagaca

SEQ ID NO: 340198 - RNA, 65 nt, hsa
cugacuuguaagcaguucauagaagcugcucaauacucaagaaucuugcaagacaguuauuaaac

SEQ ID NO: 340199 - RNA, 65 nt, hsa
uaucuuguuuugaucauuuccacugcacauuucuccucaagaaaagcgaaaggacagacuguugg

SEQ ID NO: 340200 - RNA, 65 nt, hsa
cucagcaauuugaacacuaaccucuccccuccuggcucaagaauuacuccgaagucagucugcag

SEQ ID NO: 340201 - RNA, 65 nt, hsa
guucugagcaaauaacuacagggugcccauuaccacucaagaagacacuucacguauucuuguau

SEQ ID NO: 340202 - RNA, 65 nt, hsa
gaccgguagccuucaagcuuguccagcagaaccagcucaagaaaggagaugcccuagugguggcc

SEQ ID NO: 340203 - RNA, 65 nt, hsa
uguuuuacuccgugccuuacuggauuuggccuguccucaagaaugguaauuaugaagaguggaga

SEQ ID NO: 340204 - RNA, 65 nt, hsa
aaacagcguccauuuuuucauauuagagguggaaccucaagaaugacuuuauucuuguaucucau

SEQ ID NO: 340205 - RNA, 65 nt, hsa
ugcauugucuugcccuauagacucaggaguugcuucucaagaaagagccagcaaguauucucagc

SEQ ID NO: 340206 - RNA, 65 nt, hsa
cuuuuaaacauuaaguuugaaauaggaaugguuuucucaagaauagauuuggugugauaccuugu

SEQ ID NO: 340207 - RNA, 65 nt, hsa
uugagugaugagcagacauguuuaagggucuaagucucaagaaucuguuauguguguuugcugcg

SEQ ID NO: 340208 - RNA, 65 nt, hsa
aauauuuaaucuauuuaaucuucuugcauuuauuucucaagaauuacuggcuuuaaaagaagcca

SEQ ID NO: 340209 - RNA, 65 nt, hsa
uagcccucaauauuugguaaugcuauuuaaagugacucaagaagcaugugcuaucuggcuuugaa

SEQ ID NO: 340210 - RNA, 65 nt, hsa
gaaagaaauauuguugcucaguguuguuaauauagcucaagaauugaguuuauauuugcaguaug

SEQ ID NO: 340211 - RNA, 65 nt, hsa
uggacgagaagacucagccugagggccugcggagccucaagaagccagaccgcaagaagcgcuac

SEQ ID NO: 340212 - RNA, 65 nt, hsa
uuguggaacuuccucuuucauuggaaacuuucuuacucaagaaugacggcaguauuguuuucuua

SEQ ID NO: 340213 - RNA, 65 nt, hsa
ggacugucuucaucaaguauuucccuacagaacuccucaagaaaacagagaucauuuggcuagag

SEQ ID NO: 340214 - RNA, 65 nt, hsa
aggacucugggccccuccccagcuccacucccuaccucaagaaugugaccauuuggaaaaggcaa

SEQ ID NO: 340215 - RNA, 65 nt, hsa
ugccauguugccaaggcugguuucaaacuccuggacucaagaaauccacccaccucagccuccca

SEQ ID NO: 340216 - RNA, 65 nt, hsa
cugugacaguuccaggucuugaagcuaaucagcaucucaagaaaguauccagaaagaacaucugc

SEQ ID NO: 340217 - RNA, 65 nt, hsa
gauccuaagcucucaaaauagcauauucccuagagcucaagaaagcugguccaggagguugaaaa

SEQ ID NO: 340218 - RNA, 65 nt, hsa
ccguugugcuccagccugggcgacagaagucuugucucaagaagaaaacgaacugggaaaauuuc

SEQ ID NO: 340219 - RNA, 65 nt, hsa
cucccaugcccguucugaccucagccuuggaacuccucaagaaccugaagauuccaguggucagu

SEQ ID NO: 340220 - RNA, 65 nt, hsa
ggagauugggaaacuuaaccguuacccaggcaauacucaagaaggagaauccauuuagcaccucc

SEQ ID NO: 340221 - RNA, 65 nt, hsa
guuuuugcuguuguaaaaguguuuucauaaguucacucaagaaaaaugcagcuguucugaacugg

SEQ ID NO: 340222 - RNA, 65 nt, hsa
auaugucuguuuaaaaauuacuaauucucaaauggcucaagaacauuagaauuuaaguaccuuuu

SEQ ID NO: 340223 - RNA, 65 nt, hsa
cuguuagugucuucuuccugcccucagcaccacagcucaagaaaaccuaaaguuucaauacaagc

SEQ ID NO: 340224 - RNA, 65 nt, hsa
ccuacacccacgcacccccccacacacuaugcucucucaagaauguaauuuauuggggccccccc

SEQ ID NO: 340225 - RNA, 65 nt, hsa
cuuagaguccugccguggcucagguggaucuaaaacucaagaacaaauucuauuuauuuauuauu

SEQ ID NO: 340226 - RNA, 65 nt, hsa
aauauacuaucuaucucaccaguauuugcucucgacucaagaagguuaacauuuucugauucaug

SEQ ID NO: 340227 - RNA, 65 nt, hsa
caugacagcugucuguuguuuuaugaaguuuauuucucaagaaaaugggaauaaauuugggauuu

SEQ ID NO: 340228 - RNA, 65 nt, hsa
cccacucuagcuugggcaauagagcaaggcuccgucucaagaaaagaaggucauuucccaagacu

SEQ ID NO: 340229 - RNA, 65 nt, hsa
caguggaagcauguguguuucuaaaaaguaaaaaucucaagaaaacagaaauggcaugcuuuacc

SEQ ID NO: 340230 - RNA, 65 nt, hsa
uaauaaugcagagauaauuagacaugguucccgcccucaagaagcucacaaaaguauucaggaaa

SEQ ID NO: 340231 - RNA, 65 nt, hsa
caaguucuuuuggaacuuguuucaagccaaaaacucucaagaaagcaaauugcaccucagcugga

SEQ ID NO: 340232 - RNA, 57 nt, hsa; identical to SEQ ID NO: 339173

SEQ ID NO: 340233 - RNA, 65 nt, hsa
ucccuaaauuaucccauuauguaauucuuggucagcucaagaacuggguucuuuuucuaauaauu

SEQ ID NO: 340234 - RNA, 65 nt, hsa
ugagcuggaacaguaggggcagggagaagacaggucucaagaaaagguuuuuaagaaguuucauc

SEQ ID NO: 340235 - RNA, 65 nt, hsa
acuuccucuacucucccgugcacugccggccagagcucaagaagcugcugcacgggcugggccuu

SEQ ID NO: 340236 - RNA, 65 nt, hsa
uauuuuacucugaucaaauaaauaaugcuggaauacucaagaauugcauccucugaccuacuuca

SEQ ID NO: 340237 - RNA, 65 nt, hsa
gcgggaggaagcacugaaacaacacaaaacccuaucucaagaacuuguuaaccuccggggagagc

SEQ ID NO: 340238 - RNA, 65 nt, hsa
cuaaccacagggccugagaagucuugcuuuaugggcucaagaaugccaugcgcuggcaguacaug

SEQ ID NO: 340239 - RNA, 65 nt, hsa
uucccugauauuauuucuauuuaauacucuuuucucucaagaaaaaaaaaaaaguuuguuuuuuc

SEQ ID NO: 340240 - RNA, 65 nt, hsa
uauggugggagggaauguuuucaaauuucccauuucucaagaaauguucauauuaauugaggauu

SEQ ID NO: 340241 - RNA, 65 nt, hsa
ucauuuugaugauucugagaagaaacuuguccuuccucaagaacacagcccugcuucugacauaa

SEQ ID NO: 340242 - RNA, 65 nt, hsa
aaaaauaaccaaaaaaugugagcuauaauguuucccucaagaacaaacagaaacgagauuugcca

SEQ ID NO: 340243 - RNA, 65 nt, hsa
ugucagccccaguuggcuuccuggucaacaaggaccucaagaacugccuguggaccgaggccccc

SEQ ID NO: 340244 - RNA, 65 nt, hsa
aaugcagagguaacucucaggcagcuaagcagcaccucaagaaaacauguuaaauuaaugcuucu

SEQ ID NO: 340245 - RNA, 65 nt, hsa
ucugagaguagcugcugcuuucccugacuuccuuccucaagaauacagucuauucugggggguug

SEQ ID NO: 340246 - RNA, 65 nt, hsa
cagauuuuccucugacaccagagaacaauaguagucucaagaauggaaaccugaaugucugaggg

SEQ ID NO: 340247 - RNA, 65 nt, hsa
gaaaaacuucaguuacugaccagucaagagaauuucucaagaaaaaucccagcaacguucccucu

SEQ ID NO: 340248 - RNA, 65 nt, hsa
uucaagcacaaagugaugaaugacugccuucaagucucaagaaaacacuuuucccuaacuuuuag

SEQ ID NO: 340249 - RNA, 65 nt, hsa
aauuugggugagcugcaccugauuaguugaaaggccucaagaacaaacacugcaguuuccuggaa

SEQ ID NO: 340250 - RNA, 65 nt, hsa
acaacuguggaguugguagcugguaacauuguugucucaagaacaacucaccucucucccuagga

SEQ ID NO: 340251 - RNA, 65 nt, hsa
cacaacuaaaccuucuuaauauccgccacagaaggcucaagaauccagcccuaaaauucucucca

SEQ ID NO: 340252 - RNA, 65 nt, hsa
gaacuaccucauaugcaggaugagccaauggcagucucaagaaauguacucgggcgacaccuuac

SEQ ID NO: 340253 - RNA, 65 nt, hsa
acuuuucugacauuccuagacagguucauucuuugcucaagaaaggccugaaugacaauguccag

SEQ ID NO: 340254 - RNA, 65 nt, hsa
uaauacaacaagaucaacuagaagaauucaacugucucaagaaucaagguaccccaauauaucuc

SEQ ID NO: 340255 - RNA, 65 nt, hsa
cauugaagggagaaaggcaagaugugcacucuggacucaagaaacucuuaguucaguggaggaaa

SEQ ID NO: 340256 - RNA, 65 nt, hsa
agucacugugagcucccaggugcagccagaggcaccucaagaagaagaggggcauaaacuuuccu

SEQ ID NO: 340257 - RNA, 65 nt, hsa
aauucagaugaguuagaagcuuuuuaucccuuccucucaagaaaauauucuuucacccugucucu

SEQ ID NO: 340258 - RNA, 65 nt, hsa
aaagugacauaauuuacaugcaauauguuuaucaacucaagaauuuaauauaguugguacacaac

SEQ ID NO: 340259 - RNA, 65 nt, hsa
auggauacauuaggagcuucaaacacauauaauuucucaagaaauuuccagaugucucaugcugc

SEQ ID NO: 340260 - RNA, 65 nt, hsa
cuauuaaggaagaacaaggaagggaaugaucuuuacucaagaauuucagaaagucagcacugaag

SEQ ID NO: 340261 - RNA, 57 nt, hsa; identical to SEQ ID NO: 339202

SEQ ID NO: 340262 - RNA, 65 nt, hsa
aagaaggcugcuaauuggauuuugguaguucuuaccucaagaaaacuugaauuauuugggggaaa

SEQ ID NO: 340263 - RNA, 65 nt, hsa
cuaagcuuaugaaggaaugccuccuuuguuacacacucaagaauuugucagcacacaauuaauug

SEQ ID NO: 340264 - RNA, 65 nt, hsa
uaauaauucagaaauuggguuuugguucagugauucucaagaaaaagaucucuugcccauuaaga

SEQ ID NO: 340265 - RNA, 65 nt, hsa
ucacaaaauccaaggugcuacaggaaacaagcacacucaagaaaguuuuuuucugaauaacauuu

SEQ ID NO: 340266 - RNA, 65 nt, hsa
uuaaagaaaacugaacugaggaaaaugguguuuuccucaagaagacuacuggaacuggaugaccu

SEQ ID NO: 340267 - RNA, 65 nt, hsa
cauuuuccaucuccaaauagccaggcccucucucccucaagaaaugcccagauguagaaauucau

SEQ ID NO: 340268 - RNA, 65 nt, hsa
agaaaguucauuucaucacuuagaaaauaugucuucucaagaacaaaacugugcuguuacaacuc

SEQ ID NO: 340269 - RNA, 65 nt, hsa
ccuggcucucucucugcugccucuucauacguuuucucaagaacuucaguuuauaauuggaagag

SEQ ID NO: 340270 - RNA, 65 nt, hsa
gcuccucuauccgaggccauuggagaccccaguuucucaagaauucagcucugcucugagcgucc

SEQ ID NO: 340271 - RNA, 65 nt, hsa
cagguugaguccagaugcuucucaccuucuuucuccucaagaaagaugcuuuuugggaaacguug

SEQ ID NO: 340272 - RNA, 65 nt, hsa
guuccacagacagaugaggcaggagugauggggcacucaagaaaguucagaggaggcauaagcua

SEQ ID NO: 340273 - RNA, 65 nt, hsa
cuuggaucuuggcaugcacccaccuaacccacuuucucaagaacaagaaccuagaaugaauaucc

SEQ ID NO: 340274 - RNA, 65 nt, hsa
cacucccagaagaccaaacugccuuccccucagggcucaagaauguguacagucuguggggccgg

SEQ ID NO: 340275 - RNA, 65 nt, hsa
uuucuccuuuuguguuuuucccacuuuccaauguacucaagaaaauugaacaaauguaauggauc

SEQ ID NO: 340276 - RNA, 65 nt, hsa
uccugacuaaggagcugcagcgauacaucgaagggcucaagaagcgccggagcaagaggcuguac

SEQ ID NO: 340277 - RNA, 65 nt, hsa
agccccagagggcuuuguggaggacaggccuugcccucaagaacgucguaccugacgcugagccu

SEQ ID NO: 340278 - RNA, 65 nt, hsa
cuugagcuuuuuggaaggauaauucugauaaggcacucaagaaacguacaaccacagugcuuucu

SEQ ID NO: 340279 - RNA, 65 nt, hsa
ggagacccgccaccguggaggcagggggcaagaaacucaagaacgcaucaagagcaccagcccug

SEQ ID NO: 340280 - RNA, 54 nt, hsa; identical to SEQ ID NO: 339221

SEQ ID NO: 340281 - RNA, 65 nt, hsa
gaaccucacgcaccucccauccuaaucauccaaugcucaagaaacaacuucuacuucugcccuug

SEQ ID NO: 340282 - RNA, 65 nt, hsa
ccacuuuucagagucaucuacaaaauuuuucuuuccucaagaaaagaguuccuuuugccuuauuc

SEQ ID NO: 340283 - RNA, 65 nt, hsa
ggcugacuuaggaucaugcuggaaggaagccaagucucaagaacugucagcaacagaaaaugaga

SEQ ID NO: 340284 - RNA, 65 nt, hsa
aagccccuggaucuuugggguaaaaggaggguggccucaagaaacaaugucuggggacaggccuu

SEQ ID NO: 340285 - RNA, 65 nt, hsa
ccucaugccuaacaguggucuguuuuuauaugagacucaagaacaggccucauuccagggcacag

SEQ ID NO: 340286 - RNA, 65 nt, hsa
aagaggaggagggauucuggucuucacugccaugccucaagaacaccuuuguuuugcacugacaa

SEQ ID NO: 340287 - RNA, 65 nt, hsa
acugggaaugcugggaaaugagauacauucccgcccucaagaaucucccagucugguaggagaga

SEQ ID NO: 340288 - RNA, 65 nt, hsa
acaggagacaugagucuuugccggaggaaaagcagcucaagaacacaugugcagucacugguguc

SEQ ID NO: 340289 - RNA, 65 nt, hsa
aauauuccuauugaucucauuuuauuuagcaucagcucaagaaacuaagucuuagugcacaguau

SEQ ID NO: 340290 - RNA, 65 nt, hsa
uccauaaugagauaaugcauguaggggaaaaguuucucaagaagguggaagaggcagcaggacuu

SEQ ID NO: 340291 - RNA, 65 nt, hsa
ccauuuauggcaugauuagauugcaaagcaaugaacucaagaaggaauugaaauaaggagggaca

SEQ ID NO: 340292 - RNA, 65 nt, hsa
acuaguuuggauaucuuuaggguuuagaaucuaaccucaagaauaagaaauacaaguacaaauug

SEQ ID NO: 340293 - RNA, 65 nt, hsa
cacccaucuuuuuucuucccucauuuucugggauucucaagaaagaaaaaguaacccauuaucac

SEQ ID NO: 340294 - RNA, 65 nt, hsa
gcccuuuuggacuaauguuacuguccaaguucuuucucaagaaaccacaucugguucagaagagu

SEQ ID NO: 340295 - RNA, 65 nt, hsa
uuuuuuaaauuuuuuuauaggcccauaugcucuaucucaagaaacaagaugauuguaacaugucc

SEQ ID NO: 340296 - RNA, 65 nt, hsa
auaacuuuccuuuauuucacuuguacccaguuucacucaagaaaucuugaugaauauuuauguug

SEQ ID NO: 340297 - RNA, 65 nt, hsa
uagacccucucuauagccaugagacuccuuguggccucaagaaauuuagacgcccacgacagcac

SEQ ID NO: 340298 - RNA, 65 nt, hsa
ucagccgcacccgugugcacuguaacuuuugugugcucaagaaauuauacagaaaccuacagcug

SEQ ID NO: 340299 - RNA, 65 nt, hsa
accacuccuggagaaagacuuccuugcaggagugacucaagaauuaaucaguaaauaccuugaaa

SEQ ID NO: 340300 - RNA, 51 nt, hsa; identical to SEQ ID NO: 339241

SEQ ID NO: 340301 - RNA, 65 nt, hsa
uauuuccuucauaaagaaugccacccaucugauuccucaagaaucuagaccuagaaauaccauuu

SEQ ID NO: 340302 - RNA, 65 nt, hsa
guuaggaaaaaaaaauccaagaaauguauugaauacucaagaaaaugccacauuucaauuacaua

SEQ ID NO: 340303 - RNA, 65 nt, hsa
gaucucauaugaucuucuucaagccauuauuuuaacucaagaaaacucuagagaagaaaagugaa

SEQ ID NO: 340304 - RNA, 65 nt, hsa
ggcacuccacugcagcaggagggacuuaagcuagacucaagaaagcagcuuggagccucuagguu

SEQ ID NO: 340305 - RNA, 65 nt, hsa
auuaaaaauaguaagccucccuccucguccccugccucaagaaauugccuccuuauuuaucaaca

SEQ ID NO: 340306 - RNA, 65 nt, hsa
agcaugguaugagcacaggucauggacagccccugcucaagaaaaagcaugagcuggccacacau

SEQ ID NO: 340307 - RNA, 65 nt, hsa
auuuuugaaaaauagucaccaacuguauauacuuccucaagaacugauaauucauuauaucauca

SEQ ID NO: 340308 - RNA, 65 nt, hsa
cgcucugccauucaacucggaaacuauaaguaauucucaagaaagcccucauuuuuauaaccugg

SEQ ID NO: 340309 - RNA, 65 nt, hsa
uacuuuuuacuguuugccaaaacacuugaaugugccucaagaaaagguaccuacuacaugcugua

SEQ ID NO: 340310 - RNA, 65 nt, hsa
aguucuauacuggauccuuucuuucucuaauaauccucaagaaauccuuacagguaaguauugcu

SEQ ID NO: 340311 - RNA, 65 nt, hsa
aguacuggagagaugggauccuucuagauacagggcucaagaagucugcugggaguccccugagu

SEQ ID NO: 340312 - RNA, 65 nt, hsa
caucaggguccucagugcagagcaacuuacgcauccucaagaauccacugcuuuucaggcaagga

SEQ ID NO: 340313 - RNA, 65 nt, hsa
ucccacgugggcaauaccagggacccauggggaaacucaagaaugacagcuucuauauuuuguaa

SEQ ID NO: 340314 - RNA, 65 nt, hsa
uccacuaagaaggccugucuacacugcaggggaaccucaagaacuuuucauugcacuucuaaaau

SEQ ID NO: 340315 - RNA, 65 nt, hsa
ucaaaaggaagagccuuuuaaaaacauuugccaaccucaagaauaaauacugaaagucuugaaag

SEQ ID NO: 340316 - RNA, 65 nt, hsa
cuuaggauucugacuaagaggcaaaagagaaaagacucaagaaacugauccuggagaucgagacc

SEQ ID NO: 340317 - RNA, 65 nt, hsa
ugggagccaggaguaagacaagugggauuuggggccucaagaaauauacucucccagauuuuuac

SEQ ID NO: 340318 - RNA, 65 nt, hsa
guuuuguuuuaacaaaauuagcugaagaaguuauucucaagaaaauuggauguuuucauuggccu

SEQ ID NO: 340319 - RNA, 65 nt, hsa
uguuauaugacaucauccugaagaacuucgagaagcucaagaagcccaggggagaaacaaaggga

SEQ ID NO: 340320 - RNA, 65 nt, hsa
gaaagauuacauacauuugagaauaagaaauuacucucaagaacuucagaaaucugcaacauaau

SEQ ID NO: 340321 - RNA, 65 nt, hsa
agauauuucccauaaaugggaaguuugcccauugucucaagaaauguguauuucagugacaauuu

SEQ ID NO: 340322 - RNA, 65 nt, hsa
uuaacauuuugggaaguaacugccucugacuucaacucaagaaaacacuuuuuuguugcuaaugu

SEQ ID NO: 340323 - RNA, 65 nt, hsa
aaaagaagacugacuggguggaggcucugccuugccucaagaaccauccccugcagagcauccag

SEQ ID NO: 340324 - RNA, 65 nt, hsa
cguaggccuugcaucucgccaccuccacuucuguccucaagaacaaguccuaggucaagggaaac

SEQ ID NO: 340325 - RNA, 65 nt, hsa
uaaaggaagugaaaauagccagccagaggaaaugucucaagaaccagaaauaaauaaggguggug

SEQ ID NO: 340326 - RNA, 65 nt, hsa
ggaauuagugcuggauuugaagcuacgcacucagccucaagaacucccuggaauaucccugagaa

SEQ ID NO: 340327 - RNA, 65 nt, hsa
agauggcccugggaaucaauuccucaggaauugcccucaagaacucugcuucuugcuuugcagag

SEQ ID NO: 340328 - RNA, 65 nt, hsa
caaaucuuagaguucauaaauuuacuugagguugccucaagaacucagggaacaauacuguaaac

SEQ ID NO: 340329 - RNA, 65 nt, hsa
gaaugaagaauggaaauggaaaaggguggcugcgacucaagaauaauaugggagcccaugaggag

SEQ ID NO: 340330 - RNA, 65 nt, hsa
agaaggagauaaacaugaccaucgucaaagaccugcucaagaaauuuuuaaaaaagaaacaaagu

SEQ ID NO: 340331 - RNA, 65 nt, hsa
aaauuucuuauuugcuagggaacugguaaucuaggcucaagaaguguguggagaagguuuauuuu

SEQ ID NO: 340332 - RNA, 65 nt, hsa
ugcaucaguguggacuccuagaacgugcgaccugccucaagaaaaugcaguuuucaaaaacagac

SEQ ID NO: 340333 - RNA, 65 nt, hsa
uuccuccucaggacauggagaucugugcagaugagcucaagaagguccuuaacacagucgugaac

SEQ ID NO: 340334 - RNA, 65 nt, hsa
caguacaccuguagauauuacuguacuuuuauguucucaagaaauaaguuguugccuauucagug

SEQ ID NO: 340335 - RNA, 65 nt, hsa
uuacugauucauacauuaucucacuugugccaacacucaagaagcaggcuacacugacacuggua

SEQ ID NO: 340336 - RNA, 56 nt, hsa; identical to SEQ ID NO: 339277

SEQ ID NO: 340337 - RNA, 65 nt, hsa
gggcuccacuucauccagaugaaggaaaggaagaccucaagaaaaauucacaguugagugcaucc

SEQ ID NO: 340338 - RNA, 65 nt, hsa
agaaggagauaaacaccaccaucaucaaagagcugcucaagaaauuuuuaaaaacgaaacaaagu

SEQ ID NO: 340339 - RNA, 65 nt, hsa
aaggaacuuuauaaugaaacgguucggaauacuggcucaagaaccuaugucaagaugagcugaau

SEQ ID NO: 340340 - RNA, 65 nt, hsa
agaugugagcugcuaaauugacuggccuugcagagcucaagaagggggcuuccaaugcugugaga

SEQ ID NO: 340341 - RNA, 65 nt, hsa
agccccucucucacacaucacauucccaugguggccucaagaaaggcccggaagcgccaggcugg

SEQ ID NO: 340342 - RNA, 65 nt, hsa
uguguucuuagugauucacauccacgggacaaaaacucaagaagaaauaagagcugacgccacac

SEQ ID NO: 340343 - RNA, 65 nt, hsa
cagagggagugugcgaaucuacccugaccaaugggcucaagaauaaaguaugauuuuugagucag

SEQ ID NO: 340344 - RNA, 65 nt, hsa
aauugagggcuaaaucccaagugucucuugacuggcucaagaauuagggccccaacuacacaccc

SEQ ID NO: 340345 - RNA, 65 nt, hsa
caccuacuuguggcgaucugaguacucuacucuugcucaagaaguaauacgacaaucagaauaca

SEQ ID NO: 340346 - RNA, 65 nt, hsa
cagagggagugugcgaaucaaaccugaccaagcggcucaagaauaaaauaugaauugagggcccg

SEQ ID NO: 340347 - RNA, 65 nt, hsa
auacaaauuuggccuuaagaacugugucuggcguucucaagaaucuagaagauguguaaacaggu

SEQ ID NO: 340348 - RNA, 65 nt, hsa
ugaugaaugcccgcagugagcuauacuuacgcuuccucaagaagaggauuagcucugauuuugag

SEQ ID NO: 340349 - RNA, 65 nt, hsa
uacuacaaaauuaugucugcaccagugaauccauucucaagaaaagucuuaacuaggaaacuaaa

SEQ ID NO: 340350 - RNA, 65 nt, hsa
gggaacacaggcaaauuauuuguggggguaggaaucucaagaauugcgaaagucaaauauggaga

SEQ ID NO: 340351 - RNA, 65 nt, hsa
uccucaccaagcucauuacaucugccagggccugccucaagaagcccagcccagccuuuuccugg

SEQ ID NO: 340352 - RNA, 65 nt, hsa
uagugguauauuuauguaagaaaaugacuguaaaucucaagaaaaaucucagcagcuaauagcaa

SEQ ID NO: 340353 - RNA, 65 nt, hsa
guguaaccauuuguuaacuguacugaagguguguccucaagaagaaaguguucaaauuaaaaaag

SEQ ID NO: 340354 - RNA, 65 nt, hsa
gucucuaccaaaaguuaaaaaaaaaaaaaaaaaagcucaagaaccugcacgagggccuaaaacag

SEQ ID NO: 340355 - RNA, 65 nt, hsa
ccuucucuguuuaguaguugguuggggaaguggggcucaagaaggauuuugggguucaccagaug

SEQ ID NO: 340356 - RNA, 65 nt, hsa
agaaaaggggcuggaaaggggggaauggcccacaucucaagaagcaagauauuguuugugguggu

SEQ ID NO: 340357 - RNA, 65 nt, hsa
ggaacagcauggauuccguggauagcuguugcagucucaagaagacugagagcuuccaaaaugcc

SEQ ID NO: 340358 - RNA, 65 nt, hsa
cacaccaacauuuugcugccuaccuuguuauccuucucaagaagcugaaguguacgcccucuccc

SEQ ID NO: 340359 - RNA, 65 nt, hsa
uguauauaccaccuaggaggagaugccaccaagcccucaagaaguugugcccuuccccgccugcg

SEQ ID NO: 340360 - RNA, 65 nt, hsa
ggccacgugucccagcccagcguccaguggugccucucaagaaaccccgaacgaauguucggaug

SEQ ID NO: 340361 - RNA, 65 nt, hsa
cguacaucauuauuaauauaaaaauaacaggcagccucaagaaugugcugagauuucucuggaaa

SEQ ID NO: 340362 - RNA, 65 nt, hsa
ucccugaagcuggauucuuucauacgauacucuuucucaagaagggggcucccugggaucuccag

SEQ ID NO: 340363 - RNA, 65 nt, hsa
gcaggccugcaggguguggggaaggaggacacaaccucaagaaaggaagcgugaaccccagggaa

SEQ ID NO: 340364 - RNA, 65 nt, hsa
aguuugacacaaacucacacaaccaugacgcacugcucaagaacuacgggcugcucuacugcuuc

SEQ ID NO: 340365 - RNA, 65 nt, hsa
aguuugacacaaaaucgcacaacgaugacgcacugcucaagaacuacgggcugcucuacugcuuc

SEQ ID NO: 340366 - RNA, 65 nt, hsa
aguuugacacaaacucgcacaaccaugacgcacugcucaagaacuacgggcugcucuacugcuuc

SEQ ID NO: 340367 - RNA, 57 nt, hsa; identical to SEQ ID NO: 339308

SEQ ID NO: 340368 - RNA, 65 nt, hsa
uuugugagugcuuuggaauuuaaaugauuguauaacucaagaagauuacuuuucuauguugcuca

SEQ ID NO: 340369 - RNA, 65 nt, hsa
cuccagacgaugcauuucuuggccaaaguggcuuccucaagaaagcagcacuuaccuuugaaaaa

SEQ ID NO: 340370 - RNA, 65 nt, hsa
ucaaauggcuucacaguccuuacuucucuaccugccucaagaaggggcucagagcagagacuugu

SEQ ID NO: 340371 - RNA, 65 nt, hsa
agcaaacauucuuccuaaaaggaagacuucauuuucucaagaaaugggauuaguuggggguauua

SEQ ID NO: 340372 - RNA, 65 nt, hsa
uauaacuuuaaaaauaauacuuuuagcucuaauagcucaagaacacaauauucguuaauguucag

SEQ ID NO: 340373 - RNA, 65 nt, hsa
agagggcacugaagaccugaaucuacacuaguaaucucaagaaagauuauucauucuaucucaga

SEQ ID NO: 340374 - RNA, 65 nt, hsa
ccaugacgagcucuagcuggaugggcgcagagaaccucaagaaggcaugaagccagccccugcag

SEQ ID NO: 340375 - RNA, 65 nt, hsa
agcgcuccagccuggucgacagagugagacuccaucucaagaaaaaauaaaaauaaaguuguucu

SEQ ID NO: 340376 - RNA, 65 nt, hsa
ugcuuugggaggcugaggcaggaggaucacucgagcucaagaauucaagaccugggcaagagaga

SEQ ID NO: 340377 - RNA, 65 nt, hsa
ugcacuccagccugggcgacagagcaagacucugucucaagaagaaaaaaaaaauacauauacac

SEQ ID NO: 340378 - RNA, 65 nt, hsa
gauuuauaugcaugaaguuaaaacaacugacguuacucaagaauuagaaaacuuugcaagauuug

SEQ ID NO: 340379 - RNA, 65 nt, hsa
ugcacuucagccugggcgacacagcgagacccugucucaagaaagaaaagaaaaagagacaaauu

SEQ ID NO: 340380 - RNA, 65 nt, hsa
ucuucuccagcgcugggcccucccuugcccccaagcucaagaagggggcacugcccggcccggcu

SEQ ID NO: 340381 - RNA, 65 nt, hsa
ccgaccuacgccacuggaaacacacccaccgcaaccucaagaaccagacugugcagagggcauug

SEQ ID NO: 340382 - RNA, 65 nt, hsa
ugcauuccagccugugcgacagaaugagacacugucucaagaaaaaauaaaagugggaaaaucuu

SEQ ID NO: 340383 - RNA, 65 nt, hsa
uacaggaccccccaagucuuccuacccucugcacccucaagaaacccccagugccuuguaugaag

SEQ ID NO: 340384 - RNA, 65 nt, hsa
acuuccuucauuaacaaagacccuuguucuuaucccucaagaagaaacccaccauaaccagccca

SEQ ID NO: 340385 - RNA, 65 nt, hsa
gcauguaccuauugacuguauccucaugcauuuuccucaagaaugucugaagaagguaguaauau

SEQ ID NO: 340386 - RNA, 65 nt, hsa
cccgccgggcuacgaugacauguaccugugaaggccucaagaauguaacaucccaggcuucccuc

SEQ ID NO: 340387 - RNA, 63 nt, hsa
ugcacuccagcccgggcaacagaguaagacccugccucaagaaaaaaaaaaaaaaaaaaaauc

SEQ ID NO: 340388 - RNA, 65 nt, hsa
guggccaggugccggcacagugccucucccagagccucaagaagggccauuuaggagcuugcuuc

SEQ ID NO: 340389 - RNA, 65 nt, hsa
ugcaccgugccugacucauccaguggggaaggugacucaagaaguuguuuaagccuaggccuagg

SEQ ID NO: 340390 - RNA, 65 nt, hsa
uaaaagcuguugcuggaaacuugcuuuaggaacagcucaagaaccuuggaguucauauuucacaa

SEQ ID NO: 340391 - RNA, 65 nt, hsa
cgagagaagaggaguggaugagccugcggguuugccucaagaaacuucaugagggucucuuacua

SEQ ID NO: 340392 - RNA, 65 nt, hsa
gucucuauggcgcuuccuugaguggaaggaaaugucucaagaaacaaagaucucgcuggugcgua

SEQ ID NO: 340393 - RNA, 52 nt, hsa; identical to SEQ ID NO: 339334

SEQ ID NO: 340394 - RNA, 65 nt, hsa
ggaaaaucuugcuuuuauggucuuccccccucgcccucaagaacaagggccuugugcgugggccu

SEQ ID NO: 340395 - RNA, 65 nt, hsa
gacuuguuuauuuucuaguagcuuuuauaaguacacucaagaauuugucagggagaauaauucug

SEQ ID NO: 340396 - RNA, 65 nt, hsa
agauccagguuuacuuucuaucagcugagcaaccucucaagaaaaaauaaauaaauaaauaaacc

SEQ ID NO: 340397 - RNA, 65 nt, hsa
aauguguucuguauaaacaaaugcagcuggaaucgcucaagaaucuuauuuuucuaaauccaaca

SEQ ID NO: 340398 - RNA, 65 nt, hsa
ugguccugaagacuccggccaagaggcacaagcagcucaagaacaagcuggagaagaacgaggag

SEQ ID NO: 340399 - RNA, 65 nt, hsa
cauacuuuccuguauaguucacguuucauguaauccucaagaaauaaaaggaagccaaagagugu

SEQ ID NO: 340400 - RNA, 65 nt, hsa
uuuuacuguaggugaaggcuguauuuguaguaguacucaagaaucaccugauguuuucuuauucu

SEQ ID NO: 340401 - RNA, 65 nt, hsa
gggggauuuggcuggugccgaaguguuucugaagucucaagaacugccauaaaaucucacgcugc

SEQ ID NO: 340402 - RNA, 65 nt, hsa
aaggucgggacauauauuuacauagaucccagacacucaagaauuagcacagcugauguaaaauu

SEQ ID NO: 340403 - RNA, 65 nt, hsa
ggauguccauuucggggagaggagcaggugggacccucaagaaaaugacggagaacaucccagac

SEQ ID NO: 340404 - RNA, 65 nt, hsa
cggcuuuugaaacuuagguauuuuauauuuuuccccucaagaacuuuuuuuuaagagacagauuu

SEQ ID NO: 340405 - RNA, 65 nt, hsa
cuccucccagcggccuccggcgucuugcccagcagcucaagaagaaaaagaaggacugaacucca

SEQ ID NO: 340406 - RNA, 65 nt, hsa
ccuuucucgaaauugccaguguguacuuggcuuaacucaagaacaguuucuucuggauuccuuau

SEQ ID NO: 340407 - RNA, 65 nt, hsa
gccuuucuacaaagcaaggcccacagacuaccccacucaagaacagcagguaugugggccagagg

SEQ ID NO: 340408 - RNA, 65 nt, hsa
aggaggcucccuguacuggagucgucccacuauuccucaagaaaucuuagaaccagcuugugagg

SEQ ID NO: 340409 - RNA, 65 nt, hsa
gugaucuguacaaguauguggagcaugaaugcugacucaagaaacuuuuacuccuucugcucaag

SEQ ID NO: 340410 - RNA, 65 nt, hsa
uugugagcgaauuagcaauaacauacaugagauaacucaagaaaucaaaagauaguugauucuug

SEQ ID NO: 340411 - RNA, 65 nt, hsa
guuauaaaaauguauaggcaguauacacagcacuacucaagaagccaaagaaacacuugugcagu

SEQ ID NO: 340412 - RNA, 65 nt, hsa
gcucaccccucucugaagggcuguuguucugcuuccucaagaaauuaaacauuuguuucugugug

SEQ ID NO: 340413 - RNA, 65 nt, hsa
ugcacuccagccugggugacagagugagacucugucucaagaaggaaaaaaaaaaaaaagaaugu

SEQ ID NO: 340414 - RNA, 65 nt, hsa
cugccagaggaugagugaccaguugcuaaguggggcucaagaagcaccgccuuccccacccccug

SEQ ID NO: 340415 - RNA, 65 nt, hsa
uucugucacaaauguuccugaaagcaccacagcuacucaagaagaucaaauucaggacauaaacu

SEQ ID NO: 340416 - RNA, 65 nt, hsa
agucaaucugaaagauuuuucaagaaucuuaaaaucucaagaagugaagcagauucauacagccu

SEQ ID NO: 340417 - RNA, 65 nt, hsa
gagugaugcagacuuguucuucuuuuuaaagcagucucaagaauaagcauuucuuuaaaauguuu

SEQ ID NO: 340418 - RNA, 65 nt, hsa
ugagaacacaagaacuuaagagaaaaagaaaccuacucaagaaaagacagaagagacagugauuu

SEQ ID NO: 340419 - RNA, 65 nt, hsa
agaaugacaaacacaagugccccuuuucucuggaucucaagaaugguggaggacccuggaaggac

SEQ ID NO: 340420 - RNA, 65 nt, hsa
uuucuugcacuaucacaauugcuuuuuaguuauuucucaagaagcauguucguauuagagacaaa

SEQ ID NO: 340421 - RNA, 65 nt, hsa
caaaaccuucgucucuuugugcuuuguaaagcaaacucaagaaaacugguacaccuguaccagcu

SEQ ID NO: 340422 - RNA, 65 nt, hsa
gaaagaauuagcaguaaaauacaugagauaaagaccucaagaaguuaaaagauacuuaauucuug

SEQ ID NO: 340423 - RNA, 65 nt, hsa; identical to SEQ ID NO: 340410

SEQ ID NO: 340424 - RNA, 65 nt, hsa
gcagacagacugcaccaccccuucccccccugcaucucaagaauaaagcaagcugccuuuguacu

SEQ ID NO: 340425 - RNA, 65 nt, hsa
uuauuuuagguauuaagacugagaaauauuuaaagcucaagaagaacacagaagcacacaucccu

SEQ ID NO: 340426 - RNA, 65 nt, hsa
ugucuaacgagagacaucaguuucucaggaugauccucaagaacguuauggaguccauguugcaa

SEQ ID NO: 340427 - RNA, 65 nt, hsa
gccaagagcgucagguggcaaaaguccuucuguuacucaagaaaaugcucugaaaaauuccuuuu

SEQ ID NO: 340428 - RNA, 66 nt, hsa
caggugugauuugugcaagccagguucaacccuugccucaagaaaucagaugggaccaauuuagug

SEQ ID NO: 340429 - RNA, 66 nt, hsa
ugggaagauggcuggugaggagcuuaacagaggaaccucaagaagauucugaaaauccuaccccca

SEQ ID NO: 340430 - RNA, 66 nt, hsa
agggcaauacugaagggguuaaacagguuuuugcuccucaagaauuuguuugccugggcccaggau

SEQ ID NO: 340431 - RNA, 66 nt, hsa
augauaacacuuaccaaaagaucacugcaaaccugccucaagaagcugaugguggcacuucaauuu

SEQ ID NO: 340432 - RNA, 66 nt, hsa
aggaaguccuuuuuuuuuuuuuuuuuuuuuuaauugcucaagaaaugauucucucacaggcuuggg

SEQ ID NO: 340433 - RNA, 66 nt, hsa
gugacugaugacaucugacuuuugucgaugggacuucucaagaagccauuccuuggagcuucuguu

SEQ ID NO: 340434 - RNA, 66 nt, hsa
cgcauacugccaugaagacggucucuguguccucagcucaagaauccuguagcuugucccaucaua

SEQ ID NO: 340435 - RNA, 58 nt, hsa; identical to SEQ ID NO: 339023

SEQ ID NO: 340436 - RNA, 66 nt, hsa
aggauuccuccaugguaaagcugaacugaaacaauucucaagaaugcaucagcuguaccuacaaua

SEQ ID NO: 340437 - RNA, 66 nt, hsa
uucaaucugaagauguaagacuuccugaaacaaguucucaagaagucuuuacauuauauuuauaac

SEQ ID NO: 340438 - RNA, 66 nt, hsa
auuuugaauauuggggaaggaagaugauacuucuuucucaagaaaagaaaauuggauuauuaggaa

SEQ ID NO: 340439 - RNA, 66 nt, hsa
gaugucauaagcgaucacuuccuauaugcacuuauucucaagaagaacaucuuuaugguaaagaug

SEQ ID NO: 340440 - RNA, 66 nt, hsa
agugugaaugcugaacugaaggcucagauugaggagcucaagaacgagaagcagcauuugauauac

SEQ ID NO: 340441 - RNA, 66 nt, hsa
uauuuguauuucaccaccuaaauguaauguugauuccucaagaaugaaaugaaggcacuacauuga

SEQ ID NO: 340442 - RNA, 66 nt, hsa
ucuucaagacaaaacagauugcgucgcugacaaguucucaagaagaacuuaugaguaagcagucug

SEQ ID NO: 340443 - RNA, 66 nt, hsa
cuuuccacgugagguuuuguuuagagggauccacuacucaagaaaaaguuagcaaaccacuccuuu

SEQ ID NO: 340444 - RNA, 65 nt, hsa; identical to SEQ ID NO: 340091

SEQ ID NO: 340445 - RNA, 66 nt, hsa
cugauccacuggucacagguagacauguggagucaacucaagaaaaagcugagugaacagcaugau

SEQ ID NO: 340446 - RNA, 66 nt, hsa
ugccuugugaccacaucucccaccacguccccagaucucaagaacgcagcucagcuucuccuucga

SEQ ID NO: 340447 - RNA, 66 nt, hsa
ugagaagagggccugugggagccugcaaacucacugcucaagaagacauggagacuccugcccugu

SEQ ID NO: 340448 - RNA, 66 nt, hsa
agaaugagauccugucucuuaaagaaaaaaaauaaacucaagaaugauuuuucuaaaaauaugagu

SEQ ID NO: 340449 - RNA, 66 nt, hsa
cagcuuacugaucacuauaguauugcauaagcacagcucaagaacugagcuuuguauguguccuuu

SEQ ID NO: 340450 - RNA, 66 nt, hsa
acagcagugggcuacauacaaugagagcccugagcccucaagaacucaugccagcucagcccuaca

SEQ ID NO: 340451 - RNA, 66 nt, hsa
auuauugacaauggcagagaacaauuaaaggguugacucaagaacuaguuccaaaccuagcagaau

SEQ ID NO: 340452 - RNA, 66 nt, hsa
ucugagggcauccgacaaggcccaucuccuucccuccucaagaagcagaggccuccucuggaguga

SEQ ID NO: 340453 - RNA, 66 nt, hsa
cuuuguauggcaguauguauauauuguguuaaguuccucaagaaucuccuuaaaaacuuugaaguu

SEQ ID NO: 340454 - RNA, 66 nt, hsa
gcugggauuuaaggacuucugggggaccaagacauccucaagaaaacaggggcauccagggcuccc

SEQ ID NO: 340455 - RNA, 66 nt, hsa
gucaagucccccagcagaaccagccucaaaaacgcccucaagaacaugaugggccugaacucggac

SEQ ID NO: 340456 - RNA, 51 nt, hsa; identical to SEQ ID NO: 339044

SEQ ID NO: 340457 - RNA, 66 nt, hsa
cuuccugcucacauccacagucagggcacggcgccccucaagaacuccagagucaccugucucauc

SEQ ID NO: 340458 - RNA, 66 nt, hsa
aacgaaggcccucucuuccucucauaccacguuuugcucaagaagcugggcuguaacaauucaggg

SEQ ID NO: 340459 - RNA, 66 nt, hsa
ccauauuuuguaucagugcuguuaauuugcuguugccucaagaaaaagugcuuuuucuccauggau

SEQ ID NO: 340460 - RNA, 66 nt, hsa
auggaaaaccuuauggaaaauaauuauaguacaauucucaagaaaauucacuaugugaaugagaug

SEQ ID NO: 340461 - RNA, 66 nt, hsa
cauugacccugauuugaccccucuucuuauaaggaucucaagaaucucuucagaagcacugaugac

SEQ ID NO: 340462 - RNA, 66 nt, hsa
uauucaaggcaaagcaaggaacaucuugagauaugucucaagaauauaaagauguauuauuuuaag

SEQ ID NO: 340463 - RNA, 66 nt, hsa
gaggcucacaugggaguuguccucacccuuguuaaucucaagaaacucuuauuuauaauagguugc

SEQ ID NO: 340464 - RNA, 66 nt, hsa
gggaucuguuuggaaacaaccccuugagcugccaggcucaagaaaucauggacucacaggguccug

SEQ ID NO: 340465 - RNA, 66 nt, hsa
uccaauggccuguguguuacaaugauaugaucauuucucaagaauaagucccuuuuuguauguguu

SEQ ID NO: 340466 - RNA, 66 nt, hsa
ugugucuucugugucacaaacagcacuccaggccagcucaagaagcaaagcaggccaauagaaaug

SEQ ID NO: 340467 - RNA, 66 nt, hsa
augccuaugugugcuccauuccucauuucuacuuggcucaagaaaacauuucugcagucaggugag

SEQ ID NO: 340468 - RNA, 66 nt, hsa
uuaaaggcagugaaaauggccagccagagaaaagaucucaagaaccagaaauaaauaaggauggug

SEQ ID NO: 340469 - RNA, 66 nt, hsa
agguaaagacauacucauuaaguguuauuuauuuuacucaagaacuggaaaccaacuaaaugccuu

SEQ ID NO: 340470 - RNA, 66 nt, hsa
cucaguauguucccaggcuaguguugaacuccugagcucaagaaauccuccugccugagucucuga

SEQ ID NO: 340471 - RNA, 66 nt, hsa
aauagguuucugauuacauaaaauuugaauagaacacucaagaaguauguagauuuuugaaaaacc

SEQ ID NO: 340472 - RNA, 66 nt, hsa
acugugaauguuccaacaccugccuccacuucuccccucaagaaauuuucaacgccaggaaucaug

SEQ ID NO: 340473 - RNA, 66 nt, hsa
ucaugaagagacuucugcuuuucaacccccacccuccucaagaaguaauaauuuguuuacuuguaa

SEQ ID NO: 340474 - RNA, 66 nt, hsa
acaaguuggaugcggccauucaaggggagccaaaaucucaagaaauucccagcagguuaccuggag

SEQ ID NO: 340475 - RNA, 66 nt, hsa
ucccuccccagacaucuggacacugggcauagauuucucaagaaggaagacuccccugccucccca

SEQ ID NO: 340476 - RNA, 66 nt, hsa
gucauuugaaaacacugcaacagugaacuuuugcaucucaagaaaacauugaaaaauucuaugaau

SEQ ID NO: 340477 - RNA, 66 nt, hsa
cccgugucuuucucuaggacaagcucccagugaucacucaagaaucuggcucucauucuaagaggc

SEQ ID NO: 340478 - RNA, 66 nt, hsa
aauugcauucaucuuguguuuuauaugagaaggugccucaagaauuuccuguuggauuuguuuaaa

SEQ ID NO: 340479 - RNA, 66 nt, hsa
ugccugguucucaauuugacacccuaagcgaucauacucaagaauaguacagauguguggaauacg

SEQ ID NO: 340480 - RNA, 66 nt, hsa
ccagaagugacuuauuaaacuauugaaggaaaaggacucaagaaaaauaauaaaagaccauaaaua

SEQ ID NO: 340481 - RNA, 66 nt, hsa
auuuuuugaaccuuauuucucaaaacuuauaguagccucaagaagucuauugauauuggucauguu

SEQ ID NO: 340482 - RNA, 58 nt, hsa; identical to SEQ ID NO: 339070

SEQ ID NO: 340483 - RNA, 66 nt, hsa
cauuuugugcucugaguuuugcuguugaaagucucccucaagaauagcuucagauccucuugugua

SEQ ID NO: 340484 - RNA, 66 nt, hsa
gucaauaucauuuuaauguaauugauuguauauagucucaagaaugguuggugggcaugaguuccu

SEQ ID NO: 340485 - RNA, 66 nt, hsa
gaaacuuuuguagcaaucuggucuauagacuuuuaacucaagaagcuaaggcuagacuuguuaccu

SEQ ID NO: 340486 - RNA, 66 nt, hsa
cagaaaugucucuccucuagguaucguauuuuguugcucaagaauccaaaaugggucuguggacau

SEQ ID NO: 340487 - RNA, 66 nt, hsa
cugcugcuuaguuuuuggacugaaaagauauuaaaacucaagaaggaccaagaaguuuucauaugu

SEQ ID NO: 340488 - RNA, 66 nt, hsa
ucgaggaguaacaauacaaauggauuuugggagugacucaagaagugaagaaugcacaagaaugga

SEQ ID NO: 340489 - RNA, 66 nt, hsa
aucaagacacagaacaaggucugucuccuauagucacucaagaagucgaucgagaaguuccacauc

SEQ ID NO: 340490 - RNA, 66 nt, hsa
ucaauuaauuagacuuuuguauaagagaugucaugccucaagaaagccauaaaccugguaggaaca

SEQ ID NO: 340491 - RNA, 66 nt, hsa
aucucccugaagcagacugcugaggaauuacauuugcucaagaauuuuuuccgucaaauugugaac

SEQ ID NO: 340492 - RNA, 66 nt, hsa
cugccuuaauuauuuaucuuuaguuccuuauuaguucucaagaaacaaaugcuagcuucauaugua

SEQ ID NO: 340493 - RNA, 66 nt, hsa
cagugggucccuuccuuucuccuuuccucucuacugcucaagaacagauuugaggccaggugcggu

SEQ ID NO: 340494 - RNA, 66 nt, hsa
uuuuauaagcaauguaauuaugcuauucacaggggccucaagaauugguauguaugaugugaucug

SEQ ID NO: 340495 - RNA, 66 nt, hsa
aaauccuuauguagaaaggacuuugaaauuuuucuucucaagaaaugguuuguauaagaauaacaa

SEQ ID NO: 340496 - RNA, 66 nt, hsa
gaaugauacugacugauuaauuauuccugauaacaucucaagaaaaggagaaggaaaguguuucug

SEQ ID NO: 340497 - RNA, 66 nt, hsa
gccuauaaaauugucagcguauuuuuacacuauuggcucaagaauguuauaaugcuaagggacaua

SEQ ID NO: 340498 - RNA, 66 nt, hsa
gagaagaaaagauuaauaccuuaaaagaagaaaacacucaagaagcagcaguccugaaugguguuu

SEQ ID NO: 340499 - RNA, 66 nt, hsa
uacugcacuccagccugggccacagagcaagacugucucaagaaaaaaaauuuuuuaaauaaguuu

SEQ ID NO: 340500 - RNA, 66 nt, hsa
uuuauauuuuauacaaauagauugcuuagaaugguucucaagaauuauaagagaaaugaacucaca

SEQ ID NO: 340501 - RNA, 66 nt, hsa
uuagauaagcaccuggcaucuaauggcaggcaggcacucaagaaaugaauuaacuacauaauggaa

SEQ ID NO: 340502 - RNA, 66 nt, hsa
cucguuucugugaauuucaugaagagcagaacauuucucaagaauccucuugagccaguaaucaau

SEQ ID NO: 340503 - RNA, 66 nt, hsa
guuuggagaauagaaaugaaaagccacgucauauaacucaagaauaaaugguguuuuggaaauuuu

SEQ ID NO: 340504 - RNA, 66 nt, hsa
ggaucccugcugggcacaccccacaaaccccacucccucaagaagggccagggccagggcuguaug

SEQ ID NO: 340505 - RNA, 66 nt, hsa
auugugcaggacaguaaauaaugaaaaccaaauuuccucaagaaauaacugaagaaggagcaagug

SEQ ID NO: 340506 - RNA, 66 nt, hsa
ugucagauguggucaguagggagcuccaugcccaagcucaagaacgacugcaacacuacuuuaugg

SEQ ID NO: 340507 - RNA, 66 nt, hsa
auacaauuuaauugcucaaccaugcauuuaaaacuccucaagaaaggauugguacugcaacuguag

SEQ ID NO: 340508 - RNA, 66 nt, hsa
cauucuaaauuugaguaaauacaauuuuuuagguuacucaagaaccagcauuaguaauuucuagua

SEQ ID NO: 340509 - RNA, 66 nt, hsa
acuaagggaacacacaaagaauuacacaacguuuuccucaagaaaaugguacaaaacacaaccgag

SEQ ID NO: 340510 - RNA, 66 nt, hsa
uuucuauaauggguuugggggauaauaauggugaagcucaagaacagaugucuauugaguagaacc

SEQ ID NO: 340511 - RNA, 66 nt, hsa
ugcaggugaauuguggaaaaugucauguagcugacacucaagaaauagggauuccuaauaauggca

SEQ ID NO: 340512 - RNA, 66 nt, hsa
cucuggcuuuccugcuauacacauauucacauggcgcucaagaaguuaggcucauggcaacgugug

SEQ ID NO: 340513 - RNA, 66 nt, hsa
ugucuucaucaaguggaagccaacuguccugccugccucaagaauauguguuuucuuuagcuuccc

SEQ ID NO: 340514 - RNA, 66 nt, hsa
uauguaaauuugcucuguuuuaagacuuugaacuaccucaagaagaggaaucuaauacaauauuug

SEQ ID NO: 340515 - RNA, 66 nt, hsa
cccacaaguuuucacugaaugagcauggcagugccacucaagaaaaugaaucuccaaaguaucuuc

SEQ ID NO: 340516 - RNA, 66 nt, hsa
cacagugcuuagaaguaagcaauucccaggucauagcucaagaauuguuagcaaaugacagauuuc

SEQ ID NO: 340517 - RNA, 66 nt, hsa
cacuagugccaggucacuauuguaagauguuaaaaucucaagaaaauuucacagagcuaaagaaau

SEQ ID NO: 340518 - RNA, 66 nt, hsa
auagauaagaaaggacuacagcauuugauguguguccucaagaacuugucuugggucugaaaaagc

SEQ ID NO: 340519 - RNA, 66 nt, hsa
cacccuauggccuucuugucaaaaccuucacuggagcucaagaaaagcauuucuguuguguuauuu

SEQ ID NO: 340520 - RNA, 66 nt, hsa
aguugcuuaugggaauccugagcugcuuuucaccaucucaagaagccuaagaaguuauauauuuaa

SEQ ID NO: 340521 - RNA, 66 nt, hsa
acuuguagauaaaaguguuccaguaaucagaaaauccucaagaaaauugacuucauuauuuggaag

SEQ ID NO: 340522 - RNA, 66 nt, hsa
ugugcccauuaccuuuccucugccugaaagacgugucucaagaaaaauaaauucuauuuuagaugc

SEQ ID NO: 340523 - RNA, 66 nt, hsa
auuaguauaucaucauaaaauagacaauguuuuugucucaagaacaagaauaaaauugaaaucugc

SEQ ID NO: 340524 - RNA, 66 nt, hsa
aagaauaaaaagguaaaacuacauuuagacuucuuucucaagaaaucaaauacagcuuuuuuucaa

SEQ ID NO: 340525 - RNA, 66 nt, hsa
ucaaacgaacaagauuaauuaccugucuuccuguuucucaagaauauuuacguaguuuuucauagg

SEQ ID NO: 340526 - RNA, 66 nt, hsa
caaucuuuagacuacaauaauacuuuuauccaugugcucaagaaagggccccuuuuuccaacuuau

SEQ ID NO: 340527 - RNA, 66 nt, hsa
ccagauauguauuugcuacucaaguguacagaucuccucaagaaacaucaagggacuccuguguca

SEQ ID NO: 340528 - RNA, 66 nt, hsa
uuuaaauaaccgauuauugauuacuguauuuuuuuucucaagaacagugauagguagaaacuaauu

SEQ ID NO: 340529 - RNA, 66 nt, hsa
uaaaagucaucauugcuguuuagcuugacuguuuuccucaagaacaucgaucugaaggauucauaa

SEQ ID NO: 340530 - RNA, 66 nt, hsa
aaagaugcucuguagagaauuugcuaccgaaguuggcucaagaauuuguuuuuaguguuauuuacc

SEQ ID NO: 340531 - RNA, 66 nt, hsa
uucuggcaaaggccuuccugcauuuaugaauucucucucaagaagcaagagaacaccugcaggaag

SEQ ID NO: 340532 - RNA, 66 nt, hsa
gaaugagaauuaagaauggacaggaccaagacagaacucaagaaagccacuggggaaaacucgaga

SEQ ID NO: 340533 - RNA, 66 nt, hsa
caaauauguucaacauuuacuucuauuugauaucugcucaagaagucauagaagucuugggaaacu

SEQ ID NO: 340534 - RNA, 66 nt, hsa
uaaguaacauugucagaaauaaauaaaaccacaagucucaagaauuugccacguauguucaagggu

SEQ ID NO: 340535 - RNA, 66 nt, hsa
uuuuucuucagguaacacuacagaguacgugaaaugcucaagaauguagucagacugacacuacua

SEQ ID NO: 340536 - RNA, 66 nt, hsa
caaaacaaaacacaguccugcauacucaccaccaagcucaagaaauaaaucaucaccaauaccuuu

SEQ ID NO: 340537 - RNA, 66 nt, hsa
ccagccaacucauuggguuguagccaaagguucacucucaagaagcuuuaauauuuaaauaaaauc

SEQ ID NO: 340538 - RNA, 66 nt, hsa
uaaauaucaccuagaaaaguagccucacucuuauuccucaagaauuaauauccaauguuuaugagu

SEQ ID NO: 340539 - RNA, 66 nt, hsa
aaacaucagcauuguauacacauauuuucacuuuaacucaagaauuccaggagguaauuuguugau

SEQ ID NO: 340540 - RNA, 66 nt, hsa
auaucacaaauggcaauguaaaaaucaagacauuuucucaagaacuguguaccacuaaaaguaaua

SEQ ID NO: 340541 - RNA, 66 nt, hsa
uccaagaagcaugcagagaagaauugguuuguuggccucaagaagaaugggagcugcaaacgcggu

SEQ ID NO: 340542 - RNA, 66 nt, hsa
caggaaccaugccccuuccccaggcccccagcaagucucaagaacacagcugcacaggccuugacu

SEQ ID NO: 340543 - RNA, 66 nt, hsa
auaagaaauacaguuuguuuguauaaaauaaacuaucucaagaaaguuuucaacgacagugauagu

SEQ ID NO: 340544 - RNA, 66 nt, hsa
aaccuuugagaaauccuuuugugaagucauugccugcucaagaauguacaguggcuccccaaugcc

SEQ ID NO: 340545 - RNA, 66 nt, hsa
aauacagaguguguucgcacuuagccaugggcugggcucaagaaccugauaccuggguugaugugg

SEQ ID NO: 340546 - RNA, 66 nt, hsa
aagaaaacugccuaacugaagggaaugggggcccugcucaagaagggggccaggcagcuggaauca

SEQ ID NO: 340547 - RNA, 66 nt, hsa
ccugggguaugagcugccaagucuauuuuaaagacgcucaagaauccucugggguucaucuaggga

SEQ ID NO: 340548 - RNA, 66 nt, hsa
ggucauucagccaacccagaggauguagacccuguccucaagaagugcagggcgaguucugccgug

SEQ ID NO: 340549 - RNA, 66 nt, hsa
gagcuguggaacgagacuucugcagagguggcugaccucaagaagcagguacaggcccuucagccc

SEQ ID NO: 340550 - RNA, 66 nt, hsa
acagacuagauuauauuuaguaggggaaaaauugggcucaagaaccauucaucaguacgugagaca

SEQ ID NO: 340551 - RNA, 66 nt, hsa
ucugacuuguaagcaguucauagaagcugcucaauacucaagaaucuugcaagacaguuauuaaac

SEQ ID NO: 340552 - RNA, 66 nt, hsa
guaucuuguuuugaucauuuccacugcacauuucuccucaagaaaagcgaaaggacagacuguugg

SEQ ID NO: 340553 - RNA, 66 nt, hsa
ucucagcaauuugaacacuaaccucuccccuccuggcucaagaauuacuccgaagucagucugcag

SEQ ID NO: 340554 - RNA, 66 nt, hsa
gguucugagcaaauaacuacagggugcccauuaccacucaagaagacacuucacguauucuuguau

SEQ ID NO: 340555 - RNA, 66 nt, hsa
ggaccgguagccuucaagcuuguccagcagaaccagcucaagaaaggagaugcccuagugguggcc

SEQ ID NO: 340556 - RNA, 66 nt, hsa
cuguuuuacuccgugccuuacuggauuuggccuguccucaagaaugguaauuaugaagaguggaga

SEQ ID NO: 340557 - RNA, 66 nt, hsa
caaacagcguccauuuuuucauauuagagguggaaccucaagaaugacuuuauucuuguaucucau

SEQ ID NO: 340558 - RNA, 66 nt, hsa
augcauugucuugcccuauagacucaggaguugcuucucaagaaagagccagcaaguauucucagc

SEQ ID NO: 340559 - RNA, 66 nt, hsa
ucuuuuaaacauuaaguuugaaauaggaaugguuuucucaagaauagauuuggugugauaccuugu

SEQ ID NO: 340560 - RNA, 66 nt, hsa
auugagugaugagcagacauguuuaagggucuaagucucaagaaucuguuauguguguuugcugcg

SEQ ID NO: 340561 - RNA, 66 nt, hsa
gaauauuuaaucuauuuaaucuucuugcauuuauuucucaagaauuacuggcuuuaaaagaagcca

SEQ ID NO: 340562 - RNA, 66 nt, hsa
guagcccucaauauuugguaaugcuauuuaaagugacucaagaagcaugugcuaucuggcuuugaa

SEQ ID NO: 340563 - RNA, 66 nt, hsa
agaaagaaauauuguugcucaguguuguuaauauagcucaagaauugaguuuauauuugcaguaug

SEQ ID NO: 340564 - RNA, 66 nt, hsa
guggacgagaagacucagccugagggccugcggagccucaagaagccagaccgcaagaagcgcuac

SEQ ID NO: 340565 - RNA, 66 nt, hsa
auuguggaacuuccucuuucauuggaaacuuucuuacucaagaaugacggcaguauuguuuucuua

SEQ ID NO: 340566 - RNA, 66 nt, hsa
uggacugucuucaucaaguauuucccuacagaacuccucaagaaaacagagaucauuuggcuagag

SEQ ID NO: 340567 - RNA, 66 nt, hsa
caggacucugggccccuccccagcuccacucccuaccucaagaaugugaccauuuggaaaaggcaa

SEQ ID NO: 340568 - RNA, 66 nt, hsa
uugccauguugccaaggcugguuucaaacuccuggacucaagaaauccacccaccucagccuccca

SEQ ID NO: 340569 - RNA, 66 nt, hsa
ucugugacaguuccaggucuugaagcuaaucagcaucucaagaaaguauccagaaagaacaucugc

SEQ ID NO: 340570 - RNA, 66 nt, hsa
agauccuaagcucucaaaauagcauauucccuagagcucaagaaagcugguccaggagguugaaaa

SEQ ID NO: 340571 - RNA, 66 nt, hsa
gccguugugcuccagccugggcgacagaagucuugucucaagaagaaaacgaacugggaaaauuuc

SEQ ID NO: 340572 - RNA, 66 nt, hsa
ccucccaugcccguucugaccucagccuuggaacuccucaagaaccugaagauuccaguggucagu

SEQ ID NO: 340573 - RNA, 66 nt, hsa
uggagauugggaaacuuaaccguuacccaggcaauacucaagaaggagaauccauuuagcaccucc

SEQ ID NO: 340574 - RNA, 66 nt, hsa
aguuuuugcuguuguaaaaguguuuucauaaguucacucaagaaaaaugcagcuguucugaacugg

SEQ ID NO: 340575 - RNA, 66 nt, hsa
aauaugucuguuuaaaaauuacuaauucucaaauggcucaagaacauuagaauuuaaguaccuuuu

SEQ ID NO: 340576 - RNA, 66 nt, hsa
gcuguuagugucuucuuccugcccucagcaccacagcucaagaaaaccuaaaguuucaauacaagc

SEQ ID NO: 340577 - RNA, 66 nt, hsa
accuacacccacgcacccccccacacacuaugcucucucaagaauguaauuuauuggggccccccc

SEQ ID NO: 340578 - RNA, 66 nt, hsa
acuuagaguccugccguggcucagguggaucuaaaacucaagaacaaauucuauuuauuuauuauu

SEQ ID NO: 340579 - RNA, 66 nt, hsa
aaauauacuaucuaucucaccaguauuugcucucgacucaagaagguuaacauuuucugauucaug

SEQ ID NO: 340580 - RNA, 66 nt, hsa
ucaugacagcugucuguuguuuuaugaaguuuauuucucaagaaaaugggaauaaauuugggauuu

SEQ ID NO: 340581 - RNA, 66 nt, hsa
ucccacucuagcuugggcaauagagcaaggcuccgucucaagaaaagaaggucauuucccaagacu

SEQ ID NO: 340582 - RNA, 66 nt, hsa
gcaguggaagcauguguguuucuaaaaaguaaaaaucucaagaaaacagaaauggcaugcuuuacc

SEQ ID NO: 340583 - RNA, 66 nt, hsa
cuaauaaugcagagauaauuagacaugguucccgcccucaagaagcucacaaaaguauucaggaaa

SEQ ID NO: 340584 - RNA, 66 nt, hsa
acaaguucuuuuggaacuuguuucaagccaaaaacucucaagaaagcaaauugcaccucagcugga

SEQ ID NO: 340585 - RNA, 57 nt, hsa; identical to SEQ ID NO: 339173

SEQ ID NO: 340586 - RNA, 66 nt, hsa
uucccuaaauuaucccauuauguaauucuuggucagcucaagaacuggguucuuuuucuaauaauu

SEQ ID NO: 340587 - RNA, 66 nt, hsa
cugagcuggaacaguaggggcagggagaagacaggucucaagaaaagguuuuuaagaaguuucauc

SEQ ID NO: 340588 - RNA, 66 nt, hsa
uacuuccucuacucucccgugcacugccggccagagcucaagaagcugcugcacgggcugggccuu

SEQ ID NO: 340589 - RNA, 66 nt, hsa
guauuuuacucugaucaaauaaauaaugcuggaauacucaagaauugcauccucugaccuacuuca

SEQ ID NO: 340590 - RNA, 66 nt, hsa
agcgggaggaagcacugaaacaacacaaaacccuaucucaagaacuuguuaaccuccggggagagc

SEQ ID NO: 340591 - RNA, 66 nt, hsa
gcuaaccacagggccugagaagucuugcuuuaugggcucaagaaugccaugcgcuggcaguacaug

SEQ ID NO: 340592 - RNA, 66 nt, hsa
uuucccugauauuauuucuauuuaauacucuuuucucucaagaaaaaaaaaaaaguuuguuuuuuc

SEQ ID NO: 340593 - RNA, 66 nt, hsa
uuauggugggagggaauguuuucaaauuucccauuucucaagaaauguucauauuaauugaggauu

SEQ ID NO: 340594 - RNA, 66 nt, hsa
uucauuuugaugauucugagaagaaacuuguccuuccucaagaacacagcccugcuucugacauaa

SEQ ID NO: 340595 - RNA, 66 nt, hsa
uaaaaauaaccaaaaaaugugagcuauaauguuucccucaagaacaaacagaaacgagauuugcca

SEQ ID NO: 340596 - RNA, 66 nt, hsa
cugucagccccaguuggcuuccuggucaacaaggaccucaagaacugccuguggaccgaggccccc

SEQ ID NO: 340597 - RNA, 66 nt, hsa
caaugcagagguaacucucaggcagcuaagcagcaccucaagaaaacauguuaaauuaaugcuucu

SEQ ID NO: 340598 - RNA, 66 nt, hsa
uucugagaguagcugcugcuuucccugacuuccuuccucaagaauacagucuauucugggggguug

SEQ ID NO: 340599 - RNA, 66 nt, hsa
gcagauuuuccucugacaccagagaacaauaguagucucaagaauggaaaccugaaugucugaggg

SEQ ID NO: 340600 - RNA, 66 nt, hsa
ggaaaaacuucaguuacugaccagucaagagaauuucucaagaaaaaucccagcaacguucccucu

SEQ ID NO: 340601 - RNA, 66 nt, hsa
cuucaagcacaaagugaugaaugacugccuucaagucucaagaaaacacuuuucccuaacuuuuag

SEQ ID NO: 340602 - RNA, 66 nt, hsa
uaauuugggugagcugcaccugauuaguugaaaggccucaagaacaaacacugcaguuuccuggaa

SEQ ID NO: 340603 - RNA, 66 nt, hsa
uacaacuguggaguugguagcugguaacauuguugucucaagaacaacucaccucucucccuagga

SEQ ID NO: 340604 - RNA, 66 nt, hsa
gcacaacuaaaccuucuuaauauccgccacagaaggcucaagaauccagcccuaaaauucucucca

SEQ ID NO: 340605 - RNA, 66 nt, hsa
agaacuaccucauaugcaggaugagccaauggcagucucaagaaauguacucgggcgacaccuuac

SEQ ID NO: 340606 - RNA, 66 nt, hsa
gacuuuucugacauuccuagacagguucauucuuugcucaagaaaggccugaaugacaauguccag

SEQ ID NO: 340607 - RNA, 66 nt, hsa
uuaauacaacaagaucaacuagaagaauucaacugucucaagaaucaagguaccccaauauaucuc

SEQ ID NO: 340608 - RNA, 66 nt, hsa
acauugaagggagaaaggcaagaugugcacucuggacucaagaaacucuuaguucaguggaggaaa

SEQ ID NO: 340609 - RNA, 66 nt, hsa
cagucacugugagcucccaggugcagccagaggcaccucaagaagaagaggggcauaaacuuuccu

SEQ ID NO: 340610 - RNA, 66 nt, hsa
aaauucagaugaguuagaagcuuuuuaucccuuccucucaagaaaauauucuuucacccugucucu

SEQ ID NO: 340611 - RNA, 66 nt, hsa
uaaagugacauaauuuacaugcaauauguuuaucaacucaagaauuuaauauaguugguacacaac

SEQ ID NO: 340612 - RNA, 66 nt, hsa
aauggauacauuaggagcuucaaacacauauaauuucucaagaaauuuccagaugucucaugcugc

SEQ ID NO: 340613 - RNA, 66 nt, hsa
ucuauuaaggaagaacaaggaagggaaugaucuuuacucaagaauuucagaaagucagcacugaag

SEQ ID NO: 340614 - RNA, 57 nt, hsa; identical to SEQ ID NO: 339202

SEQ ID NO: 340615 - RNA, 66 nt, hsa
aaagaaggcugcuaauuggauuuugguaguucuuaccucaagaaaacuugaauuauuugggggaaa

SEQ ID NO: 340616 - RNA, 66 nt, hsa
gcuaagcuuaugaaggaaugccuccuuuguuacacacucaagaauuugucagcacacaauuaauug

SEQ ID NO: 340617 - RNA, 66 nt, hsa
auaauaauucagaaauuggguuuugguucagugauucucaagaaaaagaucucuugcccauuaaga

SEQ ID NO: 340618 - RNA, 66 nt, hsa
aucacaaaauccaaggugcuacaggaaacaagcacacucaagaaaguuuuuuucugaauaacauuu

SEQ ID NO: 340619 - RNA, 66 nt, hsa
uuuaaagaaaacugaacugaggaaaaugguguuuuccucaagaagacuacuggaacuggaugaccu

SEQ ID NO: 340620 - RNA, 66 nt, hsa
acauuuuccaucuccaaauagccaggcccucucucccucaagaaaugcccagauguagaaauucau

SEQ ID NO: 340621 - RNA, 66 nt, hsa
uagaaaguucauuucaucacuuagaaaauaugucuucucaagaacaaaacugugcuguuacaacuc

SEQ ID NO: 340622 - RNA, 66 nt, hsa
uccuggcucucucucugcugccucuucauacguuuucucaagaacuucaguuuauaauuggaagag

SEQ ID NO: 340623 - RNA, 66 nt, hsa
agcuccucuauccgaggccauuggagaccccaguuucucaagaauucagcucugcucugagcgucc

SEQ ID NO: 340624 - RNA, 66 nt, hsa
gcagguugaguccagaugcuucucaccuucuuucuccucaagaaagaugcuuuuugggaaacguug

SEQ ID NO: 340625 - RNA, 66 nt, hsa
uguuccacagacagaugaggcaggagugauggggcacucaagaaaguucagaggaggcauaagcua

SEQ ID NO: 340626 - RNA, 66 nt, hsa
acuuggaucuuggcaugcacccaccuaacccacuuucucaagaacaagaaccuagaaugaauaucc

SEQ ID NO: 340627 - RNA, 66 nt, hsa
ccacucccagaagaccaaacugccuuccccucagggcucaagaauguguacagucuguggggccgg

SEQ ID NO: 340628 - RNA, 66 nt, hsa
uuuucuccuuuuguguuuuucccacuuuccaauguacucaagaaaauugaacaaauguaauggauc

SEQ ID NO: 340629 - RNA, 66 nt, hsa
uuccugacuaaggagcugcagcgauacaucgaagggcucaagaagcgccggagcaagaggcuguac

SEQ ID NO: 340630 - RNA, 66 nt, hsa
cagccccagagggcuuuguggaggacaggccuugcccucaagaacgucguaccugacgcugagccu

SEQ ID NO: 340631 - RNA, 66 nt, hsa
ucuugagcuuuuuggaaggauaauucugauaaggcacucaagaaacguacaaccacagugcuuucu

SEQ ID NO: 340632 - RNA, 66 nt, hsa
aggagacccgccaccguggaggcagggggcaagaaacucaagaacgcaucaagagcaccagcccug

SEQ ID NO: 340633 - RNA, 54 nt, hsa; identical to SEQ ID NO: 339221

SEQ ID NO: 340634 - RNA, 66 nt, hsa
agaaccucacgcaccucccauccuaaucauccaaugcucaagaaacaacuucuacuucugcccuug

SEQ ID NO: 340635 - RNA, 66 nt, hsa
accacuuuucagagucaucuacaaaauuuuucuuuccucaagaaaagaguuccuuuugccuuauuc

SEQ ID NO: 340636 - RNA, 66 nt, hsa
aggcugacuuaggaucaugcuggaaggaagccaagucucaagaacugucagcaacagaaaaugaga

SEQ ID NO: 340637 - RNA, 66 nt, hsa
gaagccccuggaucuuugggguaaaaggaggguggccucaagaaacaaugucuggggacaggccuu

SEQ ID NO: 340638 - RNA, 66 nt, hsa
cccucaugccuaacaguggucuguuuuuauaugagacucaagaacaggccucauuccagggcacag

SEQ ID NO: 340639 - RNA, 66 nt, hsa
gaagaggaggagggauucuggucuucacugccaugccucaagaacaccuuuguuuugcacugacaa

SEQ ID NO: 340640 - RNA, 66 nt, hsa
cacugggaaugcugggaaaugagauacauucccgcccucaagaaucucccagucugguaggagaga

SEQ ID NO: 340641 - RNA, 66 nt, hsa
gacaggagacaugagucuuugccggaggaaaagcagcucaagaacacaugugcagucacugguguc

SEQ ID NO: 340642 - RNA, 66 nt, hsa
gaauauuccuauugaucucauuuuauuuagcaucagcucaagaaacuaagucuuagugcacaguau

SEQ ID NO: 340643 - RNA, 66 nt, hsa
auccauaaugagauaaugcauguaggggaaaaguuucucaagaagguggaagaggcagcaggacuu

SEQ ID NO: 340644 - RNA, 66 nt, hsa
gccauuuauggcaugauuagauugcaaagcaaugaacucaagaaggaauugaaauaaggagggaca

SEQ ID NO: 340645 - RNA, 66 nt, hsa
uacuaguuuggauaucuuuaggguuuagaaucuaaccucaagaauaagaaauacaaguacaaauug

SEQ ID NO: 340646 - RNA, 66 nt, hsa
ccacccaucuuuuuucuucccucauuuucugggauucucaagaaagaaaaaguaacccauuaucac

SEQ ID NO: 340647 - RNA, 66 nt, hsa
ggcccuuuuggacuaauguuacuguccaaguucuuucucaagaaaccacaucugguucagaagagu

SEQ ID NO: 340648 - RNA, 66 nt, hsa
auuuuuuaaauuuuuuuauaggcccauaugcucuaucucaagaaacaagaugauuguaacaugucc

SEQ ID NO: 340649 - RNA, 66 nt, hsa
uauaacuuuccuuuauuucacuuguacccaguuucacucaagaaaucuugaugaauauuuauguug

SEQ ID NO: 340650 - RNA, 66 nt, hsa
cuagacccucucuauagccaugagacuccuuguggccucaagaaauuuagacgcccacgacagcac

SEQ ID NO: 340651 - RNA, 66 nt, hsa
cucagccgcacccgugugcacuguaacuuuugugugcucaagaaauuauacagaaaccuacagcug

SEQ ID NO: 340652 - RNA, 66 nt, hsa
aaccacuccuggagaaagacuuccuugcaggagugacucaagaauuaaucaguaaauaccuugaaa

SEQ ID NO: 340653 - RNA, 51 nt, hsa; identical to SEQ ID NO: 339241

SEQ ID NO: 340654 - RNA, 66 nt, hsa
uuauuuccuucauaaagaaugccacccaucugauuccucaagaaucuagaccuagaaauaccauuu

SEQ ID NO: 340655 - RNA, 66 nt, hsa
aguuaggaaaaaaaaauccaagaaauguauugaauacucaagaaaaugccacauuucaauuacaua

SEQ ID NO: 340656 - RNA, 66 nt, hsa
agaucucauaugaucuucuucaagccauuauuuuaacucaagaaaacucuagagaagaaaagugaa

SEQ ID NO: 340657 - RNA, 66 nt, hsa
gggcacuccacugcagcaggagggacuuaagcuagacucaagaaagcagcuuggagccucuagguu

SEQ ID NO: 340658 - RNA, 66 nt, hsa
cauuaaaaauaguaagccucccuccucguccccugccucaagaaauugccuccuuauuuaucaaca

SEQ ID NO: 340659 - RNA, 66 nt, hsa
aagcaugguaugagcacaggucauggacagccccugcucaagaaaaagcaugagcuggccacacau

SEQ ID NO: 340660 - RNA, 66 nt, hsa
gauuuuugaaaaauagucaccaacuguauauacuuccucaagaacugauaauucauuauaucauca

SEQ ID NO: 340661 - RNA, 66 nt, hsa
gcgcucugccauucaacucggaaacuauaaguaauucucaagaaagcccucauuuuuauaaccugg

SEQ ID NO: 340662 - RNA, 66 nt, hsa
auacuuuuuacuguuugccaaaacacuugaaugugccucaagaaaagguaccuacuacaugcugua

SEQ ID NO: 340663 - RNA, 66 nt, hsa
aaguucuauacuggauccuuucuuucucuaauaauccucaagaaauccuuacagguaaguauugcu

SEQ ID NO: 340664 - RNA, 66 nt, hsa
aaguacuggagagaugggauccuucuagauacagggcucaagaagucugcugggaguccccugagu

SEQ ID NO: 340665 - RNA, 66 nt, hsa
ucaucaggguccucagugcagagcaacuuacgcauccucaagaauccacugcuuuucaggcaagga

SEQ ID NO: 340666 - RNA, 66 nt, hsa
uucccacgugggcaauaccagggacccauggggaaacucaagaaugacagcuucuauauuuuguaa

SEQ ID NO: 340667 - RNA, 66 nt, hsa
auccacuaagaaggccugucuacacugcaggggaaccucaagaacuuuucauugcacuucuaaaau

SEQ ID NO: 340668 - RNA, 66 nt, hsa
uucaaaaggaagagccuuuuaaaaacauuugccaaccucaagaauaaauacugaaagucuugaaag

SEQ ID NO: 340669 - RNA, 66 nt, hsa
ucuuaggauucugacuaagaggcaaaagagaaaagacucaagaaacugauccuggagaucgagacc

SEQ ID NO: 340670 - RNA, 66 nt, hsa
augggagccaggaguaagacaagugggauuuggggccucaagaaauauacucucccagauuuuuac

SEQ ID NO: 340671 - RNA, 66 nt, hsa
uguuuuguuuuaacaaaauuagcugaagaaguuauucucaagaaaauuggauguuuucauuggccu

SEQ ID NO: 340672 - RNA, 66 nt, hsa
guguuauaugacaucauccugaagaacuucgagaagcucaagaagcccaggggagaaacaaaggga

SEQ ID NO: 340673 - RNA, 66 nt, hsa
ggaaagauuacauacauuugagaauaagaaauuacucucaagaacuucagaaaucugcaacauaau

SEQ ID NO: 340674 - RNA, 66 nt, hsa
aagauauuucccauaaaugggaaguuugcccauugucucaagaaauguguauuucagugacaauuu

SEQ ID NO: 340675 - RNA, 66 nt, hsa
cuuaacauuuugggaaguaacugccucugacuucaacucaagaaaacacuuuuuuguugcuaaugu

SEQ ID NO: 340676 - RNA, 66 nt, hsa
caaaagaagacugacuggguggaggcucugccuugccucaagaaccauccccugcagagcauccag

SEQ ID NO: 340677 - RNA, 66 nt, hsa
acguaggccuugcaucucgccaccuccacuucuguccucaagaacaaguccuaggucaagggaaac

SEQ ID NO: 340678 - RNA, 66 nt, hsa
uuaaaggaagugaaaauagccagccagaggaaaugucucaagaaccagaaauaaauaaggguggug

SEQ ID NO: 340679 - RNA, 66 nt, hsa
aggaauuagugcuggauuugaagcuacgcacucagccucaagaacucccuggaauaucccugagaa

SEQ ID NO: 340680 - RNA, 66 nt, hsa
cagauggcccugggaaucaauuccucaggaauugcccucaagaacucugcuucuugcuuugcagag

SEQ ID NO: 340681 - RNA, 66 nt, hsa
ucaaaucuuagaguucauaaauuuacuugagguugccucaagaacucagggaacaauacuguaaac

SEQ ID NO: 340682 - RNA, 66 nt, hsa
agaaugaagaauggaaauggaaaaggguggcugcgacucaagaauaauaugggagcccaugaggag

SEQ ID NO: 340683 - RNA, 66 nt, hsa
aagaaggagauaaacaugaccaucgucaaagaccugcucaagaaauuuuuaaaaaagaaacaaagu

SEQ ID NO: 340684 - RNA, 66 nt, hsa
uaaauuucuuauuugcuagggaacugguaaucuaggcucaagaaguguguggagaagguuuauuuu

SEQ ID NO: 340685 - RNA, 66 nt, hsa
uugcaucaguguggacuccuagaacgugcgaccugccucaagaaaaugcaguuuucaaaaacagac

SEQ ID NO: 340686 - RNA, 66 nt, hsa
cuuccuccucaggacauggagaucugugcagaugagcucaagaagguccuuaacacagucgugaac

SEQ ID NO: 340687 - RNA, 66 nt, hsa
ccaguacaccuguagauauuacuguacuuuuauguucucaagaaauaaguuguugccuauucagug

SEQ ID NO: 340688 - RNA, 66 nt, hsa
uuuacugauucauacauuaucucacuugugccaacacucaagaagcaggcuacacugacacuggua

SEQ ID NO: 340689 - RNA, 56 nt, hsa; identical to SEQ ID NO: 339277

SEQ ID NO: 340690 - RNA, 66 nt, hsa
ugggcuccacuucauccagaugaaggaaaggaagaccucaagaaaaauucacaguugagugcaucc

SEQ ID NO: 340691 - RNA, 66 nt, hsa
aagaaggagauaaacaccaccaucaucaaagagcugcucaagaaauuuuuaaaaacgaaacaaagu

SEQ ID NO: 340692 - RNA, 66 nt, hsa
aaaggaacuuuauaaugaaacgguucggaauacuggcucaagaaccuaugucaagaugagcugaau

SEQ ID NO: 340693 - RNA, 66 nt, hsa
cagaugugagcugcuaaauugacuggccuugcagagcucaagaagggggcuuccaaugcugugaga

SEQ ID NO: 340694 - RNA, 66 nt, hsa
uagccccucucucacacaucacauucccaugguggccucaagaaaggcccggaagcgccaggcugg

SEQ ID NO: 340695 - RNA, 66 nt, hsa
auguguucuuagugauucacauccacgggacaaaaacucaagaagaaauaagagcugacgccacac

SEQ ID NO: 340696 - RNA, 66 nt, hsa
gcagagggagugugcgaaucuacccugaccaaugggcucaagaauaaaguaugauuuuugagucag

SEQ ID NO: 340697 - RNA, 66 nt, hsa
caauugagggcuaaaucccaagugucucuugacuggcucaagaauuagggccccaacuacacaccc

SEQ ID NO: 340698 - RNA, 66 nt, hsa
ccaccuacuuguggcgaucugaguacucuacucuugcucaagaaguaauacgacaaucagaauaca

SEQ ID NO: 340699 - RNA, 66 nt, hsa
gcagagggagugugcgaaucaaaccugaccaagcggcucaagaauaaaauaugaauugagggcccg

SEQ ID NO: 340700 - RNA, 66 nt, hsa
gauacaaauuuggccuuaagaacugugucuggcguucucaagaaucuagaagauguguaaacaggu

SEQ ID NO: 340701 - RNA, 66 nt, hsa
cugaugaaugcccgcagugagcuauacuuacgcuuccucaagaagaggauuagcucugauuuugag

SEQ ID NO: 340702 - RNA, 66 nt, hsa
guacuacaaaauuaugucugcaccagugaauccauucucaagaaaagucuuaacuaggaaacuaaa

SEQ ID NO: 340703 - RNA, 66 nt, hsa
agggaacacaggcaaauuauuuguggggguaggaaucucaagaauugcgaaagucaaauauggaga

SEQ ID NO: 340704 - RNA, 66 nt, hsa
auccucaccaagcucauuacaucugccagggccugccucaagaagcccagcccagccuuuuccugg

SEQ ID NO: 340705 - RNA, 66 nt, hsa
cuagugguauauuuauguaagaaaaugacuguaaaucucaagaaaaaucucagcagcuaauagcaa

SEQ ID NO: 340706 - RNA, 66 nt, hsa
gguguaaccauuuguuaacuguacugaagguguguccucaagaagaaaguguucaaauuaaaaaag

SEQ ID NO: 340707 - RNA, 66 nt, hsa
ugucucuaccaaaaguuaaaaaaaaaaaaaaaaaagcucaagaaccugcacgagggccuaaaacag

SEQ ID NO: 340708 - RNA, 66 nt, hsa
cccuucucuguuuaguaguugguuggggaaguggggcucaagaaggauuuugggguucaccagaug

SEQ ID NO: 340709 - RNA, 66 nt, hsa
gagaaaaggggcuggaaaggggggaauggcccacaucucaagaagcaagauauuguuugugguggu

SEQ ID NO: 340710 - RNA, 66 nt, hsa
aggaacagcauggauuccguggauagcuguugcagucucaagaagacugagagcuuccaaaaugcc

SEQ ID NO: 340711 - RNA, 66 nt, hsa
acacaccaacauuuugcugccuaccuuguuauccuucucaagaagcugaaguguacgcccucuccc

SEQ ID NO: 340712 - RNA, 66 nt, hsa
cuguauauaccaccuaggaggagaugccaccaagcccucaagaaguugugcccuuccccgccugcg

SEQ ID NO: 340713 - RNA, 66 nt, hsa
aggccacgugucccagcccagcguccaguggugccucucaagaaaccccgaacgaauguucggaug

SEQ ID NO: 340714 - RNA, 66 nt, hsa
acguacaucauuauuaauauaaaaauaacaggcagccucaagaaugugcugagauuucucuggaaa

SEQ ID NO: 340715 - RNA, 66 nt, hsa
cucccugaagcuggauucuuucauacgauacucuuucucaagaagggggcucccugggaucuccag

SEQ ID NO: 340716 - RNA, 66 nt, hsa
ggcaggccugcaggguguggggaaggaggacacaaccucaagaaaggaagcgugaaccccagggaa

SEQ ID NO: 340717 - RNA, 66 nt, hsa
aaguuugacacaaacucacacaaccaugacgcacugcucaagaacuacgggcugcucuacugcuuc

SEQ ID NO: 340718 - RNA, 66 nt, hsa
aaguuugacacaaaaucgcacaacgaugacgcacugcucaagaacuacgggcugcucuacugcuuc

SEQ ID NO: 340719 - RNA, 66 nt, hsa
aaguuugacacaaacucgcacaaccaugacgcacugcucaagaacuacgggcugcucuacugcuuc

SEQ ID NO: 340720 - RNA, 57 nt, hsa; identical to SEQ ID NO: 339308

SEQ ID NO: 340721 - RNA, 66 nt, hsa
uuuugugagugcuuuggaauuuaaaugauuguauaacucaagaagauuacuuuucuauguugcuca

SEQ ID NO: 340722 - RNA, 66 nt, hsa
ccuccagacgaugcauuucuuggccaaaguggcuuccucaagaaagcagcacuuaccuuugaaaaa

SEQ ID NO: 340723 - RNA, 66 nt, hsa
cucaaauggcuucacaguccuuacuucucuaccugccucaagaaggggcucagagcagagacuugu

SEQ ID NO: 340724 - RNA, 66 nt, hsa
cagcaaacauucuuccuaaaaggaagacuucauuuucucaagaaaugggauuaguuggggguauua

SEQ ID NO: 340725 - RNA, 66 nt, hsa
auauaacuuuaaaaauaauacuuuuagcucuaauagcucaagaacacaauauucguuaauguucag

SEQ ID NO: 340726 - RNA, 66 nt, hsa
gagagggcacugaagaccugaaucuacacuaguaaucucaagaaagauuauucauucuaucucaga

SEQ ID NO: 340727 - RNA, 66 nt, hsa
accaugacgagcucuagcuggaugggcgcagagaaccucaagaaggcaugaagccagccccugcag

SEQ ID NO: 340728 - RNA, 66 nt, hsa
cagcgcuccagccuggucgacagagugagacuccaucucaagaaaaaauaaaaauaaaguuguucu

SEQ ID NO: 340729 - RNA, 66 nt, hsa
gugcuuugggaggcugaggcaggaggaucacucgagcucaagaauucaagaccugggcaagagaga

SEQ ID NO: 340730 - RNA, 66 nt, hsa
uugcacuccagccugggcgacagagcaagacucugucucaagaagaaaaaaaaaauacauauacac

SEQ ID NO: 340731 - RNA, 66 nt, hsa
agauuuauaugcaugaaguuaaaacaacugacguuacucaagaauuagaaaacuuugcaagauuug

SEQ ID NO: 340732 - RNA, 66 nt, hsa
uugcacuucagccugggcgacacagcgagacccugucucaagaaagaaaagaaaaagagacaaauu

SEQ ID NO: 340733 - RNA, 66 nt, hsa
aucuucuccagcgcugggcccucccuugcccccaagcucaagaagggggcacugcccggcccggcu

SEQ ID NO: 340734 - RNA, 66 nt, hsa
accgaccuacgccacuggaaacacacccaccgcaaccucaagaaccagacugugcagagggcauug

SEQ ID NO: 340735 - RNA, 66 nt, hsa
cugcauuccagccugugcgacagaaugagacacugucucaagaaaaaauaaaagugggaaaaucuu

SEQ ID NO: 340736 - RNA, 66 nt, hsa
uuacaggaccccccaagucuuccuacccucugcacccucaagaaacccccagugccuuguaugaag

SEQ ID NO: 340737 - RNA, 66 nt, hsa
gacuuccuucauuaacaaagacccuuguucuuaucccucaagaagaaacccaccauaaccagccca

SEQ ID NO: 340738 - RNA, 66 nt, hsa
ggcauguaccuauugacuguauccucaugcauuuuccucaagaaugucugaagaagguaguaauau

SEQ ID NO: 340739 - RNA, 66 nt, hsa
ccccgccgggcuacgaugacauguaccugugaaggccucaagaauguaacaucccaggcuucccuc

SEQ ID NO: 340740 - RNA, 64 nt, hsa
cugcacuccagcccgggcaacagaguaagacccugccucaagaaaaaaaaaaaaaaaaaaaauc

SEQ ID NO: 340741 - RNA, 66 nt, hsa
aguggccaggugccggcacagugccucucccagagccucaagaagggccauuuaggagcuugcuuc

SEQ ID NO: 340742 - RNA, 66 nt, hsa
cugcaccgugccugacucauccaguggggaaggugacucaagaaguuguuuaagccuaggccuagg

SEQ ID NO: 340743 - RNA, 66 nt, hsa
auaaaagcuguugcuggaaacuugcuuuaggaacagcucaagaaccuuggaguucauauuucacaa

SEQ ID NO: 340744 - RNA, 66 nt, hsa
ccgagagaagaggaguggaugagccugcggguuugccucaagaaacuucaugagggucucuuacua

SEQ ID NO: 340745 - RNA, 66 nt, hsa
ugucucuauggcgcuuccuugaguggaaggaaaugucucaagaaacaaagaucucgcuggugcgua

SEQ ID NO: 340746 - RNA, 52 nt, hsa; identical to SEQ ID NO: 339334

SEQ ID NO: 340747 - RNA, 66 nt, hsa
gggaaaaucuugcuuuuauggucuuccccccucgcccucaagaacaagggccuugugcgugggccu

SEQ ID NO: 340748 - RNA, 66 nt, hsa
ggacuuguuuauuuucuaguagcuuuuauaaguacacucaagaauuugucagggagaauaauucug

SEQ ID NO: 340749 - RNA, 66 nt, hsa
uagauccagguuuacuuucuaucagcugagcaaccucucaagaaaaaauaaauaaauaaauaaacc

SEQ ID NO: 340750 - RNA, 66 nt, hsa
aaauguguucuguauaaacaaaugcagcuggaaucgcucaagaaucuuauuuuucuaaauccaaca

SEQ ID NO: 340751 - RNA, 66 nt, hsa
gugguccugaagacuccggccaagaggcacaagcagcucaagaacaagcuggagaagaacgaggag

SEQ ID NO: 340752 - RNA, 66 nt, hsa
ccauacuuuccuguauaguucacguuucauguaauccucaagaaauaaaaggaagccaaagagugu

SEQ ID NO: 340753 - RNA, 66 nt, hsa
uuuuuacuguaggugaaggcuguauuuguaguaguacucaagaaucaccugauguuuucuuauucu

SEQ ID NO: 340754 - RNA, 66 nt, hsa
ggggggauuuggcuggugccgaaguguuucugaagucucaagaacugccauaaaaucucacgcugc

SEQ ID NO: 340755 - RNA, 66 nt, hsa
uaaggucgggacauauauuuacauagaucccagacacucaagaauuagcacagcugauguaaaauu

SEQ ID NO: 340756 - RNA, 66 nt, hsa
aggauguccauuucggggagaggagcaggugggacccucaagaaaaugacggagaacaucccagac

SEQ ID NO: 340757 - RNA, 66 nt, hsa
ccggcuuuugaaacuuagguauuuuauauuuuuccccucaagaacuuuuuuuuaagagacagauuu

SEQ ID NO: 340758 - RNA, 66 nt, hsa
ucuccucccagcggccuccggcgucuugcccagcagcucaagaagaaaaagaaggacugaacucca

SEQ ID NO: 340759 - RNA, 66 nt, hsa
uccuuucucgaaauugccaguguguacuuggcuuaacucaagaacaguuucuucuggauuccuuau

SEQ ID NO: 340760 - RNA, 66 nt, hsa
ggccuuucuacaaagcaaggcccacagacuaccccacucaagaacagcagguaugugggccagagg

SEQ ID NO: 340761 - RNA, 66 nt, hsa
caggaggcucccuguacuggagucgucccacuauuccucaagaaaucuuagaaccagcuugugagg

SEQ ID NO: 340762 - RNA, 66 nt, hsa
ugugaucuguacaaguauguggagcaugaaugcugacucaagaaacuuuuacuccuucugcucaag

SEQ ID NO: 340763 - RNA, 66 nt, hsa
auugugagcgaauuagcaauaacauacaugagauaacucaagaaaucaaaagauaguugauucuug

SEQ ID NO: 340764 - RNA, 66 nt, hsa
uguuauaaaaauguauaggcaguauacacagcacuacucaagaagccaaagaaacacuugugcagu

SEQ ID NO: 340765 - RNA, 66 nt, hsa
ggcucaccccucucugaagggcuguuguucugcuuccucaagaaauuaaacauuuguuucugugug

SEQ ID NO: 340766 - RNA, 66 nt, hsa
uugcacuccagccugggugacagagugagacucugucucaagaaggaaaaaaaaaaaaaagaaugu

SEQ ID NO: 340767 - RNA, 66 nt, hsa
gcugccagaggaugagugaccaguugcuaaguggggcucaagaagcaccgccuuccccacccccug

SEQ ID NO: 340768 - RNA, 66 nt, hsa
guucugucacaaauguuccugaaagcaccacagcuacucaagaagaucaaauucaggacauaaacu

SEQ ID NO: 340769 - RNA, 66 nt, hsa
aagucaaucugaaagauuuuucaagaaucuuaaaaucucaagaagugaagcagauucauacagccu

SEQ ID NO: 340770 - RNA, 66 nt, hsa
agagugaugcagacuuguucuucuuuuuaaagcagucucaagaauaagcauuucuuuaaaauguuu

SEQ ID NO: 340771 - RNA, 66 nt, hsa
augagaacacaagaacuuaagagaaaaagaaaccuacucaagaaaagacagaagagacagugauuu

SEQ ID NO: 340772 - RNA, 66 nt, hsa
aagaaugacaaacacaagugccccuuuucucuggaucucaagaaugguggaggacccuggaaggac

SEQ ID NO: 340773 - RNA, 66 nt, hsa
uuuucuugcacuaucacaauugcuuuuuaguuauuucucaagaagcauguucguauuagagacaaa

SEQ ID NO: 340774 - RNA, 66 nt, hsa
gcaaaaccuucgucucuuugugcuuuguaaagcaaacucaagaaaacugguacaccuguaccagcu

SEQ ID NO: 340775 - RNA, 66 nt, hsa
ugaaagaauuagcaguaaaauacaugagauaaagaccucaagaaguuaaaagauacuuaauucuug

SEQ ID NO: 340776 - RNA, 66 nt, hsa; identical to SEQ ID NO: 340763

SEQ ID NO: 340777 - RNA, 66 nt, hsa
ggcagacagacugcaccaccccuucccccccugcaucucaagaauaaagcaagcugccuuuguacu

SEQ ID NO: 340778 - RNA, 66 nt, hsa
auuauuuuagguauuaagacugagaaauauuuaaagcucaagaagaacacagaagcacacaucccu

SEQ ID NO: 340779 - RNA, 66 nt, hsa
uugucuaacgagagacaucaguuucucaggaugauccucaagaacguuauggaguccauguugcaa

SEQ ID NO: 340780 - RNA, 66 nt, hsa
agccaagagcgucagguggcaaaaguccuucuguuacucaagaaaaugcucugaaaaauuccuuuu

SEQ ID NO: 340781 - RNA, 64 nt, hsa
aaugagaaagguauauauauuacuguaacuguagaagggaaaagggaaaguauuugguucuaaa

SEQ ID NO: 340782 - RNA, 64 nt, hsa
aagguauauauauuacuguaacuguagaagggaaaagggaaaguauuugguucuaaaaaauguu

SEQ ID NO: 340783 - RNA, 64 nt, hsa
cuauuaagggaaaggaaaagaacacuagcuaaggaagggaaagggaagugauaucauaaaagua

SEQ ID NO: 340784 - RNA, 64 nt, hsa
auaggucauuuucuauucaccauccuuuacuauuaagggaaaggaaaagaacacuagcuaagga

SEQ ID NO: 340785 - RNA, 64 nt, hsa
aauuauguuacaucuguuuuaaauuuauuucaaaaagggaaacuauuguccccuagcaaggcau

SEQ ID NO: 340786 - RNA, 64 nt, hsa
ccuacucucaggaucaagaaaguguuggcuaaugaagggaaaggauauuuucuuccaagcaaag

SEQ ID NO: 340787 - RNA, 64 nt, hsa
cucacaguggguaaauauaucauacaucucuugaaagggaaaauauccaugucaguuucuuuca

SEQ ID NO: 340788 - RNA, 64 nt, hsa
uuccauugugggguagguggucggggaugggagaaagggaaaagucagggaaggggagaagaaa

SEQ ID NO: 340789 - RNA, 64 nt, hsa
uccuuguuuguuaaugcuauuaaaacucagauucaagggaaauaccagcuuccacuugagucac

SEQ ID NO: 340790 - RNA, 64 nt, hsa
guguuucuuagguaaagucucuuuuugcuacugaaagggaaauggucucuaaacacuggucacu

SEQ ID NO: 340791 - RNA, 64 nt, hsa
uuuaacugcugugaaaauguuuccagugcaagagaagggaaauacuaggaacuaagacauuucu

SEQ ID NO: 340792 - RNA, 64 nt, hsa
aauuaaaacuuacugauauauuggacuuugagccaagggaaagaaugaguacuaucuuuccaga

SEQ ID NO: 340793 - RNA, 64 nt, hsa
uauaaugugugauuaaaugcuuuuuuaaauugcuaagggaaaauaacaaaguguuaguaaucau

SEQ ID NO: 340794 - RNA, 64 nt, hsa
uuuucaauagauuauucugccauuuuuuaaaggaaagggaaaaugaaaacagcaugucuuuuua

SEQ ID NO: 340795 - RNA, 64 nt, hsa
aggugugggguaagggagggaagucacaucagaaaagggaaagccacggaaugugugugaagcc

SEQ ID NO: 340796 - RNA, 64 nt, hsa
cauuuagugcuacgcugcacaguucuacacugucaagggaaaagggagacuaaugaggcuuaac

SEQ ID NO: 340797 - RNA, 64 nt, hsa
ccaaugaaaaaaggucaguugauuccagugcuaaaagggaaaaaccugugguccgcccagaaga

SEQ ID NO: 340798 - RNA, 64 nt, hsa
cgcagaaaagaaaaaaagguuaagcauaaaaagaaagggaaaaagcagaaacacugcagaagac

SEQ ID NO: 340799 - RNA, 64 nt, hsa
agagaacacaccaaaaaagugaaagagaaauugaaagggaaaaaagacaaaaagcauaaggcuc

SEQ ID NO: 340800 - RNA, 64 nt, hsa
acugaaaaggguucuggaguguucauucagagugaagggaaaacuuuauccuucuauuucuuau

SEQ ID NO: 340801 - RNA, 64 nt, hsa
aaggaaugagaacuuugcaguuggaugaauagagaagggaaaaguugcuggagcacggagugaa

SEQ ID NO: 340802 - RNA, 64 nt, hsa
auuuauauguguuauaaugaaugcuucuauuuaaaagggaaauauuucuacaugugcauauagu

SEQ ID NO: 340803 - RNA, 64 nt, hsa
ucauugagggccuaaaguaaucgcgcuaagaauaaagggaaaacggcgucgcccucauuucaac

SEQ ID NO: 340804 - RNA, 64 nt, hsa
guuugucugcccauuaucuucauucugcaagggaaagggaaaggaagcagggcaguggugggug

SEQ ID NO: 340805 - RNA, 64 nt, hsa
gucacgguuugucugcccauuaucuucauucugcaagggaaagggaaaggaagcagggcagugg

SEQ ID NO: 340806 - RNA, 64 nt, hsa
uccaaggaguuagaauuucccaguuuaaaacaaaaagggaaauguccuagguuuucuuugugcu

SEQ ID NO: 340807 - RNA, 64 nt, hsa
aagaauagaagugaaauuugcauaaugaauguaaaagggaaauaaaagucuuuugaagguagcu

SEQ ID NO: 340808 - RNA, 64 nt, hsa
gcaauacacagcuacagacacacauucuguugacaagggaaaaccuucaaagcauguuucuuuc

SEQ ID NO: 340809 - RNA, 64 nt, hsa
cagggucuacgaagaauagggugaaaaaccucagaagggaaaacuccaaaccaguugggagacu

SEQ ID NO: 340810 - RNA, 64 nt, hsa
guuaaagcuuacuuugcagagcuucccaaagugaaagggaaacugaacuucacaauuuugcacc

SEQ ID NO: 340811 - RNA, 64 nt, hsa
auuacugauucuuucugugauuagcagauaccagaagggaaauuauuuaggauuggcaauguaa

SEQ ID NO: 340812 - RNA, 64 nt, hsa
ccucugccuggaaccuggcucgugcugugaccagaagggaaaggcggcuguuuggcucuuucuc

SEQ ID NO: 340813 - RNA, 64 nt, hsa
uuugauagaacuaaggaaauagugguuuugagugaagggaaaggaaacccagaaacauuuuacg

SEQ ID NO: 340814 - RNA, 64 nt, hsa
uuuacugacaaaaagggaaaauacgaaacacagaaagggaaaauaaacugacuuuuauaaugaa

SEQ ID NO: 340815 - RNA, 64 nt, hsa
uuuccaaucaguguauugcucauuuacugacaaaaagggaaaauacgaaacacagaaagggaaa

SEQ ID NO: 340816 - RNA, 64 nt, hsa
ggaguuaccucagcagaagacuagaauuagagaaaagggaaagaccuuuucuucuaguaagugu

SEQ ID NO: 340817 - RNA, 64 nt, hsa
auauuugcaguuggggacagguugaguagaggaaaagggaaagaagggaaagcagaaaacaaau

SEQ ID NO: 340818 - RNA, 64 nt, hsa
guuggggacagguugaguagaggaaaagggaaagaagggaaagcagaaaacaaauuuuuagcau

SEQ ID NO: 340819 - RNA, 64 nt, hsa
ucuccuucuaaaaacuucucaacuguuuucauuuaagggaaagaaaaugaguauuuuguccuuu

SEQ ID NO: 340820 - RNA, 64 nt, hsa
ucaggggagaaaaauuggcaaaacuauuauauguaagggaaauauauacaaaaagaaaauuaau

SEQ ID NO: 340821 - RNA, 64 nt, hsa
cauggggauucuuuucuaagguaauauuaaugagaagggaaaaaaguaucuuuaacagcucuuu

SEQ ID NO: 340822 - RNA, 64 nt, hsa
uuuaauacuuaaggcuuuguaaaaacuauccaugaagggaaagcuccucagcauaacugcucag

SEQ ID NO: 340823 - RNA, 64 nt, hsa
cugugccucucugggagaaaggagagaggauaagaagggaaaguucacaaccugugaacaggga

SEQ ID NO: 340824 - RNA, 64 nt, hsa
gggggacagggcccaucuaccagccuucaucaggaagggaaagggcuuuggggucagguggcag

SEQ ID NO: 340825 - RNA, 64 nt, hsa
gucagacugaacugugugcaacaggaaaagucaaaagggaaaagguagcugaugagguuacaug

SEQ ID NO: 340826 - RNA, 64 nt, hsa
acaagguguuucauuuucguuuuuaugggaaaccaagggaaaagcacauugcgauccauucagu

SEQ ID NO: 340827 - RNA, 64 nt, hsa
ggaaaccaggguuuaucuuuugagaacuuuugguaagggaaaagggaacaggaaaagaaacccc

SEQ ID NO: 340828 - RNA, 64 nt, hsa
cuacaaucuauuuauuggacauguccaugaccagaagggaaacagucauuugcgcacaacuuaa

SEQ ID NO: 340829 - RNA, 64 nt, hsa
ugauggaugauuauuauuuuaaggucuguuuaggaagggaaauggcuacuuggccagccauugc

SEQ ID NO: 340830 - RNA, 64 nt, hsa
ccucaucucauuuggcuguguaaagaaaugggaaaagggaaaaggagagagcaauugaggcagu

SEQ ID NO: 340831 - RNA, 64 nt, hsa
ggccuucucuccagcuggacacaaaccuccuuugaagggaaauaauugccguuaggcuucacag

SEQ ID NO: 340832 - RNA, 64 nt, hsa
ccccgcauggcaguuccuagguugcaguucagggaagggaaacaauaaaucucgcugaauugaa

SEQ ID NO: 340833 - RNA, 64 nt, hsa
agggacaagcagguuuauguguuuaaacagaaagaagggaaaagguacuaugugauaugguacu

SEQ ID NO: 340834 - RNA, 64 nt, hsa
cuuuucaugaauuuugugaacuugccaaaaggggaagggaaaaaucuuuguguuacuucacuca

SEQ ID NO: 340835 - RNA, 64 nt, hsa
ggcaauuuugaccuguccugcccuucuuagcuugaagggaaaccccagagacucuucugucagg

SEQ ID NO: 340836 - RNA, 64 nt, hsa
ccaauuuuuaaauccauuucauuuuuuaaaaaauaagggaaauaaauguaauugccauuuuuca

SEQ ID NO: 340837 - RNA, 64 nt, hsa
aauguaaaaaugcugcaaauuaaaaaccucaaagaagggaaauaauugcaacaaaugggaauug

SEQ ID NO: 340838 - RNA, 64 nt, hsa
cuccacuucuguccucaagaacaaguccuaggucaagggaaacagcacagccuguuuauaauua

SEQ ID NO: 340839 - RNA, 64 nt, hsa
uuauaaggcauucauauuuuuaggacugaauucaaagggaaaugcuucuuugacuuuuuuucau

SEQ ID NO: 340840 - RNA, 64 nt, hsa
uacaauagcuuaccuggcuaaaacuuugcguauaaagggaaaacuugcuuuaaucugugggauu

SEQ ID NO: 340841 - RNA, 64 nt, hsa
auuuauuguuaugaaacuguaaggucuacauauaaagggaaaaaguuaauguggaaagcugauc

SEQ ID NO: 340842 - RNA, 64 nt, hsa
cauucccggcauaccuauuagugucuuaaaaaggaagggaaaagucuuuuguugcccucuccua

SEQ ID NO: 340843 - RNA, 64 nt, hsa
aagauccaggggacauaaauguggagauuaaauaaagggaaauuauugucucuaacugguucug

SEQ ID NO: 340844 - RNA, 64 nt, hsa
aaaaaaaaaaagaaaggacauugaguuuuaacagaagggaaaaggaaagaagaaaagauuuuug

SEQ ID NO: 340845 - RNA, 64 nt, hsa
cucugaacauaaauuuggucaaauaauuggaacaaagggaaacagauacuugauaugaaagcca

SEQ ID NO: 340846 - RNA, 64 nt, hsa
auaaggucauuuucucccucuacucacaauacuaaagggaaaaaauggauucaaagcuaggauu

SEQ ID NO: 340847 - RNA, 64 nt, hsa
aauaauggcuucacugaauguuauggcugcacugaagggaaaugucacgguaaauagcugccaa

SEQ ID NO: 340848 - RNA, 64 nt, hsa
ugaaaacuuacauagacagaaaguagguuuuggaaagggaaaccacagagauuagggggacuua

SEQ ID NO: 340849 - RNA, 64 nt, hsa
aguuuuguaaucaagauuuuauguaacauuuguaaagggaaaauuagcacuuuugugguucuua

SEQ ID NO: 340850 - RNA, 64 nt, hsa
uuguaaagggaaaauuagcacuuuugugguucuuaagggaaaagaaacagaccuuguggagauu

SEQ ID NO: 340851 - RNA, 64 nt, hsa
gaaguugucaauuccucuuauucuuaaauaucuaaagggaaaggaaaccaacuuuaauuucaga

SEQ ID NO: 340852 - RNA, 64 nt, hsa
ccaccauaccucagaagguaggacuguggccuagaagggaaaggaaagcugagaugaugucuua

SEQ ID NO: 340853 - RNA, 64 nt, hsa
uuuggaugaugccuaggcccaaaggagaggccaaaagggaaaccaaggcugcacaccuagaacc

SEQ ID NO: 340854 - RNA, 64 nt, hsa
caauuagucucaguucucuuaauuuucaggaagaaagggaaauugcagccccucagcccccagg

SEQ ID NO: 340855 - RNA, 64 nt, hsa
guucagguguggcagaagcuugcagaugcguccgaagggaaauaaaguguguuggcguuagacu

SEQ ID NO: 340856 - RNA, 64 nt, hsa
guuaacuuccuauucuuucuuaaauuugauggagaagggaaaauaaauugcaguuauugauucu

SEQ ID NO: 340857 - RNA, 64 nt, hsa
uucaguaggauauccaaaguucaauguguuucaaaagggaaaacuuuuacuuguggggguggga

SEQ ID NO: 340858 - RNA, 64 nt, hsa
ccugcuucgauggccccaaagcugggccagaguuaagggaaagaggaggaaguccuaagcagag

SEQ ID NO: 340859 - RNA, 64 nt, hsa
gcagagaaguagcaccauuauccccauuuaacagaagggaaacugaggcucggcaagcauaggc

SEQ ID NO: 340860 - RNA, 64 nt, hsa
uucaaagcacuguguauaaaacaucuaguuuuagaagggaaacaguugaaacuguuuaaaaaua

SEQ ID NO: 340861 - RNA, 64 nt, hsa
auguacauacacauacauacauauuaccauacugaagggaaauggauuuauauuugaauuugau

SEQ ID NO: 340862 - RNA, 64 nt, hsa
cuucaguauuuuaugcaauuuuuuuucacuucugaagggaaaguguauuauaaaaaaagauuuu

SEQ ID NO: 340863 - RNA, 64 nt, hsa
uuaugcuggugggccacuugucgucgucaaagucaagggaaaguucuccuggaccaaggcuugg

SEQ ID NO: 340864 - RNA, 64 nt, hsa
gaaaauacuuaaauguuauguauauggugguaauaagggaaaaaucaaguauuauaaacaagaa

SEQ ID NO: 340865 - RNA, 64 nt, hsa
auacaacaccaaaaaauaucuaguaauauauuuaaagggaaauugagcugcuuuuuuugaaacu

SEQ ID NO: 340866 - RNA, 64 nt, hsa; identical to SEQ ID NO: 328787

SEQ ID NO: 340867 - RNA, 64 nt, hsa; identical to SEQ ID NO: 328788

SEQ ID NO: 340868 - RNA, 64 nt, hsa; identical to SEQ ID NO: 328789

SEQ ID NO: 340869 - RNA, 64 nt, hsa; identical to SEQ ID NO: 328790

SEQ ID NO: 340870 - RNA, 64 nt, hsa; identical to SEQ ID NO: 328791

SEQ ID NO: 340871 - RNA, 64 nt, hsa; identical to SEQ ID NO: 328792

SEQ ID NO: 340872 - RNA, 64 nt, hsa; identical to SEQ ID NO: 328793

SEQ ID NO: 340873 - RNA, 64 nt, hsa; identical to SEQ ID NO: 328794

SEQ ID NO: 340874 - RNA, 64 nt, hsa; identical to SEQ ID NO: 328795

SEQ ID NO: 340875 - RNA, 64 nt, hsa; identical to SEQ ID NO: 328796

SEQ ID NO: 340876 - RNA, 64 nt, hsa; identical to SEQ ID NO: 328797

SEQ ID NO: 340877 - RNA, 64 nt, hsa; identical to SEQ ID NO: 328798

SEQ ID NO: 340878 - RNA, 64 nt, hsa; identical to SEQ ID NO: 328799

SEQ ID NO: 340879 - RNA, 64 nt, hsa; identical to SEQ ID NO: 328800

SEQ ID NO: 340880 - RNA, 64 nt, hsa; identical to SEQ ID NO: 328801

SEQ ID NO: 340881 - RNA, 64 nt, hsa; identical to SEQ ID NO: 328802

SEQ ID NO: 340882 - RNA, 64 nt, hsa; identical to SEQ ID NO: 328803

SEQ ID NO: 340883 - RNA, 64 nt, hsa; identical to SEQ ID NO: 328804

SEQ ID NO: 340884 - RNA, 64 nt, hsa
agaauguggaugcaaaauaucacauaagacaucaugauaacauuugaagaaaaaauaaaacugu

SEQ ID NO: 340885 - RNA, 64 nt, hsa
cugcagaucaacacagucaaagcggcucuagcucugauaacacagagagaggaauguccagguc

SEQ ID NO: 340886 - RNA, 63 nt, hsa
ucauuagaagaacuugauaaaagacucaaauaaauguuagaaagagcccguaauuuuaggacu

SEQ ID NO: 340887 - RNA, 63 nt, hsa
gagucacuuugaaauaguuaauucaacagcaccauguuagaaauauauuggcagccaagacuc

SEQ ID NO: 340888 - RNA, 63 nt, hsa
cagcacuaugaagaguuaauaaaaugcaauuucauguuagagcuagaauaaaaguaauugagc

SEQ ID NO: 340889 - RNA, 63 nt, hsa
ugcauguaaugcuuauuuaguaauggucacuguauguuagauaaggauaaaaauauauuugug

SEQ ID NO: 340890 - RNA, 63 nt, hsa
uguaugggccaucaaccauuuacuuuucccugaauguuagaaacuacaaaaccacuaccuugu

SEQ ID NO: 340891 - RNA, 63 nt, hsa
cuucugucacuacuacuuaaaacucugaugauuauguuagauuuuuuugcuaacuaauaaaga

SEQ ID NO: 340892 - RNA, 63 nt, hsa
uaggcuagucuuuacuuuucauaaaccucucucauguuagagcagcaaagaaaaaccaguuug

SEQ ID NO: 340893 - RNA, 63 nt, hsa
uuuauguauggugcaccuacugugugccaagccauguuagagauacagugggagcaaaaccag

SEQ ID NO: 340894 - RNA, 63 nt, hsa
uauuacacaaauccaguuucagaaugauaaaaaauguuagaccaaauaaugcggcuaauuaac

SEQ ID NO: 340895 - RNA, 63 nt, hsa
uaaucuccuacacaauucauuuacuucauuugaauguuagagcuacucaugauuauuuguguu

SEQ ID NO: 340896 - RNA, 63 nt, hsa
aggguugccucuuggcuggguggagucucugaaauguuagaagaagcgcugaagccuugauug

SEQ ID NO: 340897 - RNA, 63 nt, hsa
ggaugggcagguggagaaugccuggggguagaaauguuagaucuugcaacaucagauccuugg

SEQ ID NO: 340898 - RNA, 63 nt, hsa
aaucaccuuuuaguuuuaguuuuuaaucuaaagauguuagacagaugcugagugugcguuuuc

SEQ ID NO: 340899 - RNA, 63 nt, hsa
caaccgacauguucaaauguuugaaaucccacaauguuagaccaaucuuaaguuucguaaguu

SEQ ID NO: 340900 - RNA, 63 nt, hsa
acugcuuaacuaauuuuaaauaaggaaauaaguauguuagaugcaguagacgauacagguugc

SEQ ID NO: 340901 - RNA, 63 nt, hsa
aauguucuuacccaaauguaccugaacuaaaaaauguuagauguuggugauaaguugacaguu

SEQ ID NO: 340902 - RNA, 61 nt, hsa
gcagccuuggcuccugguaauaggccgcuuuccuucagaaagcccccgguguccagaucgg

SEQ ID NO: 340903 - RNA, 64 nt, hsa
uuuaacuuuggaugugaauuuagucacccuuagcccuucagauaagccuagccaguacauauuu

SEQ ID NO: 340904 - RNA, 64 nt, hsa
cuacguccugcuucuugguugagacuacugggauccuucagaaaagaaacacugggucccauag

SEQ ID NO: 340905 - RNA, 64 nt, hsa
ugggucccauagcuaaauucucaaccgccaggcaccuucagaagaauccagccuaauacuggaa

SEQ ID NO: 340906 - RNA, 64 nt, hsa
aauuaauaagaacugauacaagacaaaaacaguuccuucagauucuacggaaugacaguauauc

SEQ ID NO: 340907 - RNA, 64 nt, hsa
uccaagaguuuagguugugcuggaggagagguuuccuucagauugcugauugcuuauacaaaua

SEQ ID NO: 340908 - RNA, 64 nt, hsa
ucaugccuguagcucucuuccuuuuguuucucacccuucagaaacauauuuuucaguagcucca

SEQ ID NO: 340909 - RNA, 64 nt, hsa
uggagaacaacaagguacccagaauuuuuagaagccuucagaagaggcuaaaauauccagcuuu

SEQ ID NO: 340910 - RNA, 64 nt, hsa
aaaaucuagaauucuuggaaguacauuauauugcccuucagaauagauuccaguuccuguugug

SEQ ID NO: 340911 - RNA, 64 nt, hsa
uuuuuaaaaaggacauuucuaucagggauauauaccuucagaaauaaggaaauaggggaaaaaa

SEQ ID NO: 340912 - RNA, 64 nt, hsa
uggugagaugccaaguuuggucugaguugugaccccuucagaguagaugcccggcaggcugggg

SEQ ID NO: 340913 - RNA, 64 nt, hsa
ggagcucauuacugccuucccucccagggaggccccuucagagaggagaggccacaggagcugc

SEQ ID NO: 340914 - RNA, 64 nt, hsa
uuugauccaguaguuuccacuucuaggaacuuaaccuucagauauauuuucaccagauauaaaa

SEQ ID NO: 340915 - RNA, 64 nt, hsa
uuuuuccccuccacucagaaaccccugcccuuucccuucagaaaacgauggcaggcauuccucu

SEQ ID NO: 340916 - RNA, 64 nt, hsa
acugggacagaggcuacaucugcccuagggagguccuucagaaucuguggagcaagaaaggauu

SEQ ID NO: 340917 - RNA, 64 nt, hsa
gcuucauggcaagacauaaaaugacacucaaaauccuucagaucuggaaaccggcucaguauua

SEQ ID NO: 340918 - RNA, 64 nt, hsa
acagugguuggcuuugaugaacccucaugcugcaccuucagagccaguccucuaguuuggaaua

SEQ ID NO: 340919 - RNA, 64 nt, hsa
gagaaccccuaugaguguaagcaauuugggaaagccuucagaucugucaaaaaucuucgauuuc

SEQ ID NO: 340920 - RNA, 64 nt, hsa
gagaagcccuaugaauauaagcaaugugggaaagccuucagaucagccucgcaccuucaaaugc

SEQ ID NO: 340921 - RNA, 64 nt, hsa
gagaaacccuaugaguguaagcaaugugggaaagccuucagaugugccccacaccuucgaaggc

SEQ ID NO: 340922 - RNA, 64 nt, hsa
gagaaacccuaugaguguaaggaaugugggaaagccuucagaucugccucacaccuucaaauuc

SEQ ID NO: 340923 - RNA, 64 nt, hsa
gagaaacccuaugaguguaagcaaugugggaaagccuucagaucugccucaauccuucaaaugc

SEQ ID NO: 340924 - RNA, 64 nt, hsa
gagaagcccuacgaguguaagcaaugugggaaagccuucagaucugccccacaccuucgaaucc

SEQ ID NO: 340925 - RNA, 64 nt, hsa
gagaaacccuaugaguguaaggaaugugggaaagccuucagaucugccaagaaccuucgaauuc

SEQ ID NO: 340926 - RNA, 64 nt, hsa
gagaaacccuaugaguguaagcaauguggaaaaaccuucagaucuaccucacaccuucgaaaac

SEQ ID NO: 340927 - RNA, 64 nt, hsa
auuauuugacugugagacguccucuaguuuguggccuucagaaaucagaucuuggggagagucc

SEQ ID NO: 340928 - RNA, 64 nt, hsa
augccuuuuguuuuucucugcuauacuugacuugccuucagaauauuacauuccagauaauaug

SEQ ID NO: 340929 - RNA, 64 nt, hsa; identical to SEQ ID NO: 92137

SEQ ID NO: 340930 - RNA, 64 nt, hsa; identical to SEQ ID NO: 92138

SEQ ID NO: 340931 - RNA, 64 nt, hsa; identical to SEQ ID NO: 92139

SEQ ID NO: 340932 - RNA, 64 nt, hsa; identical to SEQ ID NO: 92140

SEQ ID NO: 340933 - RNA, 64 nt, hsa; identical to SEQ ID NO: 92141

SEQ ID NO: 340934 - RNA, 64 nt, hsa; identical to SEQ ID NO: 92142

SEQ ID NO: 340935 - RNA, 64 nt, hsa; identical to SEQ ID NO: 92143

SEQ ID NO: 340936 - RNA, 64 nt, hsa; identical to SEQ ID NO: 92144

SEQ ID NO: 340937 - RNA, 64 nt, hsa; identical to SEQ ID NO: 92145

SEQ ID NO: 340938 - RNA, 64 nt, hsa; identical to SEQ ID NO: 92146

SEQ ID NO: 340939 - RNA, 64 nt, hsa; identical to SEQ ID NO: 92147

SEQ ID NO: 340940 - RNA, 64 nt, hsa; identical to SEQ ID NO: 92148

SEQ ID NO: 340941 - RNA, 64 nt, hsa; identical to SEQ ID NO: 92149

SEQ ID NO: 340942 - RNA, 64 nt, hsa; identical to SEQ ID NO: 92150

SEQ ID NO: 340943 - RNA, 64 nt, hsa; identical to SEQ ID NO: 92151

SEQ ID NO: 340944 - RNA, 64 nt, hsa; identical to SEQ ID NO: 92152

SEQ ID NO: 340945 - RNA, 64 nt, hsa; identical to SEQ ID NO: 92153

SEQ ID NO: 340946 - RNA, 64 nt, hsa; identical to SEQ ID NO: 92154

SEQ ID NO: 340947 - RNA, 64 nt, hsa; identical to SEQ ID NO: 92155

SEQ ID NO: 340948 - RNA, 64 nt, hsa; identical to SEQ ID NO: 92156

SEQ ID NO: 340949 - RNA, 64 nt, hsa; identical to SEQ ID NO: 92157

SEQ ID NO: 340950 - RNA, 64 nt, hsa; identical to SEQ ID NO: 92158

SEQ ID NO: 340951 - RNA, 64 nt, hsa; identical to SEQ ID NO: 92159

SEQ ID NO: 340952 - RNA, 64 nt, hsa; identical to SEQ ID NO: 92160

SEQ ID NO: 340953 - RNA, 64 nt, hsa; identical to SEQ ID NO: 92161

SEQ ID NO: 340954 - RNA, 64 nt, hsa; identical to SEQ ID NO: 92162

SEQ ID NO: 340955 - RNA, 64 nt, hsa; identical to SEQ ID NO: 92163

SEQ ID NO: 340956 - RNA, 64 nt, hsa; identical to SEQ ID NO: 92164

SEQ ID NO: 340957 - RNA, 64 nt, hsa; identical to SEQ ID NO: 92165

SEQ ID NO: 340958 - RNA, 64 nt, hsa; identical to SEQ ID NO: 92166

SEQ ID NO: 340959 - RNA, 64 nt, hsa; identical to SEQ ID NO: 92167

SEQ ID NO: 340960 - RNA, 64 nt, hsa; identical to SEQ ID NO: 92168

SEQ ID NO: 340961 - RNA, 64 nt, hsa; identical to SEQ ID NO: 92169

SEQ ID NO: 340962 - RNA, 64 nt, hsa; identical to SEQ ID NO: 92170

SEQ ID NO: 340963 - RNA, 64 nt, hsa; identical to SEQ ID NO: 92171

SEQ ID NO: 340964 - RNA, 64 nt, hsa; identical to SEQ ID NO: 92172

SEQ ID NO: 340965 - RNA, 64 nt, hsa; identical to SEQ ID NO: 92173

SEQ ID NO: 340966 - RNA, 64 nt, hsa; identical to SEQ ID NO: 92174

SEQ ID NO: 340967 - RNA, 64 nt, hsa; identical to SEQ ID NO: 92175

SEQ ID NO: 340968 - RNA, 64 nt, hsa; identical to SEQ ID NO: 92176

SEQ ID NO: 340969 - RNA, 64 nt, hsa; identical to SEQ ID NO: 92177

SEQ ID NO: 340970 - RNA, 64 nt, hsa; identical to SEQ ID NO: 92178

SEQ ID NO: 340971 - RNA, 64 nt, hsa; identical to SEQ ID NO: 92179

SEQ ID NO: 340972 - RNA, 64 nt, hsa; identical to SEQ ID NO: 92180

SEQ ID NO: 340973 - RNA, 64 nt, hsa; identical to SEQ ID NO: 92181

SEQ ID NO: 340974 - RNA, 64 nt, hsa; identical to SEQ ID NO: 92182

SEQ ID NO: 340975 - RNA, 64 nt, hsa; identical to SEQ ID NO: 92183

SEQ ID NO: 340976 - RNA, 64 nt, hsa; identical to SEQ ID NO: 92184

SEQ ID NO: 340977 - RNA, 64 nt, hsa; identical to SEQ ID NO: 92185

SEQ ID NO: 340978 - RNA, 64 nt, hsa; identical to SEQ ID NO: 92186

SEQ ID NO: 340979 - RNA, 64 nt, hsa; identical to SEQ ID NO: 120942

SEQ ID NO: 340980 - RNA, 64 nt, hsa; identical to SEQ ID NO: 120943

SEQ ID NO: 340981 - RNA, 64 nt, hsa; identical to SEQ ID NO: 120944

SEQ ID NO: 340982 - RNA, 64 nt, hsa; identical to SEQ ID NO: 120945

SEQ ID NO: 340983 - RNA, 64 nt, hsa; identical to SEQ ID NO: 120946

SEQ ID NO: 340984 - RNA, 64 nt, hsa; identical to SEQ ID NO: 120947

SEQ ID NO: 340985 - RNA, 64 nt, hsa; identical to SEQ ID NO: 120948

SEQ ID NO: 340986 - RNA, 64 nt, hsa; identical to SEQ ID NO: 120949

SEQ ID NO: 340987 - RNA, 64 nt, hsa; identical to SEQ ID NO: 120950

SEQ ID NO: 340988 - RNA, 64 nt, hsa; identical to SEQ ID NO: 120951

SEQ ID NO: 340989 - RNA, 64 nt, hsa; identical to SEQ ID NO: 120952

SEQ ID NO: 340990 - RNA, 64 nt, hsa; identical to SEQ ID NO: 120953

SEQ ID NO: 340991 - RNA, 64 nt, hsa; identical to SEQ ID NO: 120954

SEQ ID NO: 340992 - RNA, 64 nt, hsa; identical to SEQ ID NO: 120955

SEQ ID NO: 340993 - RNA, 64 nt, hsa; identical to SEQ ID NO: 120956

SEQ ID NO: 340994 - RNA, 64 nt, hsa; identical to SEQ ID NO: 120957

SEQ ID NO: 340995 - RNA, 64 nt, hsa; identical to SEQ ID NO: 120958

SEQ ID NO: 340996 - RNA, 64 nt, hsa; identical to SEQ ID NO: 120959

SEQ ID NO: 340997 - RNA, 64 nt, hsa; identical to SEQ ID NO: 120960

SEQ ID NO: 340998 - RNA, 64 nt, hsa; identical to SEQ ID NO: 120961

SEQ ID NO: 340999 - RNA, 64 nt, hsa; identical to SEQ ID NO: 120962

SEQ ID NO: 341000 - RNA, 64 nt, hsa; identical to SEQ ID NO: 120963

SEQ ID NO: 341001 - RNA, 64 nt, hsa; identical to SEQ ID NO: 120964

SEQ ID NO: 341002 - RNA, 62 nt, hsa; identical to SEQ ID NO: 120965

SEQ ID NO: 341003 - RNA, 64 nt, hsa; identical to SEQ ID NO: 120966

SEQ ID NO: 341004 - RNA, 64 nt, hsa; identical to SEQ ID NO: 120967

SEQ ID NO: 341005 - RNA, 64 nt, hsa; identical to SEQ ID NO: 120968

SEQ ID NO: 341006 - RNA, 64 nt, hsa; identical to SEQ ID NO: 120969

SEQ ID NO: 341007 - RNA, 64 nt, hsa; identical to SEQ ID NO: 120970

SEQ ID NO: 341008 - RNA, 64 nt, hsa; identical to SEQ ID NO: 120971

SEQ ID NO: 341009 - RNA, 64 nt, hsa
cauugugcggauuaaaagaaauaauauauguaaagcacuuuaacacagcaccaggcccacggaa

SEQ ID NO: 341010 - RNA, 64 nt, hsa
caaggggaucuuuggggcuaacuucgggaucccugcacuuuauguaagaauguaaaccuggagu

SEQ ID NO: 341011 - RNA, 64 nt, hsa
uguuauagggaguaguuuuuucccuuaggacucugcacuuuauagaauguuguaaaacagacaa

SEQ ID NO: 341012 - RNA, 64 nt, hsa
ggcugauaguuuuguuuaagguuuuggauaaggagcacuuuaaaacaaacugguguguuguuuu

SEQ ID NO: 341013 - RNA, 64 nt, hsa
cuuauucucuagguucugagagugaaugcauugggcacuuuaaguugauauuuucucuucuccg

SEQ ID NO: 341014 - RNA, 64 nt, hsa
aaguguccacaacaguuagggaaaugaugcuagagcacuuuaaaaaucagcaggacaacccuga

SEQ ID NO: 341015 - RNA, 64 nt, hsa
uaagugaguacacucuaauuaacuugcuucuguugcacuuuaguuuucuaccugcauauggacu

SEQ ID NO: 341016 - RNA, 64 nt, hsa
uguuuuuaaauuuggaaauaugacauuuuauguagcacuuuauaaaaagugaaagcgacaaauu

SEQ ID NO: 341017 - RNA, 64 nt, hsa
gaugcuagucuuugugaccgauugcuaaucuucugcacuuuaauuuauuuuauauaaacuuuac

SEQ ID NO: 341018 - RNA, 64 nt, hsa
gacaaucaagaauguuauuaauguguaauacugagcacuuuacuucuuaauaaaaacuugauau

SEQ ID NO: 341019 - RNA, 64 nt, hsa
uguaacaaacuuacaaggacaaagaggcuuguuggcacuuuacauauacaguguauacaugugu

SEQ ID NO: 341020 - RNA, 64 nt, hsa
ucaaacgaagacauuccaauacugcuuaauuauagcacuuuauuuuuagcugcugaacugccaa

SEQ ID NO: 341021 - RNA, 64 nt, hsa
aauuucucuccugauggguacuuuaauuugaaaugcacuuuaugcacaguuaugucuuauaacu

SEQ ID NO: 341022 - RNA, 64 nt, hsa
gcaacuuugcacuauguaaaguaccuuauguauugcacuuuaaauuucucuccugauggguacu

SEQ ID NO: 341023 - RNA, 64 nt, hsa
uauucacguguacuguuuaacugagggucucaaagcacuuuaaacuguuguguucuauuuccac

SEQ ID NO: 341024 - RNA, 64 nt, hsa
ucugaaaaauguguagauuaaaugaguuuuuaaagcacuuuagaaaauauaagggagaaaauga

SEQ ID NO: 341025 - RNA, 64 nt, hsa
uggaggcccauucuguauuccuaauccagucucagcacuuuauucauacaaaauaaucaaaaua

SEQ ID NO: 341026 - RNA, 64 nt, hsa
cauuugcacuuuucaaaugccuuuggaugacccagcacuuuaaucugaaaccugcaacaagacu

SEQ ID NO: 341027 - RNA, 64 nt, hsa
ccucuggagccuauggcuuuaagcaagcacuacugcacuuuacagaauuaccccacuggauccu

SEQ ID NO: 341028 - RNA, 64 nt, hsa
caggaguucuuagcuccucagcgagcaacagagagcacuuuagauggcaccuuucaccacuugg

SEQ ID NO: 341029 - RNA, 64 nt, hsa
auucuauuuauaucuuauuacaauaaaauuaguggcacuuuauucauaaauauucaugagccug

SEQ ID NO: 341030 - RNA, 64 nt, hsa
gugugaagguaguacuuuuuagagugcacugagugcacuuuacaucuuuauuuaaauuuuuuuu

SEQ ID NO: 341031 - RNA, 64 nt, hsa
gauuugaaugauugggaugauacaucauugaacugcacuuuauauaaccaaagcuuagcaguuu

SEQ ID NO: 341032 - RNA, 64 nt, hsa
ccuucugagucugccuuuuuugcacugaacauaagcacuuuauacuaaugggucacaaaucuug

SEQ ID NO: 341033 - RNA, 64 nt, hsa
cugaacaaaugaaacucuucuccauuuaaaagaggcacuuuacuuuagacuugccacucugaaa

SEQ ID NO: 341034 - RNA, 64 nt, hsa
guauacaugcggcuucauugccaauaaauuucaugcacuuuaaaguccuguggcuugugaccuc

SEQ ID NO: 341035 - RNA, 64 nt, hsa
ggugccacccucucuggcauucaugcagagcaaagcacuuuaaccauuucuuuuaaaaggucua

SEQ ID NO: 341036 - RNA, 64 nt, hsa
agguuuuguuucaguuuguaagauuucuuuucuggcacuuuaauggcuugagguaucauuauca

SEQ ID NO: 341037 - RNA, 64 nt, hsa
uggcagggcacgguagcucacaccuguaaucccagcacuuuaggaggucaaggugggcagauca

SEQ ID NO: 341038 - RNA, 64 nt, hsa
caggcuuuuggucuuucaaaauuugugauugaaagcacuuuagugacuuggauuuuguaaaucu

SEQ ID NO: 341039 - RNA, 64 nt, hsa
uauuucauucuagaauggaaacgguuccuuaauggcacuuuaaccaguuaacuuggugcaaaac

SEQ ID NO: 341040 - RNA, 64 nt, hsa
ugaacuuacgugacaaugauuguauuccucaguagcacuuuaaacgccgaagacagcccugcag

SEQ ID NO: 341041 - RNA, 64 nt, hsa
ccagcugaaaaccugcugugagaguuuugacagagcacuuuauuuucgucaaguuucaagucug

SEQ ID NO: 341042 - RNA, 64 nt, hsa
gcaguggaccaagcaccaguggcuucagcgguggaccgagcacaggagcuggcuucggcggugg

SEQ ID NO: 341043 - RNA, 64 nt, hsa
guggaccaaacacuggugcuggcuuuggugguggaccgagcaccagugcuggcuuuggcagugg

SEQ ID NO: 341044 - RNA, 64 nt, hsa; identical to SEQ ID NO: 88257

SEQ ID NO: 341045 - RNA, 64 nt, hsa; identical to SEQ ID NO: 88258

SEQ ID NO: 341046 - RNA, 64 nt, hsa; identical to SEQ ID NO: 88259

SEQ ID NO: 341047 - RNA, 64 nt, hsa; identical to SEQ ID NO: 88260

SEQ ID NO: 341048 - RNA, 64 nt, hsa; identical to SEQ ID NO: 88261

SEQ ID NO: 341049 - RNA, 64 nt, hsa; identical to SEQ ID NO: 88262

SEQ ID NO: 341050 - RNA, 64 nt, hsa; identical to SEQ ID NO: 88263

SEQ ID NO: 341051 - RNA, 64 nt, hsa; identical to SEQ ID NO: 88264

SEQ ID NO: 341052 - RNA, 64 nt, hsa; identical to SEQ ID NO: 88265

SEQ ID NO: 341053 - RNA, 64 nt, hsa; identical to SEQ ID NO: 88266

SEQ ID NO: 341054 - RNA, 64 nt, hsa; identical to SEQ ID NO: 88267

SEQ ID NO: 341055 - RNA, 64 nt, hsa; identical to SEQ ID NO: 88268

SEQ ID NO: 341056 - RNA, 64 nt, hsa; identical to SEQ ID NO: 88269

SEQ ID NO: 341057 - RNA, 64 nt, hsa; identical to SEQ ID NO: 88270

SEQ ID NO: 341058 - RNA, 64 nt, hsa; identical to SEQ ID NO: 88271

SEQ ID NO: 341059 - RNA, 64 nt, hsa; identical to SEQ ID NO: 88269

SEQ ID NO: 341060 - RNA, 64 nt, hsa; identical to SEQ ID NO: 88273

SEQ ID NO: 341061 - RNA, 64 nt, hsa; identical to SEQ ID NO: 88274

SEQ ID NO: 341062 - RNA, 64 nt, hsa; identical to SEQ ID NO: 88275

SEQ ID NO: 341063 - RNA, 64 nt, hsa; identical to SEQ ID NO: 88276

SEQ ID NO: 341064 - RNA, 64 nt, hsa; identical to SEQ ID NO: 88277

SEQ ID NO: 341065 - RNA, 64 nt, hsa; identical to SEQ ID NO: 88278

SEQ ID NO: 341066 - RNA, 64 nt, hsa; identical to SEQ ID NO: 88279

SEQ ID NO: 341067 - RNA, 64 nt, hsa; identical to SEQ ID NO: 88280

SEQ ID NO: 341068 - RNA, 64 nt, hsa; identical to SEQ ID NO: 88281

SEQ ID NO: 341069 - RNA, 64 nt, hsa; identical to SEQ ID NO: 88282

SEQ ID NO: 341070 - RNA, 64 nt, hsa; identical to SEQ ID NO: 88283

SEQ ID NO: 341071 - RNA, 64 nt, hsa; identical to SEQ ID NO: 88284

SEQ ID NO: 341072 - RNA, 64 nt, hsa; identical to SEQ ID NO: 88285

SEQ ID NO: 341073 - RNA, 64 nt, hsa; identical to SEQ ID NO: 88286

SEQ ID NO: 341074 - RNA, 64 nt, hsa; identical to SEQ ID NO: 88287

SEQ ID NO: 341075 - RNA, 64 nt, hsa; identical to SEQ ID NO: 88288

SEQ ID NO: 341076 - RNA, 64 nt, hsa; identical to SEQ ID NO: 88289

SEQ ID NO: 341077 - RNA, 64 nt, hsa; identical to SEQ ID NO: 88290

SEQ ID NO: 341078 - RNA, 64 nt, hsa; identical to SEQ ID NO: 88291

SEQ ID NO: 341079 - RNA, 64 nt, hsa; identical to SEQ ID NO: 88292

SEQ ID NO: 341080 - RNA, 64 nt, hsa; identical to SEQ ID NO: 88293

SEQ ID NO: 341081 - RNA, 64 nt, hsa; identical to SEQ ID NO: 88294

SEQ ID NO: 341082 - RNA, 64 nt, hsa; identical to SEQ ID NO: 88295

SEQ ID NO: 341083 - RNA, 64 nt, hsa; identical to SEQ ID NO: 88296

SEQ ID NO: 341084 - RNA, 64 nt, hsa; identical to SEQ ID NO: 88297

SEQ ID NO: 341085 - RNA, 64 nt, hsa; identical to SEQ ID NO: 88298

SEQ ID NO: 341086 - RNA, 64 nt, hsa; identical to SEQ ID NO: 88299

SEQ ID NO: 341087 - RNA, 64 nt, hsa; identical to SEQ ID NO: 88300

SEQ ID NO: 341088 - RNA, 64 nt, hsa; identical to SEQ ID NO: 88298

SEQ ID NO: 341089 - RNA, 64 nt, hsa; identical to SEQ ID NO: 88302

SEQ ID NO: 341090 - RNA, 64 nt, hsa; identical to SEQ ID NO: 88300

SEQ ID NO: 341091 - RNA, 64 nt, hsa; identical to SEQ ID NO: 88304

SEQ ID NO: 341092 - RNA, 64 nt, hsa; identical to SEQ ID NO: 88305

SEQ ID NO: 341093 - RNA, 64 nt, hsa; identical to SEQ ID NO: 88306

SEQ ID NO: 341094 - RNA, 64 nt, hsa; identical to SEQ ID NO: 88307

SEQ ID NO: 341095 - RNA, 64 nt, hsa; identical to SEQ ID NO: 88299

SEQ ID NO: 341096 - RNA, 64 nt, hsa; identical to SEQ ID NO: 88309

SEQ ID NO: 341097 - RNA, 64 nt, hsa; identical to SEQ ID NO: 88310

SEQ ID NO: 341098 - RNA, 64 nt, hsa; identical to SEQ ID NO: 88311

SEQ ID NO: 341099 - RNA, 64 nt, hsa; identical to SEQ ID NO: 88312

SEQ ID NO: 341100 - RNA, 64 nt, hsa; identical to SEQ ID NO: 88313

SEQ ID NO: 341101 - RNA, 64 nt, hsa; identical to SEQ ID NO: 88314

SEQ ID NO: 341102 - RNA, 64 nt, hsa; identical to SEQ ID NO: 88315

SEQ ID NO: 341103 - RNA, 64 nt, hsa; identical to SEQ ID NO: 88316

SEQ ID NO: 341104 - RNA, 64 nt, hsa; identical to SEQ ID NO: 88317

SEQ ID NO: 341105 - RNA, 64 nt, hsa; identical to SEQ ID NO: 88318

SEQ ID NO: 341106 - RNA, 64 nt, hsa; identical to SEQ ID NO: 88319

SEQ ID NO: 341107 - RNA, 64 nt, hsa; identical to SEQ ID NO: 88320

SEQ ID NO: 341108 - RNA, 64 nt, hsa; identical to SEQ ID NO: 88321

SEQ ID NO: 341109 - RNA, 64 nt, hsa; identical to SEQ ID NO: 88322

SEQ ID NO: 341110 - RNA, 64 nt, hsa; identical to SEQ ID NO: 88323

SEQ ID NO: 341111 - RNA, 64 nt, hsa; identical to SEQ ID NO: 88324

SEQ ID NO: 341112 - RNA, 64 nt, hsa; identical to SEQ ID NO: 88325

SEQ ID NO: 341113 - RNA, 64 nt, hsa; identical to SEQ ID NO: 88326

SEQ ID NO: 341114 - RNA, 64 nt, hsa; identical to SEQ ID NO: 88327

SEQ ID NO: 341115 - RNA, 64 nt, hsa; identical to SEQ ID NO: 88328

SEQ ID NO: 341116 - RNA, 64 nt, hsa; identical to SEQ ID NO: 88329

SEQ ID NO: 341117 - RNA, 64 nt, hsa; identical to SEQ ID NO: 88330

SEQ ID NO: 341118 - RNA, 65 nt, hsa
gcagguuggugauucaguccgaccuucuuuagguaaccgagcauuuauuuaaccaacuauaccac

SEQ ID NO: 341119 - RNA, 65 nt, hsa
uaccuagaccguuauaaagugugccacauggacuuaccgagcauggagagaggauuuuagcuagg

SEQ ID NO: 341120 - RNA, 65 nt, hsa
aagcaauauaagugugauugcaagaaugguagaggaccgagcacagaaaucuuagagauuucuug

SEQ ID NO: 341121 - RNA, 65 nt, hsa
ugagcaccauagcaccauugucuccacucgccauuaccgagcaccagaagucauccuugguaagg

SEQ ID NO: 341122 - RNA, 65 nt, hsa
agcaccucuccgagccaugugagcccccugaugccaccgagcaggggcagcuucaugaccgaugu

SEQ ID NO: 341123 - RNA, 65 nt, hsa
ggggugacaugggcccuaggcagacugcaagcccgaccgagcacuuggacucgaacucugugccg

SEQ ID NO: 341124 - RNA, 65 nt, hsa
agccaagcaugggaaucuuugcucccaggcccagcaccgagcagaacagaccagagcccaccaca

SEQ ID NO: 341125 - RNA, 65 nt, hsa
cuugagacaaagugaaucaacuuccacuuaguuguaccgagcauaaaacagaacuugggcuuccu

SEQ ID NO: 341126 - RNA, 65 nt, hsa
ggggcagcugaacagaaggaugucugugugcaucaaccgagcagauugugcgcacacucguuucc

SEQ ID NO: 341127 - RNA, 65 nt, hsa
aauugcaguccacguaacuggcugcagagaaaucuaccgagcaaggaaaaggcacacacacacgu

SEQ ID NO: 341128 - RNA, 65 nt, hsa
ugaggguguggccuucaccaggggcugcuguaauuaccgagcaaggucugagcucuucuucagcc

SEQ ID NO: 341129 - RNA, 65 nt, hsa
gacacaaccccgaggcaggagagugacuguggccaaccgagcaggggaacaggggcuuuggacuc

SEQ ID NO: 341130 - RNA, 65 nt, hsa
ccaggcccccucacccucaaaguguagcgcccccaaccgagcaaccucgguuuggucccuaaaac

SEQ ID NO: 341131 - RNA, 65 nt, hsa
ggccucguggacugcugcugagaaaccgaguucagaccgagcagguucuccuccugagguccucg

SEQ ID NO: 341132 - RNA, 65 nt, hsa
ccuucugaacuacacugcauuguugugccgagaacaccgagcacugaacuuugcaaagaccuucg

SEQ ID NO: 341133 - RNA, 65 nt, hsa
uuguccaggcauggccuguggcccgagggccaaccaccgagcaggcacagcacagcagugacucg

SEQ ID NO: 341134 - RNA, 65 nt, hsa
ccugcuggaauauggaggaagcggaaauguaccuaaccgagcaggacaucuuccuauacaccgag

SEQ ID NO: 341135 - RNA, 65 nt, hsa
gagaggaaccaauaccuucaaggcucuucuuccucaccgagcaugcuucccuaggaucccgucuu

SEQ ID NO: 341136 - RNA, 65 nt, hsa
gaaccgcaggaugaaaaugaagaaaaucaacaaagaccgagcaaaagacgagugaugccauuugg

SEQ ID NO: 341137 - RNA, 65 nt, hsa
cauaccuaccuggggcaugacaucugucagguggcaccgagcaggaugcggggauggacccuaga

SEQ ID NO: 341138 - RNA, 65 nt, hsa
aauaaaaaaaggaaaggaaacuuugaaccuuauguaccgagcaaaugccaggucuagcaaacaua

SEQ ID NO: 341139 - RNA, 65 nt, hsa
accagggaauaggcuguugggcuggcaggagugaaaccgagcauaguuuccucuccaacuccucu

SEQ ID NO: 341140 - RNA, 65 nt, hsa
ggagagaggacucaacugggacccacguggaaaagaccgagcaggccacagaggcucggucuccc

SEQ ID NO: 341141 - RNA, 65 nt, hsa
cuuugggagcccgccuuguggauccaccacaccccaccgagcacuagaagcugcauaagcuacac

SEQ ID NO: 341142 - RNA, 65 nt, hsa
ccucgugauaaguaugucaccaauauaugauuuaaaccgagcacugaugcuggacuucaugauuu

SEQ ID NO: 341143 - RNA, 65 nt, hsa
ccuccccacucgggagaagcagagcugaccuuaggaccgagcaccagggcagguugcgcugacuc

SEQ ID NO: 341144 - RNA, 65 nt, hsa
ccuucacuuuacaaauucaagccuuagauaaaagaaccgagcaauuuucugcuaaaaaguccuug

SEQ ID NO: 341145 - RNA, 65 nt, hsa
gaagucacccugugauucucuuugcccacaugaccaccgagcauuauuacguaauuagaggguua

SEQ ID NO: 341146 - RNA, 65 nt, hsa
gcagugggacagggggcugcagggguccugccaccaccgagcaccaacuuggccccugggguccu

SEQ ID NO: 341147 - RNA, 65 nt, hsa
acuccuguccccagccugaccuccagccuccagagaccgagcagcuguggggccugcugggaaac

SEQ ID NO: 341148 - RNA, 65 nt, hsa
acuaccagagccguuacuacacacaaaggcuauugaccgagcacauaccaugugccacacaccuu

SEQ ID NO: 341149 - RNA, 65 nt, hsa
uaaaugcuguucuuacacauaauuucuuaauuuucaccgagcagagguggaaaaauacuuuugcu

SEQ ID NO: 341150 - RNA, 65 nt, hsa
uuuuacacuuuaagguagcaaaugucaauuauuagaccgagcauauugugaagaauuaaacuaaa

SEQ ID NO: 341151 - RNA, 62 nt, hsa
agaacgagagcaaagcaugaugggugaagagaaccgagcaaagaucaaaauaaaaagugaca

SEQ ID NO: 341152 - RNA, 65 nt, hsa
cugaagacaauuaucaaccacguggagaaaaucaaaccgagcagggcugugugaaacaugguugu

SEQ ID NO: 341153 - RNA, 65 nt, hsa
uucuggauaaggucacuguccuaggugcuagguggaccgagcaaaagacucaguggaugaacugg

SEQ ID NO: 341154 - RNA, 65 nt, hsa
uggagggcucggucggcgaccucugaagagagugcaccgagcaaaccaagugccggagcaccagc

SEQ ID NO: 341155 - RNA, 65 nt, hsa
aauaaaaaauggaaaggaaacuuugaaccuuauguaccgagcaaaugcaaggucuagcaaauaua

SEQ ID NO: 341156 - RNA, 65 nt, hsa
ucaucaugcuguguggcacaaauguguuacauuugaccgagcauaugcaacucgcuacugaagaa

SEQ ID NO: 341157 - RNA, 65 nt, hsa
acgcagcagcagagccgccguuugcuggguuguuuaccgagcacugugaccuuucuuucccugga

SEQ ID NO: 341158 - RNA, 65 nt, hsa
acucaggaugcuuuccaaagccaaucacuggggagaccgagcacagggaggaccaaggggaaggg

SEQ ID NO: 341159 - RNA, 65 nt, hsa
ccugcacauguucccaugcaugugugugcacucggaccgagcaucucccacgcaccucuacccca

SEQ ID NO: 341160 - RNA, 65 nt, hsa
ccgccccuccucaucgggguccuccagcgucuguuaccgagcacugcucccagggggcgcucaau

SEQ ID NO: 341161 - RNA, 65 nt, hsa
uacaguguuacccuguaagguguuagccuuaaaccaccgagcagcguucucuugaugccagugca

SEQ ID NO: 341162 - RNA, 65 nt, hsa
gugccccgugcagggaucaggagggcgggggagggaccgagcagcccucuugcccggucggguca

SEQ ID NO: 341163 - RNA, 65 nt, hsa
guguguauuuucauuccaggugaaaagcaggauguaccgagcacuuuauucagugcauagcuuua

SEQ ID NO: 341164 - RNA, 65 nt, hsa
gagaccguaucacuacaaaaaaguuuuuuuaguucaccgagcaugguggcacaugccuguagucc

SEQ ID NO: 341165 - RNA, 65 nt, hsa
gggcaggccccauccugggcauuggagaugaugaaaccgagcagaccuggcccauguggagcugg

SEQ ID NO: 341166 - RNA, 65 nt, hsa
gccagcauggcuggagaggcaggcauaggcagggaaccgagcagcaggucagagcaggcgagcug

SEQ ID NO: 341167 - RNA, 65 nt, hsa
agccugcagagccacagucagccugcccacaugccaccgagcaaacgcaucuugcuuuucacauc

SEQ ID NO: 341168 - RNA, 65 nt, hsa
cgcuggccccucagcggugagcccugcccacucuuaccgagcaagguggguggcucuggcacgag

SEQ ID NO: 341169 - RNA, 65 nt, hsa
gagacucgcuggagaggcggcucccguguccguccaccgagcacucagauggaugcugaucacca

SEQ ID NO: 341170 - RNA, 65 nt, hsa
auggagaccaugucaugcagaauuaacaagguagcaccgagcauaucaauaaauauuauucugau

SEQ ID NO: 341171 - RNA, 65 nt, hsa
guugggggcgggguaauuauuuuauuuaaaaaaauaccgagcagcaaaaggggagaagaucccac

SEQ ID NO: 341172 - RNA, 65 nt, hsa
ugcaguggaccaagcaccaguggcuucagcgguggaccgagcacaggagcuggcuucggcggugg

SEQ ID NO: 341173 - RNA, 65 nt, hsa
gguggaccaaacacuggugcuggcuuuggugguggaccgagcaccagugcuggcuuuggcagugg

SEQ ID NO: 341174 - RNA, 65 nt, hsa
aguucgcccuucccccaccuccuugucuuuccccgaccgagcaccagacugcagaaugaggcaau

SEQ ID NO: 341175 - RNA, 65 nt, hsa
cguccaguaaagaagauaaccucaaucauggccauaccgagcagauaaaacucagaggaaauuug

SEQ ID NO: 341176 - RNA, 65 nt, hsa
guaaacugucuaguguuugcauuaaauaaaauggcaccgagcagauucuugucuucugauggugu

SEQ ID NO: 341177 - RNA, 65 nt, hsa
ggagcaaggcuugccagcaagucagaaggauuugaaccgagcagccaaucuuuccagcccucccc

SEQ ID NO: 341178 - RNA, 63 nt, hsa
agggagcccagccuauucccguuggcuggcugggccccucagcugcugggccccaccucccca

SEQ ID NO: 341179 - RNA, 63 nt, hsa
uuccagggggcucugcuccaaguucccuagcgggccccucagggagaaauagccucacgugca

SEQ ID NO: 341180 - RNA, 63 nt, hsa
cugagaugugggaggugcagcauguuccccugggccccucagaaagucgagcuuggaggccag

SEQ ID NO: 341181 - RNA, 63 nt, hsa
ccagaugucugcagcccucagcagcugcagaccgccccucaccaacccagagaaccugcuuua

SEQ ID NO: 341182 - RNA, 63 nt, hsa
gcauuggugccaaguccaguggaugagaauccagccccucacaagcugugggauggggcuugg

SEQ ID NO: 341183 - RNA, 63 nt, hsa
aggcaccgugggccuggcacuugcaaaaguguggccccucacucuaguguguggucccucuca

SEQ ID NO: 341184 - RNA, 63 nt, hsa
ucuaacugggccuaaggugagcugagggcuugagccccucagcccagcgggggucccuuuuca

SEQ ID NO: 341185 - RNA, 63 nt, hsa
acugcgggagccagcgcuccugccgccccucuugccccucagaccuugcauccacagaagcac

SEQ ID NO: 341186 - RNA, 63 nt, hsa
agugauucucccagaagcacaaagcauacucuugccccucagguguugcuuguguacaucgua

SEQ ID NO: 341187 - RNA, 63 nt, hsa
aggcaacaauagagacacaggcuggguuggucugccccucagucaggcccccuuacccaccca

SEQ ID NO: 341188 - RNA, 63 nt, hsa
ccauggagugggaauccccagccgaggcccuaggccccucagcagggaagggauccccgggga

SEQ ID NO: 341189 - RNA, 63 nt, hsa
cugcaucuuggaggcagggaggugagggcaggugccccucagacacuucaggaagguaguuug

SEQ ID NO: 341190 - RNA, 63 nt, hsa
caaucaugugaaggacagaagcuuuugccaugggccccucacaucagggaaaaugaccuucac

SEQ ID NO: 341191 - RNA, 63 nt, hsa
ugcccaccccucaaguguaaggaacugcguuccgccccucaggcccccaugggggcagggauc

SEQ ID NO: 341192 - RNA, 63 nt, hsa
uugauaaaucagaggugcuacugaggaguuggugccccucauuccagaaucuccuacccccag

SEQ ID NO: 341193 - RNA, 63 nt, hsa
uacuuauuucuggccaaaugaaucugcuucucugccccucaaacuuuuaguucacaauucauc

SEQ ID NO: 341194 - RNA, 63 nt, hsa
aaagcacucuuauuuuuugaucuggccuauuuugccccucauuguguagccucaauuaacaca

SEQ ID NO: 341195 - RNA, 63 nt, hsa
gccucugggaggagagggacuccuggggggccugccccucauacgccaucaccaaaaggaaag

SEQ ID NO: 341196 - RNA, 63 nt, hsa
cuuccugcccuguguuaggagauagggauauuggccccucacugcagcugccagcacuugguc

SEQ ID NO: 341197 - RNA, 63 nt, hsa
ccccuagccccuucccuccuccuggggccuccagccccucacacugcuguucccagugauauu

SEQ ID NO: 341198 - RNA, 63 nt, hsa
augccgggaagccagagaccugcaggggccucggccccucacaucguguaugucucuccuuga

SEQ ID NO: 341199 - RNA, 63 nt, hsa
cucugcucccuucuucaguaagcaaggagccccgccccucaggcccagccucuggcaagaggu

SEQ ID NO: 341200 - RNA, 59 nt, hsa
gcuucgccaagcuggacugagccuuccaggccccucaugcagaccugggguccuccugg

SEQ ID NO: 341201 - RNA, 63 nt, hsa
ggccugaacugccucugcuucccccccugaggggccccucacucuuacccaagacucuggauu

SEQ ID NO: 341202 - RNA, 63 nt, hsa
uagcccagcccaucuaaauggaagcugggaauugccccucaccuccccuguguccuguccagc

SEQ ID NO: 341203 - RNA, 63 nt, hsa
gcacacacugcaugccuuaacaagugugugcaagccccucagaacucaagacauccaaauuuu

SEQ ID NO: 341204 - RNA, 63 nt, hsa
aaagauuucugaacagugauugucccguuaauagccccucagaagauguucccugcugauaac

SEQ ID NO: 341205 - RNA, 63 nt, hsa
gucauaaaaaacaguggagcucuguauuagaaagccccucagaacugggaaggccagguaacu

SEQ ID NO: 341206 - RNA, 63 nt, hsa
ucgguauauuaaguccaaaagaugguccgggcugccccucacaaaagcuucugcauccacgug

SEQ ID NO: 341207 - RNA, 63 nt, hsa
agccugggacccuguuuacaguugcacaucugggccccucacuguggggauugaucauucuca

SEQ ID NO: 341208 - RNA, 63 nt, hsa
acuccugggcuucagccucucccacccagcccugccccucaccugccugcccuccccuccccc

SEQ ID NO: 341209 - RNA, 63 nt, hsa
gcuggaagaagccuuagagcucaacuucuucaagccccucacuuuacagaugaggaaauggag

SEQ ID NO: 341210 - RNA, 63 nt, hsa
ggccagaagcaccagccugcugccagcggggcagccccucauaggaggcccaggagggagccc

SEQ ID NO: 341211 - RNA, 63 nt, hsa
ccacagcccugagaugggccggcccccuuccuggccccucauggcgggacuggagaaaugguc

SEQ ID NO: 341212 - RNA, 63 nt, hsa
ccggcccauaucccugguugccucauggccagcgccccucagccucugccacugugaaccggc

SEQ ID NO: 341213 - RNA, 63 nt, hsa
ucugagcagccguguugggggcgcucccucucugccccucagcgagagccucggaccucccaa

SEQ ID NO: 341214 - RNA, 63 nt, hsa
cgaccugcugacccacggucacugcuguguucagccccucagcucggccccagccuauuuccc

SEQ ID NO: 341215 - RNA, 63 nt, hsa
gagagggcccagcuguagccauggcucaggcaagccccucagcccuugcccccaucccucgga

SEQ ID NO: 341216 - RNA, 57 nt, hsa
uuuucuuuaaaacaucauaaggccagggccccucacccugccuuaucuugcacccca

SEQ ID NO: 341217 - RNA, 63 nt, hsa
cuuuucgaacugugcucccacggggaccacugggccccucaggggaagcugcuaggggaagga

SEQ ID NO: 341218 - RNA, 63 nt, hsa
ggaggggaggcggaucugaggggcugggugcaggccccucaguuggggcucccaccuucccca

SEQ ID NO: 341219 - RNA, 63 nt, hsa
uggggucccagggcccuuccuuguuucucagaggccccucagccacuggaaccccaucuucag

SEQ ID NO: 341220 - RNA, 63 nt, hsa
cagccucuuuccgucccucucuuucugauccaggccccucaguccaagcuuuggaaaaccuuc

SEQ ID NO: 341221 - RNA, 63 nt, hsa
gaagcacaugccucucucaggccaaacucaccugccccucaacucuccuccagagucagaagu

SEQ ID NO: 341222 - RNA, 63 nt, hsa
cccagcugcagccacccuucucaucuggaucgggccccucagaagcaggaaacccucaaaccc

SEQ ID NO: 341223 - RNA, 63 nt, hsa
uguccuacaucucccugaaccagagugugcccugccccucaugcucagaccucucccacccca

SEQ ID NO: 341224 - RNA, 63 nt, hsa
uuuuuguauuucuggggcugaggcucagcaacagccccucaggcuuccagugaguccccaucu

SEQ ID NO: 341225 - RNA, 63 nt, hsa
gugagaaagcuaaaaugguggucuucuccaccagccccucacaggcuuggggguuuucaaugu

SEQ ID NO: 341226 - RNA, 63 nt, hsa
aaccagugcauucuacuucucgaguguucacuugccccucaguuugugaccaaguugugggua

SEQ ID NO: 341227 - RNA, 63 nt, hsa
caacuauagacuugcucauuguucagacugauugccccucaccugaauccacucucuguauuc

SEQ ID NO: 341228 - RNA, 63 nt, hsa
cucuaucuuuagauuucaaaccuuaggcuuacagccccucaauaucucucugcuaacaccagu

SEQ ID NO: 341229 - RNA, 63 nt, hsa
gaccccucccuugcucagugccuccuggccggggccccucaccccaaggggucuguauauaca

SEQ ID NO: 341230 - RNA, 63 nt, hsa
acauuaaucaccaaaguauuaauguacagaguggccccucaccugggccuuuccugugccaac

SEQ ID NO: 341231 - RNA, 63 nt, hsa
guccauccuggagacccugaggucuaagcuacagccccucagccaaccacagacccuucucug

SEQ ID NO: 341232 - RNA, 63 nt, hsa
uuccuggcucgucucaaaggccaggacccuggggccccucaacugcagucagagagcaagccc

SEQ ID NO: 341233 - RNA, 63 nt, hsa
uaccugaccaacaguuccuucagcuuccauuucgccccucauuuaucccucaacccccagccc

SEQ ID NO: 341234 - RNA, 63 nt, hsa
uaugcuacuuucucucagcauccaauaaucauggccccucaauuuauuuguggucacccaggg

SEQ ID NO: 341235 - RNA, 63 nt, hsa
aaaaagugcggaggaaguagcuggacaggcccugccccucaccagcaagaggcaugauuggau

SEQ ID NO: 341236 - RNA, 63 nt, hsa
ccuuccugcucacauccacagucagggcacggcgccccucaagaacuccagagucaccugucu

SEQ ID NO: 341237 - RNA, 63 nt, hsa
caaaacccaaguagaugccucuaggggcacauggccccucacaucacaagccagaaccuaagc

SEQ ID NO: 341238 - RNA, 63 nt, hsa
uuagccauccccuccucagcaaggcaucuaccggccccucacagagacaguacuuugaaacuc

SEQ ID NO: 341239 - RNA, 63 nt, hsa
agagaaaaacccuccucugguaguucugugugugccccucaccccugugugcuagugucuggg

SEQ ID NO: 341240 - RNA, 63 nt, hsa
uugcccuugcaaaggcuuccuaggucuccaguggccccucaggacccagggucccagcugcug

SEQ ID NO: 341241 - RNA, 63 nt, hsa
agugacccuggcaguguuugccugcucagaguggccccucagaacaacagggcuggccuugga

SEQ ID NO: 341242 - RNA, 63 nt, hsa
cccagucauccagcagcgucaacaucgugaugggccccucagccagggcugccagccaggcca

SEQ ID NO: 341243 - RNA, 63 nt, hsa
cgcgaagugaaggaugcgucacuuuucugagcggccccucagaccucuccugcuggucccugg

SEQ ID NO: 341244 - RNA, 57 nt, hsa
ggcuccagaguugcaagugacaggagggccccucaggcagagauggaccaggcggug

SEQ ID NO: 341245 - RNA, 63 nt, hsa
ucaaaauauauucagcaaaggguucacuuaguugccccucaugcuucacagguugacuaguau

SEQ ID NO: 341246 - RNA, 63 nt, hsa
ugugaaugugccucguucaucccuggugcuugagccccucaagcuccagucaaugauccaguc

SEQ ID NO: 341247 - RNA, 63 nt, hsa
ccacucucugcccacuaccuaugcuucuagaaagccccucaccucaggaccccagagggacca

SEQ ID NO: 341248 - RNA, 63 nt, hsa
guguugcgcccggagcccgcccuucgccucccagccccucaagacaccgcuggcugcuggaca

SEQ ID NO: 341249 - RNA, 63 nt, hsa
gcccggccccgccgcggcccggacccccagccagccccucacagcucuuccccagcuccgccu

SEQ ID NO: 341250 - RNA, 63 nt, hsa
cacucuggccaaggagcucugaauugugagucugccccucaggggaauucggagcuagaggac

SEQ ID NO: 341251 - RNA, 63 nt, hsa
ccuucccccauccaugguugggaaagaagcucagccccucacaguggccucaagugugaugcc

SEQ ID NO: 341252 - RNA, 63 nt, hsa
gcgccccggcugggcggaggaggagacgcccaugccccucaggggaaaguggagaccgggaca

SEQ ID NO: 341253 - RNA, 63 nt, hsa
gcugcacaugccagugugacccuugaagacagugccccucagagaccccaagaccuuagggau

SEQ ID NO: 341254 - RNA, 63 nt, hsa
cuaaugacacccacuccuagcccugaggcucgugccccucagacuggggaagaguccaaggaa

SEQ ID NO: 341255 - RNA, 63 nt, hsa
cuggggagggcccucuggccccaggcaaccuuagccccucagaacagggagucccaggaccca

SEQ ID NO: 341256 - RNA, 63 nt, hsa
gcuccguaagaacucagaugccugggaagcccagccccucaggugcccccacacacagccuuc

SEQ ID NO: 341257 - RNA, 63 nt, hsa
uuuauucacucuucagacacgcuacucaagagugccccucagcugcugaacaagcauuuguag

SEQ ID NO: 341258 - RNA, 63 nt, hsa
agaccucuuauugcccauucuccuuucuucucagccccucaccccucuuuagcaauuccuaga

SEQ ID NO: 341259 - RNA, 63 nt, hsa
ggcccacugagcugcacugggauucuucacucugccccucacuuccuuuagggcaaauaacac

SEQ ID NO: 341260 - RNA, 63 nt, hsa
cuuuuuauacuuuguaaagacaauuguuggagagccccucacacagcccuggccucugcucaa

SEQ ID NO: 341261 - RNA, 63 nt, hsa
uuccugugcugcccugcaccuaggagagacucagccccucacagcuugggauguuaccuugcc

SEQ ID NO: 341262 - RNA, 63 nt, hsa
acuugccacaggagcgauguguuuucucugagugccccucacuuacauguuuaucuuuguuug

SEQ ID NO: 341263 - RNA, 63 nt, hsa
ucccacgccugcccacuuugcuagcccggcugugccccucacuaucagagacugggcgaagca

SEQ ID NO: 341264 - RNA, 63 nt, hsa
cuuccagccccuccaggacccggucccccugcugccccucacuucaggaggggccuggagcag

SEQ ID NO: 341265 - RNA, 63 nt, hsa
uagguuuuuauuguugaauguacaucuaccccagccccucaaaagaaaaacuguuuacauaga

SEQ ID NO: 341266 - RNA, 63 nt, hsa
gcuauuuuuauagcugauauaguuacaccucaagccccucagggguaacaacuaacaaacacc

SEQ ID NO: 341267 - RNA, 63 nt, hsa
guuuucuagaagguugggauugucaggguccuggccccucagaacuggcuugaucaagggccu

SEQ ID NO: 341268 - RNA, 63 nt, hsa
gaugcagccgucugaugaggccacaaccccuaggccccucaggagcuuugcagagaggaggac

SEQ ID NO: 341269 - RNA, 63 nt, hsa
ugcuacucuuugagaaugaaguugucauucagggccccucauguagccaaaagaccaagaaaa

SEQ ID NO: 341270 - RNA, 63 nt, hsa
auaugagcuacugaggaggggguuggacauccugccccucaccccccacccacacugcaggua

SEQ ID NO: 341271 - RNA, 63 nt, hsa
guuuacauguguagccuauguugugguccaucagccccucacauuccuagggguuugagaugc

SEQ ID NO: 341272 - RNA, 63 nt, hsa
caggguagggcugucgccuuagaucccgcccaagccccucauucccuccuugcacagaugcau

SEQ ID NO: 341273 - RNA, 63 nt, hsa
ccuaggaaccgccgcugccugcuggggggccacgccccucaugcccuugucccaggcccgggg

SEQ ID NO: 341274 - RNA, 63 nt, hsa
gccacaccagccuggauuucaaucccagaaucugccccucacgaggaugugaccuugggcaga

SEQ ID NO: 341275 - RNA, 63 nt, hsa
ccgugcuucucccuugggcagccucucucuugagccccucacccuguuucuuucugugaagcg

SEQ ID NO: 341276 - RNA, 63 nt, hsa
aauucuuucucauguugggagugagaaugccgggccccucagggcugucggugugcugucagc

SEQ ID NO: 341277 - RNA, 63 nt, hsa
uucuagaacacuuggagccugaacucugaccaggccccucacuugagccuuugcuuucugcuc

SEQ ID NO: 341278 - RNA, 63 nt, hsa
augacccacuaacguggcaacuuuaacccaaaggccccucagacauguuacagcaaaucugga

SEQ ID NO: 341279 - RNA, 63 nt, hsa
gccuccgaggagaccaggaacccugcuucagcagccccucagggcuucccaaggauguccagc

SEQ ID NO: 341280 - RNA, 63 nt, hsa
uguggccacagcucuggagugggaggguugguugccccucaccucagagcucccccaaaggcc

SEQ ID NO: 341281 - RNA, 63 nt, hsa
ggauuaggagagggggugaugaccccuccccaagccccucagggcccagaccuuccugcucuc

SEQ ID NO: 341282 - RNA, 63 nt, hsa
gcucgaccuugcucuuauuagucccucaccccugccccucaugaucucccacuuucucuagcu

SEQ ID NO: 341283 - RNA, 63 nt, hsa
gucuccagaagucguggccuuccagaacagucugccccucaaggaaggguggggcaggcagua

SEQ ID NO: 341284 - RNA, 63 nt, hsa
ggcuaagaaguucaccagcccugagccauggcggccccucagccugccugaagagaggaaacu

SEQ ID NO: 341285 - RNA, 63 nt, hsa
gcuagguuaggcccugcacuccaccuggggacggccccucaucaccugaaguccucugcugug

SEQ ID NO: 341286 - RNA, 63 nt, hsa
cugcuccaaaaucaucaacucagccccugggcugccccucagaggcggugucuggggaggacu

SEQ ID NO: 341287 - RNA, 63 nt, hsa
gcucgaguuccuggaugugcagaagcacuuguggccccucaaggaccucacgcugacgagcaa

SEQ ID NO: 341288 - RNA, 63 nt, hsa
caucagggaccuccaggugcauggauuggugcugccccucaugcugcccagcuucuacucaga

SEQ ID NO: 341289 - RNA, 63 nt, hsa
ugcaccucuggaggugcagggcacccuugagaagccccucaccccuaggccgccuccaggugc

SEQ ID NO: 341290 - RNA, 63 nt, hsa
cgcuaaggaagauaucuaguguuggggauccuggccccucaaccuccuguggaacccagcagu

SEQ ID NO: 341291 - RNA, 63 nt, hsa
ucuaauccuucucauuacccacccgaccuggcugccccucaccuugggcugggggacuggggg

SEQ ID NO: 341292 - RNA, 63 nt, hsa
cuggcgcuugaggcucagaagagccucuguccagccccucaguauuaccaugucucccucuca

SEQ ID NO: 341293 - RNA, 63 nt, hsa
ucaaaccauucuaauggaaaaggacaacaaacugccccucacuacuggcuugguuuggucuac

SEQ ID NO: 341294 - RNA, 63 nt, hsa
uccuccauugaggaugcccacugaggcagccaggccccucaccagcccuggggggaauccuaa

SEQ ID NO: 341295 - RNA, 63 nt, hsa
cuuuagagcauugccauucccugccuggggcgggccccucaucgcguccuccuaccgaaaccu

SEQ ID NO: 341296 - RNA, 63 nt, hsa
ugcuuauuuguguaauggaugugguccucuaaagccccucauuguuuuugauugccuucuaua

SEQ ID NO: 341297 - RNA, 63 nt, hsa
uccccaccuccaggcuuucccacuucccacccugccccucagagacugaaauuacggguaccu

SEQ ID NO: 341298 - RNA, 63 nt, hsa
gccuuucccaccuggagagaaacuuccagaccagccccucauaccacagccaagaggggccuu

SEQ ID NO: 341299 - RNA, 63 nt, hsa
gccuuucccaccgguagagaaacuuccagaccagccccucacaccacagccaagagaagccuu

SEQ ID NO: 341300 - RNA, 63 nt, hsa
gccuuuaccaccuggagagaagcuuccagaccagccccucacaccacagccaggagaggccuu

SEQ ID NO: 341301 - RNA, 63 nt, hsa; identical to SEQ ID NO: 341298

SEQ ID NO: 341302 - RNA, 63 nt, hsa
gccuuucucaccuggagagaaacuuccagaccagccccucacaccaccgccaggagaggccuu

SEQ ID NO: 341303 - RNA, 63 nt, hsa
gccuuucccaccgggagagaaacuuccagaccagccccucacaccacagccaggagaggccuu

SEQ ID NO: 341304 - RNA, 63 nt, hsa
gccuuucccaccgggagaggaacuuccagaccagccccucacaccacagccaggagaggccuu

SEQ ID NO: 341305 - RNA, 63 nt, hsa
agaaccaccagcaaagccggcggcuggacuggcgccccucagagaccugcggaaagcccccuc

SEQ ID NO: 341306 - RNA, 63 nt, hsa
uuuuccagaaauuucucaaaaugucugcugauagccccucacucauauuuuucauguggguuu

SEQ ID NO: 341307 - RNA, 63 nt, hsa
ucuguguuuccagaaggccccacacacccaagugccccucacaccucgugccucccccucaca

SEQ ID NO: 341308 - RNA, 63 nt, hsa
ugaccagcagaauccacccggugaccagugguggccccucagcccacccucccggcagcucag

SEQ ID NO: 341309 - RNA, 63 nt, hsa
acuccagugcucuggcccgggacuccccuauccgccccucacuuacccuuaaacaggugaucc

SEQ ID NO: 341310 - RNA, 63 nt, hsa
auccacugaaggcuguguuuauucuuuuccugugccccucauaauggaagaaaguaaacugcu

SEQ ID NO: 341311 - RNA, 63 nt, hsa
cgucgagugagcgucccgaggccacgugcggaggccccucacugugcugucaaaggccugugg

SEQ ID NO: 341312 - RNA, 63 nt, hsa
gcuagaaaaucgaguuggcaaaaugggguuugggccccucagagcccugcccugcacccuugu

SEQ ID NO: 341313 - RNA, 63 nt, hsa
cucgucacccaucacucccugcuuccgcagggcgccccucaguauucgcugccauaugucccu

SEQ ID NO: 341314 - RNA, 63 nt, hsa
ggagauacugggggcagagcagacuuugccagugccccucaggucaaaccaagccaagagcac

SEQ ID NO: 341315 - RNA, 63 nt, hsa
gcccacacacccugccuaggccaccccgccgcggccccucaggucgcccuggccacacucaca

SEQ ID NO: 341316 - RNA, 63 nt, hsa
ccuaagacccaccgacucugugcuagaacaagcgccccucagagauucugaugccacugaagu

SEQ ID NO: 341317 - RNA, 63 nt, hsa
gaggacagucuuuccccagcaggggucaggggggccccucaggaagccuaaggucgugcuagu

SEQ ID NO: 341318 - RNA, 63 nt, hsa
cacucccuuuggcuacccuggccgugccuggcagccccucaggccccacagguggguccuggu

SEQ ID NO: 341319 - RNA, 63 nt, hsa
cggaaaucucugggacaauggcuccuccagagggccccucagagccaggugcuggccagaugc

SEQ ID NO: 341320 - RNA, 63 nt, hsa
uguagcccucugagcccucauccugcaggcagagccccucagugcucugagaaaccugcccug

SEQ ID NO: 341321 - RNA, 63 nt, hsa
ugaggccuggcccugggcagggucuguggcugcgccccucaggccagcaguugagguccaucg

SEQ ID NO: 341322 - RNA, 63 nt, hsa
ugguccgcugagggcuggggggcggucuccgaggccccucaacagagaagccuccaccugagg

SEQ ID NO: 341323 - RNA, 63 nt, hsa
agaaaagccgaaaaagcaugcaucuuagaaauagccccucaauuccaggagucaacaugccaa

SEQ ID NO: 341324 - RNA, 63 nt, hsa
ggagaguaagaacuaagggaaugaguuugggcggccccucauaaaggaccuuagaggcaggga

SEQ ID NO: 341325 - RNA, 63 nt, hsa
cuuguaauuguggauuaaugucaauguuaaucagccccucaaagggagagaaaagcuggaccu

SEQ ID NO: 341326 - RNA, 63 nt, hsa
gccaugggcuaaauggguacuagaacaacaacugccccucauguacgccaaggaugagcucua

SEQ ID NO: 341327 - RNA, 63 nt, hsa
gaaccuugcauauccuucacauauuucccauaagccccucagaaaggcuaacugugaugauga

SEQ ID NO: 341328 - RNA, 63 nt, hsa
uggauauggugcagagaagcuggacuucugugggccccucaacagccaagugugaccccacug

SEQ ID NO: 341329 - RNA, 63 nt, hsa
agcaguccccuuggauacuaaagucugagccaggccccucaggcccggcaugggcagugcgag

SEQ ID NO: 341330 - RNA, 63 nt, hsa
uuuuuuaagcguuugcacuauuuagaguccuaagccccucauguucagcugugcuguguuucu

SEQ ID NO: 341331 - RNA, 63 nt, hsa
gaaggaugugagaggugggcgcuuuggagguuugccccucacccaccagcugccccaucccug

SEQ ID NO: 341332 - RNA, 63 nt, hsa
cgaggugcugauggagaugcucaaggccagcaagccccucaggccagcacuucgcuugcagaa

SEQ ID NO: 341333 - RNA, 63 nt, hsa
ucacgccucgcucccuccuggcccucugguccagccccucacgccuccucucagucuacucaa

SEQ ID NO: 341334 - RNA, 63 nt, hsa
uuuguguacuuuuaaaauuguaucuuuccaggagccccucagauuguaccuugcuuucucacc

SEQ ID NO: 341335 - RNA, 63 nt, hsa
gggggaguagaucuuucuaggagggagacacuggccccucaaaucguccagcgaccuuccuca

SEQ ID NO: 341336 - RNA, 63 nt, hsa
gggacagugcugcagcucccuggcuucuguggggccccucaccuacuuacccagguggguccc

SEQ ID NO: 341337 - RNA, 63 nt, hsa
ccccaaaaccuuuccccagacacauucuccugugccccucagagaggcaugugaugugcaagg

SEQ ID NO: 341338 - RNA, 63 nt, hsa
gugaccucaaauguugccuuggaguccccuacagccccucagcagagggcagcacuugaaugc

SEQ ID NO: 341339 - RNA, 63 nt, hsa
gggcccuccucccccaccagcucuccccacagggccccucagcaucauggagacccgcaggcg

SEQ ID NO: 341340 - RNA, 63 nt, hsa
uuccaagagcaaggaugaaaaauugaagucacagccccucagcaccaagcagaaggugaggac

SEQ ID NO: 341341 - RNA, 63 nt, hsa
ugucacaggcugggucaaaagagcccuggcucugccccucagggggccagcuggggagauggg

SEQ ID NO: 341342 - RNA, 63 nt, hsa
acuggcugccaacuccugccgcccucugggacugccccucagucccaggagagcuaugaggcc

SEQ ID NO: 341343 - RNA, 63 nt, hsa
cccaaagcaguuagacuauggagagccgacccagccccucaggaacccucauccuucaaagac

SEQ ID NO: 341344 - RNA, 63 nt, hsa
uccccuagacucaggcuuccuuuggagauuaaggccccucagagaucaacagaccaacauuuu

SEQ ID NO: 341345 - RNA, 63 nt, hsa
ugaggcuggcaaguggggcaacguguggaggaagccccucauaauuuggagaaaacuugauac

SEQ ID NO: 341346 - RNA, 63 nt, hsa
auugccauacaauuuuaauuuauacaaguauuggccccucaagugguuggaaauuuuuuuuuu

SEQ ID NO: 341347 - RNA, 63 nt, hsa
caugaauaggcguacuuucuguauuuaaaaauggccccucaagcaccguuaauuuacauucca

SEQ ID NO: 341348 - RNA, 63 nt, hsa
caaagguugggacucugucuuacauaucugggugccccucauagugcaguaauaaguaaguug

SEQ ID NO: 341349 - RNA, 61 nt, hsa
aagucuguccaaccccaaaaggcucuuuucagagccccucaauugucaccaaaaggaagcu

SEQ ID NO: 341350 - RNA, 63 nt, hsa
cucauugcccacggacccaaccucuguccaggugccccucaucaucacaguuuaacacaagcu

SEQ ID NO: 341351 - RNA, 63 nt, hsa
cuccuacuguuuaaauucccauuccaccacagugccccucagccagaucaccaccccuuacaa

SEQ ID NO: 341352 - RNA, 54 nt, hsa
acucugauaccuccaacugaucuugccccucagggucacaggggugggggcucu

SEQ ID NO: 341353 - RNA, 58 nt, hsa
ggaagcuggccugcgagugaccccagcagccccucagcgcccccagagcccgucagcg

SEQ ID NO: 341354 - RNA, 63 nt, hsa
ugccagcaagaaugaagcacagaugaaggcagcgccccucacuugcucuggcuucagaaguga

SEQ ID NO: 341355 - RNA, 63 nt, hsa
gccugguggagauucccugucuucugagcccgagccccucauuaccagugaaggacaugcuug

SEQ ID NO: 341356 - RNA, 63 nt, hsa
gacuuucaacuugcugacuccuccucuuuuccagccccucaaccaucggucuuguuuacuaga

SEQ ID NO: 341357 - RNA, 63 nt, hsa
agaugacccaaaucuuucacuaugugcaccccagccccucaaaaauggggaagggcugaaaga

SEQ ID NO: 341358 - RNA, 63 nt, hsa
ccagucauugacagacggacuuguugaccacacgccccucaccaaacaaugcagcagcuacug

SEQ ID NO: 341359 - RNA, 63 nt, hsa
aguggcugaguucuuucuuagcugcuuuaaggagccccucacuccccagagucaaaaggaaau

SEQ ID NO: 341360 - RNA, 63 nt, hsa
ccaagcagacuagaugggaggaggcgccgcucagccccucacccugcaucacugaagagcggc

SEQ ID NO: 341361 - RNA, 63 nt, hsa
cuguccugccacggccucccagccggugcgggagccccucacugcccugaccgacuccgcagu

SEQ ID NO: 341362 - RNA, 63 nt, hsa
cuccacgugagaacaagggugaaggugagggaagccccucaccuugggucuuuugcugugccu

SEQ ID NO: 341363 - RNA, 63 nt, hsa
aggaggugaaagaaagggacccaccugcuagucgccccucagagcaugaugggaggugugcca

SEQ ID NO: 341364 - RNA, 63 nt, hsa
cccaugaugguaccacaccagggccucagccuggccccucaccacauacccuuugccuuuuag

SEQ ID NO: 341365 - RNA, 63 nt, hsa
gugaggggccaggccauggccaaggggccagcugccccucauuuaucacucugaccuucacag

SEQ ID NO: 341366 - RNA, 63 nt, hsa
caugaccagaggcuggaguggggguguguuagagccccucaccgggacuugcugugcggaugg

SEQ ID NO: 341367 - RNA, 63 nt, hsa
ucaauguuucaucuccaacccucugccaguuuggccccucagagcuugguggcucaagacugu

SEQ ID NO: 341368 - RNA, 63 nt, hsa
uccuggugccgccucggccccagccuguccccagccccucaaucuggugcagcagcaucuugu

SEQ ID NO: 341369 - RNA, 63 nt, hsa
cucccuccuccagaucccugccuccuagugccagccccucacacgccuucauccugaaacagg

SEQ ID NO: 341370 - RNA, 63 nt, hsa
gugccacauggguuccugugccacccuuuccccgccccucaaaucguccuuuaagucuuccuu

SEQ ID NO: 341371 - RNA, 63 nt, hsa
uccccuguaaaaugggaccuccgaaccaacccugccccucagaaaugcccugccuauuaaaug

SEQ ID NO: 341372 - RNA, 63 nt, hsa
ucgcccacccugugcccuggcgccgcugcaacagccccucauggccaggagccccccauggcc

SEQ ID NO: 341373 - RNA, 63 nt, hsa
agaaccugggccuaucagcguguaagggggccugccccucaucugcgaaagaagagcccagac

SEQ ID NO: 341374 - RNA, 63 nt, hsa
ccuggcccugccucuggcccuucccgggccgcugccccucagccauguggcacuucugagcuc

SEQ ID NO: 341375 - RNA, 63 nt, hsa
gcagagaggaggggagguccugaggggacugcugccccucacucggcauccccugcagaguca

SEQ ID NO: 341376 - RNA, 63 nt, hsa
ucuguuacuuccccuuuuuccauggguuucauggccccucaugauauuugccuucugcuccua

SEQ ID NO: 341377 - RNA, 63 nt, hsa
uugcugcaauacugcucccccagccucuccccugccccucaaccugccuuagcugcacucucu

SEQ ID NO: 341378 - RNA, 63 nt, hsa
cccgccuggcuucgaguuggaacccggacacuugccccucacugguguggauggaaaucugcc

SEQ ID NO: 341379 - RNA, 63 nt, hsa
augcaacagggguguugcgggggcaacaugagagccccucacccccaacucuccacuuucagg

SEQ ID NO: 341380 - RNA, 63 nt, hsa
ggcacacagaguucauguuugcgcccucucccugccccucaccccagagggugaggaggaaug

SEQ ID NO: 341381 - RNA, 63 nt, hsa
agcaccagccaucguguggagcacuaccaaggggccccucagggccuuccugggaggaguccc

SEQ ID NO: 341382 - RNA, 63 nt, hsa
cucccucuaauuacagaucccacuuccagccgggccccucauguauccacuggccgaccgcag

SEQ ID NO: 341383 - RNA, 63 nt, hsa
cgaccuagaugaugauucuuccuguagcaucuggccccucacaaugucagaggauuuaauugu

SEQ ID NO: 341384 - RNA, 63 nt, hsa
cgacgcggugcugcugccgccgcuucggguuuggccccucagaaccccuccuuuucugagcgc

SEQ ID NO: 341385 - RNA, 63 nt, hsa
uuaaucaaccauauuaaauuuauaauaaaaaaugccccucagaaguuugccucugaagccuuu

SEQ ID NO: 341386 - RNA, 63 nt, hsa
agcagagcagaccugaugucccggugcuuccuggccccucagcuccagugauucacgcccgcc

SEQ ID NO: 341387 - RNA, 63 nt, hsa
agcccccagccugugaccuuccccccagggaaggccccucaugccuuuccuucccuuucucug

SEQ ID NO: 341388 - RNA, 63 nt, hsa
aaagggaggggagcaaguggggaccuggccauggccccucagcaaaaaccuauucacagcggg

SEQ ID NO: 341389 - RNA, 63 nt, hsa
cugcuaggcagcccaggccuggucugggagacagccccucacccugccugggcucuuggccaa

SEQ ID NO: 341390 - RNA, 63 nt, hsa
uucuuauuuauugcaugcgucgcuuccacaggggccccucaagagcugugacucgggagagcu

SEQ ID NO: 341391 - RNA, 63 nt, hsa
ugucccuucagccggcagagcgagcccagcguggccccucaauuugaaaauggacgucuuuuc

SEQ ID NO: 341392 - RNA, 63 nt, hsa
uuaaugaacaagguggaccaaagggcugaaccagccccucaaccaggacccuggggggccugc

SEQ ID NO: 341393 - RNA, 63 nt, hsa
gguggcaggagagcggacuuagagcccccgagggccccucagcagaggaaggggaguccccuc

SEQ ID NO: 341394 - RNA, 63 nt, hsa
cucgugacugcccagcgccccaggcuggacugagccccucacgccgcccugcagcccccaugc

SEQ ID NO: 341395 - RNA, 63 nt, hsa
ugaccagaccacgggcagggccugccuccgugugccccucagcucagccccagcaagugugug

SEQ ID NO: 341396 - RNA, 63 nt, hsa
cugagguuuggguggugugaucuguccuaauuggccccucaccaaugcaucuaucugucugcc

SEQ ID NO: 341397 - RNA, 63 nt, hsa
gggaagccuggcaaagcugcccaaccggguagugccccucacccaucggaucacugccuucuu

SEQ ID NO: 341398 - RNA, 63 nt, hsa
gaauugucaucuuugguguuuuuuuaacccccagccccucaaaaaaauaaggccuccagguau

SEQ ID NO: 341399 - RNA, 63 nt, hsa
aaggcuguggcugcuagugaccucuuugcuguggccccucauuugaccuuucaccucugucug

SEQ ID NO: 341400 - RNA, 63 nt, hsa
acuuccgcaucugcccgugggcgccccacagcugccccucagccgcugagauccaguguccaa

SEQ ID NO: 341401 - RNA, 63 nt, hsa
uucugucccuccuacuuuccuucacaccagacagccccucaugucuccaggacaggacaggac

SEQ ID NO: 341402 - RNA, 63 nt, hsa
augugcuugugccuaccuggccgcaaguccccagccccucaacccuccguuccuccucagccu

SEQ ID NO: 341403 - RNA, 63 nt, hsa
ggaaacgggacaaaaccuuaagcuguuuucuuagccccucagccagcugccauuagcuuggcu

SEQ ID NO: 341404 - RNA, 63 nt, hsa
uugcacaugcucacccccagcacagucccacuggccccucaccuccccuucccugagcuccuu

SEQ ID NO: 341405 - RNA, 63 nt, hsa
cacuggaugggauguacuucucagccccgcugagccccucauuugugcccagcauuuugugug

SEQ ID NO: 341406 - RNA, 63 nt, hsa
cuucuccuugaggcagcuggagagcuaucccccgccccucaagcaccugugccguguggccau

SEQ ID NO: 341407 - RNA, 63 nt, hsa
uggcgccccuucucuccaagcucaauucucuaagccccucagggucuccuccucaccccaccc

SEQ ID NO: 341408 - RNA, 63 nt, hsa
ccgaagcaggcguccaucuguguccuccuggcagccccucaaacacacaccaccccaugucac

SEQ ID NO: 341409 - RNA, 63 nt, hsa
cccgaugucacaggcagucugugugguuacagcgccccucaguguucaucuccagcagagaca

SEQ ID NO: 341410 - RNA, 63 nt, hsa
cgccccguggucggaagagcacucccuucccuggccccucauccagccuccggugcuguaaaa

SEQ ID NO: 341411 - RNA, 63 nt, hsa
ccuuucuggcauccuggccucucgugguccucagccccucacccccaguacugcagaucucac

SEQ ID NO: 341412 - RNA, 63 nt, hsa
cuccuuguggggucccagguccugcugccaagagccccucaagagaagggcugaaccugggga

SEQ ID NO: 341413 - RNA, 62 nt, hsa
ugggggcacguuguccgugauaaaaguacaagugccccucaccgcccguggagauugcuuuc

SEQ ID NO: 341414 - RNA, 63 nt, hsa
gacucccagcagcagagcccaagcacuggcuucgccccucagugcccuggggcauguucaggg

SEQ ID NO: 341415 - RNA, 63 nt, hsa
ccuggucccccuuugcccugcaguggaaugagggccccucagccccgcauugaucuaaauaaa

SEQ ID NO: 341416 - RNA, 63 nt, hsa
ugggcucagauacugugacaucccagaagcccagccccucaaccccucuggaugcuacauggg

SEQ ID NO: 341417 - RNA, 63 nt, hsa
uguuggacuuuacagaagagccucauccugucugccccucacucugcccuggaaucaacaucu

SEQ ID NO: 341418 - RNA, 63 nt, hsa
cucucgauuucucuaucugucccucugaggucggccccucagacccuccuccuuaauuuccca

SEQ ID NO: 341419 - RNA, 63 nt, hsa
cacguggaugauggggucagagaucacugagcugccccucaagggggccuggaacccgggugc

SEQ ID NO: 341420 - RNA, 63 nt, hsa
agcccugcccgaggcugaggcugggccggcgcugccccucaucuuagcauugggcagacacca

SEQ ID NO: 341421 - RNA, 63 nt, hsa
ccuuguuaaugaugcuccugccucugccucccagccccucacccagcacagcucugccuggac

SEQ ID NO: 341422 - RNA, 63 nt, hsa
ggcagacccccaccaccauacaugcugucuguggccccucagacauucuguuucaucucccau

SEQ ID NO: 341423 - RNA, 63 nt, hsa
cugucaccucccucucaccaacccggggucugagccccucauuccugaccguccguguucuca

SEQ ID NO: 341424 - RNA, 63 nt, hsa
gauuuauaaguacugagcaugaaguacuugucugccccucauuucaaggccagaguuauuuuc

SEQ ID NO: 341425 - RNA, 63 nt, hsa
cugguuagguggggacagaggauuucugcuuaggccccucaggacccagggaaugccagggac

SEQ ID NO: 341426 - RNA, 63 nt, hsa
gguaucuuuggcaaggcuaccaguuggacguaagccccucaugcugacucagggugggcccug

SEQ ID NO: 341427 - RNA, 63 nt, hsa
acagaccccagagccaggaaccucucagccgaugccccucagcaagagcaccccaucuucagg

SEQ ID NO: 341428 - RNA, 63 nt, hsa
cccgacgccggcggggaggcagggaugucgagggccccucacagcugugcccgcccugccccg

SEQ ID NO: 341429 - RNA, 63 nt, hsa
gccaggcagcggggcagggacagggagccgagugccccucagagucccccaaacacaagcaca

SEQ ID NO: 341430 - RNA, 63 nt, hsa
ccugcaugcuguguauccuaacucccuacaacagccccucaaauaaaucacaucuagugacug

SEQ ID NO: 341431 - RNA, 63 nt, hsa
ucgucuuccuccugcagacaggcggacccacaggccccucagggucugcccagccaggcuccu

SEQ ID NO: 341432 - RNA, 63 nt, hsa
cuucuugccuaccacuuggccagugcccacccagccccucagguggcacaucuggagggcagg

SEQ ID NO: 341433 - RNA, 63 nt, hsa
gaugaaccugcuuauaccuaagggcaggagcaagccccucacaaugcagcugcauggguuuuu

SEQ ID NO: 341434 - RNA, 63 nt, hsa
caucagugccagccccugcuggcuggugccugagccccucagacagcccccugccccgcaggc

SEQ ID NO: 341435 - RNA, 63 nt, hsa
caccagaauuuugaaaaucccgaauuuuugacagccccucaggccuggagaguuaucuacaga

SEQ ID NO: 341436 - RNA, 63 nt, hsa
ugcccuucccuggaggucucucccucccccagagccccucaugccacagugguacucuguguc

SEQ ID NO: 341437 - RNA, 63 nt, hsa
gcccucaauccaccuucaggccccgccccaugggccccucaccgcugguuggaaagaguguug

SEQ ID NO: 341438 - RNA, 63 nt, hsa
uggguugcugccugaugacaagggguuguuucagccccucagucaugcugccuucugcugcuc

SEQ ID NO: 341439 - RNA, 63 nt, hsa
gagcugggccccagcccagugacuggcucauuugccccucaagcacgaguuugcauguuuagu

SEQ ID NO: 341440 - RNA, 63 nt, hsa
gugguggggcugggccauggagcuggcccagaggccccucagcccuuuguaaagucugaugaa

SEQ ID NO: 341441 - RNA, 63 nt, hsa
gaaccuaacaauuuaaagacacugggaacacuugccccucaguauaguacugucaagggaagc

SEQ ID NO: 341442 - RNA, 63 nt, hsa
aagggccccugaccugccuggcuuccuuagcuugccccucagcuuugcaaagagccacccuag

SEQ ID NO: 341443 - RNA, 63 nt, hsa
ccccaucuuuaaaaugcugccagagcgauugcggccccucaccuuguccacguaucaggaaug

SEQ ID NO: 341444 - RNA, 63 nt, hsa
aaucucgacucacugcagcuaucucucgccucagccccucaaguagcugggacuacaggugca

SEQ ID NO: 341445 - RNA, 63 nt, hsa
cuugaccagcgugcugacuggccuagggccccugccccucaccuucuccuucuugauuccaaa

SEQ ID NO: 341446 - RNA, 63 nt, hsa
gguucccacccuccuccaccuccucuccuccgggccccucaguuuccucuccucaucucuggc

SEQ ID NO: 341447 - RNA, 63 nt, hsa
cuacuguguuucacugaccauacauuuuucuuagccccucaaguaauauagcacagaguuaug

SEQ ID NO: 341448 - RNA, 63 nt, hsa
auggaggaggugugggcugacuaccucccagaagccccucaugccaagccugucccacugggg

SEQ ID NO: 341449 - RNA, 63 nt, hsa
guagaggccucguuucugccacacaucacgccugccccucaccgcccucuccucaaacuccuc

SEQ ID NO: 341450 - RNA, 63 nt, hsa
auuuggguucugccugccagcugcacugaugcugccccucaucucucugcccaacccuucccu

SEQ ID NO: 341451 - RNA, 51 nt, hsa
cugccugcaguccugugugaagccccucaccuaugccaucuccauaagcac

SEQ ID NO: 341452 - RNA, 63 nt, hsa
gggaaguuccccaacacauaaucccaagacugugccccucaucugcaucuucagauccaguac

SEQ ID NO: 341453 - RNA, 63 nt, hsa
augcuuucugccucugguaacaggagugagugagccccucagaccugcacucugggugucucc

SEQ ID NO: 341454 - RNA, 63 nt, hsa
ucagggccugcauuuauggagugcuugcuaugugccccucauggcaggcccacagcacucuga

SEQ ID NO: 341455 - RNA, 63 nt, hsa
agggcagccccagcagcuggauucucaggcugggccccucaccuggcagaguccauaguggag

SEQ ID NO: 341456 - RNA, 63 nt, hsa
cgcugugcccugguuucccuccucgggcuucucgccccucagugguuuccucggcccuccugg

SEQ ID NO: 341457 - RNA, 63 nt, hsa
ccaggaugaccccacagccagagucccuuggcagccccucaccccagaccccccuucuaagga

SEQ ID NO: 341458 - RNA, 63 nt, hsa
guuguuccucuguuaucaugccugaauucccccgccccucaguuaccuggggaagaguaaagg

SEQ ID NO: 341459 - RNA, 63 nt, hsa
uuucccauugucacggaaaacauuggcugcaaagccccucaaagcccucaagugccuucugug

SEQ ID NO: 341460 - RNA, 63 nt, hsa
gcacucggcccaguccugccgccguguccaggcgccccucacccccacaccugcugcauggcu

SEQ ID NO: 341461 - RNA, 63 nt, hsa
cgguuuuguuuuuguuucucauucuucuuccucgccccucagccccccaacccccaacccccu

SEQ ID NO: 341462 - RNA, 63 nt, hsa
ggcugagugggagggcggcccuuuccagccucugccccucaggggaacccuguagcuuugugu

SEQ ID NO: 341463 - RNA, 63 nt, hsa
aucucuccaaaccccauacccuucaaugcuguggccccucagugacuuccuugggugauccug

SEQ ID NO: 341464 - RNA, 63 nt, hsa
auggcaggcuacaguugggaagucucagccugggccccucagccacccuuggucucaugcccc

SEQ ID NO: 341465 - RNA, 63 nt, hsa
cccugccccauucuggugucuuuccacuccucagccccucaucuugccuccacccagcugcuc

SEQ ID NO: 341466 - RNA, 63 nt, hsa
uccuucagccaccuggccauaccccuuaaauaagccccucaccuugcugccucaggaccuuca

SEQ ID NO: 341467 - RNA, 63 nt, hsa
cuggcugcaagcuguggguucuuucuccucugugccccucaugcugaucuucuagaugccacu

SEQ ID NO: 341468 - RNA, 63 nt, hsa
ccacacggccccuucccagccagcccgccgcccgccccucaguuugguagugccccaccuccc

SEQ ID NO: 341469 - RNA, 63 nt, hsa
cgcccauccugcacacggggccgcugggcaggugccccucacacccccaggaugucagugcuc

SEQ ID NO: 341470 - RNA, 63 nt, hsa
uacugaaaacugaccaaggccugugcacagguagccccucaugcugggcucuggaccaugagc

SEQ ID NO: 341471 - RNA, 63 nt, hsa
cccaguaacuggggccacggggagagaggaguagccccucagacucuucuuacuaagucucag

SEQ ID NO: 341472 - RNA, 63 nt, hsa
cugccuccuggugguggccauugucccccaucggccccucagccuugcaccccagcacugaga

SEQ ID NO: 341473 - RNA, 63 nt, hsa
aaugcuccagcgauuccaaacugcagccccucugccccucaccaaaaccugcggggcugcuug

SEQ ID NO: 341474 - RNA, 63 nt, hsa
ugugugucuguuuugguuugugagaaaguagcugccccucauucuggccaguucuuuccagua

SEQ ID NO: 341475 - RNA, 63 nt, hsa
aguagugccgaugugccacacugcccaguugaggccccucacgcucugugccccuagauccuu

SEQ ID NO: 341476 - RNA, 63 nt, hsa
cauggcaacucaaagugccuuccaaaccaaacugccccucaugagguuagggucccccacccu

SEQ ID NO: 341477 - RNA, 63 nt, hsa
acuucccgagaacaaacaggccugcucacaacugccccucaaguucaaccccgggaccgccca

SEQ ID NO: 341478 - RNA, 63 nt, hsa
uucgugacugaggccccucuuggggcacucacugccccucauccccagaaauuauuuuucuac

SEQ ID NO: 341479 - RNA, 63 nt, hsa
aguccacuccuagccccggcauccugcucuagggccccucaugccccaggcuggagcagcucu

SEQ ID NO: 341480 - RNA, 63 nt, hsa
ggagccaagaagcacagagacacagaggcgccugccccucagcuccgcuggucugucugugca

SEQ ID NO: 341481 - RNA, 63 nt, hsa
cuccacugagcuccucugucacaccccauucuugccccucacugggcaggccauggccuacag

SEQ ID NO: 341482 - RNA, 63 nt, hsa
ccagcuuucugguuaagguuaacaccagauggugccccucauugguguccuuuuaaaaaauau

SEQ ID NO: 341483 - RNA, 63 nt, hsa
gggaguccgggcauggugggcacaguucucccugccccucagccugggggaagaagagggccu

SEQ ID NO: 341484 - RNA, 63 nt, hsa
ugacccaggcugccugagcaccucccagccccugccccucaugccaaccccgcccuaggccug

SEQ ID NO: 341485 - RNA, 63 nt, hsa
acgucugagcccagcuuucugcgugcccuccuggccccucacucccggcagcgggccggccuc

SEQ ID NO: 341486 - RNA, 63 nt, hsa
gaagggcccggugggacguggguagugugugaagccccucagccugggucccgccuagccuaa

SEQ ID NO: 341487 - RNA, 63 nt, hsa
gcccggaggucccaaggucccugggaggacugggccccucaugccucgagcuuggcaaccgaa

SEQ ID NO: 341488 - RNA, 63 nt, hsa
aggagaaggaugccugggugccaggcaagacaagccccucagcaggagagaggcccagaggcu

SEQ ID NO: 341489 - RNA, 63 nt, hsa
uagguucaccugcaaaacaaaaaucuuacuccagccccucaaugccauccugacacacuuuau

SEQ ID NO: 341490 - RNA, 63 nt, hsa
gccccuuuuguguuuugguucaaguuucucagagccccucagagcuucuacaucugugcauca

SEQ ID NO: 341491 - RNA, 63 nt, hsa
cugggaucuccuucucccuccuguccuguccuugccccucaggacugcuggaaaauaaauccu

SEQ ID NO: 341492 - RNA, 63 nt, hsa
gcaugccuggauggggcugcaccggcuggccuggccccucagggucccugguggcagcucacc

SEQ ID NO: 341493 - RNA, 63 nt, hsa
ucgucauggaccgagguucccacucugggcaaagccccucacacugcaagggauuguagauaa

SEQ ID NO: 341494 - RNA, 63 nt, hsa
ucagguucugccugagcccagccuaccaggcuugccccucagcucagcacuguugaccacgcu

SEQ ID NO: 341495 - RNA, 63 nt, hsa
cacuggcccuggguggcucugucagggugcacagccccucaugccuggagcaaugagggucua

SEQ ID NO: 341496 - RNA, 63 nt, hsa
cuaccccucaacagagaugacuuugaugacucugccccucagcagggcuuacuaagcacuacc

SEQ ID NO: 341497 - RNA, 63 nt, hsa
agcacuaccccuuaacagggaugacuccgcacugccccucaacagggaugacucagcagagau

SEQ ID NO: 341498 - RNA, 63 nt, hsa
gcagggaugacacagcaaggaugacucagcacugccccucagcaaggaugacucagcacugcc

SEQ ID NO: 341499 - RNA, 63 nt, hsa
ucaacagacaugacucagggauggcuuaguacugccccucagcagggaugacucagcaccgcc

SEQ ID NO: 341500 - RNA, 63 nt, hsa
acagggaugacucagcagggaugacucagcaccgccccucaacaggcaugacucugcagagau

SEQ ID NO: 341501 - RNA, 63 nt, hsa; identical to SEQ ID NO: 341498

SEQ ID NO: 341502 - RNA, 63 nt, hsa
ucaacagggaugacucagggauggcuuaguacugccccucaacagggaugacucagcagggau

SEQ ID NO: 341503 - RNA, 63 nt, hsa; identical to SEQ ID NO: 341500

SEQ ID NO: 341504 - RNA, 63 nt, hsa
acaggcaugacucugcagagaugacuuaguacugccccucagcagggaugacucaguacugcc

SEQ ID NO: 341505 - RNA, 63 nt, hsa
aguacugccccucagcagggaugacucaguacugccccucagcagggaugacucagcacugcc

SEQ ID NO: 341506 - RNA, 63 nt, hsa
aguacugccccucagcagggaugacucagcacugccccucaacagggaugacucagcagggau

SEQ ID NO: 341507 - RNA, 63 nt, hsa
gcagugaugacacagcaaggaugacucagcacugccccucagcaaggaugacucagcacugcc

SEQ ID NO: 341508 - RNA, 63 nt, hsa; identical to SEQ ID NO: 341499

SEQ ID NO: 341509 - RNA, 63 nt, hsa
aguacugccccucagcagggaugacucagcaccgccccucaacagggaugacucagcacugcc

SEQ ID NO: 341510 - RNA, 63 nt, hsa
agcaccgccccucaacagggaugacucagcacugccccucaacagggaugacucagcagggau

SEQ ID NO: 341511 - RNA, 63 nt, hsa
gcagcgaugacacagcaaggaugacucagcacugccccucaccaaggaugacucagcacugcc

SEQ ID NO: 341512 - RNA, 63 nt, hsa
ucaacagacaugacucagggauggcuuaguacugccccucagcagggaugacucagcagggau

SEQ ID NO: 341513 - RNA, 63 nt, hsa
acagggaugacucagcagggaugacucagcacugccccucaacagggaugacugcagggauga

SEQ ID NO: 341514 - RNA, 63 nt, hsa
caacagggaugacugcagggaugacucagcacugccccucagcagggaugacucagcacugcc

SEQ ID NO: 341515 - RNA, 63 nt, hsa
agcacugccccucagcagggaugacucagcacugccccucagcagggaugacucagcagggau

SEQ ID NO: 341516 - RNA, 63 nt, hsa
gcagggaugacucagcagggaugacucagcaccgccccucaacaggcaugacucugcagagau

SEQ ID NO: 341517 - RNA, 63 nt, hsa
acaggcaugacucugcagagaugacucagcacugccccucagcagggauggcucagcagggau

SEQ ID NO: 341518 - RNA, 63 nt, hsa
gcagggauggcucagcagggaugacucagcauugccccucaacagggaugacucagcagacuc

SEQ ID NO: 341519 - RNA, 63 nt, hsa
acucagcagacucagcagggaugacucagcacugccccucaacagacaugacucagcagggau

SEQ ID NO: 341520 - RNA, 63 nt, hsa
acagacaugacucagcagggaugacucagcaccgccccucagcaaggaugacucagcagggau

SEQ ID NO: 341521 - RNA, 63 nt, hsa
gccugggagacccaucuggucccugcguccucugccccucacugcucugugcagauccugucg

SEQ ID NO: 341522 - RNA, 63 nt, hsa
ggccuggcugggcugggucuggggccgccacaggccccucacggggcggcagaggcaacuuca

SEQ ID NO: 341523 - RNA, 63 nt, hsa
ggcagccaaguuccugauagcacuugugccucagccccucaccuggccaccugccagggcacc

SEQ ID NO: 341524 - RNA, 59 nt, hsa
gaacaugcagaaggcacuaagcuuccugggccccucacccccagcuggaaauuaagaaa

SEQ ID NO: 341525 - RNA, 63 nt, hsa
uuuuacugccuguagcaauggccagagccucuggccccucacccaccauggaccagcccauug

SEQ ID NO: 341526 - RNA, 63 nt, hsa
gacacaaggugggcugcccucaagccccagagagccccucauccuuccucugggaccagaugu

SEQ ID NO: 341527 - RNA, 63 nt, hsa
gaagggagacuggcccugcccagccggucucuagccccucagcccccgcugggcacucucugu

SEQ ID NO: 341528 - RNA, 63 nt, hsa
gugcagacaaauucagcaauaguaugcagaucagccccucaccaccucauuguucucaucugg

SEQ ID NO: 341529 - RNA, 63 nt, hsa
ccccaacccucagacccucgccuuccaaggcaggccccucagccuggccugcucucaccaccu

SEQ ID NO: 341530 - RNA, 63 nt, hsa
cuccuuccuggucuggcccagcuggcuuccccagccccucagccauccagggcuacccacugc

SEQ ID NO: 341531 - RNA, 63 nt, hsa
cagccuuaacucgaugguccgucccugccaggugccccucacucuuccugaccccaaagccag

SEQ ID NO: 341532 - RNA, 63 nt, hsa
gugcuccaggauaacaaagaagggcagguugaagccccucauggaaggagcuggcuuuguggg

SEQ ID NO: 341533 - RNA, 63 nt, hsa
ggcacucaaugcagccagaccuauuccuccugggccccucaucugcucagcagcuauuugaau

SEQ ID NO: 341534 - RNA, 63 nt, hsa
acauccugcaguccccaccaguccugaccgugggccccucaggggucugggagugugacguug

SEQ ID NO: 341535 - RNA, 63 nt, hsa
aaccugugaugaggggaggaaacucaccugcuggccccucaccugggcaccuggggaguggga

SEQ ID NO: 341536 - RNA, 63 nt, hsa
cggacugccgccucuggguccccccaccguggugccccucaccauccuccugggggagcaggg

SEQ ID NO: 341537 - RNA, 63 nt, hsa
gaucuguagccagucagaggaggaggagaaggagccccucagcagaguggugcaguuucgcuc

SEQ ID NO: 341538 - RNA, 63 nt, hsa
cugugaaaaggcuuccugugaccuccgauggcggccccucauuggccaagggcacuguggaug

SEQ ID NO: 341539 - RNA, 63 nt, hsa
cugaagagcaagguuucguggcagcacggcccggccccucacccucuguccccacgaggggac

SEQ ID NO: 341540 - RNA, 63 nt, hsa
cccuccuugcccgccuacccucccuccagaauagccccucacccuucuuccccuucuaguuga

SEQ ID NO: 341541 - RNA, 63 nt, hsa
cucacaucccuuuccuagucccccacauccaaagccccucagccugccuugcagaccaauggg

SEQ ID NO: 341542 - RNA, 63 nt, hsa
acauaggacuaaccagccacugcccucucuuaggccccucauuuaaaaacgguuauacuauaa

SEQ ID NO: 341543 - RNA, 63 nt, hsa
gggagguugguggaccauggagucccuggugcugccccucaggugggacccaggcguucucag

SEQ ID NO: 341544 - RNA, 63 nt, hsa
ugcaccugggaccauaggaugggaggauagggagccccucaugacugagggcagaagaaauug

SEQ ID NO: 341545 - RNA, 63 nt, hsa
gccacugggugagcagagucacccacagggccagccccucagccaggagccaguggcaggagc

SEQ ID NO: 341546 - RNA, 52 nt, hsa
auucuuccaucuccuucuagaagccccucaccccgcugccccgccugucccc

SEQ ID NO: 341547 - RNA, 63 nt, hsa
ggcagggaguugugagcgccuucccaacaaugugccccucaccccuugaugcccaugcuaaug

SEQ ID NO: 341548 - RNA, 63 nt, hsa
agccugggucagaaggggugggcgagccccucggccccucacccuccaggcugcugugagagu

SEQ ID NO: 341549 - RNA, 63 nt, hsa
ccuuuccuuggcccucacugccagugccaaaccgccccucagcagggcagggccaguccuggc

SEQ ID NO: 341550 - RNA, 63 nt, hsa
uaguaugcccuguaauuuuucugggaaguccuagccccucacuuccagcuugccuguuucuuc

SEQ ID NO: 341551 - RNA, 63 nt, hsa
guuuuugagggggucaugccgggggagccaccagccccucacuggguucggaggagagucagg

SEQ ID NO: 341552 - RNA, 63 nt, hsa
uggccugggggaggucagaacauucgaaucucugccccucacuugaggaggagcuggccugcg

SEQ ID NO: 341553 - RNA, 63 nt, hsa
acagugaggccaccuugagucaagccgacuaaggccccucaacccugucacuaagcagcacgu

SEQ ID NO: 341554 - RNA, 63 nt, hsa
caggugcugcacugaccgcugggccacacggcugccccucagcccugcuggaacagggucugc

SEQ ID NO: 341555 - RNA, 63 nt, hsa
gaauggugcacugguuuaauuguguuggugucggccccucacaaaugcagccaagucauguaa

SEQ ID NO: 341556 - RNA, 63 nt, hsa
ggugggauccugaaggcacuagcugacagacgggccccucaauccuguccucugaaggauugu

SEQ ID NO: 341557 - RNA, 63 nt, hsa
uggcucugaggucacaucagcuagguuugggaggccccucagcuugguuugggagugcccgug

SEQ ID NO: 341558 - RNA, 63 nt, hsa
cucaugacaaaggaagggacucaaagcagcaaugccccucauaguguaggcuaaggugaguuu

SEQ ID NO: 341559 - RNA, 63 nt, hsa
cgcugagauuacaggugugagccaccgugcccagccccucaguagguuuuaaggagcccccag

SEQ ID NO: 341560 - RNA, 63 nt, hsa
ccgggcccccgcgccucugccggacacggaccggccccucagcccccaccgaggacgcagcca

SEQ ID NO: 341561 - RNA, 63 nt, hsa
auuugugcguuccagaaaagggcccagcucugagccccucacccuuccacacucacgaacucu

SEQ ID NO: 341562 - RNA, 63 nt, hsa
uucuuucaguucucccaugcagccgaggcccgggccccucaggacuccaaggagacggugcag

SEQ ID NO: 341563 - RNA, 63 nt, hsa
ccaugaaugaaaugacucagggaaguguuuguugccccucaugccuccuuucucacuuuagaa

SEQ ID NO: 341564 - RNA, 63 nt, hsa
cucuggcagugaugaugguacuuccuguugucagccccucaagcccagcugcaaccagucugg

SEQ ID NO: 341565 - RNA, 63 nt, hsa
ugcccucgcuccgccccaucaguuccugccccugccccucaugcagacugcccugcuggggcc

SEQ ID NO: 341566 - RNA, 63 nt, hsa
cccuaggccaccucgcggaagccuucagccuccgccccucacugcagccccuugggacuugag

SEQ ID NO: 341567 - RNA, 63 nt, hsa
gguguugggaaccaugccugccagccaguaugugccccucacccaggccuggcugggcccugg

SEQ ID NO: 341568 - RNA, 63 nt, hsa
ccugcucugagcgcucaccccugcugaggcucagccccucaacccgguggcauucugggggag

SEQ ID NO: 341569 - RNA, 63 nt, hsa
accgcuguugagcagccuggugguacuggccacgccccucaaggcaaggcuccuccccuuagg

SEQ ID NO: 341570 - RNA, 63 nt, hsa
cucagcccagcugacugugccuguucugagugagccccucacucagccggggcccucccaccu

SEQ ID NO: 341571 - RNA, 63 nt, hsa
uggggggucuugguuuaugcucccugcccuugagccccucagccguuugcccugcccccaccu

SEQ ID NO: 341572 - RNA, 63 nt, hsa
acagcggugggaucucugcugccagcucucccagccccucagcuucgcagccuggcgcagcau

SEQ ID NO: 341573 - RNA, 63 nt, hsa
uguccccaccccagggccacuuagcugacaccagccccucagaggaccagugcgccccauccc

SEQ ID NO: 341574 - RNA, 63 nt, hsa
uccuugucucauccccgaagauccgucccccuggccccucaguguccaugucuugagcuuaau

SEQ ID NO: 341575 - RNA, 63 nt, hsa
uccccuccuguucacucucccaacccugcuccagccccucagcuucccagacccucaugcagu

SEQ ID NO: 341576 - RNA, 63 nt, hsa
ccagccuaggacgccaacuucucccaccccuuggccccucacauccucuccaggaagggagug

SEQ ID NO: 341577 - RNA, 63 nt, hsa
cucuuucuccuucuucccugagucucucuccaugccccucaucucuuccuuuugcccucgccu

SEQ ID NO: 341578 - RNA, 63 nt, hsa
cuucuggaccugcccccacuguggccugcaugcgccccucacgccccuggagcgcaucgccca

SEQ ID NO: 341579 - RNA, 63 nt, hsa
ccagagcugaccccacuccaggaccuaggcccagccccucagccucaucuggagccccugaag

SEQ ID NO: 341580 - RNA, 63 nt, hsa
cacauguuuucggcaacguguucccguguccuggccccucacgggcccccacacucuccugac

SEQ ID NO: 341581 - RNA, 63 nt, hsa
ugcccccucucugagagcccuggccagcucuucgccccucaccucuuugaaacucuggacgua

SEQ ID NO: 341582 - RNA, 63 nt, hsa
ugcaaacuucucccggguccagcgccuggggcugccccucaagauggucauguacucagcugu

SEQ ID NO: 341583 - RNA, 63 nt, hsa
uuccuuggaccguaucacugguccaccuccugagccccucaauccuaucacagucuacugacu

SEQ ID NO: 341584 - RNA, 63 nt, hsa
aaggccaccugacuccuaucacgacgcacccaagccccucaguccagcuucccaaugccuggc

SEQ ID NO: 341585 - RNA, 63 nt, hsa
ucuucuuccgacugguacugaacauauauacuugccccucaggugagguuccaaguugcaacu

SEQ ID NO: 341586 - RNA, 63 nt, hsa
caucucaaaagaaguccaaagcgggaaucaugugccccucagcggagccccgggaguguccaa

SEQ ID NO: 341587 - RNA, 63 nt, hsa
cugaguugggggagcgacccuucccccagccccgccccucaggacacccagaaccccaccccu

SEQ ID NO: 341588 - RNA, 63 nt, hsa
acuuuucccuuccucuuuccccacagccccccagccccucagcccucccagcccacuucugcc

SEQ ID NO: 341589 - RNA, 63 nt, hsa
gaggcaguggcuggugggccacucucuccaggugccccucagccaugggcccuacaguccccu

SEQ ID NO: 341590 - RNA, 61 nt, hsa
cacccuauggaccagucaaauaaaagccuucaggccccucaaccagaguccccucuuacug

SEQ ID NO: 341591 - RNA, 63 nt, hsa
gaggcugagguggcugcaggagcucguuucacagccccucagguggagcugguugggccgcgg

SEQ ID NO: 341592 - RNA, 63 nt, hsa
aaccucuccccuaacccugcucccuggggcugcgccccucaacacccucucaacaccccccuc

SEQ ID NO: 341593 - RNA, 63 nt, hsa
agcagagcgggacucuguccaacaagccccacagccccucaaagacuuuuuuuuguuuguuuu

SEQ ID NO: 341594 - RNA, 63 nt, hsa
ugugcccugccuucagcuuuggugaaagggagggccccucaugugugcugugcugugucugca

SEQ ID NO: 341595 - RNA, 63 nt, hsa
gccaaacagauggggaggcccaaagcaaggcuugccccucagaggagcucacgcagggcagga

SEQ ID NO: 341596 - RNA, 63 nt, hsa
aguuuggcagcuugacuucugcagcuggaggaggccccucaggccggggaucuggggagggcu

SEQ ID NO: 341597 - RNA, 63 nt, hsa
aacagccgacuuugagcauuguuucuucuaacugccccucaacuaccauuaucuucaagucaa

SEQ ID NO: 341598 - RNA, 63 nt, hsa
gacagcaggccuggcacugggaggugggggugagccccucacagccuugccccuccccaaggc

SEQ ID NO: 341599 - RNA, 63 nt, hsa
ggccacuggggccaccacccugaccaccacugugccccucauuguuacugccuugugagauaa

SEQ ID NO: 341600 - RNA, 63 nt, hsa
cuuuuuuuuaggccccugccugucugcccaucugccccucacccacccgaggcucugcccacc

SEQ ID NO: 341601 - RNA, 63 nt, hsa
ccuuuacuaaaacacuuucucugaaccccccuugccccucacugaucuugcuuuucccugguc

SEQ ID NO: 341602 - RNA, 63 nt, hsa
cauguauauagguccugaugccuucccaaccccgccccucacccuguugccaccuuguuucau

SEQ ID NO: 341603 - RNA, 63 nt, hsa
uccucucggugggaugggcaccacagacaggaggccccucaggcccgugcgggccacugucug

SEQ ID NO: 341604 - RNA, 63 nt, hsa
aguuaccgagccgaagggagaugaugggccuucgccccucagugggauggcagcugagggggc

SEQ ID NO: 341605 - RNA, 63 nt, hsa
caggagugggcucagagucuagcaaaugcuaaggccccucaggcugggcucugaacgaggacc

SEQ ID NO: 341606 - RNA, 63 nt, hsa
ggguugguguggauagcaaaggaggaagucugagccccucauuggucuuccucccaccugucc

SEQ ID NO: 341607 - RNA, 63 nt, hsa
uaaagguccaugaacccugccccacuccugucagccccucaucagccuuuucagcagguucca

SEQ ID NO: 341608 - RNA, 63 nt, hsa
ugucuguucucuggggauugcugggucacaggugccccucaccuuccacagucaggcagggaa

SEQ ID NO: 341609 - RNA, 63 nt, hsa
aacugugaagguccccgugggguggagcauggugccccucacaagccgcagcggcuggugccc

SEQ ID NO: 341610 - RNA, 63 nt, hsa
gccauggaggcgccuuccuggguuggccagagggccccucacuggcuggacuggaggcugggu

SEQ ID NO: 341611 - RNA, 63 nt, hsa
aggugcccaacaccccccaccggaggacacgcugccccucagcgaugccccuaccuuuugggg

SEQ ID NO: 341612 - RNA, 63 nt, hsa
uucaccuuugucgcugggucagugcuggaaagcgccccucacuccugcgcugacaagggcccu

SEQ ID NO: 341613 - RNA, 63 nt, hsa
ggaguguggggauaggagccgggccaagcgcuggccccucagcggugagcccugcccacucuu

SEQ ID NO: 341614 - RNA, 63 nt, hsa
agucucugucuccugggcccugcucugggaccugccccucacguucucuuggggacacccgag

SEQ ID NO: 341615 - RNA, 63 nt, hsa
acucauccuguucaagaaacaaccuuucauguagccccucaacagaaugcauugcaucaucac

SEQ ID NO: 341616 - RNA, 63 nt, hsa
guuuuuaaucaguuaucuugggaacuuaaccuggccccucaccucuucugcaccccccgcccc

SEQ ID NO: 341617 - RNA, 63 nt, hsa
ucucuuaauuuucaggaagaaagggaaauugcagccccucagcccccaggauugaccucuggg

SEQ ID NO: 341618 - RNA, 63 nt, hsa
gcccugcacaugaugggguuugguggacccagugccccucacggcugccgcaagucugcugca

SEQ ID NO: 341619 - RNA, 63 nt, hsa
ggugagcuuccugcagccuguggauguccugcagccccucagcccuacccccaaguuucuccu

SEQ ID NO: 341620 - RNA, 63 nt, hsa
ccggugcuccucucuaggcagcgggugggcacagccccucaccacggacacggacagaggacc

SEQ ID NO: 341621 - RNA, 63 nt, hsa
ugggguguggauggggcugcagcaccaggcagagccccucagggcgccgaugucgagggcacc

SEQ ID NO: 341622 - RNA, 63 nt, hsa
auuagggauauuaucaaaauauguaaccaugaggccccucagguccugaucagucagaaugga

SEQ ID NO: 341623 - RNA, 63 nt, hsa
ccugacucugucacucaagccuuucuccaccaggccccucaucugaauaccaagcacagaaau

SEQ ID NO: 341624 - RNA, 63 nt, hsa
ggcccccggccacugucucggggcccaccucucgccccucaucuugguaauuagccagccuca

SEQ ID NO: 341625 - RNA, 63 nt, hsa
uccuuugcagaacuucagggacugggagcagaggccccucacucaacgacguuugugcgacau

SEQ ID NO: 341626 - RNA, 63 nt, hsa
ugcucaucacgggaggauaccugugugccggcagccccucagggacucucagcccuggcacug

SEQ ID NO: 341627 - RNA, 63 nt, hsa
auggggggcuggaccaccauggccacugacccagccccucagaaucccacacuccaauccuuu

SEQ ID NO: 341628 - RNA, 63 nt, hsa
acggucccagggccccaccuaggugcagagccggccccucaccuaacagcugguuccuaccag

SEQ ID NO: 341629 - RNA, 63 nt, hsa
ucccccuucccuggggcuucuagagcucucucugccccucagguccuggcccuuggguccuug

SEQ ID NO: 341630 - RNA, 63 nt, hsa
ggguccagggaggggcgccugcugagcacuuccgccccucacccugcccagccccugccauga

SEQ ID NO: 341631 - RNA, 63 nt, hsa
ccuugaaaugagaccacgucagagacauguacugccccucacauuuucucaccuaaaccagca

SEQ ID NO: 341632 - RNA, 63 nt, hsa
cccuuccuugaguggucuagaaggcacugcguggccccucagaugcugggacacaacagaccc

SEQ ID NO: 341633 - RNA, 63 nt, hsa
cagcagagcucaggacauucccccacagagcuugccccucaguuccuaccuccaagggggagg

SEQ ID NO: 341634 - RNA, 63 nt, hsa
caccccuucccuucccuggcgccccgggcccaggccccucagcugucagcugguuuugauggc

SEQ ID NO: 341635 - RNA, 63 nt, hsa
ggaugcugcugggaguccauggcacaggccacagccccucaccuugccgcgguggcuggcagc

SEQ ID NO: 341636 - RNA, 63 nt, hsa
augugguagugaaaaucgaggaagcaccucucagccccucagagaaugaucacccugaauuca

SEQ ID NO: 341637 - RNA, 59 nt, hsa
agaaggcaaggccggagugagugccugcggccccucacagggcugaggccagccccuag

SEQ ID NO: 341638 - RNA, 63 nt, hsa
aggcaggagagagagcagcuccccugcccaccugccccucaacccuguagcugcagggggagg

SEQ ID NO: 341639 - RNA, 63 nt, hsa
gugcagacaagagguggcgagagcccccaucaugccccucaaccuaucccguuccuucugccu

SEQ ID NO: 341640 - RNA, 63 nt, hsa
ucagacacugaugucuguccccaggugcucucugccccucaugccccucucaccggcccagug

SEQ ID NO: 341641 - RNA, 63 nt, hsa
ggaacgugcaaauuugcaggugcugcaucccaagccccucaugcuccugccuuccugagggcc

SEQ ID NO: 341642 - RNA, 63 nt, hsa
ugcccguuggacuuugccccucacacuggcccagccccucacacugccccaccccgagaaccc

SEQ ID NO: 341643 - RNA, 63 nt, hsa
caggccgcaggagugggaugcccguuggacuuugccccucacacuggcccagccccucacacu

SEQ ID NO: 341644 - RNA, 63 nt, hsa
aggcccuuccucccuuggcccaaccagcaaagcgccccucagucuucaagggcuuuccuggau

SEQ ID NO: 341645 - RNA, 63 nt, hsa
cacagccaggaacccggccagguccccccacaugccccucagggcccaggccugagugagugc

SEQ ID NO: 341646 - RNA, 63 nt, hsa
ucuuuagucuuugucccuuccuuuucacuaagugccccucauccuuuucaaucucauugucac

SEQ ID NO: 341647 - RNA, 63 nt, hsa
ccuuuccuuccucuccucccaccuccucccucagccccucauucuccuugggaaucugcagag

SEQ ID NO: 341648 - RNA, 63 nt, hsa
ccgccagagucccagacaccgguuuuccuagaagccccucacccccacuggcccacugguggc

SEQ ID NO: 341649 - RNA, 63 nt, hsa
cugccaagcgagaaugcaggccccgcccccucggccccucaccaccucuuucuacagccuaau

SEQ ID NO: 341650 - RNA, 63 nt, hsa
augaggagagcuucaggccccaggacugugggggccccucaggucagcucacugagcugggug

SEQ ID NO: 341651 - RNA, 63 nt, hsa
uauuggcaaggggaguggaaaugacaccaagaagccccucaugcucaugguuggacagagagc

SEQ ID NO: 341652 - RNA, 63 nt, hsa
auuugccucccuccagcucugcuuaggcauuuugccccucaccccaauguuccacaccaucga

SEQ ID NO: 341653 - RNA, 63 nt, hsa
cauucuccagucagaguagaugaugaggcccaugccccucacccccacgccccgccccuacaa

SEQ ID NO: 341654 - RNA, 63 nt, hsa
uggcaccugccacucugccccuugcccuccccugccccucacaacagucaccucacaaaccug

SEQ ID NO: 341655 - RNA, 63 nt, hsa
augacugcagcagaccuccuuggguguaccaaugccccucaucucccacuuucacaccuaacc

SEQ ID NO: 341656 - RNA, 63 nt, hsa
aauaaaguauaaaacauuuccaaucacuuaguagccccucaaaguaguuagaaaauaaacaga

SEQ ID NO: 341657 - RNA, 63 nt, hsa
cucaccguggcaaacacaggaaccccaugacucgccccucaccuggcguggagcugccugguu

SEQ ID NO: 341658 - RNA, 63 nt, hsa
ugcacacagggaugcccgcuccacauccugccugccccucagcccuggcccaggccccuuuug

SEQ ID NO: 341659 - RNA, 63 nt, hsa
ccaucuugaguccuggaacggcccugggugccugccccucacugugcaacucugggagcagcc

SEQ ID NO: 341660 - RNA, 63 nt, hsa
ccucuaaauaccuacccuagaugauuucauccugccccucacuucuuaacauauuccuguguc

SEQ ID NO: 341661 - RNA, 65 nt, hsa
ccagggagcccagccuauucccguuggcuggcugggccccucagcugcugggccccaccucccca

SEQ ID NO: 341662 - RNA, 65 nt, hsa
guuuccagggggcucugcuccaaguucccuagcgggccccucagggagaaauagccucacgugca

SEQ ID NO: 341663 - RNA, 65 nt, hsa
accugagaugugggaggugcagcauguuccccugggccccucagaaagucgagcuuggaggccag

SEQ ID NO: 341664 - RNA, 65 nt, hsa
ucccagaugucugcagcccucagcagcugcagaccgccccucaccaacccagagaaccugcuuua

SEQ ID NO: 341665 - RNA, 65 nt, hsa
gggcauuggugccaaguccaguggaugagaauccagccccucacaagcugugggauggggcuugg

SEQ ID NO: 341666 - RNA, 65 nt, hsa
ggaggcaccgugggccuggcacuugcaaaaguguggccccucacucuaguguguggucccucuca

SEQ ID NO: 341667 - RNA, 65 nt, hsa
uuucuaacugggccuaaggugagcugagggcuugagccccucagcccagcgggggucccuuuuca

SEQ ID NO: 341668 - RNA, 65 nt, hsa
ggacugcgggagccagcgcuccugccgccccucuugccccucagaccuugcauccacagaagcac

SEQ ID NO: 341669 - RNA, 65 nt, hsa
aaagugauucucccagaagcacaaagcauacucuugccccucagguguugcuuguguacaucgua

SEQ ID NO: 341670 - RNA, 65 nt, hsa
agaggcaacaauagagacacaggcuggguuggucugccccucagucaggcccccuuacccaccca

SEQ ID NO: 341671 - RNA, 65 nt, hsa
ugccauggagugggaauccccagccgaggcccuaggccccucagcagggaagggauccccgggga

SEQ ID NO: 341672 - RNA, 65 nt, hsa
gucugcaucuuggaggcagggaggugagggcaggugccccucagacacuucaggaagguaguuug

SEQ ID NO: 341673 - RNA, 65 nt, hsa
gccaaucaugugaaggacagaagcuuuugccaugggccccucacaucagggaaaaugaccuucac

SEQ ID NO: 341674 - RNA, 65 nt, hsa
ggugcccaccccucaaguguaaggaacugcguuccgccccucaggcccccaugggggcagggauc

SEQ ID NO: 341675 - RNA, 65 nt, hsa
aauugauaaaucagaggugcuacugaggaguuggugccccucauuccagaaucuccuacccccag

SEQ ID NO: 341676 - RNA, 65 nt, hsa
aauacuuauuucuggccaaaugaaucugcuucucugccccucaaacuuuuaguucacaauucauc

SEQ ID NO: 341677 - RNA, 65 nt, hsa
auaaagcacucuuauuuuuugaucuggccuauuuugccccucauuguguagccucaauuaacaca

SEQ ID NO: 341678 - RNA, 65 nt, hsa
gugccucugggaggagagggacuccuggggggccugccccucauacgccaucaccaaaaggaaag

SEQ ID NO: 341679 - RNA, 65 nt, hsa
cccuuccugcccuguguuaggagauagggauauuggccccucacugcagcugccagcacuugguc

SEQ ID NO: 341680 - RNA, 65 nt, hsa
agccccuagccccuucccuccuccuggggccuccagccccucacacugcuguucccagugauauu

SEQ ID NO: 341681 - RNA, 65 nt, hsa
ccaugccgggaagccagagaccugcaggggccucggccccucacaucguguaugucucuccuuga

SEQ ID NO: 341682 - RNA, 65 nt, hsa
cucucugcucccuucuucaguaagcaaggagccccgccccucaggcccagccucuggcaagaggu

SEQ ID NO: 341683 - RNA, 59 nt, hsa; identical to SEQ ID NO: 341200

SEQ ID NO: 341684 - RNA, 65 nt, hsa
ggggccugaacugccucugcuucccccccugaggggccccucacucuuacccaagacucuggauu

SEQ ID NO: 341685 - RNA, 65 nt, hsa
uguagcccagcccaucuaaauggaagcugggaauugccccucaccuccccuguguccuguccagc

SEQ ID NO: 341686 - RNA, 65 nt, hsa
uagcacacacugcaugccuuaacaagugugugcaagccccucagaacucaagacauccaaauuuu

SEQ ID NO: 341687 - RNA, 65 nt, hsa
ugaaagauuucugaacagugauugucccguuaauagccccucagaagauguucccugcugauaac

SEQ ID NO: 341688 - RNA, 65 nt, hsa
cugucauaaaaaacaguggagcucuguauuagaaagccccucagaacugggaaggccagguaacu

SEQ ID NO: 341689 - RNA, 65 nt, hsa
uaucgguauauuaaguccaaaagaugguccgggcugccccucacaaaagcuucugcauccacgug

SEQ ID NO: 341690 - RNA, 65 nt, hsa
ggagccugggacccuguuuacaguugcacaucugggccccucacuguggggauugaucauucuca

SEQ ID NO: 341691 - RNA, 65 nt, hsa
agacuccugggcuucagccucucccacccagcccugccccucaccugccugcccuccccuccccc

SEQ ID NO: 341692 - RNA, 65 nt, hsa
gagcuggaagaagccuuagagcucaacuucuucaagccccucacuuuacagaugaggaaauggag

SEQ ID NO: 341693 - RNA, 65 nt, hsa
cuggccagaagcaccagccugcugccagcggggcagccccucauaggaggcccaggagggagccc

SEQ ID NO: 341694 - RNA, 65 nt, hsa
ucccacagcccugagaugggccggcccccuuccuggccccucauggcgggacuggagaaaugguc

SEQ ID NO: 341695 - RNA, 65 nt, hsa
acccggcccauaucccugguugccucauggccagcgccccucagccucugccacugugaaccggc

SEQ ID NO: 341696 - RNA, 65 nt, hsa
ugucugagcagccguguugggggcgcucccucucugccccucagcgagagccucggaccucccaa

SEQ ID NO: 341697 - RNA, 65 nt, hsa
ggcgaccugcugacccacggucacugcuguguucagccccucagcucggccccagccuauuuccc

SEQ ID NO: 341698 - RNA, 65 nt, hsa
cagagagggcccagcuguagccauggcucaggcaagccccucagcccuugcccccaucccucgga

SEQ ID NO: 341699 - RNA, 57 nt, hsa; identical to SEQ ID NO: 341216

SEQ ID NO: 341700 - RNA, 65 nt, hsa
agcuuuucgaacugugcucccacggggaccacugggccccucaggggaagcugcuaggggaagga

SEQ ID NO: 341701 - RNA, 65 nt, hsa
ugggaggggaggcggaucugaggggcugggugcaggccccucaguuggggcucccaccuucccca

SEQ ID NO: 341702 - RNA, 65 nt, hsa
ccuggggucccagggcccuuccuuguuucucagaggccccucagccacuggaaccccaucuucag

SEQ ID NO: 341703 - RNA, 65 nt, hsa
cacagccucuuuccgucccucucuuucugauccaggccccucaguccaagcuuuggaaaaccuuc

SEQ ID NO: 341704 - RNA, 65 nt, hsa
aggaagcacaugccucucucaggccaaacucaccugccccucaacucuccuccagagucagaagu

SEQ ID NO: 341705 - RNA, 65 nt, hsa
ggcccagcugcagccacccuucucaucuggaucgggccccucagaagcaggaaacccucaaaccc

SEQ ID NO: 341706 - RNA, 65 nt, hsa
uuuguccuacaucucccugaaccagagugugcccugccccucaugcucagaccucucccacccca

SEQ ID NO: 341707 - RNA, 65 nt, hsa
acuuuuuguauuucuggggcugaggcucagcaacagccccucaggcuuccagugaguccccaucu

SEQ ID NO: 341708 - RNA, 65 nt, hsa
augugagaaagcuaaaaugguggucuucuccaccagccccucacaggcuuggggguuuucaaugu

SEQ ID NO: 341709 - RNA, 65 nt, hsa
caaaccagugcauucuacuucucgaguguucacuugccccucaguuugugaccaaguugugggua

SEQ ID NO: 341710 - RNA, 65 nt, hsa
gacaacuauagacuugcucauuguucagacugauugccccucaccugaauccacucucuguauuc

SEQ ID NO: 341711 - RNA, 65 nt, hsa
cacucuaucuuuagauuucaaaccuuaggcuuacagccccucaauaucucucugcuaacaccagu

SEQ ID NO: 341712 - RNA, 65 nt, hsa
uggaccccucccuugcucagugccuccuggccggggccccucaccccaaggggucuguauauaca

SEQ ID NO: 341713 - RNA, 65 nt, hsa
aaacauuaaucaccaaaguauuaauguacagaguggccccucaccugggccuuuccugugccaac

SEQ ID NO: 341714 - RNA, 65 nt, hsa
ggguccauccuggagacccugaggucuaagcuacagccccucagccaaccacagacccuucucug

SEQ ID NO: 341715 - RNA, 65 nt, hsa
ccuuccuggcucgucucaaaggccaggacccuggggccccucaacugcagucagagagcaagccc

SEQ ID NO: 341716 - RNA, 65 nt, hsa
ucuaccugaccaacaguuccuucagcuuccauuucgccccucauuuaucccucaacccccagccc

SEQ ID NO: 341717 - RNA, 65 nt, hsa
aguaugcuacuuucucucagcauccaauaaucauggccccucaauuuauuuguggucacccaggg

SEQ ID NO: 341718 - RNA, 65 nt, hsa
ucaaaaagugcggaggaaguagcuggacaggcccugccccucaccagcaagaggcaugauuggau

SEQ ID NO: 341719 - RNA, 65 nt, hsa
cuccuuccugcucacauccacagucagggcacggcgccccucaagaacuccagagucaccugucu

SEQ ID NO: 341720 - RNA, 65 nt, hsa
agcaaaacccaaguagaugccucuaggggcacauggccccucacaucacaagccagaaccuaagc

SEQ ID NO: 341721 - RNA, 65 nt, hsa
acuuagccauccccuccucagcaaggcaucuaccggccccucacagagacaguacuuugaaacuc

SEQ ID NO: 341722 - RNA, 65 nt, hsa
aaagagaaaaacccuccucugguaguucugugugugccccucaccccugugugcuagugucuggg

SEQ ID NO: 341723 - RNA, 65 nt, hsa
uuuugcccuugcaaaggcuuccuaggucuccaguggccccucaggacccagggucccagcugcug

SEQ ID NO: 341724 - RNA, 65 nt, hsa
ugagugacccuggcaguguuugccugcucagaguggccccucagaacaacagggcuggccuugga

SEQ ID NO: 341725 - RNA, 65 nt, hsa
cacccagucauccagcagcgucaacaucgugaugggccccucagccagggcugccagccaggcca

SEQ ID NO: 341726 - RNA, 65 nt, hsa
cgcgcgaagugaaggaugcgucacuuuucugagcggccccucagaccucuccugcuggucccugg

SEQ ID NO: 341727 - RNA, 57 nt, hsa; identical to SEQ ID NO: 341244

SEQ ID NO: 341728 - RNA, 65 nt, hsa
ccucaaaauauauucagcaaaggguucacuuaguugccccucaugcuucacagguugacuaguau

SEQ ID NO: 341729 - RNA, 65 nt, hsa
ccugugaaugugccucguucaucccuggugcuugagccccucaagcuccagucaaugauccaguc

SEQ ID NO: 341730 - RNA, 65 nt, hsa
agccacucucugcccacuaccuaugcuucuagaaagccccucaccucaggaccccagagggacca

SEQ ID NO: 341731 - RNA, 65 nt, hsa
uuguguugcgcccggagcccgcccuucgccucccagccccucaagacaccgcuggcugcuggaca

SEQ ID NO: 341732 - RNA, 65 nt, hsa
ccgcccggccccgccgcggcccggacccccagccagccccucacagcucuuccccagcuccgccu

SEQ ID NO: 341733 - RNA, 65 nt, hsa
cucacucuggccaaggagcucugaauugugagucugccccucaggggaauucggagcuagaggac

SEQ ID NO: 341734 - RNA, 65 nt, hsa
gcccuucccccauccaugguugggaaagaagcucagccccucacaguggccucaagugugaugcc

SEQ ID NO: 341735 - RNA, 65 nt, hsa
cagcgccccggcugggcggaggaggagacgcccaugccccucaggggaaaguggagaccgggaca

SEQ ID NO: 341736 - RNA, 64 nt, hsa
agcugcacaugccagugugacccuugaagacagugccccucagagaccccaagaccuuagggau

SEQ ID NO: 341737 - RNA, 65 nt, hsa
cccuaaugacacccacuccuagcccugaggcucgugccccucagacuggggaagaguccaaggaa

SEQ ID NO: 341738 - RNA, 65 nt, hsa
cccuggggagggcccucuggccccaggcaaccuuagccccucagaacagggagucccaggaccca

SEQ ID NO: 341739 - RNA, 65 nt, hsa
gggcuccguaagaacucagaugccugggaagcccagccccucaggugcccccacacacagccuuc

SEQ ID NO: 341740 - RNA, 65 nt, hsa
uuuuuauucacucuucagacacgcuacucaagagugccccucagcugcugaacaagcauuuguag

SEQ ID NO: 341741 - RNA, 65 nt, hsa
ccagaccucuuauugcccauucuccuuucuucucagccccucaccccucuuuagcaauuccuaga

SEQ ID NO: 341742 - RNA, 65 nt, hsa
ugggcccacugagcugcacugggauucuucacucugccccucacuuccuuuagggcaaauaacac

SEQ ID NO: 341743 - RNA, 65 nt, hsa
gacuuuuuauacuuuguaaagacaauuguuggagagccccucacacagcccuggccucugcucaa

SEQ ID NO: 341744 - RNA, 65 nt, hsa
aguuccugugcugcccugcaccuaggagagacucagccccucacagcuugggauguuaccuugcc

SEQ ID NO: 341745 - RNA, 65 nt, hsa
aaacuugccacaggagcgauguguuuucucugagugccccucacuuacauguuuaucuuuguuug

SEQ ID NO: 341746 - RNA, 65 nt, hsa
gcucccacgccugcccacuuugcuagcccggcugugccccucacuaucagagacugggcgaagca

SEQ ID NO: 341747 - RNA, 65 nt, hsa
gccuuccagccccuccaggacccggucccccugcugccccucacuucaggaggggccuggagcag

SEQ ID NO: 341748 - RNA, 65 nt, hsa
aauagguuuuuauuguugaauguacaucuaccccagccccucaaaagaaaaacuguuuacauaga

SEQ ID NO: 341749 - RNA, 65 nt, hsa
uugcuauuuuuauagcugauauaguuacaccucaagccccucagggguaacaacuaacaaacacc

SEQ ID NO: 341750 - RNA, 65 nt, hsa
gaguuuucuagaagguugggauugucaggguccuggccccucagaacuggcuugaucaagggccu

SEQ ID NO: 341751 - RNA, 65 nt, hsa
aagaugcagccgucugaugaggccacaaccccuaggccccucaggagcuuugcagagaggaggac

SEQ ID NO: 341752 - RNA, 65 nt, hsa
cuugcuacucuuugagaaugaaguugucauucagggccccucauguagccaaaagaccaagaaaa

SEQ ID NO: 341753 - RNA, 65 nt, hsa
aaauaugagcuacugaggaggggguuggacauccugccccucaccccccacccacacugcaggua

SEQ ID NO: 341754 - RNA, 65 nt, hsa
guguuuacauguguagccuauguugugguccaucagccccucacauuccuagggguuugagaugc

SEQ ID NO: 341755 - RNA, 65 nt, hsa
agcaggguagggcugucgccuuagaucccgcccaagccccucauucccuccuugcacagaugcau

SEQ ID NO: 341756 - RNA, 65 nt, hsa
aaccuaggaaccgccgcugccugcuggggggccacgccccucaugcccuugucccaggcccgggg

SEQ ID NO: 341757 - RNA, 65 nt, hsa
gagccacaccagccuggauuucaaucccagaaucugccccucacgaggaugugaccuugggcaga

SEQ ID NO: 341758 - RNA, 65 nt, hsa
ucccgugcuucucccuugggcagccucucucuugagccccucacccuguuucuuucugugaagcg

SEQ ID NO: 341759 - RNA, 65 nt, hsa
uuaauucuuucucauguugggagugagaaugccgggccccucagggcugucggugugcugucagc

SEQ ID NO: 341760 - RNA, 65 nt, hsa
uauucuagaacacuuggagccugaacucugaccaggccccucacuugagccuuugcuuucugcuc

SEQ ID NO: 341761 - RNA, 65 nt, hsa
acaugacccacuaacguggcaacuuuaacccaaaggccccucagacauguuacagcaaaucugga

SEQ ID NO: 341762 - RNA, 65 nt, hsa
cagccuccgaggagaccaggaacccugcuucagcagccccucagggcuucccaaggauguccagc

SEQ ID NO: 341763 - RNA, 65 nt, hsa
ccuguggccacagcucuggagugggaggguugguugccccucaccucagagcucccccaaaggcc

SEQ ID NO: 341764 - RNA, 65 nt, hsa
auggauuaggagagggggugaugaccccuccccaagccccucagggcccagaccuuccugcucuc

SEQ ID NO: 341765 - RNA, 65 nt, hsa
gagcucgaccuugcucuuauuagucccucaccccugccccucaugaucucccacuuucucuagcu

SEQ ID NO: 341766 - RNA, 65 nt, hsa
cugucuccagaagucguggccuuccagaacagucugccccucaaggaaggguggggcaggcagua

SEQ ID NO: 341767 - RNA, 65 nt, hsa
ggggcuaagaaguucaccagcccugagccauggcggccccucagccugccugaagagaggaaacu

SEQ ID NO: 341768 - RNA, 65 nt, hsa
aggcuagguuaggcccugcacuccaccuggggacggccccucaucaccugaaguccucugcugug

SEQ ID NO: 341769 - RNA, 65 nt, hsa
agcugcuccaaaaucaucaacucagccccugggcugccccucagaggcggugucuggggaggacu

SEQ ID NO: 341770 - RNA, 65 nt, hsa
cugcucgaguuccuggaugugcagaagcacuuguggccccucaaggaccucacgcugacgagcaa

SEQ ID NO: 341771 - RNA, 65 nt, hsa
cccaucagggaccuccaggugcauggauuggugcugccccucaugcugcccagcuucuacucaga

SEQ ID NO: 341772 - RNA, 65 nt, hsa
acugcaccucuggaggugcagggcacccuugagaagccccucaccccuaggccgccuccaggugc

SEQ ID NO: 341773 - RNA, 65 nt, hsa
cccgcuaaggaagauaucuaguguuggggauccuggccccucaaccuccuguggaacccagcagu

SEQ ID NO: 341774 - RNA, 65 nt, hsa
ggucuaauccuucucauuacccacccgaccuggcugccccucaccuugggcugggggacuggggg

SEQ ID NO: 341775 - RNA, 65 nt, hsa
cccuggcgcuugaggcucagaagagccucuguccagccccucaguauuaccaugucucccucuca

SEQ ID NO: 341776 - RNA, 65 nt, hsa
aaucaaaccauucuaauggaaaaggacaacaaacugccccucacuacuggcuugguuuggucuac

SEQ ID NO: 341777 - RNA, 65 nt, hsa
aguccuccauugaggaugcccacugaggcagccaggccccucaccagcccuggggggaauccuaa

SEQ ID NO: 341778 - RNA, 65 nt, hsa
uucuuuagagcauugccauucccugccuggggcgggccccucaucgcguccuccuaccgaaaccu

SEQ ID NO: 341779 - RNA, 65 nt, hsa
guugcuuauuuguguaauggaugugguccucuaaagccccucauuguuuuugauugccuucuaua

SEQ ID NO: 341780 - RNA, 65 nt, hsa
ccuccccaccuccaggcuuucccacuucccacccugccccucagagacugaaauuacggguaccu

SEQ ID NO: 341781 - RNA, 65 nt, hsa
gggccuuucccaccuggagagaaacuuccagaccagccccucauaccacagccaagaggggccuu

SEQ ID NO: 341782 - RNA, 65 nt, hsa
aggccuuucccaccgguagagaaacuuccagaccagccccucacaccacagccaagagaagccuu

SEQ ID NO: 341783 - RNA, 65 nt, hsa
aggccuuuaccaccuggagagaagcuuccagaccagccccucacaccacagccaggagaggccuu

SEQ ID NO: 341784 - RNA, 65 nt, hsa
aggccuuucccaccuggagagaaacuuccagaccagccccucauaccacagccaagaggggccuu

SEQ ID NO: 341785 - RNA, 65 nt, hsa
gggccuuucucaccuggagagaaacuuccagaccagccccucacaccaccgccaggagaggccuu

SEQ ID NO: 341786 - RNA, 65 nt, hsa
aggccuuucccaccgggagagaaacuuccagaccagccccucacaccacagccaggagaggccuu

SEQ ID NO: 341787 - RNA, 65 nt, hsa
aggccuuucccaccgggagaggaacuuccagaccagccccucacaccacagccaggagaggccuu

SEQ ID NO: 341788 - RNA, 65 nt, hsa
acagaaccaccagcaaagccggcggcuggacuggcgccccucagagaccugcggaaagcccccuc

SEQ ID NO: 341789 - RNA, 65 nt, hsa
uauuuuccagaaauuucucaaaaugucugcugauagccccucacucauauuuuucauguggguuu

SEQ ID NO: 341790 - RNA, 65 nt, hsa
ucucuguguuuccagaaggccccacacacccaagugccccucacaccucgugccucccccucaca

SEQ ID NO: 341791 - RNA, 65 nt, hsa
ucugaccagcagaauccacccggugaccagugguggccccucagcccacccucccggcagcucag

SEQ ID NO: 341792 - RNA, 65 nt, hsa
cgacuccagugcucuggcccgggacuccccuauccgccccucacuuacccuuaaacaggugaucc

SEQ ID NO: 341793 - RNA, 65 nt, hsa
ccauccacugaaggcuguguuuauucuuuuccugugccccucauaauggaagaaaguaaacugcu

SEQ ID NO: 341794 - RNA, 65 nt, hsa
ugcgucgagugagcgucccgaggccacgugcggaggccccucacugugcugucaaaggccugugg

SEQ ID NO: 341795 - RNA, 65 nt, hsa
augcuagaaaaucgaguuggcaaaaugggguuugggccccucagagcccugcccugcacccuugu

SEQ ID NO: 341796 - RNA, 65 nt, hsa
cucucgucacccaucacucccugcuuccgcagggcgccccucaguauucgcugccauaugucccu

SEQ ID NO: 341797 - RNA, 65 nt, hsa
agggagauacugggggcagagcagacuuugccagugccccucaggucaaaccaagccaagagcac

SEQ ID NO: 341798 - RNA, 64 nt, hsa
ggcccacacacccugccuaggccaccccgccgcggccccucaggucgcccuggccacacucaca

SEQ ID NO: 341799 - RNA, 65 nt, hsa
ccccuaagacccaccgacucugugcuagaacaagcgccccucagagauucugaugccacugaagu

SEQ ID NO: 341800 - RNA, 65 nt, hsa
gggaggacagucuuuccccagcaggggucaggggggccccucaggaagccuaaggucgugcuagu

SEQ ID NO: 341801 - RNA, 65 nt, hsa
cucacucccuuuggcuacccuggccgugccuggcagccccucaggccccacagguggguccuggu

SEQ ID NO: 341802 - RNA, 65 nt, hsa
aacggaaaucucugggacaauggcuccuccagagggccccucagagccaggugcuggccagaugc

SEQ ID NO: 341803 - RNA, 65 nt, hsa
cuuguagcccucugagcccucauccugcaggcagagccccucagugcucugagaaaccugcccug

SEQ ID NO: 341804 - RNA, 65 nt, hsa
ggugaggccuggcccugggcagggucuguggcugcgccccucaggccagcaguugagguccaucg

SEQ ID NO: 341805 - RNA, 65 nt, hsa
caugguccgcugagggcuggggggcggucuccgaggccccucaacagagaagccuccaccugagg

SEQ ID NO: 341806 - RNA, 65 nt, hsa
ugagaaaagccgaaaaagcaugcaucuuagaaauagccccucaauuccaggagucaacaugccaa

SEQ ID NO: 341807 - RNA, 65 nt, hsa
ugggagaguaagaacuaagggaaugaguuugggcggccccucauaaaggaccuuagaggcaggga

SEQ ID NO: 341808 - RNA, 65 nt, hsa
gucuuguaauuguggauuaaugucaauguuaaucagccccucaaagggagagaaaagcuggaccu

SEQ ID NO: 341809 - RNA, 65 nt, hsa
gagccaugggcuaaauggguacuagaacaacaacugccccucauguacgccaaggaugagcucua

SEQ ID NO: 341810 - RNA, 65 nt, hsa
cugaaccuugcauauccuucacauauuucccauaagccccucagaaaggcuaacugugaugauga

SEQ ID NO: 341811 - RNA, 65 nt, hsa
gguggauauggugcagagaagcuggacuucugugggccccucaacagccaagugugaccccacug

SEQ ID NO: 341812 - RNA, 65 nt, hsa
gcagcaguccccuuggauacuaaagucugagccaggccccucaggcccggcaugggcagugcgag

SEQ ID NO: 341813 - RNA, 65 nt, hsa
auuuuuuuaagcguuugcacuauuuagaguccuaagccccucauguucagcugugcuguguuucu

SEQ ID NO: 341814 - RNA, 65 nt, hsa
aagaaggaugugagaggugggcgcuuuggagguuugccccucacccaccagcugccccaucccug

SEQ ID NO: 341815 - RNA, 65 nt, hsa
cccgaggugcugauggagaugcucaaggccagcaagccccucaggccagcacuucgcuugcagaa

SEQ ID NO: 341816 - RNA, 65 nt, hsa
caucacgccucgcucccuccuggcccucugguccagccccucacgccuccucucagucuacucaa

SEQ ID NO: 341817 - RNA, 65 nt, hsa
cuuuuguguacuuuuaaaauuguaucuuuccaggagccccucagauuguaccuugcuuucucacc

SEQ ID NO: 341818 - RNA, 65 nt, hsa
augggggaguagaucuuucuaggagggagacacuggccccucaaaucguccagcgaccuuccuca

SEQ ID NO: 341819 - RNA, 65 nt, hsa
gcgggacagugcugcagcucccuggcuucuguggggccccucaccuacuuacccagguggguccc

SEQ ID NO: 341820 - RNA, 65 nt, hsa
cuccccaaaaccuuuccccagacacauucuccugugccccucagagaggcaugugaugugcaagg

SEQ ID NO: 341821 - RNA, 65 nt, hsa
cagugaccucaaauguugccuuggaguccccuacagccccucagcagagggcagcacuugaaugc

SEQ ID NO: 341822 - RNA, 65 nt, hsa
cagggcccuccucccccaccagcucuccccacagggccccucagcaucauggagacccgcaggcg

SEQ ID NO: 341823 - RNA, 65 nt, hsa
auuuccaagagcaaggaugaaaaauugaagucacagccccucagcaccaagcagaaggugaggac

SEQ ID NO: 341824 - RNA, 65 nt, hsa
ucugucacaggcugggucaaaagagcccuggcucugccccucagggggccagcuggggagauggg

SEQ ID NO: 341825 - RNA, 65 nt, hsa
ccacuggcugccaacuccugccgcccucugggacugccccucagucccaggagagcuaugaggcc

SEQ ID NO: 341826 - RNA, 65 nt, hsa
uccccaaagcaguuagacuauggagagccgacccagccccucaggaacccucauccuucaaagac

SEQ ID NO: 341827 - RNA, 65 nt, hsa
ucuccccuagacucaggcuuccuuuggagauuaaggccccucagagaucaacagaccaacauuuu

SEQ ID NO: 341828 - RNA, 65 nt, hsa
ccugaggcuggcaaguggggcaacguguggaggaagccccucauaauuuggagaaaacuugauac

SEQ ID NO: 341829 - RNA, 65 nt, hsa
auauugccauacaauuuuaauuuauacaaguauuggccccucaagugguuggaaauuuuuuuuuu

SEQ ID NO: 341830 - RNA, 65 nt, hsa
uucaugaauaggcguacuuucuguauuuaaaaauggccccucaagcaccguuaauuuacauucca

SEQ ID NO: 341831 - RNA, 65 nt, hsa
accaaagguugggacucugucuuacauaucugggugccccucauagugcaguaauaaguaaguug

SEQ ID NO: 341832 - RNA, 63 nt, hsa
agaagucuguccaaccccaaaaggcucuuuucagagccccucaauugucaccaaaaggaagcu

SEQ ID NO: 341833 - RNA, 65 nt, hsa
uucucauugcccacggacccaaccucuguccaggugccccucaucaucacaguuuaacacaagcu

SEQ ID NO: 341834 - RNA, 65 nt, hsa
cucuccuacuguuuaaauucccauuccaccacagugccccucagccagaucaccaccccuuacaa

SEQ ID NO: 341835 - RNA, 54 nt, hsa; identical to SEQ ID NO: 341352

SEQ ID NO: 341836 - RNA, 58 nt, hsa; identical to SEQ ID NO: 341353

SEQ ID NO: 341837 - RNA, 65 nt, hsa
uaugccagcaagaaugaagcacagaugaaggcagcgccccucacuugcucuggcuucagaaguga

SEQ ID NO: 341838 - RNA, 65 nt, hsa
gggccugguggagauucccugucuucugagcccgagccccucauuaccagugaaggacaugcuug

SEQ ID NO: 341839 - RNA, 65 nt, hsa
gugacuuucaacuugcugacuccuccucuuuuccagccccucaaccaucggucuuguuuacuaga

SEQ ID NO: 341840 - RNA, 65 nt, hsa
ugagaugacccaaaucuuucacuaugugcaccccagccccucaaaaauggggaagggcugaaaga

SEQ ID NO: 341841 - RNA, 65 nt, hsa
ggccagucauugacagacggacuuguugaccacacgccccucaccaaacaaugcagcagcuacug

SEQ ID NO: 341842 - RNA, 65 nt, hsa
uuaguggcugaguucuuucuuagcugcuuuaaggagccccucacuccccagagucaaaaggaaau

SEQ ID NO: 341843 - RNA, 65 nt, hsa
ccccaagcagacuagaugggaggaggcgccgcucagccccucacccugcaucacugaagagcggc

SEQ ID NO: 341844 - RNA, 65 nt, hsa
accuguccugccacggccucccagccggugcgggagccccucacugcccugaccgacuccgcagu

SEQ ID NO: 341845 - RNA, 65 nt, hsa
accuccacgugagaacaagggugaaggugagggaagccccucaccuugggucuuuugcugugccu

SEQ ID NO: 341846 - RNA, 65 nt, hsa
ggaggaggugaaagaaagggacccaccugcuagucgccccucagagcaugaugggaggugugcca

SEQ ID NO: 341847 - RNA, 65 nt, hsa
ugcccaugaugguaccacaccagggccucagccuggccccucaccacauacccuuugccuuuuag

SEQ ID NO: 341848 - RNA, 65 nt, hsa
gggugaggggccaggccauggccaaggggccagcugccccucauuuaucacucugaccuucacag

SEQ ID NO: 341849 - RNA, 65 nt, hsa
uccaugaccagaggcuggaguggggguguguuagagccccucaccgggacuugcugugcggaugg

SEQ ID NO: 341850 - RNA, 65 nt, hsa
aaucaauguuucaucuccaacccucugccaguuuggccccucagagcuugguggcucaagacugu

SEQ ID NO: 341851 - RNA, 65 nt, hsa
gcuccuggugccgccucggccccagccuguccccagccccucaaucuggugcagcagcaucuugu

SEQ ID NO: 341852 - RNA, 65 nt, hsa
cucucccuccuccagaucccugccuccuagugccagccccucacacgccuucauccugaaacagg

SEQ ID NO: 341853 - RNA, 65 nt, hsa
gggugccacauggguuccugugccacccuuuccccgccccucaaaucguccuuuaagucuuccuu

SEQ ID NO: 341854 - RNA, 65 nt, hsa
ccuccccuguaaaaugggaccuccgaaccaacccugccccucagaaaugcccugccuauuaaaug

SEQ ID NO: 341855 - RNA, 65 nt, hsa
ucucgcccacccugugcccuggcgccgcugcaacagccccucauggccaggagccccccauggcc

SEQ ID NO: 341856 - RNA, 65 nt, hsa
aaagaaccugggccuaucagcguguaagggggccugccccucaucugcgaaagaagagcccagac

SEQ ID NO: 341857 - RNA, 65 nt, hsa
cuccuggcccugccucuggcccuucccgggccgcugccccucagccauguggcacuucugagcuc

SEQ ID NO: 341858 - RNA, 65 nt, hsa
aggcagagaggaggggagguccugaggggacugcugccccucacucggcauccccugcagaguca

SEQ ID NO: 341859 - RNA, 65 nt, hsa
caucuguuacuuccccuuuuuccauggguuucauggccccucaugauauuugccuucugcuccua

SEQ ID NO: 341860 - RNA, 65 nt, hsa
cauugcugcaauacugcucccccagccucuccccugccccucaaccugccuuagcugcacucucu

SEQ ID NO: 341861 - RNA, 65 nt, hsa
ggcccgccuggcuucgaguuggaacccggacacuugccccucacugguguggauggaaaucugcc

SEQ ID NO: 341862 - RNA, 65 nt, hsa
gaaugcaacagggguguugcgggggcaacaugagagccccucacccccaacucuccacuuucagg

SEQ ID NO: 341863 - RNA, 65 nt, hsa
cuggcacacagaguucauguuugcgcccucucccugccccucaccccagagggugaggaggaaug

SEQ ID NO: 341864 - RNA, 65 nt, hsa
aaagcaccagccaucguguggagcacuaccaaggggccccucagggccuuccugggaggaguccc

SEQ ID NO: 341865 - RNA, 65 nt, hsa
uucucccucuaauuacagaucccacuuccagccgggccccucauguauccacuggccgaccgcag

SEQ ID NO: 341866 - RNA, 65 nt, hsa
uccgaccuagaugaugauucuuccuguagcaucuggccccucacaaugucagaggauuuaauugu

SEQ ID NO: 341867 - RNA, 65 nt, hsa
gccgacgcggugcugcugccgccgcuucggguuuggccccucagaaccccuccuuuucugagcgc

SEQ ID NO: 341868 - RNA, 65 nt, hsa
cauuaaucaaccauauuaaauuuauaauaaaaaaugccccucagaaguuugccucugaagccuuu

SEQ ID NO: 341869 - RNA, 65 nt, hsa
gcagcagagcagaccugaugucccggugcuuccuggccccucagcuccagugauucacgcccgcc

SEQ ID NO: 341870 - RNA, 65 nt, hsa
uuagcccccagccugugaccuuccccccagggaaggccccucaugccuuuccuucccuuucucug

SEQ ID NO: 341871 - RNA, 65 nt, hsa
ccaaagggaggggagcaaguggggaccuggccauggccccucagcaaaaaccuauucacagcggg

SEQ ID NO: 341872 - RNA, 65 nt, hsa
cucugcuaggcagcccaggccuggucugggagacagccccucacccugccugggcucuuggccaa

SEQ ID NO: 341873 - RNA, 65 nt, hsa
uguucuuauuuauugcaugcgucgcuuccacaggggccccucaagagcugugacucgggagagcu

SEQ ID NO: 341874 - RNA, 65 nt, hsa
ucugucccuucagccggcagagcgagcccagcguggccccucaauuugaaaauggacgucuuuuc

SEQ ID NO: 341875 - RNA, 65 nt, hsa
uuuuaaugaacaagguggaccaaagggcugaaccagccccucaaccaggacccuggggggccugc

SEQ ID NO: 341876 - RNA, 65 nt, hsa
uggguggcaggagagcggacuuagagcccccgagggccccucagcagaggaaggggaguccccuc

SEQ ID NO: 341877 - RNA, 65 nt, hsa
gacucgugacugcccagcgccccaggcuggacugagccccucacgccgcccugcagcccccaugc

SEQ ID NO: 341878 - RNA, 65 nt, hsa
gcugaccagaccacgggcagggccugccuccgugugccccucagcucagccccagcaagugugug

SEQ ID NO: 341879 - RNA, 65 nt, hsa
ggcugagguuuggguggugugaucuguccuaauuggccccucaccaaugcaucuaucugucugcc

SEQ ID NO: 341880 - RNA, 65 nt, hsa
augggaagccuggcaaagcugcccaaccggguagugccccucacccaucggaucacugccuucuu

SEQ ID NO: 341881 - RNA, 65 nt, hsa
augaauugucaucuuugguguuuuuuuaacccccagccccucaaaaaaauaaggccuccagguau

SEQ ID NO: 341882 - RNA, 65 nt, hsa
agaaggcuguggcugcuagugaccucuuugcuguggccccucauuugaccuuucaccucugucug

SEQ ID NO: 341883 - RNA, 65 nt, hsa
gcacuuccgcaucugcccgugggcgccccacagcugccccucagccgcugagauccaguguccaa

SEQ ID NO: 341884 - RNA, 65 nt, hsa
uuuucugucccuccuacuuuccuucacaccagacagccccucaugucuccaggacaggacaggac

SEQ ID NO: 341885 - RNA, 65 nt, hsa
ucaugugcuugugccuaccuggccgcaaguccccagccccucaacccuccguuccuccucagccu

SEQ ID NO: 341886 - RNA, 65 nt, hsa
aaggaaacgggacaaaaccuuaagcuguuuucuuagccccucagccagcugccauuagcuuggcu

SEQ ID NO: 341887 - RNA, 65 nt, hsa
cuuugcacaugcucacccccagcacagucccacuggccccucaccuccccuucccugagcuccuu

SEQ ID NO: 341888 - RNA, 65 nt, hsa
ggcacuggaugggauguacuucucagccccgcugagccccucauuugugcccagcauuuugugug

SEQ ID NO: 341889 - RNA, 65 nt, hsa
cacuucuccuugaggcagcuggagagcuaucccccgccccucaagcaccugugccguguggccau

SEQ ID NO: 341890 - RNA, 65 nt, hsa
ccuggcgccccuucucuccaagcucaauucucuaagccccucagggucuccuccucaccccaccc

SEQ ID NO: 341891 - RNA, 65 nt, hsa
acccgaagcaggcguccaucuguguccuccuggcagccccucaaacacacaccaccccaugucac

SEQ ID NO: 341892 - RNA, 65 nt, hsa
cucccgaugucacaggcagucugugugguuacagcgccccucaguguucaucuccagcagagaca

SEQ ID NO: 341893 - RNA, 65 nt, hsa
cccgccccguggucggaagagcacucccuucccuggccccucauccagccuccggugcuguaaaa

SEQ ID NO: 341894 - RNA, 65 nt, hsa
cuccuuucuggcauccuggccucucgugguccucagccccucacccccaguacugcagaucucac

SEQ ID NO: 341895 - RNA, 65 nt, hsa
cucuccuuguggggucccagguccugcugccaagagccccucaagagaagggcugaaccugggga

SEQ ID NO: 341896 - RNA, 64 nt, hsa
gaugggggcacguuguccgugauaaaaguacaagugccccucaccgcccguggagauugcuuuc

SEQ ID NO: 341897 - RNA, 65 nt, hsa
gagacucccagcagcagagcccaagcacuggcuucgccccucagugcccuggggcauguucaggg

SEQ ID NO: 341898 - RNA, 65 nt, hsa
ggccuggucccccuuugcccugcaguggaaugagggccccucagccccgcauugaucuaaauaaa

SEQ ID NO: 341899 - RNA, 65 nt, hsa
ucugggcucagauacugugacaucccagaagcccagccccucaaccccucuggaugcuacauggg

SEQ ID NO: 341900 - RNA, 65 nt, hsa
ucuguuggacuuuacagaagagccucauccugucugccccucacucugcccuggaaucaacaucu

SEQ ID NO: 341901 - RNA, 65 nt, hsa
cgcucucgauuucucuaucugucccucugaggucggccccucagacccuccuccuuaauuuccca

SEQ ID NO: 341902 - RNA, 65 nt, hsa
gacacguggaugauggggucagagaucacugagcugccccucaagggggccuggaacccgggugc

SEQ ID NO: 341903 - RNA, 65 nt, hsa
agagcccugcccgaggcugaggcugggccggcgcugccccucaucuuagcauugggcagacacca

SEQ ID NO: 341904 - RNA, 65 nt, hsa
acccuuguuaaugaugcuccugccucugccucccagccccucacccagcacagcucugccuggac

SEQ ID NO: 341905 - RNA, 65 nt, hsa
gaggcagacccccaccaccauacaugcugucuguggccccucagacauucuguuucaucucccau

SEQ ID NO: 341906 - RNA, 65 nt, hsa
cccugucaccucccucucaccaacccggggucugagccccucauuccugaccguccguguucuca

SEQ ID NO: 341907 - RNA, 65 nt, hsa
gugauuuauaaguacugagcaugaaguacuugucugccccucauuucaaggccagaguuauuuuc

SEQ ID NO: 341908 - RNA, 65 nt, hsa
uccugguuagguggggacagaggauuucugcuuaggccccucaggacccagggaaugccagggac

SEQ ID NO: 341909 - RNA, 65 nt, hsa
cagguaucuuuggcaaggcuaccaguuggacguaagccccucaugcugacucagggugggcccug

SEQ ID NO: 341910 - RNA, 65 nt, hsa
gcacagaccccagagccaggaaccucucagccgaugccccucagcaagagcaccccaucuucagg

SEQ ID NO: 341911 - RNA, 65 nt, hsa
gccccgacgccggcggggaggcagggaugucgagggccccucacagcugugcccgcccugccccg

SEQ ID NO: 341912 - RNA, 65 nt, hsa
gggccaggcagcggggcagggacagggagccgagugccccucagagucccccaaacacaagcaca

SEQ ID NO: 341913 - RNA, 65 nt, hsa
ucccugcaugcuguguauccuaacucccuacaacagccccucaaauaaaucacaucuagugacug

SEQ ID NO: 341914 - RNA, 65 nt, hsa
ucucgucuuccuccugcagacaggcggacccacaggccccucagggucugcccagccaggcuccu

SEQ ID NO: 341915 - RNA, 65 nt, hsa
ugcuucuugccuaccacuuggccagugcccacccagccccucagguggcacaucuggagggcagg

SEQ ID NO: 341916 - RNA, 65 nt, hsa
gugaugaaccugcuuauaccuaagggcaggagcaagccccucacaaugcagcugcauggguuuuu

SEQ ID NO: 341917 - RNA, 65 nt, hsa
cccaucagugccagccccugcuggcuggugccugagccccucagacagcccccugccccgcaggc

SEQ ID NO: 341918 - RNA, 65 nt, hsa
aacaccagaauuuugaaaaucccgaauuuuugacagccccucaggccuggagaguuaucuacaga

SEQ ID NO: 341919 - RNA, 65 nt, hsa
ggugcccuucccuggaggucucucccucccccagagccccucaugccacagugguacucuguguc

SEQ ID NO: 341920 - RNA, 65 nt, hsa
aggcccucaauccaccuucaggccccgccccaugggccccucaccgcugguuggaaagaguguug

SEQ ID NO: 341921 - RNA, 65 nt, hsa
aguggguugcugccugaugacaagggguuguuucagccccucagucaugcugccuucugcugcuc

SEQ ID NO: 341922 - RNA, 65 nt, hsa
cugagcugggccccagcccagugacuggcucauuugccccucaagcacgaguuugcauguuuagu

SEQ ID NO: 341923 - RNA, 65 nt, hsa
aggugguggggcugggccauggagcuggcccagaggccccucagcccuuuguaaagucugaugaa

SEQ ID NO: 341924 - RNA, 65 nt, hsa
gagaaccuaacaauuuaaagacacugggaacacuugccccucaguauaguacugucaagggaagc

SEQ ID NO: 341925 - RNA, 65 nt, hsa
gaaagggccccugaccugccuggcuuccuuagcuugccccucagcuuugcaaagagccacccuag

SEQ ID NO: 341926 - RNA, 65 nt, hsa
uuccccaucuuuaaaaugcugccagagcgauugcggccccucaccuuguccacguaucaggaaug

SEQ ID NO: 341927 - RNA, 65 nt, hsa
acaaucucgacucacugcagcuaucucucgccucagccccucaaguagcugggacuacaggugca

SEQ ID NO: 341928 - RNA, 65 nt, hsa
agcuugaccagcgugcugacuggccuagggccccugccccucaccuucuccuucuugauuccaaa

SEQ ID NO: 341929 - RNA, 65 nt, hsa
ccgguucccacccuccuccaccuccucuccuccgggccccucaguuuccucuccucaucucuggc

SEQ ID NO: 341930 - RNA, 65 nt, hsa
cacuacuguguuucacugaccauacauuuuucuuagccccucaaguaauauagcacagaguuaug

SEQ ID NO: 341931 - RNA, 65 nt, hsa
agauggaggaggugugggcugacuaccucccagaagccccucaugccaagccugucccacugggg

SEQ ID NO: 341932 - RNA, 65 nt, hsa
gaguagaggccucguuucugccacacaucacgccugccccucaccgcccucuccucaaacuccuc

SEQ ID NO: 341933 - RNA, 65 nt, hsa
gaauuuggguucugccugccagcugcacugaugcugccccucaucucucugcccaacccuucccu

SEQ ID NO: 341934 - RNA, 51 nt, hsa; identical to SEQ ID NO: 341451

SEQ ID NO: 341935 - RNA, 65 nt, hsa
uggggaaguuccccaacacauaaucccaagacugugccccucaucugcaucuucagauccaguac

SEQ ID NO: 341936 - RNA, 65 nt, hsa
gcaugcuuucugccucugguaacaggagugagugagccccucagaccugcacucugggugucucc

SEQ ID NO: 341937 - RNA, 65 nt, hsa
caucagggccugcauuuauggagugcuugcuaugugccccucauggcaggcccacagcacucuga

SEQ ID NO: 341938 - RNA, 65 nt, hsa
caagggcagccccagcagcuggauucucaggcugggccccucaccuggcagaguccauaguggag

SEQ ID NO: 341939 - RNA, 65 nt, hsa
gucgcugugcccugguuucccuccucgggcuucucgccccucagugguuuccucggcccuccugg

SEQ ID NO: 341940 - RNA, 65 nt, hsa
caccaggaugaccccacagccagagucccuuggcagccccucaccccagaccccccuucuaagga

SEQ ID NO: 341941 - RNA, 65 nt, hsa
aaguuguuccucuguuaucaugccugaauucccccgccccucaguuaccuggggaagaguaaagg

SEQ ID NO: 341942 - RNA, 65 nt, hsa
aguuucccauugucacggaaaacauuggcugcaaagccccucaaagcccucaagugccuucugug

SEQ ID NO: 341943 - RNA, 65 nt, hsa
gugcacucggcccaguccugccgccguguccaggcgccccucacccccacaccugcugcauggcu

SEQ ID NO: 341944 - RNA, 65 nt, hsa
gucgguuuuguuuuuguuucucauucuucuuccucgccccucagccccccaacccccaacccccu

SEQ ID NO: 341945 - RNA, 65 nt, hsa
agggcugagugggagggcggcccuuuccagccucugccccucaggggaacccuguagcuuugugu

SEQ ID NO: 341946 - RNA, 65 nt, hsa
cuaucucuccaaaccccauacccuucaaugcuguggccccucagugacuuccuugggugauccug

SEQ ID NO: 341947 - RNA, 65 nt, hsa
agauggcaggcuacaguugggaagucucagccugggccccucagccacccuuggucucaugcccc

SEQ ID NO: 341948 - RNA, 65 nt, hsa
cucccugccccauucuggugucuuuccacuccucagccccucaucuugccuccacccagcugcuc

SEQ ID NO: 341949 - RNA, 65 nt, hsa
ccuccuucagccaccuggccauaccccuuaaauaagccccucaccuugcugccucaggaccuuca

SEQ ID NO: 341950 - RNA, 65 nt, hsa
ugcuggcugcaagcuguggguucuuucuccucugugccccucaugcugaucuucuagaugccacu

SEQ ID NO: 341951 - RNA, 65 nt, hsa
gcccacacggccccuucccagccagcccgccgcccgccccucaguuugguagugccccaccuccc

SEQ ID NO: 341952 - RNA, 65 nt, hsa
accgcccauccugcacacggggccgcugggcaggugccccucacacccccaggaugucagugcuc

SEQ ID NO: 341953 - RNA, 65 nt, hsa
cauacugaaaacugaccaaggccugugcacagguagccccucaugcugggcucuggaccaugagc

SEQ ID NO: 341954 - RNA, 65 nt, hsa
cacccaguaacuggggccacggggagagaggaguagccccucagacucuucuuacuaagucucag

SEQ ID NO: 341955 - RNA, 65 nt, hsa
ggcugccuccuggugguggccauugucccccaucggccccucagccuugcaccccagcacugaga

SEQ ID NO: 341956 - RNA, 65 nt, hsa
ugaaugcuccagcgauuccaaacugcagccccucugccccucaccaaaaccugcggggcugcuug

SEQ ID NO: 341957 - RNA, 65 nt, hsa
agugugugucuguuuugguuugugagaaaguagcugccccucauucuggccaguucuuuccagua

SEQ ID NO: 341958 - RNA, 65 nt, hsa
ccaguagugccgaugugccacacugcccaguugaggccccucacgcucugugccccuagauccuu

SEQ ID NO: 341959 - RNA, 65 nt, hsa
cccauggcaacucaaagugccuuccaaaccaaacugccccucaugagguuagggucccccacccu

SEQ ID NO: 341960 - RNA, 65 nt, hsa
caacuucccgagaacaaacaggccugcucacaacugccccucaaguucaaccccgggaccgccca

SEQ ID NO: 341961 - RNA, 65 nt, hsa
cauucgugacugaggccccucuuggggcacucacugccccucauccccagaaauuauuuuucuac

SEQ ID NO: 341962 - RNA, 65 nt, hsa
gcaguccacuccuagccccggcauccugcucuagggccccucaugccccaggcuggagcagcucu

SEQ ID NO: 341963 - RNA, 65 nt, hsa
cuggagccaagaagcacagagacacagaggcgccugccccucagcuccgcuggucugucugugca

SEQ ID NO: 341964 - RNA, 65 nt, hsa
ugcuccacugagcuccucugucacaccccauucuugccccucacugggcaggccauggccuacag

SEQ ID NO: 341965 - RNA, 65 nt, hsa
aaccagcuuucugguuaagguuaacaccagauggugccccucauugguguccuuuuaaaaaauau

SEQ ID NO: 341966 - RNA, 65 nt, hsa
ccgggaguccgggcauggugggcacaguucucccugccccucagccugggggaagaagagggccu

SEQ ID NO: 341967 - RNA, 65 nt, hsa
gaugacccaggcugccugagcaccucccagccccugccccucaugccaaccccgcccuaggccug

SEQ ID NO: 341968 - RNA, 65 nt, hsa
ggacgucugagcccagcuuucugcgugcccuccuggccccucacucccggcagcgggccggccuc

SEQ ID NO: 341969 - RNA, 65 nt, hsa
cggaagggcccggugggacguggguagugugugaagccccucagccugggucccgccuagccuaa

SEQ ID NO: 341970 - RNA, 65 nt, hsa
gggcccggaggucccaaggucccugggaggacugggccccucaugccucgagcuuggcaaccgaa

SEQ ID NO: 341971 - RNA, 65 nt, hsa
agaggagaaggaugccugggugccaggcaagacaagccccucagcaggagagaggcccagaggcu

SEQ ID NO: 341972 - RNA, 65 nt, hsa
uuuagguucaccugcaaaacaaaaaucuuacuccagccccucaaugccauccugacacacuuuau

SEQ ID NO: 341973 - RNA, 65 nt, hsa
acgccccuuuuguguuuugguucaaguuucucagagccccucagagcuucuacaucugugcauca

SEQ ID NO: 341974 - RNA, 65 nt, hsa
uccugggaucuccuucucccuccuguccuguccuugccccucaggacugcuggaaaauaaauccu

SEQ ID NO: 341975 - RNA, 65 nt, hsa
gagcaugccuggauggggcugcaccggcuggccuggccccucagggucccugguggcagcucacc

SEQ ID NO: 341976 - RNA, 65 nt, hsa
cuucgucauggaccgagguucccacucugggcaaagccccucacacugcaagggauuguagauaa

SEQ ID NO: 341977 - RNA, 65 nt, hsa
ccucagguucugccugagcccagccuaccaggcuugccccucagcucagcacuguugaccacgcu

SEQ ID NO: 341978 - RNA, 65 nt, hsa
gccacuggcccuggguggcucugucagggugcacagccccucaugccuggagcaaugagggucua

SEQ ID NO: 341979 - RNA, 65 nt, hsa
cacuaccccucaacagagaugacuuugaugacucugccccucagcagggcuuacuaagcacuacc

SEQ ID NO: 341980 - RNA, 65 nt, hsa
uaagcacuaccccuuaacagggaugacuccgcacugccccucaacagggaugacucagcagagau

SEQ ID NO: 341981 - RNA, 65 nt, hsa
uagcagggaugacacagcaaggaugacucagcacugccccucagcaaggaugacucagcacugcc

SEQ ID NO: 341982 - RNA, 65 nt, hsa
gcucaacagacaugacucagggauggcuuaguacugccccucagcagggaugacucagcaccgcc

SEQ ID NO: 341983 - RNA, 65 nt, hsa
caacagggaugacucagcagggaugacucagcaccgccccucaacaggcaugacucugcagagau

SEQ ID NO: 341984 - RNA, 65 nt, hsa; identical to SEQ ID NO: 341981

SEQ ID NO: 341985 - RNA, 65 nt, hsa
gcucaacagggaugacucagggauggcuuaguacugccccucaacagggaugacucagcagggau

SEQ ID NO: 341986 - RNA, 65 nt, hsa; identical to SEQ ID NO: 341983

SEQ ID NO: 341987 - RNA, 65 nt, hsa
caacaggcaugacucugcagagaugacuuaguacugccccucagcagggaugacucaguacugcc

SEQ ID NO: 341988 - RNA, 65 nt, hsa
uuaguacugccccucagcagggaugacucaguacugccccucagcagggaugacucagcacugcc

SEQ ID NO: 341989 - RNA, 65 nt, hsa
ucaguacugccccucagcagggaugacucagcacugccccucaacagggaugacucagcagggau

SEQ ID NO: 341990 - RNA, 65 nt, hsa
uagcagugaugacacagcaaggaugacucagcacugccccucagcaaggaugacucagcacugcc

SEQ ID NO: 341991 - RNA, 65 nt, hsa; identical to SEQ ID NO: 341982

SEQ ID NO: 341992 - RNA, 65 nt, hsa
uuaguacugccccucagcagggaugacucagcaccgccccucaacagggaugacucagcacugcc

SEQ ID NO: 341993 - RNA, 65 nt, hsa
ucagcaccgccccucaacagggaugacucagcacugccccucaacagggaugacucagcagggau

SEQ ID NO: 341994 - RNA, 65 nt, hsa
uagcagcgaugacacagcaaggaugacucagcacugccccucaccaaggaugacucagcacugcc

SEQ ID NO: 341995 - RNA, 65 nt, hsa
gcucaacagacaugacucagggauggcuuaguacugccccucagcagggaugacucagcagggau

SEQ ID NO: 341996 - RNA, 65 nt, hsa
caacagggaugacucagcagggaugacucagcacugccccucaacagggaugacugcagggauga

SEQ ID NO: 341997 - RNA, 65 nt, hsa
cucaacagggaugacugcagggaugacucagcacugccccucagcagggaugacucagcacugcc

SEQ ID NO: 341998 - RNA, 65 nt, hsa
ucagcacugccccucagcagggaugacucagcacugccccucagcagggaugacucagcagggau

SEQ ID NO: 341999 - RNA, 65 nt, hsa
cagcagggaugacucagcagggaugacucagcaccgccccucaacaggcaugacucugcagagau

SEQ ID NO: 342000 - RNA, 65 nt, hsa
caacaggcaugacucugcagagaugacucagcacugccccucagcagggauggcucagcagggau

SEQ ID NO: 342001 - RNA, 65 nt, hsa
cagcagggauggcucagcagggaugacucagcauugccccucaacagggaugacucagcagacuc

SEQ ID NO: 342002 - RNA, 65 nt, hsa
ugacucagcagacucagcagggaugacucagcacugccccucaacagacaugacucagcagggau

SEQ ID NO: 342003 - RNA, 65 nt, hsa
caacagacaugacucagcagggaugacucagcaccgccccucagcaaggaugacucagcagggau

SEQ ID NO: 342004 - RNA, 65 nt, hsa
uggccugggagacccaucuggucccugcguccucugccccucacugcucugugcagauccugucg

SEQ ID NO: 342005 - RNA, 65 nt, hsa
cuggccuggcugggcugggucuggggccgccacaggccccucacggggcggcagaggcaacuuca

SEQ ID NO: 342006 - RNA, 65 nt, hsa
ggggcagccaaguuccugauagcacuugugccucagccccucaccuggccaccugccagggcacc

SEQ ID NO: 342007 - RNA, 59 nt, hsa; identical to SEQ ID NO: 341524

SEQ ID NO: 342008 - RNA, 65 nt, hsa
aguuuuacugccuguagcaauggccagagccucuggccccucacccaccauggaccagcccauug

SEQ ID NO: 342009 - RNA, 65 nt, hsa
aggacacaaggugggcugcccucaagccccagagagccccucauccuuccucugggaccagaugu

SEQ ID NO: 342010 - RNA, 65 nt, hsa
gggaagggagacuggcccugcccagccggucucuagccccucagcccccgcugggcacucucugu

SEQ ID NO: 342011 - RNA, 65 nt, hsa
gggugcagacaaauucagcaauaguaugcagaucagccccucaccaccucauuguucucaucugg

SEQ ID NO: 342012 - RNA, 65 nt, hsa
agccccaacccucagacccucgccuuccaaggcaggccccucagccuggccugcucucaccaccu

SEQ ID NO: 342013 - RNA, 65 nt, hsa
ggcuccuuccuggucuggcccagcuggcuuccccagccccucagccauccagggcuacccacugc

SEQ ID NO: 342014 - RNA, 65 nt, hsa
uccagccuuaacucgaugguccgucccugccaggugccccucacucuuccugaccccaaagccag

SEQ ID NO: 342015 - RNA, 65 nt, hsa
aggugcuccaggauaacaaagaagggcagguugaagccccucauggaaggagcuggcuuuguggg

SEQ ID NO: 342016 - RNA, 65 nt, hsa
caggcacucaaugcagccagaccuauuccuccugggccccucaucugcucagcagcuauuugaau

SEQ ID NO: 342017 - RNA, 65 nt, hsa
ugacauccugcaguccccaccaguccugaccgugggccccucaggggucugggagugugacguug

SEQ ID NO: 342018 - RNA, 65 nt, hsa
ucaaccugugaugaggggaggaaacucaccugcuggccccucaccugggcaccuggggaguggga

SEQ ID NO: 342019 - RNA, 65 nt, hsa
gacggacugccgccucuggguccccccaccguggugccccucaccauccuccugggggagcaggg

SEQ ID NO: 342020 - RNA, 65 nt, hsa
cagaucuguagccagucagaggaggaggagaaggagccccucagcagaguggugcaguuucgcuc

SEQ ID NO: 342021 - RNA, 65 nt, hsa
gacugugaaaaggcuuccugugaccuccgauggcggccccucauuggccaagggcacuguggaug

SEQ ID NO: 342022 - RNA, 65 nt, hsa
agcugaagagcaagguuucguggcagcacggcccggccccucacccucuguccccacgaggggac

SEQ ID NO: 342023 - RNA, 65 nt, hsa
accccuccuugcccgccuacccucccuccagaauagccccucacccuucuuccccuucuaguuga

SEQ ID NO: 342024 - RNA, 65 nt, hsa
gacucacaucccuuuccuagucccccacauccaaagccccucagccugccuugcagaccaauggg

SEQ ID NO: 342025 - RNA, 65 nt, hsa
uaacauaggacuaaccagccacugcccucucuuaggccccucauuuaaaaacgguuauacuauaa

SEQ ID NO: 342026 - RNA, 65 nt, hsa
gggggagguugguggaccauggagucccuggugcugccccucaggugggacccaggcguucucag

SEQ ID NO: 342027 - RNA, 65 nt, hsa
gcugcaccugggaccauaggaugggaggauagggagccccucaugacugagggcagaagaaauug

SEQ ID NO: 342028 - RNA, 65 nt, hsa
aagccacugggugagcagagucacccacagggccagccccucagccaggagccaguggcaggagc

SEQ ID NO: 342029 - RNA, 52 nt, hsa; identical to SEQ ID NO: 341546

SEQ ID NO: 342030 - RNA, 65 nt, hsa
ccggcagggaguugugagcgccuucccaacaaugugccccucaccccuugaugcccaugcuaaug

SEQ ID NO: 342031 - RNA, 65 nt, hsa
ccagccugggucagaaggggugggcgagccccucggccccucacccuccaggcugcugugagagu

SEQ ID NO: 342032 - RNA, 65 nt, hsa
ugccuuuccuuggcccucacugccagugccaaaccgccccucagcagggcagggccaguccuggc

SEQ ID NO: 342033 - RNA, 65 nt, hsa
ccuaguaugcccuguaauuuuucugggaaguccuagccccucacuuccagcuugccuguuucuuc

SEQ ID NO: 342034 - RNA, 65 nt, hsa
ucguuuuugagggggucaugccgggggagccaccagccccucacuggguucggaggagagucagg

SEQ ID NO: 342035 - RNA, 65 nt, hsa
uuuggccugggggaggucagaacauucgaaucucugccccucacuugaggaggagcuggccugcg

SEQ ID NO: 342036 - RNA, 65 nt, hsa
ccacagugaggccaccuugagucaagccgacuaaggccccucaacccugucacuaagcagcacgu

SEQ ID NO: 342037 - RNA, 65 nt, hsa
accaggugcugcacugaccgcugggccacacggcugccccucagcccugcuggaacagggucugc

SEQ ID NO: 342038 - RNA, 65 nt, hsa
cugaauggugcacugguuuaauuguguuggugucggccccucacaaaugcagccaagucauguaa

SEQ ID NO: 342039 - RNA, 65 nt, hsa
caggugggauccugaaggcacuagcugacagacgggccccucaauccuguccucugaaggauugu

SEQ ID NO: 342040 - RNA, 65 nt, hsa
ccuggcucugaggucacaucagcuagguuugggaggccccucagcuugguuugggagugcccgug

SEQ ID NO: 342041 - RNA, 65 nt, hsa
accucaugacaaaggaagggacucaaagcagcaaugccccucauaguguaggcuaaggugaguuu

SEQ ID NO: 342042 - RNA, 65 nt, hsa
agcgcugagauuacaggugugagccaccgugcccagccccucaguagguuuuaaggagcccccag

SEQ ID NO: 342043 - RNA, 65 nt, hsa
ccccgggcccccgcgccucugccggacacggaccggccccucagcccccaccgaggacgcagcca

SEQ ID NO: 342044 - RNA, 65 nt, hsa
guauuugugcguuccagaaaagggcccagcucugagccccucacccuuccacacucacgaacucu

SEQ ID NO: 342045 - RNA, 65 nt, hsa
cuuucuuucaguucucccaugcagccgaggcccgggccccucaggacuccaaggagacggugcag

SEQ ID NO: 342046 - RNA, 65 nt, hsa
cuccaugaaugaaaugacucagggaaguguuuguugccccucaugccuccuuucucacuuuagaa

SEQ ID NO: 342047 - RNA, 65 nt, hsa
agcucuggcagugaugaugguacuuccuguugucagccccucaagcccagcugcaaccagucugg

SEQ ID NO: 342048 - RNA, 65 nt, hsa
ggugcccucgcuccgccccaucaguuccugccccugccccucaugcagacugcccugcuggggcc

SEQ ID NO: 342049 - RNA, 65 nt, hsa
ggcccuaggccaccucgcggaagccuucagccuccgccccucacugcagccccuugggacuugag

SEQ ID NO: 342050 - RNA, 65 nt, hsa
cggguguugggaaccaugccugccagccaguaugugccccucacccaggccuggcugggcccugg

SEQ ID NO: 342051 - RNA, 65 nt, hsa
uuccugcucugagcgcucaccccugcugaggcucagccccucaacccgguggcauucugggggag

SEQ ID NO: 342052 - RNA, 65 nt, hsa
gcaccgcuguugagcagccuggugguacuggccacgccccucaaggcaaggcuccuccccuuagg

SEQ ID NO: 342053 - RNA, 65 nt, hsa
cgcucagcccagcugacugugccuguucugagugagccccucacucagccggggcccucccaccu

SEQ ID NO: 342054 - RNA, 65 nt, hsa
uuuggggggucuugguuuaugcucccugcccuugagccccucagccguuugcccugcccccaccu

SEQ ID NO: 342055 - RNA, 65 nt, hsa
auacagcggugggaucucugcugccagcucucccagccccucagcuucgcagccuggcgcagcau

SEQ ID NO: 342056 - RNA, 65 nt, hsa
aguguccccaccccagggccacuuagcugacaccagccccucagaggaccagugcgccccauccc

SEQ ID NO: 342057 - RNA, 65 nt, hsa
ccuccuugucucauccccgaagauccgucccccuggccccucaguguccaugucuugagcuuaau

SEQ ID NO: 342058 - RNA, 65 nt, hsa
aauccccuccuguucacucucccaacccugcuccagccccucagcuucccagacccucaugcagu

SEQ ID NO: 342059 - RNA, 65 nt, hsa
ccccagccuaggacgccaacuucucccaccccuuggccccucacauccucuccaggaagggagug

SEQ ID NO: 342060 - RNA, 65 nt, hsa
ugcucuuucuccuucuucccugagucucucuccaugccccucaucucuuccuuuugcccucgccu

SEQ ID NO: 342061 - RNA, 65 nt, hsa
accuucuggaccugcccccacuguggccugcaugcgccccucacgccccuggagcgcaucgccca

SEQ ID NO: 342062 - RNA, 65 nt, hsa
ucccagagcugaccccacuccaggaccuaggcccagccccucagccucaucuggagccccugaag

SEQ ID NO: 342063 - RNA, 65 nt, hsa
uacacauguuuucggcaacguguucccguguccuggccccucacgggcccccacacucuccugac

SEQ ID NO: 342064 - RNA, 65 nt, hsa
ccugcccccucucugagagcccuggccagcucuucgccccucaccucuuugaaacucuggacgua

SEQ ID NO: 342065 - RNA, 65 nt, hsa
cuugcaaacuucucccggguccagcgccuggggcugccccucaagauggucauguacucagcugu

SEQ ID NO: 342066 - RNA, 65 nt, hsa
gguuccuuggaccguaucacugguccaccuccugagccccucaauccuaucacagucuacugacu

SEQ ID NO: 342067 - RNA, 65 nt, hsa
ccaaggccaccugacuccuaucacgacgcacccaagccccucaguccagcuucccaaugccuggc

SEQ ID NO: 342068 - RNA, 65 nt, hsa
auucuucuuccgacugguacugaacauauauacuugccccucaggugagguuccaaguugcaacu

SEQ ID NO: 342069 - RNA, 65 nt, hsa
gacaucucaaaagaaguccaaagcgggaaucaugugccccucagcggagccccgggaguguccaa

SEQ ID NO: 342070 - RNA, 65 nt, hsa
cccugaguugggggagcgacccuucccccagccccgccccucaggacacccagaaccccaccccu

SEQ ID NO: 342071 - RNA, 65 nt, hsa
ccacuuuucccuuccucuuuccccacagccccccagccccucagcccucccagcccacuucugcc

SEQ ID NO: 342072 - RNA, 65 nt, hsa
uggaggcaguggcuggugggccacucucuccaggugccccucagccaugggcccuacaguccccu

SEQ ID NO: 342073 - RNA, 63 nt, hsa
cccacccuauggaccagucaaauaaaagccuucaggccccucaaccagaguccccucuuacug

SEQ ID NO: 342074 - RNA, 65 nt, hsa
uggaggcugagguggcugcaggagcucguuucacagccccucagguggagcugguugggccgcgg

SEQ ID NO: 342075 - RNA, 65 nt, hsa
acaaccucuccccuaacccugcucccuggggcugcgccccucaacacccucucaacaccccccuc

SEQ ID NO: 342076 - RNA, 65 nt, hsa
ugagcagagcgggacucuguccaacaagccccacagccccucaaagacuuuuuuuuguuuguuuu

SEQ ID NO: 342077 - RNA, 65 nt, hsa
acugugcccugccuucagcuuuggugaaagggagggccccucaugugugcugugcugugucugca

SEQ ID NO: 342078 - RNA, 65 nt, hsa
cagccaaacagauggggaggcccaaagcaaggcuugccccucagaggagcucacgcagggcagga

SEQ ID NO: 342079 - RNA, 65 nt, hsa
gcaguuuggcagcuugacuucugcagcuggaggaggccccucaggccggggaucuggggagggcu

SEQ ID NO: 342080 - RNA, 65 nt, hsa
ugaacagccgacuuugagcauuguuucuucuaacugccccucaacuaccauuaucuucaagucaa

SEQ ID NO: 342081 - RNA, 65 nt, hsa
uggacagcaggccuggcacugggaggugggggugagccccucacagccuugccccuccccaaggc

SEQ ID NO: 342082 - RNA, 65 nt, hsa
uuggccacuggggccaccacccugaccaccacugugccccucauuguuacugccuugugagauaa

SEQ ID NO: 342083 - RNA, 65 nt, hsa
aucuuuuuuuuaggccccugccugucugcccaucugccccucacccacccgaggcucugcccacc

SEQ ID NO: 342084 - RNA, 65 nt, hsa
caccuuuacuaaaacacuuucucugaaccccccuugccccucacugaucuugcuuuucccugguc

SEQ ID NO: 342085 - RNA, 65 nt, hsa
cccauguauauagguccugaugccuucccaaccccgccccucacccuguugccaccuuguuucau

SEQ ID NO: 342086 - RNA, 65 nt, hsa
gauccucucggugggaugggcaccacagacaggaggccccucaggcccgugcgggccacugucug

SEQ ID NO: 342087 - RNA, 65 nt, hsa
gcaguuaccgagccgaagggagaugaugggccuucgccccucagugggauggcagcugagggggc

SEQ ID NO: 342088 - RNA, 65 nt, hsa
cucaggagugggcucagagucuagcaaaugcuaaggccccucaggcugggcucugaacgaggacc

SEQ ID NO: 342089 - RNA, 65 nt, hsa
cuggguugguguggauagcaaaggaggaagucugagccccucauuggucuuccucccaccugucc

SEQ ID NO: 342090 - RNA, 65 nt, hsa
gguaaagguccaugaacccugccccacuccugucagccccucaucagccuuuucagcagguucca

SEQ ID NO: 342091 - RNA, 65 nt, hsa
ugugucuguucucuggggauugcugggucacaggugccccucaccuuccacagucaggcagggaa

SEQ ID NO: 342092 - RNA, 65 nt, hsa
ccaacugugaagguccccgugggguggagcauggugccccucacaagccgcagcggcuggugccc

SEQ ID NO: 342093 - RNA, 65 nt, hsa
cugccauggaggcgccuuccuggguuggccagagggccccucacuggcuggacuggaggcugggu

SEQ ID NO: 342094 - RNA, 65 nt, hsa
gcaggugcccaacaccccccaccggaggacacgcugccccucagcgaugccccuaccuuuugggg

SEQ ID NO: 342095 - RNA, 65 nt, hsa
ccuucaccuuugucgcugggucagugcuggaaagcgccccucacuccugcgcugacaagggcccu

SEQ ID NO: 342096 - RNA, 65 nt, hsa
acggaguguggggauaggagccgggccaagcgcuggccccucagcggugagcccugcccacucuu

SEQ ID NO: 342097 - RNA, 65 nt, hsa
ucagucucugucuccugggcccugcucugggaccugccccucacguucucuuggggacacccgag

SEQ ID NO: 342098 - RNA, 65 nt, hsa
aaacucauccuguucaagaaacaaccuuucauguagccccucaacagaaugcauugcaucaucac

SEQ ID NO: 342099 - RNA, 65 nt, hsa
ugguuuuuaaucaguuaucuugggaacuuaaccuggccccucaccucuucugcaccccccgcccc

SEQ ID NO: 342100 - RNA, 65 nt, hsa
guucucuuaauuuucaggaagaaagggaaauugcagccccucagcccccaggauugaccucuggg

SEQ ID NO: 342101 - RNA, 65 nt, hsa
gggcccugcacaugaugggguuugguggacccagugccccucacggcugccgcaagucugcugca

SEQ ID NO: 342102 - RNA, 65 nt, hsa
ccggugagcuuccugcagccuguggauguccugcagccccucagcccuacccccaaguuucuccu

SEQ ID NO: 342103 - RNA, 65 nt, hsa
caccggugcuccucucuaggcagcgggugggcacagccccucaccacggacacggacagaggacc

SEQ ID NO: 342104 - RNA, 65 nt, hsa
ugugggguguggauggggcugcagcaccaggcagagccccucagggcgccgaugucgagggcacc

SEQ ID NO: 342105 - RNA, 65 nt, hsa
uaauuagggauauuaucaaaauauguaaccaugaggccccucagguccugaucagucagaaugga

SEQ ID NO: 342106 - RNA, 65 nt, hsa
caccugacucugucacucaagccuuucuccaccaggccccucaucugaauaccaagcacagaaau

SEQ ID NO: 342107 - RNA, 65 nt, hsa
cuggcccccggccacugucucggggcccaccucucgccccucaucuugguaauuagccagccuca

SEQ ID NO: 342108 - RNA, 65 nt, hsa
auuccuuugcagaacuucagggacugggagcagaggccccucacucaacgacguuugugcgacau

SEQ ID NO: 342109 - RNA, 65 nt, hsa
ucugcucaucacgggaggauaccugugugccggcagccccucagggacucucagcccuggcacug

SEQ ID NO: 342110 - RNA, 65 nt, hsa
ccauggggggcuggaccaccauggccacugacccagccccucagaaucccacacuccaauccuuu

SEQ ID NO: 342111 - RNA, 65 nt, hsa
gcacggucccagggccccaccuaggugcagagccggccccucaccuaacagcugguuccuaccag

SEQ ID NO: 342112 - RNA, 65 nt, hsa
ucucccccuucccuggggcuucuagagcucucucugccccucagguccuggcccuuggguccuug

SEQ ID NO: 342113 - RNA, 65 nt, hsa
caggguccagggaggggcgccugcugagcacuuccgccccucacccugcccagccccugccauga

SEQ ID NO: 342114 - RNA, 65 nt, hsa
uaccuugaaaugagaccacgucagagacauguacugccccucacauuuucucaccuaaaccagca

SEQ ID NO: 342115 - RNA, 65 nt, hsa
ugcccuuccuugaguggucuagaaggcacugcguggccccucagaugcugggacacaacagaccc

SEQ ID NO: 342116 - RNA, 65 nt, hsa
cgcagcagagcucaggacauucccccacagagcuugccccucaguuccuaccuccaagggggagg

SEQ ID NO: 342117 - RNA, 65 nt, hsa
cccaccccuucccuucccuggcgccccgggcccaggccccucagcugucagcugguuuugauggc

SEQ ID NO: 342118 - RNA, 65 nt, hsa
agggaugcugcugggaguccauggcacaggccacagccccucaccuugccgcgguggcuggcagc

SEQ ID NO: 342119 - RNA, 65 nt, hsa
uaaugugguagugaaaaucgaggaagcaccucucagccccucagagaaugaucacccugaauuca

SEQ ID NO: 342120 - RNA, 59 nt, hsa; identical to SEQ ID NO: 341637

SEQ ID NO: 342121 - RNA, 65 nt, hsa
gaaggcaggagagagagcagcuccccugcccaccugccccucaacccuguagcugcagggggagg

SEQ ID NO: 342122 - RNA, 65 nt, hsa
aggugcagacaagagguggcgagagcccccaucaugccccucaaccuaucccguuccuucugccu

SEQ ID NO: 342123 - RNA, 65 nt, hsa
ccucagacacugaugucuguccccaggugcucucugccccucaugccccucucaccggcccagug

SEQ ID NO: 342124 - RNA, 65 nt, hsa
caggaacgugcaaauuugcaggugcugcaucccaagccccucaugcuccugccuuccugagggcc

SEQ ID NO: 342125 - RNA, 65 nt, hsa
gaugcccguuggacuuugccccucacacuggcccagccccucacacugccccaccccgagaaccc

SEQ ID NO: 342126 - RNA, 65 nt, hsa
cccaggccgcaggagugggaugcccguuggacuuugccccucacacuggcccagccccucacacu

SEQ ID NO: 342127 - RNA, 65 nt, hsa
gcaggcccuuccucccuuggcccaaccagcaaagcgccccucagucuucaagggcuuuccuggau

SEQ ID NO: 342128 - RNA, 65 nt, hsa
gacacagccaggaacccggccagguccccccacaugccccucagggcccaggccugagugagugc

SEQ ID NO: 342129 - RNA, 65 nt, hsa
ucucuuuagucuuugucccuuccuuuucacuaagugccccucauccuuuucaaucucauugucac

SEQ ID NO: 342130 - RNA, 65 nt, hsa
ccccuuuccuuccucuccucccaccuccucccucagccccucauucuccuugggaaucugcagag

SEQ ID NO: 342131 - RNA, 65 nt, hsa
aaccgccagagucccagacaccgguuuuccuagaagccccucacccccacuggcccacugguggc

SEQ ID NO: 342132 - RNA, 65 nt, hsa
gccugccaagcgagaaugcaggccccgcccccucggccccucaccaccucuuucuacagccuaau

SEQ ID NO: 342133 - RNA, 65 nt, hsa
guaugaggagagcuucaggccccaggacugugggggccccucaggucagcucacugagcugggug

SEQ ID NO: 342134 - RNA, 65 nt, hsa
aauauuggcaaggggaguggaaaugacaccaagaagccccucaugcucaugguuggacagagagc

SEQ ID NO: 342135 - RNA, 65 nt, hsa
ccauuugccucccuccagcucugcuuaggcauuuugccccucaccccaauguuccacaccaucga

SEQ ID NO: 342136 - RNA, 65 nt, hsa
uccauucuccagucagaguagaugaugaggcccaugccccucacccccacgccccgccccuacaa

SEQ ID NO: 342137 - RNA, 65 nt, hsa
gguggcaccugccacucugccccuugcccuccccugccccucacaacagucaccucacaaaccug

SEQ ID NO: 342138 - RNA, 65 nt, hsa
ugaugacugcagcagaccuccuuggguguaccaaugccccucaucucccacuuucacaccuaacc

SEQ ID NO: 342139 - RNA, 65 nt, hsa
aaaauaaaguauaaaacauuuccaaucacuuaguagccccucaaaguaguuagaaaauaaacaga

SEQ ID NO: 342140 - RNA, 65 nt, hsa
ugcucaccguggcaaacacaggaaccccaugacucgccccucaccuggcguggagcugccugguu

SEQ ID NO: 342141 - RNA, 65 nt, hsa
cgugcacacagggaugcccgcuccacauccugccugccccucagcccuggcccaggccccuuuug

SEQ ID NO: 342142 - RNA, 65 nt, hsa
ccccaucuugaguccuggaacggcccugggugccugccccucacugugcaacucugggagcagcc

SEQ ID NO: 342143 - RNA, 65 nt, hsa
ucccucuaaauaccuacccuagaugauuucauccugccccucacuucuuaacauauuccuguguc

SEQ ID NO: 342144 - RNA, 64 nt, hsa
uuuuauuaaaucuuccuuagacauuagugagaaagaaaaagaucgcuauuucagucucucagau

SEQ ID NO: 342145 - RNA, 64 nt, hsa
acaggagaaaggcccuauccaugucaagcuuguggaaaaagauuuagcaggcuagaccaucuaa

SEQ ID NO: 342146 - RNA, 64 nt, hsa
gugacagagcaagugagacccugucucaaaaaaagaaaaagaaaaagaaaaaauauuuucccua

SEQ ID NO: 342147 - RNA, 64 nt, hsa
gagcaagugagacccugucucaaaaaaagaaaaagaaaaagaaaaaauauuuucccuauuagag

SEQ ID NO: 342148 - RNA, 64 nt, hsa
cauaaggaaugaaguuggaaccacaggcagaucugaaaaagaaccaaauagagcuccuaaaaau

SEQ ID NO: 342149 - RNA, 64 nt, hsa
accaaauacaagauuuuaaaagcaaccauggggagaaaaagaucagugaaagcaagacagucaa

SEQ ID NO: 342150 - RNA, 64 nt, hsa
gagagcaaaccaaucagucccucaggaaagggaagaaaaagaagagguggcaccaugaagagga

SEQ ID NO: 342151 - RNA, 64 nt, hsa
aacugcagucagagagcaagccccccaaaaaaaagaaaaagaaaaggaggcagaaagaggagga

SEQ ID NO: 342152 - RNA, 64 nt, hsa
ugaauuugucacauguaucacccccaaaaaaagagaaaaagaaaaauagaagacauauaaauua

SEQ ID NO: 342153 - RNA, 64 nt, hsa
gcacaaauuuuggugaauugggauuugcagagaugaaaaagacugggugaccuggaucucugcu

SEQ ID NO: 342154 - RNA, 64 nt, hsa
guuauucuagaaguucaggacagccuuagcaucugaaaaagaagcccauuccucuuuauagugg

SEQ ID NO: 342155 - RNA, 64 nt, hsa
ugggcacugggccgggcuccagggauaagguggggaaaaagacuaaccuguccuacccucaaag

SEQ ID NO: 342156 - RNA, 64 nt, hsa
ugugauauuugacuuuugcuuuaaacugcaagaggaaaaagacuccacugaaauucuaaguuug

SEQ ID NO: 342157 - RNA, 55 nt, hsa
aaccugaaucaucuuugugagucuugaaaaagaugugauauuugacuuuugcuuu

SEQ ID NO: 342158 - RNA, 64 nt, hsa
cuguaauagaaaaccugaaacgaugauugaaugggaaaaagagacuacaaaauuugucguagga

SEQ ID NO: 342159 - RNA, 64 nt, hsa
augcugcugauaaagacguacccgagacugggaagaaaaagagguuuacuuggacuuacaguuc

SEQ ID NO: 342160 - RNA, 64 nt, hsa
caguuccguucugagagaaaaagagagagagagagaaaaagaccaugcugcauacauucuguaa

SEQ ID NO: 342161 - RNA, 64 nt, hsa
caaacauguugcuguuuccaguuccguucugagagaaaaagagagagagagagaaaaagaccau

SEQ ID NO: 342162 - RNA, 64 nt, hsa
uagcaagaaaggagagugacuugauuugcuuuuggaaaaagaaaugcuuaauuaauuauucugu

SEQ ID NO: 342163 - RNA, 64 nt, hsa
cugaauucugaguuuugaaaauauauuuugaggagaaaaagacauagucuaauuugaugccuuc

SEQ ID NO: 342164 - RNA, 64 nt, hsa
gaauggcccuagaguucuuuucccugagaaaggagaaaaagaugggauugccacucacccaccc

SEQ ID NO: 342165 - RNA, 64 nt, hsa
cuuccaagucaguccuuuggaaaccagcaggucugaaaaagaggcugcaucaaugcaagccugg

SEQ ID NO: 342166 - RNA, 64 nt, hsa
agaagaaaaagaaauuccgaacccccuccuuccugaaaaagagcaaaaagaaggagaaagugga

SEQ ID NO: 342167 - RNA, 64 nt, hsa
cagagggcucaccuuccaagucucccucaaagaagaaaaagaaauuccgaacccccuccuuccu

SEQ ID NO: 342168 - RNA, 64 nt, hsa
aaaaucgcaguuaaagcaugaaacacuugaauuggaaaaagaacucuguaguuugagguaugac

SEQ ID NO: 342169 - RNA, 64 nt, hsa
aaauaaggcuaguguacuacaaaagagacuaucugaaaaagaagaaauaaaaucgcaguuaaag

SEQ ID NO: 342170 - RNA, 64 nt, hsa
cccggucuguacuaaaaaaaaaaaaaaagaaaaagaaaaagaaaaaagaauacccagguguggu

SEQ ID NO: 342171 - RNA, 64 nt, hsa
gugaaacccggucuguacuaaaaaaaaaaaaaaagaaaaagaaaaagaaaaaagaauacccagg

SEQ ID NO: 342172 - RNA, 64 nt, hsa
uaugacaacuuuauauuuuuugauagcaucucuugaaaaagaauuuuaaugauucuaauaagag

SEQ ID NO: 342173 - RNA, 64 nt, hsa
acauguauguaaaacacauaggaagcugacuuaggaaaaagagaaaaccaaauuaaaguucuga

SEQ ID NO: 342174 - RNA, 64 nt, hsa
cugguuuguguugcuaagcaaacguauacaaacagaaaaagagcuuccuaaauugcacauuuuu

SEQ ID NO: 342175 - RNA, 64 nt, hsa
auauuugauuucuugagcauguauuggucagaaagaaaaagaaagaaaaccauucucuauuuuu

SEQ ID NO: 342176 - RNA, 64 nt, hsa
guuuccugaaauaauuagagaaaagucguuuaaugaaaaagagacuguguaccuugaauucuac

SEQ ID NO: 342177 - RNA, 64 nt, hsa
cuccagcagccucgucuuacagcgugacugcaaagaaaaagacuuuuguuuugcaaaagaaaag

SEQ ID NO: 342178 - RNA, 64 nt, hsa
uuggcacagaucuuugagaaucucauacaucugugaaaaagauaaugugaaauaaacaguaaaa

SEQ ID NO: 342179 - RNA, 64 nt, hsa
caacuauucagaggacugugugaaguaguuacuggaaaaagaacuugaauuaugcauuuauugg

SEQ ID NO: 342180 - RNA, 64 nt, hsa
auugcagaagugaggucauccuugaaaaguggcagaaaaagaaaauagcagagauggguccagu

SEQ ID NO: 342181 - RNA, 64 nt, hsa
gaacuucuccaugucaagcagcaggugucagcaggaaaaagaucacaagccugccacgauggcu

SEQ ID NO: 342182 - RNA, 64 nt, hsa
uggggcuuugcugcauucccuaagauaauuacaggaaaaagaaaauguaaaagugcuaacaagg

SEQ ID NO: 342183 - RNA, 64 nt, hsa
cuguucauuuaaucugccuguuuugaucuguuuugaaaaagauaaagagccucaaaucagacca

SEQ ID NO: 342184 - RNA, 64 nt, hsa
aagcaaacugcccuuuguccucaaagaaauuguugaaaaagaaaacuuuuuaaagagauuuuuu

SEQ ID NO: 342185 - RNA, 64 nt, hsa
uuggacauacauuccaagcuuuucaacucuaggagaaaaagaaaaucauguuuuccuguauugu

SEQ ID NO: 342186 - RNA, 64 nt, hsa
ccuguucagccggcacugagaagaacgaacacaagaaaaagauaagaaauacuagaguaaaggc

SEQ ID NO: 342187 - RNA, 64 nt, hsa
uuuuaguugcaugaaauuuugccugcaacagagagaaaaagauuguauuacuuuaaugauuaua

SEQ ID NO: 342188 - RNA, 64 nt, hsa
aaugcaagggacccagaauauccaaauaagccuugaaaaagaacaaaguugguggauucacacu

SEQ ID NO: 342189 - RNA, 64 nt, hsa
uuaagaagcuaauguuuaagaagcauuugggaaagaaaaagaaauaaauguauccagauaggaa

SEQ ID NO: 342190 - RNA, 64 nt, hsa
cagucgagcugaagacaauuuuaacuuggaaaaggaaaaagaagaugucccuguggaaaugucc

SEQ ID NO: 342191 - RNA, 64 nt, hsa
ugaaacauuccaccuggcuacacgaaaauuucuagaaaaagaaguuuuuaagagugacuauuac

SEQ ID NO: 342192 - RNA, 64 nt, hsa
gaauaugaacuuugguucuucaugagugcauuuugaaaaagaaaaaaaguacacauucagaauc

SEQ ID NO: 342193 - RNA, 64 nt, hsa
gaccaagaagcucaaagaaaagaaguacguuaaagaaaaagaaaaaaccucacuuuuccuuuau

SEQ ID NO: 342194 - RNA, 64 nt, hsa
gcuccuagugaaagaaaaaucucuguacaaaggagaaaaagaaccccacuuauucuuaguuaau

SEQ ID NO: 342195 - RNA, 64 nt, hsa
accguggcuauaaccauaacgagaccgcccuagagaaaaagauucugaaggaacucacuuccaa

SEQ ID NO: 342196 - RNA, 64 nt, hsa
uuugcuguauuaacugaugauaaaacuaauggcagaaaaagaaguugagcaauuucuauguaau

SEQ ID NO: 342197 - RNA, 64 nt, hsa
cuaccuggcuacaauuacuuugaacauuaauguugaaaaagaaaacaaccaaagaaaauuggua

SEQ ID NO: 342198 - RNA, 64 nt, hsa
gacaguguuuuaggugccuggauauuuuuugauggaaaaagaauauauugccaaauauuaagaa

SEQ ID NO: 342199 - RNA, 64 nt, hsa
cauguuggcaaucaaagcaugcacuuguaacaaugaaaaagaaaaagcauuuuauauuacuacu

SEQ ID NO: 342200 - RNA, 64 nt, hsa
cugaauuaggcagucuuaaaaaaaaaaaaaaacagaaaaagaaaaaaaagaacguugcaaauuu

SEQ ID NO: 342201 - RNA, 64 nt, hsa
cugaguggacuggccucaaagcaagcauucagaagaaaaagaagcaaccucaguaauuuagaaa

SEQ ID NO: 342202 - RNA, 64 nt, hsa
ugagagcauugggauaucuccugaaaagguuuaugaaaaagaagaaucucaucucagugaagaa

SEQ ID NO: 342203 - RNA, 64 nt, hsa
uaauuuaaagccacaaccacauacaacacaaagagaaaaagaaaugcaaaaaucucugcgugca

SEQ ID NO: 342204 - RNA, 64 nt, hsa
uucaaagcugcuuuauucaauaaaaaaaagaaaugaaaaagauauaugaauaugacaaaguauu

SEQ ID NO: 342205 - RNA, 64 nt, hsa
guuuacagauaacucucuucacuauuccuaggaggaaaaagaaaugcauucgguacuuacccgg

SEQ ID NO: 342206 - RNA, 64 nt, hsa
acauauucuaguguaacacugcaagaagucuugagaaaaagauuauuguaguguucaaaauauu

SEQ ID NO: 342207 - RNA, 64 nt, hsa
gagacucugucucagaaaaaaaaaaaaagaaaaggaaaaagaaaaauauauauucuauauuuuu

SEQ ID NO: 342208 - RNA, 64 nt, hsa
aaauugcaaagcacagauaaauggaaauaaacaggaaaaagaaucaccuauaaccucaccaucc

SEQ ID NO: 342209 - RNA, 64 nt, hsa
cuucuaccucccuccuuugaaugaggguaugguagaaaaagaucuggcccaauggcauaaguuu

SEQ ID NO: 342210 - RNA, 64 nt, hsa
aagguuugaauggaguugaaaguuuuacauaagugaaaaagaaaguuuaucuugggaguugagu

SEQ ID NO: 342211 - RNA, 64 nt, hsa
uuuaauuuuaagacugaaacccuuaauauugugugaaaaagaguaauaaaaccuuugaaaguag

SEQ ID NO: 342212 - RNA, 64 nt, hsa
cuugaugaaagaaaaagacagaaggaaggaagaagaaaaagacugcaagcuuuccugccaauuu

SEQ ID NO: 342213 - RNA, 64 nt, hsa
uuaaaaagcccucuuaaugaugcucuugaugaaagaaaaagacagaaggaaggaaggaaggaag

SEQ ID NO: 342214 - RNA, 64 nt, hsa
gacuggguucgaucagcccuccuaaagcuggcuggaaaaagaagccccagcccagccugccuca

SEQ ID NO: 342215 - RNA, 64 nt, hsa
cauuuuuaguuacuuaccuugaacauauucgugugaaaaagaauacaucauuucucacagucuu

SEQ ID NO: 342216 - RNA, 64 nt, hsa
gaagggagggaaacagggagaaagggaaaaagaagaaaaagagaaagaugaaaauaggaacaaa

SEQ ID NO: 342217 - RNA, 64 nt, hsa
ggaaggaaagaagggagggaaacagggagaaagggaaaaagaagaaaaagagaaagaugaaaau

SEQ ID NO: 342218 - RNA, 64 nt, hsa
cuuuuaauauuuuaugauugccaucaaagaagaagaaaaagaaggaacagacaaagguuugaaa

SEQ ID NO: 342219 - RNA, 64 nt, hsa
ccugggaucccucugucaaccccacgccuuuuaggaaaaagaaaagugagugaacagcaaggaa

SEQ ID NO: 342220 - RNA, 64 nt, hsa
uugcuguggccuagacuucugaguaauuaauaaagaaaaagaaguacccuuuggccuacagauc

SEQ ID NO: 342221 - RNA, 64 nt, hsa
uucaagugauaggauaaaguuggccauguauuaugaaaaagauuauuugugcauuuuauugacu

SEQ ID NO: 342222 - RNA, 64 nt, hsa
caauuuaguuaccucccaacuaaaaaguaaaaaugaaaaagacgacauggcagaaguugaaaca

SEQ ID NO: 342223 - RNA, 64 nt, hsa
guuuauguuuguguucuuaaauuuaaaacacgaagaaaaagaaaugucuuucuuguuagugaac

SEQ ID NO: 342224 - RNA, 64 nt, hsa
agaauaaauuaauauuguauugcugcugugcguggaaaaagacgauguuuauguucuuauagaa

SEQ ID NO: 342225 - RNA, 64 nt, hsa
uuacaugcauaaaagggucaaaccuguagaugcagaaaaagaaaaaaacuauaaauacaaaucu

SEQ ID NO: 342226 - RNA, 64 nt, hsa
aaguuucaauacaagccauaggcucacagaaaaagaaaaagaaaauaaaaauuaaauuaaaaaa

SEQ ID NO: 342227 - RNA, 64 nt, hsa
aaccuaaaguuucaauacaagccauaggcucacagaaaaagaaaaagaaaauaaaaauuaaauu

SEQ ID NO: 342228 - RNA, 64 nt, hsa
cuuaaggaucugcucuaugaaggagaagaaagaggaaaaagaaguaaaggaguuaggaggagac

SEQ ID NO: 342229 - RNA, 64 nt, hsa
ccguuggucggaaacuuuuccaucugucgcccuagaaaaagagaaagcuuaccaucgagggugu

SEQ ID NO: 342230 - RNA, 64 nt, hsa
uagaaaaggaaacuaguagggccaaaaaaaaaaagaaaaagaaaaagaaaaaagaaaaaaaaag

SEQ ID NO: 342231 - RNA, 64 nt, hsa
aggaaacuaguagggccaaaaaaaaaaagaaaaagaaaaagaaaaaagaaaaaaaaagaaaaaa

SEQ ID NO: 342232 - RNA, 64 nt, hsa
uugaacccauccacucugggcagguaagagaaaagaaaaagauaaggaaagaagagagaagaga

SEQ ID NO: 342233 - RNA, 64 nt, hsa
acuacagaccaaaacagaagaagaagaaaaaaaagaaaaagaaaucuaagcaacaugguaagua

SEQ ID NO: 342234 - RNA, 64 nt, hsa
gcagaacgaaguuaccagcaggauggaccuaauagaaaaagaagucgaugguaauuuaagaaag

SEQ ID NO: 342235 - RNA, 64 nt, hsa
aacuccauuacucugauuuuugauacaguuuucagaaaaagaaaugaacauaaucaaguaagga

SEQ ID NO: 342236 - RNA, 64 nt, hsa
augguuaauuucauguaaaacagaaaaaaagagugaaaaagagaauauacaugaagaauagaaa

SEQ ID NO: 342237 - RNA, 64 nt, hsa
ucuuuuaguaaggcauuugggguuggggaagcuagaaaaagaaaugggagcuggucacacaggg

SEQ ID NO: 342238 - RNA, 64 nt, hsa
agaacauuuggcaggaauuguccuuaugaaacaagaaaaagaaaaugaaaaguauuauuaagcu

SEQ ID NO: 342239 - RNA, 64 nt, hsa
ugcaagagggaaggugauugguagugaguuaaaagaaaaagagaggaaaagagaguaguuuugu

SEQ ID NO: 342240 - RNA, 64 nt, hsa
uuagauaaauuuucguggauuuagucauaagauggaaaaagacuggugaaucuuuuauuacaaa

SEQ ID NO: 342241 - RNA, 64 nt, hsa
cauuuguauuugcauuacuauaauacuuugaguugaaaaagaguuucauuguggagagaaaaag

SEQ ID NO: 342242 - RNA, 64 nt, hsa
guuuuaauugagguauaaauuaaugagacaaagugaaaaagaaauuauauucagauaggacugc

SEQ ID NO: 342243 - RNA, 64 nt, hsa
ucaagcagcuaacagaaauaagaagaaaacaggugaaaaagacagugugauaaggccauggugg

SEQ ID NO: 342244 - RNA, 64 nt, hsa
ccugcaucgaacugccaacauaguacaccuuuuagaaaaagauucuuguugcaaaaguaccaua

SEQ ID NO: 342245 - RNA, 64 nt, hsa
uucagaaauuggguuuugguucagugauucucaagaaaaagaucucuugcccauuaagaagugu

SEQ ID NO: 342246 - RNA, 64 nt, hsa
acgcugcugauaaagacauaccugagaccaggaagaaaaagagguuuaauuggacuuacaguuc

SEQ ID NO: 342247 - RNA, 64 nt, hsa
cacugcugauaaagacauuccucaagauugugaagaaaaagagguuuaauuggacuuacaguuc

SEQ ID NO: 342248 - RNA, 62 nt, hsa
ugaaguagacagugugguggaaucaguuuaaucagaaaaagacauaccaaguagcuggugcu

SEQ ID NO: 342249 - RNA, 64 nt, hsa
gcagauaacagcaggaaggacuuaagguguauaagaaaaagaaaguauucauacagaaauuacc

SEQ ID NO: 342250 - RNA, 64 nt, hsa
cugagaaaaagaaugagaaccaccuuauucuucugaaaaagacuuucuucucauccaguaauuu

SEQ ID NO: 342251 - RNA, 64 nt, hsa
aguuuaccuuuugacuggaaccagauggcacugagaaaaagaaugagaaccaccuuauucuucu

SEQ ID NO: 342252 - RNA, 64 nt, hsa
ugugugugcauaaauucauucuguaggaucuuaagaaaaagagucccagaauguugcuucuauu

SEQ ID NO: 342253 - RNA, 64 nt, hsa
acaauucuuuccuggggaaauuauuucuggaggggaaaaagauccauucuacguauccuugugg

SEQ ID NO: 342254 - RNA, 64 nt, hsa
cuuuuuuuuccucucaaaaaaaaaaaaagaaaaagaaaaagaggaagaagcagcuuugcugagu

SEQ ID NO: 342255 - RNA, 64 nt, hsa
agugggcuuuuuuuuccucucaaaaaaaaaaaaagaaaaagaaaaagaggaagaagcagcuuug

SEQ ID NO: 342256 - RNA, 64 nt, hsa
accuugguuugguaguucuuguuuuuaauaaggggaaaaagauaaaauaaccccuauuuuuccu

SEQ ID NO: 342257 - RNA, 64 nt, hsa
ccaucuggaggaaaaccagaucggacuaaaaaaggaaaaagaaaaacaaaaucuccgcaguguc

SEQ ID NO: 342258 - RNA, 64 nt, hsa
uagucaauaugaggauggugguuuauucucagaagaaaaagauauguaaggucuuuuagcuccu

SEQ ID NO: 342259 - RNA, 64 nt, hsa
aguguugucaaguaacaguuacugaaagagcugagaaaaagaacaaugaacagcaacgaucuug

SEQ ID NO: 342260 - RNA, 64 nt, hsa
uggguguaggauaugaaauuguacuuagauuuaagaaaaagagaaaaucagauguauuuauuug

SEQ ID NO: 342261 - RNA, 64 nt, hsa
gcccugagucaaaaggauagccaaggguggaguggaaaaagauauggugaaggcagaacugcuc

SEQ ID NO: 342262 - RNA, 64 nt, hsa
aggcaaagagggagcacacagcauuauucugauggaaaaagauuauccagggaaugguacaaca

SEQ ID NO: 342263 - RNA, 64 nt, hsa
aagaaacagaagaacucaugcugccagauagauagaaaaagaagcauggauccuugaggagcug

SEQ ID NO: 342264 - RNA, 64 nt, hsa
auccugaacggaaaaggaagaagaaagagaagaagaaaaagaagguagaguagaggccuauugc

SEQ ID NO: 342265 - RNA, 64 nt, hsa
cagaaacaccaucugauucagaucacaagaagaagaaaaagaaaaaagaagaggauccugaacg

SEQ ID NO: 342266 - RNA, 64 nt, hsa
auuuuuaauugaguguaaacacaccuaacuuuaagaaaaagaaccgcuuguaugauuuucaaaa

SEQ ID NO: 342267 - RNA, 64 nt, hsa
cuguaguaguuggucuagaaacaaaauacuccaagaaaaagaaaauuuucaaauaaaacccaaa

SEQ ID NO: 342268 - RNA, 64 nt, hsa
aacauacuaccuaaagggaaccugcaauaaucuugaaaaagaaaaagagaaaaauuuuaaaauc

SEQ ID NO: 342269 - RNA, 64 nt, hsa
cuaccuaaagggaaccugcaauaaucuugaaaaagaaaaagagaaaaauuuuaaaauccugcua

SEQ ID NO: 342270 - RNA, 64 nt, hsa
aaguugaccuuugcacuggcauuaaagagucauagaaaaagaaucauggauauuuaugaauuaa

SEQ ID NO: 342271 - RNA, 64 nt, hsa
agugucacugcugucuucuagucaaacuuguaaagaaaaagauuccaguucaguauuugcagca

SEQ ID NO: 342272 - RNA, 64 nt, hsa
gcaaagauccaccgagagaagaagagaaagaaaagaaaaagaaaaagcacaaaaaaagaucucg

SEQ ID NO: 342273 - RNA, 64 nt, hsa
cuccagccaggagcgcuccaggggagucucucaggaaaaagaagcccagaucucuucagcaauc

SEQ ID NO: 342274 - RNA, 64 nt, hsa
ccagaguuuugguuuuugaacuagcaaugccugugaaaaagaaacugaauaccuaagauuucug

SEQ ID NO: 342275 - RNA, 64 nt, hsa
auaaagaaaagaugagcaaagaugguaaaaagaagaaaaagaagucaaagacaaaguguguaau

SEQ ID NO: 342276 - RNA, 64 nt, hsa
gaucaugaggucagcaguugagaccagccaaaaggaaaaagaaaauuaugagaguuacuuaaag

SEQ ID NO: 342277 - RNA, 64 nt, hsa
cauuguaacuuuuuguuagagaugaucccauuuagaaaaagacugguagaaauuggagugaaag

SEQ ID NO: 342278 - RNA, 64 nt, hsa
aggcauuccagccccuauguuauugauggaaaaagaaaaagaagaaaagcaaucucgcaguaca

SEQ ID NO: 342279 - RNA, 64 nt, hsa
aaaaagaggcauuccagccccuauguuauugauggaaaaagaaaaagaagaaaagcaaucucgc

SEQ ID NO: 342280 - RNA, 64 nt, hsa
aagauagccuucacguuccccaucugucuucagagaaaaagagcugggacaccaagaacaagcu

SEQ ID NO: 342281 - RNA, 62 nt, hsa
ccauguacagcuggcaucuaauaaauguuuucaugaaaaagauuuucuagccaaggucccuu

SEQ ID NO: 342282 - RNA, 64 nt, hsa
aaaaauuuugaaaaagaagauaaaaagaagaaacgaaaaagaaagcccaaggcaaagaaggggg

SEQ ID NO: 342283 - RNA, 64 nt, hsa
augauguuccacugagaaaacaccaaaaaauuuugaaaaagaagauaaaaagaagaaacgaaaa

SEQ ID NO: 342284 - RNA, 64 nt, hsa
gcuuuaaucucuacuugcuauaaccgugugcuuagaaaaagaggugagaguagugguuuuccuu

SEQ ID NO: 342285 - RNA, 64 nt, hsa
auuccaaaguuuuauuuuacuuuuuuaaagaacagaaaaagaugaaugaaagaaccaaggagag

SEQ ID NO: 342286 - RNA, 64 nt, hsa
acuguggcacuuuucaccauaauuuaauuuaguggaaaaagaagacaaugcuuuccauauugug

SEQ ID NO: 342287 - RNA, 64 nt, hsa
uuaucgaggcacgugaucaguguugcaacauaaugaaaaagauggcuacugugccuuguguuac

SEQ ID NO: 342288 - RNA, 64 nt, hsa
cugucuaugccaaucauguaaaaugacguuucuugaaaaagauucagugguucagcuuugucag

SEQ ID NO: 342289 - RNA, 64 nt, hsa
ugaugggggcuguguaaugggggcagaggccagggaaaaagaugcuguucacccacccucagcu

SEQ ID NO: 342290 - RNA, 64 nt, hsa
uaaagaauuugucaauccuagccuuccaagagaagaaaaagaagagaaacuagaaacaguuaaa

SEQ ID NO: 342291 - RNA, 64 nt, hsa
gaaugagaaaaauccuaacccaauagaaucacucgaaaaagaaucugcuuucaaaacgaaagcu

SEQ ID NO: 342292 - RNA, 64 nt, hsa
caacucaggagugagcaggaaaauugaguccaaggaaaaagagagacucagagacccgggaggg

SEQ ID NO: 342293 - RNA, 64 nt, hsa
aaaagaaaaagaaaaagcaagaagaaggaagaaagaaaaagacagaaagagaaauaggaggagg

SEQ ID NO: 342294 - RNA, 64 nt, hsa
gauucaaaucucuugcuuucuuucuuaaaaaaaagaaaaagaaaaagcaagaagaaggaagaaa

SEQ ID NO: 342295 - RNA, 64 nt, hsa
agugcuguuucuuuuuuuuuuuuucucuugaccagaaaaagauuuguuuaccuaccauuucauu

SEQ ID NO: 342296 - RNA, 64 nt, hsa
uuggugcaaagaaguauaaacauauaucacuaaggaaaaagaaaguuugucuugcccuucugac

SEQ ID NO: 342297 - RNA, 64 nt, hsa
uccaaacugcuuuguguauuguauauuuuuuuaagaaaaagaaaagccuuauuugacuuaugcu

SEQ ID NO: 342298 - RNA, 64 nt, hsa
ggugaaucuagagccuacuuuuauuuugguuaaagaaaaagaaaauaucaauaauucaauuuug

SEQ ID NO: 342299 - RNA, 64 nt, hsa
guggaguaauagggaaagaagaguuacagaaaaugaaaaagaaaaugaguuacacugagaauga

SEQ ID NO: 342300 - RNA, 64 nt, hsa
gaaaaggucuucugacacacuuaucuugcacaaagaaaaagaaaauuucuuuuacuguguuuaa

SEQ ID NO: 342301 - RNA, 64 nt, hsa
gaaagaaagaaagggaaagauggaaggaaggaaggaaaaagaaagagaaagagagagagagaga

SEQ ID NO: 342302 - RNA, 64 nt, hsa
aggaaaaagaaagagaaagagagagagagagaaagaaaaagaaagaaaaguaagaaagaaaaaa

SEQ ID NO: 342303 - RNA, 64 nt, hsa
gaaagaaaaagaaagaaaaguaagaaagaaaaaagaaaaagaaagaaaaguaagaaagaaaaaa

SEQ ID NO: 342304 - RNA, 64 nt, hsa
agaaauugagaaguauguugcugaaauugaaaaagaaaaagaagaaaacgaaaagaagaaacaa

SEQ ID NO: 342305 - RNA, 64 nt, hsa
uccugaagaaauugagaaguauguugcugaaauugaaaaagaaaaagaagaaaacgaaaagaag

SEQ ID NO: 342306 - RNA, 64 nt, hsa
uuugcuguuuuaugguugugaagaacgagagcaagaaaaagaugauguagauguugcccuacua

SEQ ID NO: 342307 - RNA, 64 nt, hsa
agaaacuucuacagauauuacuaauuucaaucuggaaaaagaucgaauuucaaaagaauccggc

SEQ ID NO: 342308 - RNA, 64 nt, hsa
gaaucauacuaaagacauuugcgcuuacuuuguugaaaaagaaaaagaaauuaaauuugaacac

SEQ ID NO: 342309 - RNA, 64 nt, hsa
uacuaaagacauuugcgcuuacuuuguugaaaaagaaaaagaaauuaaauuugaacacagugaa

SEQ ID NO: 342310 - RNA, 64 nt, hsa
uguguaagucacccccaccaaaaacaaaagagaagaaaaagaauagaaagaauuauccaguguc

SEQ ID NO: 342311 - RNA, 64 nt, hsa
aaggcagggaauagacuucuagaaaaccugagaggaaaaagaauucuuuuuacaggaggcagca

SEQ ID NO: 342312 - RNA, 64 nt, hsa
ucucuuuccaauuucacuuugguggucugaagaagaaaaagaaauuuuauguauguauguguaa

SEQ ID NO: 342313 - RNA, 64 nt, hsa
aacaacacuaacaugagaacacaagaacuuaagagaaaaagaaaccuacucaagaaaagacaga

SEQ ID NO: 342314 - RNA, 64 nt, hsa
ccuccgagaaagaagaacguaagcacaggaaagagaaaaagaaaucuguugaagaaaggacaga

SEQ ID NO: 342315 - RNA, 64 nt, hsa
aaaggccagagaaagagcaguccaagcauaaaaggaaaaagaguuaugaagauacagauuuaga

SEQ ID NO: 342316 - RNA, 64 nt, hsa
auaaacuaaauuaauuuuuaggggagagcaguaggaaaaagagcuaaugcaugcgggguuuaau

SEQ ID NO: 342317 - RNA, 64 nt, hsa
ucucaguuccuuccuuuggguuacuagaauguuggaaaaagaugccaagucugucuugacaacu

SEQ ID NO: 342318 - RNA, 64 nt, hsa
aaauaaaacugucuuuggcagugaguaaauagcauauuuugaaguagaguuguauacuuuuuca

SEQ ID NO: 342319 - RNA, 64 nt, hsa
aggaaaaaaagaaaaaaaccuuaucucuugcccuuauuuugaauuuuccacucuuucauuaauu

SEQ ID NO: 342320 - RNA, 64 nt, hsa
gaacaucuuaaugcagccugcauagugaaaugguuauuuugagaucaccgcucuguagcuaacc

SEQ ID NO: 342321 - RNA, 64 nt, hsa
ugcuggguacaaugcuucuaugaauauuuccauguauuuugacuggggagaggcauggagaaga

SEQ ID NO: 342322 - RNA, 64 nt, hsa
ugguuuucuuuuuucagccuuugcgcuuuuucaguauuuugaccauagggagauaauuuuuuua

SEQ ID NO: 342323 - RNA, 64 nt, hsa
gugauuguuuuaaaaucuaaugggaaguaaaauauauuuugauuuuacccagcuuaaucuguaa

SEQ ID NO: 342324 - RNA, 64 nt, hsa
caaaucguuggugccaucagugauuuacaaacaauauuuugauauugcagaugacuugcuuacu

SEQ ID NO: 342325 - RNA, 64 nt, hsa
auacuuuuaaagacaguuuuaauguugaauuugguauuuugaaggguuauuuuuaauguauuuu

SEQ ID NO: 342326 - RNA, 64 nt, hsa
uuacauuauauauguauugugaacuuuaaaagacuauuuugauaaauuuauaaauauauaaaau

SEQ ID NO: 342327 - RNA, 64 nt, hsa
uauaaauauauaaaauuauguaaaaacuacacuauauuuugauuuagauuuuccugcuguuugc

SEQ ID NO: 342328 - RNA, 64 nt, hsa
aauauuagccuucuagucuguaauggaaauuguauauuuugauagaaguuuuuucuccauuggu

SEQ ID NO: 342329 - RNA, 64 nt, hsa
cuggaacauccaaaaccaagcaaagggaugugacuauuuugaaugaaucagaaugucaacuugu

SEQ ID NO: 342330 - RNA, 64 nt, hsa
aggcaaaguagccaagagccuuuuguuuuguuuuuauuuugauaaauuaguggagaaauggcau

SEQ ID NO: 342331 - RNA, 64 nt, hsa
aguuuuggaguuugaauuucugccaggauugaauuauuuugaaaucuccugucuuuuuaaacuu

SEQ ID NO: 342332 - RNA, 64 nt, hsa
ucuaaaaaugaaagcaagauaucuuauguagaaauauuuugauaauauuuuuacagugagcuuu

SEQ ID NO: 342333 - RNA, 64 nt, hsa
uaaacuauguuguaagcagccaacuguaaaugucuauuuugaaauucccuaugcuaagggugcc

SEQ ID NO: 342334 - RNA, 64 nt, hsa
auauccuuuuugucccaucucuaaaauguauaaauauuuugauuugguuuuacuuuaauuucuc

SEQ ID NO: 342335 - RNA, 64 nt, hsa
aaaccucauagucauuuuucuuaauugcccuuaauauuuugacauauagggauacauaaauuua

SEQ ID NO: 342336 - RNA, 64 nt, hsa
aaucccaaagacuuuuccuauguacuaggcauuuuauuuugauugacuuacaaacucuucuuaa

SEQ ID NO: 342337 - RNA, 64 nt, hsa
ugucuauuuuauuuauuuuucccagugaaaaguguauuuugauagagaacuuuucauucuauaa

SEQ ID NO: 342338 - RNA, 64 nt, hsa
aauagauacaaacucaauuuugcauagaaagguguauuuugaauaguucccauguuguguucuc

SEQ ID NO: 342339 - RNA, 64 nt, hsa
agugaauuuucaauauggaccaggaaggcauauguauuuugaacuugagugaaaagguugaagu

SEQ ID NO: 342340 - RNA, 64 nt, hsa
aagcaauaugauguacauuacuuuugagaaacaguauuuugacuaggaccucucuuauuuguca

SEQ ID NO: 342341 - RNA, 64 nt, hsa
uuauaacugaaucuaaguauuagacugcuacucauauuuugaacugcagguguaggacaguguu

SEQ ID NO: 342342 - RNA, 64 nt, hsa
cauaaauucagagugauguuuagcaguaaaucaauauuuugaagugauacacagaugucuuucc

SEQ ID NO: 342343 - RNA, 64 nt, hsa
uagccggugaauugagucguauucugucacauaauauuuugaagaaaacuuggcugucgaaaca

SEQ ID NO: 342344 - RNA, 64 nt, hsa
gccaaccuauuuugaaguaccaccaaaaaagcuguauuuugaaaaugcuuuagaaagguuuuga

SEQ ID NO: 342345 - RNA, 64 nt, hsa
gagaccaaaugucacguuuuguuuugugccaaccuauuuugaaguaccaccaaaaaagcuguau

SEQ ID NO: 342346 - RNA, 64 nt, hsa
guacacuuuuagauuagacaguaucuucuuuuaauauuuugauuuguuuuccuuuaguuugaaa

SEQ ID NO: 342347 - RNA, 64 nt, hsa
guaucagucuucugaauucugaguuuugaaaauauauuuugaggagaaaaagacauagucuaau

SEQ ID NO: 342348 - RNA, 64 nt, hsa
cuuauaaagugauaguacauguuagcauauaauguauuuugaagagugaaguaaaugcuauuga

SEQ ID NO: 342349 - RNA, 64 nt, hsa
agaaaagacagaaaaggaagaggaaggaaggaaauauuuugagaauauauugagaagaauuaag

SEQ ID NO: 342350 - RNA, 64 nt, hsa
ugacuucauccaaucucuauguuauguuuaauuuuauuuugaaagcaacaccucaacucaucuu

SEQ ID NO: 342351 - RNA, 64 nt, hsa
aguuuuuuuauaguuuaaaaguuaaagugccucauauuuugaaaauauccauuaaggacccagg

SEQ ID NO: 342352 - RNA, 64 nt, hsa
aaguuguauuugcuauuuuuccccuaugagaagauauuuugaucuccccaauacauugauuuug

SEQ ID NO: 342353 - RNA, 64 nt, hsa
aagaaaaguacagauaggcugaugguuauugccuuauuuugacugcauuucucuuaaauggauc

SEQ ID NO: 342354 - RNA, 64 nt, hsa
uacccccuacaaaagcacuccacagcuuuuacacuauuuugacuuugaguuauaacuaguauua

SEQ ID NO: 342355 - RNA, 64 nt, hsa
cacuaagaauuuucauuuuuaggggucaaaaaccuauuuugaaaauaguguugugugaaugcug

SEQ ID NO: 342356 - RNA, 64 nt, hsa
gaaacaauuuugccuccauauuucagugcaaauauauuuugaaguuacuuuuaaauauuuauuu

SEQ ID NO: 342357 - RNA, 64 nt, hsa
aaaauaauugaagcuuccaugagaaagaaaacacuauuuugauaaauuggaucacuuauaggaa

SEQ ID NO: 342358 - RNA, 64 nt, hsa
ugcauuucguauuguucuguauauuucaaaaugguauuuugaugccaucaaaugcccaggaaau

SEQ ID NO: 342359 - RNA, 64 nt, hsa
gcuaucgcaacaauccuggcagacaauugaguaauauuuugaugauuuauuuuguuuguaauua

SEQ ID NO: 342360 - RNA, 64 nt, hsa
ucaaaagagagaaaccuguauaauaguaagaucuuauuuugaauaaaaacgucuauaauuacaa

SEQ ID NO: 342361 - RNA, 64 nt, hsa
cuauacccuaaguaaaaugaggacgaaagacaaauauuuugaaagccuaguccaucagaauguu

SEQ ID NO: 342362 - RNA, 64 nt, hsa
cuuuuuaauguuuacagaaauuuuaauuuuuuucuauuuugaaauuugaggcuuguuuacauug

SEQ ID NO: 342363 - RNA, 64 nt, hsa
ugaaagucagaggugauuauugauaguacuuuuguauuuugauauggacaguuuauucauuugc

SEQ ID NO: 342364 - RNA, 64 nt, hsa
uuagcaaauuaauaacacuauuucugucacuaauuauuuugaggccuuuuaguacuaaaauuuu

SEQ ID NO: 342365 - RNA, 64 nt, hsa
ggagaauuccuugcuguuagaagaauguggccauuauuuugauuuuuugaaugagauauauaau

SEQ ID NO: 342366 - RNA, 64 nt, hsa
acucuucugucauuugcugcuauguugaaauucuuauuuugaccaucaaugccuaugaauucuu

SEQ ID NO: 342367 - RNA, 64 nt, hsa
ugcuaaaaccucaauuuaagucuuuaaaagguuguauuuugaauguaaccaaaaguuuacaguu

SEQ ID NO: 342368 - RNA, 64 nt, hsa
uuuauauuugauuuugaaauguauuuuuguacuuuauuuugaauaucauccauaugucugacau

SEQ ID NO: 342369 - RNA, 64 nt, hsa
uguggguacugcuuucauaaaacaguuuuuucaguauuuugagaauugccauauuaauuuuuau

SEQ ID NO: 342370 - RNA, 64 nt, hsa
ugauucacauaguuuuaugcauuuccugcuaauuuauuuugaguuuuaagaaaacaaccaaaac

SEQ ID NO: 342371 - RNA, 64 nt, hsa
aacaauuccaaugaaaauuuuaguaacaauuguuuauuuugaggguauuuguucauaacauuaa

SEQ ID NO: 342372 - RNA, 64 nt, hsa
aaauuaggaaauauauaugaaugucguugaagucuauuuugagacugcuaaagcuauuaauuga

SEQ ID NO: 342373 - RNA, 64 nt, hsa
uucuguagauuauuugaaaaucauucuaaauauauauuuugaaauauauagauuauauuuguau

SEQ ID NO: 342374 - RNA, 64 nt, hsa
uaaaguuuugacauuuaaauuacuugaaucucauuauuuugacaauaauuuaauucuuuuauug

SEQ ID NO: 342375 - RNA, 64 nt, hsa
gcuaacagauuuguaugguuuaguggagucugguuauuuugacagaugcauguuuuuuuuaaau

SEQ ID NO: 342376 - RNA, 64 nt, hsa
cuaagucacauuggaagugaacuuggaggaugcauauuuugauaugcuuugacagcuaacagau

SEQ ID NO: 342377 - RNA, 64 nt, hsa
agauuuauuggaagauacuuacaggggaaauuaauauuuugacuauuuuuauauauaaagaaga

SEQ ID NO: 342378 - RNA, 64 nt, hsa
ugauuuuuauggauauaguagaagaaaugugcuguauuuugauaaaauucacuuauuguaugug

SEQ ID NO: 342379 - RNA, 64 nt, hsa
caucuuuuucuuuucuuuuuuuuagaauagcugauauuuugauaacaaucucuaauuugcaugg

SEQ ID NO: 342380 - RNA, 64 nt, hsa
uaaaaauaucuaaaauaauguucauggugaaucuuauuuugagaaauacauguuaaaaaaggaa

SEQ ID NO: 342381 - RNA, 64 nt, hsa
acgggugcacgccaccaugcccagcuaauuuuuguauuuugaguagagacaggguuucaccgug

SEQ ID NO: 342382 - RNA, 64 nt, hsa
gaugauuaucugcuaaguaagucugaaaauguaauauuuugauaauacuguaauauaccuguca

SEQ ID NO: 342383 - RNA, 64 nt, hsa
gaaucagucgaaucauucuguggaugccaaagaauauuuugaccauaauacagcacagccugga

SEQ ID NO: 342384 - RNA, 64 nt, hsa
ugugcaagaaaaguauuuuuauguaucauaaauguauuuugaaacaaaugagaagaagaaaggu

SEQ ID NO: 342385 - RNA, 64 nt, hsa
aacaaaaacgccuuuucuugguucuuuuuucaguuauuuugaagguccagcauccugauuaaau

SEQ ID NO: 342386 - RNA, 64 nt, hsa
cagcagcagcuuucagcucuuaaaaagacacuuauauuuugauuuuacaugcugguuaccuguu

SEQ ID NO: 342387 - RNA, 64 nt, hsa
ugguagguagaaguuaauauuugugguucauguauauuuugaccagaguauauuuaaguauaua

SEQ ID NO: 342388 - RNA, 64 nt, hsa
uaaguuauugugauucauuuuaguuacuguguuuuauuuugaaaauauuuaaauauugcacuuc

SEQ ID NO: 342389 - RNA, 64 nt, hsa
guuauaacucuuuaguuggauauaacauuauuauuauuuugauaaaauauggaacaaaucaauu

SEQ ID NO: 342390 - RNA, 64 nt, hsa
ccaaagcuuuucagaacuucagugugagguuuccuauuuugacaaguuaacuuguaaauacuca

SEQ ID NO: 342391 - RNA, 64 nt, hsa
aauuuaccuaauagaccaaacuaacucauggagauauuuugaacuauuauuuagguacaaacuu

SEQ ID NO: 342392 - RNA, 64 nt, hsa
auauuucaugggaauauucaaauaucuaugguaauauuuugacccuuuauauuuguucuaaaau

SEQ ID NO: 342393 - RNA, 64 nt, hsa
aagucaaaaugugaaaauaauauuaaaucuaagauauuuugaacuaagcaucuuuauaugcuug

SEQ ID NO: 342394 - RNA, 64 nt, hsa
uacugucauuagguugucuuuuaauacuuuaaguuauuuugacgaaaaguaauagagaaaauuu

SEQ ID NO: 342395 - RNA, 64 nt, hsa
uaggggaaaauaaaagaauaaaucacuauacugauauuuugauacaagcaagcacuuacauggu

SEQ ID NO: 342396 - RNA, 64 nt, hsa
aguugacuaaauuuuauauuucuuguccucuaaauauuuugauaauuucuggauugaugcagug

SEQ ID NO: 342397 - RNA, 64 nt, hsa
aucaguuugauucuguaaugagcacagcaccuaauauuuugaggagcucuguuuugaggaccaa

SEQ ID NO: 342398 - RNA, 64 nt, hsa
uaggacuguuaucuguauuguuaauuuugugccauauuuugaauugcaacauuaugcuaaguau

SEQ ID NO: 342399 - RNA, 64 nt, hsa
auaaaauauauaaacauaaauaaauuagguaguguauuuugaguggcaucagucucacucaucu

SEQ ID NO: 342400 - RNA, 64 nt, hsa
uuuuuuuagugucccaaagauaucuuagauaaacuauuuugaaguucagauuucagaugaggca

SEQ ID NO: 342401 - RNA, 64 nt, hsa
ucuuuggucuaaaacauuauuaaauuuuuguaaauauuuugauuuaaugugucuuagauccuca

SEQ ID NO: 342402 - RNA, 64 nt, hsa
agcaauaauuguaaaugguuaccauacuguaagauauuuugauaaaaauuaacuaguaauacuu

SEQ ID NO: 342403 - RNA, 64 nt, hsa
agaacuuaacauuuugcacagaauauaucaaauauauuuugagaaaaaaaguacggcaugaguu

SEQ ID NO: 342404 - RNA, 64 nt, hsa
uuguacagcuuggugacuguaauuaacaacaauguauuuugaaagucacugaguaaauuuuaag

SEQ ID NO: 342405 - RNA, 64 nt, hsa
cuacgucauuuuuuaaaauuauauuuaauuuuuuuauuuugaaaguuuuuucacagaucuuuuu

SEQ ID NO: 342406 - RNA, 64 nt, hsa
auuauuuuucaguguguauuuaaacgaggcaguuuauuuugauauguaucuauucaugauugaa

SEQ ID NO: 342407 - RNA, 64 nt, hsa
ucccaguguucugaguuauugaaaggcuuucuuuuauuuugagagcuuuaggucuuuuugggau

SEQ ID NO: 342408 - RNA, 64 nt, hsa
uuuuaaaacuggaccuguauuauccugaauacacuauuuugaaaauuuuuaaaaaugacuucuu

SEQ ID NO: 342409 - RNA, 64 nt, hsa
aaauaagcacuauuaacagauucagcacuacaaguauuuugaauguuguugcuguuggucauuu

SEQ ID NO: 342410 - RNA, 64 nt, hsa
acauugucucucuauaucugcuuguggauauuguuauuuugaagagaaaugguuugugguuguc

SEQ ID NO: 342411 - RNA, 64 nt, hsa
guguuuguaaaagcuugaugaaaggacaguuaaguauuuugaucacugcauuuuguuugaaacu

SEQ ID NO: 342412 - RNA, 64 nt, hsa
aagcauaugcuaucauuguauucuuuaagaaccuuauuuugauaaaauguaaauuuguugaacc

SEQ ID NO: 342413 - RNA, 64 nt, hsa
ucgaaugggagaaaaagcaaaucgcacaaugacauauuuugaguaauaaccguauuuuucacag

SEQ ID NO: 342414 - RNA, 64 nt, hsa
aucaggugguuaaacggguaaacaaaauauacuguauuuugagaaauggcacaaaaacaggcag

SEQ ID NO: 342415 - RNA, 64 nt, hsa
aaaggauuaauuuaaacuuuacaauuuacaucaauauuuugaauaucugauuuuuuuuaauggg

SEQ ID NO: 342416 - RNA, 64 nt, hsa
auguaaaaggauuaaacuuuacaauuuagaucaauauuuugaauaugugaaaggauuaauuuaa

SEQ ID NO: 342417 - RNA, 64 nt, hsa
cauaaucaucacuuuaacuuuuccuuggagcauauauuuugaauugugagaauaauuuuguugc

SEQ ID NO: 342418 - RNA, 64 nt, hsa
uaagccacuaucugcaauuuuguacauuauauaguauuuugaagauauggaaccuuaugaaaaa

SEQ ID NO: 342419 - RNA, 64 nt, hsa
ccucauuaugcaaaaauaacauaucuuucaugacuauuuugacaaaaguuuaaaacacauauga

SEQ ID NO: 342420 - RNA, 64 nt, hsa
uagcaaaaugagaagaugugaccugugccaaaacuauuuugagaauuuuaaaugugaccauuuu

SEQ ID NO: 342421 - RNA, 64 nt, hsa
auagacuuugucuuauaaacauuuuuucauuuuuuauuuugaaaaauugcaaaucuacagcaaa

SEQ ID NO: 342422 - RNA, 64 nt, hsa
gcacucaauugcagagauuugaggacauuauuuuuauuuugagcuuuaaaaagaugaauaggug

SEQ ID NO: 342423 - RNA, 64 nt, hsa
uaaaccuauauuuucauaauucuauguguauuuuuauuuugaauaaacagaaagaaauuuuggg

SEQ ID NO: 342424 - RNA, 64 nt, hsa
gccauauuuuaaaaaaucaaaaggcacugugaacuauuuugaagaaaacacaacauuuuaauac

SEQ ID NO: 342425 - RNA, 64 nt, hsa
uugaauuaaucuagaaaaugaaaagauggaguuguauuuugacaaaaauguuuguacuuuuuaa

SEQ ID NO: 342426 - RNA, 64 nt, hsa
gagaauugcuuucuuuaguguuaagaccuacucauauuuugaagaaaucuugaguuaagugagu

SEQ ID NO: 342427 - RNA, 64 nt, hsa
uuuguauugugacaaauucauaagauaacauugauauuuugauuuguaauauuucuaauuggua

SEQ ID NO: 342428 - RNA, 64 nt, hsa
aacaaaacgggguggguauucuuaacugugacuauauuuugacaauugguagaaggugcacauu

SEQ ID NO: 342429 - RNA, 64 nt, hsa
auacagaauuagaaaaaaaaaauucuuguugaaauauuuugaaaacaaauucccuacuaucauc

SEQ ID NO: 342430 - RNA, 64 nt, hsa
guaaagaagucacucuauaucugcuaaauauaguuauuuugaaggauauuaggcuccuugaaag

SEQ ID NO: 342431 - RNA, 64 nt, hsa
uuuucuugaaaauuaaaauuguuuaccaaaacaguauuuugaagcaagaucauauuuuugucug

SEQ ID NO: 342432 - RNA, 64 nt, hsa
agaauacuaauauuuugaugcauguguaucaccuuauuuugauuaaaucuuuuccaauuuugca

SEQ ID NO: 342433 - RNA, 64 nt, hsa
guucugugaaaaauuuuuuucuucagaauacuaauauuuugaugcauguguaucaccuuauuuu

SEQ ID NO: 342434 - RNA, 64 nt, hsa
uuuucucccaagaaaccugacucaauuauuugcauauuuugagaaacugcugcagauuaguucu

SEQ ID NO: 342435 - RNA, 64 nt, hsa
uccagagcaaccagaaggagguuauaccaggauuuauuuugagcucagccccaacucuuuauca

SEQ ID NO: 342436 - RNA, 64 nt, hsa
cugcuugguuaccaaguguccagggaaacccuuguauuuugaugacuaaaaagagcacuuugcc

SEQ ID NO: 342437 - RNA, 64 nt, hsa
aaaauaccaucuaaaaggagaaugugaauaguuguauuuugaaaugaugugucaggaaaaguuu

SEQ ID NO: 342438 - RNA, 64 nt, hsa
uaacuuacugauaagauguuuaugaaguauggcauauuuugauuuuuuuaauuguaauaaauau

SEQ ID NO: 342439 - RNA, 64 nt, hsa
uacauauauaaauauacacacacuuacauguauguauuuugauagauauuacauggacuaaauu

SEQ ID NO: 342440 - RNA, 64 nt, hsa
ucccuugguggauuuuuguguuuuguaaguugucuauuuugauaauguauuauuuuuauaacug

SEQ ID NO: 342441 - RNA, 64 nt, hsa
cuuugcagcauuaaaaaauggugaaggggggaaauauuuugaaccaaagaccaaauguuaggcc

SEQ ID NO: 342442 - RNA, 64 nt, hsa
ucuaaaguaaaccagcuuaucuuugaaacaauauuauuuugaaauuggcuuuaaaauaaaacca

SEQ ID NO: 342443 - RNA, 64 nt, hsa
ucugacuaaagucaaagaaugauuucuuaugguuuauuuugaugaaaguucuuuuaacaugucu

SEQ ID NO: 342444 - RNA, 64 nt, hsa
agccaccuguuauaugggagaacgaaaauuguuauauuuugaaaguacuuauuacauuauuuuu

SEQ ID NO: 342445 - RNA, 64 nt, hsa
uuuuguuuuuaaaaccuuuagacucugaaaguaauauuuugacuaagaauguaaauauuuccaa

SEQ ID NO: 342446 - RNA, 64 nt, hsa
acaaaacucaugaaugugcaguuugagccauugcuauuuugauuacauagaauuuguauuucuu

SEQ ID NO: 342447 - RNA, 64 nt, hsa
uuuaguacauauuuugaagaauuucuauaguacauauuuugaagaauuuuuauaucaaauauac

SEQ ID NO: 342448 - RNA, 64 nt, hsa
accuuagauucacaaacuuuguauuuuuaguacauauuuugaagaauuucuauaguacauauuu

SEQ ID NO: 342449 - RNA, 64 nt, hsa
gacucaaucauaauucauuuaaucuucuauuggauauuuugacuauuuacaucuuuucacaguu

SEQ ID NO: 342450 - RNA, 64 nt, hsa
agucauccuacuauguugaaagaaccaauguuaauauuuugauaaauaucauuuguccuuuuac

SEQ ID NO: 342451 - RNA, 64 nt, hsa
uuuuauuuugugcucauuuaaguuucaaacuuacuauuuugacaguuauuuugauaacaaugac

SEQ ID NO: 342452 - RNA, 64 nt, hsa
cucauuuaaguuucaaacuuacuauuuugacaguuauuuugauaacaaugacacuagaaaacuu

SEQ ID NO: 342453 - RNA, 64 nt, hsa
aaaaacuuucuaagaggcaacaauuuagaauggauauuuugacgaaucggcaugaguguaacag

SEQ ID NO: 342454 - RNA, 64 nt, hsa
acuuaaagaacagacaguuuacuuggccuaaaaauauuuugauguuuacucaaaaaguaccucu

SEQ ID NO: 342455 - RNA, 64 nt, hsa
aaaauacuuacauugaaccugguggcauaaugaguauuuugaaagaagaaauuucuucacucuc

SEQ ID NO: 342456 - RNA, 64 nt, hsa
cuacaguacaauauauuaugaagcaugaccacuuuauuuugaaacuuagcaauuguauugcugg

SEQ ID NO: 342457 - RNA, 64 nt, hsa
uauuuggcuccuuuaauuccucugaaaacaugaguauuuugaguucugcagcacaaugacugua

SEQ ID NO: 342458 - RNA, 64 nt, hsa
uaacuuuuauuuuauuuuauuuuauuuauuuauuuauuuugagacugagucuugcucugucgcc

SEQ ID NO: 342459 - RNA, 64 nt, hsa
ccguaaacacccauaugaucugggauuuuguucauauuuugaaaugggagcuuuuauguuuuac

SEQ ID NO: 342460 - RNA, 64 nt, hsa
auuguccauaugccaauuuuuuguuaaaaccuuuuauuuugaacuagacugcuuugagauauca

SEQ ID NO: 342461 - RNA, 64 nt, hsa
gauuaggaccacagauuugguuuagaaaggguaauauuuugaaauacuacaagguuuagacagu

SEQ ID NO: 342462 - RNA, 54 nt, hsa
aucagcaggguucuuuguaaauaguauuuugagacacuaagauguuucuacugc

SEQ ID NO: 342463 - RNA, 64 nt, hsa
gguaccuuguaugucuuaauuuauuuuaaauauuuauuuugaaugaguuugauagaaagcuagu

SEQ ID NO: 342464 - RNA, 64 nt, hsa
auuaaauuaggugacauggugacaucuaucccuuuauuuugacacuaaaacauggacacaacua

SEQ ID NO: 342465 - RNA, 64 nt, hsa
gccccccccccaaaauccucauguuucugcuucauauuuugaaaaauaacaauuaaaacagaca

SEQ ID NO: 342466 - RNA, 64 nt, hsa
gggaaaagaccccggagagggaagaaaaucucaguauuuugaaaauugagauuacuucagagcc

SEQ ID NO: 342467 - RNA, 64 nt, hsa
cagcuggcagguuuguugaaauacaguuuugaguuauuuugauguggcuuuuuaaaaaaguuaa

SEQ ID NO: 342468 - RNA, 64 nt, hsa
auuuuaaacauuuaauuaaauguaauuugggggauauuuugaacuuuaauauuagugaucaaau

SEQ ID NO: 342469 - RNA, 64 nt, hsa
uuugucuauucuuuauuucucucaggguggccaguauuuugacuuauuuauccugcuugaaagc

SEQ ID NO: 342470 - RNA, 64 nt, hsa
gggugcuuuuuauuguauaaagcagcgucuuauguauuuugauauaccauuguuugaacuuccg

SEQ ID NO: 342471 - RNA, 64 nt, hsa
cucaccaaaaaaggcauuacaaaaaauugggcuauauuuugaauuuugucaauuaaaaaagcgu

SEQ ID NO: 342472 - RNA, 64 nt, hsa
uguuguuauuuuuaaaguacaguagggugugaauuauuuugauguugaauuagacgacaaagca

SEQ ID NO: 342473 - RNA, 64 nt, hsa
uuauuucaagauaaguguaauuuuguuacaaguuuauuuugaagagacaaaucuccugugaucu

SEQ ID NO: 342474 - RNA, 64 nt, hsa
aacacauagaucucuuuccuaaacugacauuuucuauuuugacuguuuucauacuauaaccagg

SEQ ID NO: 342475 - RNA, 64 nt, hsa
ugaagguuaggugagaugggcaaauaggcuuaacuauuuugaagguuggaugaaaagagauggg

SEQ ID NO: 342476 - RNA, 64 nt, hsa
uauauagcuaguuuggguuuguuuuuguuuuaacuauuuugaagguuaggugagaugggcaaau

SEQ ID NO: 342477 - RNA, 64 nt, hsa
augcuuuaaacaaacaaaaaauauguuuuucuguuauuuugaagacaaaauuauuuuugcuugg

SEQ ID NO: 342478 - RNA, 64 nt, hsa
uauuucuuuguuauuguuguguuuacuguuuauuuauuuugaggcagggucuugcucugucucc

SEQ ID NO: 342479 - RNA, 64 nt, hsa
auuguacuugagagacaaaaaaaaaacucuguuguauuuugacagaauuauuuuuauuaaaaua

SEQ ID NO: 342480 - RNA, 64 nt, hsa
caguauuggcugguuacucucauguagcgccuucuauuuugaaagggggguuuuguuuugagga

SEQ ID NO: 342481 - RNA, 64 nt, hsa
cgcucgacauuuuacacaacccggauauguuguauauuuugacccaaaguuacagguagguuua

SEQ ID NO: 342482 - RNA, 64 nt, hsa
uaucuuuguucuuguuugcugcuauuuucuguccuauuuugagaaauauaaauacauagaaaug

SEQ ID NO: 342483 - RNA, 64 nt, hsa
uuaaaauaguuaacuugaagaguagaaacaauuguauuuugaagucucauacaagcugucugau

SEQ ID NO: 342484 - RNA, 64 nt, hsa
aguuuugcuuuguuugcauguccacugguuuuuuuauuuugauauuugucuuuuuuuaaauuuu

SEQ ID NO: 342485 - RNA, 64 nt, hsa
ugugcuuuucauuucaauauuuaguuauauuugauauuuugaaacugucugcuuuuugcuauuu

SEQ ID NO: 342486 - RNA, 64 nt, hsa
uaacuguuacuucuuaaagcagcauuuuaucuucuauuuugaagacuauuuauuguaauaauua

SEQ ID NO: 342487 - RNA, 64 nt, hsa
aguuuugcuuuguuugcauguccacuaauuuuuuuauuuugauauuagucuuuuuuaaaaaauu

SEQ ID NO: 342488 - RNA, 64 nt, hsa
uuaaaauaguuaacuuuaagaguaguaguaauuuuauuuugaagucucaugcaaguugucugau

SEQ ID NO: 342489 - RNA, 64 nt, hsa
aguuuugcuuuguuugcauguccacuaauuuuuuuauuuugauauuugucuuuuuuuuaaauuu

SEQ ID NO: 342490 - RNA, 64 nt, hsa
uuaaaauaguuaacuuuaagaguaguaaucauuuuauuuugaagucucauacaagcucuccgau

SEQ ID NO: 342491 - RNA, 64 nt, hsa
uguugcaucauaauuuagcacugaugucugcuuuuauuuugaucaucuuuguccacccuuauua

SEQ ID NO: 342492 - RNA, 64 nt, hsa
uguguguguguuggaaccuccuggggacauguuauauuuugaagugauuaaacuauuuaauugu

SEQ ID NO: 342493 - RNA, 64 nt, hsa
uuucagauuccuaaagaaauagacauuuuacuguuauuuugaaagggcaucuuuugauuuuuuu

SEQ ID NO: 342494 - RNA, 64 nt, hsa
uggaauuuuaaacuuuuguucuugcuggguuauuuauuuugauuuuagcauuaaaugucaucuc

SEQ ID NO: 342495 - RNA, 64 nt, hsa
cuaaggucaaaaguggaaagacacuguugguuuuuauuuugauuucacuauacucauuuuugaa

SEQ ID NO: 342496 - RNA, 64 nt, hsa
caugguauuuuuggaaacauuuuuauugcuugcuuauuuugaagguauauuuaucuguuaacau

SEQ ID NO: 342497 - RNA, 64 nt, hsa
cagaaaguaugucuuuaaaguauagaagagcauuuauuuugaaaaaaacauuacacauaugaag

SEQ ID NO: 342498 - RNA, 64 nt, hsa
auaauauguguauauauguaugccauauaugguauauuuugaugcaggcauacucuauauaaua

SEQ ID NO: 342499 - RNA, 64 nt, hsa
uuuuuucuuuuaauguuguacuguggagaaaaacuauuuugagccaugggguugguguuuacaa

SEQ ID NO: 342500 - RNA, 64 nt, hsa
ugcuccagcaagcaaacaggguggcccagguggcuauuuugagaacuccagcuggugcccccag

SEQ ID NO: 342501 - RNA, 64 nt, hsa
auaauaugaguauauauucaugcaauauauggcauauuuugauacaagaauacaguauauaaua

SEQ ID NO: 342502 - RNA, 64 nt, hsa
ucuuuaagaaaauauaagcuuuuaaagugaagaguauuuugaagaagaacauuguaguagaauu

SEQ ID NO: 342503 - RNA, 64 nt, hsa
accgcacccagccugguuauuggauuuauuuauuuauuuugagauagagccuugcucugucacc

SEQ ID NO: 342504 - RNA, 64 nt, hsa
auccaauuguugacuucucuuuaaauuucuacuuuauuuugauacaacauauuccccccaaaaa

SEQ ID NO: 342505 - RNA, 64 nt, hsa
aaaucaagguauuauauagugaaauuauuuugcauauuuugaaaacauaaaccauaguuuuugc

SEQ ID NO: 342506 - RNA, 64 nt, hsa
cuaagaauaauuuuacuuaugauuuaauggccaauauuuugaaggucuucccaacccuauugcu

SEQ ID NO: 342507 - RNA, 64 nt, hsa
accuuucuuccuuguaaacuccaaucaacaaacauauuuugagugccuuuuguguuccuuggca

SEQ ID NO: 342508 - RNA, 64 nt, hsa
uuuuuuuuuguuguuguuguguacauguuauauuuauuuugaaaccaguuuaaugggauacaac

SEQ ID NO: 342509 - RNA, 64 nt, hsa
acacuauuuuuaauuaaaguaucugauguaaaauuauuuugaguuuuuaauauuuugauaaacg

SEQ ID NO: 342510 - RNA, 64 nt, hsa
aaguaucugauguaaaauuauuuugaguuuuuaauauuuugauaaacguguauuccugaaacuu

SEQ ID NO: 342511 - RNA, 64 nt, hsa
ucauaaguacauacauucuuuugguauaaaacaauauuuugacaguuuaggcuucauuaauaga

SEQ ID NO: 342512 - RNA, 64 nt, hsa
ggugccaaaauaugcuucauuuugggggcagaucuauuuugacaguauuugacuacauauagca

SEQ ID NO: 342513 - RNA, 64 nt, hsa
auuaucucccuuuauaaacuugguguaggccguauauuuugaaaauaaacaucugguugagguu

SEQ ID NO: 342514 - RNA, 64 nt, hsa
auucauuaguguuugacauaauuuuuagaauauuuauuuugaaucaauccuuucauuacgaaag

SEQ ID NO: 342515 - RNA, 64 nt, hsa
uauauuuacuguuuauaauagguggagacuaacuuauuuugauuguuugaugaauaaaauguuu

SEQ ID NO: 342516 - RNA, 64 nt, hsa
ggaaauuugugugcuucacacaaagugaaauuaguauuuugagccuuauuaaaauauuuucuua

SEQ ID NO: 342517 - RNA, 64 nt, hsa
agccuuuccuauugggccuuccccacaauuagaauauuuugacuuaguguccugucccccuugg

SEQ ID NO: 342518 - RNA, 64 nt, hsa
ucuaugcauagauguaaugcuaaccuucugaauauauuuugaauacauuuauauauucacuguu

SEQ ID NO: 342519 - RNA, 64 nt, hsa
auuaaacuauuuugugauggcguuuaucauuuuauauuuugaaaggauuauuuuguaaggaaua

SEQ ID NO: 342520 - RNA, 64 nt, hsa
ugccuauauuguaacaauuauuuuuaaugcauuguauuuugaaguaacgguucaguuaaauuuu

SEQ ID NO: 342521 - RNA, 64 nt, hsa
ugaagauuuccuuauuucuuuguaauugugcagauauuuugaaaggcacagcauucgaagccaa

SEQ ID NO: 342522 - RNA, 64 nt, hsa
uggugcuuucaaguuuuuauuuuguuguuguuguuauuuugaaaaacacauuguaauauguugg

SEQ ID NO: 342523 - RNA, 64 nt, hsa
cccucugcccuucuaagucauagacuagguaggaaggcccuauauugguccccagcaucuacug

SEQ ID NO: 342524 - RNA, 64 nt, hsa
caacagguuacuggcaaugccagugaguuucuguaggcccuaagcugaagaagugaggcaguga

SEQ ID NO: 342525 - RNA, 64 nt, hsa
ccaggauacuucaugagaacgaaccccuucagagaggcccuacaaaacagauuagagggaagac

SEQ ID NO: 342526 - RNA, 64 nt, hsa
agauggcucagcggggcugcaccaaggggccaagaggcccuacccgugucuaaacccuccucuc

SEQ ID NO: 342527 - RNA, 64 nt, hsa
ggcugugaguuccaggucugugcucauggccaccaggcccuacugcucagggugaaugcagcug

SEQ ID NO: 342528 - RNA, 64 nt, hsa
uuugaagguuuccucuccuaggcuaguuucaaacaggcccuaaacaagucugcugcugcccucu

SEQ ID NO: 342529 - RNA, 64 nt, hsa
acccccaacacgucacccgaguagaagcugggcaaggcccuaccauccuggccgucuguucaca

SEQ ID NO: 342530 - RNA, 64 nt, hsa
ggguuagagagucuguuuugauugauguuuucugaggcccuagaggaguuuguaucaauuugug

SEQ ID NO: 342531 - RNA, 64 nt, hsa; identical to SEQ ID NO: 106040

SEQ ID NO: 342532 - RNA, 64 nt, hsa; identical to SEQ ID NO: 106041

SEQ ID NO: 342533 - RNA, 64 nt, hsa; identical to SEQ ID NO: 106042

SEQ ID NO: 342534 - RNA, 64 nt, hsa; identical to SEQ ID NO: 106043

SEQ ID NO: 342535 - RNA, 64 nt, hsa; identical to SEQ ID NO: 106044

SEQ ID NO: 342536 - RNA, 64 nt, hsa; identical to SEQ ID NO: 106045

SEQ ID NO: 342537 - RNA, 64 nt, hsa; identical to SEQ ID NO: 106046

SEQ ID NO: 342538 - RNA, 64 nt, hsa; identical to SEQ ID NO: 106047

SEQ ID NO: 342539 - RNA, 64 nt, hsa; identical to SEQ ID NO: 106048

SEQ ID NO: 342540 - RNA, 64 nt, hsa; identical to SEQ ID NO: 106049

SEQ ID NO: 342541 - RNA, 64 nt, hsa; identical to SEQ ID NO: 106050

SEQ ID NO: 342542 - RNA, 64 nt, hsa; identical to SEQ ID NO: 106051

SEQ ID NO: 342543 - RNA, 64 nt, hsa; identical to SEQ ID NO: 106052

SEQ ID NO: 342544 - RNA, 64 nt, hsa; identical to SEQ ID NO: 106053

SEQ ID NO: 342545 - RNA, 64 nt, hsa; identical to SEQ ID NO: 106054

SEQ ID NO: 342546 - RNA, 64 nt, hsa; identical to SEQ ID NO: 106055

SEQ ID NO: 342547 - RNA, 64 nt, hsa; identical to SEQ ID NO: 106056

SEQ ID NO: 342548 - RNA, 64 nt, hsa; identical to SEQ ID NO: 106057

SEQ ID NO: 342549 - RNA, 64 nt, hsa; identical to SEQ ID NO: 106058

SEQ ID NO: 342550 - RNA, 64 nt, hsa; identical to SEQ ID NO: 106059

SEQ ID NO: 342551 - RNA, 64 nt, hsa; identical to SEQ ID NO: 106060

SEQ ID NO: 342552 - RNA, 64 nt, hsa; identical to SEQ ID NO: 106061

SEQ ID NO: 342553 - RNA, 64 nt, hsa; identical to SEQ ID NO: 106062

SEQ ID NO: 342554 - RNA, 64 nt, hsa; identical to SEQ ID NO: 106063

SEQ ID NO: 342555 - RNA, 64 nt, hsa; identical to SEQ ID NO: 106064

SEQ ID NO: 342556 - RNA, 64 nt, hsa; identical to SEQ ID NO: 106065

SEQ ID NO: 342557 - RNA, 64 nt, hsa; identical to SEQ ID NO: 106066

SEQ ID NO: 342558 - RNA, 64 nt, hsa; identical to SEQ ID NO: 106067

SEQ ID NO: 342559 - RNA, 64 nt, hsa; identical to SEQ ID NO: 106068

SEQ ID NO: 342560 - RNA, 64 nt, hsa; identical to SEQ ID NO: 106069

SEQ ID NO: 342561 - RNA, 64 nt, hsa; identical to SEQ ID NO: 106070

SEQ ID NO: 342562 - RNA, 64 nt, hsa; identical to SEQ ID NO: 106071

SEQ ID NO: 342563 - RNA, 64 nt, hsa; identical to SEQ ID NO: 106072

SEQ ID NO: 342564 - RNA, 64 nt, hsa; identical to SEQ ID NO: 106073

SEQ ID NO: 342565 - RNA, 64 nt, hsa; identical to SEQ ID NO: 106074

SEQ ID NO: 342566 - RNA, 64 nt, hsa; identical to SEQ ID NO: 106075

SEQ ID NO: 342567 - RNA, 64 nt, hsa; identical to SEQ ID NO: 106076

SEQ ID NO: 342568 - RNA, 64 nt, hsa; identical to SEQ ID NO: 106077

SEQ ID NO: 342569 - RNA, 64 nt, hsa; identical to SEQ ID NO: 106078

SEQ ID NO: 342570 - RNA, 64 nt, hsa; identical to SEQ ID NO: 106079

SEQ ID NO: 342571 - RNA, 64 nt, hsa; identical to SEQ ID NO: 106080

SEQ ID NO: 342572 - RNA, 64 nt, hsa; identical to SEQ ID NO: 106081

SEQ ID NO: 342573 - RNA, 64 nt, hsa; identical to SEQ ID NO: 106082

SEQ ID NO: 342574 - RNA, 64 nt, hsa; identical to SEQ ID NO: 106083

SEQ ID NO: 342575 - RNA, 64 nt, hsa; identical to SEQ ID NO: 106084

SEQ ID NO: 342576 - RNA, 64 nt, hsa; identical to SEQ ID NO: 106085

SEQ ID NO: 342577 - RNA, 64 nt, hsa; identical to SEQ ID NO: 106086

SEQ ID NO: 342578 - RNA, 64 nt, hsa; identical to SEQ ID NO: 106087

SEQ ID NO: 342579 - RNA, 64 nt, hsa; identical to SEQ ID NO: 106088

SEQ ID NO: 342580 - RNA, 64 nt, hsa; identical to SEQ ID NO: 56835

SEQ ID NO: 342581 - RNA, 64 nt, hsa; identical to SEQ ID NO: 56836

SEQ ID NO: 342582 - RNA, 64 nt, hsa; identical to SEQ ID NO: 56837

SEQ ID NO: 342583 - RNA, 64 nt, hsa; identical to SEQ ID NO: 56838

SEQ ID NO: 342584 - RNA, 64 nt, hsa; identical to SEQ ID NO: 56839

SEQ ID NO: 342585 - RNA, 64 nt, hsa; identical to SEQ ID NO: 56840

SEQ ID NO: 342586 - RNA, 64 nt, hsa; identical to SEQ ID NO: 56841

SEQ ID NO: 342587 - RNA, 64 nt, hsa
cuccaccagcaaggggaccccgagaacccugagcaggguccacagcuggaaaguugggccccug

SEQ ID NO: 342588 - RNA, 64 nt, hsa
gauucaccccccucugcugccggcucugggccugaggguccaccuggagaguacauuugcuuua

SEQ ID NO: 342589 - RNA, 64 nt, hsa
gcagggaggccccaggaggggaucuggccagucaaggguccacagggugccagccucucacccu

SEQ ID NO: 342590 - RNA, 64 nt, hsa
ccaugcuggggugcugcucagcuguuacaaaggcaggguccagccugcagggaggccccaggag

SEQ ID NO: 342591 - RNA, 64 nt, hsa; identical to SEQ ID NO: 183939

SEQ ID NO: 342592 - RNA, 64 nt, hsa; identical to SEQ ID NO: 183940

SEQ ID NO: 342593 - RNA, 64 nt, hsa; identical to SEQ ID NO: 183941

SEQ ID NO: 342594 - RNA, 64 nt, hsa; identical to SEQ ID NO: 183942

SEQ ID NO: 342595 - RNA, 64 nt, hsa; identical to SEQ ID NO: 183943

SEQ ID NO: 342596 - RNA, 64 nt, hsa; identical to SEQ ID NO: 183944

SEQ ID NO: 342597 - RNA, 64 nt, hsa; identical to SEQ ID NO: 183945

SEQ ID NO: 342598 - RNA, 64 nt, hsa; identical to SEQ ID NO: 183946

SEQ ID NO: 342599 - RNA, 64 nt, hsa; identical to SEQ ID NO: 183947

SEQ ID NO: 342600 - RNA, 64 nt, hsa; identical to SEQ ID NO: 183948

SEQ ID NO: 342601 - RNA, 64 nt, hsa; identical to SEQ ID NO: 183949

SEQ ID NO: 342602 - RNA, 64 nt, hsa; identical to SEQ ID NO: 183950

SEQ ID NO: 342603 - RNA, 64 nt, hsa; identical to SEQ ID NO: 183951

SEQ ID NO: 342604 - RNA, 64 nt, hsa; identical to SEQ ID NO: 183952

SEQ ID NO: 342605 - RNA, 64 nt, hsa; identical to SEQ ID NO: 183953

SEQ ID NO: 342606 - RNA, 64 nt, hsa; identical to SEQ ID NO: 183954

SEQ ID NO: 342607 - RNA, 64 nt, hsa; identical to SEQ ID NO: 183955

SEQ ID NO: 342608 - RNA, 64 nt, hsa; identical to SEQ ID NO: 183956

SEQ ID NO: 342609 - RNA, 64 nt, hsa; identical to SEQ ID NO: 183957

SEQ ID NO: 342610 - RNA, 64 nt, hsa; identical to SEQ ID NO: 183958

SEQ ID NO: 342611 - RNA, 64 nt, hsa; identical to SEQ ID NO: 183959

SEQ ID NO: 342612 - RNA, 64 nt, hsa; identical to SEQ ID NO: 183960

SEQ ID NO: 342613 - RNA, 64 nt, hsa; identical to SEQ ID NO: 183961

SEQ ID NO: 342614 - RNA, 64 nt, hsa; identical to SEQ ID NO: 183962

SEQ ID NO: 342615 - RNA, 64 nt, hsa; identical to SEQ ID NO: 183963

SEQ ID NO: 342616 - RNA, 64 nt, hsa; identical to SEQ ID NO: 183964

SEQ ID NO: 342617 - RNA, 64 nt, hsa; identical to SEQ ID NO: 183965

SEQ ID NO: 342618 - RNA, 64 nt, hsa; identical to SEQ ID NO: 183966

SEQ ID NO: 342619 - RNA, 64 nt, hsa; identical to SEQ ID NO: 324923

SEQ ID NO: 342620 - RNA, 64 nt, hsa; identical to SEQ ID NO: 324924

SEQ ID NO: 342621 - RNA, 64 nt, hsa; identical to SEQ ID NO: 324925

SEQ ID NO: 342622 - RNA, 64 nt, hsa; identical to SEQ ID NO: 324926

SEQ ID NO: 342623 - RNA, 64 nt, hsa; identical to SEQ ID NO: 324927

SEQ ID NO: 342624 - RNA, 64 nt, hsa; identical to SEQ ID NO: 324928

SEQ ID NO: 342625 - RNA, 64 nt, hsa; identical to SEQ ID NO: 324929

SEQ ID NO: 342626 - RNA, 64 nt, hsa; identical to SEQ ID NO: 324930

SEQ ID NO: 342627 - RNA, 64 nt, hsa; identical to SEQ ID NO: 324931

SEQ ID NO: 342628 - RNA, 64 nt, hsa; identical to SEQ ID NO: 324932

SEQ ID NO: 342629 - RNA, 64 nt, hsa; identical to SEQ ID NO: 324933

SEQ ID NO: 342630 - RNA, 64 nt, hsa; identical to SEQ ID NO: 324934

SEQ ID NO: 342631 - RNA, 64 nt, hsa; identical to SEQ ID NO: 324935

SEQ ID NO: 342632 - RNA, 64 nt, hsa; identical to SEQ ID NO: 324936

SEQ ID NO: 342633 - RNA, 64 nt, hsa; identical to SEQ ID NO: 324937

SEQ ID NO: 342634 - RNA, 64 nt, hsa; identical to SEQ ID NO: 324938

SEQ ID NO: 342635 - RNA, 64 nt, hsa; identical to SEQ ID NO: 324939

SEQ ID NO: 342636 - RNA, 64 nt, hsa; identical to SEQ ID NO: 324940

SEQ ID NO: 342637 - RNA, 64 nt, hsa; identical to SEQ ID NO: 324941

SEQ ID NO: 342638 - RNA, 64 nt, hsa; identical to SEQ ID NO: 324942

SEQ ID NO: 342639 - RNA, 64 nt, hsa; identical to SEQ ID NO: 324943

SEQ ID NO: 342640 - RNA, 64 nt, hsa; identical to SEQ ID NO: 324944

SEQ ID NO: 342641 - RNA, 64 nt, hsa; identical to SEQ ID NO: 324945

SEQ ID NO: 342642 - RNA, 64 nt, hsa; identical to SEQ ID NO: 324946

SEQ ID NO: 342643 - RNA, 64 nt, hsa; identical to SEQ ID NO: 324947

SEQ ID NO: 342644 - RNA, 64 nt, hsa; identical to SEQ ID NO: 324948

SEQ ID NO: 342645 - RNA, 59 nt, hsa; identical to SEQ ID NO: 324949

SEQ ID NO: 342646 - RNA, 64 nt, hsa; identical to SEQ ID NO: 324950

SEQ ID NO: 342647 - RNA, 64 nt, hsa; identical to SEQ ID NO: 324951

SEQ ID NO: 342648 - RNA, 64 nt, hsa; identical to SEQ ID NO: 324952

SEQ ID NO: 342649 - RNA, 64 nt, hsa; identical to SEQ ID NO: 324953

SEQ ID NO: 342650 - RNA, 64 nt, hsa; identical to SEQ ID NO: 324954

SEQ ID NO: 342651 - RNA, 64 nt, hsa; identical to SEQ ID NO: 324955

SEQ ID NO: 342652 - RNA, 64 nt, hsa
aucgaacaaauugaaaaucugaagaccgaugcugcaagcagaccauaugcagaugugcgaguua

SEQ ID NO: 342653 - RNA, 64 nt, hsa
uguuuugaagcaggauauggcaacggaacauccucaagcagagguaguaaaacaggaaagcagc

SEQ ID NO: 342654 - RNA, 64 nt, hsa
cuugaaugaagagaaugguggcagaaugagugagcaagcagauugccccagaggggccgguaau

SEQ ID NO: 342655 - RNA, 64 nt, hsa
uuuuuuauuuugauuuuauuaaaugggaagaaagcaagcagaaauaguaaaauucaguagguuu

SEQ ID NO: 342656 - RNA, 64 nt, hsa
cagagugagaaguuaaaauacccuuaaggagguucaagcagagugagaaguuaaaauacccuua

SEQ ID NO: 342657 - RNA, 64 nt, hsa
ucccugaauccuugcgucccgaaggacggagguucaagcagagugagaaguuaaaauacccuua

SEQ ID NO: 342658 - RNA, 64 nt, hsa
gcauggggcucugggggaaugcugggaaaaugggcaagcagagugcacagcccucguucugcca

SEQ ID NO: 342659 - RNA, 64 nt, hsa
uacuggacuuucaacuggcuuuccuuaggucaggcaagcagacagcuccccacugaagaggucu

SEQ ID NO: 342660 - RNA, 64 nt, hsa
ccacugcucuggccaaugggacugugcaagcacccaagcagaagggagacugagugccucagcc

SEQ ID NO: 342661 - RNA, 64 nt, hsa
uaucccuuucucucccaagcucuuugcugaagagcaagcagagggucccaaccgccugcuguac

SEQ ID NO: 342662 - RNA, 64 nt, hsa
cccagcagggcccuccgagguggagcagcagcuacaagcagaggcugaacaccugcggaaggag

SEQ ID NO: 342663 - RNA, 64 nt, hsa
cccagcagggcccuccgagguggaacagcagcuacaagcagaggcugaacaccugcggaaggag

SEQ ID NO: 342664 - RNA, 64 nt, hsa
cugcccgggagaaagcccaggccagccugcuggacaagcagagaccaugagaaggagaguucag

SEQ ID NO: 342665 - RNA, 64 nt, hsa
cagauuuuccuauuuuaauugcuuuagggaagagcaagcagagucaugaccagggacacagcug

SEQ ID NO: 342666 - RNA, 64 nt, hsa
uaauccagcaaagugauucccugcacaccagagacaagcagaguaacaggaucagugggucuaa

SEQ ID NO: 342667 - RNA, 64 nt, hsa
cacagccgcgggccaggaggcugccacacggaagcaagcagaugaacuaauuucauuucaaggc

SEQ ID NO: 342668 - RNA, 64 nt, hsa
uacuccacccucagcucuuccuugccugguuuaucaagcagagcugaggccccacguuuccaac

SEQ ID NO: 342669 - RNA, 64 nt, hsa
cuccuugucucucaacguauuggcuaugacgcagcaagcagaaugaauuuggacucaguuacag

SEQ ID NO: 342670 - RNA, 64 nt, hsa
gagcacucaguggaugacuauggagaagagccugcaagcagagaccaacuacccuuaggucuac

SEQ ID NO: 342671 - RNA, 64 nt, hsa
uuuguuggccaaugggacauuaacaaguaugauacaagcagaggcuugagaagugccugcacaa

SEQ ID NO: 342672 - RNA, 62 nt, hsa
uauacugugaagacuuuguuauaccuuauuugcuacaacauagaucauaucauugcuacuuu

SEQ ID NO: 342673 - RNA, 62 nt, hsa
agaaauagugagguaguaguuagucgucuuuccuacaacauuuuagcuuuugcccaucuaaa

SEQ ID NO: 342674 - RNA, 62 nt, hsa
uaaaaucauacauucugaacauuuuagucaagcuacaacagguuuggaaaaccucugugggg

SEQ ID NO: 342675 - RNA, 62 nt, hsa
uggaacgaagacuaaccucaccagccagucaucuacaacaaaucugccugguucuccgggau

SEQ ID NO: 342676 - RNA, 64 nt, hsa; identical to SEQ ID NO: 223145

SEQ ID NO: 342677 - RNA, 64 nt, hsa; identical to SEQ ID NO: 223146

SEQ ID NO: 342678 - RNA, 64 nt, hsa; identical to SEQ ID NO: 223147

SEQ ID NO: 342679 - RNA, 64 nt, hsa; identical to SEQ ID NO: 223148

SEQ ID NO: 342680 - RNA, 64 nt, hsa; identical to SEQ ID NO: 223149

SEQ ID NO: 342681 - RNA, 64 nt, hsa; identical to SEQ ID NO: 223150

SEQ ID NO: 342682 - RNA, 64 nt, hsa; identical to SEQ ID NO: 223151

SEQ ID NO: 342683 - RNA, 64 nt, hsa; identical to SEQ ID NO: 223152

SEQ ID NO: 342684 - RNA, 64 nt, hsa; identical to SEQ ID NO: 223153

SEQ ID NO: 342685 - RNA, 64 nt, hsa; identical to SEQ ID NO: 223154

SEQ ID NO: 342686 - RNA, 64 nt, hsa; identical to SEQ ID NO: 223155

SEQ ID NO: 342687 - RNA, 64 nt, hsa; identical to SEQ ID NO: 223156

SEQ ID NO: 342688 - RNA, 64 nt, hsa; identical to SEQ ID NO: 223157

SEQ ID NO: 342689 - RNA, 64 nt, hsa; identical to SEQ ID NO: 223158

SEQ ID NO: 342690 - RNA, 64 nt, hsa; identical to SEQ ID NO: 223159

SEQ ID NO: 342691 - RNA, 64 nt, hsa; identical to SEQ ID NO: 223160

SEQ ID NO: 342692 - RNA, 64 nt, hsa; identical to SEQ ID NO: 223161

SEQ ID NO: 342693 - RNA, 64 nt, hsa; identical to SEQ ID NO: 223162

SEQ ID NO: 342694 - RNA, 64 nt, hsa; identical to SEQ ID NO: 223163

SEQ ID NO: 342695 - RNA, 64 nt, hsa; identical to SEQ ID NO: 223164

SEQ ID NO: 342696 - RNA, 64 nt, hsa; identical to SEQ ID NO: 223165

SEQ ID NO: 342697 - RNA, 64 nt, hsa; identical to SEQ ID NO: 223166

SEQ ID NO: 342698 - RNA, 64 nt, hsa; identical to SEQ ID NO: 223167

SEQ ID NO: 342699 - RNA, 64 nt, hsa; identical to SEQ ID NO: 223168

SEQ ID NO: 342700 - RNA, 64 nt, hsa; identical to SEQ ID NO: 223169

SEQ ID NO: 342701 - RNA, 64 nt, hsa; identical to SEQ ID NO: 223170

SEQ ID NO: 342702 - RNA, 64 nt, hsa; identical to SEQ ID NO: 223171

SEQ ID NO: 342703 - RNA, 64 nt, hsa; identical to SEQ ID NO: 223172

SEQ ID NO: 342704 - RNA, 64 nt, hsa; identical to SEQ ID NO: 223173

SEQ ID NO: 342705 - RNA, 64 nt, hsa; identical to SEQ ID NO: 223174

SEQ ID NO: 342706 - RNA, 64 nt, hsa; identical to SEQ ID NO: 223175

SEQ ID NO: 342707 - RNA, 64 nt, hsa; identical to SEQ ID NO: 223176

SEQ ID NO: 342708 - RNA, 64 nt, hsa; identical to SEQ ID NO: 223177

SEQ ID NO: 342709 - RNA, 64 nt, hsa; identical to SEQ ID NO: 223178

SEQ ID NO: 342710 - RNA, 64 nt, hsa; identical to SEQ ID NO: 223179

SEQ ID NO: 342711 - RNA, 64 nt, hsa; identical to SEQ ID NO: 223180

SEQ ID NO: 342712 - RNA, 64 nt, hsa; identical to SEQ ID NO: 223181

SEQ ID NO: 342713 - RNA, 64 nt, hsa; identical to SEQ ID NO: 223182

SEQ ID NO: 342714 - RNA, 64 nt, hsa; identical to SEQ ID NO: 223183

SEQ ID NO: 342715 - RNA, 64 nt, hsa; identical to SEQ ID NO: 223184

SEQ ID NO: 342716 - RNA, 64 nt, hsa; identical to SEQ ID NO: 223185

SEQ ID NO: 342717 - RNA, 64 nt, hsa; identical to SEQ ID NO: 223186

SEQ ID NO: 342718 - RNA, 64 nt, hsa; identical to SEQ ID NO: 223187

SEQ ID NO: 342719 - RNA, 64 nt, hsa; identical to SEQ ID NO: 223188

SEQ ID NO: 342720 - RNA, 64 nt, hsa; identical to SEQ ID NO: 223189

SEQ ID NO: 342721 - RNA, 64 nt, hsa; identical to SEQ ID NO: 223190

SEQ ID NO: 342722 - RNA, 64 nt, hsa; identical to SEQ ID NO: 223191

SEQ ID NO: 342723 - RNA, 64 nt, hsa; identical to SEQ ID NO: 223192

SEQ ID NO: 342724 - RNA, 64 nt, hsa; identical to SEQ ID NO: 223193

SEQ ID NO: 342725 - RNA, 64 nt, hsa; identical to SEQ ID NO: 223194

SEQ ID NO: 342726 - RNA, 64 nt, hsa; identical to SEQ ID NO: 223195

SEQ ID NO: 342727 - RNA, 57 nt, hsa; identical to SEQ ID NO: 223196

SEQ ID NO: 342728 - RNA, 64 nt, hsa; identical to SEQ ID NO: 223197

SEQ ID NO: 342729 - RNA, 54 nt, hsa; identical to SEQ ID NO: 223198

SEQ ID NO: 342730 - RNA, 64 nt, hsa; identical to SEQ ID NO: 237917

SEQ ID NO: 342731 - RNA, 64 nt, hsa; identical to SEQ ID NO: 237918

SEQ ID NO: 342732 - RNA, 64 nt, hsa; identical to SEQ ID NO: 237919

SEQ ID NO: 342733 - RNA, 64 nt, hsa; identical to SEQ ID NO: 237920

SEQ ID NO: 342734 - RNA, 64 nt, hsa; identical to SEQ ID NO: 237921

SEQ ID NO: 342735 - RNA, 64 nt, hsa; identical to SEQ ID NO: 237922

SEQ ID NO: 342736 - RNA, 64 nt, hsa; identical to SEQ ID NO: 237923

SEQ ID NO: 342737 - RNA, 64 nt, hsa; identical to SEQ ID NO: 237924

SEQ ID NO: 342738 - RNA, 64 nt, hsa; identical to SEQ ID NO: 237925

SEQ ID NO: 342739 - RNA, 64 nt, hsa; identical to SEQ ID NO: 237926

SEQ ID NO: 342740 - RNA, 64 nt, hsa; identical to SEQ ID NO: 237927

SEQ ID NO: 342741 - RNA, 64 nt, hsa; identical to SEQ ID NO: 237928

SEQ ID NO: 342742 - RNA, 64 nt, hsa; identical to SEQ ID NO: 237927

SEQ ID NO: 342743 - RNA, 64 nt, hsa; identical to SEQ ID NO: 237930

SEQ ID NO: 342744 - RNA, 64 nt, hsa; identical to SEQ ID NO: 237931

SEQ ID NO: 342745 - RNA, 64 nt, hsa; identical to SEQ ID NO: 237932

SEQ ID NO: 342746 - RNA, 64 nt, hsa; identical to SEQ ID NO: 237933

SEQ ID NO: 342747 - RNA, 64 nt, hsa; identical to SEQ ID NO: 237934

SEQ ID NO: 342748 - RNA, 64 nt, hsa; identical to SEQ ID NO: 237935

SEQ ID NO: 342749 - RNA, 64 nt, hsa; identical to SEQ ID NO: 237936

SEQ ID NO: 342750 - RNA, 64 nt, hsa; identical to SEQ ID NO: 237937

SEQ ID NO: 342751 - RNA, 64 nt, hsa; identical to SEQ ID NO: 237938

SEQ ID NO: 342752 - RNA, 64 nt, hsa; identical to SEQ ID NO: 237939

SEQ ID NO: 342753 - RNA, 64 nt, hsa; identical to SEQ ID NO: 237940

SEQ ID NO: 342754 - RNA, 64 nt, hsa; identical to SEQ ID NO: 237941

SEQ ID NO: 342755 - RNA, 64 nt, hsa; identical to SEQ ID NO: 237942

SEQ ID NO: 342756 - RNA, 64 nt, hsa; identical to SEQ ID NO: 237943

SEQ ID NO: 342757 - RNA, 64 nt, hsa; identical to SEQ ID NO: 237944

SEQ ID NO: 342758 - RNA, 64 nt, hsa; identical to SEQ ID NO: 237945

SEQ ID NO: 342759 - RNA, 64 nt, hsa; identical to SEQ ID NO: 237946

SEQ ID NO: 342760 - RNA, 64 nt, hsa; identical to SEQ ID NO: 237947

SEQ ID NO: 342761 - RNA, 64 nt, hsa; identical to SEQ ID NO: 237948

SEQ ID NO: 342762 - RNA, 64 nt, hsa; identical to SEQ ID NO: 237949

SEQ ID NO: 342763 - RNA, 64 nt, hsa; identical to SEQ ID NO: 237950

SEQ ID NO: 342764 - RNA, 64 nt, hsa; identical to SEQ ID NO: 237951

SEQ ID NO: 342765 - RNA, 64 nt, hsa; identical to SEQ ID NO: 237952

SEQ ID NO: 342766 - RNA, 64 nt, hsa; identical to SEQ ID NO: 237953

SEQ ID NO: 342767 - RNA, 64 nt, hsa; identical to SEQ ID NO: 237954

SEQ ID NO: 342768 - RNA, 64 nt, hsa; identical to SEQ ID NO: 237955

SEQ ID NO: 342769 - RNA, 64 nt, hsa; identical to SEQ ID NO: 237956

SEQ ID NO: 342770 - RNA, 64 nt, hsa; identical to SEQ ID NO: 237957

SEQ ID NO: 342771 - RNA, 64 nt, hsa; identical to SEQ ID NO: 237958

SEQ ID NO: 342772 - RNA, 64 nt, hsa; identical to SEQ ID NO: 237959

SEQ ID NO: 342773 - RNA, 64 nt, hsa; identical to SEQ ID NO: 237960

SEQ ID NO: 342774 - RNA, 64 nt, hsa; identical to SEQ ID NO: 237961

SEQ ID NO: 342775 - RNA, 64 nt, hsa; identical to SEQ ID NO: 237962

SEQ ID NO: 342776 - RNA, 64 nt, hsa; identical to SEQ ID NO: 237963

SEQ ID NO: 342777 - RNA, 64 nt, hsa; identical to SEQ ID NO: 237964

SEQ ID NO: 342778 - RNA, 64 nt, hsa; identical to SEQ ID NO: 237965

SEQ ID NO: 342779 - RNA, 64 nt, hsa; identical to SEQ ID NO: 237966

SEQ ID NO: 342780 - RNA, 64 nt, hsa; identical to SEQ ID NO: 237967

SEQ ID NO: 342781 - RNA, 64 nt, hsa; identical to SEQ ID NO: 218345

SEQ ID NO: 342782 - RNA, 64 nt, hsa; identical to SEQ ID NO: 218346

SEQ ID NO: 342783 - RNA, 64 nt, hsa; identical to SEQ ID NO: 218347

SEQ ID NO: 342784 - RNA, 64 nt, hsa; identical to SEQ ID NO: 218348

SEQ ID NO: 342785 - RNA, 64 nt, hsa; identical to SEQ ID NO: 218349

SEQ ID NO: 342786 - RNA, 64 nt, hsa; identical to SEQ ID NO: 218350

SEQ ID NO: 342787 - RNA, 64 nt, hsa; identical to SEQ ID NO: 218351

SEQ ID NO: 342788 - RNA, 64 nt, hsa; identical to SEQ ID NO: 218352

SEQ ID NO: 342789 - RNA, 64 nt, hsa; identical to SEQ ID NO: 218353

SEQ ID NO: 342790 - RNA, 64 nt, hsa; identical to SEQ ID NO: 218354

SEQ ID NO: 342791 - RNA, 64 nt, hsa; identical to SEQ ID NO: 218355

SEQ ID NO: 342792 - RNA, 64 nt, hsa; identical to SEQ ID NO: 218356

SEQ ID NO: 342793 - RNA, 64 nt, hsa; identical to SEQ ID NO: 218357

SEQ ID NO: 342794 - RNA, 64 nt, hsa; identical to SEQ ID NO: 218358

SEQ ID NO: 342795 - RNA, 64 nt, hsa; identical to SEQ ID NO: 218359

SEQ ID NO: 342796 - RNA, 64 nt, hsa; identical to SEQ ID NO: 218360

SEQ ID NO: 342797 - RNA, 64 nt, hsa; identical to SEQ ID NO: 218361

SEQ ID NO: 342798 - RNA, 64 nt, hsa; identical to SEQ ID NO: 218362

SEQ ID NO: 342799 - RNA, 60 nt, hsa
aagugucacaccaccucccucagcacuuccccaucacaacaaccuaugucacugacucag

SEQ ID NO: 342800 - RNA, 60 nt, hsa
ugauuagaucgggucucggaagggaaguagccaucacaccauuaaaaagccuguggaccu

SEQ ID NO: 342801 - RNA, 60 nt, hsa
gacugcaccagaguucugaagggaucuuaaccaucacaaguuuuuacccucuuccuucau

SEQ ID NO: 342802 - RNA, 60 nt, hsa
gccuuuucccuuccuauuucacuuugccucccaucacacaacugcguguaaaugguguca

SEQ ID NO: 342803 - RNA, 60 nt, hsa
ggcccuugguaucaagugagguaaauucacccaucacagggucucgcccuaccauccugg

SEQ ID NO: 342804 - RNA, 60 nt, hsa
ccgcuaugcagucuggugagagggagacagccaucacauagaaagugaccguacggguuu

SEQ ID NO: 342805 - RNA, 60 nt, hsa
acaagguuggaugccuacuuaugagcuugaccaucacagcuaucgguaaucagaaauaug

SEQ ID NO: 342806 - RNA, 60 nt, hsa
auuugaauaucacuuccccucugcauuuucccaucacauagaagacuuugaccugugaag

SEQ ID NO: 342807 - RNA, 60 nt, hsa
uuaauucugaaguuggaguuggugccccugccaucacaaacaacacgagagccaauugug

SEQ ID NO: 342808 - RNA, 60 nt, hsa
uucagcuuauucaccccacccccccaccccccaucacacgugcuccugugaacuuuccau

SEQ ID NO: 342809 - RNA, 60 nt, hsa
ccacuucagcacaccuugccccaccugggaccaucacacgugaagcaccaggcugggaga

SEQ ID NO: 342810 - RNA, 60 nt, hsa
uuccaccaccucuccggcugccccugcccuccaucacagacagcagagccgggcagcuuu

SEQ ID NO: 342811 - RNA, 64 nt, hsa
agagaucugggccucauguagcucaccccggucacgcaugaaggcaaaagcaggucagaagcga

SEQ ID NO: 342812 - RNA, 64 nt, hsa
ggaagagaccauaaaggcuucaaaacuagaagugcgcaugaaggaugcuucaugcccuguuccc

SEQ ID NO: 342813 - RNA, 64 nt, hsa
gucccagugaagugccagguuugauugugaaguccgcaugaaacacugcaccaggcagggcuuu

SEQ ID NO: 342814 - RNA, 64 nt, hsa
gauccggaacgucagccagcucccagccacauggcgcaugaaggagagcccagucucccuccag

SEQ ID NO: 342815 - RNA, 64 nt, hsa
accagccaugcacccgcccagccaccacgucccccgcaugaauguacuguacacuuucaauccu

SEQ ID NO: 342816 - RNA, 64 nt, hsa
gaaccauuuuguagaagaaggaacgaugacaggucgcaugaagaucagccucuaguacugauga

SEQ ID NO: 342817 - RNA, 64 nt, hsa
gucuauguaaagucacaaauuaaugaaaaaaauucgcaugaaaaugacagauaacacuguaguu

SEQ ID NO: 342818 - RNA, 64 nt, hsa
uucccauuggaaaguggcagcuaaacauuaaauucgcaugaaccacagaugcuggagaucacca

SEQ ID NO: 342819 - RNA, 64 nt, hsa
acuacuuacgcagggagaugcaggucucucuaaacgcaugaauguauguaguguguaggcacug

SEQ ID NO: 342820 - RNA, 64 nt, hsa
ucuguuauucaaugauguauauacucccacagcucgcaugaaggaacagccucuauugauacuu

SEQ ID NO: 342821 - RNA, 64 nt, hsa
uuuaauucauguugccuugcauaauggucagaggcgcaugaauuugugaagguggaaauaaacu

SEQ ID NO: 342822 - RNA, 64 nt, hsa
cucuucuaacauuuaaggaauagagccuaauuagcgcaugaauacguguugaacugugaaugaa

SEQ ID NO: 342823 - RNA, 64 nt, hsa
guuuguugcuuacaguuugacaacuuaaaugcugcgcaugaaaccucuaaguuggaaauugaag

SEQ ID NO: 342824 - RNA, 64 nt, hsa
agauuuaguaacugauuuuuuagacacugccuaucgcaugaacuguaaagcuguguguauuagg

SEQ ID NO: 342825 - RNA, 64 nt, hsa
aguucguucuuguguuugaccuaagaaugauugucgcaugaaguguuuguuuuuacaguuuagc

SEQ ID NO: 342826 - RNA, 64 nt, hsa
aaucuacugaacaaauauugggauaacuccaaaccgcaugaaaggguguaauugcagcaugagu

SEQ ID NO: 342827 - RNA, 64 nt, hsa
acuacugaccuguuguaggcagcuaucuuacagacgcaugaauguaagaguaggaagggguggg

SEQ ID NO: 342828 - RNA, 64 nt, hsa
ugagcaggucagauucaaggcagugaggucaggccgcaugaaccuggaggggaaucggggacuu

SEQ ID NO: 342829 - RNA, 64 nt, hsa
ugaauuaaauauccaguuacuugaauggguauaacgcaugaauauuugugugucugugugugug

SEQ ID NO: 342830 - RNA, 64 nt, hsa
agguguuuguuaaagagccuucucuuguguguuacgcaugaacuuuggucuguagguguuaaau

SEQ ID NO: 342831 - RNA, 64 nt, hsa
uuggucaugacagugugccugucccacuguuacacgcaugaauggggguuauggggugggggug

SEQ ID NO: 342832 - RNA, 64 nt, hsa
acaaagggaaagccucuggccgucacacguaggacgcaugaaggucacucguggugaggcugac

SEQ ID NO: 342833 - RNA, 64 nt, hsa
aggucggagcugugaggacuuccagaacuggaaacgcaugaacgacccagaauaccaggcccag

SEQ ID NO: 342834 - RNA, 64 nt, hsa
guauggugaccucuccggccuggccuuuuccauucgcaugaacaaugggagcacauagcccugu

SEQ ID NO: 342835 - RNA, 64 nt, hsa
uacuuuuuguauaaaccgacgaacagcugaugaccgcaugaaugcucacacaaggggaaagggc

SEQ ID NO: 342836 - RNA, 64 nt, hsa
cagagcuggcuggcucagcuaaguggcacgaugacgcaugaaggagauuauguugugcucuuua

SEQ ID NO: 342837 - RNA, 64 nt, hsa
uaagugcaguggggguaagcaguccugugaguggcgcaugaacgcuggagcuuauuccgccgcc

SEQ ID NO: 342838 - RNA, 64 nt, hsa
uccccaggaccccauccuguucucggggacccugcgcaugaaccuggaccccuucggcagcuac

SEQ ID NO: 342839 - RNA, 64 nt, hsa
gcccaccaacgagucccggcuucgaguagugauacgcaugaacaaagccauauccuuuugcagu

SEQ ID NO: 342840 - RNA, 64 nt, hsa
ggagaggcagaucaagauaugguuccagaaccgacgcaugaaguggaaaaaggagagcaaacug

SEQ ID NO: 342841 - RNA, 64 nt, hsa
uuagucugacuugacuauuguuuuuccuuucuggcgcaugaauccauacaucauuccuggaagu

SEQ ID NO: 342842 - RNA, 64 nt, hsa
ucggaguccuuggugguugaacuuggagaaagaccgcaugaagauacuuguaagcacacaugau

SEQ ID NO: 342843 - RNA, 64 nt, hsa
aguaguucuugacccgaggucgcccugaaggugucgcaugaagagcuugcuucacacacaacag

SEQ ID NO: 342844 - RNA, 62 nt, hsa
ccuuucauccggcagagccuuccugcguuugcagcagagaggaggccccacagcuugcccuu

SEQ ID NO: 342845 - RNA, 62 nt, hsa
gguggcaaaauggcacugaauauccccuuggcagcagagaaaacccacugaaagaucguaga

SEQ ID NO: 342846 - RNA, 62 nt, hsa
cccuuaccccaaauucauugagcacuuaaaggagcagagaugcagccagugucugggcuccc

SEQ ID NO: 342847 - RNA, 62 nt, hsa
agcugccagagugcacuggggggaauguucucagcagagaagaaugaggagaaguuuaauau

SEQ ID NO: 342848 - RNA, 62 nt, hsa
guaagggaugagaaggauggcggggcuagggaagcagagagcagagcacacacuggcucaag

SEQ ID NO: 342849 - RNA, 62 nt, hsa
gugaggaaacuuuuaggugguggaaccagggaagcagagagcagagcaugcagugauggaag

SEQ ID NO: 342850 - RNA, 62 nt, hsa
cugcaggaacaagugggcuuggggaauugaauagcagagagcaaaccaaucagucccucagg

SEQ ID NO: 342851 - RNA, 62 nt, hsa
ugacuaucaguggcaaaaaagaacaaaaucugagcagagaugauuuugaaccagauauuuug

SEQ ID NO: 342852 - RNA, 62 nt, hsa
ucgcuugaacccuggagauggagguugcagugagcagagaucgcaccacugcacuccagccu

SEQ ID NO: 342853 - RNA, 62 nt, hsa
cuuccuguucugccuucaccuaugccgggauaagcagagaucucaucaauuagcucuucucu

SEQ ID NO: 342854 - RNA, 62 nt, hsa
uaucaagccuggaugcagcugcugcugcuuagagcagagaugaagaaaguguucugcauaag

SEQ ID NO: 342855 - RNA, 62 nt, hsa
ggccagcuugugccuaauagaagguugagaccagcagagacugcugugaguuucucccggcu

SEQ ID NO: 342856 - RNA, 62 nt, hsa
cucggauucuuuugcaugaugggguaaagcuuagcagagaaucaugggagcuaaccuuuauc

SEQ ID NO: 342857 - RNA, 62 nt, hsa
uacuauuuuggcugcucuuggggacugcgagaagcagagagaaugagagaccaguggcaacu

SEQ ID NO: 342858 - RNA, 62 nt, hsa
gagaaugagagaccaguggcaacugccugcacagcagagauaacccucuucccuugcuuccu

SEQ ID NO: 342859 - RNA, 62 nt, hsa
ccucuggggaagagagggaagagaaagcacagagcagagaagcagagauguuccuugaacug

SEQ ID NO: 342860 - RNA, 62 nt, hsa
gaagagagggaagagaaagcacagagcagagaagcagagauguuccuugaacugcccacaag

SEQ ID NO: 342861 - RNA, 62 nt, hsa
gucauacacgaagggcguguggccaucgugucagcagagagagucucuguacacagccccgu

SEQ ID NO: 342862 - RNA, 62 nt, hsa
gucauacgcgaaggccauauggccaucgugucagcagagagagucucuguacacagccccgu

SEQ ID NO: 342863 - RNA, 62 nt, hsa
gucucaccaggaaauucuguuuauguucuugcagcagagagaaauaaaacuccuugaaacca

SEQ ID NO: 342864 - RNA, 54 nt, hsa
gccacuggcucaagguguagagggagcagagacgaagaccccaggaagucaucc

SEQ ID NO: 342865 - RNA, 62 nt, hsa
gaggagggggaaagggucuuaauucuauguacagcagagacauuaaacuugcuguguccggg

SEQ ID NO: 342866 - RNA, 62 nt, hsa
ggcuuaacuccuaagccccugcccagcaccacagcagagaucacacacugacccuccgcccu

SEQ ID NO: 342867 - RNA, 62 nt, hsa
gcauugggauggguggagaaagacgacaagagagcagagaaucugcugauguggcugcgcuu

SEQ ID NO: 342868 - RNA, 62 nt, hsa
aucuggaauccuagcagucacuacauuaucucagcagagagacuuuaauuaaacugauuugu

SEQ ID NO: 342869 - RNA, 62 nt, hsa
ugcggcagcaggggggugggaagggaggguaaagcagagagaauguauucacaggaggccau

SEQ ID NO: 342870 - RNA, 62 nt, hsa
ugugccuugccugacagaauugcuuagaaaggagcagagaaggacgggagcuggcguagcuc

SEQ ID NO: 342871 - RNA, 62 nt, hsa
ugugguuacagcgccccucaguguucaucuccagcagagacaacggaggaggcucccaccag

SEQ ID NO: 342872 - RNA, 62 nt, hsa
uacucacagcccccgggcucuacccugggcacagcagagacagacuggugguugaaccugga

SEQ ID NO: 342873 - RNA, 62 nt, hsa
uggccccgaaucauagcucccugagagggccaagcagagaguacuggaaaccucccuaccaa

SEQ ID NO: 342874 - RNA, 62 nt, hsa
uuugggccgauguauuuuaaagcagaguggacagcagagagucaauuucccuuucguuggga

SEQ ID NO: 342875 - RNA, 62 nt, hsa
uugcacuggggagguggcugcuggcuggcccaagcagagagcugaggcauccaagaaauguu

SEQ ID NO: 342876 - RNA, 62 nt, hsa
uuuacuucauaccccaggaccccuuccccagcagcagagacccuggagcacaggagaguagg

SEQ ID NO: 342877 - RNA, 62 nt, hsa
agcccucuccuacggcgcuagggagcacuggaagcagagaugccagcccuggcugagcguag

SEQ ID NO: 342878 - RNA, 62 nt, hsa
caucaccggccuucuccuggcaggagaggaggagcagagagcuggguccugggcugggauuc

SEQ ID NO: 342879 - RNA, 62 nt, hsa
gggccaggaggugccuuggagaagccagccagagcagagagggcugcugacuuccgugugga

SEQ ID NO: 342880 - RNA, 62 nt, hsa
cagagcagagagggcugcugacuuccguguggagcagagaggccugagggccuccuaaaagg

SEQ ID NO: 342881 - RNA, 62 nt, hsa
cacaaugguacugaauuugcaucugcacagucagcagagauaacaaguguugaacugaccuu

SEQ ID NO: 342882 - RNA, 62 nt, hsa
gacuccgcacugccccucaacagggaugacucagcagagaugacucagcacugucccuuagc

SEQ ID NO: 342883 - RNA, 62 nt, hsa
ccucagcaaggaugacucagcagggaugauucagcagagauaacucggggaugacucugauu

SEQ ID NO: 342884 - RNA, 62 nt, hsa
uccuuaggaaguggagcuacauggaugaugugagcagagacgcauaacauccaauucugaga

SEQ ID NO: 342885 - RNA, 62 nt, hsa
uuuuaaucauuagguuuuagauuuccuuuagcagcagagacugacuugcuguauagagggaa

SEQ ID NO: 342886 - RNA, 62 nt, hsa
uauccacagucuguuccuguucugauauucugagcagagaaaaggcacuaacgguuccucuu

SEQ ID NO: 342887 - RNA, 62 nt, hsa
ucucaggguggaccacucugugucugucuccaagcagagaccaguaaaggagccuccugguc

SEQ ID NO: 342888 - RNA, 62 nt, hsa
ugucaccacacccagcucaguauuguauuuuuagcagagaugggguuucaccauuuugccca

SEQ ID NO: 342889 - RNA, 62 nt, hsa
cagagcgcuggggacuccagacuccccacagcagcagagacucgggacugaggcauccucug

SEQ ID NO: 342890 - RNA, 62 nt, hsa
gucgagcagcaggggcccauucagucccagggagcagagacccccccaaccccuucacaaac

SEQ ID NO: 342891 - RNA, 62 nt, hsa
gcucaguuucugcccccaggagaggauccuucagcagagaggagcugacaggguaccugcuc

SEQ ID NO: 342892 - RNA, 62 nt, hsa
aggacaccagagcccaccagacagugccggccagcagagaagcagagagccagcgccacaca

SEQ ID NO: 342893 - RNA, 62 nt, hsa
agagcccaccagacagugccggccagcagagaagcagagagccagcgccacacaacaucaag

SEQ ID NO: 342894 - RNA, 64 nt, hsa; identical to SEQ ID NO: 301795

SEQ ID NO: 342895 - RNA, 64 nt, hsa; identical to SEQ ID NO: 301796

SEQ ID NO: 342896 - RNA, 64 nt, hsa; identical to SEQ ID NO: 301797

SEQ ID NO: 342897 - RNA, 64 nt, hsa; identical to SEQ ID NO: 301798

SEQ ID NO: 342898 - RNA, 64 nt, hsa; identical to SEQ ID NO: 301799

SEQ ID NO: 342899 - RNA, 64 nt, hsa; identical to SEQ ID NO: 301800

SEQ ID NO: 342900 - RNA, 64 nt, hsa; identical to SEQ ID NO: 301801

SEQ ID NO: 342901 - RNA, 64 nt, hsa; identical to SEQ ID NO: 301802

SEQ ID NO: 342902 - RNA, 64 nt, hsa; identical to SEQ ID NO: 301803

SEQ ID NO: 342903 - RNA, 64 nt, hsa; identical to SEQ ID NO: 286103

SEQ ID NO: 342904 - RNA, 64 nt, hsa; identical to SEQ ID NO: 286104

SEQ ID NO: 342905 - RNA, 64 nt, hsa; identical to SEQ ID NO: 286105

SEQ ID NO: 342906 - RNA, 64 nt, hsa; identical to SEQ ID NO: 286106

SEQ ID NO: 342907 - RNA, 64 nt, hsa; identical to SEQ ID NO: 286107

SEQ ID NO: 342908 - RNA, 64 nt, hsa; identical to SEQ ID NO: 286108

SEQ ID NO: 342909 - RNA, 64 nt, hsa; identical to SEQ ID NO: 286109

SEQ ID NO: 342910 - RNA, 64 nt, hsa; identical to SEQ ID NO: 286110

SEQ ID NO: 342911 - RNA, 64 nt, hsa; identical to SEQ ID NO: 286111

SEQ ID NO: 342912 - RNA, 64 nt, hsa; identical to SEQ ID NO: 286112

SEQ ID NO: 342913 - RNA, 64 nt, hsa; identical to SEQ ID NO: 286113

SEQ ID NO: 342914 - RNA, 64 nt, hsa; identical to SEQ ID NO: 286114

SEQ ID NO: 342915 - RNA, 64 nt, hsa; identical to SEQ ID NO: 286115

SEQ ID NO: 342916 - RNA, 64 nt, hsa; identical to SEQ ID NO: 286116

SEQ ID NO: 342917 - RNA, 64 nt, hsa; identical to SEQ ID NO: 286117

SEQ ID NO: 342918 - RNA, 64 nt, hsa; identical to SEQ ID NO: 286118

SEQ ID NO: 342919 - RNA, 64 nt, hsa; identical to SEQ ID NO: 286119

SEQ ID NO: 342920 - RNA, 64 nt, hsa; identical to SEQ ID NO: 286120

SEQ ID NO: 342921 - RNA, 64 nt, hsa; identical to SEQ ID NO: 286121

SEQ ID NO: 342922 - RNA, 64 nt, hsa; identical to SEQ ID NO: 286122

SEQ ID NO: 342923 - RNA, 64 nt, hsa; identical to SEQ ID NO: 286123

SEQ ID NO: 342924 - RNA, 64 nt, hsa; identical to SEQ ID NO: 286124

SEQ ID NO: 342925 - RNA, 64 nt, hsa; identical to SEQ ID NO: 150696

SEQ ID NO: 342926 - RNA, 64 nt, hsa; identical to SEQ ID NO: 150697

SEQ ID NO: 342927 - RNA, 64 nt, hsa; identical to SEQ ID NO: 150698

SEQ ID NO: 342928 - RNA, 64 nt, hsa; identical to SEQ ID NO: 150699

SEQ ID NO: 342929 - RNA, 62 nt, hsa
ugcuuuaugucacuuacacggucaccuggagccggcucaaguggcuaaagcauccuggggcc

SEQ ID NO: 342930 - RNA, 62 nt, hsa
gucgcccaggcuagaguggauuggcgugaucucggcucaaugcaaaucuccaggguucaauc

SEQ ID NO: 342931 - RNA, 64 nt, hsa
gacucuuuuaaggguauuuuaaaaauuaguaaauuugaaugaacuaaagauauaucucuaccuu

SEQ ID NO: 342932 - RNA, 64 nt, hsa
uagauuaauucacuaagauuuuauuagagauuguuugaaugaugcauguuauugacaaggcaaa

SEQ ID NO: 342933 - RNA, 64 nt, hsa
aggguuuguauucugcuaaaaggagaugccaauguugaaugaagucugaaacucuaguaugugc

SEQ ID NO: 342934 - RNA, 64 nt, hsa
uauuuuuuaaacugugauaauacaacagauagcuuugaaugaucugccauaacaugugguaaca

SEQ ID NO: 342935 - RNA, 64 nt, hsa
uuuggagaauucauaacauuugaagaucaaaaaauugaaugauaaauaugaauggcuuuucaau

SEQ ID NO: 342936 - RNA, 64 nt, hsa
acauauguuguugcuaaacagcucaguaacacacuugaaugaauuuggauaccagauuguccuc

SEQ ID NO: 342937 - RNA, 64 nt, hsa
uuaaaaugacaguaaauauuacuaaggcaguauuuugaaugaguuugacacugccggcuuccuu

SEQ ID NO: 342938 - RNA, 64 nt, hsa
uuguuagaaucacaggaggcaaaaaauggaacgguugaaugaaauuuuacucuuucugugaaag

SEQ ID NO: 342939 - RNA, 64 nt, hsa
agagaaaaaaugguaaugugugccuuuauugaacuugaaugacagaacuugaaauuuuuaacac

SEQ ID NO: 342940 - RNA, 64 nt, hsa
cuuaauuauuaucaguuuaaauuuuuuuuguuuguugaaugacaaaggcaauaaaaauaaauuu

SEQ ID NO: 342941 - RNA, 64 nt, hsa
uaaaauauaauaauguuuucauuacuuuuauuauuugaaugauuuaguaaaguugacugaaucu

SEQ ID NO: 342942 - RNA, 64 nt, hsa
uguuaauauaauguguaaagggagauuaaaaaguuugaaugauuauccuaccauguagucauua

SEQ ID NO: 342943 - RNA, 64 nt, hsa
ugguaggggcuuaaaagaaacuauaaaguuuuauuugaaugaacacuaugcacugcuguaacug

SEQ ID NO: 342944 - RNA, 64 nt, hsa
ucuggaacaaauuuguaggaaaaaauuacuccaauugaaugacugauguauguaaucaacuuca

SEQ ID NO: 342945 - RNA, 64 nt, hsa
agguucuaaaggaauugaaaagagacgauaaacauugaaugagggugagggcaucccugcuggg

SEQ ID NO: 342946 - RNA, 64 nt, hsa
uugaaauaagacaucgugaaaaucuugaccauuguugaaugagccagggugugaaguuuuuaau

SEQ ID NO: 342947 - RNA, 64 nt, hsa
agagucccucuggaaccauauaaaguuccuggcuuugaaugaaccagaaguguuugcccacaca

SEQ ID NO: 342948 - RNA, 64 nt, hsa
auuuuuccagcuuuaagugccuauauaugauuauuugaaugaagaggaguaggaaggaaaaugg

SEQ ID NO: 342949 - RNA, 64 nt, hsa
cuauuuaaaacagugaauuaaauuuucacuagguuugaaugaucauguuuuauaagaaaugucu

SEQ ID NO: 342950 - RNA, 64 nt, hsa
ugcaaagauucacauaguuuauuucaacuauuuauugaaugauuacuauaugcaaaacucugug

SEQ ID NO: 342951 - RNA, 64 nt, hsa
uaagauucuuaaauuugggccucuuagaauaauuuugaaugagaucuaccgacucacuugugag

SEQ ID NO: 342952 - RNA, 64 nt, hsa
uugauauuuuacugccuuuccuuuuaauuuuuguuugaaugagaaaaguuuaauacaacaggug

SEQ ID NO: 342953 - RNA, 64 nt, hsa
auccagcacaaucauaaagugaaugacaaacccuuugaaugaaauuguggcacaaaaucuguuc

SEQ ID NO: 342954 - RNA, 64 nt, hsa
uuuuccccccaaguuagucuuaaaucuuuuggguuugaaugaagguuuuacauaagaaauuauu

SEQ ID NO: 342955 - RNA, 64 nt, hsa
acuuuauuuacauacuacauaagguagcaaacuguugaaugaguuugaagguaucacuuauuuu

SEQ ID NO: 342956 - RNA, 64 nt, hsa
gggugucauuggguuccagcugcucuccuccacauugaaugauaucuuguuaauuuauaggcac

SEQ ID NO: 342957 - RNA, 64 nt, hsa
uuauuaaucuacuguaucaauaaaauucuguaauuugaaugaguuuuuaauagucuagaauguu

SEQ ID NO: 342958 - RNA, 64 nt, hsa
aucagcuacuguaguugucacagucuugugaacuuugaaugaaauuccacuuuguccagauugg

SEQ ID NO: 342959 - RNA, 64 nt, hsa
gaucagacaaaaugcagaaggaaaaaaaaacauauugaaugaagcacuuggaaagauuuuccac

SEQ ID NO: 342960 - RNA, 64 nt, hsa
aagcacaacuaaaauuucacaugcuaacgacaacuugaaugaacugcuggggcagugguaugug

SEQ ID NO: 342961 - RNA, 64 nt, hsa
uuuaaaugaauacauuaaugggguuuuuauccuuuugaaugacuuuucagacacuagacauaaa

SEQ ID NO: 342962 - RNA, 64 nt, hsa
cagcaagaaggcggggagcagcagagccuugccuuugaaugaggcagcuugugaggcaagcauu

SEQ ID NO: 342963 - RNA, 64 nt, hsa
uuguauuuaguugacuguauuauuugauuucggauugaaugaauguaaauagaaauuaaaugca

SEQ ID NO: 342964 - RNA, 64 nt, hsa
auugaaugaauguaaauagaaauuaaaugcaaauuugaaugaacauaaauagaagugauuuauu

SEQ ID NO: 342965 - RNA, 64 nt, hsa
uuaaggagaagacuugaaugaaguuggagggacauugaaugauggucagagggcagacgaaugu

SEQ ID NO: 342966 - RNA, 64 nt, hsa
caugaagauuaggaaacaguuuuaaggagaagacuugaaugaaguuggagggacauugaaugau

SEQ ID NO: 342967 - RNA, 64 nt, hsa
auccccaguaaugaaaguacuuagaaaauaauuauugaaugaaugaaaucuaaacugugaaccu

SEQ ID NO: 342968 - RNA, 63 nt, hsa
ccgcucuuaagacauggcuggagcucagucuucauugaaugaaguuugcugugguauugcaua

SEQ ID NO: 342969 - RNA, 64 nt, hsa; identical to SEQ ID NO: 23154

SEQ ID NO: 342970 - RNA, 64 nt, hsa; identical to SEQ ID NO: 23155

SEQ ID NO: 342971 - RNA, 64 nt, hsa; identical to SEQ ID NO: 23156

SEQ ID NO: 342972 - RNA, 64 nt, hsa; identical to SEQ ID NO: 23157

SEQ ID NO: 342973 - RNA, 64 nt, hsa; identical to SEQ ID NO: 307517

SEQ ID NO: 342974 - RNA, 64 nt, hsa; identical to SEQ ID NO: 307518

SEQ ID NO: 342975 - RNA, 64 nt, hsa; identical to SEQ ID NO: 307519

SEQ ID NO: 342976 - RNA, 64 nt, hsa; identical to SEQ ID NO: 307520

SEQ ID NO: 342977 - RNA, 64 nt, hsa; identical to SEQ ID NO: 307521

SEQ ID NO: 342978 - RNA, 64 nt, hsa; identical to SEQ ID NO: 307522

SEQ ID NO: 342979 - RNA, 64 nt, hsa; identical to SEQ ID NO: 307523

SEQ ID NO: 342980 - RNA, 64 nt, hsa; identical to SEQ ID NO: 233668

SEQ ID NO: 342981 - RNA, 64 nt, hsa; identical to SEQ ID NO: 233669

SEQ ID NO: 342982 - RNA, 64 nt, hsa; identical to SEQ ID NO: 233670

SEQ ID NO: 342983 - RNA, 64 nt, hsa; identical to SEQ ID NO: 233671

SEQ ID NO: 342984 - RNA, 64 nt, hsa; identical to SEQ ID NO: 233672

SEQ ID NO: 342985 - RNA, 64 nt, hsa; identical to SEQ ID NO: 233673

SEQ ID NO: 342986 - RNA, 64 nt, hsa; identical to SEQ ID NO: 229362

SEQ ID NO: 342987 - RNA, 64 nt, hsa; identical to SEQ ID NO: 229363

SEQ ID NO: 342988 - RNA, 64 nt, hsa; identical to SEQ ID NO: 229364

SEQ ID NO: 342989 - RNA, 64 nt, hsa; identical to SEQ ID NO: 229365

SEQ ID NO: 342990 - RNA, 64 nt, hsa; identical to SEQ ID NO: 229366

SEQ ID NO: 342991 - RNA, 64 nt, hsa; identical to SEQ ID NO: 229367

SEQ ID NO: 342992 - RNA, 64 nt, hsa; identical to SEQ ID NO: 229368

SEQ ID NO: 342993 - RNA, 64 nt, hsa; identical to SEQ ID NO: 229369

SEQ ID NO: 342994 - RNA, 63 nt, hsa; identical to SEQ ID NO: 98265

SEQ ID NO: 342995 - RNA, 63 nt, hsa
cagcaauacaguccucuugaggcacucaagccugagaggaagcucaggaucugacauguucuu

SEQ ID NO: 342996 - RNA, 63 nt, hsa
caugaauaucaaaucuuuugaugcuggacccaagagaggaaaaguuguagcuaaauguugauu

SEQ ID NO: 342997 - RNA, 63 nt, hsa
guucccaaaucaauuauagguaccuguuuaggagagaggaagauuuuaccucucaaaggguga

SEQ ID NO: 342998 - RNA, 63 nt, hsa
aggaaaaaaaggaagagagaggaagggagaagggagaggaaugaauugaggaagugaaagaag

SEQ ID NO: 342999 - RNA, 63 nt, hsa
aaaagggaaaagcagaaaggaaaaaaaggaagagagaggaagggagaagggagaggaaugaau

SEQ ID NO: 343000 - RNA, 63 nt, hsa
ccugcugaagccaggagggucuucccaagauaggagaggaaccgcagguggugagcggcuggg

SEQ ID NO: 343001 - RNA, 63 nt, hsa
uugauucuucaaauuaaaaguucuugagagaaggagaggaagauacagcagacauaggacuga

SEQ ID NO: 343002 - RNA, 63 nt, hsa
caccauauguauuuucuaggauuugagaggaaagagaggaaaaugggggaauggguugcaaaa

SEQ ID NO: 343003 - RNA, 63 nt, hsa
uagcuuccccaccauauguauuuucuaggauuugagaggaaagagaggaaaaugggggaaugg

SEQ ID NO: 343004 - RNA, 63 nt, hsa
uuggaugaacagagaagggaagagaggaagaacgagaggaagagaagggaaggaaguguuugu

SEQ ID NO: 343005 - RNA, 63 nt, hsa
uuuugaggcaaguuggaugaacagagaagggaagagaggaagaacgagaggaagagaagggaa

SEQ ID NO: 343006 - RNA, 63 nt, hsa
ucuuuauacuaaaaauauaggcucuugggauuggagaggaaaaauuagaggugauuuucagau

SEQ ID NO: 343007 - RNA, 63 nt, hsa
uuaagaaaaagcaagauaauuuugaagaaggacgagaggaagaggcaugaacuuguccuaaca

SEQ ID NO: 343008 - RNA, 63 nt, hsa
gaguggacugugggggucuguagagacaguguugagaggaaaggggagguccugcugauuccu

SEQ ID NO: 343009 - RNA, 63 nt, hsa
gaggccuacaggguucaccaggauguaagaggagagaggaauccacaggaccaccagagagga

SEQ ID NO: 343010 - RNA, 63 nt, hsa
ccuaccaucaagccauuguuuugugccauucaggagaggaaaaaaaggaauuuaugcuguaca

SEQ ID NO: 343011 - RNA, 63 nt, hsa
gaacuuuauuuguugggcagaggcuguuccauugagaggaauguuuacagcaguuucaaaaau

SEQ ID NO: 343012 - RNA, 63 nt, hsa
agugcccccuucccggacggguggcaggcccuggagaggaacugagugucacccugaucucag

SEQ ID NO: 343013 - RNA, 63 nt, hsa
uguuuguuuguuucaggaaaaaagaaagggagagagaggaaaauagaggguuguccacuccuc

SEQ ID NO: 343014 - RNA, 63 nt, hsa
ucccugguucugcagagggccagaagaaugagagagaggaagacugcuggcagggaaaucgag

SEQ ID NO: 343015 - RNA, 63 nt, hsa
ggagagaacuucuguaugggcaagccugagagggagaggaaacaaaagcuguguccuggcaga

SEQ ID NO: 343016 - RNA, 63 nt, hsa
uugggauacaaaugaaacuuaugcaggaugugugagaggaagcaguuaauuguuucugaauau

SEQ ID NO: 343017 - RNA, 63 nt, hsa
gaacaggguugaaaacccaggguuuuguacuuggagaggaaagaugccaagcugcuucuuaau

SEQ ID NO: 343018 - RNA, 63 nt, hsa
ccccuggccaucacucauguguaguccagguuugagaggaacuggaaggggggugaggguggg

SEQ ID NO: 343019 - RNA, 63 nt, hsa
ugugauucucccagcccuugcaguccgcuaggugagaggaaaagcucuuuacuuccgccccug

SEQ ID NO: 343020 - RNA, 63 nt, hsa
cgggggaggccgaggcaggggcugggcagaggggagaggaagcacaagaagugggagugggag

SEQ ID NO: 343021 - RNA, 63 nt, hsa
agaggggagaggaagcacaagaagugggagugggagaggaagccacgugcuggagaguagaca

SEQ ID NO: 343022 - RNA, 63 nt, hsa
aacacauuuugauucugaucauggggugggggagagaggaaaggagggaggggagaagcccag

SEQ ID NO: 343023 - RNA, 63 nt, hsa
auuccuuccucccccucaucucacaggggaagggagaggaaagaguuguucucccacuggaag

SEQ ID NO: 343024 - RNA, 63 nt, hsa
agcgucgccaggcaaugaggaaagcagagacaggagaggaaggccucacucacccacugcguc

SEQ ID NO: 343025 - RNA, 63 nt, hsa
uagaaaccuaaggaaaaugcuuuugggcaacaugagaggaaccuuuucauauuaaugacaaaa

SEQ ID NO: 343026 - RNA, 63 nt, hsa
cacccaaggaacauuugaucuagcagcagggaugagaggaaagcagaaaugaaugaacuguga

SEQ ID NO: 343027 - RNA, 63 nt, hsa
aacacccugccuacaaggagauguuuugaaauggagaggaaaauuggcaccucaucuuuuaaa

SEQ ID NO: 343028 - RNA, 63 nt, hsa
ucugccccugccccuuagcuacugaggcauagggagaggaaguuaauuucagagccauacaaa

SEQ ID NO: 343029 - RNA, 63 nt, hsa
gggcaggugggucacguggucugcagaaccaaagagaggaaucgccaaaacaaaucacgagaa

SEQ ID NO: 343030 - RNA, 63 nt, hsa
ccauuuuccugaaucaaauucugcaguggaauggagaggaaaauacuucuaggcaagcagcua

SEQ ID NO: 343031 - RNA, 63 nt, hsa
ugacaacaacuuccaaauuggcucuuuggaggcgagaggaaggggagaacuuggagaauaguu

SEQ ID NO: 343032 - RNA, 64 nt, hsa; identical to SEQ ID NO: 93178

SEQ ID NO: 343033 - RNA, 64 nt, hsa; identical to SEQ ID NO: 93179

SEQ ID NO: 343034 - RNA, 64 nt, hsa; identical to SEQ ID NO: 93180

SEQ ID NO: 343035 - RNA, 64 nt, hsa; identical to SEQ ID NO: 93181

SEQ ID NO: 343036 - RNA, 64 nt, hsa; identical to SEQ ID NO: 21758

SEQ ID NO: 343037 - RNA, 64 nt, hsa; identical to SEQ ID NO: 21759

SEQ ID NO: 343038 - RNA, 64 nt, hsa; identical to SEQ ID NO: 21760

SEQ ID NO: 343039 - RNA, 64 nt, hsa; identical to SEQ ID NO: 21761

SEQ ID NO: 343040 - RNA, 64 nt, hsa; identical to SEQ ID NO: 21762

SEQ ID NO: 343041 - RNA, 64 nt, hsa; identical to SEQ ID NO: 21763

SEQ ID NO: 343042 - RNA, 64 nt, hsa; identical to SEQ ID NO: 21764

SEQ ID NO: 343043 - RNA, 64 nt, hsa; identical to SEQ ID NO: 21765

SEQ ID NO: 343044 - RNA, 64 nt, hsa; identical to SEQ ID NO: 21766

SEQ ID NO: 343045 - RNA, 64 nt, hsa; identical to SEQ ID NO: 21767

SEQ ID NO: 343046 - RNA, 64 nt, hsa; identical to SEQ ID NO: 21768

SEQ ID NO: 343047 - RNA, 64 nt, hsa; identical to SEQ ID NO: 21769

SEQ ID NO: 343048 - RNA, 64 nt, hsa; identical to SEQ ID NO: 21770

SEQ ID NO: 343049 - RNA, 64 nt, hsa; identical to SEQ ID NO: 21771

SEQ ID NO: 343050 - RNA, 64 nt, hsa; identical to SEQ ID NO: 21772

SEQ ID NO: 343051 - RNA, 64 nt, hsa; identical to SEQ ID NO: 21773

SEQ ID NO: 343052 - RNA, 64 nt, hsa; identical to SEQ ID NO: 21774

SEQ ID NO: 343053 - RNA, 64 nt, hsa; identical to SEQ ID NO: 21775

SEQ ID NO: 343054 - RNA, 64 nt, hsa; identical to SEQ ID NO: 21775

SEQ ID NO: 343055 - RNA, 64 nt, hsa; identical to SEQ ID NO: 21777

SEQ ID NO: 343056 - RNA, 64 nt, hsa; identical to SEQ ID NO: 21778

SEQ ID NO: 343057 - RNA, 64 nt, hsa; identical to SEQ ID NO: 21779

SEQ ID NO: 343058 - RNA, 64 nt, hsa; identical to SEQ ID NO: 21780

SEQ ID NO: 343059 - RNA, 64 nt, hsa; identical to SEQ ID NO: 21781

SEQ ID NO: 343060 - RNA, 64 nt, hsa; identical to SEQ ID NO: 97841

SEQ ID NO: 343061 - RNA, 64 nt, hsa; identical to SEQ ID NO: 97842

SEQ ID NO: 343062 - RNA, 64 nt, hsa; identical to SEQ ID NO: 97843

SEQ ID NO: 343063 - RNA, 64 nt, hsa; identical to SEQ ID NO: 97844

SEQ ID NO: 343064 - RNA, 64 nt, hsa; identical to SEQ ID NO: 97845

SEQ ID NO: 343065 - RNA, 64 nt, hsa; identical to SEQ ID NO: 97846

SEQ ID NO: 343066 - RNA, 64 nt, hsa; identical to SEQ ID NO: 97847

SEQ ID NO: 343067 - RNA, 64 nt, hsa; identical to SEQ ID NO: 97848

SEQ ID NO: 343068 - RNA, 64 nt, hsa
uggaaggagacagaaggaaauugacccacucuccuaucuccagaccuuuaccuagccccuccag

SEQ ID NO: 343069 - RNA, 64 nt, hsa
uccauuguacuagcaaaucuaugggggguaauuuuaucuccaucuuuaacuuuuaaaguacuuc

SEQ ID NO: 343070 - RNA, 64 nt, hsa
ggauugaguaaugggauuugaaucaauguauuaauaucuccauagcugggaaacguggguucaa

SEQ ID NO: 343071 - RNA, 64 nt, hsa
caauacucucugaguacauugugcccuugauuuuuaucuccaaguggcaguuuuuaaaauuggc

SEQ ID NO: 343072 - RNA, 64 nt, hsa
agacucagucacuguguucccuccccgccucucuuaucuccauggcuguuugcagcucucccag

SEQ ID NO: 343073 - RNA, 64 nt, hsa
uggucaccaagcaugguagcagcugccugcauuguaucuccaucuggucacugcaggugccaac

SEQ ID NO: 343074 - RNA, 64 nt, hsa
cgcugguggcagggcguuuucccaccgggauacgggaagccaccugugucagggcuaggcccug

SEQ ID NO: 343075 - RNA, 64 nt, hsa
agcaguaauauuucagcaagaggagguggucaugggaagccagcacagcagaggcucccugacc

SEQ ID NO: 343076 - RNA, 64 nt, hsa
gccuuguuucucuagucacaucauguguauacaaggaagccaggaauacagguuuucuugauga

SEQ ID NO: 343077 - RNA, 64 nt, hsa
gccuucuuuucuaucccuuugggcccugggagaaggaagccauuugcagugcugguguguccug

SEQ ID NO: 343078 - RNA, 64 nt, hsa
uuuuuuuaaggggcuguggggugaaauguugacuggaagccacccacaaacacacaccugcugg

SEQ ID NO: 343079 - RNA, 64 nt, hsa
uuaugcccaucuccauagccagaccaagcacucuggaagccaggguugggugcuuauuuaucug

SEQ ID NO: 343080 - RNA, 64 nt, hsa
aacugagaaggugaaaugugagcaaagacgugaaggaagccagggagguagcagguagcucucu

SEQ ID NO: 343081 - RNA, 64 nt, hsa
ugcguuguugggaagccagcaguggccuugggaaggaagccauggcugugguucagagagggug

SEQ ID NO: 343082 - RNA, 64 nt, hsa
agaucccacagucagaacugaaucugcguuguugggaagccagcaguggccuugggaaggaagc

SEQ ID NO: 343083 - RNA, 64 nt, hsa
ugucuugggcuuucgucauuaaaccaaaggaaauggaagccauuccccuguugcucuccuuagu

SEQ ID NO: 343084 - RNA, 64 nt, hsa
cccccaccccuccccacccaccaccgcucccgcgggaagccagcccgugcaacggaagccaggc

SEQ ID NO: 343085 - RNA, 64 nt, hsa
accaccgcucccgcgggaagccagcccgugcaacggaagccaggccaacugccccgcgucuuca

SEQ ID NO: 343086 - RNA, 64 nt, hsa
ucugugccucuccccaggaagcauccagggcagaggaagccacaucucccggugcccccaaccc

SEQ ID NO: 343087 - RNA, 64 nt, hsa
guggggagcagggaguugcccuuccccucccucgggaagccaccuaagaauguuuacaugccaa

SEQ ID NO: 343088 - RNA, 64 nt, hsa
cauccugcaccuguccaccccaccccaacacccuggaagccacugucaaugauuagaucggguc

SEQ ID NO: 343089 - RNA, 64 nt, hsa
ucgacagcccuggcuaacuaacuuacauuuguggggaagccaacagacacagcaggaggagagg

SEQ ID NO: 343090 - RNA, 64 nt, hsa
gacucgagcuccuaccaguggcuggccgcggauuggaagccagccugcugucgcucuguggggg

SEQ ID NO: 343091 - RNA, 64 nt, hsa
acuguuauauaauuuauugugaggaccuucucauggaagccauuaggaaaacaaacuagaggua

SEQ ID NO: 343092 - RNA, 64 nt, hsa
cuuucguuuguuuaccagcaagcaacuucccuggggaagccaaacacauauucauaaaaaaaau

SEQ ID NO: 343093 - RNA, 64 nt, hsa
ucagaccucugagugggccccagagcccagcugaggaagccacacagccuccaggacguggcac

SEQ ID NO: 343094 - RNA, 64 nt, hsa
uggcgaccgugccucugugccagcgucccaggaaggaagccaacccugagcgagccuguccucu

SEQ ID NO: 343095 - RNA, 64 nt, hsa
cuccacuuuuucagacaaggaaacugaggcucagggaagccaagugacaaguccaaggucacga

SEQ ID NO: 343096 - RNA, 64 nt, hsa
cugaccagcuggcccaggauuucacagucgaaaaggaagccaccacugaugccucccacuguga

SEQ ID NO: 343097 - RNA, 64 nt, hsa
acaccucucugcgguucccucucacuuuuagaucggaagccaguuucuacacacuugccucucg

SEQ ID NO: 343098 - RNA, 64 nt, hsa
ggacgccauccgaagacagcacuugaccucggguggaagccaggcucuuugcuuggcuucucuu

SEQ ID NO: 343099 - RNA, 64 nt, hsa
agccugaggacccccgccuaccaccucgagaacuggaagccaaccucuaaccuccugaccucau

SEQ ID NO: 343100 - RNA, 64 nt, hsa
accagugcccaagucucuauggagaaugagaacuggaagccacugcuaccgucuacccagcacc

SEQ ID NO: 343101 - RNA, 64 nt, hsa
aagacucuguuccugcccuaggcccagucucaaaggaagccacaaggcgcgggggccacugagg

SEQ ID NO: 343102 - RNA, 64 nt, hsa
ccaaggccacaaggggaccccggccuaggaggcaggaagccaaggugcagagagcagccuggcc

SEQ ID NO: 343103 - RNA, 64 nt, hsa
ucccuuugagaagauauuuucccacaaaggggugggaagccaggagugagaaggaauucaggga

SEQ ID NO: 343104 - RNA, 64 nt, hsa
aaguggcugcguuuccuggggcccuggguuuuggggaagccaguuagcugcugcuuuggcacug

SEQ ID NO: 343105 - RNA, 64 nt, hsa
guucagguguggacgggacagugaguggcugggaggaagccagaaucaacagcuccagcccucu

SEQ ID NO: 343106 - RNA, 64 nt, hsa
cuucaggcacuaagaggggcuggaccuggcggcaggaagccaaagagacugggccuaggccagg

SEQ ID NO: 343107 - RNA, 64 nt, hsa
uccgccauuuugguagcuuccagaaaggccaggcggaagccaaggucaagagggccaucccuaa

SEQ ID NO: 343108 - RNA, 64 nt, hsa
ccccacuugguggccggacaguggcugagcacguggaagccauugagggcagcguccaggagag

SEQ ID NO: 343109 - RNA, 64 nt, hsa; identical to SEQ ID NO: 125533

SEQ ID NO: 343110 - RNA, 64 nt, hsa; identical to SEQ ID NO: 125534

SEQ ID NO: 343111 - RNA, 64 nt, hsa; identical to SEQ ID NO: 125535

SEQ ID NO: 343112 - RNA, 64 nt, hsa; identical to SEQ ID NO: 125536

SEQ ID NO: 343113 - RNA, 64 nt, hsa; identical to SEQ ID NO: 125537

SEQ ID NO: 343114 - RNA, 64 nt, hsa; identical to SEQ ID NO: 125538

SEQ ID NO: 343115 - RNA, 64 nt, hsa; identical to SEQ ID NO: 125539

SEQ ID NO: 343116 - RNA, 64 nt, hsa; identical to SEQ ID NO: 125540

SEQ ID NO: 343117 - RNA, 64 nt, hsa; identical to SEQ ID NO: 125541

SEQ ID NO: 343118 - RNA, 64 nt, hsa; identical to SEQ ID NO: 125542

SEQ ID NO: 343119 - RNA, 64 nt, hsa; identical to SEQ ID NO: 125543

SEQ ID NO: 343120 - RNA, 64 nt, hsa; identical to SEQ ID NO: 125544

SEQ ID NO: 343121 - RNA, 64 nt, hsa; identical to SEQ ID NO: 125545

SEQ ID NO: 343122 - RNA, 64 nt, hsa; identical to SEQ ID NO: 125546

SEQ ID NO: 343123 - RNA, 64 nt, hsa; identical to SEQ ID NO: 125547

SEQ ID NO: 343124 - RNA, 64 nt, hsa; identical to SEQ ID NO: 125548

SEQ ID NO: 343125 - RNA, 64 nt, hsa; identical to SEQ ID NO: 125549

SEQ ID NO: 343126 - RNA, 64 nt, hsa; identical to SEQ ID NO: 125550

SEQ ID NO: 343127 - RNA, 64 nt, hsa; identical to SEQ ID NO: 125551

SEQ ID NO: 343128 - RNA, 64 nt, hsa; identical to SEQ ID NO: 125552

SEQ ID NO: 343129 - RNA, 64 nt, hsa; identical to SEQ ID NO: 125553

SEQ ID NO: 343130 - RNA, 64 nt, hsa; identical to SEQ ID NO: 125554

SEQ ID NO: 343131 - RNA, 64 nt, hsa; identical to SEQ ID NO: 125555

SEQ ID NO: 343132 - RNA, 64 nt, hsa; identical to SEQ ID NO: 125556

SEQ ID NO: 343133 - RNA, 64 nt, hsa; identical to SEQ ID NO: 125557

SEQ ID NO: 343134 - RNA, 64 nt, hsa; identical to SEQ ID NO: 125558

SEQ ID NO: 343135 - RNA, 64 nt, hsa; identical to SEQ ID NO: 125559

SEQ ID NO: 343136 - RNA, 64 nt, hsa; identical to SEQ ID NO: 125560

SEQ ID NO: 343137 - RNA, 64 nt, hsa; identical to SEQ ID NO: 125561

SEQ ID NO: 343138 - RNA, 64 nt, hsa; identical to SEQ ID NO: 125562

SEQ ID NO: 343139 - RNA, 64 nt, hsa; identical to SEQ ID NO: 125563

SEQ ID NO: 343140 - RNA, 64 nt, hsa; identical to SEQ ID NO: 125564

SEQ ID NO: 343141 - RNA, 64 nt, hsa; identical to SEQ ID NO: 125565

SEQ ID NO: 343142 - RNA, 64 nt, hsa; identical to SEQ ID NO: 125566

SEQ ID NO: 343143 - RNA, 64 nt, hsa; identical to SEQ ID NO: 125567

SEQ ID NO: 343144 - RNA, 64 nt, hsa; identical to SEQ ID NO: 125568

SEQ ID NO: 343145 - RNA, 64 nt, hsa
gucacagcaaugcucuccuugucaaggcauggaccagggucauucagacacauucagauacugc

SEQ ID NO: 343146 - RNA, 64 nt, hsa
ugcacuggcgggucucuccaugcaggccacaacacagggucaguguucaccuggugucacuucc

SEQ ID NO: 343147 - RNA, 64 nt, hsa
gucccucuagccuguggacaccagcugggggauccagggucaggcccccuccucuccccaguuu

SEQ ID NO: 343148 - RNA, 64 nt, hsa
accuuagaagaagugggaagaagaaggagcucuacagggucagcuuuguuugauuuguccaguc

SEQ ID NO: 343149 - RNA, 64 nt, hsa
aggugugacugcucugacaaccuguggcaugcugcagggucaggcuccugauaggaggauuuca

SEQ ID NO: 343150 - RNA, 64 nt, hsa
cagaauaugcucacugcuaagcuacaaacucggacagggucagaaacagaggugucccauccca

SEQ ID NO: 343151 - RNA, 64 nt, hsa
uuuugugccaguauucaagugguauagcucugagcagggucacauuuggccaaaccugacacug

SEQ ID NO: 343152 - RNA, 64 nt, hsa
acacugucuugcugcauucuccuuuggcaaacaucagggucagaauucaggauagcccuuccua

SEQ ID NO: 343153 - RNA, 64 nt, hsa
ccugcugcaguaaauauuuugcaugaugaaauuccagggucacacuuuuccaaguuuaucagug

SEQ ID NO: 343154 - RNA, 64 nt, hsa
caggcagcuucaugaugugcaggcaguagccagacagggucaugggaagggggcccugugcuuc

SEQ ID NO: 343155 - RNA, 64 nt, hsa
uuuaacaugagaaggcgccaacagcacacagggucagggucacuucuagaaauagcccaccaag

SEQ ID NO: 343156 - RNA, 64 nt, hsa
gagugguuuaacaugagaaggcgccaacagcacacagggucagggucacuucuagaaauagccc

SEQ ID NO: 343157 - RNA, 64 nt, hsa
gggcucuggccuucucaugcagagagguccgggacagggucaguaucgugggcauguguauagc

SEQ ID NO: 343158 - RNA, 64 nt, hsa
ugccccuucagaccagcugcuuccaucagaauuccagggucacagccccaacagaagcagcagu

SEQ ID NO: 343159 - RNA, 64 nt, hsa
ccugccucugcuuucuccugcaucccaugcuaagcagggucauggucugaacuacucagauugg

SEQ ID NO: 343160 - RNA, 64 nt, hsa
gcucuaugagugggccccuagugucagcucuguacagggucagaucccagguucuaugaccaaa

SEQ ID NO: 343161 - RNA, 64 nt, hsa
ggcuaugcuggggucccaggguggccgcagcagucagggucacugugggagcccugggguggag

SEQ ID NO: 343162 - RNA, 64 nt, hsa
ggcugugacuccguggggcucagccaggcuccagcagggucagacgugcuguuaagagcaaagc

SEQ ID NO: 343163 - RNA, 64 nt, hsa
cacucgggcucagaggucacucagggucaauacucagggucagugcagguuaugagauccuugg

SEQ ID NO: 343164 - RNA, 64 nt, hsa
caagcaucagggccacucgggcucagaggucacucagggucaauacucagggucagugcagguu

SEQ ID NO: 343165 - RNA, 64 nt, hsa
uugcccaccagggggcuggugcaccugcugaccucagggucacaguugagucauuugccaguug

SEQ ID NO: 343166 - RNA, 64 nt, hsa
ggcagcccccaggaaggccuuccagaucuggcuccagggucaccaccugucacagcaauaccug

SEQ ID NO: 343167 - RNA, 64 nt, hsa
gcauugaggcaagccuggagaggagcccggggagcagggucaugaacuuuuuucuuuagugaag

SEQ ID NO: 343168 - RNA, 64 nt, hsa
gaggccaggcaagcauggacaggagccaagggagcagggucauuaacuuuuucuucuuugcaaa

SEQ ID NO: 343169 - RNA, 64 nt, hsa
uggagccucagugcccguuuggccugcugcucucgcugacaauaaagagcccuugcguugcacu

SEQ ID NO: 343170 - RNA, 64 nt, hsa
acuguagaaauacuuuuucagaaacgaauccauagcugacaaauucacucagugcccaauauau

SEQ ID NO: 343171 - RNA, 64 nt, hsa
ucaggauggaggccagccugugcagaaggcugcagcugacaacagcgaccccaccugccauuac

SEQ ID NO: 343172 - RNA, 64 nt, hsa
caucagccucccucacaugggagaccccaacccagcugacaauguggagcccccagaacuucag

SEQ ID NO: 343173 - RNA, 64 nt, hsa
auauguauauauuuaauauauauauaaaaccagagcugacaaugacacucuggaacauugcaua

SEQ ID NO: 343174 - RNA, 64 nt, hsa
uugccuuguagauuccucuggugcuggucuccaggcugacaaggauucaaaguugucucugaaa

SEQ ID NO: 343175 - RNA, 64 nt, hsa
guucaagcacaucaaggccuucgaccgggcuuuugcugacaacccaggaccgauggugaggccc

SEQ ID NO: 343176 - RNA, 64 nt, hsa
gucuugugcucuucaagacaaaacagauugcgucgcugacaaguucucaagaagaacuuaugag

SEQ ID NO: 343177 - RNA, 64 nt, hsa
uuaugugaccagauuaagugcuuuugucauuugagcugacaaguuuuuaaaacuucagugcuuc

SEQ ID NO: 343178 - RNA, 64 nt, hsa
aaauauugguugaaaguuagagauuuuacaaaaugcugacaaaaauauuuuccuagcaucagua

SEQ ID NO: 343179 - RNA, 64 nt, hsa
cuggcaugaggagagaagacccugcucugguggagcugacaaccuuugaggcugggaggagagc

SEQ ID NO: 343180 - RNA, 64 nt, hsa
uuaagcuauauccccuugucauuccauugagaaagcugacaacugggauagggaggggauuaga

SEQ ID NO: 343181 - RNA, 64 nt, hsa
aaauuguacuugauccugcugaaauacaucugcagcugacaaugagagaagaaacagaaaaugu

SEQ ID NO: 343182 - RNA, 64 nt, hsa
aaaaaaaaacuugauuuguuauuaacauugaucugcugacaaaaccugggaauuuggguugugu

SEQ ID NO: 343183 - RNA, 64 nt, hsa
auaacauuggauggcaauuuacacacaugaacuugcugacaaugaauauauuauacagcaguuu

SEQ ID NO: 343184 - RNA, 64 nt, hsa
caccaauuccacuuccugccccaacugcaggaaugcugacaaugcugccaugcccaccaucggg

SEQ ID NO: 343185 - RNA, 64 nt, hsa
uuucuagaagccacuccagccacuccuuccuggggcugacaaaagggugauuccaagaucaucc

SEQ ID NO: 343186 - RNA, 64 nt, hsa
gaugaucuucagauuaaacccuuuggugcuaggagcugacaauuuccaaagcagccugugaagu

SEQ ID NO: 343187 - RNA, 64 nt, hsa
cucagggcucucuuaccuucugaggacagaaacagcugacaagaguaccauuuggggucucagu

SEQ ID NO: 343188 - RNA, 64 nt, hsa
auugaagguuggaaugguguacuaaaccaaaaaagcugacaacugagaguuuuagaagauuaga

SEQ ID NO: 343189 - RNA, 64 nt, hsa
cauguuuggaguaucaucucugucugggaucugggcugacaaauuaaaaccuagaguagugcuu

SEQ ID NO: 343190 - RNA, 64 nt, hsa
ugggguccugauacucauucccauuugucccagugcugacaacccaaucuucccaauacuuuca

SEQ ID NO: 343191 - RNA, 64 nt, hsa
gcucacuccauucggguccacagcugagguugccgcugacaagaugaaugggcacugccugccc

SEQ ID NO: 343192 - RNA, 64 nt, hsa
cucauuguguuucuaccggagagagaauguauuugcugacaaccauuaaagucagaaguuuuac

SEQ ID NO: 343193 - RNA, 64 nt, hsa
uuuaagaccuuguauaccauauugaaaggaagaggcugacaauaagguuugacagaggggaaca

SEQ ID NO: 343194 - RNA, 64 nt, hsa
ggggcuccugggcucauuuggaugggcaagauucgcugacaaauggcuguggggaugguggggu

SEQ ID NO: 343195 - RNA, 64 nt, hsa
ucacugggagggccaacuuggaggaucagugcuggcugacaagcccuccgccuccuugccugca

SEQ ID NO: 343196 - RNA, 64 nt, hsa
gaguggguacggccagccacucagcccauuggcagcugacaacgcagacacgcucuacggaggc

SEQ ID NO: 343197 - RNA, 64 nt, hsa
uuauugugugccuuucuguguuuaccucacucaagcugacaacauuguuuaugggaaucuaucc

SEQ ID NO: 343198 - RNA, 64 nt, hsa
ugaguaggcugucaucagaacaaagggcuccacugcugacaagguuugagaacugcuggcuuga

SEQ ID NO: 343199 - RNA, 64 nt, hsa
aaugccaacagacaggccacucuuuggucagccugcugacaaauuuaagugcugguaccugugg

SEQ ID NO: 343200 - RNA, 64 nt, hsa
cuggaaugcuggguaugcucugugacaaggcuacgcugacaaucaguuaaacacaccggagaag

SEQ ID NO: 343201 - RNA, 64 nt, hsa
cuuucugguuuuacaucaugaggaucaguuagcugcugacaagaaaagucaucuugugucuuuu

SEQ ID NO: 343202 - RNA, 64 nt, hsa
uacuaguccaaucacccccaggaccucuucagcugcugacaauccuauuuagcauaugcaaauc

SEQ ID NO: 343203 - RNA, 64 nt, hsa
accuggcacugcugugcugugcccaaguuguggugcugacaaagcuuggaagagccugcaggug

SEQ ID NO: 343204 - RNA, 64 nt, hsa
guguguccugccuguauauguggcuuccucugaugcugacaagguggggaacaauccuugccag

SEQ ID NO: 343205 - RNA, 64 nt, hsa
gcgggacacccugguucccaccauucccugccuugcugacaauaaagauauuuccaagaacccg

SEQ ID NO: 343206 - RNA, 53 nt, hsa
cucuagaaggcaaaauuuagccugcugacaauuucccacaccguguaaaccaa

SEQ ID NO: 343207 - RNA, 64 nt, hsa
gcugaagcccgcuuucagcacgccguaaccaggggcugacaaugcgaggucgcaacugagaucu

SEQ ID NO: 343208 - RNA, 64 nt, hsa
auaaaaggaagaugaguauuuaugaagaauaugugcugacaacagggcuuaugaggucuaugua

SEQ ID NO: 343209 - RNA, 64 nt, hsa
gcauucauuuugaauugagaagccuauacauuuagcugacaaagugcuuauagaauuucuuaac

SEQ ID NO: 343210 - RNA, 64 nt, hsa
uuugacccacguaaacugagcaaaacugcagcuggcugacaauggaagauccaggugccaaucc

SEQ ID NO: 343211 - RNA, 64 nt, hsa
gacaagcuagaggcucugcggacuucugcgggcggcugacaacgcgagggcgagggguuagaac

SEQ ID NO: 343212 - RNA, 64 nt, hsa
uuccuggugcugaauaaaggguguugcugucaaggcugacaauuuguaaguuuguuucuuucau

SEQ ID NO: 343213 - RNA, 64 nt, hsa
uggauuccaaacugcuaugcccucuauaccaguggcugacaaggcauauagggauauaugccau

SEQ ID NO: 343214 - RNA, 64 nt, hsa
auauugucauguuuggcccugagggugggugauugcugacaauuuugccaaugcugcuguauuu

SEQ ID NO: 343215 - RNA, 64 nt, hsa
ucuuuccccugcuaggaaaaaauugcacugaaaugcugacaaaaaauaaugaaaugaaguggcu

SEQ ID NO: 343216 - RNA, 64 nt, hsa
gcccaaagguugggaguaggagacaguaucccaggcugacaagggcuugcccuuuaccuugggc

SEQ ID NO: 343217 - RNA, 64 nt, hsa
uccacauaaggauaaccuuacgugaaaccuuccugcugacaaccaugcagaggaauuuuuccac

SEQ ID NO: 343218 - RNA, 64 nt, hsa
ucugaugcuucaguguuauaaauucaacauagaggcugacaaccuaaauucaugguguaacaca

SEQ ID NO: 343219 - RNA, 64 nt, hsa
aacagcguuuuuaacaagauuucagcuugguagagcugacaaagcagauaaaaucuacuccaaa

SEQ ID NO: 343220 - RNA, 64 nt, hsa
acccuguggaaaacguaaccacuggucagcccuagcugacaaaauuucaauauuauuuuagcuu

SEQ ID NO: 343221 - RNA, 64 nt, hsa
aagaaaaacgagcaugaaaauucgguuugagccggcugacaauacaaugaaaaggcuuaaaaag

SEQ ID NO: 343222 - RNA, 64 nt, hsa
cugcaguuccaucaggucccccccaggugcaggugcugacaauacugcugccuuacccgccaua

SEQ ID NO: 343223 - RNA, 64 nt, hsa
ccggaggggcuguauuaauuuguauugccccauggcugacaaaagccuuuuuuuuugguuuuga

SEQ ID NO: 343224 - RNA, 64 nt, hsa
caacuucagggugauuuuuuuagcaguaaccagagcugacaaucuaacuccccuccaccgcccc

SEQ ID NO: 343225 - RNA, 64 nt, hsa
cagcuggaaucaggggagugcaucauccucgggagcugacaacagccaggcuacaccagggcac

SEQ ID NO: 343226 - RNA, 64 nt, hsa
guauugcaaagucaggaaucaucaggaacguuuagcugacaaaauacuugucuguuuuaaaaac

SEQ ID NO: 343227 - RNA, 64 nt, hsa
cuacagcugacccuugaacauggggguuaggggagcugacaauucguggguccgcaaaaucuua

SEQ ID NO: 343228 - RNA, 64 nt, hsa
cccuaugauccauuguccccacugcccacaaauggcugacaaauauuuauugggcaccuacuau

SEQ ID NO: 343229 - RNA, 64 nt, hsa
gaauagaaaacaagagcagcagcugucaggcccagcugacaagcguggggcuggugggcugggg

SEQ ID NO: 343230 - RNA, 64 nt, hsa
gugaaggaaccagcccaauagaaguacagagccagcugacaaguccuuguaaagcucacuccuc

SEQ ID NO: 343231 - RNA, 64 nt, hsa
aagaguagguacucuugagagcaauucaaaucaugcugacaaggauacugauagaaaaagugau

SEQ ID NO: 343232 - RNA, 64 nt, hsa
gugcugggauuacaggcgugagccauugugcccggcugacaaggcuuuuuucuucacaugagua

SEQ ID NO: 343233 - RNA, 64 nt, hsa
aaaaagacaauaaaauuguaauauaauaaauuuggcugacaagaaaccaaagugauucuuaauu

SEQ ID NO: 343234 - RNA, 64 nt, hsa
ucauacaugagaaauguacacauuaaaaggccuugcugacaacuugcacaauguugaacauagc

SEQ ID NO: 343235 - RNA, 64 nt, hsa
aggcacuugccucugcacuuuucuauauuguucagcugacaaaguaguauuuuagaaaaguucu

SEQ ID NO: 343236 - RNA, 64 nt, hsa
cgccagucaugggaggcagagcugggggagcgaggcugacaaugacuccuguuuucacgcugag

SEQ ID NO: 343237 - RNA, 64 nt, hsa
gugcugggauuacaggcaugaaccacugugcccagcugacaaaaugaguucuuaaacuuuuuuu

SEQ ID NO: 343238 - RNA, 64 nt, hsa
aacaggaguaugaaaugagaguuagaccauaugggcugacaacaccauaaauaacaagaaaagg

SEQ ID NO: 343239 - RNA, 64 nt, hsa
ucgcucucccuccuccuccuccuccgagcugcuagcugacaaauacaauucugaaggaauccaa

SEQ ID NO: 343240 - RNA, 64 nt, hsa
uuuaugugauucauauaccacugcuacaguguuagcugacaacauauaguaugagguaaggauc

SEQ ID NO: 343241 - RNA, 64 nt, hsa
gggaccaguggcagggaccccggaaccugaaggugcugacaaagaugaccugcugcuguugagu

SEQ ID NO: 343242 - RNA, 64 nt, hsa
agacagcgggccucgcgcgggcaggagcggcucggcugacaagccugagcggagcgguggagag

SEQ ID NO: 343243 - RNA, 64 nt, hsa
aauugaaauuuuaaaauauggagaauaucacuaagcugacaaugauauugggagaugaauuugc

SEQ ID NO: 343244 - RNA, 64 nt, hsa; identical to SEQ ID NO: 343237

SEQ ID NO: 343245 - RNA, 64 nt, hsa
cauuguccuuacuuuugcaguggaaaacugaauggcugacaagauggaagaguaaccauuucag

SEQ ID NO: 343246 - RNA, 64 nt, hsa
caaggugaagaggacuccgaaguccuuugucagggcugacaaccucguaagcccuugcuuagaa

SEQ ID NO: 343247 - RNA, 64 nt, hsa
cuaacuaagcuuuaaaaggucaagaaguuuuauggcugacaaaggacucgcgcaacgcagaagg

SEQ ID NO: 343248 - RNA, 64 nt, hsa
aucugaccacagucauggugggauaagacaacaggcugacaaaccaagcuggccauuugguacc

SEQ ID NO: 343249 - RNA, 64 nt, hsa
gagcaaaugcuaauacaguaaauauauuguguuugcugacaaucagccggccuauaaaucuccu

SEQ ID NO: 343250 - RNA, 64 nt, hsa
caggaugcucuaagaaaacgccauagacuggguugcugacaaacaucagaauucuauuucucau

SEQ ID NO: 343251 - RNA, 64 nt, hsa
aucccuuccgcacucucucccugacuuucaagaggcugacaauccaggccgcugcuucccagcu

SEQ ID NO: 343252 - RNA, 64 nt, hsa
agcacaugcgggcucgcccauacccgugacaguggcugacaagggacuagugagucagcaccuu

SEQ ID NO: 343253 - RNA, 64 nt, hsa
uaacugcagggaagagacugguuacuagcguaaagcugacaaguuaccaguucaccugaucaga

SEQ ID NO: 343254 - RNA, 64 nt, hsa
ucaccuaaggaaacugacccagaaaacaguuuuagcugacaaagaagaaauuucagagugaagg

SEQ ID NO: 343255 - RNA, 64 nt, hsa
cuacuuccuuggaaccaucucugaauucugaauagcugacaacccccaauguuauccacucugu

SEQ ID NO: 343256 - RNA, 64 nt, hsa
ccaggacaacgugcgcgaggaccucuaugaggcugcugacaaguggguggcugcugugggcaag

SEQ ID NO: 343257 - RNA, 64 nt, hsa
agucugggacuggaaaagagaugucugacugcaagcugacaaugccacucugggaccccugaug

SEQ ID NO: 343258 - RNA, 64 nt, hsa
ccggauuucuaacaguccuugcuuuggggggugugcugacaacuuagcucaggugccuuacauc

SEQ ID NO: 343259 - RNA, 64 nt, hsa
ucagccccugugccaaauuugccuagguuuuccagcugacaaugaauacugggaguuaaaacgc

SEQ ID NO: 343260 - RNA, 64 nt, hsa
ccaucccugaacacggcuggccacuggguauacugcugacaaccgcaacaacaaaaacacaaau

SEQ ID NO: 343261 - RNA, 64 nt, hsa
cuuggcuccugucugccucucagucagagucagggcugacaaaggacucagcuuccuuagcauc

SEQ ID NO: 343262 - RNA, 64 nt, hsa
ugcauguguguauguguguguguguguggcaugcgcugacaaauguguccuugauccacacugc

SEQ ID NO: 343263 - RNA, 64 nt, hsa
ugcagugugccucugccccaugggcccgagagaagcugacaauuacccauagugagguaauuga

SEQ ID NO: 343264 - RNA, 64 nt, hsa
ccacaggucuucuggggaccccagaggugucugugcugacaaggcgacuucagauuccauacug

SEQ ID NO: 343265 - RNA, 64 nt, hsa
aaagauccauuuuuuagguucuuuucggucuccagcugacaacccaacuggacaaugaucuguc

SEQ ID NO: 343266 - RNA, 64 nt, hsa
uccucuccagcaccuugcugugcugcccucugcugcugacaaggugaauaacagccccaagacc

SEQ ID NO: 343267 - RNA, 64 nt, hsa
ugggcagggaauauagccuuccugggcacaacuagcugacaaugacagguugacuguguacccc

SEQ ID NO: 343268 - RNA, 64 nt, hsa
gaaguccugggcaugcaucugggacccccguggagcugacaaguuuuccuugcuuuccugauac

SEQ ID NO: 343269 - RNA, 64 nt, hsa
cacucacauccucacuuugcugccccaccaucuugcugacaacuuccagagaagccaugguuuu

SEQ ID NO: 343270 - RNA, 64 nt, hsa
aauuguugacuuuuuuaacuauauuaaguguuaagcugacaacugucaaagaagaccauguugu

SEQ ID NO: 343271 - RNA, 64 nt, hsa
ggaauaacauaucaaaugaaacagggaaaaugaagcugacaauuuauggaagccagggcuuguc

SEQ ID NO: 343272 - RNA, 64 nt, hsa
gauagauagaaaaagaagcauggauccuugaggagcugacaacaaguuaucccagggccugagg

SEQ ID NO: 343273 - RNA, 64 nt, hsa
cagcacacacaugaucagcccacugaguuaugaagcugacaaugacugcauucaacggggccau

SEQ ID NO: 343274 - RNA, 64 nt, hsa
aggugccuugcucaauggaagaggccaggacagagcugacaaaauuuugcuccccagugaaggc

SEQ ID NO: 343275 - RNA, 64 nt, hsa
gucuccccauaugcaggcugcccuugcagcugcagcugacaacaggcaggaugguggggacagc

SEQ ID NO: 343276 - RNA, 64 nt, hsa
caucuuccccgcccuguccagcgcccuggcaaaggcugacaacuggcugucuuggggccgaaca

SEQ ID NO: 343277 - RNA, 64 nt, hsa
ucaugacugaggugccucccaacgcuccgcccacgcugacaauaaaguugcucugaguuuggag

SEQ ID NO: 343278 - RNA, 64 nt, hsa
gggcuuuuaagaaacacggcugauaucuuugagggcugacaaggcgucucuucaaacaguucca

SEQ ID NO: 343279 - RNA, 64 nt, hsa
augucaccagucggacugugcuguggcuaaccaggcugacaacugagaugaggauucacuguac

SEQ ID NO: 343280 - RNA, 64 nt, hsa
agcagccauuucccuacccuguuuccuaacuuaugcugacaaguucuuccucuuccuaccgugg

SEQ ID NO: 343281 - RNA, 64 nt, hsa
cccaccaucggccagguccagcgcuuccucuggggcugacaacaggccccugacucaccccggu

SEQ ID NO: 343282 - RNA, 64 nt, hsa
gcucaugcucucacuccuagaaggagggugugaggcugacaaccaggucauccaggagggcugg

SEQ ID NO: 343283 - RNA, 64 nt, hsa
ugauuauuagauaacuuaaaguuuauuuuuaaaagcugacaacuuuuuaugaaucuucgaguug

SEQ ID NO: 343284 - RNA, 64 nt, hsa
cccuccuaccucacccgcagggggaaggagggaggcugacaagccuugaauaaaacacaagccu

SEQ ID NO: 343285 - RNA, 64 nt, hsa
uugggcugaaaggugauaauggcauugcgugguagcugacaaugagcaccuucgguuccaugug

SEQ ID NO: 343286 - RNA, 64 nt, hsa
uaugaaugaccaguguuuuuggucgccaaauguugcugacaaacuuaucccaaaacuuuagugg

SEQ ID NO: 343287 - RNA, 64 nt, hsa
guuccauugagugguuccauuuugccuguguggggcugacaaccaagccucgggggaaauggua

SEQ ID NO: 343288 - RNA, 64 nt, hsa
ucaacaagauacaaucucacucuguggugguccugcugacaaaucaagagcauugcuuuuguuu

SEQ ID NO: 343289 - RNA, 64 nt, hsa
gacccagagaagcuaaaagccacuggcagcacaggcugacaaaauggaagcaaagcaagaggug

SEQ ID NO: 343290 - RNA, 64 nt, hsa
caggucacucugccccagugcucucuugcugucugcugacaagggggcauggagcaucucuucc

SEQ ID NO: 343291 - RNA, 64 nt, hsa
ugaagcaccuuccuaacuucuucuacaagggccagcugacaaagauguucuuccucuuccccga

SEQ ID NO: 343292 - RNA, 64 nt, hsa
ugucaggaguggcugucucuggucucuuccuuuagcugacaaggacacuccugaggucuuuguu

SEQ ID NO: 343293 - RNA, 64 nt, hsa
cugacauacaggcacacugaccugauuuccgaaggcugacaaucguuuguggaauguaaucuug

SEQ ID NO: 343294 - RNA, 64 nt, hsa
agagccagaagccagagggccagggauaugagaggcugacaaacaucaggggacaucuggggag

SEQ ID NO: 343295 - RNA, 64 nt, hsa
auuuuaaagugugaacacuccccuauguaaauaugcugacaauaaauuguauggagaaugguau

SEQ ID NO: 343296 - RNA, 64 nt, hsa
cuacccuauuuuucccuguucccuggugccacaggcugacaacugcagucuccaguuuagaaua

SEQ ID NO: 343297 - RNA, 64 nt, hsa
uuauuugcuauaggguuagauguugagaaauucugcugacaaaaaauuuuaagccaguuuuaca

SEQ ID NO: 343298 - RNA, 64 nt, hsa
uaagagaagaggcuggccaagccacaguucugacgcugacaauaaaggaacuaauccucacugu

SEQ ID NO: 343299 - RNA, 64 nt, hsa
guaaaggccuccccugagaacacaggacaggccugcugacaaggcugagucuaccuuggcaaag

SEQ ID NO: 343300 - RNA, 64 nt, hsa; identical to SEQ ID NO: 343299

SEQ ID NO: 343301 - RNA, 64 nt, hsa
uuuuuuuuuaaagaaaaaaggacuuuuaaccuuugcugacaagguuuugucuguuucaguuaua

SEQ ID NO: 343302 - RNA, 64 nt, hsa
aauacagugguuuuguuuuuuuuuuucuuuuagugcugacaaaauaaaauacucauuuuugcau

SEQ ID NO: 343303 - RNA, 64 nt, hsa
caaacauuuaagcuguggucaaggcuacagaugugcugacaaggcacuucauguaaagugucag

SEQ ID NO: 343304 - RNA, 64 nt, hsa
uuacuggaaucuauuggugcugcugcaugagucugcugacaaccugacugcacaaggacugggu

SEQ ID NO: 343305 - RNA, 64 nt, hsa
gggauucccagaaaaccugccuaacggugccacugcugacaauggugaugauggauuaauucca

SEQ ID NO: 343306 - RNA, 64 nt, hsa
gagaugaaagguuuuuuuggguaacaaucccgcagcugacaaaaaaugugaaauuuccacaaaa

SEQ ID NO: 343307 - RNA, 64 nt, hsa
gccuacccaucagccauuucguucucccuuccuugcugacaaagccccauuuuuuuuuucuuuu

SEQ ID NO: 343308 - RNA, 64 nt, hsa
ugcccaauuccauaugucccuauuaucucacucagcugacaagacgugaaaaugagucacauuc

SEQ ID NO: 343309 - RNA, 64 nt, hsa
ucccaccucagcacuaguccaugccaggacaccagcugacaauuucuugguuuuacugucaaua

SEQ ID NO: 343310 - RNA, 64 nt, hsa
gcuguguuacuagcacuauauaauuccggucagugcugacaaauaacauuuaacaaguauugca

SEQ ID NO: 343311 - RNA, 64 nt, hsa
ugcauuccucuaccuuucagaagaucaguagcuggcugacaaucuuugccaaaucuuccuugcu

SEQ ID NO: 343312 - RNA, 62 nt, hsa
auuuuuagcaugauacuggaaauaaaauguccaagcugacaaguauuaauugccuauuaaag

SEQ ID NO: 343313 - RNA, 64 nt, hsa
gcucaccaggccuagagaauggcuguagguggccgcugacaagugccuuuaguugaagagcaca

SEQ ID NO: 343314 - RNA, 64 nt, hsa
aacagccaagauuacagaaucuauauagucuaaugcugacaacuucuauuuuaaaaaacaagac

SEQ ID NO: 343315 - RNA, 64 nt, hsa
ggcucuacauuuaccaggucuuacgccaacaauagcugacaauuccaagaagcuucacgugugg

SEQ ID NO: 343316 - RNA, 64 nt, hsa
cagaggagagggccugugucuguagaagguuaaagcugacaacaugugaaacaucccagaauua

SEQ ID NO: 343317 - RNA, 64 nt, hsa
gaggaggacgggcugacuccucuccuguaauaaagcugacaagaguucuagaggauucugcuuc

SEQ ID NO: 343318 - RNA, 64 nt, hsa
cuccuaacgugggagcgggaggggcggggucccggcugacaagccagcauagggcauucggugg

SEQ ID NO: 343319 - RNA, 64 nt, hsa
uuguugggggccuggccacuuccuugcuucucaagcugacaauucucacuuugcaauaaauagu

SEQ ID NO: 343320 - RNA, 64 nt, hsa
cccauuccacuuucccugccuccuuccuuaaauagcugacaaucaaauucaugcuaugguguga

SEQ ID NO: 343321 - RNA, 64 nt, hsa
gggugcugacgaaauccaagcugcucugguugaagcugacaagugcgagguucccucccaaagc

SEQ ID NO: 343322 - RNA, 64 nt, hsa
cgggccugagggccaggccggagcccaggucucugcugacaauggggguucaaggaagacgucg

SEQ ID NO: 343323 - RNA, 64 nt, hsa
cgggucaagcuagccuguggcccagccacaacuagcugacaaagcuuccuggccuucccuuuaa

SEQ ID NO: 343324 - RNA, 64 nt, hsa
aaaaguucucaguggggccagacuggcuccuggagcugacaagcgaccccguggugaggagaaa

SEQ ID NO: 343325 - RNA, 64 nt, hsa
uccuuuauuaacguacuuuguuggucagcacugggcugacaaaaauuuuuucuugcuaauaaau

SEQ ID NO: 343326 - RNA, 64 nt, hsa
cuauuuagcaugacaagccccaggcaggcugugcgcugacaaccaccgcuccccagcccagggu

SEQ ID NO: 343327 - RNA, 64 nt, hsa
aacugggcugcaauaaaacaugccaguuaucaaugcugacaagagccuaacaagugccaacuua

SEQ ID NO: 343328 - RNA, 64 nt, hsa
uggagaggaauccuucccuccccuggacaaaguugcugacaagcugcugaaguggccucuccau

SEQ ID NO: 343329 - RNA, 64 nt, hsa
aguaaagagucuauuuauggcugacauauuuacggcugacaaacuccuggaagaagcuaugcug

SEQ ID NO: 343330 - RNA, 64 nt, hsa
uggaccacuuuaguuuaaucagaaauuccuuuuagcugacaacauugcuuaaacaggauaguag

SEQ ID NO: 343331 - RNA, 64 nt, hsa
ccgacucugucuccaggagucucaucagcaaaccgcugacaagucuuucuagaaauucuacugc

SEQ ID NO: 343332 - RNA, 64 nt, hsa
caucauggagaauggagugagcucuuccagcacagcugacaagucccagaagcagucccugacc

SEQ ID NO: 343333 - RNA, 64 nt, hsa
aaauuuuaaaauuuugaaaggacuuauuaauuuugcugacaaaagugaaguaacaaauauaaug

SEQ ID NO: 343334 - RNA, 64 nt, hsa
guccaguuguggcagcucuccagaaguaauagcagcugacaacuuucugugccuuuuccuuucu

SEQ ID NO: 343335 - RNA, 58 nt, hsa
cgggccagaccaauggcugagagccacagcugacaaagucugcauguccgaggacggc

SEQ ID NO: 343336 - RNA, 64 nt, hsa
aauggaugcagcccuaacugcaaaagucagagaggcugacaaggaccaaugcuucuuuaucugg

SEQ ID NO: 343337 - RNA, 64 nt, hsa
ggaaucguugcaggugaguccaucagaaacaggagcugacaaccugcugggcacccgaagacca

SEQ ID NO: 343338 - RNA, 64 nt, hsa
aguucuuaguccaguuuugauguuaacuuccauagcugacaaagcuuguuaaguaagaauuaag

SEQ ID NO: 343339 - RNA, 64 nt, hsa
acccaucuccagaugccaaaggacuugaggggcagcugacaaucgcugugucccggcagauccg

SEQ ID NO: 343340 - RNA, 64 nt, hsa
auggccccagacugguugcagcugggcuugaggggcugacaacaggaaguaccaucaucacugc

SEQ ID NO: 343341 - RNA, 64 nt, hsa
uggagauggauaagaccagggaaugggccgagcagcugacaaagaugggccggggcaagcacuu

SEQ ID NO: 343342 - RNA, 64 nt, hsa
cccaaccgccggccuuagugaccccaucuaugcugcugacaagccaaccucccguacggcgccc

SEQ ID NO: 343343 - RNA, 64 nt, hsa
gucucugcaggucucugccccacgcguucccgucgcugacaaagccaccagcugccuccuuuaa

SEQ ID NO: 343344 - RNA, 64 nt, hsa
ccugcucacagagaugacaaacuggcauccuugagcugacaacacuuuuccaugaccauagguc

SEQ ID NO: 343345 - RNA, 64 nt, hsa
gaccaaggugguggcugugaggagggcagcaaaugcugacaaggaugaaaagcacauggaaaaa

SEQ ID NO: 343346 - RNA, 64 nt, hsa
ggguuuacacuacauuugggagucauugucuaaugcugacaagcacacccucucccauuauuug

SEQ ID NO: 343347 - RNA, 64 nt, hsa
aauuuuaaaccuuuuuucagcagauauggagagagcugacaaucaauucacauuuuuuaagcca

SEQ ID NO: 343348 - RNA, 64 nt, hsa
ugaauuugaaaaaugauggccaguuuucagaagugcugacaaauucauauugguaugcaaaagc

SEQ ID NO: 343349 - RNA, 64 nt, hsa
accugcuggcuacugauugcuccaggcggacaaggcugacaagcaauccaggaacaaaauacuc

SEQ ID NO: 343350 - RNA, 64 nt, hsa
ugggucagugcuggaaagcgccccucacuccugcgcugacaagggcccuucucuacugucugug

SEQ ID NO: 343351 - RNA, 64 nt, hsa
gccugccggcuacugagugcuccaggaggacaaggcugacaagcaauccagggacaagauacuc

SEQ ID NO: 343352 - RNA, 64 nt, hsa
gucuugguaggugccugcaucugucugccuucuggcugacaauccuggaaaucuguucuccaga

SEQ ID NO: 343353 - RNA, 64 nt, hsa
gcugggugagcuacugaagccaaggugggaggcagcugacaacaccacccacggcccaugcaga

SEQ ID NO: 343354 - RNA, 64 nt, hsa; identical to SEQ ID NO: 343351

SEQ ID NO: 343355 - RNA, 64 nt, hsa
agcuggugaagaugggccacagaccuggucuagggcugacaaagacagggacagccuuuguuuu

SEQ ID NO: 343356 - RNA, 64 nt, hsa
accugcuggcuacugauugcuccaggcagacaaggcugacaagcaauccagggacaagauacuc

SEQ ID NO: 343357 - RNA, 64 nt, hsa
gacaaggcuagucuaggggcaagagugcgagcuggcugacaauaagaacguggccaccugccca

SEQ ID NO: 343358 - RNA, 64 nt, hsa
ggcagugcucaguucagacaagggggaacugaaggcugacaaguucugaggauuacagcucugc

SEQ ID NO: 343359 - RNA, 64 nt, hsa
aguuggcauaagcaacauuuagaaguuccuuugcgcugacaaggauuccacuguuagagcccuu

SEQ ID NO: 343360 - RNA, 64 nt, hsa
cccuguccccagcacuguccccauggagcugguggcugacaaagauguaguuuccaucagucaa

SEQ ID NO: 343361 - RNA, 64 nt, hsa
aaggacuaugcugcccuuuugacaucaaagaccugcugacaauggaggccacgccugcuucucc

SEQ ID NO: 343362 - RNA, 64 nt, hsa
agagaguggugcagcgccagacauuuugcacauaaggcaccaaacagcccaggacugccgagac

SEQ ID NO: 343363 - RNA, 64 nt, hsa
ucuucaggcugccaggggaggaggagaagccagcaggcaccacuuuucugcucccuuucuccag

SEQ ID NO: 343364 - RNA, 64 nt, hsa
ggagguccacacuacagcuguccucucgucuagaaggcaccaccucgcuuucaugucccgugug

SEQ ID NO: 343365 - RNA, 64 nt, hsa
aaggcgacuaagagacagccuccuuggcaagggcaggcaccacuuuguagcaacuugggcacca

SEQ ID NO: 343366 - RNA, 64 nt, hsa
uuguccucaauccagucaacaccuacuauguaccaggcaccaggaagccagaagcucagggccc

SEQ ID NO: 343367 - RNA, 64 nt, hsa
gcugaauccuugcagccucuggacagaugugagaaggcaccaccucaagaggggaggagcgggg

SEQ ID NO: 343368 - RNA, 64 nt, hsa
cgugcucauagugaucagcugugcaggagccaugaggcaccaaccucuccccgcagggcaaagc

SEQ ID NO: 343369 - RNA, 64 nt, hsa
uauuauagaugccaauccaaaaccucagaauuucaggcaccacaaaaacagguaauuuucuauc

SEQ ID NO: 343370 - RNA, 64 nt, hsa
guuugaacccugugagccugagacagagagggccaggcaccaaccacaaggcgggaaaguccau

SEQ ID NO: 343371 - RNA, 64 nt, hsa
gcuggggugggggccugagcagacacagaggugcaggcaccaggauucuccacuucuuccagcc

SEQ ID NO: 343372 - RNA, 64 nt, hsa
ccacucuguauuggacaaaggcuagcacagggcuaggcaccaauaaagauuucuaaugaugcac

SEQ ID NO: 343373 - RNA, 64 nt, hsa
cccauuucguugcuacccaaguggauucugagacaggcaccaucuccuuguucccccucucucu

SEQ ID NO: 343374 - RNA, 64 nt, hsa
uccugaagcccuacagaguuagggaauggagcccaggcaccaggggucuaaagugugagccacu

SEQ ID NO: 343375 - RNA, 64 nt, hsa
gggguggaggggagugugugcagcguuuuuaccuaggcaccaucauuuaaugugacaguguuca

SEQ ID NO: 343376 - RNA, 64 nt, hsa
aaugugacaguguucaguaaacaaaucaguuggcaggcaccagaagaagaauggauuguauguc

SEQ ID NO: 343377 - RNA, 64 nt, hsa
uaacaauuucaggacgucccuaagcugagcuaggaggcaccacgcacaggccggaggcaccacg

SEQ ID NO: 343378 - RNA, 64 nt, hsa
uaagcugagcuaggaggcaccacgcacaggccggaggcaccacgcacaggccagagucucccaa

SEQ ID NO: 343379 - RNA, 64 nt, hsa
uaaugcucacgcucccaacacaaggugggcagggaggcaccauucaggaaccuggaccaaagcu

SEQ ID NO: 343380 - RNA, 64 nt, hsa
aagaccugacucaggcaucauuccaccauggcuaaggcaccagccggggaagacuugaaagaaa

SEQ ID NO: 343381 - RNA, 64 nt, hsa
gcccagcauugacuguccacccagccuugcuguuaggcaccaugacuccaagaugaagaugugg

SEQ ID NO: 343382 - RNA, 64 nt, hsa
acaaggccaugcaggugaugauacgucggaauagaggcaccagcccugguaacugcaucuucuc

SEQ ID NO: 343383 - RNA, 64 nt, hsa
uuccccacugggcguccuaccccagugagguugaaggcaccaauuccaagaaucccuccaaccu

SEQ ID NO: 343384 - RNA, 64 nt, hsa
agagaggugucaacagcaagggcucuuaggggucaggcaccagcauggagaccucaugacaaag

SEQ ID NO: 343385 - RNA, 64 nt, hsa
uuuauuuauugaagugugaaauugagcaauaggcaggcaccaccguccccagagcaggucagcg

SEQ ID NO: 343386 - RNA, 64 nt, hsa
uccagagaaggacacaaacguguuucguaagcccaggcaccaaugggaauggaccaaagaguuu

SEQ ID NO: 343387 - RNA, 64 nt, hsa
ugcgugccuguaaucccagcuauucaggaggcugaggcaccagaauugcuugaacccaggaggu

SEQ ID NO: 343388 - RNA, 64 nt, hsa
cucugaggaguggaguucucuguucuagagugacaggcaccagaugggaugggcuuucucagug

SEQ ID NO: 343389 - RNA, 64 nt, hsa
gugugcgauggaaauguguuccugccggagucugaggcaccagggugugcucaaaggcuggccc

SEQ ID NO: 343390 - RNA, 64 nt, hsa
agguuggggagccucgcugugucuugcuguucccaggcaccaccacagcaggugcugccauacu

SEQ ID NO: 343391 - RNA, 64 nt, hsa; identical to SEQ ID NO: 48356

SEQ ID NO: 343392 - RNA, 64 nt, hsa; identical to SEQ ID NO: 48357

SEQ ID NO: 343393 - RNA, 64 nt, hsa; identical to SEQ ID NO: 48358

SEQ ID NO: 343394 - RNA, 64 nt, hsa; identical to SEQ ID NO: 48359

SEQ ID NO: 343395 - RNA, 64 nt, hsa; identical to SEQ ID NO: 182986

SEQ ID NO: 343396 - RNA, 64 nt, hsa; identical to SEQ ID NO: 182987

SEQ ID NO: 343397 - RNA, 64 nt, hsa; identical to SEQ ID NO: 182988

SEQ ID NO: 343398 - RNA, 64 nt, hsa; identical to SEQ ID NO: 182989

SEQ ID NO: 343399 - RNA, 64 nt, hsa; identical to SEQ ID NO: 182990

SEQ ID NO: 343400 - RNA, 64 nt, hsa; identical to SEQ ID NO: 182991

SEQ ID NO: 343401 - RNA, 64 nt, hsa; identical to SEQ ID NO: 182992

SEQ ID NO: 343402 - RNA, 64 nt, hsa; identical to SEQ ID NO: 182993

SEQ ID NO: 343403 - RNA, 64 nt, hsa; identical to SEQ ID NO: 182994

SEQ ID NO: 343404 - RNA, 64 nt, hsa; identical to SEQ ID NO: 182995

SEQ ID NO: 343405 - RNA, 64 nt, hsa; identical to SEQ ID NO: 182996

SEQ ID NO: 343406 - RNA, 64 nt, hsa; identical to SEQ ID NO: 182997

SEQ ID NO: 343407 - RNA, 64 nt, hsa; identical to SEQ ID NO: 182998

SEQ ID NO: 343408 - RNA, 64 nt, hsa; identical to SEQ ID NO: 182999

SEQ ID NO: 343409 - RNA, 64 nt, hsa; identical to SEQ ID NO: 183000

SEQ ID NO: 343410 - RNA, 64 nt, hsa; identical to SEQ ID NO: 183001

SEQ ID NO: 343411 - RNA, 64 nt, hsa; identical to SEQ ID NO: 183002

SEQ ID NO: 343412 - RNA, 64 nt, hsa; identical to SEQ ID NO: 183003

SEQ ID NO: 343413 - RNA, 64 nt, hsa; identical to SEQ ID NO: 183004

SEQ ID NO: 343414 - RNA, 64 nt, hsa; identical to SEQ ID NO: 183005

SEQ ID NO: 343415 - RNA, 64 nt, hsa; identical to SEQ ID NO: 183006

SEQ ID NO: 343416 - RNA, 64 nt, hsa; identical to SEQ ID NO: 183007

SEQ ID NO: 343417 - RNA, 64 nt, hsa; identical to SEQ ID NO: 183008

SEQ ID NO: 343418 - RNA, 64 nt, hsa; identical to SEQ ID NO: 183009

SEQ ID NO: 343419 - RNA, 64 nt, hsa; identical to SEQ ID NO: 183010

SEQ ID NO: 343420 - RNA, 64 nt, hsa; identical to SEQ ID NO: 183011

SEQ ID NO: 343421 - RNA, 64 nt, hsa; identical to SEQ ID NO: 183012

SEQ ID NO: 343422 - RNA, 64 nt, hsa; identical to SEQ ID NO: 183013

SEQ ID NO: 343423 - RNA, 64 nt, hsa; identical to SEQ ID NO: 183014

SEQ ID NO: 343424 - RNA, 64 nt, hsa; identical to SEQ ID NO: 183015

SEQ ID NO: 343425 - RNA, 64 nt, hsa; identical to SEQ ID NO: 183016

SEQ ID NO: 343426 - RNA, 64 nt, hsa; identical to SEQ ID NO: 183017

SEQ ID NO: 343427 - RNA, 64 nt, hsa; identical to SEQ ID NO: 183018

SEQ ID NO: 343428 - RNA, 64 nt, hsa; identical to SEQ ID NO: 183019

SEQ ID NO: 343429 - RNA, 64 nt, hsa; identical to SEQ ID NO: 183020

SEQ ID NO: 343430 - RNA, 64 nt, hsa; identical to SEQ ID NO: 183021

SEQ ID NO: 343431 - RNA, 64 nt, hsa; identical to SEQ ID NO: 183022

SEQ ID NO: 343432 - RNA, 64 nt, hsa; identical to SEQ ID NO: 183023

SEQ ID NO: 343433 - RNA, 64 nt, hsa; identical to SEQ ID NO: 183024

SEQ ID NO: 343434 - RNA, 64 nt, hsa; identical to SEQ ID NO: 183025

SEQ ID NO: 343435 - RNA, 64 nt, hsa; identical to SEQ ID NO: 183026

SEQ ID NO: 343436 - RNA, 64 nt, hsa; identical to SEQ ID NO: 183027

SEQ ID NO: 343437 - RNA, 64 nt, hsa; identical to SEQ ID NO: 183028

SEQ ID NO: 343438 - RNA, 64 nt, hsa; identical to SEQ ID NO: 183029

SEQ ID NO: 343439 - RNA, 64 nt, hsa; identical to SEQ ID NO: 183030

SEQ ID NO: 343440 - RNA, 64 nt, hsa; identical to SEQ ID NO: 183031

SEQ ID NO: 343441 - RNA, 64 nt, hsa; identical to SEQ ID NO: 183032

SEQ ID NO: 343442 - RNA, 64 nt, hsa; identical to SEQ ID NO: 183033

SEQ ID NO: 343443 - RNA, 64 nt, hsa; identical to SEQ ID NO: 183034

SEQ ID NO: 343444 - RNA, 64 nt, hsa; identical to SEQ ID NO: 183035

SEQ ID NO: 343445 - RNA, 64 nt, hsa; identical to SEQ ID NO: 183036

SEQ ID NO: 343446 - RNA, 64 nt, hsa; identical to SEQ ID NO: 183037

SEQ ID NO: 343447 - RNA, 64 nt, hsa; identical to SEQ ID NO: 183038

SEQ ID NO: 343448 - RNA, 64 nt, hsa; identical to SEQ ID NO: 183039

SEQ ID NO: 343449 - RNA, 64 nt, hsa; identical to SEQ ID NO: 183040

SEQ ID NO: 343450 - RNA, 64 nt, hsa; identical to SEQ ID NO: 183041

SEQ ID NO: 343451 - RNA, 64 nt, hsa; identical to SEQ ID NO: 183042

SEQ ID NO: 343452 - RNA, 64 nt, hsa; identical to SEQ ID NO: 183043

SEQ ID NO: 343453 - RNA, 64 nt, hsa; identical to SEQ ID NO: 183044

SEQ ID NO: 343454 - RNA, 64 nt, hsa; identical to SEQ ID NO: 183045

SEQ ID NO: 343455 - RNA, 64 nt, hsa; identical to SEQ ID NO: 183046

SEQ ID NO: 343456 - RNA, 64 nt, hsa; identical to SEQ ID NO: 183047

SEQ ID NO: 343457 - RNA, 64 nt, hsa; identical to SEQ ID NO: 183048

SEQ ID NO: 343458 - RNA, 64 nt, hsa; identical to SEQ ID NO: 183049

SEQ ID NO: 343459 - RNA, 64 nt, hsa; identical to SEQ ID NO: 183050

SEQ ID NO: 343460 - RNA, 64 nt, hsa; identical to SEQ ID NO: 183051

SEQ ID NO: 343461 - RNA, 64 nt, hsa; identical to SEQ ID NO: 183052

SEQ ID NO: 343462 - RNA, 64 nt, hsa; identical to SEQ ID NO: 183053

SEQ ID NO: 343463 - RNA, 64 nt, hsa; identical to SEQ ID NO: 183054

SEQ ID NO: 343464 - RNA, 64 nt, hsa; identical to SEQ ID NO: 183055

SEQ ID NO: 343465 - RNA, 64 nt, hsa; identical to SEQ ID NO: 183056

SEQ ID NO: 343466 - RNA, 64 nt, hsa; identical to SEQ ID NO: 183057

SEQ ID NO: 343467 - RNA, 64 nt, hsa; identical to SEQ ID NO: 183058

SEQ ID NO: 343468 - RNA, 64 nt, hsa; identical to SEQ ID NO: 183059

SEQ ID NO: 343469 - RNA, 64 nt, hsa; identical to SEQ ID NO: 183060

SEQ ID NO: 343470 - RNA, 64 nt, hsa; identical to SEQ ID NO: 183061

SEQ ID NO: 343471 - RNA, 64 nt, hsa; identical to SEQ ID NO: 183062

SEQ ID NO: 343472 - RNA, 64 nt, hsa; identical to SEQ ID NO: 183063

SEQ ID NO: 343473 - RNA, 64 nt, hsa; identical to SEQ ID NO: 183064

SEQ ID NO: 343474 - RNA, 64 nt, hsa; identical to SEQ ID NO: 183065

SEQ ID NO: 343475 - RNA, 64 nt, hsa; identical to SEQ ID NO: 183066

SEQ ID NO: 343476 - RNA, 64 nt, hsa; identical to SEQ ID NO: 183067

SEQ ID NO: 343477 - RNA, 64 nt, hsa; identical to SEQ ID NO: 183068

SEQ ID NO: 343478 - RNA, 64 nt, hsa; identical to SEQ ID NO: 183069

SEQ ID NO: 343479 - RNA, 64 nt, hsa; identical to SEQ ID NO: 183070

SEQ ID NO: 343480 - RNA, 64 nt, hsa; identical to SEQ ID NO: 183071

SEQ ID NO: 343481 - RNA, 64 nt, hsa; identical to SEQ ID NO: 183072

SEQ ID NO: 343482 - RNA, 64 nt, hsa; identical to SEQ ID NO: 183073

SEQ ID NO: 343483 - RNA, 64 nt, hsa; identical to SEQ ID NO: 183074

SEQ ID NO: 343484 - RNA, 64 nt, hsa; identical to SEQ ID NO: 183075

SEQ ID NO: 343485 - RNA, 64 nt, hsa; identical to SEQ ID NO: 183076

SEQ ID NO: 343486 - RNA, 64 nt, hsa; identical to SEQ ID NO: 183077

SEQ ID NO: 343487 - RNA, 64 nt, hsa; identical to SEQ ID NO: 183078

SEQ ID NO: 343488 - RNA, 64 nt, hsa; identical to SEQ ID NO: 183079

SEQ ID NO: 343489 - RNA, 64 nt, hsa; identical to SEQ ID NO: 183080

SEQ ID NO: 343490 - RNA, 64 nt, hsa; identical to SEQ ID NO: 183081

SEQ ID NO: 343491 - RNA, 64 nt, hsa; identical to SEQ ID NO: 183082

SEQ ID NO: 343492 - RNA, 64 nt, hsa; identical to SEQ ID NO: 183083

SEQ ID NO: 343493 - RNA, 64 nt, hsa; identical to SEQ ID NO: 183084

SEQ ID NO: 343494 - RNA, 64 nt, hsa; identical to SEQ ID NO: 183085

SEQ ID NO: 343495 - RNA, 64 nt, hsa; identical to SEQ ID NO: 183086

SEQ ID NO: 343496 - RNA, 64 nt, hsa; identical to SEQ ID NO: 183087

SEQ ID NO: 343497 - RNA, 64 nt, hsa; identical to SEQ ID NO: 183088

SEQ ID NO: 343498 - RNA, 64 nt, hsa; identical to SEQ ID NO: 183089

SEQ ID NO: 343499 - RNA, 64 nt, hsa; identical to SEQ ID NO: 183090

SEQ ID NO: 343500 - RNA, 64 nt, hsa; identical to SEQ ID NO: 183091

SEQ ID NO: 343501 - RNA, 64 nt, hsa; identical to SEQ ID NO: 183092

SEQ ID NO: 343502 - RNA, 64 nt, hsa; identical to SEQ ID NO: 183093

SEQ ID NO: 343503 - RNA, 64 nt, hsa; identical to SEQ ID NO: 183094

SEQ ID NO: 343504 - RNA, 64 nt, hsa; identical to SEQ ID NO: 183095

SEQ ID NO: 343505 - RNA, 64 nt, hsa; identical to SEQ ID NO: 183096

SEQ ID NO: 343506 - RNA, 64 nt, hsa; identical to SEQ ID NO: 183097

SEQ ID NO: 343507 - RNA, 64 nt, hsa; identical to SEQ ID NO: 183098

SEQ ID NO: 343508 - RNA, 64 nt, hsa; identical to SEQ ID NO: 183099

SEQ ID NO: 343509 - RNA, 64 nt, hsa; identical to SEQ ID NO: 183100

SEQ ID NO: 343510 - RNA, 64 nt, hsa; identical to SEQ ID NO: 183101

SEQ ID NO: 343511 - RNA, 64 nt, hsa; identical to SEQ ID NO: 183102

SEQ ID NO: 343512 - RNA, 64 nt, hsa; identical to SEQ ID NO: 183103

SEQ ID NO: 343513 - RNA, 64 nt, hsa; identical to SEQ ID NO: 183104

SEQ ID NO: 343514 - RNA, 64 nt, hsa; identical to SEQ ID NO: 183105

SEQ ID NO: 343515 - RNA, 64 nt, hsa; identical to SEQ ID NO: 183106

SEQ ID NO: 343516 - RNA, 64 nt, hsa; identical to SEQ ID NO: 183107

SEQ ID NO: 343517 - RNA, 64 nt, hsa; identical to SEQ ID NO: 183108

SEQ ID NO: 343518 - RNA, 64 nt, hsa; identical to SEQ ID NO: 183109

SEQ ID NO: 343519 - RNA, 64 nt, hsa; identical to SEQ ID NO: 183110

SEQ ID NO: 343520 - RNA, 64 nt, hsa; identical to SEQ ID NO: 183111

SEQ ID NO: 343521 - RNA, 64 nt, hsa; identical to SEQ ID NO: 183112

SEQ ID NO: 343522 - RNA, 64 nt, hsa; identical to SEQ ID NO: 183113

SEQ ID NO: 343523 - RNA, 64 nt, hsa; identical to SEQ ID NO: 183114

SEQ ID NO: 343524 - RNA, 64 nt, hsa; identical to SEQ ID NO: 183115

SEQ ID NO: 343525 - RNA, 64 nt, hsa; identical to SEQ ID NO: 183116

SEQ ID NO: 343526 - RNA, 64 nt, hsa; identical to SEQ ID NO: 183117

SEQ ID NO: 343527 - RNA, 64 nt, hsa; identical to SEQ ID NO: 183118

SEQ ID NO: 343528 - RNA, 64 nt, hsa; identical to SEQ ID NO: 183119

SEQ ID NO: 343529 - RNA, 64 nt, hsa; identical to SEQ ID NO: 183120

SEQ ID NO: 343530 - RNA, 64 nt, hsa; identical to SEQ ID NO: 183121

SEQ ID NO: 343531 - RNA, 64 nt, hsa; identical to SEQ ID NO: 183122

SEQ ID NO: 343532 - RNA, 64 nt, hsa; identical to SEQ ID NO: 183123

SEQ ID NO: 343533 - RNA, 64 nt, hsa; identical to SEQ ID NO: 183124

SEQ ID NO: 343534 - RNA, 64 nt, hsa; identical to SEQ ID NO: 183125

SEQ ID NO: 343535 - RNA, 64 nt, hsa; identical to SEQ ID NO: 183126

SEQ ID NO: 343536 - RNA, 64 nt, hsa; identical to SEQ ID NO: 183127

SEQ ID NO: 343537 - RNA, 64 nt, hsa; identical to SEQ ID NO: 183128

SEQ ID NO: 343538 - RNA, 64 nt, hsa; identical to SEQ ID NO: 183129

SEQ ID NO: 343539 - RNA, 64 nt, hsa; identical to SEQ ID NO: 183130

SEQ ID NO: 343540 - RNA, 64 nt, hsa; identical to SEQ ID NO: 183131

SEQ ID NO: 343541 - RNA, 64 nt, hsa; identical to SEQ ID NO: 183132

SEQ ID NO: 343542 - RNA, 64 nt, hsa; identical to SEQ ID NO: 183133

SEQ ID NO: 343543 - RNA, 64 nt, hsa; identical to SEQ ID NO: 183134

SEQ ID NO: 343544 - RNA, 64 nt, hsa; identical to SEQ ID NO: 183135

SEQ ID NO: 343545 - RNA, 64 nt, hsa; identical to SEQ ID NO: 183136

SEQ ID NO: 343546 - RNA, 64 nt, hsa; identical to SEQ ID NO: 183137

SEQ ID NO: 343547 - RNA, 64 nt, hsa; identical to SEQ ID NO: 183138

SEQ ID NO: 343548 - RNA, 64 nt, hsa; identical to SEQ ID NO: 183139

SEQ ID NO: 343549 - RNA, 64 nt, hsa; identical to SEQ ID NO: 183140

SEQ ID NO: 343550 - RNA, 64 nt, hsa; identical to SEQ ID NO: 183141

SEQ ID NO: 343551 - RNA, 64 nt, hsa; identical to SEQ ID NO: 183142

SEQ ID NO: 343552 - RNA, 64 nt, hsa; identical to SEQ ID NO: 183143

SEQ ID NO: 343553 - RNA, 64 nt, hsa; identical to SEQ ID NO: 183144

SEQ ID NO: 343554 - RNA, 64 nt, hsa; identical to SEQ ID NO: 183145

SEQ ID NO: 343555 - RNA, 64 nt, hsa; identical to SEQ ID NO: 183146

SEQ ID NO: 343556 - RNA, 64 nt, hsa; identical to SEQ ID NO: 183147

SEQ ID NO: 343557 - RNA, 64 nt, hsa; identical to SEQ ID NO: 183148

SEQ ID NO: 343558 - RNA, 64 nt, hsa; identical to SEQ ID NO: 183149

SEQ ID NO: 343559 - RNA, 64 nt, hsa; identical to SEQ ID NO: 183150

SEQ ID NO: 343560 - RNA, 64 nt, hsa; identical to SEQ ID NO: 183151

SEQ ID NO: 343561 - RNA, 64 nt, hsa; identical to SEQ ID NO: 183152

SEQ ID NO: 343562 - RNA, 64 nt, hsa; identical to SEQ ID NO: 183153

SEQ ID NO: 343563 - RNA, 64 nt, hsa; identical to SEQ ID NO: 183154

SEQ ID NO: 343564 - RNA, 64 nt, hsa; identical to SEQ ID NO: 183155

SEQ ID NO: 343565 - RNA, 64 nt, hsa; identical to SEQ ID NO: 183156

SEQ ID NO: 343566 - RNA, 64 nt, hsa; identical to SEQ ID NO: 183157

SEQ ID NO: 343567 - RNA, 64 nt, hsa; identical to SEQ ID NO: 183158

SEQ ID NO: 343568 - RNA, 64 nt, hsa; identical to SEQ ID NO: 183159

SEQ ID NO: 343569 - RNA, 64 nt, hsa; identical to SEQ ID NO: 183160

SEQ ID NO: 343570 - RNA, 64 nt, hsa; identical to SEQ ID NO: 183161

SEQ ID NO: 343571 - RNA, 64 nt, hsa; identical to SEQ ID NO: 183162

SEQ ID NO: 343572 - RNA, 64 nt, hsa; identical to SEQ ID NO: 183163

SEQ ID NO: 343573 - RNA, 64 nt, hsa; identical to SEQ ID NO: 183164

SEQ ID NO: 343574 - RNA, 64 nt, hsa; identical to SEQ ID NO: 183165

SEQ ID NO: 343575 - RNA, 64 nt, hsa; identical to SEQ ID NO: 183166

SEQ ID NO: 343576 - RNA, 64 nt, hsa; identical to SEQ ID NO: 183167

SEQ ID NO: 343577 - RNA, 64 nt, hsa; identical to SEQ ID NO: 183168

SEQ ID NO: 343578 - RNA, 64 nt, hsa; identical to SEQ ID NO: 183169

SEQ ID NO: 343579 - RNA, 64 nt, hsa; identical to SEQ ID NO: 183170

SEQ ID NO: 343580 - RNA, 64 nt, hsa; identical to SEQ ID NO: 183171

SEQ ID NO: 343581 - RNA, 64 nt, hsa; identical to SEQ ID NO: 183172

SEQ ID NO: 343582 - RNA, 64 nt, hsa; identical to SEQ ID NO: 183173

SEQ ID NO: 343583 - RNA, 64 nt, hsa; identical to SEQ ID NO: 183174

SEQ ID NO: 343584 - RNA, 64 nt, hsa; identical to SEQ ID NO: 183175

SEQ ID NO: 343585 - RNA, 64 nt, hsa; identical to SEQ ID NO: 183176

SEQ ID NO: 343586 - RNA, 64 nt, hsa; identical to SEQ ID NO: 183177

SEQ ID NO: 343587 - RNA, 64 nt, hsa; identical to SEQ ID NO: 183178

SEQ ID NO: 343588 - RNA, 64 nt, hsa; identical to SEQ ID NO: 183179

SEQ ID NO: 343589 - RNA, 64 nt, hsa; identical to SEQ ID NO: 183180

SEQ ID NO: 343590 - RNA, 64 nt, hsa; identical to SEQ ID NO: 183181

SEQ ID NO: 343591 - RNA, 64 nt, hsa; identical to SEQ ID NO: 183182

SEQ ID NO: 343592 - RNA, 64 nt, hsa; identical to SEQ ID NO: 183183

SEQ ID NO: 343593 - RNA, 64 nt, hsa; identical to SEQ ID NO: 183184

SEQ ID NO: 343594 - RNA, 64 nt, hsa; identical to SEQ ID NO: 183185

SEQ ID NO: 343595 - RNA, 64 nt, hsa; identical to SEQ ID NO: 183186

SEQ ID NO: 343596 - RNA, 64 nt, hsa; identical to SEQ ID NO: 183187

SEQ ID NO: 343597 - RNA, 64 nt, hsa; identical to SEQ ID NO: 183188

SEQ ID NO: 343598 - RNA, 64 nt, hsa; identical to SEQ ID NO: 183189

SEQ ID NO: 343599 - RNA, 64 nt, hsa; identical to SEQ ID NO: 183190

SEQ ID NO: 343600 - RNA, 64 nt, hsa; identical to SEQ ID NO: 183191

SEQ ID NO: 343601 - RNA, 64 nt, hsa; identical to SEQ ID NO: 183192

SEQ ID NO: 343602 - RNA, 64 nt, hsa; identical to SEQ ID NO: 183193

SEQ ID NO: 343603 - RNA, 64 nt, hsa; identical to SEQ ID NO: 183194

SEQ ID NO: 343604 - RNA, 64 nt, hsa; identical to SEQ ID NO: 183195

SEQ ID NO: 343605 - RNA, 64 nt, hsa; identical to SEQ ID NO: 183196

SEQ ID NO: 343606 - RNA, 64 nt, hsa; identical to SEQ ID NO: 183197

SEQ ID NO: 343607 - RNA, 64 nt, hsa; identical to SEQ ID NO: 183198

SEQ ID NO: 343608 - RNA, 64 nt, hsa; identical to SEQ ID NO: 183199

SEQ ID NO: 343609 - RNA, 64 nt, hsa; identical to SEQ ID NO: 183200

SEQ ID NO: 343610 - RNA, 64 nt, hsa; identical to SEQ ID NO: 183201

SEQ ID NO: 343611 - RNA, 64 nt, hsa; identical to SEQ ID NO: 183202

SEQ ID NO: 343612 - RNA, 64 nt, hsa; identical to SEQ ID NO: 183203

SEQ ID NO: 343613 - RNA, 64 nt, hsa; identical to SEQ ID NO: 183204

SEQ ID NO: 343614 - RNA, 64 nt, hsa; identical to SEQ ID NO: 183205

SEQ ID NO: 343615 - RNA, 64 nt, hsa; identical to SEQ ID NO: 183206

SEQ ID NO: 343616 - RNA, 64 nt, hsa; identical to SEQ ID NO: 183207

SEQ ID NO: 343617 - RNA, 64 nt, hsa; identical to SEQ ID NO: 183208

SEQ ID NO: 343618 - RNA, 64 nt, hsa; identical to SEQ ID NO: 183209

SEQ ID NO: 343619 - RNA, 64 nt, hsa; identical to SEQ ID NO: 183210

SEQ ID NO: 343620 - RNA, 64 nt, hsa; identical to SEQ ID NO: 183211

SEQ ID NO: 343621 - RNA, 64 nt, hsa; identical to SEQ ID NO: 183212

SEQ ID NO: 343622 - RNA, 64 nt, hsa; identical to SEQ ID NO: 183213

SEQ ID NO: 343623 - RNA, 64 nt, hsa; identical to SEQ ID NO: 183214

SEQ ID NO: 343624 - RNA, 64 nt, hsa; identical to SEQ ID NO: 183215

SEQ ID NO: 343625 - RNA, 64 nt, hsa; identical to SEQ ID NO: 183216

SEQ ID NO: 343626 - RNA, 64 nt, hsa; identical to SEQ ID NO: 183217

SEQ ID NO: 343627 - RNA, 64 nt, hsa; identical to SEQ ID NO: 183218

SEQ ID NO: 343628 - RNA, 64 nt, hsa; identical to SEQ ID NO: 183219

SEQ ID NO: 343629 - RNA, 64 nt, hsa; identical to SEQ ID NO: 183220

SEQ ID NO: 343630 - RNA, 64 nt, hsa; identical to SEQ ID NO: 183221

SEQ ID NO: 343631 - RNA, 64 nt, hsa; identical to SEQ ID NO: 183222

SEQ ID NO: 343632 - RNA, 64 nt, hsa; identical to SEQ ID NO: 183223

SEQ ID NO: 343633 - RNA, 64 nt, hsa; identical to SEQ ID NO: 183224

SEQ ID NO: 343634 - RNA, 64 nt, hsa; identical to SEQ ID NO: 183225

SEQ ID NO: 343635 - RNA, 64 nt, hsa; identical to SEQ ID NO: 183226

SEQ ID NO: 343636 - RNA, 64 nt, hsa; identical to SEQ ID NO: 183227

SEQ ID NO: 343637 - RNA, 64 nt, hsa; identical to SEQ ID NO: 183228

SEQ ID NO: 343638 - RNA, 64 nt, hsa; identical to SEQ ID NO: 183229

SEQ ID NO: 343639 - RNA, 64 nt, hsa; identical to SEQ ID NO: 183230

SEQ ID NO: 343640 - RNA, 64 nt, hsa; identical to SEQ ID NO: 183231

SEQ ID NO: 343641 - RNA, 64 nt, hsa; identical to SEQ ID NO: 183232

SEQ ID NO: 343642 - RNA, 64 nt, hsa; identical to SEQ ID NO: 183233

SEQ ID NO: 343643 - RNA, 64 nt, hsa; identical to SEQ ID NO: 183234

SEQ ID NO: 343644 - RNA, 64 nt, hsa; identical to SEQ ID NO: 183235

SEQ ID NO: 343645 - RNA, 64 nt, hsa; identical to SEQ ID NO: 183236

SEQ ID NO: 343646 - RNA, 64 nt, hsa; identical to SEQ ID NO: 183237

SEQ ID NO: 343647 - RNA, 64 nt, hsa; identical to SEQ ID NO: 183238

SEQ ID NO: 343648 - RNA, 64 nt, hsa; identical to SEQ ID NO: 183239

SEQ ID NO: 343649 - RNA, 64 nt, hsa; identical to SEQ ID NO: 183240

SEQ ID NO: 343650 - RNA, 64 nt, hsa; identical to SEQ ID NO: 183241

SEQ ID NO: 343651 - RNA, 64 nt, hsa; identical to SEQ ID NO: 183242

SEQ ID NO: 343652 - RNA, 64 nt, hsa; identical to SEQ ID NO: 183243

SEQ ID NO: 343653 - RNA, 64 nt, hsa; identical to SEQ ID NO: 183244

SEQ ID NO: 343654 - RNA, 64 nt, hsa; identical to SEQ ID NO: 183245

SEQ ID NO: 343655 - RNA, 64 nt, hsa; identical to SEQ ID NO: 183246

SEQ ID NO: 343656 - RNA, 64 nt, hsa; identical to SEQ ID NO: 183247

SEQ ID NO: 343657 - RNA, 64 nt, hsa; identical to SEQ ID NO: 183248

SEQ ID NO: 343658 - RNA, 64 nt, hsa; identical to SEQ ID NO: 183249

SEQ ID NO: 343659 - RNA, 64 nt, hsa; identical to SEQ ID NO: 183250

SEQ ID NO: 343660 - RNA, 64 nt, hsa; identical to SEQ ID NO: 183251

SEQ ID NO: 343661 - RNA, 64 nt, hsa; identical to SEQ ID NO: 183252

SEQ ID NO: 343662 - RNA, 64 nt, hsa; identical to SEQ ID NO: 183253

SEQ ID NO: 343663 - RNA, 64 nt, hsa; identical to SEQ ID NO: 183254

SEQ ID NO: 343664 - RNA, 64 nt, hsa; identical to SEQ ID NO: 183255

SEQ ID NO: 343665 - RNA, 64 nt, hsa; identical to SEQ ID NO: 183256

SEQ ID NO: 343666 - RNA, 64 nt, hsa; identical to SEQ ID NO: 183257

SEQ ID NO: 343667 - RNA, 64 nt, hsa; identical to SEQ ID NO: 183258

SEQ ID NO: 343668 - RNA, 64 nt, hsa; identical to SEQ ID NO: 183259

SEQ ID NO: 343669 - RNA, 64 nt, hsa; identical to SEQ ID NO: 183260

SEQ ID NO: 343670 - RNA, 64 nt, hsa; identical to SEQ ID NO: 183261

SEQ ID NO: 343671 - RNA, 64 nt, hsa; identical to SEQ ID NO: 183262

SEQ ID NO: 343672 - RNA, 64 nt, hsa; identical to SEQ ID NO: 183263

SEQ ID NO: 343673 - RNA, 64 nt, hsa; identical to SEQ ID NO: 183264

SEQ ID NO: 343674 - RNA, 64 nt, hsa; identical to SEQ ID NO: 183265

SEQ ID NO: 343675 - RNA, 64 nt, hsa; identical to SEQ ID NO: 183266

SEQ ID NO: 343676 - RNA, 64 nt, hsa; identical to SEQ ID NO: 183267

SEQ ID NO: 343677 - RNA, 64 nt, hsa; identical to SEQ ID NO: 183268

SEQ ID NO: 343678 - RNA, 64 nt, hsa; identical to SEQ ID NO: 183269

SEQ ID NO: 343679 - RNA, 64 nt, hsa; identical to SEQ ID NO: 183270

SEQ ID NO: 343680 - RNA, 64 nt, hsa; identical to SEQ ID NO: 183271

SEQ ID NO: 343681 - RNA, 64 nt, hsa; identical to SEQ ID NO: 183272

SEQ ID NO: 343682 - RNA, 64 nt, hsa; identical to SEQ ID NO: 183273

SEQ ID NO: 343683 - RNA, 64 nt, hsa; identical to SEQ ID NO: 183274

SEQ ID NO: 343684 - RNA, 64 nt, hsa; identical to SEQ ID NO: 183275

SEQ ID NO: 343685 - RNA, 64 nt, hsa; identical to SEQ ID NO: 183276

SEQ ID NO: 343686 - RNA, 64 nt, hsa; identical to SEQ ID NO: 183277

SEQ ID NO: 343687 - RNA, 64 nt, hsa; identical to SEQ ID NO: 183278

SEQ ID NO: 343688 - RNA, 64 nt, hsa; identical to SEQ ID NO: 183279

SEQ ID NO: 343689 - RNA, 64 nt, hsa; identical to SEQ ID NO: 183280

SEQ ID NO: 343690 - RNA, 64 nt, hsa; identical to SEQ ID NO: 183281

SEQ ID NO: 343691 - RNA, 64 nt, hsa; identical to SEQ ID NO: 183282

SEQ ID NO: 343692 - RNA, 64 nt, hsa; identical to SEQ ID NO: 183283

SEQ ID NO: 343693 - RNA, 64 nt, hsa; identical to SEQ ID NO: 183284

SEQ ID NO: 343694 - RNA, 64 nt, hsa; identical to SEQ ID NO: 183285

SEQ ID NO: 343695 - RNA, 64 nt, hsa; identical to SEQ ID NO: 183286

SEQ ID NO: 343696 - RNA, 64 nt, hsa; identical to SEQ ID NO: 183287

SEQ ID NO: 343697 - RNA, 64 nt, hsa; identical to SEQ ID NO: 183288

SEQ ID NO: 343698 - RNA, 64 nt, hsa; identical to SEQ ID NO: 183289

SEQ ID NO: 343699 - RNA, 64 nt, hsa; identical to SEQ ID NO: 183290

SEQ ID NO: 343700 - RNA, 64 nt, hsa; identical to SEQ ID NO: 183291

SEQ ID NO: 343701 - RNA, 64 nt, hsa; identical to SEQ ID NO: 183292

SEQ ID NO: 343702 - RNA, 64 nt, hsa; identical to SEQ ID NO: 183293

SEQ ID NO: 343703 - RNA, 64 nt, hsa; identical to SEQ ID NO: 183294

SEQ ID NO: 343704 - RNA, 64 nt, hsa; identical to SEQ ID NO: 183295

SEQ ID NO: 343705 - RNA, 64 nt, hsa; identical to SEQ ID NO: 183296

SEQ ID NO: 343706 - RNA, 64 nt, hsa; identical to SEQ ID NO: 183297

SEQ ID NO: 343707 - RNA, 64 nt, hsa; identical to SEQ ID NO: 183298

SEQ ID NO: 343708 - RNA, 64 nt, hsa; identical to SEQ ID NO: 183299

SEQ ID NO: 343709 - RNA, 64 nt, hsa; identical to SEQ ID NO: 183300

SEQ ID NO: 343710 - RNA, 64 nt, hsa; identical to SEQ ID NO: 183301

SEQ ID NO: 343711 - RNA, 64 nt, hsa; identical to SEQ ID NO: 183302

SEQ ID NO: 343712 - RNA, 64 nt, hsa; identical to SEQ ID NO: 183303

SEQ ID NO: 343713 - RNA, 64 nt, hsa; identical to SEQ ID NO: 183304

SEQ ID NO: 343714 - RNA, 64 nt, hsa; identical to SEQ ID NO: 183305

SEQ ID NO: 343715 - RNA, 64 nt, hsa; identical to SEQ ID NO: 183306

SEQ ID NO: 343716 - RNA, 64 nt, hsa; identical to SEQ ID NO: 183307

SEQ ID NO: 343717 - RNA, 64 nt, hsa; identical to SEQ ID NO: 183308

SEQ ID NO: 343718 - RNA, 64 nt, hsa; identical to SEQ ID NO: 183309

SEQ ID NO: 343719 - RNA, 64 nt, hsa; identical to SEQ ID NO: 183310

SEQ ID NO: 343720 - RNA, 64 nt, hsa; identical to SEQ ID NO: 183311

SEQ ID NO: 343721 - RNA, 64 nt, hsa; identical to SEQ ID NO: 183312

SEQ ID NO: 343722 - RNA, 64 nt, hsa; identical to SEQ ID NO: 183313

SEQ ID NO: 343723 - RNA, 64 nt, hsa; identical to SEQ ID NO: 183314

SEQ ID NO: 343724 - RNA, 64 nt, hsa; identical to SEQ ID NO: 183315

SEQ ID NO: 343725 - RNA, 64 nt, hsa; identical to SEQ ID NO: 183316

SEQ ID NO: 343726 - RNA, 64 nt, hsa; identical to SEQ ID NO: 183317

SEQ ID NO: 343727 - RNA, 64 nt, hsa; identical to SEQ ID NO: 183318

SEQ ID NO: 343728 - RNA, 64 nt, hsa; identical to SEQ ID NO: 183319

SEQ ID NO: 343729 - RNA, 64 nt, hsa; identical to SEQ ID NO: 183320

SEQ ID NO: 343730 - RNA, 64 nt, hsa; identical to SEQ ID NO: 183321

SEQ ID NO: 343731 - RNA, 64 nt, hsa; identical to SEQ ID NO: 183322

SEQ ID NO: 343732 - RNA, 64 nt, hsa; identical to SEQ ID NO: 183323

SEQ ID NO: 343733 - RNA, 64 nt, hsa; identical to SEQ ID NO: 183324

SEQ ID NO: 343734 - RNA, 64 nt, hsa; identical to SEQ ID NO: 183325

SEQ ID NO: 343735 - RNA, 64 nt, hsa; identical to SEQ ID NO: 183326

SEQ ID NO: 343736 - RNA, 64 nt, hsa; identical to SEQ ID NO: 183327

SEQ ID NO: 343737 - RNA, 64 nt, hsa; identical to SEQ ID NO: 183328

SEQ ID NO: 343738 - RNA, 64 nt, hsa; identical to SEQ ID NO: 183329

SEQ ID NO: 343739 - RNA, 64 nt, hsa; identical to SEQ ID NO: 183330

SEQ ID NO: 343740 - RNA, 64 nt, hsa; identical to SEQ ID NO: 183331

SEQ ID NO: 343741 - RNA, 64 nt, hsa; identical to SEQ ID NO: 183332

SEQ ID NO: 343742 - RNA, 64 nt, hsa; identical to SEQ ID NO: 183333

SEQ ID NO: 343743 - RNA, 64 nt, hsa; identical to SEQ ID NO: 183334

SEQ ID NO: 343744 - RNA, 64 nt, hsa; identical to SEQ ID NO: 183335

SEQ ID NO: 343745 - RNA, 64 nt, hsa; identical to SEQ ID NO: 183336

SEQ ID NO: 343746 - RNA, 64 nt, hsa; identical to SEQ ID NO: 183337

SEQ ID NO: 343747 - RNA, 64 nt, hsa; identical to SEQ ID NO: 183338

SEQ ID NO: 343748 - RNA, 64 nt, hsa; identical to SEQ ID NO: 183339

SEQ ID NO: 343749 - RNA, 64 nt, hsa; identical to SEQ ID NO: 183340

SEQ ID NO: 343750 - RNA, 64 nt, hsa; identical to SEQ ID NO: 183341

SEQ ID NO: 343751 - RNA, 64 nt, hsa; identical to SEQ ID NO: 183342

SEQ ID NO: 343752 - RNA, 64 nt, hsa; identical to SEQ ID NO: 183343

SEQ ID NO: 343753 - RNA, 64 nt, hsa; identical to SEQ ID NO: 183344

SEQ ID NO: 343754 - RNA, 64 nt, hsa; identical to SEQ ID NO: 183345

SEQ ID NO: 343755 - RNA, 64 nt, hsa; identical to SEQ ID NO: 183346

SEQ ID NO: 343756 - RNA, 64 nt, hsa; identical to SEQ ID NO: 183347

SEQ ID NO: 343757 - RNA, 64 nt, hsa; identical to SEQ ID NO: 183348

SEQ ID NO: 343758 - RNA, 64 nt, hsa; identical to SEQ ID NO: 183349

SEQ ID NO: 343759 - RNA, 64 nt, hsa; identical to SEQ ID NO: 183350

SEQ ID NO: 343760 - RNA, 64 nt, hsa; identical to SEQ ID NO: 183351

SEQ ID NO: 343761 - RNA, 64 nt, hsa; identical to SEQ ID NO: 183352

SEQ ID NO: 343762 - RNA, 64 nt, hsa; identical to SEQ ID NO: 183353

SEQ ID NO: 343763 - RNA, 64 nt, hsa; identical to SEQ ID NO: 183354

SEQ ID NO: 343764 - RNA, 64 nt, hsa; identical to SEQ ID NO: 183355

SEQ ID NO: 343765 - RNA, 64 nt, hsa; identical to SEQ ID NO: 183356

SEQ ID NO: 343766 - RNA, 64 nt, hsa; identical to SEQ ID NO: 183357

SEQ ID NO: 343767 - RNA, 64 nt, hsa; identical to SEQ ID NO: 183358

SEQ ID NO: 343768 - RNA, 64 nt, hsa; identical to SEQ ID NO: 183359

SEQ ID NO: 343769 - RNA, 64 nt, hsa; identical to SEQ ID NO: 183360

SEQ ID NO: 343770 - RNA, 64 nt, hsa; identical to SEQ ID NO: 183361

SEQ ID NO: 343771 - RNA, 64 nt, hsa; identical to SEQ ID NO: 183362

SEQ ID NO: 343772 - RNA, 64 nt, hsa; identical to SEQ ID NO: 183363

SEQ ID NO: 343773 - RNA, 64 nt, hsa; identical to SEQ ID NO: 183364

SEQ ID NO: 343774 - RNA, 64 nt, hsa; identical to SEQ ID NO: 183365

SEQ ID NO: 343775 - RNA, 64 nt, hsa; identical to SEQ ID NO: 183366

SEQ ID NO: 343776 - RNA, 64 nt, hsa; identical to SEQ ID NO: 183367

SEQ ID NO: 343777 - RNA, 64 nt, hsa; identical to SEQ ID NO: 183368

SEQ ID NO: 343778 - RNA, 63 nt, hsa; identical to SEQ ID NO: 183369

SEQ ID NO: 343779 - RNA, 64 nt, hsa; identical to SEQ ID NO: 183370

SEQ ID NO: 343780 - RNA, 64 nt, hsa; identical to SEQ ID NO: 183371

SEQ ID NO: 343781 - RNA, 64 nt, hsa; identical to SEQ ID NO: 183372

SEQ ID NO: 343782 - RNA, 64 nt, hsa; identical to SEQ ID NO: 183373

SEQ ID NO: 343783 - RNA, 64 nt, hsa; identical to SEQ ID NO: 183374

SEQ ID NO: 343784 - RNA, 64 nt, hsa; identical to SEQ ID NO: 183375

SEQ ID NO: 343785 - RNA, 64 nt, hsa; identical to SEQ ID NO: 183376

SEQ ID NO: 343786 - RNA, 64 nt, hsa; identical to SEQ ID NO: 183377

SEQ ID NO: 343787 - RNA, 64 nt, hsa; identical to SEQ ID NO: 183378

SEQ ID NO: 343788 - RNA, 64 nt, hsa; identical to SEQ ID NO: 183379

SEQ ID NO: 343789 - RNA, 64 nt, hsa; identical to SEQ ID NO: 183380

SEQ ID NO: 343790 - RNA, 64 nt, hsa; identical to SEQ ID NO: 183381

SEQ ID NO: 343791 - RNA, 64 nt, hsa; identical to SEQ ID NO: 183382

SEQ ID NO: 343792 - RNA, 64 nt, hsa; identical to SEQ ID NO: 183383

SEQ ID NO: 343793 - RNA, 64 nt, hsa; identical to SEQ ID NO: 183384

SEQ ID NO: 343794 - RNA, 64 nt, hsa; identical to SEQ ID NO: 183385

SEQ ID NO: 343795 - RNA, 64 nt, hsa; identical to SEQ ID NO: 183386

SEQ ID NO: 343796 - RNA, 64 nt, hsa; identical to SEQ ID NO: 183387

SEQ ID NO: 343797 - RNA, 64 nt, hsa; identical to SEQ ID NO: 183388

SEQ ID NO: 343798 - RNA, 64 nt, hsa; identical to SEQ ID NO: 183389

SEQ ID NO: 343799 - RNA, 64 nt, hsa; identical to SEQ ID NO: 183390

SEQ ID NO: 343800 - RNA, 64 nt, hsa; identical to SEQ ID NO: 183391

SEQ ID NO: 343801 - RNA, 64 nt, hsa; identical to SEQ ID NO: 183392

SEQ ID NO: 343802 - RNA, 64 nt, hsa; identical to SEQ ID NO: 183393

SEQ ID NO: 343803 - RNA, 64 nt, hsa; identical to SEQ ID NO: 183394

SEQ ID NO: 343804 - RNA, 64 nt, hsa; identical to SEQ ID NO: 183395

SEQ ID NO: 343805 - RNA, 64 nt, hsa; identical to SEQ ID NO: 183396

SEQ ID NO: 343806 - RNA, 64 nt, hsa; identical to SEQ ID NO: 183397

SEQ ID NO: 343807 - RNA, 64 nt, hsa; identical to SEQ ID NO: 183398

SEQ ID NO: 343808 - RNA, 64 nt, hsa; identical to SEQ ID NO: 183399

SEQ ID NO: 343809 - RNA, 64 nt, hsa; identical to SEQ ID NO: 183400

SEQ ID NO: 343810 - RNA, 64 nt, hsa; identical to SEQ ID NO: 183401

SEQ ID NO: 343811 - RNA, 64 nt, hsa; identical to SEQ ID NO: 183402

SEQ ID NO: 343812 - RNA, 64 nt, hsa; identical to SEQ ID NO: 183403

SEQ ID NO: 343813 - RNA, 64 nt, hsa; identical to SEQ ID NO: 183404

SEQ ID NO: 343814 - RNA, 64 nt, hsa; identical to SEQ ID NO: 183405

SEQ ID NO: 343815 - RNA, 64 nt, hsa; identical to SEQ ID NO: 183406

SEQ ID NO: 343816 - RNA, 64 nt, hsa; identical to SEQ ID NO: 183407

SEQ ID NO: 343817 - RNA, 64 nt, hsa; identical to SEQ ID NO: 183408

SEQ ID NO: 343818 - RNA, 64 nt, hsa; identical to SEQ ID NO: 183409

SEQ ID NO: 343819 - RNA, 64 nt, hsa; identical to SEQ ID NO: 183410

SEQ ID NO: 343820 - RNA, 64 nt, hsa; identical to SEQ ID NO: 183411

SEQ ID NO: 343821 - RNA, 64 nt, hsa; identical to SEQ ID NO: 183412

SEQ ID NO: 343822 - RNA, 64 nt, hsa; identical to SEQ ID NO: 183413

SEQ ID NO: 343823 - RNA, 64 nt, hsa; identical to SEQ ID NO: 183414

SEQ ID NO: 343824 - RNA, 64 nt, hsa; identical to SEQ ID NO: 183415

SEQ ID NO: 343825 - RNA, 64 nt, hsa; identical to SEQ ID NO: 183416

SEQ ID NO: 343826 - RNA, 64 nt, hsa; identical to SEQ ID NO: 183417

SEQ ID NO: 343827 - RNA, 64 nt, hsa; identical to SEQ ID NO: 183418

SEQ ID NO: 343828 - RNA, 64 nt, hsa; identical to SEQ ID NO: 183419

SEQ ID NO: 343829 - RNA, 64 nt, hsa; identical to SEQ ID NO: 183420

SEQ ID NO: 343830 - RNA, 64 nt, hsa; identical to SEQ ID NO: 183421

SEQ ID NO: 343831 - RNA, 64 nt, hsa; identical to SEQ ID NO: 183422

SEQ ID NO: 343832 - RNA, 64 nt, hsa; identical to SEQ ID NO: 183423

SEQ ID NO: 343833 - RNA, 64 nt, hsa; identical to SEQ ID NO: 183424

SEQ ID NO: 343834 - RNA, 64 nt, hsa; identical to SEQ ID NO: 183425

SEQ ID NO: 343835 - RNA, 64 nt, hsa; identical to SEQ ID NO: 183426

SEQ ID NO: 343836 - RNA, 64 nt, hsa; identical to SEQ ID NO: 183427

SEQ ID NO: 343837 - RNA, 64 nt, hsa; identical to SEQ ID NO: 183428

SEQ ID NO: 343838 - RNA, 64 nt, hsa; identical to SEQ ID NO: 183429

SEQ ID NO: 343839 - RNA, 64 nt, hsa; identical to SEQ ID NO: 183430

SEQ ID NO: 343840 - RNA, 64 nt, hsa; identical to SEQ ID NO: 183431

SEQ ID NO: 343841 - RNA, 64 nt, hsa; identical to SEQ ID NO: 183432

SEQ ID NO: 343842 - RNA, 64 nt, hsa; identical to SEQ ID NO: 183433

SEQ ID NO: 343843 - RNA, 64 nt, hsa; identical to SEQ ID NO: 183434

SEQ ID NO: 343844 - RNA, 64 nt, hsa; identical to SEQ ID NO: 183435

SEQ ID NO: 343845 - RNA, 64 nt, hsa; identical to SEQ ID NO: 183436

SEQ ID NO: 343846 - RNA, 64 nt, hsa; identical to SEQ ID NO: 183437

SEQ ID NO: 343847 - RNA, 64 nt, hsa; identical to SEQ ID NO: 183438

SEQ ID NO: 343848 - RNA, 64 nt, hsa; identical to SEQ ID NO: 183439

SEQ ID NO: 343849 - RNA, 64 nt, hsa; identical to SEQ ID NO: 183440

SEQ ID NO: 343850 - RNA, 64 nt, hsa; identical to SEQ ID NO: 183441

SEQ ID NO: 343851 - RNA, 64 nt, hsa; identical to SEQ ID NO: 183442

SEQ ID NO: 343852 - RNA, 64 nt, hsa; identical to SEQ ID NO: 183443

SEQ ID NO: 343853 - RNA, 64 nt, hsa; identical to SEQ ID NO: 183444

SEQ ID NO: 343854 - RNA, 64 nt, hsa; identical to SEQ ID NO: 183445

SEQ ID NO: 343855 - RNA, 64 nt, hsa; identical to SEQ ID NO: 183446

SEQ ID NO: 343856 - RNA, 64 nt, hsa; identical to SEQ ID NO: 183447

SEQ ID NO: 343857 - RNA, 64 nt, hsa; identical to SEQ ID NO: 183448

SEQ ID NO: 343858 - RNA, 64 nt, hsa; identical to SEQ ID NO: 183449

SEQ ID NO: 343859 - RNA, 64 nt, hsa; identical to SEQ ID NO: 183450

SEQ ID NO: 343860 - RNA, 64 nt, hsa; identical to SEQ ID NO: 183451

SEQ ID NO: 343861 - RNA, 64 nt, hsa; identical to SEQ ID NO: 183452

SEQ ID NO: 343862 - RNA, 64 nt, hsa; identical to SEQ ID NO: 183453

SEQ ID NO: 343863 - RNA, 64 nt, hsa; identical to SEQ ID NO: 183454

SEQ ID NO: 343864 - RNA, 64 nt, hsa; identical to SEQ ID NO: 183455

SEQ ID NO: 343865 - RNA, 64 nt, hsa; identical to SEQ ID NO: 183456

SEQ ID NO: 343866 - RNA, 64 nt, hsa; identical to SEQ ID NO: 183457

SEQ ID NO: 343867 - RNA, 64 nt, hsa; identical to SEQ ID NO: 183458

SEQ ID NO: 343868 - RNA, 64 nt, hsa; identical to SEQ ID NO: 183459

SEQ ID NO: 343869 - RNA, 64 nt, hsa; identical to SEQ ID NO: 183460

SEQ ID NO: 343870 - RNA, 64 nt, hsa; identical to SEQ ID NO: 183461

SEQ ID NO: 343871 - RNA, 64 nt, hsa; identical to SEQ ID NO: 183462

SEQ ID NO: 343872 - RNA, 64 nt, hsa; identical to SEQ ID NO: 183463

SEQ ID NO: 343873 - RNA, 64 nt, hsa; identical to SEQ ID NO: 183464

SEQ ID NO: 343874 - RNA, 64 nt, hsa; identical to SEQ ID NO: 183465

SEQ ID NO: 343875 - RNA, 64 nt, hsa; identical to SEQ ID NO: 183466

SEQ ID NO: 343876 - RNA, 64 nt, hsa; identical to SEQ ID NO: 183467

SEQ ID NO: 343877 - RNA, 64 nt, hsa; identical to SEQ ID NO: 183468

SEQ ID NO: 343878 - RNA, 64 nt, hsa; identical to SEQ ID NO: 183469

SEQ ID NO: 343879 - RNA, 64 nt, hsa; identical to SEQ ID NO: 183470

SEQ ID NO: 343880 - RNA, 64 nt, hsa; identical to SEQ ID NO: 183471

SEQ ID NO: 343881 - RNA, 64 nt, hsa; identical to SEQ ID NO: 183472

SEQ ID NO: 343882 - RNA, 64 nt, hsa; identical to SEQ ID NO: 183473

SEQ ID NO: 343883 - RNA, 64 nt, hsa; identical to SEQ ID NO: 183474

SEQ ID NO: 343884 - RNA, 64 nt, hsa; identical to SEQ ID NO: 183475

SEQ ID NO: 343885 - RNA, 64 nt, hsa; identical to SEQ ID NO: 183476

SEQ ID NO: 343886 - RNA, 64 nt, hsa; identical to SEQ ID NO: 183477

SEQ ID NO: 343887 - RNA, 64 nt, hsa; identical to SEQ ID NO: 183478

SEQ ID NO: 343888 - RNA, 64 nt, hsa; identical to SEQ ID NO: 183479

SEQ ID NO: 343889 - RNA, 64 nt, hsa; identical to SEQ ID NO: 183480

SEQ ID NO: 343890 - RNA, 64 nt, hsa; identical to SEQ ID NO: 183481

SEQ ID NO: 343891 - RNA, 64 nt, hsa; identical to SEQ ID NO: 183482

SEQ ID NO: 343892 - RNA, 64 nt, hsa; identical to SEQ ID NO: 183483

SEQ ID NO: 343893 - RNA, 64 nt, hsa; identical to SEQ ID NO: 183484

SEQ ID NO: 343894 - RNA, 64 nt, hsa; identical to SEQ ID NO: 183485

SEQ ID NO: 343895 - RNA, 64 nt, hsa; identical to SEQ ID NO: 183486

SEQ ID NO: 343896 - RNA, 64 nt, hsa; identical to SEQ ID NO: 183487

SEQ ID NO: 343897 - RNA, 64 nt, hsa; identical to SEQ ID NO: 183488

SEQ ID NO: 343898 - RNA, 64 nt, hsa; identical to SEQ ID NO: 183489

SEQ ID NO: 343899 - RNA, 64 nt, hsa; identical to SEQ ID NO: 183490

SEQ ID NO: 343900 - RNA, 64 nt, hsa; identical to SEQ ID NO: 183491

SEQ ID NO: 343901 - RNA, 64 nt, hsa; identical to SEQ ID NO: 183492

SEQ ID NO: 343902 - RNA, 64 nt, hsa; identical to SEQ ID NO: 183493

SEQ ID NO: 343903 - RNA, 64 nt, hsa; identical to SEQ ID NO: 183494

SEQ ID NO: 343904 - RNA, 64 nt, hsa; identical to SEQ ID NO: 183495

SEQ ID NO: 343905 - RNA, 64 nt, hsa; identical to SEQ ID NO: 183496

SEQ ID NO: 343906 - RNA, 64 nt, hsa; identical to SEQ ID NO: 183497

SEQ ID NO: 343907 - RNA, 64 nt, hsa; identical to SEQ ID NO: 183498

SEQ ID NO: 343908 - RNA, 64 nt, hsa; identical to SEQ ID NO: 183499

SEQ ID NO: 343909 - RNA, 64 nt, hsa; identical to SEQ ID NO: 183500

SEQ ID NO: 343910 - RNA, 64 nt, hsa; identical to SEQ ID NO: 183501

SEQ ID NO: 343911 - RNA, 64 nt, hsa; identical to SEQ ID NO: 183502

SEQ ID NO: 343912 - RNA, 64 nt, hsa; identical to SEQ ID NO: 183503

SEQ ID NO: 343913 - RNA, 64 nt, hsa; identical to SEQ ID NO: 183504

SEQ ID NO: 343914 - RNA, 64 nt, hsa; identical to SEQ ID NO: 183505

SEQ ID NO: 343915 - RNA, 64 nt, hsa; identical to SEQ ID NO: 183506

SEQ ID NO: 343916 - RNA, 64 nt, hsa; identical to SEQ ID NO: 183507

SEQ ID NO: 343917 - RNA, 64 nt, hsa; identical to SEQ ID NO: 183508

SEQ ID NO: 343918 - RNA, 64 nt, hsa; identical to SEQ ID NO: 183509

SEQ ID NO: 343919 - RNA, 64 nt, hsa; identical to SEQ ID NO: 183510

SEQ ID NO: 343920 - RNA, 64 nt, hsa; identical to SEQ ID NO: 183511

SEQ ID NO: 343921 - RNA, 64 nt, hsa; identical to SEQ ID NO: 183512

SEQ ID NO: 343922 - RNA, 64 nt, hsa; identical to SEQ ID NO: 183513

SEQ ID NO: 343923 - RNA, 64 nt, hsa; identical to SEQ ID NO: 183514

SEQ ID NO: 343924 - RNA, 64 nt, hsa; identical to SEQ ID NO: 183515

SEQ ID NO: 343925 - RNA, 64 nt, hsa; identical to SEQ ID NO: 183516

SEQ ID NO: 343926 - RNA, 64 nt, hsa; identical to SEQ ID NO: 183517

SEQ ID NO: 343927 - RNA, 64 nt, hsa; identical to SEQ ID NO: 183518

SEQ ID NO: 343928 - RNA, 64 nt, hsa; identical to SEQ ID NO: 183519

SEQ ID NO: 343929 - RNA, 64 nt, hsa; identical to SEQ ID NO: 183520

SEQ ID NO: 343930 - RNA, 64 nt, hsa; identical to SEQ ID NO: 183521

SEQ ID NO: 343931 - RNA, 64 nt, hsa; identical to SEQ ID NO: 183522

SEQ ID NO: 343932 - RNA, 64 nt, hsa; identical to SEQ ID NO: 183523

SEQ ID NO: 343933 - RNA, 64 nt, hsa; identical to SEQ ID NO: 183524

SEQ ID NO: 343934 - RNA, 64 nt, hsa; identical to SEQ ID NO: 183525

SEQ ID NO: 343935 - RNA, 64 nt, hsa; identical to SEQ ID NO: 183526

SEQ ID NO: 343936 - RNA, 64 nt, hsa; identical to SEQ ID NO: 183527

SEQ ID NO: 343937 - RNA, 64 nt, hsa; identical to SEQ ID NO: 183528

SEQ ID NO: 343938 - RNA, 64 nt, hsa; identical to SEQ ID NO: 183529

SEQ ID NO: 343939 - RNA, 64 nt, hsa; identical to SEQ ID NO: 183530

SEQ ID NO: 343940 - RNA, 64 nt, hsa; identical to SEQ ID NO: 183531

SEQ ID NO: 343941 - RNA, 64 nt, hsa; identical to SEQ ID NO: 183532

SEQ ID NO: 343942 - RNA, 64 nt, hsa; identical to SEQ ID NO: 183533

SEQ ID NO: 343943 - RNA, 64 nt, hsa; identical to SEQ ID NO: 183534

SEQ ID NO: 343944 - RNA, 64 nt, hsa; identical to SEQ ID NO: 183535

SEQ ID NO: 343945 - RNA, 64 nt, hsa; identical to SEQ ID NO: 183536

SEQ ID NO: 343946 - RNA, 64 nt, hsa; identical to SEQ ID NO: 183537

SEQ ID NO: 343947 - RNA, 64 nt, hsa; identical to SEQ ID NO: 183538

SEQ ID NO: 343948 - RNA, 64 nt, hsa; identical to SEQ ID NO: 183539

SEQ ID NO: 343949 - RNA, 64 nt, hsa; identical to SEQ ID NO: 183540

SEQ ID NO: 343950 - RNA, 64 nt, hsa; identical to SEQ ID NO: 183541

SEQ ID NO: 343951 - RNA, 64 nt, hsa; identical to SEQ ID NO: 183542

SEQ ID NO: 343952 - RNA, 64 nt, hsa; identical to SEQ ID NO: 183543

SEQ ID NO: 343953 - RNA, 64 nt, hsa; identical to SEQ ID NO: 183544

SEQ ID NO: 343954 - RNA, 64 nt, hsa; identical to SEQ ID NO: 183545

SEQ ID NO: 343955 - RNA, 64 nt, hsa; identical to SEQ ID NO: 183546

SEQ ID NO: 343956 - RNA, 64 nt, hsa; identical to SEQ ID NO: 183547

SEQ ID NO: 343957 - RNA, 64 nt, hsa; identical to SEQ ID NO: 183548

SEQ ID NO: 343958 - RNA, 64 nt, hsa; identical to SEQ ID NO: 183549

SEQ ID NO: 343959 - RNA, 64 nt, hsa; identical to SEQ ID NO: 183550

SEQ ID NO: 343960 - RNA, 64 nt, hsa; identical to SEQ ID NO: 183551

SEQ ID NO: 343961 - RNA, 64 nt, hsa; identical to SEQ ID NO: 183552

SEQ ID NO: 343962 - RNA, 64 nt, hsa; identical to SEQ ID NO: 183553

SEQ ID NO: 343963 - RNA, 64 nt, hsa; identical to SEQ ID NO: 183554

SEQ ID NO: 343964 - RNA, 64 nt, hsa; identical to SEQ ID NO: 183555

SEQ ID NO: 343965 - RNA, 64 nt, hsa; identical to SEQ ID NO: 183556

SEQ ID NO: 343966 - RNA, 64 nt, hsa; identical to SEQ ID NO: 183557

SEQ ID NO: 343967 - RNA, 64 nt, hsa; identical to SEQ ID NO: 183558

SEQ ID NO: 343968 - RNA, 64 nt, hsa; identical to SEQ ID NO: 183559

SEQ ID NO: 343969 - RNA, 64 nt, hsa; identical to SEQ ID NO: 183560

SEQ ID NO: 343970 - RNA, 64 nt, hsa; identical to SEQ ID NO: 183561

SEQ ID NO: 343971 - RNA, 64 nt, hsa; identical to SEQ ID NO: 183562

SEQ ID NO: 343972 - RNA, 64 nt, hsa; identical to SEQ ID NO: 183563

SEQ ID NO: 343973 - RNA, 64 nt, hsa; identical to SEQ ID NO: 183564

SEQ ID NO: 343974 - RNA, 64 nt, hsa; identical to SEQ ID NO: 183565

SEQ ID NO: 343975 - RNA, 64 nt, hsa; identical to SEQ ID NO: 183566

SEQ ID NO: 343976 - RNA, 64 nt, hsa; identical to SEQ ID NO: 183567

SEQ ID NO: 343977 - RNA, 64 nt, hsa; identical to SEQ ID NO: 183568

SEQ ID NO: 343978 - RNA, 64 nt, hsa; identical to SEQ ID NO: 183569

SEQ ID NO: 343979 - RNA, 64 nt, hsa; identical to SEQ ID NO: 183570

SEQ ID NO: 343980 - RNA, 64 nt, hsa; identical to SEQ ID NO: 183571

SEQ ID NO: 343981 - RNA, 64 nt, hsa; identical to SEQ ID NO: 183572

SEQ ID NO: 343982 - RNA, 64 nt, hsa; identical to SEQ ID NO: 183573

SEQ ID NO: 343983 - RNA, 64 nt, hsa; identical to SEQ ID NO: 183574

SEQ ID NO: 343984 - RNA, 64 nt, hsa; identical to SEQ ID NO: 183575

SEQ ID NO: 343985 - RNA, 64 nt, hsa; identical to SEQ ID NO: 183576

SEQ ID NO: 343986 - RNA, 64 nt, hsa; identical to SEQ ID NO: 183577

SEQ ID NO: 343987 - RNA, 64 nt, hsa; identical to SEQ ID NO: 183578

SEQ ID NO: 343988 - RNA, 64 nt, hsa; identical to SEQ ID NO: 183579

SEQ ID NO: 343989 - RNA, 64 nt, hsa; identical to SEQ ID NO: 183580

SEQ ID NO: 343990 - RNA, 64 nt, hsa; identical to SEQ ID NO: 183581

SEQ ID NO: 343991 - RNA, 64 nt, hsa; identical to SEQ ID NO: 183582

SEQ ID NO: 343992 - RNA, 64 nt, hsa; identical to SEQ ID NO: 183583

SEQ ID NO: 343993 - RNA, 64 nt, hsa; identical to SEQ ID NO: 183584

SEQ ID NO: 343994 - RNA, 64 nt, hsa; identical to SEQ ID NO: 183585

SEQ ID NO: 343995 - RNA, 64 nt, hsa; identical to SEQ ID NO: 183586

SEQ ID NO: 343996 - RNA, 64 nt, hsa; identical to SEQ ID NO: 183587

SEQ ID NO: 343997 - RNA, 64 nt, hsa; identical to SEQ ID NO: 183588

SEQ ID NO: 343998 - RNA, 64 nt, hsa; identical to SEQ ID NO: 183589

SEQ ID NO: 343999 - RNA, 64 nt, hsa; identical to SEQ ID NO: 183590

SEQ ID NO: 344000 - RNA, 64 nt, hsa; identical to SEQ ID NO: 183591

SEQ ID NO: 344001 - RNA, 64 nt, hsa; identical to SEQ ID NO: 183592

SEQ ID NO: 344002 - RNA, 64 nt, hsa; identical to SEQ ID NO: 183593

SEQ ID NO: 344003 - RNA, 64 nt, hsa; identical to SEQ ID NO: 183594

SEQ ID NO: 344004 - RNA, 64 nt, hsa; identical to SEQ ID NO: 183595

SEQ ID NO: 344005 - RNA, 64 nt, hsa; identical to SEQ ID NO: 183596

SEQ ID NO: 344006 - RNA, 64 nt, hsa; identical to SEQ ID NO: 183597

SEQ ID NO: 344007 - RNA, 64 nt, hsa; identical to SEQ ID NO: 183598

SEQ ID NO: 344008 - RNA, 64 nt, hsa; identical to SEQ ID NO: 183599

SEQ ID NO: 344009 - RNA, 64 nt, hsa; identical to SEQ ID NO: 183600

SEQ ID NO: 344010 - RNA, 64 nt, hsa; identical to SEQ ID NO: 183601

SEQ ID NO: 344011 - RNA, 64 nt, hsa; identical to SEQ ID NO: 183602

SEQ ID NO: 344012 - RNA, 64 nt, hsa; identical to SEQ ID NO: 183603

SEQ ID NO: 344013 - RNA, 64 nt, hsa
uccuuuuauaagauuuaauuguaauugucucaaagcaucaaauaauacaucuuuaucauuaaac

SEQ ID NO: 344014 - RNA, 64 nt, hsa
ggacugcaauaucaacaacaaguuguuucaaacagcaucaaaauacaacuucauugcuacacuu

SEQ ID NO: 344015 - RNA, 64 nt, hsa
caaauguaacgugcaugcuuaagcuuuuacccaggcaucaaaaccggaacaucacaggguuuau

SEQ ID NO: 344016 - RNA, 64 nt, hsa
gauagagauuuuccgcaggccaaagucucacuaggcaucaaaaacuuuuuugaugaaaccauac

SEQ ID NO: 344017 - RNA, 64 nt, hsa
caccuguaucucuuguugggagaaaagcugaguguugggagaagcugaggccgagcuugcaugu

SEQ ID NO: 344018 - RNA, 64 nt, hsa
ugucuaccugucuccuacccaccuguaucucuuguugggagaaaagcugaguguugggagaagc

SEQ ID NO: 344019 - RNA, 64 nt, hsa
gggcugguguggaggugcucauggggugcggugcuugggagacagccaggcccaggguggcugc

SEQ ID NO: 344020 - RNA, 64 nt, hsa
guucuucuugcagaaugugcucugguggaacaaguugggagaggcugggggggccaagggcaca

SEQ ID NO: 344021 - RNA, 64 nt, hsa
auuaccuuaaucuuuguugcucaagugccagagguugggagaaggauugcagguugggagaggu

SEQ ID NO: 344022 - RNA, 64 nt, hsa
cucaagugccagagguugggagaaggauugcagguugggagaggugggaaauagcagugaauuu

SEQ ID NO: 344023 - RNA, 64 nt, hsa
uuuuuuuccuucugcaauacauuugaaaacuuguuugggagacucugcauuuuuuauugugguu

SEQ ID NO: 344024 - RNA, 64 nt, hsa
guugguuuauacaagcaugcguugcacuucuuuuuugggagauguguguuguugauguucuaug

SEQ ID NO: 344025 - RNA, 64 nt, hsa
aaagauuaaaaguuacuuuaaauuugccaauauuuugggagaacaauaaaacuacauuuuuucc

SEQ ID NO: 344026 - RNA, 64 nt, hsa
aauuggugacuauguauagcugucguuagucuuuuugggagacuguuaggaacaguuuguacag

SEQ ID NO: 344027 - RNA, 64 nt, hsa
aaacuuccuucaacccaggaagcgucuuuggugcuugggagaccaagaaaccaagaaauuaaca

SEQ ID NO: 344028 - RNA, 64 nt, hsa
uuauaaucccaugaaaauguaaauuacaguuuacuugggagagccagauuuucucugugcucuu

SEQ ID NO: 344029 - RNA, 64 nt, hsa
ucuuugaugagcuggucccucagaacaugacuccuugggagauccccaucacaaaagguacccu

SEQ ID NO: 344030 - RNA, 64 nt, hsa
agacauauggcuugagaagcggagauauuggagauugggagaccagggcccgggguuugggagg

SEQ ID NO: 344031 - RNA, 64 nt, hsa
ccuggaaggagccuauuauagaggguugguuauguugggagauugggccugaauuucuccacag

SEQ ID NO: 344032 - RNA, 64 nt, hsa
ccuacuauccucccacucgagaguucacuucugguugggagacaggauuccuagcaccuccggu

SEQ ID NO: 344033 - RNA, 64 nt, hsa
aauaaaucauaccucaaaggauggagugcaucaauugggagaaaaggagacauagcccaaaccc

SEQ ID NO: 344034 - RNA, 64 nt, hsa
gauaaggggugggagugugauuuuaaaugcucuuuugggagaacaaagaaauuaauguaaauaa

SEQ ID NO: 344035 - RNA, 64 nt, hsa
aaucuugucuuaccacaguguuuuauaggagagauugggagaaaucauccuguuuucucuguga

SEQ ID NO: 344036 - RNA, 64 nt, hsa
ugcugauaaaauaugagccgguuauuacuucuguuugggagacugugcucucuguggugccucu

SEQ ID NO: 344037 - RNA, 64 nt, hsa
gugguaauauuuggagcuuuauagccuguauuccuugggagaaaaaaaugggaauuggaguaaa

SEQ ID NO: 344038 - RNA, 64 nt, hsa
aauuucagaugacaguguggucagaagauguuuuuugggagaaccuaguguuugcugggcacua

SEQ ID NO: 344039 - RNA, 64 nt, hsa
guggggagggauuuggggcucagagugggguagguugggagaaugucaguauguggaagugugg

SEQ ID NO: 344040 - RNA, 64 nt, hsa
uucucugggauauugauacuguuuguguuuuuaguugggagaucugagagaccuggcuuuggca

SEQ ID NO: 344041 - RNA, 64 nt, hsa
aagagaagguuuuuaaggaggggcuucugaauacuugggagauacggaacggaccaaggaccac

SEQ ID NO: 344042 - RNA, 64 nt, hsa
aaauuaugagugagcuguuaacucuaaaauguacuugggagauaggccaagcgagaggucaugg

SEQ ID NO: 344043 - RNA, 64 nt, hsa
uugcuggauacuugcaguucugccaucaccuccacuguaccaagacuuggugggaaguaagcug

SEQ ID NO: 344044 - RNA, 64 nt, hsa
uacuaccccuguagcugugaaccuccgggcucaucuguaccaaggacauagaacauucuuugua

SEQ ID NO: 344045 - RNA, 64 nt, hsa
agucuuaaagucugcuauuuacagagcauugaaucuguaccaauuugcaauagaaagccuucag

SEQ ID NO: 344046 - RNA, 64 nt, hsa
uuucuuugagaagcaaauuauucaguaggugccucuguaccaaauauuuuauggaauaucuaaa

SEQ ID NO: 344047 - RNA, 64 nt, hsa
gagcccaggagguugaggcuggagugagccaugacuguaccacugcauuccagccugggugacg

SEQ ID NO: 344048 - RNA, 64 nt, hsa
uuggaucuuuuacauuugaugcucaaguuugauucuguaccagaucuggguuuggggugauggc

SEQ ID NO: 344049 - RNA, 64 nt, hsa
cuaaggauuuuccuuuaauuucucuggaguaauacuguaccauacuggucuuugcuuuuaguaa

SEQ ID NO: 344050 - RNA, 64 nt, hsa
ucuaaauuguguguucuguacaugugauguuugacuguaccauugacuguuauggaaguucagc

SEQ ID NO: 344051 - RNA, 64 nt, hsa
aguuuguguuucuuuguugccaguguuaccuuugcuguaccauagacuuaaaauuccucuauug

SEQ ID NO: 344052 - RNA, 64 nt, hsa
uacugcuuguauaguggccucaucuuccuuccugcuguaccacagauggcccaggagaggcacu

SEQ ID NO: 344053 - RNA, 64 nt, hsa; identical to SEQ ID NO: 99154

SEQ ID NO: 344054 - RNA, 64 nt, hsa; identical to SEQ ID NO: 99155

SEQ ID NO: 344055 - RNA, 64 nt, hsa; identical to SEQ ID NO: 99156

SEQ ID NO: 344056 - RNA, 64 nt, hsa; identical to SEQ ID NO: 99157

SEQ ID NO: 344057 - RNA, 64 nt, hsa; identical to SEQ ID NO: 99158

SEQ ID NO: 344058 - RNA, 64 nt, hsa; identical to SEQ ID NO: 99159

SEQ ID NO: 344059 - RNA, 64 nt, hsa; identical to SEQ ID NO: 99160

SEQ ID NO: 344060 - RNA, 64 nt, hsa; identical to SEQ ID NO: 99161

SEQ ID NO: 344061 - RNA, 64 nt, hsa; identical to SEQ ID NO: 99162

SEQ ID NO: 344062 - RNA, 64 nt, hsa; identical to SEQ ID NO: 99163

SEQ ID NO: 344063 - RNA, 64 nt, hsa; identical to SEQ ID NO: 99164

SEQ ID NO: 344064 - RNA, 64 nt, hsa; identical to SEQ ID NO: 99165

SEQ ID NO: 344065 - RNA, 64 nt, hsa; identical to SEQ ID NO: 99166

SEQ ID NO: 344066 - RNA, 64 nt, hsa; identical to SEQ ID NO: 99167

SEQ ID NO: 344067 - RNA, 64 nt, hsa; identical to SEQ ID NO: 99168

SEQ ID NO: 344068 - RNA, 64 nt, hsa; identical to SEQ ID NO: 99169

SEQ ID NO: 344069 - RNA, 64 nt, hsa; identical to SEQ ID NO: 99170

SEQ ID NO: 344070 - RNA, 64 nt, hsa; identical to SEQ ID NO: 99171

SEQ ID NO: 344071 - RNA, 64 nt, hsa; identical to SEQ ID NO: 99172

SEQ ID NO: 344072 - RNA, 64 nt, hsa; identical to SEQ ID NO: 99173

SEQ ID NO: 344073 - RNA, 64 nt, hsa; identical to SEQ ID NO: 99174

SEQ ID NO: 344074 - RNA, 64 nt, hsa; identical to SEQ ID NO: 99175

SEQ ID NO: 344075 - RNA, 64 nt, hsa; identical to SEQ ID NO: 99176

SEQ ID NO: 344076 - RNA, 64 nt, hsa; identical to SEQ ID NO: 99177

SEQ ID NO: 344077 - RNA, 64 nt, hsa; identical to SEQ ID NO: 99178

SEQ ID NO: 344078 - RNA, 64 nt, hsa; identical to SEQ ID NO: 99179

SEQ ID NO: 344079 - RNA, 64 nt, hsa; identical to SEQ ID NO: 123308

SEQ ID NO: 344080 - RNA, 64 nt, hsa; identical to SEQ ID NO: 123309

SEQ ID NO: 344081 - RNA, 64 nt, hsa; identical to SEQ ID NO: 123310

SEQ ID NO: 344082 - RNA, 64 nt, hsa; identical to SEQ ID NO: 123311

SEQ ID NO: 344083 - RNA, 64 nt, hsa; identical to SEQ ID NO: 123312

SEQ ID NO: 344084 - RNA, 64 nt, hsa; identical to SEQ ID NO: 123313

SEQ ID NO: 344085 - RNA, 64 nt, hsa; identical to SEQ ID NO: 123314

SEQ ID NO: 344086 - RNA, 64 nt, hsa; identical to SEQ ID NO: 123315

SEQ ID NO: 344087 - RNA, 64 nt, hsa; identical to SEQ ID NO: 123316

SEQ ID NO: 344088 - RNA, 64 nt, hsa; identical to SEQ ID NO: 123317

SEQ ID NO: 344089 - RNA, 64 nt, hsa; identical to SEQ ID NO: 123318

SEQ ID NO: 344090 - RNA, 64 nt, hsa; identical to SEQ ID NO: 123319

SEQ ID NO: 344091 - RNA, 64 nt, hsa; identical to SEQ ID NO: 123320

SEQ ID NO: 344092 - RNA, 64 nt, hsa; identical to SEQ ID NO: 123321

SEQ ID NO: 344093 - RNA, 64 nt, hsa; identical to SEQ ID NO: 123322

SEQ ID NO: 344094 - RNA, 64 nt, hsa; identical to SEQ ID NO: 123323

SEQ ID NO: 344095 - RNA, 64 nt, hsa; identical to SEQ ID NO: 123324

SEQ ID NO: 344096 - RNA, 64 nt, hsa; identical to SEQ ID NO: 123325

SEQ ID NO: 344097 - RNA, 64 nt, hsa; identical to SEQ ID NO: 123326

SEQ ID NO: 344098 - RNA, 64 nt, hsa; identical to SEQ ID NO: 123327

SEQ ID NO: 344099 - RNA, 64 nt, hsa; identical to SEQ ID NO: 123328

SEQ ID NO: 344100 - RNA, 64 nt, hsa; identical to SEQ ID NO: 123329

SEQ ID NO: 344101 - RNA, 64 nt, hsa; identical to SEQ ID NO: 123330

SEQ ID NO: 344102 - RNA, 64 nt, hsa; identical to SEQ ID NO: 123331

SEQ ID NO: 344103 - RNA, 64 nt, hsa; identical to SEQ ID NO: 123332

SEQ ID NO: 344104 - RNA, 64 nt, hsa; identical to SEQ ID NO: 123333

SEQ ID NO: 344105 - RNA, 64 nt, hsa; identical to SEQ ID NO: 123334

SEQ ID NO: 344106 - RNA, 64 nt, hsa; identical to SEQ ID NO: 123335

SEQ ID NO: 344107 - RNA, 64 nt, hsa; identical to SEQ ID NO: 123336

SEQ ID NO: 344108 - RNA, 64 nt, hsa; identical to SEQ ID NO: 123337

SEQ ID NO: 344109 - RNA, 64 nt, hsa; identical to SEQ ID NO: 123338

SEQ ID NO: 344110 - RNA, 64 nt, hsa; identical to SEQ ID NO: 123339

SEQ ID NO: 344111 - RNA, 64 nt, hsa; identical to SEQ ID NO: 123340

SEQ ID NO: 344112 - RNA, 64 nt, hsa; identical to SEQ ID NO: 123341

SEQ ID NO: 344113 - RNA, 61 nt, hsa; identical to SEQ ID NO: 123342

SEQ ID NO: 344114 - RNA, 64 nt, hsa; identical to SEQ ID NO: 123343

SEQ ID NO: 344115 - RNA, 64 nt, hsa; identical to SEQ ID NO: 123344

SEQ ID NO: 344116 - RNA, 64 nt, hsa; identical to SEQ ID NO: 123345

SEQ ID NO: 344117 - RNA, 64 nt, hsa; identical to SEQ ID NO: 123346

SEQ ID NO: 344118 - RNA, 64 nt, hsa; identical to SEQ ID NO: 123347

SEQ ID NO: 344119 - RNA, 64 nt, hsa; identical to SEQ ID NO: 123348

SEQ ID NO: 344120 - RNA, 64 nt, hsa; identical to SEQ ID NO: 123349

SEQ ID NO: 344121 - RNA, 64 nt, hsa; identical to SEQ ID NO: 123350

SEQ ID NO: 344122 - RNA, 64 nt, hsa; identical to SEQ ID NO: 123351

SEQ ID NO: 344123 - RNA, 64 nt, hsa; identical to SEQ ID NO: 123352

SEQ ID NO: 344124 - RNA, 64 nt, hsa; identical to SEQ ID NO: 123353

SEQ ID NO: 344125 - RNA, 64 nt, hsa; identical to SEQ ID NO: 123354

SEQ ID NO: 344126 - RNA, 64 nt, hsa; identical to SEQ ID NO: 123355

SEQ ID NO: 344127 - RNA, 64 nt, hsa; identical to SEQ ID NO: 123356

SEQ ID NO: 344128 - RNA, 64 nt, hsa; identical to SEQ ID NO: 123357

SEQ ID NO: 344129 - RNA, 64 nt, hsa; identical to SEQ ID NO: 123358

SEQ ID NO: 344130 - RNA, 64 nt, hsa; identical to SEQ ID NO: 123359

SEQ ID NO: 344131 - RNA, 64 nt, hsa; identical to SEQ ID NO: 123360

SEQ ID NO: 344132 - RNA, 64 nt, hsa; identical to SEQ ID NO: 123361

SEQ ID NO: 344133 - RNA, 64 nt, hsa; identical to SEQ ID NO: 123362

SEQ ID NO: 344134 - RNA, 64 nt, hsa; identical to SEQ ID NO: 123363

SEQ ID NO: 344135 - RNA, 64 nt, hsa; identical to SEQ ID NO: 123364

SEQ ID NO: 344136 - RNA, 64 nt, hsa; identical to SEQ ID NO: 123365

SEQ ID NO: 344137 - RNA, 64 nt, hsa; identical to SEQ ID NO: 123366

SEQ ID NO: 344138 - RNA, 64 nt, hsa; identical to SEQ ID NO: 123367

SEQ ID NO: 344139 - RNA, 64 nt, hsa; identical to SEQ ID NO: 123368

SEQ ID NO: 344140 - RNA, 64 nt, hsa; identical to SEQ ID NO: 123369

SEQ ID NO: 344141 - RNA, 64 nt, hsa; identical to SEQ ID NO: 21574

SEQ ID NO: 344142 - RNA, 64 nt, hsa; identical to SEQ ID NO: 21575

SEQ ID NO: 344143 - RNA, 64 nt, hsa; identical to SEQ ID NO: 21576

SEQ ID NO: 344144 - RNA, 64 nt, hsa; identical to SEQ ID NO: 21577

SEQ ID NO: 344145 - RNA, 64 nt, hsa; identical to SEQ ID NO: 21578

SEQ ID NO: 344146 - RNA, 64 nt, hsa; identical to SEQ ID NO: 21579

SEQ ID NO: 344147 - RNA, 64 nt, hsa; identical to SEQ ID NO: 21580

SEQ ID NO: 344148 - RNA, 64 nt, hsa; identical to SEQ ID NO: 21581

SEQ ID NO: 344149 - RNA, 64 nt, hsa; identical to SEQ ID NO: 21582

SEQ ID NO: 344150 - RNA, 64 nt, hsa; identical to SEQ ID NO: 21583

SEQ ID NO: 344151 - RNA, 64 nt, hsa; identical to SEQ ID NO: 21584

SEQ ID NO: 344152 - RNA, 64 nt, hsa; identical to SEQ ID NO: 21585

SEQ ID NO: 344153 - RNA, 64 nt, hsa; identical to SEQ ID NO: 21586

SEQ ID NO: 344154 - RNA, 64 nt, hsa; identical to SEQ ID NO: 21587

SEQ ID NO: 344155 - RNA, 64 nt, hsa; identical to SEQ ID NO: 21588

SEQ ID NO: 344156 - RNA, 64 nt, hsa; identical to SEQ ID NO: 21589

SEQ ID NO: 344157 - RNA, 64 nt, hsa; identical to SEQ ID NO: 21590

SEQ ID NO: 344158 - RNA, 64 nt, hsa; identical to SEQ ID NO: 21591

SEQ ID NO: 344159 - RNA, 64 nt, hsa; identical to SEQ ID NO: 21592

SEQ ID NO: 344160 - RNA, 64 nt, hsa; identical to SEQ ID NO: 21593

SEQ ID NO: 344161 - RNA, 64 nt, hsa; identical to SEQ ID NO: 21594

SEQ ID NO: 344162 - RNA, 64 nt, hsa; identical to SEQ ID NO: 21595

SEQ ID NO: 344163 - RNA, 64 nt, hsa; identical to SEQ ID NO: 21596

SEQ ID NO: 344164 - RNA, 64 nt, hsa; identical to SEQ ID NO: 21597

SEQ ID NO: 344165 - RNA, 64 nt, hsa; identical to SEQ ID NO: 21598

SEQ ID NO: 344166 - RNA, 64 nt, hsa; identical to SEQ ID NO: 21599

SEQ ID NO: 344167 - RNA, 64 nt, hsa; identical to SEQ ID NO: 21600

SEQ ID NO: 344168 - RNA, 64 nt, hsa; identical to SEQ ID NO: 21601

SEQ ID NO: 344169 - RNA, 64 nt, hsa; identical to SEQ ID NO: 21602

SEQ ID NO: 344170 - RNA, 64 nt, hsa; identical to SEQ ID NO: 21603

SEQ ID NO: 344171 - RNA, 64 nt, hsa; identical to SEQ ID NO: 21604

SEQ ID NO: 344172 - RNA, 64 nt, hsa; identical to SEQ ID NO: 21605

SEQ ID NO: 344173 - RNA, 64 nt, hsa; identical to SEQ ID NO: 21606

SEQ ID NO: 344174 - RNA, 64 nt, hsa; identical to SEQ ID NO: 21607

SEQ ID NO: 344175 - RNA, 64 nt, hsa; identical to SEQ ID NO: 21608

SEQ ID NO: 344176 - RNA, 64 nt, hsa; identical to SEQ ID NO: 21609

SEQ ID NO: 344177 - RNA, 64 nt, hsa; identical to SEQ ID NO: 21610

SEQ ID NO: 344178 - RNA, 64 nt, hsa; identical to SEQ ID NO: 21611

SEQ ID NO: 344179 - RNA, 64 nt, hsa; identical to SEQ ID NO: 21612

SEQ ID NO: 344180 - RNA, 64 nt, hsa; identical to SEQ ID NO: 21613

SEQ ID NO: 344181 - RNA, 64 nt, hsa; identical to SEQ ID NO: 21614

SEQ ID NO: 344182 - RNA, 64 nt, hsa; identical to SEQ ID NO: 21615

SEQ ID NO: 344183 - RNA, 64 nt, hsa; identical to SEQ ID NO: 21616

SEQ ID NO: 344184 - RNA, 64 nt, hsa; identical to SEQ ID NO: 21617

SEQ ID NO: 344185 - RNA, 64 nt, hsa; identical to SEQ ID NO: 21618

SEQ ID NO: 344186 - RNA, 64 nt, hsa; identical to SEQ ID NO: 21619

SEQ ID NO: 344187 - RNA, 64 nt, hsa; identical to SEQ ID NO: 21620

SEQ ID NO: 344188 - RNA, 64 nt, hsa; identical to SEQ ID NO: 21621

SEQ ID NO: 344189 - RNA, 64 nt, hsa; identical to SEQ ID NO: 21622

SEQ ID NO: 344190 - RNA, 64 nt, hsa; identical to SEQ ID NO: 21623

SEQ ID NO: 344191 - RNA, 64 nt, hsa; identical to SEQ ID NO: 21624

SEQ ID NO: 344192 - RNA, 64 nt, hsa; identical to SEQ ID NO: 21625

SEQ ID NO: 344193 - RNA, 64 nt, hsa; identical to SEQ ID NO: 21626

SEQ ID NO: 344194 - RNA, 64 nt, hsa; identical to SEQ ID NO: 21627

SEQ ID NO: 344195 - RNA, 64 nt, hsa; identical to SEQ ID NO: 21628

SEQ ID NO: 344196 - RNA, 64 nt, hsa; identical to SEQ ID NO: 21629

SEQ ID NO: 344197 - RNA, 64 nt, hsa; identical to SEQ ID NO: 21630

SEQ ID NO: 344198 - RNA, 57 nt, hsa; identical to SEQ ID NO: 21631

SEQ ID NO: 344199 - RNA, 64 nt, hsa; identical to SEQ ID NO: 21632

SEQ ID NO: 344200 - RNA, 64 nt, hsa; identical to SEQ ID NO: 21633

SEQ ID NO: 344201 - RNA, 64 nt, hsa; identical to SEQ ID NO: 21634

SEQ ID NO: 344202 - RNA, 64 nt, hsa; identical to SEQ ID NO: 21635

SEQ ID NO: 344203 - RNA, 64 nt, hsa; identical to SEQ ID NO: 21636

SEQ ID NO: 344204 - RNA, 64 nt, hsa; identical to SEQ ID NO: 21637

SEQ ID NO: 344205 - RNA, 64 nt, hsa; identical to SEQ ID NO: 21638

SEQ ID NO: 344206 - RNA, 64 nt, hsa; identical to SEQ ID NO: 21639

SEQ ID NO: 344207 - RNA, 64 nt, hsa; identical to SEQ ID NO: 21640

SEQ ID NO: 344208 - RNA, 64 nt, hsa; identical to SEQ ID NO: 21641

SEQ ID NO: 344209 - RNA, 64 nt, hsa; identical to SEQ ID NO: 21642

SEQ ID NO: 344210 - RNA, 64 nt, hsa; identical to SEQ ID NO: 21643

SEQ ID NO: 344211 - RNA, 64 nt, hsa; identical to SEQ ID NO: 21644

SEQ ID NO: 344212 - RNA, 64 nt, hsa; identical to SEQ ID NO: 21645

SEQ ID NO: 344213 - RNA, 64 nt, hsa; identical to SEQ ID NO: 21646

SEQ ID NO: 344214 - RNA, 64 nt, hsa; identical to SEQ ID NO: 21647

SEQ ID NO: 344215 - RNA, 64 nt, hsa; identical to SEQ ID NO: 21648

SEQ ID NO: 344216 - RNA, 64 nt, hsa; identical to SEQ ID NO: 21649

SEQ ID NO: 344217 - RNA, 64 nt, hsa; identical to SEQ ID NO: 21650

SEQ ID NO: 344218 - RNA, 64 nt, hsa; identical to SEQ ID NO: 21651

SEQ ID NO: 344219 - RNA, 64 nt, hsa; identical to SEQ ID NO: 21652

SEQ ID NO: 344220 - RNA, 64 nt, hsa; identical to SEQ ID NO: 21653

SEQ ID NO: 344221 - RNA, 64 nt, hsa; identical to SEQ ID NO: 21654

SEQ ID NO: 344222 - RNA, 64 nt, hsa; identical to SEQ ID NO: 21655

SEQ ID NO: 344223 - RNA, 64 nt, hsa; identical to SEQ ID NO: 21656

SEQ ID NO: 344224 - RNA, 64 nt, hsa; identical to SEQ ID NO: 21657

SEQ ID NO: 344225 - RNA, 64 nt, hsa; identical to SEQ ID NO: 21658

SEQ ID NO: 344226 - RNA, 64 nt, hsa; identical to SEQ ID NO: 21659

SEQ ID NO: 344227 - RNA, 64 nt, hsa; identical to SEQ ID NO: 21660

SEQ ID NO: 344228 - RNA, 64 nt, hsa; identical to SEQ ID NO: 21661

SEQ ID NO: 344229 - RNA, 64 nt, hsa; identical to SEQ ID NO: 21662

SEQ ID NO: 344230 - RNA, 64 nt, hsa; identical to SEQ ID NO: 21663

SEQ ID NO: 344231 - RNA, 64 nt, hsa; identical to SEQ ID NO: 21664

SEQ ID NO: 344232 - RNA, 64 nt, hsa; identical to SEQ ID NO: 21665

SEQ ID NO: 344233 - RNA, 64 nt, hsa; identical to SEQ ID NO: 21666

SEQ ID NO: 344234 - RNA, 64 nt, hsa; identical to SEQ ID NO: 21667

SEQ ID NO: 344235 - RNA, 64 nt, hsa; identical to SEQ ID NO: 21668

SEQ ID NO: 344236 - RNA, 64 nt, hsa; identical to SEQ ID NO: 21669

SEQ ID NO: 344237 - RNA, 64 nt, hsa; identical to SEQ ID NO: 21670

SEQ ID NO: 344238 - RNA, 64 nt, hsa; identical to SEQ ID NO: 21671

SEQ ID NO: 344239 - RNA, 64 nt, hsa; identical to SEQ ID NO: 21672

SEQ ID NO: 344240 - RNA, 64 nt, hsa; identical to SEQ ID NO: 21673

SEQ ID NO: 344241 - RNA, 64 nt, hsa; identical to SEQ ID NO: 21674

SEQ ID NO: 344242 - RNA, 64 nt, hsa; identical to SEQ ID NO: 21675

SEQ ID NO: 344243 - RNA, 64 nt, hsa; identical to SEQ ID NO: 21676

SEQ ID NO: 344244 - RNA, 64 nt, hsa; identical to SEQ ID NO: 21677

SEQ ID NO: 344245 - RNA, 64 nt, hsa; identical to SEQ ID NO: 21678

SEQ ID NO: 344246 - RNA, 64 nt, hsa; identical to SEQ ID NO: 21679

SEQ ID NO: 344247 - RNA, 64 nt, hsa; identical to SEQ ID NO: 21680

SEQ ID NO: 344248 - RNA, 64 nt, hsa; identical to SEQ ID NO: 21681

SEQ ID NO: 344249 - RNA, 64 nt, hsa; identical to SEQ ID NO: 21682

SEQ ID NO: 344250 - RNA, 64 nt, hsa
gugccgccagugguccaaggagggagacagagggucgucccaacagggggagguagggcuuuga

SEQ ID NO: 344251 - RNA, 64 nt, hsa
ggcaggggauggggugggguaccggauuucgguaucgucccagacccaagugagucacgcuucc

SEQ ID NO: 344252 - RNA, 64 nt, hsa
uuaaugugcuuuuuuuguauaaagugcaaacauuucgucccaaagucuaaguacuuuagugcag

SEQ ID NO: 344253 - RNA, 64 nt, hsa
gccgugcagacgaccuugguucacuuuucaggggucgucccaacucuguaucuccagccacucc

SEQ ID NO: 344254 - RNA, 64 nt, hsa
cucagcuuugcgugugcccagccgugugcacagcucgucccaacuccugcggguggcaccugcc

SEQ ID NO: 344255 - RNA, 64 nt, hsa
acccuggcgccaggaaggagcauguguuagcgucucgucccaccuggaauuguaauaaauacau

SEQ ID NO: 344256 - RNA, 64 nt, hsa
aagaaaaucuuuuuuaguuauuuguuuguuuacuucgucccaugugcuaacuaucuuauauaua

SEQ ID NO: 344257 - RNA, 64 nt, hsa
gauugcaaauggcuucagaggucaccaaguucagucgucccaaaacauggguguguuucaaaau

SEQ ID NO: 344258 - RNA, 64 nt, hsa
ggggccaucagggcuaaccacuucacaccuaccaucgucccauggggauccaagaccugagaua

SEQ ID NO: 344259 - RNA, 64 nt, hsa
cucucagccuggcagauguggaaacucaaauuucucgucccacuccagguuuuggcuagccaac

SEQ ID NO: 344260 - RNA, 64 nt, hsa
ccaguucuuugggcugggucaaggcaaagcucagucgucccagcagcaccucagccaucuguag

SEQ ID NO: 344261 - RNA, 64 nt, hsa
gcccucagauuccacaaagccucucuccccucccucgucccacccccacccaggcaggaagccc

SEQ ID NO: 344262 - RNA, 64 nt, hsa
gccagcuggcaccugccucuaucccagacugcccucgucccagcucucuguccaacuguugauu

SEQ ID NO: 344263 - RNA, 64 nt, hsa
aacgcugcaguuccuuuaugaagaggcuuuucugucgucccaggcuagcagagauggauagcuu

SEQ ID NO: 344264 - RNA, 64 nt, hsa
ugucuccagccuggcucuaucuuccuccuugugaucgucccauccccacaucccgugcaccccc

SEQ ID NO: 344265 - RNA, 64 nt, hsa
cacacaggccuccagcugggccaugucagucucaucgucccaaggcuugaaauccagcaggaug

SEQ ID NO: 344266 - RNA, 64 nt, hsa
gugucuagggguucugccuggucaacguuauuugucgucccaucuuuuggcagcaaaaccaccu

SEQ ID NO: 344267 - RNA, 64 nt, hsa
ccccagccaugcggccaccccuuagcacaccugcucgucccauuuagcuuacccucccaguugg

SEQ ID NO: 344268 - RNA, 64 nt, hsa
gcaggcugcaggagggcacuggagcugggaggucucgucccagcccuccccaucucggggcugc

SEQ ID NO: 344269 - RNA, 64 nt, hsa
gggcacccuggccacccugguccuuggauccccuucgucccaccugguccaccccagaugcuga

SEQ ID NO: 344270 - RNA, 64 nt, hsa
ggugaaagcauuucuuaugguucccugagucaguucgucccacacauccucccugaggcaccug

SEQ ID NO: 344271 - RNA, 64 nt, hsa
guugccuuccugaaggugaccaagcuuccaaagcucgucccacuggccucuguacauuucccug

SEQ ID NO: 344272 - RNA, 64 nt, hsa
cuccgcccgccgggcucugcguccccacguccccucgucccauccccacguccccucaucccgu

SEQ ID NO: 344273 - RNA, 64 nt, hsa
cuccugacuggggcuugcgacucacaggauugcaucgucccagcugcuaacuuggggccggggc

SEQ ID NO: 344274 - RNA, 64 nt, hsa
cuccuggugacagguggcaccugucccacagcccucgucccauguggaacuuaccauugggauu

SEQ ID NO: 344275 - RNA, 64 nt, hsa
aagugcuggacugcaggcugcagugaucccucuuucgucccacccccucuucccucagcagccc

SEQ ID NO: 344276 - RNA, 64 nt, hsa
ugccagucagccgaggauguaguuguugcugccgucgucccaccaccucagggaccagagggcu

SEQ ID NO: 344277 - RNA, 64 nt, hsa
uuauuuuucucuuuccuacuccuauuaaagaaccucgucccaguguuuccugcuuaagccuggu

SEQ ID NO: 344278 - RNA, 64 nt, hsa
auauugaauacugacaagagaauacccauacaaaucgucccaccgcccuagaggccacagaauu

SEQ ID NO: 344279 - RNA, 64 nt, hsa
uuucucuccaaccagggcagaaaggagggaggauucgucccauuacaauaaugaaauaaugaua

SEQ ID NO: 344280 - RNA, 64 nt, hsa
uucuuuuacuguuauagaauagccugagguccccucgucccauccagcuaccaccacggccacc

SEQ ID NO: 344281 - RNA, 64 nt, hsa
caaaaaauuagccgggugugguggugggcaccugucgucccagcuacuagggaggcugaggcag

SEQ ID NO: 344282 - RNA, 64 nt, hsa
uaugagacaggcacuggcugaagacaggcaacucucgucccaaccaucauucacccugagugac

SEQ ID NO: 344283 - RNA, 64 nt, hsa
aggaucuccagccucccagaagccugcugugcuuucgucccacagcuuucugcccauuguuucu

SEQ ID NO: 344284 - RNA, 64 nt, hsa
ccagguucacugaggggcccuggucuccccgcagucgucccaggcugccggcuccccucgacag

SEQ ID NO: 344285 - RNA, 64 nt, hsa
acaggcucuagagagagggagaaacaaguggaccucgucccaucuucacucuucacuugaguug

SEQ ID NO: 344286 - RNA, 64 nt, hsa
auuccuggcuucauuuuuugcugaugguucccccucgucccaaaucucucucccaguacaccag

SEQ ID NO: 344287 - RNA, 64 nt, hsa
gugccgaugcucuggcccuccccaauacgcugcuucgucccacugcaccgccuggcugagggcg

SEQ ID NO: 344288 - RNA, 64 nt, hsa
gagugccgaccuuggguggcggggccugggucucucgucccacccggagggcacagacaccggc

SEQ ID NO: 344289 - RNA, 64 nt, hsa
gaccauggaccucuuuuguuuguauguuguauugucgucccaacggaaggagagcuccugacuc

SEQ ID NO: 344290 - RNA, 64 nt, hsa
auagcaaaggucuucuucccucgccccuucuccaucgucccaggaaucccagggggcagcacag

SEQ ID NO: 344291 - RNA, 64 nt, hsa
uccguaggaaaaagucggaaugcucucgacggccucgucccagccugggacaggcccccuuucc

SEQ ID NO: 344292 - RNA, 64 nt, hsa
gggcaucagggugagguccgggacucuugggucaucgucccacaguggcugaucggcugccaag

SEQ ID NO: 344293 - RNA, 64 nt, hsa
agguuuuugcgaaccccagaagagaccaaaggagucgucccaggcuccucgcgccucaggugga

SEQ ID NO: 344294 - RNA, 64 nt, hsa
aauuaaaaaacacguguagcuguggguaaggaagucgucccauuuuauggauguggaaacugag

SEQ ID NO: 344295 - RNA, 64 nt, hsa
aauuugcuggaguguucaccuguuguuaucugugucgucccacugagugcauucaccaccuuuu

SEQ ID NO: 344296 - RNA, 64 nt, hsa
gaacccgggagguggagguugcagugagccgagaucgucccacugcacuccagccugggcaaca

SEQ ID NO: 344297 - RNA, 64 nt, hsa
uugugggacucaccugacucaaagaugacuaauaucgucccauuuuggaaauaaagcaacagac

SEQ ID NO: 344298 - RNA, 64 nt, hsa
acuggggacuaagguugcaggccuuagccucgucucgucccagaggcauuggaucaggagaaug

SEQ ID NO: 344299 - RNA, 64 nt, hsa
gaacccuggagguggagguugcagugagcugagaucgucccacugcacuccagcccgggcaaca

SEQ ID NO: 344300 - RNA, 64 nt, hsa
uccuggagcagccugggcccuucagccccugugcucgucccacccuagggacucagccacuugc

SEQ ID NO: 344301 - RNA, 64 nt, hsa
gggaggacagcucuggcccuucuuaggccuagccucgucccaagcuaaauguaagccaguuggg

SEQ ID NO: 344302 - RNA, 64 nt, hsa
ggggagaaagggaagucaggguucuagggguuauucgucccaggaaauagaagugaaauugucu

SEQ ID NO: 344303 - RNA, 64 nt, hsa
ucagguuugagucaggaggcucccuguacuggagucgucccacuauuccucaagaaaucuuaga

SEQ ID NO: 344304 - RNA, 64 nt, hsa
cccuaucccuaggcacuuaaccaagacaaaaagccacaaugaacaucccuuuuucaaugaauuu

SEQ ID NO: 344305 - RNA, 64 nt, hsa
uuacuguacaggguuaucugcaagugaggugugucacaaugagauugaauuucacugucuuuaa

SEQ ID NO: 344306 - RNA, 64 nt, hsa
ggccagcaucauucuaauaccaaaaccugacaggcacaaugaaaaaagaaaacuucaggcuggu

SEQ ID NO: 344307 - RNA, 64 nt, hsa
auaucgcuaaucauuaaggaaaugcaaucaaagccacaaugagauaccaucucagaccugucug

SEQ ID NO: 344308 - RNA, 64 nt, hsa
gcauuaucaaaauaaaguagcagaccucucaauucacaaugaguuaacugauaaaacaaaacag

SEQ ID NO: 344309 - RNA, 64 nt, hsa
uucuugaaaacauuaaugauacaugaaucuuggccacaaugagaaaaauaaaaaugaaaaaaga

SEQ ID NO: 344310 - RNA, 64 nt, hsa
aaauacaguagaagcucacaaauagauuucuuugcacaaugauuuuuugcaaaauuuuacagua

SEQ ID NO: 344311 - RNA, 64 nt, hsa
guuuugugacugagaaauuucugugcuuccaauccacaaugagaugcaugauuuuguuuucauc

SEQ ID NO: 344312 - RNA, 64 nt, hsa
ccugcaguugcuggauggauagggacaccaggaagaggacaaacugcauggacucaagcgagcu

SEQ ID NO: 344313 - RNA, 64 nt, hsa
uaacccaccauuuauugccuucugagaggugggugaggacaagcaugugccugugugugugugu

SEQ ID NO: 344314 - RNA, 64 nt, hsa
aguggggucacguaaaggaauugcaggucggugagaggacaagagggacucccauguucuaagc

SEQ ID NO: 344315 - RNA, 64 nt, hsa
uuuaaaccugagagauagguauuguuucccagaugaggacaaugaggcaaagaaauaucaagua

SEQ ID NO: 344316 - RNA, 64 nt, hsa
aggcccuagcggcagaaaggaaaaccugaagacugaggacaaaguggaggagggccgagguggg

SEQ ID NO: 344317 - RNA, 64 nt, hsa
uguauagugccaccacagcuuauggcaucucauugaggacaaagaaaacugcacaauaaaacca

SEQ ID NO: 344318 - RNA, 64 nt, hsa
ccugccuccacccacaguggagagggcuacaaaggaggacaagacccucucaggcugucccaag

SEQ ID NO: 344319 - RNA, 64 nt, hsa
ugggaauuuuauugacacaguaccauuuaauggggaggacaaaauggggcaggggagggagaag

SEQ ID NO: 344320 - RNA, 64 nt, hsa
uaaacagaggauaucggcauuuguuucuuucucugaggacaagagaaaaaagccagguuccaca

SEQ ID NO: 344321 - RNA, 64 nt, hsa
auuaagauuuauuuauuguauuuaaaccuggugagaggacaagugaggucugcucagaccuugu

SEQ ID NO: 344322 - RNA, 64 nt, hsa
gauccuaaaagguagccucuucauaggaacccaggaggacaaaaccaccaugcauuaagauuua

SEQ ID NO: 344323 - RNA, 58 nt, hsa
aagaugcagccgggaggugaacagcagagaggacaaugcauccuucagcgugguggag

SEQ ID NO: 344324 - RNA, 64 nt, hsa
ucagggacagaucugaugaucccaggaggcucuggaggacaaucuaggaccuacauuaucugga

SEQ ID NO: 344325 - RNA, 64 nt, hsa; identical to SEQ ID NO: 123292

SEQ ID NO: 344326 - RNA, 64 nt, hsa; identical to SEQ ID NO: 123293

SEQ ID NO: 344327 - RNA, 64 nt, hsa; identical to SEQ ID NO: 123294

SEQ ID NO: 344328 - RNA, 64 nt, hsa; identical to SEQ ID NO: 123295

SEQ ID NO: 344329 - RNA, 64 nt, hsa; identical to SEQ ID NO: 123296

SEQ ID NO: 344330 - RNA, 64 nt, hsa; identical to SEQ ID NO: 123297

SEQ ID NO: 344331 - RNA, 64 nt, hsa; identical to SEQ ID NO: 123298

SEQ ID NO: 344332 - RNA, 64 nt, hsa; identical to SEQ ID NO: 123299

SEQ ID NO: 344333 - RNA, 64 nt, hsa; identical to SEQ ID NO: 123300

SEQ ID NO: 344334 - RNA, 64 nt, hsa; identical to SEQ ID NO: 123301

SEQ ID NO: 344335 - RNA, 64 nt, hsa; identical to SEQ ID NO: 123302

SEQ ID NO: 344336 - RNA, 64 nt, hsa; identical to SEQ ID NO: 123303

SEQ ID NO: 344337 - RNA, 64 nt, hsa; identical to SEQ ID NO: 123304

SEQ ID NO: 344338 - RNA, 64 nt, hsa; identical to SEQ ID NO: 123305

SEQ ID NO: 344339 - RNA, 64 nt, hsa; identical to SEQ ID NO: 123306

SEQ ID NO: 344340 - RNA, 64 nt, hsa; identical to SEQ ID NO: 123307

SEQ ID NO: 344341 - RNA, 62 nt, hsa
aagucuaaccagccucagcagugugcauagaccauuuccaggagggucuguccccagaugcu

SEQ ID NO: 344342 - RNA, 62 nt, hsa
aaacagccagaagccaccuugacacuuuugaacauuuccaguucuguagaguuuauugucaa

SEQ ID NO: 344343 - RNA, 62 nt, hsa
ucaguguguuuagacuuuucaaguaucuaacucauuuccaaacauguaccauguuuuauaaa

SEQ ID NO: 344344 - RNA, 62 nt, hsa
ugaauacuuuuguauugcugcuugcaaauaugcauuuccaaacuugaaauauaggugugaac

SEQ ID NO: 344345 - RNA, 62 nt, hsa
aagacaagaggaagggcagguacuagguguuucauuuccagaauuaaaaaaaaaauccauuu

SEQ ID NO: 344346 - RNA, 62 nt, hsa
cugaaaauaaugucuacaguccacagcuucagcauuuccagagaccacaugugagcuucuuu

SEQ ID NO: 344347 - RNA, 62 nt, hsa
aguuuuucagaaaaugcaucccugauuucauucauuuccagcuugaaagccagccauauuac

SEQ ID NO: 344348 - RNA, 62 nt, hsa
acucuagucccuaccaaacugcucuagaaggucauuuccauuuuguuugugauauuuagacg

SEQ ID NO: 344349 - RNA, 62 nt, hsa
caccauggacucaaucugagaacaacagcauucauuuccauucauuuccauacuggcuuuug

SEQ ID NO: 344350 - RNA, 62 nt, hsa
ucaaucugagaacaacagcauucauuuccauucauuuccauacuggcuuuugauuauaugca

SEQ ID NO: 344351 - RNA, 62 nt, hsa
caacuuuucuuccuuauggggcuacauuuguucauuuccagcaguagcauaaacuuacggug

SEQ ID NO: 344352 - RNA, 62 nt, hsa
cuugaggguagagccacaaauuucaauucuuacauuuccauuugcaaagugacuagagaaaa

SEQ ID NO: 344353 - RNA, 62 nt, hsa
cccugcagcaaacguuugccugggcauugaggcauuuccauacaucuucugaaaacuaggcg

SEQ ID NO: 344354 - RNA, 62 nt, hsa
gugauugaacacuuuaguaaugcaaaauaacucauuuccaacuacugcugcagcauuuuggu

SEQ ID NO: 344355 - RNA, 62 nt, hsa
uaauguuuuuuucacuuaauauuuuauauauacauuuccauguauugauguaguuaguccac

SEQ ID NO: 344356 - RNA, 62 nt, hsa
auguuuucauaggcuauuauauauucucgcagcauuuccaguuaagaggauauuagguauau

SEQ ID NO: 344357 - RNA, 62 nt, hsa
auguuacccaaacucaucuucuaaaaucugugcauuuccaugguggcugacacacuugucau

SEQ ID NO: 344358 - RNA, 62 nt, hsa
caaagugagcauuucuuuuuaaauuuucuugacauuuccaagcuuauuaugaauaauauugc

SEQ ID NO: 344359 - RNA, 62 nt, hsa
ccuuagauaucaguuaggauacaucacuaaaacauuuccacuaacuccacuguuucuauaau

SEQ ID NO: 344360 - RNA, 62 nt, hsa
gagaaaagauaucacaacucuauggaaaaugacauuuccauuugccuuauugcuacuucaag

SEQ ID NO: 344361 - RNA, 62 nt, hsa
caucccaacuucauuucccccucacuguagcccauuuccaccccaccacaaaguugccacag

SEQ ID NO: 344362 - RNA, 62 nt, hsa
aacuggaagugcaugaggcagagcguccguagcauuuccaguuuguucuguauaggaacaga

SEQ ID NO: 344363 - RNA, 62 nt, hsa
ccaaccagauucaugagcuuucucacauuuuccauuuccaaauaacuguuguguugaaucag

SEQ ID NO: 344364 - RNA, 62 nt, hsa
gcacugggcuuuaaagagcgaaaugagugugucauuuccacaugaaggagaggcaaggaaaa

SEQ ID NO: 344365 - RNA, 62 nt, hsa
ccuaccugcgcagucuaaacauagcuguggaucauuuccaacuuucaacuucacuccgggcc

SEQ ID NO: 344366 - RNA, 62 nt, hsa
cgaggcugguuuccugugcagcagguggaguucauuuccaacccagagguccgugcacagaa

SEQ ID NO: 344367 - RNA, 62 nt, hsa
uggauaaaccaaggauuuuguguuuaacaauccauuuccagugucuucgccacauaaaauag

SEQ ID NO: 344368 - RNA, 62 nt, hsa
uaaaaggauaguuuaugaguaaucuuuaaaaccauuuccauaccaucuguauauaaccauuu

SEQ ID NO: 344369 - RNA, 62 nt, hsa
gggauuccaggcgugagccacugcggccagcacauuuccacuuuuagauccuacuccauacc

SEQ ID NO: 344370 - RNA, 62 nt, hsa
cccugugcuccuuaagccucauggccuuccuacauuuccacuuuauuuguuuguuuguuuau

SEQ ID NO: 344371 - RNA, 62 nt, hsa
agaaaaugggcagagagagaugaccucggaagcauuuccacagauggugucaggguuucaag

SEQ ID NO: 344372 - RNA, 62 nt, hsa
gccaacuguggucaaaguucauaggugucguacauuuccauuauuugcuaaaaucaugcaau

SEQ ID NO: 344373 - RNA, 62 nt, hsa
agucuuugcaucagcuuaccuuguaccagaaacauuuccaauuuacuaucaaauuauaguaa

SEQ ID NO: 344374 - RNA, 62 nt, hsa
agaaugcccagaaagugccagaagcaucguggcauuuccagaaccauggauucugccuuugg

SEQ ID NO: 344375 - RNA, 62 nt, hsa
acagauccaaaguuagcaguauauggcugcuacauuuccauuuucauuuucgagccaucagu

SEQ ID NO: 344376 - RNA, 62 nt, hsa
gguucauuguuuaaugaaauauuuuauucuugcauuuccauaaggaaagggaaagucaugau

SEQ ID NO: 344377 - RNA, 62 nt, hsa
uugggcaaccuccuucgacgugggggaggucccauuuccacuucaucacuguuggagaucau

SEQ ID NO: 344378 - RNA, 60 nt, hsa; identical to SEQ ID NO: 59927

SEQ ID NO: 344379 - RNA, 62 nt, hsa
aaguguucugaccagggagugacagguuaugacauuuccaugucaacucuaaaugaagucuu

SEQ ID NO: 344380 - RNA, 62 nt, hsa
uguauauacuuugccacuggaaaggacaaauacauuuccagaucuuuucagugaucuggaua

SEQ ID NO: 344381 - RNA, 62 nt, hsa
aucguccauucuuuuaaauguugucucacuugcauuuccagucuuggccaucaaaucaauga

SEQ ID NO: 344382 - RNA, 62 nt, hsa
acaaaguggcaucucauggugguuuuaauuugcauuuccauaauaucuaauuagguugagcu

SEQ ID NO: 344383 - RNA, 62 nt, hsa
aaauuuaauuuugaaaaaggugacucaccccucauuuccagaguguaggcaauuauguccug

SEQ ID NO: 344384 - RNA, 62 nt, hsa
cgaaaaaagaaaagaaaucuguuucuaccaaacauuuccagaaacguauuuauagcaugaag

SEQ ID NO: 344385 - RNA, 64 nt, hsa; identical to SEQ ID NO: 245086

SEQ ID NO: 344386 - RNA, 64 nt, hsa; identical to SEQ ID NO: 245087

SEQ ID NO: 344387 - RNA, 64 nt, hsa; identical to SEQ ID NO: 245088

SEQ ID NO: 344388 - RNA, 64 nt, hsa
auguagaauaaaaauuuuaaaucucacuucacuuagccgacauuccaugcccugaccaauccua

SEQ ID NO: 344389 - RNA, 64 nt, hsa
agaaagagaacaaggagcuugccaggcuucauguagccgacacacgucucaggauuuuaagucc

SEQ ID NO: 344390 - RNA, 64 nt, hsa
ccaaaauaaaacaaagggcacagcaucuguagucagccgacaacuauuucggccuuuugggggu

SEQ ID NO: 344391 - RNA, 64 nt, hsa
guuguuagaacucagaggaagaggcaggggcagcagccgacagggggcagcaugacccaagcaa

SEQ ID NO: 344392 - RNA, 64 nt, hsa
uugaucagaggaugcauauuauucagcaucagacagccgacacuggggaggagccuuaucaaug

SEQ ID NO: 344393 - RNA, 64 nt, hsa
agcgaauguaugaaugaaaaugcaucuauuucagagccgacaugaagaguuuaguuuuuuuacu

SEQ ID NO: 344394 - RNA, 64 nt, hsa
gagaccgguggccugcagaccauugcccaccgggagccgacaccugaccuagcacacacugaca

SEQ ID NO: 344395 - RNA, 64 nt, hsa
cacucccgggccaagacagauggacacugccaagagccgacaaugcccugcuggccugucuccc

SEQ ID NO: 344396 - RNA, 64 nt, hsa
ccgcuguugaugugcaguucccagugccugugugagccgacaucugcucaguccuaucccucgu

SEQ ID NO: 344397 - RNA, 64 nt, hsa
aucucagggaauguagccccugggcccuggcuuaagccgacacuccugaccucucuguucaccc

SEQ ID NO: 344398 - RNA, 64 nt, hsa
cucucugacuggggccccuggcccggccccacccagccgacauguuuucuuuggccuggguggu

SEQ ID NO: 344399 - RNA, 64 nt, hsa
aagucaggccgcaccugucuguuuuuggaaggguagccgacaaauccuuccagagggaaaguuc

SEQ ID NO: 344400 - RNA, 64 nt, hsa
cggcuuuucaggcuugcccucaccagcggccgucagccgacacucagggauguagcuaacacca

SEQ ID NO: 344401 - RNA, 64 nt, hsa
ccaaugacaggugaaacccagacacucuccuuagagccgacagguugauccugcuguguugaag

SEQ ID NO: 344402 - RNA, 64 nt, hsa
cuccaucuuuggcuccggcuucucggggcuggugagccgacagccggacuccucggagcagccg

SEQ ID NO: 344403 - RNA, 64 nt, hsa
ucucugccaucagcccuacguccagagggagaggagccgacacccccagagccagugccccauc

SEQ ID NO: 344404 - RNA, 52 nt, hsa
acaccgccuauauuaagugagaagccgacaccuuuuuucaacagugaagaca

SEQ ID NO: 344405 - RNA, 64 nt, hsa
gcucugagacagagcaaacacccaccccagaacaagccgacacacagggagacgggggccugga

SEQ ID NO: 344406 - RNA, 64 nt, hsa
ggggcugcagccuccucuuucugucucugaucagagccgacaccagacgugauuagcaggcgca

SEQ ID NO: 344407 - RNA, 64 nt, hsa
uacaggaagaagugcgaguccauuguggagccaaagccgacauuaaaguauguguccuuugugg

SEQ ID NO: 344408 - RNA, 64 nt, hsa
gaagcuguucaaccacccguuugggggaugagugagccgacacuuuccuuuggucuuucugaau

SEQ ID NO: 344409 - RNA, 64 nt, hsa
cgaguguggugccugagcugugagaaguguccucagccgacacucacgagggcagugcaaggga

SEQ ID NO: 344410 - RNA, 64 nt, hsa
cagaccaugaggagccaagaccagcaggucccacagccgacagugcccagagcaugcagggaac

SEQ ID NO: 344411 - RNA, 64 nt, hsa
gcuucagccacagagacacacucaggaggccagaagccgacacucaagguguucguggggcugg

SEQ ID NO: 344412 - RNA, 64 nt, hsa
ggaaucucaacaaccagggaucaggaggguccaaagccgacauucccaguccugugagcucagg

SEQ ID NO: 344413 - RNA, 64 nt, hsa
cagaaagcgggcagcaggccccgauaccgggaagagccgacacagccacgaaccagacaagcag

SEQ ID NO: 344414 - RNA, 64 nt, hsa
gaggcugagaacugggcagacaccccuggagcucagccgacaguuuugaugagcagggaagucu

SEQ ID NO: 344415 - RNA, 64 nt, hsa
aaucacuugaauucaggagguggagguugcagugagccgacaucaugccacugcacuccagccu

SEQ ID NO: 344416 - RNA, 64 nt, hsa
gcuuccagacccuaccagcacuacccuaacccucagccgacagucucagccccaccgacccacu

SEQ ID NO: 344417 - RNA, 64 nt, hsa
ucccucuugcccagggaacucuuccacaggacaaagccgacaucaagacucaacuccucuaacc

SEQ ID NO: 344418 - RNA, 64 nt, hsa
uagucaacaguacccugguuguguguccccuugcagccgacacggucucggaucaggcucccag

SEQ ID NO: 344419 - RNA, 64 nt, hsa
gaucuccaggcccaugaggauggaacaugaaaggagccgacaaaaguugcuuccauuggcaugg

SEQ ID NO: 344420 - RNA, 64 nt, hsa
guacccagauguaucauuauccuugugcugcaggagccgacaccuuucaggauuucagucacau

SEQ ID NO: 344421 - RNA, 64 nt, hsa
gcagcaagaauggaccugaugucuuuaaaagcauagccgacaaugguagcuucucaaguuauga

SEQ ID NO: 344422 - RNA, 64 nt, hsa
ccaggguagaggcugacggcgcaagaccagcuuuagccgacaacagagacuggacugugggccc

SEQ ID NO: 344423 - RNA, 64 nt, hsa
gugaacagggcacgcggugggcuggugguuucauagccgacacacagcgccuaccaugugcagc

SEQ ID NO: 344424 - RNA, 64 nt, hsa
uaaagaggcugcuggagagugcguggccauagggagccgacaugcccgggaggaaagguguuga

SEQ ID NO: 344425 - RNA, 64 nt, hsa
ugaugauuuuugcagccacuuggcuauggagagcagccgacacccccucuuacagccguggaug

SEQ ID NO: 344426 - RNA, 64 nt, hsa
uaauuauaucuguuuuguuucuugacucuguccaaucagagaauaaacaucauaguuucuuggc

SEQ ID NO: 344427 - RNA, 64 nt, hsa
gguaugauuguaaagauugagcauuggaagggguaucagagaccauguaguucaacuuuccacu

SEQ ID NO: 344428 - RNA, 64 nt, hsa
gcuucaguaauucucagugugugagcugccuaggaucagagagccuucauggaaguggccacua

SEQ ID NO: 344429 - RNA, 64 nt, hsa
gaccaccagagaggagagggaaccagauaugcagaucagagauagaggaaguggaaccagagag

SEQ ID NO: 344430 - RNA, 64 nt, hsa
ugaaaaaagcuucuaacaaaacucugacuuacccaucagagaagccauacuggugaaaaauugu

SEQ ID NO: 344431 - RNA, 64 nt, hsa
aagcuguaauaccaauauuaaaaauuauuuauguaucagagaacucauuaagaugaggacaaau

SEQ ID NO: 344432 - RNA, 64 nt, hsa
aaaacauuuuuucaaaaacuacagcuuggaaaacaucagagaguucauacuaaaauauauuuuu

SEQ ID NO: 344433 - RNA, 64 nt, hsa
ucacaugugaaagcaagugaucuguuguugcugaaucagagauaugagagauucuuuuuuauag

SEQ ID NO: 344434 - RNA, 64 nt, hsa
aaaagcuucagucuggacucuacuauugaugcagaucagagaguucuuagaauacagaauaccg

SEQ ID NO: 344435 - RNA, 64 nt, hsa
aaaauuuuccaucagagcucagcccuuacuagacaucagagaauccauacuagagagaagcccu

SEQ ID NO: 344436 - RNA, 64 nt, hsa
cagaaacuccugccugaagucaaacaccuuguacaucagagaguucacacagguuaguguggac

SEQ ID NO: 344437 - RNA, 64 nt, hsa
gggaaggcuucucugaagucagaccucauuuuauaucagagaacccuuucaguauagugaauca

SEQ ID NO: 344438 - RNA, 64 nt, hsa
ggaggcuagagagucaaggagaaccucaaauaugaucagagaauuguggaaaagacauccuuuc

SEQ ID NO: 344439 - RNA, 64 nt, hsa
agaagacagucccagaaguaaacccucacugugaaucagagaauucacauaggaaagaaaccag

SEQ ID NO: 344440 - RNA, 64 nt, hsa
aaauccuuuugacaaaaggaauaccccauuugauaucagagauacacaaaaaaccaauugaggg

SEQ ID NO: 344441 - RNA, 64 nt, hsa; identical to SEQ ID NO: 344430

SEQ ID NO: 344442 - RNA, 64 nt, hsa; identical to SEQ ID NO: 344431

SEQ ID NO: 344443 - RNA, 64 nt, hsa
ucagccgucuuucugcugguguugucuuucugccaucagagaagggacacacagcccguucgaa

SEQ ID NO: 344444 - RNA, 64 nt, hsa
agguaauucaagcccucaucagguuuacaagaucaucagagaaacagaggauuuuaauuuuuag

SEQ ID NO: 344445 - RNA, 64 nt, hsa
cauuguuaauguggaacaauuuaacacuaaucucaucagagagcgagaugaauguggcaauugc

SEQ ID NO: 344446 - RNA, 64 nt, hsa
uaugcaggagcaguaaacuggcagaaaaccaggaaucagagaaagaaaauauaauuuaacuuua

SEQ ID NO: 344447 - RNA, 64 nt, hsa
aaaacauaugugaugaaauugagcuauaugauuuaucagagaucugauuccaaagagcacagaa

SEQ ID NO: 344448 - RNA, 64 nt, hsa
aggagaccacugcugacagauacacagagaagagaucagagaggaaaaacugggaagacauaaa

SEQ ID NO: 344449 - RNA, 64 nt, hsa
aaauucuuuguggacagcuguacacugaagagucaucagagaguucacacuggagaaagaccuu

SEQ ID NO: 344450 - RNA, 64 nt, hsa
aaauccuuuagaugucgcuccacacuugauacacaucagagaauucacacuggugaaaggccuu

SEQ ID NO: 344451 - RNA, 64 nt, hsa
aaaucauuucgccgaagcucuucacucuugcagcaucagagaguucacacuagagaaaggccuu

SEQ ID NO: 344452 - RNA, 64 nt, hsa
aaaucauuucgccacaguucuucguuccgucgccaucagagaguucauacuggaaugaggccuu

SEQ ID NO: 344453 - RNA, 64 nt, hsa
uaaaacauuuaauccaaaauaagucuauguaaauaucagagaauucacaguggaaauaucuaag

SEQ ID NO: 344454 - RNA, 64 nt, hsa
aaagccauuaaugucugcucacaucuuacucaacaucagagaguacuuaaaaaaaguauuauaa

SEQ ID NO: 344455 - RNA, 64 nt, hsa
uuuuuuaaaaauuuuaaucauuaagucuguaaauaucagagaauuuacaguagaaauauguaag

SEQ ID NO: 344456 - RNA, 64 nt, hsa
aaagccauuaauacaugcucacaucuuacucaacaucagagaguucauacucaauaaaaacaua

SEQ ID NO: 344457 - RNA, 64 nt, hsa
ggaaggccuuugcuuguuuccuaccuuaauagaaaucagagaauucacacuagugagaaaccgu

SEQ ID NO: 344458 - RNA, 64 nt, hsa
aaugccuucauuuguuuuuuugauuuuaauagacaucagagaauucacaaaggagagaaacccu

SEQ ID NO: 344459 - RNA, 56 nt, hsa
caagcauaaugcacaucuaaugagacaucagagaauucacaguggggagaaacccu

SEQ ID NO: 344460 - RNA, 64 nt, hsa
caagguuuucagucacaauucacuccuacacagcaucagagaauuucauucuugagagaauccu

SEQ ID NO: 344461 - RNA, 64 nt, hsa
aaguuuaaauccugugagucaucaaagaauuuauaucagagagaaaccauacaaguauaauaaa

SEQ ID NO: 344462 - RNA, 64 nt, hsa; identical to SEQ ID NO: 104452

SEQ ID NO: 344463 - RNA, 64 nt, hsa; identical to SEQ ID NO: 104453

SEQ ID NO: 344464 - RNA, 64 nt, hsa; identical to SEQ ID NO: 104454

SEQ ID NO: 344465 - RNA, 64 nt, hsa; identical to SEQ ID NO: 104455

SEQ ID NO: 344466 - RNA, 64 nt, hsa; identical to SEQ ID NO: 104456

SEQ ID NO: 344467 - RNA, 64 nt, hsa; identical to SEQ ID NO: 104457

SEQ ID NO: 344468 - RNA, 64 nt, hsa; identical to SEQ ID NO: 104458

SEQ ID NO: 344469 - RNA, 64 nt, hsa; identical to SEQ ID NO: 104459

SEQ ID NO: 344470 - RNA, 64 nt, hsa; identical to SEQ ID NO: 104460

SEQ ID NO: 344471 - RNA, 64 nt, hsa; identical to SEQ ID NO: 104461

SEQ ID NO: 344472 - RNA, 64 nt, hsa; identical to SEQ ID NO: 104462

SEQ ID NO: 344473 - RNA, 64 nt, hsa; identical to SEQ ID NO: 104463

SEQ ID NO: 344474 - RNA, 64 nt, hsa; identical to SEQ ID NO: 104464

SEQ ID NO: 344475 - RNA, 64 nt, hsa; identical to SEQ ID NO: 104465

SEQ ID NO: 344476 - RNA, 64 nt, hsa; identical to SEQ ID NO: 104466

SEQ ID NO: 344477 - RNA, 64 nt, hsa; identical to SEQ ID NO: 104467

SEQ ID NO: 344478 - RNA, 64 nt, hsa; identical to SEQ ID NO: 104468

SEQ ID NO: 344479 - RNA, 64 nt, hsa; identical to SEQ ID NO: 104469

SEQ ID NO: 344480 - RNA, 64 nt, hsa; identical to SEQ ID NO: 104470

SEQ ID NO: 344481 - RNA, 64 nt, hsa; identical to SEQ ID NO: 104471

SEQ ID NO: 344482 - RNA, 64 nt, hsa; identical to SEQ ID NO: 104472

SEQ ID NO: 344483 - RNA, 64 nt, hsa; identical to SEQ ID NO: 104473

SEQ ID NO: 344484 - RNA, 64 nt, hsa; identical to SEQ ID NO: 104474

SEQ ID NO: 344485 - RNA, 64 nt, hsa; identical to SEQ ID NO: 104475

SEQ ID NO: 344486 - RNA, 64 nt, hsa; identical to SEQ ID NO: 104476

SEQ ID NO: 344487 - RNA, 64 nt, hsa; identical to SEQ ID NO: 104477

SEQ ID NO: 344488 - RNA, 64 nt, hsa; identical to SEQ ID NO: 104478

SEQ ID NO: 344489 - RNA, 64 nt, hsa; identical to SEQ ID NO: 104479

SEQ ID NO: 344490 - RNA, 64 nt, hsa; identical to SEQ ID NO: 104480

SEQ ID NO: 344491 - RNA, 64 nt, hsa; identical to SEQ ID NO: 167767

SEQ ID NO: 344492 - RNA, 64 nt, hsa; identical to SEQ ID NO: 167768

SEQ ID NO: 344493 - RNA, 64 nt, hsa; identical to SEQ ID NO: 167769

SEQ ID NO: 344494 - RNA, 64 nt, hsa; identical to SEQ ID NO: 167770

SEQ ID NO: 344495 - RNA, 64 nt, hsa; identical to SEQ ID NO: 167771

SEQ ID NO: 344496 - RNA, 64 nt, hsa; identical to SEQ ID NO: 167772

SEQ ID NO: 344497 - RNA, 64 nt, hsa; identical to SEQ ID NO: 167773

SEQ ID NO: 344498 - RNA, 64 nt, hsa; identical to SEQ ID NO: 167774

SEQ ID NO: 344499 - RNA, 64 nt, hsa; identical to SEQ ID NO: 167775

SEQ ID NO: 344500 - RNA, 64 nt, hsa; identical to SEQ ID NO: 167776

SEQ ID NO: 344501 - RNA, 63 nt, hsa
uauuuugaaauggacugugaaggaaaaggggacaggaacaaaggaccaaaaauaagcuacaug

SEQ ID NO: 344502 - RNA, 63 nt, hsa
aaauguggaacauuauuaacuuacuuugugucuaggaacaauggauuuuguaucugauuuaaa

SEQ ID NO: 344503 - RNA, 63 nt, hsa
gcuuucacuuaagugucuggcccgcaauacuguaggaacaagcaugaucuuguuacugugaua

SEQ ID NO: 344504 - RNA, 63 nt, hsa
gauucccgagaguaaaucaucuuuccaauccagaggaacaagcaugucucucugccaagaucc

SEQ ID NO: 344505 - RNA, 63 nt, hsa
agcuuucagugaaacacuacauacacgaagaaaaggaacaagguuuaacuauuuaagaaccau

SEQ ID NO: 344506 - RNA, 63 nt, hsa
cacgaucaugucccuuuuuaagccuuaccugagaggaacaaugccuuaaaauaaaaaagcauu

SEQ ID NO: 344507 - RNA, 63 nt, hsa
caguuguguauuuguucaucuucauaugcuggcaggaacaacuauuaauacagauacucagaa

SEQ ID NO: 344508 - RNA, 63 nt, hsa
ggcucaucucaggacagaaggcaauugcagcuaaggaacaauggaaagagcugaaggccaccu

SEQ ID NO: 344509 - RNA, 63 nt, hsa
aucuauagaaagaauuuagcugcaaguggacaaaggaacaagcccccagaaaagaaagggaag

SEQ ID NO: 344510 - RNA, 63 nt, hsa
agcacccauuaaacaaguccuggcaggacucacaggaacaaacgaggucccuguuaggguucu

SEQ ID NO: 344511 - RNA, 63 nt, hsa
auuuucuugcauuuagaugucaaccucagaaacaggaacaaucgucuuuugaacuuccaguag

SEQ ID NO: 344512 - RNA, 63 nt, hsa
gcacuguuccaguaguuauaauccacuugcccuaggaacaaguuagcacugaauuuugggugg

SEQ ID NO: 344513 - RNA, 63 nt, hsa
aaagagcuccugaaggaagcacuaaacauggaaaggaacaacugauaccagccgcugcaaaau

SEQ ID NO: 344514 - RNA, 63 nt, hsa
aguuggaaguaaagcacuccucagcaaauguaaaggaacaaaaauuauaacaaacugucucuc

SEQ ID NO: 344515 - RNA, 63 nt, hsa
uccagaaucuacaaugaacucaaacaaauuuacaggaacaaacaaccccaucaaaaagucggc

SEQ ID NO: 344516 - RNA, 63 nt, hsa
aaaugaaaaaagagcaggcauccauuuccauacaggaacaaaauaggaggcagcacuacagac

SEQ ID NO: 344517 - RNA, 63 nt, hsa
guauauauuuacacaaauacauuugaucagacuaggaacaaguugauaccaaaaccugaaaag

SEQ ID NO: 344518 - RNA, 64 nt, hsa
cuuuuaaaggaaugugaaauuuaaauaauagacauacagagauauacaaauauauuauauauuu

SEQ ID NO: 344519 - RNA, 64 nt, hsa
gggaucaucugaacagaagugcacaggcuacuuguacagagaaaaaauuaauacucaaaggaaa

SEQ ID NO: 344520 - RNA, 64 nt, hsa
uuagccuuuuuuccccagacuuguuggcguaggcuacagagaagccuucaagcucugagggaaa

SEQ ID NO: 344521 - RNA, 64 nt, hsa
agaaaaacaggcacuuggcagccuugugaugucauacagagaagucacagggcaguaccugagg

SEQ ID NO: 344522 - RNA, 64 nt, hsa
agguccaaugagcuuucugaacagcugguguagcuacagagaaaccagcuuccuucagagagca

SEQ ID NO: 344523 - RNA, 64 nt, hsa
ugcuuauuuauuguauucugggguauggcguaaguacagagaagccaucaccucagauggcagc

SEQ ID NO: 344524 - RNA, 64 nt, hsa
cuggccauggagaaagcugacuuggcuggugugguacagagaagccagcuuguuuacaugcuua

SEQ ID NO: 344525 - RNA, 64 nt, hsa
aauugugcaugguuuuggaccccuucugcucuacuacagagagugaagaagaaaguauuaaagc

SEQ ID NO: 344526 - RNA, 64 nt, hsa
aacugaguggccuauuucaugcagaguugaaguuuacagagaugguguguucugcaauaugccu

SEQ ID NO: 344527 - RNA, 64 nt, hsa
gguagcaggagaaggaccgguguugguaggugccuacagagacuauagagcuagacaaagcccu

SEQ ID NO: 344528 - RNA, 64 nt, hsa
gaugguuuauugggaacugcuggggucgaccccauacagagaacucagcuugaagcuggaagca

SEQ ID NO: 344529 - RNA, 64 nt, hsa
cucaauguaauucccuucccagcuacccaaaugcuacagagaaauguuuucuacuuggccacua

SEQ ID NO: 344530 - RNA, 64 nt, hsa
uccuuuuuuauuuuucuucuguacagucuaaagcuacagagaaaaaaaaaugcacucuucccuu

SEQ ID NO: 344531 - RNA, 64 nt, hsa
ccacaggugauuuuuaaguaacuuggguuuaauuuacagagaugaaacaugacagucugaguaa

SEQ ID NO: 344532 - RNA, 64 nt, hsa
uaauuuuuuuuuuuuuuuuguaaguuaaaaaaacuacagagacacuaaaggugaaaauggauga

SEQ ID NO: 344533 - RNA, 64 nt, hsa
uuaccuuugcuuuaaaacucucauguauguuaucuacagagaggaucauuacagagacagacuc

SEQ ID NO: 344534 - RNA, 64 nt, hsa
aacucucauguauguuaucuacagagaggaucauuacagagacagacucucccgagacaugggc

SEQ ID NO: 344535 - RNA, 64 nt, hsa
cacucucucugaguaucccaaccucuuggauguauacagagauuuuauagaauagaaccuauag

SEQ ID NO: 344536 - RNA, 64 nt, hsa
uggaaauaacucccaggcaguaucagguggucacuacagagacuuccacaaaaacuuuugaaug

SEQ ID NO: 344537 - RNA, 64 nt, hsa
uuuuuaaauuacuuaucuucuauccaaggaggucuacagagaaauuaaagucugccuuauuugu

SEQ ID NO: 344538 - RNA, 64 nt, hsa
auuuggauggaaucucuuuggucaaaugcacauuuacagagagacacuauaaacaaguacacaa

SEQ ID NO: 344539 - RNA, 64 nt, hsa
ucaacuuagcacacgugaagcaacauuucuuuccuacagagaggugucaugguaagauuucauu

SEQ ID NO: 344540 - RNA, 64 nt, hsa
ugacuuguacguguuagccuucaugaaauugcaguacagagauggguccccaaaguggagugua

SEQ ID NO: 344541 - RNA, 64 nt, hsa
aaagaugagagagaacucuguggauacucauggguacagagaaaugguugauucuggacccaga

SEQ ID NO: 344542 - RNA, 64 nt, hsa
aaagauggaagagaguucuuuggaaacccguagauacagagaaguggucgauuccagacccaga

SEQ ID NO: 344543 - RNA, 64 nt, hsa; identical to SEQ ID NO: 247720

SEQ ID NO: 344544 - RNA, 64 nt, hsa; identical to SEQ ID NO: 247721

SEQ ID NO: 344545 - RNA, 64 nt, hsa; identical to SEQ ID NO: 247722

SEQ ID NO: 344546 - RNA, 64 nt, hsa; identical to SEQ ID NO: 247723

SEQ ID NO: 344547 - RNA, 64 nt, hsa; identical to SEQ ID NO: 247724

SEQ ID NO: 344548 - RNA, 64 nt, hsa; identical to SEQ ID NO: 247725

SEQ ID NO: 344549 - RNA, 64 nt, hsa; identical to SEQ ID NO: 247726

SEQ ID NO: 344550 - RNA, 64 nt, hsa; identical to SEQ ID NO: 247727

SEQ ID NO: 344551 - RNA, 64 nt, hsa; identical to SEQ ID NO: 247728

SEQ ID NO: 344552 - RNA, 64 nt, hsa; identical to SEQ ID NO: 247729

SEQ ID NO: 344553 - RNA, 64 nt, hsa; identical to SEQ ID NO: 247730

SEQ ID NO: 344554 - RNA, 64 nt, hsa; identical to SEQ ID NO: 247731

SEQ ID NO: 344555 - RNA, 64 nt, hsa; identical to SEQ ID NO: 247732

SEQ ID NO: 344556 - RNA, 64 nt, hsa; identical to SEQ ID NO: 247733

SEQ ID NO: 344557 - RNA, 64 nt, hsa; identical to SEQ ID NO: 247734

SEQ ID NO: 344558 - RNA, 64 nt, hsa; identical to SEQ ID NO: 247735

SEQ ID NO: 344559 - RNA, 64 nt, hsa; identical to SEQ ID NO: 247736

SEQ ID NO: 344560 - RNA, 64 nt, hsa; identical to SEQ ID NO: 247737

SEQ ID NO: 344561 - RNA, 64 nt, hsa; identical to SEQ ID NO: 247738

SEQ ID NO: 344562 - RNA, 64 nt, hsa; identical to SEQ ID NO: 247739

SEQ ID NO: 344563 - RNA, 64 nt, hsa; identical to SEQ ID NO: 247740

SEQ ID NO: 344564 - RNA, 64 nt, hsa; identical to SEQ ID NO: 247741

SEQ ID NO: 344565 - RNA, 64 nt, hsa; identical to SEQ ID NO: 247742

SEQ ID NO: 344566 - RNA, 64 nt, hsa; identical to SEQ ID NO: 247743

SEQ ID NO: 344567 - RNA, 64 nt, hsa; identical to SEQ ID NO: 247744

SEQ ID NO: 344568 - RNA, 64 nt, hsa; identical to SEQ ID NO: 247745

SEQ ID NO: 344569 - RNA, 64 nt, hsa; identical to SEQ ID NO: 247746

SEQ ID NO: 344570 - RNA, 64 nt, hsa; identical to SEQ ID NO: 247747

SEQ ID NO: 344571 - RNA, 64 nt, hsa; identical to SEQ ID NO: 247748

SEQ ID NO: 344572 - RNA, 64 nt, hsa; identical to SEQ ID NO: 247749

SEQ ID NO: 344573 - RNA, 64 nt, hsa; identical to SEQ ID NO: 247750

SEQ ID NO: 344574 - RNA, 64 nt, hsa; identical to SEQ ID NO: 247751

SEQ ID NO: 344575 - RNA, 64 nt, hsa; identical to SEQ ID NO: 247752

SEQ ID NO: 344576 - RNA, 64 nt, hsa; identical to SEQ ID NO: 247753

SEQ ID NO: 344577 - RNA, 64 nt, hsa; identical to SEQ ID NO: 247754

SEQ ID NO: 344578 - RNA, 64 nt, hsa; identical to SEQ ID NO: 247755

SEQ ID NO: 344579 - RNA, 64 nt, hsa; identical to SEQ ID NO: 247756

SEQ ID NO: 344580 - RNA, 64 nt, hsa; identical to SEQ ID NO: 247757

SEQ ID NO: 344581 - RNA, 64 nt, hsa; identical to SEQ ID NO: 247758

SEQ ID NO: 344582 - RNA, 64 nt, hsa; identical to SEQ ID NO: 247759

SEQ ID NO: 344583 - RNA, 64 nt, hsa; identical to SEQ ID NO: 247760

SEQ ID NO: 344584 - RNA, 64 nt, hsa; identical to SEQ ID NO: 247761

SEQ ID NO: 344585 - RNA, 64 nt, hsa; identical to SEQ ID NO: 247762

SEQ ID NO: 344586 - RNA, 64 nt, hsa; identical to SEQ ID NO: 247763

SEQ ID NO: 344587 - RNA, 64 nt, hsa; identical to SEQ ID NO: 247764

SEQ ID NO: 344588 - RNA, 64 nt, hsa; identical to SEQ ID NO: 247765

SEQ ID NO: 344589 - RNA, 64 nt, hsa; identical to SEQ ID NO: 247766

SEQ ID NO: 344590 - RNA, 64 nt, hsa; identical to SEQ ID NO: 247767

SEQ ID NO: 344591 - RNA, 64 nt, hsa; identical to SEQ ID NO: 247768

SEQ ID NO: 344592 - RNA, 64 nt, hsa; identical to SEQ ID NO: 247769

SEQ ID NO: 344593 - RNA, 64 nt, hsa; identical to SEQ ID NO: 247770

SEQ ID NO: 344594 - RNA, 64 nt, hsa; identical to SEQ ID NO: 247771

SEQ ID NO: 344595 - RNA, 64 nt, hsa; identical to SEQ ID NO: 247772

SEQ ID NO: 344596 - RNA, 64 nt, hsa; identical to SEQ ID NO: 247773

SEQ ID NO: 344597 - RNA, 64 nt, hsa; identical to SEQ ID NO: 247774

SEQ ID NO: 344598 - RNA, 64 nt, hsa; identical to SEQ ID NO: 247775

SEQ ID NO: 344599 - RNA, 64 nt, hsa; identical to SEQ ID NO: 247776

SEQ ID NO: 344600 - RNA, 64 nt, hsa; identical to SEQ ID NO: 247777

SEQ ID NO: 344601 - RNA, 64 nt, hsa; identical to SEQ ID NO: 247778

SEQ ID NO: 344602 - RNA, 64 nt, hsa; identical to SEQ ID NO: 247779

SEQ ID NO: 344603 - RNA, 64 nt, hsa; identical to SEQ ID NO: 247780

SEQ ID NO: 344604 - RNA, 64 nt, hsa; identical to SEQ ID NO: 247781

SEQ ID NO: 344605 - RNA, 64 nt, hsa; identical to SEQ ID NO: 247782

SEQ ID NO: 344606 - RNA, 64 nt, hsa; identical to SEQ ID NO: 247783

SEQ ID NO: 344607 - RNA, 64 nt, hsa; identical to SEQ ID NO: 247784

SEQ ID NO: 344608 - RNA, 64 nt, hsa; identical to SEQ ID NO: 247785

SEQ ID NO: 344609 - RNA, 64 nt, hsa; identical to SEQ ID NO: 247786

SEQ ID NO: 344610 - RNA, 64 nt, hsa; identical to SEQ ID NO: 247787

SEQ ID NO: 344611 - RNA, 64 nt, hsa; identical to SEQ ID NO: 247788

SEQ ID NO: 344612 - RNA, 64 nt, hsa; identical to SEQ ID NO: 247789

SEQ ID NO: 344613 - RNA, 64 nt, hsa; identical to SEQ ID NO: 247790

SEQ ID NO: 344614 - RNA, 64 nt, hsa; identical to SEQ ID NO: 247791

SEQ ID NO: 344615 - RNA, 64 nt, hsa; identical to SEQ ID NO: 247792

SEQ ID NO: 344616 - RNA, 64 nt, hsa; identical to SEQ ID NO: 247793

SEQ ID NO: 344617 - RNA, 53 nt, hsa; identical to SEQ ID NO: 247794

SEQ ID NO: 344618 - RNA, 64 nt, hsa
uccuuucguuguaggaggaaucugugcucuacuuaccucucaauuccuggagaugccaacuuca

SEQ ID NO: 344619 - RNA, 64 nt, hsa
gaccccaccuugagccuuauuuccuaauggguccaccucucaucugcaucuuucacaccuccca

SEQ ID NO: 344620 - RNA, 64 nt, hsa
cggugggggcacagcacagaccccagagccaggaaccucucagccgaugccccucagcaagagc

SEQ ID NO: 344621 - RNA, 64 nt, hsa
cggugggggcacagcacagaccccagaggcaggaaccucucagccgaugccccccgguauggga

SEQ ID NO: 344622 - RNA, 64 nt, hsa
cagugggggcacagcacagaccccagagccaggaaccucucagccgaugccccccaguauggga

SEQ ID NO: 344623 - RNA, 64 nt, hsa
cgguggggacacagcacagaccccaaagccaggaaccucucagccgaugccccccgguguggga

SEQ ID NO: 344624 - RNA, 63 nt, hsa
ggagcuugguagaaaugcagaaucuuagccuaggcaacauagggagaccucaucucugcaaaa

SEQ ID NO: 344625 - RNA, 63 nt, hsa
ggaccagucuuacacucgcuguaguucaaguaugcaacauaaauccuguuccuuccagcugug

SEQ ID NO: 344626 - RNA, 63 nt, hsa
guuacguaugucuggcuugauuacauggccagagcaacauaaaagcccugcugggaacuucug

SEQ ID NO: 344627 - RNA, 63 nt, hsa
caguuuggaucucuuaguauugccuuugaaacugcaacauaagcaacucaacaauauuaguug

SEQ ID NO: 344628 - RNA, 63 nt, hsa
uggcuugaagccaguaguucaagaccagccugggcaacauaguaagaccccaucucuaugaag

SEQ ID NO: 344629 - RNA, 63 nt, hsa
uugcuugaguccaggaguuugagaugcgccugggcaacauagaaaccugugucuacaaaaaau

SEQ ID NO: 344630 - RNA, 63 nt, hsa
cuauucaccuugcugcuguuauuccccgaaugcgcaacauaccccccaucaauauaucucagu

SEQ ID NO: 344631 - RNA, 63 nt, hsa
gaaaaacucaaagaauucuuaaaaggauucauagcaacauaaugugucccugaguagaggaug

SEQ ID NO: 344632 - RNA, 63 nt, hsa
aaacaaaagcaauucaaugucaauagacauuaagcaacauaauagacaaacaucuccuaaggg

SEQ ID NO: 344633 - RNA, 63 nt, hsa
cauggcaauuaaucacuaaugaauuaugcgaaagcaacauauuugauaaccguugcaguaaau

SEQ ID NO: 344634 - RNA, 63 nt, hsa
gugauuucugagggucaccacugccagccucaggcaacauagagagccuccuguucuuucuau

SEQ ID NO: 344635 - RNA, 63 nt, hsa
ucgccugagcccaggaguuugagaccagucuaagcaacauaaugagacucagucuccgaaaaa

SEQ ID NO: 344636 - RNA, 63 nt, hsa
acaaagagcauuaagaaagcugcgguggucugagcaacauagcccaaagggcugagccuccug

SEQ ID NO: 344637 - RNA, 63 nt, hsa
cugcuugagcccaggaguucagaaucagccugggcaacauagcaauacuccgucucauaaaaa

SEQ ID NO: 344638 - RNA, 63 nt, hsa
auguaccauguuuuauaaaccucuugauuuccagcaacauacuauagaaaacaccugcuacuc

SEQ ID NO: 344639 - RNA, 63 nt, hsa
auaugaacuauugacccauuguucauugagacagcaacauacgcacuccuaaaucaguguguu

SEQ ID NO: 344640 - RNA, 63 nt, hsa
ucacuugaggccaggaguuugagaccagccugggcaacauagugagaucccaucucaaaaaac

SEQ ID NO: 344641 - RNA, 63 nt, hsa
ucaguugaggccaggaguuuaagaccagccugggcaacauagugagaccccugucucccaaaa

SEQ ID NO: 344642 - RNA, 63 nt, hsa
aaaauagaagcagaauaguaaagguucuauucagcaacauaguucauggauuuuguggagguu

SEQ ID NO: 344643 - RNA, 63 nt, hsa
aaacaaggggggaggguaauagcaauguguuuugcaacauauuaagaguaugugaaggaagca

SEQ ID NO: 344644 - RNA, 63 nt, hsa
caacacauuuuuaagaugcaugucugccaaaaugcaacauacgggaaguuuauuuccugacag

SEQ ID NO: 344645 - RNA, 63 nt, hsa
gcauuuuuuaaauugaguuugagacuagccugggcaacauagugagaccccaucucuauuuaa

SEQ ID NO: 344646 - RNA, 63 nt, hsa
auguaacuuggaucuaguuuaauuuuuuuuuuugcaacauaucccacucagaaacauucaggu

SEQ ID NO: 344647 - RNA, 63 nt, hsa
aagagagagaaccaacguuccuaaaaguacagugcaacauauacaaauugacugagugcagua

SEQ ID NO: 344648 - RNA, 63 nt, hsa
cacuuugccccaguuacaaaaauaguagaacaagcaacauaaaacaaugaaggaaaaccucac

SEQ ID NO: 344649 - RNA, 63 nt, hsa
ccuguaugaccagguugccaguguacuggucuagcaacauagggaaaugauccauauggaaaa

SEQ ID NO: 344650 - RNA, 63 nt, hsa
aaacacuuuuuauauaaaauaaaauuauaccuagcaacauauuauaguaaaaaaugagguggg

SEQ ID NO: 344651 - RNA, 63 nt, hsa
ucacuuagguccaggaguucgagacuagccugggcaacauagugagacaccggaucuacaaaa

SEQ ID NO: 344652 - RNA, 63 nt, hsa
uugcuuaagcccaggagcucaagucccaccugggcaacauaguaagaucuugucucuuaaaga

SEQ ID NO: 344653 - RNA, 63 nt, hsa
cuaauuuggaauggguaaaguacaaauguuaaugcaacauaguacaguuguauuuguccuuca

SEQ ID NO: 344654 - RNA, 63 nt, hsa
caggccagaauggguaaagacuugucaaagcuugcaacauagcuacauggugcacccggaccu

SEQ ID NO: 344655 - RNA, 63 nt, hsa
ucucuugagaauaggaguucaagaccagccugggcaacauagcaagauccugucucuccaaaa

SEQ ID NO: 344656 - RNA, 63 nt, hsa
caaaucacaggugguuaguggcuacuguacugggcaacauacauuauagaacauuuucauuau

SEQ ID NO: 344657 - RNA, 63 nt, hsa
ucauuugagcucaggaguuccagaccagccugggcaacauagcaaaaucucaucucuacaaaa

SEQ ID NO: 344658 - RNA, 63 nt, hsa
aagagcaccuuuguauuuuuauuaucagauggggcaacauauuguaugaagcauauguagcac

SEQ ID NO: 344659 - RNA, 63 nt, hsa
ucuuauuuacuccaaagccuguuguucuuaacugcaacauauuauuucgucucauuaauguug

SEQ ID NO: 344660 - RNA, 63 nt, hsa
uucagaaauguacaacuuuuuaccuaguacaaggcaacauauagguuguaaauguguuuaaaa

SEQ ID NO: 344661 - RNA, 63 nt, hsa
aaaucauggauaaacugugaaccaaaauauggugcaacauacgagacaugaauauaguccaac

SEQ ID NO: 344662 - RNA, 63 nt, hsa
cauuaaaaaaccuuccagaaucaauaauccguggcaacauaucucuguaaaaacaaacacugu

SEQ ID NO: 344663 - RNA, 63 nt, hsa
aaugggaucacagagucuguugcuagaaucuuggcaacauacagcaggaaagccuugauaaau

SEQ ID NO: 344664 - RNA, 63 nt, hsa
aucacuugagcccaggaguaaagaccagccugggcaacauagugagacuccgucucuacaaaa

SEQ ID NO: 344665 - RNA, 63 nt, hsa
ccuaguuugguaacacagcuuuaacuaugucaugcaacauauauauguugguaggauguuauu

SEQ ID NO: 344666 - RNA, 63 nt, hsa
ucaguguugucagaguauuaccacacagcaacagcaacauacagaagauauguucacucagau

SEQ ID NO: 344667 - RNA, 63 nt, hsa
uugccugaggccaggaguuugacaccagccugggcaacauagugagaccuugucucuacaaaa

SEQ ID NO: 344668 - RNA, 63 nt, hsa
ucgcuugaagcugagaguucaagaccaaccugggcaacauagugagacccccaucucuacaau

SEQ ID NO: 344669 - RNA, 63 nt, hsa
cugcuggaaacugagaguucaagaccagccugggcaacauagugagacccugucucuacaaau

SEQ ID NO: 344670 - RNA, 63 nt, hsa
ugaguucauuuccuauugcugcucaauucaguagcaacauagcuggcuuguucccagacccag

SEQ ID NO: 344671 - RNA, 63 nt, hsa
uugcuugagcccaggaguucaagaucagccuaggcaacauagggagacccuaucccuacaaaa

SEQ ID NO: 344672 - RNA, 63 nt, hsa
cuccuugaggccaggaguucaggaccagccugggcaacauagcgagacccccauugcuacaaa

SEQ ID NO: 344673 - RNA, 63 nt, hsa
uguuaaccacuguauguaaccaacccuuaucuggcaacauaauugcagcacaauaaugauuug

SEQ ID NO: 344674 - RNA, 63 nt, hsa
uaauuuccauguaaguuaccagaaagcccaccagcaacauaauuuuaaagccuuucagauuac

SEQ ID NO: 344675 - RNA, 63 nt, hsa
uuguuugaggccagaaauuugagaccagccugggcaacauagcaaaacccugucucuacaaaa

SEQ ID NO: 344676 - RNA, 63 nt, hsa
uagcuugaggccaggaguuugagacuagacugggcaacauagcaagaccccgucucuacaaag

SEQ ID NO: 344677 - RNA, 63 nt, hsa
uggcaggguacaaguaccauuaaugaagggucugcaacauaaagccuuaaaaagacacacacu

SEQ ID NO: 344678 - RNA, 63 nt, hsa
aacaaagguacauuuuuuaaaaugucauauauugcaacauauugaugcauuugucauacguuu

SEQ ID NO: 344679 - RNA, 63 nt, hsa
uagcuugaggccaggaguuccagaccagccugggcaacauagugagauccugucucuacaaaa

SEQ ID NO: 344680 - RNA, 63 nt, hsa
uacuugaauauugcuuaaagaauugugugaauagcaacauauauuauggauauauacuuugug

SEQ ID NO: 344681 - RNA, 63 nt, hsa
ggaauugcuugaguucagaaguuugagaucugggcaacauauugagacucugucucuaaaaag

SEQ ID NO: 344682 - RNA, 63 nt, hsa
guaaaaaaagaaucuuaucuccuauagaaaacagcaacauauaaauucaauaaauaagacuua

SEQ ID NO: 344683 - RNA, 63 nt, hsa
cggaugacaucuguuuaaaaacaagcacaaccugcaacauacuuugauuaccuguucucccaa

SEQ ID NO: 344684 - RNA, 63 nt, hsa
ucacuuaagcccaggagucugagaccagccugggcaacauagcaagacccccaucucugcaaa

SEQ ID NO: 344685 - RNA, 63 nt, hsa
uugcuugaguucaggaguucaagaccagccugggcaacauagcaaaaccuuaucucuacaaaa

SEQ ID NO: 344686 - RNA, 63 nt, hsa
ggguuuggaccacaucucuuuggaaaauaguuugcaacauauuuaagagauacuugaugccaa

SEQ ID NO: 344687 - RNA, 63 nt, hsa
ucacuugaggccaggacuuugagaccagccagggcaacauaauaagacuuuucucuacuuuaa

SEQ ID NO: 344688 - RNA, 63 nt, hsa
augccugugaauaaccacugcacuccagccagggcaacauaacaagacucuaucuaaaaaaaa

SEQ ID NO: 344689 - RNA, 63 nt, hsa
agcaggaaagcccauuaacuucguacugaaaaagcaacauacugugaugauacgggaugacau

SEQ ID NO: 344690 - RNA, 63 nt, hsa
cagaucuuuacugaaagagagagcagcuguuaugcaacauauagaaaaauguauagaugcuug

SEQ ID NO: 344691 - RNA, 63 nt, hsa
auguuuuuaaagaaaaccagcaucucugauguugcaacauacguguaaaauggguguuacauc

SEQ ID NO: 344692 - RNA, 63 nt, hsa
uagagaaagcaaaacauaguaguucacaauuuugcaacauagaaagucacauuuugaaaggcu

SEQ ID NO: 344693 - RNA, 63 nt, hsa
uguguaagaaccuaggagggaaaggaagauugagcaacauaggaaaaggggaagagaggcuga

SEQ ID NO: 344694 - RNA, 63 nt, hsa
acagaguuuaggcuggugcugccaaaaagaaaagcaacauagaguuuaaguauccaguaguga

SEQ ID NO: 344695 - RNA, 63 nt, hsa
ggaauagguaaagucuuugaugucagugaaguggcaacauagccaaaaaguuggguaccuuuu

SEQ ID NO: 344696 - RNA, 63 nt, hsa
acauuugauauaacaaauguguugucauuguuggcaacauacaagauaaccaagaagcuggag

SEQ ID NO: 344697 - RNA, 63 nt, hsa
ucuucuauuccaauaaaaaguccuuuuagcaaugcaacauauuaacaaaauugggugcauuca

SEQ ID NO: 344698 - RNA, 63 nt, hsa
gaauuugagucugggaguuugaguccagcaugggcaacauaacaagaccccaucccuuauuaa

SEQ ID NO: 344699 - RNA, 63 nt, hsa
aaaauugguacagaaauggaaauuugccuuguugcaacauacaauugcaaaagaugaguuuaa

SEQ ID NO: 344700 - RNA, 63 nt, hsa
gauaucauccaaguauugaggauaagaagagaugcaacauacuacuuuugugucacaauuuau

SEQ ID NO: 344701 - RNA, 63 nt, hsa
ucauuugagcccaggaguuugagaccagcuggggcaacauauggagacuccgucucuacagaa

SEQ ID NO: 344702 - RNA, 63 nt, hsa
uucuuuuucagaauucuugaaggaaaaugauacgcaacauaauuaaauuuugaguucuacaua

SEQ ID NO: 344703 - RNA, 63 nt, hsa
cugaauggcauccgccaacccagggaccucggcgcaacauaggccuuguccuugcugcacucg

SEQ ID NO: 344704 - RNA, 63 nt, hsa
uugcuugaggccgaggguucaagacuagccugggcaacauagcgagacugcaucucuacaaaa

SEQ ID NO: 344705 - RNA, 63 nt, hsa
cuaauuauuuuauaucauuuaaaccauacuguagcaacauaauauauggagcuaauuuguaga

SEQ ID NO: 344706 - RNA, 63 nt, hsa
aaggcaugcagucaugagaauuacagaaaauuugcaacauauaaaguaguuugaucuaagagg

SEQ ID NO: 344707 - RNA, 63 nt, hsa
ugccugugaucuucuuagguuauagccaagucagcaacauaauuccucuaaauaaaauuacau

SEQ ID NO: 344708 - RNA, 63 nt, hsa
uuaaaccacuugaagggacucaugaagcauccugcaacauaaauuugcauuuuuacaucagau

SEQ ID NO: 344709 - RNA, 63 nt, hsa
cuguggcccagcacuggucaagaaaacaagauggcaacauauaugcuuucagggucaaauuug

SEQ ID NO: 344710 - RNA, 63 nt, hsa
gcagagagugauggugcuuguuagggaucaagggcaacauaguacuucuccuucacccauagu

SEQ ID NO: 344711 - RNA, 63 nt, hsa
accaccugaggguaggagucaagaucagccugggcaacauagugagacgcugucucuacaaaa

SEQ ID NO: 344712 - RNA, 63 nt, hsa
ucauuugaggccaggaguuugagaccugccugggcaacauaaugaaacuuccuuuccagggag

SEQ ID NO: 344713 - RNA, 63 nt, hsa
ccuguguguuguguggaucuguuccuaguauaggcaacauaaugagauacugugcuucccacc

SEQ ID NO: 344714 - RNA, 63 nt, hsa
uugcuugaggccaggaguuugagaccagccugggcaacauagcgagaccccaucucuacaaaa

SEQ ID NO: 344715 - RNA, 63 nt, hsa
uugcuugagcccaggaguucaagaccagccugggcaacauaccaagacccccgucucuuuaaa

SEQ ID NO: 344716 - RNA, 63 nt, hsa
caggaaguacaucuuuacaucauagguucccaagcaacauagauuucccuaucuuucaggaaa

SEQ ID NO: 344717 - RNA, 63 nt, hsa
gaaaaaaauuacacuucagaaaagacaucaaaggcaacauaugacaacaaguaauuuaugaau

SEQ ID NO: 344718 - RNA, 63 nt, hsa
auguugaagcagagaaacauucacacacaaaaagcaacauagucauguggguccagauggccu

SEQ ID NO: 344719 - RNA, 63 nt, hsa
uugcuugaagucaggaguucaagaccaaccugggcaacauagcaacaccccccaugucuacaa

SEQ ID NO: 344720 - RNA, 63 nt, hsa
gcgagcagaugcaaucucuugucucacaugcuagcaacauaccagguaacaaaauaauguuug

SEQ ID NO: 344721 - RNA, 63 nt, hsa
uuggaagacuuccuggaaaucaguguaaaucuugcaacauagcucucaagauaccacuguaua

SEQ ID NO: 344722 - RNA, 63 nt, hsa
ucgcuugaggccaggaauuuuagaccagccggggcaacauagugaaaccccaucucuacaaaa

SEQ ID NO: 344723 - RNA, 63 nt, hsa
ucuauacauuauaagggacuuaacaacuaaagggcaacauauagacuuuagauccuaauuuga

SEQ ID NO: 344724 - RNA, 63 nt, hsa
caccuugaggccaggaguuuaaggccagccugggcaacauagcaaaaccuagucccuaaaauu

SEQ ID NO: 344725 - RNA, 63 nt, hsa
uguuuuuggaaauaauuuguaauaaaaaucauggcaacauaauucacuuuccaucuuuuaaaa

SEQ ID NO: 344726 - RNA, 63 nt, hsa
gauuguggauaauaauugaauugguuuuuaaaggcaacauagcauucuacagcaggguuaauc

SEQ ID NO: 344727 - RNA, 63 nt, hsa
acuuggaaaaaaaaaacagcaaaagcaaaaguagcaacauaugucaacauaugucacugaaau

SEQ ID NO: 344728 - RNA, 63 nt, hsa
ucagagugaguggaugaaaacauuuguaaggcugcaacauaauauuaaaaugugaauaaauaa

SEQ ID NO: 344729 - RNA, 63 nt, hsa
accuguaucauucaugguauaaauuuuacucuugcaacauaacuaccaucucucucuuaaaac

SEQ ID NO: 344730 - RNA, 63 nt, hsa
uggucagaaugcuguuuuguuuaauaauauuacgcaacauaaaccauagguguuauuagaagu

SEQ ID NO: 344731 - RNA, 63 nt, hsa
ccccaccaaacuuuauuuuucuauguguuuuuugcaacauaugaguguuuugaaaauaaagua

SEQ ID NO: 344732 - RNA, 63 nt, hsa
uuucaggcuaucauauauacuguauccugaaaggcaacauaauucuuccuucccuccuuuuaa

SEQ ID NO: 344733 - RNA, 63 nt, hsa
uugccaugggaaacauuuuuuggcauuaaugcagcaacauaauacucacuuuagguauuacua

SEQ ID NO: 344734 - RNA, 63 nt, hsa
ucacuugagcccaggaguucaagaccagccugggcaacauagugagacuccugucucuacaaa

SEQ ID NO: 344735 - RNA, 63 nt, hsa
uucauugugcaugcauccagugauuauacauaagcaacauauguaaucugcuuauauauuuuu

SEQ ID NO: 344736 - RNA, 63 nt, hsa
uugcuugagcucaugaguucaagaccagccugggcaacauagcgagacuccaucucuauaaau

SEQ ID NO: 344737 - RNA, 63 nt, hsa
uugcuauaaggcuuugaucauauaguccucauagcaacauaacuaccaucuagcauguaccac

SEQ ID NO: 344738 - RNA, 63 nt, hsa
gaaauuaaacuuguauacaaaaugguugccaaggcaacauaaaauuauaagaauucacuauac

SEQ ID NO: 344739 - RNA, 63 nt, hsa
uucauauuaugggucaggauagauucauuucuugcaacauaguggaaaagauauaagcugcag

SEQ ID NO: 344740 - RNA, 63 nt, hsa
gugcaugugaauagccacugcacuccagccugggcaacauagcaagacuccaucucuaaguaa

SEQ ID NO: 344741 - RNA, 63 nt, hsa
aaugugaauucaagugccugauuaauugagguggcaacauaguuugagacgagggcagagaac

SEQ ID NO: 344742 - RNA, 63 nt, hsa
ggcugcgguguuuggcaaugcuaauucaaugccgcaacauauaguugaggccgaggauaaaga

SEQ ID NO: 344743 - RNA, 63 nt, hsa
uauaugcaucaguacagcauuuucaacauauuggcaacauauuuuaaaugaaaacacuaaaac

SEQ ID NO: 344744 - RNA, 63 nt, hsa
guacuccccuccccccaguuguucuuuauuguagcaacauacacucucaaugaacuuuuauga

SEQ ID NO: 344745 - RNA, 63 nt, hsa
aaggaaaccuuucagaagucauacuuuuguuuugcaacauagaagucacacaggagaaaaauc

SEQ ID NO: 344746 - RNA, 63 nt, hsa
ucacuugagcccaggaguuuaagaccagccugggcaacauagcaagacccugucucuaaagaa

SEQ ID NO: 344747 - RNA, 63 nt, hsa
cuacuuaacacuccuaaagacuacuuugaguaggcaacauaacuaaauuuuucuaguuucuua

SEQ ID NO: 344748 - RNA, 63 nt, hsa
uuaccugaggccaggaguuuaagaccagccuuggcaacauagcgagacccccaucucuacaaa

SEQ ID NO: 344749 - RNA, 63 nt, hsa
uuucacuuucccgguguuccccacuguaucuaggcaacauaguauucaugacuauggauaaac

SEQ ID NO: 344750 - RNA, 63 nt, hsa
gacuugguucguuaguggauuacuucugagcuugcaacauagcucacugaagagcuguuagau

SEQ ID NO: 344751 - RNA, 63 nt, hsa
auucgaucuaaauggguuugagaauccauaucagcaacauacguguuuuuugacagaaaguga

SEQ ID NO: 344752 - RNA, 63 nt, hsa
gcauaauuauaucuuaaucauauauggaaaugugcaacauaugguauuuguuaaauacguuug

SEQ ID NO: 344753 - RNA, 63 nt, hsa
uacuaaugaaacuguguguacgugucugugcgugcaacauaaaaauacaguagcaccuaagga

SEQ ID NO: 344754 - RNA, 63 nt, hsa
uugcuugagcccaggaguucgagaccagccagagcaacauagugagaccacaucucuaccagu

SEQ ID NO: 344755 - RNA, 63 nt, hsa
gcacauaacuguggccugaagggauggggaguagcaacauaaaaagaaguggcucaagucuuc

SEQ ID NO: 344756 - RNA, 63 nt, hsa
uguggagaggagggauuuuccugcucuauauaagcaacauauuuuuagacauuaaaauauaua

SEQ ID NO: 344757 - RNA, 63 nt, hsa
ucacuugaggccaggaguucaagaccagccugggcaacauagugagaaugcaucucuacaaaa

SEQ ID NO: 344758 - RNA, 63 nt, hsa
uaacacccaaaagaauuaaauugauuauuuugugcaacauaacaauucggcaguuggccaaaa

SEQ ID NO: 344759 - RNA, 63 nt, hsa
agaacaugugagguugaaagagcaccagccagggcaacauagcgugacccugucucuacaaaa

SEQ ID NO: 344760 - RNA, 63 nt, hsa
uaaucaauucaggagaaacacauaucauuuaaagcaacauaggcuaaccuguagguaacacug

SEQ ID NO: 344761 - RNA, 63 nt, hsa
uguuucuuuuucuuguauaacuuuuuguuuucagcaacauaaauugauuuuuagcuggcagac

SEQ ID NO: 344762 - RNA, 63 nt, hsa
ugugaaucauuuuuuuaaacugaaauuuaaaaugcaacauaguuuaaucucugauuaaaaugu

SEQ ID NO: 344763 - RNA, 63 nt, hsa
ucgcuugagcccaggaguugaaguccagccuaagcaacauagugaaaccccaucuccaaaaau

SEQ ID NO: 344764 - RNA, 63 nt, hsa
uggcuugaacacagguguucaaggccagccugggcaacauaacaagauccugucucucaaaaa

SEQ ID NO: 344765 - RNA, 63 nt, hsa
gguauuugaguagugagguuacuuuugaucggagcaacauaaugcucauagaaucuucuagaa

SEQ ID NO: 344766 - RNA, 63 nt, hsa
aauaucugucauauaguaaacacucaauaaauugcaacauauuauuuugguguuuuuggaacu

SEQ ID NO: 344767 - RNA, 63 nt, hsa
guauuuucuuaaagaaaggaugauuuauuuucagcaacauauagaaauauacuauaaauauua

SEQ ID NO: 344768 - RNA, 63 nt, hsa
gacuucagcacacauggacuuguagggccacuggcaacauacuccucuuggcccuucccauau

SEQ ID NO: 344769 - RNA, 63 nt, hsa
uggcuugagcccaggaguucaagaccggccugagcaacauagugaggaucccaucucuacgcc

SEQ ID NO: 344770 - RNA, 63 nt, hsa
ucacuugagcccaggaguucaagaccagcuugggcaacauagggagacccugucucugcaaaa

SEQ ID NO: 344771 - RNA, 63 nt, hsa
cagucgguuuuucagccacuuuuagauacucaugcaacauagccuacuuuuauaaaaucaaaa

SEQ ID NO: 344772 - RNA, 63 nt, hsa
agcccauguauggcauggauuguggaagacugggcaacauauuuaagauuuccagcuccuugu

SEQ ID NO: 344773 - RNA, 63 nt, hsa
gcuauucaggaauauugcuugaguccagcuugggcaacauagcgagacccuaucuaaaauaac

SEQ ID NO: 344774 - RNA, 63 nt, hsa
gugcuugaggccaggaguucaagaccagccugggcaacauagggagacccccaucuuuacaaa

SEQ ID NO: 344775 - RNA, 63 nt, hsa
aggcaucuauauuuaauaacuuuuauccagauggcaacauauuugcaaaauuugcccagaucc

SEQ ID NO: 344776 - RNA, 63 nt, hsa
gagauucuaguacaaaguuacuguuuaacaaaagcaacauaaacucugggaaagauuucauuu

SEQ ID NO: 344777 - RNA, 63 nt, hsa
uugcuucagcccaggaguuugagaccagccugggcaacauagcaaaaccccaucucuacaaaa

SEQ ID NO: 344778 - RNA, 63 nt, hsa
uuguguuagcaccauggagaauacaauguuuuugcaacauaugagagaagauaguucuagcca

SEQ ID NO: 344779 - RNA, 63 nt, hsa
aggacauuuguuuucaaaagcaguugaguaacagcaacauaaaccacauuuuuuaaaaaaaug

SEQ ID NO: 344780 - RNA, 63 nt, hsa
ugcuuuccaaaagugaugauaugcucuccuacagcaacauaugagaagaaaaaaggcuuaucu

SEQ ID NO: 344781 - RNA, 63 nt, hsa
uugcuugaggccaggaguuugagaccagccugggcaacauagggagacccagucucuacaaaa

SEQ ID NO: 344782 - RNA, 63 nt, hsa
auaagaaauuacucucaagaacuucagaaaucugcaacauaauuuuauaaauauauaaauaca

SEQ ID NO: 344783 - RNA, 63 nt, hsa
caaaaauggguuccagaaauguuuugagcacuggcaacauauuugaaauaagugaauauuguc

SEQ ID NO: 344784 - RNA, 63 nt, hsa
uacucuaugaugauugcuuccacccacacgacugcaacauacaggugccuuggggaaaugugg

SEQ ID NO: 344785 - RNA, 63 nt, hsa
uauucauccaagaguacuucugagcuauuaucagcaacauaaauuuaucaaauuugcagcacu

SEQ ID NO: 344786 - RNA, 63 nt, hsa
ugaagacaggaauuuuguauauuuuuaaccaaugcaacauacucucagcaccuaaaauagugc

SEQ ID NO: 344787 - RNA, 63 nt, hsa
ucaggguuaaaguauauuucaguuuucuuuagggcaacauauauuugaauuuaaaagcacuuu

SEQ ID NO: 344788 - RNA, 63 nt, hsa
gggagauugcuugaguccaggagaccagccugggcaacauagcaaaaccucaucucuauuuaa

SEQ ID NO: 344789 - RNA, 63 nt, hsa
ccaaacguauuuuauuuuauuuuuuaaaugggagcaacauaucagucgugucaccagcuggua

SEQ ID NO: 344790 - RNA, 63 nt, hsa
ucuacguuuuagagaggaaucuuguuuuugugugcaacauaagaaaauuaugaaaacuaauag

SEQ ID NO: 344791 - RNA, 63 nt, hsa
ucccaugaaauaaaguccccuuuuuacaguucugcaacauaucugaaaugugacauuuucuaa

SEQ ID NO: 344792 - RNA, 63 nt, hsa
gugcaacuccugguucuguacuguauuuuauaugcaacauauaugcuuuaauauuuuaauguu

SEQ ID NO: 344793 - RNA, 63 nt, hsa
ucagccauuuuaucgaggcacgugaucaguguugcaacauaaugaaaaagauggcuacugugc

SEQ ID NO: 344794 - RNA, 63 nt, hsa
uagcuugaguccaggaguuugagaccagccugggcaacauagugauaccccaucucuuaaaaa

SEQ ID NO: 344795 - RNA, 63 nt, hsa
ccaauaugugcuugcuuauuaguuuuuuagcuagcaacauauuugaaucaggcugguaauucg

SEQ ID NO: 344796 - RNA, 63 nt, hsa
uuaacagugcacuggugaagaggacauguuagagcaacauaaguaaacuacuugaaaauaguu

SEQ ID NO: 344797 - RNA, 63 nt, hsa
uaccaaacauaacccagaguauguggaauaugggcaacauauauauagccuucuguauuuaac

SEQ ID NO: 344798 - RNA, 63 nt, hsa
ucgcugcagcccaggaguucgagacuagccugggcaacauagcgagaccucgucucuacaaaa

SEQ ID NO: 344799 - RNA, 63 nt, hsa
ucuaaacacaaggauuuucuuuuuuauuaauaugcaacauagacauugccauaacagaauaau

SEQ ID NO: 344800 - RNA, 63 nt, hsa
ucgcuugaggccaagaguucaagaccagccugggcaacauagcgagaccccuaucuguauuaa

SEQ ID NO: 344801 - RNA, 63 nt, hsa
ucaugcccuucggccacaggcucaacgggacaugcaacauaaaaaugggaagguuauuuaaac

SEQ ID NO: 344802 - RNA, 63 nt, hsa
cugucucaggaaaaaaaaaaaaaaaaaagaaaagcaacauagugggguuucugucaaucuguc

SEQ ID NO: 344803 - RNA, 63 nt, hsa
ucauuugagcccaggaguucgagaccaaccugggcaacauagugagauucuguuaaaaaaaua

SEQ ID NO: 344804 - RNA, 63 nt, hsa
uaacuugaaacuaggaguucaagaccagccaaggcaacauagugaggccccaucuuuacaaaa

SEQ ID NO: 344805 - RNA, 63 nt, hsa
ucacuugagcccaggaguucaagacuagccuaggcaacauagugagacccugucucuacuaaa

SEQ ID NO: 344806 - RNA, 63 nt, hsa
ucacuggaggccaagaguuggagagcagacugggcaacauagcgagaccucaucucaaacaaa

SEQ ID NO: 344807 - RNA, 63 nt, hsa
uuacuugaaacccacaguuugagaccagccugggcaacauagugagacccugucucuaaaaaa

SEQ ID NO: 344808 - RNA, 63 nt, hsa
aggauugagaccaggaguucgagaagagccugggcaacauagugagaccccaucucuacaaag

SEQ ID NO: 344809 - RNA, 63 nt, hsa
ucacuugagcucaggaguccuaaaccagccugggcaacauagugauaccuugucucuaccaaa

SEQ ID NO: 344810 - RNA, 63 nt, hsa
ugauuaggaauuagaccucuccccauucugcuagcaacauacagggacacuuggaaaaccauu

SEQ ID NO: 344811 - RNA, 63 nt, hsa
uugagcuuuaaagcauugaacaaacuggaaaaugcaacauaccacauaacugaagugaaaaaa

SEQ ID NO: 344812 - RNA, 63 nt, hsa
guaaagcuaucagucauuuaguagaauagaaaagcaacauagagcauacaagaacauuuggga

SEQ ID NO: 344813 - RNA, 63 nt, hsa
ccuggacuucuccuggguugugcuuuuuugggggcaacauaccuuggacaaagcugagcugac

SEQ ID NO: 344814 - RNA, 63 nt, hsa
uugacauaaucuuggguaauggaacggagaucugcaacauaucuuuuaacaacacuuuuuucu

SEQ ID NO: 344815 - RNA, 63 nt, hsa
gucaaauucauguuuuuaaguaaguuggcccaugcaacauaucucagcauucuugcugugcuc

SEQ ID NO: 344816 - RNA, 63 nt, hsa
gagcuaugauuaugccacugcuuuccagccugggcaacauaguaagaccccaucucuuaaaaa

SEQ ID NO: 344817 - RNA, 63 nt, hsa
uugcuugaagccaggaguuugggaccagccugggcaacauagggggaucccaucucuacacac

SEQ ID NO: 344818 - RNA, 63 nt, hsa
uucaguuuggucuuauuauauugacauuguuaugcaacauaucacuagaguguuuuuuaucuu

SEQ ID NO: 344819 - RNA, 63 nt, hsa
ucuacaccaugcucugagggacaggaggggaaggcaacauacacaccccggacuccuccgcau

SEQ ID NO: 344820 - RNA, 63 nt, hsa
uacggauuuauuauauaaauauauauucaccuagcaacauaucucugccgucucuccugcucu

SEQ ID NO: 344821 - RNA, 63 nt, hsa
uggcuugagcccaggaauucaagaccaguccgagcaacauagcaaaagcccuuaucugcaaaa

SEQ ID NO: 344822 - RNA, 63 nt, hsa
uucuaaaccuguaagaucuauguuccagccugcgcaacauagugagaccccaacucuacaaaa

SEQ ID NO: 344823 - RNA, 63 nt, hsa
cuguggaaagacaggaguucgaaaccagccugggcaacauagugagacccugccucauggcuu

SEQ ID NO: 344824 - RNA, 63 nt, hsa
ucguuugaggccaggaggucaauaccagccugggcaacauaguaagacccugucucuauuaaa

SEQ ID NO: 344825 - RNA, 63 nt, hsa
gccauaaaaaagaacaagacuguguccuuuacagcaacauagauggagcugaggcucuuaucc

SEQ ID NO: 344826 - RNA, 63 nt, hsa
ucgcuuaagcccaggaauucgaaaucagccuaggcaacauaguaagaccucaucucuacuaaa

SEQ ID NO: 344827 - RNA, 63 nt, hsa
gcuugugaggccaggaguuugagaccauccuaggcaacauaaugagacaccgucucuaaaaua

SEQ ID NO: 344828 - RNA, 63 nt, hsa
uaguuggugcgaaaaucuccugugcuuguggaagcaacauaaguugggucccuuaacugucac

SEQ ID NO: 344829 - RNA, 63 nt, hsa
uauaaaguguuaauuuugcaugcugucuuucaugcaacauaauuugaaauuuguccaugguau

SEQ ID NO: 344830 - RNA, 63 nt, hsa
ucauuggaggccaggaguuagagaucagccugggcaacauagccagaccuccucucuacaaaa

SEQ ID NO: 344831 - RNA, 63 nt, hsa
uuuuguuuuuuuccuuuuuuggguaaaguacaugcaacauaaaauuuaccauuucagucauua

SEQ ID NO: 344832 - RNA, 63 nt, hsa
cugcuuaagcccaggaguucaagaccagccugggcaacauagugagacucuguuauaaaaauu

SEQ ID NO: 344833 - RNA, 63 nt, hsa
cucuuugccagccauguguacaguaaaaagcaggcaacauagugucagccaaagcucauuugc

SEQ ID NO: 344834 - RNA, 63 nt, hsa
cugcuuaagcucaggaguuugagaccagccugggcaacauagcaagacccccaccaucucuga

SEQ ID NO: 344835 - RNA, 63 nt, hsa
augauuaugauggucagaguaagaugagcaauugcaacauaauauucucuaauauuguauacu

SEQ ID NO: 344836 - RNA, 63 nt, hsa
ucacuggagcucgggaguucaagaccagccugggcaacauagugaaaccgucuccacaaauaa

SEQ ID NO: 344837 - RNA, 63 nt, hsa
uugcuugagcccaggaguucaagaccagccugggcaacauagugagaccugcccccuaucucu

SEQ ID NO: 344838 - RNA, 63 nt, hsa
uuaccugccacugggaccagcaggugaagcguugcaacauagcccccuccaucauccuucacc

SEQ ID NO: 344839 - RNA, 63 nt, hsa
ucacuugagcccgcaaguuugagaccacccugggcaacauagcgagacuaccucuacaaaaaa

SEQ ID NO: 344840 - RNA, 63 nt, hsa
ucgcuugagcccaggaguucaagaccagccugggcaacauagugagaccccaucucuacuuaa

SEQ ID NO: 344841 - RNA, 63 nt, hsa
uuaggaaauauuaacuacuaguuauuugugauagcaacauacacauggccaguaaugcucuug

SEQ ID NO: 344842 - RNA, 63 nt, hsa
uccacuucccaagggagacuccggcaaccuucagcaacauauauccucgaccagaugcagugc

SEQ ID NO: 344843 - RNA, 63 nt, hsa
uuccuugaggccaggguucgagaccaaccuugggcaacauagcaagaccccauuucuuaaaaa

SEQ ID NO: 344844 - RNA, 63 nt, hsa
ucccuuuagcccaggaguuaaagaccagccugggcaacauagggagacccugucuuuuuuuug

SEQ ID NO: 344845 - RNA, 63 nt, hsa
ugggaggaucccaggaguucaaauccugccugggcaacauagcaagacccugucucuuaaaaa

SEQ ID NO: 344846 - RNA, 63 nt, hsa
guugcaccugugaauaacugcacuccagccugggcaacauagcgagaccucaucuccaaaaaa

SEQ ID NO: 344847 - RNA, 63 nt, hsa
uuuugugcccccagaugccucuugauaggagaggcaacauacuccaaauaguuggguucuuca

SEQ ID NO: 344848 - RNA, 63 nt, hsa
uugguaaucucauuuaaucuuuacuacacuccugcaacauagacaguauuauuacauucagua

SEQ ID NO: 344849 - RNA, 63 nt, hsa
ccccgcccuuccuccccuuauuuguuaaaugaagcaacauagugagacgucgucucuacaaaa

SEQ ID NO: 344850 - RNA, 63 nt, hsa
uuugcugguuguuucuacaggguucugaagcaugcaacauagaacagauaccuuuaaauuuag

SEQ ID NO: 344851 - RNA, 63 nt, hsa
ucuucaugcaggagaccccaggcccuggaggcugcaacauaccucaauccugucccaggccgg

SEQ ID NO: 344852 - RNA, 63 nt, hsa
gagcugagaucgcaccacugcacuccagccugggcaacauagcaaaauccugucucaaaaaaa

SEQ ID NO: 344853 - RNA, 63 nt, hsa
ucacuugagcccaggaguucgagaccagccuaggcaacauagcaagacccugucuguacacaa

SEQ ID NO: 344854 - RNA, 63 nt, hsa
uuucugagggguucugaaaguaugauucaaugugcaacauacagguaggucuucagcauaagc

SEQ ID NO: 344855 - RNA, 63 nt, hsa
uucacauugaaauaugucuauaugcugaauauagcaacauaugcaucuaagauuugggcauuu

SEQ ID NO: 344856 - RNA, 63 nt, hsa
uaggagguuugagcucaaaugcuuaaacugcuggcaacauauaauaaaugcaugcuauucaau

SEQ ID NO: 344857 - RNA, 63 nt, hsa
uaaugcuuugauuuuaauaguugguucuguguugcaacauauaucuuuagugcugacacuaac

SEQ ID NO: 344858 - RNA, 63 nt, hsa
gugcuugagguuaggcguuccagaccagccugggcaacauagugagacucuugucucuacaaa

SEQ ID NO: 344859 - RNA, 63 nt, hsa
uggcuugagaccaggaguucaagaccagccugggcaacauagugagacgccccccccccccau

SEQ ID NO: 344860 - RNA, 63 nt, hsa
uuucccuuccuaucccucugcccuacccgcucagcaacauagaagagggaaggaaagagagaa

SEQ ID NO: 344861 - RNA, 63 nt, hsa
uugcuuaaggccaggaguuugagaccagcuugggcaacauagugaaacccugucuguauggaa

SEQ ID NO: 344862 - RNA, 65 nt, hsa
ccugggggaggugauccuugaacuggcucccggggaacauucagagcaugauugguagacagaag

SEQ ID NO: 344863 - RNA, 65 nt, hsa
acuuuguaaaaauaaaauauugugguuuuguuuuaaacauucaacguuucuuuuccuucuacaau

SEQ ID NO: 344864 - RNA, 65 nt, hsa
ccucugguaugagaaauaaaaucugccaguuuuauaacauucacuuucugccucugaggaaagau

SEQ ID NO: 344865 - RNA, 65 nt, hsa
acugaaaggugggauuagagucaggccagaaagagaacauucauccagagaucccagaguugggg

SEQ ID NO: 344866 - RNA, 65 nt, hsa
gcuacauuguucagcaacucacaaaacguagcacaaacauucauuauggagaaagcaucaggacu

SEQ ID NO: 344867 - RNA, 65 nt, hsa
cacucaucccuggucgucuaucccaguguguguuuaacauucacagcccagaaccacagaugugu

SEQ ID NO: 344868 - RNA, 65 nt, hsa
aucaacauuccaggguugguaauguuggaugaugaaacauucauuuuuaccuuguggaugcuagu

SEQ ID NO: 344869 - RNA, 65 nt, hsa
aacuacuuuggaaaacaguuuaucugcuguaauugaacauucagcuacccuauaacccaguuaau

SEQ ID NO: 344870 - RNA, 65 nt, hsa
uguuguccccuucaaugguguuaccuuaggagcugaacauucaauucaguuacaccacuaugacu

SEQ ID NO: 344871 - RNA, 65 nt, hsa
uuuuacugaaccagucuaacauuuacuuuccaagaaacauucaggacauauuccuuuaauucuaa

SEQ ID NO: 344872 - RNA, 65 nt, hsa
cgaaguaaacugauguacugaauuccauaauacauaacauucaauuuuuaccacuucuguuuagc

SEQ ID NO: 344873 - RNA, 65 nt, hsa
auuuuuuagaagcauuuuacccauuuauuuuuuuaaacauucaagaacugcugacguacugugga

SEQ ID NO: 344874 - RNA, 65 nt, hsa
gaucuugaacagaaccaguaucugucauggaacugaacauucaucgauggucuccauguauucau

SEQ ID NO: 344875 - RNA, 65 nt, hsa
uuuuuuuuuuaaaccagggaugucuguugaaauaaaacauucagucugacaaacauugccugccc

SEQ ID NO: 344876 - RNA, 65 nt, hsa
uauguauuggucaaggcaggcaucucuguucucugaacauucauugcacuuucccaccucuauac

SEQ ID NO: 344877 - RNA, 65 nt, hsa
auaucauagaguaacaagugcuggucagccaaagaaacauucacugcuggugaaccaauaccaua

SEQ ID NO: 344878 - RNA, 65 nt, hsa
gcuuguuugaucccaaauggugcuuaucuugauugaacauucagaacaaggauauuauuuucagu

SEQ ID NO: 344879 - RNA, 65 nt, hsa
acuaaggcauagaaguugggaaauacuugcuucagaacauucaugguaaauuugcacuucaucuu

SEQ ID NO: 344880 - RNA, 65 nt, hsa
cccgcuuuccuuagugcuuggagcaauuuccauaaaacauucaccagaaaccuuuugcacaucgg

SEQ ID NO: 344881 - RNA, 65 nt, hsa
gguuuugaaaagcaguucggguuguccaauucuguaacauucaucuccauuuuuuaaaaagguuu

SEQ ID NO: 344882 - RNA, 65 nt, hsa
uguggccccuaaacccagagugacugagagcacuuaacauucagcuugucucauccccagucuac

SEQ ID NO: 344883 - RNA, 65 nt, hsa
uucagauuuuuuuucuuuuccauacuuguauauugaacauucaaacuugaauggaaaguugauuu

SEQ ID NO: 344884 - RNA, 65 nt, hsa
uguaaaacauauucaagauccuacaguaagagugaaacauucacaaagauuugcguuaaugaaga

SEQ ID NO: 344885 - RNA, 65 nt, hsa
aaugugaugaccaaaugaacaaaauucuuaaauaaaacauucacuuuaguuucucacagaaucau

SEQ ID NO: 344886 - RNA, 65 nt, hsa
cucugucucaaaaaaaaaaaaaaaaaaaaaaaaaaaacauucaaagagacauauacuaagauguu

SEQ ID NO: 344887 - RNA, 65 nt, hsa
cuuggcaugaaaaugagaaaaugcagacagaccucaacauucaacaacauccauacagcacugcu

SEQ ID NO: 344888 - RNA, 65 nt, hsa
aucacuggcugcucuucaucaaaccuacuauaaaaaacauucaaguucaacuguuucuuugggcc

SEQ ID NO: 344889 - RNA, 65 nt, hsa
aaagaauagggauuuaucauuucaggaaaaaaaaaaacauucaaaugugggcuuuagcuuguuuu

SEQ ID NO: 344890 - RNA, 65 nt, hsa
aaaucaacucucuccuggucgcuuugccaucaagaaacauucagaccagggaacggaaagaagag

SEQ ID NO: 344891 - RNA, 55 nt, hsa
uuggcugugauauuuacuagaauugaacauucaaaaaccccuggaagagacucuu

SEQ ID NO: 344892 - RNA, 52 nt, hsa
cuuuuaaguuuccugguuaauuaacauucacugaguauccaaaaugaaauaa

SEQ ID NO: 344893 - RNA, 65 nt, hsa
cugagugcuagcuagccagcuguguucacacuguaaacauucaucaagcuguacauuuggugcac

SEQ ID NO: 344894 - RNA, 65 nt, hsa
ccuggggaguccccacacacccgcaccaaaggggaaacauucaaaggagaugcaggugacauaca

SEQ ID NO: 344895 - RNA, 65 nt, hsa
uuuaauuuuuuuuuuugcaacauaucccacucagaaacauucagguuugaagccagcccugauaa

SEQ ID NO: 344896 - RNA, 65 nt, hsa
aggucaguuuuccucuuucuuggcuucuacccacaaacauucaccaaucauuuauucguucauuu

SEQ ID NO: 344897 - RNA, 65 nt, hsa
ccuuuugugauucuaaaaccuuugaucuuucuacuaacauucacuguuagagaguguaggcgcug

SEQ ID NO: 344898 - RNA, 65 nt, hsa
ugcuuugauuaucuuguauguuaacaauucuagaaaacauucaugaauucacaaaaauauguuac

SEQ ID NO: 344899 - RNA, 65 nt, hsa
uaaaaaaaacccauacauaagaaacagccuccaagaacauucaagcagcagucagagagaaaaau

SEQ ID NO: 344900 - RNA, 65 nt, hsa
aaggccccaccuuacucugaaagcuggggagccugaacauucacuccuuguccuccaugcugugg

SEQ ID NO: 344901 - RNA, 65 nt, hsa
gaacuuggacuccaucguuaaaauuauuuauguguaacauucaaaugugugcauuaaauaugcuu

SEQ ID NO: 344902 - RNA, 65 nt, hsa
caauucauaagcacaauaugauuuacagaauaauaaacauucauguacccacuaucagguuaaga

SEQ ID NO: 344903 - RNA, 65 nt, hsa
gaucaguggggccccaaagcccagcccggcugaccaacauucaaaagcacaaacccuggggacuc

SEQ ID NO: 344904 - RNA, 65 nt, hsa
aagaagccaucaauuuuaacauuugaugucuagauaacauucaugagauuggucauuaaauacua

SEQ ID NO: 344905 - RNA, 65 nt, hsa
auuucaguuuuaaucacugaacaaaagaaacaggcaacauucacuucuguaguaugguuuccacc

SEQ ID NO: 344906 - RNA, 65 nt, hsa
cauaaaauguagcaaaucgguacuguaaaacauuuaacauucauacaguuauauauaauauccuu

SEQ ID NO: 344907 - RNA, 65 nt, hsa
aagaacaugccacgauuuugucuuucuguggacucaacauucacuucgauuaaaaauagcaauuu

SEQ ID NO: 344908 - RNA, 65 nt, hsa
uuuuuagaaauggcauauguuuuugaugauaugucaacauucaaaauuguccuaauuaaauuguu

SEQ ID NO: 344909 - RNA, 65 nt, hsa
uugugcuuccuaacccuaaaucuguccagaguaggaacauucaugguaaucgacugucugucauu

SEQ ID NO: 344910 - RNA, 65 nt, hsa
agaagccugcauaauguuucuggauuucauacuguaacauucaggaauucuuggagaaaaugggu

SEQ ID NO: 344911 - RNA, 65 nt, hsa
acauuuagagguuaaaagaaacagugagaaauguaaacauucaaaaugauaauugaaucucucag

SEQ ID NO: 344912 - RNA, 65 nt, hsa
ugucuuuugaggauggcuuuguccuguugcugguuaacauucaccuuccucuuuugaggaguauu

SEQ ID NO: 344913 - RNA, 65 nt, hsa
agguggaagaagugagggugcagcgugucagacacaacauucauguuacucuuacauuggaaucu

SEQ ID NO: 344914 - RNA, 65 nt, hsa
cuuuugucugggcaguagugaaaauaacuacucacaacauucacuauguuugcaaggaauuaaca

SEQ ID NO: 344915 - RNA, 65 nt, hsa
cuaaccauugaugagcacuccugauuuuuaucuagaacauucagauuuaccauaauguuccuuag

SEQ ID NO: 344916 - RNA, 65 nt, hsa
aaaacauucagaaaaugaaguuuugaauuuguuggaacauucaaaggacuugagagcauuuuauu

SEQ ID NO: 344917 - RNA, 65 nt, hsa
uuaccaaugcgaacagguaguucgcauuuauguaaaacauucagaaaaugaaguuuugaauuugu

SEQ ID NO: 344918 - RNA, 65 nt, hsa
ucauuuuguuucuccuucaaaaauuaaguuggacuaacauucacguaucaaacuaauauaaaaag

SEQ ID NO: 344919 - RNA, 65 nt, hsa
cccccaaaaucuguugaaaugauucacugaugcaaaacauucacccguaauagacugagaauuga

SEQ ID NO: 344920 - RNA, 65 nt, hsa
ggucuccaccucaggggagacuuaggccagaggugaacauucauguguaggaagaggccgcugca

SEQ ID NO: 344921 - RNA, 65 nt, hsa
uguucuucauguuuuaagcacuuuaugaagaauaaaacauucauguacugcagguggcucuguug

SEQ ID NO: 344922 - RNA, 65 nt, hsa
aggagcacacuaagguguggucaugcaucauaaccaacauucacucaucugggacauucuuaaga

SEQ ID NO: 344923 - RNA, 65 nt, hsa
agggguuggaaacuuagcacuuuauauuuauacagaacauucaggauaugucaauaaaauauugu

SEQ ID NO: 344924 - RNA, 65 nt, hsa
gcacauauauuuuuuacaaacagaugaaaaaaguuaacauucaguacuuuaugaaaaaaauauau

SEQ ID NO: 344925 - RNA, 65 nt, hsa
cagauaaauguauucaacauguaauacaguauuuuaacauucaccucuuauuuuauauugaaaug

SEQ ID NO: 344926 - RNA, 65 nt, hsa
ugacuugcaucccagcuuuccaccaaccaaauucaaacauucacugcuuauuuguuacagacugu

SEQ ID NO: 344927 - RNA, 65 nt, hsa
aagaaugaacacuauacuuugcuucaaaccuucagaacauucaaaccguuuauguuucucaucua

SEQ ID NO: 344928 - RNA, 65 nt, hsa
uuuuaguaacaucuugcuuagucauguuguuauaaaacauucaaauucugauauacauugcuuga

SEQ ID NO: 344929 - RNA, 65 nt, hsa
auccuguauauuaugguguaaugcacaauuuagaaaacauucauccaguugcaauaaaauaguau

SEQ ID NO: 344930 - RNA, 65 nt, hsa
uauauuacaaucauuuuauauuuuuuuacaugauuaacauucacuuauggauucaugauggcugu

SEQ ID NO: 344931 - RNA, 65 nt, hsa
ugaaugucugaggcuaccagguuuaucacauaaaaaacauucaguaaaauaguaaguuucucuuu

SEQ ID NO: 344932 - RNA, 65 nt, hsa
acaaaaaauacaucauuuaauuuuuguuacauaugaacauucauuuuuaaaugcucagccucaag

SEQ ID NO: 344933 - RNA, 65 nt, hsa
ugcacauaaauugguauaauaaaaagaaaaacacaaacauucaaagcuuagggauagguccuugg

SEQ ID NO: 344934 - RNA, 65 nt, hsa
uauuuucucucaauucuguagacucucgcaagauaaacauucaaacagugaaacaaacaauaaaa

SEQ ID NO: 344935 - RNA, 65 nt, hsa
ggagacuuuguacaguggccucucuaaaaguacaaaacauucauaagagaaaccugcauacauuu

SEQ ID NO: 344936 - RNA, 65 nt, hsa
cuuuaaauacugaggaaaauguggccuguuuacaaaacauucagcacguugaagaaaguguuccc

SEQ ID NO: 344937 - RNA, 65 nt, hsa
gaggaaauuaaucuuuauauauuauuucuugcagaaacauucauuauuuuauuaauauugcccua

SEQ ID NO: 344938 - RNA, 65 nt, hsa
uuuuuuuuuaauguuccagaagauggccaauagagaacauucaagggaaauggggaaacauaauu

SEQ ID NO: 344939 - RNA, 65 nt, hsa
aaaaguaauacagaauugugauuuauuaauuuuaaaacauucagaacuuguugaaagaaaaauua

SEQ ID NO: 344940 - RNA, 65 nt, hsa
aaauuuaccuguagcccagugaaggguguguuuggaacauucauuaaaugauucuaagcaucuug

SEQ ID NO: 344941 - RNA, 65 nt, hsa
ccaggucucaucuugcaucucauccuggccuggagaacauucaguuuccuuccaacccuucccac

SEQ ID NO: 344942 - RNA, 65 nt, hsa
accaauuauaaggaaaauuuacagcagugaacaugaacauucacuuagcuuccucagucucucca

SEQ ID NO: 344943 - RNA, 65 nt, hsa
gggauuuauuacuguuguaucuauguugcaugauaaacauucaucaccuuccuccuguaguccug

SEQ ID NO: 344944 - RNA, 65 nt, hsa
auggaagguguugcuuuagaaagguagucaggaaaaacauucaggaauagauuuauacaccauua

SEQ ID NO: 344945 - RNA, 65 nt, hsa
ugcuaucuaucgcugcucucuucuugucauccuuaaacauucagucauguucccaggucugaggg

SEQ ID NO: 344946 - RNA, 65 nt, hsa
augcuuugcugaccacuguuuguuaggccuuaaacaacauucacuguggugguaucaggcacacu

SEQ ID NO: 344947 - RNA, 65 nt, hsa
aauauuucauaguuuucaagccuuuuuuuucugcuaacauucagacaaguaacaggcaacaaaga

SEQ ID NO: 344948 - RNA, 65 nt, hsa
augggaugccccugcucaucugguccugaaguaguaacauucacccaaaugaggauauagucauu

SEQ ID NO: 344949 - RNA, 65 nt, hsa
agcaauguaacaguguaaucuaguucaauucagcaaacauucauggaguucuucaugucugucaa

SEQ ID NO: 344950 - RNA, 65 nt, hsa
gacauagaaggauauagugggagcagugauacgcuaacauucauuacauucugcaguaaugaauc

SEQ ID NO: 344951 - RNA, 65 nt, hsa
aaguggaagaguugaaacuugauugaaggacuuaaaacauucacaaccuuaagccgagguggggg

SEQ ID NO: 344952 - RNA, 65 nt, hsa
auuaucacuuggauguggagguuuuacuuuuuaaaaacauucagcuuaauuaccuuaccuuaauu

SEQ ID NO: 344953 - RNA, 65 nt, hsa
uccauggaaaauaaagauuuagaaaccagguggaaaacauucacuauuaagacuauugauauauu

SEQ ID NO: 344954 - RNA, 65 nt, hsa
uuuccuaacaucagugagauacaucuuugaauuuaaacauucauauuuacugaguaccuacuagg

SEQ ID NO: 344955 - RNA, 65 nt, hsa
uaauacauuuauguugacaccucccuaauccaggaaacauucacaaacaaggacucccauauaca

SEQ ID NO: 344956 - RNA, 65 nt, hsa
ugcuaaacgacuccgagaacaacaguugggcugucaacauucaaagcagcagagagggaacuuug

SEQ ID NO: 344957 - RNA, 65 nt, hsa
uucucauggagugaaacagugauuuauuuuaaccaaacauucaccaaagcaaagaacgguuucag

SEQ ID NO: 344958 - RNA, 65 nt, hsa
ccggagucuuuggguuugauucaccugcugcgaaaaacauucaacaaauuguguacaagauaaau

SEQ ID NO: 344959 - RNA, 65 nt, hsa
aauaaaguuccuuucuaaccauuucugguuuagaaaacauucagccauccuagaaacuagcaaua

SEQ ID NO: 344960 - RNA, 65 nt, hsa
ugagcaaacuaacuugacuuuuaaggcuaaaacuuaacauucauagagggguggaguuuuaacug

SEQ ID NO: 344961 - RNA, 52 nt, hsa
ccaguccuauugaggcaugaggaacauucauucuguauuuuuuuucccuguu

SEQ ID NO: 344962 - RNA, 65 nt, hsa
ugccuaguuccuguggccaggagguuggugacugaaacauucacacagggcucuuugauggaccc

SEQ ID NO: 344963 - RNA, 65 nt, hsa
gggaauggaguaagucaccuucugacugcuuaguaaacauucaaagaaaugccuuggcuccagug

SEQ ID NO: 344964 - RNA, 65 nt, hsa
aguguuuggugugguuugugucugaugaguuuuuuaacauucagguguagauuguuucagcuucu

SEQ ID NO: 344965 - RNA, 65 nt, hsa
gagcuggucaaacauuccuuguguuaaaaaaaucaaacauucauauccacaaaauuuucugcuaa

SEQ ID NO: 344966 - RNA, 65 nt, hsa
accauauaaaucaaguaccuauugggaacagacauaacauucaauuuuucauuuaugcuaaguga

SEQ ID NO: 344967 - RNA, 65 nt, hsa
aucuuuugggauccuuaauuagagaugauuucuggaacauucagucuagaaagaaaacauuggaa

SEQ ID NO: 344968 - RNA, 65 nt, hsa
uucaaaccugcaaggcaaaguaaaauuagagcaagaacauucaaaccaaauaagauauuuuucag

SEQ ID NO: 344969 - RNA, 65 nt, hsa
uuauaauagauuuuuuuuaaaguuugguauuguaaaacauucacaccucugucccucaaaauuga

SEQ ID NO: 344970 - RNA, 65 nt, hsa
cuuucagguguuuagagauuuuuuuuguuguuguuaacauucauugcaaaaguacuagauggugu

SEQ ID NO: 344971 - RNA, 65 nt, hsa
uaacuccuaauuuacccuucaggucucagcuucagaacauucacuuauaaagaaacccugcugau

SEQ ID NO: 344972 - RNA, 65 nt, hsa
uuguacagucauaauuuguuaaaaugacuucauuuaacauucacugauguagauuaauaauguaa

SEQ ID NO: 344973 - RNA, 65 nt, hsa
accggugaaaagaaacagguaguuaaguuaggguuaacauucauuucaaccacgagguuguauau

SEQ ID NO: 344974 - RNA, 65 nt, hsa
gcuuguaaucucacugagccaaaucagagaucuuaaacauucagucagucaucaaacauuauuga

SEQ ID NO: 344975 - RNA, 65 nt, hsa
ccaaaagauggagaaaagcacauuaaaaagauaccaacauucagaaauucauuucagcauguuau

SEQ ID NO: 344976 - RNA, 65 nt, hsa
aauaaauugucacacaauggaaaaucauaugccacaacauucauuguaagguuuaauaaaauuaa

SEQ ID NO: 344977 - RNA, 65 nt, hsa
auauaauauauuguuugugaauuauugagaaauguaacauucaaauuucuaaaauugucugccaa

SEQ ID NO: 344978 - RNA, 65 nt, hsa
gagcaacaguaacuccaaagugucagaaaauaguuaacauucaaaaaacuuguuuucacauggac

SEQ ID NO: 344979 - RNA, 65 nt, hsa
cauguaacuuuuuaagauuuaaauuuaaauuaguuaacauucaaaacgcagcuccccaaucacac

SEQ ID NO: 344980 - RNA, 65 nt, hsa
ucuuuuuucauggaaugcgcuaccuguggccuuuuaacauucaagaguaugcccacccagcccca

SEQ ID NO: 344981 - RNA, 65 nt, hsa
cauucaguaggauucaauucaauguggaaccauucaacauucaccucauuaaccuaaaaugucuc

SEQ ID NO: 344982 - RNA, 65 nt, hsa
gagcaggcgacucaguggcccaaaacaggacccagaacauucauccguaaauggaaucugauaau

SEQ ID NO: 344983 - RNA, 65 nt, hsa
uagugaaggguaggagagcucagccucggauggccaacauucaguuguucagguucauucgucaa

SEQ ID NO: 344984 - RNA, 65 nt, hsa
ucuugucagaacauugggacaauuggucguucaaaaacauucauccucuuacugcaaguuuaucu

SEQ ID NO: 344985 - RNA, 65 nt, hsa
gcucaauacucaagaaucuugcaagacaguuauuaaacauucauagcuugaaauugcccauggug

SEQ ID NO: 344986 - RNA, 65 nt, hsa
uucauaggguuuggcaugcugcucgguacaugguuaacauucauaaauggugggggcccuuacug

SEQ ID NO: 344987 - RNA, 65 nt, hsa
ucaaacuucagguugaaacuguuugaagcauuauaaacauucauuucacaacuagauuguauaag

SEQ ID NO: 344988 - RNA, 65 nt, hsa
uggcaccaauccuagacucacgugugccccagaauaacauucagacucucagcuggucuuguguu

SEQ ID NO: 344989 - RNA, 65 nt, hsa
uuugcaugacuccccauacauguugcagcuuugaaaacauucaucucagaguuagguauaaagac

SEQ ID NO: 344990 - RNA, 65 nt, hsa
cacugagcuuucaacauugaagugacuugggaaauaacauucaagcuucuggguaaacacauaca

SEQ ID NO: 344991 - RNA, 65 nt, hsa
aagaguaaacugaugaguugaagucuggagagaauaacauucauuauaaauaaaauuauucugug

SEQ ID NO: 344992 - RNA, 65 nt, hsa
aaggcagggcccagcauaauuccuccaguuggaugaacauucaagagagcucguuccuaccuggc

SEQ ID NO: 344993 - RNA, 65 nt, hsa
ucuugugaauccuauaagcagucuuuaugucucuuaacauucacaccuacuuuuuaaaaacaaau

SEQ ID NO: 344994 - RNA, 65 nt, hsa
gcagaugucuuuacauauuucaauacagaaacuauaacauucaauagugugcugucaaagugugc

SEQ ID NO: 344995 - RNA, 65 nt, hsa
acaaaaugaauaaaagugagaguagucagaacuauaacauucaauuugcuauuuacaaaugaagu

SEQ ID NO: 344996 - RNA, 65 nt, hsa
acucaucacaagaggucaaaaguauuugcuacuguaacauucaauucacauuugagaaucauggu

SEQ ID NO: 344997 - RNA, 65 nt, hsa
ccucuaaaauauuuauagaaauauguaaguagaaaaacauucauccuuuccucgucuaauuauga

SEQ ID NO: 344998 - RNA, 65 nt, hsa
ccaaauucaacauuacugcaagucuuagagauuuaaacauucauuugauucagagcuaaauauuc

SEQ ID NO: 344999 - RNA, 65 nt, hsa
aagaugaguuugaccuguggugaccugacagagagaacauucagauccucagauugcacccugau

SEQ ID NO: 345000 - RNA, 65 nt, hsa
agagaguaccuaaaauggagagaagaaugaacuagaacauucaagacucuuuuacuucuggguau

SEQ ID NO: 345001 - RNA, 65 nt, hsa
aagaaauguuuaagacucagcuuuaaaaagaaguuaacauucauaucucuguuuugaaaucaaaa

SEQ ID NO: 345002 - RNA, 65 nt, hsa
ucuaaacagacaucuaaauuuucgagacuuagaauaacauucacuaaaguuugauaaugucuuuu

SEQ ID NO: 345003 - RNA, 65 nt, hsa
uguggcucagagauaacccuuggagaugugacuacaacauucacuaccucuacuacugguuaaag

SEQ ID NO: 345004 - RNA, 65 nt, hsa
gaucagaguauauagaugaauaugaacaagaauggaacauucacuugucaacgcacuuucuaaau

SEQ ID NO: 345005 - RNA, 65 nt, hsa
uaaagacaaagcauucuaaaugaacucaauauaaaaacauucauuuggaauguacauacugaaaa

SEQ ID NO: 345006 - RNA, 65 nt, hsa
aauauauuuaaggguuuuuuuuuuuugacaaauucaacauucaacgaguagacaaaaugcuaauu

SEQ ID NO: 345007 - RNA, 65 nt, hsa
uagaugugaaauuucugaaaauguugaagcagagaaacauucacacacaaaaagcaacauaguca

SEQ ID NO: 345008 - RNA, 65 nt, hsa
auuugagcuccgggucucuucuaccugcauucuaaaacauucaaaguaauaaaaauuucuccaca

SEQ ID NO: 345009 - RNA, 65 nt, hsa
uagaaguacaggagggcgcagauggcuaacugaguaacauucaugaaaugaggcuuucuguggcg

SEQ ID NO: 345010 - RNA, 65 nt, hsa
aaugauaaugaucaaguaaguuguuugaugcaauaaacauucaacauucugguuuugucauauuu

SEQ ID NO: 345011 - RNA, 65 nt, hsa
aaaaaaaaggaagacuaaacagaaaccagaacugaaacauucaccugguagcaaaugacacaugc

SEQ ID NO: 345012 - RNA, 65 nt, hsa
aaucgucauaggaaagacgugccaguuguggaggaaacauucacacugaucugcuaguccaacga

SEQ ID NO: 345013 - RNA, 65 nt, hsa
augguaauaaacuuuucaaaaucuuuguuaaaccaaacauucaacacaaaauaaacuagaaggcc

SEQ ID NO: 345014 - RNA, 65 nt, hsa
uucuuuuguauuuuuuuuuguuuguuuuguuuuuaaacauucaaaagcaauuaaugaucagacau

SEQ ID NO: 345015 - RNA, 65 nt, hsa
aauuaucaggacuuuuuucaggaguggguuauaaaaacauucaaguuggucugacaguauuuugu

SEQ ID NO: 345016 - RNA, 65 nt, hsa
uugaauaaugcuguuuuauauguagaguguuuuaaaacauucacaccauucgucaucacuccucu

SEQ ID NO: 345017 - RNA, 65 nt, hsa
auccagggcugcaggcagcaacgcaagucaggcugaacauucagucuccagagacagcugugugg

SEQ ID NO: 345018 - RNA, 65 nt, hsa
agaguugcccuacaaauuucauuuggcagcgccauaacauucauuuaaaaaguuuaugaaaacau

SEQ ID NO: 345019 - RNA, 65 nt, hsa
gcagcgccauaacauucauuuaaaaaguuuaugaaaacauucauuugaaaguuccaugcagcuuu

SEQ ID NO: 345020 - RNA, 65 nt, hsa
gauggauuauaauggucucuagcaaaugugugguaaacauucauauggccauuaauuuuaacauu

SEQ ID NO: 345021 - RNA, 65 nt, hsa
gguuaggaauuugacaugaauugugcaaggauguaaacauucaguccauugcaauacguguuucu

SEQ ID NO: 345022 - RNA, 65 nt, hsa
ucuaacacugauuuaauagcuaacgagguagaagcaacauucauucuccuggucuuacauaugaa

SEQ ID NO: 345023 - RNA, 65 nt, hsa
ugcucacaguaaacucauuguuuaaaagcuucaagaacauucaagcuguugguguguuaaaaaau

SEQ ID NO: 345024 - RNA, 65 nt, hsa
uuccccugcuccccugagaccacccccaaacacaaaacauucauguaacucuccagccauuguaa

SEQ ID NO: 345025 - RNA, 65 nt, hsa
acaugggcaggcacccucauuuauagaugucaggaaacauucagugaaaaacuuguagaauggga

SEQ ID NO: 345026 - RNA, 65 nt, hsa
gcaccuugggucucacccaccauaggaaacaagacaacauucaauuugauagaaaucuugccaca

SEQ ID NO: 345027 - RNA, 65 nt, hsa
aguuuauugauuucacaauagggguuaaauuggcaaacauucauauuuuuacuucauuuuuaaaa

SEQ ID NO: 345028 - RNA, 65 nt, hsa
gaaaggacauuacuaaugacauuuugcagauuaaaaacauucauuugaacacaguaguccccuag

SEQ ID NO: 345029 - RNA, 65 nt, hsa
accuuguguagcauugcacaauauagaucucagucaacauucacugagugccaagaaugugagaa

SEQ ID NO: 345030 - RNA, 65 nt, hsa
cggucggaggauuguguugcuguggacgugguuccaacauucacuccuaucucauuagaagaaau

SEQ ID NO: 345031 - RNA, 65 nt, hsa
uaucagauuccaaaucaagguuaaacauaugauagaacauucauggugaaauuccuaugguaaau

SEQ ID NO: 345032 - RNA, 65 nt, hsa
aacacccagaacauauuuucuguucaaugcaaauaaacauucacuuuuuaccuauagucugcucu

SEQ ID NO: 345033 - RNA, 65 nt, hsa
gggauguggagguaguuggguagaaaaauuauuagaacauucacuuuuguuaacaguauuucucu

SEQ ID NO: 345034 - RNA, 65 nt, hsa
aacacaucugcaggacacauuuugccauguaaacuaacauucacugguuccagggauuaaggaau

SEQ ID NO: 345035 - RNA, 65 nt, hsa
cauaaaauguagcaaaucaguacuguaaaacauuuaacauucauacaauuauauauaauauccuu

SEQ ID NO: 345036 - RNA, 65 nt, hsa
auuguuguccauuuuuaaaguugaugauugcuggaaacauucacacgcuuaaaagcaauggugug

SEQ ID NO: 345037 - RNA, 65 nt, hsa
aaauaaaacaacaacaaaaugcaucagagagccaaaacauucaguauugcauuuucacauaggug

SEQ ID NO: 345038 - RNA, 65 nt, hsa
cuuaaaauacccauugccccagaccuggaagauauaacauucaguucccaccaucugauuaaaac

SEQ ID NO: 345039 - RNA, 65 nt, hsa
ucugggggaacgauccuggccacagccgccaaacaaacauucacuaggccucuucuguuuucaua

SEQ ID NO: 345040 - RNA, 65 nt, hsa
uaacagugggguuuuuuuugugcaacucuucuaaaaacauucauaaugcagucauguuuauuuuu

SEQ ID NO: 345041 - RNA, 65 nt, hsa
cauaaaauguagcaaaucaguacuguaaaacauuuaacauucauacaguuauauauaauauccuu

SEQ ID NO: 345042 - RNA, 65 nt, hsa
auuaauuguacagacacauaauguaacauugucucaacauucauucacagauugacuguaaauua

SEQ ID NO: 345043 - RNA, 65 nt, hsa
agcucucucauuccaggaagccuuuucccuaguggaacauucagugcagaaguccucacacacua

SEQ ID NO: 345044 - RNA, 65 nt, hsa
uacacugauaaauacacagaucuuauaaagucuuuaacauucauuuguauucagaugugaguaga

SEQ ID NO: 345045 - RNA, 65 nt, hsa
uuggauuuauaaaagcagacucaccuaauaaaaucaacauucauuguaugagugugugaaucguu

SEQ ID NO: 345046 - RNA, 65 nt, hsa
ugccaguggggguuugaaagagaauuuuuggaaccaacauucaaauucugccucaucuggaggga

SEQ ID NO: 345047 - RNA, 65 nt, hsa
gcccaggugaguccuagagcuacagggguucuggaaacauucaggagcuuccuguccucccagcu

SEQ ID NO: 345048 - RNA, 65 nt, hsa
guugaaguucguuuuuuuguuuucuucuuuuuuuaaacauucauagcuggucuuauuuguaaagc

SEQ ID NO: 345049 - RNA, 65 nt, hsa
auauuuuuaauggagaaagacucuaguugagaaaaaacauucauaaaauggaaaaguaguucacg

SEQ ID NO: 345050 - RNA, 65 nt, hsa
acagugagacggugagauggauucguuuugcacacaacauucaaaacacuucauauugcccccac

SEQ ID NO: 345051 - RNA, 65 nt, hsa
uaugaauucacaccuugaguauaaaacuugcagagaacauucagcgauuuccaguccacugugag

SEQ ID NO: 345052 - RNA, 65 nt, hsa
aacgaacacgaauccaucccaaccgagaugccauuaacauucaucuaaaaauguuaggcucuaaa

SEQ ID NO: 345053 - RNA, 65 nt, hsa
aaauacuugauucuguuaaaaugcagaggugcuauaacauucaaagugucagauuccuugggagu

SEQ ID NO: 345054 - RNA, 65 nt, hsa
cuuccuugagccuaguuuuuuuacgugauuuuuguaacauucauuuuuuuguacagauaacagga

SEQ ID NO: 345055 - RNA, 65 nt, hsa
aauuaguuauaaauaaauaaccaaaaauguauguaaacauucaaaugauuaucugaacaaaugag

SEQ ID NO: 345056 - RNA, 65 nt, hsa
uuugaguuauaugauguuuauuugaaugacuguugaacauucaaauuuguauuauuuggagauga

SEQ ID NO: 345057 - RNA, 65 nt, hsa
uucaaauaucauuuuaccuuugaagaaaaccagaaaacauucaaaagaacuucaacaaaucauca

SEQ ID NO: 345058 - RNA, 65 nt, hsa
ugggaaagcaauauauuaugcagccagucuguagaaacauucagaucccucuuccuuuacucaaa

SEQ ID NO: 345059 - RNA, 65 nt, hsa
uaugccuggaggcucaacacaaaacuucccauccaaacauucagaugaacugagcgucuuacaca

SEQ ID NO: 345060 - RNA, 65 nt, hsa
aucggagugggcaccucuguguuucucuagggaguaacauucaacauuuaauugaaucguguguc

SEQ ID NO: 345061 - RNA, 65 nt, hsa
agaaaauucuuuaucauguuugccuucccuggggaaacauucaggcaguaaaaugacauccacgu

SEQ ID NO: 345062 - RNA, 65 nt, hsa
uuacgcugcaaaaaaaaaaaaaauguuggcuacccaacauucauuccccaccuucuugcugccag

SEQ ID NO: 345063 - RNA, 65 nt, hsa
ggugggaauaugggcuggcacugcugcagggcaagaacauucauguaggagcccgaggaccagca

SEQ ID NO: 345064 - RNA, 65 nt, hsa
gguuuacagaugaaccggauaaugccuaucccagaaacauucaaaucaagcccaugaguacccac

SEQ ID NO: 345065 - RNA, 65 nt, hsa
aggguggcagguacaucaguucuuuuugauaugaaaacauucauguuucagacauugaauugaga

SEQ ID NO: 345066 - RNA, 65 nt, hsa
caagucaugaaagaaguccuugaagauauaccaagaacauucaucaguaucauucguguuuggau

SEQ ID NO: 345067 - RNA, 65 nt, hsa
aaggaaaaaauggggguggggggugggggguggacaacauucaacacugcagaaugggugaccuc

SEQ ID NO: 345068 - RNA, 65 nt, hsa
caccuuuuaaaaauuaugcaugaaaacaggugguaaacauucaguaauacgcuauuucuccaaca

SEQ ID NO: 345069 - RNA, 65 nt, hsa
ugucuugacuuaucuccugcaacugacucaucugcaacauucacaccauugcuuccuugugguuu

SEQ ID NO: 345070 - RNA, 65 nt, hsa
gacuaugccugagucccagggugcggcagguaggaaacauucacagaugaagacagcagauuccc

SEQ ID NO: 345071 - RNA, 65 nt, hsa
aggugcucagcuauuuaaaaacaaaacuauucucaaacauucaucauuagacaacuggaguuuuu

SEQ ID NO: 345072 - RNA, 65 nt, hsa
gauucauaacaacaccaagaauugauuuuguagccaacauucauucaauacuguuauaucagagg

SEQ ID NO: 345073 - RNA, 65 nt, hsa
cuuuuuuuucucucuuuuguuuauaaaaaacacuaaacauucaauuccagagaaccaaaaauccc

SEQ ID NO: 345074 - RNA, 65 nt, hsa
guuuuaaauaaagaaucuuacauaagaauguugacaacauucacaguaagccauuggcagaaaau

SEQ ID NO: 345075 - RNA, 65 nt, hsa
aaaguaaaaagggaauuaugaguuuuucaauuaguaacauucauguucuagucugcuuugguacu

SEQ ID NO: 345076 - RNA, 65 nt, hsa
ucccagaaccuauucccuuucuugagggaguucaaaacauucauaggcaguaauguuccucccag

SEQ ID NO: 345077 - RNA, 65 nt, hsa
uaucuaugcuguucuuuaaaucuacagcagggguaaacauucaucugcagugugcaucaauuuaa

SEQ ID NO: 345078 - RNA, 65 nt, hsa
caaggccgauuuuuguaacuguaaaugauguguacaacauucaagucugcauucugcacaagaua

SEQ ID NO: 345079 - RNA, 65 nt, hsa
gcaaucgcauuucaacgugagcgugggaggggacaaacauucaaaccauagcagggucauaggcc

SEQ ID NO: 345080 - RNA, 65 nt, hsa
uuuagcuuuuucauauuaaauauauauuauauuuaaacauucauggcauagaugaugauuuacag

SEQ ID NO: 345081 - RNA, 65 nt, hsa
uuugcucuuggaggcuuugggagagcaggaaugaaaacauucagaggaagacaucuguagggaau

SEQ ID NO: 345082 - RNA, 65 nt, hsa
accucuucuaucuaauccuuaaaagcauaauguugaacauucauucaacagcugaugcccuauaa

SEQ ID NO: 345083 - RNA, 65 nt, hsa
agugggugggugggugggacucaguccagagaccuaacauucagaauauagcauugguugccuau

SEQ ID NO: 345084 - RNA, 65 nt, hsa
ucuugcuuuaacuuucaacacuuagaaaaucuacaaacauucagaccugucuggguugguauugc

SEQ ID NO: 345085 - RNA, 65 nt, hsa
acuuucuuauaaauuuggaucauguuaugauuuguaacauucacacaacaccucacuuuugaauc

SEQ ID NO: 345086 - RNA, 58 nt, hsa
ugaaagcugggaaguuaugaaugaagauaacauucacccauaaccaagagaacucagg

SEQ ID NO: 345087 - RNA, 65 nt, hsa
ccaaacacauucuccuuugaauuguuaaaauucagaacauucaaaauaacuguuuugcuacaacc

SEQ ID NO: 345088 - RNA, 65 nt, hsa
cucagugugaguccucagagccuccaucugccaagaacauucaguuggauuccaucguuugguuu

SEQ ID NO: 345089 - RNA, 65 nt, hsa
gcaaguggaugaguuggaaauuaugcacuuugaaaaacauucacuuuguuuaagcuuauuggguu

SEQ ID NO: 345090 - RNA, 65 nt, hsa
auaguuuuuuaaaaaauuuaaugauggguaaucaaaacauucacauuuauucugcuggauuuaaa

SEQ ID NO: 345091 - RNA, 65 nt, hsa
aacuuuuaaaaccauagacaagccuuauagaguagaacauucacagcaaagaagaauccugugaa

SEQ ID NO: 345092 - RNA, 65 nt, hsa
aggacccgaguccaauagucaauuuauucuaagcgaacauucaucuccacacuuuccugucucaa

SEQ ID NO: 345093 - RNA, 65 nt, hsa
uaauuagaagguggaggagucauuucaugauuaagaacauucaacauguauuguucauuaagcua

SEQ ID NO: 345094 - RNA, 65 nt, hsa
caacuauagcaugcuuugaagagucucgggcaagaaacauucaugcaugaguauauguucuugga

SEQ ID NO: 345095 - RNA, 65 nt, hsa
auuuuuugagguuuuuuuguuugcuuauuuuucaaaacauucauuuauuguaauguuuacuagcg

SEQ ID NO: 345096 - RNA, 65 nt, hsa
cuacccaguauuguuugauacauuuuuauuugauaaacauucagugcaggaaacugugauuugcu

SEQ ID NO: 345097 - RNA, 65 nt, hsa
ccguuuccuuuuuccucuuccuuaauucuaguuaaaacauucacuuacggagaauguaagguuac

SEQ ID NO: 345098 - RNA, 65 nt, hsa
agguauuaggacgaccauacugccucugagcugaaaacauucaaaaguucacaucccuguuuggg

SEQ ID NO: 345099 - RNA, 65 nt, hsa
cauaacuuaauuucuuuuccugaaauucacuguaaaacauucagggguccuaccauuucuguuca

SEQ ID NO: 345100 - RNA, 65 nt, hsa
auaguuucuuucauuugggggcuauguguuucaauaacauucacuuggaaucagcugaaagcugu

SEQ ID NO: 345101 - RNA, 52 nt, hsa
uuuucccccuuaaaucacagaaaacauucaggaggaauacuguugcagcuga

SEQ ID NO: 345102 - RNA, 65 nt, hsa
auaaacuaaaugaagauaagauauuauuuuguauaaacauucaucugagaacaaucaaagcagua

SEQ ID NO: 345103 - RNA, 65 nt, hsa
cugucugugauuucucacauuuuuauuugcugagaaacauucagaaaauuauuccaaaaaugaag

SEQ ID NO: 345104 - RNA, 65 nt, hsa
uauccuaagcauucacggcagugagcuccuuuacuaacauucauguuauggcaagaguuguccuc

SEQ ID NO: 345105 - RNA, 65 nt, hsa
acuauaacaauguaguuacgcuacaacuugccuaaaacauucaaacuuguuuucuuuuuucuguu

SEQ ID NO: 345106 - RNA, 65 nt, hsa
aauucaaugugauuaauuccuaaaaucauagcacuaacauucaguagucauguccagcucuuccu

SEQ ID NO: 345107 - RNA, 65 nt, hsa
acaaaaugagaugaaagccgagcuggaccgauuuuaacauucacauugcccugccucuguccccc

SEQ ID NO: 345108 - RNA, 65 nt, hsa
uguugacuuuuaacaucaaaauuggauuugugucaaacauucauuguuaagagaagaaugacagu

SEQ ID NO: 345109 - RNA, 65 nt, hsa
uuccauuuccccucugcacccagaacagugguggcaacauucauugccaagggcccaaagaaaga

SEQ ID NO: 345110 - RNA, 65 nt, hsa
guaguaacuaaugucaagucuacaucgacugguaaaacauucaaagaacaaacugacaaugaugu

SEQ ID NO: 345111 - RNA, 65 nt, hsa
ugucaauuaaauauucaguuuuaugucuccaugcaaacauucaaagugcuuccaucagaacggag

SEQ ID NO: 345112 - RNA, 65 nt, hsa
gucaacuugaaugugagggcuacggugugguuucaaacauucaugauggauguauuuuccuaccc

SEQ ID NO: 345113 - RNA, 65 nt, hsa
acugcaacauacaggugccuuggggaaauguggagaacauucaaucuugccgucacuauucauca

SEQ ID NO: 345114 - RNA, 65 nt, hsa
ucuugccaggaggaggaaugagagugauguuggccaacauucaauuugaacagagcauggaagac

SEQ ID NO: 345115 - RNA, 65 nt, hsa
aaacauagcuucuuacugaacuugaacauuuuuacaacauucacugguuuuuguuuuguuagcua

SEQ ID NO: 345116 - RNA, 65 nt, hsa
uuuaaaaaaaaaaaaaaaaaaggaaaaaaucccuaaacauucaccuugaccuuauuuaugacuuu

SEQ ID NO: 345117 - RNA, 65 nt, hsa
ugaaauuuugugucugaugcugcucccuucuauccaacauucaacaacgggucugaaugucuagc

SEQ ID NO: 345118 - RNA, 65 nt, hsa
gguuccaguccuucaacuguucauaucuacuuuauaacauucacauacuaacccuucuucaagau

SEQ ID NO: 345119 - RNA, 65 nt, hsa
auccagccacuucccccucuucuucugaagaucagaacauucagcucuggagaacagugguugcc

SEQ ID NO: 345120 - RNA, 65 nt, hsa
uguuuucaguuuuuugcccuaauaaagcugcugugaacauucauguacagguuuuuaugugaaca

SEQ ID NO: 345121 - RNA, 65 nt, hsa
aauccagccaucguagugcuuuagucacuaucguaaacauucaugauagggcaaggauuuuaaaa

SEQ ID NO: 345122 - RNA, 65 nt, hsa
cuggugaaucuuuaacauuaccugguguguucccuaacauucaaacugugcauuggccauacccu

SEQ ID NO: 345123 - RNA, 65 nt, hsa
aaaauucagaccucucuccugaaaggcagagguucaacauucaggacuguuucuggccgaggacu

SEQ ID NO: 345124 - RNA, 65 nt, hsa
gcugccgcugccgcugcaccacggcguuuuuuuacaacauucaacuuuaguauuuuuacuauuau

SEQ ID NO: 345125 - RNA, 65 nt, hsa
gucuuuaguguaacaagaucacuggauuaaauauaaacauucagguuaauuaucuagauuuuugu

SEQ ID NO: 345126 - RNA, 65 nt, hsa
aucaucacagaucuguagaacuauacaaaagugcuaacauucaugauuagggucucagaagguaa

SEQ ID NO: 345127 - RNA, 65 nt, hsa
cuggagccccuggggcggugcuggccaaugcuggaaacauucacuuuccugcagccucuugggug

SEQ ID NO: 345128 - RNA, 65 nt, hsa
uuguaugggauuuauaccaaauuauguauuugcuaaacauucacugcacacguguacagcggagu

SEQ ID NO: 345129 - RNA, 65 nt, hsa
gucuguaguuguguuaguuugcauuaagcauguauaacauucaaguaugucauccaaauaagagg

SEQ ID NO: 345130 - RNA, 65 nt, hsa
uauugucuuuaaauguaacucauguuuauuucaaaaacauucacaaauauagaaaaguauacaaa

SEQ ID NO: 345131 - RNA, 65 nt, hsa
uccauacucacagaaugaauggcacaccugagaucaacauucacauaguuuagacuccaaaccau

SEQ ID NO: 345132 - RNA, 65 nt, hsa
uacuuuaauuuuguuuucuguggagguggaaaagcaacauucauagucuuuggagaaaugcuuag

SEQ ID NO: 345133 - RNA, 65 nt, hsa
uuuguuacaaaaaguaauagaaaaugguaauaguuaacauucauugagcuguuaauauguauaag

SEQ ID NO: 345134 - RNA, 65 nt, hsa
gggugacggccgggcaggagcaggcaugauaacccaacauucaagguaaauaacuaaccaguuuu

SEQ ID NO: 345135 - RNA, 65 nt, hsa
gagaaccuuaucuuuaagauguauuuguauguguaaacauucaauguauauuguauagucagugu

SEQ ID NO: 345136 - RNA, 65 nt, hsa
uuuuauuacaucuaaagagcucuacauaaacagguaacauucaauagguaaacaauuuuuuucca

SEQ ID NO: 345137 - RNA, 65 nt, hsa
cccaacccccugcccgccucuccgcacaauacuugaacauucaucuguacugaaguguuacuuga

SEQ ID NO: 345138 - RNA, 65 nt, hsa
ggacacagaugaccgaccuggucacuccuccugccaacauucagucugguaugugaggcgugcgu

SEQ ID NO: 345139 - RNA, 65 nt, hsa
cgggagaaacacaaaauaguauaacugaaaacauuaacauucagacacacucccuucugccuucc

SEQ ID NO: 345140 - RNA, 65 nt, hsa
cuggaguaaucagguggaaauccauagacaaaugaaacauucagauguacugucuuuuuuuuugu

SEQ ID NO: 345141 - RNA, 65 nt, hsa
uggucuuauauuuuggcugucuguuuuucccuaggaacauucauacagguugaauauuccuuauc

SEQ ID NO: 345142 - RNA, 65 nt, hsa
uggucuuauauuuuggcugucuuuuuuucccuaggaacauucauacagguugaauauuccuuauc

SEQ ID NO: 345143 - RNA, 65 nt, hsa
ccgugcuggacaucagaaaugcagugguaagugaaaacauucauucacugacucagcaaauacuu

SEQ ID NO: 345144 - RNA, 65 nt, hsa
cacaccgaugagaugcucuggcagguucuggagagaacauucaugagagacacaguaggucucug

SEQ ID NO: 345145 - RNA, 65 nt, hsa
auggcugcagugacccagauauugcacuaggucaaaacauucagguauagcugacaucuccucua

SEQ ID NO: 345146 - RNA, 65 nt, hsa
ugaugggugggcuaguaauaaaauauuuaaaaaaaaacauucaaaaacauggccacauccaacau

SEQ ID NO: 345147 - RNA, 65 nt, hsa
aaauaguagaggucagugaaggucugggguagggaaacauucagacuguccauugcauggcugug

SEQ ID NO: 345148 - RNA, 65 nt, hsa
uguggaauuuccuaucuugcagcauccuguaaauaaacauucaaguccacccuuuucuugacuuc

SEQ ID NO: 345149 - RNA, 65 nt, hsa
ucacuuuaaacuuuauaaaucaaagagauauuaggaacauucagaauuauuuguguuuuguuuuu

SEQ ID NO: 345150 - RNA, 65 nt, hsa
uguggcuuaguaaacuacucuguggaugauuuccaaacauucaaagccaauagccuuguuauuaa

SEQ ID NO: 345151 - RNA, 65 nt, hsa
uguuucaauuuuguuuugugcauucuaugugucagaacauucagaagaagucugaagaagugcaa

SEQ ID NO: 345152 - RNA, 65 nt, hsa
uaugcagucgcaauaacaugucugcucccgagguuaacauucaagcguuucuacuuugaaauuca

SEQ ID NO: 345153 - RNA, 65 nt, hsa
uguaggugacuuuuaaaugauuauacaauggaaauaacauucauugacauuucugugguuugaau

SEQ ID NO: 345154 - RNA, 65 nt, hsa
cucaagucaccagagagaauggaagcucaucacccaacauucagcuucuaagaaguaggcuggac

SEQ ID NO: 345155 - RNA, 65 nt, hsa
gcuccaguauuaaugaaauagguuccagugaugaaaacauucaagcagaacuagguagaaacaga

SEQ ID NO: 345156 - RNA, 65 nt, hsa
auguaagaaaaaucugcuagaggaaaacuuugaggaacauucaaugucaccugaaagagaaaugg

SEQ ID NO: 345157 - RNA, 65 nt, hsa
cuuuuuaaaauggagaaucgcauguuuucaaugaaaacauucacuugguauuucauuuguaagaa

SEQ ID NO: 345158 - RNA, 65 nt, hsa
cuuuuacuucaguuaacaaaagaaaacauuuaauaaacauucaauaaugauuacaguuuucauuu

SEQ ID NO: 345159 - RNA, 65 nt, hsa
ucccacaggaagacccuuaaaaugaagaaccuccuaacauucaauuuuagguccuacuacauugu

SEQ ID NO: 345160 - RNA, 65 nt, hsa
uucuuccccuuaagcuuugugccccuggaugcgcuaacauucacucuuguuugucccuggacugg

SEQ ID NO: 345161 - RNA, 65 nt, hsa
gggugucauaugcuuuccuaaccugauuuguaguuaacauucacagagccuacauuuucucauua

SEQ ID NO: 345162 - RNA, 65 nt, hsa
gagguggacuggggagacagccuuggugcagcaagaacauucaacucaggaagcauuugacucgu

SEQ ID NO: 345163 - RNA, 65 nt, hsa
cuuacauuaaaguccaauaugagaaauacauguuuaacauucaauaauaauuuuaaaaauuugag

SEQ ID NO: 345164 - RNA, 65 nt, hsa
agugaauguguuagaauugcagugucauaccaaauaacauucaaaagaaaugagccauuaaguga

SEQ ID NO: 345165 - RNA, 65 nt, hsa
ggaggguuacuuggggccaguaaaucaguagacugaacauucaauauaauaaaagaacaugggga

SEQ ID NO: 345166 - RNA, 65 nt, hsa
uacuaacauuuuaaaaauauaaauacuuuagcaaaaacauucacucuugaguuugacauaggccu

SEQ ID NO: 345167 - RNA, 65 nt, hsa
uccaggagaacuuccccaaucuagcaaggcaggccaacauucagauucaggaaauacagagaacg

SEQ ID NO: 345168 - RNA, 65 nt, hsa
ccucuaacccguccugaauucuuacuaaacauaagaacauucauacugaagaggaacccuaugag

SEQ ID NO: 345169 - RNA, 65 nt, hsa
gagccuccuacccaugacaacaccccaauaaacagaacauucagagccaaugucguagagcuuuu

SEQ ID NO: 345170 - RNA, 65 nt, hsa
auacucacguuuaagucaguaaggauacacauguuaacauucaggcuuuugucuugaugcccguc

SEQ ID NO: 345171 - RNA, 65 nt, hsa
aacaagucacccacacguaguggcuuaaagcaacgaacauucacucucucacagucugugucagu

SEQ ID NO: 345172 - RNA, 65 nt, hsa
uuccucaaugcacucugcuucuuccguucuuccgaaacauucagcugacuguauccagggcuucc

SEQ ID NO: 345173 - RNA, 65 nt, hsa
cuaagggguaucucugcuacaggaaugggagugagaacauucacuuuuugaaggacaaguauaug

SEQ ID NO: 345174 - RNA, 65 nt, hsa
ucccaucucaaaccuacacuuuggacacuuguuuaaacauucacaucugaauuucucuguggcaa

SEQ ID NO: 345175 - RNA, 65 nt, hsa
guguagcucagagcacuugugucugcauuccagauaacauucaggaccugugugaaaagcugggg

SEQ ID NO: 345176 - RNA, 65 nt, hsa
uggcaagccuuuuagcuguuccucaauccuuacuaaacauucauguaauucauacuggagggaau

SEQ ID NO: 345177 - RNA, 65 nt, hsa
ccaggccugggggcacagauccccccagcaaggauaacauucaaaggagcucacauuuauggaau

SEQ ID NO: 345178 - RNA, 65 nt, hsa
uuaaaaauuaaaauguaauguugcugcccaacuucaacauucauaauggccaggagaccacacaa

SEQ ID NO: 345179 - RNA, 65 nt, hsa
uuaguccccaguagaaaaauacucucuguaugaagaacauucaaaagugugcucaaaaaugaaac

SEQ ID NO: 345180 - RNA, 65 nt, hsa
caggagaguugguaagaggauugggaaaauucuagaacauucauuccccuuuaugcaugagcagg

SEQ ID NO: 345181 - RNA, 65 nt, hsa
gugugcuaggaaauaaugcagaaaaaacuuaugaaaacauucaauguagaagacuuuuaggaaaa

SEQ ID NO: 345182 - RNA, 65 nt, hsa
aaaaacacugagagugggaaaccauuaugacuucaaacauucaucaacaucagagaauccauacu

SEQ ID NO: 345183 - RNA, 65 nt, hsa
cguuggagugcagugaugugaucucgguucacugcaacauucaccucccagguucaugcaauucu

SEQ ID NO: 345184 - RNA, 65 nt, hsa
aggccuuucacuagccccaccuuguuaacaacuugaacauucaucaaagugugguaaaaaaaaaa

SEQ ID NO: 345185 - RNA, 65 nt, hsa
ugcacuuuccuaguucuuaagcauuugcguauguaaacauucauauuugcaauaaaaaagugagc

SEQ ID NO: 345186 - RNA, 65 nt, hsa
cuaugaucuuaucuaggguuuuccuacccauccccaacauucagcucagcugccucuuucuugag

SEQ ID NO: 345187 - RNA, 65 nt, hsa
uaaccaaauaaacaagucauccacaaucaaaauacaacauucaauacuuccaggugugucagacu

SEQ ID NO: 345188 - RNA, 65 nt, hsa
agucuucuauuuacaaacuucaaaaaacacaaaacaacauucauguuuuaaaugcuuucuacuug

SEQ ID NO: 345189 - RNA, 65 nt, hsa
aagaauuuguguuuaauuuuuugauaccaacacugaacauucaucagggaacuuuccugaaguuc

SEQ ID NO: 345190 - RNA, 65 nt, hsa
gcaagcaaaugaaauuaagccacuuugggauaaugaacauucaguauaauucuacuuugucucau

SEQ ID NO: 345191 - RNA, 65 nt, hsa
guuccguaagugccugaaaaacaaacacaaguuucaacauucaaucuaaguuacaaauagcacuu

SEQ ID NO: 345192 - RNA, 65 nt, hsa
cagggcaauguuucaaaguuuagucacagcuuaaaaacauucagugugacuuuaauauuauaaaa

SEQ ID NO: 345193 - RNA, 65 nt, hsa
uuuaucauugcuauuuauuuuuaccuuuguuuuugaacauucaauccguucauuuuguauguaug

SEQ ID NO: 345194 - RNA, 65 nt, hsa
caccuggcuucugcacacuccugcgaaagucggugaacauucacuccacauugaccccucccuag

SEQ ID NO: 345195 - RNA, 65 nt, hsa
aaaauuuuaacuggaauugucugauauuuaagagaaacauucaggaccucaucauuauguggggg

SEQ ID NO: 345196 - RNA, 65 nt, hsa
cagugccaucauccccaccccgcccaggguuccggaacauucauucccccaccggugaggaccug

SEQ ID NO: 345197 - RNA, 65 nt, hsa
agugugagugaggaaaacauguucagugaggaaaaaacauucagacaaauguucagugaggaaaa

SEQ ID NO: 345198 - RNA, 65 nt, hsa
aacauccugaagcugaucccauccugcuaccaucaaacauucacucggaaucaaaggugccaauu

SEQ ID NO: 345199 - RNA, 65 nt, hsa
uuagcauuguucuuucagucagacaugauaugcgcaacauucagacaugauaugcgcaucauuca

SEQ ID NO: 345200 - RNA, 50 nt, hsa
ccagccaagcaacccccuaaaacauucauaucuaggcaguauuuugcuuu

SEQ ID NO: 345201 - RNA, 65 nt, hsa
cucugugcaggggugggggcgggucuaacugucuuaacauucaagucacugcucuucagaauaca

SEQ ID NO: 345202 - RNA, 65 nt, hsa
ucuacugcuggacuuuucagagucuuucauaugcuaacauucauugugaaucucccaagaggcca

SEQ ID NO: 345203 - RNA, 65 nt, hsa
guugaaauaauagauuaguuggguuuucacaugcaaacauucaaaaugaauacaaaauuaaaauu

SEQ ID NO: 345204 - RNA, 65 nt, hsa
acaacuuaaacuuacuacuuuaggagaaaaaaaaaaacauucaauuucggacacugaguuauaua

SEQ ID NO: 345205 - RNA, 65 nt, hsa
uuuaaaacuucaagcucaguaauuuugaacacugaaacauucaucuaggacauaauaacaaaguu

SEQ ID NO: 345206 - RNA, 65 nt, hsa
uggaaagcaaacaugcuuccugcuauguaauugcuaacauucauauuagaugaugugcuguagcu

SEQ ID NO: 345207 - RNA, 65 nt, hsa
acaguagucuauaguuaggauuaaaauaggaucugaacauucaaaagaaagcuuuggaaaaaaag

SEQ ID NO: 345208 - RNA, 65 nt, hsa
caauguuccuucuaauggaugguguaaugaacuucaacauucauuuuauguaugacaguagacag

SEQ ID NO: 345209 - RNA, 65 nt, hsa
gacugccuucauaagcguccauaggauaucugaggaacauucaucaaaaauaagccauagacaug

SEQ ID NO: 345210 - RNA, 65 nt, hsa
guguugugauucuguauaggauuuuuaaaaaugacaacauucacaaaauuuauuacuuuuuaaaa

SEQ ID NO: 345211 - RNA, 65 nt, hsa
gcugggcuggauuaagcuuuguugugauugugaccaacauucaggccacgugagcacugucuuau

SEQ ID NO: 345212 - RNA, 65 nt, hsa
caaacagguacggcauucugggccccggccccuaaaacauucauuaagucuggggugaagauuug

SEQ ID NO: 345213 - RNA, 65 nt, hsa
gcuaccaguguaugcaguaauuagaacaaagaagaaacauucaguagaacauuuuauugccuagu

SEQ ID NO: 345214 - RNA, 65 nt, hsa
guccauuguuugaggauguuaccuacuaaacugaaaacauucauuccauaucuacuuacacauac

SEQ ID NO: 345215 - RNA, 65 nt, hsa
ugggcuggacaguugcuugaaaugaccuaaccaaaaacauucaaggguucugcccccagauuucg

SEQ ID NO: 345216 - RNA, 65 nt, hsa
gggagugguacaaaauggucugaugcuccuucaaaaacauucacuuuuuacaacgucaaggaauu

SEQ ID NO: 345217 - RNA, 65 nt, hsa
acuauuuuuggagcuuaagauuuguuagagcuguuaacauucaaccuuauugauuauauugagag

SEQ ID NO: 345218 - RNA, 64 nt, hsa
gagccguuuggccagggucuccaauuuaggcuuucaacauuaucucuaaagaagguuauacauu

SEQ ID NO: 345219 - RNA, 64 nt, hsa
auggaugauaugcugcuucuguuuaacagugaugcaacauuauguggcugaaaaagaauauaaa

SEQ ID NO: 345220 - RNA, 64 nt, hsa
auugucagucugacauuuaaugucuuucuauggacaacauuaaaucucccucccuucuguaauu

SEQ ID NO: 345221 - RNA, 64 nt, hsa
cuuuuacauuuucccaacuagauggccuagaguccaacauuaccuuuugagaugacauuauugu

SEQ ID NO: 345222 - RNA, 64 nt, hsa
aaaacaacugauauaauuacucaagaaauauuugcaacauuaguuuuuuuccagcaucagcaau

SEQ ID NO: 345223 - RNA, 64 nt, hsa
augguagaaguaaaaaaaaaaaaaaaggacauagcaacauuaaaguaguggauuuuucugagua

SEQ ID NO: 345224 - RNA, 64 nt, hsa
uucaucauccaaguuuguaguucauuuaaaaauacaacauuaaacacauuuugcuaggauguca

SEQ ID NO: 345225 - RNA, 64 nt, hsa
gcaguuaccaucaaaggcagcauauuuccaauuccaacauuacuguuucuaccaagucccauua

SEQ ID NO: 345226 - RNA, 64 nt, hsa
cuguauucgugggauugguguaggguuaaaucaucaacauuauuucauaaaauaagaauuuguu

SEQ ID NO: 345227 - RNA, 64 nt, hsa
uuuguuuccuggcuuuaccuugggaaaaugcuagcaacauuauagaaauuuugccuuguugccu

SEQ ID NO: 345228 - RNA, 64 nt, hsa
ucugggauuacaagugugagucacugcgacuggccaacauuaugugauuuaugugugaacuaua

SEQ ID NO: 345229 - RNA, 64 nt, hsa
cuuugagcacaaaauuuccacggugaaauaaagucaacauuauaagcuuuaucuuuugaaacug

SEQ ID NO: 345230 - RNA, 64 nt, hsa
guuaauggaagaauucaccaauuuuaaaguuuugcaacauuaaauaagugacuugguguuagaa

SEQ ID NO: 345231 - RNA, 64 nt, hsa
uagauggcuugauauaccaaauaacaauauagaacaacauuauuauaugugcuuccccaaguuu

SEQ ID NO: 345232 - RNA, 64 nt, hsa
ccagugguaguaacuguguaaaguuucuaauucacaacauuaauuccuuuaaaauacacagccu

SEQ ID NO: 345233 - RNA, 64 nt, hsa
acuauucacuaaaauuaaucuggaauuuaaggcccaacauuaaacacaaagcuguugaaauauu

SEQ ID NO: 345234 - RNA, 64 nt, hsa
uaauuauguuaaugucauuagugacaaagauuugcaacauuagagaaaagagacacaaauauaa

SEQ ID NO: 345235 - RNA, 64 nt, hsa
gccaagagccagcuucugcguucucaacuuuauucaacauuagacuuaccuuauuucuuucagu

SEQ ID NO: 345236 - RNA, 64 nt, hsa
gauacacaugcuuuuuucccacccaaaauugugacaacauuaugugaauguuuuauuauuuuuu

SEQ ID NO: 345237 - RNA, 64 nt, hsa
acaaugcuugacuacaaaacagagcugucuucagcaacauuauuaguagacaaagaggaugugg

SEQ ID NO: 345238 - RNA, 64 nt, hsa
cagguugcaguagcaguggauguuagccugcaaacaacauuaggggauucuucuuuuguguccu

SEQ ID NO: 345239 - RNA, 64 nt, hsa
uuguuguguaagacaaugauaacuauuauuugugcaacauuacucuuugaaauaaaaauuggca

SEQ ID NO: 345240 - RNA, 64 nt, hsa
aguggcauuacauugagcgugaccuugcaauguucaacauuaacauugaugaugacuacguccc

SEQ ID NO: 345241 - RNA, 64 nt, hsa
ugccagcuauauaaggaauaaaguugauucauaucaacauuagaacuccagucccaaacuaauc

SEQ ID NO: 345242 - RNA, 64 nt, hsa
cugcauuucaguuguauuauaguccaguucuuaucaacauuaaaaccuauagcaaucauuucaa

SEQ ID NO: 345243 - RNA, 64 nt, hsa
cuacuauccauaaaugcaauaauaugcauguuaacaacauuaaaaacagcaaacagcaaucuaa

SEQ ID NO: 345244 - RNA, 64 nt, hsa
cagcaagaacaguccauguuguauauaauacaaccaacauuauagaacuuuuaggguugugacu

SEQ ID NO: 345245 - RNA, 64 nt, hsa
caugaacguuauuauauugucgaauuccuacugacaacauuauaacuguaugggagcuuaacuu

SEQ ID NO: 345246 - RNA, 64 nt, hsa
ugaguugacuucugacaaaggugguaaauucagacaacauuaugaucuaauaaacuuuauuuuu

SEQ ID NO: 345247 - RNA, 64 nt, hsa
uguauaaggcagguuuuauacaaccauuuagauucaacauuaaugguagaguggcauuuuacca

SEQ ID NO: 345248 - RNA, 64 nt, hsa
aaauuguaccaaugaauacguaaacauacagugacaacauuaaacuuagaaaaguuuuaaaacu

SEQ ID NO: 345249 - RNA, 64 nt, hsa
uauuuuuucuuuucuaugcaagauaagagauuaccaacauuacuugucuugaucuacccauauu

SEQ ID NO: 345250 - RNA, 64 nt, hsa
uuuuucuucauccucaaaaggagacucuuuugcucaacauuaaauugugcuuccuaacccuaaa

SEQ ID NO: 345251 - RNA, 64 nt, hsa
ugugguuauguuaccuuuaucuuguugaggaccacaacauuagcacggugccuugugcagaaua

SEQ ID NO: 345252 - RNA, 64 nt, hsa
gaaaagaaagcuuuauuuuaacacucaucugaaucaacauuaaagccuuuucucucaaagcguu

SEQ ID NO: 345253 - RNA, 64 nt, hsa
gcaaaaacagaacuuccaaaguaucuuucugugacaacauuagguucaggcuugaagucccuga

SEQ ID NO: 345254 - RNA, 64 nt, hsa
caguuaacucuagaaagaaagaacacuaccacugcaacauuaauggaugcuugaagcuguacaa

SEQ ID NO: 345255 - RNA, 64 nt, hsa
agggucaacuguacuauaaauaauacgaauaugccaacauuauauaaucauugcuuucugcaac

SEQ ID NO: 345256 - RNA, 64 nt, hsa
uuuuacaauugaaaugacuaaaaaacaaagaagacaacauuaaaacaauauuguuucuaauugc

SEQ ID NO: 345257 - RNA, 64 nt, hsa
uuuaggugcucugaguugaggcaaaguagagcggcaacauuaagugcuaugcuagucacuuagc

SEQ ID NO: 345258 - RNA, 64 nt, hsa
augauuuccuuagcagaagccguauuuguacgcacaacauuaaaucaagggcuacaauucaagc

SEQ ID NO: 345259 - RNA, 64 nt, hsa
aucauauacgacugaaagaagaaaacuagauuuucaacauuacaggguugaaaugaaugaugag

SEQ ID NO: 345260 - RNA, 64 nt, hsa
guguuacauuuaauauuuaauguaacuggucuagcaacauuaagggggauuucugaagccaacu

SEQ ID NO: 345261 - RNA, 64 nt, hsa
auuaaaaaaaaauuuuaacugauaaaacuuagggcaacauuaauuaauguauauucuuaccuga

SEQ ID NO: 345262 - RNA, 64 nt, hsa
acccuauuuaagagacugaucacacacguauacacaacauuacugaaagaacccugcgaaucaa

SEQ ID NO: 345263 - RNA, 64 nt, hsa
auacacacaaaaacuuguacaccaauguucauagcaacauuauuuguaauagccaaaaagugga

SEQ ID NO: 345264 - RNA, 64 nt, hsa
augcaaauggcuacuaagcacaugaaaaaauacucaacauuauuauucauuagggaaaugcaag

SEQ ID NO: 345265 - RNA, 64 nt, hsa
cuggcuuagggaacagggagcgauggaagaaugccaacauuagcguuggucuucucuugucagg

SEQ ID NO: 345266 - RNA, 64 nt, hsa
aauaaaugaauagcuuauugcagacauuuuuuaccaacauuaauuauuuuggguuuguuuaaaa

SEQ ID NO: 345267 - RNA, 64 nt, hsa
accaucaugugauaaugguacuauggcauauaugcaacauuaaaauuuuaaauuagauauuuau

SEQ ID NO: 345268 - RNA, 64 nt, hsa
cauucuaagagucuaaaaauuucaaaaaccaaaacaacauuauaaaugguguuucucaaggacc

SEQ ID NO: 345269 - RNA, 64 nt, hsa
uuuaaaauuacuucagugcaauccuacacaguaucaacauuagaauuuugauauuagucuuaug

SEQ ID NO: 345270 - RNA, 64 nt, hsa
gauauagggauauucauaugacaagagauucaugcaacauuaaaaauacuaaaauacuugugug

SEQ ID NO: 345271 - RNA, 64 nt, hsa
ccucuguacaaaagccucaagugagggucaaauucaacauuauccugaucuagacagcccccau

SEQ ID NO: 345272 - RNA, 64 nt, hsa
aaggacuguguguaguaaugaaaauaccaaguugcaacauuacauguuuacaaaaaaaaaucug

SEQ ID NO: 345273 - RNA, 64 nt, hsa
cuuuuagauuuggaaauugcuguuuacagucuaacaacauuaaaaugagagguagauucacaag

SEQ ID NO: 345274 - RNA, 64 nt, hsa
ggcagccaaggauuauaaaccacuucccuaaaggcaacauuaaugcaaaaguccccagauggca

SEQ ID NO: 345275 - RNA, 64 nt, hsa
caaaaaacuucaacaugcauaugauauauaguuacaacauuaauuuuaugaacuggagagcuuu

SEQ ID NO: 345276 - RNA, 64 nt, hsa
gaauugagacccauguuaucuuugggauguauagcaacauuaaauuugguuuguuuugcuaugu

SEQ ID NO: 345277 - RNA, 64 nt, hsa
aagaagggguagggauuuggcuaugccuucacuacaacauuagaauauuguaacucacaugccu

SEQ ID NO: 345278 - RNA, 64 nt, hsa
uauacauggucaauaaguauauuuuuaaaaugcucaacauuaacuauucauacagaaaugcaaa

SEQ ID NO: 345279 - RNA, 64 nt, hsa
ugcaucaaaauaaauuuacuaaguacuaaagagccaacauuauuuuauaagugccuggcaauag

SEQ ID NO: 345280 - RNA, 64 nt, hsa
gagaucaaauauaaaauucaucauaaugucuguucaacauuaucuuauuuggaaaauggggaaa

SEQ ID NO: 345281 - RNA, 64 nt, hsa
uaaucagucugcacauccuguuucuaauaucuagcaacauuauauucuuucagacauuuauuuu

SEQ ID NO: 345282 - RNA, 64 nt, hsa
gaucaacacuuuucuccaggguucaccaugcaggcaacauuaccuugucuuucaaaagacaccu

SEQ ID NO: 345283 - RNA, 64 nt, hsa
acuugguuggcucccuuugucucuguaccuuuaccaacauuaggaucucaccucuuucuuccuc

SEQ ID NO: 345284 - RNA, 64 nt, hsa
aacacuaaagagcuaggaaagaguugagcacaggcaacauuacaaacaaaggauuugaaaacac

SEQ ID NO: 345285 - RNA, 64 nt, hsa
uguuuuaaaaaacuaaguguuuaggauuucaagacaacauuauacauggcucugaaauaucuga

SEQ ID NO: 345286 - RNA, 64 nt, hsa
uaagacuuuuauaagacuagcuuaaaacaccaaccaacauuauuuuugcaaaagugaguuggac

SEQ ID NO: 345287 - RNA, 64 nt, hsa
aaaaacaaaucuaacuuauuaauacuaggaauaccaacauuauuagggcacuugcagguuauuc

SEQ ID NO: 345288 - RNA, 64 nt, hsa
aguaauuagagguuuuuccauuucaugucuugaacaacauuaauauuaauuacacuagaaauau

SEQ ID NO: 345289 - RNA, 64 nt, hsa
gcuaaacacuguggaggcuaaaaaaagucaaagacaacauuauaacuaaaagucgaaagcacac

SEQ ID NO: 345290 - RNA, 64 nt, hsa
uuuuucauugaucuaugcuuugaguuugcuuucucaacauuauuguauuuuccacuuauuauua

SEQ ID NO: 345291 - RNA, 64 nt, hsa
uugcuuucugcuuccuucuggugaaguccaccuccaacauuaaccugcccaccccacccccguc

SEQ ID NO: 345292 - RNA, 64 nt, hsa
gagacuccgccucaaaaaaagaauacaaaugcuccaacauuauuuuuuauaacucuggauuacc

SEQ ID NO: 345293 - RNA, 64 nt, hsa
gugaguaaugacaggacuacaacuaaaacauaaacaacauuaaugaugaccauaaaaagucaca

SEQ ID NO: 345294 - RNA, 64 nt, hsa
cugacuggauuaaggaauaccuagacagcugguacaacauuauuucugggugugucugugagug

SEQ ID NO: 345295 - RNA, 64 nt, hsa
gucucauuuagcaaguauggaaguugaggcagggcaacauuaagcaacuuacauaacucaugca

SEQ ID NO: 345296 - RNA, 64 nt, hsa
aagacagacuaaaaagaguaauaaaucaauacaacaacauuaaaagccagacuagcggaguuug

SEQ ID NO: 345297 - RNA, 64 nt, hsa
uaaguuggguauuuuuuuaaaaaaagaaaaacagcaacauuaauaaaagaagugguguguuuuu

SEQ ID NO: 345298 - RNA, 64 nt, hsa
cuguauuguuaauuuugugccauauuuugaauugcaacauuaugcuaaguauaacuuugcaagu

SEQ ID NO: 345299 - RNA, 64 nt, hsa
guuuuucuaaauaaauguaacuuuucacaagagucaacauuaaaaaauaaauuauuuaagaaca

SEQ ID NO: 345300 - RNA, 64 nt, hsa
guucaguaucuuuuauguaaauuacaaacaucugcaacauuauguaucauaugcagauacuuau

SEQ ID NO: 345301 - RNA, 64 nt, hsa
cuucccucuuuuuuaaagucacauuuccauguuucaacauuaguuugcauucaccuuuacaaag

SEQ ID NO: 345302 - RNA, 64 nt, hsa
accaacuaugauuuaugguuguguuuucagaauucaacauuaaagauuaauguuuauuuaaacg

SEQ ID NO: 345303 - RNA, 64 nt, hsa
uucaucagaaugaaggggaaaaacagccaucauccaacauuauugagauugucguguauaguca

SEQ ID NO: 345304 - RNA, 64 nt, hsa
gagaaagaugaaaauaggaacaaauaaagacaaacaacauuaagggccauauuguaagauuucc

SEQ ID NO: 345305 - RNA, 64 nt, hsa
gggaagaccaaaauuacuaauaaauugacauaaccaacauuaaaacucauaauuauuuuguuga

SEQ ID NO: 345306 - RNA, 64 nt, hsa
ugcaugaaaguuuaauuagacauuucuuuguuuucaacauuagaagugguguaacauguaagcu

SEQ ID NO: 345307 - RNA, 64 nt, hsa
agauaaacuaaucaaauaaauuagaauaaugugacaacauuacaaauuuaauuuguuagcugca

SEQ ID NO: 345308 - RNA, 64 nt, hsa
uuggagaccuagacauucagcucacugcuuaacucaacauuaaauuuuaugauucuguuuugcc

SEQ ID NO: 345309 - RNA, 64 nt, hsa
aaaauauuauaaccacaggguauccagccaaauucaacauuacugcaagucuuagagauuuaaa

SEQ ID NO: 345310 - RNA, 64 nt, hsa
caaugacugaaagucaaugcugauaguuuacuggcaacauuaauugaagcaucaaaaauaaaug

SEQ ID NO: 345311 - RNA, 64 nt, hsa
auaugcauuuaaguggaauauuuggugccauuuacaacauuauuuucaugccaauaaaagauuu

SEQ ID NO: 345312 - RNA, 64 nt, hsa
uucagaucaaguauuguugaaagcuauacauauacaacauuacagucugucuguauuuagauau

SEQ ID NO: 345313 - RNA, 64 nt, hsa
auauguuacuaaaacaggcuccaccucaguuuaucaacauuauaaguuacuguucuaagaaaag

SEQ ID NO: 345314 - RNA, 64 nt, hsa
uuuauagauaugagaaacauaauguucuaaccaacaacauuaugguauuugugugacuuuuauu

SEQ ID NO: 345315 - RNA, 64 nt, hsa
uggaaaagccauuauuaucugcucagauuuuacucaacauuagagaguuaguacguaauaaaag

SEQ ID NO: 345316 - RNA, 64 nt, hsa
acaguuggcuauucaucaucuucggcacuuaugacaacauuaacacagaaugccaguucaucag

SEQ ID NO: 345317 - RNA, 64 nt, hsa
acauuguuuucaaccagaaauuaaaguagauauccaacauuauuuucagugcuuguacuucaug

SEQ ID NO: 345318 - RNA, 64 nt, hsa
uguuuuuuuccccuagacaauaucagguuaccgucaacauuaauccauuuaaaaggacauggac

SEQ ID NO: 345319 - RNA, 64 nt, hsa
auccaaaugugacuuugaaaauuguuagagaaaacaacauuagaaaauggcgcaaaaucguuag

SEQ ID NO: 345320 - RNA, 64 nt, hsa
guuucuauuuuagaugaguguuuccuaauacaagcaacauuaacaucuucagaaaaggaagcag

SEQ ID NO: 345321 - RNA, 64 nt, hsa
ucaguuuuguucuuacccaauuguuuuuucuuuucaacauuaccaauuuacagauucaguuuau

SEQ ID NO: 345322 - RNA, 64 nt, hsa
auucauaccuucugaugaaguuguacaacaccagcaacauuauaauggcccuguagcucugaau

SEQ ID NO: 345323 - RNA, 64 nt, hsa
auauuuuacaaaugcuagauauuggucugggaggcaacauuaaugguaccagccugucacaacu

SEQ ID NO: 345324 - RNA, 64 nt, hsa
acauuuaacuaugguauuuauggaagacagguaacaacauuaaaucuaguugcuuucccuuagu

SEQ ID NO: 345325 - RNA, 64 nt, hsa
uuuuaacaucuuauuuuuuucauuaauuacauaucaacauuaauuuuguaucuugaagcaaauu

SEQ ID NO: 345326 - RNA, 64 nt, hsa
ccagcugaccuucaaacccugcauuugaaccgaccaacauuaaguccagagaguaaacuugaau

SEQ ID NO: 345327 - RNA, 64 nt, hsa
gucaacucuuuuaauuuauauacaaagcaaagaacaacauuaauggagaugcacaaugauuauu

SEQ ID NO: 345328 - RNA, 64 nt, hsa
cucuaauuugaacugguauuguuuacguuugauacaacauuaaggaauuugaugauuuucauuu

SEQ ID NO: 345329 - RNA, 64 nt, hsa
agcugcaaccuuucuguuuuauuuaaagaaagcccaacauuaaaggguuuucauugcaagcgug

SEQ ID NO: 345330 - RNA, 64 nt, hsa
gguuauagugggaauauaaauaaagugagggauccaacauuacuuuaaaagucaccccaacugu

SEQ ID NO: 345331 - RNA, 64 nt, hsa
aauaauaauaauggcaaacuuaacaccccacugucaacauuagacacaccaacgagacagaaag

SEQ ID NO: 345332 - RNA, 64 nt, hsa
augugguuucuaugcaaaguucuucauaucaucacaacauuauuugauuuaaauaaaauugaaa

SEQ ID NO: 345333 - RNA, 64 nt, hsa
aagaauaacagaaugcaucguggcaauccuuaagcaacauuaucuauguggacugcuuaaauca

SEQ ID NO: 345334 - RNA, 64 nt, hsa
caaugcaguauucucaauuguguuacugaaaaugcaacauuagcaaagagguggguucuguuuu

SEQ ID NO: 345335 - RNA, 64 nt, hsa
uguucaugaagacuuaagaaaaaugucacuacugcaacauuaggaauguccugcacuuaauaga

SEQ ID NO: 345336 - RNA, 64 nt, hsa
agccccccaaaaauuaucuagccguuucgaauaucaacauuacccugguguauucacugcugua

SEQ ID NO: 345337 - RNA, 64 nt, hsa
gggaauuuucauaauaguucauacauuugucagccaacauuaaaagguaaccaacuccucaggu

SEQ ID NO: 345338 - RNA, 64 nt, hsa
gaggaucagagaugggaaaggacuagcccaaggccaacauuaacaagcccucuaacaaaaacuu

SEQ ID NO: 345339 - RNA, 64 nt, hsa
cuguuugaauuaagaugggcuaagauggggcuugcaacauuaaacaugagcugagcauccauaa

SEQ ID NO: 345340 - RNA, 64 nt, hsa
cuggccaagagagaagacuggacggcagggaggucaacauuaacgaguggggggaucacaaagc

SEQ ID NO: 345341 - RNA, 64 nt, hsa
auauuguuucaguguucaaauaaacugaaggacucaacauuacauuugaacuauauccuuccua

SEQ ID NO: 345342 - RNA, 64 nt, hsa
cuuaacuccuuaguauuucauagaaaaaugacugcaacauuaaagcuaagaggaacacuucaac

SEQ ID NO: 345343 - RNA, 64 nt, hsa
uaugggauaggaacugucaguguuuuugcaacugcaacauuaaaccaagugcugugggcuuuuc

SEQ ID NO: 345344 - RNA, 64 nt, hsa
cuugcguggaaugaaaacgccaaaggcucaugagcaacauuaggcuagaggggucuuguucaaa

SEQ ID NO: 345345 - RNA, 64 nt, hsa
aaauugguguuucugaaugacaucaacauucccccaacauuacuccauuacuaaagacagaaaa

SEQ ID NO: 345346 - RNA, 64 nt, hsa
auauaccagaguacuguaaaaucuagguuuuuuucaacauuagcaguaaauugagcacuguuua

SEQ ID NO: 345347 - RNA, 64 nt, hsa
gccuguuggaauuaauuuaagcuuaaguauauaucaacauuauuuuauugugcaauuaaaacaa

SEQ ID NO: 345348 - RNA, 64 nt, hsa
aagagguggacuuuacagauaauggagcagaagccaacauuaguaaaaggaaucccaacuucuu

SEQ ID NO: 345349 - RNA, 64 nt, hsa
gaaugaagccaauaggaaauaaaaaacaggcacacaacauuauuuggggaaaaacaccucuagu

SEQ ID NO: 345350 - RNA, 64 nt, hsa
augcuauaauuauaguaucccacauucgguugagcaacauuauacaaaauaagugucgaguuac

SEQ ID NO: 345351 - RNA, 64 nt, hsa
aguaggcacucuuuaauccauuaccuggcacuagcaacauuagaauuuuaaaauaaaauaauug

SEQ ID NO: 345352 - RNA, 64 nt, hsa
cuagguugaaagauaggcagccuuacccagaacacaacauuagcagcugggaaggugucugagg

SEQ ID NO: 345353 - RNA, 64 nt, hsa
gaugucauugagacuauauuuauauuugacuuggcaacauuaacauguccuaagacuuagugca

SEQ ID NO: 345354 - RNA, 64 nt, hsa
auaaauaaggaucacacuguauuagggguuauggcaacauuauugaauuuuuuauguacauaaa

SEQ ID NO: 345355 - RNA, 64 nt, hsa
ccgaggucugcgagggcuucgacgaggagggccgcaacauuagcaagacccgcggguggcacag

SEQ ID NO: 345356 - RNA, 64 nt, hsa
aggaacagauugggugucaguucaggauaaauaccaacauuaacagcagaaugaugcaaugaaa

SEQ ID NO: 345357 - RNA, 64 nt, hsa
agugcauuucuauaauauaaauguugauuugcgucaacauuauaaaagagcacuucuguggcuc

SEQ ID NO: 345358 - RNA, 64 nt, hsa
aucaugcagccuauccaauaaguaaguuuauuuccaacauuagcucuaauuaguucauuuccaa

SEQ ID NO: 345359 - RNA, 64 nt, hsa
cccuccauuuguguuuauugcauauccacuauaacaacauuaaaggaccuuuaaaaggaaguaa

SEQ ID NO: 345360 - RNA, 64 nt, hsa
gagcagcggggcaguguggggcuuugugucaucacaacauuaaaguauuuuauucuacucuguc

SEQ ID NO: 345361 - RNA, 64 nt, hsa
uauccuuuaaacuaaauuuugccaaagcccgagacaacauuaaggagaaauuguaccuuaaguu

SEQ ID NO: 345362 - RNA, 64 nt, hsa
ugcuagcuaaaagacaaauuuaaggggagcucuucaacauuaaggcaguaugauaucaugcuug

SEQ ID NO: 345363 - RNA, 64 nt, hsa
aguccccacaacaaagaaucauccugucccaugucaacauuauacccauggagaaacacuggca

SEQ ID NO: 345364 - RNA, 64 nt, hsa
aucccugauccuucaaggucagucagacaguuggcaacauuauaauuaaaaauaagaaauuaag

SEQ ID NO: 345365 - RNA, 64 nt, hsa
uuucuuggggcagagaagguggagaguaaagacccaacauuacuaacaaugauacaguugcaug

SEQ ID NO: 345366 - RNA, 64 nt, hsa
cuucaaagaaauugagccagcacuaucuguacuccaacauuaccggaucuggauuggggagguu

SEQ ID NO: 345367 - RNA, 64 nt, hsa
aaucaccaaaggagcuauggagagaauuaaaacucaacauuacuguuaacugugcguuaaauaa

SEQ ID NO: 345368 - RNA, 64 nt, hsa
aggacaguugcaaaaggcuucaaggaauuuaucucaacauuauucuuucuauguccuaacuaaa

SEQ ID NO: 345369 - RNA, 64 nt, hsa
cucagauaagaagaaaucaucucuacaauguagacaacauuauauuuuauagaauuuguuugaa

SEQ ID NO: 345370 - RNA, 64 nt, hsa
ggaucccaggagacaacagucuccacagugagagcaacauuaagggcaaagccauggagaaaug

SEQ ID NO: 345371 - RNA, 64 nt, hsa
acuaaugauacacagauagauaaagcaagucuaucaacauuaaaaauacuaaaaaauaaagaca

SEQ ID NO: 345372 - RNA, 64 nt, hsa
uaaacuuaaaaggagauuuugaacuuaacuuacacaacauuaaauccuugcacaaucaaauuaa

SEQ ID NO: 345373 - RNA, 64 nt, hsa
uguuucaguuacaacuguaauguuauuuauagaacaacauuaauccauuaaagcuaaccuauuu

SEQ ID NO: 345374 - RNA, 64 nt, hsa
uucugcuccugcuucucucucuucauuccccuaucaacauuaccgccccugucucucuucugua

SEQ ID NO: 345375 - RNA, 64 nt, hsa
aauuaaccuuguugaaucucagauuccccauuugcaacauuagguuaagaccaguacugcagga

SEQ ID NO: 345376 - RNA, 64 nt, hsa
ucugggaaauuguuauagcuuaaauggaacucaccaacauuauucauaguuuaagucuuuuauc

SEQ ID NO: 345377 - RNA, 64 nt, hsa
ccuguucagucaacaaguauuuuaacucucaguccaacauuauuugaauugagcaccucaagca

SEQ ID NO: 345378 - RNA, 64 nt, hsa
cucauucuuggccucgcagaaaacucucggauggcaacauuaaguccuaccucuguucucgcug

SEQ ID NO: 345379 - RNA, 64 nt, hsa
gucuuguuauguacaaacuaguuuuuauagcuaucaacauuaggaguaacuuucaaccuugcca

SEQ ID NO: 345380 - RNA, 64 nt, hsa
ugcugcuucaaaaaguacuuacuuuuuaaaccaucaacauuacuuuucuuucuuaaggcaaggc

SEQ ID NO: 345381 - RNA, 64 nt, hsa
uaaguaugagauacuugaugggggcuuuaucaugcaacauuaguuugcuuaccuuaagaauugc

SEQ ID NO: 345382 - RNA, 64 nt, hsa
guggaggaaaggaggaaaaagugcuuauuaugugcaacauuaugauuaaucugauuauacacca

SEQ ID NO: 345383 - RNA, 64 nt, hsa
cucuaauucuuuuccagugugccaacuccaaagucaacauuaaaaauguaaauggaccugugua

SEQ ID NO: 345384 - RNA, 64 nt, hsa
cacuuacaguuaggauuugugguaagguaccucucaacauuaccaaaaucauuucuuuagaggg

SEQ ID NO: 345385 - RNA, 64 nt, hsa
aaaagaaggaaaaggagguaaaaggugaaaggaacaacauuaauuaacaauuuuacgucauguc

SEQ ID NO: 345386 - RNA, 64 nt, hsa
uucuggaagugugaaaauguuaauguucaacaagcaacauuaaaaauagauuugaaacauuuau

SEQ ID NO: 345387 - RNA, 64 nt, hsa
uauauguacauucuaaugugugucucuucuuauucaacauuaauccuuacuagaaccacaagaa

SEQ ID NO: 345388 - RNA, 64 nt, hsa
cuauaacuauaaaucucuagaauucugugaauuucaacauuauuugaaguaguucuucaguuau

SEQ ID NO: 345389 - RNA, 64 nt, hsa
uggaauaauuccaacuuaacaaaaacaaugacaacaacauuacuaaccuguggagucacacguu

SEQ ID NO: 345390 - RNA, 64 nt, hsa
uuuuacugggggagugggaaagugauucuguaaccaacauuagaauuacuuuggauuuguaauc

SEQ ID NO: 345391 - RNA, 64 nt, hsa
cacuugguuagcagauguuuaauuuuuuuuuuaacaacauuaacuuguggccucuuucuacacc

SEQ ID NO: 345392 - RNA, 64 nt, hsa
uaacauguaaacaaaaguguuaaauucacauauacaacauuauacaauuuaaucacucuuggaa

SEQ ID NO: 345393 - RNA, 64 nt, hsa
accuuuaaaaaauaauuuagauauucauacuuuccaacauuauccugugugauuacagcauagg

SEQ ID NO: 345394 - RNA, 64 nt, hsa
uaaauauaugaguauuugaguuuuuaaaucacuucaacauuauuugagcauuuacuuuguauuu

SEQ ID NO: 345395 - RNA, 64 nt, hsa
uaaauuaggcacaguaagagauuaacaauaauaacaacauuaaguaaaaugaguuacuugaaug

SEQ ID NO: 345396 - RNA, 64 nt, hsa
uggagaucaguagugucaucuucauaaagcaagacaacauuaugacacuuuaaaacaguagcaa

SEQ ID NO: 345397 - RNA, 64 nt, hsa
uuccuugcugucacagaugauagguucauguacacaacauuaauguuugauaaggaaagcauuu

SEQ ID NO: 345398 - RNA, 64 nt, hsa
augacucagaccauaagcuuuucaugccagaugucaacauuaagcugcaacauccuaaccacca

SEQ ID NO: 345399 - RNA, 64 nt, hsa
guggagacuaucagcccaagaugcuuuaagugcacaacauuacagggaaugccugagugccugg

SEQ ID NO: 345400 - RNA, 64 nt, hsa
ggguugucagugauuugugaacugagagcagcaacaacauuauuuuuuaaaaaucuuaaauccu

SEQ ID NO: 345401 - RNA, 64 nt, hsa
aguuuauaauucccaccuuucacauauaguucaacaacauuaauccagagagaauuuuauguuu

SEQ ID NO: 345402 - RNA, 64 nt, hsa
augguaacuacauagauguuauaagaacauaaaccaacauuauaaacaauggccacauuuaguu

SEQ ID NO: 345403 - RNA, 64 nt, hsa
ucacuugggagagauggcaaacacaguggcaagacaacauuacccaacuauagaagagaggcua

SEQ ID NO: 345404 - RNA, 64 nt, hsa
uuggcagauaugaggauggucaggugggcgaugccaacauuaauacucaggaccccaagauaca

SEQ ID NO: 345405 - RNA, 64 nt, hsa
gaaguauagggauguauuuaauuuuacuaugcuccaacauuaaucaugacucuuuuguaaauua

SEQ ID NO: 345406 - RNA, 64 nt, hsa
gaacuuccagggauuuuauugugaacuuacauagcaacauuaaaaugaaguugaauuguuuuua

SEQ ID NO: 345407 - RNA, 64 nt, hsa
gccccuuccuucuguuccccagaucuaugaacuacaacauuaugaagacauucuuuuguaccuu

SEQ ID NO: 345408 - RNA, 64 nt, hsa
uauuuacuuucgguucugcucauacuuuuuuguacaacauuaaagaaaauggacuuuuuuuauu

SEQ ID NO: 345409 - RNA, 64 nt, hsa
aaccaugaccugcuccuccauuuccauuuauucucaacauuaaauaguuuuaucuuguuguugc

SEQ ID NO: 345410 - RNA, 64 nt, hsa
aaaagcaguggcuccauugguguugacauacauccaacauuaaaagccacccccaaaugcccaa

SEQ ID NO: 345411 - RNA, 64 nt, hsa
cuagauguguacuuuugagggacaugagguuaggcaacauuacagcaacacacacuggggcuau

SEQ ID NO: 345412 - RNA, 64 nt, hsa
auuuucuacagcuugcugaguugucauuccuuugcaacauuaaaauacaugcugaacucauauu

SEQ ID NO: 345413 - RNA, 64 nt, hsa
aacugcuuaaugguugggguuuuuucacaauuuucaacauuagugauuuuuuuuucuguuugca

SEQ ID NO: 345414 - RNA, 64 nt, hsa
uuccccaccaucuuuaaaucaaaguuguuuaaaacaacauuaauuuuaaaaaauacauaaaagc

SEQ ID NO: 345415 - RNA, 64 nt, hsa
ugacugcuuaagucagccaguucagcauggauaccaacauuagcuuuucuucuugguuauauca

SEQ ID NO: 345416 - RNA, 64 nt, hsa
cgaguuacagacaaacaucaccguaaaugacucacaacauuauaaacaguugugagaaaauauu

SEQ ID NO: 345417 - RNA, 64 nt, hsa
cugugauugacaguagcuguagguuaccagacggcaacauuagaaagugauuguaaauaacaug

SEQ ID NO: 345418 - RNA, 64 nt, hsa
ugcuaaaacccuaaacuggugcucacaccuuacucaacauuagaaaaucaauacuggauagaaa

SEQ ID NO: 345419 - RNA, 64 nt, hsa
cucuuuguugaauuuuugucuuuauuuaaauuagcaacauuacuuaggauuuauucuucacaau

SEQ ID NO: 345420 - RNA, 64 nt, hsa
cuguuacaaauccuucuuguuuuggcaucucguacaacauuauuaagacacagcugagaguuga

SEQ ID NO: 345421 - RNA, 64 nt, hsa
acaauaauaaugggagacuuaaacaccccacugucaacauuagaucaaugagacagaaaguuaa

SEQ ID NO: 345422 - RNA, 64 nt, hsa
cuucuuuccccacaugccccacuaaaccaucugacaacauuaaugaauaaaauggugaaaaugu

SEQ ID NO: 345423 - RNA, 64 nt, hsa
uauuugacucuccguauuggagaaaauaaaauuacaacauuacgacauacuaaaaaaucaauau

SEQ ID NO: 345424 - RNA, 64 nt, hsa
gauuaauauuggauauuacuguuuuuauuaucaucaacauuauuauuaguggauuucuuaauag

SEQ ID NO: 345425 - RNA, 64 nt, hsa
gagagagauucuguuuccugaggcuuaauacacccaacauuauaacaaaggacuguagcaaggg

SEQ ID NO: 345426 - RNA, 64 nt, hsa
aaaccaaauccaucugcacaucaaaaagcuaauccaacauuaucaagcaggcuuuaguguuggg

SEQ ID NO: 345427 - RNA, 64 nt, hsa
aguggagauuccaggugaauauuuaugaaaaagucaacauuagaacugaaaauggaaauaaacu

SEQ ID NO: 345428 - RNA, 64 nt, hsa
acagacauuucauacauaucuuuaaagcacaugacaacauuagaaaauauuuucacuccuuaaa

SEQ ID NO: 345429 - RNA, 64 nt, hsa
cgauauguguaaagaucuacucucacaauauacucaacauuauauaauguauagugugauuaau

SEQ ID NO: 345430 - RNA, 64 nt, hsa
gagcccgcacccuaagcauccugcugccuucccacaacauuaaacucuccuuccucagugugcu

SEQ ID NO: 345431 - RNA, 64 nt, hsa
uugagaaaccuuuagucacagcacacacuuuucucaacauuauuggcuuccuccuagaguguug

SEQ ID NO: 345432 - RNA, 64 nt, hsa
uguagucuuccaugcuugacaaauuggauguagacaacauuacuuaaaacuucuauaaaucccu

SEQ ID NO: 345433 - RNA, 64 nt, hsa
gucucucuuuguuuuaaugugacuuaggugcugucaacauuagcaagauaauggaaaucacgac

SEQ ID NO: 345434 - RNA, 64 nt, hsa
caaauuaucaguuaaucgaaacuacauugcaagucaacauuauuuucucuucuuccucagcuuc

SEQ ID NO: 345435 - RNA, 64 nt, hsa
gugucccuuuuugguuucuggaaagauucuuugucaacauuaguaacugauacauagaaccaag

SEQ ID NO: 345436 - RNA, 64 nt, hsa
auuaagugaaccucccgugccuuuuaaaaaauaccaacauuaugaaauuuaaaagcuuaaauau

SEQ ID NO: 345437 - RNA, 64 nt, hsa
uugccuuugaauuagcuuucccuaggccaugagucaacauuaguaguuuauacauccaaauugg

SEQ ID NO: 345438 - RNA, 64 nt, hsa
aauuuauuuuuauuuuuugugguuauauucccaacaacauuaaaaaauacucgaggcauaaaug

SEQ ID NO: 345439 - RNA, 64 nt, hsa
aucagugcuguuuguaauuuuucacuuugagaaccaacauuaauuccauaugaaucaaguguuu

SEQ ID NO: 345440 - RNA, 64 nt, hsa
uaaauuuauaauuccauauuuauaauguuggccacaacauuaugauuauuccuugucuguacuu

SEQ ID NO: 345441 - RNA, 64 nt, hsa
uuuuuuauaauaugauucacuuaugccacagauucaacauuagaauauguuuuaucucuacugu

SEQ ID NO: 345442 - RNA, 64 nt, hsa
gaaaauuaaaggcguuuuacucacauggcuauuucaacauuaguuuuuuuuguuuguuucuuuu

SEQ ID NO: 345443 - RNA, 64 nt, hsa
auauacaauauauauuuugugggcuuaauugaaacaacauuauuuuaaaaucaaaggggauaua

SEQ ID NO: 345444 - RNA, 64 nt, hsa
gaggagccuuucgauaucuggggaacuuggcauucaacauuaaaaagcggauccaaagacccag

SEQ ID NO: 345445 - RNA, 64 nt, hsa
aguuagcccucacuagccaaacugaaacucuaugcaacauuaaaagaagagauccaucauguag

SEQ ID NO: 345446 - RNA, 64 nt, hsa
caggaaaauuuaguuuacagaauacuucugcauacaacauuaauuaggaaacaaagaacuuuaa

SEQ ID NO: 345447 - RNA, 64 nt, hsa
uucugucuacuaguaaacauuccaaauugcuacccaacauuacuguuaacagauuuuccuccgu

SEQ ID NO: 345448 - RNA, 64 nt, hsa
cacugagaaccugcugagcaaggacggcuuuuaccaacauuagcacaaagguuuccucaguuua

SEQ ID NO: 345449 - RNA, 64 nt, hsa
uacggcugcaaaauggcuaaggucaaguaaagcacaacauuaugauuuaauaugcuuuuguuga

SEQ ID NO: 345450 - RNA, 64 nt, hsa
gaaaauuaaagguguuuuacucacauggauauuucaacauuaguuuuuuuuguuuguuucuuuu

SEQ ID NO: 345451 - RNA, 65 nt, hsa
agagccguuuggccagggucuccaauuuaggcuuucaacauuaucucuaaagaagguuauacauu

SEQ ID NO: 345452 - RNA, 65 nt, hsa
cauggaugauaugcugcuucuguuuaacagugaugcaacauuauguggcugaaaaagaauauaaa

SEQ ID NO: 345453 - RNA, 65 nt, hsa
aauugucagucugacauuuaaugucuuucuauggacaacauuaaaucucccucccuucuguaauu

SEQ ID NO: 345454 - RNA, 65 nt, hsa
acuuuuacauuuucccaacuagauggccuagaguccaacauuaccuuuugagaugacauuauugu

SEQ ID NO: 345455 - RNA, 65 nt, hsa
aaaaacaacugauauaauuacucaagaaauauuugcaacauuaguuuuuuuccagcaucagcaau

SEQ ID NO: 345456 - RNA, 65 nt, hsa
uaugguagaaguaaaaaaaaaaaaaaaggacauagcaacauuaaaguaguggauuuuucugagua

SEQ ID NO: 345457 - RNA, 65 nt, hsa
uuucaucauccaaguuuguaguucauuuaaaaauacaacauuaaacacauuuugcuaggauguca

SEQ ID NO: 345458 - RNA, 65 nt, hsa
agcaguuaccaucaaaggcagcauauuuccaauuccaacauuacuguuucuaccaagucccauua

SEQ ID NO: 345459 - RNA, 65 nt, hsa
ccuguauucgugggauugguguaggguuaaaucaucaacauuauuucauaaaauaagaauuuguu

SEQ ID NO: 345460 - RNA, 65 nt, hsa
guuuguuuccuggcuuuaccuugggaaaaugcuagcaacauuauagaaauuuugccuuguugccu

SEQ ID NO: 345461 - RNA, 65 nt, hsa
uucugggauuacaagugugagucacugcgacuggccaacauuaugugauuuaugugugaacuaua

SEQ ID NO: 345462 - RNA, 65 nt, hsa
ccuuugagcacaaaauuuccacggugaaauaaagucaacauuauaagcuuuaucuuuugaaacug

SEQ ID NO: 345463 - RNA, 65 nt, hsa
aguuaauggaagaauucaccaauuuuaaaguuuugcaacauuaaauaagugacuugguguuagaa

SEQ ID NO: 345464 - RNA, 65 nt, hsa
uuagauggcuugauauaccaaauaacaauauagaacaacauuauuauaugugcuuccccaaguuu

SEQ ID NO: 345465 - RNA, 65 nt, hsa
gccagugguaguaacuguguaaaguuucuaauucacaacauuaauuccuuuaaaauacacagccu

SEQ ID NO: 345466 - RNA, 65 nt, hsa
cacuauucacuaaaauuaaucuggaauuuaaggcccaacauuaaacacaaagcuguugaaauauu

SEQ ID NO: 345467 - RNA, 65 nt, hsa
auaauuauguuaaugucauuagugacaaagauuugcaacauuagagaaaagagacacaaauauaa

SEQ ID NO: 345468 - RNA, 65 nt, hsa
ggccaagagccagcuucugcguucucaacuuuauucaacauuagacuuaccuuauuucuuucagu

SEQ ID NO: 345469 - RNA, 65 nt, hsa
agauacacaugcuuuuuucccacccaaaauugugacaacauuaugugaauguuuuauuauuuuuu

SEQ ID NO: 345470 - RNA, 65 nt, hsa
uacaaugcuugacuacaaaacagagcugucuucagcaacauuauuaguagacaaagaggaugugg

SEQ ID NO: 345471 - RNA, 65 nt, hsa
ccagguugcaguagcaguggauguuagccugcaaacaacauuaggggauucuucuuuuguguccu

SEQ ID NO: 345472 - RNA, 65 nt, hsa
uuuguuguguaagacaaugauaacuauuauuugugcaacauuacucuuugaaauaaaaauuggca

SEQ ID NO: 345473 - RNA, 65 nt, hsa
aaguggcauuacauugagcgugaccuugcaauguucaacauuaacauugaugaugacuacguccc

SEQ ID NO: 345474 - RNA, 65 nt, hsa
gugccagcuauauaaggaauaaaguugauucauaucaacauuagaacuccagucccaaacuaauc

SEQ ID NO: 345475 - RNA, 65 nt, hsa
acugcauuucaguuguauuauaguccaguucuuaucaacauuaaaaccuauagcaaucauuucaa

SEQ ID NO: 345476 - RNA, 65 nt, hsa
acuacuauccauaaaugcaauaauaugcauguuaacaacauuaaaaacagcaaacagcaaucuaa

SEQ ID NO: 345477 - RNA, 65 nt, hsa
acagcaagaacaguccauguuguauauaauacaaccaacauuauagaacuuuuaggguugugacu

SEQ ID NO: 345478 - RNA, 65 nt, hsa
ucaugaacguuauuauauugucgaauuccuacugacaacauuauaacuguaugggagcuuaacuu

SEQ ID NO: 345479 - RNA, 65 nt, hsa
uugaguugacuucugacaaaggugguaaauucagacaacauuaugaucuaauaaacuuuauuuuu

SEQ ID NO: 345480 - RNA, 65 nt, hsa
auguauaaggcagguuuuauacaaccauuuagauucaacauuaaugguagaguggcauuuuacca

SEQ ID NO: 345481 - RNA, 65 nt, hsa
uaaauuguaccaaugaauacguaaacauacagugacaacauuaaacuuagaaaaguuuuaaaacu

SEQ ID NO: 345482 - RNA, 65 nt, hsa
uuauuuuuucuuuucuaugcaagauaagagauuaccaacauuacuugucuugaucuacccauauu

SEQ ID NO: 345483 - RNA, 65 nt, hsa
uuuuuucuucauccucaaaaggagacucuuuugcucaacauuaaauugugcuuccuaacccuaaa

SEQ ID NO: 345484 - RNA, 65 nt, hsa
uugugguuauguuaccuuuaucuuguugaggaccacaacauuagcacggugccuugugcagaaua

SEQ ID NO: 345485 - RNA, 65 nt, hsa
agaaaagaaagcuuuauuuuaacacucaucugaaucaacauuaaagccuuuucucucaaagcguu

SEQ ID NO: 345486 - RNA, 65 nt, hsa
ggcaaaaacagaacuuccaaaguaucuuucugugacaacauuagguucaggcuugaagucccuga

SEQ ID NO: 345487 - RNA, 65 nt, hsa
acaguuaacucuagaaagaaagaacacuaccacugcaacauuaauggaugcuugaagcuguacaa

SEQ ID NO: 345488 - RNA, 65 nt, hsa
gagggucaacuguacuauaaauaauacgaauaugccaacauuauauaaucauugcuuucugcaac

SEQ ID NO: 345489 - RNA, 65 nt, hsa
auuuuacaauugaaaugacuaaaaaacaaagaagacaacauuaaaacaauauuguuucuaauugc

SEQ ID NO: 345490 - RNA, 65 nt, hsa
uuuuaggugcucugaguugaggcaaaguagagcggcaacauuaagugcuaugcuagucacuuagc

SEQ ID NO: 345491 - RNA, 65 nt, hsa
aaugauuuccuuagcagaagccguauuuguacgcacaacauuaaaucaagggcuacaauucaagc

SEQ ID NO: 345492 - RNA, 65 nt, hsa
caucauauacgacugaaagaagaaaacuagauuuucaacauuacaggguugaaaugaaugaugag

SEQ ID NO: 345493 - RNA, 65 nt, hsa
gguguuacauuuaauauuuaauguaacuggucuagcaacauuaagggggauuucugaagccaacu

SEQ ID NO: 345494 - RNA, 65 nt, hsa
aauuaaaaaaaaauuuuaacugauaaaacuuagggcaacauuaauuaauguauauucuuaccuga

SEQ ID NO: 345495 - RNA, 65 nt, hsa
aacccuauuuaagagacugaucacacacguauacacaacauuacugaaagaacccugcgaaucaa

SEQ ID NO: 345496 - RNA, 65 nt, hsa
cauacacacaaaaacuuguacaccaauguucauagcaacauuauuuguaauagccaaaaagugga

SEQ ID NO: 345497 - RNA, 65 nt, hsa
uaugcaaauggcuacuaagcacaugaaaaaauacucaacauuauuauucauuagggaaaugcaag

SEQ ID NO: 345498 - RNA, 65 nt, hsa
ccuggcuuagggaacagggagcgauggaagaaugccaacauuagcguuggucuucucuugucagg

SEQ ID NO: 345499 - RNA, 65 nt, hsa
caauaaaugaauagcuuauugcagacauuuuuuaccaacauuaauuauuuuggguuuguuuaaaa

SEQ ID NO: 345500 - RNA, 65 nt, hsa
caccaucaugugauaaugguacuauggcauauaugcaacauuaaaauuuuaaauuagauauuuau

SEQ ID NO: 345501 - RNA, 65 nt, hsa
ucauucuaagagucuaaaaauuucaaaaaccaaaacaacauuauaaaugguguuucucaaggacc

SEQ ID NO: 345502 - RNA, 65 nt, hsa
auuuaaaauuacuucagugcaauccuacacaguaucaacauuagaauuuugauauuagucuuaug

SEQ ID NO: 345503 - RNA, 65 nt, hsa
ugauauagggauauucauaugacaagagauucaugcaacauuaaaaauacuaaaauacuugugug

SEQ ID NO: 345504 - RNA, 65 nt, hsa
uccucuguacaaaagccucaagugagggucaaauucaacauuauccugaucuagacagcccccau

SEQ ID NO: 345505 - RNA, 65 nt, hsa
gaaggacuguguguaguaaugaaaauaccaaguugcaacauuacauguuuacaaaaaaaaaucug

SEQ ID NO: 345506 - RNA, 65 nt, hsa
acuuuuagauuuggaaauugcuguuuacagucuaacaacauuaaaaugagagguagauucacaag

SEQ ID NO: 345507 - RNA, 65 nt, hsa
gggcagccaaggauuauaaaccacuucccuaaaggcaacauuaaugcaaaaguccccagauggca

SEQ ID NO: 345508 - RNA, 65 nt, hsa
gcaaaaaacuucaacaugcauaugauauauaguuacaacauuaauuuuaugaacuggagagcuuu

SEQ ID NO: 345509 - RNA, 65 nt, hsa
ugaauugagacccauguuaucuuugggauguauagcaacauuaaauuugguuuguuuugcuaugu

SEQ ID NO: 345510 - RNA, 65 nt, hsa
aaagaagggguagggauuuggcuaugccuucacuacaacauuagaauauuguaacucacaugccu

SEQ ID NO: 345511 - RNA, 65 nt, hsa
auauacauggucaauaaguauauuuuuaaaaugcucaacauuaacuauucauacagaaaugcaaa

SEQ ID NO: 345512 - RNA, 65 nt, hsa
augcaucaaaauaaauuuacuaaguacuaaagagccaacauuauuuuauaagugccuggcaauag

SEQ ID NO: 345513 - RNA, 65 nt, hsa
agagaucaaauauaaaauucaucauaaugucuguucaacauuaucuuauuuggaaaauggggaaa

SEQ ID NO: 345514 - RNA, 65 nt, hsa
uuaaucagucugcacauccuguuucuaauaucuagcaacauuauauucuuucagacauuuauuuu

SEQ ID NO: 345515 - RNA, 65 nt, hsa
agaucaacacuuuucuccaggguucaccaugcaggcaacauuaccuugucuuucaaaagacaccu

SEQ ID NO: 345516 - RNA, 65 nt, hsa
cacuugguuggcucccuuugucucuguaccuuuaccaacauuaggaucucaccucuuucuuccuc

SEQ ID NO: 345517 - RNA, 65 nt, hsa
gaacacuaaagagcuaggaaagaguugagcacaggcaacauuacaaacaaaggauuugaaaacac

SEQ ID NO: 345518 - RNA, 65 nt, hsa
auguuuuaaaaaacuaaguguuuaggauuucaagacaacauuauacauggcucugaaauaucuga

SEQ ID NO: 345519 - RNA, 65 nt, hsa
uuaagacuuuuauaagacuagcuuaaaacaccaaccaacauuauuuuugcaaaagugaguuggac

SEQ ID NO: 345520 - RNA, 65 nt, hsa
aaaaaacaaaucuaacuuauuaauacuaggaauaccaacauuauuagggcacuugcagguuauuc

SEQ ID NO: 345521 - RNA, 65 nt, hsa
aaguaauuagagguuuuuccauuucaugucuugaacaacauuaauauuaauuacacuagaaauau

SEQ ID NO: 345522 - RNA, 65 nt, hsa
cgcuaaacacuguggaggcuaaaaaaagucaaagacaacauuauaacuaaaagucgaaagcacac

SEQ ID NO: 345523 - RNA, 65 nt, hsa
uuuuuucauugaucuaugcuuugaguuugcuuucucaacauuauuguauuuuccacuuauuauua

SEQ ID NO: 345524 - RNA, 65 nt, hsa
cuugcuuucugcuuccuucuggugaaguccaccuccaacauuaaccugcccaccccacccccguc

SEQ ID NO: 345525 - RNA, 65 nt, hsa
cgagacuccgccucaaaaaaagaauacaaaugcuccaacauuauuuuuuauaacucuggauuacc

SEQ ID NO: 345526 - RNA, 65 nt, hsa
agugaguaaugacaggacuacaacuaaaacauaaacaacauuaaugaugaccauaaaaagucaca

SEQ ID NO: 345527 - RNA, 65 nt, hsa
ccugacuggauuaaggaauaccuagacagcugguacaacauuauuucugggugugucugugagug

SEQ ID NO: 345528 - RNA, 65 nt, hsa
agucucauuuagcaaguauggaaguugaggcagggcaacauuaagcaacuuacauaacucaugca

SEQ ID NO: 345529 - RNA, 65 nt, hsa
aaagacagacuaaaaagaguaauaaaucaauacaacaacauuaaaagccagacuagcggaguuug

SEQ ID NO: 345530 - RNA, 65 nt, hsa
uuaaguuggguauuuuuuuaaaaaaagaaaaacagcaacauuaauaaaagaagugguguguuuuu

SEQ ID NO: 345531 - RNA, 65 nt, hsa
ucuguauuguuaauuuugugccauauuuugaauugcaacauuaugcuaaguauaacuuugcaagu

SEQ ID NO: 345532 - RNA, 65 nt, hsa
aguuuuucuaaauaaauguaacuuuucacaagagucaacauuaaaaaauaaauuauuuaagaaca

SEQ ID NO: 345533 - RNA, 65 nt, hsa
aguucaguaucuuuuauguaaauuacaaacaucugcaacauuauguaucauaugcagauacuuau

SEQ ID NO: 345534 - RNA, 65 nt, hsa
ccuucccucuuuuuuaaagucacauuuccauguuucaacauuaguuugcauucaccuuuacaaag

SEQ ID NO: 345535 - RNA, 65 nt, hsa
aaccaacuaugauuuaugguuguguuuucagaauucaacauuaaagauuaauguuuauuuaaacg

SEQ ID NO: 345536 - RNA, 65 nt, hsa
guucaucagaaugaaggggaaaaacagccaucauccaacauuauugagauugucguguauaguca

SEQ ID NO: 345537 - RNA, 65 nt, hsa
agagaaagaugaaaauaggaacaaauaaagacaaacaacauuaagggccauauuguaagauuucc

SEQ ID NO: 345538 - RNA, 65 nt, hsa
ugggaagaccaaaauuacuaauaaauugacauaaccaacauuaaaacucauaauuauuuuguuga

SEQ ID NO: 345539 - RNA, 65 nt, hsa
cugcaugaaaguuuaauuagacauuucuuuguuuucaacauuagaagugguguaacauguaagcu

SEQ ID NO: 345540 - RNA, 65 nt, hsa
cagauaaacuaaucaaauaaauuagaauaaugugacaacauuacaaauuuaauuuguuagcugca

SEQ ID NO: 345541 - RNA, 65 nt, hsa
uuuggagaccuagacauucagcucacugcuuaacucaacauuaaauuuuaugauucuguuuugcc

SEQ ID NO: 345542 - RNA, 65 nt, hsa
uaaaauauuauaaccacaggguauccagccaaauucaacauuacugcaagucuuagagauuuaaa

SEQ ID NO: 345543 - RNA, 65 nt, hsa
ucaaugacugaaagucaaugcugauaguuuacuggcaacauuaauugaagcaucaaaaauaaaug

SEQ ID NO: 345544 - RNA, 65 nt, hsa
uauaugcauuuaaguggaauauuuggugccauuuacaacauuauuuucaugccaauaaaagauuu

SEQ ID NO: 345545 - RNA, 65 nt, hsa
auucagaucaaguauuguugaaagcuauacauauacaacauuacagucugucuguauuuagauau

SEQ ID NO: 345546 - RNA, 65 nt, hsa
uauauguuacuaaaacaggcuccaccucaguuuaucaacauuauaaguuacuguucuaagaaaag

SEQ ID NO: 345547 - RNA, 65 nt, hsa
auuuauagauaugagaaacauaauguucuaaccaacaacauuaugguauuugugugacuuuuauu

SEQ ID NO: 345548 - RNA, 65 nt, hsa
guggaaaagccauuauuaucugcucagauuuuacucaacauuagagaguuaguacguaauaaaag

SEQ ID NO: 345549 - RNA, 65 nt, hsa
aacaguuggcuauucaucaucuucggcacuuaugacaacauuaacacagaaugccaguucaucag

SEQ ID NO: 345550 - RNA, 65 nt, hsa
uacauuguuuucaaccagaaauuaaaguagauauccaacauuauuuucagugcuuguacuucaug

SEQ ID NO: 345551 - RNA, 65 nt, hsa
cuguuuuuuuccccuagacaauaucagguuaccgucaacauuaauccauuuaaaaggacauggac

SEQ ID NO: 345552 - RNA, 65 nt, hsa
aauccaaaugugacuuugaaaauuguuagagaaaacaacauuagaaaauggcgcaaaaucguuag

SEQ ID NO: 345553 - RNA, 65 nt, hsa
uguuucuauuuuagaugaguguuuccuaauacaagcaacauuaacaucuucagaaaaggaagcag

SEQ ID NO: 345554 - RNA, 65 nt, hsa
uucaguuuuguucuuacccaauuguuuuuucuuuucaacauuaccaauuuacagauucaguuuau

SEQ ID NO: 345555 - RNA, 65 nt, hsa
uauucauaccuucugaugaaguuguacaacaccagcaacauuauaauggcccuguagcucugaau

SEQ ID NO: 345556 - RNA, 65 nt, hsa
uauauuuuacaaaugcuagauauuggucugggaggcaacauuaaugguaccagccugucacaacu

SEQ ID NO: 345557 - RNA, 65 nt, hsa
aacauuuaacuaugguauuuauggaagacagguaacaacauuaaaucuaguugcuuucccuuagu

SEQ ID NO: 345558 - RNA, 65 nt, hsa
uuuuuaacaucuuauuuuuuucauuaauuacauaucaacauuaauuuuguaucuugaagcaaauu

SEQ ID NO: 345559 - RNA, 65 nt, hsa
gccagcugaccuucaaacccugcauuugaaccgaccaacauuaaguccagagaguaaacuugaau

SEQ ID NO: 345560 - RNA, 65 nt, hsa
ggucaacucuuuuaauuuauauacaaagcaaagaacaacauuaauggagaugcacaaugauuauu

SEQ ID NO: 345561 - RNA, 65 nt, hsa
ccucuaauuugaacugguauuguuuacguuugauacaacauuaaggaauuugaugauuuucauuu

SEQ ID NO: 345562 - RNA, 65 nt, hsa
aagcugcaaccuuucuguuuuauuuaaagaaagcccaacauuaaaggguuuucauugcaagcgug

SEQ ID NO: 345563 - RNA, 65 nt, hsa
ugguuauagugggaauauaaauaaagugagggauccaacauuacuuuaaaagucaccccaacugu

SEQ ID NO: 345564 - RNA, 65 nt, hsa
uaauaauaauaauggcaaacuuaacaccccacugucaacauuagacacaccaacgagacagaaag

SEQ ID NO: 345565 - RNA, 65 nt, hsa
caugugguuucuaugcaaaguucuucauaucaucacaacauuauuugauuuaaauaaaauugaaa

SEQ ID NO: 345566 - RNA, 65 nt, hsa
aaagaauaacagaaugcaucguggcaauccuuaagcaacauuaucuauguggacugcuuaaauca

SEQ ID NO: 345567 - RNA, 65 nt, hsa
acaaugcaguauucucaauuguguuacugaaaaugcaacauuagcaaagagguggguucuguuuu

SEQ ID NO: 345568 - RNA, 65 nt, hsa
guguucaugaagacuuaagaaaaaugucacuacugcaacauuaggaauguccugcacuuaauaga

SEQ ID NO: 345569 - RNA, 65 nt, hsa
aagccccccaaaaauuaucuagccguuucgaauaucaacauuacccugguguauucacugcugua

SEQ ID NO: 345570 - RNA, 65 nt, hsa
ugggaauuuucauaauaguucauacauuugucagccaacauuaaaagguaaccaacuccucaggu

SEQ ID NO: 345571 - RNA, 65 nt, hsa
agaggaucagagaugggaaaggacuagcccaaggccaacauuaacaagcccucuaacaaaaacuu

SEQ ID NO: 345572 - RNA, 65 nt, hsa
ucuguuugaauuaagaugggcuaagauggggcuugcaacauuaaacaugagcugagcauccauaa

SEQ ID NO: 345573 - RNA, 65 nt, hsa
gcuggccaagagagaagacuggacggcagggaggucaacauuaacgaguggggggaucacaaagc

SEQ ID NO: 345574 - RNA, 65 nt, hsa
cauauuguuucaguguucaaauaaacugaaggacucaacauuacauuugaacuauauccuuccua

SEQ ID NO: 345575 - RNA, 65 nt, hsa
ccuuaacuccuuaguauuucauagaaaaaugacugcaacauuaaagcuaagaggaacacuucaac

SEQ ID NO: 345576 - RNA, 65 nt, hsa
cuaugggauaggaacugucaguguuuuugcaacugcaacauuaaaccaagugcugugggcuuuuc

SEQ ID NO: 345577 - RNA, 65 nt, hsa
ccuugcguggaaugaaaacgccaaaggcucaugagcaacauuaggcuagaggggucuuguucaaa

SEQ ID NO: 345578 - RNA, 65 nt, hsa
caaauugguguuucugaaugacaucaacauucccccaacauuacuccauuacuaaagacagaaaa

SEQ ID NO: 345579 - RNA, 65 nt, hsa
uauauaccagaguacuguaaaaucuagguuuuuuucaacauuagcaguaaauugagcacuguuua

SEQ ID NO: 345580 - RNA, 65 nt, hsa
ugccuguuggaauuaauuuaagcuuaaguauauaucaacauuauuuuauugugcaauuaaaacaa

SEQ ID NO: 345581 - RNA, 65 nt, hsa
aaagagguggacuuuacagauaauggagcagaagccaacauuaguaaaaggaaucccaacuucuu

SEQ ID NO: 345582 - RNA, 65 nt, hsa
ugaaugaagccaauaggaaauaaaaaacaggcacacaacauuauuuggggaaaaacaccucuagu

SEQ ID NO: 345583 - RNA, 65 nt, hsa
uaugcuauaauuauaguaucccacauucgguugagcaacauuauacaaaauaagugucgaguuac

SEQ ID NO: 345584 - RNA, 65 nt, hsa
gaguaggcacucuuuaauccauuaccuggcacuagcaacauuagaauuuuaaaauaaaauaauug

SEQ ID NO: 345585 - RNA, 65 nt, hsa
ucuagguugaaagauaggcagccuuacccagaacacaacauuagcagcugggaaggugucugagg

SEQ ID NO: 345586 - RNA, 65 nt, hsa
ugaugucauugagacuauauuuauauuugacuuggcaacauuaacauguccuaagacuuagugca

SEQ ID NO: 345587 - RNA, 65 nt, hsa
aauaaauaaggaucacacuguauuagggguuauggcaacauuauugaauuuuuuauguacauaaa

SEQ ID NO: 345588 - RNA, 65 nt, hsa
uccgaggucugcgagggcuucgacgaggagggccgcaacauuagcaagacccgcggguggcacag

SEQ ID NO: 345589 - RNA, 65 nt, hsa
caggaacagauugggugucaguucaggauaaauaccaacauuaacagcagaaugaugcaaugaaa

SEQ ID NO: 345590 - RNA, 65 nt, hsa
gagugcauuucuauaauauaaauguugauuugcgucaacauuauaaaagagcacuucuguggcuc

SEQ ID NO: 345591 - RNA, 65 nt, hsa
aaucaugcagccuauccaauaaguaaguuuauuuccaacauuagcucuaauuaguucauuuccaa

SEQ ID NO: 345592 - RNA, 65 nt, hsa
acccuccauuuguguuuauugcauauccacuauaacaacauuaaaggaccuuuaaaaggaaguaa

SEQ ID NO: 345593 - RNA, 65 nt, hsa
ggagcagcggggcaguguggggcuuugugucaucacaacauuaaaguauuuuauucuacucuguc

SEQ ID NO: 345594 - RNA, 65 nt, hsa
auauccuuuaaacuaaauuuugccaaagcccgagacaacauuaaggagaaauuguaccuuaaguu

SEQ ID NO: 345595 - RNA, 65 nt, hsa
gugcuagcuaaaagacaaauuuaaggggagcucuucaacauuaaggcaguaugauaucaugcuug

SEQ ID NO: 345596 - RNA, 65 nt, hsa
uaguccccacaacaaagaaucauccugucccaugucaacauuauacccauggagaaacacuggca

SEQ ID NO: 345597 - RNA, 65 nt, hsa
aaucccugauccuucaaggucagucagacaguuggcaacauuauaauuaaaaauaagaaauuaag

SEQ ID NO: 345598 - RNA, 65 nt, hsa
guuucuuggggcagagaagguggagaguaaagacccaacauuacuaacaaugauacaguugcaug

SEQ ID NO: 345599 - RNA, 65 nt, hsa
acuucaaagaaauugagccagcacuaucuguacuccaacauuaccggaucuggauuggggagguu

SEQ ID NO: 345600 - RNA, 65 nt, hsa
gaaucaccaaaggagcuauggagagaauuaaaacucaacauuacuguuaacugugcguuaaauaa

SEQ ID NO: 345601 - RNA, 65 nt, hsa
aaggacaguugcaaaaggcuucaaggaauuuaucucaacauuauucuuucuauguccuaacuaaa

SEQ ID NO: 345602 - RNA, 65 nt, hsa
ccucagauaagaagaaaucaucucuacaauguagacaacauuauauuuuauagaauuuguuugaa

SEQ ID NO: 345603 - RNA, 65 nt, hsa
uggaucccaggagacaacagucuccacagugagagcaacauuaagggcaaagccauggagaaaug

SEQ ID NO: 345604 - RNA, 65 nt, hsa
cacuaaugauacacagauagauaaagcaagucuaucaacauuaaaaauacuaaaaaauaaagaca

SEQ ID NO: 345605 - RNA, 65 nt, hsa
auaaacuuaaaaggagauuuugaacuuaacuuacacaacauuaaauccuugcacaaucaaauuaa

SEQ ID NO: 345606 - RNA, 65 nt, hsa
auguuucaguuacaacuguaauguuauuuauagaacaacauuaauccauuaaagcuaaccuauuu

SEQ ID NO: 345607 - RNA, 65 nt, hsa
uuucugcuccugcuucucucucuucauuccccuaucaacauuaccgccccugucucucuucugua

SEQ ID NO: 345608 - RNA, 65 nt, hsa
uaauuaaccuuguugaaucucagauuccccauuugcaacauuagguuaagaccaguacugcagga

SEQ ID NO: 345609 - RNA, 65 nt, hsa
uucugggaaauuguuauagcuuaaauggaacucaccaacauuauucauaguuuaagucuuuuauc

SEQ ID NO: 345610 - RNA, 65 nt, hsa
uccuguucagucaacaaguauuuuaacucucaguccaacauuauuugaauugagcaccucaagca

SEQ ID NO: 345611 - RNA, 65 nt, hsa
gcucauucuuggccucgcagaaaacucucggauggcaacauuaaguccuaccucuguucucgcug

SEQ ID NO: 345612 - RNA, 65 nt, hsa
ugucuuguuauguacaaacuaguuuuuauagcuaucaacauuaggaguaacuuucaaccuugcca

SEQ ID NO: 345613 - RNA, 65 nt, hsa
cugcugcuucaaaaaguacuuacuuuuuaaaccaucaacauuacuuuucuuucuuaaggcaaggc

SEQ ID NO: 345614 - RNA, 65 nt, hsa
uuaaguaugagauacuugaugggggcuuuaucaugcaacauuaguuugcuuaccuuaagaauugc

SEQ ID NO: 345615 - RNA, 65 nt, hsa
gguggaggaaaggaggaaaaagugcuuauuaugugcaacauuaugauuaaucugauuauacacca

SEQ ID NO: 345616 - RNA, 65 nt, hsa
ccucuaauucuuuuccagugugccaacuccaaagucaacauuaaaaauguaaauggaccugugua

SEQ ID NO: 345617 - RNA, 65 nt, hsa
acacuuacaguuaggauuugugguaagguaccucucaacauuaccaaaaucauuucuuuagaggg

SEQ ID NO: 345618 - RNA, 65 nt, hsa
aaaaagaaggaaaaggagguaaaaggugaaaggaacaacauuaauuaacaauuuuacgucauguc

SEQ ID NO: 345619 - RNA, 65 nt, hsa
uuucuggaagugugaaaauguuaauguucaacaagcaacauuaaaaauagauuugaaacauuuau

SEQ ID NO: 345620 - RNA, 65 nt, hsa
guauauguacauucuaaugugugucucuucuuauucaacauuaauccuuacuagaaccacaagaa

SEQ ID NO: 345621 - RNA, 65 nt, hsa
acuauaacuauaaaucucuagaauucugugaauuucaacauuauuugaaguaguucuucaguuau

SEQ ID NO: 345622 - RNA, 65 nt, hsa
auggaauaauuccaacuuaacaaaaacaaugacaacaacauuacuaaccuguggagucacacguu

SEQ ID NO: 345623 - RNA, 65 nt, hsa
cuuuuacugggggagugggaaagugauucuguaaccaacauuagaauuacuuuggauuuguaauc

SEQ ID NO: 345624 - RNA, 65 nt, hsa
gcacuugguuagcagauguuuaauuuuuuuuuuaacaacauuaacuuguggccucuuucuacacc

SEQ ID NO: 345625 - RNA, 65 nt, hsa
uuaacauguaaacaaaaguguuaaauucacauauacaacauuauacaauuuaaucacucuuggaa

SEQ ID NO: 345626 - RNA, 65 nt, hsa
uaccuuuaaaaaauaauuuagauauucauacuuuccaacauuauccugugugauuacagcauagg

SEQ ID NO: 345627 - RNA, 65 nt, hsa
guaaauauaugaguauuugaguuuuuaaaucacuucaacauuauuugagcauuuacuuuguauuu

SEQ ID NO: 345628 - RNA, 65 nt, hsa
auaaauuaggcacaguaagagauuaacaauaauaacaacauuaaguaaaaugaguuacuugaaug

SEQ ID NO: 345629 - RNA, 65 nt, hsa
uuggagaucaguagugucaucuucauaaagcaagacaacauuaugacacuuuaaaacaguagcaa

SEQ ID NO: 345630 - RNA, 65 nt, hsa
guuccuugcugucacagaugauagguucauguacacaacauuaauguuugauaaggaaagcauuu

SEQ ID NO: 345631 - RNA, 65 nt, hsa
caugacucagaccauaagcuuuucaugccagaugucaacauuaagcugcaacauccuaaccacca

SEQ ID NO: 345632 - RNA, 65 nt, hsa
gguggagacuaucagcccaagaugcuuuaagugcacaacauuacagggaaugccugagugccugg

SEQ ID NO: 345633 - RNA, 65 nt, hsa
uggguugucagugauuugugaacugagagcagcaacaacauuauuuuuuaaaaaucuuaaauccu

SEQ ID NO: 345634 - RNA, 65 nt, hsa
caguuuauaauucccaccuuucacauauaguucaacaacauuaauccagagagaauuuuauguuu

SEQ ID NO: 345635 - RNA, 65 nt, hsa
uaugguaacuacauagauguuauaagaacauaaaccaacauuauaaacaauggccacauuuaguu

SEQ ID NO: 345636 - RNA, 65 nt, hsa
uucacuugggagagauggcaaacacaguggcaagacaacauuacccaacuauagaagagaggcua

SEQ ID NO: 345637 - RNA, 65 nt, hsa
uuuggcagauaugaggauggucaggugggcgaugccaacauuaauacucaggaccccaagauaca

SEQ ID NO: 345638 - RNA, 65 nt, hsa
ugaaguauagggauguauuuaauuuuacuaugcuccaacauuaaucaugacucuuuuguaaauua

SEQ ID NO: 345639 - RNA, 65 nt, hsa
ugaacuuccagggauuuuauugugaacuuacauagcaacauuaaaaugaaguugaauuguuuuua

SEQ ID NO: 345640 - RNA, 65 nt, hsa
cgccccuuccuucuguuccccagaucuaugaacuacaacauuaugaagacauucuuuuguaccuu

SEQ ID NO: 345641 - RNA, 65 nt, hsa
uuauuuacuuucgguucugcucauacuuuuuuguacaacauuaaagaaaauggacuuuuuuuauu

SEQ ID NO: 345642 - RNA, 65 nt, hsa
uaaccaugaccugcuccuccauuuccauuuauucucaacauuaaauaguuuuaucuuguuguugc

SEQ ID NO: 345643 - RNA, 65 nt, hsa
gaaaagcaguggcuccauugguguugacauacauccaacauuaaaagccacccccaaaugcccaa

SEQ ID NO: 345644 - RNA, 65 nt, hsa
ucuagauguguacuuuugagggacaugagguuaggcaacauuacagcaacacacacuggggcuau

SEQ ID NO: 345645 - RNA, 65 nt, hsa
cauuuucuacagcuugcugaguugucauuccuuugcaacauuaaaauacaugcugaacucauauu

SEQ ID NO: 345646 - RNA, 65 nt, hsa
caacugcuuaaugguugggguuuuuucacaauuuucaacauuagugauuuuuuuuucuguuugca

SEQ ID NO: 345647 - RNA, 65 nt, hsa
uuuccccaccaucuuuaaaucaaaguuguuuaaaacaacauuaauuuuaaaaaauacauaaaagc

SEQ ID NO: 345648 - RNA, 65 nt, hsa
uugacugcuuaagucagccaguucagcauggauaccaacauuagcuuuucuucuugguuauauca

SEQ ID NO: 345649 - RNA, 65 nt, hsa
acgaguuacagacaaacaucaccguaaaugacucacaacauuauaaacaguugugagaaaauauu

SEQ ID NO: 345650 - RNA, 65 nt, hsa
gcugugauugacaguagcuguagguuaccagacggcaacauuagaaagugauuguaaauaacaug

SEQ ID NO: 345651 - RNA, 65 nt, hsa
gugcuaaaacccuaaacuggugcucacaccuuacucaacauuagaaaaucaauacuggauagaaa

SEQ ID NO: 345652 - RNA, 65 nt, hsa
ccucuuuguugaauuuuugucuuuauuuaaauuagcaacauuacuuaggauuuauucuucacaau

SEQ ID NO: 345653 - RNA, 65 nt, hsa
acuguuacaaauccuucuuguuuuggcaucucguacaacauuauuaagacacagcugagaguuga

SEQ ID NO: 345654 - RNA, 65 nt, hsa
cacaauaauaaugggagacuuaaacaccccacugucaacauuagaucaaugagacagaaaguuaa

SEQ ID NO: 345655 - RNA, 65 nt, hsa
ccuucuuuccccacaugccccacuaaaccaucugacaacauuaaugaauaaaauggugaaaaugu

SEQ ID NO: 345656 - RNA, 65 nt, hsa
auauuugacucuccguauuggagaaaauaaaauuacaacauuacgacauacuaaaaaaucaauau

SEQ ID NO: 345657 - RNA, 65 nt, hsa
ggauuaauauuggauauuacuguuuuuauuaucaucaacauuauuauuaguggauuucuuaauag

SEQ ID NO: 345658 - RNA, 65 nt, hsa
ggagagagauucuguuuccugaggcuuaauacacccaacauuauaacaaaggacuguagcaaggg

SEQ ID NO: 345659 - RNA, 65 nt, hsa
uaaaccaaauccaucugcacaucaaaaagcuaauccaacauuaucaagcaggcuuuaguguuggg

SEQ ID NO: 345660 - RNA, 65 nt, hsa
uaguggagauuccaggugaauauuuaugaaaaagucaacauuagaacugaaaauggaaauaaacu

SEQ ID NO: 345661 - RNA, 65 nt, hsa
cacagacauuucauacauaucuuuaaagcacaugacaacauuagaaaauauuuucacuccuuaaa

SEQ ID NO: 345662 - RNA, 65 nt, hsa
ccgauauguguaaagaucuacucucacaauauacucaacauuauauaauguauagugugauuaau

SEQ ID NO: 345663 - RNA, 65 nt, hsa
ggagcccgcacccuaagcauccugcugccuucccacaacauuaaacucuccuuccucagugugcu

SEQ ID NO: 345664 - RNA, 65 nt, hsa
guugagaaaccuuuagucacagcacacacuuuucucaacauuauuggcuuccuccuagaguguug

SEQ ID NO: 345665 - RNA, 65 nt, hsa
cuguagucuuccaugcuugacaaauuggauguagacaacauuacuuaaaacuucuauaaaucccu

SEQ ID NO: 345666 - RNA, 65 nt, hsa
agucucucuuuguuuuaaugugacuuaggugcugucaacauuagcaagauaauggaaaucacgac

SEQ ID NO: 345667 - RNA, 65 nt, hsa
ccaaauuaucaguuaaucgaaacuacauugcaagucaacauuauuuucucuucuuccucagcuuc

SEQ ID NO: 345668 - RNA, 65 nt, hsa
ugugucccuuuuugguuucuggaaagauucuuugucaacauuaguaacugauacauagaaccaag

SEQ ID NO: 345669 - RNA, 65 nt, hsa
uauuaagugaaccucccgugccuuuuaaaaaauaccaacauuaugaaauuuaaaagcuuaaauau

SEQ ID NO: 345670 - RNA, 65 nt, hsa
cuugccuuugaauuagcuuucccuaggccaugagucaacauuaguaguuuauacauccaaauugg

SEQ ID NO: 345671 - RNA, 65 nt, hsa
aaauuuauuuuuauuuuuugugguuauauucccaacaacauuaaaaaauacucgaggcauaaaug

SEQ ID NO: 345672 - RNA, 65 nt, hsa
uaucagugcuguuuguaauuuuucacuuugagaaccaacauuaauuccauaugaaucaaguguuu

SEQ ID NO: 345673 - RNA, 65 nt, hsa
uuaaauuuauaauuccauauuuauaauguuggccacaacauuaugauuauuccuugucuguacuu

SEQ ID NO: 345674 - RNA, 65 nt, hsa
cuuuuuuauaauaugauucacuuaugccacagauucaacauuagaauauguuuuaucucuacugu

SEQ ID NO: 345675 - RNA, 65 nt, hsa
agaaaauuaaaggcguuuuacucacauggcuauuucaacauuaguuuuuuuuguuuguuucuuuu

SEQ ID NO: 345676 - RNA, 65 nt, hsa
uauauacaauauauauuuugugggcuuaauugaaacaacauuauuuuaaaaucaaaggggauaua

SEQ ID NO: 345677 - RNA, 65 nt, hsa
agaggagccuuucgauaucuggggaacuuggcauucaacauuaaaaagcggauccaaagacccag

SEQ ID NO: 345678 - RNA, 65 nt, hsa
uaguuagcccucacuagccaaacugaaacucuaugcaacauuaaaagaagagauccaucauguag

SEQ ID NO: 345679 - RNA, 65 nt, hsa
ucaggaaaauuuaguuuacagaauacuucugcauacaacauuaauuaggaaacaaagaacuuuaa

SEQ ID NO: 345680 - RNA, 65 nt, hsa
guucugucuacuaguaaacauuccaaauugcuacccaacauuacuguuaacagauuuuccuccgu

SEQ ID NO: 345681 - RNA, 65 nt, hsa
ccacugagaaccugcugagcaaggacggcuuuuaccaacauuagcacaaagguuuccucaguuua

SEQ ID NO: 345682 - RNA, 65 nt, hsa
uuacggcugcaaaauggcuaaggucaaguaaagcacaacauuaugauuuaauaugcuuuuguuga

SEQ ID NO: 345683 - RNA, 65 nt, hsa
agaaaauuaaagguguuuuacucacauggauauuucaacauuaguuuuuuuuguuuguuucuuuu

SEQ ID NO: 345684 - RNA, 64 nt, hsa; identical to SEQ ID NO: 257744

SEQ ID NO: 345685 - RNA, 64 nt, hsa; identical to SEQ ID NO: 257745

SEQ ID NO: 345686 - RNA, 64 nt, hsa; identical to SEQ ID NO: 257746

SEQ ID NO: 345687 - RNA, 64 nt, hsa; identical to SEQ ID NO: 257747

SEQ ID NO: 345688 - RNA, 64 nt, hsa; identical to SEQ ID NO: 257748

SEQ ID NO: 345689 - RNA, 64 nt, hsa; identical to SEQ ID NO: 257749

SEQ ID NO: 345690 - RNA, 64 nt, hsa; identical to SEQ ID NO: 257750

SEQ ID NO: 345691 - RNA, 64 nt, hsa; identical to SEQ ID NO: 257751

SEQ ID NO: 345692 - RNA, 64 nt, hsa; identical to SEQ ID NO: 257752

SEQ ID NO: 345693 - RNA, 64 nt, hsa; identical to SEQ ID NO: 257753

SEQ ID NO: 345694 - RNA, 51 nt, hsa; identical to SEQ ID NO: 257754

SEQ ID NO: 345695 - RNA, 64 nt, hsa; identical to SEQ ID NO: 257755

SEQ ID NO: 345696 - RNA, 64 nt, hsa
ccuguugucuucaaaugcuaaaaaaggagaauggaggguacaagacuagacaugacugaaaugg

SEQ ID NO: 345697 - RNA, 64 nt, hsa
uagcuguaacccuuaaaaaugaaacgucaacucuaggguacauuugacauugaaagaauaguua

SEQ ID NO: 345698 - RNA, 64 nt, hsa; identical to SEQ ID NO: 175895

SEQ ID NO: 345699 - RNA, 64 nt, hsa; identical to SEQ ID NO: 175896

SEQ ID NO: 345700 - RNA, 64 nt, hsa; identical to SEQ ID NO: 175897

SEQ ID NO: 345701 - RNA, 64 nt, hsa; identical to SEQ ID NO: 175898

SEQ ID NO: 345702 - RNA, 64 nt, hsa; identical to SEQ ID NO: 175899

SEQ ID NO: 345703 - RNA, 64 nt, hsa; identical to SEQ ID NO: 175900

SEQ ID NO: 345704 - RNA, 64 nt, hsa; identical to SEQ ID NO: 175901

SEQ ID NO: 345705 - RNA, 64 nt, hsa; identical to SEQ ID NO: 175902

SEQ ID NO: 345706 - RNA, 64 nt, hsa; identical to SEQ ID NO: 175903

SEQ ID NO: 345707 - RNA, 64 nt, hsa; identical to SEQ ID NO: 175904

SEQ ID NO: 345708 - RNA, 64 nt, hsa; identical to SEQ ID NO: 175905

SEQ ID NO: 345709 - RNA, 64 nt, hsa; identical to SEQ ID NO: 175906

SEQ ID NO: 345710 - RNA, 64 nt, hsa; identical to SEQ ID NO: 175907

SEQ ID NO: 345711 - RNA, 64 nt, hsa; identical to SEQ ID NO: 175908

SEQ ID NO: 345712 - RNA, 64 nt, hsa; identical to SEQ ID NO: 175909

SEQ ID NO: 345713 - RNA, 64 nt, hsa; identical to SEQ ID NO: 175910

SEQ ID NO: 345714 - RNA, 64 nt, hsa; identical to SEQ ID NO: 175911

SEQ ID NO: 345715 - RNA, 64 nt, hsa; identical to SEQ ID NO: 175912

SEQ ID NO: 345716 - RNA, 64 nt, hsa; identical to SEQ ID NO: 175913

SEQ ID NO: 345717 - RNA, 64 nt, hsa; identical to SEQ ID NO: 175914

SEQ ID NO: 345718 - RNA, 64 nt, hsa; identical to SEQ ID NO: 175915

SEQ ID NO: 345719 - RNA, 64 nt, hsa; identical to SEQ ID NO: 175916

SEQ ID NO: 345720 - RNA, 64 nt, hsa; identical to SEQ ID NO: 175917

SEQ ID NO: 345721 - RNA, 64 nt, hsa; identical to SEQ ID NO: 175918

SEQ ID NO: 345722 - RNA, 64 nt, hsa; identical to SEQ ID NO: 175919

SEQ ID NO: 345723 - RNA, 64 nt, hsa; identical to SEQ ID NO: 175920

SEQ ID NO: 345724 - RNA, 64 nt, hsa; identical to SEQ ID NO: 175921

SEQ ID NO: 345725 - RNA, 64 nt, hsa; identical to SEQ ID NO: 175922

SEQ ID NO: 345726 - RNA, 64 nt, hsa; identical to SEQ ID NO: 175923

SEQ ID NO: 345727 - RNA, 64 nt, hsa; identical to SEQ ID NO: 175924

SEQ ID NO: 345728 - RNA, 64 nt, hsa; identical to SEQ ID NO: 175925

SEQ ID NO: 345729 - RNA, 64 nt, hsa; identical to SEQ ID NO: 175926

SEQ ID NO: 345730 - RNA, 64 nt, hsa; identical to SEQ ID NO: 175927

SEQ ID NO: 345731 - RNA, 64 nt, hsa; identical to SEQ ID NO: 175928

SEQ ID NO: 345732 - RNA, 64 nt, hsa; identical to SEQ ID NO: 175929

SEQ ID NO: 345733 - RNA, 64 nt, hsa; identical to SEQ ID NO: 175930

SEQ ID NO: 345734 - RNA, 64 nt, hsa; identical to SEQ ID NO: 175931

SEQ ID NO: 345735 - RNA, 64 nt, hsa; identical to SEQ ID NO: 175932

SEQ ID NO: 345736 - RNA, 64 nt, hsa; identical to SEQ ID NO: 175933

SEQ ID NO: 345737 - RNA, 64 nt, hsa; identical to SEQ ID NO: 175934

SEQ ID NO: 345738 - RNA, 64 nt, hsa; identical to SEQ ID NO: 175935

SEQ ID NO: 345739 - RNA, 64 nt, hsa; identical to SEQ ID NO: 175936

SEQ ID NO: 345740 - RNA, 64 nt, hsa; identical to SEQ ID NO: 175937

SEQ ID NO: 345741 - RNA, 64 nt, hsa; identical to SEQ ID NO: 175938

SEQ ID NO: 345742 - RNA, 64 nt, hsa; identical to SEQ ID NO: 175939

SEQ ID NO: 345743 - RNA, 64 nt, hsa; identical to SEQ ID NO: 175940

SEQ ID NO: 345744 - RNA, 64 nt, hsa; identical to SEQ ID NO: 175941

SEQ ID NO: 345745 - RNA, 64 nt, hsa; identical to SEQ ID NO: 175942

SEQ ID NO: 345746 - RNA, 64 nt, hsa; identical to SEQ ID NO: 175943

SEQ ID NO: 345747 - RNA, 64 nt, hsa; identical to SEQ ID NO: 175944

SEQ ID NO: 345748 - RNA, 64 nt, hsa; identical to SEQ ID NO: 175945

SEQ ID NO: 345749 - RNA, 64 nt, hsa; identical to SEQ ID NO: 175946

SEQ ID NO: 345750 - RNA, 64 nt, hsa; identical to SEQ ID NO: 175947

SEQ ID NO: 345751 - RNA, 64 nt, hsa; identical to SEQ ID NO: 175948

SEQ ID NO: 345752 - RNA, 64 nt, hsa; identical to SEQ ID NO: 175949

SEQ ID NO: 345753 - RNA, 64 nt, hsa; identical to SEQ ID NO: 175950

SEQ ID NO: 345754 - RNA, 64 nt, hsa; identical to SEQ ID NO: 175951

SEQ ID NO: 345755 - RNA, 64 nt, hsa; identical to SEQ ID NO: 175952

SEQ ID NO: 345756 - RNA, 64 nt, hsa; identical to SEQ ID NO: 175953

SEQ ID NO: 345757 - RNA, 62 nt, hsa; identical to SEQ ID NO: 175954

SEQ ID NO: 345758 - RNA, 64 nt, hsa; identical to SEQ ID NO: 175955

SEQ ID NO: 345759 - RNA, 64 nt, hsa; identical to SEQ ID NO: 175956

SEQ ID NO: 345760 - RNA, 64 nt, hsa; identical to SEQ ID NO: 175957

SEQ ID NO: 345761 - RNA, 64 nt, hsa; identical to SEQ ID NO: 175958

SEQ ID NO: 345762 - RNA, 64 nt, hsa; identical to SEQ ID NO: 175959

SEQ ID NO: 345763 - RNA, 64 nt, hsa; identical to SEQ ID NO: 175960

SEQ ID NO: 345764 - RNA, 64 nt, hsa; identical to SEQ ID NO: 175961

SEQ ID NO: 345765 - RNA, 64 nt, hsa; identical to SEQ ID NO: 175962

SEQ ID NO: 345766 - RNA, 64 nt, hsa; identical to SEQ ID NO: 175963

SEQ ID NO: 345767 - RNA, 64 nt, hsa; identical to SEQ ID NO: 175964

SEQ ID NO: 345768 - RNA, 64 nt, hsa; identical to SEQ ID NO: 175965

SEQ ID NO: 345769 - RNA, 64 nt, hsa; identical to SEQ ID NO: 175966

SEQ ID NO: 345770 - RNA, 64 nt, hsa; identical to SEQ ID NO: 175967

SEQ ID NO: 345771 - RNA, 64 nt, hsa; identical to SEQ ID NO: 175968

SEQ ID NO: 345772 - RNA, 64 nt, hsa; identical to SEQ ID NO: 175969

SEQ ID NO: 345773 - RNA, 64 nt, hsa; identical to SEQ ID NO: 175970

SEQ ID NO: 345774 - RNA, 64 nt, hsa; identical to SEQ ID NO: 175971

SEQ ID NO: 345775 - RNA, 64 nt, hsa; identical to SEQ ID NO: 175972

SEQ ID NO: 345776 - RNA, 64 nt, hsa; identical to SEQ ID NO: 175973

SEQ ID NO: 345777 - RNA, 64 nt, hsa; identical to SEQ ID NO: 175974

SEQ ID NO: 345778 - RNA, 64 nt, hsa; identical to SEQ ID NO: 175975

SEQ ID NO: 345779 - RNA, 64 nt, hsa; identical to SEQ ID NO: 175976

SEQ ID NO: 345780 - RNA, 64 nt, hsa; identical to SEQ ID NO: 175977

SEQ ID NO: 345781 - RNA, 64 nt, hsa; identical to SEQ ID NO: 175978

SEQ ID NO: 345782 - RNA, 64 nt, hsa; identical to SEQ ID NO: 175979

SEQ ID NO: 345783 - RNA, 64 nt, hsa; identical to SEQ ID NO: 175980

SEQ ID NO: 345784 - RNA, 64 nt, hsa; identical to SEQ ID NO: 175981

SEQ ID NO: 345785 - RNA, 64 nt, hsa; identical to SEQ ID NO: 175982

SEQ ID NO: 345786 - RNA, 64 nt, hsa; identical to SEQ ID NO: 175983

SEQ ID NO: 345787 - RNA, 64 nt, hsa; identical to SEQ ID NO: 175984

SEQ ID NO: 345788 - RNA, 64 nt, hsa; identical to SEQ ID NO: 175985

SEQ ID NO: 345789 - RNA, 64 nt, hsa; identical to SEQ ID NO: 175986

SEQ ID NO: 345790 - RNA, 64 nt, hsa; identical to SEQ ID NO: 175987

SEQ ID NO: 345791 - RNA, 64 nt, hsa; identical to SEQ ID NO: 175988

SEQ ID NO: 345792 - RNA, 64 nt, hsa; identical to SEQ ID NO: 175989

SEQ ID NO: 345793 - RNA, 64 nt, hsa; identical to SEQ ID NO: 175990

SEQ ID NO: 345794 - RNA, 64 nt, hsa; identical to SEQ ID NO: 175991

SEQ ID NO: 345795 - RNA, 64 nt, hsa; identical to SEQ ID NO: 175992

SEQ ID NO: 345796 - RNA, 64 nt, hsa; identical to SEQ ID NO: 175993

SEQ ID NO: 345797 - RNA, 64 nt, hsa; identical to SEQ ID NO: 175994

SEQ ID NO: 345798 - RNA, 64 nt, hsa; identical to SEQ ID NO: 175995

SEQ ID NO: 345799 - RNA, 64 nt, hsa; identical to SEQ ID NO: 175996

SEQ ID NO: 345800 - RNA, 64 nt, hsa; identical to SEQ ID NO: 175997

SEQ ID NO: 345801 - RNA, 62 nt, hsa; identical to SEQ ID NO: 175998

SEQ ID NO: 345802 - RNA, 64 nt, hsa; identical to SEQ ID NO: 175999

SEQ ID NO: 345803 - RNA, 64 nt, hsa; identical to SEQ ID NO: 176000

SEQ ID NO: 345804 - RNA, 64 nt, hsa; identical to SEQ ID NO: 176001

SEQ ID NO: 345805 - RNA, 64 nt, hsa; identical to SEQ ID NO: 176002

SEQ ID NO: 345806 - RNA, 64 nt, hsa; identical to SEQ ID NO: 176003

SEQ ID NO: 345807 - RNA, 64 nt, hsa; identical to SEQ ID NO: 176004

SEQ ID NO: 345808 - RNA, 64 nt, hsa; identical to SEQ ID NO: 176005

SEQ ID NO: 345809 - RNA, 64 nt, hsa; identical to SEQ ID NO: 176006

SEQ ID NO: 345810 - RNA, 64 nt, hsa; identical to SEQ ID NO: 176007

SEQ ID NO: 345811 - RNA, 64 nt, hsa; identical to SEQ ID NO: 176008

SEQ ID NO: 345812 - RNA, 64 nt, hsa; identical to SEQ ID NO: 176009

SEQ ID NO: 345813 - RNA, 64 nt, hsa; identical to SEQ ID NO: 176010

SEQ ID NO: 345814 - RNA, 64 nt, hsa; identical to SEQ ID NO: 176011

SEQ ID NO: 345815 - RNA, 64 nt, hsa; identical to SEQ ID NO: 176012

SEQ ID NO: 345816 - RNA, 64 nt, hsa; identical to SEQ ID NO: 176013

SEQ ID NO: 345817 - RNA, 64 nt, hsa; identical to SEQ ID NO: 176014

SEQ ID NO: 345818 - RNA, 64 nt, hsa; identical to SEQ ID NO: 176015

SEQ ID NO: 345819 - RNA, 64 nt, hsa; identical to SEQ ID NO: 176016

SEQ ID NO: 345820 - RNA, 64 nt, hsa; identical to SEQ ID NO: 176017

SEQ ID NO: 345821 - RNA, 64 nt, hsa; identical to SEQ ID NO: 176018

SEQ ID NO: 345822 - RNA, 64 nt, hsa; identical to SEQ ID NO: 176019

SEQ ID NO: 345823 - RNA, 64 nt, hsa; identical to SEQ ID NO: 176020

SEQ ID NO: 345824 - RNA, 64 nt, hsa; identical to SEQ ID NO: 176021

SEQ ID NO: 345825 - RNA, 64 nt, hsa; identical to SEQ ID NO: 176022

SEQ ID NO: 345826 - RNA, 64 nt, hsa; identical to SEQ ID NO: 176023

SEQ ID NO: 345827 - RNA, 64 nt, hsa; identical to SEQ ID NO: 176024

SEQ ID NO: 345828 - RNA, 64 nt, hsa; identical to SEQ ID NO: 176025

SEQ ID NO: 345829 - RNA, 64 nt, hsa; identical to SEQ ID NO: 176026

SEQ ID NO: 345830 - RNA, 64 nt, hsa; identical to SEQ ID NO: 176027

SEQ ID NO: 345831 - RNA, 64 nt, hsa; identical to SEQ ID NO: 176028

SEQ ID NO: 345832 - RNA, 64 nt, hsa; identical to SEQ ID NO: 176029

SEQ ID NO: 345833 - RNA, 59 nt, hsa; identical to SEQ ID NO: 176030

SEQ ID NO: 345834 - RNA, 56 nt, hsa; identical to SEQ ID NO: 176031

SEQ ID NO: 345835 - RNA, 64 nt, hsa; identical to SEQ ID NO: 176032

SEQ ID NO: 345836 - RNA, 64 nt, hsa; identical to SEQ ID NO: 176033

SEQ ID NO: 345837 - RNA, 64 nt, hsa; identical to SEQ ID NO: 176034

SEQ ID NO: 345838 - RNA, 64 nt, hsa; identical to SEQ ID NO: 176035

SEQ ID NO: 345839 - RNA, 64 nt, hsa; identical to SEQ ID NO: 176036

SEQ ID NO: 345840 - RNA, 64 nt, hsa; identical to SEQ ID NO: 176037

SEQ ID NO: 345841 - RNA, 64 nt, hsa; identical to SEQ ID NO: 176038

SEQ ID NO: 345842 - RNA, 64 nt, hsa; identical to SEQ ID NO: 176039

SEQ ID NO: 345843 - RNA, 64 nt, hsa; identical to SEQ ID NO: 176040

SEQ ID NO: 345844 - RNA, 64 nt, hsa; identical to SEQ ID NO: 176041

SEQ ID NO: 345845 - RNA, 64 nt, hsa; identical to SEQ ID NO: 176042

SEQ ID NO: 345846 - RNA, 64 nt, hsa; identical to SEQ ID NO: 176043

SEQ ID NO: 345847 - RNA, 64 nt, hsa; identical to SEQ ID NO: 176044

SEQ ID NO: 345848 - RNA, 64 nt, hsa; identical to SEQ ID NO: 176045

SEQ ID NO: 345849 - RNA, 64 nt, hsa; identical to SEQ ID NO: 176046

SEQ ID NO: 345850 - RNA, 64 nt, hsa; identical to SEQ ID NO: 176047

SEQ ID NO: 345851 - RNA, 64 nt, hsa; identical to SEQ ID NO: 176048

SEQ ID NO: 345852 - RNA, 64 nt, hsa; identical to SEQ ID NO: 176049

SEQ ID NO: 345853 - RNA, 64 nt, hsa; identical to SEQ ID NO: 176050

SEQ ID NO: 345854 - RNA, 64 nt, hsa; identical to SEQ ID NO: 176051

SEQ ID NO: 345855 - RNA, 64 nt, hsa; identical to SEQ ID NO: 176052

SEQ ID NO: 345856 - RNA, 64 nt, hsa; identical to SEQ ID NO: 176053

SEQ ID NO: 345857 - RNA, 64 nt, hsa; identical to SEQ ID NO: 176054

SEQ ID NO: 345858 - RNA, 64 nt, hsa; identical to SEQ ID NO: 176055

SEQ ID NO: 345859 - RNA, 64 nt, hsa; identical to SEQ ID NO: 176056

SEQ ID NO: 345860 - RNA, 64 nt, hsa; identical to SEQ ID NO: 176057

SEQ ID NO: 345861 - RNA, 64 nt, hsa; identical to SEQ ID NO: 176058

SEQ ID NO: 345862 - RNA, 64 nt, hsa; identical to SEQ ID NO: 176059

SEQ ID NO: 345863 - RNA, 64 nt, hsa; identical to SEQ ID NO: 176060

SEQ ID NO: 345864 - RNA, 64 nt, hsa; identical to SEQ ID NO: 176061

SEQ ID NO: 345865 - RNA, 64 nt, hsa; identical to SEQ ID NO: 176062

SEQ ID NO: 345866 - RNA, 64 nt, hsa; identical to SEQ ID NO: 176063

SEQ ID NO: 345867 - RNA, 64 nt, hsa; identical to SEQ ID NO: 176064

SEQ ID NO: 345868 - RNA, 64 nt, hsa; identical to SEQ ID NO: 176065

SEQ ID NO: 345869 - RNA, 64 nt, hsa; identical to SEQ ID NO: 176066

SEQ ID NO: 345870 - RNA, 64 nt, hsa; identical to SEQ ID NO: 176067

SEQ ID NO: 345871 - RNA, 64 nt, hsa; identical to SEQ ID NO: 176068

SEQ ID NO: 345872 - RNA, 64 nt, hsa; identical to SEQ ID NO: 176069

SEQ ID NO: 345873 - RNA, 64 nt, hsa; identical to SEQ ID NO: 176070

SEQ ID NO: 345874 - RNA, 64 nt, hsa; identical to SEQ ID NO: 176071

SEQ ID NO: 345875 - RNA, 64 nt, hsa; identical to SEQ ID NO: 176072

SEQ ID NO: 345876 - RNA, 64 nt, hsa; identical to SEQ ID NO: 176073

SEQ ID NO: 345877 - RNA, 64 nt, hsa; identical to SEQ ID NO: 176074

SEQ ID NO: 345878 - RNA, 64 nt, hsa; identical to SEQ ID NO: 176075

SEQ ID NO: 345879 - RNA, 62 nt, hsa
aacugguuuuaaaaucaguggaaaagggcagguugaaucaaggugaaucaaucugaaauuga

SEQ ID NO: 345880 - RNA, 62 nt, hsa
cauggguaaauaauuugucauuaaacuuguguuugaaucaugaauucccuuguuucaaaaga

SEQ ID NO: 345881 - RNA, 62 nt, hsa
cauuauuuuguauuuuaaauacauaaauaggauugaaucaacuagaaaugaaucuauauguu

SEQ ID NO: 345882 - RNA, 62 nt, hsa
caaguaguaccaguuuuaagguuuuaauucauuugaaucacuuaugaauugaugauauacag

SEQ ID NO: 345883 - RNA, 62 nt, hsa
aacuuaucauaaggaaaaauagaaaggaaaacuugaaucaauacucauugauuaaaauggaa

SEQ ID NO: 345884 - RNA, 62 nt, hsa
uggauacuaaaugacagccuuguuucuccccuuugaaucagcagacaccauggauuauauuc

SEQ ID NO: 345885 - RNA, 62 nt, hsa
ucaggugauacugcugcaguaaucauagcuguuugaaucaggaauaaucccaaucacauuuu

SEQ ID NO: 345886 - RNA, 62 nt, hsa
gaaaggagauugguaaggaagugugauacauauugaaucaggugucaagguaccauuugugc

SEQ ID NO: 345887 - RNA, 62 nt, hsa
ccagaauuuaaaccuauacucacuuucccaaauugaaucacugcucacacugcugaugauuu

SEQ ID NO: 345888 - RNA, 62 nt, hsa
caccaagcugcuguggccaucaaccucuguauuugaaucagccuacaggccucacacacaau

SEQ ID NO: 345889 - RNA, 62 nt, hsa
guuauguggugacuauuugaaucaaaaauguauugaaucaucaaauaaaagaauguggcuau

SEQ ID NO: 345890 - RNA, 62 nt, hsa
uuaauaucgugccuagguuauguggugacuauuugaaucaaaaauguauugaaucaucaaau

SEQ ID NO: 345891 - RNA, 62 nt, hsa
uaaggaaaugggggugaaauauuuuuuuauuguugaaucauuuugugaaugucccccucaaa

SEQ ID NO: 345892 - RNA, 62 nt, hsa; identical to SEQ ID NO: 176089

SEQ ID NO: 345893 - RNA, 62 nt, hsa
uggauagaaauauauuuuugcuaguucuaggcuugaaucaugggcuccuuggcuuuccuagc

SEQ ID NO: 345894 - RNA, 62 nt, hsa
aauuuuuugcucaccgccauguuuaaaugggguugaaucauagcgagccauuugcucuugcc

SEQ ID NO: 345895 - RNA, 62 nt, hsa
uuuucacucuugauaagcuuauaaaaucaugauugaaucagcuuuaaagcaucauaccauca

SEQ ID NO: 345896 - RNA, 62 nt, hsa
aauuugcuugucaucacaaugaaguauguuuuuugaaucaucaauucuuucucauucuccau

SEQ ID NO: 345897 - RNA, 62 nt, hsa
uugauaagccauacaugagacugcagauuauauugaaucauauuaaauguacagaaauaaaa

SEQ ID NO: 345898 - RNA, 62 nt, hsa
aaacuucauguucaaguagaaguucucuaccauugaaucagugaacuagaaagaucugauuu

SEQ ID NO: 345899 - RNA, 62 nt, hsa
augaaaugcacucuucucgaugaggccucgauuugaaucaauggggugggccacaggaaaug

SEQ ID NO: 345900 - RNA, 62 nt, hsa
gaccuuucuucccuucccuuggagguaucccuuugaaucaggccucucucuucucaucaguc

SEQ ID NO: 345901 - RNA, 64 nt, hsa
agcacucuacuuaaguauucucuguguuuuaugaagagaaaaugaucugauuuucccuuauacu

SEQ ID NO: 345902 - RNA, 64 nt, hsa
ucugggauauucuguggguuuuggcauauuagauagagaaaaugacagaucuagaugaagggag

SEQ ID NO: 345903 - RNA, 64 nt, hsa
aagcccagaaaaacucucauuugcucaaagucacagagaaaauuaguggcaaagccaaaaagau

SEQ ID NO: 345904 - RNA, 64 nt, hsa
auauauauuguauacuguauucuuaaaguaagcuagagaaaagaaaauguuacuuagaaaauca

SEQ ID NO: 345905 - RNA, 64 nt, hsa
agaaaagaaaauguuacuuagaaaaucauaaggaagagaaaauauauuuacuguguuuaucaau

SEQ ID NO: 345906 - RNA, 64 nt, hsa
ggcuggggccccuauaacaaaagacagauugacaagagaaaaacaaacauaaauuuauuagcgg

SEQ ID NO: 345907 - RNA, 64 nt, hsa
acagaagcugcaaaagggaucuucgaaacugggcagagaaaaaauaaaguggaauauuaaguaa

SEQ ID NO: 345908 - RNA, 64 nt, hsa
cuuuagggaccagguagacuuuaaaacgaggguaagagaaaagccagugucuuucugagguaaa

SEQ ID NO: 345909 - RNA, 64 nt, hsa
cuugggcucuggagcuuuccccaagaauuacaucagagaaaaggaagaaggggccugcaggacc

SEQ ID NO: 345910 - RNA, 64 nt, hsa
gaagguuggaucuuggguuuggucuacccacccaagagaaaagacuguuaacuggaagaaaaaa

SEQ ID NO: 345911 - RNA, 64 nt, hsa
cuuuuacucaacuaacuacucaacucauaucuggagagaaaaccuaggaguuucucaucuauga

SEQ ID NO: 345912 - RNA, 64 nt, hsa
aaaugaauauguugaucauuaggggugugggagcagagaaaauugugaaagugacucucacuaa

SEQ ID NO: 345913 - RNA, 64 nt, hsa
auuuaaaguaaggccuuuaguaaugaauguaaugagagaaaauguuuugaaaagaacaaaacau

SEQ ID NO: 345914 - RNA, 64 nt, hsa
aaacauuuuguuaaccuauggaaaaagccuuggaagagaaaaguagaauucaguauguauggag

SEQ ID NO: 345915 - RNA, 64 nt, hsa
uccuagaaaacaggaugccugucacugauaaguuagagaaaacacccaaauuauacuugcacua

SEQ ID NO: 345916 - RNA, 64 nt, hsa
guaugaauuugucacauguaucacccccaaaaaaagagaaaaagaaaaauagaagacauauaaa

SEQ ID NO: 345917 - RNA, 64 nt, hsa
guuaaugucauuagugacaaagauuugcaacauuagagaaaagagacacaaauauaaaauuaaa

SEQ ID NO: 345918 - RNA, 64 nt, hsa
aaacugaaggcagaauggaacuaauauauguaacagagaaaaacaauaaauuuuaugaacuugu

SEQ ID NO: 345919 - RNA, 64 nt, hsa
aaaucguauauaugagcuauacuuuaacauuaugagagaaaagcauaaaacaaaaauagguagu

SEQ ID NO: 345920 - RNA, 64 nt, hsa
auaucuauuauucuccuaaacgaaugccuagcauagagaaaauacuuaauacacauuuguugac

SEQ ID NO: 345921 - RNA, 64 nt, hsa
gagggcguuggccaucucuacauuuugugaggugagagaaaacuaauguuuacuuucugcugug

SEQ ID NO: 345922 - RNA, 64 nt, hsa
acacccagaaugagccagaagacaugaugaaaaaagagaaaaagucugaagcucugaauaucag

SEQ ID NO: 345923 - RNA, 64 nt, hsa
aucaucugaacagaagugcacaggcuacuuguacagagaaaaaauuaauacucaaaggaaaucu

SEQ ID NO: 345924 - RNA, 64 nt, hsa
gacauucugcaccagcuaccucugccuccauggcagagaaaaggccauaagaacaguggaagag

SEQ ID NO: 345925 - RNA, 64 nt, hsa
aagugacgaggaagguucuguuuugaguauagccagagaaaacaaggauggagaaaaaucuagg

SEQ ID NO: 345926 - RNA, 64 nt, hsa
aagugaugagaaggauucuuuuucgaauauaaccagagaaaaaaaggauggagaaauaucuagg

SEQ ID NO: 345927 - RNA, 64 nt, hsa
aagugacgaggaagauucuguuuuggguauagccagagaaaacaaggauggagaaaaaucuagg

SEQ ID NO: 345928 - RNA, 64 nt, hsa
ugcccugaaccuguaagcaucaaauaagcaugagagagaaaaaaacaugauauauugcuuuacu

SEQ ID NO: 345929 - RNA, 64 nt, hsa
ccggaguaggucccguguagcaugcgggugcuguagagaaaauucagugacguacauggcucug

SEQ ID NO: 345930 - RNA, 64 nt, hsa
aguuaauaagcaaaauccugacuauuauguuguuagagaaaaaugcuuugcuuugucuggaaga

SEQ ID NO: 345931 - RNA, 64 nt, hsa
uacuuuuuuccaauuuuagaaaaucaagcagguuagagaaaauagagaugaauuaggggacacu

SEQ ID NO: 345932 - RNA, 64 nt, hsa
cacaaaggcuuaaaggcagugaaaauggccagccagagaaaagaucucaagaaccagaaauaaa

SEQ ID NO: 345933 - RNA, 64 nt, hsa
ggagcuagacacaaugaaacaucagagccagcuaagagaaaagaaauauuuggaggauauugaa

SEQ ID NO: 345934 - RNA, 64 nt, hsa
uauagcuuucccaugguagccugauaaggcugagagagaaaaauaugugcaguaucucauccuc

SEQ ID NO: 345935 - RNA, 64 nt, hsa
ugaucacauggcaguugcaguaacuuguauggaaagagaaaaugcaaugagcccaguuacugca

SEQ ID NO: 345936 - RNA, 64 nt, hsa
cacguguaaggugaugugcacauaucaagaagucagagaaaacacuuuccuggauaaaaaagaa

SEQ ID NO: 345937 - RNA, 64 nt, hsa
guguucuccacuaauacugguuauccugugcuacagagaaaaucaaagcagucauaagcuccag

SEQ ID NO: 345938 - RNA, 64 nt, hsa
aauccagacuugggggucauuguguugcuacccaagagaaaaugcuacaguuuuauagauugca

SEQ ID NO: 345939 - RNA, 64 nt, hsa
auucagccguauugcacagaugagcaauuacagcagagaaaauucauuagugcucccacucaua

SEQ ID NO: 345940 - RNA, 64 nt, hsa
ugcagccaccagugggagagacaagccaguccuaagagaaaaggugguggcagccacaaauucu

SEQ ID NO: 345941 - RNA, 64 nt, hsa
aguauuuuguggaauguacuauauagcaagauacagagaaaauuguuuuggcaugucagagccu

SEQ ID NO: 345942 - RNA, 64 nt, hsa
ucuauuacccacuacaugacaugugggccaagugagagaaaaguguccuucaguuucucaguau

SEQ ID NO: 345943 - RNA, 64 nt, hsa
uuccaguuccguucugagagaaaaagagagagagagagaaaaagaccaugcugcauacauucug

SEQ ID NO: 345944 - RNA, 64 nt, hsa
gagcaaacauguugcuguuuccaguuccguucugagagaaaaagagagagagagagaaaaagac

SEQ ID NO: 345945 - RNA, 64 nt, hsa
auagaguuguaauguuuuauauguguauggugcaagagaaaauuggaucaaaucaaucugcagu

SEQ ID NO: 345946 - RNA, 64 nt, hsa
ccacacugugcaugcacccuugcuugccuuuuucagagaaaaagaaaauuuuacaacaggauca

SEQ ID NO: 345947 - RNA, 64 nt, hsa
uuagagaaaauguggaggaaauaauaugacacuuagagaaaaaggaagguuuauucuugucuua

SEQ ID NO: 345948 - RNA, 64 nt, hsa
gagguaggugaacauuccaggaaagaagcagcuuagagaaaauguggaggaaauaauaugacac

SEQ ID NO: 345949 - RNA, 64 nt, hsa
ucagaaagaaaugucuuuauacaaaagacaugauagagaaaagaugagagaggggacuaauuau

SEQ ID NO: 345950 - RNA, 64 nt, hsa
uaaagcagagagaacccagguuagaaggaugggaagagaaaaggagcaguuuuauugcuuauag

SEQ ID NO: 345951 - RNA, 64 nt, hsa
auaugcacugaaacauguggucuggucugacuugagagaaaaggaauguugcacaaggguugug

SEQ ID NO: 345952 - RNA, 64 nt, hsa
uuggcccuucuguaauaggagauguaaucaguguagagaaaaccgugaagagaugccuuuugga

SEQ ID NO: 345953 - RNA, 64 nt, hsa
ucccagaugguaaagacugaagggaaaggagcaaagagaaaaaccuccgaggaagagaagaaug

SEQ ID NO: 345954 - RNA, 64 nt, hsa
uaaagagacugguagcucaucauccuaccauaaaagagaaaaaaauucggaaagugaucagagc

SEQ ID NO: 345955 - RNA, 64 nt, hsa
agauugaugacaagcaaguuacucaggaaucaaaagagaaaaaaguuucugaaaacaaugaaac

SEQ ID NO: 345956 - RNA, 64 nt, hsa
ucuauguacuguaauagugugauuacuaugcucuagagaaaagucuaccccugcuaaggaguuc

SEQ ID NO: 345957 - RNA, 64 nt, hsa
ccaaaagagaucacaauacucaaaagagagagagagagaaaaaagagagaucuugauccacaga

SEQ ID NO: 345958 - RNA, 64 nt, hsa
agagcaagaaaagagaaaauauuaaaacgaggagagagaaaaauaauauuaacacaaaaaaaug

SEQ ID NO: 345959 - RNA, 64 nt, hsa
aguuuaaacccaccauguauggaagagcaagaaaagagaaaauauuaaaacgaggagagagaaa

SEQ ID NO: 345960 - RNA, 64 nt, hsa
aaugagcaaacaaaaaaaucgaaagacaaacgggagagaaaaagaggaagggaacuuauuucuu

SEQ ID NO: 345961 - RNA, 64 nt, hsa
uuuuucccuucaguagugagcaguuuguauguacagagaaaauggacuuacaaaaacuugcagc

SEQ ID NO: 345962 - RNA, 64 nt, hsa
agcauuuagaaguuuuggauaugaaaaacagaagagagaaaaauauacauuauaaaagcagaac

SEQ ID NO: 345963 - RNA, 64 nt, hsa
auaaagccagaaugagaaauuaccaucuucuacuagagaaaaccaagagaaaaauuuuuaugcu

SEQ ID NO: 345964 - RNA, 64 nt, hsa
augagaaauuaccaucuucuacuagagaaaaccaagagaaaaauuuuuaugcuaggaugccuuu

SEQ ID NO: 345965 - RNA, 64 nt, hsa
auguuauguuuuuggcaugaacaaaagaaacaagagagaaaaaaaucaaaauaauuaaaauaaa

SEQ ID NO: 345966 - RNA, 64 nt, hsa
gagaaaaaaaucaaaauaauuaaaauaaauuguuagagaaaaguuacuuuaaaaauagcuauaa

SEQ ID NO: 345967 - RNA, 64 nt, hsa
ggcucuuugaauguaugucaaacucaguuacuccagagaaaaaacugccuuucccuucaaagug

SEQ ID NO: 345968 - RNA, 50 nt, hsa
auaacauccauaguguuuagagagaaaaaaauaaaccaauaaccuaccua

SEQ ID NO: 345969 - RNA, 64 nt, hsa
ccuacuucuaggauugcaaaggagucuuccaacuagagaaaaauuguccacugacauuugggau

SEQ ID NO: 345970 - RNA, 64 nt, hsa
aacagauccauguuaggacauuucugaauaauaaagagaaaagguguuucguuggguauugcag

SEQ ID NO: 345971 - RNA, 64 nt, hsa
auguuuacuguucagcaaaucugugccucuugauagagaaaaauacuaugugguuucuguaagu

SEQ ID NO: 345972 - RNA, 64 nt, hsa
auuuguucuuccugauaugauaacuaggucuccaagagaaaauagaaaggcugcuuuagugccu

SEQ ID NO: 345973 - RNA, 64 nt, hsa
auuaaagcuggaaggggcuaagagauuaguuuacagagaaaaggcuugguggugggauuuuuuu

SEQ ID NO: 345974 - RNA, 64 nt, hsa
cuccaguucucccugaugacaguagcugucuccaagagaaaaauccucacuuauuaacucucuu

SEQ ID NO: 345975 - RNA, 64 nt, hsa
guaucaugguguuuauuuucuuucuuauaacugcagagaaaauauccugacuaaaaaaaauuca

SEQ ID NO: 345976 - RNA, 64 nt, hsa
accucuuuuggguaugccuuuuaaaaaugcuuauagagaaaaaaaauuuuaaaaagaaagcuaa

SEQ ID NO: 345977 - RNA, 64 nt, hsa
cuuuuucuaaaaacuucaaguguuugauuaaaauagagaaaauaauuuuuaaaauaauagauaa

SEQ ID NO: 345978 - RNA, 64 nt, hsa
uuuuuuuuuugguauacugagcuuauagacuaugagagaaaagugagcaccaaaaacuucauua

SEQ ID NO: 345979 - RNA, 64 nt, hsa
uguauaucaugacuagcuuuuacucuugguuuacagagaaaaguuaaacagccaacuaggcagu

SEQ ID NO: 345980 - RNA, 64 nt, hsa
uuguuuuauauaccaaugacuuccauauuuuaaaagagaaaaacaacuuuauguugcaggaaac

SEQ ID NO: 345981 - RNA, 64 nt, hsa
gauuaaugucaauguuaaucagccccucaaagggagagaaaagcuggaccuuuucccuugcugu

SEQ ID NO: 345982 - RNA, 64 nt, hsa
gagauuucuacuucggagaggccaagucuaaugaagagaaaaaaaggaaaagaaguugcaagac

SEQ ID NO: 345983 - RNA, 64 nt, hsa
cagucuaucauauaaacaucuuuaacuauagccuagagaaaagaggguugaagagcaaagcaga

SEQ ID NO: 345984 - RNA, 64 nt, hsa
cuuauuuuuugccacugcaaacauauaucuacagagagaaaaauuaauggcauuuuaaagguua

SEQ ID NO: 345985 - RNA, 64 nt, hsa
uauuauacacuauauuccuacaauaaaguaagcuagagaaaauguuauuuagaaaaucauaaga

SEQ ID NO: 345986 - RNA, 64 nt, hsa
gcuagagaaaauguuauuuagaaaaucauaagaaagagaaaauauauuuacuauucauuaaaug

SEQ ID NO: 345987 - RNA, 64 nt, hsa
ccaguccugcagugucugugagcuguggaaugagagagaaaaccauggcugcucaggaaggaag

SEQ ID NO: 345988 - RNA, 64 nt, hsa
gaucugauuaauguuuccuuuccuuacaacagcuagagaaaacaucucaucacaauuggagacc

SEQ ID NO: 345989 - RNA, 64 nt, hsa
cucaagucuuagucgacauaaaagaauacacacuagagaaaaaccuuacaaaugugaagcaucu

SEQ ID NO: 345990 - RNA, 64 nt, hsa
guuggccuauauuaaacaacaaggaauucauuucagagaaaagcccuauacguguagugaaugu

SEQ ID NO: 345991 - RNA, 64 nt, hsa
acauuucaggcuuuacccaacaucgaaauaauggagagaaaauuguugauuauuuguuuaugaa

SEQ ID NO: 345992 - RNA, 64 nt, hsa
cauuugggcuuauuuagaaaaaaggguaagcuagagagaaaaagaaagaacuguccgucccccu

SEQ ID NO: 345993 - RNA, 51 nt, hsa
ugugguucuccuccaguugauagagaaaaacaacccagcgaaggcgccuuc

SEQ ID NO: 345994 - RNA, 64 nt, hsa
ccuuucucccagcuuugccgccugugcugccauuagagaaaaaaagaagcauaaucgugggcau

SEQ ID NO: 345995 - RNA, 64 nt, hsa
ccaaauuauugcuucaaccaucagucauaacucuagagaaaaacuucaucuucaucucggaauu

SEQ ID NO: 345996 - RNA, 64 nt, hsa
acuuaaguuuguaagacagugcccugagaccucuagagaaaagauguuuguuuacauaagagaa

SEQ ID NO: 345997 - RNA, 64 nt, hsa
ccaaagcaaggagaucauuuggagcucuugggucagagaaaaugagaaaggacagagccagcgg

SEQ ID NO: 345998 - RNA, 64 nt, hsa
uagcgcacccagagaaaauuaauuauauuucuacagagaaaaugaauuugggauacuaaaguag

SEQ ID NO: 345999 - RNA, 64 nt, hsa
auugauuuguuaugguuacauauuuagcgcacccagagaaaauuaauuauauuucuacagagaa

SEQ ID NO: 346000 - RNA, 64 nt, hsa
cacccaacccgagaugucaggaaaggccuucugcagagaaaauguccccccacccgccaucugc

SEQ ID NO: 346001 - RNA, 64 nt, hsa
ucuggguaucuuggcugaaaauuuuguuuuacauagagaaaaacgaucuuuuaagggucccuuu

SEQ ID NO: 346002 - RNA, 64 nt, hsa
aucuugccuuauccaggaauaauugccccuuugcagagaaaaaaaaaaacuuaaaaaaagcaca

SEQ ID NO: 346003 - RNA, 64 nt, hsa
cugcuagcuaggcaguaauaaacucuguuacagaagagaaaaagggccgggcacaguggcuuau

SEQ ID NO: 346004 - RNA, 64 nt, hsa
cugcucuacaggaauagcaugguuccagugaauuagagaaaaccugcuguaaagccaugguagu

SEQ ID NO: 346005 - RNA, 64 nt, hsa
agaaugagaagcuugaaugggcaguagaugaugaagagaaaaaaaagucucccucagaaaguac

SEQ ID NO: 346006 - RNA, 64 nt, hsa
acaaaagaaaaugcacucuaacuuaugugaacugagagaaaaaaaucagguuuuaaacaggaaa

SEQ ID NO: 346007 - RNA, 64 nt, hsa
uaauaaaacuguucucagacauuaagcuaaacuaagagaaaaauaacuuuguugccaaaagguu

SEQ ID NO: 346008 - RNA, 64 nt, hsa
aaauacuguaagucucaauuaacagcagaaucucagagaaaagcuguuugcaauccaaauccag

SEQ ID NO: 346009 - RNA, 64 nt, hsa
auauaaauaaaggaaccuuuuauacugacaaaccagagaaaaauggaccuuuuuccaguuaaaa

SEQ ID NO: 346010 - RNA, 64 nt, hsa
uaauucuagucagucauacaacuauaacuacuauagagaaaauaaaauuuuuuccuuuuuuuuu

SEQ ID NO: 346011 - RNA, 64 nt, hsa
gggaugucaguuaauuaaggggugaugauuugcaagagaaaauuaguggagagucacauaggua

SEQ ID NO: 346012 - RNA, 64 nt, hsa
aaucuauucuacaugaggaggcugagaaaggggaagagaaaaacaaaccaaauggaugauguua

SEQ ID NO: 346013 - RNA, 64 nt, hsa
aaggaaacacgaaagaaaagucaggaagguagagagagaaaaagggagggaaggagaaagaaug

SEQ ID NO: 346014 - RNA, 64 nt, hsa
ugaaaccuacaguugacaagagaauguacagcuaagagaaaagcuuaagaggccacacuauucg

SEQ ID NO: 346015 - RNA, 64 nt, hsa
cgucaccuagcugcugagcagaaaccgcaccccgagagaaaaucccauccucuguuccaaggcc

SEQ ID NO: 346016 - RNA, 64 nt, hsa
agaaauuuucuagcccaacucccuguuucaugaaagagaaaagaggcucagaaaaguuuagaga

SEQ ID NO: 346017 - RNA, 64 nt, hsa
gucauauuuagaacaaagucaaguauaaauuuacagagaaaaaauucuaagacaguuggauguu

SEQ ID NO: 346018 - RNA, 64 nt, hsa
guuuggcugcccacaggcaggaggagaagcaugaagagaaaaccuguuugagaaguuuuguuuu

SEQ ID NO: 346019 - RNA, 64 nt, hsa
uccacuauggugugugccuuuuauaaaggaaaagagagaaaaaggcaaagcaagguuguggccu

SEQ ID NO: 346020 - RNA, 64 nt, hsa
aagaucuugaaaagguaguuguuacuucguugucagagaaaaacacuugcccuuuuuccuggga

SEQ ID NO: 346021 - RNA, 64 nt, hsa
cauauaaaaacuuuaaugaauuaggauaacaagaagagaaaauaaagguaaaaacacuauuacc

SEQ ID NO: 346022 - RNA, 64 nt, hsa
gauucauaaaaguuauaaaauauuagguaaauacagagaaaacaauaagccucugaaauaaguc

SEQ ID NO: 346023 - RNA, 64 nt, hsa
cagaaaauagaaauacaaacaagguugguacaugagagaaaauguugaccuuuuacuuccuuuu

SEQ ID NO: 346024 - RNA, 64 nt, hsa
ggaggcaaaaagcacuucuuacauggcggcagcaagagaaaaugagaaagaagcaaaaguggaa

SEQ ID NO: 346025 - RNA, 64 nt, hsa
ggaggugaaaagcacuucguacauggugguggcaagagaaaaugaagaagaagcaaaaguggaa

SEQ ID NO: 346026 - RNA, 64 nt, hsa
ugucuugcauaguuaagccggacauuuuucugucagagaaaaggcaucauuguccgcuccauua

SEQ ID NO: 346027 - RNA, 64 nt, hsa
cuuuccaauuuauagaccaaaaaauuaacauccaagagaaaaguuauugucagauaccgcucuu

SEQ ID NO: 346028 - RNA, 64 nt, hsa
auuguccuuauagcauugcauacacaagaaaaacagagaaaagccugaucccugucaguggaaa

SEQ ID NO: 346029 - RNA, 64 nt, hsa
ccaggggcugguagacaagaacugugaaagagagagagaaaaaaccucaacuguguauuuuguc

SEQ ID NO: 346030 - RNA, 64 nt, hsa
aauuaauugcaguaaaaacaaaagaguaguggggagagaaaaacaauccaauacauauuuuucu

SEQ ID NO: 346031 - RNA, 64 nt, hsa
cauauuuuucucucagaauagaaagaaaacacaaagagaaaauaugaacaauauaaagcacuua

SEQ ID NO: 346032 - RNA, 64 nt, hsa
aggaucaucgccguugaaaugaaaagagagacagagagaaaaaaaaaaagagaacccacaugaa

SEQ ID NO: 346033 - RNA, 64 nt, hsa
ugcauuuugaugaauuuuuucuagccauuuuuaaagagaaaacuaggaauugaguauuuugugu

SEQ ID NO: 346034 - RNA, 64 nt, hsa
agcagguagcccaaaauagagaaagauuagauaaagagaaaauaaguauccaucagagacagua

SEQ ID NO: 346035 - RNA, 64 nt, hsa
uauccaucagagacaguaucucuaggcuugggcaagagaaaaguccacagugauaagcaacucc

SEQ ID NO: 346036 - RNA, 64 nt, hsa
auaagcaacuccaccuaaggcaugaauaugcggcagagaaaacagcaauagugaaugaaugcaa

SEQ ID NO: 346037 - RNA, 64 nt, hsa
ccuguagcuugaaaggggaaagauuggagguaagagagaaaaugaaagaacaccucuggguccu

SEQ ID NO: 346038 - RNA, 64 nt, hsa
gucuguaacugcugugcacugcuguaaacuuguuagagaaaaaaauaaccugcaugugggcucc

SEQ ID NO: 346039 - RNA, 64 nt, hsa
guagccucagguuugaaucagucaccuagggguaagagaaaaaccacaacauaagaccugaaaa

SEQ ID NO: 346040 - RNA, 64 nt, hsa
aaauuuuaggacuugaggacgugaacaacuugaaagagaaaauugauuccccuugaggaaagaa

SEQ ID NO: 346041 - RNA, 64 nt, hsa
gaguccuuugggauucuaggaaacccaaggaacaagagaaaaaacuagagccugugcuaaagaa

SEQ ID NO: 346042 - RNA, 64 nt, hsa
uugaaacccauuaggcaugccuaauauuuaggcaagagaaaauaaaccaagauagauccauuug

SEQ ID NO: 346043 - RNA, 64 nt, hsa
uaaagggaaccugcaauaaucuugaaaaagaaaaagagaaaaauuuuaaaauccugcuauagga

SEQ ID NO: 346044 - RNA, 64 nt, hsa
gaaaaauuuuaaaauccugcuauaggagaaaaaaagagaaaaaaauaaaaaucaaaaaaaaaaa

SEQ ID NO: 346045 - RNA, 64 nt, hsa
ugauaaaacauaaagguacaguggucuaugaggaagagaaaagguaccugaggaugcagaagua

SEQ ID NO: 346046 - RNA, 64 nt, hsa
uaccacaugggaaccguuuguccacacucauuccagagaaaaccgaguccucucaguugcacac

SEQ ID NO: 346047 - RNA, 64 nt, hsa
uaacuuucaggauguauuuuaaaugagcugcaagagagaaaaaucugacaggagaugggauuuu

SEQ ID NO: 346048 - RNA, 64 nt, hsa
aaauucaaauaauuauaagcauuuggcaaaaacaagagaaaagaaacuugccauauuuuacaag

SEQ ID NO: 346049 - RNA, 64 nt, hsa
cucagcaguuugugccuccuacacagucaaagaaagagaaaaaagauaaaguagaaaaagaaaa

SEQ ID NO: 346050 - RNA, 64 nt, hsa
uuuccuacucuaauucaacuaaaguuauaaauaaagagaaaaacucauucagaaaucauggauu

SEQ ID NO: 346051 - RNA, 64 nt, hsa
augugcuuaccacacugccacauuuuaaugagucagagaaaaauuaauuuuucuucaauacaau

SEQ ID NO: 346052 - RNA, 64 nt, hsa
cuaucaacuggagagcccacaaggcauagggaauagagaaaagggaaauguuuucaguuuucuu

SEQ ID NO: 346053 - RNA, 64 nt, hsa
guucauagaugggaagcuuccuuauaacugaugcagagaaaaauuaguccuucaaauacugcug

SEQ ID NO: 346054 - RNA, 64 nt, hsa
cccaaaauagcugcccuuaaagaguuguuagcagagagaaaaauaacagugaaugugcuccugg

SEQ ID NO: 346055 - RNA, 64 nt, hsa
aguauacacucagcaauaauuagaaaaaaaggagagagaaaagugauuuaaacaggguggauuc

SEQ ID NO: 346056 - RNA, 64 nt, hsa
uuaugagaauaucaguugguauaaagagagagaaagagaaaaacauuucagcccuuagaugagg

SEQ ID NO: 346057 - RNA, 64 nt, hsa
accccugagaaaugaacauugguaggagcauuuaagagaaaacuugcuuauuugcuaaugccua

SEQ ID NO: 346058 - RNA, 64 nt, hsa
guuacuuucaaugugaggaaugaaugauaaauuaagagaaaaaaauaucaggaaggucaauaua

SEQ ID NO: 346059 - RNA, 64 nt, hsa
aucuguaguuuagaguguaagaaguaauggguacagagaaaaaaaauuuaagaccaauauuuua

SEQ ID NO: 346060 - RNA, 64 nt, hsa
agaguuaauugcaaugugauaguggguagaaaggagagaaaaacccacugaaggguucaaauac

SEQ ID NO: 346061 - RNA, 64 nt, hsa
gcaaagaagggagagaagguacccaaagggaaaaagagaaaagcugaugcuggcaaggagcggg

SEQ ID NO: 346062 - RNA, 64 nt, hsa
uaauuauguuuggaugcagcagcugaauauauccagagaaaauaaacuuaagauuacuggccuu

SEQ ID NO: 346063 - RNA, 64 nt, hsa
ucuuuuuaaaaaaaauaacaacaaaaaaaaaaugagagaaaagcuaaaaaaaaaaaaguaaggg

SEQ ID NO: 346064 - RNA, 64 nt, hsa
uuuuuccggcuuaagccuuaagugccaaaucacaagagaaaaagcaguaacaguuuacagaagc

SEQ ID NO: 346065 - RNA, 64 nt, hsa
aaaaggcagaauacuggcaagaaaugaggaagagagagaaaaacaauauaacuuucuugagugc

SEQ ID NO: 346066 - RNA, 64 nt, hsa
gacucaguuuuauugagguagauacagguuuagaagagaaaagagcaacagauuuucagcguug

SEQ ID NO: 346067 - RNA, 64 nt, hsa
aagcaugaauuauuuucauauaaauauagaaaauagagaaaaggcuaugccuguaauuuuuaag

SEQ ID NO: 346068 - RNA, 64 nt, hsa
aaugcauggauuccuuugaagaaaaaaaagaaaaagagaaaaaaaucacaaaaacaaacuuuuu

SEQ ID NO: 346069 - RNA, 64 nt, hsa
cacacacacacacacacacacacgaaggagagagagagaaaacugauggggaaaacaagcugug

SEQ ID NO: 346070 - RNA, 64 nt, hsa
cggcugugcaucgcauucgaggcuccuuuuuuaaagagaaaagcauaggccucuguucucauuu

SEQ ID NO: 346071 - RNA, 64 nt, hsa
uccugaaguuugcugguucaggaaagaacaggaaagagaaaagccuucugugcccaggcuaaag

SEQ ID NO: 346072 - RNA, 64 nt, hsa
auccacagucuguuccuguucugauauucugagcagagaaaaggcacuaacgguuccucuuagc

SEQ ID NO: 346073 - RNA, 64 nt, hsa
uaauaauccuuauaaaauuggguucauaaaguuuagagaaaaggaauggaaaguacccagaacu

SEQ ID NO: 346074 - RNA, 64 nt, hsa
aaguacagugagcacaauuagccguaauaacauuagagaaaauguuuuuaaagaagccagcuca

SEQ ID NO: 346075 - RNA, 64 nt, hsa
uucuaaaugagguagaugaauauucugguucuucagagaaaauagacuuacuggccagugaucc

SEQ ID NO: 346076 - RNA, 64 nt, hsa
aaaaagguagaucugaaugcugauccccugugugagagaaaagaauggaauaagcagaaacugc

SEQ ID NO: 346077 - RNA, 64 nt, hsa
aagugugaggucuacuuuaaaaaaauucaaaugaagagaaaaagaaaaacagcauucuagaaau

SEQ ID NO: 346078 - RNA, 64 nt, hsa
gaacgaauuuugcaaguuuaauuugauuuauuucagagaaaauagaaaaaacaauguuagaagg

SEQ ID NO: 346079 - RNA, 64 nt, hsa
uauaguuacugaacugauucugagaaaucuuuagagagaaaaaacucaacaguacaaauuaacu

SEQ ID NO: 346080 - RNA, 64 nt, hsa
ugcaucuuugagugcaguuuggucugaccccucaagagaaaagcauggugccguagggcugcua

SEQ ID NO: 346081 - RNA, 64 nt, hsa
uaugaaaacacaaagcacaggucaggauccucugagagaaaaucaacauugcaccacguagggg

SEQ ID NO: 346082 - RNA, 64 nt, hsa
augagggcaacaggagauguggggacguguuaggagagaaaaaaaaaaaaacaaaaauauauau

SEQ ID NO: 346083 - RNA, 64 nt, hsa
aucaaccaacacaagaucaaaaaggaaaaggacgagagaaaaauuauuuuuaagauaauuaaac

SEQ ID NO: 346084 - RNA, 64 nt, hsa
cacccugaccgugcugaacagacccccccacacgagagaaaauaaaggagcaauaaagucacga

SEQ ID NO: 346085 - RNA, 64 nt, hsa
ccgcaagcagcugccugggggguguccaaggagcagagaaaacuacuagaugugaacuugaaga

SEQ ID NO: 346086 - RNA, 64 nt, hsa
cuaaaugggaaugcaaagcuugagcugcucugcaagagaaaauaagcaggacagaggauuugcu

SEQ ID NO: 346087 - RNA, 64 nt, hsa
ucauaaaugaaauauacuccgaguuucuugaagaagagaaaaucuucucagaaucaggucuaau

SEQ ID NO: 346088 - RNA, 64 nt, hsa
aaaagucaugcuuuauuuuagugagggcaauuacagagaaaagaguaagcagaaauguccuucu

SEQ ID NO: 346089 - RNA, 64 nt, hsa
ucauacgcauaauuggaucacuguguuuucacacagagaaaaaucacucgcccuucugagaggc

SEQ ID NO: 346090 - RNA, 64 nt, hsa
cuuacaaaugucuaagguccccacugccugcuggagagaaaacacacuccuuugcuuagcccac

SEQ ID NO: 346091 - RNA, 64 nt, hsa
gcuaaagggcauauguccucugcagauccacagcagagaaaaagucccgugcuugcuagucagg

SEQ ID NO: 346092 - RNA, 64 nt, hsa
gggucugggcucugucagccgccaccucugggaaagagaaaagguuuggguccacugaacauca

SEQ ID NO: 346093 - RNA, 64 nt, hsa
ucacaccccagugucacagggcgagcuguucuggagagaaaaccaucugucguggcugagcggg

SEQ ID NO: 346094 - RNA, 64 nt, hsa
ccagggucuggugauggcagggauggggggagagagagaaaauccacaaauuccaaugucacaa

SEQ ID NO: 346095 - RNA, 64 nt, hsa
aaaacagaaacccgagaaagagagagacagagagagagaaaaaaaaucacccaccaccccccca

SEQ ID NO: 346096 - RNA, 59 nt, hsa
ucacagccggacucgccuaaaaaccaaaaagagaaaacagaaacccgagaaagagagag

SEQ ID NO: 346097 - RNA, 64 nt, hsa
uaguauguuuuucuguguguauguuuagagcaacagagaaaaaaagaugugggagaggacauau

SEQ ID NO: 346098 - RNA, 64 nt, hsa
uggacguaauaagucuuauguacuuauuggugagagagaaaauccgugcauuguuuucaaaaga

SEQ ID NO: 346099 - RNA, 64 nt, hsa
uugaaugggguauuuacuguugauuaaccuccuuagagaaaauuaaugaaugagaugacuaacg

SEQ ID NO: 346100 - RNA, 64 nt, hsa
auuggugugaauugcuaagggaaaaaccuuaugcagagaaaaguuuuugacuggaaauacacug

SEQ ID NO: 346101 - RNA, 64 nt, hsa
cugggaucaguuauaauauauauuuuuuuuagaaagagaaaaugagcugagaguuuacaggcac

SEQ ID NO: 346102 - RNA, 64 nt, hsa
acuuggggagagaucaguagcauuugaggaaguaagagaaaagaaucaugguaccucaggguuu

SEQ ID NO: 346103 - RNA, 64 nt, hsa
gaagagaccugccagaagauuaaaaaaaagaaugagagaaaagcccaguuaguggugugcaaac

SEQ ID NO: 346104 - RNA, 64 nt, hsa
ucccucuuagaaucucuuaugaaaaaaugaucagagagaaaagugggguuuuguuuccccaccu

SEQ ID NO: 346105 - RNA, 64 nt, hsa
auauucuuuguuuagagguacuuguuuuuuauuaagagaaaaaccaguguaacguuuaugugac

SEQ ID NO: 346106 - RNA, 64 nt, hsa
caagggcuccuccaggauugcaaaaaaaaaaggaagagaaaagaugaaccuuuaagcaaauaag

SEQ ID NO: 346107 - RNA, 64 nt, hsa
cuuuccaacaccccugaaauucauagucaguagcagagaaaagcagaucccaauucaucccaca

SEQ ID NO: 346108 - RNA, 64 nt, hsa
uugaaaacauccugaaaggaacucauacagcacaagagaaaacuacuaagcuugacaucuguga

SEQ ID NO: 346109 - RNA, 64 nt, hsa
cugaacaacacuaacaugagaacacaagaacuuaagagaaaaagaaaccuacucaagaaaagac

SEQ ID NO: 346110 - RNA, 64 nt, hsa
ugagaaaagaacauaagaacucaaggagaacauaagagaaaaggaaaccuguuacagaaaagac

SEQ ID NO: 346111 - RNA, 64 nt, hsa
uacccuccgagaaagaagaacguaagcacaggaaagagaaaaagaaaucuguugaagaaaggac

SEQ ID NO: 346112 - RNA, 64 nt, hsa
gaccaucaagcaggucauaaacagaaacaucagaagagaaaacgacaccuagaagaaggcaaag

SEQ ID NO: 346113 - RNA, 64 nt, hsa
ugauuucuuuuagaauaugggaguaagaugagcuagagaaaauaaccuggucucacugugguug

SEQ ID NO: 346114 - RNA, 64 nt, hsa
aacuucauaaguaguauuaacuagggguaaauugagagaaaagcuccuuuucucuucacuguuu

SEQ ID NO: 346115 - RNA, 64 nt, hsa
gugagcucaaacaaaaacugcagacaaacaaaaaagagaaaagcuuuuauuuguguuuucaguu

SEQ ID NO: 346116 - RNA, 64 nt, hsa
gacacacacacacagacacacacaaagaaucagcagagaaaacaaaauacaaguccuguucugu

SEQ ID NO: 346117 - RNA, 64 nt, hsa; identical to SEQ ID NO: 53500

SEQ ID NO: 346118 - RNA, 64 nt, hsa; identical to SEQ ID NO: 53501

SEQ ID NO: 346119 - RNA, 64 nt, hsa; identical to SEQ ID NO: 53502

SEQ ID NO: 346120 - RNA, 64 nt, hsa; identical to SEQ ID NO: 53503

SEQ ID NO: 346121 - RNA, 64 nt, hsa; identical to SEQ ID NO: 53504

SEQ ID NO: 346122 - RNA, 64 nt, hsa; identical to SEQ ID NO: 53505

SEQ ID NO: 346123 - RNA, 64 nt, hsa; identical to SEQ ID NO: 53506

SEQ ID NO: 346124 - RNA, 64 nt, hsa; identical to SEQ ID NO: 53507

SEQ ID NO: 346125 - RNA, 64 nt, hsa; identical to SEQ ID NO: 53508

SEQ ID NO: 346126 - RNA, 64 nt, hsa; identical to SEQ ID NO: 53509

SEQ ID NO: 346127 - RNA, 64 nt, hsa; identical to SEQ ID NO: 53510

SEQ ID NO: 346128 - RNA, 64 nt, hsa; identical to SEQ ID NO: 53511

SEQ ID NO: 346129 - RNA, 64 nt, hsa; identical to SEQ ID NO: 53512

SEQ ID NO: 346130 - RNA, 64 nt, hsa; identical to SEQ ID NO: 53513

SEQ ID NO: 346131 - RNA, 64 nt, hsa; identical to SEQ ID NO: 53514

SEQ ID NO: 346132 - RNA, 64 nt, hsa; identical to SEQ ID NO: 53515

SEQ ID NO: 346133 - RNA, 64 nt, hsa; identical to SEQ ID NO: 53516

SEQ ID NO: 346134 - RNA, 64 nt, hsa; identical to SEQ ID NO: 53517

SEQ ID NO: 346135 - RNA, 64 nt, hsa; identical to SEQ ID NO: 53518

SEQ ID NO: 346136 - RNA, 64 nt, hsa; identical to SEQ ID NO: 53519

SEQ ID NO: 346137 - RNA, 64 nt, hsa; identical to SEQ ID NO: 53520

SEQ ID NO: 346138 - RNA, 54 nt, hsa; identical to SEQ ID NO: 53521

SEQ ID NO: 346139 - RNA, 64 nt, hsa; identical to SEQ ID NO: 53522

SEQ ID NO: 346140 - RNA, 64 nt, hsa; identical to SEQ ID NO: 53523

SEQ ID NO: 346141 - RNA, 64 nt, hsa; identical to SEQ ID NO: 53524

SEQ ID NO: 346142 - RNA, 64 nt, hsa; identical to SEQ ID NO: 53525

SEQ ID NO: 346143 - RNA, 64 nt, hsa; identical to SEQ ID NO: 53526

SEQ ID NO: 346144 - RNA, 64 nt, hsa; identical to SEQ ID NO: 53527

SEQ ID NO: 346145 - RNA, 64 nt, hsa; identical to SEQ ID NO: 53528

SEQ ID NO: 346146 - RNA, 64 nt, hsa; identical to SEQ ID NO: 53529

SEQ ID NO: 346147 - RNA, 64 nt, hsa; identical to SEQ ID NO: 53530

SEQ ID NO: 346148 - RNA, 64 nt, hsa; identical to SEQ ID NO: 53531

SEQ ID NO: 346149 - RNA, 64 nt, hsa; identical to SEQ ID NO: 53532

SEQ ID NO: 346150 - RNA, 64 nt, hsa; identical to SEQ ID NO: 53533

SEQ ID NO: 346151 - RNA, 64 nt, hsa; identical to SEQ ID NO: 53534

SEQ ID NO: 346152 - RNA, 64 nt, hsa; identical to SEQ ID NO: 53535

SEQ ID NO: 346153 - RNA, 64 nt, hsa; identical to SEQ ID NO: 53536

SEQ ID NO: 346154 - RNA, 64 nt, hsa; identical to SEQ ID NO: 53537

SEQ ID NO: 346155 - RNA, 64 nt, hsa; identical to SEQ ID NO: 53538

SEQ ID NO: 346156 - RNA, 64 nt, hsa; identical to SEQ ID NO: 53539

SEQ ID NO: 346157 - RNA, 64 nt, hsa; identical to SEQ ID NO: 53540

SEQ ID NO: 346158 - RNA, 64 nt, hsa; identical to SEQ ID NO: 53541

SEQ ID NO: 346159 - RNA, 64 nt, hsa; identical to SEQ ID NO: 53542

SEQ ID NO: 346160 - RNA, 64 nt, hsa; identical to SEQ ID NO: 53543

SEQ ID NO: 346161 - RNA, 64 nt, hsa
ggaaagacagauaauuucacugccccuuugagccaccacucacucuccuuauuacacaagcaca

SEQ ID NO: 346162 - RNA, 64 nt, hsa
ugugucccauggcuggucagagcccugggucaaaaccacucagcccaggggaggggaugaggca

SEQ ID NO: 346163 - RNA, 64 nt, hsa; identical to SEQ ID NO: 313188

SEQ ID NO: 346164 - RNA, 64 nt, hsa; identical to SEQ ID NO: 313189

SEQ ID NO: 346165 - RNA, 64 nt, hsa; identical to SEQ ID NO: 313190

SEQ ID NO: 346166 - RNA, 64 nt, hsa; identical to SEQ ID NO: 313191

SEQ ID NO: 346167 - RNA, 64 nt, hsa; identical to SEQ ID NO: 313192

SEQ ID NO: 346168 - RNA, 64 nt, hsa; identical to SEQ ID NO: 313193

SEQ ID NO: 346169 - RNA, 64 nt, hsa; identical to SEQ ID NO: 313194

SEQ ID NO: 346170 - RNA, 64 nt, hsa; identical to SEQ ID NO: 313195

SEQ ID NO: 346171 - RNA, 64 nt, hsa; identical to SEQ ID NO: 313196

SEQ ID NO: 346172 - RNA, 64 nt, hsa; identical to SEQ ID NO: 313197

SEQ ID NO: 346173 - RNA, 64 nt, hsa; identical to SEQ ID NO: 313198

SEQ ID NO: 346174 - RNA, 64 nt, hsa; identical to SEQ ID NO: 313199

SEQ ID NO: 346175 - RNA, 64 nt, hsa; identical to SEQ ID NO: 313200

SEQ ID NO: 346176 - RNA, 64 nt, hsa; identical to SEQ ID NO: 313201

SEQ ID NO: 346177 - RNA, 64 nt, hsa
auucaaaaacccuaaauuauucuagccaauuugucauaggcauaggcaaggaaagcuggccuug

SEQ ID NO: 346178 - RNA, 64 nt, hsa
aaacccuaaauuauucuagccaauuugucauaggcauaggcaaggaaagcuggccuugcuaacu

SEQ ID NO: 346179 - RNA, 64 nt, hsa
gagaagcaaacuuuuuugugacagauuguauuggcauaggcaugauagauggggauugguacgu

SEQ ID NO: 346180 - RNA, 64 nt, hsa
uuuuuaggaagcucugcaacagaugugaucugaucauaggcaauuagaacuggaagaaacuucc

SEQ ID NO: 346181 - RNA, 64 nt, hsa
uaucuaucuaucuaucuaucucuauuuauuuauguauuuagagaucaggucucacucuguugac

SEQ ID NO: 346182 - RNA, 64 nt, hsa
cauaaaucaaaaguuaauguaauuguuaucccauuauuuagagcgaaauaaauguugaauauau

SEQ ID NO: 346183 - RNA, 64 nt, hsa
ccugucuguguaaagauucaucuuuuauuguaaauauuuagacuuuaccacagaaauauuggaa

SEQ ID NO: 346184 - RNA, 64 nt, hsa
auuuuugaggucaaagaaccaguuguucucuuuauauuuagaugaggaugauugaguccauaua

SEQ ID NO: 346185 - RNA, 64 nt, hsa
aaagaaauucugacagaugacaucagaagacaccuauuuagaauguuacauuuaugaugggaau

SEQ ID NO: 346186 - RNA, 64 nt, hsa
gggcauuguagaguauccuaaauauguuaucaaguauuuagaguucuauauuuuaaagauauau

SEQ ID NO: 346187 - RNA, 64 nt, hsa
uauaccuguugagacugauucagaggagcaacccuauuuagaaauggauuuaucaucaccucaa

SEQ ID NO: 346188 - RNA, 64 nt, hsa
acaggcgugagccaccgcgccuggccgaugguacuauuuagauauaacacuauguuuauuuacu

SEQ ID NO: 346189 - RNA, 64 nt, hsa
auucauugcuguuccuaggugauaacuguccuaauauuuagauguccaaacaagaauacuucca

SEQ ID NO: 346190 - RNA, 64 nt, hsa
aaugacuccuagaguaaacuuuaggacccgguuuuauuuagacuuguuuucccguuuccuugaa

SEQ ID NO: 346191 - RNA, 64 nt, hsa
aucuuuuauuuuucuuuguuuuuauuuuuuuuuuuauuuagaugaccaaaggucauuacaaccu

SEQ ID NO: 346192 - RNA, 64 nt, hsa
uuuuuuucauugccaaaaacuaaauggugcuuuauauuuagauuggaaagaauuucauaugcaa

SEQ ID NO: 346193 - RNA, 64 nt, hsa
uuaccacuuuuuuuuuuuguuuuucgucauuuuauauuuagaucuccuguauucuuguucccga

SEQ ID NO: 346194 - RNA, 64 nt, hsa
aaaaaaugaggaauagcaaaauuccuguguucaauauuuagaaaauuuuguauuaauuucugau

SEQ ID NO: 346195 - RNA, 64 nt, hsa
auaauguguauuuuuuccucaauuauucuugaaauauuuagagccucuccugcuucuaacauga

SEQ ID NO: 346196 - RNA, 64 nt, hsa
guuaugguugcgcauaaauuaauaauuuuauaaguauuuagaaaugguauaauucucuuaacuu

SEQ ID NO: 346197 - RNA, 64 nt, hsa
uuccaugugcucuuaguucuauucuaaacaggcuuauuuagaaaaggauugcuuguaauguuug

SEQ ID NO: 346198 - RNA, 64 nt, hsa
auguggaaaauauuagaaacuacagaguuugcgauauuuagauacugaaauuuaugucaaaaua

SEQ ID NO: 346199 - RNA, 64 nt, hsa
ugugguuucuuugaacccauaucaaauguaugacuauuuagaguguuuauaagagauaauggaa

SEQ ID NO: 346200 - RNA, 64 nt, hsa
aucaagugauuuugaucuuuagugucaauauuuauauuuagauuaauuuuuauaaaugaaaaua

SEQ ID NO: 346201 - RNA, 64 nt, hsa
auaagauuuccugccgcuuuuugacaaucuuguguauuuagaaaaauguauuacuugaaaacau

SEQ ID NO: 346202 - RNA, 64 nt, hsa
uagaaaaguaagauuagugacauguguggguuuauauuuagauauuuaaggugcauuuucauag

SEQ ID NO: 346203 - RNA, 64 nt, hsa
ccucuccuuauuuuucuaauauuuagacuuugaauauuuagaacuagaguuccuauuuucagcu

SEQ ID NO: 346204 - RNA, 64 nt, hsa
cauuuugucauauccccucuccuuauuuuucuaauauuuagacuuugaauauuuagaacuagag

SEQ ID NO: 346205 - RNA, 64 nt, hsa
ggacauggugcauuuuuuuuucuuuuauuuguuuuauuuagaacuuuuuuuauuuguuuuauuu

SEQ ID NO: 346206 - RNA, 64 nt, hsa
uauuuguuuuauuuagaacuuuuuuuauuuguuuuauuuagaacuuuguguguucuuaaagugu

SEQ ID NO: 346207 - RNA, 64 nt, hsa
cagaaaauaaaaacauccaguuuguggaugacuauauuuagauuucucuagacucuaguggaag

SEQ ID NO: 346208 - RNA, 64 nt, hsa
ucagcucaacucaagauuucauaaucauuuuuaguauuuagauugugccucaaaguuguaguac

SEQ ID NO: 346209 - RNA, 64 nt, hsa
caagaccuaauagaaaauaagaaagcccauaauguauuuagaaacaggaauccucagagcaauu

SEQ ID NO: 346210 - RNA, 64 nt, hsa
auccucuaguauaagugaauuacuaguuucucuuuauuuagacaaacacacacacaccagauaa

SEQ ID NO: 346211 - RNA, 64 nt, hsa
uaucggaucugucguucuggaaagaagacccuucuauuuagaguagaaacaaacgaaacuucua

SEQ ID NO: 346212 - RNA, 64 nt, hsa
acaauuucucauugauguugugaaaaucgucauguauuuagacuugguguaguagccagaauuc

SEQ ID NO: 346213 - RNA, 64 nt, hsa
ccuaauuaggucauucaggacagcuaagucaguauauuuagagcaauacuagcauacguuuuuc

SEQ ID NO: 346214 - RNA, 64 nt, hsa
guuagcuaugggaauaacuugauuuuguauaagcuauuuagagugaggcuggagguggcagcuu

SEQ ID NO: 346215 - RNA, 64 nt, hsa
uacuuuaaugcuuaaaauuauacauaaaaugcuuuauuuagaaaaccuacaugauacaguggug

SEQ ID NO: 346216 - RNA, 64 nt, hsa
ccaauugauaaccaaucacauaguuuuaucaguguauuuagacacuaucuugaaaaucagauuu

SEQ ID NO: 346217 - RNA, 64 nt, hsa
auuaagacaaauauacauucaaaaagggagauuuuauuuagacacacauuuucuuuucacccua

SEQ ID NO: 346218 - RNA, 64 nt, hsa
uuauuuagacacacauuuucuuuucacccuaaucuauuuagauucauacuuauugagacgggaa

SEQ ID NO: 346219 - RNA, 64 nt, hsa
acauagguuuuguguaauaauuauuuguaaauauuauuuagauuuguauuuagacaugauuuau

SEQ ID NO: 346220 - RNA, 64 nt, hsa
uguaauaauuauuuguaaauauuauuuagauuuguauuuagacaugauuuauaucuaauauaga

SEQ ID NO: 346221 - RNA, 64 nt, hsa
uugccaaauagcauucuuauucacuuuaugccgguauuuagaaaaaauaaauuauagcaaguau

SEQ ID NO: 346222 - RNA, 64 nt, hsa
uuaauguauuaaaaagaaaauacaacaaaauguauauuuagacacgagcuuacauggcauaccu

SEQ ID NO: 346223 - RNA, 64 nt, hsa
uuuggguagauucacugaggcuaugucaacaugauauuuagaccaacaggugaucaauguuugg

SEQ ID NO: 346224 - RNA, 64 nt, hsa
caacaaugacuuauuuaaaaauuacccuuccugcuauuuagacaaaaacaacugaucagugguu

SEQ ID NO: 346225 - RNA, 64 nt, hsa
uuauuucauuuagaguucucuaucucuaaauauuuauuuagagaaugauuuuaaaagggaauga

SEQ ID NO: 346226 - RNA, 64 nt, hsa
uaugucaccaaccagacaguauuuccugcaugcuuauuuagaagaggcagcuuaucuugagagg

SEQ ID NO: 346227 - RNA, 64 nt, hsa
agccuucuaaaauaauugcauuccauggguuggguauuuagaaauguagguggcauuuagaaca

SEQ ID NO: 346228 - RNA, 64 nt, hsa
cugggaaccuuuuuuacuuccccauauuuguuauuauuuagaaugguucauacgucugcuuugu

SEQ ID NO: 346229 - RNA, 64 nt, hsa
uuccuuccaagcuuuuggaguuucucucguaucguauuuagaagauucugccuucccuaguagu

SEQ ID NO: 346230 - RNA, 64 nt, hsa
aagaucuaacugugaaaacauacauaccuguacauauuuagauauaagcugcuauauguugaau

SEQ ID NO: 346231 - RNA, 64 nt, hsa
cuuuuuuucucuuuuuacugcaacuuaauauuucuauuuagaacacagaaaaugaaaauauuua

SEQ ID NO: 346232 - RNA, 64 nt, hsa
uuaauauuucuauuuagaacacagaaaaugaaaauauuuagaauaaguuguacauuugaugaca

SEQ ID NO: 346233 - RNA, 64 nt, hsa
aauucacgaaaguacugcuccaccccaguugaguuauuuagaauuuuaucucaagugaaagcug

SEQ ID NO: 346234 - RNA, 64 nt, hsa
augcuagggaugaaccugaaaauucuauuacguuuauuuagauuucaaaggcaaauauugauuc

SEQ ID NO: 346235 - RNA, 64 nt, hsa
aaugaaguacuauuauugauaacuuauauauuuuuauuuagagcaaucccacaugcuuuucaca

SEQ ID NO: 346236 - RNA, 55 nt, hsa
ccggccccccagagaaaugagcuccugcuggcaucuggagaacaccccugugccu

SEQ ID NO: 346237 - RNA, 64 nt, hsa
gggccucaagcuggggugggaugaggaggcgcucugcuggcagugcugaggacggguacuccag

SEQ ID NO: 346238 - RNA, 64 nt, hsa
guagagagggccagagaugcccgcgugguagggcugcuggcaggcacacuggguguagcccaac

SEQ ID NO: 346239 - RNA, 64 nt, hsa
aggcacuggcccacuugcggaaccugacucaggcugcuggcaagcguagcuauguguuggcccu

SEQ ID NO: 346240 - RNA, 64 nt, hsa
gagauccacauaccauucucaaucccacugaaauugcuggcauucucaaaggcagggcagaggg

SEQ ID NO: 346241 - RNA, 64 nt, hsa
aaucagcucuguccuuggcgggacaguccuucccugcuggcagucucuucucguuggcucccuc

SEQ ID NO: 346242 - RNA, 64 nt, hsa
ugggauuacuagaaaaccugacuaauggugucacugcuggcaauggugauaauggauuaauucc

SEQ ID NO: 346243 - RNA, 64 nt, hsa
ucggauucccagaaaaccugacuaauggugccacugcuggcaauggugaugauggauuaauucc

SEQ ID NO: 346244 - RNA, 64 nt, hsa
caaccucuuuacucuuagucaaguggaaugugcaugcuggcaucugaauguccauucgccaggc

SEQ ID NO: 346245 - RNA, 64 nt, hsa
cugugcucucccugccuccccuagcccauaccucugcuggcaccuucuguaccaugccuucaga

SEQ ID NO: 346246 - RNA, 64 nt, hsa
agcagaucauguauuucccggagacgugggaccuugcuggcaugucuccuucacaaucaggcgu

SEQ ID NO: 346247 - RNA, 64 nt, hsa
cacagcccggcagaggggcacacucuggagaccuugcuggcagugcuagccaggaaacagagug

SEQ ID NO: 346248 - RNA, 64 nt, hsa
ccucagguauuguaaccacugggccuuccaacuuugcuggcaagcucugguaaccucccugacu

SEQ ID NO: 346249 - RNA, 64 nt, hsa
agcuucccuuuccacccuaccuagguucccuccuugcuggcauaaaggccaagcagugaaauga

SEQ ID NO: 346250 - RNA, 64 nt, hsa
auagcugccauccgaggcuuccuggucuaagaguugcuggcaagaagauggccgggcguggugg

SEQ ID NO: 346251 - RNA, 64 nt, hsa
guuggccacagcaugggaggaaagacagccaugcugcuggcacuacagagggugagccgcccau

SEQ ID NO: 346252 - RNA, 64 nt, hsa
gggcccaccaccuguccgucccuguccccuuuccugcuggcaggagccggcugccuaccagggg

SEQ ID NO: 346253 - RNA, 64 nt, hsa
acaguccugccgcagguacaugaugaugcgggacugcuggcaugcagugcccucacagagaccc

SEQ ID NO: 346254 - RNA, 64 nt, hsa
ucuaggggagacucugucuccugcuccuucaggcugcuggcagaauccacauccuuucgguggc

SEQ ID NO: 346255 - RNA, 64 nt, hsa
cugcuccauggggucugggagagcagccauccccugcuggcaccauagacccacacaaggagcc

SEQ ID NO: 346256 - RNA, 64 nt, hsa
gucagccguggccccaccuaccagaacugugcucugcuggcagcugugcuuuugccaaacccag

SEQ ID NO: 346257 - RNA, 64 nt, hsa
aucaaccgcuucugcuuccaagucacacggcugcugcuggcacacggggccgaccccagcgagu

SEQ ID NO: 346258 - RNA, 63 nt, hsa
acuguggccaguugagcuaaucuguggccagggugcuggcaugguggcagcugcaaaugucca

SEQ ID NO: 346259 - RNA, 64 nt, hsa
ucaggacguucauguggaugguuucaugucaucgugcuggcaacuuguccucccugccuuagag

SEQ ID NO: 346260 - RNA, 64 nt, hsa
cuggagccaacaccgccagccacccccucuggccugcuggcaaugccacaggugcccaagaaga

SEQ ID NO: 346261 - RNA, 64 nt, hsa
ccaguguccugccccugcuuggcccaguuuugauugcuggcaucuugccaccccagguaucccu

SEQ ID NO: 346262 - RNA, 64 nt, hsa
cuggauuucugcccaagaccagaggagugugcugugcuggcaaguguaagucccccaguugcuc

SEQ ID NO: 346263 - RNA, 64 nt, hsa
cuagggaggugggguagagcacucuccguccugcugcuggcaaggaaugggaacaguggcuguc

SEQ ID NO: 346264 - RNA, 64 nt, hsa
caccuucuggucucagcaagggaggagagucuguugcuggcauagcccuggaaggagcccccag

SEQ ID NO: 346265 - RNA, 64 nt, hsa
cccacccuccuggaagagacccccguguucagagugcuggcagcccugcacguguccagggaca

SEQ ID NO: 346266 - RNA, 64 nt, hsa
cacaucuuugaccacgucaucgggccagaaggcgugcuggcaggcaaggugaggccugccagag

SEQ ID NO: 346267 - RNA, 64 nt, hsa
gcugcuuuaggaauucugcaaggguucuuggugaugcuggcagccauggccauggcagcgggug

SEQ ID NO: 346268 - RNA, 64 nt, hsa
cuucaaauuacccaccugccucagccucccaaagugcuggcauuacaggcgcucgaggcuuucu

SEQ ID NO: 346269 - RNA, 64 nt, hsa
acucgggacugaggcauccucuguucacaggacaugcuggcaucuacugggucagggcucugcu

SEQ ID NO: 346270 - RNA, 64 nt, hsa
agcacguugaucugaacuuuaaaucaaucagugcugcuggcacaaugaaagguggaacugcacu

SEQ ID NO: 346271 - RNA, 64 nt, hsa
uuuuguauguguuuuaucagaauuugcuggacuaugcuggcaaggacuuuguuuacgaucaaau

SEQ ID NO: 346272 - RNA, 64 nt, hsa
ucauucuuugcucaagaaaggccugaaugacaauguccaggaugucugcacaacugagcagcuc

SEQ ID NO: 346273 - RNA, 64 nt, hsa
cacaaggucacucugaggauugaaacuugaucuuguccaggaaagcuuuguaccaaacagugaa

SEQ ID NO: 346274 - RNA, 64 nt, hsa
guguuuagaguuggggacaaggaugacaccgaagguccaggaguccaggacagcaggugcuggc

SEQ ID NO: 346275 - RNA, 64 nt, hsa
aguuggggacaaggaugacaccgaagguccaggaguccaggacagcaggugcuggccggugggg

SEQ ID NO: 346276 - RNA, 64 nt, hsa
aguggcugagcacguggaagccauugagggcagcguccaggagagcucgggcccugugaccacg

SEQ ID NO: 346277 - RNA, 64 nt, hsa
ccucccucaggccagcgagagauggagcuaccguguccaggaugaagcugcaggucugggggac

SEQ ID NO: 346278 - RNA, 64 nt, hsa
uucacugcugaggaguggccaguuggguccuugaguccaggagcguggggcggagggguggggc

SEQ ID NO: 346279 - RNA, 64 nt, hsa
acucugagcggccuccguccaggagccuggcuccguccaggagccugugccuccucacccccag

SEQ ID NO: 346280 - RNA, 59 nt, hsa
ggacgccgcagagacucugagcggccuccguccaggagccuggcuccguccaggagccu

SEQ ID NO: 346281 - RNA, 55 nt, hsa; identical to SEQ ID NO: 346236

SEQ ID NO: 346282 - RNA, 64 nt, hsa; identical to SEQ ID NO: 346237

SEQ ID NO: 346283 - RNA, 64 nt, hsa; identical to SEQ ID NO: 346238

SEQ ID NO: 346284 - RNA, 64 nt, hsa; identical to SEQ ID NO: 346239

SEQ ID NO: 346285 - RNA, 64 nt, hsa; identical to SEQ ID NO: 346240

SEQ ID NO: 346286 - RNA, 64 nt, hsa; identical to SEQ ID NO: 346241

SEQ ID NO: 346287 - RNA, 64 nt, hsa; identical to SEQ ID NO: 346242

SEQ ID NO: 346288 - RNA, 64 nt, hsa; identical to SEQ ID NO: 346243

SEQ ID NO: 346289 - RNA, 64 nt, hsa; identical to SEQ ID NO: 346244

SEQ ID NO: 346290 - RNA, 64 nt, hsa; identical to SEQ ID NO: 346245

SEQ ID NO: 346291 - RNA, 64 nt, hsa; identical to SEQ ID NO: 346246

SEQ ID NO: 346292 - RNA, 64 nt, hsa; identical to SEQ ID NO: 346247

SEQ ID NO: 346293 - RNA, 64 nt, hsa; identical to SEQ ID NO: 346248

SEQ ID NO: 346294 - RNA, 64 nt, hsa; identical to SEQ ID NO: 346249

SEQ ID NO: 346295 - RNA, 64 nt, hsa; identical to SEQ ID NO: 346250

SEQ ID NO: 346296 - RNA, 64 nt, hsa; identical to SEQ ID NO: 346251

SEQ ID NO: 346297 - RNA, 64 nt, hsa; identical to SEQ ID NO: 346252

SEQ ID NO: 346298 - RNA, 64 nt, hsa; identical to SEQ ID NO: 346253

SEQ ID NO: 346299 - RNA, 64 nt, hsa; identical to SEQ ID NO: 346254

SEQ ID NO: 346300 - RNA, 64 nt, hsa; identical to SEQ ID NO: 346255

SEQ ID NO: 346301 - RNA, 64 nt, hsa; identical to SEQ ID NO: 346256

SEQ ID NO: 346302 - RNA, 64 nt, hsa; identical to SEQ ID NO: 346257

SEQ ID NO: 346303 - RNA, 63 nt, hsa; identical to SEQ ID NO: 346258

SEQ ID NO: 346304 - RNA, 64 nt, hsa; identical to SEQ ID NO: 346259

SEQ ID NO: 346305 - RNA, 64 nt, hsa; identical to SEQ ID NO: 346260

SEQ ID NO: 346306 - RNA, 64 nt, hsa; identical to SEQ ID NO: 346261

SEQ ID NO: 346307 - RNA, 64 nt, hsa; identical to SEQ ID NO: 346262

SEQ ID NO: 346308 - RNA, 64 nt, hsa; identical to SEQ ID NO: 346263

SEQ ID NO: 346309 - RNA, 64 nt, hsa; identical to SEQ ID NO: 346264

SEQ ID NO: 346310 - RNA, 64 nt, hsa; identical to SEQ ID NO: 346265

SEQ ID NO: 346311 - RNA, 64 nt, hsa; identical to SEQ ID NO: 346266

SEQ ID NO: 346312 - RNA, 64 nt, hsa; identical to SEQ ID NO: 346267

SEQ ID NO: 346313 - RNA, 64 nt, hsa; identical to SEQ ID NO: 346268

SEQ ID NO: 346314 - RNA, 64 nt, hsa; identical to SEQ ID NO: 346269

SEQ ID NO: 346315 - RNA, 64 nt, hsa; identical to SEQ ID NO: 346270

SEQ ID NO: 346316 - RNA, 64 nt, hsa; identical to SEQ ID NO: 346271

SEQ ID NO: 346317 - RNA, 64 nt, hsa; identical to SEQ ID NO: 346272

SEQ ID NO: 346318 - RNA, 64 nt, hsa; identical to SEQ ID NO: 346273

SEQ ID NO: 346319 - RNA, 64 nt, hsa; identical to SEQ ID NO: 346274

SEQ ID NO: 346320 - RNA, 64 nt, hsa; identical to SEQ ID NO: 346275

SEQ ID NO: 346321 - RNA, 64 nt, hsa; identical to SEQ ID NO: 346276

SEQ ID NO: 346322 - RNA, 64 nt, hsa; identical to SEQ ID NO: 346277

SEQ ID NO: 346323 - RNA, 64 nt, hsa; identical to SEQ ID NO: 346278

SEQ ID NO: 346324 - RNA, 64 nt, hsa; identical to SEQ ID NO: 346279

SEQ ID NO: 346325 - RNA, 59 nt, hsa; identical to SEQ ID NO: 346280

SEQ ID NO: 346326 - RNA, 64 nt, hsa; identical to SEQ ID NO: 24356

SEQ ID NO: 346327 - RNA, 64 nt, hsa; identical to SEQ ID NO: 24357

SEQ ID NO: 346328 - RNA, 64 nt, hsa; identical to SEQ ID NO: 24358

SEQ ID NO: 346329 - RNA, 64 nt, hsa; identical to SEQ ID NO: 24359

SEQ ID NO: 346330 - RNA, 64 nt, hsa; identical to SEQ ID NO: 24360

SEQ ID NO: 346331 - RNA, 64 nt, hsa; identical to SEQ ID NO: 24361

SEQ ID NO: 346332 - RNA, 64 nt, hsa; identical to SEQ ID NO: 24362

SEQ ID NO: 346333 - RNA, 64 nt, hsa; identical to SEQ ID NO: 24363

SEQ ID NO: 346334 - RNA, 64 nt, hsa; identical to SEQ ID NO: 24364

SEQ ID NO: 346335 - RNA, 64 nt, hsa; identical to SEQ ID NO: 24365

SEQ ID NO: 346336 - RNA, 64 nt, hsa; identical to SEQ ID NO: 24366

SEQ ID NO: 346337 - RNA, 64 nt, hsa; identical to SEQ ID NO: 24367

SEQ ID NO: 346338 - RNA, 64 nt, hsa; identical to SEQ ID NO: 24368

SEQ ID NO: 346339 - RNA, 64 nt, hsa; identical to SEQ ID NO: 24369

SEQ ID NO: 346340 - RNA, 64 nt, hsa; identical to SEQ ID NO: 24370

SEQ ID NO: 346341 - RNA, 64 nt, hsa; identical to SEQ ID NO: 24371

SEQ ID NO: 346342 - RNA, 64 nt, hsa
agucgagccucaaugcuugcuacaaggauguauguacaaggacugacuuuaauaauuugcauua

SEQ ID NO: 346343 - RNA, 64 nt, hsa
uuaaaggugcuguuagucgagccucaaugcuugcuacaaggauguauguacaaggacugacuuu

SEQ ID NO: 346344 - RNA, 64 nt, hsa
cauucaccuugccaucugucuugucauuguacuguacaaggaacagcccucagacguguucugc

SEQ ID NO: 346345 - RNA, 64 nt, hsa
ugauugagguuuguaggagacugguucuucuacauacaaggauuugucuuaaguuugcacaaug

SEQ ID NO: 346346 - RNA, 64 nt, hsa
ucagcauuugcagcauucuaaaagccuguguagguacaaggacauugauuuuguauucagaauu

SEQ ID NO: 346347 - RNA, 64 nt, hsa
auuauuuuucuuagcccaagaggucuuucacugauacaaggaaaacuugcagaaaugugauuuu

SEQ ID NO: 346348 - RNA, 64 nt, hsa
cuugcaggagggccgugagccugacuacucagaguacaaggaguucaagcugacuguggagaac

SEQ ID NO: 346349 - RNA, 64 nt, hsa
aggccccgaguuagaaaaaguagcuauggaggacuacaaggauaacccagcauuugcgugagua

SEQ ID NO: 346350 - RNA, 64 nt, hsa
aaggccaaagggaggccccuggguauuguccuccuacaaggaagauccucuuuguuuguucaaa

SEQ ID NO: 346351 - RNA, 64 nt, hsa
auauugccccuugaugagagucaaacacccugccuacaaggagauguuuugaaauggagaggaa

SEQ ID NO: 346352 - RNA, 64 nt, hsa; identical to SEQ ID NO: 225861

SEQ ID NO: 346353 - RNA, 64 nt, hsa; identical to SEQ ID NO: 225862

SEQ ID NO: 346354 - RNA, 64 nt, hsa; identical to SEQ ID NO: 225863

SEQ ID NO: 346355 - RNA, 64 nt, hsa; identical to SEQ ID NO: 225864

SEQ ID NO: 346356 - RNA, 64 nt, hsa; identical to SEQ ID NO: 225865

SEQ ID NO: 346357 - RNA, 64 nt, hsa; identical to SEQ ID NO: 225866

SEQ ID NO: 346358 - RNA, 64 nt, hsa; identical to SEQ ID NO: 225867

SEQ ID NO: 346359 - RNA, 64 nt, hsa; identical to SEQ ID NO: 225868

SEQ ID NO: 346360 - RNA, 64 nt, hsa; identical to SEQ ID NO: 225869

SEQ ID NO: 346361 - RNA, 64 nt, hsa; identical to SEQ ID NO: 225870

SEQ ID NO: 346362 - RNA, 64 nt, hsa; identical to SEQ ID NO: 225871

SEQ ID NO: 346363 - RNA, 64 nt, hsa; identical to SEQ ID NO: 225872

SEQ ID NO: 346364 - RNA, 64 nt, hsa; identical to SEQ ID NO: 225873

SEQ ID NO: 346365 - RNA, 64 nt, hsa; identical to SEQ ID NO: 225874

SEQ ID NO: 346366 - RNA, 64 nt, hsa; identical to SEQ ID NO: 225875

SEQ ID NO: 346367 - RNA, 64 nt, hsa; identical to SEQ ID NO: 225876

SEQ ID NO: 346368 - RNA, 64 nt, hsa; identical to SEQ ID NO: 225877

SEQ ID NO: 346369 - RNA, 64 nt, hsa; identical to SEQ ID NO: 225878

SEQ ID NO: 346370 - RNA, 64 nt, hsa; identical to SEQ ID NO: 225879

SEQ ID NO: 346371 - RNA, 64 nt, hsa; identical to SEQ ID NO: 225880

SEQ ID NO: 346372 - RNA, 64 nt, hsa; identical to SEQ ID NO: 225881

SEQ ID NO: 346373 - RNA, 64 nt, hsa; identical to SEQ ID NO: 225882

SEQ ID NO: 346374 - RNA, 64 nt, hsa; identical to SEQ ID NO: 225883

SEQ ID NO: 346375 - RNA, 64 nt, hsa; identical to SEQ ID NO: 225884

SEQ ID NO: 346376 - RNA, 64 nt, hsa; identical to SEQ ID NO: 225885

SEQ ID NO: 346377 - RNA, 64 nt, hsa; identical to SEQ ID NO: 225886

SEQ ID NO: 346378 - RNA, 64 nt, hsa; identical to SEQ ID NO: 225887

SEQ ID NO: 346379 - RNA, 64 nt, hsa; identical to SEQ ID NO: 225888

SEQ ID NO: 346380 - RNA, 64 nt, hsa; identical to SEQ ID NO: 225889

SEQ ID NO: 346381 - RNA, 64 nt, hsa; identical to SEQ ID NO: 225890

SEQ ID NO: 346382 - RNA, 61 nt, hsa; identical to SEQ ID NO: 225891

SEQ ID NO: 346383 - RNA, 64 nt, hsa; identical to SEQ ID NO: 225892

SEQ ID NO: 346384 - RNA, 64 nt, hsa; identical to SEQ ID NO: 225893

SEQ ID NO: 346385 - RNA, 64 nt, hsa; identical to SEQ ID NO: 225894

SEQ ID NO: 346386 - RNA, 64 nt, hsa; identical to SEQ ID NO: 225895

SEQ ID NO: 346387 - RNA, 64 nt, hsa; identical to SEQ ID NO: 225896

SEQ ID NO: 346388 - RNA, 64 nt, hsa; identical to SEQ ID NO: 225897

SEQ ID NO: 346389 - RNA, 64 nt, hsa; identical to SEQ ID NO: 140340

SEQ ID NO: 346390 - RNA, 64 nt, hsa; identical to SEQ ID NO: 140341

SEQ ID NO: 346391 - RNA, 64 nt, hsa; identical to SEQ ID NO: 103765

SEQ ID NO: 346392 - RNA, 64 nt, hsa; identical to SEQ ID NO: 103766

SEQ ID NO: 346393 - RNA, 53 nt, hsa; identical to SEQ ID NO: 103767

SEQ ID NO: 346394 - RNA, 64 nt, hsa; identical to SEQ ID NO: 103768

SEQ ID NO: 346395 - RNA, 64 nt, hsa; identical to SEQ ID NO: 103769

SEQ ID NO: 346396 - RNA, 64 nt, hsa; identical to SEQ ID NO: 103770

SEQ ID NO: 346397 - RNA, 53 nt, hsa; identical to SEQ ID NO: 103771

SEQ ID NO: 346398 - RNA, 64 nt, hsa; identical to SEQ ID NO: 103772

SEQ ID NO: 346399 - RNA, 64 nt, hsa; identical to SEQ ID NO: 103773

SEQ ID NO: 346400 - RNA, 64 nt, hsa; identical to SEQ ID NO: 103774

SEQ ID NO: 346401 - RNA, 64 nt, hsa; identical to SEQ ID NO: 103775

SEQ ID NO: 346402 - RNA, 64 nt, hsa; identical to SEQ ID NO: 103776

SEQ ID NO: 346403 - RNA, 64 nt, hsa; identical to SEQ ID NO: 86375

SEQ ID NO: 346404 - RNA, 64 nt, hsa; identical to SEQ ID NO: 86376

SEQ ID NO: 346405 - RNA, 64 nt, hsa; identical to SEQ ID NO: 86377

SEQ ID NO: 346406 - RNA, 64 nt, hsa; identical to SEQ ID NO: 86378

SEQ ID NO: 346407 - RNA, 64 nt, hsa; identical to SEQ ID NO: 86379

SEQ ID NO: 346408 - RNA, 64 nt, hsa; identical to SEQ ID NO: 86380

SEQ ID NO: 346409 - RNA, 64 nt, hsa; identical to SEQ ID NO: 86381

SEQ ID NO: 346410 - RNA, 64 nt, hsa; identical to SEQ ID NO: 86382

SEQ ID NO: 346411 - RNA, 64 nt, hsa
gcacaggggaagcccagccgugggcuuaggagagagggaccagcgcccagcguuagggcuggaa

SEQ ID NO: 346412 - RNA, 64 nt, hsa
uguuuacauuuauguucugcaagacgcuguccucagggaccauuaggggaccauucuguucagu

SEQ ID NO: 346413 - RNA, 64 nt, hsa
ugugccaugcggcugccugcaccccagacaauaaagggaccaaaaccacccaacccccacccug

SEQ ID NO: 346414 - RNA, 64 nt, hsa
cacuaggaucauuccacaccccugcaccugaccaagggaccaaugaggcagaggcuugccccaa

SEQ ID NO: 346415 - RNA, 64 nt, hsa
aggaaagggcuucaggaggaggcugugaggcuggagggaccagauggaggaggccagcagcuag

SEQ ID NO: 346416 - RNA, 64 nt, hsa
agaggagaagcagccuccgcccagccgcuaggccagggaccaucuucuggccaaucaaggcuug

SEQ ID NO: 346417 - RNA, 64 nt, hsa
ccauaagcacuggggacugccagguuggcacuguagggaccaagauuaacuuuuuggugcaucu

SEQ ID NO: 346418 - RNA, 64 nt, hsa
ggaaaggggguggagacaggaccgugacagucucagggaccaaucccugccucugcccaucaga

SEQ ID NO: 346419 - RNA, 64 nt, hsa
aagcuggcagggaccaccagccccaggauggcagagggaccagaaccucccacucagacuggcc

SEQ ID NO: 346420 - RNA, 64 nt, hsa
ggccugacggguccggcuugucauggaagcuggcagggaccaccagccccaggauggcagaggg

SEQ ID NO: 346421 - RNA, 64 nt, hsa
uccugggauggcgauggggacucugccgcuguguagggaccagugggaugggcucuaccucucu

SEQ ID NO: 346422 - RNA, 64 nt, hsa
augccaaguggacuuggagcugcacaaagucagcagggaccacuaaaucuccaagaccuggugu

SEQ ID NO: 346423 - RNA, 64 nt, hsa
ggauggggccucuagacuugcaagggagaggaacagggaccaggcugccccacggucccugaag

SEQ ID NO: 346424 - RNA, 64 nt, hsa
ucccucuacacuugaggaccacaguuggggguguagggaccacccagacccugguugaauuguu

SEQ ID NO: 346425 - RNA, 64 nt, hsa
caagguucacggcgauucuccccaugggaucuugagggaccaagcugcugggauugggaaggag

SEQ ID NO: 346426 - RNA, 64 nt, hsa
uggguccugaagcccucugucuaccugggagaccagggaccacaggccuuagggauacaggggg

SEQ ID NO: 346427 - RNA, 64 nt, hsa
uaaggucuuucucuggaaauccagcaguagaggaagggaccacccaagaaaacuaaaaaccaag

SEQ ID NO: 346428 - RNA, 64 nt, hsa
uggccuucaugaagaauagcaaacucaucccuguagggaccaggcagguaacauagacgaguga

SEQ ID NO: 346429 - RNA, 64 nt, hsa; identical to SEQ ID NO: 95478

SEQ ID NO: 346430 - RNA, 64 nt, hsa; identical to SEQ ID NO: 95479

SEQ ID NO: 346431 - RNA, 64 nt, hsa; identical to SEQ ID NO: 95480

SEQ ID NO: 346432 - RNA, 64 nt, hsa; identical to SEQ ID NO: 95481

SEQ ID NO: 346433 - RNA, 64 nt, hsa; identical to SEQ ID NO: 95482

SEQ ID NO: 346434 - RNA, 64 nt, hsa; identical to SEQ ID NO: 95483

SEQ ID NO: 346435 - RNA, 64 nt, hsa; identical to SEQ ID NO: 95484

SEQ ID NO: 346436 - RNA, 64 nt, hsa; identical to SEQ ID NO: 95485

SEQ ID NO: 346437 - RNA, 64 nt, hsa; identical to SEQ ID NO: 95486

SEQ ID NO: 346438 - RNA, 64 nt, hsa; identical to SEQ ID NO: 95487

SEQ ID NO: 346439 - RNA, 64 nt, hsa; identical to SEQ ID NO: 95488

SEQ ID NO: 346440 - RNA, 64 nt, hsa; identical to SEQ ID NO: 95489

SEQ ID NO: 346441 - RNA, 64 nt, hsa; identical to SEQ ID NO: 95490

SEQ ID NO: 346442 - RNA, 64 nt, hsa; identical to SEQ ID NO: 95491

SEQ ID NO: 346443 - RNA, 64 nt, hsa; identical to SEQ ID NO: 95492

SEQ ID NO: 346444 - RNA, 64 nt, hsa; identical to SEQ ID NO: 95493

SEQ ID NO: 346445 - RNA, 64 nt, hsa; identical to SEQ ID NO: 95494

SEQ ID NO: 346446 - RNA, 64 nt, hsa; identical to SEQ ID NO: 95495

SEQ ID NO: 346447 - RNA, 64 nt, hsa; identical to SEQ ID NO: 95496

SEQ ID NO: 346448 - RNA, 64 nt, hsa; identical to SEQ ID NO: 95497

SEQ ID NO: 346449 - RNA, 64 nt, hsa; identical to SEQ ID NO: 95498

SEQ ID NO: 346450 - RNA, 64 nt, hsa; identical to SEQ ID NO: 95499

SEQ ID NO: 346451 - RNA, 64 nt, hsa; identical to SEQ ID NO: 95500

SEQ ID NO: 346452 - RNA, 64 nt, hsa; identical to SEQ ID NO: 95501

SEQ ID NO: 346453 - RNA, 64 nt, hsa; identical to SEQ ID NO: 95502

SEQ ID NO: 346454 - RNA, 64 nt, hsa; identical to SEQ ID NO: 95503

SEQ ID NO: 346455 - RNA, 64 nt, hsa; identical to SEQ ID NO: 95504

SEQ ID NO: 346456 - RNA, 64 nt, hsa; identical to SEQ ID NO: 95505

SEQ ID NO: 346457 - RNA, 64 nt, hsa; identical to SEQ ID NO: 95506

SEQ ID NO: 346458 - RNA, 64 nt, hsa; identical to SEQ ID NO: 95507

SEQ ID NO: 346459 - RNA, 64 nt, hsa; identical to SEQ ID NO: 95508

SEQ ID NO: 346460 - RNA, 64 nt, hsa; identical to SEQ ID NO: 95509

SEQ ID NO: 346461 - RNA, 64 nt, hsa; identical to SEQ ID NO: 95510

SEQ ID NO: 346462 - RNA, 64 nt, hsa; identical to SEQ ID NO: 95511

SEQ ID NO: 346463 - RNA, 64 nt, hsa; identical to SEQ ID NO: 95512

SEQ ID NO: 346464 - RNA, 64 nt, hsa; identical to SEQ ID NO: 95513

SEQ ID NO: 346465 - RNA, 64 nt, hsa; identical to SEQ ID NO: 95514

SEQ ID NO: 346466 - RNA, 64 nt, hsa; identical to SEQ ID NO: 95515

SEQ ID NO: 346467 - RNA, 64 nt, hsa; identical to SEQ ID NO: 95516

SEQ ID NO: 346468 - RNA, 64 nt, hsa; identical to SEQ ID NO: 95517

SEQ ID NO: 346469 - RNA, 64 nt, hsa; identical to SEQ ID NO: 95518

SEQ ID NO: 346470 - RNA, 64 nt, hsa; identical to SEQ ID NO: 95519

SEQ ID NO: 346471 - RNA, 64 nt, hsa; identical to SEQ ID NO: 95520

SEQ ID NO: 346472 - RNA, 64 nt, hsa; identical to SEQ ID NO: 95521

SEQ ID NO: 346473 - RNA, 64 nt, hsa; identical to SEQ ID NO: 95522

SEQ ID NO: 346474 - RNA, 64 nt, hsa; identical to SEQ ID NO: 95523

SEQ ID NO: 346475 - RNA, 64 nt, hsa; identical to SEQ ID NO: 95524

SEQ ID NO: 346476 - RNA, 64 nt, hsa; identical to SEQ ID NO: 95525

SEQ ID NO: 346477 - RNA, 64 nt, hsa
gcuucucuuuggcucccaaagagaaggacaguguugggaguaucugccguggcuucucuuuggc

SEQ ID NO: 346478 - RNA, 64 nt, hsa
gcuucucuuuggcucccaaagagaaggacaguguugggaguaucugccggcgcuguccaggucc

SEQ ID NO: 346479 - RNA, 64 nt, hsa
uuuaagaacgaauuauaauuaugguuuacacuguugggaguaaaggagcauuuuuacaccccuu

SEQ ID NO: 346480 - RNA, 64 nt, hsa
aaaacccaaauaaagguagaguaagugugauauaugggaguauuaaaauagcuuaaaauuucuc

SEQ ID NO: 346481 - RNA, 64 nt, hsa
cccuugguguuuuaccacagaccccagcgucaggugggaguacugcaaccugacgcgaugcuca

SEQ ID NO: 346482 - RNA, 64 nt, hsa
acccugguguuacacaacugauccgugugugaggugggaguacugcaaccugacacaaugcuca

SEQ ID NO: 346483 - RNA, 64 nt, hsa
cccuugguguuacacgauggaucccaaagucagaugggaguacugcaaccugacacgaugcuca

SEQ ID NO: 346484 - RNA, 64 nt, hsa
cccuugguguuauacaacggaucccaaagucaggugggaguacugcaaccugacaggaugcuca

SEQ ID NO: 346485 - RNA, 64 nt, hsa
aaucuaguaaaagaagaaaguuguacuuccuggcugggaguauuaggagaugggaguagagauu

SEQ ID NO: 346486 - RNA, 64 nt, hsa
aaaguuguacuuccuggcugggaguauuaggagaugggaguagagauucacuuuuaaguucuug

SEQ ID NO: 346487 - RNA, 64 nt, hsa
ccauguuggcugcugcuguugagauacugugcuuugggaguaaaaaaagaaaguuauuucuuug

SEQ ID NO: 346488 - RNA, 64 nt, hsa
aaauaaaacaugugaagcaguauugauucuuuauugggaguacauuuuuuuaggucucuuaaac

SEQ ID NO: 346489 - RNA, 64 nt, hsa
uucagagaauuuaggcaaacacuggccauggccgugggaguacugggaguaaaauaaaaauauc

SEQ ID NO: 346490 - RNA, 64 nt, hsa
uuuaggcaaacacuggccauggccgugggaguacugggaguaaaauaaaaauaucgagguauag

SEQ ID NO: 346491 - RNA, 64 nt, hsa; identical to SEQ ID NO: 179463

SEQ ID NO: 346492 - RNA, 64 nt, hsa; identical to SEQ ID NO: 179464

SEQ ID NO: 346493 - RNA, 64 nt, hsa; identical to SEQ ID NO: 179465

SEQ ID NO: 346494 - RNA, 64 nt, hsa; identical to SEQ ID NO: 179466

SEQ ID NO: 346495 - RNA, 64 nt, hsa; identical to SEQ ID NO: 179467

SEQ ID NO: 346496 - RNA, 64 nt, hsa; identical to SEQ ID NO: 179468

SEQ ID NO: 346497 - RNA, 64 nt, hsa; identical to SEQ ID NO: 179469

SEQ ID NO: 346498 - RNA, 64 nt, hsa; identical to SEQ ID NO: 179470

SEQ ID NO: 346499 - RNA, 64 nt, hsa; identical to SEQ ID NO: 179471

SEQ ID NO: 346500 - RNA, 64 nt, hsa; identical to SEQ ID NO: 179472

SEQ ID NO: 346501 - RNA, 64 nt, hsa; identical to SEQ ID NO: 179473

SEQ ID NO: 346502 - RNA, 64 nt, hsa; identical to SEQ ID NO: 179474

SEQ ID NO: 346503 - RNA, 64 nt, hsa; identical to SEQ ID NO: 179475

SEQ ID NO: 346504 - RNA, 64 nt, hsa; identical to SEQ ID NO: 179476

SEQ ID NO: 346505 - RNA, 64 nt, hsa; identical to SEQ ID NO: 179477

SEQ ID NO: 346506 - RNA, 64 nt, hsa; identical to SEQ ID NO: 179478

SEQ ID NO: 346507 - RNA, 64 nt, hsa; identical to SEQ ID NO: 179479

SEQ ID NO: 346508 - RNA, 64 nt, hsa; identical to SEQ ID NO: 179480

SEQ ID NO: 346509 - RNA, 64 nt, hsa; identical to SEQ ID NO: 179481

SEQ ID NO: 346510 - RNA, 64 nt, hsa; identical to SEQ ID NO: 179482

SEQ ID NO: 346511 - RNA, 64 nt, hsa; identical to SEQ ID NO: 179483

SEQ ID NO: 346512 - RNA, 64 nt, hsa; identical to SEQ ID NO: 179484

SEQ ID NO: 346513 - RNA, 64 nt, hsa
uuccugcuauugccuaaagcuacgucugaaacugaguagggaaaggcauacuuuuccagggacu

SEQ ID NO: 346514 - RNA, 64 nt, hsa
ucaaagcuagucugaaagugaccuuacuuucggaaguagggaaguggaacuuugguaaaugacu

SEQ ID NO: 346515 - RNA, 64 nt, hsa
cagugucacagacagcugccaucagagggcuggcaguagggaguuccaggagcggggacuucuc

SEQ ID NO: 346516 - RNA, 64 nt, hsa
uccuucugucuuaagagaaagccaaggcacguagaguagggagaagaagggcaccauccucucu

SEQ ID NO: 346517 - RNA, 64 nt, hsa
uccugaaauucuauuaacauuuccgcagaagaugaguagggagaugcugccuucccuuuugaga

SEQ ID NO: 346518 - RNA, 64 nt, hsa
acaguaaaggguggaggugauauggcauucugaaaguagggagggacuaagucagucaucauac

SEQ ID NO: 346519 - RNA, 64 nt, hsa; identical to SEQ ID NO: 264456

SEQ ID NO: 346520 - RNA, 64 nt, hsa; identical to SEQ ID NO: 264457

SEQ ID NO: 346521 - RNA, 64 nt, hsa; identical to SEQ ID NO: 264458

SEQ ID NO: 346522 - RNA, 64 nt, hsa; identical to SEQ ID NO: 264459

SEQ ID NO: 346523 - RNA, 64 nt, hsa; identical to SEQ ID NO: 264460

SEQ ID NO: 346524 - RNA, 64 nt, hsa; identical to SEQ ID NO: 264461

SEQ ID NO: 346525 - RNA, 64 nt, hsa; identical to SEQ ID NO: 264460

SEQ ID NO: 346526 - RNA, 64 nt, hsa
ugacccuggagaaccauuucauuucauccuggucagucuagagucugugcaccaggcaguccau

SEQ ID NO: 346527 - RNA, 64 nt, hsa
cccccugaacaucaaauaugccugaagagaagaaagucuagauucuucuaugaguaacgccccc

SEQ ID NO: 346528 - RNA, 64 nt, hsa
gccaagacaucugcccaaagugauggaacuagaaagucuagagcugguauucuagcccaaaucu

SEQ ID NO: 346529 - RNA, 64 nt, hsa
ggauccuuaauuagagaugauuucuggaacauucagucuagaaagaaaacauuggaauugacug

SEQ ID NO: 346530 - RNA, 64 nt, hsa
ugucccugagugaagucuagaaagaaagguaaagagucuagaguuuauuccucuuuccaaaaca

SEQ ID NO: 346531 - RNA, 64 nt, hsa
cuuguuucuuuuaauuuuauuugucccugagugaagucuagaaagaaagguaaagagucuagag

SEQ ID NO: 346532 - RNA, 64 nt, hsa
cauuaacccccaaauucaaaaguaagaaugcaaaagucuagaggggguaacagucugcaucauc

SEQ ID NO: 346533 - RNA, 64 nt, hsa
uugaaucagagaaaacuguugagguuccucuuggagucuagaacauccuuaaaugucuaacaac

SEQ ID NO: 346534 - RNA, 64 nt, hsa
gcuggagccgaagagucaaagagcuaaaaaauuaagucuagaacauucuaugaggauaguauaa

SEQ ID NO: 346535 - RNA, 64 nt, hsa
auucuaugaggauaguauaaauaaaaagaaauacagucuagacaugcugcaaggaaagaagauu

SEQ ID NO: 346536 - RNA, 64 nt, hsa
aacauuccaagacucuagaguccaagguuuaaagagucuagauucaaagguucuagguuucaaa

SEQ ID NO: 346537 - RNA, 64 nt, hsa
cuaagauucugauuuuaggagcuaaggcucuaugagucuagauguuuauucuucuagaguucag

SEQ ID NO: 346538 - RNA, 64 nt, hsa
aggauucuaaaaugugauguucuaaggcucugagagucuagauucucuggcuguaaggcucuag

SEQ ID NO: 346539 - RNA, 64 nt, hsa
uccagaggcccuaggcgggaugggcucgcugaaccucgaggaacuccaggacgaggaggacaug

SEQ ID NO: 346540 - RNA, 64 nt, hsa
ggcccuccuggugcccacucccgccagccccugccucgaggacugauacugcagugacugccgu

SEQ ID NO: 346541 - RNA, 64 nt, hsa
ccccuccuagcccugugguuaucccuagguggcucucgaggaguuaacuccaugagcccaggga

SEQ ID NO: 346542 - RNA, 64 nt, hsa
accuguccacguggccagggcccaugcugccacccucgaggagauggaacccugugaugcaaaa

SEQ ID NO: 346543 - RNA, 64 nt, hsa
uccccugcgucuccuuguaaaguuccaugagaugcucgaggagcaccugcugguggggcaccca

SEQ ID NO: 346544 - RNA, 62 nt, hsa
uuccagcuggagaggaauaaccaucccuacaacucgaggauagccaucaggagcacuguugg

SEQ ID NO: 346545 - RNA, 64 nt, hsa
ucuccacagacuaacauugaagucuuccagaaaccucgaggagcugggcuagauacuucgagag

SEQ ID NO: 346546 - RNA, 64 nt, hsa
uugguuuccaccuauuuaaagucagauuuauagacucgaggagacagaaacugaaucccacacc

SEQ ID NO: 346547 - RNA, 64 nt, hsa
auuaaaaacccaagcauugaucuguguacguguccucgaggaucccggaucaucagcacaauug

SEQ ID NO: 346548 - RNA, 64 nt, hsa
uacuucuugauaccugggauacugugcccagagccucgaggagguaaugaauuaaagaagagaa

SEQ ID NO: 346549 - RNA, 64 nt, hsa
cccagaagaagccgugaacuucaucuuguccugucucgaggaugaaaagauccagacccgggaa

SEQ ID NO: 346550 - RNA, 64 nt, hsa
gaaugagccuucgacccugaaauccuuggggugccucgaggacgacuggccgaaaagccgcauu

SEQ ID NO: 346551 - RNA, 64 nt, hsa
ucaccugccccucccccaucccagguuguggaggcucgaggaagcugacuucuuaggcuaaagg

SEQ ID NO: 346552 - RNA, 64 nt, hsa
cacacauugaccaagccagacccgguucacccagcucgaggaucccagguugaagaguggcccc

SEQ ID NO: 346553 - RNA, 64 nt, hsa
ucuccucccucccacuucugcacccuuucaccaccucgaggagauuugcuccccauuagcgaau

SEQ ID NO: 346554 - RNA, 64 nt, hsa
aaaggaauggauuucuuccaugauaacuacgugucucgaggaugaucugcucagagcucuucca

SEQ ID NO: 346555 - RNA, 64 nt, hsa
cccagcagagccugcauugauaacagccuuaacccucgaggaauaccucaauaccucagacaag

SEQ ID NO: 346556 - RNA, 64 nt, hsa
gcugacugugcgcuagacacugccaggcccgggccucgaggaggaaaagacaguagggaagaca

SEQ ID NO: 346557 - RNA, 64 nt, hsa
agauacugagucuuccuuuccuuuucugacccuucucgaggacauuugcuuuccucacacuuuu

SEQ ID NO: 346558 - RNA, 64 nt, hsa
gauuuccaauuguuaauaacgcuauguuagcgcgcucgaggaagaagguaggaaucccggcucc

SEQ ID NO: 346559 - RNA, 64 nt, hsa
ucuccagccauggucagacaggucacccaggagccucgaggaaagcccuggagggaaucacaug

SEQ ID NO: 346560 - RNA, 64 nt, hsa
caggacugaggauccucuccuccagaaaagcccccucgaggaaauaaauuagugcgguucucuu

SEQ ID NO: 346561 - RNA, 64 nt, hsa
guuaaaugccugucuccccgcggaucaugggcuccucgaggacagggacuggccugucugucca

SEQ ID NO: 346562 - RNA, 64 nt, hsa
cccguuccccccagguggccugggagguggcccccucgaggaugacuccacuagcgcccuggga

SEQ ID NO: 346563 - RNA, 64 nt, hsa
guuaaacacuaccuugaucauucucuccucuuuccucgaggaacuccuggaggguuugagcguc

SEQ ID NO: 346564 - RNA, 64 nt, hsa
uugaaauugucacucgcuuacuggauccaagcgucucgaggauaaauaaagaucaugaaaaaga

SEQ ID NO: 346565 - RNA, 64 nt, hsa
ugacacccuggggugaggugcucagcaccuuccucucgaggagccacauuuuccuccuuugugu

SEQ ID NO: 346566 - RNA, 64 nt, hsa
ccaggacccaugagggggcugagagguuucuacacucgaggagcagggguccagagaggcaggc

SEQ ID NO: 346567 - RNA, 64 nt, hsa
gccuccggcggcccaggauucuaaggaugcaauccucgaggaaaauuagucgauucucagauua

SEQ ID NO: 346568 - RNA, 62 nt, hsa
ucggggcccuggggcugugagaccccgacccucucgaggaacccugccugagacgccuccau

SEQ ID NO: 346569 - RNA, 64 nt, hsa
gccagguccaugggggcuggcaucccagcuccaacucgaggagccucaguuuccucaucuguaa

SEQ ID NO: 346570 - RNA, 64 nt, hsa
gcacuccagccugggcaacacagcgagacuccgucucgaggaaaaaaaaagaaaagauacgugc

SEQ ID NO: 346571 - RNA, 64 nt, hsa
uuuuagacaaauacucauguguaugggcaaaaaacucgaggacuguauuugugacuaauuguau

SEQ ID NO: 346572 - RNA, 64 nt, hsa
acggugaugaaacugagguucaguacucucgggacucgaggaaauuauuccugagacauggagu

SEQ ID NO: 346573 - RNA, 64 nt, hsa; identical to SEQ ID NO: 346571

SEQ ID NO: 346574 - RNA, 64 nt, hsa
ugauuaugagaugugcauauugcuuugggaagagcucgaggaaggaaauaauucucuccuuugu

SEQ ID NO: 346575 - RNA, 64 nt, hsa
cccagcuacuuggaaggcugaggugagaggaucacucgaggagauuggggcugccaugagccau

SEQ ID NO: 346576 - RNA, 64 nt, hsa
ccucuucccacaccugucagcuucggaagcaucucucgaggacucuggucccaggaugucuccc

SEQ ID NO: 346577 - RNA, 64 nt, hsa
caaggaagacgucguuaucuccccuccccacuuacucgaggagagaggugagggggggaugacu

SEQ ID NO: 346578 - RNA, 64 nt, hsa
cagauugaaguaagagcaguucucuccguugccucucgaggaggaggugcgaaguccuggagua

SEQ ID NO: 346579 - RNA, 64 nt, hsa
agggacagagcccucugugguggaacgaccccaccucgaggagcuuccugagcagguggcagaa

SEQ ID NO: 346580 - RNA, 64 nt, hsa
ccucucccacacacauuccagaagucagggcccccucgaggagcacccgcugcagggaugcagg

SEQ ID NO: 346581 - RNA, 64 nt, hsa
cuuuguaaaaugaggguggaggugggaauaggaucucgaggagacuauuggcauaugauuccaa

SEQ ID NO: 346582 - RNA, 64 nt, hsa
guacuauccuguacugcaguggugccuucagggacucgaggaauguaagguugccuuuccccuu

SEQ ID NO: 346583 - RNA, 64 nt, hsa
gcgcugcaugacuugcugaacggcacagggaccccucgaggaacaagguugcacaccagcuuuc

SEQ ID NO: 346584 - RNA, 64 nt, hsa
caacuaagaaaaaaagcacaaaguucucagagcucucgaggaaagugguuguccccguaccacc

SEQ ID NO: 346585 - RNA, 64 nt, hsa
cacugacugagccacccucuccguaggguucuuucucgaggacucuacccuccucccccacguc

SEQ ID NO: 346586 - RNA, 64 nt, hsa
ccugcgccccgccagcugcccgcagaggugcagccucgaggaaucugagggcgucggggcagcg

SEQ ID NO: 346587 - RNA, 64 nt, hsa
aucagagcauucugugcccagggacaggacagaucucgaggacaccacaguccaccuguucccg

SEQ ID NO: 346588 - RNA, 64 nt, hsa
ucccugagagguggugggaauggcugcuucauuccucgaggaugcccgggccccaccugggcuu

SEQ ID NO: 346589 - RNA, 64 nt, hsa
auuauagcaauuuaagggcccaccagaagcaggccucgaggagucaauuugccucugugugccu

SEQ ID NO: 346590 - RNA, 64 nt, hsa
gugaccaugccgaccacaaaggugucugcggaaacucgaggacauucaccacgaugauuuuccu

SEQ ID NO: 346591 - RNA, 64 nt, hsa
caacggccucuagcacccagaaacagggaggguccucgaggaggacacaccagggucucagccu

SEQ ID NO: 346592 - RNA, 64 nt, hsa
augcaccugggagcccccuggcuugcacugaacccucgaggaccugggcacggggucggaugga

SEQ ID NO: 346593 - RNA, 64 nt, hsa
cacaccucugggaaaagauuacacuguauuaacucucgaggaguuuccucaccaauaaacagac

SEQ ID NO: 346594 - RNA, 64 nt, hsa
ggcagcagcaaggcgcccaugccacacaccgucucucgaggaaacgcgguucagcgauucuuug

SEQ ID NO: 346595 - RNA, 64 nt, hsa
guuuagguucuagguaguggagggccagguggggcucgaggaacguaguguucuuugcauuucu

SEQ ID NO: 346596 - RNA, 63 nt, hsa
cccuacugcaugcagccaaauaaaaggugugcccagucuaaccugugcccugugguuucugga

SEQ ID NO: 346597 - RNA, 63 nt, hsa
ucugccucccaggcucaagcaauccucccacuucagucuaaguagcugggacuacaggcacgu

SEQ ID NO: 346598 - RNA, 63 nt, hsa
uucuaauguggggugcuauguaaauuagcaaagcagucuaacuagaauggauuuuacugaacc

SEQ ID NO: 346599 - RNA, 63 nt, hsa
aaagcagucuaacuagaauggauuuuacugaaccagucuaacauuuacuuuccaagaaacauu

SEQ ID NO: 346600 - RNA, 63 nt, hsa
gucugugccugaagcucaggaguguggaucagacagucuaaagauccuaaaaacuugccaacu

SEQ ID NO: 346601 - RNA, 63 nt, hsa
acaacucaaaauacaccagcucauuuggcugcucagucuaacucuagaauggaugcuuuugaa

SEQ ID NO: 346602 - RNA, 63 nt, hsa
gaacuggagcgaagugcacaccucaccauccuucagucuaaggaagaagggcaagcccuggga

SEQ ID NO: 346603 - RNA, 63 nt, hsa
gagcucuacagggucagcuuuguuugauuuguccagucuaagaagucccauugccaaagcuuu

SEQ ID NO: 346604 - RNA, 63 nt, hsa
ugggaggaucgccugagcccaggaguuugagaccagucuaagcaacauaaugagacucagucu

SEQ ID NO: 346605 - RNA, 63 nt, hsa
ugugcacugcuucugucuaaaaauuacaagccacagucuaauaugucuuauuuuccaaaacac

SEQ ID NO: 346606 - RNA, 63 nt, hsa
aaugaacugcucccacguccugcacugcaauaccagucuaaugaacacuuugugaaacaaauc

SEQ ID NO: 346607 - RNA, 63 nt, hsa
gcaguuuuuaguugcuguaauuguugcuguuuccagucuaaaggaccuccuuugguaaaggug

SEQ ID NO: 346608 - RNA, 63 nt, hsa
cuccaguuuuuguuuuugcaugaaauuguaucucagucuaaggucucaugcuguugcugcuac

SEQ ID NO: 346609 - RNA, 63 nt, hsa
gucuugugugugauuuuuuuuuaaguugaugugcagucuaauuguuguuucauaaaaguugga

SEQ ID NO: 346610 - RNA, 63 nt, hsa
caaccuuucuauaguuaaugcagaguuaaugaacagucuaauauugacuuaucagaauaagcu

SEQ ID NO: 346611 - RNA, 63 nt, hsa
ucauacgugaaauaaggugaaagugacagccuucagucuaauaaccuugaagugguuuuugaa

SEQ ID NO: 346612 - RNA, 63 nt, hsa
gaaaguaucuugagauaucaguggaaagcuaaacagucuaaauuaacaugaaauacuucauuu

SEQ ID NO: 346613 - RNA, 63 nt, hsa
cauugagcccaucacaacuguuuugacugcuggcagucuaaaacaguccacccaccccauggc

SEQ ID NO: 346614 - RNA, 63 nt, hsa
uucaaauuucauuuuagaauaaguuaacuaaaucagucuaauaauuaaaauuuuaaaacuccu

SEQ ID NO: 346615 - RNA, 63 nt, hsa
cagugucuaggaagauaacagccagucucaccccagucuaaucauggacccugauaauauugc

SEQ ID NO: 346616 - RNA, 63 nt, hsa
aacuguuauaaacucuuugcuucugcuaagaagcagucuaaauauaaucaacguacagugagc

SEQ ID NO: 346617 - RNA, 63 nt, hsa
caaaauuacuaaguauaaauuagucaaguuuaucagucuaaaaaacgaagggaugugcaacug

SEQ ID NO: 346618 - RNA, 63 nt, hsa
ccagcagccuccaggugcuuucauuuucacuuccagucuaagccaguggcuccugccacugcc

SEQ ID NO: 346619 - RNA, 63 nt, hsa
uucuuuuggcuccaacauuccuuuuagcuugaccagucuaauuuaaaauguguuuguuggagg

SEQ ID NO: 346620 - RNA, 63 nt, hsa
aaagaagcuuuuuacuuaacguugucuuauuuccagucuaauuuuacgcuguagcagaaccag

SEQ ID NO: 346621 - RNA, 63 nt, hsa
aggaggaaacaguuuuuuagacuggaaaaaagccagucuaaaggccucuggauacugggcucc

SEQ ID NO: 346622 - RNA, 63 nt, hsa
cuagcagaaaucaaaaugcuuuaugaacagcuacagucuaauucucuuuucaacaacagacgu

SEQ ID NO: 346623 - RNA, 63 nt, hsa
cucuuucguaggccaguagcaauguuguguucacagucuaauuuccaaaagaccaucaauaaa

SEQ ID NO: 346624 - RNA, 63 nt, hsa
ccaagacagcucaaaauauccacaccucggcaacagucuaagaugagagccugugacaggugg

SEQ ID NO: 346625 - RNA, 63 nt, hsa
aaauaacugucugaggcuaaggcccacgugggacagucuaauacccaugaguacucaacuugc

SEQ ID NO: 346626 - RNA, 63 nt, hsa
cugcaaagaucauaauaaagucauuuuuauagacagucuaaacaaaauggguggggaugucgu

SEQ ID NO: 346627 - RNA, 63 nt, hsa
acagcucucucgaagagaucuuacagacuguaucagucuaauuuuuaaauuuuaaguuauuuu

SEQ ID NO: 346628 - RNA, 63 nt, hsa
ggugcuagacuuuagaagccagauaggaagaaucagucuaaacuggccaugcuuuggaaggga

SEQ ID NO: 346629 - RNA, 63 nt, hsa
aaagucuuauuaaaacacuucauugaaaauauacagucuaaauuuauuauuuaaauuuuacua

SEQ ID NO: 346630 - RNA, 63 nt, hsa
aaacugugccauuugaacagucacuuccaagcucagucuaaaugaaaccgaaacgugaccacg

SEQ ID NO: 346631 - RNA, 63 nt, hsa
acuaaagucuuauuuuauguuuuagaacaguuacagucuaauugucuuggacauuuugggaag

SEQ ID NO: 346632 - RNA, 63 nt, hsa
ggaaaagcaagucccugcagugagcacuagggacagucuaauuuggggauugcucaaccauca

SEQ ID NO: 346633 - RNA, 63 nt, hsa
aaaaaaauauauuuuaggaggcugauuuaaugccagucuaaauccuuauguagaaaggacuuu

SEQ ID NO: 346634 - RNA, 63 nt, hsa
cauacacaggagaaauuguagugaugaaaugugcagucuaagguuuaaucugaccaagaaauu

SEQ ID NO: 346635 - RNA, 63 nt, hsa
ugauaucauguucuagaaauaccugcaacaugacagucuaaucaguagucuauuaaaacuugu

SEQ ID NO: 346636 - RNA, 63 nt, hsa
acuucuucaccugaggaaaacuagaaugaaaugcagucuaaaauauuuugcacugaauuguaa

SEQ ID NO: 346637 - RNA, 63 nt, hsa
acagacugcauguaguuggguauaauuuuuauccagucuaaaaauaucugucuuuuaauuggu

SEQ ID NO: 346638 - RNA, 63 nt, hsa
caauaaguaguagaaggagcaucacacagauuucagucuaaucugcccuucugugggccauaa

SEQ ID NO: 346639 - RNA, 63 nt, hsa
uaaacaggaaugcuuaaagcuuuaaaaguuuaacagucuaaaacauuuuugcuuuuauucaac

SEQ ID NO: 346640 - RNA, 63 nt, hsa
uuucuuucccugcacuuuguuacaucugggauacagucuaacucaucugauuuaauaugcauu

SEQ ID NO: 346641 - RNA, 63 nt, hsa
uaaacuaaauuuuacuaagcugaacaacucugacagucuaaagagcuaauguggguuaccaaa

SEQ ID NO: 346642 - RNA, 63 nt, hsa
uucagaaaaguauguuuugcauguauuuuuuuacagucuaaauuuugacugcugagaaguuuc

SEQ ID NO: 346643 - RNA, 63 nt, hsa
aaaaucacagaaaugaaccguuuugcagcugcgcagucuaaagggcaggccagugucuggaag

SEQ ID NO: 346644 - RNA, 63 nt, hsa
ugcacacuccacuucacaugccguugacucucacagucuaagacuucagggccgggaccuuug

SEQ ID NO: 346645 - RNA, 63 nt, hsa
ucccuucaacaugaaaauauauacccccccaugcagucuaaaaugcuucaguacuugugaaac

SEQ ID NO: 346646 - RNA, 63 nt, hsa
uucaaaacuagaauuuguaaugcaaauggagcucagucuaauaaaaaagagguuuugguauua

SEQ ID NO: 346647 - RNA, 63 nt, hsa
cuuuucauaguacaugaccugcauuccacaucucagucuaacaguuuaguagugauguaaaga

SEQ ID NO: 346648 - RNA, 63 nt, hsa
uaagcuacuuuuagauuuggaaauugcuguuuacagucuaacaacauuaaaaugagagguaga

SEQ ID NO: 346649 - RNA, 63 nt, hsa
guuggcuguucaucuuugaaaccaggggaugcacagucuaaaugaauaucugcaugggauuug

SEQ ID NO: 346650 - RNA, 63 nt, hsa
uugguaugaccccucuaaggaguguagcaacuacagucuaaagcugguuuaauguuuuggcca

SEQ ID NO: 346651 - RNA, 63 nt, hsa
auucagaaagaaaaagcuaccuguuagaauuuccagucuaaauggcacaggguaguuacggag

SEQ ID NO: 346652 - RNA, 63 nt, hsa
cccaagguaugaagcagaugagggaccagcacucagucuaacauguaaacaucauacguaaua

SEQ ID NO: 346653 - RNA, 63 nt, hsa
gguucaaucaauaaaaauauuuuauucaaaaaacagucuaauaucuuauuuuacaugauuuca

SEQ ID NO: 346654 - RNA, 63 nt, hsa
cuugagaccaaaauuuaaguuaacuguugcuggcagucuaaguguaaauguuaacagcaggag

SEQ ID NO: 346655 - RNA, 63 nt, hsa
acugcuuucugcauuccguuaaauaucaucuaacagucuaaaacauaucccuucauugccaua

SEQ ID NO: 346656 - RNA, 63 nt, hsa
uaucucugguacaucaaggggcaugauacaaaccagucuaaagacuguuuauaaaggagagag

SEQ ID NO: 346657 - RNA, 63 nt, hsa
ucuuuuauaaguuauuaauuuuuaugguuuaaucagucuaauuguuuugacuguuauagaaac

SEQ ID NO: 346658 - RNA, 63 nt, hsa
gaccacaccacacaugccuccaacacacacccacagucuaaacaucucuccuucucagugagc

SEQ ID NO: 346659 - RNA, 63 nt, hsa
aauacagucaugcaucgcuuaacaacggggauacagucuaagaauugccuugucuggcaguuu

SEQ ID NO: 346660 - RNA, 63 nt, hsa
uacccuucugggagccaaacuggauaaguaccacagucuaaaugaggagcuugauuucuuggu

SEQ ID NO: 346661 - RNA, 63 nt, hsa
ucaucacugugaucuuuaaaaaccugcauuuaacagucuaauuugaggcugggugcaguggcu

SEQ ID NO: 346662 - RNA, 63 nt, hsa
ccaugcagccacuuuggguuuuguuauaggcaucagucuaacaagucauuaggucacucggga

SEQ ID NO: 346663 - RNA, 63 nt, hsa
ucauaagacacuuagauuaagauuuuacuuuaacagucuaaaaauugauagaagaauaucgau

SEQ ID NO: 346664 - RNA, 63 nt, hsa
auuguaagcaaaaaguuauuuuuauauuauauacagucuaauuguucauccuaauuguuccug

SEQ ID NO: 346665 - RNA, 63 nt, hsa
uccuauuacccaccuccuauuuuaaauauuuaucagucuaaacuugugcaguguaguaaacau

SEQ ID NO: 346666 - RNA, 63 nt, hsa
agaaaagcugggauuacauauggugugcgguuacagucuaaauuuuuucauccuccuaugcau

SEQ ID NO: 346667 - RNA, 63 nt, hsa
ugagcugauugugucagaggccuccuaccugcgcagucuaaacauagcuguggaucauuucca

SEQ ID NO: 346668 - RNA, 63 nt, hsa
ucagccauucuaguuuuguuguguguuggaggacagucuaaugaagacaggauaaaugugauu

SEQ ID NO: 346669 - RNA, 63 nt, hsa
gguauuacacagggaaagcuaugacugcaggaucagucuaacuauacuauuaggugcauguau

SEQ ID NO: 346670 - RNA, 63 nt, hsa
aauuaaaguagauuauggccuuuuuaaguauugcagucuaaaacuucaaaaacuaaaaucauu

SEQ ID NO: 346671 - RNA, 63 nt, hsa
aaaaauaagacaaauccauucucuucuucaauucagucuaauaugcauuguagugucuuuuaa

SEQ ID NO: 346672 - RNA, 63 nt, hsa
ggagcagagaaggacgggagcuggcguagcucucagucuaaugcuuucacauugcaccagauu

SEQ ID NO: 346673 - RNA, 63 nt, hsa
ccuuagagagccacaggaauaucuucuguuguacagucuaauaagcugugguaggaaguauca

SEQ ID NO: 346674 - RNA, 63 nt, hsa
auaauccuggacugugaugggaacagcccagugcagucuaaacuucaauuguguugaaacuac

SEQ ID NO: 346675 - RNA, 63 nt, hsa
uaaugaaucucaaaauuuugaguaaauguaccucagucuaaucagacuuuuuaugaccuuuau

SEQ ID NO: 346676 - RNA, 63 nt, hsa
aacaacuacagucuuugaaauauggaaaaucagcagucuaaaguuuguuuuaaauucuaaauu

SEQ ID NO: 346677 - RNA, 63 nt, hsa
guaguauuaaucaguuuuaucuuuugaaaggcacagucuaaaucgaaacccuaaacucaaugc

SEQ ID NO: 346678 - RNA, 63 nt, hsa
uuuuuuuuaacuauauugauucguuuacuagaacagucuaauuggggcauugaggaaaugaag

SEQ ID NO: 346679 - RNA, 63 nt, hsa
uucuucuuauuguaaauacacuuuacgugaauacagucuaagugaagaaaauaaauaaaagga

SEQ ID NO: 346680 - RNA, 63 nt, hsa
ugagacugaaauuuaguacacuauguucuaggucagucuaacaguuugccugcuguauuuaua

SEQ ID NO: 346681 - RNA, 63 nt, hsa
ugggaugugauaacgagguuccaguaaucugagcagucuaacgaggcccaccuccuccaccac

SEQ ID NO: 346682 - RNA, 63 nt, hsa
ugaacuacuagaaaauugugcuggaaauggacacagucuaacaaauuccaaauucucacagaa

SEQ ID NO: 346683 - RNA, 63 nt, hsa
gaauagcuggauuuuuuagaaaagaaauggauacagucuaaagaauuaacucacccgguacuu

SEQ ID NO: 346684 - RNA, 63 nt, hsa
guauuuaaaaaaagaaaaaagacaauauacugacagucuaaucaucagauuuguccuauagga

SEQ ID NO: 346685 - RNA, 63 nt, hsa
cuggauccuauaucuuagguaagacauauaacgcagucuaauuacauuucacuucaaggcuca

SEQ ID NO: 346686 - RNA, 63 nt, hsa
uggaaaacacauuuggaaugagcuuccacacuucagucuaaaaucucacccaaacuuauggcu

SEQ ID NO: 346687 - RNA, 63 nt, hsa
guccacagugcugugaucccgagggaaguccuccagucuaagucacagugcccugacagguga

SEQ ID NO: 346688 - RNA, 63 nt, hsa
aauacauggucacaaccguggaucaaacaaggucagucuaaaguggcagguccuaggugugac

SEQ ID NO: 346689 - RNA, 63 nt, hsa
uuugcauuuaauggccucagacauuucuuucaucagucuaaaaguuagaaauaucccuuuauu

SEQ ID NO: 346690 - RNA, 63 nt, hsa
gucaucacacucuccauguuaguaauggcagagcagucuaaacagaguccgggagaaugcugg

SEQ ID NO: 346691 - RNA, 63 nt, hsa
guuuuuuaagcaaccuuugaauccagcucuagucagucuaagcaggcaaagguaacugaugac

SEQ ID NO: 346692 - RNA, 63 nt, hsa
uagucagaauagcaguucuagagcacagguucucagucuaagcuauggaaaagcuccccuuau

SEQ ID NO: 346693 - RNA, 63 nt, hsa
guaagaacaauccuuuuuuauuuuucuucuguacagucuaaagcuacagagaaaaaaaaaugc

SEQ ID NO: 346694 - RNA, 63 nt, hsa
uaggggaagcauaaugguuauugucacuaucaacagucuaaaaagaaaaacugaggucuuuuu

SEQ ID NO: 346695 - RNA, 63 nt, hsa
agagacagugacuguuccugccacaguccuucccagucuaacacuauuccugggcugcaugau

SEQ ID NO: 346696 - RNA, 63 nt, hsa
aaugccccuaaauaguaaaagaaaaagggguaucagucuaaucucauggagaaaaacuacuug

SEQ ID NO: 346697 - RNA, 63 nt, hsa
gggaaguccugggaggauccugagcugcuguugcagucuaacccacuaaucaguucuuagauu

SEQ ID NO: 346698 - RNA, 63 nt, hsa
cuugcuagugaaucaagaaaacauccagguugacagucuaaaauggcuacugguauuuuaguu

SEQ ID NO: 346699 - RNA, 63 nt, hsa
cagaaaugacccuccuuggaucaguuuucuuuccagucuaaucaucuuuggaacuaaaacuug

SEQ ID NO: 346700 - RNA, 63 nt, hsa
uccuuauggagcuggagcagcccgccuagaacccagucuaaugagaacuccagaaagcuggag

SEQ ID NO: 346701 - RNA, 63 nt, hsa
aaccacuuguaccacuauaccacuggggggccccagucuaagcucugcuuaugccuaucuuga

SEQ ID NO: 346702 - RNA, 63 nt, hsa
acucuaggaggguggccuggguggagacaagcucagucuaaucaaacaccagaacccuaucaa

SEQ ID NO: 346703 - RNA, 63 nt, hsa
cugaacugagaaaggagcucugaauuuauuugacagucuaacuuuugaauuacauuuuuguaa

SEQ ID NO: 346704 - RNA, 63 nt, hsa
aauuuuuugacuaagcauaaccaaauuucagaacagucuaaucaaugccaaguauccaaggca

SEQ ID NO: 346705 - RNA, 63 nt, hsa
cccugccucaguuggaaaaccuuuucaggcccucagucuaaaaaauaaaaaauaugagcacca

SEQ ID NO: 346706 - RNA, 63 nt, hsa
aacauauucaaggagcaagaaaugaacuuucagcagucuaaauuuucuaaauaaccaauaguu

SEQ ID NO: 346707 - RNA, 63 nt, hsa
aaaugugauuuaaauuggacauuuucaucaaugcagucuaauguguagauaaauauuucaacc

SEQ ID NO: 346708 - RNA, 63 nt, hsa
aauuaauauguuuuaaggagaaauaaaauaucacagucuaaaaauaauaaaaacauuuucuga

SEQ ID NO: 346709 - RNA, 63 nt, hsa
ucuccucauggauauuuucagucucaauguugccagucuaauaguauaguaugugguugcuuu

SEQ ID NO: 346710 - RNA, 63 nt, hsa
uuugcaugaugauccggauuuaauuugauaucacagucuaauuuuuauucauaagccaauuuu

SEQ ID NO: 346711 - RNA, 63 nt, hsa
uuaccaugaagagauugcacuuauccuugagaacagucuaaauauaaaugaagauauuuuacc

SEQ ID NO: 346712 - RNA, 63 nt, hsa
uuaccaugaagagauugcacuuauccuugagaacagucuaaugauacuuuuuuuacuuucaga

SEQ ID NO: 346713 - RNA, 63 nt, hsa
aaugcauuauucauauuucuugaagcuuagauacagucuaauucauagcaaccauaucugcuu

SEQ ID NO: 346714 - RNA, 63 nt, hsa
uauauauucccaaaaaugucaguauugacaacacagucuaacucuuaaauaaaauuaugcuaa

SEQ ID NO: 346715 - RNA, 63 nt, hsa
aguuuguucaaaaccugcagcaaagagaagcaucagucuaacaagccagaacucauuuugugc

SEQ ID NO: 346716 - RNA, 63 nt, hsa
uccagcuugacaagauugagaggcccaugccaacagucuaaucuaagagauuagucuuucaaa

SEQ ID NO: 346717 - RNA, 63 nt, hsa
gggcacuuggcccagaaguuguuugcuaaugaucagucuaacagcugaaagucaaagucagug

SEQ ID NO: 346718 - RNA, 63 nt, hsa
ugaaauaaccaguuauacguauuaaacaguuuacagucuaaaggaaacaaaaccuauauguua

SEQ ID NO: 346719 - RNA, 63 nt, hsa
uucaaugauuuuuuaugaucaaggugaaauaaacagucuaaagaagagguguuuuuauaauau

SEQ ID NO: 346720 - RNA, 63 nt, hsa
auccaucucuucuuaaguugauagugacuaugucagucuaaucucuuguuugccaagguuccu

SEQ ID NO: 346721 - RNA, 63 nt, hsa
agggucugaacucacuccaaaagauaauaacugcagucuaauuuuucccaugguacuugcuag

SEQ ID NO: 346722 - RNA, 63 nt, hsa
gcaaaucucuugcaagaacagcacaaggaaaaucagucuaauaagcugcucugccccuugugc

SEQ ID NO: 346723 - RNA, 63 nt, hsa
ggcaagccauuuacagaaacccacucggcaccccagucuaacaccacaacuaauuucacccaa

SEQ ID NO: 346724 - RNA, 63 nt, hsa
auaguucccuucuuuuuuggguaaugaagggagcagucuaaagaauuguaugcauguuugcau

SEQ ID NO: 346725 - RNA, 63 nt, hsa
uuuuuuuuuaagggugagccaggucuagcccaacagucuaaacuauccagucaauaccgagug

SEQ ID NO: 346726 - RNA, 63 nt, hsa
caucccuccaggggagccugggagcugcucucccagucuaagcauguagauaucaucguuugc

SEQ ID NO: 346727 - RNA, 63 nt, hsa
gagaaagcugaggcccagaggggacacucgacccagucuaaagugggugccauucacggagga

SEQ ID NO: 346728 - RNA, 63 nt, hsa
gccucaaaguaaaugacaugaccagugguugaacagucuaauuuucaaauuuaauauagagca

SEQ ID NO: 346729 - RNA, 63 nt, hsa
ucaacauucacauaguuuagacuccaaaccauucagucuaaaauacugaaacuuuggaauaua

SEQ ID NO: 346730 - RNA, 63 nt, hsa
auauuuuacuuuggugcuuauuuuuccuccuugcagucuaauaaaaaaaucuggacaaucaaa

SEQ ID NO: 346731 - RNA, 63 nt, hsa
cccaauugcacuggcccugggcauggccuuacccagucuaagcuggcaggaucuaaaacagca

SEQ ID NO: 346732 - RNA, 63 nt, hsa
agguucacacuguaaagaguuugugaaagguuucagucuaacugggguuccuuagcuggaagc

SEQ ID NO: 346733 - RNA, 63 nt, hsa
cgggugcuguaaauagucugauaaacguucacacagucuaaaauuacccuuuauauuugcuga

SEQ ID NO: 346734 - RNA, 63 nt, hsa
cggccaacagccagcccuugccagcugacgucacagucuaagaugggaaacugugguacagau

SEQ ID NO: 346735 - RNA, 63 nt, hsa
aaguuacgcuuuucuguuguucuagagccacagcagucuaauauugaaauauaauaugauuug

SEQ ID NO: 346736 - RNA, 62 nt, hsa
cgcaagguggccguuacugaucuuacuucauccagucuaauagguuuggagauuaaaccuuu

SEQ ID NO: 346737 - RNA, 63 nt, hsa
cagagacgcauaacauccaauucugagaugaaacagucuaaaauaggaguaaagcaugcacua

SEQ ID NO: 346738 - RNA, 63 nt, hsa
aaucuuccaauacagguauauugagaaaaaaagcagucuaauaaaauccuagacagaacuuuc

SEQ ID NO: 346739 - RNA, 63 nt, hsa
ucucuaccacagcaaacacauucuccaccaugucagucuaaagagucuaaaggggccgggaga

SEQ ID NO: 346740 - RNA, 63 nt, hsa
aggguuaagaucuaaucucccuaaucuaaaugacagucuaagaguaaguaaaagaacagccau

SEQ ID NO: 346741 - RNA, 63 nt, hsa
cuggcuauaaccccugucccugucuaauucucccagucuaaaaucuaaacaaugacuucauuu

SEQ ID NO: 346742 - RNA, 63 nt, hsa
cucagaggguuguucuccuagacugacccugaucagucuaagauggguggggacguccugcca

SEQ ID NO: 346743 - RNA, 63 nt, hsa
uagaaagcaauccagaugugguuuacucugccacagucuaaugucauucacuucauuugaugg

SEQ ID NO: 346744 - RNA, 63 nt, hsa
uuaugaagcugccccccaccccucaguuaauugcagucuaaugucaagaggcacuucuuuauu

SEQ ID NO: 346745 - RNA, 63 nt, hsa
uuuguuuucacacugauacauaaaaauuaacagcagucuaaucuagugacaccucagucauau

SEQ ID NO: 346746 - RNA, 63 nt, hsa
auuggugaaauggcccuuucccucuuugcaguucagucuaagucucguauuugcuuugcuguc

SEQ ID NO: 346747 - RNA, 63 nt, hsa
aaggcaaaaaaaaaaagcuucuccuacgagaaucagucuaacagagaugccgaugucagcaca

SEQ ID NO: 346748 - RNA, 63 nt, hsa
augugcagguuuguuguuucaugucauauuacucagucuaaacaauaaauauuucauaauuua

SEQ ID NO: 346749 - RNA, 63 nt, hsa
auaauguuuucccauauauuauuaaaaagcauacagucuaaauaauaaacaguuguaaaauaa

SEQ ID NO: 346750 - RNA, 63 nt, hsa
gauccaccuuaacgaccgugcauaugaaaaccacagucuaaggaagugacugcagaaagcuca

SEQ ID NO: 346751 - RNA, 63 nt, hsa
uacaaaugccuuacuuaugcuucacagguuagucagucuaagaauauuuauacaggaaaaaaa

SEQ ID NO: 346752 - RNA, 63 nt, hsa
uuugcuucuuccuuaaagcauuugcaacagcuacagucuaaaauugcuucuuuaccaaggaua

SEQ ID NO: 346753 - RNA, 63 nt, hsa
guguucucuuaagucuuuggaggaaaucuugagcagucuaagccuuuagagaaaauucauucu

SEQ ID NO: 346754 - RNA, 63 nt, hsa
uuucuaagucaucaagauaaauccuuaagaauucagucuaaauuagcaaccaggaaggaaaaa

SEQ ID NO: 346755 - RNA, 63 nt, hsa
cagaacagccaguuuuacugugauucagagccacagucuaacugagcaccuuuuaaaccccuc

SEQ ID NO: 346756 - RNA, 63 nt, hsa
cacaugguaguguagggccaacauacaagcuaccagucuaauguguauaguagacuuugggaa

SEQ ID NO: 346757 - RNA, 63 nt, hsa
uuuacuccagggccugacacggggugugugcuacagucuaagggcucccacucaucugggagu

SEQ ID NO: 346758 - RNA, 63 nt, hsa
gugacccguuaggagcucucaccguacauacuccagucuaauuuaaaucugaccacaguugca

SEQ ID NO: 346759 - RNA, 63 nt, hsa
aaacuuguaccauguuacauguacacugcaccacagucuaaauucagaccagcauuugaagga

SEQ ID NO: 346760 - RNA, 63 nt, hsa
cagagaaaguuggugcugcucauacuggucucacagucuaaguaagugucugugaugcuccca

SEQ ID NO: 346761 - RNA, 63 nt, hsa
uuucugggcccaguucccacgugccuuucguggcagucuaaccucaggccauucucuuccccu

SEQ ID NO: 346762 - RNA, 63 nt, hsa
agauuggaguuuccaucccauguugguuugucccagucuaacguguugauaaaaugugacuug

SEQ ID NO: 346763 - RNA, 63 nt, hsa
acugucaacaaaugauaccuuuggauauccauccuccucgacuuauaguacagugguguauag

SEQ ID NO: 346764 - RNA, 63 nt, hsa
cccauuugucaccucgcacacuuauagcguuuccuccucgaaauucuaccaagacuggucaaa

SEQ ID NO: 346765 - RNA, 63 nt, hsa
ucaaguucuuggaaauggacaaagggcucuguccuccucgacccuagugggggaucaagaagg

SEQ ID NO: 346766 - RNA, 63 nt, hsa
gagcaagagauauuuugggcaugugggcuucaacuccucgacaucacuguucaugcuggcgag

SEQ ID NO: 346767 - RNA, 63 nt, hsa
ucaaccuaucuguuucccccacuagacugugagcuccucgagggcaggauugucuuuuuuuuu

SEQ ID NO: 346768 - RNA, 63 nt, hsa
ugaaacuuucaacaaucucuggagugacuuuuucuccucgaauugaaacaagucuauggcaaa

SEQ ID NO: 346769 - RNA, 63 nt, hsa
gaacucuucuaaccuccuugggcuauauuuucucuccucgaguugcuccucauggcugggcuc

SEQ ID NO: 346770 - RNA, 63 nt, hsa
cuauaauugcacaaggucuuguuauauugaucucuccucgaacucaacuaacuauaucuugaa

SEQ ID NO: 346771 - RNA, 63 nt, hsa
ugcugccagcggaggcgacagcagcguugggagcuccucgaugucagcuuuuugugcuggacu

SEQ ID NO: 346772 - RNA, 63 nt, hsa
agaugccaaggccugugccagguucccugugcccuccucgaggugggcagccaucaccagcca

SEQ ID NO: 346773 - RNA, 63 nt, hsa
uuaaaguucuuuauuuuaggucaaggucagcaucuccucgacgaucaagaucuaucucucuuc

SEQ ID NO: 346774 - RNA, 63 nt, hsa
aggggcugcuccugcuugccaauacugacccuccuccucgaugccuucggagccucugagcuc

SEQ ID NO: 346775 - RNA, 63 nt, hsa
agagcugugauuuuugcaaaguauuuuaccaaccuccucgauggcuuugauaaagguuagauu

SEQ ID NO: 346776 - RNA, 63 nt, hsa
cgagcauaccccaugcccaccguggagcugcaacuccucgacagcacugaguuugauagucuc

SEQ ID NO: 346777 - RNA, 63 nt, hsa
aggaguugaguuguuugcuccaggguuauucuccuccucgagucacagucacacgaauaccug

SEQ ID NO: 346778 - RNA, 63 nt, hsa
cuggacuuuuuaugccugccauacccgcuaaugcuccucgaggugcaggagcagguugcugag

SEQ ID NO: 346779 - RNA, 63 nt, hsa
aggcucccuccugucucuaagucaauuccaccccuccucgaagucccggcuuccaccccucuc

SEQ ID NO: 346780 - RNA, 63 nt, hsa
ucguuaaaugccugucuccccgcggaucaugggcuccucgaggacagggacuggccugucugu

SEQ ID NO: 346781 - RNA, 63 nt, hsa
aguaaggaggaggagaaggggggcuccuucccucuccucgaaugacguuaugggcacaugccu

SEQ ID NO: 346782 - RNA, 63 nt, hsa
ggagccgagcguccucgggcaccgcccucacaccuccucgagugcccugggaccacugggcca

SEQ ID NO: 346783 - RNA, 63 nt, hsa
uggcuguaucauagcgauauuuaucucuuccugcuccucgauaggccacuggcccugcacccu

SEQ ID NO: 346784 - RNA, 63 nt, hsa
cagccagagggaaagcgacccagacagcagccccuccucgacaggcccacccugcagcucagg

SEQ ID NO: 346785 - RNA, 63 nt, hsa
guguuuaggacauuugauuugcauauccaauaucuccucgaaaccuucagaaaaugguuuuau

SEQ ID NO: 346786 - RNA, 63 nt, hsa
augagggcugcagggccagugcugccccucggacuccucgagggguugggugcuaagcgcgag

SEQ ID NO: 346787 - RNA, 63 nt, hsa
ccaccagagcagccucucugcacaugcagcccucuccucgagcacgucacacacaguaagugu

SEQ ID NO: 346788 - RNA, 63 nt, hsa
uugcuuauauuaacaagaagacucacgcaauaacuccucgauaacucucagugaugguaucug

SEQ ID NO: 346789 - RNA, 63 nt, hsa
ugcccauggaggaggcucuugaugaucccaggucuccucgaccuccauacaccacacaggcau

SEQ ID NO: 346790 - RNA, 63 nt, hsa
aaggggccugccacccagccccuccagugcccucuccucgaugccucgcuccuuccugccccc

SEQ ID NO: 346791 - RNA, 63 nt, hsa
agucagucaguggugccgggaccccagggcagccuccucgacuccugaagaaaaggcagugcc

SEQ ID NO: 346792 - RNA, 63 nt, hsa
acgggcugggucauaaggacacuucuccuuccccuccucgaagcugguuggcaaggugaaggc

SEQ ID NO: 346793 - RNA, 63 nt, hsa
gaucuuccccugacuccccaccgaggagagccucuccucgacccugcacgggcucugaggcca

SEQ ID NO: 346794 - RNA, 63 nt, hsa
guuuauuauguuuucucuccaucagaaugaaagcuccucgagggcagggacuuuggucuauug

SEQ ID NO: 346795 - RNA, 63 nt, hsa
ccaucuggcacuggccuggacuccuccucugcccuccucgaggccugcacagcuguggccgug

SEQ ID NO: 346796 - RNA, 63 nt, hsa
uguuccuguggaggaugucuacgcccaggcgagcuccucgaccucugagggaccaucuccccg

SEQ ID NO: 346797 - RNA, 63 nt, hsa
gaggcgcugcgcggacucgcccccaggaacgcucuccucgagcccucccccaaacagacucgc

SEQ ID NO: 346798 - RNA, 63 nt, hsa
aaauccgaugugcuuccuucccuggcgcagucgcuccucgagccgcugccccccacccacccu

SEQ ID NO: 346799 - RNA, 63 nt, hsa
uuuuacuaaaauuuuauauaucuccccuuccuucuccucgagucacauaauaucaguaccuug

SEQ ID NO: 346800 - RNA, 63 nt, hsa
ucgggaggugccaucggcacuuccucccccgcccuccucgagugccaagaagguguuggacca

SEQ ID NO: 346801 - RNA, 63 nt, hsa
uggggacuuaguuagguagauuaauaucuggagcuccucgagggaccaaaucuccaacuuuuu

SEQ ID NO: 346802 - RNA, 63 nt, hsa
ccauucggacugcugugccgcgucccacgucuccuccucgaagccaugugcugcggucacuca

SEQ ID NO: 346803 - RNA, 63 nt, hsa
agguagauggggcugaccuggccucuccaaugucuccucgaacuagcaaaagccgcaugucca

SEQ ID NO: 346804 - RNA, 63 nt, hsa
uucucugucuccucucucuccuccuuugaccuucuccucgaccagccaucaugacauuuacca

SEQ ID NO: 346805 - RNA, 63 nt, hsa
auggccacgccagcugcggggacgcacuugggacuccucgagaggggacucgcggccgcgaug

SEQ ID NO: 346806 - RNA, 63 nt, hsa
uagagacuugcuugggggcugcagaagugcccucuccucgaauccugccaguugcauucuucc

SEQ ID NO: 346807 - RNA, 63 nt, hsa
ugcucccccagccgcaggccucaccugcaggugcuccucgauguccuugcggucguaggugau

SEQ ID NO: 346808 - RNA, 63 nt, hsa
gagcaugcgcagaggccaguuaaaguagaucaccuccucgaacccacuccgguuccccgcaac

SEQ ID NO: 346809 - RNA, 63 nt, hsa
ggugccuuuggccacaugugcugugcuguuugucuccucgacagggagccuguccaccagcag

SEQ ID NO: 346810 - RNA, 63 nt, hsa
agcucuuguugcacuaaaaaguggauuacaaaucuccucgacugcuuuaguggggaaaggaau

SEQ ID NO: 346811 - RNA, 63 nt, hsa
ccccugugccuugucacgccagacuucccacggcuccucgagaucccaacacugccagcauuu

SEQ ID NO: 346812 - RNA, 63 nt, hsa
gcccagggacucaugggacaccuuucccacagccuccucgauugcugugagcagaggccacuc

SEQ ID NO: 346813 - RNA, 63 nt, hsa
aggggcucuggggacuucuccuucuaugaaagccuccucgagccaggugcuccugggcaccuu

SEQ ID NO: 346814 - RNA, 63 nt, hsa
acacccccauucuccaccuguugguggggggugcuccucgacccacccagauuugaccguuca

SEQ ID NO: 346815 - RNA, 63 nt, hsa
ccguggccaugggaagauguuccacgcugccuccuccucgaguuuuccucggaaacacucuug

SEQ ID NO: 346816 - RNA, 63 nt, hsa
gcuagcucaugcugcucuugucagccucugguucuccucgaguccuuggggacguggcagaug

SEQ ID NO: 346817 - RNA, 63 nt, hsa
uucuuuccuucaagugaagaugugacugacuaccuccucgaguugucaugaggaugaaagaau

SEQ ID NO: 346818 - RNA, 63 nt, hsa
gccugccccucucugccuuuuccucgggugucccuccucgagccccuguggcauuggcuuggg

SEQ ID NO: 346819 - RNA, 63 nt, hsa
uuacuccuccauauucuuucaacccacaugagucuccucgagaagugaggagaggcaguuugg

SEQ ID NO: 346820 - RNA, 63 nt, hsa
ggagccacugggacagggugaggcucccagacgcuccucgaggugcccagcucuccagggagc

SEQ ID NO: 346821 - RNA, 63 nt, hsa
cccugcagggcaucuagcagccccggccggcgccuccucgagguuccaaaagaugccgccugg

SEQ ID NO: 346822 - RNA, 63 nt, hsa
guuccccauaugucuuccuuacuagacugugagcuccucgagggcagggaccgugccuuaugu

SEQ ID NO: 346823 - RNA, 63 nt, hsa
uccugaccccagccaacagcugagcugccgggccuccucgaggccccuaagccacccccagag

SEQ ID NO: 346824 - RNA, 63 nt, hsa
gggccaggggcugugugacggcugccugaaguucuccucgaucccccggugagcuuccugcag

SEQ ID NO: 346825 - RNA, 63 nt, hsa
cuugagaaggggacuugugaacucaaccacaaucuccucgagacauucauccagagaccaugu

SEQ ID NO: 346826 - RNA, 63 nt, hsa
gccugggacagccacuggaaacuuuugggaacucuccucgaaugugugggcccaaggccccca

SEQ ID NO: 346827 - RNA, 63 nt, hsa
ggcucaccuuucucuccucagcagaacaugucucuccucgaguccuuuggguuucagauuguu

SEQ ID NO: 346828 - RNA, 63 nt, hsa
ccuugguggggaccaagcagccuuucccguccccuccucgacccguacaguugagagccaggg

SEQ ID NO: 346829 - RNA, 63 nt, hsa
ggcuucccagaucccugagucucucuuuccuuccuccucgaucuuuaguuguccacggucaau

SEQ ID NO: 346830 - RNA, 63 nt, hsa
ggcaugacuggcuucugaaaaauuccagcacaccuccucgaaccucauugucagcagagaggg

SEQ ID NO: 346831 - RNA, 63 nt, hsa
ccccagccccugcugccccagccugugucuguucuccucgagggcuccagcauccucugcuuc

SEQ ID NO: 346832 - RNA, 63 nt, hsa
uuuuaaauauucauguugagugugccuaauacucuccucgacaagucaugcuguuuuaugcag

SEQ ID NO: 346833 - RNA, 63 nt, hsa
gucauuucuucauaagauagcaaauuuaaaucucuccucgaucagcuuuuaaaaaauguguac

SEQ ID NO: 346834 - RNA, 64 nt, hsa
aacugucaacaaaugauaccuuuggauauccauccuccucgacuuauaguacagugguguauag

SEQ ID NO: 346835 - RNA, 64 nt, hsa
ccccauuugucaccucgcacacuuauagcguuuccuccucgaaauucuaccaagacuggucaaa

SEQ ID NO: 346836 - RNA, 64 nt, hsa
gucaaguucuuggaaauggacaaagggcucuguccuccucgacccuagugggggaucaagaagg

SEQ ID NO: 346837 - RNA, 64 nt, hsa
ggagcaagagauauuuugggcaugugggcuucaacuccucgacaucacuguucaugcuggcgag

SEQ ID NO: 346838 - RNA, 64 nt, hsa
gucaaccuaucuguuucccccacuagacugugagcuccucgagggcaggauugucuuuuuuuuu

SEQ ID NO: 346839 - RNA, 64 nt, hsa
uugaaacuuucaacaaucucuggagugacuuuuucuccucgaauugaaacaagucuauggcaaa

SEQ ID NO: 346840 - RNA, 64 nt, hsa
ggaacucuucuaaccuccuugggcuauauuuucucuccucgaguugcuccucauggcugggcuc

SEQ ID NO: 346841 - RNA, 64 nt, hsa
acuauaauugcacaaggucuuguuauauugaucucuccucgaacucaacuaacuauaucuugaa

SEQ ID NO: 346842 - RNA, 64 nt, hsa
cugcugccagcggaggcgacagcagcguugggagcuccucgaugucagcuuuuugugcuggacu

SEQ ID NO: 346843 - RNA, 64 nt, hsa
gagaugccaaggccugugccagguucccugugcccuccucgaggugggcagccaucaccagcca

SEQ ID NO: 346844 - RNA, 64 nt, hsa
cuuaaaguucuuuauuuuaggucaaggucagcaucuccucgacgaucaagaucuaucucucuuc

SEQ ID NO: 346845 - RNA, 64 nt, hsa
gaggggcugcuccugcuugccaauacugacccuccuccucgaugccuucggagccucugagcuc

SEQ ID NO: 346846 - RNA, 64 nt, hsa
cagagcugugauuuuugcaaaguauuuuaccaaccuccucgauggcuuugauaaagguuagauu

SEQ ID NO: 346847 - RNA, 64 nt, hsa
acgagcauaccccaugcccaccguggagcugcaacuccucgacagcacugaguuugauagucuc

SEQ ID NO: 346848 - RNA, 64 nt, hsa
uaggaguugaguuguuugcuccaggguuauucuccuccucgagucacagucacacgaauaccug

SEQ ID NO: 346849 - RNA, 64 nt, hsa
ucuggacuuuuuaugccugccauacccgcuaaugcuccucgaggugcaggagcagguugcugag

SEQ ID NO: 346850 - RNA, 64 nt, hsa
gaggcucccuccugucucuaagucaauuccaccccuccucgaagucccggcuuccaccccucuc

SEQ ID NO: 346851 - RNA, 64 nt, hsa
gucguuaaaugccugucuccccgcggaucaugggcuccucgaggacagggacuggccugucugu

SEQ ID NO: 346852 - RNA, 64 nt, hsa
uaguaaggaggaggagaaggggggcuccuucccucuccucgaaugacguuaugggcacaugccu

SEQ ID NO: 346853 - RNA, 64 nt, hsa
aggagccgagcguccucgggcaccgcccucacaccuccucgagugcccugggaccacugggcca

SEQ ID NO: 346854 - RNA, 64 nt, hsa
auggcuguaucauagcgauauuuaucucuuccugcuccucgauaggccacuggcccugcacccu

SEQ ID NO: 346855 - RNA, 64 nt, hsa
acagccagagggaaagcgacccagacagcagccccuccucgacaggcccacccugcagcucagg

SEQ ID NO: 346856 - RNA, 64 nt, hsa
uguguuuaggacauuugauuugcauauccaauaucuccucgaaaccuucagaaaaugguuuuau

SEQ ID NO: 346857 - RNA, 64 nt, hsa
uaugagggcugcagggccagugcugccccucggacuccucgagggguugggugcuaagcgcgag

SEQ ID NO: 346858 - RNA, 64 nt, hsa
gccaccagagcagccucucugcacaugcagcccucuccucgagcacgucacacacaguaagugu

SEQ ID NO: 346859 - RNA, 64 nt, hsa
guugcuuauauuaacaagaagacucacgcaauaacuccucgauaacucucagugaugguaucug

SEQ ID NO: 346860 - RNA, 64 nt, hsa
cugcccauggaggaggcucuugaugaucccaggucuccucgaccuccauacaccacacaggcau

SEQ ID NO: 346861 - RNA, 64 nt, hsa
caaggggccugccacccagccccuccagugcccucuccucgaugccucgcuccuuccugccccc

SEQ ID NO: 346862 - RNA, 64 nt, hsa
gagucagucaguggugccgggaccccagggcagccuccucgacuccugaagaaaaggcagugcc

SEQ ID NO: 346863 - RNA, 64 nt, hsa
cacgggcugggucauaaggacacuucuccuuccccuccucgaagcugguuggcaaggugaaggc

SEQ ID NO: 346864 - RNA, 64 nt, hsa
cgaucuuccccugacuccccaccgaggagagccucuccucgacccugcacgggcucugaggcca

SEQ ID NO: 346865 - RNA, 64 nt, hsa
uguuuauuauguuuucucuccaucagaaugaaagcuccucgagggcagggacuuuggucuauug

SEQ ID NO: 346866 - RNA, 64 nt, hsa
uccaucuggcacuggccuggacuccuccucugcccuccucgaggccugcacagcuguggccgug

SEQ ID NO: 346867 - RNA, 64 nt, hsa
cuguuccuguggaggaugucuacgcccaggcgagcuccucgaccucugagggaccaucuccccg

SEQ ID NO: 346868 - RNA, 64 nt, hsa
ugaggcgcugcgcggacucgcccccaggaacgcucuccucgagcccucccccaaacagacucgc

SEQ ID NO: 346869 - RNA, 64 nt, hsa
aaaauccgaugugcuuccuucccuggcgcagucgcuccucgagccgcugccccccacccacccu

SEQ ID NO: 346870 - RNA, 64 nt, hsa
guuuuacuaaaauuuuauauaucuccccuuccuucuccucgagucacauaauaucaguaccuug

SEQ ID NO: 346871 - RNA, 64 nt, hsa
aucgggaggugccaucggcacuuccucccccgcccuccucgagugccaagaagguguuggacca

SEQ ID NO: 346872 - RNA, 64 nt, hsa
cuggggacuuaguuagguagauuaauaucuggagcuccucgagggaccaaaucuccaacuuuuu

SEQ ID NO: 346873 - RNA, 64 nt, hsa
cccauucggacugcugugccgcgucccacgucuccuccucgaagccaugugcugcggucacuca

SEQ ID NO: 346874 - RNA, 64 nt, hsa
cagguagauggggcugaccuggccucuccaaugucuccucgaacuagcaaaagccgcaugucca

SEQ ID NO: 346875 - RNA, 64 nt, hsa
auucucugucuccucucucuccuccuuugaccuucuccucgaccagccaucaugacauuuacca

SEQ ID NO: 346876 - RNA, 64 nt, hsa
cauggccacgccagcugcggggacgcacuugggacuccucgagaggggacucgcggccgcgaug

SEQ ID NO: 346877 - RNA, 64 nt, hsa
cuagagacuugcuugggggcugcagaagugcccucuccucgaauccugccaguugcauucuucc

SEQ ID NO: 346878 - RNA, 64 nt, hsa
cugcucccccagccgcaggccucaccugcaggugcuccucgauguccuugcggucguaggugau

SEQ ID NO: 346879 - RNA, 64 nt, hsa
ggagcaugcgcagaggccaguuaaaguagaucaccuccucgaacccacuccgguuccccgcaac

SEQ ID NO: 346880 - RNA, 64 nt, hsa
aggugccuuuggccacaugugcugugcuguuugucuccucgacagggagccuguccaccagcag

SEQ ID NO: 346881 - RNA, 64 nt, hsa
gagcucuuguugcacuaaaaaguggauuacaaaucuccucgacugcuuuaguggggaaaggaau

SEQ ID NO: 346882 - RNA, 64 nt, hsa
cccccugugccuugucacgccagacuucccacggcuccucgagaucccaacacugccagcauuu

SEQ ID NO: 346883 - RNA, 64 nt, hsa
ggcccagggacucaugggacaccuuucccacagccuccucgauugcugugagcagaggccacuc

SEQ ID NO: 346884 - RNA, 64 nt, hsa
aaggggcucuggggacuucuccuucuaugaaagccuccucgagccaggugcuccugggcaccuu

SEQ ID NO: 346885 - RNA, 64 nt, hsa
aacacccccauucuccaccuguugguggggggugcuccucgacccacccagauuugaccguuca

SEQ ID NO: 346886 - RNA, 64 nt, hsa; identical to SEQ ID NO: 76484

SEQ ID NO: 346887 - RNA, 64 nt, hsa; identical to SEQ ID NO: 76485

SEQ ID NO: 346888 - RNA, 64 nt, hsa
auucuuuccuucaagugaagaugugacugacuaccuccucgaguugucaugaggaugaaagaau

SEQ ID NO: 346889 - RNA, 64 nt, hsa
ugccugccccucucugccuuuuccucgggugucccuccucgagccccuguggcauuggcuuggg

SEQ ID NO: 346890 - RNA, 64 nt, hsa
cuuacuccuccauauucuuucaacccacaugagucuccucgagaagugaggagaggcaguuugg

SEQ ID NO: 346891 - RNA, 64 nt, hsa
aggagccacugggacagggugaggcucccagacgcuccucgaggugcccagcucuccagggagc

SEQ ID NO: 346892 - RNA, 64 nt, hsa
ucccugcagggcaucuagcagccccggccggcgccuccucgagguuccaaaagaugccgccugg

SEQ ID NO: 346893 - RNA, 64 nt, hsa
gguuccccauaugucuuccuuacuagacugugagcuccucgagggcagggaccgugccuuaugu

SEQ ID NO: 346894 - RNA, 64 nt, hsa
auccugaccccagccaacagcugagcugccgggccuccucgaggccccuaagccacccccagag

SEQ ID NO: 346895 - RNA, 64 nt, hsa
agggccaggggcugugugacggcugccugaaguucuccucgaucccccggugagcuuccugcag

SEQ ID NO: 346896 - RNA, 64 nt, hsa
acuugagaaggggacuugugaacucaaccacaaucuccucgagacauucauccagagaccaugu

SEQ ID NO: 346897 - RNA, 64 nt, hsa
ugccugggacagccacuggaaacuuuugggaacucuccucgaaugugugggcccaaggccccca

SEQ ID NO: 346898 - RNA, 64 nt, hsa
uggcucaccuuucucuccucagcagaacaugucucuccucgaguccuuuggguuucagauuguu

SEQ ID NO: 346899 - RNA, 64 nt, hsa
gccuugguggggaccaagcagccuuucccguccccuccucgacccguacaguugagagccaggg

SEQ ID NO: 346900 - RNA, 64 nt, hsa
aggcuucccagaucccugagucucucuuuccuuccuccucgaucuuuaguuguccacggucaau

SEQ ID NO: 346901 - RNA, 64 nt, hsa
aggcaugacuggcuucugaaaaauuccagcacaccuccucgaaccucauugucagcagagaggg

SEQ ID NO: 346902 - RNA, 64 nt, hsa
cccccagccccugcugccccagccugugucuguucuccucgagggcuccagcauccucugcuuc

SEQ ID NO: 346903 - RNA, 64 nt, hsa
cuuuuaaauauucauguugagugugccuaauacucuccucgacaagucaugcuguuuuaugcag

SEQ ID NO: 346904 - RNA, 64 nt, hsa
ggucauuucuucauaagauagcaaauuuaaaucucuccucgaucagcuuuuaaaaaauguguac

SEQ ID NO: 346905 - RNA, 64 nt, hsa; identical to SEQ ID NO: 182508

SEQ ID NO: 346906 - RNA, 64 nt, hsa; identical to SEQ ID NO: 182509

SEQ ID NO: 346907 - RNA, 64 nt, hsa; identical to SEQ ID NO: 182510

SEQ ID NO: 346908 - RNA, 64 nt, hsa; identical to SEQ ID NO: 182511

SEQ ID NO: 346909 - RNA, 64 nt, hsa; identical to SEQ ID NO: 182512

SEQ ID NO: 346910 - RNA, 64 nt, hsa; identical to SEQ ID NO: 182513

SEQ ID NO: 346911 - RNA, 64 nt, hsa; identical to SEQ ID NO: 182514

SEQ ID NO: 346912 - RNA, 64 nt, hsa; identical to SEQ ID NO: 182515

SEQ ID NO: 346913 - RNA, 64 nt, hsa; identical to SEQ ID NO: 182516

SEQ ID NO: 346914 - RNA, 64 nt, hsa; identical to SEQ ID NO: 182517

SEQ ID NO: 346915 - RNA, 64 nt, hsa; identical to SEQ ID NO: 182518

SEQ ID NO: 346916 - RNA, 64 nt, hsa; identical to SEQ ID NO: 182519

SEQ ID NO: 346917 - RNA, 64 nt, hsa; identical to SEQ ID NO: 182520

SEQ ID NO: 346918 - RNA, 64 nt, hsa; identical to SEQ ID NO: 182521

SEQ ID NO: 346919 - RNA, 64 nt, hsa; identical to SEQ ID NO: 182522

SEQ ID NO: 346920 - RNA, 64 nt, hsa; identical to SEQ ID NO: 182523

SEQ ID NO: 346921 - RNA, 64 nt, hsa; identical to SEQ ID NO: 182524

SEQ ID NO: 346922 - RNA, 64 nt, hsa; identical to SEQ ID NO: 182525

SEQ ID NO: 346923 - RNA, 64 nt, hsa; identical to SEQ ID NO: 182526

SEQ ID NO: 346924 - RNA, 64 nt, hsa; identical to SEQ ID NO: 182527

SEQ ID NO: 346925 - RNA, 64 nt, hsa; identical to SEQ ID NO: 182528

SEQ ID NO: 346926 - RNA, 64 nt, hsa; identical to SEQ ID NO: 182529

SEQ ID NO: 346927 - RNA, 64 nt, hsa; identical to SEQ ID NO: 182530

SEQ ID NO: 346928 - RNA, 64 nt, hsa; identical to SEQ ID NO: 182531

SEQ ID NO: 346929 - RNA, 64 nt, hsa; identical to SEQ ID NO: 182532

SEQ ID NO: 346930 - RNA, 64 nt, hsa; identical to SEQ ID NO: 182533

SEQ ID NO: 346931 - RNA, 64 nt, hsa; identical to SEQ ID NO: 182534

SEQ ID NO: 346932 - RNA, 64 nt, hsa; identical to SEQ ID NO: 182535

SEQ ID NO: 346933 - RNA, 64 nt, hsa; identical to SEQ ID NO: 298158

SEQ ID NO: 346934 - RNA, 64 nt, hsa; identical to SEQ ID NO: 298159

SEQ ID NO: 346935 - RNA, 64 nt, hsa; identical to SEQ ID NO: 298160

SEQ ID NO: 346936 - RNA, 64 nt, hsa; identical to SEQ ID NO: 298161

SEQ ID NO: 346937 - RNA, 64 nt, hsa; identical to SEQ ID NO: 298162

SEQ ID NO: 346938 - RNA, 64 nt, hsa; identical to SEQ ID NO: 298163

SEQ ID NO: 346939 - RNA, 64 nt, hsa; identical to SEQ ID NO: 298164

SEQ ID NO: 346940 - RNA, 64 nt, hsa; identical to SEQ ID NO: 298165

SEQ ID NO: 346941 - RNA, 64 nt, hsa; identical to SEQ ID NO: 298166

SEQ ID NO: 346942 - RNA, 64 nt, hsa; identical to SEQ ID NO: 298167

SEQ ID NO: 346943 - RNA, 64 nt, hsa; identical to SEQ ID NO: 298168

SEQ ID NO: 346944 - RNA, 64 nt, hsa; identical to SEQ ID NO: 298169

SEQ ID NO: 346945 - RNA, 64 nt, hsa; identical to SEQ ID NO: 298170

SEQ ID NO: 346946 - RNA, 64 nt, hsa; identical to SEQ ID NO: 298171

SEQ ID NO: 346947 - RNA, 64 nt, hsa; identical to SEQ ID NO: 298172

SEQ ID NO: 346948 - RNA, 64 nt, hsa; identical to SEQ ID NO: 298173

SEQ ID NO: 346949 - RNA, 64 nt, hsa; identical to SEQ ID NO: 298174

SEQ ID NO: 346950 - RNA, 64 nt, hsa; identical to SEQ ID NO: 298175

SEQ ID NO: 346951 - RNA, 64 nt, hsa; identical to SEQ ID NO: 298176

SEQ ID NO: 346952 - RNA, 64 nt, hsa; identical to SEQ ID NO: 298177

SEQ ID NO: 346953 - RNA, 64 nt, hsa; identical to SEQ ID NO: 298178

SEQ ID NO: 346954 - RNA, 64 nt, hsa; identical to SEQ ID NO: 298179

SEQ ID NO: 346955 - RNA, 64 nt, hsa; identical to SEQ ID NO: 298180

SEQ ID NO: 346956 - RNA, 64 nt, hsa; identical to SEQ ID NO: 298181

SEQ ID NO: 346957 - RNA, 64 nt, hsa; identical to SEQ ID NO: 298182

SEQ ID NO: 346958 - RNA, 64 nt, hsa; identical to SEQ ID NO: 298183

SEQ ID NO: 346959 - RNA, 64 nt, hsa; identical to SEQ ID NO: 298184

SEQ ID NO: 346960 - RNA, 64 nt, hsa; identical to SEQ ID NO: 298185

SEQ ID NO: 346961 - RNA, 64 nt, hsa; identical to SEQ ID NO: 298186

SEQ ID NO: 346962 - RNA, 64 nt, hsa; identical to SEQ ID NO: 298187

SEQ ID NO: 346963 - RNA, 64 nt, hsa; identical to SEQ ID NO: 298188

SEQ ID NO: 346964 - RNA, 64 nt, hsa; identical to SEQ ID NO: 298189

SEQ ID NO: 346965 - RNA, 64 nt, hsa; identical to SEQ ID NO: 298190

SEQ ID NO: 346966 - RNA, 64 nt, hsa; identical to SEQ ID NO: 298191

SEQ ID NO: 346967 - RNA, 64 nt, hsa; identical to SEQ ID NO: 298192

SEQ ID NO: 346968 - RNA, 64 nt, hsa; identical to SEQ ID NO: 298193

SEQ ID NO: 346969 - RNA, 64 nt, hsa; identical to SEQ ID NO: 298194

SEQ ID NO: 346970 - RNA, 64 nt, hsa; identical to SEQ ID NO: 298195

SEQ ID NO: 346971 - RNA, 64 nt, hsa; identical to SEQ ID NO: 298196

SEQ ID NO: 346972 - RNA, 64 nt, hsa; identical to SEQ ID NO: 298197

SEQ ID NO: 346973 - RNA, 64 nt, hsa; identical to SEQ ID NO: 298198

SEQ ID NO: 346974 - RNA, 64 nt, hsa; identical to SEQ ID NO: 298199

SEQ ID NO: 346975 - RNA, 64 nt, hsa; identical to SEQ ID NO: 298200

SEQ ID NO: 346976 - RNA, 64 nt, hsa; identical to SEQ ID NO: 298201

SEQ ID NO: 346977 - RNA, 64 nt, hsa; identical to SEQ ID NO: 298202

SEQ ID NO: 346978 - RNA, 64 nt, hsa; identical to SEQ ID NO: 298203

SEQ ID NO: 346979 - RNA, 64 nt, hsa; identical to SEQ ID NO: 298204

SEQ ID NO: 346980 - RNA, 64 nt, hsa; identical to SEQ ID NO: 298205

SEQ ID NO: 346981 - RNA, 64 nt, hsa; identical to SEQ ID NO: 298206

SEQ ID NO: 346982 - RNA, 64 nt, hsa; identical to SEQ ID NO: 298207

SEQ ID NO: 346983 - RNA, 64 nt, hsa; identical to SEQ ID NO: 298208

SEQ ID NO: 346984 - RNA, 64 nt, hsa; identical to SEQ ID NO: 298209

SEQ ID NO: 346985 - RNA, 64 nt, hsa; identical to SEQ ID NO: 298210

SEQ ID NO: 346986 - RNA, 64 nt, hsa; identical to SEQ ID NO: 298211

SEQ ID NO: 346987 - RNA, 64 nt, hsa; identical to SEQ ID NO: 298212

SEQ ID NO: 346988 - RNA, 64 nt, hsa; identical to SEQ ID NO: 298213

SEQ ID NO: 346989 - RNA, 64 nt, hsa; identical to SEQ ID NO: 298214

SEQ ID NO: 346990 - RNA, 64 nt, hsa; identical to SEQ ID NO: 298215

SEQ ID NO: 346991 - RNA, 64 nt, hsa; identical to SEQ ID NO: 298216

SEQ ID NO: 346992 - RNA, 64 nt, hsa; identical to SEQ ID NO: 298217

SEQ ID NO: 346993 - RNA, 64 nt, hsa; identical to SEQ ID NO: 298218

SEQ ID NO: 346994 - RNA, 64 nt, hsa; identical to SEQ ID NO: 298219

SEQ ID NO: 346995 - RNA, 64 nt, hsa; identical to SEQ ID NO: 298220

SEQ ID NO: 346996 - RNA, 64 nt, hsa; identical to SEQ ID NO: 298221

SEQ ID NO: 346997 - RNA, 64 nt, hsa; identical to SEQ ID NO: 298222

SEQ ID NO: 346998 - RNA, 64 nt, hsa; identical to SEQ ID NO: 298223

SEQ ID NO: 346999 - RNA, 64 nt, hsa; identical to SEQ ID NO: 298224

SEQ ID NO: 347000 - RNA, 64 nt, hsa; identical to SEQ ID NO: 298225

SEQ ID NO: 347001 - RNA, 64 nt, hsa; identical to SEQ ID NO: 298226

SEQ ID NO: 347002 - RNA, 64 nt, hsa; identical to SEQ ID NO: 298227

SEQ ID NO: 347003 - RNA, 64 nt, hsa; identical to SEQ ID NO: 298228

SEQ ID NO: 347004 - RNA, 64 nt, hsa; identical to SEQ ID NO: 298229

SEQ ID NO: 347005 - RNA, 56 nt, hsa; identical to SEQ ID NO: 298230

SEQ ID NO: 347006 - RNA, 64 nt, hsa; identical to SEQ ID NO: 298231

SEQ ID NO: 347007 - RNA, 64 nt, hsa; identical to SEQ ID NO: 298232

SEQ ID NO: 347008 - RNA, 64 nt, hsa; identical to SEQ ID NO: 298233

SEQ ID NO: 347009 - RNA, 64 nt, hsa; identical to SEQ ID NO: 298234

SEQ ID NO: 347010 - RNA, 64 nt, hsa; identical to SEQ ID NO: 298235

SEQ ID NO: 347011 - RNA, 64 nt, hsa; identical to SEQ ID NO: 298236

SEQ ID NO: 347012 - RNA, 64 nt, hsa; identical to SEQ ID NO: 298237

SEQ ID NO: 347013 - RNA, 64 nt, hsa; identical to SEQ ID NO: 298238

SEQ ID NO: 347014 - RNA, 63 nt, hsa; identical to SEQ ID NO: 298239

SEQ ID NO: 347015 - RNA, 64 nt, hsa; identical to SEQ ID NO: 298240

SEQ ID NO: 347016 - RNA, 64 nt, hsa; identical to SEQ ID NO: 298241

SEQ ID NO: 347017 - RNA, 64 nt, hsa; identical to SEQ ID NO: 298242

SEQ ID NO: 347018 - RNA, 64 nt, hsa; identical to SEQ ID NO: 298243

SEQ ID NO: 347019 - RNA, 64 nt, hsa; identical to SEQ ID NO: 298244

SEQ ID NO: 347020 - RNA, 64 nt, hsa; identical to SEQ ID NO: 298245

SEQ ID NO: 347021 - RNA, 64 nt, hsa; identical to SEQ ID NO: 298246

SEQ ID NO: 347022 - RNA, 64 nt, hsa; identical to SEQ ID NO: 298247

SEQ ID NO: 347023 - RNA, 64 nt, hsa; identical to SEQ ID NO: 298248

SEQ ID NO: 347024 - RNA, 64 nt, hsa; identical to SEQ ID NO: 298249

SEQ ID NO: 347025 - RNA, 64 nt, hsa; identical to SEQ ID NO: 182508

SEQ ID NO: 347026 - RNA, 64 nt, hsa; identical to SEQ ID NO: 182509

SEQ ID NO: 347027 - RNA, 64 nt, hsa; identical to SEQ ID NO: 182510

SEQ ID NO: 347028 - RNA, 64 nt, hsa; identical to SEQ ID NO: 182511

SEQ ID NO: 347029 - RNA, 64 nt, hsa; identical to SEQ ID NO: 182512

SEQ ID NO: 347030 - RNA, 64 nt, hsa; identical to SEQ ID NO: 182513

SEQ ID NO: 347031 - RNA, 64 nt, hsa; identical to SEQ ID NO: 182514

SEQ ID NO: 347032 - RNA, 64 nt, hsa; identical to SEQ ID NO: 182515

SEQ ID NO: 347033 - RNA, 64 nt, hsa; identical to SEQ ID NO: 182516

SEQ ID NO: 347034 - RNA, 64 nt, hsa; identical to SEQ ID NO: 182517

SEQ ID NO: 347035 - RNA, 64 nt, hsa; identical to SEQ ID NO: 182518

SEQ ID NO: 347036 - RNA, 64 nt, hsa; identical to SEQ ID NO: 182519

SEQ ID NO: 347037 - RNA, 64 nt, hsa; identical to SEQ ID NO: 182520

SEQ ID NO: 347038 - RNA, 64 nt, hsa; identical to SEQ ID NO: 182521

SEQ ID NO: 347039 - RNA, 64 nt, hsa; identical to SEQ ID NO: 182522

SEQ ID NO: 347040 - RNA, 64 nt, hsa; identical to SEQ ID NO: 182523

SEQ ID NO: 347041 - RNA, 64 nt, hsa; identical to SEQ ID NO: 182524

SEQ ID NO: 347042 - RNA, 64 nt, hsa; identical to SEQ ID NO: 182525

SEQ ID NO: 347043 - RNA, 64 nt, hsa; identical to SEQ ID NO: 182526

SEQ ID NO: 347044 - RNA, 64 nt, hsa; identical to SEQ ID NO: 182527

SEQ ID NO: 347045 - RNA, 64 nt, hsa; identical to SEQ ID NO: 182528

SEQ ID NO: 347046 - RNA, 64 nt, hsa; identical to SEQ ID NO: 182529

SEQ ID NO: 347047 - RNA, 64 nt, hsa; identical to SEQ ID NO: 182530

SEQ ID NO: 347048 - RNA, 64 nt, hsa; identical to SEQ ID NO: 182531

SEQ ID NO: 347049 - RNA, 64 nt, hsa; identical to SEQ ID NO: 182532

SEQ ID NO: 347050 - RNA, 64 nt, hsa; identical to SEQ ID NO: 182533

SEQ ID NO: 347051 - RNA, 64 nt, hsa; identical to SEQ ID NO: 182534

SEQ ID NO: 347052 - RNA, 64 nt, hsa; identical to SEQ ID NO: 182535

SEQ ID NO: 347053 - RNA, 64 nt, hsa; identical to SEQ ID NO: 298158

SEQ ID NO: 347054 - RNA, 64 nt, hsa; identical to SEQ ID NO: 298159

SEQ ID NO: 347055 - RNA, 64 nt, hsa; identical to SEQ ID NO: 298160

SEQ ID NO: 347056 - RNA, 64 nt, hsa; identical to SEQ ID NO: 298161

SEQ ID NO: 347057 - RNA, 64 nt, hsa; identical to SEQ ID NO: 298162

SEQ ID NO: 347058 - RNA, 64 nt, hsa; identical to SEQ ID NO: 298163

SEQ ID NO: 347059 - RNA, 64 nt, hsa; identical to SEQ ID NO: 298164

SEQ ID NO: 347060 - RNA, 64 nt, hsa; identical to SEQ ID NO: 298165

SEQ ID NO: 347061 - RNA, 64 nt, hsa; identical to SEQ ID NO: 298166

SEQ ID NO: 347062 - RNA, 64 nt, hsa; identical to SEQ ID NO: 298167

SEQ ID NO: 347063 - RNA, 64 nt, hsa; identical to SEQ ID NO: 298168

SEQ ID NO: 347064 - RNA, 64 nt, hsa; identical to SEQ ID NO: 298169

SEQ ID NO: 347065 - RNA, 64 nt, hsa; identical to SEQ ID NO: 298170

SEQ ID NO: 347066 - RNA, 64 nt, hsa; identical to SEQ ID NO: 298171

SEQ ID NO: 347067 - RNA, 64 nt, hsa; identical to SEQ ID NO: 298172

SEQ ID NO: 347068 - RNA, 64 nt, hsa; identical to SEQ ID NO: 298173

SEQ ID NO: 347069 - RNA, 64 nt, hsa; identical to SEQ ID NO: 298174

SEQ ID NO: 347070 - RNA, 64 nt, hsa; identical to SEQ ID NO: 298175

SEQ ID NO: 347071 - RNA, 64 nt, hsa; identical to SEQ ID NO: 298176

SEQ ID NO: 347072 - RNA, 64 nt, hsa; identical to SEQ ID NO: 298177

SEQ ID NO: 347073 - RNA, 64 nt, hsa; identical to SEQ ID NO: 298178

SEQ ID NO: 347074 - RNA, 64 nt, hsa; identical to SEQ ID NO: 298179

SEQ ID NO: 347075 - RNA, 64 nt, hsa; identical to SEQ ID NO: 298180

SEQ ID NO: 347076 - RNA, 64 nt, hsa; identical to SEQ ID NO: 298181

SEQ ID NO: 347077 - RNA, 64 nt, hsa; identical to SEQ ID NO: 298182

SEQ ID NO: 347078 - RNA, 64 nt, hsa; identical to SEQ ID NO: 298183

SEQ ID NO: 347079 - RNA, 64 nt, hsa; identical to SEQ ID NO: 298184

SEQ ID NO: 347080 - RNA, 64 nt, hsa; identical to SEQ ID NO: 298185

SEQ ID NO: 347081 - RNA, 64 nt, hsa; identical to SEQ ID NO: 298186

SEQ ID NO: 347082 - RNA, 64 nt, hsa; identical to SEQ ID NO: 298187

SEQ ID NO: 347083 - RNA, 64 nt, hsa; identical to SEQ ID NO: 298188

SEQ ID NO: 347084 - RNA, 64 nt, hsa; identical to SEQ ID NO: 298189

SEQ ID NO: 347085 - RNA, 64 nt, hsa; identical to SEQ ID NO: 298190

SEQ ID NO: 347086 - RNA, 64 nt, hsa; identical to SEQ ID NO: 298191

SEQ ID NO: 347087 - RNA, 64 nt, hsa; identical to SEQ ID NO: 298192

SEQ ID NO: 347088 - RNA, 64 nt, hsa; identical to SEQ ID NO: 298193

SEQ ID NO: 347089 - RNA, 64 nt, hsa; identical to SEQ ID NO: 298194

SEQ ID NO: 347090 - RNA, 64 nt, hsa; identical to SEQ ID NO: 298195

SEQ ID NO: 347091 - RNA, 64 nt, hsa; identical to SEQ ID NO: 298196

SEQ ID NO: 347092 - RNA, 64 nt, hsa; identical to SEQ ID NO: 298197

SEQ ID NO: 347093 - RNA, 64 nt, hsa; identical to SEQ ID NO: 298198

SEQ ID NO: 347094 - RNA, 64 nt, hsa; identical to SEQ ID NO: 298199

SEQ ID NO: 347095 - RNA, 64 nt, hsa; identical to SEQ ID NO: 298200

SEQ ID NO: 347096 - RNA, 64 nt, hsa; identical to SEQ ID NO: 298201

SEQ ID NO: 347097 - RNA, 64 nt, hsa; identical to SEQ ID NO: 298202

SEQ ID NO: 347098 - RNA, 64 nt, hsa; identical to SEQ ID NO: 298203

SEQ ID NO: 347099 - RNA, 64 nt, hsa; identical to SEQ ID NO: 298204

SEQ ID NO: 347100 - RNA, 64 nt, hsa; identical to SEQ ID NO: 298205

SEQ ID NO: 347101 - RNA, 64 nt, hsa; identical to SEQ ID NO: 298206

SEQ ID NO: 347102 - RNA, 64 nt, hsa; identical to SEQ ID NO: 298207

SEQ ID NO: 347103 - RNA, 64 nt, hsa; identical to SEQ ID NO: 298208

SEQ ID NO: 347104 - RNA, 64 nt, hsa; identical to SEQ ID NO: 298209

SEQ ID NO: 347105 - RNA, 64 nt, hsa; identical to SEQ ID NO: 298210

SEQ ID NO: 347106 - RNA, 64 nt, hsa; identical to SEQ ID NO: 298211

SEQ ID NO: 347107 - RNA, 64 nt, hsa; identical to SEQ ID NO: 298212

SEQ ID NO: 347108 - RNA, 64 nt, hsa; identical to SEQ ID NO: 298213

SEQ ID NO: 347109 - RNA, 64 nt, hsa; identical to SEQ ID NO: 298214

SEQ ID NO: 347110 - RNA, 64 nt, hsa; identical to SEQ ID NO: 298215

SEQ ID NO: 347111 - RNA, 64 nt, hsa; identical to SEQ ID NO: 298216

SEQ ID NO: 347112 - RNA, 64 nt, hsa; identical to SEQ ID NO: 298217

SEQ ID NO: 347113 - RNA, 64 nt, hsa; identical to SEQ ID NO: 298218

SEQ ID NO: 347114 - RNA, 64 nt, hsa; identical to SEQ ID NO: 298219

SEQ ID NO: 347115 - RNA, 64 nt, hsa; identical to SEQ ID NO: 298220

SEQ ID NO: 347116 - RNA, 64 nt, hsa; identical to SEQ ID NO: 298221

SEQ ID NO: 347117 - RNA, 64 nt, hsa; identical to SEQ ID NO: 298222

SEQ ID NO: 347118 - RNA, 64 nt, hsa; identical to SEQ ID NO: 298223

SEQ ID NO: 347119 - RNA, 64 nt, hsa; identical to SEQ ID NO: 298224

SEQ ID NO: 347120 - RNA, 64 nt, hsa; identical to SEQ ID NO: 298225

SEQ ID NO: 347121 - RNA, 64 nt, hsa; identical to SEQ ID NO: 298226

SEQ ID NO: 347122 - RNA, 64 nt, hsa; identical to SEQ ID NO: 298227

SEQ ID NO: 347123 - RNA, 64 nt, hsa; identical to SEQ ID NO: 298228

SEQ ID NO: 347124 - RNA, 64 nt, hsa; identical to SEQ ID NO: 298229

SEQ ID NO: 347125 - RNA, 56 nt, hsa; identical to SEQ ID NO: 298230

SEQ ID NO: 347126 - RNA, 64 nt, hsa; identical to SEQ ID NO: 298231

SEQ ID NO: 347127 - RNA, 64 nt, hsa; identical to SEQ ID NO: 298232

SEQ ID NO: 347128 - RNA, 64 nt, hsa; identical to SEQ ID NO: 298233

SEQ ID NO: 347129 - RNA, 64 nt, hsa; identical to SEQ ID NO: 298234

SEQ ID NO: 347130 - RNA, 64 nt, hsa; identical to SEQ ID NO: 298235

SEQ ID NO: 347131 - RNA, 64 nt, hsa; identical to SEQ ID NO: 298236

SEQ ID NO: 347132 - RNA, 64 nt, hsa; identical to SEQ ID NO: 298237

SEQ ID NO: 347133 - RNA, 64 nt, hsa; identical to SEQ ID NO: 298238

SEQ ID NO: 347134 - RNA, 63 nt, hsa; identical to SEQ ID NO: 298239

SEQ ID NO: 347135 - RNA, 64 nt, hsa; identical to SEQ ID NO: 298240

SEQ ID NO: 347136 - RNA, 64 nt, hsa; identical to SEQ ID NO: 298241

SEQ ID NO: 347137 - RNA, 64 nt, hsa; identical to SEQ ID NO: 298242

SEQ ID NO: 347138 - RNA, 64 nt, hsa; identical to SEQ ID NO: 298243

SEQ ID NO: 347139 - RNA, 64 nt, hsa; identical to SEQ ID NO: 298244

SEQ ID NO: 347140 - RNA, 64 nt, hsa; identical to SEQ ID NO: 298245

SEQ ID NO: 347141 - RNA, 64 nt, hsa; identical to SEQ ID NO: 298246

SEQ ID NO: 347142 - RNA, 64 nt, hsa; identical to SEQ ID NO: 298247

SEQ ID NO: 347143 - RNA, 64 nt, hsa; identical to SEQ ID NO: 298248

SEQ ID NO: 347144 - RNA, 64 nt, hsa; identical to SEQ ID NO: 298249

SEQ ID NO: 347145 - RNA, 64 nt, hsa; identical to SEQ ID NO: 182508

SEQ ID NO: 347146 - RNA, 64 nt, hsa; identical to SEQ ID NO: 182509

SEQ ID NO: 347147 - RNA, 64 nt, hsa; identical to SEQ ID NO: 182510

SEQ ID NO: 347148 - RNA, 64 nt, hsa; identical to SEQ ID NO: 182511

SEQ ID NO: 347149 - RNA, 64 nt, hsa; identical to SEQ ID NO: 182512

SEQ ID NO: 347150 - RNA, 64 nt, hsa; identical to SEQ ID NO: 182513

SEQ ID NO: 347151 - RNA, 64 nt, hsa; identical to SEQ ID NO: 182514

SEQ ID NO: 347152 - RNA, 64 nt, hsa; identical to SEQ ID NO: 182515

SEQ ID NO: 347153 - RNA, 64 nt, hsa; identical to SEQ ID NO: 182516

SEQ ID NO: 347154 - RNA, 64 nt, hsa; identical to SEQ ID NO: 182517

SEQ ID NO: 347155 - RNA, 64 nt, hsa; identical to SEQ ID NO: 182518

SEQ ID NO: 347156 - RNA, 64 nt, hsa; identical to SEQ ID NO: 182519

SEQ ID NO: 347157 - RNA, 64 nt, hsa; identical to SEQ ID NO: 182520

SEQ ID NO: 347158 - RNA, 64 nt, hsa; identical to SEQ ID NO: 182521

SEQ ID NO: 347159 - RNA, 64 nt, hsa; identical to SEQ ID NO: 182522

SEQ ID NO: 347160 - RNA, 64 nt, hsa; identical to SEQ ID NO: 182523

SEQ ID NO: 347161 - RNA, 64 nt, hsa; identical to SEQ ID NO: 182524

SEQ ID NO: 347162 - RNA, 64 nt, hsa; identical to SEQ ID NO: 182525

SEQ ID NO: 347163 - RNA, 64 nt, hsa; identical to SEQ ID NO: 182526

SEQ ID NO: 347164 - RNA, 64 nt, hsa; identical to SEQ ID NO: 182527

SEQ ID NO: 347165 - RNA, 64 nt, hsa; identical to SEQ ID NO: 182528

SEQ ID NO: 347166 - RNA, 64 nt, hsa; identical to SEQ ID NO: 182529

SEQ ID NO: 347167 - RNA, 64 nt, hsa; identical to SEQ ID NO: 182530

SEQ ID NO: 347168 - RNA, 64 nt, hsa; identical to SEQ ID NO: 182531

SEQ ID NO: 347169 - RNA, 64 nt, hsa; identical to SEQ ID NO: 182532

SEQ ID NO: 347170 - RNA, 64 nt, hsa; identical to SEQ ID NO: 182533

SEQ ID NO: 347171 - RNA, 64 nt, hsa; identical to SEQ ID NO: 182534

SEQ ID NO: 347172 - RNA, 64 nt, hsa; identical to SEQ ID NO: 182535

SEQ ID NO: 347173 - RNA, 64 nt, hsa; identical to SEQ ID NO: 298158

SEQ ID NO: 347174 - RNA, 64 nt, hsa; identical to SEQ ID NO: 298159

SEQ ID NO: 347175 - RNA, 64 nt, hsa; identical to SEQ ID NO: 298160

SEQ ID NO: 347176 - RNA, 64 nt, hsa; identical to SEQ ID NO: 298161

SEQ ID NO: 347177 - RNA, 64 nt, hsa; identical to SEQ ID NO: 298162

SEQ ID NO: 347178 - RNA, 64 nt, hsa; identical to SEQ ID NO: 298163

SEQ ID NO: 347179 - RNA, 64 nt, hsa; identical to SEQ ID NO: 298164

SEQ ID NO: 347180 - RNA, 64 nt, hsa; identical to SEQ ID NO: 298165

SEQ ID NO: 347181 - RNA, 64 nt, hsa; identical to SEQ ID NO: 298166

SEQ ID NO: 347182 - RNA, 64 nt, hsa; identical to SEQ ID NO: 298167

SEQ ID NO: 347183 - RNA, 64 nt, hsa; identical to SEQ ID NO: 298168

SEQ ID NO: 347184 - RNA, 64 nt, hsa; identical to SEQ ID NO: 298169

SEQ ID NO: 347185 - RNA, 64 nt, hsa; identical to SEQ ID NO: 298170

SEQ ID NO: 347186 - RNA, 64 nt, hsa; identical to SEQ ID NO: 298171

SEQ ID NO: 347187 - RNA, 64 nt, hsa; identical to SEQ ID NO: 298172

SEQ ID NO: 347188 - RNA, 64 nt, hsa; identical to SEQ ID NO: 298173

SEQ ID NO: 347189 - RNA, 64 nt, hsa; identical to SEQ ID NO: 298174

SEQ ID NO: 347190 - RNA, 64 nt, hsa; identical to SEQ ID NO: 298175

SEQ ID NO: 347191 - RNA, 64 nt, hsa; identical to SEQ ID NO: 298176

SEQ ID NO: 347192 - RNA, 64 nt, hsa; identical to SEQ ID NO: 298177

SEQ ID NO: 347193 - RNA, 64 nt, hsa; identical to SEQ ID NO: 298178

SEQ ID NO: 347194 - RNA, 64 nt, hsa; identical to SEQ ID NO: 298179

SEQ ID NO: 347195 - RNA, 64 nt, hsa; identical to SEQ ID NO: 298180

SEQ ID NO: 347196 - RNA, 64 nt, hsa; identical to SEQ ID NO: 298181

SEQ ID NO: 347197 - RNA, 64 nt, hsa; identical to SEQ ID NO: 298182

SEQ ID NO: 347198 - RNA, 64 nt, hsa; identical to SEQ ID NO: 298183

SEQ ID NO: 347199 - RNA, 64 nt, hsa; identical to SEQ ID NO: 298184

SEQ ID NO: 347200 - RNA, 64 nt, hsa; identical to SEQ ID NO: 298185

SEQ ID NO: 347201 - RNA, 64 nt, hsa; identical to SEQ ID NO: 298186

SEQ ID NO: 347202 - RNA, 64 nt, hsa; identical to SEQ ID NO: 298187

SEQ ID NO: 347203 - RNA, 64 nt, hsa; identical to SEQ ID NO: 298188

SEQ ID NO: 347204 - RNA, 64 nt, hsa; identical to SEQ ID NO: 298189

SEQ ID NO: 347205 - RNA, 64 nt, hsa; identical to SEQ ID NO: 298190

SEQ ID NO: 347206 - RNA, 64 nt, hsa; identical to SEQ ID NO: 298191

SEQ ID NO: 347207 - RNA, 64 nt, hsa; identical to SEQ ID NO: 298192

SEQ ID NO: 347208 - RNA, 64 nt, hsa; identical to SEQ ID NO: 298193

SEQ ID NO: 347209 - RNA, 64 nt, hsa; identical to SEQ ID NO: 298194

SEQ ID NO: 347210 - RNA, 64 nt, hsa; identical to SEQ ID NO: 298195

SEQ ID NO: 347211 - RNA, 64 nt, hsa; identical to SEQ ID NO: 298196

SEQ ID NO: 347212 - RNA, 64 nt, hsa; identical to SEQ ID NO: 298197

SEQ ID NO: 347213 - RNA, 64 nt, hsa; identical to SEQ ID NO: 298198

SEQ ID NO: 347214 - RNA, 64 nt, hsa; identical to SEQ ID NO: 298199

SEQ ID NO: 347215 - RNA, 64 nt, hsa; identical to SEQ ID NO: 298200

SEQ ID NO: 347216 - RNA, 64 nt, hsa; identical to SEQ ID NO: 298201

SEQ ID NO: 347217 - RNA, 64 nt, hsa; identical to SEQ ID NO: 298202

SEQ ID NO: 347218 - RNA, 64 nt, hsa; identical to SEQ ID NO: 298203

SEQ ID NO: 347219 - RNA, 64 nt, hsa; identical to SEQ ID NO: 298204

SEQ ID NO: 347220 - RNA, 64 nt, hsa; identical to SEQ ID NO: 298205

SEQ ID NO: 347221 - RNA, 64 nt, hsa; identical to SEQ ID NO: 298206

SEQ ID NO: 347222 - RNA, 64 nt, hsa; identical to SEQ ID NO: 298207

SEQ ID NO: 347223 - RNA, 64 nt, hsa; identical to SEQ ID NO: 298208

SEQ ID NO: 347224 - RNA, 64 nt, hsa; identical to SEQ ID NO: 298209

SEQ ID NO: 347225 - RNA, 64 nt, hsa; identical to SEQ ID NO: 298210

SEQ ID NO: 347226 - RNA, 64 nt, hsa; identical to SEQ ID NO: 298211

SEQ ID NO: 347227 - RNA, 64 nt, hsa; identical to SEQ ID NO: 298212

SEQ ID NO: 347228 - RNA, 64 nt, hsa; identical to SEQ ID NO: 298213

SEQ ID NO: 347229 - RNA, 64 nt, hsa; identical to SEQ ID NO: 298214

SEQ ID NO: 347230 - RNA, 64 nt, hsa; identical to SEQ ID NO: 298215

SEQ ID NO: 347231 - RNA, 64 nt, hsa; identical to SEQ ID NO: 298216

SEQ ID NO: 347232 - RNA, 64 nt, hsa; identical to SEQ ID NO: 298217

SEQ ID NO: 347233 - RNA, 64 nt, hsa; identical to SEQ ID NO: 298218

SEQ ID NO: 347234 - RNA, 64 nt, hsa; identical to SEQ ID NO: 298219

SEQ ID NO: 347235 - RNA, 64 nt, hsa; identical to SEQ ID NO: 298220

SEQ ID NO: 347236 - RNA, 64 nt, hsa; identical to SEQ ID NO: 298221

SEQ ID NO: 347237 - RNA, 64 nt, hsa; identical to SEQ ID NO: 298222

SEQ ID NO: 347238 - RNA, 64 nt, hsa; identical to SEQ ID NO: 298223

SEQ ID NO: 347239 - RNA, 64 nt, hsa; identical to SEQ ID NO: 298224

SEQ ID NO: 347240 - RNA, 64 nt, hsa; identical to SEQ ID NO: 298225

SEQ ID NO: 347241 - RNA, 64 nt, hsa; identical to SEQ ID NO: 298226

SEQ ID NO: 347242 - RNA, 64 nt, hsa; identical to SEQ ID NO: 298227

SEQ ID NO: 347243 - RNA, 64 nt, hsa; identical to SEQ ID NO: 298228

SEQ ID NO: 347244 - RNA, 64 nt, hsa; identical to SEQ ID NO: 298229

SEQ ID NO: 347245 - RNA, 56 nt, hsa; identical to SEQ ID NO: 298230

SEQ ID NO: 347246 - RNA, 64 nt, hsa; identical to SEQ ID NO: 298231

SEQ ID NO: 347247 - RNA, 64 nt, hsa; identical to SEQ ID NO: 298232

SEQ ID NO: 347248 - RNA, 64 nt, hsa; identical to SEQ ID NO: 298233

SEQ ID NO: 347249 - RNA, 64 nt, hsa; identical to SEQ ID NO: 298234

SEQ ID NO: 347250 - RNA, 64 nt, hsa; identical to SEQ ID NO: 298235

SEQ ID NO: 347251 - RNA, 64 nt, hsa; identical to SEQ ID NO: 298236

SEQ ID NO: 347252 - RNA, 64 nt, hsa; identical to SEQ ID NO: 298237

SEQ ID NO: 347253 - RNA, 64 nt, hsa; identical to SEQ ID NO: 298238

SEQ ID NO: 347254 - RNA, 63 nt, hsa; identical to SEQ ID NO: 298239

SEQ ID NO: 347255 - RNA, 64 nt, hsa; identical to SEQ ID NO: 298240

SEQ ID NO: 347256 - RNA, 64 nt, hsa; identical to SEQ ID NO: 298241

SEQ ID NO: 347257 - RNA, 64 nt, hsa; identical to SEQ ID NO: 298242

SEQ ID NO: 347258 - RNA, 64 nt, hsa; identical to SEQ ID NO: 298243

SEQ ID NO: 347259 - RNA, 64 nt, hsa; identical to SEQ ID NO: 298244

SEQ ID NO: 347260 - RNA, 64 nt, hsa; identical to SEQ ID NO: 298245

SEQ ID NO: 347261 - RNA, 64 nt, hsa; identical to SEQ ID NO: 298246

SEQ ID NO: 347262 - RNA, 64 nt, hsa; identical to SEQ ID NO: 298247

SEQ ID NO: 347263 - RNA, 64 nt, hsa; identical to SEQ ID NO: 298248

SEQ ID NO: 347264 - RNA, 64 nt, hsa; identical to SEQ ID NO: 298249

SEQ ID NO: 347265 - RNA, 64 nt, hsa; identical to SEQ ID NO: 182508

SEQ ID NO: 347266 - RNA, 64 nt, hsa; identical to SEQ ID NO: 182509

SEQ ID NO: 347267 - RNA, 64 nt, hsa; identical to SEQ ID NO: 182510

SEQ ID NO: 347268 - RNA, 64 nt, hsa; identical to SEQ ID NO: 182511

SEQ ID NO: 347269 - RNA, 64 nt, hsa; identical to SEQ ID NO: 182512

SEQ ID NO: 347270 - RNA, 64 nt, hsa; identical to SEQ ID NO: 182513

SEQ ID NO: 347271 - RNA, 64 nt, hsa; identical to SEQ ID NO: 182514

SEQ ID NO: 347272 - RNA, 64 nt, hsa; identical to SEQ ID NO: 182515

SEQ ID NO: 347273 - RNA, 64 nt, hsa; identical to SEQ ID NO: 182516

SEQ ID NO: 347274 - RNA, 64 nt, hsa; identical to SEQ ID NO: 182517

SEQ ID NO: 347275 - RNA, 64 nt, hsa; identical to SEQ ID NO: 182518

SEQ ID NO: 347276 - RNA, 64 nt, hsa; identical to SEQ ID NO: 182519

SEQ ID NO: 347277 - RNA, 64 nt, hsa; identical to SEQ ID NO: 182520

SEQ ID NO: 347278 - RNA, 64 nt, hsa; identical to SEQ ID NO: 182521

SEQ ID NO: 347279 - RNA, 64 nt, hsa; identical to SEQ ID NO: 182522

SEQ ID NO: 347280 - RNA, 64 nt, hsa; identical to SEQ ID NO: 182523

SEQ ID NO: 347281 - RNA, 64 nt, hsa; identical to SEQ ID NO: 182524

SEQ ID NO: 347282 - RNA, 64 nt, hsa; identical to SEQ ID NO: 182525

SEQ ID NO: 347283 - RNA, 64 nt, hsa; identical to SEQ ID NO: 182526

SEQ ID NO: 347284 - RNA, 64 nt, hsa; identical to SEQ ID NO: 182527

SEQ ID NO: 347285 - RNA, 64 nt, hsa; identical to SEQ ID NO: 182528

SEQ ID NO: 347286 - RNA, 64 nt, hsa; identical to SEQ ID NO: 182529

SEQ ID NO: 347287 - RNA, 64 nt, hsa; identical to SEQ ID NO: 182530

SEQ ID NO: 347288 - RNA, 64 nt, hsa; identical to SEQ ID NO: 182531

SEQ ID NO: 347289 - RNA, 64 nt, hsa; identical to SEQ ID NO: 182532

SEQ ID NO: 347290 - RNA, 64 nt, hsa; identical to SEQ ID NO: 182533

SEQ ID NO: 347291 - RNA, 64 nt, hsa; identical to SEQ ID NO: 182534

SEQ ID NO: 347292 - RNA, 64 nt, hsa; identical to SEQ ID NO: 182535

SEQ ID NO: 347293 - RNA, 64 nt, hsa; identical to SEQ ID NO: 298158

SEQ ID NO: 347294 - RNA, 64 nt, hsa; identical to SEQ ID NO: 298159

SEQ ID NO: 347295 - RNA, 64 nt, hsa; identical to SEQ ID NO: 298160

SEQ ID NO: 347296 - RNA, 64 nt, hsa; identical to SEQ ID NO: 298161

SEQ ID NO: 347297 - RNA, 64 nt, hsa; identical to SEQ ID NO: 298162

SEQ ID NO: 347298 - RNA, 64 nt, hsa; identical to SEQ ID NO: 298163

SEQ ID NO: 347299 - RNA, 64 nt, hsa; identical to SEQ ID NO: 298164

SEQ ID NO: 347300 - RNA, 64 nt, hsa; identical to SEQ ID NO: 298165

SEQ ID NO: 347301 - RNA, 64 nt, hsa; identical to SEQ ID NO: 298166

SEQ ID NO: 347302 - RNA, 64 nt, hsa; identical to SEQ ID NO: 298167

SEQ ID NO: 347303 - RNA, 64 nt, hsa; identical to SEQ ID NO: 298168

SEQ ID NO: 347304 - RNA, 64 nt, hsa; identical to SEQ ID NO: 298169

SEQ ID NO: 347305 - RNA, 64 nt, hsa; identical to SEQ ID NO: 298170

SEQ ID NO: 347306 - RNA, 64 nt, hsa; identical to SEQ ID NO: 298171

SEQ ID NO: 347307 - RNA, 64 nt, hsa; identical to SEQ ID NO: 298172

SEQ ID NO: 347308 - RNA, 64 nt, hsa; identical to SEQ ID NO: 298173

SEQ ID NO: 347309 - RNA, 64 nt, hsa; identical to SEQ ID NO: 298174

SEQ ID NO: 347310 - RNA, 64 nt, hsa; identical to SEQ ID NO: 298175

SEQ ID NO: 347311 - RNA, 64 nt, hsa; identical to SEQ ID NO: 298176

SEQ ID NO: 347312 - RNA, 64 nt, hsa; identical to SEQ ID NO: 298177

SEQ ID NO: 347313 - RNA, 64 nt, hsa; identical to SEQ ID NO: 298178

SEQ ID NO: 347314 - RNA, 64 nt, hsa; identical to SEQ ID NO: 298179

SEQ ID NO: 347315 - RNA, 64 nt, hsa; identical to SEQ ID NO: 298180

SEQ ID NO: 347316 - RNA, 64 nt, hsa; identical to SEQ ID NO: 298181

SEQ ID NO: 347317 - RNA, 64 nt, hsa; identical to SEQ ID NO: 298182

SEQ ID NO: 347318 - RNA, 64 nt, hsa; identical to SEQ ID NO: 298183

SEQ ID NO: 347319 - RNA, 64 nt, hsa; identical to SEQ ID NO: 298184

SEQ ID NO: 347320 - RNA, 64 nt, hsa; identical to SEQ ID NO: 298185

SEQ ID NO: 347321 - RNA, 64 nt, hsa; identical to SEQ ID NO: 298186

SEQ ID NO: 347322 - RNA, 64 nt, hsa; identical to SEQ ID NO: 298187

SEQ ID NO: 347323 - RNA, 64 nt, hsa; identical to SEQ ID NO: 298188

SEQ ID NO: 347324 - RNA, 64 nt, hsa; identical to SEQ ID NO: 298189

SEQ ID NO: 347325 - RNA, 64 nt, hsa; identical to SEQ ID NO: 298190

SEQ ID NO: 347326 - RNA, 64 nt, hsa; identical to SEQ ID NO: 298191

SEQ ID NO: 347327 - RNA, 64 nt, hsa; identical to SEQ ID NO: 298192

SEQ ID NO: 347328 - RNA, 64 nt, hsa; identical to SEQ ID NO: 298193

SEQ ID NO: 347329 - RNA, 64 nt, hsa; identical to SEQ ID NO: 298194

SEQ ID NO: 347330 - RNA, 64 nt, hsa; identical to SEQ ID NO: 298195

SEQ ID NO: 347331 - RNA, 64 nt, hsa; identical to SEQ ID NO: 298196

SEQ ID NO: 347332 - RNA, 64 nt, hsa; identical to SEQ ID NO: 298197

SEQ ID NO: 347333 - RNA, 64 nt, hsa; identical to SEQ ID NO: 298198

SEQ ID NO: 347334 - RNA, 64 nt, hsa; identical to SEQ ID NO: 298199

SEQ ID NO: 347335 - RNA, 64 nt, hsa; identical to SEQ ID NO: 298200

SEQ ID NO: 347336 - RNA, 64 nt, hsa; identical to SEQ ID NO: 298201

SEQ ID NO: 347337 - RNA, 64 nt, hsa; identical to SEQ ID NO: 298202

SEQ ID NO: 347338 - RNA, 64 nt, hsa; identical to SEQ ID NO: 298203

SEQ ID NO: 347339 - RNA, 64 nt, hsa; identical to SEQ ID NO: 298204

SEQ ID NO: 347340 - RNA, 64 nt, hsa; identical to SEQ ID NO: 298205

SEQ ID NO: 347341 - RNA, 64 nt, hsa; identical to SEQ ID NO: 298206

SEQ ID NO: 347342 - RNA, 64 nt, hsa; identical to SEQ ID NO: 298207

SEQ ID NO: 347343 - RNA, 64 nt, hsa; identical to SEQ ID NO: 298208

SEQ ID NO: 347344 - RNA, 64 nt, hsa; identical to SEQ ID NO: 298209

SEQ ID NO: 347345 - RNA, 64 nt, hsa; identical to SEQ ID NO: 298210

SEQ ID NO: 347346 - RNA, 64 nt, hsa; identical to SEQ ID NO: 298211

SEQ ID NO: 347347 - RNA, 64 nt, hsa; identical to SEQ ID NO: 298212

SEQ ID NO: 347348 - RNA, 64 nt, hsa; identical to SEQ ID NO: 298213

SEQ ID NO: 347349 - RNA, 64 nt, hsa; identical to SEQ ID NO: 298214

SEQ ID NO: 347350 - RNA, 64 nt, hsa; identical to SEQ ID NO: 298215

SEQ ID NO: 347351 - RNA, 64 nt, hsa; identical to SEQ ID NO: 298216

SEQ ID NO: 347352 - RNA, 64 nt, hsa; identical to SEQ ID NO: 298217

SEQ ID NO: 347353 - RNA, 64 nt, hsa; identical to SEQ ID NO: 298218

SEQ ID NO: 347354 - RNA, 64 nt, hsa; identical to SEQ ID NO: 298219

SEQ ID NO: 347355 - RNA, 64 nt, hsa; identical to SEQ ID NO: 298220

SEQ ID NO: 347356 - RNA, 64 nt, hsa; identical to SEQ ID NO: 298221

SEQ ID NO: 347357 - RNA, 64 nt, hsa; identical to SEQ ID NO: 298222

SEQ ID NO: 347358 - RNA, 64 nt, hsa; identical to SEQ ID NO: 298223

SEQ ID NO: 347359 - RNA, 64 nt, hsa; identical to SEQ ID NO: 298224

SEQ ID NO: 347360 - RNA, 64 nt, hsa; identical to SEQ ID NO: 298225

SEQ ID NO: 347361 - RNA, 64 nt, hsa; identical to SEQ ID NO: 298226

SEQ ID NO: 347362 - RNA, 64 nt, hsa; identical to SEQ ID NO: 298227

SEQ ID NO: 347363 - RNA, 64 nt, hsa; identical to SEQ ID NO: 298228

SEQ ID NO: 347364 - RNA, 64 nt, hsa; identical to SEQ ID NO: 298229

SEQ ID NO: 347365 - RNA, 56 nt, hsa; identical to SEQ ID NO: 298230

SEQ ID NO: 347366 - RNA, 64 nt, hsa; identical to SEQ ID NO: 298231

SEQ ID NO: 347367 - RNA, 64 nt, hsa; identical to SEQ ID NO: 298232

SEQ ID NO: 347368 - RNA, 64 nt, hsa; identical to SEQ ID NO: 298233

SEQ ID NO: 347369 - RNA, 64 nt, hsa; identical to SEQ ID NO: 298234

SEQ ID NO: 347370 - RNA, 64 nt, hsa; identical to SEQ ID NO: 298235

SEQ ID NO: 347371 - RNA, 64 nt, hsa; identical to SEQ ID NO: 298236

SEQ ID NO: 347372 - RNA, 64 nt, hsa; identical to SEQ ID NO: 298237

SEQ ID NO: 347373 - RNA, 64 nt, hsa; identical to SEQ ID NO: 298238

SEQ ID NO: 347374 - RNA, 63 nt, hsa; identical to SEQ ID NO: 298239

SEQ ID NO: 347375 - RNA, 64 nt, hsa; identical to SEQ ID NO: 298240

SEQ ID NO: 347376 - RNA, 64 nt, hsa; identical to SEQ ID NO: 298241

SEQ ID NO: 347377 - RNA, 64 nt, hsa; identical to SEQ ID NO: 298242

SEQ ID NO: 347378 - RNA, 64 nt, hsa; identical to SEQ ID NO: 298243

SEQ ID NO: 347379 - RNA, 64 nt, hsa; identical to SEQ ID NO: 298244

SEQ ID NO: 347380 - RNA, 64 nt, hsa; identical to SEQ ID NO: 298245

SEQ ID NO: 347381 - RNA, 64 nt, hsa; identical to SEQ ID NO: 298246

SEQ ID NO: 347382 - RNA, 64 nt, hsa; identical to SEQ ID NO: 298247

SEQ ID NO: 347383 - RNA, 64 nt, hsa; identical to SEQ ID NO: 298248

SEQ ID NO: 347384 - RNA, 64 nt, hsa; identical to SEQ ID NO: 298249

SEQ ID NO: 347385 - RNA, 64 nt, hsa; identical to SEQ ID NO: 182508

SEQ ID NO: 347386 - RNA, 64 nt, hsa; identical to SEQ ID NO: 182509

SEQ ID NO: 347387 - RNA, 64 nt, hsa; identical to SEQ ID NO: 182510

SEQ ID NO: 347388 - RNA, 64 nt, hsa; identical to SEQ ID NO: 182511

SEQ ID NO: 347389 - RNA, 64 nt, hsa; identical to SEQ ID NO: 182512

SEQ ID NO: 347390 - RNA, 64 nt, hsa; identical to SEQ ID NO: 182513

SEQ ID NO: 347391 - RNA, 64 nt, hsa; identical to SEQ ID NO: 182514

SEQ ID NO: 347392 - RNA, 64 nt, hsa; identical to SEQ ID NO: 182515

SEQ ID NO: 347393 - RNA, 64 nt, hsa; identical to SEQ ID NO: 182516

SEQ ID NO: 347394 - RNA, 64 nt, hsa; identical to SEQ ID NO: 182517

SEQ ID NO: 347395 - RNA, 64 nt, hsa; identical to SEQ ID NO: 182518

SEQ ID NO: 347396 - RNA, 64 nt, hsa; identical to SEQ ID NO: 182519

SEQ ID NO: 347397 - RNA, 64 nt, hsa; identical to SEQ ID NO: 182520

SEQ ID NO: 347398 - RNA, 64 nt, hsa; identical to SEQ ID NO: 182521

SEQ ID NO: 347399 - RNA, 64 nt, hsa; identical to SEQ ID NO: 182522

SEQ ID NO: 347400 - RNA, 64 nt, hsa; identical to SEQ ID NO: 182523

SEQ ID NO: 347401 - RNA, 64 nt, hsa; identical to SEQ ID NO: 182524

SEQ ID NO: 347402 - RNA, 64 nt, hsa; identical to SEQ ID NO: 182525

SEQ ID NO: 347403 - RNA, 64 nt, hsa; identical to SEQ ID NO: 182526

SEQ ID NO: 347404 - RNA, 64 nt, hsa; identical to SEQ ID NO: 182527

SEQ ID NO: 347405 - RNA, 64 nt, hsa; identical to SEQ ID NO: 182528

SEQ ID NO: 347406 - RNA, 64 nt, hsa; identical to SEQ ID NO: 182529

SEQ ID NO: 347407 - RNA, 64 nt, hsa; identical to SEQ ID NO: 182530

SEQ ID NO: 347408 - RNA, 64 nt, hsa; identical to SEQ ID NO: 182531

SEQ ID NO: 347409 - RNA, 64 nt, hsa; identical to SEQ ID NO: 182532

SEQ ID NO: 347410 - RNA, 64 nt, hsa; identical to SEQ ID NO: 182533

SEQ ID NO: 347411 - RNA, 64 nt, hsa; identical to SEQ ID NO: 182534

SEQ ID NO: 347412 - RNA, 64 nt, hsa; identical to SEQ ID NO: 182535

SEQ ID NO: 347413 - RNA, 64 nt, hsa; identical to SEQ ID NO: 298158

SEQ ID NO: 347414 - RNA, 64 nt, hsa; identical to SEQ ID NO: 298159

SEQ ID NO: 347415 - RNA, 64 nt, hsa; identical to SEQ ID NO: 298160

SEQ ID NO: 347416 - RNA, 64 nt, hsa; identical to SEQ ID NO: 298161

SEQ ID NO: 347417 - RNA, 64 nt, hsa; identical to SEQ ID NO: 298162

SEQ ID NO: 347418 - RNA, 64 nt, hsa; identical to SEQ ID NO: 298163

SEQ ID NO: 347419 - RNA, 64 nt, hsa; identical to SEQ ID NO: 298164

SEQ ID NO: 347420 - RNA, 64 nt, hsa; identical to SEQ ID NO: 298165

SEQ ID NO: 347421 - RNA, 64 nt, hsa; identical to SEQ ID NO: 298166

SEQ ID NO: 347422 - RNA, 64 nt, hsa; identical to SEQ ID NO: 298167

SEQ ID NO: 347423 - RNA, 64 nt, hsa; identical to SEQ ID NO: 298168

SEQ ID NO: 347424 - RNA, 64 nt, hsa; identical to SEQ ID NO: 298169

SEQ ID NO: 347425 - RNA, 64 nt, hsa; identical to SEQ ID NO: 298170

SEQ ID NO: 347426 - RNA, 64 nt, hsa; identical to SEQ ID NO: 298171

SEQ ID NO: 347427 - RNA, 64 nt, hsa; identical to SEQ ID NO: 298172

SEQ ID NO: 347428 - RNA, 64 nt, hsa; identical to SEQ ID NO: 298173

SEQ ID NO: 347429 - RNA, 64 nt, hsa; identical to SEQ ID NO: 298174

SEQ ID NO: 347430 - RNA, 64 nt, hsa; identical to SEQ ID NO: 298175

SEQ ID NO: 347431 - RNA, 64 nt, hsa; identical to SEQ ID NO: 298176

SEQ ID NO: 347432 - RNA, 64 nt, hsa; identical to SEQ ID NO: 298177

SEQ ID NO: 347433 - RNA, 64 nt, hsa; identical to SEQ ID NO: 298178

SEQ ID NO: 347434 - RNA, 64 nt, hsa; identical to SEQ ID NO: 298179

SEQ ID NO: 347435 - RNA, 64 nt, hsa; identical to SEQ ID NO: 298180

SEQ ID NO: 347436 - RNA, 64 nt, hsa; identical to SEQ ID NO: 298181

SEQ ID NO: 347437 - RNA, 64 nt, hsa; identical to SEQ ID NO: 298182

SEQ ID NO: 347438 - RNA, 64 nt, hsa; identical to SEQ ID NO: 298183

SEQ ID NO: 347439 - RNA, 64 nt, hsa; identical to SEQ ID NO: 298184

SEQ ID NO: 347440 - RNA, 64 nt, hsa; identical to SEQ ID NO: 298185

SEQ ID NO: 347441 - RNA, 64 nt, hsa; identical to SEQ ID NO: 298186

SEQ ID NO: 347442 - RNA, 64 nt, hsa; identical to SEQ ID NO: 298187

SEQ ID NO: 347443 - RNA, 64 nt, hsa; identical to SEQ ID NO: 298188

SEQ ID NO: 347444 - RNA, 64 nt, hsa; identical to SEQ ID NO: 298189

SEQ ID NO: 347445 - RNA, 64 nt, hsa; identical to SEQ ID NO: 298190

SEQ ID NO: 347446 - RNA, 64 nt, hsa; identical to SEQ ID NO: 298191

SEQ ID NO: 347447 - RNA, 64 nt, hsa; identical to SEQ ID NO: 298192

SEQ ID NO: 347448 - RNA, 64 nt, hsa; identical to SEQ ID NO: 298193

SEQ ID NO: 347449 - RNA, 64 nt, hsa; identical to SEQ ID NO: 298194

SEQ ID NO: 347450 - RNA, 64 nt, hsa; identical to SEQ ID NO: 298195

SEQ ID NO: 347451 - RNA, 64 nt, hsa; identical to SEQ ID NO: 298196

SEQ ID NO: 347452 - RNA, 64 nt, hsa; identical to SEQ ID NO: 298197

SEQ ID NO: 347453 - RNA, 64 nt, hsa; identical to SEQ ID NO: 298198

SEQ ID NO: 347454 - RNA, 64 nt, hsa; identical to SEQ ID NO: 298199

SEQ ID NO: 347455 - RNA, 64 nt, hsa; identical to SEQ ID NO: 298200

SEQ ID NO: 347456 - RNA, 64 nt, hsa; identical to SEQ ID NO: 298201

SEQ ID NO: 347457 - RNA, 64 nt, hsa; identical to SEQ ID NO: 298202

SEQ ID NO: 347458 - RNA, 64 nt, hsa; identical to SEQ ID NO: 298203

SEQ ID NO: 347459 - RNA, 64 nt, hsa; identical to SEQ ID NO: 298204

SEQ ID NO: 347460 - RNA, 64 nt, hsa; identical to SEQ ID NO: 298205

SEQ ID NO: 347461 - RNA, 64 nt, hsa; identical to SEQ ID NO: 298206

SEQ ID NO: 347462 - RNA, 64 nt, hsa; identical to SEQ ID NO: 298207

SEQ ID NO: 347463 - RNA, 64 nt, hsa; identical to SEQ ID NO: 298208

SEQ ID NO: 347464 - RNA, 64 nt, hsa; identical to SEQ ID NO: 298209

SEQ ID NO: 347465 - RNA, 64 nt, hsa; identical to SEQ ID NO: 298210

SEQ ID NO: 347466 - RNA, 64 nt, hsa; identical to SEQ ID NO: 298211

SEQ ID NO: 347467 - RNA, 64 nt, hsa; identical to SEQ ID NO: 298212

SEQ ID NO: 347468 - RNA, 64 nt, hsa; identical to SEQ ID NO: 298213

SEQ ID NO: 347469 - RNA, 64 nt, hsa; identical to SEQ ID NO: 298214

SEQ ID NO: 347470 - RNA, 64 nt, hsa; identical to SEQ ID NO: 298215

SEQ ID NO: 347471 - RNA, 64 nt, hsa; identical to SEQ ID NO: 298216

SEQ ID NO: 347472 - RNA, 64 nt, hsa; identical to SEQ ID NO: 298217

SEQ ID NO: 347473 - RNA, 64 nt, hsa; identical to SEQ ID NO: 298218

SEQ ID NO: 347474 - RNA, 64 nt, hsa; identical to SEQ ID NO: 298219

SEQ ID NO: 347475 - RNA, 64 nt, hsa; identical to SEQ ID NO: 298220

SEQ ID NO: 347476 - RNA, 64 nt, hsa; identical to SEQ ID NO: 298221

SEQ ID NO: 347477 - RNA, 64 nt, hsa; identical to SEQ ID NO: 298222

SEQ ID NO: 347478 - RNA, 64 nt, hsa; identical to SEQ ID NO: 298223

SEQ ID NO: 347479 - RNA, 64 nt, hsa; identical to SEQ ID NO: 298224

SEQ ID NO: 347480 - RNA, 64 nt, hsa; identical to SEQ ID NO: 298225

SEQ ID NO: 347481 - RNA, 64 nt, hsa; identical to SEQ ID NO: 298226

SEQ ID NO: 347482 - RNA, 64 nt, hsa; identical to SEQ ID NO: 298227

SEQ ID NO: 347483 - RNA, 64 nt, hsa; identical to SEQ ID NO: 298228

SEQ ID NO: 347484 - RNA, 64 nt, hsa; identical to SEQ ID NO: 298229

SEQ ID NO: 347485 - RNA, 56 nt, hsa; identical to SEQ ID NO: 298230

SEQ ID NO: 347486 - RNA, 64 nt, hsa; identical to SEQ ID NO: 298231

SEQ ID NO: 347487 - RNA, 64 nt, hsa; identical to SEQ ID NO: 298232

SEQ ID NO: 347488 - RNA, 64 nt, hsa; identical to SEQ ID NO: 298233

SEQ ID NO: 347489 - RNA, 64 nt, hsa; identical to SEQ ID NO: 298234

SEQ ID NO: 347490 - RNA, 64 nt, hsa; identical to SEQ ID NO: 298235

SEQ ID NO: 347491 - RNA, 64 nt, hsa; identical to SEQ ID NO: 298236

SEQ ID NO: 347492 - RNA, 64 nt, hsa; identical to SEQ ID NO: 298237

SEQ ID NO: 347493 - RNA, 64 nt, hsa; identical to SEQ ID NO: 298238

SEQ ID NO: 347494 - RNA, 63 nt, hsa; identical to SEQ ID NO: 298239

SEQ ID NO: 347495 - RNA, 64 nt, hsa; identical to SEQ ID NO: 298240

SEQ ID NO: 347496 - RNA, 64 nt, hsa; identical to SEQ ID NO: 298241

SEQ ID NO: 347497 - RNA, 64 nt, hsa; identical to SEQ ID NO: 298242

SEQ ID NO: 347498 - RNA, 64 nt, hsa; identical to SEQ ID NO: 298243

SEQ ID NO: 347499 - RNA, 64 nt, hsa; identical to SEQ ID NO: 298244

SEQ ID NO: 347500 - RNA, 64 nt, hsa; identical to SEQ ID NO: 298245

SEQ ID NO: 347501 - RNA, 64 nt, hsa; identical to SEQ ID NO: 298246

SEQ ID NO: 347502 - RNA, 64 nt, hsa; identical to SEQ ID NO: 298247

SEQ ID NO: 347503 - RNA, 64 nt, hsa; identical to SEQ ID NO: 298248

SEQ ID NO: 347504 - RNA, 64 nt, hsa; identical to SEQ ID NO: 298249

SEQ ID NO: 347505 - RNA, 64 nt, hsa; identical to SEQ ID NO: 182508

SEQ ID NO: 347506 - RNA, 64 nt, hsa; identical to SEQ ID NO: 182509

SEQ ID NO: 347507 - RNA, 64 nt, hsa; identical to SEQ ID NO: 182510

SEQ ID NO: 347508 - RNA, 64 nt, hsa; identical to SEQ ID NO: 182511

SEQ ID NO: 347509 - RNA, 64 nt, hsa; identical to SEQ ID NO: 182512

SEQ ID NO: 347510 - RNA, 64 nt, hsa; identical to SEQ ID NO: 182513

SEQ ID NO: 347511 - RNA, 64 nt, hsa; identical to SEQ ID NO: 182514

SEQ ID NO: 347512 - RNA, 64 nt, hsa; identical to SEQ ID NO: 182515

SEQ ID NO: 347513 - RNA, 64 nt, hsa; identical to SEQ ID NO: 182516

SEQ ID NO: 347514 - RNA, 64 nt, hsa; identical to SEQ ID NO: 182517

SEQ ID NO: 347515 - RNA, 64 nt, hsa; identical to SEQ ID NO: 182518

SEQ ID NO: 347516 - RNA, 64 nt, hsa; identical to SEQ ID NO: 182519

SEQ ID NO: 347517 - RNA, 64 nt, hsa; identical to SEQ ID NO: 182520

SEQ ID NO: 347518 - RNA, 64 nt, hsa; identical to SEQ ID NO: 182521

SEQ ID NO: 347519 - RNA, 64 nt, hsa; identical to SEQ ID NO: 182522

SEQ ID NO: 347520 - RNA, 64 nt, hsa; identical to SEQ ID NO: 182523

SEQ ID NO: 347521 - RNA, 64 nt, hsa; identical to SEQ ID NO: 182524

SEQ ID NO: 347522 - RNA, 64 nt, hsa; identical to SEQ ID NO: 182525

SEQ ID NO: 347523 - RNA, 64 nt, hsa; identical to SEQ ID NO: 182526

SEQ ID NO: 347524 - RNA, 64 nt, hsa; identical to SEQ ID NO: 182527

SEQ ID NO: 347525 - RNA, 64 nt, hsa; identical to SEQ ID NO: 182528

SEQ ID NO: 347526 - RNA, 64 nt, hsa; identical to SEQ ID NO: 182529

SEQ ID NO: 347527 - RNA, 64 nt, hsa; identical to SEQ ID NO: 182530

SEQ ID NO: 347528 - RNA, 64 nt, hsa; identical to SEQ ID NO: 182531

SEQ ID NO: 347529 - RNA, 64 nt, hsa; identical to SEQ ID NO: 182532

SEQ ID NO: 347530 - RNA, 64 nt, hsa; identical to SEQ ID NO: 182533

SEQ ID NO: 347531 - RNA, 64 nt, hsa; identical to SEQ ID NO: 182534

SEQ ID NO: 347532 - RNA, 64 nt, hsa; identical to SEQ ID NO: 182535

SEQ ID NO: 347533 - RNA, 64 nt, hsa; identical to SEQ ID NO: 298158

SEQ ID NO: 347534 - RNA, 64 nt, hsa; identical to SEQ ID NO: 298159

SEQ ID NO: 347535 - RNA, 64 nt, hsa; identical to SEQ ID NO: 298160

SEQ ID NO: 347536 - RNA, 64 nt, hsa; identical to SEQ ID NO: 298161

SEQ ID NO: 347537 - RNA, 64 nt, hsa; identical to SEQ ID NO: 298162

SEQ ID NO: 347538 - RNA, 64 nt, hsa; identical to SEQ ID NO: 298163

SEQ ID NO: 347539 - RNA, 64 nt, hsa; identical to SEQ ID NO: 298164

SEQ ID NO: 347540 - RNA, 64 nt, hsa; identical to SEQ ID NO: 298165

SEQ ID NO: 347541 - RNA, 64 nt, hsa; identical to SEQ ID NO: 298166

SEQ ID NO: 347542 - RNA, 64 nt, hsa; identical to SEQ ID NO: 298167

SEQ ID NO: 347543 - RNA, 64 nt, hsa; identical to SEQ ID NO: 298168

SEQ ID NO: 347544 - RNA, 64 nt, hsa; identical to SEQ ID NO: 298169

SEQ ID NO: 347545 - RNA, 64 nt, hsa; identical to SEQ ID NO: 298170

SEQ ID NO: 347546 - RNA, 64 nt, hsa; identical to SEQ ID NO: 298171

SEQ ID NO: 347547 - RNA, 64 nt, hsa; identical to SEQ ID NO: 298172

SEQ ID NO: 347548 - RNA, 64 nt, hsa; identical to SEQ ID NO: 298173

SEQ ID NO: 347549 - RNA, 64 nt, hsa; identical to SEQ ID NO: 298174

SEQ ID NO: 347550 - RNA, 64 nt, hsa; identical to SEQ ID NO: 298175

SEQ ID NO: 347551 - RNA, 64 nt, hsa; identical to SEQ ID NO: 298176

SEQ ID NO: 347552 - RNA, 64 nt, hsa; identical to SEQ ID NO: 298177

SEQ ID NO: 347553 - RNA, 64 nt, hsa; identical to SEQ ID NO: 298178

SEQ ID NO: 347554 - RNA, 64 nt, hsa; identical to SEQ ID NO: 298179

SEQ ID NO: 347555 - RNA, 64 nt, hsa; identical to SEQ ID NO: 298180

SEQ ID NO: 347556 - RNA, 64 nt, hsa; identical to SEQ ID NO: 298181

SEQ ID NO: 347557 - RNA, 64 nt, hsa; identical to SEQ ID NO: 298182

SEQ ID NO: 347558 - RNA, 64 nt, hsa; identical to SEQ ID NO: 298183

SEQ ID NO: 347559 - RNA, 64 nt, hsa; identical to SEQ ID NO: 298184

SEQ ID NO: 347560 - RNA, 64 nt, hsa; identical to SEQ ID NO: 298185

SEQ ID NO: 347561 - RNA, 64 nt, hsa; identical to SEQ ID NO: 298186

SEQ ID NO: 347562 - RNA, 64 nt, hsa; identical to SEQ ID NO: 298187

SEQ ID NO: 347563 - RNA, 64 nt, hsa; identical to SEQ ID NO: 298188

SEQ ID NO: 347564 - RNA, 64 nt, hsa; identical to SEQ ID NO: 298189

SEQ ID NO: 347565 - RNA, 64 nt, hsa; identical to SEQ ID NO: 298190

SEQ ID NO: 347566 - RNA, 64 nt, hsa; identical to SEQ ID NO: 298191

SEQ ID NO: 347567 - RNA, 64 nt, hsa; identical to SEQ ID NO: 298192

SEQ ID NO: 347568 - RNA, 64 nt, hsa; identical to SEQ ID NO: 298193

SEQ ID NO: 347569 - RNA, 64 nt, hsa; identical to SEQ ID NO: 298194

SEQ ID NO: 347570 - RNA, 64 nt, hsa; identical to SEQ ID NO: 298195

SEQ ID NO: 347571 - RNA, 64 nt, hsa; identical to SEQ ID NO: 298196

SEQ ID NO: 347572 - RNA, 64 nt, hsa; identical to SEQ ID NO: 298197

SEQ ID NO: 347573 - RNA, 64 nt, hsa; identical to SEQ ID NO: 298198

SEQ ID NO: 347574 - RNA, 64 nt, hsa; identical to SEQ ID NO: 298199

SEQ ID NO: 347575 - RNA, 64 nt, hsa; identical to SEQ ID NO: 298200

SEQ ID NO: 347576 - RNA, 64 nt, hsa; identical to SEQ ID NO: 298201

SEQ ID NO: 347577 - RNA, 64 nt, hsa; identical to SEQ ID NO: 298202

SEQ ID NO: 347578 - RNA, 64 nt, hsa; identical to SEQ ID NO: 298203

SEQ ID NO: 347579 - RNA, 64 nt, hsa; identical to SEQ ID NO: 298204

SEQ ID NO: 347580 - RNA, 64 nt, hsa; identical to SEQ ID NO: 298205

SEQ ID NO: 347581 - RNA, 64 nt, hsa; identical to SEQ ID NO: 298206

SEQ ID NO: 347582 - RNA, 64 nt, hsa; identical to SEQ ID NO: 298207

SEQ ID NO: 347583 - RNA, 64 nt, hsa; identical to SEQ ID NO: 298208

SEQ ID NO: 347584 - RNA, 64 nt, hsa; identical to SEQ ID NO: 298209

SEQ ID NO: 347585 - RNA, 64 nt, hsa; identical to SEQ ID NO: 298210

SEQ ID NO: 347586 - RNA, 64 nt, hsa; identical to SEQ ID NO: 298211

SEQ ID NO: 347587 - RNA, 64 nt, hsa; identical to SEQ ID NO: 298212

SEQ ID NO: 347588 - RNA, 64 nt, hsa; identical to SEQ ID NO: 298213

SEQ ID NO: 347589 - RNA, 64 nt, hsa; identical to SEQ ID NO: 298214

SEQ ID NO: 347590 - RNA, 64 nt, hsa; identical to SEQ ID NO: 298215

SEQ ID NO: 347591 - RNA, 64 nt, hsa; identical to SEQ ID NO: 298216

SEQ ID NO: 347592 - RNA, 64 nt, hsa; identical to SEQ ID NO: 298217

SEQ ID NO: 347593 - RNA, 64 nt, hsa; identical to SEQ ID NO: 298218

SEQ ID NO: 347594 - RNA, 64 nt, hsa; identical to SEQ ID NO: 298219

SEQ ID NO: 347595 - RNA, 64 nt, hsa; identical to SEQ ID NO: 298220

SEQ ID NO: 347596 - RNA, 64 nt, hsa; identical to SEQ ID NO: 298221

SEQ ID NO: 347597 - RNA, 64 nt, hsa; identical to SEQ ID NO: 298222

SEQ ID NO: 347598 - RNA, 64 nt, hsa; identical to SEQ ID NO: 298223

SEQ ID NO: 347599 - RNA, 64 nt, hsa; identical to SEQ ID NO: 298224

SEQ ID NO: 347600 - RNA, 64 nt, hsa; identical to SEQ ID NO: 298225

SEQ ID NO: 347601 - RNA, 64 nt, hsa; identical to SEQ ID NO: 298226

SEQ ID NO: 347602 - RNA, 64 nt, hsa; identical to SEQ ID NO: 298227

SEQ ID NO: 347603 - RNA, 64 nt, hsa; identical to SEQ ID NO: 298228

SEQ ID NO: 347604 - RNA, 64 nt, hsa; identical to SEQ ID NO: 298229

SEQ ID NO: 347605 - RNA, 56 nt, hsa; identical to SEQ ID NO: 298230

SEQ ID NO: 347606 - RNA, 64 nt, hsa; identical to SEQ ID NO: 298231

SEQ ID NO: 347607 - RNA, 64 nt, hsa; identical to SEQ ID NO: 298232

SEQ ID NO: 347608 - RNA, 64 nt, hsa; identical to SEQ ID NO: 298233

SEQ ID NO: 347609 - RNA, 64 nt, hsa; identical to SEQ ID NO: 298234

SEQ ID NO: 347610 - RNA, 64 nt, hsa; identical to SEQ ID NO: 298235

SEQ ID NO: 347611 - RNA, 64 nt, hsa; identical to SEQ ID NO: 298236

SEQ ID NO: 347612 - RNA, 64 nt, hsa; identical to SEQ ID NO: 298237

SEQ ID NO: 347613 - RNA, 64 nt, hsa; identical to SEQ ID NO: 298238

SEQ ID NO: 347614 - RNA, 63 nt, hsa; identical to SEQ ID NO: 298239

SEQ ID NO: 347615 - RNA, 64 nt, hsa; identical to SEQ ID NO: 298240

SEQ ID NO: 347616 - RNA, 64 nt, hsa; identical to SEQ ID NO: 298241

SEQ ID NO: 347617 - RNA, 64 nt, hsa; identical to SEQ ID NO: 298242

SEQ ID NO: 347618 - RNA, 64 nt, hsa; identical to SEQ ID NO: 298243

SEQ ID NO: 347619 - RNA, 64 nt, hsa; identical to SEQ ID NO: 298244

SEQ ID NO: 347620 - RNA, 64 nt, hsa; identical to SEQ ID NO: 298245

SEQ ID NO: 347621 - RNA, 64 nt, hsa; identical to SEQ ID NO: 298246

SEQ ID NO: 347622 - RNA, 64 nt, hsa; identical to SEQ ID NO: 298247

SEQ ID NO: 347623 - RNA, 64 nt, hsa; identical to SEQ ID NO: 298248

SEQ ID NO: 347624 - RNA, 64 nt, hsa; identical to SEQ ID NO: 298249

SEQ ID NO: 347625 - RNA, 64 nt, hsa; identical to SEQ ID NO: 182508

SEQ ID NO: 347626 - RNA, 64 nt, hsa; identical to SEQ ID NO: 182509

SEQ ID NO: 347627 - RNA, 64 nt, hsa; identical to SEQ ID NO: 182510

SEQ ID NO: 347628 - RNA, 64 nt, hsa; identical to SEQ ID NO: 182511

SEQ ID NO: 347629 - RNA, 64 nt, hsa; identical to SEQ ID NO: 182512

SEQ ID NO: 347630 - RNA, 64 nt, hsa; identical to SEQ ID NO: 182513

SEQ ID NO: 347631 - RNA, 64 nt, hsa; identical to SEQ ID NO: 182514

SEQ ID NO: 347632 - RNA, 64 nt, hsa; identical to SEQ ID NO: 182515

SEQ ID NO: 347633 - RNA, 64 nt, hsa; identical to SEQ ID NO: 182516

SEQ ID NO: 347634 - RNA, 64 nt, hsa; identical to SEQ ID NO: 182517

SEQ ID NO: 347635 - RNA, 64 nt, hsa; identical to SEQ ID NO: 182518

SEQ ID NO: 347636 - RNA, 64 nt, hsa; identical to SEQ ID NO: 182519

SEQ ID NO: 347637 - RNA, 64 nt, hsa; identical to SEQ ID NO: 182520

SEQ ID NO: 347638 - RNA, 64 nt, hsa; identical to SEQ ID NO: 182521

SEQ ID NO: 347639 - RNA, 64 nt, hsa; identical to SEQ ID NO: 182522

SEQ ID NO: 347640 - RNA, 64 nt, hsa; identical to SEQ ID NO: 182523

SEQ ID NO: 347641 - RNA, 64 nt, hsa; identical to SEQ ID NO: 182524

SEQ ID NO: 347642 - RNA, 64 nt, hsa; identical to SEQ ID NO: 182525

SEQ ID NO: 347643 - RNA, 64 nt, hsa; identical to SEQ ID NO: 182526

SEQ ID NO: 347644 - RNA, 64 nt, hsa; identical to SEQ ID NO: 182527

SEQ ID NO: 347645 - RNA, 64 nt, hsa; identical to SEQ ID NO: 182528

SEQ ID NO: 347646 - RNA, 64 nt, hsa; identical to SEQ ID NO: 182529

SEQ ID NO: 347647 - RNA, 64 nt, hsa; identical to SEQ ID NO: 182530

SEQ ID NO: 347648 - RNA, 64 nt, hsa; identical to SEQ ID NO: 182531

SEQ ID NO: 347649 - RNA, 64 nt, hsa; identical to SEQ ID NO: 182532

SEQ ID NO: 347650 - RNA, 64 nt, hsa; identical to SEQ ID NO: 182533

SEQ ID NO: 347651 - RNA, 64 nt, hsa; identical to SEQ ID NO: 182534

SEQ ID NO: 347652 - RNA, 64 nt, hsa; identical to SEQ ID NO: 182535

SEQ ID NO: 347653 - RNA, 64 nt, hsa; identical to SEQ ID NO: 327835

SEQ ID NO: 347654 - RNA, 64 nt, hsa; identical to SEQ ID NO: 327836

SEQ ID NO: 347655 - RNA, 64 nt, hsa; identical to SEQ ID NO: 327837

SEQ ID NO: 347656 - RNA, 64 nt, hsa; identical to SEQ ID NO: 327838

SEQ ID NO: 347657 - RNA, 64 nt, hsa; identical to SEQ ID NO: 327839

SEQ ID NO: 347658 - RNA, 64 nt, hsa; identical to SEQ ID NO: 327840

SEQ ID NO: 347659 - RNA, 64 nt, hsa; identical to SEQ ID NO: 327841

SEQ ID NO: 347660 - RNA, 64 nt, hsa; identical to SEQ ID NO: 327842

SEQ ID NO: 347661 - RNA, 64 nt, hsa; identical to SEQ ID NO: 327843

SEQ ID NO: 347662 - RNA, 64 nt, hsa; identical to SEQ ID NO: 327844

SEQ ID NO: 347663 - RNA, 64 nt, hsa; identical to SEQ ID NO: 327845

SEQ ID NO: 347664 - RNA, 64 nt, hsa; identical to SEQ ID NO: 327846

SEQ ID NO: 347665 - RNA, 64 nt, hsa; identical to SEQ ID NO: 327847

SEQ ID NO: 347666 - RNA, 64 nt, hsa; identical to SEQ ID NO: 327848

SEQ ID NO: 347667 - RNA, 64 nt, hsa; identical to SEQ ID NO: 327849

SEQ ID NO: 347668 - RNA, 64 nt, hsa; identical to SEQ ID NO: 327850

SEQ ID NO: 347669 - RNA, 64 nt, hsa; identical to SEQ ID NO: 327851

SEQ ID NO: 347670 - RNA, 64 nt, hsa; identical to SEQ ID NO: 327852

SEQ ID NO: 347671 - RNA, 64 nt, hsa; identical to SEQ ID NO: 182508

SEQ ID NO: 347672 - RNA, 64 nt, hsa; identical to SEQ ID NO: 182509

SEQ ID NO: 347673 - RNA, 64 nt, hsa; identical to SEQ ID NO: 182510

SEQ ID NO: 347674 - RNA, 64 nt, hsa; identical to SEQ ID NO: 182511

SEQ ID NO: 347675 - RNA, 64 nt, hsa; identical to SEQ ID NO: 182512

SEQ ID NO: 347676 - RNA, 64 nt, hsa; identical to SEQ ID NO: 182513

SEQ ID NO: 347677 - RNA, 64 nt, hsa; identical to SEQ ID NO: 182514

SEQ ID NO: 347678 - RNA, 64 nt, hsa; identical to SEQ ID NO: 182515

SEQ ID NO: 347679 - RNA, 64 nt, hsa; identical to SEQ ID NO: 182516

SEQ ID NO: 347680 - RNA, 64 nt, hsa; identical to SEQ ID NO: 182517

SEQ ID NO: 347681 - RNA, 64 nt, hsa; identical to SEQ ID NO: 182518

SEQ ID NO: 347682 - RNA, 64 nt, hsa; identical to SEQ ID NO: 182519

SEQ ID NO: 347683 - RNA, 64 nt, hsa; identical to SEQ ID NO: 182520

SEQ ID NO: 347684 - RNA, 64 nt, hsa; identical to SEQ ID NO: 182521

SEQ ID NO: 347685 - RNA, 64 nt, hsa; identical to SEQ ID NO: 182522

SEQ ID NO: 347686 - RNA, 64 nt, hsa; identical to SEQ ID NO: 182523

SEQ ID NO: 347687 - RNA, 64 nt, hsa; identical to SEQ ID NO: 182524

SEQ ID NO: 347688 - RNA, 64 nt, hsa; identical to SEQ ID NO: 182525

SEQ ID NO: 347689 - RNA, 64 nt, hsa; identical to SEQ ID NO: 182526

SEQ ID NO: 347690 - RNA, 64 nt, hsa; identical to SEQ ID NO: 182527

SEQ ID NO: 347691 - RNA, 64 nt, hsa; identical to SEQ ID NO: 182528

SEQ ID NO: 347692 - RNA, 64 nt, hsa; identical to SEQ ID NO: 182529

SEQ ID NO: 347693 - RNA, 64 nt, hsa; identical to SEQ ID NO: 182530

SEQ ID NO: 347694 - RNA, 64 nt, hsa; identical to SEQ ID NO: 182531

SEQ ID NO: 347695 - RNA, 64 nt, hsa; identical to SEQ ID NO: 182532

SEQ ID NO: 347696 - RNA, 64 nt, hsa; identical to SEQ ID NO: 182533

SEQ ID NO: 347697 - RNA, 64 nt, hsa; identical to SEQ ID NO: 182534

SEQ ID NO: 347698 - RNA, 64 nt, hsa; identical to SEQ ID NO: 182535

SEQ ID NO: 347699 - RNA, 64 nt, hsa; identical to SEQ ID NO: 327835

SEQ ID NO: 347700 - RNA, 64 nt, hsa; identical to SEQ ID NO: 327836

SEQ ID NO: 347701 - RNA, 64 nt, hsa; identical to SEQ ID NO: 327837

SEQ ID NO: 347702 - RNA, 64 nt, hsa; identical to SEQ ID NO: 327838

SEQ ID NO: 347703 - RNA, 64 nt, hsa; identical to SEQ ID NO: 327839

SEQ ID NO: 347704 - RNA, 64 nt, hsa; identical to SEQ ID NO: 327840

SEQ ID NO: 347705 - RNA, 64 nt, hsa; identical to SEQ ID NO: 327841

SEQ ID NO: 347706 - RNA, 64 nt, hsa; identical to SEQ ID NO: 327842

SEQ ID NO: 347707 - RNA, 64 nt, hsa; identical to SEQ ID NO: 327843

SEQ ID NO: 347708 - RNA, 64 nt, hsa; identical to SEQ ID NO: 327844

SEQ ID NO: 347709 - RNA, 64 nt, hsa; identical to SEQ ID NO: 327845

SEQ ID NO: 347710 - RNA, 64 nt, hsa; identical to SEQ ID NO: 327846

SEQ ID NO: 347711 - RNA, 64 nt, hsa; identical to SEQ ID NO: 327847

SEQ ID NO: 347712 - RNA, 64 nt, hsa; identical to SEQ ID NO: 327848

SEQ ID NO: 347713 - RNA, 64 nt, hsa; identical to SEQ ID NO: 327849

SEQ ID NO: 347714 - RNA, 64 nt, hsa; identical to SEQ ID NO: 327850

SEQ ID NO: 347715 - RNA, 64 nt, hsa; identical to SEQ ID NO: 327851

SEQ ID NO: 347716 - RNA, 64 nt, hsa; identical to SEQ ID NO: 327852

SEQ ID NO: 347717 - RNA, 64 nt, hsa; identical to SEQ ID NO: 182508

SEQ ID NO: 347718 - RNA, 64 nt, hsa; identical to SEQ ID NO: 182509

SEQ ID NO: 347719 - RNA, 64 nt, hsa; identical to SEQ ID NO: 182510

SEQ ID NO: 347720 - RNA, 64 nt, hsa; identical to SEQ ID NO: 182511

SEQ ID NO: 347721 - RNA, 64 nt, hsa; identical to SEQ ID NO: 182512

SEQ ID NO: 347722 - RNA, 64 nt, hsa; identical to SEQ ID NO: 182513

SEQ ID NO: 347723 - RNA, 64 nt, hsa; identical to SEQ ID NO: 182514

SEQ ID NO: 347724 - RNA, 64 nt, hsa; identical to SEQ ID NO: 182515

SEQ ID NO: 347725 - RNA, 64 nt, hsa; identical to SEQ ID NO: 182516

SEQ ID NO: 347726 - RNA, 64 nt, hsa; identical to SEQ ID NO: 182517

SEQ ID NO: 347727 - RNA, 64 nt, hsa; identical to SEQ ID NO: 182518

SEQ ID NO: 347728 - RNA, 64 nt, hsa; identical to SEQ ID NO: 182519

SEQ ID NO: 347729 - RNA, 64 nt, hsa; identical to SEQ ID NO: 182520

SEQ ID NO: 347730 - RNA, 64 nt, hsa; identical to SEQ ID NO: 182521

SEQ ID NO: 347731 - RNA, 64 nt, hsa; identical to SEQ ID NO: 182522

SEQ ID NO: 347732 - RNA, 64 nt, hsa; identical to SEQ ID NO: 182523

SEQ ID NO: 347733 - RNA, 64 nt, hsa; identical to SEQ ID NO: 182524

SEQ ID NO: 347734 - RNA, 64 nt, hsa; identical to SEQ ID NO: 182525

SEQ ID NO: 347735 - RNA, 64 nt, hsa; identical to SEQ ID NO: 182526

SEQ ID NO: 347736 - RNA, 64 nt, hsa; identical to SEQ ID NO: 182527

SEQ ID NO: 347737 - RNA, 64 nt, hsa; identical to SEQ ID NO: 182528

SEQ ID NO: 347738 - RNA, 64 nt, hsa; identical to SEQ ID NO: 182529

SEQ ID NO: 347739 - RNA, 64 nt, hsa; identical to SEQ ID NO: 182530

SEQ ID NO: 347740 - RNA, 64 nt, hsa; identical to SEQ ID NO: 182531

SEQ ID NO: 347741 - RNA, 64 nt, hsa; identical to SEQ ID NO: 182532

SEQ ID NO: 347742 - RNA, 64 nt, hsa; identical to SEQ ID NO: 182533

SEQ ID NO: 347743 - RNA, 64 nt, hsa; identical to SEQ ID NO: 182534

SEQ ID NO: 347744 - RNA, 64 nt, hsa; identical to SEQ ID NO: 182535

SEQ ID NO: 347745 - RNA, 64 nt, hsa; identical to SEQ ID NO: 327835

SEQ ID NO: 347746 - RNA, 64 nt, hsa; identical to SEQ ID NO: 327836

SEQ ID NO: 347747 - RNA, 64 nt, hsa; identical to SEQ ID NO: 327837

SEQ ID NO: 347748 - RNA, 64 nt, hsa; identical to SEQ ID NO: 327838

SEQ ID NO: 347749 - RNA, 64 nt, hsa; identical to SEQ ID NO: 327839

SEQ ID NO: 347750 - RNA, 64 nt, hsa; identical to SEQ ID NO: 327840

SEQ ID NO: 347751 - RNA, 64 nt, hsa; identical to SEQ ID NO: 327841

SEQ ID NO: 347752 - RNA, 64 nt, hsa; identical to SEQ ID NO: 327842

SEQ ID NO: 347753 - RNA, 64 nt, hsa; identical to SEQ ID NO: 327843

SEQ ID NO: 347754 - RNA, 64 nt, hsa; identical to SEQ ID NO: 327844

SEQ ID NO: 347755 - RNA, 64 nt, hsa; identical to SEQ ID NO: 327845

SEQ ID NO: 347756 - RNA, 64 nt, hsa; identical to SEQ ID NO: 327846

SEQ ID NO: 347757 - RNA, 64 nt, hsa; identical to SEQ ID NO: 327847

SEQ ID NO: 347758 - RNA, 64 nt, hsa; identical to SEQ ID NO: 327848

SEQ ID NO: 347759 - RNA, 64 nt, hsa; identical to SEQ ID NO: 327849

SEQ ID NO: 347760 - RNA, 64 nt, hsa; identical to SEQ ID NO: 327850

SEQ ID NO: 347761 - RNA, 64 nt, hsa; identical to SEQ ID NO: 327851

SEQ ID NO: 347762 - RNA, 64 nt, hsa; identical to SEQ ID NO: 327852

SEQ ID NO: 347763 - RNA, 64 nt, hsa; identical to SEQ ID NO: 182508

SEQ ID NO: 347764 - RNA, 64 nt, hsa; identical to SEQ ID NO: 182509

SEQ ID NO: 347765 - RNA, 64 nt, hsa; identical to SEQ ID NO: 182510

SEQ ID NO: 347766 - RNA, 64 nt, hsa; identical to SEQ ID NO: 182511

SEQ ID NO: 347767 - RNA, 64 nt, hsa; identical to SEQ ID NO: 182512

SEQ ID NO: 347768 - RNA, 64 nt, hsa; identical to SEQ ID NO: 182513

SEQ ID NO: 347769 - RNA, 64 nt, hsa; identical to SEQ ID NO: 182514

SEQ ID NO: 347770 - RNA, 64 nt, hsa; identical to SEQ ID NO: 182515

SEQ ID NO: 347771 - RNA, 64 nt, hsa; identical to SEQ ID NO: 182516

SEQ ID NO: 347772 - RNA, 64 nt, hsa; identical to SEQ ID NO: 182517

SEQ ID NO: 347773 - RNA, 64 nt, hsa; identical to SEQ ID NO: 182518

SEQ ID NO: 347774 - RNA, 64 nt, hsa; identical to SEQ ID NO: 182519

SEQ ID NO: 347775 - RNA, 64 nt, hsa; identical to SEQ ID NO: 182520

SEQ ID NO: 347776 - RNA, 64 nt, hsa; identical to SEQ ID NO: 182521

SEQ ID NO: 347777 - RNA, 64 nt, hsa; identical to SEQ ID NO: 182522

SEQ ID NO: 347778 - RNA, 64 nt, hsa; identical to SEQ ID NO: 182523

SEQ ID NO: 347779 - RNA, 64 nt, hsa; identical to SEQ ID NO: 182524

SEQ ID NO: 347780 - RNA, 64 nt, hsa; identical to SEQ ID NO: 182525

SEQ ID NO: 347781 - RNA, 64 nt, hsa; identical to SEQ ID NO: 182526

SEQ ID NO: 347782 - RNA, 64 nt, hsa; identical to SEQ ID NO: 182527

SEQ ID NO: 347783 - RNA, 64 nt, hsa; identical to SEQ ID NO: 182528

SEQ ID NO: 347784 - RNA, 64 nt, hsa; identical to SEQ ID NO: 182529

SEQ ID NO: 347785 - RNA, 64 nt, hsa; identical to SEQ ID NO: 182530

SEQ ID NO: 347786 - RNA, 64 nt, hsa; identical to SEQ ID NO: 182531

SEQ ID NO: 347787 - RNA, 64 nt, hsa; identical to SEQ ID NO: 182532

SEQ ID NO: 347788 - RNA, 64 nt, hsa; identical to SEQ ID NO: 182533

SEQ ID NO: 347789 - RNA, 64 nt, hsa; identical to SEQ ID NO: 182534

SEQ ID NO: 347790 - RNA, 64 nt, hsa; identical to SEQ ID NO: 182535

SEQ ID NO: 347791 - RNA, 64 nt, hsa; identical to SEQ ID NO: 327835

SEQ ID NO: 347792 - RNA, 64 nt, hsa; identical to SEQ ID NO: 327836

SEQ ID NO: 347793 - RNA, 64 nt, hsa; identical to SEQ ID NO: 327837

SEQ ID NO: 347794 - RNA, 64 nt, hsa; identical to SEQ ID NO: 327838

SEQ ID NO: 347795 - RNA, 64 nt, hsa; identical to SEQ ID NO: 327839

SEQ ID NO: 347796 - RNA, 64 nt, hsa; identical to SEQ ID NO: 327840

SEQ ID NO: 347797 - RNA, 64 nt, hsa; identical to SEQ ID NO: 327841

SEQ ID NO: 347798 - RNA, 64 nt, hsa; identical to SEQ ID NO: 327842

SEQ ID NO: 347799 - RNA, 64 nt, hsa; identical to SEQ ID NO: 327843

SEQ ID NO: 347800 - RNA, 64 nt, hsa; identical to SEQ ID NO: 327844

SEQ ID NO: 347801 - RNA, 64 nt, hsa; identical to SEQ ID NO: 327845

SEQ ID NO: 347802 - RNA, 64 nt, hsa; identical to SEQ ID NO: 327846

SEQ ID NO: 347803 - RNA, 64 nt, hsa; identical to SEQ ID NO: 327847

SEQ ID NO: 347804 - RNA, 64 nt, hsa; identical to SEQ ID NO: 327848

SEQ ID NO: 347805 - RNA, 64 nt, hsa; identical to SEQ ID NO: 327849

SEQ ID NO: 347806 - RNA, 64 nt, hsa; identical to SEQ ID NO: 327850

SEQ ID NO: 347807 - RNA, 64 nt, hsa; identical to SEQ ID NO: 327851

SEQ ID NO: 347808 - RNA, 64 nt, hsa; identical to SEQ ID NO: 327852

SEQ ID NO: 347809 - RNA, 64 nt, hsa; identical to SEQ ID NO: 182508

SEQ ID NO: 347810 - RNA, 64 nt, hsa; identical to SEQ ID NO: 182509

SEQ ID NO: 347811 - RNA, 64 nt, hsa; identical to SEQ ID NO: 182510

SEQ ID NO: 347812 - RNA, 64 nt, hsa; identical to SEQ ID NO: 182511

SEQ ID NO: 347813 - RNA, 64 nt, hsa; identical to SEQ ID NO: 182512

SEQ ID NO: 347814 - RNA, 64 nt, hsa; identical to SEQ ID NO: 182513

SEQ ID NO: 347815 - RNA, 64 nt, hsa; identical to SEQ ID NO: 182514

SEQ ID NO: 347816 - RNA, 64 nt, hsa; identical to SEQ ID NO: 182515

SEQ ID NO: 347817 - RNA, 64 nt, hsa; identical to SEQ ID NO: 182516

SEQ ID NO: 347818 - RNA, 64 nt, hsa; identical to SEQ ID NO: 182517

SEQ ID NO: 347819 - RNA, 64 nt, hsa; identical to SEQ ID NO: 182518

SEQ ID NO: 347820 - RNA, 64 nt, hsa; identical to SEQ ID NO: 182519

SEQ ID NO: 347821 - RNA, 64 nt, hsa; identical to SEQ ID NO: 182520

SEQ ID NO: 347822 - RNA, 64 nt, hsa; identical to SEQ ID NO: 182521

SEQ ID NO: 347823 - RNA, 64 nt, hsa; identical to SEQ ID NO: 182522

SEQ ID NO: 347824 - RNA, 64 nt, hsa; identical to SEQ ID NO: 182523

SEQ ID NO: 347825 - RNA, 64 nt, hsa; identical to SEQ ID NO: 182524

SEQ ID NO: 347826 - RNA, 64 nt, hsa; identical to SEQ ID NO: 182525

SEQ ID NO: 347827 - RNA, 64 nt, hsa; identical to SEQ ID NO: 182526

SEQ ID NO: 347828 - RNA, 64 nt, hsa; identical to SEQ ID NO: 182527

SEQ ID NO: 347829 - RNA, 64 nt, hsa; identical to SEQ ID NO: 182528

SEQ ID NO: 347830 - RNA, 64 nt, hsa; identical to SEQ ID NO: 182529

SEQ ID NO: 347831 - RNA, 64 nt, hsa; identical to SEQ ID NO: 182530

SEQ ID NO: 347832 - RNA, 64 nt, hsa; identical to SEQ ID NO: 182531

SEQ ID NO: 347833 - RNA, 64 nt, hsa; identical to SEQ ID NO: 182532

SEQ ID NO: 347834 - RNA, 64 nt, hsa; identical to SEQ ID NO: 182533

SEQ ID NO: 347835 - RNA, 64 nt, hsa; identical to SEQ ID NO: 182534

SEQ ID NO: 347836 - RNA, 64 nt, hsa; identical to SEQ ID NO: 182535

SEQ ID NO: 347837 - RNA, 64 nt, hsa; identical to SEQ ID NO: 327835

SEQ ID NO: 347838 - RNA, 64 nt, hsa; identical to SEQ ID NO: 327836

SEQ ID NO: 347839 - RNA, 64 nt, hsa; identical to SEQ ID NO: 327837

SEQ ID NO: 347840 - RNA, 64 nt, hsa; identical to SEQ ID NO: 327838

SEQ ID NO: 347841 - RNA, 64 nt, hsa; identical to SEQ ID NO: 327839

SEQ ID NO: 347842 - RNA, 64 nt, hsa; identical to SEQ ID NO: 327840

SEQ ID NO: 347843 - RNA, 64 nt, hsa; identical to SEQ ID NO: 327841

SEQ ID NO: 347844 - RNA, 64 nt, hsa; identical to SEQ ID NO: 327842

SEQ ID NO: 347845 - RNA, 64 nt, hsa; identical to SEQ ID NO: 327843

SEQ ID NO: 347846 - RNA, 64 nt, hsa; identical to SEQ ID NO: 327844

SEQ ID NO: 347847 - RNA, 64 nt, hsa; identical to SEQ ID NO: 327845

SEQ ID NO: 347848 - RNA, 64 nt, hsa; identical to SEQ ID NO: 327846

SEQ ID NO: 347849 - RNA, 64 nt, hsa; identical to SEQ ID NO: 327847

SEQ ID NO: 347850 - RNA, 64 nt, hsa; identical to SEQ ID NO: 327848

SEQ ID NO: 347851 - RNA, 64 nt, hsa; identical to SEQ ID NO: 327849

SEQ ID NO: 347852 - RNA, 64 nt, hsa; identical to SEQ ID NO: 327850

SEQ ID NO: 347853 - RNA, 64 nt, hsa; identical to SEQ ID NO: 327851

SEQ ID NO: 347854 - RNA, 64 nt, hsa; identical to SEQ ID NO: 327852

SEQ ID NO: 347855 - RNA, 64 nt, hsa
ugggaaauaacagcagaaccucuaccucgaacuaaagaccuauuggggcuggcccugguggagg

SEQ ID NO: 347856 - RNA, 64 nt, hsa
aggcggaacagaacugcauuugaagaaguggaagaagaccuaaggcucucccuucaccuccagg

SEQ ID NO: 347857 - RNA, 64 nt, hsa
aaguauaauaaguguuaauuugccuugaaaaacaaagaccuaaaaagccuuuuuuaagaaauaa

SEQ ID NO: 347858 - RNA, 64 nt, hsa
ucuaggcacuaagggaguuuggggaaagccaaagaagaccuaggccauagagcacaguggaacg

SEQ ID NO: 347859 - RNA, 64 nt, hsa
aagaccuacuugugauauuuaaaugaugcaauaaaagaccuauugauuuggaccuucuucuuaa

SEQ ID NO: 347860 - RNA, 64 nt, hsa
ccuggcuacagaaagaagaugccagaugacacuuaagaccuacuugugauauuuaaaugaugca

SEQ ID NO: 347861 - RNA, 64 nt, hsa
aggcuuccaagugaucugcuccugaacaaguuugaagaccuauuguuucauagacccaagacca

SEQ ID NO: 347862 - RNA, 64 nt, hsa
aagaccaaacgcaucuaaaggauccccagcccccaagaccuagccuuugucugcgauuuuggcu

SEQ ID NO: 347863 - RNA, 64 nt, hsa
cuagacucagcugaaggaucuucaaagcaggaugaagaccuagacuuaccugaaggccuagacu

SEQ ID NO: 347864 - RNA, 64 nt, hsa
cuagacucagcugaaggaucuucaaagcaggaugaagaccuagacuuaccugaaggaucuucaa

SEQ ID NO: 347865 - RNA, 64 nt, hsa
cuagacuuaccugaaggaucuucaaagcagaaugaagaccuaggcuuaccugaaggaucuucaa

SEQ ID NO: 347866 - RNA, 64 nt, hsa
cuaggcuuaccugaaggaucuucaaagcaggaugaagaccuagacuuaccugaaggaucuucac

SEQ ID NO: 347867 - RNA, 63 nt, hsa
guagaauuaccugaaggaucuucacaggaggaugaagaccuagagaaaaagcgaucaucuagg

SEQ ID NO: 347868 - RNA, 64 nt, hsa
cuaggguuaucugaaggaucuucacaagaggaugaagaccuagacucaucugaaggaucuuuga

SEQ ID NO: 347869 - RNA, 64 nt, hsa
cuacaauuaccugaaggaucuucacaggaggaugaagaccuaggguuaucugaaggaucuucac

SEQ ID NO: 347870 - RNA, 64 nt, hsa
cuagacucaucugcagaaucuucaaagcaggaugaagaccuacaauuaccugaaggaucuucac

SEQ ID NO: 347871 - RNA, 64 nt, hsa
gaggaggaggacgaaggauccucacaggaggaugaagaccuagacucaucugcagaaucuucaa

SEQ ID NO: 347872 - RNA, 64 nt, hsa; identical to SEQ ID NO: 165063

SEQ ID NO: 347873 - RNA, 64 nt, hsa; identical to SEQ ID NO: 165064

SEQ ID NO: 347874 - RNA, 64 nt, hsa; identical to SEQ ID NO: 165065

SEQ ID NO: 347875 - RNA, 64 nt, hsa; identical to SEQ ID NO: 165066

SEQ ID NO: 347876 - RNA, 64 nt, hsa; identical to SEQ ID NO: 165067

SEQ ID NO: 347877 - RNA, 64 nt, hsa; identical to SEQ ID NO: 165068

SEQ ID NO: 347878 - RNA, 64 nt, hsa; identical to SEQ ID NO: 165069

SEQ ID NO: 347879 - RNA, 64 nt, hsa; identical to SEQ ID NO: 165070

SEQ ID NO: 347880 - RNA, 64 nt, hsa; identical to SEQ ID NO: 165071

SEQ ID NO: 347881 - RNA, 64 nt, hsa; identical to SEQ ID NO: 165072

SEQ ID NO: 347882 - RNA, 64 nt, hsa; identical to SEQ ID NO: 165073

SEQ ID NO: 347883 - RNA, 64 nt, hsa; identical to SEQ ID NO: 165074

SEQ ID NO: 347884 - RNA, 64 nt, hsa; identical to SEQ ID NO: 165075

SEQ ID NO: 347885 - RNA, 64 nt, hsa; identical to SEQ ID NO: 165076

SEQ ID NO: 347886 - RNA, 64 nt, hsa; identical to SEQ ID NO: 165077

SEQ ID NO: 347887 - RNA, 64 nt, hsa; identical to SEQ ID NO: 165078

SEQ ID NO: 347888 - RNA, 64 nt, hsa; identical to SEQ ID NO: 165079

SEQ ID NO: 347889 - RNA, 64 nt, hsa; identical to SEQ ID NO: 165080

SEQ ID NO: 347890 - RNA, 64 nt, hsa; identical to SEQ ID NO: 165081

SEQ ID NO: 347891 - RNA, 64 nt, hsa; identical to SEQ ID NO: 165082

SEQ ID NO: 347892 - RNA, 64 nt, hsa; identical to SEQ ID NO: 165083

SEQ ID NO: 347893 - RNA, 64 nt, hsa; identical to SEQ ID NO: 165084

SEQ ID NO: 347894 - RNA, 64 nt, hsa; identical to SEQ ID NO: 165085

SEQ ID NO: 347895 - RNA, 64 nt, hsa; identical to SEQ ID NO: 165086

SEQ ID NO: 347896 - RNA, 64 nt, hsa; identical to SEQ ID NO: 165087

SEQ ID NO: 347897 - RNA, 64 nt, hsa; identical to SEQ ID NO: 165088

SEQ ID NO: 347898 - RNA, 64 nt, hsa; identical to SEQ ID NO: 165089

SEQ ID NO: 347899 - RNA, 64 nt, hsa; identical to SEQ ID NO: 165090

SEQ ID NO: 347900 - RNA, 64 nt, hsa; identical to SEQ ID NO: 165091

SEQ ID NO: 347901 - RNA, 64 nt, hsa; identical to SEQ ID NO: 165092

SEQ ID NO: 347902 - RNA, 64 nt, hsa; identical to SEQ ID NO: 165093

SEQ ID NO: 347903 - RNA, 64 nt, hsa; identical to SEQ ID NO: 165094

SEQ ID NO: 347904 - RNA, 64 nt, hsa; identical to SEQ ID NO: 165095

SEQ ID NO: 347905 - RNA, 64 nt, hsa; identical to SEQ ID NO: 165096

SEQ ID NO: 347906 - RNA, 64 nt, hsa; identical to SEQ ID NO: 165097

SEQ ID NO: 347907 - RNA, 64 nt, hsa; identical to SEQ ID NO: 165098

SEQ ID NO: 347908 - RNA, 64 nt, hsa; identical to SEQ ID NO: 165099

SEQ ID NO: 347909 - RNA, 64 nt, hsa; identical to SEQ ID NO: 165100

SEQ ID NO: 347910 - RNA, 64 nt, hsa; identical to SEQ ID NO: 165101

SEQ ID NO: 347911 - RNA, 64 nt, hsa; identical to SEQ ID NO: 165102

SEQ ID NO: 347912 - RNA, 64 nt, hsa; identical to SEQ ID NO: 165103

SEQ ID NO: 347913 - RNA, 64 nt, hsa; identical to SEQ ID NO: 165104

SEQ ID NO: 347914 - RNA, 64 nt, hsa; identical to SEQ ID NO: 165105

SEQ ID NO: 347915 - RNA, 64 nt, hsa; identical to SEQ ID NO: 165106

SEQ ID NO: 347916 - RNA, 64 nt, hsa
auucauaauugcauuauagaggaauguaguaugucauaaguacuuuguaaagauuugacauuca

SEQ ID NO: 347917 - RNA, 64 nt, hsa
uacagcugugaagggcuaaaguuagaguugauuacauaaguaaguauuccccauauaaucuuuu

SEQ ID NO: 347918 - RNA, 64 nt, hsa
cugggugacaaaaugagacauugucucuaaaauacauaaguaaauuuaaaaaaaaaagaauaau

SEQ ID NO: 347919 - RNA, 64 nt, hsa
aaauugaaaaacuaguaagcaaauaaaugauaaacauaaguaaauuuaaacuguuguuuguaua

SEQ ID NO: 347920 - RNA, 64 nt, hsa
auuuuuauccuauccauaaguaauauguaacugccauaaguauagcuuuuagaauguaauaugu

SEQ ID NO: 347921 - RNA, 64 nt, hsa
agauucucagaaaucaggagauuuuuauccuauccauaaguaauauguaacugccauaaguaua

SEQ ID NO: 347922 - RNA, 64 nt, hsa
gaucuggaugaguuauacaugauauuugacuuuucauaaguaguggaagguuucacuaaguaaa

SEQ ID NO: 347923 - RNA, 64 nt, hsa
gaucuagaugaguuauaaaugguauuugacuuuucauaaguaguggaagguuucacuaaguaaa

SEQ ID NO: 347924 - RNA, 64 nt, hsa
guucuugcuguguaacagaugcuccauaguaagccauaaguauuccugcuaaaguuagcuugua

SEQ ID NO: 347925 - RNA, 64 nt, hsa
uuuaguuauuuuucuuuucacuuuuuauaguugacauaaguaaauuuauuuauugagucaauuu

SEQ ID NO: 347926 - RNA, 64 nt, hsa; identical to SEQ ID NO: 51595

SEQ ID NO: 347927 - RNA, 64 nt, hsa; identical to SEQ ID NO: 51596

SEQ ID NO: 347928 - RNA, 64 nt, hsa; identical to SEQ ID NO: 51597

SEQ ID NO: 347929 - RNA, 64 nt, hsa; identical to SEQ ID NO: 51598

SEQ ID NO: 347930 - RNA, 64 nt, hsa; identical to SEQ ID NO: 51599

SEQ ID NO: 347931 - RNA, 64 nt, hsa; identical to SEQ ID NO: 51600

SEQ ID NO: 347932 - RNA, 64 nt, hsa; identical to SEQ ID NO: 51601

SEQ ID NO: 347933 - RNA, 64 nt, hsa; identical to SEQ ID NO: 51602

SEQ ID NO: 347934 - RNA, 64 nt, hsa; identical to SEQ ID NO: 51603

SEQ ID NO: 347935 - RNA, 64 nt, hsa; identical to SEQ ID NO: 51604

SEQ ID NO: 347936 - RNA, 64 nt, hsa; identical to SEQ ID NO: 51605

SEQ ID NO: 347937 - RNA, 64 nt, hsa; identical to SEQ ID NO: 51606

SEQ ID NO: 347938 - RNA, 64 nt, hsa; identical to SEQ ID NO: 51607

SEQ ID NO: 347939 - RNA, 64 nt, hsa; identical to SEQ ID NO: 51608

SEQ ID NO: 347940 - RNA, 64 nt, hsa; identical to SEQ ID NO: 51609

SEQ ID NO: 347941 - RNA, 64 nt, hsa; identical to SEQ ID NO: 51610

SEQ ID NO: 347942 - RNA, 64 nt, hsa; identical to SEQ ID NO: 51611

SEQ ID NO: 347943 - RNA, 64 nt, hsa; identical to SEQ ID NO: 51612

SEQ ID NO: 347944 - RNA, 64 nt, hsa; identical to SEQ ID NO: 51613

SEQ ID NO: 347945 - RNA, 64 nt, hsa; identical to SEQ ID NO: 51614

SEQ ID NO: 347946 - RNA, 64 nt, hsa; identical to SEQ ID NO: 51615

SEQ ID NO: 347947 - RNA, 64 nt, hsa; identical to SEQ ID NO: 51616

SEQ ID NO: 347948 - RNA, 64 nt, hsa; identical to SEQ ID NO: 51617

SEQ ID NO: 347949 - RNA, 64 nt, hsa; identical to SEQ ID NO: 51618

SEQ ID NO: 347950 - RNA, 64 nt, hsa; identical to SEQ ID NO: 51619

SEQ ID NO: 347951 - RNA, 64 nt, hsa; identical to SEQ ID NO: 51620

SEQ ID NO: 347952 - RNA, 64 nt, hsa
acacugaccgacccuccuggggucugucaggaaaaaguagaagaaaagccacccccugcacccu

SEQ ID NO: 347953 - RNA, 64 nt, hsa
ugugucaugccauccuuugggcccucugcuggaaaaguagaaucaagucucaaauaaugccuuu

SEQ ID NO: 347954 - RNA, 64 nt, hsa
aauuaagauuuguuuucaaguggauguccauuaaaaguagaaaaauauuugggauaagugagug

SEQ ID NO: 347955 - RNA, 64 nt, hsa
uaccuuucaguccugucuggguuuuaaauaagugaaguagaagaaauugaguauuuucugacau

SEQ ID NO: 347956 - RNA, 64 nt, hsa
guacucaaauucucuacuguaugaauuaugcuuuaaguagaauucagugccaaggagaacuugg

SEQ ID NO: 347957 - RNA, 64 nt, hsa
gauuuuuaaaggauuaauaaaauucugaaauguuaaguagaagauuacauugucuagucuugua

SEQ ID NO: 347958 - RNA, 64 nt, hsa
uuuaaagugcaggcugcaauuaaaacauggagaaaaguagaaauaaugccauaagucuagauug

SEQ ID NO: 347959 - RNA, 64 nt, hsa
auuacccuaauggauugcaaccaaaacuuuaaacaaguagaaagauaauauuucuccaauuggg

SEQ ID NO: 347960 - RNA, 64 nt, hsa
agaacacaugaaaggaauacauggggaagaaauaaaguagaacccaagaguucuuuuaaguuuu

SEQ ID NO: 347961 - RNA, 64 nt, hsa
gcuauuucuggauagagaugacuauuuucccaacaaguagaaacacuuaaaaucaucuuucuuu

SEQ ID NO: 347962 - RNA, 64 nt, hsa
agaaggaugccacaguaguauguaaaacccaaacaaguagaacccaagcaaauaaaauuauuua

SEQ ID NO: 347963 - RNA, 64 nt, hsa
uuuuguugugcugaguuugauuaguugcuuaaccaaguagaaagaaaagcacaucuuccugauc

SEQ ID NO: 347964 - RNA, 64 nt, hsa
gguaugacauuggauagaacaugggauacuuuagaaguagaauugacagggcauauuaguugau

SEQ ID NO: 347965 - RNA, 64 nt, hsa
gagcuuauuuagaguccuaguuuuccuacuuauaaaguagaaauggugagauuguuuucuuuuu

SEQ ID NO: 347966 - RNA, 64 nt, hsa
cuccuucccucuagcaauuucuacuaaaauguccaaguagaauguuuccuuuuacaaucaaauu

SEQ ID NO: 347967 - RNA, 64 nt, hsa
caguucuccuccugugcuaucuucucuucuauccaaguagaauguacgccaggagcuccuuccc

SEQ ID NO: 347968 - RNA, 64 nt, hsa
guaccuugcuuuagaguagauguuuggaaaagcuaaguagaaauuuuuuaaaauagaaguugua

SEQ ID NO: 347969 - RNA, 64 nt, hsa
uuaggcuuuauaggugaaggacuuguuuugacuuaaguagaaguaauaugcucucauuucuuug

SEQ ID NO: 347970 - RNA, 64 nt, hsa
uugaaagaugggguuggguaaaguagauuaggugaaguagaacauaaaauugaauaguacccaa

SEQ ID NO: 347971 - RNA, 64 nt, hsa
cauuggaggugguuucuggccgugauuggaugugaaguagaagagguccucgaucaugguguua

SEQ ID NO: 347972 - RNA, 64 nt, hsa
ccauacuauuagacuguguagugaugugacuuccaaguagaauuuaaucuccccauugagugug

SEQ ID NO: 347973 - RNA, 64 nt, hsa
aguccuggguuuuugaaaaagugcuaaaacggacaaguagaauaaauguugcuguggaaugcca

SEQ ID NO: 347974 - RNA, 64 nt, hsa
cugaaugagcaaaagcuggagcauuacucuugagaaguagaacaaggcacuucaguccuauuca

SEQ ID NO: 347975 - RNA, 64 nt, hsa
aacagaaaaccaaauaccacauguucucacuuauaaguagaagcuaaacauugaguacacaugg

SEQ ID NO: 347976 - RNA, 64 nt, hsa
uuuuuuaaugugccuuuuggguugguagaaacggaaguagaaguaggcuggaggaugaguuggg

SEQ ID NO: 347977 - RNA, 64 nt, hsa
guucccuuggggguguugagccauuaauaccagcaaguagaagcugggaugggcagugucugac

SEQ ID NO: 347978 - RNA, 64 nt, hsa
uauuucuuagcaagauauuuuaucucuguacauaaaguagaaaccaaaagcuagggaaacagau

SEQ ID NO: 347979 - RNA, 64 nt, hsa
ggcaagaugaaaugccagaauuaaaaccaaucauaaguagaacccacuucaaaauaaaaaaaca

SEQ ID NO: 347980 - RNA, 64 nt, hsa
aaaggcggauugaggcugcugggucagccuugaucgcacagacagagcuugugccggauuuggc

SEQ ID NO: 347981 - RNA, 64 nt, hsa
gauucugaaaauccuacccccaccccccaccagccgcacagauuguacuaccgcgagaggcauc

SEQ ID NO: 347982 - RNA, 64 nt, hsa
ggccggcacgcgugacacggcacuucaggcuccacgcacagaaucucgcagauaguugggacua

SEQ ID NO: 347983 - RNA, 64 nt, hsa
aagcugagagacccuggccucaaguuauuucaugcgcacagagggaagccaugugggguugcug

SEQ ID NO: 347984 - RNA, 64 nt, hsa
ggaacugccaguguagagggaauucuaagcuggacgcacagaacagucucuccgugggaggaga

SEQ ID NO: 347985 - RNA, 64 nt, hsa
ucuuuugucuucugugaagacaggaccuaugcaacgcacagacacuuuuggagaccguaaaaca

SEQ ID NO: 347986 - RNA, 64 nt, hsa
uaaccguucccagguguacgcacgcgcgcgcgcgcgcacagacacacacacacacacacacaca

SEQ ID NO: 347987 - RNA, 64 nt, hsa
auuuccuuccauuaagaauuacucagaguucuaacgcacagaauccugacuuccauguagcucc

SEQ ID NO: 347988 - RNA, 64 nt, hsa
uuuagaaaacagaaaucugcaucucagccugagacgcacagagaggucucuuccugacccagac

SEQ ID NO: 347989 - RNA, 64 nt, hsa
ugguacugcugugacgcggcacauacaccccagccgcacagaugcgugugacccagaggcgaga

SEQ ID NO: 347990 - RNA, 64 nt, hsa
ccccaaaagagagucaggagagcagcaggagaggcgcacagaaggcccaguucucagggguuuu

SEQ ID NO: 347991 - RNA, 64 nt, hsa
cugccagggagccgccauccgagcuugagcugggcgcacagaggugcccgccaggaucuguggc

SEQ ID NO: 347992 - RNA, 64 nt, hsa
acauguggcuucacauuuauuaaacaauaaauuccgcacagaaaguuucauuucaccaaugugu

SEQ ID NO: 347993 - RNA, 64 nt, hsa
aggcccgccggaggagcgcguccccagccuuccgcgcacagagccgcaucccgccccgcccugc

SEQ ID NO: 347994 - RNA, 64 nt, hsa
uucaaaggggcaccaguuuguagucccucuguuucgcacagaguacuaugacaaggaaacauca

SEQ ID NO: 347995 - RNA, 64 nt, hsa
auguuuccuagaacaagaaccaccaaagccuguucgcacagaagggcgaccuugcagggacucg

SEQ ID NO: 347996 - RNA, 64 nt, hsa
aguugugauaauagcauuuuuguaacuugccauccgcacagaaaauacgagaaaaucugcaugu

SEQ ID NO: 347997 - RNA, 64 nt, hsa
ggccggggcacaauuugcacuccccucagcuagacgcacagacucagcaauaaaccuuugcauc

SEQ ID NO: 347998 - RNA, 64 nt, hsa
uaaaccugggucuucuccuuggcggugcugucagcgcacagacccaugcgcauccccacccaca

SEQ ID NO: 347999 - RNA, 64 nt, hsa
aggacccagagcaggccuguccaugccauuccuucgcacagaugaaacugagcugggacuggaa

SEQ ID NO: 348000 - RNA, 64 nt, hsa
gggcacacagauaagcugcccaaaugcacgcacacgcacagagacaugccagaacauacaagga

SEQ ID NO: 348001 - RNA, 64 nt, hsa
ugcauuaagaaacccccucauggaucugcauaaccgcacagacauugacaagcacgcacacaca

SEQ ID NO: 348002 - RNA, 64 nt, hsa
ugauaaccaaauucugucacucaagacacagacacgcacagacccuguccuuugccucuauuaa

SEQ ID NO: 348003 - RNA, 64 nt, hsa
agagguucugcacuccuggaaccggucacaggaacgcacagaucauggcaggaugcgcugggac

SEQ ID NO: 348004 - RNA, 64 nt, hsa
ccuuaagguuuuaauaccugguacaguagugaaccgcacagauuucaugaacuuaggauguguu

SEQ ID NO: 348005 - RNA, 64 nt, hsa
acuucagaaaauacacaacagccccuucugcccccgcacagaaaugcugcagaguauauaaaac

SEQ ID NO: 348006 - RNA, 64 nt, hsa
cgacagguggccccagcuuccucuccggagccugcgcacagagagucacgccccccacucuccu

SEQ ID NO: 348007 - RNA, 64 nt, hsa
uaaggaacucagggggcacguggucaggcuccaccgcacagaagagccacagucuccagacuca

SEQ ID NO: 348008 - RNA, 64 nt, hsa
gggcagcaucagagugccuuucuagagggagccacgcacagaauguaacaggaugaaacaguuu

SEQ ID NO: 348009 - RNA, 64 nt, hsa
acucucgcucacgcucagacgcuacacacgcgcgcgcacagacacggugcaccuaggucacaca

SEQ ID NO: 348010 - RNA, 64 nt, hsa
acacacacacaugcacacaacacauacacacacacgcacagaggugaacagaaacugaaacauu

SEQ ID NO: 348011 - RNA, 64 nt, hsa
cccuuguggcagcuuucucuucaaauaggaagaacgcacagagggcaggagccuccuguuugca

SEQ ID NO: 348012 - RNA, 64 nt, hsa
gagacgccacccggugcuugaggcgggaccgaggcgcacagagaccgaggcgcauagagaccga

SEQ ID NO: 348013 - RNA, 64 nt, hsa
agggcaagggguuccucuggauugcagaccacaucgcacagaccccuggcucugacccccucuc

SEQ ID NO: 348014 - RNA, 64 nt, hsa
agguauguuuuagauauaguuuacaaaaauaaaacgcacagaucuuaccuuuuuggccuccuga

SEQ ID NO: 348015 - RNA, 64 nt, hsa
gaagcaguucacugagucagcugguucccaagcucgcacagaaggugauaaguuacuaucaaau

SEQ ID NO: 348016 - RNA, 64 nt, hsa
ugaaggagaucguaggguggaugccccugauggccgcacagaaggacuucuucugggaggcccu

SEQ ID NO: 348017 - RNA, 64 nt, hsa
acacacacacacacaaaugugccacacccagacacgcacagaaucagacacuacaaacaccugc

SEQ ID NO: 348018 - RNA, 64 nt, hsa
aaacaggcuuuccaccccugcucugagagcaccacgcacagauuuccaguucuuaguguggcug

SEQ ID NO: 348019 - RNA, 52 nt, hsa
ggcaucagaaagcacugugagacgcacagacggcgucuucugccaccaagag

SEQ ID NO: 348020 - RNA, 64 nt, hsa
gugagaaaauucagaauaccaucuguuucauagccgcacagauuuuggacuuucacaaacauug

SEQ ID NO: 348021 - RNA, 64 nt, hsa
gcugggcagguguucuggcagcuucucaggugcccgcacagaggcuccgugugacuuccgucca

SEQ ID NO: 348022 - RNA, 64 nt, hsa
ggaccacgggcgaggacgugaagccucccgaacacgcacagaaggaaggagccagcucccagcc

SEQ ID NO: 348023 - RNA, 64 nt, hsa
cgcccaccucccugggagccgggccuguacauagcgcacagauguuuguuuuaaauaaauaaac

SEQ ID NO: 348024 - RNA, 64 nt, hsa
ggcccccaccacacaucccagcccaauccagguacgcacagacagguuuucacauaaaugcagc

SEQ ID NO: 348025 - RNA, 64 nt, hsa
gguuuuuuucuacuugugugucugggggaaugaacgcacagaucuguuugacuuuguuauaaaa

SEQ ID NO: 348026 - RNA, 64 nt, hsa
guuugugaucugagacccgcgguguggcugagagcgcacagagcgcacgugcacauaccucugc

SEQ ID NO: 348027 - RNA, 64 nt, hsa
aaucaccacauaguaugucccuuuaaagcauugacgcacagacaaauguuuaaagcacaguaaa

SEQ ID NO: 348028 - RNA, 64 nt, hsa
gagguggggagguggcgaggauggggacagaaagcgcacagaaucuuggaccaggucucucuuc

SEQ ID NO: 348029 - RNA, 64 nt, hsa
ugcccacugugccuuucgagauggugguggaggccgcacagaaggccaaugcccacggcuucau

SEQ ID NO: 348030 - RNA, 64 nt, hsa
uccccacacacgccuaugcacaaacguggauuaucgcacagacugggagguuuaguggugcauu

SEQ ID NO: 348031 - RNA, 64 nt, hsa
uccucgccugcagccucagaggggcaggcauccccgcacagacuugacuggcagggcggucacg

SEQ ID NO: 348032 - RNA, 64 nt, hsa
aguggcugcagguagcuggacuuccugccugugacgcacagagagcagcggacuccggagcguc

SEQ ID NO: 348033 - RNA, 64 nt, hsa
ggaugugaguugugugaauaaucuuucugucccucgcacagaagccaguaauuagcaucuaaug

SEQ ID NO: 348034 - RNA, 64 nt, hsa
uuguacauaaaggcuucauccacgaaccauccagcgcacagaagcaagugcaaaaaugacacaa

SEQ ID NO: 348035 - RNA, 64 nt, hsa
ccuucucugucccauugcuuucuccuuuccccgacgcacagaauaaacaugaagcucagcagua

SEQ ID NO: 348036 - RNA, 64 nt, hsa
gugugccaggcacccccagauacaaaugcagccacgcacagacguaacacacaggugccaggcc

SEQ ID NO: 348037 - RNA, 64 nt, hsa
aauugccugcgccacgcagcggggccggacaggccgcacagaccuacuguggcgggagggaggg

SEQ ID NO: 348038 - RNA, 64 nt, hsa
uuaaacacugaagugccgaaguggcccgugccgccgcacagagaccccgacuuuaguuugggcu

SEQ ID NO: 348039 - RNA, 64 nt, hsa
ugcacagguggcauuugcuuccaauuguagcuagcgcacagagcuuuggaagccugucauuaug

SEQ ID NO: 348040 - RNA, 64 nt, hsa
gaagggggcagagagaguuaugaccccgagagggcgcacagaccaagcgugagcuccacgcggg

SEQ ID NO: 348041 - RNA, 64 nt, hsa
ccugcagugggcacccuaggcguauguguauacacgcacagauauuuauuccuuucgcuuuuag

SEQ ID NO: 348042 - RNA, 64 nt, hsa
aggaggugccguccaggugugcggcgagccgcugcgcacagaugucaggauuuccguuuggguc

SEQ ID NO: 348043 - RNA, 64 nt, hsa
guuuugaggagaggcagugauuccccucccgccccgcacagagaccccgacucacugccagccg

SEQ ID NO: 348044 - RNA, 64 nt, hsa
cugauuugacuuuucucgccggccggucucaggccgcacagacguuccagaggaggagggugac

SEQ ID NO: 348045 - RNA, 64 nt, hsa
agauuaaagccaucucagugaagauaugcgugcacgcacagacagacagacacacacacacaca

SEQ ID NO: 348046 - RNA, 64 nt, hsa
uucaggcaggcaggcccaggaugggcguuugcugcgcacagacacucagcaggggccucgcaga

SEQ ID NO: 348047 - RNA, 64 nt, hsa
gggaaggaacaggacugcaaaaauccuucuccaccgcacagacugggaaccccuccuggccugg

SEQ ID NO: 348048 - RNA, 64 nt, hsa
uccugaugguuucccguuuucaugguaacaaauucgcacagagguuuugcuuuaugcuguagaa

SEQ ID NO: 348049 - RNA, 64 nt, hsa
ccgcccccagccggugcucagguggcccaggggccgcacagacgaggcgugguccaggcauugu

SEQ ID NO: 348050 - RNA, 64 nt, hsa
guuuguuuuuacuuuuaaagaaauguaaacagaucgcacagaguaaagaagaugaugauguaau

SEQ ID NO: 348051 - RNA, 64 nt, hsa
ugaugcagucguggugaacaggaggucuaccuaacgcacagaaagucaugcuucagugacauug

SEQ ID NO: 348052 - RNA, 64 nt, hsa
agagggcagaggggacaccuucauugccucuccucgcacagaaauggugggcucucucuggccc

SEQ ID NO: 348053 - RNA, 64 nt, hsa
gcacugccugcgggugccagucugaaaaccagaccgcacagaggccuggggcugcugaugagcu

SEQ ID NO: 348054 - RNA, 64 nt, hsa
uaggccuugcuugcugccuucuggauucuuggcccgcacagagcuggggcugagggauggacug

SEQ ID NO: 348055 - RNA, 64 nt, hsa
cacaaccagccacacagagccugccucagcugcucgcacagauuacuucagggcuggaaaaguc

SEQ ID NO: 348056 - RNA, 64 nt, hsa
gaagccccaggugccacuuugcuggucuuguugccgcacagauuccugaccauccucagaaucu

SEQ ID NO: 348057 - RNA, 64 nt, hsa; identical to SEQ ID NO: 283329

SEQ ID NO: 348058 - RNA, 64 nt, hsa; identical to SEQ ID NO: 283330

SEQ ID NO: 348059 - RNA, 64 nt, hsa; identical to SEQ ID NO: 283331

SEQ ID NO: 348060 - RNA, 64 nt, hsa; identical to SEQ ID NO: 283332

SEQ ID NO: 348061 - RNA, 64 nt, hsa; identical to SEQ ID NO: 247598

SEQ ID NO: 348062 - RNA, 64 nt, hsa; identical to SEQ ID NO: 247599

SEQ ID NO: 348063 - RNA, 64 nt, hsa; identical to SEQ ID NO: 247600

SEQ ID NO: 348064 - RNA, 64 nt, hsa; identical to SEQ ID NO: 247601

SEQ ID NO: 348065 - RNA, 64 nt, hsa; identical to SEQ ID NO: 247602

SEQ ID NO: 348066 - RNA, 64 nt, hsa; identical to SEQ ID NO: 247603

SEQ ID NO: 348067 - RNA, 64 nt, hsa; identical to SEQ ID NO: 247604

SEQ ID NO: 348068 - RNA, 64 nt, hsa; identical to SEQ ID NO: 247605

SEQ ID NO: 348069 - RNA, 64 nt, hsa; identical to SEQ ID NO: 247606

SEQ ID NO: 348070 - RNA, 64 nt, hsa; identical to SEQ ID NO: 247607

SEQ ID NO: 348071 - RNA, 64 nt, hsa; identical to SEQ ID NO: 247608

SEQ ID NO: 348072 - RNA, 64 nt, hsa; identical to SEQ ID NO: 247609

SEQ ID NO: 348073 - RNA, 64 nt, hsa; identical to SEQ ID NO: 247610

SEQ ID NO: 348074 - RNA, 64 nt, hsa; identical to SEQ ID NO: 247611

SEQ ID NO: 348075 - RNA, 64 nt, hsa; identical to SEQ ID NO: 247612

SEQ ID NO: 348076 - RNA, 64 nt, hsa; identical to SEQ ID NO: 247613

SEQ ID NO: 348077 - RNA, 64 nt, hsa
caguuuauuacauuuagcuuguucacacuuugcccuaugacauuucuacaucacuggcugcucu

SEQ ID NO: 348078 - RNA, 64 nt, hsa
ggcagcaggaacuuuaaauuuuuuaaguucaugucuaugacaugaacaaugugugggauaaugu

SEQ ID NO: 348079 - RNA, 64 nt, hsa
ugcuaugcauagcuugggcaauagcccuaaauugcuaugacaacuaaugaaccagcuacguaua

SEQ ID NO: 348080 - RNA, 64 nt, hsa
gaauuguuuaucaucuugacaugguuggucauuucuaugacaauuuacuucaaacuguguacug

SEQ ID NO: 348081 - RNA, 64 nt, hsa
auggcacugcaggugagaaccccgcccauccgugcuaugacauggaggcacugaagcccgagga

SEQ ID NO: 348082 - RNA, 64 nt, hsa
cauuuaauccaaacagggguucuuagucucagcacuaugacauuuugggcugacuacuuauuug

SEQ ID NO: 348083 - RNA, 64 nt, hsa
cucaaauuuucuauugccagaaaauuuucaaacacuaugacacagaccaguccggcaccaucaa

SEQ ID NO: 348084 - RNA, 64 nt, hsa
uccccuccacaggauuccaccucaacaaccagcucuaugacaucauuaccaugcgguacgcaga

SEQ ID NO: 348085 - RNA, 64 nt, hsa
accgggacuuuuuuucuuuuuucuuuuuuuuuugcuaugacagaguaaugcuaacguaaggaca

SEQ ID NO: 348086 - RNA, 64 nt, hsa
gguucuggucuccaaguaucguuaagcacaggugcuaugacagaaaaaguucugggguggaagu

SEQ ID NO: 348087 - RNA, 57 nt, hsa
ccuauagaaggagccuggacucugaucccucuguacaggcuggauggaaggggcccu

SEQ ID NO: 348088 - RNA, 57 nt, hsa
gagagaugugacaugguucuuggauuuccucuguagcagccuccuggacuuccugag

SEQ ID NO: 348089 - RNA, 57 nt, hsa
guauggaugucauaaaagucuauuuaaccucuguaaugaaacuaaauaaaaauguuu

SEQ ID NO: 348090 - RNA, 57 nt, hsa
gagucauccagcaaugagagaauccugccucuguagaccaacauccagugugauuuu

SEQ ID NO: 348091 - RNA, 57 nt, hsa
aaaaguaaugaucguaaagacacaaauccucuguaugccaucuugcauuggcacuga

SEQ ID NO: 348092 - RNA, 57 nt, hsa
accaguccaucaccccucccaggccagccucuguaaguuggccacacuuggggagug

SEQ ID NO: 348093 - RNA, 57 nt, hsa
cuuucugcugugucuucacaucacccuccucuguauaccuaaucugccucugccucu

SEQ ID NO: 348094 - RNA, 57 nt, hsa
uccucuguucccacacuugggccucugccucuguaccugcagcucugcucucgggau

SEQ ID NO: 348095 - RNA, 64 nt, hsa
gaccuaaauggacuauaguauauuggauguuaaauccauauaugauguauauuuuguaaaauug

SEQ ID NO: 348096 - RNA, 64 nt, hsa
cgauacaugcaaauuuaauguaguaacucacuuuuccauauauuuugaauguauauuucuauuu

SEQ ID NO: 348097 - RNA, 64 nt, hsa
caaacuucguuauuuuaucuugucauuuacaacauccauauaagcaacuagccauauaagcaaa

SEQ ID NO: 348098 - RNA, 64 nt, hsa
cuacuaaugacuuaaguguacaucuguucuugucuccauauauucauguaagaugcacaacaaa

SEQ ID NO: 348099 - RNA, 64 nt, hsa
uuuuuggaaguauuuggcauugcuaauugagcaguccauauaguacuacuuuuagaagaaacaa

SEQ ID NO: 348100 - RNA, 64 nt, hsa
uuuuauuaauauuaauuuaaugcuauuagcaauuuccauauacuauauuguggaaaagacugaa

SEQ ID NO: 348101 - RNA, 64 nt, hsa
gaucaaaguucagaaaauggucugcaaaaguuacuccauauacaaccccaaaucuacuacuuua

SEQ ID NO: 348102 - RNA, 64 nt, hsa
guaacaugaaaaagcagggaaucucaaacuuuauuccauauauacacacacacacacacacaca

SEQ ID NO: 348103 - RNA, 64 nt, hsa
uagacuaguaaaucacagugguucaaaauauauauccauauauauauauauccauauauauauc

SEQ ID NO: 348104 - RNA, 64 nt, hsa
agugguucaaaauauauauccauauauauauauauccauauauauaucucaugucaucacauua

SEQ ID NO: 348105 - RNA, 64 nt, hsa
aaauugaauuagcaagaaccgacuguuugcauuuuccauauauccuuuuaucugcucuuuuuaa

SEQ ID NO: 348106 - RNA, 64 nt, hsa
uucuucucagucccagcucagaucgaauuauauauccauauauauauauauauauauauauaua

SEQ ID NO: 348107 - RNA, 64 nt, hsa
gugauaaaagauagaguauccuuaugguugaguuuccauauaaguggaccagacacagaaacaa

SEQ ID NO: 348108 - RNA, 64 nt, hsa
auuccucuucagacaugaaagggaacauauauauuccauauauauguucaacucuucauagauu

SEQ ID NO: 348109 - RNA, 64 nt, hsa
auauaccauauauguauauauuccacauauguauuccauauauauauuccauauguauaugugu

SEQ ID NO: 348110 - RNA, 64 nt, hsa
uguaugcauauauguauuccauauauguauauauuccauauaccauauauguauauauuccaca

SEQ ID NO: 348111 - RNA, 64 nt, hsa
uguauacauuccauguauguaugcauauauguauuccauauauguauauauuccauauaccaua

SEQ ID NO: 348112 - RNA, 64 nt, hsa
aagaauuucuuaacaaaaugauggccaagguaguuccauauauauacauauauuccacaugugu

SEQ ID NO: 348113 - RNA, 64 nt, hsa
uuuugguuaaauggguguuuaaucuuuugguuaguggguuaaacgggguaaguuagaguagggg

SEQ ID NO: 348114 - RNA, 64 nt, hsa
acuccuauaauuuuugauugugagcucaccuauuuggguuaagcaugccaauuuaaagagacca

SEQ ID NO: 348115 - RNA, 64 nt, hsa
aguugguucuauugaagccagucuuuaagaaaccuggguuaaagacaccagcacuucugcuugc

SEQ ID NO: 348116 - RNA, 64 nt, hsa
uagauaaaccucugcccuccacuccuugcuugaguggguuaaaggaacuaacaguugucccuuu

SEQ ID NO: 348117 - RNA, 64 nt, hsa
ggcguugcuggguggcgaugcccguccucuggcuuggguuaauucuuggaugacgucggcguug

SEQ ID NO: 348118 - RNA, 64 nt, hsa
ggcguugcuggguggcaaugcccauccucugccuuggguuaauucuucggugacacuggcguug

SEQ ID NO: 348119 - RNA, 64 nt, hsa
ggcauugcuggguggugaugcccguccucuggcuuggguuaauucuucggugacacuggcguug

SEQ ID NO: 348120 - RNA, 64 nt, hsa
aagaugaaggcauggcgaugcccguccucuggcuuggguuaauucuucggugacacuggcauug

SEQ ID NO: 348121 - RNA, 64 nt, hsa
uauagggcuuccuuugguaucaaaguacuuuacuuggguuaauuuauuaaaaccuauccagugg

SEQ ID NO: 348122 - RNA, 64 nt, hsa
uccagugguagaauuugagcuuucuaggucacauuggguuaaguuuguaugaccaaaugaaucu

SEQ ID NO: 348123 - RNA, 64 nt, hsa; identical to SEQ ID NO: 110383

SEQ ID NO: 348124 - RNA, 64 nt, hsa; identical to SEQ ID NO: 110384

SEQ ID NO: 348125 - RNA, 64 nt, hsa; identical to SEQ ID NO: 110385

SEQ ID NO: 348126 - RNA, 64 nt, hsa; identical to SEQ ID NO: 110386

SEQ ID NO: 348127 - RNA, 64 nt, hsa; identical to SEQ ID NO: 110387

SEQ ID NO: 348128 - RNA, 64 nt, hsa; identical to SEQ ID NO: 110388

SEQ ID NO: 348129 - RNA, 64 nt, hsa
uaguguaguuuucuaaacgcugcaaauuugcagccuuuaccacuacaaagaaguuuggaugagg

SEQ ID NO: 348130 - RNA, 64 nt, hsa
aaagauuuagaugccuuccuaaauuguuacaaugcuuuaccaaaucuaugacuucuacauaaca

SEQ ID NO: 348131 - RNA, 64 nt, hsa
uaucuauagauucaguaucuacuacccauauuuacuuuaccaaauauauuucuccucacugcau

SEQ ID NO: 348132 - RNA, 64 nt, hsa
acuaagaugguauuugcacauuuaagauauguuacuuuaccaauuuuuaaugguaaucaacucu

SEQ ID NO: 348133 - RNA, 64 nt, hsa
cuuaccacuugguuggcucccuuugucucuguaccuuuaccaacauuaggaucucaccucuuuc

SEQ ID NO: 348134 - RNA, 64 nt, hsa
uauuaucucauauuuucucccucuuucucuuacucuuuaccaaguuuuccugguggcuuggcuu

SEQ ID NO: 348135 - RNA, 64 nt, hsa
uugaaugucgauggggcaagaacucagacuucuacuuuaccaaguaccacacacucuggaaugc

SEQ ID NO: 348136 - RNA, 64 nt, hsa
uaauucucuaagcucaagaugcaucccauugccacuuuaccauucuauuucccaagggaaccau

SEQ ID NO: 348137 - RNA, 64 nt, hsa
gaagccugaggcuucuguucaauuucauagacuccuuuaccauguaaaauuugucugauauuug

SEQ ID NO: 348138 - RNA, 64 nt, hsa
augaguuagucaauuguaucagguuuuccaagaccuuuaccaguaaauuauguuucuguaugua

SEQ ID NO: 348139 - RNA, 64 nt, hsa
uuugaaauaucauguuaaauuagaaugaauuuaucuuuaccaaaaaccauguugcguucaaaga

SEQ ID NO: 348140 - RNA, 64 nt, hsa
aauauagagacaggacagaauguguucuuuucuccuuuaccaguccuauuuuucaaugggaaga

SEQ ID NO: 348141 - RNA, 64 nt, hsa; identical to SEQ ID NO: 298975

SEQ ID NO: 348142 - RNA, 64 nt, hsa; identical to SEQ ID NO: 298976

SEQ ID NO: 348143 - RNA, 64 nt, hsa; identical to SEQ ID NO: 171676

SEQ ID NO: 348144 - RNA, 64 nt, hsa; identical to SEQ ID NO: 171677

SEQ ID NO: 348145 - RNA, 64 nt, hsa; identical to SEQ ID NO: 171678

SEQ ID NO: 348146 - RNA, 64 nt, hsa; identical to SEQ ID NO: 171679

SEQ ID NO: 348147 - RNA, 64 nt, hsa; identical to SEQ ID NO: 171680

SEQ ID NO: 348148 - RNA, 64 nt, hsa; identical to SEQ ID NO: 171681

SEQ ID NO: 348149 - RNA, 64 nt, hsa; identical to SEQ ID NO: 171682

SEQ ID NO: 348150 - RNA, 64 nt, hsa; identical to SEQ ID NO: 171683

SEQ ID NO: 348151 - RNA, 64 nt, hsa; identical to SEQ ID NO: 171684

SEQ ID NO: 348152 - RNA, 64 nt, hsa; identical to SEQ ID NO: 171685

SEQ ID NO: 348153 - RNA, 64 nt, hsa; identical to SEQ ID NO: 171686

SEQ ID NO: 348154 - RNA, 64 nt, hsa; identical to SEQ ID NO: 171687

SEQ ID NO: 348155 - RNA, 64 nt, hsa; identical to SEQ ID NO: 171688

SEQ ID NO: 348156 - RNA, 64 nt, hsa; identical to SEQ ID NO: 171689

SEQ ID NO: 348157 - RNA, 64 nt, hsa; identical to SEQ ID NO: 171690

SEQ ID NO: 348158 - RNA, 64 nt, hsa; identical to SEQ ID NO: 171691

SEQ ID NO: 348159 - RNA, 64 nt, hsa; identical to SEQ ID NO: 171692

SEQ ID NO: 348160 - RNA, 64 nt, hsa; identical to SEQ ID NO: 171693

SEQ ID NO: 348161 - RNA, 64 nt, hsa; identical to SEQ ID NO: 171694

SEQ ID NO: 348162 - RNA, 64 nt, hsa; identical to SEQ ID NO: 171695

SEQ ID NO: 348163 - RNA, 64 nt, hsa; identical to SEQ ID NO: 171696

SEQ ID NO: 348164 - RNA, 64 nt, hsa; identical to SEQ ID NO: 171697

SEQ ID NO: 348165 - RNA, 64 nt, hsa; identical to SEQ ID NO: 171698

SEQ ID NO: 348166 - RNA, 64 nt, hsa; identical to SEQ ID NO: 171699

SEQ ID NO: 348167 - RNA, 64 nt, hsa; identical to SEQ ID NO: 171700

SEQ ID NO: 348168 - RNA, 64 nt, hsa; identical to SEQ ID NO: 171701

SEQ ID NO: 348169 - RNA, 64 nt, hsa; identical to SEQ ID NO: 171702

SEQ ID NO: 348170 - RNA, 64 nt, hsa; identical to SEQ ID NO: 171703

SEQ ID NO: 348171 - RNA, 64 nt, hsa; identical to SEQ ID NO: 171704

SEQ ID NO: 348172 - RNA, 64 nt, hsa; identical to SEQ ID NO: 171705

SEQ ID NO: 348173 - RNA, 64 nt, hsa; identical to SEQ ID NO: 171706

SEQ ID NO: 348174 - RNA, 64 nt, hsa; identical to SEQ ID NO: 171707

SEQ ID NO: 348175 - RNA, 61 nt, hsa; identical to SEQ ID NO: 171708

SEQ ID NO: 348176 - RNA, 64 nt, hsa; identical to SEQ ID NO: 171709

SEQ ID NO: 348177 - RNA, 64 nt, hsa; identical to SEQ ID NO: 171710

SEQ ID NO: 348178 - RNA, 64 nt, hsa; identical to SEQ ID NO: 171711

SEQ ID NO: 348179 - RNA, 64 nt, hsa; identical to SEQ ID NO: 171712

SEQ ID NO: 348180 - RNA, 64 nt, hsa; identical to SEQ ID NO: 171713

SEQ ID NO: 348181 - RNA, 64 nt, hsa; identical to SEQ ID NO: 171714

SEQ ID NO: 348182 - RNA, 64 nt, hsa; identical to SEQ ID NO: 171715

SEQ ID NO: 348183 - RNA, 64 nt, hsa; identical to SEQ ID NO: 171716

SEQ ID NO: 348184 - RNA, 64 nt, hsa; identical to SEQ ID NO: 171717

SEQ ID NO: 348185 - RNA, 64 nt, hsa; identical to SEQ ID NO: 171718

SEQ ID NO: 348186 - RNA, 64 nt, hsa; identical to SEQ ID NO: 171719

SEQ ID NO: 348187 - RNA, 64 nt, hsa; identical to SEQ ID NO: 171720

SEQ ID NO: 348188 - RNA, 64 nt, hsa; identical to SEQ ID NO: 171721

SEQ ID NO: 348189 - RNA, 64 nt, hsa; identical to SEQ ID NO: 171722

SEQ ID NO: 348190 - RNA, 64 nt, hsa; identical to SEQ ID NO: 171723

SEQ ID NO: 348191 - RNA, 64 nt, hsa; identical to SEQ ID NO: 171724

SEQ ID NO: 348192 - RNA, 64 nt, hsa; identical to SEQ ID NO: 171725

SEQ ID NO: 348193 - RNA, 64 nt, hsa; identical to SEQ ID NO: 171726

SEQ ID NO: 348194 - RNA, 64 nt, hsa; identical to SEQ ID NO: 171727

SEQ ID NO: 348195 - RNA, 64 nt, hsa; identical to SEQ ID NO: 171728

SEQ ID NO: 348196 - RNA, 64 nt, hsa; identical to SEQ ID NO: 171729

SEQ ID NO: 348197 - RNA, 64 nt, hsa; identical to SEQ ID NO: 171730

SEQ ID NO: 348198 - RNA, 64 nt, hsa; identical to SEQ ID NO: 171731

SEQ ID NO: 348199 - RNA, 64 nt, hsa; identical to SEQ ID NO: 171732

SEQ ID NO: 348200 - RNA, 64 nt, hsa; identical to SEQ ID NO: 171733

SEQ ID NO: 348201 - RNA, 64 nt, hsa; identical to SEQ ID NO: 171734

SEQ ID NO: 348202 - RNA, 64 nt, hsa; identical to SEQ ID NO: 171735

SEQ ID NO: 348203 - RNA, 64 nt, hsa; identical to SEQ ID NO: 171736

SEQ ID NO: 348204 - RNA, 64 nt, hsa; identical to SEQ ID NO: 171737

SEQ ID NO: 348205 - RNA, 64 nt, hsa; identical to SEQ ID NO: 171738

SEQ ID NO: 348206 - RNA, 64 nt, hsa; identical to SEQ ID NO: 171739

SEQ ID NO: 348207 - RNA, 64 nt, hsa; identical to SEQ ID NO: 171740

SEQ ID NO: 348208 - RNA, 64 nt, hsa; identical to SEQ ID NO: 171741

SEQ ID NO: 348209 - RNA, 64 nt, hsa; identical to SEQ ID NO: 171742

SEQ ID NO: 348210 - RNA, 64 nt, hsa; identical to SEQ ID NO: 171743

SEQ ID NO: 348211 - RNA, 64 nt, hsa; identical to SEQ ID NO: 171744

SEQ ID NO: 348212 - RNA, 64 nt, hsa; identical to SEQ ID NO: 171745

SEQ ID NO: 348213 - RNA, 64 nt, hsa; identical to SEQ ID NO: 171746

SEQ ID NO: 348214 - RNA, 64 nt, hsa; identical to SEQ ID NO: 171747

SEQ ID NO: 348215 - RNA, 64 nt, hsa; identical to SEQ ID NO: 171748

SEQ ID NO: 348216 - RNA, 64 nt, hsa; identical to SEQ ID NO: 171749

SEQ ID NO: 348217 - RNA, 64 nt, hsa; identical to SEQ ID NO: 171750

SEQ ID NO: 348218 - RNA, 64 nt, hsa; identical to SEQ ID NO: 171751

SEQ ID NO: 348219 - RNA, 64 nt, hsa; identical to SEQ ID NO: 171752

SEQ ID NO: 348220 - RNA, 64 nt, hsa; identical to SEQ ID NO: 171753

SEQ ID NO: 348221 - RNA, 64 nt, hsa; identical to SEQ ID NO: 171754

SEQ ID NO: 348222 - RNA, 64 nt, hsa; identical to SEQ ID NO: 171755

SEQ ID NO: 348223 - RNA, 64 nt, hsa; identical to SEQ ID NO: 171756

SEQ ID NO: 348224 - RNA, 64 nt, hsa; identical to SEQ ID NO: 171757

SEQ ID NO: 348225 - RNA, 64 nt, hsa; identical to SEQ ID NO: 171758

SEQ ID NO: 348226 - RNA, 64 nt, hsa; identical to SEQ ID NO: 171759

SEQ ID NO: 348227 - RNA, 64 nt, hsa; identical to SEQ ID NO: 171760

SEQ ID NO: 348228 - RNA, 64 nt, hsa; identical to SEQ ID NO: 171761

SEQ ID NO: 348229 - RNA, 64 nt, hsa; identical to SEQ ID NO: 171762

SEQ ID NO: 348230 - RNA, 64 nt, hsa; identical to SEQ ID NO: 171763

SEQ ID NO: 348231 - RNA, 64 nt, hsa; identical to SEQ ID NO: 171764

SEQ ID NO: 348232 - RNA, 64 nt, hsa; identical to SEQ ID NO: 171765

SEQ ID NO: 348233 - RNA, 64 nt, hsa; identical to SEQ ID NO: 171766

SEQ ID NO: 348234 - RNA, 64 nt, hsa; identical to SEQ ID NO: 171767

SEQ ID NO: 348235 - RNA, 64 nt, hsa; identical to SEQ ID NO: 171768

SEQ ID NO: 348236 - RNA, 64 nt, hsa; identical to SEQ ID NO: 171769

SEQ ID NO: 348237 - RNA, 64 nt, hsa; identical to SEQ ID NO: 171770

SEQ ID NO: 348238 - RNA, 64 nt, hsa; identical to SEQ ID NO: 171771

SEQ ID NO: 348239 - RNA, 64 nt, hsa; identical to SEQ ID NO: 171772

SEQ ID NO: 348240 - RNA, 64 nt, hsa; identical to SEQ ID NO: 171773

SEQ ID NO: 348241 - RNA, 64 nt, hsa; identical to SEQ ID NO: 171774

SEQ ID NO: 348242 - RNA, 64 nt, hsa; identical to SEQ ID NO: 171775

SEQ ID NO: 348243 - RNA, 64 nt, hsa; identical to SEQ ID NO: 171776

SEQ ID NO: 348244 - RNA, 64 nt, hsa; identical to SEQ ID NO: 171777

SEQ ID NO: 348245 - RNA, 64 nt, hsa; identical to SEQ ID NO: 171778

SEQ ID NO: 348246 - RNA, 64 nt, hsa; identical to SEQ ID NO: 171779

SEQ ID NO: 348247 - RNA, 64 nt, hsa; identical to SEQ ID NO: 171780

SEQ ID NO: 348248 - RNA, 64 nt, hsa; identical to SEQ ID NO: 171781

SEQ ID NO: 348249 - RNA, 64 nt, hsa; identical to SEQ ID NO: 171782

SEQ ID NO: 348250 - RNA, 64 nt, hsa; identical to SEQ ID NO: 171783

SEQ ID NO: 348251 - RNA, 64 nt, hsa; identical to SEQ ID NO: 171784

SEQ ID NO: 348252 - RNA, 64 nt, hsa; identical to SEQ ID NO: 171785

SEQ ID NO: 348253 - RNA, 64 nt, hsa; identical to SEQ ID NO: 171786

SEQ ID NO: 348254 - RNA, 64 nt, hsa; identical to SEQ ID NO: 171787

SEQ ID NO: 348255 - RNA, 64 nt, hsa; identical to SEQ ID NO: 171788

SEQ ID NO: 348256 - RNA, 64 nt, hsa; identical to SEQ ID NO: 171789

SEQ ID NO: 348257 - RNA, 64 nt, hsa; identical to SEQ ID NO: 171790

SEQ ID NO: 348258 - RNA, 64 nt, hsa; identical to SEQ ID NO: 171791

SEQ ID NO: 348259 - RNA, 64 nt, hsa; identical to SEQ ID NO: 171792

SEQ ID NO: 348260 - RNA, 64 nt, hsa; identical to SEQ ID NO: 171793

SEQ ID NO: 348261 - RNA, 64 nt, hsa; identical to SEQ ID NO: 171794

SEQ ID NO: 348262 - RNA, 64 nt, hsa; identical to SEQ ID NO: 171795

SEQ ID NO: 348263 - RNA, 64 nt, hsa; identical to SEQ ID NO: 171796

SEQ ID NO: 348264 - RNA, 64 nt, hsa; identical to SEQ ID NO: 171797

SEQ ID NO: 348265 - RNA, 64 nt, hsa; identical to SEQ ID NO: 171798

SEQ ID NO: 348266 - RNA, 64 nt, hsa; identical to SEQ ID NO: 171799

SEQ ID NO: 348267 - RNA, 64 nt, hsa
uucuaaaaagauucuuauuugggggagugggcaaaauguugauuauuuucuaaugcuuuguagc

SEQ ID NO: 348268 - RNA, 64 nt, hsa
uguaaauuucaguuacuggucauagaaggcuuucaauguugaguggccuuuuauuaacauguuu

SEQ ID NO: 348269 - RNA, 64 nt, hsa
ccaaaggguuuguauucugcuaaaaggagaugccaauguugaaugaagucugaaacucuaguau

SEQ ID NO: 348270 - RNA, 64 nt, hsa
aauaugaaaugggaccuaauaccaguaugugauaaauguugauguuuucuguguacaaacacau

SEQ ID NO: 348271 - RNA, 64 nt, hsa
aaugccaucccugcugggaauguugaaguuacuuaauguugaucuaucccuuggggaaaguaaa

SEQ ID NO: 348272 - RNA, 64 nt, hsa
guaaaauucugugagaaaugccaucccugcugggaauguugaaguuacuuaauguugaucuauc

SEQ ID NO: 348273 - RNA, 64 nt, hsa
augcuuagcuuuuaaggcauuuuaaauaaccaugaauguugauuucauuacuuuccuuuccucc

SEQ ID NO: 348274 - RNA, 64 nt, hsa
gagagaaggugaucuauucccacaugucauuucuaauguugaguuuccaugacugaacaaagag

SEQ ID NO: 348275 - RNA, 64 nt, hsa
uuguuaagagguuuugguuccaaacucaaccagcaauguugagagcugaacuuaagauagcugu

SEQ ID NO: 348276 - RNA, 64 nt, hsa
agguuugcagaaaguauuaaacauuuuuaagcugaauguugagacagugcauccauuuucuuua

SEQ ID NO: 348277 - RNA, 64 nt, hsa
agaaacgaugcguaguuuucauuuacuaauuacaaauguugaggccuaauucugaaaguccuca

SEQ ID NO: 348278 - RNA, 64 nt, hsa
auuuaggcgaaguaguuaagaaauggcccuuuugaauguugaagauaggaaagaaagccauaua

SEQ ID NO: 348279 - RNA, 64 nt, hsa
acauuuuuaaucaauuguggaugauggcuuauuaaauguugacuuccuaguauaaaacugcaag

SEQ ID NO: 348280 - RNA, 64 nt, hsa
caaaaaccauaauguuggaauuugguaaaauuuuaauguugauuuuuacugugaaaagguuuuu

SEQ ID NO: 348281 - RNA, 64 nt, hsa
gcugggagugaguugguaauaugagaugggaaggaauguugacuugcuaacauuccuuuaacaa

SEQ ID NO: 348282 - RNA, 64 nt, hsa
uguuuaaauuuguuacagugacuuuuaaaggauuaauguugaaucacauugucagaauuuuuuc

SEQ ID NO: 348283 - RNA, 64 nt, hsa
auauucuuugugcaugugauuuuuuugcaugauuaauguugaauugaaagcucucaggauaauu

SEQ ID NO: 348284 - RNA, 64 nt, hsa
ggcuguaccuauaagauguacaggauaauaguuaaauguugaguauuguacauauguauuuaag

SEQ ID NO: 348285 - RNA, 64 nt, hsa
uggcuuuuuauuccagucuaggcagagacagaagaauguugaauaagagcacgauuagaguccu

SEQ ID NO: 348286 - RNA, 64 nt, hsa
ccgaggugccggagagggagcgcuggacaacuagaauguugaccucgagccgaggcccuacuug

SEQ ID NO: 348287 - RNA, 64 nt, hsa
acggaaagugccuuagacacuacaguacuaagacaauguugaauauaucauucgccucuauaac

SEQ ID NO: 348288 - RNA, 64 nt, hsa
uuauggagccuccagaacagaugccaucuuccugaauguugacaugccagugggugugacuccu

SEQ ID NO: 348289 - RNA, 64 nt, hsa
acuucuuauggaggagaguguuuaacugaguuagaauguugaaacugacuugcugugacuuaug

SEQ ID NO: 348290 - RNA, 64 nt, hsa
caguaaucaguuugcuaacauauuuaaagucuugaauguugaagaacucaugugauuuacccuu

SEQ ID NO: 348291 - RNA, 64 nt, hsa
cuuuuaauacuauaguuucaccuguauucuaguaaauguugagacaccguuuugcuuuuaagua

SEQ ID NO: 348292 - RNA, 64 nt, hsa
agcaagaucauuuacccaaggauagguguuugguaauguugaaggaguuagucuggcuucaugu

SEQ ID NO: 348293 - RNA, 63 nt, hsa; identical to SEQ ID NO: 38974

SEQ ID NO: 348294 - RNA, 63 nt, hsa; identical to SEQ ID NO: 38975

SEQ ID NO: 348295 - RNA, 64 nt, hsa
acugugagcaggugggccugugucuucaggugcuuugccaaacucuuaaaagaaaguguccagu

SEQ ID NO: 348296 - RNA, 64 nt, hsa
cugucagggaggcaaaaaaggcuucaucccauccuugccaaaaaauaagaaaacugucuuggag

SEQ ID NO: 348297 - RNA, 64 nt, hsa
aagcaggaaggaggagugaauuuuauuaacauguuugccaaauguauugagauuuggccucuga

SEQ ID NO: 348298 - RNA, 64 nt, hsa
cuuuaucauuguuuacuacuaguaaaaagcagcauugccaaauaaucccuaauuuuccacuaaa

SEQ ID NO: 348299 - RNA, 64 nt, hsa
uucauuuuacuaaaaagauuccucguuauuguuguugccaaagagaaacaaaaaugauuuugcu

SEQ ID NO: 348300 - RNA, 64 nt, hsa
ugggccaacuauuuaguaagcccggauagacuuauugccaaaaacaaaaaauagcuuucaaaag

SEQ ID NO: 348301 - RNA, 64 nt, hsa
acaaugacaacaucacaaggggaagggagggauuuugccaaaaguuagaaagguggagcuguaa

SEQ ID NO: 348302 - RNA, 64 nt, hsa
guccugugaauuuuaaaaagcuaucccauaucgauugccaaagagcaucuaccuuaccuccuaa

SEQ ID NO: 348303 - RNA, 64 nt, hsa
ugcaaucuugggggugguuuuauuuauuucuuuuuugccaaauagaguguggauucauuucagg

SEQ ID NO: 348304 - RNA, 64 nt, hsa
gaguagggcaauggaaauaccaaaccuucugacuuugccaaaaagcauacaagcaaccugguca

SEQ ID NO: 348305 - RNA, 64 nt, hsa
gguaauucacuucaguuuaaugucuccuuugcucuugccaaaaaauagcacacuuuuccacauu

SEQ ID NO: 348306 - RNA, 64 nt, hsa
ucgaacuuucaaaauauauuuucaguacacccaguugccaaaguuuugcugucucuuagagaaa

SEQ ID NO: 348307 - RNA, 64 nt, hsa
aaaaggaaccuguuucuuagaagaaguaacauuuuugccaaaagaugacugggguuuuccguuu

SEQ ID NO: 348308 - RNA, 64 nt, hsa
ccguuuguuaauauuaagcacaucagaacgugaauugccaaagucuucauuagaaggcagcauu

SEQ ID NO: 348309 - RNA, 64 nt, hsa
cucaaacugacacaagaccuacagagaaaacccuuugccaaaucugcucucagcaaguggacag

SEQ ID NO: 348310 - RNA, 64 nt, hsa
uuucaggaaagaaaucagcucagcucuccacucauugccaaaugucacuaaaggguuuaguuuu

SEQ ID NO: 348311 - RNA, 64 nt, hsa
ucuauagcgagacauagaauaguauucugaucaguugccaaagaaucuaggaaauuaguuguau

SEQ ID NO: 348312 - RNA, 64 nt, hsa
uuucaucacuaguaugugugcgugagcuggucaguugccaaaggaggaaauaagguuagaagcc

SEQ ID NO: 348313 - RNA, 64 nt, hsa
aaggacuuuugugcaauauggucuuaagaaauaauugccaaaaaaaucggccaugguuugcauu

SEQ ID NO: 348314 - RNA, 64 nt, hsa
uaaguuuggagaaaauaccacacaaaacaaugaauugccaaauuguuuguuuuauucaagacuc

SEQ ID NO: 348315 - RNA, 64 nt, hsa
gggucaguuccucacagugguucuguaccaaaacuugccaaauuccuccauggccaaguguuaa

SEQ ID NO: 348316 - RNA, 64 nt, hsa
aggucccuaguggguauauuugcugccaagccacuugccaaagaagaggaaccacagaaagaga

SEQ ID NO: 348317 - RNA, 64 nt, hsa
uuugauucuucuuuuuaacaauuuuuuuuuuuuuuugccaaacaauaucaauggugaugccguc

SEQ ID NO: 348318 - RNA, 64 nt, hsa
ugguuuuaugcauugaugguuuuuuuuuucuuuuuugccaaauugacugucacgcggcagcuuc

SEQ ID NO: 348319 - RNA, 64 nt, hsa
gaacccuccuccugucaauggggguguaguauuuuugccaaaauaucauguucaauuucaguag

SEQ ID NO: 348320 - RNA, 64 nt, hsa
aaaacuuucaauggagauagggcuagaaauacuuuugccaaauagcauucuuauucacuuuaug

SEQ ID NO: 348321 - RNA, 64 nt, hsa
aaaugcagucaucuuaauacuagucuauacauuuuugccaaauggcgcaaauauaccuccauuu

SEQ ID NO: 348322 - RNA, 64 nt, hsa
cuucuccaugucaguaucauguucucuaauuaucuugccaaauuuugaaacuacacacaaaaag

SEQ ID NO: 348323 - RNA, 64 nt, hsa
auuggaccgaagucauuaaaacaaaaugaaacauuugccaaaacaaaacaaaaaacuauguauu

SEQ ID NO: 348324 - RNA, 64 nt, hsa
auugucuugaggcuuccagguuuuguuuuuguuuuugccaaaguagaaaaggcagguggugggc

SEQ ID NO: 348325 - RNA, 64 nt, hsa
uucccaucagccagagggggucagggcugcccuguugccaaacaacucccugaggccucuccgc

SEQ ID NO: 348326 - RNA, 64 nt, hsa
uucauuuuguaaugugguuuaacauccuuguuguuugccaaagaaauuucauuuggcugugaau

SEQ ID NO: 348327 - RNA, 64 nt, hsa
aaacucuguuucugcaggggaugauauuggugaguugccaaagaagcaauacagcauaucugcu

SEQ ID NO: 348328 - RNA, 64 nt, hsa
guuuucuuucauacucauaauuagcccaaaacaguugccaaacuuugccauugugcuccugcau

SEQ ID NO: 348329 - RNA, 50 nt, hsa
augaaaauaguggaagguaauugccaaaucaagagaacugacuugcaagc

SEQ ID NO: 348330 - RNA, 64 nt, hsa
aaagaaaauuucuacauauuaaaacuuguggauguugccaaagcucuacacauugggauuggaa

SEQ ID NO: 348331 - RNA, 64 nt, hsa
gccuccuaaugugcuacaguaagauauacacaucuugccaaaaauauugaaccugaauuuaagc

SEQ ID NO: 348332 - RNA, 64 nt, hsa
ucuggcaagaacaccucggagccacugcauuguuuugccaaaaacuuacugcagauuaaguaaa

SEQ ID NO: 348333 - RNA, 64 nt, hsa
guccguuagaucuugauuuuacaggugagggugguugccaaaggugauaagaaaagcagccaac

SEQ ID NO: 348334 - RNA, 64 nt, hsa
acacaguucuucuuucagcuugucuuaagaaugguugccaaaaacaacagccaaaaaaaaaaaa

SEQ ID NO: 348335 - RNA, 64 nt, hsa
ucugcaugaguugcuuuuguacccuuuaaaucauuugccaaacauugcagcaaacaagugugcg

SEQ ID NO: 348336 - RNA, 64 nt, hsa
aggggaucaauauuuugcacaccuguaauaggccauggcacaccagccaagaugcucugcucac

SEQ ID NO: 348337 - RNA, 64 nt, hsa
ucccaucauagcacauguagaaaauaauauuuuuauggcacacugggauaaacaagcaagauug

SEQ ID NO: 348338 - RNA, 64 nt, hsa
uauacauuauaauguaauauauaaacuaaaauuuauggcacaaaagauaaauauggcuuugaaa

SEQ ID NO: 348339 - RNA, 64 nt, hsa
cuuaaggggauagacuagacugccacagcagcccauggcacaacuaacaccuacugauauucac

SEQ ID NO: 348340 - RNA, 64 nt, hsa
aaccaugaugugaaacugacaauccuguggccacauggcacaaaacaccaaauauugguuauga

SEQ ID NO: 348341 - RNA, 64 nt, hsa
uuugacaucaaccauuaguaggucuuugguuuugauggcacacuauggagaaaggacacacugg

SEQ ID NO: 348342 - RNA, 64 nt, hsa
ggucccccagggcuuccucccacagcagcugugaauggcacagugaccuuccugcagcguggag

SEQ ID NO: 348343 - RNA, 64 nt, hsa
gugaauggcacagugaccuuccugcagcguggagauggcacauccuugcugcuggggacuuggc

SEQ ID NO: 348344 - RNA, 64 nt, hsa
agacauuuaagauugucagcaaacuugucccaaaauggcacaucaucauaauccauuuucucuu

SEQ ID NO: 348345 - RNA, 64 nt, hsa
uuguuuuuauucuuacacgacuacaguacuucaaauggcacauagauaggcaggauauuacaua

SEQ ID NO: 348346 - RNA, 64 nt, hsa
uuucagugucacagagacauucuuugauaaggaaauggcacaaacauaaagggaaaggcugcua

SEQ ID NO: 348347 - RNA, 64 nt, hsa
ucaauauuaaagauagcugagaagcaccuuucaaauggcacagucccucuucaagaugucuaaa

SEQ ID NO: 348348 - RNA, 64 nt, hsa
cagggucuugcuuugucacccaugcuggaguacaauggcacaaacacugcucacugcagccucg

SEQ ID NO: 348349 - RNA, 64 nt, hsa
aauucuacaugaccauaaaaccucgaagauggguauggcacaguucaugcccuguaauccuagc

SEQ ID NO: 348350 - RNA, 64 nt, hsa
ucucauuuuggaucucacuguugucuuuauaaaaauggcacauuuuacaaaguaguuuauucuu

SEQ ID NO: 348351 - RNA, 64 nt, hsa
gaaaaggcagacacugguugggaccaaagucuccauggcacaugacugaagacugguggucgug

SEQ ID NO: 348352 - RNA, 64 nt, hsa
cuuaguucauauaaucucgggauacacacacacacacacauauauauacacacacauacguaua

SEQ ID NO: 348353 - RNA, 64 nt, hsa
ucgggauacacacacacacacacauauauauacacacacauacguauacacacacauacauaua

SEQ ID NO: 348354 - RNA, 64 nt, hsa
cacacacauauauauacacacacauacguauacacacacauacauauauauaaauauaccugau

SEQ ID NO: 348355 - RNA, 64 nt, hsa
aagaccaaacagaacaugagaauacacacacacacacacauauacacacacacacacuucacac

SEQ ID NO: 348356 - RNA, 64 nt, hsa
acacacacacacacauauacacacacacacacuucacacauacacaccacucccaccaccguca

SEQ ID NO: 348357 - RNA, 64 nt, hsa
aaucauauauaguccagucuucauuuuacauacacacacauauuuuacacacacacacauuuua

SEQ ID NO: 348358 - RNA, 64 nt, hsa
acacacacacauuuuacacacacacacacacacacacacauauguuuuucuagucucuggcaug

SEQ ID NO: 348359 - RNA, 64 nt, hsa
agagacaagccauuuacauacagauauucacagucacacauagaaacacccacauggacacaag

SEQ ID NO: 348360 - RNA, 64 nt, hsa
cguuauacacaaggccagguaagcgcucauaauucacacauaauaaaacaucuagguuucauuc

SEQ ID NO: 348361 - RNA, 64 nt, hsa
acuggugcuaaugucuaauauaauuuuauauuuacacacauacgugcuacccagagauuaauuu

SEQ ID NO: 348362 - RNA, 64 nt, hsa
auuccuauaaugggagcaucaccacuuauuaaaacacacauagaaugaugaauuaaaaaaguuu

SEQ ID NO: 348363 - RNA, 64 nt, hsa
aagaugaauauauauauauauauaucuguauagacacacauauaauauauauagauauauaauc

SEQ ID NO: 348364 - RNA, 64 nt, hsa
ccauagauuuuuuaaaaacuacauuuuguaaggccacacauaagugaaaauacggaaggcuuug

SEQ ID NO: 348365 - RNA, 64 nt, hsa
uuucuuuuaaauuauaucugucccaggugcucuccacacauaggaugguaaugccagucccagg

SEQ ID NO: 348366 - RNA, 64 nt, hsa
cacaugcgugugcacccgcgcacgcacauacacacacacauauagcaguagcagcagcagcagc

SEQ ID NO: 348367 - RNA, 64 nt, hsa
uuauuauacugagauauauauauauacacacacacacacauauguguauauauguauauauaua

SEQ ID NO: 348368 - RNA, 64 nt, hsa
uauaugugaguauauauacacacacacacacacacacacauauauauauauacacacacgcaca

SEQ ID NO: 348369 - RNA, 64 nt, hsa
cacacacacacacauauauauauauacacacacgcacacauauauguugcugcagcauaaagaa

SEQ ID NO: 348370 - RNA, 64 nt, hsa
ccauguucuucuaaaacauauacauauauacauacacacauacacauauucuucaggucucuaa

SEQ ID NO: 348371 - RNA, 64 nt, hsa
cauaugcacacacgcauacacacaugcacgcacacacacauacacacaugcacgcacgcacgca

SEQ ID NO: 348372 - RNA, 64 nt, hsa
uauuugguaucucuugcuccuuucuaucuguggucacacauacacgcucuauuaacuuugccua

SEQ ID NO: 348373 - RNA, 64 nt, hsa
ugagugucaccaguggguaauugaaucaacuucucacacauacugaaggcuuuauaugucucau

SEQ ID NO: 348374 - RNA, 64 nt, hsa
cacacacacacauauacacacacucacagacccacacacauacacacugucaugcacucaacua

SEQ ID NO: 348375 - RNA, 64 nt, hsa
cacuuauaaaccucuguacacacacacacacacacacacauauacacacacucacagacccaca

SEQ ID NO: 348376 - RNA, 64 nt, hsa
cugccacacaaacguauguaaauguauauacccacacacauacacacauaugucauauauuacu

SEQ ID NO: 348377 - RNA, 64 nt, hsa
caaacguauguaaauguauauacccacacacauacacacauaugucauauauuacuagcauaug

SEQ ID NO: 348378 - RNA, 64 nt, hsa
auacauauguguguguauaguauauauauauauacacacauauauguuucuguguuccucuuuu

SEQ ID NO: 348379 - RNA, 64 nt, hsa
uauacauauauacauauauauguauauauauacacacacauacauauguguguguauaguauau

SEQ ID NO: 348380 - RNA, 64 nt, hsa
guuaaaauuauauauauauauauauauacacacacacacauauauauauauauauaauucaaag

SEQ ID NO: 348381 - RNA, 64 nt, hsa
gauagaauguauuauauauauauauauauacacacacacauauauauagcugaaucuuuggugu

SEQ ID NO: 348382 - RNA, 64 nt, hsa
cuuucaaaaaaaaaaacaaaaaaaaaaccacacacacacauaaaaaacccaacaggucaaaaua

SEQ ID NO: 348383 - RNA, 64 nt, hsa
auuuuuuaaagguauucauggugacucaggaauacacacauacacacacacacacacacacaca

SEQ ID NO: 348384 - RNA, 64 nt, hsa
cacacauacacacacacacacacacacacacacacacacauacacacauauaauuugaaagagg

SEQ ID NO: 348385 - RNA, 64 nt, hsa
cacacacacacacacacacacacacacacacauacacacauauaauuugaaagaggugaguaug

SEQ ID NO: 348386 - RNA, 64 nt, hsa
uucccucccaggucugugucugauagcauacacacacacauauauauacacacacacacacaca

SEQ ID NO: 348387 - RNA, 64 nt, hsa
uauacacacacacacacacacacacacacacacacacacauacauacacacacacauauauaua

SEQ ID NO: 348388 - RNA, 64 nt, hsa
cacacacacacacacacacacacauacauacacacacacauauauauacacacacacacacaca

SEQ ID NO: 348389 - RNA, 64 nt, hsa
caggaggccccugcggaggcagcguggaucugcccacacauaggcuacuggaauaguuuaaccc

SEQ ID NO: 348390 - RNA, 64 nt, hsa
cuuauuuaacccuuuuguguucuagauuuacuuacacacauagccuagagcucaguuuuaguuu

SEQ ID NO: 348391 - RNA, 64 nt, hsa
uacauauauauauauauauacauauauauacauacacacauacauauaauuuuuuuuuuuuuug

SEQ ID NO: 348392 - RNA, 64 nt, hsa
uccauauauacacacacacacacacacacacacacacacauacauacauacauauauauauaua

SEQ ID NO: 348393 - RNA, 64 nt, hsa
uauauauauggauggauguaauauauguagaacacacacauagauguauauaggauacacacuc

SEQ ID NO: 348394 - RNA, 64 nt, hsa
gagagagaaguaccacuguggcuagauauauacacacacauauauauauggauggauguaauau

SEQ ID NO: 348395 - RNA, 64 nt, hsa
auagugacugugccauaggaaagcagccccuccucacacauacaugugcacaugcacacacaug

SEQ ID NO: 348396 - RNA, 64 nt, hsa
ugugcacaugcacacacaugcaugcacacacaugcacacauacacgcacaugcacacauacaca

SEQ ID NO: 348397 - RNA, 64 nt, hsa
ugcaugcacacacaugcacacauacacgcacaugcacacauacacaugcaugcacacauacaca

SEQ ID NO: 348398 - RNA, 64 nt, hsa
cacauacacgcacaugcacacauacacaugcaugcacacauacacaggcauacaugcaugcaca

SEQ ID NO: 348399 - RNA, 64 nt, hsa
ugcaugcacacacacaugcacgcacacacacaugcacacauacacgugcacacauacacaggca

SEQ ID NO: 348400 - RNA, 64 nt, hsa
caugcacgcacacacacaugcacacauacacgugcacacauacacaggcacacaugcaugcaca

SEQ ID NO: 348401 - RNA, 64 nt, hsa
uacacgugcacacauacacaggcacacaugcaugcacacauacacaugcacacacacaugcaca

SEQ ID NO: 348402 - RNA, 64 nt, hsa
caugcaugcacacauacacaugcacacacacaugcacacauauaugcacaggcacacacaugua

SEQ ID NO: 348403 - RNA, 64 nt, hsa
aggcacacacauguacgcacacacacaugcacugcacacauauccaugcacacaaacacauaua

SEQ ID NO: 348404 - RNA, 64 nt, hsa
agcuuaagcauuuuuucauauucugaagucucaccacacauaauaaccaagugguagacucaca

SEQ ID NO: 348405 - RNA, 64 nt, hsa
uaucuuuugugccuagauugcaaaaucuccaauccacacauauuguuuuaaaauaagaauguua

SEQ ID NO: 348406 - RNA, 64 nt, hsa
uguguguguguguguguguauauauacacacacacacacauacuuaaaucuugcccugcaugaa

SEQ ID NO: 348407 - RNA, 64 nt, hsa
auauauauauauaauacacacacacacacacaugcacacauaccgcacuucauagaaucaaagu

SEQ ID NO: 348408 - RNA, 64 nt, hsa
cagcuggggagguagcugagaacuuggcacugcgcacacauacuagguugaaagagaguugagg

SEQ ID NO: 348409 - RNA, 64 nt, hsa
uaugugaucgcacccggacuguucauauguuaagcacacauacuuuagaugugugcucccuguu

SEQ ID NO: 348410 - RNA, 64 nt, hsa
uacaugcaugcacacauacauacauauguauacacacacauaauuugaaaacugauuggcacuu

SEQ ID NO: 348411 - RNA, 64 nt, hsa
gaaaaaauacacauaauacaaacauacaugcaugcacacauacauacauauguauacacacaca

SEQ ID NO: 348412 - RNA, 64 nt, hsa
gaaauuaagacguuucuuugcaaaacaaggaaaucacacauaugcacacauacauauuuauggu

SEQ ID NO: 348413 - RNA, 64 nt, hsa
cguuucuuugcaaaacaaggaaaucacacauaugcacacauacauauuuaugguuacuaugauu

SEQ ID NO: 348414 - RNA, 64 nt, hsa
ggugauauccagcauguuugaauuuggugaguaacacacauauagugggagucguuuuuuuuaa

SEQ ID NO: 348415 - RNA, 64 nt, hsa
aaaaucuuacagaaccuuuaaacacgugugcauacacacauacccuauaccccacuauauaaaa

SEQ ID NO: 348416 - RNA, 64 nt, hsa
cacacacauacacaccccugaacacacacacagacacacauacacccaugaugugagcaaacac

SEQ ID NO: 348417 - RNA, 64 nt, hsa
cacacccugaaaacacacacagacacacaacacacacacauacacaccccugaacacacacaca

SEQ ID NO: 348418 - RNA, 64 nt, hsa
cuaggauuacaggcgugagacagacacacauacacacacauacacacacacagagucuuuauug

SEQ ID NO: 348419 - RNA, 64 nt, hsa
agaaugagugcuaggauuacaggcgugagacagacacacauacacacacauacacacacacaga

SEQ ID NO: 348420 - RNA, 64 nt, hsa
cucagcccuccacacacacucacccccacucccacacacauacacacacacacacacauacccc

SEQ ID NO: 348421 - RNA, 64 nt, hsa
cucacccccacucccacacacauacacacacacacacacauaccccaucucccgagggcugacc

SEQ ID NO: 348422 - RNA, 64 nt, hsa
uauacacacacacacacacacacacacacacacacacacauauauauauauauauauuuuuuuu

SEQ ID NO: 348423 - RNA, 64 nt, hsa
uauauauauauauacacacacacacacacacacacacacauauauacauauacacacacacaca

SEQ ID NO: 348424 - RNA, 64 nt, hsa
uguguguguguguauauguguuuauagagauacacacacauauauauguguguauauauauaca

SEQ ID NO: 348425 - RNA, 64 nt, hsa
uacauauauauacacacacgcauuugcacagacacacacauauaucaauucucaugaguguauu

SEQ ID NO: 348426 - RNA, 64 nt, hsa
ucaaaauuuuuacagguuugcucaucugccagagcacacauauaaauuugguauuucuuaacau

SEQ ID NO: 348427 - RNA, 64 nt, hsa
gaggugaagauagagacauagagaggcugugaaacacacauacagcccuguuaggucuuuugaa

SEQ ID NO: 348428 - RNA, 64 nt, hsa
caguugccuagaaaggaucaaauggaacauuugacacacauacucaaaaaaauguaacugacua

SEQ ID NO: 348429 - RNA, 64 nt, hsa
auuaauaucuaacauaaaauuguuaauuuauacacacacauacacucauacauagagagagauu

SEQ ID NO: 348430 - RNA, 64 nt, hsa
auauaugaauuuguguaacacacacagagacacacacacauacuacuuuaagggggugaggauc

SEQ ID NO: 348431 - RNA, 64 nt, hsa
cuuugaauuuuacuuacauuuacacacacacgcacacacauauguauauacacauaucauuuua

SEQ ID NO: 348432 - RNA, 64 nt, hsa
uauagauauagauauacacacauauauauacucacacacauauagcauaaaauacucagcaggg

SEQ ID NO: 348433 - RNA, 64 nt, hsa
uggauauagaucuacaucuauagauauagauauacacacauauauauacucacacacauauagc

SEQ ID NO: 348434 - RNA, 64 nt, hsa
agcucaaagugacagaauauguuauagguugaagcacacauauuugcaguuuacugaaaaguag

SEQ ID NO: 348435 - RNA, 64 nt, hsa
gucucccuccucaacacacacacacacacauacacacacauauacauagacacacaaacacaca

SEQ ID NO: 348436 - RNA, 64 nt, hsa
ccuccacacugucucccuccucaacacacacacacacacauacacacacauauacauagacaca

SEQ ID NO: 348437 - RNA, 64 nt, hsa; identical to SEQ ID NO: 211145

SEQ ID NO: 348438 - RNA, 64 nt, hsa; identical to SEQ ID NO: 211146

SEQ ID NO: 348439 - RNA, 64 nt, hsa; identical to SEQ ID NO: 211147

SEQ ID NO: 348440 - RNA, 64 nt, hsa; identical to SEQ ID NO: 211148

SEQ ID NO: 348441 - RNA, 64 nt, hsa; identical to SEQ ID NO: 211149

SEQ ID NO: 348442 - RNA, 64 nt, hsa; identical to SEQ ID NO: 211150

SEQ ID NO: 348443 - RNA, 64 nt, hsa; identical to SEQ ID NO: 211151

SEQ ID NO: 348444 - RNA, 64 nt, hsa; identical to SEQ ID NO: 211152

SEQ ID NO: 348445 - RNA, 64 nt, hsa
ggccgcuuuuuuaggccuaguugaaagucaagaaggacagcagcaagcauaggcucaggauuaa

SEQ ID NO: 348446 - RNA, 64 nt, hsa
gccugguggggcuacugcagugugcugccaaaugggacagcacacagccugugcacaugggaca

SEQ ID NO: 348447 - RNA, 64 nt, hsa
aggcccccacauacccugcaguuuucucuguccaggacagcagguaaaaaggaauccccagagc

SEQ ID NO: 348448 - RNA, 64 nt, hsa
ccuguagggaguuuuccaggcagguccuuugccaggacagcaugguccugcccuguugucccgu

SEQ ID NO: 348449 - RNA, 64 nt, hsa
acagcugcgcacacagcugcuugcucaggggccgggacagcacugggugcucaggcuggccaag

SEQ ID NO: 348450 - RNA, 64 nt, hsa
caaggaucaagccgacuaccugugcugucuacugggacagcagucuccgagcuacuccguaccu

SEQ ID NO: 348451 - RNA, 64 nt, hsa
gguacuggcaguuuugggaguggcagcccaggauggacagcaguggggagggaaccauuuggca

SEQ ID NO: 348452 - RNA, 64 nt, hsa
gggguagcugcuaucuuugagacagaaagaugcaggacagcauuucauauguaaccauuugaau

SEQ ID NO: 348453 - RNA, 64 nt, hsa
uacauaguucacccuaauuuauacuuacucaucuggacagcaucuccucagauggugaauuaug

SEQ ID NO: 348454 - RNA, 64 nt, hsa
uaguucauuggaugaggcugggugacauuucccaggacagcauggugaacauuaccaggcaugc

SEQ ID NO: 348455 - RNA, 64 nt, hsa
caugccagauucugccucucuggaaagaggcucuggacagcagaagccuccaagcacagagccu

SEQ ID NO: 348456 - RNA, 64 nt, hsa
cuauuuuugacuguagccacagcugcuguucucaggacagcaucccuucccacaugccugcgcc

SEQ ID NO: 348457 - RNA, 64 nt, hsa
ccaaggaaacuguuaacuuauucauaguccuauuggacagcaggagcagcuccuacagugaacu

SEQ ID NO: 348458 - RNA, 64 nt, hsa
cccagacccuuauuccagaugcugagagugaccaggacagcagcuccugaggcccaguggucuu

SEQ ID NO: 348459 - RNA, 64 nt, hsa
cucgcagcagccucgggacaaaacaaugacucaaggacagcacuucucgcagaaggucuggaag

SEQ ID NO: 348460 - RNA, 64 nt, hsa
gcagcagcuggacaggggcuacuggguuuggccuggacagcacugauuuguggauguggauggg

SEQ ID NO: 348461 - RNA, 64 nt, hsa
gguggcauggacagggagucguccgcccuuuccgggacagcaaaucccaucucaguccagcaag

SEQ ID NO: 348462 - RNA, 64 nt, hsa
gagaggaggaccuugugccugcccagagccugcaggacagcacgccuugaggucagaggccugg

SEQ ID NO: 348463 - RNA, 64 nt, hsa
acaguugauauauuuguaacugguacaagaugaaggacagcagcuuuccaucccuaguucagag

SEQ ID NO: 348464 - RNA, 64 nt, hsa
caugagguccgccuccugggcgagacccagcaguggacagcaugguccucacacccagcucccu

SEQ ID NO: 348465 - RNA, 64 nt, hsa
ugcacuguugaaaacugcugcuugugaauguuaaggacagcagguagaggaaucaaagccagca

SEQ ID NO: 348466 - RNA, 64 nt, hsa
agaucaacacguacuggggccugcuggacagcgaggacagcaggcuuuccuguagcccauguuc

SEQ ID NO: 348467 - RNA, 64 nt, hsa
uauguuauuaucccaaugaaagaucaugcauuggggacagcagaaacaaaagcuuuuuuggaaa

SEQ ID NO: 348468 - RNA, 64 nt, hsa
gcaugcacuucauacuagcaaucacagcacaggaggacagcauuaaauuuuauauagccaauuu

SEQ ID NO: 348469 - RNA, 64 nt, hsa
ucuuuuugcuuacaguuuuaaauucugaacaauucucucuuauauguguauugcuaaucauuaa

SEQ ID NO: 348470 - RNA, 64 nt, hsa
acauguuuaguauuaugucuuauuggugcauuuacucucuuaucauuauguaauguccuucuuu

SEQ ID NO: 348471 - RNA, 64 nt, hsa
ucccugcgggccaggcacugcccuuuucaggaagcucucuuaaaauacccauugccccagaccu

SEQ ID NO: 348472 - RNA, 64 nt, hsa
ggguggaaggaugggauggguuccagagguauuccucucuuaaaugcaagugccuagauuaggu

SEQ ID NO: 348473 - RNA, 64 nt, hsa
agucgguacagaacaguuccuucacucccaauagcucucuuaugcugucccuuuguagucagcu

SEQ ID NO: 348474 - RNA, 64 nt, hsa
aagucucaguaguaucccuagagaaauaguguuccucucuuauauauucuugauucuagugaca

SEQ ID NO: 348475 - RNA, 64 nt, hsa
uucucuuucucucuccuaucucucugucuuuuuucucucuuagaauuggaggauuugccauugu

SEQ ID NO: 348476 - RNA, 64 nt, hsa
guuucuugacccuuuuguauaaagcuacaauauucucucuuauuguucuuucauauggaaugua

SEQ ID NO: 348477 - RNA, 64 nt, hsa
guuuaacuaaucucauuuaacuccaaaaucaucucucucuuaggacugcugacuugguuaugca

SEQ ID NO: 348478 - RNA, 64 nt, hsa
auuuaauagguaaucaaggcaauucaguaucucccucucuuaaagucuguuuuuagacuucaug

SEQ ID NO: 348479 - RNA, 64 nt, hsa
uaaaugaacaaagcaaaggauacagagguauguucucucuuagaagcuaacuucccugagacug

SEQ ID NO: 348480 - RNA, 64 nt, hsa
gagaugaaagauguauaauguagagaacugacuucucucuuaaaaaguacagagagccugugcu

SEQ ID NO: 348481 - RNA, 64 nt, hsa; identical to SEQ ID NO: 311206

SEQ ID NO: 348482 - RNA, 64 nt, hsa; identical to SEQ ID NO: 311207

SEQ ID NO: 348483 - RNA, 64 nt, hsa; identical to SEQ ID NO: 311208

SEQ ID NO: 348484 - RNA, 64 nt, hsa; identical to SEQ ID NO: 311209

SEQ ID NO: 348485 - RNA, 64 nt, hsa; identical to SEQ ID NO: 311210

SEQ ID NO: 348486 - RNA, 64 nt, hsa; identical to SEQ ID NO: 311211

SEQ ID NO: 348487 - RNA, 64 nt, hsa; identical to SEQ ID NO: 311212

SEQ ID NO: 348488 - RNA, 64 nt, hsa; identical to SEQ ID NO: 311213

SEQ ID NO: 348489 - RNA, 64 nt, hsa; identical to SEQ ID NO: 311214

SEQ ID NO: 348490 - RNA, 64 nt, hsa; identical to SEQ ID NO: 311215

SEQ ID NO: 348491 - RNA, 64 nt, hsa; identical to SEQ ID NO: 311216

SEQ ID NO: 348492 - RNA, 64 nt, hsa; identical to SEQ ID NO: 311217

SEQ ID NO: 348493 - RNA, 64 nt, hsa
cauuuaccuuguauagaggauuguucauuccuuugggacuaaguuauaguuauggugagugugu

SEQ ID NO: 348494 - RNA, 64 nt, hsa
uucaggcuccacgcacagaaucucgcagauaguugggacuaagcgggcucuaucgcucagggcg

SEQ ID NO: 348495 - RNA, 64 nt, hsa
auuaagaauacuuaaaaugccugggauaguucuugggacuaacaacaugaucuucuuugaguua

SEQ ID NO: 348496 - RNA, 64 nt, hsa
augagggugcucuugugacuuaauuuuuguucaagggacuaaauugcuuauguuuauucccugu

SEQ ID NO: 348497 - RNA, 64 nt, hsa
gcuuuacaaguauuagugcaugcucagaacaggugggacuaaaacaaacucaaggaacuguugg

SEQ ID NO: 348498 - RNA, 64 nt, hsa
cuuuggucucuugcuugugggacuagccuggcuugggacuaaaugcccugcucugaacacgaag

SEQ ID NO: 348499 - RNA, 64 nt, hsa
acacacacacacacacacacacacacucuuuuaggggacuaagagagagaagcauguuauuaca

SEQ ID NO: 348500 - RNA, 64 nt, hsa
caagcccugugguuugaaggugagcugugaggaugggacuaauugauaugcaccaguuuacaaa

SEQ ID NO: 348501 - RNA, 64 nt, hsa
guuuuaagucuucauggauguucugcaugucauggggacuaaaacucacccaacagaucuuucc

SEQ ID NO: 348502 - RNA, 64 nt, hsa
cuguuuguuauaagauuggaaacaauuuuugagagggacuaauuuaaacaaguccuccuuuagu

SEQ ID NO: 348503 - RNA, 64 nt, hsa
aauuagcuuccaggcagccuguuuuuaaagaaaugggacuaaugggagaagcuguuugucacuc

SEQ ID NO: 348504 - RNA, 64 nt, hsa
auacaaaagacaugauagagaaaagaugagagaggggacuaauuauuuuguuuaugaaaauggc

SEQ ID NO: 348505 - RNA, 64 nt, hsa
caaaacuccuuuauucaaaaucacugcuaucuuugggacuaaacacaggcuacuuucuguuuac

SEQ ID NO: 348506 - RNA, 64 nt, hsa
gauguguggguacuugguggggacggaggagcuagggacuaacuguugcucuuggugggcuugg

SEQ ID NO: 348507 - RNA, 64 nt, hsa
guguguuuuggggcauuuguggaacuuacccauggggacuaauauggaaaaggucuguccauag

SEQ ID NO: 348508 - RNA, 64 nt, hsa
gacuaggucccaggauccccuugucccuggaguagggacuaacuauagcacaaaguaauaugug

SEQ ID NO: 348509 - RNA, 64 nt, hsa
cauuacccuuguuuuucucuuuggauacuguccugggacuaaguguagauuucugcuucaagca

SEQ ID NO: 348510 - RNA, 64 nt, hsa
agaugaaugagcaaaaccaaauauuccagagacugggacuaaguguaccagagaagggcuugga

SEQ ID NO: 348511 - RNA, 64 nt, hsa
cagcgacccugugacaccggucugcagggaguuggggacuaagggcuuccagagaguggcugga

SEQ ID NO: 348512 - RNA, 64 nt, hsa
uggccuuguugcuggcaucccggccaggugggcggggacuaacaaagacagcuguuuagggucu

SEQ ID NO: 348513 - RNA, 64 nt, hsa
ucuuuggaaaagguuguauacuucuugaccgugugggacuaaugaaugcuucauaguggaaaua

SEQ ID NO: 348514 - RNA, 64 nt, hsa
auaaaugaggaggacagcaggccccaagaaaguagggacuaaguaugucuuguucaaaauugua

SEQ ID NO: 348515 - RNA, 64 nt, hsa
gcuuuuuuguaaguugaucguaucugaugucugugggacuaacuguaucacuuaauuuuuaccu

SEQ ID NO: 348516 - RNA, 64 nt, hsa
uacuugauuuuaaccaaugagacuacaggcagaugggacuaaguguuuaugggacaauuaugua

SEQ ID NO: 348517 - RNA, 64 nt, hsa
gaaccuucggaucuaugaaagaaaauauaguagggggacuaaggaacauagaauuuuauuagca

SEQ ID NO: 348518 - RNA, 64 nt, hsa
caaauugcagaaaaggcucaauauccaagagacagggacuaaugcacuguacaaucugcuuauc

SEQ ID NO: 348519 - RNA, 64 nt, hsa
caauacggugauauccuuauuugcuagcagaaaagggacuaacgucccauuccucuuuucugcu

SEQ ID NO: 348520 - RNA, 64 nt, hsa
gaaacagccaccgagaagguucuagcucuagaaagggacuaaacuuauucucucauccgaaguc

SEQ ID NO: 348521 - RNA, 64 nt, hsa
uuugaacaauaauauacugguuugcuuuaaagaagggacuaaauaugacuuuaaagagacuuca

SEQ ID NO: 348522 - RNA, 64 nt, hsa
cccaauggugugagucugacuuuggaaagaaaaagggacuaaagagaaauguaacaaacuuaca

SEQ ID NO: 348523 - RNA, 64 nt, hsa
uuaugugacacugauacacacacaccccuuauaugggacuaauuuuacacuuuucuguguuaug

SEQ ID NO: 348524 - RNA, 64 nt, hsa
aaagaagacacuauuuuagcuaaugggguuucuugggacuaaaaaauggcuuuguuuaaauuau

SEQ ID NO: 348525 - RNA, 64 nt, hsa
gaaaccaagggggcugcugaggagaccuggugcagggacuaauccuggaucauuccuguauuaa

SEQ ID NO: 348526 - RNA, 64 nt, hsa
gaaaguucuuuguuuggggaaguaaaauccuuaagggacuaaauuaaugcuugggugcauuaaa

SEQ ID NO: 348527 - RNA, 64 nt, hsa
ucuacugcuuacacuuuagaauguuuauuuuauggggacuaagggauuaggagugugaacuaaa

SEQ ID NO: 348528 - RNA, 64 nt, hsa
guuguacagaaauguguucaucaaaucuggucaagggacuaagcuccuagcugaccauucauuc

SEQ ID NO: 348529 - RNA, 64 nt, hsa
cuggucccuccaacaugcauggacaggggacagugggacuaacuucaguacccuuggccugcac

SEQ ID NO: 348530 - RNA, 64 nt, hsa
ugugaacaucccucagccccugcuguccccccuugggacuaaccacuaaccucacccccaaacu

SEQ ID NO: 348531 - RNA, 64 nt, hsa
aagccagauuuauaguauuccaucuuuaauaugugggacuaacagcaguguagauuguuaccuu

SEQ ID NO: 348532 - RNA, 64 nt, hsa
uagucccuggaggagggaguccggccccaggccagggacuaaggagcaaugaccauugugcaca

SEQ ID NO: 348533 - RNA, 64 nt, hsa
uauaucacuauguauuuuaugaacagaauugacugggacuaauaucacaggaucaaucaucuca

SEQ ID NO: 348534 - RNA, 64 nt, hsa
aagcaauucucuugccucagccucccgaguagcugggacuaaaggcgugugccaccaugcccag

SEQ ID NO: 348535 - RNA, 64 nt, hsa
acccacgaucuucuuugggcuuccauuuccaccagggacuaaaaucugcuguagcuagugagag

SEQ ID NO: 348536 - RNA, 64 nt, hsa
acccaucucccuagucucagccuuacaacaccacgggacuaaggaagagcacuuccuugccucc

SEQ ID NO: 348537 - RNA, 64 nt, hsa
ggaaagcaaagaagcugcuuuaaaaaauaaaaaggggacuaaaaauuuguuuuguauaaagagg

SEQ ID NO: 348538 - RNA, 64 nt, hsa
uugccaacuaggcaggcacaaaucuugggucuuggggacuaacccaaugccugugaagcaguca

SEQ ID NO: 348539 - RNA, 64 nt, hsa
aagcguuucucccaccuuagccuccugaguagcugggacuaaggcacacacacuguacuuggca

SEQ ID NO: 348540 - RNA, 64 nt, hsa
ggcuuuauuuuaauagugaucuugauccuguugugggacuaauacaagaucuauauuuaaguuu

SEQ ID NO: 348541 - RNA, 64 nt, hsa
agguuguacagacuuauuuauaucaucguuuugagggacuaauggaggcuuauuguaacauaua

SEQ ID NO: 348542 - RNA, 64 nt, hsa
cacucuugaagagcagacucccucuguggcugaugggacuaauuauucccacuagccagcggac

SEQ ID NO: 348543 - RNA, 64 nt, hsa
agaguuuuucaggagagaaaacugccugaccuuugggacuaagcugcggaaucuucuuacuaag

SEQ ID NO: 348544 - RNA, 64 nt, hsa
gguggacuaggcccuacacacagaccgcgccccugggacuaaagccaggaacagggaccagcuc

SEQ ID NO: 348545 - RNA, 64 nt, hsa
uuguacuugcacauuggagacugaaaggaaagaagggacuaaaugcuggggagguaaauuaaga

SEQ ID NO: 348546 - RNA, 64 nt, hsa
gaggaguacccccagcccaagagaugaacaucuggggacuaauaucauagacccaucuggaggc

SEQ ID NO: 348547 - RNA, 64 nt, hsa
aagcacaaagcaucuuccuuaaagcacaaagagagggacuaacugaugcugcaucuagaaaaca

SEQ ID NO: 348548 - RNA, 55 nt, hsa
ugcuggugcaggcccugugagggcugggacuaagucacagggaucugcugcagcc

SEQ ID NO: 348549 - RNA, 64 nt, hsa
uauaagugagagaaaugaaguuuauauuaucaaggggacuaaagucacacggcuugugggcacu

SEQ ID NO: 348550 - RNA, 64 nt, hsa
gcauucaggaggguaacacucaggauucauacaugggacuaaagguucaagaauaaaacaaagc

SEQ ID NO: 348551 - RNA, 64 nt, hsa
gccucccucgaaucaagugcuacauccaauaauagggacuaaacccacaucuguagcuucugag

SEQ ID NO: 348552 - RNA, 64 nt, hsa
gaagcccagggagguugagcagugagagagggaagggacuaacgugcuccggaaggguggaggu

SEQ ID NO: 348553 - RNA, 64 nt, hsa
ccgcuccuguagaagguagggagcacaauaccuagggacuaagggauguucgccgguugugguu

SEQ ID NO: 348554 - RNA, 64 nt, hsa
auuaccaagugccggacuagcaagugcuggagucgggacuaacccaggucccuugucccaaguu

SEQ ID NO: 348555 - RNA, 64 nt, hsa
cccauccaucuucccuacccuuccugccaagccagggacuaagcagcccagaagcccaguaacu

SEQ ID NO: 348556 - RNA, 64 nt, hsa
caguauagagacuugguuggcaucuucugcugcagggacuaaaaguauuugacuggggcacaug

SEQ ID NO: 348557 - RNA, 64 nt, hsa
ucucuuuuucuagagaggaguugcuuaaaccaaugggacuaaaaccugaugggacaauaacgcc

SEQ ID NO: 348558 - RNA, 64 nt, hsa
ugagaggaagggugggucuguaagaccuugguaggggacuaauucacuggcgaggugcggccac

SEQ ID NO: 348559 - RNA, 64 nt, hsa
ucagcagcuugcccagcucuugaguacagugguggggacuaaaaaugugggcauguggagaggg

SEQ ID NO: 348560 - RNA, 64 nt, hsa
ggguggaggugauauggcauucugaaaguagggagggacuaagucagucaucauacuaaacaaa

SEQ ID NO: 348561 - RNA, 64 nt, hsa
cuuaagucucagacugauuucuugcgggaggagggggacuaaacucaaccuaacacauuaaaug

SEQ ID NO: 348562 - RNA, 64 nt, hsa
gcuauuggucuguccuuuugacauacagcuaaaagggacuaaauuuguaaaaaauuaguuuguu

SEQ ID NO: 348563 - RNA, 64 nt, hsa
cagggaacuuccaaggaaggagccugagccacuggggacuaagugggcagaagaaacccuuggc

SEQ ID NO: 348564 - RNA, 64 nt, hsa
gauuacauuuugaaaaggaaaucuagcaugugaggggacuaaguguucucagagugauguuuua

SEQ ID NO: 348565 - RNA, 64 nt, hsa
gcagcuacaccaguaauggcacucuuccuaggacgggacuaaagaggacgccguccuuaaaacc

SEQ ID NO: 348566 - RNA, 64 nt, hsa
ccucaaucacagaaaguaaagccguggauacggugggacuaauguauugguagcagccuagagg

SEQ ID NO: 348567 - RNA, 64 nt, hsa
auuacugaaagcuaaauccucaaaaccuaguaaggggacuaaugauucauuaaaguaaauugau

SEQ ID NO: 348568 - RNA, 64 nt, hsa
acauucuaaucuuaaaggaauaaagcacugaauugggacuaacauucugauagguugcacccuu

SEQ ID NO: 348569 - RNA, 64 nt, hsa
uuuccuacagggagaugccuuggauccagguucagggacuaaauacacuuggcagcugaagaug

SEQ ID NO: 348570 - RNA, 64 nt, hsa
cuuggauaggguaggcugagggggcccuaagggagggacuaaggcuccaaggcaggucacuuuu

SEQ ID NO: 348571 - RNA, 64 nt, hsa
uucuucggaggagguggacauuucggaagugguggggacuaagggaagaacucucuaguucccu

SEQ ID NO: 348572 - RNA, 64 nt, hsa
caacaaauuucugcucaacugacucaucuuuugggggacuaauuuaauuugcugcugacagcca

SEQ ID NO: 348573 - RNA, 64 nt, hsa
caacaaccuucagcucaacugacuugucuuuugagggacuaauuuacuuugcugcugacagcca

SEQ ID NO: 348574 - RNA, 64 nt, hsa
caacaacuuucugcucaacugacuuaucuuuugggggacuaauuuaauuugcugcugacagcca

SEQ ID NO: 348575 - RNA, 64 nt, hsa
uuuugcauuaaugaaguuugacuauauguguaaagggacuaaauauuuuugcaacagccuguuc

SEQ ID NO: 348576 - RNA, 64 nt, hsa
gugugagucagugugcagcauuugaaaaccccaagggacuaauucaugguuguuccaaagauaa

SEQ ID NO: 348577 - RNA, 64 nt, hsa
auuuugcucccuuccccccauuuuuguuuuaauagggacuaaugugggaagaacuggcuaauuu

SEQ ID NO: 348578 - RNA, 64 nt, hsa
gguuaagcauuugguauuguuucauuuacaauuugggacuaagauggaaacacuuuuuuuauaa

SEQ ID NO: 348579 - RNA, 64 nt, hsa
gguauuucuuccuccucaaugcccaagguaaugugggacuaaagcccagaaauuugaaaagaau

SEQ ID NO: 348580 - RNA, 64 nt, hsa
uuuauuaugguauaguuaggacuugauuguagaagggacuaaauguuccaacauaaucuuuacc

SEQ ID NO: 348581 - RNA, 64 nt, hsa
uuauucuucucauguuaaacccaccaaaauaaaggggacuaaauagguaaugauuuuccuagug

SEQ ID NO: 348582 - RNA, 64 nt, hsa
accaagaucaagcagagaaaauaauuaauuucaugggacuaaaugaacuaaugaggauaauauu

SEQ ID NO: 348583 - RNA, 64 nt, hsa
gauggcugggaaauggagaucacugaaguacacagggacuaaccaaggagaugagggggucgac

SEQ ID NO: 348584 - RNA, 64 nt, hsa
uucugguugcucugaggguucggagcuucccucugggacuaaaggaguguccuuuacccuccca

SEQ ID NO: 348585 - RNA, 64 nt, hsa
cccuucaucccuggcugccggucccauccuuggagggacuaagcugggggugggggacaugagu

SEQ ID NO: 348586 - RNA, 64 nt, hsa
gccuuccucagucucgagccucagucucccgucugggacuaaaacgugaacucuguaauucuau

SEQ ID NO: 348587 - RNA, 64 nt, hsa
ugcugcccauucuccauuucugugugugucaaaggggacuaacagcagaaucuaccucccaacu

SEQ ID NO: 348588 - RNA, 64 nt, hsa
caauggggaguaucauuguuuuuguacaaaaaccgggacuaaaagaaaagacagcacugcaaau

SEQ ID NO: 348589 - RNA, 64 nt, hsa
agacuggccccgucugaaccuucucugggcacuggggacuaagguugcaggccuuagccucguc

SEQ ID NO: 348590 - RNA, 64 nt, hsa
ggcaugugccuucugccaccugacuuuccgugaggggacuaaaauuuacuaauuguaguugcug

SEQ ID NO: 348591 - RNA, 64 nt, hsa
caauuuucauagaccuaauuugcaaacucaaucggggacuaaaauuucccacugaaaauguuaa

SEQ ID NO: 348592 - RNA, 64 nt, hsa
auuugcuucuaaaaauuaguuucagugagucccagggacuaauuaagguuuauuuuaaaaagug

SEQ ID NO: 348593 - RNA, 64 nt, hsa
aagcgacccuccugccucagccccccaaguagcugggacuaaagucaugugccaccacacccag

SEQ ID NO: 348594 - RNA, 64 nt, hsa
cucccucugcccucugcuccguucccugggggcugggacuaaagaaaugggugucccccacccc

SEQ ID NO: 348595 - RNA, 64 nt, hsa
ggggugacucccuggccuaguauagugugacccugggacuaacuuaauguccuaaagcauuuug

SEQ ID NO: 348596 - RNA, 64 nt, hsa
uuuuuuuuuuuuuuuuuuugguuaugaaaacuuagggacuaaaauuaauauaaaaauuggcaua

SEQ ID NO: 348597 - RNA, 64 nt, hsa
uggugaugcgugucguaggugugcagcuauuugagggacuaagggauggagauauucugucaaa

SEQ ID NO: 348598 - RNA, 64 nt, hsa
gucuuuucacgcagaaagugccauauagacgagauaaaggcagcuaaaacgagggcaguagaga

SEQ ID NO: 348599 - RNA, 64 nt, hsa
cuuuuaacagcaaccaauaacggauuguaaaguguaaaggcacagguuacucaugaugcuucug

SEQ ID NO: 348600 - RNA, 64 nt, hsa
cuuuuuauggaugagcauaaaccuagucuuaguuuaaaggcaaacuaaaguugaggggaaauaa

SEQ ID NO: 348601 - RNA, 64 nt, hsa
ccaguuauucacuuacagaugaaacuaaaacaaauaaaggcaagcuauuaucaguuugguaguu

SEQ ID NO: 348602 - RNA, 64 nt, hsa
ggaaaaucaaguauaaucccugagauuuguagacuaaaggcaaugaugugggacuacuuggucg

SEQ ID NO: 348603 - RNA, 64 nt, hsa
aauguuuacuuuuggacuggguuuguaacacgguuaaaggcaaugagaaacaagcagaauucca

SEQ ID NO: 348604 - RNA, 64 nt, hsa
ucaagacgaagcuuauuucugaggauaagcucuuuaaaggcaaagcuuuauuuucaucucucau

SEQ ID NO: 348605 - RNA, 64 nt, hsa
aucuaagaauguucuagggcacucugggaaccuauaaaggcagguauuucgggcccuccucuuc

SEQ ID NO: 348606 - RNA, 64 nt, hsa
uuaaaaauuauauguuuauaaaguuauuaauuuguaaaggcaguguuacaaaauguucaguuua

SEQ ID NO: 348607 - RNA, 64 nt, hsa
aggaaagcacuaagaaacacucguuuguuguuuuuaaaggcaacagacuuaaaguuguccucag

SEQ ID NO: 348608 - RNA, 64 nt, hsa
uauuuucugcuaaaggagugacugugcauauaaguaaaggcaaccucucaggaagccagaggua

SEQ ID NO: 348609 - RNA, 64 nt, hsa
cugccuaaggguggugaugguggggagugguugauaaaggcacacagaagggccacggaggcuc

SEQ ID NO: 348610 - RNA, 64 nt, hsa
ggucacaucucuggaaaauagauguuacaguucuuaaaggcagugcuuuaaagugaaguucauu

SEQ ID NO: 348611 - RNA, 64 nt, hsa
acauggcuuacagaauuaugaacaguggauagauuaaaggcauuuaauauuuguaauucauaau

SEQ ID NO: 348612 - RNA, 64 nt, hsa
gagguggugcugccccagugggccaugauuaucuuaaaggcauuauucuccagccuuaaguaag

SEQ ID NO: 348613 - RNA, 64 nt, hsa
ugcaugauucuccaagacaaaagaagagagauccuaaaggcaauucagauauccccaaggcugc

SEQ ID NO: 348614 - RNA, 64 nt, hsa
uccucagcgggucuccaguccccugacccagcucuaaaggcacuuaggacccagggaacauuuc

SEQ ID NO: 348615 - RNA, 64 nt, hsa
ggcugagcucagagcucuggccuccugcucagacuaaaggcaccuccucuggccucacccaagc

SEQ ID NO: 348616 - RNA, 64 nt, hsa
ucaaacacagauaaggccugccauccucauugguuaaaggcacacgugagacuuucagugggcu

SEQ ID NO: 348617 - RNA, 64 nt, hsa
aauuggcuagucuggcuuuuuuuuuuuuuuuuuuuaaaggcaaagauugacauuauugaaggaa

SEQ ID NO: 348618 - RNA, 61 nt, hsa
uaaaaaugaauaagcuaucaauauauaauuuaaguacaaguuuaggcugggcgugguggcu

SEQ ID NO: 348619 - RNA, 61 nt, hsa
ccaucucaaaaaaagaaagaaagaaaaaagaaaguacaaguuuauaaaguauuauagugaa

SEQ ID NO: 348620 - RNA, 61 nt, hsa
uuuucuuccucuuuaccucuuaaaacagcagaaguacaagaauacagcuguagggucauug

SEQ ID NO: 348621 - RNA, 61 nt, hsa
aauuguuuuaaaucuauuuuguaaagauauaaaguacaauagaauuucuggaguacagauu

SEQ ID NO: 348622 - RNA, 61 nt, hsa
gaaacauucauuauuuuauuaauauugcccuaaguacaacuaggcaagugauugccaccua

SEQ ID NO: 348623 - RNA, 61 nt, hsa
gaggaaaccagcagauaguaaaccugguucaaaguacaauucaagaaacugaguauuuaug

SEQ ID NO: 348624 - RNA, 61 nt, hsa
gaccaacauggugaaacccugucucuacuaaaaguacaaaaauuagccaggcgugguggcg

SEQ ID NO: 348625 - RNA, 61 nt, hsa
uugcuggaucugaaccaguguucuuuuguguaaguacaaccauauuucagucaguccagag

SEQ ID NO: 348626 - RNA, 61 nt, hsa
uuauuuaaauguuaacuguuguauugugacuaaguacaacuuuuggaaugauaccugaaga

SEQ ID NO: 348627 - RNA, 61 nt, hsa
aucccaucauuuggaaaaauaaaggcaucugaaguacaauauuacuuauagaaauaguuua

SEQ ID NO: 348628 - RNA, 61 nt, hsa
aacuucuucccauagaauuagaaacaugugaaaguacaauaaacuucuuguucaaauuacc

SEQ ID NO: 348629 - RNA, 61 nt, hsa
aaauugaaaauuuaaauaacaugguggcaugaaguacaauucgaguauuaggcaauuugca

SEQ ID NO: 348630 - RNA, 61 nt, hsa
uuaauucagccaaacauaaauaaccuuccuuaaguacaauuuaacuucaagaaaacaaaau

SEQ ID NO: 348631 - RNA, 61 nt, hsa
auagaugaguauuuccaggacaacguucuaaaaguacaauuauuucuuauuggggagauua

SEQ ID NO: 348632 - RNA, 61 nt, hsa
gggagauuacagguaguuuggcaaagcauugaaguacaaagguacauuuucaauuaaaaag

SEQ ID NO: 348633 - RNA, 64 nt, hsa; identical to SEQ ID NO: 313493

SEQ ID NO: 348634 - RNA, 64 nt, hsa; identical to SEQ ID NO: 313494

SEQ ID NO: 348635 - RNA, 64 nt, hsa; identical to SEQ ID NO: 313495

SEQ ID NO: 348636 - RNA, 64 nt, hsa; identical to SEQ ID NO: 313496

SEQ ID NO: 348637 - RNA, 64 nt, hsa; identical to SEQ ID NO: 313497

SEQ ID NO: 348638 - RNA, 64 nt, hsa; identical to SEQ ID NO: 313498

SEQ ID NO: 348639 - RNA, 64 nt, hsa; identical to SEQ ID NO: 313499

SEQ ID NO: 348640 - RNA, 64 nt, hsa; identical to SEQ ID NO: 313500

SEQ ID NO: 348641 - RNA, 64 nt, hsa; identical to SEQ ID NO: 182371

SEQ ID NO: 348642 - RNA, 64 nt, hsa; identical to SEQ ID NO: 182372

SEQ ID NO: 348643 - RNA, 64 nt, hsa; identical to SEQ ID NO: 182373

SEQ ID NO: 348644 - RNA, 64 nt, hsa; identical to SEQ ID NO: 182374

SEQ ID NO: 348645 - RNA, 64 nt, hsa; identical to SEQ ID NO: 182375

SEQ ID NO: 348646 - RNA, 64 nt, hsa; identical to SEQ ID NO: 182376

SEQ ID NO: 348647 - RNA, 64 nt, hsa; identical to SEQ ID NO: 182377

SEQ ID NO: 348648 - RNA, 64 nt, hsa; identical to SEQ ID NO: 182378

SEQ ID NO: 348649 - RNA, 64 nt, hsa; identical to SEQ ID NO: 182379

SEQ ID NO: 348650 - RNA, 64 nt, hsa; identical to SEQ ID NO: 182380

SEQ ID NO: 348651 - RNA, 64 nt, hsa; identical to SEQ ID NO: 182381

SEQ ID NO: 348652 - RNA, 64 nt, hsa; identical to SEQ ID NO: 182382

SEQ ID NO: 348653 - RNA, 64 nt, hsa; identical to SEQ ID NO: 182383

SEQ ID NO: 348654 - RNA, 64 nt, hsa; identical to SEQ ID NO: 182384

SEQ ID NO: 348655 - RNA, 64 nt, hsa; identical to SEQ ID NO: 182385

SEQ ID NO: 348656 - RNA, 64 nt, hsa; identical to SEQ ID NO: 182386

SEQ ID NO: 348657 - RNA, 64 nt, hsa; identical to SEQ ID NO: 182387

SEQ ID NO: 348658 - RNA, 64 nt, hsa; identical to SEQ ID NO: 182388

SEQ ID NO: 348659 - RNA, 64 nt, hsa; identical to SEQ ID NO: 182389

SEQ ID NO: 348660 - RNA, 64 nt, hsa; identical to SEQ ID NO: 182390

SEQ ID NO: 348661 - RNA, 64 nt, hsa; identical to SEQ ID NO: 182391

SEQ ID NO: 348662 - RNA, 64 nt, hsa; identical to SEQ ID NO: 182392

SEQ ID NO: 348663 - RNA, 64 nt, hsa; identical to SEQ ID NO: 182393

SEQ ID NO: 348664 - RNA, 64 nt, hsa; identical to SEQ ID NO: 182394

SEQ ID NO: 348665 - RNA, 64 nt, hsa; identical to SEQ ID NO: 182395

SEQ ID NO: 348666 - RNA, 64 nt, hsa; identical to SEQ ID NO: 182396

SEQ ID NO: 348667 - RNA, 64 nt, hsa; identical to SEQ ID NO: 182397

SEQ ID NO: 348668 - RNA, 64 nt, hsa; identical to SEQ ID NO: 182398

SEQ ID NO: 348669 - RNA, 64 nt, hsa; identical to SEQ ID NO: 182399

SEQ ID NO: 348670 - RNA, 64 nt, hsa; identical to SEQ ID NO: 182400

SEQ ID NO: 348671 - RNA, 64 nt, hsa; identical to SEQ ID NO: 182401

SEQ ID NO: 348672 - RNA, 64 nt, hsa; identical to SEQ ID NO: 182402

SEQ ID NO: 348673 - RNA, 64 nt, hsa; identical to SEQ ID NO: 182403

SEQ ID NO: 348674 - RNA, 64 nt, hsa; identical to SEQ ID NO: 182404

SEQ ID NO: 348675 - RNA, 64 nt, hsa; identical to SEQ ID NO: 182405

SEQ ID NO: 348676 - RNA, 64 nt, hsa; identical to SEQ ID NO: 182406

SEQ ID NO: 348677 - RNA, 64 nt, hsa; identical to SEQ ID NO: 182407

SEQ ID NO: 348678 - RNA, 64 nt, hsa; identical to SEQ ID NO: 182408

SEQ ID NO: 348679 - RNA, 64 nt, hsa; identical to SEQ ID NO: 182409

SEQ ID NO: 348680 - RNA, 64 nt, hsa; identical to SEQ ID NO: 182410

SEQ ID NO: 348681 - RNA, 64 nt, hsa; identical to SEQ ID NO: 182411

SEQ ID NO: 348682 - RNA, 64 nt, hsa; identical to SEQ ID NO: 182412

SEQ ID NO: 348683 - RNA, 64 nt, hsa; identical to SEQ ID NO: 182413

SEQ ID NO: 348684 - RNA, 64 nt, hsa; identical to SEQ ID NO: 182414

SEQ ID NO: 348685 - RNA, 64 nt, hsa; identical to SEQ ID NO: 182415

SEQ ID NO: 348686 - RNA, 64 nt, hsa; identical to SEQ ID NO: 182416

SEQ ID NO: 348687 - RNA, 64 nt, hsa; identical to SEQ ID NO: 182417

SEQ ID NO: 348688 - RNA, 64 nt, hsa; identical to SEQ ID NO: 182418

SEQ ID NO: 348689 - RNA, 64 nt, hsa; identical to SEQ ID NO: 182419

SEQ ID NO: 348690 - RNA, 64 nt, hsa; identical to SEQ ID NO: 182420

SEQ ID NO: 348691 - RNA, 64 nt, hsa; identical to SEQ ID NO: 182421

SEQ ID NO: 348692 - RNA, 64 nt, hsa; identical to SEQ ID NO: 182422

SEQ ID NO: 348693 - RNA, 64 nt, hsa; identical to SEQ ID NO: 182423

SEQ ID NO: 348694 - RNA, 64 nt, hsa; identical to SEQ ID NO: 182424

SEQ ID NO: 348695 - RNA, 64 nt, hsa; identical to SEQ ID NO: 182425

SEQ ID NO: 348696 - RNA, 64 nt, hsa; identical to SEQ ID NO: 182426

SEQ ID NO: 348697 - RNA, 64 nt, hsa; identical to SEQ ID NO: 182427

SEQ ID NO: 348698 - RNA, 64 nt, hsa; identical to SEQ ID NO: 182428

SEQ ID NO: 348699 - RNA, 64 nt, hsa; identical to SEQ ID NO: 182429

SEQ ID NO: 348700 - RNA, 64 nt, hsa
cauaggaccuaaccagugaagcuagaggcuacagccacuaaacuugcuucaggccaacgauagu

SEQ ID NO: 348701 - RNA, 64 nt, hsa
uacucacaaguaaguaccuuaaugcuaaugagguccacuaaaaaggggaggaaggcagaccucc

SEQ ID NO: 348702 - RNA, 64 nt, hsa
agauucuaaucugagugaguuacugagcuuugguccacuaaaacaagcugagcuuugguccacu

SEQ ID NO: 348703 - RNA, 64 nt, hsa
agcuuugguccacuaaaacaagcugagcuuugguccacuaaaacaagaugaaaaauacaagagu

SEQ ID NO: 348704 - RNA, 64 nt, hsa
gaauaaacauguuuguuuucagugcucacucaaaccacuaaaacagauggauagcuuugagguu

SEQ ID NO: 348705 - RNA, 64 nt, hsa
gcaaguaagagcuaauucauucauuccaugugugccacuaaauaaagagauugagcaagugcca

SEQ ID NO: 348706 - RNA, 64 nt, hsa
ccauacaauugaugaauuguguacaacuuuuguuaguaccaaaauaaucuguuauaugaacaga

SEQ ID NO: 348707 - RNA, 64 nt, hsa
acguugcuucuuguucuucacaauucaugacuuaaguaccaaaaugcauaccaguuauuauaua

SEQ ID NO: 348708 - RNA, 64 nt, hsa
uguguggcauuuacaugguacccaggcuccacagaguaccaagauguugcccucugggaccaca

SEQ ID NO: 348709 - RNA, 64 nt, hsa
aaacuaaacuuuuuuuugucucccguuauugaaaaguaccaaagcuucuuucuguuguguuuga

SEQ ID NO: 348710 - RNA, 64 nt, hsa
ugccaggcaggcauucuuccuucagggagaggauggugagaauuaauugguucuuugcacuguu

SEQ ID NO: 348711 - RNA, 64 nt, hsa
gugaccagagaugacgccauugcacuccagccugggugagaagagcgaaacuccgucucaaaaa

SEQ ID NO: 348712 - RNA, 64 nt, hsa
uguacaguuaacucucccagguggauuuuguggaggugagaaaaggggcauugagacuauaaag

SEQ ID NO: 348713 - RNA, 64 nt, hsa
ccagcugagugagaggguuugagucaaaagccugggugagaauccugccucuccccaaacauua

SEQ ID NO: 348714 - RNA, 64 nt, hsa
acgggcgaaacaacugaugggggaagauaccuggggugagaagaugagaaagaaaugaugcuga

SEQ ID NO: 348715 - RNA, 64 nt, hsa
ggcaauaggccgagcuuuagaagcagccaggucuggugagaaaugggcccccauaccaacugug

SEQ ID NO: 348716 - RNA, 64 nt, hsa
uccucuuuguggcaacagaucucagauauccuacggugagaagcuuaccauaagcuuggcaccu

SEQ ID NO: 348717 - RNA, 64 nt, hsa
cuguuucuccuacuguucuguaaacuuauuaaugggugagaaucuaauuuuacucaucuugaug

SEQ ID NO: 348718 - RNA, 64 nt, hsa
aguccaagugggguucccuguugccaguuagagaggugagaauguuuggacucuaacucaccga

SEQ ID NO: 348719 - RNA, 64 nt, hsa
caggccucauccaccaggcaauagacaggagagaggugagaacuauuuuuagaaggaggaaaag

SEQ ID NO: 348720 - RNA, 64 nt, hsa
uaaauaaucaaaacuguuuuauagucauugauuuggugagaacaguaauggaaaaugguguuga

SEQ ID NO: 348721 - RNA, 64 nt, hsa
uuuccacuuuaauuucucaguggaaguuaagaggggugagaaaacaaagaaggggaaaaacuga

SEQ ID NO: 348722 - RNA, 64 nt, hsa
aauucaaaaguaauuaauaguguuggaagauguaggugagaaaauauuccugaaaguagaacug

SEQ ID NO: 348723 - RNA, 64 nt, hsa
acaagccaguuagcaaacaguccuggaaaaauauggugagaaugguuuaauuccggucuucaca

SEQ ID NO: 348724 - RNA, 64 nt, hsa
ggucuccaguggauaggagaggaccugccuccugggugagaagggucagauuuuccuauuuuaa

SEQ ID NO: 348725 - RNA, 64 nt, hsa
acucggaagugaaaggacuugucugaaaucacauggugagaaggaggaugaagggaggagagag

SEQ ID NO: 348726 - RNA, 64 nt, hsa
gucaaaccucauucgacaccagagaauucauacgggugagaaacccuaugcauguacaguaugu

SEQ ID NO: 348727 - RNA, 64 nt, hsa
cucauuacuuauuauacauaugagaagucauacuggugagaaacccuuugaauguaaugaaugu

SEQ ID NO: 348728 - RNA, 64 nt, hsa
cucagcuauacuuuuucauaacagaauuuguacaggugagaagccuaaugaaagcccgauaugu

SEQ ID NO: 348729 - RNA, 64 nt, hsa
ggcgcaucuuacucaacaucaaagaauuccuacuggugagaaacccuaugaauguaaugaaugu

SEQ ID NO: 348730 - RNA, 64 nt, hsa
auuguucaacucuuaacaccagagaauucacacuggugagaaacccuuugaaugucaggaaugu

SEQ ID NO: 348731 - RNA, 64 nt, hsa
agcccaucuuagucaacaucaaaauauucauacuggugagaaacccuaugaguuuaaggaaugu

SEQ ID NO: 348732 - RNA, 64 nt, hsa; identical to SEQ ID NO: 22278

SEQ ID NO: 348733 - RNA, 64 nt, hsa; identical to SEQ ID NO: 22279

SEQ ID NO: 348734 - RNA, 64 nt, hsa; identical to SEQ ID NO: 22280

SEQ ID NO: 348735 - RNA, 64 nt, hsa; identical to SEQ ID NO: 22281

SEQ ID NO: 348736 - RNA, 64 nt, hsa; identical to SEQ ID NO: 22282

SEQ ID NO: 348737 - RNA, 64 nt, hsa; identical to SEQ ID NO: 22283

SEQ ID NO: 348738 - RNA, 64 nt, hsa; identical to SEQ ID NO: 22284

SEQ ID NO: 348739 - RNA, 64 nt, hsa; identical to SEQ ID NO: 22285

SEQ ID NO: 348740 - RNA, 64 nt, hsa; identical to SEQ ID NO: 22286

SEQ ID NO: 348741 - RNA, 64 nt, hsa; identical to SEQ ID NO: 22287

SEQ ID NO: 348742 - RNA, 64 nt, hsa; identical to SEQ ID NO: 22288

SEQ ID NO: 348743 - RNA, 64 nt, hsa; identical to SEQ ID NO: 22289

SEQ ID NO: 348744 - RNA, 64 nt, hsa; identical to SEQ ID NO: 22290

SEQ ID NO: 348745 - RNA, 64 nt, hsa; identical to SEQ ID NO: 22291

SEQ ID NO: 348746 - RNA, 64 nt, hsa; identical to SEQ ID NO: 22292

SEQ ID NO: 348747 - RNA, 64 nt, hsa; identical to SEQ ID NO: 22293

SEQ ID NO: 348748 - RNA, 64 nt, hsa
cuuucaugcaagaaggcccaguugccacagauuauacaaccauuacccaaaccacucugacagu

SEQ ID NO: 348749 - RNA, 64 nt, hsa
cuuaauaaagucuucuaggcuguagggugguuccuacaaccacagccaugauugucuugugucu

SEQ ID NO: 348750 - RNA, 64 nt, hsa
cucaggucgcucuaagcacaaacguggcucuuucuacaaccagaugcaaccgagggauuucccu

SEQ ID NO: 348751 - RNA, 64 nt, hsa
cuguaggugugcacugucuauuuacauccguccuuacaaccauccuuguccuccuugguaccgu

SEQ ID NO: 348752 - RNA, 64 nt, hsa
caccuccuuccucagcaggacugacucugggcucuacaaccagcuccuucacauaaaggguuua

SEQ ID NO: 348753 - RNA, 64 nt, hsa
ugaugcaguuggguuccuccugguuuucuuuuguuacaaccacccuugccuguuuacauuaauu

SEQ ID NO: 348754 - RNA, 64 nt, hsa; identical to SEQ ID NO: 346526

SEQ ID NO: 348755 - RNA, 64 nt, hsa; identical to SEQ ID NO: 346527

SEQ ID NO: 348756 - RNA, 64 nt, hsa; identical to SEQ ID NO: 346528

SEQ ID NO: 348757 - RNA, 64 nt, hsa; identical to SEQ ID NO: 346529

SEQ ID NO: 348758 - RNA, 64 nt, hsa; identical to SEQ ID NO: 346530

SEQ ID NO: 348759 - RNA, 64 nt, hsa; identical to SEQ ID NO: 346531

SEQ ID NO: 348760 - RNA, 64 nt, hsa; identical to SEQ ID NO: 346532

SEQ ID NO: 348761 - RNA, 64 nt, hsa; identical to SEQ ID NO: 346533

SEQ ID NO: 348762 - RNA, 64 nt, hsa; identical to SEQ ID NO: 346534

SEQ ID NO: 348763 - RNA, 64 nt, hsa; identical to SEQ ID NO: 346535

SEQ ID NO: 348764 - RNA, 64 nt, hsa; identical to SEQ ID NO: 346536

SEQ ID NO: 348765 - RNA, 64 nt, hsa; identical to SEQ ID NO: 346537

SEQ ID NO: 348766 - RNA, 64 nt, hsa; identical to SEQ ID NO: 346538

SEQ ID NO: 348767 - RNA, 64 nt, hsa; identical to SEQ ID NO: 125569

SEQ ID NO: 348768 - RNA, 64 nt, hsa; identical to SEQ ID NO: 125570

SEQ ID NO: 348769 - RNA, 64 nt, hsa; identical to SEQ ID NO: 125571

SEQ ID NO: 348770 - RNA, 64 nt, hsa; identical to SEQ ID NO: 125572

SEQ ID NO: 348771 - RNA, 64 nt, hsa; identical to SEQ ID NO: 125573

SEQ ID NO: 348772 - RNA, 64 nt, hsa; identical to SEQ ID NO: 125574

SEQ ID NO: 348773 - RNA, 64 nt, hsa; identical to SEQ ID NO: 125575

SEQ ID NO: 348774 - RNA, 64 nt, hsa; identical to SEQ ID NO: 125576

SEQ ID NO: 348775 - RNA, 64 nt, hsa; identical to SEQ ID NO: 125577

SEQ ID NO: 348776 - RNA, 64 nt, hsa; identical to SEQ ID NO: 125578

SEQ ID NO: 348777 - RNA, 64 nt, hsa; identical to SEQ ID NO: 125579

SEQ ID NO: 348778 - RNA, 64 nt, hsa; identical to SEQ ID NO: 125580

SEQ ID NO: 348779 - RNA, 64 nt, hsa; identical to SEQ ID NO: 125581

SEQ ID NO: 348780 - RNA, 64 nt, hsa; identical to SEQ ID NO: 125582

SEQ ID NO: 348781 - RNA, 64 nt, hsa; identical to SEQ ID NO: 125583

SEQ ID NO: 348782 - RNA, 64 nt, hsa; identical to SEQ ID NO: 125584

SEQ ID NO: 348783 - RNA, 64 nt, hsa; identical to SEQ ID NO: 125585

SEQ ID NO: 348784 - RNA, 64 nt, hsa; identical to SEQ ID NO: 125586

SEQ ID NO: 348785 - RNA, 64 nt, hsa; identical to SEQ ID NO: 125587

SEQ ID NO: 348786 - RNA, 64 nt, hsa; identical to SEQ ID NO: 125588

SEQ ID NO: 348787 - RNA, 64 nt, hsa; identical to SEQ ID NO: 125589

SEQ ID NO: 348788 - RNA, 64 nt, hsa; identical to SEQ ID NO: 125590

SEQ ID NO: 348789 - RNA, 64 nt, hsa; identical to SEQ ID NO: 125591

SEQ ID NO: 348790 - RNA, 64 nt, hsa; identical to SEQ ID NO: 125592

SEQ ID NO: 348791 - RNA, 64 nt, hsa; identical to SEQ ID NO: 125593

SEQ ID NO: 348792 - RNA, 64 nt, hsa; identical to SEQ ID NO: 125594

SEQ ID NO: 348793 - RNA, 64 nt, hsa; identical to SEQ ID NO: 125595

SEQ ID NO: 348794 - RNA, 64 nt, hsa; identical to SEQ ID NO: 125596

SEQ ID NO: 348795 - RNA, 64 nt, hsa; identical to SEQ ID NO: 125597

SEQ ID NO: 348796 - RNA, 64 nt, hsa; identical to SEQ ID NO: 125598

SEQ ID NO: 348797 - RNA, 64 nt, hsa; identical to SEQ ID NO: 125599

SEQ ID NO: 348798 - RNA, 64 nt, hsa; identical to SEQ ID NO: 125600

SEQ ID NO: 348799 - RNA, 64 nt, hsa; identical to SEQ ID NO: 125601

SEQ ID NO: 348800 - RNA, 64 nt, hsa; identical to SEQ ID NO: 125602

SEQ ID NO: 348801 - RNA, 64 nt, hsa; identical to SEQ ID NO: 125603

SEQ ID NO: 348802 - RNA, 64 nt, hsa; identical to SEQ ID NO: 125604

SEQ ID NO: 348803 - RNA, 64 nt, hsa; identical to SEQ ID NO: 125605

SEQ ID NO: 348804 - RNA, 64 nt, hsa; identical to SEQ ID NO: 125606

SEQ ID NO: 348805 - RNA, 64 nt, hsa; identical to SEQ ID NO: 125607

SEQ ID NO: 348806 - RNA, 64 nt, hsa; identical to SEQ ID NO: 125608

SEQ ID NO: 348807 - RNA, 64 nt, hsa; identical to SEQ ID NO: 125609

SEQ ID NO: 348808 - RNA, 64 nt, hsa; identical to SEQ ID NO: 125610

SEQ ID NO: 348809 - RNA, 64 nt, hsa; identical to SEQ ID NO: 125611

SEQ ID NO: 348810 - RNA, 64 nt, hsa; identical to SEQ ID NO: 125612

SEQ ID NO: 348811 - RNA, 64 nt, hsa; identical to SEQ ID NO: 125613

SEQ ID NO: 348812 - RNA, 64 nt, hsa; identical to SEQ ID NO: 125614

SEQ ID NO: 348813 - RNA, 64 nt, hsa; identical to SEQ ID NO: 125615

SEQ ID NO: 348814 - RNA, 64 nt, hsa; identical to SEQ ID NO: 125616

SEQ ID NO: 348815 - RNA, 64 nt, hsa; identical to SEQ ID NO: 125617

SEQ ID NO: 348816 - RNA, 64 nt, hsa; identical to SEQ ID NO: 125618

SEQ ID NO: 348817 - RNA, 64 nt, hsa; identical to SEQ ID NO: 125619

SEQ ID NO: 348818 - RNA, 64 nt, hsa; identical to SEQ ID NO: 125620

SEQ ID NO: 348819 - RNA, 64 nt, hsa; identical to SEQ ID NO: 125621

SEQ ID NO: 348820 - RNA, 64 nt, hsa; identical to SEQ ID NO: 125622

SEQ ID NO: 348821 - RNA, 64 nt, hsa; identical to SEQ ID NO: 125623

SEQ ID NO: 348822 - RNA, 64 nt, hsa; identical to SEQ ID NO: 125624

SEQ ID NO: 348823 - RNA, 64 nt, hsa; identical to SEQ ID NO: 125625

SEQ ID NO: 348824 - RNA, 64 nt, hsa; identical to SEQ ID NO: 125626

SEQ ID NO: 348825 - RNA, 64 nt, hsa; identical to SEQ ID NO: 125627

SEQ ID NO: 348826 - RNA, 64 nt, hsa; identical to SEQ ID NO: 125628

SEQ ID NO: 348827 - RNA, 64 nt, hsa; identical to SEQ ID NO: 125629

SEQ ID NO: 348828 - RNA, 64 nt, hsa; identical to SEQ ID NO: 125630

SEQ ID NO: 348829 - RNA, 64 nt, hsa; identical to SEQ ID NO: 125631

SEQ ID NO: 348830 - RNA, 64 nt, hsa; identical to SEQ ID NO: 125632

SEQ ID NO: 348831 - RNA, 64 nt, hsa; identical to SEQ ID NO: 125633

SEQ ID NO: 348832 - RNA, 64 nt, hsa; identical to SEQ ID NO: 125634

SEQ ID NO: 348833 - RNA, 64 nt, hsa; identical to SEQ ID NO: 125635

SEQ ID NO: 348834 - RNA, 64 nt, hsa; identical to SEQ ID NO: 125636

SEQ ID NO: 348835 - RNA, 64 nt, hsa; identical to SEQ ID NO: 125637

SEQ ID NO: 348836 - RNA, 64 nt, hsa; identical to SEQ ID NO: 125638

SEQ ID NO: 348837 - RNA, 64 nt, hsa; identical to SEQ ID NO: 125639

SEQ ID NO: 348838 - RNA, 64 nt, hsa; identical to SEQ ID NO: 125640

SEQ ID NO: 348839 - RNA, 64 nt, hsa; identical to SEQ ID NO: 125641

SEQ ID NO: 348840 - RNA, 64 nt, hsa; identical to SEQ ID NO: 125642

SEQ ID NO: 348841 - RNA, 64 nt, hsa; identical to SEQ ID NO: 156518

SEQ ID NO: 348842 - RNA, 64 nt, hsa; identical to SEQ ID NO: 156519

SEQ ID NO: 348843 - RNA, 64 nt, hsa; identical to SEQ ID NO: 156520

SEQ ID NO: 348844 - RNA, 64 nt, hsa; identical to SEQ ID NO: 156521

SEQ ID NO: 348845 - RNA, 64 nt, hsa
caaggaccuuccaguccaggggaaugacugugcaagguaguaucuaagcaccugagaagcagua

SEQ ID NO: 348846 - RNA, 64 nt, hsa
gcuuuaacucuaugcugacucagugagacacaguagguaguaugguuguggaccuauuuguuuu

SEQ ID NO: 348847 - RNA, 64 nt, hsa
uuacauucauguucuaauuauagauuuuagaguuagguaguacagguaagggggaaauuguaaa

SEQ ID NO: 348848 - RNA, 64 nt, hsa
gcuuuuuucuagcauguauaacuuuuuuaaauaaagguaguauuuaccauuaaaaaaauuuuag

SEQ ID NO: 348849 - RNA, 64 nt, hsa
ugcuuuccuccagaaaguguguucccgucuagugagguaguauugaagccucggcuuucccucu

SEQ ID NO: 348850 - RNA, 64 nt, hsa
agccacaaguguuggagcugcagagagaccccaaagguaguagauugugccagauacaaauggg

SEQ ID NO: 348851 - RNA, 64 nt, hsa
ccauuuacccuugaccccaguccacaguggucacagguaguaccugguccuaggguugccugag

SEQ ID NO: 348852 - RNA, 64 nt, hsa
augacuuugagugauggcacugggagaucagggcagguaguaggccuuccuuccuccgcugggc

SEQ ID NO: 348853 - RNA, 64 nt, hsa
ggucagggagccccugguguggaaagaggccccaagguaguaaacccugccccuguuacugugc

SEQ ID NO: 348854 - RNA, 64 nt, hsa
uccuccuuuuccaggcucagcagggagcugcuggagguaguagagccugaagucuugcaggacu

SEQ ID NO: 348855 - RNA, 64 nt, hsa
aaaagagcacaagaguaugcguacauaguuuaccagguaguagaaguguguuaaaauguuccug

SEQ ID NO: 348856 - RNA, 64 nt, hsa
auguucugaaguaccugauacauguuaaaauuagagguaguaaaaugacacauuuuguaaauaa

SEQ ID NO: 348857 - RNA, 64 nt, hsa
aaaauucuugaagaguuuucauaugugggagcuaagguaguauuguaaaauuucaagucauccu

SEQ ID NO: 348858 - RNA, 64 nt, hsa
auuacaacaucaauuaugaaauacugauaacgaaagguaguaaugaaauauauaugaugaaaag

SEQ ID NO: 348859 - RNA, 64 nt, hsa
cuguugguggucuuccccacacgccccaauuuucagguaguacuaagaguaugugccaggaaac

SEQ ID NO: 348860 - RNA, 64 nt, hsa
caauuaccuggugagaaguugcauaaacagaauuagguaguauauugaagacagcaucauuaaa

SEQ ID NO: 348861 - RNA, 64 nt, hsa
uuucuuuauuuugcuggggagaggcuaaagggaaagguaguaggggcggggguggugaccuuua

SEQ ID NO: 348862 - RNA, 64 nt, hsa
agauaugauuucugcuguucaaaaaagucccuaaagguaguauuaagguuaaaauuaaguuuuu

SEQ ID NO: 348863 - RNA, 64 nt, hsa
aauuaaauuuacauuugaguuguuuguugcuaagagguaguaaauguaagagaguacugguucc

SEQ ID NO: 348864 - RNA, 64 nt, hsa
gaaauuuccauccacuuugguucagcggacaucaagguaguaauaauaauuuuuccuccacagg

SEQ ID NO: 348865 - RNA, 64 nt, hsa
gguguguccuuucccagugcuuuucuuuuacaagagguaguagacuaguggaaauccccaaaug

SEQ ID NO: 348866 - RNA, 64 nt, hsa
aagcaggauauggcaacggaacauccucaagcagagguaguaaaacaggaaagcagcauguccg

SEQ ID NO: 348867 - RNA, 64 nt, hsa
uaauuaagagauuuaaauauuagaacgguauguaagguaguauaauuaccacuauuuuaaauaa

SEQ ID NO: 348868 - RNA, 64 nt, hsa
aaacaccaucuauugagcaccuacauugugugccagguaguaaaauaggugcuuucauacacau

SEQ ID NO: 348869 - RNA, 64 nt, hsa
ugccuuauguuugggcauguaacuccaaaauacuagguaguauaaggcuuucucaaucagugca

SEQ ID NO: 348870 - RNA, 64 nt, hsa
ucgguuguuugaugugcaauauguuuuuguaugcagguaguaaauaaacuuugaucuuccauuu

SEQ ID NO: 348871 - RNA, 64 nt, hsa
agcaaguuuauuuuuguuaaagagcacuugguggagguaguaggggcagggaaaggucagcaua

SEQ ID NO: 348872 - RNA, 64 nt, hsa
cuguauucuagccagaauaauuuuagaucugaucagguaguagcuaaaauuagaaaaaaacaaa

SEQ ID NO: 348873 - RNA, 64 nt, hsa
cuuuaauucacuuuuaauaguauaaaccucauuuagguaguaguauuaagccacaacaauaaug

SEQ ID NO: 348874 - RNA, 64 nt, hsa
auguacuaagcaguaagcuaucuucaaaugucuaagguaguaacuuuccauagggccuccuuag

SEQ ID NO: 348875 - RNA, 64 nt, hsa
cuggggcagaauguuuacagccagugccagcacaagguaguaaucuagugacagagaacagggu

SEQ ID NO: 348876 - RNA, 64 nt, hsa
aacaauuuucauguguaagguagaagccuucaguagguaguaaagacuuaaugugcaugacuug

SEQ ID NO: 348877 - RNA, 64 nt, hsa
uuuuucuuuuuuuuuucuuaaagaagggcagccaagguaguaaccuaaaaauagugcccaggca

SEQ ID NO: 348878 - RNA, 64 nt, hsa
uacaaaggaaauuucuaaagcacaagaaauagugagguaguaguuagucgucuuuccuacaaca

SEQ ID NO: 348879 - RNA, 64 nt, hsa
caagcuguuuguucaucuauauuuaguuuaaaauagguaguauuaucuuucuguacauagugua

SEQ ID NO: 348880 - RNA, 64 nt, hsa
ugcuuuucaaagcauccuaacuugcuaagaugcuagguaguacgacccucuggauuuggaaggc

SEQ ID NO: 348881 - RNA, 64 nt, hsa
aaaacugugagagcuagauguccuaugggcaauuagguaguauaauaaagguaaaugaagguac

SEQ ID NO: 348882 - RNA, 64 nt, hsa
caaacacauuuuagugugauauuucauuuauuauagguaguauauuuuaauuuguuaguuuaaa

SEQ ID NO: 348883 - RNA, 64 nt, hsa
aucuuauacaaaugagccucugcuuguucuacaaagguaguagaaucaaucucgaccuauauaa

SEQ ID NO: 348884 - RNA, 64 nt, hsa
gcuuuucugucagucugaagcguaguaguggaagagguaguaagcaccagcugccucuuugcug

SEQ ID NO: 348885 - RNA, 64 nt, hsa
uguguuagucuguaucaaucagaagacagaaacaagguaguaauuuaaacagggaaaguuuaau

SEQ ID NO: 348886 - RNA, 64 nt, hsa
uguaaaaauuuuguucuucaaaaaaguguacaaaagguaguauaaaauccuacuaauaaaaaua

SEQ ID NO: 348887 - RNA, 64 nt, hsa
cuggauaaaaacaguugugucagugucucuccuaagguaguaaauauaauugacuuauucugaa

SEQ ID NO: 348888 - RNA, 64 nt, hsa
gccugacaagacauuuuuuucaguguauaaaacuagguaguauugugcacugauuugaccauug

SEQ ID NO: 348889 - RNA, 64 nt, hsa
guauguuggaguuauaaagaaauacacuaaggagagguaguaaaugugaaccuuguugcagugu

SEQ ID NO: 348890 - RNA, 64 nt, hsa
aguuaaggaagggggugaggauguggguugggacagguaguaccuaaagaggagcgaagggauu

SEQ ID NO: 348891 - RNA, 64 nt, hsa
aauaucaugggcauuucucuaugauggucauucaagguaguaggucucuuucaacugagugcaa

SEQ ID NO: 348892 - RNA, 64 nt, hsa
aaaucguagacguaacucccccugaaauaaaguuagguaguaaaauccuuaaugaaaccagugg

SEQ ID NO: 348893 - RNA, 64 nt, hsa
ucugacucaacucacuggcuaucgaugaaucaguagguaguauuuauaagucuuaggaaagacu

SEQ ID NO: 348894 - RNA, 64 nt, hsa
uuucuguuuaauucccaaagugacaucuucucacagguaguauguuaguaaaauuuugcaauuc

SEQ ID NO: 348895 - RNA, 64 nt, hsa
cagcuuucagggccaugguucacauuagaauaaaagguaguaauuagaacacucuggcuccugg

SEQ ID NO: 348896 - RNA, 64 nt, hsa
cuccugcugcuucucccaacagcccacuguuaggagguaguagaccccagccucaaggcucuga

SEQ ID NO: 348897 - RNA, 64 nt, hsa
guaguuaagauaugccugcuaucuuuaacuuuggagguaguaucaaaauuuuacuucuuugguu

SEQ ID NO: 348898 - RNA, 64 nt, hsa
cacaguucacucuagcuucuuccaaaauaucucuagguaguacaacugaagccaaaccugccug

SEQ ID NO: 348899 - RNA, 64 nt, hsa
gaaugacaguagcauuaugaguaguguggaauucagguaguaaauaugaaacuaggguuugaaa

SEQ ID NO: 348900 - RNA, 64 nt, hsa
aaaagcuguaauuuccagagagaccauuaggaacagguaguaucuauuuuucuccauuauuuau

SEQ ID NO: 348901 - RNA, 64 nt, hsa
ugacuguuuugggaaggaagaguaccucuuaucgagguaguauaaaacacauagggucuuguuu

SEQ ID NO: 348902 - RNA, 64 nt, hsa
uuagucuugccugucaaaaaguccaacauuucauagguaguaggggccacauauuacauucagu

SEQ ID NO: 348903 - RNA, 64 nt, hsa
gcagugaauuaauaacuccuucuaggauauuccgagguaguaagaauacagauaguucuguuug

SEQ ID NO: 348904 - RNA, 64 nt, hsa
aaaaauugggaggcuuuucaaagguggcuuuguuagguaguaaaacugcuggauucuucuuccu

SEQ ID NO: 348905 - RNA, 64 nt, hsa
aauacaauuuguuauguuuauguuaauugugauuagguaguaaaguauaaguaauuuuuugguu

SEQ ID NO: 348906 - RNA, 64 nt, hsa
cucaccuuucuaaacccaguuaagcauggaagagagguaguagguaggugcaguguguggaagc

SEQ ID NO: 348907 - RNA, 64 nt, hsa
aacaaaauuacuggaagcaguauuguaaguaaugagguaguauuaaucaguuuuaucuuuugaa

SEQ ID NO: 348908 - RNA, 64 nt, hsa
cagcucgauucaguuuuagcuaaauuuauaguuuagguaguauguuacauuugaauuuuugucu

SEQ ID NO: 348909 - RNA, 64 nt, hsa
aaaucagaaaugauugcauuggaagaucauucgaagguaguauuaguaagauuugcugaugaga

SEQ ID NO: 348910 - RNA, 64 nt, hsa
aaucuuuuucaaauuuaauguauauguguauauaagguaguauucagugaauacuugagaaaug

SEQ ID NO: 348911 - RNA, 64 nt, hsa
auuguaucuuacuaggagaucacccauuuacuguagguaguauucucuuccuacuauauuucau

SEQ ID NO: 348912 - RNA, 64 nt, hsa
augacuugggcucauauccacaauacuugguauaagguaguagauuguuggggguggggaggga

SEQ ID NO: 348913 - RNA, 64 nt, hsa
aaaguuuuccucaaggagcagcugggggcagaauagguaguauuuaagcaaauacuuaagucca

SEQ ID NO: 348914 - RNA, 64 nt, hsa
auuuuuuuuugguuggugguuuacacguuaauagagguaguacaauuucuuuggaaaggugucu

SEQ ID NO: 348915 - RNA, 64 nt, hsa
uaggguacugagagccuagcagacuuaaaggacaagguaguaaauguuuuaucacucaaaaauc

SEQ ID NO: 348916 - RNA, 64 nt, hsa
uacuuguguuccacaguuauggccauauacacagagguaguauaugaugaagagaagauuacag

SEQ ID NO: 348917 - RNA, 64 nt, hsa
aacacauuaugaaguuauuaaauuuaagggacagagguaguauaguuagauauacuuucucuua

SEQ ID NO: 348918 - RNA, 64 nt, hsa
aaucauuuguaucaaaggggcaaaugcuuuauuaagguaguaaaagggaacauuacuucugcuu

SEQ ID NO: 348919 - RNA, 64 nt, hsa
acugaucucguuuuuucuucacugcaacaugaugagguaguaccuuuuauaucccauuuauaga

SEQ ID NO: 348920 - RNA, 64 nt, hsa
cugaaagugcauuauuauggaagaauguauuugcagguaguaauagcauuaaaaaauauacucg

SEQ ID NO: 348921 - RNA, 64 nt, hsa
uucuuuccaccacaaauuaaucacuauguuuauaagguaguaucagaauuuuuuuaggauucac

SEQ ID NO: 348922 - RNA, 64 nt, hsa
cagcugcuggccacauuuccugcuuuauuuuaaaagguaguauaagaaaugaggaaaaagaggu

SEQ ID NO: 348923 - RNA, 64 nt, hsa
gggaugauuacuuuuuuaaggaggauuaauucugagguaguauaguaacuaaaggggaauauau

SEQ ID NO: 348924 - RNA, 64 nt, hsa
uuguguaugcccaauaauuuguuaucauuuccuuagguaguaaccuauuuuuguucugguuugg

SEQ ID NO: 348925 - RNA, 64 nt, hsa
aaaccaaggcuaagggacuggucuaaagucucacagguaguauaugguggagccaacacuugaa

SEQ ID NO: 348926 - RNA, 64 nt, hsa
auuuguaauuccuuccucucccuuguucccaaguagguaguaguaaguaugugccacaggcuga

SEQ ID NO: 348927 - RNA, 64 nt, hsa
agaggaaggguggagaaggagagagaaauaugugagguaguaaggaggacagaaaacagaacag

SEQ ID NO: 348928 - RNA, 64 nt, hsa
uauuuuccaauuuccuuucucacauacuguacacagguaguauuuucaaugugaauccaaagcu

SEQ ID NO: 348929 - RNA, 64 nt, hsa
ccagccucaggaacuaacaaguuuugagaaaagcagguaguagagcagcagcuucgugcucuca

SEQ ID NO: 348930 - RNA, 64 nt, hsa
gcuaacaacacccugcugaagcucuuugucaaauagguaguaguuagaacuggauugccauuuu

SEQ ID NO: 348931 - RNA, 64 nt, hsa
ggaaaaccacauuuccagaagcauguuaguuuaaagguaguaggugagaaauguguucucuuga

SEQ ID NO: 348932 - RNA, 64 nt, hsa
gaaaugagaagccccaagcuugcuuuuaacucuaagguaguauuuucuacucugacuacuuucc

SEQ ID NO: 348933 - RNA, 64 nt, hsa
cccaauaaaugaacaaauguacauacacucaggaagguaguacaagauacuccauacaacacaa

SEQ ID NO: 348934 - RNA, 64 nt, hsa
guaugaagucauagauaauaguacaugucaccuuagguaguaggaagaauuacaauuucuuuaa

SEQ ID NO: 348935 - RNA, 64 nt, hsa
aucauaugaucuaauauuguauugauggaaguauagguaguauaguagugauuguucuucaagc

SEQ ID NO: 348936 - RNA, 64 nt, hsa
cuaguuacuacuuuuaaguauguaaauacuagaaagguaguacuagugacaucaucacguguau

SEQ ID NO: 348937 - RNA, 64 nt, hsa
guauuuuaauccuauuacuugacuaagagugugaagguaguacuuuuuagagugcacugagugc

SEQ ID NO: 348938 - RNA, 64 nt, hsa
agaugugccagaguccuuccuccccuccaaggacagguaguaggugccagccuaggggagcuuc

SEQ ID NO: 348939 - RNA, 64 nt, hsa
uucuaaauggauaaauuauucuaggcuucuuaauagguaguaauuuguucaaaagcgguuuuag

SEQ ID NO: 348940 - RNA, 64 nt, hsa
auucucacugaaucaugagagaauguguauuuguagguaguacucuaaauagaucucauugaua

SEQ ID NO: 348941 - RNA, 64 nt, hsa
cugccuguauuucccagugauuuacucuaggguaagguaguacacauuugguucagaaauuaau

SEQ ID NO: 348942 - RNA, 64 nt, hsa
ucagucguguugcuuacgguuucuuuguuacuuuagguaguagaaucucagcacuuuguuucau

SEQ ID NO: 348943 - RNA, 64 nt, hsa
cugaauguacucauuauaauaugauaucugacaaagguaguacagcguuucugagucauuuggg

SEQ ID NO: 348944 - RNA, 64 nt, hsa
caguaaaaaguuucuuacuuuauuuuauuauauuagguaguaaaaaauguaggguuauuuacca

SEQ ID NO: 348945 - RNA, 64 nt, hsa
ucguuaucguuauuguacugucacuuuguucuugagguaguagucaaggaucaggaggggcaga

SEQ ID NO: 348946 - RNA, 64 nt, hsa
uggcgucugcucugguggcuuaagugagcagaacagguaguauuacaccaccggcccccucccc

SEQ ID NO: 348947 - RNA, 64 nt, hsa; identical to SEQ ID NO: 348942

SEQ ID NO: 348948 - RNA, 64 nt, hsa
ccugacuuucccccuguaccuucagccccugugcagguaguaaccucuugagaccucucccuga

SEQ ID NO: 348949 - RNA, 64 nt, hsa
gacaaccaaggcggcuacuaagugacuaaggggcagguaguauacaguguggauaagcaggaca

SEQ ID NO: 348950 - RNA, 64 nt, hsa
uuaaaggauucuuuccaagcgagauuuaauuauaagguaguaccuaauuuguucaauguauaac

SEQ ID NO: 348951 - RNA, 64 nt, hsa
gcguucuuagcuuuuuugacaaacucuuuucuccagguaguaggacaaugaaaauuguucuaag

SEQ ID NO: 348952 - RNA, 64 nt, hsa
acuuggauuuccaguuuguuuacagaguagucuuagguaguagcaaaagagccaaagaagagau

SEQ ID NO: 348953 - RNA, 64 nt, hsa
gagcugcgagaucugugcaagucugguuuugguuagguaguaauaaaaguccucacuguagauc

SEQ ID NO: 348954 - RNA, 64 nt, hsa
ucauugccagauuccauuacccuuucuuccucauagguaguaauuaccaauguaacuaagcauu

SEQ ID NO: 348955 - RNA, 64 nt, hsa
gaagcuguuuuaauuccccuguugaaugugaaaaagguaguaguauuccugggucuuuaugaug

SEQ ID NO: 348956 - RNA, 64 nt, hsa
guuucugcccuuaccccucaguaguggggcugcgagguaguagacaggaugcccaguuaaguuu

SEQ ID NO: 348957 - RNA, 64 nt, hsa
gcguagaaucugaacacacugaggccaccuagcaagguaguaacuagucuaaccugugcuaaca

SEQ ID NO: 348958 - RNA, 64 nt, hsa
uaauugucagauuccacuacacuuucuuccucauagguaguaauuaccaguguaacuaagcauu

SEQ ID NO: 348959 - RNA, 64 nt, hsa
auauucaauguauuuuuuauggauccuuuuucaaagguaguaucaguaggcauagucauuuucu

SEQ ID NO: 348960 - RNA, 64 nt, hsa
aaaccccacacgagggcucucaccuccuucuccuagguaguauuuauuuucagcaccuguuuga

SEQ ID NO: 348961 - RNA, 64 nt, hsa
aucuugcuuuguguaucucauuuaauuuguuauaagguaguacugauuuuagcauauuaaugcg

SEQ ID NO: 348962 - RNA, 64 nt, hsa
gaagugcccaugauugcagggcucuaagcuucagagguaguaacugucauucuucaaucagaua

SEQ ID NO: 348963 - RNA, 64 nt, hsa
aauucauauuugauagagaaauuguggcauauacagguaguaaagaaagcacauugugucaaug

SEQ ID NO: 348964 - RNA, 64 nt, hsa
cuuuuuauuucauucuuuuaaaaaauuuauuuuaagguaguacauguaguuggaagaacuacua

SEQ ID NO: 348965 - RNA, 64 nt, hsa
auccucaugcauuuuccucaagaaugucugaagaagguaguaauauuccuuuuaaauuuuuucc

SEQ ID NO: 348966 - RNA, 64 nt, hsa
ccgucuacucacuguaguaguagcagcuacagaaagguaguagugagacgugaagccagcugga

SEQ ID NO: 348967 - RNA, 64 nt, hsa
agggcuuuaucaaaaaguacaauaauaaauccucagguaguacugggaauggaaggcuuugcca

SEQ ID NO: 348968 - RNA, 64 nt, hsa
ugaugacagguaacgaaacuuccuauguuaugucagguaguaguaaguaguauuggaaugaugu

SEQ ID NO: 348969 - RNA, 64 nt, hsa
gaaaauucgauuaggaaacuuuauuuaaaauuucagguaguaauauucaguguaguuaaggcca

SEQ ID NO: 348970 - RNA, 64 nt, hsa
agaaagguauguugucuaacaggggaccaacagaagguaguauugacaacuguuccugcuucua

SEQ ID NO: 348971 - RNA, 64 nt, hsa
auaauccaagcaaaaguuaaugguggcuucaacuagguaguagcaauaagggugauaagaagug

SEQ ID NO: 348972 - RNA, 64 nt, hsa
uauaaguacaaauuugggaacauacaaaucuuuuagguaguagaguuuaacguguauaagcuaa

SEQ ID NO: 348973 - RNA, 64 nt, hsa
cccucucuuagggacagucaaaaccaagucacuuagguaguaccaaaauaaauaaggaaaagcu

SEQ ID NO: 348974 - RNA, 64 nt, hsa
cuuggaaauccucuguuuagcuuaguugcacaaaagguaguauguccaguggcuagaggugggg

SEQ ID NO: 348975 - RNA, 64 nt, hsa
ccugccucauggcaccagagugaacagggcaggcagguaguaggcccagcuggggaaaugggag

SEQ ID NO: 348976 - RNA, 64 nt, hsa
guguuuuucauauuauuuccacguaagggaaauaagguaguacuuuucuuuuuauauuucuaug

SEQ ID NO: 348977 - RNA, 64 nt, hsa
ucuuggaaacuuccauuaaguguguagauugagcagguaguaauugcaugcaguuuguacauua

SEQ ID NO: 348978 - RNA, 64 nt, hsa
gacagaggcacaugcugaggccugcugguggaggagguaguaccuuugaagaugcuguugacca

SEQ ID NO: 348979 - RNA, 64 nt, hsa
aguguuaucucuuaccuuaaaaaacucagccaacagguaguauugguaaaaacaaacaaacaaa

SEQ ID NO: 348980 - RNA, 64 nt, hsa
caguucauguauuuacuggugauuguucuugcugagguaguaacagcccaaucuugggcuguua

SEQ ID NO: 348981 - RNA, 64 nt, hsa; identical to SEQ ID NO: 156540

SEQ ID NO: 348982 - RNA, 64 nt, hsa; identical to SEQ ID NO: 156541

SEQ ID NO: 348983 - RNA, 64 nt, hsa; identical to SEQ ID NO: 156542

SEQ ID NO: 348984 - RNA, 64 nt, hsa; identical to SEQ ID NO: 156543

SEQ ID NO: 348985 - RNA, 64 nt, hsa; identical to SEQ ID NO: 156544

SEQ ID NO: 348986 - RNA, 64 nt, hsa; identical to SEQ ID NO: 156545

SEQ ID NO: 348987 - RNA, 64 nt, hsa; identical to SEQ ID NO: 156546

SEQ ID NO: 348988 - RNA, 64 nt, hsa; identical to SEQ ID NO: 156547

SEQ ID NO: 348989 - RNA, 64 nt, hsa; identical to SEQ ID NO: 156548

SEQ ID NO: 348990 - RNA, 64 nt, hsa; identical to SEQ ID NO: 156549

SEQ ID NO: 348991 - RNA, 64 nt, hsa; identical to SEQ ID NO: 156550

SEQ ID NO: 348992 - RNA, 64 nt, hsa; identical to SEQ ID NO: 156551

SEQ ID NO: 348993 - RNA, 64 nt, hsa; identical to SEQ ID NO: 156552

SEQ ID NO: 348994 - RNA, 64 nt, hsa; identical to SEQ ID NO: 156553

SEQ ID NO: 348995 - RNA, 64 nt, hsa; identical to SEQ ID NO: 156554

SEQ ID NO: 348996 - RNA, 64 nt, hsa
aggacuucacuacguugauugcuagguggccuaguuuguguaaauauaauguauuggucuuucu

SEQ ID NO: 348997 - RNA, 64 nt, hsa
auguaacuccauguuuacugcuaaaaaccaaagcuuuguguaaaaucuugaauuuauggggcgg

SEQ ID NO: 348998 - RNA, 64 nt, hsa
uuucugggaggucucuccuuugugugucuguauguuuguguacacacacgugcccaucugcugu

SEQ ID NO: 348999 - RNA, 64 nt, hsa
augagggggaggagaaucuuuaucagaaacugguuuuguguaguaaacuuucuuuugugguuuu

SEQ ID NO: 349000 - RNA, 64 nt, hsa
ugcuagaaauaugguuaauguauuuuacuuugcauuuguguaguacuuuauaguuuacaaagca

SEQ ID NO: 349001 - RNA, 64 nt, hsa
aauuauguuaaaagaaaucucuacauaaaucguauuuguguaugaaaaccuucuauuuugggcu

SEQ ID NO: 349002 - RNA, 64 nt, hsa
guagaacuuaauauacaggauuauaaaauaauauuuuguguauaaauuuguuauaaguucacau

SEQ ID NO: 349003 - RNA, 64 nt, hsa
uaaaugauugguuuguaacauuccuuaagugaaauuuguguagaacuuaauauacaggauuaua

SEQ ID NO: 349004 - RNA, 64 nt, hsa
cagauguguugacguaagcucuaucugcaauguuuuuguguagaguggcgauugaaugcugccc

SEQ ID NO: 349005 - RNA, 64 nt, hsa
ucgauguacagucucaauuuuguauuuaaugauuuuuguguauccaguaugcacguuaacagcg

SEQ ID NO: 349006 - RNA, 64 nt, hsa
auguaauacugauaaugacaauaaaugacaccgguuuguguauuuacuuuuuauaauuagagug

SEQ ID NO: 349007 - RNA, 64 nt, hsa
uuuuauuuauugaacaauguagucacuugaagguuuuguguauaucuuauguggauuaccaauu

SEQ ID NO: 349008 - RNA, 64 nt, hsa
guuagacauuuucucauuuugaaauauuuguguguuuguguaugugcucugugccauggcuggu

SEQ ID NO: 349009 - RNA, 64 nt, hsa
aauuauucuuuguaagcgggacauuuagaauauauuuguguacauauuauauguauguauauuu

SEQ ID NO: 349010 - RNA, 64 nt, hsa
caaaaauaacacaauaacaggagacuuccauaaguuuguguauuauguuagucuaugaaaacgu

SEQ ID NO: 349011 - RNA, 64 nt, hsa
caaaauaagauacugucucagcuagggcuugucauuuguguauuuaguguuaagauaggaaugc

SEQ ID NO: 349012 - RNA, 64 nt, hsa
cauacuccuuuuaaaacaauauuuauguccuauguuuguguauagacaugacucuacuagggca

SEQ ID NO: 349013 - RNA, 64 nt, hsa
guauagacaugacucuacuagggcauaauuagaguuuguguauuauuuuuccagguuuggggau

SEQ ID NO: 349014 - RNA, 64 nt, hsa
gcuucuugagcuaugucucuacuccaggcucuguuuuguguauuuaucugccauuugcaucaug

SEQ ID NO: 349015 - RNA, 64 nt, hsa
agaaaccccgaagucuucccagccagugagccacuuuguguauuuacuguauauuuauugugcc

SEQ ID NO: 349016 - RNA, 64 nt, hsa
auuuccuggcaaacggccuccugaacccugacuuuuuguguacauacuuguaaacacggauuuu

SEQ ID NO: 349017 - RNA, 64 nt, hsa
ucucuucugauucugcugcucacugucauagccuuuuguguauagugaugugucuguaucuuua

SEQ ID NO: 349018 - RNA, 64 nt, hsa
uuuagcucuaaccucaucaaaccaaaggcacagauuuguguacaauauacccauugaauguaua

SEQ ID NO: 349019 - RNA, 64 nt, hsa
acuuuucaugggaaauauauuucacaccauugccuuuguguagagaaauauuucuuuuccugug

SEQ ID NO: 349020 - RNA, 64 nt, hsa
augccuuuuugcaauucugaauaugauucuaguauuuguguagauguauuugguacuuuuuccc

SEQ ID NO: 349021 - RNA, 64 nt, hsa
cagaaggaucaagaauucuaccaucccuugggucuuuguguauaaacaauguuaaauaaaggua

SEQ ID NO: 349022 - RNA, 64 nt, hsa
acccucaaguguuuuuuccgagcuugggaaagauuuuguguaggaaaugugcauagaguuugua

SEQ ID NO: 349023 - RNA, 64 nt, hsa
ccuaccucaacaaagcagggugggguaggugacauuuguguauccacauucuuaccuuugguag

SEQ ID NO: 349024 - RNA, 64 nt, hsa
aaaaaaaaaagaugaaaaaaguuccuguggauguuuuguguaguaucuuggcauuuguauugau

SEQ ID NO: 349025 - RNA, 64 nt, hsa
uuucucuguuguauguuggauuauguaggaaauguuuguguacaauucaaaaaaaaaaaagaug

SEQ ID NO: 349026 - RNA, 64 nt, hsa
gcgacagcggggcuuccugauucuggaauauaacuuuguguaaauuaacagccaccuauagaag

SEQ ID NO: 349027 - RNA, 64 nt, hsa
cugaagaugauuauugugaaauuuuaguaugcacuuuguguaggaaaaaauggaauggucuuuu

SEQ ID NO: 349028 - RNA, 64 nt, hsa
uugugauuuguucauguuauauuaaaacuugagauuuguguauuuauguagagucuguauugac

SEQ ID NO: 349029 - RNA, 64 nt, hsa
cuugaauaaauauagccugcuuucccuagaugcauuuguguaggaaguauauacauuucccuau

SEQ ID NO: 349030 - RNA, 64 nt, hsa
gacaaaccauuugaauuuuaacauugguuauuuauuuguguaauggccuuacauguggauauua

SEQ ID NO: 349031 - RNA, 64 nt, hsa
uugaaauauacuuaaaaauucaagaugcuucccauuuguguaauauuuaccuggaggacucgua

SEQ ID NO: 349032 - RNA, 64 nt, hsa
uucccagucauugcugcaauuaucuugucuguucuuuguguaauauguucugugugagccucug

SEQ ID NO: 349033 - RNA, 64 nt, hsa
uuucuaaaggcaguuucuguuguuuuaauuaguauuuguguaguucaaaccaggaaggauuuga

SEQ ID NO: 349034 - RNA, 64 nt, hsa
agaguaacuucacauaaaagcagauaccuuuaaguuuguguagacuucugaauaagaugauaga

SEQ ID NO: 349035 - RNA, 64 nt, hsa
aaucuaguagagcagacuuucuaacauaccuaguuuuguguauuggcuuugcuggaguaugaua

SEQ ID NO: 349036 - RNA, 64 nt, hsa
ucguggcucucggccuucucagagaaauaaaugcuuuguguaacaucugugcacaccauccauu

SEQ ID NO: 349037 - RNA, 64 nt, hsa
cccagaggcugaucugcaaaucaagcuacauguauuuguguauaagacccuguguucaggacug

SEQ ID NO: 349038 - RNA, 64 nt, hsa
agagagaugaugaaaguaggcagggcuguguuccuuuguguagccuguauauauuuuccauaug

SEQ ID NO: 349039 - RNA, 64 nt, hsa
aagagcaaccaaguaaagucaugaauuuucuaauuuuguguauauggaauauauuuuuaaauag

SEQ ID NO: 349040 - RNA, 64 nt, hsa
cacuauuuguuggagaguuaaauggucucuucccuuuguguaucuuaccuaguguuuacuccug

SEQ ID NO: 349041 - RNA, 64 nt, hsa
aaauuuuucuuuucuuucuuucuuuuuuuuuuuuuuuguguagaaaaauaggugcaauaaugau

SEQ ID NO: 349042 - RNA, 64 nt, hsa
ugcuauuuccuucaaaugaaugauuuuuacuaauuuuguguacuuuuauugugucgauguagaa

SEQ ID NO: 349043 - RNA, 64 nt, hsa
agauacaugaaauauuaaagaaaauguguaacuuuuuguguaaauacaucuugucuuguuuuca

SEQ ID NO: 349044 - RNA, 64 nt, hsa
uucuucauguguuuuugucucuagccuauguguauuuguguagaauaaugugggauaccugaau

SEQ ID NO: 349045 - RNA, 64 nt, hsa
aaagaaauuuuaagaauuuggcacaguuacucacuuuguguaaucugaaaucuagcugcugaau

SEQ ID NO: 349046 - RNA, 64 nt, hsa
aucuuaccaugaagguuguuuugcuuauuguauauuuguguauguaguguaacuauuuuguaca

SEQ ID NO: 349047 - RNA, 64 nt, hsa
uuaggucuuccuugcaauacuggaacauaauucuuuuguguagcucacuauuagccagcuaagu

SEQ ID NO: 349048 - RNA, 64 nt, hsa
aaaaauaaaguccuuuuaagggaacuuccugaauuuuguguauuaauguucuuuaaaaguuuaa

SEQ ID NO: 349049 - RNA, 64 nt, hsa
uguaauuaaaugcuuugcccucuggaacuugauuuuuguguaucugagauuuauuaacagugcu

SEQ ID NO: 349050 - RNA, 64 nt, hsa
auuguucaucuaauuaaauaaauuaaaagagcgguuuguguagaaauuggagagaacuauguuu

SEQ ID NO: 349051 - RNA, 64 nt, hsa
uccauugguguagcuuuacaaaccauucacugauuuuguguaauuuaacaauagauaugaaaua

SEQ ID NO: 349052 - RNA, 64 nt, hsa
accuugaagucacaguguuuuagaguaaaacuauuuuguguacaauuguguuuuuaaaauaguu

SEQ ID NO: 349053 - RNA, 64 nt, hsa
aggacuuucuuucuauagaauuauuuuaucaauauuuguguagugagguccuaaucaagaaacu

SEQ ID NO: 349054 - RNA, 64 nt, hsa
uucaaacccucagguuugccucuaaccaggugucccuggucaccaucagaguacuggaauacgg

SEQ ID NO: 349055 - RNA, 64 nt, hsa
aacacucaaggggaaaccuguagugacagugugcccuggucauccuuaaaauaaccugcaucuc

SEQ ID NO: 349056 - RNA, 64 nt, hsa
cccacagucccuggcaggcggcuggaaggccaggccuggucaucugucaagcaggguggacuuc

SEQ ID NO: 349057 - RNA, 64 nt, hsa
aaguggguggaucacuugaggaguucaagaccagccuggucaacaugucaaaacccuguaccua

SEQ ID NO: 349058 - RNA, 64 nt, hsa
guuuuccuaguauacccacugcauccuacuccuaccuggucaacccgcugcuuccagguauggg

SEQ ID NO: 349059 - RNA, 64 nt, hsa
gcaacuggacuauagcagggcugggcucugucuuccuggucauaggcucacucuuucccccaaa

SEQ ID NO: 349060 - RNA, 64 nt, hsa
ugcagugagccaagaucacgucauugcacuccagccuggucaacaagaguaaaacuucaucuca

SEQ ID NO: 349061 - RNA, 64 nt, hsa
gaggcccacagccacccaggcagggagcaaguggccuggucacuucugguucgauugaccagga

SEQ ID NO: 349062 - RNA, 64 nt, hsa
uuggauaaugugggaaaaugacaucuaagcuuuaccuggucaccaugugaugugaucagaugcu

SEQ ID NO: 349063 - RNA, 64 nt, hsa
ccagagcuacaacaugccaucuauaguugccagcccuggucaguuuugauucuuaaccccaugg

SEQ ID NO: 349064 - RNA, 64 nt, hsa
gcaucugccaucugcuuuucccauugccaugcguccuggucaagcuccccucacucuguuuccu

SEQ ID NO: 349065 - RNA, 64 nt, hsa
caugcguccuggucaagcuccccucacucuguuuccuggucagcauguacuccccucauccgau

SEQ ID NO: 349066 - RNA, 64 nt, hsa
guuaacacaugggaacaccaaaauauucaauaagccuggucaauucuauaguuaucuuuuuugu

SEQ ID NO: 349067 - RNA, 64 nt, hsa
cuaagcuagcaugcucagggugcaccguauguccccuggucaugugaugcuauguguuaccuug

SEQ ID NO: 349068 - RNA, 64 nt, hsa
caugcguccuggucaggcuucccucacucuguuuccuggucagcauguacuccccucauccgau

SEQ ID NO: 349069 - RNA, 64 nt, hsa
gcaucucccaucugcuuuucccauugccaugcguccuggucaggcuucccucacucuguuuccu

SEQ ID NO: 349070 - RNA, 64 nt, hsa; identical to SEQ ID NO: 115714

SEQ ID NO: 349071 - RNA, 64 nt, hsa; identical to SEQ ID NO: 115715

SEQ ID NO: 349072 - RNA, 64 nt, hsa; identical to SEQ ID NO: 115716

SEQ ID NO: 349073 - RNA, 64 nt, hsa; identical to SEQ ID NO: 115717

SEQ ID NO: 349074 - RNA, 64 nt, hsa; identical to SEQ ID NO: 115718

SEQ ID NO: 349075 - RNA, 64 nt, hsa; identical to SEQ ID NO: 115719

SEQ ID NO: 349076 - RNA, 64 nt, hsa; identical to SEQ ID NO: 115720

SEQ ID NO: 349077 - RNA, 64 nt, hsa; identical to SEQ ID NO: 115721

SEQ ID NO: 349078 - RNA, 64 nt, hsa; identical to SEQ ID NO: 115722

SEQ ID NO: 349079 - RNA, 64 nt, hsa; identical to SEQ ID NO: 115723

SEQ ID NO: 349080 - RNA, 64 nt, hsa; identical to SEQ ID NO: 115724

SEQ ID NO: 349081 - RNA, 64 nt, hsa; identical to SEQ ID NO: 115725

SEQ ID NO: 349082 - RNA, 64 nt, hsa; identical to SEQ ID NO: 115726

SEQ ID NO: 349083 - RNA, 64 nt, hsa; identical to SEQ ID NO: 115727

SEQ ID NO: 349084 - RNA, 64 nt, hsa; identical to SEQ ID NO: 115728

SEQ ID NO: 349085 - RNA, 64 nt, hsa; identical to SEQ ID NO: 115729

SEQ ID NO: 349086 - RNA, 64 nt, hsa; identical to SEQ ID NO: 115730

SEQ ID NO: 349087 - RNA, 64 nt, hsa; identical to SEQ ID NO: 115731

SEQ ID NO: 349088 - RNA, 64 nt, hsa; identical to SEQ ID NO: 115732

SEQ ID NO: 349089 - RNA, 64 nt, hsa; identical to SEQ ID NO: 115733

SEQ ID NO: 349090 - RNA, 64 nt, hsa; identical to SEQ ID NO: 115734

SEQ ID NO: 349091 - RNA, 64 nt, hsa; identical to SEQ ID NO: 115735

SEQ ID NO: 349092 - RNA, 64 nt, hsa; identical to SEQ ID NO: 115736

SEQ ID NO: 349093 - RNA, 64 nt, hsa; identical to SEQ ID NO: 115737

SEQ ID NO: 349094 - RNA, 64 nt, hsa; identical to SEQ ID NO: 115738

SEQ ID NO: 349095 - RNA, 64 nt, hsa; identical to SEQ ID NO: 115739

SEQ ID NO: 349096 - RNA, 64 nt, hsa
aagcaacucucaguauuuuggauuauucaaguguaugugguaaaaaugcagaugauugcugcuu

SEQ ID NO: 349097 - RNA, 64 nt, hsa
ccuuuggaaauaaaaaguuaaauguuuacauuucaugugguauuucaggucuucagguucugau

SEQ ID NO: 349098 - RNA, 64 nt, hsa
uguggacgucuuuggaauuuguuaggggaaggcuaugugguaagcucuacuaaauguaucugua

SEQ ID NO: 349099 - RNA, 64 nt, hsa
uggccaaugccuggcugcaggcaucaguuguucaaugugguagaugaaaaucauggcaugaauu

SEQ ID NO: 349100 - RNA, 64 nt, hsa
uuuauacuggagcaaaaccuuggaaauucaaagaaugugguaaaacuuacaauccucaaaacuu

SEQ ID NO: 349101 - RNA, 64 nt, hsa
uucauacuggagagaaaccccacaaauaugaagaaugugguaaugcuuuuaaccaauucucaaa

SEQ ID NO: 349102 - RNA, 64 nt, hsa
cucacacuggagagaaacccuauaaaugcaugccaugugguaaagccuucaaucuuuccaguuc

SEQ ID NO: 349103 - RNA, 64 nt, hsa
cucacacugcagagaaacccuaugaaugcaagcaaugugguaaagccuucaguaguuccaguuc

SEQ ID NO: 349104 - RNA, 64 nt, hsa; identical to SEQ ID NO: 122412

SEQ ID NO: 349105 - RNA, 64 nt, hsa; identical to SEQ ID NO: 122413

SEQ ID NO: 349106 - RNA, 64 nt, hsa; identical to SEQ ID NO: 122453

SEQ ID NO: 349107 - RNA, 64 nt, hsa; identical to SEQ ID NO: 122454

SEQ ID NO: 349108 - RNA, 64 nt, hsa; identical to SEQ ID NO: 122460

SEQ ID NO: 349109 - RNA, 64 nt, hsa; identical to SEQ ID NO: 122461

SEQ ID NO: 349110 - RNA, 64 nt, hsa; identical to SEQ ID NO: 122467

SEQ ID NO: 349111 - RNA, 64 nt, hsa; identical to SEQ ID NO: 122468

SEQ ID NO: 349112 - RNA, 64 nt, hsa; identical to SEQ ID NO: 122481

SEQ ID NO: 349113 - RNA, 64 nt, hsa; identical to SEQ ID NO: 122482

SEQ ID NO: 349114 - RNA, 64 nt, hsa; identical to SEQ ID NO: 122498

SEQ ID NO: 349115 - RNA, 64 nt, hsa; identical to SEQ ID NO: 122499

SEQ ID NO: 349116 - RNA, 64 nt, hsa; identical to SEQ ID NO: 122513

SEQ ID NO: 349117 - RNA, 64 nt, hsa; identical to SEQ ID NO: 122514

SEQ ID NO: 349118 - RNA, 64 nt, hsa; identical to SEQ ID NO: 122517

SEQ ID NO: 349119 - RNA, 64 nt, hsa; identical to SEQ ID NO: 122518

SEQ ID NO: 349120 - RNA, 64 nt, hsa; identical to SEQ ID NO: 122606

SEQ ID NO: 349121 - RNA, 64 nt, hsa; identical to SEQ ID NO: 122607

SEQ ID NO: 349122 - RNA, 64 nt, hsa; identical to SEQ ID NO: 122654

SEQ ID NO: 349123 - RNA, 64 nt, hsa; identical to SEQ ID NO: 122655

SEQ ID NO: 349124 - RNA, 64 nt, hsa; identical to SEQ ID NO: 122669

SEQ ID NO: 349125 - RNA, 64 nt, hsa; identical to SEQ ID NO: 122670

SEQ ID NO: 349126 - RNA, 64 nt, hsa; identical to SEQ ID NO: 122677

SEQ ID NO: 349127 - RNA, 64 nt, hsa; identical to SEQ ID NO: 122678

SEQ ID NO: 349128 - RNA, 64 nt, hsa; identical to SEQ ID NO: 122684

SEQ ID NO: 349129 - RNA, 64 nt, hsa; identical to SEQ ID NO: 122685

SEQ ID NO: 349130 - RNA, 64 nt, hsa; identical to SEQ ID NO: 122691

SEQ ID NO: 349131 - RNA, 64 nt, hsa; identical to SEQ ID NO: 122692

SEQ ID NO: 349132 - RNA, 64 nt, hsa; identical to SEQ ID NO: 122693

SEQ ID NO: 349133 - RNA, 64 nt, hsa; identical to SEQ ID NO: 122709

SEQ ID NO: 349134 - RNA, 64 nt, hsa; identical to SEQ ID NO: 122710

SEQ ID NO: 349135 - RNA, 64 nt, hsa; identical to SEQ ID NO: 122711

SEQ ID NO: 349136 - RNA, 64 nt, hsa; identical to SEQ ID NO: 122718

SEQ ID NO: 349137 - RNA, 64 nt, hsa; identical to SEQ ID NO: 122719

SEQ ID NO: 349138 - RNA, 64 nt, hsa; identical to SEQ ID NO: 122734

SEQ ID NO: 349139 - RNA, 64 nt, hsa; identical to SEQ ID NO: 122735

SEQ ID NO: 349140 - RNA, 64 nt, hsa; identical to SEQ ID NO: 122742

SEQ ID NO: 349141 - RNA, 64 nt, hsa; identical to SEQ ID NO: 122743

SEQ ID NO: 349142 - RNA, 64 nt, hsa; identical to SEQ ID NO: 122744

SEQ ID NO: 349143 - RNA, 64 nt, hsa; identical to SEQ ID NO: 122746

SEQ ID NO: 349144 - RNA, 64 nt, hsa; identical to SEQ ID NO: 122747

SEQ ID NO: 349145 - RNA, 64 nt, hsa; identical to SEQ ID NO: 122749

SEQ ID NO: 349146 - RNA, 64 nt, hsa; identical to SEQ ID NO: 122750

SEQ ID NO: 349147 - RNA, 64 nt, hsa; identical to SEQ ID NO: 122801

SEQ ID NO: 349148 - RNA, 64 nt, hsa; identical to SEQ ID NO: 122802

SEQ ID NO: 349149 - RNA, 64 nt, hsa; identical to SEQ ID NO: 122837

SEQ ID NO: 349150 - RNA, 64 nt, hsa; identical to SEQ ID NO: 122838

SEQ ID NO: 349151 - RNA, 64 nt, hsa; identical to SEQ ID NO: 122842

SEQ ID NO: 349152 - RNA, 64 nt, hsa; identical to SEQ ID NO: 122843

SEQ ID NO: 349153 - RNA, 64 nt, hsa; identical to SEQ ID NO: 122853

SEQ ID NO: 349154 - RNA, 64 nt, hsa; identical to SEQ ID NO: 122854

SEQ ID NO: 349155 - RNA, 64 nt, hsa; identical to SEQ ID NO: 122861

SEQ ID NO: 349156 - RNA, 64 nt, hsa; identical to SEQ ID NO: 122862

SEQ ID NO: 349157 - RNA, 64 nt, hsa; identical to SEQ ID NO: 122909

SEQ ID NO: 349158 - RNA, 64 nt, hsa; identical to SEQ ID NO: 122910

SEQ ID NO: 349159 - RNA, 64 nt, hsa; identical to SEQ ID NO: 122911

SEQ ID NO: 349160 - RNA, 64 nt, hsa; identical to SEQ ID NO: 122931

SEQ ID NO: 349161 - RNA, 64 nt, hsa; identical to SEQ ID NO: 122932

SEQ ID NO: 349162 - RNA, 64 nt, hsa; identical to SEQ ID NO: 122949

SEQ ID NO: 349163 - RNA, 64 nt, hsa; identical to SEQ ID NO: 122950

SEQ ID NO: 349164 - RNA, 64 nt, hsa; identical to SEQ ID NO: 122967

SEQ ID NO: 349165 - RNA, 64 nt, hsa; identical to SEQ ID NO: 122968

SEQ ID NO: 349166 - RNA, 64 nt, hsa; identical to SEQ ID NO: 122972

SEQ ID NO: 349167 - RNA, 64 nt, hsa; identical to SEQ ID NO: 122973

SEQ ID NO: 349168 - RNA, 64 nt, hsa; identical to SEQ ID NO: 122977

SEQ ID NO: 349169 - RNA, 64 nt, hsa; identical to SEQ ID NO: 122978

SEQ ID NO: 349170 - RNA, 64 nt, hsa
cuuuauugagcaucuucuacauccuaggcauuguccuaggcauugcauguuuauauccccaauu

SEQ ID NO: 349171 - RNA, 64 nt, hsa
aaugauaacuaucuuuauugagcaucuucuacauccuaggcauuguccuaggcauugcauguuu

SEQ ID NO: 349172 - RNA, 64 nt, hsa
gcugagcccccugcagcucccaucuccagcuauuccuaggcaaagagccucauggcuaaggcag

SEQ ID NO: 349173 - RNA, 64 nt, hsa
augcuauuaauuuccauccuuuagcaggcugggcccuaggcaggaagcuggcuucugggagagg

SEQ ID NO: 349174 - RNA, 64 nt, hsa; identical to SEQ ID NO: 159255

SEQ ID NO: 349175 - RNA, 64 nt, hsa; identical to SEQ ID NO: 159256

SEQ ID NO: 349176 - RNA, 64 nt, hsa; identical to SEQ ID NO: 159257

SEQ ID NO: 349177 - RNA, 64 nt, hsa; identical to SEQ ID NO: 159258

SEQ ID NO: 349178 - RNA, 64 nt, hsa; identical to SEQ ID NO: 159259

SEQ ID NO: 349179 - RNA, 64 nt, hsa; identical to SEQ ID NO: 159260

SEQ ID NO: 349180 - RNA, 63 nt, hsa; identical to SEQ ID NO: 38974

SEQ ID NO: 349181 - RNA, 63 nt, hsa; identical to SEQ ID NO: 38975

SEQ ID NO: 349182 - RNA, 64 nt, hsa
auuggugaccuuuuguaagacauuaguuugagguacuaccuauguacuugaaaauaauaaagug

SEQ ID NO: 349183 - RNA, 64 nt, hsa
gaugacaguaauucuguugucuaccauuaaugcuacuaccuacuccauaauugccuauuuagcu

SEQ ID NO: 349184 - RNA, 64 nt, hsa
cugacgacuggaauagauauaaaguccuguuuaaacuaccuaaccuuggcugugggccgauaau

SEQ ID NO: 349185 - RNA, 64 nt, hsa
uaaggauacagcuuauaaguugcuaucaauuuucacuaccuaagcagaauuuuucucuaauuua

SEQ ID NO: 349186 - RNA, 64 nt, hsa
uguuauugguagacacccucagccucaucauuugacuaccuauguacuacucuacccccugccu

SEQ ID NO: 349187 - RNA, 64 nt, hsa
aauguaccuggcacguuugaaaauaaaaaaucugacuaccuaucagaagaguaaaucagacuga

SEQ ID NO: 349188 - RNA, 64 nt, hsa
gaagguuuuggcugggguuccugguggauuucuuacuaccuaacgcccaagaaaaccaacuaag

SEQ ID NO: 349189 - RNA, 64 nt, hsa
ugaggccuuucagagcucaguagaauccugggcaacuaccuaugguucaaaaaauaaagaaaug

SEQ ID NO: 349190 - RNA, 64 nt, hsa
aauuuuuaccuaaucuccacuuuuuucauagguuacuaccuauacaauguauguaauuuguuuc

SEQ ID NO: 349191 - RNA, 64 nt, hsa
guuuggauccugacucaaauuaagaaaaaauaaaacuaccuacgaaauacuaagaaaaauuugu

SEQ ID NO: 349192 - RNA, 64 nt, hsa
uacugugaagugaaguuggcgcagcccugaagaaacuaccuaggagaacuaauagacacaggag

SEQ ID NO: 349193 - RNA, 64 nt, hsa
ggugguaauaauuauaacugaaagguuuaaauauacuaccuaagaaaaaaguacuucugugaca

SEQ ID NO: 349194 - RNA, 64 nt, hsa
caaaaaaaaaagaaaaaagaauagucauuuuuaaacuaccuaucucaugcaaugaaagcauuuu

SEQ ID NO: 349195 - RNA, 64 nt, hsa
acauaauugcuaaaaacucauuuuuguuuaauauacuaccuauaguuuaauuaucggcacuugu

SEQ ID NO: 349196 - RNA, 64 nt, hsa
cacacacacacacacacacacaaauauugcuuggacuaccuauaaauggacuugcuucuugugu

SEQ ID NO: 349197 - RNA, 64 nt, hsa
ccccuggucuccuccccguagccacucucugcccacuaccuaugcuucuagaaagccccucacc

SEQ ID NO: 349198 - RNA, 64 nt, hsa
ucuuugguguugguuguaacaaaauuugauuugaacuaccuauaaaugaaaagucgggguuuau

SEQ ID NO: 349199 - RNA, 64 nt, hsa
aaaaucacauuucagaauaaaacaauugggcaaaacuaccuaggcuuuacucuugagugucucc

SEQ ID NO: 349200 - RNA, 64 nt, hsa
uaagaagacuuuuuguuguacuaugugcaugcauacuaccuauuucuaaacuuugccauauuga

SEQ ID NO: 349201 - RNA, 64 nt, hsa
ccacaguucuggaaggaucugcagaugauggagaacuaccuaggcuucaucuuuucaacauaug

SEQ ID NO: 349202 - RNA, 64 nt, hsa
ugggguuggaagugugacuucuuacacauaaagcacuaccuaaguaauucucucucuguuuugu

SEQ ID NO: 349203 - RNA, 64 nt, hsa
aucuuaguuccagaauuuagucuuccuuuggaauacuaccuaauucccuuccuuaucauagugg

SEQ ID NO: 349204 - RNA, 64 nt, hsa
uccuucugacuagaaguauguauaauaaaacaauacuaccuaguuaaacauuuacuuucucuuu

SEQ ID NO: 349205 - RNA, 64 nt, hsa
acagaagcacaaguaaauaaaagaaauuuaagucacuaccuaguauacauaaacauauacaaua

SEQ ID NO: 349206 - RNA, 64 nt, hsa
cccaacaucccaggcugugguggcuccugugggaacuaccuagaugaagagaguaucauuuaua

SEQ ID NO: 349207 - RNA, 64 nt, hsa
ggacauauagauuauucguauuauaguuuguagaacuaccuaguucagaaucuugacugccagu

SEQ ID NO: 349208 - RNA, 64 nt, hsa
uuuggaagaugcagaagcaauaauaaaguacuugacuaccuacugguguaaucucaaugcaagc

SEQ ID NO: 349209 - RNA, 64 nt, hsa
gaagaaauuaauggaauauggugugcuaauuaucacuaccuauaacaugaggaauauaacauug

SEQ ID NO: 349210 - RNA, 64 nt, hsa
aagucauuaauuuauacugaaauuggauugacuuacuaccuaacacugagcgcuguuuuuaaau

SEQ ID NO: 349211 - RNA, 64 nt, hsa
cuuguauuagaacauaauaaaaguagagaauuaaacuaccuaaauaaaugcaucaaaaaauaua

SEQ ID NO: 349212 - RNA, 64 nt, hsa
acuucaaaguauuauucaacuucaaguuucagcaacuaccuacaaaagauucuaaggccuagua

SEQ ID NO: 349213 - RNA, 64 nt, hsa
uaaaauuguaagcaauagaauaggaaauaaaacaacuaccuaauacaaauauuucugauaagac

SEQ ID NO: 349214 - RNA, 64 nt, hsa
aggucugagugcaugugugcauuaaaaacauuucacuaccuauucucucauggacuucucaucc

SEQ ID NO: 349215 - RNA, 64 nt, hsa
cauccuuugaguaguaaaggauaaaagcauauauacuaccuauauguaugugcuguaugugggc

SEQ ID NO: 349216 - RNA, 64 nt, hsa
ucagacaagagaucugccauuucaugcccuugugacuaccuaucauuggcccugcaauaaaauc

SEQ ID NO: 349217 - RNA, 64 nt, hsa
uaaaaucaugaggaauggaagaauggaccuugaaacuaccuaggcuuuuaugcauggcaccucu

SEQ ID NO: 349218 - RNA, 64 nt, hsa
gcaugcacacacacagaaccccaaaccacuaaaaacuaccuaaacacugacuuaguaaauagua

SEQ ID NO: 349219 - RNA, 64 nt, hsa
uuucucgugaucagaagccaaaauauaaauacauacuaccuaaaaaaucuugaagagagguaau

SEQ ID NO: 349220 - RNA, 64 nt, hsa
cuuucccuguguuggaaaguuuuuauguauuuaaacuaccuaccaugccuguugugcucaggug

SEQ ID NO: 349221 - RNA, 64 nt, hsa
ggguuuuuuauacuccccaauuuagcauaucuagacuaccuauuugaaaggaacccuaucaacu

SEQ ID NO: 349222 - RNA, 64 nt, hsa
gccugccucucuacuguucccccuuuucuaacacacuaccuagaaaagccauucaguacuggcu

SEQ ID NO: 349223 - RNA, 64 nt, hsa
gggagcugacaauucguggguccgcaaaaucuuaacuaccuaauagccuacuauugaccauaaa

SEQ ID NO: 349224 - RNA, 64 nt, hsa
uauugcugaauauaaugugacacuauggucgaauacuaccuacgaauuauaacauuagaagccu

SEQ ID NO: 349225 - RNA, 64 nt, hsa
ugauagauucccagagcuggauggaucccuagggacuaccuaaucugacuuucuguccacugca

SEQ ID NO: 349226 - RNA, 64 nt, hsa
cagaaguuaacacaaugguuuuuucuaaugaaaaacuaccuauaauaggauaaauuucaagcua

SEQ ID NO: 349227 - RNA, 53 nt, hsa
auuaugaaagaagacguuaauaaacuaccuaacauuauuuauucagcuucauu

SEQ ID NO: 349228 - RNA, 64 nt, hsa
acucugaccacuuaaaaaaaaaucuaaaaauugaacuaccuauaguagucuguguuuaaaguga

SEQ ID NO: 349229 - RNA, 64 nt, hsa
guacauuguuuauauagccaaguguauaugcuuuacuaccuaacaauuauucuagccuagguga

SEQ ID NO: 349230 - RNA, 64 nt, hsa
aauauuuagaaaaacaucccaagaaaaucacaucacuaccuagagucaacucuggccaggaacu

SEQ ID NO: 349231 - RNA, 64 nt, hsa
auagcuccaagcuguuaaagauauuuuuauucaaacuaccuauauuccuuguguaauuaaugcu

SEQ ID NO: 349232 - RNA, 64 nt, hsa
ggaaauucggagcuauacauaugugcagaagguuacuaccuaggguuuaugcuuaauuuuaauu

SEQ ID NO: 349233 - RNA, 64 nt, hsa
uaaauuauauaucagaaaacuuucaauauuggugacuaccuaaaugugauuuuugcugguuacu

SEQ ID NO: 349234 - RNA, 64 nt, hsa
gcuugccaguuccugguucuguguccuuggacaaacuaccuaaccuuucugagccuccuauacc

SEQ ID NO: 349235 - RNA, 64 nt, hsa
aaggaugucccggguguguacaccaagguuaccaacuaccuagacuggauucgugacaacaugc

SEQ ID NO: 349236 - RNA, 64 nt, hsa
uaaauaugcuuuaguuuuaauucaguugggaugcacuaccuagcgaaaauugagaaacuauaua

SEQ ID NO: 349237 - RNA, 64 nt, hsa
guguuucccugccucucaauucgcugaaaaaggaacuaccuauccuuacauuucaccuacuaau

SEQ ID NO: 349238 - RNA, 64 nt, hsa
cuauuuagggaagcuuuuccaagccacaaucuuaacuaccuacccaaaggauuugcauuacccc

SEQ ID NO: 349239 - RNA, 64 nt, hsa
aaguuuggaugaaagugcaagauguggaacaucaacuaccuauuuuccuuggguuuuuccacuc

SEQ ID NO: 349240 - RNA, 64 nt, hsa
aggcagagcugagggcccuguggaguccagcucuacuaccuacguuugcaccgccugcccuccc

SEQ ID NO: 349241 - RNA, 64 nt, hsa
accaacaugaaaguaccacugaaguaaaacaccaacuaccuaccuuacuauaaaggaaauguua

SEQ ID NO: 349242 - RNA, 64 nt, hsa
aguaaaaaguggacaugcuaaacaaauaugagagacuaccuacuuuuucuggucauucuugacu

SEQ ID NO: 349243 - RNA, 64 nt, hsa
aaaccugaaaaaugaauugauauucugagugaaaacuaccuaauauaaauaaaauuagugaaaa

SEQ ID NO: 349244 - RNA, 64 nt, hsa
uucucagugccaucuauaaaauggggauaauagcacuaccuaccaagugcugugaggcucaaau

SEQ ID NO: 349245 - RNA, 64 nt, hsa
caaaaauaagaaaauuaaaauaaucucuaauccuacuaccuagaauaaaacacuauuaauauuu

SEQ ID NO: 349246 - RNA, 64 nt, hsa
ggggcuugauagcugugguccccucuccccucugacuaccuaaaaucaauaccuaaauacagaa

SEQ ID NO: 349247 - RNA, 64 nt, hsa
auaaaauagaauuacuacaauucugcaauuucauacuaccuaaaaaagacuagauuugaaaaug

SEQ ID NO: 349248 - RNA, 64 nt, hsa
uauuauauauguguaugcauuuuacuggcucaaaacuaccuacuucuuucucaggcaucaaaag

SEQ ID NO: 349249 - RNA, 59 nt, hsa
augauaccacacaugguuaauuggaaaauacuaccuacugguuugggagauguauauag

SEQ ID NO: 349250 - RNA, 64 nt, hsa
cucaguguagaggacauuccugucauccaugccaacuaccuaacucguuaucagagcugauaga

SEQ ID NO: 349251 - RNA, 64 nt, hsa
acuugucuuuugguggacauggugcacuaauuucacuaccuauccaggaguggaacugguagag

SEQ ID NO: 349252 - RNA, 64 nt, hsa
gccauuucaauuuugcagcaccauccaagaaacuacuaccuaucaagaaugcugucacaccuuu

SEQ ID NO: 349253 - RNA, 64 nt, hsa
uggaugggcaagaguguacuucuuggcuccauuuacuaccuacugcucaguagucaucucugua

SEQ ID NO: 349254 - RNA, 64 nt, hsa
cgguucucuuguuggugccaguauuacauugaagacuaccuaugauagaggcaauguugcuuug

SEQ ID NO: 349255 - RNA, 64 nt, hsa
uugacugcccacccacagaaaagcaaaauaaccaacuaccuacucaauuguguguuuguaauug

SEQ ID NO: 349256 - RNA, 64 nt, hsa
aaucacgaaaauaauaauaauaaaucuuuaacauacuaccuaaagggaaccugcaauaaucuug

SEQ ID NO: 349257 - RNA, 64 nt, hsa
aaaagaaagaaagaaaccuccagcguauuuuaucacuaccuauagaaagaaauccugcuuugag

SEQ ID NO: 349258 - RNA, 64 nt, hsa
agaagacacgcuuuuuguggaaugaggaaaauguacuaccuagaaaauggccagauuuucagug

SEQ ID NO: 349259 - RNA, 64 nt, hsa
cauucaugcggauacuaguauuuauagaugucugacuaccuaacuuaauuuuuguuuuugaacu

SEQ ID NO: 349260 - RNA, 64 nt, hsa
cucaguuugucuuuuaaaaaacagcugaaucuuuacuaccuauuuaguucuccuuguuaaagaa

SEQ ID NO: 349261 - RNA, 64 nt, hsa
gaaggaguguucuuaggguaaaucuuuuaauaaaacuaccuaucugguuuaugaccacuuagau

SEQ ID NO: 349262 - RNA, 64 nt, hsa
cccccgaaaaccuugaucuuacccaugaaugugcacuaccuacauuuuuuaaauagcuagguuu

SEQ ID NO: 349263 - RNA, 64 nt, hsa
gagaucccagccccuaugaguaggguguuuguggacuaccuaauggaauauuuuugaggccugg

SEQ ID NO: 349264 - RNA, 64 nt, hsa
uguguauauaguauuuccuuguauaaagcacuuuacuaccuaccacuuguguugugaacguuug

SEQ ID NO: 349265 - RNA, 64 nt, hsa
auuuccuucagggacagauuuuccaaccuaagaaacuaccuaccguguguauucucuugacggg

SEQ ID NO: 349266 - RNA, 64 nt, hsa
uagcaaucauuuuggaucacuggacuuucaguggacuaccuaaaacaggggacagcuuuuggaa

SEQ ID NO: 349267 - RNA, 64 nt, hsa
gucccauagaacagaaaugggaugcuagcgugccacuaccuacuugugugauugugggaaauua

SEQ ID NO: 349268 - RNA, 64 nt, hsa
ugcaaauuagcuuuuuaucuucuagcauuuuuuuacuaccuauauggguaaguugaaaagguaa

SEQ ID NO: 349269 - RNA, 64 nt, hsa
accugcacagcucauuuuccuucugaaagaaacuacuaccuaggagaaucuaagcuauagcagg

SEQ ID NO: 349270 - RNA, 64 nt, hsa
uaacaaauuucuucucccuccagacucuuggaugacuaccuagauccccagcuuaccgguuagu

SEQ ID NO: 349271 - RNA, 64 nt, hsa
agacucaguuucuuccucuguaaaaugaggacauacuaccuaccucaugugguugguugaugau

SEQ ID NO: 349272 - RNA, 64 nt, hsa
cuguuauauaauucaguuuuaaauuguaguucaaacuaccuaaaacguuuuuuauuuuugugcu

SEQ ID NO: 349273 - RNA, 64 nt, hsa
agucagcauacccugagugauggcucaggggcgcacuaccuauuuugucaccagagcugacuca

SEQ ID NO: 349274 - RNA, 64 nt, hsa
uucuccuuauccuugccagcacuuguauugccagacuaccuaauuuuugccagucucaugggua

SEQ ID NO: 349275 - RNA, 64 nt, hsa
ucuugguuuucuucauccaugaaauccaaguaauacuaccuaauuguuacuguggagauuaagu

SEQ ID NO: 349276 - RNA, 64 nt, hsa
aucaccccaaggacaacggcacaaguagagagaaacuaccuaccucacuucaaauuauguuugg

SEQ ID NO: 349277 - RNA, 64 nt, hsa
aucaccccaaggacaacggcagaaguagagagaaacuaccuaccucacuucaaauuauguuugg

SEQ ID NO: 349278 - RNA, 64 nt, hsa
cacguuuacacagggugggcugcccccacccugcacuaccuauuuuugugagucuccgugaccc

SEQ ID NO: 349279 - RNA, 64 nt, hsa
auaaucaugggacugccgguggccaucuuuuccuacuaccuagagaaagccagcaaagaaugaa

SEQ ID NO: 349280 - RNA, 64 nt, hsa
ggucggagcauggaaggagggugaggaucaaaaaacuaccuaucugguacuaugcuuuuuaucu

SEQ ID NO: 349281 - RNA, 64 nt, hsa
ugauguuaauggguuaucucaaauuuuaaguuaaacuaccuaaaauaaauaccaaagauaaugc

SEQ ID NO: 349282 - RNA, 64 nt, hsa
accuuaccaccccucagagugcugcuucaccuacacuaccuacaagaucccgcgucagcggauu

SEQ ID NO: 349283 - RNA, 64 nt, hsa
cacccccuccccaaagccacuggaaggagcacauacuaccuagaaguaagaagaggagccucag

SEQ ID NO: 349284 - RNA, 64 nt, hsa
aggagaaauuuugguuuuucaacacugaaaaaauacuaccuauaggaaagucugucagguuugg

SEQ ID NO: 349285 - RNA, 64 nt, hsa
ggaauaugugcuggaaaaauugcaacaacacuuuacuaccuaacggauagcauuuguaaauacu

SEQ ID NO: 349286 - RNA, 64 nt, hsa
caaggaucaaaaauuguggccaucuuugcaaaugacuaccuauagccugugaaaauacauuuca

SEQ ID NO: 349287 - RNA, 64 nt, hsa
aagaacauccguguacccaguacccugacuaccgacuaccuacaacccgucccugccccauccu

SEQ ID NO: 349288 - RNA, 64 nt, hsa
gucuaccuugaguuaaaucccaccucugccaucuacuaccuaagugaccuugggaaggucagaa

SEQ ID NO: 349289 - RNA, 64 nt, hsa
ggucccagagcuggagcuucuugcacugcccuacacuaccuaccaucuccauccucugggcacc

SEQ ID NO: 349290 - RNA, 64 nt, hsa
cccguuuacagaaugcuacaagaauaauguacguacuaccuaaaaggaugucuaaauguuuguu

SEQ ID NO: 349291 - RNA, 64 nt, hsa
gagagcaagaaaaagaugauguagauguugcccuacuaccuaccauuguggaaaaggugauucu

SEQ ID NO: 349292 - RNA, 64 nt, hsa
gucacuggcaucucacuuuaugauagggaaggcuacuaccuagggcacuuuaagucagugacag

SEQ ID NO: 349293 - RNA, 64 nt, hsa
aucuccccucuugucuguggaagauaucacaugaacuaccuaauuuucaagcauggaucuccau

SEQ ID NO: 349294 - RNA, 64 nt, hsa
uaaaauuugcacaugugauugugaagaaauuuguacuaccuaaaagucccagugcaugucucug

SEQ ID NO: 349295 - RNA, 64 nt, hsa
ugcucaaaucuaugggaacaaaagucaagguaucacuaccuagaaguaaugauauacaguuuuc

SEQ ID NO: 349296 - RNA, 64 nt, hsa
ucggccuugugucagcaggucauggucccuagagacuaccuaguuguagugugaccuacauuua

SEQ ID NO: 349297 - RNA, 64 nt, hsa
uggcagaguuuugguuuaagaaaaacaaaccacuacuaccuagcacaaguuaaauuuacaaguc

SEQ ID NO: 349298 - RNA, 64 nt, hsa
ggaaaauuaauucuaaacugagaaaaauguuccuacuaccuauugcugauacugucuuugcaua

SEQ ID NO: 349299 - RNA, 64 nt, hsa; identical to SEQ ID NO: 349298

SEQ ID NO: 349300 - RNA, 64 nt, hsa
gcuuugugugcacaaaauugcuuuuuccaccucggaaaugcagcuuucccuagggggaggccua

SEQ ID NO: 349301 - RNA, 64 nt, hsa
aauuuuagugacaccuuaugccauuucaagaggagaaaugcaggcuggcagagcaauuuccaga

SEQ ID NO: 349302 - RNA, 64 nt, hsa
cgauuucagcuucauuccucugauagaacaaagcgaaaugcagguccaccagggagggagacac

SEQ ID NO: 349303 - RNA, 64 nt, hsa
gagcccugcaaggcagaaaugacagugcaaggaggaaaugcagggaaacucccgagguccagag

SEQ ID NO: 349304 - RNA, 64 nt, hsa
cuacaaauaauugcccccuuuguuuuaaaaagaagaaaugcauauugaaguaguuugaugauuu

SEQ ID NO: 349305 - RNA, 64 nt, hsa
gucuaggccuuugaauggcauaugccauuucugggaaaugcaucuggaggcuaaguauugcuuu

SEQ ID NO: 349306 - RNA, 64 nt, hsa
acucuggguaucucuccuaugggcaaagccauuagaaaugcauaaaaccucgagacaugguuuu

SEQ ID NO: 349307 - RNA, 64 nt, hsa
aaguauuuucuuaauuugaauaauaaaaccagaggaaaugcauacagggcaugagcaacugagg

SEQ ID NO: 349308 - RNA, 64 nt, hsa
aguuuauauuuagcuaaacuguuauguuaauuaagaaaugcauaaaucuucuauucuuaauauu

SEQ ID NO: 349309 - RNA, 64 nt, hsa
uuauaaggaaaacaaauauaauaaccagugcugugaaaugcagaagaaaggcuuguuuugguug

SEQ ID NO: 349310 - RNA, 64 nt, hsa
ugaaaagggaguuucguaagcaaaauagaggacagaaaugcaguucaugaacuugcugguuggu

SEQ ID NO: 349311 - RNA, 64 nt, hsa
cugcuguccuggugacuugucccucuucuuaguggaaaugcauuugagauggugacagggcugg

SEQ ID NO: 349312 - RNA, 64 nt, hsa
aaagaaccaucagcaucacccgggaacuuuuuuagaaaugcaaaaucucuacugcuuuggaucc

SEQ ID NO: 349313 - RNA, 64 nt, hsa
uuuggauccugggucaaaaaaaagaaaaaaaaaagaaaugcaaaacuuuaggcccugccccaga

SEQ ID NO: 349314 - RNA, 64 nt, hsa
augaagauguggaaaccaaugaaaaguacauuuagaaaugcaggcuuuuuaguagaaagaagcu

SEQ ID NO: 349315 - RNA, 64 nt, hsa
ccccagagcaguccucaacacuaugucagugcuggaaaugcagccacuggcagaucuggccccc

SEQ ID NO: 349316 - RNA, 64 nt, hsa
ugacagcagugaaacuccuccucacuggaaagaggaaaugcagagauuaagagcauauagacca

SEQ ID NO: 349317 - RNA, 64 nt, hsa
uccccagcaaaaguagaggagacuuccccucuaggaaaugcacggcuugauaccccagauauaa

SEQ ID NO: 349318 - RNA, 64 nt, hsa
aggugcaaaagcccacauauugucugacugcauugaaaugcaaugucuaaaauggacgaaucua

SEQ ID NO: 349319 - RNA, 64 nt, hsa
caugaaaaaauacucaacauuauuauucauuagggaaaugcaagucaaaaucacaaugagauuc

SEQ ID NO: 349320 - RNA, 64 nt, hsa
cagaaauugauaagcuagucccaaaauucauaaagaaaugcaagggacccagaauauccaaaua

SEQ ID NO: 349321 - RNA, 64 nt, hsa
auuuuuaaaaugcucaacauuaacuauucauacagaaaugcaaaucaaaaccacaaugagauau

SEQ ID NO: 349322 - RNA, 64 nt, hsa
aaauauaaaauaguaaaauuucacuaaauuuagagaaaugcacaugguaauaaaaaguauaaau

SEQ ID NO: 349323 - RNA, 64 nt, hsa
ccacauaaaugcaggaagaacuuagacaaugccugaaaugcaaaggcgacacuggagucuucuu

SEQ ID NO: 349324 - RNA, 64 nt, hsa
gcugggugguugcacaggccaggugcacagguuggaaaugcacugaacucugggugccgagaga

SEQ ID NO: 349325 - RNA, 64 nt, hsa
uuuggagaacuuaauuaacgugagauuggcaauugaaaugcaggugcaguuuucuguuaauguc

SEQ ID NO: 349326 - RNA, 64 nt, hsa
gauuucguauucuaguagucaauguauuuucagugaaaugcaaaaauauucccguuaucuuuga

SEQ ID NO: 349327 - RNA, 64 nt, hsa
uauaaaaauacugcaaaaccaggaguugaugguagaaaugcauaugauccauggcaggaguaaa

SEQ ID NO: 349328 - RNA, 64 nt, hsa
uaaauuuucaugagaauucuaaaaugaauccugggaaaugcacguuuggugauguugcacuuuc

SEQ ID NO: 349329 - RNA, 64 nt, hsa
ucagaauaucagaaucuucuuagaaauaaacuaggaaaugcagauguuuuuaacuacucagacu

SEQ ID NO: 349330 - RNA, 64 nt, hsa
cuaaacuaucagucauuuacauccucucaugaaugaaaugcaguguagggagaggagauggcag

SEQ ID NO: 349331 - RNA, 64 nt, hsa
accacuauguauauauguuuaauaucugucuuuugaaaugcagaaauaguuuaaauguuucuuu

SEQ ID NO: 349332 - RNA, 64 nt, hsa
uguuaaaguaauauuuuauuaucuacauaaaacagaaaugcacaauaccuucauaguuuguucu

SEQ ID NO: 349333 - RNA, 64 nt, hsa
cuaccugcccgguuccuuuccugaggacccggcagaaaugcagaaccauccauggacugugauu

SEQ ID NO: 349334 - RNA, 64 nt, hsa
auauuugcucuagaagaaaaaaaaaaaaggaggggaaaugcauuuuccccagagauaaaggcug

SEQ ID NO: 349335 - RNA, 64 nt, hsa
uuuauagaaugugaagacccaguggaucauguuggaaaugcaacugcaucccaggaacuugguu

SEQ ID NO: 349336 - RNA, 64 nt, hsa
aucucuuuuugaucaaacaagaaaaggcauuugggaaaugcaaagaggacugagaauacuuugg

SEQ ID NO: 349337 - RNA, 64 nt, hsa
uaaaccuggguuuuguucauauuuucuccagacagaaaugcaaagaucaaacugugcaaauauu

SEQ ID NO: 349338 - RNA, 64 nt, hsa
ugacuuucucucaacugcaguuuucuuaaucuuugaaaugcaaauaauguuuaucucagaagac

SEQ ID NO: 349339 - RNA, 64 nt, hsa
cauagaacugagugcugagaauccaggauggaaagaaaugcagaacuaucauagucacauacau

SEQ ID NO: 349340 - RNA, 64 nt, hsa
uguacuugaagguuuuauauuuaaaaguauuuuugaaaugcaauguguccccucucaccuuauu

SEQ ID NO: 349341 - RNA, 64 nt, hsa
gaaacaccagauagaagaucuuaggagaggcccagaaaugcaucaccuugucaugacaaaagag

SEQ ID NO: 349342 - RNA, 64 nt, hsa
agaaguaggcuaaggcagaccacccacuucugcugaaaugcauugggagccugugaaagcacaa

SEQ ID NO: 349343 - RNA, 64 nt, hsa
acuaugugcuuuuuuuuuuuaaccauaguucaucgaaaugcagcuuuuucugaacuucaaagau

SEQ ID NO: 349344 - RNA, 64 nt, hsa
uuggauuagcugugccuuucauuacuuuguuacagaaaugcagugacuuauacuaagacaauuu

SEQ ID NO: 349345 - RNA, 64 nt, hsa
acauguugaaauuuuaaaaauuaauguuaauauggaaaugcauuuagagaagcccaguaguuuu

SEQ ID NO: 349346 - RNA, 64 nt, hsa
uccuaaaguuucuucaaguauuuuuuaagguggagaaaugcaggaauuguauaaccagaauugu

SEQ ID NO: 349347 - RNA, 64 nt, hsa
gcauucagaccaaccaucauuaauguuaauagaggaaaugcagcaacgucaaaagcaaggcagg

SEQ ID NO: 349348 - RNA, 64 nt, hsa
ucacugcuucagcagugaagacccauggcaccuagaaaugcaugccagcuuccugcgucuacca

SEQ ID NO: 349349 - RNA, 64 nt, hsa
uugcagguuuuguguuuuaucaucagugcuuuuagaaaugcaggccuuaacuuacugaacugaa

SEQ ID NO: 349350 - RNA, 64 nt, hsa
ucacaugucacuuaaugauagggaaacauucugagaaaugcauuguaaggugacuuuauugugu

SEQ ID NO: 349351 - RNA, 64 nt, hsa
ggaaaaauggguucaagcuuuccuauuagccauggaaaugcaaaguuuagcagaagcaagcaau

SEQ ID NO: 349352 - RNA, 64 nt, hsa
aguaguaagauuuuaaucaaacacgaccagguccgaaaugcaggucaugagugugaaauucuca

SEQ ID NO: 349353 - RNA, 64 nt, hsa
ggcccugaggcugaaaugugcccauguguucuaagaaaugcagcgaugcuggugugccuggagc

SEQ ID NO: 349354 - RNA, 64 nt, hsa
cagacuuguucuuuuuacauaaaggaauuuguaggaaaugcagccaaaggugcagucggaaaag

SEQ ID NO: 349355 - RNA, 64 nt, hsa
acacagaaaugcacaggggacacuuacggacacagaaaugcacaggggaggccgagcauaacca

SEQ ID NO: 349356 - RNA, 64 nt, hsa
ugucuacaggguuuauaguagucuuguggacacagaaaugcacaggggacacuuacggacacag

SEQ ID NO: 349357 - RNA, 58 nt, hsa
ugugcccucagauguguugacagcugcucuucugaauugccacaccugugcuacacuu

SEQ ID NO: 349358 - RNA, 58 nt, hsa
ccuaaggcccuucaagaucucaaagugccuucugaagcaucagagauuaaauauuguu

SEQ ID NO: 349359 - RNA, 58 nt, hsa
uauaugaugcugagucuguggaaugauacuucugaaaucaaaauuccucauaaggcau

SEQ ID NO: 349360 - RNA, 58 nt, hsa
uauccuuuuaaauuaugcuaauucucuucuucugaaauuauggucacacuauauacua

SEQ ID NO: 349361 - RNA, 58 nt, hsa
uccauuauagcaauguuagugccaccaccuucugaacacaguggggagggcugugaag

SEQ ID NO: 349362 - RNA, 58 nt, hsa
ggcuggcauauuaacaccugccuucuggcuucugaaagugagauuuguauaugggcug

SEQ ID NO: 349363 - RNA, 58 nt, hsa
auuagcuagaauaugaccauuaaaugugcuucugaaauauauuuugagauagguuuag

SEQ ID NO: 349364 - RNA, 58 nt, hsa
auaguuuucucaaccauuuaaaaauauucuucugaacucaucaaaguagaagagcccc

SEQ ID NO: 349365 - RNA, 58 nt, hsa
cacuacccuggucccugauugcaaggagcuucugaagcaagggugaauccuucccaca

SEQ ID NO: 349366 - RNA, 58 nt, hsa
agcagcccaaccaauccccaauccuuuucuucugaaacugagcaggaaggguaaggaa

SEQ ID NO: 349367 - RNA, 58 nt, hsa
cccuuggcguugccuauggcaccuuucccuucugaaagucugguuccugcccagugac

SEQ ID NO: 349368 - RNA, 58 nt, hsa
aaaucaaggugucagcagagcugugcuccuucugaaggcucuagggagaagccgguuc

SEQ ID NO: 349369 - RNA, 58 nt, hsa
gaagcuuuuuuuuuuaaaaaauguauugcuucugaacuuuuuucugccacugcucccu

SEQ ID NO: 349370 - RNA, 58 nt, hsa
guucaaacauaauaccaucuuuuugcuucuucugaacuuuagaucuccauaacacaug

SEQ ID NO: 349371 - RNA, 58 nt, hsa
gaauucagaaaaccacuuaagcaagacccuucugaaauaaaaaauguugcuuuuuaaa

SEQ ID NO: 349372 - RNA, 58 nt, hsa
aaaagcaaaucaacacuuuauaguuauucuucugaacuaagacaugucaauauucuuu

SEQ ID NO: 349373 - RNA, 58 nt, hsa
uguagcuucuucugaaagaauuauuugccuucugaaaugugacccccaaguccuaucc

SEQ ID NO: 349374 - RNA, 58 nt, hsa
uacccauagaaaacuugacauguagcuucuucugaaagaauuauuugccuucugaaau

SEQ ID NO: 349375 - RNA, 58 nt, hsa
aacauuuuaauacagauugaaaggaccucuucugaagcuagaaacaaucuauaguuau

SEQ ID NO: 349376 - RNA, 58 nt, hsa
uauuuggaauuuuaaguucuaucagugacuucugaauccuuagaauggccucuuugua

SEQ ID NO: 349377 - RNA, 58 nt, hsa
ccaagaaauacuuuuuauugcugggagucuucugaaccucaccaaacugaggccagag

SEQ ID NO: 349378 - RNA, 58 nt, hsa
cccucccuaagcuccagggucccugaaucuucugaaaucucaaaugaguggaggccuc

SEQ ID NO: 349379 - RNA, 58 nt, hsa
aagagcucaaaagcagaaauggccaggccuucugaaaacuuaaguccagaauugucac

SEQ ID NO: 349380 - RNA, 58 nt, hsa
uggccuccuuggauucuucugacuuuggcuucugaaaggaaggccuagauccagcccu

SEQ ID NO: 349381 - RNA, 58 nt, hsa
aaaggcgcuucauguccaguguguggcccuucugaaacuuauggucaucucucccacu

SEQ ID NO: 349382 - RNA, 58 nt, hsa
aauuuugucuccugcuuggaaagucucucuucugaaccuggagccugaauacauuuuc

SEQ ID NO: 349383 - RNA, 58 nt, hsa
gucuucuuuucauuuuugauuagaggaacuucugaacuuggaaaggggaaguuggcag

SEQ ID NO: 349384 - RNA, 58 nt, hsa
uuuagaugauaaggcuacaauucagaaucuucugaaccaucuauguaaugaaugggga

SEQ ID NO: 349385 - RNA, 58 nt, hsa
uuagaacaaacccuuuuugaucuuaaugcuucugaaaacuaggucugacucuggggau

SEQ ID NO: 349386 - RNA, 58 nt, hsa
aauaaacauauuuuuuuuacaaaaauaacuucugaauuuaucaguguuuugccguuaa

SEQ ID NO: 349387 - RNA, 58 nt, hsa
auauauaaccgugauugucucugcuuuucuucugaaauguagauaacugcuuuuugac

SEQ ID NO: 349388 - RNA, 58 nt, hsa
gggcuguuacuuuuaaagucaaaauuuucuucugaaggcucauuuugguauuugaucu

SEQ ID NO: 349389 - RNA, 58 nt, hsa
caaagccauucuuaagagucgugagguccuucugaauguaaaacuggagcccaggaga

SEQ ID NO: 349390 - RNA, 58 nt, hsa
ucucucccaaaucacuaaguuuaauauacuucugaaguuuacaucaguuuuauuuuaa

SEQ ID NO: 349391 - RNA, 58 nt, hsa
gaguagaaaacuaugaaugugggauagccuucugaaaaagccacaaauuuaugaaaca

SEQ ID NO: 349392 - RNA, 58 nt, hsa
ucagugaggaaaucucuuccaauuucugcuucugaaugauucaauguugggagcaaua

SEQ ID NO: 349393 - RNA, 58 nt, hsa
aguugagggaaggagcuguauuguggcacuucugaauuccccguuuuguuccauauug

SEQ ID NO: 349394 - RNA, 58 nt, hsa
aggggacgauggaauacccagaacgcuccuucugaagaaauggggcccuguagcugca

SEQ ID NO: 349395 - RNA, 58 nt, hsa
aaaccuuuccuacuucaaacaggcuucucuucugaaaugaugacuuaaugucgaauau

SEQ ID NO: 349396 - RNA, 64 nt, hsa; identical to SEQ ID NO: 47016

SEQ ID NO: 349397 - RNA, 64 nt, hsa; identical to SEQ ID NO: 47017

SEQ ID NO: 349398 - RNA, 64 nt, hsa; identical to SEQ ID NO: 47018

SEQ ID NO: 349399 - RNA, 64 nt, hsa; identical to SEQ ID NO: 47019

SEQ ID NO: 349400 - RNA, 64 nt, hsa; identical to SEQ ID NO: 47020

SEQ ID NO: 349401 - RNA, 64 nt, hsa; identical to SEQ ID NO: 47021

SEQ ID NO: 349402 - RNA, 64 nt, hsa; identical to SEQ ID NO: 47022

SEQ ID NO: 349403 - RNA, 64 nt, hsa; identical to SEQ ID NO: 47023

SEQ ID NO: 349404 - RNA, 64 nt, hsa; identical to SEQ ID NO: 47024

SEQ ID NO: 349405 - RNA, 64 nt, hsa; identical to SEQ ID NO: 47025

SEQ ID NO: 349406 - RNA, 64 nt, hsa; identical to SEQ ID NO: 47026

SEQ ID NO: 349407 - RNA, 64 nt, hsa; identical to SEQ ID NO: 47027

SEQ ID NO: 349408 - RNA, 64 nt, hsa; identical to SEQ ID NO: 47028

SEQ ID NO: 349409 - RNA, 64 nt, hsa; identical to SEQ ID NO: 47029

SEQ ID NO: 349410 - RNA, 64 nt, hsa; identical to SEQ ID NO: 47030

SEQ ID NO: 349411 - RNA, 64 nt, hsa; identical to SEQ ID NO: 47031

SEQ ID NO: 349412 - RNA, 64 nt, hsa; identical to SEQ ID NO: 47032

SEQ ID NO: 349413 - RNA, 64 nt, hsa; identical to SEQ ID NO: 47033

SEQ ID NO: 349414 - RNA, 64 nt, hsa; identical to SEQ ID NO: 47034

SEQ ID NO: 349415 - RNA, 64 nt, hsa; identical to SEQ ID NO: 47035

SEQ ID NO: 349416 - RNA, 64 nt, hsa; identical to SEQ ID NO: 47036

SEQ ID NO: 349417 - RNA, 64 nt, hsa; identical to SEQ ID NO: 47037

SEQ ID NO: 349418 - RNA, 64 nt, hsa; identical to SEQ ID NO: 47038

SEQ ID NO: 349419 - RNA, 64 nt, hsa; identical to SEQ ID NO: 47039

SEQ ID NO: 349420 - RNA, 64 nt, hsa; identical to SEQ ID NO: 47040

SEQ ID NO: 349421 - RNA, 64 nt, hsa; identical to SEQ ID NO: 47041

SEQ ID NO: 349422 - RNA, 64 nt, hsa; identical to SEQ ID NO: 47042

SEQ ID NO: 349423 - RNA, 64 nt, hsa; identical to SEQ ID NO: 47043

SEQ ID NO: 349424 - RNA, 64 nt, hsa; identical to SEQ ID NO: 47044

SEQ ID NO: 349425 - RNA, 64 nt, hsa; identical to SEQ ID NO: 47045

SEQ ID NO: 349426 - RNA, 64 nt, hsa; identical to SEQ ID NO: 47046

SEQ ID NO: 349427 - RNA, 64 nt, hsa; identical to SEQ ID NO: 47047

SEQ ID NO: 349428 - RNA, 64 nt, hsa; identical to SEQ ID NO: 47048

SEQ ID NO: 349429 - RNA, 64 nt, hsa; identical to SEQ ID NO: 47049

SEQ ID NO: 349430 - RNA, 64 nt, hsa; identical to SEQ ID NO: 47050

SEQ ID NO: 349431 - RNA, 64 nt, hsa; identical to SEQ ID NO: 47051

SEQ ID NO: 349432 - RNA, 64 nt, hsa; identical to SEQ ID NO: 47052

SEQ ID NO: 349433 - RNA, 64 nt, hsa; identical to SEQ ID NO: 47053

SEQ ID NO: 349434 - RNA, 64 nt, hsa; identical to SEQ ID NO: 47054

SEQ ID NO: 349435 - RNA, 51 nt, hsa; identical to SEQ ID NO: 47055

SEQ ID NO: 349436 - RNA, 64 nt, hsa; identical to SEQ ID NO: 47056

SEQ ID NO: 349437 - RNA, 64 nt, hsa; identical to SEQ ID NO: 47057

SEQ ID NO: 349438 - RNA, 64 nt, hsa; identical to SEQ ID NO: 47058

SEQ ID NO: 349439 - RNA, 64 nt, hsa; identical to SEQ ID NO: 47059

SEQ ID NO: 349440 - RNA, 64 nt, hsa; identical to SEQ ID NO: 47060

SEQ ID NO: 349441 - RNA, 64 nt, hsa; identical to SEQ ID NO: 47061

SEQ ID NO: 349442 - RNA, 64 nt, hsa; identical to SEQ ID NO: 47062

SEQ ID NO: 349443 - RNA, 64 nt, hsa; identical to SEQ ID NO: 47063

SEQ ID NO: 349444 - RNA, 64 nt, hsa; identical to SEQ ID NO: 47064

SEQ ID NO: 349445 - RNA, 64 nt, hsa; identical to SEQ ID NO: 47065

SEQ ID NO: 349446 - RNA, 64 nt, hsa; identical to SEQ ID NO: 47066

SEQ ID NO: 349447 - RNA, 64 nt, hsa; identical to SEQ ID NO: 47067

SEQ ID NO: 349448 - RNA, 64 nt, hsa; identical to SEQ ID NO: 47068

SEQ ID NO: 349449 - RNA, 64 nt, hsa; identical to SEQ ID NO: 47069

SEQ ID NO: 349450 - RNA, 64 nt, hsa; identical to SEQ ID NO: 47070

SEQ ID NO: 349451 - RNA, 64 nt, hsa; identical to SEQ ID NO: 47071

SEQ ID NO: 349452 - RNA, 64 nt, hsa; identical to SEQ ID NO: 47072

SEQ ID NO: 349453 - RNA, 64 nt, hsa; identical to SEQ ID NO: 47073

SEQ ID NO: 349454 - RNA, 64 nt, hsa; identical to SEQ ID NO: 47074

SEQ ID NO: 349455 - RNA, 64 nt, hsa; identical to SEQ ID NO: 47075

SEQ ID NO: 349456 - RNA, 64 nt, hsa; identical to SEQ ID NO: 47076

SEQ ID NO: 349457 - RNA, 64 nt, hsa; identical to SEQ ID NO: 47077

SEQ ID NO: 349458 - RNA, 64 nt, hsa; identical to SEQ ID NO: 47078

SEQ ID NO: 349459 - RNA, 64 nt, hsa; identical to SEQ ID NO: 47079

SEQ ID NO: 349460 - RNA, 64 nt, hsa; identical to SEQ ID NO: 47080

SEQ ID NO: 349461 - RNA, 64 nt, hsa; identical to SEQ ID NO: 47081

SEQ ID NO: 349462 - RNA, 64 nt, hsa; identical to SEQ ID NO: 47082

SEQ ID NO: 349463 - RNA, 64 nt, hsa; identical to SEQ ID NO: 47083

SEQ ID NO: 349464 - RNA, 64 nt, hsa; identical to SEQ ID NO: 334556

SEQ ID NO: 349465 - RNA, 64 nt, hsa; identical to SEQ ID NO: 334557

SEQ ID NO: 349466 - RNA, 64 nt, hsa
uccauccuacuucccucaauugaaucagguaacacuaacggaucaaggcagggccagagggugg

SEQ ID NO: 349467 - RNA, 64 nt, hsa
uugcuucuuccuuugaauucucuaaaauaggcagcuaacggauuauauacuucaggguuuggcu

SEQ ID NO: 349468 - RNA, 64 nt, hsa
acgguggaaacccgaggauguguggguuucccagcuaacggacaagcuccccugccacacccag

SEQ ID NO: 349469 - RNA, 64 nt, hsa
uccucaucuguugugauauacaccaauggauaaacuaacggaaacugcuuuuugacauuaaaag

SEQ ID NO: 349470 - RNA, 64 nt, hsa
aaaaacaauaauuuggaaaaacccaugaagguaacuaacggaaggaaaaacuaagagaaugaaa

SEQ ID NO: 349471 - RNA, 64 nt, hsa
uuuuuuuuuuuuuuuuuuucauccugugguuuuucuaacggacuuucaggaauuuuguaaucuc

SEQ ID NO: 349472 - RNA, 64 nt, hsa
guguuggcggggcggucgcagacuucaggguccccuaacggaaaggccaggcuccgcguggacg

SEQ ID NO: 349473 - RNA, 64 nt, hsa
acaggaaguaggaacaugcauacacgaagaaaugcuaacggaaggauuuguuauguuuaggauc

SEQ ID NO: 349474 - RNA, 64 nt, hsa
aaaaagucucccucagaaaguacugaggagaaagcuaacggaacacauccaaagaccaucaguc

SEQ ID NO: 349475 - RNA, 64 nt, hsa
cucugauggcaagacuuggccccuccaccugucccuaacggacggcaggucaggaaagccagga

SEQ ID NO: 349476 - RNA, 64 nt, hsa
ugucacuuccuagaaggggaagggaacucugggucuaacggaguccacuccugggcccacugug

SEQ ID NO: 349477 - RNA, 64 nt, hsa
gcacgauuaaaauccaguuguauauaauggacagcuaacggaacaauauaaucaccacaaugca

SEQ ID NO: 349478 - RNA, 64 nt, hsa
ugaccuguguguucccagcacacgaacagugccccuaacggagauuuguucagcgacugaauau

SEQ ID NO: 349479 - RNA, 64 nt, hsa
augugcuggaaaaauugcaacaacacuuuacuaccuaacggauagcauuuguaaauacucuagg

SEQ ID NO: 349480 - RNA, 64 nt, hsa
guguacuuuguugcuauuuaaaacuguaucaacucuaacggaagaauaaauuauuugugauuuu

SEQ ID NO: 349481 - RNA, 64 nt, hsa
ucacuuguaagucaccgccaguaccuaaguuaggcuaacggagacuuugacaggacuggauuuu

SEQ ID NO: 349482 - RNA, 55 nt, hsa
auuucuccaaacacaauuaggcuggcuaacggauagugagcuugugccccugccu

SEQ ID NO: 349483 - RNA, 64 nt, hsa
augccucauccagagcuccucugaagccagggggcuaacggauguuguguggaguccuggcugg

SEQ ID NO: 349484 - RNA, 64 nt, hsa
uuuuuuuuuuuuuuaaagaaaaguucuuaaaacacuaacggaaacccauggaguuuguccuuug

SEQ ID NO: 349485 - RNA, 64 nt, hsa
ugcgguaggagugccgccucuacccacuugugaugggguacagaggcacuugcucuucugcaug

SEQ ID NO: 349486 - RNA, 64 nt, hsa
gaaugagccggcuggucccccagaaagcuggagugggguacagaguucaguuuuccucucuguu

SEQ ID NO: 349487 - RNA, 64 nt, hsa
gaacuucagaaucucacuuacagcaggcgacacggggguacaccgaugggucacacugggucug

SEQ ID NO: 349488 - RNA, 64 nt, hsa
cugggggugccgcuccucacucaaccccaggcuagggguacaccugacccagcuggccucggcc

SEQ ID NO: 349489 - RNA, 64 nt, hsa
gagcccaaggcccccucggccuccugggcaacuugggguacacaggauacugggggugccgcuc

SEQ ID NO: 349490 - RNA, 64 nt, hsa
uguggugcgcccuggauugagaaccaccacccgagggguacagccccucucuuccaaccgagaa

SEQ ID NO: 349491 - RNA, 64 nt, hsa
acugcuccuacuuccugugguucgagaaugacaugggguacaaacuccagaugaucgaggugcc

SEQ ID NO: 349492 - RNA, 64 nt, hsa; identical to SEQ ID NO: 209887

SEQ ID NO: 349493 - RNA, 64 nt, hsa; identical to SEQ ID NO: 209888

SEQ ID NO: 349494 - RNA, 64 nt, hsa; identical to SEQ ID NO: 209889

SEQ ID NO: 349495 - RNA, 64 nt, hsa; identical to SEQ ID NO: 209890

SEQ ID NO: 349496 - RNA, 64 nt, hsa; identical to SEQ ID NO: 209891

SEQ ID NO: 349497 - RNA, 64 nt, hsa; identical to SEQ ID NO: 209892

SEQ ID NO: 349498 - RNA, 64 nt, hsa; identical to SEQ ID NO: 209893

SEQ ID NO: 349499 - RNA, 64 nt, hsa; identical to SEQ ID NO: 209894

SEQ ID NO: 349500 - RNA, 64 nt, hsa; identical to SEQ ID NO: 209895

SEQ ID NO: 349501 - RNA, 64 nt, hsa; identical to SEQ ID NO: 209896

SEQ ID NO: 349502 - RNA, 64 nt, hsa; identical to SEQ ID NO: 209897

SEQ ID NO: 349503 - RNA, 64 nt, hsa; identical to SEQ ID NO: 209898

SEQ ID NO: 349504 - RNA, 64 nt, hsa; identical to SEQ ID NO: 209899

SEQ ID NO: 349505 - RNA, 64 nt, hsa; identical to SEQ ID NO: 209900

SEQ ID NO: 349506 - RNA, 64 nt, hsa; identical to SEQ ID NO: 209901

SEQ ID NO: 349507 - RNA, 64 nt, hsa; identical to SEQ ID NO: 209902

SEQ ID NO: 349508 - RNA, 64 nt, hsa; identical to SEQ ID NO: 209903

SEQ ID NO: 349509 - RNA, 64 nt, hsa; identical to SEQ ID NO: 209904

SEQ ID NO: 349510 - RNA, 64 nt, hsa; identical to SEQ ID NO: 209905

SEQ ID NO: 349511 - RNA, 64 nt, hsa; identical to SEQ ID NO: 209906

SEQ ID NO: 349512 - RNA, 64 nt, hsa; identical to SEQ ID NO: 209907

SEQ ID NO: 349513 - RNA, 64 nt, hsa; identical to SEQ ID NO: 209908

SEQ ID NO: 349514 - RNA, 64 nt, hsa; identical to SEQ ID NO: 209909

SEQ ID NO: 349515 - RNA, 64 nt, hsa; identical to SEQ ID NO: 209910

SEQ ID NO: 349516 - RNA, 64 nt, hsa; identical to SEQ ID NO: 209911

SEQ ID NO: 349517 - RNA, 64 nt, hsa; identical to SEQ ID NO: 209912

SEQ ID NO: 349518 - RNA, 64 nt, hsa; identical to SEQ ID NO: 209913

SEQ ID NO: 349519 - RNA, 64 nt, hsa; identical to SEQ ID NO: 209914

SEQ ID NO: 349520 - RNA, 64 nt, hsa; identical to SEQ ID NO: 209915

SEQ ID NO: 349521 - RNA, 64 nt, hsa; identical to SEQ ID NO: 209916

SEQ ID NO: 349522 - RNA, 64 nt, hsa; identical to SEQ ID NO: 225055

SEQ ID NO: 349523 - RNA, 64 nt, hsa; identical to SEQ ID NO: 225056

SEQ ID NO: 349524 - RNA, 64 nt, hsa; identical to SEQ ID NO: 225057

SEQ ID NO: 349525 - RNA, 64 nt, hsa; identical to SEQ ID NO: 225058

SEQ ID NO: 349526 - RNA, 64 nt, hsa; identical to SEQ ID NO: 225059

SEQ ID NO: 349527 - RNA, 64 nt, hsa; identical to SEQ ID NO: 225060

SEQ ID NO: 349528 - RNA, 64 nt, hsa; identical to SEQ ID NO: 225061

SEQ ID NO: 349529 - RNA, 64 nt, hsa; identical to SEQ ID NO: 225062

SEQ ID NO: 349530 - RNA, 64 nt, hsa; identical to SEQ ID NO: 225063

SEQ ID NO: 349531 - RNA, 64 nt, hsa; identical to SEQ ID NO: 225064

SEQ ID NO: 349532 - RNA, 64 nt, hsa; identical to SEQ ID NO: 225065

SEQ ID NO: 349533 - RNA, 64 nt, hsa; identical to SEQ ID NO: 225066

SEQ ID NO: 349534 - RNA, 64 nt, hsa; identical to SEQ ID NO: 225067

SEQ ID NO: 349535 - RNA, 64 nt, hsa; identical to SEQ ID NO: 225068

SEQ ID NO: 349536 - RNA, 64 nt, hsa; identical to SEQ ID NO: 225069

SEQ ID NO: 349537 - RNA, 64 nt, hsa; identical to SEQ ID NO: 225070

SEQ ID NO: 349538 - RNA, 64 nt, hsa; identical to SEQ ID NO: 225071

SEQ ID NO: 349539 - RNA, 64 nt, hsa; identical to SEQ ID NO: 225072

SEQ ID NO: 349540 - RNA, 64 nt, hsa; identical to SEQ ID NO: 225073

SEQ ID NO: 349541 - RNA, 64 nt, hsa; identical to SEQ ID NO: 225074

SEQ ID NO: 349542 - RNA, 64 nt, hsa; identical to SEQ ID NO: 225075

SEQ ID NO: 349543 - RNA, 64 nt, hsa; identical to SEQ ID NO: 225076

SEQ ID NO: 349544 - RNA, 64 nt, hsa; identical to SEQ ID NO: 225077

SEQ ID NO: 349545 - RNA, 64 nt, hsa; identical to SEQ ID NO: 225078

SEQ ID NO: 349546 - RNA, 64 nt, hsa; identical to SEQ ID NO: 209887

SEQ ID NO: 349547 - RNA, 64 nt, hsa; identical to SEQ ID NO: 209888

SEQ ID NO: 349548 - RNA, 64 nt, hsa; identical to SEQ ID NO: 209889

SEQ ID NO: 349549 - RNA, 64 nt, hsa; identical to SEQ ID NO: 209890

SEQ ID NO: 349550 - RNA, 64 nt, hsa; identical to SEQ ID NO: 209891

SEQ ID NO: 349551 - RNA, 64 nt, hsa; identical to SEQ ID NO: 209892

SEQ ID NO: 349552 - RNA, 64 nt, hsa; identical to SEQ ID NO: 209893

SEQ ID NO: 349553 - RNA, 64 nt, hsa; identical to SEQ ID NO: 209894

SEQ ID NO: 349554 - RNA, 64 nt, hsa; identical to SEQ ID NO: 209895

SEQ ID NO: 349555 - RNA, 64 nt, hsa; identical to SEQ ID NO: 209896

SEQ ID NO: 349556 - RNA, 64 nt, hsa; identical to SEQ ID NO: 209897

SEQ ID NO: 349557 - RNA, 64 nt, hsa; identical to SEQ ID NO: 209898

SEQ ID NO: 349558 - RNA, 64 nt, hsa; identical to SEQ ID NO: 209899

SEQ ID NO: 349559 - RNA, 64 nt, hsa; identical to SEQ ID NO: 209900

SEQ ID NO: 349560 - RNA, 64 nt, hsa; identical to SEQ ID NO: 209901

SEQ ID NO: 349561 - RNA, 64 nt, hsa; identical to SEQ ID NO: 209902

SEQ ID NO: 349562 - RNA, 64 nt, hsa; identical to SEQ ID NO: 209903

SEQ ID NO: 349563 - RNA, 64 nt, hsa; identical to SEQ ID NO: 209904

SEQ ID NO: 349564 - RNA, 64 nt, hsa; identical to SEQ ID NO: 209905

SEQ ID NO: 349565 - RNA, 64 nt, hsa; identical to SEQ ID NO: 209906

SEQ ID NO: 349566 - RNA, 64 nt, hsa; identical to SEQ ID NO: 209907

SEQ ID NO: 349567 - RNA, 64 nt, hsa; identical to SEQ ID NO: 209908

SEQ ID NO: 349568 - RNA, 64 nt, hsa; identical to SEQ ID NO: 209909

SEQ ID NO: 349569 - RNA, 64 nt, hsa; identical to SEQ ID NO: 209910

SEQ ID NO: 349570 - RNA, 64 nt, hsa; identical to SEQ ID NO: 209911

SEQ ID NO: 349571 - RNA, 64 nt, hsa; identical to SEQ ID NO: 209912

SEQ ID NO: 349572 - RNA, 64 nt, hsa; identical to SEQ ID NO: 209913

SEQ ID NO: 349573 - RNA, 64 nt, hsa; identical to SEQ ID NO: 209914

SEQ ID NO: 349574 - RNA, 64 nt, hsa; identical to SEQ ID NO: 209915

SEQ ID NO: 349575 - RNA, 64 nt, hsa; identical to SEQ ID NO: 209916

SEQ ID NO: 349576 - RNA, 64 nt, hsa; identical to SEQ ID NO: 225055

SEQ ID NO: 349577 - RNA, 64 nt, hsa; identical to SEQ ID NO: 225056

SEQ ID NO: 349578 - RNA, 64 nt, hsa; identical to SEQ ID NO: 225057

SEQ ID NO: 349579 - RNA, 64 nt, hsa; identical to SEQ ID NO: 225058

SEQ ID NO: 349580 - RNA, 64 nt, hsa; identical to SEQ ID NO: 225059

SEQ ID NO: 349581 - RNA, 64 nt, hsa; identical to SEQ ID NO: 225060

SEQ ID NO: 349582 - RNA, 64 nt, hsa; identical to SEQ ID NO: 225061

SEQ ID NO: 349583 - RNA, 64 nt, hsa; identical to SEQ ID NO: 225062

SEQ ID NO: 349584 - RNA, 64 nt, hsa; identical to SEQ ID NO: 225063

SEQ ID NO: 349585 - RNA, 64 nt, hsa; identical to SEQ ID NO: 225064

SEQ ID NO: 349586 - RNA, 64 nt, hsa; identical to SEQ ID NO: 225065

SEQ ID NO: 349587 - RNA, 64 nt, hsa; identical to SEQ ID NO: 225066

SEQ ID NO: 349588 - RNA, 64 nt, hsa; identical to SEQ ID NO: 225067

SEQ ID NO: 349589 - RNA, 64 nt, hsa; identical to SEQ ID NO: 225068

SEQ ID NO: 349590 - RNA, 64 nt, hsa; identical to SEQ ID NO: 225069

SEQ ID NO: 349591 - RNA, 64 nt, hsa; identical to SEQ ID NO: 225070

SEQ ID NO: 349592 - RNA, 64 nt, hsa; identical to SEQ ID NO: 225071

SEQ ID NO: 349593 - RNA, 64 nt, hsa; identical to SEQ ID NO: 225072

SEQ ID NO: 349594 - RNA, 64 nt, hsa; identical to SEQ ID NO: 225073

SEQ ID NO: 349595 - RNA, 64 nt, hsa; identical to SEQ ID NO: 225074

SEQ ID NO: 349596 - RNA, 64 nt, hsa; identical to SEQ ID NO: 225075

SEQ ID NO: 349597 - RNA, 64 nt, hsa; identical to SEQ ID NO: 225076

SEQ ID NO: 349598 - RNA, 64 nt, hsa; identical to SEQ ID NO: 225077

SEQ ID NO: 349599 - RNA, 64 nt, hsa; identical to SEQ ID NO: 225078

SEQ ID NO: 349600 - RNA, 64 nt, hsa; identical to SEQ ID NO: 209887

SEQ ID NO: 349601 - RNA, 64 nt, hsa; identical to SEQ ID NO: 209888

SEQ ID NO: 349602 - RNA, 64 nt, hsa; identical to SEQ ID NO: 209889

SEQ ID NO: 349603 - RNA, 64 nt, hsa; identical to SEQ ID NO: 209890

SEQ ID NO: 349604 - RNA, 64 nt, hsa; identical to SEQ ID NO: 209891

SEQ ID NO: 349605 - RNA, 64 nt, hsa; identical to SEQ ID NO: 209892

SEQ ID NO: 349606 - RNA, 64 nt, hsa; identical to SEQ ID NO: 209893

SEQ ID NO: 349607 - RNA, 64 nt, hsa; identical to SEQ ID NO: 209894

SEQ ID NO: 349608 - RNA, 64 nt, hsa; identical to SEQ ID NO: 209895

SEQ ID NO: 349609 - RNA, 64 nt, hsa; identical to SEQ ID NO: 209896

SEQ ID NO: 349610 - RNA, 64 nt, hsa; identical to SEQ ID NO: 209897

SEQ ID NO: 349611 - RNA, 64 nt, hsa; identical to SEQ ID NO: 209898

SEQ ID NO: 349612 - RNA, 64 nt, hsa; identical to SEQ ID NO: 209899

SEQ ID NO: 349613 - RNA, 64 nt, hsa; identical to SEQ ID NO: 209900

SEQ ID NO: 349614 - RNA, 64 nt, hsa; identical to SEQ ID NO: 209901

SEQ ID NO: 349615 - RNA, 64 nt, hsa; identical to SEQ ID NO: 209902

SEQ ID NO: 349616 - RNA, 64 nt, hsa; identical to SEQ ID NO: 209903

SEQ ID NO: 349617 - RNA, 64 nt, hsa; identical to SEQ ID NO: 209904

SEQ ID NO: 349618 - RNA, 64 nt, hsa; identical to SEQ ID NO: 209905

SEQ ID NO: 349619 - RNA, 64 nt, hsa; identical to SEQ ID NO: 209906

SEQ ID NO: 349620 - RNA, 64 nt, hsa; identical to SEQ ID NO: 209907

SEQ ID NO: 349621 - RNA, 64 nt, hsa; identical to SEQ ID NO: 209908

SEQ ID NO: 349622 - RNA, 64 nt, hsa; identical to SEQ ID NO: 209909

SEQ ID NO: 349623 - RNA, 64 nt, hsa; identical to SEQ ID NO: 209910

SEQ ID NO: 349624 - RNA, 64 nt, hsa; identical to SEQ ID NO: 209911

SEQ ID NO: 349625 - RNA, 64 nt, hsa; identical to SEQ ID NO: 209912

SEQ ID NO: 349626 - RNA, 64 nt, hsa; identical to SEQ ID NO: 209913

SEQ ID NO: 349627 - RNA, 64 nt, hsa; identical to SEQ ID NO: 209914

SEQ ID NO: 349628 - RNA, 64 nt, hsa; identical to SEQ ID NO: 209915

SEQ ID NO: 349629 - RNA, 64 nt, hsa; identical to SEQ ID NO: 209916

SEQ ID NO: 349630 - RNA, 64 nt, hsa; identical to SEQ ID NO: 225055

SEQ ID NO: 349631 - RNA, 64 nt, hsa; identical to SEQ ID NO: 225056

SEQ ID NO: 349632 - RNA, 64 nt, hsa; identical to SEQ ID NO: 225057

SEQ ID NO: 349633 - RNA, 64 nt, hsa; identical to SEQ ID NO: 225058

SEQ ID NO: 349634 - RNA, 64 nt, hsa; identical to SEQ ID NO: 225059

SEQ ID NO: 349635 - RNA, 64 nt, hsa; identical to SEQ ID NO: 225060

SEQ ID NO: 349636 - RNA, 64 nt, hsa; identical to SEQ ID NO: 225061

SEQ ID NO: 349637 - RNA, 64 nt, hsa; identical to SEQ ID NO: 225062

SEQ ID NO: 349638 - RNA, 64 nt, hsa; identical to SEQ ID NO: 225063

SEQ ID NO: 349639 - RNA, 64 nt, hsa; identical to SEQ ID NO: 225064

SEQ ID NO: 349640 - RNA, 64 nt, hsa; identical to SEQ ID NO: 225065

SEQ ID NO: 349641 - RNA, 64 nt, hsa; identical to SEQ ID NO: 225066

SEQ ID NO: 349642 - RNA, 64 nt, hsa; identical to SEQ ID NO: 225067

SEQ ID NO: 349643 - RNA, 64 nt, hsa; identical to SEQ ID NO: 225068

SEQ ID NO: 349644 - RNA, 64 nt, hsa; identical to SEQ ID NO: 225069

SEQ ID NO: 349645 - RNA, 64 nt, hsa; identical to SEQ ID NO: 225070

SEQ ID NO: 349646 - RNA, 64 nt, hsa; identical to SEQ ID NO: 225071

SEQ ID NO: 349647 - RNA, 64 nt, hsa; identical to SEQ ID NO: 225072

SEQ ID NO: 349648 - RNA, 64 nt, hsa; identical to SEQ ID NO: 225073

SEQ ID NO: 349649 - RNA, 64 nt, hsa; identical to SEQ ID NO: 225074

SEQ ID NO: 349650 - RNA, 64 nt, hsa; identical to SEQ ID NO: 225075

SEQ ID NO: 349651 - RNA, 64 nt, hsa; identical to SEQ ID NO: 225076

SEQ ID NO: 349652 - RNA, 64 nt, hsa; identical to SEQ ID NO: 225077

SEQ ID NO: 349653 - RNA, 64 nt, hsa; identical to SEQ ID NO: 225078

SEQ ID NO: 349654 - RNA, 64 nt, hsa; identical to SEQ ID NO: 209887

SEQ ID NO: 349655 - RNA, 64 nt, hsa; identical to SEQ ID NO: 209888

SEQ ID NO: 349656 - RNA, 64 nt, hsa; identical to SEQ ID NO: 209889

SEQ ID NO: 349657 - RNA, 64 nt, hsa; identical to SEQ ID NO: 209890

SEQ ID NO: 349658 - RNA, 64 nt, hsa; identical to SEQ ID NO: 209891

SEQ ID NO: 349659 - RNA, 64 nt, hsa; identical to SEQ ID NO: 209892

SEQ ID NO: 349660 - RNA, 64 nt, hsa; identical to SEQ ID NO: 209893

SEQ ID NO: 349661 - RNA, 64 nt, hsa; identical to SEQ ID NO: 209894

SEQ ID NO: 349662 - RNA, 64 nt, hsa; identical to SEQ ID NO: 209895

SEQ ID NO: 349663 - RNA, 64 nt, hsa; identical to SEQ ID NO: 209896

SEQ ID NO: 349664 - RNA, 64 nt, hsa; identical to SEQ ID NO: 209897

SEQ ID NO: 349665 - RNA, 64 nt, hsa; identical to SEQ ID NO: 209898

SEQ ID NO: 349666 - RNA, 64 nt, hsa; identical to SEQ ID NO: 209899

SEQ ID NO: 349667 - RNA, 64 nt, hsa; identical to SEQ ID NO: 209900

SEQ ID NO: 349668 - RNA, 64 nt, hsa; identical to SEQ ID NO: 209901

SEQ ID NO: 349669 - RNA, 64 nt, hsa; identical to SEQ ID NO: 209902

SEQ ID NO: 349670 - RNA, 64 nt, hsa; identical to SEQ ID NO: 209903

SEQ ID NO: 349671 - RNA, 64 nt, hsa; identical to SEQ ID NO: 209904

SEQ ID NO: 349672 - RNA, 64 nt, hsa; identical to SEQ ID NO: 209905

SEQ ID NO: 349673 - RNA, 64 nt, hsa; identical to SEQ ID NO: 209906

SEQ ID NO: 349674 - RNA, 64 nt, hsa; identical to SEQ ID NO: 209907

SEQ ID NO: 349675 - RNA, 64 nt, hsa; identical to SEQ ID NO: 209908

SEQ ID NO: 349676 - RNA, 64 nt, hsa; identical to SEQ ID NO: 209909

SEQ ID NO: 349677 - RNA, 64 nt, hsa; identical to SEQ ID NO: 209910

SEQ ID NO: 349678 - RNA, 64 nt, hsa; identical to SEQ ID NO: 209911

SEQ ID NO: 349679 - RNA, 64 nt, hsa; identical to SEQ ID NO: 209912

SEQ ID NO: 349680 - RNA, 64 nt, hsa; identical to SEQ ID NO: 209913

SEQ ID NO: 349681 - RNA, 64 nt, hsa; identical to SEQ ID NO: 209914

SEQ ID NO: 349682 - RNA, 64 nt, hsa; identical to SEQ ID NO: 209915

SEQ ID NO: 349683 - RNA, 64 nt, hsa; identical to SEQ ID NO: 209916

SEQ ID NO: 349684 - RNA, 64 nt, hsa; identical to SEQ ID NO: 225055

SEQ ID NO: 349685 - RNA, 64 nt, hsa; identical to SEQ ID NO: 225056

SEQ ID NO: 349686 - RNA, 64 nt, hsa; identical to SEQ ID NO: 225057

SEQ ID NO: 349687 - RNA, 64 nt, hsa; identical to SEQ ID NO: 225058

SEQ ID NO: 349688 - RNA, 64 nt, hsa; identical to SEQ ID NO: 225059

SEQ ID NO: 349689 - RNA, 64 nt, hsa; identical to SEQ ID NO: 225060

SEQ ID NO: 349690 - RNA, 64 nt, hsa; identical to SEQ ID NO: 225061

SEQ ID NO: 349691 - RNA, 64 nt, hsa; identical to SEQ ID NO: 225062

SEQ ID NO: 349692 - RNA, 64 nt, hsa; identical to SEQ ID NO: 225063

SEQ ID NO: 349693 - RNA, 64 nt, hsa; identical to SEQ ID NO: 225064

SEQ ID NO: 349694 - RNA, 64 nt, hsa; identical to SEQ ID NO: 225065

SEQ ID NO: 349695 - RNA, 64 nt, hsa; identical to SEQ ID NO: 225066

SEQ ID NO: 349696 - RNA, 64 nt, hsa; identical to SEQ ID NO: 225067

SEQ ID NO: 349697 - RNA, 64 nt, hsa; identical to SEQ ID NO: 225068

SEQ ID NO: 349698 - RNA, 64 nt, hsa; identical to SEQ ID NO: 225069

SEQ ID NO: 349699 - RNA, 64 nt, hsa; identical to SEQ ID NO: 225070

SEQ ID NO: 349700 - RNA, 64 nt, hsa; identical to SEQ ID NO: 225071

SEQ ID NO: 349701 - RNA, 64 nt, hsa; identical to SEQ ID NO: 225072

SEQ ID NO: 349702 - RNA, 64 nt, hsa; identical to SEQ ID NO: 225073

SEQ ID NO: 349703 - RNA, 64 nt, hsa; identical to SEQ ID NO: 225074

SEQ ID NO: 349704 - RNA, 64 nt, hsa; identical to SEQ ID NO: 225075

SEQ ID NO: 349705 - RNA, 64 nt, hsa; identical to SEQ ID NO: 225076

SEQ ID NO: 349706 - RNA, 64 nt, hsa; identical to SEQ ID NO: 225077

SEQ ID NO: 349707 - RNA, 64 nt, hsa; identical to SEQ ID NO: 225078

SEQ ID NO: 349708 - RNA, 64 nt, hsa; identical to SEQ ID NO: 209887

SEQ ID NO: 349709 - RNA, 64 nt, hsa; identical to SEQ ID NO: 209888

SEQ ID NO: 349710 - RNA, 64 nt, hsa; identical to SEQ ID NO: 209889

SEQ ID NO: 349711 - RNA, 64 nt, hsa; identical to SEQ ID NO: 209890

SEQ ID NO: 349712 - RNA, 64 nt, hsa; identical to SEQ ID NO: 209891

SEQ ID NO: 349713 - RNA, 64 nt, hsa; identical to SEQ ID NO: 209892

SEQ ID NO: 349714 - RNA, 64 nt, hsa; identical to SEQ ID NO: 209893

SEQ ID NO: 349715 - RNA, 64 nt, hsa; identical to SEQ ID NO: 209894

SEQ ID NO: 349716 - RNA, 64 nt, hsa; identical to SEQ ID NO: 209895

SEQ ID NO: 349717 - RNA, 64 nt, hsa; identical to SEQ ID NO: 209896

SEQ ID NO: 349718 - RNA, 64 nt, hsa; identical to SEQ ID NO: 209897

SEQ ID NO: 349719 - RNA, 64 nt, hsa; identical to SEQ ID NO: 209898

SEQ ID NO: 349720 - RNA, 64 nt, hsa; identical to SEQ ID NO: 209899

SEQ ID NO: 349721 - RNA, 64 nt, hsa; identical to SEQ ID NO: 209900

SEQ ID NO: 349722 - RNA, 64 nt, hsa; identical to SEQ ID NO: 209901

SEQ ID NO: 349723 - RNA, 64 nt, hsa; identical to SEQ ID NO: 209902

SEQ ID NO: 349724 - RNA, 64 nt, hsa; identical to SEQ ID NO: 209903

SEQ ID NO: 349725 - RNA, 64 nt, hsa; identical to SEQ ID NO: 209904

SEQ ID NO: 349726 - RNA, 64 nt, hsa; identical to SEQ ID NO: 209905

SEQ ID NO: 349727 - RNA, 64 nt, hsa; identical to SEQ ID NO: 209906

SEQ ID NO: 349728 - RNA, 64 nt, hsa; identical to SEQ ID NO: 209907

SEQ ID NO: 349729 - RNA, 64 nt, hsa; identical to SEQ ID NO: 209908

SEQ ID NO: 349730 - RNA, 64 nt, hsa; identical to SEQ ID NO: 209909

SEQ ID NO: 349731 - RNA, 64 nt, hsa; identical to SEQ ID NO: 209910

SEQ ID NO: 349732 - RNA, 64 nt, hsa; identical to SEQ ID NO: 209911

SEQ ID NO: 349733 - RNA, 64 nt, hsa; identical to SEQ ID NO: 209912

SEQ ID NO: 349734 - RNA, 64 nt, hsa; identical to SEQ ID NO: 209913

SEQ ID NO: 349735 - RNA, 64 nt, hsa; identical to SEQ ID NO: 209914

SEQ ID NO: 349736 - RNA, 64 nt, hsa; identical to SEQ ID NO: 209915

SEQ ID NO: 349737 - RNA, 64 nt, hsa; identical to SEQ ID NO: 209916

SEQ ID NO: 349738 - RNA, 64 nt, hsa; identical to SEQ ID NO: 225055

SEQ ID NO: 349739 - RNA, 64 nt, hsa; identical to SEQ ID NO: 225056

SEQ ID NO: 349740 - RNA, 64 nt, hsa; identical to SEQ ID NO: 225057

SEQ ID NO: 349741 - RNA, 64 nt, hsa; identical to SEQ ID NO: 225058

SEQ ID NO: 349742 - RNA, 64 nt, hsa; identical to SEQ ID NO: 225059

SEQ ID NO: 349743 - RNA, 64 nt, hsa; identical to SEQ ID NO: 225060

SEQ ID NO: 349744 - RNA, 64 nt, hsa; identical to SEQ ID NO: 225061

SEQ ID NO: 349745 - RNA, 64 nt, hsa; identical to SEQ ID NO: 225062

SEQ ID NO: 349746 - RNA, 64 nt, hsa; identical to SEQ ID NO: 225063

SEQ ID NO: 349747 - RNA, 64 nt, hsa; identical to SEQ ID NO: 225064

SEQ ID NO: 349748 - RNA, 64 nt, hsa; identical to SEQ ID NO: 225065

SEQ ID NO: 349749 - RNA, 64 nt, hsa; identical to SEQ ID NO: 225066

SEQ ID NO: 349750 - RNA, 64 nt, hsa; identical to SEQ ID NO: 225067

SEQ ID NO: 349751 - RNA, 64 nt, hsa; identical to SEQ ID NO: 225068

SEQ ID NO: 349752 - RNA, 64 nt, hsa; identical to SEQ ID NO: 225069

SEQ ID NO: 349753 - RNA, 64 nt, hsa; identical to SEQ ID NO: 225070

SEQ ID NO: 349754 - RNA, 64 nt, hsa; identical to SEQ ID NO: 225071

SEQ ID NO: 349755 - RNA, 64 nt, hsa; identical to SEQ ID NO: 225072

SEQ ID NO: 349756 - RNA, 64 nt, hsa; identical to SEQ ID NO: 225073

SEQ ID NO: 349757 - RNA, 64 nt, hsa; identical to SEQ ID NO: 225074

SEQ ID NO: 349758 - RNA, 64 nt, hsa; identical to SEQ ID NO: 225075

SEQ ID NO: 349759 - RNA, 64 nt, hsa; identical to SEQ ID NO: 225076

SEQ ID NO: 349760 - RNA, 64 nt, hsa; identical to SEQ ID NO: 225077

SEQ ID NO: 349761 - RNA, 64 nt, hsa; identical to SEQ ID NO: 225078

SEQ ID NO: 349762 - RNA, 64 nt, hsa; identical to SEQ ID NO: 117299

SEQ ID NO: 349763 - RNA, 64 nt, hsa; identical to SEQ ID NO: 117300

SEQ ID NO: 349764 - RNA, 64 nt, hsa; identical to SEQ ID NO: 117301

SEQ ID NO: 349765 - RNA, 64 nt, hsa; identical to SEQ ID NO: 117302

SEQ ID NO: 349766 - RNA, 64 nt, hsa; identical to SEQ ID NO: 117303

SEQ ID NO: 349767 - RNA, 64 nt, hsa; identical to SEQ ID NO: 117304

SEQ ID NO: 349768 - RNA, 64 nt, hsa; identical to SEQ ID NO: 117305

SEQ ID NO: 349769 - RNA, 64 nt, hsa; identical to SEQ ID NO: 117306

SEQ ID NO: 349770 - RNA, 64 nt, hsa; identical to SEQ ID NO: 117307

SEQ ID NO: 349771 - RNA, 64 nt, hsa; identical to SEQ ID NO: 117308

SEQ ID NO: 349772 - RNA, 64 nt, hsa; identical to SEQ ID NO: 117309

SEQ ID NO: 349773 - RNA, 64 nt, hsa; identical to SEQ ID NO: 117310

SEQ ID NO: 349774 - RNA, 64 nt, hsa; identical to SEQ ID NO: 117311

SEQ ID NO: 349775 - RNA, 64 nt, hsa; identical to SEQ ID NO: 117312

SEQ ID NO: 349776 - RNA, 64 nt, hsa; identical to SEQ ID NO: 117313

SEQ ID NO: 349777 - RNA, 64 nt, hsa; identical to SEQ ID NO: 117314

SEQ ID NO: 349778 - RNA, 64 nt, hsa; identical to SEQ ID NO: 117315

SEQ ID NO: 349779 - RNA, 64 nt, hsa; identical to SEQ ID NO: 117316

SEQ ID NO: 349780 - RNA, 64 nt, hsa; identical to SEQ ID NO: 117317

SEQ ID NO: 349781 - RNA, 64 nt, hsa; identical to SEQ ID NO: 117318

SEQ ID NO: 349782 - RNA, 64 nt, hsa; identical to SEQ ID NO: 117319

SEQ ID NO: 349783 - RNA, 64 nt, hsa; identical to SEQ ID NO: 117320

SEQ ID NO: 349784 - RNA, 64 nt, hsa; identical to SEQ ID NO: 117321

SEQ ID NO: 349785 - RNA, 64 nt, hsa; identical to SEQ ID NO: 117322

SEQ ID NO: 349786 - RNA, 64 nt, hsa; identical to SEQ ID NO: 117323

SEQ ID NO: 349787 - RNA, 64 nt, hsa; identical to SEQ ID NO: 117324

SEQ ID NO: 349788 - RNA, 64 nt, hsa; identical to SEQ ID NO: 117325

SEQ ID NO: 349789 - RNA, 64 nt, hsa; identical to SEQ ID NO: 117326

SEQ ID NO: 349790 - RNA, 64 nt, hsa; identical to SEQ ID NO: 117327

SEQ ID NO: 349791 - RNA, 64 nt, hsa; identical to SEQ ID NO: 117328

SEQ ID NO: 349792 - RNA, 64 nt, hsa; identical to SEQ ID NO: 174092

SEQ ID NO: 349793 - RNA, 64 nt, hsa; identical to SEQ ID NO: 174093

SEQ ID NO: 349794 - RNA, 64 nt, hsa; identical to SEQ ID NO: 174095

SEQ ID NO: 349795 - RNA, 64 nt, hsa; identical to SEQ ID NO: 174096

SEQ ID NO: 349796 - RNA, 64 nt, hsa; identical to SEQ ID NO: 174127

SEQ ID NO: 349797 - RNA, 64 nt, hsa; identical to SEQ ID NO: 174128

SEQ ID NO: 349798 - RNA, 64 nt, hsa; identical to SEQ ID NO: 174147

SEQ ID NO: 349799 - RNA, 64 nt, hsa; identical to SEQ ID NO: 174148

SEQ ID NO: 349800 - RNA, 64 nt, hsa; identical to SEQ ID NO: 174171

SEQ ID NO: 349801 - RNA, 64 nt, hsa; identical to SEQ ID NO: 174172

SEQ ID NO: 349802 - RNA, 64 nt, hsa; identical to SEQ ID NO: 174194

SEQ ID NO: 349803 - RNA, 64 nt, hsa; identical to SEQ ID NO: 174195

SEQ ID NO: 349804 - RNA, 64 nt, hsa; identical to SEQ ID NO: 174204

SEQ ID NO: 349805 - RNA, 64 nt, hsa; identical to SEQ ID NO: 174205

SEQ ID NO: 349806 - RNA, 64 nt, hsa; identical to SEQ ID NO: 174212

SEQ ID NO: 349807 - RNA, 64 nt, hsa; identical to SEQ ID NO: 174213

SEQ ID NO: 349808 - RNA, 64 nt, hsa; identical to SEQ ID NO: 174220

SEQ ID NO: 349809 - RNA, 64 nt, hsa; identical to SEQ ID NO: 174221

SEQ ID NO: 349810 - RNA, 64 nt, hsa; identical to SEQ ID NO: 174227

SEQ ID NO: 349811 - RNA, 64 nt, hsa; identical to SEQ ID NO: 174228

SEQ ID NO: 349812 - RNA, 64 nt, hsa; identical to SEQ ID NO: 174230

SEQ ID NO: 349813 - RNA, 64 nt, hsa; identical to SEQ ID NO: 174231

SEQ ID NO: 349814 - RNA, 64 nt, hsa; identical to SEQ ID NO: 174233

SEQ ID NO: 349815 - RNA, 51 nt, hsa; identical to SEQ ID NO: 173793

SEQ ID NO: 349816 - RNA, 64 nt, hsa; identical to SEQ ID NO: 174312

SEQ ID NO: 349817 - RNA, 64 nt, hsa; identical to SEQ ID NO: 174313

SEQ ID NO: 349818 - RNA, 57 nt, hsa; identical to SEQ ID NO: 173883

SEQ ID NO: 349819 - RNA, 64 nt, hsa; identical to SEQ ID NO: 174325

SEQ ID NO: 349820 - RNA, 64 nt, hsa; identical to SEQ ID NO: 174358

SEQ ID NO: 349821 - RNA, 64 nt, hsa; identical to SEQ ID NO: 174359

SEQ ID NO: 349822 - RNA, 64 nt, hsa; identical to SEQ ID NO: 174369

SEQ ID NO: 349823 - RNA, 64 nt, hsa; identical to SEQ ID NO: 174370

SEQ ID NO: 349824 - RNA, 64 nt, hsa; identical to SEQ ID NO: 174388

SEQ ID NO: 349825 - RNA, 64 nt, hsa; identical to SEQ ID NO: 174389

SEQ ID NO: 349826 - RNA, 64 nt, hsa; identical to SEQ ID NO: 174405

SEQ ID NO: 349827 - RNA, 64 nt, hsa; identical to SEQ ID NO: 174406

SEQ ID NO: 349828 - RNA, 64 nt, hsa; identical to SEQ ID NO: 174416

SEQ ID NO: 349829 - RNA, 64 nt, hsa; identical to SEQ ID NO: 174417

SEQ ID NO: 349830 - RNA, 64 nt, hsa; identical to SEQ ID NO: 174427

SEQ ID NO: 349831 - RNA, 64 nt, hsa; identical to SEQ ID NO: 174428

SEQ ID NO: 349832 - RNA, 64 nt, hsa; identical to SEQ ID NO: 174434

SEQ ID NO: 349833 - RNA, 64 nt, hsa; identical to SEQ ID NO: 174435

SEQ ID NO: 349834 - RNA, 64 nt, hsa; identical to SEQ ID NO: 174516

SEQ ID NO: 349835 - RNA, 64 nt, hsa; identical to SEQ ID NO: 174517

SEQ ID NO: 349836 - RNA, 63 nt, hsa
ccucuggggaagggguucccucccuccugaagaugaacacacaauacacggaagagcgccagc

SEQ ID NO: 349837 - RNA, 63 nt, hsa
gagccaccuggcagggcucacacuccugggcucugaacacacacgccagcuccucucugaagc

SEQ ID NO: 349838 - RNA, 63 nt, hsa
gucauuuccccagaaaagcuguguucccuaugcugaacacaccauacacauucucaucuggaa

SEQ ID NO: 349839 - RNA, 63 nt, hsa
ccaaaucaaaauaaaagaaauaugaucagagcuugaacacaggcuuauuuuuaaaauaaaaau

SEQ ID NO: 349840 - RNA, 63 nt, hsa
auucaaguuaaaugacguguaugauauauaagcugaacacauuuucuauagcccuuaauuuag

SEQ ID NO: 349841 - RNA, 63 nt, hsa
cugaccacauacaucauagggugcuaaaguugaugaacacauuaauccguuaaguaaaaugga

SEQ ID NO: 349842 - RNA, 63 nt, hsa
ggacucagcgccccuggacccccaaaugcugcaugaacacauuuucaggggagccugugcccc

SEQ ID NO: 349843 - RNA, 63 nt, hsa
gaaacuucaaauucagcuauaggauaguaccaaugaacacauccagcugaucccaaaagcugu

SEQ ID NO: 349844 - RNA, 63 nt, hsa
agagaccagcagcccaagggcuccagacacaccugaacacaucgugaugaugacguccucuca

SEQ ID NO: 349845 - RNA, 63 nt, hsa
ucagucagguuaaaacaacggacaauaaaagaaugaacacauuccucgugugugauucacucu

SEQ ID NO: 349846 - RNA, 63 nt, hsa
cagcuugcuauuuuuauaacauggugauugaguugaacacaaucaaaguacaguaguaacuga

SEQ ID NO: 349847 - RNA, 63 nt, hsa
agcugcuugggaggcugaggcaggagaaucacuugaacacaggaggcagagguugcagugagc

SEQ ID NO: 349848 - RNA, 63 nt, hsa
cacagucuuccuuccucuucaagcguuucauguugaacacagcucucuccgcucccuugugau

SEQ ID NO: 349849 - RNA, 63 nt, hsa
uuaaaauaguuaagaauccaagucgagaacacuugaacacacagaagggagaccccgccuagc

SEQ ID NO: 349850 - RNA, 63 nt, hsa
uuuucuuucuuaguccaguuguguugacacauaugaacacagacaaagugcuaugcggaggaa

SEQ ID NO: 349851 - RNA, 63 nt, hsa
cuguuguuuaagcauuuuuuuaaggugaacaaaugaacacaauguaucuaccuuugaacuguu

SEQ ID NO: 349852 - RNA, 63 nt, hsa
agacggcaguguucagaauuccagccgcucaucugaacacagaaggugugaacugaccucuaa

SEQ ID NO: 349853 - RNA, 63 nt, hsa
gcucagaaaacagaaauacugucauggaggugcugaacacagggaaggucugguacauauugg

SEQ ID NO: 349854 - RNA, 63 nt, hsa
accuucugguucuaaaacggggaguggucugaaugaacacagcugaccccuuucccgcgcacu

SEQ ID NO: 349855 - RNA, 63 nt, hsa
gcauggagcuauuccuuggugcaguucaggauaugaacacagguacagucauucuuugaaggu

SEQ ID NO: 349856 - RNA, 63 nt, hsa
ucaggcccaauauucucagacagcccagcagugugaacacacaaugccaggccaggaacuggg

SEQ ID NO: 349857 - RNA, 63 nt, hsa
gaugugcaauugguuuaaguguucauguucuagugaacacagcuuguucaggaacaaacacua

SEQ ID NO: 349858 - RNA, 63 nt, hsa
gucugauuuuauuuuucaaaguuuuuucauuuaugaacacauuuucauugguauauuauuuaa

SEQ ID NO: 349859 - RNA, 63 nt, hsa
uauguccuuauuuuucuuucagcugaauacgaaugaacacagugguggaauuucugaagggaa

SEQ ID NO: 349860 - RNA, 63 nt, hsa
caauucaggaaagacuuaaauaugaaagcaaauugaacacaucggguguuuguuaucagaaaa

SEQ ID NO: 349861 - RNA, 63 nt, hsa
guuaguaaguuagaaagcuagcuuuguuguaucugaacacaugaaucuuuuuuggucagugua

SEQ ID NO: 349862 - RNA, 63 nt, hsa
cuugggggaugggcucuucgccaugggggucuuugaacacaccucucuccuuuccuuuugucu

SEQ ID NO: 349863 - RNA, 63 nt, hsa
agacugggcucugaccuaggcuucuugucacacugaacacauccagccacaggcaccagcugg

SEQ ID NO: 349864 - RNA, 63 nt, hsa
ccaugaauauauuauguuuauacaaaaucaaucugaacacaauucauaaagauuucucuuuua

SEQ ID NO: 349865 - RNA, 63 nt, hsa
cauucagugaguuaaacacgaauugauuuaaagugaacacacacaagggagcuugcuugcaga

SEQ ID NO: 349866 - RNA, 63 nt, hsa
auggccuuagcugucccacacaacucaguggccugaacacacaccuucagccaccaugccuuu

SEQ ID NO: 349867 - RNA, 63 nt, hsa
acauaaucggaggugcagaaucuuggaauugucugaacacaguagaacgauacaauccugaaa

SEQ ID NO: 349868 - RNA, 63 nt, hsa
augaugguuuugguaguaucuauauugcuuuagugaacacagaguaugggcacggcuaugcua

SEQ ID NO: 349869 - RNA, 63 nt, hsa
cauauacugauguaaaaaucaugcuggcauccaugaacacaccgguaaauaaaacauagucca

SEQ ID NO: 349870 - RNA, 63 nt, hsa
gugaagauaagaaaugaucuuuacguggcaaaaugaacacaucuugaguauuuaggaaauggg

SEQ ID NO: 349871 - RNA, 63 nt, hsa
cuuugaagacccugcggagguuccgucgcugcuugaacacagugccuggacucccugcuccgu

SEQ ID NO: 349872 - RNA, 63 nt, hsa
ugcugcacguggcaucugauuaccuguggucacugaacacacgaauaacuuggauagcaaauc

SEQ ID NO: 349873 - RNA, 63 nt, hsa
uuccauuauagcaauguuagugccaccaccuucugaacacaguggggagggcugugaaggcuc

SEQ ID NO: 349874 - RNA, 63 nt, hsa
uaaggacauauuuugauaaaguauuauuuguaaugaacacaagccucucuugaguagaagucu

SEQ ID NO: 349875 - RNA, 63 nt, hsa
gaugaugguaaauaagaacacagaagcuguagcugaacacaggcuggcuggugggcuuccuag

SEQ ID NO: 349876 - RNA, 63 nt, hsa
uuuaggcuuuucauaagaugaaacaugccacagugaacacacucguguacauaucaagagaag

SEQ ID NO: 349877 - RNA, 63 nt, hsa
uauucgggagcuucuuagagggaugagguucuuugaacacagugaaaauuuaaauuaguaacu

SEQ ID NO: 349878 - RNA, 63 nt, hsa
cagccaguuaucaguagauacaauaucuuuaaaugaacacacgaguguaugucucacaauaua

SEQ ID NO: 349879 - RNA, 63 nt, hsa
gaaagauccauuuuaggucuuuuucaagaauagugaacacauuuuuuaacaaaauaaguugua

SEQ ID NO: 349880 - RNA, 63 nt, hsa
cuuuauuagugaaguaugcacuaaucaauacuuugaacacaaagccuguguuacugauuuggc

SEQ ID NO: 349881 - RNA, 63 nt, hsa
ugaacuuuaugugcuacgauuuaacugcagccuugaacacacacaaaaauauucuuaagggcu

SEQ ID NO: 349882 - RNA, 63 nt, hsa
uucucugucuauucacacauauguacaaauacaugaacacagccugucugugcucagacauag

SEQ ID NO: 349883 - RNA, 63 nt, hsa
uugcucugucaccuaggcuagaguggaguggcaugaacacaacgcacugcagccucuaccucc

SEQ ID NO: 349884 - RNA, 63 nt, hsa
uauaaagagcaagcauagauggaaagugcauauugaacacaucugugcauuugagaaggcagg

SEQ ID NO: 349885 - RNA, 63 nt, hsa
uuacuauaccuaccauuuauucagcuggauugcugaacacaguucuggauucauagaauuaag

SEQ ID NO: 349886 - RNA, 63 nt, hsa
agcuguucugaauuuauccacaguaauauagucugaacacaaauaguuuacuuaacuuauccu

SEQ ID NO: 349887 - RNA, 63 nt, hsa
accgccuccuuuuuccuuuaaucuuauuuuugaugaacacauauauaggagaacaucuauccu

SEQ ID NO: 349888 - RNA, 63 nt, hsa
gggaugguguccacauucauguucugcgguucuugaacacacggaugccucugggccaccugu

SEQ ID NO: 349889 - RNA, 63 nt, hsa
cuccugauuucccuggagguucuggaugaaggcugaacacaggcuuguuaaugucagucugug

SEQ ID NO: 349890 - RNA, 63 nt, hsa
aagggaaaaguugcaagaaugcugaaaaaaaauugaacacaaucucauugaggagcauuuuuu

SEQ ID NO: 349891 - RNA, 63 nt, hsa
ugcugugaugcuaguguugauuuugcucucagaugaacacaaugucucauacuaaccaagaag

SEQ ID NO: 349892 - RNA, 63 nt, hsa
aaaauuaaaaauauguaaaauuaauaauuugcaugaacacagaugacuacauuuuccaaaacu

SEQ ID NO: 349893 - RNA, 63 nt, hsa
uccuagugaaagaggcagcuugaaacugagaugugaacacaucagcuugcccuguuaaaagau

SEQ ID NO: 349894 - RNA, 63 nt, hsa
uuuguagcaccgcucagcugucuuguaaaacagugaacacacgcuuucugguucuaguaaucc

SEQ ID NO: 349895 - RNA, 63 nt, hsa
acuggguguauucuaguguggaacaaaaaacagugaacacaagugcuuacuuguggauacuau

SEQ ID NO: 349896 - RNA, 63 nt, hsa
guuacuucuaaaaauuaguauugaguuuaauggugaacacauuuuucuauuuucucuugaauc

SEQ ID NO: 349897 - RNA, 63 nt, hsa
ucacccccacauaccaacucaacuuuuuuccugugaacacauaaauauauuuuuauagaaaaa

SEQ ID NO: 349898 - RNA, 63 nt, hsa
aaagaaaaaauccagaacauaagaacuauauuaugaacacaugauuugaaccuguugugguaa

SEQ ID NO: 349899 - RNA, 63 nt, hsa
acagugggaucuguuuuuugugagguucauuucugaacacauuaggcauaugagcagauuucc

SEQ ID NO: 349900 - RNA, 63 nt, hsa
ugguguaaaaggaugggucugguuugcagagcuugaacacagucucacccagacuccaggcug

SEQ ID NO: 349901 - RNA, 63 nt, hsa
agcuggugacauggaacuguuuucugguccacaugaacacaggcuccauccaggcccagcucc

SEQ ID NO: 349902 - RNA, 63 nt, hsa
ggcuucagccuuugugcaguacucucgaugcccugaacacacaccuucccuuugcccaggcgg

SEQ ID NO: 349903 - RNA, 63 nt, hsa
ccggccacaucauucugugucucugcauccauuugaacacauuauuaagcaccgauaauaggu

SEQ ID NO: 349904 - RNA, 63 nt, hsa
acuuaccuccaguagaaacacugcauuuuucugugaacacauccacuucacaagccuuguuuc

SEQ ID NO: 349905 - RNA, 63 nt, hsa
gcagacuauuaggaaugauucagugcauuuaacugaacacagagcuaguucuaggugagugag

SEQ ID NO: 349906 - RNA, 63 nt, hsa
gguuggauuuucuauguuggcugauuaccauauugaacacauggcauuuguagcauucuuuaa

SEQ ID NO: 349907 - RNA, 63 nt, hsa
ucuauaauaucuuccugugauuuauguagaaaaugaacacaccccuuuuccauuuaagacccu

SEQ ID NO: 349908 - RNA, 63 nt, hsa
ggggccggugaugguaugcugaaguucagccguugaacacauaggaaugucuguggggugacu

SEQ ID NO: 349909 - RNA, 63 nt, hsa
uuggugucagaugcuggaauuuauucugaccaaugaacacagcugacucaggggaguacaauc

SEQ ID NO: 349910 - RNA, 63 nt, hsa
uaaaauuuugcagaggucuucaguaucuauauuugaacacacuguacaauaguacaaaaacca

SEQ ID NO: 349911 - RNA, 63 nt, hsa
cugcaggguuugauggagccucauuucccuuugugaacacaaagugcaaaaugaauucuuuuu

SEQ ID NO: 349912 - RNA, 63 nt, hsa
ugcuugcaggaggccaaacugucccucccuugcugaacacacacacacacacacacacacagg

SEQ ID NO: 349913 - RNA, 63 nt, hsa
ggacuaaaugaaaaguuguucccagccugcacaugaacacauucaugacacacaaaacuggcu

SEQ ID NO: 349914 - RNA, 63 nt, hsa
uuugagguggucuuaguaguaauuaccauuuguugaacacauuaaugcuauacuagacagaua

SEQ ID NO: 349915 - RNA, 63 nt, hsa
guuuguauggcucuggaauaacucauucguuuaugaacacaucucauguauuacuugacacag

SEQ ID NO: 349916 - RNA, 63 nt, hsa
cuaggcccuacuccaguuaaaucaaacauugguugaacacaucagccucugaaaagguagcuc

SEQ ID NO: 349917 - RNA, 63 nt, hsa
cagggcuuaaccugcuagaaaaugcauggaaugugaacacaaguuaauuauuucaaaauguuu

SEQ ID NO: 349918 - RNA, 63 nt, hsa
uguuuaccccaaaacaagugucaauuaagaauuugaacacaaccacauuuuuuaaaaugaaac

SEQ ID NO: 349919 - RNA, 63 nt, hsa
uaaaauugaagagccuuuucauguauuaaauaaugaacacaaauuauauaauuaaaauaauug

SEQ ID NO: 349920 - RNA, 63 nt, hsa
uucuguuuaugauccauauugauauuuaugacaugaacacagaauaguaccuuacauuugcua

SEQ ID NO: 349921 - RNA, 63 nt, hsa
uuauuuuuaccauaucagcacaugacaaggccaugaacacauggcucuaaaauaauuuagugu

SEQ ID NO: 349922 - RNA, 63 nt, hsa
auagguacauaagugaaagaagucucaguucagugaacacaaaacuuauuuaaagaugcuuua

SEQ ID NO: 349923 - RNA, 63 nt, hsa
aauuaguaauaaguuuugacuaggucuaaagaaugaacacauuguaaacaguugccacaguag

SEQ ID NO: 349924 - RNA, 63 nt, hsa
agauucuaacauauugccauguguggagugugcugaacacacaccaguuuacaggaaagaugc

SEQ ID NO: 349925 - RNA, 63 nt, hsa
ggcaccauuggucucuggguagugcuuuaagaaugaacacaaucacguuauaguccauggucc

SEQ ID NO: 349926 - RNA, 63 nt, hsa
gaacaacaacaacaauaacaacaaugguuuacaugaacacagcugcugaagaggcaagagaca

SEQ ID NO: 349927 - RNA, 63 nt, hsa
gcaggccacgauggucugcucuggagcauugggugaacacacaggcuggcugcucugggcagc

SEQ ID NO: 349928 - RNA, 63 nt, hsa
uacugagcuuccuuauguuucacacauuguauuugaacacaaaacauuaacaacuccacucau

SEQ ID NO: 349929 - RNA, 63 nt, hsa
uauacuuaauuuucuaaaaccauguaacuccauugaacacauuuuucaacuuaaggucugcau

SEQ ID NO: 349930 - RNA, 63 nt, hsa
acauagcccugcaaagagaucuggccccagcagugaacacaaacucaguaauucucuuuagag

SEQ ID NO: 349931 - RNA, 63 nt, hsa
cucugcucuucugcccucgaugccacauggcggugaacacaucugaagccacuauguuuccug

SEQ ID NO: 349932 - RNA, 63 nt, hsa
ccuggcucugauuuuuuacuggcugugugacuuugaacacaucucuuagucccucuuaggagu

SEQ ID NO: 349933 - RNA, 63 nt, hsa
agccuuugcuuuccucuggccccggccccacccugaacacagcucauacacagaaucaggacc

SEQ ID NO: 349934 - RNA, 63 nt, hsa
aaaugcuuuuuacucugguguauuauagaauaaugaacacauuuuuauauauguuaaagccug

SEQ ID NO: 349935 - RNA, 63 nt, hsa
ucucagguucuuuccaugcagacuccucagaucugaacacaguuuagugcuuuacaugcugug

SEQ ID NO: 349936 - RNA, 63 nt, hsa
uacuuugcuucuuuuauguuuguaaucuguaaaugaacacauggcagaaaauaaccccugauu

SEQ ID NO: 349937 - RNA, 63 nt, hsa
uuuugguggauguaaauaaccccauucuuugcuugaacacaguauuuucccaauagcacuuuc

SEQ ID NO: 349938 - RNA, 63 nt, hsa
caaagaaacuuaaaguaaugcccaauuauuaaaugaacacaagagcugagaugucacauucgu

SEQ ID NO: 349939 - RNA, 63 nt, hsa
cucguuuuaggcaaucaagauucuggagagucuugaacacagaauaacgauugugaccauuau

SEQ ID NO: 349940 - RNA, 63 nt, hsa
gacaaguauaaaaccuccuuuauggguuuguugugaacacagugcagggcacauuuauaauaa

SEQ ID NO: 349941 - RNA, 63 nt, hsa
cugaucgcacacaugcuuuguuuggauauggagugaacacaauuauguaccaaauuuaacuug

SEQ ID NO: 349942 - RNA, 63 nt, hsa
uguaaaaccagugcauuucagcuugcaaguuacugaacacaauaaugcuguuuuaauuuuguu

SEQ ID NO: 349943 - RNA, 63 nt, hsa
agacuaucuugaaggugggcuguuugccuuucgugaacacauucuugguaaagaacaucaaaa

SEQ ID NO: 349944 - RNA, 63 nt, hsa
uaaacuuuguaaugcacauucuuagcauauaacugaacacaguugaaaaauugugccugauua

SEQ ID NO: 349945 - RNA, 63 nt, hsa
cacagaggcacaugugcaugcacacacaacuugugaacacacauuucuguuaaagaaguuaga

SEQ ID NO: 349946 - RNA, 63 nt, hsa
agccucaacacaauuuuggacaaagcuaguaacugaacacaggucugucugccccacacuucu

SEQ ID NO: 349947 - RNA, 63 nt, hsa
gaucuuuagauucuuguuuagaacuguugauuuugaacacaacauacacugucaaacuuuaca

SEQ ID NO: 349948 - RNA, 63 nt, hsa
uagcaaccaaagaaauagggcaagagaggcaggugaacacacaugauaccucaauugacaauc

SEQ ID NO: 349949 - RNA, 63 nt, hsa
auuggaaaugucaucuaaccauuaagucaugugugaacacauaaggacguguguaaauaugua

SEQ ID NO: 349950 - RNA, 63 nt, hsa
aaugauuccguccuaacacccacccagccuguuugaacacauucuaauugucuaacauuuguu

SEQ ID NO: 349951 - RNA, 52 nt, hsa
augccaaguugauaucuugaacugaacacauucucguugccucugauuuucu

SEQ ID NO: 349952 - RNA, 63 nt, hsa
ugaaugcuuuuccacguagacuuaucuggaaugugaacacaacucuuugguuaauaguaaaug

SEQ ID NO: 349953 - RNA, 63 nt, hsa
uccaagugcuggcaccuacuugcucagugaucaugaacacaauuuuaaaucuuucugaaucuc

SEQ ID NO: 349954 - RNA, 63 nt, hsa
caaacacuuaggacugaacugaaccccuccccaugaacacaaggguuuuauccuuuccuuuaa

SEQ ID NO: 349955 - RNA, 63 nt, hsa
aaagcaauuacuacaaauggaugacacauuuaaugaacacaauuuuauuuuuuuucuguaacu

SEQ ID NO: 349956 - RNA, 63 nt, hsa
aaaaaaaaaaagaauucuguuccccucauaucaugaacacaguaacugauagguaaaaagacu

SEQ ID NO: 349957 - RNA, 63 nt, hsa
aaagguagaauggacaagugacacuguggacaaugaacacaugggccgccgcucauccaaaug

SEQ ID NO: 349958 - RNA, 63 nt, hsa
augaagcuggaagcacugcuguguccgcuuucaugaacacagccugggaccagggcauauuaa

SEQ ID NO: 349959 - RNA, 63 nt, hsa; identical to SEQ ID NO: 349958

SEQ ID NO: 349960 - RNA, 63 nt, hsa
auuguuuaagguuuccucaaacugugauuuuucugaacacaauaaacuauuuugaugaucuug

SEQ ID NO: 349961 - RNA, 63 nt, hsa
caccucucuucagccccuagugcuauucuguguugaacacaauugauacuucaggugcuuuug

SEQ ID NO: 349962 - RNA, 63 nt, hsa
ugaauguuuccaaaucuauuuuaucugacgucaugaacacacaggcaaugauuuuaugacaac

SEQ ID NO: 349963 - RNA, 63 nt, hsa
uuguggguuuugugccuuauaaauggaaauguaugaacacaauauaugcucauguagaauuuu

SEQ ID NO: 349964 - RNA, 63 nt, hsa
ccgucugaacucaaguagucauucauauaaauuugaacacaccugcugugccuagacaagugu

SEQ ID NO: 349965 - RNA, 63 nt, hsa
uuuccgaaaacugguuucuaguaaagccuugaaugaacacacacacacacacacacacacaca

SEQ ID NO: 349966 - RNA, 63 nt, hsa
guucucauuauacucuuauuuuaaauuuauauuugaacacagucaaaucugaauggaaauaca

SEQ ID NO: 349967 - RNA, 63 nt, hsa
uuucucuuuauuaacgauuuaaauguaacuuucugaacacauugcauugaauucuuccuuuaa

SEQ ID NO: 349968 - RNA, 63 nt, hsa
uggagcagagaucacauuucagagaggugagagugaacacauugucucugcuguggcaaagau

SEQ ID NO: 349969 - RNA, 63 nt, hsa
auguucuuauguucacugugucgggaaguuccaugaacacacaaggcaacaucauaaguagga

SEQ ID NO: 349970 - RNA, 63 nt, hsa
ggagcgacugucgagaucgccuaguauguucugugaacacaaauaaaauugauuuacugucug

SEQ ID NO: 349971 - RNA, 63 nt, hsa
ucccaagguggucguagugguggaguuggaguuugaacacaggccugacccuagaguccacac

SEQ ID NO: 349972 - RNA, 63 nt, hsa
uuccuacauuccaggccagaaccagcacaggacugaacacaucccugguuguaauguccauuu

SEQ ID NO: 349973 - RNA, 63 nt, hsa
gugccagaugccccagugccagagcugcgaacgugaacacaguggaaggcagaggguuuacua

SEQ ID NO: 349974 - RNA, 63 nt, hsa
guacuguacaguuaaucuuauuugccaucaucuugaacacaaaauguguauuuagaauauuug

SEQ ID NO: 349975 - RNA, 63 nt, hsa
cuugcccuaagcuaccugaggguuuaggaggucugaacacacacaguggagagguuaaucuag

SEQ ID NO: 349976 - RNA, 63 nt, hsa
gaaauguguauuuuggcuacaguuugcauacagugaacacauaaaaucuauauugaaaacuga

SEQ ID NO: 349977 - RNA, 63 nt, hsa
uucugagcaguuaaccucuaggauaauguggcuugaacacauuacagaacuauguuuugacuu

SEQ ID NO: 349978 - RNA, 63 nt, hsa
uauacauguguugcuuagugaaugauuaccaagugaacacacuugguauauugcuuuaccaaa

SEQ ID NO: 349979 - RNA, 63 nt, hsa
cuaauuauuuuaacuguauacaucuguuuaauuugaacacacuacaucguagggugacugauu

SEQ ID NO: 349980 - RNA, 63 nt, hsa
uauaauaaauuuaaaaucuaaaauguaaaauuuugaacacaacacuggaaaggguauccacag

SEQ ID NO: 349981 - RNA, 63 nt, hsa
gucucaguauagaucaguugguacagaaauacaugaacacauuuugauagggcuuauuucaca

SEQ ID NO: 349982 - RNA, 63 nt, hsa
agguuguucaaaguuuaagcaauucauucucucugaacacacauugcuauucccaucccaccc

SEQ ID NO: 349983 - RNA, 63 nt, hsa
uugguuucacuccugagauacgagaacguccucugaacacacaugcagauagcuggacuucua

SEQ ID NO: 349984 - RNA, 63 nt, hsa
cccuccuucccacuggccagcaccugaacccagugaacacaggcauuagugguccaggguccu

SEQ ID NO: 349985 - RNA, 63 nt, hsa
aagaauuuuaauuuguaaagaauugagccacauugaacacaauugaaugagauucagaauaaa

SEQ ID NO: 349986 - RNA, 63 nt, hsa
agcgagacccugucucuuaaaaaacgaugaugaugaacacagaggacggggcacugugcuggg

SEQ ID NO: 349987 - RNA, 63 nt, hsa
uucgugauuaaaaugcuccuaaucaagauuguuugaacacauguauuuauaaaacagagcuag

SEQ ID NO: 349988 - RNA, 63 nt, hsa
uugaugcccaauugguuagguaugaaaguaauaugaacacauuaauguugaauuuuacagaca

SEQ ID NO: 349989 - RNA, 63 nt, hsa
guagccagcagggaccuaaacuuuggcaaaaagugaacacaauucaaauacgaaugaaggaag

SEQ ID NO: 349990 - RNA, 63 nt, hsa
auauguguguuuacacauaugucugcaugcaugugaacacacacacacacacacacacaccag

SEQ ID NO: 349991 - RNA, 63 nt, hsa
guagaaaggucauccaaagaacaucugcacuccugaacacacccugaagaaauccugggaauu

SEQ ID NO: 349992 - RNA, 63 nt, hsa
agugugagaagacuggcuaguguggaagcauagugaacacacugauuagguuaugguuuaaug

SEQ ID NO: 349993 - RNA, 63 nt, hsa
aaauauuggauucauuuuaucgagaugccaagaugaacacaaugugaauaucauuuccauuuc

SEQ ID NO: 349994 - RNA, 63 nt, hsa
agaguuuccaucccaacaugauggacuuugguuugaacacaauucguuuuuucauuugaauug

SEQ ID NO: 349995 - RNA, 63 nt, hsa
cccuccguccugcugaaaacccccauaagccagugaacacagagcagcuagaggcuccuccuc

SEQ ID NO: 349996 - RNA, 63 nt, hsa
uggcaaagcuucuaccugauccucaaaacucauugaacacaagaaaauucauacuggagagaa

SEQ ID NO: 349997 - RNA, 63 nt, hsa
cagguauaauggugagagagcaagagagaggcaugaacacacagucaccuccacuccccauuc

SEQ ID NO: 349998 - RNA, 63 nt, hsa
ucuaaaaucaauuauuaggcaaucagaaaaauuugaacacagacuagauauuugaggauauua

SEQ ID NO: 349999 - RNA, 63 nt, hsa
cauuucacagauaaacuguaacaggugaacaggugaacacaaacaugagggaggguuggaguc

SEQ ID NO: 350000 - RNA, 63 nt, hsa
ucucauuauugcagagaacacuacauuacuuuaugaacacaggugucugagcuagaauuauuc

SEQ ID NO: 350001 - RNA, 63 nt, hsa
auacccacuguguagccuguguaugacuuuuacugaacacaguuauguuuugaggcagcaugg

SEQ ID NO: 350002 - RNA, 63 nt, hsa
ccaguuguuacccuagcaaggcuagggagggcaugaacacaaacauaagaacuggucuucuac

SEQ ID NO: 350003 - RNA, 63 nt, hsa
aaaucuaauccgguuacauuguggcugguuucuugaacacauucuaacugugcaaaauuaucu

SEQ ID NO: 350004 - RNA, 63 nt, hsa
gcugggaacccgacugugaaaguaugugauaucugaacacauacuagaaagcucugcaugugu

SEQ ID NO: 350005 - RNA, 63 nt, hsa
cacaccuccaguuuuugcucuuuuguguuguacugaacacaauauuuguguuuuuauuauuua

SEQ ID NO: 350006 - RNA, 63 nt, hsa
ugcuggugaaacguauaaucacauccaauuauuugaacacaugcaaaauaauuuuuuaaauua

SEQ ID NO: 350007 - RNA, 63 nt, hsa
cuaagcauuaacuuaauaaucacauuuaagacuugaacacaugcuacccuuuugucaucuucu

SEQ ID NO: 350008 - RNA, 63 nt, hsa
gcucugauugaucuauucuugcacgauuuccucugaacacaggguuccagaguacuuaaacac

SEQ ID NO: 350009 - RNA, 63 nt, hsa
cuaaugacauuuugcagauuaaaaacauucauuugaacacaguaguccccuagaaaaacaacu

SEQ ID NO: 350010 - RNA, 63 nt, hsa
gcugguguugaauagggccuuugagaaucagacugaacacagugaaauaugugcccaaaguuc

SEQ ID NO: 350011 - RNA, 63 nt, hsa
acuuuuguucugcugguggguaaaaucuuaggcugaacacauauuucaaugguaagauacuua

SEQ ID NO: 350012 - RNA, 63 nt, hsa
caugacugguguccuucuaaggagauggccacaugaacacagacacgcagggagaaggcagcc

SEQ ID NO: 350013 - RNA, 63 nt, hsa
ugcugcuaggcuggagcacacacuggccauuacugaacacagccauauuagggaaagcaaaaa

SEQ ID NO: 350014 - RNA, 63 nt, hsa
caacagugucaguuuaggaaauuauuacuacuuugaacacaaacugaaauugcaacuuugccu

SEQ ID NO: 350015 - RNA, 63 nt, hsa
cagaaaaggaaaugacacuugagauccuuggaaugaacacagcuucuaaagugugcauauacu

SEQ ID NO: 350016 - RNA, 63 nt, hsa
uugcuuuuucacuguuuccuauuaaucuucagcugaacacaagcaaaccuucucaggaggugu

SEQ ID NO: 350017 - RNA, 63 nt, hsa
guuugggucaagauccugguucuuauggguccaugaacacacuugugaccuuaguacuugguc

SEQ ID NO: 350018 - RNA, 63 nt, hsa
aacugguuuuguucugaauaguacagauugaugugaacacaaagcauuuuguguaaggagaac

SEQ ID NO: 350019 - RNA, 63 nt, hsa
caugaaaguugcuugacagcucuaauuacgaauugaacacauuaaacaccuggugaaauuauc

SEQ ID NO: 350020 - RNA, 63 nt, hsa
uacuuauuuuuaaguaucuugacagaagcaauuugaacacagugucccgucauuucuagaaac

SEQ ID NO: 350021 - RNA, 63 nt, hsa
aaaggaaaaaaagaaaaaaggaaaaaaacaguuugaacacaaaggcucuauggaagaaaugcc

SEQ ID NO: 350022 - RNA, 63 nt, hsa
uuccuguguaauuuggguagauuuucaagagugugaacacaaauuuaaaauaagcuauaauca

SEQ ID NO: 350023 - RNA, 63 nt, hsa
gacuuuaauuuuggcaaacauuuuagaagcuugugaacacaugacgucagaucaaagaaaaca

SEQ ID NO: 350024 - RNA, 63 nt, hsa
agacuucauccuuagguuuucucaagauuuaagugaacacauuuacacauaucaauuucuuaa

SEQ ID NO: 350025 - RNA, 63 nt, hsa
uccccuacacauacaugcacauagacacacacaugaacacacugaagauauuuccuucaggug

SEQ ID NO: 350026 - RNA, 63 nt, hsa
uuuacgucuuaagagcagauaagugacuaagacugaacacauacauuuuguggaguauauagu

SEQ ID NO: 350027 - RNA, 63 nt, hsa
guuagagaaaaagccuuuuuauccugcuuucuuugaacacauacuugaucaaaauuauuugua

SEQ ID NO: 350028 - RNA, 63 nt, hsa
uagcccuuucccagccuuuuugguuuuuuuaauugaacacauuucaucuaaguaaagcucagu

SEQ ID NO: 350029 - RNA, 63 nt, hsa
caagaaaggaaaacuacagaucaauauuuccauugaacacagaugcagaaauccucaaaauau

SEQ ID NO: 350030 - RNA, 63 nt, hsa
auccugccucagcccgccaagguagccaucccaugaacacacuguguccuggugcucucugcc

SEQ ID NO: 350031 - RNA, 63 nt, hsa
gagaccugggauuugagauaccacaaacccugcugaacacagugucuguucagcaaacuaacc

SEQ ID NO: 350032 - RNA, 63 nt, hsa
auugagauuugaccugaaaaacaaugaaacacaugaacacacuuccgauuuucuccucgcuga

SEQ ID NO: 350033 - RNA, 63 nt, hsa
cucauuugauccuaauuuuccccguauucuacuugaacacauuaaaaauacucugcugccuau

SEQ ID NO: 350034 - RNA, 63 nt, hsa
auuuuaauggcuuuuuugaaaguuccuuuuucaugaacacacccgagaaaucuuaaauagaca

SEQ ID NO: 350035 - RNA, 63 nt, hsa
uccacacuaaauuaagugggucaguaccaacaaugaacacauuauuuccuggucuacugguac

SEQ ID NO: 350036 - RNA, 63 nt, hsa
uacuuauucauucuguacuuaaauuuuuucuaaugaacacauauacuuuuguaaucagaaaau

SEQ ID NO: 350037 - RNA, 63 nt, hsa
uuguaauacgugugcauaaaaauuaaauagaggugaacacaauuauuuuaaggcaguuaaauu

SEQ ID NO: 350038 - RNA, 63 nt, hsa
caagaaaggaaaacuacagaucaauauuuccagugaacacagaugcagaaauccuuaaaaugu

SEQ ID NO: 350039 - RNA, 63 nt, hsa
uguuaaauguggaucuuuuacaccacaucacagugaacacacuggggagacgugcuuuuuugg

SEQ ID NO: 350040 - RNA, 63 nt, hsa
aagccaauaacaugacaggagcugggacugguuugaacacagggugugcagauggggaggggg

SEQ ID NO: 350041 - RNA, 63 nt, hsa
ugcauauccuauuuccaggcaggcucucuuacuugaacacaaauccaaaaacuaauuuagagu

SEQ ID NO: 350042 - RNA, 63 nt, hsa
uaacauuuuaauguuuaugcucauaaaacuuagugaacacacuguguuaugccagcucaaauc

SEQ ID NO: 350043 - RNA, 63 nt, hsa
ucaggauucguauuuuuaaagauuuaguuaauaugaacacagcacagauuuguuagaagaaaa

SEQ ID NO: 350044 - RNA, 63 nt, hsa
cucaccaucuauacacccuguauguccagcuuuugaacacaagggaaccaugcuucucuuaga

SEQ ID NO: 350045 - RNA, 63 nt, hsa
agcucacacagcuaacaaguagcacacugaguuugaacacagaucauucuccuuguaaaagcc

SEQ ID NO: 350046 - RNA, 63 nt, hsa
cagagggaagaugauaauauauaaauaauauaaugaacacacccuuaguuucucauaagcauu

SEQ ID NO: 350047 - RNA, 63 nt, hsa
aaguaaauucuaguuuguaguucucauuuguaaugaacacauuaacgacuagauuaaaauauu

SEQ ID NO: 350048 - RNA, 63 nt, hsa
acuuuucuaaauguagugccuuuaaaggaaaaaugaacacagggaagugacuuugcuacaaau

SEQ ID NO: 350049 - RNA, 63 nt, hsa
cagagaagauuguauaguuggggcuggucuuggugaacacacauuauuaccccacacaucccc

SEQ ID NO: 350050 - RNA, 63 nt, hsa
gguucugcugaggaaauggguaugaaugugccuugaacacaaagcucugucaauaagugauac

SEQ ID NO: 350051 - RNA, 63 nt, hsa
agccucccuaagaccuccugucacuggcuucagugaacacagacacugcagagccugggagca

SEQ ID NO: 350052 - RNA, 63 nt, hsa
caccugucaccuuguaaaacacggacauuagugugaacacaggacagcuucgcucuuucucuu

SEQ ID NO: 350053 - RNA, 63 nt, hsa
cuguaaacacagacagggucaaaguguuuucucugaacacauugaguuggaaucacuguuuag

SEQ ID NO: 350054 - RNA, 63 nt, hsa
cguuaggaaacagugagcuccggccccaccucgugaacacaaagccucggaucagccuugaga

SEQ ID NO: 350055 - RNA, 63 nt, hsa
ucaauguuaacaucauugcugcauuuuguacuuugaacacacacauaauauauauaaccagug

SEQ ID NO: 350056 - RNA, 63 nt, hsa
guucugaaauauuuuaccacugcugugaacaagugaacacauugugucacaucaugacacucg

SEQ ID NO: 350057 - RNA, 63 nt, hsa
cacagacacacaacacacacacauacacaccccugaacacacacacagacacacauacaccca

SEQ ID NO: 350058 - RNA, 63 nt, hsa
acuagcacauaccgcgugguguuuguauuucugugaacacacagccaguccguuucuaggcuu

SEQ ID NO: 350059 - RNA, 63 nt, hsa
uccuguggcaggaggcuuuggguggcucacuacugaacacauguguaugauacuaaagacggu

SEQ ID NO: 350060 - RNA, 63 nt, hsa
uuuuucuugauuaggucuggaacagcucuagaaugaacacauaaaauuuagcaauuuaaaauc

SEQ ID NO: 350061 - RNA, 63 nt, hsa
aagaguugccucugaguuagcucuuuggaaucgugaacacaggugugcuauauuguccuuguc

SEQ ID NO: 350062 - RNA, 63 nt, hsa
uuacuacaguguauuucacuugucuugugugucugaacacacagaagcuaauuagcaaguuuu

SEQ ID NO: 350063 - RNA, 63 nt, hsa
agcaaccaaacuuacuacuagccugcaaugcaaugaacacaagugguugcugagucucagccu

SEQ ID NO: 350064 - RNA, 63 nt, hsa
aggggagaaacccuaaaaagagaagaaucuuaaugaacacacaagcuugucaaugauuucaaa

SEQ ID NO: 350065 - RNA, 63 nt, hsa
aggaggcgugggaaacucuggcuuaggaaaacaugaacacaggggcaacagaggcaaacuguu

SEQ ID NO: 350066 - RNA, 63 nt, hsa
ugaggaggcuggagaaagggaaguggaaggcagugaacacacucagcagcccccugcccgacc

SEQ ID NO: 350067 - RNA, 63 nt, hsa
uuuccuacauucugaaaagcaaacaugaaaaacugaacacaguuuuuacagauauacaauaug

SEQ ID NO: 350068 - RNA, 63 nt, hsa
acugaucuaugcuguguuugcuuauucuuuaguugaacacacuaugaagaauuccagguguac

SEQ ID NO: 350069 - RNA, 63 nt, hsa
agcaaguucuauuuguucauugcuugccagagaugaacacagaauguucuguuucauuuuaca

SEQ ID NO: 350070 - RNA, 63 nt, hsa
aguuauuaauaucauaaguuauuauuaauauuuugaacacagguggaugugaaggauuuucau

SEQ ID NO: 350071 - RNA, 63 nt, hsa
uuguaaagccacuggcaucugauuaucuccauuugaacacacagcacagaacaaucauuuaaa

SEQ ID NO: 350072 - RNA, 63 nt, hsa
ucauuuaggacuguuuuuagacccuccuagccuugaacacacacauguacacacacacacaca

SEQ ID NO: 350073 - RNA, 63 nt, hsa
cugaugggacaauacccuguuggaagugacaacugaacacacuguguuggaucggagguuccg

SEQ ID NO: 350074 - RNA, 63 nt, hsa
agcugcuugggagguugaggagggaggauggcuugaacacagguguucaaggccagccugggc

SEQ ID NO: 350075 - RNA, 63 nt, hsa
accuacugagcgacccagcagccaccuccuuccugaacacauuuggcccacuccccccaucag

SEQ ID NO: 350076 - RNA, 62 nt, hsa
guaugugaagaugcuuggucaacuuguacccagugaacacacacagucaggccuggucuccc

SEQ ID NO: 350077 - RNA, 63 nt, hsa
gcuagcuagaccacagauaucuucuagacauauugaacacauuuaagauuugagggauauaag

SEQ ID NO: 350078 - RNA, 63 nt, hsa
uuucugagaaguuaguguuaaggucuuggaaugugaacacauuguuuguagugcuauccauuc

SEQ ID NO: 350079 - RNA, 63 nt, hsa
ugcuuuuaguuguaugagucucuuucuaugaacugaacacaaaacucaggaauugguggcuua

SEQ ID NO: 350080 - RNA, 63 nt, hsa
acaacacugauaauuauaccugucaagaagcugugaacacaugguguauaaauucuuuaccaa

SEQ ID NO: 350081 - RNA, 63 nt, hsa
cauaguuucuuuuguacuugaauauacaaaacaugaacacagugccauaugaauaauuucaca

SEQ ID NO: 350082 - RNA, 63 nt, hsa
aguuauuuauuuuuuaauaacccuugaaagucaugaacacaucagcuagcaaaagaaguaaca

SEQ ID NO: 350083 - RNA, 63 nt, hsa
aacaaaaucuuucaaaaaaaaaaucgggacaagugaacacauuaacaugauucuguuugugca

SEQ ID NO: 350084 - RNA, 63 nt, hsa
agaaacuuaacccaaggucaagcagaugaguagugaacacaggugaucgaguguuggcucuga

SEQ ID NO: 350085 - RNA, 63 nt, hsa
uuccccaacccacugguugggugucuuuaauugugaacacauauuuguaaauagugccuuuau

SEQ ID NO: 350086 - RNA, 63 nt, hsa
cuugaucuuuucuuuagauugaaagucugucucugaacacaauuauuuguaaaaguuaguagu

SEQ ID NO: 350087 - RNA, 63 nt, hsa
ggcaauuucucuggguucccaaagaaugacauuugaacacaguauuuugaaacagcucuaguu

SEQ ID NO: 350088 - RNA, 63 nt, hsa
agaaagguuuuuguugcuagucuggaaaacuggugaacacacuguuuauuaugacaaguuuuc

SEQ ID NO: 350089 - RNA, 63 nt, hsa
auuuaaaacaaacaagcaagcagacacacacagugaacacauuugauuaauuguguuguuuca

SEQ ID NO: 350090 - RNA, 63 nt, hsa
uugaaguagaggguaaaucagcgguaagaacagugaacacagugguugggauaaaauaaggug

SEQ ID NO: 350091 - RNA, 63 nt, hsa
gcucugccuucauugcuggagacaguagaggcaugaacacacauggaugcacacacacacacg

SEQ ID NO: 350092 - RNA, 63 nt, hsa
ggaaucugugccguauugauaaggagaugauguugaacacacugcauaaauuugccugguuca

SEQ ID NO: 350093 - RNA, 63 nt, hsa
auuuuuuguccuuuauucaacauacuuauccucugaacacauaaauaagugaauaagauaaaa

SEQ ID NO: 350094 - RNA, 63 nt, hsa
gaagugauauggugaagggaaguggggaguauuugaacacaguugaauuuuuucuaaaaagaa

SEQ ID NO: 350095 - RNA, 63 nt, hsa
uaaaucaucucuguagacauguguucauauuaaugaacacauuuuuucucaacauuguagcag

SEQ ID NO: 350096 - RNA, 63 nt, hsa
caucagcacaaagaagcaaucaucaaauaauucugaacacaaauuuaauauuuuuuuuucuga

SEQ ID NO: 350097 - RNA, 63 nt, hsa
cagcuuaccuagucuuguagcauucggccuuggugaacacacacgcucccuggaagcuggaag

SEQ ID NO: 350098 - RNA, 63 nt, hsa
gcccguguuugucacuuacaaaaauguuuacuaugaacacacagaaauaaaaaauaggcuaaa

SEQ ID NO: 350099 - RNA, 63 nt, hsa
auuauauaagcaaaaugaaaagagaaacuuaaaugaacacagcucuuuaacaugguucaggua

SEQ ID NO: 350100 - RNA, 63 nt, hsa
uugcguuaggaugcucugaucugacauuugacaugaacacaaaguugcuagaugcucuuguug

SEQ ID NO: 350101 - RNA, 63 nt, hsa
ugugauaucugauggcuugaacuugcccacaguugaacacaagugcugucauugcauuucuuc

SEQ ID NO: 350102 - RNA, 63 nt, hsa
cauucucccuugauuccacuuguguggagggauugaacacaggcaaagaggugcugcuuugcu

SEQ ID NO: 350103 - RNA, 63 nt, hsa
aaucuguuguuuguuuccuauaagaugcuuugcugaacacauagcaaaauucaugugacggau

SEQ ID NO: 350104 - RNA, 63 nt, hsa
ccccacaacuuuaaacauugacgauuccuucucugaacacaggcagcuuucuagaaguuuccc

SEQ ID NO: 350105 - RNA, 63 nt, hsa
cuuaggaggacaguuuuaaugauuguacuugcaugaacacaaucauaugaugguaaagcagaa

SEQ ID NO: 350106 - RNA, 63 nt, hsa
uuguaagccguggcuauaguuuuaucaagacucugaacacaagauguaacaaugcaaauaaau

SEQ ID NO: 350107 - RNA, 63 nt, hsa
caguaccugaccaguauuaguugcauauaucauugaacacacauaccagagauguuuuagaaa

SEQ ID NO: 350108 - RNA, 63 nt, hsa
aagucaccuccauucucuaccucccaugcagcaugaacacaauuucucuccaccuggcuccca

SEQ ID NO: 350109 - RNA, 63 nt, hsa
ucuacauauuuuuuauuuuuuucugagaaauucugaacacauagaucucuuuccuaaacugac

SEQ ID NO: 350110 - RNA, 63 nt, hsa
agcaauauuuaaagaugcuuuggaaaccaaccgugaacacaucaacaccacgacgucuacgau

SEQ ID NO: 350111 - RNA, 63 nt, hsa
gaggcacuggcgaucccaguccuugcagcacccugaacacagcucagaccagugaggggugau

SEQ ID NO: 350112 - RNA, 63 nt, hsa
cccaguagucaccaaggcagguagugugauaaaugaacacaccacucugaggcuaauuaccua

SEQ ID NO: 350113 - RNA, 63 nt, hsa
gauuccuacuuuauguaauggggucgaaaucuuugaacacauuauuuauaaaaaccuguuuaa

SEQ ID NO: 350114 - RNA, 63 nt, hsa
ugggggaggagggagcgugaagguagugacuccugaacacacccagguggaaccaucuuuggg

SEQ ID NO: 350115 - RNA, 63 nt, hsa
cuagugccaaagguucaauucaguguauauaacugaacacacucauccauuugugcuuuuguu

SEQ ID NO: 350116 - RNA, 63 nt, hsa
gaugacuauauauaaaauuauauucacuacuuuugaacacauucugcuaugaauuauuuauau

SEQ ID NO: 350117 - RNA, 63 nt, hsa
uauuuuucccaauugcccugagcaguacaaugaugaacacacguuucaagagcagacaucuug

SEQ ID NO: 350118 - RNA, 63 nt, hsa
guggcuucaggccucgggaaucacaagacauccugaacacauugccuccucaucuucuuccug

SEQ ID NO: 350119 - RNA, 63 nt, hsa
guauugacaauucuucauguaggaaaccugaaaugaacacagucacaguuugauuaaaacauu

SEQ ID NO: 350120 - RNA, 63 nt, hsa
uuaaucauccuuaauccuuaucuuagggauacuugaacacaaacacugugguaggauaacagu

SEQ ID NO: 350121 - RNA, 63 nt, hsa
cccaguauucagaugugucuauaccuuccacuaugaacacagauaaacugaggcucagauaag

SEQ ID NO: 350122 - RNA, 63 nt, hsa
agugcauugcccuuuguuggggguaugcauguaugaacacacaugcuugucggaacgcuuucu

SEQ ID NO: 350123 - RNA, 63 nt, hsa
gauguuuuucccggccaguguugacaucuucccugaacacauuccucagugagaugcaggcau

SEQ ID NO: 350124 - RNA, 63 nt, hsa
uuucugaacaagaaggugaucaguguuugccuuugaacacaucuucuugcugaacauuaugua

SEQ ID NO: 350125 - RNA, 63 nt, hsa
ggcagagugcgcucacgcgagggcuggcugugaugaacacaucucucuuuuauuuuuauguuu

SEQ ID NO: 350126 - RNA, 63 nt, hsa
uguuggcuuuguauugaucucuccagucauuuuugaacacauccaauagaaacauuggcagca

SEQ ID NO: 350127 - RNA, 63 nt, hsa
uagauauuauaagcgaugaugguucuguugcuaugaacacagcagucggucccugucauuguc

SEQ ID NO: 350128 - RNA, 63 nt, hsa
ucaauaagaguuguauauuuaauauauuugcagugaacacagaauacuuuaugcauauuacug

SEQ ID NO: 350129 - RNA, 63 nt, hsa
uuugaugaugucuacagaaaaugcuggcugagcugaacacauuugcccaauuccaggugugca

SEQ ID NO: 350130 - RNA, 63 nt, hsa
gcaaccugcggaaggagguucucccagcccaucugaacacaaccagagguggcaggagaauuu

SEQ ID NO: 350131 - RNA, 63 nt, hsa
uuugcacaagguguguguaguaaguuaaauuguugaacacaaaaauguugcugcuugaggcau

SEQ ID NO: 350132 - RNA, 63 nt, hsa
aauuauuuaaguguacguguauuauuaaacugaugaacacauccccagaggccaacauucaau

SEQ ID NO: 350133 - RNA, 63 nt, hsa
ucaccugcuccauguggggacuggccuguuuccugaacacagaccucuuucuugugccuuguu

SEQ ID NO: 350134 - RNA, 63 nt, hsa
uucauuucacugggauuuugaagcauuucugucugaacacaaagccuguucuaguccuggcgg

SEQ ID NO: 350135 - RNA, 63 nt, hsa
uuaccuguguucuaucauguuuuucuuuuccauugaacacagcuuugagcugaagucuuucuu

SEQ ID NO: 350136 - RNA, 63 nt, hsa
cauccucuacugccauaccuuucccugggggcuugaacacagaacagggagauggacaaccac

SEQ ID NO: 350137 - RNA, 63 nt, hsa
agcucuggccuuguguguauauguauacauacgugaacacaugccugugugugugugugugug

SEQ ID NO: 350138 - RNA, 63 nt, hsa
uggaauccaucaguguuacgugaugagaauaggugaacacaccuugucagugaugauguaaac

SEQ ID NO: 350139 - RNA, 63 nt, hsa
aaucuaucauaagcagaccuaagcacaguuuuaugaacacaauuuugcccaugacauugccua

SEQ ID NO: 350140 - RNA, 63 nt, hsa
ccggcuccaucuugguucuagccgccaccugcaugaacacaguggcccggcuuaacgcacuaa

SEQ ID NO: 350141 - RNA, 63 nt, hsa
ucauuuggacuaaaaaaagaaagcagaaauccaugaacacauugcuucucggccuuuuggcua

SEQ ID NO: 350142 - RNA, 63 nt, hsa
aagagaccuacuugcacauucuuaaccuguauuugaacacaaaauaucuauacuucaugcucc

SEQ ID NO: 350143 - RNA, 63 nt, hsa
uaacuggaagaaauuguauugcugcguagaaucugaacacacugaggccaccuagcaagguag

SEQ ID NO: 350144 - RNA, 63 nt, hsa
uaaaccacagucuguaaucccaggagaauugcuugaacacaggaggcagagguugcagcgagc

SEQ ID NO: 350145 - RNA, 63 nt, hsa
ucccucaguccuuuauuguccauuccaauacauugaacacauuuccuuuacccuccacacacu

SEQ ID NO: 350146 - RNA, 63 nt, hsa
gcacccgugucuuacgauggacagugauaaaggugaacacacagagacagacuauucucuaag

SEQ ID NO: 350147 - RNA, 63 nt, hsa
ucugccuuaauuuuugaaaagcugcuaacuacaugaacacaaauguguauuuuuguugcagug

SEQ ID NO: 350148 - RNA, 63 nt, hsa
ccagcccggggacuguccuggguggagggcaggugaacacaagcugcugccggggacuguccu

SEQ ID NO: 350149 - RNA, 63 nt, hsa
ugcugccggggacuguccuggguggacggcaggugaacacaagcggcugccgcauguagccac

SEQ ID NO: 350150 - RNA, 63 nt, hsa
uggugacuugggguggacgccucugccuucacuugaacacaaaugugcuuccuauaaaaucau

SEQ ID NO: 350151 - RNA, 63 nt, hsa
agaggggcaccuuuucauggucucugcacccagugaacacauuuuacucuagaggcaucaccu

SEQ ID NO: 350152 - RNA, 63 nt, hsa
agcaccugcuacuauugcuacuccagcaguauuugaacacauggaacagguacauauauuaaa

SEQ ID NO: 350153 - RNA, 63 nt, hsa
uuagaguaguuacuuaugaagugguuauuaaagugaacacagcacauauacauuaucuauacu

SEQ ID NO: 350154 - RNA, 60 nt, hsa
gugccuccucuugcugcuaaaucucugcugugaacacaccacuuccuuauuacguccuuu

SEQ ID NO: 350155 - RNA, 63 nt, hsa
cugcuccuuaauagugcagacagaaaacugcagugaacacaugccaaaacaugauugaagccu

SEQ ID NO: 350156 - RNA, 63 nt, hsa
cagugggggugacugggugcacaccugcccaggugaacacagcggcugccagucuccuggucc

SEQ ID NO: 350157 - RNA, 63 nt, hsa
aguucuucaggcauuucuauuucacaaucgaauugaacacauuggccaaauaaaguugaaauu

SEQ ID NO: 350158 - RNA, 63 nt, hsa
ggaagaaaaugccaaagauaccucuaguuauguugaacacagccagcacaguuucgacauguc

SEQ ID NO: 350159 - RNA, 63 nt, hsa
ugcuacucuuaggcugcauaguuuaugagaaaaugaacacaugcauuuauggauccaguauca

SEQ ID NO: 350160 - RNA, 63 nt, hsa
uucugagaugugacgagacuuuugaaaaaauggugaacacacucuuggagagguaaauaguaa

SEQ ID NO: 350161 - RNA, 63 nt, hsa
uuuuuuagccuguugcuucagagagacacaaagugaacacacuggugugaaugucgcucucug

SEQ ID NO: 350162 - RNA, 63 nt, hsa
ugugcuuuuucauauuuugugauauauaaguagugaacacacauguuauuuacuucaaaagac

SEQ ID NO: 350163 - RNA, 63 nt, hsa
ccacaaacuucaguuguugguuaacguauuaacugaacacagacaauacagucugauuuagaa

SEQ ID NO: 350164 - RNA, 63 nt, hsa
aaagucagauggauucuuuugcuuucugaggggugaacacagaagacugcaacaagaaccaaa

SEQ ID NO: 350165 - RNA, 63 nt, hsa
uuagucucgugcauauaguugcuguuuuuuaaaugaacacaguugaguauuugaagugaauuu

SEQ ID NO: 350166 - RNA, 63 nt, hsa
gggacguuucaagcaguacauguuuuaauguagugaacacaguuaggaaaaccacgaugaucc

SEQ ID NO: 350167 - RNA, 63 nt, hsa
aaauuugauuuuguuauuagaaaaaugauuccgugaacacagauguguuuugaagaaguagca

SEQ ID NO: 350168 - RNA, 63 nt, hsa
agaggguuuuuuuaaaauuuuuuuuucucuuaaugaacacauuuucuaaaugaauuuuuuuug

SEQ ID NO: 350169 - RNA, 63 nt, hsa
cacacccaccccguucggccccgccccccgcacugaacacacccgcccucaaccccgcacccu

SEQ ID NO: 350170 - RNA, 63 nt, hsa
ugagacagaaaguuaacaaggauauccaggaauugaacacagcucugcaccaagcggaccuaa

SEQ ID NO: 350171 - RNA, 63 nt, hsa
aagaugcugauguacaauugucgugcauuugugugaacacauugcguucccaguccaugccau

SEQ ID NO: 350172 - RNA, 63 nt, hsa
caggacaaguuggcgaccuuacuccuccaaaacugaacacaaggggagggaaagaucauuaca

SEQ ID NO: 350173 - RNA, 63 nt, hsa
ggguggagaaaaggcguuggucgcagugauuggugaacacagcgggggugggugguagcgcug

SEQ ID NO: 350174 - RNA, 63 nt, hsa
ugcacaugcacacaccccacacgcauacacacaugaacacaugcacaugugcacacacaagua

SEQ ID NO: 350175 - RNA, 63 nt, hsa
gcuccgaggaaaaaguuucuucuuuugugggcaugaacacagugggcuucaguagguucaggu

SEQ ID NO: 350176 - RNA, 63 nt, hsa
uggagaugacaacugaguggggaaaacagaccgugaacacaaaacaucaaguuccacacacgc

SEQ ID NO: 350177 - RNA, 63 nt, hsa
cuucagaaaaacucuagggaugcacugcaugugugaacacaugauaaaaaagucaugcuuuau

SEQ ID NO: 350178 - RNA, 63 nt, hsa
gccugcuaggacaacucaacauugauagcccuuugaacacacaugcuaccaagcucugggaaa

SEQ ID NO: 350179 - RNA, 63 nt, hsa
uggagucggguccuggcaguggggacugccuggugaacacagaugugcuugggaugacgggug

SEQ ID NO: 350180 - RNA, 63 nt, hsa
aauguggaagcaacuuuguaucucaggucuuaaugaacacauaugaauucacaguggagaaga

SEQ ID NO: 350181 - RNA, 63 nt, hsa
ggaagcaaggaugcaacaagaugaugcugagcgugaacacaucugagaacuaaaugugcuucc

SEQ ID NO: 350182 - RNA, 63 nt, hsa
aacuacuauauauaugcaucuacccaagaaacaugaacacagggagucauguacuggucuaua

SEQ ID NO: 350183 - RNA, 63 nt, hsa
aagauuuauggaaaauacucugacgaguacucuugaacacaaguuccugauaacuuuaagauc

SEQ ID NO: 350184 - RNA, 63 nt, hsa
ucuccaucuugcauacagggcucccaauagaaaugaacacagagauauugccuguguguuugc

SEQ ID NO: 350185 - RNA, 63 nt, hsa; identical to SEQ ID NO: 350184

SEQ ID NO: 350186 - RNA, 63 nt, hsa
auucguguaaccacugcaaccacauaaaacuaaugaacacaaagucccucaugcuaccuuuuu

SEQ ID NO: 350187 - RNA, 63 nt, hsa
agcaacuuaggagccugaggcaggagaaugguuugaacacagggauggugaggcugcagugag

SEQ ID NO: 350188 - RNA, 63 nt, hsa
guaagcugaaacuaauaauuaggcaaugucaagugaacacaaauucaggaugacagacugcaa

SEQ ID NO: 350189 - RNA, 63 nt, hsa
gccgggcacuaaacacccgccugccugccagggugaacacacagccagcuuaucccucuuaag

SEQ ID NO: 350190 - RNA, 63 nt, hsa
cacaaagcaucaaaagacucacucacaaacuucugaacacaaacuccauggaugaaagcuguu

SEQ ID NO: 350191 - RNA, 63 nt, hsa
caucuuugcaggaaccaggaguccugagcacacugaacacaccucagagggaggauccuuguu

SEQ ID NO: 350192 - RNA, 63 nt, hsa
aaggaguaugcagggagcugggcuuccagaaaaugaacacagcaguucugcagaggacgggag

SEQ ID NO: 350193 - RNA, 63 nt, hsa
uagacuaagauuuguuuuccaggaggcucaaucugaacacacagaaugucagagcuggaaggg

SEQ ID NO: 350194 - RNA, 63 nt, hsa
augaauacuaaagucagaagcaguguuucauuuugaacacauuuuggauuauuaagcugacua

SEQ ID NO: 350195 - RNA, 63 nt, hsa
gaaaacauggaaacuuagacuuguauaguguaaugaacacaaauaccaaaacugcauuuuggu

SEQ ID NO: 350196 - RNA, 63 nt, hsa
gguuacugcugcgauugauguaguggagaugccugaacacaauucuauauuuuaguauuuuuu

SEQ ID NO: 350197 - RNA, 63 nt, hsa
gucaggguggagaucuggguuucuagaccucacugaacacacuggaauggcugaguuuaacuu

SEQ ID NO: 350198 - RNA, 63 nt, hsa
uuccauguccgauucacacgcuacacacccacaugaacacauucgaacuucgaaggccacaca

SEQ ID NO: 350199 - RNA, 63 nt, hsa
auuucaccaaacuauuaaucaaaagucacuuauugaacacauugauaaagcaucauguucccu

SEQ ID NO: 350200 - RNA, 63 nt, hsa
uuuuaugacgugcaggcaaauuaucauuuucugugaacacagcucagauuuuggcuggaaugg

SEQ ID NO: 350201 - RNA, 63 nt, hsa
ccugcugauggaagauaaacugcacacuuucccugaacacacuguauaaacucuuuuuaguuc

SEQ ID NO: 350202 - RNA, 63 nt, hsa
guuuaagaaaaaggaauaauuaauggcugugacugaacacacgcggcccugacggugguaucc

SEQ ID NO: 350203 - RNA, 61 nt, hsa
uggaagucaguguaacaugacaacgccagggugaacacacgccacuucccagcuaggagug

SEQ ID NO: 350204 - RNA, 63 nt, hsa
uuuggaaagcagugugcauaucuugaggggugaugaacacaagcaaaccaaguugcaccuggc

SEQ ID NO: 350205 - RNA, 63 nt, hsa
ggaaauauugagagagaagucggccagguaggaugaacacaggcaaugacugcgcagagugga

SEQ ID NO: 350206 - RNA, 63 nt, hsa
ugggcugugccuggaaggcgagccuugauugucugaacacauaaagcaaacuguccagaaggg

SEQ ID NO: 350207 - RNA, 63 nt, hsa
uggacccugguaaagaaaagccucagcucauagugaacacagcagaccuagaaauguagcagc

SEQ ID NO: 350208 - RNA, 63 nt, hsa
aagucagcugccggggagaaacuugcuccuaaaugaacacauaaguuuagaucgcaaugagga

SEQ ID NO: 350209 - RNA, 63 nt, hsa
accuaaaugaagaaaccaugccuggaggggccgugaacacagaacccucaagacaaggaugac

SEQ ID NO: 350210 - RNA, 63 nt, hsa
ucugcccagagauguggagcagaagcugggcccugaacacacggggccaugucuggacgagca

SEQ ID NO: 350211 - RNA, 63 nt, hsa
caaaggguguuucugugaugagagccaggggucugaacacagggccugggugccagggaaagg

SEQ ID NO: 350212 - RNA, 63 nt, hsa
cuggggggaggcagccagccaagacugggcccaugaacacagagagggccuaaccgagaucag

SEQ ID NO: 350213 - RNA, 63 nt, hsa
auuguuaaauugacucuucaaauauauaacauuugaacacaauuguguguguuuugguuaauc

SEQ ID NO: 350214 - RNA, 63 nt, hsa
cuccuucugcucaaggcugauguuuguaacuuaugaacacacgugaaguguugaguccaaaag

SEQ ID NO: 350215 - RNA, 63 nt, hsa
uuacuuuguugaaaaagaaaaagaaauuaaauuugaacacagugaaagcugcaaguaugccag

SEQ ID NO: 350216 - RNA, 63 nt, hsa
aguguucugcguggguggugauggggguucaccugaacacagaguguauuuucuuauugaggc

SEQ ID NO: 350217 - RNA, 63 nt, hsa
gugucuggcagaugaguaugucaaggauugagaugaacacauaagucuuggaaauuaaauaaa

SEQ ID NO: 350218 - RNA, 63 nt, hsa
gccuccuucucccucccacccaccucaagcaguugaacacagccaguuauucuuccauuauua

SEQ ID NO: 350219 - RNA, 63 nt, hsa
uauugcaagacuccucccacaauuauucuaaucugaacacaguuaucaggauuacaaaaugug

SEQ ID NO: 350220 - RNA, 63 nt, hsa
guuuguauauuuucugugacuugaaauaaacuuugaacacaauuuuaguacacugcaaauuga

SEQ ID NO: 350221 - RNA, 63 nt, hsa
auagacuaagaauaagaagcaucauacuauaacugaacacaauguguauucauaguauacuga

SEQ ID NO: 350222 - RNA, 63 nt, hsa
uauugaaacacucaaaaauaccacuucucaguaugaacacaauugcuaagagccuaauuuggu

SEQ ID NO: 350223 - RNA, 63 nt, hsa
acagucugagcagccaacccauuucaacaaaauugaacacaggacucuucugcucagcagcau

SEQ ID NO: 350224 - RNA, 63 nt, hsa
caaauaguaggcaagauggcacagggcaugaaaugaacacaaauuaugcuaagaauuuuuuau

SEQ ID NO: 350225 - RNA, 63 nt, hsa
cugugccacgucauccauaguuuauuguuaguaugaacacaacuguaacauuuaccugguauc

SEQ ID NO: 350226 - RNA, 63 nt, hsa
auauacaucuuguguauaaaaauugauaccuuaugaacacauuaaugaagacuuuauuuucag

SEQ ID NO: 350227 - RNA, 63 nt, hsa
uaccuucaaggcggaucugggcuuccacccucaugaacacagggauuggggagggaccagagc

SEQ ID NO: 350228 - RNA, 63 nt, hsa
ucaugguuuauauuucuuauucuauggaguucgugaacacaucuagguggaaugcaucugaga

SEQ ID NO: 350229 - RNA, 63 nt, hsa
ccuuaauuuccuuauuuauaaauuguggugguuugaacacauugcucauaaggucuuuucagu

SEQ ID NO: 350230 - RNA, 63 nt, hsa
uuccugucaagcaaucaagaaacaaacaaaagcugaacacauuucuuuuuaaaaaaaggagac

SEQ ID NO: 350231 - RNA, 63 nt, hsa
uaggcuuuaaugaccuuacaaagugaacauaacugaacacaaguauuuuuucaaugcaagaug

SEQ ID NO: 350232 - RNA, 63 nt, hsa
uauaugcagacuuccaugguuuguguguagccaugaacacagcuugcuugcauuuaguaagac

SEQ ID NO: 350233 - RNA, 63 nt, hsa
acaaauccacaucuuuuguaaaagccacuguuuugaacacauuuccuugaaaaauguuggugg

SEQ ID NO: 350234 - RNA, 63 nt, hsa
aaccugauuugaaagcuaacaauuuugauagucugaacacaagcauuucacuucuccaagaag

SEQ ID NO: 350235 - RNA, 63 nt, hsa; identical to SEQ ID NO: 350234

SEQ ID NO: 350236 - RNA, 63 nt, hsa
gcucaaaauccacugacgaucauucuccuaaacugaacacaugacuagaauugguggugagau

SEQ ID NO: 350237 - RNA, 62 nt, hsa
ugccuaacacaaaucugugauaacaacaggcugugccuuauuuugauaauuuucugauuccc

SEQ ID NO: 350238 - RNA, 62 nt, hsa
agacuuggguuuucucuuuggugguuucuaaagugccuuaucugcaaacaacuucuuuucuc

SEQ ID NO: 350239 - RNA, 62 nt, hsa
ccccaggggacccugcccacuuccuggacuucgugccuuacugagucucuaagacuuuuucu

SEQ ID NO: 350240 - RNA, 62 nt, hsa
uuuuuuuuuuccuuucaacuuaguugacauacgugccuuaaaaaggaaaacuaguguugcua

SEQ ID NO: 350241 - RNA, 62 nt, hsa
uccuucccuuucuuccuccuucccuuauuguagugccuuauaugauaauguagugguuaaua

SEQ ID NO: 350242 - RNA, 62 nt, hsa
uuugccauuccuaccuugcauuuuuccugucagugccuuagccaaggcaaggagauaaggau

SEQ ID NO: 350243 - RNA, 62 nt, hsa
uucaucuuccaacucaaacucuuaaaacccaagugccuuagcaaauucuguuuuucuaggcc

SEQ ID NO: 350244 - RNA, 62 nt, hsa
ucauugcacuuucccaccucuauaccuugccugugccuuaguguccucuuuuuuccaguuca

SEQ ID NO: 350245 - RNA, 62 nt, hsa
ucuacuguccucauugacuuguuugaaccuuagugccuuacccuguccucuucccaguucuc

SEQ ID NO: 350246 - RNA, 62 nt, hsa
ugaguucuaaaaggcaugcccacaucucuuucgugccuuaaggauagugagaugcacacuua

SEQ ID NO: 350247 - RNA, 62 nt, hsa
ucaaaaacagagcccauucuuaagaucacuuggugccuuaaagacacgcauuccaaagugga

SEQ ID NO: 350248 - RNA, 62 nt, hsa
ugugcagaaguuagaagggucuggcgggggcagugccuuacacaugcuugauucccacgcua

SEQ ID NO: 350249 - RNA, 62 nt, hsa
uuuuagagagguguuauacagggcgauuuuuggugccuuacuuuuaucuuaauuuuugccaa

SEQ ID NO: 350250 - RNA, 62 nt, hsa
augcagccuuuuaccuaagaaauuuucugucagugccuuaucuuaugaagaaacagaaccuc

SEQ ID NO: 350251 - RNA, 62 nt, hsa
gcaaggccuucucuccagacuaucguaaccuggugccuuaccaaguugugcuuuucuguuuu

SEQ ID NO: 350252 - RNA, 62 nt, hsa
ucacugccuuaagggggcugauggcgccaccugugccuuacauccagguucaggcaucacua

SEQ ID NO: 350253 - RNA, 55 nt, hsa; identical to SEQ ID NO: 174536

SEQ ID NO: 350254 - RNA, 62 nt, hsa
ucuugaugauccucaaggaaauacaaccuagggugccuuaaaaauaacaacaacaaaaaacc

SEQ ID NO: 350255 - RNA, 62 nt, hsa
auugccauggacaccaguugcgaagggaaauagugccuuacuauauguggguugagcuaugc

SEQ ID NO: 350256 - RNA, 62 nt, hsa
cagccuccucccuccaugccucucuggucagugugccuuaggguggccucucacucccacca

SEQ ID NO: 350257 - RNA, 62 nt, hsa
ugcgcuggaagcauaucccgugaaaaguguuagugccuuaggugaaagcaacauguaucccu

SEQ ID NO: 350258 - RNA, 62 nt, hsa
gcagggagccaggaggcaccugaggccuaucugugccuuagucacuucagcuaugagccaaa

SEQ ID NO: 350259 - RNA, 62 nt, hsa
accacuccccaccccagcuguaguuaauuucagugccuuacaaauccuaagcucagagaaag

SEQ ID NO: 350260 - RNA, 62 nt, hsa
aaaugucuauuuugaaauucccuaugcuaagggugccuuagaaucauugugucucuuuuauc

SEQ ID NO: 350261 - RNA, 62 nt, hsa
agcuuuuaauagugucauaaagauuauaauaugugccuuaaguuuuagucuuuagaacucua

SEQ ID NO: 350262 - RNA, 62 nt, hsa
auucuaaagagacugauagaauuaaaaacaaagugccuuaucuugcacuggaguucaagugc

SEQ ID NO: 350263 - RNA, 62 nt, hsa
aaaagaccacuuuuaccacucaggcucuauuugugccuuagcuugguuaugaguaaaaauua

SEQ ID NO: 350264 - RNA, 62 nt, hsa
ccuuugacucccugaccuccagagccaggguugugccuuauugucccaucugugggccucau

SEQ ID NO: 350265 - RNA, 62 nt, hsa
aaucugaugucaaauagcacuaagaaguuauugugccuuaugaaaaauaaugaucucugucu

SEQ ID NO: 350266 - RNA, 62 nt, hsa
ccacuccacuuuccuccacagaugccucuucugugccuuaagcagagucaggagaccccaag

SEQ ID NO: 350267 - RNA, 62 nt, hsa
uuucuugcaauuuaaugccaaaaguuugccaugugccuuaaacauauuacuauauauuuucc

SEQ ID NO: 350268 - RNA, 62 nt, hsa
ucagauauuugagaauaggggauuuuuuugaugugccuuaaauuauaccaaagauuacuaau

SEQ ID NO: 350269 - RNA, 58 nt, hsa; identical to SEQ ID NO: 174552

SEQ ID NO: 350270 - RNA, 62 nt, hsa
uuuguaccaaaacaguccuucaacuuugcacugugccuuaaguaauuacuaacaaaagguac

SEQ ID NO: 350271 - RNA, 62 nt, hsa
cuugaauauguaaaugggauuaauuuuguccugugccuuauguggaaaggaacuucuuuggu

SEQ ID NO: 350272 - RNA, 62 nt, hsa
uacgugcauguuuuccguacuuucagaauagagugccuuagcuaggccagaggcucguauug

SEQ ID NO: 350273 - RNA, 62 nt, hsa
uuacauuucuuuauacaaauaaugugcuuucagugccuuaguuacagcucccuuucuguuuc

SEQ ID NO: 350274 - RNA, 62 nt, hsa
gguacagucaggggaaaauagaucuaggcagagugccuuagucagggaccacgggcgcugaa

SEQ ID NO: 350275 - RNA, 62 nt, hsa
ugugggugugaaaaugccuacaaaggguuuuagugccuuagaaguccuaagaagcccaaucu

SEQ ID NO: 350276 - RNA, 62 nt, hsa
gcacaguaucagaggagccuguuaaccucucugugccuuaguuucuuagcccaugaaagaga

SEQ ID NO: 350277 - RNA, 62 nt, hsa
uuuuuucuucaguuaacaaaaucauaaauauggugccuuauaacaugaaaggaaaauuaguu

SEQ ID NO: 350278 - RNA, 62 nt, hsa
cauugcuuauguaguauuuuucuuuuggaaaugugccuuauguuaaacacuauguacuuuua

SEQ ID NO: 350279 - RNA, 62 nt, hsa
ggccccagcagcccuauggugaccgccacacugugccuuaaugucugccgggggcccaggcu

SEQ ID NO: 350280 - RNA, 62 nt, hsa
gggagaaggagccgugcgccagggcagggcccgugccuuagacuucucccgacccccagagc

SEQ ID NO: 350281 - RNA, 62 nt, hsa
caaggggccuucugcccgcccccgcccuagcugugccuuagucaguguguacuugugugugu

SEQ ID NO: 350282 - RNA, 62 nt, hsa
auaauucauauuucaggugguauuugcauucagugccuuacugguauucucagaacauuuua

SEQ ID NO: 350283 - RNA, 62 nt, hsa
aguaaaagccaggagaaauguuuaauccaauggugccuuacuuugugauuuaaaagaaauca

SEQ ID NO: 350284 - RNA, 62 nt, hsa
auuuaguaguuacauccuauuuccaaacaugagugccuuauuuaaaagggcauucuuaggac

SEQ ID NO: 350285 - RNA, 62 nt, hsa
ccauuucucuguguaauacaggcuuuagauuagugccuuauauugguuuugguuuggggcac

SEQ ID NO: 350286 - RNA, 62 nt, hsa
guggaggcugcuggaccuggucagagacugaugugccuuagcggcaaugguuagagcuuuuc

SEQ ID NO: 350287 - RNA, 62 nt, hsa
aucccuucuacuucacuccucaggggagugaagugccuuaagaaacaaagcccuguccuaau

SEQ ID NO: 350288 - RNA, 62 nt, hsa
caagugaagaguuugccuguacucuuaucugggugccuuaaggagagagauuguguucuucc

SEQ ID NO: 350289 - RNA, 62 nt, hsa
aaguggcauaaagcauauccauucagaaugaagugccuuaaauauagcaguagucuuuuuug

SEQ ID NO: 350290 - RNA, 62 nt, hsa
gaaggguugaagagugacaagcauugguaacagugccuuagaacugugucaguuagucugau

SEQ ID NO: 350291 - RNA, 62 nt, hsa
cacugucuuuaauacccccagcccaggagcucgugccuuacaugcugggcccacauucugcc

SEQ ID NO: 350292 - RNA, 62 nt, hsa
agaagaaaaguauuuaaaagaaauaccagugagugccuuaaaguuggagaaguaacugccca

SEQ ID NO: 350293 - RNA, 62 nt, hsa
aggucagggagugcuggcucacaguacagcaugugccuuaaugcuucauaugaggaggaugu

SEQ ID NO: 350294 - RNA, 62 nt, hsa
ucuuggucuccccuguggaaacccuucucccugugccuuagagcagguguguacaucucuca

SEQ ID NO: 350295 - RNA, 62 nt, hsa
uuaauuuuggaggggguggggaaauaguucuggugccuuaacgcauggcuggaauuuauaga

SEQ ID NO: 350296 - RNA, 62 nt, hsa
caaccucugccuucuggauucaagugauucuugugccuuagccucccaaguagcugggauua

SEQ ID NO: 350297 - RNA, 62 nt, hsa
gucggcacuuugccacuguguggcaguuacccgugccuuagucuucuccacucugcacccua

SEQ ID NO: 350298 - RNA, 62 nt, hsa
ccagcaguccacuaucugccagaggagcaagggugccuuagaccgaagccaggggaagaagc

SEQ ID NO: 350299 - RNA, 62 nt, hsa
uuacugcaagcuaccuuaauuucccaagaguggugccuuacucuguuuuuucugauaugguc

SEQ ID NO: 350300 - RNA, 62 nt, hsa
ccaacagaagcacauuugucuuccagaacaccgugccuuagaaaugcuuuagaaucugaacu

SEQ ID NO: 350301 - RNA, 62 nt, hsa
ucuguuuuaugguugugcuaaauucauagcaggugccuuauucuuugcuuuuagucaaacca

SEQ ID NO: 350302 - RNA, 62 nt, hsa
auauaaauguauguuggugugugaaaugcucugugccuuagaagcgugacaguucagcucuc

SEQ ID NO: 350303 - RNA, 62 nt, hsa
acuuaaauuuaguggucagaaauguauuugaagugccuuaaagaugaucaugguucagaaua

SEQ ID NO: 350304 - RNA, 62 nt, hsa
ugacuaacuuaaaaaaauagauuguaauugaugugccuuaauuugcauaaaucauaaaugua

SEQ ID NO: 350305 - RNA, 62 nt, hsa
uuucacuggauaauguguguagauuuuuacaugugccuuauuugacaaugcuuaugucuugu

SEQ ID NO: 350306 - RNA, 62 nt, hsa
gaaaaaauggagugauguuguaaucuaaacaagugccuuauguuuauugcuaagaacuggug

SEQ ID NO: 350307 - RNA, 62 nt, hsa
uucauuuguugguacauauuacacaaaacauugugccuuaaaaugagucauacaucuuuuaa

SEQ ID NO: 350308 - RNA, 62 nt, hsa
cugaucucucgugauugauaagaaccuuuugagugccuuacacaaugguuuucuuguguguu

SEQ ID NO: 350309 - RNA, 62 nt, hsa
uauaggaguucaccuucuuaggacuagagacugugccuuauagcuguuaauucauuuccccc

SEQ ID NO: 350310 - RNA, 62 nt, hsa
ucacagaauccuuccaagugcucuaucacagugugccuuaugggaaguuucugacuggaaaa

SEQ ID NO: 350311 - RNA, 62 nt, hsa
ggucuccaagagaaaauagaaaggcugcuuuagugccuuacgcuuacuaaauuuaaaucuuu

SEQ ID NO: 350312 - RNA, 62 nt, hsa
aguauaacaggugccuucacuuuugagacuuagugccuuaaaauauguauucuauaaugauu

SEQ ID NO: 350313 - RNA, 62 nt, hsa
uucccuuucccuaaaucaaaucaauauuaauugugccuuauuucacuuaacauagacuugaa

SEQ ID NO: 350314 - RNA, 62 nt, hsa
auaacauggaacuuacacaaaaggcuuuucaugugccuuacuuuuuuaaaaaggaguuuauu

SEQ ID NO: 350315 - RNA, 62 nt, hsa
caguuuaggaugcaauuacgaguguaaacugugugccuuauuuacacuuuauugucucccgc

SEQ ID NO: 350316 - RNA, 62 nt, hsa
uuguuaaugguucuuacagaguaucuuuaaaagugccuuaggggaacccugucccuccuaac

SEQ ID NO: 350317 - RNA, 62 nt, hsa
gaggaaccacgcugccaccaaagcagccggaagugccuuaacuuguggaaccaacacuaauc

SEQ ID NO: 350318 - RNA, 62 nt, hsa
aaacauagcugcaggucuuuggucccagggcugugccuuaacuuuaaccaauauuuucuucu

SEQ ID NO: 350319 - RNA, 62 nt, hsa
aauugaguauuguggguccccuaauucugugggugccuuaagugagaauuucuaaaugauuu

SEQ ID NO: 350320 - RNA, 62 nt, hsa
cugugaauagccuguuuuccacauguaaauuugugccuuacaccuugaguuguguacacuug

SEQ ID NO: 350321 - RNA, 62 nt, hsa
aggaagaugaauuuuuaaaaucuccaucaaacgugccuuaaagcuaaagcauuuugacagga

SEQ ID NO: 350322 - RNA, 62 nt, hsa
ugcgcgggaggccacagcccgugccgauuccagugccuuaacuacuuaccggaucccuccau

SEQ ID NO: 350323 - RNA, 62 nt, hsa
ggacgaugagacuuugaaacuaucucaugccagugccuuauuacccaggaagauuuuaaagg

SEQ ID NO: 350324 - RNA, 62 nt, hsa
uuguaucuagaucuuugcucuguguuucaguugugccuuacccucuguaagauacugauucu

SEQ ID NO: 350325 - RNA, 62 nt, hsa
acaggguuccugagcucacugaaaagacuauugugccuuaggaaaagcauuugcuguguuuc

SEQ ID NO: 350326 - RNA, 62 nt, hsa
uugacaguauauuugaaacuguaaauauguuugugccuuaaaaggagagaagaaaguguaga

SEQ ID NO: 350327 - RNA, 62 nt, hsa
uuuucuuccuuuuugugagauuuguggguuuugugccuuauaaauggaaauguaugaacaca

SEQ ID NO: 350328 - RNA, 62 nt, hsa
uggaguguggggaagcugcugucucccaggaagugccuuacucaucccgcaaccagucagcg

SEQ ID NO: 350329 - RNA, 62 nt, hsa
aaaguauuuguuuuuauuuguaccauccacuugugccuuacuguauccugugucauguccaa

SEQ ID NO: 350330 - RNA, 62 nt, hsa
uuuggcaaacagaauguucauacugauguguugugccuuaaagacaagacagcauuugugug

SEQ ID NO: 350331 - RNA, 62 nt, hsa
gcaaacaaggaaaggaaaggaaagaagaaaaggugccuuaguccuuuguugcacuuccauuu

SEQ ID NO: 350332 - RNA, 62 nt, hsa
gggcacuguacuuggaucuucccggcgugugugugccuuacacaggggugaacuguucacug

SEQ ID NO: 350333 - RNA, 62 nt, hsa
ccccugcggaggagcgcucccgucucccacaggugccuuaccgcguucccucccgcugcuuu

SEQ ID NO: 350334 - RNA, 62 nt, hsa
caugacauauugugguuaauuuuaaaacuacugugccuuaacguguuucuuaaacuuuugua

SEQ ID NO: 350335 - RNA, 62 nt, hsa
acuucccgugcagacucagaugccaacucaaagugccuuagcccagguuccugggcuucugc

SEQ ID NO: 350336 - RNA, 62 nt, hsa
cacacauagccccccaucagcuguuuuacuccgugccuuacuggauuuggccuguccucaag

SEQ ID NO: 350337 - RNA, 62 nt, hsa
ugcacauuuguacauauacuuaauguuuucaagugccuuaauuguuuaaaaucucuggcuuc

SEQ ID NO: 350338 - RNA, 62 nt, hsa
agcaucuuaugucauugagaauauaaagaacagugccuuagaagacagugaaagguaagcuc

SEQ ID NO: 350339 - RNA, 62 nt, hsa
cagcccagcaggccaggcagacacaccccgcugugccuuaggaaggugugagaccggcuucc

SEQ ID NO: 350340 - RNA, 62 nt, hsa
uuuaguuguuucuagacuauaaauguugcuaugugccuuauguugaaaaaauuuaaaaguaa

SEQ ID NO: 350341 - RNA, 62 nt, hsa
aagauaauucauacuggagaaaacucccagaagugccuuauugcacaggaaagcauuuauac

SEQ ID NO: 350342 - RNA, 62 nt, hsa
ggcauuuccucuauucuguuacgucauuaacagugccuuacugugcaaggcaccaaaggaca

SEQ ID NO: 350343 - RNA, 62 nt, hsa
cuucccaaacaguaacucacuccaggccaagugugccuuagcacgagugaccacaguuuaau

SEQ ID NO: 350344 - RNA, 62 nt, hsa
ugggaauaaaaauuugugcaagucagagaagggugccuuaaaaauguuguggccaagccaca

SEQ ID NO: 350345 - RNA, 62 nt, hsa
agcucguacauguggguucuuauccugauccugugccuuaaaguaggaagguguuuccaagu

SEQ ID NO: 350346 - RNA, 62 nt, hsa
agaaguccuuuaucugugcucucugcccgccagugccuuacaauuugcaaacguguauagcc

SEQ ID NO: 350347 - RNA, 62 nt, hsa
caguaaggaucuugcccucccugcaacaccgagugccuuagacagcugcugccugagaacug

SEQ ID NO: 350348 - RNA, 62 nt, hsa
ugaucagagauuuacaacuguucauuauaguggugccuuaggcaaucuuuccaaaguaaauu

SEQ ID NO: 350349 - RNA, 62 nt, hsa
uuaaaggauaguaauuauucuuguuuauaacagugccuuaagguaugauguauuucugaugg

SEQ ID NO: 350350 - RNA, 62 nt, hsa
ggaaauacuuuggcuuuuucauauaccuaguggugccuuaucauaauagcacuguuacauga

SEQ ID NO: 350351 - RNA, 62 nt, hsa
ggcauuuguccccuccaugcuauaauccaguggugccuuacauggugugugugugugugugu

SEQ ID NO: 350352 - RNA, 62 nt, hsa
cauaggaagagaucugccagacgcgaacucaggugccuuaaaaaguauuccaaguuuacucc

SEQ ID NO: 350353 - RNA, 62 nt, hsa
ggccagaaucauuauccuugaaauuucugguagugccuuagcuugguuaaaaaaaaaaaaaa

SEQ ID NO: 350354 - RNA, 62 nt, hsa
caugaggcagcacgugcacaaauucaugugccgugccuuaucugaguuuucgguauaaauau

SEQ ID NO: 350355 - RNA, 62 nt, hsa
uggaaauuaaaaaaaaaaaacuagacuccauugugccuuacuaaauaugggaaugucuaacu

SEQ ID NO: 350356 - RNA, 62 nt, hsa
acuuugguccucuauguauuuaaauguuugaagugccuuagacucuugccauauuuucaaaa

SEQ ID NO: 350357 - RNA, 62 nt, hsa
auguuacuuuuaguuuuaaaaugaaaucuuaggugccuuagggguuuuuuuuuuuuuuaagu

SEQ ID NO: 350358 - RNA, 62 nt, hsa
auagccuaagugcuauaucgaucgucccggaugugccuuaagaaccgugaccucaucagucg

SEQ ID NO: 350359 - RNA, 62 nt, hsa
uggaaccuggacacccucagcucuccugcuuugugccuuaucuacaggagcaucgcccauug

SEQ ID NO: 350360 - RNA, 62 nt, hsa
gcuagagcuucuguauuuucaaagacugccacgugccuuaggaauacuguuuuaucuccaua

SEQ ID NO: 350361 - RNA, 62 nt, hsa
cuggauguccagcaccugagcguggaugcaccgugccuuaucaaagccagcaccacuuugcc

SEQ ID NO: 350362 - RNA, 62 nt, hsa
cuccauuacucucccugcccuucucuguuggggugccuuauccugagccaccuccucucccc

SEQ ID NO: 350363 - RNA, 62 nt, hsa
cuggcucugcccuucuuacugcaaaccaugcugugccuuagggcccuucucauagcuguucc

SEQ ID NO: 350364 - RNA, 62 nt, hsa
ucuuucuguccgcagauccugacuuuuccaaagugccuuaaaagaaaucagacaaaugcccu

SEQ ID NO: 350365 - RNA, 62 nt, hsa
ggugagcagccacugugcaguucaacguaagugugccuuaauugcacagagguacugccccc

SEQ ID NO: 350366 - RNA, 62 nt, hsa
cacagccccagcccugcccccgucacacugcugugccuuagucauguuguucccuuugcucg

SEQ ID NO: 350367 - RNA, 62 nt, hsa
ugcucuucugucuauaaauuuugaaugauacugugccuuaauugguuuucauaguuuaagug

SEQ ID NO: 350368 - RNA, 62 nt, hsa
aauuacuguguauuuacuuaauuucuuauuaugugccuuauuaugugcuuaagauacaauag

SEQ ID NO: 350369 - RNA, 62 nt, hsa
ugaaauuuggggcccaaaauuucacacuucaugugccuuacugaugagaguacuaacuggaa

SEQ ID NO: 350370 - RNA, 62 nt, hsa
cuuacaccacaaccagcuucuccaggucauaugugccuuaccuccagagagucuuuuuuuuu

SEQ ID NO: 350371 - RNA, 62 nt, hsa
gauuccucaaguaccauuugcuaggcugugaggugccuuagggcaggucucuugugcccugu

SEQ ID NO: 350372 - RNA, 62 nt, hsa
gagccacugagggauguuuuccccccuugcuugugccuuaaaggcagagaagcgaggcggau

SEQ ID NO: 350373 - RNA, 62 nt, hsa
ggccagcaccucccuccuccaucgcucgcugugugccuuaaacuccaucucaugucccuccc

SEQ ID NO: 350374 - RNA, 62 nt, hsa
cagugguagauuuaugauucacauccgaaagugugccuuaguuaucaauuuaacauuucucu

SEQ ID NO: 350375 - RNA, 62 nt, hsa
ggguaauucauugacuuguuuuaguauuuugugugccuuagauuuccguuuuaagacaugua

SEQ ID NO: 350376 - RNA, 62 nt, hsa
gcuuuggggggugugcugacaacuuagcucaggugccuuacaucuuuucuaaucacaguguu

SEQ ID NO: 350377 - RNA, 62 nt, hsa
uugcauuuuguaccucaauauuucuacgucaugugccuuaguaaaaaaaaauaauaaauaaa

SEQ ID NO: 350378 - RNA, 62 nt, hsa
cuuuccagccagugucucugacgucgggguuagugccuuagaggguacuggggucuggucuu

SEQ ID NO: 350379 - RNA, 62 nt, hsa
cagccuaguguuaacauucuugguaucuuuuugugccuuaucuaaaacauuucucgaucacu

SEQ ID NO: 350380 - RNA, 62 nt, hsa
gggugguaauauuggcauucugauuaaauacugugccuuaggagacuggaaguuuaaaaaug

SEQ ID NO: 350381 - RNA, 62 nt, hsa
ucagugacagggcuucuuguaauuugugguaugugccuuaaaccugaaugucuguagccaaa

SEQ ID NO: 350382 - RNA, 62 nt, hsa
ccuccccugggccgcugaggccccgcgcaccugugccuuaaucuucccuccccugugcugcc

SEQ ID NO: 350383 - RNA, 62 nt, hsa
cccccuacacuucaguugagggaaaagcucaagugccuuaggcccguggaccacagucuugg

SEQ ID NO: 350384 - RNA, 62 nt, hsa
gacuucugccacagugacaauggaauuguguugugccuuacuucagagguggucucuucuuu

SEQ ID NO: 350385 - RNA, 62 nt, hsa
uuuugguugaaauugaacauacucuagugaaugugccuuaaaaaucaagacacuaguucaga

SEQ ID NO: 350386 - RNA, 62 nt, hsa
cuucagcuucuuacguuuucugagcauccauugugccuuaacauuuucugcuuguccuuugg

SEQ ID NO: 350387 - RNA, 62 nt, hsa
auuuggagaccagcuaugccugcccucugugggugccuuagcauugcgggaggguggugcuu

SEQ ID NO: 350388 - RNA, 62 nt, hsa
aguugugccuuggugccuuguccgccucagcugugccuuaaggacuaauucuggcaccccuu

SEQ ID NO: 350389 - RNA, 62 nt, hsa
gucuuaauauaucuuaggcuucaauuauuugggugccuuaaaaacucaaugagaaucauggu

SEQ ID NO: 350390 - RNA, 62 nt, hsa
ggugcugguucacucugcccagcccugaaugugugccuuaaaggcccccuacaaggggcccc

SEQ ID NO: 350391 - RNA, 62 nt, hsa
gaaccccuuuaucccaggaaguccucuuccuugugccuuaacauacaggacaaauaggcucu

SEQ ID NO: 350392 - RNA, 62 nt, hsa
guuugcacagcccuuguguguggggcuagaaugugccuuaguccugaauccuagcccuuacc

SEQ ID NO: 350393 - RNA, 62 nt, hsa
agccugaagagcuuauuacuuauuugugcgaagugccuuaugcuaugagaccauucagaaua

SEQ ID NO: 350394 - RNA, 62 nt, hsa
gcgauggaguguggcugggcugaccgcaaaaggugccuuacacacugcccccacccucagcc

SEQ ID NO: 350395 - RNA, 62 nt, hsa
ccagcuguauuauuuugaucuuuuggaugcaggugccuuaaugaagcucucaaaauauuuua

SEQ ID NO: 350396 - RNA, 62 nt, hsa
uuuuuuccugucuugggagauagaauaaugaugugccuuacaauggauuguguuuuagauuc

SEQ ID NO: 350397 - RNA, 62 nt, hsa
cccuuuccuaaucuggcuuuuacauuuauuuugugccuuaaagauuaacuacaaagauaaac

SEQ ID NO: 350398 - RNA, 62 nt, hsa
ugcuuucguaucuccucaggcaaaaguggagggugccuuaugggcccuccucauagguuguc

SEQ ID NO: 350399 - RNA, 62 nt, hsa
augcacacuauucuguaacagaaagcccuauugugccuuaccugugugcuuuugugggcacc

SEQ ID NO: 350400 - RNA, 62 nt, hsa
uccauuucuuuuuucccaaacccucaaacagagugccuuaaaaaauuguuuuaucaggauaa

SEQ ID NO: 350401 - RNA, 62 nt, hsa
aauaggaggguggcaagaacaguucuauccuggugccuuacgaauaaaaaacuggauucugg

SEQ ID NO: 350402 - RNA, 62 nt, hsa
gccacugaacaucccuucucugcuccacaggagugccuuagacagccugacucuccacaaac

SEQ ID NO: 350403 - RNA, 62 nt, hsa
ggcugucaggcgacuacaagacugagggucuugugccuuauagaucuuuguaucccccaugg

SEQ ID NO: 350404 - RNA, 62 nt, hsa
aagcaccugccgaccucguccucccccugccagugccuuaccuccugcccaggagagccagc

SEQ ID NO: 350405 - RNA, 62 nt, hsa
uaacaggaccccaaggaccugccuccccggaagugccuuaaccuagagggucggggaggagg

SEQ ID NO: 350406 - RNA, 62 nt, hsa
gaagaugggagauuccuaaguggaggagaacugugccuuacugaccuaaauauccacucagu

SEQ ID NO: 350407 - RNA, 62 nt, hsa
ugcuaaggggggagggugaggauuaaguacucgugccuuauauuugugugccaauuaaugcc

SEQ ID NO: 350408 - RNA, 62 nt, hsa
uaaagggauguaagcacuuuuauuuuaauaaagugccuuauaacaaguucuuugcaugcuuu

SEQ ID NO: 350409 - RNA, 62 nt, hsa
cuucuuucccucuauccaaaggagcuugguaagugccuuacugcagcgugucuccuggcacg

SEQ ID NO: 350410 - RNA, 62 nt, hsa
guuuuaaucucuaacaguggacaaaguuaccagugccuuaaacucuguuacacuuuuuggaa

SEQ ID NO: 350411 - RNA, 62 nt, hsa
guuucaguguuguauauauaaauaugcaagaugugccuuacaaugaaguuguuggaagcuau

SEQ ID NO: 350412 - RNA, 62 nt, hsa
uuccugccuaauuuuuauaucuucuaagcaaagugccuuaggauagcuugggaugagaugug

SEQ ID NO: 350413 - RNA, 62 nt, hsa
gauucuguuuuaaguccauaccuuguaaauaagugccuuacgugagugugucaucaaucaga

SEQ ID NO: 350414 - RNA, 62 nt, hsa
ggccaccaguuaaaugccgucuaucagguuuugugccuuaagagacuacagagucaaagcuc

SEQ ID NO: 350415 - RNA, 62 nt, hsa
uguaccucacuguccaauaugaaaaccguaaagugccuuauaggaauuugcguaacuaacac

SEQ ID NO: 350416 - RNA, 62 nt, hsa
gccccuauggcgccccugcugggccacugauugugccuuauaaccugccuuugccuggggga

SEQ ID NO: 350417 - RNA, 62 nt, hsa
auuuuagucucugugaagccuuuacucucuaggugccuuauaauguuucagggcucaacuuu

SEQ ID NO: 350418 - RNA, 62 nt, hsa
uggcgguacccacccagcccaagggagucacagugccuuagaaguggcagaggugaggguca

SEQ ID NO: 350419 - RNA, 62 nt, hsa
gcaaccaauuauauacucaauaugguuuuacugugccuuacacaaagagaaacucuauacag

SEQ ID NO: 350420 - RNA, 62 nt, hsa
uguguguguuuuuaauauucacacugagacaugugccuuaaacagacuuuuuaguccaaaau

SEQ ID NO: 350421 - RNA, 62 nt, hsa
cgacacuuugucgacacugaaauaucgauuaagugccuuaaaaccucuuuagacauagcuau

SEQ ID NO: 350422 - RNA, 62 nt, hsa
uuggaggagggguaugaaguaucuuugacauggugccuuaggaaugacuuggguuuaacaag

SEQ ID NO: 350423 - RNA, 62 nt, hsa
ggcuguauagcaaaguguuuuaauccacgguugugccuuauuguuccauuaaaauuguaucu

SEQ ID NO: 350424 - RNA, 62 nt, hsa
gugaacagaaguccuuaagcagaggaauuggugugccuuaaagauacaaucugggauaguuu

SEQ ID NO: 350425 - RNA, 62 nt, hsa
ugaugacucaaguguagacugaaguugagguagugccuuaugccauuaugucauauguugaa

SEQ ID NO: 350426 - RNA, 62 nt, hsa
cacaugugaguuuaccugaaucugugcauuuugugccuuauucaugagaaugauagaaguac

SEQ ID NO: 350427 - RNA, 62 nt, hsa
aacaguaugguacugcuucugugacaaauaucgugccuuaacaauguggcuguccuuuucca

SEQ ID NO: 350428 - RNA, 62 nt, hsa
cauuguuuuuaaaacuguuuuauaucuuaagagugccuuauuaaaguauagauguaugucuu

SEQ ID NO: 350429 - RNA, 62 nt, hsa
ugagaguuaggagaaauauuucagagccaaaagugccuuauacaaccuuagccuauuauagu

SEQ ID NO: 350430 - RNA, 62 nt, hsa
gugaugcuaaaguaaugguggauaagcugcuggugccuuagugugaaucaagguagugccac

SEQ ID NO: 350431 - RNA, 62 nt, hsa
ucugggccuggugugggggcuaccucaacuaugugccuuaugguaacuuguucuguaccucc

SEQ ID NO: 350432 - RNA, 62 nt, hsa
cucgccugccuucugagcugcacuuuccgugggugccuuaugugguggugguugugcccagc

SEQ ID NO: 350433 - RNA, 62 nt, hsa
uguucuuaauuccuagcaucugcuaucaaacugugccuuauuaaaaccaaauuguggcuauu

SEQ ID NO: 350434 - RNA, 62 nt, hsa
cccgugucuaugacgcaaagaucaccagccaugugccuuaguguccuucuuaacagacucaa

SEQ ID NO: 350435 - RNA, 62 nt, hsa
uuauaccagaaaguuaaauucucagaucaaaugugccuuaauaaauuuguuuucauuuagau

SEQ ID NO: 350436 - RNA, 62 nt, hsa
ucaugagaguggagcccucaugaaugggaucagugccuuaugaaaggcccuagagagauacc

SEQ ID NO: 350437 - RNA, 62 nt, hsa
ugcagggaggcccuucccaagguguggugacugugccuuacuguacaugcucggaggccugg

SEQ ID NO: 350438 - RNA, 62 nt, hsa
cacuugggggaccaaucauguccuucaccacugugccuuagaaucgccccuggacagaguuc

SEQ ID NO: 350439 - RNA, 62 nt, hsa
acuugguacccauggccaccuccccauuuucugugccuuaucucacuguuucagcugagucc

SEQ ID NO: 350440 - RNA, 62 nt, hsa
uuucaaaugauuggaucuuugaaagcuucagcgugccuuaguuucuaggaucagaauuaguu

SEQ ID NO: 350441 - RNA, 62 nt, hsa
acugagcccucguggccaccugugucacccuugugccuuagccucaugggcugccuaggagc

SEQ ID NO: 350442 - RNA, 62 nt, hsa
cucucggcggccucaccuggccucacugcuucgugccuuagcucgggggucgggggagaacc

SEQ ID NO: 350443 - RNA, 62 nt, hsa
agugagaggcuguggggcagcggcucuguccugugccuuaccagcccuggggaggggggcau

SEQ ID NO: 350444 - RNA, 62 nt, hsa
ugcuagucuguaagcuccuuaagaguaggguugugccuuauucaacugcauacauagcuccu

SEQ ID NO: 350445 - RNA, 62 nt, hsa
cuuauucaacugcauacauagcuccuagcacagugccuuauucgguaggcaucuaagcacau

SEQ ID NO: 350446 - RNA, 62 nt, hsa
uacaggacauagcucucuccugcuaccagucugugccuuagaggucuguuaggccugccaaa

SEQ ID NO: 350447 - RNA, 62 nt, hsa
cugggggcaccuuaagauuuugcaccuguaaagugccuuacaggguaacugugcugaaugcu

SEQ ID NO: 350448 - RNA, 62 nt, hsa
cagcugagcugcgcuggcucugggcagggagugugccuuaaugggaagcacacgggcuuugg

SEQ ID NO: 350449 - RNA, 62 nt, hsa
cagaagagcccuuaugaccccugggccgcgcugugccuuagugucuacuugcaggacccuuc

SEQ ID NO: 350450 - RNA, 62 nt, hsa
acaaagacaagaaaaaucagggcauuuugugagugccuuaagaucaaacuaacaagaucuga

SEQ ID NO: 350451 - RNA, 62 nt, hsa
aauaaauacaaagcccauucuuccagagucuugugccuuaaauaaaacacaccucucugcug

SEQ ID NO: 350452 - RNA, 62 nt, hsa
ccugccuucagcuggugcuugcugcgauuccugugccuuauguaacugcccuuccuucccuu

SEQ ID NO: 350453 - RNA, 62 nt, hsa
guugguaguuaagcaaacugacauuacggaaagugccuuagacacuacaguacuaagacaau

SEQ ID NO: 350454 - RNA, 62 nt, hsa
uugaggaugcuuaaugauuccagccucucacugugccuuaugcauuaaaauuucuuuguuac

SEQ ID NO: 350455 - RNA, 62 nt, hsa
cccacagaacaacgggaacguuacugacucuggugccuuaucucgaagggaccagaagugcu

SEQ ID NO: 350456 - RNA, 62 nt, hsa
uccgguccugagagcuugcaucgguuucuucagugccuuacagggaaauagccugggguguc

SEQ ID NO: 350457 - RNA, 62 nt, hsa
cugcuguuucagaggcuagguuguuucugugggugccuuaucagggcugggauacuucugau

SEQ ID NO: 350458 - RNA, 62 nt, hsa
acccuucacugaguucucuggauuuguucucagugccuuagcaacgaaaaccugugcuugug

SEQ ID NO: 350459 - RNA, 62 nt, hsa
gcauauuucaacuguucuucauaaauguuuaugugccuuaaaagacuuuauguuaaaggauu

SEQ ID NO: 350460 - RNA, 62 nt, hsa
ccuucuggcaccccugggguucaauacuggaagugccuuauuuaaccagaccaucagggcau

SEQ ID NO: 350461 - RNA, 62 nt, hsa
uuuauucauugaaacacgguugaccugaacucgugccuuaggaauuaaugcccccuuaugga

SEQ ID NO: 350462 - RNA, 62 nt, hsa
auccuccuccagccuccuccagcccccaggcagugccuuaccuguggugcccagaaaagugc

SEQ ID NO: 350463 - RNA, 62 nt, hsa
ggugggcgccccgaccacgacuuggcuuccuugugccuuaaaaaaccugccuuccugcagcc

SEQ ID NO: 350464 - RNA, 62 nt, hsa
uggccuuuuaugagaggggacccgucaaaucugugccuuauggagggguccggcagcggcca

SEQ ID NO: 350465 - RNA, 62 nt, hsa
ugcccagucuggccugcgcucccgccgcccuggugccuuagcccccggcacaggauggggca

SEQ ID NO: 350466 - RNA, 62 nt, hsa
agugcgcccucccucccucccaucuggggguagugccuuaugcuggguguuggagcagagug

SEQ ID NO: 350467 - RNA, 62 nt, hsa
ggugugacuuggccccucuggcuugucuuucugugccuuacuccuccuccugcgucucccgu

SEQ ID NO: 350468 - RNA, 62 nt, hsa
aacuccucaccaggagagccaaagacaggguugugccuuaccccaggagccaccccuguacc

SEQ ID NO: 350469 - RNA, 62 nt, hsa
cggacuggggccuccccaccucccucucggcugugccuuacggagccccgauccaggccucc

SEQ ID NO: 350470 - RNA, 62 nt, hsa
caggucagcugcuuggggcucccaggcugggugugccuuagccacaggcagggcugucaaua

SEQ ID NO: 350471 - RNA, 62 nt, hsa
cacccccagcuggcccuccacccccaccucaagugccuuauucucacagcaagccccuuagu

SEQ ID NO: 350472 - RNA, 62 nt, hsa
ccauugccaaagcaugccugcccacccucgcugugccuuagucaguguguacgugugugugu

SEQ ID NO: 350473 - RNA, 62 nt, hsa
caagagggggaugucagccucacccacaccgugugccuuacuccugucuagagaccccaccu

SEQ ID NO: 350474 - RNA, 62 nt, hsa
gccucggauuuccuggccccucuacuguaaaugugccuuagccuaagccucccauccugugu

SEQ ID NO: 350475 - RNA, 62 nt, hsa
cauccccuuccuagcuguaugaccuugauugugugccuuaaccgcucugugacacagucuac

SEQ ID NO: 350476 - RNA, 62 nt, hsa
gagccgcagcugcaaacucugacacaaaagacgugccuuaaggaacccgccgcgugcccagg

SEQ ID NO: 350477 - RNA, 62 nt, hsa
uccugaaccacaaaccauagcauaagugaucugugccuuaacgacauguuccugcugcagau

SEQ ID NO: 350478 - RNA, 62 nt, hsa
ccuuccgggccgggcggaaggggacgcgggcugugccuuacuuaagucggggguggcaaggg

SEQ ID NO: 350479 - RNA, 62 nt, hsa
acuagacugugagcuccucgagggcagggaccgugccuuaugucugugugugaucaguuucu

SEQ ID NO: 350480 - RNA, 62 nt, hsa
cagcucccgccccucgccccccaccuccacaggugccuuaaagggcccucguccacccaagg

SEQ ID NO: 350481 - RNA, 62 nt, hsa
gacaguccuuccgugaggccuggggggcaucugugccuuauuuauacuuauuuauuucagga

SEQ ID NO: 350482 - RNA, 62 nt, hsa
ucccgucagaagaaucagcaggacagaucguagugccuuauuccauuguccuccccuggcca

SEQ ID NO: 350483 - RNA, 62 nt, hsa
acugccuaaagucacagcacagauacugcccagugccuuaagaggagacaugaucucuacca

SEQ ID NO: 350484 - RNA, 62 nt, hsa
aagaccuacuugacgucauguggacagugcacgugccuuacgcuacaucuuguuuucuagga

SEQ ID NO: 350485 - RNA, 62 nt, hsa
uugcucaugggauguugcaaagaacacaaagugugccuuagacauucucaagucaucagcgu

SEQ ID NO: 350486 - RNA, 62 nt, hsa
ugucagauggcguggucugcagggggagcucugugccuuaguggcucuuggcaggacacuga

SEQ ID NO: 350487 - RNA, 62 nt, hsa
cccacagcaggcuguaccaggcugcccugcuugugccuuagugggaagcccagugaggcauu

SEQ ID NO: 350488 - RNA, 62 nt, hsa
cuguguccgggccggccugcugcagccaccuggugccuuaguccuugggcugggggaggggg

SEQ ID NO: 350489 - RNA, 62 nt, hsa
uaaaacccuuuuuaggcaagggcccaaggacagugccuuaguuuggauccucuagaaacuaa

SEQ ID NO: 350490 - RNA, 62 nt, hsa
uacacaagaaauauuuguuuuacucagcaggugugccuuaaccucccuauucagaaagcucc

SEQ ID NO: 350491 - RNA, 62 nt, hsa
aacguaucuuuccuuuaugugacgcgucucuagugccuuacugaagaagcagugacacuccc

SEQ ID NO: 350492 - RNA, 62 nt, hsa
aaggauugucuaauuucaauugugcaagacaugugccuuauaauuauuuuuagcuuaaaauu

SEQ ID NO: 350493 - RNA, 62 nt, hsa
auaaucuuacucugugaaauagaggaauucgugugccuuagauuuagaaguguguucuuuaa

SEQ ID NO: 350494 - RNA, 62 nt, hsa
cucuaccauaucuuagcucagagcacagaggagugccuuauccccacacuugacugggcugu

SEQ ID NO: 350495 - RNA, 62 nt, hsa
acuguaaccucaaggaaaccauaaagcuuggagugccuuaauuuuuaaccaguuuccaauaa

SEQ ID NO: 350496 - RNA, 62 nt, hsa
ggccgcucuccagcucaccacagugucuccacgugccuuaccccuucuccuucaggccaagu

SEQ ID NO: 350497 - RNA, 62 nt, hsa
acuuuuccaggugguguuaauaagccauucaagugccuuacacagcuuugaagaaacuagga

SEQ ID NO: 350498 - RNA, 62 nt, hsa
uuugaauaaagugaacagaggcucauuuguuugugccuuacuuuacugaaugaauaggguuu

SEQ ID NO: 350499 - RNA, 62 nt, hsa
ccagccaugagcgccuuccugcagaacacacagugccuuaugccacagccgaagaauccgug

SEQ ID NO: 350500 - RNA, 62 nt, hsa
ucccacccuacccccuuuuuuauauaauaaaagugccuuagcauguguugcagcugucacca

SEQ ID NO: 350501 - RNA, 62 nt, hsa
ccagaguccucacaccugaaugaauuauacaugugccuuaccaggugaguggucuuucgaag

SEQ ID NO: 350502 - RNA, 62 nt, hsa
uuccuaccuagcuccuuguuggugagcuucuugugccuuaauccugugacccagccccuuac

SEQ ID NO: 350503 - RNA, 62 nt, hsa
agggaaacaguugaaacuguuuaaaaauagaugugccuuauuuauugcaggcuuucuuuccc

SEQ ID NO: 350504 - RNA, 62 nt, hsa
guauuucuuuguuauacauuuaaagauuuaaagugccuuaucaaauaauauucaugaagagu

SEQ ID NO: 350505 - RNA, 62 nt, hsa
guguuugaaaaagaagggggggagaauuccaggugccuuaauauaaaguuugaagcuucauc

SEQ ID NO: 350506 - RNA, 62 nt, hsa
cuaaucauguuuucgucacaugcugaguaaaagugccuuacaauguaaaaauuguacaguac

SEQ ID NO: 350507 - RNA, 62 nt, hsa
cucucuuguggaauugcauucaaaccagaacagugccuuagaauggaugugcccaacugcuc

SEQ ID NO: 350508 - RNA, 62 nt, hsa
aggcccggcuguggcuccaccuccagcucuccgugccuuaagggaaaagcgggacagcuccc

SEQ ID NO: 350509 - RNA, 62 nt, hsa
uccagugcccgcccuguggggccaaggcggccgugccuuacuacucugugucuucugccucc

SEQ ID NO: 350510 - RNA, 62 nt, hsa
uugugaaaauuuugaauuagcuuucauaugaagugccuuaaguagacucuucauuuacuuuu

SEQ ID NO: 350511 - RNA, 62 nt, hsa
auaguuaaucauuuaaccaaagaagauguguagugccuuaacaagcaauccucugucaaaau

SEQ ID NO: 350512 - RNA, 62 nt, hsa
aaggcaccaugaccaccuggugugaccucucugugccuuacugaggcaccuuucuagagauu

SEQ ID NO: 350513 - RNA, 64 nt, hsa; identical to SEQ ID NO: 219184

SEQ ID NO: 350514 - RNA, 64 nt, hsa; identical to SEQ ID NO: 219185

SEQ ID NO: 350515 - RNA, 64 nt, hsa; identical to SEQ ID NO: 219186

SEQ ID NO: 350516 - RNA, 64 nt, hsa; identical to SEQ ID NO: 219187

SEQ ID NO: 350517 - RNA, 64 nt, hsa; identical to SEQ ID NO: 219188

SEQ ID NO: 350518 - RNA, 64 nt, hsa; identical to SEQ ID NO: 219189

SEQ ID NO: 350519 - RNA, 64 nt, hsa; identical to SEQ ID NO: 219190

SEQ ID NO: 350520 - RNA, 64 nt, hsa; identical to SEQ ID NO: 219191

SEQ ID NO: 350521 - RNA, 64 nt, hsa; identical to SEQ ID NO: 219192

SEQ ID NO: 350522 - RNA, 64 nt, hsa; identical to SEQ ID NO: 219193

SEQ ID NO: 350523 - RNA, 64 nt, hsa; identical to SEQ ID NO: 219194

SEQ ID NO: 350524 - RNA, 64 nt, hsa; identical to SEQ ID NO: 219195

SEQ ID NO: 350525 - RNA, 64 nt, hsa; identical to SEQ ID NO: 219196

SEQ ID NO: 350526 - RNA, 64 nt, hsa; identical to SEQ ID NO: 219197

SEQ ID NO: 350527 - RNA, 64 nt, hsa; identical to SEQ ID NO: 219198

SEQ ID NO: 350528 - RNA, 64 nt, hsa; identical to SEQ ID NO: 219199

SEQ ID NO: 350529 - RNA, 64 nt, hsa; identical to SEQ ID NO: 219200

SEQ ID NO: 350530 - RNA, 64 nt, hsa; identical to SEQ ID NO: 219201

SEQ ID NO: 350531 - RNA, 64 nt, hsa; identical to SEQ ID NO: 219202

SEQ ID NO: 350532 - RNA, 64 nt, hsa; identical to SEQ ID NO: 219203

SEQ ID NO: 350533 - RNA, 64 nt, hsa; identical to SEQ ID NO: 219204

SEQ ID NO: 350534 - RNA, 64 nt, hsa; identical to SEQ ID NO: 219205

SEQ ID NO: 350535 - RNA, 64 nt, hsa; identical to SEQ ID NO: 219206

SEQ ID NO: 350536 - RNA, 64 nt, hsa; identical to SEQ ID NO: 219207

SEQ ID NO: 350537 - RNA, 64 nt, hsa; identical to SEQ ID NO: 219208

SEQ ID NO: 350538 - RNA, 64 nt, hsa; identical to SEQ ID NO: 219209

SEQ ID NO: 350539 - RNA, 64 nt, hsa; identical to SEQ ID NO: 219210

SEQ ID NO: 350540 - RNA, 64 nt, hsa; identical to SEQ ID NO: 219211

SEQ ID NO: 350541 - RNA, 64 nt, hsa; identical to SEQ ID NO: 219212

SEQ ID NO: 350542 - RNA, 64 nt, hsa; identical to SEQ ID NO: 219213

SEQ ID NO: 350543 - RNA, 58 nt, hsa
cugcguguggccacuccucagcauccuccccacccaccaugguucauuccgacuuuuc

SEQ ID NO: 350544 - RNA, 58 nt, hsa
acguggccuucagaggaauccacagguccccacccaagaucccucaauuauaugggga

SEQ ID NO: 350545 - RNA, 58 nt, hsa
cacugguuaggaaggauguucaaacggucccacccaagccugucaccucugcucaucc

SEQ ID NO: 350546 - RNA, 58 nt, hsa
ccuaccaagcucgagcuggcccuugacccccacccacccccacccuugcuggcagggg

SEQ ID NO: 350547 - RNA, 58 nt, hsa
ccccauggagcagccagcguuagaugcccccacccaccuguacucuggagagacugug

SEQ ID NO: 350548 - RNA, 58 nt, hsa
ggcaaaauaaucuaaaaagacuaaccugcccacccacuccuuauauugcugugagauu

SEQ ID NO: 350549 - RNA, 58 nt, hsa
aggccauccccucuucuaccuccugcaacccacccauccuauuagccucccacauuca

SEQ ID NO: 350550 - RNA, 58 nt, hsa
gggcuucuccugagguaaugauuacccccccacccacagcugagucugugaggcccca

SEQ ID NO: 350551 - RNA, 58 nt, hsa
gcagggugcucacacacccccacacccacccacccacacacaacacugggacaauuca

SEQ ID NO: 350552 - RNA, 58 nt, hsa
caucgcagggugcucacacacccccacacccacccacccacacacaacacugggacaa

SEQ ID NO: 350553 - RNA, 58 nt, hsa
auccaccggcugcacaggcacaaacucccccacccaggacggcugugaugagguggcc

SEQ ID NO: 350554 - RNA, 58 nt, hsa
agaggccuagggagguuuuagggcccuccccacccacacccacaggucgauuuggucu

SEQ ID NO: 350555 - RNA, 58 nt, hsa
cccgugauggcuccuuggggucugccugcccacccacaugagcccgcgaguauggcag

SEQ ID NO: 350556 - RNA, 58 nt, hsa
uagguuagcggagcuuuuuccucuuuuccccacccaucuccccaauauugcccauuau

SEQ ID NO: 350557 - RNA, 58 nt, hsa
gcccacuagcagcccccagcaucucccacccacccagcuagggcagaggggucaggau

SEQ ID NO: 350558 - RNA, 58 nt, hsa
gggggcccacuagcagcccccagcaucucccacccacccagcuagggcagagggguca

SEQ ID NO: 350559 - RNA, 58 nt, hsa
uuaaaaaagauaccuuauccuauuccuccccacccacccauguuuuuaaacuaauuua

SEQ ID NO: 350560 - RNA, 58 nt, hsa
aaaagauaccuuauccuauuccuccccacccacccauguuuuuaaacuaauuuauaua

SEQ ID NO: 350561 - RNA, 58 nt, hsa
ccgcuguuccgcugcagccccgcccugccccacccacccagugccuugcugaagccca

SEQ ID NO: 350562 - RNA, 58 nt, hsa
uguuccgcugcagccccgcccugccccacccacccagugccuugcugaagcccauagc

SEQ ID NO: 350563 - RNA, 58 nt, hsa
uuucuuuuauuucagugcugccuucccacccacccaguccauucacccucaccucucc

SEQ ID NO: 350564 - RNA, 58 nt, hsa
gccuuuucuuuuauuucagugcugccuucccacccacccaguccauucacccucaccu

SEQ ID NO: 350565 - RNA, 58 nt, hsa
uccuccuggccuucugacgggcggcguucccacccacaccuucgacgcgacgccuacg

SEQ ID NO: 350566 - RNA, 58 nt, hsa
cccgucucccggccgccccucuucccuucccacccagcugcgcccucggcucggucuc

SEQ ID NO: 350567 - RNA, 58 nt, hsa
uggccugagcagggggccugccaccagacccacccacgcucugacgagaggcuuuucc

SEQ ID NO: 350568 - RNA, 58 nt, hsa
gagucugggucucacuggccccaagucucccacccagaacucuggccaaaaauggcuc

SEQ ID NO: 350569 - RNA, 58 nt, hsa
cuguggccuuuuaacauucaagaguaugcccacccagccccaaagccaccggcaugug

SEQ ID NO: 350570 - RNA, 58 nt, hsa
gaggcagugagacugcaggugggcugggcccacccagggagcugaugccccuucuccc

SEQ ID NO: 350571 - RNA, 58 nt, hsa
uguucuuccuuccuagaagccccugucgcccacccagcugguccuguggaugggaucc

SEQ ID NO: 350572 - RNA, 50 nt, hsa; identical to SEQ ID NO: 56468

SEQ ID NO: 350573 - RNA, 58 nt, hsa
cuucuaccacucuuaaauuuacucccuccccacccagaacccagaugggguggagggg

SEQ ID NO: 350574 - RNA, 58 nt, hsa
ccuccccccccgccccucugcuucccuccccacccaccaccucaaggguagggaguug

SEQ ID NO: 350575 - RNA, 58 nt, hsa
cuggcaggccugcugugugccaaaaacucccacccaaggucccucaggggauauuuca

SEQ ID NO: 350576 - RNA, 58 nt, hsa
uaugacccccucccccaggacaccaccucccacccacagaccuucccuuuagcuguug

SEQ ID NO: 350577 - RNA, 58 nt, hsa
gaagcccccucucccugguccucuccuacccacccauguccucucagaaccccagccu

SEQ ID NO: 350578 - RNA, 58 nt, hsa
uagaggacagaaaaaugugaagagacgccccacccacccucagccagcccucuccagu

SEQ ID NO: 350579 - RNA, 58 nt, hsa
cauaguacaguucuucaguggacaugaccccacccagcccccugcagcccugcugcac

SEQ ID NO: 350580 - RNA, 58 nt, hsa
ucuguccccaucuuccuccccacaccuacccacccagugggcccugaagcagggccaa

SEQ ID NO: 350581 - RNA, 58 nt, hsa
cagcuggaggcuggagggagacacaggccccacccagcagacugaggggcagaggcac

SEQ ID NO: 350582 - RNA, 58 nt, hsa
gaauuggagaaauggagcucuguggcuucccacccaaaccuucucaguccagcuggag

SEQ ID NO: 350583 - RNA, 58 nt, hsa
gcagugcccuccucgccugugcagcccgcccacccacaggcucaccccuccugccggc

SEQ ID NO: 350584 - RNA, 58 nt, hsa
ccgccuucuuggugccaaacccccuucccccacccagagacugggcagcugugucugg

SEQ ID NO: 350585 - RNA, 58 nt, hsa
cugguugggagcagccccuggcccauugcccacccacccaucucacuaugcaauucga

SEQ ID NO: 350586 - RNA, 58 nt, hsa
uugggagcagccccuggcccauugcccacccacccaucucacuaugcaauucgaguuc

SEQ ID NO: 350587 - RNA, 58 nt, hsa
auucucugaauuuauuuccucuccuucccccacccagcuuucuuuuuauggccccagg

SEQ ID NO: 350588 - RNA, 58 nt, hsa
uuggggcuacgcgccaggagagucuccccccacccaccuuuuuucuuugguugcuuuu

SEQ ID NO: 350589 - RNA, 58 nt, hsa
ccauauaucccuccuuuaccauaguacucccacccacuuccaucacccauccaauaaa

SEQ ID NO: 350590 - RNA, 58 nt, hsa
gggggaugggggacuuuuguugguggcucccacccauauaucccuccuuuaccauagu

SEQ ID NO: 350591 - RNA, 58 nt, hsa
cccagucuccccgagucacagugccgaucccacccacccaccguagggugcacagcaa

SEQ ID NO: 350592 - RNA, 58 nt, hsa
gucuccccgagucacagugccgaucccacccacccaccguagggugcacagcaaggca

SEQ ID NO: 350593 - RNA, 58 nt, hsa
ccuccccacuggagggcaagcccccccacccacccaggauguccuggcucacuccgca

SEQ ID NO: 350594 - RNA, 58 nt, hsa
cuuuccuccccacuggagggcaagcccccccacccacccaggauguccuggcucacuc

SEQ ID NO: 350595 - RNA, 58 nt, hsa
uggcuuacuauuucauugugugcacccacccacccaccacacuggacuuuucuagaga

SEQ ID NO: 350596 - RNA, 58 nt, hsa
gguguggcuuacuauuucauugugugcacccacccacccaccacacuggacuuuucua

SEQ ID NO: 350597 - RNA, 58 nt, hsa
agguagcugugauacaaaccccaggacacccacccacccaaagagccaaagaauaguu

SEQ ID NO: 350598 - RNA, 58 nt, hsa
agcugugauacaaaccccaggacacccacccacccaaagagccaaagaauaguuccug

SEQ ID NO: 350599 - RNA, 58 nt, hsa
gaacguuugguacaaucgacauccuagccccacccagagguggcccucccaggcuggu

SEQ ID NO: 350600 - RNA, 58 nt, hsa
uuugcuccaggcaucacugauucccucucccacccaaggagaacguuugguacaaucg

SEQ ID NO: 350601 - RNA, 58 nt, hsa
gugcccugagccagggucuccagaaagccccacccaggccaggcauguggcagggguu

SEQ ID NO: 350602 - RNA, 58 nt, hsa
cccagacgccuggcugcugaucgccuuccccacccaccaacccucagggcaaagccag

SEQ ID NO: 350603 - RNA, 58 nt, hsa
cugcagcaccuuaguccauacuaccagccccacccaccuuccuuccucuucccucuuc

SEQ ID NO: 350604 - RNA, 58 nt, hsa
cccaccuagaggagaccaugggcccugccccacccacuccaggauguuaggguccccu

SEQ ID NO: 350605 - RNA, 58 nt, hsa
ccuugggcuggggccugcggaggggaagcccacccacaaugcauggaguauuauuuuu

SEQ ID NO: 350606 - RNA, 58 nt, hsa
guccuggccccugugaugcucccccauccccacccacuucuacauccauccacacccc

SEQ ID NO: 350607 - RNA, 58 nt, hsa
guccugcccacagcgcccuguaccugcucccacccagcccuuggugugcccacccagc

SEQ ID NO: 350608 - RNA, 58 nt, hsa
uaccugcucccacccagcccuuggugugcccacccagccuccucuccagcaccuugcu

SEQ ID NO: 350609 - RNA, 58 nt, hsa
agccaagaagaucaagucucagcaccggcccacccaaagauucuggcccaacuccauc

SEQ ID NO: 350610 - RNA, 58 nt, hsa
ucccugaggauagauggcacccauggcccccacccacggaaggacuugaguuguuuac

SEQ ID NO: 350611 - RNA, 58 nt, hsa
agccugcggggaugcccaucccacacaccccacccagcuguucuaacccugcuaucca

SEQ ID NO: 350612 - RNA, 58 nt, hsa
cuccacuguccacccuaacacauacccucccacccaccuuccagacccccuugguugg

SEQ ID NO: 350613 - RNA, 58 nt, hsa
ugcaucugaauaggccuacccucacccacccacccaguuuaauugugcuuagagccca

SEQ ID NO: 350614 - RNA, 58 nt, hsa
gccuugcaucugaauaggccuacccucacccacccacccaguuuaauugugcuuagag

SEQ ID NO: 350615 - RNA, 58 nt, hsa
gcagcuccccaaggcccugccccccagccccacccacucaugacucuaaguguguugu

SEQ ID NO: 350616 - RNA, 58 nt, hsa
cugcuucuugccuaccacuuggccagugcccacccagccccucagguggcacaucugg

SEQ ID NO: 350617 - RNA, 58 nt, hsa
gccgagugcccucuccguccccucuccucccacccacgccacaggccagccuacucuu

SEQ ID NO: 350618 - RNA, 58 nt, hsa
ucagggccauguaccagaucugucugugcccacccaggcacagccacugccucccccu

SEQ ID NO: 350619 - RNA, 58 nt, hsa
cuuccccaacccuggauaccaguagcuucccacccaguccaaaccugcaccauccauc

SEQ ID NO: 350620 - RNA, 58 nt, hsa
ucaucuguaggauuugggcugccccaggcccacccagggggcucugaauguauuuugu

SEQ ID NO: 350621 - RNA, 58 nt, hsa
cuccuccucuugaacuugggugggaaaccccacccaaaagcccccuuuguuacuuagg

SEQ ID NO: 350622 - RNA, 58 nt, hsa
ugguacugccucugaacacucugguuuccccacccaacugcggcuaagucucuuuuuc

SEQ ID NO: 350623 - RNA, 58 nt, hsa
cagaccucucccacccacaagaacuccucccacccaacuuccccuuagagugcuguga

SEQ ID NO: 350624 - RNA, 58 nt, hsa
aucggcuuccucaggggcacagaccucucccacccacaagaacuccucccacccaacu

SEQ ID NO: 350625 - RNA, 58 nt, hsa
ucucaccaguggccugcccucucgcucccccacccagcccacccauugaagucuccuu

SEQ ID NO: 350626 - RNA, 58 nt, hsa
uggccugcccucucgcucccccacccagcccacccauugaagucuccuugggccacca

SEQ ID NO: 350627 - RNA, 58 nt, hsa
ugcaggcccaggcaggcccagccucugccccacccaucaguggaguccagauggcagg

SEQ ID NO: 350628 - RNA, 58 nt, hsa
cucccgaccccauccaccuauccaccaccccacccaccuuugcagggaauaccucguu

SEQ ID NO: 350629 - RNA, 58 nt, hsa
uauacaaaccuagaugggacaccuaugacccacccaggccagaugguacagccuguug

SEQ ID NO: 350630 - RNA, 58 nt, hsa
cugacaaguugacucuucgacccccacccccacccaagacauuuuaauaguaaauaga

SEQ ID NO: 350631 - RNA, 58 nt, hsa
cugcuccccacacggacuccaggcgguccccacccacagaagcagaccuucagcucag

SEQ ID NO: 350632 - RNA, 58 nt, hsa
ggguggcccuggaggccccugaccccaccccacccacagagcacgagggccccgucag

SEQ ID NO: 350633 - RNA, 58 nt, hsa
ccucccucagcaccaagaccgggacccccccacccacgugucucauuguggcugccua

SEQ ID NO: 350634 - RNA, 58 nt, hsa
cccccacaccagaccccaacauagcuuccccacccaggcacccccucccggggcagca

SEQ ID NO: 350635 - RNA, 58 nt, hsa
ccugagaguuauaggaagugcccacugacccacccacccaccuacaccccccgccaca

SEQ ID NO: 350636 - RNA, 58 nt, hsa
agaguuauaggaagugcccacugacccacccacccaccuacaccccccgccacacaca

SEQ ID NO: 350637 - RNA, 58 nt, hsa
gcaguauccauaacccccugcccacguccccacccacgggggagacggagagauauaa

SEQ ID NO: 350638 - RNA, 58 nt, hsa
ggccuggagggcacuuccuccacagucccccacccaccuccugcggcucagccuugca

SEQ ID NO: 350639 - RNA, 58 nt, hsa
ggagaacagcaagaucuagggcaccagccccacccacuggcuguuucuccguccucuc

SEQ ID NO: 350640 - RNA, 58 nt, hsa
aaaagagcuaaccccuucccacacuccacccacccaccuacauuuccucugugaaauc

SEQ ID NO: 350641 - RNA, 58 nt, hsa
caaaagcagaaguggaccaccaucagcucccacccacccagcgauuuuuccuuggagg

SEQ ID NO: 350642 - RNA, 58 nt, hsa
agcagaaguggaccaccaucagcucccacccacccagcgauuuuuccuuggaggucag

SEQ ID NO: 350643 - RNA, 58 nt, hsa
ucuucaccuccuuggcgcugccaccugccccacccaguuucuggaaaaaguugaugcu

SEQ ID NO: 350644 - RNA, 58 nt, hsa
gcugagccuccuugucuauccuuccucccccacccaccauuguaaaguuuaugucacc

SEQ ID NO: 350645 - RNA, 58 nt, hsa
agcgggucaggccuucagaacacugccacccacccaguuuuauaaucccgcucccucu

SEQ ID NO: 350646 - RNA, 58 nt, hsa
uuauaaucccgcucccucuccaggcaaccccacccaccagccuaggccugcuccucca

SEQ ID NO: 350647 - RNA, 58 nt, hsa
cugggccugcaggagaggcugagaccagcccacccagccaguggucgagcacugcccc

SEQ ID NO: 350648 - RNA, 58 nt, hsa
ucuaucccacacccacccccaccccacccccacccagccuccagaagcuggaaccauu

SEQ ID NO: 350649 - RNA, 58 nt, hsa
ucccugggggcgauuagcugcugagucacccacccagccuuggagcuggaugccugug

SEQ ID NO: 350650 - RNA, 58 nt, hsa
aggccacugcugggacagggucuaugggcccacccagugccuuuccuuggcccucacu

SEQ ID NO: 350651 - RNA, 58 nt, hsa
ccggcagaggacgggaggagaccagucccccacccagccguaccagaaauaaaggcuu

SEQ ID NO: 350652 - RNA, 58 nt, hsa
gcacgcggcccucuccugucagugccggcccacccaccagcaggcccccaacccccag

SEQ ID NO: 350653 - RNA, 58 nt, hsa
aggguggggcgggcugggguuggagggucccacccaccacccugcugugcuugggaac

SEQ ID NO: 350654 - RNA, 58 nt, hsa
uuugaggcuagacggggaggggccaggacccacccacugcuccugggggaugaggucc

SEQ ID NO: 350655 - RNA, 58 nt, hsa
aagcggagaccagggugcaggcuccgcccccacccaaggccgggcccagccagaggag

SEQ ID NO: 350656 - RNA, 58 nt, hsa
caggucugagcagggagcaacucaggcccccacccaagccugcgucagcggaacuuga

SEQ ID NO: 350657 - RNA, 58 nt, hsa
aagugacucagccugguuggagaacugccccacccaguaucuucugugccaugguucc

SEQ ID NO: 350658 - RNA, 58 nt, hsa
caaauaaguacgauaacauagucauagucccacccaacaugaugcaguuaucuugcau

SEQ ID NO: 350659 - RNA, 58 nt, hsa
uaacuccagcccccacccacacccccaucccacccaaccacaggccccacuugcuaag

SEQ ID NO: 350660 - RNA, 58 nt, hsa
aaagaggggcucacgcuuaacuccagcccccacccacacccccaucccacccaaccac

SEQ ID NO: 350661 - RNA, 58 nt, hsa
ugcgaacucacagugacuguccuacccacccacccaccucuguagagucccagaaaca

SEQ ID NO: 350662 - RNA, 58 nt, hsa; identical to SEQ ID NO: 56558

SEQ ID NO: 350663 - RNA, 58 nt, hsa
uggcugugccgggcagccauccugcauucccacccagcgcgcagucuccaccucggcc

SEQ ID NO: 350664 - RNA, 58 nt, hsa
gggcccacaggcagggguaugagugcgucccacccaacgcagcaccagccccggccac

SEQ ID NO: 350665 - RNA, 58 nt, hsa
cccagaaguggggagagacuuugggccucccacccaguggggcuuggccuggcuucug

SEQ ID NO: 350666 - RNA, 58 nt, hsa
ccagcgaaucugccugggcugcuccugucccacccacccucacugagauccauguaag

SEQ ID NO: 350667 - RNA, 58 nt, hsa
aggggucccagcccgucuaccuccccaucccacccaggcccccagcuccccgcggggg

SEQ ID NO: 350668 - RNA, 58 nt, hsa
uucaucaccacucgggggcaccgggccgcccacccacucccaaaauccgucaguauuc

SEQ ID NO: 350669 - RNA, 58 nt, hsa
ucagggccuggguauccagcgagcccuccccacccacccacgguccucaccuggagcu

SEQ ID NO: 350670 - RNA, 58 nt, hsa
ggccuggguauccagcgagcccuccccacccacccacgguccucaccuggagcugugg

SEQ ID NO: 350671 - RNA, 58 nt, hsa
ccuugcggcccuggcucugagucgcucucccacccagccuggacuuggccccauggga

SEQ ID NO: 350672 - RNA, 58 nt, hsa
ggcccuccugcuccacccccaucccacucccacccaugucugggcucccaggcaggga

SEQ ID NO: 350673 - RNA, 58 nt, hsa
gccucagaauccaggagauacgcacagccccacccacucugagaugacaguggcugac

SEQ ID NO: 350674 - RNA, 58 nt, hsa
agggccugcccggccuccuguuccugcccccacccaccaccugccuggagaggaacgg

SEQ ID NO: 350675 - RNA, 58 nt, hsa
gcccuccucccauccacacacacaggcacccacccacaccaggucggcuuguuucuca

SEQ ID NO: 350676 - RNA, 58 nt, hsa
caccagaaagcaccaaagccccuggcaccccacccacuccauccuacccagggacccc

SEQ ID NO: 350677 - RNA, 58 nt, hsa
ggcuucuccugagguaaugauuuacccccccacccacagcugagucugugaggcccca

SEQ ID NO: 350678 - RNA, 58 nt, hsa
aggccauccccucuucuaccuccugcaacccacccauccuauuagccucccacauucu

SEQ ID NO: 350679 - RNA, 58 nt, hsa
cacgaccugcucaccaccuaugccguuacccacccacagguguccuacugccagggca

SEQ ID NO: 350680 - RNA, 58 nt, hsa
uccaggagggacccucugguccagcugccccacccagcugcccuuaucagcuccaagu

SEQ ID NO: 350681 - RNA, 58 nt, hsa
gggguaaauccugaggcuuuggugcucccccacccacccauucccgcccuuugcagca

SEQ ID NO: 350682 - RNA, 58 nt, hsa
uaaauccugaggcuuuggugcucccccacccacccauucccgcccuuugcagcagccc

SEQ ID NO: 350683 - RNA, 58 nt, hsa
cuguagugacccacgcguccagcagacgcccacccaccgcuagccguuguuccugugc

SEQ ID NO: 350684 - RNA, 58 nt, hsa
guuccugugcaaaguagugugcuaugcacccacccagguggccgccucugggcccaag

SEQ ID NO: 350685 - RNA, 58 nt, hsa
agaaucuaggccaccccaaccucuguuccccacccaguucuucauuuggaggaaucac

SEQ ID NO: 350686 - RNA, 58 nt, hsa
ucaggccucaccccuccccugggacuuucccacccaggaaaggaggaccagucaggau

SEQ ID NO: 350687 - RNA, 64 nt, hsa
acuuucugugauucauaccaacagaggacuuucugugauucauaccaacaguccuaaacuguca

SEQ ID NO: 350688 - RNA, 64 nt, hsa
cuuuucuuuucacuguauauaaacgguacuuucugugauucauaccaacagaggacuuucugug

SEQ ID NO: 350689 - RNA, 64 nt, hsa
guuggauuuguuaugucuguugcagugaggacuugugauucacugguaugaagaauuuuuugau

SEQ ID NO: 350690 - RNA, 64 nt, hsa
agaaggaaacagauauuuuaaauacucacaacaugugauucauuuucugauaaaauauuugucu

SEQ ID NO: 350691 - RNA, 64 nt, hsa
agucuuucaaggcuugagacuaauauaggccauugugauucaggaagaaacccaagguuggagg

SEQ ID NO: 350692 - RNA, 64 nt, hsa
caggugguuuuaaaguuaacagggguuugucauggugauucacuacucaguuuaucagcucaag

SEQ ID NO: 350693 - RNA, 64 nt, hsa
aaaugugugaaaccaaaaugaucacugccuacuugugauucaaaucuucagaguuuuccuaguu

SEQ ID NO: 350694 - RNA, 64 nt, hsa
gauagaguggagguaaauuaagagccuccaggcugugauucaccauuugagacauuauacauaa

SEQ ID NO: 350695 - RNA, 64 nt, hsa
gccuuauuaguuauaacaugauaggugcugaauugugauucacaauuuaaaaacacuguaaucc

SEQ ID NO: 350696 - RNA, 64 nt, hsa
aacagcugcuguaacuagucuggccuacaauagugugauucauguaggacuucuuucaucaauu

SEQ ID NO: 350697 - RNA, 63 nt, hsa
auuuuacaauugugaaaaccucauggauuugggcaaacugaauguauauaggcuuuugacaaa

SEQ ID NO: 350698 - RNA, 63 nt, hsa
aaaggcaaacauaggucugggcauuaaauuauacaaacugaaaauguguuacaagaaaaauau

SEQ ID NO: 350699 - RNA, 63 nt, hsa
ggaagggcugcuaucaaaccuaccuuuuuugagcaaacugagacuaaacuucucucuuuucaa

SEQ ID NO: 350700 - RNA, 63 nt, hsa
uuuucuaaacagaaauuauuuucuauuaauuugcaaacugaugauuucacuuuuuuuuacuuu

SEQ ID NO: 350701 - RNA, 63 nt, hsa
ccauuagaagcaaaauuaaaaguacaagcugggcaaacugacagaauacuagauaggagagac

SEQ ID NO: 350702 - RNA, 63 nt, hsa
uggauugugagaaaguaccaaguaccagccguccaaacugaucacaauuaaaauucugacagu

SEQ ID NO: 350703 - RNA, 63 nt, hsa
cuuucaugcuucugggguuggagcuuaaagauccaaacugagaaagcaggccgggcauggugg

SEQ ID NO: 350704 - RNA, 63 nt, hsa
agaaagguuugguuugaaaugccccgggggcagcaaacugacaugguugaaugauagcauuuc

SEQ ID NO: 350705 - RNA, 63 nt, hsa
cuucauucagggcauauuuuuucuucccaggaucaaacugaaaacauguuaaggcuauaguuu

SEQ ID NO: 350706 - RNA, 63 nt, hsa
aagauuuagaagauauuuuggagauaaacaagacaaacugagucaauuuaacaauccugacau

SEQ ID NO: 350707 - RNA, 61 nt, hsa
cauguguuugguuucugauucaagugacacgcacaaacugaaaaaaaaaaaacaaaaaaag

SEQ ID NO: 350708 - RNA, 63 nt, hsa
gcuagaaaaaaauaaugguaguaaagaaacugacaaacugaaaauaagaaaacaaaaaucaaa

SEQ ID NO: 350709 - RNA, 63 nt, hsa
aaaauuaaaagaagaggaagaaagagaaauaaucaaacugaccaugaaguaagcagcacuuaa

SEQ ID NO: 350710 - RNA, 63 nt, hsa
aucagucaugugaaguauuugucuaaaacagagcaaacugaagaccaaauuauucuccuguug

SEQ ID NO: 350711 - RNA, 63 nt, hsa
uuuuaaguacccccuuuccuccucacccaccuccaaacugacuagcacucagagggacuuaug

SEQ ID NO: 350712 - RNA, 63 nt, hsa
gggaaguccagaugcggguuaucuugaaagaaacaaacugacauucuaggcagacaguugucu

SEQ ID NO: 350713 - RNA, 64 nt, hsa
auacauuagaaauggacaaaaguggccaggagcgguagcucauacuuguaacccagcacuuugg

SEQ ID NO: 350714 - RNA, 64 nt, hsa
uuuggguauaaaggagggggauucuacgggggcaguagcucaacaaggaauagagggaggagug

SEQ ID NO: 350715 - RNA, 64 nt, hsa
uuagacaaccacugaacuagaugacuguuguacuguagcucagucauuuaaaaaauauauaaau

SEQ ID NO: 350716 - RNA, 64 nt, hsa
agccuauuccaucacaaucaugaucgcugguaaaguagcucagugguguggggaaacguucccc

SEQ ID NO: 350717 - RNA, 64 nt, hsa
cagaauuugagaaccuuggaccacuccugucccuguagcucagucaucaaagcagaagucuggc

SEQ ID NO: 350718 - RNA, 64 nt, hsa
guuugcuaguaucuuggguguauucucuguaaguguagcucaaauaggucaucaugaaagguua

SEQ ID NO: 350719 - RNA, 64 nt, hsa
uaaaagggaaaaguagauccgauaacuuaaaaacguagcucaucccuuaccauccaaggggcac

SEQ ID NO: 350720 - RNA, 64 nt, hsa
ucugcaguuuguagcagaaugguauuuuccucaaguagcucauaauacugccaaaucucaaaag

SEQ ID NO: 350721 - RNA, 64 nt, hsa
cacuagcaaggaugauaaacacuugugcacugaaagcuaacagggagagguuacacaauauuuu

SEQ ID NO: 350722 - RNA, 64 nt, hsa
auguuuuccaacauauccuaaaaacugugauauaagcuaacauauaauuugccuuacgucaaaa

SEQ ID NO: 350723 - RNA, 64 nt, hsa
aagccauccguagaaaguacuuuguccuccaaaaagcuaacauacgguuuugaagcagcauuga

SEQ ID NO: 350724 - RNA, 64 nt, hsa
uuuuuuguuguaauaguuaaagaggcuuagaacaagcuaacaggcaauagaaauauguauauca

SEQ ID NO: 350725 - RNA, 64 nt, hsa
gcaggacaugcugaagccaaagccaauaacacacagcuaacacacagcucccauaaccgcugau

SEQ ID NO: 350726 - RNA, 64 nt, hsa
aggcaaugccauccucaaacacugcaggcaucacagcuaacaauugugaagucgucuuaacuca

SEQ ID NO: 350727 - RNA, 64 nt, hsa
cuuaguggacaauggagucauuucuaccuagaguaccaguaaacaucucccagugugcuauagu

SEQ ID NO: 350728 - RNA, 64 nt, hsa
acucuugugacuccuggaaguucuuauauauuucaccaguaagaaauugauugguaucuuugau

SEQ ID NO: 350729 - RNA, 64 nt, hsa
ggucaccagcggccccauguccccagagggcucaccuuccaagucucccucaaagaagaaaaag

SEQ ID NO: 350730 - RNA, 55 nt, hsa
agagacaaagagcccuuuagucucuccuuccaagucuuuagagggugaguccagc

SEQ ID NO: 350731 - RNA, 64 nt, hsa
cuuacggagcuucuccucagaagugguaccaucgccuuccaaagucagcacucuacacucuuga

SEQ ID NO: 350732 - RNA, 64 nt, hsa
ucacuuuacauccucagguauuguaaccacugggccuuccaacuuugcuggcaagcucugguaa

SEQ ID NO: 350733 - RNA, 64 nt, hsa
acuuuuauuugcaacauuuacaguccuucaaaauccuuccaaagaauucuuauacacauugggg

SEQ ID NO: 350734 - RNA, 64 nt, hsa
uacuugagccuuuaauggacuuauuucuucaaauccuuccaaaaauuauuauaagcauugaaau

SEQ ID NO: 350735 - RNA, 64 nt, hsa
cccaaggcacccugugccugcuucccucagaggaccuuccaauccauuugccccgcaacccugg

SEQ ID NO: 350736 - RNA, 64 nt, hsa
uugccccaacuagacugugagcuccuccucugagccuuccaaguccccccuccaccuucgccac

SEQ ID NO: 350737 - RNA, 64 nt, hsa
gaccuggaagagaacuuugagaacaauaucuucuccuuccaaguaugugacguaguccugaacc

SEQ ID NO: 350738 - RNA, 64 nt, hsa
cagcgccuuucccucaaguccuuucugauucugcccuuccaacgcaucacccgccucaaacugc

SEQ ID NO: 350739 - RNA, 64 nt, hsa
agacuccaucucaauaaaauuaauaauaauaaaaccuuccaaaaaaagugccgggaccaaaugg

SEQ ID NO: 350740 - RNA, 64 nt, hsa
uaucuauuaaauaaauugaagcaguaauuaauaaccuuccaagaccaggcgcgguggcuaaaaa

SEQ ID NO: 350741 - RNA, 64 nt, hsa
cuacagcccuggcagcccauggcaacucaaagugccuuccaaaccaaacugccccucaugaggu

SEQ ID NO: 350742 - RNA, 64 nt, hsa
auguuccaugcaugucccugcuuccaaagccugaccuuccaaagcuugcuuccuuccuccuggc

SEQ ID NO: 350743 - RNA, 64 nt, hsa
agugucugaucaucucucuuggaaguuuucugaaccuuccaagcucuguggugaggacaaacca

SEQ ID NO: 350744 - RNA, 64 nt, hsa
aguguuuuccaccucauucucccagauugagcucccuuccaaaggaucguuccucucauugcac

SEQ ID NO: 350745 - RNA, 64 nt, hsa
aaacuccugggcucaagugauccacccaccuuggccuuccaaaguggugggauuaugggcagga

SEQ ID NO: 350746 - RNA, 64 nt, hsa
gccuccagaccucggugcccacagccuugaggauccuuccaauaaaggugucaagagcucagcc

SEQ ID NO: 350747 - RNA, 64 nt, hsa; identical to SEQ ID NO: 57592

SEQ ID NO: 350748 - RNA, 64 nt, hsa; identical to SEQ ID NO: 57593

SEQ ID NO: 350749 - RNA, 64 nt, hsa; identical to SEQ ID NO: 57594

SEQ ID NO: 350750 - RNA, 64 nt, hsa; identical to SEQ ID NO: 57595

SEQ ID NO: 350751 - RNA, 64 nt, hsa; identical to SEQ ID NO: 57596

SEQ ID NO: 350752 - RNA, 64 nt, hsa; identical to SEQ ID NO: 57597

SEQ ID NO: 350753 - RNA, 64 nt, hsa; identical to SEQ ID NO: 57598

SEQ ID NO: 350754 - RNA, 64 nt, hsa; identical to SEQ ID NO: 57599

SEQ ID NO: 350755 - RNA, 64 nt, hsa; identical to SEQ ID NO: 57600

SEQ ID NO: 350756 - RNA, 64 nt, hsa; identical to SEQ ID NO: 57601

SEQ ID NO: 350757 - RNA, 64 nt, hsa; identical to SEQ ID NO: 57602

SEQ ID NO: 350758 - RNA, 64 nt, hsa
aaaaguuuaaaauccgauaaggaauaucugggacaggguuuagaucaugacucuacacagauac

SEQ ID NO: 350759 - RNA, 64 nt, hsa
cagcugguuugggcucaaauugucccuggagacuaggguuuauguuaggguauugauagauuag

SEQ ID NO: 350760 - RNA, 64 nt, hsa
uacuuuuaucugucagguagcacauaagguuugcaggguuuauauuuuguauagaaucacaguu

SEQ ID NO: 350761 - RNA, 64 nt, hsa
ucuggguuaacgcuuuucagggccaagcacuauaaggguuuagcuguggcgcagugaugcaugg

SEQ ID NO: 350762 - RNA, 64 nt, hsa
cuguaaauuuacauacguugucuagaaguaccauaggguuuaaaaaccugggcuggcauugguc

SEQ ID NO: 350763 - RNA, 64 nt, hsa
acuguguuucacuuacaaguuuuaaaaaaaugacaggguuuaauggagcgugcauaaaaaugua

SEQ ID NO: 350764 - RNA, 64 nt, hsa
gcaagcugcuuuaucccugcgcuagucucccccgaggguuuaggcuggcccagcacauccuguc

SEQ ID NO: 350765 - RNA, 64 nt, hsa
ccaccugcccuccaccaggagugggcaccccauaaggguuuaggccacuuugcagaggauggag

SEQ ID NO: 350766 - RNA, 64 nt, hsa; identical to SEQ ID NO: 265198

SEQ ID NO: 350767 - RNA, 64 nt, hsa; identical to SEQ ID NO: 265199

SEQ ID NO: 350768 - RNA, 64 nt, hsa; identical to SEQ ID NO: 265200

SEQ ID NO: 350769 - RNA, 64 nt, hsa; identical to SEQ ID NO: 265201

SEQ ID NO: 350770 - RNA, 64 nt, hsa; identical to SEQ ID NO: 265202

SEQ ID NO: 350771 - RNA, 64 nt, hsa; identical to SEQ ID NO: 265203

SEQ ID NO: 350772 - RNA, 64 nt, hsa; identical to SEQ ID NO: 265204

SEQ ID NO: 350773 - RNA, 64 nt, hsa; identical to SEQ ID NO: 265205

SEQ ID NO: 350774 - RNA, 64 nt, hsa; identical to SEQ ID NO: 286991

SEQ ID NO: 350775 - RNA, 64 nt, hsa; identical to SEQ ID NO: 286992

SEQ ID NO: 350776 - RNA, 64 nt, hsa; identical to SEQ ID NO: 286993

SEQ ID NO: 350777 - RNA, 64 nt, hsa; identical to SEQ ID NO: 286994

SEQ ID NO: 350778 - RNA, 64 nt, hsa; identical to SEQ ID NO: 286995

SEQ ID NO: 350779 - RNA, 64 nt, hsa; identical to SEQ ID NO: 286996

SEQ ID NO: 350780 - RNA, 64 nt, hsa; identical to SEQ ID NO: 286997

SEQ ID NO: 350781 - RNA, 64 nt, hsa; identical to SEQ ID NO: 286998

SEQ ID NO: 350782 - RNA, 64 nt, hsa; identical to SEQ ID NO: 286999

SEQ ID NO: 350783 - RNA, 64 nt, hsa; identical to SEQ ID NO: 287000

SEQ ID NO: 350784 - RNA, 64 nt, hsa; identical to SEQ ID NO: 287001

SEQ ID NO: 350785 - RNA, 64 nt, hsa; identical to SEQ ID NO: 287002

SEQ ID NO: 350786 - RNA, 64 nt, hsa; identical to SEQ ID NO: 287003

SEQ ID NO: 350787 - RNA, 64 nt, hsa; identical to SEQ ID NO: 287004

SEQ ID NO: 350788 - RNA, 64 nt, hsa; identical to SEQ ID NO: 287005

SEQ ID NO: 350789 - RNA, 64 nt, hsa; identical to SEQ ID NO: 287006

SEQ ID NO: 350790 - RNA, 64 nt, hsa; identical to SEQ ID NO: 287007

SEQ ID NO: 350791 - RNA, 64 nt, hsa; identical to SEQ ID NO: 287008

SEQ ID NO: 350792 - RNA, 64 nt, hsa; identical to SEQ ID NO: 287009

SEQ ID NO: 350793 - RNA, 64 nt, hsa; identical to SEQ ID NO: 287010

SEQ ID NO: 350794 - RNA, 64 nt, hsa; identical to SEQ ID NO: 287011

SEQ ID NO: 350795 - RNA, 64 nt, hsa; identical to SEQ ID NO: 287012

SEQ ID NO: 350796 - RNA, 64 nt, hsa; identical to SEQ ID NO: 287013

SEQ ID NO: 350797 - RNA, 64 nt, hsa; identical to SEQ ID NO: 287014

SEQ ID NO: 350798 - RNA, 64 nt, hsa; identical to SEQ ID NO: 287015

SEQ ID NO: 350799 - RNA, 64 nt, hsa; identical to SEQ ID NO: 287016

SEQ ID NO: 350800 - RNA, 64 nt, hsa; identical to SEQ ID NO: 287017

SEQ ID NO: 350801 - RNA, 64 nt, hsa; identical to SEQ ID NO: 287018

SEQ ID NO: 350802 - RNA, 64 nt, hsa; identical to SEQ ID NO: 287019

SEQ ID NO: 350803 - RNA, 64 nt, hsa; identical to SEQ ID NO: 287020

SEQ ID NO: 350804 - RNA, 64 nt, hsa; identical to SEQ ID NO: 287021

SEQ ID NO: 350805 - RNA, 64 nt, hsa; identical to SEQ ID NO: 287022

SEQ ID NO: 350806 - RNA, 64 nt, hsa; identical to SEQ ID NO: 287023

SEQ ID NO: 350807 - RNA, 64 nt, hsa; identical to SEQ ID NO: 287024

SEQ ID NO: 350808 - RNA, 64 nt, hsa; identical to SEQ ID NO: 287025

SEQ ID NO: 350809 - RNA, 64 nt, hsa; identical to SEQ ID NO: 287026

SEQ ID NO: 350810 - RNA, 64 nt, hsa; identical to SEQ ID NO: 287027

SEQ ID NO: 350811 - RNA, 64 nt, hsa; identical to SEQ ID NO: 287028

SEQ ID NO: 350812 - RNA, 64 nt, hsa; identical to SEQ ID NO: 287029

SEQ ID NO: 350813 - RNA, 64 nt, hsa; identical to SEQ ID NO: 287030

SEQ ID NO: 350814 - RNA, 64 nt, hsa; identical to SEQ ID NO: 287031

SEQ ID NO: 350815 - RNA, 64 nt, hsa; identical to SEQ ID NO: 287032

SEQ ID NO: 350816 - RNA, 64 nt, hsa; identical to SEQ ID NO: 287033

SEQ ID NO: 350817 - RNA, 64 nt, hsa; identical to SEQ ID NO: 287034

SEQ ID NO: 350818 - RNA, 64 nt, hsa; identical to SEQ ID NO: 287035

SEQ ID NO: 350819 - RNA, 64 nt, hsa; identical to SEQ ID NO: 287036

SEQ ID NO: 350820 - RNA, 64 nt, hsa; identical to SEQ ID NO: 287037

SEQ ID NO: 350821 - RNA, 64 nt, hsa; identical to SEQ ID NO: 287038

SEQ ID NO: 350822 - RNA, 64 nt, hsa; identical to SEQ ID NO: 287039

SEQ ID NO: 350823 - RNA, 64 nt, hsa; identical to SEQ ID NO: 287040

SEQ ID NO: 350824 - RNA, 64 nt, hsa; identical to SEQ ID NO: 287041

SEQ ID NO: 350825 - RNA, 64 nt, hsa; identical to SEQ ID NO: 287042

SEQ ID NO: 350826 - RNA, 64 nt, hsa; identical to SEQ ID NO: 287043

SEQ ID NO: 350827 - RNA, 64 nt, hsa; identical to SEQ ID NO: 287044

SEQ ID NO: 350828 - RNA, 64 nt, hsa; identical to SEQ ID NO: 287045

SEQ ID NO: 350829 - RNA, 64 nt, hsa; identical to SEQ ID NO: 287046

SEQ ID NO: 350830 - RNA, 64 nt, hsa; identical to SEQ ID NO: 287047

SEQ ID NO: 350831 - RNA, 64 nt, hsa; identical to SEQ ID NO: 287048

SEQ ID NO: 350832 - RNA, 64 nt, hsa; identical to SEQ ID NO: 287049

SEQ ID NO: 350833 - RNA, 64 nt, hsa; identical to SEQ ID NO: 287050

SEQ ID NO: 350834 - RNA, 64 nt, hsa; identical to SEQ ID NO: 287051

SEQ ID NO: 350835 - RNA, 64 nt, hsa; identical to SEQ ID NO: 287052

SEQ ID NO: 350836 - RNA, 64 nt, hsa; identical to SEQ ID NO: 287053

SEQ ID NO: 350837 - RNA, 64 nt, hsa; identical to SEQ ID NO: 287054

SEQ ID NO: 350838 - RNA, 64 nt, hsa; identical to SEQ ID NO: 287055

SEQ ID NO: 350839 - RNA, 64 nt, hsa; identical to SEQ ID NO: 287056

SEQ ID NO: 350840 - RNA, 64 nt, hsa; identical to SEQ ID NO: 287057

SEQ ID NO: 350841 - RNA, 64 nt, hsa; identical to SEQ ID NO: 287058

SEQ ID NO: 350842 - RNA, 64 nt, hsa; identical to SEQ ID NO: 287059

SEQ ID NO: 350843 - RNA, 64 nt, hsa; identical to SEQ ID NO: 287060

SEQ ID NO: 350844 - RNA, 64 nt, hsa; identical to SEQ ID NO: 287061

SEQ ID NO: 350845 - RNA, 64 nt, hsa; identical to SEQ ID NO: 287062

SEQ ID NO: 350846 - RNA, 64 nt, hsa; identical to SEQ ID NO: 287063

SEQ ID NO: 350847 - RNA, 64 nt, hsa; identical to SEQ ID NO: 287064

SEQ ID NO: 350848 - RNA, 64 nt, hsa; identical to SEQ ID NO: 287065

SEQ ID NO: 350849 - RNA, 64 nt, hsa; identical to SEQ ID NO: 287066

SEQ ID NO: 350850 - RNA, 64 nt, hsa; identical to SEQ ID NO: 287067

SEQ ID NO: 350851 - RNA, 64 nt, hsa; identical to SEQ ID NO: 287068

SEQ ID NO: 350852 - RNA, 64 nt, hsa; identical to SEQ ID NO: 287069

SEQ ID NO: 350853 - RNA, 64 nt, hsa; identical to SEQ ID NO: 287070

SEQ ID NO: 350854 - RNA, 64 nt, hsa; identical to SEQ ID NO: 287071

SEQ ID NO: 350855 - RNA, 64 nt, hsa; identical to SEQ ID NO: 287072

SEQ ID NO: 350856 - RNA, 64 nt, hsa; identical to SEQ ID NO: 287073

SEQ ID NO: 350857 - RNA, 64 nt, hsa; identical to SEQ ID NO: 287074

SEQ ID NO: 350858 - RNA, 64 nt, hsa; identical to SEQ ID NO: 287075

SEQ ID NO: 350859 - RNA, 55 nt, hsa; identical to SEQ ID NO: 287076

SEQ ID NO: 350860 - RNA, 64 nt, hsa; identical to SEQ ID NO: 287077

SEQ ID NO: 350861 - RNA, 64 nt, hsa; identical to SEQ ID NO: 287078

SEQ ID NO: 350862 - RNA, 64 nt, hsa; identical to SEQ ID NO: 287079

SEQ ID NO: 350863 - RNA, 64 nt, hsa; identical to SEQ ID NO: 287080

SEQ ID NO: 350864 - RNA, 64 nt, hsa; identical to SEQ ID NO: 287081

SEQ ID NO: 350865 - RNA, 64 nt, hsa; identical to SEQ ID NO: 287082

SEQ ID NO: 350866 - RNA, 64 nt, hsa; identical to SEQ ID NO: 287083

SEQ ID NO: 350867 - RNA, 64 nt, hsa; identical to SEQ ID NO: 287084

SEQ ID NO: 350868 - RNA, 64 nt, hsa; identical to SEQ ID NO: 287085

SEQ ID NO: 350869 - RNA, 64 nt, hsa; identical to SEQ ID NO: 287086

SEQ ID NO: 350870 - RNA, 64 nt, hsa; identical to SEQ ID NO: 287087

SEQ ID NO: 350871 - RNA, 64 nt, hsa; identical to SEQ ID NO: 287088

SEQ ID NO: 350872 - RNA, 64 nt, hsa; identical to SEQ ID NO: 287089

SEQ ID NO: 350873 - RNA, 64 nt, hsa; identical to SEQ ID NO: 287090

SEQ ID NO: 350874 - RNA, 64 nt, hsa; identical to SEQ ID NO: 287091

SEQ ID NO: 350875 - RNA, 64 nt, hsa; identical to SEQ ID NO: 287092

SEQ ID NO: 350876 - RNA, 64 nt, hsa; identical to SEQ ID NO: 287093

SEQ ID NO: 350877 - RNA, 64 nt, hsa; identical to SEQ ID NO: 287094

SEQ ID NO: 350878 - RNA, 64 nt, hsa; identical to SEQ ID NO: 287095

SEQ ID NO: 350879 - RNA, 64 nt, hsa; identical to SEQ ID NO: 287096

SEQ ID NO: 350880 - RNA, 64 nt, hsa; identical to SEQ ID NO: 287097

SEQ ID NO: 350881 - RNA, 64 nt, hsa; identical to SEQ ID NO: 287098

SEQ ID NO: 350882 - RNA, 64 nt, hsa; identical to SEQ ID NO: 287099

SEQ ID NO: 350883 - RNA, 64 nt, hsa; identical to SEQ ID NO: 287100

SEQ ID NO: 350884 - RNA, 64 nt, hsa; identical to SEQ ID NO: 287101

SEQ ID NO: 350885 - RNA, 64 nt, hsa; identical to SEQ ID NO: 287102

SEQ ID NO: 350886 - RNA, 64 nt, hsa; identical to SEQ ID NO: 287103

SEQ ID NO: 350887 - RNA, 64 nt, hsa; identical to SEQ ID NO: 287104

SEQ ID NO: 350888 - RNA, 64 nt, hsa; identical to SEQ ID NO: 287105

SEQ ID NO: 350889 - RNA, 64 nt, hsa; identical to SEQ ID NO: 287106

SEQ ID NO: 350890 - RNA, 64 nt, hsa; identical to SEQ ID NO: 287107

SEQ ID NO: 350891 - RNA, 64 nt, hsa; identical to SEQ ID NO: 287108

SEQ ID NO: 350892 - RNA, 64 nt, hsa; identical to SEQ ID NO: 287109

SEQ ID NO: 350893 - RNA, 64 nt, hsa; identical to SEQ ID NO: 287110

SEQ ID NO: 350894 - RNA, 64 nt, hsa; identical to SEQ ID NO: 287111

SEQ ID NO: 350895 - RNA, 64 nt, hsa; identical to SEQ ID NO: 287112

SEQ ID NO: 350896 - RNA, 64 nt, hsa; identical to SEQ ID NO: 287113

SEQ ID NO: 350897 - RNA, 64 nt, hsa; identical to SEQ ID NO: 287114

SEQ ID NO: 350898 - RNA, 64 nt, hsa; identical to SEQ ID NO: 287115

SEQ ID NO: 350899 - RNA, 64 nt, hsa; identical to SEQ ID NO: 287116

SEQ ID NO: 350900 - RNA, 64 nt, hsa; identical to SEQ ID NO: 287117

SEQ ID NO: 350901 - RNA, 64 nt, hsa; identical to SEQ ID NO: 287118

SEQ ID NO: 350902 - RNA, 52 nt, hsa; identical to SEQ ID NO: 287119

SEQ ID NO: 350903 - RNA, 64 nt, hsa; identical to SEQ ID NO: 287120

SEQ ID NO: 350904 - RNA, 64 nt, hsa; identical to SEQ ID NO: 287121

SEQ ID NO: 350905 - RNA, 64 nt, hsa; identical to SEQ ID NO: 287122

SEQ ID NO: 350906 - RNA, 55 nt, hsa; identical to SEQ ID NO: 287123

SEQ ID NO: 350907 - RNA, 64 nt, hsa; identical to SEQ ID NO: 287124

SEQ ID NO: 350908 - RNA, 64 nt, hsa; identical to SEQ ID NO: 287125

SEQ ID NO: 350909 - RNA, 64 nt, hsa; identical to SEQ ID NO: 287126

SEQ ID NO: 350910 - RNA, 64 nt, hsa; identical to SEQ ID NO: 287127

SEQ ID NO: 350911 - RNA, 64 nt, hsa; identical to SEQ ID NO: 287128

SEQ ID NO: 350912 - RNA, 64 nt, hsa; identical to SEQ ID NO: 287129

SEQ ID NO: 350913 - RNA, 64 nt, hsa; identical to SEQ ID NO: 287130

SEQ ID NO: 350914 - RNA, 64 nt, hsa; identical to SEQ ID NO: 287131

SEQ ID NO: 350915 - RNA, 64 nt, hsa; identical to SEQ ID NO: 287132

SEQ ID NO: 350916 - RNA, 64 nt, hsa; identical to SEQ ID NO: 287133

SEQ ID NO: 350917 - RNA, 64 nt, hsa; identical to SEQ ID NO: 287134

SEQ ID NO: 350918 - RNA, 64 nt, hsa; identical to SEQ ID NO: 287135

SEQ ID NO: 350919 - RNA, 64 nt, hsa; identical to SEQ ID NO: 287136

SEQ ID NO: 350920 - RNA, 64 nt, hsa; identical to SEQ ID NO: 287137

SEQ ID NO: 350921 - RNA, 64 nt, hsa; identical to SEQ ID NO: 287138

SEQ ID NO: 350922 - RNA, 64 nt, hsa; identical to SEQ ID NO: 287139

SEQ ID NO: 350923 - RNA, 64 nt, hsa; identical to SEQ ID NO: 287140

SEQ ID NO: 350924 - RNA, 64 nt, hsa; identical to SEQ ID NO: 287141

SEQ ID NO: 350925 - RNA, 64 nt, hsa; identical to SEQ ID NO: 287142

SEQ ID NO: 350926 - RNA, 64 nt, hsa; identical to SEQ ID NO: 287143

SEQ ID NO: 350927 - RNA, 64 nt, hsa; identical to SEQ ID NO: 287144

SEQ ID NO: 350928 - RNA, 64 nt, hsa; identical to SEQ ID NO: 287145

SEQ ID NO: 350929 - RNA, 64 nt, hsa; identical to SEQ ID NO: 287146

SEQ ID NO: 350930 - RNA, 64 nt, hsa; identical to SEQ ID NO: 287147

SEQ ID NO: 350931 - RNA, 64 nt, hsa; identical to SEQ ID NO: 287148

SEQ ID NO: 350932 - RNA, 64 nt, hsa; identical to SEQ ID NO: 287149

SEQ ID NO: 350933 - RNA, 64 nt, hsa; identical to SEQ ID NO: 287150

SEQ ID NO: 350934 - RNA, 64 nt, hsa; identical to SEQ ID NO: 287151

SEQ ID NO: 350935 - RNA, 64 nt, hsa; identical to SEQ ID NO: 287152

SEQ ID NO: 350936 - RNA, 64 nt, hsa; identical to SEQ ID NO: 287153

SEQ ID NO: 350937 - RNA, 64 nt, hsa; identical to SEQ ID NO: 287154

SEQ ID NO: 350938 - RNA, 64 nt, hsa; identical to SEQ ID NO: 287155

SEQ ID NO: 350939 - RNA, 64 nt, hsa; identical to SEQ ID NO: 287156

SEQ ID NO: 350940 - RNA, 64 nt, hsa; identical to SEQ ID NO: 287157

SEQ ID NO: 350941 - RNA, 64 nt, hsa; identical to SEQ ID NO: 287158

SEQ ID NO: 350942 - RNA, 64 nt, hsa; identical to SEQ ID NO: 287159

SEQ ID NO: 350943 - RNA, 64 nt, hsa; identical to SEQ ID NO: 287160

SEQ ID NO: 350944 - RNA, 64 nt, hsa; identical to SEQ ID NO: 287161

SEQ ID NO: 350945 - RNA, 64 nt, hsa; identical to SEQ ID NO: 287162

SEQ ID NO: 350946 - RNA, 64 nt, hsa; identical to SEQ ID NO: 287163

SEQ ID NO: 350947 - RNA, 64 nt, hsa; identical to SEQ ID NO: 287164

SEQ ID NO: 350948 - RNA, 64 nt, hsa; identical to SEQ ID NO: 287165

SEQ ID NO: 350949 - RNA, 64 nt, hsa; identical to SEQ ID NO: 287166

SEQ ID NO: 350950 - RNA, 64 nt, hsa; identical to SEQ ID NO: 287167

SEQ ID NO: 350951 - RNA, 64 nt, hsa; identical to SEQ ID NO: 287168

SEQ ID NO: 350952 - RNA, 64 nt, hsa; identical to SEQ ID NO: 287169

SEQ ID NO: 350953 - RNA, 64 nt, hsa; identical to SEQ ID NO: 287170

SEQ ID NO: 350954 - RNA, 64 nt, hsa; identical to SEQ ID NO: 287171

SEQ ID NO: 350955 - RNA, 64 nt, hsa; identical to SEQ ID NO: 287172

SEQ ID NO: 350956 - RNA, 64 nt, hsa; identical to SEQ ID NO: 287173

SEQ ID NO: 350957 - RNA, 64 nt, hsa; identical to SEQ ID NO: 287174

SEQ ID NO: 350958 - RNA, 64 nt, hsa; identical to SEQ ID NO: 287175

SEQ ID NO: 350959 - RNA, 64 nt, hsa; identical to SEQ ID NO: 287176

SEQ ID NO: 350960 - RNA, 64 nt, hsa; identical to SEQ ID NO: 167924

SEQ ID NO: 350961 - RNA, 64 nt, hsa; identical to SEQ ID NO: 167925

SEQ ID NO: 350962 - RNA, 64 nt, hsa; identical to SEQ ID NO: 167926

SEQ ID NO: 350963 - RNA, 64 nt, hsa; identical to SEQ ID NO: 167927

SEQ ID NO: 350964 - RNA, 64 nt, hsa; identical to SEQ ID NO: 167928

SEQ ID NO: 350965 - RNA, 64 nt, hsa; identical to SEQ ID NO: 167929

SEQ ID NO: 350966 - RNA, 64 nt, hsa; identical to SEQ ID NO: 167930

SEQ ID NO: 350967 - RNA, 64 nt, hsa; identical to SEQ ID NO: 167931

SEQ ID NO: 350968 - RNA, 64 nt, hsa; identical to SEQ ID NO: 167932

SEQ ID NO: 350969 - RNA, 64 nt, hsa; identical to SEQ ID NO: 167933

SEQ ID NO: 350970 - RNA, 64 nt, hsa; identical to SEQ ID NO: 167934

SEQ ID NO: 350971 - RNA, 64 nt, hsa; identical to SEQ ID NO: 167935

SEQ ID NO: 350972 - RNA, 64 nt, hsa; identical to SEQ ID NO: 167936

SEQ ID NO: 350973 - RNA, 64 nt, hsa; identical to SEQ ID NO: 167937

SEQ ID NO: 350974 - RNA, 64 nt, hsa; identical to SEQ ID NO: 167938

SEQ ID NO: 350975 - RNA, 64 nt, hsa; identical to SEQ ID NO: 167939

SEQ ID NO: 350976 - RNA, 64 nt, hsa; identical to SEQ ID NO: 167940

SEQ ID NO: 350977 - RNA, 64 nt, hsa; identical to SEQ ID NO: 167941

SEQ ID NO: 350978 - RNA, 64 nt, hsa; identical to SEQ ID NO: 167942

SEQ ID NO: 350979 - RNA, 64 nt, hsa; identical to SEQ ID NO: 167942

SEQ ID NO: 350980 - RNA, 64 nt, hsa; identical to SEQ ID NO: 167944

SEQ ID NO: 350981 - RNA, 64 nt, hsa; identical to SEQ ID NO: 167945

SEQ ID NO: 350982 - RNA, 64 nt, hsa; identical to SEQ ID NO: 167946

SEQ ID NO: 350983 - RNA, 64 nt, hsa; identical to SEQ ID NO: 167947

SEQ ID NO: 350984 - RNA, 64 nt, hsa; identical to SEQ ID NO: 167948

SEQ ID NO: 350985 - RNA, 64 nt, hsa; identical to SEQ ID NO: 167949

SEQ ID NO: 350986 - RNA, 64 nt, hsa; identical to SEQ ID NO: 221951

SEQ ID NO: 350987 - RNA, 64 nt, hsa; identical to SEQ ID NO: 221952

SEQ ID NO: 350988 - RNA, 64 nt, hsa; identical to SEQ ID NO: 221953

SEQ ID NO: 350989 - RNA, 64 nt, hsa; identical to SEQ ID NO: 221954

SEQ ID NO: 350990 - RNA, 64 nt, hsa; identical to SEQ ID NO: 221955

SEQ ID NO: 350991 - RNA, 64 nt, hsa; identical to SEQ ID NO: 221956

SEQ ID NO: 350992 - RNA, 64 nt, hsa; identical to SEQ ID NO: 221957

SEQ ID NO: 350993 - RNA, 64 nt, hsa; identical to SEQ ID NO: 221958

SEQ ID NO: 350994 - RNA, 64 nt, hsa; identical to SEQ ID NO: 221959

SEQ ID NO: 350995 - RNA, 64 nt, hsa; identical to SEQ ID NO: 221960

SEQ ID NO: 350996 - RNA, 64 nt, hsa; identical to SEQ ID NO: 221961

SEQ ID NO: 350997 - RNA, 64 nt, hsa; identical to SEQ ID NO: 221962

SEQ ID NO: 350998 - RNA, 64 nt, hsa; identical to SEQ ID NO: 221963

SEQ ID NO: 350999 - RNA, 64 nt, hsa; identical to SEQ ID NO: 221964

SEQ ID NO: 351000 - RNA, 64 nt, hsa; identical to SEQ ID NO: 221965

SEQ ID NO: 351001 - RNA, 64 nt, hsa; identical to SEQ ID NO: 221966

SEQ ID NO: 351002 - RNA, 64 nt, hsa; identical to SEQ ID NO: 221967

SEQ ID NO: 351003 - RNA, 64 nt, hsa; identical to SEQ ID NO: 221968

SEQ ID NO: 351004 - RNA, 64 nt, hsa; identical to SEQ ID NO: 221969

SEQ ID NO: 351005 - RNA, 64 nt, hsa; identical to SEQ ID NO: 221970

SEQ ID NO: 351006 - RNA, 64 nt, hsa; identical to SEQ ID NO: 221971

SEQ ID NO: 351007 - RNA, 64 nt, hsa; identical to SEQ ID NO: 221972

SEQ ID NO: 351008 - RNA, 64 nt, hsa; identical to SEQ ID NO: 221973

SEQ ID NO: 351009 - RNA, 64 nt, hsa; identical to SEQ ID NO: 221974

SEQ ID NO: 351010 - RNA, 64 nt, hsa; identical to SEQ ID NO: 221975

SEQ ID NO: 351011 - RNA, 64 nt, hsa; identical to SEQ ID NO: 221976

SEQ ID NO: 351012 - RNA, 64 nt, hsa; identical to SEQ ID NO: 221977

SEQ ID NO: 351013 - RNA, 64 nt, hsa; identical to SEQ ID NO: 221978

SEQ ID NO: 351014 - RNA, 64 nt, hsa; identical to SEQ ID NO: 221979

SEQ ID NO: 351015 - RNA, 64 nt, hsa; identical to SEQ ID NO: 221980

SEQ ID NO: 351016 - RNA, 64 nt, hsa; identical to SEQ ID NO: 221981

SEQ ID NO: 351017 - RNA, 64 nt, hsa; identical to SEQ ID NO: 221982

SEQ ID NO: 351018 - RNA, 64 nt, hsa; identical to SEQ ID NO: 221983

SEQ ID NO: 351019 - RNA, 64 nt, hsa; identical to SEQ ID NO: 221984

SEQ ID NO: 351020 - RNA, 64 nt, hsa; identical to SEQ ID NO: 221985

SEQ ID NO: 351021 - RNA, 64 nt, hsa; identical to SEQ ID NO: 221986

SEQ ID NO: 351022 - RNA, 64 nt, hsa; identical to SEQ ID NO: 221987

SEQ ID NO: 351023 - RNA, 64 nt, hsa; identical to SEQ ID NO: 221988

SEQ ID NO: 351024 - RNA, 64 nt, hsa; identical to SEQ ID NO: 221989

SEQ ID NO: 351025 - RNA, 64 nt, hsa; identical to SEQ ID NO: 221990

SEQ ID NO: 351026 - RNA, 64 nt, hsa; identical to SEQ ID NO: 221991

SEQ ID NO: 351027 - RNA, 64 nt, hsa; identical to SEQ ID NO: 221992

SEQ ID NO: 351028 - RNA, 64 nt, hsa; identical to SEQ ID NO: 221993

SEQ ID NO: 351029 - RNA, 64 nt, hsa; identical to SEQ ID NO: 221994

SEQ ID NO: 351030 - RNA, 64 nt, hsa; identical to SEQ ID NO: 221995

SEQ ID NO: 351031 - RNA, 64 nt, hsa; identical to SEQ ID NO: 221996

SEQ ID NO: 351032 - RNA, 64 nt, hsa; identical to SEQ ID NO: 221997

SEQ ID NO: 351033 - RNA, 64 nt, hsa; identical to SEQ ID NO: 221998

SEQ ID NO: 351034 - RNA, 64 nt, hsa; identical to SEQ ID NO: 221999

SEQ ID NO: 351035 - RNA, 64 nt, hsa; identical to SEQ ID NO: 222000

SEQ ID NO: 351036 - RNA, 64 nt, hsa; identical to SEQ ID NO: 222001

SEQ ID NO: 351037 - RNA, 64 nt, hsa; identical to SEQ ID NO: 222002

SEQ ID NO: 351038 - RNA, 64 nt, hsa; identical to SEQ ID NO: 222003

SEQ ID NO: 351039 - RNA, 64 nt, hsa; identical to SEQ ID NO: 222004

SEQ ID NO: 351040 - RNA, 64 nt, hsa; identical to SEQ ID NO: 222005

SEQ ID NO: 351041 - RNA, 64 nt, hsa; identical to SEQ ID NO: 222006

SEQ ID NO: 351042 - RNA, 64 nt, hsa; identical to SEQ ID NO: 222007

SEQ ID NO: 351043 - RNA, 64 nt, hsa
ggaggagugcaguggugugaucucagcucacugcaaccuccaccucccagguucaagcaauucu

SEQ ID NO: 351044 - RNA, 64 nt, hsa
gcuggaacgcaguggugacaucucggcucacugcaaccuccaccucccagguucaagugauucu

SEQ ID NO: 351045 - RNA, 64 nt, hsa
gcuggaaugcagugaugccaucucagcucacugcaaccuccaccuccuggguucaagugauucu

SEQ ID NO: 351046 - RNA, 64 nt, hsa
cauuuuuaaaaaaguuuuauuuugcacggcucuaaaccuccauguuauuuuccagugguguaga

SEQ ID NO: 351047 - RNA, 64 nt, hsa
uuuggaugugcuuguuccuggccuccaaggcaauaaccuccauguccuuuucccuguauuuacu

SEQ ID NO: 351048 - RNA, 64 nt, hsa
agcacgccaacuucaggcaguguuuucuacugcaaaccuccacauccuggaaucaaucacacug

SEQ ID NO: 351049 - RNA, 64 nt, hsa
agguggaauauaguucugucagggcuuuuacguaaaccuccacuuguacaugcaauuuggacag

SEQ ID NO: 351050 - RNA, 64 nt, hsa
guguuucugucagcagaauguacauguuguacaaaaccuccagguuccuuaagcuuuuugcugu

SEQ ID NO: 351051 - RNA, 64 nt, hsa
gcuggagugcaguggcgugaucucggcucacuacaaccuccaccucccagccaccugccuuggc

SEQ ID NO: 351052 - RNA, 64 nt, hsa
ugcuuuuuccucuuaggguuucuuugcagaaagaaaccuccagcaagggaagagaggugugugu

SEQ ID NO: 351053 - RNA, 64 nt, hsa
gcaggagucaggagccagggacugugcagccuggaaccuccagucacugugcccagcagggugg

SEQ ID NO: 351054 - RNA, 64 nt, hsa
gggucuccugugagccggggaccaugcagcccgaaaccuccagucacugcgcccggcaggaguc

SEQ ID NO: 351055 - RNA, 64 nt, hsa
ggagggggguggcacagcagcuuggguaccccccaaccuccaggagcuaguggaggggugugua

SEQ ID NO: 351056 - RNA, 50 nt, hsa
gguggaaugggguuucauaaaaccuccaaccugcaccccucccuucucca

SEQ ID NO: 351057 - RNA, 64 nt, hsa
gcugaacugcaguggugugaucuaggcucacugcaaccuccaccucccagguucaagcaauuau

SEQ ID NO: 351058 - RNA, 64 nt, hsa
gcaugcacaccucugaagaccccugcaugaaaauaaccuccaaggacccucugaccccaucgac

SEQ ID NO: 351059 - RNA, 64 nt, hsa
gcuggagugcaguggugcgaccuuggcucacugcaaccuccaucuccggggcucaagcgcuucu

SEQ ID NO: 351060 - RNA, 64 nt, hsa
gcuggaguucaguggugcgaccucggcuuacugcaaccuccaccucccggguucaagugauucu

SEQ ID NO: 351061 - RNA, 64 nt, hsa
gcuggagugcaguggcgugaucucggcucacugcaaccuccacccccggggaucaagcaacucu

SEQ ID NO: 351062 - RNA, 64 nt, hsa
guucgaguucaguggugccaucucuguccacugcaaccuccacauccuggguucaagugauucu

SEQ ID NO: 351063 - RNA, 64 nt, hsa
gcuggagugcaguggcacagucuuggcucacugcaaccuccaccuccuggguucaagcaauucu

SEQ ID NO: 351064 - RNA, 64 nt, hsa
gcuguagugcaguggcacgaucuuggcucacugcaaccuccaccucccggguucaagcaauucu

SEQ ID NO: 351065 - RNA, 59 nt, hsa
ggcgcccaauggggggucccugagacuugcauguaaaacuagucuagaugucuucuuuu

SEQ ID NO: 351066 - RNA, 59 nt, hsa
uuuuuguaaguuuuauuuuuguaauugugcauguaaagcaucauugaaucaauggaucu

SEQ ID NO: 351067 - RNA, 59 nt, hsa
uuaaguaaaaacaacaaauaaacucuguacauguaaaacgugagaaauuguccugcccu

SEQ ID NO: 351068 - RNA, 59 nt, hsa
aaauuuuaaguaccuaggggagaaagagccauguaaauaucuguaauaaacuuguagca

SEQ ID NO: 351069 - RNA, 59 nt, hsa
guuguaauaauugcuagguugaaguucaacauguaaaaaaagggggcauggauuuacau

SEQ ID NO: 351070 - RNA, 59 nt, hsa
uccuaagcgcauaguuuuugguccugccucauguaaaauaguuaaugauuaucauuuac

SEQ ID NO: 351071 - RNA, 59 nt, hsa
ucacaaacauuaacggcaguaggcaccaccauguaaaagugagcucagacgucucuaaa

SEQ ID NO: 351072 - RNA, 59 nt, hsa
uauuuaaaucucuacacagauucaccaggcauguaaacucaucugcagaaaauguaaac

SEQ ID NO: 351073 - RNA, 59 nt, hsa
gguuaucaaguguuucugcaugguaaugucauguaaaugcugauauugauuucacuggu

SEQ ID NO: 351074 - RNA, 59 nt, hsa
cuauuaaguuucaucuauugugugcuauacauguaaaaacugucucuuugaacuauuga

SEQ ID NO: 351075 - RNA, 59 nt, hsa
gguggugcugauuauuauaguacauauaccauguaaacucucaaacucuauuuagcugu

SEQ ID NO: 351076 - RNA, 59 nt, hsa
gaguuugagaccauggcuguuacagggaucauguaaacuugcuguuuuuguuuuuuccu

SEQ ID NO: 351077 - RNA, 59 nt, hsa
gcuuauguuacagguuacgugagaacaaucauguaaaucuauaugauuucagaaauguu

SEQ ID NO: 351078 - RNA, 59 nt, hsa
auacaaaaagaaauguaaaugaccuuuaacauguaaagaugcucaccuuguucagaaga

SEQ ID NO: 351079 - RNA, 59 nt, hsa
gcuucauugccuucucugauugccuuuugcauguaaaacuaugugucuggagucuuuug

SEQ ID NO: 351080 - RNA, 59 nt, hsa
acaaacuucuuuaucacauguaucuucuacauguaaaacauuucugaugauuuuuuaac

SEQ ID NO: 351081 - RNA, 59 nt, hsa
uauuuaugacagugaacauucugauuuuacauguaaaacaagaaaaguugaagaagaua

SEQ ID NO: 351082 - RNA, 59 nt, hsa
aucuaagauaggcaauaguguauaaauaucauguaaaugugauggauuucuuaaucaua

SEQ ID NO: 351083 - RNA, 59 nt, hsa
cgggcucaccaggcugcuggcuccgguaccauguaaaccuaggaagguaaaggagcagg

SEQ ID NO: 351084 - RNA, 59 nt, hsa
aaacccacauagcacuuugcucuuaguuacauguaaaauuuuagauuucuaaaacaggu

SEQ ID NO: 351085 - RNA, 59 nt, hsa
cuuagcuggacuuagaucuucgguggccucauguaaacguggcagccagccucuucuag

SEQ ID NO: 351086 - RNA, 59 nt, hsa
aagacuuuagggggaaagaauaguaaaugcauguaaacaaauggggacacucuguucag

SEQ ID NO: 351087 - RNA, 59 nt, hsa
aucucuuuuccacuccauugucguauaggcauguaaacagccucuuuuugauacuggag

SEQ ID NO: 351088 - RNA, 59 nt, hsa
aaugaaaaucauauuucagaaaauauuaccauguaaauauguacauauguagucuagua

SEQ ID NO: 351089 - RNA, 59 nt, hsa
auaaggauguaaugauuuagauaaagcaucauguaaagaaauccuaacauuuaagugua

SEQ ID NO: 351090 - RNA, 59 nt, hsa
aaggaaauauuuuuguucuuauacaaaaacauguaaauauugcuuuauuacuuucauuu

SEQ ID NO: 351091 - RNA, 59 nt, hsa
agugacaccaagggaaguugacuaagucacauguaaauuaggaguguuuuaaagaaugc

SEQ ID NO: 351092 - RNA, 59 nt, hsa
uuuaaaauuuguaaauuucuaaauccaaucauguaaaaugaaacuguugcuccauugga

SEQ ID NO: 351093 - RNA, 59 nt, hsa
aagauuuuaaauucacaauagaaacucaccauguaaaagagucaucugguagauuuuua

SEQ ID NO: 351094 - RNA, 59 nt, hsa
auuccagaauuuguuuauauggcugguaacauguaaaaucuauaucagcaaaagggucu

SEQ ID NO: 351095 - RNA, 59 nt, hsa
gcccuggcagauugggguauccacccagucauguaaaggcaggagaccugcucugggcc

SEQ ID NO: 351096 - RNA, 59 nt, hsa
uuuuuuuaaaguaauauuuuuuagaaauacauguaaaauaccaagaaauaaugucugcg

SEQ ID NO: 351097 - RNA, 59 nt, hsa
uguuaauggugcuuuaagugucaauguagcauguaaaaggcuuuguacagacagguaaa

SEQ ID NO: 351098 - RNA, 59 nt, hsa
gauuguugagauaaauaagugauauaaaacauguaaagcuuaguucuggccacagugua

SEQ ID NO: 351099 - RNA, 59 nt, hsa
ugaauaguugguuuccaaugcacaaauaucauguaaacuaaucuaaagaugguuugcuu

SEQ ID NO: 351100 - RNA, 59 nt, hsa
ccacuuucagcuggacacaggcgcggccucauguaaacauuuuauuuucaaaugaauga

SEQ ID NO: 351101 - RNA, 59 nt, hsa
aaauguuuauagccaaauaacaaaugugccauguaaaaguaagucuggacuuaagaguu

SEQ ID NO: 351102 - RNA, 59 nt, hsa
guuuccugaggccuccccagaagcagaagcauguaaagcccacagaaccgugaguugau

SEQ ID NO: 351103 - RNA, 59 nt, hsa
ggaaaucaguucucacugagcccgguuuccauguaaaaucucuguuguggugggcauag

SEQ ID NO: 351104 - RNA, 59 nt, hsa
gcauguaagauccacaaaaugagacaaugcauguaaauccaugcucauguucuaaacau

SEQ ID NO: 351105 - RNA, 59 nt, hsa
guuuggaaaaaggacaacgaaaggcuuuucauguaaagauaagaucuuuagcuaucucu

SEQ ID NO: 351106 - RNA, 59 nt, hsa
cuacuguguugugguuuuuaaacauuaaacauguaaaguuauauacgaaauaucugcuu

SEQ ID NO: 351107 - RNA, 59 nt, hsa
aaagaaauugauagguguaaaugagagaccauguaaaauauguaaauucuaguaccuga

SEQ ID NO: 351108 - RNA, 59 nt, hsa
acucugaaaccugaugcaacaguggaauccauguaaaacucucugugcaucuaaauacu

SEQ ID NO: 351109 - RNA, 59 nt, hsa
gugaucaaaaaagaagaguuaaaacaacacauguaaaugccuuuugauauuucauggga

SEQ ID NO: 351110 - RNA, 59 nt, hsa
ucccauugaggaaucuuaaauuucauagacauguaaagcugaaguaacucuaaagagca

SEQ ID NO: 351111 - RNA, 59 nt, hsa
uuuaauuuuuugaauaugauaccuugucacauguaaauuagauacuuaaauauuaaauu

SEQ ID NO: 351112 - RNA, 59 nt, hsa
auguuuuaaauguacaguuuggggcaagucauguaaauacuguugguggucuuccccac

SEQ ID NO: 351113 - RNA, 59 nt, hsa
auuuagaugugaaaccucuacagagcuaucauguaaaaacuacauaaggugguugugcu

SEQ ID NO: 351114 - RNA, 59 nt, hsa
uucuuaaacccgugcauauucuggugaaacauguaaaauacuuuaaguaaaauugaaca

SEQ ID NO: 351115 - RNA, 59 nt, hsa
auagcagccucucaaguccauugaggccucauguaaaauucccauuuuucaucuuuaca

SEQ ID NO: 351116 - RNA, 59 nt, hsa
auggcuuguuauauaaaauuacauuuuuacauguaaaaauaaacuaaacaaaucuaaug

SEQ ID NO: 351117 - RNA, 59 nt, hsa
gaccuuauaagugacauuuaaugucauagcauguaaaggguuuuuuuuguaauaaaaau

SEQ ID NO: 351118 - RNA, 59 nt, hsa
cauuccacugaaguucugaaaucuuucgucauguaaauaauuuccauauuucucuuuua

SEQ ID NO: 351119 - RNA, 59 nt, hsa
aauuugugacaaguuugcacuuacaaaaucauguaaauaugucacauuuuguuuaacau

SEQ ID NO: 351120 - RNA, 59 nt, hsa
gacaugaugcuucuugcuggguuuuuguacauguaaacauugucaagcugugaaagaaa

SEQ ID NO: 351121 - RNA, 59 nt, hsa
gaccgcauuggaagaauuuucuugggccacauguaaaacacacuaacacuaaccauagu

SEQ ID NO: 351122 - RNA, 59 nt, hsa
aauugucugaaauugggacaaaacaccuucauguaaaccagcuuugcaaaauuuuccag

SEQ ID NO: 351123 - RNA, 59 nt, hsa
uaugacauugaguccuucacugcuuccaucauguaaaaguucacaguuaaagacugaau

SEQ ID NO: 351124 - RNA, 59 nt, hsa
acauucuuccugauuauuuucuacacauacauguaaaauaugucuuucuuuuuuaaaua

SEQ ID NO: 351125 - RNA, 59 nt, hsa
uucaaaaagugccaaauuugucaguauugcauguaaauaauuguguuaauuauuuuacu

SEQ ID NO: 351126 - RNA, 59 nt, hsa
uucuuuuaggucagccuuuguuggucuuccauguaaauacaaguugguacaaaucaaua

SEQ ID NO: 351127 - RNA, 59 nt, hsa
agacaauuuuaauguuuacaacaauaaaccauguaaaugaacagaauuuugucuucuuu

SEQ ID NO: 351128 - RNA, 59 nt, hsa
uucacaggauuguaauuagucuuguuucccauguaaauaaacaacacacgcauacagaa

SEQ ID NO: 351129 - RNA, 59 nt, hsa
accaugucucccagggccuuaaaagccaucauguaaauuaccaguaaaguguaacauau

SEQ ID NO: 351130 - RNA, 59 nt, hsa
uuaauucauaauuagaacaauagcuauugcauguaaaaugcaguccagaauaagugcug

SEQ ID NO: 351131 - RNA, 59 nt, hsa
uuuggugaccaucuguuugagaauaugaucauguaaaugauuaucuccuuuauagccug

SEQ ID NO: 351132 - RNA, 59 nt, hsa
uucagcugugguuauuuaaagcagacuuacauguaaaccggaauccucucuauacaagu

SEQ ID NO: 351133 - RNA, 59 nt, hsa
gauuaacauauuguaaauguucuuuuuuccauguaaaucaacuaucuuuguuaucacua

SEQ ID NO: 351134 - RNA, 59 nt, hsa
auauguggauaacaaagauagauagauagcauguaaauuggguugugguuuggggucag

SEQ ID NO: 351135 - RNA, 59 nt, hsa
gaggacaauuuauauaacucacuuuuugucauguaaaaaagguuacucaaguuguacua

SEQ ID NO: 351136 - RNA, 59 nt, hsa
uuuuaaagggaaaaguaaauauaacuuagcauguaaacucauuucggcuaccauuugcu

SEQ ID NO: 351137 - RNA, 59 nt, hsa
uuagaaauugcaaauaguuaacuuuucaucauguaaaaaguuaacauuauccuauuucc

SEQ ID NO: 351138 - RNA, 59 nt, hsa
caacaacaauguguuguaaaaaugucuuucauguaaaaagugcaguaaauauuuacuau

SEQ ID NO: 351139 - RNA, 59 nt, hsa
ggcaauggaauuuucuauaaacauuuucucauguaaacaugcugccaccuuuucuucuu

SEQ ID NO: 351140 - RNA, 59 nt, hsa
aaaaaagugaauugccaagauacuggugucauguaaauucccacuuuacauaaaaaccc

SEQ ID NO: 351141 - RNA, 59 nt, hsa
uuuauugaaagauuucaucugucguguuucauguaaaugagaacagauuauuugcauga

SEQ ID NO: 351142 - RNA, 59 nt, hsa
cagugguuagcuauucgcacguuauuugccauguaaaugaaaacgucuuuauuuaucaa

SEQ ID NO: 351143 - RNA, 59 nt, hsa
uauaaucaauuagaaguaaugaauggaugcauguaaaauggaugugauuuuuuuucaag

SEQ ID NO: 351144 - RNA, 59 nt, hsa
uugcuaaagaccaguucuuuaagcuaagacauguaaaaaaucccaaauggcaguaccuc

SEQ ID NO: 351145 - RNA, 59 nt, hsa
aucuauaucuauauauuuuuaaucaucuacauguaaaugaagcaauagaauucuaacau

SEQ ID NO: 351146 - RNA, 59 nt, hsa
gaagaaagcuacuaacuuagcuguauucucauguaaauauuuuuuaaauaauuaagcaa

SEQ ID NO: 351147 - RNA, 59 nt, hsa
gcuguuacgaauuuacagcagcauuuguacauguaaaauuaaaggcuauuuucuggucu

SEQ ID NO: 351148 - RNA, 59 nt, hsa
uaggguaaguaaauauagccaccuguuaacauguaaauaagcauaauuuguuccaaaga

SEQ ID NO: 351149 - RNA, 59 nt, hsa
acauggauuuucaucuuucugcauuauuucauguaaauuuucuacacauuuguauacaa

SEQ ID NO: 351150 - RNA, 59 nt, hsa
uuuuaaauuguuagcuuccuuaaguauaucauguaaagaaaugucuuaauuuuugaaaa

SEQ ID NO: 351151 - RNA, 59 nt, hsa
uauuuaaaaaaagauggcagucaucuagacauguaaaaugccaagaaugucuuagaauu

SEQ ID NO: 351152 - RNA, 59 nt, hsa
uuuuuaaguauuuaucauuuuauaguacacauguaaagaauauaugagccuuguaugga

SEQ ID NO: 351153 - RNA, 59 nt, hsa
ccaacaucugggucugugucucugauuuccauguaaauguugcaaaaagaguuuuccaa

SEQ ID NO: 351154 - RNA, 59 nt, hsa
ucugauuguacaugauaguaaguguaagccauguaaaaaguaaauaaugucugggcaca

SEQ ID NO: 351155 - RNA, 59 nt, hsa
auuaagagcacaaacuuuuuuuuguaaaacauguaaaaaaaaaaacugggauuaauuuu

SEQ ID NO: 351156 - RNA, 59 nt, hsa
auauaauuccuaguuuccauauuuauccgcauguaaagggccgguuuauccauguuaca

SEQ ID NO: 351157 - RNA, 59 nt, hsa
cauuuuuuuuuguagagggugauauauaccauguaaaugaacaaagacauuuuaaauuu

SEQ ID NO: 351158 - RNA, 59 nt, hsa
guguauuuuccauauauguaaaacauacacauguaaaauauauguggccauaaauuagg

SEQ ID NO: 351159 - RNA, 59 nt, hsa
cacuggucacauuuucaucaagcagucaacauguaaauuucuguuguaaagacaccuua

SEQ ID NO: 351160 - RNA, 59 nt, hsa
uaccuauacuuaucuccucauaauaucuucauguaaagaaccaucuguuucuuauugga

SEQ ID NO: 351161 - RNA, 59 nt, hsa
gguuuaccuguuacauuuucaaguuaauucauguaaaaaaugauagugauuuugaugua

SEQ ID NO: 351162 - RNA, 59 nt, hsa
uguuuauaucuuuugcugugcaaaagaaacauguaaaauguuguucaguuguauauaca

SEQ ID NO: 351163 - RNA, 59 nt, hsa
uccaugugugaaccuugagugauacuaaucauguaaaguaagaguucucuuauguauua

SEQ ID NO: 351164 - RNA, 59 nt, hsa
aucgaucauauucuaaaggcuauuuaaaacauguaaaaggauuuggggaacggcagaaa

SEQ ID NO: 351165 - RNA, 59 nt, hsa
ugacguaaaucaacgugaugauucuuucacauguaaacacauuuuaguguuucugguuu

SEQ ID NO: 351166 - RNA, 59 nt, hsa
aaguucuccugcaagguuuaauuuguuaucauguaaauauucuaaagcaggcugccuug

SEQ ID NO: 351167 - RNA, 59 nt, hsa
ugggauguauggagaggauggaagauuuucauguaaaauaaaauuaaaaaaaaaaaaca

SEQ ID NO: 351168 - RNA, 59 nt, hsa
aggacacauuuuuuaucucuaggcuuagucauguaaaaacugccuauugcuaaaauucu

SEQ ID NO: 351169 - RNA, 59 nt, hsa
cgcggcgccccuagccaucuuuauacagccauguaaauccuccuguacaagcgaacacg

SEQ ID NO: 351170 - RNA, 59 nt, hsa
cugggguuugcugcagagcuauuucuuuccauguaaaguaguggauccaucuugcuuuu

SEQ ID NO: 351171 - RNA, 59 nt, hsa
gaaauuuugguacaguguacauugaaaaccauguaaaauauugaagugucuaacaaaug

SEQ ID NO: 351172 - RNA, 59 nt, hsa
uuucuuccauuaacugcuuccagagaugucauguaaaaaaguuaguguauuagagaagu

SEQ ID NO: 351173 - RNA, 59 nt, hsa
ucuguaucuuucuuuuguaaaugaccucacauguaaauucaccaaauaaauauuacauu

SEQ ID NO: 351174 - RNA, 59 nt, hsa
uguguaugaccauuaauguaugucauaaacauguaaauaaaagauguugaaucuuguug

SEQ ID NO: 351175 - RNA, 59 nt, hsa
aaguauaaaauuaagauauaagcagaucacauguaaaucauuccuaaagcacaagaaaa

SEQ ID NO: 351176 - RNA, 59 nt, hsa
aagcaaaguacacccauuauuuaugcagacauguaaaaaaucuaaaaauucuugcaaug

SEQ ID NO: 351177 - RNA, 59 nt, hsa
uccuugaggcuguugcugaggaaaagccucauguaaaacccuauuucucuaagaccauu

SEQ ID NO: 351178 - RNA, 59 nt, hsa
aggaggauuuucuuuagaaugcucuuuugcauguaaagcacaaaguauguuucaguuua

SEQ ID NO: 351179 - RNA, 59 nt, hsa
aaucccuuuuugcagugacagaagaggagcauguaaauuacccaagggaauguugguga

SEQ ID NO: 351180 - RNA, 59 nt, hsa
uuuggucuacaacacagugaucgaaaaugcauguaaaugcccauccuucccuucauuca

SEQ ID NO: 351181 - RNA, 59 nt, hsa
agagaaagaaccucuuuccugaauauugacauguaaaagaccaaaguaauuuuucugaa

SEQ ID NO: 351182 - RNA, 59 nt, hsa
uauuuugauuauuguauuuauuccauauucauguaaacaaaauuuaguuuuuguucuua

SEQ ID NO: 351183 - RNA, 59 nt, hsa
gagaauuuauaccagagagaaacccuacacauguaaagaauguggcaaagccuucaaua

SEQ ID NO: 351184 - RNA, 59 nt, hsa
auacguuuaauguaauaagaacaagggaacauguaaacuaacauaaccaauugucaguu

SEQ ID NO: 351185 - RNA, 59 nt, hsa
ugccuauaucaugaaguacauuaauuucucauguaaaaaaaauagcucuaaaauuuguu

SEQ ID NO: 351186 - RNA, 59 nt, hsa
uucaggcccuauaaugugucaggcacugacauguaaaauuuuuuuaauuaaaaaagagc

SEQ ID NO: 351187 - RNA, 59 nt, hsa
aaguuugagauuugugauaacuuuguagucauguaaaacuuaagugcuucaugccucuc

SEQ ID NO: 351188 - RNA, 59 nt, hsa
cauauuuauguauauguaccauguuguuacauguaaacaaacuucaauuugaagugcag

SEQ ID NO: 351189 - RNA, 59 nt, hsa
gugcuuugugguaucugaacaauucauaacauguaaauaaugugggaaaauaguauugu

SEQ ID NO: 351190 - RNA, 59 nt, hsa
guucuuuuucacaaguucaaucuguuuuucauguaaauuuuguaugaaaaaucaauguc

SEQ ID NO: 351191 - RNA, 59 nt, hsa
uaauuuuaaaguggcuuaguacugccagucauguaaauugauucugcugagggucuuau

SEQ ID NO: 351192 - RNA, 59 nt, hsa
aggccuaagaaagguggcaaugaacugugcauguaaauuuuaaauggguacuuugugca

SEQ ID NO: 351193 - RNA, 59 nt, hsa
aaaagaacuauuuaaaacucuugaaaacucauguaaauaaaaaucauagggugaaaauu

SEQ ID NO: 351194 - RNA, 59 nt, hsa
gaacauuuuaaaacaaucaguuaauuuaccauguaaaauugcuguaaaugauaaugugu

SEQ ID NO: 351195 - RNA, 59 nt, hsa
auuugcacagagugaaaugucagaaguuacauguaaaugaauucacagucaauaaaguc

SEQ ID NO: 351196 - RNA, 59 nt, hsa
ccauuugcauauuaauauguuccuccacacauguaaaggcacaguggcuccguguguua

SEQ ID NO: 351197 - RNA, 59 nt, hsa
uucuguaguucauccuuaauccugacacccauguaaauguccaaaauguugaucuucca

SEQ ID NO: 351198 - RNA, 53 nt, hsa
acggaauggugccauuguaacuucauguaaaugucgcuucuucaagugaauga

SEQ ID NO: 351199 - RNA, 59 nt, hsa
uuuuuuguuuuuguuuuuguuuugaaugccauguaaaggcuuuuugguuaagaccucac

SEQ ID NO: 351200 - RNA, 59 nt, hsa
uacaggucuuucuguagggaaaauuauuccauguaaacauuucaacucuguaugaaaau

SEQ ID NO: 351201 - RNA, 59 nt, hsa
auuauuucucuggauaucuuucuguguuccauguaaauuuauuuaccaacaucuauugu

SEQ ID NO: 351202 - RNA, 59 nt, hsa
uugauuaaacuguaugucuuauaagaaaacauguaaagggggaauauauggggggagug

SEQ ID NO: 351203 - RNA, 59 nt, hsa
uauaaaucaaauacacaugugauaauaugcauguaaauacauaacuauccucaucaugu

SEQ ID NO: 351204 - RNA, 59 nt, hsa
aauaugauauuuaaauaacauaguaaacacauguaaaaauuuuguucuucaaaaaagug

SEQ ID NO: 351205 - RNA, 59 nt, hsa
caggguauuauuauagaauauuauucucgcauguaaacaaagauaucuuugcuuuaaga

SEQ ID NO: 351206 - RNA, 59 nt, hsa
ccaugaaaguaaaagacuacugucauuagcauguaaaacaaagaaagauauacaugacu

SEQ ID NO: 351207 - RNA, 59 nt, hsa
caaaauuuuguuuaaaacucagaauauaacauguaaaaucccaucugcuagaagcccau

SEQ ID NO: 351208 - RNA, 59 nt, hsa
uuuaugagggggcccuucacuaaaaaguacauguaaaaguacauuugaugacaauagcu

SEQ ID NO: 351209 - RNA, 59 nt, hsa
uguagaagugaguuuguaaauauucuacacauguaaaauauguaaaacuauggguuauu

SEQ ID NO: 351210 - RNA, 59 nt, hsa
aaaagagguuuuucuuaaauaauaaagaucauguaaaaguaacaaaugugugaaauuua

SEQ ID NO: 351211 - RNA, 59 nt, hsa
cuguacuacaaucaacuuuauuuugaaaucauguaaaauaagauauuagacuguuuuuu

SEQ ID NO: 351212 - RNA, 59 nt, hsa
ggugggaaauuuagcugacuagggacaaacauguaaaccuauuuuccuaugaaaaaaau

SEQ ID NO: 351213 - RNA, 59 nt, hsa
uccuacuaaaugaaagugcacuacugccucauguaaagacucuugcacgcagagccuuu

SEQ ID NO: 351214 - RNA, 59 nt, hsa
uuaaagaaaaaugcaaucaggauuuuaaacauguaaauacaaauuuuguauaacuuuug

SEQ ID NO: 351215 - RNA, 59 nt, hsa
uuaaaaugcucaauuucagcaccgauggccauguaaauaagaugauuuaauguugauuu

SEQ ID NO: 351216 - RNA, 59 nt, hsa
uuuuguucugaaagugauauuauauuguacauguaaaauuaauuuaaauauuuuuucaa

SEQ ID NO: 351217 - RNA, 59 nt, hsa
agcagaugagggaccagcacucagucuaacauguaaacaucauacguaauaaagguugu

SEQ ID NO: 351218 - RNA, 59 nt, hsa
cacuuaaaguuuuuuauauaugaauauuacauguaaagcuguuaaaauacauaacuuca

SEQ ID NO: 351219 - RNA, 59 nt, hsa
gcugcuucugugugauuucuuccaaaauacauguaaaaucuuguacacaucuuagcugc

SEQ ID NO: 351220 - RNA, 59 nt, hsa
uacugccuacuuuaccuaguucaccuuaacauguaaauccacaggguagauuucuuucu

SEQ ID NO: 351221 - RNA, 59 nt, hsa
aagagagaguggcuuugucaguauaaaaccauguaaagucaucaucaagucaucuggau

SEQ ID NO: 351222 - RNA, 59 nt, hsa
uacugcuuccucacaagucucccacaggccauguaaaggguauuuuuuuguggcuugcu

SEQ ID NO: 351223 - RNA, 59 nt, hsa
caaucagccccuaccacgagcauuaauaccauguaaagcuggcuuucuggagucugcca

SEQ ID NO: 351224 - RNA, 59 nt, hsa
aaaucaaaugucaguccuagcagauguugcauguaaauugguagcaaguaaugauuaca

SEQ ID NO: 351225 - RNA, 59 nt, hsa
auauaaaaugucccuuggauuuugcuucccauguaaaucuauuguauuauuacacuugu

SEQ ID NO: 351226 - RNA, 59 nt, hsa
uauguuuuguaaauccauuuuguagagggcauguaaauaaauguuuuccuguagucaua

SEQ ID NO: 351227 - RNA, 59 nt, hsa
auuucaaggcuaauaccuacuuguacguacauguaaaacaaaucccgccgcaacuguuu

SEQ ID NO: 351228 - RNA, 59 nt, hsa
uguguacaaaaggauugcuuguaaauaugcauguaaauaguucuguuaauaacccacug

SEQ ID NO: 351229 - RNA, 59 nt, hsa
uuuaaaauuauaaauuaauguuuucguggcauguaaauuuuuaugguacagauaguuau

SEQ ID NO: 351230 - RNA, 59 nt, hsa
cccuuuuaaaaccuagauauaaaugcuuacauguaaagaaaggaagcuaagcagugggu

SEQ ID NO: 351231 - RNA, 59 nt, hsa
uacauuacauguauauuacaaguauauuacauguaaaacaggacaauuuaaaaauuuua

SEQ ID NO: 351232 - RNA, 59 nt, hsa
gugucauguugcagguucaacguuauuuacauguaaauagacaaaaggaaacauuugcc

SEQ ID NO: 351233 - RNA, 59 nt, hsa
agcuuuggucccacagccuugccucacagcauguaaauaauuaaaacaauauugaugcu

SEQ ID NO: 351234 - RNA, 59 nt, hsa
gguuacaucugugaauagccuguuuuccacauguaaauuugugccuuacaccuugaguu

SEQ ID NO: 351235 - RNA, 59 nt, hsa
cauguggagaaaauuauucacacuacuugcauguaaagaauaauuuaacuuuuaacauu

SEQ ID NO: 351236 - RNA, 59 nt, hsa
aaguuuacauuuuuguacugcagacgcuucauguaaauaaaaacuaaaaauaagucgcc

SEQ ID NO: 351237 - RNA, 59 nt, hsa
uuagacccaucuuaauuaagccuuaccuccauguaaagaacagcacgucuguuccaagg

SEQ ID NO: 351238 - RNA, 59 nt, hsa
uaugucccuagccugucauuuuucagcugcauguaaaaggagguaggaugaauugauca

SEQ ID NO: 351239 - RNA, 59 nt, hsa
cauucaucucuaacauaugauacugaugccauguaaaggccuuuaauaagucauugaaa

SEQ ID NO: 351240 - RNA, 59 nt, hsa
aaggggcuugagcaugaccccuaaagcuacauguaaaguucuuguacaaaaaauggaau

SEQ ID NO: 351241 - RNA, 59 nt, hsa
uauauaaaugaagaacauuuuuaauauggcauguaaagcuuuuaaaguuaugaacucag

SEQ ID NO: 351242 - RNA, 59 nt, hsa
caauaacuggaagaaaaugaugugaauuucauguaaaugaccagaggaaagauggauaa

SEQ ID NO: 351243 - RNA, 59 nt, hsa
uaccgauuagaucuauccauuguagaauucauguaaauagaauacuguaguauguacuu

SEQ ID NO: 351244 - RNA, 56 nt, hsa
ccagccucuacacccagugaaugccccauguaaaaacaugaugauaaaacagcaaa

SEQ ID NO: 351245 - RNA, 59 nt, hsa
ucauucuucacaaaagaauaguagaggaucauguaaaccugagccuaacucuuguucca

SEQ ID NO: 351246 - RNA, 59 nt, hsa
aaguauaagugaaugauauuuuucuuuuacauguaaacaaugaaguuauuucaaaguua

SEQ ID NO: 351247 - RNA, 59 nt, hsa
gagcaccauugcugguuccauuuagcuuacauguaaauguaauuauuuaaaacacacac

SEQ ID NO: 351248 - RNA, 59 nt, hsa
auggugccuaagagagcuauauauauacacauguaaaguccauuguuuuuauuguccug

SEQ ID NO: 351249 - RNA, 59 nt, hsa
cuuucaauaacaguaauguauaauaaaaccauguaaaguuuuguuguauuuugauucga

SEQ ID NO: 351250 - RNA, 59 nt, hsa
uuuauaaccacuuaaauugugagccaagccauguaaaagaucuacuuuuucuaagggca

SEQ ID NO: 351251 - RNA, 59 nt, hsa
gugaucuuuauuuauaguaaauuauguuucauguaaaugauauauuuuuggugaaaugc

SEQ ID NO: 351252 - RNA, 59 nt, hsa
guacccuugggucgcacgggccuggcuggcauguaaacggucaguugcacugccuagug

SEQ ID NO: 351253 - RNA, 59 nt, hsa
aaccuagagauuuuaaaucaugaauugaacauguaaaauuccaguaaaauguaaaaacg

SEQ ID NO: 351254 - RNA, 59 nt, hsa
gaauaaauggaagcauuaauuguuuugaacauguaaauauaaaucugucagccacuaca

SEQ ID NO: 351255 - RNA, 59 nt, hsa
aaaaaaaaaaaaaaaaaggaaagaacugucauguaaacauaccaacauguuuaaaccug

SEQ ID NO: 351256 - RNA, 59 nt, hsa
cuccuguuaaaaaaauuguacuuuuauuucauguaaacugccccucugaggauuugggc

SEQ ID NO: 351257 - RNA, 59 nt, hsa
gccaguacaccaaggcuguagggaucaagcauguaaacaccaacugguccauacccauu

SEQ ID NO: 351258 - RNA, 59 nt, hsa
ugguuguucuaagaauuaaaaggaacugacauguaaaagugcuuagaacaggaccuagg

SEQ ID NO: 351259 - RNA, 59 nt, hsa
ucuggauccagaaggccuuaugcuccaagcauguaaagaaaagaucgcaggaaugugga

SEQ ID NO: 351260 - RNA, 59 nt, hsa
cauugccguggcaucuuaaaagcuaucuucauguaaauugacuguacuaggccuacugg

SEQ ID NO: 351261 - RNA, 59 nt, hsa
gugccauuguuuggacaauauuaaagcugcauguaaaaggggaaauuaguauaugaugu

SEQ ID NO: 351262 - RNA, 59 nt, hsa
ugaggucauccagcugguguguucuuuugcauguaaacugccauuuauauuuuagaaaa

SEQ ID NO: 351263 - RNA, 59 nt, hsa
uugcuuuguauuaaaccucuuugucuacacauguaaaacuuaccuuuuguuauugagca

SEQ ID NO: 351264 - RNA, 59 nt, hsa
uucagauauauuauuuuaaaggcaccacacauguaaaacaguuauuacaaauauuuuau

SEQ ID NO: 351265 - RNA, 59 nt, hsa
gcaugauuuuuuuggucuuaaaagcuuaacauguaaaauuggcaaaaaaaauuuuuuac

SEQ ID NO: 351266 - RNA, 59 nt, hsa
aucuaaaaauaugggaaaacauuccaccccauguaaauauguacaagugcaucacuggu

SEQ ID NO: 351267 - RNA, 59 nt, hsa
ucugaaaucuguuuuaauauuuuuguauacauguaaauauuucuguauuuuuuauaugu

SEQ ID NO: 351268 - RNA, 59 nt, hsa
gcaagugacugcuuucaagcagcagucgacauguaaaugaagguguucuuagaauucgc

SEQ ID NO: 351269 - RNA, 59 nt, hsa
gaaaacgugggccggugaaaacaacuuaacauguaaauguacauaauaaaauuccaggc

SEQ ID NO: 351270 - RNA, 59 nt, hsa
gacauaagcuaccgauuaacuaaucggaacauguaaaacaguuacaaaaauaaacgaac

SEQ ID NO: 351271 - RNA, 59 nt, hsa
cucuuugcugaaauugaauugcacuuauacauguaaauugucaacauguaauuuggaau

SEQ ID NO: 351272 - RNA, 59 nt, hsa
augauugacucauucauaguaaauaugggcauguaaacuaauaaauaugcacuggauac

SEQ ID NO: 351273 - RNA, 59 nt, hsa
gcaaaaggggaagaaaggaauugcgaauacauguaaaaugucaccagacauuuguauua

SEQ ID NO: 351274 - RNA, 59 nt, hsa
aauauggaaaagccauuuauaucugcucacauguaaaaacaucaguucauacuuaauaa

SEQ ID NO: 351275 - RNA, 59 nt, hsa
ucuaaaacuacuagaucucaucccauucccauguaaauuaccacagaccgcaguaccgg

SEQ ID NO: 351276 - RNA, 59 nt, hsa
gaagaggaauauaaaugcucuagaguuaacauguaaaauauauacguacugagguuugu

SEQ ID NO: 351277 - RNA, 59 nt, hsa
ccugugcuauuaaauauaucagggcagugcauguaaaucauccugauauauuuaauaua

SEQ ID NO: 351278 - RNA, 59 nt, hsa
aaucugucuagaauccugcuuuacaggaucauguaaaugcucaaagauguaauguaguu

SEQ ID NO: 351279 - RNA, 59 nt, hsa
cacaaaauuucacucucuaaaagcaacagcauguaaacuagaaugaaagaaggaaauua

SEQ ID NO: 351280 - RNA, 59 nt, hsa
gaaagagacgaggggugaucugugagucccauguaaacuuuguacauuggaauauuuau

SEQ ID NO: 351281 - RNA, 59 nt, hsa
ggugacccagcaucugaguuagguuccagcauguaaagagcugggagggcggagaauuc

SEQ ID NO: 351282 - RNA, 59 nt, hsa
aguauguggacucuguuccuuuauguaaacauguaaagaaaauaagucagcgaaaaaaa

SEQ ID NO: 351283 - RNA, 59 nt, hsa
aguccucuggauugagauacuugaccuugcauguaaaaaccuuguagauagcuugagcu

SEQ ID NO: 351284 - RNA, 59 nt, hsa
uuguaauuuaacaauaaauaagccugcuacauguaaaaagaaccaaacucacaauauua

SEQ ID NO: 351285 - RNA, 59 nt, hsa
uuuauguuuugaguuuuggaauuuauugucauguaaauaguugagcuaagcaagccccg

SEQ ID NO: 351286 - RNA, 59 nt, hsa
uuuacugaaauuugagcuaaacauuuuuacauguaaauacuuguauuuaccaaagauuu

SEQ ID NO: 351287 - RNA, 59 nt, hsa
caaaagacuuuuuucaauguuauuuuagccauguaaauaaguguagauagaggaauuaa

SEQ ID NO: 351288 - RNA, 59 nt, hsa
uagaaaguuaagauguaaauguauucucacauguaaauuugaaaguucaggggucuauu

SEQ ID NO: 351289 - RNA, 59 nt, hsa
gugaucucaaauuaggaaaugcauuuaaccauguaaaagaugagugcuaaaguaagcuu

SEQ ID NO: 351290 - RNA, 59 nt, hsa
aauaagcuuuuuccagccaaaccaaacuacauguaaagugaacuguuuccuguauaaag

SEQ ID NO: 351291 - RNA, 59 nt, hsa
aaaaucauuuuuucaaagaaaaauuuguccauguaaagcuuaaauuauaauauugcugc

SEQ ID NO: 351292 - RNA, 59 nt, hsa
auucuucgaguucaaagcacaauuuuaaacauguaaaauggauauauaauuugccaaag

SEQ ID NO: 351293 - RNA, 59 nt, hsa
cuuucugucuguggauucuguaaaauuaucauguaaauguucuaccaauuugcuguaua

SEQ ID NO: 351294 - RNA, 59 nt, hsa
gacuuaauauuauccuuuucuaauagucucauguaaaauaugccgcuauuacaacuuac

SEQ ID NO: 351295 - RNA, 59 nt, hsa
agagucaaucucuuaauuauauuuuucaucauguaaacaaguuucccauuucccuuucu

SEQ ID NO: 351296 - RNA, 59 nt, hsa
ugcaaaccucugagccuggaaccgauugacauguaaaugcaccugcaccguuucugagc

SEQ ID NO: 351297 - RNA, 59 nt, hsa
aucacuuaaugaaccacguguuuugacaucauguaaaccuaagcacguagagaugauuc

SEQ ID NO: 351298 - RNA, 59 nt, hsa
uguuuauauaucacugagguauacuaugccauguaaauagacuauuuuuuauaaucuuu

SEQ ID NO: 351299 - RNA, 59 nt, hsa
cagaagauaagccauguuucuguauuguacauguaaagaaaaauaaaacuguuuaugau

SEQ ID NO: 351300 - RNA, 59 nt, hsa
gaaagggcucccucaucagagacgugcgacauguaaaccaaauuaaacuauggugucca

SEQ ID NO: 351301 - RNA, 59 nt, hsa
aguuuuuuuuauuugaguccaguauaauucauguaaauguuaacaauuagaauaauacu

SEQ ID NO: 351302 - RNA, 59 nt, hsa
auuuugggugccauuaaauagggaaaaaacauguaaaaaauguaaaauggagaccaauu

SEQ ID NO: 351303 - RNA, 59 nt, hsa
aucuaaucuuaaaacauuugaauucuaaacauguaaaaugugacagccugcaauuuugu

SEQ ID NO: 351304 - RNA, 59 nt, hsa
auguuuacauuuacuaaggugugcugggucauguaaaauauuagacacuaauauuuuca

SEQ ID NO: 351305 - RNA, 59 nt, hsa
auuccuucaacagacugcuauauauucaccauguaaacugcagccaccuuuagugauac

SEQ ID NO: 351306 - RNA, 59 nt, hsa
uucacaguucauaaaagaugugaccacuacauguaaaaauagcauucuacuugaucuua

SEQ ID NO: 351307 - RNA, 59 nt, hsa
cauuaaguuuugcauaucuuuuguuaugccauguaaauucccuuuuucguaugauuaaa

SEQ ID NO: 351308 - RNA, 59 nt, hsa
gcaugacauacuuuugcuuucaguaguuucauguaaagaaaaaaacuugaaaauaguaa

SEQ ID NO: 351309 - RNA, 59 nt, hsa
auuuuuuaaaguuaauaauauaaaguggccauguaaaauauuuuauuuuccaggcuaaa

SEQ ID NO: 351310 - RNA, 59 nt, hsa
uaacuuuucuuaugaaaaauacauauuugcauguaaacaaugauuucaaaauacuugaa

SEQ ID NO: 351311 - RNA, 59 nt, hsa
uguuguacggugucuagaauuaaagaauacauguaaacuuucaugguauuuagccuuuc

SEQ ID NO: 351312 - RNA, 59 nt, hsa
uguugggaccuucugagccuucuacuuaucauguaaauguauuggcacagugcuuacau

SEQ ID NO: 351313 - RNA, 59 nt, hsa
ccucacaagcaaaugcuaaggggaacauacauguaaaaagccagcaaacuaucuucaaa

SEQ ID NO: 351314 - RNA, 59 nt, hsa
caaccugggcagaaaaaaaaaaaaaaagacauguaaaauuuuguuauuuccagucugua

SEQ ID NO: 351315 - RNA, 59 nt, hsa
ucauuuuauuuuugacgucacuuuuuggccauguaaacuauuuguggcaauuuuauguu

SEQ ID NO: 351316 - RNA, 59 nt, hsa
gcugcaucccagguguguagcaaaguccacauguaaauuuauagcuuagaauauucuua

SEQ ID NO: 351317 - RNA, 59 nt, hsa
uuuuggcugcagauguuaaauuuugauaccauguaaaccuacccagcuucucagacuug

SEQ ID NO: 351318 - RNA, 59 nt, hsa
aacuguuuaagcaaaaaaugcacugcuuucauguaaaaugauauaaucuucuuuaacaa

SEQ ID NO: 351319 - RNA, 59 nt, hsa
uguucuagguuuaugaauuucaccucuuacauguaaaggguauaagauuuuaauguaau

SEQ ID NO: 351320 - RNA, 59 nt, hsa
acuuuucaacuacuuucucuacagcuuuucauguaaauuagucuugguucugaaacuuc

SEQ ID NO: 351321 - RNA, 59 nt, hsa
gguagccagaugauaaauaugguuaauuucauguaaaacagaaaaaaagagugaaaaag

SEQ ID NO: 351322 - RNA, 59 nt, hsa
ggcagagauuauaucccuaucuucuuuuucauguaaaccacuggucacaaaugaacuga

SEQ ID NO: 351323 - RNA, 59 nt, hsa
auuaaacacaucugcaggacacauuuugccauguaaacuaacauucacugguuccaggg

SEQ ID NO: 351324 - RNA, 59 nt, hsa
auugccaaaaagugaaauaauguguaguucauguaaauaauacauuauauuucuauuuu

SEQ ID NO: 351325 - RNA, 59 nt, hsa
cagaauugaugguuguauaagaacuagcucauguaaaaauaaaauaacauuauuacauu

SEQ ID NO: 351326 - RNA, 59 nt, hsa
aaucagaacccagggcaacaaugccauuucauguaaacauuuucucucucaccauguuu

SEQ ID NO: 351327 - RNA, 59 nt, hsa
aagaacaauagauguugcuuuucccgugucauguaaauuuguugcacuuuuuugggcug

SEQ ID NO: 351328 - RNA, 59 nt, hsa
ucuaugaaaugaguggaccauuaaccuuacauguaaagauuauguuaguaauuaagaaa

SEQ ID NO: 351329 - RNA, 59 nt, hsa
auuuauggucuauauaccaauuuaaauggcauguaaaccugccuguuucuucuccucuu

SEQ ID NO: 351330 - RNA, 59 nt, hsa
guaaaauuagcucuuucaaaucuucuugucauguaaaaugaagcuagucuguuuuaaaa

SEQ ID NO: 351331 - RNA, 59 nt, hsa
acaacccccuauaccuggaagauugucagcauguaaaucaggaacaacuuucuccuuau

SEQ ID NO: 351332 - RNA, 59 nt, hsa
guuguauugaaauaguaacuuaucaaugccauguaaaaauuaauuccauuuucgaagcc

SEQ ID NO: 351333 - RNA, 59 nt, hsa
gagcuugcuuuuguugcuucagcagcacccauguaaauaccuucuugcuuuucuguggg

SEQ ID NO: 351334 - RNA, 59 nt, hsa
gucauguccuuacaggucuuaaaagauaacauguaaauguuuuuaaaaugguaaaaaaa

SEQ ID NO: 351335 - RNA, 59 nt, hsa
cucuggaaauaucuacaacuaauaggacacauguaaauccuugaagacacauccuggaa

SEQ ID NO: 351336 - RNA, 59 nt, hsa
uucgucaccucuuccacagagcacuuuggcauguaaacaagcaagagcacugccucuau

SEQ ID NO: 351337 - RNA, 59 nt, hsa
uucgguagaugccuuuguuagaucuaucacauguaaacgagcuuguaucuccuucccug

SEQ ID NO: 351338 - RNA, 59 nt, hsa
ccuuauaaaucauguaauuuagugccacucauguaaaucaguaaaaucacaaaggucua

SEQ ID NO: 351339 - RNA, 59 nt, hsa
cucugcucaugaaugaacaaagaagcaggcauguaaaauggauccuuguccuaacguca

SEQ ID NO: 351340 - RNA, 59 nt, hsa
gcugagguggcuaaauaccuagccuuuuacauguaaaccugucugcaaaauuagcuuuu

SEQ ID NO: 351341 - RNA, 59 nt, hsa
cccacccccgaaaauguucaauaaugucccauguaaaaccugcuacaaauggcagcuua

SEQ ID NO: 351342 - RNA, 59 nt, hsa
auagaauuuguggaaggagagaggauacacauguaaaauuacaucuggucucuuccuuc

SEQ ID NO: 351343 - RNA, 59 nt, hsa
uaagauucuucucagcaguugcugaaaagcauguaaauaacuacauaauagccugagaa

SEQ ID NO: 351344 - RNA, 59 nt, hsa
uuauauuuuaauaggaaguugacucccagcauguaaaagugauccacgcagccggagug

SEQ ID NO: 351345 - RNA, 59 nt, hsa
agggacuugguguuaaaacaggauuagagcauguaaagguacaucuagauucauauuug

SEQ ID NO: 351346 - RNA, 59 nt, hsa
aauguaucuucaaauucagauuuaauaaacauguaaagauccucuguauauaaaaguug

SEQ ID NO: 351347 - RNA, 59 nt, hsa
augugauaucaaugaagaaauauuuguagcauguaaacgguuauuucuguuucuuaaaa

SEQ ID NO: 351348 - RNA, 59 nt, hsa
uuagguugcuccugaaacugacuguagagcauguaaaaugauuuuacuggauucuguuc

SEQ ID NO: 351349 - RNA, 59 nt, hsa
uuuguuucucauuaaauauuaauauaugacauguaaaaauauuaaaggaacguauuuuu

SEQ ID NO: 351350 - RNA, 59 nt, hsa
ugcaaaaggacucucaggaccaaagcuuucauguaaacugugcaccaagcaggaaauga

SEQ ID NO: 351351 - RNA, 59 nt, hsa
ucuguuuucuuucuaaugagauauuaaaccauguaaagaacauaaauaacaaaucucaa

SEQ ID NO: 351352 - RNA, 59 nt, hsa
agugcugguaauuauaugguuauaugugccauguaaaauauagugauaucaaauauucu

SEQ ID NO: 351353 - RNA, 59 nt, hsa
gugugauguagacaauguuacaaggucugcauguaaauggguugccuuauuauggagaa

SEQ ID NO: 351354 - RNA, 59 nt, hsa
agguauuaugaugcaucaacuaguucuuccauguaaaauaauuuuagugcaauaugaag

SEQ ID NO: 351355 - RNA, 59 nt, hsa
uugcugcaugccaagaaguauguugaauucauguaaaugaagugauguguaggcauugu

SEQ ID NO: 351356 - RNA, 59 nt, hsa
auagcugcauuaaaaaaauacaauauggacauguaaaaagacaaaaaccaaguuaucug

SEQ ID NO: 351357 - RNA, 59 nt, hsa
aacauuuuuugaaaagcuuuuauuuucaacauguaaaaagugagaaauuacuucaaaau

SEQ ID NO: 351358 - RNA, 59 nt, hsa
cuuacacacacugccagagauacucuaggcauguaaagcacaaacauacauauaaaauc

SEQ ID NO: 351359 - RNA, 59 nt, hsa
ggguggugagguuuugaaagacagauuuccauguaaaugugcacaagccaggcauggcu

SEQ ID NO: 351360 - RNA, 59 nt, hsa
uaaacacaaaauugguuucaaaauguuuucauguaaaaauaaauuaacuuuucuguaau

SEQ ID NO: 351361 - RNA, 59 nt, hsa
aucuggccaaacaacugugguuaaaaacacauguaaaaugcuuuuuaacagcugauacu

SEQ ID NO: 351362 - RNA, 59 nt, hsa
cauuuuggaauauuugagaauguaugauacauguaaaauuaaaaaaacuauuagaacug

SEQ ID NO: 351363 - RNA, 59 nt, hsa
gcaaagaucuguguguguuggggagcugucauguaaaucaaagccaagguugucaaaga

SEQ ID NO: 351364 - RNA, 59 nt, hsa
cguguuagcccauuugaggucuggggaaucauguaaaggguacccagaccucacuuuua

SEQ ID NO: 351365 - RNA, 59 nt, hsa
agcaugucccugccucccaugaaucuuaccauguaaauccaaaucucugcaauccugug

SEQ ID NO: 351366 - RNA, 50 nt, hsa
ugaagaaauguagugugugacauguaaaaacuuucauccugguuuccacu

SEQ ID NO: 351367 - RNA, 59 nt, hsa
gcaguaauuuaggggagacagaggaguuucauguaaagagcaugcaguuuggagucaga

SEQ ID NO: 351368 - RNA, 59 nt, hsa
guguauauauacacacauacauaugccaacauguaaauaaccucauguuuauuccuaau

SEQ ID NO: 351369 - RNA, 59 nt, hsa
uucuguguccuucuacuccagcaucgucucauguaaaauaagaaagcccuaaaauacua

SEQ ID NO: 351370 - RNA, 59 nt, hsa
aagugaccuaagaacacuuuaaaaagcaacauguaaaugauuggaaauuaauauaguac

SEQ ID NO: 351371 - RNA, 59 nt, hsa
guucucucuaugguaaagauauuauucaccauguaaaacaaaaaacaauauuuauugua

SEQ ID NO: 351372 - RNA, 59 nt, hsa
uauuugccuaauggcaacucauugcucuccauguaaauguaaucaacagaugaagagaa

SEQ ID NO: 351373 - RNA, 59 nt, hsa
uggaaauagugaaaaaauguggugugugacauguaaaaaugcucaaccugguuuccaaa

SEQ ID NO: 351374 - RNA, 59 nt, hsa
acccuggcucuucacccagguuucacacacauguaaaugaaacacuauguuaguaucua

SEQ ID NO: 351375 - RNA, 59 nt, hsa
agguucgauacagcguauuuauugcuugucauguaaauuaaaaaccuuguauuuaacuc

SEQ ID NO: 351376 - RNA, 59 nt, hsa
aucuauugcaccuaaggaauacuacacagcauguaaaagucaaucugcaugugcuucuu

SEQ ID NO: 351377 - RNA, 59 nt, hsa
ugguucuugagcucucugacaucaagaugcauguaaagucgauuguauguuuuggaagg

SEQ ID NO: 351378 - RNA, 59 nt, hsa
aacgauuaagucuaccaaagaacacacugcauguaaaagauguauuacaaucucaaagc

SEQ ID NO: 351379 - RNA, 59 nt, hsa
gagccaggcaacuucaguccugggagacccauguaaauaccagacugcagguuggaccc

SEQ ID NO: 351380 - RNA, 59 nt, hsa
auuuguaccgacagaaauagacauuucaucauguaaaauuccuguuauucuggaaaaac

SEQ ID NO: 351381 - RNA, 59 nt, hsa
uucggauucacuucuuguauauuuugcugcauguaaaguaaaucauuuuguauuuggag

SEQ ID NO: 351382 - RNA, 59 nt, hsa
gaggguuuccaggaguaguacuaugacaucauguaaacacauucaguuuucauguugga

SEQ ID NO: 351383 - RNA, 59 nt, hsa
ucuuguuuuuaaucuugugcaugauaccccauguaaaauccaccuugugcaagauuucu

SEQ ID NO: 351384 - RNA, 59 nt, hsa
guguguguauauaagcucccacauagauacauguaaaacauauucacacccaugcacgc

SEQ ID NO: 351385 - RNA, 59 nt, hsa
cucauagggagauguacuguauuauauaacauguaaaguugauuuucuugugacaagag

SEQ ID NO: 351386 - RNA, 59 nt, hsa
aacuauuuuuuuaaaugucaaacuucuaucauguaaauggacuuauagagaacaaaaag

SEQ ID NO: 351387 - RNA, 59 nt, hsa
uaccucgauagcauaagagagaccuaagacauguaaaauacguauauugcaguaucauc

SEQ ID NO: 351388 - RNA, 59 nt, hsa
gagauuaacugggauuaagugagaugacgcauguaaagaugcuguguaaacuguaauuc

SEQ ID NO: 351389 - RNA, 59 nt, hsa
aauacauauuauuuaccccacuguaacaucauguaaacuaaguauguuuuuaaacaauu

SEQ ID NO: 351390 - RNA, 59 nt, hsa
gggauugauuaaugucccgcuccugaauacauguaaaauuuguacaaaaauaucuucua

SEQ ID NO: 351391 - RNA, 59 nt, hsa
ugaugggccaggguguaggauucauucuccauguaaaguuuccuuucauccugccuagc

SEQ ID NO: 351392 - RNA, 59 nt, hsa
caucuuuuucuugcuucuaaaacauauuucauguaaacauuguacauuuauuauuguaa

SEQ ID NO: 351393 - RNA, 59 nt, hsa
guuauuaguaauuuuuucuuuugcauuaccauguaaaauuuagacauuugaauuuugua

SEQ ID NO: 351394 - RNA, 59 nt, hsa
uuuuauaaacucuuggacuauguauuugacauguaaaauauguacaguauuaacgucaa

SEQ ID NO: 351395 - RNA, 59 nt, hsa
gauccuuuuagauuaaaaauaaaaugucgcauguaaaggcugaagucgcguuuuaucag

SEQ ID NO: 351396 - RNA, 59 nt, hsa
uuugccacucaucuguguuuuacuugagacauguaaauaugauagggaaggaacugaau

SEQ ID NO: 351397 - RNA, 59 nt, hsa
ucacauguucuguguucauuaucccuacacauguaaauuaauuauuuuaucaauacuag

SEQ ID NO: 351398 - RNA, 59 nt, hsa
uuuuaggaugucaucauuuugaugugaaucauguaaauguugauaauaugcuguuuauu

SEQ ID NO: 351399 - RNA, 59 nt, hsa
cacagugcuguaauuuuguauguagcaaucauguaaauacauguauggauuuuauaaua

SEQ ID NO: 351400 - RNA, 59 nt, hsa
gucugugugccuguaucaacaugugacuucauguaaaguuucuuuguguucacaguucu

SEQ ID NO: 351401 - RNA, 59 nt, hsa
agcucuugcauugcauagaugaaccucagcauguaaagaacuauuuuuuuaaagaagug

SEQ ID NO: 351402 - RNA, 59 nt, hsa
agggggcaagguggaaugcagauaacucacauguaaaaggaacuuggguagguaaauaa

SEQ ID NO: 351403 - RNA, 59 nt, hsa
guggugcuagccaggaagaagccaguaaacauguaaauauagugcaacccagucgggcu

SEQ ID NO: 351404 - RNA, 59 nt, hsa
cuucauaaggaucaagguucaggccacuacauguaaaaacuaugcaaguguuuuuacaa

SEQ ID NO: 351405 - RNA, 59 nt, hsa
ugaaaauaguuuaaagugcuuucuuugcccauguaaaugagaacucaacugcuguuuac

SEQ ID NO: 351406 - RNA, 59 nt, hsa
ccauguuggugcccuucagaguagagaaccauguaaacauuaggaaugaacagaggccu

SEQ ID NO: 351407 - RNA, 59 nt, hsa
ccauuuaguaaaauguagcuggcccaggacauguaaaaaaaaaaaaaaaacaacaacaa

SEQ ID NO: 351408 - RNA, 59 nt, hsa
ucuauagcuauuuacuuguaacuguacuacauguaaacugauuuuuuguucugauuuuu

SEQ ID NO: 351409 - RNA, 59 nt, hsa
uucauuccuuuuaucuacauguaauuggacauguaaacuuguuaaaaaucaaaaucuua

SEQ ID NO: 351410 - RNA, 59 nt, hsa
gccacuguauguuguacaaacguuggcgacauguaaaauaaaagucauaaaaugcuucu

SEQ ID NO: 351411 - RNA, 59 nt, hsa
aucuuuuuuaauucaguacaacccauaaucauguaaaugcucauuuucuuuaggacaua

SEQ ID NO: 351412 - RNA, 59 nt, hsa
guaauacgaauuguuucacaaacagaaaacauguaaagcaguauuaaaauuuggccaaa

SEQ ID NO: 351413 - RNA, 59 nt, hsa
uaaauguuuguugaaugaaugauuaagugcauguaaagcauuaagcauagcgccuggca

SEQ ID NO: 351414 - RNA, 59 nt, hsa
uguagcaguguacccacgcuggguauuaccauguaaauaaucugugagugaaaguugcc

SEQ ID NO: 351415 - RNA, 59 nt, hsa
aagaacucuuaggaacauugccuuuuggacauguaaaauauuuaggauuugaccacaca

SEQ ID NO: 351416 - RNA, 59 nt, hsa
acaccagcugcuaucaagcaagcuuauaucauguaaauuauaugaauuaggagauguuu

SEQ ID NO: 351417 - RNA, 59 nt, hsa
cagagaauucacugacguguggcuuaauacauguaaaucuagaccucugacaucauggu

SEQ ID NO: 351418 - RNA, 59 nt, hsa
uuccuugaauuaugcaaugcaacauuuuacauguaaauagcacuggucauauacugaug

SEQ ID NO: 351419 - RNA, 59 nt, hsa
cacguguacaccacaaacgagcucccagacauguaaacacacgucucccacacgugagc

SEQ ID NO: 351420 - RNA, 59 nt, hsa
agcuuagcuguuuauugucuuuaaaauaacauguaaacuucaauguucuaucuggaagc

SEQ ID NO: 351421 - RNA, 59 nt, hsa
uuauguucaguguguuuggaaguguauagcauguaaauuacuucauauaugauuuaaag

SEQ ID NO: 351422 - RNA, 59 nt, hsa
ugcuuugcuuaugcaugugugugcacaugcauguaaaccagggaccuucagcucacggc

SEQ ID NO: 351423 - RNA, 59 nt, hsa
guucaucucuguggucuguguuguccugacauguaaaaagcauaucguuuauugagguu

SEQ ID NO: 351424 - RNA, 59 nt, hsa
augugaccuuucguaaauuugggcuggaacauguaaaagggugaaaguuagucguuuuu

SEQ ID NO: 351425 - RNA, 59 nt, hsa
aagugauauaauauccuguacuugucacucauguaaaacuaauguaucaaaauuagcau

SEQ ID NO: 351426 - RNA, 59 nt, hsa
cauuacacaauguccuuaauaaauaggcccauguaaauuuuaauuacaauuaauaaaug

SEQ ID NO: 351427 - RNA, 59 nt, hsa
gaugucuuucugguuuuaacgcaugcaggcauguaaauauuugucuggagucacaguau

SEQ ID NO: 351428 - RNA, 59 nt, hsa
uagucugucccaaauaaaauaaauccuugcauguaaaucauucaaggauuauaguaaua

SEQ ID NO: 351429 - RNA, 59 nt, hsa
aaaaucagaucaucaacaguauuucgaagcauguaaagguguuuaagacuuccgcugcu

SEQ ID NO: 351430 - RNA, 59 nt, hsa
guuucaggagacuuuguauuuagaauauucauguaaaacuugugaacaagcuuucauuu

SEQ ID NO: 351431 - RNA, 59 nt, hsa
ccuuuucucagaaggacucuuuauauuuccauguaaaucuagaucuuuggagcaauuaa

SEQ ID NO: 351432 - RNA, 59 nt, hsa
aaggcuacagaugugcugacaaggcacuucauguaaagugucagaaggagcuacaaaac

SEQ ID NO: 351433 - RNA, 59 nt, hsa
cauaucuuaauauauuucuaaauguuuggcauguaaauguaaacucagcaucaaaauau

SEQ ID NO: 351434 - RNA, 59 nt, hsa
cuuuaaaaguaaucuuauguccuuuccuacauguaaaauauuuuguuaaucuaugccau

SEQ ID NO: 351435 - RNA, 59 nt, hsa
aauuagugaauguaagauacuuuagaaagcauguaaaguacuagaaacaaugagguggc

SEQ ID NO: 351436 - RNA, 59 nt, hsa
acaaggcagguggaggggaggccaguguacauguaaaugcccacagcccagcauugggu

SEQ ID NO: 351437 - RNA, 59 nt, hsa
aauuuucauugaacuuaaagagugaaaaccauguaaacuauugaaacuauuguaaucca

SEQ ID NO: 351438 - RNA, 59 nt, hsa
ggaagcauuucacauccaaacgagaaaaucauguaaacaugugucuuuucuguagagca

SEQ ID NO: 351439 - RNA, 59 nt, hsa
gucuuauauuaugagauacuugaaugcugcauguaaagccuuuaaagcaaaauccucag

SEQ ID NO: 351440 - RNA, 59 nt, hsa
uuuuucuuaaucuuuaagaugucaguauucauguaaauaaacaauagauccagcuuuau

SEQ ID NO: 351441 - RNA, 59 nt, hsa
gcuucaacaguguaaagagauaaauuauucauguaaaaguauuucaaguagugaugauu

SEQ ID NO: 351442 - RNA, 59 nt, hsa
cuggaugugaagaagguuuggguaaacugcauguaaaggcuacaaaucacaaucugauu

SEQ ID NO: 351443 - RNA, 59 nt, hsa
ugacgucuuuuaauaauacuggcccuaaacauguaaauaaucuuguaggugagacuuuu

SEQ ID NO: 351444 - RNA, 59 nt, hsa
ucagcagacaaaaauaagucacucuuacgcauguaaaaauauucuuucacucauaauaa

SEQ ID NO: 351445 - RNA, 59 nt, hsa
uguagucuaauauauacacauuuguuuaacauguaaacaaaaguguuaaauucacauau

SEQ ID NO: 351446 - RNA, 59 nt, hsa
accaguggucucacauggugcuacgccugcauguaaacacgccugcaaacgcugccugc

SEQ ID NO: 351447 - RNA, 59 nt, hsa
ugaugcugacuggcguuagcugauuaacccauguaaauaggcacuuaaauagaagcagg

SEQ ID NO: 351448 - RNA, 59 nt, hsa
gcugguagaauuucaauggaagcauaauccauguaaaauauauuuuaguugauauuuug

SEQ ID NO: 351449 - RNA, 59 nt, hsa
ucauuuuguauuuacuuugcaguaaguaucauguaaauaugcaaauguugaauguaaua

SEQ ID NO: 351450 - RNA, 59 nt, hsa
auaauauguacuuuggguuuuuaacaccgcauguaaagucaaaauaaaauauacaaauc

SEQ ID NO: 351451 - RNA, 59 nt, hsa
agaucaccaagggcucauguuggugacaucauguaaaauuuuccuggguagaagggaaa

SEQ ID NO: 351452 - RNA, 59 nt, hsa
cacagcuaucauagaaaagaaacuugccucauguaaacuggauugagaaauucucagug

SEQ ID NO: 351453 - RNA, 59 nt, hsa
cuuggcaaaauuggauuucuucaaaaauacauguaaaggucuguuguugaauuguacuc

SEQ ID NO: 351454 - RNA, 59 nt, hsa
aaucaugggcugacugagacaauucuguccauguaaagauccucuggaaaaagacuccg

SEQ ID NO: 351455 - RNA, 59 nt, hsa
ugggcaauggcacuacauguaaccuucaucauguaaagcaaucgcaaagcaagggggaa

SEQ ID NO: 351456 - RNA, 59 nt, hsa
cuuaucucaguuaugaguauaauacauuacauguaaauuaaguguguguauacuguaau

SEQ ID NO: 351457 - RNA, 59 nt, hsa
cauguauaccugagaauuugaaaucuucacauguaaauagauauuacuucuagaggagc

SEQ ID NO: 351458 - RNA, 59 nt, hsa
acuuaguccauccgacaccugaaucauuccauguaaaacagagcucuaagaugauccuu

SEQ ID NO: 351459 - RNA, 59 nt, hsa
uuaagugauuaucuuuucuucuguuaagucauguaaauucauaaauccuuuugcacuga

SEQ ID NO: 351460 - RNA, 59 nt, hsa
gugauuaguaugcuaugcuauggaauauacauguaaaaauguuuccuuuuaguuguuga

SEQ ID NO: 351461 - RNA, 59 nt, hsa
cuaacaggagugcccauuggcagauuacacauguaaauaugaccucagacaaaaaggaa

SEQ ID NO: 351462 - RNA, 59 nt, hsa
guguuuguguuucuccucccccuuacuugcauguaaaucacaaaaacugugugacuuac

SEQ ID NO: 351463 - RNA, 59 nt, hsa
agggauuguguuguucuuguguugguucccauguaaagaagcagcagagaaaugcgaug

SEQ ID NO: 351464 - RNA, 59 nt, hsa
ggacuggauauuaaauaaaaauuuauugacauguaaagauggcaauuauuaacaacaac

SEQ ID NO: 351465 - RNA, 58 nt, hsa
gcucuuuguguuugaauaaaguaguaaugcauguaaacauauacguguuuagagcucu

SEQ ID NO: 351466 - RNA, 59 nt, hsa
cugaaaagaacuuucaacacagcauacuucauguaaaagaaauuguuuguuugcuuucu

SEQ ID NO: 351467 - RNA, 59 nt, hsa
cuucuguucaauuucauagacuccuuuaccauguaaaauuugucugauauuugauuugu

SEQ ID NO: 351468 - RNA, 59 nt, hsa
cuggagauugugcucugcagcgagccccccauguaaaguggggacgggggcugcuucuc

SEQ ID NO: 351469 - RNA, 59 nt, hsa
caaaaggaaaagggagugggaauugcuaucauguaaaauaucaaaguuaaaauacuaag

SEQ ID NO: 351470 - RNA, 59 nt, hsa
ugaaaaguaacugauuuguauucugugagcauguaaaagcggaaaguuagugcuuguuc

SEQ ID NO: 351471 - RNA, 59 nt, hsa
aaagaaagugucuccuuuccuggaaagcacauguaaaaguuaagggccugaaucucuuc

SEQ ID NO: 351472 - RNA, 59 nt, hsa
cucuaauacagaauaagcaauauggugugcauguaaaccugacacagacaaaauaaaaa

SEQ ID NO: 351473 - RNA, 59 nt, hsa
uuugcacgcuuggacuucaguucugcuagcauguaaagagugguggacuuuaaaaccgu

SEQ ID NO: 351474 - RNA, 59 nt, hsa
cugcucaggcucucccacuucguggcauccauguaaaguagguggcagggcagagaugu

SEQ ID NO: 351475 - RNA, 59 nt, hsa
gagcucuguuuaaauaaauauuguccuuucauguaaauuauucuggauguagauugagc

SEQ ID NO: 351476 - RNA, 59 nt, hsa
acgcaaagaaucuccugguagagaagcgacauguaaaaaacugguggaaaaagguuuug

SEQ ID NO: 351477 - RNA, 59 nt, hsa
ucuuaaugagagugucugucuaugccaaucauguaaaaugacguuucuugaaaaagauu

SEQ ID NO: 351478 - RNA, 59 nt, hsa
aagaagcacaaaagaauauuauuucauaacauguaaaaauuauauaaaacguaaauuuc

SEQ ID NO: 351479 - RNA, 59 nt, hsa
ugguggaguaccgcgcagacauuaaaagucauguaaaagaacaucugacugaaagaaaa

SEQ ID NO: 351480 - RNA, 59 nt, hsa
agaugguugugaggaguaaaugugaucagcauguaaagugucuggcguguaguaggcuc

SEQ ID NO: 351481 - RNA, 59 nt, hsa
caaaacuaacucugggauuaaaggggaagcauguaaacagcuaacuguuuuuguuaaag

SEQ ID NO: 351482 - RNA, 59 nt, hsa
uauacuaaaccucacaaaguagaggaauccauguaaauugcaaauaaaccacuuucuaa

SEQ ID NO: 351483 - RNA, 59 nt, hsa
gaucucuuguacgcagauguaaucauucacauguaaaaauaaccccaccuccccacccc

SEQ ID NO: 351484 - RNA, 59 nt, hsa
cacucucucccuguggcuggucugguucucauguaaacccacuccuugcuuugucuccc

SEQ ID NO: 351485 - RNA, 59 nt, hsa
uacaggaugguuacugaggaccaaagauacauguaaaauagggcuuuguaaacuccaca

SEQ ID NO: 351486 - RNA, 59 nt, hsa
aagggacucauuuuucuuugcuuucagcccauguaaauaaauaauacaguauuaacauu

SEQ ID NO: 351487 - RNA, 59 nt, hsa
cuuuuaauguauauguuuguuauaauguccauguaaacaugcccuauguuugugccuuu

SEQ ID NO: 351488 - RNA, 59 nt, hsa
gggcccccucuccguagguguacagaggacauguaaauacacagcgguggugcccaggc

SEQ ID NO: 351489 - RNA, 59 nt, hsa
auggggauucugcucucuuuucuuauuuacauguaaauaauacauuguucuaagucuuu

SEQ ID NO: 351490 - RNA, 59 nt, hsa
uuuauguuuuaaaauaggauuuaaaaacucauguaaagguuuuuuuuuuuucuuuuuuu

SEQ ID NO: 351491 - RNA, 59 nt, hsa
auuuuaugguuuugauuucagauugcaaacauguaaaaccugcauagcagcgaguucuc

SEQ ID NO: 351492 - RNA, 59 nt, hsa
cuguacuuggcaugcgcaauaaagcagcacauguaaaaaaaaaauacacagugcaagga

SEQ ID NO: 351493 - RNA, 59 nt, hsa
gaagccauuaaaauuuuacuaaaauugugcauguaaauuaauugucagcauuccauguc

SEQ ID NO: 351494 - RNA, 59 nt, hsa
aguuccccugacugaagagagccuguggccauguaaaaagagaauuaaacucuuguugc

SEQ ID NO: 351495 - RNA, 59 nt, hsa
uaaggggaucuaaaaaaauguuuuuagaacauguaaaauguuuaauggugaaaguugga

SEQ ID NO: 351496 - RNA, 59 nt, hsa
uuggcuguuaggaauaauguugcucugaacauguaaauaaagaucuuuguguucacaua

SEQ ID NO: 351497 - RNA, 59 nt, hsa
aaugcauguuaacaguuggucuguauuugcauguaaaagugggccaccagagaacccuu

SEQ ID NO: 351498 - RNA, 59 nt, hsa
uuguucguugauccucaucuuauuccugacauguaaaaaucaauuuuacguagagucaa

SEQ ID NO: 351499 - RNA, 59 nt, hsa
uccuguuacaaauccugcacuguauuaaacauguaaauuaauuguuugucugauuagcc

SEQ ID NO: 351500 - RNA, 59 nt, hsa
uccuauauuuguguguauauguauguguucauguaaauuugguauaguaauuuuuuauu

SEQ ID NO: 351501 - RNA, 59 nt, hsa
uaaggaauuuauuucucccuuuacuacagcauguaaauucagcucaaauugcaugaucu

SEQ ID NO: 351502 - RNA, 59 nt, hsa
ggauuaauugaccccugucuauggaauuacauguaaaacauuaucuugucacuguaguu

SEQ ID NO: 351503 - RNA, 59 nt, hsa
gcauacaacuuaaggaauuuuuuccuccucauguaaauuuuacuuuucaugcuuauaua

SEQ ID NO: 351504 - RNA, 59 nt, hsa
cauucagcuugcuuaauugcuuucauagacauguaaagacacaccagaaggaaacccua

SEQ ID NO: 351505 - RNA, 59 nt, hsa
ccaaaguauaaaaauuucuggaauacugacauguaaagacuacaguuaauucugacacu

SEQ ID NO: 351506 - RNA, 59 nt, hsa
agaccacccaaccucacccuccugacccccauguaaauauuguucugcugucugggacu

SEQ ID NO: 351507 - RNA, 59 nt, hsa
gauucuuggaaguauuauguaaguuauuacauguaaaagcucuuagaauggugccuuga

SEQ ID NO: 351508 - RNA, 59 nt, hsa
uuucuuaagccccagaaagccaaaaagaacauguaaacucuucaccucaacuagcuaca

SEQ ID NO: 351509 - RNA, 59 nt, hsa
cugcuaucauggaaauuaaauguuugguacauguaaagucuuugaaaguguaacuggaa

SEQ ID NO: 351510 - RNA, 59 nt, hsa
aagucagacaauguuuuaaauugaaugaucauguaaauauuacacaucaaaccaaugac

SEQ ID NO: 351511 - RNA, 59 nt, hsa
ucagaaguuaauagaagaaugaaauaaugcauguaaauugcucagcagcgugccuagca

SEQ ID NO: 351512 - RNA, 59 nt, hsa
gcuggacacuuaugugcaaggauucccuucauguaaauucuuggucucacaugacacuu

SEQ ID NO: 351513 - RNA, 59 nt, hsa
ccuuugcuguuuccucaagccuaacugaacauguaaaaauucacaggagaaaguaacac

SEQ ID NO: 351514 - RNA, 59 nt, hsa
uggauggaugaauagauagaugguguuugcauguaaauugcagagaaaacaaaaccaaa

SEQ ID NO: 351515 - RNA, 59 nt, hsa
aaaaacucacacuggagagaaacucuguacauguaaacaaugugggaaagccuucagug

SEQ ID NO: 351516 - RNA, 59 nt, hsa
cagguuauauuuaauaagaaagaaaguaucauguaaacagcccaguaauaaaauuuuac

SEQ ID NO: 351517 - RNA, 59 nt, hsa
cauaugagaaccuuuguauaaaauauuggcauguaaacagcacagacaccguaacacac

SEQ ID NO: 351518 - RNA, 59 nt, hsa
aguuuccuuuuauucuaacgggaauauuucauguaaauuucauaaauucuuuggacaaa

SEQ ID NO: 351519 - RNA, 59 nt, hsa
cuuuaggguaacaagauuucuuuaaaaaacauguaaacauggaauagucuguugaauuu

SEQ ID NO: 351520 - RNA, 59 nt, hsa
guuuuuacuuagaucaugaguugaacaaacauguaaaagaagagauacuuaacaauaau

SEQ ID NO: 351521 - RNA, 59 nt, hsa
aaaacguaggaaaccauucuuuauacuugcauguaaacaucuuccagcaacaaucauuu

SEQ ID NO: 351522 - RNA, 59 nt, hsa
agauaugagaggccauaagcaagagacaucauguaaacauauguggcagagggucuauc

SEQ ID NO: 351523 - RNA, 59 nt, hsa
aacgcucugaacccccuauaaaaaaugugcauguaaauauauacucucaacauuuaaaa

SEQ ID NO: 351524 - RNA, 59 nt, hsa
ucaaauagaagauuuacuauuauuccagccauguaaaaauaugugcacauauggaugua

SEQ ID NO: 351525 - RNA, 59 nt, hsa
aauauuuaucuagagaauacaaagacccacauguaaaugauagguauuaucuccaugua

SEQ ID NO: 351526 - RNA, 59 nt, hsa
uacacuacugagaauagcaugguuuuggccauguaaaccaauuuucaaaguucuaauga

SEQ ID NO: 351527 - RNA, 59 nt, hsa
ugcgugucuccaugugcguccauauuuaacauguaaaaaugucccccccgcuccguccc

SEQ ID NO: 351528 - RNA, 59 nt, hsa
guaugucauuuuuauuuccauuuuauaaacauguaaauaauagugauaacuuguuaaua

SEQ ID NO: 351529 - RNA, 59 nt, hsa
ggaaaagcguuuuugaagcucucauuguucauguaaaaaucauacacguggcauguugc

SEQ ID NO: 351530 - RNA, 59 nt, hsa
cuagggcucccguccugcuuuggcagugccauguaaauccccacugggaccaacccugg

SEQ ID NO: 351531 - RNA, 59 nt, hsa
aaauguuuuccuuaugacacugguuucgacauguaaaauguguuugaaaaccugcuuug

SEQ ID NO: 351532 - RNA, 59 nt, hsa
uuacugugaguguggagauguuaucccaccauguaaagucgccugcgcaggggagggcu

SEQ ID NO: 351533 - RNA, 59 nt, hsa
aaaauaagaaaaugcuaaauauuuauggccauguaaacguucugacaacugguggcaga

SEQ ID NO: 351534 - RNA, 59 nt, hsa
uaacauaucugccaugaggaacauaaauucauguaaagccauuuucucuuaaacaaaac

SEQ ID NO: 351535 - RNA, 59 nt, hsa
accugccgcaacagaaauuguuuuuauuucauguaaaauaagggaucaauuucaaaccc

SEQ ID NO: 351536 - RNA, 59 nt, hsa
ucaauccuauuggggaccuuuuaaagaaucauguaaaacaggcuuacaaauuuucuuuu

SEQ ID NO: 351537 - RNA, 59 nt, hsa
uucuugaagaaguauaauuguaaauaagccauguaaaaugccuuuuuaaaauuuaauuu

SEQ ID NO: 351538 - RNA, 59 nt, hsa
uuuaggaaaucccugucuuuccauuuuuucauguaaauuuugcacaguuacuuguucau

SEQ ID NO: 351539 - RNA, 59 nt, hsa
ccaucucaagagcucgcccauguuacgagcauguaaaggacugacuuccuaguaacugu

SEQ ID NO: 351540 - RNA, 59 nt, hsa
agaaagucauucgcguggcucgggacgcucauguaaauuugguuuuggugcucaagggu

SEQ ID NO: 351541 - RNA, 59 nt, hsa
ggcucccuagaaucuggagagcuuaccaacauguaaagcuguucauuuuuccaccgugg

SEQ ID NO: 351542 - RNA, 59 nt, hsa
uauuaugugcaucuguuauuuuuccaauacauguaaacaguugcagcaugaugcuuugu

SEQ ID NO: 351543 - RNA, 59 nt, hsa
uugcagccguuuuacaaauaucuguggaacauguaaauacugucaaauggaaaauaaaa

SEQ ID NO: 351544 - RNA, 59 nt, hsa
ugucuucaauuuguauaaaaugguguuuucauguaaauaaauacauucuuggaggagca

SEQ ID NO: 351545 - RNA, 59 nt, hsa
guuuaauaugauucacuuuucuccaaagacauguaaaaggcuguuacgaaagcuuggcu

SEQ ID NO: 351546 - RNA, 59 nt, hsa
guugcaacucauuagcuagugaagauauucauguaaauauauuuuaggauuguaauuaa

SEQ ID NO: 351547 - RNA, 59 nt, hsa
auaaaaauaaauauuugguauuuuguggucauguaaaacuucuuuuuguaugaaaauug

SEQ ID NO: 351548 - RNA, 59 nt, hsa
agaccuaagcuaauuauuuaaaauaaauacauguaaaggccacugccacauucucagca

SEQ ID NO: 351549 - RNA, 59 nt, hsa
gacagugaacucugucugccugaacgagccauguaaauuaaguucuagagcagcucucu

SEQ ID NO: 351550 - RNA, 59 nt, hsa
uugggaaagaaaacgaaaauguuauugcacauguaaaauaugaaaacuuaacucugcug

SEQ ID NO: 351551 - RNA, 59 nt, hsa
uaggucuucagcauaagcugaaauauaugcauguaaaaacuuugacaucuuuuuuuuua

SEQ ID NO: 351552 - RNA, 59 nt, hsa
caccaaaccuacuaggucuucucauuacccauguaaaccacauguuagauaaauuuuug

SEQ ID NO: 351553 - RNA, 59 nt, hsa
gccaccaggguucuuuugaaauaguaccacauguaaaagggaauuuggcuuucacuuca

SEQ ID NO: 351554 - RNA, 59 nt, hsa
guguaugguguguauuccauaucuauucccauguaaauccaaauacuuauucuuuauuu

SEQ ID NO: 351555 - RNA, 59 nt, hsa
guaagacaauagcauuucuagaacaauuacauguaaacaaauauuuucuuuauuuguag

SEQ ID NO: 351556 - RNA, 59 nt, hsa
gcagaaucacaugugcacacacacauacacauguaaacauuggaaugcauaaguuuuaa

SEQ ID NO: 351557 - RNA, 59 nt, hsa
auauggccuacagagaauagaaacaaauccauguaaacaauuuugaaggaggcauggga

SEQ ID NO: 351558 - RNA, 59 nt, hsa
cuuccaaaucuaacuuugcacaaguaacccauguaaaaaaaaauguacauuuuucaaaa

SEQ ID NO: 351559 - RNA, 59 nt, hsa
gcuauuuaaucuugggaacugaagccagucauguaaacauacuauaccaaucuaguccc

SEQ ID NO: 351560 - RNA, 59 nt, hsa
uuggagagucccacccacuaagcacugugcauguaaacagguuccuuugcucagaugaa

SEQ ID NO: 351561 - RNA, 59 nt, hsa
guauggaccuacauacacacaaaugaaugcauguaaaaucuggugauacugaauaaagu

SEQ ID NO: 351562 - RNA, 59 nt, hsa
gugcacauaugaaaauggcacaucauauacauguaaaaucaggcaguauacauuuauua

SEQ ID NO: 351563 - RNA, 59 nt, hsa
aauuguacaaaaaaguuauaagaaaacuacauguaaaaucuugauagcuaaauaacuug

SEQ ID NO: 351564 - RNA, 59 nt, hsa
cacaauuauuuagcuuuuuguaaguucaacauguaaauuuuaaagacauaaauauagag

SEQ ID NO: 351565 - RNA, 59 nt, hsa
cuuaggacaaaucugcaaagcauguuuugcauguaaaagccuaggucuauuuggauuau

SEQ ID NO: 351566 - RNA, 59 nt, hsa
guuuuagcauuuguauaaagaaacugguccauguaaauacuuuccauguuuuuucuuca

SEQ ID NO: 351567 - RNA, 59 nt, hsa
uuguaauugacaucuaguagacuucugcacauguaaaauugaauucaaauaaaaucaua

SEQ ID NO: 351568 - RNA, 59 nt, hsa
aaacuguaguacccuuauuccuuuugugucauguaaauuguaacucaggggggcagaag

SEQ ID NO: 351569 - RNA, 59 nt, hsa
gaauaaucuaguagaaaaauaacugguugcauguaaaauuccuuccagccagaaagaaa

SEQ ID NO: 351570 - RNA, 59 nt, hsa; identical to SEQ ID NO: 351560

SEQ ID NO: 351571 - RNA, 59 nt, hsa
acagcaaaagaggcuuuucuucuuaauuacauguaaacaaagacaugggauuuucugac

SEQ ID NO: 351572 - RNA, 65 nt, hsa
ggaauaaguauaauuaucauccagccucccagaagaauacucaacaacccuuggccaagcaugaa

SEQ ID NO: 351573 - RNA, 65 nt, hsa
aggacugugggacccagauuugaagacccaauaaaaauacucaacuuuuuaaaaaagauagugaa

SEQ ID NO: 351574 - RNA, 65 nt, hsa
gguauauucuuguguuaacugcccauuggccugaaaauacucauuguaagccugaaaaaaaaaau

SEQ ID NO: 351575 - RNA, 65 nt, hsa
auuauacaguggcagauuucuuuagcugccacaguaauacucauuccuugugugugucuuggagu

SEQ ID NO: 351576 - RNA, 65 nt, hsa
ccauuaaauuuucaaaauguaauuuaaaaggauuaaauacucauuuaauaauuuaaaauaauuau

SEQ ID NO: 351577 - RNA, 65 nt, hsa
ugaaacaggguuuuucaaguuguauaauucucugaaauacucagcuuuugucauauggguaaaaa

SEQ ID NO: 351578 - RNA, 65 nt, hsa
aguuuaauuuucucugggggcaugaucucacaaagaauacucaagucuuuuucuucuuauggaau

SEQ ID NO: 351579 - RNA, 65 nt, hsa
cugucuuuuacagcucuuugcauuuuguagaccuuaauacucagguuaaauauucauugcauuua

SEQ ID NO: 351580 - RNA, 65 nt, hsa
cagccagaacaugagagggagaacuaacucaagacaauacucagcagagagcaucccguguggau

SEQ ID NO: 351581 - RNA, 65 nt, hsa
gaaguaauguacccuuuuuuucugaaacugaauuaaauacucauuuuaucuuugacucuccuuga

SEQ ID NO: 351582 - RNA, 65 nt, hsa
ccaaagcagcauaauauguguuauauaaacauaauaauacucagauauccaaauguucagauagc

SEQ ID NO: 351583 - RNA, 65 nt, hsa
agaggauuauuuuauuauguuuauuaaucaccucuaauacucauccacaugaaggguacacauua

SEQ ID NO: 351584 - RNA, 65 nt, hsa
acguacaugcuucaauaauucuuuuuugugucuuaaauacucauaggggaaaaaaacagcucacc

SEQ ID NO: 351585 - RNA, 65 nt, hsa
ucaguaagacagugcagugcucaguaaggcagugcaauacucaguaacaguguaguacucaguaa

SEQ ID NO: 351586 - RNA, 65 nt, hsa
guacucaggaaugcagcacaguacucaggcagugcaauacucagugcgguacucaguaacacagu

SEQ ID NO: 351587 - RNA, 65 nt, hsa
ugugaggacugagaagaacaaugucaaauguuuuuaauacucagaugugggagcgacaucaauga

SEQ ID NO: 351588 - RNA, 65 nt, hsa
aggucugguacauauuggaaauuaugagcagaacaaauacucaacuaaaugcacaaaguauaaag

SEQ ID NO: 351589 - RNA, 65 nt, hsa
guguguaacacacacaccccuaucguuguccuucaaauacucagcauuaccauugguugaggcca

SEQ ID NO: 351590 - RNA, 65 nt, hsa
uacccuuugcagaaaugcuuuuggucuccuacccaaauacucacaagggucuuaucagacgcccg

SEQ ID NO: 351591 - RNA, 65 nt, hsa
uucuacaagaucccuauuugacuguaaaaguagcuaauacucacauguucuccaaucccagguag

SEQ ID NO: 351592 - RNA, 65 nt, hsa
uucugcuuuuaguucuuaagaggaucaggcuuuuaaauacucauuuacaaguuuucuauccuccu

SEQ ID NO: 351593 - RNA, 65 nt, hsa
uauaugauauucuuuaaacaaauaugaaaaauguaaauacucaugaaugaaaauacaucuuuuug

SEQ ID NO: 351594 - RNA, 65 nt, hsa
cagccuucaguuguacuagaauuuuguuuuuauccaauacucauuaaauaagugggccacuuagg

SEQ ID NO: 351595 - RNA, 65 nt, hsa
acugaugacuuacaaauaaugggcucugauugggcaauacucauuugaguuccuuccauuugacc

SEQ ID NO: 351596 - RNA, 65 nt, hsa
ucaacaugcccccaauuucucucccaaucacccucaauacucacguguacacauucagaugcaga

SEQ ID NO: 351597 - RNA, 65 nt, hsa
cuaauucuucucaugcauaugcauucacucccaggaauacucauucgucuacucugauguuggga

SEQ ID NO: 351598 - RNA, 65 nt, hsa
cucccaugaagaauuucuaggucauaaacaugaauaauacucaguauauguauaauaucauauuu

SEQ ID NO: 351599 - RNA, 65 nt, hsa
aaaguccacauauggauauuuggggauguuauuuaaauacucagcaggcugagugcagguauacg

SEQ ID NO: 351600 - RNA, 65 nt, hsa
ugagggaauauuucaguuuccugaaguaugacacaaauacucauauacugucuuuuagagucagu

SEQ ID NO: 351601 - RNA, 65 nt, hsa
ugauccuuuaugcacugugaaggucugaaguuuauaauacucacuugacccuuguaacugaugag

SEQ ID NO: 351602 - RNA, 65 nt, hsa
agaagugcacaggcuacuuguacagagaaaaaauuaauacucaaaggaaaucuucauuuuuuaga

SEQ ID NO: 351603 - RNA, 65 nt, hsa
uucccuuccuaagaaacugccuuccacaauuaaagaauacucauagaaagaaaauaaucauaaau

SEQ ID NO: 351604 - RNA, 65 nt, hsa
uuguuaaagagcuuucaauguauauuaaaaccuucaauacucagaaaugauggauuccuccaagg

SEQ ID NO: 351605 - RNA, 65 nt, hsa
guaucucuagauaagaagauaugcaccacguugaaaauacucaguguagaucucuauguguauag

SEQ ID NO: 351606 - RNA, 65 nt, hsa
guacauacauuuuuguauguuuagauauuaccguaaauacucaggauuggagcugcuuguaagua

SEQ ID NO: 351607 - RNA, 65 nt, hsa
auccuucucucuuaaaaaggaauuuauuguaaaagaauacucacacuaaauuaaauucaaauuuc

SEQ ID NO: 351608 - RNA, 65 nt, hsa
gugagauaauauucuaagaggcucuagaaacaugaaauacucaguagugauggguuucccacuuc

SEQ ID NO: 351609 - RNA, 65 nt, hsa
aaguuugggcugauuauauuguaaugauguuagauaauacucaacaugauucaguaugacaaacu

SEQ ID NO: 351610 - RNA, 65 nt, hsa
gcuccuuccguaagaaaaugaaauauucuaugccuaauacucacacgcaacauuucuuguacuuu

SEQ ID NO: 351611 - RNA, 65 nt, hsa
gauuguaggaucaaaaaaggcagaugaaauuacuuaauacucaguguuuuggagaguauuccuuu

SEQ ID NO: 351612 - RNA, 65 nt, hsa
gcaagauugcaaugauuauggaaaaauagaaagcgaauacucaguuuaagccaaggaaaauauug

SEQ ID NO: 351613 - RNA, 65 nt, hsa
aagcaaaauuauuuuaaaugacuuaauuguaugcuaauacucaucugauaauaaaugcuucuuaa

SEQ ID NO: 351614 - RNA, 65 nt, hsa
cuuaaacaaauguaugauuacaucaaggcuucaaaaauacucacauggcuauguuuuagccagug

SEQ ID NO: 351615 - RNA, 65 nt, hsa
agacuacagggaucucacgacgaauauucugauacaauacucaaccucgguauauauauaugugu

SEQ ID NO: 351616 - RNA, 65 nt, hsa
uucucaccugaaaauguggacagcuugguguacuuaauacucaugcauucuuuugcacaccuguu

SEQ ID NO: 351617 - RNA, 65 nt, hsa
uaaacauugcuguucacuagauuaucuuaacaaauaauacucagcuaaauauuugcauuuaggaa

SEQ ID NO: 351618 - RNA, 65 nt, hsa
cgcacuuagucauucgugguaacuaacaauuuugaaauacucauauaaaaugaacaggaaagugu

SEQ ID NO: 351619 - RNA, 65 nt, hsa
auauacauauguaucuuauaaucuuuucucccugaaauacucacauucccacauacauucacuau

SEQ ID NO: 351620 - RNA, 65 nt, hsa
aaaaacaugaauguugugcauuuugugauuuuggaaauacucaauguggcucuucuauaggcuuc

SEQ ID NO: 351621 - RNA, 65 nt, hsa
gaggccuuaaaauucuggauaagagaauggaggaaaauacucagaguacuugauuauuuuauuuc

SEQ ID NO: 351622 - RNA, 65 nt, hsa
uuggugguaggacuaagaaggaaacagauauuuuaaauacucacaacaugugauucauuuucuga

SEQ ID NO: 351623 - RNA, 65 nt, hsa
uaaaauucuauuaaugucuauacauuggucaccuaaauacucauauucucgaguuuuauacaguu

SEQ ID NO: 351624 - RNA, 65 nt, hsa
cucagcuaugggcuucccuagaguaggucuaggggaauacucagucugaucuuuuuuuuguuugu

SEQ ID NO: 351625 - RNA, 65 nt, hsa
cuuccugaguagcugcaacuacagacacaugccccaauacucagcuaauuuuuaaauuuuugugg

SEQ ID NO: 351626 - RNA, 65 nt, hsa
gugcaauagcaauuaaaauauaucaaaucgcacugaauacucaacaccagagcucuaauguggga

SEQ ID NO: 351627 - RNA, 65 nt, hsa
aaagagaacuuucuuccugaaaccuuugucuuaaaaauacucagcuuucaauguaucaaagauac

SEQ ID NO: 351628 - RNA, 65 nt, hsa
aagaggagguccaugccaaacugacuguuuuaacaaauacucauagucagugccuauacaagaca

SEQ ID NO: 351629 - RNA, 65 nt, hsa
cugugcagauuuucccacugauuuauuuguauaaaaauacucaucuuuucagacuuuuuuguaaa

SEQ ID NO: 351630 - RNA, 65 nt, hsa
guuuuuucuuucccauguauuuguuauauauaauaaauacucagugaugagaaaaaauuggcauu

SEQ ID NO: 351631 - RNA, 65 nt, hsa
aaucaaggauuuaauuaaggccacaauaccuuuuuaauacucaguguucuguuuuuuuaaaaacu

SEQ ID NO: 351632 - RNA, 65 nt, hsa
uaguaucauguaauguuccguguagguuucauuguaauacucaugccuaccucgcaugguugcug

SEQ ID NO: 351633 - RNA, 65 nt, hsa
ccacgaagguuacauuuaugcugaauacauuuguaaauacucaguuuuauacuguauguauauga

SEQ ID NO: 351634 - RNA, 65 nt, hsa
aacuuuaauguuuuuugccacagcuuuugcaacuuaauacucaaaugaguaacauuugcuguuuu

SEQ ID NO: 351635 - RNA, 65 nt, hsa
ggcaagauaaccauaauaauuuuagugagaagauuaauacucaaggaccugacuugauaauuacu

SEQ ID NO: 351636 - RNA, 65 nt, hsa
ccuggggaagcugugaaagaaccaaaagagaucacaauacucaaaagagagagagagagaaaaaa

SEQ ID NO: 351637 - RNA, 65 nt, hsa
aguacauaugaaagugaccuccaaggggauuggugaauacucauaaggaucuucaggcugaacag

SEQ ID NO: 351638 - RNA, 65 nt, hsa
augcugcauaaaaauaccaaacuucagcaacuguuaauacucagaucauauaccucuuaauaaau

SEQ ID NO: 351639 - RNA, 65 nt, hsa
auaaauagaacaagggacuuuuuguugauaauccaaauacucaaaguuuacguaaugaaaauuau

SEQ ID NO: 351640 - RNA, 65 nt, hsa
ccaauuguucuuauauucuauagaaguucgcucaaaauacucaacaggggaauaggcagcggaca

SEQ ID NO: 351641 - RNA, 65 nt, hsa
ucaaaauauuauagauuauagcuaaaauccagauuaauacucauuugggguuuuuuauaguggaa

SEQ ID NO: 351642 - RNA, 65 nt, hsa
agaagauaugcaaauggcuacuaagcacaugaaaaaauacucaacauuauuauucauuagggaaa

SEQ ID NO: 351643 - RNA, 65 nt, hsa
gcugguugcaaagaauugauauuuagaugguuuuuaauacucagcagauugucuuccuuuauauu

SEQ ID NO: 351644 - RNA, 64 nt, hsa
ggaggaaaaaaacccaguauuuaaagucuauaaaaaauacucaaaauagugggucuucgaguuu

SEQ ID NO: 351645 - RNA, 65 nt, hsa
gaaggguuguguucuucaggggucuuuuguuuugaaauacucaggauggggagagguuuauuuaa

SEQ ID NO: 351646 - RNA, 65 nt, hsa
aaauaaaaaauccgaacagcauacuugaagaauguaauacucaaacucucagugcuuccuuaugg

SEQ ID NO: 351647 - RNA, 65 nt, hsa
uauaacugauuuauaaagguuuuuguacauuuuuuaauacucauugucaauuugagaaaaaggac

SEQ ID NO: 351648 - RNA, 65 nt, hsa
aaauauaaacuugaaaguauguagucagcucuuguaauacucauauuuaugauuguccuauauga

SEQ ID NO: 351649 - RNA, 65 nt, hsa
uaucauaaggaaaaauagaaaggaaaacuugaaucaauacucauugauuaaaauggaauaaagaa

SEQ ID NO: 351650 - RNA, 65 nt, hsa
uaaaccuucagaagcuauuuuuuuaagcuaucagcaauacucaucagagcagcuagcucuuuggu

SEQ ID NO: 351651 - RNA, 65 nt, hsa
agaacauauauauauauauauuaagccccaggcugaauacucagggacagcaauucacagccugc

SEQ ID NO: 351652 - RNA, 65 nt, hsa
aaaacaaacaaacaaacaaaaaacccauguguuaaaauacucagugcuaaacauggcuuaaucuu

SEQ ID NO: 351653 - RNA, 65 nt, hsa
aacugagguaacugucauuagaaaagguuucuuaaaauacucacaaagcuguuauuggcuucuua

SEQ ID NO: 351654 - RNA, 65 nt, hsa
gauuaauagcauucgaagauccccagacuucauagaauacucagggaaagcauuuaaagggugau

SEQ ID NO: 351655 - RNA, 65 nt, hsa
uauggacaacuuuuugccacuaacugaauucuccaaauacucacacgugaaauuucaaaaaagaa

SEQ ID NO: 351656 - RNA, 65 nt, hsa
caaaacaaaacaaaaaaaaacagaaguuacaaaugaauacucacggauauguauaguuuuauguu

SEQ ID NO: 351657 - RNA, 65 nt, hsa
uucccaaaagcuccaggauuugugugcuguugccgaauacucaggacggaccugaauucugauuu

SEQ ID NO: 351658 - RNA, 65 nt, hsa
uucagcaauggcuacaugacuaugucuaaaaacugaauacucagaauacuaaagguuuggugcuu

SEQ ID NO: 351659 - RNA, 65 nt, hsa
gugaaacugauuaguugcaaaauccaguagguuaaaauacucacauauuuuuacuuaaauuuucu

SEQ ID NO: 351660 - RNA, 65 nt, hsa
cauaaaauaacaauguuuccaaaugcaacuaagaaaauacucauagugaguacgcucuaugcaua

SEQ ID NO: 351661 - RNA, 65 nt, hsa
aacaacuccacucauaguaucaacauuguuuugcaaauacucagaauauuuuggcuucauuuuga

SEQ ID NO: 351662 - RNA, 65 nt, hsa
aagaaguccacugacaguaucaguacuguuuugcaaauacucagcauacuuuggauccauuucau

SEQ ID NO: 351663 - RNA, 65 nt, hsa
uccaaaucuuaauucaacuaguaccacagaaguucaauacucauuuggaaaugcuacaaacauau

SEQ ID NO: 351664 - RNA, 65 nt, hsa
ggccuauuagcaaagauuaagaaaugauaacauuaaauacucaauaaaucaccaugagaugggga

SEQ ID NO: 351665 - RNA, 65 nt, hsa
acuaaguugguacccuaccuacccguaaaauaugaaauacucagaaguaaagugugugggcaauc

SEQ ID NO: 351666 - RNA, 65 nt, hsa
uguaggucuuucacagcuagcuuuggggaauacggaauacucaaauaaagugcuuuguuauuauu

SEQ ID NO: 351667 - RNA, 64 nt, hsa
caaauaggcuaaaugugaacaaauaaaauacagcaaauacucagauacagcuuuuuaucuuugu

SEQ ID NO: 351668 - RNA, 65 nt, hsa
auguauugauggggacuuuuccaccucauuagacuaauacucauucaaaaagaguuugguucugc

SEQ ID NO: 351669 - RNA, 65 nt, hsa
aagacauacacaauuaauuauauugguuaauuagaaauacucagcacaauauuuaaugagaaauc

SEQ ID NO: 351670 - RNA, 65 nt, hsa
uuuauuguaaggaaacuuuaaagcauuuuuuaggaaauacucaaaagcaagguuggaaaauguuu

SEQ ID NO: 351671 - RNA, 65 nt, hsa
ucucugucacauuagacuauccaucaugaccagcaaauacucauuuuaggaaaaaaaaaagcaug

SEQ ID NO: 351672 - RNA, 65 nt, hsa
uuuucauuuugguuuuguguuuugguuaauaaaacaauacucaaauacaaaagguaucuuuuuua

SEQ ID NO: 351673 - RNA, 65 nt, hsa
gcaacgugcaauacaaaaaucguaucucaagggaaaauacucaaagaaagaaaaguggcagcacu

SEQ ID NO: 351674 - RNA, 65 nt, hsa
guaaaaauacguuuuuuguaaaggcaauuguacauaauacucaucacuuaauucaccacacucuc

SEQ ID NO: 351675 - RNA, 65 nt, hsa
accaugcuuaaaaaucacgucauucuuuaaacaaaaauacucaagaucauuuauauuuauuugga

SEQ ID NO: 351676 - RNA, 65 nt, hsa
gcuuuaccauauaucaggaauuauauccaggaugcaauacucagacacuagcuuuuuucucacuu

SEQ ID NO: 351677 - RNA, 65 nt, hsa
gauguuuauauauaaacucuauauccuaauuuacuaauacucaucagaugucagccuuugcucuc

SEQ ID NO: 351678 - RNA, 65 nt, hsa
ucaggaguguccuaugugagaauugagccaaggaaaauacucaugcaaccagccugagucgcggu

SEQ ID NO: 351679 - RNA, 65 nt, hsa
gagcaaaaggacgccaugugagcauuaggaaaaaaaauacucacucuuacuaacaauuuuuauac

SEQ ID NO: 351680 - RNA, 65 nt, hsa
accacaaauaaucaagaguugauuucaagauuauaaauacucaugaucagaaaauaguacuuauu

SEQ ID NO: 351681 - RNA, 65 nt, hsa
aaauaagagcaagaguugauagagcuuuuacaaucaauacucaccuaauucugauaaaaggaaua

SEQ ID NO: 351682 - RNA, 65 nt, hsa
acuuaucacauggagaccuaauguaauaauagaaaaauacucauaauagggagaaaccaagagaa

SEQ ID NO: 351683 - RNA, 65 nt, hsa
caaaguucaucacacagcuuaaugagucacauugaaauacucaguaauugaacugcaaaucacuu

SEQ ID NO: 351684 - RNA, 65 nt, hsa
uggccagacucugaccccacugcccuaggcucuuaaauacucauugggaggguccgaguccuuac

SEQ ID NO: 351685 - RNA, 65 nt, hsa
acagaguaauauaugugaugcaguguaagaaggaaaauacucaucucuaacauuaugguaauaac

SEQ ID NO: 351686 - RNA, 65 nt, hsa
guuaugaagacuuaaggcccaguauuuuugaauacaauacucaucuaggauguaacagugaagcu

SEQ ID NO: 351687 - RNA, 65 nt, hsa
uccaggguaugaccuagggaaugaacuagcuaugaaauacucaggguuaggaauccuagcacuug

SEQ ID NO: 351688 - RNA, 65 nt, hsa
gugcaaauaacuuuugguguuguagcuaaauaaggaauacucaugccaagauugcacaauugugc

SEQ ID NO: 351689 - RNA, 65 nt, hsa
augaugaaauucuuauguugaauauguuagaaucaaauacucauuuuucauuagauacaguagug

SEQ ID NO: 351690 - RNA, 65 nt, hsa
gugugagguuuccuauuuugacaaguuaacuuguaaauacucagguuuuacgauguauaauuuac

SEQ ID NO: 351691 - RNA, 65 nt, hsa
ggcaguucugcuucagcuuagagcagaacccauaaaauacucaaguacugggauaggcaagcaug

SEQ ID NO: 351692 - RNA, 65 nt, hsa
auuuuuuauauauuugguauuuuuugaaaauuccaaauacucaugucucaaguaagcuuaaacua

SEQ ID NO: 351693 - RNA, 65 nt, hsa
ugagacauuuuaagaucucaaguuuuuauuuaacuaauacucaaaauauggacuuuucauguaug

SEQ ID NO: 351694 - RNA, 65 nt, hsa
ugauacgguguuaaaaaaaaucaugguaaggcuacaauacucaaguaacaagguuugggacaaug

SEQ ID NO: 351695 - RNA, 65 nt, hsa
guagaauaugaauaaauagaauaauaaaauuccaaaauacucaaugggaaaugacuaguaauaua

SEQ ID NO: 351696 - RNA, 65 nt, hsa
agaucugacuuguaagcaguucauagaagcugcucaauacucaagaaucuugcaagacaguuauu

SEQ ID NO: 351697 - RNA, 51 nt, hsa
uuucccuuacccagaaaugaaaauacucaauauggaccauuuaggaauuau

SEQ ID NO: 351698 - RNA, 65 nt, hsa
cccaaguuuacagcuuguacuuuacuuuaauguguaauacucaacucaagguacaagacaauugc

SEQ ID NO: 351699 - RNA, 65 nt, hsa
aagaaaucauuuuuaauguguacuguaaaacuugaaauacucaggagcugagugaauauguuugu

SEQ ID NO: 351700 - RNA, 65 nt, hsa
ggcagagaaacugagagaaaagggauggagaagagaauacucauuuuuguccaguguuuuucuuu

SEQ ID NO: 351701 - RNA, 65 nt, hsa
ccucucuggaaaaucgaagugaaacauuugucucuaauacucaaauucaacauauggcucaucuc

SEQ ID NO: 351702 - RNA, 65 nt, hsa
uaugacguaccguugagaagaucaauuucagcuacaauacucaucugaaaaucauuaaugccaac

SEQ ID NO: 351703 - RNA, 65 nt, hsa
aauucuuucuuuccuacuacauucuguuuuauuuaaauacucauuguugcuauuucacuuuuuga

SEQ ID NO: 351704 - RNA, 65 nt, hsa
ggcaaagaacucgugggaggaugucuguuguauguaauacucacaauggcuuuugguuaguguug

SEQ ID NO: 351705 - RNA, 65 nt, hsa
aaucaguguguguacugcagggaaaaggauauaggaauacucaucuuacaggggaauuugugacc

SEQ ID NO: 351706 - RNA, 65 nt, hsa
gccauucaacaaggagucaaguagaucugaaauuaaauacucaacagacuccuccuuuuuuagcu

SEQ ID NO: 351707 - RNA, 65 nt, hsa
ucaagagaaguuuaggagggggagcaucccuagugaauacucacaccacaagaaggacaaacuug

SEQ ID NO: 351708 - RNA, 65 nt, hsa
uaagguucagguguuuucaaguuggaaagaucauaaauacucaaaauuguuuucaaguuagcaag

SEQ ID NO: 351709 - RNA, 65 nt, hsa
uugcuacaacuuggugcaugccugcuccuaaaagaaauacucaggaauugucucauaaaguccuc

SEQ ID NO: 351710 - RNA, 65 nt, hsa
cgauggagauugggaaacuuaaccguuacccaggcaauacucaagaaggagaauccauuuagcac

SEQ ID NO: 351711 - RNA, 65 nt, hsa
gggaagagcuuuaggauucuaguagauggauacugaauacucaggcccacuuaaauuauuaaugu

SEQ ID NO: 351712 - RNA, 65 nt, hsa
ugaaggcaaccuuggcugauaaaaccucuauagugaauacucacaucuuuacuucacucacuauc

SEQ ID NO: 351713 - RNA, 65 nt, hsa
cucccuggcagaacacggagaaucaggauuucuuaaauacucaacagagaggcugagcagagcaa

SEQ ID NO: 351714 - RNA, 65 nt, hsa
gggaauuuagagguuguagcaucuucugcuggaguaauacucaggcuauucuaauaacagaugau

SEQ ID NO: 351715 - RNA, 65 nt, hsa
aguaguaccuuuaaaguaacacuuuguacauaacaaauacucagcaaaugugaaacuuuauuugc

SEQ ID NO: 351716 - RNA, 65 nt, hsa
aguguauuuuacucugaucaaauaaauaaugcuggaauacucaagaauugcauccucugaccuac

SEQ ID NO: 351717 - RNA, 65 nt, hsa
uucugcaauucagcuuuguuuaaagugauuugaaaaauacucauucugaacauauccaugcgcaa

SEQ ID NO: 351718 - RNA, 65 nt, hsa
gggccaaauagcacauaacaccugguuauauaugaaauacucauauguuuaugaccaaaauaaau

SEQ ID NO: 351719 - RNA, 65 nt, hsa
cacuguuauuacuguuaccugcacaaaugaaaaacaauacucaacaguaauuccacucccaugaa

SEQ ID NO: 351720 - RNA, 65 nt, hsa
augggaaacauuuuuuggcauuaaugcagcaacauaauacucacuuuagguauuacuacauaguu

SEQ ID NO: 351721 - RNA, 65 nt, hsa
ucuaacuauuaggaggaaugugcuuuuccaucuaaaauacucaccaaaauauaguuaauuguggc

SEQ ID NO: 351722 - RNA, 65 nt, hsa
auggauaccacauauuaaaccauguauaucuguggaauacucaauguguacaccuuugacuacag

SEQ ID NO: 351723 - RNA, 65 nt, hsa
uaacuucauuauuuuaaaaauauuuuuagaacuccaauacucacccuguuaugucuugcuaauuu

SEQ ID NO: 351724 - RNA, 65 nt, hsa
cacccucucugauauuuuuguccuuuagauguucaaauacucaguaguccuuuuguuugcgguuu

SEQ ID NO: 351725 - RNA, 65 nt, hsa
cuucugacccuggcuuccagggaccuaugucuuuuaauacucacugucacauugggcaaaguugc

SEQ ID NO: 351726 - RNA, 65 nt, hsa
aucuaagaaggauagguuauaaagggagguaccuaaauacucaaauaauguauauauucuuuuuc

SEQ ID NO: 351727 - RNA, 65 nt, hsa
cuguagcuuagagugcucacuuacuaccucugaacaauacucacgcuguaguuugucucuuucuu

SEQ ID NO: 351728 - RNA, 65 nt, hsa
uugagguuuuagauugaaacuuugaauaaaucaaaaauacucauucuuauuuacugcaaccuucu

SEQ ID NO: 351729 - RNA, 65 nt, hsa
ugguaugcccuugcccuguucuauaaauaucuauaaauacucauauauauacacaccuacacaug

SEQ ID NO: 351730 - RNA, 65 nt, hsa
gguccuuuccgcucuccuaagagccacaccuggugaauacucaguaaacauuugcggaaugaaug

SEQ ID NO: 351731 - RNA, 65 nt, hsa
acuauggguuuuuucaggugaaccucccccauuuaaauacucagaagauaaggugugaauguaug

SEQ ID NO: 351732 - RNA, 65 nt, hsa
aaaggagcgcuuucuagggucagaaucguggagagaauacucagaaaugaaccucuuuaaagccu

SEQ ID NO: 351733 - RNA, 65 nt, hsa
ccuggacucauuugagaagacuugagaaaugucuuaauacucacacugcugcauguagcucuugc

SEQ ID NO: 351734 - RNA, 65 nt, hsa
gagguucauugccagggcaggagguauuuccagaaaauacucaugccuguguucuguuccuugcu

SEQ ID NO: 351735 - RNA, 65 nt, hsa
guucuguuuuugcuacucuauugucauuccuguuuaauacucacuguacuuguauuugagacaaa

SEQ ID NO: 351736 - RNA, 65 nt, hsa
ucucuucuuugucuaccauuucaaauugacuugugaauacucagagcaguuauuuuucaauccuc

SEQ ID NO: 351737 - RNA, 65 nt, hsa
acaaggaauugccuuccgaauggagguucauguauaauacucauuuacaauucaauauauaauua

SEQ ID NO: 351738 - RNA, 65 nt, hsa
cagugaagcaauggaagcuggagugugacuggaaaaauacucagcaaacaaaguuaccaauucca

SEQ ID NO: 351739 - RNA, 65 nt, hsa
aauauguaaacuuacaguuaaaaacaaagguaauaaauacucagcacucaucacuuccuaauuau

SEQ ID NO: 351740 - RNA, 65 nt, hsa
uuaccuuccuucuucauacuuugcucuuuuucuuaaauacucauuaaugugcauauaucauuauu

SEQ ID NO: 351741 - RNA, 65 nt, hsa
aaggcccagguagguagaaguuuuuauauagccugaauacucacuugacuuacugcucauuuuac

SEQ ID NO: 351742 - RNA, 65 nt, hsa
ugguuuuuuuucuuuuaauuuuuaaauugucguaaaauacucauaaaacauacugucuucaccau

SEQ ID NO: 351743 - RNA, 65 nt, hsa
guuuaaaacaaguagcuguuacuaagugugcuaaaaauacucauuuuauaauuaauuuuaguuuu

SEQ ID NO: 351744 - RNA, 65 nt, hsa
caaugcacaaauuaagaaucuauauaagcuauaaaaauacucauuuuuuaaaaaaaguuuuuuuc

SEQ ID NO: 351745 - RNA, 65 nt, hsa
aacuuguaggugacaugacaugagaauugccuuaaaauacucaaggaaaaaaauccuacugcugg

SEQ ID NO: 351746 - RNA, 65 nt, hsa
gucuuuaaagugacuaauggcaugagaaauacaaaaauacucagauaagguaaaaugccaugaug

SEQ ID NO: 351747 - RNA, 65 nt, hsa
uucacaagaaaaugcaaguuacuuuuuuuggaaauaauacucacugauuauggauaaaauggaau

SEQ ID NO: 351748 - RNA, 65 nt, hsa
gauacccugcuaucgauggucgcuacaaaccaggaaauacucaaguuauuauguguauacauugg

SEQ ID NO: 351749 - RNA, 65 nt, hsa
auaguuauaacgucguuacuuguacuaugaaggaaaauacucagugucagcuugagccugcauuc

SEQ ID NO: 351750 - RNA, 65 nt, hsa
gcaacccucccccaucccuaguuauuagguuaaaaaauacucagauuacuauuucuauuacuaug

SEQ ID NO: 351751 - RNA, 65 nt, hsa
uugcccaguuaaauguucaccaaucauuuuaacuaaauacucagacuuagaagucagaugcuuca

SEQ ID NO: 351752 - RNA, 65 nt, hsa
ucuagacccuauacauuuugaaaauauuuuacccaaauacucaauuuacuaauuuauucuucacu

SEQ ID NO: 351753 - RNA, 65 nt, hsa
agaggggagcuugagggacaaugccacuauaguuuaauacucagaggggguuggguuuggggaca

SEQ ID NO: 351754 - RNA, 65 nt, hsa
cacuugcuuuugaauugcacugaacagaauuaagaaauacucaugugcaauaggugagagaaugu

SEQ ID NO: 351755 - RNA, 65 nt, hsa
guuuugguuuuguuuuuaauauuuuuuucuauuaaaauacucaugcauuuaaccuucccguuauu

SEQ ID NO: 351756 - RNA, 65 nt, hsa
aaaaacauacuuacauuucagacauauccaaagggaauacucacauuuuguuaagaaguugaacu

SEQ ID NO: 351757 - RNA, 65 nt, hsa
uaaagauuuucugugcguauuuuaaaagucguguuaauacucaugauaauuauuagggaccuggc

SEQ ID NO: 351758 - RNA, 65 nt, hsa
ggccuagcugcuacaaagaagacauguuuuagacaaauacucauguguaugggcaaaaaacucga

SEQ ID NO: 351759 - RNA, 65 nt, hsa
ugggguuuggauuuccccaggaagauggagaauggaauacucacucuugggucuaaucuuucccc

SEQ ID NO: 351760 - RNA, 65 nt, hsa
accuccaacagcugcuuuaaauuuaagauuuacuuaauacucagaaaauucagauaaagccauag

SEQ ID NO: 351761 - RNA, 65 nt, hsa
uucggccuaaaauaugcagaagacagaugaggucaaauacucaguuggcucucuuuaucucccuu

SEQ ID NO: 351762 - RNA, 65 nt, hsa
uuuguagaugaaaaagcauguacaguguucuguuuaauacucauccuuguauaaaaaaaauaguu

SEQ ID NO: 351763 - RNA, 65 nt, hsa
ugcaguuaggaaaaaaaaauccaagaaauguauugaauacucaagaaaaugccacauuucaauua

SEQ ID NO: 351764 - RNA, 65 nt, hsa
uaugggcaaauuguguucuuuaucacuuccgagcaaauacucagauuuaaaauuacuuuaaaguc

SEQ ID NO: 351765 - RNA, 65 nt, hsa
cagucuucccugggagacuacuauuaacugaaauaaauacucagagccugaugcugguuuuucug

SEQ ID NO: 351766 - RNA, 65 nt, hsa
uuaaggucugggaguguucuguuucccauuacuuuaauacucaccuccucccagacuuucuacac

SEQ ID NO: 351767 - RNA, 65 nt, hsa
ugauggcacuggcacauuacaguggugucuuguuuaauacucauugguauauuccaguagcuauc

SEQ ID NO: 351768 - RNA, 65 nt, hsa
ggggagacacuuuaccaguauuuuuuuauggaaauaauacucaagguuguaaaaccccucaaagc

SEQ ID NO: 351769 - RNA, 65 nt, hsa; identical to SEQ ID NO: 351758

SEQ ID NO: 351770 - RNA, 65 nt, hsa
cuuguaaaaaacauauccugaacugagauaugcaaaauacucauuuucaaguuauggaaaugugu

SEQ ID NO: 351771 - RNA, 65 nt, hsa
ccaaaaauuuagaugccuuaauaguauauacgugaaauacucagcugucccuuuaaaaauaauuc

SEQ ID NO: 351772 - RNA, 65 nt, hsa
uucuguacauauauguauuacauuucuacauuuuuaauacucacaugggcuuaugcauuaaguuu

SEQ ID NO: 351773 - RNA, 65 nt, hsa
aagaugucuuucauguguauaugccucugccauagaauacucagucuuguggucaagagaguucu

SEQ ID NO: 351774 - RNA, 65 nt, hsa
uuguuuuuuuuuuucuuuuagugcugacaaaauaaaauacucauuuuugcauaaaaagguuccua

SEQ ID NO: 351775 - RNA, 65 nt, hsa
ugacuuuugaggguuuuuauuucuguuauucacaaaauacucauucucauuuauguauauuguau

SEQ ID NO: 351776 - RNA, 65 nt, hsa
uuccugugagucuugcgagguggaaguaaugauuaaauacucauguguucagaaaacauaaacuu

SEQ ID NO: 351777 - RNA, 65 nt, hsa
augaccuuccgcacaucucuaaguuuuaucuuugcaauacucaagguucucggaaauuugcuaau

SEQ ID NO: 351778 - RNA, 65 nt, hsa
uuuucuaaauagacccuuaugggaguuugaaaauaaauacucacauauuucacuacuuaaauuau

SEQ ID NO: 351779 - RNA, 65 nt, hsa
cuuuaucugauaugcugagaaauuauuagauugccaauacucaugugcguuucauguguuuuaua

SEQ ID NO: 351780 - RNA, 65 nt, hsa
uauguaaugauuuggaccaaaaaguauuuugcugaaauacucagguaauugagauagcaaugguu

SEQ ID NO: 351781 - RNA, 65 nt, hsa
ccucugaccuaccuuugccuuuuucugucauggagaauacucacccuucagaaacagaccaaagg

SEQ ID NO: 351782 - RNA, 65 nt, hsa
gagugacacuacacucuagaauuuccacuuuggagaauacucaguuccaacuugugauuccugau

SEQ ID NO: 351783 - RNA, 65 nt, hsa
uccuugaucagagauaaacuauuaaaacuuuaaaaaauacucaaaaauauguaaguuuuuugguu

SEQ ID NO: 351784 - RNA, 65 nt, hsa
gauaugaggauggucaggugggcgaugccaacauuaauacucaggaccccaagauacagaaggaa

SEQ ID NO: 351785 - RNA, 65 nt, hsa
uagauuuuuggucacuugcuuuuauagacuauuuuaauacucagcacuagagggagggaggggga

SEQ ID NO: 351786 - RNA, 65 nt, hsa
gagaugcauuuacaaaacagacuggagaaggacuuaauacucagauggauuggaacuaucauggu

SEQ ID NO: 351787 - RNA, 65 nt, hsa
cauuauuuuugaaaaaaaaaauauuuuuauagaugaauacucaggcuaaccuaguggaugugauc

SEQ ID NO: 351788 - RNA, 65 nt, hsa
aggaaaccucaaugcugccuccagagcuuuuuggaaauacucagauccuggccgccuuuguaacc

SEQ ID NO: 351789 - RNA, 65 nt, hsa
auucuguuccccucuucgcagaagugaggaaggcaaauacucaggguuugaagggagaccuggcc

SEQ ID NO: 351790 - RNA, 65 nt, hsa
gaggaaggggagaucguagauuugcugcugaugaaaauacucaguuuccugggcauuaagucuaa

SEQ ID NO: 351791 - RNA, 65 nt, hsa
auggucaugugagcuucuggucaccggaagccagaaauacucagcugccauguugauccacaaag

SEQ ID NO: 351792 - RNA, 65 nt, hsa
acagcgugagauuucaacagaacuuguuuggaacaaauacucacuuaaaacuucagcagaagaaa

SEQ ID NO: 351793 - RNA, 65 nt, hsa
cuuuccccauuucuaucucccagcccagucacaaaaauacucagcuccaucaagaggaauugugu

SEQ ID NO: 351794 - RNA, 65 nt, hsa
ugaaccggaaaucugaacgggaagucuucuuuaugaauacucagagcauuguucagcugguacag

SEQ ID NO: 351795 - RNA, 65 nt, hsa
uguuuuaauuccaugaaucgcuucucuuuugaaacaauacucauaaugugaaguguuaauacuag

SEQ ID NO: 351796 - RNA, 65 nt, hsa
cuguuucaaacuugcauguggagccauguggcacaaauacucaugccagcucauuacagcaugag

SEQ ID NO: 351797 - RNA, 65 nt, hsa
uugcuugcauuuucugaugacuuuuauaaguuucaaauacucagacuuguggaauuuuauaauuu

SEQ ID NO: 351798 - RNA, 65 nt, hsa
agaacuaugcuggaugcuguagacagaagaaauaaaauacucaacuuggucccuaucuuccagca

SEQ ID NO: 351799 - RNA, 65 nt, hsa
cucuuaguuuacuuauguugaauggcuuagcuauuaauacucaaauugaguuaaaaugaaaauuc

SEQ ID NO: 351800 - RNA, 65 nt, hsa
aagcauuauacuguggaauacugccuuuugacaaaaauacucaugccuuuacaauuguuaguaaa

SEQ ID NO: 351801 - RNA, 65 nt, hsa
aauauauaauguaccauauauauuaauagucaacaaauacucagauauucuaaggucaaugccau

SEQ ID NO: 351802 - RNA, 65 nt, hsa
acauauuaaagaaaaguuacuuacuguauuuaugaaauacucagcuuaggcauuuuuacuuuaac

SEQ ID NO: 351803 - RNA, 65 nt, hsa
agugacauuugauucaauuguugagcuguaguuagaauacucaauuuuuaauuuuuuuaauuuuu

SEQ ID NO: 351804 - RNA, 65 nt, hsa
gugaaaguugaucauacgaauuggaucaaucuugaaauacucaaccaaaagacagucgagaagcc

SEQ ID NO: 351805 - RNA, 65 nt, hsa
cuuaaguucaucucugucaccuagcuuuuauuuuuaauacucaauuucugaggcuuaggagaaua

SEQ ID NO: 351806 - RNA, 65 nt, hsa
ccuuuaaugcucuggguucaugucagauacauuaaaauacucacugaagagaagcccuaugaaug

SEQ ID NO: 351807 - RNA, 65 nt, hsa
uuuaaaaaaagaaguggagguguuuacaccagcaaaauacucauuuuuuaaguguaauuaaguug

SEQ ID NO: 351808 - RNA, 65 nt, hsa
gcacaccacugucuuccccagucagcucccucuaaaauacucagcggccagggcggcugccacuc

SEQ ID NO: 351809 - RNA, 65 nt, hsa
uaacuuuaugacaacuuagggggcuugagccaugaaauacucacguuuaagucaguaaggauaca

SEQ ID NO: 351810 - RNA, 65 nt, hsa
uuaccagagaacuaauaaauguuguuauggcuggaaauacucacugaugcccaacucuucuauag

SEQ ID NO: 351811 - RNA, 65 nt, hsa
ucagggccacucgggcucagaggucacucagggucaauacucagggucagugcagguuaugagau

SEQ ID NO: 351812 - RNA, 65 nt, hsa
uuacaagugugaagaauguggcaaaauuuuuaaugaauacucacaccuuauugccaggaaagcau

SEQ ID NO: 351813 - RNA, 65 nt, hsa
cugauaccuucaugaaauucaagacaaagaagaaaaauacucaauguuauuggacuaaauaauca

SEQ ID NO: 351814 - RNA, 65 nt, hsa
guuucccuguuugccuuugauauuauacacuguagaauacucacaaguccaaauaugcuaaaaau

SEQ ID NO: 351815 - RNA, 65 nt, hsa
cuaagauaccaaaaccacagugccgacagcucuccaauacucagguuaaugcugaaaaaucaucc

SEQ ID NO: 351816 - RNA, 65 nt, hsa
uaagaguaccuuuguuuucuugaucuguuacuuuuaauacucagguaaugcuacaaauauuacag

SEQ ID NO: 351817 - RNA, 65 nt, hsa
cuccaugagcucuggaagguauaugcaucuucuguaauacucagauagguauaagauuuuucaca

SEQ ID NO: 351818 - RNA, 65 nt, hsa
uccuggaccccagagucauuccuccauuugguuaaaauacucagugcagggaacucuuacauccu

SEQ ID NO: 351819 - RNA, 65 nt, hsa
aagaugguaucagagagaaacccaucaauugcucaaauacucagaaaguacugucaaaagccuaa

SEQ ID NO: 351820 - RNA, 65 nt, hsa
caggcggacaaggcugacaagcaauccaggaacaaaauacucaccaggacgaggaagaggacuuu

SEQ ID NO: 351821 - RNA, 65 nt, hsa
uauauauauauauacacacacacauauacaguauaaauacucauuugauucucguaaaacgcgca

SEQ ID NO: 351822 - RNA, 65 nt, hsa
caugcuguuuugggggguggggggguauuugcaagaauacucauuuugacauaauagguccucuu

SEQ ID NO: 351823 - RNA, 65 nt, hsa
guuuguauuuuguuugaaucaaaacugguuauagcaauacucaaauggaaaaaacuucaugauag

SEQ ID NO: 351824 - RNA, 65 nt, hsa
agccccgugcuagcagcgcuccgugcucuuccccaaauacucacggcucuaauuccccaaaccug

SEQ ID NO: 351825 - RNA, 65 nt, hsa
uuugggucaccuaaucauagauuucucagggcaucaauacucaaauauaggcugauuaugcccca

SEQ ID NO: 351826 - RNA, 65 nt, hsa
agggugcaggaggacagcagcuaacaaggccaggaaauacucacuucccuccacccucaacagga

SEQ ID NO: 351827 - RNA, 65 nt, hsa
caugcacugaugcugcuugcaaaaaaugaagacaaaauacucagaaguugcauuugccauggcca

SEQ ID NO: 351828 - RNA, 65 nt, hsa
cagcagucaccugaucacuguucaguucccacucuaauacucacacagcuccuccacaggagacu

SEQ ID NO: 351829 - RNA, 65 nt, hsa
auuuggaaaggucuguccugaauuaucaaaguaagaauacucagauuuccauaagcucuucucac

SEQ ID NO: 351830 - RNA, 65 nt, hsa
cuuccaagauacaggguccacuagaaauuggcuguaauacucauugagccaaguugucauaucaa

SEQ ID NO: 351831 - RNA, 65 nt, hsa
cuacagaagaauauuggauugauuggaguuaauguaauacucaucauuuaccacugugcuuggca

SEQ ID NO: 351832 - RNA, 65 nt, hsa
aucauauuuaaaucuuacuuuaaggcucaauaaauaauacucauaaugucucauuuuagugacuc

SEQ ID NO: 351833 - RNA, 65 nt, hsa
ucuuauucuuuuuaaauuuuaaauauuuuguuauaaauacucacaggauaccuuauuucccuagc

SEQ ID NO: 351834 - RNA, 57 nt, hsa
cgagacaugguccagccuaagcuuacuaauacucacuuagugauuuguaaaauuugc

SEQ ID NO: 351835 - RNA, 65 nt, hsa
acucaugagggcuuccaaugugcugccccccucuuaauacucaccaauaaauucuacuuccuguc

SEQ ID NO: 351836 - RNA, 65 nt, hsa
gaaguuuaauuuaauacuguuuuuuuucuugaaggaauacucacauacaugguuugaaaugugca

SEQ ID NO: 351837 - RNA, 65 nt, hsa
acacacauauauauacucacacacauauagcauaaaauacucagcagggcuaguuauuccgauuu

SEQ ID NO: 351838 - RNA, 65 nt, hsa
gagucucuagggcaaggagaaacaacuagcuggacaauacucaauucacaacuuagcauuuugcc

SEQ ID NO: 351839 - RNA, 65 nt, hsa
aguacugauugguucagcauauccugggacauaaaaauacucacuacugggaaaaacuuuuucaa

SEQ ID NO: 351840 - RNA, 65 nt, hsa
gagcaacaccaugcauauagauugaguacuuggagaauacucacguuuuuuaacucauguaguga

SEQ ID NO: 351841 - RNA, 65 nt, hsa
acaccccugcaaguggccaaagguggccuggguuuaauacucaagagaaugguggaagguuaaac

SEQ ID NO: 351842 - RNA, 65 nt, hsa
auuucuuuaaucaguuucucgacuuguauuuauuaaauacucaaacucaguauuaccuacucaau

SEQ ID NO: 351843 - RNA, 64 nt, hsa
uaagucaguguuaaaauuuuaguagguccgcuagcaguacuaaucaugugaggaaaugaugaga

SEQ ID NO: 351844 - RNA, 64 nt, hsa
ccuugaccgacaugaacuguacacagaauuguuccaguacuauggagugcucacaaaggauacu

SEQ ID NO: 351845 - RNA, 64 nt, hsa; identical to SEQ ID NO: 297037

SEQ ID NO: 351846 - RNA, 64 nt, hsa; identical to SEQ ID NO: 297038

SEQ ID NO: 351847 - RNA, 64 nt, hsa; identical to SEQ ID NO: 297039

SEQ ID NO: 351848 - RNA, 64 nt, hsa; identical to SEQ ID NO: 297040

SEQ ID NO: 351849 - RNA, 64 nt, hsa; identical to SEQ ID NO: 234645

SEQ ID NO: 351850 - RNA, 64 nt, hsa; identical to SEQ ID NO: 234646

SEQ ID NO: 351851 - RNA, 64 nt, hsa; identical to SEQ ID NO: 234647

SEQ ID NO: 351852 - RNA, 64 nt, hsa; identical to SEQ ID NO: 234648

SEQ ID NO: 351853 - RNA, 64 nt, hsa; identical to SEQ ID NO: 234649

SEQ ID NO: 351854 - RNA, 64 nt, hsa; identical to SEQ ID NO: 234650

SEQ ID NO: 351855 - RNA, 64 nt, hsa; identical to SEQ ID NO: 234651

SEQ ID NO: 351856 - RNA, 64 nt, hsa; identical to SEQ ID NO: 234652

SEQ ID NO: 351857 - RNA, 64 nt, hsa; identical to SEQ ID NO: 234653

SEQ ID NO: 351858 - RNA, 64 nt, hsa; identical to SEQ ID NO: 234654

SEQ ID NO: 351859 - RNA, 64 nt, hsa; identical to SEQ ID NO: 234655

SEQ ID NO: 351860 - RNA, 64 nt, hsa; identical to SEQ ID NO: 234656

SEQ ID NO: 351861 - RNA, 64 nt, hsa; identical to SEQ ID NO: 234657

SEQ ID NO: 351862 - RNA, 64 nt, hsa; identical to SEQ ID NO: 234658

SEQ ID NO: 351863 - RNA, 64 nt, hsa; identical to SEQ ID NO: 234659

SEQ ID NO: 351864 - RNA, 64 nt, hsa; identical to SEQ ID NO: 234660

SEQ ID NO: 351865 - RNA, 64 nt, hsa; identical to SEQ ID NO: 234661

SEQ ID NO: 351866 - RNA, 64 nt, hsa; identical to SEQ ID NO: 234662

SEQ ID NO: 351867 - RNA, 64 nt, hsa; identical to SEQ ID NO: 234663

SEQ ID NO: 351868 - RNA, 64 nt, hsa; identical to SEQ ID NO: 234664

SEQ ID NO: 351869 - RNA, 64 nt, hsa; identical to SEQ ID NO: 234665

SEQ ID NO: 351870 - RNA, 63 nt, hsa; identical to SEQ ID NO: 234666

SEQ ID NO: 351871 - RNA, 64 nt, hsa; identical to SEQ ID NO: 234667

SEQ ID NO: 351872 - RNA, 64 nt, hsa; identical to SEQ ID NO: 234668

SEQ ID NO: 351873 - RNA, 64 nt, hsa; identical to SEQ ID NO: 234669

SEQ ID NO: 351874 - RNA, 64 nt, hsa; identical to SEQ ID NO: 234670

SEQ ID NO: 351875 - RNA, 64 nt, hsa; identical to SEQ ID NO: 234671

SEQ ID NO: 351876 - RNA, 64 nt, hsa; identical to SEQ ID NO: 234672

SEQ ID NO: 351877 - RNA, 64 nt, hsa; identical to SEQ ID NO: 234673

SEQ ID NO: 351878 - RNA, 64 nt, hsa; identical to SEQ ID NO: 234674

SEQ ID NO: 351879 - RNA, 64 nt, hsa; identical to SEQ ID NO: 234675

SEQ ID NO: 351880 - RNA, 64 nt, hsa; identical to SEQ ID NO: 234676

SEQ ID NO: 351881 - RNA, 64 nt, hsa; identical to SEQ ID NO: 234677

SEQ ID NO: 351882 - RNA, 64 nt, hsa; identical to SEQ ID NO: 234678

SEQ ID NO: 351883 - RNA, 64 nt, hsa; identical to SEQ ID NO: 234679

SEQ ID NO: 351884 - RNA, 64 nt, hsa; identical to SEQ ID NO: 234680

SEQ ID NO: 351885 - RNA, 64 nt, hsa; identical to SEQ ID NO: 234681

SEQ ID NO: 351886 - RNA, 64 nt, hsa; identical to SEQ ID NO: 234682

SEQ ID NO: 351887 - RNA, 64 nt, hsa; identical to SEQ ID NO: 234683

SEQ ID NO: 351888 - RNA, 64 nt, hsa; identical to SEQ ID NO: 234684

SEQ ID NO: 351889 - RNA, 64 nt, hsa; identical to SEQ ID NO: 234685

SEQ ID NO: 351890 - RNA, 64 nt, hsa; identical to SEQ ID NO: 234686

SEQ ID NO: 351891 - RNA, 64 nt, hsa; identical to SEQ ID NO: 234687

SEQ ID NO: 351892 - RNA, 64 nt, hsa; identical to SEQ ID NO: 234688

SEQ ID NO: 351893 - RNA, 64 nt, hsa; identical to SEQ ID NO: 234689

SEQ ID NO: 351894 - RNA, 64 nt, hsa; identical to SEQ ID NO: 234690

SEQ ID NO: 351895 - RNA, 64 nt, hsa; identical to SEQ ID NO: 234691

SEQ ID NO: 351896 - RNA, 64 nt, hsa; identical to SEQ ID NO: 234692

SEQ ID NO: 351897 - RNA, 64 nt, hsa; identical to SEQ ID NO: 234693

SEQ ID NO: 351898 - RNA, 64 nt, hsa; identical to SEQ ID NO: 234694

SEQ ID NO: 351899 - RNA, 64 nt, hsa; identical to SEQ ID NO: 234695

SEQ ID NO: 351900 - RNA, 64 nt, hsa; identical to SEQ ID NO: 234696

SEQ ID NO: 351901 - RNA, 64 nt, hsa; identical to SEQ ID NO: 53771

SEQ ID NO: 351902 - RNA, 64 nt, hsa; identical to SEQ ID NO: 53772

SEQ ID NO: 351903 - RNA, 64 nt, hsa; identical to SEQ ID NO: 53773

SEQ ID NO: 351904 - RNA, 64 nt, hsa; identical to SEQ ID NO: 53774

SEQ ID NO: 351905 - RNA, 64 nt, hsa; identical to SEQ ID NO: 53775

SEQ ID NO: 351906 - RNA, 64 nt, hsa; identical to SEQ ID NO: 53776

SEQ ID NO: 351907 - RNA, 64 nt, hsa; identical to SEQ ID NO: 53777

SEQ ID NO: 351908 - RNA, 64 nt, hsa; identical to SEQ ID NO: 53778

SEQ ID NO: 351909 - RNA, 64 nt, hsa; identical to SEQ ID NO: 53779

SEQ ID NO: 351910 - RNA, 64 nt, hsa; identical to SEQ ID NO: 53780

SEQ ID NO: 351911 - RNA, 64 nt, hsa; identical to SEQ ID NO: 53781

SEQ ID NO: 351912 - RNA, 64 nt, hsa; identical to SEQ ID NO: 53782

SEQ ID NO: 351913 - RNA, 64 nt, hsa; identical to SEQ ID NO: 53783

SEQ ID NO: 351914 - RNA, 64 nt, hsa; identical to SEQ ID NO: 53784

SEQ ID NO: 351915 - RNA, 64 nt, hsa; identical to SEQ ID NO: 53785

SEQ ID NO: 351916 - RNA, 64 nt, hsa; identical to SEQ ID NO: 53786

SEQ ID NO: 351917 - RNA, 64 nt, hsa; identical to SEQ ID NO: 53787

SEQ ID NO: 351918 - RNA, 64 nt, hsa; identical to SEQ ID NO: 53788

SEQ ID NO: 351919 - RNA, 64 nt, hsa; identical to SEQ ID NO: 53789

SEQ ID NO: 351920 - RNA, 64 nt, hsa; identical to SEQ ID NO: 53790

SEQ ID NO: 351921 - RNA, 64 nt, hsa; identical to SEQ ID NO: 53791

SEQ ID NO: 351922 - RNA, 64 nt, hsa; identical to SEQ ID NO: 53792

SEQ ID NO: 351923 - RNA, 64 nt, hsa; identical to SEQ ID NO: 53793

SEQ ID NO: 351924 - RNA, 64 nt, hsa; identical to SEQ ID NO: 53794

SEQ ID NO: 351925 - RNA, 64 nt, hsa; identical to SEQ ID NO: 53795

SEQ ID NO: 351926 - RNA, 64 nt, hsa; identical to SEQ ID NO: 53796

SEQ ID NO: 351927 - RNA, 64 nt, hsa; identical to SEQ ID NO: 53797

SEQ ID NO: 351928 - RNA, 64 nt, hsa; identical to SEQ ID NO: 53798

SEQ ID NO: 351929 - RNA, 64 nt, hsa; identical to SEQ ID NO: 53799

SEQ ID NO: 351930 - RNA, 64 nt, hsa; identical to SEQ ID NO: 53800

SEQ ID NO: 351931 - RNA, 64 nt, hsa; identical to SEQ ID NO: 53801

SEQ ID NO: 351932 - RNA, 64 nt, hsa; identical to SEQ ID NO: 53802

SEQ ID NO: 351933 - RNA, 64 nt, hsa; identical to SEQ ID NO: 53803

SEQ ID NO: 351934 - RNA, 64 nt, hsa; identical to SEQ ID NO: 53804

SEQ ID NO: 351935 - RNA, 64 nt, hsa; identical to SEQ ID NO: 53805

SEQ ID NO: 351936 - RNA, 64 nt, hsa; identical to SEQ ID NO: 53806

SEQ ID NO: 351937 - RNA, 64 nt, hsa; identical to SEQ ID NO: 53807

SEQ ID NO: 351938 - RNA, 64 nt, hsa; identical to SEQ ID NO: 53808

SEQ ID NO: 351939 - RNA, 64 nt, hsa; identical to SEQ ID NO: 53809

SEQ ID NO: 351940 - RNA, 64 nt, hsa; identical to SEQ ID NO: 53810

SEQ ID NO: 351941 - RNA, 64 nt, hsa; identical to SEQ ID NO: 53811

SEQ ID NO: 351942 - RNA, 64 nt, hsa; identical to SEQ ID NO: 53812

SEQ ID NO: 351943 - RNA, 64 nt, hsa; identical to SEQ ID NO: 53813

SEQ ID NO: 351944 - RNA, 64 nt, hsa; identical to SEQ ID NO: 53814

SEQ ID NO: 351945 - RNA, 64 nt, hsa; identical to SEQ ID NO: 53815

SEQ ID NO: 351946 - RNA, 64 nt, hsa
ggcaacaaugagcagaccaaccuaaauuuggggaaauuaggagaggcagagauagaaccuggag

SEQ ID NO: 351947 - RNA, 64 nt, hsa
ccacuccuggcugagagaggaagagcugcaacggaauuaggaagaccaagacacagaucacccg

SEQ ID NO: 351948 - RNA, 64 nt, hsa
aaaugugucauacuguuuuaggaucaagacuaggaauuaggagccagguugacaaggacuuuuu

SEQ ID NO: 351949 - RNA, 64 nt, hsa
gucuuuagagguauuuugauuuaaaguauacuuaaauuaggauuucuuaaagaaaacauaggga

SEQ ID NO: 351950 - RNA, 64 nt, hsa
ccaggcagacucagacacagggaaggaggcuuggaauuaggaugggaucgcgagagagaugaaa

SEQ ID NO: 351951 - RNA, 54 nt, hsa
uuguucacuuucuaacuugauuggaauuaggaaagguaagaaucgccuuaauuu

SEQ ID NO: 351952 - RNA, 64 nt, hsa
agagacugggauuagggguucugugcucuugccuaauuaggaacauucucccaugucucuugug

SEQ ID NO: 351953 - RNA, 64 nt, hsa
aauuauuuucucacagucuggugagcaggcaauuaauuaggaguaagggggccuaguagagcgu

SEQ ID NO: 351954 - RNA, 64 nt, hsa
uuucuucuucacaggccuucuuucaaggcaaauugaaaaucacuggcaacaugggucucgcuau

SEQ ID NO: 351955 - RNA, 64 nt, hsa
gcuaagcucugaagaacucccuuuggcuacuuuugaaaaucaagaugagauauauagauauaua

SEQ ID NO: 351956 - RNA, 64 nt, hsa
cuucaacgccagugacuguguaccuccagcagaagaaaaucaggugucuggucuugggggcacu

SEQ ID NO: 351957 - RNA, 64 nt, hsa
aagcccugaagucgggagaggugaccacaggucugaaaaucagccagugccaacauugcuugcc

SEQ ID NO: 351958 - RNA, 64 nt, hsa
uuguuaauaaacuauuaugcagcaucuacacuuugaaaaucaaguacuucaaaacgcauacugc

SEQ ID NO: 351959 - RNA, 64 nt, hsa
acuuucauugguaaaacuuuuaaauucaacaccugaaaaucaugagggaaaaugauuaccucuu

SEQ ID NO: 351960 - RNA, 64 nt, hsa
guucuauaccagaaugggaaauuuccccaaaucagaaaaucacauccuaacaaagaagucuguc

SEQ ID NO: 351961 - RNA, 64 nt, hsa
ugaaauaauaaggccgauuuucauauaaauguaugaaaaucaaccauguuuucucucacccucu

SEQ ID NO: 351962 - RNA, 64 nt, hsa
uauguaauaagguuuauuucugugaguuuuguaugaaaaucagccucauuauuuauaguugaau

SEQ ID NO: 351963 - RNA, 64 nt, hsa
guucuaagaaaugcauaguuagggaaucuugugugaaaaucagcuuguauuuacacaaacccag

SEQ ID NO: 351964 - RNA, 64 nt, hsa
ucagugcauuuauuguacauuuuaagaaaaaggugaaaaucauuuggggaguaaaaaaaugaaa

SEQ ID NO: 351965 - RNA, 64 nt, hsa
aaugugaauuuugccagaggugguuuuugaacaggaaaaucauaauucauaucauuggagaagu

SEQ ID NO: 351966 - RNA, 64 nt, hsa
aauaucaaauugaagaaaaacucaauccucccaugaaaaucaguucgccuggccuccaagucgu

SEQ ID NO: 351967 - RNA, 64 nt, hsa
gaaaaacaaaaaagaagaauaaaauaauuuggaugaaaaucauguuuauuuaaauaguaauguc

SEQ ID NO: 351968 - RNA, 64 nt, hsa
caugagacuauuaaagaugugccagaguuucaaugaaaaucauuaaaguaggacagcuaagaaa

SEQ ID NO: 351969 - RNA, 64 nt, hsa
aaacaaaauuucuucauggaaaucauauacauuagaaaaucacagucagauguuuaaucaaucc

SEQ ID NO: 351970 - RNA, 64 nt, hsa
cugcccugcucagcagucaccauagcagcugacugaaaaucagcacugccugaguaguuuugau

SEQ ID NO: 351971 - RNA, 64 nt, hsa
gaaacuagguaacagguucuuaaauaguucaugugaaaaucaugacagacuaaggcaguggcug

SEQ ID NO: 351972 - RNA, 64 nt, hsa
uugggugcaaguaaagauugagcaggaaauaaaggaaaaucaaguauaaucccugagauuugua

SEQ ID NO: 351973 - RNA, 64 nt, hsa
auaaauaaaaguacaguuuucuugguggcagaaugaaaaucagcaacuucuagcauauagacua

SEQ ID NO: 351974 - RNA, 64 nt, hsa
acuuuguagaaagcaaacaaaauuguucuugggagaaaaucaacuuuuagauuaaaaaaauuuu

SEQ ID NO: 351975 - RNA, 64 nt, hsa
ugaacacaauugauacuucaggugcuuuugaugugaaaaucaugaaaagaggaacagguggaug

SEQ ID NO: 351976 - RNA, 64 nt, hsa
ucuucacucccaauaacuaaugcuaagaaaugcugaaaaucaaaguaaaaaauuaaagcccaua

SEQ ID NO: 351977 - RNA, 64 nt, hsa
auaauuuuacuauuucuuuuaaaaguauguuuuggaaaaucaaugauuuuaaugcauagcagua

SEQ ID NO: 351978 - RNA, 64 nt, hsa
cauguaugaugugcauauaugcuaaaagaaugcagaaaaucauuuuaugaauagccaaauuugg

SEQ ID NO: 351979 - RNA, 64 nt, hsa
uugaaauauauagauuauuguaaccuuucaaccugaaaaucaagcaguaugagaguuuaguuau

SEQ ID NO: 351980 - RNA, 64 nt, hsa
gcaacagaguaagacaaaaaaauauauauauauugaaaaucaaaggaggcaaaauuuugacagg

SEQ ID NO: 351981 - RNA, 64 nt, hsa
gaaacaccuagaauaauguuugaccuuauaauuggaaaaucagagcaaaaguuaaaucucaaaa

SEQ ID NO: 351982 - RNA, 64 nt, hsa
aucuuggacgcuaccuuacaauaacuagacaaaggaaaaucauccuuuguccuguucuguguaa

SEQ ID NO: 351983 - RNA, 64 nt, hsa
cauuauuuuucauuuuguuuguucuaagaggauugaaaaucaguuuaguuuaaaugucuuucug

SEQ ID NO: 351984 - RNA, 64 nt, hsa
cauuaaaaugcaaauuuuccuauuuauuugaguagaaaaucacuuaccagugagcauauauauu

SEQ ID NO: 351985 - RNA, 64 nt, hsa
uggcacaucaucauaauccauuuucucuuugcuagaaaaucagcccauagagugcauucccaaa

SEQ ID NO: 351986 - RNA, 64 nt, hsa
ccaguauccccacaaaacaaguuaaaacuuaagugaaaaucauucugcuuuugaaucuuaaaag

SEQ ID NO: 351987 - RNA, 64 nt, hsa
caagauguacuaaauauguauauuagaaauuauagaaaaucauguuguccguuuucaaauucau

SEQ ID NO: 351988 - RNA, 64 nt, hsa
gacaugugcugcuaguuuauaaacuggcauugacgaaaaucauuugaaucucuucuggcugaga

SEQ ID NO: 351989 - RNA, 64 nt, hsa
caaauguaacucccacauugaguuuaucuauauugaaaaucauuuacauuggccuauauuugga

SEQ ID NO: 351990 - RNA, 64 nt, hsa
uccucugaggaggaguuuuuaauuguauuugcuagaaaaucaggauguaauaaagauuuguaua

SEQ ID NO: 351991 - RNA, 64 nt, hsa
cuuugagggcaugcuucccauacaaagagcaucagaaaaucagggcaaucaucuagaucucaca

SEQ ID NO: 351992 - RNA, 64 nt, hsa
acugugugcaggaagucucgugagaauauacuuagaaaaucacacuuaucuggaaauucaauaa

SEQ ID NO: 351993 - RNA, 64 nt, hsa
aggagggaguaacagaaagagcaaggcuguuuuugaaaaucauuacacuuucacuagaagccca

SEQ ID NO: 351994 - RNA, 64 nt, hsa
uaugacauuuuaugagcuguuuacggcauggaaagaaaaucagugggaauuaagaaagccucgu

SEQ ID NO: 351995 - RNA, 64 nt, hsa
agaacuuuaauuugcacuaccagucucccaaauagaaaaucauguauaguauuucauaguaaua

SEQ ID NO: 351996 - RNA, 64 nt, hsa
uccugcuuucuuuugcgguaggacuuggcugugagaaaaucaccuaaaucccagaaaagaggaa

SEQ ID NO: 351997 - RNA, 64 nt, hsa
gaaauuaacaagaacucauuauuuugagguagaggaaaaucaaugcuuuaucugauaugcugag

SEQ ID NO: 351998 - RNA, 64 nt, hsa
aacaaagcaaauuucauuaucuaaugaguugcuggaaaaucauauugagaauaauuauuucaga

SEQ ID NO: 351999 - RNA, 64 nt, hsa
aaauacacuauagagucaaaauaccauuuacaaagaaaaucaaaagcauuucuauauuuugucu

SEQ ID NO: 352000 - RNA, 64 nt, hsa
ucguaaguuagcaaaagaaauuuuuuucaccuuugaaaaucacgugauguuaaaggacaaaugc

SEQ ID NO: 352001 - RNA, 64 nt, hsa
uccaaaagucacuuuugaaugugaacaaaaggaagaaaaucaaggaaagaaugagucuaauauc

SEQ ID NO: 352002 - RNA, 64 nt, hsa
guacgagauuuagucaacuuguugaagagcuauugaaaaucauuugugcuuuucagcuugacac

SEQ ID NO: 352003 - RNA, 64 nt, hsa
acaggagaaaggccuuaugaaugcguugaguguggaaaaucauuucgccgaagcucuucacucu

SEQ ID NO: 352004 - RNA, 64 nt, hsa
acuggagaaaggccauaugaaugcauugauuguggaaaaucauuucgccacaguucuucguucc

SEQ ID NO: 352005 - RNA, 64 nt, hsa
gccugucuucagagaacccacuagaagcaacuaggaaaaucacuugccaaaauccaaggcaauu

SEQ ID NO: 352006 - RNA, 64 nt, hsa
ucuccaaagccuugugugaacucaccaaacacaagaaaaucaaauauauaaccaauagugaaau

SEQ ID NO: 352007 - RNA, 64 nt, hsa
ggaacuuuuaaugaaggacagugucuucuuugaagaaaaucaagcucguguuuuuauucgaagc

SEQ ID NO: 352008 - RNA, 64 nt, hsa
gauuaaaaaaaacacaucuaguaagacguaaggggaaaaucacauccucuuuggagaugauuau

SEQ ID NO: 352009 - RNA, 64 nt, hsa
uuagacucccugagguuccguuuuacacaugauccaacguuaacuaccuuuuuuucuguaugcu

SEQ ID NO: 352010 - RNA, 64 nt, hsa
uaguggugaaaggagacuaguagcaucuuuucuacaacguuaaaauugcagaaguagcuuauca

SEQ ID NO: 352011 - RNA, 64 nt, hsa
cguaguaaaugaugcuucgguuugauggaccuuucaacguuauuuauugaauauguauuucggu

SEQ ID NO: 352012 - RNA, 64 nt, hsa
auuuuacuaaggcagcuaagacauauucagacaucaacguuauccuucuuuuucauauuucuac

SEQ ID NO: 352013 - RNA, 64 nt, hsa
aggaaguaggaaacuguagggccagagaguaguacaacguuaaauuguccgauuuauguguauu

SEQ ID NO: 352014 - RNA, 64 nt, hsa
ucugcuacagcguaaaauuagacuggaaauaagacaacguuaaguaaaaagcuucuuuuaccua

SEQ ID NO: 352015 - RNA, 64 nt, hsa
cucuguacucaaaccuguggcaaauucauccuagcaacguuauuugacgaggggcaugaacauu

SEQ ID NO: 352016 - RNA, 64 nt, hsa
ccaggaguauuagacuagcuaauaguaaaggccucaacguuauucuuuacuucauguugaaaac

SEQ ID NO: 352017 - RNA, 64 nt, hsa
ccuucaugggagacaacgauaacgaaaccuuggccaacguuaccucagccaccugggacuucga

SEQ ID NO: 352018 - RNA, 64 nt, hsa
ucuuuuuugugugauuuaagacacuuuuuggacucaacguuacauuuuugaauguaguaaguaa

SEQ ID NO: 352019 - RNA, 64 nt, hsa
aaggcaaagguaucucuuagaaguaaaucuccuucaacguuauauauguacagaagaaaaaaag

SEQ ID NO: 352020 - RNA, 64 nt, hsa
cuuauacaaauaaccuacaugccagauuucuauucaacguuagaguuuaacaaaauacuccuag

SEQ ID NO: 352021 - RNA, 64 nt, hsa
ggaucugacaacaaacugauuuauagacauuaugcaacguuauauuuugucuucuguguggauu

SEQ ID NO: 352022 - RNA, 64 nt, hsa
ucaccuuaggucacgaguuugagaccagccugaccaacguuaaguaaccccgucuuuacuaaaa

SEQ ID NO: 352023 - RNA, 64 nt, hsa
guauguuacaauagauagugucauguugcagguucaacguuauuuacauguaaauagacaaaag

SEQ ID NO: 352024 - RNA, 64 nt, hsa
gugguauacggugucagguuucaggguuuuuuuucaacguuaaauauucuagaaacuuucugaa

SEQ ID NO: 352025 - RNA, 64 nt, hsa
gagaauguauuuccuuuucuaaauccuuguuaagcaacguuaguagaacuuacugcugaccuuu

SEQ ID NO: 352026 - RNA, 64 nt, hsa
aggauaaaaacuuucagaaugagcaaaacaccaucaacguuaauuccagagauggaacauuuuu

SEQ ID NO: 352027 - RNA, 64 nt, hsa
uuuaugggguauaguggccaaauagcacauccuccaacguuaaaagacaguggaucaugaaaag

SEQ ID NO: 352028 - RNA, 64 nt, hsa
caggccaacucauacucauuuggaucuauuuagacaacguuaaccaauauaucuauagcuuuag

SEQ ID NO: 352029 - RNA, 64 nt, hsa
ggugggccgagggugucuagggguucugccuggucaacguuauuugucgucccaucuuuuggca

SEQ ID NO: 352030 - RNA, 64 nt, hsa
uauauaaaaugugucacagaaaaacacgcauuugcaacguuaaccuaacgaaauuuccaugaag

SEQ ID NO: 352031 - RNA, 64 nt, hsa
auuuucuaauccgcuguuuuaggguagacacugacaacguuauguguggucuuuaaccuguugu

SEQ ID NO: 352032 - RNA, 64 nt, hsa
gcuccuccucggaaccgcucaccuagagccagaccaacguuacucagggcuccucccagcuugu

SEQ ID NO: 352033 - RNA, 64 nt, hsa
uuuugugaccuuuuuuguaaacuaagugccguuucaacguuacaaucauuuuuaggguuauugu

SEQ ID NO: 352034 - RNA, 64 nt, hsa
gccuaugaguugugugaagcucuuggcuuuuuuccaacguuacuuuguaacuaaugagggugga

SEQ ID NO: 352035 - RNA, 64 nt, hsa
guugcuacuguuugccucaaacgcuguguuuaaacaacguuaaacucuuagccuacaagguggc

SEQ ID NO: 352036 - RNA, 64 nt, hsa
uuacuguuuuuagaugaauguacgaugagaaauucaacguuaauaauucuggauuuucuuauca

SEQ ID NO: 352037 - RNA, 64 nt, hsa
uuuuaaacaggugaucacguuucguguucauacucaacguuaauaaaaggagagaguuuguagu

SEQ ID NO: 352038 - RNA, 64 nt, hsa
gaaaagacaagcgagagcacacuauucucauugccaacguuaaaccuuauuuaaaagccaaacg

SEQ ID NO: 352039 - RNA, 64 nt, hsa
uuauacuguagcaaauacauuuaaaaauuaaucacaacguuaagaugaaauuauauuuuuggaa

SEQ ID NO: 352040 - RNA, 64 nt, hsa
aaagagauaagcauuaaaccuauugugcuguuaacaacguuaguggacacuuguaagucaauca

SEQ ID NO: 352041 - RNA, 64 nt, hsa
accaaggggaaggggagagaaaggaaauaaagaacaacguuauuucuuaacagacuuucuauag

SEQ ID NO: 352042 - RNA, 64 nt, hsa
cacuucucagagauaucuucccaggugcccaucccaacguuacuauuauaucauaauuugauuc

SEQ ID NO: 352043 - RNA, 64 nt, hsa
caaagaaaucauaggugaaacccccuacccuccccaacguuaaaugcucgagaggaaucuucca

SEQ ID NO: 352044 - RNA, 64 nt, hsa
gcccuuuagccauauugaaaacaaauaucuuuuucaacguuaucuuagcucuacuaguugaucu

SEQ ID NO: 352045 - RNA, 64 nt, hsa
cucuuuuugaugaguuucugaaacuggagcgguucaacguuauccagugugaaaaucagugagu

SEQ ID NO: 352046 - RNA, 64 nt, hsa
ccuccagauagccacugccuuuuccucaagggagcaacguuagcuuuccugaaugaugaaguuu

SEQ ID NO: 352047 - RNA, 64 nt, hsa
uuucaccagccuaaggccuggcugaccaggaagccaacguuaacuugcaggccacgugacauaa

SEQ ID NO: 352048 - RNA, 64 nt, hsa; identical to SEQ ID NO: 157838

SEQ ID NO: 352049 - RNA, 64 nt, hsa; identical to SEQ ID NO: 157839

SEQ ID NO: 352050 - RNA, 64 nt, hsa; identical to SEQ ID NO: 157840

SEQ ID NO: 352051 - RNA, 64 nt, hsa; identical to SEQ ID NO: 157841

SEQ ID NO: 352052 - RNA, 64 nt, hsa; identical to SEQ ID NO: 157842

SEQ ID NO: 352053 - RNA, 64 nt, hsa; identical to SEQ ID NO: 157843

SEQ ID NO: 352054 - RNA, 64 nt, hsa; identical to SEQ ID NO: 157844

SEQ ID NO: 352055 - RNA, 64 nt, hsa; identical to SEQ ID NO: 157845

SEQ ID NO: 352056 - RNA, 64 nt, hsa; identical to SEQ ID NO: 157846

SEQ ID NO: 352057 - RNA, 64 nt, hsa; identical to SEQ ID NO: 157847

SEQ ID NO: 352058 - RNA, 64 nt, hsa; identical to SEQ ID NO: 157848

SEQ ID NO: 352059 - RNA, 64 nt, hsa; identical to SEQ ID NO: 157849

SEQ ID NO: 352060 - RNA, 64 nt, hsa; identical to SEQ ID NO: 157850

SEQ ID NO: 352061 - RNA, 64 nt, hsa; identical to SEQ ID NO: 157851

SEQ ID NO: 352062 - RNA, 64 nt, hsa; identical to SEQ ID NO: 157852

SEQ ID NO: 352063 - RNA, 64 nt, hsa; identical to SEQ ID NO: 157853

SEQ ID NO: 352064 - RNA, 64 nt, hsa; identical to SEQ ID NO: 157854

SEQ ID NO: 352065 - RNA, 64 nt, hsa; identical to SEQ ID NO: 157855

SEQ ID NO: 352066 - RNA, 64 nt, hsa; identical to SEQ ID NO: 157856

SEQ ID NO: 352067 - RNA, 64 nt, hsa; identical to SEQ ID NO: 157857

SEQ ID NO: 352068 - RNA, 64 nt, hsa; identical to SEQ ID NO: 157858

SEQ ID NO: 352069 - RNA, 64 nt, hsa; identical to SEQ ID NO: 157859

SEQ ID NO: 352070 - RNA, 64 nt, hsa; identical to SEQ ID NO: 157860

SEQ ID NO: 352071 - RNA, 64 nt, hsa; identical to SEQ ID NO: 157861

SEQ ID NO: 352072 - RNA, 64 nt, hsa; identical to SEQ ID NO: 157862

SEQ ID NO: 352073 - RNA, 64 nt, hsa; identical to SEQ ID NO: 157863

SEQ ID NO: 352074 - RNA, 64 nt, hsa; identical to SEQ ID NO: 157864

SEQ ID NO: 352075 - RNA, 64 nt, hsa; identical to SEQ ID NO: 157865

SEQ ID NO: 352076 - RNA, 64 nt, hsa; identical to SEQ ID NO: 157866

SEQ ID NO: 352077 - RNA, 64 nt, hsa; identical to SEQ ID NO: 157867

SEQ ID NO: 352078 - RNA, 64 nt, hsa; identical to SEQ ID NO: 157868

SEQ ID NO: 352079 - RNA, 64 nt, hsa; identical to SEQ ID NO: 157869

SEQ ID NO: 352080 - RNA, 64 nt, hsa; identical to SEQ ID NO: 157870

SEQ ID NO: 352081 - RNA, 64 nt, hsa; identical to SEQ ID NO: 157871

SEQ ID NO: 352082 - RNA, 64 nt, hsa; identical to SEQ ID NO: 157872

SEQ ID NO: 352083 - RNA, 64 nt, hsa; identical to SEQ ID NO: 157873

SEQ ID NO: 352084 - RNA, 64 nt, hsa; identical to SEQ ID NO: 157874

SEQ ID NO: 352085 - RNA, 64 nt, hsa; identical to SEQ ID NO: 157875

SEQ ID NO: 352086 - RNA, 64 nt, hsa; identical to SEQ ID NO: 157876

SEQ ID NO: 352087 - RNA, 64 nt, hsa; identical to SEQ ID NO: 157877

SEQ ID NO: 352088 - RNA, 64 nt, hsa; identical to SEQ ID NO: 157878

SEQ ID NO: 352089 - RNA, 64 nt, hsa; identical to SEQ ID NO: 157879

SEQ ID NO: 352090 - RNA, 64 nt, hsa; identical to SEQ ID NO: 157880

SEQ ID NO: 352091 - RNA, 64 nt, hsa; identical to SEQ ID NO: 157881

SEQ ID NO: 352092 - RNA, 64 nt, hsa; identical to SEQ ID NO: 157882

SEQ ID NO: 352093 - RNA, 64 nt, hsa; identical to SEQ ID NO: 157883

SEQ ID NO: 352094 - RNA, 64 nt, hsa; identical to SEQ ID NO: 157884

SEQ ID NO: 352095 - RNA, 64 nt, hsa; identical to SEQ ID NO: 157885

SEQ ID NO: 352096 - RNA, 64 nt, hsa; identical to SEQ ID NO: 157886

SEQ ID NO: 352097 - RNA, 64 nt, hsa; identical to SEQ ID NO: 157887

SEQ ID NO: 352098 - RNA, 64 nt, hsa; identical to SEQ ID NO: 157888

SEQ ID NO: 352099 - RNA, 64 nt, hsa; identical to SEQ ID NO: 157889

SEQ ID NO: 352100 - RNA, 64 nt, hsa
agagaguccaagcuggugaacuauuaagcuguuuaaagaucacccuuggccuggcacagugguu

SEQ ID NO: 352101 - RNA, 64 nt, hsa
gucuguuaauuuaugacaugaucucggaauggaaaaagaucauuucagagugugcgaaauaaua

SEQ ID NO: 352102 - RNA, 64 nt, hsa
ccccaacuaaaggauauuaaaguuaggggaaagaaaagaucauugaaagucaugauaauuucug

SEQ ID NO: 352103 - RNA, 64 nt, hsa
guaaauuauaguauauguaaguagcuaaugaaguaaagaucaugaagaaagaaauugauaggug

SEQ ID NO: 352104 - RNA, 64 nt, hsa
agucaacacaagauggcaaaucaggaucaggugaaaagaucaagaaacgugugaaaacucccua

SEQ ID NO: 352105 - RNA, 64 nt, hsa
uuuuauauguagaaaagugggguccuuuugaauaaaagaucauucaacuaaaaauauuaaaauu

SEQ ID NO: 352106 - RNA, 64 nt, hsa
ucuccacuuuaaccucuucuaaaauacccaaccaaaagaucacuguuucucucaacacuauuua

SEQ ID NO: 352107 - RNA, 64 nt, hsa
cuugaacauuguuauuuauauuuuuuaaaauggaaaagaucacuauguuuguugugcuaaccac

SEQ ID NO: 352108 - RNA, 64 nt, hsa
gaaauggaaaauaaucuaacucgaaggcgccugaaaagaucaaauucuauaucccagauaccuu

SEQ ID NO: 352109 - RNA, 64 nt, hsa
uauuggauuuguagguccugugccaccaaaacccaaagaucaaagguccaucaucaaaacacca

SEQ ID NO: 352110 - RNA, 64 nt, hsa
agaaaaagauaaggaaagaagagagaagagagacaaagaucacuacagaccaaaacagaagaag

SEQ ID NO: 352111 - RNA, 64 nt, hsa
gccuuuugagauucuccaacuugacaaaugugccaaagaucaacagacagaaaauaucauccug

SEQ ID NO: 352112 - RNA, 64 nt, hsa
uuuaaugguggaacaaauguuaaacugcucaucuaaagaucauguugauauuauuccagguuuu

SEQ ID NO: 352113 - RNA, 64 nt, hsa
aauucuuuuuaauugaagaugucuugagcucugcaaagaucagagcaggugagcauccacuuug

SEQ ID NO: 352114 - RNA, 64 nt, hsa
uuaccauuaaauucacacaugaaagauuaaucugaaagaucagagaccauguuauuccugacca

SEQ ID NO: 352115 - RNA, 64 nt, hsa
gcaacacagucacugcuguggucauuuguaauguaaagaucaguuauauauauauauuuguaau

SEQ ID NO: 352116 - RNA, 64 nt, hsa
uggacacauuauaucuccaacaagguguggguggaaagaucaaauuaaccugcuuuuuugaaag

SEQ ID NO: 352117 - RNA, 64 nt, hsa
auuucuaggaacccccaaaaggagaauaguaaaaaaagaucauacuuaaaauuuguauuacaau

SEQ ID NO: 352118 - RNA, 64 nt, hsa
agauuuuggaauucgugcaggaagccaugaaaggaaagaucagugaagacagcaaucacgguuc

SEQ ID NO: 352119 - RNA, 64 nt, hsa
gccacuccagcgucaucggacucucucuuauuacaaagaucacugcccaggaccaucuucccga

SEQ ID NO: 352120 - RNA, 64 nt, hsa
cuugaaagcgaaauacuugaaaagaggugaccauaaagaucacaccaauuuagaaugaauauua

SEQ ID NO: 352121 - RNA, 64 nt, hsa
uacccuuuuccaaccuaccucacaagguuaucagaaagaucaaauuaaauaauagaugugaaaa

SEQ ID NO: 352122 - RNA, 64 nt, hsa; identical to SEQ ID NO: 170678

SEQ ID NO: 352123 - RNA, 60 nt, hsa; identical to SEQ ID NO: 170679

SEQ ID NO: 352124 - RNA, 64 nt, hsa; identical to SEQ ID NO: 170680

SEQ ID NO: 352125 - RNA, 64 nt, hsa; identical to SEQ ID NO: 170681

SEQ ID NO: 352126 - RNA, 64 nt, hsa; identical to SEQ ID NO: 170682

SEQ ID NO: 352127 - RNA, 64 nt, hsa; identical to SEQ ID NO: 170683

SEQ ID NO: 352128 - RNA, 64 nt, hsa; identical to SEQ ID NO: 170684

SEQ ID NO: 352129 - RNA, 64 nt, hsa; identical to SEQ ID NO: 170685

SEQ ID NO: 352130 - RNA, 64 nt, hsa; identical to SEQ ID NO: 170686

SEQ ID NO: 352131 - RNA, 64 nt, hsa; identical to SEQ ID NO: 170687

SEQ ID NO: 352132 - RNA, 64 nt, hsa; identical to SEQ ID NO: 170688

SEQ ID NO: 352133 - RNA, 64 nt, hsa; identical to SEQ ID NO: 170689

SEQ ID NO: 352134 - RNA, 64 nt, hsa; identical to SEQ ID NO: 170690

SEQ ID NO: 352135 - RNA, 64 nt, hsa; identical to SEQ ID NO: 170691

SEQ ID NO: 352136 - RNA, 64 nt, hsa; identical to SEQ ID NO: 170692

SEQ ID NO: 352137 - RNA, 64 nt, hsa; identical to SEQ ID NO: 170693

SEQ ID NO: 352138 - RNA, 64 nt, hsa; identical to SEQ ID NO: 170694

SEQ ID NO: 352139 - RNA, 64 nt, hsa; identical to SEQ ID NO: 170695

SEQ ID NO: 352140 - RNA, 64 nt, hsa; identical to SEQ ID NO: 170696

SEQ ID NO: 352141 - RNA, 64 nt, hsa; identical to SEQ ID NO: 170697

SEQ ID NO: 352142 - RNA, 64 nt, hsa; identical to SEQ ID NO: 170698

SEQ ID NO: 352143 - RNA, 64 nt, hsa; identical to SEQ ID NO: 170699

SEQ ID NO: 352144 - RNA, 64 nt, hsa; identical to SEQ ID NO: 170700

SEQ ID NO: 352145 - RNA, 64 nt, hsa; identical to SEQ ID NO: 170701

SEQ ID NO: 352146 - RNA, 64 nt, hsa; identical to SEQ ID NO: 170702

SEQ ID NO: 352147 - RNA, 64 nt, hsa; identical to SEQ ID NO: 170703

SEQ ID NO: 352148 - RNA, 64 nt, hsa; identical to SEQ ID NO: 170704

SEQ ID NO: 352149 - RNA, 64 nt, hsa; identical to SEQ ID NO: 170705

SEQ ID NO: 352150 - RNA, 64 nt, hsa; identical to SEQ ID NO: 170706

SEQ ID NO: 352151 - RNA, 64 nt, hsa; identical to SEQ ID NO: 170707

SEQ ID NO: 352152 - RNA, 64 nt, hsa; identical to SEQ ID NO: 170708

SEQ ID NO: 352153 - RNA, 64 nt, hsa; identical to SEQ ID NO: 170709

SEQ ID NO: 352154 - RNA, 64 nt, hsa; identical to SEQ ID NO: 170710

SEQ ID NO: 352155 - RNA, 64 nt, hsa; identical to SEQ ID NO: 170711

SEQ ID NO: 352156 - RNA, 64 nt, hsa; identical to SEQ ID NO: 170712

SEQ ID NO: 352157 - RNA, 64 nt, hsa; identical to SEQ ID NO: 170713

SEQ ID NO: 352158 - RNA, 64 nt, hsa; identical to SEQ ID NO: 170714

SEQ ID NO: 352159 - RNA, 64 nt, hsa; identical to SEQ ID NO: 170715

SEQ ID NO: 352160 - RNA, 50 nt, hsa; identical to SEQ ID NO: 170716

SEQ ID NO: 352161 - RNA, 64 nt, hsa; identical to SEQ ID NO: 170717

SEQ ID NO: 352162 - RNA, 64 nt, hsa; identical to SEQ ID NO: 170718

SEQ ID NO: 352163 - RNA, 64 nt, hsa; identical to SEQ ID NO: 170719

SEQ ID NO: 352164 - RNA, 64 nt, hsa; identical to SEQ ID NO: 170720

SEQ ID NO: 352165 - RNA, 64 nt, hsa; identical to SEQ ID NO: 170721

SEQ ID NO: 352166 - RNA, 64 nt, hsa; identical to SEQ ID NO: 205245

SEQ ID NO: 352167 - RNA, 64 nt, hsa; identical to SEQ ID NO: 205246

SEQ ID NO: 352168 - RNA, 64 nt, hsa; identical to SEQ ID NO: 205247

SEQ ID NO: 352169 - RNA, 64 nt, hsa; identical to SEQ ID NO: 205248

SEQ ID NO: 352170 - RNA, 64 nt, hsa; identical to SEQ ID NO: 205249

SEQ ID NO: 352171 - RNA, 64 nt, hsa; identical to SEQ ID NO: 205250

SEQ ID NO: 352172 - RNA, 64 nt, hsa; identical to SEQ ID NO: 205251

SEQ ID NO: 352173 - RNA, 64 nt, hsa; identical to SEQ ID NO: 205252

SEQ ID NO: 352174 - RNA, 64 nt, hsa; identical to SEQ ID NO: 205253

SEQ ID NO: 352175 - RNA, 64 nt, hsa; identical to SEQ ID NO: 205254

SEQ ID NO: 352176 - RNA, 64 nt, hsa; identical to SEQ ID NO: 205255

SEQ ID NO: 352177 - RNA, 64 nt, hsa
aacacuuggugcugggaaccucaggguauugcuugccacuaagccaugaaaccagagacaaaau

SEQ ID NO: 352178 - RNA, 64 nt, hsa
uggucuagcuagaccugcacuguccaguacaguagccacuaaauacauguggcuaaacuuaaau

SEQ ID NO: 352179 - RNA, 64 nt, hsa
aaaacaaaguauugcuaaguacuauaacauauuggccacuaaaauucauauugagauuaucuug

SEQ ID NO: 352180 - RNA, 64 nt, hsa
ugaaaaaccuuuuguuuauuagcaccaauuucuugccacuaagcuauuuguuuuauuauacauc

SEQ ID NO: 352181 - RNA, 64 nt, hsa
ggccacggccacagucaugguggccacggccacagccacuaaucaggaggccaggccacccugc

SEQ ID NO: 352182 - RNA, 64 nt, hsa
gauggaccaguagacaacugguccacucagggcugccacuaaccuguagaacaccccugugcaa

SEQ ID NO: 352183 - RNA, 64 nt, hsa
guguuuaugaagaacagugaguaccuagaacugugccacuaauuaaaggaaauccuaagaaggu

SEQ ID NO: 352184 - RNA, 64 nt, hsa
ugagguguuugaggguguggacuggcauccagcagccacuaacaaacacacaacugguguguaa

SEQ ID NO: 352185 - RNA, 64 nt, hsa
gcauaggaccuaaccagugaagcuagaggcuacagccacuaaacuugcuucaggccaacgauag

SEQ ID NO: 352186 - RNA, 64 nt, hsa
ccacucugcugccccaccacgcggccugugaggagccacuaaaccuuuccgugccuagaccucc

SEQ ID NO: 352187 - RNA, 64 nt, hsa
gcaaccucgcugagggcagacuggggcauccugugccacuaaacuacauuguucuuauucuggc

SEQ ID NO: 352188 - RNA, 64 nt, hsa
uucugacgguagcuuuuggaggaagauuccugcagccacuaaugcauuguguaugauaacaaaa

SEQ ID NO: 352189 - RNA, 64 nt, hsa
aaagucaggagaucagaauuuuaaauuugacuuagccacuaacuagccauguaaccuugggaaa

SEQ ID NO: 352190 - RNA, 64 nt, hsa
gguucccagaagggagaucugggaggggucaggagccacuaaguugcuucacuccuuuuuucuc

SEQ ID NO: 352191 - RNA, 64 nt, hsa
gauguuuugacagucuccuagugcuccugguagugccacuaagggaaaaccaaggugcgcauuc

SEQ ID NO: 352192 - RNA, 64 nt, hsa
agauaggcuuagcaggaugggcgcaguggcucacgccacuaaucccaacauuuuaggaggccua

SEQ ID NO: 352193 - RNA, 64 nt, hsa
agaacaauggcuggguggaucgcacguaaagcuugccacuaaaaaucaaagcagagguuaacag

SEQ ID NO: 352194 - RNA, 64 nt, hsa
caguagugauaguuguaccgcaaugugacuuaaugccacuaaauugacacuuaaaaaugguuua

SEQ ID NO: 352195 - RNA, 64 nt, hsa
gugucuucagauagcccuguccuggugguauuuagccacuaaccuuugccugguacaguauggg

SEQ ID NO: 352196 - RNA, 64 nt, hsa
aacaugcucucuuuucaccccccaccuccugagagccacuaauguaagauacagaaacauagcu

SEQ ID NO: 352197 - RNA, 64 nt, hsa
uuccuugaaauuucucagcgggagucuccucacugccacuaaaauccacccagcccacuaacug

SEQ ID NO: 352198 - RNA, 64 nt, hsa
auagucacacauuuacaaauuuuucaagagguuagccacuaagacuuuaauaauuuuacaaggg

SEQ ID NO: 352199 - RNA, 64 nt, hsa
cuucccuaagucacauaucagaauaggaagauaugccacuaacuucuaaagaaguucaaacccu

SEQ ID NO: 352200 - RNA, 64 nt, hsa
aggcauuggccuugaaaaccuggacagcccagcagccacuaaggcucagauuguuaaagcucuc

SEQ ID NO: 352201 - RNA, 64 nt, hsa
cgcaaguaagagcuaauucauucauuccaugugugccacuaaauaaagagauugagcaagugcc

SEQ ID NO: 352202 - RNA, 64 nt, hsa
ccuggucuaguuuccugggccuuguggcucagcugccacuaaagagcuuuuuggauaaaauuga

SEQ ID NO: 352203 - RNA, 64 nt, hsa
auagauguuaaaaaugcaguuuggcuuaugaaaugccacuaauuaaaauaauuuaugcaaugaa

SEQ ID NO: 352204 - RNA, 64 nt, hsa
ugauuuuauagggaaucuaucuucuaggaucuaagccacuaaauaaaaggauaaaugaaugaug

SEQ ID NO: 352205 - RNA, 64 nt, hsa
aaaugcacaaagaagaaggcagugcuguuacuuggccacuaagauguguaaaauggacugaaau

SEQ ID NO: 352206 - RNA, 64 nt, hsa
cuuuuguuuguuuccaauugagucauuacugccugccacuaagaaacgugcuugaaucuaauaa

SEQ ID NO: 352207 - RNA, 64 nt, hsa
gcgaugaugguugcucaacauuuugaauguuaaugccacuaaauuguacccauaaaaaugguua

SEQ ID NO: 352208 - RNA, 64 nt, hsa
gucucacagaggccuggguucaagucccaccucugccacuaacuggcaugugacccuaucuauc

SEQ ID NO: 352209 - RNA, 64 nt, hsa
cauauuacauuucucauaguauggacaacuuuuugccacuaacugaauucuccaaauacucaca

SEQ ID NO: 352210 - RNA, 64 nt, hsa
cuuauuguugggaaagaacacuaguccuaccucugccacuaaugagguguuuggaggagguacc

SEQ ID NO: 352211 - RNA, 64 nt, hsa
ccagccugcugcagccuccuggggggcccuugaugccacuaaucccccgaccccccgcaucugc

SEQ ID NO: 352212 - RNA, 64 nt, hsa
uuuauucaggaccuaguaucugcaguccauguuggccacuaacugcuacauaauuacuuucaau

SEQ ID NO: 352213 - RNA, 64 nt, hsa
gaaaagaaaaaucacagaagagagaaugcaaauggccacuaaguauaugaaaaaagucguaucu

SEQ ID NO: 352214 - RNA, 64 nt, hsa
aaacuuuaugaugauaaauuuguguuggucguaagccacuaaaucacaguaauuuguuauagca

SEQ ID NO: 352215 - RNA, 64 nt, hsa
ucuuauccgaggggucugugguuguaucagaagagccacuaaaccaaucccccuuuccaaaauu

SEQ ID NO: 352216 - RNA, 64 nt, hsa
ugacaggccacgcuggucucagaugcccagugaagccacuaacaugagugaggggagggcugug

SEQ ID NO: 352217 - RNA, 64 nt, hsa
cuuuuuuacuucuccugaaggaaauauguuaguugccacuaagucaugauaaaauugaucagug

SEQ ID NO: 352218 - RNA, 64 nt, hsa
uagauuuugggugucugaggccccaagauuagaugccacuaaucuccaaagauucccuccaauu

SEQ ID NO: 352219 - RNA, 64 nt, hsa
uagaucguuuccugacagagaagccuucuuccaggccacuaagguagcauguuauccacugugg

SEQ ID NO: 352220 - RNA, 64 nt, hsa
uguggcauacguuauuggcuuugucuguaauacugccacuaagugauuauaauuaagcuguccu

SEQ ID NO: 352221 - RNA, 64 nt, hsa
acucagagaaucucauuuuguacuugguuguggugccacuaaacaaaacaaaugaugggagagu

SEQ ID NO: 352222 - RNA, 64 nt, hsa
aauucaauaaauggaauugacugaacuucccaacgccacuaauuauuaaaauccaucugcuuau

SEQ ID NO: 352223 - RNA, 64 nt, hsa
cccuccccccauuuacaugcaugcaaucagacaggccacuaagguaaaagagucugcucuauca

SEQ ID NO: 352224 - RNA, 64 nt, hsa
aagcagcccuguaggcuucaaagaaucaguguaagccacuaaaaggaacugaaaaccuaggugu

SEQ ID NO: 352225 - RNA, 64 nt, hsa
cauuuguggguuuuuauuuccuaugauguauacugccacuaaccuuccaaaaauuacuuaguau

SEQ ID NO: 352226 - RNA, 64 nt, hsa
aauagaacccuuaucacuagaagaaccauuuucugccacuaaauaucucugauguuuccaugag

SEQ ID NO: 352227 - RNA, 64 nt, hsa
uuuauuugguuuuugguugucaucgauuuacauugccacuaauaaaccauauugagaauuucua

SEQ ID NO: 352228 - RNA, 64 nt, hsa
cuaauuuaaaggagaguuacuuuguuguaugugugccacuaaaauaggggcugcccuugcccug

SEQ ID NO: 352229 - RNA, 64 nt, hsa
uauuagugaaucaugcuuauuuuuuacucuuaaugccacuaauauacaucccuaauaucacagg

SEQ ID NO: 352230 - RNA, 64 nt, hsa
acuuuggaaaucucuuuguauuuuuacuugaagugccacuaauggacagcagauauuuucuggc

SEQ ID NO: 352231 - RNA, 64 nt, hsa
uacaccuguagcccuggagaggcccucuggaguggccacuaagcagaggaggggccgcugccac

SEQ ID NO: 352232 - RNA, 64 nt, hsa
guguuuuguucuuuagacauuuaugagauucucugccacuaacaguaaauaugauuuagggguu

SEQ ID NO: 352233 - RNA, 64 nt, hsa
aaagcauuaggagggucauucuugucacaaaagugccacuaaaacagccucaggagaauaaaug

SEQ ID NO: 352234 - RNA, 64 nt, hsa
gggcugcuucugugaguucucagccuaggcuguggccacuaagacguggguggggggauagaca

SEQ ID NO: 352235 - RNA, 64 nt, hsa
gagcaggguugagaaucgggaaaacuagaccccugccacuaacaggcuaggagacuuugggcag

SEQ ID NO: 352236 - RNA, 64 nt, hsa
uguuacaugggaauaaggaauuucauucacuucagccacuaagaaaaguuuagaaucacgaaag

SEQ ID NO: 352237 - RNA, 64 nt, hsa
gauauuuuguagacuuuugcuguccagugugguagccacuaaccacauguggcuguuaagcccu

SEQ ID NO: 352238 - RNA, 64 nt, hsa
ucucuuuuuagacacaacagccgcaguuuggccagccacuaagucccaccagcugagguccgag

SEQ ID NO: 352239 - RNA, 64 nt, hsa
gaaggaguuaguagaaaacagucuggaugcuggugccacuaauauugguaaguuugggagaguu

SEQ ID NO: 352240 - RNA, 64 nt, hsa
uuauuugcacaccuguauguguggugccacguuagccacuaaaucugaacuuuuacccugcuuu

SEQ ID NO: 352241 - RNA, 64 nt, hsa
uuuaauauggaaauguuuggaacaggagaugcaagccacuaacagagaacuuuaauaauucuac

SEQ ID NO: 352242 - RNA, 64 nt, hsa
auagaggucuuuggacucuaaagaccaauguuuggccacuaacuggacuaauauguaucuuucu

SEQ ID NO: 352243 - RNA, 64 nt, hsa
caaagagaagcaaaaucuaccaggucaaaauagugccacuaacgguugaguuuugacugcuugg

SEQ ID NO: 352244 - RNA, 64 nt, hsa
cuacguuucauauauuauauggugcuuuguauaugccacuaauaaaaugaaucuaaacauugaa

SEQ ID NO: 352245 - RNA, 64 nt, hsa
gccaaggacucauuacuugucuuauauuuuuacugccacuaaacugccuguauuucuguauguc

SEQ ID NO: 352246 - RNA, 64 nt, hsa
gaggaggugacaaaccauuuccaacagcaacacagccacuaaaacacaaaaagggggauugggc

SEQ ID NO: 352247 - RNA, 64 nt, hsa
ccuagcacucagaucuucgugucuaauauaguuugccacuaaaaggaaccaaggcuacuuggaa

SEQ ID NO: 352248 - RNA, 64 nt, hsa
ggcccaaauucucaagguuguugauggggaacuugccacuaagagaaggcagagaggucccuag

SEQ ID NO: 352249 - RNA, 64 nt, hsa
auuuaacaauggauuagaaaaauauuuuggucuagccacuaaacauaaugacugaaaaaaauua

SEQ ID NO: 352250 - RNA, 64 nt, hsa
uuagcccugagcgccagcgcgaggaccagggccugccacuaagcccgccccgcuggccgccagc

SEQ ID NO: 352251 - RNA, 64 nt, hsa
cugguucugcccuuggaagccauuuccugcucaugccacuaacagcaugcugccaaacuguuca

SEQ ID NO: 352252 - RNA, 64 nt, hsa
acaaaccaaacuuuuagccugaaaccaacuuuaugccacuaagucauagccucaguugucccag

SEQ ID NO: 352253 - RNA, 64 nt, hsa
auaaugaauauuuuauacugcauccuuuacauuagccacuaaauacguuauugcuugaugaaga

SEQ ID NO: 352254 - RNA, 64 nt, hsa
aacacaaugacaaugacaucuuccccuuaccuuagccacuaagaagacaagggcuguuacucau

SEQ ID NO: 352255 - RNA, 64 nt, hsa
aaaaaugaaguaaggaaaacaaguaguccuguuugccacuaaaaacauuuucaaaggaaaaaua

SEQ ID NO: 352256 - RNA, 64 nt, hsa
aagagcaucccuucagcuuccccuccccguagcagccacuaaaagauuauuuaauuccagauug

SEQ ID NO: 352257 - RNA, 64 nt, hsa
cagauuugaggacugaagcuggggcuuggggauugccacuaaguacagcugacgguuucucccc

SEQ ID NO: 352258 - RNA, 64 nt, hsa
agaugaggugaagaucacugucaucuaaaagcuggccacuaaauuaaaaaaaaauuaaaaguua

SEQ ID NO: 352259 - RNA, 64 nt, hsa
ugcugcaacugaccagcugccggaagauucuggagccacuaacauuaguuuugcacauauuuuc

SEQ ID NO: 352260 - RNA, 64 nt, hsa
ucgcuauuuuuccccucugcccuagcccuagacagccacuaauguacuuucugucucuauggau

SEQ ID NO: 352261 - RNA, 64 nt, hsa
auugcuguuuuugacagcauuugugacugucauugccacuaaauuauugagcuagaagaugcug

SEQ ID NO: 352262 - RNA, 64 nt, hsa
uguucuuucaaauccuguucucaggaaagaaacugccacuaauucauucacacuaagguguaaa

SEQ ID NO: 352263 - RNA, 64 nt, hsa
acucuggguaccaaauuuaagcaagauauugauggccacuaaguguguauccagaagaagagau

SEQ ID NO: 352264 - RNA, 64 nt, hsa
ccgaagaagaaaacauuugaauuuaccuucauaugccacuaagaacaaaagcucugaaguucuu

SEQ ID NO: 352265 - RNA, 64 nt, hsa
accucuuuguagcacguaguguuguggaaacuaagccacuaauugaguuucuggcuccccuccu

SEQ ID NO: 352266 - RNA, 64 nt, hsa
aaacucuugguuuuguuuuuuuggaaaugagugggccacuaagccacacuuucccuucauccug

SEQ ID NO: 352267 - RNA, 64 nt, hsa
agagaacagcccauaaugcuccccgggagcagaggccacuaauggagagugggaagagccugga

SEQ ID NO: 352268 - RNA, 64 nt, hsa
cacaaagcaguggggcaugagcuguguuucaggggccacuaaauaacagcugguacugacccca

SEQ ID NO: 352269 - RNA, 64 nt, hsa
ggaagaagguaguccucuaaagcaaaaucugagugccacuaaauggggagauggggcuguuaag

SEQ ID NO: 352270 - RNA, 64 nt, hsa
aaugaauugaaauuuuucaugaugcuacuaauuugccacuaaauacugcaaauggucacccuga

SEQ ID NO: 352271 - RNA, 64 nt, hsa
uuauucccuuucuuaaagauacuccaagccacaugccacuaaccacaagcaagcuggcugcaag

SEQ ID NO: 352272 - RNA, 64 nt, hsa
caucaggcaauuuccaggguuggucuagagucuugccacuaaauauugaucacucguuuaagga

SEQ ID NO: 352273 - RNA, 64 nt, hsa
ucauuccuguuuuucuuggcaggagagaagcaaggccacuaaaagaggagaugguggagacgga

SEQ ID NO: 352274 - RNA, 64 nt, hsa
cauggaauguuuuuaauaaguaggcaagaaaaaugccacuaaucaaagcauuaaguguguccag

SEQ ID NO: 352275 - RNA, 64 nt, hsa
uuuguuuuguuuguuguuuguuguuuguuuuuuugccacuaauuuuaguauucauucugcauug

SEQ ID NO: 352276 - RNA, 64 nt, hsa
uguaaagcuuuggacauacacuuagcugcugugagccacuaauaacauugggcuaauaucugcu

SEQ ID NO: 352277 - RNA, 64 nt, hsa
gagaucuuccccuaaccuuugggccaauuuacuggccacuaauuucguuuaaauaccauugugu

SEQ ID NO: 352278 - RNA, 64 nt, hsa
uuuuuugcaggaagguuugcucuucagucaucuagccacuaaauguuaauuaucugauacuuuu

SEQ ID NO: 352279 - RNA, 64 nt, hsa
gcugcaucagacccugguagggaggggugccgcagccacuaacgguaugugcucuccuucagcc

SEQ ID NO: 352280 - RNA, 64 nt, hsa
ggucuuuucaguauuuacuguguaauacuuaagugccacuaaacauagcaaauugugcugcaca

SEQ ID NO: 352281 - RNA, 64 nt, hsa
gcugucucauuccuaacauguaauucaugauuuagccacuaaauuucuaaggagaucauaagaa

SEQ ID NO: 352282 - RNA, 64 nt, hsa
cuggucauuaagucaucugacauuaaaucauuuagccacuaaguuauuugucuacucucacuuu

SEQ ID NO: 352283 - RNA, 64 nt, hsa
uuuagauagcccuguccuggugguauuuucaauagccacuaaccuugccugguacaguaugggg

SEQ ID NO: 352284 - RNA, 64 nt, hsa
agucccaaaugucaucagguuuuguuuuuuuucagccacuaagaaccccucugcuuuuaacucu

SEQ ID NO: 352285 - RNA, 64 nt, hsa
acuaugguauauauuuugaaaggagaaaaaaaaagccacuaaggucaguguuauaaaaucugua

SEQ ID NO: 352286 - RNA, 64 nt, hsa
uacgacuuuauuaacagguuacugugaagauuuugccacuaacucuagauuuuaccuuuuugua

SEQ ID NO: 352287 - RNA, 64 nt, hsa
uuccauuccacuauuucccauaaugcuucugagagccacuaacuugauugauaaagauccugcc

SEQ ID NO: 352288 - RNA, 64 nt, hsa
ggcaguucaccggguccugcaggaccaggugccagccacuaagggggggcaccgccgaugccag

SEQ ID NO: 352289 - RNA, 64 nt, hsa
guaccaagaaaaaauuagucaccugaguaacuuggccacuaauaauuaaccaucuaccucuguu

SEQ ID NO: 352290 - RNA, 64 nt, hsa
gaacuguguguaugucaguggaaucaaaucaaaagccacuaacauggcugucuguuucauugga

SEQ ID NO: 352291 - RNA, 64 nt, hsa
guaaggacaugcuuaugaaaugugagagaggcucgccacuaaguauucuaaauacuuuucaaug

SEQ ID NO: 352292 - RNA, 64 nt, hsa
cugcccuccuguagcauguguccaaguggacauagccacuaaccaacuaguuaccuuuggacug

SEQ ID NO: 352293 - RNA, 64 nt, hsa
agugggggcacagggagggaacucuugacacugagccacuaaaauauggacuaauuuuuuggac

SEQ ID NO: 352294 - RNA, 64 nt, hsa
guauucaaugacauuaucaucauuuuuagaacgagccacuaaccuauuagagaagaggcagaua

SEQ ID NO: 352295 - RNA, 64 nt, hsa
ccaggagguggagguugcagugagccgucaucgcgccacuaagccaagaucgcgccacugcacu

SEQ ID NO: 352296 - RNA, 64 nt, hsa
aggucaaggaaggaaaauacuaccuguccccuaugccacuaagccaacgugugugucagcuggu

SEQ ID NO: 352297 - RNA, 64 nt, hsa
ugccuccugcaccccacccccaccaaccaggggagccacuaagcugacuaacaacuguccccuc

SEQ ID NO: 352298 - RNA, 64 nt, hsa
ggccugacacccccuccccgccccuguggcccuggccacuaaagcuucagacucaaguacccau

SEQ ID NO: 352299 - RNA, 64 nt, hsa
ggcaacuguagaugugguuucuaguccuggcucugccacuaacuugcuguguaaccuugaacua

SEQ ID NO: 352300 - RNA, 64 nt, hsa
gaggucacagucacgaagcucaugguagacugaggccacuaaacacccgucuccugauuuucag

SEQ ID NO: 352301 - RNA, 64 nt, hsa
uucaguaugaaaccaguuuccuugugcgaugauggccacuaaagcauaguacguggaugucagu

SEQ ID NO: 352302 - RNA, 64 nt, hsa
aaauacuauugugaauucaaugaaguguucuuaugccacuaacuuuaaccuauucccuuacuca

SEQ ID NO: 352303 - RNA, 64 nt, hsa
ccagugucuugucagcucuggguguuuguucccugccacuaaguggcucagucacaccuuugcu

SEQ ID NO: 352304 - RNA, 64 nt, hsa
gaccugauuucuuugaccggcuugucauccuuacgccacuaaccugugagcuuccccaggucag

SEQ ID NO: 352305 - RNA, 64 nt, hsa
aguuguucugcauaucauuguucuguuuuuauuggccacuaauaaucuaugauacgaauauacc

SEQ ID NO: 352306 - RNA, 64 nt, hsa
aaacagagcagaccugaaggcuaaucuuauuuuugccacuaacuuagugaaugacccuaagcaa

SEQ ID NO: 352307 - RNA, 64 nt, hsa
ggggaccugagggcuguccucgcugcugagaagagccacuaacucgugaccuccagccugcccc

SEQ ID NO: 352308 - RNA, 64 nt, hsa
caggugccccugggcucagguaguuaguuguucagccacuaaugccuuuuaucccccauauggg

SEQ ID NO: 352309 - RNA, 64 nt, hsa
agcguugagccuuggaaagguagacaagcguugagccacuaagcagaggaccuuggguucccaa

SEQ ID NO: 352310 - RNA, 64 nt, hsa
uacgugauucccucccuuucacuuuucaaagugagccacuaaacagaaagucuaagaguucaga

SEQ ID NO: 352311 - RNA, 64 nt, hsa
uacaccuaacucaccuaacucauacugugcuggagccacuaacuagagcagcccuggagucaug

SEQ ID NO: 352312 - RNA, 64 nt, hsa
aauuguuugaauauuaucccauugaauacccagagccacuaaaucuuuuuuuacuagaaaauaa

SEQ ID NO: 352313 - RNA, 64 nt, hsa
uucuccucuacugaacccacuggcaucaccugaugccacuaauuugugaacaacaagaaaucau

SEQ ID NO: 352314 - RNA, 64 nt, hsa
cgguguaaguggcucuguccucagggugggcagagccacuaaacuuguuuuaccuaguucuuuc

SEQ ID NO: 352315 - RNA, 64 nt, hsa; identical to SEQ ID NO: 107011

SEQ ID NO: 352316 - RNA, 64 nt, hsa; identical to SEQ ID NO: 107012

SEQ ID NO: 352317 - RNA, 64 nt, hsa; identical to SEQ ID NO: 107013

SEQ ID NO: 352318 - RNA, 64 nt, hsa; identical to SEQ ID NO: 107014

SEQ ID NO: 352319 - RNA, 64 nt, hsa; identical to SEQ ID NO: 107015

SEQ ID NO: 352320 - RNA, 64 nt, hsa; identical to SEQ ID NO: 107016

SEQ ID NO: 352321 - RNA, 64 nt, hsa; identical to SEQ ID NO: 107017

SEQ ID NO: 352322 - RNA, 64 nt, hsa; identical to SEQ ID NO: 107018

SEQ ID NO: 352323 - RNA, 64 nt, hsa; identical to SEQ ID NO: 107019

SEQ ID NO: 352324 - RNA, 64 nt, hsa; identical to SEQ ID NO: 107020

SEQ ID NO: 352325 - RNA, 64 nt, hsa; identical to SEQ ID NO: 107021

SEQ ID NO: 352326 - RNA, 64 nt, hsa; identical to SEQ ID NO: 107022

SEQ ID NO: 352327 - RNA, 64 nt, hsa; identical to SEQ ID NO: 107023

SEQ ID NO: 352328 - RNA, 64 nt, hsa; identical to SEQ ID NO: 107024

SEQ ID NO: 352329 - RNA, 64 nt, hsa; identical to SEQ ID NO: 107025

SEQ ID NO: 352330 - RNA, 64 nt, hsa; identical to SEQ ID NO: 107026

SEQ ID NO: 352331 - RNA, 64 nt, hsa; identical to SEQ ID NO: 107027

SEQ ID NO: 352332 - RNA, 64 nt, hsa; identical to SEQ ID NO: 107028

SEQ ID NO: 352333 - RNA, 64 nt, hsa; identical to SEQ ID NO: 107029

SEQ ID NO: 352334 - RNA, 64 nt, hsa; identical to SEQ ID NO: 107030

SEQ ID NO: 352335 - RNA, 64 nt, hsa; identical to SEQ ID NO: 107031

SEQ ID NO: 352336 - RNA, 64 nt, hsa; identical to SEQ ID NO: 107032

SEQ ID NO: 352337 - RNA, 64 nt, hsa
ccuauuuugccagugggaacuccuaaaucaaguuggcuucuaaucaaagcuuuuaaacccuauu

SEQ ID NO: 352338 - RNA, 64 nt, hsa
uguguuucugaucugaugcaagcaagaaacacugggcuucuagaaccaggcaacuugggaacua

SEQ ID NO: 352339 - RNA, 64 nt, hsa; identical to SEQ ID NO: 307734

SEQ ID NO: 352340 - RNA, 64 nt, hsa; identical to SEQ ID NO: 307735

SEQ ID NO: 352341 - RNA, 64 nt, hsa; identical to SEQ ID NO: 307736

SEQ ID NO: 352342 - RNA, 64 nt, hsa; identical to SEQ ID NO: 307737

SEQ ID NO: 352343 - RNA, 64 nt, hsa; identical to SEQ ID NO: 307738

SEQ ID NO: 352344 - RNA, 64 nt, hsa; identical to SEQ ID NO: 307739

SEQ ID NO: 352345 - RNA, 64 nt, hsa; identical to SEQ ID NO: 307740

SEQ ID NO: 352346 - RNA, 64 nt, hsa; identical to SEQ ID NO: 307741

SEQ ID NO: 352347 - RNA, 59 nt, hsa; identical to SEQ ID NO: 307742

SEQ ID NO: 352348 - RNA, 64 nt, hsa; identical to SEQ ID NO: 307743

SEQ ID NO: 352349 - RNA, 64 nt, hsa; identical to SEQ ID NO: 307744

SEQ ID NO: 352350 - RNA, 64 nt, hsa; identical to SEQ ID NO: 307745

SEQ ID NO: 352351 - RNA, 64 nt, hsa; identical to SEQ ID NO: 307746

SEQ ID NO: 352352 - RNA, 64 nt, hsa; identical to SEQ ID NO: 307747

SEQ ID NO: 352353 - RNA, 64 nt, hsa; identical to SEQ ID NO: 307748

SEQ ID NO: 352354 - RNA, 64 nt, hsa; identical to SEQ ID NO: 307749

SEQ ID NO: 352355 - RNA, 64 nt, hsa; identical to SEQ ID NO: 307750

SEQ ID NO: 352356 - RNA, 64 nt, hsa; identical to SEQ ID NO: 307751

SEQ ID NO: 352357 - RNA, 64 nt, hsa; identical to SEQ ID NO: 307752

SEQ ID NO: 352358 - RNA, 64 nt, hsa; identical to SEQ ID NO: 307753

SEQ ID NO: 352359 - RNA, 64 nt, hsa; identical to SEQ ID NO: 307754

SEQ ID NO: 352360 - RNA, 64 nt, hsa; identical to SEQ ID NO: 307755

SEQ ID NO: 352361 - RNA, 64 nt, hsa; identical to SEQ ID NO: 307756

SEQ ID NO: 352362 - RNA, 64 nt, hsa; identical to SEQ ID NO: 307757

SEQ ID NO: 352363 - RNA, 64 nt, hsa; identical to SEQ ID NO: 307758

SEQ ID NO: 352364 - RNA, 64 nt, hsa; identical to SEQ ID NO: 307759

SEQ ID NO: 352365 - RNA, 64 nt, hsa; identical to SEQ ID NO: 307760

SEQ ID NO: 352366 - RNA, 64 nt, hsa; identical to SEQ ID NO: 307761

SEQ ID NO: 352367 - RNA, 64 nt, hsa; identical to SEQ ID NO: 307762

SEQ ID NO: 352368 - RNA, 64 nt, hsa; identical to SEQ ID NO: 307763

SEQ ID NO: 352369 - RNA, 64 nt, hsa; identical to SEQ ID NO: 307764

SEQ ID NO: 352370 - RNA, 64 nt, hsa; identical to SEQ ID NO: 307765

SEQ ID NO: 352371 - RNA, 64 nt, hsa; identical to SEQ ID NO: 307766

SEQ ID NO: 352372 - RNA, 64 nt, hsa; identical to SEQ ID NO: 307767

SEQ ID NO: 352373 - RNA, 64 nt, hsa; identical to SEQ ID NO: 307768

SEQ ID NO: 352374 - RNA, 64 nt, hsa; identical to SEQ ID NO: 307769

SEQ ID NO: 352375 - RNA, 64 nt, hsa; identical to SEQ ID NO: 307770

SEQ ID NO: 352376 - RNA, 64 nt, hsa; identical to SEQ ID NO: 307771

SEQ ID NO: 352377 - RNA, 64 nt, hsa; identical to SEQ ID NO: 307772

SEQ ID NO: 352378 - RNA, 64 nt, hsa; identical to SEQ ID NO: 307773

SEQ ID NO: 352379 - RNA, 64 nt, hsa; identical to SEQ ID NO: 307774

SEQ ID NO: 352380 - RNA, 64 nt, hsa; identical to SEQ ID NO: 307775

SEQ ID NO: 352381 - RNA, 64 nt, hsa; identical to SEQ ID NO: 307776

SEQ ID NO: 352382 - RNA, 64 nt, hsa; identical to SEQ ID NO: 307777

SEQ ID NO: 352383 - RNA, 64 nt, hsa; identical to SEQ ID NO: 307778

SEQ ID NO: 352384 - RNA, 64 nt, hsa; identical to SEQ ID NO: 307779

SEQ ID NO: 352385 - RNA, 64 nt, hsa; identical to SEQ ID NO: 307780

SEQ ID NO: 352386 - RNA, 64 nt, hsa; identical to SEQ ID NO: 307781

SEQ ID NO: 352387 - RNA, 64 nt, hsa; identical to SEQ ID NO: 307782

SEQ ID NO: 352388 - RNA, 64 nt, hsa; identical to SEQ ID NO: 307783

SEQ ID NO: 352389 - RNA, 64 nt, hsa; identical to SEQ ID NO: 307784

SEQ ID NO: 352390 - RNA, 64 nt, hsa; identical to SEQ ID NO: 307785

SEQ ID NO: 352391 - RNA, 64 nt, hsa; identical to SEQ ID NO: 307786

SEQ ID NO: 352392 - RNA, 64 nt, hsa; identical to SEQ ID NO: 307787

SEQ ID NO: 352393 - RNA, 64 nt, hsa; identical to SEQ ID NO: 307788

SEQ ID NO: 352394 - RNA, 64 nt, hsa; identical to SEQ ID NO: 307789

SEQ ID NO: 352395 - RNA, 64 nt, hsa; identical to SEQ ID NO: 307790

SEQ ID NO: 352396 - RNA, 64 nt, hsa; identical to SEQ ID NO: 307791

SEQ ID NO: 352397 - RNA, 64 nt, hsa; identical to SEQ ID NO: 307792

SEQ ID NO: 352398 - RNA, 64 nt, hsa; identical to SEQ ID NO: 307793

SEQ ID NO: 352399 - RNA, 64 nt, hsa; identical to SEQ ID NO: 307794

SEQ ID NO: 352400 - RNA, 64 nt, hsa; identical to SEQ ID NO: 307795

SEQ ID NO: 352401 - RNA, 64 nt, hsa; identical to SEQ ID NO: 307796

SEQ ID NO: 352402 - RNA, 62 nt, hsa; identical to SEQ ID NO: 307797

SEQ ID NO: 352403 - RNA, 64 nt, hsa; identical to SEQ ID NO: 307798

SEQ ID NO: 352404 - RNA, 64 nt, hsa; identical to SEQ ID NO: 307799

SEQ ID NO: 352405 - RNA, 64 nt, hsa; identical to SEQ ID NO: 307800

SEQ ID NO: 352406 - RNA, 64 nt, hsa; identical to SEQ ID NO: 307801

SEQ ID NO: 352407 - RNA, 64 nt, hsa; identical to SEQ ID NO: 307802

SEQ ID NO: 352408 - RNA, 64 nt, hsa; identical to SEQ ID NO: 307803

SEQ ID NO: 352409 - RNA, 64 nt, hsa; identical to SEQ ID NO: 307804

SEQ ID NO: 352410 - RNA, 64 nt, hsa; identical to SEQ ID NO: 307805

SEQ ID NO: 352411 - RNA, 64 nt, hsa; identical to SEQ ID NO: 307806

SEQ ID NO: 352412 - RNA, 64 nt, hsa; identical to SEQ ID NO: 307807

SEQ ID NO: 352413 - RNA, 64 nt, hsa; identical to SEQ ID NO: 307808

SEQ ID NO: 352414 - RNA, 64 nt, hsa; identical to SEQ ID NO: 307809

SEQ ID NO: 352415 - RNA, 64 nt, hsa
acaguuguagcagcagcagacgaagccauugcagaggcagaauaugcugagugucuggagucag

SEQ ID NO: 352416 - RNA, 64 nt, hsa
cccacccuugagaauguggagaacucccauggagaggcagaauggcaggagguuucaugucccg

SEQ ID NO: 352417 - RNA, 64 nt, hsa
gagcacgucugcagggcccucucauacacgccugaggcagaagcagcgucccccgugaaagcca

SEQ ID NO: 352418 - RNA, 64 nt, hsa
caguggggggccuguggccccggcucuucacagcaggcagaagcguaugaucccagggagggug

SEQ ID NO: 352419 - RNA, 64 nt, hsa
uauuuugcuuuugggaauuuuacagagucaaaguaggcagaauaagaaaauaguucuucaggag

SEQ ID NO: 352420 - RNA, 64 nt, hsa
cuucuaaagaaaauauguuucagcauuauaagaaaggcagaaugcagaacaccuacauuuuugu

SEQ ID NO: 352421 - RNA, 64 nt, hsa
cucccauuuuucugaaaguggcugauguaagaacaggcagaaggaaaacccuuuuugucaauaa

SEQ ID NO: 352422 - RNA, 64 nt, hsa
uugcuggagagcgaaagauggaacagccuuguccaggcagaacagucauaagccaggaaaugaa

SEQ ID NO: 352423 - RNA, 64 nt, hsa
aggcccucccaccccuucucuaacacuagcuucaaggcagaagccacagcagccucuguccagc

SEQ ID NO: 352424 - RNA, 64 nt, hsa
cuggaacccaggugagggcaagaugaaggcuuccaggcagaacagcugcagagaguuuggcuau

SEQ ID NO: 352425 - RNA, 64 nt, hsa
gcucgccucuuuaggguccaugguggcagcagagaggcagaagugggaguccagagccaggaac

SEQ ID NO: 352426 - RNA, 64 nt, hsa
uccaguccaugcucuucuggacguggacucucugaggcagaacugagcuuuuccaggccucuua

SEQ ID NO: 352427 - RNA, 64 nt, hsa
cacacgccuguagucccagcuacucgggaggcugaggcagaagaaucgcuugaaccugggaggu

SEQ ID NO: 352428 - RNA, 64 nt, hsa
ggccuacgugacacaaggagacaugggcuagggaaggcagaacugggcccaaagacacacaccc

SEQ ID NO: 352429 - RNA, 64 nt, hsa
aaaaacgaaaaacaaaaaaaaacucgaaugacuuaggcagaacaugccuucccuaguuuaauua

SEQ ID NO: 352430 - RNA, 64 nt, hsa
ugugaucagggaaguugggggcauuuggccugaaaggcagaauguucccaguauuucuggauaa

SEQ ID NO: 352431 - RNA, 64 nt, hsa
ccauaauccaggagggucuccuuccccacugcagaggcagaacguccaagaauggaguaagauu

SEQ ID NO: 352432 - RNA, 64 nt, hsa
gaagagacuuaggaucaagacauuuuuuaauguuaggcagaacacauucauucagacuuugcua

SEQ ID NO: 352433 - RNA, 64 nt, hsa
uacugucccuuacuggggcagcagagggcuucggaggcagaagugaggccugggguuuuggggg

SEQ ID NO: 352434 - RNA, 64 nt, hsa
auauucagugucccuguuccucacucagagaggaaggcagaaccagucaggcuuauuucaguaa

SEQ ID NO: 352435 - RNA, 64 nt, hsa
cuacauugcauaugggcauagcaguuuuugacccaggcagaauaaguuaauauuuaauuaaaua

SEQ ID NO: 352436 - RNA, 64 nt, hsa
auccucucagcagucuuccugucacccgccuggcaggcagaaggagcugcagucccacgugggc

SEQ ID NO: 352437 - RNA, 64 nt, hsa
cagccucagaaaccaggccucucacuccagcagcaggcagaaccgugucuguggucgggugcug

SEQ ID NO: 352438 - RNA, 64 nt, hsa
cugaggcacccgaauggucccucagggugcagggaggcagaagccuggccacagaggagccucc

SEQ ID NO: 352439 - RNA, 64 nt, hsa
auacugacaaaauacauggaagugaguuauaaugaggcagaaacaaaauccucgguaacauuga

SEQ ID NO: 352440 - RNA, 64 nt, hsa
gauaccaucuggcggcugcacauuguaacaguaaaggcagaaagcuguagugauaaccucucuc

SEQ ID NO: 352441 - RNA, 64 nt, hsa
aaggaugaaagacaaagaaggaaaagaguaucaaaggcagaaaggagaucauuuaguugggucu

SEQ ID NO: 352442 - RNA, 64 nt, hsa
caaagacagggaauagugggaucaaagcuaggaaaggcagaaacacaaccacucaccaguccua

SEQ ID NO: 352443 - RNA, 64 nt, hsa
ccucuacggccccgacggacgcuugugaggcccgaggcagaagggcccaccccgucccuccucu

SEQ ID NO: 352444 - RNA, 64 nt, hsa
aagcaaaggagaguccugggagcccacaagauccaggcagaaggagauggguuuggggcuggcc

SEQ ID NO: 352445 - RNA, 64 nt, hsa
auuccaggccucaacagcugcccuugaggagcacaggcagaagugugaacuugugaauguaauu

SEQ ID NO: 352446 - RNA, 64 nt, hsa
gauaacauaaaguggauucaucuuguaucauuauaggcagaagguauuuggcaaauuuuuaugu

SEQ ID NO: 352447 - RNA, 64 nt, hsa
gcuggaacuggagccaaggggaggcugccuaugaaggcagaagauguggaugaauucaggcacu

SEQ ID NO: 352448 - RNA, 64 nt, hsa
gaccagauaucuuguuggcauaaauguuaugaaaaggcagaauacuggcaagaaaugaggaaga

SEQ ID NO: 352449 - RNA, 64 nt, hsa
gcagccccgaggcugagaccagacaaagcccgggaggcagaaagaugcuccaagaaccaacacu

SEQ ID NO: 352450 - RNA, 64 nt, hsa
gaugacccaaucugccuuugaaucuggaggaaauaggcagaaacaaaaugacuguagaacuuau

SEQ ID NO: 352451 - RNA, 64 nt, hsa
augggauggcaaaggugguggugcuuucaucuucaggcagaagccucugcccaucccccucaag

SEQ ID NO: 352452 - RNA, 64 nt, hsa
gucauuuugauaggagcguuuuguuauuuuuacaaggcagaaugggguguaacaguugaauuaa

SEQ ID NO: 352453 - RNA, 64 nt, hsa
ggcuccgcuguguggauggggagaucggggccagaggcagaacccuggugaggaagcuccaguc

SEQ ID NO: 352454 - RNA, 64 nt, hsa
guugggcagcugaacaguguuggcuuucaugaggaggcagaaagcagaggcuggccucagacuc

SEQ ID NO: 352455 - RNA, 64 nt, hsa
gggacacccacgcccuucucuccagaagccgggcaggcagaauccggccagacgacggggcuga

SEQ ID NO: 352456 - RNA, 64 nt, hsa
cuauuuuuauacuuaaaacaugucagcagagcauaggcagaauaaaaugguuuaaauaccccac

SEQ ID NO: 352457 - RNA, 64 nt, hsa
ccggaggugcagcuaaaggccaccaaggcagaacaggcagaagggauggaauuuggcuucaaga

SEQ ID NO: 352458 - RNA, 64 nt, hsa
cccagggcuccggaggugcagcuaaaggccaccaaggcagaacaggcagaagggauggaauuug

SEQ ID NO: 352459 - RNA, 64 nt, hsa
cagagucucagggaaagagaaccacaauagaaaaaggcagaaaaggccgggcgcgguggcucau

SEQ ID NO: 352460 - RNA, 64 nt, hsa
cacaugccugugaucccagcuacucaggaagcugaggcagaaagaucccuugacccugagaggu

SEQ ID NO: 352461 - RNA, 64 nt, hsa
caguuugggguucugggucgguuccagcggcuuuaggcagaaagugcucgcucucacccagcac

SEQ ID NO: 352462 - RNA, 64 nt, hsa
cagguccuaucaaaggaggcugccggaacucaagaggcagaaaaagaccaguuaggcggugcag

SEQ ID NO: 352463 - RNA, 64 nt, hsa
ggcuggacucagcaggaacaccaaaucccggaccaggcagaaaccacccaagacugaggggcuc

SEQ ID NO: 352464 - RNA, 64 nt, hsa
aagauuguuugaaaaaaaaaaaaggggagcagggaggcagaaaguccuggaaaaguaaauuguu

SEQ ID NO: 352465 - RNA, 64 nt, hsa
gcaagcacaauaccauuaaaaagccucaagcccaaggcagaagaccuaucugcauuugagcccu

SEQ ID NO: 352466 - RNA, 64 nt, hsa
auaggcagggcagcuguggcuggggagagacuuuaggcagaagcugugaugcaggcugacugcc

SEQ ID NO: 352467 - RNA, 64 nt, hsa
cguuccuacaggugcacaaucuaagagagcuaauuaaccucagagucuggaguuaacagcuuuu

SEQ ID NO: 352468 - RNA, 64 nt, hsa
gaacuuauaguaaggaaacucacuugauuuuaucuaaccucaaacuuuccaaguuuaauggauc

SEQ ID NO: 352469 - RNA, 64 nt, hsa
uugcuuacaaucuuuauuaugcauucuuauaacauaaccucagaguaucuuuaccaaagguuuu

SEQ ID NO: 352470 - RNA, 64 nt, hsa
ggcagcugcuagggagaucagggaaacacugauguaaccucaaagccucucaccauuccucuug

SEQ ID NO: 352471 - RNA, 64 nt, hsa
auuuccuguauaauucacuuaaauaaaagcagguuaaccucaaugauagcaguuaaaauguucu

SEQ ID NO: 352472 - RNA, 64 nt, hsa
aagacacacucaggcuuuagugaauaacuuuacauaaccucaguuuuuaacacaugcauaucuu

SEQ ID NO: 352473 - RNA, 64 nt, hsa
caauucuagcauuuuguuuggaggauuucagaguuaaccucauggaauucaggauuuuuuagca

SEQ ID NO: 352474 - RNA, 64 nt, hsa
uaaucuguugaaaagugcaguuacuucuggaaauuaaccucaauauuaggucagcaugugaaau

SEQ ID NO: 352475 - RNA, 64 nt, hsa
uuucugaaauacacuaagagcagccacaaaacuguaaccucaaggaaaccauaaagcuuggagu

SEQ ID NO: 352476 - RNA, 64 nt, hsa
cuccaguacacagucugauaaggacuuaacguccuaaccucaauuguauuaaauagcauugggg

SEQ ID NO: 352477 - RNA, 64 nt, hsa
gagaaaaacaagugaaaaggucaagauacaaauguguauuaaaaaaaaaaaagccuauuaauag

SEQ ID NO: 352478 - RNA, 64 nt, hsa
uaccaaugaacuguuuagaaacaagacacacuuuuguauuaaaauugcuugcaguaacaaauau

SEQ ID NO: 352479 - RNA, 64 nt, hsa
aaaugcaaggucacacauauuaaugacagccuguuguauuaaugauggcuccaggucagugucu

SEQ ID NO: 352480 - RNA, 64 nt, hsa
uccagcagaagcagaugcaccugacaaaaauggauguauuaauuggcucuauaaacuaugugcc

SEQ ID NO: 352481 - RNA, 64 nt, hsa
uaugcucuggaaaaccugaggccaaauauugaucuguauuaagcuccagugcuuuauccacauu

SEQ ID NO: 352482 - RNA, 64 nt, hsa
ugaagacaccagaguguaugcauacaaaucucacuguauuaaagaugcagguuuucuaauugua

SEQ ID NO: 352483 - RNA, 64 nt, hsa
guagaaaauauaucuuaaacuaguugaccuagauuguauuaauagcuacuuaagauguuucaaa

SEQ ID NO: 352484 - RNA, 64 nt, hsa
caguagaauacaguuuuuauuuuguaaacacuaauguauuaaacuugcuauacauuaaagcaaa

SEQ ID NO: 352485 - RNA, 64 nt, hsa
aaacacaagagaagucuuuaaaaagccugcauuguguauuaaacaccagguaauaugugcaaaa

SEQ ID NO: 352486 - RNA, 64 nt, hsa
uuuguugauguagcuuguaucucugagaauuuauuguauuaaaauuaauacugagauauuuuua

SEQ ID NO: 352487 - RNA, 64 nt, hsa
cuaucuucucauuguuuguuuguaaguuugaauuuguauuaaaaagccugcauucugagcugga

SEQ ID NO: 352488 - RNA, 64 nt, hsa
agcaaaauuccuguguucaauauuuagaaaauuuuguauuaauuucugauaaaguuccuuaagc

SEQ ID NO: 352489 - RNA, 64 nt, hsa
aauaaugguuugguucacuuuaugaaaaauaaaauguauuaaaauauaguuuaaaugcuguucu

SEQ ID NO: 352490 - RNA, 64 nt, hsa
aggaaagaguaagacuguuaagaagaccgaagcauguauuaaugcuguggcuaugagaggccuc

SEQ ID NO: 352491 - RNA, 64 nt, hsa
uguauauuuucauauauaugacagaacaagaauauguauuaauagugccuaauguaucuauauu

SEQ ID NO: 352492 - RNA, 64 nt, hsa
uugggacauuuuucuaggaaauaaaauuccucgguguauuaaucuaagguuucaaaguauaaaa

SEQ ID NO: 352493 - RNA, 64 nt, hsa
cuuugccagucuuuaagaucuuggcuuaauuuaauguauuaaucuguuugugcaaacauaauac

SEQ ID NO: 352494 - RNA, 64 nt, hsa
gaagcccaaauucauauaaaaguugcguuuaaguuguauuaaaaauagauauauaagaaaaaau

SEQ ID NO: 352495 - RNA, 64 nt, hsa
uauuuuacguguuuccauguaucucacuuugugcuguauuaaaaaaaccuccauuuugaaaauc

SEQ ID NO: 352496 - RNA, 64 nt, hsa
uuuguuuuauuauguaauugauaaaauggugauguguauuaauguuaguucaaccauauauuua

SEQ ID NO: 352497 - RNA, 64 nt, hsa
acgaugccagauuagauuuauagcagccucaaguuguauuaaaugauauuuugcuuccuguaau

SEQ ID NO: 352498 - RNA, 64 nt, hsa
ccauuauuugaacacuuggguagaacucuugcuuuguauuaaaccucuuugucuacacauguaa

SEQ ID NO: 352499 - RNA, 63 nt, hsa
aauacauuucuccuuugauaaaauaaaugagcuauguauuaacacugccagauucaguuaaua

SEQ ID NO: 352500 - RNA, 64 nt, hsa
aauaauuuuauggcucacuaugaaucuauuauacuguauuaagagugaaaauugucuucuucug

SEQ ID NO: 352501 - RNA, 64 nt, hsa
ccaauuagguugaaaaugccccuuacugaaaaucuguauuaaaaauaaaauuaauaaaaguaaa

SEQ ID NO: 352502 - RNA, 64 nt, hsa
cggaaugucucccccagcugccacacacacauuuuguauuaauuuuaaugauuaaaaagagcau

SEQ ID NO: 352503 - RNA, 64 nt, hsa
aauagaagauggaucucuagcucugagcuauucguguauuaacucguauucaagaagguuccac

SEQ ID NO: 352504 - RNA, 64 nt, hsa
uuggaccgaugaugucucuacuacuggaucuaucuguauuaacagcaauguuacucucaaugaa

SEQ ID NO: 352505 - RNA, 64 nt, hsa
uucuguaacccuaaagcugcucuaaaaaaugaaguguauuaaguaaauaaauaaguaaauaacc

SEQ ID NO: 352506 - RNA, 64 nt, hsa
ggaaucaggauuuagccucaaguaguucccuuguuguauuaauaaccacacccuuucugcaucc

SEQ ID NO: 352507 - RNA, 64 nt, hsa
uaaagugucuaguuuuuugaaaugcaaagcuuuauguauuaacuugcugaugugguuuacaaua

SEQ ID NO: 352508 - RNA, 64 nt, hsa
aagcaaaacuuuuugaagaagcaccccucuuucauguauuaaaauaacacugagauuuuuuuaa

SEQ ID NO: 352509 - RNA, 64 nt, hsa
aaguauguggcaguaaauacaacaagacacucuauguauuaaugucuccauugucuuaacccug

SEQ ID NO: 352510 - RNA, 64 nt, hsa
uuuauucucaaacuggcaaacuuagcauguuagguguauuaaccucaucagucuugaagaacau

SEQ ID NO: 352511 - RNA, 64 nt, hsa
uauuagaugauauuuauugcagaauuucuauucuuguauuaacaaauaaaaugcuugccccaga

SEQ ID NO: 352512 - RNA, 64 nt, hsa
ccccagccccacccacucaugacucuaaguguguuguauuaauauuuauuuauuuggagauguu

SEQ ID NO: 352513 - RNA, 64 nt, hsa
aaagucuggaaacuuucauaucaauaauugauuauguauuaacugaaacaaaagacuagagaaa

SEQ ID NO: 352514 - RNA, 64 nt, hsa
aaagacuagagaaagacacagugggaauugauuauguauuaacugaggaauaaaagacugaaga

SEQ ID NO: 352515 - RNA, 64 nt, hsa
gccuguaggauguacuguauguagucaugcacuuuguauuaauauauuagaaaucuacagaucu

SEQ ID NO: 352516 - RNA, 64 nt, hsa
uuuuagccuauuaaauuuuuauuuucuuucacucuguauuaaaaguaaaacuuacuaaaagaaa

SEQ ID NO: 352517 - RNA, 64 nt, hsa
ccuugcuauguagaaugacuauucuaaauauuaauguauuaaaaagaaaauacaacaaaaugua

SEQ ID NO: 352518 - RNA, 64 nt, hsa
cuuagugggaauggaaguauauguaucuaucuuguguauuaacuucugacuuauuuauacaaga

SEQ ID NO: 352519 - RNA, 64 nt, hsa
gccaauuccguuuauccaaaaagguacauguuuuuguauuaaaaaguaaacagggaucagugac

SEQ ID NO: 352520 - RNA, 64 nt, hsa
ccuuuuuuguguguuuguguguuuuuuuaagugcuguauuaauaauacuuucugaaagaaaagg

SEQ ID NO: 352521 - RNA, 64 nt, hsa
gugugaaagucacagcuuguaaauaaguguuguauguauuaaaccuuuuccaguucuccaaagc

SEQ ID NO: 352522 - RNA, 64 nt, hsa
uccauugucagcacagccuaggaaggucagauccuguauuaauuacucuuaguggagaugccag

SEQ ID NO: 352523 - RNA, 64 nt, hsa
cauauuauguaauauauuguuagauuaaaaccauuguauuaagacuuuaaaauguaagcauugu

SEQ ID NO: 352524 - RNA, 64 nt, hsa
ucuuugauaacagggauugauuuuaaaauguacauguauuaaauuacauuuguaauuuaagguc

SEQ ID NO: 352525 - RNA, 64 nt, hsa
ucagaaguuuaaauauuaagcaugacagaaaauauguauuaacacuacucaaagcaaaagugcu

SEQ ID NO: 352526 - RNA, 64 nt, hsa
agccaaauucugucuccugcauacacuccggcaugcauccaacaccaauggcuuucuagaugag

SEQ ID NO: 352527 - RNA, 64 nt, hsa
uugagauucaagaaaaauuucuauucuuuuuuuugcauccaauugugccugaacuuuuaaaaua

SEQ ID NO: 352528 - RNA, 64 nt, hsa
gagacaaggauaaguuauagagcaguuggaggaagcauccaaagauugcaacccagggcaaaug

SEQ ID NO: 352529 - RNA, 64 nt, hsa
guccugcauuucuuugguggggggccaggagggugcauccaauuuaacuuaacucuuaccuauu

SEQ ID NO: 352530 - RNA, 64 nt, hsa
accuucucuuaagcaaucaguguguaaagauuugagggaagaaugaauaagagauacaaggucu

SEQ ID NO: 352531 - RNA, 64 nt, hsa
cugugaagaaaucauaacacuuggaggaaucagaagggaagaucaacagcaaggauggggcauc

SEQ ID NO: 352532 - RNA, 64 nt, hsa
aauagucaugaaaagaaagggaagaaaggggagaagggaagagguuaaaaaguaagugcucaga

SEQ ID NO: 352533 - RNA, 64 nt, hsa
uagcaaguuuaggagagaauagucaugaaaagaaagggaagaaaggggagaagggaagagguua

SEQ ID NO: 352534 - RNA, 64 nt, hsa
ggggcugagguuggaggccuacuaauuucccuguagggaagacucccagcacuucuggaacugu

SEQ ID NO: 352535 - RNA, 64 nt, hsa
cagcugacccguguaugugcagaugcaguuccgaagggaagaacaguccucgggugauucagag

SEQ ID NO: 352536 - RNA, 64 nt, hsa
ucacaguucucuggaugcccagacaccucucuucagggaagaugagucugacugguuugcccca

SEQ ID NO: 352537 - RNA, 64 nt, hsa
ucuucagggaagaugagucugacugguuugccccagggaagagcauauccuuaccauuauuuua

SEQ ID NO: 352538 - RNA, 64 nt, hsa
caguggcagcccagccaccuccuaucaaucaaucagggaagaaaugcaggggagacuggggccc

SEQ ID NO: 352539 - RNA, 64 nt, hsa
ggaagacacugaccuuucccaucccgguagcuucagggaagaucauaguuaauaacgucucuca

SEQ ID NO: 352540 - RNA, 64 nt, hsa
aggauugcagaagacgagcgggagcggggagggcagggaagaugccugucggguuuuuagcaca

SEQ ID NO: 352541 - RNA, 64 nt, hsa
ucagcagagaaguuuucuggaggucucugaacccagggaagacaagaaggaaagauuuuguugu

SEQ ID NO: 352542 - RNA, 64 nt, hsa
uucucucugaaagcagaaaaaggcacugauauaaagggaagagaaggaggcucaccggagggaa

SEQ ID NO: 352543 - RNA, 64 nt, hsa
acugauauaaagggaagagaaggaggcucaccggagggaagagaacauagugaagauucccgcc

SEQ ID NO: 352544 - RNA, 64 nt, hsa
uuagaguaaauggacuugccuuaauuuauaaaggagggaagagguagaagggaaccaugggucc

SEQ ID NO: 352545 - RNA, 64 nt, hsa
uucugcaaccuaacguuuaauaguccgggucuacagggaagaacaaugacacagcuugagcguu

SEQ ID NO: 352546 - RNA, 64 nt, hsa
uagacaggagggaagauauuagugauuagacagcagggaagauauuagugguaaagagugaaug

SEQ ID NO: 352547 - RNA, 64 nt, hsa
uagacaggaaggaagacauuagugauuagacaggagggaagauauuagugauuagacagcaggg

SEQ ID NO: 352548 - RNA, 64 nt, hsa
caaagacuuauuuugaaaguuggaaggagaagggagggaagagagcagaagggaagaaggugua

SEQ ID NO: 352549 - RNA, 64 nt, hsa
aaaguuggaaggagaagggagggaagagagcagaagggaagaagguguaagucaagcucuugaa

SEQ ID NO: 352550 - RNA, 64 nt, hsa
uccucugagugagaugcccaggaggaggagcccuagggaagaagucagggacagggaccaggau

SEQ ID NO: 352551 - RNA, 64 nt, hsa
gcacuucuucccuauguccaggagagggcaauagagggaagacugaggcugaagaauugacggc

SEQ ID NO: 352552 - RNA, 64 nt, hsa
uucccuccguucugcuucagcuuccccuaagguuagggaagaaagaaucgggcucacgaaugcc

SEQ ID NO: 352553 - RNA, 64 nt, hsa
caaacccggaagaucagaugcaauugcucccaucagggaagaacccuauacuugguuugcuacc

SEQ ID NO: 352554 - RNA, 64 nt, hsa
gaggagcugcuuguuguuuguugacagcuuggaaagggaagaucuuaugccuuuucuuuucugu

SEQ ID NO: 352555 - RNA, 64 nt, hsa
gagaagcaggcggguugggugggaggaggaagaaagggaagaauuagguuugaauugcuuuuuu

SEQ ID NO: 352556 - RNA, 64 nt, hsa
gagaagcaggcggguugggugggaggaggaagaaagggaagaauuagguuugaauugcuuuuua

SEQ ID NO: 352557 - RNA, 64 nt, hsa
ccaacuuagagcaauaacggcugccgcagcagccagggaagaccuugguuugguuuauguguca

SEQ ID NO: 352558 - RNA, 64 nt, hsa
guguggcucccuccuucccugucugggagguuggagggaagaaucuaggccuuagcuugcccuc

SEQ ID NO: 352559 - RNA, 64 nt, hsa
ggaggggacuggaaagcugagacugaaaaucaagagggaagaggugaggaaggcccaccccugg

SEQ ID NO: 352560 - RNA, 64 nt, hsa
cuuguggccucugggcuguaugccucugggguguagggaagaggcgggaggagucauggggaug

SEQ ID NO: 352561 - RNA, 64 nt, hsa
ucaguacaucuuuuguaaaaacccugaaaugggcagggaagaaaacagggauuuccccucucua

SEQ ID NO: 352562 - RNA, 64 nt, hsa
uucaaagguuuauugcuuagccauaugaaaaauaagggaagauuuuuuagcaaggggacccaca

SEQ ID NO: 352563 - RNA, 64 nt, hsa
ugcagcucugggggcccuuuccacuucuggcuauagggaagaaccugaauacugaacuugauuc

SEQ ID NO: 352564 - RNA, 64 nt, hsa
aaaaacguuuaugauauuaagaucaaagggaggaagggaagacagcaguauuaauucacccuag

SEQ ID NO: 352565 - RNA, 64 nt, hsa
caugcugcauacuugccuaguagcaaaacaauacagggaagagucaaaagggcuucuccaacug

SEQ ID NO: 352566 - RNA, 64 nt, hsa
guccagguuauaaccugguaccagcagacuuugcagggaagaaagaguuguuccaaucauguaa

SEQ ID NO: 352567 - RNA, 64 nt, hsa
aaucauguaaccuucuguaggggauuacugagacagggaagagaagugcaagaauugguugcug

SEQ ID NO: 352568 - RNA, 64 nt, hsa
cuuucuccccucccgcuaguaucuuuacaggagcagggaagagcaguagaggauguauaauuuu

SEQ ID NO: 352569 - RNA, 64 nt, hsa
uaggcuaaauaggaguuacagaaaacuguuaaauagggaagaacuacauuaaauuuaaauauuc

SEQ ID NO: 352570 - RNA, 64 nt, hsa
ggaggugcccuucacucuaagcuuaacacuuaguagggaagagauucucaaaugagaaaaaggg

SEQ ID NO: 352571 - RNA, 64 nt, hsa
gagaaaaagggcuccggcuauaugggcaacaaagagggaagauacagguugccaguuauacauu

SEQ ID NO: 352572 - RNA, 64 nt, hsa
gagacuguugaagcucucaauagguggcaguuuuagggaagauuuccauucaguguagggaaga

SEQ ID NO: 352573 - RNA, 64 nt, hsa
gguggcaguuuuagggaagauuuccauucaguguagggaagacauuuguaauaaugaaaacuga

SEQ ID NO: 352574 - RNA, 64 nt, hsa
ucccccagcuuguuugccaugaacugauuccuggagggaagaccauuccuguuacaaaugaaaa

SEQ ID NO: 352575 - RNA, 64 nt, hsa
gugcauacaugcggggaccccagacugucagcacagggaagauggaucccauccuaauuuuuau

SEQ ID NO: 352576 - RNA, 64 nt, hsa
aagcaccuuuuugacagugaacauggucuaaaaaagggaagauauuguagaagauuucacacac

SEQ ID NO: 352577 - RNA, 64 nt, hsa
aaguguggcugaugguagccucuaguuugaagugagggaagaaugaguagucaggaacugguca

SEQ ID NO: 352578 - RNA, 64 nt, hsa
ugaguagucaggaacuggucacuuugaaugugggagggaagauauucacgacaagguuuucuac

SEQ ID NO: 352579 - RNA, 64 nt, hsa
aauucaccaugaaaaaacaagaauaacaaauagaagggaagagauaggaugggaaagcuaacaa

SEQ ID NO: 352580 - RNA, 64 nt, hsa
cuuucugucaaacaaugagguuguagggggagguagggaagaaugagcugaauuuguagcauac

SEQ ID NO: 352581 - RNA, 64 nt, hsa
uaaaaaacaauuccaaaugugaaacuagaaugagagggaagagauagcauggcaugcagcacac

SEQ ID NO: 352582 - RNA, 64 nt, hsa
uuucgugacaauguacgccuuucccucagaauucagggaagagacugucgccugccuuccuccg

SEQ ID NO: 352583 - RNA, 64 nt, hsa
cugugcaggagccuucauuucagcuucaauuaauagggaagaauuuaugauagcucuauagaug

SEQ ID NO: 352584 - RNA, 64 nt, hsa
ucuaccucacaguguccauacaaauuaguuccagagggaagauauaccacaaaauuacucaaaa

SEQ ID NO: 352585 - RNA, 64 nt, hsa
gccuggcugcccaucauguggccccacccaaucaagggaagaaggaggaaugcuggacuggagg

SEQ ID NO: 352586 - RNA, 64 nt, hsa
gggcuguaacguggcacugguagguugggacaccagggaagaagaucaacgccucacugaaaca

SEQ ID NO: 352587 - RNA, 64 nt, hsa
uuagaggauugcagaagacgaguggggggagggcagggaagaugccugucggguuuuuagcaca

SEQ ID NO: 352588 - RNA, 64 nt, hsa
ucuucggugcuucccgggcccggggucugucgggagggaagagaacugggccugaccuaccuga

SEQ ID NO: 352589 - RNA, 64 nt, hsa
cuucacaccauaacuagguaacaguuugauaacuagggaagaaagcagaacaguuaagcagccg

SEQ ID NO: 352590 - RNA, 64 nt, hsa
aggccaccugcaggucacugaaacuucaagcaccagggaagaucuaacauuugagucccuucca

SEQ ID NO: 352591 - RNA, 64 nt, hsa
aucaaaaucuguagagcagggcaaguaacauggaagggaagaaaaggugaaaaauuagaaaugu

SEQ ID NO: 352592 - RNA, 64 nt, hsa
uuggucccuaucuuccagcagguuagaggccuuuagggaagaaaagccugugugcagggaaaga

SEQ ID NO: 352593 - RNA, 64 nt, hsa
ccuuacgaggauuucuggaagcuucuguaacuguagggaagaaagcuguaggggagcaugguuu

SEQ ID NO: 352594 - RNA, 64 nt, hsa
gauggggagugagaugaguaauucagggaagagaagggaagagagaagagucuauuaugagcug

SEQ ID NO: 352595 - RNA, 64 nt, hsa
ggacauacaagauggggagugagaugaguaauucagggaagagaagggaagagagaagagucua

SEQ ID NO: 352596 - RNA, 64 nt, hsa
uguaaaauuuuuuuagaagagauggcuuauuaacagggaagaagcuuguuauauuccaguugua

SEQ ID NO: 352597 - RNA, 64 nt, hsa
aagaauagccuuaguguuuagauuuuuuuaugauagggaagaugcggccaucacugggauauuu

SEQ ID NO: 352598 - RNA, 64 nt, hsa
agccacugacugggggcagagcucuggguggaagagggaagagauccuaauggaggcgccucca

SEQ ID NO: 352599 - RNA, 64 nt, hsa
aggugggaccauggugcucuuuaagcgugaucggagggaagacacacagcagggccaccauucc

SEQ ID NO: 352600 - RNA, 64 nt, hsa
agacuuugauacuaccagggucucucagggauggagggaagaccugaaagagaggacugguucu

SEQ ID NO: 352601 - RNA, 64 nt, hsa
acccuguuacuuauguagaaacugaggcccagagagggaagaugaccugccccaaguggugagc

SEQ ID NO: 352602 - RNA, 64 nt, hsa
uauaauccuagacuggaagaguagaauaucauauagggaagaaaccuuaaacaccacaguguuc

SEQ ID NO: 352603 - RNA, 64 nt, hsa
agaaucaggcagucgcccacuucucuccagaugaagggaagacauucauaggucccaaaucugc

SEQ ID NO: 352604 - RNA, 64 nt, hsa
ggggagaagaaggaagggaagggcagaaggaaggagggaagaaaagaaagcaaaggaacagaag

SEQ ID NO: 352605 - RNA, 64 nt, hsa
uuuuccugucaguuggaccccucaccuggccuccagggaagaaugcagagaaaagcaaggagag

SEQ ID NO: 352606 - RNA, 64 nt, hsa; identical to SEQ ID NO: 246269

SEQ ID NO: 352607 - RNA, 64 nt, hsa; identical to SEQ ID NO: 246270

SEQ ID NO: 352608 - RNA, 64 nt, hsa; identical to SEQ ID NO: 246271

SEQ ID NO: 352609 - RNA, 64 nt, hsa; identical to SEQ ID NO: 246272

SEQ ID NO: 352610 - RNA, 64 nt, hsa; identical to SEQ ID NO: 246273

SEQ ID NO: 352611 - RNA, 64 nt, hsa; identical to SEQ ID NO: 246274

SEQ ID NO: 352612 - RNA, 64 nt, hsa; identical to SEQ ID NO: 246275

SEQ ID NO: 352613 - RNA, 64 nt, hsa; identical to SEQ ID NO: 246276

SEQ ID NO: 352614 - RNA, 51 nt, hsa; identical to SEQ ID NO: 246277

SEQ ID NO: 352615 - RNA, 64 nt, hsa; identical to SEQ ID NO: 246278

SEQ ID NO: 352616 - RNA, 64 nt, hsa; identical to SEQ ID NO: 246279

SEQ ID NO: 352617 - RNA, 56 nt, hsa; identical to SEQ ID NO: 246280

SEQ ID NO: 352618 - RNA, 64 nt, hsa; identical to SEQ ID NO: 246281

SEQ ID NO: 352619 - RNA, 64 nt, hsa; identical to SEQ ID NO: 246282

SEQ ID NO: 352620 - RNA, 64 nt, hsa; identical to SEQ ID NO: 246283

SEQ ID NO: 352621 - RNA, 64 nt, hsa; identical to SEQ ID NO: 246284

SEQ ID NO: 352622 - RNA, 64 nt, hsa; identical to SEQ ID NO: 246285

SEQ ID NO: 352623 - RNA, 64 nt, hsa; identical to SEQ ID NO: 246286

SEQ ID NO: 352624 - RNA, 64 nt, hsa; identical to SEQ ID NO: 246287

SEQ ID NO: 352625 - RNA, 64 nt, hsa; identical to SEQ ID NO: 246288

SEQ ID NO: 352626 - RNA, 64 nt, hsa; identical to SEQ ID NO: 246289

SEQ ID NO: 352627 - RNA, 64 nt, hsa; identical to SEQ ID NO: 246290

SEQ ID NO: 352628 - RNA, 64 nt, hsa; identical to SEQ ID NO: 246291

SEQ ID NO: 352629 - RNA, 64 nt, hsa; identical to SEQ ID NO: 246292

SEQ ID NO: 352630 - RNA, 64 nt, hsa; identical to SEQ ID NO: 246293

SEQ ID NO: 352631 - RNA, 64 nt, hsa; identical to SEQ ID NO: 246294

SEQ ID NO: 352632 - RNA, 64 nt, hsa; identical to SEQ ID NO: 246295

SEQ ID NO: 352633 - RNA, 64 nt, hsa; identical to SEQ ID NO: 246296

SEQ ID NO: 352634 - RNA, 64 nt, hsa; identical to SEQ ID NO: 246297

SEQ ID NO: 352635 - RNA, 64 nt, hsa; identical to SEQ ID NO: 246298

SEQ ID NO: 352636 - RNA, 64 nt, hsa; identical to SEQ ID NO: 246299

SEQ ID NO: 352637 - RNA, 64 nt, hsa; identical to SEQ ID NO: 246300

SEQ ID NO: 352638 - RNA, 64 nt, hsa; identical to SEQ ID NO: 246301

SEQ ID NO: 352639 - RNA, 61 nt, hsa
cuggaugcugucagaggcgauggagaaacgcaaaggcuacuagacgcaacaauagaauuac

SEQ ID NO: 352640 - RNA, 61 nt, hsa
aaauucuacuaaguuuucccauauucuugauaaaggcuaaauuugaaauaauuuauuuaga

SEQ ID NO: 352641 - RNA, 61 nt, hsa
auccuucacauauuucccauaagccccucagaaaggcuaacugugaugaugacacuuuggu

SEQ ID NO: 352642 - RNA, 61 nt, hsa
guauuugucauguuaaaaaguguuagccacaaaaggcuacuuacuuucuuuuccuuuuccu

SEQ ID NO: 352643 - RNA, 61 nt, hsa
auauagaaguguugcauguauaggauuucauaaaggcuaauugcauaagaaagaguaaaca

SEQ ID NO: 352644 - RNA, 61 nt, hsa; identical to SEQ ID NO: 97548

SEQ ID NO: 352645 - RNA, 61 nt, hsa
ccacugugaggcaagcugaggugaacauuuaaaaggcuauuucaagacgaggugcgguggc

SEQ ID NO: 352646 - RNA, 61 nt, hsa
cuggcgccucaaccagcagcuucgaguagagaaaggcuaucccagaaauauuucccacaac

SEQ ID NO: 352647 - RNA, 61 nt, hsa
gguuggguugaccaguaaguagaaaaaggcuaaaggcuaugcgauaugaauuucagaaaug

SEQ ID NO: 352648 - RNA, 61 nt, hsa
caguacugguuggguugaccaguaaguagaaaaaggcuaaaggcuaugcgauaugaauuuc

SEQ ID NO: 352649 - RNA, 64 nt, hsa; identical to SEQ ID NO: 279561

SEQ ID NO: 352650 - RNA, 64 nt, hsa; identical to SEQ ID NO: 279562

SEQ ID NO: 352651 - RNA, 64 nt, hsa; identical to SEQ ID NO: 279563

SEQ ID NO: 352652 - RNA, 64 nt, hsa; identical to SEQ ID NO: 279564

SEQ ID NO: 352653 - RNA, 64 nt, hsa; identical to SEQ ID NO: 279565

SEQ ID NO: 352654 - RNA, 64 nt, hsa; identical to SEQ ID NO: 279566

SEQ ID NO: 352655 - RNA, 64 nt, hsa; identical to SEQ ID NO: 279567

SEQ ID NO: 352656 - RNA, 64 nt, hsa; identical to SEQ ID NO: 279568

SEQ ID NO: 352657 - RNA, 64 nt, hsa; identical to SEQ ID NO: 279569

SEQ ID NO: 352658 - RNA, 64 nt, hsa; identical to SEQ ID NO: 279570

SEQ ID NO: 352659 - RNA, 64 nt, hsa; identical to SEQ ID NO: 279571

SEQ ID NO: 352660 - RNA, 64 nt, hsa; identical to SEQ ID NO: 279572

SEQ ID NO: 352661 - RNA, 64 nt, hsa; identical to SEQ ID NO: 279573

SEQ ID NO: 352662 - RNA, 61 nt, hsa; identical to SEQ ID NO: 279574

SEQ ID NO: 352663 - RNA, 64 nt, hsa; identical to SEQ ID NO: 279575

SEQ ID NO: 352664 - RNA, 64 nt, hsa; identical to SEQ ID NO: 279576

SEQ ID NO: 352665 - RNA, 64 nt, hsa; identical to SEQ ID NO: 279577

SEQ ID NO: 352666 - RNA, 64 nt, hsa; identical to SEQ ID NO: 279578

SEQ ID NO: 352667 - RNA, 64 nt, hsa; identical to SEQ ID NO: 279579

SEQ ID NO: 352668 - RNA, 63 nt, hsa; identical to SEQ ID NO: 279580

SEQ ID NO: 352669 - RNA, 64 nt, hsa; identical to SEQ ID NO: 279581

SEQ ID NO: 352670 - RNA, 64 nt, hsa; identical to SEQ ID NO: 279582

SEQ ID NO: 352671 - RNA, 64 nt, hsa; identical to SEQ ID NO: 279583

SEQ ID NO: 352672 - RNA, 64 nt, hsa; identical to SEQ ID NO: 279584

SEQ ID NO: 352673 - RNA, 64 nt, hsa; identical to SEQ ID NO: 279585

SEQ ID NO: 352674 - RNA, 64 nt, hsa; identical to SEQ ID NO: 279586

SEQ ID NO: 352675 - RNA, 64 nt, hsa; identical to SEQ ID NO: 279587

SEQ ID NO: 352676 - RNA, 64 nt, hsa; identical to SEQ ID NO: 279588

SEQ ID NO: 352677 - RNA, 64 nt, hsa; identical to SEQ ID NO: 279589

SEQ ID NO: 352678 - RNA, 64 nt, hsa; identical to SEQ ID NO: 279590

SEQ ID NO: 352679 - RNA, 64 nt, hsa; identical to SEQ ID NO: 108616

SEQ ID NO: 352680 - RNA, 64 nt, hsa; identical to SEQ ID NO: 108617

SEQ ID NO: 352681 - RNA, 64 nt, hsa; identical to SEQ ID NO: 108618

SEQ ID NO: 352682 - RNA, 64 nt, hsa; identical to SEQ ID NO: 108619

SEQ ID NO: 352683 - RNA, 64 nt, hsa; identical to SEQ ID NO: 108620

SEQ ID NO: 352684 - RNA, 64 nt, hsa; identical to SEQ ID NO: 108621

SEQ ID NO: 352685 - RNA, 64 nt, hsa; identical to SEQ ID NO: 108622

SEQ ID NO: 352686 - RNA, 64 nt, hsa; identical to SEQ ID NO: 108623

SEQ ID NO: 352687 - RNA, 61 nt, hsa; identical to SEQ ID NO: 108624

SEQ ID NO: 352688 - RNA, 64 nt, hsa; identical to SEQ ID NO: 108625

SEQ ID NO: 352689 - RNA, 64 nt, hsa; identical to SEQ ID NO: 108626

SEQ ID NO: 352690 - RNA, 64 nt, hsa; identical to SEQ ID NO: 108627

SEQ ID NO: 352691 - RNA, 64 nt, hsa; identical to SEQ ID NO: 108628

SEQ ID NO: 352692 - RNA, 64 nt, hsa; identical to SEQ ID NO: 108629

SEQ ID NO: 352693 - RNA, 64 nt, hsa; identical to SEQ ID NO: 108630

SEQ ID NO: 352694 - RNA, 64 nt, hsa; identical to SEQ ID NO: 108631

SEQ ID NO: 352695 - RNA, 64 nt, hsa; identical to SEQ ID NO: 108632

SEQ ID NO: 352696 - RNA, 64 nt, hsa; identical to SEQ ID NO: 108633

SEQ ID NO: 352697 - RNA, 64 nt, hsa; identical to SEQ ID NO: 108634

SEQ ID NO: 352698 - RNA, 64 nt, hsa; identical to SEQ ID NO: 108635

SEQ ID NO: 352699 - RNA, 64 nt, hsa; identical to SEQ ID NO: 108636

SEQ ID NO: 352700 - RNA, 64 nt, hsa; identical to SEQ ID NO: 108637

SEQ ID NO: 352701 - RNA, 64 nt, hsa; identical to SEQ ID NO: 108638

SEQ ID NO: 352702 - RNA, 64 nt, hsa; identical to SEQ ID NO: 108639

SEQ ID NO: 352703 - RNA, 64 nt, hsa; identical to SEQ ID NO: 108640

SEQ ID NO: 352704 - RNA, 64 nt, hsa; identical to SEQ ID NO: 108641

SEQ ID NO: 352705 - RNA, 64 nt, hsa; identical to SEQ ID NO: 108642

SEQ ID NO: 352706 - RNA, 64 nt, hsa; identical to SEQ ID NO: 108643

SEQ ID NO: 352707 - RNA, 64 nt, hsa; identical to SEQ ID NO: 108644

SEQ ID NO: 352708 - RNA, 64 nt, hsa; identical to SEQ ID NO: 108645

SEQ ID NO: 352709 - RNA, 64 nt, hsa; identical to SEQ ID NO: 108646

SEQ ID NO: 352710 - RNA, 64 nt, hsa; identical to SEQ ID NO: 108647

SEQ ID NO: 352711 - RNA, 64 nt, hsa; identical to SEQ ID NO: 108648

SEQ ID NO: 352712 - RNA, 64 nt, hsa; identical to SEQ ID NO: 108649

SEQ ID NO: 352713 - RNA, 64 nt, hsa; identical to SEQ ID NO: 108650

SEQ ID NO: 352714 - RNA, 64 nt, hsa; identical to SEQ ID NO: 108651

SEQ ID NO: 352715 - RNA, 64 nt, hsa; identical to SEQ ID NO: 108652

SEQ ID NO: 352716 - RNA, 64 nt, hsa; identical to SEQ ID NO: 108653

SEQ ID NO: 352717 - RNA, 64 nt, hsa; identical to SEQ ID NO: 108654

SEQ ID NO: 352718 - RNA, 64 nt, hsa; identical to SEQ ID NO: 108655

SEQ ID NO: 352719 - RNA, 64 nt, hsa; identical to SEQ ID NO: 108656

SEQ ID NO: 352720 - RNA, 64 nt, hsa; identical to SEQ ID NO: 108657

SEQ ID NO: 352721 - RNA, 64 nt, hsa; identical to SEQ ID NO: 108658

SEQ ID NO: 352722 - RNA, 64 nt, hsa; identical to SEQ ID NO: 108659

SEQ ID NO: 352723 - RNA, 64 nt, hsa; identical to SEQ ID NO: 108660

SEQ ID NO: 352724 - RNA, 64 nt, hsa; identical to SEQ ID NO: 108661

SEQ ID NO: 352725 - RNA, 64 nt, hsa; identical to SEQ ID NO: 108662

SEQ ID NO: 352726 - RNA, 64 nt, hsa; identical to SEQ ID NO: 108663

SEQ ID NO: 352727 - RNA, 64 nt, hsa; identical to SEQ ID NO: 108664

SEQ ID NO: 352728 - RNA, 64 nt, hsa; identical to SEQ ID NO: 108665

SEQ ID NO: 352729 - RNA, 64 nt, hsa; identical to SEQ ID NO: 108666

SEQ ID NO: 352730 - RNA, 64 nt, hsa; identical to SEQ ID NO: 108667

SEQ ID NO: 352731 - RNA, 64 nt, hsa; identical to SEQ ID NO: 108668

SEQ ID NO: 352732 - RNA, 64 nt, hsa; identical to SEQ ID NO: 108669

SEQ ID NO: 352733 - RNA, 64 nt, hsa; identical to SEQ ID NO: 108670

SEQ ID NO: 352734 - RNA, 64 nt, hsa; identical to SEQ ID NO: 108671

SEQ ID NO: 352735 - RNA, 64 nt, hsa; identical to SEQ ID NO: 108672

SEQ ID NO: 352736 - RNA, 64 nt, hsa; identical to SEQ ID NO: 108673

SEQ ID NO: 352737 - RNA, 64 nt, hsa; identical to SEQ ID NO: 108674

SEQ ID NO: 352738 - RNA, 64 nt, hsa; identical to SEQ ID NO: 108675

SEQ ID NO: 352739 - RNA, 64 nt, hsa; identical to SEQ ID NO: 108676

SEQ ID NO: 352740 - RNA, 64 nt, hsa; identical to SEQ ID NO: 108677

SEQ ID NO: 352741 - RNA, 64 nt, hsa; identical to SEQ ID NO: 108678

SEQ ID NO: 352742 - RNA, 64 nt, hsa; identical to SEQ ID NO: 108679

SEQ ID NO: 352743 - RNA, 64 nt, hsa; identical to SEQ ID NO: 108680

SEQ ID NO: 352744 - RNA, 64 nt, hsa; identical to SEQ ID NO: 108681

SEQ ID NO: 352745 - RNA, 64 nt, hsa; identical to SEQ ID NO: 108682

SEQ ID NO: 352746 - RNA, 64 nt, hsa; identical to SEQ ID NO: 108683

SEQ ID NO: 352747 - RNA, 64 nt, hsa; identical to SEQ ID NO: 108684

SEQ ID NO: 352748 - RNA, 64 nt, hsa; identical to SEQ ID NO: 108685

SEQ ID NO: 352749 - RNA, 64 nt, hsa; identical to SEQ ID NO: 108686

SEQ ID NO: 352750 - RNA, 64 nt, hsa; identical to SEQ ID NO: 108687

SEQ ID NO: 352751 - RNA, 64 nt, hsa; identical to SEQ ID NO: 108688

SEQ ID NO: 352752 - RNA, 64 nt, hsa; identical to SEQ ID NO: 108689

SEQ ID NO: 352753 - RNA, 64 nt, hsa; identical to SEQ ID NO: 108690

SEQ ID NO: 352754 - RNA, 64 nt, hsa; identical to SEQ ID NO: 108691

SEQ ID NO: 352755 - RNA, 64 nt, hsa; identical to SEQ ID NO: 108692

SEQ ID NO: 352756 - RNA, 64 nt, hsa; identical to SEQ ID NO: 108693

SEQ ID NO: 352757 - RNA, 64 nt, hsa; identical to SEQ ID NO: 108694

SEQ ID NO: 352758 - RNA, 64 nt, hsa; identical to SEQ ID NO: 108695

SEQ ID NO: 352759 - RNA, 64 nt, hsa; identical to SEQ ID NO: 108696

SEQ ID NO: 352760 - RNA, 64 nt, hsa; identical to SEQ ID NO: 108697

SEQ ID NO: 352761 - RNA, 64 nt, hsa; identical to SEQ ID NO: 108698

SEQ ID NO: 352762 - RNA, 64 nt, hsa; identical to SEQ ID NO: 108699

SEQ ID NO: 352763 - RNA, 64 nt, hsa; identical to SEQ ID NO: 108700

SEQ ID NO: 352764 - RNA, 64 nt, hsa; identical to SEQ ID NO: 108701

SEQ ID NO: 352765 - RNA, 64 nt, hsa; identical to SEQ ID NO: 108702

SEQ ID NO: 352766 - RNA, 64 nt, hsa; identical to SEQ ID NO: 108703

SEQ ID NO: 352767 - RNA, 64 nt, hsa; identical to SEQ ID NO: 108704

SEQ ID NO: 352768 - RNA, 64 nt, hsa; identical to SEQ ID NO: 108705

SEQ ID NO: 352769 - RNA, 64 nt, hsa; identical to SEQ ID NO: 108706

SEQ ID NO: 352770 - RNA, 64 nt, hsa; identical to SEQ ID NO: 108707

SEQ ID NO: 352771 - RNA, 64 nt, hsa; identical to SEQ ID NO: 108708

SEQ ID NO: 352772 - RNA, 64 nt, hsa; identical to SEQ ID NO: 108709

SEQ ID NO: 352773 - RNA, 64 nt, hsa; identical to SEQ ID NO: 108710

SEQ ID NO: 352774 - RNA, 64 nt, hsa; identical to SEQ ID NO: 108711

SEQ ID NO: 352775 - RNA, 64 nt, hsa; identical to SEQ ID NO: 108712

SEQ ID NO: 352776 - RNA, 64 nt, hsa; identical to SEQ ID NO: 108713

SEQ ID NO: 352777 - RNA, 64 nt, hsa; identical to SEQ ID NO: 108714

SEQ ID NO: 352778 - RNA, 64 nt, hsa; identical to SEQ ID NO: 108715

SEQ ID NO: 352779 - RNA, 64 nt, hsa; identical to SEQ ID NO: 108716

SEQ ID NO: 352780 - RNA, 64 nt, hsa; identical to SEQ ID NO: 108717

SEQ ID NO: 352781 - RNA, 64 nt, hsa; identical to SEQ ID NO: 108718

SEQ ID NO: 352782 - RNA, 64 nt, hsa; identical to SEQ ID NO: 108719

SEQ ID NO: 352783 - RNA, 64 nt, hsa; identical to SEQ ID NO: 108720

SEQ ID NO: 352784 - RNA, 64 nt, hsa; identical to SEQ ID NO: 108721

SEQ ID NO: 352785 - RNA, 64 nt, hsa; identical to SEQ ID NO: 108722

SEQ ID NO: 352786 - RNA, 64 nt, hsa; identical to SEQ ID NO: 108723

SEQ ID NO: 352787 - RNA, 64 nt, hsa; identical to SEQ ID NO: 108724

SEQ ID NO: 352788 - RNA, 64 nt, hsa; identical to SEQ ID NO: 108725

SEQ ID NO: 352789 - RNA, 64 nt, hsa; identical to SEQ ID NO: 108726

SEQ ID NO: 352790 - RNA, 64 nt, hsa; identical to SEQ ID NO: 108727

SEQ ID NO: 352791 - RNA, 64 nt, hsa; identical to SEQ ID NO: 108728

SEQ ID NO: 352792 - RNA, 64 nt, hsa; identical to SEQ ID NO: 108729

SEQ ID NO: 352793 - RNA, 64 nt, hsa; identical to SEQ ID NO: 108730

SEQ ID NO: 352794 - RNA, 64 nt, hsa; identical to SEQ ID NO: 108731

SEQ ID NO: 352795 - RNA, 64 nt, hsa; identical to SEQ ID NO: 108732

SEQ ID NO: 352796 - RNA, 64 nt, hsa; identical to SEQ ID NO: 108733

SEQ ID NO: 352797 - RNA, 64 nt, hsa; identical to SEQ ID NO: 108734

SEQ ID NO: 352798 - RNA, 64 nt, hsa; identical to SEQ ID NO: 108735

SEQ ID NO: 352799 - RNA, 64 nt, hsa; identical to SEQ ID NO: 108736

SEQ ID NO: 352800 - RNA, 64 nt, hsa; identical to SEQ ID NO: 108737

SEQ ID NO: 352801 - RNA, 64 nt, hsa; identical to SEQ ID NO: 108738

SEQ ID NO: 352802 - RNA, 64 nt, hsa; identical to SEQ ID NO: 108739

SEQ ID NO: 352803 - RNA, 64 nt, hsa; identical to SEQ ID NO: 108740

SEQ ID NO: 352804 - RNA, 64 nt, hsa; identical to SEQ ID NO: 108741

SEQ ID NO: 352805 - RNA, 64 nt, hsa; identical to SEQ ID NO: 108742

SEQ ID NO: 352806 - RNA, 64 nt, hsa; identical to SEQ ID NO: 108743

SEQ ID NO: 352807 - RNA, 64 nt, hsa; identical to SEQ ID NO: 108744

SEQ ID NO: 352808 - RNA, 64 nt, hsa; identical to SEQ ID NO: 108745

SEQ ID NO: 352809 - RNA, 64 nt, hsa; identical to SEQ ID NO: 108746

SEQ ID NO: 352810 - RNA, 64 nt, hsa; identical to SEQ ID NO: 108747

SEQ ID NO: 352811 - RNA, 64 nt, hsa; identical to SEQ ID NO: 108748

SEQ ID NO: 352812 - RNA, 64 nt, hsa; identical to SEQ ID NO: 108749

SEQ ID NO: 352813 - RNA, 64 nt, hsa; identical to SEQ ID NO: 108750

SEQ ID NO: 352814 - RNA, 64 nt, hsa; identical to SEQ ID NO: 108751

SEQ ID NO: 352815 - RNA, 64 nt, hsa; identical to SEQ ID NO: 108752

SEQ ID NO: 352816 - RNA, 64 nt, hsa; identical to SEQ ID NO: 108753

SEQ ID NO: 352817 - RNA, 64 nt, hsa; identical to SEQ ID NO: 108754

SEQ ID NO: 352818 - RNA, 64 nt, hsa; identical to SEQ ID NO: 108755

SEQ ID NO: 352819 - RNA, 64 nt, hsa; identical to SEQ ID NO: 108756

SEQ ID NO: 352820 - RNA, 64 nt, hsa; identical to SEQ ID NO: 108757

SEQ ID NO: 352821 - RNA, 64 nt, hsa; identical to SEQ ID NO: 108758

SEQ ID NO: 352822 - RNA, 64 nt, hsa; identical to SEQ ID NO: 108759

SEQ ID NO: 352823 - RNA, 64 nt, hsa; identical to SEQ ID NO: 108760

SEQ ID NO: 352824 - RNA, 64 nt, hsa; identical to SEQ ID NO: 108761

SEQ ID NO: 352825 - RNA, 64 nt, hsa; identical to SEQ ID NO: 108762

SEQ ID NO: 352826 - RNA, 64 nt, hsa; identical to SEQ ID NO: 108763

SEQ ID NO: 352827 - RNA, 64 nt, hsa; identical to SEQ ID NO: 108764

SEQ ID NO: 352828 - RNA, 64 nt, hsa; identical to SEQ ID NO: 108765

SEQ ID NO: 352829 - RNA, 64 nt, hsa
gaggagauacuuauuggucuuuuuguuuaauaccuuccccaagaggggacagucuggccaacuu

SEQ ID NO: 352830 - RNA, 64 nt, hsa
ucuaaagucauuuaacuaauagccagcacaucccuuccccaaacugucaauugaaaucuuaacu

SEQ ID NO: 352831 - RNA, 64 nt, hsa
aaauaacaauauagaacaacauuauuauaugugcuuccccaaguuuaaaggcccugcagaaaua

SEQ ID NO: 352832 - RNA, 64 nt, hsa
acaguuccaaugugccuguucacucaccucucccuuccccaacccuucucuacuuggcugcugu

SEQ ID NO: 352833 - RNA, 64 nt, hsa
cuucucuacuuggcugcuguuuuaaaguuugcccuuccccaaauuuggauuuuuauuacagauc

SEQ ID NO: 352834 - RNA, 64 nt, hsa
ucuguaguacguaguuuugucuuaccuguuaacuuuccccaauugagauaaaaguguuuuaaaa

SEQ ID NO: 352835 - RNA, 64 nt, hsa
uuugaacacugcccaucagcuacagucauuacuguuccccaacccacaacuaucuuuuaagaag

SEQ ID NO: 352836 - RNA, 64 nt, hsa
uauuuaaucuucccuguucucugugguccuuuucuuccccaacaacagauagcucaccuuggac

SEQ ID NO: 352837 - RNA, 64 nt, hsa
auggaucccugggccccacuccccuccugacagguuccccaacagcccauuugcccacuuccca

SEQ ID NO: 352838 - RNA, 64 nt, hsa
uuuucuucuaagccuguguguuauaauuuaccaguuccccaaaaugccauuuuuaacgccgaac

SEQ ID NO: 352839 - RNA, 64 nt, hsa
uguaaauaaaauaaaaaauauuugucuccaccuuuuccccaaaagcaacagcaagacauauuuu

SEQ ID NO: 352840 - RNA, 64 nt, hsa
uuuaucaucagcucuuucagugguaaacugugguuuccccaagcugcacaggaggccagaaacc

SEQ ID NO: 352841 - RNA, 64 nt, hsa
gguggcaucucaggggaacacaaagcuaugucuauuccccaauauaggacuuuuaugggcucgg

SEQ ID NO: 352842 - RNA, 64 nt, hsa
gauucucauguuaaccaaguuuuaaaaguucaaauuccccaaaaaggcuuguccaaggcuggcc

SEQ ID NO: 352843 - RNA, 64 nt, hsa
agggauuacuuagaagacauuuuuguacaugcucuuccccaaggauuguacguauuauacaaau

SEQ ID NO: 352844 - RNA, 64 nt, hsa
aguaauaaucguuuuuguuuucuuguacuuugaauuccccaaagucuuaauugcuuuauuuugg

SEQ ID NO: 352845 - RNA, 64 nt, hsa
acuagccccaguuuugacagaauaauucuuggucuuccccaaagagacaauuuguuguacccau

SEQ ID NO: 352846 - RNA, 64 nt, hsa
gccgggcucugaggccacaccucacaccucgcuguuccccaacauccccugagcagugugagcu

SEQ ID NO: 352847 - RNA, 64 nt, hsa
cugaggauucccuagggcugccccgcagaggggcuuccccaagcucuguuuugaagccugcaau

SEQ ID NO: 352848 - RNA, 64 nt, hsa
aaugaaaauucauguccauauggagacuuacauauuccccaaucuuuccaugaauugcauuuuu

SEQ ID NO: 352849 - RNA, 64 nt, hsa
gcuauauauuauucuagcaucaaaguuuuucucuuuccccaaaagugaugaucucaaguccuuu

SEQ ID NO: 352850 - RNA, 64 nt, hsa
aaucuuacaaaguguugguccagagucccaucucuuccccaacccuggauaccaguagcuuccc

SEQ ID NO: 352851 - RNA, 64 nt, hsa
aagcaagggcacagggauuagaccuguggcacacuuccccaauucccucaucuguaggauuugg

SEQ ID NO: 352852 - RNA, 64 nt, hsa
auuacuuuugugaacgcuucugccacaucuugucuuccccaaaauugaucacuccgccuucucc

SEQ ID NO: 352853 - RNA, 64 nt, hsa
augucugcuugagauauuuccucagccugaaaguuuccccaaccaucugccagagaacuccuau

SEQ ID NO: 352854 - RNA, 64 nt, hsa
ccuggccuucacugucucccuugcccuuugacuuuuccccaaucaaagggaacugcagugcugg

SEQ ID NO: 352855 - RNA, 64 nt, hsa
aaccaagccccauggccucagaauuuccccccaguuccccaagugucucuggggaccugaagcc

SEQ ID NO: 352856 - RNA, 64 nt, hsa
ccaggggaguggguaggccauagccaaggaucgauuccccaaccacagcaaaggcaacacucuu

SEQ ID NO: 352857 - RNA, 64 nt, hsa
gggcugguccagguagcucuccugaaccuccuccuuccccaagcugagaagcugagagcuggag

SEQ ID NO: 352858 - RNA, 64 nt, hsa
uccugcuuauuuauaaaucauuuccuuucuuuuuuuccccaaagucagaauugcucaaagaaaa

SEQ ID NO: 352859 - RNA, 64 nt, hsa
aaucccagauaugguugcacaaaaccacuuuuuuuuccccaaguauuaaacucuaauguaccaa

SEQ ID NO: 352860 - RNA, 64 nt, hsa
ucuaagcacuuuacuuguauuaauuuauuuuaucuuccccaaggcccucagaagcagauuauuc

SEQ ID NO: 352861 - RNA, 64 nt, hsa
ugggcaggagaaagagcagauuccuuuuagcuaauuccccaacccauaugccccucugaaguug

SEQ ID NO: 352862 - RNA, 64 nt, hsa
ggcuggccuugugcagacccuggacugcauccgguuccccaaagcccugcugcauucgaguguc

SEQ ID NO: 352863 - RNA, 64 nt, hsa
aggccagggccccuguucuagggguuaggguucuuuccccaaaggaacuuaaaaagacaagcgu

SEQ ID NO: 352864 - RNA, 64 nt, hsa
cacccaagccccgugcuagcagcgcuccgugcucuuccccaaauacucacggcucuaauucccc

SEQ ID NO: 352865 - RNA, 64 nt, hsa
cuccgugcucuuccccaaauacucacggcucuaauuccccaaaccugaaacuucauacccuggg

SEQ ID NO: 352866 - RNA, 64 nt, hsa
cacaaauugugaagauuucauggacacugaucacuuccccaaucaauacccuugugauuucuua

SEQ ID NO: 352867 - RNA, 64 nt, hsa
cguggauugugaagauuucauggacauuuauuaguuccccaaauuaauacuuuuauaauuuccu

SEQ ID NO: 352868 - RNA, 64 nt, hsa
acagugcuacacucgucuccacuguuuguuuuacuuccccaaaauggaccuuuuuuuuuucuaa

SEQ ID NO: 352869 - RNA, 64 nt, hsa
gugguuaggacaucucccccaccuccccacuuuuuuccccaagacaagacaaucgaggucuggc

SEQ ID NO: 352870 - RNA, 64 nt, hsa; identical to SEQ ID NO: 102089

SEQ ID NO: 352871 - RNA, 64 nt, hsa; identical to SEQ ID NO: 102090

SEQ ID NO: 352872 - RNA, 64 nt, hsa; identical to SEQ ID NO: 102091

SEQ ID NO: 352873 - RNA, 64 nt, hsa; identical to SEQ ID NO: 102092

SEQ ID NO: 352874 - RNA, 64 nt, hsa; identical to SEQ ID NO: 102093

SEQ ID NO: 352875 - RNA, 64 nt, hsa; identical to SEQ ID NO: 102094

SEQ ID NO: 352876 - RNA, 64 nt, hsa; identical to SEQ ID NO: 102095

SEQ ID NO: 352877 - RNA, 64 nt, hsa; identical to SEQ ID NO: 102096

SEQ ID NO: 352878 - RNA, 64 nt, hsa; identical to SEQ ID NO: 171556

SEQ ID NO: 352879 - RNA, 64 nt, hsa; identical to SEQ ID NO: 171557

SEQ ID NO: 352880 - RNA, 64 nt, hsa; identical to SEQ ID NO: 171558

SEQ ID NO: 352881 - RNA, 64 nt, hsa; identical to SEQ ID NO: 171559

SEQ ID NO: 352882 - RNA, 64 nt, hsa; identical to SEQ ID NO: 171560

SEQ ID NO: 352883 - RNA, 64 nt, hsa; identical to SEQ ID NO: 171561

SEQ ID NO: 352884 - RNA, 64 nt, hsa; identical to SEQ ID NO: 171562

SEQ ID NO: 352885 - RNA, 64 nt, hsa; identical to SEQ ID NO: 171563

SEQ ID NO: 352886 - RNA, 64 nt, hsa; identical to SEQ ID NO: 171564

SEQ ID NO: 352887 - RNA, 64 nt, hsa; identical to SEQ ID NO: 171565

SEQ ID NO: 352888 - RNA, 64 nt, hsa; identical to SEQ ID NO: 171566

SEQ ID NO: 352889 - RNA, 64 nt, hsa; identical to SEQ ID NO: 171567

SEQ ID NO: 352890 - RNA, 64 nt, hsa; identical to SEQ ID NO: 171568

SEQ ID NO: 352891 - RNA, 64 nt, hsa; identical to SEQ ID NO: 171569

SEQ ID NO: 352892 - RNA, 64 nt, hsa; identical to SEQ ID NO: 171570

SEQ ID NO: 352893 - RNA, 64 nt, hsa; identical to SEQ ID NO: 171571

SEQ ID NO: 352894 - RNA, 64 nt, hsa; identical to SEQ ID NO: 171572

SEQ ID NO: 352895 - RNA, 64 nt, hsa; identical to SEQ ID NO: 171573

SEQ ID NO: 352896 - RNA, 64 nt, hsa; identical to SEQ ID NO: 171574

SEQ ID NO: 352897 - RNA, 64 nt, hsa; identical to SEQ ID NO: 171575

SEQ ID NO: 352898 - RNA, 64 nt, hsa; identical to SEQ ID NO: 171576

SEQ ID NO: 352899 - RNA, 64 nt, hsa; identical to SEQ ID NO: 171577

SEQ ID NO: 352900 - RNA, 64 nt, hsa; identical to SEQ ID NO: 171578

SEQ ID NO: 352901 - RNA, 64 nt, hsa; identical to SEQ ID NO: 171579

SEQ ID NO: 352902 - RNA, 64 nt, hsa; identical to SEQ ID NO: 171580

SEQ ID NO: 352903 - RNA, 64 nt, hsa; identical to SEQ ID NO: 171581

SEQ ID NO: 352904 - RNA, 64 nt, hsa; identical to SEQ ID NO: 171582

SEQ ID NO: 352905 - RNA, 64 nt, hsa; identical to SEQ ID NO: 171583

SEQ ID NO: 352906 - RNA, 64 nt, hsa; identical to SEQ ID NO: 171584

SEQ ID NO: 352907 - RNA, 64 nt, hsa; identical to SEQ ID NO: 171585

SEQ ID NO: 352908 - RNA, 64 nt, hsa; identical to SEQ ID NO: 171586

SEQ ID NO: 352909 - RNA, 64 nt, hsa; identical to SEQ ID NO: 171587

SEQ ID NO: 352910 - RNA, 64 nt, hsa; identical to SEQ ID NO: 171588

SEQ ID NO: 352911 - RNA, 64 nt, hsa; identical to SEQ ID NO: 171589

SEQ ID NO: 352912 - RNA, 64 nt, hsa; identical to SEQ ID NO: 171590

SEQ ID NO: 352913 - RNA, 64 nt, hsa; identical to SEQ ID NO: 171591

SEQ ID NO: 352914 - RNA, 64 nt, hsa; identical to SEQ ID NO: 171592

SEQ ID NO: 352915 - RNA, 64 nt, hsa; identical to SEQ ID NO: 171593

SEQ ID NO: 352916 - RNA, 64 nt, hsa; identical to SEQ ID NO: 171594

SEQ ID NO: 352917 - RNA, 64 nt, hsa; identical to SEQ ID NO: 171595

SEQ ID NO: 352918 - RNA, 64 nt, hsa; identical to SEQ ID NO: 171596

SEQ ID NO: 352919 - RNA, 64 nt, hsa; identical to SEQ ID NO: 171597

SEQ ID NO: 352920 - RNA, 64 nt, hsa; identical to SEQ ID NO: 171598

SEQ ID NO: 352921 - RNA, 64 nt, hsa; identical to SEQ ID NO: 171599

SEQ ID NO: 352922 - RNA, 64 nt, hsa; identical to SEQ ID NO: 171600

SEQ ID NO: 352923 - RNA, 64 nt, hsa; identical to SEQ ID NO: 171601

SEQ ID NO: 352924 - RNA, 64 nt, hsa; identical to SEQ ID NO: 171602

SEQ ID NO: 352925 - RNA, 64 nt, hsa; identical to SEQ ID NO: 171603

SEQ ID NO: 352926 - RNA, 64 nt, hsa; identical to SEQ ID NO: 171604

SEQ ID NO: 352927 - RNA, 64 nt, hsa; identical to SEQ ID NO: 171605

SEQ ID NO: 352928 - RNA, 64 nt, hsa; identical to SEQ ID NO: 171606

SEQ ID NO: 352929 - RNA, 64 nt, hsa; identical to SEQ ID NO: 171607

SEQ ID NO: 352930 - RNA, 64 nt, hsa; identical to SEQ ID NO: 171608

SEQ ID NO: 352931 - RNA, 64 nt, hsa; identical to SEQ ID NO: 171609

SEQ ID NO: 352932 - RNA, 64 nt, hsa; identical to SEQ ID NO: 171610

SEQ ID NO: 352933 - RNA, 64 nt, hsa; identical to SEQ ID NO: 171611

SEQ ID NO: 352934 - RNA, 64 nt, hsa; identical to SEQ ID NO: 171612

SEQ ID NO: 352935 - RNA, 64 nt, hsa; identical to SEQ ID NO: 171613

SEQ ID NO: 352936 - RNA, 64 nt, hsa; identical to SEQ ID NO: 171614

SEQ ID NO: 352937 - RNA, 64 nt, hsa; identical to SEQ ID NO: 171615

SEQ ID NO: 352938 - RNA, 64 nt, hsa; identical to SEQ ID NO: 171616

SEQ ID NO: 352939 - RNA, 64 nt, hsa; identical to SEQ ID NO: 171617

SEQ ID NO: 352940 - RNA, 64 nt, hsa; identical to SEQ ID NO: 171618

SEQ ID NO: 352941 - RNA, 64 nt, hsa; identical to SEQ ID NO: 171619

SEQ ID NO: 352942 - RNA, 64 nt, hsa; identical to SEQ ID NO: 171620

SEQ ID NO: 352943 - RNA, 64 nt, hsa; identical to SEQ ID NO: 171621

SEQ ID NO: 352944 - RNA, 64 nt, hsa; identical to SEQ ID NO: 171622

SEQ ID NO: 352945 - RNA, 64 nt, hsa; identical to SEQ ID NO: 171623

SEQ ID NO: 352946 - RNA, 64 nt, hsa; identical to SEQ ID NO: 171624

SEQ ID NO: 352947 - RNA, 64 nt, hsa; identical to SEQ ID NO: 171625

SEQ ID NO: 352948 - RNA, 64 nt, hsa; identical to SEQ ID NO: 171626

SEQ ID NO: 352949 - RNA, 64 nt, hsa; identical to SEQ ID NO: 171627

SEQ ID NO: 352950 - RNA, 64 nt, hsa; identical to SEQ ID NO: 171628

SEQ ID NO: 352951 - RNA, 64 nt, hsa
gucuuuuuacccccaagauaucugucuucaguagcgacugaaucugccacucucagaauaaguu

SEQ ID NO: 352952 - RNA, 50 nt, hsa
uccaggacacaaaugugugacgacugaaaucaggaagauuuuucuaucag

SEQ ID NO: 352953 - RNA, 64 nt, hsa
ggaggacacaguuucuauuguaaauuuggauuuacgacugaagaaggacauuuucucuuuaaaa

SEQ ID NO: 352954 - RNA, 64 nt, hsa
ucaguaaagccuccuggcaccaggccuuccugcucgacugaaaaaaauuuucucuuugaaaauc

SEQ ID NO: 352955 - RNA, 64 nt, hsa
cacacacacacacacacacacacacauacacacacgacugaaucagaucggauugcucuuugau

SEQ ID NO: 352956 - RNA, 64 nt, hsa
acugcacuccagccggggugacagagugagacuccgacugaaaauaaauaaauaaauaaauaaa

SEQ ID NO: 352957 - RNA, 64 nt, hsa
cuuuugauacgaucuugugaaaacacuguauuuucgacugaaaauuccacuuucuucaucuugu

SEQ ID NO: 352958 - RNA, 64 nt, hsa
uuaaugaaagggauguucaugacagcaucauauacgacugaaagaagaaaacuagauuuucaac

SEQ ID NO: 352959 - RNA, 64 nt, hsa
aagcacuuguuucaaguuuuguucugcacucccacgacugaaguuguagauugagcugaauaac

SEQ ID NO: 352960 - RNA, 64 nt, hsa
gcaguugguugaauaauuauugaaaaaaagaacacgacugaaaaaguucaucugaugccucuga

SEQ ID NO: 352961 - RNA, 64 nt, hsa
gauuuuuuuuuaauaaacugcaucgagauccaaccgacugaauuguuaaaaaaaaaaaaaauaa

SEQ ID NO: 352962 - RNA, 64 nt, hsa
gguggauggagacacuucuaacuuuaauaaacugcgacugaacguggaauccuaguaaaagugu

SEQ ID NO: 352963 - RNA, 64 nt, hsa
gucuuuuuggggguuucagaguggccggagaaaccgacugaagggacugaccagcuagcuagga

SEQ ID NO: 352964 - RNA, 64 nt, hsa
gguuuuucuuuuuauuuuuuuuuuuaauuuuaaacgacugaagaaaacauuaggagaggcaaaa

SEQ ID NO: 352965 - RNA, 64 nt, hsa
guacuacuggaacuaaugacugcaaaguguuaaacgacugaaauauacaaacagucucuuaguu

SEQ ID NO: 352966 - RNA, 64 nt, hsa
ccagccgggcuccugaagcccgcugaaaggucagcgacugaaggccuugcagacaaccgucugg

SEQ ID NO: 352967 - RNA, 64 nt, hsa
ugacuuccauuuggcaauuguugaauuauaacugcgacugaaacaaacagguucauagagauga

SEQ ID NO: 352968 - RNA, 64 nt, hsa
cugagggggccgacagugcccuccaagacagagacgacugaacuuuugggguggagacuagagg

SEQ ID NO: 352969 - RNA, 64 nt, hsa
gccugaggggacaccagacucagcucuuuucuagcgacugaaaguagaagucuguccgucuaug

SEQ ID NO: 352970 - RNA, 64 nt, hsa
uccgcaguguccaaaccuaguuucccaugaguugcgacugaaaaugugaaacgacacuguauug

SEQ ID NO: 352971 - RNA, 64 nt, hsa
uuucagcaauuccugcagagccugcagcccaggacgacugaagcucuugcagccccugcagacg

SEQ ID NO: 352972 - RNA, 64 nt, hsa
gcagcacagacugccaaguacuguuuuuuuuaaccgacugaaaucacuuugggauauuuuuucc

SEQ ID NO: 352973 - RNA, 64 nt, hsa
uggugcgggcaggaggcgggagcccggaucugugcgacugaaggugggaagaggaguacacggu

SEQ ID NO: 352974 - RNA, 64 nt, hsa
aaacgggggaauuacuguguauuugcucucuagacgacugaauaagggaaaaguuagggaaccc

SEQ ID NO: 352975 - RNA, 64 nt, hsa
aacauacagaaggaauuuaggggcuuaaacauuacgacugaaugcacuuuaguauaaagggcac

SEQ ID NO: 352976 - RNA, 64 nt, hsa
cuagagacuucacccgggggugaagggguaaacccgacugaaacuggaacccuuguccuccgcu

SEQ ID NO: 352977 - RNA, 64 nt, hsa
agucagcaaccauuuuacuuuguguguuuuuucacgacugaacaccagcugcuaucaagcaagc

SEQ ID NO: 352978 - RNA, 64 nt, hsa
ugccugcagguaucacuuugauccuaugugggagcgacugaaaauagaaugagcuugguuaagc

SEQ ID NO: 352979 - RNA, 64 nt, hsa
guccuggggcucuccaggcagugggguuaugugucgacugaagggugaugugcagaagagcuug

SEQ ID NO: 352980 - RNA, 64 nt, hsa
cgagugccugccucggcuguggcacuuccagguucgacugaaucaagcaucugaagacuggguu

SEQ ID NO: 352981 - RNA, 64 nt, hsa
gaugccauccaaguuguauauuuuuuuaaucucucgacugaauggacuuugcacacuuuggccc

SEQ ID NO: 352982 - RNA, 64 nt, hsa
auaaaacuggguugagggaugcuggaaccaguuacgacugaagucaguguagaccugagcuggg

SEQ ID NO: 352983 - RNA, 64 nt, hsa
acacgaacagugccccuaacggagauuuguucagcgacugaauauacaccuguaaacgaguagc

SEQ ID NO: 352984 - RNA, 64 nt, hsa
gcgccgagauagcgccauugcacuccagccugggcgacugaauaaaacucugucucaaaaaaaa

SEQ ID NO: 352985 - RNA, 64 nt, hsa
cuccugcaagagggcaacuccagccaguguucagcgacugaacagccaauaggagcccuugguu

SEQ ID NO: 352986 - RNA, 64 nt, hsa
ccauaucaguaacuucgagugaguuuccuaaggccgacugaagcucuguuuacacauaagagug

SEQ ID NO: 352987 - RNA, 64 nt, hsa
gaaauugcuuuguauuguauauuacaaugaucaccgacugaaaauauuguuuuacaauaguucu

SEQ ID NO: 352988 - RNA, 64 nt, hsa
gugcucagugggagccaggaagccucaggcuucacgacugaaugcacccaauauccgaccuggc

SEQ ID NO: 352989 - RNA, 64 nt, hsa
cguggcagauuuccuguucuuguucgcaguuugccgacugaagagugugggauuuccgaggccc

SEQ ID NO: 352990 - RNA, 64 nt, hsa
uagacaucaggugaggaugauggagguagacagucgacugaaugucagcuggaaaauccaguca

SEQ ID NO: 352991 - RNA, 64 nt, hsa
gguuuucuccuugggguugaaucauucaacuuaacgacugaagcccuuucuugucuccuuugga

SEQ ID NO: 352992 - RNA, 64 nt, hsa
uuaauaccuauacacacuaaguccaucuuacaaccgacugaagggguguugcaccuaaucauca

SEQ ID NO: 352993 - RNA, 64 nt, hsa
cugucacauagcucugacguuuuguuguaauaaauguuuucaggccgggcacuguggcucacgc

SEQ ID NO: 352994 - RNA, 64 nt, hsa
aaauaauaauaauaauaaauaaauaaaaaauaaauguuuucaguaaaaccagccugggguuggu

SEQ ID NO: 352995 - RNA, 64 nt, hsa
gucuuucuuuuuuuguuuuuguuuucuguuuguuuguuuucauguugaaugcccacaccaccau

SEQ ID NO: 352996 - RNA, 64 nt, hsa
uuaauuaucacauuuuaaauuacuuuguggacuguguuuucaaaacuuugcaaauucaucuguu

SEQ ID NO: 352997 - RNA, 64 nt, hsa
cugcagaagaaaauuuugcucuuauaaaaccucauguuuucaucauucccaucuuuucuuuuua

SEQ ID NO: 352998 - RNA, 64 nt, hsa
guaccaaugaacacauccagcugaucccaaaagcuguuuucagguauaaggacaaggagaggag

SEQ ID NO: 352999 - RNA, 64 nt, hsa
acuacuggcaaggaacuuacccagcuguuauacauguuuucaguucucuuugggggccaugucc

SEQ ID NO: 353000 - RNA, 64 nt, hsa
ugucugacuuugaaauuccauuuacaauguaguauguuuucaaugaaaaaccauaaaguaacau

SEQ ID NO: 353001 - RNA, 64 nt, hsa
uauuuuucugaguuuguuuucuaucauaaauacauguuuucacagccuuugucucucagacucu

SEQ ID NO: 353002 - RNA, 64 nt, hsa
cagagaccccaucacugaguuuugugugaugagauguuuucaucauuuuuguuuccuuuucuug

SEQ ID NO: 353003 - RNA, 64 nt, hsa
ucagaacacugauaacacucagaaaaccacaguguguuuucauauuuggaacuuuguaauagcg

SEQ ID NO: 353004 - RNA, 64 nt, hsa
aaacauccuaugaauuugaaaguuuccuaaguguuguuuucaaagaacugguuuauuuuauagu

SEQ ID NO: 353005 - RNA, 64 nt, hsa
ugcaaauuguuuuuauuuaaagauggugagaaaguguuuucauuaaaauauguuuucaaaacca

SEQ ID NO: 353006 - RNA, 64 nt, hsa
uuaaagauggugagaaaguguuuucauuaaaauauguuuucaaaaccauuuucaggccgggcac

SEQ ID NO: 353007 - RNA, 64 nt, hsa
aauauuuuaggauuuauucaaaaacagacuauucuguuuucagcuucagaauuguucuuugaau

SEQ ID NO: 353008 - RNA, 64 nt, hsa
uuuauuuuauuauccuauuuucuaccauuaucuauguuuucauggugcuauuaauuacaaguuu

SEQ ID NO: 353009 - RNA, 64 nt, hsa
acugaacuuguaauuugaaucuaguaugguguucuguuuucagcugacuuggacaaccugacug

SEQ ID NO: 353010 - RNA, 64 nt, hsa
ugcagcaagaggaccccgcucucuucaggaaaaguguuuucauuucucaggaugcuucuuaccu

SEQ ID NO: 353011 - RNA, 64 nt, hsa
agaagcaacuugcauuagagagggaacuguuaaauguuuucaacccaguucaucugguggaugu

SEQ ID NO: 353012 - RNA, 64 nt, hsa
aauguucauuuuuuucuguauagauacuuuaucauguuuucaugauuuuaggaauuacugcuuu

SEQ ID NO: 353013 - RNA, 64 nt, hsa
uaugcuaucuguaggcugaaauuauagguacaucuguuuucacuauaugauauuaagaaagcgu

SEQ ID NO: 353014 - RNA, 64 nt, hsa
cauuccaggauaacagcuugcacccuccucagaauguuuucagcgaaagagugggguggcuguu

SEQ ID NO: 353015 - RNA, 64 nt, hsa
gacacagcaauuuaaauuauaaugugucaggcuguguuuucacuucaaacauguaugaguaguc

SEQ ID NO: 353016 - RNA, 64 nt, hsa
augacugguaaaaauguucuccccuucuguggauuguuuucaguuucuuguugguguccuuuga

SEQ ID NO: 353017 - RNA, 64 nt, hsa
ugaacauauuucuacaagauuuuguguggacauauguuuucauuucuuuuagcaauauacauag

SEQ ID NO: 353018 - RNA, 64 nt, hsa
uuacuucuguguccuaaggguaauuucucaggauuguuuucaaauugcuuuuuuaggggaaaua

SEQ ID NO: 353019 - RNA, 64 nt, hsa
ccaaauaauguguagucucuauaaccaauaccuuuguuuucauguguaagaaaaggcccauuac

SEQ ID NO: 353020 - RNA, 64 nt, hsa
cagaaguguuucuggaagugaugcuuccaggauuuguuuucagaaacaagaauugaguugaugg

SEQ ID NO: 353021 - RNA, 64 nt, hsa
ugccaagcacuucaggccuauguuuugcuuauauuguuuucaggugcucaaaaugcaaaacaca

SEQ ID NO: 353022 - RNA, 64 nt, hsa
ucaaaauaaaauaucauauaaauauugagggaaauguuuucauauuuuucaaaauagguuuuua

SEQ ID NO: 353023 - RNA, 64 nt, hsa
auuuguguaguuuggugcuuuguuccaaguuaaguguuuucagaaaaguauguuuugcauguau

SEQ ID NO: 353024 - RNA, 64 nt, hsa
uuuacgaugacuacuuuugguggaguugaaaugcuguuuucauucugcauuuguguaguuuggu

SEQ ID NO: 353025 - RNA, 64 nt, hsa
uauagaguuuauaaaaugacuauggauaggggacuguuuucacuuuuagaucaaaauggguuuu

SEQ ID NO: 353026 - RNA, 64 nt, hsa
agaguggaggaggcuggccaaagagacugugggcuguuuucagucagggagcaugugcauuguu

SEQ ID NO: 353027 - RNA, 64 nt, hsa
ucaaucuggauucauauuuaauuugaagguagaauguuuucaaauguucuccagucauuauguu

SEQ ID NO: 353028 - RNA, 64 nt, hsa
uuucuggcuuagaacaaaggggcuuaauuauugauguuuucauagagaauauaaaaauaaagca

SEQ ID NO: 353029 - RNA, 64 nt, hsa
guaaucaagaaaguuagucauguuuuauguaccauguuuucacacgugucucuucucuucgacu

SEQ ID NO: 353030 - RNA, 64 nt, hsa
gauuuguuugguauaaauaaagaauuauuuguuuuguuuucaaugacaguaagcuacaaaucau

SEQ ID NO: 353031 - RNA, 64 nt, hsa
caguuaagaaccacugacaauguaacucucucauuguuuucauuuuauacguuuuuuugagaug

SEQ ID NO: 353032 - RNA, 64 nt, hsa
cucacaaucuucacaaaguagaacuuagguauaguguuuucaaauucuaaaguccacuucaguu

SEQ ID NO: 353033 - RNA, 64 nt, hsa
gagcaaucaguauuauuggaccaaauuugguguuuguuuucaccuugacgcucuucuuuucauu

SEQ ID NO: 353034 - RNA, 64 nt, hsa
gaucaguggccauauuacuguaggcccugguucauguuuucaucaaucuaaggugcaauuucua

SEQ ID NO: 353035 - RNA, 64 nt, hsa
uuaccuccaucauaguugcuuuuuucauaguucuuguuuucauguuuuauuuuuaaaaagacau

SEQ ID NO: 353036 - RNA, 64 nt, hsa
aaauguuuacauugaugaugaguaauauugcauguguuuucaggugaucagauaaaauauauuu

SEQ ID NO: 353037 - RNA, 64 nt, hsa
aauucuaagugccgccuuccauuuuuuuucaguauguuuucacuggcuuauguuuucagauaug

SEQ ID NO: 353038 - RNA, 64 nt, hsa
uuccauuuuuuuucaguauguuuucacuggcuuauguuuucagauaugauuuuccuuuuucgca

SEQ ID NO: 353039 - RNA, 64 nt, hsa
guucuuuacauauaaaucugcuucaaccuuaggauguuuucagaccagaggcaacuuauucaug

SEQ ID NO: 353040 - RNA, 64 nt, hsa
aucuauaaucccuaaaaugcaauaaaaacuaguauguuuucacgguguauauuuuuuuucaaaa

SEQ ID NO: 353041 - RNA, 64 nt, hsa
ugcauauaacgugauauuugguucaugaaagaguuguuuucaugugguuauuguagggaguaua

SEQ ID NO: 353042 - RNA, 64 nt, hsa
ucuuagugcagaaauaacauuauuaauagaguauuguuuucaaaacagagaugauuaauuucaa

SEQ ID NO: 353043 - RNA, 64 nt, hsa
uaguuaaauaggacaaagcaggcccuaugacuauuguuuucaaaaaauuaauauauaaauaauu

SEQ ID NO: 353044 - RNA, 64 nt, hsa
auuucagaugccaccguauagcaaagggugaacauguuuucaacccuuuaacuuuuuacggugu

SEQ ID NO: 353045 - RNA, 64 nt, hsa
aaaauauaaauucuggacaaauaagucauauaccuguuuucaguccuaacauuuaaggauucuu

SEQ ID NO: 353046 - RNA, 64 nt, hsa
caucuucauugucaguucucaaaaugacugaaauuguuuucaugguaaaaguuaauauacuaaa

SEQ ID NO: 353047 - RNA, 64 nt, hsa
uuaagucuuuggguuuuguuuuaauaaaacagcauguuuucagguagagcuuaaacuaaaugau

SEQ ID NO: 353048 - RNA, 64 nt, hsa
aaagugucagaaaauaguuaacauucaaaaaacuuguuuucacauggaccaaaagaugugccau

SEQ ID NO: 353049 - RNA, 64 nt, hsa
aagaaaaccuccacagccuucuggaugaagaaccuguuuucaaauauacuuguugcagauacag

SEQ ID NO: 353050 - RNA, 64 nt, hsa
uuguuuuuguuuuucuguucuuuguuguggcucuuguuuucauuuuuguuguacguguagaucu

SEQ ID NO: 353051 - RNA, 64 nt, hsa
uacuugaauuugucauaaagcuaaauauuuuauauguuuucaaagauuauuuuuucauauuaau

SEQ ID NO: 353052 - RNA, 64 nt, hsa
ugcuaauuuaaaaauauuuauuuuaucauuuuaauguuuucauggacuuuuuugcugaugguaa

SEQ ID NO: 353053 - RNA, 64 nt, hsa
auuuacacagcacuuuguaguuugcaaauugguguguuuucagcccccucccgcugccccaugc

SEQ ID NO: 353054 - RNA, 64 nt, hsa
guuccauauuccacucauucaaaggacagcuugguguuuucacacuuuaugcagguuaggggau

SEQ ID NO: 353055 - RNA, 64 nt, hsa
acaguaaacagaaacccaaaaaucucaucuuggguguuuucagggcuuguuuugaguuuugcug

SEQ ID NO: 353056 - RNA, 64 nt, hsa
gguuaagacaguuuucaguguaccguaaauguuguguuuucagaaaaagacaaaacgauggugc

SEQ ID NO: 353057 - RNA, 64 nt, hsa
gcugcuuuacacaaucuguucuauaagguucagguguuuucaaguuggaaagaucauaaauacu

SEQ ID NO: 353058 - RNA, 64 nt, hsa
uuuucaaguuggaaagaucauaaauacucaaaauuguuuucaaguuagcaaguucuuuuaacag

SEQ ID NO: 353059 - RNA, 64 nt, hsa
uagacuuauuguacacacuuaguuuuuauucacuuguuuucacucugaauuuuaauauuuggcu

SEQ ID NO: 353060 - RNA, 64 nt, hsa
guuuagauucuuuaugugccuuucaugaaagauauguuuucauuaauuuuacugguggaccugu

SEQ ID NO: 353061 - RNA, 64 nt, hsa
uugccgagugacuuucuaacauaggaauucacuguguuuucauuugaugucguacugguuuuaa

SEQ ID NO: 353062 - RNA, 64 nt, hsa
agagcacaaugcuguguaacauaggaauucacuguguuuucauuugaugucguacugguuuuaa

SEQ ID NO: 353063 - RNA, 64 nt, hsa
caauaucagcucuaaaggaccaaugcuuuuauaauguuuucaacuguaucugagucagccagag

SEQ ID NO: 353064 - RNA, 64 nt, hsa
gacucagcuaaacaauaaguuauuaguagucacuuguuuucauuaucauaauugaauuuccaag

SEQ ID NO: 353065 - RNA, 64 nt, hsa
uaaacaucuuucauauuuuguuaguacuuucaaauguuuucaauuugacuuucccucugaauau

SEQ ID NO: 353066 - RNA, 64 nt, hsa
auuacuucauuuauguuuacaucauguuuagaaauguuuucauuuacuguggucuuuggucacu

SEQ ID NO: 353067 - RNA, 64 nt, hsa
uuuaaaaauaaguuuaagaaauuuaagagaauuguguuuucauuaaguuuugcauaucuuuugu

SEQ ID NO: 353068 - RNA, 64 nt, hsa
cuuuccauacauccauuucugaaguauucaggaauguuuucauaaucgaaagaaacggguaucc

SEQ ID NO: 353069 - RNA, 64 nt, hsa
uaaacgccauaggcuaggcugaacuguauguuacuguuuucaugcuuauacauauauuuucaau

SEQ ID NO: 353070 - RNA, 64 nt, hsa
uuuuagagucuuauuugauuauggugggagggaauguuuucaaauuucccauuucucaagaaau

SEQ ID NO: 353071 - RNA, 64 nt, hsa
ucugagcaaggccuacuuggcccuggauagaaauuguuuucaaagagaagggcagcugcuuaga

SEQ ID NO: 353072 - RNA, 64 nt, hsa
auucuaguuaagccauaaguucaacguguaaacuuguuuucauuaaagaauuuuucuaucaaac

SEQ ID NO: 353073 - RNA, 64 nt, hsa
guaugacauugugugguugacccucugagauaacuguuuucaucuacagaauugcauuuuugcu

SEQ ID NO: 353074 - RNA, 64 nt, hsa
gaaguuacaguaguaccauuuugauuagucugaauguuuucaggccuugaaauaaauuuugacu

SEQ ID NO: 353075 - RNA, 64 nt, hsa
uguuuguuguuguuguugaagacaguaaaauaaguguuuucaaaucuauaugucuccuuuuugu

SEQ ID NO: 353076 - RNA, 64 nt, hsa
caucucgguaaucauggaaccuaaggaugugauuuguuuucauuguuuguauguacuacuuuua

SEQ ID NO: 353077 - RNA, 64 nt, hsa
auuauaggcuguaauuauaaaauauauuggcuuuuguuuucaaugugaaagauacauuaaaugg

SEQ ID NO: 353078 - RNA, 64 nt, hsa
aaugcaauaaaauauauaucugguuguauuagucuguuuucacgcugcugauaaagacauaccu

SEQ ID NO: 353079 - RNA, 64 nt, hsa
cccacucuacuguuagcaguuuacuguauuagucuguuuucacacugcugauaaagacauuccu

SEQ ID NO: 353080 - RNA, 64 nt, hsa
uaacauuuacacagugcuuuuuaccacuguggaauguuuucacacucauuuuuccuuacaacaa

SEQ ID NO: 353081 - RNA, 64 nt, hsa
auuugauucaggggaccuguguuuccaugucaaauguuuucaaauaaaaugaaauaugaguuuc

SEQ ID NO: 353082 - RNA, 64 nt, hsa
aacagcuguuagguuaaaaaaauagcuggacauuuguuuucagucauuauacauugcuuugguc

SEQ ID NO: 353083 - RNA, 64 nt, hsa
aacugugagaguauacauaggcauuacuuuauuauguuuucacuugccauccuugacauaagag

SEQ ID NO: 353084 - RNA, 64 nt, hsa
guuguuaauugaaauagaauucagcucaagcaguuguuuucagugagugaguuaacaauaaaag

SEQ ID NO: 353085 - RNA, 64 nt, hsa
auggacuguugccuauugagcauuguggaugauguguuuucagauuuccaggugaaguucugac

SEQ ID NO: 353086 - RNA, 64 nt, hsa
caaaaaccauguuucuuuuucuuguauaacuuuuuguuuucagcaacauaaauugauuuuuagc

SEQ ID NO: 353087 - RNA, 64 nt, hsa
uuggguuuucuuaaugccagugugaauuugcagauguuuucagaaaaucaagucacaguaacaa

SEQ ID NO: 353088 - RNA, 64 nt, hsa
uuuucauugacucucacuaaaugucaaauaaccuuguuuucacuuggauaggcucaaccuaccu

SEQ ID NO: 353089 - RNA, 64 nt, hsa
cuagcaaaugcccagccuucagagugugcaggaauguuuucaaaucccucaucagacugugacu

SEQ ID NO: 353090 - RNA, 64 nt, hsa
gacccguuuccaccgcagcaggugaacaugaccguguuuucaacuguguccacaguucagaucc

SEQ ID NO: 353091 - RNA, 64 nt, hsa
uuuccccagggugacaucguagccaaauguuuacuguuuucauugccuuuuauggccuugacga

SEQ ID NO: 353092 - RNA, 64 nt, hsa
acuugguuugcauauaaaagguagacagcugauauguuuucaugaauaaauauugucagccaga

SEQ ID NO: 353093 - RNA, 64 nt, hsa
ucaugacccaauuuguguuauucaucuuuaauccuguuuucagucucuauguguacagcaguau

SEQ ID NO: 353094 - RNA, 64 nt, hsa
uuuauuccacuggcaccauuagugaauauuuaguuguuuucauaaacgaugcugugaugaagac

SEQ ID NO: 353095 - RNA, 64 nt, hsa
cucacuccucacagccauccuaggagauacauauuguuuucauccugcauuuacagaaaaagaa

SEQ ID NO: 353096 - RNA, 64 nt, hsa
ugggauuacaggugcgcaccaccaugccuggcuguguuuucacuuuucuuucaacauguucaac

SEQ ID NO: 353097 - RNA, 64 nt, hsa
uuagauguaauucuucauucuagacuuccaaguuuguuuucacuuuuuugugugugcgugaagg

SEQ ID NO: 353098 - RNA, 64 nt, hsa
uuugcaauuuuuuuuuaaacuuagaagcaaugaauguuuucaucagucaagcuaggaucugcag

SEQ ID NO: 353099 - RNA, 64 nt, hsa
cuagcgcucaaugcuugaauggcagaacugaaaguguuuucagguaucuuuguagcgguuuccc

SEQ ID NO: 353100 - RNA, 64 nt, hsa
uuauuuucacugucuuuuugaaaguuacaguauguguuuucacuuucgugcagauaacuggaag

SEQ ID NO: 353101 - RNA, 64 nt, hsa
ucuuaaaaauaaaaaaaaauauauaaguguaacauguuuucauuccaaacugguagugguaugu

SEQ ID NO: 353102 - RNA, 64 nt, hsa
cucugauguacguuuuuaaggauuuuguaagagcuguuuucaguguuuaaauuagugcuauuuu

SEQ ID NO: 353103 - RNA, 64 nt, hsa
auauucugugaugacagagaagccuauuuuguuuuguuuucagcaucuuucucugauguacguu

SEQ ID NO: 353104 - RNA, 64 nt, hsa
uucgacauuacuguggcaaauuauuuaagcucucuguuuucauuucuuuuucuguaaaugcagg

SEQ ID NO: 353105 - RNA, 64 nt, hsa
agccaggucucuauuccauguuuugugucugccauguuuucauuccugagcagaagagcuuggg

SEQ ID NO: 353106 - RNA, 64 nt, hsa
cgaaaaaauuccggacaagacuacccuuguuuuauguuuucaguauucugaaaauaccagugug

SEQ ID NO: 353107 - RNA, 64 nt, hsa
auuagcugaagaaguuauucucaagaaaauuggauguuuucauuggccuucuuaaauuguggcc

SEQ ID NO: 353108 - RNA, 64 nt, hsa
acagagcauuccauuuuguccuguuaaaaccuuuuguuuucaccuaaacccuuucugcuuaguu

SEQ ID NO: 353109 - RNA, 64 nt, hsa
gaguuuugugauccugcuuauuguaacugacaacuguuuucaacuccaagagcuaaacuauugg

SEQ ID NO: 353110 - RNA, 64 nt, hsa
cgugcuaugacucucuccaguuugaauaugcaauuguuuucacaggcaggaugucuguuuucug

SEQ ID NO: 353111 - RNA, 64 nt, hsa
guggugacaguguaauuuaauuaaaagguguaaauguuuucaucucuuaggcuugcugucuccu

SEQ ID NO: 353112 - RNA, 64 nt, hsa
aucucuuuccuaaacugacauuuucuauuuugacuguuuucauacuauaaccagguaaagggac

SEQ ID NO: 353113 - RNA, 64 nt, hsa
guaacacgucccacccccuuuuuaaagcacuuacuguuuucagagcacccauaucccacccugg

SEQ ID NO: 353114 - RNA, 64 nt, hsa
uauucuuugaaaaaaaagaugcuuacuguauacuuguuuucaagcauccucuaaaaucaaaggu

SEQ ID NO: 353115 - RNA, 64 nt, hsa
cuucugauuugauaguauuuauuuuaaaaaauuauguuuucaucauucauuugaaaaugaaaaa

SEQ ID NO: 353116 - RNA, 64 nt, hsa
gacuuuguugcccaguggccaacgcccgagugucuguuuucaggagccccaggucaagccuugu

SEQ ID NO: 353117 - RNA, 64 nt, hsa
gcacucaacuuggccuuuugauugcacaagccuuuguuuucaguccuagugaauaaaguugugu

SEQ ID NO: 353118 - RNA, 64 nt, hsa
agccccgcagggacuggcccgcaccugccuuggauguuuucagcaauuaaacuuuuuuaagcug

SEQ ID NO: 353119 - RNA, 64 nt, hsa
cacauccucugggccucuggcaguucccagggacuguuuucaccucugcugucucuggggucag

SEQ ID NO: 353120 - RNA, 64 nt, hsa
aauuacuaauacaaggguuaaagaagguagauuuuguuuucaauauuuggguaauauuagaaag

SEQ ID NO: 353121 - RNA, 64 nt, hsa
guaaagaagauaaauaggugaauuuuauugccuguguuuucaggcuucagagguaccuggcacc

SEQ ID NO: 353122 - RNA, 64 nt, hsa
cccuaggauuuuuuuaaauagaugcugcuugcuauguuuucaaaccuuuuugagccauaggauc

SEQ ID NO: 353123 - RNA, 64 nt, hsa
cagacuguaaauggcuugugauacucuugauacuuguuuucaaauauguuuacuaacuguagug

SEQ ID NO: 353124 - RNA, 64 nt, hsa
aggugugagcauccuggcucgcuggauuuguggguguuuucaggccuuccauuccccauagagg

SEQ ID NO: 353125 - RNA, 64 nt, hsa
ccuucucuguguacucuggagauagauggagaaguguuuucagauuccugggaacagacaccag

SEQ ID NO: 353126 - RNA, 64 nt, hsa
aaaggaagaaaacuuuuuaaaauggagaaucgcauguuuucaaugaaaacauucacuugguauu

SEQ ID NO: 353127 - RNA, 64 nt, hsa
gagacuccgucucaaaaaaaaaaaaaaaaaaaaauguuuucaaaguuccauucuguuaaaguaa

SEQ ID NO: 353128 - RNA, 64 nt, hsa
aguguuaaaugugauaaaaguacauauuuuaaauuguuuucagcucuuggauauagcagcaaua

SEQ ID NO: 353129 - RNA, 64 nt, hsa
uuuucuaucauuugaaaccuuuuuagcuacuguuuguuuucauucaacuaacaaacauauucca

SEQ ID NO: 353130 - RNA, 64 nt, hsa
ggggaaaaauaacugauuccaaugacauucauuuuguuuucaucugugauagucauggaugcuu

SEQ ID NO: 353131 - RNA, 64 nt, hsa
aauacccaagauucaugcuacuguaccacagauuuguuuucacagcaauaaaucuucaguucuu

SEQ ID NO: 353132 - RNA, 64 nt, hsa
ugaacauggucuuuuaaaaacuagucagaugaauuguuuucaucugaagccugcuaucuuuuuu

SEQ ID NO: 353133 - RNA, 64 nt, hsa
uaaccccacucccaugaagaauugccuggaaagauguuuucaaggaauuugaaccauaaaacac

SEQ ID NO: 353134 - RNA, 64 nt, hsa
ccaggggcugauucacuuccuugggagauggugguguuuucaugaacaucuuugauccuuccau

SEQ ID NO: 353135 - RNA, 64 nt, hsa
gagaccuggccuuccuguugugcuuuucagacuuuguuuucagaaugcuuuuaucucgagugug

SEQ ID NO: 353136 - RNA, 64 nt, hsa
ggccacuggggggcuggggucuccaggggaugacuguuuucaaucucugggccaagaucacaug

SEQ ID NO: 353137 - RNA, 64 nt, hsa
gauggagagaugagaagcaauuccaccaaacucauguuuucacaggaggguucaguguggagag

SEQ ID NO: 353138 - RNA, 64 nt, hsa
gccaagcuccucaaacaggguucaguccacguuguguuuucacaccuuucuccaaggaucgaac

SEQ ID NO: 353139 - RNA, 64 nt, hsa
ucauuucagugggccaggaaaauagaugucuugcuguuuucaguauuuucuuaagaaauugcuu

SEQ ID NO: 353140 - RNA, 64 nt, hsa
ggaaauuuaaaaggaaaaaaaucguauuucacuguguuuucaauuuauauuuucacaacuacuu

SEQ ID NO: 353141 - RNA, 64 nt, hsa
gaaagaaaaaaaaugucuggcuucuucuacuauuuguuuucacuaccaaacuguguuacuaaau

SEQ ID NO: 353142 - RNA, 64 nt, hsa
uuaaauugcugcaaagaugguuucuuuuguaagauguuuucaacguuuacauucaauccaagcc

SEQ ID NO: 353143 - RNA, 64 nt, hsa
auauauagcauuuaugguaaucauauuagacuucuguuuucaaucucguauagaagucuucaug

SEQ ID NO: 353144 - RNA, 64 nt, hsa
agaaagaacuaucuucaucugagagaggcuaaaauguuuucagcuaggaacaaaucuuccuggu

SEQ ID NO: 353145 - RNA, 64 nt, hsa
auuacuaacuucuaaaacuguacuuugauucacauguuuucaaauggaguuggaguucauucau

SEQ ID NO: 353146 - RNA, 64 nt, hsa
gaacuaccaacucucuaguuaauuuugaugaagauguuuucauuaauagucugguuuaguauua

SEQ ID NO: 353147 - RNA, 64 nt, hsa
ucucuaauaaucggguugggacuuaacuuuaagguguuuucaaugugauuuuaguauuuacagu

SEQ ID NO: 353148 - RNA, 64 nt, hsa
agauucauacacuuuugagacuccagugagacgcuguuuucaccccuuccuccuccuagccucu

SEQ ID NO: 353149 - RNA, 64 nt, hsa
ugacaugcuaacuagacuucaggggagccacuucuguuuucagccccucccuggaauagugagu

SEQ ID NO: 353150 - RNA, 64 nt, hsa
agaaaagcauucaaguaugacaauauacuaucuguguuuucaccauucaaagugcuguuuagua

SEQ ID NO: 353151 - RNA, 64 nt, hsa
cuuacacacgcugaguacagaagauauuucaaauuguuuucagugaaaacaaguccuuccauaa

SEQ ID NO: 353152 - RNA, 64 nt, hsa
aguguuuuacucuuuuucuaaaguguuggucuuucuaauguagcuauuuuucuuguugcaucuu

SEQ ID NO: 353153 - RNA, 64 nt, hsa
uuuauuuuuucccuccugacaaauauuuuagaagcuaauguaggacuguauagguagauccaga

SEQ ID NO: 353154 - RNA, 64 nt, hsa
cauacauaaaaauguagccugccuuacauauaagcuaauguagaaaaguuuagacuuauaaaaa

SEQ ID NO: 353155 - RNA, 64 nt, hsa
ggacuuuugauauacucaaagccagaaagcuuaacuaauguaagauuagcuauuauuuguagga

SEQ ID NO: 353156 - RNA, 64 nt, hsa
aucagucuucaugugaccugcaguauuuuuuuuucuaauguauuugucagaaaucuguuguaga

SEQ ID NO: 353157 - RNA, 64 nt, hsa
uaaaggguacaguugcauaaaguggguuuuuauccuaauguauuggaaauaaaugauaaacuuu

SEQ ID NO: 353158 - RNA, 64 nt, hsa
ucucaggguacuuucugggauugcucacauuucucuaauguacugcacuugaugccaguaggaa

SEQ ID NO: 353159 - RNA, 64 nt, hsa
ugaaucaccacuuuauauccacaaaggcaaauaacuaauguaugauaauagaauaauuugcacu

SEQ ID NO: 353160 - RNA, 64 nt, hsa
ccuugggacagguguguaauguuagugugcaugacuaauguaagaaauuguuauucuacuaaua

SEQ ID NO: 353161 - RNA, 64 nt, hsa
uucuaaagaaaagaaucagaaaucaaucuuucuacuaauguaaauuugagauuauuuuuaaaaa

SEQ ID NO: 353162 - RNA, 64 nt, hsa
cagguguaccucaauccacauuacagccaugcuccuaauguacauggacauuuuuguaacucag

SEQ ID NO: 353163 - RNA, 64 nt, hsa
aggcaauuuggcuaaaaaaugaauaagacuacuucuaauguaacuaagcaucuccacuauggug

SEQ ID NO: 353164 - RNA, 64 nt, hsa
acagaauugauauuuaucucaagacuaucuuaagcuaauguacuucuguuacauaauuaaacua

SEQ ID NO: 353165 - RNA, 64 nt, hsa
uaguuuauuuuuccaaaacauaacuuuagguauucuaauguauuuuguuaguugcuuagaaaug

SEQ ID NO: 353166 - RNA, 64 nt, hsa; identical to SEQ ID NO: 163826

SEQ ID NO: 353167 - RNA, 64 nt, hsa; identical to SEQ ID NO: 163827

SEQ ID NO: 353168 - RNA, 64 nt, hsa; identical to SEQ ID NO: 163828

SEQ ID NO: 353169 - RNA, 64 nt, hsa; identical to SEQ ID NO: 163829

SEQ ID NO: 353170 - RNA, 64 nt, hsa; identical to SEQ ID NO: 163830

SEQ ID NO: 353171 - RNA, 64 nt, hsa; identical to SEQ ID NO: 163831

SEQ ID NO: 353172 - RNA, 64 nt, hsa; identical to SEQ ID NO: 163832

SEQ ID NO: 353173 - RNA, 64 nt, hsa; identical to SEQ ID NO: 163833

SEQ ID NO: 353174 - RNA, 64 nt, hsa; identical to SEQ ID NO: 163834

SEQ ID NO: 353175 - RNA, 64 nt, hsa; identical to SEQ ID NO: 163835

SEQ ID NO: 353176 - RNA, 64 nt, hsa; identical to SEQ ID NO: 163836

SEQ ID NO: 353177 - RNA, 64 nt, hsa; identical to SEQ ID NO: 163837

SEQ ID NO: 353178 - RNA, 64 nt, hsa; identical to SEQ ID NO: 163838

SEQ ID NO: 353179 - RNA, 64 nt, hsa; identical to SEQ ID NO: 163839

SEQ ID NO: 353180 - RNA, 64 nt, hsa; identical to SEQ ID NO: 163840

SEQ ID NO: 353181 - RNA, 64 nt, hsa; identical to SEQ ID NO: 163841

SEQ ID NO: 353182 - RNA, 64 nt, hsa; identical to SEQ ID NO: 163842

SEQ ID NO: 353183 - RNA, 64 nt, hsa; identical to SEQ ID NO: 163843

SEQ ID NO: 353184 - RNA, 64 nt, hsa; identical to SEQ ID NO: 163844

SEQ ID NO: 353185 - RNA, 64 nt, hsa; identical to SEQ ID NO: 163845

SEQ ID NO: 353186 - RNA, 64 nt, hsa; identical to SEQ ID NO: 163846

SEQ ID NO: 353187 - RNA, 64 nt, hsa; identical to SEQ ID NO: 163847

SEQ ID NO: 353188 - RNA, 64 nt, hsa; identical to SEQ ID NO: 163848

SEQ ID NO: 353189 - RNA, 64 nt, hsa; identical to SEQ ID NO: 163849

SEQ ID NO: 353190 - RNA, 64 nt, hsa; identical to SEQ ID NO: 163850

SEQ ID NO: 353191 - RNA, 64 nt, hsa; identical to SEQ ID NO: 163851

SEQ ID NO: 353192 - RNA, 64 nt, hsa; identical to SEQ ID NO: 163852

SEQ ID NO: 353193 - RNA, 64 nt, hsa; identical to SEQ ID NO: 163853

SEQ ID NO: 353194 - RNA, 64 nt, hsa; identical to SEQ ID NO: 163854

SEQ ID NO: 353195 - RNA, 64 nt, hsa; identical to SEQ ID NO: 163855

SEQ ID NO: 353196 - RNA, 64 nt, hsa; identical to SEQ ID NO: 163856

SEQ ID NO: 353197 - RNA, 64 nt, hsa; identical to SEQ ID NO: 163857

SEQ ID NO: 353198 - RNA, 64 nt, hsa; identical to SEQ ID NO: 163858

SEQ ID NO: 353199 - RNA, 64 nt, hsa; identical to SEQ ID NO: 163859

SEQ ID NO: 353200 - RNA, 64 nt, hsa; identical to SEQ ID NO: 163860

SEQ ID NO: 353201 - RNA, 64 nt, hsa; identical to SEQ ID NO: 163861

SEQ ID NO: 353202 - RNA, 64 nt, hsa; identical to SEQ ID NO: 163862

SEQ ID NO: 353203 - RNA, 64 nt, hsa; identical to SEQ ID NO: 163863

SEQ ID NO: 353204 - RNA, 64 nt, hsa; identical to SEQ ID NO: 163864

SEQ ID NO: 353205 - RNA, 64 nt, hsa; identical to SEQ ID NO: 163865

SEQ ID NO: 353206 - RNA, 64 nt, hsa; identical to SEQ ID NO: 163866

SEQ ID NO: 353207 - RNA, 64 nt, hsa; identical to SEQ ID NO: 163867

SEQ ID NO: 353208 - RNA, 64 nt, hsa; identical to SEQ ID NO: 163868

SEQ ID NO: 353209 - RNA, 64 nt, hsa; identical to SEQ ID NO: 163869

SEQ ID NO: 353210 - RNA, 64 nt, hsa; identical to SEQ ID NO: 163870

SEQ ID NO: 353211 - RNA, 64 nt, hsa; identical to SEQ ID NO: 163871

SEQ ID NO: 353212 - RNA, 64 nt, hsa; identical to SEQ ID NO: 163872

SEQ ID NO: 353213 - RNA, 64 nt, hsa; identical to SEQ ID NO: 163873

SEQ ID NO: 353214 - RNA, 64 nt, hsa; identical to SEQ ID NO: 163874

SEQ ID NO: 353215 - RNA, 64 nt, hsa; identical to SEQ ID NO: 163875

SEQ ID NO: 353216 - RNA, 64 nt, hsa; identical to SEQ ID NO: 163876

SEQ ID NO: 353217 - RNA, 64 nt, hsa; identical to SEQ ID NO: 163877

SEQ ID NO: 353218 - RNA, 64 nt, hsa; identical to SEQ ID NO: 163878

SEQ ID NO: 353219 - RNA, 64 nt, hsa; identical to SEQ ID NO: 163879

SEQ ID NO: 353220 - RNA, 64 nt, hsa; identical to SEQ ID NO: 163880

SEQ ID NO: 353221 - RNA, 64 nt, hsa; identical to SEQ ID NO: 163881

SEQ ID NO: 353222 - RNA, 64 nt, hsa; identical to SEQ ID NO: 163882

SEQ ID NO: 353223 - RNA, 64 nt, hsa; identical to SEQ ID NO: 163883

SEQ ID NO: 353224 - RNA, 64 nt, hsa; identical to SEQ ID NO: 163884

SEQ ID NO: 353225 - RNA, 64 nt, hsa; identical to SEQ ID NO: 163885

SEQ ID NO: 353226 - RNA, 64 nt, hsa; identical to SEQ ID NO: 163886

SEQ ID NO: 353227 - RNA, 64 nt, hsa; identical to SEQ ID NO: 163887

SEQ ID NO: 353228 - RNA, 64 nt, hsa; identical to SEQ ID NO: 163888

SEQ ID NO: 353229 - RNA, 64 nt, hsa; identical to SEQ ID NO: 163889

SEQ ID NO: 353230 - RNA, 64 nt, hsa; identical to SEQ ID NO: 163890

SEQ ID NO: 353231 - RNA, 64 nt, hsa; identical to SEQ ID NO: 163891

SEQ ID NO: 353232 - RNA, 64 nt, hsa; identical to SEQ ID NO: 163892

SEQ ID NO: 353233 - RNA, 64 nt, hsa; identical to SEQ ID NO: 163893

SEQ ID NO: 353234 - RNA, 64 nt, hsa; identical to SEQ ID NO: 163894

SEQ ID NO: 353235 - RNA, 64 nt, hsa; identical to SEQ ID NO: 163895

SEQ ID NO: 353236 - RNA, 64 nt, hsa; identical to SEQ ID NO: 163896

SEQ ID NO: 353237 - RNA, 64 nt, hsa; identical to SEQ ID NO: 163897

SEQ ID NO: 353238 - RNA, 64 nt, hsa; identical to SEQ ID NO: 163898

SEQ ID NO: 353239 - RNA, 64 nt, hsa; identical to SEQ ID NO: 163899

SEQ ID NO: 353240 - RNA, 64 nt, hsa; identical to SEQ ID NO: 163900

SEQ ID NO: 353241 - RNA, 64 nt, hsa; identical to SEQ ID NO: 163901

SEQ ID NO: 353242 - RNA, 64 nt, hsa; identical to SEQ ID NO: 163902

SEQ ID NO: 353243 - RNA, 64 nt, hsa; identical to SEQ ID NO: 163903

SEQ ID NO: 353244 - RNA, 64 nt, hsa; identical to SEQ ID NO: 163904

SEQ ID NO: 353245 - RNA, 64 nt, hsa; identical to SEQ ID NO: 163905

SEQ ID NO: 353246 - RNA, 64 nt, hsa; identical to SEQ ID NO: 163906

SEQ ID NO: 353247 - RNA, 64 nt, hsa; identical to SEQ ID NO: 163907

SEQ ID NO: 353248 - RNA, 64 nt, hsa; identical to SEQ ID NO: 163908

SEQ ID NO: 353249 - RNA, 64 nt, hsa; identical to SEQ ID NO: 163909

SEQ ID NO: 353250 - RNA, 64 nt, hsa; identical to SEQ ID NO: 163910

SEQ ID NO: 353251 - RNA, 64 nt, hsa; identical to SEQ ID NO: 163911

SEQ ID NO: 353252 - RNA, 64 nt, hsa; identical to SEQ ID NO: 163912

SEQ ID NO: 353253 - RNA, 64 nt, hsa; identical to SEQ ID NO: 163913

SEQ ID NO: 353254 - RNA, 64 nt, hsa; identical to SEQ ID NO: 163914

SEQ ID NO: 353255 - RNA, 64 nt, hsa; identical to SEQ ID NO: 163915

SEQ ID NO: 353256 - RNA, 64 nt, hsa; identical to SEQ ID NO: 163916

SEQ ID NO: 353257 - RNA, 64 nt, hsa; identical to SEQ ID NO: 163917

SEQ ID NO: 353258 - RNA, 64 nt, hsa; identical to SEQ ID NO: 163918

SEQ ID NO: 353259 - RNA, 64 nt, hsa; identical to SEQ ID NO: 163919

SEQ ID NO: 353260 - RNA, 64 nt, hsa; identical to SEQ ID NO: 163920

SEQ ID NO: 353261 - RNA, 64 nt, hsa; identical to SEQ ID NO: 163921

SEQ ID NO: 353262 - RNA, 64 nt, hsa; identical to SEQ ID NO: 163922

SEQ ID NO: 353263 - RNA, 64 nt, hsa; identical to SEQ ID NO: 163923

SEQ ID NO: 353264 - RNA, 64 nt, hsa; identical to SEQ ID NO: 163924

SEQ ID NO: 353265 - RNA, 64 nt, hsa; identical to SEQ ID NO: 163925

SEQ ID NO: 353266 - RNA, 64 nt, hsa; identical to SEQ ID NO: 163926

SEQ ID NO: 353267 - RNA, 64 nt, hsa; identical to SEQ ID NO: 163927

SEQ ID NO: 353268 - RNA, 64 nt, hsa; identical to SEQ ID NO: 163928

SEQ ID NO: 353269 - RNA, 64 nt, hsa; identical to SEQ ID NO: 163929

SEQ ID NO: 353270 - RNA, 64 nt, hsa; identical to SEQ ID NO: 163930

SEQ ID NO: 353271 - RNA, 64 nt, hsa; identical to SEQ ID NO: 163931

SEQ ID NO: 353272 - RNA, 64 nt, hsa; identical to SEQ ID NO: 163932

SEQ ID NO: 353273 - RNA, 64 nt, hsa; identical to SEQ ID NO: 163933

SEQ ID NO: 353274 - RNA, 64 nt, hsa; identical to SEQ ID NO: 163934

SEQ ID NO: 353275 - RNA, 64 nt, hsa; identical to SEQ ID NO: 163935

SEQ ID NO: 353276 - RNA, 64 nt, hsa; identical to SEQ ID NO: 163936

SEQ ID NO: 353277 - RNA, 64 nt, hsa; identical to SEQ ID NO: 163937

SEQ ID NO: 353278 - RNA, 64 nt, hsa; identical to SEQ ID NO: 163938

SEQ ID NO: 353279 - RNA, 64 nt, hsa; identical to SEQ ID NO: 163939

SEQ ID NO: 353280 - RNA, 64 nt, hsa; identical to SEQ ID NO: 163940

SEQ ID NO: 353281 - RNA, 64 nt, hsa
auaaucaaaacauuuuuuacaguacaccuuuccuggaugauaugcaaucgaaugcuauauuauu

SEQ ID NO: 353282 - RNA, 64 nt, hsa
uucagagaacuacaaacugucaaagaaaggguggggaugauaagaaaugcuaauauaaaaaugc

SEQ ID NO: 353283 - RNA, 64 nt, hsa
aguaacauuuucuaagugaagauuaauuuacugaggaugauacauuauaguauuguauuauucu

SEQ ID NO: 353284 - RNA, 64 nt, hsa
gaguggcugccagcaagagacaguguucagauguggaugauauuuguucaauaugucaagcuga

SEQ ID NO: 353285 - RNA, 64 nt, hsa; identical to SEQ ID NO: 140968

SEQ ID NO: 353286 - RNA, 64 nt, hsa; identical to SEQ ID NO: 140969

SEQ ID NO: 353287 - RNA, 64 nt, hsa; identical to SEQ ID NO: 140970

SEQ ID NO: 353288 - RNA, 64 nt, hsa; identical to SEQ ID NO: 140971

SEQ ID NO: 353289 - RNA, 64 nt, hsa; identical to SEQ ID NO: 140972

SEQ ID NO: 353290 - RNA, 64 nt, hsa; identical to SEQ ID NO: 140973

SEQ ID NO: 353291 - RNA, 64 nt, hsa; identical to SEQ ID NO: 140974

SEQ ID NO: 353292 - RNA, 64 nt, hsa; identical to SEQ ID NO: 140975

SEQ ID NO: 353293 - RNA, 64 nt, hsa; identical to SEQ ID NO: 140976

SEQ ID NO: 353294 - RNA, 64 nt, hsa; identical to SEQ ID NO: 140977

SEQ ID NO: 353295 - RNA, 64 nt, hsa; identical to SEQ ID NO: 140978

SEQ ID NO: 353296 - RNA, 64 nt, hsa; identical to SEQ ID NO: 140979

SEQ ID NO: 353297 - RNA, 64 nt, hsa; identical to SEQ ID NO: 140980

SEQ ID NO: 353298 - RNA, 64 nt, hsa; identical to SEQ ID NO: 140981

SEQ ID NO: 353299 - RNA, 64 nt, hsa; identical to SEQ ID NO: 140982

SEQ ID NO: 353300 - RNA, 64 nt, hsa; identical to SEQ ID NO: 140983

SEQ ID NO: 353301 - RNA, 64 nt, hsa; identical to SEQ ID NO: 140984

SEQ ID NO: 353302 - RNA, 64 nt, hsa; identical to SEQ ID NO: 140985

SEQ ID NO: 353303 - RNA, 64 nt, hsa; identical to SEQ ID NO: 140986

SEQ ID NO: 353304 - RNA, 64 nt, hsa; identical to SEQ ID NO: 140987

SEQ ID NO: 353305 - RNA, 64 nt, hsa; identical to SEQ ID NO: 140988

SEQ ID NO: 353306 - RNA, 64 nt, hsa; identical to SEQ ID NO: 140989

SEQ ID NO: 353307 - RNA, 64 nt, hsa; identical to SEQ ID NO: 140990

SEQ ID NO: 353308 - RNA, 64 nt, hsa; identical to SEQ ID NO: 140991

SEQ ID NO: 353309 - RNA, 64 nt, hsa; identical to SEQ ID NO: 140992

SEQ ID NO: 353310 - RNA, 64 nt, hsa; identical to SEQ ID NO: 140993

SEQ ID NO: 353311 - RNA, 64 nt, hsa; identical to SEQ ID NO: 140994

SEQ ID NO: 353312 - RNA, 64 nt, hsa; identical to SEQ ID NO: 140995

SEQ ID NO: 353313 - RNA, 64 nt, hsa; identical to SEQ ID NO: 140996

SEQ ID NO: 353314 - RNA, 64 nt, hsa; identical to SEQ ID NO: 140997

SEQ ID NO: 353315 - RNA, 64 nt, hsa; identical to SEQ ID NO: 140998

SEQ ID NO: 353316 - RNA, 64 nt, hsa; identical to SEQ ID NO: 140999

SEQ ID NO: 353317 - RNA, 64 nt, hsa; identical to SEQ ID NO: 141000

SEQ ID NO: 353318 - RNA, 64 nt, hsa; identical to SEQ ID NO: 141001

SEQ ID NO: 353319 - RNA, 64 nt, hsa; identical to SEQ ID NO: 141002

SEQ ID NO: 353320 - RNA, 64 nt, hsa; identical to SEQ ID NO: 141003

SEQ ID NO: 353321 - RNA, 64 nt, hsa; identical to SEQ ID NO: 141004

SEQ ID NO: 353322 - RNA, 64 nt, hsa; identical to SEQ ID NO: 141005

SEQ ID NO: 353323 - RNA, 64 nt, hsa; identical to SEQ ID NO: 141006

SEQ ID NO: 353324 - RNA, 64 nt, hsa; identical to SEQ ID NO: 141007

SEQ ID NO: 353325 - RNA, 64 nt, hsa; identical to SEQ ID NO: 141008

SEQ ID NO: 353326 - RNA, 64 nt, hsa; identical to SEQ ID NO: 141009

SEQ ID NO: 353327 - RNA, 64 nt, hsa; identical to SEQ ID NO: 141010

SEQ ID NO: 353328 - RNA, 64 nt, hsa; identical to SEQ ID NO: 141011

SEQ ID NO: 353329 - RNA, 64 nt, hsa; identical to SEQ ID NO: 141012

SEQ ID NO: 353330 - RNA, 64 nt, hsa; identical to SEQ ID NO: 141013

SEQ ID NO: 353331 - RNA, 64 nt, hsa; identical to SEQ ID NO: 141014

SEQ ID NO: 353332 - RNA, 64 nt, hsa; identical to SEQ ID NO: 141015

SEQ ID NO: 353333 - RNA, 64 nt, hsa; identical to SEQ ID NO: 141016

SEQ ID NO: 353334 - RNA, 64 nt, hsa; identical to SEQ ID NO: 141017

SEQ ID NO: 353335 - RNA, 64 nt, hsa; identical to SEQ ID NO: 141018

SEQ ID NO: 353336 - RNA, 64 nt, hsa; identical to SEQ ID NO: 141019

SEQ ID NO: 353337 - RNA, 64 nt, hsa; identical to SEQ ID NO: 141020

SEQ ID NO: 353338 - RNA, 64 nt, hsa; identical to SEQ ID NO: 141021

SEQ ID NO: 353339 - RNA, 64 nt, hsa; identical to SEQ ID NO: 141022

SEQ ID NO: 353340 - RNA, 64 nt, hsa; identical to SEQ ID NO: 141023

SEQ ID NO: 353341 - RNA, 64 nt, hsa; identical to SEQ ID NO: 141024

SEQ ID NO: 353342 - RNA, 64 nt, hsa; identical to SEQ ID NO: 141025

SEQ ID NO: 353343 - RNA, 64 nt, hsa; identical to SEQ ID NO: 141026

SEQ ID NO: 353344 - RNA, 64 nt, hsa; identical to SEQ ID NO: 141027

SEQ ID NO: 353345 - RNA, 64 nt, hsa; identical to SEQ ID NO: 141028

SEQ ID NO: 353346 - RNA, 64 nt, hsa; identical to SEQ ID NO: 141029

SEQ ID NO: 353347 - RNA, 64 nt, hsa; identical to SEQ ID NO: 141030

SEQ ID NO: 353348 - RNA, 64 nt, hsa; identical to SEQ ID NO: 141031

SEQ ID NO: 353349 - RNA, 64 nt, hsa; identical to SEQ ID NO: 141032

SEQ ID NO: 353350 - RNA, 64 nt, hsa; identical to SEQ ID NO: 141033

SEQ ID NO: 353351 - RNA, 64 nt, hsa; identical to SEQ ID NO: 141034

SEQ ID NO: 353352 - RNA, 64 nt, hsa; identical to SEQ ID NO: 141035

SEQ ID NO: 353353 - RNA, 64 nt, hsa; identical to SEQ ID NO: 141036

SEQ ID NO: 353354 - RNA, 64 nt, hsa; identical to SEQ ID NO: 141037

SEQ ID NO: 353355 - RNA, 64 nt, hsa; identical to SEQ ID NO: 141038

SEQ ID NO: 353356 - RNA, 64 nt, hsa; identical to SEQ ID NO: 141039

SEQ ID NO: 353357 - RNA, 64 nt, hsa; identical to SEQ ID NO: 141040

SEQ ID NO: 353358 - RNA, 64 nt, hsa; identical to SEQ ID NO: 141041

SEQ ID NO: 353359 - RNA, 64 nt, hsa; identical to SEQ ID NO: 141042

SEQ ID NO: 353360 - RNA, 64 nt, hsa; identical to SEQ ID NO: 141043

SEQ ID NO: 353361 - RNA, 64 nt, hsa; identical to SEQ ID NO: 141044

SEQ ID NO: 353362 - RNA, 64 nt, hsa; identical to SEQ ID NO: 141045

SEQ ID NO: 353363 - RNA, 64 nt, hsa; identical to SEQ ID NO: 141046

SEQ ID NO: 353364 - RNA, 64 nt, hsa; identical to SEQ ID NO: 141047

SEQ ID NO: 353365 - RNA, 64 nt, hsa; identical to SEQ ID NO: 141048

SEQ ID NO: 353366 - RNA, 64 nt, hsa; identical to SEQ ID NO: 141049

SEQ ID NO: 353367 - RNA, 64 nt, hsa; identical to SEQ ID NO: 141050

SEQ ID NO: 353368 - RNA, 64 nt, hsa; identical to SEQ ID NO: 141051

SEQ ID NO: 353369 - RNA, 64 nt, hsa; identical to SEQ ID NO: 141052

SEQ ID NO: 353370 - RNA, 64 nt, hsa; identical to SEQ ID NO: 141053

SEQ ID NO: 353371 - RNA, 64 nt, hsa; identical to SEQ ID NO: 141054

SEQ ID NO: 353372 - RNA, 64 nt, hsa; identical to SEQ ID NO: 141055

SEQ ID NO: 353373 - RNA, 64 nt, hsa; identical to SEQ ID NO: 141056

SEQ ID NO: 353374 - RNA, 64 nt, hsa; identical to SEQ ID NO: 141057

SEQ ID NO: 353375 - RNA, 64 nt, hsa; identical to SEQ ID NO: 141058

SEQ ID NO: 353376 - RNA, 64 nt, hsa; identical to SEQ ID NO: 141059

SEQ ID NO: 353377 - RNA, 64 nt, hsa; identical to SEQ ID NO: 141060

SEQ ID NO: 353378 - RNA, 64 nt, hsa; identical to SEQ ID NO: 141061

SEQ ID NO: 353379 - RNA, 64 nt, hsa; identical to SEQ ID NO: 141062

SEQ ID NO: 353380 - RNA, 64 nt, hsa; identical to SEQ ID NO: 141063

SEQ ID NO: 353381 - RNA, 64 nt, hsa; identical to SEQ ID NO: 141064

SEQ ID NO: 353382 - RNA, 64 nt, hsa; identical to SEQ ID NO: 141065

SEQ ID NO: 353383 - RNA, 64 nt, hsa; identical to SEQ ID NO: 141066

SEQ ID NO: 353384 - RNA, 64 nt, hsa; identical to SEQ ID NO: 141067

SEQ ID NO: 353385 - RNA, 64 nt, hsa; identical to SEQ ID NO: 141068

SEQ ID NO: 353386 - RNA, 64 nt, hsa; identical to SEQ ID NO: 141069

SEQ ID NO: 353387 - RNA, 64 nt, hsa; identical to SEQ ID NO: 141070

SEQ ID NO: 353388 - RNA, 64 nt, hsa; identical to SEQ ID NO: 141071

SEQ ID NO: 353389 - RNA, 64 nt, hsa; identical to SEQ ID NO: 141072

SEQ ID NO: 353390 - RNA, 64 nt, hsa; identical to SEQ ID NO: 141073

SEQ ID NO: 353391 - RNA, 64 nt, hsa; identical to SEQ ID NO: 141074

SEQ ID NO: 353392 - RNA, 64 nt, hsa; identical to SEQ ID NO: 141075

SEQ ID NO: 353393 - RNA, 64 nt, hsa; identical to SEQ ID NO: 141076

SEQ ID NO: 353394 - RNA, 64 nt, hsa; identical to SEQ ID NO: 141077

SEQ ID NO: 353395 - RNA, 64 nt, hsa; identical to SEQ ID NO: 141078

SEQ ID NO: 353396 - RNA, 64 nt, hsa; identical to SEQ ID NO: 141079

SEQ ID NO: 353397 - RNA, 64 nt, hsa; identical to SEQ ID NO: 141080

SEQ ID NO: 353398 - RNA, 64 nt, hsa; identical to SEQ ID NO: 141081

SEQ ID NO: 353399 - RNA, 64 nt, hsa; identical to SEQ ID NO: 141082

SEQ ID NO: 353400 - RNA, 64 nt, hsa; identical to SEQ ID NO: 141083

SEQ ID NO: 353401 - RNA, 64 nt, hsa; identical to SEQ ID NO: 141084

SEQ ID NO: 353402 - RNA, 64 nt, hsa; identical to SEQ ID NO: 141085

SEQ ID NO: 353403 - RNA, 64 nt, hsa; identical to SEQ ID NO: 141086

SEQ ID NO: 353404 - RNA, 64 nt, hsa; identical to SEQ ID NO: 141087

SEQ ID NO: 353405 - RNA, 64 nt, hsa; identical to SEQ ID NO: 141088

SEQ ID NO: 353406 - RNA, 64 nt, hsa; identical to SEQ ID NO: 141089

SEQ ID NO: 353407 - RNA, 64 nt, hsa; identical to SEQ ID NO: 141090

SEQ ID NO: 353408 - RNA, 64 nt, hsa; identical to SEQ ID NO: 141091

SEQ ID NO: 353409 - RNA, 64 nt, hsa; identical to SEQ ID NO: 141092

SEQ ID NO: 353410 - RNA, 64 nt, hsa; identical to SEQ ID NO: 141093

SEQ ID NO: 353411 - RNA, 64 nt, hsa; identical to SEQ ID NO: 141094

SEQ ID NO: 353412 - RNA, 64 nt, hsa; identical to SEQ ID NO: 141095

SEQ ID NO: 353413 - RNA, 64 nt, hsa; identical to SEQ ID NO: 141096

SEQ ID NO: 353414 - RNA, 64 nt, hsa; identical to SEQ ID NO: 141097

SEQ ID NO: 353415 - RNA, 64 nt, hsa; identical to SEQ ID NO: 141098

SEQ ID NO: 353416 - RNA, 64 nt, hsa; identical to SEQ ID NO: 141099

SEQ ID NO: 353417 - RNA, 64 nt, hsa; identical to SEQ ID NO: 141100

SEQ ID NO: 353418 - RNA, 64 nt, hsa; identical to SEQ ID NO: 141101

SEQ ID NO: 353419 - RNA, 64 nt, hsa; identical to SEQ ID NO: 141102

SEQ ID NO: 353420 - RNA, 64 nt, hsa; identical to SEQ ID NO: 141103

SEQ ID NO: 353421 - RNA, 64 nt, hsa; identical to SEQ ID NO: 141104

SEQ ID NO: 353422 - RNA, 64 nt, hsa; identical to SEQ ID NO: 141105

SEQ ID NO: 353423 - RNA, 64 nt, hsa; identical to SEQ ID NO: 141106

SEQ ID NO: 353424 - RNA, 64 nt, hsa; identical to SEQ ID NO: 141107

SEQ ID NO: 353425 - RNA, 64 nt, hsa; identical to SEQ ID NO: 141108

SEQ ID NO: 353426 - RNA, 64 nt, hsa; identical to SEQ ID NO: 141109

SEQ ID NO: 353427 - RNA, 64 nt, hsa; identical to SEQ ID NO: 141110

SEQ ID NO: 353428 - RNA, 64 nt, hsa; identical to SEQ ID NO: 294262

SEQ ID NO: 353429 - RNA, 64 nt, hsa; identical to SEQ ID NO: 294263

SEQ ID NO: 353430 - RNA, 64 nt, hsa; identical to SEQ ID NO: 294264

SEQ ID NO: 353431 - RNA, 64 nt, hsa; identical to SEQ ID NO: 294265

SEQ ID NO: 353432 - RNA, 64 nt, hsa; identical to SEQ ID NO: 294266

SEQ ID NO: 353433 - RNA, 64 nt, hsa; identical to SEQ ID NO: 294267

SEQ ID NO: 353434 - RNA, 64 nt, hsa; identical to SEQ ID NO: 294268

SEQ ID NO: 353435 - RNA, 64 nt, hsa; identical to SEQ ID NO: 294269

SEQ ID NO: 353436 - RNA, 64 nt, hsa; identical to SEQ ID NO: 294270

SEQ ID NO: 353437 - RNA, 64 nt, hsa; identical to SEQ ID NO: 294271

SEQ ID NO: 353438 - RNA, 64 nt, hsa; identical to SEQ ID NO: 294272

SEQ ID NO: 353439 - RNA, 64 nt, hsa; identical to SEQ ID NO: 294273

SEQ ID NO: 353440 - RNA, 64 nt, hsa; identical to SEQ ID NO: 294274

SEQ ID NO: 353441 - RNA, 64 nt, hsa; identical to SEQ ID NO: 294275

SEQ ID NO: 353442 - RNA, 64 nt, hsa; identical to SEQ ID NO: 294276

SEQ ID NO: 353443 - RNA, 64 nt, hsa; identical to SEQ ID NO: 294277

SEQ ID NO: 353444 - RNA, 64 nt, hsa; identical to SEQ ID NO: 294278

SEQ ID NO: 353445 - RNA, 64 nt, hsa; identical to SEQ ID NO: 294279

SEQ ID NO: 353446 - RNA, 64 nt, hsa; identical to SEQ ID NO: 294280

SEQ ID NO: 353447 - RNA, 64 nt, hsa; identical to SEQ ID NO: 294281

SEQ ID NO: 353448 - RNA, 64 nt, hsa; identical to SEQ ID NO: 294282

SEQ ID NO: 353449 - RNA, 64 nt, hsa; identical to SEQ ID NO: 294283

SEQ ID NO: 353450 - RNA, 64 nt, hsa; identical to SEQ ID NO: 294284

SEQ ID NO: 353451 - RNA, 64 nt, hsa; identical to SEQ ID NO: 294285

SEQ ID NO: 353452 - RNA, 64 nt, hsa; identical to SEQ ID NO: 294286

SEQ ID NO: 353453 - RNA, 64 nt, hsa; identical to SEQ ID NO: 294287

SEQ ID NO: 353454 - RNA, 64 nt, hsa; identical to SEQ ID NO: 294288

SEQ ID NO: 353455 - RNA, 64 nt, hsa; identical to SEQ ID NO: 294289

SEQ ID NO: 353456 - RNA, 64 nt, hsa; identical to SEQ ID NO: 294290

SEQ ID NO: 353457 - RNA, 64 nt, hsa; identical to SEQ ID NO: 294291

SEQ ID NO: 353458 - RNA, 64 nt, hsa; identical to SEQ ID NO: 294292

SEQ ID NO: 353459 - RNA, 64 nt, hsa; identical to SEQ ID NO: 294293

SEQ ID NO: 353460 - RNA, 64 nt, hsa; identical to SEQ ID NO: 294294

SEQ ID NO: 353461 - RNA, 64 nt, hsa; identical to SEQ ID NO: 294295

SEQ ID NO: 353462 - RNA, 64 nt, hsa; identical to SEQ ID NO: 294296

SEQ ID NO: 353463 - RNA, 64 nt, hsa; identical to SEQ ID NO: 294297

SEQ ID NO: 353464 - RNA, 64 nt, hsa; identical to SEQ ID NO: 294298

SEQ ID NO: 353465 - RNA, 64 nt, hsa; identical to SEQ ID NO: 294299

SEQ ID NO: 353466 - RNA, 64 nt, hsa
cuugaacccaggagguggagguugcagugagcugagaucacaccacugcacuccggccugggcg

SEQ ID NO: 353467 - RNA, 64 nt, hsa
guuuuaaagcuaaacguaauuuccacuugggacuagaucacaacugaagauaacaagagauuua

SEQ ID NO: 353468 - RNA, 64 nt, hsa
aacaaugaaugcucauauguaauugaaauacuucagaucacaugaaaaugcugauuuaacauuu

SEQ ID NO: 353469 - RNA, 64 nt, hsa
auuagaaugguaucuguucauuuuagugauaugaagaucacaacuaacaacugacaaaucagag

SEQ ID NO: 353470 - RNA, 64 nt, hsa
cugguuugggugggacaaaguuagaauugccugaagaucacacauucagacuguugugucugug

SEQ ID NO: 353471 - RNA, 64 nt, hsa
ucuauggacaggcugggacagaggcagauggguuagaucacacauaacaauagggucuauguca

SEQ ID NO: 353472 - RNA, 64 nt, hsa
aaauucuuaucucuguaugugauuggaaaagaaaagaucacauuuguauauucaacaaucuuuc

SEQ ID NO: 353473 - RNA, 64 nt, hsa
aagaaucacucgaaccugggagguggagguugcgagaucacaccacugcacuccagugugagca

SEQ ID NO: 353474 - RNA, 64 nt, hsa
uuacuccacaggaaaauguaagcuacuuugucauagaucacaaaagaaucauaaugcuaacaaa

SEQ ID NO: 353475 - RNA, 64 nt, hsa
ucguagaaaaacauuuuauauguacuauucuuaaagaucacaauuauuuuuaaacuuucuauuu

SEQ ID NO: 353476 - RNA, 64 nt, hsa
cuugaacccgggaggcaaagguugcagugagcugagaucacaccacugcacuccagccuggcga

SEQ ID NO: 353477 - RNA, 64 nt, hsa
uguaaucccagcacuuugggaggcugaggugggcagaucacaaggucaggaguuugagaccagc

SEQ ID NO: 353478 - RNA, 64 nt, hsa
ugccgggaacgggcaagacauguuuugaaauguaagaucacagacuguuuuuugcaagaccaca

SEQ ID NO: 353479 - RNA, 64 nt, hsa
auugguaauucugaauaaggaucugaauaaauccagaucacagacuguuccuuuaccaauaugu

SEQ ID NO: 353480 - RNA, 64 nt, hsa
aaugccguacagagcagaggcuggggcauuggcaagaucacagguugaugcugcacagccccau

SEQ ID NO: 353481 - RNA, 64 nt, hsa
gcauacacaugcacgcuuacauguacacgugcacagaucacacacaugcacacacguguagcuc

SEQ ID NO: 353482 - RNA, 64 nt, hsa; identical to SEQ ID NO: 210956

SEQ ID NO: 353483 - RNA, 64 nt, hsa; identical to SEQ ID NO: 210957

SEQ ID NO: 353484 - RNA, 64 nt, hsa; identical to SEQ ID NO: 210958

SEQ ID NO: 353485 - RNA, 64 nt, hsa; identical to SEQ ID NO: 210959

SEQ ID NO: 353486 - RNA, 64 nt, hsa; identical to SEQ ID NO: 312521

SEQ ID NO: 353487 - RNA, 64 nt, hsa; identical to SEQ ID NO: 312522

SEQ ID NO: 353488 - RNA, 64 nt, hsa; identical to SEQ ID NO: 312523

SEQ ID NO: 353489 - RNA, 64 nt, hsa; identical to SEQ ID NO: 312524

SEQ ID NO: 353490 - RNA, 64 nt, hsa; identical to SEQ ID NO: 312525

SEQ ID NO: 353491 - RNA, 64 nt, hsa; identical to SEQ ID NO: 312526

SEQ ID NO: 353492 - RNA, 64 nt, hsa; identical to SEQ ID NO: 312527

SEQ ID NO: 353493 - RNA, 64 nt, hsa; identical to SEQ ID NO: 312528

SEQ ID NO: 353494 - RNA, 64 nt, hsa; identical to SEQ ID NO: 312529

SEQ ID NO: 353495 - RNA, 64 nt, hsa; identical to SEQ ID NO: 312530

SEQ ID NO: 353496 - RNA, 64 nt, hsa; identical to SEQ ID NO: 312531

SEQ ID NO: 353497 - RNA, 64 nt, hsa; identical to SEQ ID NO: 312532

SEQ ID NO: 353498 - RNA, 64 nt, hsa; identical to SEQ ID NO: 312533

SEQ ID NO: 353499 - RNA, 64 nt, hsa; identical to SEQ ID NO: 312534

SEQ ID NO: 353500 - RNA, 64 nt, hsa; identical to SEQ ID NO: 312535

SEQ ID NO: 353501 - RNA, 64 nt, hsa; identical to SEQ ID NO: 312536

SEQ ID NO: 353502 - RNA, 64 nt, hsa; identical to SEQ ID NO: 312537

SEQ ID NO: 353503 - RNA, 64 nt, hsa; identical to SEQ ID NO: 312538

SEQ ID NO: 353504 - RNA, 64 nt, hsa; identical to SEQ ID NO: 312539

SEQ ID NO: 353505 - RNA, 64 nt, hsa; identical to SEQ ID NO: 312540

SEQ ID NO: 353506 - RNA, 64 nt, hsa; identical to SEQ ID NO: 312541

SEQ ID NO: 353507 - RNA, 64 nt, hsa; identical to SEQ ID NO: 312542

SEQ ID NO: 353508 - RNA, 64 nt, hsa; identical to SEQ ID NO: 312543

SEQ ID NO: 353509 - RNA, 64 nt, hsa; identical to SEQ ID NO: 312544

SEQ ID NO: 353510 - RNA, 64 nt, hsa; identical to SEQ ID NO: 312545

SEQ ID NO: 353511 - RNA, 64 nt, hsa; identical to SEQ ID NO: 312546

SEQ ID NO: 353512 - RNA, 64 nt, hsa; identical to SEQ ID NO: 312547

SEQ ID NO: 353513 - RNA, 64 nt, hsa; identical to SEQ ID NO: 312548

SEQ ID NO: 353514 - RNA, 64 nt, hsa; identical to SEQ ID NO: 312549

SEQ ID NO: 353515 - RNA, 64 nt, hsa; identical to SEQ ID NO: 312550

SEQ ID NO: 353516 - RNA, 64 nt, hsa; identical to SEQ ID NO: 312551

SEQ ID NO: 353517 - RNA, 64 nt, hsa; identical to SEQ ID NO: 312552

SEQ ID NO: 353518 - RNA, 64 nt, hsa; identical to SEQ ID NO: 312553

SEQ ID NO: 353519 - RNA, 64 nt, hsa; identical to SEQ ID NO: 312554

SEQ ID NO: 353520 - RNA, 64 nt, hsa; identical to SEQ ID NO: 312555

SEQ ID NO: 353521 - RNA, 64 nt, hsa; identical to SEQ ID NO: 312556

SEQ ID NO: 353522 - RNA, 64 nt, hsa; identical to SEQ ID NO: 312557

SEQ ID NO: 353523 - RNA, 64 nt, hsa; identical to SEQ ID NO: 312558

SEQ ID NO: 353524 - RNA, 64 nt, hsa; identical to SEQ ID NO: 312559

SEQ ID NO: 353525 - RNA, 64 nt, hsa; identical to SEQ ID NO: 312560

SEQ ID NO: 353526 - RNA, 64 nt, hsa; identical to SEQ ID NO: 312561

SEQ ID NO: 353527 - RNA, 64 nt, hsa; identical to SEQ ID NO: 312562

SEQ ID NO: 353528 - RNA, 64 nt, hsa; identical to SEQ ID NO: 312563

SEQ ID NO: 353529 - RNA, 64 nt, hsa; identical to SEQ ID NO: 312564

SEQ ID NO: 353530 - RNA, 64 nt, hsa; identical to SEQ ID NO: 312565

SEQ ID NO: 353531 - RNA, 64 nt, hsa; identical to SEQ ID NO: 312566

SEQ ID NO: 353532 - RNA, 64 nt, hsa; identical to SEQ ID NO: 312567

SEQ ID NO: 353533 - RNA, 64 nt, hsa; identical to SEQ ID NO: 312568

SEQ ID NO: 353534 - RNA, 64 nt, hsa
gcuguuugggaauuuuccuugcugcuaccgcgcugccaccaaauggaauugaccagcggcuguu

SEQ ID NO: 353535 - RNA, 64 nt, hsa
acuguucucucuugagaaccuguggccucaaccagccaccaagcugauguggcccaaguccauc

SEQ ID NO: 353536 - RNA, 64 nt, hsa
gacuaaagaggacgccguccuuaaaaccugacgugccaccaaagccuuccuuuguuccucaaac

SEQ ID NO: 353537 - RNA, 64 nt, hsa
agcauuuuuuuuucauguguggcaucuuuuucaugccaccaacaaacuuguugugugugugcgu

SEQ ID NO: 353538 - RNA, 64 nt, hsa
gaggugcaggggagucaccgcccagaccuccccagccaccaaccgaccccaccucuguuccuaa

SEQ ID NO: 353539 - RNA, 64 nt, hsa
gaggcccugcccggggcuggggccuaguccagcagccaccaaagucuggcagacuuucugcauu

SEQ ID NO: 353540 - RNA, 64 nt, hsa
uggcccuccuccuuuuccacagccacucacuggggccaccaaaacccagagauggcaggugugu

SEQ ID NO: 353541 - RNA, 64 nt, hsa
gggucagcuggucucaaaacuggccacugccucagccaccaagcuuuuuccuaccacuaccuua

SEQ ID NO: 353542 - RNA, 64 nt, hsa; identical to SEQ ID NO: 157974

SEQ ID NO: 353543 - RNA, 64 nt, hsa; identical to SEQ ID NO: 157975

SEQ ID NO: 353544 - RNA, 64 nt, hsa; identical to SEQ ID NO: 157976

SEQ ID NO: 353545 - RNA, 64 nt, hsa; identical to SEQ ID NO: 157977

SEQ ID NO: 353546 - RNA, 64 nt, hsa; identical to SEQ ID NO: 157978

SEQ ID NO: 353547 - RNA, 64 nt, hsa; identical to SEQ ID NO: 157979

SEQ ID NO: 353548 - RNA, 64 nt, hsa; identical to SEQ ID NO: 157980

SEQ ID NO: 353549 - RNA, 64 nt, hsa; identical to SEQ ID NO: 157981

SEQ ID NO: 353550 - RNA, 64 nt, hsa; identical to SEQ ID NO: 157982

SEQ ID NO: 353551 - RNA, 64 nt, hsa; identical to SEQ ID NO: 157983

SEQ ID NO: 353552 - RNA, 62 nt, hsa
uuacuuccuuuguuacagggagggguuggcuuggggugaaaaguucugcccuccgcagggag

SEQ ID NO: 353553 - RNA, 62 nt, hsa
gugcuagugggucccuaagagggcccauguugggggugaagucaugagguccugaaggcuua

SEQ ID NO: 353554 - RNA, 62 nt, hsa
cgccagagcccuggcuggugaugugcuggcugggggugaaucccaaugagggucccucucag

SEQ ID NO: 353555 - RNA, 62 nt, hsa
cgccagagcccuggauggugaugcgcuggcugggggugaaucccaaugagggucccucucag

SEQ ID NO: 353556 - RNA, 62 nt, hsa
cgccagagcccuggcuggugacaugcuggcugggggugaauccgaaugacagugcagacguu

SEQ ID NO: 353557 - RNA, 62 nt, hsa
aagaaacaugguccauuagaggggaaagcccaggggugaaucuucacgccccaaacagugcc

SEQ ID NO: 353558 - RNA, 62 nt, hsa
uuaagccuauggaaccggcuuugcuguucuggggggugaaaauagacuaacuacuggagaaa

SEQ ID NO: 353559 - RNA, 62 nt, hsa
uaauguuuuaauaucacaucucacaaauaacaggggugaauguuucucucuagcaaucuagg

SEQ ID NO: 353560 - RNA, 62 nt, hsa
gagaucuuaagcaaacagucccaaaccucuuaggggugaaaaaagaaacaugccacuugauu

SEQ ID NO: 353561 - RNA, 62 nt, hsa
ucaggguaccuguuagccccugacaacucaguggggugaaguuuuggaggucagagucugcu

SEQ ID NO: 353562 - RNA, 62 nt, hsa
ucuuagcugcacuccaacauugcauccuuucuggggugaagaaucugggccaaccagggguc

SEQ ID NO: 353563 - RNA, 62 nt, hsa
cacaaauccuaagauuuuuuucugcucaggaaggggugaaauagcuggcagauacaaaagac

SEQ ID NO: 353564 - RNA, 64 nt, hsa
cucggccucccaaagugcugggauuacaggcaugagucaccaugcccugccgaaucaguuuugu

SEQ ID NO: 353565 - RNA, 64 nt, hsa
caggagcaccuccuaccaccacgaaguucagaacagucaccaauguggcaggcuugcuaggccc

SEQ ID NO: 353566 - RNA, 64 nt, hsa
agacaccauauuuauggagaacauuaggacaaaaagucaccaacuuacuuuguaacauuuuaau

SEQ ID NO: 353567 - RNA, 64 nt, hsa
uccagacaaggcccacugcaguuccuauggcgccagucaccagcuccuagacagcacuugggua

SEQ ID NO: 353568 - RNA, 64 nt, hsa
ccucccagauaauugcuuccaaauucgaagaguuagucaccaagagagccauauguaugaaagc

SEQ ID NO: 353569 - RNA, 64 nt, hsa
uauaauagaaagccagccacugcuuagcuaucauagucaccauuuucucacuguuaacauuagg

SEQ ID NO: 353570 - RNA, 64 nt, hsa
acugucccuuccagcugccccagacaggaagcagagucaccacgcagcagugucccuucuuggg

SEQ ID NO: 353571 - RNA, 64 nt, hsa
acugguugagauggaauagaauaacugggcuaugagucaccagcccacuuugugacccagcaag

SEQ ID NO: 353572 - RNA, 64 nt, hsa
gccaccagggggcaggagugcacuaccugcugucagucaccagaguggccgcucagugcccagc

SEQ ID NO: 353573 - RNA, 64 nt, hsa
aggacugcugggaaaacagguggugugggacuuaagucaccauaauuuugaagacuugcaugca

SEQ ID NO: 353574 - RNA, 64 nt, hsa
agaccauuucccaaggucacagaaccagcucucuagucaccacccugccucucccucucaccca

SEQ ID NO: 353575 - RNA, 64 nt, hsa
cuuuuggaauaguuucaccugagaaaacauaguuggcuauuaucuaucuuaaccuguucaggcu

SEQ ID NO: 353576 - RNA, 64 nt, hsa
cuuuaaaguguuauuuuauuaauuaaaaggauauggcuauuauuauauauucucuaaagauuug

SEQ ID NO: 353577 - RNA, 64 nt, hsa; identical to SEQ ID NO: 217042

SEQ ID NO: 353578 - RNA, 64 nt, hsa; identical to SEQ ID NO: 217043

SEQ ID NO: 353579 - RNA, 64 nt, hsa; identical to SEQ ID NO: 217044

SEQ ID NO: 353580 - RNA, 64 nt, hsa; identical to SEQ ID NO: 217045

SEQ ID NO: 353581 - RNA, 64 nt, hsa; identical to SEQ ID NO: 217046

SEQ ID NO: 353582 - RNA, 64 nt, hsa; identical to SEQ ID NO: 217047

SEQ ID NO: 353583 - RNA, 64 nt, hsa; identical to SEQ ID NO: 217048

SEQ ID NO: 353584 - RNA, 64 nt, hsa; identical to SEQ ID NO: 217049

SEQ ID NO: 353585 - RNA, 64 nt, hsa; identical to SEQ ID NO: 217050

SEQ ID NO: 353586 - RNA, 64 nt, hsa; identical to SEQ ID NO: 217051

SEQ ID NO: 353587 - RNA, 64 nt, hsa; identical to SEQ ID NO: 217052

SEQ ID NO: 353588 - RNA, 64 nt, hsa; identical to SEQ ID NO: 217053

SEQ ID NO: 353589 - RNA, 64 nt, hsa; identical to SEQ ID NO: 217054

SEQ ID NO: 353590 - RNA, 64 nt, hsa; identical to SEQ ID NO: 217055

SEQ ID NO: 353591 - RNA, 64 nt, hsa; identical to SEQ ID NO: 217056

SEQ ID NO: 353592 - RNA, 64 nt, hsa; identical to SEQ ID NO: 217057

SEQ ID NO: 353593 - RNA, 64 nt, hsa; identical to SEQ ID NO: 217058

SEQ ID NO: 353594 - RNA, 64 nt, hsa; identical to SEQ ID NO: 70741

SEQ ID NO: 353595 - RNA, 64 nt, hsa; identical to SEQ ID NO: 70742

SEQ ID NO: 353596 - RNA, 64 nt, hsa; identical to SEQ ID NO: 70743

SEQ ID NO: 353597 - RNA, 64 nt, hsa; identical to SEQ ID NO: 70744

SEQ ID NO: 353598 - RNA, 63 nt, hsa; identical to SEQ ID NO: 118067

SEQ ID NO: 353599 - RNA, 64 nt, hsa; identical to SEQ ID NO: 118068

SEQ ID NO: 353600 - RNA, 64 nt, hsa; identical to SEQ ID NO: 118069

SEQ ID NO: 353601 - RNA, 64 nt, hsa; identical to SEQ ID NO: 118070

SEQ ID NO: 353602 - RNA, 64 nt, hsa; identical to SEQ ID NO: 118071

SEQ ID NO: 353603 - RNA, 64 nt, hsa; identical to SEQ ID NO: 118072

SEQ ID NO: 353604 - RNA, 64 nt, hsa; identical to SEQ ID NO: 118073

SEQ ID NO: 353605 - RNA, 64 nt, hsa; identical to SEQ ID NO: 118074

SEQ ID NO: 353606 - RNA, 64 nt, hsa; identical to SEQ ID NO: 118075

SEQ ID NO: 353607 - RNA, 64 nt, hsa; identical to SEQ ID NO: 118076

SEQ ID NO: 353608 - RNA, 64 nt, hsa; identical to SEQ ID NO: 118077

SEQ ID NO: 353609 - RNA, 64 nt, hsa; identical to SEQ ID NO: 118078

SEQ ID NO: 353610 - RNA, 64 nt, hsa; identical to SEQ ID NO: 118079

SEQ ID NO: 353611 - RNA, 64 nt, hsa; identical to SEQ ID NO: 118080

SEQ ID NO: 353612 - RNA, 64 nt, hsa; identical to SEQ ID NO: 118081

SEQ ID NO: 353613 - RNA, 64 nt, hsa; identical to SEQ ID NO: 118082

SEQ ID NO: 353614 - RNA, 64 nt, hsa; identical to SEQ ID NO: 118083

SEQ ID NO: 353615 - RNA, 64 nt, hsa; identical to SEQ ID NO: 118084

SEQ ID NO: 353616 - RNA, 64 nt, hsa; identical to SEQ ID NO: 118085

SEQ ID NO: 353617 - RNA, 64 nt, hsa; identical to SEQ ID NO: 118086

SEQ ID NO: 353618 - RNA, 64 nt, hsa; identical to SEQ ID NO: 118087

SEQ ID NO: 353619 - RNA, 64 nt, hsa; identical to SEQ ID NO: 118088

SEQ ID NO: 353620 - RNA, 64 nt, hsa; identical to SEQ ID NO: 118089

SEQ ID NO: 353621 - RNA, 64 nt, hsa; identical to SEQ ID NO: 118090

SEQ ID NO: 353622 - RNA, 64 nt, hsa; identical to SEQ ID NO: 118091

SEQ ID NO: 353623 - RNA, 64 nt, hsa; identical to SEQ ID NO: 118092

SEQ ID NO: 353624 - RNA, 64 nt, hsa; identical to SEQ ID NO: 118093

SEQ ID NO: 353625 - RNA, 64 nt, hsa; identical to SEQ ID NO: 118094

SEQ ID NO: 353626 - RNA, 64 nt, hsa; identical to SEQ ID NO: 118095

SEQ ID NO: 353627 - RNA, 64 nt, hsa; identical to SEQ ID NO: 118096

SEQ ID NO: 353628 - RNA, 64 nt, hsa; identical to SEQ ID NO: 118097

SEQ ID NO: 353629 - RNA, 64 nt, hsa; identical to SEQ ID NO: 118098

SEQ ID NO: 353630 - RNA, 64 nt, hsa; identical to SEQ ID NO: 118099

SEQ ID NO: 353631 - RNA, 64 nt, hsa; identical to SEQ ID NO: 118100

SEQ ID NO: 353632 - RNA, 64 nt, hsa; identical to SEQ ID NO: 118101

SEQ ID NO: 353633 - RNA, 64 nt, hsa; identical to SEQ ID NO: 118102

SEQ ID NO: 353634 - RNA, 64 nt, hsa; identical to SEQ ID NO: 118103

SEQ ID NO: 353635 - RNA, 64 nt, hsa; identical to SEQ ID NO: 118104

SEQ ID NO: 353636 - RNA, 64 nt, hsa; identical to SEQ ID NO: 118105

SEQ ID NO: 353637 - RNA, 64 nt, hsa; identical to SEQ ID NO: 118106

SEQ ID NO: 353638 - RNA, 64 nt, hsa; identical to SEQ ID NO: 118107

SEQ ID NO: 353639 - RNA, 64 nt, hsa; identical to SEQ ID NO: 118108

SEQ ID NO: 353640 - RNA, 64 nt, hsa; identical to SEQ ID NO: 118109

SEQ ID NO: 353641 - RNA, 64 nt, hsa; identical to SEQ ID NO: 118110

SEQ ID NO: 353642 - RNA, 64 nt, hsa; identical to SEQ ID NO: 118111

SEQ ID NO: 353643 - RNA, 64 nt, hsa; identical to SEQ ID NO: 118112

SEQ ID NO: 353644 - RNA, 64 nt, hsa; identical to SEQ ID NO: 118113

SEQ ID NO: 353645 - RNA, 64 nt, hsa; identical to SEQ ID NO: 118114

SEQ ID NO: 353646 - RNA, 64 nt, hsa; identical to SEQ ID NO: 118115

SEQ ID NO: 353647 - RNA, 64 nt, hsa; identical to SEQ ID NO: 118116

SEQ ID NO: 353648 - RNA, 64 nt, hsa; identical to SEQ ID NO: 118117

SEQ ID NO: 353649 - RNA, 64 nt, hsa; identical to SEQ ID NO: 118118

SEQ ID NO: 353650 - RNA, 64 nt, hsa; identical to SEQ ID NO: 118119

SEQ ID NO: 353651 - RNA, 64 nt, hsa; identical to SEQ ID NO: 118120

SEQ ID NO: 353652 - RNA, 64 nt, hsa; identical to SEQ ID NO: 118121

SEQ ID NO: 353653 - RNA, 64 nt, hsa; identical to SEQ ID NO: 87364

SEQ ID NO: 353654 - RNA, 64 nt, hsa; identical to SEQ ID NO: 87365

SEQ ID NO: 353655 - RNA, 64 nt, hsa; identical to SEQ ID NO: 87366

SEQ ID NO: 353656 - RNA, 64 nt, hsa; identical to SEQ ID NO: 87367

SEQ ID NO: 353657 - RNA, 64 nt, hsa; identical to SEQ ID NO: 87368

SEQ ID NO: 353658 - RNA, 64 nt, hsa; identical to SEQ ID NO: 87369

SEQ ID NO: 353659 - RNA, 64 nt, hsa; identical to SEQ ID NO: 87370

SEQ ID NO: 353660 - RNA, 64 nt, hsa; identical to SEQ ID NO: 87371

SEQ ID NO: 353661 - RNA, 64 nt, hsa; identical to SEQ ID NO: 87372

SEQ ID NO: 353662 - RNA, 64 nt, hsa; identical to SEQ ID NO: 87373

SEQ ID NO: 353663 - RNA, 64 nt, hsa; identical to SEQ ID NO: 87374

SEQ ID NO: 353664 - RNA, 64 nt, hsa; identical to SEQ ID NO: 87375

SEQ ID NO: 353665 - RNA, 64 nt, hsa; identical to SEQ ID NO: 87376

SEQ ID NO: 353666 - RNA, 64 nt, hsa; identical to SEQ ID NO: 87377

SEQ ID NO: 353667 - RNA, 64 nt, hsa; identical to SEQ ID NO: 87378

SEQ ID NO: 353668 - RNA, 64 nt, hsa; identical to SEQ ID NO: 87379

SEQ ID NO: 353669 - RNA, 64 nt, hsa; identical to SEQ ID NO: 87380

SEQ ID NO: 353670 - RNA, 64 nt, hsa; identical to SEQ ID NO: 87381

SEQ ID NO: 353671 - RNA, 64 nt, hsa; identical to SEQ ID NO: 87382

SEQ ID NO: 353672 - RNA, 64 nt, hsa; identical to SEQ ID NO: 87383

SEQ ID NO: 353673 - RNA, 64 nt, hsa; identical to SEQ ID NO: 87384

SEQ ID NO: 353674 - RNA, 64 nt, hsa; identical to SEQ ID NO: 87385

SEQ ID NO: 353675 - RNA, 64 nt, hsa; identical to SEQ ID NO: 87386

SEQ ID NO: 353676 - RNA, 64 nt, hsa; identical to SEQ ID NO: 87387

SEQ ID NO: 353677 - RNA, 64 nt, hsa; identical to SEQ ID NO: 87388

SEQ ID NO: 353678 - RNA, 64 nt, hsa; identical to SEQ ID NO: 87389

SEQ ID NO: 353679 - RNA, 64 nt, hsa; identical to SEQ ID NO: 87390

SEQ ID NO: 353680 - RNA, 64 nt, hsa; identical to SEQ ID NO: 87391

SEQ ID NO: 353681 - RNA, 64 nt, hsa; identical to SEQ ID NO: 87392

SEQ ID NO: 353682 - RNA, 64 nt, hsa; identical to SEQ ID NO: 87393

SEQ ID NO: 353683 - RNA, 64 nt, hsa; identical to SEQ ID NO: 87394

SEQ ID NO: 353684 - RNA, 64 nt, hsa; identical to SEQ ID NO: 87395

SEQ ID NO: 353685 - RNA, 64 nt, hsa; identical to SEQ ID NO: 87396

SEQ ID NO: 353686 - RNA, 64 nt, hsa; identical to SEQ ID NO: 87397

SEQ ID NO: 353687 - RNA, 64 nt, hsa; identical to SEQ ID NO: 87398

SEQ ID NO: 353688 - RNA, 64 nt, hsa; identical to SEQ ID NO: 87399

SEQ ID NO: 353689 - RNA, 64 nt, hsa; identical to SEQ ID NO: 87400

SEQ ID NO: 353690 - RNA, 64 nt, hsa; identical to SEQ ID NO: 87401

SEQ ID NO: 353691 - RNA, 64 nt, hsa; identical to SEQ ID NO: 87402

SEQ ID NO: 353692 - RNA, 64 nt, hsa; identical to SEQ ID NO: 87403

SEQ ID NO: 353693 - RNA, 64 nt, hsa; identical to SEQ ID NO: 87404

SEQ ID NO: 353694 - RNA, 64 nt, hsa; identical to SEQ ID NO: 87405

SEQ ID NO: 353695 - RNA, 64 nt, hsa; identical to SEQ ID NO: 87406

SEQ ID NO: 353696 - RNA, 64 nt, hsa; identical to SEQ ID NO: 106476

SEQ ID NO: 353697 - RNA, 64 nt, hsa; identical to SEQ ID NO: 106477

SEQ ID NO: 353698 - RNA, 64 nt, hsa; identical to SEQ ID NO: 69094

SEQ ID NO: 353699 - RNA, 64 nt, hsa; identical to SEQ ID NO: 69095

SEQ ID NO: 353700 - RNA, 64 nt, hsa; identical to SEQ ID NO: 69096

SEQ ID NO: 353701 - RNA, 64 nt, hsa; identical to SEQ ID NO: 69097

SEQ ID NO: 353702 - RNA, 64 nt, hsa; identical to SEQ ID NO: 69098

SEQ ID NO: 353703 - RNA, 64 nt, hsa; identical to SEQ ID NO: 69099

SEQ ID NO: 353704 - RNA, 64 nt, hsa
auuacaauugaggaaaaagucaaaauuauaaaauaccuuuaaagacaugcacuuuccauauuuu

SEQ ID NO: 353705 - RNA, 64 nt, hsa
uuuugccuucacaaaagccuaaugucuguaauuaaccuuuaauuuuuauuucuguaugagacaa

SEQ ID NO: 353706 - RNA, 64 nt, hsa
agaaauaaugucaaaaauauuuaggaauuuaauaaccuuuaagucagaaacuaaaacaaauacu

SEQ ID NO: 353707 - RNA, 64 nt, hsa
uaaaagcuaagaugccuucuaacuucauaagcaaaccuuuaacuaauuauguaucugaaaguca

SEQ ID NO: 353708 - RNA, 64 nt, hsa
agauaaacccugcaaauguaaagaguguaacaaaaccuuuaaacagcccucaccggugaauaaa

SEQ ID NO: 353709 - RNA, 64 nt, hsa
uauaaaaccauagaaauguaaaagaugugacaaaaccuuuaagccauacuccaggcuucuuaaa

SEQ ID NO: 353710 - RNA, 64 nt, hsa
auuauaaugauaagcauuauucauaaaacuuguuaccuuuaagaagguggaaguggcaaaccau

SEQ ID NO: 353711 - RNA, 64 nt, hsa
uaauuguucccuuucuguuuucauauagugaauaaccuuuaaaggguuguuuuguuuuguuuug

SEQ ID NO: 353712 - RNA, 64 nt, hsa
agaucuacauuuuguacauauuuauauaaaauuuaccuuuaaguauuuacuuuaaaaaauuuaa

SEQ ID NO: 353713 - RNA, 64 nt, hsa
uaaagcaaauuggagacugggcacaguggcucccaccuuuaaucccagcaccuggggaggcuga

SEQ ID NO: 353714 - RNA, 64 nt, hsa
aagggaaaaauuaaaaauaccuagacugcaauaaaccuuuaaauuggauuuucagugagaauuu

SEQ ID NO: 353715 - RNA, 64 nt, hsa
gcaggaaaagccagagaagccgguggagagcagcaccuuuaagagcccucucucucugcuugcc

SEQ ID NO: 353716 - RNA, 64 nt, hsa
uuguagcagaaccccgggucaucucaugucagaaaccuuuaauccaggccuaaauuugcauaga

SEQ ID NO: 353717 - RNA, 64 nt, hsa
uuagauucauaucauuuaauuucacauauucaacaccuuuaaauguuguaaucuuaauaugcga

SEQ ID NO: 353718 - RNA, 64 nt, hsa
aauggucuaacuggcaucucuuguaucaagaaguaccuuuaagguagaccuuuucagggugccc

SEQ ID NO: 353719 - RNA, 64 nt, hsa
caacuuuuugcuuugcuuuggauaagaaauccuuaccuuuaaaaaaagcuucuagucuccauaa

SEQ ID NO: 353720 - RNA, 64 nt, hsa
aaaacugcuucuaauccuuccuuugcuaaaucucaccuuuaaaaacgaaggugacucacuuugc

SEQ ID NO: 353721 - RNA, 64 nt, hsa
ccucugagcugcacuucaccgcugaccuugccucaccuuuaaccccccaccugagccccagcuc

SEQ ID NO: 353722 - RNA, 64 nt, hsa
gccccgcuucaccccuucugacucuggaaaccgcaccuuuaacuuugcagaccuuccuucaccc

SEQ ID NO: 353723 - RNA, 64 nt, hsa; identical to SEQ ID NO: 274666

SEQ ID NO: 353724 - RNA, 64 nt, hsa; identical to SEQ ID NO: 274667

SEQ ID NO: 353725 - RNA, 64 nt, hsa
uuaaaauucuguaguguaugguaagucauaucagauaucagaccuaauuuaaauuucauuuuag

SEQ ID NO: 353726 - RNA, 64 nt, hsa
cccccuuuuaaaauucuguaguguaugguaagucauaucagauaucagaccuaauuuaaauuuc

SEQ ID NO: 353727 - RNA, 64 nt, hsa
ucaaggccagucauuuuuaauuuauaucagauuuauaucagacccuccaaaaaguauuugaaau

SEQ ID NO: 353728 - RNA, 64 nt, hsa
uuaugcuguggucaaggccagucauuuuuaauuuauaucagauuuauaucagacccuccaaaaa

SEQ ID NO: 353729 - RNA, 64 nt, hsa
cuacaagagacaaagaaaugauuuugccuccuggauaucagaaaaauccaugugaaaauguagu

SEQ ID NO: 353730 - RNA, 64 nt, hsa
uauucagaauaaguaggagaaugaaaacugcagcauaucagacagcaauuuaacagcuugaaac

SEQ ID NO: 353731 - RNA, 64 nt, hsa
guuuagcuucuaaaugaaauaauauauaggagggauaucagaaugucuagauagagaaaguauu

SEQ ID NO: 353732 - RNA, 64 nt, hsa
agauuuuuguuagucaucauguaauaagccauuuauaucagaaaccuuuuuuccugccacagaa

SEQ ID NO: 353733 - RNA, 64 nt, hsa
uuuuuaaacuucaguuuuacugcauuuucacaacauaucagacuucaccaaauauaugccuuac

SEQ ID NO: 353734 - RNA, 64 nt, hsa
aagggaacaugugaaugaauacacaggacuuauuauaucagagugaguaaucgguugguugguu

SEQ ID NO: 353735 - RNA, 64 nt, hsa
auaagugacuccggaugcaucaguguccaccaguuggaagcaaugacaaggauggcuggcuggu

SEQ ID NO: 353736 - RNA, 64 nt, hsa
aggaaaaagucuagacccagaacaaucaggagauuggaagcaaauuuaugaagaaugauggugg

SEQ ID NO: 353737 - RNA, 58 nt, hsa
gucuggaugaccaucgguagcaaccuauuggaagcauacaaagcaguuuauuuuagag

SEQ ID NO: 353738 - RNA, 64 nt, hsa
cuuuauaauuuacccauuucuauacaacaggcaguggaagcaguuucagagaacuuuuugcaug

SEQ ID NO: 353739 - RNA, 64 nt, hsa
cuugagagagacaagaugaaauuugaguuuguuuuggaagcaugcucaucuccucacacugcug

SEQ ID NO: 353740 - RNA, 64 nt, hsa
cacugccuccaagucaggcagaccuuggugaaucuggaagcaagaggaccugagccagaugcac

SEQ ID NO: 353741 - RNA, 64 nt, hsa
uuuuucacaccuuuugcauuacauaauaauuuuguggaagcauuuugcccuuuagaauaaauau

SEQ ID NO: 353742 - RNA, 64 nt, hsa
gaaauuaaaccauccuugucagcagaagccaagauggaagcaguuugagcaaugaaauccguaa

SEQ ID NO: 353743 - RNA, 64 nt, hsa
aucagaacuauuaauagcauaaaucgaacucaaauggaagcaaaacugauuucaugcagguccu

SEQ ID NO: 353744 - RNA, 64 nt, hsa
agugaaguuuuccuaaggcaagcaagaagaggaguggaagcacaguugccuggauuuggaggca

SEQ ID NO: 353745 - RNA, 64 nt, hsa
ggcuugauaccaaucgagcuaaggauaccugcuuuggaagcauguuuauucuguuccccagcaa

SEQ ID NO: 353746 - RNA, 64 nt, hsa
uaaagauguuuuaagcuaaagccugaauuugggauggaagcaggacagacaccguggacagcgc

SEQ ID NO: 353747 - RNA, 64 nt, hsa
uggacaacaccacgaccacauggaaacauauuuuuggaagcaaaacuuuaauuuuauauaacgu

SEQ ID NO: 353748 - RNA, 64 nt, hsa
ggguuggcugugccacuccauaaaguaucuauuguggaagcagccaaaaagggcugcuguggca

SEQ ID NO: 353749 - RNA, 64 nt, hsa
uacacccuggaugucacuuuggaaaccaagcccuuggaagcaagugggguggcaugggagagaa

SEQ ID NO: 353750 - RNA, 64 nt, hsa
cucuaguggugauccggcucauucuccugcaaguuggaagcacaauuuuccccccaaguggagg

SEQ ID NO: 353751 - RNA, 64 nt, hsa
aaccugaguccggcucuucagcaggcugcacaaguggaagcaacuaauucuggugcucaggcug

SEQ ID NO: 353752 - RNA, 64 nt, hsa
gucagucaguaauuucacaaccguuaucagaguuuggaagcagaaauagcuguuaacuaaaauc

SEQ ID NO: 353753 - RNA, 64 nt, hsa
agaugacugacugccaauacuugucaccauucccuggaagcagcuaccuaggggaaacaagaug

SEQ ID NO: 353754 - RNA, 64 nt, hsa
uugauuugcaaauuuggauuuacacccauuguuuuggaagcacaucagcugaauaaaguugagg

SEQ ID NO: 353755 - RNA, 64 nt, hsa
ugucggccuccucccgacuugacucaccgucaccuggaagcagggcaccagcugcugggguggg

SEQ ID NO: 353756 - RNA, 64 nt, hsa
acaauggggaaaaguuaaggagcaaaauggggguuggaagcaaaaaauagggccccaccuauuu

SEQ ID NO: 353757 - RNA, 64 nt, hsa
gacucagugcagugggcagggaagacauaacagauggaagcaaaggaauccugccugccuucag

SEQ ID NO: 353758 - RNA, 64 nt, hsa
uguauugaaggcccauugaaugacuaauccaggcuggaagcauucccaugugggugucugaguc

SEQ ID NO: 353759 - RNA, 64 nt, hsa; identical to SEQ ID NO: 45477

SEQ ID NO: 353760 - RNA, 64 nt, hsa; identical to SEQ ID NO: 45478

SEQ ID NO: 353761 - RNA, 64 nt, hsa; identical to SEQ ID NO: 45479

SEQ ID NO: 353762 - RNA, 64 nt, hsa; identical to SEQ ID NO: 45480

SEQ ID NO: 353763 - RNA, 64 nt, hsa; identical to SEQ ID NO: 45481

SEQ ID NO: 353764 - RNA, 64 nt, hsa; identical to SEQ ID NO: 45482

SEQ ID NO: 353765 - RNA, 64 nt, hsa; identical to SEQ ID NO: 45483

SEQ ID NO: 353766 - RNA, 64 nt, hsa; identical to SEQ ID NO: 45484

SEQ ID NO: 353767 - RNA, 64 nt, hsa; identical to SEQ ID NO: 45485

SEQ ID NO: 353768 - RNA, 64 nt, hsa; identical to SEQ ID NO: 45486

SEQ ID NO: 353769 - RNA, 64 nt, hsa; identical to SEQ ID NO: 45487

SEQ ID NO: 353770 - RNA, 56 nt, hsa; identical to SEQ ID NO: 45488

SEQ ID NO: 353771 - RNA, 64 nt, hsa; identical to SEQ ID NO: 45489

SEQ ID NO: 353772 - RNA, 64 nt, hsa; identical to SEQ ID NO: 45490

SEQ ID NO: 353773 - RNA, 64 nt, hsa; identical to SEQ ID NO: 45491

SEQ ID NO: 353774 - RNA, 64 nt, hsa; identical to SEQ ID NO: 45492

SEQ ID NO: 353775 - RNA, 64 nt, hsa; identical to SEQ ID NO: 45493

SEQ ID NO: 353776 - RNA, 64 nt, hsa; identical to SEQ ID NO: 45494

SEQ ID NO: 353777 - RNA, 64 nt, hsa; identical to SEQ ID NO: 45495

SEQ ID NO: 353778 - RNA, 64 nt, hsa; identical to SEQ ID NO: 45496

SEQ ID NO: 353779 - RNA, 64 nt, hsa; identical to SEQ ID NO: 45497

SEQ ID NO: 353780 - RNA, 64 nt, hsa; identical to SEQ ID NO: 45498

SEQ ID NO: 353781 - RNA, 64 nt, hsa; identical to SEQ ID NO: 45499

SEQ ID NO: 353782 - RNA, 64 nt, hsa; identical to SEQ ID NO: 45500

SEQ ID NO: 353783 - RNA, 64 nt, hsa; identical to SEQ ID NO: 45501

SEQ ID NO: 353784 - RNA, 64 nt, hsa; identical to SEQ ID NO: 45502

SEQ ID NO: 353785 - RNA, 64 nt, hsa; identical to SEQ ID NO: 45503

SEQ ID NO: 353786 - RNA, 64 nt, hsa; identical to SEQ ID NO: 45504

SEQ ID NO: 353787 - RNA, 64 nt, hsa; identical to SEQ ID NO: 45505

SEQ ID NO: 353788 - RNA, 64 nt, hsa; identical to SEQ ID NO: 45506

SEQ ID NO: 353789 - RNA, 64 nt, hsa; identical to SEQ ID NO: 45507

SEQ ID NO: 353790 - RNA, 64 nt, hsa; identical to SEQ ID NO: 45508

SEQ ID NO: 353791 - RNA, 64 nt, hsa; identical to SEQ ID NO: 45509

SEQ ID NO: 353792 - RNA, 64 nt, hsa; identical to SEQ ID NO: 45510

SEQ ID NO: 353793 - RNA, 64 nt, hsa; identical to SEQ ID NO: 45511

SEQ ID NO: 353794 - RNA, 64 nt, hsa; identical to SEQ ID NO: 45512

SEQ ID NO: 353795 - RNA, 64 nt, hsa; identical to SEQ ID NO: 45513

SEQ ID NO: 353796 - RNA, 64 nt, hsa; identical to SEQ ID NO: 45514

SEQ ID NO: 353797 - RNA, 64 nt, hsa; identical to SEQ ID NO: 45515

SEQ ID NO: 353798 - RNA, 64 nt, hsa; identical to SEQ ID NO: 45516

SEQ ID NO: 353799 - RNA, 64 nt, hsa; identical to SEQ ID NO: 45517

SEQ ID NO: 353800 - RNA, 64 nt, hsa; identical to SEQ ID NO: 45518

SEQ ID NO: 353801 - RNA, 64 nt, hsa; identical to SEQ ID NO: 45519

SEQ ID NO: 353802 - RNA, 64 nt, hsa; identical to SEQ ID NO: 45520

SEQ ID NO: 353803 - RNA, 64 nt, hsa; identical to SEQ ID NO: 45521

SEQ ID NO: 353804 - RNA, 64 nt, hsa; identical to SEQ ID NO: 45522

SEQ ID NO: 353805 - RNA, 64 nt, hsa; identical to SEQ ID NO: 45523

SEQ ID NO: 353806 - RNA, 64 nt, hsa; identical to SEQ ID NO: 45524

SEQ ID NO: 353807 - RNA, 64 nt, hsa; identical to SEQ ID NO: 45525

SEQ ID NO: 353808 - RNA, 64 nt, hsa; identical to SEQ ID NO: 45526

SEQ ID NO: 353809 - RNA, 64 nt, hsa; identical to SEQ ID NO: 45527

SEQ ID NO: 353810 - RNA, 64 nt, hsa; identical to SEQ ID NO: 45528

SEQ ID NO: 353811 - RNA, 64 nt, hsa; identical to SEQ ID NO: 45529

SEQ ID NO: 353812 - RNA, 64 nt, hsa; identical to SEQ ID NO: 45530

SEQ ID NO: 353813 - RNA, 64 nt, hsa; identical to SEQ ID NO: 45531

SEQ ID NO: 353814 - RNA, 64 nt, hsa; identical to SEQ ID NO: 45532

SEQ ID NO: 353815 - RNA, 64 nt, hsa; identical to SEQ ID NO: 45533

SEQ ID NO: 353816 - RNA, 64 nt, hsa; identical to SEQ ID NO: 45534

SEQ ID NO: 353817 - RNA, 64 nt, hsa; identical to SEQ ID NO: 45535

SEQ ID NO: 353818 - RNA, 64 nt, hsa; identical to SEQ ID NO: 45536

SEQ ID NO: 353819 - RNA, 64 nt, hsa; identical to SEQ ID NO: 45537

SEQ ID NO: 353820 - RNA, 64 nt, hsa; identical to SEQ ID NO: 45538

SEQ ID NO: 353821 - RNA, 64 nt, hsa; identical to SEQ ID NO: 45539

SEQ ID NO: 353822 - RNA, 64 nt, hsa; identical to SEQ ID NO: 45540

SEQ ID NO: 353823 - RNA, 64 nt, hsa; identical to SEQ ID NO: 45541

SEQ ID NO: 353824 - RNA, 64 nt, hsa; identical to SEQ ID NO: 45542

SEQ ID NO: 353825 - RNA, 64 nt, hsa; identical to SEQ ID NO: 45543

SEQ ID NO: 353826 - RNA, 64 nt, hsa; identical to SEQ ID NO: 45544

SEQ ID NO: 353827 - RNA, 64 nt, hsa; identical to SEQ ID NO: 45545

SEQ ID NO: 353828 - RNA, 64 nt, hsa; identical to SEQ ID NO: 45546

SEQ ID NO: 353829 - RNA, 64 nt, hsa; identical to SEQ ID NO: 45547

SEQ ID NO: 353830 - RNA, 64 nt, hsa; identical to SEQ ID NO: 45548

SEQ ID NO: 353831 - RNA, 64 nt, hsa; identical to SEQ ID NO: 45549

SEQ ID NO: 353832 - RNA, 64 nt, hsa; identical to SEQ ID NO: 45550

SEQ ID NO: 353833 - RNA, 64 nt, hsa; identical to SEQ ID NO: 45551

SEQ ID NO: 353834 - RNA, 64 nt, hsa; identical to SEQ ID NO: 45552

SEQ ID NO: 353835 - RNA, 64 nt, hsa; identical to SEQ ID NO: 45553

SEQ ID NO: 353836 - RNA, 64 nt, hsa; identical to SEQ ID NO: 45554

SEQ ID NO: 353837 - RNA, 64 nt, hsa; identical to SEQ ID NO: 45555

SEQ ID NO: 353838 - RNA, 64 nt, hsa; identical to SEQ ID NO: 45556

SEQ ID NO: 353839 - RNA, 64 nt, hsa; identical to SEQ ID NO: 45557

SEQ ID NO: 353840 - RNA, 64 nt, hsa; identical to SEQ ID NO: 45558

SEQ ID NO: 353841 - RNA, 64 nt, hsa; identical to SEQ ID NO: 45559

SEQ ID NO: 353842 - RNA, 64 nt, hsa; identical to SEQ ID NO: 45560

SEQ ID NO: 353843 - RNA, 64 nt, hsa; identical to SEQ ID NO: 45561

SEQ ID NO: 353844 - RNA, 64 nt, hsa; identical to SEQ ID NO: 45562

SEQ ID NO: 353845 - RNA, 64 nt, hsa; identical to SEQ ID NO: 45563

SEQ ID NO: 353846 - RNA, 64 nt, hsa; identical to SEQ ID NO: 45564

SEQ ID NO: 353847 - RNA, 64 nt, hsa; identical to SEQ ID NO: 45565

SEQ ID NO: 353848 - RNA, 64 nt, hsa; identical to SEQ ID NO: 45566

SEQ ID NO: 353849 - RNA, 64 nt, hsa; identical to SEQ ID NO: 45567

SEQ ID NO: 353850 - RNA, 64 nt, hsa; identical to SEQ ID NO: 45568

SEQ ID NO: 353851 - RNA, 64 nt, hsa; identical to SEQ ID NO: 45569

SEQ ID NO: 353852 - RNA, 64 nt, hsa; identical to SEQ ID NO: 45570

SEQ ID NO: 353853 - RNA, 64 nt, hsa; identical to SEQ ID NO: 45571

SEQ ID NO: 353854 - RNA, 64 nt, hsa; identical to SEQ ID NO: 45572

SEQ ID NO: 353855 - RNA, 64 nt, hsa; identical to SEQ ID NO: 45573

SEQ ID NO: 353856 - RNA, 64 nt, hsa; identical to SEQ ID NO: 45574

SEQ ID NO: 353857 - RNA, 64 nt, hsa; identical to SEQ ID NO: 45575

SEQ ID NO: 353858 - RNA, 64 nt, hsa; identical to SEQ ID NO: 45576

SEQ ID NO: 353859 - RNA, 64 nt, hsa; identical to SEQ ID NO: 45577

SEQ ID NO: 353860 - RNA, 64 nt, hsa; identical to SEQ ID NO: 45578

SEQ ID NO: 353861 - RNA, 64 nt, hsa; identical to SEQ ID NO: 45579

SEQ ID NO: 353862 - RNA, 64 nt, hsa; identical to SEQ ID NO: 45580

SEQ ID NO: 353863 - RNA, 64 nt, hsa; identical to SEQ ID NO: 45581

SEQ ID NO: 353864 - RNA, 64 nt, hsa; identical to SEQ ID NO: 45582

SEQ ID NO: 353865 - RNA, 64 nt, hsa; identical to SEQ ID NO: 45583

SEQ ID NO: 353866 - RNA, 64 nt, hsa; identical to SEQ ID NO: 45584

SEQ ID NO: 353867 - RNA, 64 nt, hsa; identical to SEQ ID NO: 45585

SEQ ID NO: 353868 - RNA, 64 nt, hsa; identical to SEQ ID NO: 45586

SEQ ID NO: 353869 - RNA, 64 nt, hsa; identical to SEQ ID NO: 45587

SEQ ID NO: 353870 - RNA, 64 nt, hsa; identical to SEQ ID NO: 45588

SEQ ID NO: 353871 - RNA, 64 nt, hsa; identical to SEQ ID NO: 45589

SEQ ID NO: 353872 - RNA, 64 nt, hsa; identical to SEQ ID NO: 45590

SEQ ID NO: 353873 - RNA, 64 nt, hsa; identical to SEQ ID NO: 45591

SEQ ID NO: 353874 - RNA, 64 nt, hsa; identical to SEQ ID NO: 45592

SEQ ID NO: 353875 - RNA, 64 nt, hsa; identical to SEQ ID NO: 45593

SEQ ID NO: 353876 - RNA, 64 nt, hsa; identical to SEQ ID NO: 45594

SEQ ID NO: 353877 - RNA, 64 nt, hsa; identical to SEQ ID NO: 45595

SEQ ID NO: 353878 - RNA, 64 nt, hsa; identical to SEQ ID NO: 45596

SEQ ID NO: 353879 - RNA, 64 nt, hsa; identical to SEQ ID NO: 45597

SEQ ID NO: 353880 - RNA, 64 nt, hsa; identical to SEQ ID NO: 45598

SEQ ID NO: 353881 - RNA, 64 nt, hsa; identical to SEQ ID NO: 45599

SEQ ID NO: 353882 - RNA, 64 nt, hsa; identical to SEQ ID NO: 45600

SEQ ID NO: 353883 - RNA, 64 nt, hsa; identical to SEQ ID NO: 45601

SEQ ID NO: 353884 - RNA, 64 nt, hsa; identical to SEQ ID NO: 45602

SEQ ID NO: 353885 - RNA, 64 nt, hsa; identical to SEQ ID NO: 45603

SEQ ID NO: 353886 - RNA, 64 nt, hsa; identical to SEQ ID NO: 45604

SEQ ID NO: 353887 - RNA, 64 nt, hsa; identical to SEQ ID NO: 45605

SEQ ID NO: 353888 - RNA, 64 nt, hsa; identical to SEQ ID NO: 45606

SEQ ID NO: 353889 - RNA, 64 nt, hsa; identical to SEQ ID NO: 45607

SEQ ID NO: 353890 - RNA, 64 nt, hsa; identical to SEQ ID NO: 45608

SEQ ID NO: 353891 - RNA, 64 nt, hsa; identical to SEQ ID NO: 45609

SEQ ID NO: 353892 - RNA, 64 nt, hsa; identical to SEQ ID NO: 45610

SEQ ID NO: 353893 - RNA, 64 nt, hsa; identical to SEQ ID NO: 45611

SEQ ID NO: 353894 - RNA, 64 nt, hsa; identical to SEQ ID NO: 45612

SEQ ID NO: 353895 - RNA, 64 nt, hsa; identical to SEQ ID NO: 45613

SEQ ID NO: 353896 - RNA, 64 nt, hsa; identical to SEQ ID NO: 45614

SEQ ID NO: 353897 - RNA, 64 nt, hsa; identical to SEQ ID NO: 45615

SEQ ID NO: 353898 - RNA, 64 nt, hsa; identical to SEQ ID NO: 45616

SEQ ID NO: 353899 - RNA, 64 nt, hsa; identical to SEQ ID NO: 45617

SEQ ID NO: 353900 - RNA, 64 nt, hsa; identical to SEQ ID NO: 45618

SEQ ID NO: 353901 - RNA, 64 nt, hsa; identical to SEQ ID NO: 45619

SEQ ID NO: 353902 - RNA, 64 nt, hsa; identical to SEQ ID NO: 45620

SEQ ID NO: 353903 - RNA, 64 nt, hsa; identical to SEQ ID NO: 45621

SEQ ID NO: 353904 - RNA, 64 nt, hsa; identical to SEQ ID NO: 45622

SEQ ID NO: 353905 - RNA, 64 nt, hsa; identical to SEQ ID NO: 45623

SEQ ID NO: 353906 - RNA, 64 nt, hsa; identical to SEQ ID NO: 45624

SEQ ID NO: 353907 - RNA, 64 nt, hsa; identical to SEQ ID NO: 45625

SEQ ID NO: 353908 - RNA, 64 nt, hsa; identical to SEQ ID NO: 45626

SEQ ID NO: 353909 - RNA, 64 nt, hsa; identical to SEQ ID NO: 45627

SEQ ID NO: 353910 - RNA, 64 nt, hsa; identical to SEQ ID NO: 45628

SEQ ID NO: 353911 - RNA, 64 nt, hsa; identical to SEQ ID NO: 45629

SEQ ID NO: 353912 - RNA, 64 nt, hsa; identical to SEQ ID NO: 45630

SEQ ID NO: 353913 - RNA, 64 nt, hsa; identical to SEQ ID NO: 45631

SEQ ID NO: 353914 - RNA, 64 nt, hsa; identical to SEQ ID NO: 45632

SEQ ID NO: 353915 - RNA, 64 nt, hsa; identical to SEQ ID NO: 45633

SEQ ID NO: 353916 - RNA, 64 nt, hsa; identical to SEQ ID NO: 45634

SEQ ID NO: 353917 - RNA, 64 nt, hsa; identical to SEQ ID NO: 45635

SEQ ID NO: 353918 - RNA, 64 nt, hsa; identical to SEQ ID NO: 45636

SEQ ID NO: 353919 - RNA, 64 nt, hsa; identical to SEQ ID NO: 45637

SEQ ID NO: 353920 - RNA, 64 nt, hsa; identical to SEQ ID NO: 45638

SEQ ID NO: 353921 - RNA, 64 nt, hsa; identical to SEQ ID NO: 45639

SEQ ID NO: 353922 - RNA, 64 nt, hsa; identical to SEQ ID NO: 45640

SEQ ID NO: 353923 - RNA, 64 nt, hsa; identical to SEQ ID NO: 45641

SEQ ID NO: 353924 - RNA, 64 nt, hsa; identical to SEQ ID NO: 45642

SEQ ID NO: 353925 - RNA, 64 nt, hsa; identical to SEQ ID NO: 45643

SEQ ID NO: 353926 - RNA, 64 nt, hsa; identical to SEQ ID NO: 45644

SEQ ID NO: 353927 - RNA, 64 nt, hsa; identical to SEQ ID NO: 45645

SEQ ID NO: 353928 - RNA, 64 nt, hsa; identical to SEQ ID NO: 45646

SEQ ID NO: 353929 - RNA, 64 nt, hsa; identical to SEQ ID NO: 45647

SEQ ID NO: 353930 - RNA, 64 nt, hsa; identical to SEQ ID NO: 45648

SEQ ID NO: 353931 - RNA, 64 nt, hsa; identical to SEQ ID NO: 45649

SEQ ID NO: 353932 - RNA, 64 nt, hsa; identical to SEQ ID NO: 45650

SEQ ID NO: 353933 - RNA, 64 nt, hsa; identical to SEQ ID NO: 45651

SEQ ID NO: 353934 - RNA, 64 nt, hsa; identical to SEQ ID NO: 45652

SEQ ID NO: 353935 - RNA, 64 nt, hsa; identical to SEQ ID NO: 45653

SEQ ID NO: 353936 - RNA, 64 nt, hsa; identical to SEQ ID NO: 45654

SEQ ID NO: 353937 - RNA, 64 nt, hsa; identical to SEQ ID NO: 45655

SEQ ID NO: 353938 - RNA, 64 nt, hsa; identical to SEQ ID NO: 72506

SEQ ID NO: 353939 - RNA, 64 nt, hsa; identical to SEQ ID NO: 72507

SEQ ID NO: 353940 - RNA, 64 nt, hsa; identical to SEQ ID NO: 72508

SEQ ID NO: 353941 - RNA, 64 nt, hsa; identical to SEQ ID NO: 72509

SEQ ID NO: 353942 - RNA, 64 nt, hsa; identical to SEQ ID NO: 72510

SEQ ID NO: 353943 - RNA, 64 nt, hsa; identical to SEQ ID NO: 72511

SEQ ID NO: 353944 - RNA, 64 nt, hsa; identical to SEQ ID NO: 72512

SEQ ID NO: 353945 - RNA, 64 nt, hsa; identical to SEQ ID NO: 72513

SEQ ID NO: 353946 - RNA, 64 nt, hsa; identical to SEQ ID NO: 72514

SEQ ID NO: 353947 - RNA, 64 nt, hsa; identical to SEQ ID NO: 72515

SEQ ID NO: 353948 - RNA, 64 nt, hsa; identical to SEQ ID NO: 72516

SEQ ID NO: 353949 - RNA, 64 nt, hsa; identical to SEQ ID NO: 72517

SEQ ID NO: 353950 - RNA, 64 nt, hsa; identical to SEQ ID NO: 72518

SEQ ID NO: 353951 - RNA, 64 nt, hsa; identical to SEQ ID NO: 72519

SEQ ID NO: 353952 - RNA, 64 nt, hsa; identical to SEQ ID NO: 72520

SEQ ID NO: 353953 - RNA, 64 nt, hsa; identical to SEQ ID NO: 72521

SEQ ID NO: 353954 - RNA, 64 nt, hsa; identical to SEQ ID NO: 72522

SEQ ID NO: 353955 - RNA, 64 nt, hsa; identical to SEQ ID NO: 72523

SEQ ID NO: 353956 - RNA, 64 nt, hsa; identical to SEQ ID NO: 72524

SEQ ID NO: 353957 - RNA, 64 nt, hsa; identical to SEQ ID NO: 72525

SEQ ID NO: 353958 - RNA, 64 nt, hsa; identical to SEQ ID NO: 72526

SEQ ID NO: 353959 - RNA, 64 nt, hsa; identical to SEQ ID NO: 72527

SEQ ID NO: 353960 - RNA, 64 nt, hsa; identical to SEQ ID NO: 72528

SEQ ID NO: 353961 - RNA, 64 nt, hsa; identical to SEQ ID NO: 72529

SEQ ID NO: 353962 - RNA, 64 nt, hsa; identical to SEQ ID NO: 72530

SEQ ID NO: 353963 - RNA, 64 nt, hsa; identical to SEQ ID NO: 72531

SEQ ID NO: 353964 - RNA, 64 nt, hsa; identical to SEQ ID NO: 72532

SEQ ID NO: 353965 - RNA, 64 nt, hsa; identical to SEQ ID NO: 72533

SEQ ID NO: 353966 - RNA, 64 nt, hsa; identical to SEQ ID NO: 72534

SEQ ID NO: 353967 - RNA, 64 nt, hsa; identical to SEQ ID NO: 72535

SEQ ID NO: 353968 - RNA, 64 nt, hsa; identical to SEQ ID NO: 72536

SEQ ID NO: 353969 - RNA, 64 nt, hsa; identical to SEQ ID NO: 72537

SEQ ID NO: 353970 - RNA, 64 nt, hsa; identical to SEQ ID NO: 72538

SEQ ID NO: 353971 - RNA, 64 nt, hsa; identical to SEQ ID NO: 72539

SEQ ID NO: 353972 - RNA, 64 nt, hsa; identical to SEQ ID NO: 72540

SEQ ID NO: 353973 - RNA, 64 nt, hsa; identical to SEQ ID NO: 72541

SEQ ID NO: 353974 - RNA, 64 nt, hsa; identical to SEQ ID NO: 72542

SEQ ID NO: 353975 - RNA, 64 nt, hsa; identical to SEQ ID NO: 72543

SEQ ID NO: 353976 - RNA, 64 nt, hsa; identical to SEQ ID NO: 72544

SEQ ID NO: 353977 - RNA, 64 nt, hsa; identical to SEQ ID NO: 72545

SEQ ID NO: 353978 - RNA, 64 nt, hsa; identical to SEQ ID NO: 72546

SEQ ID NO: 353979 - RNA, 64 nt, hsa; identical to SEQ ID NO: 72547

SEQ ID NO: 353980 - RNA, 64 nt, hsa; identical to SEQ ID NO: 72548

SEQ ID NO: 353981 - RNA, 64 nt, hsa; identical to SEQ ID NO: 72549

SEQ ID NO: 353982 - RNA, 64 nt, hsa; identical to SEQ ID NO: 72550

SEQ ID NO: 353983 - RNA, 64 nt, hsa; identical to SEQ ID NO: 72551

SEQ ID NO: 353984 - RNA, 64 nt, hsa; identical to SEQ ID NO: 72552

SEQ ID NO: 353985 - RNA, 64 nt, hsa; identical to SEQ ID NO: 72553

SEQ ID NO: 353986 - RNA, 64 nt, hsa; identical to SEQ ID NO: 72554

SEQ ID NO: 353987 - RNA, 64 nt, hsa; identical to SEQ ID NO: 72555

SEQ ID NO: 353988 - RNA, 64 nt, hsa; identical to SEQ ID NO: 72556

SEQ ID NO: 353989 - RNA, 64 nt, hsa; identical to SEQ ID NO: 72557

SEQ ID NO: 353990 - RNA, 64 nt, hsa; identical to SEQ ID NO: 72558

SEQ ID NO: 353991 - RNA, 64 nt, hsa; identical to SEQ ID NO: 72559

SEQ ID NO: 353992 - RNA, 64 nt, hsa; identical to SEQ ID NO: 72560

SEQ ID NO: 353993 - RNA, 64 nt, hsa; identical to SEQ ID NO: 72561

SEQ ID NO: 353994 - RNA, 64 nt, hsa; identical to SEQ ID NO: 72562

SEQ ID NO: 353995 - RNA, 64 nt, hsa; identical to SEQ ID NO: 72563

SEQ ID NO: 353996 - RNA, 64 nt, hsa; identical to SEQ ID NO: 72564

SEQ ID NO: 353997 - RNA, 64 nt, hsa; identical to SEQ ID NO: 72565

SEQ ID NO: 353998 - RNA, 64 nt, hsa; identical to SEQ ID NO: 72566

SEQ ID NO: 353999 - RNA, 64 nt, hsa; identical to SEQ ID NO: 72567

SEQ ID NO: 354000 - RNA, 64 nt, hsa; identical to SEQ ID NO: 72568

SEQ ID NO: 354001 - RNA, 64 nt, hsa; identical to SEQ ID NO: 72569

SEQ ID NO: 354002 - RNA, 64 nt, hsa; identical to SEQ ID NO: 72570

SEQ ID NO: 354003 - RNA, 64 nt, hsa; identical to SEQ ID NO: 72571

SEQ ID NO: 354004 - RNA, 64 nt, hsa; identical to SEQ ID NO: 72572

SEQ ID NO: 354005 - RNA, 64 nt, hsa; identical to SEQ ID NO: 72573

SEQ ID NO: 354006 - RNA, 64 nt, hsa; identical to SEQ ID NO: 72574

SEQ ID NO: 354007 - RNA, 64 nt, hsa; identical to SEQ ID NO: 72575

SEQ ID NO: 354008 - RNA, 64 nt, hsa; identical to SEQ ID NO: 72576

SEQ ID NO: 354009 - RNA, 64 nt, hsa; identical to SEQ ID NO: 72577

SEQ ID NO: 354010 - RNA, 64 nt, hsa; identical to SEQ ID NO: 72578

SEQ ID NO: 354011 - RNA, 64 nt, hsa; identical to SEQ ID NO: 72579

SEQ ID NO: 354012 - RNA, 64 nt, hsa; identical to SEQ ID NO: 72580

SEQ ID NO: 354013 - RNA, 64 nt, hsa; identical to SEQ ID NO: 72581

SEQ ID NO: 354014 - RNA, 64 nt, hsa; identical to SEQ ID NO: 72582

SEQ ID NO: 354015 - RNA, 64 nt, hsa; identical to SEQ ID NO: 72583

SEQ ID NO: 354016 - RNA, 64 nt, hsa; identical to SEQ ID NO: 72584

SEQ ID NO: 354017 - RNA, 64 nt, hsa; identical to SEQ ID NO: 72585

SEQ ID NO: 354018 - RNA, 64 nt, hsa; identical to SEQ ID NO: 72586

SEQ ID NO: 354019 - RNA, 64 nt, hsa; identical to SEQ ID NO: 72587

SEQ ID NO: 354020 - RNA, 64 nt, hsa; identical to SEQ ID NO: 72588

SEQ ID NO: 354021 - RNA, 64 nt, hsa; identical to SEQ ID NO: 72589

SEQ ID NO: 354022 - RNA, 64 nt, hsa; identical to SEQ ID NO: 72590

SEQ ID NO: 354023 - RNA, 64 nt, hsa; identical to SEQ ID NO: 72591

SEQ ID NO: 354024 - RNA, 64 nt, hsa; identical to SEQ ID NO: 72592

SEQ ID NO: 354025 - RNA, 64 nt, hsa; identical to SEQ ID NO: 72593

SEQ ID NO: 354026 - RNA, 64 nt, hsa; identical to SEQ ID NO: 72594

SEQ ID NO: 354027 - RNA, 64 nt, hsa; identical to SEQ ID NO: 72595

SEQ ID NO: 354028 - RNA, 64 nt, hsa; identical to SEQ ID NO: 72596

SEQ ID NO: 354029 - RNA, 64 nt, hsa; identical to SEQ ID NO: 72597

SEQ ID NO: 354030 - RNA, 64 nt, hsa; identical to SEQ ID NO: 72598

SEQ ID NO: 354031 - RNA, 64 nt, hsa; identical to SEQ ID NO: 72599

SEQ ID NO: 354032 - RNA, 64 nt, hsa; identical to SEQ ID NO: 72600

SEQ ID NO: 354033 - RNA, 64 nt, hsa; identical to SEQ ID NO: 72601

SEQ ID NO: 354034 - RNA, 64 nt, hsa
uuaaggcuggcauucuuacuuuuacauuaaaaaaacuggcuacaggcugcgcagcugagguacu

SEQ ID NO: 354035 - RNA, 64 nt, hsa
ugaggucagggacagggcauauuacugacaccccacuggcuauugcccuauaccugccaaucac

SEQ ID NO: 354036 - RNA, 64 nt, hsa
agcagcauguacccaaaguguucugauuccuucaacuggcuacugagucaugauccuugcugau

SEQ ID NO: 354037 - RNA, 64 nt, hsa
ggaaaucuuauaaaaacuagucaagccuaaugcaacuggcuaaaggauaguaccacccucaccc

SEQ ID NO: 354038 - RNA, 64 nt, hsa
ggcacgcacugacuuugauauuccaggcacacggacuggcuauuuaucaccacuucuuuuuccc

SEQ ID NO: 354039 - RNA, 58 nt, hsa
agacgaagccuuccccaugaaccccaccacuggcuaaaacuggacacauccugccugg

SEQ ID NO: 354040 - RNA, 64 nt, hsa
gaagcuaagaauauuauuuuauuugcaaaacccagaagcuaaaaagucaauaaacagaaagaau

SEQ ID NO: 354041 - RNA, 64 nt, hsa
uauacauaaaacacucugauauuauuguauaaaggaagcuaagaauauuauuuuauuugcaaaa

SEQ ID NO: 354042 - RNA, 64 nt, hsa
uaauuaauauucccauuuuacagaugaggaaacugaagcuaagagaagcuaaguaauaugccca

SEQ ID NO: 354043 - RNA, 64 nt, hsa
ucccauuuuacagaugaggaaacugaagcuaagagaagcuaaguaauaugcccaagguccacau

SEQ ID NO: 354044 - RNA, 64 nt, hsa
uaauaaaguaaaaauaaaaauaaaaaaguaaucagaagcuaaaguaaaguuccuuuccuggugc

SEQ ID NO: 354045 - RNA, 64 nt, hsa
caguaucuauuccaagauacugaggucauaaucagaagcuaagcugggugcaguggcucaugcc

SEQ ID NO: 354046 - RNA, 64 nt, hsa
cuaacucagaaugggauuaaaaauuuuagaagcagaagcuaauauauaaaugaaguuugggauu

SEQ ID NO: 354047 - RNA, 64 nt, hsa
gauaauagagaaguccauuuaaaaauuauuuuuagaagcuaaagaaaguaauuaugcuuccugu

SEQ ID NO: 354048 - RNA, 64 nt, hsa
aaugguucuggguacaccagaaauuuguuugccugaagcuaaagugugucuacaaugguacagc

SEQ ID NO: 354049 - RNA, 64 nt, hsa
aaggggaguaauaauguaaaacaacugacccagagaagcuaaaagccacuggcagcacaggcug

SEQ ID NO: 354050 - RNA, 64 nt, hsa
auaaguuaaggcuuucugcacugguacucucaaggaagcuaauuuucuuucuggggggggcggg

SEQ ID NO: 354051 - RNA, 64 nt, hsa
cugggauuacaggcaugagccaucgcccagcccagaagcuaauuuuuuaauauuguauaugguc

SEQ ID NO: 354052 - RNA, 64 nt, hsa; identical to SEQ ID NO: 236646

SEQ ID NO: 354053 - RNA, 64 nt, hsa; identical to SEQ ID NO: 236647

SEQ ID NO: 354054 - RNA, 64 nt, hsa; identical to SEQ ID NO: 236648

SEQ ID NO: 354055 - RNA, 64 nt, hsa; identical to SEQ ID NO: 236649

SEQ ID NO: 354056 - RNA, 64 nt, hsa; identical to SEQ ID NO: 236650

SEQ ID NO: 354057 - RNA, 64 nt, hsa; identical to SEQ ID NO: 236651

SEQ ID NO: 354058 - RNA, 64 nt, hsa; identical to SEQ ID NO: 236652

SEQ ID NO: 354059 - RNA, 64 nt, hsa; identical to SEQ ID NO: 236653

SEQ ID NO: 354060 - RNA, 64 nt, hsa; identical to SEQ ID NO: 236654

SEQ ID NO: 354061 - RNA, 62 nt, hsa; identical to SEQ ID NO: 236655

SEQ ID NO: 354062 - RNA, 64 nt, hsa; identical to SEQ ID NO: 236656

SEQ ID NO: 354063 - RNA, 64 nt, hsa; identical to SEQ ID NO: 236657

SEQ ID NO: 354064 - RNA, 64 nt, hsa; identical to SEQ ID NO: 236658

SEQ ID NO: 354065 - RNA, 64 nt, hsa; identical to SEQ ID NO: 236659

SEQ ID NO: 354066 - RNA, 64 nt, hsa; identical to SEQ ID NO: 236660

SEQ ID NO: 354067 - RNA, 64 nt, hsa; identical to SEQ ID NO: 236661

SEQ ID NO: 354068 - RNA, 50 nt, hsa; identical to SEQ ID NO: 236662

SEQ ID NO: 354069 - RNA, 64 nt, hsa; identical to SEQ ID NO: 236663

SEQ ID NO: 354070 - RNA, 64 nt, hsa; identical to SEQ ID NO: 236664

SEQ ID NO: 354071 - RNA, 64 nt, hsa; identical to SEQ ID NO: 236665

SEQ ID NO: 354072 - RNA, 64 nt, hsa; identical to SEQ ID NO: 236666

SEQ ID NO: 354073 - RNA, 64 nt, hsa; identical to SEQ ID NO: 236667

SEQ ID NO: 354074 - RNA, 64 nt, hsa; identical to SEQ ID NO: 236668

SEQ ID NO: 354075 - RNA, 64 nt, hsa; identical to SEQ ID NO: 236669

SEQ ID NO: 354076 - RNA, 64 nt, hsa; identical to SEQ ID NO: 236670

SEQ ID NO: 354077 - RNA, 64 nt, hsa; identical to SEQ ID NO: 236671

SEQ ID NO: 354078 - RNA, 64 nt, hsa; identical to SEQ ID NO: 236672

SEQ ID NO: 354079 - RNA, 64 nt, hsa; identical to SEQ ID NO: 236673

SEQ ID NO: 354080 - RNA, 64 nt, hsa; identical to SEQ ID NO: 236674

SEQ ID NO: 354081 - RNA, 64 nt, hsa; identical to SEQ ID NO: 236675

SEQ ID NO: 354082 - RNA, 64 nt, hsa; identical to SEQ ID NO: 236676

SEQ ID NO: 354083 - RNA, 64 nt, hsa; identical to SEQ ID NO: 236677

SEQ ID NO: 354084 - RNA, 64 nt, hsa; identical to SEQ ID NO: 236678

SEQ ID NO: 354085 - RNA, 64 nt, hsa; identical to SEQ ID NO: 236679

SEQ ID NO: 354086 - RNA, 64 nt, hsa; identical to SEQ ID NO: 236680

SEQ ID NO: 354087 - RNA, 64 nt, hsa; identical to SEQ ID NO: 236681

SEQ ID NO: 354088 - RNA, 64 nt, hsa; identical to SEQ ID NO: 236682

SEQ ID NO: 354089 - RNA, 64 nt, hsa; identical to SEQ ID NO: 236683

SEQ ID NO: 354090 - RNA, 64 nt, hsa; identical to SEQ ID NO: 236684

SEQ ID NO: 354091 - RNA, 64 nt, hsa; identical to SEQ ID NO: 236685

SEQ ID NO: 354092 - RNA, 64 nt, hsa; identical to SEQ ID NO: 236686

SEQ ID NO: 354093 - RNA, 64 nt, hsa; identical to SEQ ID NO: 236687

SEQ ID NO: 354094 - RNA, 64 nt, hsa; identical to SEQ ID NO: 236688

SEQ ID NO: 354095 - RNA, 64 nt, hsa; identical to SEQ ID NO: 236689

SEQ ID NO: 354096 - RNA, 64 nt, hsa; identical to SEQ ID NO: 236690

SEQ ID NO: 354097 - RNA, 64 nt, hsa; identical to SEQ ID NO: 236691

SEQ ID NO: 354098 - RNA, 64 nt, hsa; identical to SEQ ID NO: 236692

SEQ ID NO: 354099 - RNA, 64 nt, hsa; identical to SEQ ID NO: 195961

SEQ ID NO: 354100 - RNA, 64 nt, hsa; identical to SEQ ID NO: 195962

SEQ ID NO: 354101 - RNA, 64 nt, hsa; identical to SEQ ID NO: 195963

SEQ ID NO: 354102 - RNA, 64 nt, hsa; identical to SEQ ID NO: 195964

SEQ ID NO: 354103 - RNA, 64 nt, hsa; identical to SEQ ID NO: 195965

SEQ ID NO: 354104 - RNA, 64 nt, hsa; identical to SEQ ID NO: 195966

SEQ ID NO: 354105 - RNA, 64 nt, hsa; identical to SEQ ID NO: 195967

SEQ ID NO: 354106 - RNA, 64 nt, hsa; identical to SEQ ID NO: 195968

SEQ ID NO: 354107 - RNA, 64 nt, hsa; identical to SEQ ID NO: 195969

SEQ ID NO: 354108 - RNA, 64 nt, hsa; identical to SEQ ID NO: 195970

SEQ ID NO: 354109 - RNA, 64 nt, hsa; identical to SEQ ID NO: 195971

SEQ ID NO: 354110 - RNA, 64 nt, hsa; identical to SEQ ID NO: 195972

SEQ ID NO: 354111 - RNA, 64 nt, hsa; identical to SEQ ID NO: 195973

SEQ ID NO: 354112 - RNA, 64 nt, hsa; identical to SEQ ID NO: 195974

SEQ ID NO: 354113 - RNA, 64 nt, hsa; identical to SEQ ID NO: 195975

SEQ ID NO: 354114 - RNA, 64 nt, hsa; identical to SEQ ID NO: 195976

SEQ ID NO: 354115 - RNA, 64 nt, hsa; identical to SEQ ID NO: 195977

SEQ ID NO: 354116 - RNA, 64 nt, hsa; identical to SEQ ID NO: 195978

SEQ ID NO: 354117 - RNA, 64 nt, hsa; identical to SEQ ID NO: 195979

SEQ ID NO: 354118 - RNA, 64 nt, hsa; identical to SEQ ID NO: 195980

SEQ ID NO: 354119 - RNA, 64 nt, hsa; identical to SEQ ID NO: 195981

SEQ ID NO: 354120 - RNA, 64 nt, hsa; identical to SEQ ID NO: 195982

SEQ ID NO: 354121 - RNA, 64 nt, hsa; identical to SEQ ID NO: 195983

SEQ ID NO: 354122 - RNA, 64 nt, hsa; identical to SEQ ID NO: 195984

SEQ ID NO: 354123 - RNA, 64 nt, hsa; identical to SEQ ID NO: 195985

SEQ ID NO: 354124 - RNA, 64 nt, hsa; identical to SEQ ID NO: 195986

SEQ ID NO: 354125 - RNA, 64 nt, hsa; identical to SEQ ID NO: 195987

SEQ ID NO: 354126 - RNA, 64 nt, hsa; identical to SEQ ID NO: 128854

SEQ ID NO: 354127 - RNA, 64 nt, hsa; identical to SEQ ID NO: 128855

SEQ ID NO: 354128 - RNA, 64 nt, hsa; identical to SEQ ID NO: 128856

SEQ ID NO: 354129 - RNA, 64 nt, hsa; identical to SEQ ID NO: 128857

SEQ ID NO: 354130 - RNA, 64 nt, hsa; identical to SEQ ID NO: 128858

SEQ ID NO: 354131 - RNA, 64 nt, hsa; identical to SEQ ID NO: 128859

SEQ ID NO: 354132 - RNA, 64 nt, hsa; identical to SEQ ID NO: 128860

SEQ ID NO: 354133 - RNA, 64 nt, hsa; identical to SEQ ID NO: 128861

SEQ ID NO: 354134 - RNA, 64 nt, hsa; identical to SEQ ID NO: 128862

SEQ ID NO: 354135 - RNA, 64 nt, hsa; identical to SEQ ID NO: 128863

SEQ ID NO: 354136 - RNA, 64 nt, hsa; identical to SEQ ID NO: 128864

SEQ ID NO: 354137 - RNA, 64 nt, hsa; identical to SEQ ID NO: 128865

SEQ ID NO: 354138 - RNA, 64 nt, hsa; identical to SEQ ID NO: 128866

SEQ ID NO: 354139 - RNA, 64 nt, hsa; identical to SEQ ID NO: 128867

SEQ ID NO: 354140 - RNA, 64 nt, hsa; identical to SEQ ID NO: 128868

SEQ ID NO: 354141 - RNA, 64 nt, hsa; identical to SEQ ID NO: 128869

SEQ ID NO: 354142 - RNA, 64 nt, hsa; identical to SEQ ID NO: 128870

SEQ ID NO: 354143 - RNA, 64 nt, hsa; identical to SEQ ID NO: 128871

SEQ ID NO: 354144 - RNA, 64 nt, hsa; identical to SEQ ID NO: 128872

SEQ ID NO: 354145 - RNA, 64 nt, hsa; identical to SEQ ID NO: 128873

SEQ ID NO: 354146 - RNA, 64 nt, hsa; identical to SEQ ID NO: 128874

SEQ ID NO: 354147 - RNA, 64 nt, hsa; identical to SEQ ID NO: 128875

SEQ ID NO: 354148 - RNA, 64 nt, hsa; identical to SEQ ID NO: 128876

SEQ ID NO: 354149 - RNA, 64 nt, hsa; identical to SEQ ID NO: 128877

SEQ ID NO: 354150 - RNA, 64 nt, hsa; identical to SEQ ID NO: 128878

SEQ ID NO: 354151 - RNA, 64 nt, hsa; identical to SEQ ID NO: 128879

SEQ ID NO: 354152 - RNA, 64 nt, hsa; identical to SEQ ID NO: 128880

SEQ ID NO: 354153 - RNA, 64 nt, hsa; identical to SEQ ID NO: 128881

SEQ ID NO: 354154 - RNA, 64 nt, hsa; identical to SEQ ID NO: 128882

SEQ ID NO: 354155 - RNA, 64 nt, hsa; identical to SEQ ID NO: 128883

SEQ ID NO: 354156 - RNA, 64 nt, hsa; identical to SEQ ID NO: 128884

SEQ ID NO: 354157 - RNA, 64 nt, hsa; identical to SEQ ID NO: 128885

SEQ ID NO: 354158 - RNA, 64 nt, hsa; identical to SEQ ID NO: 128886

SEQ ID NO: 354159 - RNA, 64 nt, hsa
ccucucaggagaagccagaggcccuggccaaagauaggaggaagaaagagaacucuccauagaa

SEQ ID NO: 354160 - RNA, 64 nt, hsa
gccaagagcccuccccuuucuccaucccuccagcuaggaggaaauggagcaagaugaacaggca

SEQ ID NO: 354161 - RNA, 64 nt, hsa
gccacaagguggugcuucugccauuagacgcaguuaggaggaugcaacugcaaaucuaaaauua

SEQ ID NO: 354162 - RNA, 64 nt, hsa
ucuucucuuucauacauauaugcgugccuaguucuaggaggaaacggguuaaaaauuguuuuaa

SEQ ID NO: 354163 - RNA, 64 nt, hsa
cuggaggcucugagggagaugggcuugggggcuguaggaggaggcagggauuccagggugucag

SEQ ID NO: 354164 - RNA, 64 nt, hsa
cuggaugcucugaggcagaugggcuugggggcucuaggaggaggcagggacuccagggugucag

SEQ ID NO: 354165 - RNA, 64 nt, hsa
aaaugaaacuugaaucugucccucgugacaauuauaggaggaagguauuuaaaaccccagauuu

SEQ ID NO: 354166 - RNA, 64 nt, hsa
gacaagccuggaaggaggcaauaagugggaaagguaggaggagagaaggcuggggagggcuggg

SEQ ID NO: 354167 - RNA, 64 nt, hsa
uugguguuuauugaaaauuaaccaaacuuaauacuaggagaagacugaaucauuaaugaugucu

SEQ ID NO: 354168 - RNA, 64 nt, hsa
gcuaagccuucaucauaauuuguucccucaguaauaggagaaauauaaauacaguaaguuuaga

SEQ ID NO: 354169 - RNA, 64 nt, hsa
aaguuuucagucacagaucacgccuuaaaagacauaggagaauucauacuggagagaaaccuua

SEQ ID NO: 354170 - RNA, 64 nt, hsa
aggucuucagucaagcuucauccuaugcaaaacauaggagaauucaugcaggagagaaauguca

SEQ ID NO: 354171 - RNA, 64 nt, hsa
aggucuucagucaagcuucauccuaugcaaaacauaggagaauuuauacaggagagaaaccuca

SEQ ID NO: 354172 - RNA, 64 nt, hsa
aaaguuuccauuuggaaaucacaccuuaaagacauaggagaauuuauacuggagagaaagcuua

SEQ ID NO: 354173 - RNA, 64 nt, hsa
gguaguuaacacaucaaauauuucuugcugcuucuaggagaacuuuuuugguguguguuggaau

SEQ ID NO: 354174 - RNA, 64 nt, hsa
aauugucaaauuaccguguaccaccuaauguuuauaggagaaagcaaaauacaucagcuuggua

SEQ ID NO: 354175 - RNA, 64 nt, hsa; identical to SEQ ID NO: 227821

SEQ ID NO: 354176 - RNA, 64 nt, hsa; identical to SEQ ID NO: 227822

SEQ ID NO: 354177 - RNA, 64 nt, hsa; identical to SEQ ID NO: 227823

SEQ ID NO: 354178 - RNA, 64 nt, hsa; identical to SEQ ID NO: 227824

SEQ ID NO: 354179 - RNA, 64 nt, hsa; identical to SEQ ID NO: 227825

SEQ ID NO: 354180 - RNA, 64 nt, hsa; identical to SEQ ID NO: 227826

SEQ ID NO: 354181 - RNA, 64 nt, hsa; identical to SEQ ID NO: 227827

SEQ ID NO: 354182 - RNA, 64 nt, hsa; identical to SEQ ID NO: 227828

SEQ ID NO: 354183 - RNA, 64 nt, hsa; identical to SEQ ID NO: 227829

SEQ ID NO: 354184 - RNA, 64 nt, hsa; identical to SEQ ID NO: 227830

SEQ ID NO: 354185 - RNA, 64 nt, hsa; identical to SEQ ID NO: 227831

SEQ ID NO: 354186 - RNA, 64 nt, hsa; identical to SEQ ID NO: 227832

SEQ ID NO: 354187 - RNA, 64 nt, hsa; identical to SEQ ID NO: 227833

SEQ ID NO: 354188 - RNA, 64 nt, hsa; identical to SEQ ID NO: 227834

SEQ ID NO: 354189 - RNA, 64 nt, hsa; identical to SEQ ID NO: 227835

SEQ ID NO: 354190 - RNA, 64 nt, hsa; identical to SEQ ID NO: 227836

SEQ ID NO: 354191 - RNA, 64 nt, hsa; identical to SEQ ID NO: 227837

SEQ ID NO: 354192 - RNA, 64 nt, hsa; identical to SEQ ID NO: 227838

SEQ ID NO: 354193 - RNA, 64 nt, hsa; identical to SEQ ID NO: 227839

SEQ ID NO: 354194 - RNA, 64 nt, hsa; identical to SEQ ID NO: 227840

SEQ ID NO: 354195 - RNA, 64 nt, hsa; identical to SEQ ID NO: 227841

SEQ ID NO: 354196 - RNA, 64 nt, hsa; identical to SEQ ID NO: 227842

SEQ ID NO: 354197 - RNA, 64 nt, hsa
gacuggguuaagggagcugcucaagcaauagcagagguuucacccggcaggaugacacagacca

SEQ ID NO: 354198 - RNA, 64 nt, hsa
guguuugcuacacugaccucuugcggucuugauuagguuucagucaacucuggaucaugucagg

SEQ ID NO: 354199 - RNA, 64 nt, hsa
auaccagucuauuuaucaguugguuucaacacagagguuucaaguggaaagccauucaucuuaa

SEQ ID NO: 354200 - RNA, 64 nt, hsa
uugcguccuuuuggaaucacagaaauaaacaaguagguuucaguugucuucagagacaaauguu

SEQ ID NO: 354201 - RNA, 64 nt, hsa
cacaaaauggacuccugaaguagacagaguagugagguuucauugcccucuauaagcuucugac

SEQ ID NO: 354202 - RNA, 64 nt, hsa
agugcugagauccucaaauaaucucaauuucaggagguuucacaaaauggacuccugaaguaga

SEQ ID NO: 354203 - RNA, 64 nt, hsa
ccuuuucauguuaauaauuugaggacuggauaaaagguuucaagauuaaaauuugauguucaaa

SEQ ID NO: 354204 - RNA, 64 nt, hsa
agaaacaugaacugaaaagucuugcaaugacaagagguuucauggucuuaaaaagauacuuuau

SEQ ID NO: 354205 - RNA, 64 nt, hsa
ugagaaagcuuuuauuccuuugaauauuuuuugaagguuucagaugaggucaacacagguagca

SEQ ID NO: 354206 - RNA, 64 nt, hsa
aagggcuucggccacaggcaggucacagaaaggcagguuucauuucuuaucacauaagagagau

SEQ ID NO: 354207 - RNA, 64 nt, hsa
uauacaugauauuugacuuuucauaaguaguggaagguuucacuaaguaaaacucucaguuucu

SEQ ID NO: 354208 - RNA, 64 nt, hsa
uauaaaugguauuugacuuuucauaaguaguggaagguuucacuaaguaaagaucugaguuucu

SEQ ID NO: 354209 - RNA, 64 nt, hsa
accuaggauuaagcuggagagaaguaaguaauuuagguuucaugguacuguagaggccaggcug

SEQ ID NO: 354210 - RNA, 64 nt, hsa
uuuaaguaugaggguuuguuggucacagugggagagguuucaccaccgcauucugaccuccucc

SEQ ID NO: 354211 - RNA, 64 nt, hsa
uuuuugguuuuucaccauugauauuguauuuagaagguuucaggugggugaaaccuccuauucc

SEQ ID NO: 354212 - RNA, 64 nt, hsa
agggaccucaaccuaggugcaauccugucaugugagguuucagcuucaguccuccuugggagac

SEQ ID NO: 354213 - RNA, 64 nt, hsa; identical to SEQ ID NO: 309431

SEQ ID NO: 354214 - RNA, 64 nt, hsa; identical to SEQ ID NO: 309432

SEQ ID NO: 354215 - RNA, 64 nt, hsa; identical to SEQ ID NO: 309433

SEQ ID NO: 354216 - RNA, 64 nt, hsa; identical to SEQ ID NO: 309434

SEQ ID NO: 354217 - RNA, 64 nt, hsa; identical to SEQ ID NO: 309435

SEQ ID NO: 354218 - RNA, 64 nt, hsa; identical to SEQ ID NO: 309436

SEQ ID NO: 354219 - RNA, 64 nt, hsa; identical to SEQ ID NO: 309437

SEQ ID NO: 354220 - RNA, 64 nt, hsa; identical to SEQ ID NO: 309438

SEQ ID NO: 354221 - RNA, 64 nt, hsa; identical to SEQ ID NO: 309439

SEQ ID NO: 354222 - RNA, 64 nt, hsa; identical to SEQ ID NO: 309440

SEQ ID NO: 354223 - RNA, 64 nt, hsa; identical to SEQ ID NO: 309441

SEQ ID NO: 354224 - RNA, 64 nt, hsa; identical to SEQ ID NO: 309442

SEQ ID NO: 354225 - RNA, 64 nt, hsa; identical to SEQ ID NO: 309443

SEQ ID NO: 354226 - RNA, 64 nt, hsa; identical to SEQ ID NO: 309444

SEQ ID NO: 354227 - RNA, 64 nt, hsa; identical to SEQ ID NO: 309445

SEQ ID NO: 354228 - RNA, 64 nt, hsa; identical to SEQ ID NO: 309446

SEQ ID NO: 354229 - RNA, 64 nt, hsa; identical to SEQ ID NO: 309447

SEQ ID NO: 354230 - RNA, 64 nt, hsa; identical to SEQ ID NO: 309448

SEQ ID NO: 354231 - RNA, 64 nt, hsa; identical to SEQ ID NO: 309449

SEQ ID NO: 354232 - RNA, 64 nt, hsa; identical to SEQ ID NO: 309450

SEQ ID NO: 354233 - RNA, 64 nt, hsa; identical to SEQ ID NO: 309451

SEQ ID NO: 354234 - RNA, 64 nt, hsa; identical to SEQ ID NO: 309452

SEQ ID NO: 354235 - RNA, 64 nt, hsa; identical to SEQ ID NO: 309453

SEQ ID NO: 354236 - RNA, 64 nt, hsa; identical to SEQ ID NO: 309454

SEQ ID NO: 354237 - RNA, 64 nt, hsa; identical to SEQ ID NO: 309455

SEQ ID NO: 354238 - RNA, 64 nt, hsa; identical to SEQ ID NO: 309456

SEQ ID NO: 354239 - RNA, 64 nt, hsa; identical to SEQ ID NO: 309457

SEQ ID NO: 354240 - RNA, 64 nt, hsa; identical to SEQ ID NO: 309458

SEQ ID NO: 354241 - RNA, 64 nt, hsa; identical to SEQ ID NO: 309459

SEQ ID NO: 354242 - RNA, 64 nt, hsa; identical to SEQ ID NO: 309460

SEQ ID NO: 354243 - RNA, 64 nt, hsa; identical to SEQ ID NO: 309461

SEQ ID NO: 354244 - RNA, 64 nt, hsa; identical to SEQ ID NO: 309462

SEQ ID NO: 354245 - RNA, 64 nt, hsa; identical to SEQ ID NO: 309463

SEQ ID NO: 354246 - RNA, 64 nt, hsa; identical to SEQ ID NO: 309464

SEQ ID NO: 354247 - RNA, 64 nt, hsa; identical to SEQ ID NO: 309465

SEQ ID NO: 354248 - RNA, 64 nt, hsa; identical to SEQ ID NO: 309466

SEQ ID NO: 354249 - RNA, 64 nt, hsa; identical to SEQ ID NO: 309467

SEQ ID NO: 354250 - RNA, 64 nt, hsa; identical to SEQ ID NO: 309468

SEQ ID NO: 354251 - RNA, 64 nt, hsa; identical to SEQ ID NO: 347916

SEQ ID NO: 354252 - RNA, 64 nt, hsa; identical to SEQ ID NO: 347917

SEQ ID NO: 354253 - RNA, 64 nt, hsa; identical to SEQ ID NO: 347918

SEQ ID NO: 354254 - RNA, 64 nt, hsa; identical to SEQ ID NO: 347919

SEQ ID NO: 354255 - RNA, 64 nt, hsa; identical to SEQ ID NO: 347920

SEQ ID NO: 354256 - RNA, 64 nt, hsa; identical to SEQ ID NO: 347921

SEQ ID NO: 354257 - RNA, 64 nt, hsa; identical to SEQ ID NO: 347922

SEQ ID NO: 354258 - RNA, 64 nt, hsa; identical to SEQ ID NO: 347923

SEQ ID NO: 354259 - RNA, 64 nt, hsa; identical to SEQ ID NO: 347924

SEQ ID NO: 354260 - RNA, 64 nt, hsa; identical to SEQ ID NO: 347925

SEQ ID NO: 354261 - RNA, 64 nt, hsa
cuaaugcauguauuuguaaaccagauuuguuuaccacucaaaauuaacuuguuuucuucaucca

SEQ ID NO: 354262 - RNA, 64 nt, hsa
gugccagaaaaaccgucacuugcaaaauacuuugcacucaaaauguuuuuacaaugcuucuaaa

SEQ ID NO: 354263 - RNA, 64 nt, hsa
cuguuuaguugcaacaaucucuugugacuaaugucacucaaagcaucuuguaaauccuagggcu

SEQ ID NO: 354264 - RNA, 64 nt, hsa
cuuggagcuccugacugcagggacucuguccccacacucaaaaagacucagcucacucaaugag

SEQ ID NO: 354265 - RNA, 64 nt, hsa
ccacauggcacagagauucugaacuaaagugcugcacucaaaugaugggaaguccggccccagu

SEQ ID NO: 354266 - RNA, 64 nt, hsa
gagaaggaacauaccccuuacaaaugaaaaauuccacucaaaauagggacuaucuaucuuaaua

SEQ ID NO: 354267 - RNA, 64 nt, hsa
aagcugaauacauucugcuuucaucuuggucacauacaauuauuuuuacaguucucccaaggga

SEQ ID NO: 354268 - RNA, 64 nt, hsa
uuuaccugugaaauaguucaaagccaaguuuauauacaauuauaucaguccucuuucaaaggua

SEQ ID NO: 354269 - RNA, 64 nt, hsa
gaaaaucuuagauuuuguuuagaaugagaaaauauacaauuagaauuauuuuagaaauaguagg

SEQ ID NO: 354270 - RNA, 64 nt, hsa
uuugagguuaauuauaugauagugaggaacauuuuacaauuauuuacaguguuugacauuaauu

SEQ ID NO: 354271 - RNA, 64 nt, hsa
ugagacuuuuuuccccaaaggauacugacuguaauacaauuaccaauucacaaugauaaaaaua

SEQ ID NO: 354272 - RNA, 64 nt, hsa
acagaccugugaaauaaagggcauuuugaccuaauacaauuaauuuucuggauaacucuuaaag

SEQ ID NO: 354273 - RNA, 64 nt, hsa
accauuagcauaauuuuguguuguacaauuaaguuacaauuacaucucuaauuuuggauaauau

SEQ ID NO: 354274 - RNA, 64 nt, hsa
aguaggcuuuuaccauuagcauaauuuuguguuguacaauuaaguuacaauuacaucucuaauu

SEQ ID NO: 354275 - RNA, 64 nt, hsa
agucaacaucuaacuagugaggaaaagugccuaauacaauuagaaucucccucacucuauaguu

SEQ ID NO: 354276 - RNA, 64 nt, hsa
uggguacaggggaauuaugugugugaaugucaucuacaauuaaaaaaaauuagcacaucccuuu

SEQ ID NO: 354277 - RNA, 64 nt, hsa
gguuacuuucuuguuuuuggaaaaacaaaauuucuacaauuacaguucccaaagucaguuauuc

SEQ ID NO: 354278 - RNA, 64 nt, hsa
gguuacuuucuuguucuuggauaaagaaaauuucuacaauuacaguucccaaagacacaguugu

SEQ ID NO: 354279 - RNA, 64 nt, hsa; identical to SEQ ID NO: 101897

SEQ ID NO: 354280 - RNA, 64 nt, hsa; identical to SEQ ID NO: 101898

SEQ ID NO: 354281 - RNA, 64 nt, hsa; identical to SEQ ID NO: 101899

SEQ ID NO: 354282 - RNA, 64 nt, hsa; identical to SEQ ID NO: 101900

SEQ ID NO: 354283 - RNA, 64 nt, hsa; identical to SEQ ID NO: 101901

SEQ ID NO: 354284 - RNA, 64 nt, hsa; identical to SEQ ID NO: 101902

SEQ ID NO: 354285 - RNA, 64 nt, hsa; identical to SEQ ID NO: 354267

SEQ ID NO: 354286 - RNA, 64 nt, hsa; identical to SEQ ID NO: 354268

SEQ ID NO: 354287 - RNA, 64 nt, hsa; identical to SEQ ID NO: 354269

SEQ ID NO: 354288 - RNA, 64 nt, hsa; identical to SEQ ID NO: 354270

SEQ ID NO: 354289 - RNA, 64 nt, hsa; identical to SEQ ID NO: 354271

SEQ ID NO: 354290 - RNA, 64 nt, hsa; identical to SEQ ID NO: 354272

SEQ ID NO: 354291 - RNA, 64 nt, hsa; identical to SEQ ID NO: 354273

SEQ ID NO: 354292 - RNA, 64 nt, hsa; identical to SEQ ID NO: 354274

SEQ ID NO: 354293 - RNA, 64 nt, hsa; identical to SEQ ID NO: 354275

SEQ ID NO: 354294 - RNA, 64 nt, hsa; identical to SEQ ID NO: 354276

SEQ ID NO: 354295 - RNA, 64 nt, hsa; identical to SEQ ID NO: 354277

SEQ ID NO: 354296 - RNA, 64 nt, hsa; identical to SEQ ID NO: 354278

SEQ ID NO: 354297 - RNA, 64 nt, hsa; identical to SEQ ID NO: 101897

SEQ ID NO: 354298 - RNA, 64 nt, hsa; identical to SEQ ID NO: 101898

SEQ ID NO: 354299 - RNA, 64 nt, hsa; identical to SEQ ID NO: 101899

SEQ ID NO: 354300 - RNA, 64 nt, hsa; identical to SEQ ID NO: 101900

SEQ ID NO: 354301 - RNA, 64 nt, hsa; identical to SEQ ID NO: 101901

SEQ ID NO: 354302 - RNA, 64 nt, hsa; identical to SEQ ID NO: 101902

SEQ ID NO: 354303 - RNA, 63 nt, hsa
uuccaucuaccaaauggguguaauaauacuuaccuaccucacaggacuguugugaggcuuggc

SEQ ID NO: 354304 - RNA, 63 nt, hsa
aggaguagcccccuuuuucagagaguuuggggucuaccucagagcucucccugucaaaaagca

SEQ ID NO: 354305 - RNA, 63 nt, hsa
auuuaccuuuuacaagguuagaaaagucucauacuaccucaucuuuauuguggcgcuuuugua

SEQ ID NO: 354306 - RNA, 63 nt, hsa
gcaaccucugccuuccagguuccagcaauucuccuaccucagcucccaaguagcugagaugac

SEQ ID NO: 354307 - RNA, 63 nt, hsa
guaaaaucuuaagccaauggaacccuugauuuccuaccucaguguacacccaacuauugguug

SEQ ID NO: 354308 - RNA, 63 nt, hsa
uuaaauagccagcauguaauacaaguaacuacacuaccucauaucuacaugauuuucaaguug

SEQ ID NO: 354309 - RNA, 63 nt, hsa
gccagcauggauaauaacccagauaacuaaccccuaccucacaggauaaaaaggauuacauga

SEQ ID NO: 354310 - RNA, 63 nt, hsa
uccucaucuguaaaauggggcuaacaauauuaccuaccucauaggauuuaaugaugucaagcu

SEQ ID NO: 354311 - RNA, 62 nt, hsa
uugcaaaaaaaguuugcuaauuuuaaguccuuucguauaagaauuaaugagacaauuuuccu

SEQ ID NO: 354312 - RNA, 64 nt, hsa
gcauaucgucauguuaauaaauuuaaaacaucauucguauaaaauauuuuaauuuucuuguauu

SEQ ID NO: 354313 - RNA, 64 nt, hsa
ugguuaaaauauuacugaucuuaccuuuaugaggucguauaauuuagucccuuaaaaauuaaau

SEQ ID NO: 354314 - RNA, 64 nt, hsa
uacaaaaagccauuguugagaauuagaucccacaucguauaaauaucuauuaaccauucuaaau

SEQ ID NO: 354315 - RNA, 64 nt, hsa
gagagaaauauucauuaucugucauuuaucauagucguauaaguuuccaugauuuuauuuucug

SEQ ID NO: 354316 - RNA, 64 nt, hsa
acacguacuuaaaugaaagcauguggcauguucaucguauaacacaauaugaauacagggcaug

SEQ ID NO: 354317 - RNA, 64 nt, hsa
uauaauggauguuaaccaguaucaauaaaucacuucguauaaucuuaguagguagauuuauuua

SEQ ID NO: 354318 - RNA, 64 nt, hsa
cuuaacucuaaagcuccauguccugggccuaaaaucguauaaaaucuggauuuuuuuuuuuuuu

SEQ ID NO: 354319 - RNA, 64 nt, hsa
aacuaauuuauuugcuuuuuuaaacuugaacuuuucguauaauagauacguucuuuggauuaug

SEQ ID NO: 354320 - RNA, 64 nt, hsa
agauuuccaaaucagucguuuucucaaaaaaauaucguauaagugacucauccugucugcuaac

SEQ ID NO: 354321 - RNA, 64 nt, hsa
aacauuuggguacuuagaggauaaagcuucguggucguauaaauuuagaucauuuggauugauu

SEQ ID NO: 354322 - RNA, 64 nt, hsa
aggccuuuguucagcaaagaaaccuuauacaaacucguauaaagaauguaggaagaccuucacc

SEQ ID NO: 354323 - RNA, 64 nt, hsa
cagacuuuaagauugcccggaggaagcaaacucuucguauaaaaaaagcaggccaucugcuuaa

SEQ ID NO: 354324 - RNA, 64 nt, hsa
aacauauaugggcuguuagauaguaauuguaauuucguauaaauaguaaaugaguacaucuuga

SEQ ID NO: 354325 - RNA, 64 nt, hsa
ccuguauaauuuauuuuaaagauucaaaggauguucguauaaauggcacugcuccauccucccc

SEQ ID NO: 354326 - RNA, 64 nt, hsa
acucaagcaucaacaccaaauuauuccucccuucucguauaaauagagugacuauccacaggag

SEQ ID NO: 354327 - RNA, 64 nt, hsa
uuuuuuuuuuuugacuucuagauccuuugcauuuucguauaaaauuugaagucaacuucuauca

SEQ ID NO: 354328 - RNA, 64 nt, hsa
agauuuugcugagaugaagcuaauugugcacaucucguauaauauucacacauauucuuaauga

SEQ ID NO: 354329 - RNA, 64 nt, hsa
ugcccccggccccgcgccccuacagccgccaaccucguauaacagucauugcuuccuccuaugg

SEQ ID NO: 354330 - RNA, 64 nt, hsa
uccuuuuacaaaaaugaaaauaauaaacauguuuucguauaaaauaacacaaaaugauauacac

SEQ ID NO: 354331 - RNA, 64 nt, hsa
gaacaagugaacacauugugucacaucaugacacucguauaagcauggagaacagugauuuuuu

SEQ ID NO: 354332 - RNA, 64 nt, hsa
ccaaagauaaggacuagauacuacuuucucuuuuucguauaaucuuguagacacuuacuugaug

SEQ ID NO: 354333 - RNA, 64 nt, hsa
cucacuggccaguagcugccaaaaagaacacccaucguauaaggaaauccagccccauagaaaa

SEQ ID NO: 354334 - RNA, 64 nt, hsa
gauauguuuguauuguuuuucuuaaagaggaaccucguauaagcuucaagccucacaaaccuuc

SEQ ID NO: 354335 - RNA, 64 nt, hsa
gggagaagacucuuuuuuuuuggccauuuuguaaucguauaaaaauaguagacaacugcuuaau

SEQ ID NO: 354336 - RNA, 64 nt, hsa
auaauacugaauaaauaaauuuacuuuuacaugaucguauaaguuucuagauaagauaaacaaa

SEQ ID NO: 354337 - RNA, 64 nt, hsa
gcuaaagguugagaacuacugcuuuagaaugaagucguauaauaaagucucugaaaaggccuua

SEQ ID NO: 354338 - RNA, 64 nt, hsa
ugaggagcauaaacauugugaagacuacguuuguucguauaacuaugaaggcaaagguucucug

SEQ ID NO: 354339 - RNA, 64 nt, hsa
uuuuauuuuuuauuuccacuugaagaguuacauuucguauaaaaguuuacaaauaacgguuuuu

SEQ ID NO: 354340 - RNA, 64 nt, hsa
aaaacaaaaaucuugggggaagaaauuggcaauaucguauaaaaaucugcucauauuagaacac

SEQ ID NO: 354341 - RNA, 64 nt, hsa
guuaugccuugcuauuuuaauaaagauucuauuuucguauaacauugucaaguggaaacaugcu

SEQ ID NO: 354342 - RNA, 64 nt, hsa
aaacucuguauaacuuuuaaauggcuggaacuacucguauaaggacuagacuguauuuuugaca

SEQ ID NO: 354343 - RNA, 64 nt, hsa
uuggacuaaaagguuuuauugaaauaaagccucuuaaaaugaaaaaucauauacuuuuaacauc

SEQ ID NO: 354344 - RNA, 64 nt, hsa
accuacugugugcucagcacuaaagguuuguugauaaaaugacaauuaaaaaauggcauuuagc

SEQ ID NO: 354345 - RNA, 64 nt, hsa
gauuaaaacucaguuuuuaaauuaaccaucaacuuaaaaugaaugguaaaagaucaaaaugcau

SEQ ID NO: 354346 - RNA, 64 nt, hsa
uaaaaugaaugguaaaagaucaaaaugcauaugguaaaaugauugcuuucagauaacaagauac

SEQ ID NO: 354347 - RNA, 64 nt, hsa
aagauaccaaucuuauauuguauuuugacugcucuaaaaugauuaaacaguuuucacuuacauu

SEQ ID NO: 354348 - RNA, 64 nt, hsa
auguauauaaagcuuuuugguaauauguuacaauuaaaaugacaagcacuauaucacaaucucu

SEQ ID NO: 354349 - RNA, 64 nt, hsa
aauaguuuuguaucgggaauuucucagagcugaguaaaaugaaggaaaagcauguuauguguuu

SEQ ID NO: 354350 - RNA, 64 nt, hsa
cauuuuuuaggacaucuuaaaucuaaacaaaaaauaaaaugaacaucucuugaaaccuguuaaa

SEQ ID NO: 354351 - RNA, 64 nt, hsa
guuuccugaagcauuuaguuacaaccugaaggaauaaaaugauuuguggaaaugcuuaaaauag

SEQ ID NO: 354352 - RNA, 64 nt, hsa
cguaguucaguaauugccagcaauauaacacggcuaaaaugaaguuuuuacaguauaugacaua

SEQ ID NO: 354353 - RNA, 64 nt, hsa
uuuaauugccagagagaaggaugcaaucacuagguaaaaugagguuuuuaggauuauuuauuga

SEQ ID NO: 354354 - RNA, 64 nt, hsa
uagacaaaacagaguauagaugccaagaugucuguaaaaugauuuuuucugguuuuaaagagau

SEQ ID NO: 354355 - RNA, 64 nt, hsa
guugauaggauguuuaaaacaucaacacauugcuuaaaaugaugaaaccaacccucaaaaaaca

SEQ ID NO: 354356 - RNA, 64 nt, hsa
uacauacuaugccagauuacaaaauacuuauuuuuaaaaugaaaucuauauauugacuuucuua

SEQ ID NO: 354357 - RNA, 64 nt, hsa
uauaaauuaacugaaauuacaguuugcuauaauauaaaaugacaauagucucuugagugguaag

SEQ ID NO: 354358 - RNA, 64 nt, hsa
aguaaacauaaaccccaacuugugccauucuuuauaaaaugauuuuaaaggcaagaagugugug

SEQ ID NO: 354359 - RNA, 64 nt, hsa
agagacuggcagugagagcccagaaggaccuguauaaaaugaaucuggagcuuuacauuuucug

SEQ ID NO: 354360 - RNA, 64 nt, hsa
gugagacucugucucaaaaaauaaauaaauaaaauaaaaugaaauagaucuuauuauucuguua

SEQ ID NO: 354361 - RNA, 64 nt, hsa
ccuccuaagagaaaccuucccagaccacucuuucuaaaaugaaucuucuaggcugggcauggug

SEQ ID NO: 354362 - RNA, 64 nt, hsa
gagagaaaugggauuucaucacaauucauggugcuaaaaugaaaaccucugcacuuuaauuuuu

SEQ ID NO: 354363 - RNA, 64 nt, hsa
uuuuacagacuuuauucacuaugucccauuguucuaaaaugauaacaugacuucuguuuuugaa

SEQ ID NO: 354364 - RNA, 64 nt, hsa
aguaauuaaaaugagaaauacauaagaugauaaauaaaaugaaggugaagguauuccagaucua

SEQ ID NO: 354365 - RNA, 64 nt, hsa
ugaaauacuugaaauagaccuauaaaauaguaauuaaaaugagaaauacauaagaugauaaaua

SEQ ID NO: 354366 - RNA, 64 nt, hsa
cuuaaagacacaaugcacacuuaaaaugacucaauaaaaugacuugcuacguuccguuauucaa

SEQ ID NO: 354367 - RNA, 64 nt, hsa
aagucaaauaaaucuuaaagacacaaugcacacuuaaaaugacucaauaaaaugacuugcuacg

SEQ ID NO: 354368 - RNA, 64 nt, hsa
aaaaaaaagugaagugaaaacaaucagggcacauuaaaaugauacaagucaaauaaaucuuaaa

SEQ ID NO: 354369 - RNA, 64 nt, hsa
aagagcuaguauguuguaaaaccugccaccugaauaaaaugaaaaaaaaaguguuuuuuugaga

SEQ ID NO: 354370 - RNA, 64 nt, hsa
ugggauuacaggcgugagccaccgugcccggcccuaaaaugaaauuauuaauguugguucugaa

SEQ ID NO: 354371 - RNA, 64 nt, hsa
aaggagauuuauuuuccuuaaacauccaauaauuuaaaaugauuuucaauaauaauaaucaaau

SEQ ID NO: 354372 - RNA, 64 nt, hsa
ccaacaugggaugggaaggaaugggcaaagagauuaaaaugacagaaguuagcuguagaugacc

SEQ ID NO: 354373 - RNA, 64 nt, hsa
gaaacaagauaauaaauguacaaaacaugaaaauuaaaaugaacaauauaggaaaauaauugua

SEQ ID NO: 354374 - RNA, 64 nt, hsa
uugcaguggugcuuauacaaaucuacacaagugauaaaaugacacagaacuauauacacacauu

SEQ ID NO: 354375 - RNA, 64 nt, hsa
gugugcaaaagcacacauauguaugucuguguuauaaaaugacugugcuuguucguaacagaug

SEQ ID NO: 354376 - RNA, 64 nt, hsa
uuggcucaaugggaagagaggagagggagaaaaauaaaaugaaaggaaaaaaaaaaguuugcaa

SEQ ID NO: 354377 - RNA, 64 nt, hsa
aaaaaaaccuuuaaauguucgucuauacccuaaguaaaaugaggacgaaagacaaauauuuuga

SEQ ID NO: 354378 - RNA, 64 nt, hsa
agaacauuacaagccuaaugucuccauaauuuuauaaaaugaaaucuuagugucuaaauccuug

SEQ ID NO: 354379 - RNA, 64 nt, hsa
auaguuggaaauguaaucauccaaagaucauuuuuaaaaugaaauuuaauuagcacauauugaa

SEQ ID NO: 354380 - RNA, 64 nt, hsa
guccuccucuaagaccauauuguaagagucuuguuaaaaugauggauucaacuucugccucgga

SEQ ID NO: 354381 - RNA, 64 nt, hsa
agugagauccucucaccauuuugccaagauacucuaaaaugacauccaaguuuaccaguagaaa

SEQ ID NO: 354382 - RNA, 64 nt, hsa
cuuuucaucuguaaauguuuuauuguuacuuuuuuaaaaugaauuuuuuuaaaacaaucuagcc

SEQ ID NO: 354383 - RNA, 64 nt, hsa
gaaauuauuuauugugauguaauauuuuuguacguaaaaugauucuauuaugacugccuuugca

SEQ ID NO: 354384 - RNA, 64 nt, hsa
aauacauucucuauuaguuuuuaaagaguuuuuguaaaaugauuuuguacaaguaggauaugaa

SEQ ID NO: 354385 - RNA, 64 nt, hsa
ugaaggacuuuauauaaaaggaugacucaaaggauaaaaugaacgcuauuugaggacucugguu

SEQ ID NO: 354386 - RNA, 64 nt, hsa
cagagcaugauaucuauaauaggagauacugcaauaaaaugauuaggcuguaaaauuuggagac

SEQ ID NO: 354387 - RNA, 64 nt, hsa
guugaacugcucugcauuaauuacagauuuaauauaaaaugaacugauuauauauuggaauugu

SEQ ID NO: 354388 - RNA, 64 nt, hsa
ucauuaagcauuggguggguaaauucaaccacuguaaaaugaaauuacuacaaaauuugaaauu

SEQ ID NO: 354389 - RNA, 64 nt, hsa
caaugaggucugaaauggagguccuucugcuggauaaaaugagguucaacuguugauugcagga

SEQ ID NO: 354390 - RNA, 64 nt, hsa
uguaugcauuaaaccaaguccauuuugaaugaccuaaaaugaaguaacacaaucagaaauccca

SEQ ID NO: 354391 - RNA, 64 nt, hsa
uguuacgguuguauauagaggucugaaggauuuuuaaaaugauuugcacuuuuucacugcaugc

SEQ ID NO: 354392 - RNA, 64 nt, hsa
ugguagaauucagcaauaugagaaaaccagccccuaaaaugauagccacaagagauuaauugug

SEQ ID NO: 354393 - RNA, 64 nt, hsa
gcauucaagcacuuuuacaaaauuaccaaauucuuaaaaugaagccacagcuagacuugcauuu

SEQ ID NO: 354394 - RNA, 64 nt, hsa
uguaaacugcaaauacuacagauaauucugauaauaaaaugauaugcacgcugaauccugcuau

SEQ ID NO: 354395 - RNA, 64 nt, hsa
uuuguugguacauauuacacaaaacauugugccuuaaaaugagucauacaucuuuuaaauugga

SEQ ID NO: 354396 - RNA, 64 nt, hsa
agcucuauauguaaaugauggguuuguugguauuuaaaaugaauacaacuugaauguaauuaaa

SEQ ID NO: 354397 - RNA, 64 nt, hsa
uuuuuuggaagcgauaaacuuuaaauauacuuauuaaaaugaaauucuauuaaguuuuucagau

SEQ ID NO: 354398 - RNA, 64 nt, hsa
ggcucagauccuaguuuuaaaaaccauuucccauuaaaaugaaguuggaggaacagcugcuucu

SEQ ID NO: 354399 - RNA, 64 nt, hsa
aauauaaagaaagaaagagacaagucaaauguaguaaaaugacaacacuuggugacucuaggug

SEQ ID NO: 354400 - RNA, 64 nt, hsa
cauaguuuuaagcuacaccuuucugcaccugauguaaaaugacauuaaucacuauuuaacuucu

SEQ ID NO: 354401 - RNA, 64 nt, hsa
uuccacaagaagugcauagguccauaauauuucauaaaaugaagaaaaagaauguggccaaaca

SEQ ID NO: 354402 - RNA, 64 nt, hsa
ccuuucuauccuacaacaagaguuuauuuccaaauaaaaugaggacauguuuuuguuuucuuug

SEQ ID NO: 354403 - RNA, 64 nt, hsa
gggaagggcuacugcagcuuuacaugcaauuuauuaaaaugauuguaaaauagcuuguauagug

SEQ ID NO: 354404 - RNA, 64 nt, hsa
uuuuuucauaauguaaugccguauuuauuguuuuuaaaaugaaaggaauacuaauaagucuuaa

SEQ ID NO: 354405 - RNA, 64 nt, hsa
uaauuugaauaaauuuuguaugguaaaggaucaauaaaaugauuuuuuuuaagaguucaggcuu

SEQ ID NO: 354406 - RNA, 64 nt, hsa
ugucucucuaaaacaguaaacauaucuuacaaauuaaaaugacuuuuaggcugggugcaguggc

SEQ ID NO: 354407 - RNA, 64 nt, hsa
agacugugucucaaaauaaauaaauaaaauaaaauaaaaugacguacagagauucuauauucua

SEQ ID NO: 354408 - RNA, 64 nt, hsa
aaauauagccccuagccuaauaacuuaucauuuguaaaaugacuuauaaaaauauuaccucaau

SEQ ID NO: 354409 - RNA, 64 nt, hsa
uuccaagguuuuaguuacucaggaaggaguuaauuaaaaugauuuuauuuuggucugauggaug

SEQ ID NO: 354410 - RNA, 64 nt, hsa
auuguacuacugugcuuaucuuguaaagauuucauaaaaugauaguauugguuauuuuaaaaag

SEQ ID NO: 354411 - RNA, 64 nt, hsa
aguauuuucuaauguuucugggauaugcucccuauaaaaugaaauguuuuccuggaacaaugcu

SEQ ID NO: 354412 - RNA, 64 nt, hsa
ugugcauggcauuuuauauguuaauuuuuuaguuuaaaaugaaguauauugaauguuugccuuu

SEQ ID NO: 354413 - RNA, 64 nt, hsa
ugccuuuagcaccauuuuauuugguuugucccacuaaaaugacucgagaaguguuuagacaaac

SEQ ID NO: 354414 - RNA, 64 nt, hsa
uaaagaguaguucauaaaaaaaucaacauacugauaaaaugacuuuguacuccacaaaauuaug

SEQ ID NO: 354415 - RNA, 64 nt, hsa
uuguacuccacaaaauuaugacugaaagguuuauuaaaaugauuguaauauauagaaaguaucu

SEQ ID NO: 354416 - RNA, 64 nt, hsa
caccauguaaggucacauuuaguaaaugcugaaauaaaaugauuaaugcauuuaucaauaaaag

SEQ ID NO: 354417 - RNA, 64 nt, hsa
aauuuuuuugaugugcuuacauaaccauggugauuaaaaugaguuuauauuuuuucucaaaaau

SEQ ID NO: 354418 - RNA, 64 nt, hsa
cuagcucagucccuaugagguagcuguaacccuuuaaaaugaaaugucaacuuuaagguauguu

SEQ ID NO: 354419 - RNA, 64 nt, hsa
aguuacauuaacuauuucaaaggacuacugcccuuaaaaugaaaaaaccuuucagcuauguuug

SEQ ID NO: 354420 - RNA, 64 nt, hsa
uguaggcugaccucaacccuguaacguaacccauuaaaaugaauuucuuuuuuuuuaagacaga

SEQ ID NO: 354421 - RNA, 64 nt, hsa
cugagauuacagacgugagccacugcguccugccuaaaaugaauuuucuagaugauugaauaac

SEQ ID NO: 354422 - RNA, 64 nt, hsa
cugaaaauaguagaucagaaaucucaguuuaauauaaaaugagcuaaguuuuuaaaaauaaauu

SEQ ID NO: 354423 - RNA, 64 nt, hsa
caccggauggauucugaugaaaacgaaaacaaaguaaaaugacuggcuuagcagauucuuugaa

SEQ ID NO: 354424 - RNA, 64 nt, hsa
augaaguuaccguggcgaaguugacaaauaccacuaaaaugauuaugauuuagaaguaacuuuc

SEQ ID NO: 354425 - RNA, 64 nt, hsa
aagaccuaauugaaagaaaaaucauagaaauaaguaaaaugauuuguuuuauaauuuauccacc

SEQ ID NO: 354426 - RNA, 64 nt, hsa
auaaauauguaaauacaugcuuuaauuugcaauuuaaaaugaagggguuaaauaaguuagacau

SEQ ID NO: 354427 - RNA, 64 nt, hsa
uuaguauuugagaugaguuguugggacaugcaaauaaaaugaagaaugaacuuucgugucuuuu

SEQ ID NO: 354428 - RNA, 64 nt, hsa
cuuggggugggaggggagaaagggaaccuuuucuuaaaaugaaaauaauuacugcuauuuuaaa

SEQ ID NO: 354429 - RNA, 64 nt, hsa
uuuauaauggaucaugcauaauuucucaggagaauaaaaugagaauucauauauacguucaucu

SEQ ID NO: 354430 - RNA, 64 nt, hsa
ccugcaccucuuugggccucaguuuccccaucuguaaaaugaaggaguuggaccaaugcccccu

SEQ ID NO: 354431 - RNA, 64 nt, hsa
gaagauggucacuuuaaccuuguaaauauuuaucuaaaaugauauuuacaaaacuguaauauau

SEQ ID NO: 354432 - RNA, 64 nt, hsa
ggguauguguugccaaagcuggcuuuuugucaaauaaaaugaauacgaacuuaaaaaauaaaag

SEQ ID NO: 354433 - RNA, 64 nt, hsa
uuucuuuuuuuucuugguguuugggccacgauuuuaaaaugacuuuuauuauggguauguguug

SEQ ID NO: 354434 - RNA, 64 nt, hsa
uacaguuacaggaaauuaaaauguuaaaguaaccuaaaaugaauucagaccaauaaaaucaagg

SEQ ID NO: 354435 - RNA, 64 nt, hsa
aucuguuuucucaugcacaggcaauacacaaauuuaaaaugaguugugagccaauuguuucuga

SEQ ID NO: 354436 - RNA, 64 nt, hsa
gucacuuuugcagauauucuucgguuugaauaauuaaaaugaaccagauaucagggugguuaau

SEQ ID NO: 354437 - RNA, 64 nt, hsa
uaauuaaaaugaaccagauaucagggugguuaauuaaaaugaaccagauaucagggugguuuau

SEQ ID NO: 354438 - RNA, 64 nt, hsa
aucuucuaacaugauauauucaggauuuacacauuaaaaugauuauuuaaauuguggcagugau

SEQ ID NO: 354439 - RNA, 64 nt, hsa
uuuacuugacuguucuauuuguuuguccaaaagauaaaaugaugagagagauucgagaggucuu

SEQ ID NO: 354440 - RNA, 64 nt, hsa
auuagguugcuccugaaacugacuguagagcauguaaaaugauuuuacuggauucuguucaacu

SEQ ID NO: 354441 - RNA, 64 nt, hsa
ggcucuaccagaccagaaggguaaggauggacacuaaaaugaaacaaauaccaagguauuccuu

SEQ ID NO: 354442 - RNA, 64 nt, hsa
auuuggaggcauuugcaugguagucuuugaacaguaaaaugauguguugacuauacugauacac

SEQ ID NO: 354443 - RNA, 64 nt, hsa
acaucucauguuuuaucauuuggauggaguaauuuaaaaugaauuaaauuccagagaacaaugg

SEQ ID NO: 354444 - RNA, 64 nt, hsa
gccagccaccgaauaaagauaaaaguucaguucuuaaaaugaguuuuuaugagauaacagucag

SEQ ID NO: 354445 - RNA, 64 nt, hsa
uaguaguaguccugagccucagcguccucaucuauaaaaugacuggcgaaaauacuucacaagc

SEQ ID NO: 354446 - RNA, 64 nt, hsa
cuuuuuuuucugagauuacuuuugggguaauauuuaaaaugagagacauuuuguaacccuguaa

SEQ ID NO: 354447 - RNA, 63 nt, hsa
gaaggcaaauucuuuaaucaaauaaagcgcauuauaaaaugagauguuuauuggauuauugac

SEQ ID NO: 354448 - RNA, 64 nt, hsa
acucaggccuucuaaaaagcagguuaaaaugcucuaaaaugagaaagccugugguuucacuuau

SEQ ID NO: 354449 - RNA, 64 nt, hsa
ucaugugauuuuugagucucaauuuaaggcuuuguaaaaugaagaguagaauuccaagaaaaau

SEQ ID NO: 354450 - RNA, 64 nt, hsa
guaugcaccuaccauuuuccuuuauugugaucacuaaaaugaggccaagguuuaggaggugaga

SEQ ID NO: 354451 - RNA, 64 nt, hsa
cuguguuucagugacugauaaacaaaaaugaagcuaaaaugaaucaacggcucauucauaguua

SEQ ID NO: 354452 - RNA, 64 nt, hsa
uguucaguguauuuuauuacuuuuaaugcugucuuaaaaugaacauucuuuaaaguuggacagg

SEQ ID NO: 354453 - RNA, 64 nt, hsa
aauuuaacaaagggagccugcugaauaacaaaauuaaaaugaugaaacaaaaguuugacaguga

SEQ ID NO: 354454 - RNA, 64 nt, hsa
cuuggcugaaaaaaaaaaaugcuuuuaaaaaagauaaaaugaaaaggagagcucucuuuuucuc

SEQ ID NO: 354455 - RNA, 64 nt, hsa
uuuuucaccucaaaauaagaucgaugguaucuuguaaaaugaggguagugccacuucuuaguau

SEQ ID NO: 354456 - RNA, 64 nt, hsa
caggaaaucagcacaaagccugauaguacuuuacuaaaaugacugcauucuuuggauuccuuca

SEQ ID NO: 354457 - RNA, 64 nt, hsa
uuucuuuuuuggcacaugugaaucuuguuuuguguaaaaugaaauuacuuucucuuguucucug

SEQ ID NO: 354458 - RNA, 64 nt, hsa
uuuuuugaaaacacaucaguagaaaccaagauuuuaaaaugaagugucaagacaaaggcaaaac

SEQ ID NO: 354459 - RNA, 64 nt, hsa
caagugcauuaauauaaacagaacugguggcacuuaaaaugauaaugauuaacuuauauugcau

SEQ ID NO: 354460 - RNA, 64 nt, hsa
uuuuagccauagggucuuuuauagacagggauaguaaaaugaaaauugagaaauauaagaugaa

SEQ ID NO: 354461 - RNA, 64 nt, hsa
ugcuuguccuuuugaauuccuguuuuaauaauuuuaaaaugagcacaaagaacguugaaguuca

SEQ ID NO: 354462 - RNA, 64 nt, hsa
cuaugcaaucuugaauauuuucucuuuugccucguaaaaugaaaaugcauucacaguuucugua

SEQ ID NO: 354463 - RNA, 64 nt, hsa
ccagacuuaauauuaaagaauguaaagguccaaguaaaaugagguaugauuuauguugaugugu

SEQ ID NO: 354464 - RNA, 64 nt, hsa
agauuagguaaaaugagauuacaugaaaagguucuaaaaugauauauuuagaugcaauaauuaa

SEQ ID NO: 354465 - RNA, 64 nt, hsa
uuuuaauucuuaaguggccaaauaacagauuagguaaaaugagauuacaugaaaagguucuaaa

SEQ ID NO: 354466 - RNA, 64 nt, hsa
guucucugucucuguuucuuuguucauuuauuacuaaaaugaacuuguuauuaaaguauaugca

SEQ ID NO: 354467 - RNA, 64 nt, hsa
uauauuuuugauaauuuuucauguaugguaaaguuaaaaugacaaauugauauucugauauaaa

SEQ ID NO: 354468 - RNA, 64 nt, hsa
uauauauaaaaugaacauaguucaugcuuucagauaaaaugaguagauguauauuuagauuaau

SEQ ID NO: 354469 - RNA, 64 nt, hsa
uuuuguuguugcuauguacauauaaauauauauauaaaaugaacauaguucaugcuuucagaua

SEQ ID NO: 354470 - RNA, 64 nt, hsa
agaaaauuaaaaauacuacucacuacaauaaaacuaaaaugaaaacucuuuuuuaaaugugcuu

SEQ ID NO: 354471 - RNA, 64 nt, hsa
aaaugccacucucaugcauucuaaauuaaaaaguuaaaaugauuaauaguucagguggaagaaa

SEQ ID NO: 354472 - RNA, 64 nt, hsa
gacacuuggcuacaugggaagaugauguuaauaauaaaaugauuuuuaaauggacucauagccu

SEQ ID NO: 354473 - RNA, 64 nt, hsa
gccauauuuuguuaguugacaucugaguuuucaguaaaaugauuauggaauuaaucagcaaaug

SEQ ID NO: 354474 - RNA, 64 nt, hsa
gcugaaucuguuuggguuccaguuuccuuggcaauaaaaugagcuaaaugggcuaggugaauuu

SEQ ID NO: 354475 - RNA, 64 nt, hsa
aucuuuccaagaccaucauggaccagguccucuauaaaaugaagaacuaacaaaaauuagucuu

SEQ ID NO: 354476 - RNA, 64 nt, hsa
cuggaaucuaaauagucagugaggaaggcuuugauaaaaugaaauugccagaaagauauaaaac

SEQ ID NO: 354477 - RNA, 64 nt, hsa
augugccuucucugagacucaguuucuuccucuguaaaaugaggacauacuaccuaccucaugu

SEQ ID NO: 354478 - RNA, 64 nt, hsa
uugcuugagccaagugcuuaaaaaguuaauaaaauaaaaugaucuguaugauaccugcaauuga

SEQ ID NO: 354479 - RNA, 64 nt, hsa
acuuuguguuuuggcaaucguuuuauaacuaaaauaaaaugaaagcuaaaucuacacgcuguga

SEQ ID NO: 354480 - RNA, 64 nt, hsa
ugauauuugcauuuucuguaacaauuccuuauaauaaaaugaaguaaaauugugcauuuaaagu

SEQ ID NO: 354481 - RNA, 64 nt, hsa
uagauuuauacauucuguugccuaaauauguguguaaaaugagcugauaaacuggaguacuacu

SEQ ID NO: 354482 - RNA, 64 nt, hsa
aacuuuaucacauaugauagagauauauaugcuguaaaaugagggaaaggaacuuucuaauaaa

SEQ ID NO: 354483 - RNA, 64 nt, hsa
uugcccuaguugaauuaagaaacucuaaagguuauaaaaugaaaacaaaaaauaaaauauuugu

SEQ ID NO: 354484 - RNA, 64 nt, hsa
acauaucauuauuucauggucaagccuguaguauuaaaaugauuuuuuuaaaagauguaaacug

SEQ ID NO: 354485 - RNA, 64 nt, hsa
aguuuuuguauagacuucuuugguagucuguuucuaaaaugaaauguauuucaauaagcagugu

SEQ ID NO: 354486 - RNA, 64 nt, hsa
auagacauauuucuuuugcuuucuuaaaacagcuuaaaaugaugaacuuuuauaauuuuaauuu

SEQ ID NO: 354487 - RNA, 64 nt, hsa
uuaguaaaggagugaauuaauaaaguaguaauaguaaaaugaaaggaacuugacuguacaguuu

SEQ ID NO: 354488 - RNA, 64 nt, hsa
caaaugaaaccagaaggugguuauguaagaggcuuaaaaugaucuuauguuuaaagagauucug

SEQ ID NO: 354489 - RNA, 64 nt, hsa
ucuaccccuuuugaugaccccaggcuugaguuuuuaaaaugacuacccagaagggcacaagggg

SEQ ID NO: 354490 - RNA, 64 nt, hsa
auauuuuagauauauugguucaaauaaaauacauuaaaaugaauaacacuuuuuuguuuuuaaa

SEQ ID NO: 354491 - RNA, 64 nt, hsa
aaagaucaaauuauccaugaaauuauagccaguuuaaaaugaauuauuuuaaaaaaaauuucug

SEQ ID NO: 354492 - RNA, 64 nt, hsa
uaggccuugguacaugaugcuggauuaccucucuuaaaaugacacccuuccucgccuguuggug

SEQ ID NO: 354493 - RNA, 64 nt, hsa
cauuuuuauuauuuugccauuggaagguuaacuuuaaaaugagcccuaucacugagaaauacgu

SEQ ID NO: 354494 - RNA, 64 nt, hsa
uuuaauucuaauaaaccagcuguuauaaaaauuauaaaaugaucucuguuuuuccugucagaga

SEQ ID NO: 354495 - RNA, 64 nt, hsa
uuaugcaaagcagcuuauauuccuuuguuucugauaaaaugaagacuuuaaaucagucaguagu

SEQ ID NO: 354496 - RNA, 64 nt, hsa
agugaauacuuugaugauugccaacaguggcuaauaaaaugacggcuaccacacucauggguca

SEQ ID NO: 354497 - RNA, 63 nt, hsa
auuuguccaacaacugucagaauaaagaacauucuaaaaugagaaguucacugucacucuugu

SEQ ID NO: 354498 - RNA, 64 nt, hsa
auucaaauuuucuuuagugcuuaaaauuaaguuuuaaaaugaaaucagacacugcagguuugua

SEQ ID NO: 354499 - RNA, 64 nt, hsa
uuuaaaaugaaaucagacacugcagguuuguauauaaaaugaaaagcuauacuacuuuuuacaa

SEQ ID NO: 354500 - RNA, 64 nt, hsa
gagcauauucucuaguauauagcuacaccuuuaauaaaaugaaggaaugucuucaaucauauuu

SEQ ID NO: 354501 - RNA, 64 nt, hsa
ugauuuuggagagauccuauucuaacaaauacucuaaaaugauaaaauugagguacaacucucu

SEQ ID NO: 354502 - RNA, 64 nt, hsa
uuagggauuaauguccuccauuuauaaugaagauuaaaaugaaggcuuuaaucagcauuguaaa

SEQ ID NO: 354503 - RNA, 64 nt, hsa
aucucacauagagacaugcuuauaugguuuuauuuaaaaugaaaugccaguccauuacacugaa

SEQ ID NO: 354504 - RNA, 64 nt, hsa
cuauuauuuauauaacaugagauuuaguaacuuauaaaaugagguuuaguaauuuaauuuaaau

SEQ ID NO: 354505 - RNA, 64 nt, hsa
aaguuaaauauuaagugugugacuuaugguuaaauaaaaugaaaauacaagacuuuuuuuuuug

SEQ ID NO: 354506 - RNA, 64 nt, hsa
agcuguaugugaaugaaaauaugcuuguauuuaguaaaaugauugauuaugugacugugagauu

SEQ ID NO: 354507 - RNA, 64 nt, hsa
uaaaagguaccaauuagcuuuuaacagcuuucuguaaaaugaggaacacagaccaaaaggucug

SEQ ID NO: 354508 - RNA, 64 nt, hsa; identical to SEQ ID NO: 81945

SEQ ID NO: 354509 - RNA, 64 nt, hsa; identical to SEQ ID NO: 81946

SEQ ID NO: 354510 - RNA, 64 nt, hsa; identical to SEQ ID NO: 81947

SEQ ID NO: 354511 - RNA, 64 nt, hsa; identical to SEQ ID NO: 81948

SEQ ID NO: 354512 - RNA, 64 nt, hsa; identical to SEQ ID NO: 81949

SEQ ID NO: 354513 - RNA, 64 nt, hsa; identical to SEQ ID NO: 81950

SEQ ID NO: 354514 - RNA, 64 nt, hsa; identical to SEQ ID NO: 81951

SEQ ID NO: 354515 - RNA, 64 nt, hsa; identical to SEQ ID NO: 81952

SEQ ID NO: 354516 - RNA, 64 nt, hsa; identical to SEQ ID NO: 81953

SEQ ID NO: 354517 - RNA, 64 nt, hsa; identical to SEQ ID NO: 81954

SEQ ID NO: 354518 - RNA, 64 nt, hsa; identical to SEQ ID NO: 81955

SEQ ID NO: 354519 - RNA, 64 nt, hsa; identical to SEQ ID NO: 81956

SEQ ID NO: 354520 - RNA, 64 nt, hsa; identical to SEQ ID NO: 81957

SEQ ID NO: 354521 - RNA, 64 nt, hsa; identical to SEQ ID NO: 81958

SEQ ID NO: 354522 - RNA, 64 nt, hsa; identical to SEQ ID NO: 81959

SEQ ID NO: 354523 - RNA, 64 nt, hsa; identical to SEQ ID NO: 81960

SEQ ID NO: 354524 - RNA, 64 nt, hsa; identical to SEQ ID NO: 81961

SEQ ID NO: 354525 - RNA, 64 nt, hsa; identical to SEQ ID NO: 81962

SEQ ID NO: 354526 - RNA, 64 nt, hsa; identical to SEQ ID NO: 311206

SEQ ID NO: 354527 - RNA, 64 nt, hsa; identical to SEQ ID NO: 311207

SEQ ID NO: 354528 - RNA, 64 nt, hsa; identical to SEQ ID NO: 311208

SEQ ID NO: 354529 - RNA, 64 nt, hsa; identical to SEQ ID NO: 311209

SEQ ID NO: 354530 - RNA, 64 nt, hsa; identical to SEQ ID NO: 311210

SEQ ID NO: 354531 - RNA, 64 nt, hsa; identical to SEQ ID NO: 311211

SEQ ID NO: 354532 - RNA, 64 nt, hsa; identical to SEQ ID NO: 311212

SEQ ID NO: 354533 - RNA, 64 nt, hsa; identical to SEQ ID NO: 311213

SEQ ID NO: 354534 - RNA, 64 nt, hsa; identical to SEQ ID NO: 311214

SEQ ID NO: 354535 - RNA, 64 nt, hsa; identical to SEQ ID NO: 311215

SEQ ID NO: 354536 - RNA, 64 nt, hsa; identical to SEQ ID NO: 311216

SEQ ID NO: 354537 - RNA, 64 nt, hsa; identical to SEQ ID NO: 311217

SEQ ID NO: 354538 - RNA, 59 nt, hsa
guauuccauuagguucuuuucauuuaaaguagucuuaaaaucaaaguauccaauauuuu

SEQ ID NO: 354539 - RNA, 59 nt, hsa
ggguuuagauccucuuuaauacuuugagauagucuuauucugauuuuuuuuuucuucug

SEQ ID NO: 354540 - RNA, 59 nt, hsa
cugaauaagauuugaguaaugaaagucuguagucuuaaaacucuaaaacaguuguacug

SEQ ID NO: 354541 - RNA, 59 nt, hsa
aaugcuaacucuugcaugucaagaaacauuagucuuaggaauucuucaaaaaauggcau

SEQ ID NO: 354542 - RNA, 59 nt, hsa
auugcucuacuaugcuaaguccuuguuaauagucuuacccuccuugaaacacuugaaca

SEQ ID NO: 354543 - RNA, 59 nt, hsa
uuaauggaguguuaaaauucugauucauauagucuuaaauuaucaacuccuuaaaugug

SEQ ID NO: 354544 - RNA, 59 nt, hsa
acacaguaucaacauuagaauuuugauauuagucuuauguuaucuuccauucuauuuuu

SEQ ID NO: 354545 - RNA, 59 nt, hsa
auauaggagaaaucaguuugcugaaaaguuagucuuaauuaucuauuggccacgaugaa

SEQ ID NO: 354546 - RNA, 59 nt, hsa
auuaaauuuauuauuuaagaugguagcacuagucuuaaauuguauaaaauauccccuaa

SEQ ID NO: 354547 - RNA, 59 nt, hsa
auuaaauuuauuauuaaagauaguagcacuagucuuaaauuugauauaacaucuccuaa

SEQ ID NO: 354548 - RNA, 59 nt, hsa
uuuuagagauguaaaacauucugcuuucuuagucuuaccuagucugaaacauuuuuauu

SEQ ID NO: 354549 - RNA, 59 nt, hsa
cuauaggccuuuuucuugggaugauuuucuagucuuaagguuuggggacauuauaaacu

SEQ ID NO: 354550 - RNA, 64 nt, hsa; identical to SEQ ID NO: 43717

SEQ ID NO: 354551 - RNA, 64 nt, hsa; identical to SEQ ID NO: 43718

SEQ ID NO: 354552 - RNA, 64 nt, hsa; identical to SEQ ID NO: 43719

SEQ ID NO: 354553 - RNA, 64 nt, hsa; identical to SEQ ID NO: 43720

SEQ ID NO: 354554 - RNA, 64 nt, hsa; identical to SEQ ID NO: 43721

SEQ ID NO: 354555 - RNA, 64 nt, hsa; identical to SEQ ID NO: 43722

SEQ ID NO: 354556 - RNA, 64 nt, hsa; identical to SEQ ID NO: 43723

SEQ ID NO: 354557 - RNA, 64 nt, hsa; identical to SEQ ID NO: 43724

SEQ ID NO: 354558 - RNA, 64 nt, hsa; identical to SEQ ID NO: 43725

SEQ ID NO: 354559 - RNA, 64 nt, hsa; identical to SEQ ID NO: 43726

SEQ ID NO: 354560 - RNA, 64 nt, hsa; identical to SEQ ID NO: 43727

SEQ ID NO: 354561 - RNA, 64 nt, hsa; identical to SEQ ID NO: 43728

SEQ ID NO: 354562 - RNA, 64 nt, hsa; identical to SEQ ID NO: 43729

SEQ ID NO: 354563 - RNA, 64 nt, hsa; identical to SEQ ID NO: 43730

SEQ ID NO: 354564 - RNA, 64 nt, hsa; identical to SEQ ID NO: 43731

SEQ ID NO: 354565 - RNA, 64 nt, hsa; identical to SEQ ID NO: 43732

SEQ ID NO: 354566 - RNA, 64 nt, hsa; identical to SEQ ID NO: 43733

SEQ ID NO: 354567 - RNA, 64 nt, hsa; identical to SEQ ID NO: 43734

SEQ ID NO: 354568 - RNA, 64 nt, hsa; identical to SEQ ID NO: 43735

SEQ ID NO: 354569 - RNA, 64 nt, hsa; identical to SEQ ID NO: 43736

SEQ ID NO: 354570 - RNA, 64 nt, hsa; identical to SEQ ID NO: 43737

SEQ ID NO: 354571 - RNA, 64 nt, hsa; identical to SEQ ID NO: 43738

SEQ ID NO: 354572 - RNA, 64 nt, hsa; identical to SEQ ID NO: 43739

SEQ ID NO: 354573 - RNA, 64 nt, hsa; identical to SEQ ID NO: 43740

SEQ ID NO: 354574 - RNA, 64 nt, hsa; identical to SEQ ID NO: 43741

SEQ ID NO: 354575 - RNA, 64 nt, hsa; identical to SEQ ID NO: 43742

SEQ ID NO: 354576 - RNA, 64 nt, hsa; identical to SEQ ID NO: 43743

SEQ ID NO: 354577 - RNA, 64 nt, hsa; identical to SEQ ID NO: 43744

SEQ ID NO: 354578 - RNA, 64 nt, hsa; identical to SEQ ID NO: 43745

SEQ ID NO: 354579 - RNA, 64 nt, hsa; identical to SEQ ID NO: 43746

SEQ ID NO: 354580 - RNA, 64 nt, hsa; identical to SEQ ID NO: 44393

SEQ ID NO: 354581 - RNA, 64 nt, hsa; identical to SEQ ID NO: 44394

SEQ ID NO: 354582 - RNA, 64 nt, hsa; identical to SEQ ID NO: 44395

SEQ ID NO: 354583 - RNA, 64 nt, hsa; identical to SEQ ID NO: 44396

SEQ ID NO: 354584 - RNA, 64 nt, hsa; identical to SEQ ID NO: 44397

SEQ ID NO: 354585 - RNA, 64 nt, hsa; identical to SEQ ID NO: 44398

SEQ ID NO: 354586 - RNA, 64 nt, hsa
ugaggcaacagcagcaagggcuggucuggacaagaaaagccauagcccggcagccccuaccaug

SEQ ID NO: 354587 - RNA, 64 nt, hsa
uuuaaauugaaauauaauagcugcaucagcccugaaaagccaaauucaaccacauggcuggaga

SEQ ID NO: 354588 - RNA, 64 nt, hsa
aaaugaaugaauaaauaaauaaaugaauaaagacaaaagccaagguguaugcucucaaguucca

SEQ ID NO: 354589 - RNA, 64 nt, hsa
gaaagggacaauuuggcugaagucuuucucugaaaaaagccaaaggguuauagggguacacuua

SEQ ID NO: 354590 - RNA, 64 nt, hsa
aaagaauaaaaaguuugaauagcuauuauuaaagaaaagccaugucuucaacaucugagucacc

SEQ ID NO: 354591 - RNA, 64 nt, hsa
uugccaaagagcaucuaccuuaccuccuaagaagaaaagccacuuucuuccaauccaagcccac

SEQ ID NO: 354592 - RNA, 61 nt, hsa
uccugaaaaacaucaaguagaaaguacagaaaaaagccacaugugggacucaaaugcaaac

SEQ ID NO: 354593 - RNA, 64 nt, hsa
ucuuguuuccaaaaaccaugucucccagggccuuaaaagccaucauguaaauuaccaguaaagu

SEQ ID NO: 354594 - RNA, 64 nt, hsa
aacucuagggauagucaccuuuuaaauccuguugaaaagccauguuuaagauuuaauuugccaa

SEQ ID NO: 354595 - RNA, 64 nt, hsa
aauggaaaacacaaaacuuaagauggcccaaaacaaaagccacaaacaguucaucauuuggugc

SEQ ID NO: 354596 - RNA, 64 nt, hsa
uugacuuuuaccacaaaucuucauuuauaaaagaaaaagccaaagugaaaaaaaguuagauugu

SEQ ID NO: 354597 - RNA, 64 nt, hsa
gaccaaaagacuaaaaucuuucaacgucaaugccaaaagccaaggggaauuuugcagugacagg

SEQ ID NO: 354598 - RNA, 64 nt, hsa
ggcgggagugguauguggcccugaauaaaagaggaaaagccaaacgagggugcagcccccgggu

SEQ ID NO: 354599 - RNA, 64 nt, hsa
gaacuuucuuucacgguuacuguuccugaaaagaaaaagccaccuagcccuaucaagccaaaga

SEQ ID NO: 354600 - RNA, 64 nt, hsa
ggaacuugaaguauaauauacuuaauauaacauaaaaagccaguuggguucuaaauuguaguug

SEQ ID NO: 354601 - RNA, 64 nt, hsa
aaguaugccaguguaaugaaacugcccuuauuuuaaaagccagucaaagauuccacugauugac

SEQ ID NO: 354602 - RNA, 64 nt, hsa
aaagccacaucacaaaaaaagccacaucacaaaaaaaagccagugccuauugaguauaucaaac

SEQ ID NO: 354603 - RNA, 64 nt, hsa
acuucuacaauaguguggaaagccacaucacaaaaaaagccacaucacaaaaaaaagccagugc

SEQ ID NO: 354604 - RNA, 64 nt, hsa
cauauuguaucuuuuuaaaaaccauguuguggaaaaaagccagagugacaagugacaaaaucua

SEQ ID NO: 354605 - RNA, 64 nt, hsa
cacugaaaguguucaugugcuuuuaauguagucuaaaagccaaaguauagugacucagaauccu

SEQ ID NO: 354606 - RNA, 64 nt, hsa
gugcaaaaagacaacuaaaauacccauuuggaccaaaagccaccagauugcuuagugccugaca

SEQ ID NO: 354607 - RNA, 64 nt, hsa
aauaaaggaggagauuuuauuuacagauuuuuuuaaaagccaccuggguugacaccuuccuacu

SEQ ID NO: 354608 - RNA, 64 nt, hsa
caaaaaguguuugagguucuuugguuuuguuaguaaaagccaguucuguggugaugaccuaugg

SEQ ID NO: 354609 - RNA, 64 nt, hsa
acuuuuacuaaacauaagguaauucauacuggagaaaagccauacaaaugagaagaauguggca

SEQ ID NO: 354610 - RNA, 64 nt, hsa
cuucagaaagauuguacaaauacaaggaauguggaaaagccauuauuaucugcucagauuuuac

SEQ ID NO: 354611 - RNA, 64 nt, hsa
cuccguccccacccccugccaaaaaaaaaaaaaaaaaagccagggcaaaggaccuggcguggcc

SEQ ID NO: 354612 - RNA, 64 nt, hsa
ucuuaugggcaccacagggaacauccuggacuuaaaaagccagggcaggccgggcacaguggcu

SEQ ID NO: 354613 - RNA, 64 nt, hsa
uagggaggcacucaagaugaaaacuacuucaacuaaaagccaaccacuugaacaaggugaguga

SEQ ID NO: 354614 - RNA, 64 nt, hsa
acacuauucucauugccaacguuaaaccuuauuuaaaagccaaacgugcccugagcccucuccu

SEQ ID NO: 354615 - RNA, 64 nt, hsa
uguucccuccgucuccccagacaucugacacccuaaaagccauccacagcuauggaaccugagc

SEQ ID NO: 354616 - RNA, 64 nt, hsa
aauucuguucucuauuaaauuaagaaaauguuccaaaagccauaagccugaagauuggcccugu

SEQ ID NO: 354617 - RNA, 64 nt, hsa
acaaaagcuuuucauuaucugaagacaaaaccgaaaaagccaaaauuaccauugcuuccuccag

SEQ ID NO: 354618 - RNA, 64 nt, hsa
guaaucuggccggccugggagaaagacucacgagaaaagccaguggagaaagcgcccuuccagg

SEQ ID NO: 354619 - RNA, 64 nt, hsa
aaaccccuuugcaggugaggggacagcuuucuagaaaagccacaccugcaucuggggacacacu

SEQ ID NO: 354620 - RNA, 64 nt, hsa
aguuaucucauguaccucugagugccuucuucccaaaagccagcaguaccauaccugcugucag

SEQ ID NO: 354621 - RNA, 64 nt, hsa
aaguguguaauauaccauagugauaaauaugaccaaaagccauaaaugacugugagauguauga

SEQ ID NO: 354622 - RNA, 64 nt, hsa
auguuuuacuuaaaauaucuuggcauaagcucaaaaaagccaggaucuuuauggaaaaauuuua

SEQ ID NO: 354623 - RNA, 64 nt, hsa
uuaacauucuaaaggauuuaaauacuggaauuugaaaagccaaacugugaaaccauugggagaa

SEQ ID NO: 354624 - RNA, 64 nt, hsa
auuuuucuagguggauggcuacuuuaaucucuaaaaaagccaagugaaguaaaaguauucagua

SEQ ID NO: 354625 - RNA, 64 nt, hsa
caguucaggaaagcuuaagcaucgaaaaaagaaaaaaagccaugauguacccuccgagaaagaa

SEQ ID NO: 354626 - RNA, 64 nt, hsa; identical to SEQ ID NO: 133252

SEQ ID NO: 354627 - RNA, 64 nt, hsa; identical to SEQ ID NO: 133253

SEQ ID NO: 354628 - RNA, 64 nt, hsa; identical to SEQ ID NO: 133254

SEQ ID NO: 354629 - RNA, 64 nt, hsa; identical to SEQ ID NO: 133255

SEQ ID NO: 354630 - RNA, 64 nt, hsa; identical to SEQ ID NO: 133256

SEQ ID NO: 354631 - RNA, 64 nt, hsa; identical to SEQ ID NO: 133257

SEQ ID NO: 354632 - RNA, 64 nt, hsa; identical to SEQ ID NO: 133258

SEQ ID NO: 354633 - RNA, 64 nt, hsa; identical to SEQ ID NO: 133259

SEQ ID NO: 354634 - RNA, 64 nt, hsa; identical to SEQ ID NO: 133260

SEQ ID NO: 354635 - RNA, 64 nt, hsa; identical to SEQ ID NO: 133261

SEQ ID NO: 354636 - RNA, 64 nt, hsa; identical to SEQ ID NO: 133262

SEQ ID NO: 354637 - RNA, 57 nt, hsa; identical to SEQ ID NO: 133263

SEQ ID NO: 354638 - RNA, 64 nt, hsa; identical to SEQ ID NO: 133264

SEQ ID NO: 354639 - RNA, 64 nt, hsa; identical to SEQ ID NO: 133265

SEQ ID NO: 354640 - RNA, 64 nt, hsa; identical to SEQ ID NO: 133266

SEQ ID NO: 354641 - RNA, 64 nt, hsa; identical to SEQ ID NO: 133267

SEQ ID NO: 354642 - RNA, 64 nt, hsa; identical to SEQ ID NO: 133268

SEQ ID NO: 354643 - RNA, 64 nt, hsa; identical to SEQ ID NO: 133269

SEQ ID NO: 354644 - RNA, 64 nt, hsa; identical to SEQ ID NO: 133270

SEQ ID NO: 354645 - RNA, 64 nt, hsa
ccuuccucucucuaccagucuauuuccacugaacaaaaccuacgcacauaccuucauguggcuc

SEQ ID NO: 354646 - RNA, 64 nt, hsa
ccuuccucucucuaccagucuauuuccacugaacaaaaccuacacacauaccuucaugugguuc

SEQ ID NO: 354647 - RNA, 64 nt, hsa
ucagcuggcugagacacugaagaagucacugaacaaaaccuacacacguaccuucaugugauuc

SEQ ID NO: 354648 - RNA, 64 nt, hsa
uuuuaaaaucaaacucaguuuuuauuucuucacuaaaaccuauuuucauaugauauacauguua

SEQ ID NO: 354649 - RNA, 64 nt, hsa
agggcuguguuauauuaaguucucccuuacuguuaaaaccuaauuaaauaugcuuuagaauuuu

SEQ ID NO: 354650 - RNA, 64 nt, hsa
auacauuuggauaaacaacauugagauuaugaugaaaaccuacauauuccauguuuggaagacc

SEQ ID NO: 354651 - RNA, 64 nt, hsa
uccagcguacuauaaugaaaacauccuuguuuugaaaaccuaaaagacaggcucuguauauaua

SEQ ID NO: 354652 - RNA, 64 nt, hsa
uucucugaaauggguaaaggacaaauuguguaaaaaaaccuaugcacuauagaagggaauagua

SEQ ID NO: 354653 - RNA, 64 nt, hsa
uagcuuauauaaggucauuacauuuuuuaacugaaaaaccuaguuaccugauuauugcacauua

SEQ ID NO: 354654 - RNA, 64 nt, hsa
gauuguauauaguaagaaaagaucaaaagacuuuaaaaccuaaaugacuuuugacauacaaacu

SEQ ID NO: 354655 - RNA, 64 nt, hsa
uaguaauuaugaauuuaagaccauauuauuaucaaaaaccuagagaccaaucauauaucugaaa

SEQ ID NO: 354656 - RNA, 64 nt, hsa
caucucaagucuagugaagacagccaacagaaacaaaaccuagcauagggauagaaaauaccau

SEQ ID NO: 354657 - RNA, 64 nt, hsa
gaaauaaaaaugcaugauuaaaaacuaagaauaaaaaaccuauuuuuauguuuccuaaaggaaa

SEQ ID NO: 354658 - RNA, 64 nt, hsa
ccagagcaucuugaccuaaucagcuuacaguuugaaaaccuagcucuccagaacaugagaugag

SEQ ID NO: 354659 - RNA, 64 nt, hsa
ugguuuuuaccccacccucaacccucuccagcauaaaaccuagugagcuaaaggcuuugucugc

SEQ ID NO: 354660 - RNA, 64 nt, hsa
ucauguuaaaaaaaaaaauguauuucauaucuauaaaaccuauauagccauuuagcugaagccc

SEQ ID NO: 354661 - RNA, 64 nt, hsa
ggcacaugccuguauuacugaaagcuaaauccucaaaaccuaguaaggggacuaaugauucauu

SEQ ID NO: 354662 - RNA, 64 nt, hsa
gauuacuauaaacaccuguaugcacacaaacuagaaaaccuagaaaaaauuaauaaauuccuug

SEQ ID NO: 354663 - RNA, 64 nt, hsa
aaaucaacucaagauggauuaaagacuuaaauauaaaaccuaaaaguauuaaauuccuagaaga

SEQ ID NO: 354664 - RNA, 64 nt, hsa
aaaccaaaauuauaggauuuuuucuuuuuuaguaaaaaccuauaugaaaaccaaaauuauagga

SEQ ID NO: 354665 - RNA, 64 nt, hsa
aaccaaaauuauaggauuuuuuucuuuuuuaguaaaaaccuauauaaaaaccaaaauuauagga

SEQ ID NO: 354666 - RNA, 64 nt, hsa
aauauuucggggguaauagagccacuggugaguaaaaaccuauauaaaaaccaaaauuauagga

SEQ ID NO: 354667 - RNA, 61 nt, hsa
ggcacggggaagguuuuggaguagaaccagggguguguaugaaggggggugacaagguccc

SEQ ID NO: 354668 - RNA, 61 nt, hsa
guaccccccaaccuccaggagcuaguggagggguguguaacagggucauacccccucccuc

SEQ ID NO: 354669 - RNA, 61 nt, hsa
cugcuuuucucagccccaagccucuagucuggguguguacggagggucuagccugggugug

SEQ ID NO: 354670 - RNA, 61 nt, hsa
uagucuggguguguacggagggucuagccuggguguguacggagggucuagccugggugag

SEQ ID NO: 354671 - RNA, 61 nt, hsa
uagccugggugaguacggagggucuagccuggguguguauggaggaucuagccugggugag

SEQ ID NO: 354672 - RNA, 61 nt, hsa
uagccugggugaguauggagggucuagccuggguguguauggagggucuagccugggugag

SEQ ID NO: 354673 - RNA, 61 nt, hsa; identical to SEQ ID NO: 354672

SEQ ID NO: 354674 - RNA, 61 nt, hsa
uagccugggugaguauggagggucuagccuggguguguacggagggucuagucugagugcg

SEQ ID NO: 354675 - RNA, 64 nt, hsa; identical to SEQ ID NO: 71724

SEQ ID NO: 354676 - RNA, 64 nt, hsa; identical to SEQ ID NO: 71725

SEQ ID NO: 354677 - RNA, 64 nt, hsa; identical to SEQ ID NO: 71726

SEQ ID NO: 354678 - RNA, 64 nt, hsa; identical to SEQ ID NO: 71727

SEQ ID NO: 354679 - RNA, 64 nt, hsa; identical to SEQ ID NO: 71728

SEQ ID NO: 354680 - RNA, 64 nt, hsa; identical to SEQ ID NO: 71729

SEQ ID NO: 354681 - RNA, 64 nt, hsa; identical to SEQ ID NO: 71730

SEQ ID NO: 354682 - RNA, 64 nt, hsa; identical to SEQ ID NO: 71731

SEQ ID NO: 354683 - RNA, 64 nt, hsa; identical to SEQ ID NO: 71732

SEQ ID NO: 354684 - RNA, 64 nt, hsa; identical to SEQ ID NO: 71733

SEQ ID NO: 354685 - RNA, 64 nt, hsa; identical to SEQ ID NO: 71734

SEQ ID NO: 354686 - RNA, 64 nt, hsa; identical to SEQ ID NO: 71735

SEQ ID NO: 354687 - RNA, 64 nt, hsa; identical to SEQ ID NO: 71736

SEQ ID NO: 354688 - RNA, 64 nt, hsa; identical to SEQ ID NO: 71737

SEQ ID NO: 354689 - RNA, 64 nt, hsa; identical to SEQ ID NO: 71738

SEQ ID NO: 354690 - RNA, 64 nt, hsa; identical to SEQ ID NO: 71739

SEQ ID NO: 354691 - RNA, 64 nt, hsa; identical to SEQ ID NO: 71739

SEQ ID NO: 354692 - RNA, 64 nt, hsa; identical to SEQ ID NO: 71738

SEQ ID NO: 354693 - RNA, 64 nt, hsa; identical to SEQ ID NO: 71742

SEQ ID NO: 354694 - RNA, 64 nt, hsa; identical to SEQ ID NO: 71743

SEQ ID NO: 354695 - RNA, 64 nt, hsa; identical to SEQ ID NO: 71744

SEQ ID NO: 354696 - RNA, 64 nt, hsa; identical to SEQ ID NO: 71745

SEQ ID NO: 354697 - RNA, 64 nt, hsa; identical to SEQ ID NO: 71746

SEQ ID NO: 354698 - RNA, 64 nt, hsa; identical to SEQ ID NO: 71747

SEQ ID NO: 354699 - RNA, 64 nt, hsa; identical to SEQ ID NO: 71748

SEQ ID NO: 354700 - RNA, 64 nt, hsa; identical to SEQ ID NO: 71749

SEQ ID NO: 354701 - RNA, 64 nt, hsa; identical to SEQ ID NO: 71750

SEQ ID NO: 354702 - RNA, 64 nt, hsa; identical to SEQ ID NO: 71751

SEQ ID NO: 354703 - RNA, 64 nt, hsa; identical to SEQ ID NO: 71752

SEQ ID NO: 354704 - RNA, 64 nt, hsa; identical to SEQ ID NO: 71753

SEQ ID NO: 354705 - RNA, 64 nt, hsa; identical to SEQ ID NO: 282668

SEQ ID NO: 354706 - RNA, 64 nt, hsa; identical to SEQ ID NO: 282669

SEQ ID NO: 354707 - RNA, 64 nt, hsa; identical to SEQ ID NO: 282670

SEQ ID NO: 354708 - RNA, 64 nt, hsa; identical to SEQ ID NO: 282671

SEQ ID NO: 354709 - RNA, 64 nt, hsa; identical to SEQ ID NO: 282672

SEQ ID NO: 354710 - RNA, 64 nt, hsa; identical to SEQ ID NO: 282673

SEQ ID NO: 354711 - RNA, 64 nt, hsa; identical to SEQ ID NO: 282674

SEQ ID NO: 354712 - RNA, 64 nt, hsa; identical to SEQ ID NO: 282675

SEQ ID NO: 354713 - RNA, 64 nt, hsa; identical to SEQ ID NO: 282676

SEQ ID NO: 354714 - RNA, 64 nt, hsa; identical to SEQ ID NO: 282677

SEQ ID NO: 354715 - RNA, 64 nt, hsa; identical to SEQ ID NO: 282678

SEQ ID NO: 354716 - RNA, 64 nt, hsa; identical to SEQ ID NO: 282679

SEQ ID NO: 354717 - RNA, 64 nt, hsa
cucugagaggaaguacugaaagaugaauugacauacaacguauguuuccagugaagucaauuga

SEQ ID NO: 354718 - RNA, 64 nt, hsa
cucuaauucaguguuuuggaggccugacuuggggacaacguauuauugauauuauugucuguuu

SEQ ID NO: 354719 - RNA, 64 nt, hsa
cccccuggcugaagagucugcuuuaaaugggaaaacaacguaggagcagggguuuuuaggcacu

SEQ ID NO: 354720 - RNA, 64 nt, hsa
caaucauacuuaacaaaacuacugaugguuuaugacaacguaggguaacuacaguucauucugu

SEQ ID NO: 354721 - RNA, 64 nt, hsa
auauuauaggaauuucuuuucuaucuuuaugaaaacaacguauauaaaauauaucuagaaaacc

SEQ ID NO: 354722 - RNA, 64 nt, hsa
ugguuuuuaaugucugagcuagugauuugccucaacaacguaaacuuccuaaugauuagcacuu

SEQ ID NO: 354723 - RNA, 64 nt, hsa
auaugacacaccuuugaauuuguuaaaauuaaaaacaacguauuccuuuguagugugaauauga

SEQ ID NO: 354724 - RNA, 64 nt, hsa
gggcaaaugaaaaccuuuccuacaguuccuaugaacaacguaccaacacuuucugauuucuucu

SEQ ID NO: 354725 - RNA, 64 nt, hsa
auaaguauagacuaauuaaccuaagcuaccuuuaacaacguagaauuuagauggguucauauau

SEQ ID NO: 354726 - RNA, 64 nt, hsa
ucacuggaauuuacucacgcaaucucaguagaguacaacguagauacagaaccuaggagaguca

SEQ ID NO: 354727 - RNA, 64 nt, hsa
auauuaaauuacuggaucuaguaacaugaaacacacaacguaaguuauuuagaaucacuuuaau

SEQ ID NO: 354728 - RNA, 64 nt, hsa
ccuaauaccgaugaguuaaaucuugcaaguuaacacaacguaacacuuaaaagcauacauuuuc

SEQ ID NO: 354729 - RNA, 64 nt, hsa
auuguuuauacggaugacugggaggcacugcaccacaacguaggacccuggcuccccuuuccuu

SEQ ID NO: 354730 - RNA, 64 nt, hsa
ccuaauucugaaaguccucauauuuaaaggcuagacaacguaaugaaauuuuuaacuauuugua

SEQ ID NO: 354731 - RNA, 64 nt, hsa
cugugauuucagguuuuuuccuuuuuuuacauuuacaacguaucaauaaacaguagugauuuaa

SEQ ID NO: 354732 - RNA, 64 nt, hsa
agaaugggacauggccccaugcuuauuuuuguuuacaacguaacauggcaugagagagggcaga

SEQ ID NO: 354733 - RNA, 64 nt, hsa
uacgugcagcacuacggccugggcagugccugugacaacguagagcgcgugcugaagagugugg

SEQ ID NO: 354734 - RNA, 64 nt, hsa
gugcacguuggccucagauggacuacaggagauuacaacguacaaggcagauggagcauugacg

SEQ ID NO: 354735 - RNA, 64 nt, hsa
uccuuccgccgccucgauacacgggacguugagcacaacguaucuccuggcuacaauuucaggu

SEQ ID NO: 354736 - RNA, 64 nt, hsa
ucauaaauuuauaacuuuagaaaugauucuaauaacaacguauguaauuguaacauugcaguaa

SEQ ID NO: 354737 - RNA, 64 nt, hsa
acucauuugcacuggacugucaucucauucuuguacaacguagaauuacuuguuuacauccaac

SEQ ID NO: 354738 - RNA, 64 nt, hsa
agaacugggcuugcucagacgcacucgcauugacacaacguaacaccagcauugugugugcaga

SEQ ID NO: 354739 - RNA, 64 nt, hsa
cgaugucacuacuuguuuuucugauguuccaaaaacaacguaacuugguuuucauguguuuuuc

SEQ ID NO: 354740 - RNA, 64 nt, hsa
uuaaggcaucuuuccucuugccccaaaggcagcaacaacguacucauauguacacagagccaug

SEQ ID NO: 354741 - RNA, 64 nt, hsa
uuaacuuuuuguaggauacuugcuccauucauacacaacguaaucaaauaugugguccaucucu

SEQ ID NO: 354742 - RNA, 64 nt, hsa
ugaaacugugugguguucgcuaaaaguaggaauaacaacguaaaagcuaauuaaggucacaaac

SEQ ID NO: 354743 - RNA, 64 nt, hsa
uguagacugauguuuuagcauuuuuccaacacacacaacguaaaaauaaaagcagucgaccgca

SEQ ID NO: 354744 - RNA, 64 nt, hsa
ccuguuucuaaaaacaaaacaaacaaacaaacaaacaacguaucuuacugacuaaacuggaaug

SEQ ID NO: 354745 - RNA, 64 nt, hsa
aagcuccuguuuuuggaaaguagaauuuauggguacaacguauguucauuauuuguacauaaaa

SEQ ID NO: 354746 - RNA, 64 nt, hsa
ucacuguccagagaauugcuuuuguaaaugcuccacaacguaugggcaaaaguuuaaggacuac

SEQ ID NO: 354747 - RNA, 64 nt, hsa
ggcccuuuccguggauuucauuuggggcaaagaaacaacguaguuuuguuuuuguuuucagccu

SEQ ID NO: 354748 - RNA, 64 nt, hsa
cugaguuguugggcugaacaacuaggagcugaaaacaacguagaggcuggaaaguguccccugc

SEQ ID NO: 354749 - RNA, 64 nt, hsa
uguuauacucaguguugauuucuucggucacuacacaacguaaaaucauuuguuucuuuugacu

SEQ ID NO: 354750 - RNA, 64 nt, hsa
uuccuuuaaauguugauaucugccauuuguggaaacaacguaaauucuacuuaaguguaaacaa

SEQ ID NO: 354751 - RNA, 64 nt, hsa
acaagacuuuauauuuuaagcuaaguggaauaauacaacguaacuaaaacauggcggguaccga

SEQ ID NO: 354752 - RNA, 64 nt, hsa
gcacugaugcgauuuuuuguucuuuuauguuuauacaacguaucuauguuguguaggggaaauu

SEQ ID NO: 354753 - RNA, 64 nt, hsa
gccuggccagaccaggugaccuuagauuuggugaacaacguacuauggaagccacaucacuauu

SEQ ID NO: 354754 - RNA, 64 nt, hsa
auccugugauacuaagaucucagucauaugaauuacaacguaguauuuacuggcaagaaggaga

SEQ ID NO: 354755 - RNA, 64 nt, hsa
uucaguguacaagucacugaacccauuguuucuuucugaagagacuuuccuuucaaggcuuccc

SEQ ID NO: 354756 - RNA, 64 nt, hsa
caccucuggccugcgucgcccaguucuuuguggcucugaagaauuggccgcuguggaaaagagc

SEQ ID NO: 354757 - RNA, 64 nt, hsa
cugcauagauuuucuuuuaaauugguucuuuguuucugaagaaagaauuuuuuuuaacuucaug

SEQ ID NO: 354758 - RNA, 64 nt, hsa
uuuaacuucaugguuuuauuuauaauaauuuguuucugaagaaauuugccgagaguuacagguc

SEQ ID NO: 354759 - RNA, 64 nt, hsa
aaauacguacuauaaagcuuuuguucacacacacucugaagaauccuguaagccccugaauuaa

SEQ ID NO: 354760 - RNA, 64 nt, hsa
auggcuuuucuggucuucggcugcucaggguucaucugaagauucgaaugaaaagaaaugcaug

SEQ ID NO: 354761 - RNA, 64 nt, hsa
ccuuuauauucucucaauaucagaacuccugaauucugaagauugcccuccucccauuaauagg

SEQ ID NO: 354762 - RNA, 64 nt, hsa
agcaucugugaugccaucccaggaugugagugggucugaagauacauucccaaauaaacgaccu

SEQ ID NO: 354763 - RNA, 64 nt, hsa
uaauuuaggcuucagcaucucaccagccccucccucugaagaaguauuauguucagaagccaac

SEQ ID NO: 354764 - RNA, 64 nt, hsa
augguuauagcgggugggguuguauuuggaagccucugaagagaccaugucuuuuuaaaaucua

SEQ ID NO: 354765 - RNA, 64 nt, hsa
uucaguggcccagagguuauuuuuuuccuauugcucugaagacugcacugguugcugcaaagcu

SEQ ID NO: 354766 - RNA, 64 nt, hsa
auuaauuuauuauuauaaugaccuaauuuauuaaucugaagauuaaccauuuuuuugucuuaga

SEQ ID NO: 354767 - RNA, 64 nt, hsa
gguauguguuacauauggccaaguggaaaauauaucugaagaggggcuuucauacaaauagacu

SEQ ID NO: 354768 - RNA, 64 nt, hsa
ggguagaaauguauggugauuuuuauuuucucugucugaagaaccagccauuuuuaaaaagguu

SEQ ID NO: 354769 - RNA, 64 nt, hsa
aguguaagcauuaaggacauuaugcuucuucgauucugaagacaggucccugcucauggaugac

SEQ ID NO: 354770 - RNA, 64 nt, hsa
accaaccagcccgcucaaugcagaaaaacuagaaucugaagaagaugugucccaagcuuuccuu

SEQ ID NO: 354771 - RNA, 64 nt, hsa
ggggaaauaugaacuguauuuuaaauuuguuaggucugaagaaucuaaaacuguuaauuuaacc

SEQ ID NO: 354772 - RNA, 64 nt, hsa
uaauacaaagcuguuaccuucuacagaauuuaagucugaagauguaaagagagaacaggccuug

SEQ ID NO: 354773 - RNA, 64 nt, hsa
aggcucugggaucccaaauggacccuuuuaacuuucugaagaugggaccguccccuggaggaaa

SEQ ID NO: 354774 - RNA, 64 nt, hsa
aacaaggaacacuaaaacaguguugauucuugucucugaagacaaauaauuaaaccuuuuuuuu

SEQ ID NO: 354775 - RNA, 64 nt, hsa
gggggucaggacagggccugauuugagccuccucucugaagaugauuuggccgagcggaaggug

SEQ ID NO: 354776 - RNA, 64 nt, hsa
ggacaggaggugcugaggcuggcugcaccugcucucugaagacgccuuccucucuagguucauu

SEQ ID NO: 354777 - RNA, 64 nt, hsa
uguucuuuuauaugcagcaaacacaccguccauuucugaagaggcuucggccugaaggcauuuu

SEQ ID NO: 354778 - RNA, 64 nt, hsa
uggcucgagcagccuugggaagaggcaaggagcuucugaagaaacugccucugcacacacauca

SEQ ID NO: 354779 - RNA, 64 nt, hsa
aacauuuucuuucauuccaguggccuuagucaucucugaagaaauacuuacuugauuuuuuuuu

SEQ ID NO: 354780 - RNA, 64 nt, hsa
uuccucgcccuccuccacccgagaugccagagucucugaagaagaagcuuggguuaacucagua

SEQ ID NO: 354781 - RNA, 64 nt, hsa
aaucaaaccuaaccuuuuuguuuggggcaccaaaucugaagacaaaauuaauuugcaccaguaa

SEQ ID NO: 354782 - RNA, 64 nt, hsa
gaaaaaagaacguauuuuuugugcuuugaagaucucugaagaauuucuuuuauaauagaauggg

SEQ ID NO: 354783 - RNA, 64 nt, hsa
aagaaugagucagguggcacugaaagccauggguucugaagaggcgaauuuguugaaaaguccc

SEQ ID NO: 354784 - RNA, 64 nt, hsa
augcaucucuccaaaagccaccaaggucggcgcgucugaagagcguuuugcggucaucagacuu

SEQ ID NO: 354785 - RNA, 64 nt, hsa
ggaauguguuugugaaugccucaugacauaagcaucugaagaagagggucgugggcugggcgcg

SEQ ID NO: 354786 - RNA, 64 nt, hsa
uuccauugguggcagcaguguuggcaaggaggacucugaagaugcacucucuguucaguuugac

SEQ ID NO: 354787 - RNA, 64 nt, hsa
aacaguccuuauucagaaacuuuucggucagucuucugaagaaucucaaaaagcccacccaacu

SEQ ID NO: 354788 - RNA, 64 nt, hsa
gacugcugcuccuggaaacccauuuagagccaagucugaagaaucagaggcaacuucaugguuc

SEQ ID NO: 354789 - RNA, 64 nt, hsa
gggcgugguggcgggcgccuguagucccagcuacucugaagacugaggcaggagaauggcguga

SEQ ID NO: 354790 - RNA, 64 nt, hsa
uuccaggggacgauggaauacccagaacgcuccuucugaagaaauggggcccuguagcugcagc

SEQ ID NO: 354791 - RNA, 64 nt, hsa
ucucaguaugggguuucccucuggaaaaagaaaaucugaagacauuacaguugccuauugccuc

SEQ ID NO: 354792 - RNA, 64 nt, hsa
uuccaguugcacaaauggguaacuaucaggaauaucugaagacauuggcuucuccacugcgaga

SEQ ID NO: 354793 - RNA, 64 nt, hsa
uuucaaauaauuuuuuaaauguaucucuugccuaaaggacuauauacaucuaauaaaguaacac

SEQ ID NO: 354794 - RNA, 64 nt, hsa
gguuugauuuuuggauaccacucugcuguucuaaaaggacuauuauauuauauaauucacuuug

SEQ ID NO: 354795 - RNA, 64 nt, hsa
uucugugucugcuguguauuuggugacacuucauaaggacuagucccuucugggguaucagagc

SEQ ID NO: 354796 - RNA, 64 nt, hsa
gucaacuguggcaccuguaaccucccggaacaugaaggacuaugcucugaggcuauacucugug

SEQ ID NO: 354797 - RNA, 64 nt, hsa
ggggugggguggggagaaaucacauaaccuuaaaaaggacuauauuaaucaccuucuuuguaau

SEQ ID NO: 354798 - RNA, 64 nt, hsa
cuguagugaauccucuguuuagaacaccaaagauaaggacuagauacuacuuucucuuuuucgu

SEQ ID NO: 354799 - RNA, 64 nt, hsa
uaccuaaggacuaauuuaaacacauaucaaugugaaggacuaauuuaaauuacuaucauuuaug

SEQ ID NO: 354800 - RNA, 64 nt, hsa
gagcaacagaacaaaaggcagaaaaggcauaccuaaggacuaauuuaaacacauaucaauguga

SEQ ID NO: 354801 - RNA, 64 nt, hsa
ucauugucuuucucuccuagcccccucaggaaagaaggacuauauuuguacuguacccuagggg

SEQ ID NO: 354802 - RNA, 64 nt, hsa
ccaugcacuccacaaaggggagcauuuggaaaugaaggacuagcuccuauguaucagguuaaga

SEQ ID NO: 354803 - RNA, 58 nt, hsa
aagccuccguggaacauucuggaucugacccucccagucucaucuccugacccuccca

SEQ ID NO: 354804 - RNA, 58 nt, hsa
aucugacccucccagucucaucuccugacccucccacucccaucuccuuaccucugga

SEQ ID NO: 354805 - RNA, 58 nt, hsa
uucaguauggguugagggucacagaccucccucccaucugggugccugaguuuugacu

SEQ ID NO: 354806 - RNA, 58 nt, hsa
gaaaaaaguauaguaucgaguacccguucccucccagaggugggaguaacugcuggua

SEQ ID NO: 354807 - RNA, 58 nt, hsa
gacagggcuucuccugcgggggcgaggccccucccaguaagggcguggcucugggugg

SEQ ID NO: 354808 - RNA, 58 nt, hsa
gggacuucgcagaggcaagcgaccgaggcccucccaaagaggcccgcccugcccgggc

SEQ ID NO: 354809 - RNA, 58 nt, hsa
ggcagcgaguccugccccgcccgcagcucccucccacaccccgccuggccaagaugac

SEQ ID NO: 354810 - RNA, 58 nt, hsa
uuaguuuuuaaucaucaggacuaucucacccucccacuccuguuuuuaaaacucagaa

SEQ ID NO: 354811 - RNA, 58 nt, hsa
ggcuugcucugucccuuccucucugcuucccucccaggccucgccagggcucccuucu

SEQ ID NO: 354812 - RNA, 58 nt, hsa
gggacuggacccagugcccucugcagaccccucccagccgcagcaccaagggcuugcu

SEQ ID NO: 354813 - RNA, 58 nt, hsa
cuuaccacugaucuggccaagaaugaggcccucccaacacuuucacucccucuccaag

SEQ ID NO: 354814 - RNA, 58 nt, hsa
uggaugcucaagauuacgugcaaggaaucccucccaucugguacuaaaauuucagugu

SEQ ID NO: 354815 - RNA, 58 nt, hsa
cccagcucuaccccucccagggaccuaccccucccagggaccgaccccuggcccaagc

SEQ ID NO: 354816 - RNA, 58 nt, hsa
cacuggccaugcugcugcccagcucuaccccucccagggaccuaccccucccagggac

SEQ ID NO: 354817 - RNA, 58 nt, hsa
cucagugcagcaagacugaccccugacccccucccagcccucccuaccuuggacagga

SEQ ID NO: 354818 - RNA, 58 nt, hsa
ggacaggugccgagcccugcauguggagcccucccaccccacccccagauagagggaa

SEQ ID NO: 354819 - RNA, 58 nt, hsa
gggcgugucccuccucuuccuguagugccccucccauggcccagcagcuuggcugagc

SEQ ID NO: 354820 - RNA, 58 nt, hsa
cuucucccuccccucacccgcugcccagcccucccagcuggugucacucugccucuaa

SEQ ID NO: 354821 - RNA, 58 nt, hsa
uguggaauuucuuucuucuccccuucuucccucccaaaagcuuagcuauguauaaagu

SEQ ID NO: 354822 - RNA, 58 nt, hsa
guuuuggaggagggaguggaguaagaugcccucccacuuuuaucaguuuaguaguagu

SEQ ID NO: 354823 - RNA, 58 nt, hsa
ugaucugacuggaaaacaauccuguauccccucccaaagaaucaugggcuuuuuuuuu

SEQ ID NO: 354824 - RNA, 58 nt, hsa
uccaacuccaagcucccuccacaaguuucccucccaggccccccacaccccagugugg

SEQ ID NO: 354825 - RNA, 58 nt, hsa
uugcuucucuucugguguugcuucuccucccucccauucucucugcaacucccugcgg

SEQ ID NO: 354826 - RNA, 58 nt, hsa
ggugggccugggcucagcaaacagcccucccucccaguauuucaucaaggacagggaa

SEQ ID NO: 354827 - RNA, 58 nt, hsa
ccaguauuucaucaaggacagggaauaucccucccacacacaggccagcugcucaccc

SEQ ID NO: 354828 - RNA, 58 nt, hsa
caccugucuacccagagccagugacugucccucccagcagccuccaaaggguccaaag

SEQ ID NO: 354829 - RNA, 58 nt, hsa
cucugggcugaggcuggucguccuggagcccucccaguaccucgggcugcaagagcug

SEQ ID NO: 354830 - RNA, 58 nt, hsa
gucccucugugggagcccgggugccaggcccucccaacaccacaccacccuccaggcc

SEQ ID NO: 354831 - RNA, 58 nt, hsa
gccuucccagagucaaccuccugugacgcccucccagagccaaccucgggugacaccc

SEQ ID NO: 354832 - RNA, 58 nt, hsa
gcccucccagagccaaccucgggugacacccucccagagucaaccucaugugacaccu

SEQ ID NO: 354833 - RNA, 58 nt, hsa
auacgccgccuucacuccacagccucaccccucccacccccauacugguacugcugua

SEQ ID NO: 354834 - RNA, 58 nt, hsa
ggaguugacgacagggaguaccacucuccccucccacaaacuucaacuccuccaugga

SEQ ID NO: 354835 - RNA, 58 nt, hsa
ccgucacuccuccccacugccgccccuccccucccacucucgucuccuuccccucgcc

SEQ ID NO: 354836 - RNA, 58 nt, hsa
ugcaggcccucagcccgggcugugccagcccucccagccccaggcccaucugagggac

SEQ ID NO: 354837 - RNA, 58 nt, hsa
uuuuccuuugucgccuccccagcaccugcccucccagucucccaccccggccccaggc

SEQ ID NO: 354838 - RNA, 58 nt, hsa
aguagcacugauguguuuuguaaucugccccucccagcccuccguggaggcugccagg

SEQ ID NO: 354839 - RNA, 58 nt, hsa
agggggguuucagggcugaaccccaccucccucccaccuuccucccaccucaccuguc

SEQ ID NO: 354840 - RNA, 58 nt, hsa
cgggaggaguggcaucuggggcucuuggcccucccaccuggagccuguuacccguuag

SEQ ID NO: 354841 - RNA, 58 nt, hsa
aagcgaagccacucuuaccucucccuuccccucccaccugcccccugcguaggcaccc

SEQ ID NO: 354842 - RNA, 58 nt, hsa
ccuuggucugucucgcuuuaucugucgccccucccagcgcugagagccuccccuggcu

SEQ ID NO: 354843 - RNA, 58 nt, hsa
aauggacagcugcuuuugacaauaaugccccucccaacuucccauucauagaaucaua

SEQ ID NO: 354844 - RNA, 58 nt, hsa
ucgcuuacaccuaauauaagcuuguccucccucccacacucaucccugcuucuuuggg

SEQ ID NO: 354845 - RNA, 58 nt, hsa
ccgguugccccccacucuaaagccuccucccucccagcguccacuggcuccaggcucc

SEQ ID NO: 354846 - RNA, 58 nt, hsa
ucagucccuguggucccccaccagcucccccucccauagggcugcccaccaagcccug

SEQ ID NO: 354847 - RNA, 58 nt, hsa
aauuguucuccagcauuuuauggcuccucccucccauguccucagacccagcaaaagc

SEQ ID NO: 354848 - RNA, 58 nt, hsa
gcccuguugucuggaggguucuuguugucccucccauuagccagggcggagacugucu

SEQ ID NO: 354849 - RNA, 58 nt, hsa
ccagcccggggcagucugacugucggugcccucccaggaacggggaaggccuccgucu

SEQ ID NO: 354850 - RNA, 58 nt, hsa
acaggaaaccaaggucugaccuaggguucccucccagucuucacaucacucuggccuc

SEQ ID NO: 354851 - RNA, 58 nt, hsa
uucucuucugccaacuaacgugcucgcgcccucccagcacguggagagcuucaauugu

SEQ ID NO: 354852 - RNA, 58 nt, hsa
gaguuaccuggugagagaccguguugcccccucccacagcucucugcccugcgcguuc

SEQ ID NO: 354853 - RNA, 58 nt, hsa
agggggugugggguuccguucucccuuccccucccacugaaguuugugcuuaaaaaac

SEQ ID NO: 354854 - RNA, 58 nt, hsa
ggucaggucugaggccaguauccuccagcccucccaaugccaacccccaccccguuuc

SEQ ID NO: 354855 - RNA, 58 nt, hsa
ugggugugagcagcacccauccaccguccccucccagggagcaagggcagggacaggg

SEQ ID NO: 354856 - RNA, 58 nt, hsa
agcugaaagaggccaaacaggcccuccucccucccagcuccaccccgcaagcaccauc

SEQ ID NO: 354857 - RNA, 58 nt, hsa
aaauuccagagcuuugggggagaauccacccucccaucaucugcuucccccaaggccu

SEQ ID NO: 354858 - RNA, 58 nt, hsa
agcuucccuccccuuccuccaaaacccucccucccaccuccccacacccauugaguca

SEQ ID NO: 354859 - RNA, 58 nt, hsa
uuucaucccugcuucuggacuugggguacccucccaauugccacauccuaucuggucc

SEQ ID NO: 354860 - RNA, 58 nt, hsa
aguccguggacauuucagagggagaucccccucccauuuaacuguccucacaggcccu

SEQ ID NO: 354861 - RNA, 58 nt, hsa
auuccccuuuaagagcuuccacugcacccccucccaagggacacagcgguaggaaugg

SEQ ID NO: 354862 - RNA, 58 nt, hsa
uugaggguugguccuguccccaccuccacccucccacccccuggaagaggaagggccc

SEQ ID NO: 354863 - RNA, 58 nt, hsa
ccccaugauucaauuaccucccccgggucccucccacaacacaugggaauucugagag

SEQ ID NO: 354864 - RNA, 58 nt, hsa
ccccugauucgaugaccucccccugggucccucccacaacaugugggaauuccagaag

SEQ ID NO: 354865 - RNA, 58 nt, hsa
cugaggagcccuuacccucccaccacuccccucccaagacccagccgccgccguugag

SEQ ID NO: 354866 - RNA, 58 nt, hsa
guccagggagggagcugaggagcccuuacccucccaccacuccccucccaagacccag

SEQ ID NO: 354867 - RNA, 58 nt, hsa
aguuuaauagagacuuccugccuuuauucccucccagggagaggcugaaggaauggaa

SEQ ID NO: 354868 - RNA, 58 nt, hsa
ucagugggacaagauggacacugggccacccucccaggcaccagacacagggcacggu

SEQ ID NO: 354869 - RNA, 58 nt, hsa
agugggcccagccaccuauuuuaacaagcccucccagugauugugauacauacuaaag

SEQ ID NO: 354870 - RNA, 58 nt, hsa
ggauccucaugugccucuccucaaagcucccucccaucuguaggagauuagugaggca

SEQ ID NO: 354871 - RNA, 58 nt, hsa
agacugggucucagagccgugccacccacccucccacacagccggccacagggagaac

SEQ ID NO: 354872 - RNA, 58 nt, hsa
acgcagcucaauaagggugagggucacucccucccagaagccccgucuggacgagccu

SEQ ID NO: 354873 - RNA, 58 nt, hsa
gggcacccuccugggagcaggccuuccucccucccacccccaauguccuguugguagg

SEQ ID NO: 354874 - RNA, 58 nt, hsa
cacccuaccugcccugccugccugcugccccucccagccugccaagaaaacgguaggg

SEQ ID NO: 354875 - RNA, 58 nt, hsa
ucgugccuucauucugcagcggcauggucccucccauucuggcuccaccugcagccuc

SEQ ID NO: 354876 - RNA, 58 nt, hsa
augccaccggaaccccagcccuuagcuccccucccaggccucugugggcccuugucgg

SEQ ID NO: 354877 - RNA, 58 nt, hsa
cgggaccgugggccgaggugacugcagacccucccagggaggcugugcacagacuguc

SEQ ID NO: 354878 - RNA, 58 nt, hsa
gggccugggugggcaggcaggaccugggcccucccacccaucagagcccacucaggac

SEQ ID NO: 354879 - RNA, 58 nt, hsa
ccuucauaaaggccucccuugucaccuucccucccaccccgucucagcccugugcucc

SEQ ID NO: 354880 - RNA, 58 nt, hsa
agcccuagggaaaggcugcucuugcucucccucccagggcuugaggcucccuauacuu

SEQ ID NO: 354881 - RNA, 58 nt, hsa
ggccuccaggaguauggguccugcccugcccucccaggaguccagccaggggcugccu

SEQ ID NO: 354882 - RNA, 58 nt, hsa
uuuacuuugucccagguuggagucccuacccucccaccucccaccugauaugcagugc

SEQ ID NO: 354883 - RNA, 58 nt, hsa
cagcugcuuccugcucagcugggccacccccucccacccugggguuggggaggagcag

SEQ ID NO: 354884 - RNA, 58 nt, hsa
guagugccuugugggguauccaggaacacccucccagcaggggaugggaacccugucc

SEQ ID NO: 354885 - RNA, 58 nt, hsa
uccuggccucgaccccuaagggcuucgccccucccaggggccuguaacuaagucgggu

SEQ ID NO: 354886 - RNA, 58 nt, hsa
cagggagggcuuggggcugcaccuccuacccucccaccagaacgcaccccacugggag

SEQ ID NO: 354887 - RNA, 58 nt, hsa
gcaccuaugagauggccaugcucaaccccccucccagacaggcccucccugucuccag

SEQ ID NO: 354888 - RNA, 58 nt, hsa
cccugcuuagccagcuucuguguguccgcccucccagcuccagcccugcaggccgucu

SEQ ID NO: 354889 - RNA, 58 nt, hsa
cccaguguaaaaaugucccaaguguagccccucccaccgcagagccuguuucuaacgu

SEQ ID NO: 354890 - RNA, 58 nt, hsa
uuugggcugauguaagacuagaggcuggcccucccagauaacagagaaaagggagccc

SEQ ID NO: 354891 - RNA, 58 nt, hsa
ugagcugauggugucauccagcagccuccccucccaagcaaagcuucuaaaacugggg

SEQ ID NO: 354892 - RNA, 58 nt, hsa
auccaaguuccuagaccucauggcuguccccucccaccagucaccuccacugcacaac

SEQ ID NO: 354893 - RNA, 58 nt, hsa
cacccccgagcccccuuggagacacccccccucccaaaagccauguccauccagcccu

SEQ ID NO: 354894 - RNA, 58 nt, hsa
ucuccccguacugaccucaacccugaaccccucccauucaacuccccaccuccagccg

SEQ ID NO: 354895 - RNA, 58 nt, hsa
cccccauuauucuuucuguccagccccucccucccacuggagcagcuccagagccauu

SEQ ID NO: 354896 - RNA, 58 nt, hsa
gaguccggggggaaccaagagccugggucccucccacuacuaucuugggagggagaag

SEQ ID NO: 354897 - RNA, 58 nt, hsa
cucucuucuagggcuucccaccaucagccccucccacuugagacuggucuuugggagg

SEQ ID NO: 354898 - RNA, 58 nt, hsa
aggcugggaaaaacuaagcugucccagccccucccauuucuugggcagggcucuuuuc

SEQ ID NO: 354899 - RNA, 58 nt, hsa
gaagcccagccagccucuacccaucccucccucccaauuaggcugcacuggggccgaa

SEQ ID NO: 354900 - RNA, 58 nt, hsa
gaugggacugucaaaguugugcugcccucccucccacaaacaaaugaauccagcgugg

SEQ ID NO: 354901 - RNA, 58 nt, hsa
accuccucuucugacgugccuuuugcaccccucccauuaggacaaucaguccccuccc

SEQ ID NO: 354902 - RNA, 58 nt, hsa
ugcaccccucccauuaggacaaucaguccccucccaucugggaguccccuuuucuuuu

SEQ ID NO: 354903 - RNA, 58 nt, hsa
cuuuccccuccaaccaguucaaucucaucccucccagcagcuccccuuccaccccccg

SEQ ID NO: 354904 - RNA, 58 nt, hsa
ugccccugcccguccccacccagucuugcccucccauccucucaucuauucccccgcu

SEQ ID NO: 354905 - RNA, 58 nt, hsa
cagcccugccuccgcccucaccuacaugcccucccagccccucccaucucuggacgag

SEQ ID NO: 354906 - RNA, 58 nt, hsa
uccgcccucaccuacaugcccucccagccccucccaucucuggacgaggccuccuucc

SEQ ID NO: 354907 - RNA, 58 nt, hsa
acugugcugagagcuuuccucgcagaggcccucccaacgaacagcucucucagaagca

SEQ ID NO: 354908 - RNA, 58 nt, hsa
cucucucuccuaccugccucccugcagucccucccauggaugacucaggccucccaga

SEQ ID NO: 354909 - RNA, 58 nt, hsa
cuuggcaaugucugugccaccuccugagcccucccagcauguccucacaugcucaugc

SEQ ID NO: 354910 - RNA, 58 nt, hsa
uaagcacacagggguuaaagcugugugucccucccaguggcuguggcagugacaguga

SEQ ID NO: 354911 - RNA, 58 nt, hsa
aacgugugugugugugucggugaucacacccucccauccuuccugccuccugccccaa

SEQ ID NO: 354912 - RNA, 58 nt, hsa
ucagcucugggaggcaggcgcagugccccccucccaugggcuggcccaggaccguggg

SEQ ID NO: 354913 - RNA, 58 nt, hsa
ucagcccccgaccuuauuuauuacccuccccucccacacccccaaucuaccuggugau

SEQ ID NO: 354914 - RNA, 58 nt, hsa
aggcacuucugcaucacggaagaccuggcccucccagccguccuggggaugcucaggg

SEQ ID NO: 354915 - RNA, 58 nt, hsa
uauauauauauacacaaaugcacagucccccucccacuccguuaccuaacuguacguc

SEQ ID NO: 354916 - RNA, 58 nt, hsa
ucucuccaagugugccaggccaggacagcccucccagccaugaauccuuacucagcua

SEQ ID NO: 354917 - RNA, 58 nt, hsa
gguggggaauggcuggggcugggcaggacccucccacacaccugcacccuagcuucgu

SEQ ID NO: 354918 - RNA, 58 nt, hsa
aggacagaaaaagcugggucuugcugugcccucccaggcuuaguguucccucccucaa

SEQ ID NO: 354919 - RNA, 58 nt, hsa
gugcaggcagggcugggacacgcggcuucccucccagucccugccuuggcaccgucac

SEQ ID NO: 354920 - RNA, 58 nt, hsa
uuccacauauguaagucucugggcggcgcccucccagcucccugccucuguuucccca

SEQ ID NO: 354921 - RNA, 58 nt, hsa
aacucaagguacgcccacugcaaggccucccucccaccgcggccccugccuggccacc

SEQ ID NO: 354922 - RNA, 58 nt, hsa
cccagccucccgcggggccacacacuuccccucccaacacacacacacaccugccauc

SEQ ID NO: 354923 - RNA, 58 nt, hsa
ugaggggggccccagggguucucaggaccccucccaccaccucccagugcuuccacgu

SEQ ID NO: 354924 - RNA, 58 nt, hsa
cugagcacagauguucccccaucucgcucccucccaggacucugaccccagcauucuc

SEQ ID NO: 354925 - RNA, 58 nt, hsa
ugccacccacaucuuccauuuccauguccccucccagagcugguggacccagggaaca

SEQ ID NO: 354926 - RNA, 58 nt, hsa
gaggggcacaggacccugcccucguguucccucccagcccgcaguauuucagggacag

SEQ ID NO: 354927 - RNA, 50 nt, hsa; identical to SEQ ID NO: 58436

SEQ ID NO: 354928 - RNA, 58 nt, hsa
uccccacacuucacagcaucuuccaucccccucccaccuucuaggcgaauagucccca

SEQ ID NO: 354929 - RNA, 58 nt, hsa
ccccucaccccaccucugcauggccacccccucccagcccuguggggaaacuguuccc

SEQ ID NO: 354930 - RNA, 58 nt, hsa
ccugaccccccugccgugccucccgcagcccucccaugccguuccacuccucccugcc

SEQ ID NO: 354931 - RNA, 58 nt, hsa
gagaagcccagccccucccccucgagaccccucccaugucccuuccuggccuggccgg

SEQ ID NO: 354932 - RNA, 58 nt, hsa
gggauggcuuggggggcuccagggggugcccucccagacccccuugcccaggccuccc

SEQ ID NO: 354933 - RNA, 58 nt, hsa
agcacaaggcgugagcccaccccgccugcccucccacccccuccccgggcagcagaga

SEQ ID NO: 354934 - RNA, 58 nt, hsa
ccucccucccuccuuccucuacucccaccccucccauguccccccauuccucaaaucc

SEQ ID NO: 354935 - RNA, 58 nt, hsa
cuuuccccacagccccccagccccucagcccucccagcccacuucugccuguuuuaaa

SEQ ID NO: 354936 - RNA, 58 nt, hsa
gcacuggagucugaggccugggaccccccccucccacccccuaacccauguuucucau

SEQ ID NO: 354937 - RNA, 58 nt, hsa
aagcugggggcccaucgccguggggagucccucccaccacccucgccgcaggcagcug

SEQ ID NO: 354938 - RNA, 58 nt, hsa
aauggcccagaccccagccuccccuccucccucccauccucacccaggccaaggccca

SEQ ID NO: 354939 - RNA, 58 nt, hsa
cccacaagccuggucaucagccaggcagcccucccagugcccaagggccaccaacccc

SEQ ID NO: 354940 - RNA, 58 nt, hsa
uuaguucaguuuaaaauguugauaccuucccucccaggcuccuuaccuuggucuuuuc

SEQ ID NO: 354941 - RNA, 58 nt, hsa
auauuucauggacaaauuuuuuuuucuccccucccaaauuuaguuccucaucacaaaa

SEQ ID NO: 354942 - RNA, 58 nt, hsa
agugccucacucaccugggacugguauccccucccaggguccaccaagggcuccugcu

SEQ ID NO: 354943 - RNA, 58 nt, hsa
gggcgcagcaacgcaucguguggcccuccccucccaccucccuguguauaaauauuua

SEQ ID NO: 354944 - RNA, 58 nt, hsa
agcccaaucagggucucgugcugcccuucccucccacagccuggcagccauccagagg

SEQ ID NO: 354945 - RNA, 58 nt, hsa
caggaugaggaagacaggccaaucccuucccucccagaagcuggccgcccagcaggag

SEQ ID NO: 354946 - RNA, 58 nt, hsa
cgaggugugaccccaccugcucuuuccucccucccaguauggccccaccugcucuuuc

SEQ ID NO: 354947 - RNA, 58 nt, hsa
agucugcacggcccaucugcuucaccuucccucccagccacgugccaguggccacagc

SEQ ID NO: 354948 - RNA, 58 nt, hsa
ccugggggccagccagggcccuuugugccccucccagcacaggccugaugcagguguc

SEQ ID NO: 354949 - RNA, 58 nt, hsa
caugugagcaccccaugaagggaccgcccccucccaaggauggucccuuugggugcag

SEQ ID NO: 354950 - RNA, 58 nt, hsa
ucuguccuagccccucccuaaucccuggcccucccagcugucugggacuucaguggac

SEQ ID NO: 354951 - RNA, 58 nt, hsa
uuggccugaguaaacuuggaaaggggcucccucccagagaagggacuacucucuucac

SEQ ID NO: 354952 - RNA, 58 nt, hsa
gggggcucagcugcuucagggaaugugucccucccaccaugggccagagcuucagccc

SEQ ID NO: 354953 - RNA, 58 nt, hsa
ccugaccucaagagauccacucgccuugcccucccaaagugcugggauuacaggcuug

SEQ ID NO: 354954 - RNA, 58 nt, hsa
aaacuauagccauauccaaaucuuuucccccucccaagaguucucagugucuacaugu

SEQ ID NO: 354955 - RNA, 58 nt, hsa
ccaacucucgcguguuggagagaaggggcccucccagcacaaaguugcauuccucccc

SEQ ID NO: 354956 - RNA, 58 nt, hsa
ugagggcugucgagugagcugccccagccccucccagcccuugcccagccugggggag

SEQ ID NO: 354957 - RNA, 58 nt, hsa
aaggcggagcugaggacagccagcuccgcccucccaaggcugugcguuccugagggcc

SEQ ID NO: 354958 - RNA, 58 nt, hsa
ugcuucaggaacacccgccagggcccaccccucccaccccgucccagcauucgcacuu

SEQ ID NO: 354959 - RNA, 55 nt, hsa; identical to SEQ ID NO: 113265

SEQ ID NO: 354960 - RNA, 64 nt, hsa; identical to SEQ ID NO: 113266

SEQ ID NO: 354961 - RNA, 64 nt, hsa; identical to SEQ ID NO: 113267

SEQ ID NO: 354962 - RNA, 64 nt, hsa; identical to SEQ ID NO: 113268

SEQ ID NO: 354963 - RNA, 64 nt, hsa; identical to SEQ ID NO: 113269

SEQ ID NO: 354964 - RNA, 64 nt, hsa; identical to SEQ ID NO: 113270

SEQ ID NO: 354965 - RNA, 64 nt, hsa; identical to SEQ ID NO: 113271

SEQ ID NO: 354966 - RNA, 64 nt, hsa; identical to SEQ ID NO: 113272

SEQ ID NO: 354967 - RNA, 64 nt, hsa; identical to SEQ ID NO: 113273

SEQ ID NO: 354968 - RNA, 64 nt, hsa; identical to SEQ ID NO: 113274

SEQ ID NO: 354969 - RNA, 64 nt, hsa; identical to SEQ ID NO: 113275

SEQ ID NO: 354970 - RNA, 64 nt, hsa; identical to SEQ ID NO: 113276

SEQ ID NO: 354971 - RNA, 64 nt, hsa; identical to SEQ ID NO: 113277

SEQ ID NO: 354972 - RNA, 64 nt, hsa; identical to SEQ ID NO: 113278

SEQ ID NO: 354973 - RNA, 64 nt, hsa
uaagucauuuuuaguuugguugugaaaaaacccugggcugaaguuggcauuucaguuaaaagaa

SEQ ID NO: 354974 - RNA, 64 nt, hsa
gccauuggggaggcagaugcggguguggaggugugggcugaagguagugacuguuugauuuuaa

SEQ ID NO: 354975 - RNA, 64 nt, hsa
ccauugggugcauagagauggggaggaggccacugggcugaauuuucucuuuaggcggaaaugc

SEQ ID NO: 354976 - RNA, 64 nt, hsa
uuugucuggguauagucacuccuggugaugauaugggcugaaaugucuccacgucucuuugugu

SEQ ID NO: 354977 - RNA, 64 nt, hsa
augaacagucagaaaaauaccuuaugagggggcagggcugaagcugggccuugaaggauggaug

SEQ ID NO: 354978 - RNA, 56 nt, hsa
gcuaugaaauugugaucuaggcugcugggcugaauucucccucuggaaacugaguu

SEQ ID NO: 354979 - RNA, 64 nt, hsa
guccuuugcccgguggugggaggauggagggauugggcugaagcugcuccaccucauccuugcu

SEQ ID NO: 354980 - RNA, 64 nt, hsa
aaagcuccccgggcgucagaguugagcccugccugggcugaaggacugucuucacgaagucagu

SEQ ID NO: 354981 - RNA, 64 nt, hsa
ggccaaggacaucaucuaggcagggggagagccugggcugaacagcugugaccaaaacucccuu

SEQ ID NO: 354982 - RNA, 64 nt, hsa
gcgugauguuccuuagcccaaagacggugagacagggcugaaaucagguggcuucugccacccu

SEQ ID NO: 354983 - RNA, 64 nt, hsa
agagaaugaggaagcaaagagugagaaagaauaggggcugaagacgccacucccagauggcucu

SEQ ID NO: 354984 - RNA, 64 nt, hsa
cacuuuccacucccugcuuaggauucuguucccugggcugaaacugaaauaagcuaauuuuuug

SEQ ID NO: 354985 - RNA, 64 nt, hsa
ggggccucuggagcaggccuggcuuuuaaauggggggcugaauuccagcucacacacaccucaa

SEQ ID NO: 354986 - RNA, 64 nt, hsa
aucaccuggggagauuuguaagcuucugcugucugggcugaacccccagagguucggauugaau

SEQ ID NO: 354987 - RNA, 64 nt, hsa
ccaugccaugaagacaccaaggcagcccuauugagaaaucuaccugucguggccgggcgcagug

SEQ ID NO: 354988 - RNA, 64 nt, hsa
aaaaaaaaaaaaaagaaagaaagaaagaaagaaagaaaucuaccugucaaggaacuaagguauu

SEQ ID NO: 354989 - RNA, 64 nt, hsa
ugggauuacaggcgugagccaccaugccuggccagaaaucuauguuuucuuagaacauguggaa

SEQ ID NO: 354990 - RNA, 64 nt, hsa
aagacccauccucccgcugucacuuuggacaauggaaaucuacauuuucuuuucccuuuuuuuu

SEQ ID NO: 354991 - RNA, 64 nt, hsa
gguucaaagauuuuuuuuucuuuuucucauauaagaaaucuagguguaaauauugaguacagaa

SEQ ID NO: 354992 - RNA, 64 nt, hsa
cuuuacgagagggucucacccaaauuuauggggagaaaucuauuucucaaaaaaaaaaaucuuc

SEQ ID NO: 354993 - RNA, 64 nt, hsa
auucucuauauaggacuucuuaaaauuuagaagggaaaucuagcuacuucaaauugucuguuaa

SEQ ID NO: 354994 - RNA, 64 nt, hsa
aacuuuauaauuacuuuaauauuuuugauaacuagaaaucuaguauugccauaaaggaaacuaa

SEQ ID NO: 354995 - RNA, 64 nt, hsa
agcacuuguuuucaggacaacacuucauuuucaggaaaucuacuuccuacagagccaaaaugcc

SEQ ID NO: 354996 - RNA, 64 nt, hsa
ugaugaacucaccuaauuaugaggugggaggagcgaaaucuaaauuucuuuugcuauaguuaua

SEQ ID NO: 354997 - RNA, 64 nt, hsa; identical to SEQ ID NO: 119910

SEQ ID NO: 354998 - RNA, 64 nt, hsa; identical to SEQ ID NO: 119911

SEQ ID NO: 354999 - RNA, 64 nt, hsa; identical to SEQ ID NO: 119912

SEQ ID NO: 355000 - RNA, 64 nt, hsa; identical to SEQ ID NO: 119913

SEQ ID NO: 355001 - RNA, 64 nt, hsa; identical to SEQ ID NO: 119914

SEQ ID NO: 355002 - RNA, 64 nt, hsa; identical to SEQ ID NO: 119915

SEQ ID NO: 355003 - RNA, 64 nt, hsa; identical to SEQ ID NO: 119916

SEQ ID NO: 355004 - RNA, 64 nt, hsa; identical to SEQ ID NO: 119917

SEQ ID NO: 355005 - RNA, 64 nt, hsa; identical to SEQ ID NO: 119918

SEQ ID NO: 355006 - RNA, 64 nt, hsa; identical to SEQ ID NO: 119919

SEQ ID NO: 355007 - RNA, 64 nt, hsa; identical to SEQ ID NO: 119920

SEQ ID NO: 355008 - RNA, 64 nt, hsa; identical to SEQ ID NO: 119921

SEQ ID NO: 355009 - RNA, 64 nt, hsa; identical to SEQ ID NO: 119922

SEQ ID NO: 355010 - RNA, 64 nt, hsa; identical to SEQ ID NO: 119923

SEQ ID NO: 355011 - RNA, 64 nt, hsa; identical to SEQ ID NO: 119924

SEQ ID NO: 355012 - RNA, 64 nt, hsa; identical to SEQ ID NO: 119925

SEQ ID NO: 355013 - RNA, 64 nt, hsa; identical to SEQ ID NO: 119926

SEQ ID NO: 355014 - RNA, 64 nt, hsa; identical to SEQ ID NO: 119927

SEQ ID NO: 355015 - RNA, 64 nt, hsa; identical to SEQ ID NO: 119928

SEQ ID NO: 355016 - RNA, 64 nt, hsa; identical to SEQ ID NO: 119929

SEQ ID NO: 355017 - RNA, 64 nt, hsa; identical to SEQ ID NO: 119930

SEQ ID NO: 355018 - RNA, 64 nt, hsa; identical to SEQ ID NO: 119931

SEQ ID NO: 355019 - RNA, 64 nt, hsa; identical to SEQ ID NO: 119932

SEQ ID NO: 355020 - RNA, 64 nt, hsa; identical to SEQ ID NO: 119933

SEQ ID NO: 355021 - RNA, 64 nt, hsa; identical to SEQ ID NO: 119934

SEQ ID NO: 355022 - RNA, 64 nt, hsa; identical to SEQ ID NO: 119935

SEQ ID NO: 355023 - RNA, 64 nt, hsa; identical to SEQ ID NO: 119936

SEQ ID NO: 355024 - RNA, 64 nt, hsa; identical to SEQ ID NO: 119937

SEQ ID NO: 355025 - RNA, 64 nt, hsa; identical to SEQ ID NO: 119938

SEQ ID NO: 355026 - RNA, 64 nt, hsa; identical to SEQ ID NO: 119939

SEQ ID NO: 355027 - RNA, 64 nt, hsa; identical to SEQ ID NO: 119940

SEQ ID NO: 355028 - RNA, 64 nt, hsa; identical to SEQ ID NO: 119941

SEQ ID NO: 355029 - RNA, 64 nt, hsa; identical to SEQ ID NO: 119942

SEQ ID NO: 355030 - RNA, 64 nt, hsa; identical to SEQ ID NO: 119943

SEQ ID NO: 355031 - RNA, 64 nt, hsa; identical to SEQ ID NO: 119944

SEQ ID NO: 355032 - RNA, 64 nt, hsa; identical to SEQ ID NO: 119945

SEQ ID NO: 355033 - RNA, 64 nt, hsa; identical to SEQ ID NO: 119946

SEQ ID NO: 355034 - RNA, 64 nt, hsa; identical to SEQ ID NO: 119947

SEQ ID NO: 355035 - RNA, 64 nt, hsa; identical to SEQ ID NO: 119948

SEQ ID NO: 355036 - RNA, 64 nt, hsa; identical to SEQ ID NO: 119949

SEQ ID NO: 355037 - RNA, 64 nt, hsa; identical to SEQ ID NO: 119950

SEQ ID NO: 355038 - RNA, 64 nt, hsa; identical to SEQ ID NO: 119951

SEQ ID NO: 355039 - RNA, 64 nt, hsa; identical to SEQ ID NO: 119952

SEQ ID NO: 355040 - RNA, 64 nt, hsa; identical to SEQ ID NO: 119953

SEQ ID NO: 355041 - RNA, 64 nt, hsa; identical to SEQ ID NO: 119954

SEQ ID NO: 355042 - RNA, 64 nt, hsa; identical to SEQ ID NO: 119955

SEQ ID NO: 355043 - RNA, 64 nt, hsa; identical to SEQ ID NO: 119956

SEQ ID NO: 355044 - RNA, 64 nt, hsa; identical to SEQ ID NO: 119957

SEQ ID NO: 355045 - RNA, 64 nt, hsa; identical to SEQ ID NO: 119958

SEQ ID NO: 355046 - RNA, 64 nt, hsa; identical to SEQ ID NO: 119959

SEQ ID NO: 355047 - RNA, 64 nt, hsa; identical to SEQ ID NO: 119960

SEQ ID NO: 355048 - RNA, 64 nt, hsa; identical to SEQ ID NO: 119961

SEQ ID NO: 355049 - RNA, 58 nt, hsa; identical to SEQ ID NO: 119962

SEQ ID NO: 355050 - RNA, 64 nt, hsa; identical to SEQ ID NO: 119963

SEQ ID NO: 355051 - RNA, 64 nt, hsa; identical to SEQ ID NO: 119964

SEQ ID NO: 355052 - RNA, 64 nt, hsa; identical to SEQ ID NO: 119965

SEQ ID NO: 355053 - RNA, 64 nt, hsa; identical to SEQ ID NO: 119966

SEQ ID NO: 355054 - RNA, 64 nt, hsa; identical to SEQ ID NO: 119967

SEQ ID NO: 355055 - RNA, 64 nt, hsa; identical to SEQ ID NO: 119968

SEQ ID NO: 355056 - RNA, 64 nt, hsa; identical to SEQ ID NO: 119969

SEQ ID NO: 355057 - RNA, 64 nt, hsa; identical to SEQ ID NO: 119970

SEQ ID NO: 355058 - RNA, 55 nt, hsa; identical to SEQ ID NO: 119971

SEQ ID NO: 355059 - RNA, 64 nt, hsa; identical to SEQ ID NO: 119972

SEQ ID NO: 355060 - RNA, 64 nt, hsa; identical to SEQ ID NO: 119973

SEQ ID NO: 355061 - RNA, 64 nt, hsa; identical to SEQ ID NO: 119974

SEQ ID NO: 355062 - RNA, 64 nt, hsa; identical to SEQ ID NO: 119975

SEQ ID NO: 355063 - RNA, 64 nt, hsa; identical to SEQ ID NO: 119976

SEQ ID NO: 355064 - RNA, 64 nt, hsa; identical to SEQ ID NO: 119977

SEQ ID NO: 355065 - RNA, 64 nt, hsa; identical to SEQ ID NO: 119978

SEQ ID NO: 355066 - RNA, 64 nt, hsa; identical to SEQ ID NO: 119979

SEQ ID NO: 355067 - RNA, 64 nt, hsa; identical to SEQ ID NO: 119980

SEQ ID NO: 355068 - RNA, 64 nt, hsa; identical to SEQ ID NO: 119981

SEQ ID NO: 355069 - RNA, 64 nt, hsa; identical to SEQ ID NO: 119982

SEQ ID NO: 355070 - RNA, 64 nt, hsa; identical to SEQ ID NO: 119983

SEQ ID NO: 355071 - RNA, 64 nt, hsa; identical to SEQ ID NO: 119984

SEQ ID NO: 355072 - RNA, 64 nt, hsa; identical to SEQ ID NO: 119985

SEQ ID NO: 355073 - RNA, 64 nt, hsa; identical to SEQ ID NO: 119986

SEQ ID NO: 355074 - RNA, 64 nt, hsa; identical to SEQ ID NO: 119987

SEQ ID NO: 355075 - RNA, 55 nt, hsa; identical to SEQ ID NO: 119988

SEQ ID NO: 355076 - RNA, 64 nt, hsa; identical to SEQ ID NO: 119989

SEQ ID NO: 355077 - RNA, 64 nt, hsa; identical to SEQ ID NO: 119990

SEQ ID NO: 355078 - RNA, 64 nt, hsa; identical to SEQ ID NO: 119991

SEQ ID NO: 355079 - RNA, 64 nt, hsa; identical to SEQ ID NO: 119992

SEQ ID NO: 355080 - RNA, 64 nt, hsa; identical to SEQ ID NO: 119993

SEQ ID NO: 355081 - RNA, 64 nt, hsa; identical to SEQ ID NO: 119994

SEQ ID NO: 355082 - RNA, 64 nt, hsa; identical to SEQ ID NO: 119995

SEQ ID NO: 355083 - RNA, 64 nt, hsa; identical to SEQ ID NO: 119996

SEQ ID NO: 355084 - RNA, 64 nt, hsa; identical to SEQ ID NO: 119997

SEQ ID NO: 355085 - RNA, 64 nt, hsa; identical to SEQ ID NO: 119998

SEQ ID NO: 355086 - RNA, 62 nt, hsa; identical to SEQ ID NO: 119999

SEQ ID NO: 355087 - RNA, 64 nt, hsa; identical to SEQ ID NO: 120000

SEQ ID NO: 355088 - RNA, 64 nt, hsa; identical to SEQ ID NO: 120001

SEQ ID NO: 355089 - RNA, 64 nt, hsa; identical to SEQ ID NO: 120002

SEQ ID NO: 355090 - RNA, 64 nt, hsa; identical to SEQ ID NO: 120003

SEQ ID NO: 355091 - RNA, 64 nt, hsa; identical to SEQ ID NO: 120004

SEQ ID NO: 355092 - RNA, 64 nt, hsa; identical to SEQ ID NO: 120005

SEQ ID NO: 355093 - RNA, 64 nt, hsa; identical to SEQ ID NO: 120006

SEQ ID NO: 355094 - RNA, 64 nt, hsa; identical to SEQ ID NO: 120007

SEQ ID NO: 355095 - RNA, 64 nt, hsa; identical to SEQ ID NO: 120008

SEQ ID NO: 355096 - RNA, 64 nt, hsa; identical to SEQ ID NO: 44100

SEQ ID NO: 355097 - RNA, 64 nt, hsa; identical to SEQ ID NO: 44101

SEQ ID NO: 355098 - RNA, 64 nt, hsa; identical to SEQ ID NO: 44102

SEQ ID NO: 355099 - RNA, 64 nt, hsa; identical to SEQ ID NO: 44103

SEQ ID NO: 355100 - RNA, 64 nt, hsa; identical to SEQ ID NO: 44104

SEQ ID NO: 355101 - RNA, 64 nt, hsa; identical to SEQ ID NO: 44105

SEQ ID NO: 355102 - RNA, 64 nt, hsa; identical to SEQ ID NO: 44106

SEQ ID NO: 355103 - RNA, 64 nt, hsa; identical to SEQ ID NO: 44107

SEQ ID NO: 355104 - RNA, 64 nt, hsa; identical to SEQ ID NO: 44108

SEQ ID NO: 355105 - RNA, 64 nt, hsa; identical to SEQ ID NO: 44109

SEQ ID NO: 355106 - RNA, 64 nt, hsa; identical to SEQ ID NO: 44110

SEQ ID NO: 355107 - RNA, 64 nt, hsa; identical to SEQ ID NO: 44111

SEQ ID NO: 355108 - RNA, 64 nt, hsa; identical to SEQ ID NO: 44112

SEQ ID NO: 355109 - RNA, 64 nt, hsa; identical to SEQ ID NO: 44113

SEQ ID NO: 355110 - RNA, 64 nt, hsa; identical to SEQ ID NO: 44114

SEQ ID NO: 355111 - RNA, 64 nt, hsa; identical to SEQ ID NO: 44115

SEQ ID NO: 355112 - RNA, 64 nt, hsa; identical to SEQ ID NO: 44116

SEQ ID NO: 355113 - RNA, 64 nt, hsa; identical to SEQ ID NO: 44117

SEQ ID NO: 355114 - RNA, 64 nt, hsa; identical to SEQ ID NO: 44118

SEQ ID NO: 355115 - RNA, 64 nt, hsa; identical to SEQ ID NO: 44119

SEQ ID NO: 355116 - RNA, 64 nt, hsa; identical to SEQ ID NO: 44120

SEQ ID NO: 355117 - RNA, 64 nt, hsa; identical to SEQ ID NO: 44121

SEQ ID NO: 355118 - RNA, 64 nt, hsa; identical to SEQ ID NO: 44122

SEQ ID NO: 355119 - RNA, 64 nt, hsa; identical to SEQ ID NO: 44123

SEQ ID NO: 355120 - RNA, 64 nt, hsa; identical to SEQ ID NO: 44124

SEQ ID NO: 355121 - RNA, 64 nt, hsa; identical to SEQ ID NO: 44125

SEQ ID NO: 355122 - RNA, 64 nt, hsa; identical to SEQ ID NO: 44126

SEQ ID NO: 355123 - RNA, 64 nt, hsa; identical to SEQ ID NO: 44127

SEQ ID NO: 355124 - RNA, 64 nt, hsa; identical to SEQ ID NO: 44128

SEQ ID NO: 355125 - RNA, 64 nt, hsa; identical to SEQ ID NO: 44129

SEQ ID NO: 355126 - RNA, 64 nt, hsa; identical to SEQ ID NO: 44130

SEQ ID NO: 355127 - RNA, 64 nt, hsa; identical to SEQ ID NO: 44131

SEQ ID NO: 355128 - RNA, 64 nt, hsa; identical to SEQ ID NO: 44132

SEQ ID NO: 355129 - RNA, 64 nt, hsa; identical to SEQ ID NO: 44133

SEQ ID NO: 355130 - RNA, 64 nt, hsa; identical to SEQ ID NO: 44134

SEQ ID NO: 355131 - RNA, 64 nt, hsa; identical to SEQ ID NO: 44135

SEQ ID NO: 355132 - RNA, 64 nt, hsa; identical to SEQ ID NO: 44136

SEQ ID NO: 355133 - RNA, 64 nt, hsa; identical to SEQ ID NO: 44137

SEQ ID NO: 355134 - RNA, 64 nt, hsa; identical to SEQ ID NO: 44138

SEQ ID NO: 355135 - RNA, 64 nt, hsa; identical to SEQ ID NO: 44139

SEQ ID NO: 355136 - RNA, 64 nt, hsa; identical to SEQ ID NO: 44140

SEQ ID NO: 355137 - RNA, 64 nt, hsa; identical to SEQ ID NO: 44141

SEQ ID NO: 355138 - RNA, 64 nt, hsa; identical to SEQ ID NO: 44142

SEQ ID NO: 355139 - RNA, 64 nt, hsa; identical to SEQ ID NO: 44143

SEQ ID NO: 355140 - RNA, 64 nt, hsa; identical to SEQ ID NO: 44144

SEQ ID NO: 355141 - RNA, 64 nt, hsa; identical to SEQ ID NO: 44145

SEQ ID NO: 355142 - RNA, 64 nt, hsa; identical to SEQ ID NO: 44146

SEQ ID NO: 355143 - RNA, 64 nt, hsa; identical to SEQ ID NO: 44147

SEQ ID NO: 355144 - RNA, 64 nt, hsa; identical to SEQ ID NO: 44148

SEQ ID NO: 355145 - RNA, 64 nt, hsa; identical to SEQ ID NO: 44149

SEQ ID NO: 355146 - RNA, 64 nt, hsa; identical to SEQ ID NO: 44150

SEQ ID NO: 355147 - RNA, 64 nt, hsa; identical to SEQ ID NO: 44151

SEQ ID NO: 355148 - RNA, 64 nt, hsa; identical to SEQ ID NO: 44152

SEQ ID NO: 355149 - RNA, 64 nt, hsa; identical to SEQ ID NO: 44153

SEQ ID NO: 355150 - RNA, 64 nt, hsa; identical to SEQ ID NO: 44154

SEQ ID NO: 355151 - RNA, 64 nt, hsa; identical to SEQ ID NO: 44155

SEQ ID NO: 355152 - RNA, 64 nt, hsa; identical to SEQ ID NO: 44156

SEQ ID NO: 355153 - RNA, 64 nt, hsa; identical to SEQ ID NO: 44157

SEQ ID NO: 355154 - RNA, 64 nt, hsa; identical to SEQ ID NO: 44158

SEQ ID NO: 355155 - RNA, 64 nt, hsa; identical to SEQ ID NO: 44159

SEQ ID NO: 355156 - RNA, 64 nt, hsa; identical to SEQ ID NO: 44160

SEQ ID NO: 355157 - RNA, 64 nt, hsa; identical to SEQ ID NO: 44161

SEQ ID NO: 355158 - RNA, 64 nt, hsa; identical to SEQ ID NO: 44162

SEQ ID NO: 355159 - RNA, 64 nt, hsa; identical to SEQ ID NO: 44163

SEQ ID NO: 355160 - RNA, 64 nt, hsa; identical to SEQ ID NO: 44164

SEQ ID NO: 355161 - RNA, 64 nt, hsa; identical to SEQ ID NO: 44165

SEQ ID NO: 355162 - RNA, 64 nt, hsa; identical to SEQ ID NO: 44166

SEQ ID NO: 355163 - RNA, 64 nt, hsa; identical to SEQ ID NO: 44167

SEQ ID NO: 355164 - RNA, 64 nt, hsa; identical to SEQ ID NO: 44168

SEQ ID NO: 355165 - RNA, 64 nt, hsa; identical to SEQ ID NO: 44169

SEQ ID NO: 355166 - RNA, 64 nt, hsa; identical to SEQ ID NO: 44170

SEQ ID NO: 355167 - RNA, 64 nt, hsa; identical to SEQ ID NO: 44171

SEQ ID NO: 355168 - RNA, 64 nt, hsa; identical to SEQ ID NO: 44172

SEQ ID NO: 355169 - RNA, 64 nt, hsa; identical to SEQ ID NO: 44173

SEQ ID NO: 355170 - RNA, 64 nt, hsa; identical to SEQ ID NO: 44174

SEQ ID NO: 355171 - RNA, 64 nt, hsa; identical to SEQ ID NO: 44175

SEQ ID NO: 355172 - RNA, 64 nt, hsa; identical to SEQ ID NO: 44176

SEQ ID NO: 355173 - RNA, 64 nt, hsa; identical to SEQ ID NO: 44177

SEQ ID NO: 355174 - RNA, 64 nt, hsa; identical to SEQ ID NO: 44178

SEQ ID NO: 355175 - RNA, 64 nt, hsa; identical to SEQ ID NO: 44179

SEQ ID NO: 355176 - RNA, 64 nt, hsa; identical to SEQ ID NO: 44180

SEQ ID NO: 355177 - RNA, 64 nt, hsa; identical to SEQ ID NO: 44181

SEQ ID NO: 355178 - RNA, 64 nt, hsa; identical to SEQ ID NO: 44182

SEQ ID NO: 355179 - RNA, 64 nt, hsa; identical to SEQ ID NO: 44183

SEQ ID NO: 355180 - RNA, 64 nt, hsa; identical to SEQ ID NO: 44184

SEQ ID NO: 355181 - RNA, 64 nt, hsa; identical to SEQ ID NO: 44185

SEQ ID NO: 355182 - RNA, 64 nt, hsa; identical to SEQ ID NO: 44186

SEQ ID NO: 355183 - RNA, 64 nt, hsa; identical to SEQ ID NO: 44187

SEQ ID NO: 355184 - RNA, 64 nt, hsa; identical to SEQ ID NO: 44188

SEQ ID NO: 355185 - RNA, 64 nt, hsa; identical to SEQ ID NO: 44189

SEQ ID NO: 355186 - RNA, 64 nt, hsa; identical to SEQ ID NO: 44190

SEQ ID NO: 355187 - RNA, 64 nt, hsa; identical to SEQ ID NO: 44191

SEQ ID NO: 355188 - RNA, 64 nt, hsa; identical to SEQ ID NO: 44192

SEQ ID NO: 355189 - RNA, 64 nt, hsa; identical to SEQ ID NO: 44193

SEQ ID NO: 355190 - RNA, 64 nt, hsa; identical to SEQ ID NO: 44194

SEQ ID NO: 355191 - RNA, 64 nt, hsa; identical to SEQ ID NO: 44195

SEQ ID NO: 355192 - RNA, 64 nt, hsa; identical to SEQ ID NO: 44196

SEQ ID NO: 355193 - RNA, 64 nt, hsa; identical to SEQ ID NO: 44197

SEQ ID NO: 355194 - RNA, 64 nt, hsa; identical to SEQ ID NO: 44198

SEQ ID NO: 355195 - RNA, 64 nt, hsa; identical to SEQ ID NO: 44199

SEQ ID NO: 355196 - RNA, 64 nt, hsa; identical to SEQ ID NO: 44200

SEQ ID NO: 355197 - RNA, 64 nt, hsa; identical to SEQ ID NO: 44201

SEQ ID NO: 355198 - RNA, 64 nt, hsa; identical to SEQ ID NO: 44202

SEQ ID NO: 355199 - RNA, 64 nt, hsa; identical to SEQ ID NO: 44203

SEQ ID NO: 355200 - RNA, 64 nt, hsa; identical to SEQ ID NO: 44204

SEQ ID NO: 355201 - RNA, 64 nt, hsa; identical to SEQ ID NO: 44205

SEQ ID NO: 355202 - RNA, 64 nt, hsa; identical to SEQ ID NO: 44206

SEQ ID NO: 355203 - RNA, 64 nt, hsa; identical to SEQ ID NO: 44207

SEQ ID NO: 355204 - RNA, 64 nt, hsa; identical to SEQ ID NO: 44208

SEQ ID NO: 355205 - RNA, 64 nt, hsa; identical to SEQ ID NO: 44209

SEQ ID NO: 355206 - RNA, 64 nt, hsa; identical to SEQ ID NO: 44210

SEQ ID NO: 355207 - RNA, 64 nt, hsa; identical to SEQ ID NO: 44211

SEQ ID NO: 355208 - RNA, 64 nt, hsa; identical to SEQ ID NO: 44212

SEQ ID NO: 355209 - RNA, 64 nt, hsa; identical to SEQ ID NO: 44213

SEQ ID NO: 355210 - RNA, 64 nt, hsa; identical to SEQ ID NO: 44214

SEQ ID NO: 355211 - RNA, 64 nt, hsa; identical to SEQ ID NO: 44215

SEQ ID NO: 355212 - RNA, 64 nt, hsa; identical to SEQ ID NO: 44216

SEQ ID NO: 355213 - RNA, 64 nt, hsa; identical to SEQ ID NO: 44217

SEQ ID NO: 355214 - RNA, 64 nt, hsa; identical to SEQ ID NO: 44218

SEQ ID NO: 355215 - RNA, 64 nt, hsa; identical to SEQ ID NO: 44219

SEQ ID NO: 355216 - RNA, 64 nt, hsa; identical to SEQ ID NO: 44220

SEQ ID NO: 355217 - RNA, 64 nt, hsa; identical to SEQ ID NO: 44221

SEQ ID NO: 355218 - RNA, 64 nt, hsa; identical to SEQ ID NO: 44222

SEQ ID NO: 355219 - RNA, 64 nt, hsa; identical to SEQ ID NO: 44223

SEQ ID NO: 355220 - RNA, 64 nt, hsa; identical to SEQ ID NO: 44224

SEQ ID NO: 355221 - RNA, 64 nt, hsa; identical to SEQ ID NO: 44225

SEQ ID NO: 355222 - RNA, 64 nt, hsa; identical to SEQ ID NO: 44226

SEQ ID NO: 355223 - RNA, 64 nt, hsa; identical to SEQ ID NO: 44227

SEQ ID NO: 355224 - RNA, 64 nt, hsa; identical to SEQ ID NO: 44228

SEQ ID NO: 355225 - RNA, 64 nt, hsa; identical to SEQ ID NO: 44229

SEQ ID NO: 355226 - RNA, 64 nt, hsa; identical to SEQ ID NO: 44230

SEQ ID NO: 355227 - RNA, 64 nt, hsa; identical to SEQ ID NO: 44231

SEQ ID NO: 355228 - RNA, 64 nt, hsa; identical to SEQ ID NO: 44232

SEQ ID NO: 355229 - RNA, 64 nt, hsa; identical to SEQ ID NO: 44233

SEQ ID NO: 355230 - RNA, 64 nt, hsa; identical to SEQ ID NO: 44234

SEQ ID NO: 355231 - RNA, 64 nt, hsa; identical to SEQ ID NO: 44235

SEQ ID NO: 355232 - RNA, 64 nt, hsa; identical to SEQ ID NO: 44236

SEQ ID NO: 355233 - RNA, 64 nt, hsa; identical to SEQ ID NO: 44237

SEQ ID NO: 355234 - RNA, 64 nt, hsa; identical to SEQ ID NO: 44238

SEQ ID NO: 355235 - RNA, 64 nt, hsa; identical to SEQ ID NO: 44239

SEQ ID NO: 355236 - RNA, 64 nt, hsa; identical to SEQ ID NO: 44240

SEQ ID NO: 355237 - RNA, 64 nt, hsa; identical to SEQ ID NO: 44241

SEQ ID NO: 355238 - RNA, 64 nt, hsa; identical to SEQ ID NO: 44242

SEQ ID NO: 355239 - RNA, 64 nt, hsa; identical to SEQ ID NO: 44243

SEQ ID NO: 355240 - RNA, 64 nt, hsa; identical to SEQ ID NO: 44244

SEQ ID NO: 355241 - RNA, 64 nt, hsa; identical to SEQ ID NO: 44245

SEQ ID NO: 355242 - RNA, 64 nt, hsa; identical to SEQ ID NO: 44246

SEQ ID NO: 355243 - RNA, 64 nt, hsa; identical to SEQ ID NO: 44247

SEQ ID NO: 355244 - RNA, 64 nt, hsa; identical to SEQ ID NO: 44248

SEQ ID NO: 355245 - RNA, 64 nt, hsa; identical to SEQ ID NO: 44249

SEQ ID NO: 355246 - RNA, 64 nt, hsa; identical to SEQ ID NO: 44250

SEQ ID NO: 355247 - RNA, 64 nt, hsa; identical to SEQ ID NO: 44251

SEQ ID NO: 355248 - RNA, 64 nt, hsa; identical to SEQ ID NO: 44252

SEQ ID NO: 355249 - RNA, 64 nt, hsa; identical to SEQ ID NO: 44253

SEQ ID NO: 355250 - RNA, 64 nt, hsa
acugcuguucccagugauauuugggaucugacugaagccagaggcucuguaaaaucagaccaua

SEQ ID NO: 355251 - RNA, 64 nt, hsa
ugucuuaaaaguuguuuuuaaaugacaauaaaacaagccagaaugucuuuugugcuggaguguc

SEQ ID NO: 355252 - RNA, 64 nt, hsa
gaccacucaacccccaccuggaaggggcaaagaaaagccagaguuccauguuuguacuccugug

SEQ ID NO: 355253 - RNA, 64 nt, hsa
caaccuucccucucuccuuggugaagaacaucccaagccagaaagaaguuaacuacaguguuuu

SEQ ID NO: 355254 - RNA, 64 nt, hsa
ugggaggggagggcuggcugcuggaagaaggaagaagccagacugguuagacaguacucuuaac

SEQ ID NO: 355255 - RNA, 64 nt, hsa
gucuuauaacaccucccaagaaagauaggggaagaagccagaaccccaccuggccugcccacag

SEQ ID NO: 355256 - RNA, 64 nt, hsa
gccuccuuggcuggcaugguucuguguuacguugaagccagagucuuauaacaccucccaagaa

SEQ ID NO: 355257 - RNA, 64 nt, hsa
gaaaaugugcaugacaacacuagagguaugggcgaagccagaaagaagggaaguuuuggcugaa

SEQ ID NO: 355258 - RNA, 64 nt, hsa
cccuugccuuuaaccuuuucugcagugaucuaagaagccagauucaucugcacaaauacguggu

SEQ ID NO: 355259 - RNA, 64 nt, hsa
aagggaaaagacacacaagucgcguggguuggagaagccagagccauuccaccuccccuccccc

SEQ ID NO: 355260 - RNA, 64 nt, hsa
caccuccccucccccagcaucucucagagaugugaagccagauccucauggcagcgaggcccuc

SEQ ID NO: 355261 - RNA, 64 nt, hsa
gaacacuaagcugugaugaagaaagugugguaaaaagccagaguaguuuuauacagacaaaacc

SEQ ID NO: 355262 - RNA, 64 nt, hsa
ggaggcaaccugaccagaaacacuucgcugcugcaagccagacaggaaaaagauuccaugucag

SEQ ID NO: 355263 - RNA, 64 nt, hsa
guuaucuagugauaugaccucacugucuugaccaaagccagaauagaaggcaggauuccugaau

SEQ ID NO: 355264 - RNA, 64 nt, hsa
ugaauaauaugcagagaugcauauuaggaaugugaagccagaaugggucaguuguagcugcugc

SEQ ID NO: 355265 - RNA, 64 nt, hsa
uuuuucuuuuuugcuuucuugucuuuucagaagcaagccagaccuagcaggcuguuccauguuc

SEQ ID NO: 355266 - RNA, 64 nt, hsa
ucuagaggucaggacggcuccucagagcgccaggaagccagagccccaagcaggacgaaaaaga

SEQ ID NO: 355267 - RNA, 64 nt, hsa
ggauuucugaaacuugaacucagagcccagugggaagccagaggucuugaaagacuucagccau

SEQ ID NO: 355268 - RNA, 61 nt, hsa; identical to SEQ ID NO: 188794

SEQ ID NO: 355269 - RNA, 64 nt, hsa
gggcucccuccucuucacauuccccccgaccccaaagccagagaaagccagauggcaccagcug

SEQ ID NO: 355270 - RNA, 64 nt, hsa
cucuucacauuccccccgaccccaaagccagagaaagccagauggcaccagcugcuccggaugu

SEQ ID NO: 355271 - RNA, 64 nt, hsa
aaccaaaguucucaggccaaggucucgcccaccaaagccagaaagugcaagcacccgucuaccc

SEQ ID NO: 355272 - RNA, 64 nt, hsa
cgccuucuggagagccucuggguucugagucagcaagccagaggucaugccacaggccuggcug

SEQ ID NO: 355273 - RNA, 64 nt, hsa
caaaaccugcagcaaagagaagcaucagucuaacaagccagaacucauuuugugccacccauuu

SEQ ID NO: 355274 - RNA, 64 nt, hsa
ccacccauugucaggugcucucccucaccccuguaagccagacaguuuguucaaaaccugcagc

SEQ ID NO: 355275 - RNA, 64 nt, hsa
uguaguuaacauuuauguucccuacucccuacguaagccagacuuuggcaacagugauaguuga

SEQ ID NO: 355276 - RNA, 64 nt, hsa
gaucuucauuuuacaggcagaccugucuaacuacaagccagacuuggguuuucuccuguaguuu

SEQ ID NO: 355277 - RNA, 64 nt, hsa
cuguguuuccuucauguguuagauauuggcaacaaagccagagguguaauguugguuauaugaa

SEQ ID NO: 355278 - RNA, 64 nt, hsa
auagaucuuggaaggagagauccauugaguccagaagccagaucagcaaauggaggaaccucgg

SEQ ID NO: 355279 - RNA, 64 nt, hsa
guuauuuagccauucaccuagagaguaaguguugaagccagagccaccuccaacucuggagccu

SEQ ID NO: 355280 - RNA, 64 nt, hsa
gugggauguggcgggacaggguugcuggguacagaagccagacuucuuuuacaaguaacucuag

SEQ ID NO: 355281 - RNA, 64 nt, hsa
aaggaucauggucaugugagcuucuggucaccggaagccagaaauacucagcugccauguugau

SEQ ID NO: 355282 - RNA, 64 nt, hsa
cugugaagagauccuggcauuucugguccaacccaagccagagaaccauuaagaaggggccuuc

SEQ ID NO: 355283 - RNA, 64 nt, hsa
ugcucaccccuuucccccgccaaauaagaaacgcaagccagaccacgaugauuguagaaguccc

SEQ ID NO: 355284 - RNA, 64 nt, hsa
caagaugaacuugaagauuacauaaaagugcagaaagccagaggacuagagccaaaaacuuguu

SEQ ID NO: 355285 - RNA, 64 nt, hsa
caagaugaacuugaagauuacaucaaaguacagaaagccagaggacuagauccaaagacuuguu

SEQ ID NO: 355286 - RNA, 64 nt, hsa
caaaaugagugugcagauuacaucaaugugcagaaagccagaggacuagaggccaagacuuguu

SEQ ID NO: 355287 - RNA, 64 nt, hsa; identical to SEQ ID NO: 313523

SEQ ID NO: 355288 - RNA, 64 nt, hsa; identical to SEQ ID NO: 313524

SEQ ID NO: 355289 - RNA, 64 nt, hsa
gugccuaggaaaaggggacagagggcaaggagagaagugagagcuacaauuccagcauuggaga

SEQ ID NO: 355290 - RNA, 64 nt, hsa
cccagauagacuaacaacccuuuagugcuccaagaagugagaauuuccgaaaaagaucugccgg

SEQ ID NO: 355291 - RNA, 64 nt, hsa
gccuuuuuuuuaaggagcaaaaaucugagaaaaaaagugagagaccucugccuacaaaaccuca

SEQ ID NO: 355292 - RNA, 64 nt, hsa
auguugagcagaauguuguacuugaaaaugcuauaagugagaugguaugaaauaaauucugacu

SEQ ID NO: 355293 - RNA, 64 nt, hsa
agaauuaaagaacuugcuguucaaauuaaguagaaagugagacucaauaauaacugaacuacag

SEQ ID NO: 355294 - RNA, 64 nt, hsa
augcaguccgaaagcaugugggaguggggagggaaagugagaugaauuaagacaaagaacaggu

SEQ ID NO: 355295 - RNA, 64 nt, hsa
uuccaggcagaggaacaggaugugcacugccccaaagugagaacuugcucuacguggucaggaa

SEQ ID NO: 355296 - RNA, 64 nt, hsa
ggaggacaggugguggagggccuuggcuucugcuaagugagaugggaaccacuggaggguuuga

SEQ ID NO: 355297 - RNA, 64 nt, hsa
ugggugaaugauggggaguaaauuuaggaaggggaagugagagaguaugguggcaauaucacaa

SEQ ID NO: 355298 - RNA, 64 nt, hsa
uguguguuuuacuaaccuuuuauaucuugccuucaagugagaaggaacaaacaacucucagugg

SEQ ID NO: 355299 - RNA, 64 nt, hsa
gaaauugcgccacugcacuccagccugggcaacaaagugagacuccaucucaaaaaaaaaaaaa

SEQ ID NO: 355300 - RNA, 64 nt, hsa
cauuugcauaaagcugacugacugaaggaacagaaagugagacagacagauaugaccaaauuua

SEQ ID NO: 355301 - RNA, 64 nt, hsa
gcgaccugcacgcacugcguagagccuggaagggaagugagaaaccagccgaccggcccugccc

SEQ ID NO: 355302 - RNA, 64 nt, hsa
agggacagaacugaacguccugcagcuucggggcaagugagacaaucacagcuccucgcugcgu

SEQ ID NO: 355303 - RNA, 64 nt, hsa
guaaauuucuguacauguacuguuuucauaugugaagugagaagaaacuuuaugcuuguuuaau

SEQ ID NO: 355304 - RNA, 64 nt, hsa
cugaccucugauggcacuuguugacaaaucauucaagugagaccauguuacuagacaugaucuu

SEQ ID NO: 355305 - RNA, 64 nt, hsa
aucucucucuuauaucacuugaaugauauauuguaagugagagguaaaggaaaauguaggcaca

SEQ ID NO: 355306 - RNA, 64 nt, hsa
aaauugucagugaaauaaaugagauuuuggaauaaagugagaaugggagaagggauauguugug

SEQ ID NO: 355307 - RNA, 64 nt, hsa
ugaauuaauaauugugagcccauagacacaagggaagugagaaacagugcucuggugacaugau

SEQ ID NO: 355308 - RNA, 64 nt, hsa
gcaagcucugcccuggcuguggguaucaggacugugaccaaagcauuucuagucccuucucucu

SEQ ID NO: 355309 - RNA, 64 nt, hsa
gaccccaggcucuuagagacuaaggggcagcuccugaccaaagacgauacagcuuggcacuuua

SEQ ID NO: 355310 - RNA, 64 nt, hsa
uccucccaggaaccaaaaaaccccagcuauuuucugaccaaaauguguuucauaacaaaccauc

SEQ ID NO: 355311 - RNA, 64 nt, hsa
gcagacuacuacuaaucacagaccacaaggguaaugaccaaauuuaugugguuguuacacuucc

SEQ ID NO: 355312 - RNA, 64 nt, hsa
uaacuagggagugagugguaguuacuuaaguaauugaccaaauggaaaaggggaaguaauuaag

SEQ ID NO: 355313 - RNA, 64 nt, hsa
uuauucuaugcucucuguacuuuugaccaaaaauugaccaaaguaagaaaaugcaaguucuaaa

SEQ ID NO: 355314 - RNA, 64 nt, hsa
caucuuugcuuuuauucuaugcucucuguacuuuugaccaaaaauugaccaaaguaagaaaaug

SEQ ID NO: 355315 - RNA, 64 nt, hsa
uaaauuggaguuaggaauuucaugaaccucacuaugaccaaaauuaauuuuuugauucaguuug

SEQ ID NO: 355316 - RNA, 64 nt, hsa
uuagcuaggccagaggcucguauuguguuucugcugaccaaaguugcauacaccuguaagaagu

SEQ ID NO: 355317 - RNA, 64 nt, hsa
auuugccuuaggcugauaggaauguggguuuucuugaccaaauauaucagcaucuaauugaaau

SEQ ID NO: 355318 - RNA, 64 nt, hsa
uuucuugaccaaauauaucagcaucuaauugaaaugaccaaauagcauucuuagacuucuguau

SEQ ID NO: 355319 - RNA, 64 nt, hsa
ugcaggcuccugguuguuccucucaaaccugugcugaccaaagauuaguaaccaguuauaccca

SEQ ID NO: 355320 - RNA, 64 nt, hsa
ucuucucaacccaagaaccuguuuccuggaccagugaccaaaccucauaugugaaauggccaaa

SEQ ID NO: 355321 - RNA, 64 nt, hsa
gacuagcccaauuauccuuauaaauugaauauggugaccaaaugcuuugauaucauacuacucu

SEQ ID NO: 355322 - RNA, 64 nt, hsa
cauuugaaaguuccaugcagcuuuagcacagaguugaccaaacacuggcguaaguucaauuuac

SEQ ID NO: 355323 - RNA, 63 nt, hsa
acaucccuaugaaguugaaaaauaaaguuaauuuugaccaaaagacuucauuuguaacccaug

SEQ ID NO: 355324 - RNA, 64 nt, hsa
auuucaaguuuaauaaaauagcaauuagcagaagugaccaaauugggagauaauuaucagucau

SEQ ID NO: 355325 - RNA, 64 nt, hsa
acagggguuggcugggaggaggaagaccauucugugaccaaaauaccuuggucauuuuuuuuau

SEQ ID NO: 355326 - RNA, 64 nt, hsa
cauuuuuuugaaugaguuuuuuaaauuuuuuagaugaccaaaacuugcagggcaggggaugccc

SEQ ID NO: 355327 - RNA, 64 nt, hsa
gaggaccccaagagcagugauucagagaacagugugaccaaaaacccacuaagaaaaacagauu

SEQ ID NO: 355328 - RNA, 64 nt, hsa
gugaugccauggaacucaagcccaacggcggugcugaccaaaaaugucucaaagucaacagccc

SEQ ID NO: 355329 - RNA, 64 nt, hsa
uggaugaggagggaaaacucugccaaauggaaaaugaccaaauuuaagagggugggacaguccc

SEQ ID NO: 355330 - RNA, 64 nt, hsa
augcccugccuaccuucugaaauguuuaccccauugaccaaacuuggcuccagccauugcggug

SEQ ID NO: 355331 - RNA, 64 nt, hsa
aaauauccauauauauuucuauaaaaaaaguguuugaccaaaguaggucugcagcuauuucaac

SEQ ID NO: 355332 - RNA, 64 nt, hsa
caggaguccaauuaugggcagaaucugcucucugugaccaaaagaggaugugcacugcuucacg

SEQ ID NO: 355333 - RNA, 64 nt, hsa
cauuggaauuggaagaacuauaaagugugauucgaucgucaagacaucacuuggauuucuuaau

SEQ ID NO: 355334 - RNA, 64 nt, hsa
gacuugcaggaagaugaugauaacggcgaugugaaucgucaaagguacgggccagcuugugccu

SEQ ID NO: 355335 - RNA, 64 nt, hsa
aguaaaggacgaggucauuagccauauuguauauaucgucaagcaacacacacaaaaguuccuc

SEQ ID NO: 355336 - RNA, 64 nt, hsa
ggaaaaaaagauuuugguugagacuaaauuacucaucgucaaaauaaugucaaaauaguuuugg

SEQ ID NO: 355337 - RNA, 64 nt, hsa
guugggauuggggggagggccaugggagggguacaucgucaacauagccgauccuguuacauuu

SEQ ID NO: 355338 - RNA, 63 nt, hsa
caaaagaucaacaaaaaugaaguuuaucuggggaucgucaaaucuuuuucaaauuuaauguau

SEQ ID NO: 355339 - RNA, 64 nt, hsa
uuauuuucuucugacuuagaauauaagucucgccaucgucaaagagaaacuuugaaggagcagg

SEQ ID NO: 355340 - RNA, 64 nt, hsa
uguugcccucuccuuccauucacuagaggaucgcaucgucaaaagauuuuugcuuggaauaagc

SEQ ID NO: 355341 - RNA, 64 nt, hsa
accucucccccacccccgacuccgugguuuccguaucgucaacccuucagccgccgacccggga

SEQ ID NO: 355342 - RNA, 64 nt, hsa
accguuugcugggcuauuccccugcagugcagacaucgucaaaauucagacaagaggaaauuuu

SEQ ID NO: 355343 - RNA, 64 nt, hsa
ugccucccuugcagcaagcacuacaauguaugugaucgucaaugugaauagcuuagaauacugc

SEQ ID NO: 355344 - RNA, 58 nt, hsa
ugccaagaagaaggagauaaacaugaccaucgucaaagaccugcucaagaaauuuuua

SEQ ID NO: 355345 - RNA, 58 nt, hsa
ugccaagaagaaggagauaaacaucaccaucgucaaagagcugcugaagaaauuuuua

SEQ ID NO: 355346 - RNA, 64 nt, hsa
aaguuugcgcccucauaagcagcgaccuuguggcaucgucaaaaggaagggauugguuuggcaa

SEQ ID NO: 355347 - RNA, 64 nt, hsa
augcccuccuggugccccuggcacugaggcacagaucgucaaggcagguacccccucaacccuu

SEQ ID NO: 355348 - RNA, 64 nt, hsa
cuuuccucuucgguuuuacaguggcuuccgugggaucgucaauuucuuguucuuagaguuucgg

SEQ ID NO: 355349 - RNA, 57 nt, hsa
ccauuacagauuuuuccugaagaacacaucgucaauaaaucaccugcacccaaaucu

SEQ ID NO: 355350 - RNA, 64 nt, hsa
cagauguauuuuugauuucagggaauucuuuaguaucgucaauggugccacauaaaacaugucc

SEQ ID NO: 355351 - RNA, 64 nt, hsa
agucuguuuucucugagcauguuggccaacuaguaucgucaaauuauugaguggaucaucucuu

SEQ ID NO: 355352 - RNA, 64 nt, hsa
gcuuugauucgaagggucuuaaagaauuuuuuuaaucgucaaccacuuuuaaacauaaagaauu

SEQ ID NO: 355353 - RNA, 64 nt, hsa; identical to SEQ ID NO: 169257

SEQ ID NO: 355354 - RNA, 64 nt, hsa; identical to SEQ ID NO: 169258

SEQ ID NO: 355355 - RNA, 64 nt, hsa; identical to SEQ ID NO: 169259

SEQ ID NO: 355356 - RNA, 64 nt, hsa; identical to SEQ ID NO: 169260

SEQ ID NO: 355357 - RNA, 64 nt, hsa; identical to SEQ ID NO: 169261

SEQ ID NO: 355358 - RNA, 64 nt, hsa; identical to SEQ ID NO: 169262

SEQ ID NO: 355359 - RNA, 64 nt, hsa; identical to SEQ ID NO: 169263

SEQ ID NO: 355360 - RNA, 64 nt, hsa; identical to SEQ ID NO: 169264

SEQ ID NO: 355361 - RNA, 64 nt, hsa; identical to SEQ ID NO: 169265

SEQ ID NO: 355362 - RNA, 64 nt, hsa; identical to SEQ ID NO: 169266

SEQ ID NO: 355363 - RNA, 64 nt, hsa; identical to SEQ ID NO: 169267

SEQ ID NO: 355364 - RNA, 64 nt, hsa; identical to SEQ ID NO: 169268

SEQ ID NO: 355365 - RNA, 64 nt, hsa; identical to SEQ ID NO: 169269

SEQ ID NO: 355366 - RNA, 64 nt, hsa; identical to SEQ ID NO: 169270

SEQ ID NO: 355367 - RNA, 64 nt, hsa; identical to SEQ ID NO: 169271

SEQ ID NO: 355368 - RNA, 64 nt, hsa; identical to SEQ ID NO: 169272

SEQ ID NO: 355369 - RNA, 64 nt, hsa; identical to SEQ ID NO: 169273

SEQ ID NO: 355370 - RNA, 64 nt, hsa; identical to SEQ ID NO: 169274

SEQ ID NO: 355371 - RNA, 64 nt, hsa; identical to SEQ ID NO: 169275

SEQ ID NO: 355372 - RNA, 64 nt, hsa; identical to SEQ ID NO: 169276

SEQ ID NO: 355373 - RNA, 64 nt, hsa; identical to SEQ ID NO: 169277

SEQ ID NO: 355374 - RNA, 64 nt, hsa; identical to SEQ ID NO: 169278

SEQ ID NO: 355375 - RNA, 64 nt, hsa; identical to SEQ ID NO: 169279

SEQ ID NO: 355376 - RNA, 64 nt, hsa
ccuccacccaccccucucccaaccucucuccccgccccuguauccugcauuccuccacccaccc

SEQ ID NO: 355377 - RNA, 64 nt, hsa
acucccaccccucccacaaccccuguaccucccaccccuguauccccaccccuccacccacccc

SEQ ID NO: 355378 - RNA, 64 nt, hsa
guauccccaccccguacucccaccccucccacaaccccuguaccucccaccccuguauccccac

SEQ ID NO: 355379 - RNA, 64 nt, hsa
gccgacgggggcagcugccccaucccucccccaaccccuguauccccaccccguacucccaccc

SEQ ID NO: 355380 - RNA, 64 nt, hsa
ugucuucuguccccaucuuccugccgauagcuauccccuguaugauguuggaugcuccucacau

SEQ ID NO: 355381 - RNA, 64 nt, hsa
ucgucccuacuuccuccucccugcuuccucuccuccccuguacgugccccagcauucugggguu

SEQ ID NO: 355382 - RNA, 64 nt, hsa
cuugucugaccuuaaugcaagcagucuguuugaaccccuguaggcugcauucaggagacagaag

SEQ ID NO: 355383 - RNA, 64 nt, hsa
uagcauuaguagcuucuguggggggaucccagagccccuguauuuauuuucccuguguuugucu

SEQ ID NO: 355384 - RNA, 64 nt, hsa
accccaccccacagcagggcuccuggcccccaccccccuguacauaauuuuuaaaaccuuuuuu

SEQ ID NO: 355385 - RNA, 64 nt, hsa
ccaaagacaggguugugccuuaccccaggagccaccccuguaccccccuugcccugccauucac

SEQ ID NO: 355386 - RNA, 64 nt, hsa
uccuuacagucucuagaauuaaauguacucauuuagacaacauauuaaaugcauauuuuagcca

SEQ ID NO: 355387 - RNA, 64 nt, hsa
uauaaaagccaauggaauucaaauaggagcuaggagacaacaaguuauauaugacaguggaggu

SEQ ID NO: 355388 - RNA, 64 nt, hsa
ugucugacuccuaauuaauaacauguuuuuggcaagacaacagauugagguuagaggaucagua

SEQ ID NO: 355389 - RNA, 64 nt, hsa
acaccauuggaaaguggauauauuagauugugagagacaacaguugccuccuuuugacaaauac

SEQ ID NO: 355390 - RNA, 64 nt, hsa
uuuguaauugagagcucauuucaaaagcagaaaaagacaacaaauauuaaagcaaggaaaagug

SEQ ID NO: 355391 - RNA, 64 nt, hsa
aucauuccagaaggaaaagugugucagggcaagcagacaacacaauuuccuaucagaauauguc

SEQ ID NO: 355392 - RNA, 64 nt, hsa
agagcacagaauacuguucucagaccaugaaaccagacaacacauguauugguuuaaacucgau

SEQ ID NO: 355393 - RNA, 64 nt, hsa
ugaaagcuuuagcacuuuuuugccccuacauaugagacaacauauuuuguauuucacucaaggc

SEQ ID NO: 355394 - RNA, 64 nt, hsa; identical to SEQ ID NO: 294474

SEQ ID NO: 355395 - RNA, 64 nt, hsa; identical to SEQ ID NO: 294475

SEQ ID NO: 355396 - RNA, 64 nt, hsa; identical to SEQ ID NO: 294476

SEQ ID NO: 355397 - RNA, 64 nt, hsa; identical to SEQ ID NO: 294477

SEQ ID NO: 355398 - RNA, 64 nt, hsa; identical to SEQ ID NO: 294478

SEQ ID NO: 355399 - RNA, 64 nt, hsa; identical to SEQ ID NO: 294479

SEQ ID NO: 355400 - RNA, 64 nt, hsa; identical to SEQ ID NO: 110917

SEQ ID NO: 355401 - RNA, 64 nt, hsa; identical to SEQ ID NO: 110918

SEQ ID NO: 355402 - RNA, 64 nt, hsa; identical to SEQ ID NO: 110919

SEQ ID NO: 355403 - RNA, 64 nt, hsa; identical to SEQ ID NO: 110920

SEQ ID NO: 355404 - RNA, 64 nt, hsa; identical to SEQ ID NO: 110921

SEQ ID NO: 355405 - RNA, 64 nt, hsa; identical to SEQ ID NO: 110922

SEQ ID NO: 355406 - RNA, 64 nt, hsa; identical to SEQ ID NO: 110923

SEQ ID NO: 355407 - RNA, 64 nt, hsa; identical to SEQ ID NO: 110924

SEQ ID NO: 355408 - RNA, 64 nt, hsa; identical to SEQ ID NO: 110925

SEQ ID NO: 355409 - RNA, 64 nt, hsa; identical to SEQ ID NO: 110926

SEQ ID NO: 355410 - RNA, 64 nt, hsa; identical to SEQ ID NO: 110927

SEQ ID NO: 355411 - RNA, 64 nt, hsa; identical to SEQ ID NO: 110928

SEQ ID NO: 355412 - RNA, 61 nt, hsa; identical to SEQ ID NO: 110929

SEQ ID NO: 355413 - RNA, 64 nt, hsa; identical to SEQ ID NO: 110930

SEQ ID NO: 355414 - RNA, 64 nt, hsa; identical to SEQ ID NO: 110931

SEQ ID NO: 355415 - RNA, 64 nt, hsa; identical to SEQ ID NO: 110932

SEQ ID NO: 355416 - RNA, 64 nt, hsa; identical to SEQ ID NO: 110933

SEQ ID NO: 355417 - RNA, 64 nt, hsa; identical to SEQ ID NO: 110934

SEQ ID NO: 355418 - RNA, 64 nt, hsa; identical to SEQ ID NO: 110935

SEQ ID NO: 355419 - RNA, 64 nt, hsa; identical to SEQ ID NO: 110936

SEQ ID NO: 355420 - RNA, 64 nt, hsa; identical to SEQ ID NO: 110937

SEQ ID NO: 355421 - RNA, 64 nt, hsa; identical to SEQ ID NO: 110938

SEQ ID NO: 355422 - RNA, 64 nt, hsa; identical to SEQ ID NO: 110939

SEQ ID NO: 355423 - RNA, 64 nt, hsa; identical to SEQ ID NO: 110940

SEQ ID NO: 355424 - RNA, 64 nt, hsa; identical to SEQ ID NO: 110941

SEQ ID NO: 355425 - RNA, 64 nt, hsa; identical to SEQ ID NO: 110942

SEQ ID NO: 355426 - RNA, 64 nt, hsa; identical to SEQ ID NO: 110943

SEQ ID NO: 355427 - RNA, 64 nt, hsa; identical to SEQ ID NO: 110944

SEQ ID NO: 355428 - RNA, 64 nt, hsa; identical to SEQ ID NO: 110945

SEQ ID NO: 355429 - RNA, 64 nt, hsa; identical to SEQ ID NO: 110946

SEQ ID NO: 355430 - RNA, 64 nt, hsa; identical to SEQ ID NO: 110947

SEQ ID NO: 355431 - RNA, 64 nt, hsa; identical to SEQ ID NO: 110948

SEQ ID NO: 355432 - RNA, 64 nt, hsa; identical to SEQ ID NO: 110949

SEQ ID NO: 355433 - RNA, 64 nt, hsa; identical to SEQ ID NO: 110950

SEQ ID NO: 355434 - RNA, 64 nt, hsa; identical to SEQ ID NO: 110951

SEQ ID NO: 355435 - RNA, 64 nt, hsa; identical to SEQ ID NO: 110952

SEQ ID NO: 355436 - RNA, 64 nt, hsa; identical to SEQ ID NO: 110953

SEQ ID NO: 355437 - RNA, 64 nt, hsa; identical to SEQ ID NO: 110954

SEQ ID NO: 355438 - RNA, 64 nt, hsa; identical to SEQ ID NO: 110955

SEQ ID NO: 355439 - RNA, 64 nt, hsa; identical to SEQ ID NO: 110956

SEQ ID NO: 355440 - RNA, 64 nt, hsa; identical to SEQ ID NO: 110957

SEQ ID NO: 355441 - RNA, 64 nt, hsa; identical to SEQ ID NO: 110958

SEQ ID NO: 355442 - RNA, 64 nt, hsa; identical to SEQ ID NO: 110959

SEQ ID NO: 355443 - RNA, 64 nt, hsa; identical to SEQ ID NO: 110960

SEQ ID NO: 355444 - RNA, 64 nt, hsa; identical to SEQ ID NO: 110961

SEQ ID NO: 355445 - RNA, 64 nt, hsa; identical to SEQ ID NO: 110962

SEQ ID NO: 355446 - RNA, 64 nt, hsa; identical to SEQ ID NO: 110963

SEQ ID NO: 355447 - RNA, 64 nt, hsa; identical to SEQ ID NO: 110964

SEQ ID NO: 355448 - RNA, 64 nt, hsa; identical to SEQ ID NO: 110965

SEQ ID NO: 355449 - RNA, 64 nt, hsa; identical to SEQ ID NO: 110966

SEQ ID NO: 355450 - RNA, 64 nt, hsa; identical to SEQ ID NO: 110967

SEQ ID NO: 355451 - RNA, 64 nt, hsa; identical to SEQ ID NO: 110968

SEQ ID NO: 355452 - RNA, 64 nt, hsa; identical to SEQ ID NO: 110969

SEQ ID NO: 355453 - RNA, 64 nt, hsa; identical to SEQ ID NO: 110970

SEQ ID NO: 355454 - RNA, 64 nt, hsa; identical to SEQ ID NO: 110971

SEQ ID NO: 355455 - RNA, 64 nt, hsa; identical to SEQ ID NO: 110972

SEQ ID NO: 355456 - RNA, 64 nt, hsa; identical to SEQ ID NO: 110973

SEQ ID NO: 355457 - RNA, 64 nt, hsa; identical to SEQ ID NO: 110974

SEQ ID NO: 355458 - RNA, 64 nt, hsa; identical to SEQ ID NO: 110975

SEQ ID NO: 355459 - RNA, 64 nt, hsa; identical to SEQ ID NO: 110976

SEQ ID NO: 355460 - RNA, 64 nt, hsa; identical to SEQ ID NO: 110977

SEQ ID NO: 355461 - RNA, 64 nt, hsa; identical to SEQ ID NO: 110978

SEQ ID NO: 355462 - RNA, 64 nt, hsa; identical to SEQ ID NO: 110979

SEQ ID NO: 355463 - RNA, 64 nt, hsa; identical to SEQ ID NO: 110980

SEQ ID NO: 355464 - RNA, 64 nt, hsa; identical to SEQ ID NO: 110917

SEQ ID NO: 355465 - RNA, 64 nt, hsa; identical to SEQ ID NO: 110918

SEQ ID NO: 355466 - RNA, 64 nt, hsa; identical to SEQ ID NO: 110919

SEQ ID NO: 355467 - RNA, 64 nt, hsa; identical to SEQ ID NO: 110920

SEQ ID NO: 355468 - RNA, 64 nt, hsa; identical to SEQ ID NO: 110921

SEQ ID NO: 355469 - RNA, 64 nt, hsa; identical to SEQ ID NO: 110922

SEQ ID NO: 355470 - RNA, 64 nt, hsa; identical to SEQ ID NO: 110923

SEQ ID NO: 355471 - RNA, 64 nt, hsa; identical to SEQ ID NO: 110924

SEQ ID NO: 355472 - RNA, 64 nt, hsa; identical to SEQ ID NO: 110925

SEQ ID NO: 355473 - RNA, 64 nt, hsa; identical to SEQ ID NO: 110926

SEQ ID NO: 355474 - RNA, 64 nt, hsa; identical to SEQ ID NO: 110927

SEQ ID NO: 355475 - RNA, 64 nt, hsa; identical to SEQ ID NO: 110928

SEQ ID NO: 355476 - RNA, 61 nt, hsa; identical to SEQ ID NO: 110929

SEQ ID NO: 355477 - RNA, 64 nt, hsa; identical to SEQ ID NO: 110930

SEQ ID NO: 355478 - RNA, 64 nt, hsa; identical to SEQ ID NO: 110931

SEQ ID NO: 355479 - RNA, 64 nt, hsa; identical to SEQ ID NO: 110932

SEQ ID NO: 355480 - RNA, 64 nt, hsa; identical to SEQ ID NO: 110933

SEQ ID NO: 355481 - RNA, 64 nt, hsa; identical to SEQ ID NO: 110934

SEQ ID NO: 355482 - RNA, 64 nt, hsa; identical to SEQ ID NO: 110935

SEQ ID NO: 355483 - RNA, 64 nt, hsa; identical to SEQ ID NO: 110936

SEQ ID NO: 355484 - RNA, 64 nt, hsa; identical to SEQ ID NO: 110937

SEQ ID NO: 355485 - RNA, 64 nt, hsa; identical to SEQ ID NO: 110938

SEQ ID NO: 355486 - RNA, 64 nt, hsa; identical to SEQ ID NO: 110939

SEQ ID NO: 355487 - RNA, 64 nt, hsa; identical to SEQ ID NO: 110940

SEQ ID NO: 355488 - RNA, 64 nt, hsa; identical to SEQ ID NO: 110941

SEQ ID NO: 355489 - RNA, 64 nt, hsa; identical to SEQ ID NO: 110942

SEQ ID NO: 355490 - RNA, 64 nt, hsa; identical to SEQ ID NO: 110943

SEQ ID NO: 355491 - RNA, 64 nt, hsa; identical to SEQ ID NO: 110944

SEQ ID NO: 355492 - RNA, 64 nt, hsa; identical to SEQ ID NO: 110945

SEQ ID NO: 355493 - RNA, 64 nt, hsa; identical to SEQ ID NO: 110946

SEQ ID NO: 355494 - RNA, 64 nt, hsa; identical to SEQ ID NO: 110947

SEQ ID NO: 355495 - RNA, 64 nt, hsa; identical to SEQ ID NO: 110948

SEQ ID NO: 355496 - RNA, 64 nt, hsa; identical to SEQ ID NO: 110949

SEQ ID NO: 355497 - RNA, 64 nt, hsa; identical to SEQ ID NO: 110950

SEQ ID NO: 355498 - RNA, 64 nt, hsa; identical to SEQ ID NO: 110951

SEQ ID NO: 355499 - RNA, 64 nt, hsa; identical to SEQ ID NO: 110952

SEQ ID NO: 355500 - RNA, 64 nt, hsa; identical to SEQ ID NO: 110953

SEQ ID NO: 355501 - RNA, 64 nt, hsa; identical to SEQ ID NO: 110954

SEQ ID NO: 355502 - RNA, 64 nt, hsa; identical to SEQ ID NO: 110955

SEQ ID NO: 355503 - RNA, 64 nt, hsa; identical to SEQ ID NO: 110956

SEQ ID NO: 355504 - RNA, 64 nt, hsa; identical to SEQ ID NO: 110957

SEQ ID NO: 355505 - RNA, 64 nt, hsa; identical to SEQ ID NO: 110958

SEQ ID NO: 355506 - RNA, 64 nt, hsa; identical to SEQ ID NO: 110959

SEQ ID NO: 355507 - RNA, 64 nt, hsa; identical to SEQ ID NO: 110960

SEQ ID NO: 355508 - RNA, 64 nt, hsa; identical to SEQ ID NO: 110961

SEQ ID NO: 355509 - RNA, 64 nt, hsa; identical to SEQ ID NO: 110962

SEQ ID NO: 355510 - RNA, 64 nt, hsa; identical to SEQ ID NO: 110963

SEQ ID NO: 355511 - RNA, 64 nt, hsa; identical to SEQ ID NO: 110964

SEQ ID NO: 355512 - RNA, 64 nt, hsa; identical to SEQ ID NO: 110965

SEQ ID NO: 355513 - RNA, 64 nt, hsa; identical to SEQ ID NO: 110966

SEQ ID NO: 355514 - RNA, 64 nt, hsa; identical to SEQ ID NO: 110967

SEQ ID NO: 355515 - RNA, 64 nt, hsa; identical to SEQ ID NO: 110968

SEQ ID NO: 355516 - RNA, 64 nt, hsa; identical to SEQ ID NO: 110969

SEQ ID NO: 355517 - RNA, 64 nt, hsa; identical to SEQ ID NO: 110970

SEQ ID NO: 355518 - RNA, 64 nt, hsa; identical to SEQ ID NO: 110971

SEQ ID NO: 355519 - RNA, 64 nt, hsa; identical to SEQ ID NO: 110972

SEQ ID NO: 355520 - RNA, 64 nt, hsa; identical to SEQ ID NO: 110973

SEQ ID NO: 355521 - RNA, 64 nt, hsa; identical to SEQ ID NO: 110974

SEQ ID NO: 355522 - RNA, 64 nt, hsa; identical to SEQ ID NO: 110975

SEQ ID NO: 355523 - RNA, 64 nt, hsa; identical to SEQ ID NO: 110976

SEQ ID NO: 355524 - RNA, 64 nt, hsa; identical to SEQ ID NO: 110977

SEQ ID NO: 355525 - RNA, 64 nt, hsa; identical to SEQ ID NO: 110978

SEQ ID NO: 355526 - RNA, 64 nt, hsa; identical to SEQ ID NO: 110979

SEQ ID NO: 355527 - RNA, 64 nt, hsa; identical to SEQ ID NO: 110980

SEQ ID NO: 355528 - RNA, 64 nt, hsa; identical to SEQ ID NO: 110917

SEQ ID NO: 355529 - RNA, 64 nt, hsa; identical to SEQ ID NO: 110918

SEQ ID NO: 355530 - RNA, 64 nt, hsa; identical to SEQ ID NO: 110919

SEQ ID NO: 355531 - RNA, 64 nt, hsa; identical to SEQ ID NO: 110920

SEQ ID NO: 355532 - RNA, 64 nt, hsa; identical to SEQ ID NO: 110921

SEQ ID NO: 355533 - RNA, 64 nt, hsa; identical to SEQ ID NO: 110922

SEQ ID NO: 355534 - RNA, 64 nt, hsa; identical to SEQ ID NO: 110923

SEQ ID NO: 355535 - RNA, 64 nt, hsa; identical to SEQ ID NO: 110924

SEQ ID NO: 355536 - RNA, 64 nt, hsa; identical to SEQ ID NO: 110925

SEQ ID NO: 355537 - RNA, 64 nt, hsa; identical to SEQ ID NO: 110926

SEQ ID NO: 355538 - RNA, 64 nt, hsa; identical to SEQ ID NO: 110927

SEQ ID NO: 355539 - RNA, 64 nt, hsa; identical to SEQ ID NO: 110928

SEQ ID NO: 355540 - RNA, 61 nt, hsa; identical to SEQ ID NO: 110929

SEQ ID NO: 355541 - RNA, 64 nt, hsa; identical to SEQ ID NO: 110930

SEQ ID NO: 355542 - RNA, 64 nt, hsa; identical to SEQ ID NO: 110931

SEQ ID NO: 355543 - RNA, 64 nt, hsa; identical to SEQ ID NO: 110932

SEQ ID NO: 355544 - RNA, 64 nt, hsa; identical to SEQ ID NO: 110933

SEQ ID NO: 355545 - RNA, 64 nt, hsa; identical to SEQ ID NO: 110934

SEQ ID NO: 355546 - RNA, 64 nt, hsa; identical to SEQ ID NO: 110935

SEQ ID NO: 355547 - RNA, 64 nt, hsa; identical to SEQ ID NO: 110936

SEQ ID NO: 355548 - RNA, 64 nt, hsa; identical to SEQ ID NO: 110937

SEQ ID NO: 355549 - RNA, 64 nt, hsa; identical to SEQ ID NO: 110938

SEQ ID NO: 355550 - RNA, 64 nt, hsa; identical to SEQ ID NO: 110939

SEQ ID NO: 355551 - RNA, 64 nt, hsa; identical to SEQ ID NO: 110940

SEQ ID NO: 355552 - RNA, 64 nt, hsa; identical to SEQ ID NO: 110941

SEQ ID NO: 355553 - RNA, 64 nt, hsa; identical to SEQ ID NO: 110942

SEQ ID NO: 355554 - RNA, 64 nt, hsa; identical to SEQ ID NO: 110943

SEQ ID NO: 355555 - RNA, 64 nt, hsa; identical to SEQ ID NO: 110944

SEQ ID NO: 355556 - RNA, 64 nt, hsa; identical to SEQ ID NO: 110945

SEQ ID NO: 355557 - RNA, 64 nt, hsa; identical to SEQ ID NO: 110946

SEQ ID NO: 355558 - RNA, 64 nt, hsa; identical to SEQ ID NO: 110947

SEQ ID NO: 355559 - RNA, 64 nt, hsa; identical to SEQ ID NO: 110948

SEQ ID NO: 355560 - RNA, 64 nt, hsa; identical to SEQ ID NO: 110949

SEQ ID NO: 355561 - RNA, 64 nt, hsa; identical to SEQ ID NO: 110950

SEQ ID NO: 355562 - RNA, 64 nt, hsa; identical to SEQ ID NO: 110951

SEQ ID NO: 355563 - RNA, 64 nt, hsa; identical to SEQ ID NO: 110952

SEQ ID NO: 355564 - RNA, 64 nt, hsa; identical to SEQ ID NO: 110953

SEQ ID NO: 355565 - RNA, 64 nt, hsa; identical to SEQ ID NO: 110954

SEQ ID NO: 355566 - RNA, 64 nt, hsa; identical to SEQ ID NO: 110955

SEQ ID NO: 355567 - RNA, 64 nt, hsa; identical to SEQ ID NO: 110956

SEQ ID NO: 355568 - RNA, 64 nt, hsa; identical to SEQ ID NO: 110957

SEQ ID NO: 355569 - RNA, 64 nt, hsa; identical to SEQ ID NO: 110958

SEQ ID NO: 355570 - RNA, 64 nt, hsa; identical to SEQ ID NO: 110959

SEQ ID NO: 355571 - RNA, 64 nt, hsa; identical to SEQ ID NO: 110960

SEQ ID NO: 355572 - RNA, 64 nt, hsa; identical to SEQ ID NO: 110961

SEQ ID NO: 355573 - RNA, 64 nt, hsa; identical to SEQ ID NO: 110962

SEQ ID NO: 355574 - RNA, 64 nt, hsa; identical to SEQ ID NO: 110963

SEQ ID NO: 355575 - RNA, 64 nt, hsa; identical to SEQ ID NO: 110964

SEQ ID NO: 355576 - RNA, 64 nt, hsa; identical to SEQ ID NO: 110965

SEQ ID NO: 355577 - RNA, 64 nt, hsa; identical to SEQ ID NO: 110966

SEQ ID NO: 355578 - RNA, 64 nt, hsa; identical to SEQ ID NO: 110967

SEQ ID NO: 355579 - RNA, 64 nt, hsa; identical to SEQ ID NO: 110968

SEQ ID NO: 355580 - RNA, 64 nt, hsa; identical to SEQ ID NO: 110969

SEQ ID NO: 355581 - RNA, 64 nt, hsa; identical to SEQ ID NO: 110970

SEQ ID NO: 355582 - RNA, 64 nt, hsa; identical to SEQ ID NO: 110971

SEQ ID NO: 355583 - RNA, 64 nt, hsa; identical to SEQ ID NO: 110972

SEQ ID NO: 355584 - RNA, 64 nt, hsa; identical to SEQ ID NO: 110973

SEQ ID NO: 355585 - RNA, 64 nt, hsa; identical to SEQ ID NO: 110974

SEQ ID NO: 355586 - RNA, 64 nt, hsa; identical to SEQ ID NO: 110975

SEQ ID NO: 355587 - RNA, 64 nt, hsa; identical to SEQ ID NO: 110976

SEQ ID NO: 355588 - RNA, 64 nt, hsa; identical to SEQ ID NO: 110977

SEQ ID NO: 355589 - RNA, 64 nt, hsa; identical to SEQ ID NO: 110978

SEQ ID NO: 355590 - RNA, 64 nt, hsa; identical to SEQ ID NO: 110979

SEQ ID NO: 355591 - RNA, 64 nt, hsa; identical to SEQ ID NO: 110980

SEQ ID NO: 355592 - RNA, 64 nt, hsa; identical to SEQ ID NO: 110917

SEQ ID NO: 355593 - RNA, 64 nt, hsa; identical to SEQ ID NO: 110918

SEQ ID NO: 355594 - RNA, 64 nt, hsa; identical to SEQ ID NO: 110919

SEQ ID NO: 355595 - RNA, 64 nt, hsa; identical to SEQ ID NO: 110920

SEQ ID NO: 355596 - RNA, 64 nt, hsa; identical to SEQ ID NO: 110921

SEQ ID NO: 355597 - RNA, 64 nt, hsa; identical to SEQ ID NO: 110922

SEQ ID NO: 355598 - RNA, 64 nt, hsa; identical to SEQ ID NO: 110923

SEQ ID NO: 355599 - RNA, 64 nt, hsa; identical to SEQ ID NO: 110924

SEQ ID NO: 355600 - RNA, 64 nt, hsa; identical to SEQ ID NO: 110925

SEQ ID NO: 355601 - RNA, 64 nt, hsa; identical to SEQ ID NO: 110926

SEQ ID NO: 355602 - RNA, 64 nt, hsa; identical to SEQ ID NO: 110927

SEQ ID NO: 355603 - RNA, 64 nt, hsa; identical to SEQ ID NO: 110928

SEQ ID NO: 355604 - RNA, 61 nt, hsa; identical to SEQ ID NO: 110929

SEQ ID NO: 355605 - RNA, 64 nt, hsa; identical to SEQ ID NO: 110930

SEQ ID NO: 355606 - RNA, 64 nt, hsa; identical to SEQ ID NO: 110931

SEQ ID NO: 355607 - RNA, 64 nt, hsa; identical to SEQ ID NO: 110932

SEQ ID NO: 355608 - RNA, 64 nt, hsa; identical to SEQ ID NO: 110933

SEQ ID NO: 355609 - RNA, 64 nt, hsa; identical to SEQ ID NO: 110934

SEQ ID NO: 355610 - RNA, 64 nt, hsa; identical to SEQ ID NO: 110935

SEQ ID NO: 355611 - RNA, 64 nt, hsa; identical to SEQ ID NO: 110936

SEQ ID NO: 355612 - RNA, 64 nt, hsa; identical to SEQ ID NO: 110937

SEQ ID NO: 355613 - RNA, 64 nt, hsa; identical to SEQ ID NO: 110938

SEQ ID NO: 355614 - RNA, 64 nt, hsa; identical to SEQ ID NO: 110939

SEQ ID NO: 355615 - RNA, 64 nt, hsa; identical to SEQ ID NO: 110940

SEQ ID NO: 355616 - RNA, 64 nt, hsa; identical to SEQ ID NO: 110941

SEQ ID NO: 355617 - RNA, 64 nt, hsa; identical to SEQ ID NO: 110942

SEQ ID NO: 355618 - RNA, 64 nt, hsa; identical to SEQ ID NO: 110943

SEQ ID NO: 355619 - RNA, 64 nt, hsa; identical to SEQ ID NO: 110944

SEQ ID NO: 355620 - RNA, 64 nt, hsa; identical to SEQ ID NO: 110945

SEQ ID NO: 355621 - RNA, 64 nt, hsa; identical to SEQ ID NO: 110946

SEQ ID NO: 355622 - RNA, 64 nt, hsa; identical to SEQ ID NO: 110947

SEQ ID NO: 355623 - RNA, 64 nt, hsa; identical to SEQ ID NO: 110948

SEQ ID NO: 355624 - RNA, 64 nt, hsa; identical to SEQ ID NO: 110949

SEQ ID NO: 355625 - RNA, 64 nt, hsa; identical to SEQ ID NO: 110950

SEQ ID NO: 355626 - RNA, 64 nt, hsa; identical to SEQ ID NO: 110951

SEQ ID NO: 355627 - RNA, 64 nt, hsa; identical to SEQ ID NO: 110952

SEQ ID NO: 355628 - RNA, 64 nt, hsa; identical to SEQ ID NO: 110953

SEQ ID NO: 355629 - RNA, 64 nt, hsa; identical to SEQ ID NO: 110954

SEQ ID NO: 355630 - RNA, 64 nt, hsa; identical to SEQ ID NO: 110955

SEQ ID NO: 355631 - RNA, 64 nt, hsa; identical to SEQ ID NO: 110956

SEQ ID NO: 355632 - RNA, 64 nt, hsa; identical to SEQ ID NO: 110957

SEQ ID NO: 355633 - RNA, 64 nt, hsa; identical to SEQ ID NO: 110958

SEQ ID NO: 355634 - RNA, 64 nt, hsa; identical to SEQ ID NO: 110959

SEQ ID NO: 355635 - RNA, 64 nt, hsa; identical to SEQ ID NO: 110960

SEQ ID NO: 355636 - RNA, 64 nt, hsa; identical to SEQ ID NO: 110961

SEQ ID NO: 355637 - RNA, 64 nt, hsa; identical to SEQ ID NO: 110962

SEQ ID NO: 355638 - RNA, 64 nt, hsa; identical to SEQ ID NO: 110963

SEQ ID NO: 355639 - RNA, 64 nt, hsa; identical to SEQ ID NO: 110964

SEQ ID NO: 355640 - RNA, 64 nt, hsa; identical to SEQ ID NO: 110965

SEQ ID NO: 355641 - RNA, 64 nt, hsa; identical to SEQ ID NO: 110966

SEQ ID NO: 355642 - RNA, 64 nt, hsa; identical to SEQ ID NO: 110967

SEQ ID NO: 355643 - RNA, 64 nt, hsa; identical to SEQ ID NO: 110968

SEQ ID NO: 355644 - RNA, 64 nt, hsa; identical to SEQ ID NO: 110969

SEQ ID NO: 355645 - RNA, 64 nt, hsa; identical to SEQ ID NO: 110970

SEQ ID NO: 355646 - RNA, 64 nt, hsa; identical to SEQ ID NO: 110971

SEQ ID NO: 355647 - RNA, 64 nt, hsa; identical to SEQ ID NO: 110972

SEQ ID NO: 355648 - RNA, 64 nt, hsa; identical to SEQ ID NO: 110973

SEQ ID NO: 355649 - RNA, 64 nt, hsa; identical to SEQ ID NO: 110974

SEQ ID NO: 355650 - RNA, 64 nt, hsa; identical to SEQ ID NO: 110975

SEQ ID NO: 355651 - RNA, 64 nt, hsa; identical to SEQ ID NO: 110976

SEQ ID NO: 355652 - RNA, 64 nt, hsa; identical to SEQ ID NO: 110977

SEQ ID NO: 355653 - RNA, 64 nt, hsa; identical to SEQ ID NO: 110978

SEQ ID NO: 355654 - RNA, 64 nt, hsa; identical to SEQ ID NO: 110979

SEQ ID NO: 355655 - RNA, 64 nt, hsa; identical to SEQ ID NO: 110980

SEQ ID NO: 355656 - RNA, 64 nt, hsa
ugggggugcugaugcauccucaguuaaccuacacccaccugaauauagaugagcguagcugagu

SEQ ID NO: 355657 - RNA, 64 nt, hsa
gccggguggggaugggcaccaagaaucucucccaccaccugaauucuccaaggacucggguuuc

SEQ ID NO: 355658 - RNA, 64 nt, hsa
cuggccaccgagccaugguggaggagaugcagggccaccugaagcgggccuccaacgagagcac

SEQ ID NO: 355659 - RNA, 64 nt, hsa
gcccuuccuuauaggccaaaaagcaaauggauuuccaccugacaaaucuucgggauccaagaag

SEQ ID NO: 355660 - RNA, 64 nt, hsa
uucacuccuuuaacaaaaaccuugcuuccuuaucccaccugaucccagucugaaggucucuuag

SEQ ID NO: 355661 - RNA, 64 nt, hsa
ugucccccacccuauccccucuaacaccauuccuccaccugaugaugcaacuaacacuugccuc

SEQ ID NO: 355662 - RNA, 64 nt, hsa
ugcuccaagggagcguggucguggaagaaacaacccaccugaaggccaaaugccagagauuugg

SEQ ID NO: 355663 - RNA, 64 nt, hsa
gccagagauuugggguuggggaaagggccccuccccaccugacacccacuggggugcacuuuaa

SEQ ID NO: 355664 - RNA, 64 nt, hsa
gucugagauggcagggcacuugcccugguggcucccaccugaccccaggccuuuuauaggcagg

SEQ ID NO: 355665 - RNA, 64 nt, hsa
ggguguacggguucuguuccucugagccugcggcccaccugauguuuacgugugugugugaggg

SEQ ID NO: 355666 - RNA, 64 nt, hsa
cuuuguaaguaaacugcccugucuaggucaguacccaccugagcuuuggacgcacacagcuuuu

SEQ ID NO: 355667 - RNA, 64 nt, hsa
caccugagcuuuggacgcacacagcuuuuaguacccaccugagcuuuggacacacacagcuucu

SEQ ID NO: 355668 - RNA, 64 nt, hsa
auccuggugugagaaucaaccaggcuuuccugcuccaccugagauaaccaacucccucccguaa

SEQ ID NO: 355669 - RNA, 64 nt, hsa
ggcgccacagaggaagcugccugccggaggacccccaccugagagauggaugagcugcuccaaa

SEQ ID NO: 355670 - RNA, 64 nt, hsa
gaaaacccauccaguucuucagaaauugcuuucuaggcauuaauacuacuuuacuaucuauacu

SEQ ID NO: 355671 - RNA, 64 nt, hsa
gaugugguaagcggaaacagaagacaggcagcagaggcauuaaaaaugcauaccaugcuuucag

SEQ ID NO: 355672 - RNA, 64 nt, hsa
uauaguuuuaaauacauaaagaaauguuucaguuaggcauuaaccuugauagaaucacucaguu

SEQ ID NO: 355673 - RNA, 64 nt, hsa
ugauaauugccuauguucuagguaacaggaaaacaggcauuaaguuuauuuuagucuucccauu

SEQ ID NO: 355674 - RNA, 64 nt, hsa
ucaucuaaggaaaaaagacaagggaauuccagucaggcauuauuuuccuauuacuaguguuugc

SEQ ID NO: 355675 - RNA, 64 nt, hsa
cucuuucuuccuccuugauuuuccaucuugacgaaggcauuauauagaaucauuuuaaucacuu

SEQ ID NO: 355676 - RNA, 64 nt, hsa
cgcccccacccgucggcagagcaaccccaccuccaggcauuauggcuccuccaccugguaugag

SEQ ID NO: 355677 - RNA, 64 nt, hsa
gcaugccgccuccgggaaugagacccccuccaccaggcauuagaggugagugggagcauagggg

SEQ ID NO: 355678 - RNA, 64 nt, hsa
aacuugaagaacugcugguguuacauguuccaaaaggcauuagaccuaucagcuuuguuucgcc

SEQ ID NO: 355679 - RNA, 64 nt, hsa
caaauauauuaauuaucauuaaguauuaaauaauaggcauuagaugucuaaugugaguauaauu

SEQ ID NO: 355680 - RNA, 64 nt, hsa
ucacaguucacagguaaccauguuguguucuucuaggcauuacuggccuuuucacugacaaguu

SEQ ID NO: 355681 - RNA, 64 nt, hsa
gauaauugugcuuuacaacuugaaugcugauucaaggcauuauuuggaugugaguuuaaucuuu

SEQ ID NO: 355682 - RNA, 64 nt, hsa
uuggaugauggcagaaacuucaugaaccagcccuuucucagagccagugaugugaguguaucag

SEQ ID NO: 355683 - RNA, 64 nt, hsa
gcauaggccacgauaaaggaaggagagaaggggcuucucagacuuauuugcagaagggcccaga

SEQ ID NO: 355684 - RNA, 64 nt, hsa
gucaccccaaauggagacacucgcagaccugcaguucucagaccgaaggugcugccuucauccu

SEQ ID NO: 355685 - RNA, 64 nt, hsa
agaaaacgcuuuggaucugagcagaguagucaguuucucagacacucauuccauacugcaccgu

SEQ ID NO: 355686 - RNA, 64 nt, hsa
gucacacaacacugaugugacuuuuauaugcuuuuucucagaucugguuucuaagaguuuuggg

SEQ ID NO: 355687 - RNA, 64 nt, hsa
uacugucuauuaaaauucugauguuucugugaaauucucagaguguuuaauuguacucaauggu

SEQ ID NO: 355688 - RNA, 64 nt, hsa
aguuaacacaaucccaccaugagggauggguaaauucucagauuuccaaacugcuguacagagc

SEQ ID NO: 355689 - RNA, 64 nt, hsa
acucucaggauacccaguucccucauagccucuguucucagagaauuggaguuggcccaagaaa

SEQ ID NO: 355690 - RNA, 64 nt, hsa
cuuucaacaauguucucuaguuucaagcuccagcuucucagaaagaauuaaagaacuugcuguu

SEQ ID NO: 355691 - RNA, 64 nt, hsa
gaaaccugggacacgagucugugaauagucgguuuucucagaauaauuugaaucuguuuucuua

SEQ ID NO: 355692 - RNA, 64 nt, hsa
caaauccuaaaauuccugucccaagccacccaaauucucagaucuuuucuggaacaaggcagaa

SEQ ID NO: 355693 - RNA, 64 nt, hsa
cucccacagcugccuacaacagagucucccagccuucucagagagcuaaaaccagaaauuucca

SEQ ID NO: 355694 - RNA, 64 nt, hsa
gaaggaaggauucaccaccuccaggaaaagugucuucucagaaacaaccagcugagaagguaau

SEQ ID NO: 355695 - RNA, 64 nt, hsa
aaauaaaggagggaccaauaucugggacagugucuucucagaaacaaccagcugagaagguaau

SEQ ID NO: 355696 - RNA, 64 nt, hsa
gaauaauggguggugggaaaucuggaacagugucuucucagaaacaaccagccucaaagguaau

SEQ ID NO: 355697 - RNA, 64 nt, hsa
aaauaaaggauggacuacagugugggacagugucuucucagaaacaaccagccuugaagguaau

SEQ ID NO: 355698 - RNA, 64 nt, hsa
aaauaaaggauggagaaaaaucugggacagugucuucucagaaacaaccagccuugaagguaau

SEQ ID NO: 355699 - RNA, 64 nt, hsa
aaauaaaggauggagaaaaaucugggacagugucuucucagaaaccaccagccuugacgguaau

SEQ ID NO: 355700 - RNA, 64 nt, hsa
gaaaaaaggauggagaaauaucuaggaaagugucuucucagaaaccaccaaccuugaagguaau

SEQ ID NO: 355701 - RNA, 64 nt, hsa
aaaaaaaggauggagaaauaucuaggaaagugucuucucagaaaccaccagccuugaagguaau

SEQ ID NO: 355702 - RNA, 64 nt, hsa
uggaaaaaaugauguucauuuagauugaaaacuuuucucagauggauugauaauugcauucauc

SEQ ID NO: 355703 - RNA, 64 nt, hsa
caauuuuugccuucauuaccuuuuuugauaaaguuucucagauccuuguuucaaacacaaaugc

SEQ ID NO: 355704 - RNA, 64 nt, hsa
uuaauaucagcaaggugaacugggacauucuucuuucucagaagaagaaacaucuuguaaauug

SEQ ID NO: 355705 - RNA, 64 nt, hsa
uaauuuaaaaauaauauauuuucgaaguaguagauucucagaucuuuauucuaacaauuacaug

SEQ ID NO: 355706 - RNA, 64 nt, hsa
uagucugugcuaaauauuuugcugaagaagcaguuucucagacacaacaucucagaauuuuaau

SEQ ID NO: 355707 - RNA, 64 nt, hsa
cuaccauacuguaaauaugagcuuuauggugucauucucagaaacuuacacauuucugcucucc

SEQ ID NO: 355708 - RNA, 64 nt, hsa
aaaagucacagcuuaucccaggcacccuggcagguucucagagccugccuccucccuguuuaua

SEQ ID NO: 355709 - RNA, 64 nt, hsa
agugagacuaucagcuaguuguggguggaguguguucucagaagguaugaaguagauguuuucc

SEQ ID NO: 355710 - RNA, 64 nt, hsa
uggaaaaaaaauauaauaacaauuaaacaauuauuucucagagggcaacuuuauuuucuaauuc

SEQ ID NO: 355711 - RNA, 64 nt, hsa
ucucacucacagggggugcauuuuacucauuuauuucucagaggagcagggcgugguggcacac

SEQ ID NO: 355712 - RNA, 64 nt, hsa
gaggauuucacccugcaugggagagagcaggguuuucucagauuccuuuuuaaucucuauuuau

SEQ ID NO: 355713 - RNA, 64 nt, hsa
ugaauauugaaaacaacaacuaaaaaaguggaccuucucagaaaaaaagggcagcaaaugacca

SEQ ID NO: 355714 - RNA, 64 nt, hsa
cuuagauuuuuaaaaaagaauuaaaaugugggaguucucagaaagaaauaaacacaugagaaua

SEQ ID NO: 355715 - RNA, 64 nt, hsa
aaaauaacgccugauguauagauuaguuagcaaauucucagaaaucccccacauaaaagccuua

SEQ ID NO: 355716 - RNA, 64 nt, hsa
ucaaggagagugcagucaaccaguaaauugcagauucucagaauguuuauugacguacugauua

SEQ ID NO: 355717 - RNA, 64 nt, hsa
guuauacucuaacaucuguauauuuuuaccaguauucucagaccacuucuaccaaaacauaaau

SEQ ID NO: 355718 - RNA, 64 nt, hsa
ucaaggagagugcagucaaccaguaaacugcagauucucagaauguuuauugacguacugauua

SEQ ID NO: 355719 - RNA, 64 nt, hsa; identical to SEQ ID NO: 355717

SEQ ID NO: 355720 - RNA, 64 nt, hsa
aggagaggaggguuccucuuaggucagauggagguucucagagccaaguccucccucucuacug

SEQ ID NO: 355721 - RNA, 64 nt, hsa
uugaaccuuuuuuuuugaaacagcagucccaguauucucagagcaugugucagaguguuguucc

SEQ ID NO: 355722 - RNA, 64 nt, hsa
cugucaccccaauuucuccaagccagagguagcuuucucagagccccuuggugguucuguccuc

SEQ ID NO: 355723 - RNA, 64 nt, hsa
aaaucauguuucuucucucucaucuuacuuuuucuucucagauuucucccuuccuagaacauuc

SEQ ID NO: 355724 - RNA, 64 nt, hsa
agaggcacgcccucccccagcggcccucaggcuuuucucagacaugcgggagccaggagagcac

SEQ ID NO: 355725 - RNA, 64 nt, hsa
uugcuuuccugagaagaugcgguggcugccuauguucucagagcgggucugggaagauucagaa

SEQ ID NO: 355726 - RNA, 64 nt, hsa
aauucucuccuacaguacugggaccacuguaaacuucucagaugacuuguauuuuuguagugcu

SEQ ID NO: 355727 - RNA, 64 nt, hsa
uguuaaauuuugauaccauguaaaccuacccagcuucucagacuugggucuuguuuuuugaugg

SEQ ID NO: 355728 - RNA, 64 nt, hsa
agaaauaaacccacagcuccagagaaggugaccauucucagaacuccagcuauucacucuccag

SEQ ID NO: 355729 - RNA, 64 nt, hsa
cccagacgauuuccacuauucacagcauuuccuuuucucagaaggacucuuuauauuuccaugu

SEQ ID NO: 355730 - RNA, 64 nt, hsa
auuguauucuauaguuuuuuuauguagucuacauuucucagauguauccccauucgguuuuauu

SEQ ID NO: 355731 - RNA, 64 nt, hsa
cuacauuucucagauguauccccauucgguuuuauucucagaacuguuacuagacucaugacuu

SEQ ID NO: 355732 - RNA, 64 nt, hsa
gucacacacgccccuuuuguguuuugguucaaguuucucagagccccucagagcuucuacaucu

SEQ ID NO: 355733 - RNA, 64 nt, hsa
cuugauauuuuaagcauuuucccaugucaugaguuucucagaaacauguuuuuaacaauuguac

SEQ ID NO: 355734 - RNA, 64 nt, hsa
uguguccaggaugugccugaaguauugauaggucuucucagauagagcccuccacacuguggac

SEQ ID NO: 355735 - RNA, 64 nt, hsa
ccaggcaggugguguguguggacucacacucacauucucagaggauccagggaggcccagguac

SEQ ID NO: 355736 - RNA, 64 nt, hsa
guguccugaugacuauagugcagcuaacuuuuuguucucagauuuguagugcauaggugugugu

SEQ ID NO: 355737 - RNA, 64 nt, hsa
cacaggcugacaccaaaguggcacaacugcacaguucucagauuucuuugcacagauugauuuu

SEQ ID NO: 355738 - RNA, 64 nt, hsa
ugguguggaggcuguugauguuucuggugucaaguucucagaaguugcugccaccaacucuuua

SEQ ID NO: 355739 - RNA, 64 nt, hsa
uuucuaaaguccaguacuuuguccagauuuuagauucucagaauaaauguuuuucacagauaga

SEQ ID NO: 355740 - RNA, 64 nt, hsa
cagauuucacaaauugugcuaagaaccguccguguucucagaaagcccaguguuuuugcaaaga

SEQ ID NO: 355741 - RNA, 64 nt, hsa
aggcccucuuuuccaguaggaaguuagauggggguucucagaaguggcugauuggaaggggaca

SEQ ID NO: 355742 - RNA, 56 nt, hsa
ucgaugcccacuuguuguaguggguguucucagaucucuagcaucacgacccauca

SEQ ID NO: 355743 - RNA, 64 nt, hsa
agucauuuuuuuucuuuuagcauuugauaugcauuucucagauuccaccaucuuuuugugcuuu

SEQ ID NO: 355744 - RNA, 64 nt, hsa; identical to SEQ ID NO: 237274

SEQ ID NO: 355745 - RNA, 64 nt, hsa; identical to SEQ ID NO: 237275

SEQ ID NO: 355746 - RNA, 64 nt, hsa; identical to SEQ ID NO: 237276

SEQ ID NO: 355747 - RNA, 64 nt, hsa; identical to SEQ ID NO: 237277

SEQ ID NO: 355748 - RNA, 64 nt, hsa
gauucuuccacccucucacuuuccugccuguuccccacuccacaggagggagcugacguuggcu

SEQ ID NO: 355749 - RNA, 64 nt, hsa
ccagguuaauuucuaucucugaucccuccccaacccacuccauauuugggucauggacaguaaa

SEQ ID NO: 355750 - RNA, 64 nt, hsa
agucccuggcugccaaaacugcucagcaguugggccacuccacuauuccaccucucuaaaagaa

SEQ ID NO: 355751 - RNA, 64 nt, hsa
auuuguucuucaucuccugucucuucaagccuccccacuccaccgugccgaaggagcucugcca

SEQ ID NO: 355752 - RNA, 64 nt, hsa
gguggcgguugcugugagccaagaucaugccacuccacuccagucugggcgacagagcaagacu

SEQ ID NO: 355753 - RNA, 64 nt, hsa
uaggagguggcgguugcugugagccaagaucaugccacuccacuccagucugggcgacagagca

SEQ ID NO: 355754 - RNA, 64 nt, hsa
cuaccugcccaccuggggcuccugugcccccuccccacuccagaggccacccuacaaguugucc

SEQ ID NO: 355755 - RNA, 64 nt, hsa
gcgguagccacucuaggucguuggccuuccuugaccacuccauuuaauucucucugcuguuugg

SEQ ID NO: 355756 - RNA, 64 nt, hsa
ccugacccuuccaccccgccucacucccuccgucccacuccacuccaggcugccggcaccugcc

SEQ ID NO: 355757 - RNA, 64 nt, hsa
cccuuccaccccgccucacucccuccgucccacuccacuccaggcugccggcaccugccccauu

SEQ ID NO: 355758 - RNA, 64 nt, hsa
gacuccagccugucccucuuagcacucuagcugcccacuccagggcagggacucgaaacccccu

SEQ ID NO: 355759 - RNA, 64 nt, hsa
acccaccgcccaggucuuaacuuucuggcauccaccacuccaugucucuggaugugucacuugg

SEQ ID NO: 355760 - RNA, 64 nt, hsa
gaaggggcucuccagaccccuuuuccaugaugacccacuccaagauauuauguguaaauugugu

SEQ ID NO: 355761 - RNA, 64 nt, hsa
cucgugcccagcacaagugagccugguguggaaaccacuccauugcccgguggaauggauucug

SEQ ID NO: 355762 - RNA, 64 nt, hsa
uugggccugggcagucugaagacugauaacuuccccacuccacccuacaagcagugggacuccu

SEQ ID NO: 355763 - RNA, 64 nt, hsa
cugugcacacuuccaggccucccuggagagguguccacuccauccuucccuccguggcguaggg

SEQ ID NO: 355764 - RNA, 64 nt, hsa
uuaaagacaaggggccaggagccaacaccagaggccacuccacaaccccagcgccagucagcaa

SEQ ID NO: 355765 - RNA, 64 nt, hsa
aagccacccaaacugccacuccacuccaggugggccacuccaaggaggcccuggcugcugccac

SEQ ID NO: 355766 - RNA, 64 nt, hsa
gcaucuucgccuagaagccacccaaacugccacuccacuccaggugggccacuccaaggaggcc

SEQ ID NO: 355767 - RNA, 64 nt, hsa
ugggggcaucuucgccuagaagccacccaaacugccacuccacuccaggugggccacuccaagg

SEQ ID NO: 355768 - RNA, 64 nt, hsa
gcauaguccaucccgcuaguccaucccgcuagccccacuccagggacucagacccaucuccaac

SEQ ID NO: 355769 - RNA, 64 nt, hsa
acuaugccuuccuguccuuucuacucaaugguccccacuccaagaugaguugacacaaccccuu

SEQ ID NO: 355770 - RNA, 64 nt, hsa
gaacccagaggaacccccaccccacccccaccuaccacuccaugcuuucucuacucccugccuc

SEQ ID NO: 355771 - RNA, 64 nt, hsa
cuucugcagggagugagcuccccagacccccucgccacuccagcgcccaguccuucuccugccc

SEQ ID NO: 355772 - RNA, 64 nt, hsa
cugcuccaucggcacuaaugcuccacucggcgccccacuccaucggccccgcuccaucggcacu

SEQ ID NO: 355773 - RNA, 64 nt, hsa
ccgcuccaucggcacuaaugccccacucggcgccccacuccaucagcacuaaugcuccacucca

SEQ ID NO: 355774 - RNA, 64 nt, hsa
ccacucggcgccccacuccaucagcacuaaugcuccacuccauuggcacuaacgccccaacucc

SEQ ID NO: 355775 - RNA, 64 nt, hsa
ggcacuaaugacccgcuccuuugacauuggugccccacuccaucagcacuaacgcccugcucca

SEQ ID NO: 355776 - RNA, 64 nt, hsa
agcacuaacgcccugcuccaucggcacuggugucccacuccauugucacuaacguccggcucca

SEQ ID NO: 355777 - RNA, 64 nt, hsa
cacaggggacgggaugaggagcgggaggguuccgccacuccaguuuucuccucugcuucuuugc

SEQ ID NO: 355778 - RNA, 64 nt, hsa
ugcuucuuugccucccucagauagaaaacagcccccacuccaguccacuccugaccccucuccu

SEQ ID NO: 355779 - RNA, 64 nt, hsa
ucucagcucugaaggccgugagaccccugauuucccacuccacacccuauauuucuguguaugu

SEQ ID NO: 355780 - RNA, 64 nt, hsa
gagguugaggcugcagugagccgugauuucaccaccacuccagccugggugagaaagcaagacc

SEQ ID NO: 355781 - RNA, 62 nt, hsa
uguucaacagcaacacauagccugacccuccuccacuccaccuccacccacuguccgccucu

SEQ ID NO: 355782 - RNA, 64 nt, hsa
cagccccccccuugaaucugcagggagcaacucuccacuccauauuuauuuaaacaauuuuuuc

SEQ ID NO: 355783 - RNA, 64 nt, hsa
ggaaguuucuuccccgaguggagcuucgacccacccacuccaggaacccagagccacauuagaa

SEQ ID NO: 355784 - RNA, 64 nt, hsa
augaacagauuuaaagacagguggccacugacagccacuccaggaacuugaacugcaggggcag

SEQ ID NO: 355785 - RNA, 64 nt, hsa; identical to SEQ ID NO: 324845

SEQ ID NO: 355786 - RNA, 64 nt, hsa; identical to SEQ ID NO: 324846

SEQ ID NO: 355787 - RNA, 64 nt, hsa; identical to SEQ ID NO: 324847

SEQ ID NO: 355788 - RNA, 64 nt, hsa; identical to SEQ ID NO: 324848

SEQ ID NO: 355789 - RNA, 64 nt, hsa; identical to SEQ ID NO: 324849

SEQ ID NO: 355790 - RNA, 64 nt, hsa; identical to SEQ ID NO: 324850

SEQ ID NO: 355791 - RNA, 64 nt, hsa; identical to SEQ ID NO: 324851

SEQ ID NO: 355792 - RNA, 64 nt, hsa; identical to SEQ ID NO: 324852

SEQ ID NO: 355793 - RNA, 64 nt, hsa; identical to SEQ ID NO: 324853

SEQ ID NO: 355794 - RNA, 64 nt, hsa; identical to SEQ ID NO: 324854

SEQ ID NO: 355795 - RNA, 64 nt, hsa; identical to SEQ ID NO: 324855

SEQ ID NO: 355796 - RNA, 64 nt, hsa; identical to SEQ ID NO: 324856

SEQ ID NO: 355797 - RNA, 64 nt, hsa; identical to SEQ ID NO: 324857

SEQ ID NO: 355798 - RNA, 64 nt, hsa; identical to SEQ ID NO: 324858

SEQ ID NO: 355799 - RNA, 64 nt, hsa; identical to SEQ ID NO: 324859

SEQ ID NO: 355800 - RNA, 64 nt, hsa; identical to SEQ ID NO: 324860

SEQ ID NO: 355801 - RNA, 64 nt, hsa; identical to SEQ ID NO: 324861

SEQ ID NO: 355802 - RNA, 64 nt, hsa; identical to SEQ ID NO: 324862

SEQ ID NO: 355803 - RNA, 64 nt, hsa; identical to SEQ ID NO: 324863

SEQ ID NO: 355804 - RNA, 64 nt, hsa; identical to SEQ ID NO: 324864

SEQ ID NO: 355805 - RNA, 64 nt, hsa; identical to SEQ ID NO: 324865

SEQ ID NO: 355806 - RNA, 64 nt, hsa; identical to SEQ ID NO: 324866

SEQ ID NO: 355807 - RNA, 64 nt, hsa; identical to SEQ ID NO: 324867

SEQ ID NO: 355808 - RNA, 64 nt, hsa; identical to SEQ ID NO: 324868

SEQ ID NO: 355809 - RNA, 64 nt, hsa; identical to SEQ ID NO: 324869

SEQ ID NO: 355810 - RNA, 64 nt, hsa; identical to SEQ ID NO: 324870

SEQ ID NO: 355811 - RNA, 64 nt, hsa; identical to SEQ ID NO: 324871

SEQ ID NO: 355812 - RNA, 64 nt, hsa; identical to SEQ ID NO: 324872

SEQ ID NO: 355813 - RNA, 64 nt, hsa; identical to SEQ ID NO: 324873

SEQ ID NO: 355814 - RNA, 64 nt, hsa; identical to SEQ ID NO: 324874

SEQ ID NO: 355815 - RNA, 64 nt, hsa; identical to SEQ ID NO: 324875

SEQ ID NO: 355816 - RNA, 64 nt, hsa; identical to SEQ ID NO: 324876

SEQ ID NO: 355817 - RNA, 64 nt, hsa; identical to SEQ ID NO: 324877

SEQ ID NO: 355818 - RNA, 64 nt, hsa; identical to SEQ ID NO: 324878

SEQ ID NO: 355819 - RNA, 64 nt, hsa; identical to SEQ ID NO: 324879

SEQ ID NO: 355820 - RNA, 64 nt, hsa; identical to SEQ ID NO: 324880

SEQ ID NO: 355821 - RNA, 64 nt, hsa; identical to SEQ ID NO: 324881

SEQ ID NO: 355822 - RNA, 64 nt, hsa; identical to SEQ ID NO: 324882

SEQ ID NO: 355823 - RNA, 64 nt, hsa; identical to SEQ ID NO: 79909

SEQ ID NO: 355824 - RNA, 64 nt, hsa; identical to SEQ ID NO: 79910

SEQ ID NO: 355825 - RNA, 64 nt, hsa; identical to SEQ ID NO: 79911

SEQ ID NO: 355826 - RNA, 64 nt, hsa; identical to SEQ ID NO: 79912

SEQ ID NO: 355827 - RNA, 64 nt, hsa; identical to SEQ ID NO: 79913

SEQ ID NO: 355828 - RNA, 64 nt, hsa; identical to SEQ ID NO: 79914

SEQ ID NO: 355829 - RNA, 64 nt, hsa; identical to SEQ ID NO: 79915

SEQ ID NO: 355830 - RNA, 64 nt, hsa; identical to SEQ ID NO: 79916

SEQ ID NO: 355831 - RNA, 64 nt, hsa; identical to SEQ ID NO: 79917

SEQ ID NO: 355832 - RNA, 64 nt, hsa; identical to SEQ ID NO: 79918

SEQ ID NO: 355833 - RNA, 64 nt, hsa; identical to SEQ ID NO: 257521

SEQ ID NO: 355834 - RNA, 64 nt, hsa; identical to SEQ ID NO: 257522

SEQ ID NO: 355835 - RNA, 64 nt, hsa; identical to SEQ ID NO: 257523

SEQ ID NO: 355836 - RNA, 64 nt, hsa; identical to SEQ ID NO: 257524

SEQ ID NO: 355837 - RNA, 64 nt, hsa; identical to SEQ ID NO: 259226

SEQ ID NO: 355838 - RNA, 64 nt, hsa; identical to SEQ ID NO: 259227

SEQ ID NO: 355839 - RNA, 64 nt, hsa; identical to SEQ ID NO: 259228

SEQ ID NO: 355840 - RNA, 64 nt, hsa; identical to SEQ ID NO: 259229

SEQ ID NO: 355841 - RNA, 64 nt, hsa; identical to SEQ ID NO: 259230

SEQ ID NO: 355842 - RNA, 64 nt, hsa; identical to SEQ ID NO: 259231

SEQ ID NO: 355843 - RNA, 64 nt, hsa; identical to SEQ ID NO: 259232

SEQ ID NO: 355844 - RNA, 64 nt, hsa; identical to SEQ ID NO: 259233

SEQ ID NO: 355845 - RNA, 64 nt, hsa; identical to SEQ ID NO: 259234

SEQ ID NO: 355846 - RNA, 64 nt, hsa; identical to SEQ ID NO: 259235

SEQ ID NO: 355847 - RNA, 64 nt, hsa; identical to SEQ ID NO: 259236

SEQ ID NO: 355848 - RNA, 64 nt, hsa; identical to SEQ ID NO: 259237

SEQ ID NO: 355849 - RNA, 64 nt, hsa; identical to SEQ ID NO: 259238

SEQ ID NO: 355850 - RNA, 64 nt, hsa; identical to SEQ ID NO: 259239

SEQ ID NO: 355851 - RNA, 64 nt, hsa; identical to SEQ ID NO: 259240

SEQ ID NO: 355852 - RNA, 64 nt, hsa; identical to SEQ ID NO: 259241

SEQ ID NO: 355853 - RNA, 64 nt, hsa; identical to SEQ ID NO: 259242

SEQ ID NO: 355854 - RNA, 64 nt, hsa; identical to SEQ ID NO: 259243

SEQ ID NO: 355855 - RNA, 64 nt, hsa; identical to SEQ ID NO: 259244

SEQ ID NO: 355856 - RNA, 64 nt, hsa; identical to SEQ ID NO: 259245

SEQ ID NO: 355857 - RNA, 64 nt, hsa; identical to SEQ ID NO: 259246

SEQ ID NO: 355858 - RNA, 64 nt, hsa; identical to SEQ ID NO: 259247

SEQ ID NO: 355859 - RNA, 64 nt, hsa; identical to SEQ ID NO: 259248

SEQ ID NO: 355860 - RNA, 64 nt, hsa; identical to SEQ ID NO: 259249

SEQ ID NO: 355861 - RNA, 64 nt, hsa; identical to SEQ ID NO: 259250

SEQ ID NO: 355862 - RNA, 64 nt, hsa; identical to SEQ ID NO: 259251

SEQ ID NO: 355863 - RNA, 64 nt, hsa; identical to SEQ ID NO: 259252

SEQ ID NO: 355864 - RNA, 64 nt, hsa; identical to SEQ ID NO: 259253

SEQ ID NO: 355865 - RNA, 64 nt, hsa; identical to SEQ ID NO: 259254

SEQ ID NO: 355866 - RNA, 64 nt, hsa; identical to SEQ ID NO: 259255

SEQ ID NO: 355867 - RNA, 64 nt, hsa; identical to SEQ ID NO: 259256

SEQ ID NO: 355868 - RNA, 64 nt, hsa; identical to SEQ ID NO: 259257

SEQ ID NO: 355869 - RNA, 64 nt, hsa; identical to SEQ ID NO: 259258

SEQ ID NO: 355870 - RNA, 64 nt, hsa; identical to SEQ ID NO: 259259

SEQ ID NO: 355871 - RNA, 64 nt, hsa; identical to SEQ ID NO: 259260

SEQ ID NO: 355872 - RNA, 64 nt, hsa; identical to SEQ ID NO: 259261

SEQ ID NO: 355873 - RNA, 64 nt, hsa; identical to SEQ ID NO: 259262

SEQ ID NO: 355874 - RNA, 64 nt, hsa; identical to SEQ ID NO: 259263

SEQ ID NO: 355875 - RNA, 64 nt, hsa; identical to SEQ ID NO: 259264

SEQ ID NO: 355876 - RNA, 64 nt, hsa; identical to SEQ ID NO: 259265

SEQ ID NO: 355877 - RNA, 64 nt, hsa; identical to SEQ ID NO: 259266

SEQ ID NO: 355878 - RNA, 64 nt, hsa; identical to SEQ ID NO: 259267

SEQ ID NO: 355879 - RNA, 64 nt, hsa; identical to SEQ ID NO: 259268

SEQ ID NO: 355880 - RNA, 64 nt, hsa; identical to SEQ ID NO: 259269

SEQ ID NO: 355881 - RNA, 64 nt, hsa; identical to SEQ ID NO: 259270

SEQ ID NO: 355882 - RNA, 64 nt, hsa; identical to SEQ ID NO: 259271

SEQ ID NO: 355883 - RNA, 64 nt, hsa; identical to SEQ ID NO: 259272

SEQ ID NO: 355884 - RNA, 64 nt, hsa; identical to SEQ ID NO: 259273

SEQ ID NO: 355885 - RNA, 64 nt, hsa; identical to SEQ ID NO: 259274

SEQ ID NO: 355886 - RNA, 64 nt, hsa; identical to SEQ ID NO: 259275

SEQ ID NO: 355887 - RNA, 64 nt, hsa; identical to SEQ ID NO: 259276

SEQ ID NO: 355888 - RNA, 64 nt, hsa; identical to SEQ ID NO: 259277

SEQ ID NO: 355889 - RNA, 64 nt, hsa; identical to SEQ ID NO: 259278

SEQ ID NO: 355890 - RNA, 64 nt, hsa; identical to SEQ ID NO: 259279

SEQ ID NO: 355891 - RNA, 64 nt, hsa; identical to SEQ ID NO: 259280

SEQ ID NO: 355892 - RNA, 64 nt, hsa; identical to SEQ ID NO: 259281

SEQ ID NO: 355893 - RNA, 64 nt, hsa; identical to SEQ ID NO: 259282

SEQ ID NO: 355894 - RNA, 64 nt, hsa; identical to SEQ ID NO: 259283

SEQ ID NO: 355895 - RNA, 64 nt, hsa; identical to SEQ ID NO: 259284

SEQ ID NO: 355896 - RNA, 64 nt, hsa; identical to SEQ ID NO: 259285

SEQ ID NO: 355897 - RNA, 64 nt, hsa; identical to SEQ ID NO: 259286

SEQ ID NO: 355898 - RNA, 64 nt, hsa; identical to SEQ ID NO: 259287

SEQ ID NO: 355899 - RNA, 64 nt, hsa; identical to SEQ ID NO: 259288

SEQ ID NO: 355900 - RNA, 64 nt, hsa; identical to SEQ ID NO: 259289

SEQ ID NO: 355901 - RNA, 64 nt, hsa; identical to SEQ ID NO: 259290

SEQ ID NO: 355902 - RNA, 64 nt, hsa; identical to SEQ ID NO: 259291

SEQ ID NO: 355903 - RNA, 64 nt, hsa; identical to SEQ ID NO: 259292

SEQ ID NO: 355904 - RNA, 64 nt, hsa; identical to SEQ ID NO: 259293

SEQ ID NO: 355905 - RNA, 64 nt, hsa; identical to SEQ ID NO: 259294

SEQ ID NO: 355906 - RNA, 64 nt, hsa; identical to SEQ ID NO: 259295

SEQ ID NO: 355907 - RNA, 64 nt, hsa; identical to SEQ ID NO: 259296

SEQ ID NO: 355908 - RNA, 64 nt, hsa; identical to SEQ ID NO: 259297

SEQ ID NO: 355909 - RNA, 64 nt, hsa; identical to SEQ ID NO: 259298

SEQ ID NO: 355910 - RNA, 64 nt, hsa; identical to SEQ ID NO: 259299

SEQ ID NO: 355911 - RNA, 64 nt, hsa; identical to SEQ ID NO: 259300

SEQ ID NO: 355912 - RNA, 64 nt, hsa; identical to SEQ ID NO: 259301

SEQ ID NO: 355913 - RNA, 64 nt, hsa; identical to SEQ ID NO: 259302

SEQ ID NO: 355914 - RNA, 64 nt, hsa; identical to SEQ ID NO: 259303

SEQ ID NO: 355915 - RNA, 64 nt, hsa; identical to SEQ ID NO: 259304

SEQ ID NO: 355916 - RNA, 64 nt, hsa; identical to SEQ ID NO: 259305

SEQ ID NO: 355917 - RNA, 64 nt, hsa; identical to SEQ ID NO: 259306

SEQ ID NO: 355918 - RNA, 64 nt, hsa; identical to SEQ ID NO: 259307

SEQ ID NO: 355919 - RNA, 64 nt, hsa; identical to SEQ ID NO: 259308

SEQ ID NO: 355920 - RNA, 64 nt, hsa; identical to SEQ ID NO: 259309

SEQ ID NO: 355921 - RNA, 64 nt, hsa; identical to SEQ ID NO: 259310

SEQ ID NO: 355922 - RNA, 64 nt, hsa; identical to SEQ ID NO: 259311

SEQ ID NO: 355923 - RNA, 64 nt, hsa; identical to SEQ ID NO: 259312

SEQ ID NO: 355924 - RNA, 64 nt, hsa; identical to SEQ ID NO: 259313

SEQ ID NO: 355925 - RNA, 64 nt, hsa; identical to SEQ ID NO: 259314

SEQ ID NO: 355926 - RNA, 64 nt, hsa; identical to SEQ ID NO: 259315

SEQ ID NO: 355927 - RNA, 64 nt, hsa; identical to SEQ ID NO: 259316

SEQ ID NO: 355928 - RNA, 64 nt, hsa; identical to SEQ ID NO: 259317

SEQ ID NO: 355929 - RNA, 64 nt, hsa; identical to SEQ ID NO: 259318

SEQ ID NO: 355930 - RNA, 64 nt, hsa; identical to SEQ ID NO: 259319

SEQ ID NO: 355931 - RNA, 64 nt, hsa; identical to SEQ ID NO: 259320

SEQ ID NO: 355932 - RNA, 64 nt, hsa; identical to SEQ ID NO: 259321

SEQ ID NO: 355933 - RNA, 64 nt, hsa; identical to SEQ ID NO: 259322

SEQ ID NO: 355934 - RNA, 64 nt, hsa; identical to SEQ ID NO: 259323

SEQ ID NO: 355935 - RNA, 64 nt, hsa; identical to SEQ ID NO: 259324

SEQ ID NO: 355936 - RNA, 64 nt, hsa; identical to SEQ ID NO: 259325

SEQ ID NO: 355937 - RNA, 64 nt, hsa; identical to SEQ ID NO: 259326

SEQ ID NO: 355938 - RNA, 64 nt, hsa; identical to SEQ ID NO: 259327

SEQ ID NO: 355939 - RNA, 64 nt, hsa; identical to SEQ ID NO: 259328

SEQ ID NO: 355940 - RNA, 64 nt, hsa; identical to SEQ ID NO: 259329

SEQ ID NO: 355941 - RNA, 64 nt, hsa; identical to SEQ ID NO: 259330

SEQ ID NO: 355942 - RNA, 64 nt, hsa; identical to SEQ ID NO: 259331

SEQ ID NO: 355943 - RNA, 64 nt, hsa; identical to SEQ ID NO: 259332

SEQ ID NO: 355944 - RNA, 64 nt, hsa; identical to SEQ ID NO: 259333

SEQ ID NO: 355945 - RNA, 64 nt, hsa; identical to SEQ ID NO: 259334

SEQ ID NO: 355946 - RNA, 64 nt, hsa; identical to SEQ ID NO: 259335

SEQ ID NO: 355947 - RNA, 64 nt, hsa; identical to SEQ ID NO: 259336

SEQ ID NO: 355948 - RNA, 64 nt, hsa; identical to SEQ ID NO: 259337

SEQ ID NO: 355949 - RNA, 64 nt, hsa; identical to SEQ ID NO: 259338

SEQ ID NO: 355950 - RNA, 64 nt, hsa; identical to SEQ ID NO: 259339

SEQ ID NO: 355951 - RNA, 64 nt, hsa; identical to SEQ ID NO: 259340

SEQ ID NO: 355952 - RNA, 64 nt, hsa; identical to SEQ ID NO: 259341

SEQ ID NO: 355953 - RNA, 64 nt, hsa; identical to SEQ ID NO: 259342

SEQ ID NO: 355954 - RNA, 64 nt, hsa; identical to SEQ ID NO: 259343

SEQ ID NO: 355955 - RNA, 64 nt, hsa; identical to SEQ ID NO: 259344

SEQ ID NO: 355956 - RNA, 64 nt, hsa; identical to SEQ ID NO: 259345

SEQ ID NO: 355957 - RNA, 64 nt, hsa; identical to SEQ ID NO: 259346

SEQ ID NO: 355958 - RNA, 64 nt, hsa; identical to SEQ ID NO: 259347

SEQ ID NO: 355959 - RNA, 64 nt, hsa; identical to SEQ ID NO: 259348

SEQ ID NO: 355960 - RNA, 64 nt, hsa; identical to SEQ ID NO: 259349

SEQ ID NO: 355961 - RNA, 64 nt, hsa; identical to SEQ ID NO: 259350

SEQ ID NO: 355962 - RNA, 64 nt, hsa; identical to SEQ ID NO: 259351

SEQ ID NO: 355963 - RNA, 64 nt, hsa; identical to SEQ ID NO: 259352

SEQ ID NO: 355964 - RNA, 64 nt, hsa; identical to SEQ ID NO: 259353

SEQ ID NO: 355965 - RNA, 61 nt, hsa
ggcacuaaauccuuuccugacaauggcagagucucuagagguagaaauuugccuugcugca

SEQ ID NO: 355966 - RNA, 61 nt, hsa
aucccauggaggugaggauuuucacuucuuuucucuagacuuggaagcugagauucagaga

SEQ ID NO: 355967 - RNA, 61 nt, hsa
guuccuggaccccccaguucuguguggcucuucucuagaggagcauugaccccccugaauc

SEQ ID NO: 355968 - RNA, 61 nt, hsa
cuagaauaagaggugagaaucucaugauuugucucuagaugugggaggauuguguguaacc

SEQ ID NO: 355969 - RNA, 61 nt, hsa
guuuucauugucaagaauguuacuguaguauucucuagaacuucaaugucuuuguggacau

SEQ ID NO: 355970 - RNA, 61 nt, hsa
uaauuuuuaagcucuuugccaauauuccauuucucuagaauguuuauccuaagcacuuguu

SEQ ID NO: 355971 - RNA, 61 nt, hsa
gauucaaugagugggaaauacauugugccuuucucuagaugugauacguuauaccaaaauc

SEQ ID NO: 355972 - RNA, 61 nt, hsa
aggaaucaauaguuaguagugacauuggugcucucuagaaaucucagcaugagcugcuaua

SEQ ID NO: 355973 - RNA, 61 nt, hsa
caugcaaccaggugauuuuuaggaauagaugucucuagacucugucuccuuuccuacaagg

SEQ ID NO: 355974 - RNA, 61 nt, hsa
uuaggaaaacaaaacugcuuagaagccccuuucucuagagcaguuuuaugucauuuguaaa

SEQ ID NO: 355975 - RNA, 61 nt, hsa
gugauuuugauguauucuaauuuugagaccaucucuagaaaagaauugcuaccucuuguau

SEQ ID NO: 355976 - RNA, 61 nt, hsa
ugugggugcuaacaccucagagcuguccucuucucuagaguggagguuuucaaagugcauc

SEQ ID NO: 355977 - RNA, 61 nt, hsa
ggguuuucccuugccuuaugggcugaaguguucucuagaauccagcaggucacacuggggg

SEQ ID NO: 355978 - RNA, 61 nt, hsa
cggaccucgggcuaguuaaggugugcaaagaucucuagaguuuaguccuuacugucucacu

SEQ ID NO: 355979 - RNA, 61 nt, hsa
uggguucuguucugugugggccuguggggagucucuagacaagaucuuuuccaggcccuga

SEQ ID NO: 355980 - RNA, 61 nt, hsa
gagaggaaucuaagaaccagauggcuucagcucucuagaggagcugagccuauucacagug

SEQ ID NO: 355981 - RNA, 61 nt, hsa
agaacccagcccagaucggaggacaaguuccucucuagaacccaauccaauuuggagcccc

SEQ ID NO: 355982 - RNA, 61 nt, hsa
gagccccagcccaacuccagaacccaacccuucucuagaauccagcccagaucugaggcca

SEQ ID NO: 355983 - RNA, 64 nt, hsa; identical to SEQ ID NO: 93643

SEQ ID NO: 355984 - RNA, 64 nt, hsa; identical to SEQ ID NO: 93644

SEQ ID NO: 355985 - RNA, 64 nt, hsa; identical to SEQ ID NO: 93645

SEQ ID NO: 355986 - RNA, 64 nt, hsa; identical to SEQ ID NO: 93646

SEQ ID NO: 355987 - RNA, 64 nt, hsa; identical to SEQ ID NO: 93647

SEQ ID NO: 355988 - RNA, 64 nt, hsa; identical to SEQ ID NO: 93648

SEQ ID NO: 355989 - RNA, 64 nt, hsa; identical to SEQ ID NO: 93649

SEQ ID NO: 355990 - RNA, 64 nt, hsa; identical to SEQ ID NO: 93650

SEQ ID NO: 355991 - RNA, 64 nt, hsa; identical to SEQ ID NO: 93651

SEQ ID NO: 355992 - RNA, 64 nt, hsa; identical to SEQ ID NO: 93652

SEQ ID NO: 355993 - RNA, 64 nt, hsa; identical to SEQ ID NO: 93653

SEQ ID NO: 355994 - RNA, 64 nt, hsa; identical to SEQ ID NO: 93654

SEQ ID NO: 355995 - RNA, 64 nt, hsa; identical to SEQ ID NO: 93655

SEQ ID NO: 355996 - RNA, 64 nt, hsa; identical to SEQ ID NO: 93656

SEQ ID NO: 355997 - RNA, 64 nt, hsa; identical to SEQ ID NO: 93657

SEQ ID NO: 355998 - RNA, 64 nt, hsa; identical to SEQ ID NO: 93658

SEQ ID NO: 355999 - RNA, 64 nt, hsa; identical to SEQ ID NO: 93659

SEQ ID NO: 356000 - RNA, 64 nt, hsa; identical to SEQ ID NO: 93660

SEQ ID NO: 356001 - RNA, 64 nt, hsa; identical to SEQ ID NO: 93661

SEQ ID NO: 356002 - RNA, 64 nt, hsa; identical to SEQ ID NO: 93662

SEQ ID NO: 356003 - RNA, 64 nt, hsa; identical to SEQ ID NO: 93663

SEQ ID NO: 356004 - RNA, 64 nt, hsa; identical to SEQ ID NO: 93664

SEQ ID NO: 356005 - RNA, 64 nt, hsa
aagagguguaaucuaaugaagaaaucaauuagaugccccgaaaucuacagucgcugaauaacca

SEQ ID NO: 356006 - RNA, 64 nt, hsa
aacgcccacccacgaaggcccagggcgccagacggccccgaaaaggcgcucggggagcguuuaa

SEQ ID NO: 356007 - RNA, 64 nt, hsa
ccacuaacuggcuaauuagcauggccacaucugagccccgaaucugacauuagaugagagaaca

SEQ ID NO: 356008 - RNA, 64 nt, hsa
ccaugggucucauacagcugccuuauugaaauaggccccgaacccccuaaaugcaaaaaauacu

SEQ ID NO: 356009 - RNA, 64 nt, hsa
cucugaggaagaagggauaauagacacaucaaaugccccgaauuuagucacaccaucuuaaaug

SEQ ID NO: 356010 - RNA, 64 nt, hsa
aagggaugcuguuggcuucagagaucaaacaccugccccgaagacuccuaauaggucaagagag

SEQ ID NO: 356011 - RNA, 64 nt, hsa
uuucuuucuuucccccuuaaaaaaaaacacaucugccccgaacacuuucccacuguuauucuuu

SEQ ID NO: 356012 - RNA, 64 nt, hsa
uccuaaagaguuauucaaaugaaggugguucgacgccccgaaccucaccugaccucaacuaacc

SEQ ID NO: 356013 - RNA, 64 nt, hsa
ccagagcugggccacacagugggugcugggccucgccccgaagcuucuggugcagcagccucug

SEQ ID NO: 356014 - RNA, 64 nt, hsa
ccaggacaucuggccugaggggauuugaaucacagccccgaagguccugccuucaccccauugg

SEQ ID NO: 356015 - RNA, 52 nt, hsa
agccgcggcaucgcuucugauggccccgaauccccauugagcagcacaaagc

SEQ ID NO: 356016 - RNA, 64 nt, hsa
aauuuauugucauguaaauaguugagcuaagcaagccccgaauuugauaguguauaaggugcuu

SEQ ID NO: 356017 - RNA, 64 nt, hsa
agggccucucccuuuaguggagccagguugucgggccccgaaugucacugguggaucuaagaag

SEQ ID NO: 356018 - RNA, 64 nt, hsa
guccccgcccacccccauggcccuaugcggcccagccccgaaugccuugaagaagugcccccug

SEQ ID NO: 356019 - RNA, 64 nt, hsa
cuucacggcgucuccacugugcgauuggcccggagccccgaagacucggagggagcugcucagg

SEQ ID NO: 356020 - RNA, 64 nt, hsa
ccaugcgacacugggaggccagugagccacuccggccccgaauguugagguggacucucaccaa

SEQ ID NO: 356021 - RNA, 64 nt, hsa
ccugcccgcgccaggauguuuggcacaaagagcagccccgaagcccgcucaaugcucucgaugg

SEQ ID NO: 356022 - RNA, 64 nt, hsa
aacugcaagugccugaggaccagaguggccucuagccccgaauugaacacuuuuaaaccuaaag

SEQ ID NO: 356023 - RNA, 64 nt, hsa
uucggcccagcucgucccggccuccaccaagccagccccgaagcccgccagccacccugccgga

SEQ ID NO: 356024 - RNA, 64 nt, hsa
aggguguaacuaggacauccucaagggcagcuaggccccgaauguacaauguuaagacagggaa

SEQ ID NO: 356025 - RNA, 64 nt, hsa
acugcacccaggaggggaacacugcccucgcacggccccgaagggcccccacauuugugccgac

SEQ ID NO: 356026 - RNA, 64 nt, hsa
auguuucuaucuuguaugucugugugccccuccugccccgaaagugcugacuauggggaaaucu

SEQ ID NO: 356027 - RNA, 64 nt, hsa
ccuggaauacaugugguaaugaaauaaaaacccugccccgaaucuuccgucccucauccuaacu

SEQ ID NO: 356028 - RNA, 64 nt, hsa
ggagaagguuguaggcauggaagagagccaggcagccccgaaagaagagccugggccacggcca

SEQ ID NO: 356029 - RNA, 64 nt, hsa
ucucugccccucucucagccucagugucccgagggccccgaagcauuccauucucguggaggag

SEQ ID NO: 356030 - RNA, 64 nt, hsa
auugcacagugaaagaauucuggauaucucaggagccccgaaauucuagcucugacuuugcugu

SEQ ID NO: 356031 - RNA, 64 nt, hsa
acccgcugugcugaccaugggcccugagcguccugccccgaauucacgaggcugaggcauccgg

SEQ ID NO: 356032 - RNA, 64 nt, hsa
uuauuauuauuauuugcaaugagagagaugguuggccccgaaugaggcucaugggagguuugga

SEQ ID NO: 356033 - RNA, 64 nt, hsa
ggugugugaggggugaggaggcaucagcaguugagccccgaaggagaucaggcagccccaccug

SEQ ID NO: 356034 - RNA, 64 nt, hsa
cagcugggaugaagagagauggcaugucaggcuggccccgaaucauagcucccugagagggcca

SEQ ID NO: 356035 - RNA, 64 nt, hsa
cuggagugcaguggcacaaucauggcucacugcagccccgaacuacugggcucaagccuuccuc

SEQ ID NO: 356036 - RNA, 64 nt, hsa
gggccgccccccgcgcucggcccccgggggccccgccccgaagcagccuccugaaaccaaaacg

SEQ ID NO: 356037 - RNA, 64 nt, hsa
guuuuuguuaaaaugcaucugagcaagucagccagccccgaaguccccucagugugugugucuc

SEQ ID NO: 356038 - RNA, 64 nt, hsa
caucaccccagugguggcccuguggcagccuauggccccgaaccaaggacugccgcgccuccug

SEQ ID NO: 356039 - RNA, 64 nt, hsa
caugccagaguacaaaacacauaguucuuuccccgccccgaaugugacaaugguuuucauagug

SEQ ID NO: 356040 - RNA, 64 nt, hsa
cagagaaccguucguguugggcuucucucugaacgccccgaaccuugcaucaaggcuccuuggu

SEQ ID NO: 356041 - RNA, 64 nt, hsa
gaaggcccuccucccaggagguagggucuuggcugccccgaacuuaaaugcuuuugaaaucucu

SEQ ID NO: 356042 - RNA, 64 nt, hsa
accuggaggguuggacccacucaccuccacucuagccccgaacccuccugccccaggcuuccag

SEQ ID NO: 356043 - RNA, 64 nt, hsa
uagaaaaacaugaccagaaaucaaagaugucagagccccgaagcagcuaauguaauaagcacuc

SEQ ID NO: 356044 - RNA, 64 nt, hsa
aucgccugacugagaacucugggccuuagagcaggccccgaacuguggucgccaggcccaggag

SEQ ID NO: 356045 - RNA, 64 nt, hsa
acagucuguuuaaguaagcuaaauguaucuuacugccccgaaaugagaggagacuggucuugaa

SEQ ID NO: 356046 - RNA, 64 nt, hsa
ugucaacugcuuguuaauugauuuggggauguuugccccgaaugagagguugaggaaaagacug

SEQ ID NO: 356047 - RNA, 64 nt, hsa
ucauggaaugcgguagagccaggggacccugucugccccgaauaacuuucaguaguauggcaga

SEQ ID NO: 356048 - RNA, 64 nt, hsa
ccuccuuccuuccgcccuuggacuuacccagcgugccccgaaucccaccacccaaguguccagc

SEQ ID NO: 356049 - RNA, 64 nt, hsa
cccucuccugcugucccuccugguggaacugggagccccgaaccgggcagcgugggguccuggc

SEQ ID NO: 356050 - RNA, 64 nt, hsa
gugggcgcucguguugugcgggcccugcuccucugccccgaaaccacuggcuggucccuucccu

SEQ ID NO: 356051 - RNA, 64 nt, hsa
aauaaccacagggccugcagcagugccccugccagccccgaaucccacccccgggaccagccac

SEQ ID NO: 356052 - RNA, 64 nt, hsa
ugcccaggacggccccgucccagagaacaauccagccccgaaugucagcaccuucccccuaccc

SEQ ID NO: 356053 - RNA, 64 nt, hsa
uucuucuaggcaauuucuugcaaccaccaccgaggccccgaaaagcacuggucgucagggagcu

SEQ ID NO: 356054 - RNA, 64 nt, hsa
ccugcagggcgggguaggggagggcaggggcugagccccgaagccagcucaguaccugaggggc

SEQ ID NO: 356055 - RNA, 64 nt, hsa
cugaucuggacaaagucgggacagcaccaucccagccccgaagccagggccaugccagcaggcc

SEQ ID NO: 356056 - RNA, 64 nt, hsa
cagggagcccucugcccuguccuccgggccuucagccccgaacuuggagcucagcuauucggcg

SEQ ID NO: 356057 - RNA, 64 nt, hsa
gggcccugucgcgcucccgccccgguccugcacagccccgaaguucgccgggcccggccacccu

SEQ ID NO: 356058 - RNA, 64 nt, hsa
cacagagaagcccuauaaucacaggucugugguggccccgaaauggggggccugcuagucagga

SEQ ID NO: 356059 - RNA, 64 nt, hsa
gggacucuggccggacggccaaugggcugccugggccccgaagccaagcccuuuccagcuccuc

SEQ ID NO: 356060 - RNA, 64 nt, hsa
gggguccagggaauggagcucaggucccaggccagccccgaagucgccacguggccuggggcag

SEQ ID NO: 356061 - RNA, 64 nt, hsa
ggaucuugggcuaggugacaaguucuuggacuuugccccgaaagcacauccauaaaagacaaaa

SEQ ID NO: 356062 - RNA, 64 nt, hsa
uaaaggcugcccuccacacccgcgccccgcgcgcgccccgaaaggucaccucacucagcaccac

SEQ ID NO: 356063 - RNA, 64 nt, hsa
cauuuggcauuccccacuugagaauuacccuuuugccccgaacauguuuuucuucucccucagu

SEQ ID NO: 356064 - RNA, 64 nt, hsa; identical to SEQ ID NO: 104428

SEQ ID NO: 356065 - RNA, 64 nt, hsa; identical to SEQ ID NO: 104429

SEQ ID NO: 356066 - RNA, 64 nt, hsa; identical to SEQ ID NO: 104430

SEQ ID NO: 356067 - RNA, 64 nt, hsa; identical to SEQ ID NO: 104431

SEQ ID NO: 356068 - RNA, 64 nt, hsa; identical to SEQ ID NO: 104432

SEQ ID NO: 356069 - RNA, 64 nt, hsa; identical to SEQ ID NO: 104433

SEQ ID NO: 356070 - RNA, 64 nt, hsa; identical to SEQ ID NO: 104434

SEQ ID NO: 356071 - RNA, 64 nt, hsa; identical to SEQ ID NO: 104435

SEQ ID NO: 356072 - RNA, 64 nt, hsa; identical to SEQ ID NO: 104436

SEQ ID NO: 356073 - RNA, 64 nt, hsa; identical to SEQ ID NO: 104437

SEQ ID NO: 356074 - RNA, 64 nt, hsa; identical to SEQ ID NO: 104438

SEQ ID NO: 356075 - RNA, 64 nt, hsa; identical to SEQ ID NO: 104439

SEQ ID NO: 356076 - RNA, 64 nt, hsa; identical to SEQ ID NO: 104440

SEQ ID NO: 356077 - RNA, 64 nt, hsa; identical to SEQ ID NO: 104441

SEQ ID NO: 356078 - RNA, 64 nt, hsa; identical to SEQ ID NO: 104442

SEQ ID NO: 356079 - RNA, 64 nt, hsa; identical to SEQ ID NO: 104443

SEQ ID NO: 356080 - RNA, 64 nt, hsa; identical to SEQ ID NO: 104444

SEQ ID NO: 356081 - RNA, 64 nt, hsa; identical to SEQ ID NO: 104445

SEQ ID NO: 356082 - RNA, 64 nt, hsa; identical to SEQ ID NO: 104446

SEQ ID NO: 356083 - RNA, 64 nt, hsa; identical to SEQ ID NO: 104447

SEQ ID NO: 356084 - RNA, 64 nt, hsa; identical to SEQ ID NO: 104448

SEQ ID NO: 356085 - RNA, 64 nt, hsa; identical to SEQ ID NO: 104449

SEQ ID NO: 356086 - RNA, 64 nt, hsa; identical to SEQ ID NO: 104450

SEQ ID NO: 356087 - RNA, 64 nt, hsa; identical to SEQ ID NO: 104451

SEQ ID NO: 356088 - RNA, 64 nt, hsa
uguuaauuugcuuuuuaaaacaaauuuaauuaucacauuuuaaauuacuuuguggacuguguuu

SEQ ID NO: 356089 - RNA, 64 nt, hsa
uuuaacuuuuuuacucuuauaaaaccaguuccugacauuuuaaaaaacaauaucuguaaaaugg

SEQ ID NO: 356090 - RNA, 64 nt, hsa
caaagcugaucacuuccuauaaggacaaugguagacauuuuauaaagauguuuuuucacaagau

SEQ ID NO: 356091 - RNA, 64 nt, hsa
acacuuaaccauuugugaagguuuucuuuagcuuacauuuuaaacauacacaauaaacacuaau

SEQ ID NO: 356092 - RNA, 64 nt, hsa
uauauuuagaauuuuuaaacauguacaaagggcuacauuuuaauuuuaaaauagcuucacauua

SEQ ID NO: 356093 - RNA, 64 nt, hsa
auauaacauauggauauuaaaaauggggaauugcacauuuuaccuuuuggacaguaauuucuau

SEQ ID NO: 356094 - RNA, 64 nt, hsa
agucaguuuaaaacuucugaagugcugucuuuuuacauuuuacucugucccaguuugaaacuua

SEQ ID NO: 356095 - RNA, 64 nt, hsa
ugcuguaacuucuuuuaaguaguugauguggaaaacauuuuaaagugaauuugucaaaaugcug

SEQ ID NO: 356096 - RNA, 64 nt, hsa
auaaauauccuguauucuaaugaucauccucuaaacauuuuaucauuuauuaauccucccugcc

SEQ ID NO: 356097 - RNA, 64 nt, hsa
aacugugcagcacaugccgggagugaucagucggacauuuuaauuugaaccacguaucucuggg

SEQ ID NO: 356098 - RNA, 64 nt, hsa
ucuauguaaaugauuuugucagcuauaaauaauaacauuuuauuuucucuuuccuugcaauacc

SEQ ID NO: 356099 - RNA, 64 nt, hsa
gcuuagguauucauggaccuugauucuucuauauacauuuuauaauaaauacgugaaauugcuu

SEQ ID NO: 356100 - RNA, 64 nt, hsa
ucuuaaagagaaaaucuuuggagguuuuaauuaaacauuuuauacauuuaaagucuuguuaaug

SEQ ID NO: 356101 - RNA, 64 nt, hsa
caacauacaggcauucuuuuaaaaccaggcugaaacauuuuauuuccgagacuuaacguugugu

SEQ ID NO: 356102 - RNA, 64 nt, hsa
cuuuacuacuuugggaaagcugcaucuuucuaccacauuuuaacaucuaauauauuuaauuucu

SEQ ID NO: 356103 - RNA, 64 nt, hsa
uuauauuaaaccagguaaguauuuuaaacagagaacauuuuauuugcauauaucccuacaaauu

SEQ ID NO: 356104 - RNA, 64 nt, hsa
aaacacuuuuuaaaaaguggaguaaaagugaggcacauuuuacaagaacauaacuccuauuaaa

SEQ ID NO: 356105 - RNA, 64 nt, hsa
uuguacaguauaguaaaaauacccuuuacuucugacauuuuaaggucacguccuauaguuuggg

SEQ ID NO: 356106 - RNA, 64 nt, hsa
uaaaucucugaaacuugaacguaugaugcucuggacauuuuaggaagcuuaaguaaauuucuga

SEQ ID NO: 356107 - RNA, 64 nt, hsa
uuugaaaauguuaaauugagaaaccuguuaacuuacauuuuaugaauuggcacauuguauuacu

SEQ ID NO: 356108 - RNA, 64 nt, hsa
ugucuuuuuuucuaauuccguuuuguuuuaaagcacauuuuaaauguaguuuucucauuuagua

SEQ ID NO: 356109 - RNA, 64 nt, hsa
uuuuuuuuuuccuuacagugagacauuuaagcacacauuuuauucacauagauacuauguccuu

SEQ ID NO: 356110 - RNA, 64 nt, hsa
gauaucugguuaaguguuauauggaauaaaguggacauuuuaaaacuagcaaaguuaauuaugu

SEQ ID NO: 356111 - RNA, 64 nt, hsa
ccuauguaacagcagaguaacauaaaauaaaaguacauuuuauaaaccauuuacuauggcuuug

SEQ ID NO: 356112 - RNA, 64 nt, hsa
ucuuccauuguguagauuucuauauaauauaaauacauuuuaauuauuuguacuaaaaugcuca

SEQ ID NO: 356113 - RNA, 64 nt, hsa
uucuauuuugucuagggugaugugcuguagagcaacauuuuaguaguaucuuccauuguguaga

SEQ ID NO: 356114 - RNA, 64 nt, hsa
uacucauauacccuuugucuuaaacugaucuguuacauuuuauguucuuguggcuagaaguagc

SEQ ID NO: 356115 - RNA, 64 nt, hsa
guuauuauaacugaagaauauagaagauugacacacauuuuauacacccucaggcaguguuuug

SEQ ID NO: 356116 - RNA, 64 nt, hsa
uuuuuuuugcauucauuuaauuuuaggucaaauaacauuuuauuuauguggcucauuuuauauu

SEQ ID NO: 356117 - RNA, 64 nt, hsa
aaacuuuaaaaaacuaugucuaauuuauauuaauacauuuuaaaaaggugcccgcacuaccaua

SEQ ID NO: 356118 - RNA, 64 nt, hsa
uaacaauauaauucuuuggcagauauucagaauaacauuuuaaacuacauuuucuuagaaaauu

SEQ ID NO: 356119 - RNA, 64 nt, hsa
ugacagugaucaaaguuuucagugcauuuauuguacauuuuaagaaaaaggugaaaaucauuug

SEQ ID NO: 356120 - RNA, 64 nt, hsa
auaggaacugagguuuacauacguuuguguggugacauuuuagaaugucaauaaauuugcuuuu

SEQ ID NO: 356121 - RNA, 64 nt, hsa
agaggaagaccuggagcaauaaaagacaaaugcaacauuuuaaggcaaugguuucacaugguua

SEQ ID NO: 356122 - RNA, 64 nt, hsa
gauuaagcuuuauauuugcuuauuuguuguagcuacauuuuaaaaaaaagauugaacuugauga

SEQ ID NO: 356123 - RNA, 64 nt, hsa
gauauuggaauuuauuaaaagauuuuuguucaauacauuuuagauuaggauugacaaguaaaga

SEQ ID NO: 356124 - RNA, 64 nt, hsa
caauauugaaguauccauagggcacaauuuucagacauuuuaguaucuguauauagugcauaua

SEQ ID NO: 356125 - RNA, 64 nt, hsa
uugaguguuaacauaauaaaucauauacaguaugacauuuuaaggaaauaagucugcauugaug

SEQ ID NO: 356126 - RNA, 64 nt, hsa
aacagacaugugcuaguaucugauaacauuaaguacauuuuaugucguuuaauauaauuauuua

SEQ ID NO: 356127 - RNA, 64 nt, hsa
aaaugauuuugaaauuaaauauaauauagaauucacauuuuauauagcucucucaaaaauuaau

SEQ ID NO: 356128 - RNA, 64 nt, hsa
aaaaauuaauuuuuauuccuuaagcauuuuaaaaacauuuuaaaaaauguuuuguaaauccagg

SEQ ID NO: 356129 - RNA, 64 nt, hsa
guaaaguguauucuguacauaauuuacaaauaaaacauuuuauuuuaauuguuacuuauuauuu

SEQ ID NO: 356130 - RNA, 64 nt, hsa
uucuaauugugaaaaauauguuuucuguaucgacacauuuuauuaaacuuggcuugauugcuuc

SEQ ID NO: 356131 - RNA, 64 nt, hsa
cuguacguuacaaguuuggucauuuugaagcuugacauuuuaguuugccauuauguuaaaaaca

SEQ ID NO: 356132 - RNA, 64 nt, hsa
aaggaugaaugccuguauuuggucuaggaacaguacauuuuagucugauuuagaauuacuggua

SEQ ID NO: 356133 - RNA, 64 nt, hsa
ugacauuuguguucauuuuuucucuuuauguauuacauuuuaaccuauauuaaauaaauguuua

SEQ ID NO: 356134 - RNA, 64 nt, hsa
guaaaucaacgugaugauucuuucacauguaaacacauuuuaguguuucugguuugucauuuuu

SEQ ID NO: 356135 - RNA, 64 nt, hsa
guaauauuuauacuuguuuccagaauguuauuuuacauuuuauguucaauaagaacacuuuuua

SEQ ID NO: 356136 - RNA, 64 nt, hsa
uucauaauaaaacggcuauauuugaagagagaauacauuuuauauaaacaggaaaauacauuug

SEQ ID NO: 356137 - RNA, 64 nt, hsa
ccauggauuuauuuuacugcacaaugugaaguuuacauuuuauuaacacuugaguagucugauu

SEQ ID NO: 356138 - RNA, 64 nt, hsa
uuauuaacagguugaauauuuguuucuuuuuagaacauuuuauuuauacugugaagacuuuguu

SEQ ID NO: 356139 - RNA, 64 nt, hsa
aauagugagguaguaguuagucgucuuuccuacaacauuuuagcuuuugcccaucuaaagcaca

SEQ ID NO: 356140 - RNA, 64 nt, hsa
gcaaugcagauggauguuuggaugaacaacugauacauuuuaguuagaaugcuuuuucagcauu

SEQ ID NO: 356141 - RNA, 64 nt, hsa
uguaaguuuuuaaaauuauccauuuguuacuuuaacauuuuaaaauuaugguguuuuccugauu

SEQ ID NO: 356142 - RNA, 64 nt, hsa
gauuuuuaaaaauaacuaguguagcuuaucuuaaacauuuuauaaaaccuucagaugucuuuaa

SEQ ID NO: 356143 - RNA, 64 nt, hsa
gcauuuucuuauauuaaaaaaugucugcaugauuacauuuuauuuccuuuguaauuuacauuuc

SEQ ID NO: 356144 - RNA, 64 nt, hsa
uucuagccauaccucagauaauauguuuaguuuuacauuuuaaaauguuuaaauucucuuucac

SEQ ID NO: 356145 - RNA, 64 nt, hsa
ccccuugcccucauucuugaacagcuggaggaauacauuuuauucuguccaugaagcauacacu

SEQ ID NO: 356146 - RNA, 64 nt, hsa
acuagguauaaacauauauuuacaugauuaauccacauuuuaaaaugacuugcacuugugcaua

SEQ ID NO: 356147 - RNA, 64 nt, hsa
uuggcugucuuucuagguauuccauagaaucaacacauuuuaaggcugaaagauacugucgaaa

SEQ ID NO: 356148 - RNA, 64 nt, hsa
auauuuuuucauugauauuugaaaacagacuaugacauuuuaaaaaucugcccuaugaguauca

SEQ ID NO: 356149 - RNA, 64 nt, hsa
ugugaacuauaaaagcuuuuugccuacagauuuuacauuuuaaaauuaucuauggcuguuuuaa

SEQ ID NO: 356150 - RNA, 64 nt, hsa
auguggucaaauaauauagucauuagccaccuaaacauuuuaauuccagauauuauuuaauucc

SEQ ID NO: 356151 - RNA, 64 nt, hsa
ucuuugacuaaaguuaucuccccauucuaugguuacauuuuauuuuggacuauggggacuucua

SEQ ID NO: 356152 - RNA, 64 nt, hsa
uucuguuuuugagaagaguuucauaugcuggaccacauuuuagcuuuuauuguuuuuuuuuucc

SEQ ID NO: 356153 - RNA, 64 nt, hsa
gcuguuuggaaguccuggugaaacuuugcgguucacauuuuaaauuccugaaugaccuuuucau

SEQ ID NO: 356154 - RNA, 64 nt, hsa
gucuucuucccuaauaguuuguaagcuuaaagggacauuuuauuuucccugguaaagaggauuc

SEQ ID NO: 356155 - RNA, 64 nt, hsa
uucuuguaagaaaaaaacauuuucacuuuguagcacauuuuaguuauuuuugagucuucuuccc

SEQ ID NO: 356156 - RNA, 64 nt, hsa
caaguuuauacuaaaauuucaacugugugaagauacauuuuaaggcauuacuuugcuaauaauc

SEQ ID NO: 356157 - RNA, 64 nt, hsa
aauuguuaguauuagucucacacauaagugccauacauuuuauccucauggaugugaugcacug

SEQ ID NO: 356158 - RNA, 64 nt, hsa
auuguuccauggcuggaaguucccuuuagauuucacauuuuauauggcugaucaauuuucauac

SEQ ID NO: 356159 - RNA, 64 nt, hsa
gcagaaaaaugugagcucuccugguaaauaguauacauuuuauaagcuauauuuuaaaggccua

SEQ ID NO: 356160 - RNA, 64 nt, hsa
cuuuauuuguguaguuuuuaggugguuuuauauaacauuuuaauuacuugugauuuagauguau

SEQ ID NO: 356161 - RNA, 64 nt, hsa
aguagccauauguaacgggauuuuaaaaauauauacauuuuacaacauggacuagaaaaggacc

SEQ ID NO: 356162 - RNA, 64 nt, hsa
cagguacugucuacaauggcugugcauaccuauaacauuuuagguauuucauauugaauuaugc

SEQ ID NO: 356163 - RNA, 64 nt, hsa
uuuccauauacaaguauguuugaguuccaaucuuacauuuuauaccaaguucaaaacacuuuca

SEQ ID NO: 356164 - RNA, 64 nt, hsa
auaguaaauaagacucugacuuuacacaagcuacacauuuuauacuuuucauaaaccacaaagu

SEQ ID NO: 356165 - RNA, 64 nt, hsa
ggcccaacaguuuguacuucaugaaacauauuguacauuuuacauaguuuaauuuaaaaaauac

SEQ ID NO: 356166 - RNA, 64 nt, hsa
auguuugggaaacauuuuaauaacgaauuaauaaacauuuuaauaucaaaacuaaaguguuuuu

SEQ ID NO: 356167 - RNA, 64 nt, hsa
uauaaaauggagacggcuuucauauguuugggaaacauuuuaauaacgaauuaauaaacauuuu

SEQ ID NO: 356168 - RNA, 64 nt, hsa
agaaacuuuaaaauguaaaaguuguacacuuucaacauuuuauuacgauuauuauucagcagca

SEQ ID NO: 356169 - RNA, 64 nt, hsa
aaaauaauagagcuugagcugucugaacuauuuuacauuuuauggugucucauagccaauccca

SEQ ID NO: 356170 - RNA, 64 nt, hsa
aaaggcagacaguuuugcuuuaguacaauaguauacauuuuauaaugaugaacuuauaaugauu

SEQ ID NO: 356171 - RNA, 64 nt, hsa
ucacuuuacuuucaaguaauauuggugcuauuuaacauuuuacaguaaauguuacuucugauac

SEQ ID NO: 356172 - RNA, 64 nt, hsa
uuaaagauaacucagcauguuuguaaagcaggauacauuuuacuaaaagguucauugguuccaa

SEQ ID NO: 356173 - RNA, 64 nt, hsa
aauuuuguuaggccacaaaaacacugcacugugaacauuuuagaaaagguaugucagacuggga

SEQ ID NO: 356174 - RNA, 64 nt, hsa
gugaaauuccuaccguuguuguacguucugcaaaacauuuuauguauagauuuagaggggaaac

SEQ ID NO: 356175 - RNA, 64 nt, hsa
uuacugaaaucuuguaaguauuuaagugaucguuacauuuuaggacacugcguuagaugguaau

SEQ ID NO: 356176 - RNA, 64 nt, hsa
acuuuguuauauauaucaaggauguucuggcuuuacauuuuauuuauuagcuguaaauacaugu

SEQ ID NO: 356177 - RNA, 64 nt, hsa
gaagaaauggaaucagcuuuuaauaaaauugacaacauuuuauuaccacacuaagucauuauuu

SEQ ID NO: 356178 - RNA, 64 nt, hsa
aagcuuuguuggagaaagagaauaugaaaauuacacauuuuauaauuuuuagaugagaaaauac

SEQ ID NO: 356179 - RNA, 64 nt, hsa
auauuuucaaucacauacaaguacauagaauuucacauuuuaauuuagcaaauugauuuaccua

SEQ ID NO: 356180 - RNA, 64 nt, hsa
acuuggccuagaaaaguuuggucugcacuauaaaacauuuuacuuauuuuccuacauagaacau

SEQ ID NO: 356181 - RNA, 64 nt, hsa
aaccaaauaaguauauuuagaacuuguuaaaaauacauuuuaauuuaugauauacauauuauuu

SEQ ID NO: 356182 - RNA, 64 nt, hsa
ugggauugaguuaaaacuauuuuauuuuaaauauacauuuuaaagcaguucuuuuuuuuuguua

SEQ ID NO: 356183 - RNA, 64 nt, hsa
uauccccuuccccacguuccagccccugcagcccacauuuuaaguauauuccuucaagugaguu

SEQ ID NO: 356184 - RNA, 64 nt, hsa
cggguaauauuccauuguauggaaugguaguacuacauuuuauuuaucaugcaucgauuggugg

SEQ ID NO: 356185 - RNA, 64 nt, hsa
ccuucugcccauccccuucaguucacaaaagcugacauuuuaaacaaaucaugacucacacgua

SEQ ID NO: 356186 - RNA, 64 nt, hsa
uagguucuuucuuaaauuguugguggaugacuguacauuuuagugauuugaaaaauaacugaca

SEQ ID NO: 356187 - RNA, 64 nt, hsa
uuguucuggguuuugguuuucuucacaaucuugaacauuuuacaguagaacucaucuaaaaaug

SEQ ID NO: 356188 - RNA, 64 nt, hsa
ccacuguuaaaaccacauguguaugugcagcuuuacauuuuauuuuacgugaagcaugugauua

SEQ ID NO: 356189 - RNA, 64 nt, hsa
acgaucgcauaugcugcauuucacguuuuauuggacauuuuaccccacugagugguaaaaagga

SEQ ID NO: 356190 - RNA, 64 nt, hsa
uauuaacauugaacacugcugcgauugcucaaggacauuuuauguuacggcuuuaaagcaaagg

SEQ ID NO: 356191 - RNA, 64 nt, hsa
uuuaauuuguaaauauugacaauuuucuuucugcacauuuuaaucuuaguuucccuuuugauuu

SEQ ID NO: 356192 - RNA, 64 nt, hsa
gcaaaugacuaguaaacaugugggaaaaaauauuacauuuuaagggggaaaaaaaaacccacca

SEQ ID NO: 356193 - RNA, 64 nt, hsa
aacugaaaguuuaacuauuuaaaagacuaaaugcacauuuuaugguaucugauauuuuaaaaag

SEQ ID NO: 356194 - RNA, 64 nt, hsa
uguauacacuaucugccaguuagucacuuacuugacauuuuaguuaucagaucaccugucaggg

SEQ ID NO: 356195 - RNA, 64 nt, hsa
aguuauuaaauggauccagaaauaaacaauuccuacauuuuaaacugcacccgauucugaguag

SEQ ID NO: 356196 - RNA, 64 nt, hsa
aaugcacucagcucaacugcuguguuuaaaauacacauuuuaaaucccucuuuacagacacuaa

SEQ ID NO: 356197 - RNA, 64 nt, hsa
auagaaaaagaaaaaaggcuggguuuacuauugcacauuuuaagcuuuuauaccuuuaucuucu

SEQ ID NO: 356198 - RNA, 64 nt, hsa
auguuuccagaaaugacugauauuuuauauuuauacauuuuagaugacaaagcuugauauuuau

SEQ ID NO: 356199 - RNA, 64 nt, hsa
uuagaugacaaagcuugauauuuauugcuguugcacauuuuaaaguuuucuuuuuggguugcuc

SEQ ID NO: 356200 - RNA, 64 nt, hsa
ugauuuguuacuauaauuaaccuguauaaaagauacauuuuauggugguuucaguaggucauuu

SEQ ID NO: 356201 - RNA, 64 nt, hsa
guugcuuagaauaaucauuacuguuauaugagaaacauuuuaguaauuuaauaaaaggauaaug

SEQ ID NO: 356202 - RNA, 64 nt, hsa
uaccucccauguguggacauccugggacuuguuuacauuuuaucuguaauaagauaacugacuc

SEQ ID NO: 356203 - RNA, 64 nt, hsa
uguaacucucugggugacaugauaccuauucgaaacauuuuauacaaacuuuuauagacaaauu

SEQ ID NO: 356204 - RNA, 64 nt, hsa
caauauuuugacucuauuaccuguuuugccuuauacauuuuagaaacuggaaauuuuuuaaaga

SEQ ID NO: 356205 - RNA, 64 nt, hsa
aguauccuaugccuauacacuuuaaaauguauauacauuuuagacaaaaaugcacacuccagua

SEQ ID NO: 356206 - RNA, 64 nt, hsa
uguauuuauuugacuucauuccguauuugaaagcacauuuuaauuuuuauuugccuuguuuugu

SEQ ID NO: 356207 - RNA, 64 nt, hsa
guugguuauuuuuaauaagccucuuccuacuagaacauuuuauuuuccuuguucaccauacaau

SEQ ID NO: 356208 - RNA, 64 nt, hsa
aaauuguaaagauugacaauagacuuaagaaauaacauuuuaaaaucuauuuuauacuuaccau

SEQ ID NO: 356209 - RNA, 64 nt, hsa
uuacaggcgugagccaccgcgccuggccaaaacaacauuuuaaguagaagauccagguuuuagu

SEQ ID NO: 356210 - RNA, 64 nt, hsa
ucaguucuguguacauuuuaaaggauaauggugaacauuuuaauggguuucccuugcccuuucc

SEQ ID NO: 356211 - RNA, 64 nt, hsa
ugacaaauguguaugugugguuucaguucuguguacauuuuaaaggauaauggugaacauuuua

SEQ ID NO: 356212 - RNA, 64 nt, hsa
ccaaaggagaagacaguaagaacagacauaagggacauuuuaguuugggcuaguguccugccuc

SEQ ID NO: 356213 - RNA, 64 nt, hsa
ucuccacuggaaagguggaauugaaaugugguccacauuuuaacuagcuauuuccuggggcugu

SEQ ID NO: 356214 - RNA, 64 nt, hsa
gcuaacucauuuucuuugaguuaaagcuguguauacauuuuaaaaggcauauagauaguguaug

SEQ ID NO: 356215 - RNA, 64 nt, hsa
cuaacaguacgcacugaauagugaaaauaauuagacauuuuaagaaccagagccauagaauuau

SEQ ID NO: 356216 - RNA, 64 nt, hsa
uauacguaguaaugcuagcagguaauuuuaguagacauuuuauaacaacugucacuuuguuucg

SEQ ID NO: 356217 - RNA, 64 nt, hsa
uaugagaaaugagaauuauuuauuugccaucaacacauuuuauacuuugcaucuccaaauuuau

SEQ ID NO: 356218 - RNA, 64 nt, hsa
acauucaucaguuggugaguuuugaagaauaacuacauuuuauuucaaacuaacaaauguauac

SEQ ID NO: 356219 - RNA, 64 nt, hsa
auaaacaguaccaauaucauuauagaaaaaaauaacauuuuaauguauauuguucuaacaauca

SEQ ID NO: 356220 - RNA, 64 nt, hsa
gcauauaauaaagaagcuacuauuuuggaaaaugacauuuuacuauuugccaauguauauugca

SEQ ID NO: 356221 - RNA, 64 nt, hsa
aauugcaccagaaauguuuauggaaauauuaagaacauuuuauaaaacauacgaaaaagugauu

SEQ ID NO: 356222 - RNA, 64 nt, hsa
aagugaaaauauaacuuuauuuuuuaacucuauuacauuuuauuuugucauguacuaaaauuau

SEQ ID NO: 356223 - RNA, 64 nt, hsa
agaaugaccugucacuauaauauacuguauguuuacauuuuauuuaaauuuaaucucuuaugua

SEQ ID NO: 356224 - RNA, 64 nt, hsa
gaaacuaugccacagucuggauguguuuacugaaacauuuuaauaaggaaguuuauuuuugaua

SEQ ID NO: 356225 - RNA, 64 nt, hsa
uuacuguguauuuuucacuuguuucuaagaucaaacauuuuaauaugugcauguuauauauaaa

SEQ ID NO: 356226 - RNA, 64 nt, hsa
aggagucaaaaaaccuuuucugugaagugcuagaacauuuuagacuuuguuggcuauggucugu

SEQ ID NO: 356227 - RNA, 64 nt, hsa
cuucaggaauauuuugggauaggguugccuuaaaacauuuuacuuggcuuauucaauuucuaaa

SEQ ID NO: 356228 - RNA, 64 nt, hsa
ccuaagugugugauacaguuuguuacuuuuaaguacauuuuaauaauuucagacaucugcauuu

SEQ ID NO: 356229 - RNA, 64 nt, hsa
uuaaaccgauauuuuauauuauuuaaguuagguaacauuuuauauuacuuucauaugaauaaaa

SEQ ID NO: 356230 - RNA, 64 nt, hsa
auucucuaugcauuuaaaaaaaaauguaaacuugacauuuuagggucuucaguuacacauacac

SEQ ID NO: 356231 - RNA, 64 nt, hsa
ucuuggcugcacaagauauccauuacguacuuauacauuuuaaaaugaguacuaauuuucacug

SEQ ID NO: 356232 - RNA, 64 nt, hsa
agcauuuuucucuaaccuauaacaaggagacauuacauuuuacuuuagaacaugagaauagcag

SEQ ID NO: 356233 - RNA, 64 nt, hsa
cuaauugauacauuuuauguuaauuuaccaccauacauuuuauuaaucaaaauuguauagcaug

SEQ ID NO: 356234 - RNA, 64 nt, hsa
auagagccuagcaguuacuuuguaucuaauugauacauuuuauguuaauuuaccaccauacauu

SEQ ID NO: 356235 - RNA, 64 nt, hsa
ucauacuaaaauuucugucauauguauacugaagacauuuuaaaaaccagaauauguagucuac

SEQ ID NO: 356236 - RNA, 64 nt, hsa
uuuuaaugaacauuggcuggcauguuggugaaucacauuuuaguuuucugaugccacauagucu

SEQ ID NO: 356237 - RNA, 64 nt, hsa
aucuuugcaucuaaagcaaacuaauguauauuucacauuuuauugagccgacuuauuuccacaa

SEQ ID NO: 356238 - RNA, 64 nt, hsa
uuauacagcaacauuucuucaauuagcagucuagacauuuuauaaacagaaaucuuggaccaau

SEQ ID NO: 356239 - RNA, 64 nt, hsa
cuauaaaauacuaugugaaucucuuaaaaaucugacauuuuacagucuguauuagacauacugu

SEQ ID NO: 356240 - RNA, 64 nt, hsa
caaguugacucuucgacccccacccccacccaagacauuuuaauaguaaauagagagagagaga

SEQ ID NO: 356241 - RNA, 64 nt, hsa
cuggaagcuuucaugaauauucucuucuuuuaaaacauuuuaacauuauuuaaacagaaaaaga

SEQ ID NO: 356242 - RNA, 64 nt, hsa
aaauguaacugcuaucuuaauguucugaaauaaaacauuuuaaaauauaaauccuguaguuuaa

SEQ ID NO: 356243 - RNA, 64 nt, hsa
accuuuccuagcuuagagcauuuguaucuacaauacauuuuaaagucagaguucguguucccug

SEQ ID NO: 356244 - RNA, 64 nt, hsa
caauuuugagcuaagcacucaagguggauacuuuacauuuuaaagcuggaaucagcaacagccc

SEQ ID NO: 356245 - RNA, 64 nt, hsa
cauauuccucucuguuguguuucggggggaaaagacauuuuagccuuuuuuaaaaguuacugau

SEQ ID NO: 356246 - RNA, 64 nt, hsa
accuaauacuguaauuugauuugagccauaaaacacauuuuaauauuagcuuguauuauaguua

SEQ ID NO: 356247 - RNA, 64 nt, hsa
ugcagagaacucccaguauaauucacugaccaguacauuuuauaaccauccaggccuugguuug

SEQ ID NO: 356248 - RNA, 64 nt, hsa
agaaaauuuugcagaagcuauguuuuuaaaguguacauuuuauaaaguuuaucagauauuuuca

SEQ ID NO: 356249 - RNA, 64 nt, hsa
guuuucuaucccucuaagaguauacuugaaucagacauuuuaaggaugucacuauggcacuguu

SEQ ID NO: 356250 - RNA, 64 nt, hsa
ugcuugcuggaaaugaaauauaguuuaagaccaaacauuuuacuaauaaacaaauuuuaaguau

SEQ ID NO: 356251 - RNA, 64 nt, hsa
gaggagcuaaccccucuacuccacuuucaaaacuacauuuuaaagggaauguguaugugaagag

SEQ ID NO: 356252 - RNA, 64 nt, hsa
aacgugccuucuguauaaguuuauguuuauuccuacauuuuauucauuuuuaauguauggguaa

SEQ ID NO: 356253 - RNA, 64 nt, hsa
gcuuuuaucauuuuugcaauucagacaaggguaaacauuuuacuuuauguaauugccacauccc

SEQ ID NO: 356254 - RNA, 64 nt, hsa
aauguccuccaggagaaaguguuagagggaacuaacauuuuaggaaugcuuauucagaaaaaaa

SEQ ID NO: 356255 - RNA, 64 nt, hsa
gagaggagcucauuucagauuccuaaagaaauagacauuuuacuguuauuuugaaagggcaucu

SEQ ID NO: 356256 - RNA, 64 nt, hsa
uugugucuuuucucaauuuauuagcaaacacaagacauuuuauguauuauuucgauuuacuucc

SEQ ID NO: 356257 - RNA, 64 nt, hsa
uacuucuagguauuacagaaacagucuguaaaugacauuuuaagaugcaaauuuaauucuguuc

SEQ ID NO: 356258 - RNA, 64 nt, hsa
gcaguuaagaauaaaccuuaaagcaaagacaaccacauuuuaauuuguucacaguauguaaauc

SEQ ID NO: 356259 - RNA, 64 nt, hsa
uaaggcuuucuuauuguaaaaauguucaugaacgacauuuuacucaauagagauucuucauuau

SEQ ID NO: 356260 - RNA, 64 nt, hsa
uguuaauaauuccucuagauagaauaauguagaaacauuuuauuuguggacuacagcuuauuca

SEQ ID NO: 356261 - RNA, 64 nt, hsa
ccugcaggguuuauaaaaaauggccuggagugacacauuuuauuauaccuaauauucacugcau

SEQ ID NO: 356262 - RNA, 64 nt, hsa
aaauuugaaaauuguauuuagaauaagaaauuuuacauuuuaaacccuauuguccuuuaugcau

SEQ ID NO: 356263 - RNA, 64 nt, hsa
gcuauuucauuaagugugauauaaaccuccucaaacauuuuacuuagaggcaaggauugucuaa

SEQ ID NO: 356264 - RNA, 64 nt, hsa
ucacuaucaguguggagacaagcacagcacacagacauuuuaggaaggaaaggaacuacgaaau

SEQ ID NO: 356265 - RNA, 64 nt, hsa
agacgcaccugacuuuuuggaguuugcacagcaaacauuuuacacaguuuuauuucuaauaugu

SEQ ID NO: 356266 - RNA, 64 nt, hsa
gagucaacaguaaugauugguuguaagccaagggacauuuuaagcuagugaagaguuuuuucug

SEQ ID NO: 356267 - RNA, 64 nt, hsa
aaaggauuacagcccuuaaaauuuuagcuuaaggacauuuuaaaauugcaugagauuagcaaaa

SEQ ID NO: 356268 - RNA, 64 nt, hsa
gaugcaguguccugcccaguuuuguuugccuccuacauuuuacuguaaaauauuuauugucuuc

SEQ ID NO: 356269 - RNA, 64 nt, hsa
guauccucuuaacuggccauuaucuuguaugugcacauuuuauaaauguacagaaacaucacca

SEQ ID NO: 356270 - RNA, 64 nt, hsa
uuagagaguaauuuuguguauucuuauuuacuuaacauuuuacuuuuaauuauguaaauuuggu

SEQ ID NO: 356271 - RNA, 64 nt, hsa
uuauugaaacaauguaaaaugagccagagauagaacauuuuaagccaucuucaaacucuagcag

SEQ ID NO: 356272 - RNA, 64 nt, hsa
ugauuuuuaucuugucuagauuggcauauuuuuaacauuuuacuuaagauagcaaaccaguucg

SEQ ID NO: 356273 - RNA, 64 nt, hsa
acuuggaccacuuuguauacacucuucucacuugacauuuuagcuauauaauauguacuuugag

SEQ ID NO: 356274 - RNA, 64 nt, hsa
ccccuuuacuagaaguuuuacuagaaaauguauuacauuuuauuuuuucuuaauccaguucugc

SEQ ID NO: 356275 - RNA, 64 nt, hsa
ggcccccaaaauuuaauagauaucuauuucuguuacauuuuauuacuguauggcacaagaaaga

SEQ ID NO: 356276 - RNA, 64 nt, hsa
accaaggcaucucagcuuucuguggcuuaauauaacauuuuaaaauucuaaguguauaguuuca

SEQ ID NO: 356277 - RNA, 64 nt, hsa
aggggaaagugauuuuaaaggugguuucuccagcacauuuuaagaaaagggaccaaaaguuauu

SEQ ID NO: 356278 - RNA, 64 nt, hsa
uaccuaaucagcauauuuuugucugaauacuugaacauuuuaacaguaacgcagguguagaauc

SEQ ID NO: 356279 - RNA, 64 nt, hsa
cguguggcaguguuguaaaaagaaacuaaagaucacauuuuaccuguauggauggaauaucccu

SEQ ID NO: 356280 - RNA, 64 nt, hsa
aguguaaaguacaucagaaauaaaacuguaucugacauuuuaagccuguaguccauuauuacuu

SEQ ID NO: 356281 - RNA, 64 nt, hsa
uuauccucuuaacuggccauuaucuuguaugugcacauuuuauaaauguacagaaacaucacca

SEQ ID NO: 356282 - RNA, 64 nt, hsa; identical to SEQ ID NO: 356270

SEQ ID NO: 356283 - RNA, 64 nt, hsa; identical to SEQ ID NO: 104428

SEQ ID NO: 356284 - RNA, 64 nt, hsa; identical to SEQ ID NO: 104429

SEQ ID NO: 356285 - RNA, 64 nt, hsa; identical to SEQ ID NO: 104430

SEQ ID NO: 356286 - RNA, 64 nt, hsa; identical to SEQ ID NO: 104431

SEQ ID NO: 356287 - RNA, 64 nt, hsa; identical to SEQ ID NO: 104432

SEQ ID NO: 356288 - RNA, 64 nt, hsa; identical to SEQ ID NO: 104433

SEQ ID NO: 356289 - RNA, 64 nt, hsa; identical to SEQ ID NO: 104434

SEQ ID NO: 356290 - RNA, 64 nt, hsa; identical to SEQ ID NO: 104435

SEQ ID NO: 356291 - RNA, 64 nt, hsa; identical to SEQ ID NO: 104436

SEQ ID NO: 356292 - RNA, 64 nt, hsa; identical to SEQ ID NO: 104437

SEQ ID NO: 356293 - RNA, 64 nt, hsa; identical to SEQ ID NO: 104438

SEQ ID NO: 356294 - RNA, 64 nt, hsa; identical to SEQ ID NO: 104439

SEQ ID NO: 356295 - RNA, 64 nt, hsa; identical to SEQ ID NO: 104440

SEQ ID NO: 356296 - RNA, 64 nt, hsa; identical to SEQ ID NO: 104441

SEQ ID NO: 356297 - RNA, 64 nt, hsa; identical to SEQ ID NO: 104442

SEQ ID NO: 356298 - RNA, 64 nt, hsa; identical to SEQ ID NO: 104443

SEQ ID NO: 356299 - RNA, 64 nt, hsa; identical to SEQ ID NO: 104444

SEQ ID NO: 356300 - RNA, 64 nt, hsa; identical to SEQ ID NO: 104445

SEQ ID NO: 356301 - RNA, 64 nt, hsa; identical to SEQ ID NO: 104446

SEQ ID NO: 356302 - RNA, 64 nt, hsa; identical to SEQ ID NO: 104447

SEQ ID NO: 356303 - RNA, 64 nt, hsa; identical to SEQ ID NO: 104448

SEQ ID NO: 356304 - RNA, 64 nt, hsa; identical to SEQ ID NO: 104449

SEQ ID NO: 356305 - RNA, 64 nt, hsa; identical to SEQ ID NO: 104450

SEQ ID NO: 356306 - RNA, 64 nt, hsa; identical to SEQ ID NO: 104451

SEQ ID NO: 356307 - RNA, 64 nt, hsa; identical to SEQ ID NO: 356088

SEQ ID NO: 356308 - RNA, 64 nt, hsa; identical to SEQ ID NO: 356089

SEQ ID NO: 356309 - RNA, 64 nt, hsa; identical to SEQ ID NO: 356090

SEQ ID NO: 356310 - RNA, 64 nt, hsa; identical to SEQ ID NO: 356091

SEQ ID NO: 356311 - RNA, 64 nt, hsa; identical to SEQ ID NO: 356092

SEQ ID NO: 356312 - RNA, 64 nt, hsa; identical to SEQ ID NO: 356093

SEQ ID NO: 356313 - RNA, 64 nt, hsa; identical to SEQ ID NO: 356094

SEQ ID NO: 356314 - RNA, 64 nt, hsa; identical to SEQ ID NO: 356095

SEQ ID NO: 356315 - RNA, 64 nt, hsa; identical to SEQ ID NO: 356096

SEQ ID NO: 356316 - RNA, 64 nt, hsa; identical to SEQ ID NO: 356097

SEQ ID NO: 356317 - RNA, 64 nt, hsa; identical to SEQ ID NO: 356098

SEQ ID NO: 356318 - RNA, 64 nt, hsa; identical to SEQ ID NO: 356099

SEQ ID NO: 356319 - RNA, 64 nt, hsa; identical to SEQ ID NO: 356100

SEQ ID NO: 356320 - RNA, 64 nt, hsa; identical to SEQ ID NO: 356101

SEQ ID NO: 356321 - RNA, 64 nt, hsa; identical to SEQ ID NO: 356102

SEQ ID NO: 356322 - RNA, 64 nt, hsa; identical to SEQ ID NO: 356103

SEQ ID NO: 356323 - RNA, 64 nt, hsa; identical to SEQ ID NO: 356104

SEQ ID NO: 356324 - RNA, 64 nt, hsa; identical to SEQ ID NO: 356105

SEQ ID NO: 356325 - RNA, 64 nt, hsa; identical to SEQ ID NO: 356106

SEQ ID NO: 356326 - RNA, 64 nt, hsa; identical to SEQ ID NO: 356107

SEQ ID NO: 356327 - RNA, 64 nt, hsa; identical to SEQ ID NO: 356108

SEQ ID NO: 356328 - RNA, 64 nt, hsa; identical to SEQ ID NO: 356109

SEQ ID NO: 356329 - RNA, 64 nt, hsa; identical to SEQ ID NO: 356110

SEQ ID NO: 356330 - RNA, 64 nt, hsa; identical to SEQ ID NO: 356111

SEQ ID NO: 356331 - RNA, 64 nt, hsa; identical to SEQ ID NO: 356112

SEQ ID NO: 356332 - RNA, 64 nt, hsa; identical to SEQ ID NO: 356113

SEQ ID NO: 356333 - RNA, 64 nt, hsa; identical to SEQ ID NO: 356114

SEQ ID NO: 356334 - RNA, 64 nt, hsa; identical to SEQ ID NO: 356115

SEQ ID NO: 356335 - RNA, 64 nt, hsa; identical to SEQ ID NO: 356116

SEQ ID NO: 356336 - RNA, 64 nt, hsa; identical to SEQ ID NO: 356117

SEQ ID NO: 356337 - RNA, 64 nt, hsa; identical to SEQ ID NO: 356118

SEQ ID NO: 356338 - RNA, 64 nt, hsa; identical to SEQ ID NO: 356119

SEQ ID NO: 356339 - RNA, 64 nt, hsa; identical to SEQ ID NO: 356120

SEQ ID NO: 356340 - RNA, 64 nt, hsa; identical to SEQ ID NO: 356121

SEQ ID NO: 356341 - RNA, 64 nt, hsa; identical to SEQ ID NO: 356122

SEQ ID NO: 356342 - RNA, 64 nt, hsa; identical to SEQ ID NO: 356123

SEQ ID NO: 356343 - RNA, 64 nt, hsa; identical to SEQ ID NO: 356124

SEQ ID NO: 356344 - RNA, 64 nt, hsa; identical to SEQ ID NO: 356125

SEQ ID NO: 356345 - RNA, 64 nt, hsa; identical to SEQ ID NO: 356126

SEQ ID NO: 356346 - RNA, 64 nt, hsa; identical to SEQ ID NO: 356127

SEQ ID NO: 356347 - RNA, 64 nt, hsa; identical to SEQ ID NO: 356128

SEQ ID NO: 356348 - RNA, 64 nt, hsa; identical to SEQ ID NO: 356129

SEQ ID NO: 356349 - RNA, 64 nt, hsa; identical to SEQ ID NO: 356130

SEQ ID NO: 356350 - RNA, 64 nt, hsa; identical to SEQ ID NO: 356131

SEQ ID NO: 356351 - RNA, 64 nt, hsa; identical to SEQ ID NO: 356132

SEQ ID NO: 356352 - RNA, 64 nt, hsa; identical to SEQ ID NO: 356133

SEQ ID NO: 356353 - RNA, 64 nt, hsa; identical to SEQ ID NO: 356134

SEQ ID NO: 356354 - RNA, 64 nt, hsa; identical to SEQ ID NO: 356135

SEQ ID NO: 356355 - RNA, 64 nt, hsa; identical to SEQ ID NO: 356136

SEQ ID NO: 356356 - RNA, 64 nt, hsa; identical to SEQ ID NO: 356137

SEQ ID NO: 356357 - RNA, 64 nt, hsa; identical to SEQ ID NO: 356138

SEQ ID NO: 356358 - RNA, 64 nt, hsa; identical to SEQ ID NO: 356139

SEQ ID NO: 356359 - RNA, 64 nt, hsa; identical to SEQ ID NO: 356140

SEQ ID NO: 356360 - RNA, 64 nt, hsa; identical to SEQ ID NO: 356141

SEQ ID NO: 356361 - RNA, 64 nt, hsa; identical to SEQ ID NO: 356142

SEQ ID NO: 356362 - RNA, 64 nt, hsa; identical to SEQ ID NO: 356143

SEQ ID NO: 356363 - RNA, 64 nt, hsa; identical to SEQ ID NO: 356144

SEQ ID NO: 356364 - RNA, 64 nt, hsa; identical to SEQ ID NO: 356145

SEQ ID NO: 356365 - RNA, 64 nt, hsa; identical to SEQ ID NO: 356146

SEQ ID NO: 356366 - RNA, 64 nt, hsa; identical to SEQ ID NO: 356147

SEQ ID NO: 356367 - RNA, 64 nt, hsa; identical to SEQ ID NO: 356148

SEQ ID NO: 356368 - RNA, 64 nt, hsa; identical to SEQ ID NO: 356149

SEQ ID NO: 356369 - RNA, 64 nt, hsa; identical to SEQ ID NO: 356150

SEQ ID NO: 356370 - RNA, 64 nt, hsa; identical to SEQ ID NO: 356151

SEQ ID NO: 356371 - RNA, 64 nt, hsa; identical to SEQ ID NO: 356152

SEQ ID NO: 356372 - RNA, 64 nt, hsa; identical to SEQ ID NO: 356153

SEQ ID NO: 356373 - RNA, 64 nt, hsa; identical to SEQ ID NO: 356154

SEQ ID NO: 356374 - RNA, 64 nt, hsa; identical to SEQ ID NO: 356155

SEQ ID NO: 356375 - RNA, 64 nt, hsa; identical to SEQ ID NO: 356156

SEQ ID NO: 356376 - RNA, 64 nt, hsa; identical to SEQ ID NO: 356157

SEQ ID NO: 356377 - RNA, 64 nt, hsa; identical to SEQ ID NO: 356158

SEQ ID NO: 356378 - RNA, 64 nt, hsa; identical to SEQ ID NO: 356159

SEQ ID NO: 356379 - RNA, 64 nt, hsa; identical to SEQ ID NO: 356160

SEQ ID NO: 356380 - RNA, 64 nt, hsa; identical to SEQ ID NO: 356161

SEQ ID NO: 356381 - RNA, 64 nt, hsa; identical to SEQ ID NO: 356162

SEQ ID NO: 356382 - RNA, 64 nt, hsa; identical to SEQ ID NO: 356163

SEQ ID NO: 356383 - RNA, 64 nt, hsa; identical to SEQ ID NO: 356164

SEQ ID NO: 356384 - RNA, 64 nt, hsa; identical to SEQ ID NO: 356165

SEQ ID NO: 356385 - RNA, 64 nt, hsa; identical to SEQ ID NO: 356166

SEQ ID NO: 356386 - RNA, 64 nt, hsa; identical to SEQ ID NO: 356167

SEQ ID NO: 356387 - RNA, 64 nt, hsa; identical to SEQ ID NO: 356168

SEQ ID NO: 356388 - RNA, 64 nt, hsa; identical to SEQ ID NO: 356169

SEQ ID NO: 356389 - RNA, 64 nt, hsa; identical to SEQ ID NO: 356170

SEQ ID NO: 356390 - RNA, 64 nt, hsa; identical to SEQ ID NO: 356171

SEQ ID NO: 356391 - RNA, 64 nt, hsa; identical to SEQ ID NO: 356172

SEQ ID NO: 356392 - RNA, 64 nt, hsa; identical to SEQ ID NO: 356173

SEQ ID NO: 356393 - RNA, 64 nt, hsa; identical to SEQ ID NO: 356174

SEQ ID NO: 356394 - RNA, 64 nt, hsa; identical to SEQ ID NO: 356175

SEQ ID NO: 356395 - RNA, 64 nt, hsa; identical to SEQ ID NO: 356176

SEQ ID NO: 356396 - RNA, 64 nt, hsa; identical to SEQ ID NO: 356177

SEQ ID NO: 356397 - RNA, 64 nt, hsa; identical to SEQ ID NO: 356178

SEQ ID NO: 356398 - RNA, 64 nt, hsa; identical to SEQ ID NO: 356179

SEQ ID NO: 356399 - RNA, 64 nt, hsa; identical to SEQ ID NO: 356180

SEQ ID NO: 356400 - RNA, 64 nt, hsa; identical to SEQ ID NO: 356181

SEQ ID NO: 356401 - RNA, 64 nt, hsa; identical to SEQ ID NO: 356182

SEQ ID NO: 356402 - RNA, 64 nt, hsa; identical to SEQ ID NO: 356183

SEQ ID NO: 356403 - RNA, 64 nt, hsa; identical to SEQ ID NO: 356184

SEQ ID NO: 356404 - RNA, 64 nt, hsa; identical to SEQ ID NO: 356185

SEQ ID NO: 356405 - RNA, 64 nt, hsa; identical to SEQ ID NO: 356186

SEQ ID NO: 356406 - RNA, 64 nt, hsa; identical to SEQ ID NO: 356187

SEQ ID NO: 356407 - RNA, 64 nt, hsa; identical to SEQ ID NO: 356188

SEQ ID NO: 356408 - RNA, 64 nt, hsa; identical to SEQ ID NO: 356189

SEQ ID NO: 356409 - RNA, 64 nt, hsa; identical to SEQ ID NO: 356190

SEQ ID NO: 356410 - RNA, 64 nt, hsa; identical to SEQ ID NO: 356191

SEQ ID NO: 356411 - RNA, 64 nt, hsa; identical to SEQ ID NO: 356192

SEQ ID NO: 356412 - RNA, 64 nt, hsa; identical to SEQ ID NO: 356193

SEQ ID NO: 356413 - RNA, 64 nt, hsa; identical to SEQ ID NO: 356194

SEQ ID NO: 356414 - RNA, 64 nt, hsa; identical to SEQ ID NO: 356195

SEQ ID NO: 356415 - RNA, 64 nt, hsa; identical to SEQ ID NO: 356196

SEQ ID NO: 356416 - RNA, 64 nt, hsa; identical to SEQ ID NO: 356197

SEQ ID NO: 356417 - RNA, 64 nt, hsa; identical to SEQ ID NO: 356198

SEQ ID NO: 356418 - RNA, 64 nt, hsa; identical to SEQ ID NO: 356199

SEQ ID NO: 356419 - RNA, 64 nt, hsa; identical to SEQ ID NO: 356200

SEQ ID NO: 356420 - RNA, 64 nt, hsa; identical to SEQ ID NO: 356201

SEQ ID NO: 356421 - RNA, 64 nt, hsa; identical to SEQ ID NO: 356202

SEQ ID NO: 356422 - RNA, 64 nt, hsa; identical to SEQ ID NO: 356203

SEQ ID NO: 356423 - RNA, 64 nt, hsa; identical to SEQ ID NO: 356204

SEQ ID NO: 356424 - RNA, 64 nt, hsa; identical to SEQ ID NO: 356205

SEQ ID NO: 356425 - RNA, 64 nt, hsa; identical to SEQ ID NO: 356206

SEQ ID NO: 356426 - RNA, 64 nt, hsa; identical to SEQ ID NO: 356207

SEQ ID NO: 356427 - RNA, 64 nt, hsa; identical to SEQ ID NO: 356208

SEQ ID NO: 356428 - RNA, 64 nt, hsa; identical to SEQ ID NO: 356209

SEQ ID NO: 356429 - RNA, 64 nt, hsa; identical to SEQ ID NO: 356210

SEQ ID NO: 356430 - RNA, 64 nt, hsa; identical to SEQ ID NO: 356211

SEQ ID NO: 356431 - RNA, 64 nt, hsa; identical to SEQ ID NO: 356212

SEQ ID NO: 356432 - RNA, 64 nt, hsa; identical to SEQ ID NO: 356213

SEQ ID NO: 356433 - RNA, 64 nt, hsa; identical to SEQ ID NO: 356214

SEQ ID NO: 356434 - RNA, 64 nt, hsa; identical to SEQ ID NO: 356215

SEQ ID NO: 356435 - RNA, 64 nt, hsa; identical to SEQ ID NO: 356216

SEQ ID NO: 356436 - RNA, 64 nt, hsa; identical to SEQ ID NO: 356217

SEQ ID NO: 356437 - RNA, 64 nt, hsa; identical to SEQ ID NO: 356218

SEQ ID NO: 356438 - RNA, 64 nt, hsa; identical to SEQ ID NO: 356219

SEQ ID NO: 356439 - RNA, 64 nt, hsa; identical to SEQ ID NO: 356220

SEQ ID NO: 356440 - RNA, 64 nt, hsa; identical to SEQ ID NO: 356221

SEQ ID NO: 356441 - RNA, 64 nt, hsa; identical to SEQ ID NO: 356222

SEQ ID NO: 356442 - RNA, 64 nt, hsa; identical to SEQ ID NO: 356223

SEQ ID NO: 356443 - RNA, 64 nt, hsa; identical to SEQ ID NO: 356224

SEQ ID NO: 356444 - RNA, 64 nt, hsa; identical to SEQ ID NO: 356225

SEQ ID NO: 356445 - RNA, 64 nt, hsa; identical to SEQ ID NO: 356226

SEQ ID NO: 356446 - RNA, 64 nt, hsa; identical to SEQ ID NO: 356227

SEQ ID NO: 356447 - RNA, 64 nt, hsa; identical to SEQ ID NO: 356228

SEQ ID NO: 356448 - RNA, 64 nt, hsa; identical to SEQ ID NO: 356229

SEQ ID NO: 356449 - RNA, 64 nt, hsa; identical to SEQ ID NO: 356230

SEQ ID NO: 356450 - RNA, 64 nt, hsa; identical to SEQ ID NO: 356231

SEQ ID NO: 356451 - RNA, 64 nt, hsa; identical to SEQ ID NO: 356232

SEQ ID NO: 356452 - RNA, 64 nt, hsa; identical to SEQ ID NO: 356233

SEQ ID NO: 356453 - RNA, 64 nt, hsa; identical to SEQ ID NO: 356234

SEQ ID NO: 356454 - RNA, 64 nt, hsa; identical to SEQ ID NO: 356235

SEQ ID NO: 356455 - RNA, 64 nt, hsa; identical to SEQ ID NO: 356236

SEQ ID NO: 356456 - RNA, 64 nt, hsa; identical to SEQ ID NO: 356237

SEQ ID NO: 356457 - RNA, 64 nt, hsa; identical to SEQ ID NO: 356238

SEQ ID NO: 356458 - RNA, 64 nt, hsa; identical to SEQ ID NO: 356239

SEQ ID NO: 356459 - RNA, 64 nt, hsa; identical to SEQ ID NO: 356240

SEQ ID NO: 356460 - RNA, 64 nt, hsa; identical to SEQ ID NO: 356241

SEQ ID NO: 356461 - RNA, 64 nt, hsa; identical to SEQ ID NO: 356242

SEQ ID NO: 356462 - RNA, 64 nt, hsa; identical to SEQ ID NO: 356243

SEQ ID NO: 356463 - RNA, 64 nt, hsa; identical to SEQ ID NO: 356244

SEQ ID NO: 356464 - RNA, 64 nt, hsa; identical to SEQ ID NO: 356245

SEQ ID NO: 356465 - RNA, 64 nt, hsa; identical to SEQ ID NO: 356246

SEQ ID NO: 356466 - RNA, 64 nt, hsa; identical to SEQ ID NO: 356247

SEQ ID NO: 356467 - RNA, 64 nt, hsa; identical to SEQ ID NO: 356248

SEQ ID NO: 356468 - RNA, 64 nt, hsa; identical to SEQ ID NO: 356249

SEQ ID NO: 356469 - RNA, 64 nt, hsa; identical to SEQ ID NO: 356250

SEQ ID NO: 356470 - RNA, 64 nt, hsa; identical to SEQ ID NO: 356251

SEQ ID NO: 356471 - RNA, 64 nt, hsa; identical to SEQ ID NO: 356252

SEQ ID NO: 356472 - RNA, 64 nt, hsa; identical to SEQ ID NO: 356253

SEQ ID NO: 356473 - RNA, 64 nt, hsa; identical to SEQ ID NO: 356254

SEQ ID NO: 356474 - RNA, 64 nt, hsa; identical to SEQ ID NO: 356255

SEQ ID NO: 356475 - RNA, 64 nt, hsa; identical to SEQ ID NO: 356256

SEQ ID NO: 356476 - RNA, 64 nt, hsa; identical to SEQ ID NO: 356257

SEQ ID NO: 356477 - RNA, 64 nt, hsa; identical to SEQ ID NO: 356258

SEQ ID NO: 356478 - RNA, 64 nt, hsa; identical to SEQ ID NO: 356259

SEQ ID NO: 356479 - RNA, 64 nt, hsa; identical to SEQ ID NO: 356260

SEQ ID NO: 356480 - RNA, 64 nt, hsa; identical to SEQ ID NO: 356261

SEQ ID NO: 356481 - RNA, 64 nt, hsa; identical to SEQ ID NO: 356262

SEQ ID NO: 356482 - RNA, 64 nt, hsa; identical to SEQ ID NO: 356263

SEQ ID NO: 356483 - RNA, 64 nt, hsa; identical to SEQ ID NO: 356264

SEQ ID NO: 356484 - RNA, 64 nt, hsa; identical to SEQ ID NO: 356265

SEQ ID NO: 356485 - RNA, 64 nt, hsa; identical to SEQ ID NO: 356266

SEQ ID NO: 356486 - RNA, 64 nt, hsa; identical to SEQ ID NO: 356267

SEQ ID NO: 356487 - RNA, 64 nt, hsa; identical to SEQ ID NO: 356268

SEQ ID NO: 356488 - RNA, 64 nt, hsa; identical to SEQ ID NO: 356269

SEQ ID NO: 356489 - RNA, 64 nt, hsa; identical to SEQ ID NO: 356270

SEQ ID NO: 356490 - RNA, 64 nt, hsa; identical to SEQ ID NO: 356271

SEQ ID NO: 356491 - RNA, 64 nt, hsa; identical to SEQ ID NO: 356272

SEQ ID NO: 356492 - RNA, 64 nt, hsa; identical to SEQ ID NO: 356273

SEQ ID NO: 356493 - RNA, 64 nt, hsa; identical to SEQ ID NO: 356274

SEQ ID NO: 356494 - RNA, 64 nt, hsa; identical to SEQ ID NO: 356275

SEQ ID NO: 356495 - RNA, 64 nt, hsa; identical to SEQ ID NO: 356276

SEQ ID NO: 356496 - RNA, 64 nt, hsa; identical to SEQ ID NO: 356277

SEQ ID NO: 356497 - RNA, 64 nt, hsa; identical to SEQ ID NO: 356278

SEQ ID NO: 356498 - RNA, 64 nt, hsa; identical to SEQ ID NO: 356279

SEQ ID NO: 356499 - RNA, 64 nt, hsa; identical to SEQ ID NO: 356280

SEQ ID NO: 356500 - RNA, 64 nt, hsa; identical to SEQ ID NO: 356281

SEQ ID NO: 356501 - RNA, 64 nt, hsa; identical to SEQ ID NO: 356270

SEQ ID NO: 356502 - RNA, 64 nt, hsa
ugauaaauagaauacacagaauagugaugaaauucaauuuaaaaaaucacguuagccuccaaac

SEQ ID NO: 356503 - RNA, 64 nt, hsa
gcauugauuuauaaauaguugucaguucacauagcaauuuaaucaaguaaucauuaauuaguua

SEQ ID NO: 356504 - RNA, 64 nt, hsa
cugagagcauaaaauaaaccugacuguaugaagucaauuuaagugaugagaacauuuaacuuug

SEQ ID NO: 356505 - RNA, 64 nt, hsa
cuuuggaaucgugucuuccaugcuccacuggguucaauuuaaaauaggagaggcuuucucuucu

SEQ ID NO: 356506 - RNA, 64 nt, hsa
gaccuuuuaggggcagcaaugcugaaggacacagcaauuuaaauuauaaugugucaggcugugu

SEQ ID NO: 356507 - RNA, 64 nt, hsa
guucaaggagccagacgaaauaaggccugucuuccaauuuaaccaaagauaaaggacuagagcc

SEQ ID NO: 356508 - RNA, 64 nt, hsa
caucucucucucccccuaccuaccaaacuauccacaauuuaaauaaagaacugcugugucugac

SEQ ID NO: 356509 - RNA, 64 nt, hsa
guuagggagaagauugaugcaauaggacaauuuccaauuuaauuuagauccucuaaucuuucua

SEQ ID NO: 356510 - RNA, 64 nt, hsa
aaguuuaauugugcaacaaauuuguauuagaguacaauuuaaaguguuuuucucuauagccuuu

SEQ ID NO: 356511 - RNA, 64 nt, hsa
ucuuguuccaagaugagccucugcaauauucuggcaauuuaauauacccccuacaaaagcacuc

SEQ ID NO: 356512 - RNA, 64 nt, hsa
gccacaauuuaaaaauaaaaccagagguuauauacaauuuaaauugggcuaaaaauuaaaaauu

SEQ ID NO: 356513 - RNA, 64 nt, hsa
aauaaaguguauauuaggauuuaaauuuaugccacaauuuaaaaauaaaaccagagguuauaua

SEQ ID NO: 356514 - RNA, 64 nt, hsa
cuuauuuuacuuguuuuuaauuauucauucauggcaauuuaaaaagucauauuuuaagugggau

SEQ ID NO: 356515 - RNA, 64 nt, hsa
uuuuuaagggacuuuuuaagaguuccuuaagaaccaauuuaaaauuacuucagugcaauccuac

SEQ ID NO: 356516 - RNA, 64 nt, hsa
uuuuuuuuucuuuuccacuguuuguaaggugcaacaauuuaauauuuuuaagggacuuuuuaag

SEQ ID NO: 356517 - RNA, 64 nt, hsa
ggugcuagagaagagacuuagcuucugauacugccaauuuaaugugagaacaugggguauacug

SEQ ID NO: 356518 - RNA, 64 nt, hsa
ucuuaugaacaacuguagucaaaauaagguggcacaauuuaauuguuuuguaucagaaauacac

SEQ ID NO: 356519 - RNA, 64 nt, hsa
cugagucaauuuaacaauccugacaugcucccuccaauuuaaaagcgcacacacacacacacac

SEQ ID NO: 356520 - RNA, 64 nt, hsa
aagauauuuuggagauaaacaagacaaacugagucaauuuaacaauccugacaugcucccucca

SEQ ID NO: 356521 - RNA, 64 nt, hsa
aaccacuggucuagcuuuagauaggauauugagccaauuuaaauaaagcaauauacuggucuag

SEQ ID NO: 356522 - RNA, 64 nt, hsa
aagaauaaagauuucuuuagauagguuguugagccaauuuaaguaaagcaauguuauugugaca

SEQ ID NO: 356523 - RNA, 64 nt, hsa
aaguaguguuuccugauucugaagcauagcugaacaauuuaauugugguuuaccaucuuuuugg

SEQ ID NO: 356524 - RNA, 64 nt, hsa
gguggugagaaugcugacugaaaaauagaaugaucaauuuaaucugaaacaaaugguuauuucu

SEQ ID NO: 356525 - RNA, 64 nt, hsa
gagaaaaaguuuaaaauucucaauacaaaucaaacaauuuaaauauuuuaagaaaaaaggaaaa

SEQ ID NO: 356526 - RNA, 64 nt, hsa
uaaagaggauagacaaccucuuaaaauauuuuuacaauuuaaugagaaaaaguuuaaaauucuc

SEQ ID NO: 356527 - RNA, 64 nt, hsa
ugaaagcaacagagguuuguuuuagaacugaaggcaauuuaaucaaaauuccugucaagaaaag

SEQ ID NO: 356528 - RNA, 64 nt, hsa
aguuuuaaagcacuuuguaguucucuauugccaacaauuuaauguuuauguguugccaauucuu

SEQ ID NO: 356529 - RNA, 64 nt, hsa
uugcugaguccucauaaucaauuggcuauaaucacaauuuaauaauuuaucaaugcaaacagua

SEQ ID NO: 356530 - RNA, 64 nt, hsa
aaauagcacaauaaauuuccuuaaaauuucauagcaauuuaaagcacaagcacaauguucaggc

SEQ ID NO: 356531 - RNA, 64 nt, hsa
guuauguuagaauuuacacugaggagaaaauugucaauuuaagaaaucuaaagugaaaauuuug

SEQ ID NO: 356532 - RNA, 64 nt, hsa
caggcccaucccagauguuugugauguccugaaacaauuuaaaaggagacccacagagcuaaug

SEQ ID NO: 356533 - RNA, 64 nt, hsa
caggcccaucccagguguuugucguguccugaaacaauuuaaauagagacccacagagcuaaug

SEQ ID NO: 356534 - RNA, 64 nt, hsa
auuauguuagcauuuacacugaggagaaaauugucaauuuaagaaaucuaaagugaaaauuuug

SEQ ID NO: 356535 - RNA, 64 nt, hsa
ucuucacuauaacugagugguaauuuaaagacaacaauuuaaugucacuaauuuucaaaauuaa

SEQ ID NO: 356536 - RNA, 64 nt, hsa
ugucacuaauuuucaaaauuaaauaguuuaagcucaauuuaauuuugcuagauauuuaacaaaa

SEQ ID NO: 356537 - RNA, 64 nt, hsa
aguuuuauggaauugggagucugacaagugaaaccaauuuaauguaaaguauuuggcuuucaaa

SEQ ID NO: 356538 - RNA, 64 nt, hsa
uuucagauuccagagauaucuuacgucuuugauucaauuuaaaauuuguacuuauuuucuuuua

SEQ ID NO: 356539 - RNA, 64 nt, hsa
cucacuguagcauucuuuacugcagagcaaaauucaauuuaagaugggcuucucugagguccac

SEQ ID NO: 356540 - RNA, 64 nt, hsa
aaagcagacugauacuaaauuuaaaauguaguuucaauuuaauaaucacauuagguuuaauuuu

SEQ ID NO: 356541 - RNA, 61 nt, hsa
aaauuguaccacuccuugaagaacuacaggcacaguaaaaaaaauauggcguauuauguga

SEQ ID NO: 356542 - RNA, 61 nt, hsa
caauauuuguguaucuaaauauagaaaagguacaguaaaaauauggucuacuaaggaaaca

SEQ ID NO: 356543 - RNA, 61 nt, hsa
aagcauagcagcagcucugaaaagacacuucacaguaaauaugucaaagguagagacaggu

SEQ ID NO: 356544 - RNA, 61 nt, hsa
gagucaaauucagaacgagaugucacuaaaaacaguaaaaaugacucccauccauccucug

SEQ ID NO: 356545 - RNA, 61 nt, hsa
ccuccucuugaaaaugauuaggcacuuaaggacaguaaagcuguauuuucuggaaggaaga

SEQ ID NO: 356546 - RNA, 61 nt, hsa
caccuuuguuauuuauguuguacuugugaaaacaguaaaauaguuuggauaguuaugcaaa

SEQ ID NO: 356547 - RNA, 61 nt, hsa
ugcuauuaaaucauacaaaagcaaauuuugcacaguaaaccaauaguuugagauuuaaaac

SEQ ID NO: 356548 - RNA, 61 nt, hsa
uucauauuaauuccaggugauuuguuuuuucacaguaaaccauguaaguggaagcuuuacu

SEQ ID NO: 356549 - RNA, 61 nt, hsa
uuuuuuuuggauacagcacaaacuccaguugacaguaaaaugaagcuucuagguauuuugu

SEQ ID NO: 356550 - RNA, 61 nt, hsa
uaaaugcaaaauguuaaguuugaaaugguuaacaguaaauuauuauguuaguuuccaggca

SEQ ID NO: 356551 - RNA, 61 nt, hsa
gagcuucugcacagaaaaagaaacuagcaacacaguaaacagacagccuguagaaugggga

SEQ ID NO: 356552 - RNA, 61 nt, hsa
aaggacagagaaucaaucuaagugcccaacaacaguaaauucaaugaaaaaaaauguggua

SEQ ID NO: 356553 - RNA, 61 nt, hsa
gauggauuaaagacuuaauguaaaacccaaaacaguaaaaauccuggaagacaacccaggc

SEQ ID NO: 356554 - RNA, 61 nt, hsa
uuucuuuacagaauggauuuguuaaacuagcacaguaaaaguaaagacuauucuguuucua

SEQ ID NO: 356555 - RNA, 61 nt, hsa
gucacagcuaaaaagaaagaaaucguuucuaacaguaaauuauugugcuuuaguugcuagu

SEQ ID NO: 356556 - RNA, 61 nt, hsa
ucuuucaaauaaauggcaguuaacuggcuuuacaguaaacauugaagagaggaggauuugu

SEQ ID NO: 356557 - RNA, 61 nt, hsa
guauguaaaaagaaacugcauuuuaagucagacaguaaauguuuuuuuuaauuuacagcaa

SEQ ID NO: 356558 - RNA, 61 nt, hsa
uguuaaugaauuauugauuuuuguaucugccacaguaaauuaaagcauuacacaguauuua

SEQ ID NO: 356559 - RNA, 61 nt, hsa
ucaauuuugugccacugguucagcuguuagcacaguaaaaaaaucauuuguaucaaagggg

SEQ ID NO: 356560 - RNA, 61 nt, hsa
ggaggauaccaucuggcggcugcacauuguaacaguaaaggcagaaagcuguagugauaac

SEQ ID NO: 356561 - RNA, 61 nt, hsa
auacacauauguauacauauauauauauucuacaguaaaacuguagacuguccucguccuu

SEQ ID NO: 356562 - RNA, 61 nt, hsa
gagaucacgacacugcacuccagccugggcaacaguaaaaccuggucuccaaaaaaaaaaa

SEQ ID NO: 356563 - RNA, 61 nt, hsa
uacaacauuuaaugugaaacauuuagugaauacaguaaaggagaaaauaaaauuguuagca

SEQ ID NO: 356564 - RNA, 61 nt, hsa
gucauuuaaaaguaacaaaaacugccauuugacaguaaaggcucuuggcuucuguuggagg

SEQ ID NO: 356565 - RNA, 61 nt, hsa
cugugaagaaaauucauuuuacauuggguagacaguaaaaaacaaguaaaauaacuugaca

SEQ ID NO: 356566 - RNA, 61 nt, hsa
auuugaaagacugggaauuuaaugguuagggacaguaaaucuacuucuuuuuccagggacg

SEQ ID NO: 356567 - RNA, 61 nt, hsa
acacguaaaguagaagaaucuagugcgugggacaguaaaggauccuuucucguacagaaua

SEQ ID NO: 356568 - RNA, 61 nt, hsa
gcggacuuuaaaaaaaauaaugugcuguaacacaguaaauauguacuuguagccuggauag

SEQ ID NO: 356569 - RNA, 61 nt, hsa
ugaugugaccacacucuucuuaauuuuguucacaguaaaaacacuuuuuugaguuauuagg

SEQ ID NO: 356570 - RNA, 61 nt, hsa
guacauaucuuaauuuuggaugaauuuuuccacaguaaagccgaacaguauucuuuuuuga

SEQ ID NO: 356571 - RNA, 61 nt, hsa
aggaacugucaauaauugacagccaacuaauacaguaaacuguuauacuaguuuugagcuu

SEQ ID NO: 356572 - RNA, 64 nt, hsa; identical to SEQ ID NO: 279953

SEQ ID NO: 356573 - RNA, 64 nt, hsa; identical to SEQ ID NO: 279954

SEQ ID NO: 356574 - RNA, 64 nt, hsa; identical to SEQ ID NO: 279955

SEQ ID NO: 356575 - RNA, 64 nt, hsa; identical to SEQ ID NO: 279956

SEQ ID NO: 356576 - RNA, 64 nt, hsa; identical to SEQ ID NO: 279957

SEQ ID NO: 356577 - RNA, 64 nt, hsa; identical to SEQ ID NO: 279958

SEQ ID NO: 356578 - RNA, 64 nt, hsa; identical to SEQ ID NO: 279959

SEQ ID NO: 356579 - RNA, 64 nt, hsa; identical to SEQ ID NO: 279960

SEQ ID NO: 356580 - RNA, 64 nt, hsa; identical to SEQ ID NO: 279961

SEQ ID NO: 356581 - RNA, 64 nt, hsa; identical to SEQ ID NO: 279962

SEQ ID NO: 356582 - RNA, 64 nt, hsa; identical to SEQ ID NO: 279963

SEQ ID NO: 356583 - RNA, 64 nt, hsa; identical to SEQ ID NO: 279964

SEQ ID NO: 356584 - RNA, 64 nt, hsa; identical to SEQ ID NO: 279965

SEQ ID NO: 356585 - RNA, 64 nt, hsa; identical to SEQ ID NO: 279966

SEQ ID NO: 356586 - RNA, 64 nt, hsa; identical to SEQ ID NO: 279967

SEQ ID NO: 356587 - RNA, 64 nt, hsa; identical to SEQ ID NO: 279968

SEQ ID NO: 356588 - RNA, 64 nt, hsa; identical to SEQ ID NO: 53771

SEQ ID NO: 356589 - RNA, 64 nt, hsa; identical to SEQ ID NO: 53772

SEQ ID NO: 356590 - RNA, 64 nt, hsa; identical to SEQ ID NO: 53773

SEQ ID NO: 356591 - RNA, 64 nt, hsa; identical to SEQ ID NO: 53774

SEQ ID NO: 356592 - RNA, 64 nt, hsa; identical to SEQ ID NO: 53775

SEQ ID NO: 356593 - RNA, 64 nt, hsa; identical to SEQ ID NO: 53776

SEQ ID NO: 356594 - RNA, 64 nt, hsa; identical to SEQ ID NO: 53777

SEQ ID NO: 356595 - RNA, 64 nt, hsa; identical to SEQ ID NO: 53778

SEQ ID NO: 356596 - RNA, 64 nt, hsa; identical to SEQ ID NO: 53779

SEQ ID NO: 356597 - RNA, 64 nt, hsa; identical to SEQ ID NO: 53780

SEQ ID NO: 356598 - RNA, 64 nt, hsa; identical to SEQ ID NO: 53781

SEQ ID NO: 356599 - RNA, 64 nt, hsa; identical to SEQ ID NO: 53782

SEQ ID NO: 356600 - RNA, 64 nt, hsa; identical to SEQ ID NO: 53783

SEQ ID NO: 356601 - RNA, 64 nt, hsa; identical to SEQ ID NO: 53784

SEQ ID NO: 356602 - RNA, 64 nt, hsa; identical to SEQ ID NO: 53785

SEQ ID NO: 356603 - RNA, 64 nt, hsa; identical to SEQ ID NO: 53786

SEQ ID NO: 356604 - RNA, 64 nt, hsa; identical to SEQ ID NO: 53787

SEQ ID NO: 356605 - RNA, 64 nt, hsa; identical to SEQ ID NO: 53788

SEQ ID NO: 356606 - RNA, 64 nt, hsa; identical to SEQ ID NO: 53789

SEQ ID NO: 356607 - RNA, 64 nt, hsa; identical to SEQ ID NO: 53790

SEQ ID NO: 356608 - RNA, 64 nt, hsa; identical to SEQ ID NO: 53791

SEQ ID NO: 356609 - RNA, 64 nt, hsa; identical to SEQ ID NO: 53792

SEQ ID NO: 356610 - RNA, 64 nt, hsa; identical to SEQ ID NO: 53793

SEQ ID NO: 356611 - RNA, 64 nt, hsa; identical to SEQ ID NO: 53794

SEQ ID NO: 356612 - RNA, 64 nt, hsa; identical to SEQ ID NO: 53795

SEQ ID NO: 356613 - RNA, 64 nt, hsa; identical to SEQ ID NO: 53796

SEQ ID NO: 356614 - RNA, 64 nt, hsa; identical to SEQ ID NO: 53797

SEQ ID NO: 356615 - RNA, 64 nt, hsa; identical to SEQ ID NO: 53798

SEQ ID NO: 356616 - RNA, 64 nt, hsa; identical to SEQ ID NO: 53799

SEQ ID NO: 356617 - RNA, 64 nt, hsa; identical to SEQ ID NO: 53800

SEQ ID NO: 356618 - RNA, 64 nt, hsa; identical to SEQ ID NO: 53801

SEQ ID NO: 356619 - RNA, 64 nt, hsa; identical to SEQ ID NO: 53802

SEQ ID NO: 356620 - RNA, 64 nt, hsa; identical to SEQ ID NO: 53803

SEQ ID NO: 356621 - RNA, 64 nt, hsa; identical to SEQ ID NO: 53804

SEQ ID NO: 356622 - RNA, 64 nt, hsa; identical to SEQ ID NO: 53805

SEQ ID NO: 356623 - RNA, 64 nt, hsa; identical to SEQ ID NO: 53806

SEQ ID NO: 356624 - RNA, 64 nt, hsa; identical to SEQ ID NO: 53807

SEQ ID NO: 356625 - RNA, 64 nt, hsa; identical to SEQ ID NO: 53808

SEQ ID NO: 356626 - RNA, 64 nt, hsa; identical to SEQ ID NO: 53809

SEQ ID NO: 356627 - RNA, 64 nt, hsa; identical to SEQ ID NO: 53810

SEQ ID NO: 356628 - RNA, 64 nt, hsa; identical to SEQ ID NO: 53811

SEQ ID NO: 356629 - RNA, 64 nt, hsa; identical to SEQ ID NO: 53812

SEQ ID NO: 356630 - RNA, 64 nt, hsa; identical to SEQ ID NO: 53813

SEQ ID NO: 356631 - RNA, 64 nt, hsa; identical to SEQ ID NO: 53814

SEQ ID NO: 356632 - RNA, 64 nt, hsa; identical to SEQ ID NO: 53815

SEQ ID NO: 356633 - RNA, 64 nt, hsa; identical to SEQ ID NO: 296379

SEQ ID NO: 356634 - RNA, 64 nt, hsa; identical to SEQ ID NO: 296380

SEQ ID NO: 356635 - RNA, 64 nt, hsa; identical to SEQ ID NO: 296381

SEQ ID NO: 356636 - RNA, 64 nt, hsa; identical to SEQ ID NO: 296382

SEQ ID NO: 356637 - RNA, 64 nt, hsa; identical to SEQ ID NO: 296383

SEQ ID NO: 356638 - RNA, 64 nt, hsa; identical to SEQ ID NO: 296384

SEQ ID NO: 356639 - RNA, 64 nt, hsa; identical to SEQ ID NO: 296385

SEQ ID NO: 356640 - RNA, 64 nt, hsa; identical to SEQ ID NO: 296386

SEQ ID NO: 356641 - RNA, 64 nt, hsa; identical to SEQ ID NO: 296387

SEQ ID NO: 356642 - RNA, 64 nt, hsa; identical to SEQ ID NO: 296388

SEQ ID NO: 356643 - RNA, 64 nt, hsa; identical to SEQ ID NO: 296389

SEQ ID NO: 356644 - RNA, 64 nt, hsa; identical to SEQ ID NO: 296390

SEQ ID NO: 356645 - RNA, 64 nt, hsa; identical to SEQ ID NO: 296391

SEQ ID NO: 356646 - RNA, 64 nt, hsa; identical to SEQ ID NO: 296392

SEQ ID NO: 356647 - RNA, 64 nt, hsa; identical to SEQ ID NO: 296393

SEQ ID NO: 356648 - RNA, 64 nt, hsa; identical to SEQ ID NO: 296394

SEQ ID NO: 356649 - RNA, 64 nt, hsa; identical to SEQ ID NO: 296395

SEQ ID NO: 356650 - RNA, 64 nt, hsa; identical to SEQ ID NO: 296396

SEQ ID NO: 356651 - RNA, 64 nt, hsa; identical to SEQ ID NO: 296397

SEQ ID NO: 356652 - RNA, 64 nt, hsa; identical to SEQ ID NO: 296398

SEQ ID NO: 356653 - RNA, 64 nt, hsa; identical to SEQ ID NO: 296399

SEQ ID NO: 356654 - RNA, 64 nt, hsa; identical to SEQ ID NO: 296400

SEQ ID NO: 356655 - RNA, 64 nt, hsa; identical to SEQ ID NO: 296401

SEQ ID NO: 356656 - RNA, 64 nt, hsa; identical to SEQ ID NO: 296402

SEQ ID NO: 356657 - RNA, 64 nt, hsa; identical to SEQ ID NO: 296403

SEQ ID NO: 356658 - RNA, 64 nt, hsa; identical to SEQ ID NO: 296404

SEQ ID NO: 356659 - RNA, 64 nt, hsa; identical to SEQ ID NO: 296405

SEQ ID NO: 356660 - RNA, 64 nt, hsa; identical to SEQ ID NO: 296406

SEQ ID NO: 356661 - RNA, 64 nt, hsa; identical to SEQ ID NO: 296407

SEQ ID NO: 356662 - RNA, 64 nt, hsa; identical to SEQ ID NO: 296408

SEQ ID NO: 356663 - RNA, 64 nt, hsa; identical to SEQ ID NO: 296409

SEQ ID NO: 356664 - RNA, 64 nt, hsa; identical to SEQ ID NO: 296410

SEQ ID NO: 356665 - RNA, 64 nt, hsa; identical to SEQ ID NO: 296402

SEQ ID NO: 356666 - RNA, 64 nt, hsa; identical to SEQ ID NO: 296403

SEQ ID NO: 356667 - RNA, 64 nt, hsa; identical to SEQ ID NO: 296404

SEQ ID NO: 356668 - RNA, 64 nt, hsa; identical to SEQ ID NO: 296414

SEQ ID NO: 356669 - RNA, 64 nt, hsa; identical to SEQ ID NO: 296415

SEQ ID NO: 356670 - RNA, 64 nt, hsa; identical to SEQ ID NO: 296416

SEQ ID NO: 356671 - RNA, 64 nt, hsa; identical to SEQ ID NO: 296417

SEQ ID NO: 356672 - RNA, 64 nt, hsa; identical to SEQ ID NO: 296418

SEQ ID NO: 356673 - RNA, 64 nt, hsa; identical to SEQ ID NO: 296419

SEQ ID NO: 356674 - RNA, 64 nt, hsa; identical to SEQ ID NO: 296420

SEQ ID NO: 356675 - RNA, 64 nt, hsa; identical to SEQ ID NO: 296421

SEQ ID NO: 356676 - RNA, 64 nt, hsa; identical to SEQ ID NO: 296422

SEQ ID NO: 356677 - RNA, 64 nt, hsa; identical to SEQ ID NO: 296423

SEQ ID NO: 356678 - RNA, 64 nt, hsa; identical to SEQ ID NO: 296424

SEQ ID NO: 356679 - RNA, 64 nt, hsa; identical to SEQ ID NO: 296425

SEQ ID NO: 356680 - RNA, 64 nt, hsa; identical to SEQ ID NO: 296426

SEQ ID NO: 356681 - RNA, 64 nt, hsa; identical to SEQ ID NO: 296427

SEQ ID NO: 356682 - RNA, 64 nt, hsa; identical to SEQ ID NO: 296428

SEQ ID NO: 356683 - RNA, 64 nt, hsa; identical to SEQ ID NO: 296429

SEQ ID NO: 356684 - RNA, 64 nt, hsa; identical to SEQ ID NO: 296430

SEQ ID NO: 356685 - RNA, 64 nt, hsa; identical to SEQ ID NO: 296431

SEQ ID NO: 356686 - RNA, 63 nt, hsa
aacuccugaccucaggugauccgcccaccucagccucccaaagugcugggaugacagguguga

SEQ ID NO: 356687 - RNA, 63 nt, hsa
gccucucagguucaagugguucuccuuccucagccucccaaguagcugggauuacaggcaccu

SEQ ID NO: 356688 - RNA, 63 nt, hsa
guaugguaggggguuugaagaauccccuguccaccucccaaauccaggcccggcccccucugg

SEQ ID NO: 356689 - RNA, 63 nt, hsa
caaucuccugaccucgugauccacccaccucgaccucccaaagugcugagauuacaggcguga

SEQ ID NO: 356690 - RNA, 63 nt, hsa
aacuccugaccucaagugaucugcccgccucggccucccaaagugcuggaaccacaggccuga

SEQ ID NO: 356691 - RNA, 63 nt, hsa
ggaucucuuggccucaugaucagccugccucggccucccaaagugcugggauuacagguguga

SEQ ID NO: 356692 - RNA, 63 nt, hsa
gccuccuggguucaagcaguucucuugccucagccucccaaguagcugggaugacaggcgcac

SEQ ID NO: 356693 - RNA, 63 nt, hsa
aacuccugaccucaggugauccacccaccuuggccucccaaagugcugggauuacagguguga

SEQ ID NO: 356694 - RNA, 63 nt, hsa
ucugccucccggguucaagccauucugccucagccucccaaguagcugggaguacaggcgucu

SEQ ID NO: 356695 - RNA, 63 nt, hsa
cgauauccugaucucgugauccgccugccucugccucccaaagugcugggauuacagguguga

SEQ ID NO: 356696 - RNA, 63 nt, hsa
aacuccuaaccucgggugauccacccaccuuggccucccaaaguguuaggauuacaggcauga

SEQ ID NO: 356697 - RNA, 63 nt, hsa
ugaucucuugaccucgugauccguccaccucagccucccaaagugcugggauuacagguguga

SEQ ID NO: 356698 - RNA, 63 nt, hsa
gacuccugaccucaggucauccuccugccucggccucccaaagugcugagacuacagguguga

SEQ ID NO: 356699 - RNA, 63 nt, hsa
gaagaucucugccuacaugaaguccagccgcuuccucccaaaaccucuguacacaaggguggc

SEQ ID NO: 356700 - RNA, 63 nt, hsa
ccucagcuacccacuuuccuucaugaacaucccccucccaacacuacccuucccugcacuaaa

SEQ ID NO: 356701 - RNA, 63 nt, hsa
aacuccuggccucaggugauccucuugucucagccucccaaagugcugggauuacaggcauga

SEQ ID NO: 356702 - RNA, 63 nt, hsa
gccucuuggguucaagcgauucuccugccucagccucccaaguagcugggauuacaggcauac

SEQ ID NO: 356703 - RNA, 63 nt, hsa
aacuccugaccucaaguaaucugcccaccucggccucccaaagugcuaggauuacaggaguga

SEQ ID NO: 356704 - RNA, 63 nt, hsa
gcccuccagguucaagugauucuccucccucagccucccaaguagcugggauuacaggcaccc

SEQ ID NO: 356705 - RNA, 63 nt, hsa
aauuccagaccucaggugauccacccgccucggccucccaaagugcugggauuacaggugcga

SEQ ID NO: 356706 - RNA, 63 nt, hsa
gccuccugggcucaagcaauccucccacuucagccucccaaauagcuggggcuaccaugguau

SEQ ID NO: 356707 - RNA, 63 nt, hsa
aacuccuggccucaugugaucugcccaccucagccucccaaaguacagggauuagaguuguga

SEQ ID NO: 356708 - RNA, 63 nt, hsa
aacuccugaccucaggugauccgcccgccucggccucccaaagugcugggauuacaggcguga

SEQ ID NO: 356709 - RNA, 63 nt, hsa
accucccggguucaagugauucuccugccucagccucccaaguagcugggauuacaggcaccc

SEQ ID NO: 356710 - RNA, 63 nt, hsa
aacuacugagcucaagcaaucugccugcuucagccucccaaaguacugggauuuaggcaugag

SEQ ID NO: 356711 - RNA, 63 nt, hsa
auacccaauagguuuuuuucugaucuucucccuccucccaaccuacacccucaaguagacccc

SEQ ID NO: 356712 - RNA, 63 nt, hsa
aacuucugaccucaggugauccacccacuuugaccucccaaagugcugggauuacuagacgua

SEQ ID NO: 356713 - RNA, 63 nt, hsa
aacuccuggccucaagugguccuccugccucagccucccaaaguguggggauuacaggugcga

SEQ ID NO: 356714 - RNA, 63 nt, hsa
aacuccuaaccucaagugauccacccgccucagccucccaaagugcugggauuacagguguga

SEQ ID NO: 356715 - RNA, 63 nt, hsa
cgaacuccugaccucguaaucugcccaccucggccucccaaaguucugggauuacagguguga

SEQ ID NO: 356716 - RNA, 63 nt, hsa
ccggccucugcucuccccacguucacccacccuccucccaauuguuuccccuucacacuccug

SEQ ID NO: 356717 - RNA, 63 nt, hsa
cgaucucuugaccucgugaucugccugccuuggccucccaaagugcugggauuacaggcguga

SEQ ID NO: 356718 - RNA, 63 nt, hsa
aucacuccccacuucuuucugcugugcugcuucccucccaaacuccauuucugucacccuuuu

SEQ ID NO: 356719 - RNA, 63 nt, hsa
cgaucuccugaccucgugauccgccugccucugccucccaaagugcugggauuacaggcguga

SEQ ID NO: 356720 - RNA, 63 nt, hsa
gccucccagguugacaccauucuccugccucacccucccaaguagcugggacuacaggcgccu

SEQ ID NO: 356721 - RNA, 63 nt, hsa
aacuccuggccucaagcaauccucucuccucagccucccaaagugcugggauuacaaguguga

SEQ ID NO: 356722 - RNA, 63 nt, hsa
aacuccuggguucaagcaauccucccaccucggccucccaaagugcugggauugcaggcauga

SEQ ID NO: 356723 - RNA, 63 nt, hsa
agguuguggaauuucuuucuucuccccuucuucccucccaaaagcuuagcuauguauaaagug

SEQ ID NO: 356724 - RNA, 63 nt, hsa
auuaugaucugacuggaaaacaauccuguauccccucccaaagaaucaugggcuuuuuuuuug

SEQ ID NO: 356725 - RNA, 63 nt, hsa
aacuccuaggcuuaagugauccucccgccuuagccucccaagugcuaggauuacaggcaucag

SEQ ID NO: 356726 - RNA, 63 nt, hsa
gccucccagcuucaagcgauucuccuguaucagccucccaaguagcugggauuauaggcaugu

SEQ ID NO: 356727 - RNA, 63 nt, hsa
gccucccggauucaagugauucuccugucucagccucccaaguagcugggauuacagugccug

SEQ ID NO: 356728 - RNA, 63 nt, hsa
cgaacuccugaccucaugagccgcccgccuuggccucccaaagugcugggacgugacaggagu

SEQ ID NO: 356729 - RNA, 63 nt, hsa
aacucuugagcucaagcagucuacccaccuugaccucccaaagugcugggauuacaggcuuga

SEQ ID NO: 356730 - RNA, 63 nt, hsa
gccuucugggcucaagcaauccucccacuucaaccucccaaguagcugggacuauaggcaugc

SEQ ID NO: 356731 - RNA, 63 nt, hsa
aacuccugggcucaagugaucccccugccuuggccucccaaacuggugagauuacaggcauga

SEQ ID NO: 356732 - RNA, 63 nt, hsa
uggcucacugaagucuugaccccgcugccucagccucccaaauaacuggggccacaggugugc

SEQ ID NO: 356733 - RNA, 63 nt, hsa
aacucuugacuucaagugauccgcccgccucagccucccaaagugcugggauuacagguguga

SEQ ID NO: 356734 - RNA, 63 nt, hsa
accuccuggguucaagugauucuugugccucagccucccaaguagcugggauuaaaggcacgu

SEQ ID NO: 356735 - RNA, 63 nt, hsa
aacuccugacuucaggugaucugucugccucggccucccaaagagcugagauuacaggcguga

SEQ ID NO: 356736 - RNA, 63 nt, hsa
accuccugaguucaagccauucuccuaccucagccucccaaguagcugggacuaugggugcac

SEQ ID NO: 356737 - RNA, 63 nt, hsa
ucccccuggguugaagcaauucucaugccucagccucccaaguagccaggacuauaggcaccu

SEQ ID NO: 356738 - RNA, 63 nt, hsa
cgaucucuugaccuugggauccacccgccuuggccucccaaagugcugggauuacagguguga

SEQ ID NO: 356739 - RNA, 63 nt, hsa
aaacccuuggcucaagcaauuugccugccucagccucccaaagugcugggauuacaggcguga

SEQ ID NO: 356740 - RNA, 63 nt, hsa
accuccuggguucaugccauucuucugccucagccucccaaguagcugggacuacaggugccc

SEQ ID NO: 356741 - RNA, 63 nt, hsa
cgaucuccugaccuugugauccaccugucucggccucccaaagugcugggauuacaggccuca

SEQ ID NO: 356742 - RNA, 63 nt, hsa
aacuccugaccuccagugauccgccugccuugaccucccaaagugcugggauuacagacauga

SEQ ID NO: 356743 - RNA, 63 nt, hsa
acuccuggacuuaacgccauccaccugccacagccucccaaagugcuaggaauacaggagugc

SEQ ID NO: 356744 - RNA, 63 nt, hsa
cgccuccugggucaaaugauucuccugcuuuagccucccaaguagcugggacuacagguguac

SEQ ID NO: 356745 - RNA, 63 nt, hsa
aacuccugagcucaagugauccucccgucucagccucccaaagggcugagauuacagguguga

SEQ ID NO: 356746 - RNA, 63 nt, hsa
accuccccggcucaagugauccuccugccucagccucccaaguagcugggacuacaggcguuc

SEQ ID NO: 356747 - RNA, 63 nt, hsa
aacuccuggacucaaaguauccucccgccucggccucccaaaguguugggauuauaggaguga

SEQ ID NO: 356748 - RNA, 63 nt, hsa
gaacuccuggccuaggugauccacccgccucgaccucccaaagugcugggauuacaggcauga

SEQ ID NO: 356749 - RNA, 63 nt, hsa
cuaccucuaccaugagcaauucuccugccucagccucccaaguagcuggaacuacaggcucau

SEQ ID NO: 356750 - RNA, 63 nt, hsa
caaacuccugacuuugugauccacccgccucggccucccaaagugcugggauuacaggcauga

SEQ ID NO: 356751 - RNA, 63 nt, hsa
cgaucuccugacgucgugauccacccgccucggccucccaaaaugcugggauuacagguguga

SEQ ID NO: 356752 - RNA, 63 nt, hsa
aacuccugggcucaagcaauccacccaccucugccucccaaagugcugggauuacaggcguga

SEQ ID NO: 356753 - RNA, 63 nt, hsa
accuccugggcucaagcaauccuccugccucggccucccaaagugcugggauuacagauguga

SEQ ID NO: 356754 - RNA, 63 nt, hsa
gccuccugggcucaagcaauucucccaccucagccucccaaauagcugggaucacuggcacaa

SEQ ID NO: 356755 - RNA, 63 nt, hsa
cccucuccucccaaaccaaaaaccauugucuuaccucccaacuggaagacagcucgagaucca

SEQ ID NO: 356756 - RNA, 63 nt, hsa
acaaauaaucucuuggaucugccgccccccucuccucccaaaccaaaaaccauugucuuaccu

SEQ ID NO: 356757 - RNA, 63 nt, hsa
cgaacucuggguucaagaaauccucccaccuugccucccaaagugcugggauuacagguguga

SEQ ID NO: 356758 - RNA, 63 nt, hsa
gccuucuggauucaagugauucuugugccuuagccucccaaguagcugggauuacaggcgugc

SEQ ID NO: 356759 - RNA, 63 nt, hsa
gguuucauuucagggcauagucaaaggcaucauccucccaacuacccacuugauuauguauuu

SEQ ID NO: 356760 - RNA, 63 nt, hsa
ugaucuccugaccucgugauccacccgccucagccucccaaagugcugggauugcaggcauga

SEQ ID NO: 356761 - RNA, 63 nt, hsa
aacuccugaccucaggugauccaccugccucagccucccaaagugcugggauuacaggcauga

SEQ ID NO: 356762 - RNA, 63 nt, hsa
gccucccgaguucaagcaauucuccugccucagccucccaaguagcugggacuacaggugcau

SEQ ID NO: 356763 - RNA, 63 nt, hsa
aacuccugaccucaggugaucugcccaccuuggccucccaaagugcugggauuacaggcauga

SEQ ID NO: 356764 - RNA, 63 nt, hsa
aacuccugaccucaacugauccgcccaccuuggccucccaagugcugggauuacaggcgcgag

SEQ ID NO: 356765 - RNA, 63 nt, hsa
accuccuggguucaagcauuucuccugccucagccucccaaguagcugggauuacaggcagca

SEQ ID NO: 356766 - RNA, 63 nt, hsa
aacuccugaccucaagugauccgcccuccccagccucccaaagugcugggauuacagguguga

SEQ ID NO: 356767 - RNA, 63 nt, hsa
caguggcgcaaucucgggucacugcaagcucugccucccaaguucaugccauucuccugccuc

SEQ ID NO: 356768 - RNA, 63 nt, hsa
gccucccaaguucaugccauucuccugccucagccucccaaguagcugggacuacaggcaccu

SEQ ID NO: 356769 - RNA, 63 nt, hsa
ucuugaucugaccucgugauccgccgaccucggccucccaaagugcuggaauuacaggcguga

SEQ ID NO: 356770 - RNA, 63 nt, hsa
ugccucccaguucaagcaauucuucugccucagccucccaaguagcugggauuacaggcaccc

SEQ ID NO: 356771 - RNA, 63 nt, hsa
aacuucugaccucaagugaucugcccaccuuggccucccaaagugcugggauuacagguguaa

SEQ ID NO: 356772 - RNA, 63 nt, hsa
accucccagguucaagcaauucuucugccucagccucccaaguagcugggauuacaggugccu

SEQ ID NO: 356773 - RNA, 63 nt, hsa
aacuccugaccucaagugauccaccugccucagccucccaaagugcugggauuauagucguga

SEQ ID NO: 356774 - RNA, 63 nt, hsa
ugaucucuugaccucgugaucugccugccucggccucccaaagugcuggcauuacaggcauga

SEQ ID NO: 356775 - RNA, 63 nt, hsa
accucccggguucaagugauucucuggccucagccucccaaguagcugggacuacaggugugu

SEQ ID NO: 356776 - RNA, 63 nt, hsa
aacuccugaccuccagugaucugcccaccucggccucccaaagugcugggauuacagguguga

SEQ ID NO: 356777 - RNA, 63 nt, hsa
caaucuccugaccuugugaaccacccgucucggccucccaaagugcugggauuacagguguga

SEQ ID NO: 356778 - RNA, 63 nt, hsa
gcuucccagguucacgccauucuccuggcucagccucccaaguagcugggacuacaggcaccc

SEQ ID NO: 356779 - RNA, 63 nt, hsa
aacccuugagcucaagugaucuucccacaccagccucccaaaauacugggauuacaggcuuga

SEQ ID NO: 356780 - RNA, 63 nt, hsa
accuccuugacucaauugauccucccaucucagccucccaaguagcuaggacuacagacaugu

SEQ ID NO: 356781 - RNA, 63 nt, hsa
uggccucgaacucaggugaucugccagccuccgccucccaacgugcugggauuacaggcauga

SEQ ID NO: 356782 - RNA, 63 nt, hsa
gcuuccuggguucaaacaauucucaugccucagccucccaagcagcugggacuacaggcaugu

SEQ ID NO: 356783 - RNA, 63 nt, hsa
cgaucuccugaccucaugauccacccgccucagccucccaaaguguugggauuacaggcguga

SEQ ID NO: 356784 - RNA, 63 nt, hsa
gccuccuggguucaagcgauucuccugccucugccucccaaguagcugggauuacaggcaccc

SEQ ID NO: 356785 - RNA, 63 nt, hsa
accuuccugguucaagggauucuccugccucagccucccaaguagcugggauuacaggcaugc

SEQ ID NO: 356786 - RNA, 63 nt, hsa
aacuucugaccucaggugaucugcccaccucggccucccaaagugcugggauuacaggcguga

SEQ ID NO: 356787 - RNA, 63 nt, hsa
aacuccugggcucaagugauccuccugccuuggccucccaaaaugcugggauuacaggcauga

SEQ ID NO: 356788 - RNA, 63 nt, hsa
gccucccggguucaagcaauucuccugccucagccucccaaguagcugggauuacaggugucu

SEQ ID NO: 356789 - RNA, 63 nt, hsa
aacuccugaccucaggugauccacccgccucagccucccaaagugcugggauuacaggcaaaa

SEQ ID NO: 356790 - RNA, 63 nt, hsa
cgaacuccugaccuugugaugcucccaccucggccucccaaagugcugggauuaaagcuguga

SEQ ID NO: 356791 - RNA, 63 nt, hsa
cgaucuccugaccucaugauccucccgccucagccucccaaaaugcugggauuacaggcguga

SEQ ID NO: 356792 - RNA, 63 nt, hsa
gccuccugggcucaacggauccuuccaccucagccucccaaguagcuuggacuauaggugcau

SEQ ID NO: 356793 - RNA, 63 nt, hsa
aacuccugggcucaagccauccucccuccucagccucccaaaauucugggauuacaggcauaa

SEQ ID NO: 356794 - RNA, 63 nt, hsa
uaaacucuugaccucauguuccacccgccacggccucccaaagugcugugauuaccgguguga

SEQ ID NO: 356795 - RNA, 63 nt, hsa
aacuucugagcucaagagaugcacuccccucagccucccaaagugcugggauuacaggcggcc

SEQ ID NO: 356796 - RNA, 63 nt, hsa
acugauguuuguuuuuuaaaggguaagaugcugccucccaaugggugaugccaucugacuggu

SEQ ID NO: 356797 - RNA, 63 nt, hsa
accucccagguucaagugauucuccugucucagccucccaaguagcugggacuacaggcauga

SEQ ID NO: 356798 - RNA, 63 nt, hsa
ggaccugagccagaugcacaccaucucugauggccucccaaaccaaugugccuguuucucuuc

SEQ ID NO: 356799 - RNA, 63 nt, hsa
cacauccccugcuugagcccagcgcugcaugucccucccaagaaguccagaaugccugcaaau

SEQ ID NO: 356800 - RNA, 63 nt, hsa
gacuccugguuucaagugauccucucaucuuggccucccaaagugcugggauuacagggacga

SEQ ID NO: 356801 - RNA, 63 nt, hsa
ucucgaacucgaccucgugauccgccgccucggccucccaaagugcuaggauuacaggcguga

SEQ ID NO: 356802 - RNA, 63 nt, hsa
aacuccuggucucgagugaucuuccuaucucagccucccaaagugcugggacuacaggcauga

SEQ ID NO: 356803 - RNA, 63 nt, hsa
aacuccugggcucaagcaauccugcugucucagccucccaaguaacuaagacuacaggcaugc

SEQ ID NO: 356804 - RNA, 63 nt, hsa
aacuccugaccucaagugaucuuccggccucagccucccaaagugcuggauuacaggcgugag

SEQ ID NO: 356805 - RNA, 63 nt, hsa
uuggcucauugcaaccucugccucccaggucagccucccaaguagcugggauuacaccaccau

SEQ ID NO: 356806 - RNA, 63 nt, hsa
aacucccagguucaagcuauucuccugccucagccucccaaguagcuggauuacaggcauaca

SEQ ID NO: 356807 - RNA, 63 nt, hsa
cgcuacagggcaccuaucuguuaucgcugcuguccucccaacagcugucuccaguucuaguuc

SEQ ID NO: 356808 - RNA, 63 nt, hsa
gccucccagguucaagcgauucuccugccucagccucccaauuuacugggauuacaggcaccu

SEQ ID NO: 356809 - RNA, 63 nt, hsa
aacuccugaccucaagugauucaccugccucggccucccaaagugcugggauuacaggcguga

SEQ ID NO: 356810 - RNA, 63 nt, hsa
accuccuggguucaagcaagucuccugucucagccucccaaguagcugggauuacaggcaugu

SEQ ID NO: 356811 - RNA, 63 nt, hsa
gcugaguggagcucagcuguguuugacccacauccucccaauuuguucuguauuuagguaguu

SEQ ID NO: 356812 - RNA, 63 nt, hsa
acuuccugaccucagguuauccacccaccucagccucccaaagugcugggauuacagguguga

SEQ ID NO: 356813 - RNA, 63 nt, hsa
accuccuggguucaagugauucucgugccucagccucccaaguagcugggguuacaggcgccc

SEQ ID NO: 356814 - RNA, 63 nt, hsa
caaucuccugaccucgugauccacccgccuuggccucccaaagugcugggauuacaggcguga

SEQ ID NO: 356815 - RNA, 63 nt, hsa
caguggcgcgaucucagcucacugcaagcuccgccucccaaguucacuccauucuccugccuc

SEQ ID NO: 356816 - RNA, 63 nt, hsa
aacuccugaccucaggugauccacuugccucggccucccaaagugcugagauuacaaguguga

SEQ ID NO: 356817 - RNA, 63 nt, hsa
accuccuggguucaagcgauucuucugccucagccucccaaguagcuaggauuacaagugccu

SEQ ID NO: 356818 - RNA, 63 nt, hsa
aacucccgaccucaggugauccacccaccccggccucccaaaaugcugggaucacaggcguga

SEQ ID NO: 356819 - RNA, 63 nt, hsa
cucucccgggcuccagugauccucccgccucagccucccaaguagcugggauuauaggugugu

SEQ ID NO: 356820 - RNA, 63 nt, hsa
aacucccagccucaagcgaugcucccaccuccaccucccaaagugcugggauuacaggcguga

SEQ ID NO: 356821 - RNA, 63 nt, hsa
accucccagacucaagccauccucccaccucaaccucccaaguagcugggacuacaggcauau

SEQ ID NO: 356822 - RNA, 63 nt, hsa
aaauucugggcuaaagcaauccuaccaccuuggccucccaaagugcugagauuacaggcauga

SEQ ID NO: 356823 - RNA, 63 nt, hsa
gccucccagguucaagugauucuccugccucagccucccaaguagcugggauuacaggcgugc

SEQ ID NO: 356824 - RNA, 63 nt, hsa
aacucccgaccucaggugauccgccagccucagccucccaaagugcugggauuacaggcguga

SEQ ID NO: 356825 - RNA, 63 nt, hsa
aauuccugaccucaagugauccaccugccuuagccucccaaagugcugggauuacaggcauga

SEQ ID NO: 356826 - RNA, 63 nt, hsa
cgaucucuugaccuuguguuccacccgccuuggccucccaaagugcuggaauuacaggcauga

SEQ ID NO: 356827 - RNA, 63 nt, hsa
gacuccaggguucaggugauuauuuugccucagccucccaagcagcugggauuauagacaccc

SEQ ID NO: 356828 - RNA, 63 nt, hsa
aacuccugaccucaggugauccgcccgccucggccucccaaagugcugggauuacagacguga

SEQ ID NO: 356829 - RNA, 63 nt, hsa
aacuccuggccucaagcgauccgccuaccucagccucccaaagugcuaggauuacaggcauaa

SEQ ID NO: 356830 - RNA, 63 nt, hsa
uccuccuggauucaagcaauucucuugcuucagccucccaaguagcugagacuacaagcaccc

SEQ ID NO: 356831 - RNA, 63 nt, hsa
cgaucuccugaccucgugauccacccgccucggccucccaaagugcugggauuacaggcuuga

SEQ ID NO: 356832 - RNA, 63 nt, hsa
cacaacuucaguaaaaacacugcacaugcguccccucccaagugcuggcaggccacugugcau

SEQ ID NO: 356833 - RNA, 63 nt, hsa
uaaugaguggcagcuggcgccagggaacgauggccucccaauagauaggaaacaccugaagcu

SEQ ID NO: 356834 - RNA, 63 nt, hsa
aacuccugaguucaagcaauccaccuuccucggccucccaaaguacuaggaguacaggcauag

SEQ ID NO: 356835 - RNA, 63 nt, hsa
acgucccccgcucaggugguccuuccaccucagccucccaaguagcugggaccacaagugugc

SEQ ID NO: 356836 - RNA, 63 nt, hsa
cguuagagagcugagacccuuauuuaaaacucaccucccaaucaccccaaacaaauggaagag

SEQ ID NO: 356837 - RNA, 63 nt, hsa
caccuggaaucccacaacaucagcucugugccaccucccaagagggcuccucacuaucuaggg

SEQ ID NO: 356838 - RNA, 63 nt, hsa
cgaucuccugaccuugugaucugcccgccucggccucccaaagugcugggauuacaggcguga

SEQ ID NO: 356839 - RNA, 63 nt, hsa
cgaucuccuaaccuggugauccgcccgccucggccucccaaaguauugggauuacccgcguga

SEQ ID NO: 356840 - RNA, 63 nt, hsa
gccucucggguucacgccauucuccugccucagccucccaaguagcucggacuacaggcgucc

SEQ ID NO: 356841 - RNA, 63 nt, hsa
aauuccugaccucaggugaucugcccaccucagccucccaaagugcugggauuacaggcguga

SEQ ID NO: 356842 - RNA, 63 nt, hsa
uaggauuaauucgaaaauaggcagaauuccauuccucccaagguggcaaaaauuagcuauacu

SEQ ID NO: 356843 - RNA, 63 nt, hsa
guuauacagaauugaaagccuucguaucuugaaccucccaacauuuuucuuauggcuguugaa

SEQ ID NO: 356844 - RNA, 63 nt, hsa
aacuccugaccacagguaaucagcccgccucggccucccaaagugcugggauuacaggcguga

SEQ ID NO: 356845 - RNA, 63 nt, hsa
ucuugaacugaccucaugauccaccugccucagccucccaaaaugcugggauuacaggcuuga

SEQ ID NO: 356846 - RNA, 63 nt, hsa
cgaucucuugaccucaugauccacccgccucgaccucccaaagugcugugauuacagguguga

SEQ ID NO: 356847 - RNA, 63 nt, hsa
ugcccaggucucaaacucccgaucucaagccacccucccaaaaugcugugauuauaggccaga

SEQ ID NO: 356848 - RNA, 63 nt, hsa
aacuccugggcucaagagauccuuuugcuucagccucccaagcagcuaggacuacaggcacau

SEQ ID NO: 356849 - RNA, 63 nt, hsa
aacuccugaccucaggugguccuucugccuuggccucccaaagugcugggauuacaggcguga

SEQ ID NO: 356850 - RNA, 63 nt, hsa
cgaucuccugaccucgugaucugcccgccucagccucccaaagugcugggauuacaggaguga

SEQ ID NO: 356851 - RNA, 63 nt, hsa
uuuuuuuuauuuugagcaauucuccugccucagccucccaaauagcugggauuacaggugcau

SEQ ID NO: 356852 - RNA, 63 nt, hsa
aacuccugaccucagaugauccgccugccuuggccucccaaagugcugggauuacaggugugg

SEQ ID NO: 356853 - RNA, 63 nt, hsa
aacuccugaccucaggugauacacccaucucggccucccaaagugcugggauuacaggcuuga

SEQ ID NO: 356854 - RNA, 63 nt, hsa
acaggcuggccucaagugauccucuuaccuuggccucccaaacaccgggauuauaggcgugag

SEQ ID NO: 356855 - RNA, 63 nt, hsa
aacucccgacgucaggugaucuaccugccucggccucccaaagugcugggauuacaggcguga

SEQ ID NO: 356856 - RNA, 63 nt, hsa
uggacuccugaccucgugauccacccaccuuggccucccaaaguucuaggauuacagguguga

SEQ ID NO: 356857 - RNA, 63 nt, hsa
ugaacuccugaccucgugauccacccgccuuggccucccaaagugcugggauuacaggcauga

SEQ ID NO: 356858 - RNA, 63 nt, hsa
ugccucccggguucaagcaauucucugccucagccucccaaguaguugggauuacaggcaccu

SEQ ID NO: 356859 - RNA, 63 nt, hsa
aggaguccuucuacagaauaggucagaucuuggccucccaaaccccuuauuuuuaaaauacuu

SEQ ID NO: 356860 - RNA, 63 nt, hsa
aacuccugagcucaggcaaucugcccgccuuggccucccaaagugcuaggauuacagguauga

SEQ ID NO: 356861 - RNA, 63 nt, hsa
gccucccaguuucaagugauucugcugucucagccucccaaguagcugggacuacaggcaugc

SEQ ID NO: 356862 - RNA, 63 nt, hsa
ccaucucuugacauugugauccaccugccucggccucccaaagugcugggauuacaggcauga

SEQ ID NO: 356863 - RNA, 63 nt, hsa
uccugggcuccagggauccacagucccccuuggccucccaaaguguugggauuacaugcauga

SEQ ID NO: 356864 - RNA, 63 nt, hsa
ugaacuccugagcucaugauccacccgccucagccucccaaagugcugggauuacaggccccu

SEQ ID NO: 356865 - RNA, 63 nt, hsa
cucacugccugggcucaagugaucuuacuccagccucccaagcagcugggacuacaccaccac

SEQ ID NO: 356866 - RNA, 63 nt, hsa
uacuccucaguucacgcauuccucccaccuccaccucccaaacugcugggauuacagguguga

SEQ ID NO: 356867 - RNA, 63 nt, hsa
uagaacaugagagacccccucccucaauuuccaccucccaagggaaguuuauguauuuuucua

SEQ ID NO: 356868 - RNA, 63 nt, hsa
aacuccugagcucaagggauccucccgccucagccucccaaagugcugguguuacaggcauaa

SEQ ID NO: 356869 - RNA, 63 nt, hsa
aacuccugaccucaagugauccacucaccucggccucccaaagugcugggauuacagguguga

SEQ ID NO: 356870 - RNA, 63 nt, hsa
aaccccuaggcucaaaugaugugcccaacucggccucccaaagugcugggauuacaggcauga

SEQ ID NO: 356871 - RNA, 63 nt, hsa
caggcucaggcucaggugauccucacaccuuagccucccaaguaccugggacuacaggcacgc

SEQ ID NO: 356872 - RNA, 63 nt, hsa
ggugggaggggcccacaggaagcucagccuucuccucccaagguuugagucccuccaaagggc

SEQ ID NO: 356873 - RNA, 63 nt, hsa
aacuccuggccucaagugauccaccggccucggccucccaaagugcugggaugacaggcauga

SEQ ID NO: 356874 - RNA, 63 nt, hsa
aacuccugaccucaggugauccgcccgccucagccucccaaagugcugagauuacagguguga

SEQ ID NO: 356875 - RNA, 63 nt, hsa
accuccuggguuccagcgauucuccugccucagccucccaaauagcugugauuacaggcgugc

SEQ ID NO: 356876 - RNA, 63 nt, hsa
accaggcaccaccuggacacuuucuuguugaauccucccaacacccagcacgcugucaucccc

SEQ ID NO: 356877 - RNA, 63 nt, hsa
cugaggucaggucugaggccaguauccuccagcccucccaaugccaacccccaccccguuucc

SEQ ID NO: 356878 - RNA, 63 nt, hsa
accucccagguucaagcaauucuccugccucagccucccaaguagcugggauuacaggcaccc

SEQ ID NO: 356879 - RNA, 63 nt, hsa
aacuucugaccucaggugauccaccugccucagccucccaaauugcugggauuacaggcguga

SEQ ID NO: 356880 - RNA, 63 nt, hsa
aagcauuccccuuuaagagcuuccacugcacccccucccaagggacacagcgguaggaauggu

SEQ ID NO: 356881 - RNA, 63 nt, hsa
aacuccugaccucaggugauccaccugccuuggccucccaaagcacugggauuacaagcauga

SEQ ID NO: 356882 - RNA, 63 nt, hsa
aacuccugacuucaggugauccacccaucucagccucccaaagugcugggauuacaggcguga

SEQ ID NO: 356883 - RNA, 63 nt, hsa
caugucuucuuucagaaugggaauauaugugugccucccaacauuuacuguuaaaguguguua

SEQ ID NO: 356884 - RNA, 63 nt, hsa
accuccuggguuccagugauucucaugccucauccucccaaguagcuggaacuacaggugugc

SEQ ID NO: 356885 - RNA, 63 nt, hsa
ggucuucuggcuucuggauaucgcccaccuuggccucccaaagugcugggauuacagggauga

SEQ ID NO: 356886 - RNA, 63 nt, hsa
cgaucuccugaccucaugaucuacccgccucggccucccaaagugcugggauuacaggcguga

SEQ ID NO: 356887 - RNA, 63 nt, hsa
aauuccuggccucaggugauccaccugccucagccucccaaagugcugggauuacaggcauga

SEQ ID NO: 356888 - RNA, 63 nt, hsa
accucccagguucaagcgauucuccugccucagccucccaaguagcugggauuacuggcgccc

SEQ ID NO: 356889 - RNA, 63 nt, hsa
ucucaaucugaccuugugaucugcccaccucggccucccaaagugcuaggauuacuggcguga

SEQ ID NO: 356890 - RNA, 63 nt, hsa
ugaucuccugaccucgugauccgcccgccuuggccucccaaaagugcugggauuauaggcgug

SEQ ID NO: 356891 - RNA, 63 nt, hsa
aacuccuggccucaagugguccuccugccuuggccucccaaaauguugcaauuacaggcauga

SEQ ID NO: 356892 - RNA, 63 nt, hsa
gcuuuguugcucaggcugguuuugaacuccuggccucccaaggugcugauaguacaggcauga

SEQ ID NO: 356893 - RNA, 63 nt, hsa
gccucccugguucaagugauucuccuaucucagccucccaaguagcugggacuauaggcacac

SEQ ID NO: 356894 - RNA, 63 nt, hsa
aacuccugaccucaggugauccaccugccucagccucccaaagugcugggauuacaggcguga

SEQ ID NO: 356895 - RNA, 63 nt, hsa
caaacuucugaccucauaauccacccaccuuggccucccaaagugcuaggauuacaggcauga

SEQ ID NO: 356896 - RNA, 63 nt, hsa
guucaugagaggucugcucucaugaccuaaucaccucccaaaggccccaccucccaauaccau

SEQ ID NO: 356897 - RNA, 63 nt, hsa
cucucaugaccuaaucaccucccaaaggccccaccucccaauaccaucacauuagggguuagg

SEQ ID NO: 356898 - RNA, 63 nt, hsa
aaccucugaccucaggugauccacccgccucggccucccaaagugcugggauuacaggcguga

SEQ ID NO: 356899 - RNA, 63 nt, hsa
accucucagauucaagcaauucuccugccucagccucccaaguagcugggauuacaggugccc

SEQ ID NO: 356900 - RNA, 63 nt, hsa
caaacaccugaccuugugauccguccgccuuggccucccaaagugcugggauuacaggcguga

SEQ ID NO: 356901 - RNA, 63 nt, hsa
ucugccucccaggaucaagcaauucugacucagccucccaaguagcugggauuacaggcgcag

SEQ ID NO: 356902 - RNA, 63 nt, hsa
cgaucuccugaccucgugauucgcccgccucggccucccaaagugcuggaauuacuggcguga

SEQ ID NO: 356903 - RNA, 63 nt, hsa
cugcagccugaaacuccuuggcuuccaccucagccucccaaagcauuaggauuauaggcguga

SEQ ID NO: 356904 - RNA, 63 nt, hsa
aacuccagaucucaggugaucuacccuccucggccucccaaaguacugggauuacaggccuga

SEQ ID NO: 356905 - RNA, 63 nt, hsa
caguggcacgaucucggcucacugcaaccuccgccucccaaguucaagcgauucuccucucuc

SEQ ID NO: 356906 - RNA, 63 nt, hsa
uaugcuggaaguaauugugcuuagacaccucauccucccaagcugucuagaaaggccauuucg

SEQ ID NO: 356907 - RNA, 63 nt, hsa
cgaucuccugaccucgugauccaccugccuaggccucccaaaguguugggauuacaggcguga

SEQ ID NO: 356908 - RNA, 63 nt, hsa
accuccuggguucaagggauucuccugccucagccucccaaguagcugggauuacaggcgccu

SEQ ID NO: 356909 - RNA, 63 nt, hsa
aacuccugaccugaggcgaucugcccaccucggccucccaaagugcugggauuacaggcguga

SEQ ID NO: 356910 - RNA, 63 nt, hsa
gccucccggguucgcaccauucuccugccucagccucccaauuagcuuggccuacagucaucu

SEQ ID NO: 356911 - RNA, 63 nt, hsa
cgaucuccugaccucgugauccgcccaccucggccucccaaagugcugggauuacaggcauga

SEQ ID NO: 356912 - RNA, 63 nt, hsa
caaacuccuaaccucgugauccgccugccucgaccucccaaagugcugggauuacaggcauga

SEQ ID NO: 356913 - RNA, 63 nt, hsa
aaauugggcagcuaaauuuuucaguuccaugugccucccaaauaaaaaacagaaaauaaguag

SEQ ID NO: 356914 - RNA, 63 nt, hsa
cgaucucuugaccucaugaucuacccgccuuggccucccaaagugcugagauuacaggcguga

SEQ ID NO: 356915 - RNA, 63 nt, hsa
gacuccuggguucaagcaauccuccugccucagccucccaaguagcugagacuacaggcacga

SEQ ID NO: 356916 - RNA, 63 nt, hsa
aacucuuggccucaaguaauccuccugccucagccucccaaaguguugggauugcagauauga

SEQ ID NO: 356917 - RNA, 63 nt, hsa
ucaaccuggguucaagugauccucucaccucagccucccaaguaguugugccuccuaggcaca

SEQ ID NO: 356918 - RNA, 63 nt, hsa
aacaccugggcucaacugauccgccugccucggccucccaaagugcugggauuacagguguga

SEQ ID NO: 356919 - RNA, 63 nt, hsa
gccucccggguucaagugauucuccugccucagccucccaaguaggugggauuacaggcgccc

SEQ ID NO: 356920 - RNA, 63 nt, hsa
cgaacuccugaccucgugauuggcccaccucagccucccaaagugcugguauuacagauguga

SEQ ID NO: 356921 - RNA, 63 nt, hsa
aacuccugaccgcaagugauccacccgccuccgccucccaaagugcugggauuacaggcguga

SEQ ID NO: 356922 - RNA, 63 nt, hsa
accuccuggguucaagugauuuuccugccucagccucccaaguagcugggaauacaggcacgc

SEQ ID NO: 356923 - RNA, 63 nt, hsa
aacuccugaccucaagugaucugccugccucggccucccaagugcugggauuacaggcgugag

SEQ ID NO: 356924 - RNA, 63 nt, hsa
gcccccuggguucaagcaauucuccugccucagccucccaaguagcugggauuacagucaggc

SEQ ID NO: 356925 - RNA, 63 nt, hsa
aacuccugggcuuaagugaucugcccgccuuggccucccaaagugcugggauuacagauguga

SEQ ID NO: 356926 - RNA, 63 nt, hsa
aacuccugaccucaggugauccaccuuucucggccucccaaagugcugggauuacggguguga

SEQ ID NO: 356927 - RNA, 63 nt, hsa
accuccuggguuccagcaguucuccugccucagccucccaaguagcugagauuacaggcgccu

SEQ ID NO: 356928 - RNA, 63 nt, hsa
uugaucuccugacuugugauccgccugccucggccucccaaagugcuuggauuacagguguaa

SEQ ID NO: 356929 - RNA, 63 nt, hsa
agcuccugaccucaggugauccgccugccuuggccucccaaaguggugggaucacaggcguga

SEQ ID NO: 356930 - RNA, 63 nt, hsa
aacuccugaccucagaugauccgcccacauuggccucccaaagugcugggauuacagguguga

SEQ ID NO: 356931 - RNA, 63 nt, hsa
gccuccuagauucaagcaauucuccugucucagccucccaaguagcugggauuacaggugcgc

SEQ ID NO: 356932 - RNA, 63 nt, hsa
gaacuccugaccucaaaugauccgcugucuuguccucccaaagugcugggauuauaggcguga

SEQ ID NO: 356933 - RNA, 63 nt, hsa
gccucccagauucaagcgauuuuccugccucagccucccaaguagcugggauuacaggugccc

SEQ ID NO: 356934 - RNA, 63 nt, hsa
aacuccuggcuucaagagauccacccaccucagccucccaaagcgcuaggauuacaaguauga

SEQ ID NO: 356935 - RNA, 63 nt, hsa
cauguuaggagcgcuggaacguuuauucucuucccucccaauuauccacucuaauggagcaga

SEQ ID NO: 356936 - RNA, 63 nt, hsa
aacuucugaccucagaugaucugcccgccucagccucccaaagugcugggauuacaggcauga

SEQ ID NO: 356937 - RNA, 63 nt, hsa
aacucccgaccucagguaauccgcccgccucggccucccaaaaugcugggauuagagguguga

SEQ ID NO: 356938 - RNA, 63 nt, hsa
gccuccuggguucaagugauucuccugccacagccucccaaguagcugggauuacaggugccu

SEQ ID NO: 356939 - RNA, 63 nt, hsa
aacuccugaccucaguugauccgccugccucagccucccaaagugcugggcuuacaggccuga

SEQ ID NO: 356940 - RNA, 63 nt, hsa
uccuccaggguucaagugauucucccaccucagccucccaaguagcugggacuacgggcacau

SEQ ID NO: 356941 - RNA, 63 nt, hsa
aacuccugaccucaagcgauccacccaccuaggccucccaaagugcugggauuacaggcauga

SEQ ID NO: 356942 - RNA, 63 nt, hsa
aacucccgaccucaggugauccgcccgccugggccucccaaagugcugggauuacaggcguga

SEQ ID NO: 356943 - RNA, 63 nt, hsa
gccuccuggauuuaagugauucuccugccucagccucccaaguagcugggauuacaggugugc

SEQ ID NO: 356944 - RNA, 63 nt, hsa
cgaacuccugaccucgugauccgccugccucagccucccaaagugcugggauuacagguguga

SEQ ID NO: 356945 - RNA, 63 nt, hsa
gccuccuggguucaagcaauucucccaccucagccucccaaguagcugggauuacagacgugu

SEQ ID NO: 356946 - RNA, 63 nt, hsa
aacuccugaccucaggugauccuccugccucggccucccaaagugcugggauuacaggcauga

SEQ ID NO: 356947 - RNA, 63 nt, hsa
gccuccuggguucaggcaauuuuccugccucagccucccaaguagcugggauuacaggcaccc

SEQ ID NO: 356948 - RNA, 63 nt, hsa
aacuccugaccucaggugauccuccugcauuggccucccaaagugcuggaauuccaggcauga

SEQ ID NO: 356949 - RNA, 63 nt, hsa
acuccuggggcucaagugauccuccugccuuggccucccaaaaugcuggauuacaggcaugug

SEQ ID NO: 356950 - RNA, 63 nt, hsa
auagcuucccacuggaaaguaaacaaaaccaucccucccaaccucaaagcuaggccacacucu

SEQ ID NO: 356951 - RNA, 63 nt, hsa
gccucccugguucaagugauucuccugccucauccucccaagaagcugagauuacagaugacc

SEQ ID NO: 356952 - RNA, 63 nt, hsa
aacuccugaccucaggugauccaccugccucagccucccaaagugcugagauuacaggcauga

SEQ ID NO: 356953 - RNA, 63 nt, hsa
accucgcagguucaagcaauccucccacuucagccucccaagcaccugggauuacaagcauga

SEQ ID NO: 356954 - RNA, 63 nt, hsa
ccaucucuugaccucgugauccacccgccucagccucccaaagugcugggauuaacagguaug

SEQ ID NO: 356955 - RNA, 63 nt, hsa
gccucccagguucaagugcuucuccagccucagccucccaaguagcugagacuacaggcacac

SEQ ID NO: 356956 - RNA, 63 nt, hsa
aacuccugaacucaagcaauccuccugccucagccucccaaagugcugggauuacugguguga

SEQ ID NO: 356957 - RNA, 63 nt, hsa
acuuccugggcucaagugauccuuccacuucagccucccaaguagcugggacuacaggcaugu

SEQ ID NO: 356958 - RNA, 63 nt, hsa
aacuccugaccucaggugauccacucgccucggccucccaaagugcugggauuauaggcaugu

SEQ ID NO: 356959 - RNA, 63 nt, hsa
gccuccuggguucaagcaguucuccugccucagccucccaaguagcugggauuacaggcgucc

SEQ ID NO: 356960 - RNA, 63 nt, hsa
aacuccugaccucaaaugacccaccugccucggccucccaaagugcuaggauuacaaguguga

SEQ ID NO: 356961 - RNA, 63 nt, hsa
aucgcccaggcucaagugauucuccugccucaaccucccaaguagcugggauuacagaaagcc

SEQ ID NO: 356962 - RNA, 63 nt, hsa
aacucuugaccucaggugauccacccaccucagccucccaaagugcugggauuacaagcguga

SEQ ID NO: 356963 - RNA, 63 nt, hsa
aacuccuggccucaagugauucuccugccucagccucccaaagugcugggauuacagguguga

SEQ ID NO: 356964 - RNA, 63 nt, hsa
uccgccucccggguucacgccauucugcgucagccucccaaguagcugggacuacaggcaccu

SEQ ID NO: 356965 - RNA, 63 nt, hsa
ugaucuccugaccgcauaauccacccaccucggccucccaaagugcugggauuacaggcguga

SEQ ID NO: 356966 - RNA, 63 nt, hsa
aacucccagguucaagugagucucgugccucagccucccaaguagcugggauuacaggcaccc

SEQ ID NO: 356967 - RNA, 63 nt, hsa
aacuccugaccucaggugcuccaccugccuuggccucccaaagugcugggauuacaggcguga

SEQ ID NO: 356968 - RNA, 63 nt, hsa
aacuccuguccucagguaauccgcccaccucagccucccaaagugcugggauuacaggcguga

SEQ ID NO: 356969 - RNA, 63 nt, hsa
accuccuggguucaagcgauucucccaccccagccucccaaguagcugggauuacaggugugu

SEQ ID NO: 356970 - RNA, 63 nt, hsa
aacuccugggcucaagcgauccuccuggcucagccucccaaagugcugggauuacaggcguga

SEQ ID NO: 356971 - RNA, 63 nt, hsa
aacuccugaccucaggugaugcacccaccucagccucccaaagugcagggauuacaggcauga

SEQ ID NO: 356972 - RNA, 63 nt, hsa
aacuccugaccucaggugauccacccgccucagccucccaaagugcugggauuacaggcauga

SEQ ID NO: 356973 - RNA, 63 nt, hsa
aaugccugaccucaggugauccacccgccuuggccucccaaagugcuggaauuacagguguga

SEQ ID NO: 356974 - RNA, 63 nt, hsa
gccuccuggguucaauccauucuccugccucagccucccaaguagcugggauuacaggcacau

SEQ ID NO: 356975 - RNA, 63 nt, hsa
aacuccuagccuugauugauccuccugccuuggccucccaaagugcugggacuacaggugcau

SEQ ID NO: 356976 - RNA, 63 nt, hsa
gccucccagguucaagcaauucuccugccucagccucccaaguagcugggacuacaggcacac

SEQ ID NO: 356977 - RNA, 63 nt, hsa
ccaucucuugaccuugugauccacccaccucagccucccaaagugcugggauuacaggcauga

SEQ ID NO: 356978 - RNA, 63 nt, hsa
aacuccugaccuaaagugaucugcccgccuuggccucccaaagugcugggauuacagacauga

SEQ ID NO: 356979 - RNA, 63 nt, hsa
aacucuugaccucaggugaucugcccgccuuggccucccaaagugcugggauuacagguguga

SEQ ID NO: 356980 - RNA, 63 nt, hsa
aacuccugaccucaggugauccgcccaccucggccucccaaagugcugggauuacagguguga

SEQ ID NO: 356981 - RNA, 63 nt, hsa
aaccccugggcucaagcaagccuccugccuuggccucccaaagugcugggauuacagguguga

SEQ ID NO: 356982 - RNA, 63 nt, hsa
accucccaagcucaagcaauccuccugccucugccucccaaguagcugggaccacaggugggc

SEQ ID NO: 356983 - RNA, 63 nt, hsa
gcaguggugugauuacagcucauguagccuggaccucccaagcucaagcaauccuccugccuc

SEQ ID NO: 356984 - RNA, 63 nt, hsa
aacuccugaccucaggugauccaccugccucggccucccaaagugcuaggauuacaggcguga

SEQ ID NO: 356985 - RNA, 63 nt, hsa
aacuccugaccucaggugauccgcccaccuuggccucccaaagugcugggauuacacgcguga

SEQ ID NO: 356986 - RNA, 63 nt, hsa
aacuccuuggcucaagcaauccugcugccuuggccucccaaguauguaggacuacagguacuc

SEQ ID NO: 356987 - RNA, 63 nt, hsa
aacuccugggcugaaacaauccucccgccuuggccucccaaagugcugggauuauaggcacaa

SEQ ID NO: 356988 - RNA, 63 nt, hsa
gccucccguguucaagcaguucuccugccucagccucccaaauagcugggauuacaguugccu

SEQ ID NO: 356989 - RNA, 63 nt, hsa
aacuccugaccucaagugauccacccgccuuggccucccaaagugcugggauaauagguguca

SEQ ID NO: 356990 - RNA, 63 nt, hsa
gccuccugcguucaagugauuguccugucucagccucccaaguagcugggauuacaggcaccc

SEQ ID NO: 356991 - RNA, 63 nt, hsa
aacuccuaaccucaggugauccacccgccucggccucccaaagugcugggauuacaggcccgg

SEQ ID NO: 356992 - RNA, 63 nt, hsa
accuaccgaguucaagugauuuuccugccuuggccucccaaguagcugggauuacaggugugu

SEQ ID NO: 356993 - RNA, 63 nt, hsa
aacuccugaccucaagugaucugcccaccucagccucccaaagugcugagauuacaggcauga

SEQ ID NO: 356994 - RNA, 63 nt, hsa
aacuccugaccucaagugauauguucaccucagccucccaaagugcugggauuacaggcauga

SEQ ID NO: 356995 - RNA, 63 nt, hsa
gccucccggguucaagcaauucuccugccucagccucccaaguagcugggauuacaggcgugu

SEQ ID NO: 356996 - RNA, 63 nt, hsa
accucuuggguucaagugauucuugugccucagccucccaaguagcuggaauuacaggcacau

SEQ ID NO: 356997 - RNA, 63 nt, hsa
aacuccugaccucaggugauccacccaccuuggccucccaaagugcugagauuauaggcauga

SEQ ID NO: 356998 - RNA, 63 nt, hsa
gccucccggguucacgccauucuccugccucagccucccaaguagcugggacuacaggcaccc

SEQ ID NO: 356999 - RNA, 63 nt, hsa
cgaucuccugaccucgugauccgcccgccucagccucccaaagugcugggauuacaggcguga

SEQ ID NO: 357000 - RNA, 63 nt, hsa
gccucccggguucaugccauucuccugccucagccucccaaguagcugggacuacaggcgccu

SEQ ID NO: 357001 - RNA, 63 nt, hsa
cgaucuccugaccucgugauccacccgccucggccucccaaagugcugggauuacaggcguga

SEQ ID NO: 357002 - RNA, 63 nt, hsa
ugaucuccugaccuugugauccaccagccucagccucccaaagugcugggauuacaggcguga

SEQ ID NO: 357003 - RNA, 63 nt, hsa
accuccuggguucaagugauucuccugcuucagccucccaaguagcugggauuacaggugugc

SEQ ID NO: 357004 - RNA, 63 nt, hsa
aacuccuggccuccagugauccuccauccucggccucccaaagugcuggaaucacagggguga

SEQ ID NO: 357005 - RNA, 63 nt, hsa
cgaucucuugaccucgugauucgcccgccgcguccucccaaagugcugggauuacaggccuga

SEQ ID NO: 357006 - RNA, 63 nt, hsa
aacucccgaccucagaugaucugcccgccucggccucccaaaauugcugggauuacaggugug

SEQ ID NO: 357007 - RNA, 63 nt, hsa
ccaucuccugaguuugugaucugcccgccuuggccucccaaagugcugggauuacagguguga

SEQ ID NO: 357008 - RNA, 63 nt, hsa
ccugaccucaggugauccacccgcccgccuuggccucccaaagugcuaggauuccaggcguga

SEQ ID NO: 357009 - RNA, 63 nt, hsa
ugaucuccugaccucgugauccgcccuccucggccucccaaagugcugggauuauaggcguga

SEQ ID NO: 357010 - RNA, 63 nt, hsa
aacuccugaccucagguaauccaccugccuuggccucccaaagugcugggauuacaggcguga

SEQ ID NO: 357011 - RNA, 63 nt, hsa
aacucuugaccucaaaugauccacccaccuuggccucccaaauuguucguuuuacuuuuuuuu

SEQ ID NO: 357012 - RNA, 63 nt, hsa
aacuccugaccucaggugaucugccugccucggccucccaaagugcugggauuacagguguga

SEQ ID NO: 357013 - RNA, 63 nt, hsa
gccucccggauucaagcaauucuccugccgcagccucccaagaagcugggauuacaggcaugc

SEQ ID NO: 357014 - RNA, 63 nt, hsa
aacuccugggcucaagugauccacccaucuccaccucccaaagugcuaggauuacaggcguga

SEQ ID NO: 357015 - RNA, 63 nt, hsa
aacuccugaccucaagugauccaccugccuuggccucccaaaguguugggauuauaggcguga

SEQ ID NO: 357016 - RNA, 63 nt, hsa
aacuccugaccucauaugauccaccugccucagccucccaaagugcuuggauuacaggcauaa

SEQ ID NO: 357017 - RNA, 63 nt, hsa
gccuuccagguucaagcaauuauccugccucagccucccaaguagcugggauuacaggcaccu

SEQ ID NO: 357018 - RNA, 63 nt, hsa
aaauccugaccucaaaugauccacccaccucagccucccaaagugcugggauuacaggcauga

SEQ ID NO: 357019 - RNA, 63 nt, hsa
gcccccugggaucaagcgauucuccuaccucagccucccaaauagcugggacuacaaggugcc

SEQ ID NO: 357020 - RNA, 63 nt, hsa
cgauuuccugaccuugugaucccccugccucggccucccaaagugcugggauuacaggcauga

SEQ ID NO: 357021 - RNA, 63 nt, hsa
aacucccgaccucaggugauccacccgccucagccucccaaagugcugggauuacaggcauga

SEQ ID NO: 357022 - RNA, 63 nt, hsa
gacuccugggcucaagcaaucugcccgccucugccucccaaagugcugggauuacagacguga

SEQ ID NO: 357023 - RNA, 63 nt, hsa
accugccagguugaagugagccucccauuucagccucccaaguagcugggacuacaauuguga

SEQ ID NO: 357024 - RNA, 63 nt, hsa
aacgccugaccucagaugauccacccaccuuggccucccaaagugcugggauuacaggcauga

SEQ ID NO: 357025 - RNA, 63 nt, hsa
gccuccuggguucaagugauucucgugcuucagccucccaaguaccugggacuacaggugugc

SEQ ID NO: 357026 - RNA, 63 nt, hsa
cgaacuccugaccucgugauccgcccgccucagccucccaaaguguuaggauuaggggcauga

SEQ ID NO: 357027 - RNA, 63 nt, hsa
gccucccagguucaagcaauucuccugccucagccucccaaguagccaggauuacaggcacgc

SEQ ID NO: 357028 - RNA, 63 nt, hsa
aauuccagggcucaagcgauccagccguauuggccucccaaggugcugggauuacagccauga

SEQ ID NO: 357029 - RNA, 63 nt, hsa
guuacaaagauuuuuuaaaaagcuacauaugccccucccaaaccgggaaccucaagaucucca

SEQ ID NO: 357030 - RNA, 63 nt, hsa
aacuccugagcucaagugauccacccgccucagccucccaaagugcugggauuacagggguga

SEQ ID NO: 357031 - RNA, 63 nt, hsa
aacucuugggcucaagugauccucccgccucagccucccaaaguguugggauuacagguguga

SEQ ID NO: 357032 - RNA, 63 nt, hsa
accucccaggcucaagcgauccuccugccucagccucccaaguagcugggagccugggcaugc

SEQ ID NO: 357033 - RNA, 63 nt, hsa
aacuccugggcucaagugauccuccugccucagccucccaaagcguugggauuauaggcguga

SEQ ID NO: 357034 - RNA, 63 nt, hsa
acuucuuaggcucaggugauccucccaccucagccucccaagcagcugggaugacagacuugc

SEQ ID NO: 357035 - RNA, 63 nt, hsa
accuuccaggcuuaagcgauucucaugccucauccucccaaguaggugggauuacaggugccc

SEQ ID NO: 357036 - RNA, 63 nt, hsa
aacuccugacaucaggugauccaccugccucggccucccaaagugcugggauuacagguguga

SEQ ID NO: 357037 - RNA, 63 nt, hsa
gccucccggguucaagcgauucuccugccucagccucccaaguagcugggauuacaggcacgc

SEQ ID NO: 357038 - RNA, 63 nt, hsa
aacucccgaccucaaguagucugccugccucaaccucccaaagugcugggauuacaggcguga

SEQ ID NO: 357039 - RNA, 63 nt, hsa
auccaucggacaagaccccgucuaacacugcauccucccaacugggcauuacccaccauugua

SEQ ID NO: 357040 - RNA, 63 nt, hsa
ccagaaucccagaauucuaggaaauuguaucagccucccaagcauauaacccccuaaggaauc

SEQ ID NO: 357041 - RNA, 63 nt, hsa
ugaacuccugaccucgugauccacccgccuaggccucccaaaguguugggauuacaggcguga

SEQ ID NO: 357042 - RNA, 63 nt, hsa
gccucugggguucaagugauucuccugucucagccucccaaguagcuggaauuacagggaccc

SEQ ID NO: 357043 - RNA, 63 nt, hsa
cgaacuccugaccucgugauuugccugccugggccucccaaagugcuaggauuacaggcauga

SEQ ID NO: 357044 - RNA, 63 nt, hsa
ugaucuccugagcucgugaucugcccgccucggccucccaaagugcugggauuacagguguga

SEQ ID NO: 357045 - RNA, 63 nt, hsa
gggcagccaauuccuaucauucagaucuuccuuccucccaaguacucaccaaccccuuccacu

SEQ ID NO: 357046 - RNA, 63 nt, hsa
ccucuccagauucaagugauccucccaucucagccucccaaguagcugggacuacaguugugc

SEQ ID NO: 357047 - RNA, 63 nt, hsa
aacuccugggcuccaacgaucugcccaccuuggccucccaaagugcugagauuacaggcguga

SEQ ID NO: 357048 - RNA, 63 nt, hsa
acuucuuggguucaagugauucuccugucucagccucccaaguagcugggauuacaggcauga

SEQ ID NO: 357049 - RNA, 63 nt, hsa
aacuccugaccucaggugauccacccgccuuggccucccaaagugcugggauuacaggcguga

SEQ ID NO: 357050 - RNA, 63 nt, hsa
gccuccuggguucaagugauucucccaccucagccucccaaguaggugggauuacagguacuc

SEQ ID NO: 357051 - RNA, 63 nt, hsa
aacuccugaccucagauggucugcccaccuccgccucccaaagugcugggauuacaggcguga

SEQ ID NO: 357052 - RNA, 63 nt, hsa
aaauccugggcucaagugauccuccugcuuuggccucccaaaaugcugggauuauaggcauga

SEQ ID NO: 357053 - RNA, 63 nt, hsa
ucuuccucucucgcccaaguucucaugccucagccucccaaauagcugggacuacaggcacag

SEQ ID NO: 357054 - RNA, 63 nt, hsa
augggcuuggccaaaacaggcucaggccaaagaccucccaagcuguauguacuuccaguaucc

SEQ ID NO: 357055 - RNA, 63 nt, hsa
aacuccuagacucaagugauccuccugucuuggccucccaaagugcugagauuacagguguga

SEQ ID NO: 357056 - RNA, 63 nt, hsa
ugaacuccugaccucgugacccacccgccuuggccucccaaagugcugggauuacagguguga

SEQ ID NO: 357057 - RNA, 63 nt, hsa
gccuccugaguucaagcgauucuccugccucagccucccaaguagcugggacugcaggcgcgc

SEQ ID NO: 357058 - RNA, 63 nt, hsa
acuccugacuucaggugauccacccgccuucagccucccaacgugcugggauuacagccguga

SEQ ID NO: 357059 - RNA, 63 nt, hsa
gccucccagguugaagcgauucuccugccucagccucccaaguagcugggauuacaggcaugc

SEQ ID NO: 357060 - RNA, 63 nt, hsa
cgaugaucugaccucgugaucugcccgccucggccucccaaagugcugggauuacaggccuga

SEQ ID NO: 357061 - RNA, 63 nt, hsa
aacuccuggacucaaucgauccucccaccucugccucccaaguaacugggacuauagcaugcc

SEQ ID NO: 357062 - RNA, 63 nt, hsa
aacuccuggacucaauugauccucccacuucugccucccaaguaacugggacuauagcaugcc

SEQ ID NO: 357063 - RNA, 63 nt, hsa
gccucccguguucaagcgauucuccugccuuggccucccaaguagcugggacuacaggcgccu

SEQ ID NO: 357064 - RNA, 63 nt, hsa
cgaucuccugaccucuugaucugcccaccuuggccucccaaagugcugggauuacaggcguga

SEQ ID NO: 357065 - RNA, 63 nt, hsa
aacucuugaccucaagugauccacucgcuucggccucccaaagugcugggauuauaggcguga

SEQ ID NO: 357066 - RNA, 63 nt, hsa
cgaacuccugaccucaugauccuccugccucggccucccaaagugcugggauuauaggcauga

SEQ ID NO: 357067 - RNA, 63 nt, hsa
aacuccugaccucaagagauccacucgccuugcccucccaaagugcugggauuacaggcuuga

SEQ ID NO: 357068 - RNA, 63 nt, hsa
gucaaaacuauagccauauccaaaucuuuucccccucccaagaguucucagugucuacaugua

SEQ ID NO: 357069 - RNA, 63 nt, hsa
gccuccugacuucaagcaauucuccugccucagccucccaaagugcugggauuacagguguga

SEQ ID NO: 357070 - RNA, 63 nt, hsa
aacuccugaccucaguugauccacccgccucagccucccaaagugcuaggauuacaggcauga

SEQ ID NO: 357071 - RNA, 63 nt, hsa
ugaacuccugaccucgugaucugcccgccuuggccucccaaaguacugggauuacaggcguga

SEQ ID NO: 357072 - RNA, 63 nt, hsa
cccaugcccccucccugagcaccaccggcaccgccucccaaacagggcugcugguuuccgcag

SEQ ID NO: 357073 - RNA, 63 nt, hsa
agggaaggcggagcugaggacagccagcuccgcccucccaaggcugugcguuccugagggcca

SEQ ID NO: 357074 - RNA, 63 nt, hsa
ccucccggguuccagcaaauucuccugccucagccucccaaguagcugggauugcaggcgccc

SEQ ID NO: 357075 - RNA, 63 nt, hsa
aucuccugaccucaggugauccacccgccucggccucccaaagugcugggaugacaggcguga

SEQ ID NO: 357076 - RNA, 63 nt, hsa
aacuccugaccucaggugauccaccugccucggccucccaaagugcugggauuacaggcuuga

SEQ ID NO: 357077 - RNA, 63 nt, hsa
gccucccgggcucaagcgauucuccugccucagccucccaaguagcugggauuacaggcaccu

SEQ ID NO: 357078 - RNA, 64 nt, hsa
cuauuggauagacuaggcaauucaucagcucaccugaaaucagccaggaggagcaaggacaaga

SEQ ID NO: 357079 - RNA, 64 nt, hsa
ugacacgauuagacacuccuccccacaaaggcuuugaaaucauaaggauuuuccucaucucuuu

SEQ ID NO: 357080 - RNA, 64 nt, hsa
ggauuugggcaggauggaagucuuugucuaggucugaaaucaagggcuugggaaucuagagcag

SEQ ID NO: 357081 - RNA, 64 nt, hsa
aaaggcaugguaccucagucugguauccagacugugaaaucagccucugggccaaggagggucc

SEQ ID NO: 357082 - RNA, 64 nt, hsa
caauaugauaaguuuugucauaugcauacagccaugaaaucaucagcauaagcaagguaaugaa

SEQ ID NO: 357083 - RNA, 64 nt, hsa
ugaucugcuuucuuuaugaucaguuugcuacaaaugaaaucacauaauaugaaccuuuuuuggu

SEQ ID NO: 357084 - RNA, 64 nt, hsa
caagcaucacagcuuuguguauaauugcaaaaguugaaaucaacaugaaugcccaaaauaguga

SEQ ID NO: 357085 - RNA, 64 nt, hsa
cagcuacacgggaggccaaggcaggaggaucacuugaaaucaagaguucaagucuagccuagac

SEQ ID NO: 357086 - RNA, 64 nt, hsa
aaacacuuguuaugaguuaaguuggauuacauuuugaaaucaguucauuccaugaugcauauua

SEQ ID NO: 357087 - RNA, 64 nt, hsa
gaacuggaguuucucuugugagaguucccucaucugaaaucauguaucugucucacaaauacaa

SEQ ID NO: 357088 - RNA, 64 nt, hsa
uagaauuuguaauuuaauacuuaccuucuauuucugaaaucaguugugaacuguugccuuaugu

SEQ ID NO: 357089 - RNA, 64 nt, hsa
gucuugaguuuucuucucuggacaccuuaugcucugaaaucaugagcgaggcugauucaauugg

SEQ ID NO: 357090 - RNA, 64 nt, hsa
acuuucaauucaugacugcuuuauauucauuugaugaaaucauuuguauacaaaccagggagag

SEQ ID NO: 357091 - RNA, 64 nt, hsa
uguagaaucauauaauuaccuuuucauguauauuugaaaucagagguguuuaaaauaccuauga

SEQ ID NO: 357092 - RNA, 64 nt, hsa
guaguugucacacuaaaauuuaauuggauauugaugaaaucauuggccuggcaaaauaaaacau

SEQ ID NO: 357093 - RNA, 64 nt, hsa
aaaaauuugaaguauuagacuucuaaauaaggugugaaaucaucaaaaagaaaaaucaaaguag

SEQ ID NO: 357094 - RNA, 64 nt, hsa
cagcucauagcaaguuaaaauauugugacagauuugaaaucauguuugaauuucauaguaggac

SEQ ID NO: 357095 - RNA, 64 nt, hsa
ugcuucuccaaggaaaccgccuaguuuacuguuuugaaaucaaugcaagagugauugcagcuuu

SEQ ID NO: 357096 - RNA, 64 nt, hsa
cccagugaaaucagcauguuucucggugcagaucugaaaucacauccagcuccugauguuuucu

SEQ ID NO: 357097 - RNA, 64 nt, hsa
agccagccuucaccugggacugccacauccccagugaaaucagcauguuucucggugcagaucu

SEQ ID NO: 357098 - RNA, 64 nt, hsa
cagacuuuucccuaccucugucauuagcaaugguugaaaucauguggcuuguguuugggcguca

SEQ ID NO: 357099 - RNA, 64 nt, hsa
uuugugagcuguguaaucccucuggucaguauuaugaaaucauuugucagugguaauaaauaag

SEQ ID NO: 357100 - RNA, 64 nt, hsa
cauacuuuacaagcaaguuaaauggagauaaaguugaaaucauagaagaugcaaaugaccuuuc

SEQ ID NO: 357101 - RNA, 64 nt, hsa
gauguuuuuguuaauguuuccaaacaauguacuuugaaaucagaaucacuucuuaucguuuuca

SEQ ID NO: 357102 - RNA, 64 nt, hsa
aguagaaacgaaauggaaacagaaauaacauuugugaaaucacuggagggcucaagcaaaugcc

SEQ ID NO: 357103 - RNA, 64 nt, hsa
acuguuagaaaaggccuuugaaaauuaccagcagugaaaucaaauaaauuagccacuuuaaacu

SEQ ID NO: 357104 - RNA, 64 nt, hsa
gaaaugauacggaugguauucacugcacauaugaugaaaucaucagaauuguuaaaacuuuugc

SEQ ID NO: 357105 - RNA, 64 nt, hsa
uauuguuuucucuguuuuucuucucuaacuucucugaaaucaucuccuauuaagggauagaaau

SEQ ID NO: 357106 - RNA, 64 nt, hsa
guuucuauuuuuaaggugaauuuuaauuucuaucugaaaucaguuaagauaccuugagaaaaac

SEQ ID NO: 357107 - RNA, 64 nt, hsa
caugcugucuguacaguuccauacaacaaggaggugaaaucagagauaccagcuccucuuuuaa

SEQ ID NO: 357108 - RNA, 64 nt, hsa
uuacuauuugcagucaaacuuugauccuuguuuuugaaaucauuugucaauucggaaugaaaaa

SEQ ID NO: 357109 - RNA, 64 nt, hsa
aaaagaacauuuguuuuuacauuaaauguuuauuugaaaucaaaugauuuuguacauaaaguuc

SEQ ID NO: 357110 - RNA, 64 nt, hsa
aguaguuccuuaagaauaaucuaguuauauuuuuugaaaucacauauaauuagacuuuauaaua

SEQ ID NO: 357111 - RNA, 64 nt, hsa
cuagugagcaaaacaaagaaggugcuugagucacugaaaucaaaguacucaggcacacagccca

SEQ ID NO: 357112 - RNA, 64 nt, hsa
aacaaacaaacaucagucuuagucucuugcuaguugaaaucaaauaaaagaaaauauauaccca

SEQ ID NO: 357113 - RNA, 64 nt, hsa
cauauuuuugaagcugucuuugguacuuguucuuugaaaucauauccaccugucucuauaggua

SEQ ID NO: 357114 - RNA, 64 nt, hsa
aggaauggcaucagaacaauagcuuggaauggcuugaaaucacaaaggaucugcaagaugaacu

SEQ ID NO: 357115 - RNA, 64 nt, hsa
gccuauauaaugagaagcagcucucugaggguucugaaaucaauguggucccucucuugcccac

SEQ ID NO: 357116 - RNA, 64 nt, hsa
aauguuuacggcgcuuaauugccuggaaaugaaaugaaaucaaauuuaucaguuuuuuuccccc

SEQ ID NO: 357117 - RNA, 64 nt, hsa
aauuuucuuuagugcuuaaaauuaaguuuuaaaaugaaaucagacacugcagguuuguauauaa

SEQ ID NO: 357118 - RNA, 64 nt, hsa
aaguucuuuuaaacagucuuuuuauuguggauugugaaaucaaaaucuggagaaaugcuuauaa

SEQ ID NO: 357119 - RNA, 64 nt, hsa
cagcccuguuaggucuuuugaauucacaccuuauugaaaucaguguagaaguagaguuaccuaa

SEQ ID NO: 357120 - RNA, 64 nt, hsa
ucacaguuuaaaacaucauuaaacauuauguaauuacaaugagaaagaaucuuacuuaaauuug

SEQ ID NO: 357121 - RNA, 64 nt, hsa
guauaaaucuaaguuauuuggguacuuguaggaauacaaugaggagcuugaaugccaccuucug

SEQ ID NO: 357122 - RNA, 64 nt, hsa
accagaaaaugacauucugcuuugugagagccgcuacaaugagagcgacaagcagaugaagaaa

SEQ ID NO: 357123 - RNA, 64 nt, hsa
ugaaccagguugccacuacuuugagcagcuccauuacaaugacauguggcugaagguuggcgac

SEQ ID NO: 357124 - RNA, 64 nt, hsa
caguuacaaaaauaaacgaacucuccucuuguccuacaaugaaagcccucaugugcaguagaga

SEQ ID NO: 357125 - RNA, 64 nt, hsa
uaaaguugucacuauucuugaauuagaguugcucuacaaugacacacaaaucccauuaaauaaa

SEQ ID NO: 357126 - RNA, 64 nt, hsa
cuggauucuccuagcauucaugauuuuuuuuucauacaaugaauuaaaauugcuaaaaucaugg

SEQ ID NO: 357127 - RNA, 64 nt, hsa
gcauuuuuacucaacuaccucagguauucaguaauacaaugaaaagcaaaauuguuccuuuuuu

SEQ ID NO: 357128 - RNA, 64 nt, hsa
aucugaucagaauuuaacuaaaggguaguuguuuuacaaugaagacuaaaacugaacaagaugu

SEQ ID NO: 357129 - RNA, 64 nt, hsa
agaagauacuuuuaagacaacuuggccauuauuuuacaaugauguauccuuccuuugacaauua

SEQ ID NO: 357130 - RNA, 64 nt, hsa
ucccccacucucaauaccuagagagugaaacccguacaaugagauaaagacuaaaaagagaaau

SEQ ID NO: 357131 - RNA, 64 nt, hsa
cauuuuuauuaguuacuuauggaaaaucaucuauuacaaugauaaccuucaagugacuuccauu

SEQ ID NO: 357132 - RNA, 64 nt, hsa
uuguauguuuuuacuucugacuauauuaacaauauacaaugaaauuuguuucaagugaacuaca

SEQ ID NO: 357133 - RNA, 64 nt, hsa
uaaauaaucucauuuaacauuguaaugcaaguucuacaaugauaauauauuaaagauuuuuaaa

SEQ ID NO: 357134 - RNA, 64 nt, hsa
ccuucugaaggcccaugcccuggcuuggcauguguacaaugaaaaguuuaggcaugcucagaau

SEQ ID NO: 357135 - RNA, 64 nt, hsa
ccuuguagacucagaaaaagaagauccaauaaaauacaaugauuaccuagaagugcaagaaaug

SEQ ID NO: 357136 - RNA, 64 nt, hsa
aauaauacauuuuuaaacaugucaacauugauaauacaaugaagauuuaccauaaaaaguauca

SEQ ID NO: 357137 - RNA, 64 nt, hsa
gcgauuugaaugcacaguaaguggauaaucugaguacaaugaaauuucuuaaguuuuagaacau

SEQ ID NO: 357138 - RNA, 64 nt, hsa
uuggccauuuacuguaaucacauuuuuauaucuguacaaugacacuuuuugcaguuguggggua

SEQ ID NO: 357139 - RNA, 64 nt, hsa
uguaacacuguccaucuugcaucauugaaacuacuacaaugauacuaucauuuaauaauauuaa

SEQ ID NO: 357140 - RNA, 64 nt, hsa
uguacuuugauuuuauaacuuguaaucuuuuguuuacaaugaggggcuuucuguaacuuguuuu

SEQ ID NO: 357141 - RNA, 64 nt, hsa
aguaccacuuauuuaauaagacgggauguaaauuuacaaugacaaauguguauuuuaagaaaga

SEQ ID NO: 357142 - RNA, 64 nt, hsa
auucugguaaaaauaggcaaaagugaccugaaucuacaaugaugucccaaaguaaccaaguaag

SEQ ID NO: 357143 - RNA, 64 nt, hsa
acuucaagacugcuaauuguuucaucugaaagccuacaaugaaucauuguucaaccuugaaaaa

SEQ ID NO: 357144 - RNA, 64 nt, hsa; identical to SEQ ID NO: 114926

SEQ ID NO: 357145 - RNA, 64 nt, hsa; identical to SEQ ID NO: 114927

SEQ ID NO: 357146 - RNA, 64 nt, hsa
gugccaugcggcugccugcaccccagacaauaaagggaccaaaaccacccaacccccacccugc

SEQ ID NO: 357147 - RNA, 64 nt, hsa
acuaggaucauuccacaccccugcaccugaccaagggaccaaugaggcagaggcuugccccaag

SEQ ID NO: 357148 - RNA, 64 nt, hsa
uucuuccauucccagacagcagugugagggugcagggaccaagaugucaagcuggccguggagu

SEQ ID NO: 357149 - RNA, 64 nt, hsa
uaucauaaggucuuauucuugugcacuuuaucuugggaccaaaacugccuacccaccccuuccc

SEQ ID NO: 357150 - RNA, 64 nt, hsa
cacuucccagggcccaggccucagcccaggccucgggaccaacucuuuguauaaccuaccugaa

SEQ ID NO: 357151 - RNA, 64 nt, hsa
gagucaugagcugucugggaagaauggacgugcugggaccaacucaagaccuuguuuugcuguc

SEQ ID NO: 357152 - RNA, 64 nt, hsa
cauaagcacuggggacugccagguuggcacuguagggaccaagauuaacuuuuuggugcaucua

SEQ ID NO: 357153 - RNA, 64 nt, hsa
gaaaggggguggagacaggaccgugacagucucagggaccaaucccugccucugcccaucagau

SEQ ID NO: 357154 - RNA, 64 nt, hsa
gaugcugugccuugucacccauugagcugcaagagggaccaagagggggccacgcagccagcca

SEQ ID NO: 357155 - RNA, 64 nt, hsa
caauccucucccccacgggacaccucucugguucgggaccaaucccucccuggggacgugcccc

SEQ ID NO: 357156 - RNA, 64 nt, hsa
accaagaagcacugggugaccagcuggcagacucgggaccaauacuacugacguccucccugau

SEQ ID NO: 357157 - RNA, 64 nt, hsa
gcuggggcacggcgggauccuccacagagaggaggggaccaauucuggacagacagauguuggg

SEQ ID NO: 357158 - RNA, 64 nt, hsa
uugaaaugcaaugucuaaaauggacgaaucuauauagagugaauauagauuagcguuugccagg

SEQ ID NO: 357159 - RNA, 64 nt, hsa
aaaacaguuuggcaguaccucaaaaaguuaaacguagagugaccauaugacccaggaaugccac

SEQ ID NO: 357160 - RNA, 64 nt, hsa
auguuuuggucuugugaucacugucugucacaaguagagugaaagggguaagggggugggaggg

SEQ ID NO: 357161 - RNA, 63 nt, hsa
aaaagcugugauacuauaguuaauaaauucccacuagagugacacugaagauuuaaacacaag

SEQ ID NO: 357162 - RNA, 64 nt, hsa
ucauucauaaacacagaguguagagugaaaacacuagagugaaaacacaugcuacaaugaggca

SEQ ID NO: 357163 - RNA, 64 nt, hsa
auagcucaggcuauucauucauaaacacagaguguagagugaaaacacuagagugaaaacacau

SEQ ID NO: 357164 - RNA, 64 nt, hsa
cuguacagagucuuacuguagcuacgcuaaugguuaaccugauagaauuaacucguauuuuucu

SEQ ID NO: 357165 - RNA, 64 nt, hsa
ccugauagaauuaacucguauuuuucuaugguuuuaaccugaugcuccacugucuccgucaugg

SEQ ID NO: 357166 - RNA, 64 nt, hsa
gacauuaaauugacuuuuaagaaaaacaugucacuaaccugaagcucagccacacagugacuuu

SEQ ID NO: 357167 - RNA, 64 nt, hsa
ucaacuguugugugaaugagccagacacauugcuuaaccugaguccgagauggacaaugguaua

SEQ ID NO: 357168 - RNA, 64 nt, hsa
gaagcccccucugcuuuaauccacacaaggaacguaaccugaaguaaccugauguuaaccaauc

SEQ ID NO: 357169 - RNA, 64 nt, hsa
cugcuuuaauccacacaaggaacguaaccugaaguaaccugauguuaaccaaucugcugugucu

SEQ ID NO: 357170 - RNA, 64 nt, hsa
augauuccauuccauucuagaaauuugaaguauguaaccugaaauccuuaauaaaauuuggauu

SEQ ID NO: 357171 - RNA, 64 nt, hsa
uauuguguuuuaggugacauaguuaacuguaaaguaaccugacucaguauaguuacugguacca

SEQ ID NO: 357172 - RNA, 64 nt, hsa
aggaaagaacuacauucuucagaauacagugaugaaaauucauuuugaaacucaaauauuuuca

SEQ ID NO: 357173 - RNA, 64 nt, hsa
guugucuuuuacuaggacuguaaacuuuugugauaaaauucaaauaagauuuuauuucuuggua

SEQ ID NO: 357174 - RNA, 64 nt, hsa
uaaaguugaaaaaccuucucuucagaaaagaagaaaaauucagaaaucaguagaucuuggcaau

SEQ ID NO: 357175 - RNA, 64 nt, hsa
uuuccauugggauguuuucauuucaaaauuguucaaaauucaaaagacacagaacgauaaacag

SEQ ID NO: 357176 - RNA, 64 nt, hsa
gcucaccaaacgaaggguaucagcuauuuuuuuuaaaauucaaaaagaauaucccuuuuauagu

SEQ ID NO: 357177 - RNA, 64 nt, hsa
aaguauugcuaaguacuauaacauauuggccacuaaaauucauauugagauuaucuugguuucu

SEQ ID NO: 357178 - RNA, 64 nt, hsa
uuuuacauuuugaagaaggggagcaaaucuaaaaaaaauucaguugaacuucugagaguuaaca

SEQ ID NO: 357179 - RNA, 64 nt, hsa
uaauaaaucugaauucuauuaguuuaaaaauuguaaaauucaaguuaaaugacguguaugauau

SEQ ID NO: 357180 - RNA, 64 nt, hsa
auuucaguuaguuaaauaccuguagccuaacuggaaaauucaggcuucaucauguaguuugaag

SEQ ID NO: 357181 - RNA, 64 nt, hsa
gugucagagaacaaaagaaacagaaucaauauauaaaauucaaagacuaucugcagcuagugug

SEQ ID NO: 357182 - RNA, 64 nt, hsa
gucagucagucucuguaguuaaaacuuuuucuuuaaaauucaauuaagguacuucucccucagg

SEQ ID NO: 357183 - RNA, 64 nt, hsa
gucagucagucucuguaguuaaaacuuuuucuuuaaaauucaauuaaguuacaccagaauuuac

SEQ ID NO: 357184 - RNA, 64 nt, hsa
acuggaguagcugggauuuacuaguaguguaaauaaaauucacucuucaauacaugaauggaaa

SEQ ID NO: 357185 - RNA, 64 nt, hsa
ggguaauguauauacauauuuuuuauuuccaaaaaaaauucauuaauugcuucuuaacucuuau

SEQ ID NO: 357186 - RNA, 64 nt, hsa
cugcuguguauuguauuuuucaaauaaaaauuuaaaaauucaauugaaaacugaauuuugacuu

SEQ ID NO: 357187 - RNA, 64 nt, hsa
ucaagauuguacagugagugaugcugucaugaagaaaauucagaugaaaaaggcaagauacaug

SEQ ID NO: 357188 - RNA, 64 nt, hsa
auugcaagugucuuuaaacuagggaucuaaucugaaaauucaguaacuaauauuaggcaguuga

SEQ ID NO: 357189 - RNA, 64 nt, hsa
uuuuaagaauuguuccuuggggaaaaauuuuuuuaaaauucaccuagaaucauagggccucauu

SEQ ID NO: 357190 - RNA, 64 nt, hsa
uuagucaguaaaauguuagaaaucaaacuauaagaaaauucaaguccuuuauuuugugucuugg

SEQ ID NO: 357191 - RNA, 64 nt, hsa
uaucauuauuuaacaacaagugaagaucaacagaaaaauucaaguagcuuugcaaauacuaguu

SEQ ID NO: 357192 - RNA, 64 nt, hsa
auuaucccuuuuuaauauuggggaaagaaaaaugaaaauucauuaguuaauuacugcuuugugu

SEQ ID NO: 357193 - RNA, 64 nt, hsa
aggcgggagccacugcacauggcagcauuuuuuaaaaauucaguuuuaagaucucugguuuagg

SEQ ID NO: 357194 - RNA, 64 nt, hsa
ucccacucauucugaauuaauuaauuuggagcacaaaauucaaagcauggacauuuagaagaaa

SEQ ID NO: 357195 - RNA, 64 nt, hsa
uuuagaaauauucacaucuucggagaugaggaguaaaauucaguuuuuuuccaguuccucuuuu

SEQ ID NO: 357196 - RNA, 64 nt, hsa
uuacauuaaugagugcaaaauaacacauaaaaugaaaauucacacaucacauuuuucuggaaaa

SEQ ID NO: 357197 - RNA, 64 nt, hsa
ucaucucuagcacugccauccaauuuaguucaauaaaauucaaauauaaguuuccaugcuuuuu

SEQ ID NO: 357198 - RNA, 64 nt, hsa
aaaacaaaagcaaguucuuuguuaggaauuggucaaaauucaucucuuucuuuaagcccaucaa

SEQ ID NO: 357199 - RNA, 64 nt, hsa
uacggucucaccgaugcaguuuucauggacauagaaaauucaaauagaauauauaauauugaau

SEQ ID NO: 357200 - RNA, 64 nt, hsa
guuuacauuguaacauucuauuguaaaaucaacuaaaauucagacuuuuagcaggacuuugugu

SEQ ID NO: 357201 - RNA, 64 nt, hsa
ggaaaugacaacugcaaauguagacuauacuguaaaaauucaguuuguugcuuuaaagaaacaa

SEQ ID NO: 357202 - RNA, 64 nt, hsa
uugaaaccacuccuuuucuccucuuggcuacauuaaaauucaguugacuacaaaugcuuucuau

SEQ ID NO: 357203 - RNA, 64 nt, hsa
ucauucagucagucucuguugacuaaauacgacgaaaauucauacuuuaugcaggagauuucua

SEQ ID NO: 357204 - RNA, 64 nt, hsa
auuuggcuauuuauuaaccucucuuucauauucuaaaauucauuuuccccuuauggauauuuau

SEQ ID NO: 357205 - RNA, 64 nt, hsa
uguucuuuagcugaaguuuugcaauuuuuaugucaaaauucaauugcuauuaaacaaguugaga

SEQ ID NO: 357206 - RNA, 64 nt, hsa
acuuaauugauccuacaagcuuacuacacauaggaaaauucauacuggagagaaacuacaaaug

SEQ ID NO: 357207 - RNA, 64 nt, hsa
uuuuaaccuuccuuaacccuuaacuguagauaagaaaauucauacuggaaagaaacccuacaaa

SEQ ID NO: 357208 - RNA, 64 nt, hsa
uuuucaccgauacucaauccuuaguacacauaagaaaauucauacuggggagaaaccccacaaa

SEQ ID NO: 357209 - RNA, 64 nt, hsa
uuuuaaccaguccucacaccuuaugagacauaagaaaauucauaguaaagagaaacccuacaaa

SEQ ID NO: 357210 - RNA, 64 nt, hsa
uuuuaacuaguucucgaacuuuacuaugcauaagaaaauucaaacuggagagaaacucuacaaa

SEQ ID NO: 357211 - RNA, 64 nt, hsa
guaaaacuuacaauccucaaaacuucuuacaccuaaaauucaugcaggagagaaacaccacaaa

SEQ ID NO: 357212 - RNA, 64 nt, hsa
auauauaauaccauauuuuuaauuucacaaauaaaaaauucaaaguuuuguacaaaauuauaug

SEQ ID NO: 357213 - RNA, 62 nt, hsa
uuuuauggugucucauagccaaucccacaguguaaaaauucaggaauucaaugaaaaaaguc

SEQ ID NO: 357214 - RNA, 64 nt, hsa
cuguaguccaagcucaggcauaauucagcauaagaaaauucacaccagagccaaaucuuacaaa

SEQ ID NO: 357215 - RNA, 64 nt, hsa
cuucagucguaguguccaccuuacucaacaucagaaaauucacaaagagaugcccuguaagugu

SEQ ID NO: 357216 - RNA, 64 nt, hsa
aauuuuaaacacuuuuauuuuuaaacgauuuaucaaaauucaucucuaaauuuuacauguagaa

SEQ ID NO: 357217 - RNA, 64 nt, hsa
aacucaauacaaagacaaguacaacuccauuagaaaaauucagacagcaucuucucuauuggcc

SEQ ID NO: 357218 - RNA, 64 nt, hsa
aggcguuuggagaaggucuguggugcagugugugaaaauucaggugcuagaagccuacugguag

SEQ ID NO: 357219 - RNA, 64 nt, hsa
cuugagagaaacgugaaacgccacaaaaauagagaaaauucaggucuguaugucauggaucgug

SEQ ID NO: 357220 - RNA, 64 nt, hsa
aauuugcaaaagccacaacaguaguggaagaauuaaaauucauaaagucucaucauucuguugg

SEQ ID NO: 357221 - RNA, 64 nt, hsa
uaagacaauaugugaugaauauaagaaagggcaaaaaauucauuugaaccaguuuuccaagaac

SEQ ID NO: 357222 - RNA, 64 nt, hsa
accaaaucacauuaucuauuuuagcacucauuccaaaauucaguauuuaauguaauuaaucuuu

SEQ ID NO: 357223 - RNA, 64 nt, hsa
gcuuagagguucaaauaucaccagcaaucaguaaaaaauucagcaauaaucuuaaggccagaga

SEQ ID NO: 357224 - RNA, 64 nt, hsa
caccuguuuuauaugguuuaaaauucucuuuaacaaaauucagaaaauucaccugaaacguauu

SEQ ID NO: 357225 - RNA, 64 nt, hsa
uauaugguuuaaaauucucuuuaacaaaauucagaaaauucaccugaaacguauuuugaccuaa

SEQ ID NO: 357226 - RNA, 64 nt, hsa
acuaggugucagcaugugaauuuuggaaaacacaaaaauucagaacauagcaaauaccuuugaa

SEQ ID NO: 357227 - RNA, 64 nt, hsa
agaacauagcaaauaccuuugaaguauaaaagauaaaauucauuuuuagugaacccuguaauuu

SEQ ID NO: 357228 - RNA, 64 nt, hsa
caagaacaaacagaaacgagauuugccaaaaacuaaaauucaacaaaugauguugagugggaga

SEQ ID NO: 357229 - RNA, 64 nt, hsa
cucuauuuuuuacuacauaauuaaauuuuaauguaaaauucauagcauccugauuauugaaugu

SEQ ID NO: 357230 - RNA, 64 nt, hsa
uguuuucaacuguaauugucuuaauggaaauguuaaaauucauaucugauuaacauuuuuaaua

SEQ ID NO: 357231 - RNA, 64 nt, hsa
uuguccaaauagaugagagagcaaaucaugugagaaaauucagaauaccaucuguuucauagcc

SEQ ID NO: 357232 - RNA, 64 nt, hsa
uuucucaaauaggaauacuaccuuugaauucaauaaaauucacugcaggauagaccaguuacau

SEQ ID NO: 357233 - RNA, 64 nt, hsa
uaggcuugucagagccuauagccagaacucagaaaaaauucaaaugcacuuauguucucauucu

SEQ ID NO: 357234 - RNA, 64 nt, hsa
cauguauauaccuuuuugugucaaaaggacauuuaaaauucaauuaggauuaauaaagauggca

SEQ ID NO: 357235 - RNA, 64 nt, hsa
cuucuccaucuccuguguaaucaaggccagugcuaaaauucagaugcuguuaguaccuacauca

SEQ ID NO: 357236 - RNA, 64 nt, hsa
ucucaaaaaagccaaucuuuguacucuugcagagaaaauucagacuaucauccucaaggacauu

SEQ ID NO: 357237 - RNA, 64 nt, hsa
acuaucauccucaaggacauuacuagugacucagaaaauucaaacuucagaaaugaaauccaaa

SEQ ID NO: 357238 - RNA, 64 nt, hsa
cuugugucaaaaugauauagcuuaguauaaaaauaaaauucaacguuuuggccaaaauguuugu

SEQ ID NO: 357239 - RNA, 64 nt, hsa
acuacuguuacauuuuauuaauuuaaaaagcuagaaaauucauguaguuacuuuuuuuacauau

SEQ ID NO: 357240 - RNA, 64 nt, hsa
aacccaugugauguccuccaaaauguguaggguaaaaauucacagggcuuccagaucacuuuuu

SEQ ID NO: 357241 - RNA, 64 nt, hsa
uucuggaaacuuuaauguuuuaaaccucuuuuauaaaauucaaugacgacuacuagaauucuuu

SEQ ID NO: 357242 - RNA, 64 nt, hsa
gcugcuguuggaaaacgcuauggagguucgucacaaaauucaacauagaauuacccuaugauuc

SEQ ID NO: 357243 - RNA, 64 nt, hsa
acauccacaaaaauaugcaauggauguagaaaauaaaauucaagaaaagaacguugaaccaaau

SEQ ID NO: 357244 - RNA, 64 nt, hsa
uuuguaagacccauauuuuuaacucuucccagggaaaauucauguugcugcagaaguaggcuaa

SEQ ID NO: 357245 - RNA, 64 nt, hsa
gucuguuauuuuguuucuuuuuauacaaagaaaaaaaauucagcuuucauguuucugauuccag

SEQ ID NO: 357246 - RNA, 64 nt, hsa
auuuuuaaagcaguauuauuuuauaaccaauucuaaaauucagcuuuaaaaauauugaacauac

SEQ ID NO: 357247 - RNA, 64 nt, hsa
cugagaguaucuaugucuuucugaauuuaaaaugaaaauucauguccauauggagacuuacaua

SEQ ID NO: 357248 - RNA, 64 nt, hsa
gcgcugggggcuugugauguuugugugcuguuuuaaaauucauuucaaauuggacucgauuucc

SEQ ID NO: 357249 - RNA, 64 nt, hsa
uucuggauaguaggauuuuaauaggcgagcaaauaaaauucaaaucaauuucaaggaaaaacau

SEQ ID NO: 357250 - RNA, 64 nt, hsa
uuauaggaggaaaaaaaucacuuugggagaaaauaaaauucaacucaagcauaaagcuucuguu

SEQ ID NO: 357251 - RNA, 64 nt, hsa
uggcgcgcuuuuuuaauaaucauuuaaucuugggaaaauucagguguuuggugucugccuuuuu

SEQ ID NO: 357252 - RNA, 64 nt, hsa
cuaggaaauucuugaaaauauaaguggugcuuagaaaauucaagcauuuaggaaugugaccuuu

SEQ ID NO: 357253 - RNA, 64 nt, hsa
uccuucuucuaguuuuaugcgacagcuuuacuuuaaaauucaaguuauacaucuugggaguaca

SEQ ID NO: 357254 - RNA, 64 nt, hsa
uuaauaguagaugugguucccagaaaauauaaucaaaauucaaagauuuuuuuuguuucuguaa

SEQ ID NO: 357255 - RNA, 64 nt, hsa
uuaaaauaugaauuuaaaaaauuuuuguaaaaauaaaauucacaaaauuguuuugaaaaacauu

SEQ ID NO: 357256 - RNA, 64 nt, hsa
cugggguuggcccagaaggaggcacaucagucccaaaauucaucacuuaacccagcguccagga

SEQ ID NO: 357257 - RNA, 64 nt, hsa
ucgaccucuguuaaguggagggauuugugagauaaaaauucaaaauguuggccugaggccugag

SEQ ID NO: 357258 - RNA, 64 nt, hsa
caauauuuucccuauaacaaaggcaauaggacacaaaauucacauccugcugggccuuuuuuca

SEQ ID NO: 357259 - RNA, 64 nt, hsa
uuuaaguagguugaaguuuuugcaaaggcauuuaaaaauucaauuucuugucagauacuacaaa

SEQ ID NO: 357260 - RNA, 64 nt, hsa
cagauuuugcuuucuguggaauugaaaauucacaaaaauucacagcuuaaauuucccaucagug

SEQ ID NO: 357261 - RNA, 64 nt, hsa
ggaugugauacagauuuugcuuucuguggaauugaaaauucacaaaaauucacagcuuaaauuu

SEQ ID NO: 357262 - RNA, 64 nt, hsa
agggcagguuagagacaguauguaugccuucgggaaaauucaaagguggauuacaagguguccu

SEQ ID NO: 357263 - RNA, 64 nt, hsa
gacaagcuaggaaagaggaggcagaaagauuuggaaaauucacagaguuucacccuuaagcugu

SEQ ID NO: 357264 - RNA, 64 nt, hsa
cuccccgacuaguggaugggagagucccauugcuaaaauucagcuacucagauaaauucagaau

SEQ ID NO: 357265 - RNA, 64 nt, hsa
ucaguauucuuuuaucauaaauuuuuagcauuuaaaaauucacugauguacauuaagccaauaa

SEQ ID NO: 357266 - RNA, 64 nt, hsa
agugucccaauuuuuuccaaacguuggggaggggaaaauucacuguaucaugaaacccuaaggg

SEQ ID NO: 357267 - RNA, 64 nt, hsa
gucucgaugcuguuaacaacuucugauaacauggaaaauucaaggauuguuuaaaggucugaug

SEQ ID NO: 357268 - RNA, 64 nt, hsa
uucuucuaaaauauugggcacucgguuaucuuuuaaaauucacacagaaaaauuccguuuggua

SEQ ID NO: 357269 - RNA, 64 nt, hsa
ccacccucagucgcauagacuuauguguuuugcuaaaauucagguauuacugaauuagcguuua

SEQ ID NO: 357270 - RNA, 64 nt, hsa
uuuccauauguuacugaaucugaaaaacaucuuuaaaauucaaacaguuccauuuucucucuug

SEQ ID NO: 357271 - RNA, 64 nt, hsa
acuuaaauaaagaaagugugaggucuacuuuaaaaaaauucaaaugaagagaaaaagaaaaaca

SEQ ID NO: 357272 - RNA, 64 nt, hsa
cuugcucuguuuugcuuuuccauauagcucgagcaaaauucaaaaagaacuaaauaugcaauau

SEQ ID NO: 357273 - RNA, 64 nt, hsa
agaugcccuguugguuucacagauaacauaaauaaaaauucaaccacagauuuauacaaggguu

SEQ ID NO: 357274 - RNA, 64 nt, hsa
cuucagcaggaaagaaaaucucauuacacaucagaaaauucacacuggagagaaaccuuaugaa

SEQ ID NO: 357275 - RNA, 64 nt, hsa
cuuuagucagaaaucaaaccucacugaacaugagaaaauucauacuggagagaaaccuuaucau

SEQ ID NO: 357276 - RNA, 64 nt, hsa
uuucagucagagacaaaaucuucuugagcaugaaaaaauucauacuggagagaaaccauucaaa

SEQ ID NO: 357277 - RNA, 64 nt, hsa
uaagaauuuucuaggaucuuucaaaaaugauuauaaaauucaugugaaauagaaguguaugaau

SEQ ID NO: 357278 - RNA, 64 nt, hsa
uuuuaaacaguccucaaucuuuauuacacauaagaaaauucaugcuggagagaaacacuacaaa

SEQ ID NO: 357279 - RNA, 64 nt, hsa
uccuucagcugauucucagucuaguaaacauaagaaaauucauacuggagagaaaaucuacaaa

SEQ ID NO: 357280 - RNA, 64 nt, hsa
uugcuuauuugccaccauaagaaaugguacaauaaaaauucauguaaucaccccuuagauuuca

SEQ ID NO: 357281 - RNA, 64 nt, hsa
cguucagcagauuuuacacuuaauaguguauuggaaaauucauuuuacauuaaagugacaugaa

SEQ ID NO: 357282 - RNA, 64 nt, hsa
uuggucaaaauucacaccuuguaauuaaaaggucaaaauucacaccuuguaauucauaguggag

SEQ ID NO: 357283 - RNA, 64 nt, hsa
uauaaguguaaugaguguggcaagaccguuggucaaaauucacaccuuguaauuaaaaggucaa

SEQ ID NO: 357284 - RNA, 64 nt, hsa
uuucaguuguaaaucaaaccuuaaaacacauaagaaaauucacauugaagagaaaccauacaga

SEQ ID NO: 357285 - RNA, 64 nt, hsa
ccaugcauuccaguuaacacauuuaaacauauagaaaauucacuucuucuuucaaguccuuccc

SEQ ID NO: 357286 - RNA, 64 nt, hsa
uuuuuagcuaauuaccaaggucucugccuaugcaaaaauucaucuuucggugauugugggcggc

SEQ ID NO: 357287 - RNA, 64 nt, hsa
uaugccauuggguuuuuguguguaugugauuuucaaaauucaugacuugaagugcaaggacaga

SEQ ID NO: 357288 - RNA, 64 nt, hsa
acuguggugugauuggcuaaacaaucucgcauuaaaaauucaaauguaaauugaauucacauga

SEQ ID NO: 357289 - RNA, 64 nt, hsa
aaucugucucugggaaagacuagauuggaagaauaaaauucaagaaugugauguuuuaguaaug

SEQ ID NO: 357290 - RNA, 64 nt, hsa
ucauaauccuuagaaguuagcuuguccgcaucugaaaauucacuuuuaccuugaaguucaaucu

SEQ ID NO: 357291 - RNA, 64 nt, hsa
ggacagacagccaaagcuucagagauacaguccacagguggacaaagggauccccagccagaga

SEQ ID NO: 357292 - RNA, 64 nt, hsa
cccaaaagacagacaucucugcuagcuggacagccagguggacccccuaaguuagauuacuaga

SEQ ID NO: 357293 - RNA, 64 nt, hsa
ugaugaccucguggccuguguggagagcaugcaucagguggaagaagacuaccuguuugaaaaa

SEQ ID NO: 357294 - RNA, 64 nt, hsa
ccuuucuccugucuuugcagaguuugccuucugccagguggaugccuccaucgcucuggcccug

SEQ ID NO: 357295 - RNA, 64 nt, hsa
gucagcucauucuugccuuacuccaaugauggcccagguggaaaaguagcagcuguaucgggcu

SEQ ID NO: 357296 - RNA, 64 nt, hsa
gugauacugagaaaauacaugaacagaaacugcccagguggaacagcacguaaccuagugagug

SEQ ID NO: 357297 - RNA, 64 nt, hsa
guuccagccaaccugcucuuuccugaguucaaagcagguggagacuggcugguuaccaucuuug

SEQ ID NO: 357298 - RNA, 64 nt, hsa
caucgucucccgcaaugggcagagagagcagagacagguggaccaacagacagcuggccccugg

SEQ ID NO: 357299 - RNA, 64 nt, hsa
ccucaccagcgucaccaaccauggcuaccgcgugcagguggagaacccggaacgcuucuccucg

SEQ ID NO: 357300 - RNA, 64 nt, hsa
gcggcgcuccuaugaggccaucgccaagcacaaucagguggaggcugcauggcuggaaggccgg

SEQ ID NO: 357301 - RNA, 64 nt, hsa
guggaguagaacgagccagaguuccugacuugagcagguggauuugggcccaggcccuguucac

SEQ ID NO: 357302 - RNA, 64 nt, hsa
ucucuggccauugcagagcugcuggccuccugcccagguggaggguccuggggacggcagagga

SEQ ID NO: 357303 - RNA, 64 nt, hsa
cccggguaaagugggggccucaacugugccuccucagguggauggaagguucugggugcccgca

SEQ ID NO: 357304 - RNA, 64 nt, hsa
agguggauacagaacuuccauucuuuagucauuccagguggaucugaguuuuauauucaaacuu

SEQ ID NO: 357305 - RNA, 64 nt, hsa
guaacagauaucauuacauuuaccaguuuuaacacagguggauacagaacuuccauucuuuagu

SEQ ID NO: 357306 - RNA, 64 nt, hsa
acaccuguaaucccagcauuuugggaggccgaggcagguggaucaccugaggucaggaguuuga

SEQ ID NO: 357307 - RNA, 64 nt, hsa
gaugauuuuguagaauaugcacggccaguagucacagguggaaaacgcagccuuuucuaggcag

SEQ ID NO: 357308 - RNA, 64 nt, hsa
gcccaguccuuggugucagggagcccccaggccgcagguggagggugauaaaauauguucucug

SEQ ID NO: 357309 - RNA, 64 nt, hsa
gaagaagaaacgggugagaacugcuaagugaugacagguggagccccagcaggggccacucuau

SEQ ID NO: 357310 - RNA, 64 nt, hsa
acgccuguaaucccagcgcuuugggaggcagaggcagguggaucaccugaggucgggaguucga

SEQ ID NO: 357311 - RNA, 64 nt, hsa
acuuccaggugccccaccuauuuaucugagcccacagguggaaaggggaacugccucagugaga

SEQ ID NO: 357312 - RNA, 64 nt, hsa
uuuccggcagcccggaaccugggaugagaaacgacagguggaagguuguccagagacaccuaca

SEQ ID NO: 357313 - RNA, 64 nt, hsa
auccaccuccauuucagcauguggcucgcguggacagguggacggacgcuguggccgcauggaa

SEQ ID NO: 357314 - RNA, 64 nt, hsa
gccugugcagcagaacagaggcaacgguggcaggcagguggaggcugcgcacagcuucucccgg

SEQ ID NO: 357315 - RNA, 64 nt, hsa
cugucuuaccugcgcucagcuuggagucaggccucagguggagagccgcaugucacugucagag

SEQ ID NO: 357316 - RNA, 64 nt, hsa
guccucgagaugaagacgggggggagcccccagccagguggagaccccgcagggacgcggcggc

SEQ ID NO: 357317 - RNA, 64 nt, hsa
ugggaggcggcggcggcggcucgggcuggggggucagguggacgccgcccuccggggcuggacg

SEQ ID NO: 357318 - RNA, 64 nt, hsa
cgugcggcuccaacaggcaucgucuucccuuccgcagguggaggggccgcuucccgcaggcauc

SEQ ID NO: 357319 - RNA, 64 nt, hsa
agguacacauugggcggccugcaggaaccugcuccagguggacacacgggccagcagccgcgaa

SEQ ID NO: 357320 - RNA, 64 nt, hsa
gcugaggaugccuccgcugggcaucucccugccacagguggagcugaccggcuuuggggaggca

SEQ ID NO: 357321 - RNA, 64 nt, hsa
uguggaggccccagccgugggaauccaggucccccagguggagcugccugccuugcccucacug

SEQ ID NO: 357322 - RNA, 64 nt, hsa
ugagguggcugcaggagcucguuucacagccccucagguggagcugguugggccgcggcugcca

SEQ ID NO: 357323 - RNA, 64 nt, hsa
cuggggcagggcagguggaggggagaccuccauucagguggaggucccgagugggcggggcagc

SEQ ID NO: 357324 - RNA, 64 nt, hsa
gcuggggcuggaugcuuggguaacuggggcagggcagguggaggggagaccuccauucaggugg

SEQ ID NO: 357325 - RNA, 64 nt, hsa
uauacuuauuuauuucaggagcaggggugggaggcagguggacuccuggguccccgaggaggag

SEQ ID NO: 357326 - RNA, 64 nt, hsa
cuccuuucucuuggcugagugacagguggcuguucagguggaccaaagcaccuugacacaagga

SEQ ID NO: 357327 - RNA, 64 nt, hsa
acagugacccagccaugggcacuagcucaucuuucagguggaaaaguacagugcugccugcccu

SEQ ID NO: 357328 - RNA, 64 nt, hsa; identical to SEQ ID NO: 50374

SEQ ID NO: 357329 - RNA, 64 nt, hsa; identical to SEQ ID NO: 50375

SEQ ID NO: 357330 - RNA, 64 nt, hsa; identical to SEQ ID NO: 50376

SEQ ID NO: 357331 - RNA, 64 nt, hsa; identical to SEQ ID NO: 50377

SEQ ID NO: 357332 - RNA, 64 nt, hsa; identical to SEQ ID NO: 50378

SEQ ID NO: 357333 - RNA, 64 nt, hsa; identical to SEQ ID NO: 50379

SEQ ID NO: 357334 - RNA, 64 nt, hsa; identical to SEQ ID NO: 50380

SEQ ID NO: 357335 - RNA, 64 nt, hsa; identical to SEQ ID NO: 50381

SEQ ID NO: 357336 - RNA, 64 nt, hsa; identical to SEQ ID NO: 50382

SEQ ID NO: 357337 - RNA, 64 nt, hsa; identical to SEQ ID NO: 50383

SEQ ID NO: 357338 - RNA, 64 nt, hsa; identical to SEQ ID NO: 50384

SEQ ID NO: 357339 - RNA, 64 nt, hsa; identical to SEQ ID NO: 50385

SEQ ID NO: 357340 - RNA, 64 nt, hsa; identical to SEQ ID NO: 50386

SEQ ID NO: 357341 - RNA, 64 nt, hsa; identical to SEQ ID NO: 50387

SEQ ID NO: 357342 - RNA, 64 nt, hsa; identical to SEQ ID NO: 50388

SEQ ID NO: 357343 - RNA, 64 nt, hsa; identical to SEQ ID NO: 50389

SEQ ID NO: 357344 - RNA, 64 nt, hsa; identical to SEQ ID NO: 50390

SEQ ID NO: 357345 - RNA, 64 nt, hsa; identical to SEQ ID NO: 50391

SEQ ID NO: 357346 - RNA, 64 nt, hsa; identical to SEQ ID NO: 50392

SEQ ID NO: 357347 - RNA, 64 nt, hsa; identical to SEQ ID NO: 50393

SEQ ID NO: 357348 - RNA, 64 nt, hsa; identical to SEQ ID NO: 50394

SEQ ID NO: 357349 - RNA, 64 nt, hsa; identical to SEQ ID NO: 50395

SEQ ID NO: 357350 - RNA, 64 nt, hsa; identical to SEQ ID NO: 50396

SEQ ID NO: 357351 - RNA, 64 nt, hsa; identical to SEQ ID NO: 50397

SEQ ID NO: 357352 - RNA, 64 nt, hsa; identical to SEQ ID NO: 50398

SEQ ID NO: 357353 - RNA, 64 nt, hsa; identical to SEQ ID NO: 50399

SEQ ID NO: 357354 - RNA, 64 nt, hsa; identical to SEQ ID NO: 50400

SEQ ID NO: 357355 - RNA, 64 nt, hsa; identical to SEQ ID NO: 50401

SEQ ID NO: 357356 - RNA, 64 nt, hsa; identical to SEQ ID NO: 50402

SEQ ID NO: 357357 - RNA, 64 nt, hsa
uuguagauucuaacauuuauguaucuuuauuuucauauuguacaguaauuuuacuuuaaauuau

SEQ ID NO: 357358 - RNA, 64 nt, hsa
uguucagaauuacuuuugcucuucucacgaucccauauuguauuaucacuugucuucuagaggu

SEQ ID NO: 357359 - RNA, 64 nt, hsa
agcaaauguccauuuguguaaauguauuuauuuuauauuguauauauuguuaaaugcaaaaagg

SEQ ID NO: 357360 - RNA, 64 nt, hsa
aauacuguguaucuaucauuagcuauaugggacuauauuguagauugugguuucucaguagaga

SEQ ID NO: 357361 - RNA, 64 nt, hsa
uauguaacaaaacaacugaagauauguuuaauaaauauuguacuuauuggaaguaauaucaaac

SEQ ID NO: 357362 - RNA, 64 nt, hsa
ucuucauacucugcauauaauuuguggcugcagaauauuguaauuuguugcacacuauguaaca

SEQ ID NO: 357363 - RNA, 64 nt, hsa
guuuaacacauuuucuugaguaacaguucuguuaauauuguacaagaugguacuugaauucuuu

SEQ ID NO: 357364 - RNA, 64 nt, hsa
cauuuuauacacccucaggcaguguuuuggaauaauauuguaccuuuucaaauuguuaucaauu

SEQ ID NO: 357365 - RNA, 64 nt, hsa
agaaaaagguuauacguaccacggauucucuuuaauauuguacaguuaaacuguauuucugaug

SEQ ID NO: 357366 - RNA, 64 nt, hsa
guacaaauguuuaaaauauggcuuuucuaauuggauauuguauuuuuuuuaagucuucuugaag

SEQ ID NO: 357367 - RNA, 64 nt, hsa
uaugguaaaauaauagaaaugaucgacucuaucaauauuguauaaaaagacugaaacaaugcau

SEQ ID NO: 357368 - RNA, 64 nt, hsa
ccaucauucgaaucauccuuaaacacuugaauuuauauuguaugguaguauacuugguaagaua

SEQ ID NO: 357369 - RNA, 64 nt, hsa
caaaaugaagaauauguagauaauggacugggauauauuguauuucucauguuaaagccucuuc

SEQ ID NO: 357370 - RNA, 64 nt, hsa
aauguguuucauucuaguaagaaaaccucaaaggauauuguaggauauaaaucuuacuugaaaa

SEQ ID NO: 357371 - RNA, 64 nt, hsa
uuuauuaacuaauguaauguccuccucuaagaccauauuguaagagucuuguuaaaaugaugga

SEQ ID NO: 357372 - RNA, 64 nt, hsa
guaaugugugcguaucaugucacuauauauaagaauauuguaugucaugcuguuuaugugugac

SEQ ID NO: 357373 - RNA, 64 nt, hsa
auguuaucaggaguauuuugagggagauaugauuauauuguauuuucucagauaagaaaaaugu

SEQ ID NO: 357374 - RNA, 64 nt, hsa
ccagugcuugucaaauuugcugacaggucacaucauauuguaauucuauucuuugcagcucaag

SEQ ID NO: 357375 - RNA, 51 nt, hsa; identical to SEQ ID NO: 75575

SEQ ID NO: 357376 - RNA, 64 nt, hsa
cugagggcaaagaaaguccuuagauaaagagagaauauuguaugggccaucaaccauuuacuuu

SEQ ID NO: 357377 - RNA, 64 nt, hsa
aaaguaguaauaaagaauaaaauacuuuacuaaaauauuguauggcuauuuucauguuugaagc

SEQ ID NO: 357378 - RNA, 64 nt, hsa
auaaagccauaguuuucuuggauuuucuuccaagauauuguauucccaagaagaaauugauuua

SEQ ID NO: 357379 - RNA, 64 nt, hsa
gcagaaacaguagaaccuguguaaccucaaggagauauuguaugaaucucacuagccgcagcuu

SEQ ID NO: 357380 - RNA, 64 nt, hsa
uaccacauaguacuuauucagucaguguuagaggauauuguaguauuaucaaaaguauugguua

SEQ ID NO: 357381 - RNA, 64 nt, hsa
uaggaacaaauaaagacaaacaacauuaagggccauauuguaagauuuccauguuaaugaucua

SEQ ID NO: 357382 - RNA, 64 nt, hsa
aaacucaagcccucaaggcccaacuucucugucuauauuguaauauagaauuucgaagagacau

SEQ ID NO: 357383 - RNA, 64 nt, hsa
aaugacauauaauuuauauaugaaagcuuacgcuauauuguaugaauuauuugcaucuuucagu

SEQ ID NO: 357384 - RNA, 64 nt, hsa
caaugauuuuuuuagcauuuuaauauuuuaauauauauuguaaaauuuagacugaugauacuaa

SEQ ID NO: 357385 - RNA, 64 nt, hsa
auugcacauaaucaugcuauucagcauugaugcuauauuguauuauguaaauaauaaaagccau

SEQ ID NO: 357386 - RNA, 64 nt, hsa
guauccagcaccacuugcagagggcugcuuuaucauauuguacuuggguguaggacucuagugu

SEQ ID NO: 357387 - RNA, 64 nt, hsa
auuugaauuuugauuuucuauuuuuauuuuuuaaauauuguauuugugcacaauguacauuaaa

SEQ ID NO: 357388 - RNA, 64 nt, hsa
uacagcuuaauaguuuaugcgugauuuucucaaaauauuguaaaacuuuugacaaugcucauua

SEQ ID NO: 357389 - RNA, 64 nt, hsa
aauaaaggacaggcuggugcuaacauaaaauccaauauuguaauccuagcacuuugggaggcca

SEQ ID NO: 357390 - RNA, 64 nt, hsa
gaugaguuguagacacugaucugcuagugcuguaauauuguaaauacuggacucaggaacuuuu

SEQ ID NO: 357391 - RNA, 64 nt, hsa
cacaguauucaguuuucucaccucuugcuauuguauauuguagauuuuuuucauucauguguua

SEQ ID NO: 357392 - RNA, 64 nt, hsa
aauauaacaaaaaugaauuuuguuugauagauuuauauuguaaccuuuuucuaguucuugaaua

SEQ ID NO: 357393 - RNA, 64 nt, hsa
uaaaaauaaggaaccaugacauuguagauauuuaauauuguacaguauagaaaccuccauuuuu

SEQ ID NO: 357394 - RNA, 64 nt, hsa
cauuaucgcauuaucuuggcauaauggccagaaaauauuguauugcuuggcagaaaagaaaaua

SEQ ID NO: 357395 - RNA, 64 nt, hsa
uaagucagguacaaauguacacaucaaaaugcccauauuguaucuaucuguagucguuuaaugu

SEQ ID NO: 357396 - RNA, 64 nt, hsa
aacgugggugcuuguguuugaccuuuucagccauauauuguacagccuuauagaaucuaagcug

SEQ ID NO: 357397 - RNA, 64 nt, hsa
cauugacaaauaccaagaauuuuugcguauguuuauauuguauuguucuaaauaauggguagcc

SEQ ID NO: 357398 - RNA, 64 nt, hsa
auacaucacagccuucucaaacagcucaagcaauauauuguauauugccauaucgucuggugaa

SEQ ID NO: 357399 - RNA, 64 nt, hsa
agguuuuuccccaucuccuguagagcgaauuuacauauuguauuggguaaguguucacuacuuu

SEQ ID NO: 357400 - RNA, 64 nt, hsa
ucugugcuggggaacaaagcuuuugcaguaccuuauauuguaguuaaaauuuuauuuaacauau

SEQ ID NO: 357401 - RNA, 64 nt, hsa
ucuauuacacuggagcuguuuuauagauaagucaauauuguaucaggcaagauaaaccaauguc

SEQ ID NO: 357402 - RNA, 64 nt, hsa
uaacauuuccuacguauuuuauuuuacauagaucauauuguauauaguuaguaucuuuauuaau

SEQ ID NO: 357403 - RNA, 64 nt, hsa
uaguguuucuguucaaauagagaccugaauucaaauauuguaguuuagguucaaacagaguaug

SEQ ID NO: 357404 - RNA, 64 nt, hsa
augcagaggaguuuucaagaggcuaucuggugugauauuguaauaggcugaaugcaaaagcaga

SEQ ID NO: 357405 - RNA, 64 nt, hsa
ugugauaaaaauaggugagagaucauaugaucuaauauuguauugauggaaguauagguaguau

SEQ ID NO: 357406 - RNA, 64 nt, hsa
uuuuugacagugaacauggucuaaaaaagggaagauauuguagaagauuucacacacacacgcg

SEQ ID NO: 357407 - RNA, 64 nt, hsa
ugccuuuuuaagcuguuucauauugaaagguggaauauuguaaaaauuuugucaaagauguacu

SEQ ID NO: 357408 - RNA, 64 nt, hsa
gaacaugauuugaugcuauaaaguaggcauuuuaauauuguaaacauauacuuuggcuguauug

SEQ ID NO: 357409 - RNA, 64 nt, hsa
aguugaaacucuuauuagaaacuuucaguuggugauauuguauucuagaagauauaaaugagag

SEQ ID NO: 357410 - RNA, 64 nt, hsa
aaucucagaaguaguuugcugcuaauauauacauauauuguauaaaaagguauauuuugguuuu

SEQ ID NO: 357411 - RNA, 64 nt, hsa
gccuuaauuuguacugucugcggcauuuuuuauaauauuguauauagugacugacaaauauugu

SEQ ID NO: 357412 - RNA, 64 nt, hsa
cauuuuuuauaauauuguauauagugacugacaaauauuguauuacuguacauagagagacagg

SEQ ID NO: 357413 - RNA, 64 nt, hsa
gauuucauuauuauuacccauacuguugccacucauauuguaagucaguuuuuucauugcuggu

SEQ ID NO: 357414 - RNA, 64 nt, hsa
uugcuuuacaggaguuugucauguauugacuuuaauauuguauuuugguaauaaauuuuuuguu

SEQ ID NO: 357415 - RNA, 64 nt, hsa
ucacuuauuuauaagcccucuugguugcuauuccauauuguaggaugccuuucuauuucaauug

SEQ ID NO: 357416 - RNA, 64 nt, hsa
agaauauuauuuucacauugaaacauagauguauauauuguauagauuucagacucucuuauga

SEQ ID NO: 357417 - RNA, 64 nt, hsa
aguaagaugagcaauugcaacauaauauucucuaauauuguauacuguaaauuuauucagcugc

SEQ ID NO: 357418 - RNA, 64 nt, hsa
uuuuaaaaaauuagagugaagaaaaaugaugaacauauuguaaugaugcuucugugaauuugaa

SEQ ID NO: 357419 - RNA, 64 nt, hsa
uuauuuauggcuaccuauguguuuguaagcagguauauuguauauuaguguauuaguaauacua

SEQ ID NO: 357420 - RNA, 64 nt, hsa
uuaguacuauuccuguuguaaaguuagauuuugcauauuguaucuaucaaaauauguuuggguu

SEQ ID NO: 357421 - RNA, 64 nt, hsa
ucuauauaaaguuacuuuuccccuuuacuuaauuauauuguagugugcagauaacaaaacugcu

SEQ ID NO: 357422 - RNA, 64 nt, hsa
caaaacguguuaucaauauagaguguugcaguguauauuguaacaaccuaaaacgcagagaagu

SEQ ID NO: 357423 - RNA, 64 nt, hsa
aaggcagaaaccaagaacugucugcaggcaaauaagcacccagcacccauccuggcugccggug

SEQ ID NO: 357424 - RNA, 64 nt, hsa
aaaccaagaacugucugcaggcaaauaagcacccagcacccauccuggcugccggugccccgua

SEQ ID NO: 357425 - RNA, 64 nt, hsa
ugagcagggaacucagugugacaccgccagguccagcacccaugggggcgggggagaggcucac

SEQ ID NO: 357426 - RNA, 64 nt, hsa
ccuaggaucagggaccagaggauccuaucuucucagcacccagcccaccccuuccuguagcaua

SEQ ID NO: 357427 - RNA, 64 nt, hsa
gacaaugcaaaaauggucuucaaagcacauaaaaagcacccagggugagaaagccccaucccgg

SEQ ID NO: 357428 - RNA, 64 nt, hsa
gaugaauuaguugcugucacaaaaggagggaaguagcacccaaauuaaguugcuuaagagagga

SEQ ID NO: 357429 - RNA, 64 nt, hsa
gacaaaucccacuggccuacagucuugcuucugcagcacccacuuugucuccucagguagugau

SEQ ID NO: 357430 - RNA, 64 nt, hsa
ggguaccaggcaggcucccuuccuggggaaaagaagcacccagaccccgcgccccgcugaucuu

SEQ ID NO: 357431 - RNA, 64 nt, hsa
ucucagacguuccauacccccacaugccaauuucagcacccaacugagauccgaggagcuccug

SEQ ID NO: 357432 - RNA, 64 nt, hsa
gcaauacucuguggaggucugguggggcugggggagcacccaggcggaucugcaagcaccucgg

SEQ ID NO: 357433 - RNA, 64 nt, hsa
ggggagcacccaggcggaucugcaagcaccucggagcacccaccgcugggucugcggccuaagg

SEQ ID NO: 357434 - RNA, 64 nt, hsa
gcccaccugugcucaggaugcagcccugggauccagcacccauggaagcuucugcugggauggu

SEQ ID NO: 357435 - RNA, 64 nt, hsa
gggagcucugcucugagcuugccacacugcugagagcacccacuguccugaccagagucucagu

SEQ ID NO: 357436 - RNA, 64 nt, hsa
gggcaugagguggucaccaggauugagcuuccucagcacccaguggguaauacuugcuuccacu

SEQ ID NO: 357437 - RNA, 64 nt, hsa
cuccugccucagccucccuaguagcugggacuacagcacccaccaccacacccagcuaauuuuu

SEQ ID NO: 357438 - RNA, 64 nt, hsa
aaacccaagggaggaguccugguccugcucccucagcacccaaaaggggcagaaccugaguuga

SEQ ID NO: 357439 - RNA, 64 nt, hsa
ugugucgcuucucacuccucaaagcccccucaggagcacccaguccucagcugcucucuuaggu

SEQ ID NO: 357440 - RNA, 64 nt, hsa
gcacaugagcacccaccccacagcaccaucaggcagcacccaugggcuccaccagcccagcucu

SEQ ID NO: 357441 - RNA, 64 nt, hsa
caggucuccacugccaagcaggacuuggcacaugagcacccaccccacagcaccaucaggcagc

SEQ ID NO: 357442 - RNA, 64 nt, hsa
uccagcccaggcacggaaugggagggcccugcaaagcacccaaguguguuucacucaccccuua

SEQ ID NO: 357443 - RNA, 64 nt, hsa
gccaacugaccaucuaccugcccguggggccaggagcacccaagaccacagaaaagagaaagga

SEQ ID NO: 357444 - RNA, 64 nt, hsa
gccaagcaguuuucugggacaacagaaugacucagaccaagauggauaggaugguuagggcuuu

SEQ ID NO: 357445 - RNA, 64 nt, hsa
ugggugggucccacacuugugaccucaguuuuaggaccaagaucuguguugguuucuuagauug

SEQ ID NO: 357446 - RNA, 64 nt, hsa
uggcuuggcucuugacguggacagaauuaaaaaggaccaagaagaggaagaagaccaaggccca

SEQ ID NO: 357447 - RNA, 64 nt, hsa
ugcagaaauugaaaaguaccaagaaguggaagaagaccaagacccaucaugccccagguaacuu

SEQ ID NO: 357448 - RNA, 64 nt, hsa
gcagcagcaacaggcuggagggagagggaagcaagaccaagaugaggaggggggaaggcugggu

SEQ ID NO: 357449 - RNA, 64 nt, hsa
cuuagccuccugugcugcguguccaucaucagcugaccaagacaccugaggacacaucuuggca

SEQ ID NO: 357450 - RNA, 64 nt, hsa
gccgcgggucucccggcccaaccccaccgacccagaccaagaccgcgccgagccgccgggacuc

SEQ ID NO: 357451 - RNA, 64 nt, hsa
gaaaucugaaaggagugugcucaugccauuuccagaccaagaaaauacauuuauuauuugcuaa

SEQ ID NO: 357452 - RNA, 54 nt, hsa
cagaagaugaugaauugugaucaggaccaagaucccugugguaaacacucugau

SEQ ID NO: 357453 - RNA, 64 nt, hsa
ugcucuccuucugagucaggacauguguacaggagaccaagaacaaugaguauuagaaaaaaag

SEQ ID NO: 357454 - RNA, 64 nt, hsa
ucaucuccuaugugaugcugaagaccaagagagugaccaagaaggcucagugaaggucccgcag

SEQ ID NO: 357455 - RNA, 64 nt, hsa
ucccaggacuguucaucuccuaugugaugcugaagaccaagagagugaccaagaaggcucagug

SEQ ID NO: 357456 - RNA, 64 nt, hsa
uuuuuuaucuagagaccagcauguucuccccaaagaccaagauauucugccaaaauaucaggac

SEQ ID NO: 357457 - RNA, 64 nt, hsa
cuccaacgaccagaauauucuacccaaaugucaggaccaagauuuucuaccaaaauaucaggua

SEQ ID NO: 357458 - RNA, 64 nt, hsa
ggacuaucaucaauauguuguaccuaaaauccaggaccaagacuccccuagagaacagguagaa

SEQ ID NO: 357459 - RNA, 64 nt, hsa
gagagguggguggcgggcaccucaugccagcugagaccaagagugguuguauacauuucugcag

SEQ ID NO: 357460 - RNA, 64 nt, hsa
uaagcacuggggacugccagguuggcacuguagggaccaagauuaacuuuuuggugcaucuaau

SEQ ID NO: 357461 - RNA, 64 nt, hsa
agaaccaagcggugccagccacgagacgucaccaagaaaacaugcaacucaaacgacggaaaaa

SEQ ID NO: 357462 - RNA, 64 nt, hsa
ucaaacgacggaaaaaaaaagggaaugggaaaaaagaaaacagauccugggagggggcgggaaa

SEQ ID NO: 357463 - RNA, 64 nt, hsa
gguuaugggagggcaugagggaacacuucuuaugagaaaacauuuauaaacaaaagaaacauuu

SEQ ID NO: 357464 - RNA, 64 nt, hsa
uugcagaugacuugcuuacuguauuugcauuguuagaaaacaguuuguagacaaugauucuuuu

SEQ ID NO: 357465 - RNA, 64 nt, hsa
aaacuacuagacaaaaaagugagaggauagauuuagaaaacaucagugaugcucagauaaacuu

SEQ ID NO: 357466 - RNA, 64 nt, hsa
ccauacaucugcuacuuugggaggcccuuuacauagaaaacagcauucuuuuugccaaauauga

SEQ ID NO: 357467 - RNA, 64 nt, hsa
aucuguuauaauuuaauauucaaaucuggaauuaagaaaacauauuuucuaguauccucuaagg

SEQ ID NO: 357468 - RNA, 64 nt, hsa
ucucuccugaucagugccauucccacgguuucaaagaaaacagcuacaaggaaugcuuaccuga

SEQ ID NO: 357469 - RNA, 64 nt, hsa
accuucaauacacgucaaggucgcuuccaguuuuagaaaacagaaaucugcaucucagccugag

SEQ ID NO: 357470 - RNA, 64 nt, hsa
uaggccagaagacacuuuauucguuuauauugugagaaaacagccccaucaggcuuguguuaag

SEQ ID NO: 357471 - RNA, 64 nt, hsa
uguaaauguaauaaaauguauaaauaugguuuucagaaaacaucaagugcuguaaauauguaau

SEQ ID NO: 357472 - RNA, 64 nt, hsa
aaauguaggauuuguuauuccccuuugacagaugagaaaacagaagccugcaaagguaaagaca

SEQ ID NO: 357473 - RNA, 64 nt, hsa
gcauugaguuaaugaaacagacacuuuuagaucaagaaaacacuucaacagccuuuuuagaaau

SEQ ID NO: 357474 - RNA, 64 nt, hsa
cuagaaaacaggaugccugucacugauaaguuagagaaaacacccaaauuauacuugcacuaug

SEQ ID NO: 357475 - RNA, 64 nt, hsa
caguuuuuccuauaucauuuagauauuauuuccuagaaaacaggaugccugucacugauaaguu

SEQ ID NO: 357476 - RNA, 64 nt, hsa
ucuccuuuuccuauuugaauuucuuuggugcuguagaaaacaaaaaaagaaaaauauauauuca

SEQ ID NO: 357477 - RNA, 64 nt, hsa
ugugccacaugcaaguuuugaauaaggaugguauagaaaacaacgcugcauauacagguaccau

SEQ ID NO: 357478 - RNA, 64 nt, hsa
agguuacaaggaguguuguagcuucugaaggugcagaaaacaauuucuaaaaaugcuuuuauuc

SEQ ID NO: 357479 - RNA, 64 nt, hsa
acuggucauaggcucuagucaccuggggagcuguagaaaacacuugcagagccagguuuugcug

SEQ ID NO: 357480 - RNA, 64 nt, hsa
gcaugugcaaagcaagcaaggaacauuugggguaagaaaacaaacaugaggcaaaagaaaaaau

SEQ ID NO: 357481 - RNA, 64 nt, hsa
aaacaugaggcaaaagaaaaaauacauguuuuuaagaaaacauugagcagagaacugcagccag

SEQ ID NO: 357482 - RNA, 64 nt, hsa
cucagcagacauucacucuggcugcugggacaucagaaaacaaagucuucaucucucucuccag

SEQ ID NO: 357483 - RNA, 64 nt, hsa
uaacuggccgccccacuuuccggcauaacuuuuuagaaaacagaaaugcccuugaugguggaaa

SEQ ID NO: 357484 - RNA, 64 nt, hsa
uuagaaaacagaaaugcccuugaugguggaaaaaagaaaacaaccacccccccacugcccaaaa

SEQ ID NO: 357485 - RNA, 64 nt, hsa
gugacgaggaagguucuguuuugaguauagccagagaaaacaaggauggagaaaaaucuaggac

SEQ ID NO: 357486 - RNA, 64 nt, hsa
gugacgaggaagauucuguuuuggguauagccagagaaaacaaggauggagaaaaaucuaggac

SEQ ID NO: 357487 - RNA, 64 nt, hsa
uauuaauggcauguaauauucugagcacgggcaaagaaaacacacaaaagauuauguauuggca

SEQ ID NO: 357488 - RNA, 64 nt, hsa
cugggaaggcaacaccuguggauaaaacauuagaagaaaacauauauuuuauuuucauacuuuu

SEQ ID NO: 357489 - RNA, 64 nt, hsa
cauguacuuagugacuugacugagaaguuaggguagaaaacaaaaagggaguggauucugggag

SEQ ID NO: 357490 - RNA, 64 nt, hsa
aaugcuuucauaguuucagauaugguaguuaugaagaaaacaaugucauuugcugcuauuauug

SEQ ID NO: 357491 - RNA, 64 nt, hsa
cguguaaggugaugugcacauaucaagaagucagagaaaacacuuuccuggauaaaaaagaaaa

SEQ ID NO: 357492 - RNA, 64 nt, hsa
ucuuuuuucuagaaaacacuuuccuggauaaaaaagaaaacauuccagaugcaugauccagcug

SEQ ID NO: 357493 - RNA, 64 nt, hsa
uccuagaaauucuuaaauauauacagaauuuuaaagaaaacauuucaucugauuuaguuagcau

SEQ ID NO: 357494 - RNA, 64 nt, hsa
ucuauugggauauaaaagccuuccccuucagugaagaaaacauuuauuuuuuauuugauuccua

SEQ ID NO: 357495 - RNA, 64 nt, hsa
ugcuaucuguuauagacuagugauacaaacuuuaagaaaacaggauaaaaagauacccauugcc

SEQ ID NO: 357496 - RNA, 64 nt, hsa
ucugcacccgggugggggacagagggaccuuuaaagaaaacaaaacuggacagaaacaggaaug

SEQ ID NO: 357497 - RNA, 64 nt, hsa
ggccgagcugccgaauucaguugacacgaggcacagaaaacaaauaucaaagaucuaauaauac

SEQ ID NO: 357498 - RNA, 64 nt, hsa
uucaaagacaacaugcuuuggaaacauauguccuagaaaacauaaaauuaaaaaaaaacacuau

SEQ ID NO: 357499 - RNA, 64 nt, hsa
aaaaaucccauuuacaagcauugcaccuuuaagaagaaaacaaauaugacaguaugguagcuau

SEQ ID NO: 357500 - RNA, 64 nt, hsa
caaaaaaucugaccaaaacaaacaaacagaaaacagaaaacaaaaaaaccucuaugcaaucuga

SEQ ID NO: 357501 - RNA, 64 nt, hsa
gauguuucaaaaaaucugaccaaaacaaacaaacagaaaacagaaaacaaaaaaaccucuaugc

SEQ ID NO: 357502 - RNA, 64 nt, hsa
gcuuagaugacuucugcaggauuuauauucagauagaaaacaucaaauauuuucaggggagagg

SEQ ID NO: 357503 - RNA, 64 nt, hsa
uuucacccuguugggguaaauguuuuaaagagugagaaaacauaaauugagaaagggugauaaa

SEQ ID NO: 357504 - RNA, 64 nt, hsa
uaguuuguuaauugauuaaacuguaugucuuauaagaaaacauguaaagggggaauauaugggg

SEQ ID NO: 357505 - RNA, 64 nt, hsa
cacacacacacacaaaugcagacacacaacaucaagaaaacagcaagggagagaauccaagccu

SEQ ID NO: 357506 - RNA, 64 nt, hsa
uaggagguuuguaaaagaagaaucaauuuucagcagaaaacaugucaacuuuaaaauauaguuu

SEQ ID NO: 357507 - RNA, 64 nt, hsa
uuuuugaagaccaaaugugaugcaugguggauccagaaaacaaaaaguaggauacuuacaaucc

SEQ ID NO: 357508 - RNA, 64 nt, hsa
uggugcugaauauguccuuguaggcucuguuuuaagaaaacaauaugugggaaaugauuuaauu

SEQ ID NO: 357509 - RNA, 64 nt, hsa
caaaacaaauaggcuuuuccauaaguggccuuuaagaaaacauggaagacaauucauguuugac

SEQ ID NO: 357510 - RNA, 64 nt, hsa
uauuuuauauucagcauaaaggagaauaaauuccagaaaacacauauucugaaaauggaguguu

SEQ ID NO: 357511 - RNA, 64 nt, hsa
uauuaccuuuguagcagccacaucagaaagcagaagaaaacaguauuucugaaggcauuguuug

SEQ ID NO: 357512 - RNA, 64 nt, hsa
cuuuugagaccacccauuuuuauagaucagaaucagaaaacagguaaaccucacucacacauuu

SEQ ID NO: 357513 - RNA, 64 nt, hsa
cucugcugccauaaucacacaaauuuaaaaagaaagaaaacagucuuccauagauuuuuaagga

SEQ ID NO: 357514 - RNA, 64 nt, hsa
uauauaggugauuuuaccagguuuaguuauccugagaaaacaucuggacuuaagaguuucugcu

SEQ ID NO: 357515 - RNA, 64 nt, hsa
aucacucucauaauaugcuuuccagcuagaggggagaaaacaccaggaaagaggaacccugggu

SEQ ID NO: 357516 - RNA, 64 nt, hsa
uucucuguauucucauauaauuucaauguaaaacagaaaacauauugauguguuggugauaggc

SEQ ID NO: 357517 - RNA, 64 nt, hsa
aaucuuuuacgcagaagaaauaaaaacuacggguagaaaacauaagaacuaucauaaaauuuac

SEQ ID NO: 357518 - RNA, 64 nt, hsa
cauucaaaacagucucaguaacaaagacauuaaaagaaaacaauuuacuuucuaauuaaaauuu

SEQ ID NO: 357519 - RNA, 64 nt, hsa
cauaauuacauuaccaguguuggaaaacuaaugaagaaaacacuguaauugcuacucagcaaau

SEQ ID NO: 357520 - RNA, 64 nt, hsa
guuuucuacuauuccuuucugagcuauguuuuagagaaaacaauuugauaugcuucaauuuugu

SEQ ID NO: 357521 - RNA, 64 nt, hsa
acucuagguuuauagagugauguaauucaacugaagaaaacacacacaugcuuuuggugcuuau

SEQ ID NO: 357522 - RNA, 64 nt, hsa
aaggaauuauuuacugauugguuuuaaagagagcagaaaacacccaaguguagaaugucuacug

SEQ ID NO: 357523 - RNA, 64 nt, hsa
ugauuuaaaguauacuuaaauuaggauuucuuaaagaaaacauagggagaaaacuuuacaugca

SEQ ID NO: 357524 - RNA, 64 nt, hsa
aaggugcaaagcgaaacugguugcucaaguugauagaaaacaaaauucugaauaucuucaaauu

SEQ ID NO: 357525 - RNA, 64 nt, hsa
aaauauuagcuguaugaauaugauuuaauuaacaagaaaacauuucuuccugauugacaacagu

SEQ ID NO: 357526 - RNA, 64 nt, hsa
uaugucucuaggacauuuuauaguuuuaagaggaagaaaacagaaacguggcaucauuugggaa

SEQ ID NO: 357527 - RNA, 64 nt, hsa
aucaaguauaaugauguaguaaaaagauuucuccagaaaacacuuugagauacuuaaagaaauu

SEQ ID NO: 357528 - RNA, 64 nt, hsa
gauguguugaugaaauaaaauguguaucugagugagaaaacaaguauggugaggucacuuuaau

SEQ ID NO: 357529 - RNA, 64 nt, hsa
caacuaagcuuuuaaaaaucaacuauuaccacccagaaaacaguccuacgugaucauguggcca

SEQ ID NO: 357530 - RNA, 64 nt, hsa
aaacugucauaauggugaauguucaaucuguguaagaaaacaaacuaaauguaguugucacacu

SEQ ID NO: 357531 - RNA, 64 nt, hsa
gugauggcaaggugcuuguuaugucuagaaaguaagaaaacaauaugaggagacauucugucuu

SEQ ID NO: 357532 - RNA, 64 nt, hsa
aaauagccucccuuuagaaugucacauuuuucuuagaaaacauuuuggaauugguuaaccuuau

SEQ ID NO: 357533 - RNA, 64 nt, hsa
uauuggauuuugugauuauauuugagugaauaggagaaaacaauauauaacacacagagaauua

SEQ ID NO: 357534 - RNA, 64 nt, hsa
accccuuuggcuaucuacugagacaugacuaggaagaaaacaugacuuuaucauuuuguuauag

SEQ ID NO: 357535 - RNA, 64 nt, hsa
ccaguacucacccagggacuccaguucacaggccagaaaacauaugcauuaugaaguuccccuc

SEQ ID NO: 357536 - RNA, 64 nt, hsa
agcgcucagccuauggguuuaagcagagggcuacagaaaacagggaagagacauaccccugggc

SEQ ID NO: 357537 - RNA, 64 nt, hsa
aggccuuguccaagaagaacuugcuacacagccuagaaaacaagauggaaagauauauaaauau

SEQ ID NO: 357538 - RNA, 64 nt, hsa
ucuaagagaaugaauuaucccccaaaaugcauuuagaaaacagucuuuggugauauuuauuaua

SEQ ID NO: 357539 - RNA, 64 nt, hsa
cauugaucaaauauuucaaccuuucauauuuuuaagaaaacacccauauauauugaaaugcaaa

SEQ ID NO: 357540 - RNA, 64 nt, hsa
gauccgagggcagcagugcuggguggagagagccagaaaacagaucuggaggcagcagugcugg

SEQ ID NO: 357541 - RNA, 64 nt, hsa
gcuaaauuaauuggaguggggcgaggagagagccagaaaacauagauccgagggcagcagugcu

SEQ ID NO: 357542 - RNA, 64 nt, hsa
uaauuccagagauggaacauuuuuuuuccuagugagaaaacaacccauuugaagagaagaccac

SEQ ID NO: 357543 - RNA, 64 nt, hsa
uucagugcuuaccgaugaugcaguacuugauagaagaaaacagucugggaggauagcgcucauu

SEQ ID NO: 357544 - RNA, 64 nt, hsa
cagccacagacagcucccgaugcgcugcccccugagaaaacacuugaauugacgcaauauaaaa

SEQ ID NO: 357545 - RNA, 64 nt, hsa
ugaaaaguagcauauucucuuaugaaauagcaugagaaaacacagggcauuucuaggacaguaa

SEQ ID NO: 357546 - RNA, 64 nt, hsa
uucuaggacaguaaaacguuaaaguacuggauuaagaaaacaacaacaggcugggcgcaguggc

SEQ ID NO: 357547 - RNA, 64 nt, hsa
aguagucauuuagcaguagaugugcauuauuaugagaaaacaguucuauaaguccaggguuaau

SEQ ID NO: 357548 - RNA, 64 nt, hsa
aggaaagaaauguaauuuucuuugaacaugaaaaagaaaacaacuuugagaguagucauuuagc

SEQ ID NO: 357549 - RNA, 64 nt, hsa
acacgaugaaaacagccuguauuugagggagaagagaaaacagauggagacccccacucugucu

SEQ ID NO: 357550 - RNA, 64 nt, hsa
aauugucacauacauuuuacaguuuggacuuuuaagaaaacauggauacuacuggaacuucccc

SEQ ID NO: 357551 - RNA, 64 nt, hsa
acaaguuuguggcagaacuggauuagaacugcacagaaaacagccaagcugggauuugaaccca

SEQ ID NO: 357552 - RNA, 64 nt, hsa
aauuauacaaagagaauuggggagacagcuaagaagaaaacaaagaaauaaagcaguuacaaau

SEQ ID NO: 357553 - RNA, 64 nt, hsa
guuugacuacuuuguucuuugguuaagauccaaaagaaaacagaaaacaauuccacgaggccaa

SEQ ID NO: 357554 - RNA, 64 nt, hsa
uacuuuguucuuugguuaagauccaaaagaaaacagaaaacaauuccacgaggccaaucuaaag

SEQ ID NO: 357555 - RNA, 64 nt, hsa
aaaagcugcaagggugcaaagggccugugccagaagaaaacacacacagggaaaccgcuuuuuu

SEQ ID NO: 357556 - RNA, 64 nt, hsa
acauccagaaaacuuuaacauucuucaaagaaauagaaaacacaauccuaaaauuuauauggga

SEQ ID NO: 357557 - RNA, 64 nt, hsa
uaaaucuaagaccucaaacuaugaaacagcuaaaagaaaacaucggggaaucucuccaggacau

SEQ ID NO: 357558 - RNA, 64 nt, hsa
uucuuuguucuuucagugaagagaaaggaaguacagaaaacaugcagaaagcacagaaaggaaa

SEQ ID NO: 357559 - RNA, 64 nt, hsa
cauauuauacaauauuucaauugugaauucacauagaaaacauuaaauuauaauguuugacuau

SEQ ID NO: 357560 - RNA, 64 nt, hsa
gaguucccucuguauagccucugggacaagaaaaagaaaacacaagaauguauacacuggaaga

SEQ ID NO: 357561 - RNA, 64 nt, hsa
ccgugaucaagguagcuuaagagagauggucaggagaaaacacuguuuuuguuuuuuuuguugu

SEQ ID NO: 357562 - RNA, 64 nt, hsa
cuagacguucaaguuugcaaaucaguuuuuagcaagaaaacauuuuugcuauacaaacauuuug

SEQ ID NO: 357563 - RNA, 64 nt, hsa
aauuuuauaugcagagagaaaaaguuaccgagacagaaaacaaaucuaagggaaaggaauauua

SEQ ID NO: 357564 - RNA, 64 nt, hsa
acagugugcuacauuuacaaaaaauuucuccuuaagaaaacagaauauucaaaaacagcacuuu

SEQ ID NO: 357565 - RNA, 64 nt, hsa
gagagacugaauuguuaguaggucuaaacaucaaagaaaacauuuuuauuaguuacuuauggaa

SEQ ID NO: 357566 - RNA, 64 nt, hsa
agugaugaaucaaaauuagaaauuaagaguuuuaagaaaacauguggccuuuuauuaauaacac

SEQ ID NO: 357567 - RNA, 64 nt, hsa
aagagcccaacucuacuaaaaauacaaaaagaaaagaaaacagccaagcuuggugguaugugcc

SEQ ID NO: 357568 - RNA, 64 nt, hsa
auaagcauggagaacagugauuuuuuuuuagaacagaaaacaacaaaaaauaaccccaaaauga

SEQ ID NO: 357569 - RNA, 64 nt, hsa
uuaauugugaauugauaauaaacuguccucuuucagaaaacagaaaaaaaacacacacacacac

SEQ ID NO: 357570 - RNA, 64 nt, hsa
uuuuuuuuuuuuuucugguguuggagucuuauuuagaaaacaggauaaaugacgcuguuaucaa

SEQ ID NO: 357571 - RNA, 64 nt, hsa
aauauaaaagguauagguuuuuuuuuuuuuuuaaagaaaacaauaaacuuucaaagagaaaacc

SEQ ID NO: 357572 - RNA, 64 nt, hsa
uuccccuuaugauugggaaagaugaauuuucagcagaaaacauuguuuguucacuuucaaagag

SEQ ID NO: 357573 - RNA, 64 nt, hsa
uuugugguuuaucuaaggaaagucaaaucuugacagaaaacauuuuuccuuggaaggucaacuc

SEQ ID NO: 357574 - RNA, 64 nt, hsa
uugcagaaauaaaucuuuuuuuuuuuuuuuugguagaaaacaaagaggcauacucugauuuuua

SEQ ID NO: 357575 - RNA, 64 nt, hsa
caauauauucaaagaaaagaaaacacaaauaagcagaaaacauacuuauuuuaaaaaagaaaaa

SEQ ID NO: 357576 - RNA, 64 nt, hsa
aauaauaaaauauugugcaauauauucaaagaaaagaaaacacaaauaagcagaaaacauacuu

SEQ ID NO: 357577 - RNA, 64 nt, hsa
uguguuuaauauugaaguggaucaugagauguaaagaaaacaauaauggcaaugacuuauauuc

SEQ ID NO: 357578 - RNA, 64 nt, hsa
ugcuacuuuuaaaaucccagauacucugaauuuuagaaaacaaacuaauucugauugugucgug

SEQ ID NO: 357579 - RNA, 64 nt, hsa
uuuauuuccaggucacagaauugcuguuaacacuagaaaacacacuuccugcaccaacaccaau

SEQ ID NO: 357580 - RNA, 64 nt, hsa
uugugguuuuuauuuugaacgcuugcuuuuagagagaaaacaauauagcccccuacccuuuucc

SEQ ID NO: 357581 - RNA, 64 nt, hsa
ugguuauaaauguaauacgaauuguuucacaaacagaaaacauguaaagcaguauuaaaauuug

SEQ ID NO: 357582 - RNA, 64 nt, hsa
ugucuuucuuuuuggacauuuaccuuuuugaaaaagaaaacacuuaaaaugaucauuaggacau

SEQ ID NO: 357583 - RNA, 64 nt, hsa
uacugaggugugcuucaagggagcauuauagggcagaaaacaaauuaaaaugaaauguuguugu

SEQ ID NO: 357584 - RNA, 64 nt, hsa
gggcggguggauagcuuuuuguucuaucuuguacagaaaacaguaauggaaucacucauguuca

SEQ ID NO: 357585 - RNA, 64 nt, hsa
ggugauuggaaauuuuuagcuguaacaaaaagaaagaaaacaacuuuuuuuaaagccucauucu

SEQ ID NO: 357586 - RNA, 64 nt, hsa
auuauuuuuauuuucucccugcucuguauugaccagaaaacaaugauuuuauaauauuuaaccc

SEQ ID NO: 357587 - RNA, 64 nt, hsa
uagagaaacagauucaugcuuguaucuugcauucagaaaacaaacuguccuacuaaucaaagcu

SEQ ID NO: 357588 - RNA, 64 nt, hsa
agaguuaguagaucaaacagaauaguaggaaacaagaaaacauuaaacuuauacaggaaaaaug

SEQ ID NO: 357589 - RNA, 64 nt, hsa
gcuuaauucuagauacuuuugagacaacaccuucagaaaacacauaauuuaaucuuugccaucc

SEQ ID NO: 357590 - RNA, 64 nt, hsa
gacuuaccauuccagcugcaugggaaagcaaagcagaaaacagugccccaaauggaaaaaagau

SEQ ID NO: 357591 - RNA, 64 nt, hsa
uaacuuuccuucccuccauugaguacgugcuuugagaaaacauuucuuaaaacagugugugcca

SEQ ID NO: 357592 - RNA, 64 nt, hsa
cagaagccagaggauggacuaagugggagaaauuagaaaacaaaacgaacucugguugggguac

SEQ ID NO: 357593 - RNA, 64 nt, hsa
uaugcuguuaauuguguaagaaagaaaggaaauuagaaaacauauuugcauaaauaaaagcuag

SEQ ID NO: 357594 - RNA, 64 nt, hsa
ugaaaaaaaacaaaaguaaaguuauaaaaggaaaagaaaacagaggcuuuaaauuaaaucaucu

SEQ ID NO: 357595 - RNA, 64 nt, hsa
aagaagugaucuuuagcuaauaaagaaagagaauagaaaacacgcaugagauauucagaaaaua

SEQ ID NO: 357596 - RNA, 64 nt, hsa
aaacugauuuuagcucauguauauuuuauaugaaagaaaacacccuuaugaauugaugacuaua

SEQ ID NO: 357597 - RNA, 64 nt, hsa
ucggugucauucugagugaacacucagguuggcaagaaaacauacuugaauuuucauucaucuu

SEQ ID NO: 357598 - RNA, 64 nt, hsa
cuuugggggaggguggauauccaaaccaaaaagaagaaaacagaugcccccagaaggggccagu

SEQ ID NO: 357599 - RNA, 64 nt, hsa
caggugcagugucaguuucaaaucaaauuaucuaagaaaacaagaaaacaaaggcagcagacua

SEQ ID NO: 357600 - RNA, 64 nt, hsa
gugucaguuucaaaucaaauuaucuaagaaaacaagaaaacaaaggcagcagacuauugguaca

SEQ ID NO: 357601 - RNA, 64 nt, hsa
ucuucuauuuugaagacuauuuauuguaauaauuagaaaacaugaaauagggaacuccagacug

SEQ ID NO: 357602 - RNA, 64 nt, hsa
uaauucuccuuuuaauguauuuaauuuucuacauagaaaacaugcaguaccuucuuauuacaag

SEQ ID NO: 357603 - RNA, 64 nt, hsa
uuacucaucacauccccgaugcuaaauuaaaaacagaaaacaaagaaaagcuuguauauacuuu

SEQ ID NO: 357604 - RNA, 64 nt, hsa
acuuguaaugguguuagggaacaguuguaggggcagaaaacaacucugaaagugguagaagguc

SEQ ID NO: 357605 - RNA, 64 nt, hsa
ccuauggacuguuuacuauccaaaaguucaagagagaaaacagcacuugaggucucaucaauua

SEQ ID NO: 357606 - RNA, 64 nt, hsa
gaauagauagaugguguuugcauguaaauugcagagaaaacaaaaccaaagcugauuggaaaca

SEQ ID NO: 357607 - RNA, 64 nt, hsa
ccccgggacuccagaauuucucuccucaaaggaaagaaaacagggcaugcgcuuguuggcaaaa

SEQ ID NO: 357608 - RNA, 64 nt, hsa
uuaucacuugguuuucuggaaaguagcuuacccuagaaaacagcugcaaaugccagaaagauga

SEQ ID NO: 357609 - RNA, 64 nt, hsa
gguuuucagugaacaagcgcugagcaccagcagcagaaaacaacaacaaaaaaacaccucguuu

SEQ ID NO: 357610 - RNA, 64 nt, hsa
ucuccccugccccacugcuggaacagaggcuccaagaaaacagggaccuuauuauucauuacug

SEQ ID NO: 357611 - RNA, 64 nt, hsa
agacaguaguagccauaaaaaguacuuauacuuuagaaaacaguccuuauucagaaacuuuucg

SEQ ID NO: 357612 - RNA, 64 nt, hsa
cacuggacuuuacagaaagauaacgccaugcaauagaaaacaguggguacuugcuuuuggcagg

SEQ ID NO: 357613 - RNA, 64 nt, hsa
aucuauccuugaugauguguuuaaacugaguagcagaaaacagaggccacacuuucugggaaau

SEQ ID NO: 357614 - RNA, 64 nt, hsa
aaaacuuaucugagucacuugaaacuugguucccagaaaacacauuucugguuuauaaucuccu

SEQ ID NO: 357615 - RNA, 64 nt, hsa
gauuucuuaaugcuauuugccaagaccauuucacagaaaacauugacuguggcucuugccuuau

SEQ ID NO: 357616 - RNA, 64 nt, hsa
uggcaggauucuaaagagagccugguuuguuaaaagaaaacacugucaugcugucaguucccaa

SEQ ID NO: 357617 - RNA, 64 nt, hsa
caggauguacaaagaacucucaaaccggauaguaagaaaacaaacagcccaagugaaaagcagg

SEQ ID NO: 357618 - RNA, 64 nt, hsa
auuaacuuggaugaguuuugggaaguuaaagggaagaaaacacuguuaucauuuuuuccuguuu

SEQ ID NO: 357619 - RNA, 64 nt, hsa
auguaagguauaucauucuaaagauagaguaaaaagaaaacaaaaccaaaaguuauuaaaauug

SEQ ID NO: 357620 - RNA, 64 nt, hsa; identical to SEQ ID NO: 276116

SEQ ID NO: 357621 - RNA, 64 nt, hsa; identical to SEQ ID NO: 276117

SEQ ID NO: 357622 - RNA, 64 nt, hsa; identical to SEQ ID NO: 276118

SEQ ID NO: 357623 - RNA, 64 nt, hsa; identical to SEQ ID NO: 276119

SEQ ID NO: 357624 - RNA, 64 nt, hsa; identical to SEQ ID NO: 276120

SEQ ID NO: 357625 - RNA, 64 nt, hsa; identical to SEQ ID NO: 276121

SEQ ID NO: 357626 - RNA, 64 nt, hsa; identical to SEQ ID NO: 276122

SEQ ID NO: 357627 - RNA, 64 nt, hsa; identical to SEQ ID NO: 276123

SEQ ID NO: 357628 - RNA, 64 nt, hsa; identical to SEQ ID NO: 276124

SEQ ID NO: 357629 - RNA, 64 nt, hsa; identical to SEQ ID NO: 276125

SEQ ID NO: 357630 - RNA, 64 nt, hsa; identical to SEQ ID NO: 276126

SEQ ID NO: 357631 - RNA, 64 nt, hsa; identical to SEQ ID NO: 276127

SEQ ID NO: 357632 - RNA, 64 nt, hsa; identical to SEQ ID NO: 276128

SEQ ID NO: 357633 - RNA, 64 nt, hsa; identical to SEQ ID NO: 276129

SEQ ID NO: 357634 - RNA, 64 nt, hsa; identical to SEQ ID NO: 276130

SEQ ID NO: 357635 - RNA, 64 nt, hsa; identical to SEQ ID NO: 276131

SEQ ID NO: 357636 - RNA, 64 nt, hsa; identical to SEQ ID NO: 276132

SEQ ID NO: 357637 - RNA, 64 nt, hsa; identical to SEQ ID NO: 276133

SEQ ID NO: 357638 - RNA, 64 nt, hsa; identical to SEQ ID NO: 276134

SEQ ID NO: 357639 - RNA, 64 nt, hsa; identical to SEQ ID NO: 276135

SEQ ID NO: 357640 - RNA, 64 nt, hsa; identical to SEQ ID NO: 276136

SEQ ID NO: 357641 - RNA, 64 nt, hsa; identical to SEQ ID NO: 276137

SEQ ID NO: 357642 - RNA, 64 nt, hsa; identical to SEQ ID NO: 276138

SEQ ID NO: 357643 - RNA, 64 nt, hsa; identical to SEQ ID NO: 276139

SEQ ID NO: 357644 - RNA, 64 nt, hsa; identical to SEQ ID NO: 276140

SEQ ID NO: 357645 - RNA, 64 nt, hsa; identical to SEQ ID NO: 276141

SEQ ID NO: 357646 - RNA, 64 nt, hsa; identical to SEQ ID NO: 276142

SEQ ID NO: 357647 - RNA, 64 nt, hsa; identical to SEQ ID NO: 276143

SEQ ID NO: 357648 - RNA, 64 nt, hsa; identical to SEQ ID NO: 276144

SEQ ID NO: 357649 - RNA, 64 nt, hsa; identical to SEQ ID NO: 276145

SEQ ID NO: 357650 - RNA, 64 nt, hsa; identical to SEQ ID NO: 276146

SEQ ID NO: 357651 - RNA, 64 nt, hsa; identical to SEQ ID NO: 276147

SEQ ID NO: 357652 - RNA, 64 nt, hsa; identical to SEQ ID NO: 276148

SEQ ID NO: 357653 - RNA, 64 nt, hsa
cuuagccauugaaaugucaaauugaugugcccuagaucaacagaucaacaauaccuuuuuuuuc

SEQ ID NO: 357654 - RNA, 64 nt, hsa
uugaaaugucaaauugaugugcccuagaucaacagaucaacaauaccuuuuuuuucaguguuaa

SEQ ID NO: 357655 - RNA, 64 nt, hsa; identical to SEQ ID NO: 59819

SEQ ID NO: 357656 - RNA, 64 nt, hsa; identical to SEQ ID NO: 59820

SEQ ID NO: 357657 - RNA, 64 nt, hsa; identical to SEQ ID NO: 59821

SEQ ID NO: 357658 - RNA, 64 nt, hsa; identical to SEQ ID NO: 59822

SEQ ID NO: 357659 - RNA, 64 nt, hsa; identical to SEQ ID NO: 59823

SEQ ID NO: 357660 - RNA, 64 nt, hsa; identical to SEQ ID NO: 59824

SEQ ID NO: 357661 - RNA, 64 nt, hsa; identical to SEQ ID NO: 59825

SEQ ID NO: 357662 - RNA, 64 nt, hsa; identical to SEQ ID NO: 59826

SEQ ID NO: 357663 - RNA, 64 nt, hsa; identical to SEQ ID NO: 59827

SEQ ID NO: 357664 - RNA, 64 nt, hsa; identical to SEQ ID NO: 59828

SEQ ID NO: 357665 - RNA, 64 nt, hsa; identical to SEQ ID NO: 59829

SEQ ID NO: 357666 - RNA, 64 nt, hsa; identical to SEQ ID NO: 59830

SEQ ID NO: 357667 - RNA, 64 nt, hsa; identical to SEQ ID NO: 59831

SEQ ID NO: 357668 - RNA, 64 nt, hsa; identical to SEQ ID NO: 59832

SEQ ID NO: 357669 - RNA, 64 nt, hsa; identical to SEQ ID NO: 59833

SEQ ID NO: 357670 - RNA, 64 nt, hsa; identical to SEQ ID NO: 59834

SEQ ID NO: 357671 - RNA, 64 nt, hsa; identical to SEQ ID NO: 59835

SEQ ID NO: 357672 - RNA, 64 nt, hsa; identical to SEQ ID NO: 59836

SEQ ID NO: 357673 - RNA, 64 nt, hsa; identical to SEQ ID NO: 59837

SEQ ID NO: 357674 - RNA, 64 nt, hsa; identical to SEQ ID NO: 59838

SEQ ID NO: 357675 - RNA, 64 nt, hsa; identical to SEQ ID NO: 59839

SEQ ID NO: 357676 - RNA, 64 nt, hsa; identical to SEQ ID NO: 59840

SEQ ID NO: 357677 - RNA, 64 nt, hsa; identical to SEQ ID NO: 59841

SEQ ID NO: 357678 - RNA, 64 nt, hsa; identical to SEQ ID NO: 59842

SEQ ID NO: 357679 - RNA, 64 nt, hsa; identical to SEQ ID NO: 59843

SEQ ID NO: 357680 - RNA, 64 nt, hsa; identical to SEQ ID NO: 59844

SEQ ID NO: 357681 - RNA, 64 nt, hsa; identical to SEQ ID NO: 59845

SEQ ID NO: 357682 - RNA, 64 nt, hsa; identical to SEQ ID NO: 59846

SEQ ID NO: 357683 - RNA, 64 nt, hsa; identical to SEQ ID NO: 59847

SEQ ID NO: 357684 - RNA, 64 nt, hsa; identical to SEQ ID NO: 59848

SEQ ID NO: 357685 - RNA, 64 nt, hsa; identical to SEQ ID NO: 59849

SEQ ID NO: 357686 - RNA, 64 nt, hsa; identical to SEQ ID NO: 59850

SEQ ID NO: 357687 - RNA, 64 nt, hsa; identical to SEQ ID NO: 59851

SEQ ID NO: 357688 - RNA, 64 nt, hsa; identical to SEQ ID NO: 59852

SEQ ID NO: 357689 - RNA, 64 nt, hsa; identical to SEQ ID NO: 59853

SEQ ID NO: 357690 - RNA, 64 nt, hsa; identical to SEQ ID NO: 59854

SEQ ID NO: 357691 - RNA, 64 nt, hsa; identical to SEQ ID NO: 59855

SEQ ID NO: 357692 - RNA, 64 nt, hsa; identical to SEQ ID NO: 59856

SEQ ID NO: 357693 - RNA, 64 nt, hsa; identical to SEQ ID NO: 59857

SEQ ID NO: 357694 - RNA, 64 nt, hsa; identical to SEQ ID NO: 59858

SEQ ID NO: 357695 - RNA, 64 nt, hsa; identical to SEQ ID NO: 59859

SEQ ID NO: 357696 - RNA, 64 nt, hsa; identical to SEQ ID NO: 59860

SEQ ID NO: 357697 - RNA, 64 nt, hsa; identical to SEQ ID NO: 59861

SEQ ID NO: 357698 - RNA, 64 nt, hsa; identical to SEQ ID NO: 59862

SEQ ID NO: 357699 - RNA, 64 nt, hsa; identical to SEQ ID NO: 59863

SEQ ID NO: 357700 - RNA, 64 nt, hsa; identical to SEQ ID NO: 59864

SEQ ID NO: 357701 - RNA, 64 nt, hsa; identical to SEQ ID NO: 59865

SEQ ID NO: 357702 - RNA, 64 nt, hsa; identical to SEQ ID NO: 59866

SEQ ID NO: 357703 - RNA, 64 nt, hsa; identical to SEQ ID NO: 59867

SEQ ID NO: 357704 - RNA, 64 nt, hsa; identical to SEQ ID NO: 59868

SEQ ID NO: 357705 - RNA, 64 nt, hsa; identical to SEQ ID NO: 59869

SEQ ID NO: 357706 - RNA, 64 nt, hsa; identical to SEQ ID NO: 59870

SEQ ID NO: 357707 - RNA, 64 nt, hsa; identical to SEQ ID NO: 59871

SEQ ID NO: 357708 - RNA, 64 nt, hsa; identical to SEQ ID NO: 59872

SEQ ID NO: 357709 - RNA, 64 nt, hsa; identical to SEQ ID NO: 59873

SEQ ID NO: 357710 - RNA, 64 nt, hsa; identical to SEQ ID NO: 59874

SEQ ID NO: 357711 - RNA, 64 nt, hsa; identical to SEQ ID NO: 59875

SEQ ID NO: 357712 - RNA, 64 nt, hsa; identical to SEQ ID NO: 150215

SEQ ID NO: 357713 - RNA, 64 nt, hsa; identical to SEQ ID NO: 150216

SEQ ID NO: 357714 - RNA, 64 nt, hsa; identical to SEQ ID NO: 150217

SEQ ID NO: 357715 - RNA, 64 nt, hsa; identical to SEQ ID NO: 150218

SEQ ID NO: 357716 - RNA, 64 nt, hsa; identical to SEQ ID NO: 150219

SEQ ID NO: 357717 - RNA, 64 nt, hsa; identical to SEQ ID NO: 150220

SEQ ID NO: 357718 - RNA, 64 nt, hsa; identical to SEQ ID NO: 150221

SEQ ID NO: 357719 - RNA, 64 nt, hsa; identical to SEQ ID NO: 150222

SEQ ID NO: 357720 - RNA, 64 nt, hsa; identical to SEQ ID NO: 150223

SEQ ID NO: 357721 - RNA, 64 nt, hsa; identical to SEQ ID NO: 150224

SEQ ID NO: 357722 - RNA, 64 nt, hsa; identical to SEQ ID NO: 150225

SEQ ID NO: 357723 - RNA, 64 nt, hsa; identical to SEQ ID NO: 150226

SEQ ID NO: 357724 - RNA, 64 nt, hsa; identical to SEQ ID NO: 150227

SEQ ID NO: 357725 - RNA, 64 nt, hsa; identical to SEQ ID NO: 150228

SEQ ID NO: 357726 - RNA, 64 nt, hsa; identical to SEQ ID NO: 150229

SEQ ID NO: 357727 - RNA, 64 nt, hsa; identical to SEQ ID NO: 150230

SEQ ID NO: 357728 - RNA, 64 nt, hsa; identical to SEQ ID NO: 150231

SEQ ID NO: 357729 - RNA, 64 nt, hsa; identical to SEQ ID NO: 150232

SEQ ID NO: 357730 - RNA, 64 nt, hsa; identical to SEQ ID NO: 150233

SEQ ID NO: 357731 - RNA, 64 nt, hsa; identical to SEQ ID NO: 150234

SEQ ID NO: 357732 - RNA, 64 nt, hsa; identical to SEQ ID NO: 150235

SEQ ID NO: 357733 - RNA, 64 nt, hsa; identical to SEQ ID NO: 150236

SEQ ID NO: 357734 - RNA, 64 nt, hsa; identical to SEQ ID NO: 150237

SEQ ID NO: 357735 - RNA, 64 nt, hsa; identical to SEQ ID NO: 150238

SEQ ID NO: 357736 - RNA, 64 nt, hsa; identical to SEQ ID NO: 150239

SEQ ID NO: 357737 - RNA, 64 nt, hsa; identical to SEQ ID NO: 150240

SEQ ID NO: 357738 - RNA, 64 nt, hsa; identical to SEQ ID NO: 150241

SEQ ID NO: 357739 - RNA, 64 nt, hsa; identical to SEQ ID NO: 150242

SEQ ID NO: 357740 - RNA, 64 nt, hsa; identical to SEQ ID NO: 150243

SEQ ID NO: 357741 - RNA, 64 nt, hsa; identical to SEQ ID NO: 150244

SEQ ID NO: 357742 - RNA, 64 nt, hsa; identical to SEQ ID NO: 150245

SEQ ID NO: 357743 - RNA, 64 nt, hsa; identical to SEQ ID NO: 150246

SEQ ID NO: 357744 - RNA, 64 nt, hsa; identical to SEQ ID NO: 150247

SEQ ID NO: 357745 - RNA, 64 nt, hsa; identical to SEQ ID NO: 150248

SEQ ID NO: 357746 - RNA, 60 nt, hsa
gcucaugcugacugugaugagaaauugcagcaccucuaucucgcagguaauggaguaguu

SEQ ID NO: 357747 - RNA, 60 nt, hsa
cuuuggaaugacugcuccacuccacacucacaccucuauucacagaccagcaucuccucu

SEQ ID NO: 357748 - RNA, 60 nt, hsa
cgucagccuucaggacugaucugccauuuucaccucuaaauccccaugucugaccauuag

SEQ ID NO: 357749 - RNA, 60 nt, hsa
gcugccugaaacagccauguccaaguucuucaccucuauccaaagaacuugauuugcaug

SEQ ID NO: 357750 - RNA, 60 nt, hsa
cuugacaugugcaauugugagggacaugcucaccucuagccuuaaggggggcagggagug

SEQ ID NO: 357751 - RNA, 64 nt, hsa; identical to SEQ ID NO: 216718

SEQ ID NO: 357752 - RNA, 64 nt, hsa; identical to SEQ ID NO: 216719

SEQ ID NO: 357753 - RNA, 64 nt, hsa; identical to SEQ ID NO: 216720

SEQ ID NO: 357754 - RNA, 64 nt, hsa; identical to SEQ ID NO: 216721

SEQ ID NO: 357755 - RNA, 64 nt, hsa; identical to SEQ ID NO: 216722

SEQ ID NO: 357756 - RNA, 64 nt, hsa; identical to SEQ ID NO: 216723

SEQ ID NO: 357757 - RNA, 64 nt, hsa; identical to SEQ ID NO: 216724

SEQ ID NO: 357758 - RNA, 64 nt, hsa; identical to SEQ ID NO: 216725

SEQ ID NO: 357759 - RNA, 64 nt, hsa; identical to SEQ ID NO: 216726

SEQ ID NO: 357760 - RNA, 64 nt, hsa; identical to SEQ ID NO: 216727

SEQ ID NO: 357761 - RNA, 64 nt, hsa; identical to SEQ ID NO: 216728

SEQ ID NO: 357762 - RNA, 64 nt, hsa; identical to SEQ ID NO: 216729

SEQ ID NO: 357763 - RNA, 64 nt, hsa; identical to SEQ ID NO: 216730

SEQ ID NO: 357764 - RNA, 64 nt, hsa; identical to SEQ ID NO: 216731

SEQ ID NO: 357765 - RNA, 64 nt, hsa; identical to SEQ ID NO: 216732

SEQ ID NO: 357766 - RNA, 64 nt, hsa; identical to SEQ ID NO: 216733

SEQ ID NO: 357767 - RNA, 64 nt, hsa; identical to SEQ ID NO: 216734

SEQ ID NO: 357768 - RNA, 64 nt, hsa; identical to SEQ ID NO: 216735

SEQ ID NO: 357769 - RNA, 64 nt, hsa; identical to SEQ ID NO: 216736

SEQ ID NO: 357770 - RNA, 64 nt, hsa; identical to SEQ ID NO: 216737

SEQ ID NO: 357771 - RNA, 64 nt, hsa; identical to SEQ ID NO: 216738

SEQ ID NO: 357772 - RNA, 64 nt, hsa; identical to SEQ ID NO: 216739

SEQ ID NO: 357773 - RNA, 64 nt, hsa; identical to SEQ ID NO: 216740

SEQ ID NO: 357774 - RNA, 64 nt, hsa; identical to SEQ ID NO: 216741

SEQ ID NO: 357775 - RNA, 64 nt, hsa; identical to SEQ ID NO: 216742

SEQ ID NO: 357776 - RNA, 64 nt, hsa; identical to SEQ ID NO: 216743

SEQ ID NO: 357777 - RNA, 64 nt, hsa; identical to SEQ ID NO: 216744

SEQ ID NO: 357778 - RNA, 64 nt, hsa; identical to SEQ ID NO: 216745

SEQ ID NO: 357779 - RNA, 64 nt, hsa; identical to SEQ ID NO: 216746

SEQ ID NO: 357780 - RNA, 64 nt, hsa; identical to SEQ ID NO: 216747

SEQ ID NO: 357781 - RNA, 64 nt, hsa; identical to SEQ ID NO: 216748

SEQ ID NO: 357782 - RNA, 64 nt, hsa; identical to SEQ ID NO: 216749

SEQ ID NO: 357783 - RNA, 64 nt, hsa; identical to SEQ ID NO: 216750

SEQ ID NO: 357784 - RNA, 64 nt, hsa; identical to SEQ ID NO: 216751

SEQ ID NO: 357785 - RNA, 64 nt, hsa; identical to SEQ ID NO: 216752

SEQ ID NO: 357786 - RNA, 64 nt, hsa; identical to SEQ ID NO: 216753

SEQ ID NO: 357787 - RNA, 64 nt, hsa; identical to SEQ ID NO: 216754

SEQ ID NO: 357788 - RNA, 64 nt, hsa; identical to SEQ ID NO: 216755

SEQ ID NO: 357789 - RNA, 64 nt, hsa; identical to SEQ ID NO: 216756

SEQ ID NO: 357790 - RNA, 64 nt, hsa; identical to SEQ ID NO: 216757

SEQ ID NO: 357791 - RNA, 64 nt, hsa; identical to SEQ ID NO: 216758

SEQ ID NO: 357792 - RNA, 64 nt, hsa; identical to SEQ ID NO: 216759

SEQ ID NO: 357793 - RNA, 64 nt, hsa; identical to SEQ ID NO: 216760

SEQ ID NO: 357794 - RNA, 64 nt, hsa; identical to SEQ ID NO: 216761

SEQ ID NO: 357795 - RNA, 64 nt, hsa; identical to SEQ ID NO: 216762

SEQ ID NO: 357796 - RNA, 64 nt, hsa; identical to SEQ ID NO: 216763

SEQ ID NO: 357797 - RNA, 64 nt, hsa; identical to SEQ ID NO: 216764

SEQ ID NO: 357798 - RNA, 64 nt, hsa; identical to SEQ ID NO: 216765

SEQ ID NO: 357799 - RNA, 64 nt, hsa; identical to SEQ ID NO: 216766

SEQ ID NO: 357800 - RNA, 64 nt, hsa; identical to SEQ ID NO: 216767

SEQ ID NO: 357801 - RNA, 64 nt, hsa; identical to SEQ ID NO: 216768

SEQ ID NO: 357802 - RNA, 64 nt, hsa; identical to SEQ ID NO: 216769

SEQ ID NO: 357803 - RNA, 64 nt, hsa; identical to SEQ ID NO: 216770

SEQ ID NO: 357804 - RNA, 64 nt, hsa; identical to SEQ ID NO: 216771

SEQ ID NO: 357805 - RNA, 64 nt, hsa; identical to SEQ ID NO: 216772

SEQ ID NO: 357806 - RNA, 64 nt, hsa; identical to SEQ ID NO: 216773

SEQ ID NO: 357807 - RNA, 55 nt, hsa; identical to SEQ ID NO: 216774

SEQ ID NO: 357808 - RNA, 64 nt, hsa; identical to SEQ ID NO: 216775

SEQ ID NO: 357809 - RNA, 64 nt, hsa; identical to SEQ ID NO: 216776

SEQ ID NO: 357810 - RNA, 64 nt, hsa; identical to SEQ ID NO: 216777

SEQ ID NO: 357811 - RNA, 64 nt, hsa; identical to SEQ ID NO: 216778

SEQ ID NO: 357812 - RNA, 64 nt, hsa; identical to SEQ ID NO: 216779

SEQ ID NO: 357813 - RNA, 64 nt, hsa; identical to SEQ ID NO: 216780

SEQ ID NO: 357814 - RNA, 64 nt, hsa; identical to SEQ ID NO: 216781

SEQ ID NO: 357815 - RNA, 64 nt, hsa; identical to SEQ ID NO: 216782

SEQ ID NO: 357816 - RNA, 64 nt, hsa; identical to SEQ ID NO: 216783

SEQ ID NO: 357817 - RNA, 64 nt, hsa; identical to SEQ ID NO: 216784

SEQ ID NO: 357818 - RNA, 64 nt, hsa; identical to SEQ ID NO: 216785

SEQ ID NO: 357819 - RNA, 64 nt, hsa; identical to SEQ ID NO: 216786

SEQ ID NO: 357820 - RNA, 64 nt, hsa; identical to SEQ ID NO: 216787

SEQ ID NO: 357821 - RNA, 64 nt, hsa; identical to SEQ ID NO: 216788

SEQ ID NO: 357822 - RNA, 64 nt, hsa; identical to SEQ ID NO: 216789

SEQ ID NO: 357823 - RNA, 64 nt, hsa; identical to SEQ ID NO: 216790

SEQ ID NO: 357824 - RNA, 64 nt, hsa; identical to SEQ ID NO: 216791

SEQ ID NO: 357825 - RNA, 64 nt, hsa; identical to SEQ ID NO: 216792

SEQ ID NO: 357826 - RNA, 64 nt, hsa; identical to SEQ ID NO: 216793

SEQ ID NO: 357827 - RNA, 64 nt, hsa; identical to SEQ ID NO: 216794

SEQ ID NO: 357828 - RNA, 64 nt, hsa; identical to SEQ ID NO: 216795

SEQ ID NO: 357829 - RNA, 64 nt, hsa; identical to SEQ ID NO: 216796

SEQ ID NO: 357830 - RNA, 58 nt, hsa; identical to SEQ ID NO: 216797

SEQ ID NO: 357831 - RNA, 64 nt, hsa; identical to SEQ ID NO: 216798

SEQ ID NO: 357832 - RNA, 64 nt, hsa; identical to SEQ ID NO: 216799

SEQ ID NO: 357833 - RNA, 64 nt, hsa; identical to SEQ ID NO: 216800

SEQ ID NO: 357834 - RNA, 64 nt, hsa; identical to SEQ ID NO: 216801

SEQ ID NO: 357835 - RNA, 64 nt, hsa; identical to SEQ ID NO: 216802

SEQ ID NO: 357836 - RNA, 64 nt, hsa; identical to SEQ ID NO: 216803

SEQ ID NO: 357837 - RNA, 64 nt, hsa; identical to SEQ ID NO: 216804

SEQ ID NO: 357838 - RNA, 64 nt, hsa; identical to SEQ ID NO: 216805

SEQ ID NO: 357839 - RNA, 64 nt, hsa; identical to SEQ ID NO: 216806

SEQ ID NO: 357840 - RNA, 64 nt, hsa; identical to SEQ ID NO: 216807

SEQ ID NO: 357841 - RNA, 64 nt, hsa; identical to SEQ ID NO: 216808

SEQ ID NO: 357842 - RNA, 64 nt, hsa; identical to SEQ ID NO: 216809

SEQ ID NO: 357843 - RNA, 64 nt, hsa; identical to SEQ ID NO: 216810

SEQ ID NO: 357844 - RNA, 64 nt, hsa; identical to SEQ ID NO: 216811

SEQ ID NO: 357845 - RNA, 64 nt, hsa; identical to SEQ ID NO: 216812

SEQ ID NO: 357846 - RNA, 64 nt, hsa; identical to SEQ ID NO: 216813

SEQ ID NO: 357847 - RNA, 64 nt, hsa; identical to SEQ ID NO: 216814

SEQ ID NO: 357848 - RNA, 64 nt, hsa; identical to SEQ ID NO: 216815

SEQ ID NO: 357849 - RNA, 64 nt, hsa; identical to SEQ ID NO: 216816

SEQ ID NO: 357850 - RNA, 64 nt, hsa; identical to SEQ ID NO: 216817

SEQ ID NO: 357851 - RNA, 64 nt, hsa; identical to SEQ ID NO: 216818

SEQ ID NO: 357852 - RNA, 64 nt, hsa; identical to SEQ ID NO: 216819

SEQ ID NO: 357853 - RNA, 64 nt, hsa; identical to SEQ ID NO: 216820

SEQ ID NO: 357854 - RNA, 64 nt, hsa; identical to SEQ ID NO: 216821

SEQ ID NO: 357855 - RNA, 64 nt, hsa; identical to SEQ ID NO: 216822

SEQ ID NO: 357856 - RNA, 64 nt, hsa; identical to SEQ ID NO: 216820

SEQ ID NO: 357857 - RNA, 64 nt, hsa; identical to SEQ ID NO: 216819

SEQ ID NO: 357858 - RNA, 64 nt, hsa; identical to SEQ ID NO: 216825

SEQ ID NO: 357859 - RNA, 64 nt, hsa; identical to SEQ ID NO: 216826

SEQ ID NO: 357860 - RNA, 64 nt, hsa; identical to SEQ ID NO: 216827

SEQ ID NO: 357861 - RNA, 64 nt, hsa; identical to SEQ ID NO: 216828

SEQ ID NO: 357862 - RNA, 64 nt, hsa; identical to SEQ ID NO: 216829

SEQ ID NO: 357863 - RNA, 64 nt, hsa; identical to SEQ ID NO: 216830

SEQ ID NO: 357864 - RNA, 64 nt, hsa; identical to SEQ ID NO: 216831

SEQ ID NO: 357865 - RNA, 64 nt, hsa; identical to SEQ ID NO: 216832

SEQ ID NO: 357866 - RNA, 64 nt, hsa; identical to SEQ ID NO: 216833

SEQ ID NO: 357867 - RNA, 64 nt, hsa; identical to SEQ ID NO: 216834

SEQ ID NO: 357868 - RNA, 64 nt, hsa; identical to SEQ ID NO: 216835

SEQ ID NO: 357869 - RNA, 64 nt, hsa; identical to SEQ ID NO: 216836

SEQ ID NO: 357870 - RNA, 64 nt, hsa; identical to SEQ ID NO: 216837

SEQ ID NO: 357871 - RNA, 64 nt, hsa; identical to SEQ ID NO: 216838

SEQ ID NO: 357872 - RNA, 64 nt, hsa; identical to SEQ ID NO: 216839

SEQ ID NO: 357873 - RNA, 64 nt, hsa; identical to SEQ ID NO: 216840

SEQ ID NO: 357874 - RNA, 64 nt, hsa; identical to SEQ ID NO: 216841

SEQ ID NO: 357875 - RNA, 64 nt, hsa; identical to SEQ ID NO: 216842

SEQ ID NO: 357876 - RNA, 64 nt, hsa; identical to SEQ ID NO: 216843

SEQ ID NO: 357877 - RNA, 64 nt, hsa; identical to SEQ ID NO: 216844

SEQ ID NO: 357878 - RNA, 64 nt, hsa; identical to SEQ ID NO: 216845

SEQ ID NO: 357879 - RNA, 64 nt, hsa; identical to SEQ ID NO: 216846

SEQ ID NO: 357880 - RNA, 64 nt, hsa; identical to SEQ ID NO: 216847

SEQ ID NO: 357881 - RNA, 64 nt, hsa; identical to SEQ ID NO: 216848

SEQ ID NO: 357882 - RNA, 64 nt, hsa; identical to SEQ ID NO: 216849

SEQ ID NO: 357883 - RNA, 64 nt, hsa; identical to SEQ ID NO: 216850

SEQ ID NO: 357884 - RNA, 64 nt, hsa; identical to SEQ ID NO: 216851

SEQ ID NO: 357885 - RNA, 64 nt, hsa; identical to SEQ ID NO: 216852

SEQ ID NO: 357886 - RNA, 64 nt, hsa; identical to SEQ ID NO: 216853

SEQ ID NO: 357887 - RNA, 64 nt, hsa; identical to SEQ ID NO: 216854

SEQ ID NO: 357888 - RNA, 64 nt, hsa; identical to SEQ ID NO: 216855

SEQ ID NO: 357889 - RNA, 64 nt, hsa; identical to SEQ ID NO: 216856

SEQ ID NO: 357890 - RNA, 64 nt, hsa; identical to SEQ ID NO: 216857

SEQ ID NO: 357891 - RNA, 64 nt, hsa; identical to SEQ ID NO: 216858

SEQ ID NO: 357892 - RNA, 64 nt, hsa; identical to SEQ ID NO: 216859

SEQ ID NO: 357893 - RNA, 64 nt, hsa; identical to SEQ ID NO: 216860

SEQ ID NO: 357894 - RNA, 64 nt, hsa; identical to SEQ ID NO: 216861

SEQ ID NO: 357895 - RNA, 64 nt, hsa; identical to SEQ ID NO: 216862

SEQ ID NO: 357896 - RNA, 64 nt, hsa; identical to SEQ ID NO: 216863

SEQ ID NO: 357897 - RNA, 64 nt, hsa; identical to SEQ ID NO: 216864

SEQ ID NO: 357898 - RNA, 64 nt, hsa; identical to SEQ ID NO: 216865

SEQ ID NO: 357899 - RNA, 64 nt, hsa; identical to SEQ ID NO: 216866

SEQ ID NO: 357900 - RNA, 64 nt, hsa; identical to SEQ ID NO: 216867

SEQ ID NO: 357901 - RNA, 64 nt, hsa; identical to SEQ ID NO: 216868

SEQ ID NO: 357902 - RNA, 64 nt, hsa; identical to SEQ ID NO: 216869

SEQ ID NO: 357903 - RNA, 64 nt, hsa; identical to SEQ ID NO: 216870

SEQ ID NO: 357904 - RNA, 64 nt, hsa; identical to SEQ ID NO: 216871

SEQ ID NO: 357905 - RNA, 64 nt, hsa; identical to SEQ ID NO: 216872

SEQ ID NO: 357906 - RNA, 64 nt, hsa; identical to SEQ ID NO: 216873

SEQ ID NO: 357907 - RNA, 64 nt, hsa; identical to SEQ ID NO: 216874

SEQ ID NO: 357908 - RNA, 64 nt, hsa; identical to SEQ ID NO: 216875

SEQ ID NO: 357909 - RNA, 64 nt, hsa; identical to SEQ ID NO: 216876

SEQ ID NO: 357910 - RNA, 64 nt, hsa; identical to SEQ ID NO: 216877

SEQ ID NO: 357911 - RNA, 64 nt, hsa; identical to SEQ ID NO: 216878

SEQ ID NO: 357912 - RNA, 64 nt, hsa; identical to SEQ ID NO: 216879

SEQ ID NO: 357913 - RNA, 64 nt, hsa; identical to SEQ ID NO: 216880

SEQ ID NO: 357914 - RNA, 64 nt, hsa; identical to SEQ ID NO: 216881

SEQ ID NO: 357915 - RNA, 64 nt, hsa; identical to SEQ ID NO: 216882

SEQ ID NO: 357916 - RNA, 64 nt, hsa; identical to SEQ ID NO: 216883

SEQ ID NO: 357917 - RNA, 64 nt, hsa; identical to SEQ ID NO: 216884

SEQ ID NO: 357918 - RNA, 64 nt, hsa; identical to SEQ ID NO: 216885

SEQ ID NO: 357919 - RNA, 64 nt, hsa; identical to SEQ ID NO: 216886

SEQ ID NO: 357920 - RNA, 64 nt, hsa; identical to SEQ ID NO: 216887

SEQ ID NO: 357921 - RNA, 64 nt, hsa; identical to SEQ ID NO: 216888

SEQ ID NO: 357922 - RNA, 64 nt, hsa; identical to SEQ ID NO: 216889

SEQ ID NO: 357923 - RNA, 64 nt, hsa; identical to SEQ ID NO: 216890

SEQ ID NO: 357924 - RNA, 64 nt, hsa; identical to SEQ ID NO: 216891

SEQ ID NO: 357925 - RNA, 64 nt, hsa; identical to SEQ ID NO: 216892

SEQ ID NO: 357926 - RNA, 64 nt, hsa; identical to SEQ ID NO: 216893

SEQ ID NO: 357927 - RNA, 64 nt, hsa; identical to SEQ ID NO: 216894

SEQ ID NO: 357928 - RNA, 64 nt, hsa; identical to SEQ ID NO: 216895

SEQ ID NO: 357929 - RNA, 64 nt, hsa; identical to SEQ ID NO: 216896

SEQ ID NO: 357930 - RNA, 64 nt, hsa; identical to SEQ ID NO: 216897

SEQ ID NO: 357931 - RNA, 64 nt, hsa; identical to SEQ ID NO: 216898

SEQ ID NO: 357932 - RNA, 64 nt, hsa; identical to SEQ ID NO: 216899

SEQ ID NO: 357933 - RNA, 64 nt, hsa; identical to SEQ ID NO: 216900

SEQ ID NO: 357934 - RNA, 64 nt, hsa; identical to SEQ ID NO: 216901

SEQ ID NO: 357935 - RNA, 64 nt, hsa; identical to SEQ ID NO: 216902

SEQ ID NO: 357936 - RNA, 64 nt, hsa; identical to SEQ ID NO: 216903

SEQ ID NO: 357937 - RNA, 64 nt, hsa; identical to SEQ ID NO: 216904

SEQ ID NO: 357938 - RNA, 64 nt, hsa; identical to SEQ ID NO: 216905

SEQ ID NO: 357939 - RNA, 64 nt, hsa; identical to SEQ ID NO: 216906

SEQ ID NO: 357940 - RNA, 64 nt, hsa; identical to SEQ ID NO: 216907

SEQ ID NO: 357941 - RNA, 64 nt, hsa; identical to SEQ ID NO: 216908

SEQ ID NO: 357942 - RNA, 64 nt, hsa; identical to SEQ ID NO: 216909

SEQ ID NO: 357943 - RNA, 64 nt, hsa; identical to SEQ ID NO: 216910

SEQ ID NO: 357944 - RNA, 64 nt, hsa; identical to SEQ ID NO: 216911

SEQ ID NO: 357945 - RNA, 64 nt, hsa; identical to SEQ ID NO: 216912

SEQ ID NO: 357946 - RNA, 64 nt, hsa; identical to SEQ ID NO: 216913

SEQ ID NO: 357947 - RNA, 64 nt, hsa; identical to SEQ ID NO: 216914

SEQ ID NO: 357948 - RNA, 64 nt, hsa; identical to SEQ ID NO: 216915

SEQ ID NO: 357949 - RNA, 64 nt, hsa; identical to SEQ ID NO: 216916

SEQ ID NO: 357950 - RNA, 64 nt, hsa; identical to SEQ ID NO: 216917

SEQ ID NO: 357951 - RNA, 64 nt, hsa; identical to SEQ ID NO: 216918

SEQ ID NO: 357952 - RNA, 64 nt, hsa; identical to SEQ ID NO: 216919

SEQ ID NO: 357953 - RNA, 64 nt, hsa; identical to SEQ ID NO: 216920

SEQ ID NO: 357954 - RNA, 64 nt, hsa; identical to SEQ ID NO: 216921

SEQ ID NO: 357955 - RNA, 64 nt, hsa; identical to SEQ ID NO: 216913

SEQ ID NO: 357956 - RNA, 64 nt, hsa; identical to SEQ ID NO: 216923

SEQ ID NO: 357957 - RNA, 64 nt, hsa
aaaggcaaagggaaggguaaagucggaccagugucaaggaaaguuuguuuuauugagguggaaa

SEQ ID NO: 357958 - RNA, 64 nt, hsa
uaccaagggcaggggaagggggauauagaggucacaaggaaauaaaaaucaucuuucaucuuua

SEQ ID NO: 357959 - RNA, 64 nt, hsa
auaaauuuugccgucagcuucuucauaacguuuucaaggaaauucuaggcaaucauuccuguca

SEQ ID NO: 357960 - RNA, 64 nt, hsa
uuccgcuuccuuuguuugccaaauacuagaaacacaaggaaaugcaaguuacgcuaaauggcag

SEQ ID NO: 357961 - RNA, 64 nt, hsa
agcagaaguccugguaguuacaagcaaagggagacaaggaaacgggcacagcgaaauccuggug

SEQ ID NO: 357962 - RNA, 64 nt, hsa
aacuuucuagcagucaccauaaccgggaaaaagccaaggaaaagcccagguucuuaaaacacga

SEQ ID NO: 357963 - RNA, 64 nt, hsa
guugcuaguuuauaaugucuuacuaaugcagaaacaaggaaaaaagcaaaauuggccugaauau

SEQ ID NO: 357964 - RNA, 64 nt, hsa
auauuuauaauuaggcuuuauuaucuuccuaaaucaaggaaaggaaaucauccccagaccauuu

SEQ ID NO: 357965 - RNA, 64 nt, hsa
ggaaaauaccaaaugaacguacaguacaacauuucaaggaaaugaauauauuguuagaccaggu

SEQ ID NO: 357966 - RNA, 64 nt, hsa
uuugcuuagaauagaauggaacaaguuuaaauuucaaggaaauaugaaggcacuuccuuuuuuu

SEQ ID NO: 357967 - RNA, 64 nt, hsa
gacuccuuuauauucguacugcacuuuguuuuuccaaggaaaucagugucuuuuacguuguuau

SEQ ID NO: 357968 - RNA, 54 nt, hsa
gccugcccacuauggacugacaaccaaggaaagucuuccccaguccaaggagca

SEQ ID NO: 357969 - RNA, 64 nt, hsa
acgugguuuuagagucuaccuaauauguuaaggacaaggaaaccucugagucuaccuaauaugu

SEQ ID NO: 357970 - RNA, 64 nt, hsa
aggaaaccucugagucuaccuaauauguuaaggacaaggaaaccucuggacagugguauauugg

SEQ ID NO: 357971 - RNA, 64 nt, hsa
ccuuccucuucacuggcucgagguaaacccuuuucaaggaaaaacaacucuaggauuucuuuuu

SEQ ID NO: 357972 - RNA, 64 nt, hsa
ugcugugucucauggguuuccauagugauaaagacaaggaaacgcugcaggggccacaggcaca

SEQ ID NO: 357973 - RNA, 64 nt, hsa
acuguuuauaaaauucaguuuuuguaggguuuuccaaggaaaaaucaccuugguugaauguuuc

SEQ ID NO: 357974 - RNA, 64 nt, hsa
uuuuaaucacuuuuuaaaauauaaggaccgaaugcaaggaaaccaaaguuuauuaauaauuuuu

SEQ ID NO: 357975 - RNA, 64 nt, hsa
uuugaaaucaucggagucagccaggagcugucaccaaggaaacgcuaccucucugucccuugcu

SEQ ID NO: 357976 - RNA, 64 nt, hsa
uauuguuuucugacaguuuuucuguuuuguuuggcaaggaaaggggagaagggaauccuccucc

SEQ ID NO: 357977 - RNA, 64 nt, hsa
gguuuucacacuauuucagcagcaaaaacuuuuucaaggaaaaucuuacagaaccuuuaaacac

SEQ ID NO: 357978 - RNA, 64 nt, hsa
uuaauaggcgagcaaauaaaauucaaaucaauuucaaggaaaaacaucuggccagggguagcuu

SEQ ID NO: 357979 - RNA, 64 nt, hsa
auuuugggauauuaaaaguuaacagaacacugaacaaggaaagaauggcauagaucuaucuuua

SEQ ID NO: 357980 - RNA, 64 nt, hsa
ccugaagauucuuucuucugaaagccaagcaccacaaggaaaaaaaaaauuauuaauagcucag

SEQ ID NO: 357981 - RNA, 64 nt, hsa
uggacaccaaggaaacagauaucauagagcugaacaaggaaacugaggaaucacccaaaugagu

SEQ ID NO: 357982 - RNA, 64 nt, hsa
cugauaugcuguauuuaauggaaaaccuggacaccaaggaaacagauaucauagagcugaacaa

SEQ ID NO: 357983 - RNA, 64 nt, hsa
uaagauuucgagcagaauuuaucuaaauguguuucaaggaaacacaaucgcugaaccaaaacgu

SEQ ID NO: 357984 - RNA, 64 nt, hsa
aaugacuccauuuaaaaauaucacagggugggggcaaggaaauuagcugagauucaucucagga

SEQ ID NO: 357985 - RNA, 64 nt, hsa
ccgcugcauaacaacacagugcaucuuuuuaaaacaaggaaaagggaaaaaaaggagaaaaaac

SEQ ID NO: 357986 - RNA, 64 nt, hsa
auucaaaaacugagaguggagaucugggauaaagcaaggaaauaauaauuacuccuccuuaaag

SEQ ID NO: 357987 - RNA, 64 nt, hsa
ccagaguaccccgcauucccaugaauagagccuccaaggaaagggaggaugggguguccuuugu

SEQ ID NO: 357988 - RNA, 64 nt, hsa
guaucuuucagagaaaaaaaaaguuagauguagccaaggaaaguagugaucacgggaaggacug

SEQ ID NO: 357989 - RNA, 64 nt, hsa
uuaagagcuaacaagagaagagaguccaguuuucuggaaauaugucuuuaaguauuuuagacau

SEQ ID NO: 357990 - RNA, 64 nt, hsa
cagccaggaguaagaaaagaugguuagugauauuuggaaauaccuggauauuugcuagaggaaa

SEQ ID NO: 357991 - RNA, 64 nt, hsa
ucaggaccaucucaggcauccaggcauggcaaaguggaaauaauucauuuuggccugcaaaccu

SEQ ID NO: 357992 - RNA, 64 nt, hsa
agcaaagguuucuugggguuauuaaccaguaguguggaaauacuaguuuuauguggccaaggaa

SEQ ID NO: 357993 - RNA, 64 nt, hsa
aguugugguacggucuaaaagcagucuuguuuccuggaaauaaaaaguugggauauuaacuugu

SEQ ID NO: 357994 - RNA, 64 nt, hsa
auggaaaacuccauuguguguugcuggacuguuuuggaaauauuugguuaaauguguguuaauu

SEQ ID NO: 357995 - RNA, 64 nt, hsa
gucaaguuaagacacuaacuuggcccuuuccugauggaaauauuuccuccauagcagaaguugu

SEQ ID NO: 357996 - RNA, 64 nt, hsa
ccuucacaaccuucaugauuucauaggauuauuuuggaaauauagcacuugacuuuaugaaagg

SEQ ID NO: 357997 - RNA, 64 nt, hsa
uuauacuugagacauugcaccuaccccggaaggcuggaaauacagaaacagcauggaauugcaa

SEQ ID NO: 357998 - RNA, 64 nt, hsa
uauugcuugauuaaauuuggcauuuaaauagugguggaaauauuuuauauaauuuucauuuuuu

SEQ ID NO: 357999 - RNA, 64 nt, hsa
augcuagucauaacuguacuaguuacuaugaaaauggaaauaauuaucuuagaauauuuucaaa

SEQ ID NO: 358000 - RNA, 64 nt, hsa
ggaaguugacucucuuuuucacuguagaauaauguggaaauaacccuagauaaaaauucagucu

SEQ ID NO: 358001 - RNA, 64 nt, hsa
uuguguacauggcgcugcauuuggcuauuuucuuuggaaauaaauaaugugauguuucucuucc

SEQ ID NO: 358002 - RNA, 64 nt, hsa
gacggugcaucagcaugccgcguuaggcucgccauggaaauacgcgcggggagcggccgcuuca

SEQ ID NO: 358003 - RNA, 64 nt, hsa
aacagacuuuagcuuacagucaauuuuacaauuauggaaauauaguucugaugggucccaaaag

SEQ ID NO: 358004 - RNA, 64 nt, hsa
cacuaucuaucugccuuuaccuacauaggcaaauuggaaauacacagaugauuaaacagacuuu

SEQ ID NO: 358005 - RNA, 64 nt, hsa
agacaugaaauguacuagaggagcccuuuuccaauggaaauauuauauaccacauuuuuuguua

SEQ ID NO: 358006 - RNA, 64 nt, hsa
caauggaaauauuauauaccacauuuuuuguuaauggaaauaaaugucuucauucccauguuuu

SEQ ID NO: 358007 - RNA, 64 nt, hsa
auuucuacccugaagaacuaaugacagcaaucauuggaaauacugauuaugacuggaaacaguu

SEQ ID NO: 358008 - RNA, 64 nt, hsa
cgugauaggcugcaugcaagaggcauacagaaaauggaaauaguauuucgcuguccugaaacuu

SEQ ID NO: 358009 - RNA, 64 nt, hsa
uuaagauaggaaugcuagugucucuuuaauuaauuggaaauagauggaggcuaaaaaugaaggu

SEQ ID NO: 358010 - RNA, 64 nt, hsa
uguguauguuaaaauagaaaauuuugaggaaaaauggaaauaggguggaaaaguacucgguaaa

SEQ ID NO: 358011 - RNA, 64 nt, hsa
caggcaguucagauuuaaagcaccauccaaaccuuggaaauacgacagggugugguagaauuca

SEQ ID NO: 358012 - RNA, 64 nt, hsa
aggaaacagauuuugggcaggacauuccaugcacuggaaauagcaugaacaaaugcaugaaaau

SEQ ID NO: 358013 - RNA, 64 nt, hsa
ugcccaaagucauguuaccaguuggugacagagcuggaaauacguagagaucuauacccuuaaa

SEQ ID NO: 358014 - RNA, 64 nt, hsa
augaagaaaaagucaaggaaggaggugauacaauuggaaauauucccaucaaaugguuaaucuu

SEQ ID NO: 358015 - RNA, 64 nt, hsa
uaacuugguuuuaaauguugacaauauuuacaaguggaaauaaaauuuguaaauauaugaaaga

SEQ ID NO: 358016 - RNA, 64 nt, hsa
uuagugaaugucuggcaugauuauacacguguauuggaaauaucuaguuuuuuaaauuuuuaau

SEQ ID NO: 358017 - RNA, 64 nt, hsa
cacauaaauuucuggagaaccaccagguuuagcuuggaaauaaccuuuaaagauuguuucuguu

SEQ ID NO: 358018 - RNA, 64 nt, hsa
aguguagugcaggaaacagcccugucucaacuaauggaaauauauuugcauguaacccaaaauu

SEQ ID NO: 358019 - RNA, 64 nt, hsa
ugugggagaauaggaguccagccguaagauaaacuggaaauauuugggcgucuuguaccuggcu

SEQ ID NO: 358020 - RNA, 64 nt, hsa
aaauuuuuuuuaguucuaaucauugaugauagcuuggaaauaaauaauuaugccauggcauuug

SEQ ID NO: 358021 - RNA, 64 nt, hsa
uaugcauucugacauuacauauuuuuuaagacuauggaaauaauuuaaagauuuaagcucuggu

SEQ ID NO: 358022 - RNA, 64 nt, hsa
augcaugaucucagagugauuaaaaaaaaaucaguggaaauaaaugaucauagaaggugcuuuu

SEQ ID NO: 358023 - RNA, 64 nt, hsa
gaaggggacugcguuaacgguuacuaaggaaaacuggaaauacugucugguuuuuguaaauguu

SEQ ID NO: 358024 - RNA, 64 nt, hsa
aaaugaaguauuucauguaauauaagugaacaacuggaaauaaaguaggaaagaauuuguauca

SEQ ID NO: 358025 - RNA, 64 nt, hsa
uuuugauuuauggcuguuccugauuuuucauauguggaaauauaccuaccucuuccguuggaaa

SEQ ID NO: 358026 - RNA, 64 nt, hsa
cauugcuagauuuaaagggacuuguaagcauuucuggaaauauuugauuuaaaaacauauauua

SEQ ID NO: 358027 - RNA, 64 nt, hsa
uauaacuuuuaaauggaaaaaccuauuagguaaauggaaauaauccuugaaaauaguuuuugau

SEQ ID NO: 358028 - RNA, 64 nt, hsa
uuugagguaauuuugcaaaugugguuuuuuuacuuggaaauaacugcacauuuauauauaggau

SEQ ID NO: 358029 - RNA, 64 nt, hsa
caugaaaccuagcuccucuacacacaaauuccuauggaaauaccuuuguguacagugucuuaca

SEQ ID NO: 358030 - RNA, 64 nt, hsa
acaaacuuguauguaucuguaugugaccucuagauggaaauaaaaguuugauguuugcuagccg

SEQ ID NO: 358031 - RNA, 64 nt, hsa
aguaacauauuuuucucccauaaccuagugaaccuggaaauacaacuuugcuucuuuaugaaag

SEQ ID NO: 358032 - RNA, 64 nt, hsa
aacacuaaagguggaaauaaaagauuuucuauuauggaaauaaagaguuggcaugaaaguggcu

SEQ ID NO: 358033 - RNA, 64 nt, hsa
uguggucaucuauucuagcagggaacacuaaagguggaaauaaaagauuuucuauuauggaaau

SEQ ID NO: 358034 - RNA, 64 nt, hsa
acaaaaaguaaaccaaacaaaacgaaugaaaaacuggaaauaauucguuuccauaucuuuccau

SEQ ID NO: 358035 - RNA, 64 nt, hsa
uuguacuaacucagcauguaacaaccaauuuacauggaaauaaaucgaaauaugauaacuauua

SEQ ID NO: 358036 - RNA, 64 nt, hsa
augguuaagacaccaguaacaaaaacacaugauuuggaaauacuuuggcuuuuucauauaccua

SEQ ID NO: 358037 - RNA, 64 nt, hsa
guauaaucuguauuugaaaucauuuugcaaucuauggaaauagaguagcaauugcuauuucuaa

SEQ ID NO: 358038 - RNA, 64 nt, hsa
ggaacaaaauguuauauagauaauauuuuucuaauggaaauaaaauaggcagauuuccuuuggu

SEQ ID NO: 358039 - RNA, 64 nt, hsa
agugugaguuugaugaaaauaucugaagcuauuauggaaauaccauguaauagggagaguugaa

SEQ ID NO: 358040 - RNA, 64 nt, hsa
gucugcuaaauggauauauuguguguguugcuguuggaaauagccccaccccauccucccaauc

SEQ ID NO: 358041 - RNA, 64 nt, hsa
cuggacuguuguaaccuuagguuguaaucugauuuggaaauaaguacaucuuuaaaaguugcua

SEQ ID NO: 358042 - RNA, 64 nt, hsa
cuugcauacaaguuucuaguugccagugauguucuggaaauaaugggagauauuacaauaaagc

SEQ ID NO: 358043 - RNA, 64 nt, hsa
aaauuuguaauguguugcuucuacauaaguucucuggaaauaucuacaacuaauaggacacaug

SEQ ID NO: 358044 - RNA, 64 nt, hsa
guuauucacuguguuuuugaugaucuaucuguauuggaaauauguuccuggaaaaugcauuuaa

SEQ ID NO: 358045 - RNA, 64 nt, hsa
augaaaucuucauugucaaaaccuuuaauaaaaguggaaauauuuugaaaugcccuuuuucuug

SEQ ID NO: 358046 - RNA, 64 nt, hsa
aaaaauguauaauaacucaguuuuucuugguuuauggaaauaucuauauuaaugugaaaauaau

SEQ ID NO: 358047 - RNA, 64 nt, hsa
ugugccuuugagccuauacuauacuguguauguguggaaauaaaaauguauuguacuuuuggag

SEQ ID NO: 358048 - RNA, 64 nt, hsa
ugguggaccuauuacccuauggguaagaaauaaauggaaauaugacaucggauguuucagcaac

SEQ ID NO: 358049 - RNA, 64 nt, hsa
ccacucagugugauaauugugucuacagcuaaaauggaaauaguuuuaucuguacaguugugca

SEQ ID NO: 358050 - RNA, 64 nt, hsa
caaauauuuuaauauuucuguuuucauuuccuguuggaaauauuauccugcauaauagcuauug

SEQ ID NO: 358051 - RNA, 64 nt, hsa
gaaaaucugcccugcuagaauuugcuuuucaaaauggaaauaaauuccaacucuccuaagaggc

SEQ ID NO: 358052 - RNA, 64 nt, hsa
auuuccaucauggaaggugguauggaagaagguauggaaauacuuuguauucuaaaaacucacu

SEQ ID NO: 358053 - RNA, 64 nt, hsa
uuuuaacaucuuaaaguugcuuuuguuaaaggaauggaaauauauauccauugguaauaauguu

SEQ ID NO: 358054 - RNA, 64 nt, hsa
gggguaggggagacacuuuaccaguauuuuuuuauggaaauaauacucaagguuguaaaacccc

SEQ ID NO: 358055 - RNA, 64 nt, hsa
aaaucgggagaaaaauccauuuuaguucuauggauggaaauauuucaugcuuuuaaaaagaugu

SEQ ID NO: 358056 - RNA, 64 nt, hsa
aauguaugaaaauuuacauuugaucauccggcauuggaaauaguuugaacuauuuccaaaaauc

SEQ ID NO: 358057 - RNA, 64 nt, hsa
gaggcaaggucuguagugcuucuuuaacuaccuuuggaaauacuguacaauguuagaauaauuu

SEQ ID NO: 358058 - RNA, 64 nt, hsa
aguauguguauauuuaauaggggaagguaguuuauggaaauauuuuuaauggaauaguuuuccc

SEQ ID NO: 358059 - RNA, 64 nt, hsa
uccugaugggcccacaaguuuuucuauauuuaacuggaaauaugcuuugauuuuguguuauuaa

SEQ ID NO: 358060 - RNA, 64 nt, hsa
gguugaaggucacagaaguagugguuugcuuugauggaaauagcuacagcugugucccuuccug

SEQ ID NO: 358061 - RNA, 64 nt, hsa
aaggcuaaacacuauguaaaugugaauggaaacuuggaaauacucguuuuuauaaacuacaaaa

SEQ ID NO: 358062 - RNA, 64 nt, hsa
uguggugggggaguggguauuacaugcauugcugaagagucauccugguguuccucauuccucc

SEQ ID NO: 358063 - RNA, 64 nt, hsa
uuuuaucauauuuccaccaucacuucaggguuuuaagagucagugcucaccugggcggagcugg

SEQ ID NO: 358064 - RNA, 64 nt, hsa
uggugcuuuaaauuaagucuguuuacuaugaaacaagagucauuuuuagaggauuuuaacaggu

SEQ ID NO: 358065 - RNA, 64 nt, hsa
ccaaaaggagaugagggaacaggauagguuucagaagagucaaaugcuucuaaugucucaaggu

SEQ ID NO: 358066 - RNA, 64 nt, hsa
auaaaagagagaagagagguaauuuguuagcaucaagagucaaguugcuauauggucaaagguu

SEQ ID NO: 358067 - RNA, 64 nt, hsa
caucuguugacacagcuuuuauacucaccuguggaagagucagcuacucacccgcuauuagagu

SEQ ID NO: 358068 - RNA, 64 nt, hsa
ccagcccgacccugacacugcacgugggcguaguggggagcacccuggaguggagaugauuguc

SEQ ID NO: 358069 - RNA, 64 nt, hsa
ccggacccugccccuccaaguuggggacggagauggggagcaggucaggcccucccuaggccug

SEQ ID NO: 358070 - RNA, 64 nt, hsa
ugcuuuuagggauuauuuuuugaauaccccgaguggggagcaggguucuccucaaagccucaca

SEQ ID NO: 358071 - RNA, 64 nt, hsa
cuugucuguaucagauuuggcagugaggaggcuuggggagcaccuaccuuacuuucagggacag

SEQ ID NO: 358072 - RNA, 64 nt, hsa
gugccugggagggccgaaccacuggugagggcguggggagcaggggguggcagagggcacccgg

SEQ ID NO: 358073 - RNA, 64 nt, hsa
cggggcugcggggugagaggaagaaagcaaacccggggagcaggcggcugccgcacccgcgcac

SEQ ID NO: 358074 - RNA, 64 nt, hsa
guccacagccuuguccagaguuccuguguagcacggggagcaaugauggagggagccccugaga

SEQ ID NO: 358075 - RNA, 64 nt, hsa
agauggggauggaggaggaaggcugauauccucuggggagcacaucaccugaaggugccaagga

SEQ ID NO: 358076 - RNA, 64 nt, hsa
ccccguguguccucaucugcggcaggcaggagagggggagcaaacaggaaauuccacagcugcc

SEQ ID NO: 358077 - RNA, 64 nt, hsa
gguggggcagggaugguguuucggguggcgggauggggagcagcuugguccaugugccuucagg

SEQ ID NO: 358078 - RNA, 64 nt, hsa
guggaguggagccucaucgaggggcgcuggguuaggggagcaccuguuucagacugggcaugaa

SEQ ID NO: 358079 - RNA, 64 nt, hsa
gcauguguggccacuguacccccacccacccuugggggagcaugaugggcaggugagggcagga

SEQ ID NO: 358080 - RNA, 64 nt, hsa
uggaggcucauugaggcaagcagcaacauuggagggggagcagggcagugcugugucugcugcc

SEQ ID NO: 358081 - RNA, 64 nt, hsa
agcccagcccacccacauaccagucaagcucuuaggggagcagaagaaaagcaggaagaauuua

SEQ ID NO: 358082 - RNA, 64 nt, hsa
agagaaacagcagccuuugucucuucccucuuguggggagcaaggaggggaugagcgguaccuu

SEQ ID NO: 358083 - RNA, 64 nt, hsa
caaauggagccagcggcugugguugaccugccuuggggagcagggcugaggggcgaagaggaca

SEQ ID NO: 358084 - RNA, 64 nt, hsa
ccacucuaagugauuccuccagggugggaagcacggggagcaauggaaucagauggcucauucu

SEQ ID NO: 358085 - RNA, 64 nt, hsa
aggaaucccuugggucagcuccuauccucuggacggggagcaucaugggaaaaagagguccgag

SEQ ID NO: 358086 - RNA, 64 nt, hsa
augccuguuaccaggugcugcuucuucagaugauggggagcacuuuucagggugaaauucaggc

SEQ ID NO: 358087 - RNA, 64 nt, hsa
gcgcccaggggcgggcggggguacgagggaggaaggggagcaagacuugggcucacaggcuggu

SEQ ID NO: 358088 - RNA, 64 nt, hsa
caaauguccaucuuucucagacggggcucugucuggggagcacccacaggcugccuuugggguc

SEQ ID NO: 358089 - RNA, 64 nt, hsa
cacugcgcgccucucccaggucucagcucuggguggggagcaguggccgcuaccgacagcgcau

SEQ ID NO: 358090 - RNA, 64 nt, hsa
cccgaggcuacagcagacccccaugagagaaggaggggagcaggcccguggcaggaggagggcu

SEQ ID NO: 358091 - RNA, 64 nt, hsa
augcaaacucaccgcuccaaugccuacugaguagggggagcaaaucgugccuugucauuuuauu

SEQ ID NO: 358092 - RNA, 64 nt, hsa
cagaggagcggggcaggcagccacagggcccugcggggagcacauccucgccuccguccggcug

SEQ ID NO: 358093 - RNA, 64 nt, hsa
gaagcaccugaggccaagcaggggagaggaaugaggggagcagcuggacaugggccuccugagg

SEQ ID NO: 358094 - RNA, 64 nt, hsa
aagagaauccaggcuggcagagcuggagccaguuggggagcacgguucugggagcucugcaaaa

SEQ ID NO: 358095 - RNA, 64 nt, hsa
cgcuccucugucuugucaguggaggugccuggguggggagcaggucucaggccucuuguccucu

SEQ ID NO: 358096 - RNA, 62 nt, hsa
uaggaggagcucucaauuuuauguauucuuucugccuuuaauuuucuuguuuguuugagcuu

SEQ ID NO: 358097 - RNA, 62 nt, hsa
uuggucucccuggaggggacuuccacaccuccugccuuuaggccauggguggaaagugcuca

SEQ ID NO: 358098 - RNA, 62 nt, hsa
cccagacaacuccgucaccccagcucugccugugccuuuaucccugacagcugcugcacuag

SEQ ID NO: 358099 - RNA, 62 nt, hsa
accccugccuccaguugcaccacuucuagaugugccuuuaaaagaucuaacuaugggauggg

SEQ ID NO: 358100 - RNA, 62 nt, hsa
gcucccaaccagcuguuaggaccccacccuuuugccuuuauugucgacgugacucaccagac

SEQ ID NO: 358101 - RNA, 62 nt, hsa
cuuuuccuguuuuuauuuugguauuaagucguugccuuuauuuguaaagcuguuauaaauau

SEQ ID NO: 358102 - RNA, 62 nt, hsa
uuugggucaguugauaaaaggaaaccuuuucaugccuuuagaugugagcuuccaguagguaa

SEQ ID NO: 358103 - RNA, 62 nt, hsa
auguguucaaggaccacauguguucucuauuuugccuuuaaauuuuugugaaccaauuuuaa

SEQ ID NO: 358104 - RNA, 62 nt, hsa
aagacuuccacucgaugaugcuucuauaauuuugccuuuaacagaaacuuucaaaagggaag

SEQ ID NO: 358105 - RNA, 62 nt, hsa
gugccuagguuuuggagaguuugccuguucuaugccuuuagucaggaauggcugcaccuuuu

SEQ ID NO: 358106 - RNA, 62 nt, hsa
gaaaagccauacaaaugagaagaauguggcaaugccuuuaaucaguccucacaccuuucuac

SEQ ID NO: 358107 - RNA, 62 nt, hsa
aagaaacccuacaaauguaaaaaacguggcaaugccuuuaacugguccucacaccuugcuac

SEQ ID NO: 358108 - RNA, 62 nt, hsa
acuuucuagguauggaguuugauggacagggcugccuuuaaugagugugaaggucacuaagu

SEQ ID NO: 358109 - RNA, 62 nt, hsa
uggaaaaaaauaucuauuuuggcagguuucugugccuuuauuucccucuucugaaaaaaagu

SEQ ID NO: 358110 - RNA, 62 nt, hsa
caaaugaaacaagccgucuuacaagucguuauugccuuuaaaaaucuguuccguuuuuuucc

SEQ ID NO: 358111 - RNA, 62 nt, hsa
uacagauuuauugugagacacaaauucacugcugccuuuacacuaagaaauguauauguuaa

SEQ ID NO: 358112 - RNA, 62 nt, hsa
ugaucuugguguucaaaacagaacuguauuuuugccuuuaaaauuaaauaauauaacgugaa

SEQ ID NO: 358113 - RNA, 62 nt, hsa
gcugagcuggugccuggccccagucuuaucugugccuuuacugcuuugcgcaucucagaugc

SEQ ID NO: 358114 - RNA, 62 nt, hsa
uuuuauauguagcauucacuucccucuuacugugccuuuagccuuuucauguuucugucuca

SEQ ID NO: 358115 - RNA, 62 nt, hsa
aauguauaaucauuuaucacuaaauugcacauugccuuuauuuauuugugcucuguuuuugg

SEQ ID NO: 358116 - RNA, 62 nt, hsa
ggaggugauucagaaccuuuuaaagugauuuuugccuuuaaagauacagugugaaaauuugc

SEQ ID NO: 358117 - RNA, 62 nt, hsa
uucagugaaugcagaacaaaugaagggaaaagugccuuuaaaauuaccucacugugggcugg

SEQ ID NO: 358118 - RNA, 62 nt, hsa
aauagaauaaguacaugcugcuguaauaaaauugccuuuaaucacuuaacaagccuaaccuu

SEQ ID NO: 358119 - RNA, 62 nt, hsa
aucaccuacaccagagagccauuuugguauuuugccuuuaaauaaaaagccuccuuuaucug

SEQ ID NO: 358120 - RNA, 62 nt, hsa
ggaucaugagagagauauuuaucacaugcacaugccuuuauauagcuggucuccuugggugg

SEQ ID NO: 358121 - RNA, 62 nt, hsa
aagcucuggagugugccuaggagggggcuggcugccuuuaugucccaggaugacucuuuaug

SEQ ID NO: 358122 - RNA, 62 nt, hsa
gaacugcaaacucuaauagcccaggucuuaauugccuuuagcagagguauccaaagcuuuua

SEQ ID NO: 358123 - RNA, 62 nt, hsa
gucaacuucaacuugcauucucagaaugauagugccuuuaaaaauuuuuuuauuuuuuaaag

SEQ ID NO: 358124 - RNA, 62 nt, hsa
aaaugggaguacccaugguuaggauauagcuaugccuuuaugguuaagauuagaauauauga

SEQ ID NO: 358125 - RNA, 62 nt, hsa
gauuaauagccuaaauaaagagaaaagccugaugccuuuaaaaaaaaugaaacacuuuggau

SEQ ID NO: 358126 - RNA, 62 nt, hsa
ggauuuaucugcaguguucagggagauaauucugccuuuaauugucuaaaacaaaaacaaaa

SEQ ID NO: 358127 - RNA, 62 nt, hsa
uuuucuccuuuuuucucuugcugcccacauugugccuuuauuuuaugagccccaguuuucug

SEQ ID NO: 358128 - RNA, 62 nt, hsa
ucucuuuguuucuguuucuugcucucucucccugccuuuaaaugaaacaagucuagucuucu

SEQ ID NO: 358129 - RNA, 62 nt, hsa
uugugagaaagggaugguggagugagagccuuugccuuuagggguguguauucacauagucc

SEQ ID NO: 358130 - RNA, 62 nt, hsa
aucaccuacaccagagagcuauuuugguauuuugccuuuaaauaaaaagccuccuccauaug

SEQ ID NO: 358131 - RNA, 62 nt, hsa; identical to SEQ ID NO: 358118

SEQ ID NO: 358132 - RNA, 64 nt, hsa
ggcucccuacccuuccauuaagaaucuaccaagcauuagcaaggcugaaaguggucuaagaggu

SEQ ID NO: 358133 - RNA, 64 nt, hsa
acuuagcagagugcuauugacuauagauucacauauuagcaacaaaaucccguaauucuuuugg

SEQ ID NO: 358134 - RNA, 64 nt, hsa
uaucaugaauguagaaauaaaaguccuuaaaauaauuagcaaaucaaauccagcaauguauaaa

SEQ ID NO: 358135 - RNA, 64 nt, hsa
uguugauguuuuuugaagcauuaagucauuacuuauuagcaaguuacuauuuuguuuuuuuguc

SEQ ID NO: 358136 - RNA, 64 nt, hsa
uuguuauuaaacuaucaucuccaccuuccuuuugauuagcaauuuguacuaagaaacgaaacaa

SEQ ID NO: 358137 - RNA, 64 nt, hsa
uuuuuguagucuuugcuugacuuuuuugggggggauuagcaaagcagaaaacuggcugcugggu

SEQ ID NO: 358138 - RNA, 64 nt, hsa
uacaggagaagugacauacuuuauauauguuuauauuagcaaggucuguuuuuaauaccauaua

SEQ ID NO: 358139 - RNA, 64 nt, hsa
auuaaauccuugaccuugugcauuauagcauuccauuagcaagaguuguacccccuccccaguc

SEQ ID NO: 358140 - RNA, 64 nt, hsa
cugggugggggugacucuucacugauucuuguauauuagcaauuauaauguuuguauaugcaaa

SEQ ID NO: 358141 - RNA, 64 nt, hsa
aaaucacuuucauuuccggauuggcgcgugugcaauuagcaaugcaguguauauacaagaagcc

SEQ ID NO: 358142 - RNA, 64 nt, hsa
cacuugucuugugugucugaacacacagaagcuaauuagcaaguuuuuaagaaguauuuaaaaa

SEQ ID NO: 358143 - RNA, 64 nt, hsa
auuauugccgucauuauuuacauacuuaagacauauuagcaaguugauccaaaaugggaggccu

SEQ ID NO: 358144 - RNA, 64 nt, hsa
ccacauuauuucuuaaucugaacaugaaggcuccauuagcaacacuaaaacuugaucauuaaca

SEQ ID NO: 358145 - RNA, 64 nt, hsa
uuugcuuuguacgucugccaagaaucuuccaguuauuagcaaacucagacgaauguaccgccag

SEQ ID NO: 358146 - RNA, 64 nt, hsa
gggucuuacuaucauuguagugugauuucuuuguauuagcaaagacaaaaacgcuaacauugaa

SEQ ID NO: 358147 - RNA, 64 nt, hsa
aucaauaauucaauuuugugucuuuucucaauuuauuagcaaacacaagacauuuuauguauua

SEQ ID NO: 358148 - RNA, 64 nt, hsa
uccaugugacuaguguauaugguauuugcucuccauuagcaaaauaauucauuguuagguaaac

SEQ ID NO: 358149 - RNA, 64 nt, hsa
caguuuugaucuacagggccagucuacauuaaaaauuagcaacccgaaaggauggguaaccuuc

SEQ ID NO: 358150 - RNA, 64 nt, hsa
uuaggauauauacuugaauggaaauacauguacuauuagcaaucauauuucauuuaucccugua

SEQ ID NO: 358151 - RNA, 64 nt, hsa
cucgauuugaggacauucauuucuucagcagcccauuagcaacugagagcccagggauguccua

SEQ ID NO: 358152 - RNA, 64 nt, hsa
cuaauauaaaugggagguuuuacugucaaguccaauuagcaaaacgugguaauaauuuuuuugu

SEQ ID NO: 358153 - RNA, 64 nt, hsa
ugguaccauguaacagaaugagagcuaauuccaaauuagcaacuucauccugcuuucuauuuua

SEQ ID NO: 358154 - RNA, 64 nt, hsa
ccagccugagcccccaccaggggucucugcccagcacaggaagcugacccuggcccagcucuac

SEQ ID NO: 358155 - RNA, 64 nt, hsa
agucggcugccuggccggggaaccugcaggcucccacaggaagagguguggagaccugcccucg

SEQ ID NO: 358156 - RNA, 64 nt, hsa
acuccuuuuccuuuuggaucauagcuuaacaaggcacaggaagggaagggaucuugacuaagau

SEQ ID NO: 358157 - RNA, 64 nt, hsa
ucugaacauuguuaauggccugugacaugaugagcacaggaacaggcaugaagauauugccaua

SEQ ID NO: 358158 - RNA, 64 nt, hsa
gacagaguuaucaaggcacauucuccaccacugucacaggaaggacaugucaaucuuggucauc

SEQ ID NO: 358159 - RNA, 64 nt, hsa
gacagaguuaucgaggcacauacuucaccacugucacaggaagaaccugccaagcuuggucauc

SEQ ID NO: 358160 - RNA, 64 nt, hsa
gacagaguuaucgaggcacauacuucaccaccgucacaggaagcacuugccaagcuuggucauc

SEQ ID NO: 358161 - RNA, 64 nt, hsa
guggcagcagcaggagcuacuagaauauucucagcacaggaaugaggcuuccuugguuuccaug

SEQ ID NO: 358162 - RNA, 64 nt, hsa
cauccgcagccugggaaccuucucccucguacagcacaggaaccugacacauaguaggcacaca

SEQ ID NO: 358163 - RNA, 64 nt, hsa
cccacagccagcucuuggcuccaagaugagcacccacaggaagccgacccaggccugaggggcc

SEQ ID NO: 358164 - RNA, 64 nt, hsa
ugagauucuugucugcccucauaucacgcugccccacaggaaugcugcugggaaaagcagggcc

SEQ ID NO: 358165 - RNA, 64 nt, hsa
gauacauaaucucaugggacuucagugggaguuacacaggaauguugaagaaucauucuucuuu

SEQ ID NO: 358166 - RNA, 64 nt, hsa
uggguuaucugcaucucaaaagaaaaugcuuacccacaggaacuguuaacucagggguucuuaa

SEQ ID NO: 358167 - RNA, 64 nt, hsa
ucagaucuugugagacuuacuaucacgagaauagcacaggaaagacuggcccccaugauucaau

SEQ ID NO: 358168 - RNA, 64 nt, hsa
ucagaucucaugagacuuacuaucaugagaauagcacaggaaagacuggccccccugauucgau

SEQ ID NO: 358169 - RNA, 64 nt, hsa
gcuuaguggaauucuuaaauuaugggaauguauucacaggaagacggugauucuugcccuuaau

SEQ ID NO: 358170 - RNA, 64 nt, hsa
cauucuuuuuaagcuugaaacugcagaagaaauucacaggaaaaaucaacaagauagugaucuc

SEQ ID NO: 358171 - RNA, 64 nt, hsa
ccuuccagacauacgaaacacaaaccacaacugacacaggaaaccaacacccaaagcauggacu

SEQ ID NO: 358172 - RNA, 64 nt, hsa
aaaccaacacccaaagcauggacuaaccccaacgcacaggaaaagguagcuuaccugacacaag

SEQ ID NO: 358173 - RNA, 56 nt, hsa
gguauguccuggugaauuagucucagcacaggaauugaggugggucaggugaagga

SEQ ID NO: 358174 - RNA, 64 nt, hsa
aaggcaaaucaagaagacaucaggaaaucagaugcacaggaaauaaaggaaagcugugcuuugu

SEQ ID NO: 358175 - RNA, 64 nt, hsa
ucaucucauccugugggauucugcaaucauaaaacacaggaaaggggaauucugugauggcaaa

SEQ ID NO: 358176 - RNA, 64 nt, hsa
ggauggauagaaaaaaagcacuuacauuggggcacacaggaaaucccagugucuagcaaugguu

SEQ ID NO: 358177 - RNA, 64 nt, hsa
ccuuuacuuuacagcuucccuuuauaauuuguuacacaggaauaguuaaaugcauuuguuuguu

SEQ ID NO: 358178 - RNA, 64 nt, hsa
agaggacugccuaguagcaaagguuauuccuggacacaggaaagacgggcauuacagggaccaa

SEQ ID NO: 358179 - RNA, 64 nt, hsa
agguaggacagcugcuccccaagccuccugaggacacaggaagagacggaaggagcaccuugac

SEQ ID NO: 358180 - RNA, 64 nt, hsa
gccuggugugaaaugaucuauggccuguuucuuacacaggaagcccccugaaccuccuguacau

SEQ ID NO: 358181 - RNA, 64 nt, hsa
uccccgacugugccacgugguaggacacauaggacacaggaauuccuggguccuugcccaugac

SEQ ID NO: 358182 - RNA, 64 nt, hsa
ugcccaugacugugccaugugguaggacacaggacacaggaauuccuggaaagugguggcuuca

SEQ ID NO: 358183 - RNA, 64 nt, hsa
ggaggggggagcagguuuuaugaauguaacugugcacaggaaaugacugguaauggaaaaaaug

SEQ ID NO: 358184 - RNA, 64 nt, hsa
uauagccugaugucccacauugacccacugaccacacaggaaaagcagcgaaaccugcacccuc

SEQ ID NO: 358185 - RNA, 64 nt, hsa
cacagagauuagggggacuuaaaauuaauauaggcacaggaaagagaaaagugugcgcuccauu

SEQ ID NO: 358186 - RNA, 64 nt, hsa
ugccucuacuugacuuggaauuggcugaagacuacacaggaaugcaucguucccacuccccauc

SEQ ID NO: 358187 - RNA, 64 nt, hsa
ccggucccucugcuggggaugcaccaaugaaccccacaggaagggggaaggaaggagggaauuu

SEQ ID NO: 358188 - RNA, 64 nt, hsa
aaaaagaaaagaaagcaagaacagaaaacgaagccacaggaagggaaguagacauuguaugcuu

SEQ ID NO: 358189 - RNA, 64 nt, hsa
acucugagcuugugcccagaaauuaccccaagaccacaggaacccuucaagaagcucccaucac

SEQ ID NO: 358190 - RNA, 64 nt, hsa
auuaaccauacagugugaucaacacugacaggagcacaggaaaaacaucuagcuuaugugaaga

SEQ ID NO: 358191 - RNA, 64 nt, hsa
auuacaugagaugccuuaggcuaaggcccuggcacacaggaacacaugugcuacaaaggagcuu

SEQ ID NO: 358192 - RNA, 64 nt, hsa
ccaugauguacccuccgagaaagaagaacguaagcacaggaaagagaaaaagaaaucuguugaa

SEQ ID NO: 358193 - RNA, 64 nt, hsa
uuucagaaagauaggagauagcucuguagaaacacacaggaacagagaaaugguugaugucaga

SEQ ID NO: 358194 - RNA, 64 nt, hsa
cuucaugucccucauccagcucagaucuuauuagcacaggaauggcuaccauaacgauauggaa

SEQ ID NO: 358195 - RNA, 64 nt, hsa; identical to SEQ ID NO: 171556

SEQ ID NO: 358196 - RNA, 64 nt, hsa; identical to SEQ ID NO: 171557

SEQ ID NO: 358197 - RNA, 64 nt, hsa; identical to SEQ ID NO: 171558

SEQ ID NO: 358198 - RNA, 64 nt, hsa; identical to SEQ ID NO: 171559

SEQ ID NO: 358199 - RNA, 64 nt, hsa; identical to SEQ ID NO: 171560

SEQ ID NO: 358200 - RNA, 64 nt, hsa; identical to SEQ ID NO: 171561

SEQ ID NO: 358201 - RNA, 64 nt, hsa; identical to SEQ ID NO: 171562

SEQ ID NO: 358202 - RNA, 64 nt, hsa; identical to SEQ ID NO: 171563

SEQ ID NO: 358203 - RNA, 64 nt, hsa; identical to SEQ ID NO: 171564

SEQ ID NO: 358204 - RNA, 64 nt, hsa; identical to SEQ ID NO: 171565

SEQ ID NO: 358205 - RNA, 64 nt, hsa; identical to SEQ ID NO: 171566

SEQ ID NO: 358206 - RNA, 64 nt, hsa; identical to SEQ ID NO: 171567

SEQ ID NO: 358207 - RNA, 64 nt, hsa; identical to SEQ ID NO: 171568

SEQ ID NO: 358208 - RNA, 64 nt, hsa; identical to SEQ ID NO: 171569

SEQ ID NO: 358209 - RNA, 64 nt, hsa; identical to SEQ ID NO: 171570

SEQ ID NO: 358210 - RNA, 64 nt, hsa; identical to SEQ ID NO: 171571

SEQ ID NO: 358211 - RNA, 64 nt, hsa; identical to SEQ ID NO: 171572

SEQ ID NO: 358212 - RNA, 64 nt, hsa; identical to SEQ ID NO: 171573

SEQ ID NO: 358213 - RNA, 64 nt, hsa; identical to SEQ ID NO: 171574

SEQ ID NO: 358214 - RNA, 64 nt, hsa; identical to SEQ ID NO: 171575

SEQ ID NO: 358215 - RNA, 64 nt, hsa; identical to SEQ ID NO: 171576

SEQ ID NO: 358216 - RNA, 64 nt, hsa; identical to SEQ ID NO: 171577

SEQ ID NO: 358217 - RNA, 64 nt, hsa; identical to SEQ ID NO: 171578

SEQ ID NO: 358218 - RNA, 64 nt, hsa; identical to SEQ ID NO: 171579

SEQ ID NO: 358219 - RNA, 64 nt, hsa; identical to SEQ ID NO: 171580

SEQ ID NO: 358220 - RNA, 64 nt, hsa; identical to SEQ ID NO: 171581

SEQ ID NO: 358221 - RNA, 64 nt, hsa; identical to SEQ ID NO: 171582

SEQ ID NO: 358222 - RNA, 64 nt, hsa; identical to SEQ ID NO: 171583

SEQ ID NO: 358223 - RNA, 64 nt, hsa; identical to SEQ ID NO: 171584

SEQ ID NO: 358224 - RNA, 64 nt, hsa; identical to SEQ ID NO: 171585

SEQ ID NO: 358225 - RNA, 64 nt, hsa; identical to SEQ ID NO: 171586

SEQ ID NO: 358226 - RNA, 64 nt, hsa; identical to SEQ ID NO: 171587

SEQ ID NO: 358227 - RNA, 64 nt, hsa; identical to SEQ ID NO: 171588

SEQ ID NO: 358228 - RNA, 64 nt, hsa; identical to SEQ ID NO: 171589

SEQ ID NO: 358229 - RNA, 64 nt, hsa; identical to SEQ ID NO: 171590

SEQ ID NO: 358230 - RNA, 64 nt, hsa; identical to SEQ ID NO: 171591

SEQ ID NO: 358231 - RNA, 64 nt, hsa; identical to SEQ ID NO: 171592

SEQ ID NO: 358232 - RNA, 64 nt, hsa; identical to SEQ ID NO: 171593

SEQ ID NO: 358233 - RNA, 64 nt, hsa; identical to SEQ ID NO: 171594

SEQ ID NO: 358234 - RNA, 64 nt, hsa; identical to SEQ ID NO: 171595

SEQ ID NO: 358235 - RNA, 64 nt, hsa; identical to SEQ ID NO: 171596

SEQ ID NO: 358236 - RNA, 64 nt, hsa; identical to SEQ ID NO: 171597

SEQ ID NO: 358237 - RNA, 64 nt, hsa; identical to SEQ ID NO: 171598

SEQ ID NO: 358238 - RNA, 64 nt, hsa; identical to SEQ ID NO: 171599

SEQ ID NO: 358239 - RNA, 64 nt, hsa; identical to SEQ ID NO: 171600

SEQ ID NO: 358240 - RNA, 64 nt, hsa; identical to SEQ ID NO: 171601

SEQ ID NO: 358241 - RNA, 64 nt, hsa; identical to SEQ ID NO: 171602

SEQ ID NO: 358242 - RNA, 64 nt, hsa; identical to SEQ ID NO: 171603

SEQ ID NO: 358243 - RNA, 64 nt, hsa; identical to SEQ ID NO: 171604

SEQ ID NO: 358244 - RNA, 64 nt, hsa; identical to SEQ ID NO: 171605

SEQ ID NO: 358245 - RNA, 64 nt, hsa; identical to SEQ ID NO: 171606

SEQ ID NO: 358246 - RNA, 64 nt, hsa; identical to SEQ ID NO: 171607

SEQ ID NO: 358247 - RNA, 64 nt, hsa; identical to SEQ ID NO: 171608

SEQ ID NO: 358248 - RNA, 64 nt, hsa; identical to SEQ ID NO: 171609

SEQ ID NO: 358249 - RNA, 64 nt, hsa; identical to SEQ ID NO: 171610

SEQ ID NO: 358250 - RNA, 64 nt, hsa; identical to SEQ ID NO: 171611

SEQ ID NO: 358251 - RNA, 64 nt, hsa; identical to SEQ ID NO: 171612

SEQ ID NO: 358252 - RNA, 64 nt, hsa; identical to SEQ ID NO: 171613

SEQ ID NO: 358253 - RNA, 64 nt, hsa; identical to SEQ ID NO: 171614

SEQ ID NO: 358254 - RNA, 64 nt, hsa; identical to SEQ ID NO: 171615

SEQ ID NO: 358255 - RNA, 64 nt, hsa; identical to SEQ ID NO: 171616

SEQ ID NO: 358256 - RNA, 64 nt, hsa; identical to SEQ ID NO: 171617

SEQ ID NO: 358257 - RNA, 64 nt, hsa; identical to SEQ ID NO: 171618

SEQ ID NO: 358258 - RNA, 64 nt, hsa; identical to SEQ ID NO: 171619

SEQ ID NO: 358259 - RNA, 64 nt, hsa; identical to SEQ ID NO: 171620

SEQ ID NO: 358260 - RNA, 64 nt, hsa; identical to SEQ ID NO: 171621

SEQ ID NO: 358261 - RNA, 64 nt, hsa; identical to SEQ ID NO: 171622

SEQ ID NO: 358262 - RNA, 64 nt, hsa; identical to SEQ ID NO: 171623

SEQ ID NO: 358263 - RNA, 64 nt, hsa; identical to SEQ ID NO: 171624

SEQ ID NO: 358264 - RNA, 64 nt, hsa; identical to SEQ ID NO: 171625

SEQ ID NO: 358265 - RNA, 64 nt, hsa; identical to SEQ ID NO: 171626

SEQ ID NO: 358266 - RNA, 64 nt, hsa; identical to SEQ ID NO: 171627

SEQ ID NO: 358267 - RNA, 64 nt, hsa; identical to SEQ ID NO: 171628

SEQ ID NO: 358268 - RNA, 64 nt, hsa
uuguauuuuaaagauugagagggcuaagaaaguagcccucaaauaaacuguuauugcauuauag

SEQ ID NO: 358269 - RNA, 64 nt, hsa
uggaagguaucauccguguggguucuucccuccugcccucaauuguuuuucugggccuuguuuu

SEQ ID NO: 358270 - RNA, 64 nt, hsa
cuuucccuggucuuuuagucuaguccuuuggcaagcccucaaccucagauuaauccuauuuauu

SEQ ID NO: 358271 - RNA, 64 nt, hsa
aucacuacaagugucucacuucagccuuagaaaagcccucaauguaaaccuuauguuuguuacu

SEQ ID NO: 358272 - RNA, 64 nt, hsa
ccguucggccccgccccccgcacugaacacacccgcccucaaccccgcacccuccgcacucacc

SEQ ID NO: 358273 - RNA, 64 nt, hsa
uucaccauguuggccaggcuggucuccaacuccugcccucaagugauccgccucggucccauuu

SEQ ID NO: 358274 - RNA, 64 nt, hsa
uaaguuauagcuuuguuuuugcuugccuccugauuaucuguacuguggguuuaaguaugcuacu

SEQ ID NO: 358275 - RNA, 64 nt, hsa
cuguuucucucagcuuugccuucuugcuuuuucauaucuguaaagaaaaaaauuacauaucagu

SEQ ID NO: 358276 - RNA, 64 nt, hsa
aauugcagauuuaaaagguacuguacaaccauuauaucuguaaauaacuuagcaccuuuuuguc

SEQ ID NO: 358277 - RNA, 64 nt, hsa
cuuaucagucauaauuauauauacuguggaacaguaucuguaguuacugcaaauuacuguacag

SEQ ID NO: 358278 - RNA, 64 nt, hsa
ugaaacuauccaaugacauauuauaguaaaugaguaucuguaaccucccacugcaucagaagca

SEQ ID NO: 358279 - RNA, 64 nt, hsa
uuuucaucuccuaaaagugguuuuuauuuccuuguaucuguagucuuuuauuuuuuaaaugacu

SEQ ID NO: 358280 - RNA, 64 nt, hsa
ugguuagccuuaguuucucagacuuguugucuauuaucuguagguggaagaaauuuaggaagcg

SEQ ID NO: 358281 - RNA, 64 nt, hsa
cuuaaaauaugugcuuuagguagguguuauuacauaucuguagacaauugguauaugaaauaua

SEQ ID NO: 358282 - RNA, 64 nt, hsa
gacugguagccaccauaggacuuuauuuucaugauaucuguaaucacugcuacaaucagcucac

SEQ ID NO: 358283 - RNA, 64 nt, hsa
auucaccagucacuucauaugucuugaacaucuguaucuguaaacaugaaucaccgugugugua

SEQ ID NO: 358284 - RNA, 64 nt, hsa
uugcaaauauuaugcuauauguaauaccuaacuguaucuguaguguauauguaauauauuuaug

SEQ ID NO: 358285 - RNA, 64 nt, hsa
uauauagcuacauacgcauguauauauuacagcuuaucuguaagaagaaaaugcauuuuaaaca

SEQ ID NO: 358286 - RNA, 64 nt, hsa
cuauuagggaagcaguuugccauuguugcagaguuaucuguacuuuguuuaacugaaaaaaaug

SEQ ID NO: 358287 - RNA, 64 nt, hsa
guauaaaauaguuuuaguaguccaaaaugucaacuaucuguagcugcuuuugugugugugucag

SEQ ID NO: 358288 - RNA, 64 nt, hsa
uucagauguuuaucaguucccaacauuguuucuuuaucuguagugggaucuugaguaaugaggc

SEQ ID NO: 358289 - RNA, 64 nt, hsa
uaaauaaaacaauguaauuacauuaaaauggaccuaucuguaagagguacuaaaaacacuggau

SEQ ID NO: 358290 - RNA, 64 nt, hsa
guaagacuuuaagaagcgaacaaaaaguaauguauaucuguaauauauaaucaaaugauucauu

SEQ ID NO: 358291 - RNA, 64 nt, hsa
uuguaaaaucaaauuacauauauauaaaaaaaccuaucuguauuagacaaaaacuguuuuuauu

SEQ ID NO: 358292 - RNA, 64 nt, hsa
auuguuaaaguuuuuauauguuguaagauugauguaucuguaaauauugcaguuuuuaugauuu

SEQ ID NO: 358293 - RNA, 64 nt, hsa
guaccuagugaguggaguuugcuuuguuuuaugguaucuguacuccugguauauucaagcacug

SEQ ID NO: 358294 - RNA, 64 nt, hsa
caccacaauaauaaaucgggugaagugugcacaauaucuguauuuugaauggcuauggcguuag

SEQ ID NO: 358295 - RNA, 64 nt, hsa
auuaaugaaauaucuguauuuaauuuugacacuauaucuguauauaaaauauuuucauacagca

SEQ ID NO: 358296 - RNA, 64 nt, hsa
auaauaauauauguuuaccuuuuaauuaaugaaauaucuguauuuaauuuugacacuauaucug

SEQ ID NO: 358297 - RNA, 64 nt, hsa
ccauauuuuucuguguggaguauuuuuauaauuuuaucuguauaagcuguaauaucauuuuaua

SEQ ID NO: 358298 - RNA, 64 nt, hsa
aaagccauauuuuuuucuguaaaaguuacuaauauaucuguaacacuauuacaguauugcuauu

SEQ ID NO: 358299 - RNA, 64 nt, hsa
ugcauuuuugaaguauaaagucauaaauuguacauaucuguaagcuaguauauuuguuucacug

SEQ ID NO: 358300 - RNA, 64 nt, hsa
gaaacagaaguuauucacuguguuuuugaugaucuaucuguauuggaaauauguuccuggaaaa

SEQ ID NO: 358301 - RNA, 64 nt, hsa
ccauguguggacauccugggacuuguuuacauuuuaucuguaauaagauaacugacucacaaca

SEQ ID NO: 358302 - RNA, 64 nt, hsa
gguaugacuuauugacaaccaguugggacaauuuuaucuguaacucucugggugacaugauacc

SEQ ID NO: 358303 - RNA, 64 nt, hsa
ugcuucugggagacacccaaagggugaagcuauuuaucuguaguaaacuauuuaucuguguuuu

SEQ ID NO: 358304 - RNA, 64 nt, hsa
aggcacaaaaggguuuaaacugauucauaauaaauaucuguacuucuucgaucuucaccuuuug

SEQ ID NO: 358305 - RNA, 64 nt, hsa
uguuuauauguaaauguuuguaaguauaugggccuaucuguaaguggauaagucuguaugugug

SEQ ID NO: 358306 - RNA, 64 nt, hsa
gugaaaacagacauuccagugccacccaaauauauaucuguaacgugcccaagaaauccuagcu

SEQ ID NO: 358307 - RNA, 64 nt, hsa
auaacucuguggcauuauugcauuauauaccauuuaucuguauuaacuuuggaauguacucugu

SEQ ID NO: 358308 - RNA, 64 nt, hsa
caaaaaaaaaguuccagguguggaauauggggguuaucuguacauccuggggcauuaaaaaaaa

SEQ ID NO: 358309 - RNA, 64 nt, hsa
aaugacuauucuccagguuguugcacuaccgcuguaucuguacauaauucuaacuuggcaccug

SEQ ID NO: 358310 - RNA, 64 nt, hsa
cagaugugugccuccagauggcaguauacuacacuaucuguaaaauauauuugcaaagccaggc

SEQ ID NO: 358311 - RNA, 64 nt, hsa; identical to SEQ ID NO: 271341

SEQ ID NO: 358312 - RNA, 64 nt, hsa; identical to SEQ ID NO: 271342

SEQ ID NO: 358313 - RNA, 64 nt, hsa; identical to SEQ ID NO: 271343

SEQ ID NO: 358314 - RNA, 64 nt, hsa; identical to SEQ ID NO: 271344

SEQ ID NO: 358315 - RNA, 64 nt, hsa; identical to SEQ ID NO: 271345

SEQ ID NO: 358316 - RNA, 64 nt, hsa; identical to SEQ ID NO: 271346

SEQ ID NO: 358317 - RNA, 64 nt, hsa; identical to SEQ ID NO: 271347

SEQ ID NO: 358318 - RNA, 64 nt, hsa; identical to SEQ ID NO: 271348

SEQ ID NO: 358319 - RNA, 64 nt, hsa; identical to SEQ ID NO: 271349

SEQ ID NO: 358320 - RNA, 64 nt, hsa; identical to SEQ ID NO: 271350

SEQ ID NO: 358321 - RNA, 64 nt, hsa; identical to SEQ ID NO: 271351

SEQ ID NO: 358322 - RNA, 64 nt, hsa; identical to SEQ ID NO: 271352

SEQ ID NO: 358323 - RNA, 64 nt, hsa; identical to SEQ ID NO: 271353

SEQ ID NO: 358324 - RNA, 64 nt, hsa; identical to SEQ ID NO: 271354

SEQ ID NO: 358325 - RNA, 64 nt, hsa; identical to SEQ ID NO: 271355

SEQ ID NO: 358326 - RNA, 64 nt, hsa; identical to SEQ ID NO: 271356

SEQ ID NO: 358327 - RNA, 64 nt, hsa; identical to SEQ ID NO: 271357

SEQ ID NO: 358328 - RNA, 52 nt, hsa; identical to SEQ ID NO: 271358

SEQ ID NO: 358329 - RNA, 64 nt, hsa; identical to SEQ ID NO: 271359

SEQ ID NO: 358330 - RNA, 64 nt, hsa; identical to SEQ ID NO: 271360

SEQ ID NO: 358331 - RNA, 64 nt, hsa; identical to SEQ ID NO: 271361

SEQ ID NO: 358332 - RNA, 64 nt, hsa; identical to SEQ ID NO: 271362

SEQ ID NO: 358333 - RNA, 64 nt, hsa; identical to SEQ ID NO: 271363

SEQ ID NO: 358334 - RNA, 64 nt, hsa; identical to SEQ ID NO: 271364

SEQ ID NO: 358335 - RNA, 64 nt, hsa; identical to SEQ ID NO: 271365

SEQ ID NO: 358336 - RNA, 64 nt, hsa; identical to SEQ ID NO: 271366

SEQ ID NO: 358337 - RNA, 64 nt, hsa; identical to SEQ ID NO: 271367

SEQ ID NO: 358338 - RNA, 64 nt, hsa; identical to SEQ ID NO: 271368

SEQ ID NO: 358339 - RNA, 64 nt, hsa; identical to SEQ ID NO: 271369

SEQ ID NO: 358340 - RNA, 64 nt, hsa; identical to SEQ ID NO: 271370

SEQ ID NO: 358341 - RNA, 64 nt, hsa; identical to SEQ ID NO: 271371

SEQ ID NO: 358342 - RNA, 64 nt, hsa; identical to SEQ ID NO: 271372

SEQ ID NO: 358343 - RNA, 64 nt, hsa; identical to SEQ ID NO: 271373

SEQ ID NO: 358344 - RNA, 64 nt, hsa; identical to SEQ ID NO: 271374

SEQ ID NO: 358345 - RNA, 64 nt, hsa; identical to SEQ ID NO: 271375

SEQ ID NO: 358346 - RNA, 64 nt, hsa; identical to SEQ ID NO: 271376

SEQ ID NO: 358347 - RNA, 64 nt, hsa; identical to SEQ ID NO: 271377

SEQ ID NO: 358348 - RNA, 64 nt, hsa; identical to SEQ ID NO: 271378

SEQ ID NO: 358349 - RNA, 64 nt, hsa; identical to SEQ ID NO: 271379

SEQ ID NO: 358350 - RNA, 64 nt, hsa; identical to SEQ ID NO: 271380

SEQ ID NO: 358351 - RNA, 64 nt, hsa; identical to SEQ ID NO: 271381

SEQ ID NO: 358352 - RNA, 64 nt, hsa; identical to SEQ ID NO: 271382

SEQ ID NO: 358353 - RNA, 64 nt, hsa; identical to SEQ ID NO: 271383

SEQ ID NO: 358354 - RNA, 64 nt, hsa; identical to SEQ ID NO: 271384

SEQ ID NO: 358355 - RNA, 64 nt, hsa; identical to SEQ ID NO: 271385

SEQ ID NO: 358356 - RNA, 64 nt, hsa; identical to SEQ ID NO: 271386

SEQ ID NO: 358357 - RNA, 64 nt, hsa; identical to SEQ ID NO: 271387

SEQ ID NO: 358358 - RNA, 64 nt, hsa; identical to SEQ ID NO: 271388

SEQ ID NO: 358359 - RNA, 64 nt, hsa; identical to SEQ ID NO: 271389

SEQ ID NO: 358360 - RNA, 64 nt, hsa; identical to SEQ ID NO: 271390

SEQ ID NO: 358361 - RNA, 64 nt, hsa; identical to SEQ ID NO: 271391

SEQ ID NO: 358362 - RNA, 64 nt, hsa; identical to SEQ ID NO: 271392

SEQ ID NO: 358363 - RNA, 64 nt, hsa; identical to SEQ ID NO: 271393

SEQ ID NO: 358364 - RNA, 64 nt, hsa; identical to SEQ ID NO: 271394

SEQ ID NO: 358365 - RNA, 64 nt, hsa; identical to SEQ ID NO: 271395

SEQ ID NO: 358366 - RNA, 64 nt, hsa; identical to SEQ ID NO: 271396

SEQ ID NO: 358367 - RNA, 64 nt, hsa; identical to SEQ ID NO: 271397

SEQ ID NO: 358368 - RNA, 64 nt, hsa; identical to SEQ ID NO: 271398

SEQ ID NO: 358369 - RNA, 64 nt, hsa; identical to SEQ ID NO: 271399

SEQ ID NO: 358370 - RNA, 64 nt, hsa; identical to SEQ ID NO: 271400

SEQ ID NO: 358371 - RNA, 64 nt, hsa; identical to SEQ ID NO: 271401

SEQ ID NO: 358372 - RNA, 64 nt, hsa; identical to SEQ ID NO: 271402

SEQ ID NO: 358373 - RNA, 64 nt, hsa; identical to SEQ ID NO: 271403

SEQ ID NO: 358374 - RNA, 64 nt, hsa; identical to SEQ ID NO: 271404

SEQ ID NO: 358375 - RNA, 64 nt, hsa; identical to SEQ ID NO: 271405

SEQ ID NO: 358376 - RNA, 64 nt, hsa; identical to SEQ ID NO: 271406

SEQ ID NO: 358377 - RNA, 64 nt, hsa; identical to SEQ ID NO: 271407

SEQ ID NO: 358378 - RNA, 64 nt, hsa; identical to SEQ ID NO: 271408

SEQ ID NO: 358379 - RNA, 64 nt, hsa; identical to SEQ ID NO: 271409

SEQ ID NO: 358380 - RNA, 64 nt, hsa; identical to SEQ ID NO: 271410

SEQ ID NO: 358381 - RNA, 64 nt, hsa; identical to SEQ ID NO: 271411

SEQ ID NO: 358382 - RNA, 64 nt, hsa; identical to SEQ ID NO: 271412

SEQ ID NO: 358383 - RNA, 64 nt, hsa; identical to SEQ ID NO: 271413

SEQ ID NO: 358384 - RNA, 64 nt, hsa; identical to SEQ ID NO: 271414

SEQ ID NO: 358385 - RNA, 64 nt, hsa; identical to SEQ ID NO: 271415

SEQ ID NO: 358386 - RNA, 64 nt, hsa; identical to SEQ ID NO: 271416

SEQ ID NO: 358387 - RNA, 64 nt, hsa; identical to SEQ ID NO: 271417

SEQ ID NO: 358388 - RNA, 64 nt, hsa; identical to SEQ ID NO: 271418

SEQ ID NO: 358389 - RNA, 64 nt, hsa; identical to SEQ ID NO: 271419

SEQ ID NO: 358390 - RNA, 64 nt, hsa; identical to SEQ ID NO: 271420

SEQ ID NO: 358391 - RNA, 64 nt, hsa; identical to SEQ ID NO: 271421

SEQ ID NO: 358392 - RNA, 64 nt, hsa; identical to SEQ ID NO: 271422

SEQ ID NO: 358393 - RNA, 64 nt, hsa; identical to SEQ ID NO: 271423

SEQ ID NO: 358394 - RNA, 64 nt, hsa; identical to SEQ ID NO: 271424

SEQ ID NO: 358395 - RNA, 64 nt, hsa; identical to SEQ ID NO: 271425

SEQ ID NO: 358396 - RNA, 64 nt, hsa; identical to SEQ ID NO: 271426

SEQ ID NO: 358397 - RNA, 64 nt, hsa; identical to SEQ ID NO: 271427

SEQ ID NO: 358398 - RNA, 64 nt, hsa; identical to SEQ ID NO: 271428

SEQ ID NO: 358399 - RNA, 64 nt, hsa; identical to SEQ ID NO: 271429

SEQ ID NO: 358400 - RNA, 64 nt, hsa; identical to SEQ ID NO: 271430

SEQ ID NO: 358401 - RNA, 64 nt, hsa; identical to SEQ ID NO: 271431

SEQ ID NO: 358402 - RNA, 64 nt, hsa; identical to SEQ ID NO: 271432

SEQ ID NO: 358403 - RNA, 64 nt, hsa; identical to SEQ ID NO: 271433

SEQ ID NO: 358404 - RNA, 64 nt, hsa; identical to SEQ ID NO: 271434

SEQ ID NO: 358405 - RNA, 64 nt, hsa; identical to SEQ ID NO: 271435

SEQ ID NO: 358406 - RNA, 64 nt, hsa; identical to SEQ ID NO: 271436

SEQ ID NO: 358407 - RNA, 64 nt, hsa; identical to SEQ ID NO: 271437

SEQ ID NO: 358408 - RNA, 64 nt, hsa; identical to SEQ ID NO: 271438

SEQ ID NO: 358409 - RNA, 64 nt, hsa; identical to SEQ ID NO: 271439

SEQ ID NO: 358410 - RNA, 64 nt, hsa; identical to SEQ ID NO: 271440

SEQ ID NO: 358411 - RNA, 64 nt, hsa; identical to SEQ ID NO: 271441

SEQ ID NO: 358412 - RNA, 64 nt, hsa; identical to SEQ ID NO: 271442

SEQ ID NO: 358413 - RNA, 64 nt, hsa; identical to SEQ ID NO: 271443

SEQ ID NO: 358414 - RNA, 64 nt, hsa; identical to SEQ ID NO: 271444

SEQ ID NO: 358415 - RNA, 64 nt, hsa; identical to SEQ ID NO: 271445

SEQ ID NO: 358416 - RNA, 64 nt, hsa; identical to SEQ ID NO: 271446

SEQ ID NO: 358417 - RNA, 64 nt, hsa; identical to SEQ ID NO: 271447

SEQ ID NO: 358418 - RNA, 64 nt, hsa; identical to SEQ ID NO: 271448

SEQ ID NO: 358419 - RNA, 64 nt, hsa; identical to SEQ ID NO: 271449

SEQ ID NO: 358420 - RNA, 64 nt, hsa; identical to SEQ ID NO: 271450

SEQ ID NO: 358421 - RNA, 64 nt, hsa; identical to SEQ ID NO: 271451

SEQ ID NO: 358422 - RNA, 64 nt, hsa; identical to SEQ ID NO: 271452

SEQ ID NO: 358423 - RNA, 64 nt, hsa; identical to SEQ ID NO: 271453

SEQ ID NO: 358424 - RNA, 64 nt, hsa; identical to SEQ ID NO: 271454

SEQ ID NO: 358425 - RNA, 64 nt, hsa; identical to SEQ ID NO: 271455

SEQ ID NO: 358426 - RNA, 64 nt, hsa; identical to SEQ ID NO: 271456

SEQ ID NO: 358427 - RNA, 64 nt, hsa; identical to SEQ ID NO: 271457

SEQ ID NO: 358428 - RNA, 64 nt, hsa; identical to SEQ ID NO: 271458

SEQ ID NO: 358429 - RNA, 64 nt, hsa; identical to SEQ ID NO: 271459

SEQ ID NO: 358430 - RNA, 64 nt, hsa; identical to SEQ ID NO: 271460

SEQ ID NO: 358431 - RNA, 64 nt, hsa; identical to SEQ ID NO: 271461

SEQ ID NO: 358432 - RNA, 64 nt, hsa; identical to SEQ ID NO: 271462

SEQ ID NO: 358433 - RNA, 64 nt, hsa; identical to SEQ ID NO: 271463

SEQ ID NO: 358434 - RNA, 64 nt, hsa; identical to SEQ ID NO: 271464

SEQ ID NO: 358435 - RNA, 64 nt, hsa; identical to SEQ ID NO: 271465

SEQ ID NO: 358436 - RNA, 64 nt, hsa; identical to SEQ ID NO: 271466

SEQ ID NO: 358437 - RNA, 64 nt, hsa; identical to SEQ ID NO: 271467

SEQ ID NO: 358438 - RNA, 64 nt, hsa; identical to SEQ ID NO: 271468

SEQ ID NO: 358439 - RNA, 64 nt, hsa; identical to SEQ ID NO: 271469

SEQ ID NO: 358440 - RNA, 64 nt, hsa; identical to SEQ ID NO: 271470

SEQ ID NO: 358441 - RNA, 64 nt, hsa; identical to SEQ ID NO: 271471

SEQ ID NO: 358442 - RNA, 64 nt, hsa; identical to SEQ ID NO: 271472

SEQ ID NO: 358443 - RNA, 64 nt, hsa; identical to SEQ ID NO: 271473

SEQ ID NO: 358444 - RNA, 64 nt, hsa; identical to SEQ ID NO: 271474

SEQ ID NO: 358445 - RNA, 64 nt, hsa; identical to SEQ ID NO: 271475

SEQ ID NO: 358446 - RNA, 64 nt, hsa; identical to SEQ ID NO: 271476

SEQ ID NO: 358447 - RNA, 64 nt, hsa; identical to SEQ ID NO: 271477

SEQ ID NO: 358448 - RNA, 64 nt, hsa; identical to SEQ ID NO: 271478

SEQ ID NO: 358449 - RNA, 64 nt, hsa; identical to SEQ ID NO: 271479

SEQ ID NO: 358450 - RNA, 64 nt, hsa; identical to SEQ ID NO: 271480

SEQ ID NO: 358451 - RNA, 64 nt, hsa; identical to SEQ ID NO: 271481

SEQ ID NO: 358452 - RNA, 64 nt, hsa; identical to SEQ ID NO: 271482

SEQ ID NO: 358453 - RNA, 64 nt, hsa; identical to SEQ ID NO: 271483

SEQ ID NO: 358454 - RNA, 64 nt, hsa; identical to SEQ ID NO: 271484

SEQ ID NO: 358455 - RNA, 64 nt, hsa; identical to SEQ ID NO: 271485

SEQ ID NO: 358456 - RNA, 64 nt, hsa; identical to SEQ ID NO: 271486

SEQ ID NO: 358457 - RNA, 64 nt, hsa; identical to SEQ ID NO: 271487

SEQ ID NO: 358458 - RNA, 64 nt, hsa; identical to SEQ ID NO: 271488

SEQ ID NO: 358459 - RNA, 64 nt, hsa; identical to SEQ ID NO: 271489

SEQ ID NO: 358460 - RNA, 64 nt, hsa; identical to SEQ ID NO: 271490

SEQ ID NO: 358461 - RNA, 64 nt, hsa; identical to SEQ ID NO: 271491

SEQ ID NO: 358462 - RNA, 64 nt, hsa; identical to SEQ ID NO: 271492

SEQ ID NO: 358463 - RNA, 64 nt, hsa; identical to SEQ ID NO: 271493

SEQ ID NO: 358464 - RNA, 64 nt, hsa; identical to SEQ ID NO: 271494

SEQ ID NO: 358465 - RNA, 64 nt, hsa; identical to SEQ ID NO: 271495

SEQ ID NO: 358466 - RNA, 64 nt, hsa; identical to SEQ ID NO: 271496

SEQ ID NO: 358467 - RNA, 64 nt, hsa; identical to SEQ ID NO: 271497

SEQ ID NO: 358468 - RNA, 64 nt, hsa; identical to SEQ ID NO: 271498

SEQ ID NO: 358469 - RNA, 64 nt, hsa; identical to SEQ ID NO: 271499

SEQ ID NO: 358470 - RNA, 64 nt, hsa; identical to SEQ ID NO: 271500

SEQ ID NO: 358471 - RNA, 64 nt, hsa; identical to SEQ ID NO: 271501

SEQ ID NO: 358472 - RNA, 64 nt, hsa; identical to SEQ ID NO: 271502

SEQ ID NO: 358473 - RNA, 64 nt, hsa; identical to SEQ ID NO: 271503

SEQ ID NO: 358474 - RNA, 64 nt, hsa; identical to SEQ ID NO: 271504

SEQ ID NO: 358475 - RNA, 64 nt, hsa; identical to SEQ ID NO: 271505

SEQ ID NO: 358476 - RNA, 64 nt, hsa; identical to SEQ ID NO: 271506

SEQ ID NO: 358477 - RNA, 64 nt, hsa; identical to SEQ ID NO: 271507

SEQ ID NO: 358478 - RNA, 64 nt, hsa; identical to SEQ ID NO: 271508

SEQ ID NO: 358479 - RNA, 64 nt, hsa; identical to SEQ ID NO: 271509

SEQ ID NO: 358480 - RNA, 64 nt, hsa; identical to SEQ ID NO: 271510

SEQ ID NO: 358481 - RNA, 64 nt, hsa; identical to SEQ ID NO: 271511

SEQ ID NO: 358482 - RNA, 64 nt, hsa; identical to SEQ ID NO: 271512

SEQ ID NO: 358483 - RNA, 64 nt, hsa; identical to SEQ ID NO: 271513

SEQ ID NO: 358484 - RNA, 64 nt, hsa; identical to SEQ ID NO: 271514

SEQ ID NO: 358485 - RNA, 64 nt, hsa; identical to SEQ ID NO: 271515

SEQ ID NO: 358486 - RNA, 64 nt, hsa; identical to SEQ ID NO: 271516

SEQ ID NO: 358487 - RNA, 64 nt, hsa; identical to SEQ ID NO: 271517

SEQ ID NO: 358488 - RNA, 64 nt, hsa; identical to SEQ ID NO: 271518

SEQ ID NO: 358489 - RNA, 64 nt, hsa; identical to SEQ ID NO: 271519

SEQ ID NO: 358490 - RNA, 64 nt, hsa; identical to SEQ ID NO: 271520

SEQ ID NO: 358491 - RNA, 64 nt, hsa; identical to SEQ ID NO: 271520

SEQ ID NO: 358492 - RNA, 64 nt, hsa; identical to SEQ ID NO: 271522

SEQ ID NO: 358493 - RNA, 64 nt, hsa; identical to SEQ ID NO: 271523

SEQ ID NO: 358494 - RNA, 64 nt, hsa; identical to SEQ ID NO: 271524

SEQ ID NO: 358495 - RNA, 64 nt, hsa; identical to SEQ ID NO: 271525

SEQ ID NO: 358496 - RNA, 64 nt, hsa; identical to SEQ ID NO: 271526

SEQ ID NO: 358497 - RNA, 64 nt, hsa; identical to SEQ ID NO: 271527

SEQ ID NO: 358498 - RNA, 64 nt, hsa; identical to SEQ ID NO: 271528

SEQ ID NO: 358499 - RNA, 64 nt, hsa; identical to SEQ ID NO: 271529

SEQ ID NO: 358500 - RNA, 64 nt, hsa; identical to SEQ ID NO: 271530

SEQ ID NO: 358501 - RNA, 64 nt, hsa; identical to SEQ ID NO: 271531

SEQ ID NO: 358502 - RNA, 64 nt, hsa; identical to SEQ ID NO: 271532

SEQ ID NO: 358503 - RNA, 64 nt, hsa; identical to SEQ ID NO: 271533

SEQ ID NO: 358504 - RNA, 64 nt, hsa; identical to SEQ ID NO: 271534

SEQ ID NO: 358505 - RNA, 64 nt, hsa; identical to SEQ ID NO: 271535

SEQ ID NO: 358506 - RNA, 64 nt, hsa; identical to SEQ ID NO: 271536

SEQ ID NO: 358507 - RNA, 64 nt, hsa; identical to SEQ ID NO: 271537

SEQ ID NO: 358508 - RNA, 64 nt, hsa; identical to SEQ ID NO: 271538

SEQ ID NO: 358509 - RNA, 64 nt, hsa; identical to SEQ ID NO: 271539

SEQ ID NO: 358510 - RNA, 64 nt, hsa; identical to SEQ ID NO: 271540

SEQ ID NO: 358511 - RNA, 64 nt, hsa; identical to SEQ ID NO: 271541

SEQ ID NO: 358512 - RNA, 64 nt, hsa; identical to SEQ ID NO: 271542

SEQ ID NO: 358513 - RNA, 64 nt, hsa; identical to SEQ ID NO: 271543

SEQ ID NO: 358514 - RNA, 64 nt, hsa; identical to SEQ ID NO: 271544

SEQ ID NO: 358515 - RNA, 64 nt, hsa; identical to SEQ ID NO: 271545

SEQ ID NO: 358516 - RNA, 64 nt, hsa; identical to SEQ ID NO: 271546

SEQ ID NO: 358517 - RNA, 64 nt, hsa; identical to SEQ ID NO: 271547

SEQ ID NO: 358518 - RNA, 64 nt, hsa; identical to SEQ ID NO: 271548

SEQ ID NO: 358519 - RNA, 64 nt, hsa; identical to SEQ ID NO: 271549

SEQ ID NO: 358520 - RNA, 64 nt, hsa; identical to SEQ ID NO: 271550

SEQ ID NO: 358521 - RNA, 64 nt, hsa; identical to SEQ ID NO: 271551

SEQ ID NO: 358522 - RNA, 64 nt, hsa; identical to SEQ ID NO: 271552

SEQ ID NO: 358523 - RNA, 64 nt, hsa; identical to SEQ ID NO: 271553

SEQ ID NO: 358524 - RNA, 64 nt, hsa; identical to SEQ ID NO: 271554

SEQ ID NO: 358525 - RNA, 64 nt, hsa; identical to SEQ ID NO: 271555

SEQ ID NO: 358526 - RNA, 64 nt, hsa; identical to SEQ ID NO: 271556

SEQ ID NO: 358527 - RNA, 64 nt, hsa; identical to SEQ ID NO: 271557

SEQ ID NO: 358528 - RNA, 64 nt, hsa; identical to SEQ ID NO: 271558

SEQ ID NO: 358529 - RNA, 64 nt, hsa; identical to SEQ ID NO: 271559

SEQ ID NO: 358530 - RNA, 64 nt, hsa; identical to SEQ ID NO: 271560

SEQ ID NO: 358531 - RNA, 64 nt, hsa; identical to SEQ ID NO: 271561

SEQ ID NO: 358532 - RNA, 64 nt, hsa; identical to SEQ ID NO: 271562

SEQ ID NO: 358533 - RNA, 64 nt, hsa; identical to SEQ ID NO: 271563

SEQ ID NO: 358534 - RNA, 64 nt, hsa; identical to SEQ ID NO: 271564

SEQ ID NO: 358535 - RNA, 64 nt, hsa; identical to SEQ ID NO: 271565

SEQ ID NO: 358536 - RNA, 64 nt, hsa; identical to SEQ ID NO: 271566

SEQ ID NO: 358537 - RNA, 64 nt, hsa; identical to SEQ ID NO: 271567

SEQ ID NO: 358538 - RNA, 52 nt, hsa; identical to SEQ ID NO: 271358

SEQ ID NO: 358539 - RNA, 64 nt, hsa; identical to SEQ ID NO: 271569

SEQ ID NO: 358540 - RNA, 64 nt, hsa; identical to SEQ ID NO: 271570

SEQ ID NO: 358541 - RNA, 64 nt, hsa; identical to SEQ ID NO: 73772

SEQ ID NO: 358542 - RNA, 64 nt, hsa; identical to SEQ ID NO: 73773

SEQ ID NO: 358543 - RNA, 64 nt, hsa; identical to SEQ ID NO: 73774

SEQ ID NO: 358544 - RNA, 64 nt, hsa; identical to SEQ ID NO: 73775

SEQ ID NO: 358545 - RNA, 64 nt, hsa; identical to SEQ ID NO: 73776

SEQ ID NO: 358546 - RNA, 64 nt, hsa; identical to SEQ ID NO: 73777

SEQ ID NO: 358547 - RNA, 64 nt, hsa; identical to SEQ ID NO: 73778

SEQ ID NO: 358548 - RNA, 64 nt, hsa; identical to SEQ ID NO: 73779

SEQ ID NO: 358549 - RNA, 64 nt, hsa; identical to SEQ ID NO: 73780

SEQ ID NO: 358550 - RNA, 64 nt, hsa; identical to SEQ ID NO: 73781

SEQ ID NO: 358551 - RNA, 64 nt, hsa; identical to SEQ ID NO: 73782

SEQ ID NO: 358552 - RNA, 64 nt, hsa; identical to SEQ ID NO: 73783

SEQ ID NO: 358553 - RNA, 64 nt, hsa; identical to SEQ ID NO: 73784

SEQ ID NO: 358554 - RNA, 64 nt, hsa; identical to SEQ ID NO: 73785

SEQ ID NO: 358555 - RNA, 64 nt, hsa; identical to SEQ ID NO: 73786

SEQ ID NO: 358556 - RNA, 64 nt, hsa; identical to SEQ ID NO: 73787

SEQ ID NO: 358557 - RNA, 64 nt, hsa; identical to SEQ ID NO: 73788

SEQ ID NO: 358558 - RNA, 64 nt, hsa; identical to SEQ ID NO: 73789

SEQ ID NO: 358559 - RNA, 64 nt, hsa; identical to SEQ ID NO: 73790

SEQ ID NO: 358560 - RNA, 64 nt, hsa; identical to SEQ ID NO: 73791

SEQ ID NO: 358561 - RNA, 64 nt, hsa; identical to SEQ ID NO: 73792

SEQ ID NO: 358562 - RNA, 64 nt, hsa; identical to SEQ ID NO: 73793

SEQ ID NO: 358563 - RNA, 64 nt, hsa; identical to SEQ ID NO: 73794

SEQ ID NO: 358564 - RNA, 64 nt, hsa; identical to SEQ ID NO: 73795

SEQ ID NO: 358565 - RNA, 64 nt, hsa; identical to SEQ ID NO: 73796

SEQ ID NO: 358566 - RNA, 64 nt, hsa; identical to SEQ ID NO: 73797

SEQ ID NO: 358567 - RNA, 64 nt, hsa; identical to SEQ ID NO: 73798

SEQ ID NO: 358568 - RNA, 64 nt, hsa; identical to SEQ ID NO: 73799

SEQ ID NO: 358569 - RNA, 64 nt, hsa; identical to SEQ ID NO: 73800

SEQ ID NO: 358570 - RNA, 64 nt, hsa; identical to SEQ ID NO: 73801

SEQ ID NO: 358571 - RNA, 64 nt, hsa; identical to SEQ ID NO: 73802

SEQ ID NO: 358572 - RNA, 64 nt, hsa; identical to SEQ ID NO: 73803

SEQ ID NO: 358573 - RNA, 64 nt, hsa; identical to SEQ ID NO: 73804

SEQ ID NO: 358574 - RNA, 64 nt, hsa; identical to SEQ ID NO: 73805

SEQ ID NO: 358575 - RNA, 64 nt, hsa; identical to SEQ ID NO: 73806

SEQ ID NO: 358576 - RNA, 64 nt, hsa; identical to SEQ ID NO: 73807

SEQ ID NO: 358577 - RNA, 64 nt, hsa; identical to SEQ ID NO: 73808

SEQ ID NO: 358578 - RNA, 64 nt, hsa; identical to SEQ ID NO: 73809

SEQ ID NO: 358579 - RNA, 64 nt, hsa; identical to SEQ ID NO: 73810

SEQ ID NO: 358580 - RNA, 64 nt, hsa; identical to SEQ ID NO: 73811

SEQ ID NO: 358581 - RNA, 64 nt, hsa; identical to SEQ ID NO: 73812

SEQ ID NO: 358582 - RNA, 64 nt, hsa; identical to SEQ ID NO: 73813

SEQ ID NO: 358583 - RNA, 64 nt, hsa; identical to SEQ ID NO: 73814

SEQ ID NO: 358584 - RNA, 64 nt, hsa; identical to SEQ ID NO: 73815

SEQ ID NO: 358585 - RNA, 64 nt, hsa; identical to SEQ ID NO: 73816

SEQ ID NO: 358586 - RNA, 64 nt, hsa; identical to SEQ ID NO: 73817

SEQ ID NO: 358587 - RNA, 64 nt, hsa; identical to SEQ ID NO: 73818

SEQ ID NO: 358588 - RNA, 64 nt, hsa; identical to SEQ ID NO: 73819

SEQ ID NO: 358589 - RNA, 64 nt, hsa; identical to SEQ ID NO: 73820

SEQ ID NO: 358590 - RNA, 64 nt, hsa; identical to SEQ ID NO: 73821

SEQ ID NO: 358591 - RNA, 64 nt, hsa; identical to SEQ ID NO: 73822

SEQ ID NO: 358592 - RNA, 64 nt, hsa; identical to SEQ ID NO: 73823

SEQ ID NO: 358593 - RNA, 64 nt, hsa; identical to SEQ ID NO: 73824

SEQ ID NO: 358594 - RNA, 64 nt, hsa; identical to SEQ ID NO: 73825

SEQ ID NO: 358595 - RNA, 64 nt, hsa; identical to SEQ ID NO: 73826

SEQ ID NO: 358596 - RNA, 64 nt, hsa; identical to SEQ ID NO: 73827

SEQ ID NO: 358597 - RNA, 64 nt, hsa; identical to SEQ ID NO: 73828

SEQ ID NO: 358598 - RNA, 64 nt, hsa; identical to SEQ ID NO: 73829

SEQ ID NO: 358599 - RNA, 64 nt, hsa; identical to SEQ ID NO: 73830

SEQ ID NO: 358600 - RNA, 64 nt, hsa
uauguuuacaggcuuccuguuugaugaagauagcaacggaaaacucaaaaugguggcaguucuu

SEQ ID NO: 358601 - RNA, 64 nt, hsa
ggagaauucuggaguuguuaugaacaugaauaccaacggaaaaccuuaacugaaucuaaaagaa

SEQ ID NO: 358602 - RNA, 64 nt, hsa
uaccaauuuaugaauucuuguaagcggaauguaaaacggaaauacugaaagacuuuugccuaaa

SEQ ID NO: 358603 - RNA, 64 nt, hsa
ugaaugucaaucuggaaaauaaauugacuguauuaacggaaauaccacucuuuguguagauauu

SEQ ID NO: 358604 - RNA, 64 nt, hsa
aaugaggggaaagagccuggggaggagcuuaaaacucaaccacucuggaauuuacccauagaag

SEQ ID NO: 358605 - RNA, 64 nt, hsa
cccuuuguucaguggacgguuaaaccuucccccacucaaccaaucuuuuucuuuuuccuuuucu

SEQ ID NO: 358606 - RNA, 64 nt, hsa
cccccacagggcuggccuccccuagagggugggccucaaccaccugcucccgccacgcaccggu

SEQ ID NO: 358607 - RNA, 64 nt, hsa
ccagauuccgaaacucccauucuccaaugacuuccucaaccaauggguggccuugugacuguuc

SEQ ID NO: 358608 - RNA, 64 nt, hsa
ccaagcguaauuuuagccagcaguuucaguuauacucaaccaugcccuucugagcuguuaacaa

SEQ ID NO: 358609 - RNA, 64 nt, hsa
uuaaaaacaaaaacagggaauaaaagcuuuucaacucaaccacuucuuuguaagacaaaacuga

SEQ ID NO: 358610 - RNA, 64 nt, hsa
auaagcugacuguucucucuugagaaccuguggccucaaccagccaccaagcugauguggccca

SEQ ID NO: 358611 - RNA, 64 nt, hsa
acacagaauuaggcccuaaugagagccuuagacccucaaccaugcccccuucguuggcaucaca

SEQ ID NO: 358612 - RNA, 64 nt, hsa
guccacacccuacacagacuuggggcacuaugcucucaaccaguuugucagcccacuccucagg

SEQ ID NO: 358613 - RNA, 64 nt, hsa
caucugcuccgggaagccagcccagggcagccagcucaaccacuucuaccagaagaggcuccuu

SEQ ID NO: 358614 - RNA, 64 nt, hsa
cccccgcugcuucgaguuguccugccuuucugaacucaaccaauguauuucuuaaauguauuug

SEQ ID NO: 358615 - RNA, 64 nt, hsa
auuccuuuccauugaucccaggucuucagcuaagcucaaccaauugucaaccagaaaauguuua

SEQ ID NO: 358616 - RNA, 64 nt, hsa
acuuuuuagugguuggauuucaucccuuacuggucucaaccaaaauauuccuguuggaaucaug

SEQ ID NO: 358617 - RNA, 64 nt, hsa
auauuucuaaucagcgauaauuucuaccuauguucucaaccaacuuagccaguuuguuuuucag

SEQ ID NO: 358618 - RNA, 64 nt, hsa
aaaguauguuuuaaaugcuuugaagacugauacacucaaccaucuauauucaugagcucucaau

SEQ ID NO: 358619 - RNA, 64 nt, hsa
uucuuuaauuagggcuggaauaggaagccagugucucaaccauaguauugucucuuuaagucuu

SEQ ID NO: 358620 - RNA, 64 nt, hsa
agucuacuucuucaagggcaaagucuacuggcgccucaaccagcagcuucgaguagagaaaggc

SEQ ID NO: 358621 - RNA, 64 nt, hsa
agaaccuaaccuggaugcagcucucuauuggccucucaaccaaaagguguuccucuuuaaggua

SEQ ID NO: 358622 - RNA, 64 nt, hsa
gagcgaagcacauuacauauaucaucaaauuuaucucaaccauucgguccuuucucaacguucc

SEQ ID NO: 358623 - RNA, 64 nt, hsa
caguguuuagaacaguguccagcacaaacaggcacucaaccacuauuuguugaaugaacaaaug

SEQ ID NO: 358624 - RNA, 64 nt, hsa
caggacacagggacagguucugucaugggugacacgaggacacagggacagguucuaucauggg

SEQ ID NO: 358625 - RNA, 64 nt, hsa
caccuagccaggagggguagcaaaaauaaagucacgaggacauaguggucaccacugucaguua

SEQ ID NO: 358626 - RNA, 64 nt, hsa
uuaagagucucauauggcuaagauggagaaacagguacuggacuuuucccuccugcaugaaaca

SEQ ID NO: 358627 - RNA, 64 nt, hsa
agggagacuaagguggccggaacucgcggucacaguacuggagagagacacacagaucuaaguc

SEQ ID NO: 358628 - RNA, 64 nt, hsa
guccugaaguagaugguugagauaugaguucuucguacuggaaaagcccuuccguaguuuguuu

SEQ ID NO: 358629 - RNA, 64 nt, hsa
cuuacuacugggucauccuuggucuaugugcucuguacuggaggcucuguucugccucuuauca

SEQ ID NO: 358630 - RNA, 64 nt, hsa
uuuguacugacaaccuccuuggcuuauuuggggguggagcaauuguuuuauuccccaguuucag

SEQ ID NO: 358631 - RNA, 64 nt, hsa
ccagacaggaaagcuuuagaaaacuugagugaaauggagcaagcuugaaggaguuagaaucuuc

SEQ ID NO: 358632 - RNA, 64 nt, hsa
aggcagagaaagggacaaugauaguagagugauauggagcaagagauauuuugggcaugugggc

SEQ ID NO: 358633 - RNA, 64 nt, hsa
uucuguuuccuguaccaguaggagaucagaaaaauggagcaaagugguagguacuuuuugugaa

SEQ ID NO: 358634 - RNA, 64 nt, hsa
gcaggccacguacccaugacguaaacggcggcacuggagcaagcuggggcgggggguggguaaa

SEQ ID NO: 358635 - RNA, 64 nt, hsa
uuaggugggcaugaaauuuguuucccccagucccuggagcaaaccuuacaauuugccuuuagau

SEQ ID NO: 358636 - RNA, 64 nt, hsa
uuucccuaucaugcugcuucugaaaauucaguuuuggagcaaguccugugagcaagauaagaau

SEQ ID NO: 358637 - RNA, 64 nt, hsa
gcagguuauuuggggugaguggguggugggagccuggagcaagguggagggugcagaggggcug

SEQ ID NO: 358638 - RNA, 64 nt, hsa
aggaagagguugcuggagcaagaggagaggaugcuggagcaagaggagaggcugcuggagcuug

SEQ ID NO: 358639 - RNA, 64 nt, hsa
ugagucgccugaaccaagagcaggaagagguugcuggagcaagaggagaggaugcuggagcaag

SEQ ID NO: 358640 - RNA, 64 nt, hsa
gacgagagguuguuggagcaagaggagagguugcuggagcaagaggagagguugcuggagcugc

SEQ ID NO: 358641 - RNA, 64 nt, hsa
uugcugagauuguuggaacaagacgagagguuguuggagcaagaggagagguugcuggagcaag

SEQ ID NO: 358642 - RNA, 64 nt, hsa
gaggagagguugcuggagcaagaggagagguugcuggagcaagaggagaggcuacuggagcugc

SEQ ID NO: 358643 - RNA, 64 nt, hsa
gaggagaaguugcuggagcaagaggagagguugcuggagcaagaggagagguugcuggagcaag

SEQ ID NO: 358644 - RNA, 64 nt, hsa
uugcucagguuguuggagcaagaggagaaguugcuggagcaagaggagagguugcuggagcaag

SEQ ID NO: 358645 - RNA, 64 nt, hsa
ugaaccaagagcaggaagagguugcucagguuguuggagcaagaggagaaguugcuggagcaag

SEQ ID NO: 358646 - RNA, 64 nt, hsa
gcuuggcccccauggggaagacacggauggaagguggagcaaaggaaaauacaugaaauugaga

SEQ ID NO: 358647 - RNA, 64 nt, hsa
uaugauccagcuuuggucauacccaaggggaagguggagcaagaaaugaaaaggaaccugaauc

SEQ ID NO: 358648 - RNA, 64 nt, hsa; identical to SEQ ID NO: 124377

SEQ ID NO: 358649 - RNA, 64 nt, hsa; identical to SEQ ID NO: 124378

SEQ ID NO: 358650 - RNA, 64 nt, hsa; identical to SEQ ID NO: 124379

SEQ ID NO: 358651 - RNA, 64 nt, hsa; identical to SEQ ID NO: 124380

SEQ ID NO: 358652 - RNA, 64 nt, hsa; identical to SEQ ID NO: 124381

SEQ ID NO: 358653 - RNA, 64 nt, hsa; identical to SEQ ID NO: 124382

SEQ ID NO: 358654 - RNA, 64 nt, hsa; identical to SEQ ID NO: 124383

SEQ ID NO: 358655 - RNA, 64 nt, hsa; identical to SEQ ID NO: 124384

SEQ ID NO: 358656 - RNA, 64 nt, hsa; identical to SEQ ID NO: 165778

SEQ ID NO: 358657 - RNA, 64 nt, hsa; identical to SEQ ID NO: 165779

SEQ ID NO: 358658 - RNA, 64 nt, hsa; identical to SEQ ID NO: 165780

SEQ ID NO: 358659 - RNA, 64 nt, hsa; identical to SEQ ID NO: 165781

SEQ ID NO: 358660 - RNA, 64 nt, hsa; identical to SEQ ID NO: 165782

SEQ ID NO: 358661 - RNA, 64 nt, hsa; identical to SEQ ID NO: 165783

SEQ ID NO: 358662 - RNA, 64 nt, hsa; identical to SEQ ID NO: 165784

SEQ ID NO: 358663 - RNA, 64 nt, hsa; identical to SEQ ID NO: 165785

SEQ ID NO: 358664 - RNA, 64 nt, hsa; identical to SEQ ID NO: 165786

SEQ ID NO: 358665 - RNA, 64 nt, hsa; identical to SEQ ID NO: 165787

SEQ ID NO: 358666 - RNA, 64 nt, hsa; identical to SEQ ID NO: 165788

SEQ ID NO: 358667 - RNA, 64 nt, hsa; identical to SEQ ID NO: 165789

SEQ ID NO: 358668 - RNA, 64 nt, hsa; identical to SEQ ID NO: 165790

SEQ ID NO: 358669 - RNA, 64 nt, hsa; identical to SEQ ID NO: 165791

SEQ ID NO: 358670 - RNA, 64 nt, hsa; identical to SEQ ID NO: 165792

SEQ ID NO: 358671 - RNA, 64 nt, hsa; identical to SEQ ID NO: 165793

SEQ ID NO: 358672 - RNA, 64 nt, hsa; identical to SEQ ID NO: 165794

SEQ ID NO: 358673 - RNA, 64 nt, hsa; identical to SEQ ID NO: 165795

SEQ ID NO: 358674 - RNA, 64 nt, hsa; identical to SEQ ID NO: 165796

SEQ ID NO: 358675 - RNA, 64 nt, hsa; identical to SEQ ID NO: 165797

SEQ ID NO: 358676 - RNA, 64 nt, hsa; identical to SEQ ID NO: 165798

SEQ ID NO: 358677 - RNA, 64 nt, hsa; identical to SEQ ID NO: 165799

SEQ ID NO: 358678 - RNA, 64 nt, hsa
ugggggugucucacucucugucuuuauagccggcgguagccaccgggguggcucugucagaguu

SEQ ID NO: 358679 - RNA, 64 nt, hsa
ggaacugcccucccccuuagcucacagugccugcgguagccacucuaggucguuggccuuccuu

SEQ ID NO: 358680 - RNA, 64 nt, hsa; identical to SEQ ID NO: 107033

SEQ ID NO: 358681 - RNA, 64 nt, hsa; identical to SEQ ID NO: 107034

SEQ ID NO: 358682 - RNA, 64 nt, hsa; identical to SEQ ID NO: 107035

SEQ ID NO: 358683 - RNA, 64 nt, hsa; identical to SEQ ID NO: 107036

SEQ ID NO: 358684 - RNA, 64 nt, hsa; identical to SEQ ID NO: 107037

SEQ ID NO: 358685 - RNA, 64 nt, hsa; identical to SEQ ID NO: 107038

SEQ ID NO: 358686 - RNA, 64 nt, hsa; identical to SEQ ID NO: 107039

SEQ ID NO: 358687 - RNA, 64 nt, hsa; identical to SEQ ID NO: 107040

SEQ ID NO: 358688 - RNA, 64 nt, hsa; identical to SEQ ID NO: 107041

SEQ ID NO: 358689 - RNA, 64 nt, hsa; identical to SEQ ID NO: 107042

SEQ ID NO: 358690 - RNA, 64 nt, hsa; identical to SEQ ID NO: 107043

SEQ ID NO: 358691 - RNA, 64 nt, hsa; identical to SEQ ID NO: 107044

SEQ ID NO: 358692 - RNA, 64 nt, hsa; identical to SEQ ID NO: 107045

SEQ ID NO: 358693 - RNA, 64 nt, hsa; identical to SEQ ID NO: 107046

SEQ ID NO: 358694 - RNA, 64 nt, hsa; identical to SEQ ID NO: 107047

SEQ ID NO: 358695 - RNA, 64 nt, hsa; identical to SEQ ID NO: 107048

SEQ ID NO: 358696 - RNA, 64 nt, hsa; identical to SEQ ID NO: 107049

SEQ ID NO: 358697 - RNA, 64 nt, hsa; identical to SEQ ID NO: 107050

SEQ ID NO: 358698 - RNA, 64 nt, hsa; identical to SEQ ID NO: 107051

SEQ ID NO: 358699 - RNA, 64 nt, hsa; identical to SEQ ID NO: 107052

SEQ ID NO: 358700 - RNA, 64 nt, hsa; identical to SEQ ID NO: 107053

SEQ ID NO: 358701 - RNA, 64 nt, hsa; identical to SEQ ID NO: 107054

SEQ ID NO: 358702 - RNA, 64 nt, hsa; identical to SEQ ID NO: 107055

SEQ ID NO: 358703 - RNA, 64 nt, hsa; identical to SEQ ID NO: 107056

SEQ ID NO: 358704 - RNA, 64 nt, hsa; identical to SEQ ID NO: 107057

SEQ ID NO: 358705 - RNA, 64 nt, hsa; identical to SEQ ID NO: 107058

SEQ ID NO: 358706 - RNA, 64 nt, hsa; identical to SEQ ID NO: 107059

SEQ ID NO: 358707 - RNA, 64 nt, hsa; identical to SEQ ID NO: 107060

SEQ ID NO: 358708 - RNA, 64 nt, hsa; identical to SEQ ID NO: 107061

SEQ ID NO: 358709 - RNA, 64 nt, hsa; identical to SEQ ID NO: 107062

SEQ ID NO: 358710 - RNA, 64 nt, hsa; identical to SEQ ID NO: 107063

SEQ ID NO: 358711 - RNA, 64 nt, hsa; identical to SEQ ID NO: 107064

SEQ ID NO: 358712 - RNA, 64 nt, hsa; identical to SEQ ID NO: 107065

SEQ ID NO: 358713 - RNA, 64 nt, hsa; identical to SEQ ID NO: 107066

SEQ ID NO: 358714 - RNA, 64 nt, hsa; identical to SEQ ID NO: 107067

SEQ ID NO: 358715 - RNA, 64 nt, hsa; identical to SEQ ID NO: 107068

SEQ ID NO: 358716 - RNA, 64 nt, hsa; identical to SEQ ID NO: 107069

SEQ ID NO: 358717 - RNA, 64 nt, hsa; identical to SEQ ID NO: 107070

SEQ ID NO: 358718 - RNA, 64 nt, hsa; identical to SEQ ID NO: 107071

SEQ ID NO: 358719 - RNA, 64 nt, hsa; identical to SEQ ID NO: 107072

SEQ ID NO: 358720 - RNA, 64 nt, hsa; identical to SEQ ID NO: 107073

SEQ ID NO: 358721 - RNA, 62 nt, hsa; identical to SEQ ID NO: 107074

SEQ ID NO: 358722 - RNA, 64 nt, hsa; identical to SEQ ID NO: 107075

SEQ ID NO: 358723 - RNA, 64 nt, hsa; identical to SEQ ID NO: 107076

SEQ ID NO: 358724 - RNA, 64 nt, hsa; identical to SEQ ID NO: 107077

SEQ ID NO: 358725 - RNA, 64 nt, hsa; identical to SEQ ID NO: 107078

SEQ ID NO: 358726 - RNA, 64 nt, hsa; identical to SEQ ID NO: 107079

SEQ ID NO: 358727 - RNA, 64 nt, hsa; identical to SEQ ID NO: 107080

SEQ ID NO: 358728 - RNA, 64 nt, hsa; identical to SEQ ID NO: 107081

SEQ ID NO: 358729 - RNA, 64 nt, hsa; identical to SEQ ID NO: 107082

SEQ ID NO: 358730 - RNA, 64 nt, hsa; identical to SEQ ID NO: 107083

SEQ ID NO: 358731 - RNA, 64 nt, hsa; identical to SEQ ID NO: 107084

SEQ ID NO: 358732 - RNA, 64 nt, hsa; identical to SEQ ID NO: 107085

SEQ ID NO: 358733 - RNA, 64 nt, hsa; identical to SEQ ID NO: 107086

SEQ ID NO: 358734 - RNA, 64 nt, hsa; identical to SEQ ID NO: 107087

SEQ ID NO: 358735 - RNA, 64 nt, hsa; identical to SEQ ID NO: 107088

SEQ ID NO: 358736 - RNA, 64 nt, hsa; identical to SEQ ID NO: 107089

SEQ ID NO: 358737 - RNA, 64 nt, hsa; identical to SEQ ID NO: 107090

SEQ ID NO: 358738 - RNA, 64 nt, hsa; identical to SEQ ID NO: 107091

SEQ ID NO: 358739 - RNA, 64 nt, hsa; identical to SEQ ID NO: 107092

SEQ ID NO: 358740 - RNA, 64 nt, hsa; identical to SEQ ID NO: 107093

SEQ ID NO: 358741 - RNA, 64 nt, hsa; identical to SEQ ID NO: 107094

SEQ ID NO: 358742 - RNA, 64 nt, hsa; identical to SEQ ID NO: 107095

SEQ ID NO: 358743 - RNA, 64 nt, hsa; identical to SEQ ID NO: 107096

SEQ ID NO: 358744 - RNA, 64 nt, hsa; identical to SEQ ID NO: 107097

SEQ ID NO: 358745 - RNA, 64 nt, hsa; identical to SEQ ID NO: 107098

SEQ ID NO: 358746 - RNA, 64 nt, hsa; identical to SEQ ID NO: 107099

SEQ ID NO: 358747 - RNA, 64 nt, hsa; identical to SEQ ID NO: 107100

SEQ ID NO: 358748 - RNA, 64 nt, hsa; identical to SEQ ID NO: 107101

SEQ ID NO: 358749 - RNA, 64 nt, hsa; identical to SEQ ID NO: 107102

SEQ ID NO: 358750 - RNA, 64 nt, hsa; identical to SEQ ID NO: 107103

SEQ ID NO: 358751 - RNA, 64 nt, hsa; identical to SEQ ID NO: 107104

SEQ ID NO: 358752 - RNA, 64 nt, hsa; identical to SEQ ID NO: 107105

SEQ ID NO: 358753 - RNA, 64 nt, hsa; identical to SEQ ID NO: 107106

SEQ ID NO: 358754 - RNA, 64 nt, hsa; identical to SEQ ID NO: 107107

SEQ ID NO: 358755 - RNA, 64 nt, hsa; identical to SEQ ID NO: 107108

SEQ ID NO: 358756 - RNA, 64 nt, hsa; identical to SEQ ID NO: 107109

SEQ ID NO: 358757 - RNA, 64 nt, hsa; identical to SEQ ID NO: 107110

SEQ ID NO: 358758 - RNA, 64 nt, hsa; identical to SEQ ID NO: 107111

SEQ ID NO: 358759 - RNA, 64 nt, hsa; identical to SEQ ID NO: 107112

SEQ ID NO: 358760 - RNA, 64 nt, hsa; identical to SEQ ID NO: 107113

SEQ ID NO: 358761 - RNA, 64 nt, hsa; identical to SEQ ID NO: 107114

SEQ ID NO: 358762 - RNA, 64 nt, hsa; identical to SEQ ID NO: 107115

SEQ ID NO: 358763 - RNA, 64 nt, hsa; identical to SEQ ID NO: 107116

SEQ ID NO: 358764 - RNA, 64 nt, hsa; identical to SEQ ID NO: 107117

SEQ ID NO: 358765 - RNA, 64 nt, hsa; identical to SEQ ID NO: 107118

SEQ ID NO: 358766 - RNA, 64 nt, hsa; identical to SEQ ID NO: 107119

SEQ ID NO: 358767 - RNA, 64 nt, hsa; identical to SEQ ID NO: 107120

SEQ ID NO: 358768 - RNA, 64 nt, hsa; identical to SEQ ID NO: 107121

SEQ ID NO: 358769 - RNA, 64 nt, hsa; identical to SEQ ID NO: 107122

SEQ ID NO: 358770 - RNA, 64 nt, hsa; identical to SEQ ID NO: 107123

SEQ ID NO: 358771 - RNA, 64 nt, hsa; identical to SEQ ID NO: 107124

SEQ ID NO: 358772 - RNA, 64 nt, hsa; identical to SEQ ID NO: 107125

SEQ ID NO: 358773 - RNA, 64 nt, hsa; identical to SEQ ID NO: 107126

SEQ ID NO: 358774 - RNA, 64 nt, hsa; identical to SEQ ID NO: 107127

SEQ ID NO: 358775 - RNA, 64 nt, hsa; identical to SEQ ID NO: 107128

SEQ ID NO: 358776 - RNA, 64 nt, hsa; identical to SEQ ID NO: 107129

SEQ ID NO: 358777 - RNA, 64 nt, hsa; identical to SEQ ID NO: 107130

SEQ ID NO: 358778 - RNA, 64 nt, hsa; identical to SEQ ID NO: 107131

SEQ ID NO: 358779 - RNA, 64 nt, hsa; identical to SEQ ID NO: 107132

SEQ ID NO: 358780 - RNA, 64 nt, hsa; identical to SEQ ID NO: 107133

SEQ ID NO: 358781 - RNA, 64 nt, hsa; identical to SEQ ID NO: 107134

SEQ ID NO: 358782 - RNA, 64 nt, hsa; identical to SEQ ID NO: 107135

SEQ ID NO: 358783 - RNA, 64 nt, hsa; identical to SEQ ID NO: 107136

SEQ ID NO: 358784 - RNA, 64 nt, hsa; identical to SEQ ID NO: 107137

SEQ ID NO: 358785 - RNA, 64 nt, hsa; identical to SEQ ID NO: 107138

SEQ ID NO: 358786 - RNA, 64 nt, hsa; identical to SEQ ID NO: 107139

SEQ ID NO: 358787 - RNA, 64 nt, hsa; identical to SEQ ID NO: 107140

SEQ ID NO: 358788 - RNA, 64 nt, hsa; identical to SEQ ID NO: 107141

SEQ ID NO: 358789 - RNA, 64 nt, hsa; identical to SEQ ID NO: 107142

SEQ ID NO: 358790 - RNA, 64 nt, hsa; identical to SEQ ID NO: 107143

SEQ ID NO: 358791 - RNA, 64 nt, hsa; identical to SEQ ID NO: 107144

SEQ ID NO: 358792 - RNA, 64 nt, hsa; identical to SEQ ID NO: 107145

SEQ ID NO: 358793 - RNA, 64 nt, hsa; identical to SEQ ID NO: 107146

SEQ ID NO: 358794 - RNA, 64 nt, hsa; identical to SEQ ID NO: 107147

SEQ ID NO: 358795 - RNA, 64 nt, hsa; identical to SEQ ID NO: 107148

SEQ ID NO: 358796 - RNA, 64 nt, hsa; identical to SEQ ID NO: 107149

SEQ ID NO: 358797 - RNA, 64 nt, hsa; identical to SEQ ID NO: 107150

SEQ ID NO: 358798 - RNA, 64 nt, hsa; identical to SEQ ID NO: 107151

SEQ ID NO: 358799 - RNA, 64 nt, hsa; identical to SEQ ID NO: 107152

SEQ ID NO: 358800 - RNA, 64 nt, hsa; identical to SEQ ID NO: 107153

SEQ ID NO: 358801 - RNA, 64 nt, hsa; identical to SEQ ID NO: 107154

SEQ ID NO: 358802 - RNA, 64 nt, hsa; identical to SEQ ID NO: 107155

SEQ ID NO: 358803 - RNA, 64 nt, hsa; identical to SEQ ID NO: 107156

SEQ ID NO: 358804 - RNA, 64 nt, hsa; identical to SEQ ID NO: 107157

SEQ ID NO: 358805 - RNA, 64 nt, hsa; identical to SEQ ID NO: 107158

SEQ ID NO: 358806 - RNA, 64 nt, hsa; identical to SEQ ID NO: 107159

SEQ ID NO: 358807 - RNA, 64 nt, hsa; identical to SEQ ID NO: 107160

SEQ ID NO: 358808 - RNA, 64 nt, hsa; identical to SEQ ID NO: 107161

SEQ ID NO: 358809 - RNA, 64 nt, hsa; identical to SEQ ID NO: 107162

SEQ ID NO: 358810 - RNA, 64 nt, hsa; identical to SEQ ID NO: 107163

SEQ ID NO: 358811 - RNA, 64 nt, hsa; identical to SEQ ID NO: 107164

SEQ ID NO: 358812 - RNA, 64 nt, hsa; identical to SEQ ID NO: 107165

SEQ ID NO: 358813 - RNA, 64 nt, hsa; identical to SEQ ID NO: 107166

SEQ ID NO: 358814 - RNA, 64 nt, hsa; identical to SEQ ID NO: 107167

SEQ ID NO: 358815 - RNA, 64 nt, hsa; identical to SEQ ID NO: 107168

SEQ ID NO: 358816 - RNA, 64 nt, hsa; identical to SEQ ID NO: 107169

SEQ ID NO: 358817 - RNA, 64 nt, hsa; identical to SEQ ID NO: 107170

SEQ ID NO: 358818 - RNA, 64 nt, hsa; identical to SEQ ID NO: 107171

SEQ ID NO: 358819 - RNA, 64 nt, hsa; identical to SEQ ID NO: 107172

SEQ ID NO: 358820 - RNA, 64 nt, hsa; identical to SEQ ID NO: 107173

SEQ ID NO: 358821 - RNA, 64 nt, hsa; identical to SEQ ID NO: 107174

SEQ ID NO: 358822 - RNA, 64 nt, hsa; identical to SEQ ID NO: 107175

SEQ ID NO: 358823 - RNA, 64 nt, hsa; identical to SEQ ID NO: 107176

SEQ ID NO: 358824 - RNA, 64 nt, hsa; identical to SEQ ID NO: 107177

SEQ ID NO: 358825 - RNA, 64 nt, hsa; identical to SEQ ID NO: 107178

SEQ ID NO: 358826 - RNA, 64 nt, hsa; identical to SEQ ID NO: 107179

SEQ ID NO: 358827 - RNA, 64 nt, hsa; identical to SEQ ID NO: 107180

SEQ ID NO: 358828 - RNA, 64 nt, hsa; identical to SEQ ID NO: 107181

SEQ ID NO: 358829 - RNA, 64 nt, hsa; identical to SEQ ID NO: 107182

SEQ ID NO: 358830 - RNA, 64 nt, hsa; identical to SEQ ID NO: 107183

SEQ ID NO: 358831 - RNA, 64 nt, hsa; identical to SEQ ID NO: 107184

SEQ ID NO: 358832 - RNA, 64 nt, hsa; identical to SEQ ID NO: 107185

SEQ ID NO: 358833 - RNA, 64 nt, hsa; identical to SEQ ID NO: 107186

SEQ ID NO: 358834 - RNA, 64 nt, hsa; identical to SEQ ID NO: 107187

SEQ ID NO: 358835 - RNA, 64 nt, hsa; identical to SEQ ID NO: 107188

SEQ ID NO: 358836 - RNA, 64 nt, hsa; identical to SEQ ID NO: 107189

SEQ ID NO: 358837 - RNA, 64 nt, hsa; identical to SEQ ID NO: 107190

SEQ ID NO: 358838 - RNA, 64 nt, hsa; identical to SEQ ID NO: 107191

SEQ ID NO: 358839 - RNA, 64 nt, hsa; identical to SEQ ID NO: 107192

SEQ ID NO: 358840 - RNA, 64 nt, hsa; identical to SEQ ID NO: 107193

SEQ ID NO: 358841 - RNA, 64 nt, hsa; identical to SEQ ID NO: 107194

SEQ ID NO: 358842 - RNA, 64 nt, hsa; identical to SEQ ID NO: 107195

SEQ ID NO: 358843 - RNA, 64 nt, hsa; identical to SEQ ID NO: 107196

SEQ ID NO: 358844 - RNA, 64 nt, hsa; identical to SEQ ID NO: 107197

SEQ ID NO: 358845 - RNA, 64 nt, hsa; identical to SEQ ID NO: 107198

SEQ ID NO: 358846 - RNA, 64 nt, hsa; identical to SEQ ID NO: 107199

SEQ ID NO: 358847 - RNA, 64 nt, hsa; identical to SEQ ID NO: 107200

SEQ ID NO: 358848 - RNA, 64 nt, hsa; identical to SEQ ID NO: 107201

SEQ ID NO: 358849 - RNA, 64 nt, hsa; identical to SEQ ID NO: 107202

SEQ ID NO: 358850 - RNA, 64 nt, hsa; identical to SEQ ID NO: 107203

SEQ ID NO: 358851 - RNA, 64 nt, hsa; identical to SEQ ID NO: 107204

SEQ ID NO: 358852 - RNA, 64 nt, hsa; identical to SEQ ID NO: 107205

SEQ ID NO: 358853 - RNA, 64 nt, hsa; identical to SEQ ID NO: 107206

SEQ ID NO: 358854 - RNA, 64 nt, hsa; identical to SEQ ID NO: 107207

SEQ ID NO: 358855 - RNA, 64 nt, hsa; identical to SEQ ID NO: 107208

SEQ ID NO: 358856 - RNA, 64 nt, hsa; identical to SEQ ID NO: 107209

SEQ ID NO: 358857 - RNA, 64 nt, hsa; identical to SEQ ID NO: 107210

SEQ ID NO: 358858 - RNA, 64 nt, hsa; identical to SEQ ID NO: 107211

SEQ ID NO: 358859 - RNA, 64 nt, hsa; identical to SEQ ID NO: 107212

SEQ ID NO: 358860 - RNA, 64 nt, hsa; identical to SEQ ID NO: 107213

SEQ ID NO: 358861 - RNA, 64 nt, hsa; identical to SEQ ID NO: 107214

SEQ ID NO: 358862 - RNA, 64 nt, hsa; identical to SEQ ID NO: 107215

SEQ ID NO: 358863 - RNA, 64 nt, hsa; identical to SEQ ID NO: 107216

SEQ ID NO: 358864 - RNA, 64 nt, hsa; identical to SEQ ID NO: 107217

SEQ ID NO: 358865 - RNA, 64 nt, hsa; identical to SEQ ID NO: 107218

SEQ ID NO: 358866 - RNA, 64 nt, hsa; identical to SEQ ID NO: 107219

SEQ ID NO: 358867 - RNA, 64 nt, hsa; identical to SEQ ID NO: 107220

SEQ ID NO: 358868 - RNA, 64 nt, hsa; identical to SEQ ID NO: 107221

SEQ ID NO: 358869 - RNA, 64 nt, hsa; identical to SEQ ID NO: 107222

SEQ ID NO: 358870 - RNA, 64 nt, hsa; identical to SEQ ID NO: 107223

SEQ ID NO: 358871 - RNA, 64 nt, hsa; identical to SEQ ID NO: 107224

SEQ ID NO: 358872 - RNA, 64 nt, hsa; identical to SEQ ID NO: 107225

SEQ ID NO: 358873 - RNA, 64 nt, hsa; identical to SEQ ID NO: 107226

SEQ ID NO: 358874 - RNA, 64 nt, hsa; identical to SEQ ID NO: 107227

SEQ ID NO: 358875 - RNA, 64 nt, hsa; identical to SEQ ID NO: 107228

SEQ ID NO: 358876 - RNA, 64 nt, hsa; identical to SEQ ID NO: 107229

SEQ ID NO: 358877 - RNA, 64 nt, hsa; identical to SEQ ID NO: 107230

SEQ ID NO: 358878 - RNA, 64 nt, hsa; identical to SEQ ID NO: 107231

SEQ ID NO: 358879 - RNA, 64 nt, hsa; identical to SEQ ID NO: 107232

SEQ ID NO: 358880 - RNA, 64 nt, hsa; identical to SEQ ID NO: 107233

SEQ ID NO: 358881 - RNA, 64 nt, hsa; identical to SEQ ID NO: 107234

SEQ ID NO: 358882 - RNA, 64 nt, hsa; identical to SEQ ID NO: 107235

SEQ ID NO: 358883 - RNA, 64 nt, hsa; identical to SEQ ID NO: 107236

SEQ ID NO: 358884 - RNA, 64 nt, hsa; identical to SEQ ID NO: 107237

SEQ ID NO: 358885 - RNA, 64 nt, hsa; identical to SEQ ID NO: 107238

SEQ ID NO: 358886 - RNA, 64 nt, hsa; identical to SEQ ID NO: 107239

SEQ ID NO: 358887 - RNA, 64 nt, hsa; identical to SEQ ID NO: 107240

SEQ ID NO: 358888 - RNA, 64 nt, hsa; identical to SEQ ID NO: 107241

SEQ ID NO: 358889 - RNA, 64 nt, hsa; identical to SEQ ID NO: 107242

SEQ ID NO: 358890 - RNA, 64 nt, hsa; identical to SEQ ID NO: 107243

SEQ ID NO: 358891 - RNA, 64 nt, hsa; identical to SEQ ID NO: 107244

SEQ ID NO: 358892 - RNA, 64 nt, hsa; identical to SEQ ID NO: 107245

SEQ ID NO: 358893 - RNA, 64 nt, hsa; identical to SEQ ID NO: 107246

SEQ ID NO: 358894 - RNA, 64 nt, hsa; identical to SEQ ID NO: 107247

SEQ ID NO: 358895 - RNA, 64 nt, hsa; identical to SEQ ID NO: 107248

SEQ ID NO: 358896 - RNA, 64 nt, hsa; identical to SEQ ID NO: 107249

SEQ ID NO: 358897 - RNA, 64 nt, hsa; identical to SEQ ID NO: 107250

SEQ ID NO: 358898 - RNA, 64 nt, hsa; identical to SEQ ID NO: 107251

SEQ ID NO: 358899 - RNA, 64 nt, hsa; identical to SEQ ID NO: 107252

SEQ ID NO: 358900 - RNA, 64 nt, hsa; identical to SEQ ID NO: 107253

SEQ ID NO: 358901 - RNA, 64 nt, hsa; identical to SEQ ID NO: 107254

SEQ ID NO: 358902 - RNA, 64 nt, hsa; identical to SEQ ID NO: 107255

SEQ ID NO: 358903 - RNA, 64 nt, hsa; identical to SEQ ID NO: 107256

SEQ ID NO: 358904 - RNA, 64 nt, hsa; identical to SEQ ID NO: 107257

SEQ ID NO: 358905 - RNA, 64 nt, hsa; identical to SEQ ID NO: 107258

SEQ ID NO: 358906 - RNA, 64 nt, hsa; identical to SEQ ID NO: 107259

SEQ ID NO: 358907 - RNA, 64 nt, hsa; identical to SEQ ID NO: 107260

SEQ ID NO: 358908 - RNA, 64 nt, hsa; identical to SEQ ID NO: 107261

SEQ ID NO: 358909 - RNA, 64 nt, hsa; identical to SEQ ID NO: 107262

SEQ ID NO: 358910 - RNA, 64 nt, hsa; identical to SEQ ID NO: 107263

SEQ ID NO: 358911 - RNA, 64 nt, hsa; identical to SEQ ID NO: 107264

SEQ ID NO: 358912 - RNA, 64 nt, hsa; identical to SEQ ID NO: 107265

SEQ ID NO: 358913 - RNA, 64 nt, hsa; identical to SEQ ID NO: 107266

SEQ ID NO: 358914 - RNA, 64 nt, hsa; identical to SEQ ID NO: 107267

SEQ ID NO: 358915 - RNA, 64 nt, hsa; identical to SEQ ID NO: 107268

SEQ ID NO: 358916 - RNA, 64 nt, hsa; identical to SEQ ID NO: 107269

SEQ ID NO: 358917 - RNA, 64 nt, hsa; identical to SEQ ID NO: 107270

SEQ ID NO: 358918 - RNA, 64 nt, hsa; identical to SEQ ID NO: 107271

SEQ ID NO: 358919 - RNA, 64 nt, hsa; identical to SEQ ID NO: 107272

SEQ ID NO: 358920 - RNA, 64 nt, hsa; identical to SEQ ID NO: 107273

SEQ ID NO: 358921 - RNA, 64 nt, hsa; identical to SEQ ID NO: 107274

SEQ ID NO: 358922 - RNA, 64 nt, hsa; identical to SEQ ID NO: 107275

SEQ ID NO: 358923 - RNA, 64 nt, hsa; identical to SEQ ID NO: 107276

SEQ ID NO: 358924 - RNA, 64 nt, hsa; identical to SEQ ID NO: 107277

SEQ ID NO: 358925 - RNA, 64 nt, hsa; identical to SEQ ID NO: 107278

SEQ ID NO: 358926 - RNA, 64 nt, hsa; identical to SEQ ID NO: 107279

SEQ ID NO: 358927 - RNA, 64 nt, hsa; identical to SEQ ID NO: 107280

SEQ ID NO: 358928 - RNA, 64 nt, hsa; identical to SEQ ID NO: 107281

SEQ ID NO: 358929 - RNA, 64 nt, hsa; identical to SEQ ID NO: 107282

SEQ ID NO: 358930 - RNA, 64 nt, hsa; identical to SEQ ID NO: 107283

SEQ ID NO: 358931 - RNA, 64 nt, hsa; identical to SEQ ID NO: 107284

SEQ ID NO: 358932 - RNA, 64 nt, hsa; identical to SEQ ID NO: 107285

SEQ ID NO: 358933 - RNA, 64 nt, hsa; identical to SEQ ID NO: 107286

SEQ ID NO: 358934 - RNA, 64 nt, hsa; identical to SEQ ID NO: 107287

SEQ ID NO: 358935 - RNA, 64 nt, hsa; identical to SEQ ID NO: 107288

SEQ ID NO: 358936 - RNA, 64 nt, hsa; identical to SEQ ID NO: 107289

SEQ ID NO: 358937 - RNA, 64 nt, hsa; identical to SEQ ID NO: 107290

SEQ ID NO: 358938 - RNA, 64 nt, hsa; identical to SEQ ID NO: 107291

SEQ ID NO: 358939 - RNA, 64 nt, hsa; identical to SEQ ID NO: 107292

SEQ ID NO: 358940 - RNA, 64 nt, hsa; identical to SEQ ID NO: 107293

SEQ ID NO: 358941 - RNA, 64 nt, hsa; identical to SEQ ID NO: 107294

SEQ ID NO: 358942 - RNA, 64 nt, hsa; identical to SEQ ID NO: 107295

SEQ ID NO: 358943 - RNA, 64 nt, hsa; identical to SEQ ID NO: 107296

SEQ ID NO: 358944 - RNA, 64 nt, hsa; identical to SEQ ID NO: 107297

SEQ ID NO: 358945 - RNA, 64 nt, hsa; identical to SEQ ID NO: 107298

SEQ ID NO: 358946 - RNA, 64 nt, hsa; identical to SEQ ID NO: 107299

SEQ ID NO: 358947 - RNA, 64 nt, hsa; identical to SEQ ID NO: 107300

SEQ ID NO: 358948 - RNA, 64 nt, hsa; identical to SEQ ID NO: 107301

SEQ ID NO: 358949 - RNA, 64 nt, hsa; identical to SEQ ID NO: 107302

SEQ ID NO: 358950 - RNA, 64 nt, hsa; identical to SEQ ID NO: 107303

SEQ ID NO: 358951 - RNA, 64 nt, hsa; identical to SEQ ID NO: 107304

SEQ ID NO: 358952 - RNA, 64 nt, hsa; identical to SEQ ID NO: 107305

SEQ ID NO: 358953 - RNA, 64 nt, hsa; identical to SEQ ID NO: 107306

SEQ ID NO: 358954 - RNA, 64 nt, hsa; identical to SEQ ID NO: 107307

SEQ ID NO: 358955 - RNA, 64 nt, hsa; identical to SEQ ID NO: 107308

SEQ ID NO: 358956 - RNA, 64 nt, hsa; identical to SEQ ID NO: 107309

SEQ ID NO: 358957 - RNA, 64 nt, hsa; identical to SEQ ID NO: 107310

SEQ ID NO: 358958 - RNA, 64 nt, hsa; identical to SEQ ID NO: 107311

SEQ ID NO: 358959 - RNA, 64 nt, hsa; identical to SEQ ID NO: 107312

SEQ ID NO: 358960 - RNA, 64 nt, hsa; identical to SEQ ID NO: 107313

SEQ ID NO: 358961 - RNA, 64 nt, hsa; identical to SEQ ID NO: 107314

SEQ ID NO: 358962 - RNA, 64 nt, hsa; identical to SEQ ID NO: 107315

SEQ ID NO: 358963 - RNA, 64 nt, hsa; identical to SEQ ID NO: 107316

SEQ ID NO: 358964 - RNA, 64 nt, hsa; identical to SEQ ID NO: 107317

SEQ ID NO: 358965 - RNA, 64 nt, hsa; identical to SEQ ID NO: 107318

SEQ ID NO: 358966 - RNA, 64 nt, hsa; identical to SEQ ID NO: 107319

SEQ ID NO: 358967 - RNA, 64 nt, hsa; identical to SEQ ID NO: 107320

SEQ ID NO: 358968 - RNA, 64 nt, hsa; identical to SEQ ID NO: 107321

SEQ ID NO: 358969 - RNA, 64 nt, hsa; identical to SEQ ID NO: 107322

SEQ ID NO: 358970 - RNA, 64 nt, hsa; identical to SEQ ID NO: 107323

SEQ ID NO: 358971 - RNA, 64 nt, hsa; identical to SEQ ID NO: 107324

SEQ ID NO: 358972 - RNA, 64 nt, hsa; identical to SEQ ID NO: 107325

SEQ ID NO: 358973 - RNA, 64 nt, hsa; identical to SEQ ID NO: 107326

SEQ ID NO: 358974 - RNA, 64 nt, hsa; identical to SEQ ID NO: 107327

SEQ ID NO: 358975 - RNA, 64 nt, hsa; identical to SEQ ID NO: 107328

SEQ ID NO: 358976 - RNA, 64 nt, hsa; identical to SEQ ID NO: 107329

SEQ ID NO: 358977 - RNA, 64 nt, hsa; identical to SEQ ID NO: 107330

SEQ ID NO: 358978 - RNA, 64 nt, hsa; identical to SEQ ID NO: 107331

SEQ ID NO: 358979 - RNA, 64 nt, hsa; identical to SEQ ID NO: 107332

SEQ ID NO: 358980 - RNA, 64 nt, hsa; identical to SEQ ID NO: 107333

SEQ ID NO: 358981 - RNA, 64 nt, hsa; identical to SEQ ID NO: 107334

SEQ ID NO: 358982 - RNA, 64 nt, hsa; identical to SEQ ID NO: 107335

SEQ ID NO: 358983 - RNA, 64 nt, hsa; identical to SEQ ID NO: 107336

SEQ ID NO: 358984 - RNA, 64 nt, hsa; identical to SEQ ID NO: 107337

SEQ ID NO: 358985 - RNA, 64 nt, hsa; identical to SEQ ID NO: 107338

SEQ ID NO: 358986 - RNA, 64 nt, hsa; identical to SEQ ID NO: 107339

SEQ ID NO: 358987 - RNA, 64 nt, hsa; identical to SEQ ID NO: 107340

SEQ ID NO: 358988 - RNA, 64 nt, hsa; identical to SEQ ID NO: 107341

SEQ ID NO: 358989 - RNA, 64 nt, hsa; identical to SEQ ID NO: 107342

SEQ ID NO: 358990 - RNA, 64 nt, hsa; identical to SEQ ID NO: 107343

SEQ ID NO: 358991 - RNA, 64 nt, hsa; identical to SEQ ID NO: 107344

SEQ ID NO: 358992 - RNA, 64 nt, hsa; identical to SEQ ID NO: 107345

SEQ ID NO: 358993 - RNA, 64 nt, hsa; identical to SEQ ID NO: 107346

SEQ ID NO: 358994 - RNA, 64 nt, hsa; identical to SEQ ID NO: 107347

SEQ ID NO: 358995 - RNA, 64 nt, hsa; identical to SEQ ID NO: 107348

SEQ ID NO: 358996 - RNA, 64 nt, hsa; identical to SEQ ID NO: 107349

SEQ ID NO: 358997 - RNA, 64 nt, hsa; identical to SEQ ID NO: 107350

SEQ ID NO: 358998 - RNA, 64 nt, hsa; identical to SEQ ID NO: 107351

SEQ ID NO: 358999 - RNA, 64 nt, hsa; identical to SEQ ID NO: 107352

SEQ ID NO: 359000 - RNA, 64 nt, hsa; identical to SEQ ID NO: 107353

SEQ ID NO: 359001 - RNA, 64 nt, hsa; identical to SEQ ID NO: 107354

SEQ ID NO: 359002 - RNA, 64 nt, hsa; identical to SEQ ID NO: 107355

SEQ ID NO: 359003 - RNA, 64 nt, hsa; identical to SEQ ID NO: 107356

SEQ ID NO: 359004 - RNA, 64 nt, hsa; identical to SEQ ID NO: 107357

SEQ ID NO: 359005 - RNA, 64 nt, hsa; identical to SEQ ID NO: 107358

SEQ ID NO: 359006 - RNA, 64 nt, hsa; identical to SEQ ID NO: 107359

SEQ ID NO: 359007 - RNA, 64 nt, hsa; identical to SEQ ID NO: 107360

SEQ ID NO: 359008 - RNA, 64 nt, hsa; identical to SEQ ID NO: 107361

SEQ ID NO: 359009 - RNA, 64 nt, hsa; identical to SEQ ID NO: 107362

SEQ ID NO: 359010 - RNA, 64 nt, hsa; identical to SEQ ID NO: 107363

SEQ ID NO: 359011 - RNA, 64 nt, hsa; identical to SEQ ID NO: 107364

SEQ ID NO: 359012 - RNA, 64 nt, hsa; identical to SEQ ID NO: 107365

SEQ ID NO: 359013 - RNA, 64 nt, hsa; identical to SEQ ID NO: 107366

SEQ ID NO: 359014 - RNA, 64 nt, hsa; identical to SEQ ID NO: 107367

SEQ ID NO: 359015 - RNA, 64 nt, hsa; identical to SEQ ID NO: 107368

SEQ ID NO: 359016 - RNA, 64 nt, hsa; identical to SEQ ID NO: 107369

SEQ ID NO: 359017 - RNA, 64 nt, hsa; identical to SEQ ID NO: 107370

SEQ ID NO: 359018 - RNA, 64 nt, hsa; identical to SEQ ID NO: 107371

SEQ ID NO: 359019 - RNA, 64 nt, hsa; identical to SEQ ID NO: 107372

SEQ ID NO: 359020 - RNA, 64 nt, hsa; identical to SEQ ID NO: 107373

SEQ ID NO: 359021 - RNA, 64 nt, hsa; identical to SEQ ID NO: 107374

SEQ ID NO: 359022 - RNA, 64 nt, hsa; identical to SEQ ID NO: 107375

SEQ ID NO: 359023 - RNA, 64 nt, hsa; identical to SEQ ID NO: 107376

SEQ ID NO: 359024 - RNA, 64 nt, hsa; identical to SEQ ID NO: 107377

SEQ ID NO: 359025 - RNA, 64 nt, hsa; identical to SEQ ID NO: 107378

SEQ ID NO: 359026 - RNA, 64 nt, hsa; identical to SEQ ID NO: 107379

SEQ ID NO: 359027 - RNA, 64 nt, hsa; identical to SEQ ID NO: 107380

SEQ ID NO: 359028 - RNA, 64 nt, hsa; identical to SEQ ID NO: 107381

SEQ ID NO: 359029 - RNA, 64 nt, hsa; identical to SEQ ID NO: 107382

SEQ ID NO: 359030 - RNA, 64 nt, hsa; identical to SEQ ID NO: 107383

SEQ ID NO: 359031 - RNA, 64 nt, hsa; identical to SEQ ID NO: 107384

SEQ ID NO: 359032 - RNA, 64 nt, hsa; identical to SEQ ID NO: 107385

SEQ ID NO: 359033 - RNA, 64 nt, hsa; identical to SEQ ID NO: 107386

SEQ ID NO: 359034 - RNA, 64 nt, hsa; identical to SEQ ID NO: 107387

SEQ ID NO: 359035 - RNA, 64 nt, hsa; identical to SEQ ID NO: 107388

SEQ ID NO: 359036 - RNA, 64 nt, hsa; identical to SEQ ID NO: 107389

SEQ ID NO: 359037 - RNA, 64 nt, hsa; identical to SEQ ID NO: 107390

SEQ ID NO: 359038 - RNA, 64 nt, hsa; identical to SEQ ID NO: 107391

SEQ ID NO: 359039 - RNA, 64 nt, hsa; identical to SEQ ID NO: 107392

SEQ ID NO: 359040 - RNA, 64 nt, hsa; identical to SEQ ID NO: 107393

SEQ ID NO: 359041 - RNA, 64 nt, hsa; identical to SEQ ID NO: 107394

SEQ ID NO: 359042 - RNA, 64 nt, hsa; identical to SEQ ID NO: 107395

SEQ ID NO: 359043 - RNA, 64 nt, hsa; identical to SEQ ID NO: 107396

SEQ ID NO: 359044 - RNA, 64 nt, hsa; identical to SEQ ID NO: 107397

SEQ ID NO: 359045 - RNA, 64 nt, hsa; identical to SEQ ID NO: 107398

SEQ ID NO: 359046 - RNA, 64 nt, hsa; identical to SEQ ID NO: 107399

SEQ ID NO: 359047 - RNA, 64 nt, hsa; identical to SEQ ID NO: 107400

SEQ ID NO: 359048 - RNA, 64 nt, hsa; identical to SEQ ID NO: 107401

SEQ ID NO: 359049 - RNA, 64 nt, hsa; identical to SEQ ID NO: 107402

SEQ ID NO: 359050 - RNA, 64 nt, hsa; identical to SEQ ID NO: 107403

SEQ ID NO: 359051 - RNA, 64 nt, hsa; identical to SEQ ID NO: 107404

SEQ ID NO: 359052 - RNA, 64 nt, hsa; identical to SEQ ID NO: 107405

SEQ ID NO: 359053 - RNA, 64 nt, hsa; identical to SEQ ID NO: 107406

SEQ ID NO: 359054 - RNA, 64 nt, hsa; identical to SEQ ID NO: 107407

SEQ ID NO: 359055 - RNA, 64 nt, hsa; identical to SEQ ID NO: 107408

SEQ ID NO: 359056 - RNA, 64 nt, hsa; identical to SEQ ID NO: 107409

SEQ ID NO: 359057 - RNA, 64 nt, hsa; identical to SEQ ID NO: 107410

SEQ ID NO: 359058 - RNA, 64 nt, hsa; identical to SEQ ID NO: 107411

SEQ ID NO: 359059 - RNA, 64 nt, hsa; identical to SEQ ID NO: 107412

SEQ ID NO: 359060 - RNA, 64 nt, hsa; identical to SEQ ID NO: 107413

SEQ ID NO: 359061 - RNA, 64 nt, hsa; identical to SEQ ID NO: 107414

SEQ ID NO: 359062 - RNA, 64 nt, hsa; identical to SEQ ID NO: 107415

SEQ ID NO: 359063 - RNA, 64 nt, hsa; identical to SEQ ID NO: 107416

SEQ ID NO: 359064 - RNA, 64 nt, hsa; identical to SEQ ID NO: 107417

SEQ ID NO: 359065 - RNA, 64 nt, hsa; identical to SEQ ID NO: 107418

SEQ ID NO: 359066 - RNA, 64 nt, hsa; identical to SEQ ID NO: 107419

SEQ ID NO: 359067 - RNA, 64 nt, hsa; identical to SEQ ID NO: 107420

SEQ ID NO: 359068 - RNA, 64 nt, hsa; identical to SEQ ID NO: 107421

SEQ ID NO: 359069 - RNA, 64 nt, hsa; identical to SEQ ID NO: 107422

SEQ ID NO: 359070 - RNA, 64 nt, hsa; identical to SEQ ID NO: 107423

SEQ ID NO: 359071 - RNA, 64 nt, hsa; identical to SEQ ID NO: 107424

SEQ ID NO: 359072 - RNA, 64 nt, hsa; identical to SEQ ID NO: 107425

SEQ ID NO: 359073 - RNA, 64 nt, hsa; identical to SEQ ID NO: 107426

SEQ ID NO: 359074 - RNA, 64 nt, hsa; identical to SEQ ID NO: 107427

SEQ ID NO: 359075 - RNA, 64 nt, hsa; identical to SEQ ID NO: 107428

SEQ ID NO: 359076 - RNA, 64 nt, hsa; identical to SEQ ID NO: 107429

SEQ ID NO: 359077 - RNA, 64 nt, hsa; identical to SEQ ID NO: 107430

SEQ ID NO: 359078 - RNA, 64 nt, hsa; identical to SEQ ID NO: 107431

SEQ ID NO: 359079 - RNA, 64 nt, hsa; identical to SEQ ID NO: 107432

SEQ ID NO: 359080 - RNA, 64 nt, hsa; identical to SEQ ID NO: 107433

SEQ ID NO: 359081 - RNA, 64 nt, hsa; identical to SEQ ID NO: 107434

SEQ ID NO: 359082 - RNA, 64 nt, hsa; identical to SEQ ID NO: 107435

SEQ ID NO: 359083 - RNA, 64 nt, hsa; identical to SEQ ID NO: 107436

SEQ ID NO: 359084 - RNA, 64 nt, hsa; identical to SEQ ID NO: 107437

SEQ ID NO: 359085 - RNA, 64 nt, hsa; identical to SEQ ID NO: 107438

SEQ ID NO: 359086 - RNA, 64 nt, hsa; identical to SEQ ID NO: 107439

SEQ ID NO: 359087 - RNA, 64 nt, hsa; identical to SEQ ID NO: 107440

SEQ ID NO: 359088 - RNA, 64 nt, hsa; identical to SEQ ID NO: 107441

SEQ ID NO: 359089 - RNA, 64 nt, hsa; identical to SEQ ID NO: 107442

SEQ ID NO: 359090 - RNA, 64 nt, hsa; identical to SEQ ID NO: 107443

SEQ ID NO: 359091 - RNA, 64 nt, hsa; identical to SEQ ID NO: 107444

SEQ ID NO: 359092 - RNA, 64 nt, hsa; identical to SEQ ID NO: 107445

SEQ ID NO: 359093 - RNA, 64 nt, hsa; identical to SEQ ID NO: 107446

SEQ ID NO: 359094 - RNA, 64 nt, hsa; identical to SEQ ID NO: 107447

SEQ ID NO: 359095 - RNA, 64 nt, hsa; identical to SEQ ID NO: 107448

SEQ ID NO: 359096 - RNA, 64 nt, hsa; identical to SEQ ID NO: 107449

SEQ ID NO: 359097 - RNA, 64 nt, hsa; identical to SEQ ID NO: 107450

SEQ ID NO: 359098 - RNA, 64 nt, hsa; identical to SEQ ID NO: 107451

SEQ ID NO: 359099 - RNA, 64 nt, hsa; identical to SEQ ID NO: 107452

SEQ ID NO: 359100 - RNA, 64 nt, hsa; identical to SEQ ID NO: 107453

SEQ ID NO: 359101 - RNA, 64 nt, hsa; identical to SEQ ID NO: 107454

SEQ ID NO: 359102 - RNA, 64 nt, hsa; identical to SEQ ID NO: 107455

SEQ ID NO: 359103 - RNA, 64 nt, hsa; identical to SEQ ID NO: 107456

SEQ ID NO: 359104 - RNA, 64 nt, hsa; identical to SEQ ID NO: 107457

SEQ ID NO: 359105 - RNA, 64 nt, hsa; identical to SEQ ID NO: 107458

SEQ ID NO: 359106 - RNA, 64 nt, hsa; identical to SEQ ID NO: 107459

SEQ ID NO: 359107 - RNA, 64 nt, hsa; identical to SEQ ID NO: 107460

SEQ ID NO: 359108 - RNA, 64 nt, hsa; identical to SEQ ID NO: 107461

SEQ ID NO: 359109 - RNA, 64 nt, hsa; identical to SEQ ID NO: 107462

SEQ ID NO: 359110 - RNA, 64 nt, hsa; identical to SEQ ID NO: 107463

SEQ ID NO: 359111 - RNA, 64 nt, hsa; identical to SEQ ID NO: 107464

SEQ ID NO: 359112 - RNA, 64 nt, hsa; identical to SEQ ID NO: 107465

SEQ ID NO: 359113 - RNA, 64 nt, hsa; identical to SEQ ID NO: 107466

SEQ ID NO: 359114 - RNA, 64 nt, hsa; identical to SEQ ID NO: 107467

SEQ ID NO: 359115 - RNA, 64 nt, hsa; identical to SEQ ID NO: 107468

SEQ ID NO: 359116 - RNA, 64 nt, hsa; identical to SEQ ID NO: 107469

SEQ ID NO: 359117 - RNA, 64 nt, hsa; identical to SEQ ID NO: 107470

SEQ ID NO: 359118 - RNA, 64 nt, hsa; identical to SEQ ID NO: 107471

SEQ ID NO: 359119 - RNA, 64 nt, hsa; identical to SEQ ID NO: 107472

SEQ ID NO: 359120 - RNA, 64 nt, hsa; identical to SEQ ID NO: 107473

SEQ ID NO: 359121 - RNA, 64 nt, hsa; identical to SEQ ID NO: 107474

SEQ ID NO: 359122 - RNA, 64 nt, hsa; identical to SEQ ID NO: 107475

SEQ ID NO: 359123 - RNA, 64 nt, hsa; identical to SEQ ID NO: 107476

SEQ ID NO: 359124 - RNA, 64 nt, hsa; identical to SEQ ID NO: 107477

SEQ ID NO: 359125 - RNA, 64 nt, hsa; identical to SEQ ID NO: 107478

SEQ ID NO: 359126 - RNA, 64 nt, hsa; identical to SEQ ID NO: 107479

SEQ ID NO: 359127 - RNA, 64 nt, hsa; identical to SEQ ID NO: 107480

SEQ ID NO: 359128 - RNA, 64 nt, hsa; identical to SEQ ID NO: 107481

SEQ ID NO: 359129 - RNA, 64 nt, hsa; identical to SEQ ID NO: 107482

SEQ ID NO: 359130 - RNA, 64 nt, hsa; identical to SEQ ID NO: 107483

SEQ ID NO: 359131 - RNA, 64 nt, hsa; identical to SEQ ID NO: 107484

SEQ ID NO: 359132 - RNA, 64 nt, hsa; identical to SEQ ID NO: 107485

SEQ ID NO: 359133 - RNA, 64 nt, hsa; identical to SEQ ID NO: 107486

SEQ ID NO: 359134 - RNA, 64 nt, hsa; identical to SEQ ID NO: 107487

SEQ ID NO: 359135 - RNA, 64 nt, hsa; identical to SEQ ID NO: 107488

SEQ ID NO: 359136 - RNA, 64 nt, hsa; identical to SEQ ID NO: 107489

SEQ ID NO: 359137 - RNA, 64 nt, hsa; identical to SEQ ID NO: 107490

SEQ ID NO: 359138 - RNA, 64 nt, hsa; identical to SEQ ID NO: 107491

SEQ ID NO: 359139 - RNA, 64 nt, hsa; identical to SEQ ID NO: 107492

SEQ ID NO: 359140 - RNA, 64 nt, hsa; identical to SEQ ID NO: 107493

SEQ ID NO: 359141 - RNA, 64 nt, hsa; identical to SEQ ID NO: 107494

SEQ ID NO: 359142 - RNA, 64 nt, hsa; identical to SEQ ID NO: 107495

SEQ ID NO: 359143 - RNA, 64 nt, hsa; identical to SEQ ID NO: 107496

SEQ ID NO: 359144 - RNA, 64 nt, hsa; identical to SEQ ID NO: 107497

SEQ ID NO: 359145 - RNA, 64 nt, hsa; identical to SEQ ID NO: 107498

SEQ ID NO: 359146 - RNA, 64 nt, hsa; identical to SEQ ID NO: 107499

SEQ ID NO: 359147 - RNA, 64 nt, hsa; identical to SEQ ID NO: 107500

SEQ ID NO: 359148 - RNA, 64 nt, hsa; identical to SEQ ID NO: 107501

SEQ ID NO: 359149 - RNA, 64 nt, hsa; identical to SEQ ID NO: 107502

SEQ ID NO: 359150 - RNA, 64 nt, hsa; identical to SEQ ID NO: 107503

SEQ ID NO: 359151 - RNA, 64 nt, hsa; identical to SEQ ID NO: 107504

SEQ ID NO: 359152 - RNA, 64 nt, hsa; identical to SEQ ID NO: 107505

SEQ ID NO: 359153 - RNA, 64 nt, hsa; identical to SEQ ID NO: 107506

SEQ ID NO: 359154 - RNA, 64 nt, hsa; identical to SEQ ID NO: 107507

SEQ ID NO: 359155 - RNA, 64 nt, hsa; identical to SEQ ID NO: 107508

SEQ ID NO: 359156 - RNA, 64 nt, hsa; identical to SEQ ID NO: 107509

SEQ ID NO: 359157 - RNA, 64 nt, hsa; identical to SEQ ID NO: 107510

SEQ ID NO: 359158 - RNA, 64 nt, hsa; identical to SEQ ID NO: 107511

SEQ ID NO: 359159 - RNA, 64 nt, hsa; identical to SEQ ID NO: 107512

SEQ ID NO: 359160 - RNA, 64 nt, hsa; identical to SEQ ID NO: 107513

SEQ ID NO: 359161 - RNA, 64 nt, hsa; identical to SEQ ID NO: 107514

SEQ ID NO: 359162 - RNA, 64 nt, hsa; identical to SEQ ID NO: 107515

SEQ ID NO: 359163 - RNA, 64 nt, hsa; identical to SEQ ID NO: 107516

SEQ ID NO: 359164 - RNA, 64 nt, hsa; identical to SEQ ID NO: 107517

SEQ ID NO: 359165 - RNA, 64 nt, hsa; identical to SEQ ID NO: 107518

SEQ ID NO: 359166 - RNA, 64 nt, hsa; identical to SEQ ID NO: 107519

SEQ ID NO: 359167 - RNA, 64 nt, hsa; identical to SEQ ID NO: 107520

SEQ ID NO: 359168 - RNA, 64 nt, hsa; identical to SEQ ID NO: 107521

SEQ ID NO: 359169 - RNA, 64 nt, hsa; identical to SEQ ID NO: 107522

SEQ ID NO: 359170 - RNA, 64 nt, hsa; identical to SEQ ID NO: 107523

SEQ ID NO: 359171 - RNA, 64 nt, hsa; identical to SEQ ID NO: 107524

SEQ ID NO: 359172 - RNA, 64 nt, hsa; identical to SEQ ID NO: 107525

SEQ ID NO: 359173 - RNA, 64 nt, hsa; identical to SEQ ID NO: 107526

SEQ ID NO: 359174 - RNA, 64 nt, hsa; identical to SEQ ID NO: 107527

SEQ ID NO: 359175 - RNA, 64 nt, hsa; identical to SEQ ID NO: 107528

SEQ ID NO: 359176 - RNA, 64 nt, hsa; identical to SEQ ID NO: 107529

SEQ ID NO: 359177 - RNA, 64 nt, hsa; identical to SEQ ID NO: 107530

SEQ ID NO: 359178 - RNA, 64 nt, hsa; identical to SEQ ID NO: 107531

SEQ ID NO: 359179 - RNA, 64 nt, hsa; identical to SEQ ID NO: 107532

SEQ ID NO: 359180 - RNA, 64 nt, hsa; identical to SEQ ID NO: 107533

SEQ ID NO: 359181 - RNA, 64 nt, hsa; identical to SEQ ID NO: 107534

SEQ ID NO: 359182 - RNA, 64 nt, hsa; identical to SEQ ID NO: 107535

SEQ ID NO: 359183 - RNA, 64 nt, hsa; identical to SEQ ID NO: 107536

SEQ ID NO: 359184 - RNA, 64 nt, hsa; identical to SEQ ID NO: 107537

SEQ ID NO: 359185 - RNA, 64 nt, hsa; identical to SEQ ID NO: 107538

SEQ ID NO: 359186 - RNA, 64 nt, hsa; identical to SEQ ID NO: 107539

SEQ ID NO: 359187 - RNA, 64 nt, hsa; identical to SEQ ID NO: 107540

SEQ ID NO: 359188 - RNA, 64 nt, hsa; identical to SEQ ID NO: 107541

SEQ ID NO: 359189 - RNA, 64 nt, hsa; identical to SEQ ID NO: 107542

SEQ ID NO: 359190 - RNA, 64 nt, hsa; identical to SEQ ID NO: 107543

SEQ ID NO: 359191 - RNA, 64 nt, hsa; identical to SEQ ID NO: 107544

SEQ ID NO: 359192 - RNA, 64 nt, hsa; identical to SEQ ID NO: 107545

SEQ ID NO: 359193 - RNA, 64 nt, hsa; identical to SEQ ID NO: 107546

SEQ ID NO: 359194 - RNA, 64 nt, hsa; identical to SEQ ID NO: 107547

SEQ ID NO: 359195 - RNA, 64 nt, hsa; identical to SEQ ID NO: 107548

SEQ ID NO: 359196 - RNA, 64 nt, hsa; identical to SEQ ID NO: 107549

SEQ ID NO: 359197 - RNA, 64 nt, hsa; identical to SEQ ID NO: 107550

SEQ ID NO: 359198 - RNA, 64 nt, hsa; identical to SEQ ID NO: 107551

SEQ ID NO: 359199 - RNA, 64 nt, hsa; identical to SEQ ID NO: 107552

SEQ ID NO: 359200 - RNA, 64 nt, hsa; identical to SEQ ID NO: 107553

SEQ ID NO: 359201 - RNA, 64 nt, hsa; identical to SEQ ID NO: 107554

SEQ ID NO: 359202 - RNA, 64 nt, hsa; identical to SEQ ID NO: 107555

SEQ ID NO: 359203 - RNA, 64 nt, hsa; identical to SEQ ID NO: 107556

SEQ ID NO: 359204 - RNA, 64 nt, hsa; identical to SEQ ID NO: 107557

SEQ ID NO: 359205 - RNA, 64 nt, hsa; identical to SEQ ID NO: 107558

SEQ ID NO: 359206 - RNA, 64 nt, hsa; identical to SEQ ID NO: 107559

SEQ ID NO: 359207 - RNA, 64 nt, hsa; identical to SEQ ID NO: 107560

SEQ ID NO: 359208 - RNA, 64 nt, hsa; identical to SEQ ID NO: 107561

SEQ ID NO: 359209 - RNA, 64 nt, hsa; identical to SEQ ID NO: 107562

SEQ ID NO: 359210 - RNA, 64 nt, hsa; identical to SEQ ID NO: 107563

SEQ ID NO: 359211 - RNA, 64 nt, hsa; identical to SEQ ID NO: 107564

SEQ ID NO: 359212 - RNA, 64 nt, hsa; identical to SEQ ID NO: 107565

SEQ ID NO: 359213 - RNA, 64 nt, hsa; identical to SEQ ID NO: 107566

SEQ ID NO: 359214 - RNA, 64 nt, hsa; identical to SEQ ID NO: 107567

SEQ ID NO: 359215 - RNA, 64 nt, hsa; identical to SEQ ID NO: 107568

SEQ ID NO: 359216 - RNA, 64 nt, hsa; identical to SEQ ID NO: 107569

SEQ ID NO: 359217 - RNA, 64 nt, hsa; identical to SEQ ID NO: 107570

SEQ ID NO: 359218 - RNA, 64 nt, hsa; identical to SEQ ID NO: 107571

SEQ ID NO: 359219 - RNA, 64 nt, hsa; identical to SEQ ID NO: 107572

SEQ ID NO: 359220 - RNA, 64 nt, hsa; identical to SEQ ID NO: 107573

SEQ ID NO: 359221 - RNA, 64 nt, hsa; identical to SEQ ID NO: 107574

SEQ ID NO: 359222 - RNA, 64 nt, hsa; identical to SEQ ID NO: 107575

SEQ ID NO: 359223 - RNA, 64 nt, hsa; identical to SEQ ID NO: 107576

SEQ ID NO: 359224 - RNA, 64 nt, hsa; identical to SEQ ID NO: 107577

SEQ ID NO: 359225 - RNA, 64 nt, hsa; identical to SEQ ID NO: 107578

SEQ ID NO: 359226 - RNA, 64 nt, hsa; identical to SEQ ID NO: 107579

SEQ ID NO: 359227 - RNA, 64 nt, hsa; identical to SEQ ID NO: 107580

SEQ ID NO: 359228 - RNA, 64 nt, hsa; identical to SEQ ID NO: 107581

SEQ ID NO: 359229 - RNA, 64 nt, hsa; identical to SEQ ID NO: 107582

SEQ ID NO: 359230 - RNA, 64 nt, hsa; identical to SEQ ID NO: 107583

SEQ ID NO: 359231 - RNA, 64 nt, hsa; identical to SEQ ID NO: 107584

SEQ ID NO: 359232 - RNA, 64 nt, hsa; identical to SEQ ID NO: 107585

SEQ ID NO: 359233 - RNA, 64 nt, hsa; identical to SEQ ID NO: 107586

SEQ ID NO: 359234 - RNA, 64 nt, hsa; identical to SEQ ID NO: 107587

SEQ ID NO: 359235 - RNA, 64 nt, hsa; identical to SEQ ID NO: 107588

SEQ ID NO: 359236 - RNA, 64 nt, hsa; identical to SEQ ID NO: 107589

SEQ ID NO: 359237 - RNA, 64 nt, hsa; identical to SEQ ID NO: 107590

SEQ ID NO: 359238 - RNA, 64 nt, hsa; identical to SEQ ID NO: 107591

SEQ ID NO: 359239 - RNA, 64 nt, hsa; identical to SEQ ID NO: 107592

SEQ ID NO: 359240 - RNA, 64 nt, hsa; identical to SEQ ID NO: 107593

SEQ ID NO: 359241 - RNA, 64 nt, hsa; identical to SEQ ID NO: 107594

SEQ ID NO: 359242 - RNA, 64 nt, hsa; identical to SEQ ID NO: 107595

SEQ ID NO: 359243 - RNA, 64 nt, hsa; identical to SEQ ID NO: 107596

SEQ ID NO: 359244 - RNA, 64 nt, hsa; identical to SEQ ID NO: 107597

SEQ ID NO: 359245 - RNA, 64 nt, hsa; identical to SEQ ID NO: 107598

SEQ ID NO: 359246 - RNA, 64 nt, hsa; identical to SEQ ID NO: 107599

SEQ ID NO: 359247 - RNA, 64 nt, hsa; identical to SEQ ID NO: 107600

SEQ ID NO: 359248 - RNA, 64 nt, hsa; identical to SEQ ID NO: 107601

SEQ ID NO: 359249 - RNA, 64 nt, hsa; identical to SEQ ID NO: 107602

SEQ ID NO: 359250 - RNA, 64 nt, hsa; identical to SEQ ID NO: 107603

SEQ ID NO: 359251 - RNA, 64 nt, hsa; identical to SEQ ID NO: 107604

SEQ ID NO: 359252 - RNA, 64 nt, hsa; identical to SEQ ID NO: 107605

SEQ ID NO: 359253 - RNA, 64 nt, hsa; identical to SEQ ID NO: 107606

SEQ ID NO: 359254 - RNA, 64 nt, hsa; identical to SEQ ID NO: 107607

SEQ ID NO: 359255 - RNA, 64 nt, hsa; identical to SEQ ID NO: 107608

SEQ ID NO: 359256 - RNA, 64 nt, hsa; identical to SEQ ID NO: 107609

SEQ ID NO: 359257 - RNA, 64 nt, hsa; identical to SEQ ID NO: 107610

SEQ ID NO: 359258 - RNA, 64 nt, hsa; identical to SEQ ID NO: 107611

SEQ ID NO: 359259 - RNA, 64 nt, hsa; identical to SEQ ID NO: 107612

SEQ ID NO: 359260 - RNA, 64 nt, hsa; identical to SEQ ID NO: 107613

SEQ ID NO: 359261 - RNA, 64 nt, hsa; identical to SEQ ID NO: 107614

SEQ ID NO: 359262 - RNA, 64 nt, hsa; identical to SEQ ID NO: 107615

SEQ ID NO: 359263 - RNA, 64 nt, hsa; identical to SEQ ID NO: 107616

SEQ ID NO: 359264 - RNA, 64 nt, hsa; identical to SEQ ID NO: 107617

SEQ ID NO: 359265 - RNA, 64 nt, hsa; identical to SEQ ID NO: 107618

SEQ ID NO: 359266 - RNA, 64 nt, hsa; identical to SEQ ID NO: 107619

SEQ ID NO: 359267 - RNA, 64 nt, hsa; identical to SEQ ID NO: 107620

SEQ ID NO: 359268 - RNA, 64 nt, hsa; identical to SEQ ID NO: 107621

SEQ ID NO: 359269 - RNA, 64 nt, hsa; identical to SEQ ID NO: 107622

SEQ ID NO: 359270 - RNA, 64 nt, hsa; identical to SEQ ID NO: 107623

SEQ ID NO: 359271 - RNA, 64 nt, hsa; identical to SEQ ID NO: 107624

SEQ ID NO: 359272 - RNA, 64 nt, hsa; identical to SEQ ID NO: 107625

SEQ ID NO: 359273 - RNA, 64 nt, hsa; identical to SEQ ID NO: 107626

SEQ ID NO: 359274 - RNA, 64 nt, hsa; identical to SEQ ID NO: 107627

SEQ ID NO: 359275 - RNA, 64 nt, hsa; identical to SEQ ID NO: 107628

SEQ ID NO: 359276 - RNA, 64 nt, hsa; identical to SEQ ID NO: 107629

SEQ ID NO: 359277 - RNA, 64 nt, hsa; identical to SEQ ID NO: 107630

SEQ ID NO: 359278 - RNA, 64 nt, hsa; identical to SEQ ID NO: 107631

SEQ ID NO: 359279 - RNA, 64 nt, hsa; identical to SEQ ID NO: 107632

SEQ ID NO: 359280 - RNA, 64 nt, hsa; identical to SEQ ID NO: 107633

SEQ ID NO: 359281 - RNA, 64 nt, hsa; identical to SEQ ID NO: 107634

SEQ ID NO: 359282 - RNA, 64 nt, hsa; identical to SEQ ID NO: 107635

SEQ ID NO: 359283 - RNA, 64 nt, hsa; identical to SEQ ID NO: 107636

SEQ ID NO: 359284 - RNA, 64 nt, hsa; identical to SEQ ID NO: 107637

SEQ ID NO: 359285 - RNA, 64 nt, hsa; identical to SEQ ID NO: 107638

SEQ ID NO: 359286 - RNA, 64 nt, hsa; identical to SEQ ID NO: 107639

SEQ ID NO: 359287 - RNA, 64 nt, hsa; identical to SEQ ID NO: 107640

SEQ ID NO: 359288 - RNA, 64 nt, hsa; identical to SEQ ID NO: 107641

SEQ ID NO: 359289 - RNA, 64 nt, hsa; identical to SEQ ID NO: 107642

SEQ ID NO: 359290 - RNA, 64 nt, hsa; identical to SEQ ID NO: 107643

SEQ ID NO: 359291 - RNA, 64 nt, hsa; identical to SEQ ID NO: 107644

SEQ ID NO: 359292 - RNA, 64 nt, hsa; identical to SEQ ID NO: 107645

SEQ ID NO: 359293 - RNA, 64 nt, hsa; identical to SEQ ID NO: 107646

SEQ ID NO: 359294 - RNA, 64 nt, hsa; identical to SEQ ID NO: 107647

SEQ ID NO: 359295 - RNA, 64 nt, hsa; identical to SEQ ID NO: 107648

SEQ ID NO: 359296 - RNA, 64 nt, hsa; identical to SEQ ID NO: 107649

SEQ ID NO: 359297 - RNA, 64 nt, hsa; identical to SEQ ID NO: 107650

SEQ ID NO: 359298 - RNA, 64 nt, hsa; identical to SEQ ID NO: 107651

SEQ ID NO: 359299 - RNA, 64 nt, hsa; identical to SEQ ID NO: 107652

SEQ ID NO: 359300 - RNA, 64 nt, hsa; identical to SEQ ID NO: 107653

SEQ ID NO: 359301 - RNA, 64 nt, hsa; identical to SEQ ID NO: 107654

SEQ ID NO: 359302 - RNA, 64 nt, hsa; identical to SEQ ID NO: 107655

SEQ ID NO: 359303 - RNA, 64 nt, hsa; identical to SEQ ID NO: 107656

SEQ ID NO: 359304 - RNA, 64 nt, hsa; identical to SEQ ID NO: 107657

SEQ ID NO: 359305 - RNA, 64 nt, hsa; identical to SEQ ID NO: 107658

SEQ ID NO: 359306 - RNA, 64 nt, hsa; identical to SEQ ID NO: 107659

SEQ ID NO: 359307 - RNA, 64 nt, hsa; identical to SEQ ID NO: 107660

SEQ ID NO: 359308 - RNA, 64 nt, hsa; identical to SEQ ID NO: 107661

SEQ ID NO: 359309 - RNA, 64 nt, hsa; identical to SEQ ID NO: 107662

SEQ ID NO: 359310 - RNA, 64 nt, hsa; identical to SEQ ID NO: 107663

SEQ ID NO: 359311 - RNA, 64 nt, hsa; identical to SEQ ID NO: 107664

SEQ ID NO: 359312 - RNA, 64 nt, hsa; identical to SEQ ID NO: 107665

SEQ ID NO: 359313 - RNA, 64 nt, hsa; identical to SEQ ID NO: 107666

SEQ ID NO: 359314 - RNA, 64 nt, hsa; identical to SEQ ID NO: 107667

SEQ ID NO: 359315 - RNA, 64 nt, hsa; identical to SEQ ID NO: 107668

SEQ ID NO: 359316 - RNA, 64 nt, hsa; identical to SEQ ID NO: 107669

SEQ ID NO: 359317 - RNA, 64 nt, hsa; identical to SEQ ID NO: 107670

SEQ ID NO: 359318 - RNA, 64 nt, hsa; identical to SEQ ID NO: 107671

SEQ ID NO: 359319 - RNA, 64 nt, hsa; identical to SEQ ID NO: 107672

SEQ ID NO: 359320 - RNA, 64 nt, hsa; identical to SEQ ID NO: 107673

SEQ ID NO: 359321 - RNA, 64 nt, hsa; identical to SEQ ID NO: 107674

SEQ ID NO: 359322 - RNA, 64 nt, hsa; identical to SEQ ID NO: 107675

SEQ ID NO: 359323 - RNA, 64 nt, hsa; identical to SEQ ID NO: 107676

SEQ ID NO: 359324 - RNA, 64 nt, hsa; identical to SEQ ID NO: 107677

SEQ ID NO: 359325 - RNA, 64 nt, hsa; identical to SEQ ID NO: 107678

SEQ ID NO: 359326 - RNA, 64 nt, hsa; identical to SEQ ID NO: 107679

SEQ ID NO: 359327 - RNA, 64 nt, hsa; identical to SEQ ID NO: 107680

SEQ ID NO: 359328 - RNA, 64 nt, hsa; identical to SEQ ID NO: 107681

SEQ ID NO: 359329 - RNA, 64 nt, hsa; identical to SEQ ID NO: 107682

SEQ ID NO: 359330 - RNA, 64 nt, hsa; identical to SEQ ID NO: 107683

SEQ ID NO: 359331 - RNA, 64 nt, hsa; identical to SEQ ID NO: 107684

SEQ ID NO: 359332 - RNA, 64 nt, hsa; identical to SEQ ID NO: 107685

SEQ ID NO: 359333 - RNA, 64 nt, hsa; identical to SEQ ID NO: 107686

SEQ ID NO: 359334 - RNA, 64 nt, hsa; identical to SEQ ID NO: 107687

SEQ ID NO: 359335 - RNA, 64 nt, hsa; identical to SEQ ID NO: 107688

SEQ ID NO: 359336 - RNA, 64 nt, hsa; identical to SEQ ID NO: 107689

SEQ ID NO: 359337 - RNA, 64 nt, hsa; identical to SEQ ID NO: 107690

SEQ ID NO: 359338 - RNA, 64 nt, hsa; identical to SEQ ID NO: 107691

SEQ ID NO: 359339 - RNA, 64 nt, hsa; identical to SEQ ID NO: 107692

SEQ ID NO: 359340 - RNA, 64 nt, hsa; identical to SEQ ID NO: 107693

SEQ ID NO: 359341 - RNA, 64 nt, hsa; identical to SEQ ID NO: 107694

SEQ ID NO: 359342 - RNA, 64 nt, hsa; identical to SEQ ID NO: 107695

SEQ ID NO: 359343 - RNA, 64 nt, hsa; identical to SEQ ID NO: 328239

SEQ ID NO: 359344 - RNA, 64 nt, hsa; identical to SEQ ID NO: 328240

SEQ ID NO: 359345 - RNA, 64 nt, hsa; identical to SEQ ID NO: 328241

SEQ ID NO: 359346 - RNA, 64 nt, hsa; identical to SEQ ID NO: 328242

SEQ ID NO: 359347 - RNA, 64 nt, hsa; identical to SEQ ID NO: 328243

SEQ ID NO: 359348 - RNA, 64 nt, hsa; identical to SEQ ID NO: 328244

SEQ ID NO: 359349 - RNA, 64 nt, hsa; identical to SEQ ID NO: 328245

SEQ ID NO: 359350 - RNA, 64 nt, hsa; identical to SEQ ID NO: 328246

SEQ ID NO: 359351 - RNA, 64 nt, hsa; identical to SEQ ID NO: 328247

SEQ ID NO: 359352 - RNA, 64 nt, hsa; identical to SEQ ID NO: 328248

SEQ ID NO: 359353 - RNA, 64 nt, hsa; identical to SEQ ID NO: 328249

SEQ ID NO: 359354 - RNA, 64 nt, hsa; identical to SEQ ID NO: 328250

SEQ ID NO: 359355 - RNA, 64 nt, hsa; identical to SEQ ID NO: 328251

SEQ ID NO: 359356 - RNA, 64 nt, hsa; identical to SEQ ID NO: 328252

SEQ ID NO: 359357 - RNA, 64 nt, hsa; identical to SEQ ID NO: 328253

SEQ ID NO: 359358 - RNA, 64 nt, hsa; identical to SEQ ID NO: 328254

SEQ ID NO: 359359 - RNA, 64 nt, hsa; identical to SEQ ID NO: 328255

SEQ ID NO: 359360 - RNA, 64 nt, hsa; identical to SEQ ID NO: 328256

SEQ ID NO: 359361 - RNA, 64 nt, hsa; identical to SEQ ID NO: 328257

SEQ ID NO: 359362 - RNA, 64 nt, hsa; identical to SEQ ID NO: 328258

SEQ ID NO: 359363 - RNA, 64 nt, hsa; identical to SEQ ID NO: 328259

SEQ ID NO: 359364 - RNA, 64 nt, hsa; identical to SEQ ID NO: 328260

SEQ ID NO: 359365 - RNA, 64 nt, hsa; identical to SEQ ID NO: 328261

SEQ ID NO: 359366 - RNA, 64 nt, hsa; identical to SEQ ID NO: 328262

SEQ ID NO: 359367 - RNA, 64 nt, hsa; identical to SEQ ID NO: 328263

SEQ ID NO: 359368 - RNA, 64 nt, hsa; identical to SEQ ID NO: 328264

SEQ ID NO: 359369 - RNA, 64 nt, hsa; identical to SEQ ID NO: 328265

SEQ ID NO: 359370 - RNA, 64 nt, hsa; identical to SEQ ID NO: 328266

SEQ ID NO: 359371 - RNA, 64 nt, hsa; identical to SEQ ID NO: 328267

SEQ ID NO: 359372 - RNA, 64 nt, hsa; identical to SEQ ID NO: 328268

SEQ ID NO: 359373 - RNA, 64 nt, hsa; identical to SEQ ID NO: 328269

SEQ ID NO: 359374 - RNA, 64 nt, hsa; identical to SEQ ID NO: 328270

SEQ ID NO: 359375 - RNA, 64 nt, hsa; identical to SEQ ID NO: 328271

SEQ ID NO: 359376 - RNA, 64 nt, hsa; identical to SEQ ID NO: 328272

SEQ ID NO: 359377 - RNA, 64 nt, hsa; identical to SEQ ID NO: 328273

SEQ ID NO: 359378 - RNA, 64 nt, hsa; identical to SEQ ID NO: 328274

SEQ ID NO: 359379 - RNA, 64 nt, hsa; identical to SEQ ID NO: 328275

SEQ ID NO: 359380 - RNA, 64 nt, hsa; identical to SEQ ID NO: 328276

SEQ ID NO: 359381 - RNA, 64 nt, hsa; identical to SEQ ID NO: 328277

SEQ ID NO: 359382 - RNA, 64 nt, hsa; identical to SEQ ID NO: 328278

SEQ ID NO: 359383 - RNA, 64 nt, hsa; identical to SEQ ID NO: 328279

SEQ ID NO: 359384 - RNA, 64 nt, hsa; identical to SEQ ID NO: 328280

SEQ ID NO: 359385 - RNA, 64 nt, hsa; identical to SEQ ID NO: 328281

SEQ ID NO: 359386 - RNA, 64 nt, hsa; identical to SEQ ID NO: 328282

SEQ ID NO: 359387 - RNA, 64 nt, hsa; identical to SEQ ID NO: 328283

SEQ ID NO: 359388 - RNA, 64 nt, hsa; identical to SEQ ID NO: 328284

SEQ ID NO: 359389 - RNA, 64 nt, hsa; identical to SEQ ID NO: 328285

SEQ ID NO: 359390 - RNA, 64 nt, hsa; identical to SEQ ID NO: 328286

SEQ ID NO: 359391 - RNA, 64 nt, hsa; identical to SEQ ID NO: 328287

SEQ ID NO: 359392 - RNA, 64 nt, hsa; identical to SEQ ID NO: 328288

SEQ ID NO: 359393 - RNA, 64 nt, hsa; identical to SEQ ID NO: 328289

SEQ ID NO: 359394 - RNA, 64 nt, hsa; identical to SEQ ID NO: 328290

SEQ ID NO: 359395 - RNA, 64 nt, hsa
aaguguuucuuauuauuauuuuauauugaguugaauauugaacucuaacaguuuucuacauaca

SEQ ID NO: 359396 - RNA, 64 nt, hsa
uucauuacaagucuuucacagaaguuuggugguaauauugaaagaacuagcauugggcagaaug

SEQ ID NO: 359397 - RNA, 64 nt, hsa
cacaggaaccugugguuuuaacaaaccaauacacauauugaagaagucauuuuaauucagugaa

SEQ ID NO: 359398 - RNA, 64 nt, hsa
guggauacucuuaggcgugaauguaaaugccuuaauauugaagguccugguuagaagcaugaua

SEQ ID NO: 359399 - RNA, 64 nt, hsa
uuuuaauuucuacacacccauagugcacacuuguauauugaaaagauagggaagagagaaacau

SEQ ID NO: 359400 - RNA, 64 nt, hsa
aguugggaaaaguguuauuauuuggcaugcuuaaauauugaauaaguauucuucaucagcauuu

SEQ ID NO: 359401 - RNA, 64 nt, hsa
agaauuaugagaccuacugaugucccugauacagauauugaaaccaucugaaaagaaagcuaaa

SEQ ID NO: 359402 - RNA, 64 nt, hsa
cacauuuuauucacauagauacuauguccuugacauauugaaaugauucuuuucugaaaguauu

SEQ ID NO: 359403 - RNA, 64 nt, hsa
cauuacauguuucaaagugguguggugggccaaaauauugaaaugauggaacugacugauaaag

SEQ ID NO: 359404 - RNA, 64 nt, hsa
cuggugagaaguugcauaaacagaauuagguaguauauugaagacagcaucauuaaacaguuau

SEQ ID NO: 359405 - RNA, 64 nt, hsa
aaauguucaucuaguguuaggcacuauaguauuuauauugaagcuuguauuuuuaacuguugcu

SEQ ID NO: 359406 - RNA, 64 nt, hsa
caaucaaaugauaaacuuuaagaccuuguauaccauauugaaaggaagaggcugacaauaaggu

SEQ ID NO: 359407 - RNA, 64 nt, hsa
aaacaucaaaucagaaucuagccaagcaggaauuauauugaaauaaguucacauuacagaaaag

SEQ ID NO: 359408 - RNA, 64 nt, hsa
uuuuuacugcuuuaauucuacuuaauuuugguagauauugaauggcuuggaaaagagguaccca

SEQ ID NO: 359409 - RNA, 64 nt, hsa
uauauuaaaaaagagcuugcuuacuacaagaaaaauauugaaauauugaaaauauugaaaauau

SEQ ID NO: 359410 - RNA, 64 nt, hsa
aaaagagcuugcuuacuacaagaaaaauauugaaauauugaaaauauugaaaauauuauuauug

SEQ ID NO: 359411 - RNA, 64 nt, hsa
ugcuuacuacaagaaaaauauugaaauauugaaaauauugaaaauauuauuauugaaaauaaaa

SEQ ID NO: 359412 - RNA, 64 nt, hsa
uuucauauuuuacggcuuuauugaaaacauugauauauugaauauucauaaauuuuaauuuaac

SEQ ID NO: 359413 - RNA, 64 nt, hsa
aaggagaaaggagauugguaaggaagugugauacauauugaaucaggugucaagguaccauuug

SEQ ID NO: 359414 - RNA, 64 nt, hsa
gccauaugagguuauauugaaauguauugagcuuauauugaaauuuauuguuccaauucacagg

SEQ ID NO: 359415 - RNA, 64 nt, hsa
ggaaaacaaaaaugauauaaagccauaugagguuauauugaaauguauugagcuuauauugaaa

SEQ ID NO: 359416 - RNA, 64 nt, hsa
ugugaauuuugauguaauaacugcuaauaaaauuauauugaaacuguuuuauagaaaguuuuuu

SEQ ID NO: 359417 - RNA, 64 nt, hsa
auucagggucucuugauagacuuaucauagcucuauauugaaugaaagccacugugcuuguguu

SEQ ID NO: 359418 - RNA, 64 nt, hsa
aaagugaugugccauuuguuaauauacaagagaaauauugaaaauauauugaaaagagcaauuu

SEQ ID NO: 359419 - RNA, 64 nt, hsa
ccauuuguuaauauacaagagaaauauugaaaauauauugaaaagagcaauuuuaaauuauuuu

SEQ ID NO: 359420 - RNA, 64 nt, hsa
ucaggcucuuguuuugguucagaggagauuuuaaauauugaaugacacuucuacagaacaacgg

SEQ ID NO: 359421 - RNA, 64 nt, hsa
aaggcugagaagguuguuuuuauaauagguaauuauauugaaugcauuuucacugaauauggua

SEQ ID NO: 359422 - RNA, 64 nt, hsa
auuuuuaggcacauuugugacaaacaacuacuugauauugaaaucuccuucagccauuagaagc

SEQ ID NO: 359423 - RNA, 64 nt, hsa
gcuacaguuugcauacagugaacacauaaaaucuauauugaaaacugacagaaauaugaauguc

SEQ ID NO: 359424 - RNA, 64 nt, hsa
uacuguuuuaaagguagagaacugaaguucagauauauugaaacuuucuuaggacauguagcaa

SEQ ID NO: 359425 - RNA, 64 nt, hsa
gaaaguaaacuagucuaguuuuauaugaccugguauauugaacaaacauagaucucaguuuugg

SEQ ID NO: 359426 - RNA, 64 nt, hsa
uugaagccauugcugugaauuacgugagggaaagauauugaagaggaguuggacacuccgagag

SEQ ID NO: 359427 - RNA, 64 nt, hsa
guauauacccgaaagaaaggaaaaggaagccaguauauugaagagguaucugcacccccauguu

SEQ ID NO: 359428 - RNA, 64 nt, hsa
uauauauuagcuauuaguauuuugcaauuuggggauauugaaaauuagaaauugcauguuaguu

SEQ ID NO: 359429 - RNA, 64 nt, hsa
ccaaacuggaaaucagaacacuaggguaaaguggauauugaaaugaagcaagaauauugucaca

SEQ ID NO: 359430 - RNA, 64 nt, hsa
acucuuuggcauggguaaauaagcaugguaacuuauauugaaauauagugcucuugcuuuggau

SEQ ID NO: 359431 - RNA, 64 nt, hsa
ugacuuacauggguuugcuguaauuaagugcccaauauugaaaggcugcaaguacuuuguaauc

SEQ ID NO: 359432 - RNA, 64 nt, hsa
uucacucucuucccauuaaacuugaacuguggcuauauugaacuguuuuggaggggagggggua

SEQ ID NO: 359433 - RNA, 64 nt, hsa
uugaucuguuggaggcuaaaaguagguauaaaugauauugaauguuggguauagugauacucug

SEQ ID NO: 359434 - RNA, 64 nt, hsa
gaauugucccaaaaguaccuguacagaaaauugaauauugaaaaauugacaaauuguguacaaa

SEQ ID NO: 359435 - RNA, 64 nt, hsa
augugagaaacaauucuuuuuaauuuacagcaaaauauugaauaaccauugacaaaaacacuau

SEQ ID NO: 359436 - RNA, 64 nt, hsa
uguagagaugccugauuccaaacagguguggagaauauugaauggcucagaagccgcgucccuu

SEQ ID NO: 359437 - RNA, 64 nt, hsa
gugagacuucucucacuggccuugaaauaagaaaauauugaacauuuuaauauuaaaaauauuu

SEQ ID NO: 359438 - RNA, 64 nt, hsa
auuauaaaauaggcaaacaccaaaaugguauuaaauauugaacuccugaccuuuucgacacuua

SEQ ID NO: 359439 - RNA, 64 nt, hsa
ucugaaauuuaaaauguuaaagaaaaacauuucuauauugaaauauauauaauuuauaaugaaa

SEQ ID NO: 359440 - RNA, 64 nt, hsa
aaaguuaaguaucucaauuuuucauauugaguacauauugaaauaauauuuuagauauauuggu

SEQ ID NO: 359441 - RNA, 64 nt, hsa
ugugcuacaguaagauauacacaucuugccaaaaauauugaaccugaauuuaagccucaagagc

SEQ ID NO: 359442 - RNA, 64 nt, hsa
gauagcaaaaucaagagauggcuuacaaaaagaaauauugaauuuuuauuuuugaaguuuuugu

SEQ ID NO: 359443 - RNA, 64 nt, hsa
uggcaugacucuugacucuugccugccuaacaaaauauugaaaggcaaacauuugaaggaggga

SEQ ID NO: 359444 - RNA, 64 nt, hsa
uucugaaccauuuauuguugaauaaguagagaaaaucaucaauaaauauuuauuacauucugac

SEQ ID NO: 359445 - RNA, 64 nt, hsa
aauuuaaaauauaaauccauucaggugacaacccaucaucaaaauuacaaauuuucugauugaa

SEQ ID NO: 359446 - RNA, 64 nt, hsa
agaugaauguuugaugcuaugaaaagcuuuccauaucaucaaaacuaauuuguguagauuuuug

SEQ ID NO: 359447 - RNA, 64 nt, hsa
uugauucaccuucagggggcugauaaccuaguaaaucaucaaaaugagaucauaaguguuaaug

SEQ ID NO: 359448 - RNA, 64 nt, hsa
uauaaagcugugauuauaucaaaaauccagauaaaucaucaaauauaucagauuaagaccaggg

SEQ ID NO: 359449 - RNA, 64 nt, hsa
aauauucucacaauauagguuuuggggcuuccauaucaucaaaagacugaaaaauuauaauuuu

SEQ ID NO: 359450 - RNA, 64 nt, hsa
cccagagauaguggaaacugaaauuaggaaggaaaucaucaauaacucagugggcugacccauc

SEQ ID NO: 359451 - RNA, 64 nt, hsa
cuucucccuaaagguaaccacuauucugaguccaaucaucaagguuuugcuuuucuuuuuagcu

SEQ ID NO: 359452 - RNA, 64 nt, hsa
gguggauucuuuuccuuauagugaauuuaaaaguaucaucaaggguuuaauauugggaaaauuu

SEQ ID NO: 359453 - RNA, 64 nt, hsa
ucaagaagaaaugaaagaagggacagacauguucaucaucaaggcugugcugccuguugcugaa

SEQ ID NO: 359454 - RNA, 64 nt, hsa
uuauguuucuaaauuuugugauucuauaaaacacaucaucaauaaaauaaugacauaaaaucau

SEQ ID NO: 359455 - RNA, 64 nt, hsa
auuucuuuucuaucucaucuugaugaugauagucaucaucaagaauuuaaugauuaaaauagca

SEQ ID NO: 359456 - RNA, 64 nt, hsa
uuauguuucuaaauuuugugauucuauaaaacacaucaucaauaaaauagugacauaaaaucau

SEQ ID NO: 359457 - RNA, 64 nt, hsa
auuucuuuucuuucucaucuugaugaugaucgucaucaucaagaauuuaaugauuaaaauagca

SEQ ID NO: 359458 - RNA, 64 nt, hsa
agcugccaguuuugaauaaugaauaucauauuguaucaucaaugcugauauuuaacugaguugg

SEQ ID NO: 359459 - RNA, 64 nt, hsa
ucccuucugucauuuucauugauuuaauuuguguaucaucaauaaaauuguauguuaaugcugg

SEQ ID NO: 359460 - RNA, 64 nt, hsa
cauagccccugcuuggaggcccuucucugauggggugacauaaucccuuccuccugggaaacac

SEQ ID NO: 359461 - RNA, 64 nt, hsa
cuuggcccuucaagugggcugaagcccuuggaaagugacauaggaaguccccagaucuugcccu

SEQ ID NO: 359462 - RNA, 64 nt, hsa
ucaacauggcugcuuugcugcuuccuucuccaaagugacauauggagggaacuuuagcacuucc

SEQ ID NO: 359463 - RNA, 64 nt, hsa
gcaguucucuuauuuggucgacuuuugugaaugugugacauaaacagauguaaugcaugucaca

SEQ ID NO: 359464 - RNA, 64 nt, hsa
ucuccugguuuuguagacccagaagauugaaugagugacauaaaucuuuaguucggggcaagcc

SEQ ID NO: 359465 - RNA, 64 nt, hsa
uuggcagguauguguguaaucucagaauacacaggugacauagauaugauaugacaacugguaa

SEQ ID NO: 359466 - RNA, 64 nt, hsa
caccucucucuauuuuauuugccaggggcacgaugugacauaucugcagucccagcacaguggg

SEQ ID NO: 359467 - RNA, 64 nt, hsa
uaccuacugugugccaggggcuggugggacaguggugacauagucucugcccucauagaguuga

SEQ ID NO: 359468 - RNA, 64 nt, hsa
cugugagccugucaguaguggguaccaaucuuuugugacauauugucaugcugaggugugacac

SEQ ID NO: 359469 - RNA, 64 nt, hsa
ggaagugacuugcucaaggucacacaauuggauagugacauagcuagagcgcagaguuccugau

SEQ ID NO: 359470 - RNA, 64 nt, hsa
cuacagagaaggagggaaucagacugaggaagcugugacauaggacuugaagaccaaagacuuu

SEQ ID NO: 359471 - RNA, 64 nt, hsa
guuuucacaacaaaagcuuuugauaaauugcugcgugacauauacuaaauaaaaaaaugaauau

SEQ ID NO: 359472 - RNA, 64 nt, hsa
gguaugacacauuuucugugaucauuguuaauuagugacauaguaacaucuguagcagcugguu

SEQ ID NO: 359473 - RNA, 64 nt, hsa
guuuaaauauacuaccuaagaaaaaaguacuucugugacauauacaaaaaaaucuaguggauag

SEQ ID NO: 359474 - RNA, 64 nt, hsa
aaaugagaaccuuaaauuuacauuuacaggaaaugugacauaacucauacaucggcacugaauu

SEQ ID NO: 359475 - RNA, 64 nt, hsa
cgcaccaaaggggaaacauucaaaggagaugcaggugacauacagaugggcuaaggugaggccu

SEQ ID NO: 359476 - RNA, 64 nt, hsa
gaguggagcaggugggaccucuuauucucaaauagugacauauucuccguagucacaguuucag

SEQ ID NO: 359477 - RNA, 64 nt, hsa
auugcuugagcccaggaauuugagaccagccuaggugacauagugagaccccaucucuacaaaa

SEQ ID NO: 359478 - RNA, 64 nt, hsa
cuuguuaccuaaauaaagaauugauaaaaacagugugacauauuacuauuugguaugauucagu

SEQ ID NO: 359479 - RNA, 64 nt, hsa
uagaaauaccauuuuauaauuuuacuauuccagggugacauaaugcauuuaaauuugggauuug

SEQ ID NO: 359480 - RNA, 64 nt, hsa
ccacucuaugagaaggaagauuacugaaaagcaugugacauauugcuacaaagauuuuuuuucc

SEQ ID NO: 359481 - RNA, 64 nt, hsa
aacuccuaauuguucuuugacacguaguaauucugugacauacuuuuuuuuucuuauagcaaua

SEQ ID NO: 359482 - RNA, 64 nt, hsa
gaauuuuguuuggacuucuuuuacucaugaucuugugacauauuaugucuucaugcaaggggaa

SEQ ID NO: 359483 - RNA, 64 nt, hsa
auguuacuucauuuucuuaucaaauuaaauguuugugacauaguauuauuauuaccuuccuuuu

SEQ ID NO: 359484 - RNA, 64 nt, hsa
agcucauuuuauucuaggucuuucaaacuuucaugugacauauuucccuuucccauuguugcug

SEQ ID NO: 359485 - RNA, 64 nt, hsa
ccuuacauauauuugcauacuuaucucauauuuugugacauaauuauuuaacccagaauacuuu

SEQ ID NO: 359486 - RNA, 64 nt, hsa
augggucuccuugcuucaaucccuucuuguuucagugacauauguauuguuuaucuggguuagg

SEQ ID NO: 359487 - RNA, 64 nt, hsa
auauucauucauuuaguugucauauuggcuuuaugugacauaacugucauuauaccaguguugu

SEQ ID NO: 359488 - RNA, 64 nt, hsa
ugucauauuaagaaaaaaaguuuaucuagcacuugugacauaccaauaauagaguuuauuguau

SEQ ID NO: 359489 - RNA, 64 nt, hsa
ugagaaagguuuugugaguaaacccuacuggacagugacauaaaaggcaauggaauuuucuaua

SEQ ID NO: 359490 - RNA, 64 nt, hsa
ugugacaaaugggaaaaaaaauccaaauaauaaagugacauauugguguucagcaauauaaacc

SEQ ID NO: 359491 - RNA, 64 nt, hsa
gugagccaugaucacaccacugcacuccagccaggugacauagcgagauccugucuaaaaaaau

SEQ ID NO: 359492 - RNA, 64 nt, hsa
guccuagaggacacugucaguugaguuaauacaagugacauagcuucccuucccucccccuuca

SEQ ID NO: 359493 - RNA, 64 nt, hsa
ugugcuacaauauaggaggcacagucaucaguuugugacauacauuauuuacugccuauuucau

SEQ ID NO: 359494 - RNA, 64 nt, hsa
ccucaguuuugagguuaugcacacuaaauuaaaugugacauaaauuaauuuguacaaaaagaac

SEQ ID NO: 359495 - RNA, 64 nt, hsa
ucuauguaucucuggagugagaucuauguacaaagugacauacaauuggaaauccauuuuuguu

SEQ ID NO: 359496 - RNA, 64 nt, hsa
auguuaauguuuuguaauguccuuuuaaugaguggugacauaaaagggcugcuuuguuguccug

SEQ ID NO: 359497 - RNA, 64 nt, hsa
augcaaaaauaagucagauuuuaaggcaaauaaagugacauaaggugcuuuauauuuuauuuug

SEQ ID NO: 359498 - RNA, 64 nt, hsa
ugauucagaaauuuucauucagguauuuguaauagugacauauauauguauauacauaucaccu

SEQ ID NO: 359499 - RNA, 64 nt, hsa
uaauuugugauccaacauguacaguauguauauagugacauagcuuaccaguagaccuuuaaug

SEQ ID NO: 359500 - RNA, 64 nt, hsa
uuccaauggugccuugcuuggugcucuccugguggugacauaacauugguucuacagaaucgug

SEQ ID NO: 359501 - RNA, 64 nt, hsa
auuagcugugccuucauuauuuugcuauguaaaugugacauauuaauuauaaaauggugcauaa

SEQ ID NO: 359502 - RNA, 64 nt, hsa
auuucaaagaagcaauuauguaaaguuguucaaugugacauaauaguauuauaauugguuaagu

SEQ ID NO: 359503 - RNA, 64 nt, hsa
aaaugugaacuggaaaacgcuucggucaguuuuagugacauagccugugaugaugggucuggug

SEQ ID NO: 359504 - RNA, 64 nt, hsa
guaauaaaugaaugucacuucuggauauagcuaggugacauauacauacuuacauguguguaua

SEQ ID NO: 359505 - RNA, 53 nt, hsa
gcacagacugggagaacuaacaagugacauaacagaagaaaaauaucauucaa

SEQ ID NO: 359506 - RNA, 64 nt, hsa
uuccaugccuuggagaaugaaucauuuuuagauugugacauaaaucuuguaaaaaccugucagu

SEQ ID NO: 359507 - RNA, 64 nt, hsa
gacuuuauauacauuuuguuaaauauaguuccuagugacauagaaacgaugcguaguuuucauu

SEQ ID NO: 359508 - RNA, 64 nt, hsa
guaugguaaauguguguuuuaaacuuccuaucaagugacauacuucauuugauuuuuuguuuaa

SEQ ID NO: 359509 - RNA, 64 nt, hsa
uauuuuuuuagcagugaaaaugaauauaaaaaaggugacauaggucaaguuuuccauaaauucu

SEQ ID NO: 359510 - RNA, 64 nt, hsa
uucuuuagugaacuuguuuaauuccucagugggugugacauauuucaugggaauauucaaauau

SEQ ID NO: 359511 - RNA, 64 nt, hsa
aaguaaaucauacuuuagaaucucuucagggaaugugacauacaaaguuuguaagacaugaagu

SEQ ID NO: 359512 - RNA, 64 nt, hsa
guguuauuuucugacugcuggauucuguaguaaggugacauagcuaugacauuuguuaaaaaua

SEQ ID NO: 359513 - RNA, 64 nt, hsa
aaccccugcaucuacuaugaugaauacuucgacugugacauacaaguccauuaucugggaugca

SEQ ID NO: 359514 - RNA, 64 nt, hsa
gaaaaaaucaaagaccaugauuuaugaaacuaaugugacauaauuuccagugacuuguugaugu

SEQ ID NO: 359515 - RNA, 64 nt, hsa
aauuuucuuaauuuauucuuuccuuucaauuauagugacauagaguaguuggccuuauaaguag

SEQ ID NO: 359516 - RNA, 64 nt, hsa
caggaaauugacaguggcugcaguauugacuccagugacauaaaguuaaccacaguggccuuuu

SEQ ID NO: 359517 - RNA, 64 nt, hsa
cugaaacaauccuugugaugaaguagaucaugcagugacauacaaagaccaaggauuauguaua

SEQ ID NO: 359518 - RNA, 64 nt, hsa
caguuuucauaugcucugugaaauguguccagaugugacauaguuuuuuuuuuuaauaugugga

SEQ ID NO: 359519 - RNA, 64 nt, hsa
aggaacaacaaauaacaauagcagaaauaacagugugacauaaagugcccuuccaccuauuuuu

SEQ ID NO: 359520 - RNA, 64 nt, hsa
cuaacaaaagccaauugaugaacauucuguaaaggugacauaaauacuucaaaaaugucucuga

SEQ ID NO: 359521 - RNA, 64 nt, hsa
uauccagugaacaggauguuuugcuuuagcagcagugacauaaaauuccauguuagauaagcau

SEQ ID NO: 359522 - RNA, 64 nt, hsa
gagguucugaaugauuuuauugcuaauuaucacagugacauagacuagaacagaaauuagaagc

SEQ ID NO: 359523 - RNA, 64 nt, hsa
gccccacauggacagccauuccccaggcuaugaagugacauaggccucccccacggugccugug

SEQ ID NO: 359524 - RNA, 64 nt, hsa
accaggcuggaaagggaccaggaaguuugaaauagugacauaucauccacuagucccaagggcu

SEQ ID NO: 359525 - RNA, 64 nt, hsa
cuguggugacuggaaugggacccacguggaguaggugacauaugcuucccagagacugguauug

SEQ ID NO: 359526 - RNA, 64 nt, hsa
ccuaauaccaaaucugacuccaaaauuguggggugugacauacaagugacugaacacuuccugg

SEQ ID NO: 359527 - RNA, 64 nt, hsa
uauuaaagugaaauuuagcaauaguuaauauuaggugacauaaauaaaacaucccagacuagug

SEQ ID NO: 359528 - RNA, 64 nt, hsa
uuccacacuccgugacuccgcaguuuguccuggagugacauacacauccaccauggaaagggaa

SEQ ID NO: 359529 - RNA, 64 nt, hsa
uugcucaacuucugcuauucauauggucugauuagugacauaaguagcagccguuuuucaacuu

SEQ ID NO: 359530 - RNA, 64 nt, hsa
aacugaccuauaagaguguuaaggaccuaauagagugacauauauaaauuaagcauaaaauaug

SEQ ID NO: 359531 - RNA, 64 nt, hsa
cuuaagaucuauaauuuuggcauuuaugucauuugugacauagucugaaaauagagacauuguu

SEQ ID NO: 359532 - RNA, 64 nt, hsa
uuauaaagccauauuuuuuuagggaaacuaaggagugacauagaacugaugaaugaguaaaagu

SEQ ID NO: 359533 - RNA, 64 nt, hsa
auuuuccuuucuguauuaauuauaccaguguuaagugacauagauaagaacuuugcacacuuca

SEQ ID NO: 359534 - RNA, 64 nt, hsa
uagauaauuaagauuauuaaacccucauuuaaaugugacauaaaauacagcuuuaagcacauaa

SEQ ID NO: 359535 - RNA, 64 nt, hsa
gggcaccuuuuaacucuaaaacuagugauacucagugacauagacuuugucuuauaaacauuuu

SEQ ID NO: 359536 - RNA, 64 nt, hsa
guagaucgaucuuuaugcuguuauuacaggagaagugacauacuuuauauauguuuauauuagc

SEQ ID NO: 359537 - RNA, 64 nt, hsa
ucuaauaaacaaggacuauugcugauaguaggcugugacauacugucuugugaaaugguuuccu

SEQ ID NO: 359538 - RNA, 64 nt, hsa
ugaacugggcgaaugucuuauuuaauuaccgugagugacauagccucauguucuguggggguca

SEQ ID NO: 359539 - RNA, 64 nt, hsa
agcucacucaguuuagauauggagauuuugcuaugugacauaacaaaauacagcuggcaggcau

SEQ ID NO: 359540 - RNA, 64 nt, hsa
accuuaccacauaacacguagugcagaaacucaugugacauaggcugggaacuuguuucccuua

SEQ ID NO: 359541 - RNA, 64 nt, hsa
gacccccauugguuuggaaaucaaggagagggcggugacauauuggaccagaagaggcacuagc

SEQ ID NO: 359542 - RNA, 64 nt, hsa
aaaauguaaaugacuaauuuggucauuaaaucuugugacauauucgauauuaaaaugauauuaa

SEQ ID NO: 359543 - RNA, 64 nt, hsa
ugaacauggaaagaaaauuuaauaacuuuuuaaagugacauaauuuacaugcaauauguuuauc

SEQ ID NO: 359544 - RNA, 64 nt, hsa
guaucugguaauuaaauaggccucagauucagcagugacauaacaaggacauaauguaagauaa

SEQ ID NO: 359545 - RNA, 64 nt, hsa
gucccucauccuaacuuucaguucacagagaaaagugacauacccaaagcucucugucaauuac

SEQ ID NO: 359546 - RNA, 64 nt, hsa
cuuuagucccugucaagguuaguaaauaaaauaagugacauaaaaaaaaaaaaaacuaaacuac

SEQ ID NO: 359547 - RNA, 64 nt, hsa
uuuccauuccuuggucaugcuggaaucucucaaugugacauacuuauguaaauauuguuacuau

SEQ ID NO: 359548 - RNA, 64 nt, hsa
agauguauaacuaggagcuuugacucaggagccugugacauacccccucccccaccguugucuc

SEQ ID NO: 359549 - RNA, 64 nt, hsa
uuucacugggggucagcuauaacuaaaaacucaagugacauauuucaguuaccaaaguggccag

SEQ ID NO: 359550 - RNA, 64 nt, hsa
cuacgauacgcuacuauaaagagaagacgaaauagugacauaauauauucuauuuuuauacucu

SEQ ID NO: 359551 - RNA, 64 nt, hsa
agcuuugaggaggcaggagauuccgugggucccugugacauauugcauuaagaucguggcacuu

SEQ ID NO: 359552 - RNA, 64 nt, hsa
uugagggagaagguggagacuuccuuaaggagaugugacauaugggaagacaacagauucagaa

SEQ ID NO: 359553 - RNA, 64 nt, hsa
gagauagugauagugccacugcaauucagccugggugacauagagagacuccaucucaaaaaaa

SEQ ID NO: 359554 - RNA, 64 nt, hsa
aaacuguaaauugugaacacuggaaagcaccauugugacauagaguaaacaucuuaguaauaua

SEQ ID NO: 359555 - RNA, 64 nt, hsa
ucacuuaguccuuuaucauccuuaaaacaauucugugacauacauauuaucucauuuuacacaa

SEQ ID NO: 359556 - RNA, 64 nt, hsa
uggaguugcacagaaucauggaauuuuguguugagugacauaauagguauggaaauaugagggg

SEQ ID NO: 359557 - RNA, 64 nt, hsa
auuccuugagcccuggaguuugaguccagccugggugacauagcaagacccugucuuaaaagaa

SEQ ID NO: 359558 - RNA, 64 nt, hsa
gacuggguauucuaaugaggagcugggaaguggggugacauagcugaccuuaguaucaaccccc

SEQ ID NO: 359559 - RNA, 64 nt, hsa
guuuuaugcuuguuccugagcagaacucauaagagugacauagucagcugcugacggcaccuca

SEQ ID NO: 359560 - RNA, 64 nt, hsa
guuauuagaguguuaauggauuauuguguuuuaggugacauaguuaacuguaaaguaaccugac

SEQ ID NO: 359561 - RNA, 64 nt, hsa
gcuggacauuggauucuagcacuggguuuaucuggugacauagucuccugugggucuugaguug

SEQ ID NO: 359562 - RNA, 64 nt, hsa
acuaucuuaauacuguauacuguauuaacuauucgugacauaguucacacuguuuucuuaccuu

SEQ ID NO: 359563 - RNA, 64 nt, hsa
uaaauuuauuugucuauacuaguagaagugaucagugacauacuauaaauaauccuaaaugguu

SEQ ID NO: 359564 - RNA, 64 nt, hsa
aguggaauuggcuuuggaucuggccuauagauuagugacauaaaauauuuucucuauuuucccc

SEQ ID NO: 359565 - RNA, 64 nt, hsa
cuuuuauuuaaguuuuuuaaguuaagaaaagcuggugacauauuuauacguuuuugugcaaaaa

SEQ ID NO: 359566 - RNA, 64 nt, hsa
uuuacagaaacuaauugugauguacauaucaguggugacauauuauuacuuuuuuggggacggg

SEQ ID NO: 359567 - RNA, 64 nt, hsa
uuugggaacacugcaagcccuuaaucagcccucugugacauagguagcagcccacggagauccu

SEQ ID NO: 359568 - RNA, 64 nt, hsa
cagagcuaugggugcuacaggcuugucuuucuaagugacauauucuuaucuaauucucagauca

SEQ ID NO: 359569 - RNA, 64 nt, hsa
acgagaaccgucuuuacccgggccugggagcucagugacauaaaugcugaagagacaggcauug

SEQ ID NO: 359570 - RNA, 64 nt, hsa
cugcugagacgauuuggaagucucguuaagaucagugacauauucuuuaauuuuaaaaaauugu

SEQ ID NO: 359571 - RNA, 64 nt, hsa
cacuucauauuuguauagaauccucuaaucccuugugacauagacuugacagggauuguaugcc

SEQ ID NO: 359572 - RNA, 64 nt, hsa
aaacucaaugaaaucagcaaacugggaauuucuggugacauagaccucaccagugcuucauaua

SEQ ID NO: 359573 - RNA, 64 nt, hsa
caaguccuguuuauaagucuagucauucugcaacgugacauaucccccaaaaugaaguuaccuu

SEQ ID NO: 359574 - RNA, 64 nt, hsa
uucuacuccaaucaggcuaaucuacuuacugaaugugacauauuuauuccuaguuccauaccuu

SEQ ID NO: 359575 - RNA, 64 nt, hsa
uggacauucucguuaauauucuuuugggcuaauagugacauagugugcagagguguaccaggga

SEQ ID NO: 359576 - RNA, 64 nt, hsa
gcugcucuuuuuagcuggcuuuuuauuaggcucagugacauaaaaaggauccagguaaaugggu

SEQ ID NO: 359577 - RNA, 64 nt, hsa
caggacauggucagggagaggacccugugaguuggugacauauauguggcagagaugguagugu

SEQ ID NO: 359578 - RNA, 64 nt, hsa
uuuacaaauucucauuuccaucucaacagauauagugacauagcucaggcuauucauucauaaa

SEQ ID NO: 359579 - RNA, 64 nt, hsa
gcaaccccagcccaagcucugccucaaagaccgagugacauaagccauucccacccuccuaggu

SEQ ID NO: 359580 - RNA, 64 nt, hsa
uuauggaauaguaaaauauggacaaauuacgugugugacauaucugucaauauaaguuagaagc

SEQ ID NO: 359581 - RNA, 64 nt, hsa
guccagccaccccccagcacuuuauguagagagugugacauagaccugcauauuugucagugcc

SEQ ID NO: 359582 - RNA, 64 nt, hsa
cagggucuugcucuguuguccaggcuggagggcagugacauaaucauagcucacuguacccuug

SEQ ID NO: 359583 - RNA, 64 nt, hsa
uccuuaguacaugcucuguccagcuuuccccagggugacauacagaaggggcaacaucuacccg

SEQ ID NO: 359584 - RNA, 64 nt, hsa
aacacagccucuaagaaacaaggcagcuguuagugugacauagcuuccagcuccucuguuaucu

SEQ ID NO: 359585 - RNA, 64 nt, hsa
gguauuuugucuuucaaacuacaaauggaauguggugacauaaacuagacauggggugcccuca

SEQ ID NO: 359586 - RNA, 64 nt, hsa
guaaugauguaacagugcaagauuuuuuuuuuaagugacauaauuguccaguuauaagcguauu

SEQ ID NO: 359587 - RNA, 64 nt, hsa
gugauuuuuagcuaaguggugugccagguuuucagugacauaccaaauggaaauaagaggauau

SEQ ID NO: 359588 - RNA, 64 nt, hsa
aaugcccauuaauagggaacugguuagauaaauugugacauacccauauuauggaacaguguga

SEQ ID NO: 359589 - RNA, 64 nt, hsa
ccgucucacaacucacaagaaacuuucuggguuugugacauacagagguugaauugaguauaua

SEQ ID NO: 359590 - RNA, 64 nt, hsa
uuuucccaauuccacacagcaggugauuucccgugugacauauuuucuucauagucccuaauau

SEQ ID NO: 359591 - RNA, 64 nt, hsa
auacucuugaugugaauauaguuuaccaaaauuagugacauaaugaguggaauuacuagguaag

SEQ ID NO: 359592 - RNA, 64 nt, hsa
aaguuaacuuuuggaugauaggaaagaucguacagugacauaaguucaucuccugauccauugu

SEQ ID NO: 359593 - RNA, 64 nt, hsa
uugugauucuauaaaacacaucaucaauaaaauagugacauaaaaucauuuuugcuuuacauuu

SEQ ID NO: 359594 - RNA, 64 nt, hsa
acagaacacauggucuucaauauguagauucugugugacauagauuugaacauaauugcuggac

SEQ ID NO: 359595 - RNA, 64 nt, hsa
ggacugaguucuugacaacagaauguggucagaagugacauaugccaacacggggucugggugg

SEQ ID NO: 359596 - RNA, 64 nt, hsa
ugucuucauuucaccucuguguuuaaagcacugugugacauagcuccuuagagauauaaccuau

SEQ ID NO: 359597 - RNA, 64 nt, hsa
accacuguauguguacuaugaucccaacaggcuugugacauagauuucauauuaucccuguugu

SEQ ID NO: 359598 - RNA, 64 nt, hsa
uacaaguguguuugucuuuagugaacucauaguggugacauaccuuuccuuuugaguauaacua

SEQ ID NO: 359599 - RNA, 64 nt, hsa
acuagggcugccacagcaauguaccacaaaccgagugacauaaacacagaacuuuauuuucgua

SEQ ID NO: 359600 - RNA, 64 nt, hsa
cuuagaggacugaccucuacaguucauauuugcagugacauaaaaggcaaagaggagcuggcau

SEQ ID NO: 359601 - RNA, 64 nt, hsa
gguggggaacagaaccuccgcaucguguaguuuugugacauaaggagaccuccuacuugagcug

SEQ ID NO: 359602 - RNA, 64 nt, hsa
auaaacacuaaugcagucaauuugaacaaaagaagugacauacacaauauaaaucauaugucuu

SEQ ID NO: 359603 - RNA, 64 nt, hsa
uccccugggaagugaggggacgaagccuuagagggugacauagcuagaaaguggagaagcucac

SEQ ID NO: 359604 - RNA, 64 nt, hsa
uauuagaaaggcaaaauguaagacuuugguaugugugacauaugcuuuauuuggcuuuauuuua

SEQ ID NO: 359605 - RNA, 64 nt, hsa
uguauguacuuccaguauccugaaacaguguuuggugacauaaugccaaggguaaacaagccug

SEQ ID NO: 359606 - RNA, 64 nt, hsa
ucuguggugaaccaagugaagguggugacuucuggugacauaguaauaaagugaagacucagaa

SEQ ID NO: 359607 - RNA, 64 nt, hsa
uucuaguucugauucugucacucauuggcuuugagugacauauuuuuauuuccugggccuguuu

SEQ ID NO: 359608 - RNA, 64 nt, hsa
ugggaggguuacauuuuuuaagucuuaaucauuugugacauauguaucuauacauccguaucuu

SEQ ID NO: 359609 - RNA, 64 nt, hsa
uuuuauguuuuuucuuaacuguuauauuaugauugugacauagauuauacuacuacuaauuuuu

SEQ ID NO: 359610 - RNA, 64 nt, hsa
ucugcuagguuuuauugaugcagccaccacuuaagugacauaaauauuauagaaagguacugug

SEQ ID NO: 359611 - RNA, 64 nt, hsa
cauuuagcuucagguugucuuguuucuguauauagugacauagcauucugcugccaucuuagcu

SEQ ID NO: 359612 - RNA, 64 nt, hsa
uucagauugggaaauccauuccauuuugugaauugugacauaauaauagcaguggaaaaaguau

SEQ ID NO: 359613 - RNA, 64 nt, hsa
gagucauggauggaacuagaggucacuauauuaagugacauaagccagaaacagacaaacauug

SEQ ID NO: 359614 - RNA, 64 nt, hsa
agaccacauuugauucaacugagaccuuguguaugugacauauaguggccuauaaauuuaauca

SEQ ID NO: 359615 - RNA, 64 nt, hsa
cugaccaggaagccaacguuaacuugcaggccacgugacauaaccacccaaagagccaguugcu

SEQ ID NO: 359616 - RNA, 64 nt, hsa
cucaaauugggaaauccauuccauuuugugaauugugacauaauaauagcagugguaaaaguau

SEQ ID NO: 359617 - RNA, 64 nt, hsa
cucuccugccuagguccugcccacuaaaagaauugugacauaacgcugacugcaaaaacugggu

SEQ ID NO: 359618 - RNA, 64 nt, hsa
uuuccacgcuucccucaguucaccaaaguuaccaaaauguaaaauaaaauaagacuggcucagg

SEQ ID NO: 359619 - RNA, 64 nt, hsa
ucaaaaucuuuccaaauguucugguaucuuugaaaaauguaaauaguuuauuuauagagaaccc

SEQ ID NO: 359620 - RNA, 64 nt, hsa
uaaguuuccugaguuauuaguaagauugcucccuaaauguaaccagggauuuucccauuauguu

SEQ ID NO: 359621 - RNA, 64 nt, hsa
auccaccuuguuuuuuuauugucuacaaaccauuaaauguaaauauuguuuuuagagucaguca

SEQ ID NO: 359622 - RNA, 64 nt, hsa
uuaaacugaaauaugucaugugaaauuauuuuaaaaauguaaaaacaaaacuuucugcuaacaa

SEQ ID NO: 359623 - RNA, 64 nt, hsa
caugcauuaggcuuuggaaauuuaauguuaguugaaauguaaaaugugaaaacuuuagaucauu

SEQ ID NO: 359624 - RNA, 64 nt, hsa
uuaaauuuaguucaucuuucuuuaaaagaacauuaaauguaaccauuuugucagauccauguau

SEQ ID NO: 359625 - RNA, 64 nt, hsa
gauauuugauaauuauauuuguauuucaccaccuaaauguaauguugauuccucaagaaugaaa

SEQ ID NO: 359626 - RNA, 64 nt, hsa
gguuugggacagcaccugguauagaauaaauaauaaauguaaacuauuauuuuugguuaucaug

SEQ ID NO: 359627 - RNA, 64 nt, hsa
guuuuuuuuuuuuuaaugaaggcucauuuacuugaaauguaaaaacuuucacugaauacaaaua

SEQ ID NO: 359628 - RNA, 64 nt, hsa
uguuuuuacugaugauguagauacuuuuguaaauaaauguaaauauguacacaagugacuaggu

SEQ ID NO: 359629 - RNA, 64 nt, hsa
cauuugaguauuacaauuuuugaacaacuguuggaaauguaacuugaagcagcugcuuuaagaa

SEQ ID NO: 359630 - RNA, 64 nt, hsa
uuugauguuuugaaauguauagugggagaugagcaaauguaaaugucaugugcccuguucccua

SEQ ID NO: 359631 - RNA, 64 nt, hsa
aaaagaaagcaugaccaacccaauuacaggggauaaauguaagcuuguuaaaguaagcaccaca

SEQ ID NO: 359632 - RNA, 64 nt, hsa
aauuauguugacuaaauacaaaguuuguuuucuaaaauguaaauauuugccacaauguaaagca

SEQ ID NO: 359633 - RNA, 64 nt, hsa
aaugacacagaacuuuguacuuuucagcucuuaaaaauguaaauguuacauguauauuacuugg

SEQ ID NO: 359634 - RNA, 64 nt, hsa
agacucuaaauuggcuucuacagaucaauaauuuaaauguaacuaguugggauuuuauaguuaa

SEQ ID NO: 359635 - RNA, 64 nt, hsa
uacagacagguaaaaguuccauuucugagugaugaaauguaacacuucuucaucuuuaacuuga

SEQ ID NO: 359636 - RNA, 64 nt, hsa
auuggaaaugggcaguucugaauuuucacguuugaaauguaaaauauaaacuucagucaauauc

SEQ ID NO: 359637 - RNA, 64 nt, hsa
ggcagcuguccuuugacauuuuuuuuuuuagaggaaauguaacuuggaucuaguuuaauuuuuu

SEQ ID NO: 359638 - RNA, 64 nt, hsa
gaacugauuaauauguaaugcuaccugcuaauuaaaauguaaaaucaaguaaagaaaacauuuu

SEQ ID NO: 359639 - RNA, 64 nt, hsa
cuaaaauggcucuggauaacauuuuuggguuaaaaaauguaauuuaaagccaccauagaaagua

SEQ ID NO: 359640 - RNA, 64 nt, hsa
auuugugauuuauugagaauaaaaauccauuuugaaauguaaaauuuuuaugaucugauucagu

SEQ ID NO: 359641 - RNA, 64 nt, hsa
gaauuuguaaguuggcagaucuuccuaaguugcaaaauguaaugaugagcuugguggagaagaa

SEQ ID NO: 359642 - RNA, 64 nt, hsa
cuuauacaauuaugaagauuuaauauuacagauaaaauguaaacuguuucuuuaaaauuggggc

SEQ ID NO: 359643 - RNA, 64 nt, hsa
uugauggcuaacuuacaaagauucucuauguaucaaauguaacuuacugcgacuaaacuuaauu

SEQ ID NO: 359644 - RNA, 64 nt, hsa
uaccucuuauucacagcuuacacuuaugcaugccaaauguaaggccaugaaaaucaguauuuca

SEQ ID NO: 359645 - RNA, 64 nt, hsa
uauuucaaauaacuuaaaaaaugcuuuacuacuaaaauguaaaaaauuaaugugcucaccucgg

SEQ ID NO: 359646 - RNA, 64 nt, hsa
ggaagggacacauaucaaacugaaacaaaauuagaaauguaauuauguucuaagugccuccaag

SEQ ID NO: 359647 - RNA, 64 nt, hsa
uucuaugcuuguaacugucuucuagcagugagccaaauguaaaauagugaauaaagucauuauu

SEQ ID NO: 359648 - RNA, 64 nt, hsa
aguugaaagccauggcuugaucuuguaaauauauaaauguaaaugauauuaaaucugugauucc

SEQ ID NO: 359649 - RNA, 64 nt, hsa
uccauauguuuguuuauauugcuaauuuaugagaaaauguaauaauugcaaugaaugugaauua

SEQ ID NO: 359650 - RNA, 62 nt, hsa
auaagaaaauucauacuugagagaaauccuacaaauguaaagaauguggcaaaccuuuggau

SEQ ID NO: 359651 - RNA, 64 nt, hsa
gcagaagaaaauuauuacuggagauaaacccugcaaauguaaagaguguaacaaaaccuuuaaa

SEQ ID NO: 359652 - RNA, 64 nt, hsa
aauauaagaauucauccuagauauaaaaccauagaaauguaaaagaugugacaaaaccuuuaag

SEQ ID NO: 359653 - RNA, 64 nt, hsa
aacuagcaauguucauacuuaauaaaaacauuauaaauguaauuucuguugaaagacuucagaa

SEQ ID NO: 359654 - RNA, 64 nt, hsa
aggcuaaauguugcuuguaggcuacauuaaacucaaauguaauaguuuaucuuauacuccuggu

SEQ ID NO: 359655 - RNA, 64 nt, hsa
gguaaauuucuuauuaaaucaaucuugaaauagaaaauguaauaacuuucuuaccauuaacauu

SEQ ID NO: 359656 - RNA, 64 nt, hsa
uauauaauguacauaaauguuacauuuguaaagaaaauguaaaaauguaacuauagcauaugaa

SEQ ID NO: 359657 - RNA, 64 nt, hsa
guacauaaauguuacauuuguaaagaaaauguaaaaauguaacuauagcauaugaauugcuuaa

SEQ ID NO: 359658 - RNA, 64 nt, hsa
ggauauaaauaugguguccugcuuuuuuuguagaaaauguaauuugaggaugaauuuucugcuu

SEQ ID NO: 359659 - RNA, 64 nt, hsa
uugcccugaaaaaauuucuugcauaugaauuguaaaauguaaauacauuuuuauaaccaauguu

SEQ ID NO: 359660 - RNA, 64 nt, hsa
uguaucuucugcagacacuguggguagcccaucaaaauguaagcugugcuccucucauuuuuau

SEQ ID NO: 359661 - RNA, 64 nt, hsa
aaaacugcuaaauuuuucuuaaucaagaauauucaaauguaauuaugaggugaaacaauuauug

SEQ ID NO: 359662 - RNA, 64 nt, hsa
ggcacauauauuuauagucuguuuauguagaaacaaauguaauauauuaaagccuuauauauaa

SEQ ID NO: 359663 - RNA, 64 nt, hsa
ugcucugguggaggugggcauggggucuguucugaaauguaaaggguucagacgggguuucugg

SEQ ID NO: 359664 - RNA, 64 nt, hsa
cauaaucuauucaucuauuuauaugcaaacauaaaaauguaaauauugaaacaagauugcuuca

SEQ ID NO: 359665 - RNA, 64 nt, hsa
uuauaugagcuauguacugccacaaaaaaagaugaaauguaauuucuaaauacuccaggugugu

SEQ ID NO: 359666 - RNA, 64 nt, hsa
cuccgcccuuguaagguguucaguagagcuaaauaaauguaauagccaaacccacucuguuggu

SEQ ID NO: 359667 - RNA, 64 nt, hsa
uccaaaauaaagcauaaaaagguuuuuuaaaaggaaauguaaaagcacaugagaaugcuagcag

SEQ ID NO: 359668 - RNA, 64 nt, hsa
gaaaauaagcaaagaccacacauuuuuuacuacaaaauguaaaggauaaauguaaauccugcau

SEQ ID NO: 359669 - RNA, 64 nt, hsa
gaccacacauuuuuuacuacaaaauguaaaggauaaauguaaauccugcauaacuaaaaucaca

SEQ ID NO: 359670 - RNA, 64 nt, hsa
aaaagaaauacuuucugacagucaccugagccuuaaauguaaguauuacaugacaugcauucug

SEQ ID NO: 359671 - RNA, 64 nt, hsa
guauuggucuggucaguauugccuggcugacgugaaauguaaacuaguaggcguguuauugauc

SEQ ID NO: 359672 - RNA, 64 nt, hsa
aaauggaaugcaaguuuuucaaaagcccaggucuaaauguaaugguugguuuauuguucuauaa

SEQ ID NO: 359673 - RNA, 64 nt, hsa
uaagugauuauaauuaagcuguccuguuugcaucaaauguaaagacuguguucacaaccguagu

SEQ ID NO: 359674 - RNA, 64 nt, hsa
acucuggacuuuauuuugcuaaccauaacugagcaaauguaaauuacugcuauauuaauguuuu

SEQ ID NO: 359675 - RNA, 64 nt, hsa
guuuguguguguuuuuaaugagaaucuuguuuuaaaauguaauuucuaagguuuaacaccaaaa

SEQ ID NO: 359676 - RNA, 64 nt, hsa
uccuucccucaucagugaaaaaaucuaauguuucaaauguaaauuguucauagaaaaggaacau

SEQ ID NO: 359677 - RNA, 64 nt, hsa
aacagaaacacauaguauuugcacuuuguacuuuaaauguaaauucacuuuguagaaaugagcu

SEQ ID NO: 359678 - RNA, 64 nt, hsa
cagucacagugccugggaggggcccauccuuccaaaauguaaauccagucgcggugugaccgag

SEQ ID NO: 359679 - RNA, 64 nt, hsa
uuaauaaguagccuauuuuuuaaaugucuuuuuaaaauguaaauauuuggaugaaguuuuucuu

SEQ ID NO: 359680 - RNA, 64 nt, hsa
caugauacaguaagguguaauuacagaauuuacgaaauguaaauggccucuacagaguuuuaug

SEQ ID NO: 359681 - RNA, 64 nt, hsa
uguuaccucuauuuuuuguuacuauacaauuaugaaauguaauguaagacaccaacagaaauga

SEQ ID NO: 359682 - RNA, 64 nt, hsa
gggguuccagauaauauuuucuacagauuuugaaaaauguaauaauauuaaugcaguauugcaa

SEQ ID NO: 359683 - RNA, 64 nt, hsa
ugucuuagaagaacuuaucuuuauucucaaaauuaaauguaauuuuuuuagugacaaagaagaa

SEQ ID NO: 359684 - RNA, 64 nt, hsa
acuauauuugaacgacauuccccccgaaaaauugaaauguaaagaugaggcagagaauaaagug

SEQ ID NO: 359685 - RNA, 64 nt, hsa
auguaagaguauuuauacuggaaagaaacccuacaaauguaaaaaacguggcaaugccuuuaac

SEQ ID NO: 359686 - RNA, 64 nt, hsa
acaccagaaaauuuauauuggagaaaagcacuguaaauguaaugcauuugugaaaacauuuuuu

SEQ ID NO: 359687 - RNA, 64 nt, hsa
uuaugacacuuucuaugaaagaauaaggacauuaaaauguaagaugcaugaugaaaaccugagu

SEQ ID NO: 359688 - RNA, 64 nt, hsa
gggggacuagagcuccuucuggccauguuauaugaaauguaauucuuauuuuauaaauaaugug

SEQ ID NO: 359689 - RNA, 64 nt, hsa
aaauguaauucuuauuuuauaaauaaugugauguaaauguaacuggugcccccuccccgaugug

SEQ ID NO: 359690 - RNA, 64 nt, hsa
cuacaaaaacagaauaauuuugaaguuuuagaauaaauguaauauauuuacuauaauucuaaau

SEQ ID NO: 359691 - RNA, 64 nt, hsa
aguuucuaaugugguauuuuaaauaaaguaucauaaauguaauaaguaaauauuuauuuaggaa

SEQ ID NO: 359692 - RNA, 64 nt, hsa
uaaucaaauaacuagacauauaucagaaacuuuaaaauguaaaaguuguacacuuucaacauuu

SEQ ID NO: 359693 - RNA, 64 nt, hsa
gugugcuccucuuuuggauuuacagaaaugugucaaauguaaaucuuucaaagccauuuaaaaa

SEQ ID NO: 359694 - RNA, 64 nt, hsa
acaucagagaauccauacuagagagaagcccuacaaauguaaagaaugugaaaagucuuucagu

SEQ ID NO: 359695 - RNA, 64 nt, hsa
uuaguaucaaauucacgccaugcaaaaagauuauaaauguaauaagcauguaugugugugagga

SEQ ID NO: 359696 - RNA, 64 nt, hsa
acuuagaagguaggagaucagaucauaugugggaaaauguaaaagcagggauaucagugggcau

SEQ ID NO: 359697 - RNA, 64 nt, hsa
agaggcccugugucuaccaggagcuucuuuuuccaaauguaauggauuauguggaauuguagug

SEQ ID NO: 359698 - RNA, 64 nt, hsa
aaaauauucauauauuaucaaaauucuguuuuguaaauguaagaaagcauaguuauuuuacaaa

SEQ ID NO: 359699 - RNA, 64 nt, hsa
uugggugccauuaaauagggaaaaaacauguaaaaaauguaaaauggagaccaauugcacuagg

SEQ ID NO: 359700 - RNA, 64 nt, hsa
uugggcauuuuucucucuguucccucucuuuugaaaauguaaaauaaaaccaaaaauagacaac

SEQ ID NO: 359701 - RNA, 64 nt, hsa
cuuugaacuuccaaguaugucuagucaccuuuuaaaauguaaacauuuucagaaaaaugaggau

SEQ ID NO: 359702 - RNA, 64 nt, hsa
guuguuucugguuuuguuugccaaugagcauaauaaauguaaaaccuauauaguaucccuguga

SEQ ID NO: 359703 - RNA, 64 nt, hsa
gcuagaacacacauuuuuaaugaaaagaaguaauaaauguaacuauuaagcuaaaaugcaaaug

SEQ ID NO: 359704 - RNA, 64 nt, hsa
uuaauaaugaguguguaaacugcauacguuaaauaaauguaaauacuaauguacugcugccuuc

SEQ ID NO: 359705 - RNA, 64 nt, hsa
aucuuguuuauuguugaugccaucuuagaggaaaaaauguaaagguaaguaauuaagcauauga

SEQ ID NO: 359706 - RNA, 64 nt, hsa
uaaauacacucaccuaaauugaaagcuaagaaggaaauguaaauauaauauauauuuauauuug

SEQ ID NO: 359707 - RNA, 64 nt, hsa
gcaaaaaacaaaaaguacacagaaauauuuauuaaaauguaauacaguuuauugaacuuucuag

SEQ ID NO: 359708 - RNA, 64 nt, hsa
uuaacuuuaaaaauguauauucuagggucaggggaaauguaaucuggaauuaaauauuagccuu

SEQ ID NO: 359709 - RNA, 64 nt, hsa
uuaaauuacaaaagugauagauguucauuguagaaaauguaauaaacacuguuaagacuuaaaa

SEQ ID NO: 359710 - RNA, 64 nt, hsa
gaaaaaaagagguagcuuuuagauugcaaacuggaaauguaaaacucaugaaauuuaagcaaua

SEQ ID NO: 359711 - RNA, 64 nt, hsa
caguuauauuacuuuugaggcuggugaaaaauuuaaauguaacuuugugggaacacugauucau

SEQ ID NO: 359712 - RNA, 64 nt, hsa
uguaacuuugugggaacacugauucauauuuagaaaauguaaaugucuguagcacuuucuugca

SEQ ID NO: 359713 - RNA, 64 nt, hsa
gaauuguuauccuuuauauuaagaaaauguuuuaaaauguaagaauuccauuuauucuguuuag

SEQ ID NO: 359714 - RNA, 64 nt, hsa
uguaaaauaauuuuagugcaauaugaagacguagaaauguaaaauaugauuugaauuguuaucc

SEQ ID NO: 359715 - RNA, 64 nt, hsa
agaacaucuauacauauggugaucuaaauguacaaaauguaaaauguauaagucaucucacuuu

SEQ ID NO: 359716 - RNA, 64 nt, hsa
guauaaaaaguuuauuuugcuauugugaaaaacuaaauguaaaggaaaucaccuacuuucaugc

SEQ ID NO: 359717 - RNA, 64 nt, hsa
acuugggauuguuuuguggguuuuuguuuguuuuaaauguaaauugagaaucuuuuauaagaaa

SEQ ID NO: 359718 - RNA, 64 nt, hsa
cuugauaauuuguuguugagagcuguucauucuaaaauguaaugaaauucagucuaguucugcu

SEQ ID NO: 359719 - RNA, 64 nt, hsa
uucuuuugcaagacaccuguuuaucaucuuguuuaaauguaaauguccccuuaugcuuuugaaa

SEQ ID NO: 359720 - RNA, 64 nt, hsa
cuuugaaauguauaaaaaguucauuuacaguucuaaauguaauguuuuuaagccuucuaucuuu

SEQ ID NO: 359721 - RNA, 64 nt, hsa
uuguggcaaaggaaacuauacuuuucauuuuuaaaaauguaaauagaaaaguuuuuaacgguuu

SEQ ID NO: 359722 - RNA, 64 nt, hsa
uuaaaccucucuucuaccuuaaaauguaaaacaaaaauguaaugaucauaagucuaaauaaaug

SEQ ID NO: 359723 - RNA, 64 nt, hsa
uaaaauugcacuuuuaaaccucucuucuaccuuaaaauguaaaacaaaaauguaaugaucauaa

SEQ ID NO: 359724 - RNA, 64 nt, hsa
guuccuucuauuguuuucuuauccaucugucaggaaauguaacuuugguuuuauuuuuggcuua

SEQ ID NO: 359725 - RNA, 64 nt, hsa
aggcacagccucuccucuuuaccugaucaauguuaaauguaagcaccccugaucccaggacaua

SEQ ID NO: 359726 - RNA, 64 nt, hsa
uguaauauuguguauacaaaacccaaaucucucaaaauguaaauuauguauaccugccaagaua

SEQ ID NO: 359727 - RNA, 64 nt, hsa
cagguggccugcugaggcugccccauauuuuagaaaauguaaaaauggugguuuggccauuaau

SEQ ID NO: 359728 - RNA, 64 nt, hsa
aaaaaaauuugguucucaagugaacaaacauauaaaauguaaacaaucccuacaauccagauaa

SEQ ID NO: 359729 - RNA, 64 nt, hsa
auguugauaggugaccacuguugguauuuacauuaaauguaaagaaauguguacugaucucauu

SEQ ID NO: 359730 - RNA, 64 nt, hsa
cauugugauaaugcuguauuuaaagagaauauuuaaauguaauauuaaagaaauauucaaaaga

SEQ ID NO: 359731 - RNA, 64 nt, hsa
cucugcuucuguacaaaaucuccaggauuuacaaaaauguaaccugccuuccuucaaucccaua

SEQ ID NO: 359732 - RNA, 64 nt, hsa
aaaucuucucauuuuauugaaaacuaagagcagaaaauguaaaaugcucaugaagguuuugaau

SEQ ID NO: 359733 - RNA, 64 nt, hsa
aaaaauauuuuacugcagccaaguuuucauuucaaaauguaauuucaguuuggagcuuuuaggc

SEQ ID NO: 359734 - RNA, 64 nt, hsa
caaaauggcauacaucuuuuguacaaagaacuugaaauguaaauacuguguuugugcuguaaga

SEQ ID NO: 359735 - RNA, 64 nt, hsa
uguuuaguuuguuuuuuuucaaacaacccucuaaaaauguaaaaaccauguuuagcuugcagcu

SEQ ID NO: 359736 - RNA, 64 nt, hsa
agcaugcuuguauguauauuucagaaccuuuuuuaaauguaaaagcuguacauuucugggaagu

SEQ ID NO: 359737 - RNA, 64 nt, hsa
gacuuccauguccugguuauuaacaaaaaaggaaaaauguaauaauugauaugauuuuguaaaa

SEQ ID NO: 359738 - RNA, 64 nt, hsa
uuuuccagugugccaacuccaaagucaacauuaaaaauguaaauggaccuguguaaauaucaca

SEQ ID NO: 359739 - RNA, 64 nt, hsa
guccuuuaauaaguaaagaaaauaauauguuuaaaaauguaaauguuuuacaaauuugaaacuu

SEQ ID NO: 359740 - RNA, 64 nt, hsa
aaauguaaaugguuucaaauggucagcguuguuuaaauguaaucauguuauuuuauucauuguu

SEQ ID NO: 359741 - RNA, 64 nt, hsa
ucuguacuaagugucaacagcccuuacaaacauuaaauguaaaugguuucaaauggucagcguu

SEQ ID NO: 359742 - RNA, 64 nt, hsa
auuccuaucuuauuguucguuuaaucaguuucugaaauguaagcauuacaugacuauuggugag

SEQ ID NO: 359743 - RNA, 64 nt, hsa
aaccagaucaaauuaauacaaucagaagguuucgaaauguaaauauuccuuauuuaagacaugu

SEQ ID NO: 359744 - RNA, 64 nt, hsa
aauguaaacaaauuuguuuuuuaagguuaaggccaaauguaacaauaaaacccugucgaugguu

SEQ ID NO: 359745 - RNA, 64 nt, hsa
uuacucaggguuuaaaaugucccauuuaaauaugaaauguaaacaaauuuguuuuuuaagguua

SEQ ID NO: 359746 - RNA, 64 nt, hsa
uguagucaauguuccaccagaggagcggacagugaaauguaauaucccucucuagagcagguau

SEQ ID NO: 359747 - RNA, 64 nt, hsa
gugucaaacuuaaggagauucaagaccuggcagaaaauguaagaggauuuuugcugcuuuuggg

SEQ ID NO: 359748 - RNA, 64 nt, hsa
gauuuaauggaauuguaauuuuaaacauuuaauuaaauguaauuugggggauauuuugaacuuu

SEQ ID NO: 359749 - RNA, 64 nt, hsa
uugggggauauuuugaacuuuaauauuagugaucaaauguaaauguuuugaggauauuuuucuu

SEQ ID NO: 359750 - RNA, 64 nt, hsa
cucauuuuuacuuuugaacguuggccuuacaaucaaauguaaguuauauauauuuguacugaug

SEQ ID NO: 359751 - RNA, 64 nt, hsa
ugaacaagaaucuauauuccaagcacauuuacugaaauguaaaacacaacaggaagcaaagcaa

SEQ ID NO: 359752 - RNA, 64 nt, hsa
gggguugggggaagauauuacuuugagaaaacagaaauguaaaggauuuuugaccuuauauaug

SEQ ID NO: 359753 - RNA, 64 nt, hsa
ucaugaaauugucuuaaaaaagcaagagacugcaaaauguaaacaguaaucuucugucccuuua

SEQ ID NO: 359754 - RNA, 64 nt, hsa
gauuauuucaagcuagucauugagguauaugacaaaauguaaauaacaaaaaacugaaaucuac

SEQ ID NO: 359755 - RNA, 64 nt, hsa
gggagcucauggugccgcuggggacuuuuuagagaaauguaaagagaauagcuauucagugucu

SEQ ID NO: 359756 - RNA, 50 nt, hsa
auacuagagaaaaacuuuaaaaauguaaaacauggagcagauuuuuuacu

SEQ ID NO: 359757 - RNA, 64 nt, hsa
uuaauaucagcauuuuucauggaaguuuaaugccaaauguaaaacacaugaaaauuuuuaaaaa

SEQ ID NO: 359758 - RNA, 64 nt, hsa
aauucauuuuaguuauaauaaauuuaauauuuguaaauguaacauaguuucagugugauuucua

SEQ ID NO: 359759 - RNA, 64 nt, hsa
cucugccucggccauucaaaagucuaauaacaaaaaauguaaaccuaauuuggcaguuuguuag

SEQ ID NO: 359760 - RNA, 64 nt, hsa
aacuaaaauuagaaauguccccucacugcagaucaaauguaaagcuuccaguuaaggagcuaaa

SEQ ID NO: 359761 - RNA, 64 nt, hsa
aaagagauguuaagcaagugguuguuuuagauccaaauguaaaggcagguuugggaagguguuu

SEQ ID NO: 359762 - RNA, 64 nt, hsa
auaaaguuuaucagauauuuucauauuuaaagccaaauguaaauagaggucuguaaagaaaaau

SEQ ID NO: 359763 - RNA, 64 nt, hsa
aaauguaaaugcugccuuuaugguauaaaacuguaaauguaauauuauguaauuaugugaacuu

SEQ ID NO: 359764 - RNA, 64 nt, hsa
agagauaagggaaggggagacuguaaaaacagaaaaauguaaaugcugccuuuaugguauaaaa

SEQ ID NO: 359765 - RNA, 64 nt, hsa
cauuuaucauuuuuuaggucuucauuaaauuuuaaaauguaauaucuguuucccacccccuaca

SEQ ID NO: 359766 - RNA, 64 nt, hsa
cuuaucuugauuucuuucauuagaaacuaucccuaaauguaaagaucuuuugccuucaaauuug

SEQ ID NO: 359767 - RNA, 64 nt, hsa
aacauucagauuuaauuacuguaaguaaaauuuaaaauguaaauacaucaguucauguucugua

SEQ ID NO: 359768 - RNA, 64 nt, hsa
aacucaugguguggcuaaucuacauuuaucaauaaaauguaaauuaucugaaaggacagaauau

SEQ ID NO: 359769 - RNA, 64 nt, hsa
ggaaaaauuuguagcggauggcaguguugaaggcaaauguaaacauaaggguaauggucuguca

SEQ ID NO: 359770 - RNA, 64 nt, hsa
uuuuucccuauugacugucagaaaauccacugggaaauguaaaaaucuucacucaccauuauga

SEQ ID NO: 359771 - RNA, 64 nt, hsa
aacaguuggaggaauccauggaaaauagacgagaaaauguaaauaaggcuuucuggggaucaca

SEQ ID NO: 359772 - RNA, 64 nt, hsa
ccuacaugcugucauugaacagagauguggggagaaauguaaacaaucagcucacaggcaucaa

SEQ ID NO: 359773 - RNA, 64 nt, hsa
acacauaagaauacacucuggagaaagaccuuauaaauguaagacaugugggaaaggcuuuuau

SEQ ID NO: 359774 - RNA, 64 nt, hsa
acacguaagaaugcacucuguagaaagaccuuauaaauguaagauaugugggaaaggcuuuuau

SEQ ID NO: 359775 - RNA, 64 nt, hsa
ucacacaugaauguguaguggagagaaccuugguaaauguaaagagugugggagagccuuuagu

SEQ ID NO: 359776 - RNA, 64 nt, hsa
ucauuugaaaacuucuaauacagcaaaauccuauaaauguaaguacuucaaaaagccucaugca

SEQ ID NO: 359777 - RNA, 64 nt, hsa
aacaacugauaccagccgcugcaaaaucaugccaaaauguaaagaccaucgagacuaggaagaa

SEQ ID NO: 359778 - RNA, 64 nt, hsa
cagcaucaaauucucacauaacaauauuagcuuuaaauguaaaugggcuaaaugcuccaauuaa

SEQ ID NO: 359779 - RNA, 64 nt, hsa
ugaccacauaguuggaaguaaagcacuccucagcaaauguaaaggaacaaaaauuauaacaaac

SEQ ID NO: 359780 - RNA, 64 nt, hsa
ggaugcaaggcugguucaacauacgcaaaucaauaaauguaauccagcauauaaacagaaccaa

SEQ ID NO: 359781 - RNA, 64 nt, hsa
caugugaagaaagugcacgcugaauagaaacuauaaauguaaauaucgaaaguuuuucaauuuu

SEQ ID NO: 359782 - RNA, 64 nt, hsa
gcacaugagaaugcacacuggagagaaaccuuauaaauguaaggauuguggcaacgccuucauu

SEQ ID NO: 359783 - RNA, 64 nt, hsa
acaugaaaggacucauacuggagagaaacccuacaaauguaaggaaugugggaaagccuuuuau

SEQ ID NO: 359784 - RNA, 64 nt, hsa
acaugaaaaggcucauacuggagagaaacccuacaaauguaaggaaugugggaaacccuucauu

SEQ ID NO: 359785 - RNA, 64 nt, hsa
acauaaaagaacacacagugcagggauagucuacaaauguaaggccugugggaaagccuucagu

SEQ ID NO: 359786 - RNA, 64 nt, hsa
guauaagugucaggaauauggagagaagccauauaaauguaagaaaugugggaaacccuucagu

SEQ ID NO: 359787 - RNA, 64 nt, hsa
acaugaaaggacucacacuagggagaaaaucuauaaauguaaaugugggaaagccuuuagugau

SEQ ID NO: 359788 - RNA, 64 nt, hsa
acacaugauaaggcacacuagagauggaccucauaaauguaagauaugugggaaaggcuuugau

SEQ ID NO: 359789 - RNA, 64 nt, hsa
acacauggcagugcagcauggagauggaccuuauaaauguaaguugugugggaaagcauuuuuc

SEQ ID NO: 359790 - RNA, 64 nt, hsa
agaucagggaagaucaauacgaaagucacaggauaaauguaagaugcgauaugguagagcgcuu

SEQ ID NO: 359791 - RNA, 64 nt, hsa
uuaugaccuuuucuuuggaagaguaaggacauuaaaauguaacaugcaugaugaaaaucuaagu

SEQ ID NO: 359792 - RNA, 64 nt, hsa
acaucagggaauucagauuggagaaaaacccugcaaauguaauaaauuugaaaaaaaaguuuuc

SEQ ID NO: 359793 - RNA, 64 nt, hsa
acaaaagauaauucauacuagagagaaacccuacaaauguaaagaauguggcaaagcauuuaac

SEQ ID NO: 359794 - RNA, 64 nt, hsa
aauuuuuacaaaauuuagugcauacaaaauuuuuaaauguaauuccacaauuaguguauuaagu

SEQ ID NO: 359795 - RNA, 64 nt, hsa
caagcaacccaguuuuauacuuuuaguuauuuuaaaauguaaaauuaaauuguuauugauuaca

SEQ ID NO: 359796 - RNA, 64 nt, hsa
cuaggcaucaaaaacuuuuuugaugaaaccauacaaauguaacgugcaugcuuaagcuuuuacc

SEQ ID NO: 359797 - RNA, 64 nt, hsa
ucuucaaagaauucuugcuggugagaaaccuaacaaauguaaugaauguggcaaggucuucugg

SEQ ID NO: 359798 - RNA, 64 nt, hsa
auaaccccccaaaaaaucacacaaauauauuuuaaaauguaaauauuuuaucgcuucuguuuuc

SEQ ID NO: 359799 - RNA, 64 nt, hsa
auuuaaugcauagccucuucagaaugcaauuuuaaaauguaaaggcucuuuuauaaccccccaa

SEQ ID NO: 359800 - RNA, 64 nt, hsa
uauguaauaugcugagguggcgaccucaguggagaaauguaaagacugaauugaauuuuaagcu

SEQ ID NO: 359801 - RNA, 64 nt, hsa
guauuuaaaauaugcuuccacauuucaaaauauaaaauguaacaugacaagagauuuugcguuu

SEQ ID NO: 359802 - RNA, 64 nt, hsa
auaaaggaugucagagaaacuuuaugcauauuaaaaauguaauguaauuauaagcgauuccccu

SEQ ID NO: 359803 - RNA, 64 nt, hsa
uaagcacaggccauuuuucacuuugguauuaauaaaauguaaaaaaaaaaaacuggcugaaugg

SEQ ID NO: 359804 - RNA, 64 nt, hsa
aaaaguauaaguaacaugcuuuguugcagccaaaaaauguaaucugcuuuuuuaugacagaauu

SEQ ID NO: 359805 - RNA, 64 nt, hsa
cgcccaggugucagcucuccguuuaaagaaugaaaaauguaacucaugaugaucugugaaaccu

SEQ ID NO: 359806 - RNA, 64 nt, hsa
uugucuuuucacucuaucucaaaaaaaguguugcaaauguaaaacauugccaucuucucacaaa

SEQ ID NO: 359807 - RNA, 64 nt, hsa
cuaaaugucacaaaaaauuauacuuccuuaaaguaaauguaaugauuucuucuuuuccuauuga

SEQ ID NO: 359808 - RNA, 64 nt, hsa
uaacaacaagaauaucaggaaggaacuuuucaagaaauguaauuauaaaucuacaucaaacaga

SEQ ID NO: 359809 - RNA, 64 nt, hsa
uagacuaaacaaaucacaaauuguucaguucuuaaaauguaauuaugucacacacacaaaaaau

SEQ ID NO: 359810 - RNA, 64 nt, hsa
auuuccccuaaucuuuucugaaucuucugaaaccaaauguaacuauguuuuaucguccagugac

SEQ ID NO: 359811 - RNA, 64 nt, hsa
uuuuugaaaucaguaaacacuguguauuguuguaaaauguaaaggucacuuuucacauccuuga

SEQ ID NO: 359812 - RNA, 64 nt, hsa
gagauauucugcagcugauagagcagcauuuuaaaaauguaacagguggaaaauuacacugugc

SEQ ID NO: 359813 - RNA, 64 nt, hsa
ugugauuggcuaaacaaucucgcauuaaaaauucaaauguaaauugaauucacaugaaaaauca

SEQ ID NO: 359814 - RNA, 64 nt, hsa
augcauuuauucacaagcaaccccaaaaguccaaaaauguaauaauuuugacaaggcccaaagu

SEQ ID NO: 359815 - RNA, 64 nt, hsa
caagugacacaaaaaugauuacugcauagaaaucaaauguaaguuuagcuucuaaaugaaauaa

SEQ ID NO: 359816 - RNA, 64 nt, hsa
guuuaaauagauauucuauauuaaacacuaauuuaaauguaauaaaggccaaaggccucuguau

SEQ ID NO: 359817 - RNA, 64 nt, hsa
uguaagugaaaaaaaaucacauucauuuguuuaaaaauguaaagcuauuuuguagaggcucagu

SEQ ID NO: 359818 - RNA, 64 nt, hsa
acuugcuuuuauguccacuuuuugagugguacuuaaauguaaaguaacaaccugaauugaguca

SEQ ID NO: 359819 - RNA, 64 nt, hsa; identical to SEQ ID NO: 359808

SEQ ID NO: 359820 - RNA, 64 nt, hsa
uagacuaaacaaaucacaaauuguucaguucuuaaaauguaauuaugucacacacacaaaaaaa

SEQ ID NO: 359821 - RNA, 64 nt, hsa
accucaugagucuaccugagcauucaggcagcacugacaauaguuaugccuguacuaaggagca

SEQ ID NO: 359822 - RNA, 64 nt, hsa
gcaguuccaucaggucccccccaggugcaggugcugacaauacugcugccuuacccgccauaca

SEQ ID NO: 359823 - RNA, 64 nt, hsa
guaacaucaagugaucagaacuaaguuacugggaugacaauaauugcuauuugaaauauaugcu

SEQ ID NO: 359824 - RNA, 64 nt, hsa
aauauauaugcuaaaguauaaagaguaauaauaaugacaauaaacaaaccccugugugccuacc

SEQ ID NO: 359825 - RNA, 64 nt, hsa
guauacaaaccagggagaguuuucuuuacacccuugacaauauaucacauacucuucaagauca

SEQ ID NO: 359826 - RNA, 64 nt, hsa
ccaacaguuccaagccagauagucucgugaacagugacaauacagaaauaagguguuauuucug

SEQ ID NO: 359827 - RNA, 64 nt, hsa
acgccuauaaagauugugcaguaagaauuuuuauugacaauaauuaaaauuuuuuuugacaauu

SEQ ID NO: 359828 - RNA, 64 nt, hsa
aaggaauguuuccuuuauaaaucacagaagaaaaugacaauaucuguuggauauuugauauaau

SEQ ID NO: 359829 - RNA, 64 nt, hsa
uaugugagaauuuucuccuaagucaugcagguaaugacaauauacuguaaauaccacaugugag

SEQ ID NO: 359830 - RNA, 64 nt, hsa
guaaucaggcaaaugaguucaacuggauuucuuuugacaauacuguugguaccuauuacuuggg

SEQ ID NO: 359831 - RNA, 64 nt, hsa
uucguaugugugaauaucugugugcuguacagagugacaauagaaauaaauguuugguuucuug

SEQ ID NO: 359832 - RNA, 64 nt, hsa
agaagagggggaggggaagcuuuauuuauagaaaugacaauagagggccacggggaggcccccc

SEQ ID NO: 359833 - RNA, 64 nt, hsa
aggagagaaaaaagaaauugguuaugaauaaaagugacaauaaaacaugagauauaaaucaagc

SEQ ID NO: 359834 - RNA, 64 nt, hsa
agaguguguguguguguguguguguguaacacuuugacaauacuaaacucucauaagcauuuaa

SEQ ID NO: 359835 - RNA, 64 nt, hsa
uaacacuuuuguuagcucuuugaccauaaaauaaugacaauaagcuguuucuauguauuuguuu

SEQ ID NO: 359836 - RNA, 64 nt, hsa
uuuaauuuuaaacugaacaauaaucaucuuuuccugacaauaaauaucaaucucuaucaucauc

SEQ ID NO: 359837 - RNA, 64 nt, hsa
agugaguguccuguucccagugcccgguuauuuaugauuaaauuacugaagugucuaaaaagaa

SEQ ID NO: 359838 - RNA, 64 nt, hsa
ucauaccuaaggauguugugaggcgugagugagaugauuaaagcguuccagagagugcgcucuu

SEQ ID NO: 359839 - RNA, 64 nt, hsa
uuuuaauaccaaaagaguucuuuugaaauggaacugauuaaaagggcagagggucuguugccag

SEQ ID NO: 359840 - RNA, 64 nt, hsa
gggguugcggagaaaucaaguuuaaaauuccuucugauuaaaaaaauauaguggaauacaauug

SEQ ID NO: 359841 - RNA, 64 nt, hsa
aaugucauuacuuucucuuuguuauuauaaugugugauuaaaugcuuuuuuaaauugcuaaggg

SEQ ID NO: 359842 - RNA, 64 nt, hsa
uuuacuuuuucuucccuucuucccuauugaaccuugauuaaaauguaugaauacaauacuugga

SEQ ID NO: 359843 - RNA, 64 nt, hsa
uaauuuguguguuuuuagcugugacacaacugugugauuaaaagguauacuuuaguagacauuu

SEQ ID NO: 359844 - RNA, 64 nt, hsa
caacuaacgcaaccaagugugcuaaaaaugagcuugauuaaaucaaccaccuauuuuugacaug

SEQ ID NO: 359845 - RNA, 64 nt, hsa
uggauugacccuccauuugcaguaccuucccagcugauuaaaguucagcagugguauugagguu

SEQ ID NO: 359846 - RNA, 64 nt, hsa
gcuuuguuuuaugcuacuccucccacccugcccaugauuaaacaucauguauguagaagaucuu

SEQ ID NO: 359847 - RNA, 50 nt, hsa
ccgcucgucugugugggugaugauuaaagcauucucauugcacaguucug

SEQ ID NO: 359848 - RNA, 64 nt, hsa
ugaauccauguuauuguauuguaaauaauuuagaugauuaaaauggauuguuuaaaaaguuuua

SEQ ID NO: 359849 - RNA, 64 nt, hsa
aaauuuuaguaauaaauucccaaaacuaucauguugauuaaaaauaaaaaguaaccguaaccuc

SEQ ID NO: 359850 - RNA, 64 nt, hsa
auauuuagaaguaaaguugacaggacaggaugauugauuaaaagaggggagcaagggaauuuga

SEQ ID NO: 359851 - RNA, 64 nt, hsa
aaaaauagaaaggaaaacuugaaucaauacucauugauuaaaauggaauaaagaaagagcagcu

SEQ ID NO: 359852 - RNA, 64 nt, hsa
uucauuugcauacaguuauugacuuuuucccagcugauuaaaagauagucaagaaauucugcaa

SEQ ID NO: 359853 - RNA, 64 nt, hsa
augugauguuuugauauauguuuacaguguagaaugauuaaaucaauguaauaaauuuauugcc

SEQ ID NO: 359854 - RNA, 64 nt, hsa
gcuucaaguauuuguucaugacacgucaacucgaugauuaaaauccuucaacacuucucauuca

SEQ ID NO: 359855 - RNA, 64 nt, hsa
augcaaaaagguagaguaacacaauuacaauacaugauuaaaugcaauaguccagguacuuaag

SEQ ID NO: 359856 - RNA, 64 nt, hsa
agccuacagucuauuuaugauuacauaucaaaauugauuaaaacacuuccauuucuaaaaguuc

SEQ ID NO: 359857 - RNA, 64 nt, hsa
uacuuuccuuauuggcaacuuauggacucgcuagugauuaaacgaggcaaugacugugagcgag

SEQ ID NO: 359858 - RNA, 64 nt, hsa
auuggccuuaauauaccuaaaucuccaaaaacagugauuaaagcaagagaauuauuacaagggc

SEQ ID NO: 359859 - RNA, 64 nt, hsa
guggugacccacugaaaauuaauaaugguacuuaugauuaaaaacgcauuuaauacuaacugca

SEQ ID NO: 359860 - RNA, 64 nt, hsa
uucuuggguucaaccuuugaaucaauuuuaccacugauuaaauaaaugacucaaagacaucugu

SEQ ID NO: 359861 - RNA, 64 nt, hsa
uggggaguuacuuacauguucaucugcugucuugugauuaaaaucaucucuguagugaccacgu

SEQ ID NO: 359862 - RNA, 64 nt, hsa
caugcaauggugucuguguaauuauuuugcucuuugauuaaaaaaaagacccccagcaauaaaa

SEQ ID NO: 359863 - RNA, 64 nt, hsa
aguauuacaaagauaugucauuagauccaagugcugauuaaauuuuuauaguuuaucagaaaag

SEQ ID NO: 359864 - RNA, 64 nt, hsa
ucacuuuuuacacauugggcacaaagauaagcuuugauuaaaguaguaaguaaaaggcuaccua

SEQ ID NO: 359865 - RNA, 64 nt, hsa
guggcagcuucccaaguauucgauuucauucaugugauuaaaacaaguugccauauuucaaagc

SEQ ID NO: 359866 - RNA, 64 nt, hsa
uguuugguuuguuuuaaauucugugaaaguggcuugauuaaaagacuccuuuuaaauggaagcc

SEQ ID NO: 359867 - RNA, 64 nt, hsa
auuuucuuuugugauuauaagaaagaguaguuguugauuaaauuuucagacuaaauauaggaca

SEQ ID NO: 359868 - RNA, 64 nt, hsa
uuggcugguuuucucucacugaaauggccagucgugauuaaagugauaaaaccccauaucuguu

SEQ ID NO: 359869 - RNA, 64 nt, hsa
uugguauuauugccauaguuguuauuuaauugcuugauuaaacucagucaaauauccuuccuaa

SEQ ID NO: 359870 - RNA, 64 nt, hsa
accuagguuauauauuagccauuccuaagacuccugauuaaauauuacaaauuuguucaguuca

SEQ ID NO: 359871 - RNA, 64 nt, hsa
aaacaugaaagagauguucucauuuuucuuuuucugauuaaacgucugaugcauaucauuuuuc

SEQ ID NO: 359872 - RNA, 64 nt, hsa
uaaauuaaauguuucuuauuucacuuaacucauuugauuaaacuguauucuaaaacauuugggg

SEQ ID NO: 359873 - RNA, 64 nt, hsa
caguuuuaaagggagccaugcucuuaaaggcaguugauuaaagaaccuguuacaucucugccuu

SEQ ID NO: 359874 - RNA, 64 nt, hsa
cccuuaaaaugucuaguaaagcuugcacauggauugauuaaaagcaaauaccugucuuagggaa

SEQ ID NO: 359875 - RNA, 64 nt, hsa
uaucucaagaaacaagaugauuguaacauguccaugauuaaacuauuggcagauuauugcugug

SEQ ID NO: 359876 - RNA, 64 nt, hsa
uguuuaccagaguguguauuuuacauaauguucuugauuaaaaagacuuguuuguaaauuaucc

SEQ ID NO: 359877 - RNA, 64 nt, hsa
guggggaagcuuucaaauauaauuuuacuggaacugauuaaaggccaaguauuuuauuacuacc

SEQ ID NO: 359878 - RNA, 64 nt, hsa
ugaggcuaaacuggauuagcaauuuauuaaaaacugauuaaaaagugaguuccauuaauaaaca

SEQ ID NO: 359879 - RNA, 64 nt, hsa
uuuuuuuccucuuucgaaugugcuuugcuuuuuuugauuaaaaagaauuuuuuuuuuccuuuuu

SEQ ID NO: 359880 - RNA, 64 nt, hsa
guuguggacaaaaagccaaaauaaauauucuuccugauuaaaaaaauuuuuuuugaaaaaaaca

SEQ ID NO: 359881 - RNA, 64 nt, hsa
uuuagguaaauuuauauugaguuuaacaccugugugauuaaagacaacuuuccaauguaguauc

SEQ ID NO: 359882 - RNA, 64 nt, hsa
gacuacuucccuugcuaaucacagagauuaguaaugauuaaauuaauaucuucaggaauauuuu

SEQ ID NO: 359883 - RNA, 64 nt, hsa
gcucaaaacagcagcgucgucauugaagucugcuugauuaaaccauaauaucuuuguaauaauu

SEQ ID NO: 359884 - RNA, 64 nt, hsa
cgauacucaucuugcacggccagaacuguuugguugauuaaaauacaucagcucuuaaaaacuc

SEQ ID NO: 359885 - RNA, 64 nt, hsa
auguuuauuugcugacugaauuaagauuuaagaaugauuaaaaauaagcuuuuacuuuuuaaaa

SEQ ID NO: 359886 - RNA, 64 nt, hsa
uuuuaaaaacuguaugugacauuaauaugccuaaugauuaaaauuauagugaugaaauaacaaa

SEQ ID NO: 359887 - RNA, 64 nt, hsa
uacauagagcauuuucacuauugcugaaugggaaugauuaaaaacaagguauuuuucgggccag

SEQ ID NO: 359888 - RNA, 64 nt, hsa
ccugaauugggcuuuuuaacuuagaagcaacacuugauuaaacaucuuuagaaagcuauugcuu

SEQ ID NO: 359889 - RNA, 64 nt, hsa
uuuucaaaaaguuaaaaaaaaagacauauaagguugauuaaagggaaaaaaggcuccaguuugu

SEQ ID NO: 359890 - RNA, 64 nt, hsa
gaauacaaaggguauacucuguuggaugcaccagaaacuggaaacugggaccaguggcagagau

SEQ ID NO: 359891 - RNA, 64 nt, hsa
acccagaugcccaugagcaagagaguggacaaguaaacuggaauauucacauaauagaacauua

SEQ ID NO: 359892 - RNA, 64 nt, hsa
ugugauguggauggggccccagauggaagguuugaaacuggauucucgauuuuuagcaaaaaag

SEQ ID NO: 359893 - RNA, 64 nt, hsa
gaaacucgcaucgccaauagucucuauggaagucaaacuggagguccuguugucgcagagcauu

SEQ ID NO: 359894 - RNA, 64 nt, hsa
agugccuauaacaagacagagaccucuggucagcaaacuggaacucaguaaacuggagaaauag

SEQ ID NO: 359895 - RNA, 64 nt, hsa
acagagaccucuggucagcaaacuggaacucaguaaacuggagaaauaguaucgaugggagguu

SEQ ID NO: 359896 - RNA, 64 nt, hsa
cagguggauacccgcuuccauggucuugcacuauaaacuggaauggauuucucaaugcgggacc

SEQ ID NO: 359897 - RNA, 64 nt, hsa
aaagcuaauuuuuuuuacaugucaauauuggcacaaacuggaaugaaagaauaguuugauucag

SEQ ID NO: 359898 - RNA, 64 nt, hsa
gcuccagggcgggaggcaagcccccuugccuuucaaacuggaaaccccagagaaaacggugccc

SEQ ID NO: 359899 - RNA, 64 nt, hsa
uuguauaacucuaaacgcccaugauaguagcuucaaacuggaaauagcgaaauaaaauaacuca

SEQ ID NO: 359900 - RNA, 64 nt, hsa
uuccuucauaaauauuuaucuuuuguuuguguuaaaacuggagaguguuuaaaaauuuccuuuu

SEQ ID NO: 359901 - RNA, 64 nt, hsa
cuuuuaaauguggaaaggcuuuuaaaauauuuuaaaacuggaccuguauuauccugaauacacu

SEQ ID NO: 359902 - RNA, 64 nt, hsa
cugauuuugagaauuuaaagcagauuaccuuuuaaaacuggaccaacuaaguaauugguauuua

SEQ ID NO: 359903 - RNA, 64 nt, hsa
guggacaggauucgauuaaguauucccucuugucaaacuggaagcuaggggaaaaagagggauu

SEQ ID NO: 359904 - RNA, 64 nt, hsa
aguuagggcagucaguaaagugagcuuuagaaagaaacuggaauuuuaacuucauuuuguaucu

SEQ ID NO: 359905 - RNA, 64 nt, hsa
aauauuucagaggcuccauucacagcuuucagauaaacuggaguguucagauggacuguuuuaa

SEQ ID NO: 359906 - RNA, 64 nt, hsa
cccuuuacugccacagcugcucaccuugucuggcaaacuggagggaccucagaaacuggacucc

SEQ ID NO: 359907 - RNA, 64 nt, hsa
gcucaccuugucuggcaaacuggagggaccucagaaacuggacuccugcauguccuugggggcg

SEQ ID NO: 359908 - RNA, 64 nt, hsa
uuagaauagucagcuauccugagcaaaaggaaucaaacuggaggaaucauauuaccugacuucc

SEQ ID NO: 359909 - RNA, 64 nt, hsa
gaaaagauaaugucuuuaauaaauggugcugggaaaacuggauauccauaugcagaagaaugaa

SEQ ID NO: 359910 - RNA, 64 nt, hsa
agauuuuuuuccccuagauuuugagggagcagagaaacuggaaaaaacuuuagucaauaucucg

SEQ ID NO: 359911 - RNA, 64 nt, hsa
acagggcucaacugaauaagaggcuuaagaggauaaacuggagcagaaauaagccuuaggugcu

SEQ ID NO: 359912 - RNA, 64 nt, hsa
cagggcaacugaacagauugcacaugggauagccaaacuggacuuucuuuguuuccucuuuaaa

SEQ ID NO: 359913 - RNA, 64 nt, hsa
aauugugcaaccaccagaaaaacacuacuguggcaaacuggagaagugccaauuuaauucuaac

SEQ ID NO: 359914 - RNA, 64 nt, hsa
aagaacaguucuauccuggugccuuacgaauaaaaaacuggauucugguuuacagcagcuuuac

SEQ ID NO: 359915 - RNA, 64 nt, hsa
cggcaacuucuaccgagagccauggcucaacaccaaacuggacaguagacaucaugaucccucc

SEQ ID NO: 359916 - RNA, 64 nt, hsa
ucagacccagugaaaacuaaggauagauguuuaaaaacuggaggucuccugauaaggagaacac

SEQ ID NO: 359917 - RNA, 64 nt, hsa
aaaguguuuucuuuuuuuuaaaucaagacuuuuaaaacuggauuuccucccaucacuguuuuuu

SEQ ID NO: 359918 - RNA, 64 nt, hsa
uggccacagccaguaaaucaggccagagugucucaaacuggacaagaaaugugcugcauugccg

SEQ ID NO: 359919 - RNA, 64 nt, hsa
gucuccuucuagcuuuuaggcagccuacucuuggaaacuggaggaaacugcccugagaauuauu

SEQ ID NO: 359920 - RNA, 64 nt, hsa
uuaaaauuuauuauuuugaucuugaauuauuuauaaacuggaaagugguuugauuauugugagu

SEQ ID NO: 359921 - RNA, 64 nt, hsa
caaacaaacaaacaaacaacguaucuuacugacuaaacuggaauggaaaucuuauaauuagugu

SEQ ID NO: 359922 - RNA, 64 nt, hsa
aaccuuggcuaaauggagcagcgaaaucaacgagaaacuggacuuuuuaaacccucuucagagc

SEQ ID NO: 359923 - RNA, 64 nt, hsa
caucccuuuuuucuuuguuguuuuuguugaaaacaaacuggaaacuuguuucuuuuuuuguaua

SEQ ID NO: 359924 - RNA, 64 nt, hsa
aaacaucauccacgccaugaucauguaucgccguaaacuggaccgugaagaaaucaagccugug

SEQ ID NO: 359925 - RNA, 64 nt, hsa
gaaaggugagacccucucccaagaggagcagagaaaacuggaagaagauuugcugguagaaguc

SEQ ID NO: 359926 - RNA, 64 nt, hsa
aaauagugaaaauaccaaauacugaugaggauacaaacuggauauuuuauacauugcugacagg

SEQ ID NO: 359927 - RNA, 64 nt, hsa
aaauauucauaggagcuuuauuuguaauagccccaaacuggaaacaacccagauguccuacaac

SEQ ID NO: 359928 - RNA, 64 nt, hsa
uugccuucuugaacuuccugagucacacagaaagcaacuguacacaguagaauucuguggcgca

SEQ ID NO: 359929 - RNA, 64 nt, hsa
ucaguucauucaccugauuacuuugguugcagcacaacuguauauauuguauaaccgaaauuga

SEQ ID NO: 359930 - RNA, 64 nt, hsa
aaaaauacaaaaauuagcugggcguggcggugcgcaacuguagucccagcuacucgggaggcug

SEQ ID NO: 359931 - RNA, 64 nt, hsa
uggcaaguguagguugcagugagcugagauugagcaacuguacuccagcuuggcgacagagcaa

SEQ ID NO: 359932 - RNA, 64 nt, hsa
gagucaacuagaggcaagggaguugagagagcugcaacuguaaagggcaagaacaggcagaggu

SEQ ID NO: 359933 - RNA, 64 nt, hsa
ccacgguuauugggugaaauuugagauuguaggccaacuguauuuucaagcuucugaacuuagg

SEQ ID NO: 359934 - RNA, 64 nt, hsa
gcuucguugaauuuuuuuugacacuggaaauguucaacuguaguuuuauuaaggaagccaggca

SEQ ID NO: 359935 - RNA, 64 nt, hsa
ccucaauacugauucacaauugaguuaaauuagacaacuguaagagaaaaauuuaugcuuugua

SEQ ID NO: 359936 - RNA, 64 nt, hsa
aauaaauauacauuuaguggcuugggcuauggucuccaaagauccuucaaaaauacaucaagcc

SEQ ID NO: 359937 - RNA, 64 nt, hsa
acugauuucuucacaauccuucucaaauuacaauuccaaagagccgccacucaacagucagaug

SEQ ID NO: 359938 - RNA, 64 nt, hsa
caauuauaggaaaacauaguuggaaauguaaucauccaaagaucauuuuuaaaaugaaauuuaa

SEQ ID NO: 359939 - RNA, 64 nt, hsa
augauuccuuuuuauuuguagcagcauaauuauuuccaaagaccccaguauuugcugcuauuuu

SEQ ID NO: 359940 - RNA, 64 nt, hsa
aagucuuuaauuuaauuuuuguuuuuugccuaaauccaaagaaaaagggcugccgggccaggcg

SEQ ID NO: 359941 - RNA, 64 nt, hsa
uuuaguuccuacuuuagccacugguuucucagaauccaaagaucacauauucuaguguaacacu

SEQ ID NO: 359942 - RNA, 64 nt, hsa
agaagggcacauuuaucuaggggcauuucagguuuccaaagaaaggaauguaugccugggaaag

SEQ ID NO: 359943 - RNA, 64 nt, hsa
aaaagccuuuauugacuaauugauuuaaccucaguccaaagaacagucucuauacuugcccuca

SEQ ID NO: 359944 - RNA, 64 nt, hsa
uaagauuugcuaauguucuacauuaagugccuucuccaaagacaucccucuuugccucauaugu

SEQ ID NO: 359945 - RNA, 64 nt, hsa
gaaguuuuaaaaaaaaaguuguggaaaggaaaguuccaaagaggugguuucugaggaagucaga

SEQ ID NO: 359946 - RNA, 64 nt, hsa
gucuaaagucaaucauccgagauggguuuuccauuccaaagaaaggcaauaugguuccuuccuu

SEQ ID NO: 359947 - RNA, 64 nt, hsa
guucaagggaaaugaucagucauugcauuguuauuccaaagagcagccaacaguggccuccccc

SEQ ID NO: 359948 - RNA, 64 nt, hsa
ucaguauaaggaaacguaauuaugauugauuuuuuccaaagaugacaagcuguguugaaauaca

SEQ ID NO: 359949 - RNA, 64 nt, hsa
caauauacuugaaaaaaaugaauguauuuuuuucuccaaagaacagcauguuucacucaauggu

SEQ ID NO: 359950 - RNA, 64 nt, hsa
aguuuuguuaaaucuagaaacaugaaauuaguauuccaaagagauucugaaauuucuuuucuug

SEQ ID NO: 359951 - RNA, 64 nt, hsa
caaauuggcaauuuaacgagccacuuccaugaucuccaaagaaaccaaaauacaaacacaauau

SEQ ID NO: 359952 - RNA, 64 nt, hsa
cagaauuucugaugauuuggguucuuuuccauaguccaaagaaacagaucagcucuucagguau

SEQ ID NO: 359953 - RNA, 64 nt, hsa
aggucccagaacaaggaagucacuuuucaguggauccaaagaaucuacuccuuaaaccuggaga

SEQ ID NO: 359954 - RNA, 64 nt, hsa
ugaaaacccagacugucuccacggccugcccagucgaccccaaaggaacacugacaucaauuuu

SEQ ID NO: 359955 - RNA, 64 nt, hsa
cgaagcucauucccaacgugcaaagccaaggcagcgaccccaggaccucuucuggagauggaag

SEQ ID NO: 359956 - RNA, 64 nt, hsa
ucuugccucugcugaugggggcuggcaaacuugacgaccccaacuccugccugcccccacugug

SEQ ID NO: 359957 - RNA, 64 nt, hsa
uccuuggcccugcuggucccugucgccccauccccgaccccaccucacucuuucgugaauguuc

SEQ ID NO: 359958 - RNA, 64 nt, hsa
aucugaagcacaaggcccacccucaccuaucugucgaccccauuuccuaccaccuuuguggccg

SEQ ID NO: 359959 - RNA, 64 nt, hsa
aucugucgaccccauuuccuaccaccuuuguggccgaccccaagcaccccagagauaugaggca

SEQ ID NO: 359960 - RNA, 64 nt, hsa
agagagcuauggagucaaggcauguuuaagaugggagguagagcaugccaauauugauggcaac

SEQ ID NO: 359961 - RNA, 64 nt, hsa
augggaguacccagugggggagcagcuguacaaugagguagacuccuagagguuaauuaucauc

SEQ ID NO: 359962 - RNA, 64 nt, hsa
ggcaguggagcuggggagauguggucggauuagggagguagaaucaauaagacucagugaagaa

SEQ ID NO: 359963 - RNA, 64 nt, hsa
ggaggccgaggugggagggucuucugagcccagggagguagaggcuucagugagcugagaucgc

SEQ ID NO: 359964 - RNA, 64 nt, hsa
ggagagguagagaugagacaagagguagaggggagagguagagguagccacgagcugauaauua

SEQ ID NO: 359965 - RNA, 64 nt, hsa
gcaggggucagggggagagguagagaugagacaagagguagaggggagagguagagguagccac

SEQ ID NO: 359966 - RNA, 64 nt, hsa
cugcaaaaugacccagaggcaggggucagggggagagguagagaugagacaagagguagagggg

SEQ ID NO: 359967 - RNA, 64 nt, hsa
ggcuuaugccuguaaucccagcacuuugcaggccgagguagacagauggcuugagcucaggagu

SEQ ID NO: 359968 - RNA, 64 nt, hsa
aggaggcugaggcaggagaaucguuugaacccaggagguagagguugcagugagcugagauugc

SEQ ID NO: 359969 - RNA, 64 nt, hsa
uuuaaaacuaggacuuuuccccccauaagccaaggagguagaauuacuaauacaaggguuaaag

SEQ ID NO: 359970 - RNA, 64 nt, hsa
gaugauagauuaacaauaaagugauguucugguggagguagacugaaauuuuuuuaauucaugu

SEQ ID NO: 359971 - RNA, 64 nt, hsa
cagucuguuuucuuccauguuuaauuagaagugagagguagaaguacuucaaauucaacaggcc

SEQ ID NO: 359972 - RNA, 64 nt, hsa
gauguucacuuuugcaauuuguggaggguggagagagguagacuuuuguuguguguuuuauaaa

SEQ ID NO: 359973 - RNA, 64 nt, hsa
agacaaaagcaagaggaucagaugaagaaaaggagagguagauacagucagugucacuucagga

SEQ ID NO: 359974 - RNA, 64 nt, hsa
auuuagaaaaaggaacaccugaugaagaaaaggagagguagauacagucagugucacuucagga

SEQ ID NO: 359975 - RNA, 64 nt, hsa; identical to SEQ ID NO: 206430

SEQ ID NO: 359976 - RNA, 64 nt, hsa; identical to SEQ ID NO: 206431

SEQ ID NO: 359977 - RNA, 64 nt, hsa; identical to SEQ ID NO: 206432

SEQ ID NO: 359978 - RNA, 64 nt, hsa; identical to SEQ ID NO: 206433

SEQ ID NO: 359979 - RNA, 64 nt, hsa; identical to SEQ ID NO: 206434

SEQ ID NO: 359980 - RNA, 64 nt, hsa; identical to SEQ ID NO: 206435

SEQ ID NO: 359981 - RNA, 64 nt, hsa; identical to SEQ ID NO: 206436

SEQ ID NO: 359982 - RNA, 64 nt, hsa; identical to SEQ ID NO: 206437

SEQ ID NO: 359983 - RNA, 64 nt, hsa; identical to SEQ ID NO: 206438

SEQ ID NO: 359984 - RNA, 64 nt, hsa; identical to SEQ ID NO: 206439

SEQ ID NO: 359985 - RNA, 64 nt, hsa; identical to SEQ ID NO: 206440

SEQ ID NO: 359986 - RNA, 64 nt, hsa; identical to SEQ ID NO: 206441

SEQ ID NO: 359987 - RNA, 64 nt, hsa; identical to SEQ ID NO: 206442

SEQ ID NO: 359988 - RNA, 64 nt, hsa; identical to SEQ ID NO: 206443

SEQ ID NO: 359989 - RNA, 64 nt, hsa; identical to SEQ ID NO: 206444

SEQ ID NO: 359990 - RNA, 64 nt, hsa; identical to SEQ ID NO: 206445

SEQ ID NO: 359991 - RNA, 64 nt, hsa; identical to SEQ ID NO: 206446

SEQ ID NO: 359992 - RNA, 64 nt, hsa; identical to SEQ ID NO: 206447

SEQ ID NO: 359993 - RNA, 64 nt, hsa; identical to SEQ ID NO: 206448

SEQ ID NO: 359994 - RNA, 64 nt, hsa; identical to SEQ ID NO: 206449

SEQ ID NO: 359995 - RNA, 64 nt, hsa; identical to SEQ ID NO: 206450

SEQ ID NO: 359996 - RNA, 64 nt, hsa; identical to SEQ ID NO: 206451

SEQ ID NO: 359997 - RNA, 64 nt, hsa; identical to SEQ ID NO: 206452

SEQ ID NO: 359998 - RNA, 64 nt, hsa; identical to SEQ ID NO: 206453

SEQ ID NO: 359999 - RNA, 64 nt, hsa; identical to SEQ ID NO: 206454

SEQ ID NO: 360000 - RNA, 64 nt, hsa; identical to SEQ ID NO: 206455

SEQ ID NO: 360001 - RNA, 64 nt, hsa; identical to SEQ ID NO: 206456

SEQ ID NO: 360002 - RNA, 64 nt, hsa; identical to SEQ ID NO: 206457

SEQ ID NO: 360003 - RNA, 64 nt, hsa; identical to SEQ ID NO: 206458

SEQ ID NO: 360004 - RNA, 64 nt, hsa; identical to SEQ ID NO: 206459

SEQ ID NO: 360005 - RNA, 64 nt, hsa; identical to SEQ ID NO: 206460

SEQ ID NO: 360006 - RNA, 64 nt, hsa; identical to SEQ ID NO: 206461

SEQ ID NO: 360007 - RNA, 64 nt, hsa; identical to SEQ ID NO: 206462

SEQ ID NO: 360008 - RNA, 64 nt, hsa; identical to SEQ ID NO: 206463

SEQ ID NO: 360009 - RNA, 64 nt, hsa; identical to SEQ ID NO: 206464

SEQ ID NO: 360010 - RNA, 64 nt, hsa; identical to SEQ ID NO: 206465

SEQ ID NO: 360011 - RNA, 64 nt, hsa; identical to SEQ ID NO: 206466

SEQ ID NO: 360012 - RNA, 64 nt, hsa; identical to SEQ ID NO: 206467

SEQ ID NO: 360013 - RNA, 64 nt, hsa; identical to SEQ ID NO: 206468

SEQ ID NO: 360014 - RNA, 64 nt, hsa; identical to SEQ ID NO: 206469

SEQ ID NO: 360015 - RNA, 64 nt, hsa; identical to SEQ ID NO: 206470

SEQ ID NO: 360016 - RNA, 64 nt, hsa; identical to SEQ ID NO: 206471

SEQ ID NO: 360017 - RNA, 64 nt, hsa; identical to SEQ ID NO: 206472

SEQ ID NO: 360018 - RNA, 64 nt, hsa; identical to SEQ ID NO: 206473

SEQ ID NO: 360019 - RNA, 64 nt, hsa; identical to SEQ ID NO: 206474

SEQ ID NO: 360020 - RNA, 64 nt, hsa; identical to SEQ ID NO: 206475

SEQ ID NO: 360021 - RNA, 64 nt, hsa; identical to SEQ ID NO: 206476

SEQ ID NO: 360022 - RNA, 64 nt, hsa; identical to SEQ ID NO: 206477

SEQ ID NO: 360023 - RNA, 64 nt, hsa; identical to SEQ ID NO: 206478

SEQ ID NO: 360024 - RNA, 64 nt, hsa; identical to SEQ ID NO: 206479

SEQ ID NO: 360025 - RNA, 64 nt, hsa; identical to SEQ ID NO: 206480

SEQ ID NO: 360026 - RNA, 64 nt, hsa; identical to SEQ ID NO: 206481

SEQ ID NO: 360027 - RNA, 64 nt, hsa; identical to SEQ ID NO: 206482

SEQ ID NO: 360028 - RNA, 64 nt, hsa; identical to SEQ ID NO: 206483

SEQ ID NO: 360029 - RNA, 64 nt, hsa; identical to SEQ ID NO: 206484

SEQ ID NO: 360030 - RNA, 64 nt, hsa; identical to SEQ ID NO: 206485

SEQ ID NO: 360031 - RNA, 64 nt, hsa; identical to SEQ ID NO: 206486

SEQ ID NO: 360032 - RNA, 64 nt, hsa; identical to SEQ ID NO: 206487

SEQ ID NO: 360033 - RNA, 64 nt, hsa; identical to SEQ ID NO: 206488

SEQ ID NO: 360034 - RNA, 55 nt, hsa; identical to SEQ ID NO: 206489

SEQ ID NO: 360035 - RNA, 64 nt, hsa; identical to SEQ ID NO: 206490

SEQ ID NO: 360036 - RNA, 64 nt, hsa; identical to SEQ ID NO: 206491

SEQ ID NO: 360037 - RNA, 64 nt, hsa; identical to SEQ ID NO: 206492

SEQ ID NO: 360038 - RNA, 64 nt, hsa; identical to SEQ ID NO: 206493

SEQ ID NO: 360039 - RNA, 64 nt, hsa; identical to SEQ ID NO: 206494

SEQ ID NO: 360040 - RNA, 64 nt, hsa; identical to SEQ ID NO: 206495

SEQ ID NO: 360041 - RNA, 64 nt, hsa; identical to SEQ ID NO: 206496

SEQ ID NO: 360042 - RNA, 64 nt, hsa
aagaacacuuucccuuuaaaggaaacaaaagugaauaccauauuguuuuuacugucauaguguu

SEQ ID NO: 360043 - RNA, 64 nt, hsa
uugccuguccugcuuaguuuuuacuugcuggaugauaccauaauguaucaaggagcguccaugg

SEQ ID NO: 360044 - RNA, 64 nt, hsa
uuuacaaaugucacaccuaauaaucuuuuauaauauaccauauuucauuaaaguuuuguuagag

SEQ ID NO: 360045 - RNA, 64 nt, hsa
acacuuaauacaauguaaaugcuauguaguuguuauaccauacugguuagugaauaauuacaug

SEQ ID NO: 360046 - RNA, 64 nt, hsa
ucuucuuuucucccaauuauuuucauaugaaagcaccuacaauuagccuguuaguccuauucag

SEQ ID NO: 360047 - RNA, 64 nt, hsa
uccacuuucuuuaagaaucaggggguacagaauaaccuacaaacaaccucuucaaaguacccuu

SEQ ID NO: 360048 - RNA, 64 nt, hsa
gccagggauuaggaauuaagaucgugcacaaaaguuuccuuaaaauuccuggauggcugcagau

SEQ ID NO: 360049 - RNA, 64 nt, hsa
gacauucaacuguaguauccauauguugcuuaaauuuccuuaugagccccaugauggaaagacu

SEQ ID NO: 360050 - RNA, 64 nt, hsa
cuuuagcuccagccacuuguggcaaacaaccucguuuccuuacaaauuccagcaugugacuuug

SEQ ID NO: 360051 - RNA, 64 nt, hsa
ugaaucauaaaaugaaguuggugcuuguaugguguuuccuuagccuaaagaaugaucuguuguu

SEQ ID NO: 360052 - RNA, 64 nt, hsa
cugauccagccacuggauauuuuauauccucccuuuuccuuaagcacaaugucagaccaaauug

SEQ ID NO: 360053 - RNA, 64 nt, hsa
ucaaauguuguacccuugccauuuaggacugaacuuuccuuagcccaagggacccagugacagu

SEQ ID NO: 360054 - RNA, 64 nt, hsa
guuugcaaaauauguuugaaagcauugguagugcuuuccuuaucaguaacuggaguucuccugc

SEQ ID NO: 360055 - RNA, 64 nt, hsa
ucaguccaacacuguguuuacauacacucgugcuuuuccuuaucugacuucucauuuuguauca

SEQ ID NO: 360056 - RNA, 64 nt, hsa
gacuugaacaagucacuuaacuucuacaagcuuguuuccuuauuugucaaauuagauuacacua

SEQ ID NO: 360057 - RNA, 64 nt, hsa
uaaagcaaacuauaggggucccuaauuuuggauuuuuccuuaaguguaagaaacaaugcuucaa

SEQ ID NO: 360058 - RNA, 64 nt, hsa
cucagcuucuacccccuccugccuuuccuuccucuuuccuuacuuccuucccuucccucggcuu

SEQ ID NO: 360059 - RNA, 64 nt, hsa
aggacucagcugagaaaggacaacuggguuccgcuuuccuuaacccuacacccuuuagcuggau

SEQ ID NO: 360060 - RNA, 64 nt, hsa
gugaacuuuccaagguuauuucugaauguaacaauuuccuuaaaaaugacuuauccaauuucug

SEQ ID NO: 360061 - RNA, 64 nt, hsa
aacuuuagucuccagaacuaaacaagucccuaaguuuccuuauuuuaauuuacugugacuagau

SEQ ID NO: 360062 - RNA, 64 nt, hsa
cugaguguuucacaccuuaucuauguagaauauauuuccuuauucagaauuucuaaaaguuuaa

SEQ ID NO: 360063 - RNA, 64 nt, hsa
uauuuuaauguuucuuggggaauauguuagagaauuuccuuacucuugauugugggauacuauu

SEQ ID NO: 360064 - RNA, 64 nt, hsa
aaagggagcuaacauuaauuaugcauguacuauauuuccuuaauaugagagauaauuuuuuaau

SEQ ID NO: 360065 - RNA, 64 nt, hsa
uaucuauuuggagauucagugcauaacuaaguauuuuccuuaauacuaaagauuuuaaauaaua

SEQ ID NO: 360066 - RNA, 64 nt, hsa
uuuaugcagguuaggggaucugauuaauguuuccuuuccuuacaacagcuagagaaaacaucuc

SEQ ID NO: 360067 - RNA, 64 nt, hsa
agcaacucuucaagauguugcaaaagcuuacauuuuuccuuaaaaggaaaacugaaacccaguc

SEQ ID NO: 360068 - RNA, 64 nt, hsa
acaggucuaaauuacaaugaaguuaagguuaggauuuccuuaguucuuaaugucucaguuuuug

SEQ ID NO: 360069 - RNA, 64 nt, hsa
acacuuauacugacuuucaucugguaguagaugauuuccuuaauuuuuauuagguacguaacua

SEQ ID NO: 360070 - RNA, 64 nt, hsa
guagcuuauucuucuauaucuacauaugcaaagcuuuccuuaacaguaaaggguacauaugcau

SEQ ID NO: 360071 - RNA, 64 nt, hsa
aggggcuggaggaagauguaaaagaugaaaauguuuuccuuaucacuuuucuuucuccacccac

SEQ ID NO: 360072 - RNA, 64 nt, hsa
uuuguguauaacugcaauggccuuuuuuuccagauuuccuuauugacuuuuuguuugccuuacc

SEQ ID NO: 360073 - RNA, 64 nt, hsa
ucacacguaggccaguuaacuuagagaaaaucuauuuccuuaccucuagccagucacuuccuuu

SEQ ID NO: 360074 - RNA, 64 nt, hsa
ugcuguuuuaaaauucauuucaaauuggacucgauuuccuuauaucuaauauauaucugggaga

SEQ ID NO: 360075 - RNA, 64 nt, hsa
auaccccacuauauaaaagucauauuauuauaaauuuccuuauuauauaaacuuuauauacuau

SEQ ID NO: 360076 - RNA, 64 nt, hsa
auaggucauuuaauauugguuuauggugcuuuuauuuccuuaacuugaaaacaucuuucugaga

SEQ ID NO: 360077 - RNA, 64 nt, hsa
agugcuaagaaagugcauuagaauggaauugcccuuuccuuaaggagacaguuugggcucuccc

SEQ ID NO: 360078 - RNA, 64 nt, hsa
ggggguugggaggaagcauguaagagagggaacauuuccuuagauguuacccagaugguucugg

SEQ ID NO: 360079 - RNA, 64 nt, hsa
aguggguggagaggaagcauauguggaaggagcauuuccuuagaagucauccagaugcuucugg

SEQ ID NO: 360080 - RNA, 64 nt, hsa
uuuuaccguguagguuguauacuuacauuuuuucuuuccuuaauuuauacaugauccuuuuucc

SEQ ID NO: 360081 - RNA, 64 nt, hsa
cauuuuuucuuuccuuaauuuauacaugauccuuuuuccuuaauuuauacaugauccaggcaca

SEQ ID NO: 360082 - RNA, 64 nt, hsa
uuaaaccuguugguuaugaaaauuugaagaucauuuuccuuaaauuaucucagcuuuuaacuuc

SEQ ID NO: 360083 - RNA, 64 nt, hsa
cuguaaacaggguacgugaagagcuggcauuuauuuuccuuacgagaagguuuucguagagaau

SEQ ID NO: 360084 - RNA, 64 nt, hsa
gcagaauuaauuguuauuauuuuccuaggcgcaauuuccuuaaacguacaguuuaaauucaagg

SEQ ID NO: 360085 - RNA, 64 nt, hsa
uguguguguguauguguguguguguguguguguguuuccuuauugucauuccauuauauaucca

SEQ ID NO: 360086 - RNA, 64 nt, hsa
uuccaaaagucacaauuuguacaagaaccuuugcuuuccuuagacuuguucugcauuuuauuuu

SEQ ID NO: 360087 - RNA, 64 nt, hsa
uauguauauccagugcaaucaacugucauuucuuuuuccuuaaaacauaugaguauauagaaag

SEQ ID NO: 360088 - RNA, 64 nt, hsa
gagaaaagccaaauuagaaaauccuauguccuaguuuccuuaccaaggauaauuaaauauauca

SEQ ID NO: 360089 - RNA, 64 nt, hsa
gagaauagauggcuaacaagagguuagaaauacuuuuccuuaauuuuaauccacaguauguuac

SEQ ID NO: 360090 - RNA, 64 nt, hsa
aagauuuauucuauucuuacuguuguguauuuuguuuccuuauagccauuaaagaaagcacuaa

SEQ ID NO: 360091 - RNA, 64 nt, hsa
aaacaaacaaaaauccuuugcccucagaagugcauuuccuuauucuuuaguguaauuguaauuu

SEQ ID NO: 360092 - RNA, 64 nt, hsa
cugguaaagagcaggaccagaggaagaauccagauuuccuuaugcuugggccucacacuagcuc

SEQ ID NO: 360093 - RNA, 64 nt, hsa
ccaauucuguguuugcuuuuagcagauaugaagauuuccuuauuucuuuguaauugugcagaua

SEQ ID NO: 360094 - RNA, 64 nt, hsa
guucuuaaugcagccacuauaacuugauaagucauugcacuauuuaaaaaguuuuaguaauauc

SEQ ID NO: 360095 - RNA, 64 nt, hsa
uauacacagucuguuucuucuauuccuagacauauugcacuacuuuuucagugguucuuggucc

SEQ ID NO: 360096 - RNA, 64 nt, hsa
gauuauuuuuauauuugaaaagaaaauguuuuauuugcacuacugaguaggaagaguuaauugu

SEQ ID NO: 360097 - RNA, 64 nt, hsa
gugcuuuccuuaucaguaacuggaguucuccugcuugcacuagagaagguaaagagagaaucag

SEQ ID NO: 360098 - RNA, 64 nt, hsa
cuggacuauauaacuuaaaagaaguaaaacguaauugcacuacuguuuuccagacuggaaaaaa

SEQ ID NO: 360099 - RNA, 64 nt, hsa
aagggcaaaaacggauugaaaugaacauagcguuuugcacuaaugauaagauaaccugagaggu

SEQ ID NO: 360100 - RNA, 64 nt, hsa
ggcugucaacauucaaagcagcagagagggaacuuugcacuauugggguaugauguuuggguca

SEQ ID NO: 360101 - RNA, 64 nt, hsa
ggaaauucagcuuuugcagaagcaguguuucuacuugcacuagcauggccucugacgugaccau

SEQ ID NO: 360102 - RNA, 64 nt, hsa
auuuuauucuuauucaaagaaauaucugagcucuuugcacuaccuguuaucaguagugccuuua

SEQ ID NO: 360103 - RNA, 64 nt, hsa
aaguaacuuuaaauuaugccguuacuuuucauauuugcacuaagauauuuccaggcugcauuug

SEQ ID NO: 360104 - RNA, 64 nt, hsa; identical to SEQ ID NO: 93499

SEQ ID NO: 360105 - RNA, 64 nt, hsa; identical to SEQ ID NO: 93500

SEQ ID NO: 360106 - RNA, 64 nt, hsa; identical to SEQ ID NO: 93501

SEQ ID NO: 360107 - RNA, 64 nt, hsa; identical to SEQ ID NO: 93502

SEQ ID NO: 360108 - RNA, 64 nt, hsa; identical to SEQ ID NO: 93503

SEQ ID NO: 360109 - RNA, 64 nt, hsa; identical to SEQ ID NO: 93504

SEQ ID NO: 360110 - RNA, 64 nt, hsa; identical to SEQ ID NO: 93505

SEQ ID NO: 360111 - RNA, 64 nt, hsa; identical to SEQ ID NO: 93506

SEQ ID NO: 360112 - RNA, 64 nt, hsa; identical to SEQ ID NO: 93507

SEQ ID NO: 360113 - RNA, 64 nt, hsa; identical to SEQ ID NO: 93508

SEQ ID NO: 360114 - RNA, 64 nt, hsa; identical to SEQ ID NO: 93509

SEQ ID NO: 360115 - RNA, 64 nt, hsa; identical to SEQ ID NO: 93510

SEQ ID NO: 360116 - RNA, 64 nt, hsa; identical to SEQ ID NO: 93511

SEQ ID NO: 360117 - RNA, 64 nt, hsa; identical to SEQ ID NO: 93512

SEQ ID NO: 360118 - RNA, 64 nt, hsa; identical to SEQ ID NO: 93513

SEQ ID NO: 360119 - RNA, 64 nt, hsa; identical to SEQ ID NO: 93514

SEQ ID NO: 360120 - RNA, 64 nt, hsa; identical to SEQ ID NO: 93515

SEQ ID NO: 360121 - RNA, 64 nt, hsa; identical to SEQ ID NO: 93516

SEQ ID NO: 360122 - RNA, 64 nt, hsa; identical to SEQ ID NO: 93517

SEQ ID NO: 360123 - RNA, 64 nt, hsa; identical to SEQ ID NO: 93518

SEQ ID NO: 360124 - RNA, 64 nt, hsa; identical to SEQ ID NO: 93519

SEQ ID NO: 360125 - RNA, 64 nt, hsa; identical to SEQ ID NO: 93520

SEQ ID NO: 360126 - RNA, 64 nt, hsa; identical to SEQ ID NO: 93521

SEQ ID NO: 360127 - RNA, 64 nt, hsa; identical to SEQ ID NO: 93522

SEQ ID NO: 360128 - RNA, 64 nt, hsa; identical to SEQ ID NO: 93523

SEQ ID NO: 360129 - RNA, 64 nt, hsa; identical to SEQ ID NO: 93524

SEQ ID NO: 360130 - RNA, 64 nt, hsa; identical to SEQ ID NO: 93525

SEQ ID NO: 360131 - RNA, 64 nt, hsa; identical to SEQ ID NO: 93526

SEQ ID NO: 360132 - RNA, 64 nt, hsa; identical to SEQ ID NO: 93527

SEQ ID NO: 360133 - RNA, 64 nt, hsa; identical to SEQ ID NO: 93528

SEQ ID NO: 360134 - RNA, 64 nt, hsa; identical to SEQ ID NO: 93529

SEQ ID NO: 360135 - RNA, 64 nt, hsa; identical to SEQ ID NO: 93530

SEQ ID NO: 360136 - RNA, 64 nt, hsa; identical to SEQ ID NO: 93531

SEQ ID NO: 360137 - RNA, 64 nt, hsa; identical to SEQ ID NO: 93532

SEQ ID NO: 360138 - RNA, 64 nt, hsa; identical to SEQ ID NO: 93533

SEQ ID NO: 360139 - RNA, 64 nt, hsa; identical to SEQ ID NO: 93534

SEQ ID NO: 360140 - RNA, 64 nt, hsa; identical to SEQ ID NO: 93535

SEQ ID NO: 360141 - RNA, 64 nt, hsa; identical to SEQ ID NO: 93536

SEQ ID NO: 360142 - RNA, 64 nt, hsa; identical to SEQ ID NO: 93537

SEQ ID NO: 360143 - RNA, 64 nt, hsa; identical to SEQ ID NO: 93538

SEQ ID NO: 360144 - RNA, 64 nt, hsa; identical to SEQ ID NO: 93539

SEQ ID NO: 360145 - RNA, 64 nt, hsa; identical to SEQ ID NO: 93540

SEQ ID NO: 360146 - RNA, 64 nt, hsa; identical to SEQ ID NO: 93541

SEQ ID NO: 360147 - RNA, 64 nt, hsa; identical to SEQ ID NO: 93542

SEQ ID NO: 360148 - RNA, 64 nt, hsa; identical to SEQ ID NO: 93543

SEQ ID NO: 360149 - RNA, 64 nt, hsa; identical to SEQ ID NO: 93544

SEQ ID NO: 360150 - RNA, 64 nt, hsa; identical to SEQ ID NO: 93545

SEQ ID NO: 360151 - RNA, 64 nt, hsa; identical to SEQ ID NO: 93546

SEQ ID NO: 360152 - RNA, 64 nt, hsa; identical to SEQ ID NO: 93547

SEQ ID NO: 360153 - RNA, 64 nt, hsa; identical to SEQ ID NO: 93548

SEQ ID NO: 360154 - RNA, 64 nt, hsa; identical to SEQ ID NO: 93549

SEQ ID NO: 360155 - RNA, 64 nt, hsa; identical to SEQ ID NO: 93550

SEQ ID NO: 360156 - RNA, 64 nt, hsa; identical to SEQ ID NO: 93551

SEQ ID NO: 360157 - RNA, 64 nt, hsa; identical to SEQ ID NO: 93552

SEQ ID NO: 360158 - RNA, 64 nt, hsa; identical to SEQ ID NO: 93553

SEQ ID NO: 360159 - RNA, 64 nt, hsa; identical to SEQ ID NO: 93554

SEQ ID NO: 360160 - RNA, 64 nt, hsa; identical to SEQ ID NO: 93555

SEQ ID NO: 360161 - RNA, 64 nt, hsa; identical to SEQ ID NO: 93556

SEQ ID NO: 360162 - RNA, 64 nt, hsa; identical to SEQ ID NO: 93557

SEQ ID NO: 360163 - RNA, 64 nt, hsa; identical to SEQ ID NO: 93558

SEQ ID NO: 360164 - RNA, 64 nt, hsa; identical to SEQ ID NO: 93559

SEQ ID NO: 360165 - RNA, 64 nt, hsa; identical to SEQ ID NO: 93560

SEQ ID NO: 360166 - RNA, 64 nt, hsa; identical to SEQ ID NO: 93561

SEQ ID NO: 360167 - RNA, 64 nt, hsa; identical to SEQ ID NO: 93562

SEQ ID NO: 360168 - RNA, 64 nt, hsa; identical to SEQ ID NO: 93563

SEQ ID NO: 360169 - RNA, 64 nt, hsa; identical to SEQ ID NO: 93564

SEQ ID NO: 360170 - RNA, 64 nt, hsa; identical to SEQ ID NO: 93565

SEQ ID NO: 360171 - RNA, 64 nt, hsa; identical to SEQ ID NO: 93566

SEQ ID NO: 360172 - RNA, 64 nt, hsa; identical to SEQ ID NO: 93567

SEQ ID NO: 360173 - RNA, 64 nt, hsa; identical to SEQ ID NO: 93568

SEQ ID NO: 360174 - RNA, 64 nt, hsa; identical to SEQ ID NO: 93569

SEQ ID NO: 360175 - RNA, 64 nt, hsa; identical to SEQ ID NO: 93570

SEQ ID NO: 360176 - RNA, 64 nt, hsa; identical to SEQ ID NO: 93571

SEQ ID NO: 360177 - RNA, 64 nt, hsa; identical to SEQ ID NO: 93572

SEQ ID NO: 360178 - RNA, 64 nt, hsa; identical to SEQ ID NO: 93573

SEQ ID NO: 360179 - RNA, 64 nt, hsa; identical to SEQ ID NO: 93574

SEQ ID NO: 360180 - RNA, 64 nt, hsa; identical to SEQ ID NO: 93575

SEQ ID NO: 360181 - RNA, 64 nt, hsa; identical to SEQ ID NO: 93576

SEQ ID NO: 360182 - RNA, 64 nt, hsa; identical to SEQ ID NO: 93577

SEQ ID NO: 360183 - RNA, 64 nt, hsa; identical to SEQ ID NO: 93578

SEQ ID NO: 360184 - RNA, 64 nt, hsa; identical to SEQ ID NO: 93579

SEQ ID NO: 360185 - RNA, 64 nt, hsa; identical to SEQ ID NO: 93580

SEQ ID NO: 360186 - RNA, 64 nt, hsa; identical to SEQ ID NO: 93581

SEQ ID NO: 360187 - RNA, 64 nt, hsa; identical to SEQ ID NO: 93582

SEQ ID NO: 360188 - RNA, 64 nt, hsa; identical to SEQ ID NO: 220348

SEQ ID NO: 360189 - RNA, 64 nt, hsa; identical to SEQ ID NO: 220349

SEQ ID NO: 360190 - RNA, 64 nt, hsa; identical to SEQ ID NO: 220350

SEQ ID NO: 360191 - RNA, 64 nt, hsa; identical to SEQ ID NO: 220351

SEQ ID NO: 360192 - RNA, 64 nt, hsa; identical to SEQ ID NO: 220352

SEQ ID NO: 360193 - RNA, 64 nt, hsa; identical to SEQ ID NO: 220353

SEQ ID NO: 360194 - RNA, 64 nt, hsa; identical to SEQ ID NO: 220354

SEQ ID NO: 360195 - RNA, 64 nt, hsa; identical to SEQ ID NO: 220355

SEQ ID NO: 360196 - RNA, 64 nt, hsa; identical to SEQ ID NO: 360046

SEQ ID NO: 360197 - RNA, 64 nt, hsa; identical to SEQ ID NO: 360047

SEQ ID NO: 360198 - RNA, 64 nt, hsa
ggaacuuuuaauugacaugagaugcuaaagucagacauuggaauuggaagaacuauaaagugug

SEQ ID NO: 360199 - RNA, 64 nt, hsa
cucaaaguaccauuaugguuuccauaugguaauuacauuggaaaguucugcaauaagauucuag

SEQ ID NO: 360200 - RNA, 64 nt, hsa
cuggccaaauacugaauaaacaguugaaggaaagacauuggaaaaagcuuuugaggauaauguu

SEQ ID NO: 360201 - RNA, 64 nt, hsa
uugguuaauuuuguuuuggccagagaugaauuuuacauuggaagaauaacaaaauaagauuugu

SEQ ID NO: 360202 - RNA, 64 nt, hsa
uucuccaagagaugaagcggugaaguugggauuuacauuggaagugcuguagacuucuuuaugu

SEQ ID NO: 360203 - RNA, 64 nt, hsa
ccagccugacauuagacagaauacccuuuguaauacauuggaaauuuuuacucaugccuuuuug

SEQ ID NO: 360204 - RNA, 64 nt, hsa
uugugcaaacuuuucauuccauaacagucuuuucacauuggauuuuaaacaaaguggcucuggg

SEQ ID NO: 360205 - RNA, 64 nt, hsa
aauauugcauucugagcuagcaaauguucccaguacauuggaccuaaacggugacucucauucu

SEQ ID NO: 360206 - RNA, 64 nt, hsa
uucuugggggaaaauaccacaaucaccgaugcaaacauuggaagauuauugagagcccuagaaa

SEQ ID NO: 360207 - RNA, 64 nt, hsa
accuugguuggaagggaauagaaauguuugcugaacauuggagaaucucaacaugucuccuacu

SEQ ID NO: 360208 - RNA, 64 nt, hsa
ggccaaaagcuguugauuuucuuaaguugacgguugucaauauaucgaacuguucccaaguuag

SEQ ID NO: 360209 - RNA, 64 nt, hsa
agcuuaaacuuaugucaaaaugucugcagcaguuugucaauaaaguuuaguccuuuuuuaauca

SEQ ID NO: 360210 - RNA, 64 nt, hsa
gguuuacauacguuuguguggugacauuuuagaaugucaauaaauuugcuuuuugagauguuga

SEQ ID NO: 360211 - RNA, 64 nt, hsa
uuauuuguuacuguauccucauuuguaaucuaguugucaauaaauggcccggacaugucuugcu

SEQ ID NO: 360212 - RNA, 64 nt, hsa
aaguuugacuuuuguccaguaaauugcuaaguaaugucaauaaaucgaguauggguauuaugca

SEQ ID NO: 360213 - RNA, 64 nt, hsa
uugcccuucgccauuguuuccaaagaucaaggaaugucaauaacauuuuaaaggaccaauaaac

SEQ ID NO: 360214 - RNA, 64 nt, hsa
ugagccauuuauaccuuugaaauauuaaaaucacugucaauauuuuuauuuuuaacucuggauu

SEQ ID NO: 360215 - RNA, 64 nt, hsa
ugaaauugaccuaguucagauacagggugcuccuugucaauacugagccauuuauaccuuugaa

SEQ ID NO: 360216 - RNA, 64 nt, hsa
ccuuauuuuugaugcuuuuauucaugacaagaauugucaauauaagaauguauaucuuuuuugc

SEQ ID NO: 360217 - RNA, 64 nt, hsa
aagcauuauuuguuucuaauaaaaguaauggcuuugucaauauauugguggguuuaaaacuuug

SEQ ID NO: 360218 - RNA, 64 nt, hsa
cuaacacacuauauacuuccaagaaguaugucaaugucaauauuuugucaauaaagauuuauca

SEQ ID NO: 360219 - RNA, 64 nt, hsa
uauacuuccaagaaguaugucaaugucaauauuuugucaauaaagauuuaucaauaugcccuca

SEQ ID NO: 360220 - RNA, 64 nt, hsa
ugaaugcauugucuuacucaugucuguggcccugugucaauaugacuccuggcacauuuaacug

SEQ ID NO: 360221 - RNA, 64 nt, hsa
agauuaauagacccucaaaugcuagugacugaggugucaauagccuuuaccaagauaagauccu

SEQ ID NO: 360222 - RNA, 64 nt, hsa
uaaugaauuaucacccagacaugugcagaugaaaugucaauauaagaaaaaucaagguauuugg

SEQ ID NO: 360223 - RNA, 64 nt, hsa
ggagaggauggugcauuuccagugcuuccuuaccugucaauaacaaugguggccaccugggucc

SEQ ID NO: 360224 - RNA, 64 nt, hsa
uaauguacauugcuuuguagucugcucuauauauugucaauauguucccauauuaaauauuuug

SEQ ID NO: 360225 - RNA, 64 nt, hsa
gccaauuucugggccuucuggguuuuuucuacacugucaauaauuaucgcuuuaauugguguua

SEQ ID NO: 360226 - RNA, 64 nt, hsa
acuuugugaccccuaguuuaggacccacuucagcugucaauauguuuguaacucaggugacuga

SEQ ID NO: 360227 - RNA, 64 nt, hsa
caguguuuuauaggaguacuaacauuuauugcucugucaauaaugaaaggcucgauguaauaua

SEQ ID NO: 360228 - RNA, 64 nt, hsa
gauagaccugguauacagucacugaacuaguagaugucaauaauuauuauuuuuaaaaauuuuu

SEQ ID NO: 360229 - RNA, 64 nt, hsa
agagaugaagucucacuguguugcccagccugggugucaauaauuauuuuuuaaaaaaaauuuu

SEQ ID NO: 360230 - RNA, 64 nt, hsa
aucacaucucgagucuuaucaaguuuucauucucugucaauaugacaagcucaaagugacagaa

SEQ ID NO: 360231 - RNA, 64 nt, hsa
uuugcucuauguucuuuacuguuucacuggaaagugucaauagaguugccuaagaauaaaaauu

SEQ ID NO: 360232 - RNA, 64 nt, hsa
cauggcuuggggagcagaguauaggauggauugcaguccccagucaccucuucugccagccucc

SEQ ID NO: 360233 - RNA, 64 nt, hsa
aagagguggggaccaaaaccaugcauuccuaagaaguccccaggucaugcugcuguugcuggac

SEQ ID NO: 360234 - RNA, 64 nt, hsa
ggcugccccugaggcuuggcccagcucuaggagcaguccccagggucagggagccccuggugug

SEQ ID NO: 360235 - RNA, 55 nt, hsa
agggcccccuggguguguaauguccaguccccagccaggcucuguccccugccau

SEQ ID NO: 360236 - RNA, 64 nt, hsa
cugggggucgaggguccugcauaugcaccuggggaguccccacacacccgcaccaaaggggaaa

SEQ ID NO: 360237 - RNA, 64 nt, hsa
uaucagagcagcaacccuucuacccacccuacugaguccccauucuaccuucgaaucccaugua

SEQ ID NO: 360238 - RNA, 64 nt, hsa
cauggagaugaccaugaugcugggguuaccucacaguccccacccuuucaaaguugacauaugg

SEQ ID NO: 360239 - RNA, 64 nt, hsa
aguaaaauggcugagcauugcagagaaaaaaaaaaguccccacauuuuauuuuuuaaaaaccau

SEQ ID NO: 360240 - RNA, 64 nt, hsa
agacugacucucucauggcuacuaacaagugucgaguccccaaggcugggggccgagccuggga

SEQ ID NO: 360241 - RNA, 64 nt, hsa
cuacugaggcagaccugcaacagaaguggcauucaguccccagcagacaugggugagcucaccc

SEQ ID NO: 360242 - RNA, 64 nt, hsa
ccagagggcuucaccagugugggauccaccugucaguccccagcgacucucaugacacucauuc

SEQ ID NO: 360243 - RNA, 64 nt, hsa
ucccugcccucauggaccugaccacucaacaaacaguccccaccacaccuaucuccuuaggcaa

SEQ ID NO: 360244 - RNA, 64 nt, hsa
gagcucccagagagacugccuucccuacacuagaaguccccacaaaggcuucugagaccacaaa

SEQ ID NO: 360245 - RNA, 64 nt, hsa
ccuccccuagguaaagaucacacugaagucuucaaguccccagcaaccaaguugggggugguuu

SEQ ID NO: 360246 - RNA, 64 nt, hsa
gcugugacccuggacaaagagcuuuaaccugcugaguccccauuuucucaucugugaaauggag

SEQ ID NO: 360247 - RNA, 64 nt, hsa
guucuuuugauaugcaguuuccagcccuccaaugaguccccagcacagaucucaggcuuguggc

SEQ ID NO: 360248 - RNA, 64 nt, hsa
ugcccaccucccacugcccccucagcacacacacaguccccaggcggccuaggggccaaggcug

SEQ ID NO: 360249 - RNA, 64 nt, hsa
gugcuccuguaccccagccccacucagcacugacaguccccagcuccuaguagugagcugggag

SEQ ID NO: 360250 - RNA, 64 nt, hsa
cugcucuggagggcggcgcucaccucugggucgcaguccccacgaucagccagcagcugugaga

SEQ ID NO: 360251 - RNA, 64 nt, hsa
cuugcaggaggguggguguggugcagagagaggcaguccccaugauaggcccauugguccuggg

SEQ ID NO: 360252 - RNA, 64 nt, hsa
gaggagagccacugggccccuguccccaguccccaguccccagcccugggcuuggcucuuggcu

SEQ ID NO: 360253 - RNA, 64 nt, hsa
uggaugggaggagagccacugggccccuguccccaguccccaguccccagcccugggcuuggcu

SEQ ID NO: 360254 - RNA, 64 nt, hsa
acuaacuacacuuggaucuuacugauccagaaauaguccccauaguuagaguaguuacuuauga

SEQ ID NO: 360255 - RNA, 64 nt, hsa
ggugcuuaccaaagccauagcuuuaaaccuucccaguccccaucaguagcuuccugaaagucuc

SEQ ID NO: 360256 - RNA, 64 nt, hsa
ccacuggcggagccagccuguggauccaagagacaguccccaccugggcuucacggcauccuug

SEQ ID NO: 360257 - RNA, 64 nt, hsa
ccggcucggguggggucacacgguccugcccuagaguccccaucuggcccuggagcugcagaag

SEQ ID NO: 360258 - RNA, 64 nt, hsa
uucccacugagacacgccgcccccacagaggcacaguccccagccaccucugcaacugcagccc

SEQ ID NO: 360259 - RNA, 64 nt, hsa
cacucacugaucuacagccccuguucggcgucagaguccccacuagacccaguggaagggguua

SEQ ID NO: 360260 - RNA, 64 nt, hsa
cccagggaaucccaaauuugaaaauccaaucccaaguccccaggaaacccaaucaugagguccu

SEQ ID NO: 360261 - RNA, 64 nt, hsa
ucuuagaggcccuggacaccugacaaagagacagaguccccacuagcaucuccugacacccgag

SEQ ID NO: 360262 - RNA, 64 nt, hsa
uauccaugagcagugggaaaaggcuaauguaagcaguccccaccgggaguuccccccugcuacc

SEQ ID NO: 360263 - RNA, 64 nt, hsa
ggcuagcaugcguggcucccuggguauuucugucaguccccauggcaagcagugauuuaguaaa

SEQ ID NO: 360264 - RNA, 64 nt, hsa
gauucuugguucuuugagcucguuucagaggcugaguccccacaucagcuuuaguucuuggacu

SEQ ID NO: 360265 - RNA, 64 nt, hsa
gcaccagguaagaggccaaagccccugggguaacaguccccaccgcuacccgagguaaaacaau

SEQ ID NO: 360266 - RNA, 64 nt, hsa
aacaauucagcaagucaggggcuuccucucuguuaguccccaaauccuuacuuauuuuaaaaag

SEQ ID NO: 360267 - RNA, 64 nt, hsa
ggugaagggcacggguccuuguuuuuggguugagaguccccaacccccuugucuucuaccuucu

SEQ ID NO: 360268 - RNA, 64 nt, hsa; identical to SEQ ID NO: 49593

SEQ ID NO: 360269 - RNA, 64 nt, hsa; identical to SEQ ID NO: 49594

SEQ ID NO: 360270 - RNA, 64 nt, hsa; identical to SEQ ID NO: 49595

SEQ ID NO: 360271 - RNA, 64 nt, hsa; identical to SEQ ID NO: 49596

SEQ ID NO: 360272 - RNA, 64 nt, hsa; identical to SEQ ID NO: 49597

SEQ ID NO: 360273 - RNA, 64 nt, hsa; identical to SEQ ID NO: 49598

SEQ ID NO: 360274 - RNA, 64 nt, hsa; identical to SEQ ID NO: 49599

SEQ ID NO: 360275 - RNA, 64 nt, hsa; identical to SEQ ID NO: 49600

SEQ ID NO: 360276 - RNA, 64 nt, hsa; identical to SEQ ID NO: 49601

SEQ ID NO: 360277 - RNA, 64 nt, hsa; identical to SEQ ID NO: 49602

SEQ ID NO: 360278 - RNA, 64 nt, hsa; identical to SEQ ID NO: 49603

SEQ ID NO: 360279 - RNA, 64 nt, hsa; identical to SEQ ID NO: 49604

SEQ ID NO: 360280 - RNA, 64 nt, hsa; identical to SEQ ID NO: 49605

SEQ ID NO: 360281 - RNA, 64 nt, hsa; identical to SEQ ID NO: 49606

SEQ ID NO: 360282 - RNA, 64 nt, hsa; identical to SEQ ID NO: 49607

SEQ ID NO: 360283 - RNA, 64 nt, hsa; identical to SEQ ID NO: 49608

SEQ ID NO: 360284 - RNA, 64 nt, hsa; identical to SEQ ID NO: 49609

SEQ ID NO: 360285 - RNA, 64 nt, hsa; identical to SEQ ID NO: 49610

SEQ ID NO: 360286 - RNA, 64 nt, hsa; identical to SEQ ID NO: 49611

SEQ ID NO: 360287 - RNA, 64 nt, hsa; identical to SEQ ID NO: 49612

SEQ ID NO: 360288 - RNA, 64 nt, hsa; identical to SEQ ID NO: 49613

SEQ ID NO: 360289 - RNA, 64 nt, hsa; identical to SEQ ID NO: 49614

SEQ ID NO: 360290 - RNA, 64 nt, hsa; identical to SEQ ID NO: 49615

SEQ ID NO: 360291 - RNA, 64 nt, hsa; identical to SEQ ID NO: 49616

SEQ ID NO: 360292 - RNA, 64 nt, hsa; identical to SEQ ID NO: 49617

SEQ ID NO: 360293 - RNA, 64 nt, hsa; identical to SEQ ID NO: 49618

SEQ ID NO: 360294 - RNA, 64 nt, hsa; identical to SEQ ID NO: 49619

SEQ ID NO: 360295 - RNA, 64 nt, hsa; identical to SEQ ID NO: 49620

SEQ ID NO: 360296 - RNA, 64 nt, hsa; identical to SEQ ID NO: 49621

SEQ ID NO: 360297 - RNA, 64 nt, hsa; identical to SEQ ID NO: 49622

SEQ ID NO: 360298 - RNA, 64 nt, hsa; identical to SEQ ID NO: 49623

SEQ ID NO: 360299 - RNA, 64 nt, hsa; identical to SEQ ID NO: 49624

SEQ ID NO: 360300 - RNA, 64 nt, hsa; identical to SEQ ID NO: 49625

SEQ ID NO: 360301 - RNA, 64 nt, hsa; identical to SEQ ID NO: 49626

SEQ ID NO: 360302 - RNA, 64 nt, hsa; identical to SEQ ID NO: 49627

SEQ ID NO: 360303 - RNA, 64 nt, hsa; identical to SEQ ID NO: 49628

SEQ ID NO: 360304 - RNA, 64 nt, hsa; identical to SEQ ID NO: 49629

SEQ ID NO: 360305 - RNA, 64 nt, hsa; identical to SEQ ID NO: 49630

SEQ ID NO: 360306 - RNA, 64 nt, hsa; identical to SEQ ID NO: 49631

SEQ ID NO: 360307 - RNA, 64 nt, hsa; identical to SEQ ID NO: 49632

SEQ ID NO: 360308 - RNA, 64 nt, hsa; identical to SEQ ID NO: 49633

SEQ ID NO: 360309 - RNA, 64 nt, hsa; identical to SEQ ID NO: 49634

SEQ ID NO: 360310 - RNA, 64 nt, hsa; identical to SEQ ID NO: 49635

SEQ ID NO: 360311 - RNA, 64 nt, hsa; identical to SEQ ID NO: 49636

SEQ ID NO: 360312 - RNA, 64 nt, hsa; identical to SEQ ID NO: 49637

SEQ ID NO: 360313 - RNA, 64 nt, hsa; identical to SEQ ID NO: 49638

SEQ ID NO: 360314 - RNA, 64 nt, hsa; identical to SEQ ID NO: 49639

SEQ ID NO: 360315 - RNA, 64 nt, hsa; identical to SEQ ID NO: 49640

SEQ ID NO: 360316 - RNA, 64 nt, hsa; identical to SEQ ID NO: 49641

SEQ ID NO: 360317 - RNA, 64 nt, hsa; identical to SEQ ID NO: 49642

SEQ ID NO: 360318 - RNA, 64 nt, hsa; identical to SEQ ID NO: 49643

SEQ ID NO: 360319 - RNA, 64 nt, hsa; identical to SEQ ID NO: 49644

SEQ ID NO: 360320 - RNA, 64 nt, hsa; identical to SEQ ID NO: 49645

SEQ ID NO: 360321 - RNA, 64 nt, hsa; identical to SEQ ID NO: 49646

SEQ ID NO: 360322 - RNA, 64 nt, hsa; identical to SEQ ID NO: 49647

SEQ ID NO: 360323 - RNA, 64 nt, hsa; identical to SEQ ID NO: 49648

SEQ ID NO: 360324 - RNA, 64 nt, hsa; identical to SEQ ID NO: 49649

SEQ ID NO: 360325 - RNA, 64 nt, hsa; identical to SEQ ID NO: 49650

SEQ ID NO: 360326 - RNA, 64 nt, hsa; identical to SEQ ID NO: 49651

SEQ ID NO: 360327 - RNA, 64 nt, hsa; identical to SEQ ID NO: 49652

SEQ ID NO: 360328 - RNA, 64 nt, hsa; identical to SEQ ID NO: 49653

SEQ ID NO: 360329 - RNA, 64 nt, hsa; identical to SEQ ID NO: 49654

SEQ ID NO: 360330 - RNA, 64 nt, hsa; identical to SEQ ID NO: 49655

SEQ ID NO: 360331 - RNA, 64 nt, hsa; identical to SEQ ID NO: 49656

SEQ ID NO: 360332 - RNA, 64 nt, hsa; identical to SEQ ID NO: 49657

SEQ ID NO: 360333 - RNA, 64 nt, hsa; identical to SEQ ID NO: 49658

SEQ ID NO: 360334 - RNA, 64 nt, hsa; identical to SEQ ID NO: 49659

SEQ ID NO: 360335 - RNA, 64 nt, hsa; identical to SEQ ID NO: 49660

SEQ ID NO: 360336 - RNA, 64 nt, hsa; identical to SEQ ID NO: 49661

SEQ ID NO: 360337 - RNA, 64 nt, hsa; identical to SEQ ID NO: 49662

SEQ ID NO: 360338 - RNA, 64 nt, hsa; identical to SEQ ID NO: 49663

SEQ ID NO: 360339 - RNA, 64 nt, hsa; identical to SEQ ID NO: 49664

SEQ ID NO: 360340 - RNA, 64 nt, hsa; identical to SEQ ID NO: 49665

SEQ ID NO: 360341 - RNA, 64 nt, hsa; identical to SEQ ID NO: 49666

SEQ ID NO: 360342 - RNA, 64 nt, hsa; identical to SEQ ID NO: 49667

SEQ ID NO: 360343 - RNA, 64 nt, hsa; identical to SEQ ID NO: 49668

SEQ ID NO: 360344 - RNA, 64 nt, hsa; identical to SEQ ID NO: 49669

SEQ ID NO: 360345 - RNA, 64 nt, hsa; identical to SEQ ID NO: 49670

SEQ ID NO: 360346 - RNA, 64 nt, hsa; identical to SEQ ID NO: 49671

SEQ ID NO: 360347 - RNA, 64 nt, hsa; identical to SEQ ID NO: 49672

SEQ ID NO: 360348 - RNA, 64 nt, hsa; identical to SEQ ID NO: 49673

SEQ ID NO: 360349 - RNA, 64 nt, hsa; identical to SEQ ID NO: 49674

SEQ ID NO: 360350 - RNA, 64 nt, hsa; identical to SEQ ID NO: 49675

SEQ ID NO: 360351 - RNA, 64 nt, hsa; identical to SEQ ID NO: 49676

SEQ ID NO: 360352 - RNA, 64 nt, hsa; identical to SEQ ID NO: 49677

SEQ ID NO: 360353 - RNA, 64 nt, hsa; identical to SEQ ID NO: 49678

SEQ ID NO: 360354 - RNA, 64 nt, hsa; identical to SEQ ID NO: 49679

SEQ ID NO: 360355 - RNA, 64 nt, hsa; identical to SEQ ID NO: 49680

SEQ ID NO: 360356 - RNA, 64 nt, hsa; identical to SEQ ID NO: 49681

SEQ ID NO: 360357 - RNA, 64 nt, hsa; identical to SEQ ID NO: 49682

SEQ ID NO: 360358 - RNA, 64 nt, hsa; identical to SEQ ID NO: 49683

SEQ ID NO: 360359 - RNA, 64 nt, hsa; identical to SEQ ID NO: 49684

SEQ ID NO: 360360 - RNA, 64 nt, hsa; identical to SEQ ID NO: 49685

SEQ ID NO: 360361 - RNA, 64 nt, hsa; identical to SEQ ID NO: 49686

SEQ ID NO: 360362 - RNA, 64 nt, hsa; identical to SEQ ID NO: 49687

SEQ ID NO: 360363 - RNA, 64 nt, hsa; identical to SEQ ID NO: 49688

SEQ ID NO: 360364 - RNA, 64 nt, hsa; identical to SEQ ID NO: 49689

SEQ ID NO: 360365 - RNA, 64 nt, hsa; identical to SEQ ID NO: 49690

SEQ ID NO: 360366 - RNA, 64 nt, hsa; identical to SEQ ID NO: 49691

SEQ ID NO: 360367 - RNA, 64 nt, hsa; identical to SEQ ID NO: 49692

SEQ ID NO: 360368 - RNA, 64 nt, hsa; identical to SEQ ID NO: 49693

SEQ ID NO: 360369 - RNA, 64 nt, hsa; identical to SEQ ID NO: 49694

SEQ ID NO: 360370 - RNA, 64 nt, hsa; identical to SEQ ID NO: 49695

SEQ ID NO: 360371 - RNA, 64 nt, hsa; identical to SEQ ID NO: 49696

SEQ ID NO: 360372 - RNA, 64 nt, hsa; identical to SEQ ID NO: 49697

SEQ ID NO: 360373 - RNA, 64 nt, hsa; identical to SEQ ID NO: 49698

SEQ ID NO: 360374 - RNA, 64 nt, hsa; identical to SEQ ID NO: 49699

SEQ ID NO: 360375 - RNA, 64 nt, hsa; identical to SEQ ID NO: 49700

SEQ ID NO: 360376 - RNA, 64 nt, hsa; identical to SEQ ID NO: 49701

SEQ ID NO: 360377 - RNA, 64 nt, hsa; identical to SEQ ID NO: 49702

SEQ ID NO: 360378 - RNA, 64 nt, hsa; identical to SEQ ID NO: 49703

SEQ ID NO: 360379 - RNA, 64 nt, hsa; identical to SEQ ID NO: 243529

SEQ ID NO: 360380 - RNA, 64 nt, hsa; identical to SEQ ID NO: 243530

SEQ ID NO: 360381 - RNA, 64 nt, hsa; identical to SEQ ID NO: 243531

SEQ ID NO: 360382 - RNA, 64 nt, hsa; identical to SEQ ID NO: 243532

SEQ ID NO: 360383 - RNA, 64 nt, hsa; identical to SEQ ID NO: 243533

SEQ ID NO: 360384 - RNA, 64 nt, hsa; identical to SEQ ID NO: 243534

SEQ ID NO: 360385 - RNA, 64 nt, hsa; identical to SEQ ID NO: 243535

SEQ ID NO: 360386 - RNA, 64 nt, hsa; identical to SEQ ID NO: 243536

SEQ ID NO: 360387 - RNA, 64 nt, hsa; identical to SEQ ID NO: 245168

SEQ ID NO: 360388 - RNA, 64 nt, hsa; identical to SEQ ID NO: 245169

SEQ ID NO: 360389 - RNA, 64 nt, hsa; identical to SEQ ID NO: 245170

SEQ ID NO: 360390 - RNA, 64 nt, hsa; identical to SEQ ID NO: 245171

SEQ ID NO: 360391 - RNA, 64 nt, hsa; identical to SEQ ID NO: 245172

SEQ ID NO: 360392 - RNA, 55 nt, hsa; identical to SEQ ID NO: 245173

SEQ ID NO: 360393 - RNA, 64 nt, hsa; identical to SEQ ID NO: 245174

SEQ ID NO: 360394 - RNA, 64 nt, hsa; identical to SEQ ID NO: 245175

SEQ ID NO: 360395 - RNA, 64 nt, hsa; identical to SEQ ID NO: 245176

SEQ ID NO: 360396 - RNA, 64 nt, hsa; identical to SEQ ID NO: 245177

SEQ ID NO: 360397 - RNA, 64 nt, hsa; identical to SEQ ID NO: 245178

SEQ ID NO: 360398 - RNA, 64 nt, hsa; identical to SEQ ID NO: 245179

SEQ ID NO: 360399 - RNA, 64 nt, hsa; identical to SEQ ID NO: 245180

SEQ ID NO: 360400 - RNA, 64 nt, hsa; identical to SEQ ID NO: 245181

SEQ ID NO: 360401 - RNA, 64 nt, hsa; identical to SEQ ID NO: 245182

SEQ ID NO: 360402 - RNA, 64 nt, hsa; identical to SEQ ID NO: 245183

SEQ ID NO: 360403 - RNA, 64 nt, hsa; identical to SEQ ID NO: 245184

SEQ ID NO: 360404 - RNA, 64 nt, hsa; identical to SEQ ID NO: 245185

SEQ ID NO: 360405 - RNA, 64 nt, hsa; identical to SEQ ID NO: 245186

SEQ ID NO: 360406 - RNA, 64 nt, hsa; identical to SEQ ID NO: 245187

SEQ ID NO: 360407 - RNA, 64 nt, hsa; identical to SEQ ID NO: 245188

SEQ ID NO: 360408 - RNA, 62 nt, hsa; identical to SEQ ID NO: 245189

SEQ ID NO: 360409 - RNA, 64 nt, hsa; identical to SEQ ID NO: 245190

SEQ ID NO: 360410 - RNA, 64 nt, hsa; identical to SEQ ID NO: 245191

SEQ ID NO: 360411 - RNA, 64 nt, hsa; identical to SEQ ID NO: 245192

SEQ ID NO: 360412 - RNA, 64 nt, hsa; identical to SEQ ID NO: 245193

SEQ ID NO: 360413 - RNA, 64 nt, hsa; identical to SEQ ID NO: 245194

SEQ ID NO: 360414 - RNA, 64 nt, hsa; identical to SEQ ID NO: 245195

SEQ ID NO: 360415 - RNA, 64 nt, hsa; identical to SEQ ID NO: 245196

SEQ ID NO: 360416 - RNA, 64 nt, hsa; identical to SEQ ID NO: 245197

SEQ ID NO: 360417 - RNA, 64 nt, hsa; identical to SEQ ID NO: 245198

SEQ ID NO: 360418 - RNA, 64 nt, hsa; identical to SEQ ID NO: 245199

SEQ ID NO: 360419 - RNA, 64 nt, hsa; identical to SEQ ID NO: 245200

SEQ ID NO: 360420 - RNA, 64 nt, hsa; identical to SEQ ID NO: 245201

SEQ ID NO: 360421 - RNA, 64 nt, hsa; identical to SEQ ID NO: 245202

SEQ ID NO: 360422 - RNA, 64 nt, hsa; identical to SEQ ID NO: 245203

SEQ ID NO: 360423 - RNA, 64 nt, hsa; identical to SEQ ID NO: 245204

SEQ ID NO: 360424 - RNA, 64 nt, hsa; identical to SEQ ID NO: 245205

SEQ ID NO: 360425 - RNA, 64 nt, hsa; identical to SEQ ID NO: 245206

SEQ ID NO: 360426 - RNA, 64 nt, hsa; identical to SEQ ID NO: 245207

SEQ ID NO: 360427 - RNA, 64 nt, hsa; identical to SEQ ID NO: 245208

SEQ ID NO: 360428 - RNA, 64 nt, hsa; identical to SEQ ID NO: 245209

SEQ ID NO: 360429 - RNA, 64 nt, hsa; identical to SEQ ID NO: 245210

SEQ ID NO: 360430 - RNA, 64 nt, hsa; identical to SEQ ID NO: 245211

SEQ ID NO: 360431 - RNA, 64 nt, hsa; identical to SEQ ID NO: 147960

SEQ ID NO: 360432 - RNA, 64 nt, hsa; identical to SEQ ID NO: 147961

SEQ ID NO: 360433 - RNA, 64 nt, hsa; identical to SEQ ID NO: 147962

SEQ ID NO: 360434 - RNA, 64 nt, hsa; identical to SEQ ID NO: 147963

SEQ ID NO: 360435 - RNA, 62 nt, hsa
gggguuaggcuucaugccuucaugcccaggcagccacagaaacccacucuuccccgccucac

SEQ ID NO: 360436 - RNA, 62 nt, hsa
cgaaguuggagaaccugacagggcugguccaggccacagaggaugggguuaggcuucaugcc

SEQ ID NO: 360437 - RNA, 62 nt, hsa
caagugacgacaaagauucuguuucaaauauagccacagaaauaaaggagggaccaauaucu

SEQ ID NO: 360438 - RNA, 62 nt, hsa
caagugacgagaaagauucuguuucaaauauagccacagaaauaaagaagggacaacaaucu

SEQ ID NO: 360439 - RNA, 62 nt, hsa
caacugacgaggaagacucuguuucgaauauagccacagaaauaaaggauggagaaaaaucu

SEQ ID NO: 360440 - RNA, 62 nt, hsa
caacugaugagaaagauucuguuucgaacauagccacagaaauaaaggauggagaaaaaucu

SEQ ID NO: 360441 - RNA, 62 nt, hsa
gccacagagucugagauucugaguucagccuagccacagagucuaagauucuguauccucug

SEQ ID NO: 360442 - RNA, 62 nt, hsa
uuucaaagccacagcauaagaaugucagccuagccacagagucugagauucugaguucagcc

SEQ ID NO: 360443 - RNA, 62 nt, hsa
aagccacagaguugaaagccacagaguugaaagccacagaguuaagugaccucagguaacau

SEQ ID NO: 360444 - RNA, 62 nt, hsa
cgccaucuuacacgaaagccacagaguugaaagccacagaguugaaagccacagaguuaagu

SEQ ID NO: 360445 - RNA, 62 nt, hsa
uccauggcccuauaccgccaucuuacacgaaagccacagaguugaaagccacagaguugaaa

SEQ ID NO: 360446 - RNA, 62 nt, hsa
caccucuuuuacaguuagaaacaccagccgaggccacagaaucccaucccuuuccugaguca

SEQ ID NO: 360447 - RNA, 62 nt, hsa
cauugucucaauucaaauccauagauuucgaagccacagagucucucccuggagcagcagac

SEQ ID NO: 360448 - RNA, 62 nt, hsa
cagaauggagcuuagugcuacugaauacccuggccacagagccaccucaggauauucuuuuc

SEQ ID NO: 360449 - RNA, 62 nt, hsa
auaauuuacaaaaaucaaaugaguauugagaagccacagaaauaucaaaaauggugacauca

SEQ ID NO: 360450 - RNA, 62 nt, hsa
gaagagacaguagucugcauacaucgcugcaggccacagagcagcuuggguuggaagagaga

SEQ ID NO: 360451 - RNA, 62 nt, hsa
uacuagugaaucacccacaaggaaaagccacugccacagaggaggcggguccccuugugcgg

SEQ ID NO: 360452 - RNA, 62 nt, hsa
gaaucaccccucugccccugcagcuggaaugugccacagaggccccaccugaaggguggaug

SEQ ID NO: 360453 - RNA, 62 nt, hsa
acugggccagucaacggggggcuccugcccaggccacagagaaccugaguucccgggagcug

SEQ ID NO: 360454 - RNA, 62 nt, hsa
uugggagguguuaacucaaaggugacuucugggccacagaucaagaaagcauuugaucugac

SEQ ID NO: 360455 - RNA, 62 nt, hsa
aaagcaagcacaacuaaaccuucuuaauauccgccacagaaggcucaagaauccagcccuaa

SEQ ID NO: 360456 - RNA, 62 nt, hsa
cacagacacacaaucacacgcagccccuccccgccacagagacacaccauuacauacacaga

SEQ ID NO: 360457 - RNA, 62 nt, hsa
cacagacacgcaaucgcagauacgcccuuccggccacagaaacacaccauuacacacacaua

SEQ ID NO: 360458 - RNA, 62 nt, hsa
cacagacacaaaaucacacacacacccuccccgccacagagacacaccauuacauacacaga

SEQ ID NO: 360459 - RNA, 62 nt, hsa
cacagacacaaaaucacacacacacccuccccgccacagagacaccauuacauacacagaca

SEQ ID NO: 360460 - RNA, 62 nt, hsa
gagacacggucacugauucacacccagucccugccacagaccgucucagacacgcacagugg

SEQ ID NO: 360461 - RNA, 62 nt, hsa
ugggccugcugcaugauucacacccagucccugccacagaccgucucagacacgcacagugg

SEQ ID NO: 360462 - RNA, 62 nt, hsa; identical to SEQ ID NO: 360461

SEQ ID NO: 360463 - RNA, 62 nt, hsa
ccuuuagaucccuuccccuccaugggcuuugggccacagaaugaaccuuugaggccuguaaa

SEQ ID NO: 360464 - RNA, 62 nt, hsa
guacuucaguuuggaucuauugggggaguguggccacagaccgggggaugauugaauuguuc

SEQ ID NO: 360465 - RNA, 60 nt, hsa; identical to SEQ ID NO: 315780

SEQ ID NO: 360466 - RNA, 62 nt, hsa
cucugugcagccucacagggcuuugccacggagccacagagagaugcuggguccccgaggcc

SEQ ID NO: 360467 - RNA, 62 nt, hsa
ccccccagugccuuggcgagggcagguuccaagccacagacgccugccccgaguggacucug

SEQ ID NO: 360468 - RNA, 62 nt, hsa
gccacucucugcccugccaugcggcugguggugccacagagccucaccgugccugaguggca

SEQ ID NO: 360469 - RNA, 62 nt, hsa
caggaagccaggcaaggagagggacagcacaggccacagagggcugcccccaccacacacac

SEQ ID NO: 360470 - RNA, 62 nt, hsa
agauucucugagcacuuucccccauccccagggccacagauccccuuccuuacuuguugggg

SEQ ID NO: 360471 - RNA, 62 nt, hsa
cacagguagccccgacccucucaggcauuccagccacagaacaucaaagugagcgaguacug

SEQ ID NO: 360472 - RNA, 62 nt, hsa
gcaccuccgguuggaggcacccaggcuugccagccacagagcgccccaaagucaccgucauc

SEQ ID NO: 360473 - RNA, 64 nt, hsa
acuaauugauaauugaaguaucaagauacguagaacaccucagagauuuuucuucaggaacuuc

SEQ ID NO: 360474 - RNA, 64 nt, hsa
ugauuaaaggccauuuuuaaaacuuaaaaacucaacaccucacagauuauaauagaaaaagaaa

SEQ ID NO: 360475 - RNA, 64 nt, hsa
caucuauuuugaugcagcauuugauaaugauaaaacaccucacaccucacucuuuauagugcac

SEQ ID NO: 360476 - RNA, 64 nt, hsa
uuugaugcagcauuugauaaugauaaaacaccucacaccucacucuuuauagugcacaaaauga

SEQ ID NO: 360477 - RNA, 64 nt, hsa
agaacccacgcacaugcacaccacaacacacaacacaccucaccucacaccacagcacaccuca

SEQ ID NO: 360478 - RNA, 64 nt, hsa
acaacacacaacacaccucaccucacaccacagcacaccucaccacaccacaccgcacugcacc

SEQ ID NO: 360479 - RNA, 64 nt, hsa
caccauaccucaccacaucucaccacaccacagcacaccucaccacacaacacaccacacccca

SEQ ID NO: 360480 - RNA, 64 nt, hsa
uaccucgccacaucucaccacaccacaccacaccacaccucacugcccacacacggcgcaggcu

SEQ ID NO: 360481 - RNA, 64 nt, hsa
acuaagggggccucagaggaaaccaacccugcugacaccucaaucuuagacucuggccucaaaa

SEQ ID NO: 360482 - RNA, 64 nt, hsa
cagaaccauggaagccaggacgucaggcugaccaacaccucagaccuucugaagcagcccauug

SEQ ID NO: 360483 - RNA, 64 nt, hsa
uugacauauugaaaaaguauaugaacauaaugaaacaccucauuuauuugauaauucacuaaug

SEQ ID NO: 360484 - RNA, 64 nt, hsa
caaaguacucaggcacacagcccacugacaagagacaccucauccauuaacugcuguuuuguac

SEQ ID NO: 360485 - RNA, 64 nt, hsa
ugaggcaggagaauggcaugaaccugggaggcagagcuugcagugagcugagauugcgccacug

SEQ ID NO: 360486 - RNA, 64 nt, hsa
gcgggagcucgcccugcgccugcagcagacgcagagcuugcauucucuccggagcaucucagca

SEQ ID NO: 360487 - RNA, 64 nt, hsa
ugaggcaggagaauggcgugaauccgggaggcggagcuugcagggagccgagauagugucacug

SEQ ID NO: 360488 - RNA, 64 nt, hsa
gauuugauaagggccacaucccaguguuuaucuuagcuugcaucagggcauguguauguacagu

SEQ ID NO: 360489 - RNA, 64 nt, hsa
ucuccuucucauuguuucuaauuagcuccuuuaaagcuugcaucuuugugaaggcuaacugaag

SEQ ID NO: 360490 - RNA, 64 nt, hsa
agcuccagaaccuauugagcuugcagggaagccaagcuugcaguuccagcaagcaaagauuuuu

SEQ ID NO: 360491 - RNA, 64 nt, hsa
gagcgacaugguaaaugagcuccagaaccuauugagcuugcagggaagccaagcuugcaguucc

SEQ ID NO: 360492 - RNA, 64 nt, hsa
ugaggcaggagaauggugugaaccugggagguggagcuugcagugagcagagcuugcagugaga

SEQ ID NO: 360493 - RNA, 64 nt, hsa
ugugaaccugggagguggagcuugcagugagcagagcuugcagugagacgagcuugugccacug

SEQ ID NO: 360494 - RNA, 64 nt, hsa
aaauagccuggggugucugggcucaggguuggccagcuugcagaggagcaagcuaguagaaaua

SEQ ID NO: 360495 - RNA, 51 nt, hsa
ugcaugucuuccgguccugagagcuugcaucgguuucuucagugccuuaca

SEQ ID NO: 360496 - RNA, 64 nt, hsa
uaagaauauucacaacauugaacccaggaggcggagcuugcagugagccgagauugcgccacug

SEQ ID NO: 360497 - RNA, 64 nt, hsa
aggggauggggccuuuuccagggaagucaccuaaagcuugcauguuuugaaaauuugaauaagg

SEQ ID NO: 360498 - RNA, 64 nt, hsa
aggacuagaucaccuuaguuugauucuauuuuuuagcuugcaaaaagugacuuauauuccaaag

SEQ ID NO: 360499 - RNA, 64 nt, hsa
gcagaaacuauagcugaggacuaaggaauucugcagcuugcagauguuuaagaaaauaauggcc

SEQ ID NO: 360500 - RNA, 64 nt, hsa
acuuuaugucuugcuuuggacaugaauguauuacagcuugcagcuauucuguuaaauguauagu

SEQ ID NO: 360501 - RNA, 64 nt, hsa
gugcauauauaucuuacccuaauugaacaugugaagcuugcaacuuuaugucuugcuuuggaca

SEQ ID NO: 360502 - RNA, 64 nt, hsa
caccacaccucuacggcuggggagaucaggcccagccccauaaaggagaaucuacgcugguccu

SEQ ID NO: 360503 - RNA, 64 nt, hsa
auaggguagcguuuuguuguuguuguuuuuucaugccccauacuacugaauaaacuaguucugu

SEQ ID NO: 360504 - RNA, 64 nt, hsa
uucuuggugcccucuucggcagccaagggugaaggccccauagaggagaggauccaaaggagca

SEQ ID NO: 360505 - RNA, 64 nt, hsa
gaacuugauuuuuauuuguuacagguuuccaauggccccauaggaauaagcaauaauguagacu

SEQ ID NO: 360506 - RNA, 64 nt, hsa
gugacuaugggcgcacugccuaacauuuagcccugccccauauggaacauguuaaaaaaaaaaa

SEQ ID NO: 360507 - RNA, 64 nt, hsa
agacccugagacuccagaaucugcuguugccauagccccauaugugugaauucugcaacuagcc

SEQ ID NO: 360508 - RNA, 64 nt, hsa
uauuuucauauuuauaaaggagucuuaauguucugccccauaagacuuucaaccuugugguugg

SEQ ID NO: 360509 - RNA, 64 nt, hsa
cuuagcugguaaaugaauuugaaucgacauaguagccccauaagcaucagcccuguagagugag

SEQ ID NO: 360510 - RNA, 64 nt, hsa
agugcuucccacuuaccugauuugucugucgguggccccauauggaaacccugcgugucuguug

SEQ ID NO: 360511 - RNA, 64 nt, hsa
cgucacagaagcaaaccgugccuucuggcucugcgccccauauucccagcaucauagacaucca

SEQ ID NO: 360512 - RNA, 64 nt, hsa
acuuguaaaaauuaaaaguuaugguacuauguuagccccauaauuuuuuuuuuccuuuuaaaac

SEQ ID NO: 360513 - RNA, 64 nt, hsa
ucauggcccgaggacaagggcuguaagacagggagccccauaggccaucaucauccuuauccca

SEQ ID NO: 360514 - RNA, 64 nt, hsa
gauguugauuuggaaacaugggcugaaaaugaaggccccauagugcauaggaacaguaaagcca

SEQ ID NO: 360515 - RNA, 64 nt, hsa
uuauagacuguauuuaucuaguggauuccugcaggccccauacugagccuggacugaaaguauc

SEQ ID NO: 360516 - RNA, 64 nt, hsa
uaggacagagcuguccaauagaaauauaaugugagccccauauacaauuuuuacauuucuaaua

SEQ ID NO: 360517 - RNA, 64 nt, hsa
aaguggauuuaaaauauauauauacguaacccaagccccauaaccccuaacuggacaaaugagg

SEQ ID NO: 360518 - RNA, 64 nt, hsa
aacucuauccaaaacauuuuuggagcauuuuaaagccccauacacagaaguauacgaaagcaca

SEQ ID NO: 360519 - RNA, 64 nt, hsa
agcggauggaccagauuccucuggcuaacguauggccccauaggucacugggucauacagagag

SEQ ID NO: 360520 - RNA, 64 nt, hsa
gcagggggcuggaaggcaccaggccucaggaggagccccauagucccgccugcagccuguaacc

SEQ ID NO: 360521 - RNA, 64 nt, hsa
aagagguguccugcugcuguuaccagccaugugggccccauaggggcacugcgccugcugcccu

SEQ ID NO: 360522 - RNA, 64 nt, hsa
aucccugaccauaagccugagccccucccucccagccccauauucacacacaucccagccccug

SEQ ID NO: 360523 - RNA, 64 nt, hsa
gucacugcuguggcgagucuugcuaugucugggugccccauagucacagaacaccuggacaccg

SEQ ID NO: 360524 - RNA, 64 nt, hsa
uccaucgugcccugaggccugacacggcagaucagccccauagugcucaggaggcagcaucugg

SEQ ID NO: 360525 - RNA, 64 nt, hsa
uccauaucugcaauguguaccaaaguuauaucaugccccauaaugcuacugucaaguguuacaa

SEQ ID NO: 360526 - RNA, 64 nt, hsa
auaguugggaaccucauuagaaaugaccucagcugccccauaucuacguuccuuucagcaguug

SEQ ID NO: 360527 - RNA, 64 nt, hsa
aaaaagaauaggcuacaguucucucacaccaagggccccauaguuauaaaugugaaauuauauu

SEQ ID NO: 360528 - RNA, 64 nt, hsa
aaagcauuaagcuuuaaagugcuagaaaucuugugccccauaugugcuucuuucaguauuaucc

SEQ ID NO: 360529 - RNA, 64 nt, hsa
uuuauucaaagcugagucaguggcucuugcgaaugccccauagcagaagucccgggaagguaaa

SEQ ID NO: 360530 - RNA, 64 nt, hsa
aaugcugacgacuaagcaccagccuccacucccugccccauagugaguaucccuccucugugug

SEQ ID NO: 360531 - RNA, 64 nt, hsa
augaugucguggccuccauucucguuucuaugcagccccauaguccaaggacacccaguccaca

SEQ ID NO: 360532 - RNA, 64 nt, hsa
aagaauuggaagccugcuuaaaaaauguaguugagccccauaauuuuacaaaugggcgaacuuu

SEQ ID NO: 360533 - RNA, 64 nt, hsa
gccaaauuuuagauuuaccuuguuagaagagguggccccauauuaacaaauugcauuuguggga

SEQ ID NO: 360534 - RNA, 64 nt, hsa
ggcuggcacuuuacucauugcacuugaguuuauugccccauaacuaaaggaucaggaugauggu

SEQ ID NO: 360535 - RNA, 64 nt, hsa
ucuggauguuucaagccaaggcucggcuauucccgccccauaguaaauuuccuuuucccuggaa

SEQ ID NO: 360536 - RNA, 64 nt, hsa
uggaggcugggccaggaggcagccuccgaaccaugccccauauaacgcuugggugcgugggagg

SEQ ID NO: 360537 - RNA, 64 nt, hsa
acuucucccugccucguuccuuauauucacagaagccccauaguuucacuggguugcgguuauu

SEQ ID NO: 360538 - RNA, 64 nt, hsa
gcugagcaggcggguguccccguccucccucacugccccauaugugucccuccuaaagcugcau

SEQ ID NO: 360539 - RNA, 64 nt, hsa
uguuuguauuuucugcauauucucuggcaaccuugccccauacuuacuuauuuagcauagucga

SEQ ID NO: 360540 - RNA, 64 nt, hsa
uuuuuccuuucuacacauaggguguuccugaaaagccccauagugauugagucuucaaaaccac

SEQ ID NO: 360541 - RNA, 64 nt, hsa
gccagaaaggacagaaucucucccccacucccuugccccauaaccaaacauaagcuagcuaguc

SEQ ID NO: 360542 - RNA, 64 nt, hsa
cugcccggcguaggcccugaggggcgcggccccugccccauacuggccucuuuugggcccucuc

SEQ ID NO: 360543 - RNA, 64 nt, hsa
cuaaacacauuuagcugcuuuuuuaacaaacucagccccauacuugagucccuuguuguuggga

SEQ ID NO: 360544 - RNA, 64 nt, hsa
gccccauggccccucuccacaccucaaaacuccugccccauaacguccuccgcauccacuuucc

SEQ ID NO: 360545 - RNA, 64 nt, hsa
aaaaguuaaaacaaaacauggaugucugggucccgccccauagagaaugacuuaauuggcaugg

SEQ ID NO: 360546 - RNA, 64 nt, hsa
aguggccccucuuugcuggcuggcugccucugcugccccauaccccacacacucaucagccuga

SEQ ID NO: 360547 - RNA, 56 nt, hsa
gccugcaggaccaccuguagggaagggccccauaggcagagccccagggcagacag

SEQ ID NO: 360548 - RNA, 64 nt, hsa
auuuaggccaucacauaugguggggcccaagagagccccauaugcacacugccugccugauacc

SEQ ID NO: 360549 - RNA, 64 nt, hsa
uugcuggagguggaggaagggcguccaugccaaggccccauaccugggccgggggcagcacggc

SEQ ID NO: 360550 - RNA, 64 nt, hsa
aauggcaauuagagaaaggacugacaguggcggugccccauaggaugucauauugaggcccaaa

SEQ ID NO: 360551 - RNA, 64 nt, hsa
ugcugucagacgauuguucuuagaccuccuaaaugccccauauuaaaagaacucauucauagga

SEQ ID NO: 360552 - RNA, 64 nt, hsa
ccuuuccccucaccuuaaaggagacuaccccuuugccccauauugucaaccuaauuuucucucg

SEQ ID NO: 360553 - RNA, 64 nt, hsa
cacgucuguugccgcacacauuccucucagcuccgccccauacccgucacuacagccucaccuc

SEQ ID NO: 360554 - RNA, 64 nt, hsa
cccugagugccucccuugccucacucugauccuggccccauaauguccucaguggaaggugaug

SEQ ID NO: 360555 - RNA, 64 nt, hsa
gaccaaugccgcgguggaaacgggcuuggagcuggccccauaagggcuggcggcuuccuccgac

SEQ ID NO: 360556 - RNA, 64 nt, hsa
acaggcaaucaaggccugagcaaccaaaaggagugccccauauggcuuuucuaccuguaacaug

SEQ ID NO: 360557 - RNA, 64 nt, hsa
cuauguauuuuaacucauuagugcauaaaggcaagccccauauaaugaagucucaggguauaug

SEQ ID NO: 360558 - RNA, 64 nt, hsa
ugauccuagccaggcaccuuaggaguauagggaggccccauauagguccauccuccuaggauga

SEQ ID NO: 360559 - RNA, 64 nt, hsa
caagacaggauacuacagguggccugcugaggcugccccauauuuuagaaaauguaaaaauggu

SEQ ID NO: 360560 - RNA, 64 nt, hsa
ccugaaugugugccuuaaaggcccccuacaaggggccccauacgacagagcuuuuaacuggugc

SEQ ID NO: 360561 - RNA, 64 nt, hsa
aaguugaauuguuuucugccuacaccguucaucagccccauaacccaggaaggaacaggcauug

SEQ ID NO: 360562 - RNA, 64 nt, hsa
cuacacguuagauuugccguaccaaucucugaaugccccauaauuauuauuuccaguguuuggg

SEQ ID NO: 360563 - RNA, 64 nt, hsa
auguaugaaaaugguguacuguauacuuuaacaugccccauacuuuguauuggagaguacaaua

SEQ ID NO: 360564 - RNA, 64 nt, hsa
gauaguguaugcauauguauauguacauagggaagccccauauguauauaguauguuguacacu

SEQ ID NO: 360565 - RNA, 64 nt, hsa
ucuuuaaaucucuuuaaugagugaauccaugcaagccccauaaaacaguuccuagcaugcagaa

SEQ ID NO: 360566 - RNA, 64 nt, hsa
ucgugcauuuaugaugcuaaaacagaucccuucugccccauauuccgucuuggcaaaauagugg

SEQ ID NO: 360567 - RNA, 64 nt, hsa
cacauguaauaaauaaaacaauaugagcauaauugccccauaaagaacucauguccugaauuaa

SEQ ID NO: 360568 - RNA, 64 nt, hsa
guacacgugguguugggacuggaaccauuaugcggccccauaggccucaggagucaucccagaa

SEQ ID NO: 360569 - RNA, 64 nt, hsa
guccugugacuugguaacauucuaaacgguccuugccccauagccauccugauugcugauagug

SEQ ID NO: 360570 - RNA, 64 nt, hsa
aggguccacgcccauguaccugaaacauuuggaagccccauaauuguucuaguuagaaaggguu

SEQ ID NO: 360571 - RNA, 64 nt, hsa
agccgccgccucugcauguaccacagccccccacgccccauagggaggccaagccccggaccau

SEQ ID NO: 360572 - RNA, 64 nt, hsa
uaaauucauauuuagccauaguauaugauagauugccccauaacauaguuuuucaucaagaguu

SEQ ID NO: 360573 - RNA, 64 nt, hsa
agggcaaugagucugguggggggcacguggacaugccccauaggggccccacccagacuuaaca

SEQ ID NO: 360574 - RNA, 64 nt, hsa
cuguuuauucuguuucacccuacuccuccagugagccccauauuuugggaaauuaucugccuua

SEQ ID NO: 360575 - RNA, 64 nt, hsa
augagguauauuuuauucugggcaccacacauuugccccauagauaacaauacacgugaugaug

SEQ ID NO: 360576 - RNA, 64 nt, hsa
ugcagaggaugagaggaagguguuaguuccaucagccccauaaaauuaugaaccuuuuugcaac

SEQ ID NO: 360577 - RNA, 64 nt, hsa
gccucugagccuccccugugccuugggcccugaagccccauauguaguauagagcaaagguggc

SEQ ID NO: 360578 - RNA, 62 nt, hsa
ccuuuuccucaccccaguagauccaaccuccagccccauauagggugaaccucuugauaagc

SEQ ID NO: 360579 - RNA, 64 nt, hsa
caaagauccccuucagcccccugccagagucacugccccauaaucaccaugucagaagggaccc

SEQ ID NO: 360580 - RNA, 64 nt, hsa
uaauccauucuugacauucaguuaguccagaucugccccauaauuugcuuuaguaaagucacuu

SEQ ID NO: 360581 - RNA, 64 nt, hsa
cccagcauccuaggcucagcuuaccgggugauaggccccauaagacacacacaugagcagggug

SEQ ID NO: 360582 - RNA, 64 nt, hsa
ugguauuggcauuugaggucggaaacccucuacugccccauaagccaggaaaagugaaaagaga

SEQ ID NO: 360583 - RNA, 64 nt, hsa
gccuggacuuggggagaaugacuuucccuuuuuugccccauaagggcuagcauaagcugaggua

SEQ ID NO: 360584 - RNA, 64 nt, hsa
gccaaaaagaacacccaucguauaaggaaauccagccccauagaaaacaaucugcccaccgacc

SEQ ID NO: 360585 - RNA, 64 nt, hsa
gguccagcccugaugauuggccccaccuccugcugccccauaacccucucuucauuucggcuuu

SEQ ID NO: 360586 - RNA, 64 nt, hsa
ucacuggaugcagaaguacccauucaucacaccugccccauagcccccacucugcuguacugau

SEQ ID NO: 360587 - RNA, 64 nt, hsa
gagcaaaauugugaucuuuccuaggaguuugaaugccccauauuuguguccucgccagcucuuu

SEQ ID NO: 360588 - RNA, 64 nt, hsa
uagguggcaccugccaauagcuuugucaaucacagccccauaggaacgucuggaauugcuuggg

SEQ ID NO: 360589 - RNA, 64 nt, hsa
uaugugagaguugugaaauuuuagugucucacuggccccauaaauuccacgcuucaggaaguug

SEQ ID NO: 360590 - RNA, 64 nt, hsa
aagggguggggaugcaggaccccacucugcgggagccccauagccaccucucuugcccaaggug

SEQ ID NO: 360591 - RNA, 64 nt, hsa
ugaucuuugcccucugggucuugacccauuaagagccccauagaacucuugauuuuuccugucc

SEQ ID NO: 360592 - RNA, 64 nt, hsa
cagucaucccccguggugucugcacaucacuccagccccauaaagagugucauguuagcugagu

SEQ ID NO: 360593 - RNA, 64 nt, hsa
ggguuggaggucuggacagggagcccagucccgggccccauaguggugcgggcacuggaccccc

SEQ ID NO: 360594 - RNA, 64 nt, hsa
gccagaagcguugcugaguguguucccuguaacugccccauagugggcagcccuggaggaacaa

SEQ ID NO: 360595 - RNA, 64 nt, hsa
ccacaaauuuugugaguuuaguacucuacagauugccccauaagagcaguagcuuuugaaacuc

SEQ ID NO: 360596 - RNA, 64 nt, hsa
gaugaugcucagcuguggggcgggccucuaagaugccccauacuuugggggucucagaaaugga

SEQ ID NO: 360597 - RNA, 64 nt, hsa
caugugccaaaucccuggcaggcagauggcuccugccccauauucuugccgugucuuggaaaag

SEQ ID NO: 360598 - RNA, 64 nt, hsa
uccuggcccugccccuaggucugggugggcaguggccccauagccucuggaacugugcguucug

SEQ ID NO: 360599 - RNA, 64 nt, hsa
acagcaugaauugggucccuuauucccagggggugccccauauuccccaauacuguaaagcaga

SEQ ID NO: 360600 - RNA, 64 nt, hsa
uucucucucuccuugccccccucccgcccuccccgccccauaccuuuucuuccccuggauuuuc

SEQ ID NO: 360601 - RNA, 64 nt, hsa
uugucauucuuagcccccuacuguggcccccauagccccauaacccagagagggagcuggacuu

SEQ ID NO: 360602 - RNA, 64 nt, hsa
uagcucauaagacccucauuccagagagggugcugccccauacccggaaggaggaacgcugcac

SEQ ID NO: 360603 - RNA, 64 nt, hsa
ugagcaagggcaggggucccugagcuguucuucugccccauacugaaggaacugaggccugggu

SEQ ID NO: 360604 - RNA, 64 nt, hsa
uuaauguuuuuaaggaugguugugaaucccccuggccccauaauaaauuguaauuuuauacugc

SEQ ID NO: 360605 - RNA, 64 nt, hsa
gacuuccaagaguuacuguccacccggugguguggccccauagcgaagucuaaaugccuguaga

SEQ ID NO: 360606 - RNA, 64 nt, hsa
aaauucuccuugaagaccuucucccuuuuauguggccccauauuuuauguugcuuuaucuuuga

SEQ ID NO: 360607 - RNA, 64 nt, hsa
gagagcuuucacacagugagaaauagagcaggcugccccauaaauggguaacauauuccuaauc

SEQ ID NO: 360608 - RNA, 64 nt, hsa
agaaacuuccaaggaugacccaaccuuugccuuugccccauauauuggggaaaacccauacacc

SEQ ID NO: 360609 - RNA, 64 nt, hsa
cacuccuauaccacccuuguaacccaguagacuugccccauaugccccaacucauagcaccuaa

SEQ ID NO: 360610 - RNA, 64 nt, hsa
aauauucaaauuauagaacauguuuuuucccuuugccccauaaucaguauuugccaaauuacau

SEQ ID NO: 360611 - RNA, 64 nt, hsa
gcuccccgcccacccucugccuggucgcgcucuucagucccacgaggagcugacacguccucuc

SEQ ID NO: 360612 - RNA, 64 nt, hsa
cugcuuucgaagacucugcugccauccguucucccagucccaaggguccacgauguacaaaguc

SEQ ID NO: 360613 - RNA, 64 nt, hsa
aagaaauggauuguuggugcuuuggaauauguuacagucccacauuugauauuucuuauauacu

SEQ ID NO: 360614 - RNA, 64 nt, hsa
uucaugaauuugugaugucuuugcuguuuacaugcagucccaagaaauggauuguuggugcuuu

SEQ ID NO: 360615 - RNA, 64 nt, hsa
uuggggcuggcgggcggcggcuuaccagcugggucagucccaucucgccccucugugccuaugc

SEQ ID NO: 360616 - RNA, 64 nt, hsa
cccugaacgccuccgcaggcagauucauggagaccagucccaguagcaaccgccccuuccccaa

SEQ ID NO: 360617 - RNA, 64 nt, hsa
cuccugugagcaccgagaagaacugggcgacucccagucccaccugugcugugacagucccacg

SEQ ID NO: 360618 - RNA, 64 nt, hsa
aacugggcgacucccagucccaccugugcugugacagucccacguggcuaugacagacuguuua

SEQ ID NO: 360619 - RNA, 64 nt, hsa
aggcagggcccaguccaggggccccaggccuccccagucccagugugcgagccccacuuggaca

SEQ ID NO: 360620 - RNA, 64 nt, hsa
ugaggacaugccucccaccaaauguccccugcuccagucccacuccugucaccccacgcucugc

SEQ ID NO: 360621 - RNA, 64 nt, hsa
ucccucucucucccaggucccagccccuuuuccccagucccagacaauuccauucaaucuuugg

SEQ ID NO: 360622 - RNA, 64 nt, hsa
ccaggaaagguuuuccuuauuuugugugcuuucccagucccauuccucagcuucuucacaggca

SEQ ID NO: 360623 - RNA, 64 nt, hsa
gccccagccgcuuggcgaugccagccaagcucugcagucccagcggugggaccuagggaggcau

SEQ ID NO: 360624 - RNA, 64 nt, hsa
ugaggcgagaagggcugcuucccugaagcucccacagucccaucugcuucaggcccccgccuug

SEQ ID NO: 360625 - RNA, 64 nt, hsa
ggacccuguccugcagucccacacugugcagacccagucccacacuguggccaggccuuacauc

SEQ ID NO: 360626 - RNA, 64 nt, hsa
cuccuggcagggccaccugcaggacccuguccugcagucccacacugugcagacccagucccac

SEQ ID NO: 360627 - RNA, 64 nt, hsa
cacccacucaugcuguuccugaggccgcccucuccagucccaggagccgugucuagaguuccug

SEQ ID NO: 360628 - RNA, 64 nt, hsa
gcaccgugguggaggaagucacccagcuguuucucagucccagaggccgguggcugguuuugaa

SEQ ID NO: 360629 - RNA, 64 nt, hsa
ugacuucguaccugcucaggagcccccacugucccagucccacucaggcccaucucuggcuggc

SEQ ID NO: 360630 - RNA, 64 nt, hsa
uucacggaagccaggaaucaaacugccuggguuccagucccagcucugccaguuaugcccagcu

SEQ ID NO: 360631 - RNA, 64 nt, hsa
augccauugagacuaguaacgggcguucugggcacagucccacugugcacagguuugagaggac

SEQ ID NO: 360632 - RNA, 64 nt, hsa
uaggugguccccaacagugccuagggguacaguacagucccauuacacuagagcagggcucuau

SEQ ID NO: 360633 - RNA, 64 nt, hsa
gagcacugcccuaggagcccggaccccacgagcucagucccagcucugccucugacucgcugug

SEQ ID NO: 360634 - RNA, 64 nt, hsa
uuggccauggcuuuccugcaagaccacugacgagcagucccauggugauaaagggcagcccggc

SEQ ID NO: 360635 - RNA, 64 nt, hsa
agggguggagggcagucccucagaaucccagaggcagucccagccucagaacccaggauaggaa

SEQ ID NO: 360636 - RNA, 64 nt, hsa
cuccaaccuccggggcgaccuucucuuccagccacagucccaugagggccccuagccagggaca

SEQ ID NO: 360637 - RNA, 64 nt, hsa
ccccacccuccugcccugugcccagguguugggacagucccacccucccugcuauuuauauccc

SEQ ID NO: 360638 - RNA, 64 nt, hsa
uucugccuccucugaggaaucuggcccugucugacagucccagaccccccguucucuccucuuu

SEQ ID NO: 360639 - RNA, 64 nt, hsa; identical to SEQ ID NO: 55647

SEQ ID NO: 360640 - RNA, 64 nt, hsa; identical to SEQ ID NO: 55648

SEQ ID NO: 360641 - RNA, 64 nt, hsa; identical to SEQ ID NO: 55649

SEQ ID NO: 360642 - RNA, 64 nt, hsa; identical to SEQ ID NO: 55650

SEQ ID NO: 360643 - RNA, 64 nt, hsa; identical to SEQ ID NO: 55651

SEQ ID NO: 360644 - RNA, 64 nt, hsa; identical to SEQ ID NO: 55652

SEQ ID NO: 360645 - RNA, 64 nt, hsa; identical to SEQ ID NO: 55653

SEQ ID NO: 360646 - RNA, 64 nt, hsa; identical to SEQ ID NO: 55654

SEQ ID NO: 360647 - RNA, 64 nt, hsa; identical to SEQ ID NO: 55655

SEQ ID NO: 360648 - RNA, 64 nt, hsa; identical to SEQ ID NO: 55656

SEQ ID NO: 360649 - RNA, 64 nt, hsa; identical to SEQ ID NO: 55657

SEQ ID NO: 360650 - RNA, 64 nt, hsa; identical to SEQ ID NO: 55658

SEQ ID NO: 360651 - RNA, 64 nt, hsa; identical to SEQ ID NO: 55659

SEQ ID NO: 360652 - RNA, 64 nt, hsa; identical to SEQ ID NO: 55660

SEQ ID NO: 360653 - RNA, 64 nt, hsa; identical to SEQ ID NO: 55661

SEQ ID NO: 360654 - RNA, 64 nt, hsa; identical to SEQ ID NO: 55662

SEQ ID NO: 360655 - RNA, 64 nt, hsa; identical to SEQ ID NO: 55663

SEQ ID NO: 360656 - RNA, 64 nt, hsa; identical to SEQ ID NO: 55664

SEQ ID NO: 360657 - RNA, 64 nt, hsa; identical to SEQ ID NO: 55665

SEQ ID NO: 360658 - RNA, 64 nt, hsa; identical to SEQ ID NO: 55666

SEQ ID NO: 360659 - RNA, 64 nt, hsa
auuaaguaccauuagcuacagugaucuuagcuuccuugcuuacaauuguucagugggucaucua

SEQ ID NO: 360660 - RNA, 64 nt, hsa
guauguuacugacccauauggauuuuaguaacaucuugcuuagucauguuguuauaaaacauuc

SEQ ID NO: 360661 - RNA, 64 nt, hsa
gaauauuuauacuauaaaaugcaguaacauucuacuugcuuauuacauuuaaauccuuguguaa

SEQ ID NO: 360662 - RNA, 64 nt, hsa
gacccaucccuguggcaucgucagcagaauacugcuugcuuacaaucuuuauuaugcauucuua

SEQ ID NO: 360663 - RNA, 64 nt, hsa
cgaccuuugcagauacccauaaccuauguugagccuugcuuaccagcaaagaauauuuuuaaug

SEQ ID NO: 360664 - RNA, 64 nt, hsa
agucugcaaaagaagcacaauucuauugcuuugucuugcuuauagucauuaaaucauuacuuuu

SEQ ID NO: 360665 - RNA, 64 nt, hsa
cgaaagauggcaaguguacaaccaaaccaauccacuugcuuacagaaagaauguuuaguguagu

SEQ ID NO: 360666 - RNA, 64 nt, hsa
aagagauaaagauacccucucauggaauaaacaccuugcuuagaauucauauaacaaagaagua

SEQ ID NO: 360667 - RNA, 64 nt, hsa
agugucucucucucuuagcgacacacuccuuggucuugcuuaccaacuggaggacacuagguag

SEQ ID NO: 360668 - RNA, 64 nt, hsa
aggaagcgcugucugugcggcugagucugggccacuugcuuaauugcauuucuggcagggaagg

SEQ ID NO: 360669 - RNA, 64 nt, hsa
cauucuccuggcugcugggagagcccaugggaaccuugcuuagcgcccaagguagaugagagac

SEQ ID NO: 360670 - RNA, 64 nt, hsa
cuuccucacaccacgaaucugaacaugccucucucuugcuuacaaaugucuaagguccccacug

SEQ ID NO: 360671 - RNA, 64 nt, hsa
uaagguccccacugccugcuggagagaaaacacacuugcuuagcccacaauucuccauuucacu

SEQ ID NO: 360672 - RNA, 64 nt, hsa
uaggauugcagcaacacgcucggcugcccaaacccaaggcgaagaccuugccagaguucaucaa

SEQ ID NO: 360673 - RNA, 64 nt, hsa
cggccccaccccugcucgccccuaucgcuccagccaaggcgaagaagcacgaacgaaugucgag

SEQ ID NO: 360674 - RNA, 64 nt, hsa
cauucuuguuagcuuugcuuuucuccccauaucccaaggcgaagcgcugagauucuuccaucua

SEQ ID NO: 360675 - RNA, 64 nt, hsa
uccauuuggggaugaagucuacuuugacagcuagcaaggcgacaugcaacuguuguugaaugau

SEQ ID NO: 360676 - RNA, 64 nt, hsa
gaccugcuucacaaguuacaguucguccugacuacaaggcgaguggauaauuccaacacaagac

SEQ ID NO: 360677 - RNA, 64 nt, hsa
cacuuuacaaacaaauaaacauuguuuguacucacaaggcgauaauagcuugauuuauuugguu

SEQ ID NO: 360678 - RNA, 64 nt, hsa
cagccaagagagauuagagagagaaaauguagaucaaggcgagcugccuacaaauuacucuguc

SEQ ID NO: 360679 - RNA, 64 nt, hsa
auacuguguaccucauggaugcuuuggcaaugcccaaggcgauauaagcaaaaucagaaguaua

SEQ ID NO: 360680 - RNA, 64 nt, hsa
cuguccagugugcaagcaaaaaguuguuccuucucaaggcgauucagacucugacacagacagu

SEQ ID NO: 360681 - RNA, 64 nt, hsa
gugcugguccuguugaucccagucucugccagaccaaggcgaguuuccccacuaauaaagugcc

SEQ ID NO: 360682 - RNA, 64 nt, hsa
ccagggggagggggucaggugucgaaccagcaggcaaggcgaggugcccgcucagcucagcaag

SEQ ID NO: 360683 - RNA, 64 nt, hsa
ggcucacaccuguaaucccagcacuuugggaggccaaggcgagcggaucaugaggucagaagau

SEQ ID NO: 360684 - RNA, 64 nt, hsa
ucuuggcauuuucggaggaaacuuguaggacacccaaggcgacuaagagacagccuccuuggca

SEQ ID NO: 360685 - RNA, 64 nt, hsa
uugccccucagggucacaggggugggggcucucacaaggcgacuugaagaggacgcaggcuucc

SEQ ID NO: 360686 - RNA, 64 nt, hsa
augagggcagcuaaacccauagaaggaguuggaccaaggcgaauuacgaguccuggucccagca

SEQ ID NO: 360687 - RNA, 64 nt, hsa
gagaggcccgugccaugagaccgccuggggugagcaaggcgaccugggcugcugcccgaagguu

SEQ ID NO: 360688 - RNA, 64 nt, hsa
ucccgcucccacccccaccuuguugacagggagccaaggcgaggcggcugucugcgaccacagc

SEQ ID NO: 360689 - RNA, 64 nt, hsa
ggccccucgccccugccuggcacugcucaccgcccaaggcgacgccggcuggaccaggcacugc

SEQ ID NO: 360690 - RNA, 64 nt, hsa
cagggucaggcccugccagaggcuggagggugcccaaggcgaggccggugaggcccagcucuac

SEQ ID NO: 360691 - RNA, 64 nt, hsa
cagacaguguggaacagagugagccugagcugcccaaggcgaugcccuuugugcuguaugacug

SEQ ID NO: 360692 - RNA, 64 nt, hsa
ggucuucuggggaccccagaggugucugugcugacaaggcgacuucagauuccauacugagauc

SEQ ID NO: 360693 - RNA, 64 nt, hsa
acaggccuggcaggggcccacuggugcccagcaccaaggcgagcuccgggcucagaccaacucc

SEQ ID NO: 360694 - RNA, 64 nt, hsa
cugcaaaccacuggcucguuuccgugcccaaauccaaggcgaaguuuucuagaggguucuuggg

SEQ ID NO: 360695 - RNA, 64 nt, hsa
ccugaggucgggaguuggagacccgccuggcuaacaaggcgaaauccugucuguacuaaaaaua

SEQ ID NO: 360696 - RNA, 64 nt, hsa
uggcuggccuuccacuuggcuacacagggauguacaaggcgaucccaucuugauaagaccacca

SEQ ID NO: 360697 - RNA, 64 nt, hsa
cuugaggucaggaguucaagaccagccuggccaacaaggcgaaacccugucucuacuaaaaaua

SEQ ID NO: 360698 - RNA, 64 nt, hsa
auuccccuucccaaccccgaggggcuugcagggacaaggcgaccgacugcgcugagcugcuuau

SEQ ID NO: 360699 - RNA, 64 nt, hsa
uaaaauccauaacugauuuccaagcugguguguucaaggcgaggacgguguguggguggccccu

SEQ ID NO: 360700 - RNA, 64 nt, hsa
cacaaggagaccuggacacaacagacacacaucacaaggcgaacacaaauggacacacauaccu

SEQ ID NO: 360701 - RNA, 64 nt, hsa
aggcugaguggacagucaggagagaggcgagaggcaaggcgaagccugugucccuguuucaguu

SEQ ID NO: 360702 - RNA, 64 nt, hsa
gcugccagaacuugacuagcauuucugaauaucccaaggcgaggucauguaacuuccuugggaa

SEQ ID NO: 360703 - RNA, 64 nt, hsa
auccuuguuuucuagcuuuggaucauuuuuguaccaaggcgagcaagccuuuuugaaaaauaac

SEQ ID NO: 360704 - RNA, 64 nt, hsa
uugggaagugaccauuuggaugucugggcccugccaaggcgacagggagggucagagggaggcc

SEQ ID NO: 360705 - RNA, 64 nt, hsa
gaccucaacagacugccccgggcucugggugggccaaggcgaaggcuucccaucaccacaggaa

SEQ ID NO: 360706 - RNA, 64 nt, hsa
ccgagaucgugccacuguacuccagccugggcaacaaggcgagacuccaucucaauaauaauaa

SEQ ID NO: 360707 - RNA, 64 nt, hsa
uccgggaccccagcccucaggauuccugaugcuccaaggcgacugaugggcgcuggaugaagug

SEQ ID NO: 360708 - RNA, 64 nt, hsa
cgaggauugcacccgcccguccuaagccuccccacaaggcgaggggaguuaccccuaaaacaaa

SEQ ID NO: 360709 - RNA, 64 nt, hsa
gaggacgggagcugccuagcuacaguuuucuugccaaggcgagguguuuugugaaucugugcug

SEQ ID NO: 360710 - RNA, 64 nt, hsa
uucaacuuacucucuugaguucuuacauacacuucaaggcgagcagaucaaagaaaaauccccc

SEQ ID NO: 360711 - RNA, 64 nt, hsa
cuucagcucaggaguucgagaucauucuggccaacaaggcgaaacccugucucuaccaaaaaua

SEQ ID NO: 360712 - RNA, 64 nt, hsa
aaccuuuucuccuguguaucuuugaaguggcagacaaggcgaagcaucagacugguauuaaugu

SEQ ID NO: 360713 - RNA, 64 nt, hsa
cauccagggcugccaggagauucagagcucaaaacaaggcgagcuugaguucugcacuccagau

SEQ ID NO: 360714 - RNA, 64 nt, hsa
ucugggcauuaaauuauacaaacugaaaauguguuacaagaaaaauaugagaguuuuaacuaga

SEQ ID NO: 360715 - RNA, 64 nt, hsa
caaauuuuuaaaauugaaauuaggaauuugaauuuacaagaaugccuuggauauuucuguguug

SEQ ID NO: 360716 - RNA, 64 nt, hsa
cuagcagugcaucagccaguaaaacaaacacauuuacaagaaaaauguuuuaaagaugccaggg

SEQ ID NO: 360717 - RNA, 64 nt, hsa
aauucauaaugaauauauuugccuauauucucccuacaagaauauuuuugcuccagaaagacau

SEQ ID NO: 360718 - RNA, 64 nt, hsa
auccacaggguagauuucuuucuagauguggaaguacaagaaaaucuuuuuuaguuauuuguuu

SEQ ID NO: 360719 - RNA, 64 nt, hsa
cuaagguaccaauagcucuuucauagacuugugcuacaagaagguuaaaagaccaguuuuauuu

SEQ ID NO: 360720 - RNA, 64 nt, hsa
ugccgugaggacaguugaauuuggggcauuuuucuacaagaagcagucagccuucucuccccca

SEQ ID NO: 360721 - RNA, 64 nt, hsa
cuugaaccaggcuagaacagcugucugccaaagauacaagaauaugcaaagucccucuuacccc

SEQ ID NO: 360722 - RNA, 64 nt, hsa
agagacaugcuuguguuuuggaauuucacacccuuacaagaauaccacauuuugaaacccagaa

SEQ ID NO: 360723 - RNA, 64 nt, hsa
uccaucuuuucaaagauacaacaaaagcagaaguuacaagaauauugcggagagguuggaaagc

SEQ ID NO: 360724 - RNA, 64 nt, hsa
ugguuaagacugcugaggccaagugcuauuuuguuacaagaaaggaagaacuuggcuauuuucu

SEQ ID NO: 360725 - RNA, 64 nt, hsa
aaucaaguaugaaaaucugcacaaaugcaauguuuacaagaacugguugauucugggaggcauc

SEQ ID NO: 360726 - RNA, 64 nt, hsa; identical to SEQ ID NO: 193740

SEQ ID NO: 360727 - RNA, 64 nt, hsa; identical to SEQ ID NO: 193741

SEQ ID NO: 360728 - RNA, 64 nt, hsa; identical to SEQ ID NO: 193742

SEQ ID NO: 360729 - RNA, 64 nt, hsa; identical to SEQ ID NO: 193743

SEQ ID NO: 360730 - RNA, 64 nt, hsa; identical to SEQ ID NO: 193744

SEQ ID NO: 360731 - RNA, 64 nt, hsa; identical to SEQ ID NO: 193745

SEQ ID NO: 360732 - RNA, 64 nt, hsa; identical to SEQ ID NO: 180822

SEQ ID NO: 360733 - RNA, 64 nt, hsa; identical to SEQ ID NO: 180823

SEQ ID NO: 360734 - RNA, 64 nt, hsa; identical to SEQ ID NO: 180824

SEQ ID NO: 360735 - RNA, 64 nt, hsa; identical to SEQ ID NO: 180825

SEQ ID NO: 360736 - RNA, 64 nt, hsa; identical to SEQ ID NO: 180826

SEQ ID NO: 360737 - RNA, 64 nt, hsa; identical to SEQ ID NO: 180827

SEQ ID NO: 360738 - RNA, 64 nt, hsa; identical to SEQ ID NO: 180828

SEQ ID NO: 360739 - RNA, 60 nt, hsa; identical to SEQ ID NO: 180829

SEQ ID NO: 360740 - RNA, 64 nt, hsa; identical to SEQ ID NO: 180830

SEQ ID NO: 360741 - RNA, 64 nt, hsa; identical to SEQ ID NO: 180831

SEQ ID NO: 360742 - RNA, 64 nt, hsa; identical to SEQ ID NO: 180832

SEQ ID NO: 360743 - RNA, 64 nt, hsa; identical to SEQ ID NO: 180833

SEQ ID NO: 360744 - RNA, 64 nt, hsa; identical to SEQ ID NO: 180834

SEQ ID NO: 360745 - RNA, 64 nt, hsa; identical to SEQ ID NO: 180835

SEQ ID NO: 360746 - RNA, 64 nt, hsa; identical to SEQ ID NO: 180836

SEQ ID NO: 360747 - RNA, 64 nt, hsa
cacccccugcccugcacgucaugggagggggcuugaagccaaagaaaaauaacccuuugguuuu

SEQ ID NO: 360748 - RNA, 64 nt, hsa
acaucugccuuaaaaccaaagagggcuuccucuagaagccaagggaaaggggugcuuuuauaga

SEQ ID NO: 360749 - RNA, 64 nt, hsa
acccugggugggcucugugcagucacuggagguugaagccaaguggggugcugggaggagggag

SEQ ID NO: 360750 - RNA, 64 nt, hsa
auauguguguuuuucaguauucaaauaagaucaggaagccaauuuucuauguaugaauaugcuu

SEQ ID NO: 360751 - RNA, 64 nt, hsa
ggccuguuuuugucgguaaggcauacagccuucagaagccaacauuuuuaaucaaaaacuuaua

SEQ ID NO: 360752 - RNA, 64 nt, hsa
guugcugucagagaugggcucauaucugcuuggggaagccaauggggcacaauccuucccaauu

SEQ ID NO: 360753 - RNA, 64 nt, hsa
accccagaggaaccagugggauugaaaaccagcagaagccaagacaggaugcacagcugaauug

SEQ ID NO: 360754 - RNA, 64 nt, hsa
aaagcuagcuguagguaaugugagcaaagauguggaagccaaaauugucacaauuccucaaucu

SEQ ID NO: 360755 - RNA, 64 nt, hsa
guuucugacaagaauuaggguaagaacaguaauugaagccaauuauuuauuacaaauguauuuu

SEQ ID NO: 360756 - RNA, 64 nt, hsa
gcugcuucccuuguaaauaguuguucucugguaagaagccaaauauuuaagcucacuucuuccc

SEQ ID NO: 360757 - RNA, 64 nt, hsa
uaacggugccuuuucuuaggguccaggcaggaaugaagccaauaauuuauugcuuuccauucug

SEQ ID NO: 360758 - RNA, 64 nt, hsa
cauucagaaacugcaggagacaagaugaauuugagaagccaaauggaauuuuuaauggaaacca

SEQ ID NO: 360759 - RNA, 64 nt, hsa
gacugugcuuguccauuauuuuacacaugcccuagaagccaaaacugaaagccacuggauccug

SEQ ID NO: 360760 - RNA, 64 nt, hsa
guccuuugcuacccagggcugcccccaggcccaugaagccaauaggagagcguguggcacuggc

SEQ ID NO: 360761 - RNA, 64 nt, hsa
uacucaauauuuaauauucuacucgagcuuuauggaagccaaaucaugugcaugugugugugug

SEQ ID NO: 360762 - RNA, 64 nt, hsa
uuugccuuuugcacacgcaccuggaaaagacacagaagccaaccugagaaccccuggugcuauu

SEQ ID NO: 360763 - RNA, 64 nt, hsa
gauguuucggacugaccuaaaaacuaauugucgagaagccaagggugaggaggcaggaagcacc

SEQ ID NO: 360764 - RNA, 64 nt, hsa
guucacguuucauguaauccucaagaaauaaaaggaagccaaagaguguauuuuuuuaaaaguu

SEQ ID NO: 360765 - RNA, 64 nt, hsa
ccgguggggcugguucuguaauugugugugaugugaagccaauucagacaggcaaauaaaagug

SEQ ID NO: 360766 - RNA, 64 nt, hsa
augccucuagccccuuacugugauuuguugguugcacuuucauuugcuuuaguucuagaaucac

SEQ ID NO: 360767 - RNA, 64 nt, hsa
uuagucucauuuaagagauggcauuuggaauuuacacuuucauaugauugugcagaaaacuugc

SEQ ID NO: 360768 - RNA, 64 nt, hsa
gcucaguuaaggaaugagaagauagaggguccuccacuuucagcucaugcuuuuuuauguagga

SEQ ID NO: 360769 - RNA, 64 nt, hsa
ccucccccccccccccgcaccauugguuguguaucacuuucacuuuacacuugcauguucuacu

SEQ ID NO: 360770 - RNA, 64 nt, hsa
ucaaccucuauacuacacauauuacaagauauagcacuuucaaaaugaaucuaaaccuuuacag

SEQ ID NO: 360771 - RNA, 64 nt, hsa
uuuuaagugacuagaaauauauacaguaaaaucccacuuucaugcaucucugggaaaugauagg

SEQ ID NO: 360772 - RNA, 64 nt, hsa
uagaaacccuccagaaauuuccacugcuguucuucacuuucaucuugucugcuaucaaaccacu

SEQ ID NO: 360773 - RNA, 64 nt, hsa
gugcaugggaucguugauguuuaucagaacuguucacuuucagaaaugauuuuuuaaagcauuu

SEQ ID NO: 360774 - RNA, 64 nt, hsa
gcugaguuuaaaaguugaccuguguuuguaauuucacuuucaucuugcuuaauaaauaucugcu

SEQ ID NO: 360775 - RNA, 64 nt, hsa
cuuuaaaaaaauacauaaaaauuucaucuuaaagcacuuucauuuuauaccaacgugaaaagug

SEQ ID NO: 360776 - RNA, 64 nt, hsa
gccuguggcugcacaggcucucuaaccgaaaccucacuuucagagagauguggguccuuugucu

SEQ ID NO: 360777 - RNA, 64 nt, hsa
uguuuauacuucuugauugguuucuugccauuuucacuuucagugauggugggugugcaguaga

SEQ ID NO: 360778 - RNA, 64 nt, hsa
aaaacaagagauauacauugugauauauuagggacacuuucacaguccuguccucuggaucaca

SEQ ID NO: 360779 - RNA, 64 nt, hsa
aagccaugcuggugggccauuaaugguuggaaaacacuuucauccggggcuuugccagagcgug

SEQ ID NO: 360780 - RNA, 64 nt, hsa
cuccucuuccucuccuuuaccccacuuucacugccacuuucaucagguuugugucucaucuccc

SEQ ID NO: 360781 - RNA, 64 nt, hsa
ucuguccaccuccuccucuuccucuccuuuaccccacuuucacugccacuuucaucagguuugu

SEQ ID NO: 360782 - RNA, 64 nt, hsa
gucacacgacggaauggauacugggcccggggaccacuuucauacucacguccucauccuugga

SEQ ID NO: 360783 - RNA, 64 nt, hsa
ggaaaagaagaaacaacaaaggcaggagaacagccacuuucagacuugaaaaugacaaaacccu

SEQ ID NO: 360784 - RNA, 64 nt, hsa
gacaccuagucuagagucaccaaggucacagugccacuuucacgggauagcaggcucuugggac

SEQ ID NO: 360785 - RNA, 64 nt, hsa
cuuuuacuuugugguucucuaaaaaccauguacacacuuucacucuauuguaaccacacagggc

SEQ ID NO: 360786 - RNA, 64 nt, hsa; identical to SEQ ID NO: 79249

SEQ ID NO: 360787 - RNA, 64 nt, hsa; identical to SEQ ID NO: 79250

SEQ ID NO: 360788 - RNA, 64 nt, hsa; identical to SEQ ID NO: 79251

SEQ ID NO: 360789 - RNA, 64 nt, hsa; identical to SEQ ID NO: 79252

SEQ ID NO: 360790 - RNA, 64 nt, hsa; identical to SEQ ID NO: 79253

SEQ ID NO: 360791 - RNA, 64 nt, hsa; identical to SEQ ID NO: 79254

SEQ ID NO: 360792 - RNA, 64 nt, hsa; identical to SEQ ID NO: 79255

SEQ ID NO: 360793 - RNA, 64 nt, hsa; identical to SEQ ID NO: 79256

SEQ ID NO: 360794 - RNA, 64 nt, hsa; identical to SEQ ID NO: 79257

SEQ ID NO: 360795 - RNA, 64 nt, hsa; identical to SEQ ID NO: 79258

SEQ ID NO: 360796 - RNA, 64 nt, hsa; identical to SEQ ID NO: 79259

SEQ ID NO: 360797 - RNA, 64 nt, hsa; identical to SEQ ID NO: 79260

SEQ ID NO: 360798 - RNA, 64 nt, hsa; identical to SEQ ID NO: 79261

SEQ ID NO: 360799 - RNA, 64 nt, hsa; identical to SEQ ID NO: 79262

SEQ ID NO: 360800 - RNA, 64 nt, hsa; identical to SEQ ID NO: 79263

SEQ ID NO: 360801 - RNA, 64 nt, hsa; identical to SEQ ID NO: 79264

SEQ ID NO: 360802 - RNA, 64 nt, hsa; identical to SEQ ID NO: 79265

SEQ ID NO: 360803 - RNA, 64 nt, hsa; identical to SEQ ID NO: 79266

SEQ ID NO: 360804 - RNA, 64 nt, hsa; identical to SEQ ID NO: 79267

SEQ ID NO: 360805 - RNA, 64 nt, hsa; identical to SEQ ID NO: 79268

SEQ ID NO: 360806 - RNA, 64 nt, hsa; identical to SEQ ID NO: 79269

SEQ ID NO: 360807 - RNA, 64 nt, hsa; identical to SEQ ID NO: 79270

SEQ ID NO: 360808 - RNA, 64 nt, hsa; identical to SEQ ID NO: 79271

SEQ ID NO: 360809 - RNA, 64 nt, hsa; identical to SEQ ID NO: 79272

SEQ ID NO: 360810 - RNA, 64 nt, hsa; identical to SEQ ID NO: 79273

SEQ ID NO: 360811 - RNA, 64 nt, hsa; identical to SEQ ID NO: 79274

SEQ ID NO: 360812 - RNA, 64 nt, hsa; identical to SEQ ID NO: 79275

SEQ ID NO: 360813 - RNA, 64 nt, hsa; identical to SEQ ID NO: 79276

SEQ ID NO: 360814 - RNA, 64 nt, hsa; identical to SEQ ID NO: 79277

SEQ ID NO: 360815 - RNA, 64 nt, hsa; identical to SEQ ID NO: 79278

SEQ ID NO: 360816 - RNA, 64 nt, hsa; identical to SEQ ID NO: 79279

SEQ ID NO: 360817 - RNA, 64 nt, hsa; identical to SEQ ID NO: 79280

SEQ ID NO: 360818 - RNA, 64 nt, hsa; identical to SEQ ID NO: 79281

SEQ ID NO: 360819 - RNA, 64 nt, hsa; identical to SEQ ID NO: 79282

SEQ ID NO: 360820 - RNA, 64 nt, hsa; identical to SEQ ID NO: 79283

SEQ ID NO: 360821 - RNA, 64 nt, hsa; identical to SEQ ID NO: 79284

SEQ ID NO: 360822 - RNA, 64 nt, hsa; identical to SEQ ID NO: 79285

SEQ ID NO: 360823 - RNA, 64 nt, hsa; identical to SEQ ID NO: 79286

SEQ ID NO: 360824 - RNA, 64 nt, hsa; identical to SEQ ID NO: 79287

SEQ ID NO: 360825 - RNA, 64 nt, hsa; identical to SEQ ID NO: 79288

SEQ ID NO: 360826 - RNA, 64 nt, hsa; identical to SEQ ID NO: 79289

SEQ ID NO: 360827 - RNA, 64 nt, hsa; identical to SEQ ID NO: 79290

SEQ ID NO: 360828 - RNA, 64 nt, hsa; identical to SEQ ID NO: 245916

SEQ ID NO: 360829 - RNA, 64 nt, hsa; identical to SEQ ID NO: 245917

SEQ ID NO: 360830 - RNA, 64 nt, hsa; identical to SEQ ID NO: 245918

SEQ ID NO: 360831 - RNA, 64 nt, hsa; identical to SEQ ID NO: 245919

SEQ ID NO: 360832 - RNA, 64 nt, hsa; identical to SEQ ID NO: 245920

SEQ ID NO: 360833 - RNA, 64 nt, hsa; identical to SEQ ID NO: 245921

SEQ ID NO: 360834 - RNA, 64 nt, hsa; identical to SEQ ID NO: 245922

SEQ ID NO: 360835 - RNA, 64 nt, hsa; identical to SEQ ID NO: 245923

SEQ ID NO: 360836 - RNA, 64 nt, hsa; identical to SEQ ID NO: 245924

SEQ ID NO: 360837 - RNA, 64 nt, hsa; identical to SEQ ID NO: 245925

SEQ ID NO: 360838 - RNA, 64 nt, hsa; identical to SEQ ID NO: 245926

SEQ ID NO: 360839 - RNA, 64 nt, hsa; identical to SEQ ID NO: 245927

SEQ ID NO: 360840 - RNA, 64 nt, hsa; identical to SEQ ID NO: 245928

SEQ ID NO: 360841 - RNA, 64 nt, hsa; identical to SEQ ID NO: 245929

SEQ ID NO: 360842 - RNA, 64 nt, hsa; identical to SEQ ID NO: 245930

SEQ ID NO: 360843 - RNA, 64 nt, hsa; identical to SEQ ID NO: 245931

SEQ ID NO: 360844 - RNA, 64 nt, hsa; identical to SEQ ID NO: 245932

SEQ ID NO: 360845 - RNA, 64 nt, hsa; identical to SEQ ID NO: 245933

SEQ ID NO: 360846 - RNA, 64 nt, hsa; identical to SEQ ID NO: 245934

SEQ ID NO: 360847 - RNA, 64 nt, hsa; identical to SEQ ID NO: 245935

SEQ ID NO: 360848 - RNA, 64 nt, hsa; identical to SEQ ID NO: 245936

SEQ ID NO: 360849 - RNA, 64 nt, hsa; identical to SEQ ID NO: 313160

SEQ ID NO: 360850 - RNA, 64 nt, hsa; identical to SEQ ID NO: 313161

SEQ ID NO: 360851 - RNA, 64 nt, hsa; identical to SEQ ID NO: 313162

SEQ ID NO: 360852 - RNA, 64 nt, hsa; identical to SEQ ID NO: 313163

SEQ ID NO: 360853 - RNA, 64 nt, hsa; identical to SEQ ID NO: 313164

SEQ ID NO: 360854 - RNA, 64 nt, hsa; identical to SEQ ID NO: 313165

SEQ ID NO: 360855 - RNA, 64 nt, hsa; identical to SEQ ID NO: 313166

SEQ ID NO: 360856 - RNA, 64 nt, hsa; identical to SEQ ID NO: 313167

SEQ ID NO: 360857 - RNA, 64 nt, hsa; identical to SEQ ID NO: 313168

SEQ ID NO: 360858 - RNA, 64 nt, hsa; identical to SEQ ID NO: 313169

SEQ ID NO: 360859 - RNA, 64 nt, hsa; identical to SEQ ID NO: 313170

SEQ ID NO: 360860 - RNA, 64 nt, hsa; identical to SEQ ID NO: 313171

SEQ ID NO: 360861 - RNA, 64 nt, hsa; identical to SEQ ID NO: 81987

SEQ ID NO: 360862 - RNA, 64 nt, hsa; identical to SEQ ID NO: 81988

SEQ ID NO: 360863 - RNA, 64 nt, hsa; identical to SEQ ID NO: 81989

SEQ ID NO: 360864 - RNA, 64 nt, hsa; identical to SEQ ID NO: 81990

SEQ ID NO: 360865 - RNA, 64 nt, hsa; identical to SEQ ID NO: 81991

SEQ ID NO: 360866 - RNA, 64 nt, hsa; identical to SEQ ID NO: 81992

SEQ ID NO: 360867 - RNA, 64 nt, hsa; identical to SEQ ID NO: 81993

SEQ ID NO: 360868 - RNA, 64 nt, hsa; identical to SEQ ID NO: 81994

SEQ ID NO: 360869 - RNA, 64 nt, hsa; identical to SEQ ID NO: 81995

SEQ ID NO: 360870 - RNA, 64 nt, hsa; identical to SEQ ID NO: 81996

SEQ ID NO: 360871 - RNA, 64 nt, hsa; identical to SEQ ID NO: 81997

SEQ ID NO: 360872 - RNA, 64 nt, hsa; identical to SEQ ID NO: 81998

SEQ ID NO: 360873 - RNA, 64 nt, hsa; identical to SEQ ID NO: 81999

SEQ ID NO: 360874 - RNA, 64 nt, hsa; identical to SEQ ID NO: 82000

SEQ ID NO: 360875 - RNA, 64 nt, hsa; identical to SEQ ID NO: 82001

SEQ ID NO: 360876 - RNA, 64 nt, hsa; identical to SEQ ID NO: 82002

SEQ ID NO: 360877 - RNA, 64 nt, hsa; identical to SEQ ID NO: 82003

SEQ ID NO: 360878 - RNA, 64 nt, hsa; identical to SEQ ID NO: 82004

SEQ ID NO: 360879 - RNA, 64 nt, hsa; identical to SEQ ID NO: 82005

SEQ ID NO: 360880 - RNA, 64 nt, hsa; identical to SEQ ID NO: 82006

SEQ ID NO: 360881 - RNA, 64 nt, hsa; identical to SEQ ID NO: 82007

SEQ ID NO: 360882 - RNA, 64 nt, hsa; identical to SEQ ID NO: 82008

SEQ ID NO: 360883 - RNA, 58 nt, hsa; identical to SEQ ID NO: 82009

SEQ ID NO: 360884 - RNA, 64 nt, hsa; identical to SEQ ID NO: 82010

SEQ ID NO: 360885 - RNA, 64 nt, hsa; identical to SEQ ID NO: 82011

SEQ ID NO: 360886 - RNA, 64 nt, hsa; identical to SEQ ID NO: 82012

SEQ ID NO: 360887 - RNA, 64 nt, hsa; identical to SEQ ID NO: 82013

SEQ ID NO: 360888 - RNA, 64 nt, hsa; identical to SEQ ID NO: 82014

SEQ ID NO: 360889 - RNA, 64 nt, hsa; identical to SEQ ID NO: 82015

SEQ ID NO: 360890 - RNA, 64 nt, hsa; identical to SEQ ID NO: 82016

SEQ ID NO: 360891 - RNA, 64 nt, hsa; identical to SEQ ID NO: 122997

SEQ ID NO: 360892 - RNA, 64 nt, hsa; identical to SEQ ID NO: 122998

SEQ ID NO: 360893 - RNA, 64 nt, hsa; identical to SEQ ID NO: 122999

SEQ ID NO: 360894 - RNA, 64 nt, hsa; identical to SEQ ID NO: 123000

SEQ ID NO: 360895 - RNA, 64 nt, hsa; identical to SEQ ID NO: 123001

SEQ ID NO: 360896 - RNA, 64 nt, hsa; identical to SEQ ID NO: 123002

SEQ ID NO: 360897 - RNA, 64 nt, hsa; identical to SEQ ID NO: 123003

SEQ ID NO: 360898 - RNA, 64 nt, hsa; identical to SEQ ID NO: 123004

SEQ ID NO: 360899 - RNA, 64 nt, hsa; identical to SEQ ID NO: 123005

SEQ ID NO: 360900 - RNA, 64 nt, hsa; identical to SEQ ID NO: 123006

SEQ ID NO: 360901 - RNA, 64 nt, hsa; identical to SEQ ID NO: 123007

SEQ ID NO: 360902 - RNA, 64 nt, hsa; identical to SEQ ID NO: 123008

SEQ ID NO: 360903 - RNA, 64 nt, hsa; identical to SEQ ID NO: 123009

SEQ ID NO: 360904 - RNA, 64 nt, hsa; identical to SEQ ID NO: 123010

SEQ ID NO: 360905 - RNA, 64 nt, hsa
gggucagaugaugccccccaaaacccugauuuccacacacuaagacuaaauuauguaucaaggc

SEQ ID NO: 360906 - RNA, 64 nt, hsa
guauuuucuccagcucugacauuguuuuccaaagacacacuaaacugcauugcacaguucaaaa

SEQ ID NO: 360907 - RNA, 64 nt, hsa
acacacacacacacacacacacacacacacacacacacacuauuucagaagacaguguguugcc

SEQ ID NO: 360908 - RNA, 64 nt, hsa
aaaauuuguccuugucuagguugagaacuuuuacacacacuaagauaaagauagaaaucugaca

SEQ ID NO: 360909 - RNA, 64 nt, hsa
uguauacuauauaugcccacacaugcacuacauaacacacuauauauauauauauauauacaca

SEQ ID NO: 360910 - RNA, 64 nt, hsa
guuauauuccaccauaacacacacacacacacacacacacuauauacauauaguguauauacac

SEQ ID NO: 360911 - RNA, 64 nt, hsa
ccccaauacacagaaccaccgccaccaccaccaacaccgccacaccaacaccaccacuacaaaa

SEQ ID NO: 360912 - RNA, 64 nt, hsa
aaauauaacccucccuucccccaauacacagaaccaccgccaccaccaccaacaccgccacacc

SEQ ID NO: 360913 - RNA, 64 nt, hsa
ccgccagaacggccuuuugcuuccagccaaagaacaccgccaacacgcacaccuccaaccuggg

SEQ ID NO: 360914 - RNA, 64 nt, hsa
cagcccucggagugcugccaagugccuaccuguccaccgccaccggggucugcgauggcacgcc

SEQ ID NO: 360915 - RNA, 64 nt, hsa
ucugaguaggcugacccugagaagggacaauuaaagagacaaccaagggaacacauugagacua

SEQ ID NO: 360916 - RNA, 64 nt, hsa
aguagcacauugguaauagguaucagagcagucuagagacaauugcaugucaaaaaauguacau

SEQ ID NO: 360917 - RNA, 64 nt, hsa
gaaauuucuaccaagcguuuucauggaugcuaugagagacaauccugaagcugcuguacauauu

SEQ ID NO: 360918 - RNA, 64 nt, hsa
ggcgaccuuggcuaucagacuugaaauauucacgagagacaauaaacgcugaaaggccagugcc

SEQ ID NO: 360919 - RNA, 64 nt, hsa
uugcccagagggcacgggcuuucccaccucucaaagagacaaggaagccaccuguaagcagaag

SEQ ID NO: 360920 - RNA, 64 nt, hsa
aagacuggaguuuuuccagcuggggugggaguggagagacaacaggaacaacgcugcaccaaag

SEQ ID NO: 360921 - RNA, 64 nt, hsa
uguguguguguguguguguaugagagagagagagagagacaacagagacagagagaggcagaga

SEQ ID NO: 360922 - RNA, 64 nt, hsa
agagagaggcagagaggcauagagagacagagagagagacaagaaacagagauagacagaaaau

SEQ ID NO: 360923 - RNA, 64 nt, hsa
ugauaaaacagaauuuaaaccaacaaagaucaaaagagacaaggccauuauauaaugguaaaug

SEQ ID NO: 360924 - RNA, 64 nt, hsa
ugaggccagcaucuuccuguuaccaaagcugggcagagacaaaaccaaaaaagagaauuuuaga

SEQ ID NO: 360925 - RNA, 64 nt, hsa
aagcauguauauaagagcacguuguaaacuugaaagagacaaaggcacaaauguggcuguugau

SEQ ID NO: 360926 - RNA, 64 nt, hsa
cccuagacuaggacuccagugcccuccucucccaagagacaaaggccauugcauugaaggaggu

SEQ ID NO: 360927 - RNA, 64 nt, hsa
augaggagaggaaucagaaaccccacuuuggcauagagacaagcagcacuguuccaguccaggg

SEQ ID NO: 360928 - RNA, 64 nt, hsa
cuacagaaaugauauaaaaacuauagucauaagaagagacaaucaaaaauaaucagccauaaaa

SEQ ID NO: 360929 - RNA, 64 nt, hsa
ugaaccaggauuuaaaccgguuuuuucucacuacagagacaauauuuuuccaccauuguaucuc

SEQ ID NO: 360930 - RNA, 64 nt, hsa
ccccuguguuucuuuggugguagcuuucuuuggaagagacaaacaagauaagauuugauuauuu

SEQ ID NO: 360931 - RNA, 64 nt, hsa
cugaagauuuuugcacacucaggcuaucugagauacugguaaucauccugugaaaaauguacag

SEQ ID NO: 360932 - RNA, 64 nt, hsa
aaaaaugauuucucuggauugcagugucugaguuacugguaaagaugcuuagaagucuuacuca

SEQ ID NO: 360933 - RNA, 64 nt, hsa
aaauuaauauaauagaaagaacacuaaaauacuuacugguaacugcuuagagccauuuaucuga

SEQ ID NO: 360934 - RNA, 64 nt, hsa
cuauuguuuaaugcaaaauauggaacaaaugugaacugguaaaggucgaucuugauacuauauu

SEQ ID NO: 360935 - RNA, 64 nt, hsa
agagccaagcugcacaauuuaauauauucaagaguggggggaggaagcagaggucuucagggcu

SEQ ID NO: 360936 - RNA, 64 nt, hsa
cccagcugcacuuuaacccuagaagguggggaccuggggggagggacagggcaggcgggcccau

SEQ ID NO: 360937 - RNA, 64 nt, hsa
ccuucagcuagggaaagcaguugcgggcaggggguggggggagauuauauucacuccugccaag

SEQ ID NO: 360938 - RNA, 64 nt, hsa
ugagccuccuacuucugggauugcagaucagggguggggggagaauguugcauguuguuuucug

SEQ ID NO: 360939 - RNA, 64 nt, hsa
cuuaaagcaguugguagaaggaaugguauuuguauggggggagggaggcuggaauggagaaucu

SEQ ID NO: 360940 - RNA, 64 nt, hsa
guucacccucagcucugacacauugaacugcaguuggggggauuggcaguuagcccucugugcu

SEQ ID NO: 360941 - RNA, 64 nt, hsa
cugcacugccgcccccauuuuugugccacuugcuuggggggaugugcaaacccacccugccccu

SEQ ID NO: 360942 - RNA, 64 nt, hsa
uggggggaugugcaaacccacccugccccuuggauggggggaccggugcuucggcuuggccuac

SEQ ID NO: 360943 - RNA, 64 nt, hsa
ugugccucuagcucuggagauugguggggggagguggggggaaacggcaggaauaagggaaagu

SEQ ID NO: 360944 - RNA, 64 nt, hsa
uucaugccccugugccucuagcucuggagauugguggggggagguggggggaaacggcaggaau

SEQ ID NO: 360945 - RNA, 64 nt, hsa
gguggggggagggagauggagccuccuguguguuuggggggaaggguggguggggccucccacu

SEQ ID NO: 360946 - RNA, 64 nt, hsa
aguccugcuccuagggcugugaauguuuucaggguggggggagggagauggagccuccugugug

SEQ ID NO: 360947 - RNA, 64 nt, hsa
agcaggcccguguccagucauaccuagagauuuguggggggauacugaaccucuagacugaagu

SEQ ID NO: 360948 - RNA, 64 nt, hsa
gagaccauugggaaauaauuaauagauauuuuucuggggggaaaucacaagucacugagguguu

SEQ ID NO: 360949 - RNA, 64 nt, hsa
cgagguaggucacugucauuuuuguuuuaagaguuggggggaguaucuauaguaaacuugaaua

SEQ ID NO: 360950 - RNA, 64 nt, hsa
uaauacaaucaguguucccaaggcugugcagggguggggggacaugcugucaggauggucugag

SEQ ID NO: 360951 - RNA, 64 nt, hsa
cauucuaggauugucugaaggccagaguagggguuggggggaguguggacaaaccccgcaaauc

SEQ ID NO: 360952 - RNA, 64 nt, hsa
cucagagccucaguuuaccccugcauuaaaaugguggggggacuggucaaaggacucuuauguc

SEQ ID NO: 360953 - RNA, 64 nt, hsa
agccuauacguuucuguggaguaaauauugggauuggggggaaagagggagcaacggcccauag

SEQ ID NO: 360954 - RNA, 64 nt, hsa
auuuuucuauaaucacuugggguuuguacauuuuuggggggagagacacagauuuuuacacuaa

SEQ ID NO: 360955 - RNA, 64 nt, hsa
ccauugcaaucacuucuggaggugcuggggcugcuggggggaguuaucaugauggugcugauug

SEQ ID NO: 360956 - RNA, 64 nt, hsa
aaacaucaaucguguguccugauuugggagugauuggggggauggggugggagaggguuaguug

SEQ ID NO: 360957 - RNA, 64 nt, hsa
auuuaucuuuguaaaucuuuuugagucugggggguggggggaaggggggcuucauuaauuauuu

SEQ ID NO: 360958 - RNA, 64 nt, hsa
gucagaggaguacgcaguuguaugcaguuaugguuggggggaauguuugugagggucuugaacu

SEQ ID NO: 360959 - RNA, 52 nt, hsa
gccuggagcaggccucaugauguggggggacucgacccccugacauggggca

SEQ ID NO: 360960 - RNA, 64 nt, hsa
ugacauggggcagcccauagcaggccuugugcaguggggggacucgacccccugacauggggcu

SEQ ID NO: 360961 - RNA, 64 nt, hsa
aggauuucuuguauuggugaaagacgguuggggauggggggauuuuuuuguucuuguuguaccc

SEQ ID NO: 360962 - RNA, 64 nt, hsa
uuguuuuuccaguuccaggacacagauuaucaacuggggggaccaaauagccaccuugauuuuc

SEQ ID NO: 360963 - RNA, 64 nt, hsa
auuaggguuuggggggggggguggggggaaucuauggggggagggggcucuguggggugggaca

SEQ ID NO: 360964 - RNA, 64 nt, hsa
guagagggguagaauuaggguuuggggggggggguggggggaaucuauggggggagggggcucu

SEQ ID NO: 360965 - RNA, 64 nt, hsa
ggggggaggaggaggcuuauugcuucccagcauuuggggggaacaugauccaaccccuggccuc

SEQ ID NO: 360966 - RNA, 64 nt, hsa
cugugagaauaaguccuaaucuccagagaaaugguggggggaggaggaggcuuauugcuuccca

SEQ ID NO: 360967 - RNA, 64 nt, hsa
gccgguuacugggugugcaggggcuguucugagcuggggggaucauugugaaggccuucuuccc

SEQ ID NO: 360968 - RNA, 64 nt, hsa
uccaagccagaguuuuuaaagccuucuggauccauggggggagaagugauauggugaagggaag

SEQ ID NO: 360969 - RNA, 64 nt, hsa
auuuucacaaucuuggggcugaugaagaaggggguggggggaguuuguguuguuguugcugcug

SEQ ID NO: 360970 - RNA, 64 nt, hsa
gguuuuaaggagcaggaugguucugggguuuggguggggggagacgcgggaaggguaggaaaau

SEQ ID NO: 360971 - RNA, 64 nt, hsa
ggagaagggggggagcauucgggggaguggggaguggggggaaggaaagcggagacccgagcag

SEQ ID NO: 360972 - RNA, 64 nt, hsa
auuuauggacauguaggucuaguugcauuuucacuggggggaggggggaaggugaauuauggua

SEQ ID NO: 360973 - RNA, 64 nt, hsa
ggcagaauccacuguagccuuccgcccugguauuuggggggaugaccagcccaggcguugggug

SEQ ID NO: 360974 - RNA, 64 nt, hsa
cggauugcauccaucacaaucccaaaacuagaguuggggggaacuggagggagcaaaacacuga

SEQ ID NO: 360975 - RNA, 64 nt, hsa
guaaugagcagaucucuguggguguggagcuuguuggggggaugucuaggaagcuucagcuuag

SEQ ID NO: 360976 - RNA, 64 nt, hsa
accuccagugucaggguccaggagagccuggggguggggggacugccuugucucuaguagugug

SEQ ID NO: 360977 - RNA, 64 nt, hsa
aagaugguggccacagacugacccccaucugagcuggggggauguucugccucucccugggucu

SEQ ID NO: 360978 - RNA, 64 nt, hsa
aaaccgaagguuguuaaaauacagcuaaaguugguggggggaccuuaccaccccucagagugcu

SEQ ID NO: 360979 - RNA, 64 nt, hsa
cccuagggaccaagacugaauccuccucacaaacuggggggaaaccgaagguuguuaaaauaca

SEQ ID NO: 360980 - RNA, 64 nt, hsa
ucagaggaaccccagggucuggugauggcagggauggggggagagagagaaaauccacaaauuc

SEQ ID NO: 360981 - RNA, 64 nt, hsa
cauggggccuggggcccgauccgaggcccugggcuggggggaggguagacgugggggcgcuggg

SEQ ID NO: 360982 - RNA, 64 nt, hsa
uggucaagccuuauucuguauuggggacugaggguggggggaguagaggggccgcuggagaaug

SEQ ID NO: 360983 - RNA, 64 nt, hsa
agcugcuccuaggacuggcccaugggcaggcggguggggggaugggaagggggugcccugaaac

SEQ ID NO: 360984 - RNA, 64 nt, hsa
uugcaaagccauguuugcacgguggggggauggguggggggagggcguggaaauagggauucug

SEQ ID NO: 360985 - RNA, 64 nt, hsa
cugggcacuucuuugcaaagccauguuugcacgguggggggauggguggggggagggcguggaa

SEQ ID NO: 360986 - RNA, 64 nt, hsa
aacaccaugcugguuauuuuggcggcuguaguuguggggggaugugugugugcacgugugugug

SEQ ID NO: 360987 - RNA, 64 nt, hsa
gucacaggucaccauggggaauucuagcccccacuggggggauguuacaacaccaugcugguua

SEQ ID NO: 360988 - RNA, 64 nt, hsa
ccugaugauuuuuauuuuuguugguuuuuauuuuuggggggaaugacauguuugggucuuuuau

SEQ ID NO: 360989 - RNA, 64 nt, hsa
guuuauuccaaagaguguggaauuuugguugggguggggggagaggagggaugcaacucgcccu

SEQ ID NO: 360990 - RNA, 64 nt, hsa
cuguuugaacuggaaggucugggguuccgggggguggggggaggcuagacucaaugccggggcc

SEQ ID NO: 360991 - RNA, 64 nt, hsa
gggucucagguuccagcaagucaggcuagggaccuggggggaggagacccauggacuucaccca

SEQ ID NO: 360992 - RNA, 64 nt, hsa
gggaggggggaggggugggaugauggggaaaggguggggggaauuaaaagggagggauaaauau

SEQ ID NO: 360993 - RNA, 64 nt, hsa
uguuuccauggacacaaucuccauagugacaauguggggggaggggggaggggugggaugaugg

SEQ ID NO: 360994 - RNA, 64 nt, hsa
ugauuaccuugggaggggaaggggcagugguggcuggggggauggaauugagagggagacaacu

SEQ ID NO: 360995 - RNA, 64 nt, hsa
ugggagaaguaaagucagaaagaacgaacagcuguggggggaaaaaauucucaguugucaaaaa

SEQ ID NO: 360996 - RNA, 64 nt, hsa
uaagcagacaauucaacugccauguuuugccacccccugugagcagggauuagguguucaggcc

SEQ ID NO: 360997 - RNA, 64 nt, hsa
uggagagagcagguguguuaaaugggacuggagucccugugaagacugggugaggauaacacaa

SEQ ID NO: 360998 - RNA, 64 nt, hsa
cccucuaucacccuuauuaccaagccuugugguucccugugauuuuagauaaugucugauauuu

SEQ ID NO: 360999 - RNA, 64 nt, hsa
aucacucccagccauugauuuuggugacccacuucccugugaugaucuucugaucuaguuucuc

SEQ ID NO: 361000 - RNA, 64 nt, hsa
cuagguguggucccauaggagcagccuuagcauccccugugaacuuaucaaaaaugcaaauucu

SEQ ID NO: 361001 - RNA, 64 nt, hsa
aaagcuccuuaaaguucugggcagcuaaaagcaucccugugagcaaaaaugccaggcagaaaac

SEQ ID NO: 361002 - RNA, 64 nt, hsa
aacacacacaccacacacacacacacacacaaaacccugugacuggaguguuauauuacuaugc

SEQ ID NO: 361003 - RNA, 64 nt, hsa
uuuuuugaaaaaucagcaguucugaugccuugaccccugugaugaccugguagucuuagcaggg

SEQ ID NO: 361004 - RNA, 64 nt, hsa
uuauuuugcuuuaaaucucugguaguuuuuccaccccugugacacaauccuaauagacaguguc

SEQ ID NO: 361005 - RNA, 64 nt, hsa
auauucuuucuguaaagucaaacaggauuccauccccugugaaauaacacaaaauuucacucuc

SEQ ID NO: 361006 - RNA, 64 nt, hsa
guuuggccugccccagugacagugggacgggcugcccugugaguguccaccuggagggaucccc

SEQ ID NO: 361007 - RNA, 64 nt, hsa
ucauucuuggaccucuccuggcugagcucugauucccugugagcacgaugcugaugcaauaguc

SEQ ID NO: 361008 - RNA, 64 nt, hsa
caccauguuggccaggcuggucuugaacuccugacccugugauccgaccaccuuggccucccaa

SEQ ID NO: 361009 - RNA, 64 nt, hsa
auugacccgacuccacuccaggaaggccaucugacccugugacaggcauagcucauaaacuacc

SEQ ID NO: 361010 - RNA, 64 nt, hsa
uuauuaaaugcccagccccuucugacccaugcugcccugugaguacuacaguccucccaucuca

SEQ ID NO: 361011 - RNA, 64 nt, hsa
uuccaggcugggagagccuuccaggggugggacacccugugauggggcccugccuccuuuguga

SEQ ID NO: 361012 - RNA, 64 nt, hsa
cucagucaugccagucuggacaugcucuguugugcccugugacaaaacugcucaguauuccuau

SEQ ID NO: 361013 - RNA, 64 nt, hsa
cauugcuuuucuuguuaagauaaucucuuuacuccccugugagugauucacugccuugucauua

SEQ ID NO: 361014 - RNA, 64 nt, hsa
uuguuucugugucccuaccagacacaaagaugaagugugccagcugguucccccaagccagcuc

SEQ ID NO: 361015 - RNA, 64 nt, hsa
ugccucagccucccgaguagcugggauuagaggcgugugccaccaugccuggcuaauuuuugua

SEQ ID NO: 361016 - RNA, 64 nt, hsa
ugccucggccuccugaguagcugggauuacaggcgugugccacuacacucaacuaauuuuugua

SEQ ID NO: 361017 - RNA, 64 nt, hsa
auauuaacucaaaaguugagauuuuggggugguggugugccaagacauuaauuuuuuuuuuaaa

SEQ ID NO: 361018 - RNA, 64 nt, hsa
cagacugucaucacaugcaugcauaaaccggcaugugugccaaugcacacgagugugccacuca

SEQ ID NO: 361019 - RNA, 64 nt, hsa
augcauaaaccggcaugugugccaaugcacacgagugugccacucaccaccauuccuuggccag

SEQ ID NO: 361020 - RNA, 64 nt, hsa
cacaacagugaaaaguugagcgucauuuuucuuagugugccaagaguucgauguuggcguuucc

SEQ ID NO: 361021 - RNA, 64 nt, hsa
uucgauguuggcguuuccguuguauuuucuugcagugugccauucuguuagacauuagcauuuu

SEQ ID NO: 361022 - RNA, 64 nt, hsa
ucacaacggugaaacuugagcgucauuuuucuuagugugccaagaguucgauguuaguguuucc

SEQ ID NO: 361023 - RNA, 64 nt, hsa
uucgauguuaguguuuccauuguauuuucuuacagugugccauucuguuagauacuauccuuau

SEQ ID NO: 361024 - RNA, 64 nt, hsa
uucgauguuaguguuucuguuguauuuuguuacagugugccauucuguuagauauuagcguuuu

SEQ ID NO: 361025 - RNA, 64 nt, hsa
cacaacagugaaaaguugagcgucauuuuucuuagugugccaagaguucgauguuaguguuucu

SEQ ID NO: 361026 - RNA, 64 nt, hsa
uucgauguuggcguuuccgcuguauuuucuugcagugugccauucuguuagacauuagcguuuu

SEQ ID NO: 361027 - RNA, 64 nt, hsa; identical to SEQ ID NO: 361020

SEQ ID NO: 361028 - RNA, 64 nt, hsa
cccggcuuuucucugccuuucuaccgaccaugugaccccgcaccagcccugcccccaccugccc

SEQ ID NO: 361029 - RNA, 64 nt, hsa
cccccaaccugucccacccccgugcccccuccuuaccccgcaggacgggccuacaggggggucu

SEQ ID NO: 361030 - RNA, 64 nt, hsa
aaaaauacucuuauacagugcaacccaaauaccgcgaaugcaucagcuaaagcagcguguaaau

SEQ ID NO: 361031 - RNA, 64 nt, hsa
gggagaagccacgucguguuucacaugucggagucgaaugcauuuguaaaucccuaagucaagu

SEQ ID NO: 361032 - RNA, 64 nt, hsa; identical to SEQ ID NO: 88665

SEQ ID NO: 361033 - RNA, 64 nt, hsa; identical to SEQ ID NO: 88666

SEQ ID NO: 361034 - RNA, 64 nt, hsa; identical to SEQ ID NO: 88667

SEQ ID NO: 361035 - RNA, 64 nt, hsa; identical to SEQ ID NO: 88668

SEQ ID NO: 361036 - RNA, 64 nt, hsa; identical to SEQ ID NO: 88669

SEQ ID NO: 361037 - RNA, 64 nt, hsa; identical to SEQ ID NO: 88670

SEQ ID NO: 361038 - RNA, 64 nt, hsa; identical to SEQ ID NO: 88671

SEQ ID NO: 361039 - RNA, 64 nt, hsa; identical to SEQ ID NO: 88672

SEQ ID NO: 361040 - RNA, 64 nt, hsa; identical to SEQ ID NO: 88673

SEQ ID NO: 361041 - RNA, 64 nt, hsa; identical to SEQ ID NO: 88674

SEQ ID NO: 361042 - RNA, 64 nt, hsa; identical to SEQ ID NO: 88675

SEQ ID NO: 361043 - RNA, 64 nt, hsa; identical to SEQ ID NO: 88676

SEQ ID NO: 361044 - RNA, 64 nt, hsa; identical to SEQ ID NO: 88677

SEQ ID NO: 361045 - RNA, 64 nt, hsa; identical to SEQ ID NO: 88678

SEQ ID NO: 361046 - RNA, 64 nt, hsa; identical to SEQ ID NO: 88679

SEQ ID NO: 361047 - RNA, 64 nt, hsa; identical to SEQ ID NO: 88680

SEQ ID NO: 361048 - RNA, 64 nt, hsa; identical to SEQ ID NO: 88681

SEQ ID NO: 361049 - RNA, 64 nt, hsa; identical to SEQ ID NO: 88682

SEQ ID NO: 361050 - RNA, 64 nt, hsa; identical to SEQ ID NO: 88683

SEQ ID NO: 361051 - RNA, 64 nt, hsa; identical to SEQ ID NO: 88684

SEQ ID NO: 361052 - RNA, 64 nt, hsa; identical to SEQ ID NO: 88685

SEQ ID NO: 361053 - RNA, 64 nt, hsa; identical to SEQ ID NO: 88686

SEQ ID NO: 361054 - RNA, 64 nt, hsa; identical to SEQ ID NO: 88687

SEQ ID NO: 361055 - RNA, 64 nt, hsa; identical to SEQ ID NO: 88688

SEQ ID NO: 361056 - RNA, 64 nt, hsa; identical to SEQ ID NO: 88689

SEQ ID NO: 361057 - RNA, 64 nt, hsa; identical to SEQ ID NO: 88690

SEQ ID NO: 361058 - RNA, 64 nt, hsa; identical to SEQ ID NO: 88691

SEQ ID NO: 361059 - RNA, 50 nt, hsa; identical to SEQ ID NO: 88692

SEQ ID NO: 361060 - RNA, 64 nt, hsa; identical to SEQ ID NO: 88693

SEQ ID NO: 361061 - RNA, 64 nt, hsa; identical to SEQ ID NO: 88694

SEQ ID NO: 361062 - RNA, 64 nt, hsa; identical to SEQ ID NO: 88695

SEQ ID NO: 361063 - RNA, 64 nt, hsa; identical to SEQ ID NO: 88696

SEQ ID NO: 361064 - RNA, 64 nt, hsa; identical to SEQ ID NO: 88697

SEQ ID NO: 361065 - RNA, 64 nt, hsa; identical to SEQ ID NO: 88698

SEQ ID NO: 361066 - RNA, 64 nt, hsa; identical to SEQ ID NO: 88699

SEQ ID NO: 361067 - RNA, 64 nt, hsa; identical to SEQ ID NO: 88700

SEQ ID NO: 361068 - RNA, 64 nt, hsa; identical to SEQ ID NO: 88701

SEQ ID NO: 361069 - RNA, 64 nt, hsa; identical to SEQ ID NO: 88702

SEQ ID NO: 361070 - RNA, 64 nt, hsa; identical to SEQ ID NO: 88703

SEQ ID NO: 361071 - RNA, 64 nt, hsa; identical to SEQ ID NO: 88704

SEQ ID NO: 361072 - RNA, 64 nt, hsa; identical to SEQ ID NO: 88705

SEQ ID NO: 361073 - RNA, 64 nt, hsa; identical to SEQ ID NO: 88706

SEQ ID NO: 361074 - RNA, 64 nt, hsa; identical to SEQ ID NO: 88707

SEQ ID NO: 361075 - RNA, 64 nt, hsa; identical to SEQ ID NO: 88708

SEQ ID NO: 361076 - RNA, 64 nt, hsa; identical to SEQ ID NO: 88709

SEQ ID NO: 361077 - RNA, 64 nt, hsa; identical to SEQ ID NO: 88710

SEQ ID NO: 361078 - RNA, 64 nt, hsa; identical to SEQ ID NO: 88711

SEQ ID NO: 361079 - RNA, 64 nt, hsa; identical to SEQ ID NO: 88712

SEQ ID NO: 361080 - RNA, 64 nt, hsa; identical to SEQ ID NO: 88713

SEQ ID NO: 361081 - RNA, 64 nt, hsa; identical to SEQ ID NO: 88714

SEQ ID NO: 361082 - RNA, 64 nt, hsa; identical to SEQ ID NO: 88715

SEQ ID NO: 361083 - RNA, 64 nt, hsa; identical to SEQ ID NO: 88716

SEQ ID NO: 361084 - RNA, 64 nt, hsa; identical to SEQ ID NO: 88717

SEQ ID NO: 361085 - RNA, 64 nt, hsa; identical to SEQ ID NO: 88718

SEQ ID NO: 361086 - RNA, 64 nt, hsa; identical to SEQ ID NO: 88719

SEQ ID NO: 361087 - RNA, 64 nt, hsa; identical to SEQ ID NO: 88720

SEQ ID NO: 361088 - RNA, 64 nt, hsa; identical to SEQ ID NO: 88721

SEQ ID NO: 361089 - RNA, 64 nt, hsa; identical to SEQ ID NO: 88722

SEQ ID NO: 361090 - RNA, 64 nt, hsa; identical to SEQ ID NO: 88723

SEQ ID NO: 361091 - RNA, 64 nt, hsa; identical to SEQ ID NO: 88724

SEQ ID NO: 361092 - RNA, 64 nt, hsa; identical to SEQ ID NO: 88725

SEQ ID NO: 361093 - RNA, 64 nt, hsa; identical to SEQ ID NO: 88726

SEQ ID NO: 361094 - RNA, 64 nt, hsa; identical to SEQ ID NO: 88727

SEQ ID NO: 361095 - RNA, 64 nt, hsa; identical to SEQ ID NO: 88728

SEQ ID NO: 361096 - RNA, 64 nt, hsa; identical to SEQ ID NO: 88729

SEQ ID NO: 361097 - RNA, 64 nt, hsa; identical to SEQ ID NO: 88730

SEQ ID NO: 361098 - RNA, 64 nt, hsa; identical to SEQ ID NO: 88731

SEQ ID NO: 361099 - RNA, 64 nt, hsa; identical to SEQ ID NO: 88732

SEQ ID NO: 361100 - RNA, 64 nt, hsa; identical to SEQ ID NO: 88733

SEQ ID NO: 361101 - RNA, 64 nt, hsa; identical to SEQ ID NO: 88734

SEQ ID NO: 361102 - RNA, 64 nt, hsa; identical to SEQ ID NO: 88735

SEQ ID NO: 361103 - RNA, 64 nt, hsa; identical to SEQ ID NO: 88736

SEQ ID NO: 361104 - RNA, 64 nt, hsa; identical to SEQ ID NO: 88737

SEQ ID NO: 361105 - RNA, 64 nt, hsa; identical to SEQ ID NO: 88738

SEQ ID NO: 361106 - RNA, 64 nt, hsa; identical to SEQ ID NO: 88739

SEQ ID NO: 361107 - RNA, 64 nt, hsa; identical to SEQ ID NO: 88740

SEQ ID NO: 361108 - RNA, 64 nt, hsa; identical to SEQ ID NO: 88741

SEQ ID NO: 361109 - RNA, 64 nt, hsa; identical to SEQ ID NO: 88742

SEQ ID NO: 361110 - RNA, 64 nt, hsa; identical to SEQ ID NO: 88743

SEQ ID NO: 361111 - RNA, 64 nt, hsa; identical to SEQ ID NO: 88744

SEQ ID NO: 361112 - RNA, 64 nt, hsa; identical to SEQ ID NO: 88745

SEQ ID NO: 361113 - RNA, 64 nt, hsa; identical to SEQ ID NO: 88746

SEQ ID NO: 361114 - RNA, 64 nt, hsa; identical to SEQ ID NO: 88747

SEQ ID NO: 361115 - RNA, 64 nt, hsa; identical to SEQ ID NO: 88748

SEQ ID NO: 361116 - RNA, 64 nt, hsa; identical to SEQ ID NO: 88749

SEQ ID NO: 361117 - RNA, 64 nt, hsa; identical to SEQ ID NO: 88750

SEQ ID NO: 361118 - RNA, 64 nt, hsa; identical to SEQ ID NO: 88751

SEQ ID NO: 361119 - RNA, 64 nt, hsa; identical to SEQ ID NO: 88752

SEQ ID NO: 361120 - RNA, 64 nt, hsa; identical to SEQ ID NO: 88753

SEQ ID NO: 361121 - RNA, 64 nt, hsa; identical to SEQ ID NO: 88754

SEQ ID NO: 361122 - RNA, 64 nt, hsa; identical to SEQ ID NO: 88755

SEQ ID NO: 361123 - RNA, 64 nt, hsa; identical to SEQ ID NO: 88756

SEQ ID NO: 361124 - RNA, 64 nt, hsa; identical to SEQ ID NO: 88757

SEQ ID NO: 361125 - RNA, 64 nt, hsa; identical to SEQ ID NO: 88758

SEQ ID NO: 361126 - RNA, 64 nt, hsa; identical to SEQ ID NO: 88759

SEQ ID NO: 361127 - RNA, 64 nt, hsa; identical to SEQ ID NO: 88760

SEQ ID NO: 361128 - RNA, 64 nt, hsa; identical to SEQ ID NO: 88761

SEQ ID NO: 361129 - RNA, 64 nt, hsa; identical to SEQ ID NO: 88762

SEQ ID NO: 361130 - RNA, 64 nt, hsa; identical to SEQ ID NO: 88763

SEQ ID NO: 361131 - RNA, 64 nt, hsa; identical to SEQ ID NO: 88764

SEQ ID NO: 361132 - RNA, 64 nt, hsa; identical to SEQ ID NO: 88765

SEQ ID NO: 361133 - RNA, 64 nt, hsa
gcugccaagcauuagguuggaagaugcaaaguuuauaccugaugaucagggcaguaggcauaau

SEQ ID NO: 361134 - RNA, 64 nt, hsa
acauacguauacacacacauacauauauauaaauauaccugaugccagauuuuuuucauaaaua

SEQ ID NO: 361135 - RNA, 64 nt, hsa
augcauuuuucugcuacuacuacaguuucacagaauaccugagaagacacacuuggagaaaccu

SEQ ID NO: 361136 - RNA, 64 nt, hsa
agagauugguugugccuugucacaacugcaaacaauaccugaguggaguauucaaaaacuugcu

SEQ ID NO: 361137 - RNA, 64 nt, hsa
caggacauuggagugggcaaagauuucuuguguaauaccugacaaacaggcaaccaaagcaaaa

SEQ ID NO: 361138 - RNA, 64 nt, hsa
cuguuaaguauugcgauaugacuaaacauacuguauaccugaugaucaucuguaaaguuagagu

SEQ ID NO: 361139 - RNA, 64 nt, hsa
cuagccuauguguauuuguguagaauaaugugggauaccugaauaauagauuuaaaaggaccaa

SEQ ID NO: 361140 - RNA, 64 nt, hsa
aaaagaacaguuuuuuggagaggcagaugacauuauaccugauuuuagaaaaucucacuuuauu

SEQ ID NO: 361141 - RNA, 64 nt, hsa
cguguuugaguauuuucucauuuuuuucauaaccauaccugauuauacuguguaacaaauauuu

SEQ ID NO: 361142 - RNA, 64 nt, hsa; identical to SEQ ID NO: 277333

SEQ ID NO: 361143 - RNA, 64 nt, hsa; identical to SEQ ID NO: 277334

SEQ ID NO: 361144 - RNA, 59 nt, hsa; identical to SEQ ID NO: 277335

SEQ ID NO: 361145 - RNA, 64 nt, hsa; identical to SEQ ID NO: 277336

SEQ ID NO: 361146 - RNA, 64 nt, hsa; identical to SEQ ID NO: 277337

SEQ ID NO: 361147 - RNA, 64 nt, hsa; identical to SEQ ID NO: 277338

SEQ ID NO: 361148 - RNA, 64 nt, hsa
ccauuuguucuucuguuggagagaugagacauuugacccuuagcuccaguuuucuucugauguu

SEQ ID NO: 361149 - RNA, 64 nt, hsa
ccacucuaaaccuucccucuaaguguagagggaagacccuuacguggaguuuccuagugggcuu

SEQ ID NO: 361150 - RNA, 64 nt, hsa
uggguuuaaaguuuacuucauuaucugcuagugucauccacagcaguucauccucauccacacu

SEQ ID NO: 361151 - RNA, 64 nt, hsa
uuaucugcuagugucauccacagcaguucauccucauccacacuaagccauccuguuagcuuuu

SEQ ID NO: 361152 - RNA, 64 nt, hsa
uauuuuauuauguuuauuaaucaccucuaauacucauccacaugaaggguacacauuagguaag

SEQ ID NO: 361153 - RNA, 64 nt, hsa
gaaugauuagaaagacgggcaacacagcggguuacauccacacugcugaucacaccaacgacag

SEQ ID NO: 361154 - RNA, 64 nt, hsa
ugaguuaaaaaaauaauagaaguagaaaugcccacauccacacuuagcuuguuuggguuugcuu

SEQ ID NO: 361155 - RNA, 64 nt, hsa
aggacaguauuucagaaaaggagagguugacagucauccacaaggcauagccuccaaguauacu

SEQ ID NO: 361156 - RNA, 64 nt, hsa
ucccaggucuaugcccaagagaauugaaaacauccauccacacaauaccugugcucccgcguuc

SEQ ID NO: 361157 - RNA, 64 nt, hsa
ucaaaagucaaacgguagcaacaacccaaauguccauccacagaugaauuaagacaugaagugu

SEQ ID NO: 361158 - RNA, 64 nt, hsa
uauuauuucauaaauaauuucaagcaaauacagacauccacaauguagaacaugagagaccccc

SEQ ID NO: 361159 - RNA, 64 nt, hsa
aaacauuuacugagugucugucagggaucauucacauccacaucauccucccggccccuccccg

SEQ ID NO: 361160 - RNA, 64 nt, hsa
guuuuucugacagugaugauaugauauacagauacauccacaggguaucuauuaccagcauaau

SEQ ID NO: 361161 - RNA, 64 nt, hsa
auaaucaauccuuucuaguucagugaauugaccccauccacaggcugauucaucuuuguguuaa

SEQ ID NO: 361162 - RNA, 64 nt, hsa
auccucaggaguuccaggcacaugagucaccguccauccacauccaguguggccuggagcugcu

SEQ ID NO: 361163 - RNA, 64 nt, hsa
aggccagcccuggccccuccacugcuucucuccccauccacaauggagaaggugaaaagaggag

SEQ ID NO: 361164 - RNA, 64 nt, hsa
gcaagaggaaaaugcccugucccuagcucacacucauccacacuuaagcccucgugcacacaca

SEQ ID NO: 361165 - RNA, 64 nt, hsa
ccaggccaaagauccccccagacccccauucugacauccacaugcucugcaguccuggcccccu

SEQ ID NO: 361166 - RNA, 64 nt, hsa
acuccccaucccccuaugcagggugucauuucaccauccacauccacauccuuguuuguguuuc

SEQ ID NO: 361167 - RNA, 64 nt, hsa
caucccccuaugcagggugucauuucaccauccacauccacauccuuguuuguguuucuggccc

SEQ ID NO: 361168 - RNA, 64 nt, hsa
cagaacggccacucgagaccccgggcuucauccacauccacaccucacacaccuguugucagca

SEQ ID NO: 361169 - RNA, 64 nt, hsa
uggccccagaacggccacucgagaccccgggcuucauccacauccacaccucacacaccuguug

SEQ ID NO: 361170 - RNA, 64 nt, hsa
agagaaaauaaccuggucucacugugguugcccucauccacaauguccccaaagccauccugcu

SEQ ID NO: 361171 - RNA, 64 nt, hsa
auacagccccuuuucccugcauucaccugguucccauccacauggguugcagauguccuugaag

SEQ ID NO: 361172 - RNA, 64 nt, hsa; identical to SEQ ID NO: 108245

SEQ ID NO: 361173 - RNA, 64 nt, hsa; identical to SEQ ID NO: 108246

SEQ ID NO: 361174 - RNA, 64 nt, hsa; identical to SEQ ID NO: 108247

SEQ ID NO: 361175 - RNA, 64 nt, hsa; identical to SEQ ID NO: 108248

SEQ ID NO: 361176 - RNA, 64 nt, hsa; identical to SEQ ID NO: 108249

SEQ ID NO: 361177 - RNA, 64 nt, hsa; identical to SEQ ID NO: 108250

SEQ ID NO: 361178 - RNA, 64 nt, hsa; identical to SEQ ID NO: 108251

SEQ ID NO: 361179 - RNA, 64 nt, hsa; identical to SEQ ID NO: 108252

SEQ ID NO: 361180 - RNA, 64 nt, hsa; identical to SEQ ID NO: 108253

SEQ ID NO: 361181 - RNA, 64 nt, hsa; identical to SEQ ID NO: 108254

SEQ ID NO: 361182 - RNA, 64 nt, hsa; identical to SEQ ID NO: 108255

SEQ ID NO: 361183 - RNA, 64 nt, hsa; identical to SEQ ID NO: 108256

SEQ ID NO: 361184 - RNA, 64 nt, hsa; identical to SEQ ID NO: 108257

SEQ ID NO: 361185 - RNA, 64 nt, hsa; identical to SEQ ID NO: 108258

SEQ ID NO: 361186 - RNA, 64 nt, hsa; identical to SEQ ID NO: 108259

SEQ ID NO: 361187 - RNA, 64 nt, hsa; identical to SEQ ID NO: 108260

SEQ ID NO: 361188 - RNA, 64 nt, hsa; identical to SEQ ID NO: 108261

SEQ ID NO: 361189 - RNA, 64 nt, hsa; identical to SEQ ID NO: 108262

SEQ ID NO: 361190 - RNA, 64 nt, hsa; identical to SEQ ID NO: 108263

SEQ ID NO: 361191 - RNA, 64 nt, hsa; identical to SEQ ID NO: 108264

SEQ ID NO: 361192 - RNA, 64 nt, hsa; identical to SEQ ID NO: 108265

SEQ ID NO: 361193 - RNA, 64 nt, hsa; identical to SEQ ID NO: 108266

SEQ ID NO: 361194 - RNA, 64 nt, hsa; identical to SEQ ID NO: 108267

SEQ ID NO: 361195 - RNA, 64 nt, hsa; identical to SEQ ID NO: 108268

SEQ ID NO: 361196 - RNA, 64 nt, hsa; identical to SEQ ID NO: 108269

SEQ ID NO: 361197 - RNA, 64 nt, hsa; identical to SEQ ID NO: 108270

SEQ ID NO: 361198 - RNA, 64 nt, hsa; identical to SEQ ID NO: 108271

SEQ ID NO: 361199 - RNA, 64 nt, hsa; identical to SEQ ID NO: 108272

SEQ ID NO: 361200 - RNA, 64 nt, hsa; identical to SEQ ID NO: 108273

SEQ ID NO: 361201 - RNA, 64 nt, hsa; identical to SEQ ID NO: 108274

SEQ ID NO: 361202 - RNA, 64 nt, hsa; identical to SEQ ID NO: 108275

SEQ ID NO: 361203 - RNA, 64 nt, hsa; identical to SEQ ID NO: 108276

SEQ ID NO: 361204 - RNA, 64 nt, hsa; identical to SEQ ID NO: 108277

SEQ ID NO: 361205 - RNA, 64 nt, hsa; identical to SEQ ID NO: 108278

SEQ ID NO: 361206 - RNA, 64 nt, hsa; identical to SEQ ID NO: 108279

SEQ ID NO: 361207 - RNA, 64 nt, hsa; identical to SEQ ID NO: 108280

SEQ ID NO: 361208 - RNA, 64 nt, hsa; identical to SEQ ID NO: 108281

SEQ ID NO: 361209 - RNA, 64 nt, hsa; identical to SEQ ID NO: 108282

SEQ ID NO: 361210 - RNA, 64 nt, hsa; identical to SEQ ID NO: 108283

SEQ ID NO: 361211 - RNA, 64 nt, hsa; identical to SEQ ID NO: 108284

SEQ ID NO: 361212 - RNA, 64 nt, hsa
aaaaauuguguaugaccauuaauguaugucauaaacauguaaauaaaagauguugaaucuuguu

SEQ ID NO: 361213 - RNA, 64 nt, hsa
guuauaaaguauaaaauuaagauauaagcagaucacauguaaaucauuccuaaagcacaagaaa

SEQ ID NO: 361214 - RNA, 64 nt, hsa
cuucaacccuuuuaaaaccuagauauaaaugcuuacauguaaagaaaggaagcuaagcaguggg

SEQ ID NO: 361215 - RNA, 64 nt, hsa
uacaaguacauuacauguauauuacaaguauauuacauguaaaacaggacaauuuaaaaauuuu

SEQ ID NO: 361216 - RNA, 64 nt, hsa
aaacuugagcaccauugcugguuccauuuagcuuacauguaaauguaauuauuuaaaacacaca

SEQ ID NO: 361217 - RNA, 64 nt, hsa
cugauuauggugccuaagagagcuauauauauacacauguaaaguccauuguuuuuauuguccu

SEQ ID NO: 361218 - RNA, 64 nt, hsa
aagagacucuuugcugaaauugaauugcacuuauacauguaaauugucaacauguaauuuggaa

SEQ ID NO: 361219 - RNA, 64 nt, hsa
gaaauugaauugcacuuauacauguaaauugucaacauguaauuuggaauuuucugauuaauaa

SEQ ID NO: 361220 - RNA, 64 nt, hsa
ucacauguaacuucugcagaccuaucacaaguuuacauguaaccacagaaaucccuuucucucc

SEQ ID NO: 361221 - RNA, 64 nt, hsa
auggaucauggcugacuuccucacuauccucuucacauguaacuucugcagaccuaucacaagu

SEQ ID NO: 361222 - RNA, 64 nt, hsa
cugguuuucauuccuuuuaucuacauguaauuggacauguaaacuuguuaaaaaucaaaaucuu

SEQ ID NO: 361223 - RNA, 64 nt, hsa
aaggugucuuuacugguuuucauuccuuuuaucuacauguaauuggacauguaaacuuguuaaa

SEQ ID NO: 361224 - RNA, 64 nt, hsa
cauugaaucucagggauggcccacaacuggguccacauguaaugagcccuguuuaauaacgaag

SEQ ID NO: 361225 - RNA, 64 nt, hsa
uagaugacgcaaagaaucuccugguagagaagcgacauguaaaaaacugguggaaaaagguuuu

SEQ ID NO: 361226 - RNA, 64 nt, hsa
uaauacaugaaagaauucuagagagaagccauauacauguaaguaacaugggaaagcuuucaau

SEQ ID NO: 361227 - RNA, 64 nt, hsa
cacacguuuuuagccagcccacaugcuuucaacaacauguaagaauguacccuggaucaaaaca

SEQ ID NO: 361228 - RNA, 64 nt, hsa
gcgcguuggugucuccguguuugucccugugaaaacauguaacgucugccuuagagccaugacc

SEQ ID NO: 361229 - RNA, 64 nt, hsa
caagguuauuaugugcaucuguuauuuuuccaauacauguaaacaguugcagcaugaugcuuug

SEQ ID NO: 361230 - RNA, 64 nt, hsa
uaauauguuguuuuucugucccuuuaaagucuuuacauguaauuguagcuguauaaucguuauu

SEQ ID NO: 361231 - RNA, 64 nt, hsa
aggaauuugcagccguuuuacaaauaucuguggaacauguaaauacugucaaauggaaaauaaa

SEQ ID NO: 361232 - RNA, 64 nt, hsa
aauuguugggaggauugauaauuuagauguuuauacauguaauguacuuagaucagugucugcu

SEQ ID NO: 361233 - RNA, 64 nt, hsa
uuagaagugugauuuuuauuuucagaagucauauacauguaagcuacaauuuugagugcuuuau

SEQ ID NO: 361234 - RNA, 64 nt, hsa
uaacauacccuaguugccguuuuuuaauugccaugagccaaauacuucuugguauacaauugau

SEQ ID NO: 361235 - RNA, 64 nt, hsa
uggaaaucgccccuuuugaaggugccauucuuaugagccaaaaguuugucauuuaaaaguucau

SEQ ID NO: 361236 - RNA, 64 nt, hsa
caguuaaaugcuuugauauaguggcuccuuugcagagccaaaacaagauuuauuaaauuuccuu

SEQ ID NO: 361237 - RNA, 64 nt, hsa
ccggcgcagugggaagcucgcagcagcuggggaggagccaaagccucggcgcucaccuaagccg

SEQ ID NO: 361238 - RNA, 64 nt, hsa
aagagguuuuuuaaaagacugucgccaaauagcugagccaaaaggcugaucagaauucacuuuu

SEQ ID NO: 361239 - RNA, 64 nt, hsa
gaaacaaaaauauuuuucccccuaaaauaggagagagccaaaacugaccaaggcuauucagcag

SEQ ID NO: 361240 - RNA, 64 nt, hsa; identical to SEQ ID NO: 125404

SEQ ID NO: 361241 - RNA, 64 nt, hsa; identical to SEQ ID NO: 125405

SEQ ID NO: 361242 - RNA, 64 nt, hsa; identical to SEQ ID NO: 125406

SEQ ID NO: 361243 - RNA, 64 nt, hsa; identical to SEQ ID NO: 125407

SEQ ID NO: 361244 - RNA, 64 nt, hsa; identical to SEQ ID NO: 125408

SEQ ID NO: 361245 - RNA, 57 nt, hsa; identical to SEQ ID NO: 125409

SEQ ID NO: 361246 - RNA, 64 nt, hsa; identical to SEQ ID NO: 125410

SEQ ID NO: 361247 - RNA, 64 nt, hsa; identical to SEQ ID NO: 125411

SEQ ID NO: 361248 - RNA, 64 nt, hsa; identical to SEQ ID NO: 125412

SEQ ID NO: 361249 - RNA, 64 nt, hsa; identical to SEQ ID NO: 125413

SEQ ID NO: 361250 - RNA, 64 nt, hsa; identical to SEQ ID NO: 125414

SEQ ID NO: 361251 - RNA, 64 nt, hsa; identical to SEQ ID NO: 125415

SEQ ID NO: 361252 - RNA, 64 nt, hsa; identical to SEQ ID NO: 125416

SEQ ID NO: 361253 - RNA, 63 nt, hsa; identical to SEQ ID NO: 125417

SEQ ID NO: 361254 - RNA, 64 nt, hsa; identical to SEQ ID NO: 125418

SEQ ID NO: 361255 - RNA, 64 nt, hsa; identical to SEQ ID NO: 125419

SEQ ID NO: 361256 - RNA, 64 nt, hsa; identical to SEQ ID NO: 125420

SEQ ID NO: 361257 - RNA, 64 nt, hsa; identical to SEQ ID NO: 125421

SEQ ID NO: 361258 - RNA, 53 nt, hsa; identical to SEQ ID NO: 125422

SEQ ID NO: 361259 - RNA, 64 nt, hsa; identical to SEQ ID NO: 125423

SEQ ID NO: 361260 - RNA, 64 nt, hsa; identical to SEQ ID NO: 125424

SEQ ID NO: 361261 - RNA, 64 nt, hsa; identical to SEQ ID NO: 125425

SEQ ID NO: 361262 - RNA, 64 nt, hsa; identical to SEQ ID NO: 125426

SEQ ID NO: 361263 - RNA, 64 nt, hsa; identical to SEQ ID NO: 125427

SEQ ID NO: 361264 - RNA, 64 nt, hsa; identical to SEQ ID NO: 125428

SEQ ID NO: 361265 - RNA, 64 nt, hsa; identical to SEQ ID NO: 125429

SEQ ID NO: 361266 - RNA, 56 nt, hsa; identical to SEQ ID NO: 125430

SEQ ID NO: 361267 - RNA, 64 nt, hsa; identical to SEQ ID NO: 125431

SEQ ID NO: 361268 - RNA, 60 nt, hsa; identical to SEQ ID NO: 125432

SEQ ID NO: 361269 - RNA, 64 nt, hsa; identical to SEQ ID NO: 125433

SEQ ID NO: 361270 - RNA, 64 nt, hsa; identical to SEQ ID NO: 125434

SEQ ID NO: 361271 - RNA, 64 nt, hsa; identical to SEQ ID NO: 125435

SEQ ID NO: 361272 - RNA, 64 nt, hsa; identical to SEQ ID NO: 125436

SEQ ID NO: 361273 - RNA, 60 nt, hsa; identical to SEQ ID NO: 125437

SEQ ID NO: 361274 - RNA, 64 nt, hsa; identical to SEQ ID NO: 125438

SEQ ID NO: 361275 - RNA, 64 nt, hsa; identical to SEQ ID NO: 125439

SEQ ID NO: 361276 - RNA, 64 nt, hsa; identical to SEQ ID NO: 125440

SEQ ID NO: 361277 - RNA, 64 nt, hsa; identical to SEQ ID NO: 125441

SEQ ID NO: 361278 - RNA, 64 nt, hsa; identical to SEQ ID NO: 125442

SEQ ID NO: 361279 - RNA, 64 nt, hsa; identical to SEQ ID NO: 125443

SEQ ID NO: 361280 - RNA, 64 nt, hsa; identical to SEQ ID NO: 125444

SEQ ID NO: 361281 - RNA, 64 nt, hsa; identical to SEQ ID NO: 125445

SEQ ID NO: 361282 - RNA, 64 nt, hsa; identical to SEQ ID NO: 125446

SEQ ID NO: 361283 - RNA, 64 nt, hsa; identical to SEQ ID NO: 125447

SEQ ID NO: 361284 - RNA, 64 nt, hsa; identical to SEQ ID NO: 125448

SEQ ID NO: 361285 - RNA, 64 nt, hsa; identical to SEQ ID NO: 125449

SEQ ID NO: 361286 - RNA, 64 nt, hsa; identical to SEQ ID NO: 125450

SEQ ID NO: 361287 - RNA, 64 nt, hsa; identical to SEQ ID NO: 125451

SEQ ID NO: 361288 - RNA, 64 nt, hsa; identical to SEQ ID NO: 125452

SEQ ID NO: 361289 - RNA, 64 nt, hsa; identical to SEQ ID NO: 125453

SEQ ID NO: 361290 - RNA, 64 nt, hsa; identical to SEQ ID NO: 125454

SEQ ID NO: 361291 - RNA, 64 nt, hsa; identical to SEQ ID NO: 125455

SEQ ID NO: 361292 - RNA, 64 nt, hsa; identical to SEQ ID NO: 125456

SEQ ID NO: 361293 - RNA, 64 nt, hsa; identical to SEQ ID NO: 125457

SEQ ID NO: 361294 - RNA, 64 nt, hsa; identical to SEQ ID NO: 125458

SEQ ID NO: 361295 - RNA, 64 nt, hsa; identical to SEQ ID NO: 125459

SEQ ID NO: 361296 - RNA, 64 nt, hsa; identical to SEQ ID NO: 125460

SEQ ID NO: 361297 - RNA, 59 nt, hsa; identical to SEQ ID NO: 125461

SEQ ID NO: 361298 - RNA, 64 nt, hsa; identical to SEQ ID NO: 125462

SEQ ID NO: 361299 - RNA, 64 nt, hsa; identical to SEQ ID NO: 125463

SEQ ID NO: 361300 - RNA, 64 nt, hsa; identical to SEQ ID NO: 125464

SEQ ID NO: 361301 - RNA, 64 nt, hsa; identical to SEQ ID NO: 125465

SEQ ID NO: 361302 - RNA, 64 nt, hsa; identical to SEQ ID NO: 125466

SEQ ID NO: 361303 - RNA, 64 nt, hsa; identical to SEQ ID NO: 125467

SEQ ID NO: 361304 - RNA, 64 nt, hsa; identical to SEQ ID NO: 125468

SEQ ID NO: 361305 - RNA, 64 nt, hsa; identical to SEQ ID NO: 125469

SEQ ID NO: 361306 - RNA, 64 nt, hsa; identical to SEQ ID NO: 125470

SEQ ID NO: 361307 - RNA, 64 nt, hsa; identical to SEQ ID NO: 125471

SEQ ID NO: 361308 - RNA, 64 nt, hsa; identical to SEQ ID NO: 125472

SEQ ID NO: 361309 - RNA, 64 nt, hsa; identical to SEQ ID NO: 125473

SEQ ID NO: 361310 - RNA, 64 nt, hsa; identical to SEQ ID NO: 125474

SEQ ID NO: 361311 - RNA, 55 nt, hsa; identical to SEQ ID NO: 125475

SEQ ID NO: 361312 - RNA, 64 nt, hsa; identical to SEQ ID NO: 125476

SEQ ID NO: 361313 - RNA, 64 nt, hsa; identical to SEQ ID NO: 125477

SEQ ID NO: 361314 - RNA, 64 nt, hsa; identical to SEQ ID NO: 125478

SEQ ID NO: 361315 - RNA, 64 nt, hsa; identical to SEQ ID NO: 125479

SEQ ID NO: 361316 - RNA, 64 nt, hsa; identical to SEQ ID NO: 125480

SEQ ID NO: 361317 - RNA, 64 nt, hsa; identical to SEQ ID NO: 125481

SEQ ID NO: 361318 - RNA, 64 nt, hsa; identical to SEQ ID NO: 125482

SEQ ID NO: 361319 - RNA, 64 nt, hsa; identical to SEQ ID NO: 125483

SEQ ID NO: 361320 - RNA, 64 nt, hsa; identical to SEQ ID NO: 125484

SEQ ID NO: 361321 - RNA, 64 nt, hsa; identical to SEQ ID NO: 125485

SEQ ID NO: 361322 - RNA, 64 nt, hsa; identical to SEQ ID NO: 125486

SEQ ID NO: 361323 - RNA, 64 nt, hsa; identical to SEQ ID NO: 125487

SEQ ID NO: 361324 - RNA, 64 nt, hsa; identical to SEQ ID NO: 125488

SEQ ID NO: 361325 - RNA, 64 nt, hsa; identical to SEQ ID NO: 125489

SEQ ID NO: 361326 - RNA, 64 nt, hsa; identical to SEQ ID NO: 125490

SEQ ID NO: 361327 - RNA, 64 nt, hsa; identical to SEQ ID NO: 125491

SEQ ID NO: 361328 - RNA, 64 nt, hsa; identical to SEQ ID NO: 125492

SEQ ID NO: 361329 - RNA, 64 nt, hsa; identical to SEQ ID NO: 125493

SEQ ID NO: 361330 - RNA, 64 nt, hsa; identical to SEQ ID NO: 125494

SEQ ID NO: 361331 - RNA, 64 nt, hsa; identical to SEQ ID NO: 125495

SEQ ID NO: 361332 - RNA, 64 nt, hsa; identical to SEQ ID NO: 125496

SEQ ID NO: 361333 - RNA, 61 nt, hsa
ucuuggcugguccagggacugcagaaaccaaagcugcuauuguugaggaauaauucagugg

SEQ ID NO: 361334 - RNA, 61 nt, hsa
gcccuuuuguccuugcucccuggcuagggaaagcugcuaguggucagccuguuuugccuuu

SEQ ID NO: 361335 - RNA, 61 nt, hsa
agucaguacacagcugacuuauguagauuuaagcugcuaauaugcuacuuaaccaucuauu

SEQ ID NO: 361336 - RNA, 61 nt, hsa
caaagcaaaaaaaaaaaaaaaaaaaccaguuagcugcuauauaaacacuauaccaagcacu

SEQ ID NO: 361337 - RNA, 61 nt, hsa
uccuccuugguggacguuucuguuuacucagagcugcuagagaccauccugcccauccgag

SEQ ID NO: 361338 - RNA, 61 nt, hsa
aaguggcauuauuuauguugugcugcuguccagcugcuaagaucccuucaucugcacaagc

SEQ ID NO: 361339 - RNA, 61 nt, hsa
gaguuaauggcaaccaauaaugguggccuguagcugcuaagagcuucacgcagguuuggcc

SEQ ID NO: 361340 - RNA, 61 nt, hsa
uguucgguugugugacuaauuguggauuuuaagcugcuauuauuguauuucaguggcaaug

SEQ ID NO: 361341 - RNA, 61 nt, hsa
uugugucucugagauugacuucaagauaauaagcugcuaauuguaaacaaaacaguuaccc

SEQ ID NO: 361342 - RNA, 61 nt, hsa
auuuuuuccauuugaggaauuuuaugaauaaagcugcuauaagcaugaaauuacaagucuu

SEQ ID NO: 361343 - RNA, 61 nt, hsa
ucgucuggcaucucccacacaagacccaaguagcugcuaccuucuuuggccccuugcugga

SEQ ID NO: 361344 - RNA, 61 nt, hsa
auuugacucgggccuuagaacuuugcauagcagcugcuacuagcucuuugagauaauacau

SEQ ID NO: 361345 - RNA, 64 nt, hsa; identical to SEQ ID NO: 165822

SEQ ID NO: 361346 - RNA, 64 nt, hsa; identical to SEQ ID NO: 165823

SEQ ID NO: 361347 - RNA, 64 nt, hsa
uguuccaugagaaaaggauuguuugcucaaaaagcuuggaaaauacuacacacucccuuucucc

SEQ ID NO: 361348 - RNA, 64 nt, hsa
uaaaugcuuuguuuugcuggugauuuaaccagugcuuggaaaaaucuugcuuggcuauuucugc

SEQ ID NO: 361349 - RNA, 64 nt, hsa
ugcaacuaauccuucuaucaucuaacaugcccuacuuggaaagaucuaagaucugaaucuuauc

SEQ ID NO: 361350 - RNA, 64 nt, hsa
uuccuuugaaauccacccaguguuuaaaaagcaacuuggaaauuuacacauuagcauuguacuu

SEQ ID NO: 361351 - RNA, 64 nt, hsa
uuaacaaaaguaaaggaauaaauuugcauauaggcuuggaaagugaggcagcaaugcuguuaac

SEQ ID NO: 361352 - RNA, 64 nt, hsa
auccugcucagaaccauucacauuuaauucaauucuuggaaaaaauuaaagcuuuuugcccaca

SEQ ID NO: 361353 - RNA, 64 nt, hsa
augauguugcauuaauaguuguuuuugucccuuucuuggaaauguuaaugccaaaguugccuga

SEQ ID NO: 361354 - RNA, 64 nt, hsa
guuuccuguccagcuucuuggaaaggagcucacucuuggaaagacugaucuuuccaaaauauuu

SEQ ID NO: 361355 - RNA, 64 nt, hsa
cagauccacauuuauuggguuuccuguccagcuucuuggaaaggagcucacucuuggaaagacu

SEQ ID NO: 361356 - RNA, 64 nt, hsa
aaacuugauuugagauuuuuaugccugugacuuccuuggaaaucaaauguaaaguuuaauugaa

SEQ ID NO: 361357 - RNA, 64 nt, hsa
gcauaguucccaugcacgcugggcaaugagaauccuuggaaacauuggugaugcuaucaguuuu

SEQ ID NO: 361358 - RNA, 64 nt, hsa
aagauacggauccugccuggaguagguaaccuugcuuggaaaccccacaugcaaacgucaugag

SEQ ID NO: 361359 - RNA, 64 nt, hsa
aauguaauaagaugaauauauuccuuacaaauuacuuggaaauucaauguuugugcagaguuga

SEQ ID NO: 361360 - RNA, 64 nt, hsa
gaggccaauaggugccuaguaaauguuaacuguucuuggaaaaaauaaaaacaucaguaacaaa

SEQ ID NO: 361361 - RNA, 64 nt, hsa
gcuauuuuagaaagcuaaaugaaucgcaaguuaacuuggaaaucaguagaaagcuaaagugauc

SEQ ID NO: 361362 - RNA, 64 nt, hsa
uagauggaccccagcauuuaagugaccuucugaucuuggaaaaacagcgucuuccuucuuuauc

SEQ ID NO: 361363 - RNA, 64 nt, hsa
cuuaauagaggagcugcuuguuguuuguugacagcuuggaaagggaagaucuuaugccuuuucu

SEQ ID NO: 361364 - RNA, 64 nt, hsa
aguauacuuugauuaaguaaaaaaaaucccuauucuuggaaaauacacaauaaaguauuuugag

SEQ ID NO: 361365 - RNA, 64 nt, hsa
uaauauaguuugccacuaaaaggaaccaaggcuacuuggaaaaauggaugauuccaaagcaagg

SEQ ID NO: 361366 - RNA, 64 nt, hsa
ucuggccacugugggagggaaggacaaggguucccuuggaaaugugaagggucuuggccucauc

SEQ ID NO: 361367 - RNA, 64 nt, hsa
uuucucucuggaaaguugaaguaucuccaaaggccuuggaaauggcacaaaggugauaaggagc

SEQ ID NO: 361368 - RNA, 64 nt, hsa
ccauaguuauuuacuugaaagaugggucuccgcacuuggaaagguuucaagacuugauacugca

SEQ ID NO: 361369 - RNA, 64 nt, hsa
gguucaagagacacugcuuggguuccuuuuucaacuuggaaaaagaaagaaacacucaacaaua

SEQ ID NO: 361370 - RNA, 64 nt, hsa
ugugaaauaacugcgauuuugugagcaaaacauacuuggaaaugcugauugauuuuuaugcuug

SEQ ID NO: 361371 - RNA, 64 nt, hsa
agguaauaccugccucucacagguacagcuguuucuuggaaauccuccaaccaaauagcaguuu

SEQ ID NO: 361372 - RNA, 64 nt, hsa
cuuuaccuggcagugauaaagaugggcuguggagcuuggaaaaccaccucuguuuuccuugcuc

SEQ ID NO: 361373 - RNA, 64 nt, hsa
aggggaccuuuuuuuguuucuccugacauccagacuuggaaauaucuaacuacuugcaaaacua

SEQ ID NO: 361374 - RNA, 64 nt, hsa
cucacucagucccuaauuaugggacugagaaaagcuuggaaagaaucuugguuucauauaaauu

SEQ ID NO: 361375 - RNA, 64 nt, hsa
ggggaccagcucuuuguugucuacagccagagaccuuggaaacagcugcucccagcccucugcu

SEQ ID NO: 361376 - RNA, 64 nt, hsa
uugagugaguucccuuagugaauuuugucuccugcuuggaaagucucucuucugaaccuggagc

SEQ ID NO: 361377 - RNA, 64 nt, hsa
cuucuuuucauuuuugauuagaggaacuucugaacuuggaaaggggaaguuggcagcaacucuc

SEQ ID NO: 361378 - RNA, 64 nt, hsa
aacuugggaagacaaaauugagccauuaucuccucuuggaaacgaaucuugccagaaaaacggg

SEQ ID NO: 361379 - RNA, 64 nt, hsa
ggaacagucgccuguaguccugguagcuguugugcuuggaaauaacgagcgcauccuugccuca

SEQ ID NO: 361380 - RNA, 64 nt, hsa
gggaucugggggaugagggcggaaggccuagcuccuuggaaauggccuguacuuuaaggacgcu

SEQ ID NO: 361381 - RNA, 64 nt, hsa
guugugucucagagagaguuauuucugugacucucuuggaaaugccuugacugaaugugcaaua

SEQ ID NO: 361382 - RNA, 64 nt, hsa
guguaccugaaagugagggggagaauggaaccaacuuggaaaacacucugcaggauauuaucca

SEQ ID NO: 361383 - RNA, 64 nt, hsa
aggauuaagaaacucacucaaaaccgcucaacuacuuggaaacugaacaaccugcuccugaaug

SEQ ID NO: 361384 - RNA, 64 nt, hsa
ugaguaacuuacauucucuuaauuguaaugguuccuuggaaagucaucguggaaaaugaaggcu

SEQ ID NO: 361385 - RNA, 64 nt, hsa
gguuaaauuaaaaaaaaaaaagagcacgacaaaccuuggaaaucaagaaaguucuggaaugaug

SEQ ID NO: 361386 - RNA, 64 nt, hsa
auaucugauuaaaucauuucucaguuuauuaauccuuggaaacaaugauauagcaguuacucac

SEQ ID NO: 361387 - RNA, 64 nt, hsa
aggcuuugaaguacucagauuugauuuuugcuuucuuggaaagacucacuuuaccaagcauaua

SEQ ID NO: 361388 - RNA, 64 nt, hsa
gcacuccagccugggcaccaaugugagaaccugucuuggaaaaaaaaaaaaagaaacauguuuu

SEQ ID NO: 361389 - RNA, 64 nt, hsa
cagggcucuccuguugguaguuccugcuuuucuucuuggaaauuccucguggaccucgagaucu

SEQ ID NO: 361390 - RNA, 64 nt, hsa
aaacuuuuccauuuuagauuccuuuauagacacgucagccuaaaaaucagccuauucggguguu

SEQ ID NO: 361391 - RNA, 64 nt, hsa
uuuagauuccuuuauagacacgucagccuaaaaaucagccuauucggguguucuuuugaauauc

SEQ ID NO: 361392 - RNA, 64 nt, hsa
gacaaguuaaaaaguagacuuuaagagaucaaacucagccuauuccuuguucccuggugggguc

SEQ ID NO: 361393 - RNA, 64 nt, hsa
acacuguaccuggcuucucuucuuccuuuccugcucagccuagauccuucuuccuuaaccccaa

SEQ ID NO: 361394 - RNA, 64 nt, hsa
ugucagccuagccacagagucugagauucugaguucagccuagccacagagucuaagauucugu

SEQ ID NO: 361395 - RNA, 64 nt, hsa
uauuaggcuauuucaaagccacagcauaagaaugucagccuagccacagagucugagauucuga

SEQ ID NO: 361396 - RNA, 64 nt, hsa
acucugaggauaaaguugccaguccuuuuaauggucagccuaaucauucugucagccuaaucgg

SEQ ID NO: 361397 - RNA, 64 nt, hsa
gccaguccuuuuaauggucagccuaaucauucugucagccuaaucggguaauugcuuuuuuuaa

SEQ ID NO: 361398 - RNA, 64 nt, hsa
cuuuuguuugcuaaaccuugaagaaacaugugccucagccuagauguuuugucuucucuuuucu

SEQ ID NO: 361399 - RNA, 64 nt, hsa
uuuuugcacuccuucuuuguuuucaauauuguauucagccuauuguaggagggggauguggcgu

SEQ ID NO: 361400 - RNA, 64 nt, hsa
uaagaaugagucugaaugguucuugaaaauuagccaggaucaaaugcuauugcagacaaagcca

SEQ ID NO: 361401 - RNA, 64 nt, hsa
cuugccuuuuucagagaaaaagaaaauuuuacaacaggaucacacuaguuuuugcuuugagcag

SEQ ID NO: 361402 - RNA, 64 nt, hsa; identical to SEQ ID NO: 115828

SEQ ID NO: 361403 - RNA, 64 nt, hsa; identical to SEQ ID NO: 115829

SEQ ID NO: 361404 - RNA, 64 nt, hsa; identical to SEQ ID NO: 115830

SEQ ID NO: 361405 - RNA, 64 nt, hsa; identical to SEQ ID NO: 115831

SEQ ID NO: 361406 - RNA, 64 nt, hsa; identical to SEQ ID NO: 115832

SEQ ID NO: 361407 - RNA, 64 nt, hsa; identical to SEQ ID NO: 115833

SEQ ID NO: 361408 - RNA, 64 nt, hsa; identical to SEQ ID NO: 115834

SEQ ID NO: 361409 - RNA, 64 nt, hsa; identical to SEQ ID NO: 115835

SEQ ID NO: 361410 - RNA, 64 nt, hsa; identical to SEQ ID NO: 115836

SEQ ID NO: 361411 - RNA, 64 nt, hsa; identical to SEQ ID NO: 115837

SEQ ID NO: 361412 - RNA, 64 nt, hsa; identical to SEQ ID NO: 115838

SEQ ID NO: 361413 - RNA, 64 nt, hsa; identical to SEQ ID NO: 115839

SEQ ID NO: 361414 - RNA, 64 nt, hsa; identical to SEQ ID NO: 115840

SEQ ID NO: 361415 - RNA, 64 nt, hsa; identical to SEQ ID NO: 115841

SEQ ID NO: 361416 - RNA, 64 nt, hsa; identical to SEQ ID NO: 115842

SEQ ID NO: 361417 - RNA, 64 nt, hsa; identical to SEQ ID NO: 115843

SEQ ID NO: 361418 - RNA, 64 nt, hsa; identical to SEQ ID NO: 115844

SEQ ID NO: 361419 - RNA, 64 nt, hsa; identical to SEQ ID NO: 115845

SEQ ID NO: 361420 - RNA, 64 nt, hsa; identical to SEQ ID NO: 115846

SEQ ID NO: 361421 - RNA, 64 nt, hsa; identical to SEQ ID NO: 115847

SEQ ID NO: 361422 - RNA, 64 nt, hsa; identical to SEQ ID NO: 115848

SEQ ID NO: 361423 - RNA, 64 nt, hsa; identical to SEQ ID NO: 115849

SEQ ID NO: 361424 - RNA, 64 nt, hsa; identical to SEQ ID NO: 115850

SEQ ID NO: 361425 - RNA, 64 nt, hsa; identical to SEQ ID NO: 115851

SEQ ID NO: 361426 - RNA, 64 nt, hsa; identical to SEQ ID NO: 115852

SEQ ID NO: 361427 - RNA, 64 nt, hsa
aaauaggcucauuugggagauucuuuugccaggagagauucaacuuuccaaucuaaguauucca

SEQ ID NO: 361428 - RNA, 64 nt, hsa
gaauguguggacaggucagcuuagaagagauggggagauucaggaucccccugugccagagcac

SEQ ID NO: 361429 - RNA, 64 nt, hsa
cuguggaugccgauuucuguaaacucugcauccagagauucauuuucuagauacaauaaauugc

SEQ ID NO: 361430 - RNA, 64 nt, hsa
uugaccugcauuguaaauagguucuucuuguucugagauucaauauugaauuuuuccuaugcua

SEQ ID NO: 361431 - RNA, 64 nt, hsa
uugccaagaaaggaucucuggggcuuccgggggugagauucaaguaggacaauaacaagaggcu

SEQ ID NO: 361432 - RNA, 64 nt, hsa
gucuuaguuaagauucacaaucuuuagaaagaaugagauucacaauaauuaacucuuccucucu

SEQ ID NO: 361433 - RNA, 55 nt, hsa; identical to SEQ ID NO: 113265

SEQ ID NO: 361434 - RNA, 64 nt, hsa; identical to SEQ ID NO: 113266

SEQ ID NO: 361435 - RNA, 64 nt, hsa; identical to SEQ ID NO: 113267

SEQ ID NO: 361436 - RNA, 64 nt, hsa; identical to SEQ ID NO: 113268

SEQ ID NO: 361437 - RNA, 64 nt, hsa; identical to SEQ ID NO: 113269

SEQ ID NO: 361438 - RNA, 64 nt, hsa; identical to SEQ ID NO: 113270

SEQ ID NO: 361439 - RNA, 64 nt, hsa; identical to SEQ ID NO: 113271

SEQ ID NO: 361440 - RNA, 64 nt, hsa; identical to SEQ ID NO: 113272

SEQ ID NO: 361441 - RNA, 64 nt, hsa; identical to SEQ ID NO: 113273

SEQ ID NO: 361442 - RNA, 64 nt, hsa; identical to SEQ ID NO: 113274

SEQ ID NO: 361443 - RNA, 64 nt, hsa; identical to SEQ ID NO: 113275

SEQ ID NO: 361444 - RNA, 64 nt, hsa; identical to SEQ ID NO: 113276

SEQ ID NO: 361445 - RNA, 64 nt, hsa; identical to SEQ ID NO: 113277

SEQ ID NO: 361446 - RNA, 64 nt, hsa; identical to SEQ ID NO: 113278

SEQ ID NO: 361447 - RNA, 64 nt, hsa; identical to SEQ ID NO: 189094

SEQ ID NO: 361448 - RNA, 64 nt, hsa; identical to SEQ ID NO: 189095

SEQ ID NO: 361449 - RNA, 64 nt, hsa; identical to SEQ ID NO: 189096

SEQ ID NO: 361450 - RNA, 64 nt, hsa; identical to SEQ ID NO: 189097

SEQ ID NO: 361451 - RNA, 64 nt, hsa; identical to SEQ ID NO: 189098

SEQ ID NO: 361452 - RNA, 64 nt, hsa; identical to SEQ ID NO: 189099

SEQ ID NO: 361453 - RNA, 64 nt, hsa; identical to SEQ ID NO: 189100

SEQ ID NO: 361454 - RNA, 64 nt, hsa; identical to SEQ ID NO: 189101

SEQ ID NO: 361455 - RNA, 64 nt, hsa; identical to SEQ ID NO: 189102

SEQ ID NO: 361456 - RNA, 64 nt, hsa; identical to SEQ ID NO: 189103

SEQ ID NO: 361457 - RNA, 64 nt, hsa; identical to SEQ ID NO: 189104

SEQ ID NO: 361458 - RNA, 64 nt, hsa; identical to SEQ ID NO: 189105

SEQ ID NO: 361459 - RNA, 64 nt, hsa; identical to SEQ ID NO: 189106

SEQ ID NO: 361460 - RNA, 64 nt, hsa; identical to SEQ ID NO: 189107

SEQ ID NO: 361461 - RNA, 64 nt, hsa; identical to SEQ ID NO: 189108

SEQ ID NO: 361462 - RNA, 64 nt, hsa; identical to SEQ ID NO: 189109

SEQ ID NO: 361463 - RNA, 64 nt, hsa; identical to SEQ ID NO: 189110

SEQ ID NO: 361464 - RNA, 64 nt, hsa; identical to SEQ ID NO: 189111

SEQ ID NO: 361465 - RNA, 64 nt, hsa; identical to SEQ ID NO: 189112

SEQ ID NO: 361466 - RNA, 64 nt, hsa; identical to SEQ ID NO: 189113

SEQ ID NO: 361467 - RNA, 64 nt, hsa; identical to SEQ ID NO: 189114

SEQ ID NO: 361468 - RNA, 64 nt, hsa; identical to SEQ ID NO: 189115

SEQ ID NO: 361469 - RNA, 64 nt, hsa; identical to SEQ ID NO: 189116

SEQ ID NO: 361470 - RNA, 64 nt, hsa; identical to SEQ ID NO: 189117

SEQ ID NO: 361471 - RNA, 64 nt, hsa; identical to SEQ ID NO: 189118

SEQ ID NO: 361472 - RNA, 64 nt, hsa; identical to SEQ ID NO: 189119

SEQ ID NO: 361473 - RNA, 64 nt, hsa
cgagcgaauuaacggugucgaggugagccagggccagggggaccccgguaaaguuuaguugagg

SEQ ID NO: 361474 - RNA, 64 nt, hsa
gugagaagcccgucuccucagugagccagcauuucagggggagcuggcggacucccacuccccg

SEQ ID NO: 361475 - RNA, 64 nt, hsa
cuccccugccuugcuguuggucaugugggucuuccagggggaaggccaaggggagucaccuucc

SEQ ID NO: 361476 - RNA, 64 nt, hsa
gcacaggaugcuguguugucaacaaaccaagcaucagggggaagaagcagagagaugcggccaa

SEQ ID NO: 361477 - RNA, 64 nt, hsa
uguccuuguguuccuaucggaugcucccaguaaccagggggaccacccgagcuaaucauggaau

SEQ ID NO: 361478 - RNA, 64 nt, hsa
ccacucggauggcacucagguggacaggacggggcagggggagacuuggcaccugaccucgagc

SEQ ID NO: 361479 - RNA, 64 nt, hsa
aagaggcgggaggagucauggggauggggagcggcagggggagagaggggcccucgacaaaggc

SEQ ID NO: 361480 - RNA, 64 nt, hsa
ggacucagccuugccugucuuuuccugcugcucccagggggaggugucagaccucgggaggcag

SEQ ID NO: 361481 - RNA, 64 nt, hsa
ucuaucagaaccaauucuaugcgccaaaauacaacagggggaugugucccaguacacuuacaaa

SEQ ID NO: 361482 - RNA, 64 nt, hsa
gaagugagugggagcacagcugaaaagagagggucagggggaggcuggcugcuugcuuaggugg

SEQ ID NO: 361483 - RNA, 64 nt, hsa
gcgccccagcucggccuugggagguggucguguccagggggaugauggagagcuguccaaccaa

SEQ ID NO: 361484 - RNA, 64 nt, hsa
ucugggcucagagagaggcccuugagcugcagcucagggggaugcgaggcuucguggacugugu

SEQ ID NO: 361485 - RNA, 64 nt, hsa
uuuuugcugcccccuccccgcccacugucuggggcagggggagaagguauuuucgagauaaagc

SEQ ID NO: 361486 - RNA, 64 nt, hsa
cgaggccaggauggaggugggaggccgagccaagcagggggacguugccagaggggaccagggc

SEQ ID NO: 361487 - RNA, 60 nt, hsa
agaguugaaagagaggccuuaggauucuccucucucuaggugcugagcccucaccucccu

SEQ ID NO: 361488 - RNA, 60 nt, hsa
ugugccauaccagcugagguuuuuccucugucucucuaggaauagggucuguuucacagg

SEQ ID NO: 361489 - RNA, 60 nt, hsa
guccccgaucuagggccagcugcagagggcucucucuaggcagagcguuccuggccagag

SEQ ID NO: 361490 - RNA, 60 nt, hsa
cucacucacacugggcagcccgcugucgggucucucuaggccuaugaaccacaaagcagg

SEQ ID NO: 361491 - RNA, 60 nt, hsa
cacauaccuucauguggcucagugccuuccucucucuaccagucuauuuccauucuuuca

SEQ ID NO: 361492 - RNA, 60 nt, hsa
cacauaccuucaugugguucagugccuuccucucucuaccagucuauuuccacugaacaa

SEQ ID NO: 361493 - RNA, 60 nt, hsa
cacguaccuucaugugauucacugccuuccucucucuaccagucuauuuccacugaacaa

SEQ ID NO: 361494 - RNA, 60 nt, hsa
ucauauugccucuagauuuucuucugugcuucucucuaucugcucuggaauggaugagug

SEQ ID NO: 361495 - RNA, 60 nt, hsa
acuguguuccaggaacuaugcuagaaacugucucucuaggaaagcucuugcaccuuuauc

SEQ ID NO: 361496 - RNA, 60 nt, hsa
aucauuugauuuuggauccaagauuuaucaucucucuauuuugcuauuugccaccauccu

SEQ ID NO: 361497 - RNA, 60 nt, hsa
uagugccaaaaaucuugaaaucucucucucucucucuauuuggaugaaucaaaauguaau

SEQ ID NO: 361498 - RNA, 60 nt, hsa
aaaacaaucuccucucucucucucucucucucucucuaucucucucucuaucuccucucu

SEQ ID NO: 361499 - RNA, 60 nt, hsa
ucucucucucucucucucucucucuaucucucucucuaucuccucucucucucuccucuc

SEQ ID NO: 361500 - RNA, 60 nt, hsa
auuuuucugcgugcucucacucucucuuucucucucuagcuuuuuaauucaugaauauuu

SEQ ID NO: 361501 - RNA, 60 nt, hsa
acaaaguaggucauuccaucaccacccuugucucucuacacauuuugccuuuggggaucu

SEQ ID NO: 361502 - RNA, 60 nt, hsa
ucgguuuuguuuuccaucaggaauuugaguucucucuaacccagcuuacugugggacaua

SEQ ID NO: 361503 - RNA, 60 nt, hsa
caaagccauccuuggcaucuagcacuuacaucucucuaugcuguucuacaagcaaacaaa

SEQ ID NO: 361504 - RNA, 60 nt, hsa
acaaggcgggccguggccuccuccaccaagucucucuagacaauucagggccugcuuucc

SEQ ID NO: 361505 - RNA, 60 nt, hsa
ugaaagucaacccuauguaaacugguguccucucucuagcccucucccuuacuggcccac

SEQ ID NO: 361506 - RNA, 60 nt, hsa
ggcuuugcugcuuucuaacugcuaggcaccucucucuaacccucauugucagagggaauu

SEQ ID NO: 361507 - RNA, 60 nt, hsa
ggugacucccacauacacaguugccauuuuucucucuaacugggcaccagugaacaugcg

SEQ ID NO: 361508 - RNA, 60 nt, hsa
ccaggacacccagccugugccccacaaggaucucucuaaaugggagggauugaggcuacu

SEQ ID NO: 361509 - RNA, 60 nt, hsa
uauucaucucuuuguuuuuugucacucuuuucucucuaauugugucauuuguacuguuug

SEQ ID NO: 361510 - RNA, 64 nt, hsa
uugagaaaucaucuaauuucucagaacuuuuucuuaucucuaacacaguuauuaccauaauaau

SEQ ID NO: 361511 - RNA, 64 nt, hsa
gaaguucuguucccuauaaucugcaaugcugaaguaucucuauucaauucccuuccuuaucugu

SEQ ID NO: 361512 - RNA, 64 nt, hsa
uuuaagguuauauuuuuuaaaauaaugaauuuucuaucucuaggcaacaugucuuuauuauuca

SEQ ID NO: 361513 - RNA, 64 nt, hsa
ggcaaacaaacaaaaaaugcuuucaguguugaaauaucucuauuuuccaaagaugauaaacuuu

SEQ ID NO: 361514 - RNA, 64 nt, hsa
auccugauuuucuugguaagcuuuuuuacuuuauuaucucuauaauuuauuaucucuauccaua

SEQ ID NO: 361515 - RNA, 64 nt, hsa
uaagcuuuuuuacuuuauuaucucuauaauuuauuaucucuauccauauuuguggaucggguag

SEQ ID NO: 361516 - RNA, 64 nt, hsa
cuuucccuccaugcuuccgcggaggagucuauacuaucucuauauacacauuuuaaacauuauu

SEQ ID NO: 361517 - RNA, 64 nt, hsa
caggugucagccaccgcacccagccaagcaccccuaucucuagaggaucuggccccccagccca

SEQ ID NO: 361518 - RNA, 64 nt, hsa
ccaggaggcccuugggagcaugaggagagcuggacucgcucaucuguucuugcaccaccaucca

SEQ ID NO: 361519 - RNA, 64 nt, hsa
cgaugcauccugggcugugcugaggcagugcugucucgcucagucuuuccagaccagcggggca

SEQ ID NO: 361520 - RNA, 64 nt, hsa
ucuuuuuguauaacuucaauaaagauuguaagcaaagguugaggcuuugaugguuuuuuucuua

SEQ ID NO: 361521 - RNA, 64 nt, hsa
cuggcugguugaguuuuguuauuuucuguauagaaagguugagauauaucaacacuuggaauug

SEQ ID NO: 361522 - RNA, 64 nt, hsa
aguucacugcccaugugauacugauugccacauuaagguugaacagcauggcucagagucuaga

SEQ ID NO: 361523 - RNA, 64 nt, hsa
aguucacuacucaugugauacugauucccacauuaagguugaacaacauggcucagagucuugu

SEQ ID NO: 361524 - RNA, 64 nt, hsa
uggauugggucagaugccuguccuuggaggggacaagguugacugcuuaggaggcgcgacgcac

SEQ ID NO: 361525 - RNA, 64 nt, hsa
cgcacagggcugccaggccuggccccucucugggaagguugagagcugagacgggcagcccugu

SEQ ID NO: 361526 - RNA, 64 nt, hsa
gugaauuuuggugauguaaaacagaauauucuguaaaccuaaugucuguauaaauaaugagcgu

SEQ ID NO: 361527 - RNA, 64 nt, hsa
aagcucuaauagagucacagcuuucccagguauaaaaccuaaaauuaagaaguacaauaagcag

SEQ ID NO: 361528 - RNA, 64 nt, hsa
gucaaggucuacagcuaguaaaaugcucagauugaaaccuaaaucuuuucucacucacuuuuag

SEQ ID NO: 361529 - RNA, 64 nt, hsa
auuuggguacuauuauuuccauuugacagaugaaaaaccuaaugcauagaaagauaaguagacc

SEQ ID NO: 361530 - RNA, 64 nt, hsa
auuauuuucaguuuuccaaaauucuaucaucuuuaaaccuaaauaauucaauuucauggaugca

SEQ ID NO: 361531 - RNA, 64 nt, hsa
ggagcucucugugcuaucugcucaauuuuucucuaaaccuaaaacuguucuaaaauagaaaguc

SEQ ID NO: 361532 - RNA, 64 nt, hsa
auuuuaucuucuuaccaaguaccuuacuauaaguaaaccuaagauaagaaaacccagauuuacc

SEQ ID NO: 361533 - RNA, 64 nt, hsa
auccugcagucacagacuugagagcaauaaaugcaaaccuaaaugagaaaauggaaucccugac

SEQ ID NO: 361534 - RNA, 64 nt, hsa
uaauugcuuguaggauaguaaauggucaguauugaaaccuaaucucuagcugccgucuuguaga

SEQ ID NO: 361535 - RNA, 64 nt, hsa
uaguaaacuuauaaaaggcugcuaugguaacacuaaaccuaaguggucucuugucuauuaguuu

SEQ ID NO: 361536 - RNA, 64 nt, hsa
aacaccucccaggggcuccaccuguucaggagcugaagcccaugcuuucccaccagcaugucac

SEQ ID NO: 361537 - RNA, 64 nt, hsa
gccuagcuuucauuugacacacagacuacagccagaagcccauggagcagggaugucacgucuu

SEQ ID NO: 361538 - RNA, 64 nt, hsa
gacuuuccccucccugguggccacucuuugcucugaagcccagauuggcaagaggagcuggucc

SEQ ID NO: 361539 - RNA, 64 nt, hsa
ugucuuuccuggucuguccuaggagcuguauaaagaagcccaggggcucuuuuuaacuuucaac

SEQ ID NO: 361540 - RNA, 64 nt, hsa
uugcuaaccaggaugcugggaacaaaggccucuugaagcccagccacagcccagcugagcauga

SEQ ID NO: 361541 - RNA, 64 nt, hsa
cuccugcucugggcucagauacugugacaucccagaagcccagccccucaaccccucuggaugc

SEQ ID NO: 361542 - RNA, 64 nt, hsa
aggugcucaauaaauguuggucauuguuaucacugaagcccaacaugcuagugcuucuagaccc

SEQ ID NO: 361543 - RNA, 64 nt, hsa
aggaagccccaucucugcuguucccugcguggaggaagcccacccagcaagcucucuccuaccc

SEQ ID NO: 361544 - RNA, 64 nt, hsa
caaggccccagauccuucucucuggaggaagagggaagcccagggguccuguuuguaaaacaac

SEQ ID NO: 361545 - RNA, 64 nt, hsa
gaggggacaaaaaagucaaaacgaggcgagaggcgaagcccacuuuuguauaccggccggcgcg

SEQ ID NO: 361546 - RNA, 64 nt, hsa
gaugaaauuauauuuuuggaaaaaaaaaacacuugaagcccagauggaaauacguuuauuucag

SEQ ID NO: 361547 - RNA, 64 nt, hsa
ugaaauuccuccuuccccccaucucugaguggaggaagcccaccaaucugcccuuugcagugug

SEQ ID NO: 361548 - RNA, 64 nt, hsa
uauaacuuuuguggaccaauacuaagaauaacaagaagcccaguggugaggaaagugcguucuc

SEQ ID NO: 361549 - RNA, 64 nt, hsa
auguuggcucccgccuguaaucccagcacuuugggaagcccaagugggugaaucaccugagguc

SEQ ID NO: 361550 - RNA, 64 nt, hsa
augcccagcuugugauuaucguuuuuggagaccugaagcccacacucgggucguauggacuucu

SEQ ID NO: 361551 - RNA, 64 nt, hsa
ccacugaagagccugagucccaggaggccuccuggaagcccaggacugcccacccaccacgcug

SEQ ID NO: 361552 - RNA, 64 nt, hsa
gccaagcccugccgaucagacaugugggcuccccgaagcccagccagagacugccgugcugugg

SEQ ID NO: 361553 - RNA, 64 nt, hsa
ccaccgaaagcucaggggagcacagaagcccauggaagcccagggagaugucccuggggcagac

SEQ ID NO: 361554 - RNA, 64 nt, hsa
ccaucagggcccaccgaaagcucaggggagcacagaagcccauggaagcccagggagauguccc

SEQ ID NO: 361555 - RNA, 64 nt, hsa
ugcccccguccagagcugcagcugagccccaucugaagcccagucccucggagcugcagacagc

SEQ ID NO: 361556 - RNA, 64 nt, hsa
ggucagcugcccacagcccucuugccugaccccugaagcccagaacucugaucuucacagcccu

SEQ ID NO: 361557 - RNA, 64 nt, hsa
uaaaugucaaucagccuaguugaucagcuuauugucuagugaaacucguuaauuuguaguguug

SEQ ID NO: 361558 - RNA, 64 nt, hsa
caagacugcacaucaaaauaugccccauucaacaucuagugagcagucaggaaagagaacuucc

SEQ ID NO: 361559 - RNA, 64 nt, hsa
cuccucacucccaguucccuggacagagcuaaacucucgagacuucucugugaacuucccuacc

SEQ ID NO: 361560 - RNA, 64 nt, hsa
cgugcaucugaauuucaggggucaugcugaugccucucgagacauacaaauccuugcuuuguca

SEQ ID NO: 361561 - RNA, 64 nt, hsa
ugaaaacaaaugggagcauagcagugugugagguucucgagaacugucuugucucuguguguuu

SEQ ID NO: 361562 - RNA, 64 nt, hsa
gaaagaaagauccucugcugaccccuggagcagcucucgagaacuaccuguugguauuguccac

SEQ ID NO: 361563 - RNA, 64 nt, hsa
agagagaaaaaucugcuauuuuucuaaguaagagucucgagaagcagaguuuuugucuugucau

SEQ ID NO: 361564 - RNA, 64 nt, hsa
uugcuauggaauaagaccuuuuauucucccucagucucgagauaaauagccagccuagagcaca

SEQ ID NO: 361565 - RNA, 64 nt, hsa
cacgggaagccuuucugccgcccaggcccacaggucucgagacgcacaugcacgccugggcgug

SEQ ID NO: 361566 - RNA, 64 nt, hsa
acauuuaaaaauauggaaaaacaacccagacgauucucgagagacuggggggaguuaccaacuu

SEQ ID NO: 361567 - RNA, 64 nt, hsa
gccccggcuuccccugcaccgggaaagcgcccccucucgagaggcuggucccuggagaacugcg

SEQ ID NO: 361568 - RNA, 64 nt, hsa
guacagagcuggcaucuaucuggugauuucuagcucucgagauacccaagcagccugauggggc

SEQ ID NO: 361569 - RNA, 64 nt, hsa
gaacgccaagccggaggcccgaggccagccggccucucgagagccagagcagcaguugaaugua

SEQ ID NO: 361570 - RNA, 64 nt, hsa
aacacugaacuccuauuugaccagaacuuuuuccucucgagauaguuuuuucuuuuuaaugaaa

SEQ ID NO: 361571 - RNA, 64 nt, hsa
gguuggauuaccugagaucagguggauuaccuggucucgagaccagccugaccaauauggugaa

SEQ ID NO: 361572 - RNA, 64 nt, hsa
ucuccucauuccccgccgggagcaacaucucucuucucgagaccccagccccuccgcugucuac

SEQ ID NO: 361573 - RNA, 64 nt, hsa
gguaguucuaaggauggaaaggugacaguauuacucucgagaggcaauucaguccugggcaaag

SEQ ID NO: 361574 - RNA, 64 nt, hsa
ucacugcacuccagcuugggugacagagacccugucucgagaaauuaaaaaaaaaaaaaacuua

SEQ ID NO: 361575 - RNA, 64 nt, hsa
gaggagacgggcugggcggcgacccccacagggcucucgagaacagauucuccccuccaguaug

SEQ ID NO: 361576 - RNA, 64 nt, hsa
ccugcuguucucagcuccagcuucaaaccucgagucucgagagggccacggggugguuuuuaug

SEQ ID NO: 361577 - RNA, 64 nt, hsa
gggcugcuuccucgcggcagcccccgcgaagaaaucucgagagaacuggcaugaggaguuaggu

SEQ ID NO: 361578 - RNA, 64 nt, hsa
gcauggcgcucccuucaacagcaagccugacuguucucgagaacucugcaaucuuuuaaauaag

SEQ ID NO: 361579 - RNA, 64 nt, hsa
aggcaggcaccaccguccccagagcaggucagcgucucgagaggccccuggacaauugaggaug

SEQ ID NO: 361580 - RNA, 64 nt, hsa
auggugauaaagggcagcccggcgggucccagcaucucgagacccucugcagaaguauuaucag

SEQ ID NO: 361581 - RNA, 64 nt, hsa
gcaugguucacagaaaaggauccugggcucagaaucucgagaaccgccugcuccuaacaauuca

SEQ ID NO: 361582 - RNA, 64 nt, hsa
gggaugugagaguggaguaccuuccuuucucaagucucgagaugccagugaaaccaguauuccc

SEQ ID NO: 361583 - RNA, 64 nt, hsa
uuaggaaaaguauaugucuuuauuccauugaaguucucgagagugauauaaauacuuugggggg

SEQ ID NO: 361584 - RNA, 64 nt, hsa
cguggugccaugaaggaaagaaaccuuggccuggucucgagaagcuucccaugcuucaggaagu

SEQ ID NO: 361585 - RNA, 62 nt, hsa
auaaguaaaccuaguaaaaccuuguucuauuuuucaaucaucaaaaaguaauuauaaauacg

SEQ ID NO: 361586 - RNA, 62 nt, hsa
caaacccuggugguauuuuauuuuggcuucauuucaaucauugaaguauauucuuauuggaa

SEQ ID NO: 361587 - RNA, 62 nt, hsa
uuagauaaaucagaacucuccuuaaaaugcauuucaaucagaagcaaaguacacccauuauu

SEQ ID NO: 361588 - RNA, 62 nt, hsa
cuguugucauggcugaguaguuuuuugaugaauucaaucaaugcagagaacgcuuuuagaua

SEQ ID NO: 361589 - RNA, 62 nt, hsa
gcuauaagcuuggugaaaugaaaauggaacauuucaaucaaacauuuccuauauaacaauua

SEQ ID NO: 361590 - RNA, 62 nt, hsa
uuaccuuuugauuuguaacacuacuucugcuguucaaucaagagucuugguagauaagaaaa

SEQ ID NO: 361591 - RNA, 62 nt, hsa
uuaagcaaugcagccuagaagcaaugguucuguucaaucauucagauguuaguggaagcaua

SEQ ID NO: 361592 - RNA, 62 nt, hsa
cuuuuccccuucaguagaauuagauuuuguuuuucaaucaugauuucaaaugcaauccuaag

SEQ ID NO: 361593 - RNA, 62 nt, hsa
gccagaaaccugugucaucuuuucaccccaccuucaaucaacaaguccucaaucaacaaguc

SEQ ID NO: 361594 - RNA, 62 nt, hsa
augccucucccuccgcaucucaucuuucucuuuucaaucaggcuuuuccaaaggguuguaua

SEQ ID NO: 361595 - RNA, 62 nt, hsa
cuuuguggcugaggggucaguuaccagugaccuucaaucaacuccaucacuucuuaaaucgg

SEQ ID NO: 361596 - RNA, 62 nt, hsa
gaagggaagcuuuuuuuuuucuuuuuuuuuuuuucaaucacacuuuguggaaaaacauuucc

SEQ ID NO: 361597 - RNA, 62 nt, hsa
uagcuacaccuuuaauaaaaugaaggaaugucuucaaucauauuuuagugggcuauuuauaa

SEQ ID NO: 361598 - RNA, 62 nt, hsa
cuuagcaaugaaauugcuguuaaaacacaaauuucaaucaaauacuuuuguguauagaaaau

SEQ ID NO: 361599 - RNA, 62 nt, hsa
uucaaucaagauccgugcucgcagugggcugauucaaucaagauguauguuugcuauguucu

SEQ ID NO: 361600 - RNA, 62 nt, hsa
uauguagaccuaaaacuacaccaauaggcugauucaaucaagauccgugcucgcagugggcu

SEQ ID NO: 361601 - RNA, 62 nt, hsa
ugauagaccaaaaaacuacaccaguagguugauucaaucaagauguauguagaccuaaaacu

SEQ ID NO: 361602 - RNA, 64 nt, hsa; identical to SEQ ID NO: 305640

SEQ ID NO: 361603 - RNA, 64 nt, hsa; identical to SEQ ID NO: 305641

SEQ ID NO: 361604 - RNA, 64 nt, hsa
uugagcuggcuguauauauuuuaaaauuauaaauagauaauauauuauuuuuugcacauuguga

SEQ ID NO: 361605 - RNA, 64 nt, hsa
aauggauugcaaccaaaacuuuaaacaaguagaaagauaauauuucuccaauugggacucccca

SEQ ID NO: 361606 - RNA, 64 nt, hsa
acuuuuuuauuguuuuuauuucuagccauaccucagauaauauguuuaguuuuacauuuuaaaa

SEQ ID NO: 361607 - RNA, 64 nt, hsa
cuaguaaacauauguuccuaauaagugaagggaaagauaauaaugauggucaacaauaagccac

SEQ ID NO: 361608 - RNA, 64 nt, hsa
aaaaccccaagggacuaauucaugguuguuccaaagauaauagaaaugacacagaaggcuuuaa

SEQ ID NO: 361609 - RNA, 64 nt, hsa
aaucuaauuauaggagcauuuguuacugagccacagauaauacaagagcguccccucacaaaua

SEQ ID NO: 361610 - RNA, 64 nt, hsa
ccuucuuagccauuaauguaauuccucuggauaaagauaauauauucaaaaaauauugggacca

SEQ ID NO: 361611 - RNA, 64 nt, hsa
cuauacuugacuugccuucagaauauuacauuccagauaauaugacuguucaucuuuuucuguc

SEQ ID NO: 361612 - RNA, 64 nt, hsa; identical to SEQ ID NO: 243840

SEQ ID NO: 361613 - RNA, 64 nt, hsa; identical to SEQ ID NO: 243841

SEQ ID NO: 361614 - RNA, 64 nt, hsa; identical to SEQ ID NO: 243842

SEQ ID NO: 361615 - RNA, 64 nt, hsa; identical to SEQ ID NO: 243843

SEQ ID NO: 361616 - RNA, 64 nt, hsa; identical to SEQ ID NO: 243844

SEQ ID NO: 361617 - RNA, 64 nt, hsa; identical to SEQ ID NO: 243845

SEQ ID NO: 361618 - RNA, 64 nt, hsa; identical to SEQ ID NO: 243846

SEQ ID NO: 361619 - RNA, 64 nt, hsa; identical to SEQ ID NO: 243847

SEQ ID NO: 361620 - RNA, 64 nt, hsa; identical to SEQ ID NO: 243848

SEQ ID NO: 361621 - RNA, 64 nt, hsa; identical to SEQ ID NO: 243849

SEQ ID NO: 361622 - RNA, 64 nt, hsa; identical to SEQ ID NO: 243850

SEQ ID NO: 361623 - RNA, 64 nt, hsa; identical to SEQ ID NO: 243851

SEQ ID NO: 361624 - RNA, 64 nt, hsa; identical to SEQ ID NO: 243852

SEQ ID NO: 361625 - RNA, 64 nt, hsa; identical to SEQ ID NO: 243853

SEQ ID NO: 361626 - RNA, 64 nt, hsa; identical to SEQ ID NO: 243854

SEQ ID NO: 361627 - RNA, 64 nt, hsa; identical to SEQ ID NO: 243855

SEQ ID NO: 361628 - RNA, 61 nt, hsa; identical to SEQ ID NO: 238490

SEQ ID NO: 361629 - RNA, 61 nt, hsa; identical to SEQ ID NO: 238491

SEQ ID NO: 361630 - RNA, 61 nt, hsa; identical to SEQ ID NO: 238492

SEQ ID NO: 361631 - RNA, 56 nt, hsa; identical to SEQ ID NO: 238493

SEQ ID NO: 361632 - RNA, 61 nt, hsa; identical to SEQ ID NO: 238494

SEQ ID NO: 361633 - RNA, 61 nt, hsa; identical to SEQ ID NO: 238495

SEQ ID NO: 361634 - RNA, 61 nt, hsa; identical to SEQ ID NO: 238496

SEQ ID NO: 361635 - RNA, 61 nt, hsa; identical to SEQ ID NO: 238497

SEQ ID NO: 361636 - RNA, 61 nt, hsa; identical to SEQ ID NO: 238498

SEQ ID NO: 361637 - RNA, 61 nt, hsa; identical to SEQ ID NO: 238499

SEQ ID NO: 361638 - RNA, 61 nt, hsa; identical to SEQ ID NO: 238500

SEQ ID NO: 361639 - RNA, 61 nt, hsa; identical to SEQ ID NO: 238501

SEQ ID NO: 361640 - RNA, 61 nt, hsa; identical to SEQ ID NO: 238502

SEQ ID NO: 361641 - RNA, 61 nt, hsa; identical to SEQ ID NO: 238503

SEQ ID NO: 361642 - RNA, 64 nt, hsa
ugcugcccagauucagaagaauauugcccacauuucacuguauuuggugcugggucauuuugac

SEQ ID NO: 361643 - RNA, 64 nt, hsa
ugcccaggcuggagugcaguggugccaucauagcucacuguagccucgaccuuccgggaucaag

SEQ ID NO: 361644 - RNA, 64 nt, hsa
gcucccugcaagcugagcagauacaaccaaugcaucacuguauacucuugcugagaauguggau

SEQ ID NO: 361645 - RNA, 64 nt, hsa
cccccaagcgaaugcccuauugaggagaaggacaucacuguauuuggaauucugccugcuagug

SEQ ID NO: 361646 - RNA, 64 nt, hsa
aacguuugccacugagccuuaaccucacuguacuucacuguacuucacacgcauugguguuaac

SEQ ID NO: 361647 - RNA, 64 nt, hsa
gggccucuuuaacguuugccacugagccuuaaccucacuguacuucacuguacuucacacgcau

SEQ ID NO: 361648 - RNA, 64 nt, hsa
ccuacuagaauguaagcuccauggggcagggacuucacuguauuuuguucauaguguaucccca

SEQ ID NO: 361649 - RNA, 64 nt, hsa
cccaaaugaggauauagucauuauuccuuuucagucacuguacgaacacggcagacuuuagccu

SEQ ID NO: 361650 - RNA, 64 nt, hsa
uagauuaugguguuugccuaauuuauaccgguuuucacuguauauuuuaaugaacuuugauugg

SEQ ID NO: 361651 - RNA, 64 nt, hsa
aaacugcaugcauguaaugcuuauuuaguaauggucacuguauguuagauaaggauaaaaauau

SEQ ID NO: 361652 - RNA, 64 nt, hsa
cacccaggccagaguguaguggcacaaucauugcucacuguaaccucgaauuccugggcucaag

SEQ ID NO: 361653 - RNA, 64 nt, hsa
uucuccuaaucuuuccuuuuuuagagacagggucucacuguaucacccaggccagaguguagug

SEQ ID NO: 361654 - RNA, 64 nt, hsa
uguaaugaggcuauuuccaagucuccaaagauggucacuguaacagcacuuugcugagaggguu

SEQ ID NO: 361655 - RNA, 64 nt, hsa
aucagauuauuuucauucaaaugaggaugaugagucacuguaauaucaaaaaauccccagcagc

SEQ ID NO: 361656 - RNA, 64 nt, hsa
uggaaagaguagauuuuauuggucuacccuuuucucacuguagcugcuggcagcccugugccau

SEQ ID NO: 361657 - RNA, 64 nt, hsa
gaauucucugguuuucuguguaauuccagaugagucacuguaacucuagaagauuaaccuucca

SEQ ID NO: 361658 - RNA, 64 nt, hsa
uuucugugcauguucucuacacaauuguaaggugucacuguauuuaacuguugcacuugucaac

SEQ ID NO: 361659 - RNA, 64 nt, hsa
aggguaaaaagacuaaaaugagggggaacagaguucacuguacaaauuugacaacugucaccaa

SEQ ID NO: 361660 - RNA, 64 nt, hsa
aaaauuuaaguuuuuuuaacaacuaccuuauuuuucacuguacagacacuaauucauuaaauac

SEQ ID NO: 361661 - RNA, 64 nt, hsa
aaucaaugggacucugauauaaaggaagaauaagucacuguaaaacagaacuuuuaaaugaagc

SEQ ID NO: 361662 - RNA, 62 nt, hsa
auaaauacagcucaucuugaaagaagaacuauucacuguauuucauuuucuuuauauuggac

SEQ ID NO: 361663 - RNA, 64 nt, hsa
uaaaauagaaagaaaaaaacauuuggcuuauuuuucacuguagcuagucuuuuauacaauaauc

SEQ ID NO: 361664 - RNA, 64 nt, hsa
ucaaccagcagcaagaaguucaaauuuuuuucugucacuguaacagaaaacacaauauguauau

SEQ ID NO: 361665 - RNA, 64 nt, hsa
gcccaggccugggaugcagugaugugaucauagcucacuguaaccucaaacucuggggcucaag

SEQ ID NO: 361666 - RNA, 64 nt, hsa
aagcuauaucgaauauaguucuguguagagaaugucacuguaguuuugaguguauacaugugug

SEQ ID NO: 361667 - RNA, 64 nt, hsa
uguauuucacugucaugucaacaugucugcagaaucacuguauguaacaaacagccauauuuaa

SEQ ID NO: 361668 - RNA, 64 nt, hsa
aucacccgggaagacgacagagacugaagauuggucacuguaaagcaguugaaagaauuuauuc

SEQ ID NO: 361669 - RNA, 64 nt, hsa
gauuugcaaaaucacaaaacuaaguugucaguuaucacuguagaugagcaacucaucuuuuuaa

SEQ ID NO: 361670 - RNA, 64 nt, hsa
ucaauuguuuuucuuuauuuucuucagcauuuaaucacuguauacuauguaauuccugaagggg

SEQ ID NO: 361671 - RNA, 64 nt, hsa
uauugaaaggggacaccuguacauucuuccaucaucacuguaaagacaaauaaaugauuauauu

SEQ ID NO: 361672 - RNA, 64 nt, hsa
uaaauaaauuucccaguuaaagauuauugugacuucacuguauauaaacauauuuuuauacuuu

SEQ ID NO: 361673 - RNA, 64 nt, hsa
cugucuauggaauuacauguaaaacauuaucuugucacuguaguuugguuuuauuugaaaaccu

SEQ ID NO: 361674 - RNA, 64 nt, hsa
agcaugggagccacgacccuucuuaagacauguaucacuguagagggaaggaacagaggcccug

SEQ ID NO: 361675 - RNA, 64 nt, hsa
auaaugucucuuuuaaagucuuugucagauaauuucacuguacauguuauucaguguuuggugu

SEQ ID NO: 361676 - RNA, 64 nt, hsa
ccacugagugcauucaccaccuuuuaaauuuuggucacuguauguaucaguucuaaaauuucca

SEQ ID NO: 361677 - RNA, 64 nt, hsa
aacuaucaacuaucaaauucuaguuucaaguaucucacuguaccuauaucauaucuguucucaa

SEQ ID NO: 361678 - RNA, 64 nt, hsa
uuuuuaagugauaauaccaugccgaguuaccuggucacuguaauacugguucuccauuaaaaug

SEQ ID NO: 361679 - RNA, 64 nt, hsa
ugugaugguguaagagcuaaauccucaucugucauauccagaaaucacuauauaauauauaaua

SEQ ID NO: 361680 - RNA, 64 nt, hsa
cacuaguggaaauaccaaaagcuuccuacguguauauccagagguuuguagauaaauguugcca

SEQ ID NO: 361681 - RNA, 64 nt, hsa
uggucaugcggaacacucuguuauuuaagauggcuauccagauaauccugaacacuguguauuu

SEQ ID NO: 361682 - RNA, 64 nt, hsa
cucuaccucuaagccaguguuuuucaacuauguuuauccagacuccuucuccacaaugaugaau

SEQ ID NO: 361683 - RNA, 64 nt, hsa
uggcugagggauacagagaugaaauuguaaacuguauccagauuaucaaagcuaauuugacuag

SEQ ID NO: 361684 - RNA, 64 nt, hsa
uagcaagggauucagaucuuuguaccuuaucuuauauccagagcagauuccauuuggcagauag

SEQ ID NO: 361685 - RNA, 64 nt, hsa
gguaaguaaaaaggcaucuauauuuaauaacuuuuauccagauggcaacauauuugcaaaauuu

SEQ ID NO: 361686 - RNA, 64 nt, hsa
uauugcacguuggggcauuaggggcaauaauucuuauccagacaugggagccagugaauuuaau

SEQ ID NO: 361687 - RNA, 64 nt, hsa; identical to SEQ ID NO: 138011

SEQ ID NO: 361688 - RNA, 64 nt, hsa; identical to SEQ ID NO: 138012

SEQ ID NO: 361689 - RNA, 64 nt, hsa; identical to SEQ ID NO: 138013

SEQ ID NO: 361690 - RNA, 64 nt, hsa; identical to SEQ ID NO: 138014

SEQ ID NO: 361691 - RNA, 64 nt, hsa; identical to SEQ ID NO: 138015

SEQ ID NO: 361692 - RNA, 59 nt, hsa; identical to SEQ ID NO: 138016

SEQ ID NO: 361693 - RNA, 64 nt, hsa; identical to SEQ ID NO: 138017

SEQ ID NO: 361694 - RNA, 64 nt, hsa; identical to SEQ ID NO: 138018

SEQ ID NO: 361695 - RNA, 64 nt, hsa; identical to SEQ ID NO: 138019

SEQ ID NO: 361696 - RNA, 64 nt, hsa; identical to SEQ ID NO: 138020

SEQ ID NO: 361697 - RNA, 64 nt, hsa; identical to SEQ ID NO: 138021

SEQ ID NO: 361698 - RNA, 64 nt, hsa; identical to SEQ ID NO: 138022

SEQ ID NO: 361699 - RNA, 64 nt, hsa; identical to SEQ ID NO: 138023

SEQ ID NO: 361700 - RNA, 64 nt, hsa; identical to SEQ ID NO: 138024

SEQ ID NO: 361701 - RNA, 64 nt, hsa; identical to SEQ ID NO: 138025

SEQ ID NO: 361702 - RNA, 64 nt, hsa; identical to SEQ ID NO: 138026

SEQ ID NO: 361703 - RNA, 64 nt, hsa; identical to SEQ ID NO: 138027

SEQ ID NO: 361704 - RNA, 64 nt, hsa; identical to SEQ ID NO: 138028

SEQ ID NO: 361705 - RNA, 64 nt, hsa; identical to SEQ ID NO: 138029

SEQ ID NO: 361706 - RNA, 64 nt, hsa; identical to SEQ ID NO: 138030

SEQ ID NO: 361707 - RNA, 64 nt, hsa; identical to SEQ ID NO: 138031

SEQ ID NO: 361708 - RNA, 64 nt, hsa; identical to SEQ ID NO: 138032

SEQ ID NO: 361709 - RNA, 64 nt, hsa; identical to SEQ ID NO: 138033

SEQ ID NO: 361710 - RNA, 64 nt, hsa; identical to SEQ ID NO: 138034

SEQ ID NO: 361711 - RNA, 64 nt, hsa; identical to SEQ ID NO: 138035

SEQ ID NO: 361712 - RNA, 64 nt, hsa; identical to SEQ ID NO: 138036

SEQ ID NO: 361713 - RNA, 64 nt, hsa; identical to SEQ ID NO: 138037

SEQ ID NO: 361714 - RNA, 64 nt, hsa; identical to SEQ ID NO: 138038

SEQ ID NO: 361715 - RNA, 64 nt, hsa; identical to SEQ ID NO: 138039

SEQ ID NO: 361716 - RNA, 64 nt, hsa; identical to SEQ ID NO: 138040

SEQ ID NO: 361717 - RNA, 64 nt, hsa; identical to SEQ ID NO: 138041

SEQ ID NO: 361718 - RNA, 64 nt, hsa; identical to SEQ ID NO: 138042

SEQ ID NO: 361719 - RNA, 64 nt, hsa; identical to SEQ ID NO: 138043

SEQ ID NO: 361720 - RNA, 64 nt, hsa; identical to SEQ ID NO: 138044

SEQ ID NO: 361721 - RNA, 64 nt, hsa; identical to SEQ ID NO: 138045

SEQ ID NO: 361722 - RNA, 64 nt, hsa; identical to SEQ ID NO: 138046

SEQ ID NO: 361723 - RNA, 64 nt, hsa; identical to SEQ ID NO: 138047

SEQ ID NO: 361724 - RNA, 64 nt, hsa; identical to SEQ ID NO: 138048

SEQ ID NO: 361725 - RNA, 64 nt, hsa; identical to SEQ ID NO: 138049

SEQ ID NO: 361726 - RNA, 64 nt, hsa; identical to SEQ ID NO: 138050

SEQ ID NO: 361727 - RNA, 64 nt, hsa; identical to SEQ ID NO: 138051

SEQ ID NO: 361728 - RNA, 64 nt, hsa; identical to SEQ ID NO: 138052

SEQ ID NO: 361729 - RNA, 64 nt, hsa; identical to SEQ ID NO: 138053

SEQ ID NO: 361730 - RNA, 64 nt, hsa; identical to SEQ ID NO: 138054

SEQ ID NO: 361731 - RNA, 64 nt, hsa; identical to SEQ ID NO: 138055

SEQ ID NO: 361732 - RNA, 64 nt, hsa; identical to SEQ ID NO: 138056

SEQ ID NO: 361733 - RNA, 64 nt, hsa; identical to SEQ ID NO: 138057

SEQ ID NO: 361734 - RNA, 64 nt, hsa; identical to SEQ ID NO: 138058

SEQ ID NO: 361735 - RNA, 64 nt, hsa; identical to SEQ ID NO: 138059

SEQ ID NO: 361736 - RNA, 64 nt, hsa; identical to SEQ ID NO: 138060

SEQ ID NO: 361737 - RNA, 64 nt, hsa; identical to SEQ ID NO: 138061

SEQ ID NO: 361738 - RNA, 64 nt, hsa; identical to SEQ ID NO: 138062

SEQ ID NO: 361739 - RNA, 64 nt, hsa; identical to SEQ ID NO: 138063

SEQ ID NO: 361740 - RNA, 64 nt, hsa; identical to SEQ ID NO: 138064

SEQ ID NO: 361741 - RNA, 64 nt, hsa; identical to SEQ ID NO: 138065

SEQ ID NO: 361742 - RNA, 64 nt, hsa; identical to SEQ ID NO: 138066

SEQ ID NO: 361743 - RNA, 64 nt, hsa; identical to SEQ ID NO: 133930

SEQ ID NO: 361744 - RNA, 64 nt, hsa; identical to SEQ ID NO: 133931

SEQ ID NO: 361745 - RNA, 64 nt, hsa; identical to SEQ ID NO: 133932

SEQ ID NO: 361746 - RNA, 64 nt, hsa; identical to SEQ ID NO: 133933

SEQ ID NO: 361747 - RNA, 64 nt, hsa; identical to SEQ ID NO: 133934

SEQ ID NO: 361748 - RNA, 64 nt, hsa; identical to SEQ ID NO: 133935

SEQ ID NO: 361749 - RNA, 64 nt, hsa; identical to SEQ ID NO: 133936

SEQ ID NO: 361750 - RNA, 64 nt, hsa; identical to SEQ ID NO: 133937

SEQ ID NO: 361751 - RNA, 64 nt, hsa; identical to SEQ ID NO: 133938

SEQ ID NO: 361752 - RNA, 64 nt, hsa; identical to SEQ ID NO: 133939

SEQ ID NO: 361753 - RNA, 64 nt, hsa; identical to SEQ ID NO: 133940

SEQ ID NO: 361754 - RNA, 64 nt, hsa; identical to SEQ ID NO: 133941

SEQ ID NO: 361755 - RNA, 64 nt, hsa; identical to SEQ ID NO: 133942

SEQ ID NO: 361756 - RNA, 64 nt, hsa; identical to SEQ ID NO: 133943

SEQ ID NO: 361757 - RNA, 64 nt, hsa; identical to SEQ ID NO: 133944

SEQ ID NO: 361758 - RNA, 64 nt, hsa; identical to SEQ ID NO: 133945

SEQ ID NO: 361759 - RNA, 64 nt, hsa; identical to SEQ ID NO: 133946

SEQ ID NO: 361760 - RNA, 64 nt, hsa; identical to SEQ ID NO: 133947

SEQ ID NO: 361761 - RNA, 64 nt, hsa; identical to SEQ ID NO: 133948

SEQ ID NO: 361762 - RNA, 64 nt, hsa; identical to SEQ ID NO: 133949

SEQ ID NO: 361763 - RNA, 64 nt, hsa; identical to SEQ ID NO: 133950

SEQ ID NO: 361764 - RNA, 64 nt, hsa; identical to SEQ ID NO: 133951

SEQ ID NO: 361765 - RNA, 64 nt, hsa; identical to SEQ ID NO: 133952

SEQ ID NO: 361766 - RNA, 64 nt, hsa; identical to SEQ ID NO: 133953

SEQ ID NO: 361767 - RNA, 64 nt, hsa; identical to SEQ ID NO: 133954

SEQ ID NO: 361768 - RNA, 64 nt, hsa; identical to SEQ ID NO: 133955

SEQ ID NO: 361769 - RNA, 64 nt, hsa; identical to SEQ ID NO: 133956

SEQ ID NO: 361770 - RNA, 64 nt, hsa; identical to SEQ ID NO: 133957

SEQ ID NO: 361771 - RNA, 64 nt, hsa; identical to SEQ ID NO: 133958

SEQ ID NO: 361772 - RNA, 64 nt, hsa; identical to SEQ ID NO: 133959

SEQ ID NO: 361773 - RNA, 64 nt, hsa; identical to SEQ ID NO: 133960

SEQ ID NO: 361774 - RNA, 64 nt, hsa; identical to SEQ ID NO: 133961

SEQ ID NO: 361775 - RNA, 64 nt, hsa; identical to SEQ ID NO: 133962

SEQ ID NO: 361776 - RNA, 64 nt, hsa; identical to SEQ ID NO: 133963

SEQ ID NO: 361777 - RNA, 64 nt, hsa; identical to SEQ ID NO: 133964

SEQ ID NO: 361778 - RNA, 64 nt, hsa; identical to SEQ ID NO: 133965

SEQ ID NO: 361779 - RNA, 64 nt, hsa; identical to SEQ ID NO: 133966

SEQ ID NO: 361780 - RNA, 64 nt, hsa
ccagcaaauacucauuuuaggaaaaaaaaaagcaugaucugaaaaauacuuuuggugguauguu

SEQ ID NO: 361781 - RNA, 64 nt, hsa
uagcaagacuguuagcccucaaacuugacucuacugaucugaccauuucccucucaucgccaga

SEQ ID NO: 361782 - RNA, 64 nt, hsa
gcaagaaaaaugcugaggccucgggucaagauuuugaucugagacaugcugaugcuucaaggag

SEQ ID NO: 361783 - RNA, 64 nt, hsa
ugcugcucgugagcaggaaaaucagaggagccacugaucugagugguauuuagguugaaggaaa

SEQ ID NO: 361784 - RNA, 64 nt, hsa
aucuuggaacucaaucuucuguuggaucacgggaaaucaagacacccaggaggaauugaaagag

SEQ ID NO: 361785 - RNA, 64 nt, hsa
uauuguauauauuaaaacagagauaugugcaugaaaucaagaaaaaagaaaugaacaaaagcaa

SEQ ID NO: 361786 - RNA, 64 nt, hsa
ggugaacugaaaaguuauuuuaacuauuauacauaaucaagauccugccucuacggaauuagcu

SEQ ID NO: 361787 - RNA, 64 nt, hsa
acugucuugaaauugaaucuguccaucuguuuauaaucaagaacauaucagaaauauauagguc

SEQ ID NO: 361788 - RNA, 64 nt, hsa
cucacuguucucucccuugaaucucauuuguaggaaucaagagauuccuauacaugggacuuuu

SEQ ID NO: 361789 - RNA, 64 nt, hsa
uacccaccagaguaagcaaucuuuucuuuuuagaaaucaagaauuuggcuucacagauggcuuc

SEQ ID NO: 361790 - RNA, 64 nt, hsa
uccuuuucuucacccuccccuuuuuucuucuauuaaucaagagaaacuucaaaguuaaugggau

SEQ ID NO: 361791 - RNA, 64 nt, hsa
gggacugccaggcuguuucagccaggaaggccaaaaucaagagugagauguagaaaguuguaaa

SEQ ID NO: 361792 - RNA, 64 nt, hsa
gugaaaaauaguuuuugaaaacaucagauuauaaaaucaagauaguccggacgcgguggcacau

SEQ ID NO: 361793 - RNA, 64 nt, hsa
gggcgacagagcgagacuccaccucaaaaaauaaaaucaagauaaccucuugaauguaauagcu

SEQ ID NO: 361794 - RNA, 64 nt, hsa
aagaaacaaauuuuaauuaaacaaucuguaacagaaucaagaaacaaauacauuuuaauuaaac

SEQ ID NO: 361795 - RNA, 64 nt, hsa
cccuuuucacaugguuucuccauguauauaacagaaucaagaaacaaauuuuaauuaaacaauc

SEQ ID NO: 361796 - RNA, 64 nt, hsa
auagaaguuauucaaaauuauacaguuuucaaaaaaucaagacaaguaggcccaauacaaacua

SEQ ID NO: 361797 - RNA, 64 nt, hsa
ugaguuaagaaaguuuuauuuaaauauuaauauuaaucaagaauuuaacagauauaugugacag

SEQ ID NO: 361798 - RNA, 64 nt, hsa
auuucuuuugcuuuuaaaaaaauuccugguagcaaaucaagauaaauaauugcuucauuuucuu

SEQ ID NO: 361799 - RNA, 64 nt, hsa
aauauaugaccaugacuuugaaaggcaaaagaggaaucaagaauaaauaaaacaaacuuaaucu

SEQ ID NO: 361800 - RNA, 64 nt, hsa
gguucccgugagauaaguuaacccggccugacagaaucaagaaaauugagaugagauuugaaag

SEQ ID NO: 361801 - RNA, 64 nt, hsa
gugaaggugaucaguguagcaguaagacaucuaaaaucaagacaaugacaugggggcuuugugu

SEQ ID NO: 361802 - RNA, 64 nt, hsa
aagaggaguaauguuccgaaucauguuuuugaaaaaucaagaccuccuguuaagggcccacuug

SEQ ID NO: 361803 - RNA, 64 nt, hsa
uaccaucuugaaggugaagggaguuaagaaaaguaaucaagaccugcuccuaagcauaugagac

SEQ ID NO: 361804 - RNA, 64 nt, hsa
aaaaacaucagaaauaauaaaaaauuucagagagaaucaagauaccuuuuuuuuucuuuuuuuu

SEQ ID NO: 361805 - RNA, 64 nt, hsa
caaaucucuacaaauuuuucuguggugauagcaaaaucaagagauggcuuacaaaaagaaauau

SEQ ID NO: 361806 - RNA, 64 nt, hsa
cuuucuccuuuuuuuugacagcuuccugucaagcaaucaagaaacaaacaaaagcugaacacau

SEQ ID NO: 361807 - RNA, 64 nt, hsa
ucaaucaagauccgugcucgcagugggcugauucaaucaagauguauguuugcuauguucuaag

SEQ ID NO: 361808 - RNA, 64 nt, hsa
auguagaccuaaaacuacaccaauaggcugauucaaucaagauccgugcucgcagugggcugau

SEQ ID NO: 361809 - RNA, 64 nt, hsa
gauagaccaaaaaacuacaccaguagguugauucaaucaagauguauguagaccuaaaacuaca

SEQ ID NO: 361810 - RNA, 64 nt, hsa; identical to SEQ ID NO: 124084

SEQ ID NO: 361811 - RNA, 64 nt, hsa; identical to SEQ ID NO: 124085

SEQ ID NO: 361812 - RNA, 64 nt, hsa; identical to SEQ ID NO: 124086

SEQ ID NO: 361813 - RNA, 64 nt, hsa; identical to SEQ ID NO: 124087

SEQ ID NO: 361814 - RNA, 64 nt, hsa; identical to SEQ ID NO: 124088

SEQ ID NO: 361815 - RNA, 64 nt, hsa; identical to SEQ ID NO: 124089

SEQ ID NO: 361816 - RNA, 64 nt, hsa; identical to SEQ ID NO: 124090

SEQ ID NO: 361817 - RNA, 64 nt, hsa; identical to SEQ ID NO: 124091

SEQ ID NO: 361818 - RNA, 64 nt, hsa; identical to SEQ ID NO: 124092

SEQ ID NO: 361819 - RNA, 64 nt, hsa; identical to SEQ ID NO: 124093

SEQ ID NO: 361820 - RNA, 64 nt, hsa; identical to SEQ ID NO: 124094

SEQ ID NO: 361821 - RNA, 64 nt, hsa; identical to SEQ ID NO: 124095

SEQ ID NO: 361822 - RNA, 64 nt, hsa; identical to SEQ ID NO: 124096

SEQ ID NO: 361823 - RNA, 64 nt, hsa; identical to SEQ ID NO: 124097

SEQ ID NO: 361824 - RNA, 64 nt, hsa; identical to SEQ ID NO: 124098

SEQ ID NO: 361825 - RNA, 64 nt, hsa; identical to SEQ ID NO: 124099

SEQ ID NO: 361826 - RNA, 64 nt, hsa; identical to SEQ ID NO: 124100

SEQ ID NO: 361827 - RNA, 64 nt, hsa; identical to SEQ ID NO: 124101

SEQ ID NO: 361828 - RNA, 64 nt, hsa; identical to SEQ ID NO: 124102

SEQ ID NO: 361829 - RNA, 64 nt, hsa; identical to SEQ ID NO: 124103

SEQ ID NO: 361830 - RNA, 64 nt, hsa; identical to SEQ ID NO: 124104

SEQ ID NO: 361831 - RNA, 64 nt, hsa; identical to SEQ ID NO: 124105

SEQ ID NO: 361832 - RNA, 64 nt, hsa; identical to SEQ ID NO: 124106

SEQ ID NO: 361833 - RNA, 64 nt, hsa; identical to SEQ ID NO: 124107

SEQ ID NO: 361834 - RNA, 64 nt, hsa; identical to SEQ ID NO: 124108

SEQ ID NO: 361835 - RNA, 64 nt, hsa; identical to SEQ ID NO: 124109

SEQ ID NO: 361836 - RNA, 64 nt, hsa; identical to SEQ ID NO: 124110

SEQ ID NO: 361837 - RNA, 64 nt, hsa; identical to SEQ ID NO: 124111

SEQ ID NO: 361838 - RNA, 64 nt, hsa; identical to SEQ ID NO: 124112

SEQ ID NO: 361839 - RNA, 64 nt, hsa; identical to SEQ ID NO: 124113

SEQ ID NO: 361840 - RNA, 64 nt, hsa; identical to SEQ ID NO: 124114

SEQ ID NO: 361841 - RNA, 64 nt, hsa; identical to SEQ ID NO: 124115

SEQ ID NO: 361842 - RNA, 64 nt, hsa; identical to SEQ ID NO: 124116

SEQ ID NO: 361843 - RNA, 64 nt, hsa; identical to SEQ ID NO: 124117

SEQ ID NO: 361844 - RNA, 64 nt, hsa; identical to SEQ ID NO: 124118

SEQ ID NO: 361845 - RNA, 64 nt, hsa; identical to SEQ ID NO: 124119

SEQ ID NO: 361846 - RNA, 64 nt, hsa; identical to SEQ ID NO: 124120

SEQ ID NO: 361847 - RNA, 64 nt, hsa; identical to SEQ ID NO: 124121

SEQ ID NO: 361848 - RNA, 64 nt, hsa; identical to SEQ ID NO: 124122

SEQ ID NO: 361849 - RNA, 64 nt, hsa; identical to SEQ ID NO: 124123

SEQ ID NO: 361850 - RNA, 64 nt, hsa; identical to SEQ ID NO: 245914

SEQ ID NO: 361851 - RNA, 64 nt, hsa; identical to SEQ ID NO: 245915

SEQ ID NO: 361852 - RNA, 64 nt, hsa
caggggguaguucuuuacucucccuuuacuacccuggagggacagcucugcccuugaggcccuu

SEQ ID NO: 361853 - RNA, 64 nt, hsa
caggaggagcccuucauccuggcaggccggauuguggagggacuucccucccccucuuuuccau

SEQ ID NO: 361854 - RNA, 64 nt, hsa
uguuuugucuguugccgucagccgaacuuuguuauggagggagcagccucacacaagcagaaac

SEQ ID NO: 361855 - RNA, 64 nt, hsa
cccccucugcagcccauccugggaguguauuaacuggagggaagaugggucuugcaguacauuu

SEQ ID NO: 361856 - RNA, 64 nt, hsa
ucuguucuugccacaccugcuugauccucagauguggagggagguaggcacugccucagucuuc

SEQ ID NO: 361857 - RNA, 64 nt, hsa
caucuuggcacccagaggagcagcagcaacaggcuggagggagagggaagcaagaccaagauga

SEQ ID NO: 361858 - RNA, 64 nt, hsa
uuccaugucaacaauuuguccaaaggaaaacugcuggagggagguggagggaggaaggugggaa

SEQ ID NO: 361859 - RNA, 64 nt, hsa
acaauuuguccaaaggaaaacugcuggagggagguggagggaggaaggugggaauuauuauuua

SEQ ID NO: 361860 - RNA, 64 nt, hsa
gaaugucugcucuggggggcacaggccaacuauauggagggagggucccaaauuagcaaacccu

SEQ ID NO: 361861 - RNA, 64 nt, hsa
gggagagagaggcaguguacuugcccccaucuccuggagggaggugcguuggaaauucuaggcc

SEQ ID NO: 361862 - RNA, 64 nt, hsa
gcaggcauggcccugggcggggcgugggggggcguggagggaggccccagggggucucacccau

SEQ ID NO: 361863 - RNA, 64 nt, hsa
aguuuuauagccuggacugcuaccuuucaaagcuuggagggaagccgugaauucaguugguucg

SEQ ID NO: 361864 - RNA, 64 nt, hsa
aucugucagaggaaaauggucuccacagcaacucuggagggaagcugaagacagauagcuuccu

SEQ ID NO: 361865 - RNA, 64 nt, hsa
ugggcuuuuccucugagauuccagcagguggcgcuggagggagucaggggacauaauggccucc

SEQ ID NO: 361866 - RNA, 64 nt, hsa
ggacaaucucaggcugaaaucccauaaaggaacuuggagggaauauuaugauggagggaaguga

SEQ ID NO: 361867 - RNA, 64 nt, hsa
aaucccauaaaggaacuuggagggaauauuaugauggagggaagugaggugaauccaggcacau

SEQ ID NO: 361868 - RNA, 64 nt, hsa
caggccacguggagacaccacggucgacgacggcuggagggacguuucagaggcgaguccuggg

SEQ ID NO: 361869 - RNA, 64 nt, hsa
gugcacgugcccugcgccacauccucacgcucgguggagggacgcgugcggcgggacggugccu

SEQ ID NO: 361870 - RNA, 64 nt, hsa
gauuuucucagaugccuuuacacgcugaugggacuggagggagcccacccuucagcacgagcac

SEQ ID NO: 361871 - RNA, 64 nt, hsa
aagaagacgacugcuaagacacggcaggggggccuggagggagccuccgacucugagcugcucc

SEQ ID NO: 361872 - RNA, 64 nt, hsa
cccugcccuuccccaggucggccucuccgcugucuggagggaaggggauuuggagggaggcugu

SEQ ID NO: 361873 - RNA, 64 nt, hsa
gucggccucuccgcugucuggagggaaggggauuuggagggaggcugucgucgcccccaggaaa

SEQ ID NO: 361874 - RNA, 64 nt, hsa
ccuuccucccagcagcagcagugcagagcccaccuggagggaugugggggcugugcagggugca

SEQ ID NO: 361875 - RNA, 64 nt, hsa
gguggauccugggaagcagccucuggaugcugaguggagggagccacugagcacagcaaggcac

SEQ ID NO: 361876 - RNA, 64 nt, hsa
ccuggucaccuaggaagccucagauuccuucccauggagggagggagugguuugcagguggcca

SEQ ID NO: 361877 - RNA, 64 nt, hsa
uggucccuuguauccccugcaggcugagugcauuuggagggagugaguggcccuuucggaucca

SEQ ID NO: 361878 - RNA, 64 nt, hsa
ggauuagaagaccaacagguguuucauuugcuuuuggagggaagcugguuacuuuuggccuccc

SEQ ID NO: 361879 - RNA, 64 nt, hsa
gcugacaagguuugaagggcuugguagagaaugcuggagggaaggggcugucucuguuuguggg

SEQ ID NO: 361880 - RNA, 64 nt, hsa
cuagccugcccaugcacuguggcagggguuggauuggagggagagaacagaguugggaaaaaca

SEQ ID NO: 361881 - RNA, 64 nt, hsa
cucccuguggacuugcgucggcacccagaggccuuggagggacaaggcacugggcggugugacu

SEQ ID NO: 361882 - RNA, 64 nt, hsa
gaaucaagagggcagcccccacuuuccuacaaaauggagggagccaucccuucccuguccaccu

SEQ ID NO: 361883 - RNA, 64 nt, hsa
gcccacaauggagugggagaucagccacggagccuggagggaugccacccagcaacacagagcu

SEQ ID NO: 361884 - RNA, 64 nt, hsa
ggagagcugagauuggagggaauuguguugcuccuggagggagcccaggcaucauuaaacaagc

SEQ ID NO: 361885 - RNA, 64 nt, hsa
ugugagcucuagcagggauaaggagagcugagauuggagggaauuguguugcuccuggagggag

SEQ ID NO: 361886 - RNA, 64 nt, hsa
cccaugacuuuggaugacaaacugccuccuggcuuggagggaucuuugggcucauggaugaaug

SEQ ID NO: 361887 - RNA, 64 nt, hsa
ccucuccugagcucuaggcugggauuacacccgcuggagggacacucaccccaucugcucccac

SEQ ID NO: 361888 - RNA, 64 nt, hsa
gcccccaugccuggcccugccugagccagguggguggagggagggagaucaugagggacuugga

SEQ ID NO: 361889 - RNA, 64 nt, hsa
cagguggguggagggagggagaucaugagggacuuggagggagcugggaguucauccacgggag

SEQ ID NO: 361890 - RNA, 64 nt, hsa
uaaauccacccuuaccccuccugacccccccaaguggagggaacagauccuggccugagggguc

SEQ ID NO: 361891 - RNA, 64 nt, hsa
acaugaaauggaucagcacuugaauggggagaaguggagggagaggcccugggccugucccugc

SEQ ID NO: 361892 - RNA, 64 nt, hsa
uggaucuuucuaaaaaucuuguaauguuagaauuuggagggaauuugaagaaaggaacugaggc

SEQ ID NO: 361893 - RNA, 64 nt, hsa
cugugugcugacaggagacccagagagcuagggcuggagggacagggagcagggcagaaaacac

SEQ ID NO: 361894 - RNA, 64 nt, hsa
gccuggguaaccccagccauggaccgucaguggcuggagggagcuucgugucugugcuggagcu

SEQ ID NO: 361895 - RNA, 64 nt, hsa
cuggaguaccccgagaucccagcagcgcacacaguggagggaugaggauggauggguccuaacc

SEQ ID NO: 361896 - RNA, 64 nt, hsa
acgauuggacgugugugguugacugggaugaaguuggagggaggggcagggccuugcaggggau

SEQ ID NO: 361897 - RNA, 64 nt, hsa
ggauguggagaagcucugugugagcggugagggguggagggaugucgcggagaggggaaggggg

SEQ ID NO: 361898 - RNA, 64 nt, hsa
auaugcguggggacauccugggucaucucagucauggagggagacggggaugucacgccguccc

SEQ ID NO: 361899 - RNA, 64 nt, hsa
cacucuucagaggcuaggccccaccucuggggguuggagggacccugugucuuacucgccccuc

SEQ ID NO: 361900 - RNA, 64 nt, hsa
ccuggggccuucgaugggcuuuucuucuugucaguggagggagcagcuccccacucagcccugg

SEQ ID NO: 361901 - RNA, 64 nt, hsa
gguggcacauggguguugggggaguagccuguguuggagggacaccagugcacuaggcagcugg

SEQ ID NO: 361902 - RNA, 64 nt, hsa
aauaacacacuggcccauuaguaagggugaaggcuggagggauuuguugacuucuuggaauuau

SEQ ID NO: 361903 - RNA, 64 nt, hsa
ucuuagaucuugguacauccagacaggaugaggguggagggagagcuauuuaacacaaauccua

SEQ ID NO: 361904 - RNA, 64 nt, hsa
uucuucaucuucucuaagccaagcaauuauuuuauggagggaaaauaaggccagaaacuucuga

SEQ ID NO: 361905 - RNA, 64 nt, hsa
ccuuguaaggggccauagccucuucaggaccaacuggagggagaguuaggaaacaccagcuccu

SEQ ID NO: 361906 - RNA, 64 nt, hsa
aaucccaaggcuggggguggaaggagcagggcucuggagggauucgcauucaaggcacagaauu

SEQ ID NO: 361907 - RNA, 64 nt, hsa
ugacugcuccuggcugacccugagcucucgcaguuggagggaagcagacagacuugacuuuuug

SEQ ID NO: 361908 - RNA, 64 nt, hsa
gacagacuugacuuuuugcaaguccgcguguugcuggagggacacguguauuggagcccagaag

SEQ ID NO: 361909 - RNA, 64 nt, hsa
cccuuaaucugccagaaacuucuagcgucagugcuggagggagaagcugucagggacccagggc

SEQ ID NO: 361910 - RNA, 64 nt, hsa
ucccugacucuucaagugccgguuuugcuucuccuggagggaagcacugccucccuuaaucugc

SEQ ID NO: 361911 - RNA, 64 nt, hsa
agugggccuggggccucucugacguggugccugcuggagggaggcucgucgucaccagcugacu

SEQ ID NO: 361912 - RNA, 64 nt, hsa
uucgccugggacucggcaccuuuccgagugcagcuggagggaucugagcgcaggaagacgcaga

SEQ ID NO: 361913 - RNA, 64 nt, hsa; identical to SEQ ID NO: 125533

SEQ ID NO: 361914 - RNA, 64 nt, hsa; identical to SEQ ID NO: 125534

SEQ ID NO: 361915 - RNA, 64 nt, hsa; identical to SEQ ID NO: 125535

SEQ ID NO: 361916 - RNA, 64 nt, hsa; identical to SEQ ID NO: 125536

SEQ ID NO: 361917 - RNA, 64 nt, hsa; identical to SEQ ID NO: 125537

SEQ ID NO: 361918 - RNA, 64 nt, hsa; identical to SEQ ID NO: 125538

SEQ ID NO: 361919 - RNA, 64 nt, hsa; identical to SEQ ID NO: 125539

SEQ ID NO: 361920 - RNA, 64 nt, hsa; identical to SEQ ID NO: 125540

SEQ ID NO: 361921 - RNA, 64 nt, hsa; identical to SEQ ID NO: 125541

SEQ ID NO: 361922 - RNA, 64 nt, hsa; identical to SEQ ID NO: 125542

SEQ ID NO: 361923 - RNA, 64 nt, hsa; identical to SEQ ID NO: 125543

SEQ ID NO: 361924 - RNA, 64 nt, hsa; identical to SEQ ID NO: 125544

SEQ ID NO: 361925 - RNA, 64 nt, hsa; identical to SEQ ID NO: 125545

SEQ ID NO: 361926 - RNA, 64 nt, hsa; identical to SEQ ID NO: 125546

SEQ ID NO: 361927 - RNA, 64 nt, hsa; identical to SEQ ID NO: 125547

SEQ ID NO: 361928 - RNA, 64 nt, hsa; identical to SEQ ID NO: 125548

SEQ ID NO: 361929 - RNA, 64 nt, hsa; identical to SEQ ID NO: 125549

SEQ ID NO: 361930 - RNA, 64 nt, hsa; identical to SEQ ID NO: 125550

SEQ ID NO: 361931 - RNA, 64 nt, hsa; identical to SEQ ID NO: 125551

SEQ ID NO: 361932 - RNA, 64 nt, hsa; identical to SEQ ID NO: 125552

SEQ ID NO: 361933 - RNA, 64 nt, hsa; identical to SEQ ID NO: 125553

SEQ ID NO: 361934 - RNA, 64 nt, hsa; identical to SEQ ID NO: 125554

SEQ ID NO: 361935 - RNA, 64 nt, hsa; identical to SEQ ID NO: 125555

SEQ ID NO: 361936 - RNA, 64 nt, hsa; identical to SEQ ID NO: 125556

SEQ ID NO: 361937 - RNA, 64 nt, hsa; identical to SEQ ID NO: 125557

SEQ ID NO: 361938 - RNA, 64 nt, hsa; identical to SEQ ID NO: 125558

SEQ ID NO: 361939 - RNA, 64 nt, hsa; identical to SEQ ID NO: 125559

SEQ ID NO: 361940 - RNA, 64 nt, hsa; identical to SEQ ID NO: 125560

SEQ ID NO: 361941 - RNA, 64 nt, hsa; identical to SEQ ID NO: 125561

SEQ ID NO: 361942 - RNA, 64 nt, hsa; identical to SEQ ID NO: 125562

SEQ ID NO: 361943 - RNA, 64 nt, hsa; identical to SEQ ID NO: 125563

SEQ ID NO: 361944 - RNA, 64 nt, hsa; identical to SEQ ID NO: 125564

SEQ ID NO: 361945 - RNA, 64 nt, hsa; identical to SEQ ID NO: 125565

SEQ ID NO: 361946 - RNA, 64 nt, hsa; identical to SEQ ID NO: 125566

SEQ ID NO: 361947 - RNA, 64 nt, hsa; identical to SEQ ID NO: 125567

SEQ ID NO: 361948 - RNA, 64 nt, hsa; identical to SEQ ID NO: 125568

SEQ ID NO: 361949 - RNA, 64 nt, hsa
gagagagaaggacagugcacggagagguuuccagagcacaaauuguugguuccuagcacaaauu

SEQ ID NO: 361950 - RNA, 64 nt, hsa
ggagagguuuccagagcacaaauuguugguuccuagcacaaauuagaugguuuggagcacaaug

SEQ ID NO: 361951 - RNA, 64 nt, hsa
agagagagcgcgggagagagugagagagagugagagcacaaagauaacgcaggagagagagaga

SEQ ID NO: 361952 - RNA, 64 nt, hsa
ccaugagguaaaagagccaaguucaaagaacccuagcacaaauuugcuuugggauuuucuuuuc

SEQ ID NO: 361953 - RNA, 64 nt, hsa
auguaugcgaacauaugugauuuugggguacuaaagcacaaaaaaaucccccauaaaauaaacc

SEQ ID NO: 361954 - RNA, 64 nt, hsa
ccauuuucuguuuuuaaaucuagaagaucuucuaagcacaaauacagcuacaaugaaauauuuu

SEQ ID NO: 361955 - RNA, 64 nt, hsa
ccuaaauaaucauugaugaaguaugucaguuacaagcacaaaagaauauaacugcuuuuauaaa

SEQ ID NO: 361956 - RNA, 64 nt, hsa
aaaaucagcuuuuuaauguagguuaccacuuauaagcacaaaagaaacauguauaagaaaccag

SEQ ID NO: 361957 - RNA, 64 nt, hsa
ccucagcuuccuaucgauuuaguuaccucuugaaagcacaaaaauuaaaacauugccauauguu

SEQ ID NO: 361958 - RNA, 64 nt, hsa
aaguauauucugaauacauuauuuccauucauuuagcacaaauaaaucauuugguuucacuuug

SEQ ID NO: 361959 - RNA, 64 nt, hsa
agacggagaccccgguggcaguggaaaaaucagaagcacaaaggaaaacucuuggccucugcuu

SEQ ID NO: 361960 - RNA, 64 nt, hsa
caaaggaaaacucuuggccucugcuuucuccuguagcacaaagagggaguuggcuggaucuuuu

SEQ ID NO: 361961 - RNA, 64 nt, hsa
gcugggauagccauuuccauggcucuguuaugcaagcacaaauuucaucuccuagauggacuuc

SEQ ID NO: 361962 - RNA, 64 nt, hsa
uccucucccaggaccaggaguuuaugaccaggcgagcacaaauggcuaaaagccaagcuguccu

SEQ ID NO: 361963 - RNA, 64 nt, hsa
gcagccaggagggcucuugggauuuccuuuccaaagcacaaaaauacugggacccaagaagaac

SEQ ID NO: 361964 - RNA, 64 nt, hsa
gaauggcuugucccaucagcagaugaauguguuaagcacaaagcaucuuccuuaaagcacaaag

SEQ ID NO: 361965 - RNA, 64 nt, hsa
gaugaauguguuaagcacaaagcaucuuccuuaaagcacaaagagagggacuaacugaugcugc

SEQ ID NO: 361966 - RNA, 64 nt, hsa
auuuauaacaccugcuuuagccuuuguuuucaaaagcacaaaggaaaagugaaagggaaagaga

SEQ ID NO: 361967 - RNA, 64 nt, hsa
ugucagcucaguggcagcauuagauucucauaggagcacaaauccuauugugaacucugcaugc

SEQ ID NO: 361968 - RNA, 64 nt, hsa
ucgccucuggaucugcugcauccaggacugugccagcacaaagugggagcccgauaaauauuua

SEQ ID NO: 361969 - RNA, 64 nt, hsa
ccuguaguccagucucuccagcaucaauuccaucagcacaaagacauaauuuaauuccuucuac

SEQ ID NO: 361970 - RNA, 64 nt, hsa
uucuuauuuuguuugaauuguuaauucacagaauagcacaaacuacaauuaaaacuaagcacaa

SEQ ID NO: 361971 - RNA, 64 nt, hsa
auucacagaauagcacaaacuacaauuaaaacuaagcacaaagccauucuaagucauuggggaa

SEQ ID NO: 361972 - RNA, 64 nt, hsa; identical to SEQ ID NO: 183967

SEQ ID NO: 361973 - RNA, 64 nt, hsa; identical to SEQ ID NO: 183968

SEQ ID NO: 361974 - RNA, 64 nt, hsa
cucacccugcuugaagcgcagaaggcacagccuuacugaccagcacgcccacugacuggcaucu

SEQ ID NO: 361975 - RNA, 64 nt, hsa
guuucuaaagcagagucggccucagaagccaaaaacugaccagaagauggugcucaaaccuuua

SEQ ID NO: 361976 - RNA, 64 nt, hsa
agacgggacccccugcagcuucccugaccacgccacugaccagcuaucuggggaaguuuacugu

SEQ ID NO: 361977 - RNA, 64 nt, hsa
gccacucuugggacuuugguccacguccugagccacugaccacggccagucucucuuuuuauau

SEQ ID NO: 361978 - RNA, 64 nt, hsa
ugcucgugccgcuggcugcccgcauguggcugccacugaccacucaguuguuaucuguguccgu

SEQ ID NO: 361979 - RNA, 64 nt, hsa
gggccuccccaaagccugggccuuuguggcugccacugaccaaagggaccuugcucgugccgcu

SEQ ID NO: 361980 - RNA, 64 nt, hsa
cuuuuaugguuccagccgagcguuccugaaaugaacugaccauuaacagcgccucuuugauagg

SEQ ID NO: 361981 - RNA, 64 nt, hsa
cagaaaacacagugccaguaagguucuacauaccacugaccaucugcuuaauagacauguauuu

SEQ ID NO: 361982 - RNA, 64 nt, hsa
gcuggacuucagaccucagggauccuuuugaugcacugaccaggaauugugauaauccuuuuca

SEQ ID NO: 361983 - RNA, 64 nt, hsa
uaaaaugacacaaggccaaaaacaaauggguuuaacugaccagagcgagagaacucugcacuau

SEQ ID NO: 361984 - RNA, 64 nt, hsa
ucucaggcauuguggccagcucugccucucuaaaacugaccagaaaaaucucucucaucgagua

SEQ ID NO: 361985 - RNA, 64 nt, hsa
auuauagagaaguaauagaccuaucagaaccugcacugaccaacaaauaaacacauguugccaa

SEQ ID NO: 361986 - RNA, 64 nt, hsa
aacuaaguacuggguaaacucuccucccgaaacuacugaccacccacaguucuacuaacuauau

SEQ ID NO: 361987 - RNA, 64 nt, hsa
gaaugaaguauauaaguuaaggaaaaaauacaaaacugaccaugaccauuguugguugaauauu

SEQ ID NO: 361988 - RNA, 64 nt, hsa
caauuguacuucacuaugccauauguauguauucacugaccaaaaauucacugaccaaccaacc

SEQ ID NO: 361989 - RNA, 64 nt, hsa
augccauauguauguauucacugaccaaaaauucacugaccaaccaaccaaacuccacacuuca

SEQ ID NO: 361990 - RNA, 64 nt, hsa
gcggaagccaaaggcagcuaagauagaaagcuggacugaccaaagacugcagaacccccaggug

SEQ ID NO: 361991 - RNA, 64 nt, hsa
ggcuucauuccggacuggcagaagcauugccuggacugaccacaccaaccaggccuucauccuc

SEQ ID NO: 361992 - RNA, 64 nt, hsa
uacaagaugauuauacaggguugcagauugggugacugaccagacuuguugggguccugggaug

SEQ ID NO: 361993 - RNA, 64 nt, hsa
uuuuuaguuuucaguguucagguuauagaauauaacugaccauaaaaauuaccugcagguauuu

SEQ ID NO: 361994 - RNA, 64 nt, hsa
uaaccacauccacucucaaccccguccccuucgcacugaccacacccaccccguucggccccgc

SEQ ID NO: 361995 - RNA, 64 nt, hsa
ccucccccucgccgcucgaccccgcccucaccacacugaccacccucaacccauugcgcccagu

SEQ ID NO: 361996 - RNA, 64 nt, hsa
cacacccucacuggcucggcccugcccccaguauacugaccauuccccagccacuucccuuccg

SEQ ID NO: 361997 - RNA, 64 nt, hsa
cugggacuguagcccguccaaguugacacauaaaacugaccaucgggccgggggcgguggcuca

SEQ ID NO: 361998 - RNA, 64 nt, hsa
acagggcaagacucugucucaaaaaaaauaaaaaacugaccaucuaguccuugucaucugggca

SEQ ID NO: 361999 - RNA, 64 nt, hsa
cauggcauaauugaaauacuguuauuuguaaagaguucuauacugccuaccuuagcuaaccaga

SEQ ID NO: 362000 - RNA, 64 nt, hsa
cuugaauguauacuguagauuuuuaacaaagcgaguucuauauuuauuauguuuagugugguuu

SEQ ID NO: 362001 - RNA, 64 nt, hsa
ggauugucuugugcuuuggggauuuuuguucggaguucuauacuaucagcccagaaagcuauca

SEQ ID NO: 362002 - RNA, 64 nt, hsa
ucuauuaacaugaucuucagaaucucuaguuuuuguucuauagauaaagccauaagaauccuuu

SEQ ID NO: 362003 - RNA, 64 nt, hsa
caaacauaaaaaucccuuuaauuguaguguaguuguucuauaaaccauauuuuuucaugaugug

SEQ ID NO: 362004 - RNA, 64 nt, hsa
aguuauuagaaaugagucacggcacuaacucaugguucuauacucauuuuaagaaauuguaaag

SEQ ID NO: 362005 - RNA, 64 nt, hsa
auauucuuauauguagagcaauaaugcaaaagcuguucuauaugcaaacaugaugucuuuauua

SEQ ID NO: 362006 - RNA, 64 nt, hsa
uaauuuccaaaauauaagcuguuuucauuagccaguucuauaauaucuuccugugauuuaugua

SEQ ID NO: 362007 - RNA, 64 nt, hsa
auuaagagauaauguaagaaaauacauuuuuuugguucuauauaaugcuucaugauucauuuag

SEQ ID NO: 362008 - RNA, 64 nt, hsa
cagaauaguuauauuugaaguagcccuggcccuaguucuauagggcuuggcuauuuaauauuuu

SEQ ID NO: 362009 - RNA, 64 nt, hsa; identical to SEQ ID NO: 143712

SEQ ID NO: 362010 - RNA, 64 nt, hsa; identical to SEQ ID NO: 143713

SEQ ID NO: 362011 - RNA, 64 nt, hsa; identical to SEQ ID NO: 143714

SEQ ID NO: 362012 - RNA, 64 nt, hsa; identical to SEQ ID NO: 143715

SEQ ID NO: 362013 - RNA, 64 nt, hsa; identical to SEQ ID NO: 143716

SEQ ID NO: 362014 - RNA, 64 nt, hsa; identical to SEQ ID NO: 143717

SEQ ID NO: 362015 - RNA, 64 nt, hsa; identical to SEQ ID NO: 143718

SEQ ID NO: 362016 - RNA, 64 nt, hsa; identical to SEQ ID NO: 143719

SEQ ID NO: 362017 - RNA, 64 nt, hsa; identical to SEQ ID NO: 143720

SEQ ID NO: 362018 - RNA, 64 nt, hsa; identical to SEQ ID NO: 143721

SEQ ID NO: 362019 - RNA, 64 nt, hsa; identical to SEQ ID NO: 143722

SEQ ID NO: 362020 - RNA, 64 nt, hsa; identical to SEQ ID NO: 143723

SEQ ID NO: 362021 - RNA, 64 nt, hsa; identical to SEQ ID NO: 143724

SEQ ID NO: 362022 - RNA, 64 nt, hsa; identical to SEQ ID NO: 143725

SEQ ID NO: 362023 - RNA, 64 nt, hsa; identical to SEQ ID NO: 143726

SEQ ID NO: 362024 - RNA, 64 nt, hsa; identical to SEQ ID NO: 143727

SEQ ID NO: 362025 - RNA, 64 nt, hsa; identical to SEQ ID NO: 143728

SEQ ID NO: 362026 - RNA, 64 nt, hsa; identical to SEQ ID NO: 143729

SEQ ID NO: 362027 - RNA, 64 nt, hsa; identical to SEQ ID NO: 143730

SEQ ID NO: 362028 - RNA, 64 nt, hsa; identical to SEQ ID NO: 143731

SEQ ID NO: 362029 - RNA, 64 nt, hsa; identical to SEQ ID NO: 143732

SEQ ID NO: 362030 - RNA, 64 nt, hsa; identical to SEQ ID NO: 143733

SEQ ID NO: 362031 - RNA, 64 nt, hsa; identical to SEQ ID NO: 143734

SEQ ID NO: 362032 - RNA, 64 nt, hsa; identical to SEQ ID NO: 143735

SEQ ID NO: 362033 - RNA, 64 nt, hsa; identical to SEQ ID NO: 143736

SEQ ID NO: 362034 - RNA, 64 nt, hsa; identical to SEQ ID NO: 143737

SEQ ID NO: 362035 - RNA, 64 nt, hsa; identical to SEQ ID NO: 143738

SEQ ID NO: 362036 - RNA, 64 nt, hsa; identical to SEQ ID NO: 143739

SEQ ID NO: 362037 - RNA, 64 nt, hsa; identical to SEQ ID NO: 143740

SEQ ID NO: 362038 - RNA, 64 nt, hsa; identical to SEQ ID NO: 143741

SEQ ID NO: 362039 - RNA, 64 nt, hsa; identical to SEQ ID NO: 143742

SEQ ID NO: 362040 - RNA, 64 nt, hsa; identical to SEQ ID NO: 143743

SEQ ID NO: 362041 - RNA, 64 nt, hsa; identical to SEQ ID NO: 143744

SEQ ID NO: 362042 - RNA, 64 nt, hsa; identical to SEQ ID NO: 143745

SEQ ID NO: 362043 - RNA, 64 nt, hsa; identical to SEQ ID NO: 143746

SEQ ID NO: 362044 - RNA, 64 nt, hsa; identical to SEQ ID NO: 143747

SEQ ID NO: 362045 - RNA, 64 nt, hsa; identical to SEQ ID NO: 143748

SEQ ID NO: 362046 - RNA, 64 nt, hsa; identical to SEQ ID NO: 143749

SEQ ID NO: 362047 - RNA, 64 nt, hsa; identical to SEQ ID NO: 143750

SEQ ID NO: 362048 - RNA, 64 nt, hsa; identical to SEQ ID NO: 143751

SEQ ID NO: 362049 - RNA, 64 nt, hsa; identical to SEQ ID NO: 143752

SEQ ID NO: 362050 - RNA, 64 nt, hsa; identical to SEQ ID NO: 143753

SEQ ID NO: 362051 - RNA, 64 nt, hsa; identical to SEQ ID NO: 143754

SEQ ID NO: 362052 - RNA, 64 nt, hsa; identical to SEQ ID NO: 143755

SEQ ID NO: 362053 - RNA, 64 nt, hsa; identical to SEQ ID NO: 143756

SEQ ID NO: 362054 - RNA, 64 nt, hsa; identical to SEQ ID NO: 143757

SEQ ID NO: 362055 - RNA, 64 nt, hsa; identical to SEQ ID NO: 143758

SEQ ID NO: 362056 - RNA, 64 nt, hsa; identical to SEQ ID NO: 143759

SEQ ID NO: 362057 - RNA, 64 nt, hsa; identical to SEQ ID NO: 143760

SEQ ID NO: 362058 - RNA, 64 nt, hsa; identical to SEQ ID NO: 143761

SEQ ID NO: 362059 - RNA, 64 nt, hsa; identical to SEQ ID NO: 143762

SEQ ID NO: 362060 - RNA, 64 nt, hsa; identical to SEQ ID NO: 143763

SEQ ID NO: 362061 - RNA, 64 nt, hsa; identical to SEQ ID NO: 143764

SEQ ID NO: 362062 - RNA, 64 nt, hsa; identical to SEQ ID NO: 143765

SEQ ID NO: 362063 - RNA, 64 nt, hsa; identical to SEQ ID NO: 143766

SEQ ID NO: 362064 - RNA, 64 nt, hsa; identical to SEQ ID NO: 143767

SEQ ID NO: 362065 - RNA, 64 nt, hsa; identical to SEQ ID NO: 143768

SEQ ID NO: 362066 - RNA, 64 nt, hsa; identical to SEQ ID NO: 143769

SEQ ID NO: 362067 - RNA, 64 nt, hsa; identical to SEQ ID NO: 143770

SEQ ID NO: 362068 - RNA, 64 nt, hsa; identical to SEQ ID NO: 143771

SEQ ID NO: 362069 - RNA, 64 nt, hsa; identical to SEQ ID NO: 143772

SEQ ID NO: 362070 - RNA, 64 nt, hsa; identical to SEQ ID NO: 143773

SEQ ID NO: 362071 - RNA, 64 nt, hsa; identical to SEQ ID NO: 143774

SEQ ID NO: 362072 - RNA, 64 nt, hsa; identical to SEQ ID NO: 143775

SEQ ID NO: 362073 - RNA, 64 nt, hsa; identical to SEQ ID NO: 143776

SEQ ID NO: 362074 - RNA, 64 nt, hsa; identical to SEQ ID NO: 143777

SEQ ID NO: 362075 - RNA, 64 nt, hsa; identical to SEQ ID NO: 143778

SEQ ID NO: 362076 - RNA, 64 nt, hsa; identical to SEQ ID NO: 143779

SEQ ID NO: 362077 - RNA, 64 nt, hsa; identical to SEQ ID NO: 143780

SEQ ID NO: 362078 - RNA, 64 nt, hsa; identical to SEQ ID NO: 143781

SEQ ID NO: 362079 - RNA, 64 nt, hsa; identical to SEQ ID NO: 143782

SEQ ID NO: 362080 - RNA, 64 nt, hsa; identical to SEQ ID NO: 143783

SEQ ID NO: 362081 - RNA, 64 nt, hsa; identical to SEQ ID NO: 143784

SEQ ID NO: 362082 - RNA, 64 nt, hsa; identical to SEQ ID NO: 143785

SEQ ID NO: 362083 - RNA, 64 nt, hsa; identical to SEQ ID NO: 143786

SEQ ID NO: 362084 - RNA, 64 nt, hsa; identical to SEQ ID NO: 143787

SEQ ID NO: 362085 - RNA, 64 nt, hsa; identical to SEQ ID NO: 143788

SEQ ID NO: 362086 - RNA, 64 nt, hsa; identical to SEQ ID NO: 143789

SEQ ID NO: 362087 - RNA, 57 nt, hsa; identical to SEQ ID NO: 143790

SEQ ID NO: 362088 - RNA, 64 nt, hsa; identical to SEQ ID NO: 143791

SEQ ID NO: 362089 - RNA, 64 nt, hsa; identical to SEQ ID NO: 143792

SEQ ID NO: 362090 - RNA, 64 nt, hsa; identical to SEQ ID NO: 143793

SEQ ID NO: 362091 - RNA, 64 nt, hsa; identical to SEQ ID NO: 143794

SEQ ID NO: 362092 - RNA, 64 nt, hsa; identical to SEQ ID NO: 143795

SEQ ID NO: 362093 - RNA, 64 nt, hsa; identical to SEQ ID NO: 143796

SEQ ID NO: 362094 - RNA, 64 nt, hsa; identical to SEQ ID NO: 143797

SEQ ID NO: 362095 - RNA, 64 nt, hsa; identical to SEQ ID NO: 143798

SEQ ID NO: 362096 - RNA, 64 nt, hsa; identical to SEQ ID NO: 143799

SEQ ID NO: 362097 - RNA, 64 nt, hsa; identical to SEQ ID NO: 143800

SEQ ID NO: 362098 - RNA, 64 nt, hsa; identical to SEQ ID NO: 143801

SEQ ID NO: 362099 - RNA, 64 nt, hsa; identical to SEQ ID NO: 143802

SEQ ID NO: 362100 - RNA, 64 nt, hsa; identical to SEQ ID NO: 143803

SEQ ID NO: 362101 - RNA, 64 nt, hsa; identical to SEQ ID NO: 143804

SEQ ID NO: 362102 - RNA, 64 nt, hsa; identical to SEQ ID NO: 143805

SEQ ID NO: 362103 - RNA, 64 nt, hsa; identical to SEQ ID NO: 143806

SEQ ID NO: 362104 - RNA, 64 nt, hsa; identical to SEQ ID NO: 143807

SEQ ID NO: 362105 - RNA, 64 nt, hsa; identical to SEQ ID NO: 143808

SEQ ID NO: 362106 - RNA, 64 nt, hsa; identical to SEQ ID NO: 143809

SEQ ID NO: 362107 - RNA, 64 nt, hsa; identical to SEQ ID NO: 143810

SEQ ID NO: 362108 - RNA, 64 nt, hsa; identical to SEQ ID NO: 143811

SEQ ID NO: 362109 - RNA, 64 nt, hsa; identical to SEQ ID NO: 143812

SEQ ID NO: 362110 - RNA, 64 nt, hsa
ugaaaaguagaaaaaugucacguuuccauaucuccugcuggaaaucagaaaauauaauaaaauu

SEQ ID NO: 362111 - RNA, 64 nt, hsa
aucauugaaucaauggaucuguugaagaacucagcugcuggaaaccaugcaaaauguuuugaau

SEQ ID NO: 362112 - RNA, 64 nt, hsa
ccucagaaacugcagcagccacgcacacagaagccugcuggaagacaggucucucuccguccac

SEQ ID NO: 362113 - RNA, 64 nt, hsa
auaauuuuacauaagaucugccuuccacacuucccugcuggaaggcauucucagagcuuuaugu

SEQ ID NO: 362114 - RNA, 64 nt, hsa
cgggccuuuccugcccucuguggucaucugccaccugcuggaucaagugcuuucucuuuuacac

SEQ ID NO: 362115 - RNA, 64 nt, hsa
gcgccauuccugguugucuguugaaucuuucuggcugcuggaauuggagauaggauguuuugcu

SEQ ID NO: 362116 - RNA, 64 nt, hsa
ggagauucaggagcagcaaugggucucaccauagcugcuggaaucacaccugagaacugagaua

SEQ ID NO: 362117 - RNA, 64 nt, hsa
cacgaugcuguccucgugcgauugcccucuccugcugcuggacuucugccuuuguuggccugau

SEQ ID NO: 362118 - RNA, 64 nt, hsa
ccccauccgcccucuggaccuguguagggccucacugcuggagcggggaaaccgcagcucagcc

SEQ ID NO: 362119 - RNA, 64 nt, hsa
cccuucgccucccagccccucaagacaccgcuggcugcuggacacccucuucacuugugugugu

SEQ ID NO: 362120 - RNA, 64 nt, hsa
ccuggcugggaguggcauguaugacgugacuggccugcuggauguggagggggcgcgugcaggc

SEQ ID NO: 362121 - RNA, 64 nt, hsa
cgggguuugccaugcuggccaggcuggucucgaacugcuggauucaagugauccgcccaucucc

SEQ ID NO: 362122 - RNA, 64 nt, hsa
cuccuuccaggccuacccuacugcccgcugcguccugcuggaggugcaagugccugcugcccuu

SEQ ID NO: 362123 - RNA, 64 nt, hsa
cgcccgacugcaacugcugacccugcagagcuggcugcuggacgcaccgugcucgcugcccgca

SEQ ID NO: 362124 - RNA, 64 nt, hsa
caguggcucacuuugggaggcugaggcaggaaggcugcuggaaacugagaguucaagaccagcc

SEQ ID NO: 362125 - RNA, 64 nt, hsa
caaauagaagccuuagaugcuauaguuccuucugcugcuggauucucaggcuaacauccuggag

SEQ ID NO: 362126 - RNA, 64 nt, hsa
caaauugcgcccauuuagaggauguggcuguaaccugcuggaugggacuccauagcuccuuccc

SEQ ID NO: 362127 - RNA, 64 nt, hsa
ugggccuuggcugggccucugguucugacacuuucugcuggaagcugucaggcugggacaggcu

SEQ ID NO: 362128 - RNA, 64 nt, hsa
acugaccucacagacugaccauuccaucccacagcugcuggacauagagugauuugcagccccu

SEQ ID NO: 362129 - RNA, 64 nt, hsa
ccucugugagugaccauccaggcagucaccauaacugcuggagugucugggauugguagcucuc

SEQ ID NO: 362130 - RNA, 64 nt, hsa
caccacgcgcucuacggaggcuucuccauugucccugcuggagauugggucccucggucucccu

SEQ ID NO: 362131 - RNA, 64 nt, hsa
gggccuccccuacaucgcugcugucguccacgcccugcuggaccggccuuaggggugaaggugg

SEQ ID NO: 362132 - RNA, 64 nt, hsa
aagacagggacaaacaacucaagugucuuaacagcugcuggagugggauccuuguuaucucuua

SEQ ID NO: 362133 - RNA, 64 nt, hsa
gauucuuguuuuaguaaucauucuauaaaugauacugcuggauugauugccguggguugauagc

SEQ ID NO: 362134 - RNA, 64 nt, hsa
gugcuuguguuggcaacacagcgugugcauggggcugcuggaggagagcauuccagagcaguac

SEQ ID NO: 362135 - RNA, 64 nt, hsa
gcagaaggguccgaugugccaagugaucaugauucugcuggaaagaggauuuuaaauauugugg

SEQ ID NO: 362136 - RNA, 64 nt, hsa
cacgaucgagggccuggccucgcuguugguggcccugcuggagaagaccacgugggucgaccgu

SEQ ID NO: 362137 - RNA, 64 nt, hsa
gccgcuggaggagaccgacuggucgcacucgcagcugcuggacuugggccccaucgacgcgcuc

SEQ ID NO: 362138 - RNA, 64 nt, hsa
ugggacggaagccaagccauuauggcagaugaaccugcuggauuuguaaauaauuuaaaauccu

SEQ ID NO: 362139 - RNA, 64 nt, hsa
cagccucccaaaaggacagagaacuaaaaaauugcugcuggagaaggugaaagucgcuuuggga

SEQ ID NO: 362140 - RNA, 64 nt, hsa
gugggucucagucugcuugaauggugaugagauucugcuggaucucagcacgcugcaggugucu

SEQ ID NO: 362141 - RNA, 64 nt, hsa
uuucagauucaguuagcaaaccuugaugaagcaccugcuggacacugagggacccaaagcucaa

SEQ ID NO: 362142 - RNA, 64 nt, hsa
uggggacccugcacccuccgggaagccauggagucugcuggaggcaccauaucagccugcggga

SEQ ID NO: 362143 - RNA, 64 nt, hsa
gccacugcuagggguaccccagcugcugccacuccugcuggagggugaacuggggacccugcac

SEQ ID NO: 362144 - RNA, 64 nt, hsa
cagacuggcauugcucggguaccacuugcuggagcugcuggaggcccugggguugguagggcag

SEQ ID NO: 362145 - RNA, 64 nt, hsa
ggaguaccagcuggugugccaauuccccaggccccugcuggauuggcaggcccuguccgaggag

SEQ ID NO: 362146 - RNA, 64 nt, hsa
gcuggcucaggacaaggaggagaugaaggugaagcugcuggagcugguguugcagcuugugggc

SEQ ID NO: 362147 - RNA, 64 nt, hsa
gcaagaggagaggaugcuggagcaagaggagaggcugcuggagcuugaguggaaagccgagccu

SEQ ID NO: 362148 - RNA, 64 nt, hsa
caggacucugcccagaccacacguagcccccaggcugcuggacacgucggacagcgaaguaucc

SEQ ID NO: 362149 - RNA, 64 nt, hsa
aagugggacuucccgucgccugcgagccugcggccugcuggagccugcgcagcuuggauggaga

SEQ ID NO: 362150 - RNA, 64 nt, hsa
agaugcuacaaaaccucaugccuacugucugccacugcuggagaaggaaucaugguuucuagaa

SEQ ID NO: 362151 - RNA, 64 nt, hsa
uugguggauccauguauguguccagcacagcggccugcuggacucugagaacugggaaagauca

SEQ ID NO: 362152 - RNA, 64 nt, hsa
agggacggaaugccuggucuugagcaaccucccacugcuggagugcgagugggaaucagagccu

SEQ ID NO: 362153 - RNA, 64 nt, hsa
guaggcucagaaaugaagggaaccccucagugggcugcuggacccaucuuucccaagccuugcc

SEQ ID NO: 362154 - RNA, 64 nt, hsa
accugcuggggaccucaccugcuggggaccuuggcugcuggaggcugcaccuacugaggauguc

SEQ ID NO: 362155 - RNA, 64 nt, hsa
ggcugccgggaaccucaucugccuggggccucaccugcuggaguccuuuguggccaacccucuc

SEQ ID NO: 362156 - RNA, 64 nt, hsa
caguggcacagcaaguggauccuggcaacugcagcugcuggauuccagauucuggguccccaau

SEQ ID NO: 362157 - RNA, 64 nt, hsa
ccccaugccucgagcccuggaucuccaagcucagcugcuggauucuggaugucaacaaaccuca

SEQ ID NO: 362158 - RNA, 64 nt, hsa
gaccaguuuuggccagaagggcccagccuggguucugcuggaagcugauguggaaggcuucccu

SEQ ID NO: 362159 - RNA, 64 nt, hsa
ugugucuugcaggagcuccuuugcauguucuaaacugcuggaggccuuugccagaguuaaauca

SEQ ID NO: 362160 - RNA, 64 nt, hsa
gccagcugcccuaugggccugccgggcugagggccugcuggaggccucaggugcuguccauggg

SEQ ID NO: 362161 - RNA, 64 nt, hsa
ucccagggcaaggguuaaggccugaaucaugagccugcuggaagcccagccccuacugcuguga

SEQ ID NO: 362162 - RNA, 64 nt, hsa
accucugauucaaaacuuauuagaacaguagcuucugcuggaauuugcaaucacugaagucaua

SEQ ID NO: 362163 - RNA, 64 nt, hsa
uuuauuuuguuugcugucugucuccccugccccacugcuggaacagaggcuccaagaaaacagg

SEQ ID NO: 362164 - RNA, 64 nt, hsa
auuuuauuucacuuguguuuugucuuaaacccuacugcuggaaacaauuuuauguaauaagcaa

SEQ ID NO: 362165 - RNA, 64 nt, hsa
aguuccgguaguggccaucuuacauucucauguccugcuggaagugccuaguugccugcaaagc

SEQ ID NO: 362166 - RNA, 64 nt, hsa
cagcauuuggccaagcucggaggcuuggccagcacugcuggauggcucagagcaagcugggcuc

SEQ ID NO: 362167 - RNA, 64 nt, hsa
cgcccagcgcuuuggaaaccacauccgcaaagcccugcuggacauugcugaucuuuuccaaguu

SEQ ID NO: 362168 - RNA, 64 nt, hsa
ggaccugcccccaacuggccucccugagaugaaccugcuggagauguacagccugaaggaugag

SEQ ID NO: 362169 - RNA, 64 nt, hsa
cgcugaugaccucuucuucuguuaccgcuggcugcugcuggaacucaagcgugaguucgccuuc

SEQ ID NO: 362170 - RNA, 64 nt, hsa
gaacccauucaugcuguuccucugccuggccauccugcuggagcaccgcgaccacaucaugcgc

SEQ ID NO: 362171 - RNA, 64 nt, hsa
aagucccuccugauuuugugugugugugucuguguuuaagcaagcguucgguugguauaguuuu

SEQ ID NO: 362172 - RNA, 64 nt, hsa
uaauauugcaguuggaauucuugcuguauuauuuuuuaagcaaguguuaggugcauuuaacugc

SEQ ID NO: 362173 - RNA, 64 nt, hsa
ccauacaucaguuauucauucugugaucauuuauuuuaagcacucuuaaagcaaaaaaugaaug

SEQ ID NO: 362174 - RNA, 64 nt, hsa
cuauuuaaacuuauaaaucauauugaugaaaagauuuaagcacaaacuuuaggguaaaaauugc

SEQ ID NO: 362175 - RNA, 64 nt, hsa
caagauugguucugauucuuuuggaaaaugacaguuuaagcacuugguuccucaguuggauaac

SEQ ID NO: 362176 - RNA, 64 nt, hsa
caaugaagaaaaggccuucuggagauuucuguuuuuuaagcacauucuccuuccauccacauau

SEQ ID NO: 362177 - RNA, 64 nt, hsa
gauucugaugccacugaaguuugaggagcauugguuuaagcaagauuaccuacggagaggcugu

SEQ ID NO: 362178 - RNA, 64 nt, hsa
uuuguaauccuaugcauuuuacgcauuaaaacauuuuaagcauuuaaaacguagguaucauuag

SEQ ID NO: 362179 - RNA, 64 nt, hsa
uagcaaucagcuuuuauuugccuuaauauaagcuuuuaagcaguuaucuaacuaguguccacaa

SEQ ID NO: 362180 - RNA, 64 nt, hsa
ugauuuuccuuuacauucuuaucaugaacacuauuuuaagcaucaaaugcaaucaucuaaaaua

SEQ ID NO: 362181 - RNA, 64 nt, hsa
uuuuuacauuuauuuuagucuuuauauuuuuauuuuuaagcauugauguacuuaguuguugaaa

SEQ ID NO: 362182 - RNA, 64 nt, hsa
aacaaugccaggauccaaacugauuaaguuacaguuuaagcacccuucaguauuaauauauacg

SEQ ID NO: 362183 - RNA, 64 nt, hsa
ucaaaacaaaauaauacaaaaaaugcuuuuagaguuuaagcaaugguugaaauuuguagguacu

SEQ ID NO: 362184 - RNA, 64 nt, hsa
gaaaggggcaaagagaaccuauuauuugccaguuuuuaagcagagcucaaucuaugccagcucu

SEQ ID NO: 362185 - RNA, 64 nt, hsa
caaaauauuuuaucagcuguuauuggaaagugauuuuaagcaauugcuuccucagugucagggc

SEQ ID NO: 362186 - RNA, 64 nt, hsa
ugcuauuuuggcaacagcacagaaaacuaauauuuuuaagcagagaaucuuggcaaugagugag

SEQ ID NO: 362187 - RNA, 64 nt, hsa
gucucuguguacagaauacauacuuauucccauuuuuaagcauuugcuucuguuuucccuaccu

SEQ ID NO: 362188 - RNA, 64 nt, hsa
uaaccuuguaucucauuuugaaggaauuuaauauuuuaagcaaggauguucaaaaucuuacaua

SEQ ID NO: 362189 - RNA, 64 nt, hsa
uagagcagcacuuuguuauguggaagacagguuuuuuaagcaaccuuugaauccagcucuaguc

SEQ ID NO: 362190 - RNA, 64 nt, hsa
accacucagguaagaacacucacucauggcaguuuuuaagcaugaaaauuguuuucugaaagua

SEQ ID NO: 362191 - RNA, 64 nt, hsa
uuuuccuuuuuuguuuuuuuuguuuuguuuuguuuuuaagcaaagaugaagggaaaacgaacua

SEQ ID NO: 362192 - RNA, 64 nt, hsa
uagauugcaaacuggaaauguaaaacucaugaaauuuaagcaauauagguuuagcuaucugugu

SEQ ID NO: 362193 - RNA, 64 nt, hsa
ucucauucugacuucauggagaauuaaucccaccuuuaagcaaaggcuacuaaguuaaugguau

SEQ ID NO: 362194 - RNA, 64 nt, hsa
uaagcuccugaaucugcauuccacuuggguuguuuuuaagcauucuaaauuuuaguugauuaua

SEQ ID NO: 362195 - RNA, 64 nt, hsa
agcgaaagcagagcauguuauuuauauaacugcauuuaagcaguaccaagacugaaaaaaaagg

SEQ ID NO: 362196 - RNA, 64 nt, hsa
auuuuaaaaauauuuuuuaucuauuuacuguguguuuaagcaagcaacagugcacugaucuggu

SEQ ID NO: 362197 - RNA, 64 nt, hsa
gcauucugaauggaacauuccggcucuucaauuuuuuaagcaauuuagacuguagcaagaaaau

SEQ ID NO: 362198 - RNA, 64 nt, hsa
agagcacagucccugcuuuugacuggguuccuauuuuaagcacaaaugagagcucuggagccag

SEQ ID NO: 362199 - RNA, 64 nt, hsa
uuggcugcuagauccugguguuucuauguucuuuuuuaagcaccaaaaagaagauggggaagaa

SEQ ID NO: 362200 - RNA, 64 nt, hsa
aauauauaauuuuuuacaaauguaaaauuuuacauuuaagcauuuguaaaguuacagcaaaaga

SEQ ID NO: 362201 - RNA, 64 nt, hsa
acauuguuuaaaacagaauguuaaaacacuguuguuuaagcauguuuaaaucaagguauuccaa

SEQ ID NO: 362202 - RNA, 64 nt, hsa
ucaaagacuggauuaaaaaaaaguuaagccaaaauuuaagcaguuuuuauaaugaauuaaauua

SEQ ID NO: 362203 - RNA, 64 nt, hsa
gagcccagaccucuacaaacguuguauguccuuuuuuaagcagaaauaaaaugguugaggaugu

SEQ ID NO: 362204 - RNA, 64 nt, hsa
uauucauuguuucuuaucaguuuaaaaggauuccuuuaagcaugucagaugaaaagcaauuagg

SEQ ID NO: 362205 - RNA, 64 nt, hsa
ucucaacaccuuccuuaagucuuugcugucauaauuuaagcauuugaguauauuuugaagucuu

SEQ ID NO: 362206 - RNA, 64 nt, hsa
gagaaaaaccaaggaagauaaaacaaguugcauuuuuaagcacguuucucugcuaagacaagau

SEQ ID NO: 362207 - RNA, 64 nt, hsa
auacuauguucaugauagugugauuuuuuucacauuuaagcaggaaugcaauauaaaaauguga

SEQ ID NO: 362208 - RNA, 64 nt, hsa
cuuuauauauugauuauauauuguugacaacugguuuaagcaucauagccuaugaugauaaaca

SEQ ID NO: 362209 - RNA, 64 nt, hsa
cucccugggguauccacaggaauggacauucaaaugguuguagccuggugggguagaaggcaga

SEQ ID NO: 362210 - RNA, 64 nt, hsa
ucuauguaagguguuaauguguguguaugugcuuugguuguaggaaaacuugaaaauuccaaaa

SEQ ID NO: 362211 - RNA, 64 nt, hsa
uugacuaaagccauuugucuguguuuucuucuugugguuguauauaucagguaaaauauuuucc

SEQ ID NO: 362212 - RNA, 64 nt, hsa
ucagcucacugguuuacaaauauagguugucuugugguuguaggagcccacuguaacaauacug

SEQ ID NO: 362213 - RNA, 64 nt, hsa
aauuguguggagaacucagugccacaccucgaacugguuguagugggaagucccgcgaaacccg

SEQ ID NO: 362214 - RNA, 64 nt, hsa
uuuugcucuagggcccuuucuugcacuguccagcugguuguacccucuccaggcauuuauucaa

SEQ ID NO: 362215 - RNA, 64 nt, hsa
gaacacugacuuuauuaagcauuuucagauguggugguuguauuuuugccccaagaaguguuug

SEQ ID NO: 362216 - RNA, 64 nt, hsa
ugaauaugugaaacagcuggaauuguacaaauuuugguuguauuuaaagcucaguuuccuuuuu

SEQ ID NO: 362217 - RNA, 64 nt, hsa
ggcuauuugaaacuucaccuacuuuucauuagauugguuguaccaugucaccuuagcuuuuaaa

SEQ ID NO: 362218 - RNA, 64 nt, hsa
cugaacaacaaaugaauaacgaugaaugucuuuuugguuguaauuuaacaagucaaauaaaaua

SEQ ID NO: 362219 - RNA, 64 nt, hsa; identical to SEQ ID NO: 312019

SEQ ID NO: 362220 - RNA, 64 nt, hsa; identical to SEQ ID NO: 312020

SEQ ID NO: 362221 - RNA, 64 nt, hsa; identical to SEQ ID NO: 312021

SEQ ID NO: 362222 - RNA, 64 nt, hsa; identical to SEQ ID NO: 312022

SEQ ID NO: 362223 - RNA, 64 nt, hsa; identical to SEQ ID NO: 312023

SEQ ID NO: 362224 - RNA, 64 nt, hsa; identical to SEQ ID NO: 312024

SEQ ID NO: 362225 - RNA, 64 nt, hsa; identical to SEQ ID NO: 312025

SEQ ID NO: 362226 - RNA, 64 nt, hsa; identical to SEQ ID NO: 312026

SEQ ID NO: 362227 - RNA, 64 nt, hsa; identical to SEQ ID NO: 312027

SEQ ID NO: 362228 - RNA, 64 nt, hsa; identical to SEQ ID NO: 312028

SEQ ID NO: 362229 - RNA, 64 nt, hsa; identical to SEQ ID NO: 312029

SEQ ID NO: 362230 - RNA, 64 nt, hsa; identical to SEQ ID NO: 312030

SEQ ID NO: 362231 - RNA, 64 nt, hsa; identical to SEQ ID NO: 312031

SEQ ID NO: 362232 - RNA, 64 nt, hsa; identical to SEQ ID NO: 312032

SEQ ID NO: 362233 - RNA, 64 nt, hsa; identical to SEQ ID NO: 312033

SEQ ID NO: 362234 - RNA, 64 nt, hsa; identical to SEQ ID NO: 312034

SEQ ID NO: 362235 - RNA, 64 nt, hsa; identical to SEQ ID NO: 312035

SEQ ID NO: 362236 - RNA, 64 nt, hsa; identical to SEQ ID NO: 312036

SEQ ID NO: 362237 - RNA, 64 nt, hsa
uuuaugauaauagauucucuuguauaagauccuagauccuaagggucgaaagcucuagaaucug

SEQ ID NO: 362238 - RNA, 64 nt, hsa
aaggcacucuagauuccauugguccaagauuccggauccuaagcaucuaaguuauaagacucuc

SEQ ID NO: 362239 - RNA, 64 nt, hsa; identical to SEQ ID NO: 96876

SEQ ID NO: 362240 - RNA, 64 nt, hsa; identical to SEQ ID NO: 96877

SEQ ID NO: 362241 - RNA, 64 nt, hsa; identical to SEQ ID NO: 96878

SEQ ID NO: 362242 - RNA, 64 nt, hsa; identical to SEQ ID NO: 96879

SEQ ID NO: 362243 - RNA, 64 nt, hsa; identical to SEQ ID NO: 96880

SEQ ID NO: 362244 - RNA, 51 nt, hsa; identical to SEQ ID NO: 96881

SEQ ID NO: 362245 - RNA, 64 nt, hsa; identical to SEQ ID NO: 96882

SEQ ID NO: 362246 - RNA, 64 nt, hsa; identical to SEQ ID NO: 96883

SEQ ID NO: 362247 - RNA, 64 nt, hsa; identical to SEQ ID NO: 96884

SEQ ID NO: 362248 - RNA, 64 nt, hsa; identical to SEQ ID NO: 96885

SEQ ID NO: 362249 - RNA, 64 nt, hsa; identical to SEQ ID NO: 96886

SEQ ID NO: 362250 - RNA, 64 nt, hsa; identical to SEQ ID NO: 96887

SEQ ID NO: 362251 - RNA, 64 nt, hsa; identical to SEQ ID NO: 96888

SEQ ID NO: 362252 - RNA, 64 nt, hsa
gcauucguggucugugcaaacacuucgugguucuauauaucagcagcaagugugcaaaauaaag

SEQ ID NO: 362253 - RNA, 64 nt, hsa
acuguaaccuaaauguauuacuucugauaaaacuauauaucaaaugucacugcaaauuaguuuu

SEQ ID NO: 362254 - RNA, 64 nt, hsa
acauauaucaugugcauucaagcugugugacaagauauaucaauauaaaaacaagguauauacu

SEQ ID NO: 362255 - RNA, 64 nt, hsa
gcaguaaaugcauugaugucauuuuauuauguacauauaucaugugcauucaagcugugugaca

SEQ ID NO: 362256 - RNA, 64 nt, hsa
ucauuuaauuccucauagaaucccagucaccuuuauauaucauauuauuggaagagauucaucu

SEQ ID NO: 362257 - RNA, 64 nt, hsa
uuuauucacucuucauagaaucacaauuaccuuuauauaucauauguuauuggaagagauuccu

SEQ ID NO: 362258 - RNA, 64 nt, hsa
uauuagcaucauaauucuuuguuauguaaguuaaauauaucaagaaagaagagacuguuuggaa

SEQ ID NO: 362259 - RNA, 64 nt, hsa
aauagaauuagggagaguuuacacuuacuuaccuauauaucagcagauuuuucuggaagaaacc

SEQ ID NO: 362260 - RNA, 64 nt, hsa
gucuuacauaaugccaccaguccauccaaaaccuauauaucaccuauacuauauauaucauaua

SEQ ID NO: 362261 - RNA, 64 nt, hsa
aguccauccaaaaccuauauaucaccuauacuauauauaucauauauauaguugaauggcagua

SEQ ID NO: 362262 - RNA, 64 nt, hsa
ucuuuuuauuaccaaguacuauuucauuguaugaauauaucacaguuuauccauucuacuauua

SEQ ID NO: 362263 - RNA, 64 nt, hsa
uacacugcaaauauuuguuuuugcuuuugucuuaauauaucagauaugcaaaggccuaaacuga

SEQ ID NO: 362264 - RNA, 64 nt, hsa
uauauuuuaagcuuauuucuucaaaauuauuuucauauaucacagauauaucauuggaagauau

SEQ ID NO: 362265 - RNA, 64 nt, hsa
cuuauuucuucaaaauuauuuucauauaucacagauauaucauuggaagauauaauuugcauau

SEQ ID NO: 362266 - RNA, 64 nt, hsa
uuaacuuuuguuaucauaaauggaacuugcaggcauauaucaagaacccuaugaagaauuccuc

SEQ ID NO: 362267 - RNA, 64 nt, hsa
cacuaaaaacucugaaacuucaguauaaauguaaauauaucaguucuauaagcaggauuugagu

SEQ ID NO: 362268 - RNA, 64 nt, hsa
ccucacaggcacccacaaauguacacaaagagauauauaucacuguguuccugaaucaugguuu

SEQ ID NO: 362269 - RNA, 64 nt, hsa
caaagcaaguagagaagacacacucuauuauuagauauaucauguacuuauuuaaagcugcugu

SEQ ID NO: 362270 - RNA, 64 nt, hsa
auauuuuaaauuguuuuugaacuuuuuguguaaaauauaucagaucucaacauuguugguuucu

SEQ ID NO: 362271 - RNA, 64 nt, hsa
auuuauaggguuuagauuucugaaagcagcaugaauauaucaccuaacauccugacaauaaauu

SEQ ID NO: 362272 - RNA, 64 nt, hsa
ggguagugcccaagccuggucguguugccaggaguggugacaagaaaugcagcuuacaucaaac

SEQ ID NO: 362273 - RNA, 64 nt, hsa
uuguuucuacaaaucucucucaaauguauuauuuuggugacaaaaaugaaggagcuuuguaaau

SEQ ID NO: 362274 - RNA, 64 nt, hsa
ugugucuacaaaaaauuuaaaaauuagccaaguauggugacaggcaccuaugguuccagcuacu

SEQ ID NO: 362275 - RNA, 64 nt, hsa
caaggucaagagauuaagaucauccuggccaacauggugacaccccgucucuacuaaaaauaca

SEQ ID NO: 362276 - RNA, 64 nt, hsa
cuauaugccauggaugugaauuucccauagaagcuggugacauguuccuggaagcucugggcua

SEQ ID NO: 362277 - RNA, 64 nt, hsa
cagugagcugagaucacaccacugcacuccagccuggugacagagcaagacuccggcucuuaaa

SEQ ID NO: 362278 - RNA, 64 nt, hsa
ggagucuugcucugucgcccaggcuggaacgcaguggugacaucucggcucacugcaaccucca

SEQ ID NO: 362279 - RNA, 64 nt, hsa
uaagacaguuucugcccaaagucauguuaccaguuggugacagagcuggaaauacguagagauc

SEQ ID NO: 362280 - RNA, 64 nt, hsa
gccgccuccgcaucugacugucccaacggcaugcuggugacaccccccugcccuucgcuucugu

SEQ ID NO: 362281 - RNA, 64 nt, hsa
ccagcccaguuacugcagggcagcuuuccccaccuggugacaggcugugcgcagcagccccagg

SEQ ID NO: 362282 - RNA, 64 nt, hsa
aagaaacaaccauaugguguuguauauuauaaacuggugacauucuacuauugaauuauguaca

SEQ ID NO: 362283 - RNA, 64 nt, hsa
aauuuacugaauuaaaggauuaaauuaggugacauggugacaucuaucccuuuauuuugacacu

SEQ ID NO: 362284 - RNA, 64 nt, hsa
cagugagccgagaucacgccacugcacuccagccuggugacagcgugagacucuuuaaaaaaag

SEQ ID NO: 362285 - RNA, 64 nt, hsa
caucugagaacccacucucugccggagaaccccauggugacacauuuucaucuuucugaccaga

SEQ ID NO: 362286 - RNA, 64 nt, hsa
gccuacugggcauccggccugugcugggcauggguggugacauuggcagaaauggccacuggaa

SEQ ID NO: 362287 - RNA, 64 nt, hsa
caucuguggugaaccaagugaagguggugacuucuggugacauaguaauaaagugaagacucag

SEQ ID NO: 362288 - RNA, 64 nt, hsa
cagugagcuaagacugcaccacugcacuccagccuggugacagaacgagacucugucuuaaaaa

SEQ ID NO: 362289 - RNA, 64 nt, hsa
uuuuaaagauaugauguuuuauuguuuuaacucuuggugacaguagaugcucucuggagcgcag

SEQ ID NO: 362290 - RNA, 64 nt, hsa
gggaaggcgcucccucaucugggccaaaggaaggaggacgaagcccuccucagcuggccugugu

SEQ ID NO: 362291 - RNA, 64 nt, hsa
ccagcacagagccaccggaacaucaagauccuagaggacgaaccccacaguaaggaugagaccc

SEQ ID NO: 362292 - RNA, 64 nt, hsa
ccccaucuuucguugccauucuucauuccuacaaaggacgaacuuggauuacaucaacuuugga

SEQ ID NO: 362293 - RNA, 64 nt, hsa
acccaacagacaagauggaagaaggaccuugcagaggacgaagaggaggaggaugaggaggaca

SEQ ID NO: 362294 - RNA, 64 nt, hsa
aacgcagugcgggguuagggauuccccgggagagaggacgaagcgaggagaguucuccaucccc

SEQ ID NO: 362295 - RNA, 64 nt, hsa
caucuuccagcucagcuccacacaaagcugcagaaggacgaaaugaaaagcauuuggaaguuua

SEQ ID NO: 362296 - RNA, 64 nt, hsa
guauaauuugaggugaaauucaguuauaaagucaaggacgaauuugcacagugauauauuucua

SEQ ID NO: 362297 - RNA, 64 nt, hsa
ugcuuuccuuguggcccugccaaccagcucuuccaggacgaacucaguccagcaugguuuugau

SEQ ID NO: 362298 - RNA, 64 nt, hsa
ccggaggagggcgcagggugggggguaucaaagaaggacgaauagcacccuaccuguggguguu

SEQ ID NO: 362299 - RNA, 64 nt, hsa
aagauggauuuaaaccaagaugccuccaggaaagaggacgaaaugaguauauucacagaggaau

SEQ ID NO: 362300 - RNA, 64 nt, hsa
augaggaugagucccaagaagguucuuuggaaggaggacgaauagaauggaguaaugaaauucu

SEQ ID NO: 362301 - RNA, 64 nt, hsa
gaagagcagaugaccaccaugcucugugucagccaggacgaagggagacaucugggugccaggg

SEQ ID NO: 362302 - RNA, 64 nt, hsa
uuuccagguguggccucuggaaccugacuccguuaggacgaacaucugccccuucagggagggu

SEQ ID NO: 362303 - RNA, 64 nt, hsa
aaaaugauccuuaugauguccaacaaggaaauagaggacgaaggccuguguguugccaggcagg

SEQ ID NO: 362304 - RNA, 64 nt, hsa
ucauguaggacgcggcauccugccccugguagagaggacgaauguuccacaccauggucucuac

SEQ ID NO: 362305 - RNA, 64 nt, hsa
accucgcccacccuggcaaggacagcugcggccaaggacgaaagcccucccuuggcuggccuca

SEQ ID NO: 362306 - RNA, 64 nt, hsa
ccuuuaaauguucgucuauacccuaaguaaaaugaggacgaaagacaaauauuuugaaagccua

SEQ ID NO: 362307 - RNA, 64 nt, hsa
guucauauuugccaagucuucuguaaagaugucuaggacgaaauauuuuaugugcuaaugcaug

SEQ ID NO: 362308 - RNA, 64 nt, hsa
guuuuucuuuuaagggggaaacaagguagagaaaaggacgaagaaguguaagucccgcugauuc

SEQ ID NO: 362309 - RNA, 64 nt, hsa
aaaaccauauccuguaauuuaauaaaaaaaacuaaggacgaaaaaacccuccaauuuucccaaa

SEQ ID NO: 362310 - RNA, 64 nt, hsa
ggguuggugaaaaguuggccaguggguccccgugaggacgaacuacuguccugagucauaagua

SEQ ID NO: 362311 - RNA, 64 nt, hsa
ggguucuagggcugaaccaggcgccaggcuccagaggacgaagggacucuguugccccacacua

SEQ ID NO: 362312 - RNA, 64 nt, hsa
ugcagacaacggagggcagcgcccccccgagaucaggacgaaggaccaccgucgguccucagca

SEQ ID NO: 362313 - RNA, 64 nt, hsa
ggauugugaucacacauucccgaaguaauaagugaggacgaaugcacugcucuggaacauaacc

SEQ ID NO: 362314 - RNA, 64 nt, hsa
uuuaccauauguugugucuaaucuccuucugagaaggacgaaaaacuuucuuccaagugaagau

SEQ ID NO: 362315 - RNA, 64 nt, hsa
aaagcauggagaguggcaucuucuuugcauccuaaggacgaaaaacacagugcacucagagcug

SEQ ID NO: 362316 - RNA, 64 nt, hsa
uuuuugguuuuguuuuuaauuuagcucuucucugaggacgaagcuguuggugguggugguggug

SEQ ID NO: 362317 - RNA, 64 nt, hsa
guuagggucucuaauugcaaagugacuguacaauaggacgaaaguugccucugugucugagaaa

SEQ ID NO: 362318 - RNA, 64 nt, hsa
cucucuucugccugauagagggaagaggaagaggaggacgaacagagauccugaaauucugacu

SEQ ID NO: 362319 - RNA, 52 nt, hsa
uugggaucauugcccugugaggaggacgaacauccaaccuucccaaacgccu

SEQ ID NO: 362320 - RNA, 64 nt, hsa
ggcugugacucucucucuaaugcugcucucgggaaggacgaaagugaccugcaaggagagaaau

SEQ ID NO: 362321 - RNA, 64 nt, hsa
cugggacuccugagaugggagaggcagggaucagaggacgaacaggugggacuuugcgagcucu

SEQ ID NO: 362322 - RNA, 64 nt, hsa
aaauuaccccgauuuaggacaaagugaauuuauaaggacgaaucacaaagauggucugagaaaa

SEQ ID NO: 362323 - RNA, 64 nt, hsa
cggcuguuuuugaacacggggucauucugcagucaggacgaaccgguccccgucgcagacggag

SEQ ID NO: 362324 - RNA, 64 nt, hsa
gaagaugcuguuucuccggcagaaccaacccuccaggacgaaguuucagaauuggcugaugguc

SEQ ID NO: 362325 - RNA, 64 nt, hsa
ucaaaagguucuugaacaccacugugauucuccaaggacgaauuacguaaauuauacuuucaua

SEQ ID NO: 362326 - RNA, 64 nt, hsa
gacacucuccuucagggaaaauguuauguggaggaggacgaauaaauuuauuuuguuuuccugu

SEQ ID NO: 362327 - RNA, 64 nt, hsa
agacacagagauggagaagcagggacaugcugagaggacgaagccaaggaaauuagggaggaga

SEQ ID NO: 362328 - RNA, 64 nt, hsa
uuuucuuuucuaaaugaaacuccauguagcaaccaggacgaaguugagaaggaaaacgccaaau

SEQ ID NO: 362329 - RNA, 64 nt, hsa
ccccugacccaggaggcuggaagugucccccuugaggacgaagccuccagugaccuggaccugg

SEQ ID NO: 362330 - RNA, 64 nt, hsa
agccaugacuuuuagauaugagaugacgggaagcaggacgaaauaucggcguguggcuggagcc

SEQ ID NO: 362331 - RNA, 64 nt, hsa
auuucucacagacccuucagcaauggcuacuagaaggacgaacaauugcccuccuuuggaagua

SEQ ID NO: 362332 - RNA, 64 nt, hsa
cuccucagagcgccaggaagccagagccccaagcaggacgaaaaagaggcauacacacagcagu

SEQ ID NO: 362333 - RNA, 64 nt, hsa
cauaauuugucauaaccacugcugaguggccuugaggacgaaccccgcagggagcaagcaguac

SEQ ID NO: 362334 - RNA, 64 nt, hsa
guaucauguaucucucuguggugguucauuccacaggacgaaugcauauucaacacacugccuu

SEQ ID NO: 362335 - RNA, 64 nt, hsa
cccauccaagggcaagacuuggugcccagcuggaaggacgaaagcacacuuugugaccgccauc

SEQ ID NO: 362336 - RNA, 63 nt, hsa
aggauuggccggcagggugauaugacugauucaaggacgaauagcuucuuacauauucuagau

SEQ ID NO: 362337 - RNA, 64 nt, hsa
ucaaucccacgcuguuuccuuucaaaguucugggaggacgaacucaccgaggcgagaaguguaa

SEQ ID NO: 362338 - RNA, 64 nt, hsa
uguagcugugugucuugggccaccaguggccugcaggacgaagguacuguuccaucaccugcgg

SEQ ID NO: 362339 - RNA, 64 nt, hsa
cugagacugcuaaguaggggcagugaugguugccaggacgaauugagauaauaucugugaggug

SEQ ID NO: 362340 - RNA, 64 nt, hsa
cugaauucaauucccacguagacucuuauuuuauaggacgaaugccaaauugcagcuucugggg

SEQ ID NO: 362341 - RNA, 64 nt, hsa
agcuaauaaacacauuuguaaauacauuguuugcaggacgaaaacuucugaguuacagcucagg

SEQ ID NO: 362342 - RNA, 64 nt, hsa
uacauaacguucaguugggauggaaaucuuccggaggacgaauagaguuuaauuacucauugcg

SEQ ID NO: 362343 - RNA, 64 nt, hsa
cugaggguacgaugaggccugggcucagugagccaggacgaaugugacagacaccccuugcugc

SEQ ID NO: 362344 - RNA, 64 nt, hsa
gaugcagagagcccacccgugcagagggcagaagaggacgaaaugccuuugggugggcagggca

SEQ ID NO: 362345 - RNA, 64 nt, hsa
uccaacucuuguuuucuaguccaggauaugcuaaaggacgaagauuuucuauuguuuccaggcc

SEQ ID NO: 362346 - RNA, 64 nt, hsa
uuugacccuuaagcuuuuacaucucuuagcauggaggacgaagaaagcuguacauuguugcuug

SEQ ID NO: 362347 - RNA, 64 nt, hsa
ugcuuuuccaagccgccaggguccugacggcagcaggacgaagccuguuguggcgucuucuggg

SEQ ID NO: 362348 - RNA, 64 nt, hsa
ucugauggcugagguuagugugcuuggaggcugcaggacgaacugucgauguuucuuagcagag

SEQ ID NO: 362349 - RNA, 64 nt, hsa
aaaccaggacaggccaucugcagugacccagcccaggacgaaguuuacaaacaccuccuggaac

SEQ ID NO: 362350 - RNA, 64 nt, hsa
cuugcaucugacuugccacuagcacaggaagcucaggacgaaggcagcguuaggagaauaguug

SEQ ID NO: 362351 - RNA, 64 nt, hsa
acccagggucaaccugccuaccacaggcacuagaaggacgaaucugccuacugcccaugaacgg

SEQ ID NO: 362352 - RNA, 64 nt, hsa
gcugaugagagacagcgcaugcuggugcagcguaaggacgaacuccuccagcaagcucgcaagu

SEQ ID NO: 362353 - RNA, 64 nt, hsa
aaacccuucugauuaccuucaugacgggaaccuaaggacgaagccuacaggggcaagggccgcu

SEQ ID NO: 362354 - RNA, 64 nt, hsa
cugacuccuucacgucaggcucagguuccaugggaggacgaagcaguggacgcauugugggcuu

SEQ ID NO: 362355 - RNA, 64 nt, hsa
uugggggugggugggcagaggacgggguaaugugaggacgaagcgggcacggagccagauggcc

SEQ ID NO: 362356 - RNA, 64 nt, hsa
ugucuuaaauuuacgaugaauuucuugugagcagaggacgaaacaggugaauucucaccagacu

SEQ ID NO: 362357 - RNA, 64 nt, hsa
ucgcaggcagccucucagaaaguuucacccccagaggacgaagaggucaagaaccuugcagaaa

SEQ ID NO: 362358 - RNA, 64 nt, hsa
ugguggcucacgccuguaauccuggcacuuugggaggacgaagcgaguggaucacugaagucca

SEQ ID NO: 362359 - RNA, 52 nt, hsa
agcugcaaacccucaucugaagaggacgaaugaggaggaccacuguggugca

SEQ ID NO: 362360 - RNA, 56 nt, hsa
cagacguggaugaagaauagcucugcaggacgaaugccuuaguuuccacuuuccag

SEQ ID NO: 362361 - RNA, 64 nt, hsa
ccagcccugcuucucaguguggggcaggugucucaggacgaaggcgccgcgugaccacaugggc

SEQ ID NO: 362362 - RNA, 64 nt, hsa
aagacuaagauaaccaagaugaacauaaugucaaaggacgaaaucauggggacaauuuggauuu

SEQ ID NO: 362363 - RNA, 64 nt, hsa
aguccuggccacaggaguccccuacuggcugcagaggacgaagcaggaagcaugccguggaucc

SEQ ID NO: 362364 - RNA, 64 nt, hsa
ugagagaacuccaucaauccaguccaagaggaggaggacgaaggccuagacucagcugaaggau

SEQ ID NO: 362365 - RNA, 64 nt, hsa
ugagagaacuccaucaauccaguccaagaggaggaggacgaaggauccucacaggaggaugaag

SEQ ID NO: 362366 - RNA, 64 nt, hsa; identical to SEQ ID NO: 198310

SEQ ID NO: 362367 - RNA, 64 nt, hsa; identical to SEQ ID NO: 198311

SEQ ID NO: 362368 - RNA, 64 nt, hsa; identical to SEQ ID NO: 198312

SEQ ID NO: 362369 - RNA, 64 nt, hsa; identical to SEQ ID NO: 198313

SEQ ID NO: 362370 - RNA, 64 nt, hsa; identical to SEQ ID NO: 198314

SEQ ID NO: 362371 - RNA, 64 nt, hsa; identical to SEQ ID NO: 198315

SEQ ID NO: 362372 - RNA, 64 nt, hsa; identical to SEQ ID NO: 198316

SEQ ID NO: 362373 - RNA, 64 nt, hsa; identical to SEQ ID NO: 198317

SEQ ID NO: 362374 - RNA, 64 nt, hsa; identical to SEQ ID NO: 198318

SEQ ID NO: 362375 - RNA, 64 nt, hsa; identical to SEQ ID NO: 198319

SEQ ID NO: 362376 - RNA, 64 nt, hsa; identical to SEQ ID NO: 198320

SEQ ID NO: 362377 - RNA, 64 nt, hsa; identical to SEQ ID NO: 198321

SEQ ID NO: 362378 - RNA, 64 nt, hsa; identical to SEQ ID NO: 198322

SEQ ID NO: 362379 - RNA, 64 nt, hsa; identical to SEQ ID NO: 198323

SEQ ID NO: 362380 - RNA, 64 nt, hsa; identical to SEQ ID NO: 198324

SEQ ID NO: 362381 - RNA, 64 nt, hsa; identical to SEQ ID NO: 198325

SEQ ID NO: 362382 - RNA, 64 nt, hsa; identical to SEQ ID NO: 198326

SEQ ID NO: 362383 - RNA, 64 nt, hsa; identical to SEQ ID NO: 198327

SEQ ID NO: 362384 - RNA, 64 nt, hsa; identical to SEQ ID NO: 198328

SEQ ID NO: 362385 - RNA, 64 nt, hsa; identical to SEQ ID NO: 198329

SEQ ID NO: 362386 - RNA, 64 nt, hsa; identical to SEQ ID NO: 198330

SEQ ID NO: 362387 - RNA, 64 nt, hsa; identical to SEQ ID NO: 198331

SEQ ID NO: 362388 - RNA, 64 nt, hsa; identical to SEQ ID NO: 300837

SEQ ID NO: 362389 - RNA, 64 nt, hsa; identical to SEQ ID NO: 300838

SEQ ID NO: 362390 - RNA, 64 nt, hsa; identical to SEQ ID NO: 300839

SEQ ID NO: 362391 - RNA, 64 nt, hsa; identical to SEQ ID NO: 300840

SEQ ID NO: 362392 - RNA, 64 nt, hsa; identical to SEQ ID NO: 300841

SEQ ID NO: 362393 - RNA, 64 nt, hsa; identical to SEQ ID NO: 300842

SEQ ID NO: 362394 - RNA, 64 nt, hsa; identical to SEQ ID NO: 300843

SEQ ID NO: 362395 - RNA, 64 nt, hsa; identical to SEQ ID NO: 300844

SEQ ID NO: 362396 - RNA, 64 nt, hsa; identical to SEQ ID NO: 300845

SEQ ID NO: 362397 - RNA, 64 nt, hsa; identical to SEQ ID NO: 300846

SEQ ID NO: 362398 - RNA, 64 nt, hsa; identical to SEQ ID NO: 300847

SEQ ID NO: 362399 - RNA, 64 nt, hsa; identical to SEQ ID NO: 300848

SEQ ID NO: 362400 - RNA, 64 nt, hsa; identical to SEQ ID NO: 300849

SEQ ID NO: 362401 - RNA, 64 nt, hsa; identical to SEQ ID NO: 300850

SEQ ID NO: 362402 - RNA, 64 nt, hsa; identical to SEQ ID NO: 300851

SEQ ID NO: 362403 - RNA, 64 nt, hsa; identical to SEQ ID NO: 300852

SEQ ID NO: 362404 - RNA, 64 nt, hsa; identical to SEQ ID NO: 300853

SEQ ID NO: 362405 - RNA, 64 nt, hsa; identical to SEQ ID NO: 300854

SEQ ID NO: 362406 - RNA, 64 nt, hsa
cagagacgguaucuccuccuccugccucuucuauuguucugauuagucuacuuaaauucacuug

SEQ ID NO: 362407 - RNA, 64 nt, hsa
gucucaaaaauuaaagaauuuuguuuguuauuguuguucugaccauauugaaaagagguucacu

SEQ ID NO: 362408 - RNA, 64 nt, hsa
uaauaugcuguuucauaguucuuucacugggagcuguucugacaaaguuaucaaguuaaagcaa

SEQ ID NO: 362409 - RNA, 64 nt, hsa
gucaugcuaaagccaagacacuaguugucaaagguguucugagauaagccaugaaguauuuuug

SEQ ID NO: 362410 - RNA, 64 nt, hsa
uugaguagacagcaaugaucuuuacauagcuuaguguucugauggcaaaauauuguauaugaua

SEQ ID NO: 362411 - RNA, 64 nt, hsa
cagccucucgcaccaugugauuauuugccucgcuuguucugaaaucucuacacauuucauccuu

SEQ ID NO: 362412 - RNA, 64 nt, hsa
uccuucaaaaaaauuauuuuuuaaaacacagagguguucugaccugcaacuugacugggaagcc

SEQ ID NO: 362413 - RNA, 64 nt, hsa
cugucugugauucuuuuguuuguuguugugguguuguucugauuguuuugaacuggagcaugca

SEQ ID NO: 362414 - RNA, 64 nt, hsa
ccacccgcacccguccccuagagccauaguacuguguucugaaagccauuuagaauuucuuugu

SEQ ID NO: 362415 - RNA, 64 nt, hsa
cccuccuaaaauaugacuuaacuuuuaagagaaauguucugacacccaccuaaacacacaaggc

SEQ ID NO: 362416 - RNA, 64 nt, hsa
aauguaaaggaaacccuuuuggaauuagaauucuuguucugaugcugaacuauuugguaauaaa

SEQ ID NO: 362417 - RNA, 64 nt, hsa
gccuaaacccagaguuuauguagaaagcauugaauguucugaucagaugugacuaaggucaagg

SEQ ID NO: 362418 - RNA, 64 nt, hsa
uuuaacaauaacuacuguguuccuggcaauaguguguucugauuagaaaugaccaauauuauac

SEQ ID NO: 362419 - RNA, 64 nt, hsa
uguuacugaucaugcauuguugagguggucugaauguucugacauuaacaguuuuccaugaaaa

SEQ ID NO: 362420 - RNA, 64 nt, hsa
guaaaaaaugaaggggauaauauaugauaaauuauguucugauauccuccuacaguaguuuaaa

SEQ ID NO: 362421 - RNA, 64 nt, hsa
ugagaaacaacacauuuuuccccaugaacggugcuguucugaagucuucaaauuuuucccucua

SEQ ID NO: 362422 - RNA, 64 nt, hsa
gccuggugguauauugggcauucuuuggauugaguguucugaggugagagagucuucccgaggc

SEQ ID NO: 362423 - RNA, 64 nt, hsa
ccagcauauuuccccuucuacccuuuuacuuuguuguucugauuuuaggacucuggcuggccau

SEQ ID NO: 362424 - RNA, 64 nt, hsa
agccugaggcacagcugccuguauuguccucaucuguucugacugaaggauggaggugcugaau

SEQ ID NO: 362425 - RNA, 64 nt, hsa
ugccuucuuaaaccgaguuuacuccauuucagccuguucugaauuggugacucugucaccaaua

SEQ ID NO: 362426 - RNA, 64 nt, hsa
uggcuuagaauguaaaauugauuguuaaaaguuuuguucugaauaaauauuuaucuuuuguauu

SEQ ID NO: 362427 - RNA, 64 nt, hsa
ccugcccugugaauuacugcuacaaucaaggccacugcuacaucucccagacucugggcuguca

SEQ ID NO: 362428 - RNA, 64 nt, hsa
uccugugucagaaccaguccugcccugugaauuacugcuacaaucaaggccacugcuacaucuc

SEQ ID NO: 362429 - RNA, 64 nt, hsa
cccccagaucccacugggguccauuugggggguccugcuacacuccaccgauccccaaggaagu

SEQ ID NO: 362430 - RNA, 64 nt, hsa
gaccagaccguuugccuuuucaaguuuccuaguccugcuacaagaugagcuucuuccgugguuu

SEQ ID NO: 362431 - RNA, 64 nt, hsa
aagacuggaaaguuaggagaacugacuagcuaaacugcuacaguaugcaauuucuauuacaauu

SEQ ID NO: 362432 - RNA, 64 nt, hsa
aucuguagcccuaacacaugggaugaacguuuuacugcuacacccagauuuguguugaacgaaa

SEQ ID NO: 362433 - RNA, 64 nt, hsa
cuguguuagaaguagcaaugacaaugaccaaggacugcuacaccucugauuacaauucugaugu

SEQ ID NO: 362434 - RNA, 64 nt, hsa
auggaucagcucuuccuguguuuguaauuuaaugcugcuacaagauguuucuguuucuuagauu

SEQ ID NO: 362435 - RNA, 64 nt, hsa
agaaagaaaugaagugacucagcuucuggcuucucugcuacaucaaauaucuuguuuaaugggg

SEQ ID NO: 362436 - RNA, 64 nt, hsa
uaguuuccccuagcagacuuuuacuucucuuacacugcuacaccauuacuuucuugagacauuu

SEQ ID NO: 362437 - RNA, 64 nt, hsa
acuguacccagugccgccaccaguucugcagcggcugcuacaaugccuuuuacgccaagaaugu

SEQ ID NO: 362438 - RNA, 64 nt, hsa
ccugcgggacuggacugcucuccggcuucagaagcugcuacaggacaauaacgucauguuuaau

SEQ ID NO: 362439 - RNA, 64 nt, hsa
ucagccucuauggcaaggcccugcuacauggcaacugcuacaacagguacggcagccccagccc

SEQ ID NO: 362440 - RNA, 64 nt, hsa
agaugaggccagccucagccucuauggcaaggcccugcuacauggcaacugcuacaacagguac

SEQ ID NO: 362441 - RNA, 64 nt, hsa
gcugagaaucucguuaguagcauguggccuaacaaaaggaaaaaauguuuuuaaacacacacac

SEQ ID NO: 362442 - RNA, 64 nt, hsa
ugugaagaggaggaaaagugaaucacggagagagaaaggaaaggauagaaucacaggcugcguc

SEQ ID NO: 362443 - RNA, 64 nt, hsa
acccaucauuucacacauaggcucugaaagugggaaaggaaagcugaucaagcaggggccggac

SEQ ID NO: 362444 - RNA, 64 nt, hsa
uugcauggaugguuguaaagaaacaaucagaaauaaaggaaaacugagcagaaucugucuggug

SEQ ID NO: 362445 - RNA, 64 nt, hsa
auuugcacuguguucauauuaauccucuuuuaaaaaaggaaauauacagaagacaaacauugua

SEQ ID NO: 362446 - RNA, 64 nt, hsa
uccaggcuugagugacagagcaagacuguaucucaaaggaaaaaggaaacuaggccaggcgugg

SEQ ID NO: 362447 - RNA, 64 nt, hsa
uugagugacagagcaagacuguaucucaaaggaaaaaggaaacuaggccaggcgugguggcuca

SEQ ID NO: 362448 - RNA, 64 nt, hsa
gaauaaacuuuuccagaagcacgagguaguuugcaaaggaaaagucugcacuguuugcucuaaa

SEQ ID NO: 362449 - RNA, 64 nt, hsa
guguuuugcuguauuucaaaauuuuccuucuguuaaaggaaaauauugugaauaaccacuggug

SEQ ID NO: 362450 - RNA, 64 nt, hsa
gcagagggaaagggguacacugagggagaaaggaaaaggaaacuucaaacaauauagaauuaaa

SEQ ID NO: 362451 - RNA, 64 nt, hsa
aggcuggcagagggaaagggguacacugagggagaaaggaaaaggaaacuucaaacaauauaga

SEQ ID NO: 362452 - RNA, 64 nt, hsa
uaaaaaaaaaaaaaaaggaaaaaggaaaaaaaaaaaaggaaaaccagaagcccugcugucuguc

SEQ ID NO: 362453 - RNA, 64 nt, hsa
cuaugcuuucuucuuaaaaaaaaaaaaaaaggaaaaaggaaaaaaaaaaaaggaaaaccagaag

SEQ ID NO: 362454 - RNA, 64 nt, hsa
ucaaccucuaugcuuucuucuuaaaaaaaaaaaaaaaggaaaaaggaaaaaaaaaaaaggaaaa

SEQ ID NO: 362455 - RNA, 64 nt, hsa
uuaguucaggaaguuuuguuuuguguuuuaaauaaaaggaaagagcaaguuugcucagucaagu

SEQ ID NO: 362456 - RNA, 64 nt, hsa
uguagggaaaaacuuuugcccgacugauuuuuaaaaaggaaaaaaaaaauguuuuacuaugugg

SEQ ID NO: 362457 - RNA, 64 nt, hsa
cuuuggagacuagagccaauaguguaauguucucaaaggaaacagacuugaguuguuggauuag

SEQ ID NO: 362458 - RNA, 64 nt, hsa
aaacuauucuaucauaacuacccaaggacuacuaaaaggaaaaauuguguuaccuuuuuuaaau

SEQ ID NO: 362459 - RNA, 64 nt, hsa
auguagagagcuguugauuuguuucuguuuuuuuaaaggaaaacuauuuguaagauguugcacu

SEQ ID NO: 362460 - RNA, 64 nt, hsa
cacacaaauauguaaagcaauuguaggaaauuugaaaggaaaaaaagaaaccgaagccaguauu

SEQ ID NO: 362461 - RNA, 64 nt, hsa
cauauuucuuacaagccucuguuuuuuccccuuuaaaggaaacuuugaaaggauugugaauacu

SEQ ID NO: 362462 - RNA, 64 nt, hsa
uuuaggauucuuggagcuagccuggaucauggguaaaggaaacauuuugccuuuuguaucuuau

SEQ ID NO: 362463 - RNA, 64 nt, hsa
aacaaguauaaaauaaaauacauuuauaaaauaaaaaggaaaacagacuuaaauuuucuccuau

SEQ ID NO: 362464 - RNA, 64 nt, hsa
acagacucccauuucuuaaaaacggauaaguuugaaaggaaacugcuauugaacuuaagcaucu

SEQ ID NO: 362465 - RNA, 64 nt, hsa
acuuaaaauagcuuccaauaaguaacuuagaccaaaaggaaaaaugaagugccccaggagaaga

SEQ ID NO: 362466 - RNA, 64 nt, hsa
ugguuguaaagcucauuuuggggagguugauugcaaaggaaauuugaaagauaagauuuauucu

SEQ ID NO: 362467 - RNA, 64 nt, hsa
uuagagugaaaaaguguguuuuaugucaauugugaaaggaaaauguuaggaguaugguuuuuaa

SEQ ID NO: 362468 - RNA, 64 nt, hsa
uuuugcaugcucaauuucuagguccuuugucuagaaaggaaauuugccucaguugaauuaguga

SEQ ID NO: 362469 - RNA, 64 nt, hsa
uucaugccacggauaaaugaggcaaauccgaagaaaaggaaaaucgaauaaaaaauagucccac

SEQ ID NO: 362470 - RNA, 64 nt, hsa
aauucauccauacagaauuuggaugacuauguauaaaggaaaacuuaaaucuuaauuauuauca

SEQ ID NO: 362471 - RNA, 64 nt, hsa
agguuuuaaacgacuuuuguuugcggggcuuuuaaaaggaaaaccgaauuagguccacuucaau

SEQ ID NO: 362472 - RNA, 64 nt, hsa
ccgaauuagguccacuucaauguccaccugugagaaaggaaaaauuuuuuuguuguuuaacuug

SEQ ID NO: 362473 - RNA, 64 nt, hsa
cacacaccguuaagccagagguucugacuucgcuaaaggaaauguaagagguuuuguugucugu

SEQ ID NO: 362474 - RNA, 64 nt, hsa
agguaaaaaaacauaaugucuucagccucauaauaaaggaaaguuaauuaaaaaaaaaaagcaa

SEQ ID NO: 362475 - RNA, 64 nt, hsa
ggaaagucaaaaaaacgaaagagaaggagaagaaaaaggaaaagggcaaauugaaagucaagga

SEQ ID NO: 362476 - RNA, 64 nt, hsa
gagaaaaagcgcaaagaggagaaugaagauccagaaaggaaaauaaagaagaagggcuucggcg

SEQ ID NO: 362477 - RNA, 58 nt, hsa; identical to SEQ ID NO: 292228

SEQ ID NO: 362478 - RNA, 64 nt, hsa
caaggcccugcuuuuuuucuuaaaaguacuuuaaaaaggaaauuuguuuguauuuuuuauuuac

SEQ ID NO: 362479 - RNA, 64 nt, hsa
guguguguaguaauagauguaaguuuacacuuugaaaggaaaucuuguuucaauguuuauuaua

SEQ ID NO: 362480 - RNA, 64 nt, hsa
auuuuuaccuuguaaagucacaaaaauaguuuuuaaaggaaaaaguacaguauucuuuuaauaa

SEQ ID NO: 362481 - RNA, 64 nt, hsa
uggcuuauuuaauaugcuuauaaccuaguuaaagaaaggaaaagaaaacaaaaaacgaaugaaa

SEQ ID NO: 362482 - RNA, 64 nt, hsa
auguaggcccagucgucaucagaugcuugcggcaaaaggaaagcuguguuuauauggaagaaag

SEQ ID NO: 362483 - RNA, 64 nt, hsa
gaggacaccuuuguaucucaagcuaaugcucuacaaaggaaaggccgagcaggccguguugcau

SEQ ID NO: 362484 - RNA, 64 nt, hsa
ggagcccauauaugcgguccaugaaacagauuucaaaggaaaagcuuaaagcaaggcggaacag

SEQ ID NO: 362485 - RNA, 64 nt, hsa
aaguuaccaucgcaaaggaaagguuauuccaguaaaaggaaauaguuuucucaaccauuuaaaa

SEQ ID NO: 362486 - RNA, 64 nt, hsa
gccuauacucccaagacuacaaaguuaccaucgcaaaggaaagguuauuccaguaaaaggaaau

SEQ ID NO: 362487 - RNA, 64 nt, hsa
cgcugagcugcuuguuuaaaaaaaaaaaaaaggaaaaggaaaaagcaugacauuguguaucgau

SEQ ID NO: 362488 - RNA, 64 nt, hsa
ccaaaucgcugagcugcuuguuuaaaaaaaaaaaaaaggaaaaggaaaaagcaugacauugugu

SEQ ID NO: 362489 - RNA, 64 nt, hsa
uauuuaaggaagaauuggagugacguaucuuagaaaaggaaaggcugauguuuccauauagcuu

SEQ ID NO: 362490 - RNA, 64 nt, hsa
aaaggugcuauccuagggauuuuaugaauuccugaaaggaaaauagaauaugaucaauuccuug

SEQ ID NO: 362491 - RNA, 64 nt, hsa
aaaaugucuuaauggcugugugacacacguaaggaaaggaaagggggucacgcacaucauguac

SEQ ID NO: 362492 - RNA, 64 nt, hsa
uuucaaagcagaaauuuuaagccaaaaacaaacgaaaggaaagcggggaggggaaaacagaccc

SEQ ID NO: 362493 - RNA, 64 nt, hsa
ucuuuugugacucuuguacagcuuaaugugcaauaaaggaaaaguuauaucugucuucaguguu

SEQ ID NO: 362494 - RNA, 64 nt, hsa
uauaauuaggcuuuauuaucuuccuaaaucaaggaaaggaaaucauccccagaccauuuaugcu

SEQ ID NO: 362495 - RNA, 64 nt, hsa
auuauuaguugauucacaguacagaacaagguauaaaggaaaaaacccugcuagguaguguuau

SEQ ID NO: 362496 - RNA, 64 nt, hsa
cccagucccccaaccccagccgcucggaggccccaaaggaaaaagcacaagaagcgugagacgc

SEQ ID NO: 362497 - RNA, 64 nt, hsa
gcucauucucguagcuuuuuaaaaaaaugaaaguaaaggaaaaaaaaaaaacugcaaaucuaga

SEQ ID NO: 362498 - RNA, 64 nt, hsa
aggcaacacaagaauauuucacuuagauaugaagaaaggaaacacuagucuccauucacuugaa

SEQ ID NO: 362499 - RNA, 64 nt, hsa
uggauuuuauucuuagaaauccagaaucccuugaaaaggaaauauuuucuguuucuuauaaaua

SEQ ID NO: 362500 - RNA, 64 nt, hsa
aaccucguuuuucuuuuguuugcauuuucugcaaaaaggaaaaagaaaccacaaauuggggaaa

SEQ ID NO: 362501 - RNA, 64 nt, hsa
aaugggaagagaggagagggagaaaaauaaaaugaaaggaaaaaaaaaaguuugcaaauucaga

SEQ ID NO: 362502 - RNA, 64 nt, hsa
gaugcaguugaauggaaaauuacucaguguauagaaaggaaaaaaaccagaaauuuaaaauaga

SEQ ID NO: 362503 - RNA, 64 nt, hsa
caaauaacauaagucugaaagcaaugaaaacgucaaaggaaaauguuuauauacauccacaugu

SEQ ID NO: 362504 - RNA, 64 nt, hsa
cacauaagugcugucaguauaaaguuguggggauaaaggaaacuggauauuuuuagcacgaugu

SEQ ID NO: 362505 - RNA, 64 nt, hsa
cuuucuuuuuucuaaaaaaagaaaaaaaagaaaaaaaggaaaagaagaacaaagaaacaugacu

SEQ ID NO: 362506 - RNA, 64 nt, hsa
cagcauggagaaaacccgguacgcucaaaaagaaaaaggaaaaaaaaaaaucccaucacccaca

SEQ ID NO: 362507 - RNA, 64 nt, hsa
aauuuggacauuuuaauuguuuaaaaauuguacaaaaggaaaaaauuagaauaaguacuggcga

SEQ ID NO: 362508 - RNA, 64 nt, hsa
aagccgaugggggcaguggcguuaagugguggaaaaaggaaaguauauauguuagaguuuugaa

SEQ ID NO: 362509 - RNA, 64 nt, hsa
uccagcuugggcaacagagcaagauccugucucaaaaggaaaaagaaaacaggaccuagguguu

SEQ ID NO: 362510 - RNA, 64 nt, hsa
agaucauucaguuggauuuucccaaugaagaggaaaaggaaaguaguuauuccuagcuccauuu

SEQ ID NO: 362511 - RNA, 64 nt, hsa
uugucauucaguaauuuccuacaagcagcaccccaaaggaaauauaguccuaaucuuuacuauc

SEQ ID NO: 362512 - RNA, 64 nt, hsa
gaaagggaaacucagaguacuaggacguuuauuaaaaggaaaaaaaugucuugcaaugugcugu

SEQ ID NO: 362513 - RNA, 64 nt, hsa
uuggggaagaagcaagauacuuuaagagaaauacaaaggaaauuucuaaagcacaagaaauagu

SEQ ID NO: 362514 - RNA, 64 nt, hsa
uugaccucuaaaaagcccuuuguuccuaucuucuaaaggaaaguauaucauauaugaugaugua

SEQ ID NO: 362515 - RNA, 64 nt, hsa
auuuuugagauguaauuuaagauuguuuuauguaaaaggaaaaucuuguauggcaucgaauagc

SEQ ID NO: 362516 - RNA, 64 nt, hsa
gacauuaauaaagaugaaauaaacuuauuacuuuaaaggaaaggauuuggagaauugaacucac

SEQ ID NO: 362517 - RNA, 64 nt, hsa
auucacgugcacaaagauuagcacacuuaaaagcaaaggaaaaaauaaaucagaacuccauaaa

SEQ ID NO: 362518 - RNA, 64 nt, hsa
uauuuaggaaauuacauuaaguauuaaugaggggaaaggaaaugagcucuacgaggauuucacc

SEQ ID NO: 362519 - RNA, 64 nt, hsa
uuccccacccccaucacagggcuuucaguuuggcaaaggaaaagcagauaaaaacagaacauuc

SEQ ID NO: 362520 - RNA, 64 nt, hsa
ugaccucagggagagcaccuguccaggucugccuaaaggaaauggcuccagugggucuaaacaa

SEQ ID NO: 362521 - RNA, 64 nt, hsa
cuauuguaaauauguuuuuuagaucaaauacuuuaaaggaaaaaauguuggauuuauaaaugcu

SEQ ID NO: 362522 - RNA, 64 nt, hsa
uauaaaugcuauuuuuuauuuuacuuuuauaauaaaaggaaaagcaaauugaugaccucaccuu

SEQ ID NO: 362523 - RNA, 64 nt, hsa
uuagcaagcaugaauuuuucacccaagagugaaaaaaggaaaaucuaccauggcuugaaguuaa

SEQ ID NO: 362524 - RNA, 64 nt, hsa
gguggcagguacuaugaauguaauucauaauuuaaaaggaaaacuaaaaacuauuuugauuugg

SEQ ID NO: 362525 - RNA, 64 nt, hsa
cuuaucacacugauguguucaacuguuuaugggaaaaggaaacuaggaugguuuuauuugugaa

SEQ ID NO: 362526 - RNA, 64 nt, hsa
agcgcagagcagagugcugaguaaagaugucagaaaaggaaagcaauggucugguacaagucuu

SEQ ID NO: 362527 - RNA, 64 nt, hsa
aacuuuggguaccaaaccaaaaagaagaaaaaagaaaggaaaagaucuucuuugaagaaaagua

SEQ ID NO: 362528 - RNA, 64 nt, hsa
acccuccuugagccaaugcacugaacugccuuugaaaggaaauugcauguucugaccauuuuag

SEQ ID NO: 362529 - RNA, 64 nt, hsa
guguuuggcaguaauugucuguuuaaaaaaauaaaaaggaaaggaagcguucaccgccacaaau

SEQ ID NO: 362530 - RNA, 64 nt, hsa
cacuauugggguaugauguuugggucaguugauaaaaggaaaccuuuucaugccuuuagaugug

SEQ ID NO: 362531 - RNA, 64 nt, hsa
uauauauauauauauauauauauauauaaauuaaaaaggaaagaaaacuaacaaccaaccaacc

SEQ ID NO: 362532 - RNA, 64 nt, hsa
aaccuagaacuucaaaauguucguauucuauucaaaaggaaauauauauauauauauauauaua

SEQ ID NO: 362533 - RNA, 64 nt, hsa
uugaaaguuuaaagagggggaagaguugguuugcaaaggaaaaguuuaaauagcuuaauaucaa

SEQ ID NO: 362534 - RNA, 64 nt, hsa
gaggaugagaaguaagcaaacuguggaaacaugcaaaggaaaaagugauagaauaauauucaag

SEQ ID NO: 362535 - RNA, 64 nt, hsa
aaagauauguuuuauauuguuauuuauugugacaaaaggaaauaaaaagccuaaauguucagaa

SEQ ID NO: 362536 - RNA, 64 nt, hsa
cucuacugacaaaguaugccaucaugcaagcugcaaaggaaacauuucaagagucuauaucuau

SEQ ID NO: 362537 - RNA, 64 nt, hsa
acuaucuguaacaucagagcugucuggccuuuggaaaggaaaaauuauggacucuguuaagaaa

SEQ ID NO: 362538 - RNA, 64 nt, hsa
gcccaagauaggccuucacaccuucacaggugcgaaaggaaaggccuucacacccucacagagg

SEQ ID NO: 362539 - RNA, 64 nt, hsa
ucuacuauagcuuauuuucaaacaagggguaaaaaaaggaaagaaagaaguguacagaauuaac

SEQ ID NO: 362540 - RNA, 64 nt, hsa
augaccuguuaggcugagcucaggaauuguccaaaaaggaaaaagcaaaauaauuaauugagag

SEQ ID NO: 362541 - RNA, 64 nt, hsa
gucugaguccagauuucucaucaacuggcaauacaaaggaaaauaugguacaggaguuaguuag

SEQ ID NO: 362542 - RNA, 64 nt, hsa
uuaaaaugacuguuuucucucucuauggaaauaaaaaggaaaaaaaaaaaggaaacuuuuuuug

SEQ ID NO: 362543 - RNA, 64 nt, hsa
uuucucucucuauggaaauaaaaaggaaaaaaaaaaaggaaacuuuuuuuguuugcucuugcau

SEQ ID NO: 362544 - RNA, 64 nt, hsa
ugauuggcaagacauguauuuaaacaauaaacuaaaaggaaauaaucuccacguacuaccaucu

SEQ ID NO: 362545 - RNA, 64 nt, hsa
uuuucuucaaaggcuuguuaaaccaaucauguuaaaaggaaauucuugguuuugguuuguuguu

SEQ ID NO: 362546 - RNA, 64 nt, hsa
ccgugauugguugguuuguagcacuaaggucuaaaaaggaaaaccauaaaagacaucagauuac

SEQ ID NO: 362547 - RNA, 64 nt, hsa
acagggaggaugggauuaguggaagcuuaauggaaaaggaaaguuaugauccuccaagacccuu

SEQ ID NO: 362548 - RNA, 64 nt, hsa
ucuaaaaaaaccuaaggaagaauaauaauauaagaaaggaaauuuaaaaacauuccacaagaag

SEQ ID NO: 362549 - RNA, 64 nt, hsa
aauaauccuccuucaaaaaauaaaaauaaaagaaaaaggaaaaucauucaggaagaaaugaccu

SEQ ID NO: 362550 - RNA, 64 nt, hsa
uuuuuaggaaauauacgaagagucaucaacuuggaaaggaaacaaagagugcuuuugggcaucc

SEQ ID NO: 362551 - RNA, 64 nt, hsa
uugauacuuuaaaagccaaggugcccauauggaaaaaggaaauauacgaagagucaucaacuug

SEQ ID NO: 362552 - RNA, 64 nt, hsa
aaugcugcuuccuauuggagcccagaaaaaaggaaaaggaaaguuuaggcuuucuuuguccuuu

SEQ ID NO: 362553 - RNA, 64 nt, hsa
guuguaaaugcugcuuccuauuggagcccagaaaaaaggaaaaggaaaguuuaggcuuucuuug

SEQ ID NO: 362554 - RNA, 64 nt, hsa
caccuauguacccacaaaaauuuuuuaauuaaaaaaaggaaauuugaguuuaaauagaaacaug

SEQ ID NO: 362555 - RNA, 64 nt, hsa
ugcauacccuucucuucaagaaauuuguguucacaaaggaaaaaugcaugaagggauggauacc

SEQ ID NO: 362556 - RNA, 64 nt, hsa
uuaagaaccagaaaaauaauuaaucucucuggaaaaaggaaagcuaaagaagacuaugauacca

SEQ ID NO: 362557 - RNA, 64 nt, hsa
gguaacuugaaggcagcacagaggugagggauuaaaaggaaaggcagauuuugaaaucugacuc

SEQ ID NO: 362558 - RNA, 64 nt, hsa
uagcauccuuaagauuuaaaaaaaaaaaaaaaaaaaaggaaaaaaaagugauggaagccguaag

SEQ ID NO: 362559 - RNA, 64 nt, hsa
aucuugucuauuuuuucucuucauguuguaacaaaaaggaaaaaagaaaaaaaaaucccauccc

SEQ ID NO: 362560 - RNA, 64 nt, hsa
cagcaaaauuugaaauaauuucaccaggcuaaauaaaggaaaauggaaaccaguuaagaggcac

SEQ ID NO: 362561 - RNA, 64 nt, hsa
gacaaaccaaagguaaccagcuagcccaccacugaaaggaaagaucugagacaugggauuccca

SEQ ID NO: 362562 - RNA, 64 nt, hsa
uaugcaaguaaaucuuaucguuaguucuucuucaaaaggaaauugcaucuugugacuuaguaga

SEQ ID NO: 362563 - RNA, 64 nt, hsa
ucuccagaagcugcagcaagagguacagcucaacaaaggaaaaccacaggacuggauaugcaac

SEQ ID NO: 362564 - RNA, 64 nt, hsa
gucagaauauucuuuuuauauucuguggaaaaauaaaggaaauucagauuguuuaaaugccuaa

SEQ ID NO: 362565 - RNA, 64 nt, hsa
uaaaaguuuugagauaaguuuuguuucaauuagaaaaggaaauagguuuuagguggcauagugg

SEQ ID NO: 362566 - RNA, 64 nt, hsa
gcuucuauuuugugaagggacuauauuuuuugagaaaggaaaaucucaguuagauauauuuugu

SEQ ID NO: 362567 - RNA, 64 nt, hsa
gaauuuuuauuuccuguaguaggcuugcuggagcaaaggaaaugugcugcuaaaaaucaacuua

SEQ ID NO: 362568 - RNA, 64 nt, hsa
ccccgucccuuaaaaagacaaaaaaaauaaggcaaaaggaaagcaacuaagacacuggacuauc

SEQ ID NO: 362569 - RNA, 64 nt, hsa
gauaaauaccuggcaaaacuaaauaaauuaccaaaaaggaaaaaaaauccaccaaaccaugaua

SEQ ID NO: 362570 - RNA, 64 nt, hsa
acaaagaaaugcauucauaucaaaauuggaauagaaaggaaaaccuauuuuuaagauaucaacc

SEQ ID NO: 362571 - RNA, 64 nt, hsa
ggucugucauaaauuauuuccccgguaauuuuugaaaggaaaaauguauaacaaguacuauuua

SEQ ID NO: 362572 - RNA, 64 nt, hsa
gugguguuuguuuccauccccaaggcaaacaaggaaaggaaaggaaagaagaaaaggugccuua

SEQ ID NO: 362573 - RNA, 64 nt, hsa
guuuguuuccauccccaaggcaaacaaggaaaggaaaggaaagaagaaaaggugccuuaguccu

SEQ ID NO: 362574 - RNA, 64 nt, hsa
uucaauuccucagaaacaacuuuuuucacaacggaaaggaaagaacacuaguguucuuucagua

SEQ ID NO: 362575 - RNA, 64 nt, hsa
gugcugugagaauucuccuuugagauuucagaagaaaggaaacaaugugauucaagauauuuac

SEQ ID NO: 362576 - RNA, 64 nt, hsa
uaagggguuguuguguaguugcauuggaagagagaaaggaaacacacucuuucauugcugaauu

SEQ ID NO: 362577 - RNA, 64 nt, hsa
uuaaggacaaagauguaaaaaugccaaauuugggaaaggaaauuuuguaugaccacuguucuau

SEQ ID NO: 362578 - RNA, 64 nt, hsa
aauaucuuuaaguguuuuuuugacacauuaaaauaaaggaaauaaggaaauuguaagcuuuauu

SEQ ID NO: 362579 - RNA, 64 nt, hsa
uuguuuuuggauauaaagcuaauaagcacuuuaaaaaggaaaaggcagccuuuacuauuuuuuc

SEQ ID NO: 362580 - RNA, 64 nt, hsa
ugaggguaaaaaaaaauugauucaauuuuaugguaaaggaaacccaugcaauuuuaccuagaca

SEQ ID NO: 362581 - RNA, 64 nt, hsa
aauacaaaucaaacaauuuaaauauuuuaagaaaaaaggaaaaguagauagugauacugagggu

SEQ ID NO: 362582 - RNA, 64 nt, hsa
ggauuuaugagugauugcucuacauuauuucuucaaaggaaaggaaaggaauugaagacuuugc

SEQ ID NO: 362583 - RNA, 64 nt, hsa
uaugagugauugcucuacauuauuucuucaaaggaaaggaaaggaauugaagacuuugcuacuc

SEQ ID NO: 362584 - RNA, 64 nt, hsa
aaugucauugguauaugguggcuguuuaccaauaaaaggaaaaaauucauuaaccgguugcuuc

SEQ ID NO: 362585 - RNA, 64 nt, hsa
ucuuccuugucucaugaaaaccuaaauauaaaaaaaaggaaaauacuggaguuuuuauuucucu

SEQ ID NO: 362586 - RNA, 64 nt, hsa
cagacaguuauuccauaaagcauuuguauaauuaaaaggaaaacagaaaaaggaaaaguaggca

SEQ ID NO: 362587 - RNA, 64 nt, hsa
auaaagcauuuguauaauuaaaaggaaaacagaaaaaggaaaaguaggcaaaugugaaaauagu

SEQ ID NO: 362588 - RNA, 64 nt, hsa
uugcagagcuauagauagaaacagcuggaaaacuaaaggaaaaauacaaguguuuucggggcau

SEQ ID NO: 362589 - RNA, 64 nt, hsa
cucuuucccucuccccgcugccaaaaaaaaaaaaaaaggaaacguuuaucaugaaucaacaggg

SEQ ID NO: 362590 - RNA, 64 nt, hsa
gcccauuucuguuaaccucuuaucacuaagaaagaaaggaaagaaggagaugaauagaagaaag

SEQ ID NO: 362591 - RNA, 64 nt, hsa
uuuaaaccacagucuggagugauagcuacuguagaaaggaaauagacuuuguaugaacucuuua

SEQ ID NO: 362592 - RNA, 64 nt, hsa
uggugcugaguuagacuccagguacuuuguggucaaaggaaaucgccuagcuccaggcuguguu

SEQ ID NO: 362593 - RNA, 64 nt, hsa
guucuagaaagccacuguuuuauagcaaaacaggaaaggaaaagcuaccaguuuuuuauucaga

SEQ ID NO: 362594 - RNA, 64 nt, hsa
cuuuuaaaacuugaauauaggugggagacauaagaaaggaaagaaaagacuuaaaacuggagug

SEQ ID NO: 362595 - RNA, 60 nt, hsa; identical to SEQ ID NO: 292346

SEQ ID NO: 362596 - RNA, 64 nt, hsa
uuuuuaaaaaucuaccuguuccugacuuaaaacaaaaggaaagaaacuaccuuuuuauaaugca

SEQ ID NO: 362597 - RNA, 64 nt, hsa
ggagguauuguaagcuuuccauuuucuauaagaaaaaggaaaaguugaggggggggcauuagug

SEQ ID NO: 362598 - RNA, 64 nt, hsa
auuaaacagucuucauuuuuaaguaacugauuuaaaaggaaaauaauaaaauauguucguuuau

SEQ ID NO: 362599 - RNA, 64 nt, hsa
aaaagaaaagaaaagaaaucauagggccaaguucaaaggaaaugcacagaacauaucuucacau

SEQ ID NO: 362600 - RNA, 64 nt, hsa
agaguaagugcuauuggcauuccaaaauucagcuaaaggaaaaaugaucaaaaacaaaguaagg

SEQ ID NO: 362601 - RNA, 64 nt, hsa
gcuaugauuugcacuauuaguacaguauaguuagaaaggaaagcugaacacuauaaaacuauua

SEQ ID NO: 362602 - RNA, 64 nt, hsa
agagaggagagucuuacggagggcugggagcuuaaaaggaaaacaauguccuuacuuguaaaca

SEQ ID NO: 362603 - RNA, 64 nt, hsa
cacgacuucuguuucacaguucagaccggucuucaaaggaaaagccuguccgauuuuuccaugg

SEQ ID NO: 362604 - RNA, 64 nt, hsa
cacagaaaagcaaagucaguguacacucugagugaaaggaaauguaauguggauaaaggcccgc

SEQ ID NO: 362605 - RNA, 64 nt, hsa
guuuaugauaccaaaaaaauuacaguuuuguuuaaaaggaaauguugauguuuucaacuccaaa

SEQ ID NO: 362606 - RNA, 64 nt, hsa
aagcugaaaucuauucucauucuuguuugucaagaaaggaaaaucuguuauucaagguaaauua

SEQ ID NO: 362607 - RNA, 64 nt, hsa
guccaucuuaguuuuguuaaaaaaaaaaaaaaaaaaaggaaacagccucacuuuuuugugcucc

SEQ ID NO: 362608 - RNA, 64 nt, hsa
agaugaagauuauaacuguuuauuuaccuaauuaaaaggaaaggcagugccaaauaugagagga

SEQ ID NO: 362609 - RNA, 64 nt, hsa
cuuuuaauuagucaaacuaaauuaaggcucauuaaaaggaaaggaacuacugggaaauuaugca

SEQ ID NO: 362610 - RNA, 64 nt, hsa
ucaaaugauuaugauuaguuaugucuuuuaauaaaaaggaaauauuuuucaacuucuucuauau

SEQ ID NO: 362611 - RNA, 64 nt, hsa
uucauauagccagggauugaaguuuauuauuuucaaaggaaaacaccuuuauuuuauuuuuuuu

SEQ ID NO: 362612 - RNA, 64 nt, hsa
uuaauaugaauauauaucauguguuaauauugagaaaggaaaaauacauucccgguguuaguag

SEQ ID NO: 362613 - RNA, 64 nt, hsa
gaagacaaugguccuauaaugcccuuggauaagaaaaggaaacuuuugagcugcaccuucaguu

SEQ ID NO: 362614 - RNA, 64 nt, hsa
cugauagguuaggucucauuuggaguguugguggaaaggaaacugaagguaauugaauagaaua

SEQ ID NO: 362615 - RNA, 64 nt, hsa
gccaacaucaccuuaaagucgucaguaaaaguaaaaaggaaaaagguacacuuucagauaauuu

SEQ ID NO: 362616 - RNA, 64 nt, hsa
ugugcaaucaccccugccuuuuguucaacucuauaaaggaaaaggaauguagcucaacuuguga

SEQ ID NO: 362617 - RNA, 64 nt, hsa
cuaacccuuucaaaaguguuuguaaaccaaguucaaaggaaaauagacagaaugauuuccaaaa

SEQ ID NO: 362618 - RNA, 64 nt, hsa
uaaaaagugggaaggugaugcuguucuuauuguaaaaggaaagucauuuauauuaaagaauuug

SEQ ID NO: 362619 - RNA, 64 nt, hsa
aaacauugcaaaauauaaaauaaauaaaaaaaggaaaggaaacuuugaaccuuauguaccgagc

SEQ ID NO: 362620 - RNA, 64 nt, hsa
aaaaaaaacauugcaaaauauaaaauaaauaaaaaaaggaaaggaaacuuugaaccuuauguac

SEQ ID NO: 362621 - RNA, 64 nt, hsa
aaugucauucaggguuuccugacugcuaaugcagaaaggaaaaucguaaaggaaacagaaagau

SEQ ID NO: 362622 - RNA, 64 nt, hsa
guuuccugacugcuaaugcagaaaggaaaaucguaaaggaaacagaaagaugaaauaagccauu

SEQ ID NO: 362623 - RNA, 57 nt, hsa; identical to SEQ ID NO: 292374

SEQ ID NO: 362624 - RNA, 64 nt, hsa
guuuaagaacuauuuuaaaguguuccagacccaaaaaggaaaaauaaaaaaaaaggaauauuug

SEQ ID NO: 362625 - RNA, 64 nt, hsa
ucagcaauccugcugcuggguauauacccgaaagaaaggaaaaggaagccaguauauugaagag

SEQ ID NO: 362626 - RNA, 64 nt, hsa
cauagagaguagaagguugguuaccagaagcuggaaaggaaagugggguugggaggaagguggg

SEQ ID NO: 362627 - RNA, 64 nt, hsa
ugaaagaaagaaaaagaaagaaagaaagaaagagaaaggaaauuauaaggucaaguuaacaguu

SEQ ID NO: 362628 - RNA, 64 nt, hsa
guacagauagagauaauagaagacaaagagauuaaaaggaaauaaaaaugcaugauuaaaaacu

SEQ ID NO: 362629 - RNA, 64 nt, hsa
aacuaagaauaaaaaaccuauuuuuauguuuccuaaaggaaauuguuuauucuacagccucagu

SEQ ID NO: 362630 - RNA, 64 nt, hsa
aaagaaaaaaugaaaaaaaaaggaaaaaaagaaaaaaggaaaaaaacaguuugaacacaaaggc

SEQ ID NO: 362631 - RNA, 64 nt, hsa
guuugaaaucuuaaaaaaagaaaaaaugaaaaaaaaaggaaaaaaagaaaaaaggaaaaaaaca

SEQ ID NO: 362632 - RNA, 64 nt, hsa
aagaggaagacuggacaaaacaacacaaaggcagaaaggaaagaaacugaagaaagaagauaau

SEQ ID NO: 362633 - RNA, 64 nt, hsa
aauaguuuaagaaauuuuuuuuuuaaauaaaaaaaaaggaaaagaggaagacuggacaaaacaa

SEQ ID NO: 362634 - RNA, 64 nt, hsa
guucacaucagcauucacuuccguuaaauuugccaaaggaaacuguuaauauguuucuguuguu

SEQ ID NO: 362635 - RNA, 64 nt, hsa
uugcauccuucuugcuuauacguuaaguuacauaaaaggaaaacaaaauuauguggugugaaac

SEQ ID NO: 362636 - RNA, 64 nt, hsa
uacucugcuuuucugucaacaucccauuuuggggaaaggaaaagucauauuuauuccugcaccc

SEQ ID NO: 362637 - RNA, 64 nt, hsa
gucuaacaacacugauaauaggaaguaaaaacagaaaggaaaagaaauuaccacugggaaaauc

SEQ ID NO: 362638 - RNA, 64 nt, hsa
guccaggggauuucuccuccaaguccuaccacacaaaggaaagucucaagccucuauucacccc

SEQ ID NO: 362639 - RNA, 64 nt, hsa
agaaugcaguuuggccucuuuuuuuuuuuuuuuuaaaggaaaucccaaucuuauuauggaaagc

SEQ ID NO: 362640 - RNA, 64 nt, hsa
gauaccaggcacuuaaagccuuuuccugaauuggaaaggaaaagaggcccaagugcaaaagaaa

SEQ ID NO: 362641 - RNA, 64 nt, hsa
ccaauacagucuaguuuccugguuccguuuuagaaaaggaaaacgugaacaaacuuagaaaggg

SEQ ID NO: 362642 - RNA, 64 nt, hsa
uuagugacaccacacauuuaauucagcuuuguccaaaggaaagcuuaaaacccaauacagucua

SEQ ID NO: 362643 - RNA, 64 nt, hsa
uggaagugcuaucuaaugcagugauaccaaaaaaaaaggaaauaaaaugcacauaaauuuggaa

SEQ ID NO: 362644 - RNA, 64 nt, hsa
cccuaauaccaaagccaggcaaaaacauuacaagaaaggaaaacuacagaucaauauuuccagu

SEQ ID NO: 362645 - RNA, 64 nt, hsa
ugaaaaaauaucauuugacuuuuuauagaaaaaaaaaggaaaaaauaauugagaaaguguucau

SEQ ID NO: 362646 - RNA, 64 nt, hsa
cugacacccgcgcguggggaggacucgggccacgaaaggaaagaaauguauaccguaucuaucu

SEQ ID NO: 362647 - RNA, 64 nt, hsa
aauaaacaggaaauuagaaguguuaggguuagauaaaggaaaagugaaaaagcauaagaaauuu

SEQ ID NO: 362648 - RNA, 64 nt, hsa
aacuuguuacaacaauuuaaaaauaauaauaacaaaaggaaagcaacgaaugcacuucauauag

SEQ ID NO: 362649 - RNA, 64 nt, hsa
ggacaugcagaauugaauuugcucaaaaaagaugaaaggaaaugcaaacuguaaauguauaaau

SEQ ID NO: 362650 - RNA, 64 nt, hsa
uugaaugaagcaagggaaggcauguagggacaggaaaggaaacaauggaaggaaagugauucug

SEQ ID NO: 362651 - RNA, 64 nt, hsa
ugcuaauguguuguaaacaagauucuaaauuuaaaaaggaaaacaaaacaaacuuguucuuugc

SEQ ID NO: 362652 - RNA, 64 nt, hsa
aauccugaggcugaugaauugugaaaauuccucaaaaggaaauuaugcuggucaucacaggaac

SEQ ID NO: 362653 - RNA, 64 nt, hsa
ugacccaucuggaggaaaaccagaucggacuaaaaaaggaaaaagaaaaacaaaaucuccgcag

SEQ ID NO: 362654 - RNA, 64 nt, hsa
gcccacuggaugagcggugagacgaacaaaagggaaaggaaaaaaugggggugggggguggggg

SEQ ID NO: 362655 - RNA, 64 nt, hsa
gacaggagcugucuggagcuccaccuuugcaaagaaaggaaaaacacaaauugcccccagauug

SEQ ID NO: 362656 - RNA, 64 nt, hsa
acuguucaaaagcaaaagagaaggaacaggaaugaaaggaaaccuucccuuaacucuuucugcu

SEQ ID NO: 362657 - RNA, 64 nt, hsa
aaaguuuauuuugcuauugugaaaaacuaaauguaaaggaaaucaccuacuuucaugcaggugu

SEQ ID NO: 362658 - RNA, 64 nt, hsa
aaucaccuacuuucaugcagguguauaaucuugaaaaggaaaaaugcuuccauguugaagccag

SEQ ID NO: 362659 - RNA, 64 nt, hsa
uuugaaaagaaaaggggaaugugucccacuagugaaaggaaaacuuuucaacacuaucccugcu

SEQ ID NO: 362660 - RNA, 64 nt, hsa
guauucaaauuugauuguggcgaaucuacuucaaaaaggaaaaauaauccaacuuuguggauau

SEQ ID NO: 362661 - RNA, 64 nt, hsa
cugugagguuuauacuauuucugguuuuuaaccaaaaggaaaucaucuggaagcaggaggcaaa

SEQ ID NO: 362662 - RNA, 64 nt, hsa
uaaagguugacauauuccaaaacccuucuuuuuaaaaggaaaaaggauggagagaaggauggaa

SEQ ID NO: 362663 - RNA, 64 nt, hsa
ugcgaagcagaggaaaagaaacguuuucagaccuaaaggaaauguuuggucauguuaagaaaac

SEQ ID NO: 362664 - RNA, 64 nt, hsa
gggugggaggguaagaguuuugacaaguuguggcaaaggaaacuauacuuuucauuuuuaaaaa

SEQ ID NO: 362665 - RNA, 64 nt, hsa
gauugcaaacacauggcuccaucuucugcacacgaaaggaaagucccucuccuuuucuacaguc

SEQ ID NO: 362666 - RNA, 64 nt, hsa
cugaucccagggugaggagaagauugggacauagaaaggaaacugcaucagaaacaugaacaga

SEQ ID NO: 362667 - RNA, 64 nt, hsa
aucauggguguggcauucucuaacaaaugaugugaaaggaaaguaguuuucauaaaacucaugg

SEQ ID NO: 362668 - RNA, 64 nt, hsa
ucagccaaucuuuuauuguuccuuugcuacuuugaaaggaaaaaaaagguugucucuugauuuc

SEQ ID NO: 362669 - RNA, 64 nt, hsa
ugggagaaaauagagaacaugauagcaaaaucuaaaaggaaaaucaaaacuaauaaaauugcug

SEQ ID NO: 362670 - RNA, 64 nt, hsa
cugagaaaggagugagaaggaagaaacaaugcgcaaaggaaagcagucuuucagaaucugucag

SEQ ID NO: 362671 - RNA, 62 nt, hsa
auuuuucacuuugcucucaauuaaagucuauucaaaaggaaaguggcaagauuccaucagcu

SEQ ID NO: 362672 - RNA, 64 nt, hsa
cuuucaagucugacucuccacuccuccucacuaaaaaggaaacuucaguugaucuucuucaucc

SEQ ID NO: 362673 - RNA, 64 nt, hsa
aaagugguugggaaacucauuuacuggguccaccaaaggaaacccaauucugccauguuuuugc

SEQ ID NO: 362674 - RNA, 64 nt, hsa
augguaacugaugauauaaacaagcuuucuuuaaaaaggaaaaaaaugcguauauuucuauguu

SEQ ID NO: 362675 - RNA, 64 nt, hsa
gagaacuacauuuuucuuauugccuugaaaguuaaaaggaaagcagauuucuucagugacuuug

SEQ ID NO: 362676 - RNA, 64 nt, hsa
cuuucuuacauauacaucuuaguugauuauuaaaaaaggaaaaauaugguuuccagagaaaagg

SEQ ID NO: 362677 - RNA, 64 nt, hsa
auauaguaucacuucuauucuuuuuguuaaaggaaaaggaaauguccccaaaguauuaaagaau

SEQ ID NO: 362678 - RNA, 64 nt, hsa
agcaguauauaguaucacuucuauucuuuuuguuaaaggaaaaggaaauguccccaaaguauua

SEQ ID NO: 362679 - RNA, 64 nt, hsa
uuuaaaagcugaaaauuuagaagcaagaugaaaaaaaggaaaagcaggugcuuuuuaaaaauca

SEQ ID NO: 362680 - RNA, 64 nt, hsa
gguuaauuccagaagagaggaaugacuugaaggcaaaggaaacuaaggaaggagguucagugag

SEQ ID NO: 362681 - RNA, 64 nt, hsa
caguugcagcuguaaucaauugugcgcaguugggaaaggaaagccaggacuuguggggugggug

SEQ ID NO: 362682 - RNA, 64 nt, hsa
agguuaaacaaacaaaaaaaaauuuuaaacaaagaaaggaaaaaaauugacaauaaaagucacu

SEQ ID NO: 362683 - RNA, 64 nt, hsa
ugauacacuuuacuaaucaugaaauucuaaccuaaaaggaaaacauuuuccugcuugucuuaga

SEQ ID NO: 362684 - RNA, 64 nt, hsa
guuucaauuucuacacaauauaaauauccaguauaaaggaaagcguuaagucgguaagcuagag

SEQ ID NO: 362685 - RNA, 64 nt, hsa
gcuaaggcuaguguacuagauguacuuuuucuaaaaaggaaaggacagaaaaaaaugaagaaag

SEQ ID NO: 362686 - RNA, 64 nt, hsa
uuuucuaaaaaggaaaggacagaaaaaaaugaagaaaggaaaggaagacaaauguaaagaaaua

SEQ ID NO: 362687 - RNA, 64 nt, hsa
uccuuguuccagcccggaguuuugggaaagaaagaaaggaaaggucacagugaccuaggauugg

SEQ ID NO: 362688 - RNA, 64 nt, hsa
ugcugauuuaccgauguauuuaauguaaguaaaaaaaggaaaaaaagaaaagggcauuggagug

SEQ ID NO: 362689 - RNA, 64 nt, hsa
auaucuagggucuguaaccguuuugguuugagaaaaaggaaaggccccuugucacauccucuaa

SEQ ID NO: 362690 - RNA, 64 nt, hsa
acauauuuuagugggagccagacuauaaggaauaaaaggaaaaacuuucuuccucucucuccaa

SEQ ID NO: 362691 - RNA, 64 nt, hsa
guacagagguuacauauucuggguguucuuuuauaaaggaaacauuuuaaaucccacaaauuga

SEQ ID NO: 362692 - RNA, 64 nt, hsa
uuguaugauccuuacuacuggaauuaccggguuaaaaggaaaugcuuaccacuaagaugucagu

SEQ ID NO: 362693 - RNA, 64 nt, hsa
acagcugccaguuuacacauuucucaguauccugaaaggaaaaaaguauagccccacuuauacu

SEQ ID NO: 362694 - RNA, 64 nt, hsa
agaaaaaagauaaaguagaaaaagaaaaaagugaaaaggaaacaacuagcaaaaagaauagcca

SEQ ID NO: 362695 - RNA, 64 nt, hsa
auuaagugucuaaacuaagguuuagugcuuuuuuaaaggaaaguugucccaggauucauccuaa

SEQ ID NO: 362696 - RNA, 64 nt, hsa
uugaacagacaaguggaagggcuguaccagggauaaaggaaagaagugccuguccagcagggag

SEQ ID NO: 362697 - RNA, 64 nt, hsa
aauuaugaaaaucuaacacucaagauaguuucuaaaaggaaaucaguaguuaaggauaccugau

SEQ ID NO: 362698 - RNA, 64 nt, hsa
ucuaagacauuucugaauguagaccauuuuccaaaaaggaaacuuuauuuucaaaaaccuaauc

SEQ ID NO: 362699 - RNA, 64 nt, hsa
uaaaaauauugcagugcuauuuuuucuuaaucagaaaggaaaauucucaaggccuuuugaagag

SEQ ID NO: 362700 - RNA, 64 nt, hsa
uccaagagacuuccauguccugguuauuaacaaaaaaggaaaaauguaauaauugauaugauuu

SEQ ID NO: 362701 - RNA, 64 nt, hsa
uaagaucagucacccaugugaauaagaagccaggaaaggaaagauggggaagcccagaucacca

SEQ ID NO: 362702 - RNA, 64 nt, hsa
augugacaaaugaacagcaggauuaugaauuaucaaaggaaaaaguauuugcugaggugaaaaa

SEQ ID NO: 362703 - RNA, 64 nt, hsa
gguaauagaauacuaguaggauagaaacaacuagaaaggaaagugugacacaguuuuuaaauuu

SEQ ID NO: 362704 - RNA, 64 nt, hsa
agauguagaaaauaaugaauuaaugagauuggugaaaggaaaucaugcaaaacauuugaaugca

SEQ ID NO: 362705 - RNA, 64 nt, hsa
cuauaaaccuuuugcccccauaauuucuuuuuuuaaaggaaauuaauauuaguaaaauaaacac

SEQ ID NO: 362706 - RNA, 64 nt, hsa
uguuauucaguguugcgguagcagaugcauuaucaaaggaaaaauauuuggcuccuuuaauucc

SEQ ID NO: 362707 - RNA, 64 nt, hsa
uuuggaauuuuuuucaguggagugguuuucgcuuaaaggaaaaaaaaaucuaaaacugcgaaga

SEQ ID NO: 362708 - RNA, 64 nt, hsa
ucauuggaauuuauauuaaaagacaaguuauuaaaaaggaaagguucuauucauaaucagggua

SEQ ID NO: 362709 - RNA, 64 nt, hsa
acuuucauaaauuuuauggcaugucuucuauuuaaaaggaaaagaauaaguauucuugcaucug

SEQ ID NO: 362710 - RNA, 64 nt, hsa
caguuuugaauuggaauugcaccauuucguagauaaaggaaacuaaguauauugcugcacuuuu

SEQ ID NO: 362711 - RNA, 64 nt, hsa
ucuguuuaaguugaaagcaagagucccugaguauaaaggaaaaacagcaaaacaaaaagcaaac

SEQ ID NO: 362712 - RNA, 64 nt, hsa
aaaacauuuuugucauauucuuguauucaaagaaaaaggaaaaaagauuauuguaaauauuuua

SEQ ID NO: 362713 - RNA, 64 nt, hsa
auaaagacaaacuaaaacaaaacagaacaaaagcaaaggaaaaugcuuuagaaauuuuaacucc

SEQ ID NO: 362714 - RNA, 64 nt, hsa
cuguuucacugugaauagugaauguaaaggaaagaaaggaaaaacugaaagcuuguucuaucac

SEQ ID NO: 362715 - RNA, 64 nt, hsa
aacaugcaccuguuucacugugaauagugaauguaaaggaaagaaaggaaaaacugaaagcuug

SEQ ID NO: 362716 - RNA, 64 nt, hsa
aagaaagaaacuguauuucagaguaaaaucuccuaaaggaaauaaaaacacagaguuguaaaua

SEQ ID NO: 362717 - RNA, 64 nt, hsa
ucaaauugauuauacaggcuaugaaaaccauuuuaaaggaaagaaaauauguaaauucuauuga

SEQ ID NO: 362718 - RNA, 64 nt, hsa
ugaagccccaaggacacaaaacauuuucccauuuaaaggaaaacacucuaguuuugcaaguaua

SEQ ID NO: 362719 - RNA, 64 nt, hsa
aguucagcauuuuuagggaccuaggugcaagugcaaaggaaauuucccuguuucaaaaucuauu

SEQ ID NO: 362720 - RNA, 64 nt, hsa
aggacauugaaagcgacauaaauagucacuuuaaaaaggaaaugauucuggaugguucuuugac

SEQ ID NO: 362721 - RNA, 64 nt, hsa
aaauaacuuuaauuaggaucauaugaccauugaaaaaggaaaaauguagacucugacuuccguc

SEQ ID NO: 362722 - RNA, 64 nt, hsa
uucaguggguuaauuauaccccaugauaccuauuaaaggaaaaccagugggucugguggugcug

SEQ ID NO: 362723 - RNA, 64 nt, hsa
aaggagaaggaaaucauaaugaugucaugugaucaaaggaaaccauggaaggguucacgcugau

SEQ ID NO: 362724 - RNA, 64 nt, hsa
gaaaauguaaugaauuuuaucagauauccaaaguaaaggaaauguuuuaaaacugcaacaagag

SEQ ID NO: 362725 - RNA, 64 nt, hsa
uuacuaauaguaugcuguuaauuguguaagaaagaaaggaaauuagaaaacauauuugcauaaa

SEQ ID NO: 362726 - RNA, 64 nt, hsa
aaagucugugaaaaaaaacaaaaguaaaguuauaaaaggaaaagaaaacagaggcuuuaaauua

SEQ ID NO: 362727 - RNA, 64 nt, hsa
ucacgccuagcaguuucugguuccuuuaacagcaaaaggaaagagagguucugauucuuaccuc

SEQ ID NO: 362728 - RNA, 64 nt, hsa
ucagcaucuccuugccuguuuucuuuauuaguccaaaggaaaacaacagcaacaaaaucuguuu

SEQ ID NO: 362729 - RNA, 64 nt, hsa
acauauuuauggacuuugaguaucuagcaaguagaaaggaaaaaaauauucaucauacucuaau

SEQ ID NO: 362730 - RNA, 64 nt, hsa
ugaguaacaaaaugagacccuaucucaaaaacaaaaaggaaaagaaaauauacaugaugggauu

SEQ ID NO: 362731 - RNA, 64 nt, hsa
aagccacuugauccucaacauauacuauaauugcaaaggaaacaugaggccaucuucccuuguu

SEQ ID NO: 362732 - RNA, 64 nt, hsa
aaaagugaccuuaacuguauuuauucucaaagggaaaggaaauaucagauguuuauuugguuau

SEQ ID NO: 362733 - RNA, 64 nt, hsa
ccgguuuuaguugagucuucacauuuagaauuugaaaggaaaaacagaacauuucucaugugcu

SEQ ID NO: 362734 - RNA, 64 nt, hsa
acagaacauuucucaugugcuuuguagcuuaaaaaaaggaaaacucaccauuucauccauauuu

SEQ ID NO: 362735 - RNA, 64 nt, hsa
gucggguuagugguaguauuauuguuauuuuuuuaaaggaaacaaacagacaacaaaaagaaga

SEQ ID NO: 362736 - RNA, 64 nt, hsa
uauuacccccccacuaugcccucauuuuuuuaaaaaaggaaaaaaaaaagaaacuggguuccag

SEQ ID NO: 362737 - RNA, 64 nt, hsa
aaauaaaaaaauaaauaaaaauaaaaaaaauaaaaaaggaaaaaaaaaaaagaagaaacaagac

SEQ ID NO: 362738 - RNA, 64 nt, hsa
uagaccauggccuguuaggaggcguccugucuguaaaggaaauucaucucuugugacagccugg

SEQ ID NO: 362739 - RNA, 64 nt, hsa
guaaaaguggucccgcuaccauuggggaaucaggaaaggaaagacugagaugguugccaggacu

SEQ ID NO: 362740 - RNA, 64 nt, hsa
uuuugaaaagaugaaaaauaaagauuuauuuaaaaaaggaaaaagguaugaguacauuuuuaau

SEQ ID NO: 362741 - RNA, 64 nt, hsa
gagaaauuuaagucuucacugagggccacuuuacaaaggaaauuugaauaaauggagagagaga

SEQ ID NO: 362742 - RNA, 64 nt, hsa
uggcuggggcuauauauacuggaaguugaagguuaaaggaaaagcacaagaaacuuuggaagca

SEQ ID NO: 362743 - RNA, 64 nt, hsa
agucccuuuauaaagagugcuacaugguuuagauaaaggaaacauauaacuauugaguuacagg

SEQ ID NO: 362744 - RNA, 64 nt, hsa
agaaccugggauaauucuuuacuuuuuuugaaauaaaggaaaggaaauucagacucuuacauug

SEQ ID NO: 362745 - RNA, 64 nt, hsa
cugggauaauucuuuacuuuuuuugaaauaaaggaaaggaaauucagacucuuacauuguucuc

SEQ ID NO: 362746 - RNA, 64 nt, hsa
uaagaaggcauuuaauccaguaucucuaguguacaaaggaaacuugaaguuuuaauggauuauu

SEQ ID NO: 362747 - RNA, 64 nt, hsa
gauauagcauaguauguuuauccauucgcccauuaaaggaaaucuugauugcuuccaguuuuca

SEQ ID NO: 362748 - RNA, 64 nt, hsa
cuuucuggcuccugauaggguggagcaaaaguggaaaggaaaggaaagaggccuuuucucacag

SEQ ID NO: 362749 - RNA, 64 nt, hsa
uggcuccugauaggguggagcaaaaguggaaaggaaaggaaagaggccuuuucucacagccauu

SEQ ID NO: 362750 - RNA, 64 nt, hsa
uccugcucacacuccagaauuaaauucuauugaaaaaggaaaaucagcaauucagcaaaaaaua

SEQ ID NO: 362751 - RNA, 64 nt, hsa
uuaaugacagauguucuguuuuuauaaccuaccaaaaggaaacuagaggcuucuuggugaagag

SEQ ID NO: 362752 - RNA, 64 nt, hsa
uccauccuaggcaacagagugauacgcuguuuaaaaaggaaaaaauccuucccuagagcuagua

SEQ ID NO: 362753 - RNA, 64 nt, hsa
acagagugagacuccaucucaacagaaggaaaaaaaaggaaaauaggagaagguggaaaugggu

SEQ ID NO: 362754 - RNA, 64 nt, hsa
aaaaagaaaggacauugaguuuuaacagaagggaaaaggaaagaagaaaagauuuuugcagaau

SEQ ID NO: 362755 - RNA, 64 nt, hsa
cugagcagaacaaaucgucaggugccuggagcaaaaaggaaaaaaaaaaaagaaaggacauuga

SEQ ID NO: 362756 - RNA, 64 nt, hsa
ugaaaucugcugcugaacuuguuagacauuuuugaaaggaaaauuagguuagcguacaauuuau

SEQ ID NO: 362757 - RNA, 64 nt, hsa
acuuacugcaaaguuuguuuauacuuuugccuaaaaaggaaauuggaugggauacuguggcaaa

SEQ ID NO: 362758 - RNA, 64 nt, hsa
uuggcucuuuuuuuaaaagaugcgcucuaccugaaaaggaaauuggauuuuagaacuggaugug

SEQ ID NO: 362759 - RNA, 64 nt, hsa
uauaaaaccucuugcuugugugcaaaaguuccuaaaaggaaacacaaguaaugccuauccauua

SEQ ID NO: 362760 - RNA, 64 nt, hsa
gaauagaaacuugaagugcuaaauggaauaauccaaaggaaauuuuuuaaaugcagguucuagc

SEQ ID NO: 362761 - RNA, 64 nt, hsa
aaguuaaaccauucugggauuugggaacuucuuuaaaggaaaauuguaguagaggucaucuuga

SEQ ID NO: 362762 - RNA, 64 nt, hsa
agcauacauuucugccacauucuuaaguagcaaaaaaggaaaagugcuuuccuccucugcagga

SEQ ID NO: 362763 - RNA, 64 nt, hsa
uacaacaacaaaaaaacuauauuaaacaggguuuaaaggaaauuaaaacagaacuaugagaagu

SEQ ID NO: 362764 - RNA, 64 nt, hsa
caaguguggggagucaugggguguggaggggaggaaaggaaagguauuuuguuucuuugucuau

SEQ ID NO: 362765 - RNA, 64 nt, hsa
gaugaaagcuuuaauuuagaaagaaaguucaaguaaaggaaauuauuuugauuaaauauauuuu

SEQ ID NO: 362766 - RNA, 64 nt, hsa
uuuacauaauuuguaccaaaaaaaaaaaaaaaggaaaggaaagaaagggguggccugacacugg

SEQ ID NO: 362767 - RNA, 64 nt, hsa
aauguuuuacauaauuuguaccaaaaaaaaaaaaaaaggaaaggaaagaaagggguggccugac

SEQ ID NO: 362768 - RNA, 64 nt, hsa
cuguucauacagugaauaaagaucuaucaaaggaaaaggaaacugagaccgaaaacuuaggguc

SEQ ID NO: 362769 - RNA, 64 nt, hsa
gugacucuguucauacagugaauaaagaucuaucaaaggaaaaggaaacugagaccgaaaacuu

SEQ ID NO: 362770 - RNA, 64 nt, hsa
auaaauacauauuguuuaaaaaaaagcaagaaaaaaaggaaaacaaaggaaaauauccccaaag

SEQ ID NO: 362771 - RNA, 64 nt, hsa
auuguuuaaaaaaaagcaagaaaaaaaggaaaacaaaggaaaauauccccaaaguuguuuucua

SEQ ID NO: 362772 - RNA, 64 nt, hsa
uagggaaccacuucauucugaaaauguguaaaugaaaggaaagucauuuagucugcauuuccug

SEQ ID NO: 362773 - RNA, 64 nt, hsa
ucaugcucacaacuaagcauaggaaguuuuauuuaaaggaaagaauauguuaaugaacauauag

SEQ ID NO: 362774 - RNA, 64 nt, hsa
ccucgagauuuuggaauucgugcaggaagccaugaaaggaaagaucagugaagacagcaaucac

SEQ ID NO: 362775 - RNA, 64 nt, hsa
cacuuguaauuuuaugugcuuucaucacaaauccaaaggaaagaauaaaaauuucuuaacacaa

SEQ ID NO: 362776 - RNA, 64 nt, hsa
acucucagcaaacacgggacuguguucaguccacaaaggaaaagcguuuuugaagcucucauug

SEQ ID NO: 362777 - RNA, 64 nt, hsa
uagcaucacuauagggggucaauauuuacacaaaaaaggaaagucacaagccuguuuaaaauga

SEQ ID NO: 362778 - RNA, 64 nt, hsa
aauuaauagguugcuaauuauuuaucacugcuaaaaaggaaaaaaggcauaaaaugaccuucua

SEQ ID NO: 362779 - RNA, 64 nt, hsa
auacuuuucuggcaaaaaaaaaaaaaaaagaaagaaaggaaaacaaaaagcacuuuuuucuuaa

SEQ ID NO: 362780 - RNA, 64 nt, hsa
cuagaugaggacaugagaauaauucaggagaacaaaaggaaacacagaacaugcaaaaggccug

SEQ ID NO: 362781 - RNA, 64 nt, hsa
ggucaaauugauacccuuaauaagaaaggaaaggaaaggaaaacagauccuccccucugcuuuu

SEQ ID NO: 362782 - RNA, 64 nt, hsa
cuuauggucaaauugauacccuuaauaagaaaggaaaggaaaggaaaacagauccuccccucug

SEQ ID NO: 362783 - RNA, 64 nt, hsa
cuugucuuauggucaaauugauacccuuaauaagaaaggaaaggaaaggaaaacagauccuccc

SEQ ID NO: 362784 - RNA, 64 nt, hsa
uccugcugggucuuaacaagcauaaaaaggaaaaaaaggaaacucaggcaaagggauccauaug

SEQ ID NO: 362785 - RNA, 64 nt, hsa
gacguccauuccugcugggucuuaacaagcauaaaaaggaaaaaaaggaaacucaggcaaaggg

SEQ ID NO: 362786 - RNA, 64 nt, hsa
ugguggcucuaggaauugggguucagcagggaccaaaggaaaggaggaggugccgggggccugg

SEQ ID NO: 362787 - RNA, 64 nt, hsa
uucuugaccugguggauguggcugcaguccagagaaaggaaagauugagguggcagagcagacc

SEQ ID NO: 362788 - RNA, 64 nt, hsa
aaauaaauugggccagggugggagcagggaaagaaaaggaaaauaguagcaagagcugcaaagc

SEQ ID NO: 362789 - RNA, 64 nt, hsa
acagacuuuaggaucacgugugugacuaauacagaaaggaaacauggcgucggggagagggaua

SEQ ID NO: 362790 - RNA, 64 nt, hsa
ggaugcugguauuuuaacagauggagagacaaggaaaggaaaggaaaggccuggcaugggcauu

SEQ ID NO: 362791 - RNA, 64 nt, hsa
cugguauuuuaacagauggagagacaaggaaaggaaaggaaaggccuggcaugggcauugugag

SEQ ID NO: 362792 - RNA, 64 nt, hsa
agguauacuuacaaugugaaguaacuuaugaauaaaaggaaaaguuuaucccauauucaaauaa

SEQ ID NO: 362793 - RNA, 64 nt, hsa
gcuuucuuggaaagacucacuuuaccaagcauauaaaggaaaaaugauuucaaacauugacaag

SEQ ID NO: 362794 - RNA, 64 nt, hsa
ccuaccuuuuccauccuccuccucugccuucaaaaaaggaaacuuucccuugguugucuuaauu

SEQ ID NO: 362795 - RNA, 64 nt, hsa
cgguaaauggcauccccuuaggcgccucuuugggaaaggaaaguggaugcuccuuugaggcagg

SEQ ID NO: 362796 - RNA, 64 nt, hsa
gccacaaagaagaaaaagaaacaguuugggaagaaaaggaaaagaaucccgcccacuaagacgc

SEQ ID NO: 362797 - RNA, 64 nt, hsa
uuucuguguuugugaggacugacucccauuuccuaaaggaaaugcccccggggaggacauuggg

SEQ ID NO: 362798 - RNA, 64 nt, hsa
auuaagcauaugugcuuucgcagcugauaauauaaaaggaaaucccacagucuagauauagccc

SEQ ID NO: 362799 - RNA, 64 nt, hsa
cuaccuaauuuucaagcauggaucuccauauuucaaaggaaaguuuuaaaaauguuuuuaaaac

SEQ ID NO: 362800 - RNA, 64 nt, hsa
gaggaauggcuuuguggucgucguugugcucacgaaaggaaaaauggggaggucuuuuuuuucu

SEQ ID NO: 362801 - RNA, 64 nt, hsa
gguugaaagugaaacuuugagcacuaccagaagaaaaggaaaccucgggacucuauucauccac

SEQ ID NO: 362802 - RNA, 64 nt, hsa
aacuuguauaguguguuuaaaugggacacauuucaaaggaaauaaaucaguguccguuugccag

SEQ ID NO: 362803 - RNA, 64 nt, hsa
acaaaaaaaaucugaauucagccuucaguuuaaaaaaggaaaaggacuuuuuuuuuaaacuuua

SEQ ID NO: 362804 - RNA, 64 nt, hsa
aauauuuaaugugugaacagcuacugugacaugcaaaggaaaggacagugcagaauuaaaccgu

SEQ ID NO: 362805 - RNA, 64 nt, hsa
aucuuuaaauuuucccacaccauaagagaggagcaaaggaaauuaccaguuuagacuaaguuac

SEQ ID NO: 362806 - RNA, 64 nt, hsa
ucauuguccuuucuccaguuuuuguuccagaauaaaaggaaauauuuuaaaagccacguuauag

SEQ ID NO: 362807 - RNA, 64 nt, hsa
aaagaacauaagaacucaaggagaacauaagagaaaaggaaaccuguuacagaaaagacaagaa

SEQ ID NO: 362808 - RNA, 64 nt, hsa
gauacagauuuagacaaagacaagagcaucagacaaaggaaaagagaggaggauagagucaagg

SEQ ID NO: 362809 - RNA, 64 nt, hsa
aaagaaaggccagagaaagagcaguccaagcauaaaaggaaaaagaguuaugaagauacagauu

SEQ ID NO: 362810 - RNA, 64 nt, hsa
gguguaaaaagggaauaacuguaugcagguuugaaaaggaaaugugcuuuaggcaugagucaua

SEQ ID NO: 362811 - RNA, 64 nt, hsa
uuuauuucauacuaaacuagugaauaagugaaauaaaggaaacucgucauuaaucuaaagacag

SEQ ID NO: 362812 - RNA, 64 nt, hsa; identical to SEQ ID NO: 89176

SEQ ID NO: 362813 - RNA, 64 nt, hsa; identical to SEQ ID NO: 89177

SEQ ID NO: 362814 - RNA, 64 nt, hsa; identical to SEQ ID NO: 89178

SEQ ID NO: 362815 - RNA, 64 nt, hsa; identical to SEQ ID NO: 89179

SEQ ID NO: 362816 - RNA, 64 nt, hsa; identical to SEQ ID NO: 89180

SEQ ID NO: 362817 - RNA, 64 nt, hsa; identical to SEQ ID NO: 89181

SEQ ID NO: 362818 - RNA, 64 nt, hsa
gaggaugucagcugccaauuguguuuuccugcagcaauuccauaaacacauccuggugucauca

SEQ ID NO: 362819 - RNA, 64 nt, hsa
cuugagauucuuuauacucucugccuucagcaaucaauuccauucauacaucagcacucugcug

SEQ ID NO: 362820 - RNA, 64 nt, hsa
gaucacugccagagauaaacuaaugguccacacccaauuccacucugauagaauuauuucacaa

SEQ ID NO: 362821 - RNA, 64 nt, hsa
agguguuuguuuaauggacacuuuucaccuccuucaauuccauauauccuuuucuucuauguag

SEQ ID NO: 362822 - RNA, 64 nt, hsa
auugccaccaagcccacguacccgcccaugaacccaauuccagcaccguugccuccugacauac

SEQ ID NO: 362823 - RNA, 64 nt, hsa
cucaagauuuuuggagagcagagguggucucuggcaauuccaucugguuuugagaaacuuagca

SEQ ID NO: 362824 - RNA, 64 nt, hsa
guuucaccccuuuucuuccuucagcagaggccaggcuauggagcagggccacugaauuugcugu

SEQ ID NO: 362825 - RNA, 64 nt, hsa
auaucacucuucagguuuagcuuacagagccauggcuauggauucuuagcucuguaaggaagug

SEQ ID NO: 362826 - RNA, 64 nt, hsa
ggcugcuaauaccuuggacuuuggacagaauggagcuauggacguuaauuugaccgucuacucc

SEQ ID NO: 362827 - RNA, 64 nt, hsa
ggcuucugaagguaaagggacacuggauccagaagcuauggaaccagcaguugauucuuguauu

SEQ ID NO: 362828 - RNA, 64 nt, hsa; identical to SEQ ID NO: 133550

SEQ ID NO: 362829 - RNA, 64 nt, hsa; identical to SEQ ID NO: 133551

SEQ ID NO: 362830 - RNA, 64 nt, hsa; identical to SEQ ID NO: 133552

SEQ ID NO: 362831 - RNA, 64 nt, hsa; identical to SEQ ID NO: 133553

SEQ ID NO: 362832 - RNA, 64 nt, hsa; identical to SEQ ID NO: 133554

SEQ ID NO: 362833 - RNA, 64 nt, hsa; identical to SEQ ID NO: 133555

SEQ ID NO: 362834 - RNA, 64 nt, hsa; identical to SEQ ID NO: 133556

SEQ ID NO: 362835 - RNA, 64 nt, hsa; identical to SEQ ID NO: 133557

SEQ ID NO: 362836 - RNA, 64 nt, hsa; identical to SEQ ID NO: 133558

SEQ ID NO: 362837 - RNA, 64 nt, hsa; identical to SEQ ID NO: 133559

SEQ ID NO: 362838 - RNA, 64 nt, hsa; identical to SEQ ID NO: 133560

SEQ ID NO: 362839 - RNA, 64 nt, hsa; identical to SEQ ID NO: 133561

SEQ ID NO: 362840 - RNA, 64 nt, hsa; identical to SEQ ID NO: 133562

SEQ ID NO: 362841 - RNA, 64 nt, hsa; identical to SEQ ID NO: 133563

SEQ ID NO: 362842 - RNA, 64 nt, hsa; identical to SEQ ID NO: 133564

SEQ ID NO: 362843 - RNA, 64 nt, hsa; identical to SEQ ID NO: 133565

SEQ ID NO: 362844 - RNA, 64 nt, hsa; identical to SEQ ID NO: 133566

SEQ ID NO: 362845 - RNA, 64 nt, hsa; identical to SEQ ID NO: 133567

SEQ ID NO: 362846 - RNA, 64 nt, hsa; identical to SEQ ID NO: 133568

SEQ ID NO: 362847 - RNA, 64 nt, hsa; identical to SEQ ID NO: 133569

SEQ ID NO: 362848 - RNA, 64 nt, hsa; identical to SEQ ID NO: 133570

SEQ ID NO: 362849 - RNA, 64 nt, hsa; identical to SEQ ID NO: 133571

SEQ ID NO: 362850 - RNA, 64 nt, hsa; identical to SEQ ID NO: 133572

SEQ ID NO: 362851 - RNA, 64 nt, hsa; identical to SEQ ID NO: 133573

SEQ ID NO: 362852 - RNA, 64 nt, hsa; identical to SEQ ID NO: 133574

SEQ ID NO: 362853 - RNA, 64 nt, hsa; identical to SEQ ID NO: 133575

SEQ ID NO: 362854 - RNA, 64 nt, hsa; identical to SEQ ID NO: 133576

SEQ ID NO: 362855 - RNA, 64 nt, hsa; identical to SEQ ID NO: 133577

SEQ ID NO: 362856 - RNA, 64 nt, hsa; identical to SEQ ID NO: 133578

SEQ ID NO: 362857 - RNA, 64 nt, hsa; identical to SEQ ID NO: 133579

SEQ ID NO: 362858 - RNA, 64 nt, hsa; identical to SEQ ID NO: 133580

SEQ ID NO: 362859 - RNA, 64 nt, hsa; identical to SEQ ID NO: 133581

SEQ ID NO: 362860 - RNA, 64 nt, hsa; identical to SEQ ID NO: 133582

SEQ ID NO: 362861 - RNA, 64 nt, hsa; identical to SEQ ID NO: 133583

SEQ ID NO: 362862 - RNA, 64 nt, hsa; identical to SEQ ID NO: 133584

SEQ ID NO: 362863 - RNA, 64 nt, hsa; identical to SEQ ID NO: 133585

SEQ ID NO: 362864 - RNA, 64 nt, hsa; identical to SEQ ID NO: 133586

SEQ ID NO: 362865 - RNA, 64 nt, hsa; identical to SEQ ID NO: 133587

SEQ ID NO: 362866 - RNA, 64 nt, hsa; identical to SEQ ID NO: 133588

SEQ ID NO: 362867 - RNA, 64 nt, hsa; identical to SEQ ID NO: 133589

SEQ ID NO: 362868 - RNA, 64 nt, hsa; identical to SEQ ID NO: 133590

SEQ ID NO: 362869 - RNA, 64 nt, hsa; identical to SEQ ID NO: 133591

SEQ ID NO: 362870 - RNA, 64 nt, hsa; identical to SEQ ID NO: 133592

SEQ ID NO: 362871 - RNA, 64 nt, hsa; identical to SEQ ID NO: 133593

SEQ ID NO: 362872 - RNA, 64 nt, hsa; identical to SEQ ID NO: 133594

SEQ ID NO: 362873 - RNA, 64 nt, hsa; identical to SEQ ID NO: 133595

SEQ ID NO: 362874 - RNA, 64 nt, hsa; identical to SEQ ID NO: 133596

SEQ ID NO: 362875 - RNA, 64 nt, hsa; identical to SEQ ID NO: 133597

SEQ ID NO: 362876 - RNA, 64 nt, hsa; identical to SEQ ID NO: 133598

SEQ ID NO: 362877 - RNA, 64 nt, hsa; identical to SEQ ID NO: 133599

SEQ ID NO: 362878 - RNA, 64 nt, hsa; identical to SEQ ID NO: 133600

SEQ ID NO: 362879 - RNA, 64 nt, hsa; identical to SEQ ID NO: 133601

SEQ ID NO: 362880 - RNA, 64 nt, hsa; identical to SEQ ID NO: 133602

SEQ ID NO: 362881 - RNA, 64 nt, hsa; identical to SEQ ID NO: 133603

SEQ ID NO: 362882 - RNA, 64 nt, hsa; identical to SEQ ID NO: 133604

SEQ ID NO: 362883 - RNA, 64 nt, hsa; identical to SEQ ID NO: 133605

SEQ ID NO: 362884 - RNA, 64 nt, hsa; identical to SEQ ID NO: 133606

SEQ ID NO: 362885 - RNA, 64 nt, hsa; identical to SEQ ID NO: 133607

SEQ ID NO: 362886 - RNA, 64 nt, hsa; identical to SEQ ID NO: 133608

SEQ ID NO: 362887 - RNA, 64 nt, hsa; identical to SEQ ID NO: 133609

SEQ ID NO: 362888 - RNA, 64 nt, hsa; identical to SEQ ID NO: 133610

SEQ ID NO: 362889 - RNA, 52 nt, hsa; identical to SEQ ID NO: 133611

SEQ ID NO: 362890 - RNA, 55 nt, hsa; identical to SEQ ID NO: 133612

SEQ ID NO: 362891 - RNA, 64 nt, hsa; identical to SEQ ID NO: 133613

SEQ ID NO: 362892 - RNA, 64 nt, hsa; identical to SEQ ID NO: 133614

SEQ ID NO: 362893 - RNA, 64 nt, hsa; identical to SEQ ID NO: 133615

SEQ ID NO: 362894 - RNA, 64 nt, hsa; identical to SEQ ID NO: 133616

SEQ ID NO: 362895 - RNA, 64 nt, hsa; identical to SEQ ID NO: 133617

SEQ ID NO: 362896 - RNA, 64 nt, hsa; identical to SEQ ID NO: 133618

SEQ ID NO: 362897 - RNA, 64 nt, hsa; identical to SEQ ID NO: 133619

SEQ ID NO: 362898 - RNA, 64 nt, hsa; identical to SEQ ID NO: 133620

SEQ ID NO: 362899 - RNA, 64 nt, hsa; identical to SEQ ID NO: 133621

SEQ ID NO: 362900 - RNA, 64 nt, hsa; identical to SEQ ID NO: 133622

SEQ ID NO: 362901 - RNA, 64 nt, hsa; identical to SEQ ID NO: 133623

SEQ ID NO: 362902 - RNA, 64 nt, hsa; identical to SEQ ID NO: 133624

SEQ ID NO: 362903 - RNA, 64 nt, hsa; identical to SEQ ID NO: 133625

SEQ ID NO: 362904 - RNA, 64 nt, hsa; identical to SEQ ID NO: 133626

SEQ ID NO: 362905 - RNA, 64 nt, hsa; identical to SEQ ID NO: 133627

SEQ ID NO: 362906 - RNA, 64 nt, hsa; identical to SEQ ID NO: 133628

SEQ ID NO: 362907 - RNA, 64 nt, hsa; identical to SEQ ID NO: 133629

SEQ ID NO: 362908 - RNA, 64 nt, hsa; identical to SEQ ID NO: 133630

SEQ ID NO: 362909 - RNA, 64 nt, hsa; identical to SEQ ID NO: 133631

SEQ ID NO: 362910 - RNA, 64 nt, hsa; identical to SEQ ID NO: 133632

SEQ ID NO: 362911 - RNA, 64 nt, hsa; identical to SEQ ID NO: 133633

SEQ ID NO: 362912 - RNA, 64 nt, hsa; identical to SEQ ID NO: 133634

SEQ ID NO: 362913 - RNA, 64 nt, hsa; identical to SEQ ID NO: 133635

SEQ ID NO: 362914 - RNA, 64 nt, hsa; identical to SEQ ID NO: 133636

SEQ ID NO: 362915 - RNA, 64 nt, hsa; identical to SEQ ID NO: 133637

SEQ ID NO: 362916 - RNA, 64 nt, hsa; identical to SEQ ID NO: 133638

SEQ ID NO: 362917 - RNA, 63 nt, hsa; identical to SEQ ID NO: 133639

SEQ ID NO: 362918 - RNA, 51 nt, hsa; identical to SEQ ID NO: 133640

SEQ ID NO: 362919 - RNA, 64 nt, hsa; identical to SEQ ID NO: 133641

SEQ ID NO: 362920 - RNA, 64 nt, hsa; identical to SEQ ID NO: 133642

SEQ ID NO: 362921 - RNA, 64 nt, hsa; identical to SEQ ID NO: 133643

SEQ ID NO: 362922 - RNA, 64 nt, hsa; identical to SEQ ID NO: 133644

SEQ ID NO: 362923 - RNA, 64 nt, hsa; identical to SEQ ID NO: 133645

SEQ ID NO: 362924 - RNA, 64 nt, hsa; identical to SEQ ID NO: 133646

SEQ ID NO: 362925 - RNA, 64 nt, hsa; identical to SEQ ID NO: 133647

SEQ ID NO: 362926 - RNA, 64 nt, hsa; identical to SEQ ID NO: 133648

SEQ ID NO: 362927 - RNA, 64 nt, hsa; identical to SEQ ID NO: 133649

SEQ ID NO: 362928 - RNA, 64 nt, hsa; identical to SEQ ID NO: 133650

SEQ ID NO: 362929 - RNA, 64 nt, hsa; identical to SEQ ID NO: 133651

SEQ ID NO: 362930 - RNA, 64 nt, hsa; identical to SEQ ID NO: 133652

SEQ ID NO: 362931 - RNA, 64 nt, hsa; identical to SEQ ID NO: 133653

SEQ ID NO: 362932 - RNA, 64 nt, hsa; identical to SEQ ID NO: 133654

SEQ ID NO: 362933 - RNA, 64 nt, hsa; identical to SEQ ID NO: 133655

SEQ ID NO: 362934 - RNA, 64 nt, hsa; identical to SEQ ID NO: 133656

SEQ ID NO: 362935 - RNA, 64 nt, hsa; identical to SEQ ID NO: 133657

SEQ ID NO: 362936 - RNA, 64 nt, hsa; identical to SEQ ID NO: 133658

SEQ ID NO: 362937 - RNA, 64 nt, hsa; identical to SEQ ID NO: 133659

SEQ ID NO: 362938 - RNA, 64 nt, hsa; identical to SEQ ID NO: 133660

SEQ ID NO: 362939 - RNA, 64 nt, hsa; identical to SEQ ID NO: 133661

SEQ ID NO: 362940 - RNA, 64 nt, hsa; identical to SEQ ID NO: 133662

SEQ ID NO: 362941 - RNA, 64 nt, hsa; identical to SEQ ID NO: 133663

SEQ ID NO: 362942 - RNA, 64 nt, hsa; identical to SEQ ID NO: 133664

SEQ ID NO: 362943 - RNA, 64 nt, hsa; identical to SEQ ID NO: 133665

SEQ ID NO: 362944 - RNA, 64 nt, hsa; identical to SEQ ID NO: 133666

SEQ ID NO: 362945 - RNA, 64 nt, hsa; identical to SEQ ID NO: 133667

SEQ ID NO: 362946 - RNA, 64 nt, hsa; identical to SEQ ID NO: 133668

SEQ ID NO: 362947 - RNA, 64 nt, hsa; identical to SEQ ID NO: 133669

SEQ ID NO: 362948 - RNA, 64 nt, hsa; identical to SEQ ID NO: 133670

SEQ ID NO: 362949 - RNA, 64 nt, hsa; identical to SEQ ID NO: 133671

SEQ ID NO: 362950 - RNA, 64 nt, hsa; identical to SEQ ID NO: 133672

SEQ ID NO: 362951 - RNA, 64 nt, hsa; identical to SEQ ID NO: 133673

SEQ ID NO: 362952 - RNA, 64 nt, hsa; identical to SEQ ID NO: 133674

SEQ ID NO: 362953 - RNA, 64 nt, hsa; identical to SEQ ID NO: 133675

SEQ ID NO: 362954 - RNA, 64 nt, hsa; identical to SEQ ID NO: 133676

SEQ ID NO: 362955 - RNA, 50 nt, hsa; identical to SEQ ID NO: 133677

SEQ ID NO: 362956 - RNA, 64 nt, hsa; identical to SEQ ID NO: 133678

SEQ ID NO: 362957 - RNA, 64 nt, hsa; identical to SEQ ID NO: 133679

SEQ ID NO: 362958 - RNA, 64 nt, hsa; identical to SEQ ID NO: 133680

SEQ ID NO: 362959 - RNA, 64 nt, hsa; identical to SEQ ID NO: 133681

SEQ ID NO: 362960 - RNA, 64 nt, hsa; identical to SEQ ID NO: 133682

SEQ ID NO: 362961 - RNA, 64 nt, hsa; identical to SEQ ID NO: 133683

SEQ ID NO: 362962 - RNA, 64 nt, hsa; identical to SEQ ID NO: 133684

SEQ ID NO: 362963 - RNA, 64 nt, hsa; identical to SEQ ID NO: 133685

SEQ ID NO: 362964 - RNA, 64 nt, hsa; identical to SEQ ID NO: 133686

SEQ ID NO: 362965 - RNA, 64 nt, hsa; identical to SEQ ID NO: 133687

SEQ ID NO: 362966 - RNA, 64 nt, hsa; identical to SEQ ID NO: 133688

SEQ ID NO: 362967 - RNA, 64 nt, hsa; identical to SEQ ID NO: 133689

SEQ ID NO: 362968 - RNA, 64 nt, hsa; identical to SEQ ID NO: 133690

SEQ ID NO: 362969 - RNA, 64 nt, hsa; identical to SEQ ID NO: 133691

SEQ ID NO: 362970 - RNA, 64 nt, hsa; identical to SEQ ID NO: 133692

SEQ ID NO: 362971 - RNA, 64 nt, hsa; identical to SEQ ID NO: 133693

SEQ ID NO: 362972 - RNA, 64 nt, hsa; identical to SEQ ID NO: 133694

SEQ ID NO: 362973 - RNA, 64 nt, hsa; identical to SEQ ID NO: 133695

SEQ ID NO: 362974 - RNA, 64 nt, hsa; identical to SEQ ID NO: 133696

SEQ ID NO: 362975 - RNA, 64 nt, hsa; identical to SEQ ID NO: 133697

SEQ ID NO: 362976 - RNA, 64 nt, hsa; identical to SEQ ID NO: 133698

SEQ ID NO: 362977 - RNA, 64 nt, hsa; identical to SEQ ID NO: 133699

SEQ ID NO: 362978 - RNA, 64 nt, hsa; identical to SEQ ID NO: 133700

SEQ ID NO: 362979 - RNA, 64 nt, hsa; identical to SEQ ID NO: 133701

SEQ ID NO: 362980 - RNA, 64 nt, hsa; identical to SEQ ID NO: 133702

SEQ ID NO: 362981 - RNA, 64 nt, hsa; identical to SEQ ID NO: 133703

SEQ ID NO: 362982 - RNA, 64 nt, hsa; identical to SEQ ID NO: 133704

SEQ ID NO: 362983 - RNA, 64 nt, hsa; identical to SEQ ID NO: 133705

SEQ ID NO: 362984 - RNA, 64 nt, hsa; identical to SEQ ID NO: 133706

SEQ ID NO: 362985 - RNA, 64 nt, hsa; identical to SEQ ID NO: 133707

SEQ ID NO: 362986 - RNA, 64 nt, hsa; identical to SEQ ID NO: 133708

SEQ ID NO: 362987 - RNA, 64 nt, hsa; identical to SEQ ID NO: 133709

SEQ ID NO: 362988 - RNA, 64 nt, hsa; identical to SEQ ID NO: 133710

SEQ ID NO: 362989 - RNA, 64 nt, hsa; identical to SEQ ID NO: 133711

SEQ ID NO: 362990 - RNA, 64 nt, hsa; identical to SEQ ID NO: 133712

SEQ ID NO: 362991 - RNA, 64 nt, hsa; identical to SEQ ID NO: 133713

SEQ ID NO: 362992 - RNA, 64 nt, hsa; identical to SEQ ID NO: 133714

SEQ ID NO: 362993 - RNA, 64 nt, hsa; identical to SEQ ID NO: 133715

SEQ ID NO: 362994 - RNA, 64 nt, hsa; identical to SEQ ID NO: 133716

SEQ ID NO: 362995 - RNA, 64 nt, hsa; identical to SEQ ID NO: 133717

SEQ ID NO: 362996 - RNA, 64 nt, hsa; identical to SEQ ID NO: 133718

SEQ ID NO: 362997 - RNA, 64 nt, hsa; identical to SEQ ID NO: 133719

SEQ ID NO: 362998 - RNA, 64 nt, hsa; identical to SEQ ID NO: 133720

SEQ ID NO: 362999 - RNA, 64 nt, hsa; identical to SEQ ID NO: 133721

SEQ ID NO: 363000 - RNA, 64 nt, hsa; identical to SEQ ID NO: 133722

SEQ ID NO: 363001 - RNA, 64 nt, hsa; identical to SEQ ID NO: 133723

SEQ ID NO: 363002 - RNA, 64 nt, hsa; identical to SEQ ID NO: 133724

SEQ ID NO: 363003 - RNA, 64 nt, hsa; identical to SEQ ID NO: 133725

SEQ ID NO: 363004 - RNA, 64 nt, hsa; identical to SEQ ID NO: 133726

SEQ ID NO: 363005 - RNA, 64 nt, hsa; identical to SEQ ID NO: 133727

SEQ ID NO: 363006 - RNA, 64 nt, hsa; identical to SEQ ID NO: 133728

SEQ ID NO: 363007 - RNA, 64 nt, hsa; identical to SEQ ID NO: 133729

SEQ ID NO: 363008 - RNA, 64 nt, hsa; identical to SEQ ID NO: 133730

SEQ ID NO: 363009 - RNA, 64 nt, hsa; identical to SEQ ID NO: 133731

SEQ ID NO: 363010 - RNA, 64 nt, hsa; identical to SEQ ID NO: 133732

SEQ ID NO: 363011 - RNA, 64 nt, hsa; identical to SEQ ID NO: 133733

SEQ ID NO: 363012 - RNA, 64 nt, hsa; identical to SEQ ID NO: 133734

SEQ ID NO: 363013 - RNA, 64 nt, hsa; identical to SEQ ID NO: 133735

SEQ ID NO: 363014 - RNA, 64 nt, hsa; identical to SEQ ID NO: 133736

SEQ ID NO: 363015 - RNA, 64 nt, hsa; identical to SEQ ID NO: 133737

SEQ ID NO: 363016 - RNA, 64 nt, hsa; identical to SEQ ID NO: 133738

SEQ ID NO: 363017 - RNA, 64 nt, hsa; identical to SEQ ID NO: 133739

SEQ ID NO: 363018 - RNA, 64 nt, hsa; identical to SEQ ID NO: 133740

SEQ ID NO: 363019 - RNA, 64 nt, hsa; identical to SEQ ID NO: 133741

SEQ ID NO: 363020 - RNA, 64 nt, hsa; identical to SEQ ID NO: 133742

SEQ ID NO: 363021 - RNA, 64 nt, hsa; identical to SEQ ID NO: 133743

SEQ ID NO: 363022 - RNA, 64 nt, hsa; identical to SEQ ID NO: 133744

SEQ ID NO: 363023 - RNA, 64 nt, hsa; identical to SEQ ID NO: 133745

SEQ ID NO: 363024 - RNA, 64 nt, hsa; identical to SEQ ID NO: 133746

SEQ ID NO: 363025 - RNA, 64 nt, hsa; identical to SEQ ID NO: 133747

SEQ ID NO: 363026 - RNA, 64 nt, hsa; identical to SEQ ID NO: 133748

SEQ ID NO: 363027 - RNA, 64 nt, hsa; identical to SEQ ID NO: 133749

SEQ ID NO: 363028 - RNA, 64 nt, hsa; identical to SEQ ID NO: 133750

SEQ ID NO: 363029 - RNA, 64 nt, hsa; identical to SEQ ID NO: 133751

SEQ ID NO: 363030 - RNA, 64 nt, hsa; identical to SEQ ID NO: 133752

SEQ ID NO: 363031 - RNA, 64 nt, hsa; identical to SEQ ID NO: 133753

SEQ ID NO: 363032 - RNA, 64 nt, hsa; identical to SEQ ID NO: 133754

SEQ ID NO: 363033 - RNA, 64 nt, hsa; identical to SEQ ID NO: 133755

SEQ ID NO: 363034 - RNA, 64 nt, hsa; identical to SEQ ID NO: 133756

SEQ ID NO: 363035 - RNA, 64 nt, hsa; identical to SEQ ID NO: 133757

SEQ ID NO: 363036 - RNA, 64 nt, hsa; identical to SEQ ID NO: 133758

SEQ ID NO: 363037 - RNA, 64 nt, hsa; identical to SEQ ID NO: 133759

SEQ ID NO: 363038 - RNA, 64 nt, hsa; identical to SEQ ID NO: 133760

SEQ ID NO: 363039 - RNA, 64 nt, hsa; identical to SEQ ID NO: 133761

SEQ ID NO: 363040 - RNA, 64 nt, hsa; identical to SEQ ID NO: 133762

SEQ ID NO: 363041 - RNA, 64 nt, hsa; identical to SEQ ID NO: 133763

SEQ ID NO: 363042 - RNA, 64 nt, hsa; identical to SEQ ID NO: 133764

SEQ ID NO: 363043 - RNA, 64 nt, hsa; identical to SEQ ID NO: 133765

SEQ ID NO: 363044 - RNA, 60 nt, hsa; identical to SEQ ID NO: 133766

SEQ ID NO: 363045 - RNA, 57 nt, hsa; identical to SEQ ID NO: 133767

SEQ ID NO: 363046 - RNA, 64 nt, hsa; identical to SEQ ID NO: 133768

SEQ ID NO: 363047 - RNA, 64 nt, hsa; identical to SEQ ID NO: 133769

SEQ ID NO: 363048 - RNA, 64 nt, hsa; identical to SEQ ID NO: 133770

SEQ ID NO: 363049 - RNA, 64 nt, hsa; identical to SEQ ID NO: 133771

SEQ ID NO: 363050 - RNA, 64 nt, hsa; identical to SEQ ID NO: 133772

SEQ ID NO: 363051 - RNA, 64 nt, hsa; identical to SEQ ID NO: 133773

SEQ ID NO: 363052 - RNA, 64 nt, hsa; identical to SEQ ID NO: 133774

SEQ ID NO: 363053 - RNA, 64 nt, hsa; identical to SEQ ID NO: 133775

SEQ ID NO: 363054 - RNA, 64 nt, hsa; identical to SEQ ID NO: 133776

SEQ ID NO: 363055 - RNA, 64 nt, hsa; identical to SEQ ID NO: 133777

SEQ ID NO: 363056 - RNA, 64 nt, hsa; identical to SEQ ID NO: 133778

SEQ ID NO: 363057 - RNA, 64 nt, hsa; identical to SEQ ID NO: 133779

SEQ ID NO: 363058 - RNA, 64 nt, hsa; identical to SEQ ID NO: 133780

SEQ ID NO: 363059 - RNA, 64 nt, hsa; identical to SEQ ID NO: 133781

SEQ ID NO: 363060 - RNA, 64 nt, hsa; identical to SEQ ID NO: 133782

SEQ ID NO: 363061 - RNA, 64 nt, hsa; identical to SEQ ID NO: 133783

SEQ ID NO: 363062 - RNA, 64 nt, hsa; identical to SEQ ID NO: 133784

SEQ ID NO: 363063 - RNA, 64 nt, hsa; identical to SEQ ID NO: 133785

SEQ ID NO: 363064 - RNA, 64 nt, hsa; identical to SEQ ID NO: 133786

SEQ ID NO: 363065 - RNA, 64 nt, hsa; identical to SEQ ID NO: 133787

SEQ ID NO: 363066 - RNA, 64 nt, hsa; identical to SEQ ID NO: 133788

SEQ ID NO: 363067 - RNA, 64 nt, hsa; identical to SEQ ID NO: 133789

SEQ ID NO: 363068 - RNA, 64 nt, hsa; identical to SEQ ID NO: 133790

SEQ ID NO: 363069 - RNA, 64 nt, hsa; identical to SEQ ID NO: 133791

SEQ ID NO: 363070 - RNA, 64 nt, hsa; identical to SEQ ID NO: 133792

SEQ ID NO: 363071 - RNA, 64 nt, hsa; identical to SEQ ID NO: 133793

SEQ ID NO: 363072 - RNA, 64 nt, hsa; identical to SEQ ID NO: 133794

SEQ ID NO: 363073 - RNA, 64 nt, hsa; identical to SEQ ID NO: 133795

SEQ ID NO: 363074 - RNA, 64 nt, hsa; identical to SEQ ID NO: 133796

SEQ ID NO: 363075 - RNA, 64 nt, hsa; identical to SEQ ID NO: 133797

SEQ ID NO: 363076 - RNA, 64 nt, hsa; identical to SEQ ID NO: 133798

SEQ ID NO: 363077 - RNA, 64 nt, hsa; identical to SEQ ID NO: 133799

SEQ ID NO: 363078 - RNA, 64 nt, hsa; identical to SEQ ID NO: 133800

SEQ ID NO: 363079 - RNA, 64 nt, hsa; identical to SEQ ID NO: 133801

SEQ ID NO: 363080 - RNA, 64 nt, hsa; identical to SEQ ID NO: 133802

SEQ ID NO: 363081 - RNA, 64 nt, hsa; identical to SEQ ID NO: 133803

SEQ ID NO: 363082 - RNA, 64 nt, hsa; identical to SEQ ID NO: 133804

SEQ ID NO: 363083 - RNA, 64 nt, hsa; identical to SEQ ID NO: 133805

SEQ ID NO: 363084 - RNA, 64 nt, hsa; identical to SEQ ID NO: 133806

SEQ ID NO: 363085 - RNA, 64 nt, hsa; identical to SEQ ID NO: 133807

SEQ ID NO: 363086 - RNA, 64 nt, hsa; identical to SEQ ID NO: 133808

SEQ ID NO: 363087 - RNA, 64 nt, hsa; identical to SEQ ID NO: 133809

SEQ ID NO: 363088 - RNA, 64 nt, hsa; identical to SEQ ID NO: 133810

SEQ ID NO: 363089 - RNA, 64 nt, hsa; identical to SEQ ID NO: 133811

SEQ ID NO: 363090 - RNA, 64 nt, hsa; identical to SEQ ID NO: 133812

SEQ ID NO: 363091 - RNA, 64 nt, hsa; identical to SEQ ID NO: 133813

SEQ ID NO: 363092 - RNA, 64 nt, hsa; identical to SEQ ID NO: 133814

SEQ ID NO: 363093 - RNA, 64 nt, hsa; identical to SEQ ID NO: 133815

SEQ ID NO: 363094 - RNA, 64 nt, hsa; identical to SEQ ID NO: 133816

SEQ ID NO: 363095 - RNA, 64 nt, hsa; identical to SEQ ID NO: 133817

SEQ ID NO: 363096 - RNA, 64 nt, hsa; identical to SEQ ID NO: 133818

SEQ ID NO: 363097 - RNA, 64 nt, hsa; identical to SEQ ID NO: 133819

SEQ ID NO: 363098 - RNA, 64 nt, hsa; identical to SEQ ID NO: 133820

SEQ ID NO: 363099 - RNA, 64 nt, hsa; identical to SEQ ID NO: 133821

SEQ ID NO: 363100 - RNA, 64 nt, hsa; identical to SEQ ID NO: 133822

SEQ ID NO: 363101 - RNA, 64 nt, hsa; identical to SEQ ID NO: 133823

SEQ ID NO: 363102 - RNA, 64 nt, hsa; identical to SEQ ID NO: 133824

SEQ ID NO: 363103 - RNA, 64 nt, hsa; identical to SEQ ID NO: 133825

SEQ ID NO: 363104 - RNA, 64 nt, hsa; identical to SEQ ID NO: 133826

SEQ ID NO: 363105 - RNA, 64 nt, hsa; identical to SEQ ID NO: 133827

SEQ ID NO: 363106 - RNA, 64 nt, hsa; identical to SEQ ID NO: 133828

SEQ ID NO: 363107 - RNA, 64 nt, hsa; identical to SEQ ID NO: 133829

SEQ ID NO: 363108 - RNA, 61 nt, hsa
caggcgggacucgugucccagagaggaaggggcugcugaggucugauggggcccuuccucc

SEQ ID NO: 363109 - RNA, 61 nt, hsa
guugcucccgugcugccugcgccagccccaggcugcugaggagcagaggccagaccagggc

SEQ ID NO: 363110 - RNA, 61 nt, hsa
cgggcccugugcugggggugguagaaaggaugcugcugaggcagcuggaggagugggagua

SEQ ID NO: 363111 - RNA, 61 nt, hsa
cugaaagaaguauggccaaaagcacuuuaaugcugcugacauuguuguuuuuauguucauu

SEQ ID NO: 363112 - RNA, 61 nt, hsa
aaagcccaguucuugcugucuucuaccaggggcugcugacuccaguuacccauggaaugca

SEQ ID NO: 363113 - RNA, 61 nt, hsa
aaacuuugaaaagugucaauauuccauguaugcugcugaaaugaaguuaaguuuggaaaga

SEQ ID NO: 363114 - RNA, 61 nt, hsa
ccugucucaguucuucagagagcuuccaccagcugcugaguuugugaagacaguggaguuc

SEQ ID NO: 363115 - RNA, 61 nt, hsa
cauuuugugcuuuuagaacagggaauugauagcugcugagcugaagcaguggguucagcug

SEQ ID NO: 363116 - RNA, 61 nt, hsa
guaccaauuuacuguauuaguccguuuucacgcugcugauaaagacauacccgagacuggg

SEQ ID NO: 363117 - RNA, 61 nt, hsa
gcuucaagcaucuguauuagucuguauuaaugcugcugauaaagacguacccgagacuggg

SEQ ID NO: 363118 - RNA, 61 nt, hsa
acuccucucaggugcacccgcuagcugugcugcugcugaccgacggggacgugcacauccg

SEQ ID NO: 363119 - RNA, 61 nt, hsa
ugcggcuggagggugacucgcguaccgugcggcugcugaaggagcugcggcgggcccuggg

SEQ ID NO: 363120 - RNA, 61 nt, hsa
cccguggugacggccacacggacuucguggcgcugcugacagggccgaggucgcaggcggu

SEQ ID NO: 363121 - RNA, 61 nt, hsa
uugggccuccuggaacgccagggccucggcggcugcugaagggauucuauggcucagaggu

SEQ ID NO: 363122 - RNA, 61 nt, hsa
uacuaguccaaucacccccaggaccucuucagcugcugacaauccuauuuagcauaugcaa

SEQ ID NO: 363123 - RNA, 61 nt, hsa
cccugcggcucuggaaagcaacuucaucccagcugcugaggcgaaauauaaaacugagacu

SEQ ID NO: 363124 - RNA, 61 nt, hsa
ccaggagguggaacugaaucagccuggaauggcugcugagagcucagcugcaaguugcugg

SEQ ID NO: 363125 - RNA, 61 nt, hsa
aacaaugaaccagaggcuuggucagugugcagcugcugagcaaaaggguuagagggugggg

SEQ ID NO: 363126 - RNA, 61 nt, hsa
aaaauggaaguggauucuggauggccgggcugcugcugauguaggagcuggauuugggagc

SEQ ID NO: 363127 - RNA, 61 nt, hsa
uguaggagugagaagaaggaagaucuugagagcugcugagggaccuuggagagcucaggau

SEQ ID NO: 363128 - RNA, 61 nt, hsa
gcugcugaagaggagggaggccucguggacugcugcugagaaaccgaguucagaccgagca

SEQ ID NO: 363129 - RNA, 61 nt, hsa
uaaaauuccaaggauauaugccccaacgaaugcugcugaagaggagggaggccucguggac

SEQ ID NO: 363130 - RNA, 61 nt, hsa
uaauguccauaucuagccaucuauuacaccagcugcugaggauuuacuuggugcccucauc

SEQ ID NO: 363131 - RNA, 61 nt, hsa
caccucccuucccucccuggcuuugggaagagcugcugagcucuuugccugccacucaggg

SEQ ID NO: 363132 - RNA, 61 nt, hsa
cugugcuuugucauugaauccuaaguucuuagcugcugaugcaaguugucccccaaggcca

SEQ ID NO: 363133 - RNA, 61 nt, hsa
uccauaacccucuguauugacugcaauguaagcugcugaggagacugguucuguuggucag

SEQ ID NO: 363134 - RNA, 61 nt, hsa
ucguggagcgccaucaugucuuaccagugacgcugcugacaccccugacuuuuauuaaaga

SEQ ID NO: 363135 - RNA, 61 nt, hsa
caagcccgaccgggccaggccugggugaucugcugcugagacgccacggagggcuggggau

SEQ ID NO: 363136 - RNA, 61 nt, hsa
cuucugagaccaccuuccccacugagccccagcugcugagaaggccuugagggaaguagag

SEQ ID NO: 363137 - RNA, 61 nt, hsa
aagucagagcaccuggacagguguccucccugcugcugacccugcagagggaagggguggg

SEQ ID NO: 363138 - RNA, 64 nt, hsa
aucaaggugauugugauuauagugacaaugaagaugaugcuauuaauacugcauaaaaagugcc

SEQ ID NO: 363139 - RNA, 64 nt, hsa
uuguuguuauuaacagcugauacagguauucugcugaugcuacugcugccuaguuaccaugaac

SEQ ID NO: 363140 - RNA, 64 nt, hsa
cacgcugggcaaugagaauccuuggaaacauuggugaugcuaucaguuuuauagcuuuauuucu

SEQ ID NO: 363141 - RNA, 64 nt, hsa
gggggagggcgcuggaugcaaaaguugaagaucgugaugcuaugauguuaguuuuccuuagcug

SEQ ID NO: 363142 - RNA, 64 nt, hsa
gagggagcaaggggaguuugagggaaucagagcuugaugcuacuguacagaacuggacagguug

SEQ ID NO: 363143 - RNA, 64 nt, hsa
aggcugccuuuccucuagagucacuaauuuuaccugaugcuaugagagaaucauauugaagaug

SEQ ID NO: 363144 - RNA, 64 nt, hsa
uauuuuguauuuuuauuggaauaaauuaauuuuaugaugcuaauucuuuaaaaguuuauuuuuu

SEQ ID NO: 363145 - RNA, 64 nt, hsa
aacuaggcacauuuuuaagaaaguuguguaauggugaugcuaaagaaaugucuguacaaaauaa

SEQ ID NO: 363146 - RNA, 64 nt, hsa
cauuaauuuucaugaacaagaauauguaccuuuuugaugcuauauuacugcgauuaaaaaguuc

SEQ ID NO: 363147 - RNA, 64 nt, hsa
ugaagagaugccuuuguuucaugagauucaaacuugaugcuaugcuuuaaaauaaacucaguac

SEQ ID NO: 363148 - RNA, 64 nt, hsa
uucuggagaggacagucagcugagcaccucccauccugcucacacguccuuccccauaacuaug

SEQ ID NO: 363149 - RNA, 64 nt, hsa
ucuagguuggggcucggcuguggcccuggggucuccugcucagcucagaagagccuucuggaga

SEQ ID NO: 363150 - RNA, 64 nt, hsa
gcuccgugccuguccacaaugaccuagagugcauccugcucauugucaguguagccccucgccc

SEQ ID NO: 363151 - RNA, 64 nt, hsa
uucucauuauuggcuaguuagcuuucuuuaucaaccugcucacucacaaaugugugcccucagc

SEQ ID NO: 363152 - RNA, 64 nt, hsa
cucuguguguagugagugacccuggcaguguuugccugcucagaguggccccucagaacaacag

SEQ ID NO: 363153 - RNA, 64 nt, hsa
gggagugggugcccauucugaaaaacgaggcauuccugcucauucccucugcuuagcugguggg

SEQ ID NO: 363154 - RNA, 64 nt, hsa
uuuccaacucagaaauucaauuuggauuuaaaagccugcucaaucccugaggacugauuucaga

SEQ ID NO: 363155 - RNA, 64 nt, hsa
uaccgucuuuuccuguuuccuagcugugugaauaccugcucacgucaaaugcauacaaguuuca

SEQ ID NO: 363156 - RNA, 64 nt, hsa
cagcauggcuugugagacucaugguguccuugucccugcucaccucucuggucucaucacuugc

SEQ ID NO: 363157 - RNA, 64 nt, hsa
cuuaaugggaagggggcaggggugaggagcugagccugcucaaggagugggaaguggggcuaua

SEQ ID NO: 363158 - RNA, 64 nt, hsa
gugacugaugguuugguuuccucucugcucugccccugcucagcacagggagaauguugacuua

SEQ ID NO: 363159 - RNA, 64 nt, hsa
acccucucugcaucuguccccaggaccuaugcucccugcucacccccuucuccaaagcccaagc

SEQ ID NO: 363160 - RNA, 64 nt, hsa
aguaaguagcaacccugugauacuauuaccaccaccugcucacuggucaaaaccuacacagcug

SEQ ID NO: 363161 - RNA, 64 nt, hsa
gauccaauaauuuuccugugacacuuauaaauauccugcucacaucugaaucuccuuguuguuc

SEQ ID NO: 363162 - RNA, 64 nt, hsa
gugugagccuaucagaguugcugcaaaccugaccccugcucaguaaagcacuugcaaccgucug

SEQ ID NO: 363163 - RNA, 64 nt, hsa
agcugccugguauauccaaaagcuuuuuauuccuccugcucauauugugauucugccuuugggg

SEQ ID NO: 363164 - RNA, 64 nt, hsa
guguucucagggagugcguggucuuggaugccauccugcucaucuccagcauuuccucucaccu

SEQ ID NO: 363165 - RNA, 64 nt, hsa
guguucucggggagugcguggugucagaucccauccugcucaucuccagcauuuccucucaccu

SEQ ID NO: 363166 - RNA, 64 nt, hsa
accgaaagccuccaacacaaacccuagcugccaaccugcucauuucuuagguuucacuggugag

SEQ ID NO: 363167 - RNA, 64 nt, hsa
cuggguauccgcguggugggcuggcagcugacggccugcucaguggagccaggagcuaacucag

SEQ ID NO: 363168 - RNA, 64 nt, hsa
ccaccuugaaaggacucuuggcuccugccggguuccugcucaggcuggaauugggaaaauaugc

SEQ ID NO: 363169 - RNA, 64 nt, hsa
ucucagaggcagauaccuaggggagcugcugcugccugcucauucuagcuuccgauuccauucc

SEQ ID NO: 363170 - RNA, 64 nt, hsa
uggaugaggggguccuuggguuucccagcugcuuccugcucagcugggccacccccucccaccc

SEQ ID NO: 363171 - RNA, 64 nt, hsa
cccugccccgggacccuaucugccuauccccuccccugcucagaguuuuuaagcccucucaacc

SEQ ID NO: 363172 - RNA, 64 nt, hsa
caccacugaagugaggacacaccggagccaggcgccugcucauguugaagugcgcuguucacac

SEQ ID NO: 363173 - RNA, 64 nt, hsa
cagcucccuucccugccuggaccauucccagcucccugcucacucuucucucagccaaagccuc

SEQ ID NO: 363174 - RNA, 64 nt, hsa
aggccucuacacaccccccacucuacuuaucaucccugcucacacacccuuguccaaggcuuua

SEQ ID NO: 363175 - RNA, 64 nt, hsa
gguggauggccaugggcugagccuccguaucaggccugcucaccuugcugggagcuuuauucug

SEQ ID NO: 363176 - RNA, 64 nt, hsa
aggggaaucauuuaauuuaaaucauuaagauuccccugcucaaacccagauuccuguguacaga

SEQ ID NO: 363177 - RNA, 64 nt, hsa
gaguccccuuugcccauccugaaugcacagucucccugcucaugcccuucaguccccugcuugg

SEQ ID NO: 363178 - RNA, 64 nt, hsa
cauuggguugucugucuccgucauggggagggucccugcucaguucuggagacacuggaguugg

SEQ ID NO: 363179 - RNA, 64 nt, hsa
gacagaggacucagaaguggccuuuccuccaaagccugcucagacacaggucuguagggccagg

SEQ ID NO: 363180 - RNA, 64 nt, hsa
cugugaucacccucucggccuccucccacaagcaccugcucaacauaggccugcucagccucua

SEQ ID NO: 363181 - RNA, 64 nt, hsa
cggccuccucccacaagcaccugcucaacauaggccugcucagccucuagcaccaggacucagg

SEQ ID NO: 363182 - RNA, 64 nt, hsa
cauguggggucuguggugagaguccuguaggaucccugcucaagcagcacagaggaaggggcaa

SEQ ID NO: 363183 - RNA, 64 nt, hsa
cacgcaguugcgacaggaggccaggggaaaaaccccugcucacuuguuugcccucaggcagcca

SEQ ID NO: 363184 - RNA, 64 nt, hsa
cccucuaggaugcccccucaggggcuggccaggcccugcucaacaucuggagauacaggcccac

SEQ ID NO: 363185 - RNA, 64 nt, hsa
agacccucccccuccugcccacugugcucuaaacccugcucaggauuccuguugaggagaugcc

SEQ ID NO: 363186 - RNA, 64 nt, hsa
cagggacuuucuuccuggcagaucuguggccuucccugcucagccucuugguccccccacuccc

SEQ ID NO: 363187 - RNA, 64 nt, hsa
ccaggagccucucccugcuacaggggguggggguccugcucagcaggguagguggugguuuuag

SEQ ID NO: 363188 - RNA, 64 nt, hsa
guguugccuuaaaacugaguugggugacuugguaccugcucaggaccccccgcacugucccaau

SEQ ID NO: 363189 - RNA, 64 nt, hsa
cuccagcuggccucacuccgcuggugacuucguaccugcucaggagcccccacugucccagucc

SEQ ID NO: 363190 - RNA, 64 nt, hsa
ucacaucuggccagagggcugucuggaccugggcccugcucaaugccaccugucugccugggcu

SEQ ID NO: 363191 - RNA, 64 nt, hsa
ccuccauggacagugugagccccgggccgugcauccugcucaguguggcgucagugucggggcu

SEQ ID NO: 363192 - RNA, 64 nt, hsa
gacccaccccccugccaccccucccaccccacucccugcucaguaccuggcguugguacacagg

SEQ ID NO: 363193 - RNA, 64 nt, hsa
ccagggaucugacuccugaguugguugccucuccccugcucacuccagucacauagagaauugg

SEQ ID NO: 363194 - RNA, 64 nt, hsa
ccagcucccucuucccuuacuaggcucuauggccccugcucagucagccccacucccugggcuu

SEQ ID NO: 363195 - RNA, 64 nt, hsa
aggaaugacccucuaucccaggaccugagaagggccugcucacccuccucggggaggggaagca

SEQ ID NO: 363196 - RNA, 64 nt, hsa; identical to SEQ ID NO: 144070

SEQ ID NO: 363197 - RNA, 64 nt, hsa; identical to SEQ ID NO: 144071

SEQ ID NO: 363198 - RNA, 64 nt, hsa; identical to SEQ ID NO: 144072

SEQ ID NO: 363199 - RNA, 64 nt, hsa; identical to SEQ ID NO: 144073

SEQ ID NO: 363200 - RNA, 64 nt, hsa; identical to SEQ ID NO: 144074

SEQ ID NO: 363201 - RNA, 64 nt, hsa; identical to SEQ ID NO: 144075

SEQ ID NO: 363202 - RNA, 64 nt, hsa; identical to SEQ ID NO: 144076

SEQ ID NO: 363203 - RNA, 64 nt, hsa; identical to SEQ ID NO: 144077

SEQ ID NO: 363204 - RNA, 64 nt, hsa; identical to SEQ ID NO: 144078

SEQ ID NO: 363205 - RNA, 64 nt, hsa; identical to SEQ ID NO: 144079

SEQ ID NO: 363206 - RNA, 64 nt, hsa; identical to SEQ ID NO: 144080

SEQ ID NO: 363207 - RNA, 64 nt, hsa; identical to SEQ ID NO: 144081

SEQ ID NO: 363208 - RNA, 64 nt, hsa; identical to SEQ ID NO: 144082

SEQ ID NO: 363209 - RNA, 64 nt, hsa; identical to SEQ ID NO: 144083

SEQ ID NO: 363210 - RNA, 64 nt, hsa; identical to SEQ ID NO: 144084

SEQ ID NO: 363211 - RNA, 64 nt, hsa; identical to SEQ ID NO: 144085

SEQ ID NO: 363212 - RNA, 64 nt, hsa; identical to SEQ ID NO: 144086

SEQ ID NO: 363213 - RNA, 64 nt, hsa; identical to SEQ ID NO: 144087

SEQ ID NO: 363214 - RNA, 64 nt, hsa; identical to SEQ ID NO: 144088

SEQ ID NO: 363215 - RNA, 64 nt, hsa; identical to SEQ ID NO: 144089

SEQ ID NO: 363216 - RNA, 64 nt, hsa; identical to SEQ ID NO: 144090

SEQ ID NO: 363217 - RNA, 64 nt, hsa; identical to SEQ ID NO: 144091

SEQ ID NO: 363218 - RNA, 64 nt, hsa; identical to SEQ ID NO: 144092

SEQ ID NO: 363219 - RNA, 64 nt, hsa; identical to SEQ ID NO: 144093

SEQ ID NO: 363220 - RNA, 64 nt, hsa; identical to SEQ ID NO: 144094

SEQ ID NO: 363221 - RNA, 64 nt, hsa; identical to SEQ ID NO: 144095

SEQ ID NO: 363222 - RNA, 64 nt, hsa; identical to SEQ ID NO: 144096

SEQ ID NO: 363223 - RNA, 64 nt, hsa; identical to SEQ ID NO: 144097

SEQ ID NO: 363224 - RNA, 64 nt, hsa; identical to SEQ ID NO: 144098

SEQ ID NO: 363225 - RNA, 64 nt, hsa; identical to SEQ ID NO: 144099

SEQ ID NO: 363226 - RNA, 64 nt, hsa; identical to SEQ ID NO: 144100

SEQ ID NO: 363227 - RNA, 64 nt, hsa; identical to SEQ ID NO: 144101

SEQ ID NO: 363228 - RNA, 64 nt, hsa; identical to SEQ ID NO: 144102

SEQ ID NO: 363229 - RNA, 64 nt, hsa; identical to SEQ ID NO: 144103

SEQ ID NO: 363230 - RNA, 64 nt, hsa; identical to SEQ ID NO: 144104

SEQ ID NO: 363231 - RNA, 64 nt, hsa; identical to SEQ ID NO: 144105

SEQ ID NO: 363232 - RNA, 64 nt, hsa; identical to SEQ ID NO: 144106

SEQ ID NO: 363233 - RNA, 64 nt, hsa; identical to SEQ ID NO: 144107

SEQ ID NO: 363234 - RNA, 64 nt, hsa; identical to SEQ ID NO: 144108

SEQ ID NO: 363235 - RNA, 64 nt, hsa; identical to SEQ ID NO: 144109

SEQ ID NO: 363236 - RNA, 64 nt, hsa; identical to SEQ ID NO: 144110

SEQ ID NO: 363237 - RNA, 64 nt, hsa; identical to SEQ ID NO: 144111

SEQ ID NO: 363238 - RNA, 64 nt, hsa; identical to SEQ ID NO: 144112

SEQ ID NO: 363239 - RNA, 64 nt, hsa; identical to SEQ ID NO: 144113

SEQ ID NO: 363240 - RNA, 64 nt, hsa; identical to SEQ ID NO: 144114

SEQ ID NO: 363241 - RNA, 64 nt, hsa; identical to SEQ ID NO: 144115

SEQ ID NO: 363242 - RNA, 64 nt, hsa; identical to SEQ ID NO: 144116

SEQ ID NO: 363243 - RNA, 64 nt, hsa; identical to SEQ ID NO: 144117

SEQ ID NO: 363244 - RNA, 64 nt, hsa; identical to SEQ ID NO: 144118

SEQ ID NO: 363245 - RNA, 64 nt, hsa; identical to SEQ ID NO: 144119

SEQ ID NO: 363246 - RNA, 64 nt, hsa; identical to SEQ ID NO: 144120

SEQ ID NO: 363247 - RNA, 64 nt, hsa; identical to SEQ ID NO: 144121

SEQ ID NO: 363248 - RNA, 64 nt, hsa; identical to SEQ ID NO: 144122

SEQ ID NO: 363249 - RNA, 64 nt, hsa; identical to SEQ ID NO: 144123

SEQ ID NO: 363250 - RNA, 64 nt, hsa; identical to SEQ ID NO: 144124

SEQ ID NO: 363251 - RNA, 64 nt, hsa; identical to SEQ ID NO: 144125

SEQ ID NO: 363252 - RNA, 64 nt, hsa; identical to SEQ ID NO: 144126

SEQ ID NO: 363253 - RNA, 64 nt, hsa; identical to SEQ ID NO: 144127

SEQ ID NO: 363254 - RNA, 64 nt, hsa; identical to SEQ ID NO: 144128

SEQ ID NO: 363255 - RNA, 64 nt, hsa; identical to SEQ ID NO: 144129

SEQ ID NO: 363256 - RNA, 64 nt, hsa; identical to SEQ ID NO: 144130

SEQ ID NO: 363257 - RNA, 64 nt, hsa; identical to SEQ ID NO: 144131

SEQ ID NO: 363258 - RNA, 64 nt, hsa; identical to SEQ ID NO: 144132

SEQ ID NO: 363259 - RNA, 64 nt, hsa; identical to SEQ ID NO: 144133

SEQ ID NO: 363260 - RNA, 64 nt, hsa; identical to SEQ ID NO: 144134

SEQ ID NO: 363261 - RNA, 64 nt, hsa; identical to SEQ ID NO: 144135

SEQ ID NO: 363262 - RNA, 64 nt, hsa; identical to SEQ ID NO: 144136

SEQ ID NO: 363263 - RNA, 64 nt, hsa; identical to SEQ ID NO: 144137

SEQ ID NO: 363264 - RNA, 64 nt, hsa; identical to SEQ ID NO: 144138

SEQ ID NO: 363265 - RNA, 64 nt, hsa; identical to SEQ ID NO: 144139

SEQ ID NO: 363266 - RNA, 64 nt, hsa; identical to SEQ ID NO: 144140

SEQ ID NO: 363267 - RNA, 64 nt, hsa; identical to SEQ ID NO: 144141

SEQ ID NO: 363268 - RNA, 64 nt, hsa; identical to SEQ ID NO: 144142

SEQ ID NO: 363269 - RNA, 64 nt, hsa; identical to SEQ ID NO: 144143

SEQ ID NO: 363270 - RNA, 64 nt, hsa; identical to SEQ ID NO: 144144

SEQ ID NO: 363271 - RNA, 64 nt, hsa; identical to SEQ ID NO: 144145

SEQ ID NO: 363272 - RNA, 64 nt, hsa; identical to SEQ ID NO: 144146

SEQ ID NO: 363273 - RNA, 64 nt, hsa; identical to SEQ ID NO: 144147

SEQ ID NO: 363274 - RNA, 64 nt, hsa; identical to SEQ ID NO: 144148

SEQ ID NO: 363275 - RNA, 64 nt, hsa; identical to SEQ ID NO: 144149

SEQ ID NO: 363276 - RNA, 64 nt, hsa; identical to SEQ ID NO: 144150

SEQ ID NO: 363277 - RNA, 64 nt, hsa; identical to SEQ ID NO: 144151

SEQ ID NO: 363278 - RNA, 64 nt, hsa; identical to SEQ ID NO: 144152

SEQ ID NO: 363279 - RNA, 64 nt, hsa; identical to SEQ ID NO: 144153

SEQ ID NO: 363280 - RNA, 64 nt, hsa; identical to SEQ ID NO: 144154

SEQ ID NO: 363281 - RNA, 64 nt, hsa; identical to SEQ ID NO: 144155

SEQ ID NO: 363282 - RNA, 64 nt, hsa; identical to SEQ ID NO: 79249

SEQ ID NO: 363283 - RNA, 64 nt, hsa; identical to SEQ ID NO: 79250

SEQ ID NO: 363284 - RNA, 64 nt, hsa; identical to SEQ ID NO: 79251

SEQ ID NO: 363285 - RNA, 64 nt, hsa; identical to SEQ ID NO: 79252

SEQ ID NO: 363286 - RNA, 64 nt, hsa; identical to SEQ ID NO: 79253

SEQ ID NO: 363287 - RNA, 64 nt, hsa; identical to SEQ ID NO: 79254

SEQ ID NO: 363288 - RNA, 64 nt, hsa; identical to SEQ ID NO: 79255

SEQ ID NO: 363289 - RNA, 64 nt, hsa; identical to SEQ ID NO: 79256

SEQ ID NO: 363290 - RNA, 64 nt, hsa; identical to SEQ ID NO: 79257

SEQ ID NO: 363291 - RNA, 64 nt, hsa; identical to SEQ ID NO: 79258

SEQ ID NO: 363292 - RNA, 64 nt, hsa; identical to SEQ ID NO: 79259

SEQ ID NO: 363293 - RNA, 64 nt, hsa; identical to SEQ ID NO: 79260

SEQ ID NO: 363294 - RNA, 64 nt, hsa; identical to SEQ ID NO: 79261

SEQ ID NO: 363295 - RNA, 64 nt, hsa; identical to SEQ ID NO: 79262

SEQ ID NO: 363296 - RNA, 64 nt, hsa; identical to SEQ ID NO: 79263

SEQ ID NO: 363297 - RNA, 64 nt, hsa; identical to SEQ ID NO: 79264

SEQ ID NO: 363298 - RNA, 64 nt, hsa; identical to SEQ ID NO: 79265

SEQ ID NO: 363299 - RNA, 64 nt, hsa; identical to SEQ ID NO: 79266

SEQ ID NO: 363300 - RNA, 64 nt, hsa; identical to SEQ ID NO: 79267

SEQ ID NO: 363301 - RNA, 64 nt, hsa; identical to SEQ ID NO: 79268

SEQ ID NO: 363302 - RNA, 64 nt, hsa; identical to SEQ ID NO: 79269

SEQ ID NO: 363303 - RNA, 64 nt, hsa; identical to SEQ ID NO: 79270

SEQ ID NO: 363304 - RNA, 64 nt, hsa; identical to SEQ ID NO: 79271

SEQ ID NO: 363305 - RNA, 64 nt, hsa; identical to SEQ ID NO: 79272

SEQ ID NO: 363306 - RNA, 64 nt, hsa; identical to SEQ ID NO: 79273

SEQ ID NO: 363307 - RNA, 64 nt, hsa; identical to SEQ ID NO: 79274

SEQ ID NO: 363308 - RNA, 64 nt, hsa; identical to SEQ ID NO: 79275

SEQ ID NO: 363309 - RNA, 64 nt, hsa; identical to SEQ ID NO: 79276

SEQ ID NO: 363310 - RNA, 64 nt, hsa; identical to SEQ ID NO: 79277

SEQ ID NO: 363311 - RNA, 64 nt, hsa; identical to SEQ ID NO: 79278

SEQ ID NO: 363312 - RNA, 64 nt, hsa; identical to SEQ ID NO: 79279

SEQ ID NO: 363313 - RNA, 64 nt, hsa; identical to SEQ ID NO: 79280

SEQ ID NO: 363314 - RNA, 64 nt, hsa; identical to SEQ ID NO: 79281

SEQ ID NO: 363315 - RNA, 64 nt, hsa; identical to SEQ ID NO: 79282

SEQ ID NO: 363316 - RNA, 64 nt, hsa; identical to SEQ ID NO: 79283

SEQ ID NO: 363317 - RNA, 64 nt, hsa; identical to SEQ ID NO: 79284

SEQ ID NO: 363318 - RNA, 64 nt, hsa; identical to SEQ ID NO: 79285

SEQ ID NO: 363319 - RNA, 64 nt, hsa; identical to SEQ ID NO: 79286

SEQ ID NO: 363320 - RNA, 64 nt, hsa; identical to SEQ ID NO: 79287

SEQ ID NO: 363321 - RNA, 64 nt, hsa; identical to SEQ ID NO: 79288

SEQ ID NO: 363322 - RNA, 64 nt, hsa; identical to SEQ ID NO: 79289

SEQ ID NO: 363323 - RNA, 64 nt, hsa; identical to SEQ ID NO: 79290

SEQ ID NO: 363324 - RNA, 64 nt, hsa; identical to SEQ ID NO: 161026

SEQ ID NO: 363325 - RNA, 64 nt, hsa; identical to SEQ ID NO: 161027

SEQ ID NO: 363326 - RNA, 64 nt, hsa; identical to SEQ ID NO: 161028

SEQ ID NO: 363327 - RNA, 64 nt, hsa; identical to SEQ ID NO: 161029

SEQ ID NO: 363328 - RNA, 64 nt, hsa; identical to SEQ ID NO: 161030

SEQ ID NO: 363329 - RNA, 64 nt, hsa; identical to SEQ ID NO: 161031

SEQ ID NO: 363330 - RNA, 64 nt, hsa; identical to SEQ ID NO: 161032

SEQ ID NO: 363331 - RNA, 64 nt, hsa; identical to SEQ ID NO: 161033

SEQ ID NO: 363332 - RNA, 64 nt, hsa; identical to SEQ ID NO: 161034

SEQ ID NO: 363333 - RNA, 50 nt, hsa; identical to SEQ ID NO: 161035

SEQ ID NO: 363334 - RNA, 64 nt, hsa; identical to SEQ ID NO: 161036

SEQ ID NO: 363335 - RNA, 64 nt, hsa; identical to SEQ ID NO: 161037

SEQ ID NO: 363336 - RNA, 64 nt, hsa; identical to SEQ ID NO: 161038

SEQ ID NO: 363337 - RNA, 64 nt, hsa; identical to SEQ ID NO: 161039

SEQ ID NO: 363338 - RNA, 64 nt, hsa; identical to SEQ ID NO: 161040

SEQ ID NO: 363339 - RNA, 64 nt, hsa; identical to SEQ ID NO: 161041

SEQ ID NO: 363340 - RNA, 64 nt, hsa; identical to SEQ ID NO: 161042

SEQ ID NO: 363341 - RNA, 64 nt, hsa; identical to SEQ ID NO: 161043

SEQ ID NO: 363342 - RNA, 64 nt, hsa; identical to SEQ ID NO: 161044

SEQ ID NO: 363343 - RNA, 64 nt, hsa; identical to SEQ ID NO: 161045

SEQ ID NO: 363344 - RNA, 64 nt, hsa; identical to SEQ ID NO: 161046

SEQ ID NO: 363345 - RNA, 64 nt, hsa; identical to SEQ ID NO: 161047

SEQ ID NO: 363346 - RNA, 64 nt, hsa; identical to SEQ ID NO: 270210

SEQ ID NO: 363347 - RNA, 64 nt, hsa; identical to SEQ ID NO: 270211

SEQ ID NO: 363348 - RNA, 64 nt, hsa; identical to SEQ ID NO: 270212

SEQ ID NO: 363349 - RNA, 64 nt, hsa; identical to SEQ ID NO: 270213

SEQ ID NO: 363350 - RNA, 64 nt, hsa; identical to SEQ ID NO: 270214

SEQ ID NO: 363351 - RNA, 64 nt, hsa; identical to SEQ ID NO: 270215

SEQ ID NO: 363352 - RNA, 64 nt, hsa; identical to SEQ ID NO: 270216

SEQ ID NO: 363353 - RNA, 64 nt, hsa; identical to SEQ ID NO: 270217

SEQ ID NO: 363354 - RNA, 64 nt, hsa; identical to SEQ ID NO: 270218

SEQ ID NO: 363355 - RNA, 64 nt, hsa; identical to SEQ ID NO: 270219

SEQ ID NO: 363356 - RNA, 64 nt, hsa; identical to SEQ ID NO: 270220

SEQ ID NO: 363357 - RNA, 64 nt, hsa; identical to SEQ ID NO: 270221

SEQ ID NO: 363358 - RNA, 64 nt, hsa; identical to SEQ ID NO: 270222

SEQ ID NO: 363359 - RNA, 64 nt, hsa; identical to SEQ ID NO: 270223

SEQ ID NO: 363360 - RNA, 64 nt, hsa; identical to SEQ ID NO: 270224

SEQ ID NO: 363361 - RNA, 64 nt, hsa; identical to SEQ ID NO: 270225

SEQ ID NO: 363362 - RNA, 64 nt, hsa; identical to SEQ ID NO: 270226

SEQ ID NO: 363363 - RNA, 64 nt, hsa; identical to SEQ ID NO: 270227

SEQ ID NO: 363364 - RNA, 64 nt, hsa; identical to SEQ ID NO: 270228

SEQ ID NO: 363365 - RNA, 64 nt, hsa; identical to SEQ ID NO: 270229

SEQ ID NO: 363366 - RNA, 64 nt, hsa; identical to SEQ ID NO: 270230

SEQ ID NO: 363367 - RNA, 64 nt, hsa; identical to SEQ ID NO: 270231

SEQ ID NO: 363368 - RNA, 64 nt, hsa; identical to SEQ ID NO: 270232

SEQ ID NO: 363369 - RNA, 64 nt, hsa; identical to SEQ ID NO: 270233

SEQ ID NO: 363370 - RNA, 64 nt, hsa; identical to SEQ ID NO: 270234

SEQ ID NO: 363371 - RNA, 64 nt, hsa; identical to SEQ ID NO: 270235

SEQ ID NO: 363372 - RNA, 64 nt, hsa; identical to SEQ ID NO: 270236

SEQ ID NO: 363373 - RNA, 64 nt, hsa; identical to SEQ ID NO: 270237

SEQ ID NO: 363374 - RNA, 64 nt, hsa; identical to SEQ ID NO: 270238

SEQ ID NO: 363375 - RNA, 64 nt, hsa; identical to SEQ ID NO: 270239

SEQ ID NO: 363376 - RNA, 64 nt, hsa; identical to SEQ ID NO: 270240

SEQ ID NO: 363377 - RNA, 64 nt, hsa; identical to SEQ ID NO: 270241

SEQ ID NO: 363378 - RNA, 64 nt, hsa; identical to SEQ ID NO: 270242

SEQ ID NO: 363379 - RNA, 64 nt, hsa; identical to SEQ ID NO: 284057

SEQ ID NO: 363380 - RNA, 64 nt, hsa; identical to SEQ ID NO: 284058

SEQ ID NO: 363381 - RNA, 64 nt, hsa; identical to SEQ ID NO: 284059

SEQ ID NO: 363382 - RNA, 64 nt, hsa; identical to SEQ ID NO: 284060

SEQ ID NO: 363383 - RNA, 64 nt, hsa; identical to SEQ ID NO: 284061

SEQ ID NO: 363384 - RNA, 64 nt, hsa; identical to SEQ ID NO: 284062

SEQ ID NO: 363385 - RNA, 64 nt, hsa
ugaacagugcucugccucuaacucccuccucacacuccagaauuacccuuccucaucugugccu

SEQ ID NO: 363386 - RNA, 64 nt, hsa
caggggaagcugcuaggggaaggacuggccguggcuccagaaugugcugccuuuuuaaguuuug

SEQ ID NO: 363387 - RNA, 64 nt, hsa
ccuuuucccuaaucauucccuuuucuccccacuccuccagaaggcauaacccuucucuccacac

SEQ ID NO: 363388 - RNA, 64 nt, hsa
ucuucucauaguguacacccaccugccucucuggcuccagaagcugccagagugcacugggggg

SEQ ID NO: 363389 - RNA, 64 nt, hsa
guucugaugggggagggcggucuucccacuuccucuccagaacuccagaaagagcagugugcuu

SEQ ID NO: 363390 - RNA, 64 nt, hsa
gggggagggcggucuucccacuuccucuccagaacuccagaaagagcagugugcuuaugcuuca

SEQ ID NO: 363391 - RNA, 64 nt, hsa
cauagcuucccuucccucccccuucacccacucccuccagaacauuuaguguagaugaaaaugu

SEQ ID NO: 363392 - RNA, 64 nt, hsa
cagaaaaacacaaacaaaaacagacucccacugucuccagaagucguggccuuccagaacaguc

SEQ ID NO: 363393 - RNA, 64 nt, hsa
caucugaauguuccagcagccuaacugugcucugcuccagaaacauguguguggcuucccuacc

SEQ ID NO: 363394 - RNA, 64 nt, hsa
gucacuuuaguuaugcuaaaguggagguuucagccuccagaagacagcagagccuucuaggguc

SEQ ID NO: 363395 - RNA, 64 nt, hsa
aagauguuuacuacaaaagcaugccaaaccuaggcuccagaaaccacguccaucagcugcauac

SEQ ID NO: 363396 - RNA, 64 nt, hsa
uacuagcauugcacauauagucugcuuucuguuccuccagaauuugaguccuguuaauguagua

SEQ ID NO: 363397 - RNA, 64 nt, hsa
ucauucuucaacagugccuugcauguaacaagcacuccagaaauguuuguugaaugaaugaaug

SEQ ID NO: 363398 - RNA, 64 nt, hsa
cauggcuggagagcugaucagccaggcacagaaucuccagaacaaccuagagagugaaugcuaa

SEQ ID NO: 363399 - RNA, 64 nt, hsa
uuuuauuuuccugucuucuuucuccugugguuugcuccagaauuaagguuuguuuuccauccau

SEQ ID NO: 363400 - RNA, 64 nt, hsa
ucucccuuuugacacaguuguuucagaaagagcucuccagaagccaauauugagauguaauuca

SEQ ID NO: 363401 - RNA, 64 nt, hsa
ugaagcccaaaagcucuuaaggagaauuguauuucuccagaagcugcagcaagagguacagcuc

SEQ ID NO: 363402 - RNA, 64 nt, hsa
aauuauucaauuucaugaauaacucuuguuugcacuccagaaaacaacauacauguuuaaauac

SEQ ID NO: 363403 - RNA, 64 nt, hsa
gagagggggagcaaacaggaaauuccacagcugccuccagaaacauuaaccaccccucucuagu

SEQ ID NO: 363404 - RNA, 64 nt, hsa
cgccagcuccucagccugcucccugggaggcaggcuccagaagcaccccgacggggggccuuau

SEQ ID NO: 363405 - RNA, 64 nt, hsa
gaauaucaaguauaaugauguaguaaaaagauuucuccagaaaacacuuugagauacuuaaaga

SEQ ID NO: 363406 - RNA, 64 nt, hsa
guaguucuguucuguggguuugugcuuccucuuucuccagaagccuucuggcugauuguuccga

SEQ ID NO: 363407 - RNA, 64 nt, hsa
cugcauugaauugaauaugaauuucucuaacucucuccagaaaauggauggagauaacuugucu

SEQ ID NO: 363408 - RNA, 64 nt, hsa
gugagauucuuuagccacuuuggggagccugucucuccagaagccuuucuuaguggugcccaca

SEQ ID NO: 363409 - RNA, 64 nt, hsa
ugucugcuggcaccuugaucuuggaccucccagccuccagaacugugagaaauaaauguguuuu

SEQ ID NO: 363410 - RNA, 64 nt, hsa
cauacaacauacuuaaugcagggcuacacugaaccuccagaaucauuuuguuugcuuugacccu

SEQ ID NO: 363411 - RNA, 64 nt, hsa
uucuuucacauggcuacugggaauauaaauuucgcuccagaaaggccguagcaguuugacgaua

SEQ ID NO: 363412 - RNA, 64 nt, hsa
gcucuuaugagucauuuuuuucaaaagaugaaaacuccagaaacgcacaggaacgaaauaccuc

SEQ ID NO: 363413 - RNA, 64 nt, hsa
uaaugcuuauuaugaguuuaagaagcaguucuuccuccagaaagaagggggcgauagcaugcag

SEQ ID NO: 363414 - RNA, 64 nt, hsa
gccgcagcccuggggccaguaggaagcggacccgcuccagaaguccccacgagaagaagaagaa

SEQ ID NO: 363415 - RNA, 64 nt, hsa
gaggaacgguguuauggacugaauguucauguuccuccagaauucauaugcugaagccucuguc

SEQ ID NO: 363416 - RNA, 64 nt, hsa
cgucugcuggcaccuugaucuugaacuucccagccuccagaacugugagaaagaaaucucuaug

SEQ ID NO: 363417 - RNA, 64 nt, hsa
auguuccugccccacaggaauagaauggagggagcuccagaaacuuuccaucccaaaggcaguc

SEQ ID NO: 363418 - RNA, 64 nt, hsa
ugcaaaccucacaggguccccacacaacagugcccuccagaagcagccccucggaggcagagga

SEQ ID NO: 363419 - RNA, 64 nt, hsa
ugguucaugaugcauaaagcgcuaggcccuagaacuccagaaacagcacagcuggggcggggac

SEQ ID NO: 363420 - RNA, 64 nt, hsa
gccacagccacaccucaccgcccaguccagcugucuccagaaggggacaggcaguccgcggucu

SEQ ID NO: 363421 - RNA, 64 nt, hsa
ccagcccggagcccagcccccugccccggcccugcuccagaacccagcccagaucggaggacaa

SEQ ID NO: 363422 - RNA, 64 nt, hsa
cuagaacccaauccaauuuggagccccagcccaacuccagaacccaacccuucucuagaaucca

SEQ ID NO: 363423 - RNA, 64 nt, hsa
aagguaacugagagcagaugguccuccauuucaacuccagaaguggggcucugggagggauguu

SEQ ID NO: 363424 - RNA, 64 nt, hsa
acuccagaauccacaaagccgugccuuucucuggcuccagaauaugcauaaucagcgcccugga

SEQ ID NO: 363425 - RNA, 64 nt, hsa
cacccccuccagcuccaguuuccaaguuccugcacuccagaauccacaaagccgugccuuucuc

SEQ ID NO: 363426 - RNA, 64 nt, hsa
gcuauccugggagaucuaccugaaggagaacuaccuccagaaccgacaguuccagcaaaagcag

SEQ ID NO: 363427 - RNA, 64 nt, hsa
gcgcaucccacucuaugcgaaccacaagacccuccuccagaaggcagccgcugaguucggggcu

SEQ ID NO: 363428 - RNA, 64 nt, hsa
uagacaggcuggauuccaguguugggacagccaucuccagaaaccugacuuaagagaguaagau

SEQ ID NO: 363429 - RNA, 64 nt, hsa
ugcugguucccggaaugaaucagcugcugacugucuccagaagggcuggaaaggaugcugccag

SEQ ID NO: 363430 - RNA, 64 nt, hsa; identical to SEQ ID NO: 206137

SEQ ID NO: 363431 - RNA, 64 nt, hsa; identical to SEQ ID NO: 206138

SEQ ID NO: 363432 - RNA, 64 nt, hsa; identical to SEQ ID NO: 206139

SEQ ID NO: 363433 - RNA, 64 nt, hsa; identical to SEQ ID NO: 206140

SEQ ID NO: 363434 - RNA, 64 nt, hsa; identical to SEQ ID NO: 206141

SEQ ID NO: 363435 - RNA, 64 nt, hsa; identical to SEQ ID NO: 206142

SEQ ID NO: 363436 - RNA, 64 nt, hsa; identical to SEQ ID NO: 206143

SEQ ID NO: 363437 - RNA, 64 nt, hsa; identical to SEQ ID NO: 206144

SEQ ID NO: 363438 - RNA, 64 nt, hsa; identical to SEQ ID NO: 206145

SEQ ID NO: 363439 - RNA, 64 nt, hsa; identical to SEQ ID NO: 206146

SEQ ID NO: 363440 - RNA, 64 nt, hsa; identical to SEQ ID NO: 206147

SEQ ID NO: 363441 - RNA, 64 nt, hsa; identical to SEQ ID NO: 206148

SEQ ID NO: 363442 - RNA, 64 nt, hsa; identical to SEQ ID NO: 206149

SEQ ID NO: 363443 - RNA, 64 nt, hsa; identical to SEQ ID NO: 206150

SEQ ID NO: 363444 - RNA, 64 nt, hsa
ggcagcuuguaggugauuguacaagugagaauuaaagagagaacagauauuuaaacaggugcug

SEQ ID NO: 363445 - RNA, 64 nt, hsa
aacagguuccuaccagcagcacuggugugaaugaaagagagacccagccgcgucucacacaggu

SEQ ID NO: 363446 - RNA, 64 nt, hsa
agucucccuuucccugucuggcuucucccuuaagaagagagagauacuuguagaauuggguggg

SEQ ID NO: 363447 - RNA, 64 nt, hsa
gaauaaggagccuuucuuauggaagaaaugggagaagagagacaggguucuuuucagcagaguc

SEQ ID NO: 363448 - RNA, 64 nt, hsa
uauccugagccaucggugaaacuaacagauaagcaagagagauguuuuggggacucauuucauu

SEQ ID NO: 363449 - RNA, 64 nt, hsa
uguguguguguguguguguguguguguaugacuaaagagagaauguagauauugugaaguacau

SEQ ID NO: 363450 - RNA, 64 nt, hsa
gugaaccauacuguccccaaugacuaaggaaucaaagagagagaaccaacguuccuaaaaguac

SEQ ID NO: 363451 - RNA, 64 nt, hsa
cugcugcugaacuuuuaaaagaggucucuaacugaagagagauggaagccagcccugccaaagg

SEQ ID NO: 363452 - RNA, 64 nt, hsa
gugcaaauuauuuguaugcuucaaaaaaaaaaaaaagagagaaacaaaaaagugugacauuaca

SEQ ID NO: 363453 - RNA, 64 nt, hsa
cauguugcuguuuccaguuccguucugagagaaaaagagagagagagagaaaaagaccaugcug

SEQ ID NO: 363454 - RNA, 64 nt, hsa
cugugaaagaaccaaaagagaucacaauacucaaaagagagagagagagaaaaaagagagaucu

SEQ ID NO: 363455 - RNA, 64 nt, hsa
gaucacaauacucaaaagagagagagagagaaaaaagagagaucuugauccacagaaauacaug

SEQ ID NO: 363456 - RNA, 64 nt, hsa
gaaagagacccuacacauggccuagaaaugagagaagagagagguauuuacccagaggauuuuc

SEQ ID NO: 363457 - RNA, 64 nt, hsa
aauugccccuuuuucuguuccuaaaaggaaggauaagagagaacauuccaggugaggcacuuca

SEQ ID NO: 363458 - RNA, 64 nt, hsa
aagguugacuuuuugcacuucuguauauagucaaaagagagaaaccuguauaauaguaagaucu

SEQ ID NO: 363459 - RNA, 64 nt, hsa
caaaacuacugcauguuuaaaacuucaacaaaaaaagagagaaagaacuauacuaagaacauau

SEQ ID NO: 363460 - RNA, 64 nt, hsa
aguuuuuuuuaaacaugauucuaguuaaauguagaagagagaagaaagaggaaguguucacuuu

SEQ ID NO: 363461 - RNA, 64 nt, hsa
aauagcauuuagaaguuuuggauaugaaaaacagaagagagaaaaauauacauuauaaaagcag

SEQ ID NO: 363462 - RNA, 64 nt, hsa
ucagugacuguguugugauucauaguacauuaaaaagagagagagagagaaagaaucccacagg

SEQ ID NO: 363463 - RNA, 64 nt, hsa
gaauucuugcacaccuuuccuaaaaauuucucccaagagagacuuguuugggccuuuuguggug

SEQ ID NO: 363464 - RNA, 64 nt, hsa
aucuacuuuugcuaagaugcauuuaauaaaaaaaaagagagagagagagaggugugagggacaa

SEQ ID NO: 363465 - RNA, 64 nt, hsa
cuugggcuuggcccagaauuagaguuauuagagcaagagagagcuuaggaagcaugagggcaac

SEQ ID NO: 363466 - RNA, 64 nt, hsa
agauuaccugccacuuccaggagcccagagggccaagagagacauugccuccaccucuccuugg

SEQ ID NO: 363467 - RNA, 64 nt, hsa
aggaguucguggcugcaaaagaaguuucuggagcaagagagagcucgcucuugggagucaggac

SEQ ID NO: 363468 - RNA, 64 nt, hsa
uuuugacauaaaagagccuugauuuuaaaaaaaaaagagagagagauguaauuuaaaaaguuua

SEQ ID NO: 363469 - RNA, 64 nt, hsa
ggcgaggagaggagaaggccaggggaaugaauucaagagagauguccacggacgaaacauacgg

SEQ ID NO: 363470 - RNA, 64 nt, hsa
acaauguuaagggguuguuguguaguugcauuggaagagagaaaggaaacacacucuuucauug

SEQ ID NO: 363471 - RNA, 64 nt, hsa
gggaagugaggacuguccugcugggacaacuaagaagagagaauguggacucugaaucccuuuu

SEQ ID NO: 363472 - RNA, 64 nt, hsa
caaguucagaaacuagacauuccauugaacuaagaagagagaccguugcugcugucaugaccua

SEQ ID NO: 363473 - RNA, 64 nt, hsa
uaaaacugcucuaaaaaaaauaucuuuuuuaaaaaagagagaauuagcauugugucugagguua

SEQ ID NO: 363474 - RNA, 56 nt, hsa
ccaauuuuuccuugaugugauguaacaagagagacuuuacagccccaugcuacagg

SEQ ID NO: 363475 - RNA, 64 nt, hsa
auacacacacacgagagacagaaggaaagagaggaagagagaagcaaacauguaggaaaaaaua

SEQ ID NO: 363476 - RNA, 64 nt, hsa
ucauuauacacuaugagguaaaauguaauaacaaaagagagagaaguaccacuguggcuagaua

SEQ ID NO: 363477 - RNA, 64 nt, hsa
uuuuagguaagagaaaagaaaaagauaaggaaagaagagagaagagagacaaagaucacuacag

SEQ ID NO: 363478 - RNA, 64 nt, hsa
uaagagaaaagaaaaagauaaggaaagaagagagaagagagacaaagaucacuacagaccaaaa

SEQ ID NO: 363479 - RNA, 64 nt, hsa
uuggaguccuaauaguacucuauucguauuaggaaagagagacuagauaccaaacaucacgaga

SEQ ID NO: 363480 - RNA, 64 nt, hsa
cuuuuagccaguugcucugccacagacauagacaaagagagauaagauuucacauuauccauca

SEQ ID NO: 363481 - RNA, 64 nt, hsa
uguaucuuugccaagaccgugaucaagguagcuuaagagagauggucaggagaaaacacuguuu

SEQ ID NO: 363482 - RNA, 64 nt, hsa
cacacccaguauuugcagaagggcaaagcugcuuaagagagaggaucagggugaaguuuggcac

SEQ ID NO: 363483 - RNA, 64 nt, hsa
gaauaaauguaaaguuugaccuuuuuaaaacgaaaagagagacaaagucucagcacauuccaag

SEQ ID NO: 363484 - RNA, 64 nt, hsa
uagcucaucuguggugucagaauccuuggagcugaagagagaaaucaaaagagcaugaugaugg

SEQ ID NO: 363485 - RNA, 64 nt, hsa
cagagagaaggagaaagagggagggagagagagaaagagagagaaagagagagagagagagaga

SEQ ID NO: 363486 - RNA, 64 nt, hsa
gagaaagagggagggagagagagaaagagagagaaagagagagagagagagagagagagaaagc

SEQ ID NO: 363487 - RNA, 64 nt, hsa
uuggggagacugacacaggaaaaugaacuuaaucaagagagacugugauaugugcuaagaaggg

SEQ ID NO: 363488 - RNA, 64 nt, hsa
ccaggacgucuguucuuugugggggccagaucagaagagagaggccccugugacgcccgggcug

SEQ ID NO: 363489 - RNA, 64 nt, hsa
gaugauggacccuuuccuaaugagccuccucaauaagagagaaguucucauugugggaaucuga

SEQ ID NO: 363490 - RNA, 64 nt, hsa
auauugaaaaucauuuacauuggccuauauuuggaagagagauagucuuuuguuuuuaauaagu

SEQ ID NO: 363491 - RNA, 64 nt, hsa
uauuaaucucauggaugguucucaaagguaaaaaaagagagagaaagagagagagcuagcugug

SEQ ID NO: 363492 - RNA, 64 nt, hsa
auggaugguucucaaagguaaaaaaagagagagaaagagagagagcuagcugugggauucugug

SEQ ID NO: 363493 - RNA, 64 nt, hsa
aagagaaugcgauggauuuuauuacacaugguggaagagagaagaggcguguagguuugcaaac

SEQ ID NO: 363494 - RNA, 64 nt, hsa
acaugaaggccccuccccugggaucacuguguuuaagagagagugguuccugcuguuuauucuc

SEQ ID NO: 363495 - RNA, 64 nt, hsa
uuuccucaguggaaaaacuuaugaaacuucuuauaagagagaguaaucucaggccggacaugcu

SEQ ID NO: 363496 - RNA, 64 nt, hsa
cagagcaacacucugucuuaaaagaaaaaaaaaaaagagagagauaguaaucucuugggcaaaa

SEQ ID NO: 363497 - RNA, 64 nt, hsa
caguucggggauauauuaagauauuuuuguacauaagagagaaagagagagaaaaauuuauaga

SEQ ID NO: 363498 - RNA, 64 nt, hsa
ggauauauuaagauauuuuuguacauaagagagaaagagagagaaaaauuuauagaaguuuugu

SEQ ID NO: 363499 - RNA, 64 nt, hsa
agagcaagacucugucucagaaaaaaaaaaaaaaaagagagagagagagaaagagaacaauauu

SEQ ID NO: 363500 - RNA, 64 nt, hsa
auccugucucucaaaaaaaaaaaaaaaaaaaagaaagagagagggccgggcgugguggcucacg

SEQ ID NO: 363501 - RNA, 64 nt, hsa
gacauuuccuagagaaagagagagagagaggagaaagagagagaaggagagagacaguagccaa

SEQ ID NO: 363502 - RNA, 64 nt, hsa
ugaggccugcuucacaacagacauuuccuagagaaagagagagagagaggagaaagagagagaa

SEQ ID NO: 363503 - RNA, 64 nt, hsa
acagugagaccccuucucaaaaaaaaaaaaaaaaaagagagagugugugauuagaagcuaaaua

SEQ ID NO: 363504 - RNA, 64 nt, hsa
ggcaacaagagcgagacuccguuuccaaaaaaauaagagagaauagaagaagcuacugcaugau

SEQ ID NO: 363505 - RNA, 64 nt, hsa
aguuucacuccggagugagaagcuuugcccuccuaagagagagagacagagagacagagagaga

SEQ ID NO: 363506 - RNA, 64 nt, hsa
cuaagagagagagacagagagacagagagagagaaagagagagugugugggucuauguaaaugc

SEQ ID NO: 363507 - RNA, 64 nt, hsa
gccugcgggacagagugagacccugucugaaagaaagagagaaagaaagaaagaaagagagaga

SEQ ID NO: 363508 - RNA, 64 nt, hsa
cccugucugaaagaaagagagaaagaaagaaagaaagagagagaaagaaagaaagaaagaaagg

SEQ ID NO: 363509 - RNA, 64 nt, hsa
gaaagauggaaggaaggaaggaaaaagaaagagaaagagagagagagagaaagaaaaagaaaga

SEQ ID NO: 363510 - RNA, 64 nt, hsa
gcaccauuuggaagcuugagagaaaccaaaauuaaagagagaaagagagagcgugcacgcuccu

SEQ ID NO: 363511 - RNA, 63 nt, hsa
uggaagcuugagagaaaccaaaauuaaagagagaaagagagagcgugcacgcuccugcuuugu

SEQ ID NO: 363512 - RNA, 64 nt, hsa
gagagaaagagagagagagagagagaaggggcccaagagagacagcacaggcagccccacggac

SEQ ID NO: 363513 - RNA, 64 nt, hsa
cccccuccccgggcagcagagagagagagagagaaagagagagagagagagagaaggggcccaa

SEQ ID NO: 363514 - RNA, 64 nt, hsa
caaaacuccaucuaaagaagaaaaagaaaaacugaagagagaguaguugucagagugaagaguu

SEQ ID NO: 363515 - RNA, 64 nt, hsa
agagugaugaaaaauugaucuuguuuugaaauugaagagagaggccaggcgcgguggcucacac

SEQ ID NO: 363516 - RNA, 64 nt, hsa
accugggccuggccggaggaagagagaguuuaccaagagagaugucuccgggcccuuauuuauu

SEQ ID NO: 363517 - RNA, 64 nt, hsa
gcugguguggaccacaccugggccuggccggaggaagagagaguuuaccaagagagaugucucc

SEQ ID NO: 363518 - RNA, 64 nt, hsa
agcaacauagaagagggaaggaaagagagaaggaaagagagagagaaagaaagucuccagacca

SEQ ID NO: 363519 - RNA, 64 nt, hsa
cccuacccgcucagcaacauagaagagggaaggaaagagagaaggaaagagagagagaaagaaa

SEQ ID NO: 363520 - RNA, 64 nt, hsa
uaaccgaaggaaagaccguucaccagacuuggcuccucuaaacauuugcuguucaaacauguuu

SEQ ID NO: 363521 - RNA, 64 nt, hsa
cucugucaugauggcgguugugcaauucugguauccucuaaauuuguaagcauucauaaaacag

SEQ ID NO: 363522 - RNA, 64 nt, hsa
gcuaaaaaaaagcaaggguuugucauagagggaaccucuaaauaauuucagggguaggggagau

SEQ ID NO: 363523 - RNA, 64 nt, hsa
uuugacaauugaauuuguuuucugugaauucuaaccucuaaaggcaugcuuagaggucaaggac

SEQ ID NO: 363524 - RNA, 64 nt, hsa
cuucuuagguuauagccaagucagcaacauaauuccucuaaauaaaauuacauugugcucacac

SEQ ID NO: 363525 - RNA, 64 nt, hsa
ucuggguaacauuuuuuagaggugccaguucccaccucuaaaaaaaacaccaacaacaaaagaa

SEQ ID NO: 363526 - RNA, 64 nt, hsa
aaacacaugacuucuucccagcagcccuucccggccucuaaaguuuggucccagcagcccuucc

SEQ ID NO: 363527 - RNA, 64 nt, hsa
gccucuaaaguuuggucccagcagcccuucccagccucuaaaguuuggucugguaugaaauggg

SEQ ID NO: 363528 - RNA, 64 nt, hsa; identical to SEQ ID NO: 96929

SEQ ID NO: 363529 - RNA, 64 nt, hsa; identical to SEQ ID NO: 96930

SEQ ID NO: 363530 - RNA, 64 nt, hsa; identical to SEQ ID NO: 96931

SEQ ID NO: 363531 - RNA, 64 nt, hsa; identical to SEQ ID NO: 96932

SEQ ID NO: 363532 - RNA, 64 nt, hsa; identical to SEQ ID NO: 96933

SEQ ID NO: 363533 - RNA, 64 nt, hsa; identical to SEQ ID NO: 96934

SEQ ID NO: 363534 - RNA, 64 nt, hsa; identical to SEQ ID NO: 96935

SEQ ID NO: 363535 - RNA, 64 nt, hsa; identical to SEQ ID NO: 96936

SEQ ID NO: 363536 - RNA, 64 nt, hsa
ggcccagaggagcugggagccgggccgcagacuugaccccgacgccacagcccagccacggacg

SEQ ID NO: 363537 - RNA, 64 nt, hsa
uuuaaaaucgaucuacacacauccacgcacaugcgaccccgaggaaacgaaacccacucuagaa

SEQ ID NO: 363538 - RNA, 64 nt, hsa; identical to SEQ ID NO: 283916

SEQ ID NO: 363539 - RNA, 64 nt, hsa; identical to SEQ ID NO: 283917

SEQ ID NO: 363540 - RNA, 64 nt, hsa; identical to SEQ ID NO: 283918

SEQ ID NO: 363541 - RNA, 64 nt, hsa; identical to SEQ ID NO: 283919

SEQ ID NO: 363542 - RNA, 64 nt, hsa; identical to SEQ ID NO: 164108

SEQ ID NO: 363543 - RNA, 64 nt, hsa; identical to SEQ ID NO: 164109

SEQ ID NO: 363544 - RNA, 64 nt, hsa; identical to SEQ ID NO: 164110

SEQ ID NO: 363545 - RNA, 64 nt, hsa; identical to SEQ ID NO: 164111

SEQ ID NO: 363546 - RNA, 64 nt, hsa; identical to SEQ ID NO: 164112

SEQ ID NO: 363547 - RNA, 64 nt, hsa; identical to SEQ ID NO: 164113

SEQ ID NO: 363548 - RNA, 64 nt, hsa; identical to SEQ ID NO: 164114

SEQ ID NO: 363549 - RNA, 64 nt, hsa; identical to SEQ ID NO: 164115

SEQ ID NO: 363550 - RNA, 64 nt, hsa; identical to SEQ ID NO: 164116

SEQ ID NO: 363551 - RNA, 64 nt, hsa; identical to SEQ ID NO: 164117

SEQ ID NO: 363552 - RNA, 64 nt, hsa; identical to SEQ ID NO: 164118

SEQ ID NO: 363553 - RNA, 64 nt, hsa; identical to SEQ ID NO: 164119

SEQ ID NO: 363554 - RNA, 64 nt, hsa; identical to SEQ ID NO: 164120

SEQ ID NO: 363555 - RNA, 64 nt, hsa; identical to SEQ ID NO: 164121

SEQ ID NO: 363556 - RNA, 64 nt, hsa; identical to SEQ ID NO: 164122

SEQ ID NO: 363557 - RNA, 64 nt, hsa; identical to SEQ ID NO: 164123

SEQ ID NO: 363558 - RNA, 64 nt, hsa; identical to SEQ ID NO: 164124

SEQ ID NO: 363559 - RNA, 64 nt, hsa; identical to SEQ ID NO: 164125

SEQ ID NO: 363560 - RNA, 64 nt, hsa; identical to SEQ ID NO: 164126

SEQ ID NO: 363561 - RNA, 64 nt, hsa; identical to SEQ ID NO: 164127

SEQ ID NO: 363562 - RNA, 64 nt, hsa; identical to SEQ ID NO: 164128

SEQ ID NO: 363563 - RNA, 64 nt, hsa; identical to SEQ ID NO: 164129

SEQ ID NO: 363564 - RNA, 64 nt, hsa; identical to SEQ ID NO: 164130

SEQ ID NO: 363565 - RNA, 64 nt, hsa; identical to SEQ ID NO: 131343

SEQ ID NO: 363566 - RNA, 64 nt, hsa; identical to SEQ ID NO: 131344

SEQ ID NO: 363567 - RNA, 64 nt, hsa; identical to SEQ ID NO: 131345

SEQ ID NO: 363568 - RNA, 64 nt, hsa; identical to SEQ ID NO: 131346

SEQ ID NO: 363569 - RNA, 64 nt, hsa; identical to SEQ ID NO: 131347

SEQ ID NO: 363570 - RNA, 64 nt, hsa; identical to SEQ ID NO: 131348

SEQ ID NO: 363571 - RNA, 64 nt, hsa; identical to SEQ ID NO: 131349

SEQ ID NO: 363572 - RNA, 64 nt, hsa; identical to SEQ ID NO: 131350

SEQ ID NO: 363573 - RNA, 64 nt, hsa
guuugcccuacacggaugggcuguccugggagcuacuggacagucaccuuggugggaaugccag

SEQ ID NO: 363574 - RNA, 64 nt, hsa
gugccagccacgugugaaagaagaacuccaaguuacuggacaccaggacaaaccagguagauca

SEQ ID NO: 363575 - RNA, 64 nt, hsa
agguguauguauguuuuguuguuuuguuuuggaaacuggacaggagucaaaacagggauguuug

SEQ ID NO: 363576 - RNA, 64 nt, hsa
cucuaacaccacacagaaagaggcuggaggagccacuggacaaagcuucugucucuguguguac

SEQ ID NO: 363577 - RNA, 64 nt, hsa
accaaugagaggccacauccagcuacgcaaaguuacuggacaugcggucugcagugcacauuau

SEQ ID NO: 363578 - RNA, 64 nt, hsa
cuuggggaaggguggggagaaauauaggauagacacuggacauggcccauuggagcaccugggc

SEQ ID NO: 363579 - RNA, 64 nt, hsa
cacuggacauggcccauuggagcaccugggccccacuggacaacacugauuccuggagaggugg

SEQ ID NO: 363580 - RNA, 64 nt, hsa
uugcuaaucauuucagagguccaguuuuccuuucacuggacaaucuugaauaggaggaacgcug

SEQ ID NO: 363581 - RNA, 64 nt, hsa
caaaaaaaaaaaaaaaaaagaaagguuguuauggacuggacaccccugaagcccauugccuagg

SEQ ID NO: 363582 - RNA, 64 nt, hsa
agaucagccaaauggccgaugacacaguggcagaacuggacaggcaucuggcagugaagaccaa

SEQ ID NO: 363583 - RNA, 64 nt, hsa
cauuuuaaaacucugauauuggccuucaccugugacuggacacuuuacuagaggcccauuuuca

SEQ ID NO: 363584 - RNA, 64 nt, hsa
ugacuggaaacacgcagccugcuccuggagcuucacuggacauauucuuuaugccacaccuacc

SEQ ID NO: 363585 - RNA, 64 nt, hsa
ccuggauuggacgggaucgcccaacuucacugggacuggacagggaagucuccgcccugauugg

SEQ ID NO: 363586 - RNA, 64 nt, hsa
uguuuuaacuuucuuguggcaagcuauaccggaaaagcggcaugucaaaaauacuuuagguucu

SEQ ID NO: 363587 - RNA, 64 nt, hsa
caucuuuagaaauguaaaauucaguauaguuugaaagcggcacaauuaaaaauuaauuuucuaa

SEQ ID NO: 363588 - RNA, 64 nt, hsa
acuaugcccaggcugaaguccucacccucucuuaaagcggcaccaacgugagagagacaggcag

SEQ ID NO: 363589 - RNA, 64 nt, hsa
gaggggcagccaggcugcucagggaaggggcugaaagcggcagaggagugcccuggcuugguca

SEQ ID NO: 363590 - RNA, 64 nt, hsa
aguucugcguugaguggacggacuuauuccugugaagcggcauaauuugucuccauugaaaaau

SEQ ID NO: 363591 - RNA, 64 nt, hsa
gcagaaucgaggcaguuaacucuuccaagaacagaagcggcauguugaagaaaaucugggggau

SEQ ID NO: 363592 - RNA, 64 nt, hsa
uggcugcuggacgcaccgugcucgcugcccgcagaagcggcacugugcuggcgggcuccgggug

SEQ ID NO: 363593 - RNA, 64 nt, hsa
ugcuugacugcaugcuggaaacuuuguauuuuugaagcggcaaacucuguucucuggaaugcuc

SEQ ID NO: 363594 - RNA, 64 nt, hsa
gcaugcagcucacaucuguuuuagagcauagaagaagcggcaccugccaucuucugaaaacucc

SEQ ID NO: 363595 - RNA, 64 nt, hsa
uagaagaggggugggugcaugucuuaaugcugggaagcggcaacuuugggguugaacuuacuug

SEQ ID NO: 363596 - RNA, 64 nt, hsa
uacauguaaauagacaaaaggaaacauuugccaaaagcggcagaucuuuacugaaagagagagc

SEQ ID NO: 363597 - RNA, 64 nt, hsa
cucuuccaaccacugacauguuguuuaauaaucuaagcggcaguccuggaggcuaccagacuua

SEQ ID NO: 363598 - RNA, 64 nt, hsa
gcagacccaugcagugugcugccagggcuggaagaagcggcacccgggggcgcucaccugugaa

SEQ ID NO: 363599 - RNA, 64 nt, hsa
gcgaagacugcuccuggugagccugugcauagggaagcggcagcaucggaugucagcccccugc

SEQ ID NO: 363600 - RNA, 64 nt, hsa
gucagaguugaagaggcugacuuggcccacugcuaagcggcagaggcagggccagccauccugu

SEQ ID NO: 363601 - RNA, 64 nt, hsa
caaacuagcugugucaaggcccgugauagccagaaagcggcaguuucaguccauaucaauugug

SEQ ID NO: 363602 - RNA, 64 nt, hsa
ccagccggacugccgggcauuggggccguuuguuaagcggcacucauuuugcggaggccaugcg

SEQ ID NO: 363603 - RNA, 64 nt, hsa
ccuugcuuucccaaauacugcaugugacuuuccuaagcggcagcugaaagacucgagcccgugc

SEQ ID NO: 363604 - RNA, 64 nt, hsa
aaaauaguggugaugagggcuuuaaccaagugcaaagcggcaugaaugcaaaguauuuuucugc

SEQ ID NO: 363605 - RNA, 64 nt, hsa
gaaggucuuuugagggcuaaaaagguccuguaagaagcggcauagcacccguggugcaugguau

SEQ ID NO: 363606 - RNA, 64 nt, hsa
uguuuguuugagguuuaaaacaauucaauuacaaaagcggcagcagccaaugcacgccccugca

SEQ ID NO: 363607 - RNA, 64 nt, hsa
cgugcucaggcugcuccaggcaugugggaagcugaagcggcagcucugcgccaucuaccggcug

SEQ ID NO: 363608 - RNA, 64 nt, hsa
uggaauuucaguacagaacacugacaaacaaggaaagcggcagagaaagaagaaagaccuagaa

SEQ ID NO: 363609 - RNA, 64 nt, hsa
cugugguuacccagugucuucucuacauggcauaaagcggcaaagcccaccauuaggugaggcg

SEQ ID NO: 363610 - RNA, 64 nt, hsa
gagagaauguuugagguccagccuugguguagagaagcggcagaaacagaaaucccaaaaggug

SEQ ID NO: 363611 - RNA, 64 nt, hsa
uguguuuucacuuucgugcagauaacuggaaguaaagcggcaaacagugcuuauuacaugcuaa

SEQ ID NO: 363612 - RNA, 64 nt, hsa
cucgcgcucagaaaaggaccuugugagacggaggaagcggcagaaggcggacgcgugccggcgg

SEQ ID NO: 363613 - RNA, 64 nt, hsa
auaguaaggauuauuggcuuguuucgaugaguggaagcggcauguuuguagcauacaaguuauu

SEQ ID NO: 363614 - RNA, 64 nt, hsa
augcacauguugcaacaagagcuucugggaagguaagcggcaucggagcuagaucacguuucac

SEQ ID NO: 363615 - RNA, 64 nt, hsa
caggcugacuggaagauggaaagccacaggaaggaagcggcaccugauggugaucuuggcacuc

SEQ ID NO: 363616 - RNA, 64 nt, hsa; identical to SEQ ID NO: 363614

SEQ ID NO: 363617 - RNA, 64 nt, hsa
ccagcuggauucucugccugccacugucaggguuaagcggcaggcaggauugggcuuuucuggc

SEQ ID NO: 363618 - RNA, 64 nt, hsa
gcucucccaaauagguaccucaaaaacuguuagcaagcggcauuuggaugucuugacaggggcu

SEQ ID NO: 363619 - RNA, 64 nt, hsa
ugucucugggaaagcaagggaggcuuccuggaggaagcggcauuguuaugagccuugaaggaag

SEQ ID NO: 363620 - RNA, 59 nt, hsa
ugcuacaauccagcuucuaauccgcccaaaagcggcagccaaucggagcgcgaggacgu

SEQ ID NO: 363621 - RNA, 64 nt, hsa
uaugugaccaaggcagcaggggcuuuuaccugcuaagcggcaauccuuuggcccugagaauuug

SEQ ID NO: 363622 - RNA, 64 nt, hsa
acaugguccuucaaacucccaaccaaagugagaaaagcggcaugcagugaaaugagcagugagc

SEQ ID NO: 363623 - RNA, 64 nt, hsa
uuucucaaucuugccucacagugacugcagcgccaagcggcauccaccaagcaucaaguuggag

SEQ ID NO: 363624 - RNA, 64 nt, hsa
gugcuggccccuccugugcccucugcccugguggaagcggcagccacaaguccuccucagggag

SEQ ID NO: 363625 - RNA, 64 nt, hsa
accugcuggcccauggcccggguguagagaaaccaagcggcagccaccaccaguguuguuuuga

SEQ ID NO: 363626 - RNA, 64 nt, hsa
cucuugcugggagguccggaucguuccugcagggaagcggcagcacacggagaccacuugguug

SEQ ID NO: 363627 - RNA, 64 nt, hsa
uguguaugaguuucuaugugagcaugcauauauacuucacaaagagaugaccuauauaaaucaa

SEQ ID NO: 363628 - RNA, 64 nt, hsa
gguccuugaauaaaauugucuuacuucauuaauacuucacaauacuauuugcauaagacaaaau

SEQ ID NO: 363629 - RNA, 64 nt, hsa
cucucuuacugcuucauguaauuuuguaucaccucuucacaauuuaguucguaccuggcuugaa

SEQ ID NO: 363630 - RNA, 64 nt, hsa
ccauguucaccaagauuugguggguccacacggucuucacaaagaaggaagaaaagaaggagug

SEQ ID NO: 363631 - RNA, 64 nt, hsa
gcaagcccaguuucuccugagcauucagacccccaggccccagcacuuggcguuuucaggaggc

SEQ ID NO: 363632 - RNA, 64 nt, hsa
cccaaaacacggccccgacacuuaguguggccccaggccccagcgagccucgcccucccaguuu

SEQ ID NO: 363633 - RNA, 64 nt, hsa
ucccuccccuaaacugacuggacggcugccaaggaggccccaaacccaggccccaugcaaaggc

SEQ ID NO: 363634 - RNA, 64 nt, hsa
cugacuggacggcugccaaggaggccccaaacccaggccccaugcaaaggcacgugguuuccuu

SEQ ID NO: 363635 - RNA, 64 nt, hsa
uccauacccgaaaggugaaaccagcuuucauuauaggccccagugggccacuuggguuuugaga

SEQ ID NO: 363636 - RNA, 64 nt, hsa
agaggugaggccagaaaguuguuaggccugccgcaggccccacccucaagcauuccucaggaag

SEQ ID NO: 363637 - RNA, 64 nt, hsa
cuuuccucccagagcucagcccaugucacccuccaggccccagaauccagaguggccucauuuc

SEQ ID NO: 363638 - RNA, 64 nt, hsa
gucuugcucugggaauuaggugaccuuccuggggaggccccaggagagugaaucagggacucuu

SEQ ID NO: 363639 - RNA, 64 nt, hsa
ucagggucucaccucacauugucccuacaaggacaggccccaacugauaaccguugcuuuuuuu

SEQ ID NO: 363640 - RNA, 64 nt, hsa
ugguggguaacacccucaagucucuuugccagugaggccccaccacaucggugugaguuagguu

SEQ ID NO: 363641 - RNA, 64 nt, hsa
acacucaaaaucacugccaugguucaauguucccaggccccaggccauccacuugccggccccc

SEQ ID NO: 363642 - RNA, 64 nt, hsa
cuaggguauccuugggcccaaugaauuaggggugaggccccagaacccguuaucuaugaguugu

SEQ ID NO: 363643 - RNA, 63 nt, hsa
ucccagugaucuguauuugaugaggaggagccgaggccccagcuucauccagcuucaaccaau

SEQ ID NO: 363644 - RNA, 64 nt, hsa
ccugcacacuccagcccaaagggucuguggccggaggccccacgagcaggccccagcagucacc

SEQ ID NO: 363645 - RNA, 64 nt, hsa
gcccaaagggucuguggccggaggccccacgagcaggccccagcagucaccggcucuggucuug

SEQ ID NO: 363646 - RNA, 64 nt, hsa
aacguacucaggcuugugccacgggugagcacugaggccccagguguccucccucccccacugu

SEQ ID NO: 363647 - RNA, 64 nt, hsa
ggugagaacagguucugagagggggcuucuaggaaggccccagcccuaguccuaggcgacuuga

SEQ ID NO: 363648 - RNA, 64 nt, hsa
aguguaagaaacacacugaggcagggaaguccccaggccccaggaagccgugcccugcccccgu

SEQ ID NO: 363649 - RNA, 64 nt, hsa
gucccacucaagccaagcagccaagcuccuugggaggccccacuggggaaauaacagcuguggc

SEQ ID NO: 363650 - RNA, 64 nt, hsa
ucggacuaugacuggcuacggggaggccaccaccaggccccagcucuccacccugaacucccca

SEQ ID NO: 363651 - RNA, 64 nt, hsa
ccccgaccugggaugcgcacaguguccccaacgcaggccccacucugagccugcccugggcagc

SEQ ID NO: 363652 - RNA, 64 nt, hsa
gucacauaagccaacgccagagccccuccaccucaggccccagccccugccucuccauuauuua

SEQ ID NO: 363653 - RNA, 64 nt, hsa
ccccagaggcgagggaccaguggaggugccagggaggccccaggacccugugguccccuggcuc

SEQ ID NO: 363654 - RNA, 64 nt, hsa
cuagaguaccuuugccuaaacucuuuuagaauugaggccccaacuuugauggcacauuuaauac

SEQ ID NO: 363655 - RNA, 64 nt, hsa
uucccagcauccuaggcucagcuuaccgggugauaggccccauaagacacacacaugagcaggg

SEQ ID NO: 363656 - RNA, 64 nt, hsa
aggcccgagagccuccccaggccucuucgugggaaggccccaguaccacucguaggaggucuca

SEQ ID NO: 363657 - RNA, 64 nt, hsa
cagcaucagacgggcuuccaggaccgcagcaggcaggccccagcgccgagacuccuggugacag

SEQ ID NO: 363658 - RNA, 64 nt, hsa
ccgggcaaaggagcacaaggaaaccaagcagcagaggccccaucagcacagagggccucguucc

SEQ ID NO: 363659 - RNA, 64 nt, hsa
aauucucuauucugacauuacagaccaccggauaaggccccauucuuccuuuacacccuccccu

SEQ ID NO: 363660 - RNA, 64 nt, hsa
ucccuuuucccauuguuccugcgcugcaaauugcaggccccagcaaucgugacugacguuugcu

SEQ ID NO: 363661 - RNA, 64 nt, hsa
uucgguugacccaggucauggaauggaaacggugaggccccaguggcuguucuggaagaaacag

SEQ ID NO: 363662 - RNA, 64 nt, hsa
guggcuguucuggaagaaacagaucuccuggcaaaggccccagcaucucccucacugaaaccag

SEQ ID NO: 363663 - RNA, 64 nt, hsa
gaacugagcuccucugggcaggaccucagaguccaggccccaaaaccacagcccugucagugca

SEQ ID NO: 363664 - RNA, 64 nt, hsa
ccaacaccagggaugguacuagggggaagugacaaggccccagagacucagagggaggaaucga

SEQ ID NO: 363665 - RNA, 64 nt, hsa
uccugacagaaagcuccucccacccaaaugggccaggccccagcaugauccugaaaucugcauc

SEQ ID NO: 363666 - RNA, 57 nt, hsa; identical to SEQ ID NO: 262389

SEQ ID NO: 363667 - RNA, 64 nt, hsa
ggguccugggucuucccaaccauaccccgagaucaggccccaccugccagcucuacugggcuug

SEQ ID NO: 363668 - RNA, 64 nt, hsa
cagacaccgucucacacguuggcuuuggacaaccaggccccaacuuggucccugcccuagggac

SEQ ID NO: 363669 - RNA, 64 nt, hsa
ugcaggggaggcuguggggguccuggcagccaggaggccccaggugguuuugaggcucgcucuu

SEQ ID NO: 363670 - RNA, 64 nt, hsa
gcggugccugagaagagggugaaggagcuggggcaggccccauccugggcauuggagaugauga

SEQ ID NO: 363671 - RNA, 64 nt, hsa
ccaaauccuaaagccuccaucucuaauaaauggaaggccccaaggcccugaggggaucucaaau

SEQ ID NO: 363672 - RNA, 64 nt, hsa
acgacuucccccuuugggggaccccaaaauuuggaggccccauucuaggacucuggggauccca

SEQ ID NO: 363673 - RNA, 64 nt, hsa
guagagaccccuguuagccagcccucgaucauugaggccccauuauuaacagauacucccauaa

SEQ ID NO: 363674 - RNA, 64 nt, hsa
uggcgcugcaggggugucggcgcgccaccucuccaggccccagaagcccuucuugcccaaaggc

SEQ ID NO: 363675 - RNA, 64 nt, hsa
cacacaaaccucugugguauaggugaggggugugaggccccagccuggagccaggcacugggug

SEQ ID NO: 363676 - RNA, 64 nt, hsa
augguaucugagcugcccacacccccaccugccaaggccccacagagcccaaaacagaaggggg

SEQ ID NO: 363677 - RNA, 64 nt, hsa
gcagggccugcaggugcuccccgcccugagacccaggccccaaaucagcaauaaugaacaaacc

SEQ ID NO: 363678 - RNA, 64 nt, hsa
cacccaagguugucagcuuuggauugcuggggccaggccccauggaggguauacugaggggucu

SEQ ID NO: 363679 - RNA, 64 nt, hsa
ggaacucuccuggccuucuaggaauggaggagccaggccccaccccuucccuauaggaacagcc

SEQ ID NO: 363680 - RNA, 64 nt, hsa
gcccagguauccugggggaagaggagaugugaucaggccccaccccuguaaucaggcaaggagg

SEQ ID NO: 363681 - RNA, 64 nt, hsa; identical to SEQ ID NO: 363627

SEQ ID NO: 363682 - RNA, 64 nt, hsa; identical to SEQ ID NO: 363628

SEQ ID NO: 363683 - RNA, 64 nt, hsa; identical to SEQ ID NO: 363629

SEQ ID NO: 363684 - RNA, 64 nt, hsa; identical to SEQ ID NO: 363630

SEQ ID NO: 363685 - RNA, 64 nt, hsa; identical to SEQ ID NO: 363631

SEQ ID NO: 363686 - RNA, 64 nt, hsa; identical to SEQ ID NO: 363632

SEQ ID NO: 363687 - RNA, 64 nt, hsa; identical to SEQ ID NO: 363633

SEQ ID NO: 363688 - RNA, 64 nt, hsa; identical to SEQ ID NO: 363634

SEQ ID NO: 363689 - RNA, 64 nt, hsa; identical to SEQ ID NO: 363635

SEQ ID NO: 363690 - RNA, 64 nt, hsa; identical to SEQ ID NO: 363636

SEQ ID NO: 363691 - RNA, 64 nt, hsa; identical to SEQ ID NO: 363637

SEQ ID NO: 363692 - RNA, 64 nt, hsa; identical to SEQ ID NO: 363638

SEQ ID NO: 363693 - RNA, 64 nt, hsa; identical to SEQ ID NO: 363639

SEQ ID NO: 363694 - RNA, 64 nt, hsa; identical to SEQ ID NO: 363640

SEQ ID NO: 363695 - RNA, 64 nt, hsa; identical to SEQ ID NO: 363641

SEQ ID NO: 363696 - RNA, 64 nt, hsa; identical to SEQ ID NO: 363642

SEQ ID NO: 363697 - RNA, 63 nt, hsa; identical to SEQ ID NO: 363643

SEQ ID NO: 363698 - RNA, 64 nt, hsa; identical to SEQ ID NO: 363644

SEQ ID NO: 363699 - RNA, 64 nt, hsa; identical to SEQ ID NO: 363645

SEQ ID NO: 363700 - RNA, 64 nt, hsa; identical to SEQ ID NO: 363646

SEQ ID NO: 363701 - RNA, 64 nt, hsa; identical to SEQ ID NO: 363647

SEQ ID NO: 363702 - RNA, 64 nt, hsa; identical to SEQ ID NO: 363648

SEQ ID NO: 363703 - RNA, 64 nt, hsa; identical to SEQ ID NO: 363649

SEQ ID NO: 363704 - RNA, 64 nt, hsa; identical to SEQ ID NO: 363650

SEQ ID NO: 363705 - RNA, 64 nt, hsa; identical to SEQ ID NO: 363651

SEQ ID NO: 363706 - RNA, 64 nt, hsa; identical to SEQ ID NO: 363652

SEQ ID NO: 363707 - RNA, 64 nt, hsa; identical to SEQ ID NO: 363653

SEQ ID NO: 363708 - RNA, 64 nt, hsa; identical to SEQ ID NO: 363654

SEQ ID NO: 363709 - RNA, 64 nt, hsa; identical to SEQ ID NO: 363655

SEQ ID NO: 363710 - RNA, 64 nt, hsa; identical to SEQ ID NO: 363656

SEQ ID NO: 363711 - RNA, 64 nt, hsa; identical to SEQ ID NO: 363657

SEQ ID NO: 363712 - RNA, 64 nt, hsa; identical to SEQ ID NO: 363658

SEQ ID NO: 363713 - RNA, 64 nt, hsa; identical to SEQ ID NO: 363659

SEQ ID NO: 363714 - RNA, 64 nt, hsa; identical to SEQ ID NO: 363660

SEQ ID NO: 363715 - RNA, 64 nt, hsa; identical to SEQ ID NO: 363661

SEQ ID NO: 363716 - RNA, 64 nt, hsa; identical to SEQ ID NO: 363662

SEQ ID NO: 363717 - RNA, 64 nt, hsa; identical to SEQ ID NO: 363663

SEQ ID NO: 363718 - RNA, 64 nt, hsa; identical to SEQ ID NO: 363664

SEQ ID NO: 363719 - RNA, 64 nt, hsa; identical to SEQ ID NO: 363665

SEQ ID NO: 363720 - RNA, 57 nt, hsa; identical to SEQ ID NO: 262389

SEQ ID NO: 363721 - RNA, 64 nt, hsa; identical to SEQ ID NO: 363667

SEQ ID NO: 363722 - RNA, 64 nt, hsa; identical to SEQ ID NO: 363668

SEQ ID NO: 363723 - RNA, 64 nt, hsa; identical to SEQ ID NO: 363669

SEQ ID NO: 363724 - RNA, 64 nt, hsa; identical to SEQ ID NO: 363670

SEQ ID NO: 363725 - RNA, 64 nt, hsa; identical to SEQ ID NO: 363671

SEQ ID NO: 363726 - RNA, 64 nt, hsa; identical to SEQ ID NO: 363672

SEQ ID NO: 363727 - RNA, 64 nt, hsa; identical to SEQ ID NO: 363673

SEQ ID NO: 363728 - RNA, 64 nt, hsa; identical to SEQ ID NO: 363674

SEQ ID NO: 363729 - RNA, 64 nt, hsa; identical to SEQ ID NO: 363675

SEQ ID NO: 363730 - RNA, 64 nt, hsa; identical to SEQ ID NO: 363676

SEQ ID NO: 363731 - RNA, 64 nt, hsa; identical to SEQ ID NO: 363677

SEQ ID NO: 363732 - RNA, 64 nt, hsa; identical to SEQ ID NO: 363678

SEQ ID NO: 363733 - RNA, 64 nt, hsa; identical to SEQ ID NO: 363679

SEQ ID NO: 363734 - RNA, 64 nt, hsa; identical to SEQ ID NO: 363680

SEQ ID NO: 363735 - RNA, 64 nt, hsa; identical to SEQ ID NO: 363627

SEQ ID NO: 363736 - RNA, 64 nt, hsa; identical to SEQ ID NO: 363628

SEQ ID NO: 363737 - RNA, 64 nt, hsa; identical to SEQ ID NO: 363629

SEQ ID NO: 363738 - RNA, 64 nt, hsa; identical to SEQ ID NO: 363630

SEQ ID NO: 363739 - RNA, 64 nt, hsa; identical to SEQ ID NO: 363631

SEQ ID NO: 363740 - RNA, 64 nt, hsa; identical to SEQ ID NO: 363632

SEQ ID NO: 363741 - RNA, 64 nt, hsa; identical to SEQ ID NO: 363633

SEQ ID NO: 363742 - RNA, 64 nt, hsa; identical to SEQ ID NO: 363634

SEQ ID NO: 363743 - RNA, 64 nt, hsa; identical to SEQ ID NO: 363635

SEQ ID NO: 363744 - RNA, 64 nt, hsa; identical to SEQ ID NO: 363636

SEQ ID NO: 363745 - RNA, 64 nt, hsa; identical to SEQ ID NO: 363637

SEQ ID NO: 363746 - RNA, 64 nt, hsa; identical to SEQ ID NO: 363638

SEQ ID NO: 363747 - RNA, 64 nt, hsa; identical to SEQ ID NO: 363639

SEQ ID NO: 363748 - RNA, 64 nt, hsa; identical to SEQ ID NO: 363640

SEQ ID NO: 363749 - RNA, 64 nt, hsa; identical to SEQ ID NO: 363641

SEQ ID NO: 363750 - RNA, 64 nt, hsa; identical to SEQ ID NO: 363642

SEQ ID NO: 363751 - RNA, 63 nt, hsa; identical to SEQ ID NO: 363643

SEQ ID NO: 363752 - RNA, 64 nt, hsa; identical to SEQ ID NO: 363644

SEQ ID NO: 363753 - RNA, 64 nt, hsa; identical to SEQ ID NO: 363645

SEQ ID NO: 363754 - RNA, 64 nt, hsa; identical to SEQ ID NO: 363646

SEQ ID NO: 363755 - RNA, 64 nt, hsa; identical to SEQ ID NO: 363647

SEQ ID NO: 363756 - RNA, 64 nt, hsa; identical to SEQ ID NO: 363648

SEQ ID NO: 363757 - RNA, 64 nt, hsa; identical to SEQ ID NO: 363649

SEQ ID NO: 363758 - RNA, 64 nt, hsa; identical to SEQ ID NO: 363650

SEQ ID NO: 363759 - RNA, 64 nt, hsa; identical to SEQ ID NO: 363651

SEQ ID NO: 363760 - RNA, 64 nt, hsa; identical to SEQ ID NO: 363652

SEQ ID NO: 363761 - RNA, 64 nt, hsa; identical to SEQ ID NO: 363653

SEQ ID NO: 363762 - RNA, 64 nt, hsa; identical to SEQ ID NO: 363654

SEQ ID NO: 363763 - RNA, 64 nt, hsa; identical to SEQ ID NO: 363655

SEQ ID NO: 363764 - RNA, 64 nt, hsa; identical to SEQ ID NO: 363656

SEQ ID NO: 363765 - RNA, 64 nt, hsa; identical to SEQ ID NO: 363657

SEQ ID NO: 363766 - RNA, 64 nt, hsa; identical to SEQ ID NO: 363658

SEQ ID NO: 363767 - RNA, 64 nt, hsa; identical to SEQ ID NO: 363659

SEQ ID NO: 363768 - RNA, 64 nt, hsa; identical to SEQ ID NO: 363660

SEQ ID NO: 363769 - RNA, 64 nt, hsa; identical to SEQ ID NO: 363661

SEQ ID NO: 363770 - RNA, 64 nt, hsa; identical to SEQ ID NO: 363662

SEQ ID NO: 363771 - RNA, 64 nt, hsa; identical to SEQ ID NO: 363663

SEQ ID NO: 363772 - RNA, 64 nt, hsa; identical to SEQ ID NO: 363664

SEQ ID NO: 363773 - RNA, 64 nt, hsa; identical to SEQ ID NO: 363665

SEQ ID NO: 363774 - RNA, 57 nt, hsa; identical to SEQ ID NO: 262389

SEQ ID NO: 363775 - RNA, 64 nt, hsa; identical to SEQ ID NO: 363667

SEQ ID NO: 363776 - RNA, 64 nt, hsa; identical to SEQ ID NO: 363668

SEQ ID NO: 363777 - RNA, 64 nt, hsa; identical to SEQ ID NO: 363669

SEQ ID NO: 363778 - RNA, 64 nt, hsa; identical to SEQ ID NO: 363670

SEQ ID NO: 363779 - RNA, 64 nt, hsa; identical to SEQ ID NO: 363671

SEQ ID NO: 363780 - RNA, 64 nt, hsa; identical to SEQ ID NO: 363672

SEQ ID NO: 363781 - RNA, 64 nt, hsa; identical to SEQ ID NO: 363673

SEQ ID NO: 363782 - RNA, 64 nt, hsa; identical to SEQ ID NO: 363674

SEQ ID NO: 363783 - RNA, 64 nt, hsa; identical to SEQ ID NO: 363675

SEQ ID NO: 363784 - RNA, 64 nt, hsa; identical to SEQ ID NO: 363676

SEQ ID NO: 363785 - RNA, 64 nt, hsa; identical to SEQ ID NO: 363677

SEQ ID NO: 363786 - RNA, 64 nt, hsa; identical to SEQ ID NO: 363678

SEQ ID NO: 363787 - RNA, 64 nt, hsa; identical to SEQ ID NO: 363679

SEQ ID NO: 363788 - RNA, 64 nt, hsa; identical to SEQ ID NO: 363680

SEQ ID NO: 363789 - RNA, 64 nt, hsa; identical to SEQ ID NO: 361852

SEQ ID NO: 363790 - RNA, 64 nt, hsa; identical to SEQ ID NO: 361853

SEQ ID NO: 363791 - RNA, 64 nt, hsa; identical to SEQ ID NO: 361854

SEQ ID NO: 363792 - RNA, 64 nt, hsa; identical to SEQ ID NO: 361855

SEQ ID NO: 363793 - RNA, 64 nt, hsa; identical to SEQ ID NO: 361856

SEQ ID NO: 363794 - RNA, 64 nt, hsa; identical to SEQ ID NO: 361857

SEQ ID NO: 363795 - RNA, 64 nt, hsa; identical to SEQ ID NO: 361858

SEQ ID NO: 363796 - RNA, 64 nt, hsa; identical to SEQ ID NO: 361859

SEQ ID NO: 363797 - RNA, 64 nt, hsa; identical to SEQ ID NO: 361860

SEQ ID NO: 363798 - RNA, 64 nt, hsa; identical to SEQ ID NO: 361861

SEQ ID NO: 363799 - RNA, 64 nt, hsa; identical to SEQ ID NO: 361862

SEQ ID NO: 363800 - RNA, 64 nt, hsa; identical to SEQ ID NO: 361863

SEQ ID NO: 363801 - RNA, 64 nt, hsa; identical to SEQ ID NO: 361864

SEQ ID NO: 363802 - RNA, 64 nt, hsa; identical to SEQ ID NO: 361865

SEQ ID NO: 363803 - RNA, 64 nt, hsa; identical to SEQ ID NO: 361866

SEQ ID NO: 363804 - RNA, 64 nt, hsa; identical to SEQ ID NO: 361867

SEQ ID NO: 363805 - RNA, 64 nt, hsa; identical to SEQ ID NO: 361868

SEQ ID NO: 363806 - RNA, 64 nt, hsa; identical to SEQ ID NO: 361869

SEQ ID NO: 363807 - RNA, 64 nt, hsa; identical to SEQ ID NO: 361870

SEQ ID NO: 363808 - RNA, 64 nt, hsa; identical to SEQ ID NO: 361871

SEQ ID NO: 363809 - RNA, 64 nt, hsa; identical to SEQ ID NO: 361872

SEQ ID NO: 363810 - RNA, 64 nt, hsa; identical to SEQ ID NO: 361873

SEQ ID NO: 363811 - RNA, 64 nt, hsa; identical to SEQ ID NO: 361874

SEQ ID NO: 363812 - RNA, 64 nt, hsa; identical to SEQ ID NO: 361875

SEQ ID NO: 363813 - RNA, 64 nt, hsa; identical to SEQ ID NO: 361876

SEQ ID NO: 363814 - RNA, 64 nt, hsa; identical to SEQ ID NO: 361877

SEQ ID NO: 363815 - RNA, 64 nt, hsa; identical to SEQ ID NO: 361878

SEQ ID NO: 363816 - RNA, 64 nt, hsa; identical to SEQ ID NO: 361879

SEQ ID NO: 363817 - RNA, 64 nt, hsa; identical to SEQ ID NO: 361880

SEQ ID NO: 363818 - RNA, 64 nt, hsa; identical to SEQ ID NO: 361881

SEQ ID NO: 363819 - RNA, 64 nt, hsa; identical to SEQ ID NO: 361882

SEQ ID NO: 363820 - RNA, 64 nt, hsa; identical to SEQ ID NO: 361883

SEQ ID NO: 363821 - RNA, 64 nt, hsa; identical to SEQ ID NO: 361884

SEQ ID NO: 363822 - RNA, 64 nt, hsa; identical to SEQ ID NO: 361885

SEQ ID NO: 363823 - RNA, 64 nt, hsa; identical to SEQ ID NO: 361886

SEQ ID NO: 363824 - RNA, 64 nt, hsa; identical to SEQ ID NO: 361887

SEQ ID NO: 363825 - RNA, 64 nt, hsa; identical to SEQ ID NO: 361888

SEQ ID NO: 363826 - RNA, 64 nt, hsa; identical to SEQ ID NO: 361889

SEQ ID NO: 363827 - RNA, 64 nt, hsa; identical to SEQ ID NO: 361890

SEQ ID NO: 363828 - RNA, 64 nt, hsa; identical to SEQ ID NO: 361891

SEQ ID NO: 363829 - RNA, 64 nt, hsa; identical to SEQ ID NO: 361892

SEQ ID NO: 363830 - RNA, 64 nt, hsa; identical to SEQ ID NO: 361893

SEQ ID NO: 363831 - RNA, 64 nt, hsa; identical to SEQ ID NO: 361894

SEQ ID NO: 363832 - RNA, 64 nt, hsa; identical to SEQ ID NO: 361895

SEQ ID NO: 363833 - RNA, 64 nt, hsa; identical to SEQ ID NO: 361896

SEQ ID NO: 363834 - RNA, 64 nt, hsa; identical to SEQ ID NO: 361897

SEQ ID NO: 363835 - RNA, 64 nt, hsa; identical to SEQ ID NO: 361898

SEQ ID NO: 363836 - RNA, 64 nt, hsa; identical to SEQ ID NO: 361899

SEQ ID NO: 363837 - RNA, 64 nt, hsa; identical to SEQ ID NO: 361900

SEQ ID NO: 363838 - RNA, 64 nt, hsa; identical to SEQ ID NO: 361901

SEQ ID NO: 363839 - RNA, 64 nt, hsa; identical to SEQ ID NO: 361902

SEQ ID NO: 363840 - RNA, 64 nt, hsa; identical to SEQ ID NO: 361903

SEQ ID NO: 363841 - RNA, 64 nt, hsa; identical to SEQ ID NO: 361904

SEQ ID NO: 363842 - RNA, 64 nt, hsa; identical to SEQ ID NO: 361905

SEQ ID NO: 363843 - RNA, 64 nt, hsa; identical to SEQ ID NO: 361906

SEQ ID NO: 363844 - RNA, 64 nt, hsa; identical to SEQ ID NO: 361907

SEQ ID NO: 363845 - RNA, 64 nt, hsa; identical to SEQ ID NO: 361908

SEQ ID NO: 363846 - RNA, 64 nt, hsa; identical to SEQ ID NO: 361909

SEQ ID NO: 363847 - RNA, 64 nt, hsa; identical to SEQ ID NO: 361910

SEQ ID NO: 363848 - RNA, 64 nt, hsa; identical to SEQ ID NO: 361911

SEQ ID NO: 363849 - RNA, 64 nt, hsa; identical to SEQ ID NO: 361912

SEQ ID NO: 363850 - RNA, 64 nt, hsa; identical to SEQ ID NO: 178899

SEQ ID NO: 363851 - RNA, 64 nt, hsa; identical to SEQ ID NO: 178900

SEQ ID NO: 363852 - RNA, 64 nt, hsa; identical to SEQ ID NO: 178901

SEQ ID NO: 363853 - RNA, 64 nt, hsa; identical to SEQ ID NO: 178902

SEQ ID NO: 363854 - RNA, 64 nt, hsa; identical to SEQ ID NO: 178903

SEQ ID NO: 363855 - RNA, 64 nt, hsa; identical to SEQ ID NO: 178904

SEQ ID NO: 363856 - RNA, 64 nt, hsa; identical to SEQ ID NO: 178905

SEQ ID NO: 363857 - RNA, 64 nt, hsa; identical to SEQ ID NO: 178906

SEQ ID NO: 363858 - RNA, 64 nt, hsa; identical to SEQ ID NO: 178907

SEQ ID NO: 363859 - RNA, 64 nt, hsa; identical to SEQ ID NO: 178908

SEQ ID NO: 363860 - RNA, 64 nt, hsa; identical to SEQ ID NO: 178909

SEQ ID NO: 363861 - RNA, 64 nt, hsa; identical to SEQ ID NO: 178910

SEQ ID NO: 363862 - RNA, 64 nt, hsa; identical to SEQ ID NO: 178911

SEQ ID NO: 363863 - RNA, 64 nt, hsa; identical to SEQ ID NO: 178912

SEQ ID NO: 363864 - RNA, 64 nt, hsa; identical to SEQ ID NO: 178913

SEQ ID NO: 363865 - RNA, 64 nt, hsa; identical to SEQ ID NO: 178914

SEQ ID NO: 363866 - RNA, 64 nt, hsa; identical to SEQ ID NO: 178915

SEQ ID NO: 363867 - RNA, 64 nt, hsa; identical to SEQ ID NO: 178916

SEQ ID NO: 363868 - RNA, 64 nt, hsa; identical to SEQ ID NO: 178917

SEQ ID NO: 363869 - RNA, 64 nt, hsa; identical to SEQ ID NO: 178918

SEQ ID NO: 363870 - RNA, 64 nt, hsa; identical to SEQ ID NO: 178919

SEQ ID NO: 363871 - RNA, 64 nt, hsa; identical to SEQ ID NO: 178920

SEQ ID NO: 363872 - RNA, 64 nt, hsa; identical to SEQ ID NO: 178921

SEQ ID NO: 363873 - RNA, 64 nt, hsa; identical to SEQ ID NO: 178922

SEQ ID NO: 363874 - RNA, 64 nt, hsa; identical to SEQ ID NO: 178923

SEQ ID NO: 363875 - RNA, 64 nt, hsa; identical to SEQ ID NO: 178924

SEQ ID NO: 363876 - RNA, 58 nt, hsa; identical to SEQ ID NO: 178925

SEQ ID NO: 363877 - RNA, 64 nt, hsa; identical to SEQ ID NO: 178926

SEQ ID NO: 363878 - RNA, 64 nt, hsa; identical to SEQ ID NO: 178927

SEQ ID NO: 363879 - RNA, 64 nt, hsa; identical to SEQ ID NO: 178928

SEQ ID NO: 363880 - RNA, 64 nt, hsa; identical to SEQ ID NO: 178929

SEQ ID NO: 363881 - RNA, 64 nt, hsa; identical to SEQ ID NO: 178930

SEQ ID NO: 363882 - RNA, 64 nt, hsa; identical to SEQ ID NO: 178931

SEQ ID NO: 363883 - RNA, 64 nt, hsa; identical to SEQ ID NO: 178932

SEQ ID NO: 363884 - RNA, 64 nt, hsa; identical to SEQ ID NO: 178933

SEQ ID NO: 363885 - RNA, 64 nt, hsa; identical to SEQ ID NO: 178934

SEQ ID NO: 363886 - RNA, 64 nt, hsa; identical to SEQ ID NO: 178935

SEQ ID NO: 363887 - RNA, 64 nt, hsa; identical to SEQ ID NO: 178936

SEQ ID NO: 363888 - RNA, 64 nt, hsa; identical to SEQ ID NO: 178937

SEQ ID NO: 363889 - RNA, 64 nt, hsa; identical to SEQ ID NO: 178938

SEQ ID NO: 363890 - RNA, 64 nt, hsa; identical to SEQ ID NO: 178939

SEQ ID NO: 363891 - RNA, 64 nt, hsa; identical to SEQ ID NO: 178940

SEQ ID NO: 363892 - RNA, 64 nt, hsa; identical to SEQ ID NO: 178941

SEQ ID NO: 363893 - RNA, 64 nt, hsa; identical to SEQ ID NO: 178942

SEQ ID NO: 363894 - RNA, 64 nt, hsa; identical to SEQ ID NO: 178943

SEQ ID NO: 363895 - RNA, 64 nt, hsa; identical to SEQ ID NO: 178944

SEQ ID NO: 363896 - RNA, 60 nt, hsa; identical to SEQ ID NO: 178945

SEQ ID NO: 363897 - RNA, 64 nt, hsa; identical to SEQ ID NO: 178946

SEQ ID NO: 363898 - RNA, 64 nt, hsa; identical to SEQ ID NO: 178947

SEQ ID NO: 363899 - RNA, 64 nt, hsa; identical to SEQ ID NO: 178948

SEQ ID NO: 363900 - RNA, 64 nt, hsa; identical to SEQ ID NO: 178949

SEQ ID NO: 363901 - RNA, 64 nt, hsa; identical to SEQ ID NO: 178950

SEQ ID NO: 363902 - RNA, 64 nt, hsa; identical to SEQ ID NO: 178951

SEQ ID NO: 363903 - RNA, 64 nt, hsa; identical to SEQ ID NO: 178952

SEQ ID NO: 363904 - RNA, 64 nt, hsa; identical to SEQ ID NO: 178953

SEQ ID NO: 363905 - RNA, 64 nt, hsa; identical to SEQ ID NO: 178954

SEQ ID NO: 363906 - RNA, 64 nt, hsa; identical to SEQ ID NO: 178955

SEQ ID NO: 363907 - RNA, 64 nt, hsa; identical to SEQ ID NO: 178956

SEQ ID NO: 363908 - RNA, 64 nt, hsa; identical to SEQ ID NO: 178957

SEQ ID NO: 363909 - RNA, 64 nt, hsa; identical to SEQ ID NO: 178958

SEQ ID NO: 363910 - RNA, 64 nt, hsa; identical to SEQ ID NO: 178959

SEQ ID NO: 363911 - RNA, 64 nt, hsa; identical to SEQ ID NO: 178960

SEQ ID NO: 363912 - RNA, 64 nt, hsa; identical to SEQ ID NO: 178961

SEQ ID NO: 363913 - RNA, 64 nt, hsa; identical to SEQ ID NO: 178962

SEQ ID NO: 363914 - RNA, 64 nt, hsa; identical to SEQ ID NO: 178963

SEQ ID NO: 363915 - RNA, 64 nt, hsa; identical to SEQ ID NO: 178964

SEQ ID NO: 363916 - RNA, 64 nt, hsa; identical to SEQ ID NO: 178965

SEQ ID NO: 363917 - RNA, 64 nt, hsa; identical to SEQ ID NO: 178966

SEQ ID NO: 363918 - RNA, 64 nt, hsa; identical to SEQ ID NO: 178967

SEQ ID NO: 363919 - RNA, 64 nt, hsa; identical to SEQ ID NO: 178968

SEQ ID NO: 363920 - RNA, 64 nt, hsa; identical to SEQ ID NO: 178969

SEQ ID NO: 363921 - RNA, 64 nt, hsa; identical to SEQ ID NO: 178970

SEQ ID NO: 363922 - RNA, 64 nt, hsa; identical to SEQ ID NO: 178971

SEQ ID NO: 363923 - RNA, 64 nt, hsa; identical to SEQ ID NO: 178972

SEQ ID NO: 363924 - RNA, 64 nt, hsa; identical to SEQ ID NO: 178973

SEQ ID NO: 363925 - RNA, 64 nt, hsa; identical to SEQ ID NO: 178974

SEQ ID NO: 363926 - RNA, 64 nt, hsa; identical to SEQ ID NO: 178975

SEQ ID NO: 363927 - RNA, 64 nt, hsa; identical to SEQ ID NO: 178976

SEQ ID NO: 363928 - RNA, 64 nt, hsa; identical to SEQ ID NO: 178977

SEQ ID NO: 363929 - RNA, 64 nt, hsa; identical to SEQ ID NO: 178978

SEQ ID NO: 363930 - RNA, 64 nt, hsa; identical to SEQ ID NO: 178979

SEQ ID NO: 363931 - RNA, 64 nt, hsa; identical to SEQ ID NO: 178980

SEQ ID NO: 363932 - RNA, 64 nt, hsa; identical to SEQ ID NO: 178981

SEQ ID NO: 363933 - RNA, 64 nt, hsa; identical to SEQ ID NO: 178982

SEQ ID NO: 363934 - RNA, 64 nt, hsa; identical to SEQ ID NO: 178983

SEQ ID NO: 363935 - RNA, 64 nt, hsa; identical to SEQ ID NO: 178984

SEQ ID NO: 363936 - RNA, 64 nt, hsa; identical to SEQ ID NO: 178985

SEQ ID NO: 363937 - RNA, 64 nt, hsa; identical to SEQ ID NO: 178986

SEQ ID NO: 363938 - RNA, 64 nt, hsa; identical to SEQ ID NO: 178987

SEQ ID NO: 363939 - RNA, 64 nt, hsa; identical to SEQ ID NO: 178988

SEQ ID NO: 363940 - RNA, 64 nt, hsa; identical to SEQ ID NO: 178989

SEQ ID NO: 363941 - RNA, 64 nt, hsa; identical to SEQ ID NO: 178990

SEQ ID NO: 363942 - RNA, 64 nt, hsa; identical to SEQ ID NO: 178991

SEQ ID NO: 363943 - RNA, 64 nt, hsa
auggaaagaggugaaaaugaagaaggaagcuguguugaaacagaaaaauaagucaaaaggaaca

SEQ ID NO: 363944 - RNA, 64 nt, hsa
uaugacaugaaaaguuauuuaugcuauaaauuuuuugaaacacaauaccuacaauaaacuggua

SEQ ID NO: 363945 - RNA, 64 nt, hsa
caaauacuuugauauauuauaacucuauuggucuuugaaacaaagcgauacaguguagguggua

SEQ ID NO: 363946 - RNA, 64 nt, hsa
aaacaggggagcuuugucuggaaaauacacugaguugaaacacuucauccuuggaaggauuaua

SEQ ID NO: 363947 - RNA, 64 nt, hsa
guguucuguugaaauuuuuguuuuuuuaccuuuauugaaacaacaaaaagucaguauugaaaca

SEQ ID NO: 363948 - RNA, 64 nt, hsa
uuuuuaccuuuauugaaacaacaaaaagucaguauugaaacauaucuuccuguuuucuguuguc

SEQ ID NO: 363949 - RNA, 64 nt, hsa
acuuauguauuuaugaccuuauaguguuaauaucuugaaacauagagaucuauguacuguaaua

SEQ ID NO: 363950 - RNA, 64 nt, hsa
gaaaugucuggucuguccaccccaucaacaagucuugaaacaagcaacagauggauagucuguc

SEQ ID NO: 363951 - RNA, 64 nt, hsa
gugagcagucuucuuaugugucagcucauuauuuuugaaacauuugccuuuaggcuguucuuug

SEQ ID NO: 363952 - RNA, 64 nt, hsa
agcccccucuugggggguuggggaagucucuuuuuugaaacacuucagaacugcugcuauaaag

SEQ ID NO: 363953 - RNA, 64 nt, hsa
cuaugcuaaguccuuguuaauagucuuacccuccuugaaacacuugaacacuugaugacuuuag

SEQ ID NO: 363954 - RNA, 64 nt, hsa
uaaaaacucuuguuccaaaguccugucuuaacuauugaaacaccuuaaucugugguuacuaauc

SEQ ID NO: 363955 - RNA, 64 nt, hsa
aggugcaaaacauagauauagaacugaacagggcuugaaacaauauuaggauuacuacccaggg

SEQ ID NO: 363956 - RNA, 64 nt, hsa
uuucuucaguuagaaauauauauccuuccuucaguugaaacauauaccuuuuucacaucuagga

SEQ ID NO: 363957 - RNA, 64 nt, hsa
caucuauuuauaugcaaacauaaaaauguaaauauugaaacaagauugcuucaauaugcuuauu

SEQ ID NO: 363958 - RNA, 64 nt, hsa
uaguucuuguagauaacacagggauguagauaaguugaaacaaaaccaguguccucuaagucuc

SEQ ID NO: 363959 - RNA, 64 nt, hsa
uuuuggggggcuuaaggauuuuuuuuuuuucuguuugaaacaguuuuauacuuucugauauagu

SEQ ID NO: 363960 - RNA, 64 nt, hsa
cuaguugacuuuucucuuagccugaauguggacguugaaacauaucacuucagggcuuggaaaa

SEQ ID NO: 363961 - RNA, 64 nt, hsa
ugccaagaacuuucucuugcuaucauugcuccuuuugaaacaauucaauuuucaugucuacagc

SEQ ID NO: 363962 - RNA, 64 nt, hsa
aaagguaacaaucuucauucuacagaugaacucauugaaacaauuuaggggaaugaggggcaaa

SEQ ID NO: 363963 - RNA, 64 nt, hsa
guuucaguucuauaugaaguauuugauguuuuguuugaaacaauacagcauuaaagaaccaaug

SEQ ID NO: 363964 - RNA, 64 nt, hsa
agacaguguaaauaguuaaagaauguugauaaaauugaaacauuugguuguggaauugugugug

SEQ ID NO: 363965 - RNA, 64 nt, hsa
uugauaaaaauuaacuaguaauacuuguauuuauuugaaacacugggcuguuugcacagcucca

SEQ ID NO: 363966 - RNA, 64 nt, hsa
uuuuaaacugggcaucugguuucuaaaaauuuauuugaaacaaucuagaauuuucuuggugcaa

SEQ ID NO: 363967 - RNA, 64 nt, hsa
cauugauuauagaaccacuauuacgugaaaaggcuugaaacaaccaacauauacaaauaaaacc

SEQ ID NO: 363968 - RNA, 64 nt, hsa
uauauuggcuuuucuucuuaacuugggagauauauugaaacaaggugcuuuauaagauuauugu

SEQ ID NO: 363969 - RNA, 64 nt, hsa
uugucuagcauguuuguuuaauccuuugaaauauuugaaacaucaauuucuauuuucugaccuc

SEQ ID NO: 363970 - RNA, 64 nt, hsa
cuggcguaaguucaauuuacacagaauauuugaauugaaacaauagaaauuuuucucauaauau

SEQ ID NO: 363971 - RNA, 64 nt, hsa
cucuuggguggguaagacuaaaucuguaagcucuuugaaacaacuuucucuuguaaacguuuca

SEQ ID NO: 363972 - RNA, 64 nt, hsa
cugcucuuaugccauuuguuuauuuuuauauagcuugaaacauagagggagagagggagagagc

SEQ ID NO: 363973 - RNA, 64 nt, hsa
aauaucggcuccucauccaaagaacaacugcugauugaaacaccucauuagcugaguguagaga

SEQ ID NO: 363974 - RNA, 64 nt, hsa
ucuuaaguacaagggggaaaaaauaaaucaguuauugaaacauaaaaaugaauaccaaggaccu

SEQ ID NO: 363975 - RNA, 64 nt, hsa
cuaaaaaacgaaaagucuccaaagucucuggaauuugaaacacuuugcauaacguauaaaagcc

SEQ ID NO: 363976 - RNA, 64 nt, hsa
aacaugaauauuuaguguucauaaauaaaguuuguugaaacacaaccaagaucauucuuuuacu

SEQ ID NO: 363977 - RNA, 64 nt, hsa
cguucauguauauacauuuuuaaaagugcuuucuuugaaacacuggaacuuuguuaagcugccu

SEQ ID NO: 363978 - RNA, 64 nt, hsa
uagauuuguuaaaacuauuuuuuccauaaauacuuugaaacauauuuauauauuucaauuuaag

SEQ ID NO: 363979 - RNA, 63 nt, hsa
ucaaauugugcaaccaugauguauaauaaagaauuugaaacagaaacugagcuugcuguuugc

SEQ ID NO: 363980 - RNA, 64 nt, hsa
uuaauuuguuucuugauauaugaagacuauaaacuugaaacaaagaguuagcugucagcucuug

SEQ ID NO: 363981 - RNA, 64 nt, hsa
aauuaccuagcaguugugcccucagaguagaacuuugaaacaggacugaagcccuuuuuaccua

SEQ ID NO: 363982 - RNA, 64 nt, hsa
agauguggguaguugagaacuuaaaaagugaacauugaaacaucgacguaacuggaaauuaggu

SEQ ID NO: 363983 - RNA, 64 nt, hsa
uagaaaauuuaggagauaaauuuauuuuuaaauuuugaaacacaaaacaauuuugaaucuugcu

SEQ ID NO: 363984 - RNA, 64 nt, hsa
uaguuuaaagguaguaggugagaaauguguucucuugaaacaagcacuuugaaauuugaauagg

SEQ ID NO: 363985 - RNA, 64 nt, hsa
cuuugcaagaaaacagcuucuccacacauguauuuugaaacacugaagagcaaaaggggcuggg

SEQ ID NO: 363986 - RNA, 64 nt, hsa
cacuaucuuguugauagcuuuuuguucucuaagguugaaacaugacagugcuuaucucaaacag

SEQ ID NO: 363987 - RNA, 64 nt, hsa
augcacaggaucaacaggguuuguuguaacuagauugaaacacuaaguuguuuuuacuguuuug

SEQ ID NO: 363988 - RNA, 64 nt, hsa
gugauaaugucaauuggcagccaguuguguuuuuuugaaacaucauuauuggcaguuucuccuu

SEQ ID NO: 363989 - RNA, 64 nt, hsa
gaaugucaugguaaauuguuuuucaauaaauauuuugaaacauguuuccauaugaaguuuuuuu

SEQ ID NO: 363990 - RNA, 64 nt, hsa
aaaaccauguuguuuuggggggcuggaauuugcauugaaacacugguccaguccauugaagacc

SEQ ID NO: 363991 - RNA, 64 nt, hsa
ugauacauuuagacaaaaccccaaacuaagccauuugaaacaagauucucuccauugcaguuug

SEQ ID NO: 363992 - RNA, 64 nt, hsa
aaguuucccccuuuugaauuaccaccaagaaguguugaaacaccaaauagauaucauguuauuu

SEQ ID NO: 363993 - RNA, 64 nt, hsa
guuuuauggaauaaagucacuugaucagaaggaauugaaacaauagaucauuuuguuaccuacu

SEQ ID NO: 363994 - RNA, 64 nt, hsa
uauaauuuagguucugcagaaauaugauucuuaauugaaacauauaauuugcuuaauuacguga

SEQ ID NO: 363995 - RNA, 64 nt, hsa
uaucuguguauuguacuaaauggacugaugcugcgcacaugagcugaaaaugaagagcccuccc

SEQ ID NO: 363996 - RNA, 64 nt, hsa
ggaggaggacuaaaugaaaaguuguucccagccugcacaugaacacauucaugacacacaaaac

SEQ ID NO: 363997 - RNA, 64 nt, hsa
gugggaugugcuacauugucuauuuuuggcggcugcacaugacaucaaauuguuuccugaauuu

SEQ ID NO: 363998 - RNA, 64 nt, hsa
guaaaaaguguucauggggaaaaagcucuguuuagcacaugauuuuauuguauugcguuauuag

SEQ ID NO: 363999 - RNA, 64 nt, hsa
agaaagccuucaaccagaagagugcgcugcaggugcacaugaagaagcacacgggggagcggcc

SEQ ID NO: 364000 - RNA, 64 nt, hsa
ucaugggcuucacgcagaagagcaacaugaagcugcacaugaagcgggcgcacagcuaugcugg

SEQ ID NO: 364001 - RNA, 64 nt, hsa
gaaaacccuucaguuuccuuacaggcuuucgagugcacaugagaaugcacacuggagagaaacc

SEQ ID NO: 364002 - RNA, 64 nt, hsa
ugggaaaacuuacuugucuccuuuagguuuucaagcacaugaaaguacucacacuggagauaaa

SEQ ID NO: 364003 - RNA, 64 nt, hsa
uggaaaaaccuacauaucuucuguagguuuucaagcacaugaaagaacucacacuggagaaaaa

SEQ ID NO: 364004 - RNA, 64 nt, hsa
ugggaaacccuucauuuaccgccauucugcucgagcacaugaaaggaaucacacuguacagaaa

SEQ ID NO: 364005 - RNA, 64 nt, hsa
auacgcuucaguuuuuccacauuguccacggccagcacaugaaagcaucacuucuuuuuuaugu

SEQ ID NO: 364006 - RNA, 64 nt, hsa
cacacugcccggcacgccacauccaccccugucugcacaugaguuguucugacaacagcgcugu

SEQ ID NO: 364007 - RNA, 64 nt, hsa
uggacggcaggcucacugccaggccagccuccgagagggagagagagagagagaggacagcuug

SEQ ID NO: 364008 - RNA, 64 nt, hsa
cacuggagguugaagccaaguggggugcugggaggagggagagggaggucacuggaaaggggag

SEQ ID NO: 364009 - RNA, 64 nt, hsa
uucucacaagcaacccugagagagacagucuugugagggagaucugggggaggcaggaagcucc

SEQ ID NO: 364010 - RNA, 64 nt, hsa
cuuauaugagacaugaagcauuggcucagaaguagagggagaagaggaacccaguucccuugac

SEQ ID NO: 364011 - RNA, 64 nt, hsa
ugcauuugaggggccaggggcaggcagggcugcagagggagacggcccugcuggggcuuaggaa

SEQ ID NO: 364012 - RNA, 64 nt, hsa
ucugugccauggccccccacucccccuucccuuggagggagagguggcaggaauacuucaccuu

SEQ ID NO: 364013 - RNA, 64 nt, hsa
uguuggauucugaggguggggagggagagagagggagggagagggagugaagagccugcccucc

SEQ ID NO: 364014 - RNA, 64 nt, hsa
uugcaaacgacugcuguuggauucugaggguggggagggagagagagggagggagagggaguga

SEQ ID NO: 364015 - RNA, 64 nt, hsa
caguugccuguuucacuuguuacuguuacugggagagggagacaaaaccucauggcaaucuugu

SEQ ID NO: 364016 - RNA, 64 nt, hsa
uccaucucagugaucauuuacguugcguguacuugagggagauucugagagaugcuccuuuggg

SEQ ID NO: 364017 - RNA, 64 nt, hsa
uacuccucccacacuagacacuggguuucaggaggagggagacugcccugcuuuggucccagag

SEQ ID NO: 364018 - RNA, 64 nt, hsa
gcugccaugauaaguccuuccaugaaggacugaggagggagaguggggguccagggcuggugcu

SEQ ID NO: 364019 - RNA, 64 nt, hsa
auaaggaggaggagggagaagagaaaauguaaaggagggagaucuuucccaggccgcaccauuu

SEQ ID NO: 364020 - RNA, 64 nt, hsa
ucuguuggaggcacaguuuuagaauaaggaggaggagggagaagagaaaauguaaaggagggag

SEQ ID NO: 364021 - RNA, 64 nt, hsa
uccaaaguuuugaagucaucuuagcuuuccacaggagggagagaacuuaaaaaagcaacaguag

SEQ ID NO: 364022 - RNA, 64 nt, hsa
gcuggucucccuccagcuggaauugcugcucucugagggagaggcugugguggcugucucuguc

SEQ ID NO: 364023 - RNA, 64 nt, hsa
guucaggggugguaaggacucugguaccagggaagagggagaauuaauuuauugugcaaaugcu

SEQ ID NO: 364024 - RNA, 64 nt, hsa
uccuagguguuaccauucacugaaucuucucucagagggagaugagcaauugucagucaggaua

SEQ ID NO: 364025 - RNA, 64 nt, hsa
cagagcaggagggagacugaaguaagagauggcagagggagaugguggcaaaaagguuuagaug

SEQ ID NO: 364026 - RNA, 64 nt, hsa
gaagccucccucacucuccaugcuggcagagcaggagggagacugaaguaagagauggcagagg

SEQ ID NO: 364027 - RNA, 64 nt, hsa
gaggcucucccaggggcugauggggggguucugugagggagaaucagggcucgggaagccacgc

SEQ ID NO: 364028 - RNA, 64 nt, hsa
gcggcauggaggguggugugaguuccucuggugggagggagaacgcacaucucuucugggcggc

SEQ ID NO: 364029 - RNA, 64 nt, hsa
aucugagaaguggcccaugugcuucaaggcccaggagggagaucugucagcucauucuugccuu

SEQ ID NO: 364030 - RNA, 64 nt, hsa
agucuugguaaaaggagggagccugcugagccaggagggagaaaagaagauugaccagcuugcu

SEQ ID NO: 364031 - RNA, 64 nt, hsa
ggguggaagugggguaggggaagaggaggggcaggagggagaguuccugugagcaugugggggg

SEQ ID NO: 364032 - RNA, 64 nt, hsa
ccuccuguccccucugggaacauuucaugcuucagagggagagguuuuuauugagcuuguuuca

SEQ ID NO: 364033 - RNA, 64 nt, hsa
aaguuaccuuccuggugcacacaccgaagugcucgagggagaggcugccgcccccucuccccuu

SEQ ID NO: 364034 - RNA, 64 nt, hsa
ucauggggcccugagcuucugcugccucuggugagagggagagcccuucccauccuuacccacc

SEQ ID NO: 364035 - RNA, 64 nt, hsa
gguuugaggcugggcugggagggggagggagauagagggagagaugcaguuugaccccauuugg

SEQ ID NO: 364036 - RNA, 64 nt, hsa
ucuccugggggguuugaggcugggcugggagggggagggagauagagggagagaugcaguuuga

SEQ ID NO: 364037 - RNA, 64 nt, hsa
gcaugcgugugacaggugcagagacgggggacuggagggagacuuuuauacguuuuguaccuuu

SEQ ID NO: 364038 - RNA, 64 nt, hsa
gaucaccagccccaaggucccgaagggcaggucagagggagagaggcuggagaccugggcuggg

SEQ ID NO: 364039 - RNA, 64 nt, hsa
ccccugcccugauagggcuuaccugugggugggggagggagaccacacaugucagagguaguga

SEQ ID NO: 364040 - RNA, 64 nt, hsa
gaucgugucucagcaucaggaaaggagaaaggcagagggagagcgcugagaagacuguucacgc

SEQ ID NO: 364041 - RNA, 64 nt, hsa
ugcccguccuggccuggagcacccugggauccuggagggagaggccccacgcccccacucuccc

SEQ ID NO: 364042 - RNA, 64 nt, hsa
acggaaaagacugccugccuuggaggggucacaugagggagaccugugccugauuucauuagga

SEQ ID NO: 364043 - RNA, 64 nt, hsa
aauuuauuagcgcugcucugcaccccucccuugggagggagacuucaugugguuuauugcgagu

SEQ ID NO: 364044 - RNA, 64 nt, hsa
gaagcgguuuuugcaaauucauauuacuuaagcagagggagagaaccucuacugaucagagcau

SEQ ID NO: 364045 - RNA, 64 nt, hsa
ucggugugguccuagaugaagcauuggggugggggagggagagggagcuuuguguuaagugccu

SEQ ID NO: 364046 - RNA, 64 nt, hsa
ucuggccagagcagggcuggagggaaggagccaggagggagagagccucccaccuuuccccugc

SEQ ID NO: 364047 - RNA, 64 nt, hsa
cccacaugggguaagggggguugggggugggggagagggagagagcgaacacccacgcugguuu

SEQ ID NO: 364048 - RNA, 64 nt, hsa
agggagagagaggaaagggaaggaagaaaggaaggagggagaagggaagaaagaaacaaugucu

SEQ ID NO: 364049 - RNA, 64 nt, hsa
aaggauagcugcaacaaugaaacaggaaagaagagagggagagagaggaaagggaaggaagaaa

SEQ ID NO: 364050 - RNA, 64 nt, hsa
uaaaggggcuaggacuagggugagagggaguggggagggagagggcaggaaggaggcagagcug

SEQ ID NO: 364051 - RNA, 64 nt, hsa
ugcauucuucaaaaccauuccugauagaguagccgagggagagucuuggggccaagaagggccc

SEQ ID NO: 364052 - RNA, 64 nt, hsa
ccacuagugccugagcucagugcugcuggaugaugagggagaucaagaaaaagccacguaaggg

SEQ ID NO: 364053 - RNA, 64 nt, hsa
aagugccguuuggauggggaagggaaagacuggggagggagagugaacuccgaggggugucccc

SEQ ID NO: 364054 - RNA, 64 nt, hsa
gggagggagggagggagagaauggcccgagggaggagggagagaaggagggaggcgcuccuggg

SEQ ID NO: 364055 - RNA, 64 nt, hsa
cauauaaacacuggaggggagggagggagggagggagggagagaauggcccgagggaggaggga

SEQ ID NO: 364056 - RNA, 64 nt, hsa
uuuauuuuuauauagcuugaaacauagagggagagagggagagagccuauaccccuuacuuagc

SEQ ID NO: 364057 - RNA, 64 nt, hsa
gccauuuguuuauuuuuauauagcuugaaacauagagggagagagggagagagccuauaccccu

SEQ ID NO: 364058 - RNA, 64 nt, hsa
agugagggcggccgggagggcgagcgagggagaggagggagagggggaggggaggaguccaggg

SEQ ID NO: 364059 - RNA, 64 nt, hsa
ugggguaucagugagggcggccgggagggcgagcgagggagaggagggagagggggaggggagg

SEQ ID NO: 364060 - RNA, 64 nt, hsa
uuauuuuucuccacugcuuggauaugaaacuguagagggagaggcccuguugcccaguguucuc

SEQ ID NO: 364061 - RNA, 64 nt, hsa
agcauugacuucucuacccuaaaacuguuugagagagggagagugggcccuggcuuucucaagc

SEQ ID NO: 364062 - RNA, 64 nt, hsa
uggcaacagcagcaggacagggcacggagggagcgagggagagaggaccggucccagcuuuugg

SEQ ID NO: 364063 - RNA, 64 nt, hsa
gaggauuuaucucaaaaaccaacauccaaaaugggagggagauguggcuugaggucaagcgcca

SEQ ID NO: 364064 - RNA, 64 nt, hsa
ugcacaggagugggauggggugugguagcaaaaggagggagaggaguccuuuuugugccaaauc

SEQ ID NO: 364065 - RNA, 64 nt, hsa
ccagccaggugucccuccuaugcacagagcagaggagggagaagcucuggggagccagcuuugg

SEQ ID NO: 364066 - RNA, 64 nt, hsa
acgaugccgacuggaagggagggagagggagggggagggagaaaauggggcuaugccuggcuua

SEQ ID NO: 364067 - RNA, 64 nt, hsa
gggcugugggcagcagacgaugccgacuggaagggagggagagggagggggagggagaaaaugg

SEQ ID NO: 364068 - RNA, 64 nt, hsa
cugcaguuaaugggguagaggagggcaugggagggagggagagguggggagggagacagagaca

SEQ ID NO: 364069 - RNA, 64 nt, hsa
guagaggagggcaugggagggagggagagguggggagggagacagagacagaaacagagagaga

SEQ ID NO: 364070 - RNA, 64 nt, hsa
cagaaacagagagagacagagacagagagagacugagggagagacucugaggacauggagagag

SEQ ID NO: 364071 - RNA, 64 nt, hsa
cauggucaugaaagcgugguucuguaagaaaucagagggagaaagggagagaagggggagggag

SEQ ID NO: 364072 - RNA, 64 nt, hsa
guaagaaaucagagggagaaagggagagaagggggagggagacaacccaaacguuggaggguau

SEQ ID NO: 364073 - RNA, 64 nt, hsa
gaaaugccuccccaggucugucucuggaggcucugagggagaugggcuugggggcuguaggagg

SEQ ID NO: 364074 - RNA, 64 nt, hsa
guccaaccaagagagcgggagggagggaaggagggagggagagagauagagagagagagagaga

SEQ ID NO: 364075 - RNA, 64 nt, hsa
uuagagaauggcuacugcugaguccuuugggguugagggagaugggagcuagggggaggggagg

SEQ ID NO: 364076 - RNA, 64 nt, hsa
uugggguugagggagaugggagcuagggggaggggagggagaugucuuguuguggggacuuggg

SEQ ID NO: 364077 - RNA, 64 nt, hsa
ggaugggucucagagagcaaccuccucccucguagagggagauuauauccccaacuccagggac

SEQ ID NO: 364078 - RNA, 64 nt, hsa
gggcugccaaaggggcagagggugguggagaggagagggagaaagggaagucccagggcccggg

SEQ ID NO: 364079 - RNA, 64 nt, hsa
aaucgugguucuuccccgagggugcauguugcaggagggagagggcagggaagacucacagcag

SEQ ID NO: 364080 - RNA, 64 nt, hsa
agaaugggcuuccuuuuugguucaguauuagugagagggagagggagauggauggugggguagg

SEQ ID NO: 364081 - RNA, 64 nt, hsa
ggcuuccuuuuugguucaguauuagugagagggagagggagauggauggugggguagguuuucu

SEQ ID NO: 364082 - RNA, 64 nt, hsa
aaaucgccugaacccaggaggcggagguugcagggagggagacugcaccacugcacuucagccu

SEQ ID NO: 364083 - RNA, 64 nt, hsa
gagacugcaccacugcacuucagccugggugacagagggagacucugucuuaaaaaaaaaaaaa

SEQ ID NO: 364084 - RNA, 64 nt, hsa
cggcggcccaggcacagaagggcagggccauagggagggagauucgcuacggauccaggccauu

SEQ ID NO: 364085 - RNA, 64 nt, hsa
gguccucuguccccacagugaccugacugggggugagggagaaggaggagagagcccaugugug

SEQ ID NO: 364086 - RNA, 64 nt, hsa
gagccuccugcagagccagcgaaggaaagcucuagagggagacgacuccaccgccucucugcuc

SEQ ID NO: 364087 - RNA, 64 nt, hsa
acuggagggcgcaucaaagaagaguccuacccaggagggagagcgcagcugcugcaggauucuc

SEQ ID NO: 364088 - RNA, 64 nt, hsa
agcuaccacucuggcugcuagacagcuugguggcgagggagaugacuccuuguagcugauacuu

SEQ ID NO: 364089 - RNA, 64 nt, hsa
gaggcucucuuaagagcuaugugccuuccaaccagagggagacccaguagaaagaaaaacaucc

SEQ ID NO: 364090 - RNA, 64 nt, hsa
augcuuuuaaugaauuuaaggcaaaaaagguggagagggagaugugugagcauccugcaaggug

SEQ ID NO: 364091 - RNA, 64 nt, hsa
caggauaaaaaauacauacuguggucggcaaggugagggagauagggauauccaggggaagagg

SEQ ID NO: 364092 - RNA, 64 nt, hsa
gagaggcagagagggagagaggcagagagacagagagggagagagggacagagagagauagagc

SEQ ID NO: 364093 - RNA, 64 nt, hsa
gagaaggagagaggcagagagggagagaggcagagagggagagaggcagagagacagagaggga

SEQ ID NO: 364094 - RNA, 64 nt, hsa
aggaaagagacaggcagagaaggagagaggcagagagggagagaggcagagagggagagaggca

SEQ ID NO: 364095 - RNA, 64 nt, hsa
agaaacagaggagacagagagggagagagagacagagggagagagagacagaggggaagagagg

SEQ ID NO: 364096 - RNA, 64 nt, hsa
ggaggcagagagggagagaaacagaggagacagagagggagagagagacagagggagagagaga

SEQ ID NO: 364097 - RNA, 64 nt, hsa
agagauaugaggagagagagacagaggaggcagagagggagagaaacagaggagacagagaggg

SEQ ID NO: 364098 - RNA, 64 nt, hsa
aggugcauaaaugggggucagggagggaaaggaggagggagagagauggagaggaggggagaga

SEQ ID NO: 364099 - RNA, 64 nt, hsa
gaggcucucuuaagagcuaugugccuuccacccagagggagacccaguagaaagaaaaacaucc

SEQ ID NO: 364100 - RNA, 64 nt, hsa
agcuaccacucuggcugcuagauagcuugguggggagggagaugacuccuuguagcugauacuu

SEQ ID NO: 364101 - RNA, 64 nt, hsa
uaacugcugugaacucacuuugaggggguaggaggagggagaaacagccuguguuuuuuaugca

SEQ ID NO: 364102 - RNA, 64 nt, hsa
cccacuuaaagugcuucugccccuaggguuuccggagggagagccgagaugggaugggggagcc

SEQ ID NO: 364103 - RNA, 64 nt, hsa
gagcucuggccacugcuucccaugagcugagggagagggagaggggacccgaggcugaggcaua

SEQ ID NO: 364104 - RNA, 64 nt, hsa
ccuggggagcucuggccacugcuucccaugagcugagggagagggagaggggacccgaggcuga

SEQ ID NO: 364105 - RNA, 64 nt, hsa
uuuuguggaaagaggaguuggugguaucggugucgagggagaggaggggguuggggaggaccca

SEQ ID NO: 364106 - RNA, 64 nt, hsa
uuacagugcacggaguguggaagggggucuaggagagggagagcuggaaaaggagcugaugggg

SEQ ID NO: 364107 - RNA, 64 nt, hsa
ugggggugucuccuggcugggaaggagggaaagggagggagaguuuugcggggguuggcagugg

SEQ ID NO: 364108 - RNA, 64 nt, hsa
ucucugcucaucagcacugucccaggauccuggagagggagaacuccuggccccaggggaaaga

SEQ ID NO: 364109 - RNA, 64 nt, hsa
ugaggaggagcccagaggaccccaggggagugaggagggagaacuuggaagggugcagcccacu

SEQ ID NO: 364110 - RNA, 64 nt, hsa
cagggagggaacccugggcagggcucuggugggagagggagacagauggaggcaguggcuggug

SEQ ID NO: 364111 - RNA, 64 nt, hsa
uucucuuuaaaaaaaauagaagcuauaaagaaaagagggagagaugaguggguuagcuaccugc

SEQ ID NO: 364112 - RNA, 64 nt, hsa
aagacacauaaugaggucccucuagcuuuagcuggagggagauaaaagaaccccagaccucuga

SEQ ID NO: 364113 - RNA, 64 nt, hsa
ucaaauacaugaaaaaucuuacacuggagagaaacccuaugaguguaagcaaugugggaaagcc

SEQ ID NO: 364114 - RNA, 64 nt, hsa
ucgauaucaugaaaggacucacacuggagagaaccccuaugaguguaagcaauuugggaaagcc

SEQ ID NO: 364115 - RNA, 64 nt, hsa
uugaauacaugcaagaacacacaauggagagaaacccuaugaauguaaagaaugcagaaaagca

SEQ ID NO: 364116 - RNA, 64 nt, hsa
ucaauaucaugaaaggacucacaugggagagaaacccuaugaguguaugccaagugggaaagcc

SEQ ID NO: 364117 - RNA, 64 nt, hsa
ucaauaucaugaaaggacucacacuggagagaagcccuaugaauauaagcaaugugggaaagcc

SEQ ID NO: 364118 - RNA, 64 nt, hsa
ucaaaugcauggaaggacucacacuggagaaaaacccuaugaauguaagcaguaugggaaagcg

SEQ ID NO: 364119 - RNA, 64 nt, hsa
uucaauuuaugaaaggacacacacuggagagaaacccuaugaauguaagaaauguggaaaagcg

SEQ ID NO: 364120 - RNA, 64 nt, hsa
uuucauagacauguaaagacacaccagaaggaaacccuaugaauguaagcaauguggcaaaagc

SEQ ID NO: 364121 - RNA, 64 nt, hsa
ucaguaucaugaaaggacucacacuggagagaaacccuaugaguguaagcaaugugggaaagcc

SEQ ID NO: 364122 - RNA, 64 nt, hsa
cuucgaaggcaugguaggacucacuggagagaaacccuaugaguguaaggaaugugggaaagcc

SEQ ID NO: 364123 - RNA, 64 nt, hsa
ucaaagacaugaaaaaacucacacugcagagaaacccuaugaaugcaagcaaugugguaaagcc

SEQ ID NO: 364124 - RNA, 64 nt, hsa
uugguaccaugaaaggacucacacuggagagaaacccuaugaguguaagcaaugugggaaagcc

SEQ ID NO: 364125 - RNA, 64 nt, hsa
ucgaauccaugguagaacucacacuggagagaaacccuaugaguguaaggaaugugggaaagcc

SEQ ID NO: 364126 - RNA, 64 nt, hsa
ucaaauaccugaaaaaucuuacacuggagagaaacccuaugaguguaagcaaugugggaaagcc

SEQ ID NO: 364127 - RNA, 64 nt, hsa
ucgauaacaugaaaggacucacacuggagagaaacccuaugaguguaagcaauguggaaaaacc

SEQ ID NO: 364128 - RNA, 54 nt, hsa
augcgaaaucauacagcugagaaacccuaugaauguaaggaauguggaaaagcc

SEQ ID NO: 364129 - RNA, 64 nt, hsa
cacucuucaugugagaagucacacaggggagaaacccuaugaauguaauaaaugugggaaagcc

SEQ ID NO: 364130 - RNA, 64 nt, hsa
ucauauacaugaacgaauucauacuggagagaaacccuaugaauguaaagaauguggaaaaccc

SEQ ID NO: 364131 - RNA, 64 nt, hsa
ucaagcacaugaaagaacucacacuggagaaaaacccuaugaauguaaaaaaugugggaaagug

SEQ ID NO: 364132 - RNA, 64 nt, hsa
uacucaacaucaaagaauuccuacuggugagaaacccuaugaauguaaugaaugugagaaggcc

SEQ ID NO: 364133 - RNA, 64 nt, hsa
uagucaacaucaaaauauucauacuggugagaaacccuaugaguuuaaggaaugugggaaggcc

SEQ ID NO: 364134 - RNA, 64 nt, hsa
gaauaaacaucagacaauucacacuggugacaaacccuaugaauguaaagauuguaaaaaagcu

SEQ ID NO: 364135 - RNA, 64 nt, hsa
uacucaacaucaaagaauucauaccagugugaaacccuaugaauguaaggaauguguaaagacc

SEQ ID NO: 364136 - RNA, 64 nt, hsa
aaugagacaucagagaauucacaguggggagaaacccuaugaauguaaugaaugugggaaugcc

SEQ ID NO: 364137 - RNA, 64 nt, hsa; identical to SEQ ID NO: 355250

SEQ ID NO: 364138 - RNA, 64 nt, hsa; identical to SEQ ID NO: 355251

SEQ ID NO: 364139 - RNA, 64 nt, hsa; identical to SEQ ID NO: 355252

SEQ ID NO: 364140 - RNA, 64 nt, hsa; identical to SEQ ID NO: 355253

SEQ ID NO: 364141 - RNA, 64 nt, hsa; identical to SEQ ID NO: 355254

SEQ ID NO: 364142 - RNA, 64 nt, hsa; identical to SEQ ID NO: 355255

SEQ ID NO: 364143 - RNA, 64 nt, hsa; identical to SEQ ID NO: 355256

SEQ ID NO: 364144 - RNA, 64 nt, hsa; identical to SEQ ID NO: 355257

SEQ ID NO: 364145 - RNA, 64 nt, hsa; identical to SEQ ID NO: 355258

SEQ ID NO: 364146 - RNA, 64 nt, hsa; identical to SEQ ID NO: 355259

SEQ ID NO: 364147 - RNA, 64 nt, hsa; identical to SEQ ID NO: 355260

SEQ ID NO: 364148 - RNA, 64 nt, hsa; identical to SEQ ID NO: 355261

SEQ ID NO: 364149 - RNA, 64 nt, hsa; identical to SEQ ID NO: 355262

SEQ ID NO: 364150 - RNA, 64 nt, hsa; identical to SEQ ID NO: 355263

SEQ ID NO: 364151 - RNA, 64 nt, hsa; identical to SEQ ID NO: 355264

SEQ ID NO: 364152 - RNA, 64 nt, hsa; identical to SEQ ID NO: 355265

SEQ ID NO: 364153 - RNA, 64 nt, hsa; identical to SEQ ID NO: 355266

SEQ ID NO: 364154 - RNA, 64 nt, hsa; identical to SEQ ID NO: 355267

SEQ ID NO: 364155 - RNA, 61 nt, hsa; identical to SEQ ID NO: 188794

SEQ ID NO: 364156 - RNA, 64 nt, hsa; identical to SEQ ID NO: 355269

SEQ ID NO: 364157 - RNA, 64 nt, hsa; identical to SEQ ID NO: 355270

SEQ ID NO: 364158 - RNA, 64 nt, hsa; identical to SEQ ID NO: 355271

SEQ ID NO: 364159 - RNA, 64 nt, hsa; identical to SEQ ID NO: 355272

SEQ ID NO: 364160 - RNA, 64 nt, hsa; identical to SEQ ID NO: 355273

SEQ ID NO: 364161 - RNA, 64 nt, hsa; identical to SEQ ID NO: 355274

SEQ ID NO: 364162 - RNA, 64 nt, hsa; identical to SEQ ID NO: 355275

SEQ ID NO: 364163 - RNA, 64 nt, hsa; identical to SEQ ID NO: 355276

SEQ ID NO: 364164 - RNA, 64 nt, hsa; identical to SEQ ID NO: 355277

SEQ ID NO: 364165 - RNA, 64 nt, hsa; identical to SEQ ID NO: 355278

SEQ ID NO: 364166 - RNA, 64 nt, hsa; identical to SEQ ID NO: 355279

SEQ ID NO: 364167 - RNA, 64 nt, hsa; identical to SEQ ID NO: 355280

SEQ ID NO: 364168 - RNA, 64 nt, hsa; identical to SEQ ID NO: 355281

SEQ ID NO: 364169 - RNA, 64 nt, hsa; identical to SEQ ID NO: 355282

SEQ ID NO: 364170 - RNA, 64 nt, hsa; identical to SEQ ID NO: 355283

SEQ ID NO: 364171 - RNA, 64 nt, hsa; identical to SEQ ID NO: 355284

SEQ ID NO: 364172 - RNA, 64 nt, hsa; identical to SEQ ID NO: 355285

SEQ ID NO: 364173 - RNA, 64 nt, hsa; identical to SEQ ID NO: 355286

SEQ ID NO: 364174 - RNA, 64 nt, hsa; identical to SEQ ID NO: 123011

SEQ ID NO: 364175 - RNA, 64 nt, hsa; identical to SEQ ID NO: 123012

SEQ ID NO: 364176 - RNA, 64 nt, hsa; identical to SEQ ID NO: 123013

SEQ ID NO: 364177 - RNA, 64 nt, hsa; identical to SEQ ID NO: 123014

SEQ ID NO: 364178 - RNA, 64 nt, hsa; identical to SEQ ID NO: 123015

SEQ ID NO: 364179 - RNA, 64 nt, hsa; identical to SEQ ID NO: 123016

SEQ ID NO: 364180 - RNA, 64 nt, hsa; identical to SEQ ID NO: 123017

SEQ ID NO: 364181 - RNA, 64 nt, hsa; identical to SEQ ID NO: 123018

SEQ ID NO: 364182 - RNA, 64 nt, hsa; identical to SEQ ID NO: 123019

SEQ ID NO: 364183 - RNA, 64 nt, hsa; identical to SEQ ID NO: 123020

SEQ ID NO: 364184 - RNA, 64 nt, hsa; identical to SEQ ID NO: 123021

SEQ ID NO: 364185 - RNA, 64 nt, hsa; identical to SEQ ID NO: 123022

SEQ ID NO: 364186 - RNA, 64 nt, hsa; identical to SEQ ID NO: 123023

SEQ ID NO: 364187 - RNA, 64 nt, hsa; identical to SEQ ID NO: 123024

SEQ ID NO: 364188 - RNA, 64 nt, hsa; identical to SEQ ID NO: 123025

SEQ ID NO: 364189 - RNA, 64 nt, hsa; identical to SEQ ID NO: 123026

SEQ ID NO: 364190 - RNA, 64 nt, hsa; identical to SEQ ID NO: 123027

SEQ ID NO: 364191 - RNA, 64 nt, hsa; identical to SEQ ID NO: 123028

SEQ ID NO: 364192 - RNA, 64 nt, hsa; identical to SEQ ID NO: 123029

SEQ ID NO: 364193 - RNA, 64 nt, hsa; identical to SEQ ID NO: 123030

SEQ ID NO: 364194 - RNA, 64 nt, hsa; identical to SEQ ID NO: 123031

SEQ ID NO: 364195 - RNA, 64 nt, hsa; identical to SEQ ID NO: 123032

SEQ ID NO: 364196 - RNA, 64 nt, hsa; identical to SEQ ID NO: 123033

SEQ ID NO: 364197 - RNA, 64 nt, hsa; identical to SEQ ID NO: 123034

SEQ ID NO: 364198 - RNA, 64 nt, hsa; identical to SEQ ID NO: 123035

SEQ ID NO: 364199 - RNA, 64 nt, hsa; identical to SEQ ID NO: 123036

SEQ ID NO: 364200 - RNA, 64 nt, hsa; identical to SEQ ID NO: 123037

SEQ ID NO: 364201 - RNA, 64 nt, hsa; identical to SEQ ID NO: 123038

SEQ ID NO: 364202 - RNA, 64 nt, hsa; identical to SEQ ID NO: 123039

SEQ ID NO: 364203 - RNA, 64 nt, hsa; identical to SEQ ID NO: 123040

SEQ ID NO: 364204 - RNA, 64 nt, hsa; identical to SEQ ID NO: 123041

SEQ ID NO: 364205 - RNA, 64 nt, hsa; identical to SEQ ID NO: 123042

SEQ ID NO: 364206 - RNA, 64 nt, hsa; identical to SEQ ID NO: 123043

SEQ ID NO: 364207 - RNA, 64 nt, hsa; identical to SEQ ID NO: 123044

SEQ ID NO: 364208 - RNA, 64 nt, hsa; identical to SEQ ID NO: 123045

SEQ ID NO: 364209 - RNA, 64 nt, hsa; identical to SEQ ID NO: 123046

SEQ ID NO: 364210 - RNA, 64 nt, hsa; identical to SEQ ID NO: 123047

SEQ ID NO: 364211 - RNA, 64 nt, hsa; identical to SEQ ID NO: 123048

SEQ ID NO: 364212 - RNA, 64 nt, hsa; identical to SEQ ID NO: 123049

SEQ ID NO: 364213 - RNA, 64 nt, hsa; identical to SEQ ID NO: 123050

SEQ ID NO: 364214 - RNA, 64 nt, hsa; identical to SEQ ID NO: 123051

SEQ ID NO: 364215 - RNA, 64 nt, hsa; identical to SEQ ID NO: 123052

SEQ ID NO: 364216 - RNA, 64 nt, hsa; identical to SEQ ID NO: 123053

SEQ ID NO: 364217 - RNA, 64 nt, hsa; identical to SEQ ID NO: 123054

SEQ ID NO: 364218 - RNA, 64 nt, hsa; identical to SEQ ID NO: 123055

SEQ ID NO: 364219 - RNA, 64 nt, hsa; identical to SEQ ID NO: 123056

SEQ ID NO: 364220 - RNA, 64 nt, hsa; identical to SEQ ID NO: 123057

SEQ ID NO: 364221 - RNA, 64 nt, hsa; identical to SEQ ID NO: 123058

SEQ ID NO: 364222 - RNA, 64 nt, hsa; identical to SEQ ID NO: 123059

SEQ ID NO: 364223 - RNA, 64 nt, hsa; identical to SEQ ID NO: 123060

SEQ ID NO: 364224 - RNA, 64 nt, hsa; identical to SEQ ID NO: 123061

SEQ ID NO: 364225 - RNA, 64 nt, hsa; identical to SEQ ID NO: 123062

SEQ ID NO: 364226 - RNA, 64 nt, hsa; identical to SEQ ID NO: 123063

SEQ ID NO: 364227 - RNA, 64 nt, hsa; identical to SEQ ID NO: 123064

SEQ ID NO: 364228 - RNA, 64 nt, hsa; identical to SEQ ID NO: 123065

SEQ ID NO: 364229 - RNA, 64 nt, hsa; identical to SEQ ID NO: 123066

SEQ ID NO: 364230 - RNA, 64 nt, hsa; identical to SEQ ID NO: 123067

SEQ ID NO: 364231 - RNA, 64 nt, hsa; identical to SEQ ID NO: 123068

SEQ ID NO: 364232 - RNA, 64 nt, hsa; identical to SEQ ID NO: 123069

SEQ ID NO: 364233 - RNA, 64 nt, hsa; identical to SEQ ID NO: 123070

SEQ ID NO: 364234 - RNA, 64 nt, hsa; identical to SEQ ID NO: 123071

SEQ ID NO: 364235 - RNA, 64 nt, hsa; identical to SEQ ID NO: 123072

SEQ ID NO: 364236 - RNA, 64 nt, hsa; identical to SEQ ID NO: 123073

SEQ ID NO: 364237 - RNA, 64 nt, hsa; identical to SEQ ID NO: 123074

SEQ ID NO: 364238 - RNA, 64 nt, hsa
gccauuggugggaaucaguaaacuuugaaaaccuuucacugaugauucccugguaagugcuccu

SEQ ID NO: 364239 - RNA, 64 nt, hsa
ugggaggagucgugauuuuuacuuugaauacuauuucacugacguuacuaagcauugcagcaca

SEQ ID NO: 364240 - RNA, 64 nt, hsa
auacuugguugauuuagguugcacauucacugaauucacugagauuauuccuauaauuuuaaag

SEQ ID NO: 364241 - RNA, 64 nt, hsa
uacuacaguauacuugguugauuuagguugcacauucacugaauucacugagauuauuccuaua

SEQ ID NO: 364242 - RNA, 64 nt, hsa
gugugauuuccccuccaagguaugguuaauaaguuucacugacuuagaaccaggcgagagacuu

SEQ ID NO: 364243 - RNA, 64 nt, hsa
uugaacacagucucacccagacuccaggcugucuuucacugaaugcuucugacuucauagauuu

SEQ ID NO: 364244 - RNA, 64 nt, hsa
cacucacccuccacagcacucagucccaucgacguucacugaacauuggcuuucucuuucugac

SEQ ID NO: 364245 - RNA, 64 nt, hsa
uuuuguuuuuuucuuacugaaaauggaccugccuuucacugaauuuucugagggcagagucuua

SEQ ID NO: 364246 - RNA, 64 nt, hsa
cuagguauuuauuucaaauaaagcaaggcauauguucacugauuuacgaguaagcugaugagag

SEQ ID NO: 364247 - RNA, 64 nt, hsa
uagucccacucuugcuugugucagcaccuuguucuucacugaacugcaauucuucaauuauucu

SEQ ID NO: 364248 - RNA, 64 nt, hsa
uaaagagcuguucuuuucuguggccuagacucuuuucacugaucucaaaauaaacugguuuuuu

SEQ ID NO: 364249 - RNA, 64 nt, hsa
aguuaaauguaaguguuauuccuucagcaaaauauucacugacccaaaacucuuuauggcauuu

SEQ ID NO: 364250 - RNA, 64 nt, hsa
aagcaauuguacuucacuaugccauauguauguauucacugaccaaaaauucacugaccaacca

SEQ ID NO: 364251 - RNA, 64 nt, hsa
acuaugccauauguauguauucacugaccaaaaauucacugaccaaccaaccaaacuccacacu

SEQ ID NO: 364252 - RNA, 64 nt, hsa
aaaauuacauguuucacugaaaccagugaaauauuucacugaaacagugaaauaaaaugaaaac

SEQ ID NO: 364253 - RNA, 64 nt, hsa
uuuuauugagaauaaauuuucuaaaauuacauguuucacugaaaccagugaaauauuucacuga

SEQ ID NO: 364254 - RNA, 61 nt, hsa
ucccucugcuguggguucugggcugucaugucuccaccacuuaaggaugucuuuacacuga

SEQ ID NO: 364255 - RNA, 61 nt, hsa
uccugugucuguccuccggaccuacccaggucuccaccaucaggacccugucuuuggguuu

SEQ ID NO: 364256 - RNA, 61 nt, hsa
ggauucgagcaucaggcuaagacccuguguccuccaccaugcacucaccccuagcccuggu

SEQ ID NO: 364257 - RNA, 61 nt, hsa
agaguacauuugcuuuaaugagugcaccugccuccaccagcaaggggaccccgagaacccu

SEQ ID NO: 364258 - RNA, 61 nt, hsa
aggaaaggcugauguuuccauauagcuugcucuccaccaggccuaucauuuuucuuuuuag

SEQ ID NO: 364259 - RNA, 61 nt, hsa
gcugggcggcguccacaccuaagaacagcagcuccaccaaaugaagucccucucacgcagc

SEQ ID NO: 364260 - RNA, 61 nt, hsa
ugcuugugggggcaccugggaggucaaaggucuccaccacaucaaccuauuuuguuuuacc

SEQ ID NO: 364261 - RNA, 61 nt, hsa
gccuuccaaacagcuccgucgccccuagcaacuccaccauugggcacugccaugcagagac

SEQ ID NO: 364262 - RNA, 61 nt, hsa
uauggugugacaucaccuuauucacagacaacuccaccaauuguacagguaacuaauucug

SEQ ID NO: 364263 - RNA, 61 nt, hsa
gugggacauucuacagaaccccuuucugccccuccaccaguaccaguggugccacaugugg

SEQ ID NO: 364264 - RNA, 61 nt, hsa
caauuuagccaugucaucugguggugaccagcuccaccaagccccuuucugagcccuuccu

SEQ ID NO: 364265 - RNA, 61 nt, hsa
gguagcuggacuuccccagggcccucuuccccuccaccacacccagguggacuugcagccc

SEQ ID NO: 364266 - RNA, 61 nt, hsa
aaacugagguggggauggggagaggcuuugccuccaccauucccaccccacccuccccuua

SEQ ID NO: 364267 - RNA, 61 nt, hsa
caggaauuuuguaaucucauaacuuuccaagcuccaccacuuccuaaaucuuaagaacuuu

SEQ ID NO: 364268 - RNA, 61 nt, hsa
ccuuggcugccagccuacccugccugcacuccuccaccaucacaaucucacccaaacuccu

SEQ ID NO: 364269 - RNA, 61 nt, hsa
gcggguuuccuggguccccucuccagcaagccuccaccagcaagcucggcccagagcuucc

SEQ ID NO: 364270 - RNA, 61 nt, hsa
gaccgagacccccugauccuccguggacucacuccaccagcuuccuauaacuuggacgaug

SEQ ID NO: 364271 - RNA, 61 nt, hsa
gccaguuaacaagaagauggugugagguguucuccaccagucucuccuguuugagacuguu

SEQ ID NO: 364272 - RNA, 61 nt, hsa
gggacccuuuccuuccuucccuggcuuguaacuccaccaacccaucagaaggagaaggaag

SEQ ID NO: 364273 - RNA, 61 nt, hsa
ugauguaggguaaggugccuucuuauucucacuccaccacccaaaagucaaaaggugccug

SEQ ID NO: 364274 - RNA, 61 nt, hsa
aguaacugcacgccuuugugcagcucuggagcuccaccaacucucggccugccaguucuca

SEQ ID NO: 364275 - RNA, 61 nt, hsa
gcccucgggaccugcugcaccaggaaagccacuccaccaguagugcugguugccuccuacu

SEQ ID NO: 364276 - RNA, 61 nt, hsa
ugcuccacgaggaagcucaggccugcacaggcuccaccaggccuuggaugcccucuaguug

SEQ ID NO: 364277 - RNA, 61 nt, hsa
gggugggggcuucaaguacagauugggcacacuccaccagaccccagcaaggucagcugcc

SEQ ID NO: 364278 - RNA, 61 nt, hsa
uauagacauuaggaagggagugagacggcuccuccaccauccucagccagugcaacccauu

SEQ ID NO: 364279 - RNA, 61 nt, hsa
ccugaacuccugagcgacagaagccccaggccuccaccagccuugaacccuugcaaagggg

SEQ ID NO: 364280 - RNA, 61 nt, hsa
guggggaggagaaaaucccaccuccccugaccuccaccaccuccaccaccaccaccaccac

SEQ ID NO: 364281 - RNA, 61 nt, hsa
agaaaaucccaccuccccugaccuccaccaccuccaccaccaccaccaccaccaccaccac

SEQ ID NO: 364282 - RNA, 61 nt, hsa; identical to SEQ ID NO: 364267

SEQ ID NO: 364283 - RNA, 61 nt, hsa
aaacugagguggggauggggagagccuuugccuccaccauucccacccacccuccccuuaa

SEQ ID NO: 364284 - RNA, 61 nt, hsa
ugcacccagaggggacucagcuucaaagcugcuccaccaugcugggucccaggcagcuuuc

SEQ ID NO: 364285 - RNA, 61 nt, hsa
gaaaggagaugccaauucugcuaucacagaacuccaccagcaacuccacccgaccccagca

SEQ ID NO: 364286 - RNA, 61 nt, hsa
aggugugcacaggggccucccaggcuccuggcuccaccagccaaggaggugggggcaaggg

SEQ ID NO: 364287 - RNA, 61 nt, hsa
aucuccuuggucacccucugcuccaggccuucuccaccacaggaccucagcugucccuccu

SEQ ID NO: 364288 - RNA, 64 nt, hsa
ccaucaauaaaauaaugcauaguuguguuaaacuacaggcaaacauagcccacgggaauaucuc

SEQ ID NO: 364289 - RNA, 64 nt, hsa
cuuucccugaaaagccuugaaggggguugaggguacaggcaaccuuguguucucugugcccuca

SEQ ID NO: 364290 - RNA, 64 nt, hsa
gugucaccugaagacucauucuucuguacgucugacaggcaaugcuggcuguuggcugggggcc

SEQ ID NO: 364291 - RNA, 64 nt, hsa
ccagacccggcugcgugguugaugaucuuugcagacaggcaagcaccuccugccucgaacuggc

SEQ ID NO: 364292 - RNA, 64 nt, hsa
uaaaugggcuaaaugcuccaauuaaaagacacagacaggcaaauuggauaaauagucaagaccc

SEQ ID NO: 364293 - RNA, 64 nt, hsa
uucugcacagcaaaagaaacuaccaucagagucaacaggcaaccuacaaaaugggagaaaauuu

SEQ ID NO: 364294 - RNA, 64 nt, hsa
uuucaugcauuuguccuucucccacccccuuacuacacccuagcagaucagcugaguguacuuu

SEQ ID NO: 364295 - RNA, 64 nt, hsa
caccaagaaguggaaguccucagaaauucucggcacacccuagaguauuguacaaccaacaccc

SEQ ID NO: 364296 - RNA, 64 nt, hsa
caacugugaaacucuguauugcuucuuccgguccacacccuauacucaugacauuaaauaaaag

SEQ ID NO: 364297 - RNA, 64 nt, hsa
ucugaaaugucccacaucuccuuuuuuuuccuccacacccuauauagacacuuccugaaugcua

SEQ ID NO: 364298 - RNA, 64 nt, hsa; identical to SEQ ID NO: 272831

SEQ ID NO: 364299 - RNA, 64 nt, hsa; identical to SEQ ID NO: 272832

SEQ ID NO: 364300 - RNA, 64 nt, hsa; identical to SEQ ID NO: 272833

SEQ ID NO: 364301 - RNA, 64 nt, hsa; identical to SEQ ID NO: 272834

SEQ ID NO: 364302 - RNA, 64 nt, hsa; identical to SEQ ID NO: 272835

SEQ ID NO: 364303 - RNA, 64 nt, hsa; identical to SEQ ID NO: 272836

SEQ ID NO: 364304 - RNA, 64 nt, hsa; identical to SEQ ID NO: 272837

SEQ ID NO: 364305 - RNA, 64 nt, hsa; identical to SEQ ID NO: 272838

SEQ ID NO: 364306 - RNA, 64 nt, hsa; identical to SEQ ID NO: 272839

SEQ ID NO: 364307 - RNA, 64 nt, hsa; identical to SEQ ID NO: 272840

SEQ ID NO: 364308 - RNA, 64 nt, hsa; identical to SEQ ID NO: 272841

SEQ ID NO: 364309 - RNA, 64 nt, hsa; identical to SEQ ID NO: 272842

SEQ ID NO: 364310 - RNA, 64 nt, hsa; identical to SEQ ID NO: 272843

SEQ ID NO: 364311 - RNA, 64 nt, hsa; identical to SEQ ID NO: 272844

SEQ ID NO: 364312 - RNA, 64 nt, hsa; identical to SEQ ID NO: 272845

SEQ ID NO: 364313 - RNA, 64 nt, hsa; identical to SEQ ID NO: 272846

SEQ ID NO: 364314 - RNA, 64 nt, hsa; identical to SEQ ID NO: 127802

SEQ ID NO: 364315 - RNA, 64 nt, hsa; identical to SEQ ID NO: 127803

SEQ ID NO: 364316 - RNA, 64 nt, hsa; identical to SEQ ID NO: 127804

SEQ ID NO: 364317 - RNA, 64 nt, hsa; identical to SEQ ID NO: 127805

SEQ ID NO: 364318 - RNA, 64 nt, hsa; identical to SEQ ID NO: 127806

SEQ ID NO: 364319 - RNA, 64 nt, hsa; identical to SEQ ID NO: 127807

SEQ ID NO: 364320 - RNA, 64 nt, hsa; identical to SEQ ID NO: 127808

SEQ ID NO: 364321 - RNA, 64 nt, hsa; identical to SEQ ID NO: 127809

SEQ ID NO: 364322 - RNA, 64 nt, hsa; identical to SEQ ID NO: 127810

SEQ ID NO: 364323 - RNA, 64 nt, hsa; identical to SEQ ID NO: 127811

SEQ ID NO: 364324 - RNA, 64 nt, hsa; identical to SEQ ID NO: 127812

SEQ ID NO: 364325 - RNA, 64 nt, hsa; identical to SEQ ID NO: 127813

SEQ ID NO: 364326 - RNA, 64 nt, hsa; identical to SEQ ID NO: 127814

SEQ ID NO: 364327 - RNA, 64 nt, hsa; identical to SEQ ID NO: 127815

SEQ ID NO: 364328 - RNA, 64 nt, hsa; identical to SEQ ID NO: 127816

SEQ ID NO: 364329 - RNA, 64 nt, hsa; identical to SEQ ID NO: 127817

SEQ ID NO: 364330 - RNA, 64 nt, hsa; identical to SEQ ID NO: 127818

SEQ ID NO: 364331 - RNA, 64 nt, hsa; identical to SEQ ID NO: 127819

SEQ ID NO: 364332 - RNA, 64 nt, hsa; identical to SEQ ID NO: 127820

SEQ ID NO: 364333 - RNA, 64 nt, hsa; identical to SEQ ID NO: 127821

SEQ ID NO: 364334 - RNA, 64 nt, hsa; identical to SEQ ID NO: 127822

SEQ ID NO: 364335 - RNA, 64 nt, hsa; identical to SEQ ID NO: 127823

SEQ ID NO: 364336 - RNA, 64 nt, hsa; identical to SEQ ID NO: 127824

SEQ ID NO: 364337 - RNA, 64 nt, hsa; identical to SEQ ID NO: 127825

SEQ ID NO: 364338 - RNA, 64 nt, hsa; identical to SEQ ID NO: 127826

SEQ ID NO: 364339 - RNA, 64 nt, hsa; identical to SEQ ID NO: 127827

SEQ ID NO: 364340 - RNA, 64 nt, hsa; identical to SEQ ID NO: 127828

SEQ ID NO: 364341 - RNA, 64 nt, hsa; identical to SEQ ID NO: 127829

SEQ ID NO: 364342 - RNA, 64 nt, hsa; identical to SEQ ID NO: 127830

SEQ ID NO: 364343 - RNA, 64 nt, hsa; identical to SEQ ID NO: 127831

SEQ ID NO: 364344 - RNA, 64 nt, hsa; identical to SEQ ID NO: 127832

SEQ ID NO: 364345 - RNA, 64 nt, hsa; identical to SEQ ID NO: 127833

SEQ ID NO: 364346 - RNA, 64 nt, hsa; identical to SEQ ID NO: 127834

SEQ ID NO: 364347 - RNA, 64 nt, hsa; identical to SEQ ID NO: 127835

SEQ ID NO: 364348 - RNA, 64 nt, hsa; identical to SEQ ID NO: 127836

SEQ ID NO: 364349 - RNA, 64 nt, hsa; identical to SEQ ID NO: 127837

SEQ ID NO: 364350 - RNA, 64 nt, hsa; identical to SEQ ID NO: 127838

SEQ ID NO: 364351 - RNA, 64 nt, hsa; identical to SEQ ID NO: 127839

SEQ ID NO: 364352 - RNA, 64 nt, hsa; identical to SEQ ID NO: 127840

SEQ ID NO: 364353 - RNA, 64 nt, hsa; identical to SEQ ID NO: 127841

SEQ ID NO: 364354 - RNA, 64 nt, hsa; identical to SEQ ID NO: 127842

SEQ ID NO: 364355 - RNA, 64 nt, hsa; identical to SEQ ID NO: 127843

SEQ ID NO: 364356 - RNA, 64 nt, hsa; identical to SEQ ID NO: 127844

SEQ ID NO: 364357 - RNA, 64 nt, hsa; identical to SEQ ID NO: 127845

SEQ ID NO: 364358 - RNA, 64 nt, hsa; identical to SEQ ID NO: 127846

SEQ ID NO: 364359 - RNA, 64 nt, hsa; identical to SEQ ID NO: 127847

SEQ ID NO: 364360 - RNA, 64 nt, hsa; identical to SEQ ID NO: 127848

SEQ ID NO: 364361 - RNA, 64 nt, hsa; identical to SEQ ID NO: 127849

SEQ ID NO: 364362 - RNA, 64 nt, hsa; identical to SEQ ID NO: 127850

SEQ ID NO: 364363 - RNA, 64 nt, hsa; identical to SEQ ID NO: 127851

SEQ ID NO: 364364 - RNA, 64 nt, hsa; identical to SEQ ID NO: 127852

SEQ ID NO: 364365 - RNA, 64 nt, hsa; identical to SEQ ID NO: 127853

SEQ ID NO: 364366 - RNA, 64 nt, hsa; identical to SEQ ID NO: 127854

SEQ ID NO: 364367 - RNA, 64 nt, hsa; identical to SEQ ID NO: 127855

SEQ ID NO: 364368 - RNA, 64 nt, hsa; identical to SEQ ID NO: 127856

SEQ ID NO: 364369 - RNA, 64 nt, hsa; identical to SEQ ID NO: 127857

SEQ ID NO: 364370 - RNA, 64 nt, hsa; identical to SEQ ID NO: 127858

SEQ ID NO: 364371 - RNA, 64 nt, hsa; identical to SEQ ID NO: 127859

SEQ ID NO: 364372 - RNA, 64 nt, hsa; identical to SEQ ID NO: 127860

SEQ ID NO: 364373 - RNA, 64 nt, hsa; identical to SEQ ID NO: 127861

SEQ ID NO: 364374 - RNA, 64 nt, hsa; identical to SEQ ID NO: 127862

SEQ ID NO: 364375 - RNA, 64 nt, hsa; identical to SEQ ID NO: 127863

SEQ ID NO: 364376 - RNA, 64 nt, hsa; identical to SEQ ID NO: 127864

SEQ ID NO: 364377 - RNA, 64 nt, hsa; identical to SEQ ID NO: 127865

SEQ ID NO: 364378 - RNA, 64 nt, hsa; identical to SEQ ID NO: 127866

SEQ ID NO: 364379 - RNA, 64 nt, hsa; identical to SEQ ID NO: 127867

SEQ ID NO: 364380 - RNA, 64 nt, hsa; identical to SEQ ID NO: 127868

SEQ ID NO: 364381 - RNA, 64 nt, hsa; identical to SEQ ID NO: 127869

SEQ ID NO: 364382 - RNA, 64 nt, hsa; identical to SEQ ID NO: 127870

SEQ ID NO: 364383 - RNA, 64 nt, hsa; identical to SEQ ID NO: 127871

SEQ ID NO: 364384 - RNA, 64 nt, hsa; identical to SEQ ID NO: 127872

SEQ ID NO: 364385 - RNA, 64 nt, hsa; identical to SEQ ID NO: 127873

SEQ ID NO: 364386 - RNA, 64 nt, hsa; identical to SEQ ID NO: 127874

SEQ ID NO: 364387 - RNA, 64 nt, hsa; identical to SEQ ID NO: 127875

SEQ ID NO: 364388 - RNA, 64 nt, hsa; identical to SEQ ID NO: 127876

SEQ ID NO: 364389 - RNA, 64 nt, hsa; identical to SEQ ID NO: 127877

SEQ ID NO: 364390 - RNA, 64 nt, hsa; identical to SEQ ID NO: 127878

SEQ ID NO: 364391 - RNA, 52 nt, hsa; identical to SEQ ID NO: 127879

SEQ ID NO: 364392 - RNA, 64 nt, hsa; identical to SEQ ID NO: 127880

SEQ ID NO: 364393 - RNA, 64 nt, hsa; identical to SEQ ID NO: 127881

SEQ ID NO: 364394 - RNA, 64 nt, hsa; identical to SEQ ID NO: 127882

SEQ ID NO: 364395 - RNA, 64 nt, hsa; identical to SEQ ID NO: 127883

SEQ ID NO: 364396 - RNA, 64 nt, hsa; identical to SEQ ID NO: 127884

SEQ ID NO: 364397 - RNA, 64 nt, hsa; identical to SEQ ID NO: 127885

SEQ ID NO: 364398 - RNA, 64 nt, hsa; identical to SEQ ID NO: 127886

SEQ ID NO: 364399 - RNA, 64 nt, hsa; identical to SEQ ID NO: 127887

SEQ ID NO: 364400 - RNA, 64 nt, hsa; identical to SEQ ID NO: 127888

SEQ ID NO: 364401 - RNA, 64 nt, hsa; identical to SEQ ID NO: 127889

SEQ ID NO: 364402 - RNA, 64 nt, hsa; identical to SEQ ID NO: 127890

SEQ ID NO: 364403 - RNA, 64 nt, hsa; identical to SEQ ID NO: 127891

SEQ ID NO: 364404 - RNA, 64 nt, hsa; identical to SEQ ID NO: 127892

SEQ ID NO: 364405 - RNA, 64 nt, hsa; identical to SEQ ID NO: 127893

SEQ ID NO: 364406 - RNA, 64 nt, hsa; identical to SEQ ID NO: 127894

SEQ ID NO: 364407 - RNA, 64 nt, hsa; identical to SEQ ID NO: 127895

SEQ ID NO: 364408 - RNA, 64 nt, hsa; identical to SEQ ID NO: 127896

SEQ ID NO: 364409 - RNA, 64 nt, hsa; identical to SEQ ID NO: 127897

SEQ ID NO: 364410 - RNA, 64 nt, hsa; identical to SEQ ID NO: 127898

SEQ ID NO: 364411 - RNA, 64 nt, hsa; identical to SEQ ID NO: 127899

SEQ ID NO: 364412 - RNA, 64 nt, hsa; identical to SEQ ID NO: 127900

SEQ ID NO: 364413 - RNA, 64 nt, hsa; identical to SEQ ID NO: 127901

SEQ ID NO: 364414 - RNA, 64 nt, hsa; identical to SEQ ID NO: 127902

SEQ ID NO: 364415 - RNA, 64 nt, hsa; identical to SEQ ID NO: 127903

SEQ ID NO: 364416 - RNA, 64 nt, hsa; identical to SEQ ID NO: 127904

SEQ ID NO: 364417 - RNA, 64 nt, hsa; identical to SEQ ID NO: 127905

SEQ ID NO: 364418 - RNA, 64 nt, hsa; identical to SEQ ID NO: 127906

SEQ ID NO: 364419 - RNA, 64 nt, hsa; identical to SEQ ID NO: 127907

SEQ ID NO: 364420 - RNA, 64 nt, hsa; identical to SEQ ID NO: 127908

SEQ ID NO: 364421 - RNA, 64 nt, hsa; identical to SEQ ID NO: 127909

SEQ ID NO: 364422 - RNA, 64 nt, hsa; identical to SEQ ID NO: 127910

SEQ ID NO: 364423 - RNA, 64 nt, hsa; identical to SEQ ID NO: 127826

SEQ ID NO: 364424 - RNA, 64 nt, hsa; identical to SEQ ID NO: 127912

SEQ ID NO: 364425 - RNA, 64 nt, hsa; identical to SEQ ID NO: 127913

SEQ ID NO: 364426 - RNA, 64 nt, hsa; identical to SEQ ID NO: 127914

SEQ ID NO: 364427 - RNA, 64 nt, hsa; identical to SEQ ID NO: 127915

SEQ ID NO: 364428 - RNA, 64 nt, hsa; identical to SEQ ID NO: 127916

SEQ ID NO: 364429 - RNA, 64 nt, hsa; identical to SEQ ID NO: 127917

SEQ ID NO: 364430 - RNA, 64 nt, hsa; identical to SEQ ID NO: 127918

SEQ ID NO: 364431 - RNA, 64 nt, hsa; identical to SEQ ID NO: 127919

SEQ ID NO: 364432 - RNA, 64 nt, hsa; identical to SEQ ID NO: 127920

SEQ ID NO: 364433 - RNA, 64 nt, hsa; identical to SEQ ID NO: 127921

SEQ ID NO: 364434 - RNA, 64 nt, hsa; identical to SEQ ID NO: 127922

SEQ ID NO: 364435 - RNA, 64 nt, hsa; identical to SEQ ID NO: 127923

SEQ ID NO: 364436 - RNA, 64 nt, hsa; identical to SEQ ID NO: 127924

SEQ ID NO: 364437 - RNA, 64 nt, hsa; identical to SEQ ID NO: 127925

SEQ ID NO: 364438 - RNA, 64 nt, hsa; identical to SEQ ID NO: 127926

SEQ ID NO: 364439 - RNA, 64 nt, hsa; identical to SEQ ID NO: 127927

SEQ ID NO: 364440 - RNA, 64 nt, hsa; identical to SEQ ID NO: 127928

SEQ ID NO: 364441 - RNA, 64 nt, hsa; identical to SEQ ID NO: 127929

SEQ ID NO: 364442 - RNA, 64 nt, hsa; identical to SEQ ID NO: 127930

SEQ ID NO: 364443 - RNA, 64 nt, hsa; identical to SEQ ID NO: 127931

SEQ ID NO: 364444 - RNA, 64 nt, hsa; identical to SEQ ID NO: 127932

SEQ ID NO: 364445 - RNA, 64 nt, hsa; identical to SEQ ID NO: 127933

SEQ ID NO: 364446 - RNA, 64 nt, hsa; identical to SEQ ID NO: 127934

SEQ ID NO: 364447 - RNA, 64 nt, hsa; identical to SEQ ID NO: 127935

SEQ ID NO: 364448 - RNA, 64 nt, hsa; identical to SEQ ID NO: 127936

SEQ ID NO: 364449 - RNA, 64 nt, hsa; identical to SEQ ID NO: 127937

SEQ ID NO: 364450 - RNA, 64 nt, hsa; identical to SEQ ID NO: 127938

SEQ ID NO: 364451 - RNA, 64 nt, hsa; identical to SEQ ID NO: 127939

SEQ ID NO: 364452 - RNA, 64 nt, hsa; identical to SEQ ID NO: 127940

SEQ ID NO: 364453 - RNA, 64 nt, hsa; identical to SEQ ID NO: 127941

SEQ ID NO: 364454 - RNA, 64 nt, hsa; identical to SEQ ID NO: 127942

SEQ ID NO: 364455 - RNA, 64 nt, hsa; identical to SEQ ID NO: 127943

SEQ ID NO: 364456 - RNA, 64 nt, hsa; identical to SEQ ID NO: 127944

SEQ ID NO: 364457 - RNA, 64 nt, hsa; identical to SEQ ID NO: 127945

SEQ ID NO: 364458 - RNA, 64 nt, hsa; identical to SEQ ID NO: 127946

SEQ ID NO: 364459 - RNA, 64 nt, hsa; identical to SEQ ID NO: 127947

SEQ ID NO: 364460 - RNA, 64 nt, hsa; identical to SEQ ID NO: 127948

SEQ ID NO: 364461 - RNA, 64 nt, hsa; identical to SEQ ID NO: 127949

SEQ ID NO: 364462 - RNA, 64 nt, hsa; identical to SEQ ID NO: 127950

SEQ ID NO: 364463 - RNA, 64 nt, hsa; identical to SEQ ID NO: 127951

SEQ ID NO: 364464 - RNA, 64 nt, hsa; identical to SEQ ID NO: 127952

SEQ ID NO: 364465 - RNA, 64 nt, hsa; identical to SEQ ID NO: 127953

SEQ ID NO: 364466 - RNA, 64 nt, hsa; identical to SEQ ID NO: 127954

SEQ ID NO: 364467 - RNA, 64 nt, hsa; identical to SEQ ID NO: 127955

SEQ ID NO: 364468 - RNA, 64 nt, hsa; identical to SEQ ID NO: 127956

SEQ ID NO: 364469 - RNA, 64 nt, hsa; identical to SEQ ID NO: 127957

SEQ ID NO: 364470 - RNA, 64 nt, hsa; identical to SEQ ID NO: 127958

SEQ ID NO: 364471 - RNA, 64 nt, hsa; identical to SEQ ID NO: 127959

SEQ ID NO: 364472 - RNA, 64 nt, hsa; identical to SEQ ID NO: 127960

SEQ ID NO: 364473 - RNA, 64 nt, hsa; identical to SEQ ID NO: 127961

SEQ ID NO: 364474 - RNA, 64 nt, hsa; identical to SEQ ID NO: 127962

SEQ ID NO: 364475 - RNA, 64 nt, hsa; identical to SEQ ID NO: 127963

SEQ ID NO: 364476 - RNA, 64 nt, hsa; identical to SEQ ID NO: 127964

SEQ ID NO: 364477 - RNA, 64 nt, hsa; identical to SEQ ID NO: 127965

SEQ ID NO: 364478 - RNA, 64 nt, hsa; identical to SEQ ID NO: 127966

SEQ ID NO: 364479 - RNA, 64 nt, hsa; identical to SEQ ID NO: 127967

SEQ ID NO: 364480 - RNA, 64 nt, hsa; identical to SEQ ID NO: 127968

SEQ ID NO: 364481 - RNA, 64 nt, hsa; identical to SEQ ID NO: 127969

SEQ ID NO: 364482 - RNA, 64 nt, hsa; identical to SEQ ID NO: 127970

SEQ ID NO: 364483 - RNA, 64 nt, hsa; identical to SEQ ID NO: 127971

SEQ ID NO: 364484 - RNA, 64 nt, hsa; identical to SEQ ID NO: 127972

SEQ ID NO: 364485 - RNA, 64 nt, hsa; identical to SEQ ID NO: 127973

SEQ ID NO: 364486 - RNA, 64 nt, hsa; identical to SEQ ID NO: 127974

SEQ ID NO: 364487 - RNA, 64 nt, hsa; identical to SEQ ID NO: 127975

SEQ ID NO: 364488 - RNA, 64 nt, hsa; identical to SEQ ID NO: 127976

SEQ ID NO: 364489 - RNA, 64 nt, hsa; identical to SEQ ID NO: 127977

SEQ ID NO: 364490 - RNA, 64 nt, hsa; identical to SEQ ID NO: 127978

SEQ ID NO: 364491 - RNA, 64 nt, hsa; identical to SEQ ID NO: 127979

SEQ ID NO: 364492 - RNA, 64 nt, hsa; identical to SEQ ID NO: 127980

SEQ ID NO: 364493 - RNA, 64 nt, hsa; identical to SEQ ID NO: 127981

SEQ ID NO: 364494 - RNA, 64 nt, hsa; identical to SEQ ID NO: 127982

SEQ ID NO: 364495 - RNA, 64 nt, hsa; identical to SEQ ID NO: 127983

SEQ ID NO: 364496 - RNA, 64 nt, hsa; identical to SEQ ID NO: 127984

SEQ ID NO: 364497 - RNA, 64 nt, hsa; identical to SEQ ID NO: 127985

SEQ ID NO: 364498 - RNA, 64 nt, hsa; identical to SEQ ID NO: 127986

SEQ ID NO: 364499 - RNA, 64 nt, hsa; identical to SEQ ID NO: 127987

SEQ ID NO: 364500 - RNA, 64 nt, hsa; identical to SEQ ID NO: 127988

SEQ ID NO: 364501 - RNA, 64 nt, hsa; identical to SEQ ID NO: 127989

SEQ ID NO: 364502 - RNA, 64 nt, hsa; identical to SEQ ID NO: 127990

SEQ ID NO: 364503 - RNA, 64 nt, hsa; identical to SEQ ID NO: 127991

SEQ ID NO: 364504 - RNA, 64 nt, hsa; identical to SEQ ID NO: 127992

SEQ ID NO: 364505 - RNA, 64 nt, hsa; identical to SEQ ID NO: 127993

SEQ ID NO: 364506 - RNA, 64 nt, hsa; identical to SEQ ID NO: 127994

SEQ ID NO: 364507 - RNA, 64 nt, hsa; identical to SEQ ID NO: 127995

SEQ ID NO: 364508 - RNA, 64 nt, hsa; identical to SEQ ID NO: 127996

SEQ ID NO: 364509 - RNA, 64 nt, hsa; identical to SEQ ID NO: 127997

SEQ ID NO: 364510 - RNA, 64 nt, hsa; identical to SEQ ID NO: 127998

SEQ ID NO: 364511 - RNA, 64 nt, hsa; identical to SEQ ID NO: 127999

SEQ ID NO: 364512 - RNA, 64 nt, hsa; identical to SEQ ID NO: 128000

SEQ ID NO: 364513 - RNA, 64 nt, hsa; identical to SEQ ID NO: 128001

SEQ ID NO: 364514 - RNA, 64 nt, hsa; identical to SEQ ID NO: 128002

SEQ ID NO: 364515 - RNA, 64 nt, hsa; identical to SEQ ID NO: 128003

SEQ ID NO: 364516 - RNA, 64 nt, hsa; identical to SEQ ID NO: 128004

SEQ ID NO: 364517 - RNA, 64 nt, hsa; identical to SEQ ID NO: 128005

SEQ ID NO: 364518 - RNA, 64 nt, hsa; identical to SEQ ID NO: 128006

SEQ ID NO: 364519 - RNA, 64 nt, hsa; identical to SEQ ID NO: 128007

SEQ ID NO: 364520 - RNA, 64 nt, hsa; identical to SEQ ID NO: 128008

SEQ ID NO: 364521 - RNA, 64 nt, hsa; identical to SEQ ID NO: 128009

SEQ ID NO: 364522 - RNA, 64 nt, hsa; identical to SEQ ID NO: 128010

SEQ ID NO: 364523 - RNA, 64 nt, hsa; identical to SEQ ID NO: 128011

SEQ ID NO: 364524 - RNA, 64 nt, hsa; identical to SEQ ID NO: 128012

SEQ ID NO: 364525 - RNA, 64 nt, hsa; identical to SEQ ID NO: 128013

SEQ ID NO: 364526 - RNA, 64 nt, hsa; identical to SEQ ID NO: 128014

SEQ ID NO: 364527 - RNA, 64 nt, hsa; identical to SEQ ID NO: 128015

SEQ ID NO: 364528 - RNA, 64 nt, hsa; identical to SEQ ID NO: 128016

SEQ ID NO: 364529 - RNA, 64 nt, hsa; identical to SEQ ID NO: 128017

SEQ ID NO: 364530 - RNA, 64 nt, hsa; identical to SEQ ID NO: 128018

SEQ ID NO: 364531 - RNA, 64 nt, hsa; identical to SEQ ID NO: 128019

SEQ ID NO: 364532 - RNA, 64 nt, hsa; identical to SEQ ID NO: 128020

SEQ ID NO: 364533 - RNA, 64 nt, hsa; identical to SEQ ID NO: 128021

SEQ ID NO: 364534 - RNA, 64 nt, hsa; identical to SEQ ID NO: 128022

SEQ ID NO: 364535 - RNA, 64 nt, hsa; identical to SEQ ID NO: 128023

SEQ ID NO: 364536 - RNA, 64 nt, hsa; identical to SEQ ID NO: 128024

SEQ ID NO: 364537 - RNA, 64 nt, hsa; identical to SEQ ID NO: 128025

SEQ ID NO: 364538 - RNA, 64 nt, hsa; identical to SEQ ID NO: 128026

SEQ ID NO: 364539 - RNA, 64 nt, hsa; identical to SEQ ID NO: 128027

SEQ ID NO: 364540 - RNA, 64 nt, hsa; identical to SEQ ID NO: 128028

SEQ ID NO: 364541 - RNA, 64 nt, hsa; identical to SEQ ID NO: 128029

SEQ ID NO: 364542 - RNA, 64 nt, hsa
ggcucuugaggcauuuccagacuugaaauucucaucaguccauugcucuugagucuuugcagag

SEQ ID NO: 364543 - RNA, 64 nt, hsa
cggacggggcugacuccugcucucuggaggacggucaguccaugucucggagaaacgggugagc

SEQ ID NO: 364544 - RNA, 64 nt, hsa
uaccauaccaacuucucucccaucucuagguggcucaguccauggccacucccugcccccagcc

SEQ ID NO: 364545 - RNA, 64 nt, hsa
cucuuuccgucccucucuuucugauccaggccccucaguccaagcuuuggaaaaccuucaccuc

SEQ ID NO: 364546 - RNA, 64 nt, hsa
auucuaaaggaagaagcacuaaauggcagggugaucaguccaaagcauuuaugaggggagcuua

SEQ ID NO: 364547 - RNA, 64 nt, hsa
accacaggacaacucugcccauagcaaagaugcuucaguccagagggagcccaugggcuguuug

SEQ ID NO: 364548 - RNA, 64 nt, hsa
cggcuccuguuuagcuuuuauuucaguucuaaccucaguccagaaacauaugugagguuguuuc

SEQ ID NO: 364549 - RNA, 64 nt, hsa
uuuuagcucuugcuuuaaguguuuguuuguuaucucaguccagaaccaauauuaucguaauuaa

SEQ ID NO: 364550 - RNA, 64 nt, hsa
ucgugugcauucugggcgcauguugaucgcugguucaguccaggcaacugacaugcuuuuauua

SEQ ID NO: 364551 - RNA, 64 nt, hsa
auccauucuaacagaagacugguccccagcgcucucaguccaaucaguuugucuuagcauuauu

SEQ ID NO: 364552 - RNA, 64 nt, hsa
gaauuucugcucugguuagaaaaaggacucugcuucaguccacuucugcucugguuagaaaaag

SEQ ID NO: 364553 - RNA, 64 nt, hsa
ccacuucugcucugguuagaaaaaggacucugcuucaguccacaguacauaaaauguacucagg

SEQ ID NO: 364554 - RNA, 64 nt, hsa
uucuucgaggaaagccaagcuccucaaacaggguucaguccacguuguguuuucacaccuuucu

SEQ ID NO: 364555 - RNA, 64 nt, hsa
gagaccaccucuguggccaccucagauagucaucucaguccaaggaucccaaaacacaaaucua

SEQ ID NO: 364556 - RNA, 64 nt, hsa
aaauugguuuaagauauuggaugauagaagauauuuaagauaucuagauggugauauuuuccuu

SEQ ID NO: 364557 - RNA, 64 nt, hsa
aguaccuuugaauaaaacaauuuaagaaauugguuuaagauauuggaugauagaagauauuuaa

SEQ ID NO: 364558 - RNA, 64 nt, hsa
accuuuuaaagcauuguuuuagaaugucugaguauuaagauacagauuaauugggaauaucuga

SEQ ID NO: 364559 - RNA, 64 nt, hsa
aaaaugccugaaaaaagcuaaauuauuuaagucauuaagauauugagaaaaaauuugaaauuuu

SEQ ID NO: 364560 - RNA, 64 nt, hsa
uguuuguauacacaugucauuuauuauuauuacuuuaagauagguauuauucaugugucaaugu

SEQ ID NO: 364561 - RNA, 64 nt, hsa
aacacaauggaguacuaagaugguauuugcacauuuaagauauguuacuuuaccaauuuuuaau

SEQ ID NO: 364562 - RNA, 64 nt, hsa
uaaaaauuuuaaaaagaaaaaagacuacuacagguuaagauaauuuuuuuaccugucuuuucuc

SEQ ID NO: 364563 - RNA, 64 nt, hsa
cuaccauuauauuuugggguuauguuuugcuucuuuaagauagaaaucccaguucucuaauuug

SEQ ID NO: 364564 - RNA, 64 nt, hsa
cugauuuacuacacagagaaacuuuuuuuuuuuuuuaagauauaugacuaaaauggacaauugu

SEQ ID NO: 364565 - RNA, 64 nt, hsa
uuaaaaugacuaaaugcuuuaaacauauuguagcuuaagauauauguguuaagauauauacaug

SEQ ID NO: 364566 - RNA, 64 nt, hsa
ugcuuuaaacauauuguagcuuaagauauauguguuaagauauauacaugagaaacuuuaaaag

SEQ ID NO: 364567 - RNA, 64 nt, hsa
guuugguuuuuacagucaagccuacugcuugcaauuaagauaucaaucugaaaugcaucuguaa

SEQ ID NO: 364568 - RNA, 64 nt, hsa
uuguaaauugaagaaaacaagaugcugccauauauuaagauagaauauaauuaacuccaugaga

SEQ ID NO: 364569 - RNA, 64 nt, hsa
cgagguuacaucguagguuuugauuuuucucaauuuaagauacagaaauacagcaagccuuaau

SEQ ID NO: 364570 - RNA, 64 nt, hsa
aauuacauguauauuuugguguuaagguugauuuuuaagauacuucugauuuguacaaaaggaa

SEQ ID NO: 364571 - RNA, 64 nt, hsa
uucauuuguuuugcacauaugcauaugugcccauuuaagauauuugcauauacuugauagaaac

SEQ ID NO: 364572 - RNA, 64 nt, hsa
gaagagauuguauuagauauuauauuuauuucauuuaagauaauuuucaaaguuaauuuucuaa

SEQ ID NO: 364573 - RNA, 64 nt, hsa
cagaacuuuuacaauuuuuucaucuaaaaguauuuuaagauauuuuuaaaauccaagagcuucu

SEQ ID NO: 364574 - RNA, 64 nt, hsa
aucccauuaucaacccugaaaguuugcuuguccuuuaagauaaaaauguaauguugugauauuc

SEQ ID NO: 364575 - RNA, 64 nt, hsa; identical to SEQ ID NO: 91262

SEQ ID NO: 364576 - RNA, 64 nt, hsa; identical to SEQ ID NO: 91263

SEQ ID NO: 364577 - RNA, 64 nt, hsa; identical to SEQ ID NO: 91264

SEQ ID NO: 364578 - RNA, 64 nt, hsa; identical to SEQ ID NO: 91265

SEQ ID NO: 364579 - RNA, 64 nt, hsa; identical to SEQ ID NO: 91266

SEQ ID NO: 364580 - RNA, 64 nt, hsa; identical to SEQ ID NO: 91267

SEQ ID NO: 364581 - RNA, 64 nt, hsa; identical to SEQ ID NO: 91268

SEQ ID NO: 364582 - RNA, 64 nt, hsa; identical to SEQ ID NO: 91269

SEQ ID NO: 364583 - RNA, 64 nt, hsa; identical to SEQ ID NO: 91270

SEQ ID NO: 364584 - RNA, 64 nt, hsa; identical to SEQ ID NO: 91271

SEQ ID NO: 364585 - RNA, 64 nt, hsa; identical to SEQ ID NO: 91272

SEQ ID NO: 364586 - RNA, 64 nt, hsa; identical to SEQ ID NO: 91273

SEQ ID NO: 364587 - RNA, 64 nt, hsa; identical to SEQ ID NO: 91274

SEQ ID NO: 364588 - RNA, 64 nt, hsa; identical to SEQ ID NO: 91275

SEQ ID NO: 364589 - RNA, 64 nt, hsa; identical to SEQ ID NO: 91276

SEQ ID NO: 364590 - RNA, 64 nt, hsa; identical to SEQ ID NO: 91277

SEQ ID NO: 364591 - RNA, 64 nt, hsa; identical to SEQ ID NO: 91278

SEQ ID NO: 364592 - RNA, 64 nt, hsa; identical to SEQ ID NO: 91279

SEQ ID NO: 364593 - RNA, 64 nt, hsa; identical to SEQ ID NO: 91280

SEQ ID NO: 364594 - RNA, 64 nt, hsa; identical to SEQ ID NO: 91281

SEQ ID NO: 364595 - RNA, 64 nt, hsa; identical to SEQ ID NO: 91282

SEQ ID NO: 364596 - RNA, 64 nt, hsa; identical to SEQ ID NO: 91283

SEQ ID NO: 364597 - RNA, 64 nt, hsa; identical to SEQ ID NO: 91284

SEQ ID NO: 364598 - RNA, 64 nt, hsa; identical to SEQ ID NO: 91285

SEQ ID NO: 364599 - RNA, 64 nt, hsa; identical to SEQ ID NO: 91286

SEQ ID NO: 364600 - RNA, 64 nt, hsa; identical to SEQ ID NO: 91287

SEQ ID NO: 364601 - RNA, 64 nt, hsa; identical to SEQ ID NO: 91288

SEQ ID NO: 364602 - RNA, 64 nt, hsa; identical to SEQ ID NO: 91289

SEQ ID NO: 364603 - RNA, 64 nt, hsa; identical to SEQ ID NO: 91290

SEQ ID NO: 364604 - RNA, 64 nt, hsa; identical to SEQ ID NO: 91291

SEQ ID NO: 364605 - RNA, 64 nt, hsa; identical to SEQ ID NO: 91292

SEQ ID NO: 364606 - RNA, 64 nt, hsa; identical to SEQ ID NO: 91293

SEQ ID NO: 364607 - RNA, 64 nt, hsa; identical to SEQ ID NO: 91294

SEQ ID NO: 364608 - RNA, 64 nt, hsa; identical to SEQ ID NO: 91295

SEQ ID NO: 364609 - RNA, 64 nt, hsa; identical to SEQ ID NO: 91296

SEQ ID NO: 364610 - RNA, 64 nt, hsa; identical to SEQ ID NO: 91297

SEQ ID NO: 364611 - RNA, 64 nt, hsa; identical to SEQ ID NO: 91298

SEQ ID NO: 364612 - RNA, 64 nt, hsa; identical to SEQ ID NO: 91299

SEQ ID NO: 364613 - RNA, 64 nt, hsa; identical to SEQ ID NO: 91300

SEQ ID NO: 364614 - RNA, 64 nt, hsa; identical to SEQ ID NO: 91301

SEQ ID NO: 364615 - RNA, 64 nt, hsa; identical to SEQ ID NO: 91302

SEQ ID NO: 364616 - RNA, 64 nt, hsa; identical to SEQ ID NO: 91303

SEQ ID NO: 364617 - RNA, 64 nt, hsa; identical to SEQ ID NO: 91304

SEQ ID NO: 364618 - RNA, 64 nt, hsa; identical to SEQ ID NO: 91305

SEQ ID NO: 364619 - RNA, 64 nt, hsa; identical to SEQ ID NO: 91306

SEQ ID NO: 364620 - RNA, 64 nt, hsa; identical to SEQ ID NO: 91307

SEQ ID NO: 364621 - RNA, 64 nt, hsa; identical to SEQ ID NO: 91308

SEQ ID NO: 364622 - RNA, 64 nt, hsa; identical to SEQ ID NO: 91309

SEQ ID NO: 364623 - RNA, 64 nt, hsa; identical to SEQ ID NO: 91310

SEQ ID NO: 364624 - RNA, 64 nt, hsa; identical to SEQ ID NO: 91311

SEQ ID NO: 364625 - RNA, 64 nt, hsa; identical to SEQ ID NO: 91312

SEQ ID NO: 364626 - RNA, 64 nt, hsa; identical to SEQ ID NO: 91313

SEQ ID NO: 364627 - RNA, 64 nt, hsa; identical to SEQ ID NO: 91314

SEQ ID NO: 364628 - RNA, 64 nt, hsa; identical to SEQ ID NO: 91315

SEQ ID NO: 364629 - RNA, 64 nt, hsa; identical to SEQ ID NO: 91316

SEQ ID NO: 364630 - RNA, 64 nt, hsa; identical to SEQ ID NO: 91317

SEQ ID NO: 364631 - RNA, 64 nt, hsa; identical to SEQ ID NO: 91318

SEQ ID NO: 364632 - RNA, 64 nt, hsa; identical to SEQ ID NO: 91319

SEQ ID NO: 364633 - RNA, 64 nt, hsa; identical to SEQ ID NO: 91320

SEQ ID NO: 364634 - RNA, 64 nt, hsa; identical to SEQ ID NO: 91321

SEQ ID NO: 364635 - RNA, 64 nt, hsa; identical to SEQ ID NO: 91322

SEQ ID NO: 364636 - RNA, 64 nt, hsa; identical to SEQ ID NO: 91323

SEQ ID NO: 364637 - RNA, 64 nt, hsa; identical to SEQ ID NO: 91324

SEQ ID NO: 364638 - RNA, 64 nt, hsa; identical to SEQ ID NO: 91325

SEQ ID NO: 364639 - RNA, 64 nt, hsa; identical to SEQ ID NO: 91326

SEQ ID NO: 364640 - RNA, 64 nt, hsa; identical to SEQ ID NO: 91327

SEQ ID NO: 364641 - RNA, 64 nt, hsa; identical to SEQ ID NO: 91328

SEQ ID NO: 364642 - RNA, 64 nt, hsa; identical to SEQ ID NO: 91329

SEQ ID NO: 364643 - RNA, 64 nt, hsa; identical to SEQ ID NO: 91330

SEQ ID NO: 364644 - RNA, 64 nt, hsa; identical to SEQ ID NO: 91331

SEQ ID NO: 364645 - RNA, 64 nt, hsa; identical to SEQ ID NO: 91332

SEQ ID NO: 364646 - RNA, 64 nt, hsa; identical to SEQ ID NO: 91333

SEQ ID NO: 364647 - RNA, 64 nt, hsa; identical to SEQ ID NO: 91334

SEQ ID NO: 364648 - RNA, 64 nt, hsa; identical to SEQ ID NO: 91335

SEQ ID NO: 364649 - RNA, 64 nt, hsa; identical to SEQ ID NO: 91336

SEQ ID NO: 364650 - RNA, 64 nt, hsa; identical to SEQ ID NO: 91337

SEQ ID NO: 364651 - RNA, 64 nt, hsa; identical to SEQ ID NO: 91338

SEQ ID NO: 364652 - RNA, 64 nt, hsa; identical to SEQ ID NO: 91339

SEQ ID NO: 364653 - RNA, 64 nt, hsa; identical to SEQ ID NO: 91340

SEQ ID NO: 364654 - RNA, 64 nt, hsa; identical to SEQ ID NO: 91341

SEQ ID NO: 364655 - RNA, 64 nt, hsa; identical to SEQ ID NO: 91342

SEQ ID NO: 364656 - RNA, 64 nt, hsa; identical to SEQ ID NO: 91343

SEQ ID NO: 364657 - RNA, 64 nt, hsa; identical to SEQ ID NO: 91344

SEQ ID NO: 364658 - RNA, 64 nt, hsa; identical to SEQ ID NO: 91345

SEQ ID NO: 364659 - RNA, 64 nt, hsa; identical to SEQ ID NO: 91346

SEQ ID NO: 364660 - RNA, 64 nt, hsa; identical to SEQ ID NO: 91347

SEQ ID NO: 364661 - RNA, 64 nt, hsa; identical to SEQ ID NO: 91348

SEQ ID NO: 364662 - RNA, 64 nt, hsa; identical to SEQ ID NO: 91349

SEQ ID NO: 364663 - RNA, 64 nt, hsa; identical to SEQ ID NO: 91350

SEQ ID NO: 364664 - RNA, 64 nt, hsa; identical to SEQ ID NO: 91351

SEQ ID NO: 364665 - RNA, 64 nt, hsa; identical to SEQ ID NO: 91352

SEQ ID NO: 364666 - RNA, 64 nt, hsa; identical to SEQ ID NO: 91353

SEQ ID NO: 364667 - RNA, 54 nt, hsa; identical to SEQ ID NO: 91354

SEQ ID NO: 364668 - RNA, 64 nt, hsa; identical to SEQ ID NO: 91355

SEQ ID NO: 364669 - RNA, 64 nt, hsa; identical to SEQ ID NO: 91356

SEQ ID NO: 364670 - RNA, 64 nt, hsa; identical to SEQ ID NO: 91357

SEQ ID NO: 364671 - RNA, 64 nt, hsa; identical to SEQ ID NO: 91358

SEQ ID NO: 364672 - RNA, 64 nt, hsa; identical to SEQ ID NO: 91359

SEQ ID NO: 364673 - RNA, 64 nt, hsa; identical to SEQ ID NO: 91360

SEQ ID NO: 364674 - RNA, 64 nt, hsa; identical to SEQ ID NO: 91361

SEQ ID NO: 364675 - RNA, 64 nt, hsa; identical to SEQ ID NO: 91362

SEQ ID NO: 364676 - RNA, 64 nt, hsa; identical to SEQ ID NO: 91363

SEQ ID NO: 364677 - RNA, 64 nt, hsa; identical to SEQ ID NO: 91364

SEQ ID NO: 364678 - RNA, 64 nt, hsa; identical to SEQ ID NO: 91365

SEQ ID NO: 364679 - RNA, 64 nt, hsa; identical to SEQ ID NO: 91366

SEQ ID NO: 364680 - RNA, 64 nt, hsa; identical to SEQ ID NO: 91367

SEQ ID NO: 364681 - RNA, 64 nt, hsa; identical to SEQ ID NO: 91368

SEQ ID NO: 364682 - RNA, 64 nt, hsa; identical to SEQ ID NO: 91369

SEQ ID NO: 364683 - RNA, 64 nt, hsa; identical to SEQ ID NO: 91370

SEQ ID NO: 364684 - RNA, 64 nt, hsa; identical to SEQ ID NO: 91371

SEQ ID NO: 364685 - RNA, 64 nt, hsa; identical to SEQ ID NO: 91372

SEQ ID NO: 364686 - RNA, 64 nt, hsa; identical to SEQ ID NO: 91373

SEQ ID NO: 364687 - RNA, 64 nt, hsa; identical to SEQ ID NO: 91374

SEQ ID NO: 364688 - RNA, 64 nt, hsa; identical to SEQ ID NO: 91375

SEQ ID NO: 364689 - RNA, 64 nt, hsa; identical to SEQ ID NO: 91376

SEQ ID NO: 364690 - RNA, 64 nt, hsa; identical to SEQ ID NO: 91377

SEQ ID NO: 364691 - RNA, 64 nt, hsa; identical to SEQ ID NO: 91378

SEQ ID NO: 364692 - RNA, 64 nt, hsa; identical to SEQ ID NO: 91379

SEQ ID NO: 364693 - RNA, 64 nt, hsa; identical to SEQ ID NO: 91380

SEQ ID NO: 364694 - RNA, 64 nt, hsa
agaaacagaaauagaugguggaagaacugccuaaggugugaaaagcugaagauucuaccacuga

SEQ ID NO: 364695 - RNA, 64 nt, hsa
cccucaguaaggaauggaaaccugucccgucuggggugugaagugcccucugcuuuuuccccca

SEQ ID NO: 364696 - RNA, 64 nt, hsa
uccaggccagcuccucugcccacaugucauacaaggugugaauuugagcacaguccagaaaugg

SEQ ID NO: 364697 - RNA, 64 nt, hsa
acccguguccuccguugcucgcacuggggucucuggugugaacacccccgacagcagcccuccg

SEQ ID NO: 364698 - RNA, 64 nt, hsa
uguuuuguuuuguuuuuuuaauaucaaaagagucggugugaaccuugguuggaccccaaguuca

SEQ ID NO: 364699 - RNA, 64 nt, hsa
aacucuuucaagcaucaucuuugaagagucguguggugugaauugguuuguguacauuagaaug

SEQ ID NO: 364700 - RNA, 64 nt, hsa
aucauuuguuagccaagcaaagccauuuauugauggugugaauuaauuauguuuggaugcagca

SEQ ID NO: 364701 - RNA, 64 nt, hsa
aguggacuuuguuguuauuuuuaaaguacaguagggugugaauuauuuugauguugaauuagac

SEQ ID NO: 364702 - RNA, 64 nt, hsa
cuguugcuucagagagacacaaagugaacacacuggugugaaugucgcucucugugugcuugug

SEQ ID NO: 364703 - RNA, 64 nt, hsa
uucuuucaggggugggaguuauggggaaggggugggugugaagggguagaugaaagcuuuaauu

SEQ ID NO: 364704 - RNA, 64 nt, hsa; identical to SEQ ID NO: 216180

SEQ ID NO: 364705 - RNA, 64 nt, hsa; identical to SEQ ID NO: 216181

SEQ ID NO: 364706 - RNA, 64 nt, hsa; identical to SEQ ID NO: 216182

SEQ ID NO: 364707 - RNA, 64 nt, hsa; identical to SEQ ID NO: 216183

SEQ ID NO: 364708 - RNA, 64 nt, hsa; identical to SEQ ID NO: 216184

SEQ ID NO: 364709 - RNA, 64 nt, hsa; identical to SEQ ID NO: 216185

SEQ ID NO: 364710 - RNA, 64 nt, hsa; identical to SEQ ID NO: 216186

SEQ ID NO: 364711 - RNA, 64 nt, hsa; identical to SEQ ID NO: 216187

SEQ ID NO: 364712 - RNA, 64 nt, hsa; identical to SEQ ID NO: 216188

SEQ ID NO: 364713 - RNA, 64 nt, hsa; identical to SEQ ID NO: 216189

SEQ ID NO: 364714 - RNA, 64 nt, hsa; identical to SEQ ID NO: 216190

SEQ ID NO: 364715 - RNA, 64 nt, hsa; identical to SEQ ID NO: 216191

SEQ ID NO: 364716 - RNA, 64 nt, hsa; identical to SEQ ID NO: 216192

SEQ ID NO: 364717 - RNA, 64 nt, hsa; identical to SEQ ID NO: 216193

SEQ ID NO: 364718 - RNA, 64 nt, hsa; identical to SEQ ID NO: 216194

SEQ ID NO: 364719 - RNA, 64 nt, hsa; identical to SEQ ID NO: 216195

SEQ ID NO: 364720 - RNA, 64 nt, hsa; identical to SEQ ID NO: 216196

SEQ ID NO: 364721 - RNA, 64 nt, hsa; identical to SEQ ID NO: 216197

SEQ ID NO: 364722 - RNA, 64 nt, hsa; identical to SEQ ID NO: 216198

SEQ ID NO: 364723 - RNA, 64 nt, hsa; identical to SEQ ID NO: 216199

SEQ ID NO: 364724 - RNA, 64 nt, hsa; identical to SEQ ID NO: 216200

SEQ ID NO: 364725 - RNA, 64 nt, hsa; identical to SEQ ID NO: 216201

SEQ ID NO: 364726 - RNA, 64 nt, hsa; identical to SEQ ID NO: 216202

SEQ ID NO: 364727 - RNA, 64 nt, hsa; identical to SEQ ID NO: 216203

SEQ ID NO: 364728 - RNA, 64 nt, hsa; identical to SEQ ID NO: 216204

SEQ ID NO: 364729 - RNA, 64 nt, hsa; identical to SEQ ID NO: 216205

SEQ ID NO: 364730 - RNA, 64 nt, hsa; identical to SEQ ID NO: 216206

SEQ ID NO: 364731 - RNA, 64 nt, hsa; identical to SEQ ID NO: 216207

SEQ ID NO: 364732 - RNA, 64 nt, hsa; identical to SEQ ID NO: 216208

SEQ ID NO: 364733 - RNA, 64 nt, hsa; identical to SEQ ID NO: 216209

SEQ ID NO: 364734 - RNA, 64 nt, hsa; identical to SEQ ID NO: 216210

SEQ ID NO: 364735 - RNA, 64 nt, hsa; identical to SEQ ID NO: 216211

SEQ ID NO: 364736 - RNA, 64 nt, hsa; identical to SEQ ID NO: 216212

SEQ ID NO: 364737 - RNA, 64 nt, hsa; identical to SEQ ID NO: 216213

SEQ ID NO: 364738 - RNA, 64 nt, hsa; identical to SEQ ID NO: 216214

SEQ ID NO: 364739 - RNA, 64 nt, hsa; identical to SEQ ID NO: 172917

SEQ ID NO: 364740 - RNA, 64 nt, hsa; identical to SEQ ID NO: 172918

SEQ ID NO: 364741 - RNA, 64 nt, hsa; identical to SEQ ID NO: 172919

SEQ ID NO: 364742 - RNA, 64 nt, hsa; identical to SEQ ID NO: 172920

SEQ ID NO: 364743 - RNA, 64 nt, hsa; identical to SEQ ID NO: 172921

SEQ ID NO: 364744 - RNA, 64 nt, hsa; identical to SEQ ID NO: 172922

SEQ ID NO: 364745 - RNA, 64 nt, hsa; identical to SEQ ID NO: 172923

SEQ ID NO: 364746 - RNA, 64 nt, hsa; identical to SEQ ID NO: 172924

SEQ ID NO: 364747 - RNA, 64 nt, hsa; identical to SEQ ID NO: 172925

SEQ ID NO: 364748 - RNA, 64 nt, hsa; identical to SEQ ID NO: 172926

SEQ ID NO: 364749 - RNA, 64 nt, hsa; identical to SEQ ID NO: 172927

SEQ ID NO: 364750 - RNA, 64 nt, hsa; identical to SEQ ID NO: 172928

SEQ ID NO: 364751 - RNA, 64 nt, hsa; identical to SEQ ID NO: 172929

SEQ ID NO: 364752 - RNA, 64 nt, hsa; identical to SEQ ID NO: 172930

SEQ ID NO: 364753 - RNA, 64 nt, hsa; identical to SEQ ID NO: 172931

SEQ ID NO: 364754 - RNA, 64 nt, hsa; identical to SEQ ID NO: 172932

SEQ ID NO: 364755 - RNA, 64 nt, hsa; identical to SEQ ID NO: 172933

SEQ ID NO: 364756 - RNA, 64 nt, hsa; identical to SEQ ID NO: 172934

SEQ ID NO: 364757 - RNA, 64 nt, hsa; identical to SEQ ID NO: 172935

SEQ ID NO: 364758 - RNA, 64 nt, hsa; identical to SEQ ID NO: 172936

SEQ ID NO: 364759 - RNA, 64 nt, hsa; identical to SEQ ID NO: 172937

SEQ ID NO: 364760 - RNA, 64 nt, hsa; identical to SEQ ID NO: 172938

SEQ ID NO: 364761 - RNA, 64 nt, hsa; identical to SEQ ID NO: 172939

SEQ ID NO: 364762 - RNA, 64 nt, hsa; identical to SEQ ID NO: 172940

SEQ ID NO: 364763 - RNA, 64 nt, hsa; identical to SEQ ID NO: 172941

SEQ ID NO: 364764 - RNA, 64 nt, hsa; identical to SEQ ID NO: 172942

SEQ ID NO: 364765 - RNA, 64 nt, hsa; identical to SEQ ID NO: 172943

SEQ ID NO: 364766 - RNA, 64 nt, hsa; identical to SEQ ID NO: 172944

SEQ ID NO: 364767 - RNA, 64 nt, hsa; identical to SEQ ID NO: 172945

SEQ ID NO: 364768 - RNA, 64 nt, hsa; identical to SEQ ID NO: 172946

SEQ ID NO: 364769 - RNA, 64 nt, hsa; identical to SEQ ID NO: 172947

SEQ ID NO: 364770 - RNA, 64 nt, hsa; identical to SEQ ID NO: 172948

SEQ ID NO: 364771 - RNA, 64 nt, hsa; identical to SEQ ID NO: 172949

SEQ ID NO: 364772 - RNA, 64 nt, hsa; identical to SEQ ID NO: 172950

SEQ ID NO: 364773 - RNA, 64 nt, hsa; identical to SEQ ID NO: 172951

SEQ ID NO: 364774 - RNA, 64 nt, hsa; identical to SEQ ID NO: 172952

SEQ ID NO: 364775 - RNA, 64 nt, hsa; identical to SEQ ID NO: 172953

SEQ ID NO: 364776 - RNA, 64 nt, hsa; identical to SEQ ID NO: 172954

SEQ ID NO: 364777 - RNA, 64 nt, hsa; identical to SEQ ID NO: 172955

SEQ ID NO: 364778 - RNA, 64 nt, hsa; identical to SEQ ID NO: 172956

SEQ ID NO: 364779 - RNA, 64 nt, hsa; identical to SEQ ID NO: 172957

SEQ ID NO: 364780 - RNA, 64 nt, hsa; identical to SEQ ID NO: 172958

SEQ ID NO: 364781 - RNA, 64 nt, hsa; identical to SEQ ID NO: 172959

SEQ ID NO: 364782 - RNA, 64 nt, hsa
auacauuauaauguaauauauaaacuaaaauuuauggcacaaaagauaaauauggcuuugaaau

SEQ ID NO: 364783 - RNA, 64 nt, hsa
uuaaggggauagacuagacugccacagcagcccauggcacaacuaacaccuacugauauucaca

SEQ ID NO: 364784 - RNA, 64 nt, hsa
auuaguguauuucuccugugcuugccuucugaaguggcacaaaccuguguuuauauauuuaaaa

SEQ ID NO: 364785 - RNA, 64 nt, hsa
aauucuggggcaaauccauggaaauuguuccaauuggcacaacccaugugacucugccagugua

SEQ ID NO: 364786 - RNA, 64 nt, hsa
cuacaaggcuacaguaaccaaaacagcauaguacuggcacaaaaacacacguagacugauggaa

SEQ ID NO: 364787 - RNA, 64 nt, hsa
gucuuacucugucucccaggcugcuggagugcaguggcacaaucucggcccgcugcagccucug

SEQ ID NO: 364788 - RNA, 64 nt, hsa
agagucuugcucugucucccaggcuggagugcaguggcacaaucauggcucacugcagccuuga

SEQ ID NO: 364789 - RNA, 64 nt, hsa
caggcucaggcuagaccugaaggccagagccacguggcacaauugcuggccccaggaaugggca

SEQ ID NO: 364790 - RNA, 64 nt, hsa
uuccccugaggggcacgggcuggaggaggaggcauggcacaagugacccuggcuaaggagggag

SEQ ID NO: 364791 - RNA, 64 nt, hsa
agccuuagagcucuuguguucagaagaaucuuccuggcacaauguuggagcagcaggccucugg

SEQ ID NO: 364792 - RNA, 64 nt, hsa
ucucugccaguuacuugggcuucaacagccaagcuggcacaaaagacagcuggcggaggcugcu

SEQ ID NO: 364793 - RNA, 64 nt, hsa
agccuaugaaugccuucuuaaaaucauguuuuuaaaugcauaaaauauauaggauuacaaagga

SEQ ID NO: 364794 - RNA, 64 nt, hsa
caacacauauuuuuauauuauguuaaaguaaagaaaugcauaaaagacaagcacuuuggaagaa

SEQ ID NO: 364795 - RNA, 64 nt, hsa
ccuuucucacuuuuggaaggugacuuuucaccuuaaugcauauuccccucuccauagaggagag

SEQ ID NO: 364796 - RNA, 64 nt, hsa
ccuuuggaaacaacauuuaagggaaugugagcacaaugcauaaugucuuuaaaaagcauguugu

SEQ ID NO: 364797 - RNA, 64 nt, hsa
ucuggguaucucuccuaugggcaaagccauuagaaaugcauaaaaccucgagacaugguuuuug

SEQ ID NO: 364798 - RNA, 64 nt, hsa
guauuuucuuaauuugaauaauaaaaccagaggaaaugcauacagggcaugagcaacugaggca

SEQ ID NO: 364799 - RNA, 64 nt, hsa
caugaacugaugguaacuguacauuuugugcuaaaaugcauauuuauauguguauaccauaugu

SEQ ID NO: 364800 - RNA, 64 nt, hsa
uaucuuuuuauaauuuuuuuuccuaagauaaacaaaugcauaguuuucuucuaugggugauaga

SEQ ID NO: 364801 - RNA, 64 nt, hsa
aaaagcuaaucccuaaaauaguuagaucuuuguaaaugcauauuaaauaauaaaguaugaccca

SEQ ID NO: 364802 - RNA, 64 nt, hsa
cauauucaauguauugagaaccaaagcaaccacaaaugcauaaaugcauaauuuauggucuuca

SEQ ID NO: 364803 - RNA, 64 nt, hsa
auguauugagaaccaaagcaaccacaaaugcauaaaugcauaauuuauggucuucaaccaaggc

SEQ ID NO: 364804 - RNA, 64 nt, hsa
aagccaauuaucugauuaagcauucuuuccacugaaugcauaauguuuaaauagcauaaaauga

SEQ ID NO: 364805 - RNA, 64 nt, hsa
aagauaauaaugauggucaacaauaagccacgucaaugcauaaguuguauaggcuaaauguugc

SEQ ID NO: 364806 - RNA, 64 nt, hsa
ucaacuuaacaaacacuuacguucuccuuuauaaaaugcauaguaaaccacuaacguuagcugu

SEQ ID NO: 364807 - RNA, 64 nt, hsa
ggacuagaauucugacuuugaaacuuauuaaauuaaugcauacuggaaguacuuugauacucaa

SEQ ID NO: 364808 - RNA, 64 nt, hsa
aauuuuuaauggaaagagcauguuagagcaaacaaaugcauaagcaagacugagcagcauuaua

SEQ ID NO: 364809 - RNA, 64 nt, hsa
acagauaacacuguaguuccuaaaaaaaaaauuaaaugcauaagcauaagguagaaauuaaaau

SEQ ID NO: 364810 - RNA, 64 nt, hsa
cuagaaguuaacucuuaauucuaagcuaucuuaaaaugcauauauauacuucuugcauggaaga

SEQ ID NO: 364811 - RNA, 64 nt, hsa
auccuuacucauacacuuguugggagggauguacaaugcauauucccaaacuguggaaaggaca

SEQ ID NO: 364812 - RNA, 64 nt, hsa
uuuuaaaaguauguuuuggaaaaucaaugauuuuaaugcauagcaguauguuugaaaaauagac

SEQ ID NO: 364813 - RNA, 64 nt, hsa
uuugaucaucugaaaaaacauuucagugggaagaaaugcauaaaaugccuauaagaaguagaaa

SEQ ID NO: 364814 - RNA, 64 nt, hsa
guacaucaacuauuuucagcccaaaaaggugccaaaugcauauaaaucuugauaaacaaagucu

SEQ ID NO: 364815 - RNA, 64 nt, hsa
acacauuaugugugauguacuuaaaggaauaauaaaugcauaauaugaggucaguggacgccau

SEQ ID NO: 364816 - RNA, 64 nt, hsa
aggauuacuggcgugagccaccacuccuagccuuaaugcauauucuuaaauauacaaagguaga

SEQ ID NO: 364817 - RNA, 64 nt, hsa
auuuuuguaauuggagguuuauauugucuugccuaaugcauauucucuuuuuuuuuuuuuuuuu

SEQ ID NO: 364818 - RNA, 64 nt, hsa
guuccuccauggaccagaguaauuggcacauuuuaaugcauaagcuggggguuucauuuuccca

SEQ ID NO: 364819 - RNA, 64 nt, hsa
cauuguugauaauuuccuuguuagugguauuuggaaugcauauagauugucuugucauugugcu

SEQ ID NO: 364820 - RNA, 64 nt, hsa
uguacagugcacgggcuaugagauagcaacaaaaaaugcauaguuaauggucauagacuuuauu

SEQ ID NO: 364821 - RNA, 64 nt, hsa
agguaaacuugaauauucccaguaaauguuugagaaugcauaaaauuauaccaauuuaaaaaua

SEQ ID NO: 364822 - RNA, 64 nt, hsa
acacagcaaugaauggcacacaaguaauccacauaaugcauaagccacaccaaaaccagacuca

SEQ ID NO: 364823 - RNA, 64 nt, hsa
caaccuuucucccuucucaaaaugcuugccucauaaugcauaacuuucacuuugacucuggucu

SEQ ID NO: 364824 - RNA, 64 nt, hsa
ucuguauauaugggaccuacugcuucucugaggaaaugcauaaucuguuaauaucagacaaaau

SEQ ID NO: 364825 - RNA, 64 nt, hsa
cuuaugccuuuacucuuacauggaauaaauucccaaugcauauccuauguaaaccauaagugaa

SEQ ID NO: 364826 - RNA, 64 nt, hsa
uuuucacuccauacucagauaugcuucauugucaaaugcauauuuagauuagauuauugaauug

SEQ ID NO: 364827 - RNA, 64 nt, hsa
uuuuuccugauauguagagcagucuguuggcaaaaaugcauauauuuucuuucauauuuguaaa

SEQ ID NO: 364828 - RNA, 64 nt, hsa
cauggggaugcuuuagggugagucuauaguacaaaaugcauaaaccauguccccaggaaauuug

SEQ ID NO: 364829 - RNA, 64 nt, hsa
auaaggcgauauuggugaugaaagucuuaggaaaaaugcauaauuuugcuauaaaauguacuua

SEQ ID NO: 364830 - RNA, 50 nt, hsa
auuugccugacauuuauuaaaaugcauacaagucaggguguuuggcuaau

SEQ ID NO: 364831 - RNA, 64 nt, hsa
uaaaauauuucaaagucauagaaauaguuugagaaaugcauagcauuauuuaacacuauugaac

SEQ ID NO: 364832 - RNA, 64 nt, hsa
acauauuuugguucuucuaucucaaauuauuuaaaaugcauaauucacauuuuuguaauaauuc

SEQ ID NO: 364833 - RNA, 64 nt, hsa
cuagugagagcugugaucuuugccccacccgaauaaugcauauggacaccacaccuugccugcc

SEQ ID NO: 364834 - RNA, 64 nt, hsa
gcugagauggaggagaaaaaaaugcccccuucagaaugcauaccaaggggaaggugcucgguca

SEQ ID NO: 364835 - RNA, 64 nt, hsa; identical to SEQ ID NO: 189259

SEQ ID NO: 364836 - RNA, 64 nt, hsa; identical to SEQ ID NO: 189260

SEQ ID NO: 364837 - RNA, 64 nt, hsa; identical to SEQ ID NO: 189261

SEQ ID NO: 364838 - RNA, 64 nt, hsa; identical to SEQ ID NO: 189262

SEQ ID NO: 364839 - RNA, 56 nt, hsa; identical to SEQ ID NO: 189263

SEQ ID NO: 364840 - RNA, 64 nt, hsa; identical to SEQ ID NO: 189264

SEQ ID NO: 364841 - RNA, 64 nt, hsa; identical to SEQ ID NO: 189265

SEQ ID NO: 364842 - RNA, 64 nt, hsa; identical to SEQ ID NO: 189266

SEQ ID NO: 364843 - RNA, 64 nt, hsa; identical to SEQ ID NO: 189267

SEQ ID NO: 364844 - RNA, 64 nt, hsa; identical to SEQ ID NO: 189268

SEQ ID NO: 364845 - RNA, 64 nt, hsa; identical to SEQ ID NO: 189269

SEQ ID NO: 364846 - RNA, 64 nt, hsa; identical to SEQ ID NO: 189270

SEQ ID NO: 364847 - RNA, 64 nt, hsa; identical to SEQ ID NO: 189271

SEQ ID NO: 364848 - RNA, 64 nt, hsa; identical to SEQ ID NO: 189272

SEQ ID NO: 364849 - RNA, 64 nt, hsa; identical to SEQ ID NO: 189273

SEQ ID NO: 364850 - RNA, 64 nt, hsa; identical to SEQ ID NO: 189274

SEQ ID NO: 364851 - RNA, 64 nt, hsa; identical to SEQ ID NO: 189275

SEQ ID NO: 364852 - RNA, 64 nt, hsa; identical to SEQ ID NO: 189276

SEQ ID NO: 364853 - RNA, 64 nt, hsa; identical to SEQ ID NO: 189277

SEQ ID NO: 364854 - RNA, 64 nt, hsa; identical to SEQ ID NO: 189278

SEQ ID NO: 364855 - RNA, 64 nt, hsa; identical to SEQ ID NO: 189279

SEQ ID NO: 364856 - RNA, 64 nt, hsa; identical to SEQ ID NO: 189280

SEQ ID NO: 364857 - RNA, 60 nt, hsa
gcagccuggagaagcccuaggggggcgacccgcggagaccccagcagaggucgcagccca

SEQ ID NO: 364858 - RNA, 64 nt, hsa
cuggccagugugccacauuaaauacccgugcaggcgcggagaagcaaccggcacccccuuccgg

SEQ ID NO: 364859 - RNA, 64 nt, hsa
uccugggcgcgccccgccgcgggcccuugaggcgcgcggagacaccagcgcuggcuucccgggc

SEQ ID NO: 364860 - RNA, 64 nt, hsa
ggugccugugguuugcacccaccacugaaaaagccgcggagaugcgcagcgcguacacugacuu

SEQ ID NO: 364861 - RNA, 64 nt, hsa
gagccucuuuuugcaaauaaaguuggugcagcuucgcggagaggagaggcgcugcagucugugc

SEQ ID NO: 364862 - RNA, 64 nt, hsa
cggcggugugcuggugggugccgucggcuccaugcgcggagagucuggcuacucucucguuucc

SEQ ID NO: 364863 - RNA, 64 nt, hsa
guuggggguuggguggggcuggacggggacgaggcgcggagaggcggcgggaaagagcuucggc

SEQ ID NO: 364864 - RNA, 64 nt, hsa
aguuuauacuuagaacugaccaccuccccggccacgcggagagcuguacaguguguaaaucugc

SEQ ID NO: 364865 - RNA, 64 nt, hsa
agaccggcugcgugauccagccugugccaaaacccgcggagaaggcugccauggcaccgugcau

SEQ ID NO: 364866 - RNA, 64 nt, hsa
caaaaucaacaucaggaacccagcuucagggcaucgcggagacgcgucagauggcagauuugga

SEQ ID NO: 364867 - RNA, 64 nt, hsa
ggguucugagaacauuucacagaagugccugagacgcggagacauggcugguguuaaauggagc

SEQ ID NO: 364868 - RNA, 64 nt, hsa
guucacacgcggggucgguuuaauggaguguccacgcggagauaacugcgauauuggaacaccu

SEQ ID NO: 364869 - RNA, 64 nt, hsa
auggguuucugcucucuagauggagcuuugggaacgcggagaacagugggguuacagggaguca

SEQ ID NO: 364870 - RNA, 64 nt, hsa
cugccugcgcgccgccgacagucagcgcugugcgcgcggagagaggugcgccgugggcucaaga

SEQ ID NO: 364871 - RNA, 64 nt, hsa
ccauggcccucugccacugacccaccgccaccuccgcggagaaacugcacuuugcaauggggcc

SEQ ID NO: 364872 - RNA, 64 nt, hsa
agcugagcuaguugccuggcacccaccugucgcgcgcggagaggggguucccuguugcuuuugu

SEQ ID NO: 364873 - RNA, 64 nt, hsa
cccagaagucucagaggcaccucacgccagccaucgcggagagcucagagggccguccccaccc

SEQ ID NO: 364874 - RNA, 64 nt, hsa
ucagugcaccugccucagcuaccuaaugauuccgcgcggagaccuccugacaacgucucuucaa

SEQ ID NO: 364875 - RNA, 64 nt, hsa
cgcacauuccguugccuuacccgauggcuugugacgcggagagaaccgauuaaaaccguuugag

SEQ ID NO: 364876 - RNA, 64 nt, hsa
agcucugugugagcggugagggguggagggaugucgcggagaggggaagggggaaacugaccaa

SEQ ID NO: 364877 - RNA, 64 nt, hsa
ggcucgggcgucuccucgguuuccuugccucacccgcggagagcgcugaaccuggacaagcagc

SEQ ID NO: 364878 - RNA, 64 nt, hsa
cgagcgagcagccuauggagguggagcuguggcccgcggagaagcagucaucaucauccaugga

SEQ ID NO: 364879 - RNA, 64 nt, hsa
uacaccauuuauauaccuacacgcacgcaagagacgcggagagauaggcgaugcagacucgcga

SEQ ID NO: 364880 - RNA, 64 nt, hsa
cgcgccucacgaucccucacccagagcacacggccgcggagaugacgucacgcaagcaacggcg

SEQ ID NO: 364881 - RNA, 64 nt, hsa
cacagcagaaaccaacuuuucuaacgacugaguucgcggagauagcaucaucccugaucaagga

SEQ ID NO: 364882 - RNA, 64 nt, hsa
cagagccggcccugaggacaguccugcccauccacgcggagauguggcugccgcguuugcauga

SEQ ID NO: 364883 - RNA, 64 nt, hsa
ccuguuuccuugucauuugacccucgucugugcccgcggagaccuccucugaccaaggggcacu

SEQ ID NO: 364884 - RNA, 64 nt, hsa
cagggcacaugccuggccggcugggguccccacccgcggagacgguccuagacccaguggggag

SEQ ID NO: 364885 - RNA, 64 nt, hsa
cacggcucugcaggaucagggcucgggcaggccccgcggagaugaagaauuugcagggagccuc

SEQ ID NO: 364886 - RNA, 64 nt, hsa
ccgggaccguccacgcacgacccagccagacccucgcggagauggugcagaaggcggagcgggu

SEQ ID NO: 364887 - RNA, 64 nt, hsa; identical to SEQ ID NO: 47807

SEQ ID NO: 364888 - RNA, 64 nt, hsa; identical to SEQ ID NO: 47808

SEQ ID NO: 364889 - RNA, 64 nt, hsa; identical to SEQ ID NO: 47809

SEQ ID NO: 364890 - RNA, 64 nt, hsa; identical to SEQ ID NO: 47810

SEQ ID NO: 364891 - RNA, 64 nt, hsa; identical to SEQ ID NO: 47811

SEQ ID NO: 364892 - RNA, 64 nt, hsa; identical to SEQ ID NO: 47812

SEQ ID NO: 364893 - RNA, 64 nt, hsa; identical to SEQ ID NO: 47813

SEQ ID NO: 364894 - RNA, 64 nt, hsa; identical to SEQ ID NO: 47814

SEQ ID NO: 364895 - RNA, 64 nt, hsa; identical to SEQ ID NO: 47815

SEQ ID NO: 364896 - RNA, 64 nt, hsa; identical to SEQ ID NO: 47816

SEQ ID NO: 364897 - RNA, 64 nt, hsa; identical to SEQ ID NO: 47817

SEQ ID NO: 364898 - RNA, 64 nt, hsa; identical to SEQ ID NO: 47818

SEQ ID NO: 364899 - RNA, 64 nt, hsa; identical to SEQ ID NO: 47819

SEQ ID NO: 364900 - RNA, 64 nt, hsa; identical to SEQ ID NO: 47820

SEQ ID NO: 364901 - RNA, 64 nt, hsa; identical to SEQ ID NO: 47821

SEQ ID NO: 364902 - RNA, 64 nt, hsa; identical to SEQ ID NO: 47822

SEQ ID NO: 364903 - RNA, 64 nt, hsa; identical to SEQ ID NO: 47823

SEQ ID NO: 364904 - RNA, 64 nt, hsa; identical to SEQ ID NO: 47824

SEQ ID NO: 364905 - RNA, 64 nt, hsa; identical to SEQ ID NO: 47825

SEQ ID NO: 364906 - RNA, 64 nt, hsa; identical to SEQ ID NO: 47826

SEQ ID NO: 364907 - RNA, 64 nt, hsa; identical to SEQ ID NO: 47827

SEQ ID NO: 364908 - RNA, 64 nt, hsa; identical to SEQ ID NO: 47828

SEQ ID NO: 364909 - RNA, 64 nt, hsa; identical to SEQ ID NO: 47829

SEQ ID NO: 364910 - RNA, 64 nt, hsa; identical to SEQ ID NO: 47830

SEQ ID NO: 364911 - RNA, 64 nt, hsa; identical to SEQ ID NO: 47831

SEQ ID NO: 364912 - RNA, 64 nt, hsa; identical to SEQ ID NO: 47832

SEQ ID NO: 364913 - RNA, 64 nt, hsa; identical to SEQ ID NO: 47833

SEQ ID NO: 364914 - RNA, 64 nt, hsa; identical to SEQ ID NO: 47834

SEQ ID NO: 364915 - RNA, 64 nt, hsa; identical to SEQ ID NO: 47835

SEQ ID NO: 364916 - RNA, 64 nt, hsa; identical to SEQ ID NO: 47836

SEQ ID NO: 364917 - RNA, 64 nt, hsa; identical to SEQ ID NO: 47837

SEQ ID NO: 364918 - RNA, 64 nt, hsa; identical to SEQ ID NO: 47838

SEQ ID NO: 364919 - RNA, 64 nt, hsa; identical to SEQ ID NO: 47839

SEQ ID NO: 364920 - RNA, 64 nt, hsa; identical to SEQ ID NO: 47840

SEQ ID NO: 364921 - RNA, 64 nt, hsa; identical to SEQ ID NO: 47841

SEQ ID NO: 364922 - RNA, 64 nt, hsa; identical to SEQ ID NO: 47842

SEQ ID NO: 364923 - RNA, 64 nt, hsa; identical to SEQ ID NO: 47843

SEQ ID NO: 364924 - RNA, 64 nt, hsa; identical to SEQ ID NO: 47844

SEQ ID NO: 364925 - RNA, 64 nt, hsa; identical to SEQ ID NO: 47845

SEQ ID NO: 364926 - RNA, 64 nt, hsa; identical to SEQ ID NO: 47846

SEQ ID NO: 364927 - RNA, 64 nt, hsa; identical to SEQ ID NO: 47847

SEQ ID NO: 364928 - RNA, 64 nt, hsa; identical to SEQ ID NO: 47848

SEQ ID NO: 364929 - RNA, 64 nt, hsa; identical to SEQ ID NO: 47849

SEQ ID NO: 364930 - RNA, 64 nt, hsa; identical to SEQ ID NO: 47850

SEQ ID NO: 364931 - RNA, 55 nt, hsa; identical to SEQ ID NO: 47851

SEQ ID NO: 364932 - RNA, 64 nt, hsa; identical to SEQ ID NO: 47852

SEQ ID NO: 364933 - RNA, 64 nt, hsa; identical to SEQ ID NO: 47853

SEQ ID NO: 364934 - RNA, 64 nt, hsa; identical to SEQ ID NO: 47854

SEQ ID NO: 364935 - RNA, 64 nt, hsa; identical to SEQ ID NO: 47855

SEQ ID NO: 364936 - RNA, 64 nt, hsa; identical to SEQ ID NO: 47856

SEQ ID NO: 364937 - RNA, 64 nt, hsa; identical to SEQ ID NO: 47857

SEQ ID NO: 364938 - RNA, 64 nt, hsa; identical to SEQ ID NO: 47858

SEQ ID NO: 364939 - RNA, 64 nt, hsa; identical to SEQ ID NO: 47859

SEQ ID NO: 364940 - RNA, 64 nt, hsa; identical to SEQ ID NO: 47860

SEQ ID NO: 364941 - RNA, 64 nt, hsa; identical to SEQ ID NO: 47861

SEQ ID NO: 364942 - RNA, 64 nt, hsa; identical to SEQ ID NO: 47862

SEQ ID NO: 364943 - RNA, 64 nt, hsa
gaaccacccuccccagaggcugcauugaggagacuccacagacugaaaagugaguuugcagaaa

SEQ ID NO: 364944 - RNA, 64 nt, hsa
ugggucgagcgccugagauccuguucaccaggacuccacagagcuggcucugcucagaagccau

SEQ ID NO: 364945 - RNA, 64 nt, hsa
uauguucuucuuuuuuauguaagggacagcuuucuccacagaguccuuucugcuggugaggaca

SEQ ID NO: 364946 - RNA, 64 nt, hsa
gagagaaugugcugucuaucuuccugguuuucaguccacagagucgguagaccagggguuacgu

SEQ ID NO: 364947 - RNA, 64 nt, hsa
uauaauuacauccuccaauguaccguuuccuuauuccacagauaucuuuuucauuauugugaag

SEQ ID NO: 364948 - RNA, 64 nt, hsa
cuuaucaacacuauaauuguucccuaugaaagauuccacagagauguuuauggugagguuuaaa

SEQ ID NO: 364949 - RNA, 64 nt, hsa
cccacugcuggcaggagaaggcccauuuucacaguccacagaagcguguuaggcugggguuggg

SEQ ID NO: 364950 - RNA, 64 nt, hsa
gaaccucggggacuugagccuucugcaggggauguccacagagagggaagggccgaggggagag

SEQ ID NO: 364951 - RNA, 64 nt, hsa
aaacauuugcaccacuuguggcuuuugaauaucuuccacagagggaaguuuaaaacccaaacuu

SEQ ID NO: 364952 - RNA, 64 nt, hsa
cuuugccagucucauuuucaucuucuuccaugguuccacagaagcuuuguuucuugggcaagca

SEQ ID NO: 364953 - RNA, 64 nt, hsa
aaaaugggcagagagagaugaccucggaagcauuuccacagauggugucaggguuucaagaagu

SEQ ID NO: 364954 - RNA, 64 nt, hsa
gaaaccauuuuuuuaaaaagugaauguacacaaauccacagaggacuguggcuggacauucauc

SEQ ID NO: 364955 - RNA, 64 nt, hsa
guccuaggccacugcagagggcagacugcuggucuccacagauaccugcuguucucagcuccag

SEQ ID NO: 364956 - RNA, 64 nt, hsa
cauccaugugugcaaaccaucugccccagcugccuccacagacugcugucuccuuguccuccuc

SEQ ID NO: 364957 - RNA, 64 nt, hsa
cagugcgccuucuagugcuccauccaccccucucuccacagacgcacccgaauuucuguccguu

SEQ ID NO: 364958 - RNA, 64 nt, hsa
uccaagugcaauuaauaauaacucauuuauaccuuccacagaauuuaauaaagauucuacuugu

SEQ ID NO: 364959 - RNA, 64 nt, hsa
gugcugugucccucucagaccccccaccugagucuccacagagccccacgccuggcauggcauu

SEQ ID NO: 364960 - RNA, 64 nt, hsa
gagucuccacagagccccacgccuggcauggcauuccacagaaaccauaaagguuggcugaguc

SEQ ID NO: 364961 - RNA, 64 nt, hsa
agacccuccuuagaaugccacagucccccaacccuccacagagcccccagacccaccagaacuu

SEQ ID NO: 364962 - RNA, 64 nt, hsa
aacccuccacagagcccccagacccaccagaacuuccacagacgcccccacuagcuacuccacg

SEQ ID NO: 364963 - RNA, 64 nt, hsa
gcccgcuccagagagccucagcccugccucccuuuccacagaggugguuuuauguggaacgagg

SEQ ID NO: 364964 - RNA, 64 nt, hsa
ggcaaagggaugggcaugagcgaaggcuccaggguccacagagcagggaguguggagaaggugg

SEQ ID NO: 364965 - RNA, 64 nt, hsa; identical to SEQ ID NO: 288888

SEQ ID NO: 364966 - RNA, 64 nt, hsa; identical to SEQ ID NO: 288889

SEQ ID NO: 364967 - RNA, 64 nt, hsa; identical to SEQ ID NO: 288890

SEQ ID NO: 364968 - RNA, 64 nt, hsa; identical to SEQ ID NO: 288891

SEQ ID NO: 364969 - RNA, 64 nt, hsa; identical to SEQ ID NO: 76570

SEQ ID NO: 364970 - RNA, 64 nt, hsa; identical to SEQ ID NO: 76571

SEQ ID NO: 364971 - RNA, 64 nt, hsa; identical to SEQ ID NO: 76572

SEQ ID NO: 364972 - RNA, 64 nt, hsa; identical to SEQ ID NO: 76573

SEQ ID NO: 364973 - RNA, 64 nt, hsa; identical to SEQ ID NO: 76574

SEQ ID NO: 364974 - RNA, 64 nt, hsa; identical to SEQ ID NO: 76575

SEQ ID NO: 364975 - RNA, 64 nt, hsa; identical to SEQ ID NO: 76576

SEQ ID NO: 364976 - RNA, 64 nt, hsa; identical to SEQ ID NO: 76577

SEQ ID NO: 364977 - RNA, 64 nt, hsa; identical to SEQ ID NO: 76578

SEQ ID NO: 364978 - RNA, 64 nt, hsa; identical to SEQ ID NO: 76579

SEQ ID NO: 364979 - RNA, 64 nt, hsa
augauuuuaagaggcuuuggcccaaugccuauaaaaugcccauuucgaagauauacaaaaacau

SEQ ID NO: 364980 - RNA, 64 nt, hsa
cacagagccugaauuuguaagcaacuugcuucuaaaugcccaguucacuucuuugcagagccuu

SEQ ID NO: 364981 - RNA, 64 nt, hsa
ggaccuguggauagacuuaguuuugacauaaaacaaugcccauucaccuccuccuucagcacaa

SEQ ID NO: 364982 - RNA, 64 nt, hsa
uagaauuaauucaaauucagaaucuguugugagaaaugcccaggcuuuaaaaauuaaaaaugga

SEQ ID NO: 364983 - RNA, 64 nt, hsa
ugacacuugcuuuguaugcucaguguguugugaaaguuuggaaggucagaccuuuuucuccaag

SEQ ID NO: 364984 - RNA, 64 nt, hsa
auaauaagugaaccaauuucaaaugugaucacaaaguuuggaaagcuuuuauucacagagguug

SEQ ID NO: 364985 - RNA, 64 nt, hsa
auuuauauauauuuuuuuguaauuauuauauucuaguuuggaguacuugcuguaggauucaagc

SEQ ID NO: 364986 - RNA, 64 nt, hsa
aaaaggcuuuuuaacccauuuuugaagagggugaaguuuggagaacaaauuuaaaaaccaucag

SEQ ID NO: 364987 - RNA, 64 nt, hsa
uuaucauaguaucuucucuucccucuuccccuuuaguuuggauagccuaacucugagaaguuaa

SEQ ID NO: 364988 - RNA, 64 nt, hsa
ucugauucuaccuguuaacuuuuaaaaagucguaaguuuggaugaaagugcaagauguggaaca

SEQ ID NO: 364989 - RNA, 64 nt, hsa
aaguaugauguugaagaaauucacauucucuuauaguuuggaugggaagacuauugacuauuuc

SEQ ID NO: 364990 - RNA, 64 nt, hsa
gcuguaguuauucauccuucuguacaaaaugaaaaguuuggaaauuguuugcccugauaccuug

SEQ ID NO: 364991 - RNA, 64 nt, hsa
uauuuuuccuuugguauuugcuacagugaaaagaaguuuggaaaguagauacauaaagacuuga

SEQ ID NO: 364992 - RNA, 64 nt, hsa
aagauaaauccaguuaucagcuuccugucucugaaguuuggaucauuuuauagauccacgcaau

SEQ ID NO: 364993 - RNA, 64 nt, hsa
ccugagaguggagugaggccagcaugcaggaaggaguuuggagagaguguuugcugugauccau

SEQ ID NO: 364994 - RNA, 64 nt, hsa
augaaaacagucuuuuuauagccuuuagcuugugaguuuggaaguuuggggggucuuauguuug

SEQ ID NO: 364995 - RNA, 64 nt, hsa
aaauacuugggacuggaaguguuuuugauuuuggaguuuggaauacuuuuuuuuuuuuggagau

SEQ ID NO: 364996 - RNA, 64 nt, hsa
uucgcucacgcagcagguaucugggugguugcagaguuuggagccauuuuggguagcugaucuu

SEQ ID NO: 364997 - RNA, 64 nt, hsa
gacuugauuuccccacgucauaaugaagaauggaaguuuggaucugcuccucgucaggcgcagc

SEQ ID NO: 364998 - RNA, 64 nt, hsa
uccuaguuacaugaggaugugauccaggaaauccaguuuggaggcuugauguggguuuugaccu

SEQ ID NO: 364999 - RNA, 64 nt, hsa
ccacagggccuccucuuuagcaggaauucacaacaguuuggaugcccuaaacuucuguagcuca

SEQ ID NO: 365000 - RNA, 64 nt, hsa
acauagcuugaaaauuuauuuuuauacugauauuaguuuggaugugccacuuuuggcaccaaac

SEQ ID NO: 365001 - RNA, 64 nt, hsa
gcagugucuuuucucagagagcagguuucuuuauaguuuggaaauaaaugguucacgguccacu

SEQ ID NO: 365002 - RNA, 64 nt, hsa
auuuccaaggcacagcagcuuucuaaagggacugaguuuggacuggguuuuggaccuccagggg

SEQ ID NO: 365003 - RNA, 64 nt, hsa
uugguuugcaaaaagagcacagcccuggacuacaaguuuggagauuuaaauucugaucuugagu

SEQ ID NO: 365004 - RNA, 64 nt, hsa
gacuacaaguuuggagauuuaaauucugaucuugaguuuggaacugacaaguugugugacccug

SEQ ID NO: 365005 - RNA, 64 nt, hsa; identical to SEQ ID NO: 284541

SEQ ID NO: 365006 - RNA, 64 nt, hsa; identical to SEQ ID NO: 284542

SEQ ID NO: 365007 - RNA, 64 nt, hsa; identical to SEQ ID NO: 284543

SEQ ID NO: 365008 - RNA, 64 nt, hsa; identical to SEQ ID NO: 284544

SEQ ID NO: 365009 - RNA, 64 nt, hsa; identical to SEQ ID NO: 284545

SEQ ID NO: 365010 - RNA, 64 nt, hsa; identical to SEQ ID NO: 284546

SEQ ID NO: 365011 - RNA, 64 nt, hsa; identical to SEQ ID NO: 284547

SEQ ID NO: 365012 - RNA, 64 nt, hsa; identical to SEQ ID NO: 284548

SEQ ID NO: 365013 - RNA, 64 nt, hsa; identical to SEQ ID NO: 284549

SEQ ID NO: 365014 - RNA, 64 nt, hsa; identical to SEQ ID NO: 284550

SEQ ID NO: 365015 - RNA, 64 nt, hsa; identical to SEQ ID NO: 284551

SEQ ID NO: 365016 - RNA, 64 nt, hsa; identical to SEQ ID NO: 284552

SEQ ID NO: 365017 - RNA, 64 nt, hsa; identical to SEQ ID NO: 284553

SEQ ID NO: 365018 - RNA, 64 nt, hsa; identical to SEQ ID NO: 284554

SEQ ID NO: 365019 - RNA, 64 nt, hsa; identical to SEQ ID NO: 284555

SEQ ID NO: 365020 - RNA, 64 nt, hsa; identical to SEQ ID NO: 284556

SEQ ID NO: 365021 - RNA, 64 nt, hsa; identical to SEQ ID NO: 284557

SEQ ID NO: 365022 - RNA, 64 nt, hsa; identical to SEQ ID NO: 284558

SEQ ID NO: 365023 - RNA, 64 nt, hsa; identical to SEQ ID NO: 284559

SEQ ID NO: 365024 - RNA, 64 nt, hsa; identical to SEQ ID NO: 284560

SEQ ID NO: 365025 - RNA, 64 nt, hsa; identical to SEQ ID NO: 284561

SEQ ID NO: 365026 - RNA, 64 nt, hsa; identical to SEQ ID NO: 284562

SEQ ID NO: 365027 - RNA, 64 nt, hsa; identical to SEQ ID NO: 284563

SEQ ID NO: 365028 - RNA, 64 nt, hsa; identical to SEQ ID NO: 284564

SEQ ID NO: 365029 - RNA, 64 nt, hsa; identical to SEQ ID NO: 284565

SEQ ID NO: 365030 - RNA, 64 nt, hsa; identical to SEQ ID NO: 284566

SEQ ID NO: 365031 - RNA, 64 nt, hsa; identical to SEQ ID NO: 284567

SEQ ID NO: 365032 - RNA, 64 nt, hsa; identical to SEQ ID NO: 284568

SEQ ID NO: 365033 - RNA, 64 nt, hsa; identical to SEQ ID NO: 284569

SEQ ID NO: 365034 - RNA, 64 nt, hsa; identical to SEQ ID NO: 284570

SEQ ID NO: 365035 - RNA, 59 nt, hsa; identical to SEQ ID NO: 284571

SEQ ID NO: 365036 - RNA, 64 nt, hsa; identical to SEQ ID NO: 284572

SEQ ID NO: 365037 - RNA, 64 nt, hsa; identical to SEQ ID NO: 284573

SEQ ID NO: 365038 - RNA, 64 nt, hsa; identical to SEQ ID NO: 284574

SEQ ID NO: 365039 - RNA, 64 nt, hsa; identical to SEQ ID NO: 284575

SEQ ID NO: 365040 - RNA, 64 nt, hsa; identical to SEQ ID NO: 284576

SEQ ID NO: 365041 - RNA, 64 nt, hsa; identical to SEQ ID NO: 284577

SEQ ID NO: 365042 - RNA, 64 nt, hsa; identical to SEQ ID NO: 284578

SEQ ID NO: 365043 - RNA, 64 nt, hsa; identical to SEQ ID NO: 284579

SEQ ID NO: 365044 - RNA, 64 nt, hsa; identical to SEQ ID NO: 284580

SEQ ID NO: 365045 - RNA, 64 nt, hsa; identical to SEQ ID NO: 284581

SEQ ID NO: 365046 - RNA, 64 nt, hsa; identical to SEQ ID NO: 284582

SEQ ID NO: 365047 - RNA, 64 nt, hsa; identical to SEQ ID NO: 284583

SEQ ID NO: 365048 - RNA, 56 nt, hsa; identical to SEQ ID NO: 284584

SEQ ID NO: 365049 - RNA, 64 nt, hsa; identical to SEQ ID NO: 284585

SEQ ID NO: 365050 - RNA, 64 nt, hsa; identical to SEQ ID NO: 284586

SEQ ID NO: 365051 - RNA, 64 nt, hsa; identical to SEQ ID NO: 284587

SEQ ID NO: 365052 - RNA, 64 nt, hsa; identical to SEQ ID NO: 284588

SEQ ID NO: 365053 - RNA, 64 nt, hsa; identical to SEQ ID NO: 284589

SEQ ID NO: 365054 - RNA, 64 nt, hsa; identical to SEQ ID NO: 284590

SEQ ID NO: 365055 - RNA, 64 nt, hsa; identical to SEQ ID NO: 284591

SEQ ID NO: 365056 - RNA, 64 nt, hsa; identical to SEQ ID NO: 284592

SEQ ID NO: 365057 - RNA, 64 nt, hsa; identical to SEQ ID NO: 284593

SEQ ID NO: 365058 - RNA, 64 nt, hsa; identical to SEQ ID NO: 284594

SEQ ID NO: 365059 - RNA, 64 nt, hsa; identical to SEQ ID NO: 284595

SEQ ID NO: 365060 - RNA, 64 nt, hsa; identical to SEQ ID NO: 284596

SEQ ID NO: 365061 - RNA, 64 nt, hsa; identical to SEQ ID NO: 284597

SEQ ID NO: 365062 - RNA, 64 nt, hsa; identical to SEQ ID NO: 284598

SEQ ID NO: 365063 - RNA, 64 nt, hsa; identical to SEQ ID NO: 284599

SEQ ID NO: 365064 - RNA, 64 nt, hsa; identical to SEQ ID NO: 284600

SEQ ID NO: 365065 - RNA, 64 nt, hsa; identical to SEQ ID NO: 284601

SEQ ID NO: 365066 - RNA, 64 nt, hsa; identical to SEQ ID NO: 284602

SEQ ID NO: 365067 - RNA, 64 nt, hsa; identical to SEQ ID NO: 284603

SEQ ID NO: 365068 - RNA, 64 nt, hsa; identical to SEQ ID NO: 284604

SEQ ID NO: 365069 - RNA, 64 nt, hsa; identical to SEQ ID NO: 284605

SEQ ID NO: 365070 - RNA, 64 nt, hsa
agguucuuuacaagaugauaccuuaauuacacucccgcaacacagccauuauuuuauugucuag

SEQ ID NO: 365071 - RNA, 64 nt, hsa
cgucuuaguuuauuuaaacgcuuaacaucuuccaccgcaacagcuugccucuagagggggaauu

SEQ ID NO: 365072 - RNA, 64 nt, hsa
uugccuacuaugccagaugccuuuauggcugaaaccgcaacacccaucaccacuucaauagauc

SEQ ID NO: 365073 - RNA, 64 nt, hsa
acauugaccauuuuuuuuaaugugcaugaauucaccgcaacacaugcagacaacugcugcaaug

SEQ ID NO: 365074 - RNA, 64 nt, hsa
acuguuaguguaacgugccaguggaguggaaagaccgcaacaccugaauccuggguuuuguaau

SEQ ID NO: 365075 - RNA, 64 nt, hsa
ucuccugccacaaccgcauuggaagaaaaggcugccgcaacaucucagcgaggagugaaggacc

SEQ ID NO: 365076 - RNA, 64 nt, hsa
ucaaaauggagggaauaauaccuaagccuuccugccgcaacaguuuuuuaugcuaaucagggag

SEQ ID NO: 365077 - RNA, 64 nt, hsa
gaucugccauuuguucucagagauggccuggcuuccgcaacacauuuccgggugugcccagagg

SEQ ID NO: 365078 - RNA, 64 nt, hsa
acagacuggggacccuggacaugcgggccuuucuccgcaacagccaaguggaacgaauguaagu

SEQ ID NO: 365079 - RNA, 64 nt, hsa
ucugaauacuuucuguuucaaggcacugauaaaaccgcaacaaaaacauguaagaaauaaaaua

SEQ ID NO: 365080 - RNA, 64 nt, hsa
ugucuaacuguaugucaaccccagaggcccuucaccgcaacaacuugguaggaaagauucaucc

SEQ ID NO: 365081 - RNA, 64 nt, hsa
ugccaaaaagaaguaggaagcuggcgugugaaaaccgcaacaaagccccaaaggcucuuuucag

SEQ ID NO: 365082 - RNA, 64 nt, hsa
cauaaucaggcuccagccagaaaaauaagaaacaccgcaacaggcuucaguaucagggcugaaa

SEQ ID NO: 365083 - RNA, 64 nt, hsa
ucucccugucaauggccucgugucccccccuaccccgcaacacccacaucaccuccccaccacc

SEQ ID NO: 365084 - RNA, 64 nt, hsa
cuucacucuccaggguacaugcuuuaaaaccgacccgcaacaaguauuggaaaaauguauccag

SEQ ID NO: 365085 - RNA, 64 nt, hsa
aguggcugcgguguuuggcaaugcuaauucaaugccgcaacauauaguugaggccgaggauaaa

SEQ ID NO: 365086 - RNA, 64 nt, hsa
gaacacggcuggccacuggguauacugcugacaaccgcaacaacaaaaacacaaauccuuggca

SEQ ID NO: 365087 - RNA, 64 nt, hsa
guccagugaauccacgacccgcagaccuguccccccgcaacagcuuauaccauggaaugaggac

SEQ ID NO: 365088 - RNA, 64 nt, hsa
uguccgaggucugcgagggcuucgacgaggagggccgcaacauuagcaagacccgcggguggca

SEQ ID NO: 365089 - RNA, 64 nt, hsa
gugagccggagcucaugccgaccuuuccccaccaccgcaacaagcgggccgccccagccaccuc

SEQ ID NO: 365090 - RNA, 64 nt, hsa
cuucucccgugugucgccgccgugcgucgugcgcccgcaacagagccccaaccgggccuuugcc

SEQ ID NO: 365091 - RNA, 64 nt, hsa
uuucaacauugcaacaacaguaacaacaagacaaccgcaacaugugggcguagucaggcaaugc

SEQ ID NO: 365092 - RNA, 64 nt, hsa
uaccuggcaaagaaaguaaaauuguuuuuucuguccgcaacacuggcucccgagcagcuuuugu

SEQ ID NO: 365093 - RNA, 64 nt, hsa
guagccccggccugggucaucaggcacagaggcaccgcaacaccaccugcggcaacuccagacc

SEQ ID NO: 365094 - RNA, 64 nt, hsa
uuuuacagauucaacuguguugaaaucaaaccugccgcaacagaaauuguuuuuauuucaugua

SEQ ID NO: 365095 - RNA, 64 nt, hsa
uggauagacggagcuguggugcagagaacuuuucccgcaacaggugcaggacugccagggaucg

SEQ ID NO: 365096 - RNA, 64 nt, hsa
uuuucuccuguuccagcuguaucagauacucguuccgcaacacagaaaugacucagaaucucag

SEQ ID NO: 365097 - RNA, 64 nt, hsa; identical to SEQ ID NO: 170678

SEQ ID NO: 365098 - RNA, 60 nt, hsa; identical to SEQ ID NO: 170679

SEQ ID NO: 365099 - RNA, 64 nt, hsa; identical to SEQ ID NO: 170680

SEQ ID NO: 365100 - RNA, 64 nt, hsa; identical to SEQ ID NO: 170681

SEQ ID NO: 365101 - RNA, 64 nt, hsa; identical to SEQ ID NO: 170682

SEQ ID NO: 365102 - RNA, 64 nt, hsa; identical to SEQ ID NO: 170683

SEQ ID NO: 365103 - RNA, 64 nt, hsa; identical to SEQ ID NO: 170684

SEQ ID NO: 365104 - RNA, 64 nt, hsa; identical to SEQ ID NO: 170685

SEQ ID NO: 365105 - RNA, 64 nt, hsa; identical to SEQ ID NO: 170686

SEQ ID NO: 365106 - RNA, 64 nt, hsa; identical to SEQ ID NO: 170687

SEQ ID NO: 365107 - RNA, 64 nt, hsa; identical to SEQ ID NO: 170688

SEQ ID NO: 365108 - RNA, 64 nt, hsa; identical to SEQ ID NO: 170689

SEQ ID NO: 365109 - RNA, 64 nt, hsa; identical to SEQ ID NO: 170690

SEQ ID NO: 365110 - RNA, 64 nt, hsa; identical to SEQ ID NO: 170691

SEQ ID NO: 365111 - RNA, 64 nt, hsa; identical to SEQ ID NO: 170692

SEQ ID NO: 365112 - RNA, 64 nt, hsa; identical to SEQ ID NO: 170693

SEQ ID NO: 365113 - RNA, 64 nt, hsa; identical to SEQ ID NO: 170694

SEQ ID NO: 365114 - RNA, 64 nt, hsa; identical to SEQ ID NO: 170695

SEQ ID NO: 365115 - RNA, 64 nt, hsa; identical to SEQ ID NO: 170696

SEQ ID NO: 365116 - RNA, 64 nt, hsa; identical to SEQ ID NO: 170697

SEQ ID NO: 365117 - RNA, 64 nt, hsa; identical to SEQ ID NO: 170698

SEQ ID NO: 365118 - RNA, 64 nt, hsa; identical to SEQ ID NO: 170699

SEQ ID NO: 365119 - RNA, 64 nt, hsa; identical to SEQ ID NO: 170700

SEQ ID NO: 365120 - RNA, 64 nt, hsa; identical to SEQ ID NO: 170701

SEQ ID NO: 365121 - RNA, 64 nt, hsa; identical to SEQ ID NO: 170702

SEQ ID NO: 365122 - RNA, 64 nt, hsa; identical to SEQ ID NO: 170703

SEQ ID NO: 365123 - RNA, 64 nt, hsa; identical to SEQ ID NO: 170704

SEQ ID NO: 365124 - RNA, 64 nt, hsa; identical to SEQ ID NO: 170705

SEQ ID NO: 365125 - RNA, 64 nt, hsa; identical to SEQ ID NO: 170706

SEQ ID NO: 365126 - RNA, 64 nt, hsa; identical to SEQ ID NO: 170707

SEQ ID NO: 365127 - RNA, 64 nt, hsa; identical to SEQ ID NO: 170708

SEQ ID NO: 365128 - RNA, 64 nt, hsa; identical to SEQ ID NO: 170709

SEQ ID NO: 365129 - RNA, 64 nt, hsa; identical to SEQ ID NO: 170710

SEQ ID NO: 365130 - RNA, 64 nt, hsa; identical to SEQ ID NO: 170711

SEQ ID NO: 365131 - RNA, 64 nt, hsa; identical to SEQ ID NO: 170712

SEQ ID NO: 365132 - RNA, 64 nt, hsa; identical to SEQ ID NO: 170713

SEQ ID NO: 365133 - RNA, 64 nt, hsa; identical to SEQ ID NO: 170714

SEQ ID NO: 365134 - RNA, 64 nt, hsa; identical to SEQ ID NO: 170715

SEQ ID NO: 365135 - RNA, 50 nt, hsa; identical to SEQ ID NO: 170716

SEQ ID NO: 365136 - RNA, 64 nt, hsa; identical to SEQ ID NO: 170717

SEQ ID NO: 365137 - RNA, 64 nt, hsa; identical to SEQ ID NO: 170718

SEQ ID NO: 365138 - RNA, 64 nt, hsa; identical to SEQ ID NO: 170719

SEQ ID NO: 365139 - RNA, 64 nt, hsa; identical to SEQ ID NO: 170720

SEQ ID NO: 365140 - RNA, 64 nt, hsa; identical to SEQ ID NO: 170721

SEQ ID NO: 365141 - RNA, 64 nt, hsa
aaaaacaucacaauccuaaauccucucguaucucaccccaaaccccaaacugggggaaaaaaag

SEQ ID NO: 365142 - RNA, 64 nt, hsa
ucacaauccuaaauccucucguaucucaccccaaaccccaaacugggggaaaaaaaguuaacuc

SEQ ID NO: 365143 - RNA, 64 nt, hsa
uugugcuggguaaaagaggagagcugugcuuucuaccccaaaguuguugguaauggagccgguc

SEQ ID NO: 365144 - RNA, 64 nt, hsa
aaaacauguuuaagauaaaauacaaacuuuaccuaccccaaauucauaaaguacauuuagugcu

SEQ ID NO: 365145 - RNA, 64 nt, hsa
auuuguaaggcugggcuucaaaaucaaaacaaaaaccccaaaaacagcaggcaaaugcuuuuua

SEQ ID NO: 365146 - RNA, 64 nt, hsa
gagucagcuacuucacacuugucaaggcuguuuuaccccaaaacucagacaggacuuucuaugc

SEQ ID NO: 365147 - RNA, 64 nt, hsa
uugguacccauucccauuucacaaacuccuccaaaccccaaaccccaaacggaaaucucuggga

SEQ ID NO: 365148 - RNA, 64 nt, hsa
ccauucccauuucacaaacuccuccaaaccccaaaccccaaacggaaaucucugggacaauggc

SEQ ID NO: 365149 - RNA, 64 nt, hsa
acuuuugguaagggaaaagggaacaggaaaagaaaccccaaacucaggccgaaugaucaagggg

SEQ ID NO: 365150 - RNA, 64 nt, hsa
gauuuuuuuuuagaacagaaaacaacaaaaaauaaccccaaaaugaagauuauuuuuuaugagg

SEQ ID NO: 365151 - RNA, 64 nt, hsa
uuauuuugucaucagauuacuuguggguauaccuaccccaaaauuguuuucucauucacagcau

SEQ ID NO: 365152 - RNA, 64 nt, hsa
uuaaaaauauuauugguauuaaagaaauccauucaccccaaaacuuguuuuacaggauuacaau

SEQ ID NO: 365153 - RNA, 64 nt, hsa
acgcugucucagaaaacgaaaacggaggaaaaaaaccccaaaccccaaacaaucuuaauaaaca

SEQ ID NO: 365154 - RNA, 64 nt, hsa
cucagaaaacgaaaacggaggaaaaaaaccccaaaccccaaacaaucuuaauaaacacgacuga

SEQ ID NO: 365155 - RNA, 64 nt, hsa
aggaaagcuugcugauuaucuuccugaucuacucaccccaaaaggcagaaaagcaacacaguca

SEQ ID NO: 365156 - RNA, 64 nt, hsa
auccugguuccaucaguauaccugcucuccuaugaccccaaaucauagucaauggugccucaaa

SEQ ID NO: 365157 - RNA, 64 nt, hsa
gugggccaaucuacuugaaguuacucggacaaagaccccaaaguggggcaacaacuccagagag

SEQ ID NO: 365158 - RNA, 64 nt, hsa
ucuggcacaccuuguacagaguuuugggguucacaccccaaaaugacccaacgauguccacaca

SEQ ID NO: 365159 - RNA, 64 nt, hsa
caagcacuuuacuuccuguuccuccccagccuuaaccccaaagcccuccugcaccccaaagaag

SEQ ID NO: 365160 - RNA, 64 nt, hsa
uuccuccccagccuuaaccccaaagcccuccugcaccccaaagaagccacugaggcuggccgag

SEQ ID NO: 365161 - RNA, 64 nt, hsa
gacaccaaauuccaagagccccagcccuaagggaaccccaaauccuaaagccuccaucucuaau

SEQ ID NO: 365162 - RNA, 64 nt, hsa
cuauuuuuuaaguaacgacuucccccuuugggggaccccaaaauuuggaggccccauucuagga

SEQ ID NO: 365163 - RNA, 64 nt, hsa
agagcagauucccagauuaacagauuuccauaucaccccaaaugauggugacccucuccacaua

SEQ ID NO: 365164 - RNA, 64 nt, hsa
aggcuccucuuuauggggcagauaucuauagccaaccccaaaacuucugucuucuaucauucug

SEQ ID NO: 365165 - RNA, 64 nt, hsa
agcagacagaauacauagccaccauugguaguacaccccaaaagcaaggauggcaugaugcugg

SEQ ID NO: 365166 - RNA, 64 nt, hsa
ccauuaucacuagaucaauuuuagaaaguuuaucaccccaaagagaaauccugcacccaucagc

SEQ ID NO: 365167 - RNA, 64 nt, hsa
acaggacaggcugcacaucucaguauauguagggaccccaaaugaccacaacacaguacaauug

SEQ ID NO: 365168 - RNA, 64 nt, hsa
cucugcucgucgggggcugggagauguuccuggaggaggacacucccaucagaacuuggcagcc

SEQ ID NO: 365169 - RNA, 64 nt, hsa
gggcucugcccgcugggggccugaagacauuccuggaggacacucccaucagaaccuggcagcc

SEQ ID NO: 365170 - RNA, 64 nt, hsa
cuaaccaauacauugaauguaugaugacuauuugggaggacacauuuauguacccagaggcccc

SEQ ID NO: 365171 - RNA, 64 nt, hsa
agcugucauuacagacaacagguuucagugaugaggaggacaacacugccuuucaaacuuuuua

SEQ ID NO: 365172 - RNA, 64 nt, hsa
acacucucgggguugucugcaggagagcaagccaggaggacaugggccuggacgacacggccuc

SEQ ID NO: 365173 - RNA, 64 nt, hsa
agagggagguagaagccaucauggagggcgacgaggaggacagaggcugcugcugcugcaaacc

SEQ ID NO: 365174 - RNA, 64 nt, hsa
cccgugaggagggggagaaggguuagacaagccuggaggacaaaacagcgggagugugggggug

SEQ ID NO: 365175 - RNA, 64 nt, hsa
ucugagccuuaguuucagcugaccagaaguggcaggaggacagguggaggcgagccagauuagg

SEQ ID NO: 365176 - RNA, 64 nt, hsa
auacccagccuaaguguugcccugcacuauggcuggaggacacauuugguagaggucacacugc

SEQ ID NO: 365177 - RNA, 64 nt, hsa
cauaugucaaggagcacuugcaggcagaaugggaggaggacauggagcugauggaguccaggcu

SEQ ID NO: 365178 - RNA, 64 nt, hsa
uguguccuauggaauccaguucugaagaggugggggaggacaacugugggaaaagcccuggggg

SEQ ID NO: 365179 - RNA, 64 nt, hsa
accugcuggagauguaaauuugccaugacuuccuggaggacagcagcauggagaaagauccuag

SEQ ID NO: 365180 - RNA, 64 nt, hsa
agguagcggauuuccugcagaacauccuggcucaggaggacacugcuaagggucucgaccccuu

SEQ ID NO: 365181 - RNA, 64 nt, hsa
ggguuaaaggaguccgcagcucccacggcugcugggaggacaugguccugcccccuuccuuccu

SEQ ID NO: 365182 - RNA, 64 nt, hsa
gggaugcuccuggauggagaggguuugcugcuggggaggacaugggugugugugugacugcagg

SEQ ID NO: 365183 - RNA, 64 nt, hsa
gcaagagcaccccaucuucagguggcggccccucggaggacaagcgcuucucggugguggauau

SEQ ID NO: 365184 - RNA, 64 nt, hsa
aauuccccuuuaagaccaaggagauaaggguggaggaggacacgaaagugaacuccaccgucau

SEQ ID NO: 365185 - RNA, 64 nt, hsa
cuagcuucaggcuacuugguaacuggaagaagcuggaggacagaagcaguacucaacuugcugu

SEQ ID NO: 365186 - RNA, 64 nt, hsa
uggaauuagagaauacaaucaaacuuuaccacuuggaggacacgggguuaguccaggaccaaag

SEQ ID NO: 365187 - RNA, 64 nt, hsa
gccuagaagcccugagaaagaacuuaaagagcuaggaggacagaggcccccaagcugaucuggu

SEQ ID NO: 365188 - RNA, 64 nt, hsa
cuuagaugugcucuuuggggaagcccaucuaacaggaggacauugguuugggggugcaccuccu

SEQ ID NO: 365189 - RNA, 64 nt, hsa
ugauccuaaaagguagccucuucauaggaacccaggaggacaaaaccaccaugcauuaagauuu

SEQ ID NO: 365190 - RNA, 64 nt, hsa
ccaaggccuggagcuauucugguaccuuccccauggaggacacugaaaaggcuggguuggggac

SEQ ID NO: 365191 - RNA, 64 nt, hsa
gcaacuaugcccccgaugaggaccaagggcaccuggaggacagcuggaccgguaucugccaucc

SEQ ID NO: 365192 - RNA, 64 nt, hsa
gcaugaaccuggaccccuucggcagcuacucagaggaggacauuuggugggcuuuggagcuguc

SEQ ID NO: 365193 - RNA, 64 nt, hsa
uuuggaggcccugucucuggugguuuuuaggauuggaggacaucaugaagauggaggccuugua

SEQ ID NO: 365194 - RNA, 51 nt, hsa
auaccugugaaaaugaauaguggaggacaggucuacaaguaucuacauauc

SEQ ID NO: 365195 - RNA, 64 nt, hsa
gcacaggggucacaccuguaaucccagcacuuugggaggacaagguggguggaucacuugaggc

SEQ ID NO: 365196 - RNA, 64 nt, hsa
gcugcuugcuucaucaaggcaugcaagccaaaagggaggacagucugcuagcaagauggaaguu

SEQ ID NO: 365197 - RNA, 64 nt, hsa
agcuucaucccgaugucacuccucaacugacuuaggaggacagucuugcuaccccaagucacua

SEQ ID NO: 365198 - RNA, 64 nt, hsa
auuagcaauaaguuaaaccucaucuuguacuaaaggaggacacacucagggagaagaccucugu

SEQ ID NO: 365199 - RNA, 64 nt, hsa
acugacucccauuuccuaaaggaaaugcccccggggaggacauugggaggaagauggccugagu

SEQ ID NO: 365200 - RNA, 64 nt, hsa
aacacagaacccucaagacaaggaugacagagcuggaggacacaucuagcugccauugcaaccu

SEQ ID NO: 365201 - RNA, 64 nt, hsa
uccccacucccgugaugaaacagcuagguuaauaggaggacagaaccaacgggucugugggacu

SEQ ID NO: 365202 - RNA, 64 nt, hsa
ccucccuguccccugagguuaaggggaucuaaaaggaggacagggagggaacagaccucggcug

SEQ ID NO: 365203 - RNA, 64 nt, hsa
uggccacacacuuccaugugucuuuuugccugcuggaggacacggaccauugaugcacuuggug

SEQ ID NO: 365204 - RNA, 64 nt, hsa
gggccggccaggcagggcacccagacggggggcuggaggacacccucaguuugcuccacauggc

SEQ ID NO: 365205 - RNA, 64 nt, hsa
ccaggccgugaggcuggagaaacuggcaguuauugcugucaaaagccuguucucucaacugcug

SEQ ID NO: 365206 - RNA, 64 nt, hsa
caguuauugcugucaaaagccuguucucucaacugcugucaauaaaauuaaagauacagauuug

SEQ ID NO: 365207 - RNA, 64 nt, hsa; identical to SEQ ID NO: 161197

SEQ ID NO: 365208 - RNA, 64 nt, hsa; identical to SEQ ID NO: 161198

SEQ ID NO: 365209 - RNA, 64 nt, hsa; identical to SEQ ID NO: 161199

SEQ ID NO: 365210 - RNA, 64 nt, hsa; identical to SEQ ID NO: 161200

SEQ ID NO: 365211 - RNA, 64 nt, hsa; identical to SEQ ID NO: 161201

SEQ ID NO: 365212 - RNA, 64 nt, hsa; identical to SEQ ID NO: 161202

SEQ ID NO: 365213 - RNA, 64 nt, hsa; identical to SEQ ID NO: 161203

SEQ ID NO: 365214 - RNA, 64 nt, hsa; identical to SEQ ID NO: 161204

SEQ ID NO: 365215 - RNA, 64 nt, hsa; identical to SEQ ID NO: 161205

SEQ ID NO: 365216 - RNA, 64 nt, hsa; identical to SEQ ID NO: 161206

SEQ ID NO: 365217 - RNA, 64 nt, hsa; identical to SEQ ID NO: 161207

SEQ ID NO: 365218 - RNA, 64 nt, hsa; identical to SEQ ID NO: 161208

SEQ ID NO: 365219 - RNA, 64 nt, hsa; identical to SEQ ID NO: 161209

SEQ ID NO: 365220 - RNA, 64 nt, hsa; identical to SEQ ID NO: 161210

SEQ ID NO: 365221 - RNA, 64 nt, hsa; identical to SEQ ID NO: 161211

SEQ ID NO: 365222 - RNA, 64 nt, hsa; identical to SEQ ID NO: 161212

SEQ ID NO: 365223 - RNA, 64 nt, hsa; identical to SEQ ID NO: 161213

SEQ ID NO: 365224 - RNA, 64 nt, hsa; identical to SEQ ID NO: 161214

SEQ ID NO: 365225 - RNA, 64 nt, hsa; identical to SEQ ID NO: 161215

SEQ ID NO: 365226 - RNA, 64 nt, hsa; identical to SEQ ID NO: 161216

SEQ ID NO: 365227 - RNA, 64 nt, hsa; identical to SEQ ID NO: 161217

SEQ ID NO: 365228 - RNA, 64 nt, hsa; identical to SEQ ID NO: 161218

SEQ ID NO: 365229 - RNA, 64 nt, hsa; identical to SEQ ID NO: 161219

SEQ ID NO: 365230 - RNA, 64 nt, hsa; identical to SEQ ID NO: 161220

SEQ ID NO: 365231 - RNA, 64 nt, hsa; identical to SEQ ID NO: 161221

SEQ ID NO: 365232 - RNA, 64 nt, hsa; identical to SEQ ID NO: 161222

SEQ ID NO: 365233 - RNA, 64 nt, hsa; identical to SEQ ID NO: 161223

SEQ ID NO: 365234 - RNA, 64 nt, hsa; identical to SEQ ID NO: 161224

SEQ ID NO: 365235 - RNA, 64 nt, hsa; identical to SEQ ID NO: 161225

SEQ ID NO: 365236 - RNA, 64 nt, hsa; identical to SEQ ID NO: 161226

SEQ ID NO: 365237 - RNA, 64 nt, hsa; identical to SEQ ID NO: 161227

SEQ ID NO: 365238 - RNA, 64 nt, hsa; identical to SEQ ID NO: 161228

SEQ ID NO: 365239 - RNA, 64 nt, hsa; identical to SEQ ID NO: 161229

SEQ ID NO: 365240 - RNA, 64 nt, hsa; identical to SEQ ID NO: 161230

SEQ ID NO: 365241 - RNA, 64 nt, hsa; identical to SEQ ID NO: 161231

SEQ ID NO: 365242 - RNA, 64 nt, hsa; identical to SEQ ID NO: 161232

SEQ ID NO: 365243 - RNA, 60 nt, hsa; identical to SEQ ID NO: 161233

SEQ ID NO: 365244 - RNA, 64 nt, hsa; identical to SEQ ID NO: 161234

SEQ ID NO: 365245 - RNA, 64 nt, hsa; identical to SEQ ID NO: 161235

SEQ ID NO: 365246 - RNA, 64 nt, hsa; identical to SEQ ID NO: 161236

SEQ ID NO: 365247 - RNA, 64 nt, hsa; identical to SEQ ID NO: 161237

SEQ ID NO: 365248 - RNA, 64 nt, hsa; identical to SEQ ID NO: 161238

SEQ ID NO: 365249 - RNA, 64 nt, hsa; identical to SEQ ID NO: 161239

SEQ ID NO: 365250 - RNA, 64 nt, hsa; identical to SEQ ID NO: 161240

SEQ ID NO: 365251 - RNA, 64 nt, hsa; identical to SEQ ID NO: 161241

SEQ ID NO: 365252 - RNA, 64 nt, hsa; identical to SEQ ID NO: 161242

SEQ ID NO: 365253 - RNA, 64 nt, hsa; identical to SEQ ID NO: 161243

SEQ ID NO: 365254 - RNA, 64 nt, hsa; identical to SEQ ID NO: 161244

SEQ ID NO: 365255 - RNA, 64 nt, hsa; identical to SEQ ID NO: 161245

SEQ ID NO: 365256 - RNA, 64 nt, hsa; identical to SEQ ID NO: 161246

SEQ ID NO: 365257 - RNA, 64 nt, hsa; identical to SEQ ID NO: 161247

SEQ ID NO: 365258 - RNA, 64 nt, hsa; identical to SEQ ID NO: 161248

SEQ ID NO: 365259 - RNA, 64 nt, hsa; identical to SEQ ID NO: 161249

SEQ ID NO: 365260 - RNA, 64 nt, hsa; identical to SEQ ID NO: 161250

SEQ ID NO: 365261 - RNA, 64 nt, hsa; identical to SEQ ID NO: 161251

SEQ ID NO: 365262 - RNA, 64 nt, hsa; identical to SEQ ID NO: 161252

SEQ ID NO: 365263 - RNA, 64 nt, hsa; identical to SEQ ID NO: 161253

SEQ ID NO: 365264 - RNA, 64 nt, hsa; identical to SEQ ID NO: 161254

SEQ ID NO: 365265 - RNA, 64 nt, hsa; identical to SEQ ID NO: 161255

SEQ ID NO: 365266 - RNA, 64 nt, hsa; identical to SEQ ID NO: 161256

SEQ ID NO: 365267 - RNA, 64 nt, hsa; identical to SEQ ID NO: 161257

SEQ ID NO: 365268 - RNA, 64 nt, hsa; identical to SEQ ID NO: 161258

SEQ ID NO: 365269 - RNA, 64 nt, hsa; identical to SEQ ID NO: 161259

SEQ ID NO: 365270 - RNA, 64 nt, hsa; identical to SEQ ID NO: 161260

SEQ ID NO: 365271 - RNA, 64 nt, hsa; identical to SEQ ID NO: 161261

SEQ ID NO: 365272 - RNA, 64 nt, hsa; identical to SEQ ID NO: 161262

SEQ ID NO: 365273 - RNA, 64 nt, hsa; identical to SEQ ID NO: 161263

SEQ ID NO: 365274 - RNA, 64 nt, hsa; identical to SEQ ID NO: 161264

SEQ ID NO: 365275 - RNA, 64 nt, hsa; identical to SEQ ID NO: 161265

SEQ ID NO: 365276 - RNA, 64 nt, hsa; identical to SEQ ID NO: 161266

SEQ ID NO: 365277 - RNA, 64 nt, hsa; identical to SEQ ID NO: 161267

SEQ ID NO: 365278 - RNA, 64 nt, hsa; identical to SEQ ID NO: 161268

SEQ ID NO: 365279 - RNA, 64 nt, hsa; identical to SEQ ID NO: 161269

SEQ ID NO: 365280 - RNA, 64 nt, hsa; identical to SEQ ID NO: 161270

SEQ ID NO: 365281 - RNA, 64 nt, hsa; identical to SEQ ID NO: 161271

SEQ ID NO: 365282 - RNA, 64 nt, hsa; identical to SEQ ID NO: 161272

SEQ ID NO: 365283 - RNA, 64 nt, hsa; identical to SEQ ID NO: 161273

SEQ ID NO: 365284 - RNA, 64 nt, hsa; identical to SEQ ID NO: 161274

SEQ ID NO: 365285 - RNA, 64 nt, hsa; identical to SEQ ID NO: 161275

SEQ ID NO: 365286 - RNA, 64 nt, hsa; identical to SEQ ID NO: 161276

SEQ ID NO: 365287 - RNA, 64 nt, hsa; identical to SEQ ID NO: 161277

SEQ ID NO: 365288 - RNA, 64 nt, hsa; identical to SEQ ID NO: 161278

SEQ ID NO: 365289 - RNA, 64 nt, hsa; identical to SEQ ID NO: 161279

SEQ ID NO: 365290 - RNA, 63 nt, hsa; identical to SEQ ID NO: 161280

SEQ ID NO: 365291 - RNA, 64 nt, hsa; identical to SEQ ID NO: 161281

SEQ ID NO: 365292 - RNA, 64 nt, hsa; identical to SEQ ID NO: 161282

SEQ ID NO: 365293 - RNA, 64 nt, hsa; identical to SEQ ID NO: 161283

SEQ ID NO: 365294 - RNA, 64 nt, hsa; identical to SEQ ID NO: 161284

SEQ ID NO: 365295 - RNA, 64 nt, hsa; identical to SEQ ID NO: 85920

SEQ ID NO: 365296 - RNA, 64 nt, hsa; identical to SEQ ID NO: 85921

SEQ ID NO: 365297 - RNA, 64 nt, hsa; identical to SEQ ID NO: 85922

SEQ ID NO: 365298 - RNA, 64 nt, hsa; identical to SEQ ID NO: 85923

SEQ ID NO: 365299 - RNA, 64 nt, hsa; identical to SEQ ID NO: 85924

SEQ ID NO: 365300 - RNA, 64 nt, hsa; identical to SEQ ID NO: 85925

SEQ ID NO: 365301 - RNA, 64 nt, hsa; identical to SEQ ID NO: 85926

SEQ ID NO: 365302 - RNA, 64 nt, hsa; identical to SEQ ID NO: 85927

SEQ ID NO: 365303 - RNA, 64 nt, hsa; identical to SEQ ID NO: 85928

SEQ ID NO: 365304 - RNA, 64 nt, hsa; identical to SEQ ID NO: 85929

SEQ ID NO: 365305 - RNA, 64 nt, hsa; identical to SEQ ID NO: 85930

SEQ ID NO: 365306 - RNA, 64 nt, hsa; identical to SEQ ID NO: 85931

SEQ ID NO: 365307 - RNA, 64 nt, hsa; identical to SEQ ID NO: 85932

SEQ ID NO: 365308 - RNA, 64 nt, hsa; identical to SEQ ID NO: 85933

SEQ ID NO: 365309 - RNA, 64 nt, hsa; identical to SEQ ID NO: 85934

SEQ ID NO: 365310 - RNA, 64 nt, hsa; identical to SEQ ID NO: 85935

SEQ ID NO: 365311 - RNA, 64 nt, hsa; identical to SEQ ID NO: 85936

SEQ ID NO: 365312 - RNA, 64 nt, hsa; identical to SEQ ID NO: 85937

SEQ ID NO: 365313 - RNA, 64 nt, hsa; identical to SEQ ID NO: 85938

SEQ ID NO: 365314 - RNA, 64 nt, hsa; identical to SEQ ID NO: 85939

SEQ ID NO: 365315 - RNA, 64 nt, hsa; identical to SEQ ID NO: 85940

SEQ ID NO: 365316 - RNA, 64 nt, hsa; identical to SEQ ID NO: 85941

SEQ ID NO: 365317 - RNA, 64 nt, hsa; identical to SEQ ID NO: 85942

SEQ ID NO: 365318 - RNA, 64 nt, hsa; identical to SEQ ID NO: 85943

SEQ ID NO: 365319 - RNA, 64 nt, hsa
cagcaccaccuccugcacugcacuucugccguccacaucccagcacacuggcgaccugacuagc

SEQ ID NO: 365320 - RNA, 64 nt, hsa
uacaacuacuacuucuugggaccucaagcccccaacaucccaguccucaguccucagucaucuu

SEQ ID NO: 365321 - RNA, 64 nt, hsa
caucuugucuuacacauaaaagccacugcuuuuaacaucccauuguacauuuaacacauaaaug

SEQ ID NO: 365322 - RNA, 64 nt, hsa
aucccauuguacauuuaacacauaaaugguguuaacaucccauuguacauuuaacacauaaaug

SEQ ID NO: 365323 - RNA, 64 nt, hsa
gagcuuaucccccagacccugcuuuauaccauucacaucccagggcuguguccagacagcacaa

SEQ ID NO: 365324 - RNA, 64 nt, hsa
gguguuuaauggguuaaaaauaagccacugccugacaucccaacauuugacaccccagcaaugu

SEQ ID NO: 365325 - RNA, 64 nt, hsa
uuggcaccccacagcccuucaccuucgcuaucaaacaucccaggaaaggguaagaauuuagggc

SEQ ID NO: 365326 - RNA, 64 nt, hsa
gauggcucuaagggcuauaaauuacaaacaaaacacaucccagacauuaggaguucauaaguau

SEQ ID NO: 365327 - RNA, 64 nt, hsa
aggccugugcacacaucccaggcaugucccagacacaucccacacguguccguguggccggcca

SEQ ID NO: 365328 - RNA, 64 nt, hsa
aaugagcugugaccaucccaggaggccugugcacacaucccaggcaugucccagacacauccca

SEQ ID NO: 365329 - RNA, 64 nt, hsa
acucacagaaggggacugacagugggcaacacucacaucccacuggcugcuguucugaaaccau

SEQ ID NO: 365330 - RNA, 64 nt, hsa
cgcucucgagcuguucuguaaauaccuggugcuaacaucccaugccgcucccuccucacgaugc

SEQ ID NO: 365331 - RNA, 64 nt, hsa
aaacgguuacuggggcugcauggagaauuucaccugcggugauuuugauccagggacugcaucu

SEQ ID NO: 365332 - RNA, 64 nt, hsa
uuugccaaaggcagaguggggcugagaaacaggcugcggugauugcaauuaccauccgguguuc

SEQ ID NO: 365333 - RNA, 64 nt, hsa
agccaccugggcugggagaaggugcuugggcuucugcggugaggcaggggagucugcuugucuu

SEQ ID NO: 365334 - RNA, 64 nt, hsa
gucaagagcaggggugggccggggagggguccuuugcggugagcuauguuuacaugacacagug

SEQ ID NO: 365335 - RNA, 64 nt, hsa
acaggagaaucacuugaaccugggagguggagguugcggugagcugagaucgugccacugcacu

SEQ ID NO: 365336 - RNA, 64 nt, hsa
ccacacagcagccuccaggauaccagcaaauggaugcggugacaaauggcagcuuagcuacaaa

SEQ ID NO: 365337 - RNA, 64 nt, hsa
cagaucuuagaaaccaaccauacagacgagccgaugcggugaggagaagcgucaggcggcgcuu

SEQ ID NO: 365338 - RNA, 64 nt, hsa
uacaaccugaugucauauuccauuuuggacugggugcggugacucaugccuguaaucccaguac

SEQ ID NO: 365339 - RNA, 64 nt, hsa
gcauuuaauauuuuuauaaugugucuaggcugggugcggugacucacgccugaaaucccagcac

SEQ ID NO: 365340 - RNA, 64 nt, hsa
cuacugaaacucccagccacagcauuuaucagacugcggugaacauuuccucagcauugaacaa

SEQ ID NO: 365341 - RNA, 64 nt, hsa
gcuagagaaucacuugaacccagcaggcggagguugcggugagucgagaucacgccauugcacu

SEQ ID NO: 365342 - RNA, 64 nt, hsa
guauggagagcccagcccaccagguccugccuuuugcggugauaaccuucucuggcagagugac

SEQ ID NO: 365343 - RNA, 64 nt, hsa
uuuagggccaagucccaagccugcccgggggcccugcggugaacacuggucaagcucucuccgg

SEQ ID NO: 365344 - RNA, 64 nt, hsa
uguauauaaacgugucccgagcuuagauucuguaugcggugacggcggggugugguggccugug

SEQ ID NO: 365345 - RNA, 64 nt, hsa
gagcagcuaucugauuggaaaccugccgacuuagugcggugauaggaagcuaaaagugucaagc

SEQ ID NO: 365346 - RNA, 64 nt, hsa
gaaucgccgcucagcccccuuuguuucugcuuucugcggugaucagagggcgcguuuggguuug

SEQ ID NO: 365347 - RNA, 64 nt, hsa
gcaggagaacugccugaacccaggaggcagagguugcggugagucgagaucgugcuacuacugc

SEQ ID NO: 365348 - RNA, 64 nt, hsa
gcaggagaauugcuugaacccgggagguggaggcugcggugagccaagaucaugccauugcacu

SEQ ID NO: 365349 - RNA, 64 nt, hsa
ggacaagaguggggccacucugcgccucugcuguugcggugaaucuggaagccggagcaagggc

SEQ ID NO: 365350 - RNA, 64 nt, hsa
gcaggagaaucacuugaacccaggagguggaggcugcggugagccgagauugcgccauugcacu

SEQ ID NO: 365351 - RNA, 64 nt, hsa
caugccauguguaauauaccuagccaaaaccagaugcggugacuuucuuuuuuuguaaagcaaa

SEQ ID NO: 365352 - RNA, 64 nt, hsa
gcugaggacaguaguaaaccccuugaccugagacugcggugagucuguaacucgagugcauuga

SEQ ID NO: 365353 - RNA, 64 nt, hsa
gcaggagaaucauuugaacucaggaggcggaaguugcggugagccaagauugugccauugcacu

SEQ ID NO: 365354 - RNA, 64 nt, hsa
ucccauugggcagcugaggaccgaggcacagaggugcggugacuugcccggggcuccagguagc

SEQ ID NO: 365355 - RNA, 64 nt, hsa
gcaggagaauugcuugaaccugggagacggagguugcggugagcugcagaggccucaccucuaa

SEQ ID NO: 365356 - RNA, 64 nt, hsa
gcacgagaaucaccugaacucaggaggcggagguugcggugagcugagauggcaccacugcacu

SEQ ID NO: 365357 - RNA, 64 nt, hsa
ggcggagaauugcuugaacccggaagguggagguugcggugagcugagauugcacuauugcacu

SEQ ID NO: 365358 - RNA, 64 nt, hsa
auuuguuucuacagaaauaacagcuggggacaacugcggugaugauguaaaaaccuucccauaa

SEQ ID NO: 365359 - RNA, 64 nt, hsa
aaugauccugaacacucugaacuugacguaguccugcggugauauucuaucugcaguauuugua

SEQ ID NO: 365360 - RNA, 64 nt, hsa
cgcaaguguuugaguuuggccuccaccccauugaugcggugacggggcggaaaggcgcagagaa

SEQ ID NO: 365361 - RNA, 64 nt, hsa
auaaaugggauuuaucuuuuuucucacuuauuuuugcggugaaagucgagggcaugcaagaguu

SEQ ID NO: 365362 - RNA, 63 nt, hsa
aaaauagccacuuaccuucaauaaaguaucuacaugcggugaagcauuguugacucuaaugug

SEQ ID NO: 365363 - RNA, 64 nt, hsa
gcaaucgucugggcucguggauaugucccucaggugcggugacagaaugguggcaccacgauau

SEQ ID NO: 365364 - RNA, 64 nt, hsa
gcagaagaauugcuugaacuggggaggcagagguugcggugagcccagaucgcgccauugcacu

SEQ ID NO: 365365 - RNA, 64 nt, hsa
cugcaguccucgacagccucuucagugucccuccugcggugauguccuuacuguccccagccag

SEQ ID NO: 365366 - RNA, 64 nt, hsa
uaccagccuuccgcaggaaggaaauucugacauaugcggugacauggaugaaccuugaguacau

SEQ ID NO: 365367 - RNA, 64 nt, hsa
cuggggucuggucuuccugcucugugguuugggcugcggugagucccacuccaccugggcgccu

SEQ ID NO: 365368 - RNA, 64 nt, hsa
uguuuguugaguccuuucuuugugcuaagguucuugcggugaaccagaauuauaacagugagcu

SEQ ID NO: 365369 - RNA, 64 nt, hsa
uuuguuguaugacagaaggcuuuuccaagcaaacugcggugagcguaguguugaauauguugca

SEQ ID NO: 365370 - RNA, 64 nt, hsa
gccugggccugcccagauggccaccucguggugcugcggugacuuuguagccaacuuuauaaua

SEQ ID NO: 365371 - RNA, 64 nt, hsa
guccagucccccagggcugcuuccugccugcaccugcggugacugugagcaggauccuggggcc

SEQ ID NO: 365372 - RNA, 64 nt, hsa
cgaggaacagaugugugugugacguguuuagaaaugcggugaagggccagacggugcugggaag

SEQ ID NO: 365373 - RNA, 64 nt, hsa
gggcuccagagcucggcaggccccgcugguuuggugcggugaguccugccccggcugugccagg

SEQ ID NO: 365374 - RNA, 64 nt, hsa
cgucucgaggaaaaaaaaagaaaagauacgugccugcggugaggaagcugggcgcuguuuucga

SEQ ID NO: 365375 - RNA, 64 nt, hsa
gcaggagaaucgcuugagccugggaggcagaggcugcggugagccgagaucgugucacugcacu

SEQ ID NO: 365376 - RNA, 64 nt, hsa
ccugugugugccugggggcuacugccccaacuccugcggugacaccacccagccugaccugugu

SEQ ID NO: 365377 - RNA, 64 nt, hsa
ggacugaggagcacagagcagagagcagacucugugcggugacuccgaagcuccccggcugugg

SEQ ID NO: 365378 - RNA, 64 nt, hsa
cgauuaugcuuucuuuggccuacauucuuuauucugcggugaaguugaggcuuauaaguuaaaa

SEQ ID NO: 365379 - RNA, 64 nt, hsa
cagagagaaaaauugccuucaucccccaagaggaugcggugaaguuuaaacucugcucaggaua

SEQ ID NO: 365380 - RNA, 64 nt, hsa
cuguuaauagaaaggugggauagucuuugcuguuugcggugaaaugcuuuuuguccaugugccg

SEQ ID NO: 365381 - RNA, 64 nt, hsa
gugggaggaucaccuaaggccaggaggucaaggcugcggugagccgugauugugccaauguacu

SEQ ID NO: 365382 - RNA, 64 nt, hsa
gcaggagaaucgcuugaacccagguggcggagguugcggugagcugagaucacgccauugcacu

SEQ ID NO: 365383 - RNA, 64 nt, hsa
ccuuaaucucuacaacaguaucuuaauuuuuacuugcggugacuauucuugccacaauauugga

SEQ ID NO: 365384 - RNA, 64 nt, hsa
augggucuaauaaaggaucaaccacaugggguucugcggugauaaugagcacauagugaggggu

SEQ ID NO: 365385 - RNA, 64 nt, hsa
gcaggaaaaucacuugaacccgggaggcggagguugcggugagccaagaucgcaccauugcacu

SEQ ID NO: 365386 - RNA, 64 nt, hsa
ccagguggccggcuccucggacucugcuuuauguugcggugagaacucugcccaggugugcagg

SEQ ID NO: 365387 - RNA, 64 nt, hsa
ccugaugaccagguucugucucuauggaagucacugcggugauaggucugugauggucccuaag

SEQ ID NO: 365388 - RNA, 64 nt, hsa
gagccccacggccucgcacacugaagcaggggcgugcggugacucggugcuucuguuuuggaag

SEQ ID NO: 365389 - RNA, 64 nt, hsa
gcggggugggaaccgugucauuccagaguggaucugcggugaagccaagccgcaagguuacaag

SEQ ID NO: 365390 - RNA, 64 nt, hsa
ggcugcggugggcgcugcgguccugguggggccgugcggugagggccgcgcgcugggagccgca

SEQ ID NO: 365391 - RNA, 64 nt, hsa
uugagggaaguagaggcugggagcaaaugccccaugcggugagaggaugaggggagccuacgcc

SEQ ID NO: 365392 - RNA, 64 nt, hsa
cuacuccagcaguauuugaacacauggaacagugugcggugaaacuugccaaaaugguggguua

SEQ ID NO: 365393 - RNA, 64 nt, hsa
gcaggagaaucgcuugaacucaggagguggagguugcggugagccaagaucgugccacugcacu

SEQ ID NO: 365394 - RNA, 64 nt, hsa
gcaggaggaucgcuugagaccaagaguuugagccugcggugagcugugaaugcaccacggcacu

SEQ ID NO: 365395 - RNA, 64 nt, hsa
gugcguuuugcauacuggguugguuugcuggggcugcggugacagcauaugccgcgagcugggc

SEQ ID NO: 365396 - RNA, 64 nt, hsa
uaaaaaaauuaaaucuaguucaccuugcucacccugcggugacagggacagcucaggcucuugg

SEQ ID NO: 365397 - RNA, 64 nt, hsa
uaaacacgggugugcauguggaugcacacgggugugcggugaagaucuguggagauggagcugg

SEQ ID NO: 365398 - RNA, 64 nt, hsa
gcaggagaauggcgugaacuugggaggcggagcuugcggugagccaagaucgugccacugcacu

SEQ ID NO: 365399 - RNA, 64 nt, hsa
gcaggagaaucgcuugaacccgggagguggagguugcggugagccaagaucgcaccauugcacu

SEQ ID NO: 365400 - RNA, 64 nt, hsa
gcaggauaaucacuugaauccgggaggcggagguugcggugagccaagaucgcgccacugcacu

SEQ ID NO: 365401 - RNA, 64 nt, hsa
guaaacgucgucucaaaaaugaaaugcugccgggugcggugacucacgccuauaaucccagcac

SEQ ID NO: 365402 - RNA, 64 nt, hsa
gcaggagaauugcuugaacccaugagguggagguugcggugagccaagauggcaccauugcacc

SEQ ID NO: 365403 - RNA, 64 nt, hsa
cucuuccucucgggagccuccccgguuccuccccugcggugaccccaacuccagcccauccugu

SEQ ID NO: 365404 - RNA, 64 nt, hsa
ugggcaggucgugucuccuccugaccccaguggcugcggugaggggaaccacccucccuugcug

SEQ ID NO: 365405 - RNA, 64 nt, hsa
uugaaagaagcugcugcacccgaaacugccagugugcggugacaacggcacacgccuagacuga

SEQ ID NO: 365406 - RNA, 64 nt, hsa
agcucgugggacagcaugggcacuacucuucaugugcggugacaccagcccccagaugccuuga

SEQ ID NO: 365407 - RNA, 64 nt, hsa
cagguccacggaaagguuuggccugacgcuggagugcggugaugaacuuacgugacaaugauug

SEQ ID NO: 365408 - RNA, 64 nt, hsa
gcaggagaguagcgugaacccgggaggcagagcuugcggugagccgagauugcgcuacugcacu

SEQ ID NO: 365409 - RNA, 64 nt, hsa
cacaaauauaucugugugugugugugcgugugugugcggugaagggcgguccccauccugggcc

SEQ ID NO: 365410 - RNA, 64 nt, hsa
gcaggagaaucacuugaacccaggaggcggagguugcggugagcugagauugcaccauuucauu

SEQ ID NO: 365411 - RNA, 64 nt, hsa
aacaguuuaagaugcagugugagucuggccugcgugcggugaggaggccccgccaagagacugg

SEQ ID NO: 365412 - RNA, 64 nt, hsa
gcaggagaauugcuugaacccaggaggcagagauugcggugagccaagauggcaccacugcacu

SEQ ID NO: 365413 - RNA, 64 nt, hsa
gagaaucgcuugaacccaagaaagagguggagguugcggugagccaagauugcgccacugcacu

SEQ ID NO: 365414 - RNA, 64 nt, hsa
cacuuugaauucugugcuaauuuuguggccagaaugcggugaucaaaacgcuccaucuuuuuac

SEQ ID NO: 365415 - RNA, 64 nt, hsa
agccauaggaauuuggcuguggaguaagagggaaugcggugaggcacucuggaauaugacccua

SEQ ID NO: 365416 - RNA, 64 nt, hsa
gcaggaggaucacuugagcccaggaguuugaggcugcggugagcugugaucacaccaccacacu

SEQ ID NO: 365417 - RNA, 64 nt, hsa
aagccucuguccuguauaggcaacugccugacuaugcggugacugcuguaaccaagaucagguc

SEQ ID NO: 365418 - RNA, 64 nt, hsa
gcaggagaaucacuugaacccgggaggcagagguugcggugagccaagagcgcaccauugcacu

SEQ ID NO: 365419 - RNA, 64 nt, hsa; identical to SEQ ID NO: 336839

SEQ ID NO: 365420 - RNA, 64 nt, hsa; identical to SEQ ID NO: 336840

SEQ ID NO: 365421 - RNA, 64 nt, hsa; identical to SEQ ID NO: 336841

SEQ ID NO: 365422 - RNA, 64 nt, hsa; identical to SEQ ID NO: 336842

SEQ ID NO: 365423 - RNA, 64 nt, hsa; identical to SEQ ID NO: 336843

SEQ ID NO: 365424 - RNA, 64 nt, hsa; identical to SEQ ID NO: 336844

SEQ ID NO: 365425 - RNA, 64 nt, hsa; identical to SEQ ID NO: 336845

SEQ ID NO: 365426 - RNA, 64 nt, hsa; identical to SEQ ID NO: 336846

SEQ ID NO: 365427 - RNA, 64 nt, hsa; identical to SEQ ID NO: 336847

SEQ ID NO: 365428 - RNA, 64 nt, hsa; identical to SEQ ID NO: 336848

SEQ ID NO: 365429 - RNA, 64 nt, hsa; identical to SEQ ID NO: 336849

SEQ ID NO: 365430 - RNA, 64 nt, hsa; identical to SEQ ID NO: 336850

SEQ ID NO: 365431 - RNA, 64 nt, hsa; identical to SEQ ID NO: 336851

SEQ ID NO: 365432 - RNA, 64 nt, hsa; identical to SEQ ID NO: 336852

SEQ ID NO: 365433 - RNA, 64 nt, hsa; identical to SEQ ID NO: 336853

SEQ ID NO: 365434 - RNA, 64 nt, hsa; identical to SEQ ID NO: 336854

SEQ ID NO: 365435 - RNA, 64 nt, hsa; identical to SEQ ID NO: 336855

SEQ ID NO: 365436 - RNA, 64 nt, hsa; identical to SEQ ID NO: 336856

SEQ ID NO: 365437 - RNA, 64 nt, hsa; identical to SEQ ID NO: 336857

SEQ ID NO: 365438 - RNA, 64 nt, hsa; identical to SEQ ID NO: 336858

SEQ ID NO: 365439 - RNA, 64 nt, hsa; identical to SEQ ID NO: 336859

SEQ ID NO: 365440 - RNA, 64 nt, hsa; identical to SEQ ID NO: 336860

SEQ ID NO: 365441 - RNA, 64 nt, hsa; identical to SEQ ID NO: 336861

SEQ ID NO: 365442 - RNA, 64 nt, hsa; identical to SEQ ID NO: 336862

SEQ ID NO: 365443 - RNA, 64 nt, hsa; identical to SEQ ID NO: 336863

SEQ ID NO: 365444 - RNA, 64 nt, hsa; identical to SEQ ID NO: 336864

SEQ ID NO: 365445 - RNA, 64 nt, hsa; identical to SEQ ID NO: 336865

SEQ ID NO: 365446 - RNA, 64 nt, hsa; identical to SEQ ID NO: 336866

SEQ ID NO: 365447 - RNA, 64 nt, hsa; identical to SEQ ID NO: 336867

SEQ ID NO: 365448 - RNA, 64 nt, hsa; identical to SEQ ID NO: 336868

SEQ ID NO: 365449 - RNA, 64 nt, hsa; identical to SEQ ID NO: 336869

SEQ ID NO: 365450 - RNA, 64 nt, hsa; identical to SEQ ID NO: 336870

SEQ ID NO: 365451 - RNA, 64 nt, hsa; identical to SEQ ID NO: 93680

SEQ ID NO: 365452 - RNA, 64 nt, hsa; identical to SEQ ID NO: 93681

SEQ ID NO: 365453 - RNA, 64 nt, hsa; identical to SEQ ID NO: 93682

SEQ ID NO: 365454 - RNA, 64 nt, hsa; identical to SEQ ID NO: 93683

SEQ ID NO: 365455 - RNA, 64 nt, hsa; identical to SEQ ID NO: 93684

SEQ ID NO: 365456 - RNA, 64 nt, hsa; identical to SEQ ID NO: 93685

SEQ ID NO: 365457 - RNA, 64 nt, hsa; identical to SEQ ID NO: 93686

SEQ ID NO: 365458 - RNA, 64 nt, hsa; identical to SEQ ID NO: 93687

SEQ ID NO: 365459 - RNA, 64 nt, hsa
cugggcgcgcugggagugugguuguguuucugaaggggauaaaagagggcacgguggugccaag

SEQ ID NO: 365460 - RNA, 64 nt, hsa
ccuaacuucugauuuagauacuucucccugagguggggauaaaagaaaaaaaaaaacaacuucu

SEQ ID NO: 365461 - RNA, 64 nt, hsa
cccugacuccuggugcccucucccuuuguccccccagagagacauaugcccccagagagagcaa

SEQ ID NO: 365462 - RNA, 64 nt, hsa
ucucccuuuguccccccagagagacauaugcccccagagagagcaaaucgaagcgugggaggca

SEQ ID NO: 365463 - RNA, 64 nt, hsa
uguaaccaagauggaugcaaagaggcuagugccucagagagaacuguacgggguuugugacugg

SEQ ID NO: 365464 - RNA, 64 nt, hsa
guuuggaaaacaguuuuuauucuguuuuauaaaccagagagaaaugaguuuugacgucuuuuua

SEQ ID NO: 365465 - RNA, 64 nt, hsa
ccuggugucugccucgccauccugggguaaggggcagagagaaggacuugucuuauguagggug

SEQ ID NO: 365466 - RNA, 64 nt, hsa
ugugcagugucugagggcagguugggaaggguagcagagagagagagacagaaagagagagaga

SEQ ID NO: 365467 - RNA, 64 nt, hsa
cagaagucuuguuagcagaauuauuuaucagucacagagagaaaaaucugcuauuuuucuaagu

SEQ ID NO: 365468 - RNA, 64 nt, hsa
gaucauucaguuacuugucaggauuucuccucuucagagagauuuuuuuuuauagcacagauuc

SEQ ID NO: 365469 - RNA, 64 nt, hsa
auacaguccacagguggacaaagggauccccagccagagagagagagaccagccaacagcuuga

SEQ ID NO: 365470 - RNA, 64 nt, hsa
gagaccagccaacagcuugauagaccagugcagccagagagaccaccaaacagagcccccaaaa

SEQ ID NO: 365471 - RNA, 64 nt, hsa
ucuuaaugcuguguuugagcuuucaugaguuucccagagagacauagcuggaaaauuccuauug

SEQ ID NO: 365472 - RNA, 64 nt, hsa
ggggcaggguuauuccuuuguggaaccagaggcacagagagagucaacugaggccaaaagaggc

SEQ ID NO: 365473 - RNA, 64 nt, hsa
acuguccuuggcucagagguguugggaauuaaagcagagagaagccauucgugaugcuuagaac

SEQ ID NO: 365474 - RNA, 64 nt, hsa
acaccagaccuccaggagacauccccccuugaggcagagagauccuguucccuauucccagaca

SEQ ID NO: 365475 - RNA, 64 nt, hsa
aaaucugcaaaugcacauuaaugcaaauuaaaugcagagagaaaugauuauuuuuuucuuuaug

SEQ ID NO: 365476 - RNA, 64 nt, hsa
gugcuucaguaacuugaaguuuaaauuuaaaaugcagagagaccaaugguuaaaaugugaauag

SEQ ID NO: 365477 - RNA, 64 nt, hsa
gucauacacgaagggcguguggccaucgugucagcagagagagucucuguacacagccccguga

SEQ ID NO: 365478 - RNA, 64 nt, hsa
gucauacgcgaaggccauauggccaucgugucagcagagagagucucuguacacagccccguga

SEQ ID NO: 365479 - RNA, 64 nt, hsa
cucucaacaccacaguucucaacccugagccuuccagagagagcuauugaugauacaagaggaa

SEQ ID NO: 365480 - RNA, 62 nt, hsa
agaccugccaaggacacugacccacagaaagccagagagagugccuugucauuucaucaugg

SEQ ID NO: 365481 - RNA, 64 nt, hsa
auaacaguguuauaaugcagcuuccuugagccaucagagagaguguauguucacccuaucuggc

SEQ ID NO: 365482 - RNA, 64 nt, hsa
cagauggaacgaaaggcgaugugcaaggccaucccagagagacggaagcaggugcgauacuaag

SEQ ID NO: 365483 - RNA, 64 nt, hsa
ggcgcggggcauccuaugaggcaggcacccugggcagagagaugcagugggugcggggggaucc

SEQ ID NO: 365484 - RNA, 64 nt, hsa
ggacgaggaccagcugugaggcgggcgcccugggcagagagacucuguggcgcggggcauccua

SEQ ID NO: 365485 - RNA, 64 nt, hsa
gaauuccaauuaauuaaauaucacaauagcaucccagagagacaguaggaaauuucuccuuagu

SEQ ID NO: 365486 - RNA, 64 nt, hsa
agcugaaauacaaaagcagaggauugaacaacugcagagagaaaggcggcgggucuuagaagaa

SEQ ID NO: 365487 - RNA, 64 nt, hsa
accugggcuaagaguuuggcauugcaggagcucccagagagacugccuucccuacacuagaagu

SEQ ID NO: 365488 - RNA, 64 nt, hsa
acuccaguggugaagggugcagcucugguucuuccagagagacugcccccuucccuccagcggc

SEQ ID NO: 365489 - RNA, 64 nt, hsa
cuccauccccgcuaccguccuggccagcuaccgucagagagaaccagagcuccaagucuuuaau

SEQ ID NO: 365490 - RNA, 64 nt, hsa
aggaaccugcuaucaggaaaucuacaugugugcacagagagagaaaaguagaacaguucuuugc

SEQ ID NO: 365491 - RNA, 64 nt, hsa
caaaauggggcuucuguaaguagagguggaaaaccagagagauguuuccacagcagccauuucc

SEQ ID NO: 365492 - RNA, 64 nt, hsa
cuggggggaggcaggaggcacaugugaggguccccagagagaagggagugggugggcaggggua

SEQ ID NO: 365493 - RNA, 64 nt, hsa
uguguaugagagagagagagagagacaacagagacagagagaggcagagaggcauagagagaca

SEQ ID NO: 365494 - RNA, 64 nt, hsa
cagagacagagagaggcagagaggcauagagagacagagagagagacaagaaacagagauagac

SEQ ID NO: 365495 - RNA, 64 nt, hsa
uuugaaaucuggucuguuugcauuucuguuaugacagagagaugauguuugcauuucuguuaug

SEQ ID NO: 365496 - RNA, 64 nt, hsa
ugacagagagaugauguuugcauuucuguuaugacagagagaugaugaaaguaggcagggcugu

SEQ ID NO: 365497 - RNA, 64 nt, hsa
gagggagagguggggagggagacagagacagaaacagagagagacagagacagagagagacuga

SEQ ID NO: 365498 - RNA, 64 nt, hsa
gggagacagagacagaaacagagagagacagagacagagagagacugagggagagacucugagg

SEQ ID NO: 365499 - RNA, 64 nt, hsa
aauaauucgugaacgggaagaacgggaacgcuuacagagagagagagagcgccuagaaauugaa

SEQ ID NO: 365500 - RNA, 64 nt, hsa
uaaauacugauuuuugguagacgaagagagauugcagagagagagcgucgagagcgagaacgca

SEQ ID NO: 365501 - RNA, 64 nt, hsa
cugagaucacgccacugcacuccagucugggugacagagagagaccauauccaaaaaaaaaaaa

SEQ ID NO: 365502 - RNA, 64 nt, hsa
ggggguucagaaccagccuggccaaaaauuacaccagagagacagaguccuccccauugggaac

SEQ ID NO: 365503 - RNA, 64 nt, hsa
uugaauguccaccagacaccagccccggggggcacagagagaacaacauuccucucugucaaca

SEQ ID NO: 365504 - RNA, 64 nt, hsa
gagugcgaauaugucucugagaagcuagaggcggcagagagagacaaucaaaaccuggaagaca

SEQ ID NO: 365505 - RNA, 56 nt, hsa
cuggaagaacaaugcagugagaucaacagagagaaggagaagaacacgcagcugaa

SEQ ID NO: 365506 - RNA, 64 nt, hsa
gagugagaagcuuugcccuccuaagagagagagacagagagacagagagagagaaagagagagu

SEQ ID NO: 365507 - RNA, 64 nt, hsa
agcuuugcccuccuaagagagagagacagagagacagagagagagaaagagagagugugugggu

SEQ ID NO: 365508 - RNA, 64 nt, hsa
gagagaggcagagagacagagagggagagagggacagagagagauagagcaggaggucggggca

SEQ ID NO: 365509 - RNA, 64 nt, hsa
ggcagagagggagagaggcagagagggagagaggcagagagacagagagggagagagggacaga

SEQ ID NO: 365510 - RNA, 64 nt, hsa
cggagcagggcagaagauggacugggggagggggcagagagaggagaccaaaaugagguggugg

SEQ ID NO: 365511 - RNA, 64 nt, hsa
cuccgcuuccccccugcuuccccaggucucuauccagagagaguccccagguacaacaaaugcu

SEQ ID NO: 365512 - RNA, 64 nt, hsa
uauacauuccauagucaucaaggaauauauugugcagagagaguauccuugacugcuuaaguca

SEQ ID NO: 365513 - RNA, 64 nt, hsa
cacuccagacggcuuucucaguuccaagauuuugcagagagaaggagcaaaccuuuucauugga

SEQ ID NO: 365514 - RNA, 64 nt, hsa
uuuaugagaauuauaaguaaagcuuucuguauuucagagagacauaaguuacuagaaagugaaa

SEQ ID NO: 365515 - RNA, 64 nt, hsa
aaaaggagaaagauaaaauacagaagacuggccccagagagaccucagaucaguauugugcauu

SEQ ID NO: 365516 - RNA, 64 nt, hsa
cucugcucugagcagccugggaugcugaacucuucagagagauuuuuuuauagagagauuucua

SEQ ID NO: 365517 - RNA, 64 nt, hsa
gugcugaggagguuggagagagaaagggugaaagcagagagaccagugcagggcuguuaacagg

SEQ ID NO: 365518 - RNA, 64 nt, hsa
caggggagggcugcccaucuccccaacccagucacagagagauaggaaacggcauuugaguggg

SEQ ID NO: 365519 - RNA, 64 nt, hsa
auaugugcuguuuggcaccguggcaagaugguaucagagagaaacccaucaauugcucaaauac

SEQ ID NO: 365520 - RNA, 64 nt, hsa
aagcaaaugagguuccaggggggaguacuccaagcagagagaauggcaugugugaaggugugug

SEQ ID NO: 365521 - RNA, 64 nt, hsa
gggugccaagcucagagggggaaaaaaagauagccagagagagaccuggcccucaaaaaggugu

SEQ ID NO: 365522 - RNA, 64 nt, hsa
uacuuagaauagguuuugaaugggagagguagaacagagagagaauuaagaagggaucugacuu

SEQ ID NO: 365523 - RNA, 64 nt, hsa
gcuggggguggagggguauaagaggagggagagucagagagaguguguaugggugugugugagu

SEQ ID NO: 365524 - RNA, 64 nt, hsa
gagccucuggggggcaccuguuuccccagugacucagagagagcaagacugcaggaacggaggg

SEQ ID NO: 365525 - RNA, 64 nt, hsa
uccucgucugggugugcgcacagggcuuuguuagcagagagaagccccugaggagaagggacgc

SEQ ID NO: 365526 - RNA, 64 nt, hsa
ccucuucccaugaccuaaaacacugugaggaaaaaucauucaaguggcaugccaagucccuaug

SEQ ID NO: 365527 - RNA, 64 nt, hsa
auauguagaaaagugggguccuuuugaauaaaagaucauucaacuaaaaauauuaaaauuuauu

SEQ ID NO: 365528 - RNA, 64 nt, hsa
uuguggguaaaagcuaauggccaaaaugguugcaaucauucauacuaguuagaaaaauuaugug

SEQ ID NO: 365529 - RNA, 64 nt, hsa
cuuucuaaguauuuccagaaauaccugauuuugaaucauucaacaguagaaaaagaggcauauu

SEQ ID NO: 365530 - RNA, 64 nt, hsa
cuuugccuauuaagucuaccaaauuaaaagucuuaucauucagcguguuuugagaguuaauaau

SEQ ID NO: 365531 - RNA, 64 nt, hsa
acuaaagacuugagauuauauaaaauuauccagaaucauucagcuaauacuauuggaauauagu

SEQ ID NO: 365532 - RNA, 64 nt, hsa
aauggcuucaggacauggguucucuucuccugugaucauucaagugcucacugcaugaagacug

SEQ ID NO: 365533 - RNA, 64 nt, hsa
uucaagcuguacugugagcagacgcauugguauuaucauucaaagcagucucccucuuauuugu

SEQ ID NO: 365534 - RNA, 64 nt, hsa
ugggugcaagucagcauuguaaguuuucucagguuauuauuauuagagagguuggaaacauugg

SEQ ID NO: 365535 - RNA, 64 nt, hsa
gugcaagucagcauuguaaguuuucucagguuauuauuauuagagagguuggaaacauugguaa

SEQ ID NO: 365536 - RNA, 64 nt, hsa
uggaauucauugccuuaggucuuuuuaaauaguguauuauuaucguuggggcuggcucuaugcu

SEQ ID NO: 365537 - RNA, 64 nt, hsa
aaaguggucucaaccuaacaucagaaguguuucuuauuauuauuuuauauugaguugaauauug

SEQ ID NO: 365538 - RNA, 64 nt, hsa
gguaaaacccagguuagucaucaguaaccuucucuauuauuauuauuuuuuagaaacuuggaau

SEQ ID NO: 365539 - RNA, 64 nt, hsa
aaaacccagguuagucaucaguaaccuucucuauuauuauuauuuuuuagaaacuuggaauacu

SEQ ID NO: 365540 - RNA, 64 nt, hsa
auuuauguuauuuaugauguuauuuuguacguguuauuauuauuauauuguuuuauaaauggag

SEQ ID NO: 365541 - RNA, 64 nt, hsa
uauguuauuuaugauguuauuuuguacguguuauuauuauuauauuguuuuauaaauggaggua

SEQ ID NO: 365542 - RNA, 64 nt, hsa
gcuaacuacacuuugauacuaacuccaguuuuacuauuauuauuuugguuggaaaaaaaauuca

SEQ ID NO: 365543 - RNA, 64 nt, hsa
gagaauauuuuuaauuugcugcaguacuaugucauauuauuaguaugaaucucauuucccaaag

SEQ ID NO: 365544 - RNA, 64 nt, hsa
gagaauguaguugaaauuauucuuaaacaucuuuuauuauuauuacucucaguaguaaaauauc

SEQ ID NO: 365545 - RNA, 64 nt, hsa
aauguaguugaaauuauucuuaaacaucuuuuauuauuauuacucucaguaguaaaauaucaca

SEQ ID NO: 365546 - RNA, 64 nt, hsa
uuuuuuuuaguuuuuaaauucuuccucuucuuuuuauuauuauucuaauuauuauuauuuuauu

SEQ ID NO: 365547 - RNA, 64 nt, hsa
aaauucuuccucuucuuuuuauuauuauucuaauuauuauuauuuuauuauuuacaagacuuuu

SEQ ID NO: 365548 - RNA, 64 nt, hsa
uccagaaucucgaagaaaaaagaaaaaagagugguauuauuaugggcaaauaaucauauuccca

SEQ ID NO: 365549 - RNA, 64 nt, hsa
ugcacuagggaggaaggauaaaugcuuuuuauguuauuauuauuaauuauuacaaugaccacca

SEQ ID NO: 365550 - RNA, 64 nt, hsa
acuagggaggaaggauaaaugcuuuuuauguuauuauuauuaauuauuacaaugaccaccauuu

SEQ ID NO: 365551 - RNA, 64 nt, hsa
aaaaacccagacaucagauguuuuuauuuuauauuauuauuauagaaggugguaccauuaucaa

SEQ ID NO: 365552 - RNA, 64 nt, hsa
ugaaaaaacccagacaucagauguuuuuauuuuauauuauuauuauagaaggugguaccauuau

SEQ ID NO: 365553 - RNA, 64 nt, hsa
cccagcccgacaaugucgaguauauuauuauuaauauuauuaugaauuuuuguaagaaaccgag

SEQ ID NO: 365554 - RNA, 64 nt, hsa
gggccacgccccagcccgacaaugucgaguauauuauuauuaauauuauuaugaauuuuuguaa

SEQ ID NO: 365555 - RNA, 64 nt, hsa
cccgggccacgccccagcccgacaaugucgaguauauuauuauuaauauuauuaugaauuuuug

SEQ ID NO: 365556 - RNA, 64 nt, hsa
aagcaguguaggauuuucucuccucaagagcguguauuauuaucuaguagaaaaagcauuccca

SEQ ID NO: 365557 - RNA, 64 nt, hsa
ugcacucacccuguuuguggcuauuuuaaauucauauuauuaaaaaacaaaaaaaacccaccua

SEQ ID NO: 365558 - RNA, 64 nt, hsa
agauaaacuuuccugucauguguuagaacuuuauuauuauuaauauuguuaaacuucugugcug

SEQ ID NO: 365559 - RNA, 64 nt, hsa
uccagauaaacuuuccugucauguguuagaacuuuauuauuauuaauauuguuaaacuucugug

SEQ ID NO: 365560 - RNA, 64 nt, hsa
uuacauuuguguauaauuauuauauuauuauuauuauuauuauauuuuuuuuaauuuggauucu

SEQ ID NO: 365561 - RNA, 64 nt, hsa
cgguuacauuuguguauaauuauuauauuauuauuauuauuauuauauuuuuuuuaauuuggau

SEQ ID NO: 365562 - RNA, 64 nt, hsa
ugacgguuacauuuguguauaauuauuauauuauuauuauuauuauuauauuuuuuuuaauuug

SEQ ID NO: 365563 - RNA, 64 nt, hsa
uguugacgguuacauuuguguauaauuauuauauuauuauuauuauuauuauauuuuuuuuaau

SEQ ID NO: 365564 - RNA, 64 nt, hsa
uccuguugacgguuacauuuguguauaauuauuauauuauuauuauuauuauuauauuuuuuuu

SEQ ID NO: 365565 - RNA, 64 nt, hsa
cugacucccacuucuaauuucucuuuauuguuauuauuauuauuuucucugcuauuguaauauu

SEQ ID NO: 365566 - RNA, 64 nt, hsa
acccugacucccacuucuaauuucucuuuauuguuauuauuauuauuuucucugcuauuguaau

SEQ ID NO: 365567 - RNA, 64 nt, hsa
uuuuuuuaauuauuguuauuauaauuauaauuauuauuauuauugacaugaggaaaccuagcac

SEQ ID NO: 365568 - RNA, 64 nt, hsa
gauuuuuuuuaauuauuguuauuauaauuauaauuauuauuauuauugacaugaggaaaccuag

SEQ ID NO: 365569 - RNA, 64 nt, hsa
gacagagguugcugaacuuuaaaaaaaauuaauuuauuauuauaaugaccuaauuuauuaaucu

SEQ ID NO: 365570 - RNA, 64 nt, hsa
acuaacaggauauaggacaagguguaaauuuuuuuauuauuauuuuaaagauaugauuuauccu

SEQ ID NO: 365571 - RNA, 64 nt, hsa
acugguguuuuucccccgcauuugguggauuuuuuauuauuauucaaaaacauaacugaguuuu

SEQ ID NO: 365572 - RNA, 64 nt, hsa
uccccucacauucucuauguacuauguauguauguauuauuauuauugcugccaagagggucug

SEQ ID NO: 365573 - RNA, 64 nt, hsa
ccucacauucucuauguacuauguauguauguauuauuauuauugcugccaagagggucugaug

SEQ ID NO: 365574 - RNA, 64 nt, hsa
gccuacagcugccuccuagaauauagacugucuguauuauuauucaccuauaauuagucauuau

SEQ ID NO: 365575 - RNA, 64 nt, hsa
aucugguuaccaaacauaaaugcugaacauuccauauuauuauaguuaaugucuuaauccagcu

SEQ ID NO: 365576 - RNA, 64 nt, hsa
gcacaaaacaaaugcucaguggauggaagcugccuauuauuauugucguuguuguuguuugcca

SEQ ID NO: 365577 - RNA, 64 nt, hsa
uucuacugggaauuagaauggugcauacacaauguauuauuaucacugucagaugagcaugcuu

SEQ ID NO: 365578 - RNA, 64 nt, hsa
cauuuuacccuaggguauaaaacuauuuuucuuuuauuauuauuauuauuauuauuauacuuua

SEQ ID NO: 365579 - RNA, 64 nt, hsa
uuuacccuaggguauaaaacuauuuuucuuuuauuauuauuauuauuauuauuauacuuuaagu

SEQ ID NO: 365580 - RNA, 64 nt, hsa
acccuaggguauaaaacuauuuuucuuuuauuauuauuauuauuauuauuauacuuuaaguuuu

SEQ ID NO: 365581 - RNA, 64 nt, hsa
cuaggguauaaaacuauuuuucuuuuauuauuauuauuauuauuauuauacuuuaaguuuuagg

SEQ ID NO: 365582 - RNA, 64 nt, hsa
ggguauaaaacuauuuuucuuuuauuauuauuauuauuauuauuauacuuuaaguuuuagggua

SEQ ID NO: 365583 - RNA, 64 nt, hsa
uauaaaacuauuuuucuuuuauuauuauuauuauuauuauuauacuuuaaguuuuaggguacau

SEQ ID NO: 365584 - RNA, 64 nt, hsa
cagugcaggaucuaaugacuguacauauuauuguuauuauuauuauuguuauuauuguuguucu

SEQ ID NO: 365585 - RNA, 64 nt, hsa
ugcaggaucuaaugacuguacauauuauuguuauuauuauuauuguuauuauuguuguucugua

SEQ ID NO: 365586 - RNA, 64 nt, hsa
aagccuugauagaauuuguucauaauggcucauguauuauuauuauuuuugagauggaguuuug

SEQ ID NO: 365587 - RNA, 64 nt, hsa
ccuugauagaauuuguucauaauggcucauguauuauuauuauuuuugagauggaguuuugcuc

SEQ ID NO: 365588 - RNA, 64 nt, hsa
uauuauuuuugagauggaguuuugcucuuaaugauauuauuauuauuugagacagaguuuugcu

SEQ ID NO: 365589 - RNA, 64 nt, hsa
uauuuuugagauggaguuuugcucuuaaugauauuauuauuauuugagacagaguuuugcucuu

SEQ ID NO: 365590 - RNA, 64 nt, hsa
uucauguuaaauguguuuguauacacaugucauuuauuauuauuacuuuaagauagguauuauu

SEQ ID NO: 365591 - RNA, 64 nt, hsa
auguuaaauguguuuguauacacaugucauuuauuauuauuacuuuaagauagguauuauucau

SEQ ID NO: 365592 - RNA, 64 nt, hsa
uuggggucacaguucuauuuuguuugugaguuuguauuauuauuauuauuauuauuauuauuau

SEQ ID NO: 365593 - RNA, 64 nt, hsa
gggucacaguucuauuuuguuugugaguuuguauuauuauuauuauuauuauuauuauuauauu

SEQ ID NO: 365594 - RNA, 64 nt, hsa
ucacaguucuauuuuguuugugaguuuguauuauuauuauuauuauuauuauuauuauauuuua

SEQ ID NO: 365595 - RNA, 64 nt, hsa
caguucuauuuuguuugugaguuuguauuauuauuauuauuauuauuauuauuauauuuuauuu

SEQ ID NO: 365596 - RNA, 64 nt, hsa
uucuauuuuguuugugaguuuguauuauuauuauuauuauuauuauuauuauauuuuauuucuu

SEQ ID NO: 365597 - RNA, 64 nt, hsa
uauuuuguuugugaguuuguauuauuauuauuauuauuauuauuauuauauuuuauuucuuugg

SEQ ID NO: 365598 - RNA, 64 nt, hsa
uuuguuugugaguuuguauuauuauuauuauuauuauuauuauuauauuuuauuucuuuggucu

SEQ ID NO: 365599 - RNA, 64 nt, hsa
guuugugaguuuguauuauuauuauuauuauuauuauuauuauauuuuauuucuuuggucugug

SEQ ID NO: 365600 - RNA, 64 nt, hsa
uucugagagcuccuuuuuugccaagauuccauacuauuauuauauuagagaggcgugucaaggc

SEQ ID NO: 365601 - RNA, 64 nt, hsa
gucucauauuucguggaacuccugugcaaacauauauuauuaaauuuuuuuuccuccugucaau

SEQ ID NO: 365602 - RNA, 64 nt, hsa
auuuuccaagguuagauuccaauaaauaucuauuuauuauuaaauauuaaaauaucuauuuauu

SEQ ID NO: 365603 - RNA, 64 nt, hsa
uaucuauuuauuauuaaauauuaaaauaucuauuuauuauuaaaaccauuuauaaggcuuuuuc

SEQ ID NO: 365604 - RNA, 64 nt, hsa
auaauggaaugauuuaaauugaagugacaaagaguauuauuaaaauacaauguuuauacgucua

SEQ ID NO: 365605 - RNA, 64 nt, hsa
ugugacaaaccauggcaaauuuuuaaaggggaaguauuauuauaaaaugaagaaauauguauuu

SEQ ID NO: 365606 - RNA, 64 nt, hsa
aggugcccgcacuaccauacaucaguauuuuuauuauuauuauuguuauuccuuuuuaauuuaa

SEQ ID NO: 365607 - RNA, 64 nt, hsa
aaaaggugcccgcacuaccauacaucaguauuuuuauuauuauuauuguuauuccuuuuuaauu

SEQ ID NO: 365608 - RNA, 64 nt, hsa
cucuauuacauaucucuuuuuuucuuguuuuuauuauuauuauacuuuaaguuuuaggguacau

SEQ ID NO: 365609 - RNA, 64 nt, hsa
cuucucuauuacauaucucuuuuuuucuuguuuuuauuauuauuauacuuuaaguuuuagggua

SEQ ID NO: 365610 - RNA, 64 nt, hsa
ucugugccaggcaacaugcuaacugcuguauauauauuauuauauuuguacuuuggcaagaauc

SEQ ID NO: 365611 - RNA, 64 nt, hsa
uaguauccuuuuagauacaaaagcuuauuuucauuauuauuauaauaaacaguuaaugguugaa

SEQ ID NO: 365612 - RNA, 64 nt, hsa
aaaugaaucugagcugauggugacuuuaaguuaauauuauuaauauaucacugcauauuuuuac

SEQ ID NO: 365613 - RNA, 64 nt, hsa
ugaaaagggagaauaaugugaauaucacggcuuauauuauuaaauguugauugauggcuuguaa

SEQ ID NO: 365614 - RNA, 64 nt, hsa
aguugaaacaaaaaaaacccccagacuguaauaguauuauuauuauuuuuuaagauggaaucuu

SEQ ID NO: 365615 - RNA, 64 nt, hsa
ugaaacaaaaaaaacccccagacuguaauaguauuauuauuauuuuuuaagauggaaucuugcu

SEQ ID NO: 365616 - RNA, 64 nt, hsa
ugaaggucuuuguuaugacagugaauauugcuuuuauuauuauuauugcugaagugguugcauu

SEQ ID NO: 365617 - RNA, 64 nt, hsa
aggucuuuguuaugacagugaauauugcuuuuauuauuauuauugcugaagugguugcauucua

SEQ ID NO: 365618 - RNA, 64 nt, hsa
auugggcaagcauugguaauaaauggaauaagacuauuauuauuauuauuugagauggagucuc

SEQ ID NO: 365619 - RNA, 64 nt, hsa
gggcaagcauugguaauaaauggaauaagacuauuauuauuauuauuugagauggagucucacu

SEQ ID NO: 365620 - RNA, 64 nt, hsa
caagcauugguaauaaauggaauaagacuauuauuauuauuauuugagauggagucucacucug

SEQ ID NO: 365621 - RNA, 64 nt, hsa
auuuuccccaauggcuuuuugacaaguauaaagcuauuauuacauuguauuuuuuaaauguaaa

SEQ ID NO: 365622 - RNA, 64 nt, hsa
uauauugacauugccauugaauagcucuagcaacuauuauuauucccccaaacccuaaaauucu

SEQ ID NO: 365623 - RNA, 64 nt, hsa
auugagggauagauuguaucucuuaaaguggucauauuauuauuaauuuugccaaaagaagaag

SEQ ID NO: 365624 - RNA, 64 nt, hsa
gagggauagauuguaucucuuaaaguggucauauuauuauuaauuuugccaaaagaagaagaau

SEQ ID NO: 365625 - RNA, 64 nt, hsa
ugacccuacucccuugcccuagauaguuuauuauuauuauuauuuuggggucucuuuuguaaau

SEQ ID NO: 365626 - RNA, 64 nt, hsa
accugacccuacucccuugcccuagauaguuuauuauuauuauuauuuuggggucucuuuugua

SEQ ID NO: 365627 - RNA, 64 nt, hsa
aggaccugacccuacucccuugcccuagauaguuuauuauuauuauuauuuuggggucucuuuu

SEQ ID NO: 365628 - RNA, 64 nt, hsa
uaugguuucuaauaggauuuuuuauuauuguuauuauuauuauuggguuuuuuuggacaggguu

SEQ ID NO: 365629 - RNA, 64 nt, hsa
ccuuaugguuucuaauaggauuuuuuauuauuguuauuauuauuauuggguuuuuuuggacagg

SEQ ID NO: 365630 - RNA, 64 nt, hsa
auaacuuaucugcuauuauuaguuucuuauuccuuauuauuaaucuguuagcucauuaucauua

SEQ ID NO: 365631 - RNA, 64 nt, hsa
uuggccuuuuauuuucuuuccauaacuuaucugcuauuauuaguuucuuauuccuuauuauuaa

SEQ ID NO: 365632 - RNA, 64 nt, hsa
cuaaaugccacacuguauguuucuaacauauuauuauuauuauaaaaaaugugugaauaucagu

SEQ ID NO: 365633 - RNA, 64 nt, hsa
auacuaaaugccacacuguauguuucuaacauauuauuauuauuauaaaaaaugugugaauauc

SEQ ID NO: 365634 - RNA, 64 nt, hsa
uauauacuaaaugccacacuguauguuucuaacauauuauuauuauuauaaaaaaugugugaau

SEQ ID NO: 365635 - RNA, 64 nt, hsa
uccuaauauaaaguacuggcucauagggccaggguauuauuauagaauauuauucucgcaugua

SEQ ID NO: 365636 - RNA, 64 nt, hsa
guaggucucucugguucuuucuauaucaucauuuuauuauuauguccuaauauaaaguacuggc

SEQ ID NO: 365637 - RNA, 64 nt, hsa
uaauccaguuccuaaagauuauuauuauuauuauuauuauuauuuuuuuuuuuuugagacggag

SEQ ID NO: 365638 - RNA, 64 nt, hsa
acuuaauccaguuccuaaagauuauuauuauuauuauuauuauuauuuuuuuuuuuuugagacg

SEQ ID NO: 365639 - RNA, 64 nt, hsa
cacacuuaauccaguuccuaaagauuauuauuauuauuauuauuauuauuuuuuuuuuuuugag

SEQ ID NO: 365640 - RNA, 64 nt, hsa
cuccacacuuaauccaguuccuaaagauuauuauuauuauuauuauuauuauuuuuuuuuuuuu

SEQ ID NO: 365641 - RNA, 64 nt, hsa
cuucuccacacuuaauccaguuccuaaagauuauuauuauuauuauuauuauuauuuuuuuuuu

SEQ ID NO: 365642 - RNA, 64 nt, hsa
ucucuucuccacacuuaauccaguuccuaaagauuauuauuauuauuauuauuauuauuuuuuu

SEQ ID NO: 365643 - RNA, 64 nt, hsa
uuauuucuuuauuaacccucugaguuuuuguauguauuauuauuaaagaaaaaugcaaucagga

SEQ ID NO: 365644 - RNA, 64 nt, hsa
uuucuuuauuaacccucugaguuuuuguauguauuauuauuaaagaaaaaugcaaucaggauuu

SEQ ID NO: 365645 - RNA, 64 nt, hsa
ccccccaaauaccuuuuuaaccccucugauuggcuauuauuacuauauuuauuauuauuuauug

SEQ ID NO: 365646 - RNA, 64 nt, hsa
uuuaaccccucugauuggcuauuauuacuauauuuauuauuauuuauugaaaccuuagggaaga

SEQ ID NO: 365647 - RNA, 64 nt, hsa
gguuguuguuauuuuuauuguauuauuguuauuuuauuauuauuauuguuauaauuuuauuuug

SEQ ID NO: 365648 - RNA, 64 nt, hsa
uguuguuauuuuuauuguauuauuguuauuuuauuauuauuauuguuauaauuuuauuuuguug

SEQ ID NO: 365649 - RNA, 64 nt, hsa
aagucagaaaaaaaaaacaagagagagaaauucauauuauuauuauuauuauaauacaauauuu

SEQ ID NO: 365650 - RNA, 64 nt, hsa
ucagaaaaaaaaaacaagagagagaaauucauauuauuauuauuauuauaauacaauauuuuuu

SEQ ID NO: 365651 - RNA, 64 nt, hsa
gaaaaaaaaaacaagagagagaaauucauauuauuauuauuauuauaauacaauauuuuuuuua

SEQ ID NO: 365652 - RNA, 64 nt, hsa
aaaaaaaacaagagagagaaauucauauuauuauuauuauuauaauacaauauuuuuuuuaaaa

SEQ ID NO: 365653 - RNA, 64 nt, hsa
cacuugguuauaacucuuuaguuggauauaacauuauuauuauuuugauaaaauauggaacaaa

SEQ ID NO: 365654 - RNA, 64 nt, hsa
cuuugaaauauuaauuuacauaaaggccuucauauauuauuacguguuauauauuacguguuau

SEQ ID NO: 365655 - RNA, 64 nt, hsa
cauuugcaucaugguuuuuaaaauuuauuauuauuauuauuauuguugggacaggugccauuua

SEQ ID NO: 365656 - RNA, 64 nt, hsa
ugccauuugcaucaugguuuuuaaaauuuauuauuauuauuauuauuguugggacaggugccau

SEQ ID NO: 365657 - RNA, 64 nt, hsa
aucugccauuugcaucaugguuuuuaaaauuuauuauuauuauuauuauuguugggacaggugc

SEQ ID NO: 365658 - RNA, 64 nt, hsa
uuuaucugccauuugcaucaugguuuuuaaaauuuauuauuauuauuauuauuguugggacagg

SEQ ID NO: 365659 - RNA, 64 nt, hsa
aauuuuaauggcugaaauuugcaucaacauguauuauuauuacuuuauccuggaacaugcaaaa

SEQ ID NO: 365660 - RNA, 64 nt, hsa
uuuaauuuuaauggcugaaauuugcaucaacauguauuauuauuacuuuauccuggaacaugca

SEQ ID NO: 365661 - RNA, 64 nt, hsa
gucacugaaaaaugggaaaaccucuaccaugccuuauuauuacccuuugcuguuugaggagcca

SEQ ID NO: 365662 - RNA, 64 nt, hsa
ucuuuuucucaaaugccauaauuaacugaaauacuauuauuaaauuuucaugagaauucuaaaa

SEQ ID NO: 365663 - RNA, 64 nt, hsa
uauuugauugccuccucuucccuuucaguauauguauuauuaauauuauuauuauuauuauuau

SEQ ID NO: 365664 - RNA, 64 nt, hsa
gccuccucuucccuuucaguauauguauuauuaauauuauuauuauuauuauuauuauuaguuc

SEQ ID NO: 365665 - RNA, 64 nt, hsa
uccucuucccuuucaguauauguauuauuaauauuauuauuauuauuauuauuauuaguucauc

SEQ ID NO: 365666 - RNA, 64 nt, hsa
ucuucccuuucaguauauguauuauuaauauuauuauuauuauuauuauuauuaguucaucagu

SEQ ID NO: 365667 - RNA, 64 nt, hsa
ucccuuucaguauauguauuauuaauauuauuauuauuauuauuauuauuaguucaucaguuug

SEQ ID NO: 365668 - RNA, 64 nt, hsa
cuuucaguauauguauuauuaauauuauuauuauuauuauuauuauuaguucaucaguuugcug

SEQ ID NO: 365669 - RNA, 64 nt, hsa
ucaguauauguauuauuaauauuauuauuauuauuauuauuauuaguucaucaguuugcuguuc

SEQ ID NO: 365670 - RNA, 64 nt, hsa
guauauguauuauuaauauuauuauuauuauuauuauuauuaguucaucaguuugcuguucucu

SEQ ID NO: 365671 - RNA, 64 nt, hsa
gagagaaugagaugaaaaacgauuaauguuucauuauuauuauugugaaaauauuauuaacacu

SEQ ID NO: 365672 - RNA, 64 nt, hsa
aacgauuaauguuucauuauuauuauugugaaaauauuauuaacacuggggacuccuuaagagu

SEQ ID NO: 365673 - RNA, 64 nt, hsa
ccacugcaucugcaaauuuaguuuuggguuuuuuuauuauuauuauuuugaguuuuuuugugug

SEQ ID NO: 365674 - RNA, 64 nt, hsa
cugcaucugcaaauuuaguuuuggguuuuuuuauuauuauuauuuugaguuuuuuugugugugu

SEQ ID NO: 365675 - RNA, 64 nt, hsa
uuucuaaaagacuuuucaguauuacaacuaauacuauuauuauccuucuuuuuuuauuuagaua

SEQ ID NO: 365676 - RNA, 64 nt, hsa
auaggcacccaccaccacgcccagcuaauuuuuguauuauuaguagagacaggguuucaccaug

SEQ ID NO: 365677 - RNA, 64 nt, hsa
aaaacggcaaacccaccccauuuuuuaauuuuauuauuauuaauuuuuuuuguuggcaaaagaa

SEQ ID NO: 365678 - RNA, 64 nt, hsa
aagaaaacggcaaacccaccccauuuuuuaauuuuauuauuauuaauuuuuuuuguuggcaaaa

SEQ ID NO: 365679 - RNA, 64 nt, hsa
ugcuagacaguuaaacuggcuuaacuuaguauauuauuauuaauuacaauguaauagaagcuua

SEQ ID NO: 365680 - RNA, 64 nt, hsa
uuuugcuagacaguuaaacuggcuuaacuuaguauauuauuauuaauuacaauguaauagaagc

SEQ ID NO: 365681 - RNA, 64 nt, hsa
aguucagguuuaugugugugcauuucuuuuuuauuauuauuaaauaaacaacuuggagggaguu

SEQ ID NO: 365682 - RNA, 64 nt, hsa
gggaguucagguuuaugugugugcauuucuuuuuuauuauuauuaaauaaacaacuuggaggga

SEQ ID NO: 365683 - RNA, 64 nt, hsa
uagcauuguauauuauuauugcuguugucacuguuauuauuauuguggauacuggcccuuggug

SEQ ID NO: 365684 - RNA, 64 nt, hsa
auagaauagauuuuaauaaucuuauagcauuguauauuauuauugcuguugucacuguuauuau

SEQ ID NO: 365685 - RNA, 64 nt, hsa
uuacacuaaccauuuuuaaagugcacaaaaauauuauuauuagucuuaacuaaaauuacauauu

SEQ ID NO: 365686 - RNA, 64 nt, hsa
agauuacacuaaccauuuuuaaagugcacaaaaauauuauuauuagucuuaacuaaaauuacau

SEQ ID NO: 365687 - RNA, 64 nt, hsa
cugcugccagaauuauauuaauuauuauuaauguuauuauuagaaaaaaaauuucuggagugag

SEQ ID NO: 365688 - RNA, 64 nt, hsa
cauagauuugugcugcugccagaauuauauuaauuauuauuaauguuauuauuagaaaaaaaau

SEQ ID NO: 365689 - RNA, 64 nt, hsa
cuauuuuauaugaauauacuuuuuauauauuuauuauuauuaaauauuucuacuuaaugaauca

SEQ ID NO: 365690 - RNA, 64 nt, hsa
uuucuauuuuauaugaauauacuuuuuauauauuuauuauuauuaaauauuucuacuuaaugaa

SEQ ID NO: 365691 - RNA, 64 nt, hsa
ccuaaauauuuuaucaucuuuaaauuuguuucuguauuauuauaugugcuccugaagcgagcac

SEQ ID NO: 365692 - RNA, 64 nt, hsa
aauauuuauuaaauauauuuauuuauuuaaauguuauuauuacuuuaaauauuauuuuaaauau

SEQ ID NO: 365693 - RNA, 64 nt, hsa
cauccuaaaucuuuuaccuuucaaucuuuguaucuauuauuacacgugcugcugaagggagcau

SEQ ID NO: 365694 - RNA, 64 nt, hsa
cccuuuccauucaguuuauuuugcagcagguuuuuauuauuauuauuauuauuauuauucacaa

SEQ ID NO: 365695 - RNA, 64 nt, hsa
uuuccauucaguuuauuuugcagcagguuuuuauuauuauuauuauuauuauuauucacaacag

SEQ ID NO: 365696 - RNA, 64 nt, hsa
ccauucaguuuauuuugcagcagguuuuuauuauuauuauuauuauuauuauucacaacagaca

SEQ ID NO: 365697 - RNA, 64 nt, hsa
uucaguuuauuuugcagcagguuuuuauuauuauuauuauuauuauuauucacaacagacacuu

SEQ ID NO: 365698 - RNA, 64 nt, hsa
aguuuauuuugcagcagguuuuuauuauuauuauuauuauuauuauucacaacagacacuuucc

SEQ ID NO: 365699 - RNA, 64 nt, hsa
uuauuuugcagcagguuuuuauuauuauuauuauuauuauuauucacaacagacacuuucccua

SEQ ID NO: 365700 - RNA, 64 nt, hsa
gaauuuuuuucucucuguacuuuauuuaauuuauuauuauuauuuuuugagacagagucuugcu

SEQ ID NO: 365701 - RNA, 64 nt, hsa
gaugaauuuuuuucucucuguacuuuauuuaauuuauuauuauuauuuuuugagacagagucuu

SEQ ID NO: 365702 - RNA, 64 nt, hsa
agacauaagcauacauaauugaauauauuguugcuauuauuauuuugaacaaacuacaucuuag

SEQ ID NO: 365703 - RNA, 64 nt, hsa
uguuuauuuauuuauuuuuaauuuuuuaauuuuauauuauuauuauuauuauuauacuuuaagg

SEQ ID NO: 365704 - RNA, 64 nt, hsa
uuauuuauuuauuuuuaauuuuuuaauuuuauauuauuauuauuauuauuauacuuuaagguuu

SEQ ID NO: 365705 - RNA, 64 nt, hsa
uuuauuuauuuuuaauuuuuuaauuuuauauuauuauuauuauuauuauacuuuaagguuuagg

SEQ ID NO: 365706 - RNA, 64 nt, hsa
auuuauuuuuaauuuuuuaauuuuauauuauuauuauuauuauuauacuuuaagguuuagggua

SEQ ID NO: 365707 - RNA, 64 nt, hsa
uauuuuuaauuuuuuaauuuuauauuauuauuauuauuauuauacuuuaagguuuaggguacau

SEQ ID NO: 365708 - RNA, 64 nt, hsa
cagcagccuaaaucuccuccuuggauaauguuaauauuauuauuauuauuaacaaaaaauauau

SEQ ID NO: 365709 - RNA, 64 nt, hsa
cagccuaaaucuccuccuuggauaauguuaauauuauuauuauuauuaacaaaaaauauauauu

SEQ ID NO: 365710 - RNA, 64 nt, hsa
ccuaaaucuccuccuuggauaauguuaauauuauuauuauuauuaacaaaaaauauauauuuuu

SEQ ID NO: 365711 - RNA, 64 nt, hsa
aaaucuccuccuuggauaauguuaauauuauuauuauuauuaacaaaaaauauauauuuuuaaa

SEQ ID NO: 365712 - RNA, 64 nt, hsa
uuaaacuuauuauuauuguuaauauuauuauuauuauuauuaauaaagugaggcaggaaaaugc

SEQ ID NO: 365713 - RNA, 64 nt, hsa
uccuuaaacuuauuauuauuguuaauauuauuauuauuauuauuaauaaagugaggcaggaaaa

SEQ ID NO: 365714 - RNA, 64 nt, hsa
agcuccuuaaacuuauuauuauuguuaauauuauuauuauuauuauuaauaaagugaggcagga

SEQ ID NO: 365715 - RNA, 64 nt, hsa
ccaagcuccuuaaacuuauuauuauuguuaauauuauuauuauuauuauuaauaaagugaggca

SEQ ID NO: 365716 - RNA, 64 nt, hsa
aacccaagcuccuuaaacuuauuauuauuguuaauauuauuauuauuauuauuaauaaagugag

SEQ ID NO: 365717 - RNA, 64 nt, hsa
ggggacauggagaacaacccaagcuccuuaaacuuauuauuauuguuaauauuauuauuauuau

SEQ ID NO: 365718 - RNA, 64 nt, hsa
acaccuuuccuggaugauaugcaaucgaaugcuauauuauuaaacgcauuuuucuccuuaauaa

SEQ ID NO: 365719 - RNA, 64 nt, hsa
uuucauuuuuucauaauguuaccauuuucuuaaauauuauuacaaaauuuuaagucugucuaau

SEQ ID NO: 365720 - RNA, 64 nt, hsa
gauuauuauuaauauuauuguuguuguuaauuauuauuauuauuucauaugcugaugcuuugug

SEQ ID NO: 365721 - RNA, 64 nt, hsa
ucagauuauuauuaauauuauuguuguuguuaauuauuauuauuauuucauaugcugaugcuuu

SEQ ID NO: 365722 - RNA, 64 nt, hsa
auuaaauccaacagacgcugccggucggucagauuauuauuaauauuauuguuguuguuaauua

SEQ ID NO: 365723 - RNA, 64 nt, hsa
uggguucugaugcuuuuuccuucuccuuuccuuuuauuauuauuauuuuuuucuuuuaagaacu

SEQ ID NO: 365724 - RNA, 64 nt, hsa
guucugaugcuuuuuccuucuccuuuccuuuuauuauuauuauuuuuuucuuuuaagaacuaag

SEQ ID NO: 365725 - RNA, 64 nt, hsa
ucaagcuguucucucucucucuuuuuuuuaauuuuauuauuauuauuuuggcaacauguacauu

SEQ ID NO: 365726 - RNA, 64 nt, hsa
agcuguucucucucucucuuuuuuuuaauuuuauuauuauuauuuuggcaacauguacauuucu

SEQ ID NO: 365727 - RNA, 64 nt, hsa
uuugggucuguuuuuucaugcuuugcuuuuuaauuauuauuauuauuuuuuuuacauuaggaca

SEQ ID NO: 365728 - RNA, 64 nt, hsa
gggucuguuuuuucaugcuuugcuuuuuaauuauuauuauuauuuuuuuuacauuaggacauuu

SEQ ID NO: 365729 - RNA, 64 nt, hsa
ggguauucagauucugggguuuuucauauuguauuauuauuauucuuaggaauaguucaaugua

SEQ ID NO: 365730 - RNA, 64 nt, hsa
ccaggguauucagauucugggguuuuucauauuguauuauuauuauucuuaggaauaguucaau

SEQ ID NO: 365731 - RNA, 64 nt, hsa
ggcucaugccaccaugcccagcuaauuuuuguauuauuauuauuguuuuuuaguagagacgggg

SEQ ID NO: 365732 - RNA, 64 nt, hsa
acaggcucaugccaccaugcccagcuaauuuuuguauuauuauuauuguuuuuuaguagagacg

SEQ ID NO: 365733 - RNA, 64 nt, hsa
auuuaaaucacuugaguauuuugucaugguucauuauuauuaaagcacaaaauaaccuauuguu

SEQ ID NO: 365734 - RNA, 64 nt, hsa
aaacagccauaucaugaaaaauucuacuuagcuauauuauuauaagcuacauuugcccugaauu

SEQ ID NO: 365735 - RNA, 64 nt, hsa
uuuaaaaaucuuuuguuuuacuuaauucuguuuuuauuauuauuauuauuuuguuugaucuauu

SEQ ID NO: 365736 - RNA, 64 nt, hsa
aaaaaucuuuuguuuuacuuaauucuguuuuuauuauuauuauuauuuuguuugaucuauuaag

SEQ ID NO: 365737 - RNA, 64 nt, hsa
aaucuuuuguuuuacuuaauucuguuuuuauuauuauuauuauuuuguuugaucuauuaaggaa

SEQ ID NO: 365738 - RNA, 64 nt, hsa
ccccgaauugaacacuuuuaaaccuaaagagccuuauuauuauuagcucgagaaauaccacaug

SEQ ID NO: 365739 - RNA, 64 nt, hsa
cgaauugaacacuuuuaaaccuaaagagccuuauuauuauuagcucgagaaauaccacaugcca

SEQ ID NO: 365740 - RNA, 64 nt, hsa
gaaaguugaggccuaaauaaagucuuuuuauaauuauuauuauaacaaugugacauugcacauc

SEQ ID NO: 365741 - RNA, 64 nt, hsa
auuacuaguuuuaauuagcucugcccucaugaaguauuauuauaauucaccauaaacagcuauc

SEQ ID NO: 365742 - RNA, 64 nt, hsa
uuaucaugguuuuuaaaagacugacaguguuuauuauuauuaaaauaaacaggguugguuauau

SEQ ID NO: 365743 - RNA, 64 nt, hsa
uuguuaucaugguuuuuaaaagacugacaguguuuauuauuauuaaaauaaacaggguugguua

SEQ ID NO: 365744 - RNA, 64 nt, hsa
uaugcugcaauagcuuuugcugcuauuaaaaugguauuauuaauaccauaauacucuauucagg

SEQ ID NO: 365745 - RNA, 64 nt, hsa
uuuuuaaagaagaauugggucuuuuuauuauuauuauuauuauuuacagucauauuacugaacu

SEQ ID NO: 365746 - RNA, 64 nt, hsa
cgauuuuuaaagaagaauugggucuuuuuauuauuauuauuauuauuuacagucauauuacuga

SEQ ID NO: 365747 - RNA, 64 nt, hsa
ucucgauuuuuaaagaagaauugggucuuuuuauuauuauuauuauuauuuacagucauauuac

SEQ ID NO: 365748 - RNA, 64 nt, hsa
cguucucgauuuuuaaagaagaauugggucuuuuuauuauuauuauuauuauuuacagucauau

SEQ ID NO: 365749 - RNA, 64 nt, hsa
ugggcuagagaaaucagcugcuaugcggguugauuauuauuauuauuucuaauccuuuuccuua

SEQ ID NO: 365750 - RNA, 64 nt, hsa
gcuagagaaaucagcugcuaugcggguugauuauuauuauuauuucuaauccuuuuccuuauuu

SEQ ID NO: 365751 - RNA, 64 nt, hsa
caguauccaacuucgauacugauagacuuguugauauuauuauuauauguaauccaauuaugaa

SEQ ID NO: 365752 - RNA, 64 nt, hsa
uauccaacuucgauacugauagacuuguugauauuauuauuauauguaauccaauuaugaacug

SEQ ID NO: 365753 - RNA, 64 nt, hsa
uauucuuugcguguagcuauggaaguugcauaauuauuauuauuauuauuauaacaaguguguc

SEQ ID NO: 365754 - RNA, 64 nt, hsa
ucuuugcguguagcuauggaaguugcauaauuauuauuauuauuauuauaacaagugugucuua

SEQ ID NO: 365755 - RNA, 64 nt, hsa
uugcguguagcuauggaaguugcauaauuauuauuauuauuauuauaacaagugugucuuacgu

SEQ ID NO: 365756 - RNA, 64 nt, hsa
cguguagcuauggaaguugcauaauuauuauuauuauuauuauaacaagugugucuuacgugcc

SEQ ID NO: 365757 - RNA, 64 nt, hsa
uaccuuuaccuaaguugcuccuuuauuuuuauuuuauuauuauuauuauuauuauuauuauuuu

SEQ ID NO: 365758 - RNA, 64 nt, hsa
cuuuaccuaaguugcuccuuuauuuuuauuuuauuauuauuauuauuauuauuauuauuuuuug

SEQ ID NO: 365759 - RNA, 64 nt, hsa
uaccuaaguugcuccuuuauuuuuauuuuauuauuauuauuauuauuauuauuauuuuuugaga

SEQ ID NO: 365760 - RNA, 64 nt, hsa
cuaaguugcuccuuuauuuuuauuuuauuauuauuauuauuauuauuauuauuuuuugagaugg

SEQ ID NO: 365761 - RNA, 64 nt, hsa
aguugcuccuuuauuuuuauuuuauuauuauuauuauuauuauuauuauuuuuugagauggagu

SEQ ID NO: 365762 - RNA, 64 nt, hsa
ugcuccuuuauuuuuauuuuauuauuauuauuauuauuauuauuauuuuuugagauggagucuc

SEQ ID NO: 365763 - RNA, 64 nt, hsa
uccuuuauuuuuauuuuauuauuauuauuauuauuauuauuauuuuuugagauggagucucacu

SEQ ID NO: 365764 - RNA, 64 nt, hsa
gaaaagcuugucacaaucuaacuggcuauguuauuauuauuaaauuuauguuuugcaacuuaga

SEQ ID NO: 365765 - RNA, 64 nt, hsa
aaggaaaagcuugucacaaucuaacuggcuauguuauuauuauuaaauuuauguuuugcaacuu

SEQ ID NO: 365766 - RNA, 64 nt, hsa
cacacauacccuauaccccacuauauaaaagucauauuauuauaaauuuccuuauuauauaaac

SEQ ID NO: 365767 - RNA, 64 nt, hsa
ccauauuuuccuauuauuuaucuguucaaauuuguauuauuacaacuaauagcucuugaauucu

SEQ ID NO: 365768 - RNA, 64 nt, hsa
auuaucgcaguauuauuguuguuauuauuauuguuauuauuaacaaucuuggguggguaguagg

SEQ ID NO: 365769 - RNA, 64 nt, hsa
ugaaguauuaauauuaucgcaguauuauuguuguuauuauuauuguuauuauuaacaaucuugg

SEQ ID NO: 365770 - RNA, 64 nt, hsa
ccaggccuggacugaaggcaguuauuuuuauuauuauuauuauuugcaaugagagagaugguug

SEQ ID NO: 365771 - RNA, 64 nt, hsa
ucaccaggccuggacugaaggcaguuauuuuuauuauuauuauuauuugcaaugagagagaugg

SEQ ID NO: 365772 - RNA, 64 nt, hsa
cagucaccaggccuggacugaaggcaguuauuuuuauuauuauuauuauuugcaaugagagaga

SEQ ID NO: 365773 - RNA, 64 nt, hsa
uucucucuuccuuccuguuuuuuccuaguucuuuuauuauuauucuuauauuauuauuauuauu

SEQ ID NO: 365774 - RNA, 64 nt, hsa
cuguuuuuuccuaguucuuuuauuauuauucuuauauuauuauuauuauuauugguuauauacu

SEQ ID NO: 365775 - RNA, 64 nt, hsa
uuuuuuccuaguucuuuuauuauuauucuuauauuauuauuauuauuauugguuauauacuguc

SEQ ID NO: 365776 - RNA, 64 nt, hsa
uuuccuaguucuuuuauuauuauucuuauauuauuauuauuauuauugguuauauacuguccau

SEQ ID NO: 365777 - RNA, 64 nt, hsa
ccuaguucuuuuauuauuauucuuauauuauuauuauuauuauugguuauauacuguccauagu

SEQ ID NO: 365778 - RNA, 64 nt, hsa
uaacuuguaaauauauauguauacauauggaagauauuauuauuaucuagauuacuuuaagccu

SEQ ID NO: 365779 - RNA, 64 nt, hsa
cuuguaaauauauauguauacauauggaagauauuauuauuaucuagauuacuuuaagccuuuu

SEQ ID NO: 365780 - RNA, 64 nt, hsa
gggcggaaguuauucuggcagguacuggugugauuauuauuauuauuuuuaauaaagaguuuua

SEQ ID NO: 365781 - RNA, 64 nt, hsa
cggaaguuauucuggcagguacuggugugauuauuauuauuauuuuuaauaaagaguuuuacag

SEQ ID NO: 365782 - RNA, 64 nt, hsa
cugauaagacagggguuucucuuuuugugaccuuuauuauuauuauuuuguuaacuguuguaac

SEQ ID NO: 365783 - RNA, 64 nt, hsa
auaagacagggguuucucuuuuugugaccuuuauuauuauuauuuuguuaacuguuguaaccag

SEQ ID NO: 365784 - RNA, 64 nt, hsa
auaaucaguacuuuauauuuauaaauguauuuauuauuauuauaagacugcauuuuauuuauau

SEQ ID NO: 365785 - RNA, 64 nt, hsa
uccauaaucaguacuuuauauuuauaaauguauuuauuauuauuauaagacugcauuuuauuua

SEQ ID NO: 365786 - RNA, 64 nt, hsa
auacuucuugguggacuccagcugccccuuuuauuauuauuagagacaaggucucacucuguug

SEQ ID NO: 365787 - RNA, 64 nt, hsa
acaauacuucuugguggacuccagcugccccuuuuauuauuauuagagacaaggucucacucug

SEQ ID NO: 365788 - RNA, 64 nt, hsa
aauuaaugcuuguuaacuuuuuucauauaauauuuauuauuauuagaagaacuuacaauguguu

SEQ ID NO: 365789 - RNA, 64 nt, hsa
uaaugcuuguuaacuuuuuucauauaauauuuauuauuauuagaagaacuuacaauguguucag

SEQ ID NO: 365790 - RNA, 64 nt, hsa
auuucauuuagcuuuuuuauuuuaauacaaguaauauuauuacuuuaugaacaauuuuuuuuaa

SEQ ID NO: 365791 - RNA, 64 nt, hsa
agccuuaagcaaauuuuguauuauuguucucacuuauuauuaauaaugaaguagaaguuacuua

SEQ ID NO: 365792 - RNA, 64 nt, hsa
uaugcgauuaaacgaaaugauaaagauaaaaccauauuauuaaauaccuauauaucacagcuaa

SEQ ID NO: 365793 - RNA, 64 nt, hsa
agucugacaacacuaaagaaauuucuuaauauacuauuauuagaauaguagaggauaaaagaua

SEQ ID NO: 365794 - RNA, 64 nt, hsa
cuuucuguauguuaaaguagauguaaugaauuauuauuauuacaguggucacgauuuucuucag

SEQ ID NO: 365795 - RNA, 64 nt, hsa
ugacuuucuguauguuaaaguagauguaaugaauuauuauuauuacaguggucacgauuuucuu

SEQ ID NO: 365796 - RNA, 64 nt, hsa
uacuucugcaauuaaauauucuuuagugcuuguuuauuauuacuaaauacuaauuaaguacuaa

SEQ ID NO: 365797 - RNA, 64 nt, hsa
aguugauuauacuucaugcuguuuuccagcaugguauuauuaagggauuuaaaguuuggguugc

SEQ ID NO: 365798 - RNA, 64 nt, hsa
gagcagugaaguuggucagggacauguggccacuuauuauuaccuaaagaaaacauuuguuccc

SEQ ID NO: 365799 - RNA, 64 nt, hsa
uugcccaagagcacugaguacuucucuacuauccuauuauuagcuucuaucucuuaguguaacu

SEQ ID NO: 365800 - RNA, 64 nt, hsa
uucauuuaaaaagacuuuugucuaagaagaauauuauuauuauauguucuuucaacaccccagg

SEQ ID NO: 365801 - RNA, 64 nt, hsa
aacuucauuuaaaaagacuuuugucuaagaagaauauuauuauuauauguucuuucaacacccc

SEQ ID NO: 365802 - RNA, 64 nt, hsa
guuucuccccaccuuauccccaucccaccuuuauuauuauuauuuuucucccauggcuaagcua

SEQ ID NO: 365803 - RNA, 64 nt, hsa
cauguuucuccccaccuuauccccaucccaccuuuauuauuauuauuuuucucccauggcuaag

SEQ ID NO: 365804 - RNA, 64 nt, hsa
aaaugagcaucagagaguguacaucauguuauuuuauuauuauuauuugcuuuucauguagaac

SEQ ID NO: 365805 - RNA, 64 nt, hsa
ugagcaucagagaguguacaucauguuauuuuauuauuauuauuugcuuuucauguagaacuca

SEQ ID NO: 365806 - RNA, 64 nt, hsa
agauuucagcuacauauaugaacaaauccuuuauuauuauuauaauuauuuuuuugcgugaaag

SEQ ID NO: 365807 - RNA, 64 nt, hsa
agcagauuucagcuacauauaugaacaaauccuuuauuauuauuauaauuauuuuuuugcguga

SEQ ID NO: 365808 - RNA, 64 nt, hsa
ucacuuuguguguguuagugcucuaaaguagcaguauuauuauuaaacuguccccagaguaacc

SEQ ID NO: 365809 - RNA, 64 nt, hsa
cuuuguguguguuagugcucuaaaguagcaguauuauuauuaaacuguccccagaguaacccug

SEQ ID NO: 365810 - RNA, 64 nt, hsa
gucagccugccagguacuguaauuuauucuaucauauuauuauauuauauaucaaguaggacag

SEQ ID NO: 365811 - RNA, 64 nt, hsa
gugagagcuguacauuaaaaaaaaucaucauuauuauuauuauuugcagucauggagaaccacc

SEQ ID NO: 365812 - RNA, 64 nt, hsa
ugugugagagcuguacauuaaaaaaaaucaucauuauuauuauuauuugcagucauggagaacc

SEQ ID NO: 365813 - RNA, 64 nt, hsa
gacaagaaaaggauuaaacggguggcuccuuuaauauuauuauuauuguuuuugagacaagguc

SEQ ID NO: 365814 - RNA, 64 nt, hsa
aagaaaaggauuaaacggguggcuccuuuaauauuauuauuauuguuuuugagacaaggucccu

SEQ ID NO: 365815 - RNA, 64 nt, hsa
ccccaagcgcugcuuuucaccuguaccuuuguuuuauuauuauuauuauuauugcuguuguugu

SEQ ID NO: 365816 - RNA, 64 nt, hsa
caagcgcugcuuuucaccuguaccuuuguuuuauuauuauuauuauuauugcuguuguugucau

SEQ ID NO: 365817 - RNA, 64 nt, hsa
gcgcugcuuuucaccuguaccuuuguuuuauuauuauuauuauuauugcuguuguugucaucgu

SEQ ID NO: 365818 - RNA, 64 nt, hsa
cugcuuuucaccuguaccuuuguuuuauuauuauuauuauuauugcuguuguugucaucguuaa

SEQ ID NO: 365819 - RNA, 64 nt, hsa
ucccccugaacaauccuuuucaguauuauauuuuuauuauuauuauguuauuauuacacugucu

SEQ ID NO: 365820 - RNA, 64 nt, hsa
cccugaacaauccuuuucaguauuauauuuuuauuauuauuauguuauuauuacacugucuuuu

SEQ ID NO: 365821 - RNA, 64 nt, hsa
ccuuuucaguauuauauuuuuauuauuauuauguuauuauuacacugucuuuuugccaucaaaa

SEQ ID NO: 365822 - RNA, 64 nt, hsa
cccauacccucauuccuccuuacacaauuucuccuauuauuaagauggugcauuaguguggcac

SEQ ID NO: 365823 - RNA, 64 nt, hsa
cacauuuguuacaaaugaugaaccaauauuaauuuauuauuaauuauagcccauaguucacauu

SEQ ID NO: 365824 - RNA, 64 nt, hsa
gcauagaaaaaguauaaagcucaguuaguuuuuuuauuauuauuauuauuaaaaguuaauucag

SEQ ID NO: 365825 - RNA, 64 nt, hsa
uagaaaaaguauaaagcucaguuaguuuuuuuauuauuauuauuauuaaaaguuaauucaggac

SEQ ID NO: 365826 - RNA, 64 nt, hsa
aaaaaguauaaagcucaguuaguuuuuuuauuauuauuauuauuaaaaguuaauucaggacuga

SEQ ID NO: 365827 - RNA, 64 nt, hsa
aaguauaaagcucaguuaguuuuuuuauuauuauuauuauuaaaaguuaauucaggacugaugu

SEQ ID NO: 365828 - RNA, 64 nt, hsa
auguugcaucguuuauuauuauuauugauaauauuauuauuacuauuuuuuugugucaugugag

SEQ ID NO: 365829 - RNA, 64 nt, hsa
auuauguugcaucguuuauuauuauuauugauaauauuauuauuacuauuuuuuugugucaugu

SEQ ID NO: 365830 - RNA, 64 nt, hsa
ccucucccauaguuuauuauguugcaucguuuauuauuauuauugauaauauuauuauuacuau

SEQ ID NO: 365831 - RNA, 64 nt, hsa
agcccucucccauaguuuauuauguugcaucguuuauuauuauuauugauaauauuauuauuac

SEQ ID NO: 365832 - RNA, 64 nt, hsa
ugguuaucuuguuauuauuguuaauaauaauuauuauuauuauuuuccuuccaugcucccaacu

SEQ ID NO: 365833 - RNA, 64 nt, hsa
gacugguuaucuuguuauuauuguuaauaauaauuauuauuauuauuuuccuuccaugcuccca

SEQ ID NO: 365834 - RNA, 64 nt, hsa
aacacauaaacaauucaugccuuucauaguuuauuauuauuaaagucuaaacaaaauugcaauu

SEQ ID NO: 365835 - RNA, 64 nt, hsa
uguaacacauaaacaauucaugccuuucauaguuuauuauuauuaaagucuaaacaaaauugca

SEQ ID NO: 365836 - RNA, 64 nt, hsa
uuagggauucauuucuauauuuucacauauguaguauuauuauuuccuuauauguguaagguga

SEQ ID NO: 365837 - RNA, 64 nt, hsa
gaauauaguuggaaauaaauguguguguguauauuauuauuaaucaaugcaauauuuaaaauga

SEQ ID NO: 365838 - RNA, 64 nt, hsa
uaggaauauaguuggaaauaaauguguguguguauauuauuauuaaucaaugcaauauuuaaaa

SEQ ID NO: 365839 - RNA, 64 nt, hsa
guugaacgucaggcuaaaaaagcagccaugcauuuauuauuaaacauuuucuaccgacaaggca

SEQ ID NO: 365840 - RNA, 64 nt, hsa
gucaucuuacuaaugaaaauaauguuuucccauauauuauuaaaaagcauacagucuaaauaau

SEQ ID NO: 365841 - RNA, 64 nt, hsa
acaguuggcucaagggccaccagaagcauuucuuuauuauuauuauuuuuuaaccuggacaugc

SEQ ID NO: 365842 - RNA, 64 nt, hsa
guuggcucaagggccaccagaagcauuucuuuauuauuauuauuuuuuaaccuggacaugcauu

SEQ ID NO: 365843 - RNA, 64 nt, hsa
aguccagguaugauuggauuaauauuuauaaaauuauuauuaggaauuauuuaaguggggccag

SEQ ID NO: 365844 - RNA, 64 nt, hsa
ucaaauucaaauagaacauuuaaaaugauuucauuauuauuacccauacuguugccacucauau

SEQ ID NO: 365845 - RNA, 64 nt, hsa
gcagccagcaggagccuggccugggaggacgauuuauuauuacacuggggguuuccuuggcagc

SEQ ID NO: 365846 - RNA, 64 nt, hsa
aguuacaaacaauccaguuacaaucuuuuuaaguuauuauuauuauuauuauuuuuuuuuuuuu

SEQ ID NO: 365847 - RNA, 64 nt, hsa
uacaaacaauccaguuacaaucuuuuuaaguuauuauuauuauuauuauuuuuuuuuuuuuuga

SEQ ID NO: 365848 - RNA, 64 nt, hsa
aaacaauccaguuacaaucuuuuuaaguuauuauuauuauuauuauuuuuuuuuuuuuugagau

SEQ ID NO: 365849 - RNA, 64 nt, hsa
caauccaguuacaaucuuuuuaaguuauuauuauuauuauuauuuuuuuuuuuuuugagaugga

SEQ ID NO: 365850 - RNA, 64 nt, hsa
gauuauaggugugagccacugcgccuggcuaaguuauuauuauuuuuuugagacagucuccugg

SEQ ID NO: 365851 - RNA, 64 nt, hsa
ggcuguuucuaaguuguauucuuuauuuuauuauuauuauuacuauuuuucgagauggaguuuc

SEQ ID NO: 365852 - RNA, 64 nt, hsa
uuuggcuguuucuaaguuguauucuuuauuuuauuauuauuauuacuauuuuucgagauggagu

SEQ ID NO: 365853 - RNA, 64 nt, hsa
ccauuuggcuguuucuaaguuguauucuuuauuuuauuauuauuauuacuauuuuucgagaugg

SEQ ID NO: 365854 - RNA, 64 nt, hsa
uuguauagaaacaaauucauuuaaacaaacuuauuauuauuauuuuuuacaaaauauauauaug

SEQ ID NO: 365855 - RNA, 64 nt, hsa
auuuuguauagaaacaaauucauuuaaacaaacuuauuauuauuauuuuuuacaaaauauauau

SEQ ID NO: 365856 - RNA, 64 nt, hsa
ccucucauuuccuuacacucugacaugaaugaauuauuauuauuuuuauuuuucuuuuuuuuuu

SEQ ID NO: 365857 - RNA, 64 nt, hsa
aaaccaaaucaagaguauuuauuacuauuacugcuauuauuauuaggccugccuuuaauuuuca

SEQ ID NO: 365858 - RNA, 64 nt, hsa
ccaaaucaagaguauuuauuacuauuacugcuauuauuauuaggccugccuuuaauuuucagug

SEQ ID NO: 365859 - RNA, 64 nt, hsa
cacagaaauagagaugcuauagugaacucccaucuauuauuacacaaauuuaaugguuagcaac

SEQ ID NO: 365860 - RNA, 64 nt, hsa
guguguauauauauguauauauauuuuuucauuguauuauuacggagacuuucaaacauauaua

SEQ ID NO: 365861 - RNA, 64 nt, hsa
cgguccuuauggugguuauuauuauuauuauaauuauuauuauggagucgaguugacucucggc

SEQ ID NO: 365862 - RNA, 64 nt, hsa
gcgaggaggccucgguccuuauggugguuauuauuauuauuauaauuauuauuauggagucgag

SEQ ID NO: 365863 - RNA, 64 nt, hsa
gcggcgaggaggccucgguccuuauggugguuauuauuauuauuauaauuauuauuauggaguc

SEQ ID NO: 365864 - RNA, 64 nt, hsa
guggcggcgaggaggccucgguccuuauggugguuauuauuauuauuauaauuauuauuaugga

SEQ ID NO: 365865 - RNA, 64 nt, hsa
uaguaguuauagggaagauauggguguuuuucuuuauuauuacuuuuuuuuuucugcaggucag

SEQ ID NO: 365866 - RNA, 64 nt, hsa
acguggcagcaagcugagggucuuuguuuggguuuauuauuacgguauuuuuguuuguaaguua

SEQ ID NO: 365867 - RNA, 64 nt, hsa
auucuucucguuaaauucuugauagauuuuuuauuauuauuaaaagucaguuuauaauacaaag

SEQ ID NO: 365868 - RNA, 64 nt, hsa
cagauucuucucguuaaauucuugauagauuuuuuauuauuauuaaaagucaguuuauaauaca

SEQ ID NO: 365869 - RNA, 64 nt, hsa
aauacaaaagaguagagaagguucuuauugcaaauauuauuaggauguggacaugcuauuaggg

SEQ ID NO: 365870 - RNA, 64 nt, hsa
uuuaaucuuuacuacacuccugcaacauagacaguauuauuacauucaguauuacaauggcaga

SEQ ID NO: 365871 - RNA, 64 nt, hsa
cacacaauuacuauguauaacauauaugaacauauauuauuauuaccuaauauauguauauuuc

SEQ ID NO: 365872 - RNA, 64 nt, hsa
acaauuacuauguauaacauauaugaacauauauuauuauuaccuaauauauguauauuucugu

SEQ ID NO: 365873 - RNA, 64 nt, hsa
augcaguuuuaaaaaggugaaaucaugcuuaaaauauuauuaccagugaacaucaggcacucug

SEQ ID NO: 365874 - RNA, 64 nt, hsa
ugugcucaauuauaaaagcuguguuauuguuuucuauuauuauuuuuaaauaaucacacuugga

SEQ ID NO: 365875 - RNA, 64 nt, hsa
augucagguauuuacagugguuggaagauagcaguauuauuagcauaagcugcauacguaauau

SEQ ID NO: 365876 - RNA, 64 nt, hsa
cagugauauagcauaauaaagccccgggcauuauuauuauuauuucuuuuguuacaucuauuac

SEQ ID NO: 365877 - RNA, 64 nt, hsa
gagcagugauauagcauaauaaagccccgggcauuauuauuauuauuucuuuuguuacaucuau

SEQ ID NO: 365878 - RNA, 64 nt, hsa
ucaacaugcuguuggguuuuaauucucuaauuauuauuauuauuguuauuauuuuuuaggacca

SEQ ID NO: 365879 - RNA, 64 nt, hsa
cauucaacaugcuguuggguuuuaauucucuaauuauuauuauuauuguuauuauuuuuuagga

SEQ ID NO: 365880 - RNA, 64 nt, hsa
gcuaaauuaaagggacuccauccuguuaugauuauauuauuauuauuauuauuauuauuuuuga

SEQ ID NO: 365881 - RNA, 64 nt, hsa
aaauuaaagggacuccauccuguuaugauuauauuauuauuauuauuauuauuauuuuugaggu

SEQ ID NO: 365882 - RNA, 64 nt, hsa
uuaaagggacuccauccuguuaugauuauauuauuauuauuauuauuauuauuuuugaggugga

SEQ ID NO: 365883 - RNA, 64 nt, hsa
aagggacuccauccuguuaugauuauauuauuauuauuauuauuauuauuuuugagguggaguu

SEQ ID NO: 365884 - RNA, 64 nt, hsa
ggacuccauccuguuaugauuauauuauuauuauuauuauuauuauuuuugagguggaguuuca

SEQ ID NO: 365885 - RNA, 64 nt, hsa
cuccauccuguuaugauuauauuauuauuauuauuauuauuauuuuugagguggaguuucacuc

SEQ ID NO: 365886 - RNA, 64 nt, hsa
uacaggugugagcuaccgcgccuggccaugaugauauuauuaaacaccauuauucacauuucaa

SEQ ID NO: 365887 - RNA, 64 nt, hsa
aauaguuauauuuucuauuacacaaguuuaaaaauauuauuaacuuguauuuucuuaauauaca

SEQ ID NO: 365888 - RNA, 64 nt, hsa
cuuggcauauuguagggugcucaauggugguuuuuauuauuauuacucagauuccacaguggca

SEQ ID NO: 365889 - RNA, 64 nt, hsa
ggcauauuguagggugcucaauggugguuuuuauuauuauuacucagauuccacaguggcaaga

SEQ ID NO: 365890 - RNA, 64 nt, hsa
uugagagugauucucuguauauaaauaugugaaauauuauuaucucaacuuagcacacgugaag

SEQ ID NO: 365891 - RNA, 64 nt, hsa
agcuguaauccagagagaaggaaacguagaaauuuauuauuaaaagaauggacugugcagcgaa

SEQ ID NO: 365892 - RNA, 64 nt, hsa
aauguauacaugccuuguuuaacuuggaaucuauuauuauuaaucaauugacuauuaaaucugg

SEQ ID NO: 365893 - RNA, 64 nt, hsa
uuuaauguauacaugccuuguuuaacuuggaaucuauuauuauuaaucaauugacuauuaaauc

SEQ ID NO: 365894 - RNA, 64 nt, hsa
cuuuaacaaucuuguuuggguuuuuuucuagguauauuauuaguguuuuauggucuauguucuu

SEQ ID NO: 365895 - RNA, 64 nt, hsa
caugagacuuucucuuugucaauuugggaauuauuauuauuaauuuagaaauggggucuuguua

SEQ ID NO: 365896 - RNA, 64 nt, hsa
gaccaugagacuuucucuuugucaauuugggaauuauuauuauuaauuuagaaauggggucuug

SEQ ID NO: 365897 - RNA, 64 nt, hsa
cauugaccgcgacuaauuucaaaaugcuuuuuauuauuauuauuuuuuagacagucucacuuug

SEQ ID NO: 365898 - RNA, 64 nt, hsa
uugcauugaccgcgacuaauuucaaaaugcuuuuuauuauuauuauuuuuuagacagucucacu

SEQ ID NO: 365899 - RNA, 64 nt, hsa; identical to SEQ ID NO: 81841

SEQ ID NO: 365900 - RNA, 64 nt, hsa; identical to SEQ ID NO: 81842

SEQ ID NO: 365901 - RNA, 64 nt, hsa; identical to SEQ ID NO: 81843

SEQ ID NO: 365902 - RNA, 64 nt, hsa; identical to SEQ ID NO: 81844

SEQ ID NO: 365903 - RNA, 64 nt, hsa; identical to SEQ ID NO: 81845

SEQ ID NO: 365904 - RNA, 64 nt, hsa; identical to SEQ ID NO: 81846

SEQ ID NO: 365905 - RNA, 64 nt, hsa; identical to SEQ ID NO: 81847

SEQ ID NO: 365906 - RNA, 64 nt, hsa; identical to SEQ ID NO: 81848

SEQ ID NO: 365907 - RNA, 64 nt, hsa; identical to SEQ ID NO: 81849

SEQ ID NO: 365908 - RNA, 64 nt, hsa; identical to SEQ ID NO: 81850

SEQ ID NO: 365909 - RNA, 64 nt, hsa; identical to SEQ ID NO: 81851

SEQ ID NO: 365910 - RNA, 61 nt, hsa; identical to SEQ ID NO: 81852

SEQ ID NO: 365911 - RNA, 64 nt, hsa; identical to SEQ ID NO: 81853

SEQ ID NO: 365912 - RNA, 51 nt, hsa; identical to SEQ ID NO: 81854

SEQ ID NO: 365913 - RNA, 64 nt, hsa; identical to SEQ ID NO: 81855

SEQ ID NO: 365914 - RNA, 64 nt, hsa; identical to SEQ ID NO: 81856

SEQ ID NO: 365915 - RNA, 64 nt, hsa; identical to SEQ ID NO: 81857

SEQ ID NO: 365916 - RNA, 64 nt, hsa; identical to SEQ ID NO: 81858

SEQ ID NO: 365917 - RNA, 64 nt, hsa; identical to SEQ ID NO: 81859

SEQ ID NO: 365918 - RNA, 64 nt, hsa; identical to SEQ ID NO: 81860

SEQ ID NO: 365919 - RNA, 64 nt, hsa; identical to SEQ ID NO: 81861

SEQ ID NO: 365920 - RNA, 64 nt, hsa; identical to SEQ ID NO: 81862

SEQ ID NO: 365921 - RNA, 64 nt, hsa; identical to SEQ ID NO: 81863

SEQ ID NO: 365922 - RNA, 64 nt, hsa; identical to SEQ ID NO: 81864

SEQ ID NO: 365923 - RNA, 64 nt, hsa; identical to SEQ ID NO: 81865

SEQ ID NO: 365924 - RNA, 64 nt, hsa; identical to SEQ ID NO: 81866

SEQ ID NO: 365925 - RNA, 64 nt, hsa; identical to SEQ ID NO: 81867

SEQ ID NO: 365926 - RNA, 64 nt, hsa; identical to SEQ ID NO: 81868

SEQ ID NO: 365927 - RNA, 64 nt, hsa; identical to SEQ ID NO: 81869

SEQ ID NO: 365928 - RNA, 64 nt, hsa; identical to SEQ ID NO: 81870

SEQ ID NO: 365929 - RNA, 64 nt, hsa; identical to SEQ ID NO: 81871

SEQ ID NO: 365930 - RNA, 64 nt, hsa; identical to SEQ ID NO: 81872

SEQ ID NO: 365931 - RNA, 64 nt, hsa; identical to SEQ ID NO: 81873

SEQ ID NO: 365932 - RNA, 64 nt, hsa; identical to SEQ ID NO: 81874

SEQ ID NO: 365933 - RNA, 64 nt, hsa; identical to SEQ ID NO: 81875

SEQ ID NO: 365934 - RNA, 64 nt, hsa; identical to SEQ ID NO: 81876

SEQ ID NO: 365935 - RNA, 64 nt, hsa; identical to SEQ ID NO: 81877

SEQ ID NO: 365936 - RNA, 64 nt, hsa; identical to SEQ ID NO: 81878

SEQ ID NO: 365937 - RNA, 64 nt, hsa; identical to SEQ ID NO: 81879

SEQ ID NO: 365938 - RNA, 64 nt, hsa; identical to SEQ ID NO: 81880

SEQ ID NO: 365939 - RNA, 64 nt, hsa; identical to SEQ ID NO: 81881

SEQ ID NO: 365940 - RNA, 64 nt, hsa; identical to SEQ ID NO: 81882

SEQ ID NO: 365941 - RNA, 64 nt, hsa; identical to SEQ ID NO: 81883

SEQ ID NO: 365942 - RNA, 64 nt, hsa; identical to SEQ ID NO: 81884

SEQ ID NO: 365943 - RNA, 64 nt, hsa; identical to SEQ ID NO: 81885

SEQ ID NO: 365944 - RNA, 64 nt, hsa; identical to SEQ ID NO: 81886

SEQ ID NO: 365945 - RNA, 64 nt, hsa; identical to SEQ ID NO: 81887

SEQ ID NO: 365946 - RNA, 64 nt, hsa; identical to SEQ ID NO: 81888

SEQ ID NO: 365947 - RNA, 64 nt, hsa; identical to SEQ ID NO: 81889

SEQ ID NO: 365948 - RNA, 64 nt, hsa; identical to SEQ ID NO: 81890

SEQ ID NO: 365949 - RNA, 64 nt, hsa; identical to SEQ ID NO: 81891

SEQ ID NO: 365950 - RNA, 64 nt, hsa; identical to SEQ ID NO: 81892

SEQ ID NO: 365951 - RNA, 64 nt, hsa; identical to SEQ ID NO: 81893

SEQ ID NO: 365952 - RNA, 64 nt, hsa; identical to SEQ ID NO: 81894

SEQ ID NO: 365953 - RNA, 64 nt, hsa; identical to SEQ ID NO: 81895

SEQ ID NO: 365954 - RNA, 64 nt, hsa; identical to SEQ ID NO: 81896

SEQ ID NO: 365955 - RNA, 64 nt, hsa; identical to SEQ ID NO: 81897

SEQ ID NO: 365956 - RNA, 64 nt, hsa; identical to SEQ ID NO: 81898

SEQ ID NO: 365957 - RNA, 64 nt, hsa; identical to SEQ ID NO: 81899

SEQ ID NO: 365958 - RNA, 64 nt, hsa; identical to SEQ ID NO: 81900

SEQ ID NO: 365959 - RNA, 64 nt, hsa; identical to SEQ ID NO: 81901

SEQ ID NO: 365960 - RNA, 64 nt, hsa; identical to SEQ ID NO: 81902

SEQ ID NO: 365961 - RNA, 64 nt, hsa; identical to SEQ ID NO: 81903

SEQ ID NO: 365962 - RNA, 64 nt, hsa; identical to SEQ ID NO: 81904

SEQ ID NO: 365963 - RNA, 64 nt, hsa; identical to SEQ ID NO: 81905

SEQ ID NO: 365964 - RNA, 64 nt, hsa; identical to SEQ ID NO: 81906

SEQ ID NO: 365965 - RNA, 64 nt, hsa; identical to SEQ ID NO: 81907

SEQ ID NO: 365966 - RNA, 64 nt, hsa; identical to SEQ ID NO: 81908

SEQ ID NO: 365967 - RNA, 64 nt, hsa; identical to SEQ ID NO: 81909

SEQ ID NO: 365968 - RNA, 64 nt, hsa; identical to SEQ ID NO: 81910

SEQ ID NO: 365969 - RNA, 64 nt, hsa; identical to SEQ ID NO: 81911

SEQ ID NO: 365970 - RNA, 64 nt, hsa; identical to SEQ ID NO: 81912

SEQ ID NO: 365971 - RNA, 64 nt, hsa; identical to SEQ ID NO: 81913

SEQ ID NO: 365972 - RNA, 64 nt, hsa; identical to SEQ ID NO: 81914

SEQ ID NO: 365973 - RNA, 64 nt, hsa; identical to SEQ ID NO: 81915

SEQ ID NO: 365974 - RNA, 64 nt, hsa; identical to SEQ ID NO: 81916

SEQ ID NO: 365975 - RNA, 64 nt, hsa; identical to SEQ ID NO: 81917

SEQ ID NO: 365976 - RNA, 64 nt, hsa; identical to SEQ ID NO: 81918

SEQ ID NO: 365977 - RNA, 64 nt, hsa; identical to SEQ ID NO: 81919

SEQ ID NO: 365978 - RNA, 64 nt, hsa; identical to SEQ ID NO: 81920

SEQ ID NO: 365979 - RNA, 64 nt, hsa; identical to SEQ ID NO: 81921

SEQ ID NO: 365980 - RNA, 64 nt, hsa; identical to SEQ ID NO: 81922

SEQ ID NO: 365981 - RNA, 64 nt, hsa; identical to SEQ ID NO: 81923

SEQ ID NO: 365982 - RNA, 64 nt, hsa; identical to SEQ ID NO: 81924

SEQ ID NO: 365983 - RNA, 64 nt, hsa; identical to SEQ ID NO: 81925

SEQ ID NO: 365984 - RNA, 64 nt, hsa; identical to SEQ ID NO: 81926

SEQ ID NO: 365985 - RNA, 64 nt, hsa; identical to SEQ ID NO: 81927

SEQ ID NO: 365986 - RNA, 64 nt, hsa; identical to SEQ ID NO: 81928

SEQ ID NO: 365987 - RNA, 64 nt, hsa; identical to SEQ ID NO: 81929

SEQ ID NO: 365988 - RNA, 64 nt, hsa; identical to SEQ ID NO: 81930

SEQ ID NO: 365989 - RNA, 64 nt, hsa; identical to SEQ ID NO: 81931

SEQ ID NO: 365990 - RNA, 64 nt, hsa; identical to SEQ ID NO: 81932

SEQ ID NO: 365991 - RNA, 64 nt, hsa; identical to SEQ ID NO: 81933

SEQ ID NO: 365992 - RNA, 64 nt, hsa; identical to SEQ ID NO: 81934

SEQ ID NO: 365993 - RNA, 64 nt, hsa; identical to SEQ ID NO: 81935

SEQ ID NO: 365994 - RNA, 64 nt, hsa; identical to SEQ ID NO: 81936

SEQ ID NO: 365995 - RNA, 64 nt, hsa; identical to SEQ ID NO: 81937

SEQ ID NO: 365996 - RNA, 64 nt, hsa; identical to SEQ ID NO: 81938

SEQ ID NO: 365997 - RNA, 64 nt, hsa; identical to SEQ ID NO: 81939

SEQ ID NO: 365998 - RNA, 64 nt, hsa; identical to SEQ ID NO: 81940

SEQ ID NO: 365999 - RNA, 64 nt, hsa; identical to SEQ ID NO: 81941

SEQ ID NO: 366000 - RNA, 64 nt, hsa; identical to SEQ ID NO: 81942

SEQ ID NO: 366001 - RNA, 64 nt, hsa; identical to SEQ ID NO: 81943

SEQ ID NO: 366002 - RNA, 64 nt, hsa; identical to SEQ ID NO: 81944

SEQ ID NO: 366003 - RNA, 63 nt, hsa
agaagguuuuuaaggaggggcuucugaauacuugggagauacggaacggaccaaggaccacac

SEQ ID NO: 366004 - RNA, 63 nt, hsa
uuaugagugagcuguuaacucuaaaauguacuugggagauaggccaagcgagaggucaugggc

SEQ ID NO: 366005 - RNA, 64 nt, hsa
ucucugcuuggauucuggaccaccaccugggaccaaccuucagcucuggaaccuucauaaagca

SEQ ID NO: 366006 - RNA, 64 nt, hsa
uggaccaccaccugggaccaaccuucagcucuggaaccuucauaaagcaggucagcguggccug

SEQ ID NO: 366007 - RNA, 64 nt, hsa
caaaagagagggugucuucauauuaaaccuucacaaccuucaugauuucauaggauuauuuugg

SEQ ID NO: 366008 - RNA, 64 nt, hsa
aaaagcacacaaaagagagggugucuucauauuaaaccuucacaaccuucaugauuucauagga

SEQ ID NO: 366009 - RNA, 64 nt, hsa
ucuuugaugucaguuccaauuauuuggcaucaaaaaccuucaugguagguagaguuuuagguaa

SEQ ID NO: 366010 - RNA, 64 nt, hsa
caucucuuaucucuauacagggacuagguaauaaaaccuucaaagguugucaaaggucaucaag

SEQ ID NO: 366011 - RNA, 64 nt, hsa
cauacauagaagcaaaaauacuuuaacugcuguaaaccuucaaaaguuaauagaagugagauca

SEQ ID NO: 366012 - RNA, 64 nt, hsa
gcucuuguauuuuaugaaaaaaaaugauuuuuuuaaccuucauacauagaagcaaaaauacuuu

SEQ ID NO: 366013 - RNA, 64 nt, hsa
ugaauagcauucaguaauuaagaauuacaauuuuaaccuucauguagcuaagucuaccuuaaaa

SEQ ID NO: 366014 - RNA, 64 nt, hsa
gauaaagcgucugaucuaaucccagcacuucuguaaccuucagcauuucuuugaaggauuuccu

SEQ ID NO: 366015 - RNA, 64 nt, hsa
agcuacacgaucaucuuugcuacaggccucucacaaccuucagcaugccagcaugggucaggcc

SEQ ID NO: 366016 - RNA, 64 nt, hsa
guuccccccacaagaagcaccucccuugcuuggcaaccuucaccagcauuucccaaaaguaugc

SEQ ID NO: 366017 - RNA, 64 nt, hsa
ucuuuucccuuuuuaccaugguuucuacaaaaauaaccuucaggaaaaagaaaaucaggaaaaa

SEQ ID NO: 366018 - RNA, 64 nt, hsa
uuuuucuccuaaaacuggaccauaauuucaguaaaaccuucagacauagacugaagcagcucaa

SEQ ID NO: 366019 - RNA, 64 nt, hsa
ccuuaugaugauugugugcaaguuaguuaacaugaaccuucauuuguaaauuuuuuaaaauuuc

SEQ ID NO: 366020 - RNA, 64 nt, hsa
cuugcauaaaaaaggguucuugccuuaaaagugaaaccuucauggauagucuuuaaucucugau

SEQ ID NO: 366021 - RNA, 64 nt, hsa
gauaaaaaacauauaaauguaagaaauguagaaaaaccuucagccaggaggcuggcaagauggc

SEQ ID NO: 366022 - RNA, 64 nt, hsa
cagcaugagaacuucgugaagcauacagaagaaaaaccuucagccagauugaaugcuuuacagg

SEQ ID NO: 366023 - RNA, 64 nt, hsa
uaaggaauguaggaaguccuucaauucuuugggaaaccuucaaagacacauggcagugcagcau

SEQ ID NO: 366024 - RNA, 64 nt, hsa
gagagaagcguaauacacguaaacaauuuuggaaaaccuucaguuauugccacucguuucaaac

SEQ ID NO: 366025 - RNA, 64 nt, hsa; identical to SEQ ID NO: 54328

SEQ ID NO: 366026 - RNA, 64 nt, hsa; identical to SEQ ID NO: 54329

SEQ ID NO: 366027 - RNA, 64 nt, hsa; identical to SEQ ID NO: 54330

SEQ ID NO: 366028 - RNA, 64 nt, hsa; identical to SEQ ID NO: 54331

SEQ ID NO: 366029 - RNA, 64 nt, hsa; identical to SEQ ID NO: 54332

SEQ ID NO: 366030 - RNA, 64 nt, hsa; identical to SEQ ID NO: 54333

SEQ ID NO: 366031 - RNA, 64 nt, hsa; identical to SEQ ID NO: 54334

SEQ ID NO: 366032 - RNA, 64 nt, hsa; identical to SEQ ID NO: 54335

SEQ ID NO: 366033 - RNA, 64 nt, hsa; identical to SEQ ID NO: 54336

SEQ ID NO: 366034 - RNA, 64 nt, hsa; identical to SEQ ID NO: 54337

SEQ ID NO: 366035 - RNA, 64 nt, hsa; identical to SEQ ID NO: 54338

SEQ ID NO: 366036 - RNA, 64 nt, hsa; identical to SEQ ID NO: 54339

SEQ ID NO: 366037 - RNA, 64 nt, hsa; identical to SEQ ID NO: 54340

SEQ ID NO: 366038 - RNA, 64 nt, hsa; identical to SEQ ID NO: 54341

SEQ ID NO: 366039 - RNA, 64 nt, hsa; identical to SEQ ID NO: 54342

SEQ ID NO: 366040 - RNA, 64 nt, hsa; identical to SEQ ID NO: 54343

SEQ ID NO: 366041 - RNA, 64 nt, hsa; identical to SEQ ID NO: 54344

SEQ ID NO: 366042 - RNA, 64 nt, hsa; identical to SEQ ID NO: 54345

SEQ ID NO: 366043 - RNA, 64 nt, hsa; identical to SEQ ID NO: 54346

SEQ ID NO: 366044 - RNA, 64 nt, hsa; identical to SEQ ID NO: 54347

SEQ ID NO: 366045 - RNA, 64 nt, hsa; identical to SEQ ID NO: 54348

SEQ ID NO: 366046 - RNA, 64 nt, hsa; identical to SEQ ID NO: 54349

SEQ ID NO: 366047 - RNA, 64 nt, hsa; identical to SEQ ID NO: 54350

SEQ ID NO: 366048 - RNA, 64 nt, hsa; identical to SEQ ID NO: 54351

SEQ ID NO: 366049 - RNA, 64 nt, hsa; identical to SEQ ID NO: 54352

SEQ ID NO: 366050 - RNA, 64 nt, hsa; identical to SEQ ID NO: 54353

SEQ ID NO: 366051 - RNA, 64 nt, hsa; identical to SEQ ID NO: 54354

SEQ ID NO: 366052 - RNA, 64 nt, hsa; identical to SEQ ID NO: 54355

SEQ ID NO: 366053 - RNA, 64 nt, hsa; identical to SEQ ID NO: 54356

SEQ ID NO: 366054 - RNA, 64 nt, hsa; identical to SEQ ID NO: 54357

SEQ ID NO: 366055 - RNA, 64 nt, hsa; identical to SEQ ID NO: 54358

SEQ ID NO: 366056 - RNA, 64 nt, hsa; identical to SEQ ID NO: 54359

SEQ ID NO: 366057 - RNA, 64 nt, hsa; identical to SEQ ID NO: 54360

SEQ ID NO: 366058 - RNA, 64 nt, hsa; identical to SEQ ID NO: 54361

SEQ ID NO: 366059 - RNA, 64 nt, hsa; identical to SEQ ID NO: 54362

SEQ ID NO: 366060 - RNA, 64 nt, hsa; identical to SEQ ID NO: 54363

SEQ ID NO: 366061 - RNA, 64 nt, hsa; identical to SEQ ID NO: 54364

SEQ ID NO: 366062 - RNA, 64 nt, hsa; identical to SEQ ID NO: 54365

SEQ ID NO: 366063 - RNA, 64 nt, hsa; identical to SEQ ID NO: 54366

SEQ ID NO: 366064 - RNA, 64 nt, hsa; identical to SEQ ID NO: 54367

SEQ ID NO: 366065 - RNA, 64 nt, hsa; identical to SEQ ID NO: 54368

SEQ ID NO: 366066 - RNA, 64 nt, hsa; identical to SEQ ID NO: 54369

SEQ ID NO: 366067 - RNA, 64 nt, hsa; identical to SEQ ID NO: 54370

SEQ ID NO: 366068 - RNA, 64 nt, hsa; identical to SEQ ID NO: 54371

SEQ ID NO: 366069 - RNA, 64 nt, hsa; identical to SEQ ID NO: 54372

SEQ ID NO: 366070 - RNA, 64 nt, hsa; identical to SEQ ID NO: 54373

SEQ ID NO: 366071 - RNA, 64 nt, hsa; identical to SEQ ID NO: 54374

SEQ ID NO: 366072 - RNA, 64 nt, hsa; identical to SEQ ID NO: 54375

SEQ ID NO: 366073 - RNA, 64 nt, hsa; identical to SEQ ID NO: 54376

SEQ ID NO: 366074 - RNA, 64 nt, hsa; identical to SEQ ID NO: 54377

SEQ ID NO: 366075 - RNA, 64 nt, hsa; identical to SEQ ID NO: 54378

SEQ ID NO: 366076 - RNA, 64 nt, hsa; identical to SEQ ID NO: 54379

SEQ ID NO: 366077 - RNA, 64 nt, hsa; identical to SEQ ID NO: 54380

SEQ ID NO: 366078 - RNA, 64 nt, hsa; identical to SEQ ID NO: 54381

SEQ ID NO: 366079 - RNA, 64 nt, hsa; identical to SEQ ID NO: 54382

SEQ ID NO: 366080 - RNA, 64 nt, hsa; identical to SEQ ID NO: 54383

SEQ ID NO: 366081 - RNA, 64 nt, hsa; identical to SEQ ID NO: 54384

SEQ ID NO: 366082 - RNA, 64 nt, hsa; identical to SEQ ID NO: 54385

SEQ ID NO: 366083 - RNA, 64 nt, hsa; identical to SEQ ID NO: 54386

SEQ ID NO: 366084 - RNA, 64 nt, hsa; identical to SEQ ID NO: 54387

SEQ ID NO: 366085 - RNA, 64 nt, hsa; identical to SEQ ID NO: 54388

SEQ ID NO: 366086 - RNA, 64 nt, hsa; identical to SEQ ID NO: 54389

SEQ ID NO: 366087 - RNA, 64 nt, hsa; identical to SEQ ID NO: 54390

SEQ ID NO: 366088 - RNA, 64 nt, hsa; identical to SEQ ID NO: 54391

SEQ ID NO: 366089 - RNA, 64 nt, hsa; identical to SEQ ID NO: 54392

SEQ ID NO: 366090 - RNA, 64 nt, hsa; identical to SEQ ID NO: 54393

SEQ ID NO: 366091 - RNA, 64 nt, hsa; identical to SEQ ID NO: 54394

SEQ ID NO: 366092 - RNA, 64 nt, hsa; identical to SEQ ID NO: 54395

SEQ ID NO: 366093 - RNA, 64 nt, hsa; identical to SEQ ID NO: 54396

SEQ ID NO: 366094 - RNA, 64 nt, hsa; identical to SEQ ID NO: 54397

SEQ ID NO: 366095 - RNA, 64 nt, hsa; identical to SEQ ID NO: 54398

SEQ ID NO: 366096 - RNA, 64 nt, hsa; identical to SEQ ID NO: 54399

SEQ ID NO: 366097 - RNA, 64 nt, hsa; identical to SEQ ID NO: 54400

SEQ ID NO: 366098 - RNA, 64 nt, hsa; identical to SEQ ID NO: 54401

SEQ ID NO: 366099 - RNA, 64 nt, hsa; identical to SEQ ID NO: 54402

SEQ ID NO: 366100 - RNA, 64 nt, hsa; identical to SEQ ID NO: 54403

SEQ ID NO: 366101 - RNA, 64 nt, hsa; identical to SEQ ID NO: 54404

SEQ ID NO: 366102 - RNA, 64 nt, hsa; identical to SEQ ID NO: 54405

SEQ ID NO: 366103 - RNA, 64 nt, hsa; identical to SEQ ID NO: 54406

SEQ ID NO: 366104 - RNA, 64 nt, hsa; identical to SEQ ID NO: 54407

SEQ ID NO: 366105 - RNA, 64 nt, hsa; identical to SEQ ID NO: 54408

SEQ ID NO: 366106 - RNA, 64 nt, hsa; identical to SEQ ID NO: 54409

SEQ ID NO: 366107 - RNA, 64 nt, hsa; identical to SEQ ID NO: 54410

SEQ ID NO: 366108 - RNA, 64 nt, hsa; identical to SEQ ID NO: 54411

SEQ ID NO: 366109 - RNA, 64 nt, hsa; identical to SEQ ID NO: 54412

SEQ ID NO: 366110 - RNA, 64 nt, hsa; identical to SEQ ID NO: 54413

SEQ ID NO: 366111 - RNA, 64 nt, hsa; identical to SEQ ID NO: 54414

SEQ ID NO: 366112 - RNA, 64 nt, hsa; identical to SEQ ID NO: 54415

SEQ ID NO: 366113 - RNA, 64 nt, hsa; identical to SEQ ID NO: 54416

SEQ ID NO: 366114 - RNA, 64 nt, hsa; identical to SEQ ID NO: 54417

SEQ ID NO: 366115 - RNA, 64 nt, hsa; identical to SEQ ID NO: 54418

SEQ ID NO: 366116 - RNA, 64 nt, hsa; identical to SEQ ID NO: 54419

SEQ ID NO: 366117 - RNA, 64 nt, hsa; identical to SEQ ID NO: 54420

SEQ ID NO: 366118 - RNA, 64 nt, hsa; identical to SEQ ID NO: 54421

SEQ ID NO: 366119 - RNA, 64 nt, hsa; identical to SEQ ID NO: 54422

SEQ ID NO: 366120 - RNA, 64 nt, hsa; identical to SEQ ID NO: 54423

SEQ ID NO: 366121 - RNA, 64 nt, hsa; identical to SEQ ID NO: 54424

SEQ ID NO: 366122 - RNA, 64 nt, hsa; identical to SEQ ID NO: 54425

SEQ ID NO: 366123 - RNA, 64 nt, hsa; identical to SEQ ID NO: 54426

SEQ ID NO: 366124 - RNA, 64 nt, hsa; identical to SEQ ID NO: 54427

SEQ ID NO: 366125 - RNA, 64 nt, hsa; identical to SEQ ID NO: 54428

SEQ ID NO: 366126 - RNA, 64 nt, hsa; identical to SEQ ID NO: 54429

SEQ ID NO: 366127 - RNA, 64 nt, hsa; identical to SEQ ID NO: 54430

SEQ ID NO: 366128 - RNA, 64 nt, hsa; identical to SEQ ID NO: 54431

SEQ ID NO: 366129 - RNA, 64 nt, hsa; identical to SEQ ID NO: 54432

SEQ ID NO: 366130 - RNA, 64 nt, hsa; identical to SEQ ID NO: 54433

SEQ ID NO: 366131 - RNA, 64 nt, hsa; identical to SEQ ID NO: 54434

SEQ ID NO: 366132 - RNA, 64 nt, hsa; identical to SEQ ID NO: 54435

SEQ ID NO: 366133 - RNA, 64 nt, hsa; identical to SEQ ID NO: 54436

SEQ ID NO: 366134 - RNA, 64 nt, hsa; identical to SEQ ID NO: 54437

SEQ ID NO: 366135 - RNA, 64 nt, hsa; identical to SEQ ID NO: 54438

SEQ ID NO: 366136 - RNA, 64 nt, hsa; identical to SEQ ID NO: 54439

SEQ ID NO: 366137 - RNA, 64 nt, hsa; identical to SEQ ID NO: 54440

SEQ ID NO: 366138 - RNA, 64 nt, hsa; identical to SEQ ID NO: 54441

SEQ ID NO: 366139 - RNA, 64 nt, hsa; identical to SEQ ID NO: 54442

SEQ ID NO: 366140 - RNA, 64 nt, hsa; identical to SEQ ID NO: 54443

SEQ ID NO: 366141 - RNA, 64 nt, hsa; identical to SEQ ID NO: 54444

SEQ ID NO: 366142 - RNA, 64 nt, hsa; identical to SEQ ID NO: 54445

SEQ ID NO: 366143 - RNA, 64 nt, hsa; identical to SEQ ID NO: 54446

SEQ ID NO: 366144 - RNA, 64 nt, hsa; identical to SEQ ID NO: 54447

SEQ ID NO: 366145 - RNA, 64 nt, hsa; identical to SEQ ID NO: 54448

SEQ ID NO: 366146 - RNA, 64 nt, hsa; identical to SEQ ID NO: 54449

SEQ ID NO: 366147 - RNA, 64 nt, hsa; identical to SEQ ID NO: 54450

SEQ ID NO: 366148 - RNA, 64 nt, hsa; identical to SEQ ID NO: 54451

SEQ ID NO: 366149 - RNA, 64 nt, hsa; identical to SEQ ID NO: 54452

SEQ ID NO: 366150 - RNA, 58 nt, hsa; identical to SEQ ID NO: 54453

SEQ ID NO: 366151 - RNA, 64 nt, hsa; identical to SEQ ID NO: 54454

SEQ ID NO: 366152 - RNA, 64 nt, hsa; identical to SEQ ID NO: 54455

SEQ ID NO: 366153 - RNA, 64 nt, hsa; identical to SEQ ID NO: 54456

SEQ ID NO: 366154 - RNA, 64 nt, hsa; identical to SEQ ID NO: 54457

SEQ ID NO: 366155 - RNA, 64 nt, hsa; identical to SEQ ID NO: 54458

SEQ ID NO: 366156 - RNA, 64 nt, hsa; identical to SEQ ID NO: 54459

SEQ ID NO: 366157 - RNA, 64 nt, hsa; identical to SEQ ID NO: 54460

SEQ ID NO: 366158 - RNA, 64 nt, hsa; identical to SEQ ID NO: 54461

SEQ ID NO: 366159 - RNA, 64 nt, hsa; identical to SEQ ID NO: 54462

SEQ ID NO: 366160 - RNA, 64 nt, hsa; identical to SEQ ID NO: 54463

SEQ ID NO: 366161 - RNA, 64 nt, hsa; identical to SEQ ID NO: 54464

SEQ ID NO: 366162 - RNA, 53 nt, hsa; identical to SEQ ID NO: 54465

SEQ ID NO: 366163 - RNA, 64 nt, hsa; identical to SEQ ID NO: 54466

SEQ ID NO: 366164 - RNA, 64 nt, hsa; identical to SEQ ID NO: 54467

SEQ ID NO: 366165 - RNA, 64 nt, hsa; identical to SEQ ID NO: 54468

SEQ ID NO: 366166 - RNA, 64 nt, hsa; identical to SEQ ID NO: 54469

SEQ ID NO: 366167 - RNA, 64 nt, hsa; identical to SEQ ID NO: 54470

SEQ ID NO: 366168 - RNA, 64 nt, hsa; identical to SEQ ID NO: 54471

SEQ ID NO: 366169 - RNA, 64 nt, hsa; identical to SEQ ID NO: 54472

SEQ ID NO: 366170 - RNA, 64 nt, hsa; identical to SEQ ID NO: 54473

SEQ ID NO: 366171 - RNA, 64 nt, hsa; identical to SEQ ID NO: 54474

SEQ ID NO: 366172 - RNA, 64 nt, hsa; identical to SEQ ID NO: 54475

SEQ ID NO: 366173 - RNA, 64 nt, hsa; identical to SEQ ID NO: 54476

SEQ ID NO: 366174 - RNA, 64 nt, hsa; identical to SEQ ID NO: 54477

SEQ ID NO: 366175 - RNA, 64 nt, hsa; identical to SEQ ID NO: 54478

SEQ ID NO: 366176 - RNA, 64 nt, hsa; identical to SEQ ID NO: 54479

SEQ ID NO: 366177 - RNA, 64 nt, hsa; identical to SEQ ID NO: 54480

SEQ ID NO: 366178 - RNA, 64 nt, hsa; identical to SEQ ID NO: 54481

SEQ ID NO: 366179 - RNA, 64 nt, hsa; identical to SEQ ID NO: 54482

SEQ ID NO: 366180 - RNA, 64 nt, hsa; identical to SEQ ID NO: 54483

SEQ ID NO: 366181 - RNA, 64 nt, hsa; identical to SEQ ID NO: 54484

SEQ ID NO: 366182 - RNA, 64 nt, hsa; identical to SEQ ID NO: 54485

SEQ ID NO: 366183 - RNA, 64 nt, hsa; identical to SEQ ID NO: 54486

SEQ ID NO: 366184 - RNA, 64 nt, hsa; identical to SEQ ID NO: 54487

SEQ ID NO: 366185 - RNA, 64 nt, hsa; identical to SEQ ID NO: 54488

SEQ ID NO: 366186 - RNA, 64 nt, hsa; identical to SEQ ID NO: 54489

SEQ ID NO: 366187 - RNA, 64 nt, hsa; identical to SEQ ID NO: 54490

SEQ ID NO: 366188 - RNA, 64 nt, hsa; identical to SEQ ID NO: 54491

SEQ ID NO: 366189 - RNA, 64 nt, hsa; identical to SEQ ID NO: 54492

SEQ ID NO: 366190 - RNA, 64 nt, hsa; identical to SEQ ID NO: 54493

SEQ ID NO: 366191 - RNA, 64 nt, hsa; identical to SEQ ID NO: 54494

SEQ ID NO: 366192 - RNA, 64 nt, hsa; identical to SEQ ID NO: 54495

SEQ ID NO: 366193 - RNA, 64 nt, hsa; identical to SEQ ID NO: 54496

SEQ ID NO: 366194 - RNA, 64 nt, hsa; identical to SEQ ID NO: 54497

SEQ ID NO: 366195 - RNA, 64 nt, hsa; identical to SEQ ID NO: 54498

SEQ ID NO: 366196 - RNA, 64 nt, hsa; identical to SEQ ID NO: 54499

SEQ ID NO: 366197 - RNA, 64 nt, hsa; identical to SEQ ID NO: 54500

SEQ ID NO: 366198 - RNA, 64 nt, hsa; identical to SEQ ID NO: 54501

SEQ ID NO: 366199 - RNA, 64 nt, hsa; identical to SEQ ID NO: 54502

SEQ ID NO: 366200 - RNA, 64 nt, hsa; identical to SEQ ID NO: 54503

SEQ ID NO: 366201 - RNA, 64 nt, hsa; identical to SEQ ID NO: 54504

SEQ ID NO: 366202 - RNA, 64 nt, hsa; identical to SEQ ID NO: 54505

SEQ ID NO: 366203 - RNA, 64 nt, hsa; identical to SEQ ID NO: 54506

SEQ ID NO: 366204 - RNA, 64 nt, hsa; identical to SEQ ID NO: 54507

SEQ ID NO: 366205 - RNA, 64 nt, hsa; identical to SEQ ID NO: 54508

SEQ ID NO: 366206 - RNA, 64 nt, hsa; identical to SEQ ID NO: 54509

SEQ ID NO: 366207 - RNA, 64 nt, hsa; identical to SEQ ID NO: 54510

SEQ ID NO: 366208 - RNA, 64 nt, hsa; identical to SEQ ID NO: 54511

SEQ ID NO: 366209 - RNA, 64 nt, hsa; identical to SEQ ID NO: 54512

SEQ ID NO: 366210 - RNA, 64 nt, hsa; identical to SEQ ID NO: 54513

SEQ ID NO: 366211 - RNA, 64 nt, hsa; identical to SEQ ID NO: 54514

SEQ ID NO: 366212 - RNA, 64 nt, hsa; identical to SEQ ID NO: 54515

SEQ ID NO: 366213 - RNA, 64 nt, hsa; identical to SEQ ID NO: 54516

SEQ ID NO: 366214 - RNA, 64 nt, hsa; identical to SEQ ID NO: 54517

SEQ ID NO: 366215 - RNA, 64 nt, hsa; identical to SEQ ID NO: 54518

SEQ ID NO: 366216 - RNA, 64 nt, hsa; identical to SEQ ID NO: 54519

SEQ ID NO: 366217 - RNA, 64 nt, hsa; identical to SEQ ID NO: 54520

SEQ ID NO: 366218 - RNA, 64 nt, hsa; identical to SEQ ID NO: 54521

SEQ ID NO: 366219 - RNA, 64 nt, hsa; identical to SEQ ID NO: 54522

SEQ ID NO: 366220 - RNA, 64 nt, hsa; identical to SEQ ID NO: 54523

SEQ ID NO: 366221 - RNA, 64 nt, hsa; identical to SEQ ID NO: 54524

SEQ ID NO: 366222 - RNA, 64 nt, hsa; identical to SEQ ID NO: 54525

SEQ ID NO: 366223 - RNA, 64 nt, hsa; identical to SEQ ID NO: 54526

SEQ ID NO: 366224 - RNA, 64 nt, hsa; identical to SEQ ID NO: 54527

SEQ ID NO: 366225 - RNA, 64 nt, hsa; identical to SEQ ID NO: 54528

SEQ ID NO: 366226 - RNA, 64 nt, hsa; identical to SEQ ID NO: 54529

SEQ ID NO: 366227 - RNA, 64 nt, hsa; identical to SEQ ID NO: 54530

SEQ ID NO: 366228 - RNA, 64 nt, hsa; identical to SEQ ID NO: 54531

SEQ ID NO: 366229 - RNA, 64 nt, hsa; identical to SEQ ID NO: 54532

SEQ ID NO: 366230 - RNA, 64 nt, hsa; identical to SEQ ID NO: 54533

SEQ ID NO: 366231 - RNA, 64 nt, hsa; identical to SEQ ID NO: 54534

SEQ ID NO: 366232 - RNA, 64 nt, hsa; identical to SEQ ID NO: 54535

SEQ ID NO: 366233 - RNA, 64 nt, hsa; identical to SEQ ID NO: 54536

SEQ ID NO: 366234 - RNA, 64 nt, hsa; identical to SEQ ID NO: 54537

SEQ ID NO: 366235 - RNA, 64 nt, hsa; identical to SEQ ID NO: 54538

SEQ ID NO: 366236 - RNA, 64 nt, hsa; identical to SEQ ID NO: 54539

SEQ ID NO: 366237 - RNA, 64 nt, hsa; identical to SEQ ID NO: 54540

SEQ ID NO: 366238 - RNA, 64 nt, hsa; identical to SEQ ID NO: 54541

SEQ ID NO: 366239 - RNA, 64 nt, hsa; identical to SEQ ID NO: 54542

SEQ ID NO: 366240 - RNA, 64 nt, hsa; identical to SEQ ID NO: 54543

SEQ ID NO: 366241 - RNA, 64 nt, hsa; identical to SEQ ID NO: 54544

SEQ ID NO: 366242 - RNA, 64 nt, hsa; identical to SEQ ID NO: 54545

SEQ ID NO: 366243 - RNA, 64 nt, hsa; identical to SEQ ID NO: 54546

SEQ ID NO: 366244 - RNA, 64 nt, hsa; identical to SEQ ID NO: 54547

SEQ ID NO: 366245 - RNA, 64 nt, hsa; identical to SEQ ID NO: 54548

SEQ ID NO: 366246 - RNA, 64 nt, hsa; identical to SEQ ID NO: 54549

SEQ ID NO: 366247 - RNA, 64 nt, hsa; identical to SEQ ID NO: 54550

SEQ ID NO: 366248 - RNA, 64 nt, hsa; identical to SEQ ID NO: 54551

SEQ ID NO: 366249 - RNA, 64 nt, hsa; identical to SEQ ID NO: 54552

SEQ ID NO: 366250 - RNA, 64 nt, hsa; identical to SEQ ID NO: 54553

SEQ ID NO: 366251 - RNA, 64 nt, hsa; identical to SEQ ID NO: 54554

SEQ ID NO: 366252 - RNA, 64 nt, hsa; identical to SEQ ID NO: 54555

SEQ ID NO: 366253 - RNA, 64 nt, hsa; identical to SEQ ID NO: 54556

SEQ ID NO: 366254 - RNA, 64 nt, hsa; identical to SEQ ID NO: 54557

SEQ ID NO: 366255 - RNA, 64 nt, hsa; identical to SEQ ID NO: 54558

SEQ ID NO: 366256 - RNA, 64 nt, hsa; identical to SEQ ID NO: 54559

SEQ ID NO: 366257 - RNA, 64 nt, hsa; identical to SEQ ID NO: 54560

SEQ ID NO: 366258 - RNA, 64 nt, hsa; identical to SEQ ID NO: 54561

SEQ ID NO: 366259 - RNA, 64 nt, hsa; identical to SEQ ID NO: 54562

SEQ ID NO: 366260 - RNA, 64 nt, hsa; identical to SEQ ID NO: 54563

SEQ ID NO: 366261 - RNA, 64 nt, hsa; identical to SEQ ID NO: 54564

SEQ ID NO: 366262 - RNA, 64 nt, hsa; identical to SEQ ID NO: 54565

SEQ ID NO: 366263 - RNA, 64 nt, hsa; identical to SEQ ID NO: 54566

SEQ ID NO: 366264 - RNA, 64 nt, hsa; identical to SEQ ID NO: 54567

SEQ ID NO: 366265 - RNA, 64 nt, hsa; identical to SEQ ID NO: 54568

SEQ ID NO: 366266 - RNA, 64 nt, hsa; identical to SEQ ID NO: 54569

SEQ ID NO: 366267 - RNA, 64 nt, hsa; identical to SEQ ID NO: 54570

SEQ ID NO: 366268 - RNA, 64 nt, hsa; identical to SEQ ID NO: 54571

SEQ ID NO: 366269 - RNA, 64 nt, hsa; identical to SEQ ID NO: 54572

SEQ ID NO: 366270 - RNA, 64 nt, hsa; identical to SEQ ID NO: 54573

SEQ ID NO: 366271 - RNA, 64 nt, hsa; identical to SEQ ID NO: 54574

SEQ ID NO: 366272 - RNA, 64 nt, hsa; identical to SEQ ID NO: 54575

SEQ ID NO: 366273 - RNA, 64 nt, hsa; identical to SEQ ID NO: 54576

SEQ ID NO: 366274 - RNA, 64 nt, hsa; identical to SEQ ID NO: 54577

SEQ ID NO: 366275 - RNA, 64 nt, hsa; identical to SEQ ID NO: 54578

SEQ ID NO: 366276 - RNA, 64 nt, hsa; identical to SEQ ID NO: 54579

SEQ ID NO: 366277 - RNA, 64 nt, hsa; identical to SEQ ID NO: 54580

SEQ ID NO: 366278 - RNA, 64 nt, hsa; identical to SEQ ID NO: 54581

SEQ ID NO: 366279 - RNA, 64 nt, hsa; identical to SEQ ID NO: 54582

SEQ ID NO: 366280 - RNA, 64 nt, hsa; identical to SEQ ID NO: 54583

SEQ ID NO: 366281 - RNA, 64 nt, hsa; identical to SEQ ID NO: 188817

SEQ ID NO: 366282 - RNA, 64 nt, hsa; identical to SEQ ID NO: 188818

SEQ ID NO: 366283 - RNA, 64 nt, hsa; identical to SEQ ID NO: 188819

SEQ ID NO: 366284 - RNA, 64 nt, hsa; identical to SEQ ID NO: 188820

SEQ ID NO: 366285 - RNA, 64 nt, hsa; identical to SEQ ID NO: 188821

SEQ ID NO: 366286 - RNA, 64 nt, hsa; identical to SEQ ID NO: 188822

SEQ ID NO: 366287 - RNA, 64 nt, hsa; identical to SEQ ID NO: 188823

SEQ ID NO: 366288 - RNA, 64 nt, hsa; identical to SEQ ID NO: 188824

SEQ ID NO: 366289 - RNA, 64 nt, hsa; identical to SEQ ID NO: 188825

SEQ ID NO: 366290 - RNA, 64 nt, hsa; identical to SEQ ID NO: 188826

SEQ ID NO: 366291 - RNA, 64 nt, hsa
uuuccuuaaguuuugaucuccgucuuccugaugaagcaggcagagcucagaggaucuuggcauc

SEQ ID NO: 366292 - RNA, 64 nt, hsa
uaucuucccccaccuucuacaugguauuagucccagcaggcaucccuggggcagacgugcuuug

SEQ ID NO: 366293 - RNA, 64 nt, hsa
uguuggcuacaugaguauuuagaggaaguaagguagcaggcaguccagcccugauguggagaca

SEQ ID NO: 366294 - RNA, 64 nt, hsa
cugucuucaggcugccaggggaggaggagaagccagcaggcaccacuuuucugcucccuuucuc

SEQ ID NO: 366295 - RNA, 64 nt, hsa
uaggccugggauugagcuaaccugaaacaaagguagcaggcaggaccuaaugaccagagguuaa

SEQ ID NO: 366296 - RNA, 64 nt, hsa
ggccaacauuggugucccuguccccagagggaggagcaggcaggagagagaggggaaggaggua

SEQ ID NO: 366297 - RNA, 64 nt, hsa
cauaaauacaaagcagcuuccaucaggaacauggagcaggcagggacuccauuuuacagaauua

SEQ ID NO: 366298 - RNA, 64 nt, hsa
gcaggggccggagugagggggcugcuggcuuaacagcaggcaucugggcaggccaguccucaaa

SEQ ID NO: 366299 - RNA, 64 nt, hsa
cugcagccucagaaaccaggccucucacuccagcagcaggcagaaccgugucuguggucgggug

SEQ ID NO: 366300 - RNA, 64 nt, hsa
cugugggagcagacccgugggccucagggcagccagcaggcaggucuuguugccaauuuacaaa

SEQ ID NO: 366301 - RNA, 64 nt, hsa
gaaggcgcuggagccugcggggcagcaggggccaagcaggcacucuggggcuggcaccagcagg

SEQ ID NO: 366302 - RNA, 64 nt, hsa
gcaggggccaagcaggcacucuggggcuggcaccagcaggcacugaagcugcggcccugaucuc

SEQ ID NO: 366303 - RNA, 64 nt, hsa
ccuguuaauaugcucauugaaaacauggcauugaagcaggcacuugcguggauguuucucacuu

SEQ ID NO: 366304 - RNA, 64 nt, hsa
uaccuuuggaucugugagaaggugaauacaaagcagcaggcagaguaaaaucugcugggacugc

SEQ ID NO: 366305 - RNA, 64 nt, hsa
cucauccacuugagggcgccugagggccaggagcagcaggcaaggagccugggucuaggcuaag

SEQ ID NO: 366306 - RNA, 64 nt, hsa
ccgggggggacucaacagcagagcucugagcagcagcaggcaacuucgagaacggauccagaaa

SEQ ID NO: 366307 - RNA, 64 nt, hsa
caaggcucuccguggaguggacucgagucccuggagcaggcaguguggaggcagccauccccug

SEQ ID NO: 366308 - RNA, 64 nt, hsa
uggagccaugaggaggggcugggacuggagcuggagcaggcacuugcagccgggaaagccaggg

SEQ ID NO: 366309 - RNA, 64 nt, hsa
uccugaccucuucccaggcagugccuagcuccagagcaggcacagccugccucagcaugcuucg

SEQ ID NO: 366310 - RNA, 64 nt, hsa
gaagugguggagccucagggccagggcaggcaggagcaggcacugaugcuagagggugaugacc

SEQ ID NO: 366311 - RNA, 64 nt, hsa
cuucuaagacaggaaggaaagugaaggcagagugagcaggcaaaguagaaaauucgaaaagguc

SEQ ID NO: 366312 - RNA, 64 nt, hsa
auuguugcaaugacuugggagugccauagcaccuagcaggcagaagccagaaacaccaaauguc

SEQ ID NO: 366313 - RNA, 64 nt, hsa
augccggagagacagccccuugugcugugagcagagcaggcaguggcucuggaggcugccugug

SEQ ID NO: 366314 - RNA, 64 nt, hsa
caagguuuccucucuucccccaggaccugggcagagcaggcaugagcugggcuguggugcagag

SEQ ID NO: 366315 - RNA, 64 nt, hsa
ucaggugauuuccuagggagagguucccagucccagcaggcagaaugcccaaaaccaggagcac

SEQ ID NO: 366316 - RNA, 64 nt, hsa
acucccugguuucuuccuggcaugguguuugggcagcaggcaucauuuuccuuuucuagcuuca

SEQ ID NO: 366317 - RNA, 64 nt, hsa
caguaauaagaaucuaggaggaauuccaaaccgaagcaggcagggucuggaacccaaaggacag

SEQ ID NO: 366318 - RNA, 64 nt, hsa
cucagcacgcucacuaacccagcaugccacuuccagcaggcaugcaguccuggcccagcucuau

SEQ ID NO: 366319 - RNA, 64 nt, hsa
gguucuugcaagagcgcguggggacaguucuuccagcaggcacugguuuuguugccccagggcu

SEQ ID NO: 366320 - RNA, 64 nt, hsa
acgugcaugcuuuaaaaaacacagucacgcaccaagcaggcaaauagcuuuaguccuucucacc

SEQ ID NO: 366321 - RNA, 64 nt, hsa
ccggauaguaagaaaacaaacagcccaagugaaaagcaggcaaaagacuugaauagacacuuca

SEQ ID NO: 366322 - RNA, 64 nt, hsa
agccauuuuggcugcuguucuuuaaucuuccucuagcaggcaugcaguccaaggaauaucaaaa

SEQ ID NO: 366323 - RNA, 64 nt, hsa
aaccauuuuggcugcugcucuuuaauuuuccucuagcaggcaugcaguccaaggaauaucaaaa

SEQ ID NO: 366324 - RNA, 64 nt, hsa
acccugacgucccccagcaaaggaagacguugcaagcaggcaaaaugcgucgauuuuuuuuuuu

SEQ ID NO: 366325 - RNA, 64 nt, hsa
ccucagccauggcaaguccaucuggaguccaggaagcaggcaacuggccugacccaugagaccg

SEQ ID NO: 366326 - RNA, 64 nt, hsa
acaacaggcugugccuuauuuugauaauuuucugauucccuagaagagaacccucuacuuuuug

SEQ ID NO: 366327 - RNA, 64 nt, hsa
ugcugcaacugggcauaaaccugaccuggucuauauucccuagaguuccagucucuuuugcuua

SEQ ID NO: 366328 - RNA, 64 nt, hsa
gccuguccuuuacuucauccacaccuaugaagcuauucccuaaauaaggcauuucccaaguuag

SEQ ID NO: 366329 - RNA, 64 nt, hsa
caacugauggcaccauugaugugcaaauaaugagauucccuaucuccuuuuagaccugggacgg

SEQ ID NO: 366330 - RNA, 64 nt, hsa
cuugccccaagaaaagaggccaaagcaagagcagauucccuaggcaagagcagcagcacaacua

SEQ ID NO: 366331 - RNA, 64 nt, hsa
auuuauguuuugaaagaucauguguucccaaaguauucccuauuguuggcuccacagccuuaaa

SEQ ID NO: 366332 - RNA, 64 nt, hsa
cccuccagccuccagucuguaaaauggagguugcauucccuacuuccuaaacucucuuccagca

SEQ ID NO: 366333 - RNA, 64 nt, hsa
acagucauucuuugaaggugacacuguucuguauauucccuauaggcagcuggagagaucugug

SEQ ID NO: 366334 - RNA, 64 nt, hsa
aaagggcagccccaggcugucuggaaguuggagaauucccuaucagcacagggaucucagcucu

SEQ ID NO: 366335 - RNA, 64 nt, hsa
uuguaagcagccaacuguaaaugucuauuuugaaauucccuaugcuaagggugccuuagaauca

SEQ ID NO: 366336 - RNA, 64 nt, hsa
uuaaaaauuauauucaucucagcuuucuuagagaauucccuagaacuaaaaauuuauaaauaug

SEQ ID NO: 366337 - RNA, 64 nt, hsa
gaugggaaugaggaaggagugaggggaagaacagauucccuaaacuuucaugaggucaucccua

SEQ ID NO: 366338 - RNA, 64 nt, hsa
guagagaaaaauuuucauugacucccauuguggaauucccuagcaauuuauuuagacuuaauuu

SEQ ID NO: 366339 - RNA, 64 nt, hsa
caguguacugaggguacuggccuagccauguggaauucccuacccugacuccuuccccaaaccc

SEQ ID NO: 366340 - RNA, 64 nt, hsa
cuuccagaagaugcccuccaauccuuuccacccuauucccuaacucucgggaccucguuuggga

SEQ ID NO: 366341 - RNA, 64 nt, hsa
cccuguaguauuugcugugggccugaccuaauguauucccuagggucugcuuuagagaaggggg

SEQ ID NO: 366342 - RNA, 64 nt, hsa
guagauuuuuaacgaaugaagaugucuaauaguuauucccuauuuguuuucuucuguauguuag

SEQ ID NO: 366343 - RNA, 64 nt, hsa
aucuaaagaggaaaaguuuguuggaacaguauauauucccuauuuuuauguuuauuuaauccau

SEQ ID NO: 366344 - RNA, 64 nt, hsa
cccauagugugggggaccugcagagaaccauggcauucccuauuccacagucaucuuuggacag

SEQ ID NO: 366345 - RNA, 64 nt, hsa
cugagacugacucccuuaucucuucauauucuuuauucccuaccagauggauuuuuuuuuuuuu

SEQ ID NO: 366346 - RNA, 64 nt, hsa
ggcccauuuuauuggguggggggauaaaaaagggauucccuaacuuuaaauaaucagaauaucc

SEQ ID NO: 366347 - RNA, 64 nt, hsa
cacacauuaccuucuaauuauaguuugaaaauagauucccuacacauacauacauauguaugca

SEQ ID NO: 366348 - RNA, 64 nt, hsa
agagucauuccaaguccuauggccuggaaauuguauucccuauaauauacaaauuuuccuguaa

SEQ ID NO: 366349 - RNA, 64 nt, hsa
uuuagcauugccuuggcauaacaagggcccaucgauucccuacuaaugagaggcagggagagca

SEQ ID NO: 366350 - RNA, 64 nt, hsa
uaauauuuauuuguaugucaguauuuuucauuugauucccuauuagaauuaauuuuaaaacuug

SEQ ID NO: 366351 - RNA, 64 nt, hsa
auuacuauaacaucuaagcaucaucugauuugauauucccuaaaaaacauuuggaauauaugcu

SEQ ID NO: 366352 - RNA, 64 nt, hsa
gaagugggugggaaauaagguaaaauuuugaaccauucccuagucauuuccaaacuugaaaaca

SEQ ID NO: 366353 - RNA, 64 nt, hsa
agaaaaacaaaaaacaaaaaacaggggccaauaaauucccuaacauccacaguguuuucauuua

SEQ ID NO: 366354 - RNA, 64 nt, hsa
auaauuuucaagagaagaaaaaauuaagagauacauucccuaucaaaacauaucaauucaacac

SEQ ID NO: 366355 - RNA, 64 nt, hsa
aggaaauaaguuaaaaggcagcuuacaagagccuauucccuauaaaggguauaauuuuacacag

SEQ ID NO: 366356 - RNA, 64 nt, hsa
uauauuauuccugaaaauaaaaugaggggagaauauucccuaagcaacuggcaauaguauuccu

SEQ ID NO: 366357 - RNA, 64 nt, hsa
cauguaaacucauuucggcuaccauuugcuccaaauucccuagaacagugguuuuuaccacugu

SEQ ID NO: 366358 - RNA, 64 nt, hsa
guaguugggaugaaauggccucaggcaauuucacauucccuaauuaccuggaaaguucuacagu

SEQ ID NO: 366359 - RNA, 64 nt, hsa
acuggaaccccagcuucccuccagccucuccuccauucccuauggguucugugaccacugcugg

SEQ ID NO: 366360 - RNA, 64 nt, hsa
agugguuucccggagccaguagucacgguggaccauucccuacuugcuuuuccuuggaucacua

SEQ ID NO: 366361 - RNA, 64 nt, hsa
uaaagaucuggggaccucugggucuguucugaccauucccuagucuccauggccaagcacucaa

SEQ ID NO: 366362 - RNA, 64 nt, hsa
caucucccccagcccacuuguuuuccccccuuuuauucccuaggcccuuuucagacuccugggc

SEQ ID NO: 366363 - RNA, 64 nt, hsa
ugagaacaaauggaugugaucaugaaggaaucagauucccuauguaaagcaguuuaaaauggaa

SEQ ID NO: 366364 - RNA, 64 nt, hsa
uaaacucuuugccaaaauccuggggcuuugcugcauucccuaagauaauuacaggaaaaagaaa

SEQ ID NO: 366365 - RNA, 64 nt, hsa
gucaaugaauguguaguaucuccuucugacaagcauucccuauugggauuuuaaagcuaugugc

SEQ ID NO: 366366 - RNA, 64 nt, hsa
ggagugcuggagcuccagcagccccaaccacagcauucccuaacauggaggcaaaauaccacau

SEQ ID NO: 366367 - RNA, 64 nt, hsa
uugaugcccucuagauuaggugcccuuacuauccauucccuauacacccuguucuuucccagac

SEQ ID NO: 366368 - RNA, 64 nt, hsa
uggggcaugguauuuuauucauuucugaccuccaauucccuaaguggagauuaaauguuagaaa

SEQ ID NO: 366369 - RNA, 64 nt, hsa
gcucuggagaagaagcuggaucacucuuggucccauucccuaggcccugagcaagucaggcucc

SEQ ID NO: 366370 - RNA, 64 nt, hsa
aaacgagauguggaaggagaaccucagugauuuuauucccuagugaggccucugagggccucca

SEQ ID NO: 366371 - RNA, 64 nt, hsa
acucuagaaauggagaccgauuuacaauuuauguauucccuaauccaauuaucuaaaucuuccu

SEQ ID NO: 366372 - RNA, 64 nt, hsa
ucguuaguaucuaacauguaucccaacuccuauaauucccuaucuuuuaguuuuaguugcagaa

SEQ ID NO: 366373 - RNA, 64 nt, hsa
aggaaggguugguuuuuuuccauuuucuacauggauucccuacuuugaagagugugggggaaag

SEQ ID NO: 366374 - RNA, 64 nt, hsa
cucccuuagccauccccuccccuuuuguccuaucauucccuagaacaagccaccugucaauugu

SEQ ID NO: 366375 - RNA, 64 nt, hsa
uuaaaguuaaagggaugacuuuuaaaagcaggacauucccuaccuuuaauagugcaaagcacag

SEQ ID NO: 366376 - RNA, 64 nt, hsa
gguauggaaagaucuauugucagggaaucuuagaauucccuacacgagugggagaaagaugucc

SEQ ID NO: 366377 - RNA, 64 nt, hsa
gucaggcauccauuuugccuuuuaaacaacuaggauucccuacuaaccuccaccagcaaccugg

SEQ ID NO: 366378 - RNA, 64 nt, hsa
ugaacucacaaaguguucaagaaacccuuguauaauucccuacauuucucucgagcucacaaau

SEQ ID NO: 366379 - RNA, 64 nt, hsa
uauuauagacuuuguaccuguuauauauaugaauauucccuauguuaaauaauaauaauaacua

SEQ ID NO: 366380 - RNA, 64 nt, hsa
caugucuuagcacugauuauugguuuuacuuaauauucccuaaaaacuugaggaaggaagauga

SEQ ID NO: 366381 - RNA, 64 nt, hsa
uuauucuauagcuccaacuuaaggugccuuuuuaauucccuacaguuuuauggguguuaucagu

SEQ ID NO: 366382 - RNA, 64 nt, hsa
cgcgauacuaaaauccagugagcuuugggagaucauucccuaaagguauguggguugucugaag

SEQ ID NO: 366383 - RNA, 64 nt, hsa
gaugguguauaacucuagaguugaauuuuaagggauucccuaauauguauacuaucuuuuuauc

SEQ ID NO: 366384 - RNA, 64 nt, hsa
uuauacaccuuagucuuuccuuaguuaaaaaaaaauucccuaaagacuaacuugaaaagaaaac

SEQ ID NO: 366385 - RNA, 64 nt, hsa
auuuuguuuaacacuaucugccaaaauaaacuuuauucccuauaacuuaaaauguguauauaua

SEQ ID NO: 366386 - RNA, 64 nt, hsa
gguaggccuaaugaaggaguucacuguaagacucauucccuagaucuuucuauuccaaagugcc

SEQ ID NO: 366387 - RNA, 64 nt, hsa
caacacacugugauaaaggggacuagaguggaagauucccuauuuaaacacaugaagcucuggg

SEQ ID NO: 366388 - RNA, 64 nt, hsa
uaauuuaauuauaugauuugucugcacucaguuuauucccuacucaaaucucagccccauguug

SEQ ID NO: 366389 - RNA, 64 nt, hsa
acucugcggcgugaaaucuauuucacugcucuaaauucccuaugaauggauuuaguucugagga

SEQ ID NO: 366390 - RNA, 64 nt, hsa
agagaguuccuccaauucugaccgagugcugaucauucccuagagacaccaguaaccccgggcu

SEQ ID NO: 366391 - RNA, 64 nt, hsa
uuuagcugcuuguuuuaaguccuuuuuaugugacauucccuacccccaauguugucagcugcuu

SEQ ID NO: 366392 - RNA, 64 nt, hsa
gcuuuugcuuuguuuauuuauuuuuuuaauccucauucccuauguccacuugccuuccucuccg

SEQ ID NO: 366393 - RNA, 64 nt, hsa
cugugauuguaggggguugcuggguggccuucuuauucccuagccuuugguccauuucuuauga

SEQ ID NO: 366394 - RNA, 64 nt, hsa
aaucacauuacuaaaugccaacaauuaucucugaauucccuauccaggcuccccucauuucacc

SEQ ID NO: 366395 - RNA, 64 nt, hsa
cucccaguuagcugccuggaaaacucauagaaccauucccuagaucccauuuguccgagaggcu

SEQ ID NO: 366396 - RNA, 64 nt, hsa
aaaaaaaaguucuuguguguucguaucuuuauuuauucccuaguuugcagaacugucugaauaa

SEQ ID NO: 366397 - RNA, 64 nt, hsa
caccagugcaucacaucugcacacucucuucuccauucccuagcaggaacuucuagcucauuua

SEQ ID NO: 366398 - RNA, 64 nt, hsa
agguuagugagauccuaagcucucaaaauagcauauucccuagagcucaagaaagcugguccag

SEQ ID NO: 366399 - RNA, 64 nt, hsa
cuggcacuacucaguuauuacuguuuguucucuuauucccuagucuguguggcaaauuaaacaa

SEQ ID NO: 366400 - RNA, 64 nt, hsa
uuccucuauuugcuucauucuguccuuccacuauauucccuauuugguuaaugacaucaucgaa

SEQ ID NO: 366401 - RNA, 64 nt, hsa
gagagugugauguucacuauaaccccauaccuacauucccuaaugauacagccaaugacaggug

SEQ ID NO: 366402 - RNA, 64 nt, hsa
aagauucucuaauugucauauuuuacuuuuuaggauucccuaauaguggacuguuuauuugcag

SEQ ID NO: 366403 - RNA, 64 nt, hsa
uucauauugugauccuaaauuuuauauucacuauauucccuaaaguauaccuuaauaaauauuu

SEQ ID NO: 366404 - RNA, 64 nt, hsa
ugguccugucaagcaaccuaacaggcuaguucuaauucccuauuggguagaugaggggaugaca

SEQ ID NO: 366405 - RNA, 64 nt, hsa
gaguagcugcuuggugggacagcugauuucuuugauucccuagcugcaaaaccugaaauugacc

SEQ ID NO: 366406 - RNA, 64 nt, hsa
uuucaucgggagaaaccacucagagauggaucccauucccuaaaggucucacagcaaaggagca

SEQ ID NO: 366407 - RNA, 64 nt, hsa
aagucucuuaaagccaucuagcccaccuccaucaauucccuaugugaggaagcaaaaccccagg

SEQ ID NO: 366408 - RNA, 64 nt, hsa
cuccguucugaagguucugcguccuguuuugucaauucccuagacgguuuugaaguuauauucu

SEQ ID NO: 366409 - RNA, 64 nt, hsa
aaaaucaggaaaaaaauuuuuuuucaauaaucuuauucccuauauuaaauuagauuugaagagg

SEQ ID NO: 366410 - RNA, 64 nt, hsa
acuuauacaagauaccauuuacacugaacauagaauucccuaguggaaugucaucuauaguuca

SEQ ID NO: 366411 - RNA, 64 nt, hsa
caaauuucauucagaaccauuuuaguguuuuccuauucccuaccccucccacuacuuucaauga

SEQ ID NO: 366412 - RNA, 64 nt, hsa
aacugaauguaaaacacuccuagccaguuguugcauucccuauauuuauuuacuuccaauauuu

SEQ ID NO: 366413 - RNA, 64 nt, hsa
aaaaaaaauucuuguugaaauauuuugaaaacaaauucccuacuaucaucacaugccuccccaa

SEQ ID NO: 366414 - RNA, 64 nt, hsa
uaaaucauuugagauuuuugguuuuuugauuucuauucccuaacuugugaagacaaugaaaaau

SEQ ID NO: 366415 - RNA, 64 nt, hsa
acguaucucuguaaauucuucuacagucacuuagauucccuauuuggaaaauugauccaaguua

SEQ ID NO: 366416 - RNA, 64 nt, hsa
gucccuuccuucccugaaacccugcucuauugcaauucccuauuauauucugcaucagaaaaac

SEQ ID NO: 366417 - RNA, 64 nt, hsa
cugaacacagugucuguucagcaaacuaaccagcauucccuacagccuagggcagacaauagua

SEQ ID NO: 366418 - RNA, 64 nt, hsa
aggguauguuuuguauccccuuucugauaaacccauucccuaccaauuuuaugucauaagagau

SEQ ID NO: 366419 - RNA, 64 nt, hsa
agcaguucuaagagacacugcccacaugauggccauucccuacuucauccuugcugagcuaaau

SEQ ID NO: 366420 - RNA, 64 nt, hsa
gacucauucugaaggagccccauuccugggaaauauucccuagaaacuuccaaauccccuaagc

SEQ ID NO: 366421 - RNA, 64 nt, hsa
aagaaauggguuuuaaacuuugguaugcaucagaauucccuauagaucuuuuugaaaauauagg

SEQ ID NO: 366422 - RNA, 64 nt, hsa
cagcccccagggcuuccuucuggccccucugaggauucccuagggcugccccgcagaggggcuu

SEQ ID NO: 366423 - RNA, 64 nt, hsa
uacagugcaggaaccaaaacuuguucaucucaugauucccuacaucugacauaaggaaaguaag

SEQ ID NO: 366424 - RNA, 64 nt, hsa
ccccugaggaaauggaaugaaccacucccugcccauucccuauaagaauaucccaagacccagg

SEQ ID NO: 366425 - RNA, 64 nt, hsa
uaaaaaacuccuguguggcagaaaguaaaagaaaauucccuaaauuauagcaaggaacaugaau

SEQ ID NO: 366426 - RNA, 64 nt, hsa
cuugaacugacaguaggccagccuguucucugccauucccuagucauccugugccucaccacag

SEQ ID NO: 366427 - RNA, 64 nt, hsa
cucuccuugcuuuucucaccucucacuuacccccauucccuauuacccuauucuuaccuagccu

SEQ ID NO: 366428 - RNA, 64 nt, hsa
ccugcagccuggaaagaggagggaggccaaggccauucccuaacucccuccugccccuggucug

SEQ ID NO: 366429 - RNA, 64 nt, hsa
cugauuggaagugguuucuuugacuuucaaggucauucccuaucaguuacuacuaagaguucuc

SEQ ID NO: 366430 - RNA, 64 nt, hsa
cuguauuuaucacuggcacaauugauguguuuugauucccuaaaacaaaauuagggagucaaac

SEQ ID NO: 366431 - RNA, 64 nt, hsa
aucugauguauuaucagugaaaaccaugcugcuuauucccuaauacaaugguucucaaacuuua

SEQ ID NO: 366432 - RNA, 64 nt, hsa
gguuuaguucucaggcagcuacaaaugccuauuuauucccuaauguaccugaacacuaguacca

SEQ ID NO: 366433 - RNA, 64 nt, hsa
uuauuugucugcccuacccauagcaccaaauuccauucccuagaagaaacuacuuacaugugca

SEQ ID NO: 366434 - RNA, 64 nt, hsa
ucaccuggggaagccccggaaucuuaguucuuccauucccuacucuuccuuccgagggagucag

SEQ ID NO: 366435 - RNA, 64 nt, hsa
aaaauacucuguaauucuacaucuaaaaaaaccgauucccuaauucgaauuuauugguaccaaa

SEQ ID NO: 366436 - RNA, 64 nt, hsa
aaaauuacuauuguauacaagcuuaauuguuaauauucccuaaacacaauuuuaugaagggaga

SEQ ID NO: 366437 - RNA, 64 nt, hsa
uuguauguauuguggaucugcaugugugcugaguauucccuauuucuuugaucccuuuuccccc

SEQ ID NO: 366438 - RNA, 64 nt, hsa
uacuuguacauaugauuuguacuucugcugugagauucccuagugucaaaauuaaaucaauaaa

SEQ ID NO: 366439 - RNA, 64 nt, hsa
auuagagccgcuuccauuaagaagaucgugacaaauucccuaccccuguuugcucuucaggaaa

SEQ ID NO: 366440 - RNA, 64 nt, hsa
uuuaaaaaaccauuucaguguacauuguguacuaauucccuacuagccaguuugggacauuggc

SEQ ID NO: 366441 - RNA, 64 nt, hsa
ugauaguaccaucucuuucacauacuacauacaaauucccuaauaaucaaaagauuguacacau

SEQ ID NO: 366442 - RNA, 64 nt, hsa
agcacaauacuaucuccugaaagagauaagagacauucccuagauucaaaggcaaaacagaaga

SEQ ID NO: 366443 - RNA, 64 nt, hsa
cagcugauguuaaacuuuucauauuucaaauuagauucccuaggagguauaauauauauuucuu

SEQ ID NO: 366444 - RNA, 64 nt, hsa
ccuuacugaccuguccuccuucagggacaugagcauucccuauagauuaggguucuucuuaucc

SEQ ID NO: 366445 - RNA, 64 nt, hsa
uagcaaggccaacccugaagaggcccuuugaggcauucccuauggcuuagaguuguagacuuac

SEQ ID NO: 366446 - RNA, 64 nt, hsa
aagaggcuguagucauguccccaucccccacuggauucccuacaaggagaggccuugggcccag

SEQ ID NO: 366447 - RNA, 64 nt, hsa
cgaaaugggugccgccggcccccacucccaauucauucccuaaccugcaaaccuuuccaacuuc

SEQ ID NO: 366448 - RNA, 64 nt, hsa
auuucauucuuugugaaaugguugcuuccuccugauucccuaauugugcuguguucgugucuug

SEQ ID NO: 366449 - RNA, 64 nt, hsa
ccggugccugcagccuucauaagcacacacguccauucccuacuaaggcccagaccuccuggua

SEQ ID NO: 366450 - RNA, 64 nt, hsa
ucaaaagguugguuuauuuguauuuuauuuucaaauucccuauuccaaaaauagugccgggugg

SEQ ID NO: 366451 - RNA, 64 nt, hsa
uuaauaaaaguugccauuucaacuacgucccaacauucccuaauaggguauucagggaaccugu

SEQ ID NO: 366452 - RNA, 64 nt, hsa
aaaguaaaguaaugcauuugagcauggccagacuauucccuaggacaaggaagcagagggaaau

SEQ ID NO: 366453 - RNA, 64 nt, hsa
gugcaugugacucaguaacuucacauagaauaugauucccuaaguaugcuacacagcaucauau

SEQ ID NO: 366454 - RNA, 64 nt, hsa
auuaauagagauagcaagggauaauuaaauaaauauucccuauguagcaacagugguuagauga

SEQ ID NO: 366455 - RNA, 64 nt, hsa
ucaacuaugagguggaucggagauuucauagagaauucccuaaauuuuuuacauuccgagcaag

SEQ ID NO: 366456 - RNA, 64 nt, hsa
caaucccuauuuuugucuguuccauuuucuuuggauucccuauucacauugaauccuuuuugcc

SEQ ID NO: 366457 - RNA, 64 nt, hsa
ugggcuugcaaccucucaucacacagccacauaaauucccuaggaaguaaauucauuuacaaug

SEQ ID NO: 366458 - RNA, 64 nt, hsa
ugaacuuuuauguuaggacauuacuaaauaaagaauucccuagcugcuuauaaaguaaauuuac

SEQ ID NO: 366459 - RNA, 64 nt, hsa
uuuuaccuuugggaauauguuaauuucaggcagcauucccuaugggaaaggugauaccagcucu

SEQ ID NO: 366460 - RNA, 64 nt, hsa
ggccaugaagugaggagaugguuauuuaaagagaauucccuauuuauuugacaaaaaauccagu

SEQ ID NO: 366461 - RNA, 64 nt, hsa
uuaucguaauagaaacuuauccaguuugaaaaucauucccuaaagcaugcaauaggaaaaagaa

SEQ ID NO: 366462 - RNA, 64 nt, hsa
acaugcaaaagacuauuaaguuaggaugaacuagauucccuaauuacagugaaauucuaucuug

SEQ ID NO: 366463 - RNA, 64 nt, hsa
gacaaaccugacaaaaacaagcaauggggaaaggauucccuauuuaauaaauggugcugggaaa

SEQ ID NO: 366464 - RNA, 64 nt, hsa
ucagggcauuaccgcuaacgucugcaggagcuuuauucccuauuaauagaaaaccgucacagug

SEQ ID NO: 366465 - RNA, 64 nt, hsa
aaauacccaaaugucccugcaagcccguuaaauaauucccuaugcuacccuuaauaacauacaa

SEQ ID NO: 366466 - RNA, 64 nt, hsa
aagagaaucuaaucuaauuguuuuuauaaaaauuauucccuauugaauauuuauauaaugaggu

SEQ ID NO: 366467 - RNA, 64 nt, hsa
uuaauauaagaaaccuacuagcauucaaauaaucauucccuauuuuacaaugcaucaguucugu

SEQ ID NO: 366468 - RNA, 64 nt, hsa
uacuaaacaugaacagacauuuuuucuugucauuauucccuaaacuauauaguauaauaaauau

SEQ ID NO: 366469 - RNA, 64 nt, hsa
agaaucguuaauaguggagcccaaaacaggccucauucccuacccuugacugguuuagcugugg

SEQ ID NO: 366470 - RNA, 64 nt, hsa
gguucccugaaggaggagagggaugauagcuuggauucccuaggucuuuccaggaugcagaaag

SEQ ID NO: 366471 - RNA, 64 nt, hsa
cuagcaaaccagauaagaaaagauguuaaugcccauucccuaacuuaugucuuagaccaaaauu

SEQ ID NO: 366472 - RNA, 64 nt, hsa
cucacuccuguucccuuauucuucauucccaguaauucccuaccaaaugguggggacccugagc

SEQ ID NO: 366473 - RNA, 64 nt, hsa
gcucucagaucucuauuucauuuuguggcuuaccauucccuagcacacuggccuugccaucuug

SEQ ID NO: 366474 - RNA, 64 nt, hsa
uucugccuagugacagguuaucaccacguuauauauucccuaccgaaggagacaccuuuucccc

SEQ ID NO: 366475 - RNA, 64 nt, hsa
uccaaggaaacgccuguaggaagaaaaaggaugcauucccuacagauuuuuggagaaaggauuu

SEQ ID NO: 366476 - RNA, 64 nt, hsa
ucagucccccaguccugaguggggguucucgccaauucccuaaugagauuccaccccaauauca

SEQ ID NO: 366477 - RNA, 64 nt, hsa
gccuccuagggucccuuuuucugaugaagucuuaauucccuaaaagcgccucuuuggacacuga

SEQ ID NO: 366478 - RNA, 64 nt, hsa
gcacaggugugaguccucuguuugcacuggacauauucccuaccugucuuauuucauagguaca

SEQ ID NO: 366479 - RNA, 64 nt, hsa
gcacaggugugaguccucuguuugcacuggacauauucccuaccuguuuuauuucauagguaca

SEQ ID NO: 366480 - RNA, 64 nt, hsa
caauuauuucccccauuuuucccaggcaaauaaaauucccuaaagccaaaauuucuccuggauc

SEQ ID NO: 366481 - RNA, 64 nt, hsa
cucagccaguggaacgugccggaacuuuuuguccauucccuaguaggccugccacagccuagau

SEQ ID NO: 366482 - RNA, 64 nt, hsa
uugauaacaauggaagcgaguuuaauauaaaacaauucccuaagcauuuauuuuuuuuuuaaaa

SEQ ID NO: 366483 - RNA, 64 nt, hsa
ugaaccaugagggcccucugcccaggugaugggcauucccuaagcugcuauggaaucugcuccc

SEQ ID NO: 366484 - RNA, 64 nt, hsa
auuuuuuucuauaaucacuaugaccguguucacgauucccuacucugcaacucucagcaugcau

SEQ ID NO: 366485 - RNA, 64 nt, hsa
accagaggacuuucuuguuagcaucccuuuccugauucccuauuuuguuaauuuuaaugauaag

SEQ ID NO: 366486 - RNA, 64 nt, hsa
cacaaaacagccuuagccuccuuguugccaaauaauucccuaacuguggaguuuuaggaaguca

SEQ ID NO: 366487 - RNA, 64 nt, hsa
ccucaccaccucuuucuacagccuaauuuauuggauucccuauucguagccaucuccguggcca

SEQ ID NO: 366488 - RNA, 64 nt, hsa
acaguguuuccaagagcaagcuggauccgaguagauucccuagggcuuguuggaggaacuaguu

SEQ ID NO: 366489 - RNA, 64 nt, hsa
gagcccuucuaccuggcucuaucucacuggcugcauucccuacacagggaauuuacuacccuau

SEQ ID NO: 366490 - RNA, 64 nt, hsa
gcaaacugaccggccuaaaacuaaaaugacauuuauucccuagcuacaaacaucagcguuauua

SEQ ID NO: 366491 - RNA, 64 nt, hsa
agaguagaggauacaagugaugugaauaaaauggaaauugcauugaguuaaugaaacagacacu

SEQ ID NO: 366492 - RNA, 64 nt, hsa
auauuuugugucacaugaaaauuauaugaaauucaaauugcaguguccauaaguaaaguuuuau

SEQ ID NO: 366493 - RNA, 64 nt, hsa
aggucugaggaugauguagauuacugaaaaaugcaaauugcaaucauauaaauaaguguuuuug

SEQ ID NO: 366494 - RNA, 64 nt, hsa
ugccucccucaaaggaccugcaggcagagacugaaaauugcagacagaggggcacgucugggca

SEQ ID NO: 366495 - RNA, 64 nt, hsa
auuaucagcucaguagagcagugagaaacugaucaaauugcacuuguucuccuacaagcaaccu

SEQ ID NO: 366496 - RNA, 64 nt, hsa
aagugaagcacaaggauuaaguuggaaaagcuguaaauugcaugugcauauuugucuauuuuuu

SEQ ID NO: 366497 - RNA, 64 nt, hsa
augcaauuuuacuuugucuagcuucuaaugugguaaauugcacauugugcaacagaaccauuaa

SEQ ID NO: 366498 - RNA, 64 nt, hsa
aucaaauaucuugcuuuugggucuucuccaaaguaaauugcauggacuucuuaaagaaguuuga

SEQ ID NO: 366499 - RNA, 64 nt, hsa
ccugucacauguuucuguuucuauaguaauuuagaaauugcaaauaguuaacuuuucaucaugu

SEQ ID NO: 366500 - RNA, 64 nt, hsa
aaagucauugccaaggucugauuuuucacacaaaaaauugcaacccccagcauaaauggguuag

SEQ ID NO: 366501 - RNA, 64 nt, hsa
ccugcaguucuggaccauguggagcuacauggagaaauugcacagacagaaucacuuugccaca

SEQ ID NO: 366502 - RNA, 64 nt, hsa
ggcccucccuccaggguagagaugcaccgaauggaaauugcacuaaggaccucuuccuuugcug

SEQ ID NO: 366503 - RNA, 64 nt, hsa
gaagcgaucaagaauccagauucuauaacaaaucaaauugcacuuuuggaagcccggugucaug

SEQ ID NO: 366504 - RNA, 64 nt, hsa
aacauaacaaaaaguguugcuguaaauccaaaagaaauugcaucuaagggacuuuguugaacuu

SEQ ID NO: 366505 - RNA, 64 nt, hsa
auauaaaauuaugagauugguuuuccuguggcauaaauugcaucacuguaucauuuucuuuuuu

SEQ ID NO: 366506 - RNA, 64 nt, hsa
auugccucugaaaaguguguauauauuuugugugaaauugcauacuuuguauuuugauuauuuu

SEQ ID NO: 366507 - RNA, 64 nt, hsa
acuuuaaggacauucaaaguuuaaaauaguguucaaauugcaaaauuuggcaaucuucauauaa

SEQ ID NO: 366508 - RNA, 64 nt, hsa
uucauaucuagguauccauugugacagacaaguaaaauugcaggugauuugauaauuaagcacc

SEQ ID NO: 366509 - RNA, 64 nt, hsa
accguguuguaaagauacccacuaauggacaaucaaauugcagaaaaggcucaauauccaagag

SEQ ID NO: 366510 - RNA, 64 nt, hsa
aaucuguuaccaguaggaggaggaugagccacagaaauugcauaauuuucuaauuucaagucuu

SEQ ID NO: 366511 - RNA, 64 nt, hsa
aaauuuugucuauugucuuagaauugauugccagaaauugcaagauguaauauaucaaagucag

SEQ ID NO: 366512 - RNA, 64 nt, hsa
aaauuguaagcuauuuuuuuuuguccugaugucuaaauugcagugauaagaauagguugauaca

SEQ ID NO: 366513 - RNA, 64 nt, hsa
uuaagucaacaaaaugcaauaucagucaucagguaaauugcaagcugaggauaaauaauaaaac

SEQ ID NO: 366514 - RNA, 64 nt, hsa
uuuuaaacucacgauaccaguuaucuguuaaucaaaauugcauuuuacaauuuaauaaugugau

SEQ ID NO: 366515 - RNA, 64 nt, hsa
uauuggccaauuaucuuuaauaauuuaccuuuugaaauugcauguuuaucauauauccuuaagu

SEQ ID NO: 366516 - RNA, 64 nt, hsa
uuuuuuuuuuuuaaacaguaacauccagagugacaaauugcaggagauuuaauguauaaaauuu

SEQ ID NO: 366517 - RNA, 64 nt, hsa
uuccauuccauuauuacaagugaugaaaaacaaaaaauugcaaguaguaugcaaauuauaaaua

SEQ ID NO: 366518 - RNA, 64 nt, hsa
ggucaacucuugacaguugccucaagauggagugaaauugcaucgaggguaagacuguguccac

SEQ ID NO: 366519 - RNA, 64 nt, hsa
ucuuugggauaauuccuauccuuuucagggaggcaaauugcacgugaguuuaaguaugaaggca

SEQ ID NO: 366520 - RNA, 64 nt, hsa
uauuaauagucaugguucguauuuuaggugacugaaauugcaucagugaucauaaugagguuug

SEQ ID NO: 366521 - RNA, 64 nt, hsa
ucaugaccucucagaauaaggugucaccucccugaaauugcauauauguauauagacaugcaca

SEQ ID NO: 366522 - RNA, 64 nt, hsa
gccuuuugguuugggcuguauugaaauccuuucuaaauugcaugaauaggcucugcuaacguga

SEQ ID NO: 366523 - RNA, 64 nt, hsa
uaaaccaguuucucauugcauaagauacagauguaaauugcauggagagguugauaugcaccug

SEQ ID NO: 366524 - RNA, 64 nt, hsa
aaccuaugacacuucuuauuccacacugaaugugaaauugcauguucagauguuuacuacgagg

SEQ ID NO: 366525 - RNA, 64 nt, hsa
uauacuaaaccucacaaaguagaggaauccauguaaauugcaaauaaaccacuuucuaauuuuu

SEQ ID NO: 366526 - RNA, 64 nt, hsa
ccaccuaauaucaauuuguagguaauguuccugaaaauugcaauacauuucaauuauacuaaac

SEQ ID NO: 366527 - RNA, 64 nt, hsa
uguaaucccagcuacucaggaggcugaggcaggaaaauugcaugaaccuaaguggcagagguug

SEQ ID NO: 366528 - RNA, 64 nt, hsa
aauauuuacauauuuugcuguaguauuugaguauaaauugcagauacuauaacacaucacaucu

SEQ ID NO: 366529 - RNA, 64 nt, hsa
gauuagcaaaauuauuaauuuaaaaccccaaaguaaauugcaaauuuuaaaauuuauuuuugac

SEQ ID NO: 366530 - RNA, 64 nt, hsa
acagcccuuaaaauuuuagcuuaaggacauuuuaaaauugcaugagauuagcaaaauuauuaau

SEQ ID NO: 366531 - RNA, 64 nt, hsa
uguuucauggauuuuucaucuucuaccguaugugaaauugcaaguguuugaagauuuauaagua

SEQ ID NO: 366532 - RNA, 64 nt, hsa
aaggugccacucaguuuuagccaugucuucacugaaauugcaaaaguacuuuuagggagcagga

SEQ ID NO: 366533 - RNA, 64 nt, hsa
ccuaaaucaccuggaaggagagcauuacucaccaaaauugcaaaacaaggguaucaagaauuug

SEQ ID NO: 366534 - RNA, 64 nt, hsa
auauuggauauaaugcugcuuuuuagagacaccuaaauugcaguaucagaaugaauguugaugu

SEQ ID NO: 366535 - RNA, 64 nt, hsa
gcaaagcuugcuuuggggaguuggauaaugugaaaauuuuaaguaccuaggggagaaagagcca

SEQ ID NO: 366536 - RNA, 64 nt, hsa
guaagaccguggacuguuuuuuauaauauggccuaauuuuaaagguccaaaauaacuuguuuuu

SEQ ID NO: 366537 - RNA, 64 nt, hsa
uuccucugcccuuuuaacuaaacuaaaacuugugaauuuuaaauuauuaaggggggggugcugu

SEQ ID NO: 366538 - RNA, 64 nt, hsa
aagcccaaaaauagauuguggcucccaggauuccaauuuuaauuggagagcuaaguaaguaaag

SEQ ID NO: 366539 - RNA, 64 nt, hsa
gugauuuuaaaaaccagaauuuuaguugcaauacaauuuuaauaucacccuacauauuauuuau

SEQ ID NO: 366540 - RNA, 64 nt, hsa
caguagauaagcugucgaaaauggaaaacaauucaauuuuaauuuucugcucugaguauuuagu

SEQ ID NO: 366541 - RNA, 64 nt, hsa
ucugcacccuuaccccuuuccaccuuuuguauuuaauuuuaaagucaguguacugcaaggaagc

SEQ ID NO: 366542 - RNA, 64 nt, hsa
uuuugaaaauaaugaucucagacuuucuaaguuaaauuuuaaaaauuuugauuguuugccauau

SEQ ID NO: 366543 - RNA, 64 nt, hsa
gccaucgucuuuguuuucuuuuuugucuugaaugaauuuuaaaaggaaauauauaauaaaaaug

SEQ ID NO: 366544 - RNA, 64 nt, hsa
uguaugucuccucaaaugaaaauucuuuaucugaaauuuuaaaagacauugauuccacauguaa

SEQ ID NO: 366545 - RNA, 64 nt, hsa
acuuaacagcucauuuugucuuuuucaauauacaaauuuuaaaaauacuacaauauuuaacuaa

SEQ ID NO: 366546 - RNA, 64 nt, hsa
aauaucugucaacaguuaauaaucauguuauguuaauuuuaacaugauugcugacuuggauaau

SEQ ID NO: 366547 - RNA, 64 nt, hsa
aauauuuugagauauaaaaguaggaaacagguauaauuuuaaugugaaaauuaagucuucacuu

SEQ ID NO: 366548 - RNA, 64 nt, hsa
ugacuuaaauuccuauuugaauccccuuucccggaauuuuaagugucucuacaacuuugaauaa

SEQ ID NO: 366549 - RNA, 64 nt, hsa
cuaaagaacaguuagaguaacuguuuaaccucagaauuuuaaaggcaguuguuucuuuccuaag

SEQ ID NO: 366550 - RNA, 64 nt, hsa
auauauaauuuaauguaaauaaaacaucacuaucaauuuuaaggaaacuuuuuaauugugcaaa

SEQ ID NO: 366551 - RNA, 64 nt, hsa
ccaauaaaauguaucugcauauguuuuccacauaaauuuuaauucaagaaaugacagucaaaag

SEQ ID NO: 366552 - RNA, 64 nt, hsa
auauuuccuauauaacuaaaaauuuuguuucauaaauuuuaaaauaauuauuuuugacuaugaa

SEQ ID NO: 366553 - RNA, 64 nt, hsa
aauuguuuuauaauaauccaaacucuaugaaagcaauuuuaaaaauuauuaagguuuuaugaag

SEQ ID NO: 366554 - RNA, 64 nt, hsa
uuuaucacuguguauuuuuccaagcacaguauaaaauuuuaacaacgcacaaaaaaauacagaa

SEQ ID NO: 366555 - RNA, 64 nt, hsa
acuacuguucuauuugcaauauuaggcugcgugaaauuuuaaaaggaaaaauguaucuguuccu

SEQ ID NO: 366556 - RNA, 64 nt, hsa
uugguacguuauguccugguuuaaaaaggauuaaaauuuuaaaauaauccuugcaucuaaaggc

SEQ ID NO: 366557 - RNA, 64 nt, hsa
uuuuuuuuuuugugcuggaagucuguaucuugacaauuuuaauaaaucagcuggaacugauaga

SEQ ID NO: 366558 - RNA, 64 nt, hsa
acacucgugugcaugagaaugucauuugcuaaugaauuuuaaaagcauauauaaaacaaaacaa

SEQ ID NO: 366559 - RNA, 64 nt, hsa
uaacaauugauuuucccccuaauucuuauuuuauaauuuuaaaauugcagcaguugcuagcaac

SEQ ID NO: 366560 - RNA, 64 nt, hsa
uuaacaugcauugcuuuaauuuugcccagggacaaauuuuaauaaucagcaagacugguuugug

SEQ ID NO: 366561 - RNA, 64 nt, hsa
ugauuuuuuuuagcugaaaaaugcuggcaagaagaauuuuaaagcuuaaaauaggugguaaauu

SEQ ID NO: 366562 - RNA, 64 nt, hsa
ugccagaauuucuaaauaaauccccugguuaggaaauuuuaaaagucaaagcuuguuuucuuca

SEQ ID NO: 366563 - RNA, 64 nt, hsa
guuucugugauuauaaagcauuuuuuaagagacaaauuuuaacuuuuaauuuuuauuuuggcaa

SEQ ID NO: 366564 - RNA, 64 nt, hsa
aaucguuguacauuucuuauuaaacuaagugcuuaauuuuaaaguauuauguugccaucauaua

SEQ ID NO: 366565 - RNA, 64 nt, hsa
auggaauuauguuuauuuuuaugggauuuggguaaauuuuaaauugucuagaaaacugaaauuu

SEQ ID NO: 366566 - RNA, 64 nt, hsa
guguaacauauguuaaauaaaacuguuauuuuugaauuuuaaaauuuguuuuuuggggguauga

SEQ ID NO: 366567 - RNA, 64 nt, hsa
uaguucacuaaagggugcccacaaaauagagauuaauuuuaacuuaaauuuuaagcuugaagau

SEQ ID NO: 366568 - RNA, 64 nt, hsa
gggugcccacaaaauagagauuaauuuuaacuuaaauuuuaagcuugaagauuagguacuaucu

SEQ ID NO: 366569 - RNA, 64 nt, hsa
uuaauuaacuaugugauguuaacuauuauuaauaaauuuuaacauuuuccaaaauaaucaaaug

SEQ ID NO: 366570 - RNA, 64 nt, hsa
aauuucuugggguuaaccaucuuuaguuaaauggaauuuuaauuuaaaugacgcuuugcuaauu

SEQ ID NO: 366571 - RNA, 64 nt, hsa
uuaaauggaauuuuaauuuaaaugacgcuuugcuaauuuuaaguguuaagcauuuugcauuaaa

SEQ ID NO: 366572 - RNA, 64 nt, hsa
cuagacaaauaacuacugcaaaaaguacauagugaauuuuaaaauguagaagaaagcaaaaaau

SEQ ID NO: 366573 - RNA, 64 nt, hsa
aaaauaaaauaaguccuaaagugaagaagccaucaauuuuaacauuugaugucuagauaacauu

SEQ ID NO: 366574 - RNA, 64 nt, hsa
aaauuugauuuuaaauuucaaauaaauuuaaauaaauuuuaaauaaauuuuaaauaaaauuuua

SEQ ID NO: 366575 - RNA, 64 nt, hsa
uaaauuucaaauaaauuuaaauaaauuuuaaauaaauuuuaaauaaaauuuuacagagacgugg

SEQ ID NO: 366576 - RNA, 64 nt, hsa
ccccaucaaagcugaacuugaaacguuuuagcagaauuuuaaauaugugaaaguucauuguggu

SEQ ID NO: 366577 - RNA, 64 nt, hsa
aaguguaacuguaucauacuuuuuuuguauuuuaaauuuuaaaauaaaggcuaauauauuuaga

SEQ ID NO: 366578 - RNA, 64 nt, hsa
uauuuagacaggauuuccaaaaacuuugucuucaaauuuuaauuuucuuccuaauauucuucac

SEQ ID NO: 366579 - RNA, 64 nt, hsa
auuauaaaacucuugaggcacuugguauguuaaaaauuuuaaacuuuaguaacauuagguuaca

SEQ ID NO: 366580 - RNA, 64 nt, hsa
aguuauuauaaauguuaauacacaacuuucagguaauuuuaacugauuauuucuuuugcucuuu

SEQ ID NO: 366581 - RNA, 64 nt, hsa
aaguaaccaacugaacgacaaagcaugguauuugaauuuuaaauuaaagcaaaguaaauaaaag

SEQ ID NO: 366582 - RNA, 64 nt, hsa
uuuccaauaugcuguauagccuuugucauuuuauaauuuuaauuccugauuaaaacagucugua

SEQ ID NO: 366583 - RNA, 64 nt, hsa
cauuuuauuaagcuuuuuggaaucuuuguaccaaaauuuuaaaaaagggaguuuuugauaguug

SEQ ID NO: 366584 - RNA, 64 nt, hsa
auuccaaauucauggcaugcuuaaauuuuaacuaaauuuuaaagccauucugauuauugaguuc

SEQ ID NO: 366585 - RNA, 64 nt, hsa
aauauauuaaaauuccaaauucauggcaugcuuaaauuuuaacuaaauuuuaaagccauucuga

SEQ ID NO: 366586 - RNA, 64 nt, hsa
uagugaguauagugggguuccaugaguuaucaugaauuuuaaaguaugcauuauuaaauuguaa

SEQ ID NO: 366587 - RNA, 64 nt, hsa
gaacuugacuguaguagaauacugcuaguuucuuaauuuuaauucacaucaccugaaaaguaaa

SEQ ID NO: 366588 - RNA, 64 nt, hsa
gcccaugcaaguccgaaauccagcagggcugucaaauuuuaaaguuccagaauaaucuccuuug

SEQ ID NO: 366589 - RNA, 64 nt, hsa
aaaguugcacuuauaacacccuucaacaaaaucuaauuuuaaauugucuuuuucuuuucuauua

SEQ ID NO: 366590 - RNA, 64 nt, hsa
aaggucugaaaugagaaacauacugacuuuuuaaaauuuuaacaguguacuucuuaggcuuuca

SEQ ID NO: 366591 - RNA, 64 nt, hsa
uguaguagaugcuuccagugucaguaugccuguuaauuuuaagagcuucccuuucuugcagaga

SEQ ID NO: 366592 - RNA, 64 nt, hsa
agaaguagcuuuuuauuccuagugguguacauuuaauuuuaaaaagguugcaauguaucaugcu

SEQ ID NO: 366593 - RNA, 64 nt, hsa
uaauuuguuaaauucuaaacuugaauuucaauaaaauuuuaaagcuaauuguaguuuuugugua

SEQ ID NO: 366594 - RNA, 64 nt, hsa
ucauugagauaagaauaauucagguagcaucugaaauuuuaaugaauguauaauuggcauauca

SEQ ID NO: 366595 - RNA, 64 nt, hsa
uuuuuuucugauaaauucuuucuuugagaaagacaauuuuaauguuuacaacaauaaaccaugu

SEQ ID NO: 366596 - RNA, 64 nt, hsa
auugucaguuaauuuauuauuuuguuugaguaagaauuuuaauauugccauauucuguaguauu

SEQ ID NO: 366597 - RNA, 64 nt, hsa
cacugauuuugaaauacuaagaucagacuuugaaaauuuuaaaaauucuuucauucuuacuuuu

SEQ ID NO: 366598 - RNA, 64 nt, hsa
augcgauacggcaccuggugguugcugauuacagaauuuuaaggcguguguaugacacaguaac

SEQ ID NO: 366599 - RNA, 64 nt, hsa
uaaacuuuuugaacucaguagaaaaacagacugaaauuuuaaagacaugcaguauuuguaucau

SEQ ID NO: 366600 - RNA, 64 nt, hsa
aaaaagugacucucagauugguaaugccagaaaaaauuuuaagaggacucaccaaaaguacuag

SEQ ID NO: 366601 - RNA, 64 nt, hsa
aguaaagaacaacaacaaaauaaagcuguuguuaaauuuuaaacaauauuacuaauugcccaaa

SEQ ID NO: 366602 - RNA, 64 nt, hsa
agagugcagccaaugccuuugugugguaguucuaaauuuuaauugcaccugaaaaaccugggca

SEQ ID NO: 366603 - RNA, 64 nt, hsa
ugaaagaagaauaaauacauauuuuuaauaauguaauuuuaaaaauccuuuauaaucaggacug

SEQ ID NO: 366604 - RNA, 64 nt, hsa
uaaucggcauuaauaccuagacucauauguauggaauuuuaaauucucuuagccuacugauugg

SEQ ID NO: 366605 - RNA, 64 nt, hsa
uuuugugugugcuggagggaggggauuuaauuuuaauuuuaaaauguuuaggaaauuuauacaa

SEQ ID NO: 366606 - RNA, 64 nt, hsa
uuuuuuuuuugugugugcuggagggaggggauuuaauuuuaauuuuaaaauguuuaggaaauuu

SEQ ID NO: 366607 - RNA, 64 nt, hsa
gcccuauucucucagacgguggaauauuuggaaaaauuuuaaaacaauuaaaauuuuaaagcaa

SEQ ID NO: 366608 - RNA, 64 nt, hsa
gguggaauauuuggaaaaauuuuaaaacaauuaaaauuuuaaagcaaucuuggcagacuaaaac

SEQ ID NO: 366609 - RNA, 64 nt, hsa
uauuuuuaauuaggguauaugaauauuuugcaauaauuuuaauaauuauuaagcuguuugaagg

SEQ ID NO: 366610 - RNA, 64 nt, hsa
guggaggauuuuuuuucucauuuuucuaguguuaaauuuuaaccagcauuaacaugguagagug

SEQ ID NO: 366611 - RNA, 64 nt, hsa
accuugaaaugauuauaaaauagauuuucaugggaauuuuaaaaacucuauccaaaacauuuuu

SEQ ID NO: 366612 - RNA, 64 nt, hsa
gccgaaaagccuauuauguaauuuuuacauucauaauuuuaauguggaugaucaggauuaaauc

SEQ ID NO: 366613 - RNA, 64 nt, hsa
uaucuguauuuaaagaugugacaaucuugacaccaauuuuaagaauagcugugagaccgaauua

SEQ ID NO: 366614 - RNA, 64 nt, hsa
guaaagacgucuaaacuuguuugaugugacuuuuaauuuuaaauacggguaacaaucugaggca

SEQ ID NO: 366615 - RNA, 64 nt, hsa
gagcuuuuagucugauuguuuccauuucccauguaauuuuaaguuaagcuaaaguuuuaaagug

SEQ ID NO: 366616 - RNA, 64 nt, hsa
uauacaauggaagcacaauguuauaaggaaagguaauuuuaagcuaacaaccagugcacagccu

SEQ ID NO: 366617 - RNA, 64 nt, hsa
caaaaaaguauaaaucuuuuaaggaaaauguuagaauuuuaaaguuuuuuuuugauuguugaag

SEQ ID NO: 366618 - RNA, 64 nt, hsa
cauagaagggggacuucuaggaauuuauaaccaaaauuuuaaaacuauuuuuauauuuuuuuaa

SEQ ID NO: 366619 - RNA, 64 nt, hsa
uaaaacuauuuuuauauuuuuuuaaaucuuuaaaaauuuuaauuacugugauauugauuauaca

SEQ ID NO: 366620 - RNA, 64 nt, hsa
gggaaaauugcauagcuuuuuguaacauuuacuuaauuuuaaaacuaaacucauacuuuugcua

SEQ ID NO: 366621 - RNA, 64 nt, hsa
uauauuuaacuauauauaaauacgcauauauuguaauuuuaaugucugcuuagcaccccacuga

SEQ ID NO: 366622 - RNA, 64 nt, hsa
ccccacugauaaccaaaucacaguuuauuuaaauaauuuuaaugacuuuucaaaaacaauuuau

SEQ ID NO: 366623 - RNA, 64 nt, hsa
agggcaaagauaagaacaauauuagcuguuacgaaauuuuaacuguaucuuccaaaaugagugg

SEQ ID NO: 366624 - RNA, 64 nt, hsa
ucacaagaguauaaaagaucucuggcuuugcugaaauuuuaagcaagaaguucuauuuaaugga

SEQ ID NO: 366625 - RNA, 64 nt, hsa
gcaggugcaugauacucuucagagcuauuugugaaauuuuaaagacagaagugucucagugaca

SEQ ID NO: 366626 - RNA, 64 nt, hsa
ugcuaauauacauuuugucugugaaaauauaguaaauuuuaaaauacuaauauaaugugguauu

SEQ ID NO: 366627 - RNA, 64 nt, hsa
aaucuaaaauguuuuaauaaucuguauuucuuauaauuuuaacacuaugagcugccuguauaag

SEQ ID NO: 366628 - RNA, 64 nt, hsa
cucuuacguguuuauuuugagucaugagauaaucaauuuuaacccaaagucauuggauuauuua

SEQ ID NO: 366629 - RNA, 64 nt, hsa
uauuucauauacauuguauuaaaacugccauaucaauuuuaauguauagauuuugcaaauauua

SEQ ID NO: 366630 - RNA, 64 nt, hsa
ucaagggcugucauugcacauaagcuuccauuuuaauuuuaaagugcaaaagggccagcguggc

SEQ ID NO: 366631 - RNA, 64 nt, hsa
uaagaauaccacaucaaauaagaaauaaugcuacaauuuuaagaggggagggaagggaaaguuu

SEQ ID NO: 366632 - RNA, 64 nt, hsa
guguuuuaugauaugguuggauguccacugaugaaauuuuaaaggaguuucaguuuuaaaagug

SEQ ID NO: 366633 - RNA, 64 nt, hsa
cgucauauaacucaagaauaaaugguguuuuggaaauuuuaaaauuaucaucgaagguggugaa

SEQ ID NO: 366634 - RNA, 64 nt, hsa
uugaaguacaaaaggaacuaugaaaaccagaacaaauuuuaacaaaaggacaaccacagaggga

SEQ ID NO: 366635 - RNA, 64 nt, hsa
caaaugacaguuucaauuuuuguuuguaaaacuaaauuuuaauuuuaucaucaugaacuagugu

SEQ ID NO: 366636 - RNA, 64 nt, hsa
cuucucuugcuaucuaagaauagugaaaaauaacaauuuuaaauuugaauuuuuuuccuacaaa

SEQ ID NO: 366637 - RNA, 64 nt, hsa
uaauauguaggaugucucaaauuuccaguaaauaaauuuuaaugucccaaaauacccacuaugu

SEQ ID NO: 366638 - RNA, 64 nt, hsa
uugaaucaagaggcucuaggccagauguuuacauaauuuuaaccuauaugauuuuauuuuuaac

SEQ ID NO: 366639 - RNA, 64 nt, hsa
ucaugaagaaauccuuuaucaaucauucaaaaguaauuuuaaguguaacauaacuguguuuacu

SEQ ID NO: 366640 - RNA, 64 nt, hsa
uacagauguguguguuuuucuggagggaggaagaaauuuuaaauuuuuaaaacagcugucaaga

SEQ ID NO: 366641 - RNA, 64 nt, hsa
uuuagauaaccaaguaaguauuauaauacaaaauaauuuuaaguguaagaaacuaaaguauaau

SEQ ID NO: 366642 - RNA, 64 nt, hsa
ugcucccuugacacuuauucuauacuaaaggauaaauuuuaaaaaaucuuuauaggcuacuguc

SEQ ID NO: 366643 - RNA, 64 nt, hsa
aaaaauaaauaaaaauuaaaaaaaucugugcaauaauuuuaaaaugugcucccaggaauagaca

SEQ ID NO: 366644 - RNA, 64 nt, hsa
ugucacuaauuauuuugaggccuuuuaguacuaaaauuuuaaccuguguucuaaguagaaacug

SEQ ID NO: 366645 - RNA, 64 nt, hsa
acuaaguuuuuauaauaaaaugccucagagcuacaauuuuaaaaaaugauuuagcacaagcuaa

SEQ ID NO: 366646 - RNA, 64 nt, hsa
aggucaagcuaaaaaaugaaguaaauguaugaugaauuuuaaguucguauuaguuuauguauau

SEQ ID NO: 366647 - RNA, 64 nt, hsa
aaaacagcuuuuuacaauuaauuuucaaaguuguaauuuuaaagaauuuggguguauaccuaug

SEQ ID NO: 366648 - RNA, 64 nt, hsa
accuuuuauagauguuuuugauuuuguuuuaaauaauuuuaaauuauggagcuugaccuagauu

SEQ ID NO: 366649 - RNA, 64 nt, hsa
ucauugguagcacaaauuugagcgaggccuugucaauuuuaagguggaaauaggaaggaccaca

SEQ ID NO: 366650 - RNA, 64 nt, hsa
gcugugaacagcauuagaacuuugucuauuucuuaauuuuaaaauaugcugauaugccuuaaac

SEQ ID NO: 366651 - RNA, 64 nt, hsa
uuuauugaaaacauugauauauugaauauucauaaauuuuaauuuaacuuucuuuuauaauccu

SEQ ID NO: 366652 - RNA, 64 nt, hsa
uaaaacauguauuagacauucaggcuccacaauaaauuuuaaugagcacuacaaauuuagaaua

SEQ ID NO: 366653 - RNA, 64 nt, hsa
aaauagacaauaagaugucagcaaaagugccucaaauuuuaacugcgucaaguuaagggcauug

SEQ ID NO: 366654 - RNA, 64 nt, hsa
cuuaaugugauagagacaucucuaaaguauuuugaauuuuaaaaaaagauggcagauuuucugc

SEQ ID NO: 366655 - RNA, 64 nt, hsa
uugguguuguucgauugucuuucauugaagagauaauuuuaauguuuuauuggcaacguaugcu

SEQ ID NO: 366656 - RNA, 64 nt, hsa
aaguagaacccaagcaaauaaaauuauuuaaaauaauuuuaaaguggcuuaguacugccaguca

SEQ ID NO: 366657 - RNA, 64 nt, hsa
gggcggggccaaucagucaaugauaaucugaacaaauuuuaagagcagauuuuagauuaauaau

SEQ ID NO: 366658 - RNA, 64 nt, hsa
uaauuaauccaauuaaugacccaaaugccaagguaauuuuaaauuuacauuuuuaauaaaagca

SEQ ID NO: 366659 - RNA, 64 nt, hsa
ggaacauuucuguugauacauguuuuuuaaaaguaauuuuaagagcauuauuagguuaauuaau

SEQ ID NO: 366660 - RNA, 64 nt, hsa
cagaaauuuaccuuuuaauaaauuaaaaaaucuaaauuuuaaccuacuuguauguucggagagu

SEQ ID NO: 366661 - RNA, 64 nt, hsa
cauauucauuuauaaaaaguaccuguaucaaaggaauuuuaacaaagagcaaucaguauuauug

SEQ ID NO: 366662 - RNA, 64 nt, hsa
caggcuuaccuuuuaaaguuuaguauauagagacaauuuuaauggaaauaacuacuguagacua

SEQ ID NO: 366663 - RNA, 64 nt, hsa
cuaucuugacaauggacuuaguacccaugcuuuaaauuuuaaaguauuuagcaaaucguaaaca

SEQ ID NO: 366664 - RNA, 64 nt, hsa
gccauaaucaucuuuucugguuaauaucuugaguaauuuuaaaauguugacaccuuaaucgguc

SEQ ID NO: 366665 - RNA, 64 nt, hsa
uguuuuuguagcacaucuuuucauaacauacugaaauuuuaauguuuuuugccuuuaauaauag

SEQ ID NO: 366666 - RNA, 64 nt, hsa
gucuaucaaauaucuucauuagacaucccacaguaauuuuaagcucaguguuuccaaacgucaa

SEQ ID NO: 366667 - RNA, 64 nt, hsa
ggacaaacauguaaaccuauuuuccuaugaaaaaaauuuuaaaugucccacuugaauaacguaa

SEQ ID NO: 366668 - RNA, 64 nt, hsa
agacaguucuaagcccugucuucugggaguuaucaauuuuaaagagaacuuuugugcaauucaa

SEQ ID NO: 366669 - RNA, 64 nt, hsa
uagaaaaaaaaaaaaaaagaaaaaaagaauguaaaauuuuaaaaauacaguuuaacagcuguaa

SEQ ID NO: 366670 - RNA, 64 nt, hsa
uaaauaaaagcauacuauaguuguaaaaacaaauaauuuuaauaguauauucaguggcugaagu

SEQ ID NO: 366671 - RNA, 64 nt, hsa
cccaguuccacagugggaaauuuugcacacuugaaauuuuaaccaaguggcuagauauuauucc

SEQ ID NO: 366672 - RNA, 64 nt, hsa
aaaucauuuuucaaucuguucccaguuucuaaacaauuuuaaauauuuaugagaagcaaacccu

SEQ ID NO: 366673 - RNA, 64 nt, hsa
caaaggguaaauuauaaauguuucaugaagaaaaaauuuuaaaaaucuacgucuuuauuacaca

SEQ ID NO: 366674 - RNA, 64 nt, hsa
aucugagcuuuuaccacuagacucaaggaagaauaauuuuaacagacauguauacuccauagaa

SEQ ID NO: 366675 - RNA, 64 nt, hsa
gaucagugagacuaugaagagcacugacuuguuaaauuuuaaaagaaccauaaauucuaaggua

SEQ ID NO: 366676 - RNA, 64 nt, hsa
uucuuuucauaaagagaagcuaaacauaaaaaggaauuuuaaauuuaacucuucacauggaaau

SEQ ID NO: 366677 - RNA, 64 nt, hsa
caaaaguacuagaugguguauaacucuagaguugaauuuuaagggauucccuaauauguauacu

SEQ ID NO: 366678 - RNA, 64 nt, hsa
ccauguaaaucuauuguauuauuacacuuguuauaauuuuaacuauaaagguccaauuguuuca

SEQ ID NO: 366679 - RNA, 64 nt, hsa
ugcucccugcacaugaguguaaaaacauguuuguaauuuuaaguaaaauggacugauacccaaa

SEQ ID NO: 366680 - RNA, 64 nt, hsa
aauagagaaaauaauuuuuaaaauaauagauaaaaauuuuaaaaacagccagaaaaaguauaau

SEQ ID NO: 366681 - RNA, 64 nt, hsa
auauuucauacugcccaacaaaacaauaaaaaacaauuuuaaaugcauauuuuuaaauguacac

SEQ ID NO: 366682 - RNA, 64 nt, hsa
auuauggcauuuauauauaguucauuuauauuuaaauuuuaauuccaugaacaaucaaguacca

SEQ ID NO: 366683 - RNA, 64 nt, hsa
ucucagugaacagguuuuaauguuguuuugauguaauuuuaaaagacuuuuagcaaacaugcau

SEQ ID NO: 366684 - RNA, 64 nt, hsa
aauaaugguuauuggggaacuguuuauuauagauaauuuuaagguguauagcuauuuuaaaggg

SEQ ID NO: 366685 - RNA, 64 nt, hsa
auaaagaagcauacuguaauguuuuaugaacugaaauuuuaaucaaaagaggucauuuuagaau

SEQ ID NO: 366686 - RNA, 64 nt, hsa
acaauuuaaaaauuuuaaauuuuaaagaauuaaaaauuuuaaaaauuuaaauuaaaaaaauuaa

SEQ ID NO: 366687 - RNA, 64 nt, hsa
auuacauguaaaacaggacaauuuaaaaauuuuaaauuuuaaagaauuaaaaauuuuaaaaauu

SEQ ID NO: 366688 - RNA, 64 nt, hsa
caaguauauuacauguaaaacaggacaauuuaaaaauuuuaaauuuuaaagaauuaaaaauuuu

SEQ ID NO: 366689 - RNA, 64 nt, hsa
guauuuauaauauaccaaugcuuuuaucaaacagaauuuuaaagagcauaauaaauuauauuaa

SEQ ID NO: 366690 - RNA, 64 nt, hsa
gucaaagagaaaacuuauauacuauuucccuugaaauuuuaaacuauauuuucuuuacagguau

SEQ ID NO: 366691 - RNA, 64 nt, hsa
aaagaaaucagaauuaacauuuuuauguugaauaaauuuuaaaauuuaggaaauguucuauuua

SEQ ID NO: 366692 - RNA, 64 nt, hsa
cuggucacucaaauuuaagaaugucagcaaugucaauuuuaaaugcucauaggucuuuccauau

SEQ ID NO: 366693 - RNA, 64 nt, hsa
uuacaaggaaaaaaggugauauguuuaauuuuaaaauuuuaauuggcuagcucuugcccuuaua

SEQ ID NO: 366694 - RNA, 64 nt, hsa
cagugcuuuuacaaggaaaaaaggugauauguuuaauuuuaaaauuuuaauuggcuagcucuug

SEQ ID NO: 366695 - RNA, 64 nt, hsa
uaauaaacuugugaacuaagaacugagaaggucaaauuuuaauuguaucaaugggcaagacugg

SEQ ID NO: 366696 - RNA, 53 nt, hsa
ccccagacuacuuccuguaaugaaauuuuaaacuuguacaguauugccaugaa

SEQ ID NO: 366697 - RNA, 64 nt, hsa
uuuuuaaaaauaccauauucaagggagucugcugaauuuuaaaacgcagucacugguguuucuu

SEQ ID NO: 366698 - RNA, 64 nt, hsa
uuuuauaaaauugaagcuauagcuuuuaggcuaaaauuuuaacguagauauuuuuauaagauau

SEQ ID NO: 366699 - RNA, 64 nt, hsa
ucauuguaggaauauuuaaguuauuaaguaguuuaauuuuaauggcugaaauuugcaucaacau

SEQ ID NO: 366700 - RNA, 64 nt, hsa
gaggaggaagaagaaaaagugcucagggauuuauaauuuuaaaacaaauaugcacagaaaauaa

SEQ ID NO: 366701 - RNA, 64 nt, hsa
cccugugccugcagccucauagguguuaaucuguaauuuuaaauuuugacaaaagcauuuucac

SEQ ID NO: 366702 - RNA, 64 nt, hsa
uuauauucaguaggaaacugaacucagcacucagaauuuuaaauuaaaucaaugaucuucaagu

SEQ ID NO: 366703 - RNA, 64 nt, hsa
uuuucucucuuuucuccaccucuccuuuauuuuuaauuuuaauuuuaauuuuugaaacaagauc

SEQ ID NO: 366704 - RNA, 64 nt, hsa
cucuuuucuccaccucuccuuuauuuuuaauuuuaauuuuaauuuuugaaacaagaucugacuc

SEQ ID NO: 366705 - RNA, 64 nt, hsa
agaauuauauuagguagaauacacauacaaucaaaauuuuaaaaaaaaaagcuaaauaacuuaa

SEQ ID NO: 366706 - RNA, 64 nt, hsa
ugagagcugguugacugagacgcacgaacuuuuuaauuuuaaauauauuuuuaggaaacucucg

SEQ ID NO: 366707 - RNA, 64 nt, hsa
uuuuuaaaccuuuuuuggcagcucagaugguguaaauuuuaaaauuuuguauagguauuucaua

SEQ ID NO: 366708 - RNA, 64 nt, hsa
aaucaaaguaucacaaaauacugcuucaagauuuaauuuuaaaucugcuaauuuaagggauauu

SEQ ID NO: 366709 - RNA, 64 nt, hsa
gacucaucaacaugugguuggccuuugauuucugaauuuuaaaguuucagacuuaucuuuuccu

SEQ ID NO: 366710 - RNA, 64 nt, hsa
uuguuaauuuguuuuguuaauuuauguuuuuccuaauuuuaagcaucuuuaugaaacaggcaca

SEQ ID NO: 366711 - RNA, 64 nt, hsa
ggagaaagccaacuauguuaaguuuacguguccaaauuuuaaugaaauuuuacuaacaauuuua

SEQ ID NO: 366712 - RNA, 64 nt, hsa
uuacguguccaaauuuuaaugaaauuuuacuaacaauuuuaaaccauauuuuucuucuucauau

SEQ ID NO: 366713 - RNA, 64 nt, hsa
acauugcagguguuuuguauauauacaauggauaaauuuuaagugugugcuaaggcacauggaa

SEQ ID NO: 366714 - RNA, 64 nt, hsa
uuuugguauauauccauuccagcuuaaugccucuaauuuuaaugccaacaaaauugguuguaau

SEQ ID NO: 366715 - RNA, 64 nt, hsa
cuaauuuuaaugccaacaaaauugguuguaaucaaauuuuaaaauaauaauaauuuggcccccc

SEQ ID NO: 366716 - RNA, 64 nt, hsa
auuaucaauuucucauagacacugugcuaaugugaauuuuaaaugaccugcaucaagucuucug

SEQ ID NO: 366717 - RNA, 64 nt, hsa
gugcaguugagaaaacuagaggacugaaaaaacaaauuuuaacuagcaaaugcugugaauuacu

SEQ ID NO: 366718 - RNA, 64 nt, hsa
uuuuaauuaaaaaaucaaggagucuucuaauguaaauuuuaauguuaacuuucaaauccacuag

SEQ ID NO: 366719 - RNA, 64 nt, hsa
cucuuccguuggaaagaacauuuaaaauuaaauaaauuuuaauuaaaaaaucaaggagucuucu

SEQ ID NO: 366720 - RNA, 64 nt, hsa
augaaacauuacaguuagagauuuuuaaauaaagaauuuuaaaacucguuuuuguauucauuua

SEQ ID NO: 366721 - RNA, 64 nt, hsa
auagcauauguuuuuguaaguuuaugcauacaguaauuuuaaguaauuucagaagaaauucugc

SEQ ID NO: 366722 - RNA, 64 nt, hsa
uggcucaauaacuuaaaaacguucauuuaaauaaaauuuuaauacuuguuugacaaauuccaac

SEQ ID NO: 366723 - RNA, 64 nt, hsa
uugcuggacagggugauuuaauuuuuagcuacauaauuuuaagaauuaguauuuucaguggugu

SEQ ID NO: 366724 - RNA, 64 nt, hsa
uuuuuuccauauugguauuuuugaugcugcuuccaauuuuaaaagggaacaaagcugccauaaa

SEQ ID NO: 366725 - RNA, 64 nt, hsa
agaaaccugguaucuauuuguauauaugcuaaauaauuuuaaaauacaagaguuuuugaaauuu

SEQ ID NO: 366726 - RNA, 64 nt, hsa
uucuagaaaauaugaauuaguuuccaaaugccuuaauuuuaaacuuuggccugaacaguuuuuu

SEQ ID NO: 366727 - RNA, 64 nt, hsa
guauaaucagauauaaauauauacuuaauuuuuuaauuuuaaaaauagauaccuguuugacuuu

SEQ ID NO: 366728 - RNA, 64 nt, hsa
cugguugagcucaggcacugucauggacacccuuaauuuuaaaagguuuuaaucauucuucuau

SEQ ID NO: 366729 - RNA, 64 nt, hsa
ccauuaggaguuacuuuauguauuguugaaagcaaauuuuaaacaugauguuuuagaaguguuu

SEQ ID NO: 366730 - RNA, 64 nt, hsa
uuuugacugugcuugauuucaugacugaugcacaaauuuuaaugauuaaaaagugcaggagccc

SEQ ID NO: 366731 - RNA, 64 nt, hsa
acuuaaaaggauuaaaguaacggagauauacacaaauuuuaaaauuaugugugaucacaagacu

SEQ ID NO: 366732 - RNA, 64 nt, hsa
uggcuugugguuaaaugaauauguucaguuuuugaauuuuaauaguaacuccaauucaguaaau

SEQ ID NO: 366733 - RNA, 64 nt, hsa
augugcagaagguuacuaccuaggguuuaugcuuaauuuuaauuggaggaaaugaaugcugauu

SEQ ID NO: 366734 - RNA, 64 nt, hsa
guagcuguaagaauuucccagugaaauaaaaaaaaauuuuaaguguucucggggaugcauagau

SEQ ID NO: 366735 - RNA, 64 nt, hsa
acaagaaagaaagcaggauuuucuccuguaucugaauuuuaaaauuaaaaaggcagauaagaca

SEQ ID NO: 366736 - RNA, 64 nt, hsa
gauuuugcagcacugaaaaucuauuaaagcuccaaauuuuaaguuucuaaauaaucuucgcuga

SEQ ID NO: 366737 - RNA, 64 nt, hsa
uaggagauguauuuuuaucauaguaaaugaucacaauuuuaaauaauucaucuuacaagucagg

SEQ ID NO: 366738 - RNA, 64 nt, hsa
guagguguuucacuauaaggaacagcuaaggaauaauuuuaauaaaagugaaccagaacaaauc

SEQ ID NO: 366739 - RNA, 64 nt, hsa
gauauauauuuguugaauaacagaacgaguguaaaauuuuaacaacggaaaggguuaaauuaac

SEQ ID NO: 366740 - RNA, 64 nt, hsa
aauggagauauuauaggaaaaagaaauccuuuggaauuuuaacuaaaaucacugcauaugggaa

SEQ ID NO: 366741 - RNA, 64 nt, hsa
uggcagauucuaaauaauauaauuuccagauaguaauuuuaagaguacucaucgcucuugccaa

SEQ ID NO: 366742 - RNA, 64 nt, hsa
cuguucugaacuggaauuuuucagcauucuuuagaauuuuaaaugaguagagagcucaacuuuu

SEQ ID NO: 366743 - RNA, 64 nt, hsa
aaguguuacuuuuuguaaacgacaagaauaauucaauuuuaaagacucaagguggucaguaaau

SEQ ID NO: 366744 - RNA, 64 nt, hsa
cacuggaggaagauuuucccuugcuucugcauaaaauuuuaacuccauaacuuauaagcucacu

SEQ ID NO: 366745 - RNA, 64 nt, hsa
ucaggucucuggaucuuauuugcaauucaaaagaaauuuuaaaaaaauccuacuaacaccacca

SEQ ID NO: 366746 - RNA, 64 nt, hsa
aauaaauugguuucucauaacuugcaucaaguuuaauuuuaaguaaagcuuuuuauauguagau

SEQ ID NO: 366747 - RNA, 64 nt, hsa
uucaguaagaaagaugucaacaugcuagaaaauuaauuuuaaaacuaaguuauuccaacacuaa

SEQ ID NO: 366748 - RNA, 64 nt, hsa
agcagagaguacccauucuucgaguucaaagcacaauuuuaaacauguaaaauggauauauaau

SEQ ID NO: 366749 - RNA, 64 nt, hsa
aucuugacaggcuggaccugcaagauguggcuugaauuuuaaccauuuauuacauaaucucuag

SEQ ID NO: 366750 - RNA, 64 nt, hsa
uucuaugaauaaaagaaauuuuuaaaaacuuuaaaauuuuaaauauuagucaaaauacuuuuua

SEQ ID NO: 366751 - RNA, 64 nt, hsa
uaaguccugagugcuuacagguaguuguuaaaaaaauuuuaaggccaggcaugguggcucgcuc

SEQ ID NO: 366752 - RNA, 64 nt, hsa
uguaaacaaugauuucaaaauacuugaaaaauaaaauuuuaacccaaaugaauaacuaagaaau

SEQ ID NO: 366753 - RNA, 64 nt, hsa
uuguauacucucaguucucauucaguauaaauaaaauuuuaaaauccuuucauaguucuauuag

SEQ ID NO: 366754 - RNA, 64 nt, hsa
uagguaauuuggaacauuuacaagccauuuguaaaauuuuaagauaaucuguaacuaauacaua

SEQ ID NO: 366755 - RNA, 64 nt, hsa
ggaaaugcuuaggaucuucagacccaauagcucuaauuuuaacauuucuacccaauaagaggcu

SEQ ID NO: 366756 - RNA, 64 nt, hsa
uagcaaaugugugguaaacauucauauggccauuaauuuuaacauuaaaucguagguagggcaa

SEQ ID NO: 366757 - RNA, 64 nt, hsa
uucaguucauauuuaaugauacuuaaaucgugggaauuuuaauguuuguuccaaaauagcagaa

SEQ ID NO: 366758 - RNA, 64 nt, hsa
cuuccauauaugugguucauuggaaguucuuuguaauuuuaauuccaugaaagucuuaauguuu

SEQ ID NO: 366759 - RNA, 64 nt, hsa
uuauuucuaagcucuuggcaaugacaauaauuauaauuuuaacauaucuucacuguagucaaca

SEQ ID NO: 366760 - RNA, 64 nt, hsa
gaagcuguuaccaguuaucggcucugucaucugaaauuuuaaccacuuaauuuaaaguuacaau

SEQ ID NO: 366761 - RNA, 64 nt, hsa
auuuacuucaguauaaauuaucuuaugaaaaccaaauuuuaaaagccacagguguugauuguua

SEQ ID NO: 366762 - RNA, 64 nt, hsa
accacuuauaucaacuuauuuuucaccagguuaaaauuuuaauuucuacaaaauaacauucuga

SEQ ID NO: 366763 - RNA, 64 nt, hsa
agcuauaacaacucuauuuuuuacuacauaauuaaauuuuaauguaaaauucauagcauccuga

SEQ ID NO: 366764 - RNA, 64 nt, hsa
aagaaagucuaugcuuaggccagucaguacacccaauuuuaaaaaauaacauauucuugcuuuc

SEQ ID NO: 366765 - RNA, 64 nt, hsa
cauugcuaauguggucugaguuuuguuugacaauaauuuuaauguucucaaaauuugaaauguc

SEQ ID NO: 366766 - RNA, 64 nt, hsa
cuaauuaaaaaacaacuuguaaaaaugcaauuuaaauuuuaauacaguacauuuuucuucuaau

SEQ ID NO: 366767 - RNA, 64 nt, hsa
gcagucaguaaagugagcuuuagaaagaaacuggaauuuuaacuucauuuuguaucuugcuuaa

SEQ ID NO: 366768 - RNA, 64 nt, hsa
ucuccauuagaaauauggugcaagccacauauguaauuuuaaauauucuaguagccacauuaau
